United States Patent 9,719,064 (GENOMICS OF ACTINOPLANES UTAHENSIS) - sequence listing, part 2

SEQ ID NO: 2540 - DNA, 1185 bp, Actinoplanes utahensis
gtgttctccgacctggtgggccaggcggagccggtggagacgctgcgccgggcagccggggcggcggcccgggtggtcgccggggagcaggtggccagcggcgcgatgacgcacgcgtggatcttcaccgggccggcgggcgcggggcggtcggtggcggcgcgggcgttcgcggcggcgctgcagtgtgagcgcggcggcagcgggtgcggggagtgtcacgggtgccacaccgtgctgggtcggactcatgccgacgtgcggttcgtggcgccggaggggttgtcgatcggggtcaacgagatgcgcgccctggtgctgcgcgcggcgaccgcgccgtccggtggccgatggcaggtggtggtgatcgaggatgccgaccggctcaccgaggcggccggcaacgcgctgctgaaggcgatcgaggagccgccaccgcggacggtgttcctgctgtgcacgccgtcgacgcatccggacgacatctcggtgacgatccggtcccggtgccgactggtggcgctgcgccagccgccggccgacacggtggccgcggcgctggtcgagcgggacgggatggcaccggacacggcggcctgggcggccgcggcggcacagggggacatcgtccgggcgcggctgctggcggccgatccggaggcgcgggcccggcgggaggcggtgctggcggtgccgaaaaggctgaccggggtgggcgccgcgttcgagatcgcggcgggcctggtggccgcggccaaggcggaggccgccgggagtgtggccgagtccgacgcgagtgagcggtcggcgctggagcaggcgctcggcgcgggcggcaccggccgcggggcggcgggcgcgatgcggggcgcggccggtcagatcaaggacctggagaagaggcagaagtcgcgggccacccgggcgcagcgggacgcgctggaccgggcgctggtcgacctggccgggttctatcgggatgtgctggtcacggcgatgcgggcgccggttgcggtggtgcacggcgatgtcgcgcagcagtccggggcggccgcccggaagtggaccgcggagagcacgctgcggcggctggaggcggtcctggcctgtcgcgatgcgatcaacgcgaacgtgaagccggaaatcgccgtcgaggccatgatgctgaccctctggaaaggctga

SEQ ID NO: 2541 - DNA, 1092 bp, Actinoplanes utahensis
atgagatccactcgtatcgccgtgctcctcgcggtgggcctggtggtggccggctccgcacccctgcgggcggtggcctccccgcgaccctccgccacgtccgcccgatccgtcctttccgcccttgaccccggctcgttgcgggccgctgcccggggcaccggagtgcgcatcggcaccgccgtcgacatgacggcgctcgccgccgacgcgccctaccaggcgacggtcgcgcgcgaattcgacacggtcaccccggagaacgtgatgaagtgggaggccgtcgaaccgcaacccggcgtccacgactgggcggccgccgaccagctcgtcgacttcgcccgtcaccacggccagctcgtccgcgggcacaccctcgtctggcacaaccagaacccgtcctggctgaccgaaagtgcgtacacccccgcgcagctgcgcacgctgctgcggcagcacatcttcgccgaggtcgggcacttcaaaggcaagatctgggcctgggacgtcgcgaacgaggtgttcaacgaggacggcaccctccgtgacaccctgtggctgcgggcactcggacccgactacatcgccgacgcgttccggtgggcgcatcaagccgacccgaaagcaatcctgttcctcaacgactacaacgtcgaagggctcaacgccaagagcgacgcctactacgcactgatcaagaagctgcgcgggcagggcgtcccggtgcagggcttcggcatccagggacatctggccctgcagtacgacctgccgatcaccgcggcggacaacgtacgacgcttcgaccggctcggcgtgaaaaccgcgttcactgaggtcgacgtgcggatgcagctgccggcggacaccgcggaggtggcggggcagagcgagggcttcgggctgctgctgcgggcctgcctgctggccgaacactgcatctcgtacacggtgtggggcttcagcgacaagtactcctgggtgccgggcgtcttcgacggtcaggggtcggcgacgccgatgaccgagaccttcgagccgaagccggcctatcgcaccctgcgggagacgttcctgatcgctcggcgctga

SEQ ID NO: 2542 - DNA, 2277 bp, Actinoplanes utahensis
gtggcgcgctccaggcgctggcgcagggcatcgcggtcagtgagcacaccggcacgctatctcgatcccgaccaacgcgaaagacattcatctctggcttacccgatggtgggaacccccgatgaccagggcgggcggatacagtgctccccgagcagtgaccacggggaggtaggggccatcaacacggaaagccgccaggagaccgcaccggtcgacctcacgggtgcggccgcgctgcgctccgtcctccggatccggccgttccgccgcctctggctggtgctcggcgccgcctcgttcggcgactggatcggcctgctcgccaccggcctgttcgcctccgcccagttcagcaactcggcggcgcagggcgcggcgttcggcggcacgatcgccgtccgcctgctgccggcgctgctgctcggcccgatcgccggggtgttcgccgaccggttcgaccggcgctacacgatggtgatcaccgacctgatccggttcgtgttctacgggtcgatcccgctggtgccgctgctcggcggctcacccgcgctgaccgtcacgtgggccaccatcgccaccttcatcggcgagacgatcaccctgatctggatcccggccaaggaggcggcggtccccaacctgctccaccacaagtcccagatcgaggtgtcgaaccagctgaccctggtcacgacgtacggcatcacgccgatcctgggcgccctgaccctgtccgcgttgaccgccggggtgcagcactccggcgtctcgctgcccgcctgggcgcagccggtccagctcgcgctgtacatgaacgcgctgtcccggctggccaccgcgctcaccgtgttcttcggcatccgggagatcggcggcaagagcgccgaacgccagcaggccgccgagcagagcatgttccaccagttcctggacggctggaaatacatcggtcgcaccccgctggtccgcggcctggtactgggcatcttcggcgcgtttgcggccggcggcgtggtgatcggcgcggcccgcacctacgccacctcgctgggcgccggcgaagccgccttctacctgctcttcggcaccatcttcctgggcctggcggtcggtatcgggctcggtccgatgatcgtcaaggagctctcccggcgccgctggttcggcatgaacatcgtcctggccagcggctcggtgatgttcctcggcctggccttccacctgtccatggccctggtcggtgcgctgctcgtcggcgccggcgccggcatggcgttcctggcgggcaccacgctgctctacggcgaggtcgacgacacggtccgcggccgggtcttcgccgtcgtgcagatcggcgtccggatggtgctgctgctcgccatcaccctggccggcctgctcgtcggcctgggcagctcccgccgggtcaacctgggcccggtgcacttcgacatctcgtccacccgggtgctgctgctggtcgccggcgcgatcgggatctgggtcgggatcgggtcgttccggcagatggacgacaagaagggcgtgccgatcctggccgacctgatcgggtcggtccgcggccggccgctcacgccggccgaggagttcctgcgcagcgggctgttcgtggtcttcgagggcggcgagggggccgggaaatccacccaggtggaccggctggccgacgtgctgcgcgccgaagggcgcgacgtggtggtgacccgggaaccgggagccaccgacctcggcggccggatccgcgggctggtgctcgaccactccgaggacgggccgtcgccgcgggccgaagcgctgctctacgcggcggaccgggcccatcatgtggcgaccgtggtgcggccggcgctggcccggggcgccgtggtgatcagcgaccggtacgtggactcgtcactggcctatcagggggccgggcggacgctgccggtgcaggagatctcctggctgtcctcctgggcgaccggcgggctgaaaccggacctggtggtgctgctcgacgtggacccggcgatcgggctgaagcgggccagtgcgcggggtgcgggcgtggaccggctggagagcgaatcgcaggcgttccacgaccgggtgcggtatgcgttcctcgacctggcggcggcggacccgaagcggtatctggtgctggatgcggcgcggccggccggagatctggcggagatggtggtggatcggatgtcggggctgctcgcgagccggcccgccgccagcccgtcctcctcctccgcttag

SEQ ID NO: 2543 - DNA, 1206 bp, Actinoplanes utahensis
gtgctcactgaccgcgatgccctgcgccagcgcctggagcgcgccaccgaccacctggagaccccggtcgccgcggtggacctggctgccttcgacgacaacgcggaccggctgaccgcccgggcggcgggcaagccgatccgggtggcgagcaagtcggtgcgctgccgggcgctgctggagcgggtgctggcccgccccggctggcacggtgtgatggcttacacactgccggaggcgatctggctggtccggtccggagtgaccgacgacgtgctggtcgcctacccgaccgcgcaccgggccgcgctgcgcgagctggccggcgacgaaagcctggccgccgccatctcgatcatggtggatcacccggcccagctggacctcgtcgaccaggtgaccggtcccggcgaccgcgccaccgtccggctctgcatggatctggacgcctcctggaaaccggccgcggcgctgcacgtcggcgtccgccgttccccggtgcactccgcggtccaggccggcgagctggcccgcacgatcgccgcccggcccgggttccggctggtcgggctgatgtcctacgaggcgcacatcgccggggtcggtgacgatccgccggggcaggcgctccgcgcccgcgccatccggctgatgcagagccgggccttccccgagctgctgcggcgccgggccgcggcggtgcgggccgtccgggaacatgccgatctgcggtacgtcaacggcggcgggaccggcagtgtcgcagcgaccagcgccgacccgtcggtcaccgaggtcaccgccggttcggggctgtacggcccgaccctgttcgacgcctatcgcaactggcggcccaccccggcggcgttcttcgccctgtcggtggtgcgccgtccagctccgcggatcgccaccgtgctgggcggtggctggatcgcctccggcccggccgaaacctcccggctgccccagccgtacctgccggccggcctggcgttcaaggccgacgagggtccgggcgaggtgcagaccccgctgctcggcgaggccgccgaggttctgcgcccgggcgaccgggtgtggttccggcacgccaaggccggcgagatgtgcgagcacgtcaacgaggtgcacctgatcgacggcgaccgcagcacgccggccccgacgtaccggggcgagggtcatgctttcctgggctga

SEQ ID NO: 2544 - DNA, 630 bp, Actinoplanes utahensis
gtgtcgacaccaaccgtcagcaccggaccgctgcggcgggttccggtgcagggcagaagcgttgcccgagttcaacgcatgctcgatgcctgcgccgagctggtggacgaggtgggctatgagggcctgaccacgacgctgctggccgagcgggccgaggtcgccatcggctcggtctaccagttcttcccggacaagcgggccatcgtgcaggccctggcactgcgcaacatggacgcgtatctgcagagcctctccgaccggttcgcgtcggagacgttcgcccactggtgggacgcggtggacgcggccatagacggttacatccacatgcaccgtagcgttcccggtttccgcacgctgcacttcggcgacgtcgtcgacctgcacctgctcgactccgaccgggacaacaacgcggtgatcgccgagcgcctggccgagctgctgaccgaccagttccgcctggtcgaccggaaccgggtgcggttcgcgctgcagatctcggtggaggcggccgacgcgctgatcaagctggccttccggcgcgacccgtccggcgacgaggcggtgctcaccgaggtgaaggcactgatccgggagtacctgcaccggcacgtgcaggcctga

SEQ ID NO: 2545 - DNA, 1299 bp, Actinoplanes utahensis
atgactacacccgtgaacgcccgccggtggacgaactggggacagaatcaggagtcggtcgcggaggtgctcgcgccggcgggtatcgacgaggtggccgccatggtgaccgccgcggcgcaggccgggcgccggatcaagacggtcggcaccgggcactcgttcaccgcgatcgcggtcgccgaggaccagcggatgctgctgcaccggatgaccgatctggtcgcggtcgacgggccgctggtgaccgtgcaggccgggatgccgctgtcggtgctcaacgcggtgctcgcccagcacgggctggccatgccgaacctgggtgacatcgacgtgcagacggtggccggggccatctccacggcgacccacgggaccggcatcgggcacgggacgctcgcctcctgcgtggaggcggtcaccctggtcaccgcggccggcaaggtcgagcggtacgacccgggctctccggagttccccgcggtccgcgccgggctgggcgcgctcggcgtgctggtcgaggtgacactgcgctgcgtgccggcgttcaccctgctggccgacgagaagccgatggcgcttgccgacgtgctggccggggtcgaggagtgggtggacggcaacgaccacgtggagttcttctggtatccgtacaccgaccgggccagcgtgaagatcaacaatcgggtgccggagcacgatcggccgctgtcgcggttccgcggctggctcgacgacgacttcctgtccaacacggtgttccagggcgtctgcaaggtcgggcagcggttcccaggatcggtgcggacgatcagctcgctgaccgcgcgcgcgttgagcgcccggagttacaccgaccgctcggatcgggtgttctgctcgccgcgccgggtcacattcaccgagatggagtacgagatcccgcgcgccgccctgcccgaggtgatcgacgcgctgccccggctgatcgacgcgttgccgttcaaggtgctgttcccggtcgaggtgcggttcaccgggccggacgacgtctggctgtcgcacggctacgggcgggaatccgcctacatcgcggtgcaccagttccggggcagcccgtacgagccgtatttcaaggcgctagaggcgctctgcgagccgctgggcgggcggccgcactggggcaagatgcattatcggtccgcggcggatctgcgacccgcgtacccccgattcgacgatttcctggccgtgcgggaccgcctcgacccggcccgggtcttcaccaacgcgtacctggaccgggtgctcggcgcctga

SEQ ID NO: 2546 - DNA, 2781 bp, Actinoplanes utahensis
gtgccgagtgacgccaggacgacccgtctggtcatcgtcgagtctccgtcgaaggccaagacgatcgccggttatctggggcccgactatctggtcgaggcctccgtcgggcacatccgcgatctgccgaagaacgccgacgaggtcccggccaagtacaagggccagccgtgggcccggctcggcgtcgacgtcgacaacggcttccacgcgctgtacgtggtctccgccggccgtcgggagcaggtcgccaagctgcagcggctggccaaggaggtcgacgagatcttcctcgccaccgatgaggaccgcgagggcgaggcgatcgcctggcacctgatcgaaacgatcaaacccaaggtgccggtcaagcggatggtcttccacgagatcaccaagccggccatccaggcggccgtggccaacccgcgcgacatcgaccgttcgctggtcgacgcgcaggaggcccgccgcatcctggaccggctgtacggctacgaggtcagcccggtcctgtggaaaaaggtgatgcgcggcctgtccgcgggtcgcgtgcagtcggtcgccacccggatcgtggtcgagcgtgagcggcagcggatggcgttccgctccgcggagtactgggacatccaggcgctgctggccgtgcagggtccggtcgacggcccgcgcaacttctccgccacgctgatcgcgctggacggcgaccggatcgccagcggcaaggacttcgagccgaccaccggacagctcaagccgggcgcggccgtggtccagctggacggtgacggcgcccgcgggctggccgcccggctggcggaccgcccgttcacggtcagccgggtcgaggagaagccgtaccgccgccggccgtacgcgccgttcaccacctcgacgctgcagcaggaggcgtcccgcaagctgcggtcctcctcgaaacagacgatgagcaccgcgcagagcctgtacgagaagggctacatcacctatatgcggacggactcggtgaacctctccgagaccgccatcgccgccgcccgccggcagatcgccgagctgtacggggcgaacaacgtgccgccgcagccccggcgctacaccaccaagtcgaagaacgcgcaggaggcgcacgaggcgatccgtcccgccggggacaacttccgcaccccgggcgaggtggccaaggagctgaacaccgccgagttcaagctctacgagctgatctggcggcggaccatcgcctcgcagatgaccgacgcgatcggtaactcgatcagcgtccggatccgcgccgtctccaccgcgaacgaggaggccgacttcgccgcctccggcaagacgatcaccgacccgggcttcctgcgcgcctacgtcgagtcgtccgacgacgagaacgccgaggccgaggacgccgagcgccgcctgccgaacctggtgaaggaccagccgctgaccgccgacgagctgaacgcgctgggccaccacacctcaccgccgccgcggtataccgaggcctcgctggtcaagatgctggaggagctcggcatcggccgcccctccacgtacacctcgatcatgcagaccatccaggaccgcggctatgtggagaagcgcggccaggcgatgatcccgaccttcccggccttcgccgtggtcggcctgctggagaaccactacggccggctggtcgactacaacttcaccgccgccatggaggggcagctcgacgacatcgcgtccggtgaccacaccgccgtcgacttcctcacctctttctacttcggcagccaggccggcggggcggacgaggagatcgccaaggccggcggtctgaagaagatggtgaccgaggatctgagcgccatcgacgcgcgcgaggtcaactcgatcccgctcttcaccgacgaccagaaccggcaggtcgtggtccgggtcggcaagttcgggccgtacctgcagcgcagtaacacccaggtggccgacggggcggaggaggcgtcggaggaccgcgcctcgatcccggagggcgtcgcccccgacgagctgacccgggagaaggtcgaagagctgttcctggccggcaacggcgaccggacgctcggcgacaacccggcgaccggcgagccggtgctggtcaaatccggccgcttcggcccctacgtgcagtccggcgagagcaagtcgtcgctgttccagagccagtcgccgcagaccctcaccctggagcaggcgctgcagctgctgtcgctgccccgggtggtcggcaaggaccccgagggcaacgagatcatcgcccgtaacggcaagttcggcccgttcatccagcggctcaaggactcccgctcgctggagagcgaggagcggctgttcaccgtcaccctggacgaggcgttggcgatgctggccgcgccgaaggtccgcgggcagcgcggggcgcccaaaccgccgctgcgcgacctggagggcgtcgacccggtgtcggagaagccgttgctggtcaaggacggccggttcgggccgtacgtgaccgacggcgagacgaacgtgacgctgcggcgcgggcagacgccggaggagctgaccctgcaggaggcgatcgagatgatcgccgagaagcgggccaaggggccggcaccgaagaaggcacccgccaagaaggccgcacccgcgaagaaggccgcggccaaggccgccacgccggccaagaaggcgacggccaagaaggccgcgccggcgaagaaggccgcaccccgcaaggccgcggcctcctccgagtga

SEQ ID NO: 2547 - DNA, 750 bp, Actinoplanes utahensis
atgacgtcgctgcccgagaccggctggccgctcattccgcgcgagaccctgcccccgccgattccggtggccgggcggcggtccgcgcagcgtggcgcgcccgggcggccggccgggcggcagctgtcgatgttcggcgcggagaccaccgaggcgtcgccggccgacctggccggtctgctggccggtccggggcagttggggcggatgggcggcaccgcccgggtgtcggtggtcgtggacgccgcctggcgggtccacgtgctggtcgccgagctggtcgcgcgcggtctggcgaccacctgggccccggtggaagatcaagatcaagacccgattgacgcggtacgcgacgagcgctccgccgagggggagacttccgacacgccggaggagccgccgccccgtttcgaggtccgcaccgcgtactcccgaaggttgaacgccctcgcgacggcctggcccgcggccgccgcccagctgttcctgtccggcccgcgcctgcggctctgggtggccgccgcgggccacccccacccgggcggctaccgcttgggcctggacccgggcaaggaccccgtcgaggtggacgccgcgctggtccgggccggtctggccggccgggtcaccgaggaccgccgggcctacgtgatcgccggccggcgccgcctgacccggctcaccgagctggtcgggatccggccggaggcggccccgtccgaattgtggcccggcggcgcgggtgcatga

SEQ ID NO: 2548 - DNA, 531 bp, Actinoplanes utahensis
atgcgcgcggtccgaacgatctctctcgctctcgtcctcgtgctgggcccgccgctggccgcctgctcctccgggcacggcgccgaggcctgggcggctgccgtgtgcggcacactgcgcccgtggcgcagcgagatcagcagcctgaccagccgcacccagcagcagatgaccacccgcaccacgcccggtcaggcgaaggagaatctggcccggctcttcgacggcgcgcggtcggcgagcgagacggcgcgggccggggtggagcgcgccggtgtgcccgatgtcaccgacggcaagaagatcgctgacgcgttcgtcggctcgctggccggcatgcgcgacgcctacggttcggcccacgacggcatccaggcgctggccaccgcgccgtcggccagcttctacaccgaggtcggcaaggtcgtcgacaggctcaacagtgagtacgagcagagcggcctggacacctcgaaactcgactcggtcgagctgagacgggccttcgagtcgctgcccgagtgccaatga

SEQ ID NO: 2549 - DNA, 2424 bp, Actinoplanes utahensis
atgtccgggacctcgatagacctcgccgccgggggcggcggagtgtccctcagcggatccaacgtcgtattcgtcatcgtcgctctggtgttcgccctgatcgcgctgggcttcgccgcgatgttcgtccagtcggtgctgcgcaccggccggggcaccaagaacatgcaggagatcgccggcgccgtgcaggaaggcgcctcggcctatctcttccggcagttcaagacgctcgccgtgttcgtggtgatcgcggtcgtgctgctgttcctgttgccggtgcacgacaccgacaacgagacctgggtgaagatcggcaggtcgctcttcttcgtggtgggcgcggtcttcagctcgttcatcggcggcgccgggatggctctggcgacccgggccaacctgcgggtggccgcggccgccggggagccgggcggccgggagacggcgatgggcatcgccttccgcaccggtggtgtggtcggcttcctgaccgtgggcctgggcctgttcggcggcgcgctggtggtgctgatcttccgcagcgacgccccgaccgtgctggagggcttcggcttcggcgccgccctgctcgcgatgttcatgcgggtcggtggcggcatcttcaccaaggccgcggacgtcggcgccgacctggtcggcaaggtggagaagaacattccggaggacgacccgcgcaacgccgcgacgatcgccgacaacgtcggcgacaacgtcggtgactgcgccggcatggccgccgacctgttcgagtcgtacgcggtgaccctggtcgccgcgctgatcctgggccaggccgcgttcggtcaggacggcctgatcttcccgctgatcgtgtccacgatcggtgtggtgatcgccatcctgggggtgttcatcacccggctgcgcccgtccgaccgcaacggcctgaccgcgatcaaccgggcgttctacctgtccgcggtggtgtcggcggtcgccgtggcggtggtcaccttcctgtacctgccggattcgttcgccgggttcggggatgccgggatcgcgaaggacatcgtggacagcggccgcaacccgcagtgggtggcgatcggcgcggtcgtgatcggcatcgtgctggccgccgccatccaggcgctgaccggctacttcaccgagaccaacaagcgtccggtgcaggacatcggcaagtcgtcgcagaccggcgcggccaccgtggtgctggccgggatcagcgtcggcctggagtcggcggtctactcggcgctgctgatcggcgccgccgtgtacggcgccttcctgctcggcggctcgtcgctgaccctgtcgctgttcgccgtggcgctggccggcaccggcctgctcaccacggtcggcgtgatcgtggcgatggacacgttcggtccgatctcggacaacgcgcaggggatcgccgagatgtccggtgacgtcgacgagaccggagcgcagatcctgaccgagctcgacgcggtgggcaacaccaccaaggcgatcaccaagggcatcgcgatcgcgaccgcggtgctggccgccacggcgctgttcggctcgtacaccaacagcctggtcagctcgctgaccgatgccaaggtcgccgacgtgcaggggcagatctaccagctgctgaacatcgcgaacccgcgcagcctggtcggcctgctgatcggcgcggcggtggtgttcctcttctccggcctggcgatcaacgcggtgtcccgctcggcgggcgcggtggtcatggaagtgcggcggcagttccgcgagttccccgggatcatggaccgcacccagcggcccgagtacggccgggtggtggacatctgcacccgggacgcgcagcgcgagctgctcacccccggtctgctggcgatcaccgcgccgatcgcggtgggcttcgggctgggcgccggcgcgctggccgcctatctggccggtgcgatcggcaccggcacgctgatggcggtcttcctggccaactccggtggcgcctgggacaacgcgaagaagctggtcgaggacggcgcgcacggcggcaagggctccgaggcgcacgccgccacggtgatcggtgacacggtcggtgacccgttcaaggacaccgccggcccggcgatcaacccgctgatcaaggtgatgaacttggtctcgctgctgatcgcgccggccgtggtgacctggagcgtcggcgccgacgcgaacaccccgctgcgcgtgatcgtggcgctgatcgcggtggccctggtcaccggtgcggtggtgtggagcaagcggaagtcgatcgcgatgggcgacgagccggccggggcgaccgcggtcggcgccgcggacaccgccaaggcggtgcaggacgcgcagcacagcgacgcggccgcgcagtcgcggatcaaggacaacgtgggctga

SEQ ID NO: 2550 - DNA, 438 bp, Actinoplanes utahensis
atggctacggttcggctgtccttctcgccggcgccggtgcacgttcgcaccgcccggctcgtcggcgtggcggtcgcccgccgggcgggtgtcgacgaggcactgctcgacgaggtgcgcctggcgatcggcgaagcctgcacccgtgcggtcgcgctgcaccggcaatacgggctggctgacctggtcacggtggagatgtccgactccgggtcgtacacggtgcgggtcatcgaccacgccccgatcgaggccagcatcggtctcaccaaactgccgccggacgaactggccgccgagtcgctcaccgaggacgacctgacgaccggggtgggcttcgccctgctcgccggttttgtcgacgacctgcaggtgcgcccggtcgaggacggcgccggcaccgaggtccgcatggtctggccggtcacccgccgctga

SEQ ID NO: 2551 - DNA, 357 bp, Actinoplanes utahensis
atggagctgtcgctggcgacccggaccgttgccgggcacacggtgctcgaggtcggtggtgaggtcgacgtttacaccgctccacggctgcgcgagcgcctgatcgagctggtcgacgccggcgcccgggacgtggtggtcgatctggaacgggtcgagttcctcgattccaccggactcggcgtgctggtcggtgcgttgaagaggctgcggaccgcgcagggcaccttcggcctggtctgcgccaaggagccacttctcaagattttccggatcaccgcgctggaccaggtcttcccgatctattcgacggtcgaggccgcgaccgaacgcaacggcagcggtcccgcttcgtga

SEQ ID NO: 2552 - DNA, 2562 bp, Actinoplanes utahensis
gtgcttggcgtgactgccaccgcctccggtcccgccgagctcctgcaccgcctccgggcccgggccggcaacgccgggcagtccccgatcacccacgtcgagcgggtcccggcccgcaccggcaggcccgcgccgtggccgtcctggacccaccccgaggtgcgtgaagccttcgcgcgccagggcatcaccgcgccgtggcagcaccaggcggacgccgccggcctcgccttcgagggcacccatgtggtgctggccaccggcaccgcctccggcaagtcgctggcctaccagctgccggcactgaccgctctcaccaccgatccgaaggcgaccgtcctctacctggcccccaccaaggcgctcgcggccgaccagctccgcaaactgacccgcctcggcctggccgacatccgcccggccgccctggacggcgacgtgccccgcgaggagcgcgagtggatccgccagcacgcccgtttcctgctcaccaacccggacatgctgcaccactcgctgctccccggccactcccggtgggccacgttcttccgccgcctgacctacgtcgtcatcgacgaatgccacgcctaccggggcgtcttcggttcgcatgtggcccacgtcctgcgccgcctgcgccgcaccaccgcccgttacggcggctcccccacgttcatcctggcctccgccacgtccggcgacccggccggcagcacctcccgcctgctcggcaccccggtgaccgcggtaaccgaagacgcctccccccgcggcgcggtcaccttcgccctgtgggagccgccgctgctccccccggagcccgccactcccaccttcgtgcccccgccgacgattcccgtcccggcccagcccaccgccccggccgttgccccggcccggcccaccgccgcggcccggcacaccgactcctcccggcccaccgccgcggcccggcccaccgactcctcccggctcgccgccgcggcccggcccaccgagccgctcacccccgcggcgctgtctccgctggccgttccgcctcccgaggccgatttcgacgaactggatctgccgccggtgcgacggtcggcgctgcgggagaccgcggatctgctcaccgacgccgtcatcgccggcacccggacgctggctttcgtccggtcccggcgcggcgccgaggtggtcgccgcggtggcccgtcgttccctggacgaggtggttcccggcctgggttcccgggtcgccgcctaccgcggtggctacctgcgggaggaccgccgtgccatcgaacgcgccctactcgccggcgacctgctcggtctcgcctccaccaacgccttggagctcggcgtcgacctggccggcctggacgcggtcctgatctgcggctggcccggcacccgggcttcgctgtggcagcaggccgggcgcgcgggccgggccggcggtgcggccctggccgtcctgatcgcccgcgacgatccgctggacacctacctggtgcaccatccggaggccctgttcggccatccggtcgaagcgaccgtcctggacccggccaacccgtacgtcctgggcccgcaactctgctgcgccgcctccgaagccccgctgaccgagaaggacctgccccttttcggccccgccacccgcccggtgatcgatcagctggtcgccgagggcgccctccgccgccgcccgtccggctggtactggaccgaacgcggccgccccgacgtggacctgcgcggctcgggcggcgccccggtccaggtggtcgaagccgccaccggccgcctgctcggcaccgtcgaccagggctcctcccacgtgatgctccacgagggcgcggtccacctgcaccagggcaccacctacgtggtcgacgagctggacctggaggacgcgaccgccctggtccaccaggaggacccggactggagcacgcacgcccgcgacgtcaccgacgtgtcggtggtccgggtgttctcctacgccgacgccggcccggtcggcctgttcctcggcgaggtcgacgtgaccagccaggtcgtctcctaccagcgccgccgcctgggcagtggcgaggtgatcgacatccgcccgctggatctgccggtccgcgagctgcgcaccgtcgccgtctggttcaccgtttccccgcaggccctggccgccgccggcatcgagccgaacgacgtccccggcgcgctgcacgccgccgagcacgcggctatcggcctgctcccgctgatggccacctgcgatcgctgggacatcggtggcctgtccaccgccaaccacccggacaccgaggcccccaccgtcttcgtctacgacggccacccgggcggtgccggtttcgccgaacgcgcccacgccaccgccgccgcctggctcaccgccacccgcgaagccatcgccgcctgtgcctgtgactccggctgcccgtcctgcgtccagtccccgaagtgcggaaacggcaacaaccccctttccaagcccggcgcgctcaaagtcctcgacaccgtcctcgccgccctccccgaaaccccctga

SEQ ID NO: 2553 - DNA, 654 bp, Actinoplanes utahensis
ttgaagcgtgacccgaggcgcggcatccggccgcttctcccgactcaggaggattcttttgcatcgattcgtcatgacgttccggcggctgcgcatggaggcggtcgacgccggatacagcaccgtggagtacgcggtgggggttctcggggcggccggcctcgcactgctcctgtgcaaggtgctgaccagcacgtcgatccagagcgcactgaacaccatgattcttcgggcgctgaagtgatcgggcgccggcgggccggccggggacgggacgggcatcggcgcgcaggacgcgggcccggccgggatcggggtgcgttcacggtggagctcgcggccgggctgccggcgctggtggtgctgatgttcgccgggatcacggcggtgaccgcggtggtcaccaaggcgcaatgcctggatgccgcccgggaggccgctctggccgaggcgcggggcgagcattcggtttcggcggcccggacggctccggacggggctgacatccgggtggtcggagatcgggacagcgtcacggcgacggtgaccgtgcgggttcgtgtgctcggcgcccggctgcccgggatccgggtggtgggctccgcggtcgccgcccgggaacccggcccgcagcccatcgaaggtcgacgttga

SEQ ID NO: 2554 - DNA, 1005 bp, Actinoplanes utahensis
atgtggagagccggcggtgtgcggggcgtcggcggtgctgcggccgggtgggccggttcgggtgccgctgcgcgagtgttgcgtcgcggcgctgctcggggcgggcggttcaggcagcgcctgtcgagcggctgtcccggtgcgccgggggagccgggtcgtgcccgctccgcggcggacccgagccgctcggcgcgatcagcgggcccggtcggttcgggccggccggactctccgggtggttcggatggtccggtggagagcttcgccgtcggcagcgggccatccgatggaggtgggcacatgagccggtgggggcgggccggacgccggctggggcgattgcgatcggcagggctttccgatgcggcccggtcgaggtcgccggatgtggctgccgacccggtgccggcgcggcgacggcatgccttgctcgggttgctcgccggtgcctcggccgccggtctggtcggcggctggtggggcctgccggtcgggttggtgaccgcgatcggcgtggaacgcgcgctgcggaaccaggaaccggccgacgtccggcgggaacgtcaccaggcgggtgcggacctgccactcggcgtggacctgttggccgcggcgttgcgggccggcgcgccggtggaccgggccgcagccgcggtcgccgacgcggtgggcgggccgctcggtgcgcgcatgcaacggaccgcccggtcgctgcgactcggtgccgggccggccgaagcgtgggcgcacctggccggcctgcccggcgcggaccggctgaccgcgacggcgatccggtccagcgccagcggcggggcgctcgccgcagcgctcgaacggctcgccggtgatctgcgggccgaccgtgcggtggcgacgcaggcggcggcggaacgcgcggcggtgttcatcgtcctgccgctcggactgtgttttctgcccgccttcctgctggccggcctggtgccggtgctgatcgccgtgctcggccggttgctgtga

SEQ ID NO: 2555 - DNA, 720 bp, Actinoplanes utahensis
atgatcgcggtgctggtggcctgcctgctcggctgcgcggtggtgatcgcctggccacgagccgggacgctggcccggctctccgggcggtcacccggactccggctgcctcggccgcggctgccggaacccgaccggcgcggggcggccgctctcgccggagcgacggcactggtcgcgctggtggccggcgggccggtcgcggccgtcggcggggcggtctacgcggggatcggcggggccgcatgggtgcgccggactcggcagaagcgggccgcggccggccgtctggcggcgctggacgcgctgtcgtccctggtggcggatctgcgggccgggttgccgccggggttcggcgtgccgtcgaccgggctggacggcgacgagcggatcgcgcggctcagcgccacggtgtggcgtctcgccgagcgcaccggggcgcccgcggccgatctgctggagcggatcgaggcggacgcgcgggccgcggaccgggcacgcgcgtcggccgccgcccaggcggcgggggtgcaggcgacatccctgctgctggcggtgcttccggtgggtggcctcggcctcgggtacgcgatcggtgccgactcgctgcacatcctgctgcgtacgcggttgggggcggtctgcgcgatcggagcgctggcgttgcagctcgccggactgcagtgggcgcggcggatcgcgaacgggccgcgccgatga

SEQ ID NO: 2556 - DNA, 1974 bp, Actinoplanes utahensis
gtggcccacagcggaatccctcggcgccgagcacgtcgcggcgctgcccgaggccgagccgtggctgatcgagcaactcgccacccggccccggccgcccgccgtctcccgcaccctcgccgtgatcggcggccgcggcggcgccggggccagcatcctcgccgccggactcgccgggaccgcggtcgccgcgggccgccgcaccctgctgatcgacgccgacccactcggcggcggcctcgacctggtgctcggctgggagcaggtcagcggcctgcgctggcccgggctcgccggggccggcggccgggtcgacccgccggccctgctcaacgcactgccacaccgcggcgacctggtgctgctctccttcgaccgggaccagatgaccggggtgccggccgaggcgatggccgccaccctggacgccgcccggcgcggtcgcgacgtgatcgtcgccgacctaccccggcaactcgacgacgccgcggcgctggccctgcaggccgccgaccggaccctgctggtggtccccgccgagctgcgggccacagcggccgcggcacggaccctggcccagatccggccgcactgcgagcaggtctcggtcgtggtgcgcgggcccgcccccgggcgactgcggccccgcgacatcgcgcagacgctcggtctgcccctggccggggcgctgcggcccgacccggcgatgtgccaggacctcgaacgcgggacagcgccggccacgagcgggaaagggccgctcgccgagctctgccggcggctggtcgacgaactgatgcggccgccggcggtggcggcatgagcgtggtcgaccgggtgcggcggcagctcgcctacgacggggtggaagccaccccggcggccgtggtgagcgcggtgcgccgggacggtgaggtcctcggtgaccacgccgtgctgcgcctcgccgaccgggtgcgcgaccagatgatcggggccggtccgctcgcgccgctgctcagcgacccgctggtcaccgacgtgctggtgaacggcgtgcaggtctgggtcgaccggggcgccgggttgcagcgggccgcggtgcggctcggcgatccggaggacgtgcggcggcttgcccagcggctggtcgcggcctgcgggcggcggctcgacgacggccagccgtacgcggacgcgcggctgcccgacggcacccgcctgcacgccgtgctgcccccggtcgccacccacgggccgtacctttcgctgcggaccttccggcagcgcccgttcagcctcggcgacctggtcacccacgcgacggtgccggccgcggccgcgccactgctcgaagctgtcgtcgccgccgggctggcctacctggtcaccggcggcaccggcagcggcaagaccactctgctcgccaccctgctcgggctggtcccgccgaccgagcggatcgtgctggtcgaggacgcggccgagctgcgcccggtgcacccgcacgtggtggcgttgcaggcccgcacggcgaatgtggagggcgccggcgcgatcgggctgaccgacctggtgcggcaggcgctgcggatgcgccccgaccggctggtcatcggggagtgccgtggccccgagatcgtcgacctgctcggggcgctgaacaccgggcacgacggcggcgcgggaacactgcacgccaacgccccgggcgacgtaccggcccggctggaagcgcttgggctgctcggcgggctgccccgggccgcgctgcacgcgcaggtgctggccgccctgcaggtggtgttgcacctccggcgggtcggtggcgcacggctgctggaatcgatcggcatcctggtgcccgccgggaccgaacggctcacctccgtggtgaccgcctgggaccggaccaccggccccgggcccggtccgttcgcgcggatgctgcgggcccgcgggatcaccgctccaccggtgccggcggcgtcatga

SEQ ID NO: 2557 - DNA, 360 bp, Actinoplanes utahensis
atggagagctcgatccggaccacgctcgcggacgacggcacggtcacgatcacagtgttcggagagatcgacttctccaatgccgacgaggttgccgacggcatccggcacgcggtcgccgactggtcaccgccgctggtccagatcgacctgcgggatgcgtcgttcatcgactcgaccggcctcggcgcactgatcgacggctaccgaaccgccacggagagcaacgttcgatacctggtgatcaacgccagccccactttccggcgcgttctcaccgtgaccgggctcagcggtttcttcggggtcacggacagcttcgaggagagcgccggccaggcgcacgcgaccggcgcctga

SEQ ID NO: 2558 - DNA, 801 bp, Actinoplanes utahensis
gtgggccccagcgccgcgtttttcgacctcgacaagaccgtcatcgccaagtccagcgcactggccttcggacggccgttctatcgggatggcctgatcacccgccgtgacgtggtgaaatccgcctatgcccagctgatgttccggctcggcggcggcaccgacgagcaggcgatggcccgcacccgtgactatctggccacgctctgcaagggctggcggatcgagcaggtgcaacagattgtcgcggagaccctcaacgagctgatcaatccgtacgtctacgccgaggccgccgcgctcatcgccgagcaccaggcggccggccgtgacgtggtgctcgtctcggcgtccggcgacgagatggtccgtccgatcggcgagctgctcggcatctccgacgtgatcgccacccggatggccatcgtcgacgggcgatacagcggcgacgtcgagttctacgcggccggcccggccaaggtcgtcggcatccgtgcgctggccgccacccgcggctacgacctcggccagtgcttcgcctattcggattccagcagtgacctgccgatgctcgaagcggtcggccaccccagcgtcgtgaacccggaccgcgccctgcgccgcgtcgccgccgaacgctcctggccggtgctggagttccgccacccgatcgccctcggcaaacgcctccgcgaccgcccggccgtcccggtcgccgccgccctcggcgtcggcgtcggcgtcgccatcggcttcgccctctacggccgccaccgccgcgcccgagccgccgcggcctga

SEQ ID NO: 2559 - DNA, 423 bp, Actinoplanes utahensis
ttgtcgacggtccagcagcctggtggcgatgatccccatgaaggcggaagcaccacctgtggcggaggtcccgtcgcaacgtgcctgccgtggctgatcgcgcgtgggttcccggtggccgtgcacgagacccgatcatcgaccgtccagcagatcggccatccagtgatcctggacgcccggaaagccggtgactccgactgccggtggtgccgatttctcgttggccccgcgactcctttctacgccgctcccggcatgatcgccaggtatcgggccagcaaatctggtgatcatcgattactcagaccgaagacatccgcgctggtcatcgcattgcagcagcttccgggggacgccggggcggtgccggtacacgatcccattcaagatcaaattcatgatgtcgtatgtccgcgctga

SEQ ID NO: 2560 - DNA, 456 bp, Actinoplanes utahensis
gtgcgtccctacgaccccggcaccggccggtggctggtcatcgcctgggaggcgttcgccctgacgatgctgacctgggccagcgtccggcagttcgacctgatgggccacggcgtgcgggtggtcgcctgcctgctcgccgcggtctgggtgatcggcgcctggcggatcctgcaactcggcgtctacgtcagcccggacggcgtgctcgtccgcggcctgctgcgctcccggatgctgcgctggcgggacatcgccggggtccggttgcaccgcgcgacccatcggctcgggccgtgggagatcgagggcggcaacacggtcctgctggagcggctggacggggcgacgatcaacaccgagttgtgggagcggggggtcgacttccactcgcggcccaaggtcttccgcgccgtctaccaggagatccgccaccgtcaccaggcggcgcgatag

SEQ ID NO: 2561 - DNA, 813 bp, Actinoplanes utahensis
ttggtactgcgcgaatcttgccagttccactcgtatttgtgcaccccgcgtttccgcggttttaccggttaccgtgtgcaggtggatccactagctcccctgctcgatctcgctgacgtcgctccggccctggccgcggcccgggacagcgtcgacaccgccatgcggcaccgggccctgcggcggcacggcggccaggtcgccgccgaggccagcctgcgcgccgcggtcgccagcgccgccctggaaggcaacgtccacgacctcgacgacgtgcgggccggcacgatcaccgacccggtcgtgcagggcgccctgcgggtcgccgagggcctcggcggcctggtcgacctctggccccgtgctccccgccaggtccttgccaagcttcacgtgctcgccgcccgcggcgtcgtcccggccgacgagctgggccggctcaccggcggcgccgaacgcatcgacgccctcgccggcctggtcgccggcaacgaggagaccccgccgctgctgctcgccgcgatcgtgcacgccgagctgatcaccctgcgcccgttcgccggcccggccggcgtcgtcgcccgcgccgccgcccggctcaccctgatcggccgcggcttcgacccgcgcggcctggtcggcgtcgaaaccggccacctcgcccgcgaacccgaatacgtcggctcggccggcgcctacgccaccggcaccccggacggcgtccgctcctggctgcgccactacgccgcggcgatcaccgccggcgccgaggagatcaccgccatcggcgactcggtattggcatccgtctga

SEQ ID NO: 2562 - DNA, 1986 bp, Actinoplanes utahensis
atgagcgagacactggagaatttgtactcggagacgcggcagttcccgccgcccgccgacctcgcggccggcgccaacgtcaaggccgaggcgtacgaggaggcggctgccgaccggctcgcctactgggagcgccaggccgagcgtctgacctgggcgaagccgtgggatcaggtgctggactggtcccacccgccgttcgccaagtggttcgtcggcggcgagctgaacgtggcgtacaactgcgtcgaccggcacgtcgaggccggccacggcgacaaggtcgccatccactgggagggcgagccgggcgatacccgcacggtgacgtacgccgagctgctgaagctggtctcgcaggcggccaacacgctgaccgagctgggcgtgcgcgccggcgaccgggtcgccatctacctgccgatgatccccgaggccgcggtggcgatgctcgcctgcgcccggatcggcgccacgcacagcgtggtcttcggcggcttctcggtggaggcgctcgccacccggatccaggacgccgacgccaaggtcgtgatcaccgccgacggtggctaccggcgcggcaagccgtccgcgctgaagccgaccgtcgacgaggcggtggcccgctgcgcgagcatcgagcacgtgctggtggtccgccgcaccgggcaggaggtcgcctggacggccaaggacaagtggtggcacgaaacggtcgagaatgccggctcggagcacgtggcgcagccgttcgacgccgagcacccgctcttcatcctttacacctcgggcacgaccggtaagccgaagggcatcctgcacaccacgggcggatacctgacgcagacgtcgtacacccatgatgcggtcttcgacctgaagccggagtcggacgtctactggtgcaccgccgacatcggctgggtcaccgggcactcctacatcgtgtacgggccgctctccaacggtgccacccaggtgatgtacgagggcaccccggacaccccggaccgcggccggttctggcagatcgtcgacaagtacaaggtgtccatcctgtacaccgcgcccacgctgatccgcaccatgatgaagtggggcgacgacatcccggcgaagtacgacctgtcctcgctgcgcgtgctgggcagcgtcggcgagccgatcaaccccgaggcctggatgtggtaccgggagcacgtcggccacgagcgcaccccggtggtcgacacctggtggcagaccgagaccggcgccgtgatgatctccccgctgccgggggtgaccgcggccaagcccggttcggcgatgaccgccctgcccgggatcagcgccgacgtggtcgacgacaccgcgaccccggtgccgaacggcggcggtggcttcctggtgctgaccgagccgtggccgtcgatgctgcgcaccatctggggcgacgaccagcggttcatcgacacgtactggtcccggttcggcgcgggcgccggcaacggcgacaagtggatctacttcgccggtgacggggcgaagaaggacgaggacggcgcgctctggctgctcggccgggtcgacgacgtgatgctggtgtccgggcacaacatctccaccaccgaggtggagtcggcgctggtctcgcacccgtcggtggccgaggccgcggtggtcggcgccaccgacccgacgaccggccaggcgatcgtggcgttcgccatcccgcgcggtcacgtggcgaccgagggcgccgccggccaggagctcatccaggagctgcgcaaccacgtggccaagacgctcgggccgatcgccaagccccgccagatcatgctggtcgcggagctgccgaagacccggtccggcaagatcatgcgccgcctgctgcgcgacgtggcggagaaccgctcgctcggcgacgtcaccaccctgcaggactcgacggtgatggacctgatcagctccggcatgaagtcgtccacatcggaggactga

SEQ ID NO: 2563 - DNA, 2424 bp, Actinoplanes utahensis
gtgcgcaaggtggtcgcaggactgctcggcgccgcgatggtcaccagtgtcggggcgtctttcccggccacggccttcgcggcgcccccggttgacaccgccccgtcgacctcggccgacaccgtgaacgtcgacgacctgccgcagccgctcgaggccaagcgccgcgagctgcgccagcaggcggtcgccgacgtgatcagcggcaaggccaagatcgagaaccggcacggcagccaggtggtcaacctgggccgagcgccgagtggccggggcccgctgggccacatcgggcagaaccagtacgtcgagctgggcaacgagcgcaccgaccggatcttcgtgatcctcgccgagttcggtgaccagcgggatccggcctacccggacaaggacaccgacccgaccacggccggcccgacgacgttcagcggcccgctgcacaaccagatcccacagccggaccgcaaggtcgacaactcgacgatctggcagtcggactactcggcggaccacttccgccagatgtacttcggcaccggcgccggcgccgagtcgctcaagacctacttcgagacccagtcgtccggccggtacagcgtcggcggcgaggtcaccgactgggtgaaggtgccctacaacgaggcgcggtacggccgctccaacgacccggtcaaggacgaggacaccaccaacccggccaacgacccggccgtctgccactccagcacctgcaacaacacctgggcactcgtccgggacgccgcgaacgcgtgggtcgccgaccagaagaaggccggccgcacggacgcgcagatcgccgaggacatgaagtcgttcgaccagtacgaccggtacgactacgacggtgacggcaacttcaacgagccggacggctacatcgaccacttccagatcgtgcacgccggcggtgaccaggccgacggtgacccgcagcagggtgaggacgcgatctggagccaccggtggtacgcctacggcaccgacgtcggctccaccggcccggccaccaaccggctcggcggcaccgagatcggcaacaccggcatctggatcggtgactacaccatccagccggagaacggtggcctcagcgtcttcacgcacgagtacacccacgacctcggtctgccggacgactacaacaccgacggcgaccacccgggcgacaacccgaacgagtactggacgctgatggcgcagagccgcctcaacggccggcacgaccagggcatcggcaaccggccgggcgacctcggcgcctggaacaagctgcagctgggctggctgaactacgagaaggtggacgccgggcagaagaaggtcgtcaacctcggcccggaggagtacaacaccaagaagaagcaggctgtggtggtcaacctgccggagaaaccggtctcctacgacatgggtgcgccggccgccggcaccaagcagttctactccggcaacgccgacaacctgaacacctcgatgaccacgacggtggacctcaccgggaagaccaccgccgcgctcagcctcaagggccggtacaacatcgagaccggatacgactaccagttcttcgaggcgtccgcggacggcggcaccacctggaccaaactcgacggcaccgtgggtgacaagccgttcccccgggacgccggcggcaacccgggcctgaccggcaacggtggaaagagctggtcggacatcacggtgccgctcaccgcgtacgccgggaagaagatctcgctgcggctgcggtacgtcagcgacagcgggaccaacaagggtggtttcttcggtgacgagatcaccgtgtcggccgacggcgcgacgctgagcacggacggcgctgagggcaacggcgtgtggaccctggccgggttcaccgtcatcgggtccaccgtcgtgcagaactacccgaactactacatcgccggttaccgcagctacacctcgtacgacaagtacctggccaccggcccgtacaacttcgggttcgccgacaagccggactgggtggagcactacaactaccagaccggcctgctcatctcgtattgggacacctcgcaggccgacaacaacacgccggcccacccggggtcgggccgcaacctctacatcgacgcgcacccgaagccgttcctggctccggacggcaagccgtggcgcgtccgcgtgcagatctacgacgcgccgttcgggctgtacccgaccgacggcatgctgctgcaccaggccggcaagccctcgctgatcacgccgcagtggggccggacggtcttcaacgacaaggacaagtactactacgacgagctgcccaaccagggcgtcaagctccccgcggtcggcgtcaagatcaaggtcttgagccagctcggtacgtcgatgaccgtggccgtctcctga

SEQ ID NO: 2564 - DNA, 381 bp, Actinoplanes utahensis
atgcgcagtcacctggtccgggccgggctcgccgtgatcacgggggcgctggtcgccgggtgcggagccgccccggccgccgtgccaacggccgatccggcgccgctgcccaccctcacccgcccggtcaagccgccccgggaccccaccgacaccaagccgaacaccggctggctgaccggtgtggtcagccggggcggcagcggtccctgttacggcttcacctccgacgacggcgccgcgttcgcgctgtacaacggcgacggcctcaccctcaccgagggcgcccgggtccaggtcaaactggagtcgacgctgctgaagatctactgcgggcccggtgacctgatggcggtgaccgcggccgcgccggtcggatga

SEQ ID NO: 2565 - DNA, 912 bp, Actinoplanes utahensis
atggacgaatcggtggtgatggcggaagggccgtggacccaccgcttcgtcggcgccaacggcagccggttccacgtcgccgagatgggctccgggccgctcgtcctgttcctgcacggcttcccggagttctggtgggcctggcacgacatcatgacccgggtcgccgacgccggctaccgggccgcggccatcgatctgcgcggatacggtcacagcgacaagcccccgcggggatacgacgggtacacgatggccgccgacgtgaccggcctgatccgggccctgggtgagcgctccgccacgatcgtcggcgccggcgccggcgggatgatcggctgggccgccgcggccttccaccccaaactcgtcaaccggctggtggtgctcggcgcggcccacccgctgcggttgcgggccgcgctgttcgccgacccgcgcggacagttcgcggcttccgccacgattctcaaattccaggttccgcggtacgagcatgtcctgacccgtgacgacgcggcgctcatcggcgaactcatgcagcactggagcagcccggagtgggcggccaccccggagttcgccgactactcgtaccgctgccggcaggccatgcagatcccgcaggcgtcgttctgcgccctggaggcgtaccggtgggtggcgcgcagtgccctccggctgcagggctaccgcttcgtgaagctgatgcagcagccgctcgggatgcccaccctgcagctgcacggttccctggacacggccatcctgccgcgcacggcgcagggctccgggcggtatgtgaccgcgccgtacgagtggcggctgctgcccggtgccgggcacttcatccaccaggaggcgccggacttcgtcaccggcgagatcctccgctggctgaagacgccctag

SEQ ID NO: 2566 - DNA, 363 bp, Actinoplanes utahensis
atgcgtgacggttacgtggtgtcctggcagggtcaggagtacgacgcggtgcccgacggcgacagggtgcggatctacacggcccaggcgacggagggtttcgccgaggtcaagcccgggcggtacgtgcgggtgctggagccggacgagtacgacgaggtggcgtacgtccggaccatgtgcacctggcggggagagccgttcatcgtgctcgccgaggcggacacctggctgcggctggagtacaccggcgggcgtgcgccggtggcccgccggctcgggctggaggagttcgactacggcgtctaccagggctgggccccggcgaacgagattcgcgaccggtacgagcaccgggtctga

SEQ ID NO: 2567 - DNA, 3675 bp, Actinoplanes utahensis
gtgtccgagtgggagccggttaccgacgctgaggtcgcgatgcgcgacgcgttgcgtaccgacgaccaggagtcctatttccgcatcctcgctggtgtcgaactcctgctgccggtctcggccgacgcgctcgcgggtctggcaccgctcggctggggcacctggagcaccggcggacgcacgcacgtgctggcgttcacctcacaggaggcgttgcgtgcctgcctgtccgactacaccggcgcgtcccgccgggtggcgtacgcggagctcgccaacacctggcccaacctggagtggtggctggcggtcaaccccggtctaccgatcgagggttacctccccgcctggttcgtcgcccagctagcccgcggtgacctgcggctgcccacccgcggcccggggcgggaggtccacggcacctccaagatccaggagctcggtgcggccgcgctcgcggccaagcgggccggtgagggccccggcgggccgacccatgagacgtcggcagcagccgcgtccggggggccgggtcatccggccggtcccggcggcgcgtccggcgtaggttctcggccgccgcagcccggggcggtcccctcttctctgccccagcgtggcgcgcctgttccggccggcgccgcgcagttcggtcccggcgggcagctcggtgccggtcccggtggttccggcgggcaattcgccgctgcccccggcggttccggcggggaactcggtggtgctccgggcgggcagccgggtggtgcgccgatgaacacgccgagcgggcttccggtgcgtgcgccgagcctgcccacccgttcgaccactccctccgggctgccggtgcgcactccggccgcgggtgagtcgccggccgctcccgcggctgaccagccgccggccgcctaccaggcgccgggcgtgcccggtgtgcccggcgggctgcccggccgtactccggccggcagcggttcggccacgcccgggtggaattcggactccatgccgttcgggccggagaacgatccgcgcgggccgttgcaggacctgaacgcgccgctcccggtgcggactccgatggccaacaccccgccgatccccgagcacgtcaagccgtacgacccggccgaggcccaggtcgacccgaactgggcggcgatcggcggcggccgggccggtgacccggcgagcccgggggctccagccccgtccggcctcggtgctccggcgggtcccggcgcatcgtccgggctcggcgcgccggctgccgctccgctgccgtcgcgtggcggttcggatctgccccggcgccagcccggtcaggcggccgggcccagccagacgacgtcgttctccgggttcaccaatgcacggacgatgcccggctccgcctccgccccgccgcccggcttcccgcaggggcccgcctctccgcaggccgcggccgcgcagagcgcaccggccccgggtggtccaggcctgggctcgccggctctcggtgccccgggttcgggcgcgccgtcccccggtgcggcttcgcccggtggatcgaacggtgggctgccccgccgtcaggtcactccgccttcggagcggccggcgtcgatggcggccgccgcgcaggcgctcaccggtgggcacacgcccgctccggatcccggcctcgcgcagcgggatgttccaccggcggaccgattcgggccgtccgggcccgcgccggcgctgccgcagcgttctgatctcgggcagggcggcggtgaccgaccggcgcccggcgggcgtcccggcctgctgccgccggtgatccccggcgctcccggtgcggaccgtggcggcattcccggtggctacggcggcgcttccggtcccggcacgccggggtccggcctcggcccgtccggggcgcccgtgtccggctccggtccgtccggcttccccgaggggcgacccgctccggccgctgccggcgctccggctccggctgctgccgctgctccggtttcggctccggctgttcccggcatcccgatctcggctccgcctgctccgggtgctccggtttcacccccgcccgctcccgatgcccccgtttcggggccggctgctcccggtgtcccggtttcggctgctctcggcgcgccgatctccggtgcggctgctcccggcgtccccctttcgggtgccggcactccgggcgtggccaacggcttgcccgcagccaccggcagtcctgcctcggcgtatgccgctcccggcagtcctgcctcggcgtatgccattccgaccggtcctgctccggcttacgcgccgtccatccccgccggctacagctccccgccagccggctacaccggtccttccacacccgttcccggcggttacagcgcccccgcggtgcccgctccgggaggttacggcgctccggcctcggatggctacggtgcttcgccggtgtccggtccgggcggtcacggcgggacctcagcgccggcgccagccgcctacagcgctccgacggcgcccggcccggccttcgggatgccgccgcagggcagcccggcctcggcgtatgccagtcaggcccacgccacacagatcatctcgctgaccccgcagaccacggccgcgccgacctccggcgcctccggtctgggcatcgcggggtcgtcgaccggtggcagctccgggcagggcggccgggcgcgggaggacttcgtcccggccaacgagaccgagcgggagctgcaggacgccgcggacgccgggaacaccgacgtcttcctctccacgctgctgctggcgcacgtcctggtcccggtggcccaccactcccgcccgggcagcgcgcccggcgagtccggcttcgcgttccagccggaggaggtcgagggcgagaagttcctggtcgtcttcaccagcaaggaccggctgtccgagcatttcggcgagccgacccgcacggtgggcgtccggttctacgagctgatccgcaactggcccgacccgaactggtcgttcgccgtcaacccgggcaccccggtcggcgcgaagtatccgggcacccagatcatcgcgctcgcgaactgggcgaccgaggccggtctcggcgccgagccgatcgagtcgccgtccgccgaggagccggccgctgtcgtgccggccccggagccggccagcgacgaggcgcagcacgccacggtcatgcagaagacgatcgccgccggccaggtcgactactacctggaccggggctacgaccgggtggccggtttcgtgcaccgcgcgtccgaggtcgagcatctgcgcaccccggcggagctgttcggtgcgctgggcctcagctacgacggttcgccgttccaggcggatgccaaggaggcgttcgtgctgcgctggccggcattccggcccagcctgtaccggattccctacggcggacagaacgagcaggcgctgcgtgccatggacggctgggtgatcgagcggccgccgttccggggcaacggcttcgccccgggtgagggccgcgacgtgatcgccgagttcaaggtggacagtgtgcggctgccgcacggcgcccagttgtggcgtctggacgcggacggcaacgaacgcatggtggcgatcttcgacgcggacggaccgctctggcgccgggtgggtgagcagtga

SEQ ID NO: 2568 - DNA, 747 bp, Actinoplanes utahensis
gtgatcacgctcaggatccatgcctggtctcgcccgtcattccgatgtccacagcagagaacggggggtgacctcagaaatggcttacacccaagcggagaccacggtgatggcccgcaccgccgggaaattcgaccaggtcaacggtgtcctgcaggtgatgctgggcacgctgatgaccgagctcgccgacctgaacggcacgtggaagggcctcggtgcggcagccttcgagcaggtcaagaggcagtacgcggaggatctgcagcgcctcaacaacgcactcgccgagacggccgagtcgattcgggcgtccggggccggctatcacgccgccgactccgaggccgccagccgggtcgcccgcaccggtggcaccttcacgctgccgctctgacttttcagcaccaccccgctccggcccgctctccgattcactccaggaggattctcgtgaacgacggacttctgctcgtcaacttcggcgccctgcagcaggccggcgccaacatcgacaaggcgctcggcaccctgcgcgatcagctcgcgcaactggagcaggatgccgcgccgctggtgtcgaactgggccggcgaggcgcagcatgcctatgcgcagcggcaggccacctggcgcgccgcgtccgctgacctggaggccatcctcagccggatcaggctggcggtggacgagtcggccaccgactacctgaccaccgaacgggcggctacccaacggttccagtga

SEQ ID NO: 2569 - DNA, 2517 bp, Actinoplanes utahensis
gtgacgaccggcccggccaccgcaccacgcttctccgctgtgcgcctccaccaggtgatcgccacccaggcggccgtggtcctgctcctgatcggcgccgcggcgggtggcctcgtcctgatctcggccgctgccggcgccgccgccctgctcacgatgacctggctgcgcgtccgcggacgctgggcgttccagtggctcgccgccgactggcgtttccgcgcccgtcgccgtgccggcgccacgatgctcgagctcgccgcccccggcgcccaggtcacctcgatcgccctgccgcgaggccccgccgcggtgctcgccgacgagttcggcctgaccatgcttctcgagctcggcgatccggccggcccgctggccgagccccgctccggcctggccgccccctgggagctgctgcgcgacgcccagcagcgaccgccgagccggattcagctgttgctcaccgcagcgccggtgaccgccgggcccgggccggtcgccagctcgtaccggatgctcaccggcggcgccaccctcggatacacccggacggtgctcgcggtccgcgtgctgcgcaccgacggctggaccgagggcgagctgcgccaggccctgcggggccaggcacgcaagctcgccagccggctcagggcccggccgttgccccaggccgcggcggtccgggcgcttgccgatctgacgtacgccgatcccgcggccgaggtccaggagcagtggccggtgctgcgggccggcccactgtcccaggtgaccttccaggctcgcccccgggccgacgtggcaccgtccgccgggttgctcacccggctgctccagctcccggtcaccgccaccaccgtcacggtcaccgccgacctgccggagcccgagtcctccgagccgccacggatctccctgtcggtccgcctgaccgcacccgaccgggccgccctggagtccgcggcgcagaccctgacccggctggcgcgcgccgagcgcatcgagctccgccgccgcgacggcgagcacctgcacggcctcaccgccaccctgcccctggccctgcccggcgactccgccgtcctcaccggcgatcccctcgatctggccctgctcccggtccggcacagcgactctctccacccggcgcctgccgccccgggcacgacccaccacgccccggatccgacatcagccgccgccccgggcacgacccaccacgccccggatacggcatcggctgcaccgggcacgacccgtagcgccctcgcccccgcaccggtctcaccgagcacgaccggcttccgccgggatcccggcctccgcggcgagaaaccggcgccttccgccgacacggtgcagccggagcccttccggtccaggtcgccgagacgacggcgcggcctggtcgatccccgcctgaaaccgaccatgcggcgaggcgcggtcacccacccccggccctccgcgccgctccacccgcccgcgcccgagccatccgacggcgaatccgaaccgcggccctcgatcaccagcgagcagttcggcaggctgacgctgcccaccggaagctccggtgtcgccgtcggccaggatcggcacggcaaacccgtgctgatcccgctgttccggccggcgccgacccgggtgctggtcgtcggcggtttccgctgtgctcagctgctggccttccgcgcgatggcggtcggcgcccaggtactggtgcgcaccctgcggcccggcgactggaccgcgttcgctcgtgccaccgcctcgccgggcgtcgcaatcggcatcgtgccaccggacaggccggtcgacctgccgctcgcttccccgctgcgcccgatactgaccatcctggacgtggacccgcttcccgcgcccgggccacatcccggcggccacagccccggccccggccgcccgtctccgagtcccagtccacgccctagccctcgcccgagaccccagccggccgtcacccaccccgtcgtcgccacttcctcggtcaccaccccagcccccaccaccccagcgaccccgggcacagcaaccccagccacagccgcctccgccacagccacctcggtcacagccggcgtatacgcgctcggcacaggcgcccccggcgacggcggccacatcgcgacgaccggtgacgacccgccggggcgcgacaccgcggaccagaccgacgacgacaccgaccgatggctcgaatgcatgcaggacagtggcccctgggaggccaccctgatgctccggcgggagttcgccgcctcggacggccgcaccgcgaccgacgccgatctggtcctgttgcagccgttgcgggccgacgaggccgaacgggccggtgacgcgttgccgctcggggacgccgcgcgactgctcagccggatgcgctccgggatgatcgggatcgccggtccgcacggcatccgctgggcgatgctggctcccacggccatcgaaaaggtgctgatcggagacctgacccggaggaacatttga

SEQ ID NO: 2570 - DNA, 405 bp, Actinoplanes utahensis
gtggcaccatcccgtgccatgggcatcatcatccggctcgtgatcacggccgtctcgctgtggatctcgaccctggtcatcgacgggatcgacctcaccgcgaacaccgcgacgagtaaggcaggcaccctcctcgccgtcgcggtgatcttcggcgtggtgaacgcgatcctccggccgatcatcaagacgatcggctgcgggctctacgtcttcacgctcgggctgatcgcggtggtcgtcaacggcctgctgttcatgctgacgagctggatcgccggccagttcgacctgggcttccacgtcgaccacttctggccctcggcggtcctcggcgcgctgctcgtcggcatcgtgagctgggttctcaacatgctcgtccccgacggcggcgacgacaactga

SEQ ID NO: 2571 - DNA, 927 bp, Actinoplanes utahensis
ttgcggccttacggtaagggcatgagcgacgagcggcgcggctatctgtacggcatcacggcgtacgtgctgtggggcttcttcccgatctacttcaagctgctcaagccgtccccgcccctggagatcctggcgcaccggatcatctggtcggtcgtgttcgtcgcgctgctgctcaccgcgatgcgcaactggtccttcctcggtcggatcctgcgcaccccacgcctgctcgggggcgtcaccgccgcggctttgctgatcggcgtgaactgggcgacctacatctacggcgtcaactcgtcccgggtcgtcgaggccgcgctcggctacttcatcacgccgctggtcgtggtcctgctcggcgtcaccgtccagcgcgaacgcctgcacccctggcagtggatcgcggtcggcatcggcggcctggcggtcgccatcctcaccgtcgactacggccgcctgccgtacatcgcgctgatcctggccgcgtcgttcggctcgtacagcctgatcaagaagcgcatgtcactcccgcccgccgagggcctgttcgtcgagtcagccgtcctcgcgctgcccgcgctcgcctacctgacctggctcaacctcggtcacggcgcgaagttcggccacgtctccggcgtacacaccgccctgatgctcttctccggcatcgccaccgccgtcccgctgctgctcttcgccggcgccgccaaccgcgttcccctcgtcggcctcggcatcctgcagtacatcgccccgatcctccagctggcctgcggcatcctgatctaccacgagccgatgccgcccgcccgcctcgccgggttcgccctggtctggttggccctgatcatcttcaccgcccacggcatccactcagcccgcaccaccgcccgccagcgagccaccacccgcgtctga

SEQ ID NO: 2572 - DNA, 702 bp, Actinoplanes utahensis
atgcggtgtgaggacgggcacgacgacgccgcgtacgtcctcggcgcgctgtcgccggcagagcgggcggcctacgagcagcatctggcgacgtgctcgttctgccgggaggccgtggccgatttatcccgtgtgccggacatgctggaccgtctcgacgcggacgagttcgcgcggctgctcgacccgtcactgctcgaccaatcgccgcccgcccggccgttcgccgctccggccgccgaacggtcacaccgggcgactccgccgcccagggccagaacctttccggtacgcctgctgagcaccgccgcggccgtcctcctggtcatgatcctcggggtcggcgtgacactgtggctgatgaaccgggccgagccgggcagcgccgcctccgggccggcggtcgcgatggccgccgtgaacaattcctcgccgatctccgccaacatccgtctgaccgggacggccggcggcaccaaaatcgagatggtgtgccggtacgcggagtcggagaagccttacacgttcggcctgatcgcctacggccccgacgaccagagcgaacaggtcggctcgtggacggcccacccgggcgcggaattccggatgctggccaacacccacttcaccattgaaggtctcgaccgcatcgacctggtccgcttcgacggcaagatcatgctcacctaccgtccccgctga

SEQ ID NO: 2573 - DNA, 795 bp, Actinoplanes utahensis
gtgcgtgacccgctagcggagccgtcagatctcatccggagcgtgtcgcgtgccctgcgcgtcctggagtcggtcggccgggctccgcgcgggctcacggtgaaacagatcgcccgtcgctgcgagctgaccgtcgccaccacgtatcacctcgtgcgcaccctcgcctacgagggctacgtgatccgccgcgaggacggcacgtacatcgtcggtttggagatcgccgaccgctaccgggagctcgtgtcggccttccgcggcccgccggccgtcggtgacgccctgcgccgtgccgctctcgacaccggctacagccactacctgggccgtttcgtcggcgggcggatcgcggtcaccgcctccgccgagggcgcccgctccccgttcctcgacgacgtcgcccccggcttcgacgagggcggccacgccaccgccctgggcaaggcgctgctcgccacgctcacccccgatcagcgcgggcgatacctgcgcgactacgggatgcgggcgttcacccccaccacgctgaccaccccggaggcgttggaggccgacctggcggccggcgaacgccgcggcatgcagatcgagatgggccagttccgccagggcctcgcctccgccgccgtggtcgtggtcgccgaccgggacatggaacgccgtctggtcctcgcctgctccatgcccgccgccgaaatgctcacctcggcccgcgtggtccgcgccaaactcaccgccgccgcccgcaacgtcgccgaagccctctccggaggcgaatccgccaccgcctga

SEQ ID NO: 2574 - DNA, 1014 bp, Actinoplanes utahensis
gtgagcaccggtgagctgacgctgtcgtcgctgggcctcgacgtcgatcccgcgatggacgcgtcggtgtcggcgatgctgaccgccgtcgaggaagcgctgcgggtccgcgtcgccagcgccgaccccctggtgaccgaggcggcccgccacctcgccgacgccggcggcaaacgactccgcccgatcctcgtcgcgctcggcgcccaattcggcgacccggcccgccccgagctgatcgacgcggccaacgtggtcgagctgacccacctggccacgctgtaccacgacgacgtgatggacgaggccccggtccgccgcggcacccccagcgccaacgcgcgctggggcaactcggtcgccatcctggtcggcgactacctgttcgcccaggccgccgagctggccgccaaactcggcaccgaggccgtccacctgcaggcgcagaccttctcccggctggtgcacgggcagatcgccgaaaccgtgggcccgcggggcaccgacccgattcagcactatctgcaggtcatcgccgacaagaccgggtcgctgatcgccactgcggcgcgcttcggcgggctgttctccggggcgcggcccgagctggtcgaggcgctcgccgggtacggggagctgatcgggctggtcttccagctctccgatgacctgctggacatcgcctccgagtcggtgcagtccgggaaaacgccggggaccgatctgcgggaaggggtgccgaccctgccggtgctctacgcgctggcgggggacgacgcggatccggctgcggtgcggctgcgggagctgctctccgcggggccgatcaccgatgatgcgctgcacgctgaggcgttggggctgctgcgggagtcggcggcgatgaagcaggcgcgggagacggtgcgggggtatgcggaggcggctcgcgagcggctggcgccgctgcccgagggggaggcgaagcgggcgatggagctgctctgcgactacatggccgaccgcaccaactga

SEQ ID NO: 2575 - DNA, 2496 bp, Actinoplanes utahensis
gtgggtcaacggcggacacaccttcgacttcgaggcgctcgtcaaggccgcgcagtcgatcaacacggacaccgcccgctggctgttcctcggcttcttcgtggcgttcgcgatcaaggcgccgttcttcccgttccacacctggctgccggactccggtgcggccgccccggccggtgcggccgccctgctggtcggcgtgatggacaaggtcggcacgttcggcatcctgcggtactgcctcccgctgttccccgaggcgtcccgctggttcgcgccggccgccctggtcatcgcggtgatcgggatcatctacgcggccctgctcgcggtcggtcagaacgacctgaagcggctcgtgtcatacacctcgatcgcgcacttcggattcatcggcatcggcatcttcgccttcaccacccagggtggcaccggctcggtgctgtacatggtcaaccacggtctggccaccggcctgctgttcatcgtggtcggcatgttcgtggcccgccgcgaatcgtcgctggtcagcgacttcggcggggccggcaagctggtcccggtgctggccggggtgctgttcttcgccggtctggcctcactggccctgcccggcacggcgccgttcgtcagcgaattcctggtgctgctcggcacgttcagcacgcacaaggcgtacgcggtggtcgccaccgccggcatcgtgctggccgcggcgtacgtgctctggatgatccagcggaccacccagggcacgctcaacccggccctcgaggagaagccgggcatgcggatcgacctcaccctgcgggagaaggtcgtggtcgccccgctgatcgtgctcctgctggtgctcggcttctacccgaagccggtcaccgacgtgatcaacccggcggtgcagatgacactgcagcacgacgtcggcacgcaggacccggccccggtggtcgcggacggaaaggctggccgatgaaactcccaccgatcgactacggcgcactggcccccatgctgatcctcttcggggtcgcctgcctcggggtgctcctcgaagtgctggtgccgcggcggtcccgcaacgtcgtgcagctgtcgctggccctgctgggtgtcgcggcggcgctgaccgtcctggtcatccaccgcaacgaccggctcgtcacgatcggcggcgcggtcgcgatcgacgggccgaccgtcttcctgcagggcgcgatcctgttgctcggcgcggtctcgctgttcctgatcggcgagcggtcggtcgaggccggcggtgcgttcgtggcccaggcggcggtcgtggtcggctccgataaggacagccggcagtcggccgggcagcccgggctcaccgaggtgtacccgctggccaccttcgcgctcggcggcatgctgctgttcgtcgccgcgaacgacctgctcaccatgttcgtggcactggaggtcttctcgctgccgctgtacctgctgtgcgcgctggcccgccgccggcgcctgctcagccaggaggccgccctcaagtacttcctgctcgggtcgtacgcctcggcgttcttcctgttcggtgtcgcgctactgtacggcttcgccggcggcgtccagctcagcgtcatccaccaggcggtggtcagcccgcagcgggaccagctgctcctctacggcggtctcggactggtcgcgatcggcctgctcttcaagagcgcgctggccccgttccacgtctggaccccggacgtctaccagggcgctccgaccccggtcaccgcgttcatggcggcctgcaccaaggtggccgcgttcggggccctgctccgggtgttctacgtggccttcgagggcgtccgctgggacttccagccggtcctcggggcggtcgcggtgctcaccatgttcatcggcgcgatcctggcggtcacccagaccgacatgaagcggctgctggcctactcgtcgatcgccaacgccggctacctgatggtcggcgtcctggcgctcaacgaggacgggctgagcagcacgatgttctacctggtggcctacggcttctcggtgatcgccgcgttcgcgatcgtcagcctggtccgggacgccgacggcgaggccacccacctgtcccggtgggccggcatcggccgcaagagtccgctgctggccggcgtcttcaccctggtcctgctcgccttcgccggcatcccgctgaccagtggcttcaccgccaagttcgcggtcttcgcggcggccaccgcgggcgggcagacctggctggtcatcttcggcgtgatcagcagcatgctgatcgccttcccgtacgtccgggtgatcgtgctgatgtggcagtccgagccgagcgagaacaccccgtcggtctccatcccgggcttcctcacctcggccgcactgggcctcggggtgctggtcaccgtggcgctcggcgtggtgccgggggcgctgatcgacctgacgcgggatgccgcccagtttgttcgctga

SEQ ID NO: 2576 - DNA, 1908 bp, Actinoplanes utahensis
gtggaacacacctacgcccccgcgacgggcgtgctgagcgggatctggctgctcgtggccatcccgctggtcagctcggcgatcctgctgctgctcggtcgacgcgccgaccggtggggacactggctcggcgtactcgcggtcgccgcgtccttcgtactcggcctgatcttcttcatcaagctcggcggactcgccgccgagcagcggtccgcggagctcagcctcttcgacttcatcgacgtcgggagcctgaaggtcgacttcggtctgctcttcgacccgctggccggcgtgttcgtgctgctgatcaccggggtcggatcgctgatccacctgtacgcggtcggctacatggagcacgacccgggtcggcgccgcttcttcggctacttcaacctgttcgtcgcggcgatgctgctgctcgtcctcggcaacaactacgtgatgctctacttcggctgggagggtgtcggtgtggcgtcctacctgctgatctccttctggtacacgcgcccgtcggcggccaccgccggcaagaaggcgttcctgatgaaccgggtcggtgacgccggcctggcgatcggcgtgttcctgatgttcaccacggtgggcggcacgcagtactccacggtgttcggcagaatcggctcgctggggtcgacgaccgtactcatcatgggtctgctcctgctcctcggcgcctgcggcaagtccggccagttcccgctgcaggcctggctgccggacgcgatggagggcccgaccccggtgtcggccctgatccacgcggccaccatggtcaccgcgggcgtctacctgatcgcccggtccaatccgatcttctcggccaacgacacgctgcagctggtggtggtcagcgtgggtgcgctgacgctgctgatcggctgcatcatcggcaccgccaaggacgacatcaagcgggtgctggcctggtcgacggtcagccagatcggctacatgttcctcggcgtcgggctcggcggggcggcgtacgcgctggccatcatccacctgctggcgcacggcttcttcaaggcgaacatgttcctcggggccgggtcggtcatgcacggcatgcacgaccaggtcgacatccggcggttcggcggcctcagcaaatacatgaagaccacctggctcaccttcatgatgggctggctggcgatcatcggcatcccgccgctgtccggcttcttcaccaaggagccgatcatcgcggcggcgttcgaccgccccggctggaccggctggctgttcggtggcgcggcgatgctcggcgcgggcctgaccgccttctacatgacccggctgttcgtgctcaccttccacggaccgcagcgctacaccgaggagaacacgcacccgcacgagtcgccggcgatcatgacgatcccgctgatcctgctggcgctcggttcggtggtggccggctgggtgatgtcgacgaccgtggtcgactggctcaacccggtcttcggcgagcagcccgagcacaccgagaagctgtggatcacgctgctcagcatcctgctgacgctgatcggcgccggcctggcctgggcccggttccgccgcggcaccgagccggcaccggaaccggcgggggtggtggtcaccgcggcccgacgcaacctgtacaccgacgcgttcaacgaggcggtgttcgaacggcccggcatctacctcacccgggcgctggtctacctggacggcaggggcatcgacggcctggtcaacgggctggcggcggcggtgggcggcggctccggccggctccggcggctgcagaccggcttcgtccgctcgtacgccctgtccatgctcaccggcgccatgctcctggtgggcgccttcctcgcgatccagttggggtggctggcgtga

SEQ ID NO: 2577 - DNA, 300 bp, Actinoplanes utahensis
atgacgcccgactactacctgatcctggcggtcatcctgttcaccgtcggggccgccggcgtgctggtgcggcgcaacgcgatcgtcctgttcatgtgcatcgagctgatgctgaacgcggcgaacctggcgctggtcaccttcagccggatcaacggcgggctggacggtcagatcatctcgttcttcgtgatggtcgtcgccgccgccgaggtcgtggtcggcctcgccatcatcatgtcgatcttccgtacgcgacgctcggcgagtgtcgacgacgcgaacctcctgaagtactga

SEQ ID NO: 2578 - DNA, 744 bp, Actinoplanes utahensis
atgacacacgtctccaccggggaacagatcgccttctggatcctcggcccgctggccgtgctcggggcgctcggcatggtgctggcccgcaacgcggtccactcggcgctgtgcctggtcgtcacgatgctgaacctcggcatcctgtacgtggtcaaccaggccccgttcctgggcttcgtgcagatcatcgtctacaccggcgcgatcatgatgctgttcctgttcgtgctgatgctggtcggccgggacgcctcggactcgctgatcgagaccctgcgcgggcagcgcgtcgccgccatcctgctcggcctgggcttcgccctgctggtcggcaccgggctgggccgggcgctgaaccacaccccgaccgtgggtctggaccaggccaaccagaaggggaacgtgcagggcctggccgcgctgctgttcaccaggtacgtgttcgccttcgaggtcacctcggcgctgctgatcacggcggcggtcggggcgatgatcctggcccacgtcgaggtggccaagggcgacaaggccgaccaggtgacccggatgaaggagcgcttccggccgggcaactaccccgggcccaagccgggccccggcgtctacgcgaacaccatgtcggtggccgcgccggcccgcctgccggacggcaacggcacggagaacagcatctcgccgatcctgccggtccgggagctgacggcttccgaggtcgccccgaagggaaccgagaaatga

SEQ ID NO: 2579 - DNA, 561 bp, Actinoplanes utahensis
gtgaacacgtttaccggctccttcaagggcttcggtgtcacgttcgcgcacatgttccgcaaggtggtcaccaccgactacccgttcaccccaccgaagccggctccgcggtaccacggccggcacatcctcaaccggcatccggacgggctggagaagtgcatcggctgcgagctgtgcgcctgggcctgcccggccgacgcgatctacgtcgagggtggcgacaacaccgacgagcagcggttctcgccgggtgagcggttcgcgaagatctaccagatcaactacacccggtgcatcttctgcgggctctgcatcgaggcctgtccgacccgttcgctgaccatgagcaacgagtacgagctggcccgggacagccgccaggacctgatcttcaccaaggaacaactcctggccccgctgctgcccgggatggagcagccgccgcacccgatgcgcctgggcgagaccgacaaggactactacgtcggtgcgctgaccaacccgggcacctcggccggtgccgagaaggccccgctccaccggggggacgagcaatga

SEQ ID NO: 2580 - DNA, 1368 bp, Actinoplanes utahensis
atgatcgagctcctcgcggcccacgcgacggacccggcccccgagtcgttcgggcaggacgtctggtggatcgcgctgatcaaactggtcggcctgttcgccctgctgctgatcctgaccctgttcacgatcaactacgagcgcaaggtcgtggcccggatggctgtccggcccggccccaaccaggtcggtttccgcggctatctgacctccctgagcgacggcctgaagctgccgttcaaggaggagatcatccccaggaccgccgacaaggtggtctacttcatcgccccggtgatctcggcgaccacggcgttcaccgcgttctcggtgatcccgttcggcggcgtggtgaccatgttcgggcaccggaccgcgctgcagctcaccgacgtgccggtctcggtgctggtgctgctggcctgctcgtcgatgagcgtgtacggcgtggtgctggccggctgggcctccggatcgacgtaccccctgctgggtggtctgcgatcaagcgcgcagatgatctcgtacgaggtcgcgatgggtctgtccatcgtcgcggtgttcatgaccgcgggcacgatgagcacctcacagatcgtcgcggcgcaggcctcgggtcagccggtcgtcctgttcggctggcacgtcaccgcgcccggctggtactgcgtgctgctgctgccgagcttcctggtctacatgatctcggcggtcggcgagaccaaccgggcgccgttcgacctgcccgaggccgagtccgagctggtcggcgggttccacacggaatactcgtcgttcaagttcgcgctgttcttcctggccgagtacatcaacatgatcaccgtctcggcgttctgcaccacgctgttcctgggcggctggcgggcgccgtggccgatcaccgcggtctggcacggggcgaactccggctactgggcgctgctctggttcttcctgaaggtgttcacgctgctgttcggcttcatctggctgcgggccacgctgccccggatgcgctacgaccagttcatgcggttcggctggaaggtcctgatcccggtcaacctggtgtggatcctcgcgctggcgttctggaaggtcatccggcacggcctgatctccgacacggtcaagttcagcaccgtcggcgtgctggtcgtgatcatcctggtggccgcctacgcctggccgtcggcggagaaaccccggcagctctccctggaggaggaactggcccgccgcccaccgggcagcttcccggttccgccgatcgacctgcaggttcccccgagcccgcgtgcccgccgcgcggtcgccgaacgcgcccccgcagccgtgggcggcgactccgagtcgaaggaggtgtga

SEQ ID NO: 2581 - DNA, 2496 bp, Actinoplanes utahensis
atgaccgacgtagccaagagagccgacaccgtcaagctgaccatcgacggcgtcgaggtggtcgccgagaagggcgagctgctgatccgggtcgccgagcggatgggcatcgcgatcccgcggttctgcgatcacccgctgctggccccggccggcgcctgccgccagtgcctggtcgaggtggagggccagcgcaagccgatcgcctcgtgcacccagacggtggccgacggcatggtggtcaagacccagctcagctcgccggtcgcggccaaggcccaggccggcgtgatggagctgctgctgatcaaccacccgctcgactgccccacctgcgacaagggtggcgagtgcccgctgcagaaccaggcgatgagcaccggccgcgccgactcccggttccacgagcacaagcgggagtacgagaagccgatccacatctccagccaggtcctgctggaccgggaacgctgcgtgctctgccagcgctgcacccggttctccgaggagatcgccggcgacaagttcatcgacctgatggaccgctcctccggcgagcagatcaacgtgtaccgcgacgacttcttcggtggcgcgggtaccggtgacggccaggtcggcgagggggcgggggacgtcgcgttcaactcctacttctccggcaacaccatccagatctgcccggtgggcgcgctgaccggcgagcagtaccggttccgtgcccggccgttcgacctggtctcctcgcccaccgcgtgcgagcactgcgcggccggctgctcgatgcgggccgaccaccggcgcgggaaggtgctgcgccggctggccggtgacgacccggcggtcaacgaggagtggaactgcgacaagggtcggtggggattccgttacgccacggccaccgaccggatcaccacgccgctgatccgggacgcgcgcaccgggcagctgcgcgaggcgtcctggagcgaggcgctggtcaccgccgccgaggggctcaaggcggcccgtgagcggggtgtcggggtgctgaccgggggccggctcacggtggaggacgcgtacgcgtacgcgaaattcgcccggatcgtcctgggtaccaacgacatcgacttccgggcccggccggtgcgagcctccggctcgccggccgagatcaccgaggaggcggacttcctcgcggccgcggtcgccggggtttccgatctgtcgtacgccgatgtcgaagccgccccgagcatcctgatcgtcgggctggagccggaggaggagtgcccgatcctcttcctgcgcctgcgcaaggcgtcccgcaggcagttgcgggtgaccgcggtggccccgcacctgacccggggtttcgagaagctcggcgccacgctcgtcgcggcggtcccgggtgacgaggcccggctgctgaacaccgatcccacggtggccgcggcgctcagcgcgccgggcagcctgctgctggtcggtgagcgtctggccaccgtgccgggcgggctctcggcggccgctgcgctggccgcccgaaccggcgcccgcctcgcgtgggtgccgcgccgggccggtgaccggggtgcggtggacgccggctgcctgccgaacctgctgcccggcggccgcccggtcggggacacgtcgtcccgggccgagctctccctctcctggtcggtggacgccggtgtgctgccgtcccggcccggccgggacgtcgacgcgatcatcgcggcggcggccgacgggacgctcggcggcctgctggtcggcgcggtggacccgggcgacctgaccgacccggccctcgccgagcgggcgctggacgcggtgccgttcctggtcagcctggagctgcggcacagcgcggtgaccgcgcgggccgacgtggtgctgccggtcgcgccggcggtggagaagtccggcacctacatggactgggagggccggctacggtccttcggcacggtcctgcgcggcagcacggcgatgaccgacggccgggtgctggaggccatcgccgccctgctcgacgtcaccctgaacaccggggacgtgcaggcggtccgccgcgagctgggcgcgatgccggccggtcaggcccgtcccgcgctgccgtcggtggccgccgaggcggtcgccgaccccggtgagcggtccgcggtgctggccacctggcaccagctgatcgacctgggcacgctgctggacggcgacgacgtgctggccggcaccgcccggccgccggtcgtgcggctcggcaaggagctggccgagcagctgcgtgtcgcggacggcgacctgctcacggtacgcaccgaccgcggctcggtgaccctgcccgccgcgatcgccgacctgccccggcaggtggtctggctgccgaccaactcgccgggttccacggtgcgccgcagtctgggtgtcaccgccggcgcggtggtccggctgtcggccggcctgcccggcccgattctcgccgagggagttgaccgatga

SEQ ID NO: 2582 - DNA, 1317 bp, Actinoplanes utahensis
gtgacgcaaccccggccggaggtgctccagaagctcaccccggtgctcaccaagcgctggctctcgccggacgcctggcagatcggcgtctacgagcggctcgacggctaccaggcggtgcgcaaggcgctcgacgtgcacccggacgacgtgatccagctgatcaaggactccggcctgcgcggccgcggcggggccggcttccccaccggcctcaagtggggcttcatcccacagggcgacggcaagccgcactacctcgtgatcaacgcggacgagggcgagccgggcacctgcaaggacctgccactgatgacctacgacccgcactcgctggtggagggcgcgatcatcgcgtcctacgccatccgggcgaaccgggcgttcatctacatccgcggtgaggcggtgcacgccgcgcggcggctgcgcaacgcggtccgggaggcgtacgccgccggctacctgggcaccgacatcctcggttccgggtacgacctggacctggtggtgcacagcggggccggcgcgtacatctgcggcgaggagaccgcgctgctcgactcgctggagggcttccgcggtcagcctcggctgcgcccgccgttcccggcgatcgccggcctgtacgccagccccacggtggtcaacaacgtcgggacgatcgcgagcgtgccgtacatcgtgctgggcggcgccgactggtggaagagcatgggcaccgagaagtcggccggcccgatgatctactcgctctccggccgggtggtcaatcccggacagtacgagtgcggcctcggcatcaccctgcgcgagctgatcgagctggccgggggcatgcagccggggcacgagctgaagttctggaccccgggcggctcgtccacgccgatcctgaccgccgagcacatcgacaccccgatggacttcgagggggtcgcggcggccggctcgatcctgggcaccacggcgatgcagatcttctccgaccaggactgcccggtctacaacacgtggcggtggctggagttctaccaccacgagtcgtgcggcaagtgcaccccgtgccgggagggcaactactggatggtgcgcacctaccggcggatcctggccggtcagggcacctatgccgacctggacacgctgcaggacaccgcggacaacatcttcggccggtccttctgcggcctcggcgacggcgccgcgacgccggtcgtctcgacgctgaagtggttccgggacgactacctcggctacatcgagggccgcaccgcgccgcggctctccgagaagtccctcgtaggagcgcactga

SEQ ID NO: 2583 - DNA, 1119 bp, Actinoplanes utahensis
atgaccgagcttgccgggcggcttcgccgcaacacagaagcaagtgagaagcaggttgaattcaccccggctgcggctccgctcgcggagaagctgctcgggtccgcgcaggagatcctggcgcggtatccggccggccgggagcgctcggcgctgctgccgctgctgcacctggtgcagaccgaggagggccacgtcagcccggccggggtggccttctgcgccgaggtgctgggcatcaacaaggcccaggtcggcgcggtcgccaccttctacaccatgtacaagcgccgccccaccggcgaatacctggtcagcgtctgcaccaacaccctgtgcaacgtgctgggcggccaggcggtctacgaccggctgaccgagcacctcggggtcggccacgacgagaccaccgctgacggccggatcacgctggagcacgccgaatgcctggcggcctgcgactacgccccggtggtgacggtcaactacgacttcaccgtcgaccaggccaccccggactccgcggtggagttggtcgacagcctgcgcaacggcgagcggcccacgccgtcccgcggcgcgcggatctgctcgctgcgcgagatgcagtaccagctcgccggcttcgccgacccccgggacggcgcggtcggcgacggggtggccggcgcgcccacgctgcgcggggtgcgcttggcgcaggagcacgggatcgcggtggccgggttcgacccggagaccccgatcacccggaccaaaccggcccgggagggcgacgcgcagccgaagccggcgccggacggaaaggcggaaaaacccggccgggtcgcctcggtggtgcacgcggcgacgaccgcggtgaaagcggtcgccggaaaggtcgaggagcgccggcacgccggtcacacgaccgaggatccacaggtccgtaccgcggcactgcgcaatcccaccgcgagcgaaccggccggtgccgcggcctcggccggcggcccgccgccggagaacgccgccgagacggccggcgccgcggccaacgcgccggccggtgacggcaaaccggcgggggacagcccgcgtacgcccgacccgacccgtggcaccgaggaggagaagtga

SEQ ID NO: 2584 - DNA, 1326 bp, Actinoplanes utahensis
gtgacaacgtcggaatacgcgagcgcgcgcgagaccaccgagggccgggtcttcacggtcaccggcggcgactgggacagcgtgaccagcggcatcgacccgctcagcaacgagaagatcgtcgtcaacatgggcccccagcacccgtccacgcacggggtgctccggctggtgctggagcttgagggcgagacggtgaccgaggcccgcccggtgatcggctacctgcacaccgggatcgagaagaacctggagtaccggacctggacccagggcgtcacgttcgtcacgcggatggactacctgtccaacatgtcgaacgaggcggcgtactgcctcgcggtggagaagctgctcggcatcaccgaccagatcaccgagcgggccaccacgatccgggtgctcttcatggagctgcagcggatcgcctcgcacctggtctggctggccaccaccggcatggaactgggcgcgatctcgatgatgctgtacggcttccgcgagcgggagtacatcctcgacatcttcgaggagacctccggcctgcggatgaacaacggctacatccgccccggcggcctgagccaggacctgcccgactcggcggtcaagaagatccgtgacttcctcgtgtacctgccgaagaagctcaaggagtacgaggcgatgctctccggccaggtgatctggcagaagcgcacgcagggggtcgccgtcctggacgtgaccggctgcctggcgctgggcatcaccgggccggtgctgcgctccgcgggcctgccctgggacctgcgcaagacgatgccctactgcggttacgaaacgtacgagttcgacgtgccgaccgcgaccaccggcgacgtctggggccgatacctcgtgcgactcgccgagatcaaggagtcgctcaagatcgtcgagcaggcgctcgaccggctcaagcccgggcccatctgggtcgcggacaagaagatcgcctggccgtcccagctcgcgctgggggtggacggtctcggcaactccctggaacacgtcgccaagatcatgggccagtcgatggagtcgctgatccaccacttcaagctcgtgaccgaaggcttccgggtcccgcccggccaagtctacgtggcggtcgagcatccgcgtggcgaactcggcgttcacgcggtttccgacggtggcacccatccctaccgggtgcactaccgcgagccgagcttcgtcaacctccaggccatcccggcgatggccgagggcgcgctgctcgccgacgtgatcgccggcggcgcgtcgctggaccccgtgatgggtgggtgtgatcgctga

SEQ ID NO: 2585 - DNA, 720 bp, Actinoplanes utahensis
atgagtattcaaccaggaactgacggtaacgttcccgtcaccgcaacgaccggcgcgaatctcgacgcacccgcccagacaccgcccagcccggataagggcatgttcggcgtcaaaggcaccggcgacgtctccggtttcggccgcctggtccgcccccggcctgctgtttttgacagcccacggccatacggcgggtatttcgacgacgtctatgacgcgttggaggaagcttatccggccttctccgaagccatcgagaaagtggtcgtggatagggcggagctcacacttcacatcagggccgagagaatcacggatgtctgtcaggtaatgcgggacgacgactccctgcggttcgagctgtgctcctcggtcgatgcggtcgactacctgggcagcgacgagcggcgattccacatcgcctatcaactgacctcgatgacgtaccgccggagggtccgtctcgaggtgtccgtcgccgacggcgtgccggtcccgagcgtcaccggcatctacccgaccgcggactggcaggagcgggaggtctacgacatgttcggcgtcgtcttcgccggccaccccaacctcacccggatcctgatgccggacgactgggagggccacccccagcgcaaggactacccgctcggcggggtgcccgtggaatacaagggcgccgagatcccgccgcccgaccagcggagggtctaccagtga

SEQ ID NO: 2586 - DNA, 669 bp, Actinoplanes utahensis
atgggaatcgaagagaagctgcccagtggcatcctcctcacctcggtcgagaagctgtcgaactgggcccgcaagtcgtcgttctggggcgcgaccttcggactcgcctgttgcgccatcgagatgatggcggccggcggcccgcactacgacctgggtcgctggggcatggaggtgttccgcgcctcgcctcgccaggccgacctgatgatcgtcgcgggtcgggtcagtcagaagatggccccggtggtccgccagatctacgaccagatgccggaaccccgttcggtgatctcgatgggcgtctgcgcctcgtccggcggcatgttcaacaactacgcgatcgtccagggcgtggaccacatcgtcccggtcgacatctacctgccgggctgcccgccgcggccggagatgctgatcgacgcgatcctcaagatgcgcgagaaggtgatggcccagcctctcggcccgaacggccggaagatgctggagcaacgtcgtgccgagggcaagctgccgctcgtcgcgcccggcgccatgccgtcgtcgtaccgcgtcgacaaggcgcgtcgcgcggaatggacgcaggccgtcaaggaaggccgcgaggagcaattgcggatcgagaactggatgaaactccagccgcatttgcgggagggcaaatga

SEQ ID NO: 2587 - DNA, 366 bp, Actinoplanes utahensis
atgacgatcaacccatacgtcccgatcgtcgggttgctgatcctcggcgcgctcttcgcgttgttctcggtgtctgtggcaccgatcgtcgggccgaagcgctacaaccgggcaaaaatggacgcctacgagtgcggcatcgagccggccccacaaccggtcggcggcggccgattcccggtgaagttctatctgacggcgatgctcttcatcgtcttcgacatcgagaccatcttcctgtacccgtgggccgtctcgttcgaggcgctgggcctgttcggattcgtggaaatggtcctgttcatcgtcaccgtgttcatcgcctacacgtacgtgtggcgacgcggcggcctcaactgggactga

SEQ ID NO: 2588 - DNA, 1287 bp, Actinoplanes utahensis
gtgaacgaacccctgcccgtcgccggcgaagccgacgtgatcgtggtcggtgcgggtcccggtggcagcgcggcggcttaccacctggcccggcacgggcaccgggtgctgctgctggagaagaccgagttcccgcgcgagaaggtgtgtggcgacgggctgaccccgcgcgccgtccgccagctggtccggatgggcatcgacacctcggagaaggcgggctggctgcagaatcgcggcctgcgggtgatcggcggcggggtccggctggagctggactggcccgagctggccagtttccccagttacggcctggtccgcacccgtctggacttcgacgacatgctggccgagcgcgcggtggaagccggcgcgctgctgcgcacgaacgtgaacgtcggtggtccggtcctcaatgacgaaggttacgtgatcggcgtccaggccaaggtcggtccggagaaagagccggtgcagttccgcgctcccctggtgatcgccgcggacggcgtctccggcaagtttccgctggccatgggcctggccaagcgcgacgaccgcccgctgggggtggctgtccggcgctactaccgctccgcggtcaaggccgacgacaactacctggagtcctggctggagctgcgcagcgcgcaggatccgagccggctgctccccggttacggctggatcttcggcctgggtgacggccgggtcaacgccggcctgggcatcctcaactcgtcgagcgccttcggcaggaccaactacaagaacatgctcaccgactggctcggctccactccccaggagtgggggctgcgcggcgaggagaacgcagagggcccgacgctgggcgccgcgctcccgatgggcttcaaccgggtgccgcattacacccgcggggtactgctcgtcggcgattcgggtggcatggtcaacccgatgaacggcgagggcatcgcgtacgcgatggagtccggcgagctggccgccgaggtggccgcgcaggcgttggcccgtccggccggtccggagcgcgagcgcgccctgcgcgcctacccgaccgagttgagcctgcgcttcggcggttactaccggctcggcggtgtgttcgtgaagctcatcgggaatccgcaggtcatgcggctggccacgaagcacggcatgccgcacccgacgttgatgaggttcgttctcaagctcctggcgaatctgaccgatccgcgcggtggcgacgccatggaccgcatcatcaacggcttgacgaaggtggcgcccgccgtctga

SEQ ID NO: 2589 - DNA, 261 bp, Actinoplanes utahensis
atgacgaaactagggcagctagaggacaccgacatcgacatcgcgatcgacgagggcgaggccggcgagcgccgggccagcgagctcgcgaaccgcatccggatggtcgccgcccaggatccgctgttggcgcaagacctggtagaggaattgatcgtcgctctggaccgggcgatggacggcaccattcgagatcatctcgagggtccggcacgtgggatcgcggagcgcgttttgggtgattctgacccgatccagtga

SEQ ID NO: 2590 - DNA, 705 bp, Actinoplanes utahensis
gtgggccgggtgacgcgcgcagacctggacaagcagccgcacgaggtcgccgagatgttcgacggcgtggccaaacggtatgacctcaccaacaccgtgctctccttcgggcaggaccggggctggcgccgggccacccgggcggccctcgggctgcggccgggtgagcgggtgctggacgtgggcgccggcaccgggatctccaccgacgagctggggcggtccggggcgttcgcggtgggtgccgacctgtcggtggggatgctgcaggccgggcgggcggtgcggccggtggtgccgctgctggccggggatgcgctgaagctgccgttcgccgatgccaccttcgacgcggtgacgatctccttcgcgttacgcaacgtggtggacaccggtgctgcgttgcgtgagttcggccgggtgacgcggccgggcgggcggctggtggtgtgcgagttcagcaccccgacgaatccggcattccggacggtttacatgcagtatctgatgcggtcgctgccggtcgtcgcgcgcggggtgtccagcaaccccgacgcctatgtctatctggccgagtcgatccgggcctggcccgaccaggcggggttggcgacgcggatcgccgaggcgggaccgtgggatcgcgtgggctggcggaatctcaccggcggggtcgtggcgctgcaccgggcgattcggcgctga

SEQ ID NO: 2591 - DNA, 1242 bp, Actinoplanes utahensis
gtgacggcgaatcgggagatcgacagcatcctgcagcgcggcgccgacggtgggcggatcagccccgaggaggccctgctgctctacacggaggccccgttccacgcgctgggcgaggcggccgacacggtccgccgccggcgctacccggacggcatcgtcacgtacctgatcgatcgcaacatcaactacaccaacgtctgtgtcacggcgtgcaagttctgcgcgttcttccgggcgcccaagcacaaagagggctggtcgcacccgaccgaggagatcctgcgccggtgcggtgaggcggtggagctcggcgccacccaggtgatgctgcagggcggccaccacccggactacggcgtggagtactacgaggagctgttctcctcggtcaagcaggcgttcccgcagctggcgatccactcgatcggcccgagtgagatcctgcacatggccaaggtctcgcaggtctcgatcgaggacgcgatcgtccggatcaaggcggccgggctggactcgatcgccggcgccggcgccgagatgctgcccgaccggccgcgccaggcgatcgccccgctgaaggagagcggagcgcgctggctcgaggtgatggcggtggcgcaccgtaacgggctgtcctccaccgcgaccatgatgatgggcaccggcgagaccaacgccgagcggatcgagcacatccggatgatccgcgacgtgcaggatctggccgtggccaacgggtaccgggacgtgccggtcgaggagtcgcacgacgtcggtggcttccgggccttcatcccgtggacctaccagccggagaacaaccatctcaagggccgcacccaggccaccacgatggaatacctgcggttcatcgcggtctcccggctgttcttcgacaacgtggcgcacctgcaggcctcctggctgaccaccggcaaggacatcggccagctgtcgctacacatgggcgtcgacgacctgggctcgatcatgctggaggagaacgtgatctcctcggccggcgcccggcatcggtcgaacctgcaggagctgatctcgatgatccgcaccgccgaccgcattccggcctggcgcgacacgtggtatcggcacctcgcggtccaccacacggcggccgaggatccgaccgacgaccgggtggtgtcgcacttctcgtcgatcgcgatgccgggcgggggcgccgggcgcaccccgttgccgcttgtcgaggtcaactag

SEQ ID NO: 2592 - DNA, 855 bp, Actinoplanes utahensis
atggcggtggacctgactcgcatggctgcctccccagggcgtttagctgtacgccgtacacaatacgccgtacaagaatggagtgccaccccgatggctgaagcgcgccgcaccatggacctgctctggtttccggaggcggtcgagcgcaagcgaggccgccgccccgggctgagcgtggcccgggtggtcgagaccggcatcgcgctggccgacgccgagggcctggagggcgtgtcgatgcgccgcgtcgccaccgagctgggtgtggtgccgatgacgctgtacacctacgtcccggacaaggcgaccctgctggagctgatgctggaccgggtctatctcgcgatgccccgcgccgagctgcccggccggtcgtggcgcgaccgggcggccgcgatcgccgaggagaaccgggcgctggtcgccgcgcatccctgggtggccgcgatgccggccagccggccgccgctgggccccggcctgatggccaagtacgagcatgagctgcgcgccttcgacggctgtgggctggacgacgtgacggtcgactcggcgctcaccttcctgctgggcttcgtgcaggccgcggcgagggccgccgccgaggtgcgggccaccgccgagcgcgcccaccagaccgactgggagtggtggcaggagcgcgggccggccctgcaggtggtcctcgacgagcacacctaccccaccgcggcccgggtgggcgccgcggccggcgcggctctgggcgcggcctacgacccggatcacgcgtacgagttcggtctgcgccgggtcctcgacggcctggccgcgctgatcgacggcgagcccgccggtgacccgggccgctga

SEQ ID NO: 2593 - DNA, 393 bp, Actinoplanes utahensis
atgcgagtcaggtccaccgccattgcgctcaccgtcgacgatgtccccacctcgaccaagtttctcgcggatcacttcggctacaccgaacggatggccgccgacggattcgcctccctcgggcgcgaccacaccgggcccgacctgatcttcatgcgccgcggcctggaggtgctgccgcccaccctgcgcgatgtgcacacggccggcacgatcgtcgcgttcgtggtcgacgacctggacgccgagcaggacaggttgcgcgctgagggggtggagcctttcctgccgatccgggaggagccgtggggcgagcggctgctgttggtcagcgacccgaacggggtcgtttacgagctggtggagtgggccgatcccgggtccggccgataa

SEQ ID NO: 2594 - DNA, 3051 bp, Actinoplanes utahensis
gtgctcgtcgttcacggcggctgggcgcccgggtccgggcggcccggtcggttgctgctctgggctgaggagccgtcccgtacggagtcctcctcagcgtcccgtgccaaggtgcggccccacccgttcgccgccacggccaccgtcctgaccacggccctgggcgacctgccgtccgagcccaccgccgggatcgccacgatccagctgcccggcacggcccgcggtccgctgccctcgccggacaccggggtggagacgacctcgccgcggggtgtccggctggccgggtggaccgtgccggtgctcgccgtgcccggtgaggccgccctggccgtgctggccacgatcgccgagccggacccggccgcgccgtgggttcccggcccctccctgcgctatctcggcctcctcgccggctgggcctgcgacctggcccggcacggccggatgctcccgcagctcgtcctggaggagggcgtgccggccgcccggtggcgctccgtgatcaccggtgccgacctcgcgacgtaccgtgacttcgccgccgggatgccgccggtggcccgcgccgtgacgccggccggtcaggccgtgacgccggccggccagcaggccgggcggacgctgcgggacgcgctggagacgatgctcgacgccgccgcgcggtccgtcctgccggaaaagatcctgggcggccaccgggccgggctccgggctccgctggccgaccggtgggtgaccgcgctcaccgcgcccgaccccacactccccggtgcggccgcggccgagctgcgtgagctgcgccgggcgctggacgactggatgcgcgcggcccaggcggcgaatgagccggtccgggtcagtttccgactgatcgagcccgagccgggcgaggacgactgggagctggaattcgccctgcagtccgccgaggactccgcgctctacctgcccgccgaggcggtctgggccggcgagcggtttcccgggctgcctcgccggccggatgagacactgctggccgggctgggtcgggcggtccggttgttcccggcgctgcacgaggcgctgcgcacccagcagccggccgccatgacgctcgacaccgccgaggcatatgacttcctccgccaggccgcgccgctgctgcaggccgccggcttcggggtgcagctgccgtcctgggccggccgcaagggtgtcggcctcaagctgaccacccggtcgaaatccagagccggtacctcccgggcggtggccgactccggcttcgggctcagcgagatcgtcgccttccggctcgacctggtgatcggggacggcgtggtgagcgccgcggagctggccgagctggcccggctcaaggtgcccctggtccgggtccgcggacagtgggtggagctggacgaccggcagctcaaggcggcgctcaaggcggtcggccggcgacgcgagggcgagctgaccgccgccgagatcctgcagcaggtggttgagggcggcgaggaggatctgccgctcgtcgaggtcgacgccgacggcacgctcggcgacctgctgtccggccaggcctcggagcggctcgacccgatgccgaccccgccgggtttccagggcgcgctccgaccgtatcaggagcgtggcctctcctggctgcacttcctgagccggctcgggctgggcgggatcctcgccgacgacatgggcctgggcaagaccgcgcagacactgtcgctgctgctcaccggccaggcggacgagacgcgcccggcagagaggacgttgctgatctgccccatgtcgctgatcaccaactggcgcaaggaggccgctcggttcgccccgagcctgcgcgtctacgtgcaccacggcgccacccggcagcgcggcgaggacttccgggccgcggtggacgcggccgacctggtgctcaccacctacggcaccgcggcgcgcgacctggaggcgctccgcgaggtcgagtggagccgggtggcctgcgacgaggctcaggcgatcaaaaaccacggcacccgccagtcgcaggcggtccgcgccatcccggcgcgcacgcggctcgccctgaccggcaccccggtggaaaaccacctggccgagctctggtccatcatggacttctgcaatccggggctgctcggtccggcgaaacggttccgccgccggttccaggagccgatcgaaatcaaccagagcgaggacgcgaccgccgcactgaaacgggccaccgggccgttcgtgctgcgccgcctcaaaaccgacaagacgatcatctccgacctcccggagaagaacgagatgaaggtctggtgctcgctcaccgccgagcaggccaccctctaccaggccgtggtcgaggacatgatgtccgagatcgagggcagcgagggcatccagcggcggggcaacgtgctggccgcgatgatgaagctcaagcaggtctgcaaccatccggcgcacctgctcaaggacggctcccggttgcccgaccggtccggcaagctggcccgactggaggagctggccgaggagatcgtcgaggacggcgacaaggccctggtcttcacgcagtatgcggagtggggctcgctgctgcagccctacctggcggcgcacctggaccgcccggtgctgtggctgcacggcgggctcagcaagtcccgccgggacgagctggtcgagcggttccagacgtcgccggagccgatgctcttcctgctctcgctcaaggcggccggcaccggtctcaacctgaccgccgccaaccacgtcgtccacttcgaccggtggtggaacccggccgtcgaggatcaggccaccgaccgggcgttccgcatcggacagtcgcgcgacgtgcaggtgcgcaagttcatctgcaccggcaccctggaggagaagatcgacgcgatgatcgagcggaagaaggcgctggcctcggcggtcgtgggcaccggcgaggagtggatcaccgacctgagcaccgaccagttgcgcgagctgttcgccctcgaccccggggtggtgggctga

SEQ ID NO: 2595 - DNA, 837 bp, Actinoplanes utahensis
gtgccgttcgacagatccggcaagttctacgaggcggcgcggccgatcgaggtcgacggcgggctcgcggtccggtcgaaacgcggcgcgatcggcgagcagtggtggtcgcggcggttcgtcgacgtgctggaggggatctgcgatccgggtcggctcgcccgcggtcgggcgtacgcacgcaaggggcaggtgatcgacttcgcgctgcagccgggacagctggtcgcgcgggtgcagggatcccggcccacgccctaccaggtgacgatccggatcagcgcgttcgacgacgcccagtgggcggagatcaccgaggcgctcggcgcgcaggcgctgtaccgtgccgcgctgctggccggcgagatgccgcgggagatcgtcgagctcttcaccgacctgggtttcccgctcttcccggagtcgttggacatcgactgctcctgccccgactggggcgttccgtgcaagcacggctcggccgcgctgtacgtgctggccgaggccttcgacgacgatccgttcctggtcctggcctggcgcgggcgggcccgggagccgctgctcgacgcactgcgcggcaccgccgacccgggtgaggcgatcgacccgctgcaggtcaccgaaaccccgctggacgaccggctcgccgacttctactcccccgggatcagcctgggccggctccgggagcggccggcccgcggtggcgccccgccggagctgctgcttcgcgccctcgatccgccgccgatccgggtccgacacattccgctgatcgacctgctgcgcccgctctaccgcgagttgggcacgccgcatgaggaggaggattag

SEQ ID NO: 2596 - DNA, 957 bp, Actinoplanes utahensis
atgactgagatgagctaccgccgcctcggcgaatccggcctcgtcgtctccgttgtcgggatcggctgcaacaatttcggccgcaaactcgacgcggacggcacccgggaggtcgtcgacgcggccttcgacgccggcatcacgctcttcgacacggcggacatctacggcaccccgcacggtagctcggaggaactgctcggcgccgccctcaagggccgccgggacgaagtcgtgctggccaccaagttcggcatggacatggcggggctgaacgggcgggacttcggcgctcgcggctcccggcgctacatcgtccgcgcggtcgaggcgtcactgcgccggctggaaaccgactacatcgacctctaccagctgcacgagcccgacccggccaccccgatcgaggagaccctgtccgctctcgacgacctggtccgcgccggcaaggtgcgatacctgggcaattccaacttctccggctggcagatcgcggacgccgactggaccgcccgggccgcggacctgaccccgttcatcagcgcacagaaccgctacagcctgctgcaccgggacgtggagatcgaggtggtcccggcgtgtgagcgtttcggcctgggcctgctgccgttcttcccgctcgactccggcctgctctccggcaagtatcggcggggcgagaagccggccgccggcacccggctcgcccaggaccgttacgcgccctggctggagcacgccgactggaaccggatcgacgcgctcaccgccttcggcgccgagcggggccacagtctgctggaggtggcgatcgccggcctggccgcccgccccgcggtgaccagcgtgatcgccggcgcgaccacccccgaccaggtgcacgcgaacgccgcggccgccgcctgggacctgaccgcggccgacgtggccaccctcgacgagatcctcaccgactga

SEQ ID NO: 2597 - DNA, 852 bp, Actinoplanes utahensis
atgagcgacagcgtccgtcggccccgggtcgggcacatccagttcctcaactgcctcccgatctactggggtctgatgcgctccggcgcgctgctcgacgtcgacctgcacaaggacacgccggaccggctcagcgccgccctgatcgccggcgacctcgacatcggcccgatcacgctggtcgaatacctgaagcacgccgatcagctgctgctgctgcccgacctcgcggtcggcagcgacggcccggtgctctcggtcaacctggtctcgacccggcctccggccgagctcgacaaacggccggtcgctctcggttccacctcgcggaccggcgtcctgctggcgcaattgctgctttccgagcggtacggggtggagcccacgtacttccgctgcccgcccgacctgcctctgatgttgcgggaagcggacgccgcggccctgatcggcgaccccgccctgcgcgcgctgtacgaagcgccggccatgggcctgcaggtgatcgacctggccgaggcgtggaaggaatggaccgggctgccgatggtcttcgccgtgtgggcggtccggaaggatttcgcggccgcacaccccggccaggtcaagggcgtgcacgaggcgttccagcggtccaaggagctgtgcctcggcgagctggacgcggtggccgaggcggccgcgcgctgggagccgttcgacgcggcgaccctggccaactacttccgggccctcgacttctccctgggtgaccggcagattcagggcgtccgcgagttcgcccgccgcgccgccgaccgcggcgacgtgccggcgctgccggccgagggcccgcttttcgccgacgtctga

SEQ ID NO: 2598 - DNA, 1227 bp, Actinoplanes utahensis
atgtccttcacatctgctgagtcgcgctggtcggacgtccatctcgtggccggcgggaaggcgatctccctctgcggcgactttctcgccgcgaccaccctcgccctggtcctgcagcagaccgggcacggcggcctcgccgtcgccgggctgctgctcgcctccgccgtcccgatggccgtgctcaccccgctcaccggccggctggtcgaccgggcggacagccgcacactgctggtcacggtcgggctggcgcaggcgctgatctgcgggctgctcgccttcaccacggactcccggctggtcatcgcgctggtcgccctgctcgccgccgggctcgcggtgacccagccgaccctgcaggcgctgctgccgcagatggtgcgggacgacgacctggccaaggccggcggcctggtaatgagcgccggccaggtcgggacgctgatcgccccggcgctggccggattcctggtcgggacgaccgggccgcgggtgccgttgctgatcgacgcggcgagctacctggctctggtggtgatggcgatgctgatccacacccgccggcgcggcgcggtcacccggcaggaggccggcgggccggtcgagttccggctgcgggccgaccggtcactggccgtgatgaccgtggcgatcgccgcggtggtcggtggcgtcggtgcgatcaacgtcttcgaagtcttcttcatccgggacaccctgcacgcctcgaccaccgtcttcggcctggtcacggcctcctggacggtcgggatgctgctcggcggcccgctctgcgcccgactgccgcgacaccggctcaccgtccggacggtgctcgccgtactggccggctcctgcctgccgatcctcgccgcggcggccgtcggcagctgggcctggctggtgccgctctggatcgtcggcggggtgtgcaacggcgcgctcaacgtctgtatgacggtgatcatcgcggaccgggtgccggccgcggcgcacggtcgcgcgttcgccggggtcgccgcggtcgtgcagggcgccggactgctcggcttcctggtcgccgggccgctggtggaggccttcgacccgcggctgctggtcggggcggccggcggggccgggctgctcgccgcgctctgctgctggccgctggtgcgacttcagccacgagaggccccgtcgctgggcgaacccgtcgtggtcggggataccgtcacctcatga

SEQ ID NO: 2599 - DNA, 798 bp, Actinoplanes utahensis
gtgggtgcgttcggcgtcgagttgaacatcgagatcaggcgcgggcacgggcatcctcggcaggtcgttgctgcggctgcgctcgcgtatccggtcgtgcggatgggccgccgccggcgcggggacgcccgctgcggtgcatgctcaccacggccgtcaagcggtcctccacgctacgcctccccgcagcgctgtccaccgaatttccggcggtacgacaatgggggcatggctgagcgggagaacgtgcgggtgtcggatgcgcggacgctgcgggcgctggcgcatccggcgcggatcgagatcgtggatcacctgaacgtctccggggcgacggtcaccgcgaccgagatggccggcctcgtcggactgtcgcccagcgcgaccagctaccacctgcgtgaactggccaagtacgggctggtggagcaggcgccgagccagggcgacggccgggaacgccggtggcgggcgaccgggaagaacctgtggctggaggccgaggtggagcagccggaagcgctggccgccgagcgcgcgctgatcgacatgtatctgagccgggaccgggagcgcatctacgagtggctggaccggcagggcaccgagaccaccgagtggcgggaggccagcgtcatcatgggccagcagctgctggtcagcgcggccgagctggccaagctgaacgagcaggtcaggaccctgatcgagccgtaccgggtgcgtgatcggcaggagaacccgacggacggcgcgcgccgggtggcggtgcagtatctggcattcccgatggactga

SEQ ID NO: 2600 - DNA, 867 bp, Actinoplanes utahensis
atgccccgcctcggagtgatgttcgaccgcgatctgtcccccgaagacctgccggccttcgccaccgccgtggaggaggccggcgccgacgacctctgggtggtggaggacctcggctgggccggttcgatcagtgcggccgcactggccctggccgccacctcccggatccgggtcgggatcggcatcgccccggccccgctgcgcagcccggcgctgctcgcgatggagctggccatgctggcccgggtccagccgggccgcctggtggccggaatcggtcacggggtgtccgagtggatgcgtcaggtcggcgtcgagccgacgtcgaaactggccatgctggaggagacggtccgggccgtccggggtctgctgcgcggcgagacggtgacgctcgacgggcgggaggtgcacatcgacggcgtacgcctggtgcacccgcccgcggtcgtcccgccgatcgtcaccggtgtggtccggccacgttcgctggagctgtccggccgggtcgcggacggcacgatcatcgccgagggcaacggcccggcgcagttgcgggacgcgctcacgcacatccggcggggtggcgccgacgacggtcacgagctgatcgtctttacgtatctgcacgtcaacgacgatccggcggacgccgcgagggtgaccgggcagatggtcgagggccaggccggctggctcggcgtaccgccggaagaggttttctcgctgatcggcccggtcaccgaggtgcccggcaaggtcgccgcgctgaccggggcgggcgccgcgacgatcgtcctgcgaccgctgggtcccgatccggttccgcaggtcagggccgcgctggccgctctcggtcgctga

SEQ ID NO: 2601 - DNA, 1215 bp, Actinoplanes utahensis
gtggatgaccttctggtggcgctctgcggcaaccccgcgctgccgcccgccctggtcgaccgcctgatcgggctggccgccgagaacgccgccgcgaccgccgccgcgaccgccggcaagaacgccgacgtccgcgcgatggtcgcgggcaacccggccaccccgccggagacgctcgtcgtcctggtcgcgaacgacccgccggccgcggtgtgccgggtctgcgagcaggagccgatcccgttccggcacgacccggactgcctgcggggcgactgcaccctgccgcccggcgcccgctgcaccggcagccacgaatccgctgtccacaacctgcggcaccgggctgtggacaacccgtccacgccggccgggacggtcgcgcggctggccgtggatccgccgctcgccctgcggtatgccctggccgcacggcccgacctgccgcactgggcggccgagcggctggtcaccgacccggcaccgggcgtccggcacaccctggccgagaacccgggcctggcgcccgacctgatcgagcgcctggccggggacccgctggcaccggtccggcagcggctggccaggaatccggcgctgccgctggcggtgctggcccggctgaccggcacgacccggatcgggccggtcctgctgccccgggtcgcggccgcgaccgaggccgaggtgcgcgatctcgcggcgagcgccgacccggagctgcggatgctggtggcggtccggcgggacctgccggacgacgtgcgggacgcgctcgccgaggatccggacgcgaaggtggtcgcggcggtggccggacatccggggttggccggggcggtgctcgggaggatggtggcggttcacggcgtacgcgtcaattgtcaggtggccggaaatccggacgcgcccgcggacctgttgcggcagctcgcccgggggattccgcgcgtgccgaaggcactgcgcgagatcgcgcgccacccgaacgcggacgccgcgaccctggagctctgtctcgccacagtggagccgtcggactatcgggcgcgggcgatcgcggccgggcacccggcactgccacccgggcggatcgccgcactgctcgccgacccggacccgcgggtggccgaatcggcggccggcaacccgtcgctgccggtcgccgccatgatccggctggtcagcgaccgagagcggccagcgcggccctga

SEQ ID NO: 2602 - DNA, 1479 bp, Actinoplanes utahensis
ttgccgcagagcgccaccagaaggtcatccacgaacgagcatcctgacccctgcggcacccgggcggaaggctcgctccattgcggattcgtctcactgcgtggaatcgccgagcgatttcacccaacgcgaccactcgcgttgactccggtagccgtacgcggcccagatgccgtgcgccccggtgttggcgtccaacaccatcgcgtccgcacgggtaccgcccagcgcacggaaccgctgctcggcggcggcgatcaggcgaccaccgagcccggcgcggcggcggtccggggcgaccgccagccggtagaggtggcaccgccagccgtcccagcccgcgatgatcgtgccgacgatcttgtcgccgtccacggccaggatcaacgcctccggatcccgacccaccagcgcctcgaccgccgccggggtatccgccggccggctgtcgttctccgccgccgacgcccagaaatccaggatccggctccactcggaagcctgcgccgctcgcaagatcacatctcccacgcaaccaccttaggaccccgcgccgcgcgtccggcttggcggcgggaagtgaccgattccgtacgcgcccattccccgctcgcgtccggcgaccgatcgtcgtcctcatgccgcccggcactcggctggtggatgggcgacagtttcgcccgggcggccgtgtccggatgcgaccatgcggctatgaccgctccatcgcccagcgggcccaactgggtggatctggccacgtccgacctcgacgccgcgatccggttctacacgagcctgttcggctggaccgccgacgtttccggcgacgacttcggcggatacacgacgttcctgctcaacggcctgccggtggccggtgccggcccgctctacggcgaggggcagcccaccgcctggagcacctacctggccaccgccgacgccgatcggagcgccgccctggtcgaggccgccgccgggaaagtcctggtcgccccgttcgacgtgatggatcagggccggatggccgcgttcctggacccgtccggcgctccgttcagcgtctgggagccccgctcgatgcgcggcgccgaggtcttcgacgtccccggcgccctcacctggaacgagctgaacacccgcgacctggacaccgcgcgcaccttctacggcgcggtcttcggctggacgttccgcacggccgaggtcggcggcctgccctacctgctgtgcgacaacggccgccggccggtcgccggcatccacccgatgaccggggacggctggtccgacgacatctcaccgtactggctgacctatttcgccaccggcgactgcgacgccgccgccgaacacgccttcgccctgggcggccgcatcatcagcccgccgacgacgatcccgatcggccgctacgccgtgctcaccgacccccagggcgccaccttcgcgctgctcaccaccgcccgccgatag

SEQ ID NO: 2603 - DNA, 438 bp, Actinoplanes utahensis
gtgggagatgtgatcttgcgagcggcgcaggcttccgagtggagccggatcctggatttctgggcgtcggcggcggagaacgacagccggccggcggataccccggcggcggtcgaggcgctggtgggtcgggatccggaggcgttgatcctggccgtggacggcgacaagatcgtcggcacgatcatcgcgggctgggacggctggcggtgccacctctaccggctggcggtcgccccggaccgccgccgcgccgggctcggtggtcgcctgatcgccgccgccgagcagcggttccgtgcgctgggcggtacccgtgcggacgcgatggtgttggacgccaacaccggggcgcacggcatctgggccgcgtacggctaccggagtcaacgcgagtggtcgcgttgggtgaaatcgctcggcgattccacgcagtga

SEQ ID NO: 2604 - DNA, 270 bp, Actinoplanes utahensis
atgaccgacacgatggtggttgagctgggactgcaggccatgacgatcgcggcgaaggtggcggcgccggtgctgctgaccgcgctggcggtcggcttcgcggtgtcgctcttccagtcggtgacgcagatccaggaggcgacgttggcgttcgtcccgaaggcggtggcgatcggtgcgatgctgctgttctccggcaactggatgctgcacgagatgatcacgtacaccggtcagctctttgacaagatccccgacctgctgcactga

SEQ ID NO: 2605 - DNA, 135 bp, Actinoplanes utahensis
gtgcagaccggtcgcgccccggttgcggttcggttcgcaccccgcactttcctcaagtcggccgcaccactgccgcgcgaccggcaacgagcccggccggctcaggagcggaccgccaccaccagcgggccgtga

SEQ ID NO: 2606 - DNA, 792 bp, Actinoplanes utahensis
atgagcagccccggtcgcgagaccgcggcgattgcggtcgccgatctggcggtacgccgggacggggcgctgatcgtcgacaacatcaccctgagtgtcggcgagggcgagtgggtgacggtgatcggcccgaacggcgccggcaagtccacggcgctgcgagcggtggccggcctgctcccgttcaccgggtcggtccggttgtacggcagcccggtcgaccggttgcaccgccgggaccgggccaaggcgatcgcggtggtcatgcagaaccccgtcgtcccacccgcgatgaccgttttcgactacgtactgctgggccgcaccccgtacatcccggcgctcggccgggaatccgccgccgacctggccgccgtcgacgaggagctggccgcgctcgacctggtcccgttcgccggccgccggctggacaccctttccggcggcgaacgccagcgcgtcttcctggcccgggccctcgcccagggcgcccggatcctgctgctcgacgagccgaccagtgccctcgacatcggccaccagcaggaggtcctggagctggtggaccggctgcgggcggagcgtgccctgaccgtgctggccaccatgcacgatctgtccaccgccggggagtacgcggaccggatggtgatgctcgccggtggccgggtggtggcggccgggacgccgacggaggtgctcaccgagagcaacctggccgagcactaccgggtcagggtccgggtgatcgccggcgatcacggcccgctggtggtggcggtccgctcctga

SEQ ID NO: 2607 - DNA, 1044 bp, Actinoplanes utahensis
atgagaccggccgggctccgcccggcctggctgctggccggcgtgctgtccgtgctggtcgcggtcaccgccggcctcgcgttcggctcggtctcactgccgcccggcggcgtcgcggccgaactgctcaacctgatcccgggggtccgcctgcacagcgggctcagcgaacgcgacgtcgcgatcctgatggagctgcggctgccccgggtcgtcctcggcctgctggtcggggcgatgctgtcgctggccggcgccgcctaccagggtgcgttccgcaatccgctggccgacccgcacctgctcggggtcgcggccggcgccggcctgggggtgaccgcggtgctggtgctgcgcccggccggtgcggccgaggccggtctgccgatcggcgtgccggccgccgcgttcgccggcgcgctgatcgcggtcgctctcacctgggtgctgggcgccgtcggtggccgcgaccgatcgccggccgcgctgattctggccggggtggcggtctccgcgttcctcgccgcgatgcagacctacctgctgcagcggcacgtcgagtcgctgcgcgaggtgtattcctggctgctcggccggctcgccaccgccggttggcacgacgtgctcgtggtcctgccgtacacggtgctgaccgcggcgatcatgctgacccagggccgcgaactggatgtgctgaccgtcggtgacgaggaggcgaccagcctcggcctgcatccgcagcgtagtcgctacctgctgatcgtcgcggcgtcgctgggcaccgccgcggcggtctccgtctccggcctgatcggattcgtcggcatcatcgtcccgcacacgctgcgcctgctggccggccccagctatcgctcgctgctgccactgtcggtgctgttcggggccgccttcctgacccttaccgacctgctggcccgggtcgccggcggcgccgcggagatcccgatcggggtggtcaccgcgttcctgggagcgccgttcttcgtcgtcgtgctgcgcacgacacgatcggccgccacatga

SEQ ID NO: 2608 - DNA, 930 bp, Actinoplanes utahensis
atgaaacgcgcgatcatcgccgctaccgcggctgcgctgctgctcaccggttgtggtgacaaggcggactcgacgaaggagccggccgccgcggcgagttcggccggcaccggcttcccggtcacggtcggcccactcaccctcggcgcccgcccggagaagatcgtctcgctgagcccgaccgccaccgagatgctcttcgcgatcggcgccgggccgcaggtcaccgcggtcgacgaccagtcgaaccatccagccgaggcgcccaagaccgacctgtccggcttcaaaccgaacgccgaggcgatcgcggcgaagaacccggacctggtcgtgctctccggcgacgccgaccagatcgtcgctcagctgggcaagctcaagatcccgacgttcgtgtcgccggccgcggcgtcgcttgacgacacgtaccgggaaatcgacgaacttggttcgttgaccgggcacagcggcgaggccacccagctcagccagacgatgaagactgagatcgatcagatcgtcaagggcgtgccggcgcgcaccaagccgctctcctacttctacgagctggggccggagctgtactcggcgacgtcgaagacgttcatcggcggggtgttccacctgttcgggatgaccaacgtggccgattccgccgatgccgacggcagtaagggcggctatccgcaactgtccgcggagacgctggtcaaggcgaacccggacaccgtcttcctggccgacaccaagtgctgccggcagtccgcggacagcgtcaaggcgcgcaagggctgggcgtcgatcaccgcggtgcagaagggccggatctacccgctcgacgacgacatcgcgtcccgctggggcccccgcaccgtcgacctggtcaaggccgtcgccgacgcggtgagcaaggtccccgcgtcatga

SEQ ID NO: 2609 - DNA, 414 bp, Actinoplanes utahensis
atgagtcccgccgtcaaatacacgctgggccgcatcggcctgttcctggtggtgttcgccgcgctcttccccttgccgctgaacatcctggtcaaggcgatgatcgcgttcgtcgcctcggccgggttctcgttcttcgtgctccgtaagtggcgggacgagatggccgagcagctcggcgcgtccgcccagcgccgcgccacggagaaggcgcggctgcgctccgccctggccggcgacgacgaggccgccgcggccggcgaccgggtagcggccgccgacgccaccagcggtggcgaccggatcgccgacgccgctgcggccggcagtgcggacaccgagacggctgccgccgccggcgagatcaaaaccgagggcgccaaggcggagggcagaacggaagccggcaagtag

SEQ ID NO: 2610 - DNA, 378 bp, Actinoplanes utahensis
atggcgacggtgggcgatctgctcggtgcggccttcgccgggctggtcgtcggcatcgccgtggtgctggtgctggaggggatcctggtgctgaccggggtgtcccggttcggtcaaaccaacggctggctgatcctgatcctgccggtgtggctcttcgtcgagcagttccgggcggccggcttcggtgccgaccgggtgctggcggcggtgctgggcatcgggttcggtgcggccgccggcatgacgatcgccggtgtcgtcgcaccgtatgctcctcccctggtgagcggcggcgccggtgcggtgaccgccgcggtcgtccactgcttcgtctggttctacggcctccgctggctgcgccagcgctccggctga

SEQ ID NO: 2611 - DNA, 1170 bp, Actinoplanes utahensis
atggacgccggtttgaagcgtgacctcgaggcgaaggtctacgccggtgagcggctcacccgcgaggacggcatcgcgctctacgacagcgacgatctggcctggctcggccggctggcgcaccaccggcgcaccgagctcaacggcgaccgggtgatgttcaacgtcaaccgccacctgaacctgacgaacgtctgctccgccagctgcgcgtactgctctttccagcgcaagccgggggagaaggacgcgtacacgatgcgcatcgacgaggcggtccgcaaggccaaggagatggaggacgagcagctcaccgagctgcacatcgtcaacggcctgcaccccaccctgccctggcggtattaccccaaggtgctgcgcgagctgaaagccgcgctgccgaacgtcaagctcaagtgcttcaccgccaccgaggtccagtggttcgagaagatcagcggcctatccgccagtgagatcctcgacgagctgatggacgccgggctggagtcgctgaccgggggcggcgccgagatcttcgactgggaggtccggcagcacatcgtcgaccacgcctgccactgggaggactggtcgcggatccaccggctggcccaccagaaggggatgcggaccccggccaccatgctctacggccacatcgaggagccccggcaccgggtcgaccacgtgctgcgcctgcgcgagctgcaggacgagaccggcggcttcgccgtcttcatcccgctgcgctatcagcacgacttccacgactcggcggacggcatcgtccgcaaccggatccaggcgcgcaccacgatggccgccccggccgagtcgctcaagacgttcgcggtctcccggctgctgttcgacaacgtgccgcacgtgaagtgcttctgggtcatgcacgggctctcggtcgcccagctctcgctcaacttcggcgccgacgacctggacggctcggtggtcgagtacaagatcactcacgatgccgactcgtacggcacgcccagcaccatgcaccgcgacgacctgctgcacctgatctgggacgccggcttccagccggtcgagcgcaacacgcggtacgaggtcgtccgggagtatgagaagccggtcggcctggccgagcggcgcagcgaaccgcagaaggtctgggcctaa

SEQ ID NO: 2612 - DNA, 1545 bp, Actinoplanes utahensis
atgtcgaaggcactgcggtacggacaggattcatcacgctccgtgcatgcgcgactccgacccgtcactctgtcggcggctgtcgcggcagcactggctgcgctgttccagccgatcccggcgatggccgcgcccggcgacggccagccgatctcggccggtgtgccggattccggctctcgccccacccaggtcggttccctcgtgctgcccaacacgccgatcagcaccacgccggtcagcaccatccccggctcggcgaccaacaaggtgctccaccagatcgagcagggccgcatccaggtcgaccagctcggtgaccagctgctccagctgaaagccgaccgcgacctcgcccagggccaggtgagcaccgcccaactgaaggtgagcgaggcgcagaccggcctgcagagcgcccagaccgacgcggtcaccgcggccggtcaggcgatgcagcaggccgccgcggtcccgcccggcgcgctcgactccggcctgctcggcctggaccagctggcccgcctgcagcgcggcgagaaaccgaccgacgccacgaccgcccagcacctggagtccgccgagatcgccgcgcagatcgcgatcgacgagcagaccctcgccaccgagaaatacgacggcgtcctcaagcagtacgagaagctgaacgccacgctcaccaagaagcaggccgcccagcagaaactggaagccgcacacaaggacgagctggccgccgccgagagcgtcgcgaacgccgccgaccaggccctcggcgcgcagtatctcggcggcgcctcggccggtcgcggagccgacccgcgggcgatccaggcgctgcagttcgcgctcgcccagcgcggcgatccgtacgtgtggtccgaggagggccccgacgcgtacgactgctccggtctgatcttcgcctcgtaccactcggtgggctatcccatggtccgcgtctcccgcgaccagtactggcagacccgcaacaaggtcgtcgaccggtattcgctggtccccggcgacctgctgttcttcagctacaccaacagctggaccggcatccaccacgtcgcgatgtacgcgggcaacggcatgatggtcgaggccccgcgcaccgggctgaacgtgcggctcgtgccggtccggtggagccagctcttccaggccacccgggtcttcggctcggtcgagggcggcacgaccggcatcccgctgggcaccgccgatccggaggagccggccaccggcggtggcaccaacggtggtggccacaccggcggtggcggcgcgaccccgagcaccaaaccgaccaccaagccgagcaccggcggctccagcacgccgaccaagaagccgcggccgccggcgagctccgccccggccaagccgtcccccacgccgggcccgtcgagcagcagcccgagcaccggcacctcgacgccggccggcggttccagctccggcgggaccagctccggcggcacgagctccggtggcaccagctccggtggcaccagctccggtggcaccactagctag

SEQ ID NO: 2613 - DNA, 627 bp, Actinoplanes utahensis
atgtcccacggcacccccggtaattccgacatgaccatgccgatcaacctggccacggccggcagcgacatgaccatgccggtgaacctcgccgcctccggcaccagtgacatgaccatgccgatcaacctggccgcggcgaacgccgacctcaccatgccggtcaacctggccggggcgaacgccgacctcaccatgccggtcaacctggccggggcgaacgccgacctgacgatgccggtgcaccttgccggagcgaacggcgatctgaccatgccggtgaatctggcgatggccaccaacatcgactccaccatgccggtgaattacgtgccgacccagccgggtccggcgcagcgcggcagcggtcagatctacagcaccggcggctacccgtcgatcgacatgacgatgccggtcagcgacccgtcggagaattccggttcgctgaccgggcacattctcgcccagggttggcacgacgcccaggtcgaccagcggcgcggcaatttcaaggtcatcgtggccatgctgatcgtgctggggctgctggtcacggtcagcctggtgttcgtgctgaccgtcggcagcagcctgagcggcatgttcaagagcttcggcggctga

SEQ ID NO: 2614 - DNA, 1980 bp, Actinoplanes utahensis
ttgaccactttcgctgatcccagcacgttcccgtccgttttcgagagcaacagcaccgagaccaccgaagccgtcgacaccgccacggcccccgccgcggagcaggagcagtccgcagccgccgcggagcaggagcaggccgcagccgccacggagcaggagcaggccaccgagccggccactgccgagcaggccgccgccgaaccggccgccatcgccgaggagcaggcagccgagcaggccgaggagcccgccgccgagcaggcgcccgtcctcaccttcgccgacctgggccttccggccgagatcgtgcgggtgctcacccgtgagggcatcaccaccccgttcgagatccaggccgccaccgtgccggacgcgctcgccggccgtgacgtgctgggccgtggccagaccggctccggcaagacgctggccttcggccttccggtgctggcccgcaccgcgcagggtggcaaggcccgcccgcaccacccgaaggcgctgatcctggtcccgacccgcgagctggcgatgcaggtcgccgactcgctgatgccggtcggccgcgcggtcggtgtcttcctgaagaccgcggtcggcggcgtgccgtacgaccggcagatggacgccctgcgccgcggcgtcgaggtgatcgtcgccaccccgggccggctcgccgacctgatcgagcgcggcgcctgcaagctcgacgacgtcgagatcaccgttctggacgaggccgaccagatggccgacatgggcttcctgcccgaggtcaccgacctgctgtcgaagacgccggagaacgcgcagcgcctgctcttctcggccactctggacggtgacgtggacgcgctggtgcagcggttcatgcacgacccggtgacccactcgaccgcgccggccgaggccagcgtgtccaccatggatcaccacctgctgctgatcccgccggccgagaagttcccgatcacctcgtggatcgcgaaccgggccggcaagaccatcgtcttcgcccgcacccagatgggcgtggaccggctggtcgagcagctgcacgcggtcggcgtgcgggccggcgccctgcacggcggcaagacgcagcgggtgcgcacccggaccctggccgagttcaaggagggccggacgaacgtgctggtcgccacggacgtcgcggcccggggcatccacgtcgacggggtttccctggtcgtgcacgtggacccgccgaaggacccgaaggactacctgcaccgggccggtcgcacggcgcgggccggcgagtccggcgcggtggtcaccctggtgctgcccaagcagcgccggaccacccagcagatgatggccaaggcaggcgtgtccccggccgaggtgcgggtgcggatcggcgacgagaagctggccgccatcaccggcgctcaggagccgagtggtgtcccggtggtggaggagccggagccgcggcgtgagcggtccggtggcggccgtcgcttcggcggtggcgaccggggtgaccgtccgcgctacggcgaccgtccgcagcggtcctacggcgaccggaacgaccgcttcggcgaccggccggccggcggcggctaccgcggcgaccgcccgaccggcggcggctaccggggcgaccgtccggctgacggcggctaccgcggcgaccgcccggccgagggtggctaccgcggcgaccgtccggctgacggcggctaccgcggcgaccgtccgaaccgtgagcgtggcggtttcggcgaccggaccgaccggcccgccgccgaccgcggtggcttcaacgaccgggaccggccgcgcgccgaccgcccgttcggggagcgcaccgaccggcacttcgccgaccgtccggcccgcaccggtgaccgtccgtccggccagcgccgcgacgggcagcgcatcgaccggcgcgagggtggcccgggacgtttcaactcgtcccgcccggcccgcagccactga

SEQ ID NO: 2615 - DNA, 642 bp, Actinoplanes utahensis
atgggcgttctttccacagggttgttctgggaacgccgggatgtccccggtagcgagcatgtgcgcctcgacgcccggaacgggttgtatgcgcagggcaccgcgctggccgcggcgccgatcggttacgcgtgccactacgagatccagaccgatccgggctgggcgaccgcgcggctggatgtgcgcgccgagggtgccggctgggcccgcggggtgcgtctggagctggccgccgggcggtggcgggtgaccacctccgagcagggcgatctggatgcggcgctgctggccgccgggcacgcccgggccggtctgcccgggatcgaggacccggatctgctgtacggcgcgttcgacgccgacctgggtggttccccgctgaccaacacgctgccgatccgccggctgggcctgctcagcggggaaagcgtctcccaccggctgagtgtcgcgtgggtgctcgtgcccagcctggaagtggtgcaggcggaccagatctacacgccgctgggcgagggccggatccggttcgcgagcgagacgttcagcgccgacctgaccgtcgacgacgacggtttcgtcaccgactatccgggactggcccggcgggtcgtcacacccgctcgcggatccagctga

SEQ ID NO: 2616 - DNA, 1395 bp, Actinoplanes utahensis
gtggaagaagcttcgcatccggtggcgccaccgctggaaagcccggcggtggcgccgttcgggtcgctggacggccccgtgctcgggccgtgggagggcccggcgctcgcgcccacgaggcagcgccggacggcttttctggccgcggtgaccgccgtcgtcctcgcggtcgccgctgcgggcgccgtgctcctctggccgtcctccgacaagccggcgaaagccaccgccaccacgagaccgagccgccccccgacgccgttcgaggaggcgctggcgctgctgcaggggcaggcgacagccctggagaggggcgaccaggaaggctggctcgccccgctcaacccggcgaacaccaggatggtcgatcgttaccggaccatcttcaccaacctgcgggctctggagctcagccacgcggagttccacgccacccgggtcccggaccagggcaacgactcgacgatcgtcgccgaggtgcagctcgcctattgtctcagtggcgtcgcctgccccagctggcgcaaattctccttcaccgaggggccgcccgaggccgcgtaccgggtgaccttcaccagggtcgccggggtgttccagatcgtcgcgatgaccgagaagatcgcctccgaggacaacgacctgcagccggcgccgtgggacggacgggagctgaccgtggtgaagggctcgcgggtgatcgtggccggccccgccaatcaagccaagctgatcagccaggtgctgccgatggcggagaaggccgccaaggtcgtcgacaggtacgccggctacatccacaccgagcagcggcgctaccgcatctacatcgccgatgagcagggctggaagacctggtacgggggcggcaaccagaagtgggtggtgggctacgagattccgctgaacgccaccggcggcgacgtcatcctgcgagccaaggtctccggcgacttcagcgcgctcgcggtcaccatccagcacgagctcacccacgtggtgaccgtcgcggagggctaccacggcgatcatgacgagcagtggctggtcgaggggatcgccgagtacatcggcgcgctgccgaagaagccccaggacacgatcaatcacctggtgttgaaggactcgttcgcccggcgcggggtgccgaagagcatcgcctacccggcgctggcccgcaacgccgacgacctgaccgtcgacaccctgtacgcgatgggccactatgccaccgcgtgcatggccgcccagtacggcgagccgaagctgctgcagttcaccagccaggtgctgcgcgacgggaaggcgccggacgaggctgcacaggccacctacggcaaaccgttcgcggcggtggacaaggcctgcctcagctggatccgcgagcgggtgtga

SEQ ID NO: 2617 - DNA, 450 bp, Actinoplanes utahensis
atggactccatcgacctccggctgatcgacctgctacgggagaacgctcgctcgtcgtacgccgagctggcccgcaaggtcgggctctccgcccccgcggtgcacgagcgggtcggtaagctcgaggcggccggcaccatccgcggctaccgcgccgacgtcgaccacgaggcggtcgggctcggcgtcaccgcgctgatcggcatcgtcgaggactccggcgccgacaccgacgacgtgctcgccgcggtgcgcgccatgcccgaggtggagagctgctatttcatggccggtgtggagtcgtatcaactgatcgtccgggtcggcacgatcgccgagctggagcagctgatcgtccggatcaaccggacgccaggggtggcctcgacccgtacggccatcgcactttccacgaaatgggagaaccggccgcagcccggcgtaggctga

SEQ ID NO: 2618 - DNA, 276 bp, Actinoplanes utahensis
gtggacactggagaccgtctgctgacaccgggcgaggtggccgcattgtttcgcgtcgatccgaaaacggtcacgcgctgggccgcagccggccgtatcggcagcatccgtactccgggtggacaccgccgattccgcgaatccgaagtcaaggcccttcttgagggcgacggcgtgatcgaggagatgcgcgaggacgacgcggccaacaagccgcggaacagcggcccggccaacccgggtgcgggttacggcccgccgaacggcctgcgctga

SEQ ID NO: 2619 - DNA, 618 bp, Actinoplanes utahensis
atgcgacaaccctggatcgtcggtgtctccggagcctcaggcaccccgtacgcgcgggcggtgctcaccgcgctgctcgacgccggcgaggcggtcgacctggtcgtctcccgggcggcccggctcaccctgctcgacgagaccggggcgacgatccgggatgcgcactggaaggacgacgtcgccgcgtggctcggccgggacctgggtgacctgacctactggccggccggtgacctggcggccggcccgagcagcgggtcgtatccggcgcgcgggatggccgtggtgccggccagcacggcagcgtgcgccggcatcgccgtcggtctctccaaggatctgttgcagcgcgccgccgaggtcaatctcaaggaacggcgacggacagtcatcgtgccgcgggagaccccggtgacgcgcagtcacctggagcacctgatcgctctgcacgatgccggtgcggtggtgctgccggccagccccggtttctacgggtccggtgcagacgccaccgcacagcaactcatcgacttcattgcgggtaaggtgctggactcgctgggtgtggaacacaccctgatgcggcgatggaacgggcgactcggcgagcgctga

SEQ ID NO: 2620 - DNA, 891 bp, Actinoplanes utahensis
atgacggccgtcgcaccggagaaacccggcaaggtcaaggcgtttctgcggttggtgatgatcgagcactcggtgttcgcgctgccgttcgcctacctgtcggcgctggtcgcgatcgaccgggacgggaccgggcggcactggctcgacctggtgctggtcaccgtcgccatggtgtccgggcggacgttcgcgatggccgccaaccggatcctggaccgcaggatcgacgcgctgaatccgcgtacgcagaatcgggagctggtgaccggcgcggtgagcgtccggaccgcctggaccggcgcgatcgtctcgctggtcgtcctgatcctggccgcgggcctgctcaacccgctgtgcctggtcctgtcgccgctcgcggtgatccctctggtgatctacccgtacgccaagcggttcaccgacttcccgcactacgtgctggcgctggcccaggcggtggccccggtcggtgcctggctggcgatcaccggcaccttccacggttccggcccggcctgggtgctcggggtcgcggtcggcctgtggatcggcggcttcgacatcatctacgcctgccaggacgtcgaggtggaccggcggatcggggtgcactccacgccggcccggttcggggtgccggtcgcgctgcacatctccacggtcacgcacgtggtcacgttcgcgctgttcgtgctcttcggccagctcgtcggactgggctggctgtggtggatcgggctggcgctgaccgcgggtggcctgatctaccagcacgtggtggtgaccccgaccgacctgtccaaggtcaaccgggcgttcttcaccgcgaacgggttcatcggcatcgcactgttcgtcttcgcggtgctcgacctggccgtcctgtaa

SEQ ID NO: 2621 - DNA, 1755 bp, Actinoplanes utahensis
ttgctcacgcgtacggccgattcgagaacgttggcccggcaggcgcccggtgccgagcgggaggccggcgccgaaggcggccgggtcgagggcggaccggccacgccgcagaccggcagccggcccggacgcgcggaattcgccgggctggccaccgcgagcgcggccaccagcccggccagcgcgcaccagcgcgccaccctgcggagcgtcacgacccctcaacgcgaatcgcagatcacgagtgacggcccccgggagccggcggcgcgaagcggtgccagactggtgcgcatggcgtctcgtgggtttccctatgccgatctgcagagtttcctggccgccctggaaaaggccggtgagctgcggcgggtcaccgtcccggtggacccgacactggagatcagcgaggtggtgacccgcaccgtccggtcgaacggtccggcacttgtgttcgaacggccgacccggggcgagatgccgatcgcgatcaacctgttcggcaccgagaagcggatggcgatggcgctgggcgtcgaatcgctcgacgagatcggcgaccggatcggcgcgctgatcaagccggagctgccggtcggctggtccgggatccgcgagggcatgggcaaggtgctgcagctcaagtcgctgccgccgcgcaaggtcaagaccgctccgtgccaggaggtggtgctcaagggcgacgaggtcgacctcgggaaactgcccggcctgcaggtctggcccggcgatggcgggatcttccacaacttcgggctgacccacaccaagcacccggagaccggcaagcgcaacctggggctgtaccggctgcagcagcactcgaagaacacgctcggcatgcactggcagatccacaaggattcgaccgcgcaccacgcggtcgccgagcggctcgggcagcgcctgccggtggccgtggcgatcggcgccgacccggtggtctgctacgcggccagcgccccgctgcccggcgacatcgacgagtacatgttcgccggtttcctgcgcggcgagcgggtcgagatggtcgactgcgtcaccgtgccgctgcaggtcccggcgaacgcgcaggtgatcctggaggggtacctggagccgggggagcggctgccggagggcccgttcggcgaccacaccggctactacaccccggtcgagccgttcccggtgctgcacatcgagtgcatgacgatgcgcaggaagccgatctaccactcgatcgtcacctcccagccgccgcaggaggaccacgggctgggcaaggccaccgagcggatcttcctgccgctgaccaagctgctgatcccggacatcgtcgactacgacatgccggccgccggcgtcttccacaactgtctgatcgtgtcgatccgcaagcgctacccgaagcacgcacagaaggtgatgaacgccgtctggggcgcccacctgatgtcgctgaccaagctgatcgtggtggtcgacgaggactgcgacgtgcacgattacgccgaggtggcgttccgggcgttcggcaacgtcgactacgcgcgcgacctgctgctcaccgaggggccggtggatcacctggaccacgcgtcctaccagcagttctggggtggcaaggcaggcgttgacgccacccgtaagctgccggccgagggctacggccgcggctggccggaggagatggtgatgagtcccgaggtgaccagcctggtggacaagcgctggaaggaatacgggatatga

SEQ ID NO: 2622 - DNA, 657 bp, Actinoplanes utahensis
gtgagcaagccgcccgggttcaccccgagcggctaccaccacctcggtgcggcgaccagtgccgagtggagcggcgtgtccggccgcttcggtgtggtggacacgacgatccggcccggcacctacgacttcatcgcctcccgcttcatggtgaaacgggacctgggcaaggggaacatcgcctggctggaggccgggtggtcggagaccgggtgggcgtcggcgggacgcccgcacatctacacctacaacaccaacaccaaggcgtggcagttctacgaccagtatccggtgaagcccggcgacacggtctggctggacctgcacaccgactcggacggggtctggcaggcctggctgtggtggagcaaccggtggaacctgctgaccgcgcagaagctgccgatcggcggcagtgccttcgtcgagcagtacgtcgaggtccacgtcgacgacaccaagccgggccgggtcgacgtccccccggtgaaggtggacaacgtgcagttgcgcccggccggcggcggtccgccgcggttctggcgcgaggacgtcggcaccctcaccggtgtcgcccccggcctgcagcagaccagcggcggttactgcctgaactgggtgacccgcttcgacacctgggacgccggcgactgctag

SEQ ID NO: 2623 - DNA, 975 bp, Actinoplanes utahensis
atgggacagctgtccaaccagctgatggcgctgaccgtgctggcctacctgaccgccatggtctgctacgccggggagtacgcgttcggcaggcgcagcctgatcggcaaggcggccgcgcgaccggcccggcagctggtcggcgcgggcgccgcggccccggtcgccgccgatgtgccgccggtcgtcgcgacgccggtgcggcgtgaccgcggcgagctctccgggcggatcggcgcggccgtcaacgtgctcgccctggtcctgcacgcggccacgctggtcgcccgcggcatcgcggccgaccgcatgccgtggggcaacatgtacgagtacatcctctccgcgaccttcgtcgggtcgacggtctgggtcggcgtgctgctgcgccgcccggccctgcggcacctcggcctgttcgcctcgctggccctggtggtgctgctcggcgcggccgacatggtggcctacaccccgcccgcgccgctggtcccggccctgcactcgtactggttcttcgtgcacgtcacgacgatcatcatctcctcgggaatcttcctgatcggtgccgtcccggccgccatgttcctggtcaagaacggttacgacgagggcagccggcgcttcccgtacacgctcggcaagcgcgtccccacctcggcggtcgccctggagcggctcaccttccggctgcacgcgttcgccttcccgctgttcaccttcggcgcgctgatcgccggcccgctgtgggccgaggcgtcctggggacggtactgggggtgggacccgaaggaggtctgggcgttcatctcctgggtggtctacgcggcctacctgcacgcccgggccaccccgagcgtcaagcggacctgggcgacctggatcgcgatcctcggcttcgtgacgatgctgatgaacctgttcggcgtcaacctgttcttcgagggcctgcacagctacgccaacgcgcgctag

SEQ ID NO: 2624 - DNA, 1608 bp, Actinoplanes utahensis
gtgacggtcctggaggaacgcccggaggccggtgaggtgccgccgccgcgccgggtgaacccggtgtgggcgctgctgcgcaactcctggcggcagctgaccagcatgcgtaccgcgctggtcctgctgttcctgctggccgtcgcggcgatcccggggtcgtacttcccgcagacctcggtcaaccgggagcgggtgtcgcagtattacaccgcgcacccgcagctggcaccctggatcgaccggttcggcgggttcgacgtgttcgcgtcggcctggttcgcggcgatctacctgctgctgttcacctcgctgatcgggtgcgtgctgccccggctgcgcgaccacgcgcgcgccctgcggaccgtgccgccggaggccccgcgccggctggagcggctcccgcagcacaccccggcccggccgcacgccgcggcgccggccgaggccgccgccgagctgtcccggacgctgcgccgcaagctgtaccgcacccgggtgcgcgagctgccggacggcgggttcgcggtctccggcgagaagggttacctcaaggagaccggcaacctgctgttccacttcgccctgctgtccgtgctgatcggggtcggtttcggccactggtacggctggcacggcaaccggctgctggtggccggcgaggaccagggcttctgcgactcgatcacgcagtacgacgactcggcgctcggcccccgggtcaccgcggccgacctgccgcagttctgcctgcggatgacccggttcaacgccacctaccagagcaccgggcagccgaagtcgttcctggccacggtcgaggtcaaggagggctcgggggcgtaccggccggccaccttcacggtcaacgacccgctccggctgcaccacgccaacgtgcacctgatcggtcaggggtacgcgccggtgctgcgctacaccgaccggtacggcgtcagccagaccaaggtcgtgccgttcctgccgaccgacgcgatgcagaccagcgagggcgtcgcccagttcccggacgtcaacatcgacccgaagaccaaccagcgcgacgagcagctgcaggtcgggttcgagggcgtctacctgccgaccggcggcaccgacggcagcgccgtctcgaagtacccggcggagaacagcccggtgctgttcctcgcggcctaccgcggcaacctggggctcgacgtcggcaaacccggctcggtctacgccctggaccgcggccagatcaccaacggcgaactgaagaaggtcagcggcgaccgcccgcacaccctgcacccgggcgagacctggaccctggacgacggcaccaggctggagttcctcggcacccggcagttcgccacgctcgccatccgatacgacccgacccagtcgctgctgctggtcggcgcggtgctcgggctgatcggactgatgctctcgctcttcgtgcaccggcgccgcgtctggttccgcgtgctcccagctatcgatcaggaagccggcggtagcgtggtcgaagccggtggcctgccgcgcaccgactatccggggttcgaggccgaattcgccgcgctgacccggcccgccgaggaaggaacgccctga

SEQ ID NO: 2625 - DNA, 789 bp, Actinoplanes utahensis
atgggctcggccttcagtgatgcggcggccagcggcccgctggtgctggcgatcggtgcggccgcggtcgccggcctggtcagcatcctctcgccgtgcgtgctgccgctggttccgggttatctctcctacgtgaccggcctggccggttcggacctcgaggtggccaccggcgcggccaccgccaccaagacccggaccgtggcgctcaagggccgggtgctggccggcagcggtctgttcgtgctcggtttcgccaccgtcttcacgctgctcgcctcgctggtggcgaacatcggcatcgccctgaagacccacgagcagacgctcaacctcgtgctcggcgtgctggtgatcctgctcgggctgggctatctcggggtgatccccggcctgcagcgcgaggctcgggtcagcaagctcccggccgccgggctgatcggcgccccgatcttcggcgccatcttcgccctctcctggctgccctgcgtcggcccgaccctgggcgcggtgctggcgctggccaccacgagcgggcagaccgaccgcgcggtgatcctggcactcgcgtacagcctcgggctgggtctgccgttcgtgctgttcgggctcttcttccgcaaactgctcggcgttttccaggcgatccgccggaacagccggtgggtcaccaggatcggcggcgtgctgctcatcgcggtcggcgtgaccctggtcagcggtcagtggaaccacttcctgatctggctgctgaccaccttcgacttcggcggagggacgctgctgtga

SEQ ID NO: 2626 - DNA, 558 bp, Actinoplanes utahensis
atgcgccgccttctcgccgccgccctggccgccaccgccgctgccggcgccctggccggctgcggcagcgggaagaactgggcacaggactgcaccaccacgaacggtgtggtggagtgcgacaccgcgcaccggccgcaggtcggtgatgtctccggcgagttgctcgacggcggtgcctacaacgtggccgacgaccgcggcaaggtcgtcgtggtcaacttctggggctcctggtgcgcgccgtgccgggccgaggccgctgacctggaaaaaacgtaccaggcgacgaaggccaggaacgtcacgttcctcgggatcaactcgcgggacgaccgggattcggccaaggcgttcgagaagggccgggttacctacccgagcatctacgactacgagggctcggtcgcgctgaagttcgacgtgacccagaccagcaccccggccaccctgattctggaccggcagggccggatcgcggcggccatccggcgctccaccaccgccggcgagctgcagccgctggtggagcgggtggcggcggaggggaacggctga

SEQ ID NO: 2627 - DNA, 657 bp, Actinoplanes utahensis
ttgagcgagtcgaccaggacgaccgtgcacgtgttccggcacggcgaggtcttcaaccccaccaagatcttgtacggccggctgcccgacttccatctctccgagctgggccatcagatggcgaaggcggccgcccaggcactctccggccgcgatgtgacgcacgtggtggccagcccgctggagcgcgcgcaggagaccgccgcgccgatctccgccgagttcaagctggagacggcgagcgacgtacggctgatcgagagcgccaacttcttcgagggcaagcgggtctcggtcggcgacggcgcgttcagcaacccgcgccactggtgggtgctgcgcgacccgatcaccccgtcctggggcgagccgtatctggagatcgccaagcggatgttcgaggcgctgcaggcggcccgggtcgccgccgagggccacgaggccgtctgcgtctcccaccagctgccgatctggaccctccggcggtacgtcgagggcaagcgcctgtggcacgacccgcgcaagcggcagtgcggcctggcgagcctgacctcgttccgcttcgagggggccaaggtggtcggcatcgactacaccgagccggccgcgcacctggtcgccctctccgccacggccaagaccgccaagggagcctga

SEQ ID NO: 2628 - DNA, 1332 bp, Actinoplanes utahensis
gtgaccacgacatatcccaccgcggatcttccgtatccggaggacgccccggtctcccaggccctgttcgaccgcgcccggaccatcattcccggcggggtcaattcacctgtgcgtgcgttccgcgccgtcggcggcacgccccgattcatggcctcgggcagcggcccctggctgaccgacgtcgacggccggcgctacgtcgacctggtctgctcgtggggcccgctgatccacggccacgcccaccccgagatcgtcgcggcggtccagcgggcggccgcgctcggcaccagcttcggcacccccaccgggggcgaggtcgacctggccgaggagatcgtccggcgcaccgcgatcgacgaggtgcggctggtcaactccggcaccgaggccaccatgacggcgatccggctggcccgcggctacaccggccggtcgaaagtggtgaagttcgccggttgctaccacggccacgtggacgcgctgctggccgccgccgggtccggggtggccacgctcggcctgcccgactcgcccggggtgaccggcgcggccgcggccgagaccatcgtcctgccgtacaacgacatcgacgcggtcaccgcggccttcgcccaggacggcggcgagatcgcggcgatcatcaccgaggccgccccgggcaacatgggtgtggtggtcccgcgggacggcttcaaccagaaactggccgagatcgcccacgcgaacggcgcgctgctgatcgtcgacgaggtgatgaccggtttccgggtctccgccggtggctggaccgggctgcacccggtcgacgccgacctgttcaccttcggcaaggtgatgggtggcgggctgcccgcggcggcgttcggcgggcggcgcgagatcatgtcccggctcgccccggccggcccggtctaccaggccggcacgctctccgggaacccgttggcctgcgcggccggcctggcctcgctgcgactggccgacgccgacgtctacaagcggctcgacgagctggccacgacgatcgggcagctcgcgtccacggcgctgagcgcggccggggtggcgcaccggttgtcgtacgcgggaaacatgttctcgatcttcttcaccgagaccgaggtcgtcgactacgacacggcgcggacgcaggacgccgcggcgttcaaggcgttcttccacaccatgctggcgcgcggggtctacctgccgccgagcgccttcgagtcgtggttcgtctcgaccgcgatcgacgacgcggcactggagcagatcgcgaccgcgctgccgcacgccgcgcgcgccgcagcggggagcccgagttga

SEQ ID NO: 2629 - DNA, 327 bp, Actinoplanes utahensis
gtggagcgtcccgagctgtccatcacggttcatcgggcccccgacgaggtctcgatccagctcgcgggggaaatcgacgtgctcacggtcaccgagctggccgctctcgtcaacgaggtgctggccgccgagccgcccgggcgcatcgtgctggacatggcgggcgtcacgttctgcgactcacagggcctcggcacgctggtcgtgctcagccgcaaggcgcagcacaaccagaccgtgctggcgctggccaacgtgggcgatttcctgatgcgggtgctggacatcaccggcctgcggtccgccctcatgatcagcacctcctga

SEQ ID NO: 2630 - DNA, 720 bp, Actinoplanes utahensis
gtgacactcaccgaggatgagctgcgcgcggtcctgcgcgcccaggtgagggcccatcggccggaccgggccgcgatcctggaccgggtcaccgggacggccacgcgggaccgggcggcccggcggcgggcgccccgggtccggatcgcgggggcgaccgccgcggtggcggccgtcatcgggggcggcggattcgcccagtgggcactggccggtggaacgggacccgaccggcccgctccaccgccgccctccagcttcccgacggtgccgccgagcagcccgccgccgcgaccgtcccaccagcccggccggcccgcctccgcggctccggccgcgaccccggtcctgcgggccgccggcaccgtcgaggtgggcggcaggacccgggccagcggtgtggtgacgatccgggcgaccgggcggctgaccgcgctgcgggtgaccatccgggtggcgaagaccccgggcctggtcgcccgggacggcagccagcaggtgccgggtgcgagcgtgaccagcgacgtcaccgaggaggcgggtgcggtggtctaccacttcacgctctcgtccaaggacacgctggggccggggacctataccttcttcgcccggtacacctttccggcgggtggccgtgacgccggcgccgacacctattccgcggacgcgaccggcggatcagggacctcggtgagggtcagcggcaccttcggctga

SEQ ID NO: 2631 - DNA, 504 bp, Actinoplanes utahensis
atgcgcgacgccgcctaccacgcgttcttcgagcgccactacgactcgttgtcccggctggcgtacctgatgatcggggacgcgtcggccgccgacgacctggcggcggacacgctgaccgaggtgtggcggcactgggaacgcgtgcaggcggcggacgacccggcagcgtacgcccacgggatcctgatgaacctggcccgtaactggatccgtcgacgcagccgggagcgcctcttctcgctggaggtgctcaagcgggcgccggagtcggacgtgccggcggtgctcgacgtgcgccgcgcgctggcccggctcccgcaccggcggcgggcctgcgtggtgctgcggtacgcgttcgacatgtccgagcgtgaggtcgccgcgaccctcgggatctccgagggcacggtgaagagcgccacctcgcggggcgcgaaacaactggccgagatgctcggcggaagtctggcccggatcggcggatgggaggcggcgcggtga

SEQ ID NO: 2632 - DNA, 1467 bp, Actinoplanes utahensis
atgcggcacgcacaccccgacgacgcccaggccgcgcgccgtcgtcgtcgccggatcatcaccggagtcggcgcggccggcgccgccggtgcggtcaccgcgctcgtggcggtcctcgtccccaacgcctcggccagcacgatgttcagcgacgacttcgagaacggcgtgagcgcctggtccaaatccggcggcgactggtcggtcgtgacggacggatccaaggcgtaccggcaatccaaagcggacagtcagttggcgcgggtcctcgccggggagaccacctggaccgactattcggtctcggccaaggtcaagggcatcagcctgggcagcggcggcctcgccggagtcgcggcccgggtcagcagctcctcgacgatgtaccggctggtgctgaccggtgccggcagggccgagctgcaggccgccaagggcagcgtggtgtcggtgctcgcgtcggccgcggtcagcggcgtgacgacctggcacaccctgcggatcgacgcctcgggcagcgcggtgaagggcttcgtggacggcgccgcgatcggcggcgggaccgggacgctgtccgccaaggggcggatcggcctggtcaccagcaggggatcggcggacttcgacgacgtggcggtgggcccggccggcgccgcgaccggttccccggcgaccagcgccacccccaccaggaccgcgaccgggacacccaccaagaccgcgaccgcggcgccgacgaagagcgcgacgccgacgaagagcgcgaccaccgctccggccgcgtcgaccacctggccgaccccgaccgggcagaaggccgtgaccagcaccatcaaggtgaccagcagtctcgacggcggcaacgtccgcttcttcggcagcggcgcgctgggcaccgactcgcagtccgaggaccagggcccgctgttcgagctcgccgacggcgcgagcctgtcgaacgtgatcctcggtgacccggccgccgacggcgtgcactgcctcggctcctgcacgctgaccaacgtctggtgggagaacgtcggcgaggacgcggccaccttcaagggcggcacctcggcggtctacacggtcaacggcggcggggccaggggcgccgacgacaaggtcttccagcacaacggcggcggcacgctgaccatcaagaacttccaggtcagcgactacggcaagctgtaccgctcgtgcggcaactgcaagactcaggtcaagcgctcggtgatcgtgcagaacgtgatcgccaccggcaaggccaaggcgctggtcggcatcaactcgaacttcggtgacaccgcgacgctgtcgaacatcaccgtggtgggctttcccggcctgaaggtctgcgacaagttcaagggcaacagcaccggcgccgagccgaccgaggccgggtccggcgcggacggcctcaactgcaagttctcggattccgacatcaccttcaagtga

SEQ ID NO: 2633 - DNA, 549 bp, Actinoplanes utahensis
gtgggtgagcgcgccaaagcactgctggtcgacgaccggaaggacaacctgctggccctggaggccatcctgcagggcctcccggtgaccgctgtcgccgtggagagcggtgaggcggccctcaagcagctgctcaccgacgacttcgcggtgatcctgctggacgcgcacatgcccaacatggacggcttcgagacggccagccacatcaagcggcgggaacggacccggcacgtgccgatcctcttcctgaccgcggccgaccgggacgcccagctcgccctgcgtggttacgcggtgggtgcggtggattacctgaccaagccgttcgacccgtgggtgcttcgtgccaaggtgtccgtcttcgtcgagctctggacgaaaaatcagcagctcaaggcgcaggccgaggcgaccaaggagcgggacgcgcagtggctgcggctgaccgagacggtcgacgaggcggcgcgcgtgctccgggccggcggcgacgacgccgcgaccgaggcgctggctctgctggagaaggcgcgctggggaagctga

SEQ ID NO: 2634 - DNA, 4398 bp, Actinoplanes utahensis
atgactgcggccaaagaagccagcgtcggcgggcccgacgagaccgttctgttcggtgagctcgcggacgccctgcgacgggtccggcgcggtgatctcaaggtccgcctgccccgccgcggtggtgccgccggggccgtggcggaggccttcaacgaggtcgtctcgctgcaggaacggcagaatctggacctccggcggatcagccggatcgtcggccgcgacggccggctgaccgagcgcctggacgaggaggggctggacggctcctgggccgacagcgtgcgctcggtgaactcgctgatcgacgatctgggccggcccaccaccgagatctcccgggtggtcggcgcggtggccgagggtgacctctcccagcacatggcgctggaaatggacggccggccgctgcgcggtgaattcctgcggatcggccggacggtgaacacgatggtcgaccagctgtcgtcgttcgccgacgaggtgacccgggtggcccgcgaggtgggcaccgagggtgagctgggcggtcaggccgacgtccgcggggtggccggcacctggaaggacctcaccgactcggtgaacctgatggcctccaacctgacccaccaggtgcgctcgatctcccaggtggccaccgcgatggcccgcggcgacctgtcgcagaagatcaccgtgtcggcccgcggcgaggtcgccgaactcgccgacacgatgaacgggctgaccgacacgctgcggctgttcgccgagcaggtcacccgggtggcccgcgaggtgggcaccgagggcaagctgggcggccaggccgaggtgccgaacgtggccggcacctggaaggacctcaccgactcggtgaactcgatggcgtcgaacctgacgagtcaggtgcgcaacatcgcgcaggtctccaccgcggtcgccaagggcgacctgtcgcagaagatcacggtggccgctcagggtgagatcctggagctcaaggacaccgtcaacaccatggtcgaccagctctcgtcgttcgccgacgaggtgacgcgcgtcgcccgcgaggtcggtaccgagggtcgtctcggcggacaggcacaggtcagaggcgtttccgggacgtggcgggacctcaccgagaacgtcaaccagctcgccgcgaacctgaccgcccaggtccgcaacatctcccaggtctccaccgcggtcgccaagggcgacctgtcgcagaagatcacggtcgacgcccggggcgagatcgcggagctgaagaacaccgtgaacacgatggtcgaccagctgtcgtcgttcgccgacgaggtgacccgggtggcccgcgaggtcggttccgagggcaagctcggcggacaggcccaggtcaagggcgtttccgggacgtggcgggacctcaccgacaacgtcaactacatggcgtcgaacctgaccagccaggtgcgcaacatcgcctcggtcaccacggccgtggccaagggcgacctcgggcagaagatcacggtcgacgcccgcggcgagatcctggagctcaagtccactgtcaacacgatggtcgaccagctgtcgtcgttcgccgacgaggtgacccgggtggcccgcgaggtgggcaccgagggcaagctgggtgggcaggcgcaggtgcgcggggtggccggcacgtggcgcgacctgaccgacaacgtcaactcgatggcgtcgaacctgacgagtcaggtccgcaacatcgcgcaggtctccaccgcggtcgccaagggcgacctctcgcagaagatcacggtcgacgcccagggcgagatcctggagctgaagaacaccgtgaacaccatggtcgaccagctgtcgtcgttcgccgacgaggtcacccgggtggcccgggaggtcggctcggagggcaagctgggtgggcaggcgcaggtgcgcggggtggccggcacgtggcgcgacctgaccgacaacgtcaactacatggcgtcgaacctgaccgcccaggtgcgcaacatcgcctcggtcaccacggccgtggccaagggcgacctcgggcagaagatcacggtcgacgcccgcggcgagatcctggagctgaagaacaccgtcaacaccatggtcgaccagctgtcgtcgttcgccgacgaggtcacgcgtgtcgcccgggaggtcggctcggagggcaagctcggcggacaggcccaggtcaagggcgtttccgggacgtggcgggacctcaccgacaacgtcaaccagctcgcctcgaccctgaccatccagctgcgcgcgatcgccgaggtgtccaccgcggtgacccggggcgacctgacgcagagcgtggcggtcgaggcgcagggcgaggtcgccgagctcaaggacaacatcaaccagatgatcgtgacgctccgcgacaccacgaagacgaacgcggagcagggctggctcgactcgaacctggcccgcatcggtggcctgttgcagggccagcgggacgtcggcgaggtctgtcgcatgatcatgaccgaggtgacgccgctggtggacgcgcagctcggcgcattcttcctggtcgacaacgaggaggcggtgatccggctgcggctggccgcgtcgtacggctatgtcgctcgtgatcatgaagtgaccttcggccccggtgagggcctggtcgggcaggccgcggtctcgcgccgcacgatccgggtccgggccacccacgacggcatcctgaccatgcgctccgggctgctcgccatgccgccgaacgacctggtggtgctgccggtgctgttcgagggcgagatgctcggggtgatcgagttcgcctcggtggccgccttctccggactccacctgaccttcctggagcggctggtcgccacgatcggggtggcgctcaacacgatccaggccaaccggcgtaccgaggagttgctcagccagtcgcagcgtctggcccgggagatgcaggaccagtcggccgagctgcagcgcaccaacgccgagctggaggacaaggccaagctgctgagcgaccagaaggccaacatcgagctgaagaaccgggagatcgagctggcccggctcggcctggaggagaaggcgcagcagctgtcccgggccaacacgtacaagtccgagttcctcgccaacatgagccacgagctgcgtacgccgctgaactcgctgttgttgctggcccgcctgctggccgacaacaccgagcggaacctgaccggcaagcagatcgagttcgcccggaccatccacagcgccggctccgacctgctctcgctgatcgacgacatcctcgacctgtcgaagatcgaggccggccggatggacgtcgaaccggacgtggtcgacttcgacggcatccgcagctacgtcgagcaggcgttcgtgccccaggccgaggagaagggcctgcggctggaggtggagctggcaccggacctgcccgactcgatcgtcaccgacccgcagcgactccagcagatcctgcgcaacctgctctccaacgcggtgaagttcaccgacaacggctcggtgacgctgcgcatcttcgccccgtccccggagagcgacgacgtgccggcgctggtctcggcgcgacaggtggtcgcgttcgcggtgcgggacaccgggatcggcatctcggacgagaaactggcgatcatcttcgagccgttccagcaggccgacggcaccaccacccgcaagtacggcggcaccggcctgggcctgtcgatcagccgggagttcgcggcgctgctcggcggcaccatcgcggtccgttcggtgccgggcgaggggtcgaccttcacgctctacatgccggaggcgctgaccccggacacgatcccgatgccggccctgcccgcggccacgaccaaggcggtcgcggcacggccggccacgtcgctcgacctgccgctggagatggcgccgctgggcgcgccgcggcaggaggagccggccgcggtgcacccggccggccggcagctggacggcgccaccgtgctgatcgtcgacgacgacgtgcgcaacgtgttcgccctgaccagcgccctggagatgcacgggctgcacgtcctgtactcggacaacggggtggacggggtgcggatcctgaacgagcatccggaggtggacatcgtgctgatggacgcgatgatgcccgaccaggacgggtatgagaccactcggggaatccggcgcaatcagcgtttccgggatctaccggtagtgttcctgacggcgaaggcgatgcccggtgaccgggagtcggctctcgccgcgggagccagcgactacatcaccaagccggtcgacctggacgagctgatcgccctgatggctcgctgggtgaacgccgaggagtccgccgagccggagaacggctga

SEQ ID NO: 2635 - DNA, 2481 bp, Actinoplanes utahensis
gtggtgggccggcccagatcgtcgatcagcgagttcaccgagcgcacgctgtcggcccaggagccgtccagcccctcctcgtccaggcgctcggtcagccggccgtcgcggccgacgatccggctgatccgccggaggtccagattctgccgttcctgcagcgagacgacctcgttgaaggcctccgccacggccccggcggcaccaccgcggcggggcaggcggaccttgagatcaccgcgccggacccgtcgcagggcgtccgcgagctcaccgaacagaacggtctcgtcgggcccgccgacgctggcttctttggccgcagtcatgctgtcctcactcgctgtccacctgccgggctacctatcctctctcgcccgaccgggtcaatgcgagagacgactttgtgcatacacccaccctcgggagaggatgcatgctgtgccagccgaggtcggaaccaggacgagcgtcccgtcgggagcgccgaccggcaccctcgtgcgcaaagcccgcctgcccaacgaccggcgcacccccgcggcggcgcgcgcgctggtccgctcggtgctcgaggaggccgggctggacggcctgctcaacgaggctctgctgctgaccaccgaactgtccaccaacgcggtcgtgcacgccaacaccgacctggacatcgaggtcaccgccgatccggccgggctgaccgtgacggtcaccgacttcgcccccggcccggtcgagcagctcgccgtcggccccaggaacgagagcccggacatcggcgaggtcgccgagcgcggccgcggcctgctgctggtcgaccacttcgccagccgctggggcaccgtgcacgagggcgacggcaaaggcgtctggttccacctcgaccatcacgcgccggacggtggcgacgggtcccggatcccgcccccgtccgacgcgcccagcctcggcgcgctcaccgccctgctgcgcagcggctccgaccggcagaccgacgagggcctcaccgagctcgccgccgacctgctctcccggctggcccggctgaccggcgcggccggcggggtgctccgggtcgaccgcggcgacgggatgggccggcagctgctcgcccggtacggccgggccccgcgggacaacgccgacaccatccgcgtcccgctgaccgtccaccggccctactccggcgagctggagctcgacgccgccccggtcggctacgcgcagaccctcgccgtgatggtcgccgaacgcttctccctgcacctggagaacgaccggctgcgccgcgccgacgtccgccgggccacctggatcaccttcctcgccgaggccagcgagctgctcgcccaatccctcgacgtcaacctcacgatggcgctgatcccgcagctcgtggtgccccggctcggccagtggtgcgcggtgcacaccacggacgcctggggccggctgcaactggccgcggccacccacgccgaggaggccacgctggcccacctgcacgcctcgctcgccgagtccggcccggagtcgatcctggcccggctggaggaggcgtcccggctcggcacccaggtgatgttcggcgccccgctggaaggcttcgcggtcccgctggtcgcccgcggctcgcggctcggcactctcgccgtcggccggcacgtcaagcaccggcacgacgccgacgaggtggcggtgctcgaggacgtcgcccggcgggccgccctggccatcgacaacgcccggatccacgacgaacgccgcaaggtcgcccgcaccctgcaggcctccctgctgccgccggcgctgccgcacgtcgagggcatcggcttcgccgccgaatacgtgccgaccggctccgaggtcggcggcgacttctacgacgtgatgccgttcggcaccgaccagtggctggtcgtcgtcggcgacgtctccggcaagggcgtccaggcggccaccgtgaccggcctggtccgcgacgtgatccggatcctggtcgacgacggcaagtcgctcaccgagatcctcgaccgggtcaatcgcacgctggtgcagcgtggcggcggccgctactgcaccctcgcgatggcctcggtcacccgccggcccgacggcggcctcggcgtctgcctgcacctggccgggcacgaccgggcggtgctggtccgatccgagggcaaggcgtccttcgtcggtgcgggcggcacggccctgggcctgctggaatcgatcacctcgccgaacgtggaggtcaccctcgggccggccgactcgctgatcttctacaccgacggcgtcaccgaacgccgccgcggtcgcgagctcttcggctccgcccggctccgcgaggccgccgcacccctggccggctatcccgcggatgcgatggcagcccgcctgcgctccacgacgatcaacttctcggtcgaggagccgcgcgacgacatcgccatcctggtcctccgcaacgacgcctga

SEQ ID NO: 2636 - DNA, 564 bp, Actinoplanes utahensis
atgacgacgcagtactacaccgcgaccacgatcgacggctacatcgccgacgagcaccactccctggactggctgttcgaggtcgacgacggcggcgacgcgaatccgttcggcgcgttcttcgccgatgtcggcgccttcgccatgggcgcgaccacgtacgagtgggtcctggcccacgagaacgtcgtcgccgagccggagaaatggctgtcgccctacggcgacaccccggcatggatcttcacgcaccgcgatctgccccgcgtccccggcgcgaaccttactttcgtacgcggtgacgtcaccgccgtgcaccgacagatggccgccgccgccggcgacaagaacatctggctcgtcggcggtggcgagctggtcgcctgcttcgccgacgcgggcctgctcgacgaactgatcctcggcgtcgccccggccaccctcggcgccggcgccccgctgctcccccgccgcctcaccgcgaaacggctgaccctgacgtcggtgagccggctcgggcagttcgccaatctgcgctactcggtcggcccaccggcctcctga

SEQ ID NO: 2637 - DNA, 615 bp, Actinoplanes utahensis
atggcgaagacgcagtactacaccgccaccagcatcgacggctacatcgccgacgagtcgaactcgctggactggctcttcgaggtggacgagggcaccgagaacccgttcggcgagttcttcgccggcgtcggcgcgttcgccatgggtgcgaccacctacgagtgggtgctgaagaacgacaatctgctggaggagccgcagaactggcacgacatgtacggtgacgtgccctgctgggtcttcacccaccgtgacctaccgccggtcccggacgccaacgtcttcatgatcagcggcgatgtccgccgggtccacgaggccatgctggtcgccgcccagggcaagaacgtctggctcgccggcggcggcaacctggtcgcccagttcgcccagcagcacctgctcgacgagatcatcctcggcatcgcgccggccgtcctcggcaccggcaccccgatgctccgccacaagatcggcgtcgacgagctgatcctcaccggtgtccgcgaggtcggccagttcgcctacctcacctacgccgtcggcgacgtcgcccgcatgggccgccatctcgccgccgaagcggccaccctgctccccgcccgtttctga

SEQ ID NO: 2638 - DNA, 867 bp, Actinoplanes utahensis
atgtgggaccaccacggcgccaccgccaccgtggcggcgggcacgtcgctggccgcggtccgggtcgccctcgccctgcagggcaagcgcctggccgtcgacccgccctcacccggcgccacggtcggcgggatgctcgccgtcaacgaggccggtcccctcgcccaccgctacggcagcccggcggatcagaccctgagcgtgatgtacgccgaggccgacggcgccgagctcgaaaccgacggggagaacgggcggcccggcatcgccaacatccgcggggtgatcaccgcggcggtgctgcggctgcacccgctgcccgagacgcgccgctgggtcggccgctcggtcaccaccccggccggcgtcgcggagctggtcgagcaggcggtcgagcaggacctggagcccagcgcgatcgaggtggacctgccgggcgccgccgagggcacggtcgccgtgctgatcgagggcgacaccgggtcggtggccgggcgggcggcgaaactcggccaggtctggggccccgaggcggccgtggtcgagcacgggccgccctggtgggggcggtatccgttcggggccggcgacgtcgcggtgcggatctcggtgccgccggagggcctgcaggcggtgacgtatgcgttgcgggacgcctgcggcgtgccggtgccgctgcgcggttcggccggcctcggcacggtgcacgcggtgctcccggcgggcctgccggcgcggcggctggccgagatcgtcgacggggtggaccaggtgctgatggcccgcagtggcaagatcgtggtggtttcggccccgccggctctcgccgtcgctctgccgatggctacaccgcgcgacctgttctga

SEQ ID NO: 2639 - DNA, 2124 bp, Actinoplanes utahensis
gtgtgtaacgaactcatcccggaccgatccaccggtaacgtggtgcgggtgacgaccgaatcgcccgccggcccaccgacggcccgcctggccccctccgagcgcacccatcacggcgacacggtcaccgatgagtacgcctggctcatggacaaagaggacccggcgacgatcgcctatctggaggcggagaacgcgtggaccgagacggccaccgcgcacctcgccgacctgcgcgaaaaggtattccaggagatcaagggccgcacccaggagaccgacctgtcggtgccgagccgcaagggcgggttctggtattacacccgcaccgaggagggcaagcagtacggcatccagtgccgtgtgccggtccgcccgggcgagaccgacccgccgatgggcgacgaccgtcccggcgaggaggtgctgctcgacggcaacctgctggccgaggggaaggatttcttcgcgctcggcacgttcgatgtcagcccggacggcaactggctggccttctcgaccgatttcgacggcgccgagcggttcaccctgcgggtcaaggacctgcgcaccggtgaggtgctggccgacgagatcccggacaccttctacggcagcgcctggtcggccgacggcagcgtgctcttctacatcacggtcgacgaggcgtggcgccccgaccgggtgcaccggcacttcgtcgggcagcccgccgaccgggacgcggtggtctatcacgagaccgacgagcggttctgggtcggcgtcgacctgacccgcagcgagaagttcatcgtgatcgacgcccaaagcaagatcacttcagaggtacgcgtgattccggccgacaccccggacgccgaacccgtggtgatcgccgagcgccggcagggtgtcgagtatcagatcgagcaccacggccaccggttcctgatcctgcacaaccgggacgccgaggacttcgcggtcgcctacacctcggtcgacgcccccggggactgggtcgagctgatcccgcaccagccgggcacccgcctggagtcggtcgacgcgttcgcccggcacatcgtgatctcgctgcgccgggacgggctgaccggcctgcgggtgatgggcgacggcagcaccgacgcgtacgacatggatttcccggagccgctctacagcgtcggcctcagcggcaacccggagtacgacacctccgcgatccggatcacctacacctcgctggtgaccccggattcggtgtacgacgtcgacctggtcacccgctcgatgacgctgcgcaagcagaagccggtgctcggcggttacgacccggccggctacgagcagttccgcgagtgggccaccgcaccggacggcacccgggtcccgatctcgatcgtggcccgccggggtgtcccccggaacggttccgccccggcggtcctctacggctacgggtcgtacgagcacagcatcgacccgtacttctcgatcgcccggctcagcatgctcgaccgcggtgtcgtcttcgcgatcgcgcacgtccgcggcggcggtgagatgggccgccggtggtacgaggacggcaagatgctggccaagcggaacaccttcaccgacttcgtcgcctgcgccgaggccctgatccgcaaccgctggaccagcgccgaccgcctggttgcgcgcggcggctcggccggcggcctgctgatgggcgcggtcgccaatctggccccggagtcgttcgccgggatcgtcgccgaggtcccgttcgtcgacccgctgacctcgatcctcgacccgtccctgccactcaccgtcaccgagtgggaggagtggggcaacccgctggagtcggccgaggtctatgcgtacatgaagtcgtacagcccgtacgagaacgtcgcgaagctgccgtactcgaagatcctcgcggtgaccagcctgaacgacacccgggtgctctatcacgagccggccaagtggatcgcccggctgcgcgcggtggtcccggacggcgagttcctgctgaagaccgagatgggcgccggtcacgccggcccgagcggccgctacgactcgtggaaggaagaggccttcgtcctcgcctggatcctcgacaccgtcggcgcctga

SEQ ID NO: 2640 - DNA, 228 bp, Actinoplanes utahensis
atgtccgtttcggtcctcaccgccgccaccgtggtcgcggtgctcgccgccggactggccgccctccaggcgcaccatgcgccgagcgtcccgatgctctgcatcgccgtcgtcctcggcaccgacgtggtcgcgctgttcctgctcctcggcctgctgaggccggccgctcccgagcggccgacctcaaccgagccgatgctcaccgacctgagcgccgaatcctga

SEQ ID NO: 2641 - DNA, 531 bp, Actinoplanes utahensis
atggggccgcccggggatcggagtattcacgtgacggggtgggacgaggggcagctggcggccgggttccggtcgatggtcatgttgtccgcgctggtggagcggggtggccggccggctccggtggcgccgaccgtgcggctgcggcccgccgagcggcagtacggctggttcccggccgacgtcgacggggacggccgccgggtcgtggtgatcaccagccagcggctcatcgtcggtgaccgggagtggtccctgcggtcgatcaccggggtggacagcgagccgcgcgactgcaccgtgtcgttgcggctgcgcggccggccggcgccgctggtgctcagcgggccgtgggtgccctggctgggcgtcgtgatctgcgccgagctctaccagccggtggcgcagcacggtgcgcaggtgccccggcagcgcggcctagtacacccagaccttggtcttcagcggcagcgcgtcgttgttccacatccagttcatcgcggcgatcgacacccgggcgcaaccgtgtga

SEQ ID NO: 2642 - DNA, 1329 bp, Actinoplanes utahensis
gtggtgggtgaccgacgcgctgggcacctggtcccggacgtccggcctgcccgcccccaccctgctgctgtccgccaccgacctgcggtcgctgcgccggctgcggtcggccttcgagcaggtggtgctcgccggggcgaaccaggagccgcccggcgccctgccccccgccgacgtcccggtcagcctggcgccggacgcggccggctgggtgcgggtggtgccgaccggccggggcacccgctggctggcgtccgcgctctgggccgaggcgctgctcgcccagcaggccggcctctggccgcggctcaagctctgccacaacacggtctgccgggccgcgttcttcgacacctcgcgcaacaacagcggcgtctggcacgacgtcagcacctgcggcaacacggcgaacctgcgcgctttccgggagcggcgccgcctgctcgggcacagcgaggagctgcaggtcgacgaccaccaccaccgctgaccccggacatcgccgggaaccattcgccggtcccgcgcgactatggatgcatggcgtgtgaacggtggcgcgagatgctgtccgcgcagttggacggcgaggacgatccggccctgcgcccgctggtcgacgagcacgtgtccggctgcgcgggctgccgggcgtggctggatgcggccgcggcggtcaaccggatgacgagcaccgggcggatgcccgacgtgccggatctcagcgcgtcgatcctggccgccctgccgccctcggccccggcccgaccggccccggcccggtggtggcggcgactcccggtggcggcgctgctctacgtgtcgctcgcgctggtcggcgcggtccagatcatcctggggctggcgcagatcggcggtgactcggccgccgggcacgtgcacctgggcctgtccgcgaccccgggccacctgtggaacgagtcggccgcctggaacgccgcgatcggcgccggatatctcttcatcgcgctgcggcggacccgcccggtcggcctggtgccgatgctcaccgcgttcgtcgcgatgctgctgctgctctcgctcaacgatctgaccggcggccgggtggacgtcgcccggctggtcgggcacggcttcgtgatcgtcggctatctgctggtggtggtgctctcccggggtgccggcgacaccgcgcggccgcccggcgcacgggccggtgcgggctggcgcctgaccggcgcggccgaggacgagcccgggatcgcggcgccgcaccgccccggcctgcggctggtcccgccgaccggcccgctcaccgcccaccacgacgatcagcaggccgcgtga

SEQ ID NO: 2643 - DNA, 231 bp, Actinoplanes utahensis
atggagcagcgtaagcactggtggaacggtaaatggggacgtctcgcccggaaggacgtctacctccgtaccaatggggaccagtggtatgtcgagcagcgtgccgggggctccgacggcacgtcccacttcttcgagtacgactcggaggacgccgccctcgacatggtgcgcgccctgctcaacgggcccgacgagtggcgggagctgtccgtgcgaccgccccggtga

SEQ ID NO: 2644 - DNA, 468 bp, Actinoplanes utahensis
atgttccaaggcttcaaagacttcatcatgcgcggcaacgtcgtcgaccttgccgtcggtgtggtcatcggttccgctttcaccgccgtggtgaccagcctgacgaacggcttcctgaagccgctcatccaggtgatcagtggcggtaacgggatggatgcgggttcgttcaagatccgcggcgtcaagttcgactacgcgaccttcatcaactcggccatcacgttcctgctgaccgccgcggtcctctacttcctcgtcgtctacccgctcaacgtgctcgccgagcggcgccggcggggcgaggagccgccgccgaagagccccagcgaagaggtcaagctgctcaccgagatccgtgacgcgctggtggcgcaggcggccgccgggcgcggcaacacccagggacaggtgtacggaagcgcggtggacgaggtgctgcagcgtcgccaggacccgccgcgctga

SEQ ID NO: 2645 - DNA, 354 bp, Actinoplanes utahensis
atgtccttgacggtgcagaccgaacaacgcggtgacatggtcgtcgtgtcggtggccggtgagctcgacatggccaccgcgccgcagttgcaggaccagatcagtgatctgctggagaagggccggaccaggctggtcttcgacctggccgaggtctcgttctgtgactccaccgggctgtccgttttcgtccgggcgaagaacagcaccgacgacgccggcgggacggtgcggctggccgcgccgcagcggggggtgctgcgcatcctcgaggtcagcgggctggtcgaggtgctgcacacctatccgacggtcgacgaggcggtcaccgctgaggaacccgcgctcgactga

SEQ ID NO: 2646 - DNA, 861 bp, Actinoplanes utahensis
gtggcgctgagtccggatgagtcgggtcgcttcgctgacctgctcaaagagcacgccgacgggctggtcgcccgctgggcggtgctggtcggggtcagcttgcagggccgcatgagccggcccgagttggagcggcagaccagggacttgcataagggtttccagcaggcgctggccgccggcgcgcaggacctcggcgacgaggcggccggcgagctgcgggcccagctgagcgagctgtccagcagccgggcccggcaggggttctcggcgaccgagacggcggtcagcgtgttcgcgctcaaggacgcggtcctcgaggtgctcggtgatgccggtgacgacgcgcacaccctgcgcggctacgtggcgttctcggcgttcgtggaccgggccgccctgttcaccttcgacgcctatgtgcgggtccgcgagtcgctgatcgccgatcaggccgagcagctgctggagctgtccaccccggtggtcaagctgtgggagggtgtggtcgccgtcccgctggtcggcacgctggactcggcccgcgcccaggtggtgatggagcggctgctgcagactctggtcgacaccggctcgccgtacgcgatcatcgacatcaccggtgtcccggcggtcgacacccaggtggcccagcacatcctgaagacggtggtggccgcccggctgatgggcgccgactgcatcatctccggcatccgcccgcagatcgcgcagaccatcgtggcgctcggcatcgagttcggtgacatcgccaccaagtcctcgctggccgacgcgctgcgttacgtgctgggccgcaacagctacaaggtcgtgacggccaagcggacggagcgctga

SEQ ID NO: 2647 - DNA, 426 bp, Actinoplanes utahensis
gtggaacgcgtcccggtcctgaagatcggcgacatcctcctggtctccatccagatcgacatggaggaccagaccgccctgcagctgcaggaggatctggccgagaggatcgtggccaccggctgccacggtgtgatcatcgacatcagcgcgctggacatcgtcgactcgttcgtcggccgcaccctggccaccatcgcctcggtctcccgggtgctggacgccgagacggtcgtggtcggcatgcgtccggcggtcgcgatcaccctggtcgagctgggcctgtcactgccggggatccggacggcgctcaacgtcgagctggccatcgagatgctggcccagagccgggccgtgaccatgggcgaattcgacgacgacgaggacgaggacgaagccgaccagacggcggtaaccgcgccgtga

SEQ ID NO: 2648 - DNA, 405 bp, Actinoplanes utahensis
gtgaacgaggagagccggcggatcccggtcaccaccgaccaggacgtggtgcgtgtccggcagctcgtgcgcaccgtctccgtcgaggccaagctctccctggtcgaccagaccaagctggtcaccgcggccagcgagctggcccgcaacaccctggtctacggcggtggcggcgaggtcgaggtgagccgggtgcgcaacgatctgcgggccggcatccggatcgttttctccgaccaggggccgggtatcgccgatctcgacctggccctgaccgacggctacaccaccggcggcgggctcggcctcgggctgagcggcgcccgccggctggtcgacgagttcagcatcgaaaccgcagtgggcgagggtacgaccatcaccgtgaccaagtggtgccgatga

SEQ ID NO: 2649 - DNA, 1017 bp, Actinoplanes utahensis
gtggctctcgtacccgaaggacttctcgacgagggagtctggttccgggtggaggccgccgggactgccgccgccgtccgccgcgccgcggaacgtctcgccgccgagctggccatgccggagcgccggatcgcggatctgtcgatcgtcgccgccgagatggccggaaatctggtcaagcacgcccaccagggcaccattctggtccgcacggtccgcaccgcggagcaggccggcgtggagctgatcgcgatcgacagcggcccggggatgtccgacgtgccgcacgcgttcggcgacggccattccaccgccggcacgctgggcatcgggctgggagcgatccagcggcaggccggccgctgggatctgcattcggtcccgggccggggcacggtgctggccgtgcaggtctggccgggagtgacgccaccgccggcctgggcgtccgggctgacccggccgatcaccggggagacggtgtccggcgacgcggtggcgatccgcgagatggacggccgccggcagatgctggtctgcgacggactggggcacggcgggctggccgcggccgcctcccgcgaggcggtccgggtgttccgggagacgccggcgacgtcaccggccgcgatcgtcgaggccttgcaccgggcgatgggacacacccgcggcgcggcgctggccgtcgccgacctggatccggcgacccgtcaggcgcggtatgcggggctcggcaacatcgccggcaccatcttcagcttcgagggcacccggcgcggcatgatctcgatgcccggcatcgccggtcaccagcgccggcagatccgggaatacgagtatccgctcccgcccgacgggttcgtgctgatgcattcggacggcgtggtcgaccgctggaacccgacggactatcccggtctgctcacccggtcgccggagttgatcgcggcgaccgtgctgcgtgacgccggaacccgccgcgacgacgccggcgttctcgtggcccggctgccatga

SEQ ID NO: 2650 - DNA, 1350 bp, Actinoplanes utahensis
atgaccgcgagcgagccgctgatgcgcatgcgcctgcgggtcgagcaggacatcttcgcggtccggcagttcggtcgggaggtggctcgcgcggtcgggatggagtcgcaggaccagacccggctggcgacggcactcagcgaggtgggccgggtgttgctggccgccggcacccacgcggacgtgacgttcaccgtggagccgtacggggtaccaagtctccaggtgacaatggcacattcggctccggactcggtgtcctggctgactggacagttgcagcaggtcggccgcctggtcgacacgatggaggtcgacgatggcggtcccggtacgacgattcggatggcgcggcgcctgccggtcggcgcgccgttcctgacccccgaccggatggacgagatccgcgcccgcctggcccagcatgtgccgggcaccccgctggacgagctgggtgtgcagaaccagcagctgatcaccgccctcaacgaggtgcgggcgcagcgtgacgagctggcccggctgaacgccgagctggaggagacgaaccgcggcgtgatggcgctctaccaccagctctccgacgagctggaggagacgaaccgcggcgtggtcgcgctctacgccgagctggacgagaaatccgtgcagctgcgggcggcgagcgaggcgaagagccggttcctggcgaatgtcagccatgagctgcgcgccccggtgaccgcgatcatcgggctgggccggctgatcaccgactcctcctcggacgacctcaccgaggagcagagccgtcagatcgagctgatccgcacctccgccagtgacctgctcaccctggtcaacggcctgctcgacctggccaaggcggaggccggccggatcgagcctaactggtccgcggtcgatctgaaggcggtgttcggtcagctccggggcaccctgcgaccgctggccacccggcccgaggtgcggttcgtggtggacgagccggctgtgccgaccatccactccgacgaggtgctgctcgcccaggtgctgcgcaacctgctgaccaacgcgctgaagttcaccgagaccggcacagtgcggctgagcgtgcggcgcaccggcgacgacgcggagttcaccgtctcggacaccggcaccggtatcccccacgagctgcaggaacgcatcttcgaggagttctatcaggtgcccgggagcaagccggtcagcggccgcggcaccggtctgggcctgccgtacgcccggcgtctggccgggatcctgggtggtggcctgcgggtcgactccacccccggcgagggcagcgtcttcaccctgcagctgccgatcgggccggcatga

SEQ ID NO: 2651 - DNA, 1575 bp, Actinoplanes utahensis
atgaccgagctcgcccgcgtcgagagactcgtccagggccatgtgaaagccaccgttctcgtcgtcgacgacagcgccaccaagcgttacctgctggtcagctggctgacccgggccggtttcacggtgatcgaggcggagaccggcggcgaggcgctgcgcaagctcggcgaggacctggtcgaggccgacctggtggtgctggacgtgaagctgcccgacatgagcggtttcgaggtctgcgagcggatcaagaccgatcagcggtacggcgttctcccggtcatccacgtgtccgcgcacgccgtggacgtcaacgaccgtacccagggcctgaaccggggcgcggacgcctacctggtcgagccgatcgagccggacgagctgatcgcgaccgtgcaggcggtgctccgctactaccgggcccggcagcgggccgagctgctcgccgcgcgcctggtccggctggccgagaccaccctcgcgatcaactcggcgtcgaccctgccggcgctgctggaggcggccgcggtgggtgcggcggacatcttcggcgggccggtggtggtggtcgccgagacgtcggagggggagagcctggccgcggcggggccgcccctgggcgtacgaaagtgggctgttccgcatcatcgggtggcggtcggttcgctggtccgcaccgatgaaccggccgactgggacgtcgtcgactggccggcgggcgaatccgtcgcggtggccgcggcccggctgcggatcgaccgcccgccggtgtacctggccgtctcgggcagcacgcagacgcccggtttcccggtgttgcggcagctctcccaggcggtcgcggccgccgtcgaggcgcagcgctcgttcgacgaggagcaccggatcgcggtcaccctgcagcgcagcctgctgcagtcgacgctgccccgggtgcccggcgtcgagatggccgtgcggtacgagccggccggcgcgcagaccgaggtcggcggcgacttctacgagctcaccgtgctggacggcaagctgctggtggcgatcggcgacgtggccggccactcgttgcacgccgccacggtgatggccgaggtccggcacgcggtccgggcgtacgcggtggagggtcactccccgggcgcggtgctcggcctgacgaaccgtttcatgcgcaccgtgctgccggccgactcggccacgctgtgcctgttcaccctggacccggcgaccggccggatccggatggcctcggccggtcacctgcccccgttgctgcacgtcgacggcgaggtccgcttcctgtccccgcgcggcgcgctgctcggtctggacgccccggaacgcaccgagctggagctggagctacccccgggcggcacgctggtgctctacaccgacggtctgatcgaacgccgcgacgccgacatcgacgagggcctgcgggccctggccgcctgcgccgccgatgtcgagccggatctggacgcgttctgcagccgtctcctgacccgcctgggcgggtcaggagaccaggccgacgacatcgcggtcgtcgcgctgcgccgcgcttga

SEQ ID NO: 2652 - DNA, 3123 bp, Actinoplanes utahensis
atgcttgtctcaagatcaatatcgggggatgaacccatgtccactgcggctcgacgcggcctcgctgccgccggctgcatcgccctttccgccgccggcctcacggcactcccggtcaccccggcgcacgccaccgtggcgctgccgcaaccgtccgaggtgtcggtcgtcccggcctacccgacgcgcaccgacttcccggtcgactcgctcgtcctggccggggagaccggcttcctgcaccagtacggcggctcgtcctgggccacgtcgacctggctgtggacccgttacgcggacggctcgacccgagtcgtcaccgagctggccggcctcacggcaccagcgctggcctgggccggtggcgacaggatctgggtgaagaccgacgtcgccgggcacagcgacgacaggtcgctgaccatcttcgacgcggccgccggcacctggtcgaacccgaccctgccgaccgacggcaccaagctcgcctactcggccgggacgatgctggtccggctcggcacggcaggcccactggagctgcggaagttcgccgccgacggtacgtacacgacgattccgatcaccggtgtgccggacggtaccgccgtttccggcgggtcgggcacggtcttcgactcgaccaccttcctggtgagcttctccggtaccaccgacggcgtgaaatggcagcggctcgggctgctggacttcaccagcggcaaggtttcgctgctcccgcagttcaccttcgggacggtcaaccagatcctgctctccgccacccacctcggtttccgcggcgggaacaccgtccgggtgttctcccgcgcggcgatcacggccggcacggccaccgacccggcggtcatcacggtgccctccgtgccgtacctgaccctggtcggcggcgacatgctggtccgggcttcggccgcggacaaccgggcgccggctcggctcatctccgcggacggcagtgagcggaccgttctgccgatgagccagagcaacccgtacgcgatggccacggctccgggcggcgccctcctggtgggcggctccggcgctgccgactgggcggtgcagcggatcaccgcggacggggtgcagccggtcatgtccgaggtgcggacgaacttcagcgccgggatcacgatcagccgggggcagctgcggcacgtccgggccggcgcccggccgttcgagagcccggtctacgacttcagcaaccatgagctcatccccggtctcaccgggctgccggtgaccggcccgacgatgaccggtgtgacctcgtgcgcggccgacgtgacctgtgtgcgcaccatggacggcaaccgatacggcaccggctggaccagctccaccgagaccaccaccacggtccggttcgccgacggcgccagcggcgggttcagcctcgtactggccggaggcggcggcagcctggtcgacgtctccgacgactacgcgatcgtgaacaccacctcgccggcgaagcagtacgtgattccgaccgccaacccggatgccaggaccgaacgggcggtgaccgcggcggccctcgactacgccacgctgtggaccgccggcgccggccagatccggtccaaggacctgaccaccgggaagaccgcggccccgatctcgatcggcgccgcctgcaccccgtccgagctgcaggccgcgggccggttcgtcttctggtcgtgcggcgtcgccggcccggccggcgtctacgacgtgccgcagcggatcaaccatccgctgccggccggacggtatctgctcggcgacggctacgcggtccggcacgacgcggcgaccggccggctcatctcgtacgacgtgaccctgcgcggcgcgccgaagaccgcgatcctcggcaccctggaccggggcaccccggccgacgaccggaacatcacctgggccgtcgacaagtacagcgggaacgtcgcctacgtggacgcggccggtgccgcccacgtgatcgacccggcggtggtcgagcggccgccgacggtgatccggagcaccacctcggccgacgtcgtctaccacgaccacgaccgcccgtgggtccggcagtacacgttgagccgcccggtcgcctcgtggcgcgcggagatcgccgaactgcactccggcaaggtcgtcatgacgctcaacggcggggcgagcaccggcgaggtccggctcgcctgggacggatacctggccgacaagacgccggcgcccgccgggcggtaccgcgtcaacctggtggtgaccacccccgacggcgtcggccatgacatcgcgggatcgccggtctacctcgacggggagcgcccgagactccacagttacggcctggacggcatgccctccatgctgtcggtggacccgcagggcaacggcgcgtggtggcacgcgtacgccgatcgccgctcgctggtctaccagtacatctccgaattctgggacctcggcaccgggaacagccagatctccgcgctcgtcccgtacggcgacatcaacggcgaccggaacaacgacgtgctggcccgcaccggcaacggggtgctctgggcccacctgggcttcggcgaggactacttcggctccgaccggaacagggtggtcaagatcggcaccggttggaaccggttcgacacgctgatcaccacgggcgacgtgaccggggacgggatcaccgacctgctggcccgggacgcgaggaccggcaaggtcctgcggtatgccggcaacggcacgggcggcttcaccaacggcgtcccgctcagcggctcctaccagggcttccgtctaatcggcccgggagacgtcgacggggacggccacgccgacctgctgctgatcgacggcaggggcgggctgtacgcgcagtacgggaccggcacgggcaccttcggggcgagcacccgaatcgggtcgggattcaaggcgtacaacgtcgtgctcggcatcggcgacctcaatctggacggtctcaacgatctgctggcccgggatgcgagcggtaagttgtaccgcttcctcgggaccgacgccggcacgttcggggcggcggagcggatcggcagcggctaccagacgtacgccggtctgttctag

SEQ ID NO: 2653 - DNA, 2292 bp, Actinoplanes utahensis
atgcccatgacgcggcgtggccttgctgccacctgctgttctcttctcgccctcaccggaatctccgtcgccgccccggcgtccgcgacggtgccgctgtcgaatccgcacgaggtcgcgacgattcccgccgacccgccgttcgagtaccgggaagaccacgtggcgttcgccggccgcaccggctatctgcactcccgcgcgaacgggggcggcacgtggcagtggacgacgtacgccgaccacaccaccacgacggtgaccaccctcggccggctgtatcccggcgacttcgtgtccgccggtggtgacacggtgtacgtggacgcggatgtcgacgggcactccgaagccgacacggtgagcaccctcgacctcggcaccatgacctggcagcaccggcccaggacggccgacttcagagccgtctacggtgacacctggtatgtgcgctcgtcgtcggccaccccggcgctgcgccatttcgccgtcgacggctcgtcgatcgacgtcccgatgaccggaataccggccggcaccgcgtcgatccttgcggtccgcggcgacagcaccggcatggtgatccgcttcgggggcaagccgaacaccttcggctggcagttcggcctgctggacctggcgtccgggaaggtctcgccgttcggcggaaaccgggccaccgtcgcctcgtccgtcctgctctcggccggccgcgtcgcgctgctcgacgaaggggcggacaccgggactgccgagatcttcgaccgtgccgcggtgctgaacggcaccgcacccgcgagccccgagccgatccacctgcccctcacccagcagtaccgcctggcgctggccggcaacgacgtgctcgccagccccgagccccggggcggcggcgtggcgccggccgtctatcgctactccgccgacggatcgcaccgcacgctgttcgcgcagtcccagcccggcagcggcagcctgacgcaggccgaggacggggccgtggtcgtgggcggggccgacagcggtgactggggaatccaccggatcaccgccgccggggacacccggctcgcggacctcagcgccaaggccggcaccaccggggtgaccatctcgcaggggatggtgcgccgggtgcagacggtgacctgggccggcgaccaatacaccttccttcatctgatcaatcaccatctgagcgagggaatcgaccggcaggtgccggtggacgggggccgggtcggcgcgttcctgtgccaaccggccgccttctgcatccggaccgtggacggcaaccggtacggcacgtcgttcgcggccggttattcagtgttgacgatggattcggtggctcgcccctctgtcgacaccgacatctcgggactgaccgtcaacgatgccgcggtcgtcgacgccgggctggaatatgtggtctccgatttcccgcgggcgaacgttcaggtgatcctgcgcgccggtgccggcgacacggatgtcgtccagcggccgatcacgggcgccgcactctggttcaacaccctgtggaccgggctccccggcaagatccagccaacgaacgtgaccacccgggtcagctcgccggcgatccccatcggtgccgcctgcaccccgtccgagctgcaggccaccgaccggtacgtgtactggagctgcggcaccgccggcccggccggcgtctacgacggggtcaccaagaccagccggcaggtcccgcccgcgcagtacctgctcggcgacggttatctggtccggcacgacgcggcgaccggaaagctgatccggatcgatctgcgtctgcgcggcaccctgggccgcagcgccaccctcggcaccatcccccgcggcaccctcgccgacgaccggaacatcacctgggccgtcgacaagtacagcggcgacgtcgcctacgtcgacgccgcgaacaccatccacgtgatcgacaccggcgtcgcccggtccgccccggccgtcgtcggccggcccgccggcaacctgaacccggccgccggtcagagctcgtcgtggtcgttcacgctgaaccggccggtcgacgtctggacggcgacgatcacccagaacggcgttgtcgtgcgcaccctcaccggcgggccggccgaccggaccgcccaggtcacctgggacggcctgcgggcggacgggaggccggcggccgccggcaggtaccagctcaccttcgcggccgtcgcgggcggtgtgtccggtaccccctcgaccgcgacggtgaacgtctccgcggccgcgtcgaggtga

SEQ ID NO: 2654 - DNA, 537 bp, Actinoplanes utahensis
atgtccaccgctcacgtgctcctgggtctgctcgccgacgggccacggcacggctatgagctgaagcgtgcgcacgacgaccgcctccccctggcgaaaccgctcgccttcggccaggtctacgccaccctgggccgcctggagcgggacggcctggtcgtccgctccgggcaggatcaggagtccggcccggagcgcacctccttcgagctgaccagcctcgggcgggaccgtctcgccgcctggctcaccgaggtcgagccgcccgcgccccatgtgaccagcaccctcttcagcaaggtggtcgtcgccctactggcggccggcgccgaccgggcgcgcgactacctggtcgcccagcgcgccgcccacatggcccggatgcgcgagctgaccagcacgaagaccatgcccggcgcctccgtcggcgacatcgtcgccgccgattacgccatcgggcatctcgatgccgacctgcgctggctgcagaccaccctggcccgggtcgccgacctgcacaaggaagtgacagcgtga

SEQ ID NO: 2655 - DNA, 687 bp, Actinoplanes utahensis
gtgagcacaccactgttgaccggcaccgggatcgtcaagagttacggcgccacaccggcgctgcgcggcgtggacgtcaccgtcggcgccggggagatcgtcgcgatcaccgggccgagcggctgcggcaagtcgacgctgctgcactgcctggccggcatcatccggccggacgcgggctcggtcgtctaccgcgatcaggatctgaccctctggtcggaggcgtcccggtcccggctgcggcgcaccgagttcggcgtgctgttccagttcggccaactggtaccggagctgaccgcggccgagaacgtcgcgctcccgctgcttctcgccggttcggggcggcgagaggcgcggggcgcggcgctcggctggctggaccggttcggggtggcggaggtggccgacaagcggcccggcgcgatgtccggcggccagcagcaacggtgcgctgcggcccgggcgctggtcaccgagccggcggtgatcttcgcggacgagccgaccggtgcgctcgaccagctcagcggggagcaggtgatggcggcgatggtgcaggtggtgcgggagcagggcagcgcggtcgtgctggtcacccacgaggcgccgatcgcggcgtacgccgatcgggagatcgtcctgcgcgacggcgccgtggacgccagcggcatcgggatcttcggatga

SEQ ID NO: 2656 - DNA, 1503 bp, Actinoplanes utahensis
atgagggccggcacgctggtccggctgagtctcgccggcaaccgcaccgaccggctgcgcaccgcgctcaccgcgggcagtggggcgctggccgcgctggccctgctggccgccgccacggtcgccgcgatccacggcggcgagtgggtatacgacccggccgatccggcccgccggtccaacctgtcgccgggctccagccagtactcgagtgccctactcgccgagcacggcctgcgtccgggcgtgatcttcgcgctggtcatgctggccctgccggtgttggccctggccgggcagtgcatccggctgggcgccccggcccgggatcggcggctcgccgcgctccggctggccggcgccaccccgggggagacggcgctggtcgccggcgccgagaccgcggccgccgggctgctcggctcgctcgccggctacggcctcttcctgctgctgcgcgtcctgctgaaccggcgcaccgcggacggcaagctgctcctgcccaccgatgtgctgcccggcccggtcgcgaccgtcctggtgctgctgctggtcccggtgctgtccgggctgatcggcacgctgctgatgcgccgcgtggtggtcaccccgctcggcgtggtccggcagatccgcgacgacggcccgcggccctggccgggcgtgctgatcgcggtgggtctcgtgctgttcgcgccgcgcaccctgcacctgatcccgccgggctggcatgtgccggactggacgccgctggtgatgatgggcgccagcgtgctgctggtggtgatcggcgtggtgctcggcaccggctggatctcgtacaccaccggtcgcctgctccgccggttcggtcgcggcccggtgaccctgctggccggagcccgcctgatggccgacccgtggaacggcagccgcaccctcggcgccctgctcgccgcggtcgtcttcggcgccggcacgctgggttaccgtgccgacctggccgccgacttcgccgcgcgggagcggttcgaccagctcaccgatccgcagtacggccggtacggcccggctttcgacaccggcttctacttcggggccatccgcctgatcctggtcgcggtggtgctggccctggtggtcgcctcggccggcatcctggtcaccttcgccgagggcatcaccgcccggcgccgcacgttcgccgcgatgaccgccggcggggtgccccgcggcaagctcggcgcgatgctgttctggcacacgttcgctccgctgctgccggcgctgctactggccctgaccgcgggggtgtcgctgatccgcacgatgcgcaccgaggtcgacgtgtcggagcccggcccggccggcgatctcgcggtggtgcacatgccgatcccgctccccctggcccagctgaccctcctgggtgccgccaccctggccaccatgctcctggtgaccggcgccggtctgctggtgctgcgcgccggcaccgatctggaggagttgcgcgcgggatga

SEQ ID NO: 2657 - DNA, 723 bp, Actinoplanes utahensis
atgacgcccccggatccgggtagtccaccggtcatgagactgctgaccgccgccgtcgtgatcggactcggtgtccgcgtcgtgcgctcgcgccaccggcgattcctgcaccccgcgggtcgttcgttcgccggcacgctggagatctggggtggcgccgagccgctcggtgccaccctgctcgacaccccggccgtgcacgacgtgacggtccgcgtctccaagggcgccggcacgaggggcgcccgcgtcgacatccgtggcgtcgcggtccgggtcggcccggctgacctgctgctctcctcgaccggccggaccgccctgacgaagcggcttccggttccccgactgagtttcgacacggtgtacggcgcgatcaccccgtaccggactggcacccgcaagctctatctggaggcggtcccggatccggacgcccgcccgctgggccgggcgctctcctcgatcccggcgggcgccgcgctgctgctgcgcgccgacgaccggacggtcggccgggtggcgctgcggcacgccctgcccgaagcgaccgatgcggcgctggccttcgatccgatccgcaacgccacacccgacctgcaccccaccggcctcatccacggttcccgggcgctggcctaccgcctcagccagcgctggcgcggggccaccccgccggccacggatcccgcggcgctggcccgcaccgtcacccaccactga

SEQ ID NO: 2658 - DNA, 1131 bp, Actinoplanes utahensis
gtgatcaagcgggagatggaggactacgtccgggcccggcacatcgaggagggcttccagtatgtggggaccccgcacatcaccaaagagggactgttccacacctcgggacatctgccgtactacaaggacacgatgttcccgccgctgcagatggagggcgcggactactacctcaaggcgatgaactgcccgatgcacaacctgatcttcaagtcgcgcgggcggtcgtatcgtgagctgccgctgcggctgttcgagttcggctcggtctaccgctacgagaagtccggcgtggtgcacggcctgacccgggtgcgcgggttcgcccaggacgactcccactcctatgtcaccgccgagggcgccgccgacgaggtccggcacctgctgaacttcgtgctgtcgctgctgcgcgacttcgggatggacgacttctacctggagctgtcgacccgcgacccgaagagcgacaagttcatcggctcggacgagcagtgggcggtggccaccaaggtcctggaggacgtctgcatcgagtccgggctcgacctggtgcccgacccgggcggcgcggcgttctacggtccgaaggtgtcggtgcaggtcaaggacgcgatcggccggacctggcagatgtcgaccattcagtacgacttcagccagccggccggcttcggcctggagtaccaggcggcggacggctcgcgtcaggagccggtgatgatccactcggcgaagttcggctcgatcgagcggttcttcggcgtgctcaccgagcactacgcgggtgcgttcccggcctggctggcgccggtgcaggtggtcggcatcccgatccgcgacgaccacgccgactacctgtcgtcgttcgtggagcgcctgcgccgggagggcatccgggccgaggtcgactactcgtcggaccggatgcagaagaagatccgcaccgcccagcagcagaagatcccgttcatggcgatcgccggcgacgacgacgtgaacggcggcaccgtgtcgttccgctaccgggacggctcacagcgcaacggcgtgacgctcgacgaggccgtggcgcacgtggccgaggtcgtccgctcccgcgtgaacaccggtccgtcagcagcctga

SEQ ID NO: 2659 - DNA, 1791 bp, Actinoplanes utahensis
atgggtcgagcaggccggcgccgtcgtgccggccctggccgagcacccgcactggctgggcctgacggtggagaaccgcctccagcgggtgctggccctgcggtacgcccggcagaacgacgacgcggcggtccggcggaccctggcgcgggccgtcgagctggaccgagcgctggccgcctacgcggacgactcgatcctgctccgcagcctgtccaccgagatacaccggctcctgctggacgtgcaggtgcgctacgagaccaagtgcggcaccctggccaccgccgcgccgatgatcgccgaactggaccgtatcgaaccacactatccggacagccggtccgcgatcggcgcgctgtacgcggccaacgacctgccggaccgggccgcggcacagttcgagcaggccgccgcgggcggctcggtcctcggtgcgatcgccgccttccgggccttcgagtgccaccggctggccggcgaccgggacggcgccgaacggtcactgctgctgctggccgacctggaccccgcggccgacatcgggcggtacacatgatgaccgtcctgacgagttggtggcgggccaacctgcccgccgacccggccgggcggcgcttcgtcgccggctccctggtcgacaacctgggcagcggcgtccgcgacgtcatcctgccgctgttcctggtgcagatcgccgggctgccggtcgccgaggtcggcaccggcctgctggtctccggactgatcgggctgctgggcgcgccgttcgccggccgcgccgccgatcgggccggcgccaagaccgccctgaccctcggctgcacgctgaacgcggtggtctcctgcctgctgatctcgatccactcgctggcggcgatgtgcctgctcctcgcggtgtcgcgggtggccacccagttctcccgcgtcggccggctgaccatcctggcgcacgtggccggcgagcggcgcaacacgctgcgcgcccagatcaacatcttcaacaacgtgggtgtcgcggtcggcatgggcgtcagcgcgaccgcgctcaccctcggcacccgctcggcctacctggccggcttcctgctcgacgcggtgacgttcctgatcgcggtggcgatccagctgccgatccgggtggacgcgatcgccggcccggccgtgacaccgccgcgggcgccggcgccgtggcgacatctgttcaccgatcaccggtacgccgtggcgaccgcgttgaacgggctgctctgcctgcaccaggcgatcctgttcctgggcattcccctgtggatcgccgccacccacctggtgccgcggccggtcaccgcggtgctgttcctgctcaacctgaccctggtcatcgccctgcaggtccggttctccgccccggtccgcggtctcgcgccggccgcgcggtcgtggcgccggtcggcgaccggtgtcgccggggcctgcgcgctcatggtggccgccacccgggtggactcgaccgcggtccgggtcgccctggtggtcggggcgggcgccctgctcacgctgggcgagctgtgctactcagccgccgagacggagatctccaccgtcctggcgccggccgagcaccgcggcctctaccagggagtcttcgtcctgggccgggacgccgcgcagaccgccgggccgctcgtggccgcgctgttctgcgtgtcgttgcacgcctgggggtgggggctgttgctggccggcttcgcgctcttcgccgtgctggcgccggccgcggtccggcaccccgagccggtcagcgtctag

SEQ ID NO: 2660 - DNA, 723 bp, Actinoplanes utahensis
atgatccagcagctggcccccggcaccgtctcgttcgcgcggttcgacgaggccgagtaccgccgcgtcctcgacgagcacggcttcgtccgagccgtcgacgtgccggacggcttcgaccacgccgcgttcctgagccggttcggccggttccgtcccgggccgtccggcaaggtgatcgacgacatcgtcgccgaacccggcatggacgacgtctactacggctccaaccgtcgggcgctgctgccgcacaccgaggggtacgagttcgccggcctgccgccgcgctacctcgccctctggtgccggaccccggccgccggcgacggcggccagaccacaatcttcgacagccgtccggtcctggccgggctgtccgcggccgagcgggacttcctgcggcggaccaccttcgacttcgtctccagcgagggcctgcgccggcacgggctgggccagaccaaccggcatcccatgctggagaccgtggacggcatcgagctgctccgcttctcctgcaacaacgtccggctgggcgagcgggacgggccggcccggtcgctgatccggcgggtgctggacgcctgggacgacgggcacgtcgccgtgacgtacgcccgcaacgatcttctgcacttcgacaactggcgggtgctgcactcgcgcaacgcgtacaccgatccgcggcgccatctgcgccggatacagctcgaccaagtctga

SEQ ID NO: 2661 - DNA, 912 bp, Actinoplanes utahensis
atgaccaccgccgtcaccccaccgcgtgccggcctggaccggtcggtgctgatcgcgctggccggtgtggtgcagcgccgggtgctgctcaccatgaccgcgatggccgccctctacgccggcgcgctgaccctcgcactgcgcctggacgagccggtcgtcacggtcgccgcgacgctggcgctgaccatggtcatgtccggtttcatccaggccgcccacgactgcgtgcacggctcgcacctgcggtcccggcgcgccaaccgggtcatgggcgccgcctggtgcaccccgatcctgatcaacttcaccaactaccgctaccagcacctggtccaccaccggttcaccggtgtcccgggcgacaccgagccggagaagaccttcaccggcctcggcgcatacctctactcgatgagcggcatcacgctctggcgctacaacgtcatcaccgccacccgcacctggcagcaccgattcccggccagtgtcaccggccacccggaccggcgccgcgcgtcgcggcaggacaacctggtcatctgtctctgggtcgcggtcgcgctgacgctcaccgcgattttcccgtacgccgttctgctcggctactggctgcccctgctggcgtccaccgtggtcgcgcggttcaccgggctcaccgagcactacgggctgtggggtgtgccggacatcgagcgcaacacccgcaccgtgcggtcgaacccggtgatgcgcttcttcatgtggaacgccaactaccacgccgagcaccaccggttcccggccgtgccgacgctgaacctgcaccggctgcaccgggcgctgcccgaaccgcatccgctgcaggccgcctcgtacaccgcattccatctgcggctgatccggcatctcaccccaggagagacgtcatga

SEQ ID NO: 2662 - DNA, 408 bp, Actinoplanes utahensis
atgagcgacgcccaggagcggacctggcacgacgggcgatgccactgcggcaacgtgcgtttctcggtctcgctcaccagccacctgaccgtgaccctgtgcaactgcgggatctgccacatgtccggccatcaggagctgatgctgcccgaggacttcttccggctgcaccagggacaggagttcctcaagccgtaccggttcggcacgatggtcgccgaccacacgttctgcgcggtctgcggcatcatgccgttctaccgtccccggtcccacccgaccggctacttcagcgtcaacgcgcgctgcctcgacctcagcttcgccgagcacgtcgagtacgccgagttcgacgggcagaactgggaggccagcatcgccgccggccggcacaaactgacagcctag

SEQ ID NO: 2663 - DNA, 1287 bp, Actinoplanes utahensis
atgcgcagagtcatcatcgtcaacatccgggccgactacgcggccgacatcgtgcaccggctgccctcggtcacctcctgcctgcggctgatctggatggcccggcccggcgacgtggtggtggttccggccgcggtcgcccccgggttcctcgcccacatcgaggcgacgctgggctggccgaccgggtcggtgcgggtgctgtcctggccgggcatcctcagcgacgaggtgctgacctccgacgagttcaccgcggcgctgcgccccctgctggacgcgaccggctggacggtggcgccgtgcttcgtcaccgagggcaccgccgccctggccgaccggctcgggctgccgccggcgccgggtgacacgttcgccgcccagcgcgggttcgagctgttcaaccgcaagtcgcacttccgccagatcgcggccggcgccggcctgccgctggccgccgggtcgatcgcgcgctcccccggcgcgctgtcccgggcgatcggacgcctgctgccggagaccgggcgggtgatcgtcaagactgacaacgccggtggcggcagcggcaacatcgtgctgaccagcgacgacagcggcccgctgcccggcgcccgggagacccggcggatacgtggtgacctcaccggggtcggccggcgcatctgggacgaactgaccgacgacggcagccgggtcgtcgtcgccgaggcgtaccacccggcggtacggatgttctacttcgagtacctgatcgacgaggccggccgggcgcggttcctgaactcgggaagcatccgcctggagccggccggcgacccggacgcgcccgcactgtcctggatcggcctgcggatcccggccgacctgccgccgttcagcctgaccgaggcggccacctgggccgcggcgtacgccggtcacgccgcccggctcggctaccgcggccacctcaacatcgacgccatgctcaccccggaccagcggctgatcttcaacgagtgcaacgggcgctggggtggcgggctggtcctgcacgaggtggcagaacgcctgctcgggccgcgatacgccgaccgctggctgctgaccaacctgcgcgacgtcccggccgtcccgcccgggtcgctgcccggcctcaccggggacggcgtcatcgtgctggccgccgacccggacggcggggagccgaccgagtgcctgctgttcgccgagaccccggagcggctggcggcgatcgaggacacggtccgggacgcggcttcgcggctgaccggaacaccggtctga

SEQ ID NO: 2664 - DNA, 1218 bp, Actinoplanes utahensis
atgaccaccgtcgtcgtgcttgaaccccagtcgtccgggctgtccctgctgcgctacggcaaggcggccggccaccggatcgtggtgctgtcccgcgacgccggcgaccggcgcgtgccggacgaccaccgccgctacatcgacgaactcatcgaggtcgagaccaacgaccaggccgcggtcgatgccgccctggaccggctgccccggatcgacgccgtcgtaccgggcctggagttccacgtcggcgtcgccgcccgggccgccgcccgcctcgggctgcccggcctgccggtcacgacggtcgacctggtccgcgacaagcacctgatgcgggccgctctcgaccgggccggactgccggcgccccgctgggcggcggtgacgtcaccccgggaagccgtccgggcggccaccgccatcggctacccgctggtgctcaaaccggccgacttctgcggcagcttccacgtcaccaaagtcaccgacgaggtggagctgaccgccgcgtaccggcggatggccgccgacgagacccgcgacttcggccgcaccgccggcgcccgcgcgctggtcgaggagtatctgaccgggccggagctgagcgtcgagggatacgtgcacgacggcagggtcacggtggcggcgatcgtcgagaagagactgtcgccggagccgtcgttcgtcgagatcggacacgtcgtgccggccgagctcgacgccggcgtcgcggaccggatccggcggcacaccggggcggtcgccagggcgctcggcgtcaccatggggccgttccaccacgagatccggctcaccgcggacggcccggtcaccatcgaactggcggcccggctggccggcggccagatctacgagctgatcgaactcaccaccggcgtctgcctgccgcgcgcgatgctcgccggctatctggggcgggcgccccgggagacccgcacgaaggacgcggccggcgcggcggcaacggtgttcttcatcccggccgggccggtgtccggcacccgtgcgctcggcgcggatcgggtggaatcgctgccggggtacgtgcggcaccggttcaccgtcgtcccgggtgccgcggtcccggcgggcaccgaccatcggtgccggctcggctacgcgatcctgcgggcgggcagcaccgcggaggcccgccggctcagcacgaccgccgccggactggtcaccttcgagtga

SEQ ID NO: 2665 - DNA, 1245 bp, Actinoplanes utahensis
atggccgcggcaaccttcaccaccctcctgacacccgccaacgcctgcgcggcgctgcccgtcgtggtcgaggaggagctgctgctggccgaccgggacaccggaacggccgtcccggccgatgaggcgctcgccgcggccctggcgccgcacggacgggtcatcggtgggacggtgacgctggtgtcgtcgccgtcgaccgctctcaccaccctccgcgcggatctgctgcgcggccgacgagcggccgccgcggccgccgcggaacacggcgcgcacctgctggcggtcggcatgacgcccgaagacccggcggcggccctctgcggcctgacgattcacgtcggtgttcccgacggccgggcggcggtgcgggtatgccgccggttgccggcctggttgccggtcgtcgaggcgctcaccgccaactcgccgttcgcccgcggcgccgacaccggccacgcgagctggcgtttcgtgcaggcccaacggcgcgcgctcggcgcgttcgggccggccctgcggtcagccggcgcgatcgccatgaccccctcgggcgccggggcctcgcggtccgacgaagctttgccatccggcgaggcttcgctatccggcgaacctttgcgatccggcggacctttgcgatccggcgaagcttcgctatccgccgcagcttcgctatccgccggagctttgcgatccgccggagctttgcgatccggcgaagcggccatcgaagcggccgccgcggtgtccgcggccgtccaggcggcggaggccggcctgccggagtcgctgcgctactggcgggtgcggccgagccccacgccggcggtccagatccgggtcggcgacgtgggcctgagcgccgacgacacggtcgtggcggtcggtctgctgcgagccgccgtgctcgccgcggtccaggacaccgggcccgggcaccgaccggtcccggtgggtccggcggtgctccgcgctgcccactggcgtgcgtcccggcagggtctgcaggcccggctgttcgacccggcgagcggccgccccgcgccgtcctggcacgtcatcgatcagatcgcggcggccatgttcctcccgtcgggcgatttcgagacggtacgcgacgggttggcgcgtctgcgcgacgagggcaacggcgccgaccggcagcgccggatcgtggctcgggccgacgacggccgggccgtccgctcggcgctcgcccgactgaccatccagggatga

SEQ ID NO: 2666 - DNA, 1119 bp, Actinoplanes utahensis
atgcctacgacaactggggtgacgatcgaggacgacctcgatctgatcgccgaggagtacgcgcgtctgctggccacggccgaccaggccaccgatcggcgcctgcgcgcggagatgatcgatcggatggtgccgttcgcccggcgcctggcccagcgttaccggcacagcggcgagccgttcgaggacctcgtgcaggtcgcctccctcggcctggtcaaggccgtgtcccgctacctgccggagcgggggtcgttcaccgcgtacgccgtcgccacgatcagtggagagttgaagcggcacttccgggaccacacctggtcggtccgcgcgccgcgccgcctgcagcacctggccgcgcagaccagggtggccgaggtcgagctggcgcacgagctgggccgggcgccgaccgagggggaggtggcgcagcgctgccacatcgactcggagacgctggacgaggcccggacggcggcgagcggataccgtgccgtgtcgctgagtctgccgctcggcgagggcgacggcgagctcgccgatctgctgggcagcgccgaccccgcgttcaaccaggtcgccgactatctcgcggtggccaaactcgcccgccggctcccgccgcgggtccgccggatcctgatcctgcgcttctaccaggaccgtacccaggcccagatcgccgccgagatcggcatctcgcagatgcacgtgtcccgggtgctcacccgggccctgacctggttgcgcgaggcgctgctgcaggacacggtgccgccctggccgggcaacgacgccgacccgatggacggccgggtggtcagccgcctgcggccggacggcgcgaccgaggcccggatctgcggcgagatcgacgcggacagcgccgtcctgctgcaggagacactcatggacacgctgcgccggctgggcggcggcgcgctggtcctcgacctggccggggtgtcgctgctgagcgccgccggagcgcgcgtgctgcgcggggtggcggacgccggacgcgcccacggcgtgacggtccggctgaccggtgtgcggcccaccgtccgccgggtcgtcgcggtcgccggcctgacccgcctgctggcgcccgcctga

SEQ ID NO: 2667 - DNA, 1878 bp, Actinoplanes utahensis
atgaggtttgatggacctcagacagcgcagaacggggaggcttcggtgcccgacgctccggacgagctcgacgtgcaggtgggccgggcgcgggcggtccgtgccgtcttcgactcgatgcccgtggcgctcgccgggctgaccggcccgcagcaccgggtcgatgcggtcaaccacgccttccgcgaggtgttcggcggcttcgccgtggtcggcctgccgctgtccgtgcccgccctgttggacatctgtgaccaggttttcgtctccggtgtgccgcagacgttggacggctggccggccggggaccgggagatcgacctgacggtcgcgccgcgccgcgacgccgccggctcggtcgccggtgtcgagctgatcggtgtcccccggcgggagtccgcggcggccggcgacgaggtcgccgcggtgcagcgcgagctgctgcccaccggtctgccgctgctgccgtccgtgcgcctcgatggcggctacctgccggccggggacgccgacgcggccggtggtgactggctcgacgcggtcgcgctgggcgagggccgggtcgcgctgatcgtcggggacgtggtcgggcacggcgtggccgcggccgccgcgatgggtcagctgcgggcggtgctgcacgaccggctcggcgcgaccggcgacctgctcgacgcggtcggtgccgccgaccgactggcccgccgcgtgcccgaggcctacgccgccaccgtgtgcatcgtccagctcgatccggccgacggccggctcacctactgctccgccggccacccgccgcccctgctcgccggtccgcgcgcggcccgcttcctgcccgcgtccgggcacgggccgctcggcaccggcgccacctacctggcccggaccgcacggctggagccggacgagatcgtgctgctctacagcgacggtctgatcgagcggcccggcggcaccccggccgccgggaacgacgcgctgtgccgggcggtggcgggcgcgctgtccggccccggcccgcgggacgtcctcaccgcgctggacctgctgatccagcggaccggccacaccgacgacatcaccgtgctcgtggcggcccggcgcgacccgccgccatcgctgcggctgaccgcgccccccgggtcggtctccgtacgcggcctgcgggccggcgtcgaggactgggccgatgccctcgccaccggcgaccaggatcgggtcgcgttcgctcacgtggtcaccgagctggtcaccaacgcgctggagcacggcgccggcacggtcaccctgaccgccggggtgagcccggacggcgaggcccggatcaccgtcgcggaccagggtcgctggcgggagcggccgcggcccggcgacgacgacttccgccgcgaccacggcttcgggctggccatggtcgcgtcgttcgccgaccggctggacatcgacaccggcgcggtcggcacgacggtcacggtccaccgccgcctgtcgcggccgctccggccgctgaccgccggacagtccggcagtgtgcggcccggcgcggatccggagctgatgatgatcgtcgaccagccaaacgcgccgagcagtcgggtggcgatccacggcccgctggacgccggcaacgtcgacgacctgagcgccgagctcgatcggctcaccctgggcggcagtcacgacctcgtcgtcgacctcagcgcggtcaccctgctggccagcgccgcggtcagccagctgtaccgcagcgacccgcgggccaccggccggcgctgcccgctgcggctgtacgcccccgccggcagcaccgccgatcaggttctcaccctggtcgacctgccacatgccaccgtcgatccgcacgctctggcacgctga

SEQ ID NO: 2668 - DNA, 1143 bp, Actinoplanes utahensis
atgagctcgatgaccgcgaccgccaccaccacgaccggaccggacacaccgccggcactcaccctcggggtcgaggaggagttcctgctgctcgacccggccaccggcggcaacgtaccgctcgccgaccgggtcaccgccgccctgccggagccggtccgcagccgcagccggcgggagatgcgacgcagcatggtggaggtggtcaccggggtctgcaccggactgcccgacatgcgggcgcaactggcggagcagcgccgggcggcggccgacgcggccgacgcggccggcgcccacttggtcgccatcggggccacgccggtgaccgagcaggacgtcaccgtgccgccggacccgcgatatcaggatctcgtgacccggtacggcccggtggccctcgaccccgcggcctgcggcctgcacgtgcacgtcggcgtgccggaccgggagatcgccgtgcaggtgtgcaaccacctgcaggtgtggttgccggtgatccgctcgctcaccggcaactcaccgttcttccagggtgtcgacaccggacatgccagctggcggtcggtgcagctgctgcgctggcccagcatgggtccgaccccctacttcgcgtccgcccgcgagtacgaccgcacggtggcccagctggtcgcctccgggatggtgctcgacgaggccgccatctactggtacgcccgtctctccccgacctatccgaccgtcgagatccgggtgggtgacgtctgcaccgacatcgacgacaccatcctggtggccgcgctcgtgcgggccgccgtcgccaccgcgatcgccgacatccgcgccggccggcccgcaccccgcccgcgggactgcctgctgaacgcggcgaactggcagtccgcgcacgacgggctcagcggggacctcatcgacctgcgcctgggccgcgcccggccggcctgggaattcatcgacgagttcgtcgccacggtcagccccgcgctgcgggcggccggtgacctggagacggtgctcgacgggctcacccggctgcgggccggcggcgacggcgccacccggcaacgcgcgatccaccacggaaccggcgacctgcgcgcggtgctggccaccctggccgcctggacccgtgccggctga

SEQ ID NO: 2669 - DNA, 531 bp, Actinoplanes utahensis
atgaccggctacggcgacgacgtcggtacgacatcggaccggtacaccatcaacgccggccgctactgggccagcgccgtcgcggccgccctggtcgcggccctggtcgcgatcgccggcgtactcatcgcccgcggcctgttcgacgtgcccgtgctggcccgtcgcagccacggcgcctggggcgacgcacacaccgccacctacgccaccggcgccgcgctggccaccctcctcgccgccggcctgctgcacctgctcaccctggccgtcgccgagccgcgccgcttcttccgctggatcatggccctgatcaccctgatcggcgtcatcaccccgctgaccctcgccgacaaacccggcccgagaatcgccaccgcgctgatcaccctggccatcggcgtcaccatcaccgccatcctggacagcgtcgcctccgccaccagccacccccgccctgccgagcagcgcgacgccctggccgccacccgccggtggacggccgagcccccaacgtaccggcaaagttga

SEQ ID NO: 2670 - DNA, 897 bp, Actinoplanes utahensis
gtgggacggcttgcccgcctacctggcggcggaggccgaagcctggtgccgatgaccggccggcgccttgccgccgtccggaccacgctgctgctgaccacgctgttgctgctgaccgcctgccggccgggcgtgcccgcggccaccgtgcgccccggcgcgaccgaggtcacgtcacagccggacgcgcaacgttgggtgcccgcacccggcgtcacgtggcagtggcagctcaccgtgccggtcgacccgaccgtgaacgccacggtctacgacatcgacggtttcctcaacggtgcggatctggtgtccgacctgcatcgtcgggggcgcagggtggtctgctacgtcgaggtcggctcggccgaggagtttcgccccgattacctggactggcccagggaactgctcggcaggcccaacggctggccgggggagcggtggctggacatccgcgacccggcgagattgaggccggtgctggccgcccaattcgacatgtgccgggcgaaaggtttcgacgcgatcgaaccggacctgatggacgggtacgccaacgacacgggtttcccggcctcggcggccgaccagctgcggttcaatcggttcgtcgcgcggctcgcccacgatcgcggcctgtccgtggcgctcaagaacgacgtcgagcaggcggccgagctggtcggcgacttcgacttcacggtcaacgaggagtgcgccgccttcgccgagtgctcgcgcctgacgcctttcatccgggccgggaaggcggtgctgcacgccgagtacgatctggcgccggctgaatactgcgccgagtctcatcgcctgcgcctcagctccctgcacaagaatcgcaacctggacgccgtcgccacaccatgcccggcaggctga

SEQ ID NO: 2671 - DNA, 897 bp, Actinoplanes utahensis
atgcgttgtctgctgatcggtgcttccgggttcatcggtggccgggtacgtgagcgcctcggggccgacccggcggtgaccgtgatcccggccggccggtccggcccgttgcggctggacctggccggtgcgagccacgacgaactggtcgcccggctgcgcgagaccgaacccgacgtggtgatcaactgcgccgggacgacggacggcgatccggccggcctggccgccggcaacgtggtcgcggtggcccggctcctcgccgcgctgcggtcgtccgcccaccacggcaagctgatccatctcggctcggcggcggaatacgggccggtgccggagggcctggcggtgccggagagctgcccgccgcggccggtgtccgcgtacggaatgagcaagctggccgggaccgagctggtgctcgccgcccgccgcgacggcctggccgccaccgtgctgcggatcttcaacccgatcggaccgggcaccccggagacgctccttcccggtcgcctggtgtcagcggtacgaacctccgcggtcaccggcgaccgagcccaactgggcccgttggacgggcaccgcgactttgtcgacgtccgggacgtggccgaggcggtagcggcggcggtcaccgcggccggtccactgcccgaaattctcaacatcggcagtggccgcgccacccccctgcgcgatctggcggccatggcggcggagatggccggggtggcgatgccggccgaggagcgcagcggatcgccgcggtccgccgcggtcacctggcagcaggcggacatcaccgcagccgcgtcgacgctggggttccagccggcgtacccgctgctgacgtccctgcgggacatgggtgtcgccgatcctccccccgcccggtga

SEQ ID NO: 2672 - DNA, 732 bp, Actinoplanes utahensis
atgcacgcagtgatcctggccggcgggaaaggcgtgcggctgcggccgtacacgacggtgctgccgaagccgctggtgccgatcggtgaccaatactcgatcctggaaatcatcatgcggcagctgtcgcagttcggcttccgctccgcgaccctggcgatcggccacctcggacacctgatccgggcctacgtcggcgatggccggcagtggggcctggagcgggtggacttcaccaccgaggagtcgccgctgggcaccatcgggccgttgctgggtctgcgcgaccagctaccggagcacttcgtggtgatgaacggtgatgtcctgaccgacctgaactacgccgatctgctggaccggcaccgcaacagcgggtccgagctgacggtcgccaccttcgcccggcaggtgaagatcgatttcggggtgctgacctccgtgggcggtcgcatcgtcgacttcaccgagaaacccaccatggactatcgggtgagcatgggggtgtacggcatgtcggcgagcgcactgcgccggtacaccccgggcctgcccctgggtttcgacgagctggtgctggacatgctggcccagggacggggtccggccgagtacgaattcgacggcaactggctggacatcggccggccggacgactacgaccgggccaacaccgagttcggggtgctcgctccgctgttgttgccgcagctgcgggccgaggcggcctga

SEQ ID NO: 2673 - DNA, 993 bp, Actinoplanes utahensis
atgacgacggtcgcagtaaccggtgccgacggcttcatcggctcccacctggtcgagaacctggtcgagcgcggtcaccgcgtgcgcgccatggctcagtacaattcgctcggcacctggggctggctggatgcgctcagtcccgacgtgatggccaacgtggaagtgctcaccggcgacgtcacggacagcgacacggtgcgcgacctgatcaccggcgccggcacggtttaccacctcgccgccctgatcgcgatcccgtactcctaccgggcgccccgttcctatgtgaacaccaacgtgatcggcacgctcaatgtgctggaggcggtccgggagcagggctgcgaccggctggtgcacacctccaccagcgagacgtacggcaccgcgatgaccgtgccgatcagtgagacgcacccggtgcaggcgcagtcgccgtacgcggccagcaaggccggcgccgacaagctggtggacagctaccacgccagcttcgacacccccacggtgatcatgcgaccgttcaacacgttcgggccgcggcagtccgcccgggcggtcatcccgacggtgatcagccagctcgccgccggcgccgacgagatccggctgggcgcgctcgacccgacccgtgacttcctcttcgtgcacgacaccgccgaggcgttcgccaccgtcggcaccgcaccggccgagaaggtggtcggccagtccttcaacgccggcaccggcgacgagatctccatcggcaagctggccgagatgatctgcgcgctgatgggccggccggtgccggtgcggctggagaacgaacggttgcgcccgaccaactccgaggtgatgcggctggtctgcgacagcagcaagctgcgggcggccaccggctgggccccggcccatgacctcgcctccgggctcaagctgaccatcgactggttcctggacccggcgaacctcgccaagtaccgccccggcacctacgcgcgttga

SEQ ID NO: 2674 - DNA, 1365 bp, Actinoplanes utahensis
atgaccgtcgacagcccgtacgccgatctgatcgagaagatgtcgccggtctgtgccgtggcggtcgactcgtacgaggtggccgcggtgttggaggccgacgggatcaccgatgtggcggctcaggagcgctattcggcccgggacgtcttcgacctcgccgaccggttgttccggctgcgcccccgagtgcgtcaggccgatcgaccggcccccgatccgtggcaggccacaccggtgacgcatgtcctgcggggcgtgctgttcgcgcttcccgcactggcgtacctggctgtcgcggaccggatcgccgggccgcgtcccaccgccctgctggtcgtttcggtgctgctgtcctggaccgtcgggcagggcctggctcacctggggtacgcccggctcggccgggccgatcagcgagccgccgccgtactcggtggcgccgccctgatcgtcgggttgcccgcggtgacggtcgtggcagcgctggggatcgccctcggcgtttcgctgaccgtcacgctgatcgccgccggtcaggtggcatatgtcctggccgccacggtcgctctggtgctcggccgggagtggtggctgctggccgcgctggttccgggcgtcggcgccgggatcggcagactcgtcgccgggccggacgcgggtccttccggtctgctcgcggcggccgccgcgctcagtgtggccgccgccatcgtggtggcgggctggcagcacctacggggtgtccgcccgcagctgcccagccgggtggatgtggccgccgcgtcaccgaatgcggcattcggtgccgtggtcggggcattgctgatcttcaccccggtggcccgggcgctggatgcgacccctgacccgcggatcggtgtcgggacggccctggccatggtgctgccgctgtcggtcagcatgggagtcgccgagtggctgctcttccgctatcgctcggccgcccgccgcgcgatggccgaggcccgcaccctgcaggcgttcggccgccgggcgtccacggccctgtccggggtgacaaccgcatacctggccgtcctggtcaccatcttcctggccggaatcggtctgacggcgctgctcaccggcgtgctgccggctgcctggcccgtcgccgcggcggtgttgaccggggtggcgttgttcctggcactgctgctgatgtccttccacctccgtgggccggccgtgctggcctgcctggccgcgctggccgccagtctgctcctggcccccttcgcgccacccgagaccattcaagccgtcaccgctgccggcttgctgatcggcctgtacgcctacgcccacgtgaccttacgacgggcccagctccacctctga

SEQ ID NO: 2675 - DNA, 1515 bp, Actinoplanes utahensis
gtgaaggtcgcactactcacggaggggacctacccgcactcgatgggtggggtcagcgtgtggtgtgaccagctgttgcgtggcttgaaacaccacgagttcgacgtgtacgcgatcgtggcctccggcgtcgagccggccgtgtgggaactgccggcgaacgtcacggcccacggcatcgcgctgtggccgccggtcgccggccggccccggtcccgcacgccccggaccgccgagcggctcgcctcggcgtacggggacctgatcgaagcgctgctgctgccgtccgagtcggccgccgacgccttcgcggcggcgctgcgcgggatcgtcgaacacgccgcatccgagacggtggggacggacctgtccccgtacggcgaaatggcggtcagccggctgttgaaggcgtgggcggcgaacgccgcgctgagccaggtcgccgtgccgtcggtactggacgcgttgaccgcggtggacgtcatcgagcgttcactgcggcccctgctgcacccgacgccgcgggcggacgtcacccatgcggtgaccaacgggctggccgccctgcccggcctcgccgccaagtggcggtacggcacgccgatgctgctcaccgagcacggcgtctacctccgtgagcgatacctcgggctgcgcgccgccgagtacaactggccgatcaaggcgactctcgccgcgttcctccggctgctctgcaccacggtgtaccgcagcgcggatctggtcgcccccggcaacaagtacaaccgccgctgggagacgaagttcggcgcgcacccggagctcatcgagaccgtctacaacggcgtggaacccgacgacttcccgacggccggcgcggagccggaggcacccaccgtcacgtgggccggccgggtcgatccgatcaaggatctggaaaccctgatccgcagcttcgcactggtgcacgcggaaatgcccgaggcccggctgcgcatcttcggcggcaccccggccggggccgaggggtatcggcagcggtgcgaggctctggtcgtcaaactgggactggccggagcggcgaccttcgagggccgggtggcggagatccgcgacgcctacgcggccgggcatgtggtggcgctgtcgagcatctccgagggtttcccgtacaccctgatcgaggcgatgacctcgggccgggcgacggtctccaccgacgtcggcggtgtcagcgaggcggtgggcagcaccggcctggtggtgccgccgcgtgaccctgaggcgatggctgccgcctgcctggcgctgctgcgcgacgacacccggcggcgggaactgggccggcaggcccgggagcgggcgctggccaacttcaccgtggacaaggcggtcgacagctacgacgccatctaccacgacctggcttttcggcagtcgcgaaggctggagaacaccgccgtcgccgacaccgtcgtactgaacatcgtcgtacccgacccggccggtcccgaggcggcgggtatccgatga

SEQ ID NO: 2676 - DNA, 2031 bp, Actinoplanes utahensis
atggtgcgctcctggcgttccgcattgaccacggcgggcgcgaccgccgcgacggcggtcctgaccgtcacgccggccttcgcggcggcaccggccggtagccgggtcgagttgaaggtcctggtggtcaccgacggcgggccggcaaccgcggcgatcgcggccgaactcaagtcggaggggacgccctaccaggaggtcaacctgcgcgacggcgggcggcccacggtcgacgccgcgttcctggccgacacggtcaccagcggcgggcggttggtcgaccgggcgcactaccaggcagtggtggtgcccgggcccgactcgttcggcaacgccgccgagtcggccgcgctcaccgcgtacgagcagaagttcgacatcccgcaggtgaacgcctatgtctaccccggcgtcgggatgggtttgcagacgcccacatacgccgggtcgctggacggcgtgaccgcgaccctgaccccggccggcctgggcgtcttcagctatctgaagggttcggtgccgttcgaggacaactcgccggcggtcaccgagtcgtacgggtttctcgcggaaccgtcgcccgccgacgtcgccaccggcgcgatcgccacgccgctgctgaccgccaccgcaccgaacggcaccgccggcaacagcctgatcaccgaataccgggcggacaaccggcgccaactctcgctgagcttcgtctacaacgcggctcagcagcagttccggctgctcgccccgggcatcgtcaactggatgaccggcggggtgcacctgggcctcagccggaacttcctgtcggtgcaggtggacgatgtgttcatgccggatgcccggtggagcaccaccggcaactgcaccccgggtgaggactgcccggacggcaccgccaccacggacatccggatgaccagcgccgacgtgtcggccgtctcgtcgtggcagaccagccgcaacttcaccttcgacatggttttcaacggcaacggcagcgccgaggccgccgcggacgcgttcctcggcgtggacccgctgaccgctgcgctcgtggcacgccggggaagcttccggtggaccaaccacacctggaaccacgagtacctgggctgtgtccgggacgtcacggtcatcccgtggaaatgttcgaccaccacggcgggcaccaccgactgggcctcccggtccctcatcaactccgagatcagcaagaacgtcacctgggcgacgagcttcctgcgtcagctgccgatcgaccggaccgagctggtcaccggtgagcactccggtctcttctacctgccgcaacagccgcagaccaacccgaacctggcgccggcgctgaccagccagggcatcaagtggctggccgcggacaactcccggatgcccgagcagatccaggtcggctcggcgctgaccgtgccgcggtacccgatgaccgcgtactacaacgtcggcaagcgcgccgagatggtcgacgagtacaactggatctacacgtcccgggccgacggcggcagtggcatctgcgaggacaacccggccaccaccacctgcatcacgccgctgaacaccaccaccggctaccaggactacatcgtgccgctggagacccggctggcgctgaaccggaccctcggcaacgacccgcgcccgtactacgtgcaccaggccaacctcgccgaggaccggatcctgctgaccatgatggacagcatcctgacccggtaccggtcgctgatcgccgacaacgcgccgttcgtcaacccgcggatgagcgcggccggtctggaactgcagcggcagaacgcctggcgcgccgccgtcgccggcggcaaggtcagcggttacctccaggacaagaccgtgcacatcgacgcgccggcctcgctcgcggcgccgatcaccgccatcaccggcacccggcgcggcacgaccaccttcggtgaggcgtacgccgggaaccgctcggcctggacgattcccgccgtcaacggcaccgtcgacctggtgcttccgtga

SEQ ID NO: 2677 - DNA, 522 bp, Actinoplanes utahensis
atgtttgatcttgatttgtttcggcacctggtcgtcccgccggacaacgcgccggtggcaaatgactggagcgcggttgaggcgcgtctgggtaccggcctgccgtcggactacaaatcgctggtggacacgtacgggctcggctcgttcggcaacttcttccacgtcttctgccctgacgccgggtcgaagcggggtctcgacctcgagtaccagcatgagcgcactacctgggcgctcgactacctggcggagcgtggccacaccctgccccacccctccgccgacctgctctcctgcggccgctccgacaacggtgacgtggcgtactggatcaccgcggggagcgatgacccggagcagtggcgaattggcctgggagagacgcgcggccacctgtgggaggaattcgacggtggcctcggtgagtggctggcggccgtcctatctcgtcgcatccgcatgaagatcttccccaaagacttcccccgccgaacagtccgcttcacccccatcacgtga

SEQ ID NO: 2678 - DNA, 351 bp, Actinoplanes utahensis
gtgaggaccacgttgtgccacttgctgtccgcgaccgacgcgctcgtggtgatcgggttcgcggccaacgtgctgctgctgatccagaactcgccgagcagcttgccatcggtgccgaggtacagcgtcggcatggtgttaccaccggaacgggtgttcgcgatcggcacgtcgttacgcgaccagagcacgcccgccggcgtgccggaggcggccttgaaccacagcgagatcgagtgcgagttcgacgaggccaggtgcaggttcggcaggttcactcgcgacgacgtgccgttgaacgcggccgaggtggcggcgctggtcgccagcggaccggcgccggccgtctga

SEQ ID NO: 2679 - DNA, 885 bp, Actinoplanes utahensis
atgggtgtgtactgtgtacccatgacacacgctgatcttcggtatctcgctgaggccctcactccgcggcacgccatcgcggtgaatgacccagtcgaccggcagcgcctcggcgacctggtcgatgtcgacacatccgagcacctcctcgggttcatctcccaagctggccgcgtcgtcgctgagacggtggggccgggcgagaccgtgctggccgagaccgacatcgcgatggacgccgatggtggctgggagcctgggccgccgtccgaggtgtggaaggttccggcgggaacccgccgggaggacatgtgggacgacgttgctcgcctcttccttgcccaaagcctgcgtaccggggctgccagccaggtctgtgggtggcgggaccgggttgtggcaatcgtgccggaggaagtcggcccgaaggagtcgacgattatccgaaccttggcgaacggcgggatcgaaacgacgcacacctacaacgttctcgacgcgtatggcacttacgccaagtggctcaacgaacttgccctggaatttggaagcggtgacgaggccatggcctcggacacgccgcaaccacctgggctggtgcgtaacgtcgtcgctgcatggctgatgcgcgaggcgggcgaggcagaactcaaccaggcccgcttctctcttaaaatcggcctcgccggatacgcgcggatcaccgagcgcgcgccgaacgtcgacctgccgatcgccgaacttgcccgttccctctacaccgaccgcgccaacttgacgaaggtcatcaaagcggccgagaaggatgctgtgatcaccgagatccacgatgcgatcgcgtccaaagataccgaccggatcgccgcggcactccgcaagtcgtag

SEQ ID NO: 2680 - DNA, 6387 bp, Actinoplanes utahensis
atgacgcgtcgcgtcgtgcgcttaaggctgttcaactttgtccgggcccgttatgtgatgcgggccactgtagcaacgaccgtggccgcaatggttctgtcgacggctgatgcctcggcggcatgggcagccacgacggactggaacctaggcaacacttcggcctcgcaggttgcagacctgacggcacccgccacgggagtggtccggaacgatggactcaagacctgtttggagcgtgtcagcggcgccaccgccaacggcacggtagccgcctcgtcgacgtgcaccggcgcgtccggccagatgtggaccttcaagcctccgacgttcagcacgcaagggaatctgactccggctggcgtgcccaccagttgcttgagcgtggtgagccgtaatggcggaccggctcgcgaagtggcggcggccggcgctgcccagatgcttttgaccgacgatggccaagtctgggcgaggacccagaatggcttaaatgccgagctgggtccgtgggttaaggagaccgacgccaaggtccaagatatcgccggcggctccgacggcactcagatgatcatcggcgcggactggcacgtgtatgcccgcaataatgtcggtgccgacggctggaccaacgagggcacgcaggctgcgaccgcgatcgccacgaacggtggcacccagctgtacttggcctccgacgggacggtatacgcccggtctggcatcggcgacgctaccggctgggtagccgagaccgccgctggcggtgccaaggcgatcgctgtggggtccgacggcactcagatgatgatcggcgccgacgggtcggtatacgcccgctccgccatcggcaacgcgagcggctgggtaaaggagctcggaccgggcgcgcaggcgatcgccaccaacggcggcctccagatgctggtcgacgcccgcagcgaggtctatgtcaagacgggtatcagtctcaacggctggaccaaagaggccgttacctcggccagcggcgcggcggtcactgccccagcgtcgcccctgcgcagggtgatcacggtcgacagcgaccgcacgcaaatgatgcaaggctccgacggcaacgcgtatgcccgcctggcatcggacacgacttggacagtccagaacgggcctgtcctgacgggcaccgatgtagtggggcgtaccgcgatcgcggtcggctcgtccgggcggctgatcatcctgaacaccgggaccgtctcagcacgcacggccgcatcgagaggccgctacgtctccgcatcggatccgacggcagattctgcagacggcgttccagtcaagctttacgactgccacgactgggcgaatcaaggctgggtgtttgagtacagcaagtccggcagcatccagctgcgtaacccggcatcgaaccggtgcctcaacacgccgaacgactcgaccaccagcggcaccgcgctgaccatcgccacctgcaccggctcactcggccagcagttcaccaaccccaccacaccgcccccgccttccggcccgatcaccaacccggtggtgaacaaatgcgcggtgccggcgtccacgaccagcaccccggacacaggcgccgcggtcgtgatcaacccgtgcggcgtcggctacaccaccggccccgtcctcccatggactctcaacaaggacggcaccctgacggccggcaccatgtgcctgagcctcaccggcggcgaaaccgccaccaccaacggcaccaagaccacgatgagcaagtgcgccggaaccctcgaccagcagtgggtcgtcgggttcgacaccaccggccgcacccaactgatcaacccgaactccgcgcgatgcctggaagacccgaacgccaacctcaccaccggcaccccactgcagatcgccacctgtaacaacggggacgcccaggtgtggagcatcccgcacaccgggcacgccttcgccggaccgatcaccgcgaccaccacggtgatccccgcaggaaccggcaccgaacgactcgtcgcgatgcaaaccgcggcacgagtacgcgacacccgcgcccacctggccctgcttatgcacgccggaggccccaacgtccgccagatagccgcgcagtggcttgccggccccgacacggcgctgaacgtcgaatggggcgactgggtcgacaaaaactggatcgccgaagactgggtcaacggctggaaatgggccgacgcctccagcgacacagcgccagccggcccgctaggagcggacatcgtcgcagccggcaccgccgatcaggcacgccagcagcgtgagaccgcccgcgacgcgttcctggccggctacccgatgggcgactacggatcccggccgtcctttgacaccgacgtcaccaacttcttgtccaaaggttcgacgagagaactggccgtcgaagccgcctacttccaccctctgatcacgcaggcgtcgaaggccgagcaggacaaggtctgggagatctatgagcgtcacctcaagtccgagccaggcaacggctacttcaccgctgacaacatcaaaaaagtcgtagaagggtcagccgacgacgttcgccggttcatccagttcgacagctatccccgggtcgcaccgcagccgaataccccggaattccggatcgaggtcgaagccctcaaaacccgttgggcacagggcgacccgagcaaccccctcgaccccgaccacgtcctgctcgacgtcgaggaaaccgcctgggcggaatggcaggccgaactcaactcgcaggcccagccccgcgccgacatcctcgccgccgaaatgcagagcctggacgccctgcgcgccagctccgaaaccatgcacgacggcctcggctacgcctggaccgctcgcggcatccaatgggcccaggaccagaaattcaacagcggcaaacccgcctggaccggcgtcgacatctcccgcgccccgcacgacctcggcgtgatcaaagctaaagtcgccgccctggccgccgcagcgaaaaactctgccgcggtcgccaaggacgctgccgacaaagccgtcgccgcacgtgacgccgcgtacaccacagcgaccgcagctggcctaccgcagggccgcggcctgacctacgcccagcaatcagcacaagtcgcgcaggcagcagccgccgccacacaggcaacggccaacgcgatgcaaaccgtggtcgctgcagtcaacgcaacgctggctaactcggccaccctgctggcaaacgcaagcgcgcaagcgcacgccgcccgcgccctctacctacgtcagtcggccgaggacagcgccgctcacgccgcgcagctcgccgcgcaggcaaagcaagaggagaaggaggccgccaccgccgccgccaaggccgctgcggacaagaccaagattgccactgtcgaagccgacgcgaaaagcgctctagcccgggcggacgctgcagcagcggacgccgccaagcaggaaaagattgctgcagacgcccaagcgacggccgaacgggaacggcagaacgcggccgcggcgatgacggcggcccagaatcaagccgcgatcgccgaatcaaagaagaacgaggcggcgagcgctgccgccaaggccggtcaggacgagacggcagcaaaactcgcggaaaccttcgcgatggacgcttggcgccgggcggctaaggcccaggccgagatggtcgcaacagcgcaggcagccgcggaagcagacgcgaaggcggccgccgccgccggtacagacgctgccgacgacgccgaagctcaggccgtcaaagcccgcaaggcagccgacgatgccgcagccgccgccgacacagcggggacagaagccgacgccgctcaagccgccgcatcccgagcacgatcggctgccggcaccgcgcgcgccgcggcacagcgtgcggccgcagatctggagactgcgaaggcagcagcgtcgcagacccacgcggatgcagtcgagggccacgcgctggccgccgacgcgatcagcaacgcacgctacgcggcctctcaggcagcacaggcacgaaaggcggcagccgacgccaaggcggaggcggacagtgccaaggcagccgcgcaacaggctcagaccgaagcggcggatgcgctggccgacagtgcggtcgcgatcgggcaagccgtggccaccggccaagccgcacaagaaaccgcggtcgcagccgcgactgtagcggcccccgcggacaccgcgatcgatcttgcaacgccatgggcagccaccgattcagcggccggcctggccggcctgagctcacaagcagccgagaccatttccgccgcccaggcgaatatcgccgcagcgcaggcgactcaggcggcggctctagccgtggatgcccaggacgccgcgaaccgggcgagcggggatgcgaaacttgccctccaagcagcggccgcagccgcggtctcggcatcgcaggcagccgcctcggcggcggccgccacgaagtctgctaaccaagcagcagccgacgcgaaagcaactaagcaggcatccgcgcgcatcgacgagatggatgccaaagcccagcaggacgtcaccaagacccaaggctccgccgatgccgccgacgcccatgcgacggcggcggaagcagccgccgacgagagcgaacgtgacgccgacgctgcgcaccacgcgtactacagcgcgcaggactccgcaaacgaggccagcgagtacgccgacgatgcggaagcttcagcgcaggcagcacgagaagccgccgagaatgccaacacgtcactcgagggtgctcaggcagctggcgctgccctggcctcggctacggtcaacgacccgcagcagctaactgacctgaacgccaaggcgtcgccgctcggcgacggtatctgggtccgtcctgaagcgaaggtcacctttaccccagacggcccctgcgtcggtgtcggcggctgcgacgtcaccggcacagcccacgtcaccggctacaacgtctacttctatgccgcctgcgccgtccccgacccggcggacccgaaccactgtttcacaaccgcgagcggctctgtcctcaacctgtacccgttggcgaccattccgatcaaccagccgccgtacaagatcacgcatcacatcgatcagatggcgttgtatgacacctacgtcaaacatctacctgagacgctgttccatgaattcatcggctgctaccacaagctgacgtccgccgacgacggtgggagtctgttcgactgcgggctggtcgtcggtgaacttttcggtgcggagatcatcaaagccgcatcgacagcactccgcgcgcttcgcatcgccatgatcgcctacgacgtcgaaggaatcgacggggcgatcaacgcgatcaaggctttgaagattgagtaccagaccctgatagagcttcagaagatcgcggctgctgcccgtgctgaagctctcgaaaagcggattctcgagtgcctcggtggacatagtttcgcggagggcaccggagttcttatggccgacggcacagtcaagccaattgaggcagtcagagtcggtgatttagtccgtaacgccacaccttctggtggcgtcgagacgcatcaggtgacgcagacgcaccggacaactacggacaccgaattcactgaactgaccgtcgtggccggcgacagaagagtcaatattgtcggcactcagaaccacccattctacgacgtcactcgcgccgaattcgtcaacgcaggcgatcttgccgtcggagatcagctgaggaccggcagctcgggaacgatcacggtcgccgctgtgcggaattataccggcgcgatggccacctatgacctgacaatcgaaggcctgcatacctatttcgttgacaacaacggccttcccgtactggtacataacagtacggcttgtcctcccggttgggtggcagacgcccttagggagatgacggacaggaaacttccagtcacgacgggcttcttgtacgttggtgggcggcgcgtcgcggagttgtcggctcgcacggaggaagaatccaagtatattaacgcctacctccataaaatcttcccgaatgttcccgcgaagacgaccttcagggcttcatggcacgccgacgggaagctggcctggtggatgcgtctagaatatcgaaatagcggattcaccagcgaagagttgaaaaacgggattatgattatcaataacaagaacggtccttgcggaggagtaaagtacgatcttggatgccttcaggatatggcgaacattctctatcgcgaccagaagataagtgtcttttggccggggcgggcggagccataccctgtccaaggcgtagcttcgcgatag

SEQ ID NO: 2681 - DNA, 966 bp, Actinoplanes utahensis
atgaaaacgccggggctgttcaagcaatgcgggtgccgcgatgccggcacccggcagcggctacgtgcccgctgcccgcggatcggcgagcgcgggcacggcacctggtactaccgctgctacatccgcgacatgctcggcgagtcggtgcagatcagtcacggcggctatcgcaccctgaccgaggcccggcaggcccgcactgccgtgcaggcggagtcccgcgaacagtacgccggccgcacctggacgatcgcccggtggctgacctactggctgaccacccgaaccgcgatccggccgaccacgcacgcgatctacacccggcacgtccatcagttcttgatcccggcaatcggctacctgcggctcaccgaactcaccagccggcatctgaccgcgatgttcgccgaactcgccgccggcaccaccacgaccgggctaccccgctccccggccaccctgcaacgcatccgagcaaccctgcgcgccgcctacaacgccgcgatccgggaagggatgatcaccgacaatccggcccgccgagtcgagataccagccggccgccgaccccaggccgtcgtctggaccgaaggacgagtcgaagactggcgaaccgacggcgcccgccccagcgtcgcggtctggaccccagcccagctgaccgagttcctcgagttcgtcgccgacgacccgctgtacccgctgtggtggctaatcgccctgcgcggcctacgccgcggcgaggccgccggcctgcgctgggaagacctcgatctcaacaaccggcagctcaccaccaccaaccagcgcaccacggccggctaccagatcatcgaaggaccgcccaaatcggcggccagtcgccgcaccatcgccctggaccggcgcaccgtagccgttctgcgagaccacctgcgccaccaacgcgcccactacctgctcaccggccgcagctctagctag

SEQ ID NO: 2682 - DNA, 1329 bp, Actinoplanes utahensis
atgagttgcaatgaggttgagggcgtctttcgccgttgcgggtgcaaggacacggtgaccggccggcgattcgacggtcgatgcccgaggctggccgatcccaagcatggcagctggtacttcagcgtccagctgcccgatgagcagtctcggccgacgcggtttcgccggggcgggttccgcaccgctcgccaggcgcaggccgtccgtaatcagacggtcgcgtctgccgctgctggtgccggactgcggcgggtcacggtcgagcagtggttgcgccgctggctgctgagtctgcctgggcaggtacgccggtcaacggctgccggctacagcatccacgtgcgccggtacctgatcccgcacctgggccaccacaccctgacagggctacgagctgcgcatatcgaggcgatgttcaccacgatcaccgcacaaccgagccgcaccggcgcgccgctgtcggcggcgaccttgcagaagatccgggccaccttgcgccgggcgctgaacatggcgatccgggagcagctgctggcaatcaacccggcccggctggtgctgttaccgcggccacggcggcaccgcccacaaccgtggtcggcctcgcgggtcgcggcctggcaggacgacggccacaagccggtggtggcggtgtggacgccgcagcagctggccgagttcctgctcttcgtccgggacgacccgctgttcgcgctgtggtggctggcagcccttcgcgggctgcgccgcggcgaaatctgcgcgctgcgctggaccgacgtcgacctcgccgaaggcacgctgacggtcagccacaccatcgcccacgctaacggccgtccctattgggacacgccgaagaccgctgcggggcaacgcaccgtggcccttgatcgcatgaccgttgcggtcctgctacggtcgcaacgtcagcagcgccgccggcgggcagagtgtgccggcgagcggtggcagccgaacgggcccgtgttcacccgccagggccgggcgatccggccggactggctgacgcaccgcttcgccaccctcgtggacgcatccaagctgccaccgatccggctgcactgcctacgccacggcgcggccaccctcgccctggccgcgcacgtcgacctgaagaccgtgcaggacatgctcgggcacaccagctacgccttcaccgccgacacctacgccaccgtgctccccgaccaggcgaaacacgcggccgaatcgacagcacggctcgtactcgatgcgttgaatgaggcgcgccctgccgtgggcgccaggctagggcccgggctcgcgacggcgtcctcgtag

SEQ ID NO: 2683 - DNA, 699 bp, Actinoplanes utahensis
atgttgcgtacctccatgctgtcttcttccacgtggcgccgtagtctgctggccggtgccgccgtgaccgctagcctcatgttgtccgcctgcggcggtgatgacacctcgtcggactccggcatgaaccacggcggcatgacaccgaccgcgaccgcttccgcgcaggcagcggcgacgttcaacgatgcggacgtcatgttcgccagcatgatgatcccgcaccaccagcaggccgtggagatggccgctctggccgacggtcgcgccgcgagcgccgaggtcaaaaacctcgccgccaaaatcaagtccgcgcagcagcccgagatcgacaccatgaaccagtggctgaccgcctggggccacccgatgccggctatggccgcctccggcatgccgggcatggacgcttccgccatgccaggcatgagcgcctccgccatgccgggcatggaccacggtgcgatgcccggcgccatgtcgcaggccgacatggacaagctggccaaggccaagggcgccgcgttcgacaagcagttcctcgccatgatgatcagtcaccatgaaggcgcgatcacgatggcgcagcaggaggtcgcccagggcagcagtccagacgccaaggccctcgcccagaagatcgtcaccgatcagcaggcggagatcgtcacgatgaagggcctgctcagcaagccctga

SEQ ID NO: 2684 - DNA, 639 bp, Actinoplanes utahensis
atgatgcgtaccttcgtgctgccctcgatcggctggcgccgtggcttactggccggcgctgccgcctgcgccgtgctggcggtggccggctgcggtgacaccccgacggccggtcccggcccgacgcatgccgccagcccggctgcggccggcgcggcatcaactgcggggttcaatcaagccgacgtgacgttcgcgcagcagatgatcccccatcaccagtcggccatcgccatggcgaaaatggccaccggtcacgtcggggatgctcgcgtagcaaagctcgccggccagatccaggcggcgcagcagcccgagatcaccaccatgaaccggtggccggcccagtggggaaaacccatgcccagcgctggcgctgatgcgatggatgacccggaccacggggagatggcgggcatcgacgaactcgacatgaccgccctgatgaacgccaagggcaccccgtgggacaaacagttcctcgcggtgatggtcaaacaccaccaggctgccgtcacgatggcccagcaggaactcgcccacggcctcaacacggatgccaaggccctcgcccagaagattatcgacgatcaacaggcgcagatcaccgagatgaagcagatccgcgccagcctgtag

SEQ ID NO: 2685 - DNA, 372 bp, Actinoplanes utahensis
gtgatgctccagctggtcctgcgggtggtgacggtggcgttgatgctgctgtgcgccacctcagtcgatcactgtggcttggacgccgagcacagccagctgacctcgggcgccgcgagcatgcaacaggatgctgctaccgcgatagcactgctggacagctctcacccgtcctgcagccttgccgagcatcccgcacaccggtgcgagatggcctcgaagctgccggacctcgacggactgaatccgcagttgtcgccagatctgctgaccccgcctccgggcctgcgcctgtctgccggtgcgccggcctgcgcgccaccggcgggtgctgcctcggtgttgtccagaatttgcgtctgccggacgtga

SEQ ID NO: 2686 - DNA, 1116 bp, Actinoplanes utahensis
atgaccaaccagaccatcacccggcccaccgggctgcccacgcccagccagctcatctctcactccacctgccatcaacttgctcaactcgtcggcaataccccggtgatgtggattccggacatcgccacgccgtctggtcacggcttctgggccaaactcgaagggaacaatccgggagggatcaaggaccggcctgggcttcacctgatccagcgggctcgggaacgcggcgacctcgccccgggtgccccgatcgtcgaatcgacctccggcaccctcggcctcggactggccctggccgggcagatctaccaccacccggtcaccctggtcaccgaccccggcatggaaccctcagtgcgtaacctgctcactgcctacggcgcccaggtcgacatcgtgaccgcgccgcaccccgatggcggctggcaacaggcccgccgcgatcgcgttacccagctactggccgatcggcccggtagctactgcccagaccagtatcacaacccggacaacgtcgaggcctaccagcatttggccctggagctggtggcgcagctgggccgtatcgacgtgctggtgtgcagcgtcggcaccggcggccacagcgccggcaccgcccgggtgctgcgcgagttcttcccgcacctgcgcctggccggcgtggacgccaccgggtcgacaatcttcgggcagcccgcccgaccccggctgatgcgcgggctgggcagcagcatccacccgcgcaacgtcgactaccccgccttcgacgaggtccactgggtcgcaccggccgaggcggtgtgggcgtgccggacactggctgccgaccggtacgtcagcggcggctggagcgtcggagcggtcgccctggtcgcctcctggctggcccgcacgatgccggacgacgtccgcatcgcggcggtcttcccggacggcccgcaccgttacgccgagaccgtctacagcgacgactactgccgccagcaccacctgctcggtccggcaccggccgccgatcccgaccacatccggcatcccgccgagcgtgaggtcacccggtggacccgctgcacccgcatcatcgacccggccgggcaggatgcggcatga

SEQ ID NO: 2687 - DNA, 1299 bp, Actinoplanes utahensis
atgaaggcaaccatcaccgcgacccgctcgttctcccggccggtgcagctactgctggtcaaccagctgaccatcaacatcggcttctacatgctcatgccctacctggccggctacctctccggcaacctggcgctggccggctgggcggtcggcctggtgctgggcgtgcgtaacctcagccagcagggcatgttcctgctcggcggcagcctcgccgaccggctcggctacaagccgctcatcctggccggactcggcttgcgcgtcgtcgggttcgcgctgctcggcttcgtcgacaccctgcccgggctgatcgtcgcgtcgctgctgaccggcctggccggggccctgttcaacccggcggtgcgcgcctacctggccgccgaatcgggcgaccgcaaaaccgacgcgttcgccgtgttcaacgtgttctaccaggccggcatcctcgccggaccgctgatcggcctcgccctgctcaccctcgacttccggtgggtgtgcctggtcgccgccggcctgttcctgctgctgctgatcgcccaaacccgcgcgctaccggcccgccgggcggtacccgatcacagccggcaaagcatgctggccgactggcggcaggtgttcggcaacggcccgttcctgctgttctgcggcgcgatgatcggctcctacgtgctgaacttccaggtctacctcggcctgccccttgaggtccggcgcatcaccggccacgagaccggggtggccgtgctgttcgccgtgtccgggctgctcaccgtggccgggcaggtcaaggtgaccgcctgggcgaaagcacgctggagcccgcagcaagcgatcgtgcgggggctgctggtcatggcggcggcattcgtgcccctcacgctgtccgccggagccgggccaggccgcgctggggtgataggggtcgcggtggcgctggcaccggtgctgctgagcacggtgctgctgacgatcgccacgatgatcgtgtacccgttcgagatggccaccatcgtcgccctggccgggcaacgcctggtcggcacctactacggcctgtacaacaccatcgccggactcggcatcgccgccgggaacctgctcaccggcgccgccctggacaccggccgccgccacggctttcctgccctgccctggctggcgctcaccggcctcggcgcagcgtgcgcggcagcggtatgggccttgtcccggaccgggcggttacacgctccggaacctgacctcgattcggccgcaccgccgatgcccgcgcgaaatggttcacgctga

SEQ ID NO: 2688 - DNA, 717 bp, Actinoplanes utahensis
gtgagggaacaaacgctgccaccggtccggaccagccacctctggcggggcctgcagggccggtggaactacgacatgtggggctgcaacggacggccggtggtactgctgcccgcggtgctgttcgaccggaccatgtggtggccgctggccgccgagttgcgcccatacgcggcggtgatcgccatcgacctgcccggtcacggcaacagcagcgacacccgggcgcactacgcgcccagcgacctggtcgacgatctcgccgacttgatctacagcgtcggcatccgacgcgccccgatcatcgtcgggcatgcctcgtctaccggcctggcgaccttgttcgccacccggtatgccacccatgcggtcgtcaccgtcgacgccggcgaccaagcctcgccaacacccgtcgaccgtgagcaatacctggccaccatgcgcctgcaggacatacccgccgagttccagccgttggtgcagcccagcgacaatcctgcactgctcgcggcataccagccgctccttagcggcaccgccgcgcaggcaccgggcgccgtcacggcagcgctagccgtgcacagcaccagcccttcgcccggatgcttcgacactgcaccgcatcgctggcagcaccacgtgtacaaccggcccggccggttcgcgcagctgtccgacatgcaccgcctgagttcagacatccaggcactgctgtaa

SEQ ID NO: 2689 - DNA, 717 bp, Actinoplanes utahensis
gtgcgccgcaaaagtcaccgtcatgcccgcatagggctcagcagcgccgccctcctgctggccgtaagcggatgctcctccccacccgacccagtctggggcgacgctgctcctagcacggcaccgagcaccacagcgtctgtcagccgggctacgtccccacacccgaccccctcgtcggtgaccgcagccccgtccggcccatacgtgttccccgtggctggcaccaattcgtatgcacacagccaccacgactacccggcgagcgacctgatgaccgcgtgcggcaacacgttcgtcgccgtgaccaacggcgttgtcattttcaccaacaccgtcgatcggtggaccgccaaagccaacctcggccccactcgaggcggcctgtcggtggcgatcgtcggcgacgacggcgtgcgctactacggctcccacctgtccgcgatcagcccagggatcagccccgggacgcgagtcaaagccgggcagacactcggcaagaccggcaagacgggagacacgaccgcttgccacgtgcacttcggtatctccccgccctgcgcacgcggcgccgactggtacacccagcgcggcgcgatctggccctggccatacctcgactcgtggcgcaccggcggccaacggtcagcggccgccgagatcagcacctggcaggccaagaacggctgcccgagcgaggctaaggtcgacccgtga

SEQ ID NO: 2690 - DNA, 993 bp, Actinoplanes utahensis
ttgcttgccacccgacatgccgcggcactacgccggcgcggctggaccgtcgccctgctcgccgcggtcctcagtctcggcatgaccgcgcctgcccgcgccaacccctcgccgcaacagatcgagaaacagctcgaccagcagtggaaccagctggagccgaccatcgagcagtacaaccaggttcacacccagctgcagaccagccgcagccagcagcagaaactcaccaagcagctgcagccgctgcaagcccgggtcgatgccgccatgtccggcgtcggccagctggccagccgcgcctacatgcagggcggcgacatagctctgagcagcttgctgatcagcgggaaccccgccgatctgaccgacaaactcacctacctcgacgtgatggccagctcccggcgctcgcaagtcgctggcgtcatcacgctgcgcgacaaatacgcgagtgacaagaagcaactcgacaccgtcaccgccagcctggccgcacgcgacgccgacctggcggcgaagaagaacaccatccagaaaaagatcaacgacctgcagcagttgcgggtcaaggcgtacggggccggcggcggcgccagcggcaacctgcgcaccggcgcctgcccggctacctacaccaacgatccaggcggcaaggccgctgccaaggcgtgcagcttgatcggcaagccctacatctgggccgacgccggccccgacggctacgactgctccgggctgaccctggccgcgtgggccaccgtcggcgtcagccttcgccactacaccaaatggcaatgggaagacaccaagccggtcagccgcgccgacctcaagcccggtgacctggtcttctggtacagcgatctgcaccacatgggcatgtacgtcggcaacaacacggtcgtgcacgccccgcacaccggcgacttcgtgcgcatggccggcctcgacgccgtcggccccgtcgccgggttccgacgacccagctga

SEQ ID NO: 2691 - DNA, 540 bp, Actinoplanes utahensis
atgccggtcatcgcgctgccggcgtcgcgtaggtacgcggctgccggtggtgccatccgctctccccgcgccagcgtggccgtttggcggcggggccgggtggccgcggtgtggcggctgctgcggctgctgctgatcgccggcaccgccctcggcgtcgcgactttgcacacgcttgggcacaccgacgttggcctcgacgaacaccggatgttcccgctcggcggcgggcaagcgctaaccaccaccgtcgcagttcttcccggtatccagatcgccgctgccgacgatgacggcggctgcgacggcgacggctgtacgcagagcgcgctggtcggcaccagccgcgaagcctggcacagctggcaggtttgccaggcgatcctaagccccgtcgcggtcgccgtggcggtcaccgccacccggcccactcccatcgccgggtcccgccggccaagtgcgcaccaacgcacacctgtcggccaggcccgagccccggtcgggctcacgctcgcgagcaccgcggtcttgcgcacataa

SEQ ID NO: 2692 - DNA, 606 bp, Actinoplanes utahensis
gtggccgagctggctggccggggtgtcaccgcgatcggcgtcgacgtgtccgaggccatggtggctcttggccggagccggtatccgggggccgatctgcgggtcggggccgcggagcagctacccctgggcgacggtaaggccgccgggtaccgggccgacaaggtgttccatgaactgagcgacccggcggcggccgtggccgaggcgcggcgggtgctgcggccgggtggccgcatcgtgctgcttggccaggactgggacacgatcgtgatcgacgctgatgacggctcgctgacccggcgcatcgtgcaggcccgcgccgatgccgttcgctggccgcgggtggctcgcgcctatcggacgctgctgctcgacgcaggcttcgagcaggtgtctttgcaggtgcgcacgggcgtgttcaccggcgggctcatgctgcccatgctcaccggcttcgcccatgctgcggtcaaggccgcggcgatcacgcccgcgcaggccgacacctggctggcggagcaacgtaatcgtgcggcagtcgatcggtttctgctcgccctgccccttttcgtcggcgcagcgaccaacccggaccgcaggtaa

SEQ ID NO: 2693 - DNA, 459 bp, Actinoplanes utahensis
gtgttgcgtggtatgtgtcatcctgcgagggtggagtctcaggtcgacctcaagtcaacctctgatgatccggtcctgggcatcgggcaggccgggcagcgcttcggtgtcgccgcgcacgtgctgcggcactgggagtcgatggggctgctgagccccgaacgcacccgcgacggtcaccgccgctaccaccgggccgacctcatccgcatcgcggtcatcctgcgcgccaaggacgccggcctgagtctcgacgccatccaccacatgatcacctgcgacgatccgggcacccggcagcaggcattgcagcaccagcgcgacgctctggccgagcgcatcgcccgccagcaagccgcgctcgccctcttggactgcgccctcacctgcagccaccgggacgtcgccacctgcccgcactttcagcagatgatcgcccagcgcgccggcctggcctga

SEQ ID NO: 2694 - DNA, 1416 bp, Actinoplanes utahensis
atggccgaaccgcaacgcccgtaccggtggcggcgcctgccgctgcgggtccggctggtcgccgggttcgccatcgccatgctgatcgtgctcacgggcgcgggcgggttcgtctatctgcgcgtgcgctatgccctcgacctgcgcctcaacgaggatctcatcgcccaggccggccaactgaccagctcggtgaattccggcggcccgcccgccgtcaccaccggcaccgaataccagctgctggacgccgcgaaccaggtggtggccgcgagcaccggcctcaacggcacttcgctgctgagcagcggccaactcgccaccgcccgcacgaccgccgtccgcaccgaccgcggcccgctgtttcccatccacgccgacaccctgcgcctgtacgccatccccgtgcaccccgtcagcgggtcggcgacggtcgccgtcgtcgccctgcgccgcgaccagcgcgatgaagccctgcgcgaactgatcggccagctcgccctggccaacctcgcggccctcgctatcgcttcgatggtcagctaccggctcacccgcgccgcgctcgcccccgtcgagcgttaccgcaccgaggccacccgcatcgccggcggcgccaccggcctgcggctggccgtcccgcaacgcaccgacgacgagatcacccgcctgggaaacaccctcaaccagatgctcgccgccctcgaaacagcgctggatcgcgaacggcagttcgtacacgacgccagccacgaactacgcacgccattgacgctgatcagcaccgagatcgagctggccctgcgccgcccgcgcagcaccgccgaactcgaggagaccctgcgcaacgtcgccggtgacgccgaccggctccgcgagctcgccgacacactgctcaccgtcggcgtccagccgccacccgcgccgggcgacaccgtcgacctcggcgcactcgctgttgacgctgcggcccgctacccgaacacccacgccgagcagcacgcgccggccgtggcgttcggcgacgccacccggctccagcaggtggtcaccaacctgctcgacaacgccacccgccacggcacaccaccgatcaccatcaccaccggccgccacagcgacgccgcctacctgcgcgtgcacgaccacggaccgggtatggaccccggcttcctcgcccacgccacggcccgcttcacccgcgccgacaccgcccgcagcaccccgggcaccggcctgggcctggccgtcgtcgaagccatcatcaccgcccagcacggcgagctgcgactgtgtgccaacggcacccaccaccgcgtcggcacccacttcccgaccggctgcgaccaccccgacaacggcaccaccatcacggtcctgttacccgccgcgaccgcatctgagccggcccgatga

SEQ ID NO: 2695 - DNA, 678 bp, Actinoplanes utahensis
gtgcgggtgttggtggtcgaggacgagccgcgcctggccagcctgctggcccgtggccttcgcgaggccggccacgacgcggacgtacgtcacaccggcggtgacgggctgctcgccgcgaccggcggcgactacgacgcggtggtgctcgacctgatgctgccgggcctcgacgggctggcggtctgccgcaagctgcgcgagcgtgggatccgggtgccggtgctcatgctcaccgcccgcggcgaggtccccgaccgcatcgccggactggacgccggcgccgacgactacctgagcaagccgttctccttcgacgaactgctggcccggctccgcgccctgcaccgccgcgcggccgacccggccatcgccgagctggcggccggggacctgcggctggacgccgccgcccgcacggtataccgcagcagcaccgccatcgagctgtccgcccgggagttcgacatcctcgctctgctgatgagccgggccgggcagtgcgtcacccggtatcagatcctcgacgaggtctgggacggcgagactgacctgcgctccaacgtcatcgacgtctacatcgccagcctgcgcggcaaggtcgacaaaccgttcgcccggcaggcgatcagcaccgtgcgcggcgccggctaccgcctcgaacgtgacggcggctga

SEQ ID NO: 2696 - DNA, 600 bp, Actinoplanes utahensis
gtggacgtgtcgtggtttctcgcggtgaaccggttcgcccgggcgacgccgtggctgcatccggtgctggccggctacgcggtgtacggggtgggattgttcgcattgctgctgctggcgggctggtggcgggcccggcagcgcggccggggcatgccggcggcgctctgggcgccgctgggcgtgctgctcgcggtggcggtgaaccagccgatcgtcgccgcgttcgccgagccgcgcccgtacacccatctgaccggggtgctggttctggtgacccgcagcaccgacccgtcgtttccgtcggatcacgccaccatggccggggccgcggtggccgggttgtggctggtcgaacgccgtctggggctgctcgccggggcggcggcactggtgatgtgcttcgcccgcgtgtacgtcggcgcgcactacccgcgtgacgtgctggccgggctgatcgtgggcgcagtggtcgccgtcgccggctactggctcgcggcgcccctgctgcgccggctgctgacctgggcccgcagcaccccgctacgcccgctgatcgaacgtcgccagccgcacgtgcctatcggctcggcctcctga

SEQ ID NO: 2697 - DNA, 1431 bp, Actinoplanes utahensis
gtgcccgccccgggccagaccgcgatcatcgccggggccggggcggccgggcacggaagactcaacatcgtcgtggtggcagtggtggcgttcgccgccgcggcatcgtcgccggcgccaccggcatgccctggccccgattcgtgctgttcaacgcgatcggcgcggcgctgtgggtcagcctgtggtcaaccctcggctacctggccggtgaccactgggaggcgatcaccgccgtcgcgcaccgctatgagccgtacgtcctggccgggctcgtggtcgccgccctggcactgctgtggtggcggctgcgccgccagcatcacgacggcggcaccgatcatcaggcgcgctaacctcactttctcctgctcggcaccattattcgcatccaccccaccacgacgaccagacaacccgcccggccgggtgacggcttcatgtggctttcatgcgcgatctataccgtcgctggtcatgagcgacgtgctggcggtcgacgcggtcgacctcacgaaaacctacggcgcgctcaccgcggtcgaccggctcaaccttcaggtcagccaaggtgaggtgtacggggtcctcggccctaacggggccggcaagaccaccttcctgcgcatgctgttcggcctcatccgccccgactcgggcaccctgcgcgtcctgggccgcacctggacggccgacggcgtccgcgccctcgacggcgtcgccggattcatcgagagccccaagttctaccccggcctgtccggccgtaaaaacctgcaactgctcgccggcctcgacggcggcaccagccgcatgaagatcgacgaggtcctggaaaccgtcgacctgcgcgaccggcaacgtgacaaggtcgccggctactccttcggcatgcgccaacgcctcggcgtcgccgcctccttgctgcgggagccgaaactgctggtcctcgacgaaccggccaacggcctcgacccggccggcatccgcgacatgcgcgccctggtcaaacgcctcgccgccagcggcctgaccgtgctgctgtccagccacgacatgggcgaggtcgaagagatctgcgacgacgtcaccatcatgcgcaccggcaccgtcgtctaccacggctcgatcgccgccctgcgccagcgcgctcccgaacaggcccacacgatgcagaccaccgacgacgaccgcgccgcacagctggccaccgcccgcggcctcgacgtcagccgcaacgccgacggcctggccgtccgcggaccgcaacccgagatcgacgccctggtcgccgagatcatcaccgacggcatcgcgctgcgcgaactcgcccgccgcgaaacccccctcgaagcgctgttcttcatgctcaccgaacccgacaccgacacgcccgcccctgagctggccaccaccggagcccgccgatga

SEQ ID NO: 2698 - DNA, 873 bp, Actinoplanes utahensis
atgaccgccaccacccttcggcccgccagcgcggccgccacccccaccaacagcggccagcccggcctcggtgccgccctccgctgggaaatcgtcaaactcgccgcgcagatccgcagcaaagccctgctcgccggcgccctgatcatcccgatcccggtcgtcgccgtcctcaacggccaggaacaaccaccctcggacaccatctacggcaaactcatccacctcagcggctacgccatgccgctgctcatgctcgcctgggccgcccaatgggtactcccgctactggccgcgatcgtcgccggcgacatcttcgccaacgaggaccagcacggcacctggaagaccatcctcacccgctcggtcagccgcacccacatcttctgggccaaaacactgaccgcgctcacctacaacctggtcctgctgaccgctttcgccgccagcaccatcatctccagcctgctgatcgtcggccaccagccgctcaccgggctctccgggcagaccatcgcctccggccacgcactgcgactggtcatcgccgcctgggccaccgccatcccgcccgtcatcggattcaccgcgctggcgctcctgctgtccgtacgtacgaagaacccggccttcggcatcgccgcccccgtcgtggccggcttcgccatgcaactgctgggcagcgtcaccgggctcgacctgacccgcaaactgctgctcaccaccccgttcgacgcgtggcacggcctgttcgccgaacacccgttcaccggcccactgctcaccgggctggccgtcagcgccgcctggaccctcatctgcctggccagcgcctacctgtcgctgcgccgccgcgacatcaccggaggctga

SEQ ID NO: 2699 - DNA, 453 bp, Actinoplanes utahensis
atgcgcccgatcgtcacccgcaccgccctggtgctcgccgtcggcgccggcatcgccgccaccatcgccgccggtcagcccgagatcaccaaggccggtctggagaaggcgctggtaccgaccttcaccaacctgtacatccagcaagccggcatcctcggcattcccgggatcacctcgcagagcatcggcgcgagcaccaactgcgacaagggcggcccgaagatcgccgacaccggcgccggcccgaactgggtctgcatgatgagctggatcgacaaccacggccagcaccaggacggcaaatttgaggtcaccgtccacaccgacgccacctacgtcgccggcggcccctccaaaatcgttggcctggccaccatcaccgacaagcagggccgcgacgtccgcaaccccgtcttcgaattcgacggcgtcatcaccaccaacagctga

SEQ ID NO: 2700 - DNA, 396 bp, Actinoplanes utahensis
atgacaacgacactggacgatgtgacccctcggaagaagaagtcggagccgtcggcggaggccgctgcggcggcggagctggtgcggctggccaaggaacagggcttgtcgctgaccggtccggacgggctgctcaagcagctgacgaaggcggtgctggagaccgcgctcaacgaggagatgactgggcacctcgggtatgccaaacacgatgctgccggcgccggatcgggcaacgtgcgtaacggcagccggtcgaagaaggtgctgaccgacgccaccggccatgtggaaatcgaggcttccgcggatacttcgacggtggcaaagaagaaggagctggtggtgacgccggagggtgtggaggccgaactcgtcggccggctggtggagtag

SEQ ID NO: 2701 - DNA, 831 bp, Actinoplanes utahensis
atgtcgcagcccggaacacccgccaaccgagccgccgcggacccactgacagcgaacctgctagatcaccagaccgaagaccggctgcgcgatctcgtcgccaaagtcccggccgtcaccgtcggcttctgggtcgtcaaggtgctcgccaccactctcggcgagacaggcggcgactcgctgtccatgtccatgggcctgggctacctggtcagcaccatgatcttcgcggtggtattcgtggccgccgtcatcctgcaagtccgggcgacacggttcaaccaatgggtgtactggttcaccatcgtcgcgaccacgaccctcggcaccaccatcgccgactacgtcgaccggtccctgggactcggctaccccggcggcaccaccatcctggtcatctctttggcgtgctccttcgccctctggtacaaagccaccggcaccatcgccgtgaccagcatccagaccccgcgcaccgaagcgttctactggctgaccatcctgttctcacaaaccctcggcaccgccctgggcgactggaccgccgacacgatcggcctcgaatacaccggcggcgccctgctgttcaccgctctgctggccatcctcgccgccgcctaccggtggacccggctgtcgcgcaccctgctgttctgggccgccttcgtcctcacccgcccgctcggcgccgtcgtcggtgactttctcgacaaacccatcgccaaaggcggcctcaacctcgaccgctacgccgcctccgccgcactactcgtcgcgatcgtggcgatcctgctcgcccgacgccaacacccagccacacgcccacactga

SEQ ID NO: 2702 - DNA, 618 bp, Actinoplanes utahensis
atgaaacgaggtcttggtttccggctggtgtcgctgctcgccaccgcgtgctgcaccctggccctgcccgtcgctgcccaagctgccgccacccacggctccggtgcgcactcgtccgttgcggtgcgggccctgcccccgtacgccgcctggatttccgatgtgaccgccgtgaccgatacggcgcagcagtacttgacgacccgcctacccgatccttcgatcaaggcggcgatcgttctcgacatcgacaacaccgcgctcgagaccacgtatcacccgggcctgacctcgccggcaaccgcaccggtgctcgccctcgcccgtcaggcccaggccgccggcgccgcggtcttcttcgtcaccgcccgccccgagctcctcgaatggcagaccgcactcaacctgcggtccgccggatacccgatcaccgacatctacctgcggcccaccttcgacttcgacccggacgcgacactcaaaagcggcgcccgcatcgccatcgaaggccgcggctatcgcatcgtcgccaacatcggcaacagcggcagcgacctgcaaggcggccacgccgagcgcacgttcaaactccccgactacaacggccagctgccctga

SEQ ID NO: 2703 - DNA, 111 bp, Actinoplanes utahensis
gtgagcctgcacttcggccacgaggggacgatcgcggcgagcgccccgctgctcgccggcctgaaggctcgcggcctgcacccggtcaccgtttcagacctggtcggatga

SEQ ID NO: 2704 - DNA, 102 bp, Actinoplanes utahensis
gtgagcgagcttcccggcctgtcgtacgacgtcgactcccgcgacttcgccgaccccggcacgcatgccatcgtcgcggcgacgctggccgctgagcagtga

SEQ ID NO: 2705 - DNA, 423 bp, Actinoplanes utahensis
atggttgcggaaggtgcgcaggccgtcgttgctggtgctctcgtcatgctggccgccgtcgtagtggctgctgcggccgccgcggcggtcttggccgctgcagcggtgtggcgggaaccggtcggcgtccgctccggcctggcaccgaagcgtctcggatacctggcggccggggcggcggtggtgatgctgccaccgctggccacggcagtcatgacccttccgaacttcatctcagcggttttggcgacttcactgacctgcttgctgccgtggggggcgagcattgccgcgatcgcctggctacgaggccgatcggcggctgcggccggtgcaaccgtcgtagcgtccgtcgtgctcttcgtcgtgtccaacatcgctatgcatcggatgggccacgtgtatccgccgactagtgactga

SEQ ID NO: 2706 - DNA, 495 bp, Actinoplanes utahensis
atgaaaaggattactcgtgtgctcgcaataagcggtctgggcctgggcgccgcattggcgatcgctgcggggcccgcgcaggctgccatcgtcacggcccagccggccgggcacagcgcgtcggcccaggccggcggccattgggacgacaccgatgtggtcgggtatttccggacccggttcggctgtgagcgggtgggccggctcggcgagttccacggtcgctgggacgactacgactgctcacgggtgtggtccgggttcaaccgcggcgcctgggtgctggaggtcgccaccgacgactggaacggcgagtgggacgacgacaactggtaccacggctggtacgacggctggcacggcggtgacttcaacggcggctgggatcatggtggctggcaccgtgatcacggcggctgggacggcgaccacccggacggttccgggcgcgtagcagtgttcccgctgcactcccggtcccggtcggcgaactga

SEQ ID NO: 2707 - DNA, 639 bp, Actinoplanes utahensis
atgctgaaagcactggccacgggagccactctgcttgcctcactcgccgctactggcacggccgcgcacgccgcaccgtccacgatcgtcccgggcgaggacatggcgatcaccgtggccgccgcgaacggcagcggctgcccggagggcagcgcggacgtcaccgtctcgccggacaacaaggcattcaccgtcacctacagcaagttcacggcccagaccggccccgacgcgaagccgaccgacttccgcaagaactgccaacttgccctgaacgtgcacgtcccacaggggtacaccttcgctatcgccggtgccgactaccgtggttacgcccgcctggagcgcggtgcgaccggttcggagagcgcgaactactacttccagggcgagccgcagtccacccgcatccggcacgacttctccggtccggccgacaccgactggcagcgcagcgacaccgtcggtatcgggtcactgtcgttcctgccctgcggcgaagaccgctacctcaacgtcaacaccgaactgcgtgtcaaccgtggctggtccagccgtaacgccaccagcttcctgaccatggactccaccgacgggcgcatcgacaccgtgtaccacgtcgcctggaagcagtgctga

SEQ ID NO: 2708 - DNA, 1272 bp, Actinoplanes utahensis
gtgacccagagcaacaggcaggtgtgtgacacccgcaacgagcctgtcgcgctcatctcccgcatagtggccgagcgtgccgttgagccgctgttccagcccatcgtcgatctcgatacccgccggctggtgggggtggaggcgcttgcgcgtgggccggcaggatccccgctggagttcccggaccagttgttcgaggccgctgcgcgggtcgacttgctgccggagctggaccagttgtgcgccgcccgggcacatgagatcgctcaggcccccggagcggtggtgccaccgctggtgttcatcaacaaggaacccgccggggcggatcggccgctcagcgacgacctgcgattacggctcgcctcgatctcgacctaccgatacgtgctggagttcaccgagcgtgccctggcggcacacccctcggcgctgctcgaggtcgccgcccgggcgcaccgcaccggcggtgcgctggcgctcgatgatgttggtgcggaccggctgtcgctggccttcctgccgctgctggaaccggaggtcgtcaagctcgacatgcacctgctgcgcgacccgtacagcgcacacaccatcgagacgaccgcgctggtgtgcggatacgcccagcggaccggtgcgatggtgatcgccgagggcatcgagacggagcaggatctgcaggtagcacgcgcgctaggcgccggctgggggcagggctggttgttcgcccggcctgggccgctgtccgccgtacgggattggccggtcgacccgtcggctcggttgcgtgctccccgccctgagttgtacgtacccggtgccagcgcgttcgatatggcctcggctcgacactgtgcccgggccggggaccggcatctgctcgacgggctcaccgagtacgtcttgaggcaattgccgttcgccggtccgtacggcgtggtcctgggcgcgtacccgaacctggcgacgggacacggctggattccgcggctggccgccgcggcctcgaccacggcgctggtgggtatttctggtcccggcccgggcctgccagttccttcgccgattcgcacgtcgatcactgatggactgagcggggtggagtcggagtccgccctggtgatcgtcgacccgcatgtcaccgtggctctgtgcacccgacggcgccacgacgatgccatcgccttcgtgctgaccttcgatccggacgaggttcttgcggtggcgcgaacgctgctgcaccggctcggcccgcaggacctacccggttag

SEQ ID NO: 2709 - DNA, 99 bp, Actinoplanes utahensis
ttggacaactcgctgctgacgagtgtggtggtggcggtgcgccggagccaccgcccgcctggtcgtgggctgctggtcgtcatgaaaacctgcgcctag

SEQ ID NO: 2710 - DNA, 165 bp, Actinoplanes utahensis
atgacgaccagcagcccacgaccaggcgggcggtggctccggcgcaccgccaccaccacactcgtcagcagcgagttgtccaagctgtacgcgctgccagatctcgtcgatccgcccctactgagcgagatcgtctgcgagctggccgccggccacgacgcctag

SEQ ID NO: 2711 - DNA, 294 bp, Actinoplanes utahensis
atgttcatcgtcttgctccggttcaccgaaaacaaaaccgccgccggcgagcacatggccggccaccagcagtggatcaagcaaggtctggaagatcaggtattcctgctcgtgggcggcatccagccacaactcgggggcgcggtgctggcgcacaacacgtccctaccgcagttgcagcaacgggtcgacgccgacccgttcgtcatccaccgggtcgtcgacgccgagatcctggaaatcacgccgggcatggccgacccgcgactggacttcctgatgccggcgagatga

SEQ ID NO: 2712 - DNA, 1074 bp, Actinoplanes utahensis
ttgtcaaccggccttttcgagctgttccctctgggagatctgaccctcgccaaccgtatggtcatggccccgctgacccgcaatcgcgccgaccatgacggggttgtcacaccgatgatggtcacccactaccggcagcgtgctaccgcaggcctgatcatcagcgagtccactcctgtctcggccgagggcgtcggctaccccaacacccccggcattcacaccgaggcccaggcggccggctggctccgcctcaccgaggcggtccacgccgaatcaggtcgcgtcttcgtccagctgcaacactgtgggcggatctcgcacccgagcctgctgccggacggcagcaccccggtggcgccatcggcgctacggccgtcgggccggaccctcaccccttcggggcttcaggagtttgtcacgccgcgcgaactcgaagcccatgaagtgccggagatcgtcgcccagttcgagcatgccgccaagcgggcgctcgatgccgaattcgacggcgtcgaagtacatgcaggcaacggctacctcgtcgaccagttcctgcgcgatgcgagcaacatccgcaccgacgcgtacggaggcagtccccgcaaccggatgcgcctgctcaacgagatcctcgacgcggtgtgtgcagtgtggccggcacaccgggtgggagtgcggttcacccccgagaacagcttcaactcgatggcggataccaacccacaggcgcacttccggtacttcctcgaacagctccggacccgcgacctcgcctatgtccacacgctcgaaggcgacatgacgacgaaaaccagcgccctcgactaccgcgctcttcgtgacgcgttcaccggcacctacatcgccaacaacggctatgacctcacccgcgcccaggcagcgatccgggacggcgccgccgacctcatcgccttcggtgtcccgttcctggccaaccccgatctgatccgccgctaccgcgacggcctccctctcaacaccgccgatccgtccacctactacacaggcggcccactcggatacattgactaccccacgtacgacgcctga

SEQ ID NO: 2713 - DNA, 567 bp, Actinoplanes utahensis
atgggcggcgccaaggcgacccgagagcagatcatcgaggcggccgatcggctgttctatcagcaggggtacgagcacacctcgttcgccgcgatcgccgaggccgtccagatatcgcgagggaacttttactaccacttcaagacgaaggacgacatcctggcggccgtgatcgatgcccgcctcgccgagaggcggcggatgctcgatcgatgggaggccgaggagcccacgcccgccgggcggatccgcaagtacatcgagattccgcttgccaatcgcgctgacgtccaaatgtacgggtgcccggtaggcacgctgaccaccgaactggcgaagttggatcatgcgtcgttcgtggaggccaacagcgtgttcaccctgttccgcacctggttgcgtgaacagttcgcgttactcgggcacgaatcggaggccgacgcactcgccatgcacgtcatagcgttcagtcagggtgtggcgaccttggcgaatgccttccgtgacgaagggttcatctggcgcgaggtcaagcagatgtctgactggttgaccgcctacgagtag

SEQ ID NO: 2714 - DNA, 297 bp, Actinoplanes utahensis
atgcgtatccgtaccgctgtcgccgccctcgccatgaccgccggcgccgccgcgggcagcctcgcgctgaccggcccggccatggcgaccccgcagaacggcctggtcaacgtctacgcccaggacatcgccagcggcaaccaggtcatcctgttgcagaacgtgccggtcgatgtcgccgcgaacgtgtgcgggctgaccgtcaacgtgctcagcaccgaactgctgtcgggcaaccacgccgtctgcaccgccaagaacaccccgaccaccaagtcgtgggtgtcctacagctga

SEQ ID NO: 2715 - DNA, 114 bp, Actinoplanes utahensis
gtgcaactgcaaggtgacgtggcaggcgtgctcgcctacgccgatcatgtgctggtgctagacctgcagcaaggcgccgatcacggtggagtcgaggaacttcaccgcggctag

SEQ ID NO: 2716 - DNA, 324 bp, Actinoplanes utahensis
atgaaccccacctggcagcacagcgtgcaccgcgacgccgccaccagcaccatcgccctgcgaggagaactcgacctcgccgcgaccgccaccctgagcgacctgttcgccgaacaactctccctcagtggcatcaccaccgtgcgcgtcgacctgaccgcggtgaccttcatcgactccacggtgatcagcaccctgatcgtcgcccgtaacaccgcgacctccagcaaccgccagttcaccgtcactcacgccgcaggccacgtccggcgcgtcctgaccgtggcgggtgtcctgaacacgctgaccaccgacttcagctga

SEQ ID NO: 2717 - DNA, 558 bp, Actinoplanes utahensis
atgcgcacgccggcacccgccctcgccaggccggtcgacggaccggcgccgaccctggactcccgcttcaccgcggcggtgctgaccgacctgcgccacgcggttcgaaccgcgacagccgacgccgggctgcacggggaacgactggacgacttcatcgtcgccgtacaggagctgaccaccaacgccgtacggcacggcggcggccggggccggctgctgctacgccggcacgacgacaccgtgacgtgcgaaatcagcgaccatggcagcggattccccgacggcatccccgccaccggcagcccgccaccggccggcgtacccggcggccgcgggctgtggctggccacccagctcagcgacaccctgctgattaccgaccggcgcgacggtgtgaccgtcaccatcactatctgcctgactgcccctggtatcccggccggtgcggcaccggccgcaggctccggtactgtgcccgcaccacagcagtcggagctggccatcaagcccggtccaccgcttcatggcaaccccggcaggagcacaccggcatga

SEQ ID NO: 2718 - DNA, 2151 bp, Actinoplanes utahensis
gtgtcatgtttggctgcggtgatgggcgaggaacatcctgccgagggtgacggtgatgccggcgcgtcggtgcagcagatggagctgactgccggggcgatgtcgtgggaagcggcgaacaagctcgcggcggtgacggcgcgggcggccggcgcgccgaccgcgctgatccatctcaccgatggtgatcatctgcggctggccggtggtgccggactgccggacgggtggaagcgtatcggtcatgttccggtgtcctcggggctggccgggatcattctcggcagcggcgagccgctgatcgtaaccgacaccgccgcggatgtccgggtgccggccggtgcgccgatcagcgccgtcgccggtcgcgcgtatgccgggttcccgatccgtgacccgcagggcacgctggtcggggtgtgcgccgtgctggactatcaggtccggcagtggaccgacgaggaactggccggggtacgcgagggcgcacaggcgtgtacggcgttcgtcgccgaacagcaggcccgccaacaagcggaccagcagcggcgcttcctggacgccttgctggccagcctgcaggccggtgtcactgcctgtgatgcccagggccggctggtgctggccaacgacctggccgtgcaatgggccggcgagtcgtcgccaccagcagatctgaagcaatgggctgcccggcagcatctggctgacgccgagggccgcccattgccggcgcatgccgtcccgctgctgcgggcgctggcgggtgagcagctgcgcgacgtcgagatcacggtccgcaacccggggcagcggcggacggtgctgcgcaccgacgcacagccgatcaccggcgcggacggcgaacggctcggcgcggtcgtggtcgctcaggacgtcaccgaccagcgccgggcggcacggtttcgtgacgtcgagttcgcggtggccgaggcactcgcgcacgccagcagcgtgcagcaggccggctcccgcgtgctggaggcgatctgcagcacgctgcactggccctacgccgaactgtggcttgtcgacgagcaggcccaggcgctgatgccgagcgctcactatgccgccgaccacgtcgaggccggcgaattgtcgccccagccgcaaccgggggacatgctcacgggcgccgcctggcgcaccggcaaaccgatctggataggcgacatcgacgccgcacccggcaacagcgccgccccggggctgcacctgcggaccggcctggccatccccgtgccctccggcggccgggtcctggcggtgctgtcattcttcgccgacgtcgtggaggacccagccgactcactgatcgcgctgctgtccgggaccgccgcacacgtcggcgaattcctggaacgccgccgcgccgaagaactcgccctggccctggcccgcaccaaagacgagtacctcgtcctggtcggtcacgaactgcgcaccccgctgacctcgatctccggctgcgccgacttcctgctcacggccgagcccgccgtgctgctcgccgacgcccccgagctgttggagatcatcgcccgtaacagccggaccgtgctgcacatcgtcgacgaactacttgacctgaccggcctcgacagcggacacaccatcatcgcctgcgaaccggtcgacctggcggctgccgtacgctcggccgccgccacggcggccccggcggccgagagcgccggtgtggagatgggccttcagctggccgccgaaccggtcgtcatcggcgaccacggacgcctgcaacaggtgatcggacacctgatcgccaacgccatcgcgcatagccagaccggcgaccaggtgagcgtcacggtgacccagcccgcgcccacggtcgctgaagtcacggtcaccgacaccggcatcggcatccccgccgaggagcggcaccgcctgttctcccgcttctaccgctccagccgcacccgggaacgccgcatccccggcgccggactcggcctagtcctcagccgcgccatcatcgaacgccaccacggcaccatccagctgaaccccgacaccggcgcggccaccagcgtcaccgtgcgactgcccaccgaccgatgcgaaccccaacgcccgagccccggagcgggaacgacactctga

SEQ ID NO: 2719 - DNA, 321 bp, Actinoplanes utahensis
atgccggcggtctcggcgtggctgaggccgctggcgtcccgggtagccctcggcgccggtgactgcgcaggccgcggggatcatcagcgatcgtcgtcggccggcggtacggtccgggcctgctcgaccacatcggcggggtcggcgtccgccgaagggcgactgccggcggatccgcttggcggggagggcggcggcacgctgttcggccacgtcggcaggctcggcttccaggccggtgtcccggggcgctgcggtatccggctcaggcacttcctgctgctgttcgagcgcatcggtctgtggcatcgtagccagtag

SEQ ID NO: 2720 - DNA, 1059 bp, Actinoplanes utahensis
atgaaccaccgccggaacttgcgggtcgccgctgccgcggccgccgccaccttgaccaccctgtcgatgtccggcgccgccatggcggccaagggccacaagccgaaaccggccgtgccagcggtgcgtgacagtgaccacgacggcatgcccgacacctgggagaaggccaacgggttgaacccgcgccgcaacgacgccagcggcgacgccgaccatgacggcctgaggaacttggccgagttcaaggcgcgcaccagcgcccgcgccgccgacaccgaccgtgacggcatgccggacgggtgggaggtcggcaaccgtctcgacccgctgcgcaacgacgccagcgacgacgcggacgccgacaagctgaccaaccaccaggaatacctcgtccacgacaacccccgcgcgggcgacaccgaccgcgacggcactgatgacggcaccgaggatcccgacaacgacggcctgagcaacgtgcaggacttcgagctcggtgataacccactcaaggccgacagtgacggcgatggagttgccgacggcgctgaggacgcggacggtgatgggctgagcaacgttgacgagttccaactcggtgacgacccgcagaaggccgacagcgacggcgacggtgtgtccgatggtgacgaggacagcgacgacgacggtgtcagcgacggcgacgaactggacagcggtgacaacccccgcgacggcgacagtgaccacgacggcgtccgggacggcgaggacaacgctggcaccatcgccggctacgactccaccaccgcggcgctcaccctgtccaccgcggcgggtatgaccgtcacggtcaccgtcaccgaccacaccgagatcggctggtatcgccggtccgcggcctgcccggaccccgccaccatcgacgacctcactcccggccaagcagtgcacaaactaaagaccgacgacaacgacaacgacaacgaggacagcgacgacaacgaaaacgaccgcggcgacagtgtgaccggcgcgccgaccgctgagaagatcacgctggtctgctcataa

SEQ ID NO: 2721 - DNA, 465 bp, Actinoplanes utahensis
atggcgttcatcgtggccgcgatcaccgaccggcacacccgcgacagaatccaggaactactgaccgccgagggccacattccgatgctgttcagccgcgccacaccggccgctaccgaaatcgtcgacggtctgcccgacgtggtcgtcctggacgcctacctgcctgagccagagatgacgcacgtcctgacagtcatgcacgagcacgctgcgacggccggcatccctgttctggtgtacgggtcactacggggcctgcccgagacccaactcgtcgagaccggtggcaccctgatccaggtcagcaccgtaccaacgctgttggccagcgccgtgcaaatggtcctcaacgcccgccgcgactggaacccaggcgcaggccggcgctcttgccctccggctggcggcgcgtcggtgcagggcgggagcggttcggtagcacccaagcccaagatcatctag

SEQ ID NO: 2722 - DNA, 1248 bp, Actinoplanes utahensis
atgaatgcttcggagtcgctgcggcagctgctgcgccagtcacaccatgcccggcccgatgatttgccccagatggcgatgcgtgcggcgccgctgctcaacgccaccgcgatcatcctgtacctggtggatcaccagcagcggctgctgatcccgctgctgggcggcaccgccccgcagcgggacccgttcgccgtcgacggcaccctggccggccgagccttcactctaatcgcgccctgcgtcagcgacaccgaacccggcggcgtgcggctgtggctgccactggtcgacggcgccgaacgtctcggcgtcgtcgagttcatcctcggcagcccgccgggcgacgacaccctcgacggctgcgccgcggtggcgtccctgctggccggactggtggtcacccgcagcctctacagcgacgccatcgaacaggtacgccgccgcgaacccatgcagctggccgcggagatgctacgcgcccaactgcctccgctcaccttctccaccggccacctggtcatcagcggcgtcctggaaccggcgtacgacgtcggcggtgacgcgttcgactacgccgtcaacgccgacaccgcccacctggccctgttcgacgccgtcgggcacggctccgccggcggcctgcgcccagtcatgctcgcctccctggccctggccgcgtaccgcaacgcccgccgcgccggcctcgacctcaccgccacctatcaccacatcgacaccgccgtgcacggctacgaccgcggcgggttcatcaccgccgtgctcgccgaattcgaccagcgcaccggcaccctgaaagtcatctccgccggacaccccagcggcatcgtcatccgcgacggcaaagtcgtcaaaatcctgcccacccccaccgcgctgcccgtagtcatgggccgccaccggccgcccctggtcgtcgaagaagttctggaacccggcgaccggctactgctctacaccgacggcatcatcgaagcccgcgccctggacggcgccgagttcggcctcgaccggctcatcgacttcgccgtcaaagccgccgccgatcagctatccctgcccgaaaccgctcggcgcctggtccacgccatccacgagcaccaagacgaccagctccaagacgacgccacagtcctgctcgccgaatggcgcaccccggcaccaccggcctccgacactgaactactcaccgcaccacccggcgccccgctcgacctacccacctag

SEQ ID NO: 2723 - DNA, 396 bp, Actinoplanes utahensis
atgttacggctgctgctgttcgtcctgccgttgggcctggattccttcgcggtcgcggccgcgctcggcgcgctgagcccctcacgccgcgaacgctggcgcatcaccggcctgttcgtcgccttcgaggccggcatgccgctgctcggcgttgcgatcggagcacccatcgcgcacgctgtcgccgggatcgcggactacctcgccgccgccgcactggccggagtaggcgcatggatgttgctgggcggcgacgaagacgccgaagaggaacgcgtccgccagctcagcaaagcccacggcatggccatcctcggcctgggcatcgccatcagcctcgacgaactcgccatcggcttcagcctcggacccggctatccatcaccgaagtcctga

SEQ ID NO: 2724 - DNA, 2157 bp, Actinoplanes utahensis
atggttctaaaagaaggcaggggcgcacccttgcgccatcgacgacaaggcgcagcgctcagtttcgcatgggcgcgcggccggggttcgatgcaggggttagcgctggtcgggctggcggtgtgcgccatggcggtagtcctgggtgcggccgtgccagctgcggccggcacggccgcgccattgctagatgatcggtgccgtaccgatctgaccgatgtctcatcggcgcacgcgcgggtgtggttctcgtcggccgccggaacaccggaacgcgacctggcgatgggtgtcgcacaggcgatggagcaggcttacggaaagctcgtcgcggatcccgcattgagtttcctggctccgctgtcggatctacgccccgcccgggccaaatgcgccgatggtgtgacctaccctgatcgcggcgacggtcggctcgacgtgtttgtggtgcccttcggtgacgccgggcatcccgacggtgatccgaagctcgttcgcgcagcgcaaacaaacccctaccctgcggattcgggtgtcgcgggctgcgccagctggatcgaaatcaacgatgcaattggtgccgctgggatggggtacaacgcggtgcacgaattcatgcatgcggtagagaactcgtaccggtgcggcggggacatcccggacaacgacgcctggtggtacgaggcgagcgcgacgtgggcggaacagtacgtcatcccgaccggcgaccatccgctgtccatggcgaaatcctttttcatgccgacaccgtcacaaggcatgcccgaggaacccagcacgcgctggtacggcgaattcctgttcccttggtatatccagcacgtcgtggacaaggacaagccggctccgcagacactgcgccggatctgggagctgttcggtacgacgccgtctacctcggccaccgaggccgtggacgtcgcggtcggcgggttggaccaccgctggcccgagttcgcccggtaccactggaacggggactacaacgccgcggtgccttcggacaattcctacgccgcctgggacgggcggttcttgggagtccagccggccgtcaccgaccaccggctcgagcttggcggcgcaccggacgtgctgtacccgctgcagatcgccacacccggaaccgccgggagcacaccgctacggctgccgcccctgtcctccgcctacttccacgtgtccgtcgacgacgaccacatccgctctctggtattccacaacgggtggacgtaccggctgagccagatcaacacccacagcgaggatcccgtggtgggcatggacgggcagagcctcgtcgaacaggacctgccgggcgccgccccggccggtctgcacgtgcaggcgctcgtcaaaatccaaggctactggcatgacgaggacctgaccgaacagccctggcgggcctggtgccgcgacgtatacgagcagcacgtcgaggacctcgtggtgatcgtcaccaacgcccgcattgatgccacggcgcaggtctcgccggccgagaaggatccgacgatccaggcgtcgaacatcggctgcgcaaaggtcgaccctggcggcggcgtgcgcaacagctacgccgattccgacagcgacctcgccgtgtcgacctcactgaccttcggtgccccggtacccaccggactgtccggacagaccagctcacaccttgccggacagcacgccttccaggggtggacgttcccggtcaccggcgggaccagcaccatcaacgaacagatccacgaagtagacggagaccactgcgcagggcacggaaacgccaccagcgcgctgcccaacctctcacccccattcgagatcggcctgcacctgttcgtcaacgtgctaccgggcggactcgagtaccggcactaccgattcggcggattgcccgcggtcacgcaccacaagttctccttccccatcgcctgcgacgagtacagcgacacgacgaccgagaagggctggcggtgggcacccgccaccatcgcggacggcgatccgccggcttacgttccctacctcatcgccgccgacgggctgagcgtcaccgccgaccatctcgacgtgcccgacggcggcggcaccgacggcgaatactcctacacctaccgcttccatctgaactga

SEQ ID NO: 2725 - DNA, 1797 bp, Actinoplanes utahensis
gtgcaaaccctggtaaacggctgccggacgctcgacacgctgaccgacgtcgacgtggccagcctgcccagccggtcgcagagcatcgcccaggcgatgctgcagtccctacgggtggtctacgtgacgccagcgcagacccgagaagccggctacctcgaactggatcacttcggcaccagcattcgcggcttctccagccactacgacctgaccggggtgacccagcgatggctgcgcgatcttctgtgggactacgtcgccgaccagctgcgcaccccgggcagtccgcgcaccaagggcccttacgacgacacgcggcgtgcctgcctcgaactgagcgcctatctcgaggtcgccgccgagagcggcgggcacgacccgacacgcctgcatgccgatcatttccaccggttcctggccgatcagcgtcatcgagcccgccaccaactgccctcgctggtcgtgcgactgaagacgggcaaagccagcaccgtcaccgagacgacactgcacttcatcttcagccacgctcgcaaaatcatgcggtgggcactggaacgcggggagaccgaccgcatcggcctaaaccgcgacttcgtcgtcgccttcccgtcaatgggcaccggcacccatcggacccgcagcccgttcactgacgacgtcgcccaagctctggcagctgaggacaacctccggcgcttcgccgatgtgcacgatcccgcagaccgaggcctacgcgatatttgggagatcatcatcgtgaccggccgccgggccagcgaagtgatcaagctgagcctggactgcgtcggccgctacagcaagctgcccatgctatggcacgaccagaccaaggtcggcaactacgaccaggccatccgcatcccggagtacacctaccagcgcatccttgaacggcaacgccagactttggcccgtttcgagggccgattcggtcatcccgcgaccccaccggagcgggctcggatggctctgttccccgccccgaaacacaaccccggcttcgcgcgttcgctcagctacggctggtacggagccgccttcaaggcctgggtatccgaactcgagctgggctcctgtgtcacccaccaggctcggcacactctggcgaccaagttactggccaacggggccggcctgcaccacatcaaacggttcctcggacacgtctcgaaccggatgaccgagcactacgcgaaagtcgccgtctcggagatcgaggacgtgctgcagcacgtcggggtctccggccccggagctgcccgacccggcgagatgctgtccaccggcaccaccccactcgaccggcacgaggcccaagccctcgctctggatctcacccgccgcagcatgctggccgagggcggcttctgcaccttccagcccgtggtcgacggcggcgcctgcccctggaatctgaactgccatacctgcgacaagttcgtgctctccggtgccgacctgctctactggcgccgcaaacgcgagcagtggatgtccatcgcggaacgcgccccggacgatgccaccgcggactacctgcaccaagtcttcgagcccaccgcccgcgctatcgacggcctggagaaggccctcgctgggctcggcctgctgcaggacgctctcgcactcgatctgcgcaggccgcaggactacttccaccgcatgtggtcgaccgccttccgcgccacagacctggctgacgcggtagccaccgaagcgatgacatacgacgacggcatcgccgacgagcgggaggaaccctgcgcatga

SEQ ID NO: 2726 - DNA, 588 bp, Actinoplanes utahensis
atgaacaacgccgccgttcccgatctccgcacggctgcggccttagcagcccggcgccgcagcaccgaggccaacatcgcacgggtgcacgacgccctcgcccgcctccgccgcgaagggctgccgatcagcgtcgccgccgtcgcccgccgggcaaccgtttcccgcaccttcctctacgccaacccacaggccaaagtcgcagtctccgacgccatggccgaagccggcgaacggcgcagccaggtcctcgacgaccaggccgtcggacgtgaggcgacctggcgcgaacgggcgctcaacgccgaagacgctctcaaagccgcgcgcaccgaaatcctcacccagcgggcccggatcggcgagctcctcggccagattcgcagcatggaaaccgaatgggccgaagagagcatccagcggatcaccaccgagaacaccaccctcaagcagcagctccgccagctcaccgccgacacccggattctcgacgaacggctcaaagccgctcgatccaacatccgctttcaagaccggcgtatcgccgacctggaagcccgcctcgccgacccggcaccatccacgtga

SEQ ID NO: 2727 - DNA, 393 bp, Actinoplanes utahensis
atggatacgacggaaggcagcacgactacggtgactgatccacgtccgcggccaaagcgccgccgccggttggtgatcgccgccgtcgtgcttgttgccgcagtgggcgccacctccttcgtgtggtggggcaaccctcggatgggcgagggcagcgtgatcagtcctggggagggcatgtcgtgggccaacgacggcgtgacggagacccgaatggtggtgcgtggcaggcacgccgcgacggtaaccgccaccttcagcgtccgcaacgacggtcacctgcccttcaccgtgcacggcctcgacgcgtcgacacggtcgaatggctctcacatcagcaggtcaccttcgtggcgggcgtccccggattcgataagtcggcgaccgcactga

SEQ ID NO: 2728 - DNA, 1179 bp, Actinoplanes utahensis
atgacggtcgttctccatgtgcacggcaccggagtgcgcgagcccgattactccacgggcttcgacagcttccgcgtgaaactgcaggcaatccgcccagagctgcgcgtggaaccctgctactggggcggcgagcacggcgcccggctgcgggccgagggtgtctcgattccggccgggcgtagcgcgcgcgagccccaggagccggccgatcgcgacgtggcactctggagcctcctcgcggccgacccgctattcgagctgtccaccctggccgcggccgaggcggcggcggcccgcggcggggccggcaatttcgacccaatggcggtgcgcggcgcggctaagctgatcgagcaggcgcccggcctggcggccgagctccaggccggcattgccgagctgggcctagccgacgtgttccccggggccgtccgggcggtgctggccagcgaggagatcagctcgctggcgcactccgaggtgcggccggccgacctgcgccggccgttcgcccgggcggtcgtcgctcagtcgctgctgctggccgcggaggcggcccgcccgccgatcgacggcacccaccgggatgcgctggtcgccgagatcgtggccgccctcgggggcaccgaccgcgggctcggcgccgacgccggcaagctggggctgcggctggccctgcggatgggcgccggcaaaccggtcgagcgccggcgcgccgcgatcacccggtcgaccagcgcggtcgccggcgatgtgctgctctacctggcccgcggcgcggcgatccgcgaccacctgcgatcccgcatcgaagagctgggcgacgacgtggtcgtggtggcgcacagcctgggcggggtggccgccgtcgacctgctcgcgacgaccccgctgcccgcggtgaccggtctggtcacggtcggctcccaggccccgctgctgtacgagctgggcgcgctgcccgggctggagttcggcaccccgctgccggtcggcttcccccgctggctgaacatcttcgaccggcgggacctgctcggcttcaccagcggcgggctcttccccgggcgggtcaccgacgccgaggtggacaaccgctggccgttcccctatgcgcacaccacctatttcggcaacgacgccctctacgaagagctggactcgttcctccgatga

SEQ ID NO: 2729 - DNA, 2115 bp, Actinoplanes utahensis
atgatcgatccgctccgcacccgggcggtcgtcgtcggcatcgagcggtacgacctgggcgagagctggaatctcgacgggccggccctggacgcgtgccgcttcgtggagtggctcctcgccgagcgcgttccagccgggaacatccgcctgcacgtaagcccgctggccgacaatgcggccgaggtcgagagccacgtcgccggccggctcgacgtgcggccggccgagttcggcccgatccgtaacagcctgctcgacgtcggggaggagtcgagtgacctgctgatcctgttctggggcggacacggggtgcggccaccgacagagttcacccatctgctctgcgccgacgcccgggaccgggaccgcagcaatcaccgcctcgacctgctgctgcacatcatgcgcaccaccgcgttcgcgcagcacccgcggcaactggtcatcgtggacgcctgtcaggccgacgtcccccggcactggcagctgccggtgcaccaataccaggatgccgacctggtccgcgccttccggcagcaggacacgttgctcgcggccagcccgggccagtcggccggcaatgacgaccggaaccggaccggccgcttctccgacgccgtcctggccgagctcagctggcccgacgaggggcggttcgacgagctttaccagcgggtgaaggcacgcgtcgcatcggccgagcagcagccggtccggctcgccttcctgcaggacggcgtggaacaggacgtctgggtgccccggccggccagcccgaaggtcgtgccgctgaccgatctcaccgcctaccgggcgtcagccgccgcgtcgcccggcgacggccggccgccggtcgacgagcgctaccgggtgcggctcgacgtggcctgctgcctcgaccgggcgcccggtctcgcagtcctggccgggccggtcgagccggattacgccgcgcaactggcggccgcgctgaccgcggccgaggaccatctggccgccgccggcgcggtcgagccggaagcggttcgccgctggctggtgctgaccccgtcgaccggtcggccgccggccaccgccgaggagatcggcgccgaaccgggatggttgcgagcgccggtgcagggcgcggtggtcaccggcctgaccgacgtgcgcgtcgccggcgaatacctgcgcgcgatccggagactcgtccctgggctggccgtgctcgcggtggccggcccggagcgggcggcccgcctggctcgcacgctggaactgcccgagctgctggtcgcggcgttcgcaccggtcgagacggccggtcgtccggtgccgttccccttcccggccgggggcgcgctggtcgcgctggtcgcgcacctgcgggcgtacggcgcccagctgcccgccgtggccggcgagccgccggcgatccccgatgaggtggaccccgtcgcctgggcggcccaggtggtcgctgagctgaacgaccccgggcaccccggctacgacgaggccgcgctgctgacctcggcccgcgaccgccggcccggcctgtatccggcgctgctcgcgcagtacgccgagcggcgggccgccccgggccggctgacctcgctgaccgtggcggccgggaccgacgccgagctcagctactggctcacgcacgcgaccgagccgcccgacccggcccgcgagatgcccgctcccgaggtcgtcgacgcgctggccgtcgtgctgcggcgccgctcgctcgaggcggccgccccgtgggcgccgtacgccggccggcgggtgtccgatttggtgacgctgcccgccgcggcggcgcccgggctgttcgccaccgcctcggccgaggtggcgctgctcgccatccggtgcgggctcggcgagggcgtcgagcccgccgccgtcgaacacggtccggtgcgtcccggcgcgtgggcgctgctggtccagcagggcatcaccgccgacaccgcgaagtggctgtccggcctggacgaccacctgcgccgactggtcgggctgcggcccgaggacctgtcggtcgccgatcgggaggcgctggccgcgatccggtcggcgctgcacccgatgctcccgctcccgcacgccgcctag

SEQ ID NO: 2730 - DNA, 8940 bp, Actinoplanes utahensis
gtgctcgctgactggtatctctgcgccacgcagggactctcgctgtcgggaacggacgcctacctggacgcgctgcgcgcgctcgacgaaccggccgagcgggtcgagctggccgaggaggcgatcaaccagctgcgccgggtcgagcccggcctgatgctgtacgccctcccgcgggtgctcgccgcctaccgccggcacgccgaccggttgtcgctggccggccggaccgcggcctacctggccgagctggacgagttggccggcgggcaccccgagctgcgggccgcgttcgacgccctggccgattcgccgcgccggctgcgggcccgcatcgtcgcgctggccgaggtggtggcggccgacccggccgacgccgagacggccgagacggccgacgcgccggggccggcggccgtccccgatccgtacgatgacctgttcagcgctccgttggcgaccgcggcagtggctctggcggccgagttggcggcccggtcaccgcagaccgcccgggagtggctcggcgacggcgagccggagttgctgacggccgccttcgacggccggtacgggcggctcccgttcctgctcgcggtgcggttctcggcgctcattgacgggaccgccgagaaccggcagcggttgctggcgcggctgtgggcgttcggaaggggagccgccgacctggaaccggacctcgtgcaggaggccgccgggttgtcccgcgcgcaagcgtccgacgtgaccgaaaccctgaccgaggcggtcgccggcctggacctggccgcctggcgcaagaacgaacccgggctcgacccgcagcggcgggaaatcgcgcaggctcgttggggtggcagcggtgcgcccggcgccgcggccaccgccgccgtgctctggcaggtcgcgatgtggcgggtggccgccgagcgcgatccggccgcgaccctggcgggtttgcgcacctggtgggccgccccgaccctggtcgagcgctcgcggaagaccgccgacctgatcgtgccgttcaccgtgccgtacggcgagaagggctacgaggcggcctggaacaacctcagcaccctcgcccgggtgcgcagctgggatcagcggcggcagccgccgcggctccaactgaccgacggcccggtcagcgcgactccggcggcctcggctagcctggtcggcagcccgtggctgctgcgggcggtgcagcgctggcgggcgagcgccgaacgccgcgcctatccggactggaacgatccgccctcgttgatccggctcagcgcggccgccacgctcgccaccgacctgctggccgcggtgccgccgggcccggcggaggacgccgaccacctgctcgcgctcctgctgctgatccgcgacaccgcggtctgcagcccgctgcgggacgccatcgacccgcgcgccgccgtcggcagcccgctgccgggcgccctggtcgctctctaccaccacgcgctgatggtggccgaccgctgcggcaagggggatggcccgcacgcggtaccacgccggatcgtccggctgctgaccgcggggcgggccgcgcgggcgcgatgcgacgccgagccgacccagtgggcccggctcatgatcttcgccgcgccgatggccgcgttctggtggctgcgcgagacggtcagcggtggctggcccgaggagagcgaggacgaggacggctggctcaccgggacggcgcccaccccggccgcccggctgttgcggctgctgctcgccgagcgcctcgacctcgactccgggcaacgggccgcgcccgccctgctcgagcgcgacctgcggccggacagccggcacgcggcgggttgggactggcggccgcacgaggagcccgactgggactggctgcccaatgccgagacctacggcctcaccccgcccggcgctgacgcggccgagcagccccgcacccggcacgtcaacgccaacgtgctgttgctggcgccgcggcatggcctcgacgagtggcgctggtggtcgacccggctcgtgaaggcgctgggcgacgagccggccccgatggcgctgcagaccgtacggctggaggcgctgatgcacagcccggccgaggccgactgggccgacgactgggccgacgactgggccaagagcgtcctgcgtcgggtcgagccgtgggaactggcgcggatcgtccgccggcggatgatcgacctgctgcgggcgccgatcgacggcgacgagtccgagaaactggtgggccgggtcggcgagatcgtgatcgacgcgatcctggacctcagccgcgccgcgcagtggtaccaccagttgctgctgcgtgagctgaccagggtcgccgctccgccgagcctggccacccagtggcgctaccgggcggtcggcactctctaccggctgggcaccgaggcggccgggcacggtgccatcagcccgtacgaggttatcgggcagcgggtctcggccggactcaccgcgaacaacgtccgcgagctgctcttccagcacggcggcgccccgatcgtcgggcaggcggccgcccttggcgaggccgtcgagcggctctggcgcgacctgcggaccggcccgccggtgcgccgggtggagacgccgttgagcgacctcgaccacgcccgcgccgacgatctcaccaccgtcgccgtgcagctcgaccggtaccacggcaagctggtcagctaccacgactcccgggacggggtcttcgacgcgttcacccagcgcgacagggtggccgcggtgacctccgccctgctggccggcgcggacggctacggcatcgtctgtgcggtcgaccagcccgcccgtacggtgtgggtgaacgccggcttgggccacccggcgcggcacaagctcgccaaccgggaccggatgccgggcctcggcgacctggtggtcgcccatttcgccggcaccccgggcgcgccggtggtggaccgggcactcgcgccgatcgaccgcccgctggacaccgccgaggtgcgcgaggccaccgtacggccgctggccggcgcgccctggctggccgtcgagatcggcgggatggacgtctatccggggctcggcgcgactgacgagcgggaccgcgcggcccgctggcggtgggaccccgacctggcccgccgctacggcgctcccggcgaaccggtcgagaccggcgcttgctgggacgagacgatcgagcgctgggtgcccctcgaccggggcggccgggagctcatcgccggcgaacgggccgctttcgcggacggcctacggctggtcctcgcggagcaggtgaccgaggacgagcagacgcggctgcgcttcgtgacccggcctgggcgcgcctatctgctgggcgccgacgacttcgcgcccgacgactgggcccgcctgctcggcctggtcggcgacggccggccggggctggccgtcaccgtccggccggccgacccggacgggctgctcgtgctgctcgacgaggtcgacgagcgcaaccgcgactggctgcggatcttcgacgagccggaggacagcgaggtcgccgtgcatacggcggtctggtcctcggccggttggcacctgagggtcgagccgccggccggcttcccggccgagatcgcggtgaccggcctcgacgggtcggcggagaacgcgctctgcgtagtccgcgagtggggcgagccgcaggcccgggcggcgacggtggccgcggagcggatggcggaccgcggcgtgccccggcccaccgaggcctccgaagtacgctggcacgccctggcccacctgcccaaggacagccgggtccggttgcagcggatcgtcgccggcaacctgcgcaaggcctcgctgctcggcatcacgcaggcgggcatgggcgtgttcgtggcgaccgagtcggtgtcgctggccgccgatccggcgacgatccaccggttcggccgggaccgcgaggtgatcgtcgagtccgaccgggccaacgagccggtgccgcagcgcgacccggtcgccgtgccggacgaccagttgctccggctcagcgcggcggccggcctggaggccgtgctggccggggcggacgccctcgacggcatggtcgtgcaacaggtcctcgacaccgagaagcgcatcatccagtacggcctgtggctgcgcaacggaaaccgggtcagccacgccgtggtgcccgagcccaccctgtcggccctcaaggccgaggtcggcgaccatatcgacttccgccgggccaccaccggctggatcggccacatacgccgccgccagatccgtggccgggccctctacaccggcgtggccaaggtcgggccgggctggctgccggtcggcgaggtcgagcgcgacggccggccgtacaccgtctatcaggcgcccgaggccccgcagctggccaccgggaaggcggccgaacgggtcaccgagcggcacacggtcagccggctcgacaaccggtcctggtcctacaacggtcaggcctacgtgcgggtgctggtcgagcggggcaaccgggcgtacgtcggggaggcccgggaattcccgaccggctcgctgatgcgggtccgcagcaccgacctgcgcctgacccagcacccgggcgacgacaacccgcggtacacggtccggcgcaccttcagcctggaggcggtgatcaagcagccgccgcgaccggccgcctcggccgagatcgagctcgaccgctgggagcgggcgctgcgcgacggtcaccagcacatggtcggcatccgcgacggtgaccggcttctgctgagcggctatcgggccccgctacccgacggcacgctggcccgctggctcccgctgcggccggacgagttgccactggtcgacgggcatgcgtacgacaacggctcggtccgggcgctgatcgaggacgtcgacgccgggcacgtggcgtcgttcgcccgcgcgaccccgctcgacgtcgccggcttcgcggccgcgctctcgctgccggtcgacgacacccggaccgatctgccggatcccctttactacgtgggcgccgagcccggccaccaccggttcgagtggggcttcggctggacggtcgacgtcccggtggaggcgctcacgatcgacggcgaaccggccggcagcgggcttttccacggcgaccgggtgcgggccgtccggctggtccacgacccggcgccgcccggtggaatcggtctgcggctggagggccgggacgtggcgaccgcgctgagcgggcggctgatgcaggagtcggcggccggcatgatccaccgcatccaggtcgaaatcgacctggtgcacggccgggtcgccgtgctcggcgtgcacacccagcggcagggtgcgtccggcgaccggatcgaggtggccgcgcatccgatccgggccgagctggcggacgcggaggcagtcgtggcccgcgagcgcaaggccggcagatccggcaaggtgacccggcagctccatgcccgcctggacacctcggaggcggcccggcagggtcgtcgcaaggtgttcacgctcatcgacccggcccggctggccgagggtgacctgctctacgcccgggccgaccggatcgtcgacaccggcaacgagctctgcctggagctgcgcccgctcggctcggccggccagaagtggactttcagcgtggcccgccggcagttctccccccaggtgggcctgctggcccggcagctgcgcagccctggaggcgcgaacgcctaccgcggccggcagttcatggtgcgcctggtgcggaaggcgccgaaccggcgggaccgctggcacggctcgatcgtcgacaccccggctcgcccggcggccaccctggccagctgggtgcggcagcagggcgcggcctgcttcgccgtcctgggccgggacgacgtgctcgaggtcggcccgggcgtgttctacgacgcggccggcgtgccgggcgctcgccgcctcgagcccggcaccctgctgcgcctgctcgccgtgggcgccgggaaaccgctccagctggaggtcgccatcccggccgatctgcgctacgtccggaacggtcgcccggcgctcgccctgccgaagaactcggtgctcggcccgggcgggctcggtcaggcccgtaacggcaacgcgttcacgctggccgacctgcccgcgatcgaggcccggccggaccggggcctgaacgtccggtccctgcttcaaaccgcccatcccaagatcgtgtacgcggtgagcccggcccccgacgatcacgcccggctgcgttcgatcgacccggggaccgtggtcggcagtctcgaattggacccggccggcccggcccggctgcacccggtcggcggcgcggagccgcatacgctgccctgggcgcagctgtcgttcgccgagggcagccgggccgagctggcccgccggctgcgcgacgggacctgggaataccacgacgcaaccaccggccactgggacgccgacggccgcgagtgccgccgccaggaactgggcccgggcaacgccgaacgctggccggtgttcttcgccgaccgcggtggcccgaccgtgcgctacccccgcaaccagctgctgcggctcggcctgccgaccgccgaattgctcgaccggccgatccgcggccgggaggaggagacctatgtggtcgccgacgcgaccaccctcgaaggcatcccggcgctttggctggagctgagcccgggccgggtcgccgagataccggtcgccctgttcgcctcccgccggcaatcgctggccgacctcgactggtcgcagatgcgcggcggcgacctagtcaccgtgcggcggcggcgcaacgagcagaccgggcacgtcaccctcgagctgcgcgactggacgccggggctgcgcggcgcctggcccgggtcgccggggatcgtgctgccggtggtcgcgaccgaccgcgcagcgggggcgctgcagctgggcgcgggcgggcacacccggtggtacccggccgagcccgagctgctcgaccgtcacccggtcggcagccgggtgcggctgacctcggcgaaccggctcggcgcgggcacggtccggaccgatgacaccgtcctgctaatgccccgggacggcggctgggggctggccggcttcggcgacgtcgaggtaacgctggccggggacggcccgaccccgtggccgggcgccgcctggttgcgtgacctgctggccggcccggccgccgcgtccgggctgctgacggccctcggcggcgccctgccggtgaccgtggacgagctgggccggtccggcgaacgtctgacggtgaccgtctcccgccgcaatcagccgtccggccggtggccacgccggcggatcgtgcggaccgaggtggtcacgtcgatccgcggttcgctggtcctgcgcgccggtcatgccctctatctgatcgcggccgacaaggcagtgcccgggctggacagtagcgcggtcgcggccgccgcgaccgcgctgcgcgaccggcgtgccgtgctgtggtggcatcacgaggaggatgagctgcggcccggcacgtcggccggcaccggccacgccgagcaggcggtcctgatcgaggcgccgatcgaggtcgacggccagttcctcgggctgatcggccggaacaccgagaccggtgcgctgggctggctgccgtcccggctcgcgtcctggatcggcgagcccgacccgcggctgcccggcctgctcgcggggccggcgccggtcccgatggtccgcgagcgacagcagttctcggtggtcgaccggccggccgcggcccgggagcaccgcctcaccgaggtcggcagcgtgctgtcggtggtcgtcgccgcgttgccggccgccggccagccgggctatctggtacgtaccgcctacaccggggtcctgctgaccctgaccgcggcgagcggcctggccctcggtcagcggctgcgagccgaggtcaccgcggtccgtggtggccgtttcccgcagatcgtggcggtgccggcgggcgatcgccgggccgagctcgacctgcctcggacgatcgccgagcgcctcgccgcgatccacgcgacggccgacgagccgctcgccgcggtccacgccggctcgccggccatcgactgggatcagccgttccgcgattaccgggcggcgaacctggcggccgagtgcccggtcgacccggccgcagccgtggtgtggtcggctgcccaccgggccgaccccggggtgctcgcccggtggctggccgccggcggccgggaggccctggccgggcgtgctgaccagcatctggccccgctgctggcggcctgccaggtggccgccgagctgggtgagtccgacgcccgggcggccgccctggcagtgctcatcgcgcaccagatcggccgccgggcgatccggtccctgcacgtcgagccgctggtcacccactggctggcgcagccggaacggcagaccgaacccggcctgtgggcgcagatcaagcggctcgagctggcccccgagatgccgcctgaccggttgaccgtcgtggtccagcgctgccaggccatcctggcccggccggtgctgcacggccgagaggatctgcgggcgccggtcgcgcacgcactgctgttcgctaccggctcaccggctcgggtcgagcggttcggcgaccgggcgaactggcagccggacgccccgctgctctccgaactggccgccctcggccgcggcctgaccccgcccgccggtcggccggtcgcccagccggcgctgctaccgccccagcggcaaattgtcaaccgggccgcccgggaggtgattgggcaggcccttccggtgattcttttgcctactctgagcgccccaccggcgcaatggcaaacgttgctcgacaccgacgggcggtaa

SEQ ID NO: 2731 - DNA, 279 bp, Actinoplanes utahensis
gtgacggtgggcgggtccgccaacatccggatctgcttgagaacagtgcacccggcctcgcagatccgggacgccggaacgatcgggagggcgccgtctctcgaggttgctcccagcgccgaggtgattagcttcgcggacaaggcctaccaaggcgtcggcggtaccgtgcgcacaccgttcaagcggcaccgttgccggccggagctgtcggcccggcagaaacccgtgaaccaggcccacgcccgaatccacgctcaggcgagcgcaccgtcgtga

SEQ ID NO: 2732 - DNA, 360 bp, Actinoplanes utahensis
gtgagtgacctgctccgccacgccctcgtacggcaccgcggcgaacagaacaccgccgacagcggccgatccaggccagccacccactcggcgccgcactgcggacacgccacccgatggtcctgcttcgccgcggcgagccgggcccgactccgccgcaccgtgcgccaatgccgggcccggcacgccgtcgagcagaacagcatcgacatccgggtcgtcggcggcaaccgatcaccacagaccggacatcgccgcggcggctcctctgccgagtcccgaaccgcgctggacggttgcggaaccagcgacagccagccccgagcaccgcgcttcgcaccgctcatcccgcaagcgtag

SEQ ID NO: 2733 - DNA, 837 bp, Actinoplanes utahensis
atgacccaccgccgtgcatacccgtccgacctgtccgacgcccgatgggcgctgatcgagccccgactcagcgcctggcgccagaagcgcaccgacgccggcgtcgggggccgcaccgccgaacacgatctacgagagatcttcaacgcgatcctctacgtcaaccgcaccggcatcgcgtggcgctacctgccgcacgatctcccgccgtggcagaccgtctactggtacttcaaaacctggaccgaggacggcatcttcaccgacctcaactacgacctgaacgggttggtgcgtaacaaatccggccgcagcaccacacccacggcatccatcatggacagccagagcgtgaagacgtccaccaacgtccccaccgccagccaaggcatcgacgccggcaagagaatcgtcggccgtaaacgcggcatcatcaccgacactctcggcctgctccttgccgtgatcgtcaccgccgcctccgtcagcgacaacacgatcggcatcgacctgcttgaccgggccacccgcatctatcccactcttacaaaggcctgggtcgatgccggcttccgcaccaaggtcgtcgaacatggcgccacgctcggcgtcgacgtcgagatagtcaccaaggacccgcaggtcaaaggcttctcagtgatcaaacggcgatgggtcgtcgaacgcaccatcggctggctcatgcaacaccggcgcctggcgcgtgactacgagactctcccagtcacctcggccacgatgatccgcatcgccatgatcgacaacctcaccaaggaagccgtcgacgaaaccaccccaacctggcgagacacctaa

SEQ ID NO: 2734 - DNA, 510 bp, Actinoplanes utahensis
atgacgcgacgattcggtgaccgagccagattcgctgtcgaggtgggcgaggcctggccaccgccacccgcccgggccaccggcgagctgcgcaccgtcgatctttgggccgccggcaagtggctgaccaccgaggacaacaccgtctttcttcctaccttcatcggcttcctccgatccacggcagccaaggtgcggcgccgtcaggtcagtccgtgcccgttcccggaacattcacccgaagaagttttccagctcctctatgcagacgacgagaccgactttcgtgagcagttctggctgatgcactggggagagaacgtcgacaacgtgacaagctacgcgtatctagatgccgacgacctcgtgatcgtcttcagccatcggcgagccgagcaccaccccgcagggggccctgacaaggtctccgttaccaggatcccggcggacgagttcgcgaccgtcctcgacgaagccgccgatctcctcgatgccgagctcgttcgatag

SEQ ID NO: 2735 - DNA, 156 bp, Actinoplanes utahensis
gtgttgggcagcgcggtggtgttggaggagaagtggccggtccttggccggcatgagcgggcggccgagtggctccgagtatggacggacctgggaagagcgccgcggacgatcgacgcctacgcgcggggcctggccgagtacctgctgatctga

SEQ ID NO: 2736 - DNA, 897 bp, Actinoplanes utahensis
gtgacggctggccggctgcatgtggccgcgttcgtgaaggacctgtccacgcggccgagccgccgaggcgagaacgtggtcgcgctggactcaggcgcgggtctggcgaacgcgacgctgcagcagcgcctggtgccggtccgcttgttctacgactacttgatcgaagagggattacgcgagtcgaacccggtcggccgcggccgctacacgccgggccgaaaattcggcagccatgagcgcggcctggtgccgcgcctggtgaaactgccctggatacccagcgagcagcagtggctcgacctgctggacgtggttcgccaggagccggtacggaaccgggtgatgctcgccctggcctacgacgctgctctgcggcgcgaagagctttgttcgctgcggaccgacgacgtcgatcccgcccaccggacgcttcggatcagagcagagacgacgaagacccggcgcgaacgcgtggtcccgtactccgcgccgaccggcgtgctgctgtccggctacctcgcgcatcgagccacgatcagcagagcccgcggcccgctgttcctgtcggagtcacaccgcaaccacgggcagccgctgagcctgtggacctggtcgaaggtgatccgccgcgtcgccctggccgcggacctgccgcgtttctccacccacaccacccgtcacctctgcctgaccgacctggcccggatgggctgggaactgcacgccatcgcgacgttcgccggtcaccgccacaccgagtcgaccatgacctacatccacctgtccggacgggaccttgcggagaagctgaaccgcggcatgcagcagatccactcctggcgcatcgacatgcttacccgagtcggcaactcaggcgggatgaacagccggtga

SEQ ID NO: 2737 - DNA, 2325 bp, Actinoplanes utahensis
gtgaccgcgacgaccaccaaggccgccgccggcagcgcgcgactgcctgccagctggccgtggccactcgacctggaccgctacgaccggcgagccctggtgaccggcgccgaggcgaaggcgctcgctgtcttggagatcgaacagctcagacgcctgggcctgacgccgcaggcggctccgaggcggctggtcgagccgctggcccatgcccgggactgcctccagtgggcgccgggcactggtcaccagcgacggttcgccagtgacgcggccggcctgatcttgatccgctgcggtgaactcggccgcagctactggggctggtcggacgaggactggaccgacctgatcgaccgttccgggggcgagttccggcgtcggtggagcggccagatcggctcgaacgcgcgcccattcgtgatcgcctacgcctatctcctcggcggcttcactgcgttcgagcagatcggacgcttccaacggcccacgctcgctcaccgggtcttcggccaagccctggtcgacggcgcggtcgggaaaatcctcgcggtcctcggtgactggggctatcagcgtcggcccgaacgcctcgtctccgccgtctgtcaagctcttctgctgaaccgcagccctcggctggaggatctgtccggccctgctctggccgcgatccgcgcgtcggtggccatgcaggagagcgagtgggccagcgacctgcacgggatccaccgcgccgttgccgctctcggacatgccgacccgccgccgcgcccccgacacggccccgggcccacagcgatcgagggcacctcaggagcctgggtggactgggtcgaacgctggcacgcgacctcgacgctgaccccgaaggtccgcagcagctatcgcagcgtgctcgccaagatcggacgctggctggccaccgaacaccccgacgtcaccgcgccggagcactggacccgccagacctgcgcgtcctgggtcacggccgttgaccgcatggcggtcggcgactactcccaatggactacgggcatgcgctcgcagggccgcataggcaagccgctgacgccgcaggcgaagtccggatacatacaggtgccccgcacattcttccgtgacctgcacgaatgggagtggatcccgcagcgcttcaaccctgcccacgcgctgaggacacccagaagcgttcaagccctcatgggtcccgacccgcgcgtgatcgccgacgacatctgggccaaactgttgtgggccgggctgaacgtcgagtccggcgacctaccgaccgccgatggccgcacctaccccgcagagctgatcaggggtatcaccctgacctggctcttcgccgggcaacgcagcgatgaaatcgcccggctccgcgtcggctgtattcgctggcagcacgacggcatgcccatccccggcgactccggcgaggtcctggcccgcgacgcggtctgcctgctcgacgtccccacccacaagaccggtaccgccttcaccaagccggtcgacccgctcctgggccaggcgatcgaggcctggcaggcagtccgacccgaccaacccgccatcctcgacccgaagaccaacgaacccgtcgacttcctattcgctttccgcgcccgccgggtctccaagcattacatcaacggcacgatcatcccgatgctctgccgcaaggccggcgtccccaccgccgacgtccgcggcaacatcaccagccatcgaggccgctcgaccatcgccagccagctctacaacgccaaggagcccatgaccctgttcgagctccaagaatggctcggccaccgaacgcccgaagccaccgcccactacgccaaaatcaccccgaacacactggccagggcctacaacgacgccggctacttcgcccgcaacgtccgcaccatcgaggtcctcgtcgaccgcgatgccgtcgccagcggcgcggcagcagccggcgagccctggcagtactacgacatgggacacggctactgcacctacacgttcttcgagcaatgccagcaccgcatggcctgcgcccgctgcgacttctacacaccgaaagcgtcatccaagggtcagctgctcgaggccaaagacaaccttcaacgcatgctggccagcatcccgctcaccgacgacgaacgcgccgccgtcgacgacggtcaggccgctctcgaccagctgctcgagcggctcgtcgacgtccccaccccggccggttccaccccgcgacagatcggagcgcctgccacggcaaccttgcttccgatcctcgccatcacgaagcgccctcacgatgagtaa

SEQ ID NO: 2738 - DNA, 354 bp, Actinoplanes utahensis
atgtcgataacgtcgggtggcgttcccagcagcgcgcaccttgccgctgagctcgacacgttggacaacaacgtctacggattcatgcacaacaccttcgacctggagtcactcgcgggctcgttcgcgcagctgggatgggctgcccgcaggtcggcatcggacgagtatgaaatcacatgttcgtggtgccgactgaatctcttcaactccggcgggatgcccaagttcgccggcgtggtggagcccacacgcgtcgacgatctggctgacgtcttccgttctctcgacgtcgactatgagatcgagctgtatgacgtcgaaggcgagctcgtcagaacgcttctgccctga

SEQ ID NO: 2739 - DNA, 1650 bp, Actinoplanes utahensis
atggacagccagagcgtgaagacgtccaccaacgtccccaccgccagccaaggcatcgacgccggcaagagaatcgtcggccgcaaacgcggcatcatcaccgacactctcggcctgctcctcgccgtgatcgtcaccgccgcctccgtcagcgacaacacgatcggcatcgacctgctcaaccgggccacccgcatctaccccactctcacgaaggcctgggtcgatgccggcttccgcaccaaggtcgtcgaacatggcgccacgctcggcgtcgacgtcgagatagtcaccaaggacccgcaggtcaaaggcttctcagtgatcaaacggcgatgggtcgtcgaacgcaccatcggctggctcatgcaacaccggcgcctggcgcgtgactacgaaactctcccggccacctcagccacgatgatccgcatcgccatgatcgacaacctcaccaaaagagccgttcaactacccgacgagcagtctcggccgacgcggtttcgccggggcgggttccgcaccgctcgccaggcacagaccgcccgtaaccagacggtcgcgtccgccgccgccggtgccggaccgcggcgggtcacggtcgagcagtggttgcgccgctggctgctgagtctgcctgggcaggtacgccggtcaacggctgccggctacagcatccacgtgcgccggtacctgatcccgcacctgggccaccacaccctgacagggctacgagctgcgcacatcgaggcgatgttcaccacgatcaccgcacaaccgagccgcaccggcgcgccgctgtcggcggcgaccttgcagaagatccgggccaccttgcgccgggcgctgaacatggcgatcagggagcaactgctggcaatcaacccggcccggctcgtgctgttgccgcggccacggcggcaccgcccacaaccgtggtcggcatcgcgggtcgcggcctggcaggctaatggctgcaagccggtggtggcggtgtggacgccgcagcaactggccgagttcctgctcttcgtccgggacgacccgctgttcgcgctgtggtggctggcagcccttcgcgggctgcgccgcggcgaaatctgcgcgctgcgctggaccgacgtcgacctcgccgaaggcacgctgacggtcagccacaccatcgcccacgctaacggccgtccctattgggacacgccgaagaccgctgcggggcaacgcaccgtggcccttgatcgcatgaccgttgcggtcctgctacggtcgcaacgccagcagcgtcggcaggcacagtgcgccggcgagcggtggcgcccggacgggcccgtgtttacccgccagggccgggcgatccgcccggactggctgacgcaccgcttcgccacgctcgtcgccgcgtccgggctgccgccgatccggttgcactgcctgcgccacggcgccgcgacgctcgccctggccgcgcacgtcgacctgaagaccgttcaggacatgcttggacacaccagttatgccttcaccgctgacacctacgccaccgtgctccccgaccaggcgaaacacgcggctgagtcgacagcacggctcgtactcaacgctttgcacaaagcgtgcaccgctgcgggtgcagggtcgcagacgggctcatga

SEQ ID NO: 2740 - DNA, 1209 bp, Actinoplanes utahensis
ttgggcagcagcgagcacggcgacgagccgctgaaaaaggcgttcgcggcttcctcgcttttcggtgacccagagatcttccgcctcactgaaccgcttgcctcattgttcggtcggatagccgccgaccaggcacagcagcgcgacaggttcgcgaagttgatcggagacatcacggggactgcccgggcgcgagagtcactatcggcgctggccgaagcggtggccgccgaccaggcgcagcagcatgctcgcctcacggagatggccgcgaacctcactggcacaacgcagctcacgaagtcgctgacctcgatcgccggccatatcaccgctgaccagatcggacagcgcgacaagcttataaaaacgatcggcgaggttgccggagctgcggccatggacaaggacgcactgtcgttcatggcacatcaggtcgccgccgaccaggcgcagcagcgcgcccgcctctcggagatcgccgcggacctcgccggcgcaacgcagttcacggaatcgctgacctcgaccgcaggccgcgtcttcactgatcaggccgggcggtacgacagcctggcgcaaacgatcgggccaccagccgttggcgttcggctcacggagtcgctcacctcgccgctcggtcgcatggcggtcttggagcccgggcaaatcgagggcctcgcccgggcctgtcggccgaatcttgacgacctggcggagtcgctgagcactgtcataacgcagatcaatcccgacctgacgcaccggacagtgagcgcctccgtcgatgtactccagcggatcgtcgcggacggcctcggagaagagtcgctggatcagctcgccgacgaggtgacggcgtcatcgggatacgccgacctttggcgggacattcaaaccgaagtcaagacggtgctccaggaagccggtgaggaatccggccacgctggtgtgcgagacgccgccgcatggcacatttcctggctctggctgctactgcgcgagtcgctgccgaccgtaacgaccgtcgagaagatcagcaaggtcgtatccatctcgacggttgccttcatctgctgcgccgtgcttcgtacaacccatccgaaactgtgggctgacctggaagaacttcaactcacgccattcgatttcgtaggctacctattcggggtactggcctgggccgagactcagaaggaccggtcctga

SEQ ID NO: 2741 - DNA, 183 bp, Actinoplanes utahensis
gtgaccgggtcccgcaacatcacccacggcccgctggccgctatcgccgagatccccctcgactacgccggctacggcatcgtcgccctgttcttcctcgcctggatcatcgcgatcgccgtctggcacttcgggcgcgtcgaggaacgctggtcggccaacctcgcctccaacaccaaatag

SEQ ID NO: 2742 - DNA, 282 bp, Actinoplanes utahensis
gtgattccggcaggccccgggctcgcctttctcgccgcccagcaggcggccggcgtcgtcgccgccaaacaccgcggcgatttcgccggtgccgagcaactgctcgtggcgatgggcgacgcgcaggtgcaggcccggggcttctgcctgcttgccgagctcgcgctcagcctggtccgtaggcagaccgggcaaagtatggacgagctggtgcaggagctgaccttgttgatcgccgactgcgggccgccctcgccgccgccgggtgagggtgacggctga

SEQ ID NO: 2743 - DNA, 630 bp, Actinoplanes utahensis
atggcgatctacacacttcctgacatgccctacgactacggagcgctcgaaccggccatgtccggccagatcctggagctgcaccacagcaagcaccacgccgcgtacgtcaagggcagcaacgacaccctcgaccagctcgccgaggcccgcgacaagggcgactacaccgctctggtcggcctggagaagaccctggcgttcaacctctccgggcacgtcctgcactcgatcttctggaacaacctgcgcccgggcgccagcgccgatcgccccgacggggaactggaggccgcgatcgtcgagcacttcggctccttcgaggcgttctccgcgcagctgtccaccgcgaccaagggcgtgcagggctccggctggggtgtcctggcgtgggagccgctgtcgcagcgtttgatcgtggagcaggtctacgaccaccacggcaacgtcgggcagggctcgacgccgatcctggtcttcgacgcctgggaacacgcctactacctgcagtacaagaacgtgcgcccggactacgtcgaccggctgtggagcctggtcaactgggcggacgtgacgaagcggttcgacgcggcccgcgccgccggcaacccgatcatcgtcgcgccgtga

SEQ ID NO: 2744 - DNA, 1059 bp, Actinoplanes utahensis
atgacgacacgacagcgaactctgcgcaagtacgccgccgcgacgatcatcgccatgacggccaccggctccgccatcagcccgcccacaccagccgcggccgcagctccaacagcggcagccacctggtccagcatgatgtaccgcagcctcacccacgacgagcagctggccaccctgcgcacctcgctcgccgcccagcaggccatcaggcgcgccgctgacaccgaactcgccgccgccaccgacgctctgcggaccgcgcaatccgcgctgaccaccgcgaccaccgccaacacccaggcccaggcgcagctgaccgcagcccgcgccgcgctgtccaccgcgcagcggacgttgcgtaccgtctctcaccgcaagccccgcaacgccgccgccctcacccgcgcccgcaacgcggtcaccaccgctacccaaaccgtggccacccgcaacagcgaggccgccaagggcgtcgccgccctgaccactgcccacgccgcggtcaccgccgcgaccagccgcaccagtcaggccagcaccgcagtcaccgacggcaccgcagggctcaaccgcgccgaaaatgcgatcaccgcgctgcccagcgccgcaacactcgccgcccaggccgccgccatcagccgggacgtcgtcacccagatccgagcggggttcgccatcacggacaccacccaggtgtacggagtgaccgtcaacaaaaccatcgcattcgccttccaacacatgatcgacgacgcgaaagccgacggcgtccagatgtccggcggcggcttccgtaccacccagcgccaagccgaactacgcaccatcaacggctgccccgacgtctggaccgccccaccgtcatcctgccgagtgccgaccgcgatcccaggccgctccctgcacgagatcggcctggccgtcgacatctcctccggaggcaaaaccatcaccaagaagacccccgcctacacctggctgacccgccacgccaagcagtacggcttcgtcaacctgcccgccgaagcctggcactggtccatcaccggcaactga

SEQ ID NO: 2745 - DNA, 1416 bp, Actinoplanes utahensis
gtgtcgtcatcctccgaccgtgaggtgcggcgggttctgtggccggtccggtcggggatcgggccggttgcgaatggtggatgggatcgaagccggaggctggccggctatccggggtacggttcggctgccgcagacgtcgccgtcgccgaggagctggtgttcatggccggtcatcaccacagccacgccgcgccgggtggggtgtcgctgccgcacgcgcgtcgtttgacggtggcgctgctgatcccggcggtgttgctgaccgctgtgggcatgttgttgctctggccgcggcatccgccgaaggccgagaccgctgcgggcgggccggctcaggcccagggcgtggtgctgtcgaccgcgacggccgcgtgtgcgccggtgcccgcgggtgagacacggccggccggctgcggcacggctgtcgtgcggttacgcgacggtgcgcaggtcagcacggaattgccgtccgggccgggcgccccggtgatcagctccggggatcgggtgacgttgatcggtttgcaggatgagcggggttcggtgacctggtcgatcgcggatcatcagcggtcgcgggagttgtggctgctcggtgtggcgttcgtgctggcggtgatcgcgttcgggcggtggcgcgggttgagcgccttggccggcctcggggtgaccttcgcgatcctgctgtatttcatcgtcccggcgatcctggacggccggtcgccgatggcggtggcggtggtcggctcggcggcgatcatgctgaccgtgctgtacctgacgcacgggctgaatgtcaccacgacgatcgccgtggccggcactctggcgagtctgatcatcacgacggtgctggccgagatcagtgtcgccgccgtgcacttgaccggtgtctccgatgacacgtcgaacttcctgtcggtcagtcagggcagggtcaacatgcagggactgttgctggccagcatcgtgatcggttccctgggcgtgttggacgacatcaccgtcacgcagtcggccaccgtgagcgagctggccctggcgaatccggcgtacggattccgccagctctacggtgcggcgtcccgaatcgggcgggcgcacatcgcgtcggtgatcaacacgatcgtgctggcctacgcgggagcgtccctgcccctgatgctgctgttcgcgaccggtggcacaccggtcggtgacctgctcaccgggcagttgatcgcgcaggaactggtgcgcagcgcggtcggcacggtcggattgatcaccgcggtgcccatcacgacggcgctcgccgcgctggccgcgcaccggatggcggcgccgtcggcgaagccggcagaaccggaggctgggcgatcggcgcggcaccgcctgcccccggagcgtccgtgggctgcttccgagaggtga

SEQ ID NO: 2746 - DNA, 186 bp, Actinoplanes utahensis
atgagcgaccgaaggcggcgccctgccgcccggggaagctgtgtgtcgatcaccgcgccggcggccgacacctataccgtcgtggccgatggctatgccgtgtccagcggcagcacggcctacgactaccgcgacgtctactacagcaagttgcccggtttactcaccgtgctggcgacccggtaa

SEQ ID NO: 2747 - DNA, 576 bp, Actinoplanes utahensis
atgtcaagcccgcgaggcatgagccgggtcgaggcccgagaggtgaccgtcgccctcgccggaccaggggatctggtcgaggcggaggccatgatgcgggaggtgttggaggcggacctgggcggctatcggccgcagtggcaccgcgacctcgacgatctcgaagcggcgtatctgcgtagtgccgggtgcgcactgatcgttgcccgggatccggacggcatcgtgggtacggccggggtcaagccgtgcgcgttggcgagtccgccgaatccgcagtggttggcgcaccggtacagccagcccgacgtgtgtcagttggtgcgggtctgggtggccgcaggcgggcgacgccggggcgtcggtcgcgccgtcgccgaacgggccgtcgcgtggagcgtcggcccgggcggatatcgccgcgtgtacttgcacaccgatgccagcgttcccggcgcggaggcgttctggcgttcgctgccgactcgcgaggtttgcgacacccggcctgatccgttcaacacggtgcacttcgagatcgacgtcgccgcgatgctgcggacgtcggaatgttga

SEQ ID NO: 2748 - DNA, 864 bp, Actinoplanes utahensis
atgttgagcgtgccggttgccccggcccgcgacgtcgacgagcgtgtgctggctggccgcattctgcgggtgtacgacgggctgcgcgcccaggacagtcttgccccgtcgcccgaggtcaactccctgttcgccgacctggtctcgatctgcgcccacgctgatccggccgatgcctcctcggcactgaccgaccctcggatcaccgaggcacgcgacggcctggtccgattgtgtgccgagggagaatcccggctcgaacaatggtgggcacgccgcactcttgccgccgccgacccgcacgccgagctggccgccttcccgtacctgcgcaactaccagcaactggcgcacctcgaacggcatgcgctggcgggaaccggccaccggcccggagagtcccgtcggctgtgtttcctcggcggcgggccgctaccactgagtgcgatcatgctctcccgcatgctggacactcaggtcacggtggtggaccgggatgccgacgcggtcgcgttgtcacgccgccttctcgatcggctcggcctcgcggaacagatcagcgtgctcctggccgatgccagctcggcatccgacctggcgtacgccaccgccagctgcgacgtcgtggtggtcgccgcgttggtaggcaccacccggattgaaaaacaggcggcgctccgtgccgtcggcacggccctcgaggcggacacgcgcgtgctgatccgcagcgcccagggactacggtcgctgctctaccctgtcgtcgacgtccgagacgtgcacgatgccggcctcgtacccgaagttttgctgcatccgttcggggaggtcatcaactcggtgttcgtggcccggtgtcgttga

SEQ ID NO: 2749 - DNA, 1197 bp, Actinoplanes utahensis
gtggtctaccgggcagctcacgcgttcgacggagagaagttcatccctggcgggttgcaggtccatgtcgccgccaatcgtatcgccgctgtccgtgcctatgcggagccgttgccggctggtcagccagtggtggaccgtccgggatgcacggtgctgcccggtctgatcgatacccatgttcatctggtggctggcggcgagccggacgccttgcggtgggatgcgggccggtccgccgctgaacgggaacaggtcgtgcgtcgttccctgctggcgcaggtcggtgccggtgtgacgacggtgcgcgacctgggagacaaccgattcgcggtcgtggaccgcacggttcgagacgacgaaccgtcggtcgtgggctcggggccgccgatcacctcgaccggcggtcattgcgccgcgctcggcggcgcggcccgcgaccgggcgggcttgcgggccgcggtcgcgcagcggtatgaccgaggtgcccagatcatcaaggtgatcgtcagcggtggtgcgatgaccgccggctcggatctgctgcggctgcagttcgacgtcgctgaggtgcgcgacgtggtggacgaagcgcaccgtcgagggctgcccgtgacagcgcatgcccacccagtgtccgccgtgcaggtgtgcctggccgcgggcgtcgacgccatcgaacactgcacctgcctgaccgacacaggaatcgccacgccggacgcggtgatcgacgcactggccgcacgtcgggtcacggtgtgcccgacgttcggccggttgcccgggctgccgccgtctccgcaggcgatcgaggtcatgcgccggaccggcatgacgttggaggcccggttcgcgcaggtcggccggctgcacgcggccggggtgccgttgttggccggttctgatgccgggatccacccggccaagccgcacggtgtgctcgcctacgcggtcgaggagttggttcggtccgggctgccggtgcacgccgcggtggcggccgcgacatcgggtgccgccgcggcgtgcggcctggccggtaccgtcggacggctacggccgggcatggcagccgaccttttgatcgtcgacggtgacgtggagcgcgacattctagccctgacccgagtccgggacgtcgtgctgcgtggccggcagatcgtcaacgacaccgggccacgaacaccgagttga

SEQ ID NO: 2750 - DNA, 1107 bp, Actinoplanes utahensis
atgagcagcgccccgccccggaccgggccgacacgtcccagccgtcgtaccgccgtcgtcctggtgaccgctctcgcggccggcggtgtactgctgtcaacgaccccgcgccgcagcaactccgcgcctgccgccggtccggtcaccgtcgccgcggcgtggccgcacgcacgccgggcagacctgcccggcacgctggccgacggcacccggttcaatcccgatctgttcctggccgccgacaccgtcatcggaacggcggcgaccggggacggtcgccaggtgcggctgctgctgcgctccaccggcggcctgcgcgagctgcgccgccagccggccgacgcggccccgcagttcgacaatttcgcggtggccggcgacgacgtcgtgtggaccgagtcaaccgatgcaggatcgaccgagatctggtcggtcaatacgcgtgacggacgaccggcgcatcgactgacggccgacaccggcgacaccgtcttctacggcacgcagaacgatctcgtcattgccggaggccgggtgtattgggcagccgctctgaagcagggccaagacaccgagattcgatcggtcgctctgaccggtggagctgtcaccgcccgccgggaatccggcacctgggccctgaccacatggccgtggctgaccgattccactgggggcccatcgagaatgttgcggatgcggaacttcaacaccggccgtgacgtgcaggtagccacgtcggctgaggacgcagccgagtgcagccccgtttggtgcagggtgatgatttccggcagtgagggactggtccggatcgacctcatgcacccggacggctccgcccgccgtcgcatcgccggcgccgacgcctccgccgccgtcaccgacgtcgcgatcctcgaccgcttcgaaatcttgtcgcagaccattccgggatcagatgtcaccggcgtcgccgccctgcgggtgtacgacatcagcaccggcaccaccgtcgacatcagtcccgccgtcagcgccgcgttcacacgggccggggtgctgtggtggtccaccggcagcactgacaccgtcatgtggcacatcctggacctgcgtaccgtctga

SEQ ID NO: 2751 - DNA, 711 bp, Actinoplanes utahensis
atgtcccaggcggtgatcatgctgttgttcggcggcgcgatcaccagggccaccctgaccgacgtgttcctgcgctacgtcaaggagggcttgcggccattcctgctggtcgccggtatcttgctggtcgcggccgcggtcatgacgctgtggcacgagtggcggcctggcggtgacggccaccatgacgacgggcacggccatgggcagcatgagccggccgtcggctggctgctgattctgccggtcctggccatactgctgatctctcctccggcgctgggttcctacaccgccaagcaggcgggcagcgtcagcgtgcaaccggacaccacatcggactatccgccgctgcccgcgggggagccggtgacggtcaatctgctcgactacgcttcccgcgcgatcttcgacaaaggtaagagcctggccgggcgcaccgtgcggatgaccgggttcatcaccccggacgcggcaggcaagccgatgctgacccgcatcgtgctgatctgctgcgccgcggacggccagccgatcaaggtgggactcaccggcggcaccccgatcgacgcgcccgccgacacgtgggtcgagattatcggcgtctacagcacgcagaccggcacggacccggtgaacaaggcccccatcgcgtacgtcgaggtgaagagctggcagcaaatcgcacaacccaagcagccgtacgcatga

SEQ ID NO: 2752 - DNA, 1044 bp, Actinoplanes utahensis
gtgaccacgtctgacgttgacagtcacgagcacccccgaccgatgtccgagcctgccgggcaaagcgaggtcccgcagccgggccgccgtagggaggcagggatcggctcgctggaagtcctcgccggcctgctaatcgtgttggtgctggtgcgcgggaagctgtccggtctgctcaccgggccggggttgcagacctgggcgacggtgttcgtctcggtgctggtgcaggctgtcccgtttctggtgttcggggtggtgctgtctgcagtcatcgcggtgttcgtgccgcgaagtttctgggctcgggcgttgccgagtcatccggcgctggcagtgccggcggccggtgtggccggtgtgattctgccggggtgtgagtgtggcagtgtgccgatcgccgggtcgctgattcggcgcggggtcaccccggcggccgcgctggcgttcctgctcgcggcgccggcaatcaatccgatcgtgttgaccgcgacggtgatcgcgttcccggggaggccgcagatggccgtggctcgcggggtggccagccttgtcgtggcggttgcggtgggctggctgtggctgcggctgggcaagacggagtggatcaagttgccgcaccggccggacctcgacgacagctccaggtcgcgggcgttctgggcggcgtgccggcacgacatcatgcacgccggcgggttcctggtgctgggcgcggcggcggccgccactatcaatgtcgtcgttccggcctcgtggttgcagtcgttggccggtaatccggtggtttcggtgattgctttggcgactttggcggtgttgttgtcgatttgcagtgaggcggacgcgttcgtggcggcgtcgctgacgcagttctcgctgacctcgcggctggtgttcctggtggtcgggccgatggtggacttgaagttgatctcgatgcaggccggggttttcggccgccgcttcgcgttccggttcgcgccggccacgttcgttgcggcgatgctggtcggtaccggcttcggattggtgttgctgtga

SEQ ID NO: 2753 - DNA, 300 bp, Actinoplanes utahensis
atgaccgcgcggccggcggtcagcgagaccgccctgcaccgagcggcggcggcgatgcgcggcatggcttacgagcaccgcctgcatatcctggtcatactgcgcgacggcgaggcgaccccgacacagctggcggccgccctcgcggtgcacaccacagtcgtcgcgcatcacctgcgtcacctcgccgatgcgcgtctggtccgacgccggcggcggggccagcgggtgctctactcgctgcccgacgaggcgaccaaccgcctggtggccgaggtcctgcgctacgcccgcgaatga

SEQ ID NO: 2754 - DNA, 852 bp, Actinoplanes utahensis
atgagctggtgggctgacgccctgcaccgggcgaccgcagaggtgatcctggtcggcgcgctggccggcctgatcggggtgcaggtggtgctgcgccggctgtcgttcttcaccatggccctgacccacgccacgttccccggcgtggtcgcggcctccatcatcggagtcaacatcctggccggcggtgccgtggccggggcagccgtcgcgctcggcgtggcggcgctgaccagccgccgcggccaggacgccgcggccgccaccggggtcgtactgtcggccggcttcgctcttggcgccgcgctggtcgcaacccaaaacgggttcagccgcgacctgtccgcgttcctggtcggctcgatcctcaccgtcaccaccgcggacctgatcaccacactggtcgcgctcgtcgtcgtggcgcttgtcctggcggtgttcgcccgcccgctgctgctggtcggcttcgaccgcaccggcgctcaggcggctggcctgtcgaccgggacctgggacctggtattgctgctgagcatcgagctcgtcgtggtgacgctggtacccgcggccggcacgatcctggccttgtcgctgatcgtggcgcccgccgcggcggcccggctgtggaccgaccgcctaccggtgatgaccgtgctcgccgtcgggttcgccgccggcagcggactggccggactgtgggcctccggccggttcgacatcgccgccggcgcgagcatctcgcttaccgcaaccgccatcctgctgatctcctggacggccacccgcctgcgcccggccgcgcaacgagccaccgcccatcgtgccgggtccacgaaaccggtgcgggcatga

SEQ ID NO: 2755 - DNA, 891 bp, Actinoplanes utahensis
atgatcgaaccgttcgccgcaccgttcatggcccgcgctctcacggagatcgcgctgctggcgttgatctgcggaccggtcagtgtcttcgtgttcgcccgccggctgtcgttcgtctccgacgccctgacccacacgatcttccccggtgtggtcgtcgggttcctggccggcggcatcgaggggctgttcgccggtgcgctggtcgccggggtcgtcaccgcgctcgtgctgaccctgctgacccgcggcgggcggatctccgatgacgcggccacggccgtggtgctcaccgcgatgttctcgatcggggtggccctggtttcgcgccgagcgtcgtacaccgcggacctgacctcgtttctgttcggccggttgctgactgtctcgccgcggcagatcgccgagaccgcggtcttggtcgtcgtcgtgctggcggcgctgctgatcggcgcccgggcgctgctgtttcgcaccttcgacccggccggagccgccgcggcgggtttccgggtcggctggctcgacctggggctcaacatcctggtagcgctggtggtggtcgcggcggttcgggcggtcggcaccatcctcgtggtcgcgctgctgatcgtcccggcggcggccggtcgcatggtcaccgaccggctggtcgcgatggccatcctcggcaccgtgctggtcctgggtgccggctatggcggactgtggctgagctggaccgcctccatggactacggcgtgtccctgaccgccgcctcggccgtggtgctgctgctggtcgcggcgtactgcctgctgatccccgtccgctggatccgtgatcgccgccgtcggcgtcacgtgccccttccgaggcagaggagtgccgcgcatgagctggtgggctga

SEQ ID NO: 2756 - DNA, 861 bp, Actinoplanes utahensis
atgccctgtacggcgacagcctcggcgccgacggcaccccgcaaggcacctacctcggtgccgagcagcacaacacccaggtcatcgtctccgcgctggccggctgacatgaccgcggcattcacgtactcccaggtgagcatcggctaccagggcaccccggtgctcacccacgtcgacctgaccctcgcgcccggccagcgcctcgcgctggtcggcccgaacggggccggcaaatccaccctgatcaagtcgatgctcggcctggtccccgtgctgggcggtgccgtcaccgtgctcggcgacagcccggccgcggcccggggccgggccggatacgtgccgcagaccgacaccctcgacgccgacttcccggtcagcgtccggcaggtcgtcatgatgggccgctaccgtcggatcggctggtggcgcccggccggcagatacgaccggcaggcggtggccgacgccctcgagcaggtaggcctgcctgaccgggccgctcaccgcttcggcacgctctccggtgggcagcgccagcgggtgttgctcgcccgcgccatcgcggctgagccgcggctgctgctgctcgacgagcccttcaacggcgtcgacgcggtcagccaggacgcgatcgtgcgggtgctgcgcgagttgtctgcgggcggcgccgctctggtgttcagcacccacgacttgcaggtggcacgcgacctcgccgatcaggtctgtctgatcaacggccggcagtgggccgccggggcgcccgctaagacactgaccgccgacaacctgcgacgtacgtacgccgggagcgccatcgatctggccgacggccggatggtgctggtggaaccatga

SEQ ID NO: 2757 - DNA, 954 bp, Actinoplanes utahensis
atgacattcaggcaccccttgctttggctcgcgtccctgaccgccgcggcgaccgtcctggccggctgcggctccggcggcgacgccgcagctgccccggccggctccggcggcaagccgctgccggtcgtcgccaccacgccggaggtcaccgacttcgtccgcgccatcggcggcagcgacgtcaccgtcacccagatcatcaaggtcggcgtcgacccccacgagtacgagcccacgcccgccgacatccaggccatcagtgccgcgaaggtagtggtcaagaacggcgtcggcctcgagcggtggctggaccagaccatcgcgtcggccggcttcaccggggccgtggtcgactccagccacggcgtcgcgctgcgcaagggggacccgggcgacgcagagatggccgacggtgacccgcacatttggcacaacccgcaaaacgccaagatcatggtgaccaacatcgagaaggccctcgctgcggccgaccccgcccgcgccgagacgttcgccgagaacctcgccggctactgcgccaagctggacaagcttgacgccgacaaccaggccgccttcgccacgctgccccccgccgaccgcaaactggtcaccaaccacgacgcgttcggctactacgtcgaccgctaccagctgcagttcgtcggctcggtcatccccagcatggacacctccgccgaactgtcggcgcagcagctcaccgacctggtcgccaagatcaaagcgaccggcaccaaggcgatcttcacggagagctcgctgccgcccaagaccgccgaggccatcgccacgcagaccggcgtgaagatcgtcgccggacaggatgccctgtacggcgacagcctcggcgccgacggcaccccgcaaggcacctacctcggtgccgagcagcacaacacccaggtcatcgtctccgcgctggccggctga

SEQ ID NO: 2758 - DNA, 189 bp, Actinoplanes utahensis
atgccacgcatcaccacctgcgggtcgcgaccggtctcactgccggcgatcgccacggcaagttcggcgagcagcggggatcgccgcccgcgtgggccggctgccgagagcaccgcccaacgggttctggccgtcatcttggccgaggtcactgttgttgaaccggcagcgccgcaccgcccgcgttga

SEQ ID NO: 2759 - DNA, 1311 bp, Actinoplanes utahensis
atggctgctaccagcaacgggacggtgtttgcgcggtgtgcgtgccggtcggcagagacgggcaagcagttgggcgcccggtgtccgcgccttggtcaggtggggcacggccgctggtatatcgacgcgcacgtgcctggcgctgatggccggcagaagcggctgcgccggggcggattctcgtcgagggctgaagctgagcgggggctggccgaggttctggagttgccggggccggaggcgatggcggagacgtggacggtgaagcggtggctggagttctggctgtcgcagatcgaggaccgggtgcggccgtcgacggtgcgggcgtatcggtcggtgacgtaccggcatctggtcccgtggttgggccggtatcgggtggcggagctggacgggcgccgcggtgcgaagttggttcagcgggcggtcgatgggatcggccggcaggagaagcgcgacggtgacctggtggcggcgagcacggtgcaccgcgttgtcgcggtgctgcgcagtgcgttgagcgaggcgcgtcgccaaggcctggtgtcgtcgaacgcggcgtggcgattgcggctgccgaccggtgcccggccgcaggcggtggcgtggacgcgggagagggaggcgttgtggcgggctaccggggcccggccgagggtcgcggtgtgggacgtggagaacgtcgcgaagttcctggaagcggtcgagggtgatccgctgttcccgctgtggtggctggtcgcgctgcgcgggctgcgccgcggtgaggtggctgcgctgcgggccatggacctgaacgccgagtttcgggagctgagcgtcgagcggcagctgctgatcgtggatggcaaggtgcgcttggggccgccgaagtcggcggccggggtgcgggttttggcgttggacgagttcaccaaccagttgctgcgccagcaccgtgaccggcagcaagctcggttcgccggcactgaccggaatccgcgcagatacttattcacacacgcggacgggcggccggtccggccggactggctcacccaccgctttcacgcactggttgccgagttcgggttgccgccggtccggttccatgatctgcggcacggcgccgcgagtttggcgggtgcggcgggtgtcgagctgaaggtgattcagcatgatctcgggcattccagcgcggtgaccacggcggacacgtactggacagtgttccgggagttggccgatcgggcggtggctgcgacggcagggctactgcgcacgcacgctcggatccggctgaatctaggcgccgcttcgcaggcctga

SEQ ID NO: 2760 - DNA, 549 bp, Actinoplanes utahensis
gtgcgtgaagaggaacaggaagacctctcccggcgcgcggccgccggcgaccgggcggcactcgaatcgctgctcggcctgatccagccgtcggtgctgcggcgctgcgcccggttcctgccctgctaccaggacgccgaggaagcctgccaggacgtgctgatgcaggtcgcgcgcaacatcgccggtttcgagggccgctccaaattcagcacctggctgcacgtgatcatcgcaaacagctcccggcagacctaccggatgctcaagcggcgggccgccgaacagtcccacgacgagaccccgatcgacgtcgccgacccgcgcaccaccagcgtgatcgccggctcccggctcgacctgctggacgccctggaacgcctggagaaccgccgcgccgaactcgtcgcgccgatggtgctgcgggacatctgccagctcgactaccgggagatcgcggaacacctgggtattccggaaggaaccgtgaaatcccggatccaccaggcccgcagcgacgtgcgggggtttctgctggccggcctctga

SEQ ID NO: 2761 - DNA, 1320 bp, Actinoplanes utahensis
atgatcggtcgatatcgagtgacgcgccgtctcggctcgggcgcgttcgccaccgtatggctggccgaggacgacgtgctcgagtcgtacgtcgcgatcaaggtgctggcggagaactgggcgcaccatccggatgtgcgggcccgtttcgagcaggaggcgcaggtactgcgccgggccgattcggagcggctggtccgggtgcacgatttcggtgagcttgcggacggccggccgtatcaggtgatgacctatgccggtggtggcacgctcgccgaccggctggaggcgggcccgatgccgctgggcgccgcgctgcggaccgcggtggcgatcgccgacgcggtgaccgtcctgcaccattcgggcgtcctgcatcgcgacctgaagccgtccaatgtgctcttcgacacggtccggggtcacgagcgggtgctggtcgccgacctgggcctggccaaggagatcgcccaggcttcgggtttcaccgtggtggccggcactcccggttacatggcgccggagcagagccggcccggtggcggcctggacgtgcgcgccgacgtccacgcgatcggcgcgttgacgtatcagatgctgaccggcaggacgccgttggagggccgcggcgccgctccgtcccggctgcggccggggatcccgcggcaggtcgatcgggcggtgctgcgcgcgctcagcaccgaccgcgaccgccggttcccgtcggccgaggccttcgcctcggcgttggatctttccgggcggcgccgtccgctgcggtccttcgcccgattcgccggtacgtcgttggccctggccgccctcgcctgcaccaccgccgcgactctcccggacgccaccccgcccggttggacccgggtgggtgacgccgcccgtgcgatctccgtcgcggtgccgtcgtcgtgggcccaccagatgcgcgacagcggctgggatccggcgtcgctgggcctgcccgccgcgcactggcccggtctgcaggtcggcgccgacctgcgggacccggccgccatcactcccgcggtgctggccggcgccggtgactggacaggccggttggtcgccaccaccctgccccggcaccgggcctgcacggagcagccgccccgcccggtgtcggtcgacggcttgaccggccaggtgcgccgctggacgagctgctccggcaccgcggtgtcattcagcgaggtgttgctgaccgcccccggcggccgcggcgcctacctgcagatccgtcaggacggcccccgcgaccgcaccgacgagttgctccgcacgctgcgcgccgctcactcgtaa

SEQ ID NO: 2762 - DNA, 651 bp, Actinoplanes utahensis
atgcgacgcaccatcgccacgctgaccgcggtcgccgggctgtccctggccctgaccgggtgcacccggaagccggacgtcgtcagcggggaagcggcgccgatcggcggaatcgtctcggcgaccacgacgccgcctccggccgccgccgggagccccaccaccactacgcccaccaccaagccggccgtccgcgtcgtctcgaccggcaacaccgatccggcgccggccaagcggctcatcctcggtcccgacggcctgagcgccctgaagatcggcatgacggcgcaggacgccctggccaccgggatgatcgtcggatatcacgcgagtacggcgtgcaccacgtcccacctcaaaggccacgacgacgccgtcgtccagcactcgcccgggaaagggatcatcgcgatctccgcgtacggcgacatccgtactccggagggcatccacctcggcagcacactggaagaggtgatgaaggcgtacggcaaacgcttcaagcccagcgaagtcgacggcaccgtgcagagccggacgggacgcgcctgggcaacctccaccgacctggtcaactaccgcttcttcgtcaagaaggacaaggtcgtcgaactggaggtggagcacgcgcaccaggactgttacgagtga

SEQ ID NO: 2763 - DNA, 1047 bp, Actinoplanes utahensis
atgcaacgtacttccggaatcgccgcgctcgtggccctgaccacgctggccgccggcaccccggcgttcgcttcggagcggcgcccggctcgcgagatcaccgccgaggcggagaccgcggcgctgcacgacgacgaccccgggggcaacggcgacaccgacgacgcggctgtctgggtcgatccggcgaaccggaccggcagcctggtcatcggcaccgccaggaacggcggtctacgggtgtccgacctgaccgggcgcgaggtgcagtcgatcgccacgccggacggcggccggttcagcaacgtcgacatcgtctccggcttccgcctagccgggcagaaggtggacctggccgtcgtcaccgaccgcggactggaccggctgcgcgtctaccggatcggcgcgagcggcctcaccgatgtcacgtcggctgacgccccactgctgttctcccgagaccaggccgaggtccgggcgcaggcaaccggctacggcctggccacctacggccggtacgcggtggtcagccgccggcgcaccacccgcctcggcctcttccgcctggaagagcggcaaggccgggtcacctaccgcacctcagacaccctggacctgccgagctcgttccgcctcccggacggcggcacctggtcaccgtgcgcggaaccgggccagggcccgcagatcgagggcctggtcgtcgacgccgaggcgggcgtcctctatgccgctcaggaagatgtcgccctctggcggatccccctgaccggcggcacgttcagcagcattccgcggatcgtcccctccagcagcctgccgcgaaccgtcgccttcaggagcctcccccgaaccggcccgtccaggagcctcccctgggccctcgacgccgggaaaccatgcgacaccaccgcgtcggtatccctgccgggttacccgaagggtctcctggtcctcccccacggcgagaacatcacgaccaacgaccgcgccagcaccgacttcaagttcctcgactggcgcaacctgcagatcaccacgttctaa

SEQ ID NO: 2764 - DNA, 1539 bp, Actinoplanes utahensis
gtgagcactacgcggccgccgcccccggcatcccgctgctcgaacgcacctcgcaggcctgcatgcggaccgccttccagctgtacggcgggatcctggacgagatcgaggcggccgactacgacgtgttcgcccggcgggtcacggtgccgaaccggcgccgggccgcggtcgccgtccgcagcctgctcacccggcccggcaccccggtcgaactggcggcctgagatgggcgcccgcgtcgcgctgttcacccgcgacctgcggatccacgacaacccgctgctcagcgggcccgacccggtggtgccgctgttcgtcctcgacccacggctgagcggcctctcggccaaccgcagccgctttctccaccagagcctggccgacctgcggaacagtctccgcgagcgtggcgccgacctggtgatccgggagggcgacccggtggccgagaccatcgcggtcgcctccgaggtggacgcgtcgacgatcacggtggccgccgacgtgaccggttacgcccagcggcgcgagcggcggctgcgggacgagcgattccgggtgaagacggtgccgagcgtcacggtgctgccgcccggtacggtccggccgggcgggggaggcgagtcgtaccgcgtgttcacgccgtacttcaaagcctgggagaaagctgggtggcgcgcaccctccgcaacgccggggaaggtcgcgatgccggccggcatcgcgccgggaaggctccccgagatgcccgccggcgactcaccggacgccgtcgccggtggcgagaccgagggccgccgccggctccaggcctggcagaaagaaatggcgcggtacgccgaggaccacgacgacatggccgccgacaacaccagccggctcagcgcctacctccggttcggctgcctgtcgccgctcgaactggcgctggccgcgaaagccgacgactctcccggcgcccaggcctacctgcggcaactgtgctggcgggacttctactaccaggtcaccgcgaccttcccggagatctccacccggccgctgcgggagaaggcggaccagaactggcgatacgacgacgacgcgctgcgtcactggcaggacggcctgaccggggtgccgatcgtcgacgccggcatgcgccagctccgcgcggagggctggatgcacaaccgggcccggctgatcaccgccgcgttcctcaccaaacacctgggcatcgactggcggcccgggctgcaatggttcttccgctggctgctcgacggcgacgtgccgaacaactccggcaactggcagtggaccgccggcaccggcaacgacacccggccctatcgcaggttcaatcccattcgccaagcgcagcgattcgatgcgcagggcgtgtacgttcggcgctacgtaccggagttgaaagacatcgacggtgtcacggtgcatcagccgtggcgactgccggaatcggtacgccgcgggctcgactatcccggaccgttggagtcacatcgggacgaggcggtctggctgcgcgactga

SEQ ID NO: 2765 - DNA, 888 bp, Actinoplanes utahensis
atggaaaccgatctggccgccgcctatgagcggtgccgtgagctacaccgagagcacggacgcacgtactacctggcgacccggttactaccggcctggaagcgccggcatgtgcacgctctgtatggattcacccggttcgccgacgagatcgtcgaccgcaccgaggcgcaaccacccgccgagcgcgccgccgagctggccacctggtccgccggattcctcgccggactgcgcggcgagccggtcgacgacccgctgctcccggccgtgctgcacaccatcgcggtcttcgggctcgacctggaggacttcgcgaagttcctgcgcagcatggagatggacctcaccgtcaccggctaccgcacctacgacgacctgctcgactacatggagggctcggccgccgtgatcggcaccatgatgctgccgatcctgggctccaccgacccggccgccgcccgcgaaccggcccgccagctcggcttcgccttccagctcaccaacttcatccgggacgtcgccgaggacctcgcgcgggaccggatctacctgcccgaggagcacctcgccgagttcggtgtgacccgcgccgacctggccgccggcgtcgccaccccggcgatccgcgcgctcatccgggccgaggtggaccgcgcccgtgagcactacgcggccgccgcccccggcatcccgctgctcgaacgcacctcgcaggcctgcatgcggaccgccttccagctgtacggcgggatcctggacgagatcgaggcggccgactacgacgtgttcgcccggcgggtcacggtgccgaaccggcgccgggccgcggtcgccgtccgcagcctgctcacccggcccggcaccccggtcgaactggcggcctga

SEQ ID NO: 2766 - DNA, 1071 bp, Actinoplanes utahensis
gtggccaatgacaccctcgagggaaatcgccttgccgcgataccccggcagtccgtctctcacactgggctggtcggtgcagtcgaggggacgctcgccgacttcctcgcctcccagatcgcctctctcgacgccgtcgacccatcgctcggtggcttcggccgcaccgcccgtgacctggtgatggccggcggcaaacggctgcggccgacgttcgcgtactggggctggcgcggcgtcgccgggccggccgcggacgccgagacgctgctgcccgcgctcggcgcgctggagctgatgcacaccttcgcgctcgtccacgacgacgtgatggacgactcgtccacccgccgcggccggcccaccgcccaccggatcttcgcggcccagcacggcggccggttcggcacgtcggccgcgatcctggtcggcgacctctgcctggtctgggccgaccagctgttggcccgcaccccggtgccggcggccaccctgcttgcagtccgcgcgcattacgaccggatgcggatcgaggcggtcgccgggcagtatctggacgtcctcggtgagaccgatccggcgtcctggtcggtggagcgcgcactgctggtcgcccggcacaagaccgccagctacaccgtgcagcggccgctcgacttcggcctggccctggccggggtcgaggacgtggaggtcgccgaggcgtaccggacctacggcatcgccgtcggcgaggccttccagctgcgcgacgacctgctcggtgtctacggcgacccggcggtgaccggcaaaccggtcagcgacgacctgcgcaccggcaaaccgaccgcactgctgatgctggcccgtcggatggccacccccggccagctggccgagctggagtcggcggagatcgagcgcaaggcgcaggtcgtcgccgagaccggcgccccggcccgggtcgaggagatgatccgtgcccgggtcaccgaaggactgaccgcgctggcctcggcgccgatcgacgccgaggcccgtgccaccctgatcgagctggccaccgtggcgacgcagcgcccggcatga

SEQ ID NO: 2767 - DNA, 1515 bp, Actinoplanes utahensis
atgatgaaaccccccaccccctggagccgcggcgtgcgcactgttaccggacccaccgatcgtgtcgtgatagtgggggccggcctggccggcctctcctgcgccttgcacctggccgcagccgggcggcaggtcaccgtcgtcgagcgggagccggtgccgggcggccgcgccgggcgcctctcggtcggcggatacgacttcgacaccggcccgaccgtgctgaccatgccggaactgatcgccgagccgctcgccgcggtcggcgagaatctctccgactggctggagctgaccccgctcgacccggcctaccgggcgtactacccggacggctccacgctggacgtccgcaccgacaccacccggatggcggccgagatcgcccaggtctgcggcgcccgcgaggccgacggctacctgcggttcgtcgactacacccggcggctctggcagctggaacgggaccacttcatcgaccggaacctggacagtccgctcgacctgctcaacctcaacctgctgaagctgctcgggatgggcgctttcggtcgcctgcagccgaagatcaacgagttcttccgcgatccgcggacccagcggatcttctcgttccaggcgatgtacgccggtctcgccccgcacgacgcgatggccatctacgcggtgatcgcctacctcgactcggtcgccggggtgtactaccccaagggcggcatgcacgccgtccccaaggcgctggccggcgccgccgagaagcacggggtcaccttccgttacgacacgacggtcgagcgggtgctcacccagcacggccgggcgaccggggtggtgaccgtcggcggggacgtgatcgaggcggacaccgtcgtactcaatcccgacctgcccatcgcgtaccgcgacctgctgcctgcccggaacagccgcaacctgcgcttttcgccctcctgcgtggtactccacatcggatcgtcacagcggtattcgaagatcgcacaccacaacatccactttggtacgacgtggcgccgcaccttcgacgaagtgatcaaccgtgggctgctgatgagcgacccgtcactgctggtcaccaatcccacgcacaccgacccctctgccgcgcccgacggcaaacagacctactacgtgctggcgcccgccccgaacctcgtctccggtccgatgaactggcgcggcggcctcgccgaacggtatgccgacgagctgctgcgtaccctggagcagcgcggctacatcggcttccgggacggggtcgaggtcgaacggatcatcacgccggccgactgggccgacgacgggatggcggccggcacgccgttcgccgccgcgcacaccttcgcccagaccggcccgttccggccggcgaacctgcaccccacgctgccgaacgtggtcttcaccggttcgggcacacaacccggggtcggcgtgccgatggtgctcatctccgggaagctggccgcgagccggatcacacagggagcctcatga

SEQ ID NO: 2768 - DNA, 585 bp, Actinoplanes utahensis
atgagcagcatcggtcacctcaaccgtgaagatcatctcgtcgagctcgtcaacgaggaggggcagccgctcgggtcggccaccgtctccgacgcccacctctcgccgggtgcgctgcaccgggccttctcggtcttcctcaccgacgatgagggccgggtgctgctccagcagcgggccgcggccaaaacccgcttcccgctccgctggggcaacacctgctgcggccaccccgcgcccggcgagccggtcacggtcgccgcggcgcggcgtctcaccgaggaattggcggtacgtgacgtcacgctgaccgagatcggcgtgtacacctaccgcgcgaccgacccggtcaccggccgggtggagcacgaatacgaccacgtgctgatcggcgccctgccggacggcgtcgtgccacaccccgatccggcggagatcgccacgctgcgctgggcctcgctgcccgggctgcgcaccgggttgacggagtcccccgagctgtacgcgccctggctccccggggtgttcgagattctcacggagcggtcgggtgtcctttccacggagcggtcgggtggccggtga

SEQ ID NO: 2769 - DNA, 570 bp, Actinoplanes utahensis
gtgtcctttccacggagcggtcgggtggccggtgaggcgttgagcgccgagatccccacctcgccgggcagctcggtcgcctcctcgcacgacatcccggccacagccggtcccggcgccgtccggaccggcccggtggctgccgcgcccggtggcccgagcgatacgcccctgaccgacgcgacagctgccgcgtcgggtgccgcggacgacgcctcccgggcccgcccggcgaccgccacggacgacgcctcccgcaccggcccggcgaccgccgcgacggattctccggacgacgccgtccggaccggcgtggcagatgccgcgccggccgggcgggcgggcgatgtggcgttgagtgccggggcggccgcgcggcggctgggagtggcggtcacgaccctgcgcacctggcaccagcggtacgggctcgggccgagccggcacgagcccggacatcaccggcggtacaccgccgaggacatggaccggctgcaggtgatgcagcggctcaccactcagggcgtggcgcccgccgaggccgccgcctgggcgcggtccactagctag

SEQ ID NO: 2770 - DNA, 675 bp, Actinoplanes utahensis
gtggcgtcgccacccaccccggccgctcccgggacagccccccggtcggcccccgccggccggggcacccgcccgacccgcggaccggccccgaccgctcgcgggctgacccgggccgcgatgcggctcgacgtgcgcggcatgcgcgacatcctctgcagcacgctgcacgaccgcggcgtgatacccgcctggaccgaggtgatggtcccggctctggccgcgatcggcgaccggtacgaggccactcggcgtttcgtcgaggtcgaacacctgctgtcgcgcgccgtcaccgaaatcctcgcctcggtcccacaccccgccggctctccccgggtgctgctcgccgccgccgacgaggaacagcacacactgcccctggaggccctggccgccgccctggccgagggaggcgtgccgagccgtctgttcggcgcccgggtgccgtcacaggccctgctggacgccatcgcccgcaccggcccggctgccgtcgtgctctggtcgcagcgcccggccaccggcatcgtcacccagctgacccgggtccgcgacatcccgcacccgccgctggtcatcgccgccgccggccccggctggccgcatgacctgccttccgggatcacccgcctgaccggcctcaccgaggccgtccacctgctcgccacggtctag

SEQ ID NO: 2771 - DNA, 351 bp, Actinoplanes utahensis
gtgttagcggtatcggtccggttggcgaggaggcacagcgacgtgcagagcttcacgaacgaggccgagcagacggcttacaacctggccgaggctctggcggaaaaggcgatgaccttcatgagaaacgcggaggaggcggccgagacgttccggcgcgggcggattgcgatgcgccggcagttcatggcgcgcgggttgtccgaggcggaggcggacatcaggttcgccggcaccacgcaggcgtcccgggcgatcgcggacaacaccttcttcatgtcgcaggcgtcgatgtacaacacggccgccgcgacgcagtacgcgaaggcgttgtatctgaagaagcagtga

SEQ ID NO: 2772 - DNA, 522 bp, Actinoplanes utahensis
atgacctggctgtttcgcggccctctcgcccggcggccgatccgcggccgcccggaggcgggcggccggaccgctttcccggagtcgttcgccgccgagcgtggcttgacgattacgcgtacggtttggaacgtgaccgaagcaccacagcacgcgttcgacgacgccacgcagatcctgacctccgcgctcagcggtgacagcgatgccgtggccagcaccttcaacgccgtcgtcagccgggacggcgtcgtcggcgcgtgggacgtcgcgtggtgcctggccgccaccatggtcggccagctacccggcatcggcgcctggaccctggaattccctggtatcgacgatgcccgatacgataagcgttgggtcgcccgtttcgtcagcgcctacgtcaacggggacgccaacaccggcgaagccctcttcggcgccgcgatcgccgacggccagctgcccgactgcctgctcgccctggccggctccacggtcgcgacactgcgtcaccgggcggcctga

SEQ ID NO: 2773 - DNA, 399 bp, Actinoplanes utahensis
atgcagcacctcttcaccagcaacggaggcggtgcgcttgccgagcggatgggcatcgtgatcaccgaggccacggcggagcgggtggtcggcacgatgccggtcgagggcaacacccagccgtacggtctgctgcacggcggagcgtcctgcgtgctcgccgagaccctcgggtcggtcggcgcggtcctgcacgggcagacggtcgatcggccgttcgcggtcggcgtcgacatcaacgccacccaccacaaggcggcccgctccggcctggtgaccggcgtcgcggtgccggtgcaccgaggtcgcgccgtggccacctacgaggtggttctggaggacgaggccggcgagcgggtctgcaccgcccgcatcacgtgcctgctgcgcggcgcctga

SEQ ID NO: 2774 - DNA, 255 bp, Actinoplanes utahensis
atgagcgagccgcaggagatcgtcgagacccggggcgacgaccgcgtcgacctgatcaccagcgacgccaaccacgacgggaaggtggacgtctgggtgtcggacaccgacggcgacggcaagccggacctgttccagttcgacaccgacggcgacggcaaggtcgacgtgacgatggtcgacctggacgaggacggcacgccggacacgatcgtcgacggggacggcggcctgcccccggccggcaccgtctga

SEQ ID NO: 2775 - DNA, 969 bp, Actinoplanes utahensis
atgagtgaaccggtgcggcccggcgacacccggctcgacaccctcgtccgggtgcccgcgttctgggtggtgatcaccctgctcgccgccggcgcggtgcggatgtcgcaactcctggcccggttcctgcacctctacccgatcgccacgatcaccgcgctcggcctgttcgccctgctcgccgtcccgttctggatgttcgtccaggagctcgacttcctggaacgggaaccggccgggctgctcgccgtcgcgttcgcctggggcggtgtggtcgccaccagcgtctccatcccgggcagcaccgccctggagaacctgatcgccaaactcggctcacccggcctggccgccgactggggcgccgccctggccggccccacggtcgaggagatcgccaagacgctcggcgtggtggccatcgtgctgatcgcccgctcccaggtgaacagcgtgctggacggcgtcgtctacggcgcgctggtcgggctcggcttccagatcgtcgaggacatcgtcttcgcgatcggggcggtcgcgctggccgggcagggcgacgaggtgcggccggtgatcaccacgttcctggtccgtggattcctggccggggtctggagtcacaccctgttcggcgcgctggccggcgccggcatcggctatctggtggtgcacaccgaccgcagccggtcgcgccggctcacgatggccggcctggccctgttcggcgcgtgggcgtcacacgtgctgtggaactcgccgctgttccgcgacgggctcggcaacggcgcggtggcgttgctcgccgtgctcaccttcaaaggcctgccgccgctgctgctgatcctgttcctggtccgccgggcgcacgaccgcgaggcggagtattacgtcgcccggctcgccgggctcggcgaccccgaggtgatcaccgaggccgagttgcacgcgctcggttccggggcccgctag

SEQ ID NO: 2776 - DNA, 576 bp, Actinoplanes utahensis
atggggacggtcacgcggcgtcatctcaccgatctccccagcacacccggactgctcggcgcgatcgttctggtcgccctcctggcggcgctcgccttcggcctgccggcactcgaccacgccgtctcggcccagcgggccgtgccggccggtcagccgtaccgggtcggtgccggggtcaccgtggtgcccccgaccggcgccaccctggacgtcaccgggacccggccgggcgaggaccagggcaccgcgctgttccggctcggcccggtgcggtacgcgatcgccgtacaacccttctccggcaacctcacccaggccgccgtccgactccggcagcggatcaccggcaccgccggctaccagatcaccggcacccagctcgccgtctccaccgccggtgggctggccggtctgcagggcggatacaccgccggcgaccgcggcggccggtacgccgtcttcgtcgtgcacggcctgaccatcgaggtcaccgtcagcggcgccgacctcgacctggaccacacgctgccggccatcgacgccagcacccggaccgtgcgatacgaggggtga

SEQ ID NO: 2777 - DNA, 633 bp, Actinoplanes utahensis
atggcatctgaaatcggtcgaccggcaggaccacccgtactaccttgcggtcatggagcagaatcattgaccgaactcacccgtgaccaggtgcgtctcagtcgccggatgtccctggtgctgcggcaccggccggagacggccgggctgacgctggacccgcagggctgggtgccggtcgccgacttcctcgccgcgctggggatcagccgcgccgagctcgaccacgtggtcgccttcaacgacaagtcccggttcgcggtcgccgccggccccgacggggtggagcggatccgggccagccagggtcattcccgccgggtcgaggtcgacctggacctgccgccggccatcccgcccgcgacgctgttccacggcacgccgcgggccaacctcgacgcgatcctgcgggacgggctgcgcccgcgcacccggcaccacgtgcacctgtcggcggacgtgccgaccgccctggtggtgggccggcgccggtcgcccgacgtggtggtcttcgaggtggccgccggggtgatggccgccgcggggcacgtcttccaccgcagcgagaacggggtctggttgacctccgtcgtgcccccagtgcacctttcgctaaaacggacaaatccgtaa

SEQ ID NO: 2778 - DNA, 777 bp, Actinoplanes utahensis
atggagcagccgacgatcggcgacgccttcggcgagatgatcacagacgcgtacgcggtgcgaaccggcatcggcccccgccccctggccggtggccgcctgccccgcccggtgatcgaggtgatcgagcgggacgacggcctgatcaacggtgccccggccgaccactacctggacgagccggacgcctggcaaccgcacgaccaccgggccctgcgcctgtgccgcgggcacgtgctggacatcggggtgggcgccgcccggatcgcgctcgaactgcagcgccgcggcatggcggtgaccgggctggacacctcgcccggggcgatcgcggtggcccgcaagcgggggctgcgcgacaccgtgctgagcaccgtggaccgctacgccacggccaccgcgcgatacgacaccttcctgctgctcggcaacaacctgggcctgatcgaggggcccgagcgggcgccggccttcctggcggcgctgtcccgcctggcgaacccgggtgcgcggatcatcgcgcagggcgccgacccgtacggcaccaaggatccggtgcacgtcagctaccaccggcggaaccgggagcgcgggcggctcggcgggcagttgcggctgcggctgcgctaccggctggtggccaccgactggttcgactatctgaactgctccgttgacgagctcgacgcgctgctgcagggcaccggatggcatctgaaatcggtcgaccggcaggaccacccgtactaccttgcggtcatggagcagaatcattga

SEQ ID NO: 2779 - DNA, 210 bp, Actinoplanes utahensis
atggcatcgcgtacgcacgatcctgagccgctactaacgccggccgaggtggcgtcgatgttccgtgtcgacccgaagaccgtcacccggtgggcgaaggcgggcaagctcagcgctattcgcacgctcggcggccaccgtcgctaccgggagtcggaggttcgcgccctgctgcaggggcagattcccacgcagcggcagggtgactga

SEQ ID NO: 2780 - DNA, 840 bp, Actinoplanes utahensis
gtgccgtcactgttcgcgtcgtacctacgggtttacgagccactgaccgccttcgaccgggagcggcaggtcttctggcgccgctacgccaaggagggtcgcgacctggggccgatcgagggcccggtccggcagcgcaccgccgtcctggaggcgctcggcgccgggtggacccggctgcccgacctgcccgacgaggcgtatgtcctggagtgggagaacgctctgctgatctgcccgtggaacctgcggctgcgggtcgccgaggcggcactgagcgcccgcgacggcgttccggcggtgctggccgacgcgttcgtccccccggtgctggccggccaggccaaggcggtggtggaggactggcgcagcggcgcccgggtgctggagcagggcgttcctcgggtgcacgagcagatcgccacctggggggtcccactgcgctggttcgccttcgtcgacctggaggagcgggagatcgccctgaccggccggcggcgcaccctgcgttaccggaccgagatctccaaggctcgccggcgcgcgcatcgggcggtgtcggtgctgcgtaagtcgctcggcgacgccccgatcaccgaggcggtcgaggagggcacccggtggttggaggagttccacccccggtcggtggtcgagctggactacggcggcctggtcaacctccttccggaggacaagctgaccggtgacgattcccccggactggtggcggccgggctgtccgccctgtcccagggcgacgccgacgcggctggcgaggcgtacgagaagctggtcgctagatggcgaagtgtccaacttctggagcggtgcaactga

SEQ ID NO: 2781 - DNA, 1080 bp, Actinoplanes utahensis
atgggtgtgttcgacaccgacggcaccgacgccagcgggcacgaacaggtcgtcttctgccaggaccgggtctccggcctgaaggcgatcatcgggatctactcgacggccctcgggccggcgctcggcggcacacggttctacccgtacgagagcgaggaggccgccctcgccgacgtgctgcggctgtcccgcggcatggcgtacaagaacgcgctggccggcctggacctgggtggcggtaaagcggtcatctggggcgacccggccacggtcaagtccgaggcgctgctgcgtgcctacggccgcttcgtcgagtccctgcgcggccgctactacaccgcctgcgacgtcggcacgtacgtgccggacatggacgtgatcgcccgcgaaacccggtacgtcaccggccgcagcgtcgagcacggcggcgccggcgactcctcggtcctcaccgcctggggcgtcttccagggcatgcgggccgccgccgagcacacctggggcagccccacgctcgccggccgcacggtcggcgtggccggcctcggcaaggtcggcaagtatctggtcggccacctggtcgccgacggcgccaccgtggtggccaccgacgtgaacgaggcggccctgcagtgggcccgcaccacccaccccgaggttcacctggtcccggacaaccagacgctgatcacttcggatctcgacgtctacgccccctgcgcgctgggcggcgccctcaacgacgacacggtcccgctgctgcgcgcccgggtggtcaccggcgcggccaacaaccagctggcccaccccggcatcggcaagctgctcgacgaccgcggcatcctctacaccccggactacgtggtgaacgcgggcggcgtgatccaggtggccgacgagatcgagggcttcaacttcgagcgggccaagctgcgggcgaccgggatcttcgagaccacccggcggatcctgcagctggccgacgacgagggggtgccgcccgcggtggcggcggaccgcctcgccgagcggcggatggccgatgtcggccggctgcgctccatccacctcggctag

SEQ ID NO: 2782 - DNA, 219 bp, Actinoplanes utahensis
atggggcgcggccgtgctaaggccaagcagacgaaggtggcccgggagttgaagtaccactccccgaacaccgacctcaccgccttgcagcgcgaactggccggtagtacacgccagtccgatcatcatttcgacgacgacaatgaagagttcgtcgatgatgacgaggatgacgctgacgacgaccaggattcctggtcgcctccaaggcgtatttga

SEQ ID NO: 2783 - DNA, 228 bp, Actinoplanes utahensis
atgcccgagatcacgagcccacggccgtctgacgccgtggagacggatccggtgacggcacgggtgcatgacacccgggccggcctggccgcgctcatcgcggaggccgagacggcccgccggcaacgtgccgaggaggcgactcccgaaagcggctcggcggtgtgcgcctggaaccacttcgagaacattcccacgttctacaactggaacaaccggccgcggtga

SEQ ID NO: 2784 - DNA, 1125 bp, Actinoplanes utahensis
atggcggacgcgtggagcgggatgcggggcatctcgccggaacccggctatgtggtcatgcagccgactactctgtgcaacctggcctgcaattactgctatctgccgttccgccgggagaaccggaagatgccggtcgccgtcgccgaggcggtggcggccgaggtcgccggcttcgcccgggccggccggttctcggtggtctggcacggcggtgagccgctgaccgcgggagcggcccacctggcggccctgttcgcgccgttcggaccggatgtggagcaccacatccagaccaacgccacgctgatcgacgacgcctggtgcgagttcttcaaggctcacgacgtgcgggtgagcgtcagcgtcgacgggccgccggaccgtaacggtgaccgggtggaccgggccgggaaaccggcgtacgacctgatcgccaaggggatcgcggcgctgcgccggcacggcatcccgttctccgcgctgtgcgtggtggccgatccgcgcccgggcgtcgccaccgagctgtacgagtattttctcggcctgggctgcgaggtgctcggcatcaacgtggaggagcaggagggcgtcaacctccggcagaacagccacgacccggccgcggtcagcgcgttctgggcggagctggtcggcgcctggcgccgggagccgcggatccatctgcgcgaggtggagtggtcgctgcgctatgtggccgccgtgctcgacggcacggctgaccggctgctgccccgccggctcgacccgatcccgacgatcgcccacgacggctcggtggtgctgctctcgcccgaactggccgggttccacgacccgcgctacggcgatttcaccagtggcaacgtgctgaccaccccgctgcggcagatcctcgcggacgccgggcggacaccgtggatcggcgagttcctgcagggcgtggaggcgtgccggcagagctgcccgtatttcggtttctgcggcggcgcgcacgcggcgaaccgctacttcgaacacggcagattcgacgtcaccgagacgaaccactgccggaacagcaagattcgcctattggagggagtgctggaccatgcccgagatcacgagcccacggccgtctga

SEQ ID NO: 2785 - DNA, 1137 bp, Actinoplanes utahensis
gtgacgcacgtgtccgagcgcaatgccggatccgagggcgaccgacagctgtggaccgccggcgccggccggggcccgcgcaagcgcgccgcgacctacgcggacgcgggcgtctcgatccacgccggtgaccgtgccgtcgagctgctcaagtccaaggtgaagaagaccacccggcccgaggtgatgggtgacctgggaggcttctccggcctgttccggctgaacacggcgaagtacaagagcccgatcctggcctcgtccaccgacggcgtcggcaccaagctggtcatcgcgcagcagctggacatccacgacacgatcggcatcgacctggtcgccatggtcgtcgacgacctggtggcctgtggcgccgagccgctgttcctgctcgactacatcgcctgcggcgaggtcgtgccggacaagatcgccgagatcggcgccggtatcgccgacggctgccgctacgcggggtgcgccctgctcggtggcgagaccgccgagcacccgggtgtgctgcgccccgacgagtacgacgtctcggcgaccggtgtcggcgtggtcgaggagagcgagatcctcggcaaggagcgggtcgaggtgggcgacgcggtgatcgcgatgcgctcgtccggcctgcactcgaacggttactcgctggtccggcacgtgctgctgggcgccggccggatgcgcctggacaccgtggtcgacgacttcggcacctcgcgcacgctgggcgaggagctgctcaccccgaccaagatctacgccaaggactgcctgggcctgatcgaggagaccgacgtccgggcgttctcgcacgtgaccggcggcggcatccccggcaacctggtccgggtcctgcccgagcacgtggacgccgtggtggaccggtccacctggcgcccgcagccgatcttcgacctgatccaggccaagggccggatcgaggactcggagatggaggccaccttcaacatgggtgtcggcatgttcgcggtcgtctcggccgacgacgcggaccgcgcgatggcctatctggccggtcgcggtgtcgaggcctggcaggtcggcgaggtgctggagggcaccgggcaggtgcagatgatgggctcctacacccggggctga

SEQ ID NO: 2786 - DNA, 1575 bp, Actinoplanes utahensis
gtgccccgaggcgacggccgattgaccgacgatctcgacccccaggaacgcggcccccaggacgcctgtggtgtcttcggtgtctgggcccccgaggaagaggtcgccaaactcacgtacttcgggctctacgctctacagcaccggggccaggaggccgccggcatcgcggtgagcgacggctccggggtcgtggtctacaaggacgtcggcctggtctcccaggtcttcgacgagccgacgctggccagccttcgcggccacctcgcgatcggccacgcgcgctattccaccaccggtggcaacacctgggagaacgcgcagcccacgatccgggccacgacggccggcaccaccatcgcgctggcccacaacggcaacctggtgaacaccgccgagctggccaaggaggtcgccgaccgcggcctcgaggtcggtgacgccacctcggacaccatgctggtcaccacgctgctggccggccggccggacctgtcggtcgaggccgccgccatggaggtgctgcccaccctgcgcggggcgttcagcttcgtgttcatggacgagcacacgctgtacgccgcccgggacgcccagggcgtacgcccgctggtcctgggccggatggagaacggctgggtggtcgccagcgagaccgccgccctggacatcaccggcgccagcttcgtccgcgaggtcgagcccggcgagatcctggcgatcgacgagcacggcctgcgctccacccggttcgccgcgccggagcccaagggctgcctcttcgagtacgtgtatctcgcccgcccggacaccacgatcgccggtcgcaacatctacgccgcgcgcgtcgaggtgggccgcaagctggccaaggagcatccggccgaggccgacctggtgatcggtgtgccggagtcgggcatcccggcggcgatcggctacgccgaggcgtccggcatcccgtacagcgccggcttcatgaagaacgcgtatgtcggccgcaccttcatccagccctcgcagacgatccgtcagctgggcatccggctgaagctgaacccgctgcgcgaggtggtccggggcaagcggatcgtggtggtcgacgactcgatcgtgcggggcaacacccagcgcgcccagatccgcatgctgcgcgaggccggcgccctggaggtgcacgtccggatctcgtcgccgccggtgaagtggccgtgcttctacggcatcgacttcgccacccgtgccgagctgatcgcgaacggtctggagatcgacgggatccggcgctcgatcggcgccgacagcctgggctacgtctcgctggacggcctggtccagtccactgagcagccgaaatcccggctctgcatggcctgcttcgacggggagtacccgatcgagctgccggccgccgatctgatcggcaagcacgtgctggagggggtgagccgccgggcggaggcggtcgccgagctcgagaccgactacgaggcccgcgagcaccaggacgaccacccggcaccggcgccgctggtggccagcccgggcggcgccacggcgctgcaccacccgtga

SEQ ID NO: 2787 - DNA, 363 bp, Actinoplanes utahensis
atgtcgcctgcgcacaataattccgactcggtgtccaaggcgttggacgcgctggacgccgggacccagcctgaccgaacggtcctgcgtgacgcggtccgagcactgctgaccgagttgtccggacgcgcgcctggccgatcggtggaggtgcgaattccacctttcggcgctattcagtgcgtgcccggcccgcgccacacccgcggcacaccgcccaatgtggtcgagacggatccggtcacctggctgctggtggccaccggacgcctggcatgggcggaagcggtcgccgacggacgcctgcgggccagcggaatccgcaccgatctcagcgagttcctgccgctgaccccggaatga

SEQ ID NO: 2788 - DNA, 996 bp, Actinoplanes utahensis
gtgacaacgcacctacgaggccgggctgcccgggccggtgcgttcctggcactggtcgtgggcttgatggccggcgtgcagacggcggctctggcagccccgggcgacgccagtggcaacctcaccgtccaggggcaggccaactccggggaaagtgtaaccgttcagtacacggttagtaaccccggtaccggagcggtcaagttcaccgtcaaggctgccggtgccgactgcgcgccgtgccccaccgacaacgtcagcgccggcggcggaacgtcgaacacggcgaagctccagatgccgactgtcgcggcgggccagaccgcctcggtctcggtgacgctgaccgcagacgacggcaccggcccgaagacgatcgacggcccgaagaccatcacggtcaacggaccggccgcgccgaccaccacccggcaggtcgcgggcaagatcaaggacagcaccggcgccggactcgcgggcgccaacgtcggtctccaggacagcaagggtcaccagtaccagaccaccagcaacggtgacggcggcttctccttcacctcctcggacgccgcaccgatcgcgaccggctcgatcctgatcggcgccaagatgaagggttacaccggcgcgagcgcccgggtgaccggtactgccggcaaaagcgtctccgtcagcatcacgttgaagtcggcgaccgccgcctcggcgtcgccgaccgccaacgcgagcgccgcggccagccttccggccgatgacgccggcaccgacgacgcgaccaccgacgcggtcaccaacgcggccggcaccccggccgccgacgcctcgaagacctcgcacgacagcggcggcagctcctggctgctgatcgtgatgggcggcctgctggtcgccgcgggcgtcggcgcgatggtgctggtctggctgcgccgcaagaacgcggccaaggacgacggctcggacaccggcgtcggcctcggcggctcgggcggcaactag

SEQ ID NO: 2789 - DNA, 846 bp, Actinoplanes utahensis
atggtcgccggcgccgggatgggcgccggtcagggcatgggcggcggcggtctgggcgacgcgcccacgatgatccaccggccgccggtcgaggacgagttccccgacccgtacggcgcgccgatgcctccgcagggcggcttcgtcggctcgaacaacagccagtgggacaaccaggccggcggcggcaactacggcggcggcacggccgcggccggagccggagccggtggcaactacggcggcggcacggccgcggccggagccggtggcaactacggcggcgccaccagcgtgtacggcgcgcagcagggcggctacgacgacgccccgcagcagcgctacgacgagcggaccgggatgtatcagccggacaacggcgggtacgaggaccagggcggctacggcgtgcagggtggctgggacaaccacgccgacaacggcggcgggtacggccagcagccgcaggccggcggcacctacggcggcggcacctacggccagcagcagggcggctacgaccagggcggtcagcagcaggccgggtacgaccagggcggctacggccagccgggtggttacgaccagggtggctacggccagcagccgggcggcggctacgaccagggcggctacggccaggaacagcacgaccagggcagctacggccagcagcagggttacggccagcagcagggcggcaactacggcggccatcagggcggctacgagcagcagccgaccagcggctacggccagccgcagggccagcagccgcagggccagcgcggcggcacgtacggccagcaggacccgaaccgccgcaaccgcgagtgggacgagtga

SEQ ID NO: 2790 - DNA, 2394 bp, Actinoplanes utahensis
gtgaccacgcaggacaagaccggcttcgccgccaccgacgtcctggccgagggcttcgccgacggcccggacaccgtgcagaaggccgagcagacctccgacgacctgcagccgtacgccgagctcgggctcaaggacgacgagtacgcgaagatcaaggacatcctcggccggcgccccaccgcgtccgagctggcgatgtactcgatcatgtggagtgagcactgctcgtacaagtcgagcaaggtgcacctgcgcgagttcgtcgccaaggtcccgaagaacacccggatgctggccggcatcggcgagaacgccggcgtcgtgcaggtctccgacgacctggcggtcaccttcaaggtcgagtcgcacaaccaccccagctacgtcgagccctaccagggcgcggccaccggggtcggcggcatcgtgcgtgacatcctggcgatgggcgcccgcccgatcgcggtgatggacccgctgcgcttcggcgcccacgaccacccggacaccgcccgcgtgctgcccggcgtggtggccggcatcggtggctacggcaactgcctgggcctgccgaacatcggcggcgagatcgtcttcgacccgtgttaccagggcaacccgctggtcaacgcgctctccatcggcgtgctgccggtcgagcggctgcagaagaaggaggcgaccggcaccggcaacatcgtcgtgctgctgggcgcccggaccggtcgcgacggcatcggcggggtctccgtgctggcgtccgccaccttcgacgaggaggccgagcagcgccgcccgtcggtccaggtcggcgacccgttcatggagaaactgctgatcgagagctgcctggagctgtacgacgccggcctggtcaccggcatccaggacctcggcggcgccggcctgacctgcgcgctcaccgagaccgcggcggccgccggcaccggcatgcgggtctggctggaacgggtcccgctgcgcgaggcctcgatgtcgccgaccgagatcctggccagcgagtcgcaggagcggatgctcctgatcgtcaccccggagaacctcgacgcggtcctcaaggtcgccgagaagtggggcgtctgggccaccgcgatcggcgaggtcaccccgcgcgccgaggacggcaccccgggccggctgcacatcacgtggaacgaccacgtcgtggtggacgtgcccccggggtcgctcgccgacgacggcccgatctacgagcggccgctgcgcgagccgtccgacctgatcctgctgcaggcggaccgggccgagacgctgccccggcccaccaccggcgccgagctgcgcgaaaccgtgctgcggatggccgcctcgccgaacctgtgcgacaagacctgggtcaccgagcagtacgaccggtacgtgctgggcaacaccgtgctggcccagccggaggactcgggcgtgctgcggctcgacgagcagaccaacctcggcgtggcgctgtcggtcgacggcaacggccggttcgcccgcctcgacccgtacgagggcgccaagctcgcactcgccgaggcgtaccggaacgtcgcggtcaccggggccgagccgatcgcggtcaccgactgcctgaacttcggctcgcccgaggacccggcggtcatgtggcagttcgcccgggccgtgcagggcctggcggacggctgccagcagctgggcaccccggtgaccggcggcaacgtcagcttctacaaccagaccggcgccgcggcgatccaccccaccccggtggtcggtgtgatgggcctgttcgacgacgtcacccggcgcgtcccgatgggcttcaaggccgccggcgagctgctcttcctgctcggcgagacccgcgaggagctgtccggctccgagtgggcctgggtgacccacggccacctcggcgggcgtccgcccaaggtcgacctggcggccgagcagaccctgggcaggctgatggcccgcgtctcgcagaccgggctggtcagcgcggcgcacgacctctccgacggcggcctggcccaggtcctggtggagagctgcctgcgctacggcaccggtgcgtcggtgaccgtcgagtccgccttcgtcgggctgttcagcgagtcggccgcgcgcgtcctggtgtccgtgccgcagggccacgagaaggctttcgtggcgctcgccgccgagctgggcgtcccgtgcgccaagatcggcaccaccaccgaggccgcggccctggaggtgaccggacagttcacgattccgctggacgagctgcgggcggcctggtcgggcacgctgccgaagctgttcggcggggctgagccggccgccgagggccggtcggtgacgctggagctgaccgagccgaagccgggcgggccgctgtag

SEQ ID NO: 2791 - DNA, 702 bp, Actinoplanes utahensis
atgcggatcggtgtggtcaccttccctggatcactggacgacggggacgccgcccgcgccgcccggatcgccggcgccgaggccgtccgcctctggcacggggacccggatctgcacggggtggacgccgtggtcctgcccggcggcttttcctacggcgactatctgcgctgcggcgccatcgcgcgattcgctccggtcatggagtcgatcatcgacgcggcccgcggcggcctgcccgtgctgggcatctgcaacggtttccaggtcctgtgcgaggcgcacctgctgcccggcgcgttgacccgcaaccagcacctgcacttccgcaaccgggaccagtggctcaaggtcgaggccacgaacaccgcctggaccaacggcttccggccgggccaggagatcctcatcccggtcaagaacggcgagggctgcttcgtcgccgacccggccaccctcgacaggctcgaggccgaggggcgggtgatcgcgcggtacatcaacggcaacccgaacggttcgcagcgcgacatcgccgggatcaccaacgaggccggcaatgtcgtcggcatcatgccgcacccggaacacgccgtggaggcgctgaccggcccgtcgctggacggcctcggcttcttcacctccgtcctgcgggccctggcgggttcgtccgcgggcggctcgcaagggggacagcagtga

SEQ ID NO: 2792 - DNA, 252 bp, Actinoplanes utahensis
gtggctcgcgtcgtggtcgacgtcatgctcaagccggagatcctggatccgcagggtcaggcggtagcgaatgcgctgccgcggctcggcgtcaccgatgtctcctctgtccgcatcggccgtcggatcgagatcgaattcgatggcgaacccgacctggatcgggcccgtgagatcgccgacaagctgctcgccaacccggtgatcgaggactacacggtccgggtcgagagcgcggcggaggtcgcctga

SEQ ID NO: 2793 - DNA, 1422 bp, Actinoplanes utahensis
gtgaccatcccgaacgtgcttgccagccgctacgcctccgccgaactcgtcaccctctggtcgccggaggagaagatccggatggagcgccggctctggctggccgtcctgaaggcacagcgtgacctgggcgtcgcggtgcccgacggcgccgtcgaggcctacgagtcggtgctcgaccaggtcgacctggcctcgatcgcggcccgcgagcgggtcacccggcacgacgtgaaggcgcgcatcgaggagttctccgagctcgccggcttcgagcagatccacaagggaatgacctcccgcgacctcaccgagaacgtcgagcagctgcagatccgggcctcgctggagctgatccgggaccgggtggtggccgccctggcccgcctcgccgcgctcgccgtcgagcattccgacctggtgatcaccggccgctcgcacaacgtcgcggcgcaggccaccacgctgggcaagcgcttcgcctcggcgaccgaggagctgctcatcgcgtacgaacgcctggaagatcttctgggtcgttatccgctgcgcggcatcaagggcccggtcggcaccgccgccgaccagctcgacctgctcgacgggtcgtatgccgacttcgaacagctcgaggccaaggtcgccgagcacctcggcttcacccgggtgctcagcagcgtcggccaggtctacccgcgctcgctcgacttcgacgtggtctccgcgctggcccagatcgtggccgggccgtcctcactggccaccacgatccgcctgatggtcggccaggagctggtcaccgagggcttcaaaccgggccaggtcggctcgtcggcgatgccgcacaagatgaacacccgctcgtcggagcgggtcaacggcctcgccgtgatcgtccgcggttacctgtcgatggtcggcgagctggccggcgaccagtggaacgagggcgacgtctcctgctcggtggtccgccgggtcgccctgccggacgcgttcttcgccaccgacggcctgttccagacgttcctcacggtcctcgacgagttcggggcgtaccccgcggtgatcgcccgcgagctggaccggttcctgccgttcctgaccaccaccaagctgctggtcgcctcggtgcgcaagggggtcggccgggaggtcgcgcacgaggtgatcaaggagcacgcggtcggcgtggcgctggccatgcgggagaagggcgtggcggtcaacgacctcttcgaccggctcgccgacgacggccggctgcagctgtcccgtgccgagatcgacaccctggtcgccgaccgggcggcgttcgtgggcgccgcgccggctcaggtgcgcgcggtggccgaccgggtcgccgcgatcgtcgagcatcaccccgcggcggccggctacgcccccgcgcccatcctttga

SEQ ID NO: 2794 - DNA, 507 bp, Actinoplanes utahensis
atgccgccttttcgtgcagtctgccactctcaaacaaatgttggacggtcaaccgggccgtctcctaggctgtccaccatgtctttgggggatgcttcgctgcgtgcgctcgcccatccggtgcggttgcgcatcatgtcgctgctcaccggtgccgaactgaccgccgccgacgtcgcccgcgcgctcggcatcacccacgccaacgccagctaccacctgcgccacctgtccgccggcggcctgatcgcggccgccggcgaggagaagatccgcggcggcctggccaagcgataccggtgcacggcggcgcagcggctcaccacggacgtctgggtcgaccccgcggcctggcgtgccgcgcgggaccgcatcgccgaggccgtccggcacctgcgcgacgcggctgtcccgccgggcaccccgggcgcgatccgggccgtcgcggtgatcgagctggagccccagccgggcccgcccgatgagatgggagaatcggtgccgtga

SEQ ID NO: 2795 - DNA, 450 bp, Actinoplanes utahensis
atgactgaattcaaccccgagtcgctctcctcgatcggcccgaaggagttcgctcagctggtcaagtccaccccggatgccaggctcggcgaggtcatggcgtcggacgcgcgcggcaagatcctcgacgaggtcttcaaccggatgcccacgctgttccgcgcggagaaggccggcgacgcccaggccgtcatccactggatcatcaccgggccgaacggcctctccaacccgtacgagaccgtgatcgagaacggtcagtgcacggtcacgaacgagccggtccgcgacccgaagctggccatgaccatggacgccgtgacgttcctcaaggtcgtggcgggcgacggcaacccgatgatgctgttcatgaccggcaagatcaaggcgaagggcgacctgtcgctggccgccaacatcgccaagctgttcgacatccccaagggctga

SEQ ID NO: 2796 - DNA, 1251 bp, Actinoplanes utahensis
ttggccgtcgtgcgcgtacttctgatcggctccggtgggcgcgagcacgcgctcgccatcggcctggccgccgacccgtccgtcgagttcctggccgccgcgccgggcaaccccggcatcgcccaggtcgccgagatccatccggtgaccgctaccgatccggccgcggtcgcggcgctcgccaccgagctgagcgccgacctggtggtgatcgggccggaggcgccgctggtctccggggtcgccgacgcggtccgcgccaagggcatcgcctgtttcggcccgtccgccgccgccgcgcggctggagggttcgaaggcgttcgccaacgaggtgatggcggcggccggggtgccgaccgcgcgctcggcagcctgcgagtcggccgccgaggtgagcgcggcgctggacacgttcggtgccccttatgtcgtgaaaaatgatggtctggccgccggcaagggcgtcgtcgtcaccgacgaccgcgaggccgccgagcggcacgccgcggagtgcggcaaggtggtcatcgaggagttcctccccggtcccgaggtgtcactcttcgtcatcaccgacggcaccgcggtcgctccgctgatgccggcgcaggacttcaagcgcctgctcaacgacgacgagggcccgaacaccggtggcatgggtgcctacgcgcccctcgactgggccccggccgacctcaccgagcgtgtcctgcgggagacggtcgagccgaccctcgccgagatgcgccggcgcggcacgccgttcgccggactgctctacgtgggcctcgcgctcaccccggacggccccaaggtcatcgaattcaacgcgcgcttcggcgacccggagacgcaggtggtgctggccctgctggccaccccgctggccggtctgctgaccgccgccgccaccggcacgctggccgagcacccgccgctgacctggcacgacggcgcggcgatcacggtcgtcgtggcgagccacaactaccccggcacgccgcgcaccggcgatgtgatcaccggcgccgaggtccccggcgtgatccacgccggcacggcccgcaacgccgatggtgaccttgtctcggccggtggccgggtgctcagcgtgacggccaccggggtcgacctcgcggccgcccgcgaggcggcgtatgccctggtcgacggcgtcgcgctggacggcgcccagttccgcaccgacatcgcgctgcgcgcgctcaacggccagatcaagatctag

SEQ ID NO: 2797 - DNA, 1293 bp, Actinoplanes utahensis
gtgccggtgatcgtgttggtcggcgcccagtggggcgacgagggcaagggcaaagccacggacctgctgggcgaccggctcgactacgtggtgaagttcaacggcggtaacaacgcgggccacaccgtcgtcatcgacggcgagaagtacgcgctgcacctgctcccgagcgggatcctctccccgaacgtcgtgccggtgatcggtaacggtgtcgtcgtcgacctcaacgtgctgttccaggagatcgacggactggaagcccgcggcatcgacacctcccggctgcgggtcagcgccaacgcgcacgtgatcgcgtcgtacaaccgctcgctcgacaaggtctccgaacgcttcctcggcgcccgccggatcggcaccaccggccgcggcatcggccccacctacgccgacaagatgaaccgggtcggcatccgggtgcaggacctcttcgacgagtcgatcctgcggcagaaggtgaccgccgccctcgccttcaagaaccaggtcctgtcgaagatctacaaccgcagcgcggtcaaggccgaggacgtcgtccaggaactgctgtcctacgtcgaccggctccggccgtacgtcgcggacaccgccctggagctctcccaggccctggacgccggcaaggtcgtgctctgcgaggccggccaggccaccctgctcgacgtcgaccacggcacctacccgttcgtgaccagctcgaacgcgacctcgggcggtgcctgcaccggttccggcatcccgcccacccggatcgaccgggtggtcgccgtactcaaggcgttcaccagccgggtcggcgagggccccttccccaccgagctgcacgacaagtggggcgactacctgcgtgaggtcggtcacgaatacggcaccaccaccggccgcccccgccggatcggctggctcgacctggtcatcggccggtacgcgactcggatcaacggcgtcaccgacttcgcgatgaccaaactggacaactacgacggcctcgacgagatcccggtctgcgtggcgtacgacgtgaacggtgtccggcacgacgagatgccggtcaaccagaccgacttccaccacgccaagccgatctacgagacgctgcccggctggaaacaggacatctccggctgccgcaagttcgaggagcttccccgcgaggcgcaggacttcgtcgagttcgtcgaggcccggatcggcgcccggatctcgatcgtcggcgtcggcccgggccgcgaagcggtcatcgagcggcactcggtgctcggcgaggcgtag

SEQ ID NO: 2798 - DNA, 945 bp, Actinoplanes utahensis
atggtcgacgtcgtgctgctcagcctggccgagggatcaggcgactcgtgtggctccgggtgcggcggctgcaccgcggtctgcgccaccccgcgcaccccggtgctcgcctgcgccgacgtactgcggaacgccggcgccacggtggagaccgtgctcgccggctccgatcaggagatcgacgcggtgctggcccggttcgacggcccggcccggcccgacgggctgacctggccgtccctgaactcgccggcccgcctggtcatcgcggtcgccaccgacggccaactccgggcggtcgtacgccggatggtgcggcgctgggcaccggcccccagcaaacgccccgccgacctggaagccacccggaccgtgccggacctgccgccggtcgcgatcctgccgctcgacccgggcagcaccaccgatctggccgcccagctcggcctgccgcgcaccccggcggacgtggcgaacgccgtgctctccggtgccgtgcgccggctcgacctgctgcgcaacgacggcggctcggtgacgctcgacggagcgctgctcggcggcgccgacgacaacggcgcggcggtgccgtggcgcgggcgcgtcgaggtcgacgacagcgtgctcagcgagggcgaggaaccgatcctggcctgcgtgatcggcaacggcggcggctacgccgaattcgacgggctgcgactgctggccgagggcaaccctacggacggccgggtcgaggtggccgtggcggtgccggtggtggtgaaacagcggttccgcgggacccgggtgcgcgtcgaggtgcggcgggcccgcggccgggccgtctcggtgctgccccgggagggggaactgcagttcctcgacgacggggtggcggggtcgacgacccggaaacggtcctggtggaccgaggccggggcgtgggcggtgtacgcctag

SEQ ID NO: 2799 - DNA, 558 bp, Actinoplanes utahensis
atgccggacatggctggcgagatacgacgagcggggatcgccttggccggctgtaccgcggccctgctggccggctgtgccggcggcaccgccgagccgccggtggccggcccgctcgcctccccggtgccgatgtcacgcaccggttccatcccggccgacgccatgcggcccgccggtaccccgcagatcaacgaccggtggacgtcgtgcgcggcggcgttccccgcgacgtcgtcggtgccctcgtcgtaccggattccgcgctacgacccgtccttcacggcggtcagcgtcatcatgtgcgtcgacgcgggcggcggcaccgtgcgcgaacgccgcaccggcgacgtggggccggttcttgccgcgttgcaactgcccgacatcccgcccctggaccccgaccgctgcaccgccgacggcgagatccccatggaactggtcctgctcgatgcccgggggcgttgggtgcgtccgggggtacccgctgacgtggtctgcgcgaagaggcgtccggaggttcagcaggccctgcaccggagcggcctcgcctag

SEQ ID NO: 2800 - DNA, 423 bp, Actinoplanes utahensis
atgcagaacctccttcccgagccgccggccacccgactcccggccgacgccgaagccgaccaggccctcgccgccgccgcgaccgccggcaccgacgaggcgtccaaggcggtcgcggcgaaatacccggcctacagcgcggtctgggccccgctggccgccgccgccctcgccgccggcgagccggtgaccgcttatgcctatgcccgcaccggctaccaccggggcctggacgcactgcgccgcaacggctggaagggccacggcccggtgccctggtcgcacgagccgaaccagggcttcctccgctgcctgcacgtgctgtcccaggcggccgccgtgatcggcgaggccgacgaggccgcccgctgcgcccagttcctgcgcgacagcgacccggccgccgccgacgcgctctcctag

SEQ ID NO: 2801 - DNA, 990 bp, Actinoplanes utahensis
atgcgtgctgcgtcgggatcgatgttcgggctggcctacggcgatgccctgggcaagcccaccgagttcatggactactcggcgatcgtgtcccgatacggccccgcggggccgcgtcagttgcacggcgagccggccctggtcaccgacgacacccagatggcgctggcggtcggcgaggcgctgctggaggtgcgcgtccccaccccgggccggctggagccggtgctccgccgccgcttcatggcctgggcgtacagcccggagaacgaccgtgccccggggatgacgtgtctgcggtcgatcggcgcgctggccgacggccggccgtggatccaggccacccagaccggctccaagggctgcggggcgaacatgcgggtcaccccggtcggcctggttcccggcctgaccgacgaccagcgggcgggcatcgcccagttgcaggccgggatgacgcacgggcatccgaccgcgctcgcggcgagtgagctcacggcgtacgccgtccattggcttcgtggcggccttgcgccggcgcacctgctcggcgccctccgggaccgctgcgacgagcagcgcaagatctaccgcggcgagtggctcggtgagctgtggcggcggccgctggtcgactcgccggaggagttcatcgcccgcggctgggacgagtgtgcggccgccctggatgcggtcgcggccgggctcgcgaccggatcctccgagggcgatccgtgcctggtcaccggcgccggctggatcgccgaggaggcgctggccaccgcgctctactgctacctgatctcgccggacgagccggtcgcggtgctcggccgggccgccgcctcgtccggcgactccgactcgatcgcctgcctggccggcgcgttcgccggcgccgcgctcggcctcggcgcctggccggccggctggcagacgcagatcgagtacgcggaccgcctcctcaagctgggcaccacctgggactga

SEQ ID NO: 2802 - DNA, 1188 bp, Actinoplanes utahensis
atgccggatccgctacagccggtgctcggcggcgatgcgccgttcgacgccaccgagttcgagatcgagtctcgcgaggagctcgacacccacctcgtcaagaacaccctggccgggctgatcgttctcggtcttcgtctcgaccgcaatccccccgacctgtccactgtcgacgtgcgggacaccctgttcgtcgggtgccggctggtctcccccgaggtcgaggtcgacctgatccgccgcggcgcgcacatcgtgccgccgttcagcaccctgccctacccgacgcatccggcgctgctctacacccccgacgacctggccgccggattcgccgagggcggcttcgccgggatgtacgacaccgtcgtctaccggcatttcgtggcacgtggcggggcggtgccggacgtccgtgaggcgctggcgcagcggctgcacgacgccgggatcgacaatgcgctgggcaaggcgctgtccgcgtgggcggccacgcacggcacggccggcccggtggggatcatgggcggtcatgccgaggcgcgcgggtcgcaggcgtaccggatggccgcgacgctggcccggcggctggccaagggcgggcggctgatcgtcaccggcggtggcccgggcgtgatggaggcggccaatctgggagcgtatttcgcgtcccgcaccgagcgggagatggccgcggcgatcgacatgctggtgcccgcacccgacttccgtgaccacgacccgtacaccgcggcggcgctcggcgtccgggccacctacccgctgccggccgtcgacctcgccgaccggttgcggtacggcgggctggcactgccgacctggctctacggccacgagccggccaacctgttcgccgggcagatcggcaagtacttctccaacgccgtgcgggaggattcgatcctgcggctgtcccggggcggaatcgtcttcgcgcccggctgggccgggacggtgcaggaggtgttccaagcggcgaccaagacgttctaccgcaccgacgggccgtccggggcgttcgtcttcctcggcgccgaccactgggccaagctgccggtggtggacctgctgggcaccctgctggcccgttccccgcacggcgaccagtccggcctgatcctcgtcaccgactccctcgacgaggcgatgaccgccctcaccacctga

SEQ ID NO: 2803 - DNA, 165 bp, Actinoplanes utahensis
atgttcttcgttctcctccgcacggtcccgatgatcatcgtggtcgccaccctggccgtccggcgccgccgcaacagcggcgacccggattaccacggtccggcgtcgaccggctacgaaagcggcgcgacgcggttctacggcgccaccggcagcaacggctga

SEQ ID NO: 2804 - DNA, 516 bp, Actinoplanes utahensis
gtgctcactatcgagggctggaaacccgagtggcatcacgatgccgaagccctcgccgcgacgcatcgacatatgttcgtgcggctcatcggacgaaagttgcgatcaagctggctgctctgggatgtggcgcagcgaggctggttcgccgacggcccggtgatcctcgacttcggactcagtcgcgtagagatcacacaccgtaagttcgacgagtgcgcgatcacctgggagcagatcgacatgtcggtgccgatcgacatgtatgagcatttcgactggcgggccgacccgcacgccgcgctgcgccacgcccgaggtcgccagctgcgcgcggtcaacgcgatcgaacgcaccacgtcggcggactggcggcctcgggtactgcacgcgatcgagttcctcttcgacggggcgcgcctcgccatctacaacgcgatggacgagaacggcctcaccgacgtaccggaatcggatctccccccggtgcactggcgtcgcgtgcacatcgcctga

SEQ ID NO: 2805 - DNA, 1026 bp, Actinoplanes utahensis
atgcctatcgcttctcccgaggtctacgccgaaatgatcgatcgcgccaaggccggcgcgttcgcctacccggcgatcaacgtgacgtcctcgcagaccctcaacgcggccctgcagggcttcgccgaggccggcagcgatggcatcgtccagatctcgacgggcggcgcggagtacgcgtccggcccgacgatcaagaacatgatcaccggcgctgtcgcgctggccgagtacgcgaccgaggtcgccaagcactacccggtcaacatcgcgctgcacaccgaccactgccccaaggacaagctggacaagtacgtccgtccgctgatcgcgatttcccaggagcgcgtgaacaagggcctggccccgctgttccagtcgcacatgtgggacggctcggccgtgccgctggacgagaacctgcagatcgccgaggagctgctggcctccgccgcggccgccaagatcatcctggagatcgaggtcggcgtcgtcggtggcgaggaggacggcgtctccgccgcgatcgacgacaagctgtactcgaccgtcgaggacggcctggccaccgccgccaagctgggcctgggcgagcgtggccgctacctgaccgcgctgaccttcggcaacgtgcacggcgtctacaagccgggcaacgtcaagctccgcccggagatcctcaaggagatccaggacgcgatcggcgcgaagtacggcaaggagaagccgctcgacctggtcttccacggcggctccggctccctgctctcggagatccacggtgccctggacttcggcgtggtcaagatgaacatcgacaccgacacgcagtacgcgttcacccgtccggtggtcgaccacatcatgaagaactacgacggtgtgctgaagatcgacggcgaggtcggcaacaagaaggcgtacgacccgcgcgcctggggcaagctggccgagaacggtctggccaagcgcgtcgtcgaggcctgcgagcacctccgctcgaccggcaccacgctcgccaagtaa

SEQ ID NO: 2806 - DNA, 186 bp, Actinoplanes utahensis
atgatccgcctgacagaggaagccgacgtggaaacccccgaggtggacgccgccgagcaggcggtgatcgccgtcccctcctggcaggacgacgaacccgccggaacctggtcggtcaccgaggccaacgagtgggacgccgcggaacagcaccgcatcgtcgagttcgacgacgactaccgctga

SEQ ID NO: 2807 - DNA, 1362 bp, Actinoplanes utahensis
gtgctgctcaccgtgacgaccacccaccggcccgcgaccgacctgggctacctgctggtcaagcatcccgaccgggtccatgagttcgacatgcccaccggtacggcgtacgtcatgtatcccgaggccaccgacgcccggtgcaccgccgcgctgctgctggacgtcgatccacagcggctgcgcgcccgggccgacgccttcgagctgagtcagtatgtgaacgatcgcccctacgccgcctccagcctgctggccagcgccctgtccaaggtgttccgcaccgccctgcgcggcgtctccaaggaccgtccggaactggccgccgaggcgatcccgctggagatccacgtgccggtgctgcggggcagcgccgacctggtcacccgcctgttcgccccgctcggctgggcggtgaccgcctccgcgatcccgctggagccggagctcggcggcgacagccgctatgtcgacctgcgcctggccggcaccctgcggctcgcggacgcgctcaaccacctctacgtgctgctcccggttctggacgacggcaagcactactgggtcgccccggacgagatcgagaaactggtgcgctccggggccggttggctcgccacccacccggagcgggtgctgatcgcccggcgctacctggcgcaccgcaagtcgctggcgaccaccgcgctggacctgctcgacgccgaccagccggccaccgaggaggaggccgagctgccggtggcccgcaaggcgccgctggccgagcagcgccgggacgcggtgctcgcggcgctggccgaggccggggccagccgggtgctcgacctgggctgcggtcccggcgcgctgctcagcgccctgctcagggactcccggttcaccgagatcgtcggcgccgacgtctcctcccgggcgctcgatcaggcggcccgccggctgcggctggagcggatgccgcagcggcagcgcgaccggatcaagctcatccagaccgcgctgacgtatcacgacgatcgcctcaccggttacgacgcggccgtgctgatggaggtcatcgagcacgtcgacccgccccggctgcccgctctggaggccagcgtgttcggccgggcccgccccggcgcggtcgtcgtgaccacgccgaacgtggagtacaacgtgcactacgcgggtctttccggcatgcgccattcggaccaccggttcgagtggacccgcgcggagttcgcggcctgggccgcggacgtcgcggagcgccacggctacacggtgaccatccgcggcgtcggcgacccggacgagaccaccggggcgcccacccagctcgctctcttcacccggacggaggtgaccgcatga

SEQ ID NO: 2808 - DNA, 2493 bp, Actinoplanes utahensis
atgatcgacattcccgagctcagcctggtcgcgctcgtcggcatctccggatccggcaagtcgacgttcgcccgctcccacttcgcgtcgacccaggtgctctcctcggacttcttccgcgggctgatcgccgacgacgagaacgaccaggccgcctccgccgaggcgttcgacgcgctgcactacatcgccggcaagcggctggcggccggccggctcaccgtggtcgacgcgaccaacctgcagtcgcacggccgggccgccctgatcaagctggcccgcgagcacgacgtgctgccggtcgcgatcgtgctggacgtgcccgaggcgctcgcctgggagcgcacgcaggcccggccggaccggacgttcggccgccaggtcgtttcccggatgcaccgtgacctgcgacgctcgctcgggcagctggcccgcgaggggttccgcaaggtgcacgtgctgcgcggcccggaggagatcgcggccgccgagatccgctacgagaagctgttcaacgaccggcgcgacgagcacggcccgttcgacatcgtcggtgacgtgcacggctgccgcgccgagctggagacgctgctcggcaagctcggctgggagctgatccgggacgcggccggccgcccgatcgacgcgacacatccggccggccgcaccgccgtcttcgtcggtgacctggtcgaccgtgggcccgactcgcccggcgtgctgcgtctggtgatgggcatggtggcggccggccacgcgatctgtgtgccgggaaaccacgagcagaagctggcccgcaagctgaacgggcgcaacgtccagctcacccacggcctgcccgagacactggagcagctggccgccgagccggccgagttcgtcaccgaggtgcggaccttcatcgagagcctggtcagccactacgtgctggatgacggcaagctggtggtcgcgcacgccgggctgaaggaggcataccaggggcgggcctcgggccgggtgcgcagtttcgcgctctacggcgagacgaccggcgagaccgacgagtacggcctgccggtgcgctacccgtgggcgcaggagtaccgcgggtccgccgccgtcgtctacggccacgtgcccaccccgcgctcggagtggctcaacaacaccatctgcctggacaccggctgtgtcttcggcggtgccctgacggcgctgcgctggccggagcgcgagctggtcgacaccccggcggccaaggagtattacgcgccggtccggccgctgttcacggccgtcgccgaaccggaccgcgggctcgacatcgccgacgtcaccggccgcaagcacctcgattacgggtacgggcggaccaccgtcccggccgagaacgccgccgccgccctggaggtgatgggtcgcttctcggtcgatccggaaacgctgatctggctgccgccgacgatggcgccgtgctccagctcgaccgtcgagggttacctggagcacccgtcgtccgccttcgccgacctgcgcggggccggcgtcgaccgggtggtctgcgaggagaagcacatgggctcgcgggccgtggtccgggtctccgcatccggcaccggtgacgcgatctggacccggaccggtcgcccgttcttcgggccggagctcgaccagccgctgctggcccgggtgcgcgccgcgatcgagccggtcctggccgagctggagaccgagtggctgctgctcgacaccgagctgctgccctggtcggccaaggccggcagcctgatccgggagcagtacgccggggtcggcgcggccggccgggccgcgctgccggtcgccctggcggtggtcgaccaggtggccgggcgcggcctggacgtggccgccctgcgcgaccggctcgccctgcgctcctcggagatcgacggctactcggcggcctaccggtcgtacgtgaagccgaccgacgggctgaccggcgtcaccctcgccccgttcgcggtgctggccggcgccgggacgacctacgcgaccagggaccacggttggcacctggcgatcgccgaccgtctggtggccgccgatccggagctgttcaccccgacccggcggatggtggtcgacctggccgacccggcggctgaggcggccgccaccgactggtggctgaccctgaccggggccggcggcgagggcatggtggtgaagccgttcgccggtctcgccgcggtcgacggcaagggccggctggtgcagcccggcgtgaaatgccgcggccgggagtacctacggatcatctatggcccggagtacacccggcccgagcagctcacccggctgcggcagcgcaacctgggccggaaacggaacctggcgctgcgcgagcacgggctgggcctggcggcactcgaccggctggccgagggcgcgccgtcgtggcgggtgcacgagctggtcttcgccatcctggcggccgagtcggagccggtcgacccgcgtctatga

SEQ ID NO: 2809 - DNA, 822 bp, Actinoplanes utahensis
gtggacatccgtgcgctcaccgagcagctcgccctcaacccgttggacgcgagtcaactgctgcacaccttcggcctctacggggtgtgggccatcctcttcgcggagaccggcctgctgatcggcttcttcttccccggcgactcgctgctgttcctggcgggcatcgcggcttcgccggtggctgacgcgctgttcggcgacggcacccggatctcgctggccggcctgctgatcggcgccccgatctgcgcgatcgccggtgcgcagttcgggcactacctcggcgcgcggtacggccgccggatgttcgagcgtcccgactcgaagctgttcaagcgcgagtacgtggacaaggcggagcactacttccagaagttcgggccggccaaggcggtggtgctggcccggttcatccccgtggtgcggacattcctcaacccggtggccggcacccttggcatgccggcccggcagttcctgctgtggaacgtggtcggcggcgtgatctggaccgacggtgtgctgctgatcggctacgcgctggccaagcagatctaccacgcggtcggcgacaagatcgaccactacatcctgccggtcgtcgtgatcatcgtgctgatctcggcgctaccgatcttcatcgagatcctccgcgagcggaaggcgaagaagaacggcacgcacaccggcccgcagccggccgccgcggtcggcgtcgtcgccgcggccagcatcgccggcctcgccgaggcggcccacctgcgcgacgaggacgacgacgaggatcgcccgcgccggccgcgttcgcaccgcgcctga

SEQ ID NO: 2810 - DNA, 675 bp, Actinoplanes utahensis
gtgaactacgtgcccggtgacctgcgtgatcagctcgcgcacgtgggttacgacgtggtccaggcgggtctggtctgtggatccggcggcaatctgtccgcacggattccggacgaggacgccatctggatcaccgcgagcggtacctggctcgaccggctcagccggcccagcttcgtgccggtcgacatcaccgacggtgaggtcgtggcgatcggcaacatgccgccgccgcggatcgagccgaccagcgagcttgcgctgcatctcgctctgtaccgggcccgcccggacgtcaacgccgtggtgcacctgcatccgcagacggcgttgctgctcgacgcgctcggcgagcacatccggatcgtcaccacggaccacgcgttctatctgcgccgagtgtccaccgtgccgttccggctccccggcaccaccgagctggccgcgctgaccgcggccatggccgctgacgggaccgactgcctggtgctcagccagcacggttgcgtcgtgatgggcgactcggtggagttggcgcacaaacgtgcccgcaacctggaggaggcggccacgctgacataccgcgctctcgccgccggccgcctggagaatctccgggactgcccggaggcattcctggaccggctcgccggctccgccgcggtcactgtctga

SEQ ID NO: 2811 - DNA, 378 bp, Actinoplanes utahensis
atggagatcgtgggaactgcgttggcggaaatgacgatgcctcagatctcgccgcttgccggcgagcctattgaacgcgccgacgccgagcgcctggcgggagtgctcaaggcgctcgccgacccggcacggctgcggctgctgagccttatccagtcagcgacggacggtgaggcgtgtgtctgtgacctgacggctccgctgggcctttcgcagccgactgtgagtcaccacctgcggatcctgaccgaggcgggtctgctggagcgcgagaagcggggggtgtgggcgtactaccgcctcgtgccgaccgccatcgcgaccatcgccgaccttctgacgccgccccgcaagcgggcgacgaagaaggctcgctga

SEQ ID NO: 2812 - DNA, 102 bp, Actinoplanes utahensis
ttgtccgtccaggcgaaaacacccaccggacggccgatctactgctatccggacagccgatcgggtgacagtgaaggaaaccgtctgtacccgttcgagtga

SEQ ID NO: 2813 - DNA, 1758 bp, Actinoplanes utahensis
atgtcctattccgcccagccgcccgtcaccgcagcgccgccgccgccgtccaccggcgcgcggccgcccgccgtgacgaccgcctccaccctcttgtggctgatgggcgcggccggactgctctatgccatcgccacgatcgtcgtcgccaccggcacggtcagccggttccgggacgccgcctccggcgacgccgcggacaacttcgtcaccgtcgtctggctgggcgccgccctgtccgcggtgctgtcgatcctgttcttcgccctgttcgtggtcctcggcctggccctgcgccggggcagccgggccgcccggatcgtcgcgctggtcgtctgcaccctgggcacgctcggcggcgtcgccggcctcatcaccgccgtcgtccagcgctccggcgacccggcgccgggttcgctcagcgacgccctgggctcggcctacccggagggctggctcggcctcaacatcgtcgtctgcgccctgcaggccctcggctacctcgccgtcggggcgatgctcctcgcctccccgcgcgccttcttcggcctggcccccagccgcccggccagcccgcccggcacgcacccgagcgcgttcccgcagcccggacccggcacgcaccccggcgtgttgccccagcccgcgcccggcgcctacccgggcgcattcccccagtccgtgcccggcgtccagccgggttccggcgcttattccgcgcccaccgcctacccgctgcctggcgaccatcccggatccagtgcttttcccgtgtccggcgtctatccgggatcaggcggatatccagggtccggcgacgcctacccggggccgggtgcttacccggggtccggcgcctacccggggccgggtgcttatccggggtccggcgcctacccggggccgggtgcttacccgggctccagcgcctatcccgggctcggtgcgtacgtcgcacagccgggggattccgaggctcaggctggtgcgctcccgcagcagccgggcggtgcgccgatgaccccttcgccttacgctccgcacctttctccgtacggtccggccggtcctcccggcttcacgccgcccgtgccgccttcggtggatcactccgcctacatgcccccggccgcgtctccgtccggatatccgcccatcggtggcgtcccgacccagtcggccgctgcagtgtcgtcagcgtccccggccccggaagccccggcagcgccggctcaggcagcgccggctccggcagcttcggctccggcagccccggcagccccggcagccccggcagccccggctccgtcgtctgcgaccgccgatcccaccgcgcatccggccgagccggccccggagacgcccgatgctcttccgggctcggctcgaccgtcgggggcagcggacggatctcaggccccggccggctcggcggcgggaaccttcgatggctctcgggcccccgccgggccgggtgacgggccgttcgcatcggtcgggttcccgacggtggcgggtgtcgatggtggcgcggcgggtgactcgggtacttccggcggggtcgcaaaaggggcttccggggagggcgagcgatcgtcggacagcgtcacgcaccgttcgaacgcttcctcaaacgtgagtccggttacgcagcgtgggcaaggacacatcggagactccgctcgcccgggtgatcctggggcgaaccgccccgcgcctggatctgatgacgaatactggcgccgaccggaagagtga

SEQ ID NO: 2814 - DNA, 1626 bp, Actinoplanes utahensis
gtgaccgttcccacataccccccgtcctatccagcggcgccgccaccgccagggggtcgcccggccaccgtgaccgtcgcgtcggtgctgctgttcatcgtcgcggtcctccaggtggggtacgcgatcctcgccttctccgcgctcaacaaggccggcgacgtctacgacgaggaatacggcagtaccgacttccaggacatcggcaccggcatcaccacgatcggcgtcttgctgatcatcgtctatctgatcctggcgatcgggctgggcctgctcggcttcttcaacctgcgcggcaaacagccggcccgggtgatcacctgggtcaccgccggtgtgctgatgtgctgctcagtcgtcgtaccgtcgaccatgaccgccctggtcaccgacttcgcctcggtggtgcacgactcgaacgggaccagcgggctgcccagccagcacgaactcgacacccggctggccggggtggtgccggactggttcgacaccttcgggctgttcttcacgctgttcgcgctggccgccctgatcgcggtggtgatcctgctctcggtgccgccgtccaaccggttcttccgggggatgaccggcgggtggagtccgtaccagccgggatatccggcggggtatccgcaggcgggggcggggtatccgcagcagccggcttacgggcagccgtatccggggggttacgggcagcccggggcgggttgggctggtggctatgggcagcctggcgcgggttcggctggtggctatgggcagcccggatcgcccgggcagcccggcgcctttggtcagccgggacatggcgcatccgcgcagccggggttcgggcagcctgggcagcccgctcccggactgccgccctatccggggcagcctgccgcgtacccgccgccggtcagcggtcccggcgcctatccggcgccgacgagcggtcccggcgcctaccgggtgccgacgagcggaccgggtgcctacccgccgcccggatactcgcccgcgggccctggcggctcggcgacgccgtatgcgtcgccgagtgccgcagcgggctcgccgccgccgtcggatccgttggcggagttcgggccgcccagcgatccctggcagttgccgccgtcaccgcctgtcccgccgtcgccgtcgccgtcgccgtccgtcccgccaccgccgtccgattcgtcgacgcacagcccgttgccgtccggctcgtcgccggatgctgactcgtcggccggttgggcgccgtccgacaccggtgatgcgccttcagcggtgtcctcagattcggctcacgattcgtctccctcgtccgctccctcttcggcctcttcggcctcttcggcctcttcggcctcttcggcctcttcggccgcgtcctcctccgactccgggtcgtcctcgggctcgtcgccctccggtggatcccactcctctccttcagccgccggcgaccggttgccgccggcctcctcagccgccggcgaccggttgccgccggcctcctcagccgccggcgaccagttgccgccggcttcctcagccgccggcgaccagttgccgccggcttcctcggccgacggccagcggccgccgcacgacccggcctga

SEQ ID NO: 2815 - DNA, 177 bp, Actinoplanes utahensis
atgccgcacgcagacaccctgaccgtcgttcaccatgacgacacccggacccgtttcgaggatgtccggtatcaactccatcgtgacgggatcaggatctggtccgctgacggcgaacacgccttctcggacattctgatgacccacgcctaccgacaccagaaaaccgcttcatag

SEQ ID NO: 2816 - DNA, 2586 bp, Actinoplanes utahensis
atgaacgccgaacgtctgaccacgaagagccgcgacgtgatcaagagcgcggtggccaccgccgcgcagagcggccacgccacggtggagccgtggcacatgctgctgtcactgctggacaccgccggttcgacggcgccggcgctgctgcgcgccgtcggcgccaacccggccgacgtccgccgggccgccgcccgcgccgtcgagcagctgcccagcgcccgcggtgccagcaccgccgagcccagcctgtcccgggagttcgtcaacgcgatcggtgaggccgagctgatcgcccagccgctcggcgacgaatacgtctcgaccgagcacctgctggccggcctggcccgcggcggcggcgcggtcagccagaccctcaaagcggccggcgccgccgaggacgcgctggtggcggcatttccgcaggtccgcgggggcgatcggaaggtgaccaacgccgacccggagcagacctacaaggcgctggagaagtacagcgtcgacctgaccgcgctggcccgcgagggcaagatcgacccggtgatcgggcgggacgccgagatccgccgggtggtccaggtgctctcccggcgcaccaagaacaatccggtgctgatcggtgagccgggcgtcggcaagaccgcgatcgtcgagggcctcgcccagcggatcgtggccggcgacgtaccggaaactctgcgcgacaagaaactggtctccctcgacctgggcgccatggtcgccggcgcgcagtaccggggccagttcgaggagcggctcaagagcgtgctcgaggagatccgcgggtcgaacgggcaggtcgtcacgttcctcgacgagctgcacacggtggtcggcgccggcaagggcgagggttcgatggacgccggcaacatgctcaagccgatgctggcccgcggtgagctgcggatggtcggcgccaccacgctggacgagtaccgcgagcacatcgagaaggacccggccctggagcggcgcttccagccggtcgtggtcggcgagcccaccgtcgaggacaccatcggcatcctgcgcgggctcaagagccggtacgaggcgcaccaccgggtgcagatcaccgacgccgccctggtcgccgcggccagcctgtccgaccgctacatcagcgaccggttcctgccggacaaggcgatcgacctgatcgacgaggccgcctcccggctgcgcatggagatcgactcgcggccggtcgagctggaccagctgcagcgtcaggtggaccggatgcgggtggagaagctcgccctcgaacgcgagaccgacccggcctcagtggcccggctggagcggctcgaccgcgacctcgccgaccgcgaggaggagctgaccgcgctgaacgcccgctgggaacgcgagcgcggcggcctgaaccgggtcggcgagctgaagaagcagctcgacgaggcgcgggcggcgcaggagcgggcccagcgcgacggcgacctgctgcaggcgtcccggctgctctacgaggtcatcccgggcctggagcgggagctggcgaccgcggccgagtcggaggaggagacgaccgagccgccgatggtcaaggaggaggtcggcgccgacgacatcgccgaggtgatctcctcgtggaccggcatcccggccggccggatgatggagggcgagaccgccaagctgctccgcatggaggagtcgctgcaggccaaggtcatcggccagcgcgaggccgtggccgcggtggccggcgcggtccgccgggcgcgggccggcatcgccgacccggaccgccccaccggcagcttcctgttcctcggcccgaccggtgtcggcaagaccgagctggccaaggcgctggccggcttcctgttcgacgacgagcgggcgatggtccggatcgacatgagtgagtacgcggagaagcactccgtggctcgtctcgtcggcgccccgcccggctacgtcggatacgaggagggtggccagctgaccgaggcggtgcgccgccggccgtacagcgtcgtcctgctcgacgaggtggagaaggcccacccggacgtgttcgacgtgctgctgcaggtgctcgacgacgggcggctcaccgacgggcagggacgcacggtcgacttccgcaacgcgatcctggtgctgacctcgaacctgggctcggccaactcggacttcacgatgagcgacgaggagcggcacgacgaggtgctcgccgcggtgcgggcgcacttcaagccggaattcctgaaccggctcgacgacatcgtggtgttccacgccctgaccagggacgacctgatcaggatcgtcgacatccagctggcccggctgcgggcccggctcgctgagcggcggctcaccctgtcggtggccgaggatgcggtggactggctgggcgagcacgggtacgacccgatctacggagcccggccgctgcggcggctggtccaggcgacgatcggggacctgctggccaaggccctgctcgccggtgagatccgggacggggacaccgtgcaggtggcgttgaactcggcgaaggacgggctggcggtccagcgcggctga

SEQ ID NO: 2817 - DNA, 1239 bp, Actinoplanes utahensis
gtgacgcgcctcctgtcgcggcggctggtcccgctcggcttcatgtttctcgcctccgggatcgcgaccgcggtggtcggcccgttcctcggcctgttcctcagcaccgcggtgcacgccaacccgttccaggtctccgcgttcctgatcgtcgcgtcactctccggcgtcggcatgtcgcagttcatcgcccgcgtctcggaccgccggccgatgcggcggatgctgctgatcaccgccgccctggccggcttcgccggcaccgggctgacctcgatggtgcgcgactactgggtgctgctcgcgatcaccatgacggtcaccgcactggccgggtccttctacccccaatctttcgcgtacgcccgtcaggtgctcgcccgcgaagacccccgccgcgccgcgatggggatcagctcgctgcgcaccgtcttctcgatcgcctgggtcggtggcccacctctggccgcggtcctgctcgacgtcggctcgttccgctgggtgtacggcaccgccgccgtgatgtacctggtggccgccctgatcgcgacccgctggctgccggaggcggaggcgcccgccccggccgggcagagcagccgggacgacacccgcccaccgcgcgtgatgtatccgatcatcgccgggttcgtgctgctcaccacgacgatggtgctcggcgtgcaggccatgtcgctgtacgtcaccgacgacctgcacggctcggtcggtgacaccggcctgatcctcgggctgtgcgccgcgctggagatcccgctgatgctgggcttcggtgcgctgagcacccgggttccgctgcgccggctgatcctcggcggcggcgtggccgcggtggcctaccagacggtggccgccaccgcgcactccaccgggatgttggccaccgcccaggtgctgaacgcggtcttcatcgccacctgctccgggctgggcatctcctacgtccaggatctgatgccggcgcatccgggccgggccaccacgatgttcaccaacgccttcccgatcgggaacatcctggccgcgcccctgttcgggttggcccaggaattcggctaccgactcgcgtacaccatgaatttgatcttgacggtgctcggtctgctcctgcttctggtggcgaagccgccggcagaaatcgcgaggccgcgggcggcggacaaagcggagagggaagcggagccgatcgggcccgaggccgcggccgaagcgggataa

SEQ ID NO: 2818 - DNA, 507 bp, Actinoplanes utahensis
gtggggctcgtgcgcgtacgggtggaacagacctcactgccgggtatcggtgtccgacacgacctggtcacctcctccggccgcaccgtcggagtggtctcgcaccgcaacggccgccgtgacctggtcctctacgacgtcgacgacccggatgcctgcctcgcctcgatcccgctgaccgacgacgaggcggaggcgctggccgacgtgctcggcgcgtcgctgatgctcagccagttggccgggctgcgccagcaggcggccgggctgctcaccgagcagatcgcactgccggccggttcgccgttcgtcggccggcagctcggcgacacccgcgcccgcacccgcaccagcgcgtcgatcgtggcggtgctccgcgatcgcgaggtgatcccgtcgcccggcccggccttccagttcgaggcgaacgacgtggtcgtcgccgtcggcacccggcacgggctggacggcgtgacggccatcctggccggcgacaccaccggctga

SEQ ID NO: 2819 - DNA, 1209 bp, Actinoplanes utahensis
gtgcaccacaccacggtcctgctgatcgagatcggcgcgctgctgttcggcctcgggatgctgggccgggccggccgccggttcggtctctccccgatcccgctctatctgctggccggcctgttcttcgggcacggcggcctggtgccgctctcggcgagcgaggagttcatcgggatcggcgcgcagatcggggtgatcctgctcctggtcatgctgggtctggagtactccgccgacgaactggtcggcaacctgcgctcggcggccccggccggggtgatcgacatgctgctgaacgcgctgcccggcgccctgttcgcgctgctgctcggctgggacgcgaaggcggcgctggtgctggccggcatcacctgggtgtcgtcgtccggggtgatcgccaaggtgctcgccgatctgggccggctcggcaaccgggagaccccggtgatcctctcggtgctggtgatcgaggacctggcgatggcgttctacctgccgatcgccaccgcggtgctggccggcgcggggctggccggcgggctcagcacgctcggggtcgcggtggtcaccgtggtcgcggtgctggtcgtggcgatccgctacggcggcgcgatcagccggttcatgtcggtgaaggatccggaggccctgctgctcagcgtgctgggcctgaccctgttcgtggccggggtggccgccgagctgaaggtttccgaggcggtcggcgcgttcctggtcgggatcgcgctctccggtccggtcgcgcaccacgccaccgagatgctgtcgccgctgcgggatctgttcgccgcggtcttcttcgtcttcttcgggctggccaccgacccgtccgacatgccgccggtgctgctcccggcgctcggcctggccgtgctcaccatgctgaccaaggccgccaccggttatctggcggcccgccgggtcggcgtggcgctgcccgggcggctgcgggccggactggcgctcaccccgcgcggtgagttctcggtggtgatcgccgggctggcggtcgcctccggggtggagccccggctggctccgctcgccaccgcgtacgtcttgatcaccgtcgtctgcgggccgatgctagcccgcctatcagactacgtttggttcaaaaatttggtcagacggcggatggcggcccaacggtcatctacaaaacccctgcccagcgcggagtga

SEQ ID NO: 2820 - DNA, 519 bp, Actinoplanes utahensis
ttgggacgttcgacactcgcgacggacagtgggtcatccgtcgcgttccgaacggtaaataaggcggcggcgttgagtttgcgagaggcgactttcatcgggttcggcaacccggtcgatccccggccggtggagctggagtcctgggcctaccaccccgaggcggtgccgctgagtgcgatgccgaaagactgggatctgctgatctccggcgacgtgctcggccccaccctgttcgagctggccatggaccggcagtgcccggcccgccggttcgcgcagcactgcatgtacatctatgcggcggacggcgtccggcagaacgcgaccagccagcgcaagcggcggctcaagaagttcgtggagcgcgccgaggaggtcggcgacgagccgatgcagatctgggcgcacaactgccgggtcctgatgacccggccggagctgttcgaccaccatgactggatggagggcggcctggtgcgccatccgcgccggatcggcctcttcaaccgacggtaa

SEQ ID NO: 2821 - DNA, 444 bp, Actinoplanes utahensis
atgtatgaggagatcagcatctcggtggaacaggcctccgacgcgaaggtcctgatcatctcggtggccgcgcggctcgccgggatgcacccccagacgctgcggcagtacgaccggctcgggctggtgcagcccggccgggccggcggtggtggccgacggtacagcgagcgcgatgtggcgctgctccgcgaggtgcagaagctgagtcaggaggacggtgtcaacctggccggcatcaagcggatcatcggcctcgagcagctggtcgcggacctgcagcaccgggtcgtcgagctggaacagcagctggacgacgcgtacgcccgcatcgccgaagttgaatcgatgaacccgtacgtgagccggggtgatctggtacgccaggaacggcactcgacggcgctggtcgtctggcggccgcgacgctccccggacagatga

SEQ ID NO: 2822 - DNA, 1206 bp, Actinoplanes utahensis
atgagctcgaaggactggcttgagaaggacttctacgccgtgctcggcgtcaacaagtccgcctcgaccgacgagatcaagaaggcgtaccggaaactcgcccgcgaccttcaccccgaccgcaacccggacaacaaggaggcggaggagaagttcaaggccgcttccgaggcgtacgacgtgctcgccgacgacaagaagcgcaaagagtacgacgagatgcgctcgctgttcggctcgggcgcgttccgccggggcgccggccggcccggtgccggtggcgcccagttcgacccgtccgacctgttcggcgggttcaccggggcggccgccggcggtggcgccggggccgaccgccggttcggcggcaccgggttctccgacatcttcagctcgatcttctccggtggcggcgccgccggcgccccggccggccggcgtggcccgcagcgcggccgcgacgtggagaccgaggtgacgctggacttcgcgcaggccgtgcggggcaccacgctgccgctcacactgcgcaccgctggcgcctgcgacacctgtcacggcaacggggcgaagccgggaaccatcccgcgctcctgcgcgaagtgtcacggcaccgggctgatctccagcaaccagggctcgttcagtttctccgagccgtgccgggactgttccggctcgggcagcatcgtcgacgagaaatgcccggagtgccggggcagcggcagcgtcaccaagagccggacgatcaacgtccggttcccggccggcgtcgccgacgggcagcggatccggctgtccggccgcggcgagccgggtgaccgcggcggtccggccggcgacctgtacgtacaggtcaaggtgcggcccgatgagctgttcgggcgcagcggcgacgatctgacgctgaccgtgccgatcaccgtggccgaggccgtcctcggcaccgacctgcgggtgcccagcctggacaacccggtgacgctgcgggtgccgcccggcacgccgagcggccgcaagctgcgggtccggggcaagggggtggcccgcaaggagggccagtccggcgacctgatcgtcacggtcgaggtgcagatcccggtgggcgtgaccggagaggcgcgcgacgcgctggagcggttcgccaaactgaccccgcccgccgggcgggagcgactcgaagcgcgcgtgcgcaagaccggctag

SEQ ID NO: 2823 - DNA, 615 bp, Actinoplanes utahensis
gtgagtgccgcggacgacgacaacgacggtccggtgaccgagcgggaagtcatccagggcgagaccgactcggctgccgagacgactcccgacacgaagcggaaggcggccggcgcgcaccgcgcccgcgacgaagaggagggcggagccccggtggccgaggagagcaagcccggccttggcgccgagctggaggcgctgcgcggcgagctcgacgagcggacccacgacctgcagcgcgtcacggcggagtacgcgaactaccgcaagcgggtggaccgcgaccggggcgccgcggcggagcagaccaccggctcggtgctcaccgcgctgctgccggtgctggacgacatcgaccgggctcgcgagcacggtgacctggtcggcccgttcgcctcggtggccgagcagctcaccgcggtgaccggcaagctcggcctggtcgcgttcggggagaagggtgaccccttcgacccgaaccggcacgaggcggtggcgcacctgacgtccgcggacgtcaccgagccgacctgcgtcgaggtgatgcgtcgtggctacacgctgggcgagcggctgctgcgcccggcgatggtcgccgtcgcagatccggagtga

SEQ ID NO: 2824 - DNA, 1860 bp, Actinoplanes utahensis
atggcacgtgcggtcggcatcgacctcggcaccacgaactcctgcgtcagcgttctggaaggaggcgagcccaccgtcatcgccaacgcggagggctcccggacgacgccgtcgatcgtggccttcgcccggaacggcgaggtgctggtcggcgaggtcgccaagcgccaggcggtgaccaacccggaccggaccatccgttcggtgaagcgggagatcggcaccaactggtcgatcgacatcgacggtaagaagtacaccccgcaggagatctcggcgcgggtgctgatgaagctcaagcgcgactccgaggcgtacctgggcgagaccatcaccgacgcggtgatcaccgtcccggcgtacttcaacgacgcccagcgccaggccaccaaggaggccggtgagatcgccggcctcaacgtcctgcggatcgtcaacgagcccaccgccgccgcgctggcgtacgggctggacaagggctccaaggagcagaccgtcctggttttcgacctcggcggcggcaccttcgacgtctcgctgctggagctgggcgacggcgtcatcgaggtcaagtccacctccggtgacaaccacctgggcggcgacgactgggaccagcggatcatcgaccacctggtgaagacgttccgcggcgagcacggcatcgacctgtcccaggacaagatggccctgcagcgtctgcgcgaggccgccgagaaggccaagatcgagctgtccgcggccaccaccaccagcatcaacctgccgtacatcacggccggggcgaacggcccgctgcacctggacatgtccctgagccgggccgagttccagcgcatgacgcaggacctgctggaccgctgcaagggtccgttcgagtcggcgatcaaggacgccgacgtcaagctctccgacatcgaccacgtcatcctggtcggcggctcgacccggatgccggccgtcaccgagctggtgcagagcctgatcggccgggagccgaacaagggcgtcaacccggacgaggtcgtcgcggtcggcgccgcgctgcaggccggcgtactcaagggcgaggtcaaggacgtcctgctgctcgatgtcaccccgctgtcgctgggcatcgagaccaagggcggcatcatgcacaagctggtggagcgcaacaccaccatcccggcgcaccgctccgaggtctacaccaccgcggacgacaaccagccctccgtgctgatccaggtctaccagggtgagcgcgagatggcggcgtacaacaagaagctcggcaccttcgagctgtccggcatcgcgccggccccgcgcggcgtcccgcagatcgaggtgtccttcgacatcgacgcgaacggcatcgtgcacgtgtccgccaaggatctgggcaccggcaaggagcagaagatgaccatcaccggtggctccgcgctgccgaaggaggacatcgagcggatgatgcgcgacgccgagtcgcacgccgacgacgacaagaagcggcgtgaggacgcggagacccgcaacctggccgagcagctgcagtggcagaccgagaagttcctggccgagagcggcgacaagctgcccgaggagagcaagggcaagatcggcgaggcgctcggcgagctgcgcggcgcgctgggcggcaccgacatcgagaagatcaagtcggcgcacgagcggctgtcccaggtctcccaggaggccggctcggcgctctactcccagggcgaggccccgcaggccggccccgagggtgcgacgggtgctccgggcggcgcgaccggcgcgggcccggccggcggcagcggtgacgacgtggtcgacgccgagatcgtggaggacgacaagaagtga

SEQ ID NO: 2825 - DNA, 1767 bp, Actinoplanes utahensis
atggcccgtcccgcgaacaaggagaacggcatcaccacaccggtcagccccccacccgccgtgggcaggctcgcgtcggccctgcgccgactgcgcgcggccctcggcacggtgtcgtacccgctggtgctgccctccgccgaggaggcccgccgggtcggcaccgcgctgctcgcccaactcgacgactatctggtcccgcggctgtcccggctggacgcgcccctgctcgtggtggtcggcggctccaccggcgccggcaagtcgacgctggtcaacagcctggtgcaggagcgggtgaccagcgccggggtgctgcgcccgaccacccgctcgccggtgctcgtcgcgcacccggagaacctgggctggttcgagcagccgcatctgctgcccggcctgatccgcacggtcaagaccagcgacgacccgaattcgttgcaggtgatcggcgcccgcgggatcgggcccggcctggccctgctggacgcgccggacgtcgactcggtggtcgaccacaaccgtaagctcgccgcccagctgctggccgcggccgacctgtggctgttcgtcaccaccgccgcgcgctacgccgacgcggtcccgtgggagctgctcaagacggcccggttgcgcggcacggtgatcgcgctggtgctggaccgggtgccgctggacgcggccgccgagatctccgcgcacctgggcgagatgctgaccgagcacgacctgggcaacgcaccgctgttcgtgctgccggaaagtcagctggacgagcgaggcatgctcccgcatccggcgatccagccgatccagcagtggttcgcgcagctctcggccgacccgcgggcccgcgacgcggtggtccggcagaccctggacggcgcgctggccgcgctcgccccggcgatcgagggcctggccgaggcggccgaggagcaggtccggacggcgcaggcgctggacgagcgggtcgagtcggcctatcggacggcccgccggacgatcgccgagggtctgcaggacgggcggctgctccgcggcgaggtgctggcccgctggcaggagttcatcggcaccggcgagctcgtgcgcaacctggagtcccgcgtcgggcacctgcgcgaccggctggtcgcggcggtcaccggccggcccgagcccagccgcaacctgcaggtggcgctggagtcacagctggtcacgctgctgcgcggggtggcgaccgacgccgccgagcaggcctacgccgcctggcaggcgcacccggccggggaggcgctgctgctgcccgagctgaagacggcctccgacgggctcgcgctgcgcgccgaccggatggtccgggactggcagaaatgggtgctcgacctggtccgccgggagggcggcgacaagcgctcggtggcccgcggcgcggcgtacgcggtgaacggcgccggcctggccgtgatgatcgccgtgttcacctcgaccgccttcatcccgaccgggctggaggtcgcggtcggggccggcaccacggtcgccgcacagaaggtgctcgaggcggtcttcggtgaccaggccatccgcagtctggccacccgggcccgcaccgagctggtcgcccgcttcgacgagctgctcaccgccgaagcggcccggttcgccgaccgcaccgctatcgtgcgccgcgaggccgaacccggcacactgttgcgccgagccgccgctgaggtggagagcgccaggaaggacatcgcgttgaccggatcggggtcatga

SEQ ID NO: 2826 - DNA, 918 bp, Actinoplanes utahensis
atgagtctggtggagaacgtgcgcgacaccggtcgggtggacgccgagagcctgacccgccggttggaggcgctgtcgaggttcctgcggctggtcgatccgtacctgccggacagcgagctggtcaccgcgcacaccgtggtggaacgggccagcgggcggctcacgctgtcgctggaccacaccgtggtggcgctcgccggcagcaccggcagcggcaagtccagcctgttcaacgcgctggcccggttcaagctgtccccggtcggggtgcgccggccgaccaccggcaccgcgcacgccgtggtctggggcccgctggagccggccagccggctgctcgactgggtcggcgtgctgccccggcagcggttcgtccgggagagcgcgctggacggtgacgacgaggcctcgctgcgcggcctggtcctgctcgacctgcccgacttcgactcgatcgagcaggcccaccagctggaggtggaccggctactcggcctggtcgaccagatcgtctgggtggtcgacccgcagaagtacggcgaccggatcctgcaccgggcctacctctcccagttcaacacgcacgccggcgtgaccatcgtggtgctcaaccaggccgaccggctcagcgccccggacaccgaggcggtgctcaccgacctgcgccggctgctcgacgacgacgggctgtccggcgcgccggtgctggccacctcggcgaagcagcccgggatgctgaacgagctgcgcagcgcgctggagggcacggtggccggccggcaggccgcgctgcgccggctcgccgccgacgtcgacgtggccggcgaggagctggccgcgatgatgggaccgccggccgccgaggacgaggtcgaccgagccaccgtccggcagctgaccgacctagctagctag

SEQ ID NO: 2827 - DNA, 651 bp, Actinoplanes utahensis
ttgcgcccggacccgctgcgcaagctgcacctgggtgagccggtgaaaaccgacggggtctccaccgacgtggtgccgcgcacctcgctgccggaggcggacgccgcgcagaaatccgcggtcgggctctcggtgcgcaccgtcgccaaacgcgccgccgccccgctgcccgaggtctgggcgccggcgctgaacaccgcggcgcgctccaaggcggccgacctgccggacgcgctggaccgcgcgatcgccaccaccgatctcggcaccgagcaccggccggcctggtggcgactggtcggcgggctgcagtgggtgctgctggccgccgccacggccgggctgctctggctgatcctgggctacgtgatgagcgccctcaaactgccggacatcgacggaccgcacgtcggctcggtgccgctggccaccgtgctgctgctcggcggcctgttcgccgggctgctgctctggctgctgctgaaacccgtggtcgaggcgggcgggcggcgggcccggcggcaggccgagcagaagttgcgcgccgcggtgaccgacgtcggccgccagtacgtggtggccccggtccgcgaggtgctcaatgcctacgcgcaggcgcgcgaggcgctcggcgtggtgcgttcggagtag

SEQ ID NO: 2828 - DNA, 1203 bp, Actinoplanes utahensis
atgccggcaccccagagtgtgtacgaggcggtgctgcacgcggcccgcgacgttctccagctgagttgtgcgctggatgccgagatgctcggagcagcgctgctgggcagtatctacgcgatggccgagggcgaccgggcggccgccgtccaggagttcgtcggcgagttcctgagcgcgaccgaccggcgcgccgagccgttcgccgaggcgatccgcgaggtcttcgcgaccctggtgccggcggccgacggcgcggaccgggtcggtcccggccggcaggccccggcctgggccggtcagctcggccgggtgcacgtcaccggctgctacgcctacggcgacgtctacggcgaccagacctcctacctggtgacgtacgcgtatgacgacaccgacgacggcggtcccgagcacgccctggtcgcgctggtcgaccacaacatcggcatcgtcaaggacgtgttcgtggcgagctcggcggagatcctcacccaggtccgcacggtctgcgagcacgacgagctgacctggttccgggacgaggacccgggccgggcccgcgacgaggtgggccggcatctgcgggtcaccgacgagctgggcgagctgcccgccgacggttcgctggccaccgaccgggccctggtcggcgcccggctggcggtgctgcccgaggtcaccaccccgccgctggacgagcccgacccgccgaaggtgccggagctgatccacgacttcctggcctcgccggaggccgcccgggaggggctgaccggcccggacaccgaccagccgtccctgcagttctgcctgggcctgctcgtcgaccacgcggcctcgctgtccagcggtgacccgctgcgctggagcccggcggtggccggcttcttcctgctggactgggtgcaccggcgggcggtgctggacatcgacgacgccgcgatgctgccccgggtggtccgcgcctggtcggcctacgccacctggcggcgcgggctgcccccggccgcggtcgcggagaccgccgccgaggtggagaaactggtgccggagttcgcccggctgtactcgaccggggagcgacgcagcccggcgaccgcggcggtcgcccagctgatcgccgagggtgtcgacccgagcgacgacagcgccatcgacgcctggctgcaggccaaccgcgaccggctgggcgacgactga

SEQ ID NO: 2829 - DNA, 558 bp, Actinoplanes utahensis
gtgcccggcctgcccgaggtgcccgacgacgactggcccggcccgctcggccggcgcgcgctgccgtccgacgatcccgcccccgacgatccgggattcgacgagccggcatccggcgatctgtccggaagcgacagcaccgcatcggacgaaccggattcttcagatgacgccgattccacggacgacggtgacgacgacgccgatgagccggaccaggacgccccgcatcacaggtgcgagccagacatcatcagcgaccggccccgcggctggtcccccaccagccggaggtcgaccgtgaccgaacgcccgcacaacgtcaacgccgcgcggatcatcgagtacagctacgggggcagcggccgcaacgtccgcaacgcgatggcccagccccgctccgacgaggcccgcaactccaaccgcccgtaccgcggccaccaccgcgccgagcacaccctgcacgacgagaacaacccggcccgtcagcgcagctcccgggtcggccggcaccaccgggagcacatcaccggcgagcaccacgccaaccaccggtag

SEQ ID NO: 2830 - DNA, 402 bp, Actinoplanes utahensis
gtgccgcacctgcccgacgacgacggctacgagccgcccctcaaggtgctcaggaagcggttcaacggtgtataccgggaggactacggcctgtccgggccgacccggcgctatctcctgctggtcgtcatgctggtcggcctcgcctcggtgccgaccctcgccgtgatcaccgcggggaccagcgagatcgccggcaacggtcgcagcggagcgatggacgcgcccttcctcgcgcctccggcgcccggcccggtccgctcgtcaccgtccggtccgtcgccctcccgatcgccgatcgattccggtacgtcgtcgaccgcgtccccgggcgtgtcgccgccccccggtcgcgacccggcgaccctgccgaccgttcccgggctgccgcgggctagctag

SEQ ID NO: 2831 - DNA, 1146 bp, Actinoplanes utahensis
atggcgaaaggcgaacgcaaagccggtggcggcagcgacgccccggcgggcggcttcgtccagctactcacgcccgacggcgagcacctcggcagcgtcaccacggcggacggcgccacctactcggtcgacttcaccgacgacgagtatcgcggcctctaccgcgacctggtgacggtccgccggctcgacgccgaggcgaccgccctgcagcggcagggcgagctcgggctctgggccagcctgctgggtcaggaggccgctcaggtcggctccggccgggcgctgcgcccgcaggacatggcgttccccacctaccgcgagcacggcgtgctgtactgccgcgggatcgacccgatcatgccgttcggcctgttccgcggcgtcgatcagggcggatgggactcgaacgagcacaagttcaacagctacaccatcgtgatcggctcgcagacgctgcacgcgaccggttacgccatgggcgtcaccatggacggcaagaccggcagcgccgacggcgaggccgtcatcgcgtacttcggcgacggcgcgaccagccagggcgaggtcaacgaggcgttcgtctggtccggggtgttcaacgccccgatcgtcttcttctgccagaacaaccagtacgcgatctccgagccgctggagcggcagacccgcatcccgctgtaccggcgcgccgccggctacggattcccgggcatccggatcgacggcaacgacgtgctggcgacgtacgcggtgaccagggccgcgctggacaacgcgcgcaacggccagggcccgaccctgatcgaggcgtacacctaccggatgggcgcgcacaccagctccgacgaccccacccgctaccggatcgcctccgaggtcgagtcgtggaaggcgaaggatccgatctcccgggtcgccgcgttcctggccaagcagaaactggccgacgacgacttcttcgccgaggtcgacgccaccgccggcaaactcgccctggacctgcgggaacgggtgctggcgatgcctgatccacaaccggtcacgatgttcgacaacgtctatcccaccggctccccggagctcgaccggcagcgcgccgcgttcaccgggtaccacgcgtcgttcgaggggagtgggcactga

SEQ ID NO: 2832 - DNA, 987 bp, Actinoplanes utahensis
atggccgagacgatcaccctgggcaaggccctcaaccacggcctgcgccgcgccctggagaacgacccgaaggtcgtcatcatgggcgaggacgtcggcaagctcggcggcgtcttccggatcaccgacggtctgcagaaggacttcggcgaggaccgggtcatcgacaccccgctggccgaagccggcatcgtcggcaccgcggtcggcctggccatccgcggataccggccggtctgcgagatccagttcgacgggttcgtcttcccggcgtacaaccagatcgtcgcccaggtggcgaagatgttctaccgctccaagggcaaggtccgggtgccgatggtgatccggatcccgttcggcggcggaatcggcgcggtcgagcaccactccgagtcgcccgaggcgtacttctcgcacacccccggtctcaaggtcgtcagctgctccaacccggccgacgcctactcgatgatccagcaggcgatcgcctccgacgacccggtcgtcttcttcgagccgaagcgccgctactgggagaaaggcgaggtcgacctcgacgcgccgctgagcggcgcacacccgctgcactcggcgcggatcgcccggcccggcaccgatgccacgattctggcgtacgggccgatggtgcgcgtcgcgctcgacgcggccgccgcggcggccgaggacgggcgcaacctggaggtcatcgacctgcgctcgctctccccggtcgactacccggtgctgttcgagtcggtcaagcggaccggccgcgcggtcgtggtgcacgaggcccccggcaacatcggcctcggcgccgagctcgccgcccgggtcaccgaggagtgcttctactccctggaggccccggtcctgcgggtgaccggctacgacatcccgtacccggcggcccgctcggaggaggagtaccttcccgatctggaccggctgctcgacgccgtcgaccgctccttcggctggtga

SEQ ID NO: 2833 - DNA, 1515 bp, Actinoplanes utahensis
gtgcttctactccctggaggccccggtcctgcgggtgaccggctacgacatcccgtacccggcggcccgctcggaggaggagtaccttcccgatctggaccggctgctcgacgccgtcgaccgctccttcggctggtgaccgcgatgtcccggatcaaggaattcaacctgcccgacctgggcgaggggctgaccgagggcgagatcctcgcctggctcgtcaaggtcggcgacacgatcgagctgaaccagccgatcgtcgaggtggagacggcgaaggcggccgtggagatcccggcgaagtgggccggggtggtcacccggatcttccacgaggcggggaccaccgtggaggtgggccagccgatcatctcgatcgacaccgacccgggagccggggatcttcccgccactcccgagccggcggcggctccggccgcggcgacgccgcacggcgggggccgcactccggtgctggtcgggtacggggtgcgggagagcagcgcgaagcggcgaccccggatcagtgcgccggccgcatccgcaccggtcatcccggccgctccggtcgcggctccggctccggtcgccccggttgctccggtcgctcaggcggctgcggtcgcggtgcctgttcgcagtgggccggtgctggccaagccgccggtgcgcaagctcgccaaggacctgggggtggacctcgccaccctcaccgggtccgggccactggggtcgatcacgcgggacgacgtacacaaggcgctggaaatgccggcgcagccggtgagcgtgctgaacggcgaccgcgagcagcgcatcccggtcaagggcgtacgcaagctgaccgcggagaacatggtggcctcggcgttcaccgcgccgcacgtcaccgagttcctcaccgtcgacgtgacccgcagcatgaaggcgctggagaagctgaaggcccggcgcgacttcgccgacctgcgcgtctccccgctgctgctggtggccaaggcggtgctgctcgcggtcaagcggtatccgatggtcaactcgtcctggtcggcggccggcccctcaacggccgagatcgtggtcaaggactacgtgaacctgggtatcgccgcggccaccgagcgcgggctgatcgtgccgaacatcaaggatgccggccgtctcactctgcgggagcttgccgaatctctcaacgagctcgtccggacggccaagtcgggtaggacgtcgccggccgacatggcgcacggcactctctcgatcaccaacgtgggcgtgttcggcgtcgacaccgggaccccgatcctgccccccggcgaatcggcgatcctggccttcggcgcgatccggccgacgccgtgggtgcacaagggcaagatcaaggtgcgccaggtcaccaccctcgggctctccttcgaccaccggatcatcgacggcgagctgggctcgaagttcctccgggacatcggcgagttcctcaccgacccggaagccgccctgctggcttggacttaa

SEQ ID NO: 2834 - DNA, 195 bp, Actinoplanes utahensis
gtgtccgccacaagcggacccgcagctcacgtcgagatatcgggagcaccagccatgagcatgatcaaccgcatccgccagcgtcgtctcgtcaagcgcgaggaccgggccctcgaccgggcctggcaggccgcgcccactccggccatgcgtcacgagatcaacatcttcgcctcgcaccgtcagcccctttag

SEQ ID NO: 2835 - DNA, 3228 bp, Actinoplanes utahensis
atgacgtccgaggggcaccacgccgggcagccggccgaggccgcgtcgggcggacccgattccgagggtcagcgagtttcaggccgggcatccgccccggcccccgccgaaggcactcccacgtcgtacggtccaccaccgcaaaccgcgcccggcggcggctcgccgttcgtggtgccggcggtcgccaccttcggctccggatccaacccgaccggcaccccctacggatcggcgcgaacgccccagggcgaagaggcatcgccgtacggatcggtctcccccggagcggctcccacctacggttcaggccccgccggggacagcccgtgggctcccccgcagccgccgaccacggccagcggactgcccacccggaccccgggcgcctcggccgccgcggccgaccagtccaccttctccgccttcggcgagcagaaggcgcgcgtgcccggcgccaccctcaccgacctgccgggctccggcaccggtcgtcccggctctccggattccggcgtcggtcgccccggcctcaccgggccggccgagaacagctggctcggcagtgccgcccgccccgccggggagagcgcgccgaccgccaacacgttccccacccggcagggcgacagcggcggattcccgacccgggcgcccgccggaccgaccgcggccgaggagcccagcggcccgacgcccaacctcgacctgcccatccgcagcaccgcgggacatgccgcgccgccgtcgccgttcggcgccgaggccgagcaggcttccggattcccgcagcgggtgcccggcgcggcgctcggcagtggggggtcactgtcggccaacccgccggctgcggcggtgcccgcgccggccgctccggcgttcccgcctccgtcgtccagcttccagccgtccggcggggcgggcttcccgccggccggggcggcttcgacgcccggatcgggcttcgcatccgggcccgggtccgctgctgttcccggctccgcccccgtgccgacggcttcggcatccggggcggttccgcagcctcgggatgccggtgccgcccggccggtgaccggctcggctcggccggcgaccgccagcgtctcggtgcccggcatggtgcagccgccggccgacggcgcggagatcccaccggccggcgcggcgccgcaggcccgggtctacgggcgtgccgccgcggcggaggaggcttcgcccctcggctctacgccgttcccgggcgcgcgcgtgcccgacaacgggggccagaccagtccgttcgcgccggagagtcccttcgcccccgacagcggtggccagggcagtcccttcgcccctgacagcggcgtccagggcagtcccttcgcgcccgacaacggtggacaagccagcccgtttgcgcccgccggcgaccggcagagcaacccgttcggttcggacaacgagcggcagaacagcccgttcgcgcccgacaacggccggcaggccgacccgttcgcgcaggacgccggtcggcagacggacccgttcgcgcagggcccggagaattcgggcgggtcgttcggggcccggtccgagggcttcggctcgttcgcgccgacgcagcgcgccgaggagaattcgggcggcttcggggcattcccgccgccgcagcgcggtgaggagagctccggtggattcggcgggttcccgccgccgcagggcgagacctccggcgcggccccgcaatcgccggctcgggccaccgcccgcgcttcggcgagcgcccgcgtcaccccgccggagcaggcttcgtccggcggtcccggctccggcattcccgctgctccgggctccggcggcccggggtccggtccggccggttcccccggctccgggattccctcgtccacaccggggtccggcgtctacggctcccccggctcccactccggtcccgagtccggcgtctacggctccgccggggccggctcggagtccggcgtctacgggtctcccgggtccgcgcccgagtcgggtgtctatggcgcccccggcgcacccggtgtgccgccggccggcccgacctccggcagcgcccgggtctcgcagccggacgccaccgcgccgttcccgggttctcctgccgcgttctccagcggtccgggcggtccgggcaccgcgcccggcttcccgccgccgtccttcggtggcaccgctccggcttcgccgccgttcggtggcaacccgccgggctcgcccttcggcgggaacgccccggcggcacccccgagcggctccgccccggcgacgccgctcagcggcaacgccccgccggtacctttcggtgggaaccctccgacggctccgttcggcgacaatccggcgacggtaccgttcggcggccatcacccggggtcgccgttcggcagcgccgcaccggcttcaccgccgttcggcggcaccgcaccggcctcttcgccgttcggtgaacggccccagcgcccgcagttcgagggcatcaacgagccgaccttcccgccgccgtcgtcctccttcccgggtgcgccgagtgcctccggcgccccggcgaccttccccggcgcgccggcccagccgggcacctacggctccgcgccgcagaacgctccggcctggggccaaccggctaccggcggcgaccagttcagcgagcacacgacggatgtctccggccggggcaactccccgttcgacgctccgccgatgccgccgggccagggctcggcccacccgttcggcgaccggtcgatgccggccggcccggtctccggcgacccgttcggcgctgacccggccgcccgcgccacggtgaccccgccggttccggaggacaccacgagctggccggccacgaccgagcagggcaagttcgaccagttcaagcccgaagccgcacccgcgcccaccccggcgaaggtgcgcaccatcccggtcgccctggccgtggtggtcggtgccgcgctgctgctcggcatcgtcttcggcctggtctacctgatctccgggggcggtggcggcagcttcagcgccaacgccggcgactgcgtgaagaacggcgacaaggtggtcaaggtcgcctgctcggagccgggcgcctaccagatcaagcaggtcgtcgacgccaaggagcagtgcgccgacaaggcgcagccctacgtcgtcgccgacaagaaggtgtactgcctggtcaagccggctggctga

SEQ ID NO: 2836 - DNA, 1803 bp, Actinoplanes utahensis
atgaattctcgcgttcgtgcgcccgaactcaagggtcgcggctggctgaacaccggtgggaaggccctcaccctggccgacctccgcggcaagatcttgattctcgatttctggacgttctgctgcatcaactgcctgcacgtcctggacgagctgcggccgctggaggagaagtacggcgacgccctggtggtgatcggcgtgcactccccgaaattcgagcacgagcgtgatccccgggcgctggccgccgccgtcgagcggtacggcgtgcaccacccggtcgtcgacgacggcgacatgcacctctggcagcagtacgccgcgaaggcctggcccaccctggccgtggtggacccgaccggttacctggtcgcctcgatggccggcgaggggcacgccgagggcctgtcccggctgatcgacgagctggtcgccaagcatggggcggacggcaccctgcaccgcggggacggcccgttcgtgccgccgcccgcgccggccggtctgctgcacttcccgggtaaggccatcgagctgcccggcggcaatctgctggtctccgattcggcccggcattccgtggtggagctgactccggacggtgcgacgctggtccgccggttcggcggcccgggccggggtgagccgttcagcgagccgcagggcctggtgctgctccccgccgaggtccgtgagctggccggttacgacgtggtggtcgccgacacggtcaaccatcagttgcgcgcgctgaacctgtcgaccggcgaggtcaccctggtggccggttccggccggccgtggcggtcggctgtggacgatcatgcccatgacgcgctggccaccgatctgtcgtcgccgtgggatctggcctggttcgacgacaaggtgatcatcgcgatggccgggatccaccagttgtggtggttcgacccgatcaagcgcacggtgggtgtctacgccggcaccacggtcgaggcgttgcgggacggcccactgccggatgtctggatggcgcagccgagcggcctgtcggtgcacggcgaccggctctggatcgccgacagcgagacgtcggcgctgcggttcgtcgaggacggcgtgctgcacaccgcggtcggccagggcctgttcgatttcggtcacgtggacggtccggccggggccgcgctgttccagcacccgctcggggtcgcggcgctggcggacggctcggtgctggtggccgacacgtacaacggcgccgtccgtcgtttcgatcccgcgtcgaacgaggtgtccacggtggatgccggtctggccgagccgagtgacgtcctggtcaccgcggccggcgaggtgctggtcgtggagtcggccgcgcaccggctggtccggctggcacccggcgtgctgcagaccgggcggacggtcgacggcgagcggcaccggaccgagcgaccgccgtcgcatctggctccgggcgaggtcaccctggacgtgatcttcacgccggcgccgggccagaaactggacagccagttcggctcgccggtccggttgaccgtgtcggcgtcccccgcggagctgctgctcgacggcgcgggtgtcaccaccgagttgtcccgtcgcctggtgctgaacccggcggtgcccaagggcgtgctgcaggtggtggcccaggcggcgacgtgtgacgtcgacgccgaattcggtgcctgccacctgaccaggcaggactggggtgtcccgatcgtggtcgaccccgccgccccggaccgtctgccgctgatcctgcgggggctggacgagtccgcgtga

SEQ ID NO: 2837 - DNA, 591 bp, Actinoplanes utahensis
atgcaagtcagcgaaccggatgacgccgcgatcatcctccggtcccatcgggctccggaggagttcgcggcgctcttcgatcggcacgcgccgcacatccatcgctatctggcccgccggctcggcgatcaggtggccgacgacctggtcgccgagacgttcctgaccgcgttccggcggcgtgacaccttctggccgggtccgcacgacgcccggccgtggctctacggcatcgccaccaatctggtcgcccagcatcgccgcgacgaggcccgcgcgctgcgcctgcggcacgccgtcgcccccgacccggacagcttctgccatgccgaccaggtggccgcggacgtcaccgccgccgcgctgcgcgacgcgctgaccgcggctctggcgacgctcgccgacggcgaccgcgacgtgctcctgctgatcgctcaggaggaattgacgtacgagcaggtcgccgttgccctggacatcccggtgggcaccgtgcgctcccggttgcaccgcgcgcgtaccgcattgaaggccgcgctcggcggccacaatccattgaccttcgtcgaggaggaggttcgccatggatga

SEQ ID NO: 2838 - DNA, 903 bp, Actinoplanes utahensis
atggatgagatcaccctgaccggggagctgggccgcgaggtgccgctgcccacggccgccgacctggcgccggctcgcgcccggttgctggccgaactgaccgccgccgcgccgccggtccgcaacgtccggaagctgcgcctccgctgggcggccgtcgccaccggcacggtcgctgccgctgccgctgccgccggcatcgttgcgatcgcccccggtacgccgtcgagcacctccgccccgcctgcccccgccgccccggtcccggtcgcgcagttcctggacgacgcggcgaccgtggccggccagggccgggacgtggtgccccgcggcgaccagttcctctacacccgggtgcgggcgaccgacgggacctggaccgactactggtcctcgatcgacggccggcacctcggcgaggagcggtcctcgtccggcaagaagacgatcatcgcggcgtgtgtgaacgggaagagctacgacccgagcgacccggtcgacgtcggttgtgagccgacccgcctctacctgccggatctgcccaccgacccggagcggatggtggcctggctgaaggcgcggaacccgggtctcgacggcgcaccgtacaacgccaacggggtggccaaggagatctggtcgctgagtgacagttactggctgcgcccggcgcagcgtgcggcgctgtaccgcgcgctcggccggttcgacgggatcagcctggtgccgggggccaaggacgggaccgggcaggtcggcaccggggtctcctggatctcaccgggcgacacggcaccccgggtgatgtgggtcttcgatccgaagcggcacgtactgctgggttaccagaacgcctcgatcgacgcgtacgcgttggtggaccggatcggtgccacgcactga

SEQ ID NO: 2839 - DNA, 780 bp, Actinoplanes utahensis
atggacgatgatttctccatgacggcggttgatctcaacgcggacctcggcgagggcttcggcgcctggcggctcggcgacgatgaggccctgctcgatgtcgtcacctcggcgaacgtggcctgcggctttcacgccggcgacccctccacgatgcaccgggtgtgccgggccgccgccgagcgcggggtggcgatcggcgcccaggtcggctaccgcgacctggccgggttcggccggcgccggatcgactacgagttcggcgagctgcgcgacgacgtgctctaccagatcggggcgctggaagcgttctgcaaggttgccggtgaccggatccgatacgtgaagccgcacggcgcgctctacaacaccgcggccgtcgaccgggggcaggccgacgcggtggtggccgccatcctcgcctacgacccggcgctgccggtgctctgccagcccgggtcggtgctgttccggcaggccgtcgccgccgggctgaccgcggtcggcgagggcttcgccgaccgcggctacctgccggacgggcgcctggtgccgcgctcccggccggacgcgctggtgcacgacccggccgcggtcgtcgagcgggccacccggatggtcgccgccggcgaggtgatcgccgccgacggcacgcccatccggtgcgcggtgcgctcgatctgcgtgcacggcgacaccccgggcgcggttgatctcgcccgtgcggtgcgcgccgggctgcagaccgccgatgtggcggtacgcccgttcagccgctga

SEQ ID NO: 2840 - DNA, 675 bp, Actinoplanes utahensis
gtgacgacctctgccccgttccggatgaagccgaccgacctcggcaagccgcgactacgcggccggttgcatcagtacgcgttcttcgtcgccgccgtctgcggcatcgtgctctgctcgatcgcgctgagccgccccgggtgggggccgttcgtcagctgcctgatctacagcgtgacggtgtgcggcctgttcggcaccagcgccctctatcaccggcgggtctggagcgaacgcggctaccagatcatgcgccggatggatcactcgatgatcttcatcttcatcgccggcacctacacgccgttctgcgtggagttgctcggcaggtccaaggccgagctgatgctgggcctggtctggggcggcgccctgggtggcgtggccctgaagatgatctggccgcacctgccgcgctgggccggcgccccgctctacgtcgcgctcggctgggccgcggtcgcgatcctgccggacgtgctgcacggcggcgtgacctgcctggtgctgctgatcgcgggcggtctgatctacacggtcggcgcggtgttctacgccctgcgccggcccaatccgtggccgaccgttttcggtcaccacgagttcttccacgcctgcacgctggtcgccgcgatctgtcaccacatcgccatctatttcgccctgtacaagtag

SEQ ID NO: 2841 - DNA, 702 bp, Actinoplanes utahensis
atgtccgcgttgacggcgaacgccaggatcgcccccagagcgagcaggaagatgcttgcgccgatgcccatcgggccctcctcggaaagcggccgggctggctggctcgaccatcctgaatacgtcgatcgaggccatacccatacgcgtgaagttccaatcaggcaagctgtccgcatgaccttgcggacgctgatcctgctacgccacgccaaagcggagactcccggcgagattgctgatttcgaccggagcctgaccgatcggggcatgtcggacgcggacgcggccgggtcctggttggtggatgagcgcctgcaccccgacctggtgctctgctcaccggccaggcggacccggcagacctggcaggccgcatcgctcgcactggcccagggaaactcgtcgcacggcgcgctctcgcccgaggtgcactacgaggaccagctctactatggcgggcggaccgaggtcttcgacctgctccgggcggtttcggacacggtccggacgatcctgctggtcggccacaaccccacagtgtccgaagtgtccgctctgctggtcccggacgaccagtgggacggtgtcacggtcgagctgaagacctcggggctggcggtacacaccggcgaggtgccctgggcgtcgtcgtcgccgggtgggatgcggctggcccggcggcacaccgcacggggatga

SEQ ID NO: 2842 - DNA, 1857 bp, Actinoplanes utahensis
atgactcactaccagagcaaccttcgggacctccagttcaacctgttcgaggtcttcggagcggacaaggcgttcggtcaggcgccgttcgacgagatcgacgcggagacggctcgtgacgtcctcgccgaggtgaaccggctggcccgcgaggacctcgcggccagctacgcggacgccgaccggaaccctccggtattcgacccggcgacgcacaccgcgccgctgccggagtccttcaagaagtcgtacgagaccttcatggcctccgagttctggcggctggacctgcccggcacgctgggcggcacgttcgccccgcgcaccctgtggtgggcgctggccgagcagatcctcggttccaacgcgccgatctggatgtacgcgtccggcccgtcgttcgcccacgtggcgcacaccgagggcacgccggagcagcaggagtgggccaagctcttcgtcgagaagcagtggggctccaccatggtgctgaccgagccggacgccggttcggacgtcggcgccggccgcacccgggcgatcccgcagccggacggctcgtggcacatcgagggcgtcaagcgcttcatcacctcgggtgagcacgacctgagcgacaacatcatccactacgtcctggcccgcccggtgggcgtcgagggcgtgggcggcccgggcaccaagggtctgtcgctgttcatcgtgccgaagttccacttcgacccgcagaccggcgagctgggcgagcgcaacggcgtgtacgccacgaacgtcgagcacaagatgggcctcaaggtctccaacacctgtgagatgaccttcggcgagcacggcaccccggccaagggctggctgctgggcgacaagcacgacggcatccgtcagatgttcatgatcatcgagtacgcccggatgatggtcggcaccaaggcgatcgccaccctgtcgaccggctacctgaacgcgctggagtacgcgaagaaccgcgtccagggcgccgacctggtctccaacggtgacaaggcggctccgcgggtgaccatcacccaccacccggacgtgcgccgctcgctgatgctgcagaagtcgtactccgaggccctgcgcgcgctggtcatctacaccgcgtcgtggcaggacaaggtcgcgatcgccgaggcggccggcgacgagaaggccgcgaagatcgcgagtaagatcaacgacttcctgctgccgctggtcaagggcgtcggctccgagcgggcgtacgagctgctcggccacgagtcgctgcagaccttcggtggctccggcttcctccaggactacccgctggagcagtacgtccgggacgcgaagatcgacaccctgtacgagggcaccaccgcgatccagagcctcgacctgatcttccgcaagatcgtcaaggacaacggccgggcgctcggcaccatcgccaccgagatccagaccttcatcgagaccgaggccggcaacggtcagctcaaggacgagcggctcgcgctgggcaaggccctcggcgagatgcagcagatcctcgggacggcgctgggctggctctccgcggtgcagggcggcgagacgcgcgagctctacaagatcggtctgacctcgcgccggatcctgctcgccctcggcgacgtgatcctcgcctggctgctgctgcgccaggccgaggtggcgctgaacgcgctgaacggcgaggtctccgaggccgacaagaacttctacaccggcaaggtggccgcggcccgcttcttcacccgcgagatcctgccccggatcggctcggaccgccggatcatcgagaacaccaccctcgacctcatggacctgtccgaggacgtgttctga

SEQ ID NO: 2843 - DNA, 153 bp, Actinoplanes utahensis
atgttcgccacgatcaagagcctgattcccgagccgcgccaggccggtcagccgcgaaattacgtcggccggcaccgccagcccgagccggtcgccgcgccggccccgaccgccccaagcccggccgagcccgaggacaacaccgccgcctaa

SEQ ID NO: 2844 - DNA, 1128 bp, Actinoplanes utahensis
atgctgttcggcggaaccatgcctaccttcgtgccgggccgccgcccgatgagcccagggaaccgcgccggtctcggtgcggctgtcgtgctgctcgtgatcgtgtccgccgtggagctggccagcccccgcacggtgggttacgtgggcctgttcgccctggttccggtcaccgccgcactgttcgccgtctggcagtacgtgctgggcgccgggatcgcggccaccctggccggcgcgatcttcgtggggcgcgccggcaatgccgggccgggcgtcatggtctatctgctcggcatcatgctggcgaccgggatcgcggtggccgccgccaccatgcggcagcgccagtcggaccggatcgccgagctgctgcagctggcctcggtggcccagcaggcggtgttgcgcccgatcggcccgcaggtgggctccttggcggtctccgggcgctacatctcggcgaccgccgccgcggacatcggcggtgacctttacgaggcgctgaacacgccgtacggggtccggatcatcatcggggacgtgcggggcaagggcctggacgcggtccgcctggccagcatcgtcctgggctcgtaccggcatgtcgcctacgagcgtgccgagttgaaggcgatcgtggccgacctggatcgggcggtggcccgcagtgtgggcgacgaggatttcgtgaccgcggccctggtcgaggagcgtggcggcacgctcaccatcgtcaactgtggacacccggcaccgctgctgttgcgccgcgggctggtgatcccgctggagccgccggcgccggcacccccgctcgggttcatgccggaggtcaaggcgcgggtcgagcggctggagccgggtgaccggctgctgctgttcaccgacggtctgggggaggcgcgccgggagggcgagttcttcccgaccgccgaccgtgcctggcgcctgctgggccacggcacggtcggcgacgggctggcgtccctggagaccgcgttggtcgactgggtgcgcggccgcctggaggacgacatcgctctggtcctgctggagtacgcgggcccggacgcgggcgcgtcggtcccggtgccgagctgggaggtcggcgccgccggcagttag

SEQ ID NO: 2845 - DNA, 591 bp, Actinoplanes utahensis
gtggtgaccgacgatctccgtgaccggctgcgcggcgctttccgctggaccgaccccgggccacccgccgactatctggtcagcgaccgctccggatggtggcgcgatccggtgatcctggacggactcggcccggcgctggccgatctcttccgcgccgaccggcccaccgtcgtggtgtcgcccgaagtcaccggattcctgctcggaccgctggtcgcccgggctctcggagtcggcttcgtcgaggcctaccgggccggcgcgcgccgcgccatcgccgagccgatgatctgggccgaggtcccggccgaccatcgaggtgacattcaacacttgggcgtacgacgtgagcgcctggccgtggacgaccgggtcctggtcgtggacgactgggcggccaccggctcccaggcccgcggactgcggaagctggtcggcgaccgctacatcggaaccgcggtgatcgtggacgagtgcccgcccggggtgaccgccgagctcaccatccggagtctgctcagtgcggccgatctggagcccatcgtggagtgcgacgcgccacagtcggacgcgtcgcccccgcgatga

SEQ ID NO: 2846 - DNA, 279 bp, Actinoplanes utahensis
atgatttcgacgtaccagaaaccgctggccgaggtcgaccaggcgcgggacgagcacatggcgttcgtcaccgacctggaggagcggggcctgtcggtcaccgcggggcggcaggatccgccggtgggcggggtcatcctgctggacgtggacaccgaggccgaggcccaggagctgctcgcgcaggatccttacgtggtgcggggcctggcgacctacgccgcggtgggctggcacccgagccgcggcgcgctcgccggttaccagcgtcggcgctga

SEQ ID NO: 2847 - DNA, 243 bp, Actinoplanes utahensis
atggtccagttcggcaccggcaccccccaggcgggcgacgggggcgtcgcgcgttccgacgagatcggtcggcacgcgtacgcctggcgggcgttccgcagcgtggaggcgctgtccggccagctgatgttcgggacgcgcggcggccgctgggtgcgggtgccgaccagcggcctgagtccggcgcaggtggagcaggtgctcggggcggctttcgcccagggtttgcgggtgcaccgctga

SEQ ID NO: 2848 - DNA, 891 bp, Actinoplanes utahensis
gtggacgcgggggccgccgtcggggcggaccgtggcgagatagcccatgccggggccgtactgctgcaggagcgcacggatgccggccgcgagcgagggcgcggcagcggcgaattcggaccaggaagccatacgagcattctatcgaacaagcgttcgaatcggccactgaaaacaccgattcgggcagctcaaatcccctggacggcatctgccggtggcgggcctgccgggtggcgcgagcgggtgaacgcggtagctgggcgggaggcgccgggaggggcgcggcgtaccgctcggtatggtgttgcgatgctgctctccgaccgtgacctggtttccgaaatcaaagccggggatctctcgctggagccgttcgagccgtcgctcatgcagccgtccagtatcgacgtccgccttgaccgatttttccgggtgttcaacaaccacctctacacccatatcgatccggccgagcagcaggacgagctcaccgccgaggtcgaggtcgaggacggccagccgttcgtgctgcacccaggcgagttcgtgctggcgtcgacgcttgaggtgatcactctcgggcagcagctcgcggcgcggcttgagggcaagagcagcctgggccggctcgggctgctcacgcactcgacggccggtttcatcgatcccggcttctccggtcacgtcacgctggagctctccaatgtggccaatcttccgatcaagctctggccgggtatgaagatcgggcagctgtgcatcttccgcctgtccagccccgccgatcacccgtacggttcggccgtctacggatcgcgctaccagggccagcgcggcccgaccgcgagccgctcggcgctgaatttccgcacgtggcccaccaggtaa

SEQ ID NO: 2849 - DNA, 906 bp, Actinoplanes utahensis
atgtccggagtttcggcacggacggcaagcgacaatgcggacaataaccccatgcatcactcccggcggcgtgcccattcgttcggcgccctgtccaccaccctcctcctgggcagcctgctcctgctggccccccgccccggcaccccggcgatcggcggtccggcgatccgcctggccaccccacccgcggccggcgtcctgcccaacgccacccggttcccgttgcccgccgacctcggccgggtgcagaccgcctcggcccccgtcagcctgcgctacgacttcgacggcggcgtcggcaaaccgatcgaggacaccggcggcggccacgaattgcgcccgctcggccagaacggcggcgagctccgcctcgtaccggagggaagtggcctggccgtcgcctacccggaccggtgcacgctggcccgggaacgggactgcccgcgggcgatcctggagggtcagcgcgacgacaccctcaacccgggccgccggccgctccgctacggcgcctcggtgctgatgacccacgccgatctggccgacggcgcgaacgtcgtccagaaaggctattcggtcggcggcgtcagccagttcaagctgcaggtcgaccaccggcaggggcaccccagctgtgtgatcaccggcaaccgggcacacatctaccgcgccgaacccccgatcgacgtggccgacgggcactggcacgacctcgagtgcagtcgcaccgaaggcaggctcgccctgcaggtcgacggcaccccgtacgcgtccgtcccggtcccgcccagcctgtcgatcgccaacgccgaacccctccgggtgggtggcaagggcccggcccgaggcaacgaccagttcgccggcgagatcgacaacgtcttcctcaccatcggcccgtag

SEQ ID NO: 2850 - DNA, 1053 bp, Actinoplanes utahensis
atgactaacgtgctgatcacggtgctgctgctgctcggtaacggacttttcgtcggcggcgagttcgcgctgatcgcctcccggcgcaccgcgatcgagccgctggccgccacctccaaggccgcgcgctgggcgctgtccgcgatgaaccagatcccgctgatgatcgccggggcgcagctgggcatcaccatctgctcgctgaccctcggcgcgatcgccgagaaggcgctggcccaggtgctgcagagccatttccagacggttcacctgccggagcgggcggcgcacccggtcgcgctcgtgctcgccctggtcgtcgtcgtgttcctgcacacggtggtcggcgagatggtgccgaagaacatcacgctggccgggccggaacgctcggcgctcatcctcggcccgttcatgctggccttctgcacggccaccaaaccgctgctgatcgcgatgcgctgggcgtcccggaccgtgctgcggctgtggaagatcgaggccaccgacgcggtgaagaccgtcttcaccgccgaggagctggccgggatggtcacccaggcgcgcagcgaggggctgctgggctcggagcagtacgcccggatccatgcggcgctcgggctgaacaaccggaccgccgcggacaccctgctgtcctggtcgcgggtgacgacggtggcggcggacgtgtcgccggcgacgctggaggcggtggcgacacggagtgggcggtcgcgctttccggtggtgcagcgggacacccggcgggtgctcgggttcgtgcacgtgaaagacatcctcgggtattcgggggcgcagcggcggctgcccattccggcggaagtgatccggccgctggcggtggtggctccggagcgcagcctggccgagctgctgctgacgatgcggcgggatcggctgcacatcgtgctggtgagcgacgggcggcggccgctcggggtgatcacgctggatgacgtgctgcacgcggtgatcggggagcggtcgcatgccgcggcgcactcggcgccggtggtggcgcggccgcgctga

SEQ ID NO: 2851 - DNA, 1338 bp, Actinoplanes utahensis
atggacggcctgctcctgaccgcggtgctcccgttggcggctttcgcgctgctgacggcgggcaacgcgtttttcgtggccgccgagttcgggctggtcactgtcgaccgggcggagatcgaccagcgtgccgcggagggtgaccgccgggcccggacggtccggaccgcactgcactcgttgtctttccagctctccggcgcccagctcggcatcacactgaccgcactgctgaccggctatctcgccgagccggccctgtcccggctgatcatgccggcggtggagccggtcgcgggggccgccgcggagaccgtcacgcacgtcctcgccctggtcgtcgccaccctggtgtcgatgctcttcggtgagctggtgccgaagaacgccgcgctggcccgcccgatgggtctcgcgctggccaccgcgggcccgctgcgcggcttctcccggctcttcaagttcatgatcgccgcgctcaacggaacggcgaactggctggtccgccggatcggcgtcgagccgcaggaggagctggccagcgcccgctcgccggaggagctggggctgctcgcggcgatcagcgcccgggccggcgcgctgcccaccgagaccgcgacgctgatgcgccgcaccatccggttcggtgagaaacgcgcggccaaggcgatgaccccgcgggtcgacgtggtggggttgaaaaccacggcgagcgtcgccgacctgatcacggtggcccgggagaccgggcacacccgatttccggtgtacgagaacaccctcgacgtggtgaccggcgtggccggggtgaacgacgcgctcggcgtgccacccgaacgccgcgccgcgacccgggtgtcggtgctcgcccgggagccggtctacgtaccggagagcctcggtctggacaaggtgctcgccgcgctgcgggccgcggacgccgacctggcgatcgtggtcgacgagtacggcggcaccgacggcgtcgtctccgtcgaggacctgatcgaggagctggtcggcgagatcgccgacgagtacgacaccgagctcgacgagaccggcaccgccgagctgaccgcccccggcggggagaagacctacctggtcgacggcctcctgcgggaggacgaggtgctggagcagaccgggttcgcgctgcccgaggggccgtacgagacgctggccggcttcctgctggcccggctcgggcacatcccggtggtcggtgagtcgctggaggagcacgggtgggagttcaccgtgatggaggtcgaccggcaccggatcgaacaggtccgggtcgtggccccgcccgaggagccggccgatgactaa

SEQ ID NO: 2852 - DNA, 2148 bp, Actinoplanes utahensis
atgggctacgcgcagatcatcgccaccgtcttgtcggtggcggtcacggtggtggccgtcgccctggcggtgcgcgccgttctcaccatcaccagggtgatccgatcgggccagccggccccggagcggttcaccgacaagggcacccggaccaagaccctgctcagggagtcggtcgggcacacacggatgctgaagtggagcgccatcggcgcggcccactggttcgtgatgttctccttcatcatcctgtcgtcgctggttctcgaggcgtactgggaggtggtcaccccgcacggcgaactgccgctgatcggtgagtggtcgatcttcgggttcgtcaccgagtggttcgggatcctcggcacgatcggcatcctctacctgatcctcgtgcgccagcggaacaagccgggcgccaccaagcgcagccggttcctcggctccacgatgtggcaggcgtacttcgtcgagtcgatcatcgtgggcgtgctggtctgcgggttcctgatccggggcttcaaggtcgccaacgggacgttcccctacccgacctgggccgccccgctctcccacgcgatcggcggcgtgctgcccgcctggcacgacgcgcccacctgggtcgccctggtcaagctgctcatctcgatgggctggctgatcaccatctcgctgaacccgacgatgggcgtggcctggcaccgcttcctggcgttcttcaacatcttcttcaagcgcagcccggagaagccggccggttcgggcctgggcgctttgaagccgatgatgagcgagggcaagccgctcgacttcgaggaggccgacccggagaaggatctgttcggcgtcgcccaggtcgagcagttcacctggaagggcctgctggacttctccacctgcacggagtgcggccgctgccagtcgcagtgcccggcgtggaacaccgccaagccgctctcgcccaagctgctggtgctgtcgctgcgcgaccacgcgtacgccaaggcgccctacctgctggccggtggcggcaaggacctgaccggcgaggagaaggcgaccgaggcgcagctggcgcacatggacgtgctcgcgctggccgagggcaaccgcccgctgatcggtggcgtcgacgagaacggcgtgatcgacccggacgtgctctggtcctgcaccacctgcggcgcctgcgtcgagcagtgcccggtcgacatcgagcacatcgaccacatcgtcgacatgcgccgctaccaggtgctgatcgagtcgtcgttccccagcgaggccggcgtgatgctgcgcaacctggagaacaagggcaacccgtggggcgccccgcagaacacccgcgaggactggaccaagggcctcgacttcgaggtgccgcgggtcggcgagaccgaggacttcgattacctgttctgggtcggctgcgccggcgcgttcgaggaccgggcgaagaagaccacccgggcggtcgcgacgctgctgcacgaggccggtgtgaattacgccatcctcggcgagggcgagacctgcaccggtgacccggctcgccggatcggcaacgagttcatcttccagatgctcgcccagcagaacgtcgagacgctcaccgaggccttcggggatcggaaggtcaagcggatcgtcgccacctgcccgcactgcttcaacaccctcggcaacgagtacgagcagctcggcctgaaggtcgaggtcgtacaccacacgcagctgctggcccacctggtcaaggaggggaagctcaccccggtccagccgatcgacggtgacatcacctaccacgacccgtgctacctgggccggcacaaccgggtgttcgacgcgccccgcgaggttctcggggagaccggcaacctcatcgagatgccgcgcaactccgagcgctccttctgctgcggcgccggtggcgcccggatgtggatggaggagcggatcggcaagcggatcaacgtcgagcggaccgaggaagcgctggccaccggggcgaagacgatcgcggtgggctgcccgttctgctacacgatgatcggcgacggggtgaccggcaagggcaagcaggaagaggtcgaggtggtcgacgtggccacggtcctgctgcgctcgctcaagcaggaagcttaa

SEQ ID NO: 2853 - DNA, 264 bp, Actinoplanes utahensis
gtgcccaagtcgcaggttcgtaagaagaaggtctacaccccgccgtcggacatccgccccgcggtcaccgcggcgtccaagaagccgagcccggtctggctgccggcgctggcggtggccctgatcgtcgtgggcatcgcctggctggtcgtctactacctctcctcgcagcagtacccggtggagagctggcggtactggaacctggcggtcggtttcgggtgcatggtggcttcgctgggcattctctcccgctggcggtga

SEQ ID NO: 2854 - DNA, 777 bp, Actinoplanes utahensis
gtggcttttcgagacgcttggcgcgtggttctggggcgcgccgcgggcggccggcagaccatctggtcggtcggcgtgccgctgatcgcgctcgctgccggcctgctcttcaccacctccgcgaccaccgccgacggcaccgcgctgcgcgacgaccggcgcccgcaactggcccaggtgatcgccgacaaacgggaacggctgaccgccaccgagaaacgtgaggcggcgctgcgggccgaggtcgaccaggagaccgcccggctcgccgaggtcgacacgccggtcaaggtcgcgcggcagcaggccgacgcggtgcgcgagccggccggcttcaccgccctgcacggccccggcctcaccgtcaccctgaacgactccccgcggcgcggcaccgacttcggcgacaacgcgcccgacaacgacgatctggtcgtccaccagggcgatgtccaggccgtcgtgaacgccatgtgggccggtggcgccgaggccatgacgatcatggatgtccgtgtgatcagcaccagcgcggtacgctgtgtgggcaatacgctgctccttcacggtcaggttttctccccgcccttcaagatcaccgcaatcggcgaacccacagcgatgcatcgcgcgttggagtccgcagaaggagtcagacagttccgtgaggccgttgccgacttcggcctcggctacacggagaaaccggaaaaggacgtgacagtgcgggcgtacgacgggtcgaccgacctccgatccgcgcaggcggcccagtga

SEQ ID NO: 2855 - DNA, 333 bp, Actinoplanes utahensis
gtgacgaccccgcccgctgagcagccagccgccccggccggacgcggacgccaccgcgcacccgacgccgaggcacagaccgcatacatcccgcgcctgagcgacgcgtcgcccgacggggtgcccggcggcccgctgaccccaccggtcggcctcggcgccaacgtcagcccgagcccggcccgatcggcacgcaacccggccgcatcggacaccgcgattctcaaagccgacgccgcggctcggcagcggatcgcggcggcgcagatcccggcgcggagcacctcgcacgccgaggcgacccagacgccgcgcaccgatctagctagctag

SEQ ID NO: 2856 - DNA, 1935 bp, Actinoplanes utahensis
gtgaccggtgccgcttcggctgcccgcccctacgagccggcgccgggcggccccgcgccgaccggcccggccacgcccggcagcccggcctacggaccgacctccggcagccgtgtgcacggatcggccacctccggcagcccggctcacggatcagctgccccggggcacggacccggcactccgggcggccctgtctccggttccccggggcacggaaccggcactccgggcggccctgtctccggttccccggccccgagcagcccggcctacggatcggccacgcccggcagcccggctcccgcgttcggcagcccggctcccgcgttcggcagtcccgcttccgtcgcacccggcagcccggtcggcggctcggcctccgtgcccgggtggacggccgacaccggcaagccgtccggcccggcctggacaccggcggccgagtcgaccgcgagcgccggctgggatgccgagcccacccgccagaccgccccggtgcccggccgccgcgacgcggacccggccgtcccggccgccggaaacccggcgatcccggccccggtcccgactgtcggcgctccggccgcggcggcccgggtggccgcctcctgggatccggaggccaccgggcggatcgagaccggccccgccgccgcgtccacgacaaccagctggccggctgcccaccaggccccggaaaccccctgggatgccactcaggcgcccgcgaccccgtcggccaccccgtgggcaccccaggccccgacgcttccccccgcggccccctccggccctccggccgccccgccggccgcggtgagtgcccccaccgcaccggtgccggccgcctctccgccgcagatgggctcaccgaacacccgctggatgagcaacgagcccaccgagatcgccccgccggtcaaccccaacccgtccgagacgcagatcatccggaccatcgacgcgcccaccggcatcctgcccaccctgtcgccggacaccccgctgcccggcaagctgaccgcgctgccgcccggcaaggcggccgccgccgcccgggacgccgccggtccggaggtcgcgctgggcgccgcctcggtggcggccaccccgaaggctccggccgacgagccgctggagcccaccctggaggagcctccgaagcgcggcgagaaggtggtcaagctgcgtccggagcagaccgacgagggctacaagagcgtctactccgagctgacccgcccgaccgcggcctcccggctgcggacgggcatccgcggcgccggcgagctgatgatcactttcggtctgatcgtgctgctgttcgccggctacgaggtgttcggcaactcggccgcggtgcaggacgagcaggatcatctcgcgcaggagctggaccagtcgtggaacgacccgaccgtctcgccgagcaatgcggtgaagggcccggccgctcccggtgacaacctggtcggccgtctctacatcccgaagctcgacaaggagtgggtggtcgtcaacggggtccgggcgcaggacatcaagtacgccccgggtcactacccggagaccgcgctgcccggccaggtcggcaacttctcggtggccggccaccggatcaagaagatcttctggcggatcgacgagttgcagcccggcgacgtgatcggcgtcgagacccgcgactcctggtacgtctaccaggtgtacggccagcaggtcgtgaagccgaaccaggtcgaggtggtcgacccggtgccgaacgagcccggtgtcgccccgacgaagcggctgctcacgctgaccacgtgcaacccgaagttcaacaactaccagcggctgatcgtgcacgccgagctggtcaagtcggtgccgcgggaccagaccaagccggacgccggcatgccggccgagatgaagacgaaggcctga

SEQ ID NO: 2857 - DNA, 297 bp, Actinoplanes utahensis
atgtacgcctggatctggcgcaagctcccgggacagctgtggagcaagctggccatgtcggtcgtgctgctcggcacggtcggctggctgctctggaatgtgatcttcccgaaagccgtgccgctgttgcccttcgacgacgtgcaggtcggcgacacctcgcagatcgacccgaactcggtcacccccgaccaggtgccgggcccgtcggccgacccggacgcgtccgcccccgacgtgatcccgtacagcacgtcctccaaccaccccgaccccggaggcctcgccggtgactga

SEQ ID NO: 2858 - DNA, 660 bp, Actinoplanes utahensis
gtgactgacgtccgcattctggtgatcgacaactacgactcgttcgtcttcaacctggtgcagtatctgggccagctcggcgccgagtgcgaggtgcgccgcaacgacgagatcaccgtcgaggatgcggggcggctcggcgcggccggcatcctgctgtcgccgggcccgggtgagccgacccgcgccgggatcatgctggacgtgatccggtcgtacgccggaaagatcccgctcttcggggtctgcctgggtcatcaggcgatcggggcggcgttcggcgcgaccgtgacccgcgcgccggagctgctgcacggcaagacgtcgctggtgcaccaccgcggtgtgggtgtgctggccgggctgcccgacccgttcaccgcgacccggtaccactcgctggccgtgctgccggagacgttgccggacgagatcgaggtgaccgggcgcaccgattcgggtgtggtgatggcgatgcggcaccgcacgctgccgatcgagggcgtgcagttccatccggagtcggtgctcaccgagggcggccacaccatgctggcgaactggctggccgcctgcggtctgccggaggcgctggagcgggccccggaactggccgccgaggtggagacgcggcggcggtcggcgttcgccaccgcctga

SEQ ID NO: 2859 - DNA, 1776 bp, Actinoplanes utahensis
atgacggcgcaggcccgactgctcggtggcaggtatcaggtcggcgagctgctcggctatggcggcatggcggaggtgcaccggggacgcgacctccgcctcggccgggacgttgcgatcaagatgttgcgcaccgacctggcccgggacgccactttccaggagcggttccggcgcgaggcgcagaattccgcggccctgaatcacccggccatcgtggccgtctacgacaccggcgaggagatttccgccaccggtgagaagcttccgttcatcgtcatggagttcgtcaacggacgcactctgaaagaggtcctcgcccaggagcagcggctgcagccgcgccgggcgctggaaatcatcgccgacatctgcgccgccctggagttcagccaccggcacggcatcatccaccgggacatcaagccgggcaacgtgatgatcacgcagaacggccaggtcaaggtcatggacttcggcatcgcccgggccctggccagcggcgccaccacgatgacccagaccagcgcggtgatcggcacggcccagtacctgtcgcccgagcaggcccgcggcgaggcggtcgatgcccgctccgatgtgtacgcggccggctgcgtcctgttcgagctcctcgtcgggcacccgccgttcgtcggcgacagcccggtcagcgtggcctaccagcacgtccgtgaggacccgcgggcacccagctcgatcagccgcgacatcccgccggacgtcgacgcgatcgtgctgaaagccctggcgaaaaacccgctgaaccggtaccagagcgcccaggagatgcgcgccgacgcgctgcgcgcggtctccggccgcccggtcatggccaccccggtgatgaaccaggccgagacggtcgccctgaacaacggtccccgccagtggcagccgcaggccgccaccaccatgcagcggccgatgccggccgcggtggccggcggccgtccggccgacaacaggcagtcctgggtgtgggccgcgctggccggcctgggcgtgctcgtggtgatcgtgctcggcgtcgcgctggcgctgaacaagaccgacaagggcggcgatcagaaaccggccgcgcaggcgcaggtgcccgacctcaaggggctgacggcgggccaggcccagcagaaactgagccagctcgggttcaccaacgtcaccgccggtgatccgaaagaggacaaggactgcaagggcgaggtgagcgaccagaccccgcccaaggggaacacggtgccggtcaccacccaggtcacctacaccatctgcaacccgccgaagtcggtgcaggtgccgaccggtctggtcggcggcaccaagtcctcggccgagcaggccctgcggaacgtcggcctggtgccgaagttcaagcccgtcgacagcacctcgccgaaggatcaggtcgtcaacgtcgaccagcagggtgattcggtcccgccgggcaccgagatcgtcgtgagcatctcgaacaacgagctcatcctggtgccggacgtggtcggccgcagccaggacgcggccatggcgctgctgcagaacgccggcctgaacgtcaccgtggaaaccgtgaacaccggcggtgacccgggcaaggtgatcagccagagccggaagccgaagagcaaggcgaaggcgggcgatcccatctcgatcaccgtcgtcagcaccgacaccccgccgagcggagacccgtcacccgacccgacggacacctccggcaccggtggcggcatcgggaccaacgagtag

SEQ ID NO: 2860 - DNA, 1374 bp, Actinoplanes utahensis
atgatccgcccgggggtcacgctcggtgggcgctaccgcttggaggagcggatcgccggcggcggtatgggtgacgtgtggcgcggcacggacgacgtgctgggccggacggtcgccgtcaagatcttgctgcccgcgctgctcgacgagcccggcttcgccgagcggttccgcggcgaggcgcgcaccatggcgacgatcaaccaccccggtgtggtcgacgtctacgactacggcagcgatcagcaactcgcgttcctggtgatggagtacgtcgagggtgacgcgctgtcgcgcacgttgagccgggtcggccggctcaccccggcccggaccatggccctggtcgcgcaggctgccgacgcactgcaggccgcgcatgcgaacggcatcgtgcaccgcgacgtgaagcccggcaacctgctggtccggccgaacggcacgctggtcctgaccgacttcgggatcgcccggtccgccctggtcgggcagctcacggtggccggcgcggtgctcggcacggcgtcgtacatctcgccggagcaggctgccggcgacgtggccaccccggcctccgatgtgtatgccctcggtgtggtcgcctaccagtgcctgtccgggcaccgcccgttcgacggcgccaccccgatcgagatcgcgatgaagcatgtccgggagacgccgcgcccgctgcccggcgacatcccgccggcggtccgcgccatcgtggagcgggcgctctccaaggacccggccgcccgctggcccagcgccgcggcgatggccgcggtcgcccggcaggccgccgcctccctgaccaccaccgtgcagccgccgatgaaccaccaccagccggtgcgggccacctcgtccggtccggcgccgcaggcccgggcctcggtgccgcggcccatctcgggtgcccggggcgccgcatcggtgccgtcctcggtgccgccggtccagtcggtgccgccggtgccgtccgtgcccccggtacagtccgcgccgccggtaccgacgccgatgccgccgcactaccgtccgccgtccggtccgccggtcagcaactacccgcagcagccgatgcggatgaccaagcccgagggcgccttcggccgtcaggtgctgatcgtgctcgccgtcgtcctggcgcttctcgtcctgctgtgtgccggggtcatctcgttcctgtatcgacatggcatcagcgcagccgccgccgaaaacgcgctgggtgatcgcagcagctcggcggctatcctccgcatgggcgtggccgacgaccgggtgtcaacggcgtcgtaccgtctaatgaaggccggcccccagctcggcctgatccgaccgaacgaaggacgacagacgctatga

SEQ ID NO: 2861 - DNA, 1500 bp, Actinoplanes utahensis
gtgaacgcccccctccgccgtgccggcgtggtcgtcctcgtgctgttcggactgattttcgcgaacctgaactgggtgcaggcctacaaggccgacgactaccgcacggccgcccgcaacccgcgggtcaccgtggccgaatatgagcgcccccgcggcggcatcgaggccgacggcaccccgctcgccgagaacaaggcgaccgacgacaccctgaagtacctgcgcgtctatccgaagaaggagatctacgcgccggtcctcggctacaagccggtcaacctgggcgccaccgggatcgaggagagcgagaacgacttcctctccggggagagcgacaagctcttcgccgaccggctcagcgacatgttcaccggtgaggagaccggcggcggcaacgtgttgctgtcgctgaagaccaaggcccaagaggtcgcctggaagcagatgaccgagaaccagcgcggcgccaagcggggcgcggcggtggccatcgacccgcgcaccggcgcgatccaggcgctcgtctcgatgcccagctacgacccgaacctgctggccacgcacgacaagaacgcggcggccaaggcgtacaaggagctgaacgcgaccaaggatcagccgatgctgaaccgggcgctgtcgcagaccctgccgcccggctccacgttcaaggtgatcgtctcggcggcggccctgcagaacgggtacgacgtcgacagccagatcccggccggcagcgtgtacgaggagagcggtgcggtgatccgcaacgccgaggacgaggtctgccccggcagctcgatctcgctcaaggaggcgctgaccgagagctgcaacaccgggtacgccaagctcggcgtgaagctcggcgcggacaaggtcaaggccgaggcgaaggcgttcggtttcgaggacgagtcgctcaaggtcggtgacctggagagcggcgacggcctgccggtggcggcgagccacaccggcgcgatcgcgaacccggacggcaccaccgacaagggtgcgctggcccagtcctcgatcgggcagcgcgacgtgcggatgacgccgctacagggtgcgctgatcgccgccacggtggccaacggcggcgagcagatgcggccgtacctggtgcagaagctggtcagccaggaccggcggacgatctacacggtctccccgaagaagcgcagcaacccgatcgacggcgaggtcgcctcgaagctcaaggaaatgatggtcagtgtcgtcgagaacggcaccggcaagaaggcgaagatcgacggtttcaccgtcggcggcaagaccggcaccgcgcagaacgcggagggcgccaacccgcacggctggttcatcggcttcgcgttcaacgacaagggcgaggcggtgtccgccgtctgcgtcatgctggagaacgtctccggcggtcacgccagcgccgaagctgcccggatcgcaggcctgatcatgaaggccgcggccggcgggggagggaactga

SEQ ID NO: 2862 - DNA, 1503 bp, Actinoplanes utahensis
ttgaccgcgcccgccgtaccggctccttcgccctcgtccacgggtgagctgtcgcgtatcccgggattgaagacccgccgtaacgccgagctgggcctgctggccttcgccatgctgctggtcgcgacgttcgcggccaccgtcgaggcgaaccagttcgacaagctcagcggtacgttctgggtgccgccggccctgctgagcctgctgttcctggggctgcacgtggtggtgcggttcgtcgcgccgtacgccgacccggtgctgatcccggcggtcgcgctgatcaacgggatcggggtggcgttcctgcgccgtctcgacctggcccgggcgatcgccaacaaggacccgatcccgggggtgttcgccggcaccggcggacgccagctggcctggacattggcgtcgctgatcctggccgcggtgctgctgctggtggtgcgtgaccacaaggtggtctcccggtacgcgtacacgctgggcctggccggcatcgtgctggtgatgatcccggccgtgctgcccggcagcctctccgaggtgaacggcgccaagctgtggatcaagttcggcgcgttctcgatccagcccggtgagttcgccaagctggcgctggtctccttcttcgcgtactacctggtccgcaagcgtgaggtgctctcgctggccagccaccgcttcctcggcctggacttcccgcgcggccgggacctgggcccggtgctcaccgtgtggctgctcagcctcctggtcctcgtcttcgagaaggacctgggcaccgccctgatgtacttcggcctgttcgtggtcaccctgtacgtcgccaccgagcggtccagctggttgatcatcggcctgctgctgttcttcggtggcgtctacgtggcctacctgctgggcgccgcgatcggcggtccgttcgccaacttctacgaccgtgcccaggtctggctggacccgttcgcgaccgccaactacgagcgggtgggcggcagttaccagctcgtccagggcctgctcgggctgggcaccggcgggctgttcggctccgggccgggcggcggctcaccgggcttcatccccgaggtccgcaccgacttcatcttcgccggcctgggtgaggagatcggcctgttcggcctctccgccctgctggtggcatacctgctgatcgtcgagcgggggctgcgcgccgcgctgaccgtgcgcgactcgttcggcaagctggtcgccggcggcctggcctttacgctcggcctgcagatcttcgtgatcctcggcggtatcaccgggctgatcccgctgaccggtcagaccaccccgttcctgtccgccggtggctcctcgctgatggcgaactggctgctggtggcgatgctgttgcggatctcgaacgcggcccgcggcccggccgccggcggcggacaggaccgccccaccggaccgaagaaggcccccacccaactgcacggcgccatgacggaggtgatcaagccgtga

SEQ ID NO: 2863 - DNA, 1437 bp, Actinoplanes utahensis
atgaccctgaccctgcgctatgccgctcagagcgaccgcggtctgatccgagacctgaaccaggactccgtctacgccgggccgcggctgcttgctgtcgcggacggcatgggcggcatggccgccggtgacgtcgcctccaacatcgtcatcgccgcgatggcgccgctcgacgacgacgtccccggggacgcgctggtcgacgccctgcggcacgccgtcgggacggcgaatcagcagctgcgggacaccgtcgacgccaacccgcagatggaggggatgggcaccacgctgaccgcggtgctcttcaccggcagcaagttcggcatggtgcacatcggtgactcccgcgcctacctgctccgcaagggcgagttcgcgcagatcaccaaggacgacacgtacgtccagatgctggtcgacgagggccgggtcagcccggaggaggcgagcagccatccgcagcggtcgctgctcacccgggcgctggacggccgggacatcgaccccgagtactccgtgcgccaggtgctcaagggcgaccgctacctgatctgcagcgacggcctgtccggcgtggtcagcgccgagacgatcggccagacgatgcgggagatcgccgacccgaaggcctgcgtcgagcggctcgtgcagctcgcgctgcgcggcggcgggccggacaacatctccgtggtgatcgccgacgcgaccgacgcggacatcgtcgagcaggcgccgatcgtcggtggtgcggcctccctcgaccggggcaacacgacggtggccgacagctccaccccggcgtcccgggcggccgcgctcaagcaggcaccgccgcgcccggcccagccggagccggacgccttcgaccgcgacgccgagcccgccggtcacccggtgcggaccggcctgctggtcctgctggtgctcgcggtgctgggcggcggcctctgggccggctggcggtacacccaggatcagtattacgtcggcgcgaccgacgacggccaactcgccatcttccgcggcgtccccgggcagatcgccgggctcgacctgtcgacggtgagcgaggccagcacggtccgcctggacgagctgaccacggtcgcccaggatcgggtcaagcagggcatccacgccggcagcaaggtcgacgcgcggagcatgctgaccgagctgaccagcgacgagccgtccaatccgaacctgaagccggtctgctcggtggccaccgcaaccccggccgcctccaccccggccggcgccaagccggccgtgacgaagccggcgggggcgaagccgtccgcttccggcgcggtgcgcccggccgcgaccacggcgtcgtccgctccggcgatcgcgccgagcgttcaaccgtccgagagcgcgtccaccgcgccggtcgacacgaccggctgccggaccgccgactga

SEQ ID NO: 2864 - DNA, 483 bp, Actinoplanes utahensis
ttgcccgaattcgtcctcaccgtcgcccggttcggcttcctgatcctgctgtggatcttcgtgttcacggtggtcggggtgatccggcgggatctcttcgcgggcgcccggtcgaagagcatcgtcgccagcccccggggggtgggtggcgtggtgctccccggtcggccggcgaaggtgaagcgcggtaaggcggctcggcagctggtggtgaccgccggtcagctggccggcacccggatcacgctcggcgaggcgccgatcacgatcggtcgtgccgaggattccaccctggtcatcaccgacgacttcgcgtcggcccggcacgcccggctggtgccgcgggacgggcagtggttcgtcgaggacctcggctcgaccaacggcacctacctcgatcgcggtaaggtctccggacccacccccgtccccctcggcgttccgatccggatcggacgcacttctcttgagttacggccatga

SEQ ID NO: 2865 - DNA, 849 bp, Actinoplanes utahensis
gtgccggctgctcttgggctgaggatgcgcaagcggcggccggataccatcatgtcctcggaacccgaggaggagccggtgagcgtgctgcagcgctttgagaagcgattggaaggcctggtcgagggggccttcgccaaggtgttcaagggtgtcgtgcaccctgtggagatcctgaatgccatgcagcgggaggccgaggcgcacaaagcgatcctcgccggtggccgcaccctggtgcccaaccgctacgtgatcgacctttcgccgtacgaccacagtcgcctggcgccgtacgcggccgccctggcgcaggagctggcccagtcgcaggccgagttcatcggcgagcaggcctggacggtctacggcgacgtgatcgtcgagatcgagcgtggcgacggcctggacaccgggatgttccgggtgaccgcggaggtctacaccggtggcgaggtcgccccggtgcagcagccggcctacgacgccggtccgcagtactcgccgtacgaccagcagcacggtggcggttacccgccgcacggcggtggtgctcacggcggcccgcgcagcgtcggcctggtctccggtgacggccggacctacccgctgcagatgggctcgaccgtgatcggtcgcggcgaccaggcgaacctgcgcctgccggatgtcggtatctcgcgccgccacgcgcggctggactacgacggcaaccaggtggtgctgaccgacctcggctcgaccaacggcacgatggtgaacgggcagcgggtctccgccgtggcgctgaacccgggcgacatgatccagctcggcaccaccacgctgaccttccgagtggacggctag

SEQ ID NO: 2866 - DNA, 327 bp, Actinoplanes utahensis
gtgaacaccgctgtggacgtgactctgatcggggccctcgccgccgtctggctgaccgccggactgctcgccgacggcctcgcggcggccagcaccgcgcattcgatgcgccgccgggccgggttgctgaccgtcctggccggtgcgggggcggcgttgttcgtcgcggtgccggtggccaccgccctgctgccgggcgcctcgtcggcgcccgtcgcggccctgctcccggccgtgccggccgtggtcgtgctgaccgccggtctccgcaaactgagctgggtgcgccggggcgcgggcgccttcgccaccgccccgcaggcctag

SEQ ID NO: 2867 - DNA, 114 bp, Actinoplanes utahensis
gtgctggtcaccgtcatcggcatccgggccgcgatccggcacagccgcctggccccgctggtcctggctcccttggaccgcgtccgccagcgcgcccgagccaccacccactga

SEQ ID NO: 2868 - DNA, 462 bp, Actinoplanes utahensis
atgacgattggttcggagaacctcagcaacggttcgtcgacggcgcaggaccgtttcagcggaggcgtgagcgcctaccggcagggccgccgcgaagccctgcacgccgacctcggcgacggggaactcctgtcccgcggcagctcaggtctgccgacccggtcacccggccactcccgcagcatcgattcacgcagcctggagccggcgagcgccctggaccgcgcggccaaactgccctcgctggacctgcacggcctgaccgagccggtcttctcggccagctggagcgacggcacgaacacgtcgatggccgaccacccgctgctccgcggcctgctgctggaactcccggcacgcggcacgctgccgccgtccgactggctggaccgttggttcgaggccgcgcgctccatcctggaactgctctacgtccaggaggccaagaaacaggcccactga

SEQ ID NO: 2869 - DNA, 225 bp, Actinoplanes utahensis
gtggaacttgaggtcaaaggactccgggtcgacctgagccgggcggagtggttcaagagcacccgaagcggtgcagacagcgacaactgtgtcgaggtggccttcgtcgacggcgccatcgcggtgcgcgactccaagaaccagtccggtccggcgttgatcttcacgtcggccgagtgggacgcgttcgtgcacggcgccaaagacggcgaattcgatctctga

SEQ ID NO: 2870 - DNA, 303 bp, Actinoplanes utahensis
gtgctacttcctcggtccggtgatgtcatccacgtgacgaaagcggcgagcgtccaattcgcaacaccgatgctcttccgggtcatccgggtacacgactggccgacgtacgagggttgggtctggctcgacggctacgagctcaactcggccggcgacgccgtggaacgccgctcaatctttgtgcaggtcaacgggttacgcccggtcggcaaggcgcccgacccgcgcgcccgcaacggccgtcagccggccacgcgcccgagcgtggcacccgtccggccggcgcgggctccccgctga

SEQ ID NO: 2871 - DNA, 621 bp, Actinoplanes utahensis
atggacgagcgccagccggactgggatcccgcgccgcaggacgatctgtggaccggtcgcgcagaggtgcgcccgtccgctttcgatcagaattcggaccgctatgaggtcgacgaggaggtcgagggcgagccggccggccactggtggatgccgatcgtggtcggcaccgtcggtctgctcctgcttgcgctgctggggtacggcatctacgtgatcgcgctgcacgcccggaaaccggctccgacgacgactgtggcgccggctgcggtgaccaccgtgccggccacgtcggccaccccgacgacggcgcccacgacgaccgcggtctccgtcccgccgacgccggtcgagacgacggtggtgaccaccgagccggccaccaccgaggtggcggtgccggctctgcgcgggatgccgctggccgacgcgaagatcgctctgcagcgcagcggcctggggtaccgggtgatcggccggcccagcgacgcggagccgggcacggtgatcgacagtgacccgccggagggccgggtggtcccgccggacacggcgatcaccctcgtcgtcgcggccgggcgaacgggtggcccggccccgacgacgccgaacggcggctag

SEQ ID NO: 2872 - DNA, 1464 bp, Actinoplanes utahensis
gtgcgcggcatggccgacaagggctggacagcacaggccgccgcggcggccggaatagccgccggcgcgggcgccgcgcaactgggtctcggctacgggctcggcgtgatcgagtggccggccaccgcgaccgcgaccgacagcacctggctcaacagcctgggctgggccacctggatcaccgcgagcgccaccgtgctgggcgcggtgatcgccgggcggctgcgcgccgaccgggccggacgctggcgcaccctgtggcggatcgcgctggccgcggccgccgcactgggcgccctggtctcggtggccctggtcgcgctgcccgcccgctccgcggcgcagaccccgctgttcacccattcgccgcaactggtggcggtcagctactccctgatcgggctcctcgccggagtgatcgtggcgttctgggcggtctcctcggcgccggtcgcggccaacttggtcggcaccgcggcgtggctctgggcgctggccatcgccggggtcaccgccgagctcagtaccaaccggaacctggagacgtacctgacgagctggcagttcgccgaggatcagacgccggtgcggtacggcgggatctactggccgagtgccctgctcaccctggccgcggcgttcgccatcgggctggtcgcggcctggccggcggcccgccgcgggcggctggggctgggcacggcgacctccggggcggtcgggccgctgctggtcgcggtcgccttcctggcgctggcgccgctgctgacccaggccgcggggccgttgcagtccgcctatctgatggcgccgtacgcggttctcgccgggctcgccgggtccgccctgaccgtgtcgctggggcggagccggggccgggcggcggcgagtgggccgctgaccgagccgacgggtgggcccgcggcggccgccctgcccgccgcgccgtccgcacccgcgtcgtccgcgtcgtccgcgacctcggcggtttccgctgcaccgtctgagccttccgccacccgatccgcatcttccgccacccggtccgcgtcctccgctacgcggtccgtagctcccgctgcgccgtctgtggcgtctgcgccgtccatcgcgccgtccgccgcgccttcggtgccggaaagcgcgccgcggggacgctggtcgcccttcggcaggaagcgcccggccgaagagccggccgcgccggccacccaaaagcccgccgaaaagcccacggcccagcccgccgaaaaacccgcaccgaagtctgcggccaaaccgaccggaaagactgcccctaaaccggtcgaacccctcaccgcgggcctcgccgatccggagctggccgccgccgcccgctcgagcaaggccaccaagcgcacccccacccgcaaggagccccgctccacgatcaccccgcccccggccaacccgccgatcgcgcggatcaacccggacagctga

SEQ ID NO: 2873 - DNA, 570 bp, Actinoplanes utahensis
atgaccgtcagcacgcgcgagttcgagggtctgcagttccccgcggccggcacctatgagctggacgcggcgcacaagcgggtcggcttcgtcgtgaagcacctcatggtcagcaaggtgcgcggccagttcagcgaggccagcgccaccatcgtggtcggggagaacccgctggactcctcggtcaccgcgaccatcaacaccgccagcgtccagaccggccaggtcgaccgggacaaccacctgcgcaccggcgacttcttcgaggccgagaagtacccgaccatggagttccggagcaccggcatcaagtcgcacgccggcaccgagttcgtcctcgacggcgagctcaccatcaagggcgtgaccaagccggtcgagctggtcgtcgagttcgagggcgccaccaccagcccgtacgggcagcacgtcttcgggttcagcgcgaccaccgagatcgaccgcgacgactgggggctgaactggaacgtcgccctcgagagtggcggcttcatggtcagcaagaacgtcaagatcgagattgagggcgaggcagtgctgcaggcctga

SEQ ID NO: 2874 - DNA, 507 bp, Actinoplanes utahensis
gtgcctgttatcgtggaaggcgtgaacaccgatctggacgacccccgtctcaccgcggtcggcctgctggccgaggcgtacacgggtctgatgaaccgcctcgccgcacagttcgaggagcaccgcctctccaccgtcgagttcgaggtgctgatgcgcctcgcccgatcgcccggcaaccgcctgcggatgaccgacctcgccggccagaccactctctccaccagcggcgtcacccgcgtcgtcgaccggatggaacgcgacggcctggtccgccgcgaggcctgtcccagcgaccggcgcagctcctacgcggtgatcaccgacgccggtcaggagcgcctggcccaggtccttcccggacatctggaactggtccagcggtggtatgtcgggcttctcccgcccgagcatttcaccggactgctcgactcgctacgcacgatccgcgacgcggtcaacccgagcgcgacagcggggagtgcggaagcggtcacgcaggcctga

SEQ ID NO: 2875 - DNA, 1347 bp, Actinoplanes utahensis
atggcgtccgatcagggcttcggtgccctgctgcgcgaacttcggcggcgtgccggcctgactcaggaggagttggcggtccgcgccgccatcggcgtgcgtacggtccgtgacctcgaacgtggccgggccgcccggccgcagcggaccaccgccgacctgctggcccgcgccctgggcctggccggcgccgaccacgacggtttcctggccgcggcgcggagccggccggccggcaccccgttcctgcgctccgcgccgaccgacgacctgatcggccgggacaccgacatcgccgagctgaccgcgagcctcgccgacccggccgggccgcgcggagtgaccctggtgggggccgccggggtgggcaagacgagcctggccgcggtggtcgcccggcggctggccggggcctacccgggcggggtggccggggtcgcggtggccgacggggtcaccgccgccgagctgaccggcggactgctcgccggcttcggggtgagccggccggaggaactcgccgggccgggagcggcccgggtggcggagcccggcggggccccggtgctgctgttcgtcgacgcgctcgaccgggcgcccagcgtggccgccgaggtgctggccgaactgctggcggaggtgccgcagctacgtttcctggccaccgggcgggcggcggccggactcgacggtgaacgggtacggacggtgctgccgctcgccatgccaccgggtgggtcggtgaccggcacggtcggcgagctgatgacgtacccggcaatcggcctcttcctggaacggctgggccgggtgcggcgcagccacctggcaccggacgagctcgtgccgctggtggcactggtccggcggctgggcggggtgccgctggcgatcgagctggccgcggcgcgcggccgggtgctgaccgtcccggagatcctggcgagctatgccgaggctccggtcacccacccggcctccgccgagcccggggtgatcgcgttgccggtggtggtgggggagacgtatcggctgctggcgccggcggagcaacgggcattgcggttgctggcgacatttcgccagcggtggtcacgcgagtcggccgaggcgctgctgaccacatcggacaacccgggcggggaggtcgtgcatctgctggatcgcctggtggcgctgggattgctcaacgtgagcggcgatccgggggtgcgcttccggctgccgtccgcggtccgggattacgccctcgcgcgggccgctgtcgagggtgagctggcggatgaccgattccggcatgccggagcgccggccggacggccggccgccgaggcggacatgccgtag

SEQ ID NO: 2876 - DNA, 1158 bp, Actinoplanes utahensis
atggtggatttccggctcggtgacgagctcgaggatttgcgtggcagcgtccggcagttcgcccgtgagcaggtggcgccggtcatcgccgagcactacgagcacaagacgttcccgtacgacgtgatccgtcagatggggaagatgggcctgttcggcctgccgttcccggaagaggtcggcgggatgggcggcgactacttcgcgctctgcatcgcgctggaggagatcgcccgggtcgacagctcggtggcggtcaccctggaggcggccgtctcgctgggcgcgatgccgatcttccggtacggcacgccggcccagaaggagcgctggctgcccgccctcaccagtggcgaggcactggccggtttcgggctcaccgagcccggctcgggctcggacgcggccgggaccaccacccgcgcggtcctcgacgagtcgaccggcgagtgggtgatcaacgggaccaaggccttcatcaccaactccgggaccgacatcaccagcctggtcacggtcatggcggcgaccgggacgaacccggacggcagccgtgagctgtccaccatcatcgtcccgtccggcacccccggcttcaccgtcgccccgcagtactcgaaggtcggctggtgcgcgtcggacacccacgagctgtccttcgacgacgtgcgggtgcccgcggagaacctgctcggtcagcggggccggggcttcgcccagttcctgcggatcctcgacgagggccggatcgcgatcgccgcgctctccgtcggcctggcccagggctgtgtcgacgagtcggtggcctacgccaagcagcgggtcgccttcggccgtccgatcggcgacaaccaggctgtgcagttcctgatcgcggacatggagctgcgcgcccacctggcccgcctcggctactacgacgcggccgcccggatgctggccggcgaggacttcaagcggtacgcggcgatcgccaaactgaacgccagcaacgcggccatggagaacagccggtacgccacccaggtgcacggcgggtacggcttcatgaacgagtcggcggtcggccgcttctaccgggatgccaagatcctggagatcggcgagggcacctcggaggtgcagcgcatgctgatcgcccgcgggctcggactctag

SEQ ID NO: 2877 - DNA, 1524 bp, Actinoplanes utahensis
atggacggcgacgcgctcgcgcaggttcgcaagcgtgtgctggccggcggcgccgagcgctaccacgccgccaacgcgggcaagggcaagctgttcgtccgcgagcgggtcgcgctcctggtcgacgagggttccttcgtcgaggacgggctctatgccaacagtctggccgagggactgcccgccgatggtgtgatcaccggagccgcccggatcgacggccgcgacgtgtgcgtgatggccaacgactccacggtcaaggccggctcctggggcgcccgcacggtggagaagatcgtccgcgtcatcgagcgggcctaccagctcggcgtcccgatgatctacctggtcgactcggccggcgcccggatcaccgaccaggtcgacctcttccccggtcggcgcggtgccggcaagatcttccatacccaggtcaaggcgtccggctcgatcccgcagatctgcgcgctgttcggcccctcggccgccggcggggcgtacattccggccttctgcgacgtcgtcgccatggtcgagggcaacgccagcatgtatctgggctccgaccgcatggtcgagatggtcaccggtgagaagacgacgctcgaggcgatgggcggcgcccgggtgcactgcgccgagtccggtgtcggccacttcctctgcaagaccgagcaggacgcgctcgacgtcgtgcgcggctatctgtcctatgtgccgcagaactggacccagcgtccgccttcggcgtccgcgacggattcgtccggggcggatctcggcgcgctggtcccggccagcgagcggcaggcgttcgacatgcggcggtacgtcaagggtctggtcgacgacggctcgttcttcgagatccaggcgctgtgggcccgcgagctgacggtcggcttcgcccggctcgacggcgaggtgatcggcgtcctgggcaacaactcgatgttcaagggcggtgtgctcttcgtcgactcggccgacaaggcgagccggttcgtgcagctctgcgacgccttcaacatcccgctgctgttcctcgccgacgtgcccggcttcatggtcggctcggccgtggagaaacagggcatcatccggcacggcgccaagatgatcaccgcgatctccgaggccaccgtgccgaagatctgcgtggtggtgcgcaaggcctacggcgccgggctgtacgcgatggccggccccggtttcgagccggacgccaccatcgcgctgcccaccgccaagatcgcggtgatgggcgccgaggccgcggtgaacgcggtctacgccaacaagatcgcggcgatcgaggacccggacgagcgggccgccttcgtcgccgagcgtcgcgccgagtacgagcgcgacatcgacatcatgcgcctggccagcgagctcgtggtggacgccgtggtggaacccggcgacctgcgggccgagctgatccggcggttctcggcggcccgtggcaaggaccgcacgttctcccgccgccgccatggcgtcacccctgtctag

SEQ ID NO: 2878 - DNA, 1449 bp, Actinoplanes utahensis
atgttctggaaccagccaattgaatatgcggaaatccttgccgaccattttttgaaaggcatcacttttctcatgaagaagacgtgggttcgtaagacgctgagcgtcgggatcatggctgccggcgctctgctgatggccccggccgcggctcaggccggtgggcacagccacggcggcttcgctccgtcggccgcccaggacgggatcacccagttctcgtcgaccaacctcggcgcgctgaacggcacgcagttcgcggctccgctcaccgccccggtgaacatgaacggcaacgcgatcgcgctgggcgggatctcgtcggccaacggtggcggcgtcaaccacatcgccgagggctcccgggcccgtcgcggtggcagcggcatcgcgcagcagtcgggcggtaacgtcggcttcctgaacggcacccagatcgccgtgccggtgaccgtgccgatcaaccagaacggcaacgcggacagcctgttcggggtctcctcggcgcgcggtagcggggtcaaccacgtcaccgagggtgcgcacgtcgccggcggtggctggaacgacggcatcgcgcagcagtcgggtggcaacgtcggcttcctgaacggcacccagatcgccgtgccgatcaccatcccgatcaaccagtgcggcaacgcggacagcctgttcggggtctcctcggcccaggccacctgcgccaacttcatcggtgggccgaccgggcgcagcgtccgtcagggcggtgccggcgccaacaactggggcggcggtgccggcgcccacaactggggcggcggtgccggcgccgacaactggggcggcgggaaccgggtcggcggctgggacaacggcatccgccagtccagcttcggcaacatcggcttcctgaacggcagccagttcgccgcgccggtcgtcgcgccgatcaacgcctgcggcaactcgctcggctcgctgctgggcaccgcgaactcgcaggcgttctgcgtgaaccggatcggcgacagcggcccggtctgggtcaagggccaccggcacggccaccacggcgccgtccagggtgaccagggccagggcaactgcggctgcggcgacgacaacaccggtgacgtccgcggcgaccagggctacaacggtggcggcgaggctcccgcggtcaacgacgacaacgggtacagcaacgacgacaacagcggtgacgtcaagggcgacaagggcggccacaagggtcacggtcacaagggccacaaggccgacaccggctacggcgacgtcaaggacgacaacaacggcaacgccaagggtgacaagggctacggcgacgtcagcccggacaagtacggcgactccaccggtggccgcaacaacatcgagagcacctcggtcagcggcctgaccggcagcctgggtggtctggacctgctcgacagcctgcgctga

SEQ ID NO: 2879 - DNA, 1062 bp, Actinoplanes utahensis
atggcgggctggagggtcgagcgcacgccgcgcacggcgtcccgctccgtgccggtcacccccggcggctccccgctcatgccgccccacagccagggggcggagcggcggccggagcgccgcgccggacgtgccggttcccggtgggtcctgcgtgcattcgtcgtcggtggcctggccggggcggcctggctgctcaccggcgccgccgcgcacgccgcgggtaccggtgccgagccggtgcccgtcgcgcaggccgcgggcctgaccgaaaaccccgcgggcctgaccgagaagcccgccgggctgaacgaggagccggcgcccgtggcgcaagtcgcgggccccggtgaaccgctcggggccgtgctcgacggggatgtcgagtcggcacccgcctggctcgacgagaaccaggaccgcacggtcggcgatctcctgaaggcggccgtccagccgctggagacccaccaccacatcgtcacgtcgcttccggcggcgacgcacgacgagcccgcgatcgacccggaaccccacggtgaacccctgccgacgacggccgcaccgctgcgttccagcagcggtaccgcggacgcgcagcggcagccggcgaccgagggccccgcggctgattccgtggcaccgcctgccctgtcgcacccgttcgccccggtgggcgagccggccccggcgaccttcgtgaagagggcgggcaccagggtgacccgtgccccggccggcgacaaaccggcccggcgggtcacggccctgtcccggtcacgcgtccatcggcatgccccggccgcccggccggttgcgccggaggcgatccgccaggacatgcccggcggcgacggacccgcgcccgcgcggacgaacctcggggcggtcagcggtatcccggccagcagtggctcgggtggcaacacggagaacggctcgtcggccgttctgccgacggggaccgcgaacggcccggtggcctgccaccgctgcccggtcgcgcccgatgtcgacgcccggcgcaacgacgccgtggcgccgaccgtctcacctgactag

SEQ ID NO: 2880 - DNA, 879 bp, Actinoplanes utahensis
atgcccgcgatcagcatccgcgaggtggcaccccgcgacggcctgcagaacgaggagcccgtccccaccgacggcaaggtcgccctgatcgacgcgctcagcgacaccggcgtcggccggatcgaggcggtctcgttcgtgcacccgaaggcgatcccgcagatggccgatgccgacgaggtctggtcgcggatcacccgcaacccggacgtccgctactccgcgctgatcccgaacacccggggcgcccagcgcgcgatcgccgccgggttccgtgagatcgaggtggtggtgtcggccagcgacacccacaaccggcgcaacctcaaccggtccaccgaggagtcgctggacgacatcgccggactgatcccgctggtgcacgcggccggtgccaccctcgaggtgatcgtcgcgacgagcttcggctgcccgtacgagggtgacatccccccggagcgggtggccggcatcgtcgagcgggtccggcgtgacggcgccgaccggatcgcgttcggcgacaccaccgggatgggcaccccgcgccgggtccgcgacctgctcgccgaggtgcggccggacctgctgcacttccacgacacccggggcaccggcctggccaacatcgtgaccgcgctggacctgggcgtgaccgagttcgacgccagtgccggcggcctgggcggctgcccgtacgcgcccggcgcctccggcaacgtggccaccgaggaggtggtgcacatgctgcacgacatgggactcgataccggtatcgatctcgacaagttgatcgaggccgccgaactggccgaacgcctggtcggccgtacgctttcatcaggcgttctgcgagccggcccgcgtacccgtctcgtgtga

SEQ ID NO: 2881 - DNA, 1332 bp, Actinoplanes utahensis
atgatcgagtcgctgctcgtcgccaaccgcggcgagatcgcccgccggatcatccgcaccgcgaaccgcctgggtatccgtaccatcgcggtccactcggaagccgacgccgacctgccgttcgtacgggaggccgatgaggccgtctgcgtcggcccggccaacccggcgcagagttaccgcaacgccgacgccatcctggccgccgcgaagcagaccggggcacaggccgtgcaccccggttacggcttcctcagcgagaacgccgatttcgcccgtaccgtcgaggccaacggtctgatctgggtcgggcccggcgccgacgcgatcaccgcgatgggcgacaagatcaatgcccgcaacctgatggccgcggccggcgtgccggtcgccccgggcaccgcggagccggtggccggcgtcgacgacgccgtggcggcggccgcgacgatcggctacccggtgatggtcaaggccgccgccggcggtggcggcatgggcatgggcgtcgccaccgacgaggccgccctgcgcaccgagttcggcaaggtacaggcgttcgccgagcggatgttcggcgacggctcggtgctgctggagcgctacttcccgcgggtgcggcacgtcgaggtgcagattctgggcctggccgacggccgggtggtcgcgctgtccgagcgggagtgctcggtccagcgccgcaaccagaagctcgtcgaggaggccccgtccccggcggtcacgccggagctgcgggaacggatgaagcaggctgcggtcaaggccggcgaagtggtgaactaccgcaacgcgggcaccgtcgagtgcctgctcgacccggccaccggcgagttcttcttcctggagatgaacacccggctgcaggtcgagcacccgatcaccgagctgatccacggcatcgacctggtcgaggcgcagctacggatcgccagcggcgaggacgtgtccgaccagttcggacagtcgggtcacgcgatcgagttccgggtcaacgccgaggacccgaagcggttcctgcccggccccggcgcgatcaccacctgggaggagcccgcgggcttccgggtcgactccgggtacaccgagggcaacacggtcaccccgttctacgactcgctgctcgccaagctgatcgtcttcggcgccgaccgcgaggaagcgctggccaaggcacgggacgcggtggccggcttccggatcgccgggccgaagaacaacctgccgttcttcgccgagctgctggagaacgacgagttccgctccggggactacgacaccggcatcgtcgcccggatgaagggggtgaagtga

SEQ ID NO: 2882 - DNA, 606 bp, Actinoplanes utahensis
gtgacgacggtagatcagcggcaccggacgaccccgccggcgccccggcggcggtcacgccgcgacgaaatcctcgagatcgcggtcggtctgttcgccgcccgcggctatcacggcgtgtcgatggacgacatcggttcggcggccggcgtcaccggcccggcgttgtatcaccacttcgccggcaaggaggcgatgctggtcgccgcactgattccggtcagcgagagcctgctggagggcggccgtgagcgggtcgcccggcacccggccgaggccgaggcggcgctcgccgacctgatcgacttccacgtcgacttcgcgctggccaacccggcggtcatcgccctgcacctgcacgagctggaccgcctgccggaggagccgcgccggcagatccgccggttgcagcgtctgtacgtggaggagtgggtcggcgtgctcaccctgctgcggcccgagctggaggcctctgaggcccgggtgctggcgcacgccgcgttcggcctgatgaactcgacgccgttcctgggcggcgaggtggagcgccgccgccgggccgacctgctgcgcgaggccacgatgcacgcgctgaccggccgctga

SEQ ID NO: 2883 - DNA, 2781 bp, Actinoplanes utahensis
atgaagaccgcggaagagctgtggaacgttctcgacgaggcccaccatctgccgtacggtgcggcccagatcgccctggtcgagcaggtgctgcggcacgtcgacggtgccggtgacccggcgctggccttctacacccggctgttcgcgaccacggcgtacatctacggcggcgagtcggtgaagtcgttcgccaccttctcctggtgcgtggccgacttcgacaagaacccgcagccgtaccacgagcgctggacgcacaacctgctctggctgttcaagacgatgatcagcgcgctcacccggttcccggagatcccgctcgcccggacgtacgcggtgctcgacgacatggagcgccgctaccgggagaccgggcacggcatgcagccggtatacaaacaccgctacctggtcgcccggcatctcgggctgaccgaggaggcggagggctggttcgagaagtggcggaccgcgccgcgcaacgcgctctccgactgcgcgggctgcgaccccaccacgatggtcatccacctcaacacccgggagcggttcgcggaggccgtcgagctgtccgcgccggtgctggccggcgagctgaactgcaacgagcagccgcagagcatcctcagcgagctgatggtgtcctatctgcagaccggccacctgaccgacgctgcggacgcgcaccgccggtcctacctggtcgagcgcggcaacctggccgatctggccggcatcggcgaccacatcctgttctgcgcgcggaccggcaacgaggcccgcggcctggagatcctgcagcggcacatcgactggctcgaccgcgcgccgtcgccgtccgccgggatgcacttcgccgcgaccggggtggcgctgctgcgccggctcgccgcgcggggccacggcgacacgctgatccggcgcagcgggcggccggatgtgaccgccgaggcgctggccgccgagctggagacctacgcgaccgggctggccgcccggttcgacgcccgcaacggcaccgggcaccagggcagactggtggccgagacgatgaccgccgaaccctacggggtcgacctgccgctcgccccgaccgcccgtcgtccggccccgaccccggccgcggcggtggcgccgttgcgggaggcgacgccggagccggtcgagatcccggccgacctggacgagaccgagctgctcgacctggccgagcggttcctcgacgacgatgcgcacgacgagttcgccgcggtgctggaggcgttcgccaagcgcttcccggacccgatcgacccgctggcggccggccggctctggacgttccgcggcgtcgccctgcccgatgacgaccacgacggcaccatcgccgcctgggagcaggccgtcatcgccttcacccgggccggtgacgggagccgggtcagcgccctgcgcgcccggatcgcgatcgagcgggcccgggccgagcgcggcgagccggccgacgacgtggcgctggtccggtccgacgtcgcctaccaggaggagcacggcaccgcccgggaccgggcgaacgcctggctgcggctgtccacgatgtacttcatggcggacagcctggacgaggcgaacgaggccggcgaccgcgccgacgcgtatgcggccgagtcgggccggccgcgccgggtggcgtaccacgcgctggtgcgcgcccggaaccgcggcgccgcgcaccggcacgaggaggcgggggcggcggcccgcgaggcctggtccttctatcgcgaacacggtccggcacgggccagcgccgaggcggccaccatcgtggggcaggtcagcgacgatccggccgaggtggtcgccgcgatgaccgagtcgctgaccaccgggttgcccggcgccgagctggccggccatgcgctgcgcggccgcgcgttgatgtccctggagcggccggaggaggcgatcgacgacttcgtcgaggcggtcgcgatctgtgccgagcacgacctggagcagccgggggtcttcgcccggcaggatctggcccaggcgtaccgggcggccggccggctcccggaggccgccgaggtggccgaggaggcggtgctcgggttcgagcgactgggcttcccggagccgctcaacgacacgcggtacatgctggccggcatttatcgtgatcttgacgacaccggtcgggcgctggagctgtaccgccagctgatcgaggtgctggccgacaacccggccgggcgcggccagctcggcgaggacgccggcatggtgctctacaagctggaccgggacgccgaggcggcgctgaccttccgggccgcggccgaggcgctgcgcgaggccggtgatccggctggcgagctgcgcgtgctgcggcggcggctgatggcgttgaactacgccgatcaggtcgacgaggccgaggagctgatcggcctggttacccgccggtacgaggaactccccgccgaactggccgaacagccgggcgtccagtggggtcgcgcgatcttcgccttcgaggtcggcaatctcctgatgcgccggggccggtgggccgaggcgctgccccatctggacggcgcgcccgagcggctgcgggcgatcggcgcgcgggacgacgccgaccgggtgactgggatgctttccgaggcgttgttgcgctccgggcgaccggccgaggcgttggctctgatggagtcgctccccgaggagaagcggttcgccgagttgtacgccgaggcccgggcggccgtcgatcggctgaacgaccgttaa

SEQ ID NO: 2884 - DNA, 1809 bp, Actinoplanes utahensis
gtggtcccggcaccgcgccgctccgaaataaccccggttttgtcgtaccgaaccggtaccgtgcgcgccgtgagcaacacgttccaggtcgatctacggggcatcgtcgacctgctcagccatcacctctacgcgagcccccgcgtctacgtccgtgagctgctgcagaacgcggtcgatgcgatcaccgcggtcggccccgaccacgccggccgggtcgagatcaccaccggtcccgtcctgcggatcaccgacaacggcatcgggctcaccgaggcgcaggtgcacgagctgctggccaccatcggccgcagctcgaaacgcgacgagctgggcttcgcccgccacgagttcctcggccagttcggcatcgggctgctctcctgcttcctggtcgccgacgagatccgggtgcacacccggcgccagggcgccgccccggtgctctggacgggtcactccgacgggcgctacgacgtgcggcccggcgacgatcgcgagccggggaccacggtcaccctgctgccgcggcgcggcgccgagcactacctgaccggcgcgacggtgaccgagctggccgagctctacggctcgctgctgccggtcgaggtgaccgtcgacggccgccgggtcaccgccggcacggtgccctgggcgctcccggccggtgagaggaacgcgtacgcggacagcgtcctgggttttcgtcccttcgacgtgatcgacctgaacgtgccgggctccggcctgtccggcgcggcgttcgtgctgcccacgccggtgaacccggccagtcgtggcggccaccgggtctacctcaagcggatgctgctctcggagagcgtcgaggggctgctgcccgactgggcgttcttcgcgcgctgcgtggtggacagcaccgagctgcggccgaccgccagccgggaggcgctctacgacgacggcatgctggccgagacccgcgaggcgatcgccgaccagctgcgtggctggctggtccggctctccgcgaccgatccgcgccggttgggtcagttcctgcagatccatcacctcggggtgaaggcgctggccctgcacgacgacgagatgctgcgcctggtcgagcagtggtatccgatgcagaccaacatgggcgagctgaccctggccgagttccgggcccgcttcggcgcgctgcgctacgcggccaccgccgacgagttccggcagctcgccgccgtcgccgccgcccaggacgtcggtctgatcaacggcggttatgtgtacgacgcggatctgatcgagcgtctcgccgccaccgatcccgaggttcgcgccgagcgcctcgatccgaccgacctcaccacccgcttcacggccgtcgacgcggagagtgagctgcggctgcgtccgttcctgtcggccgcccagcgccgcctggacaaactcggctgcgaggtggtggtccgggctttcgacccggtcactctgccggcgctctacctggtcagccgggccgccgcgttccacgacgagttcaccgccagccgggatcaggccgacgacctgtggggcggcgtgctcgacgcgctctcctcgacggtgcccaacgaccggccgcagctggtcctcaaccaccgcaacccgctgatccgccgggtcgccgcgctcggcgacgcggagttggccgcgctggccgtcgagtcgctctacggtcaggcgctgctgctcggccaccacccgatccggccggccgacgccgcgctgctgaccacctcgttcctcggtctgctggaccgggccgtccccggtgaggggacccgatga

SEQ ID NO: 2885 - DNA, 900 bp, Actinoplanes utahensis
atgtccgttgcgaacgatccggcgcaggcgctgcaggcctatgcgcatcccgacaaactggtcaccaccgagtggctcgccgcgaacctggacacgcccggcctggtcgtcgtcgagtcggacgaggacgtgctgctctacgacaccgggcacatcccgggcgcggtgaaggtcgactggcacctggagctcaacgaccagctcacccgggactatctcgacccggccgcgttcgccgcgatgtgtgaggccaaaggcatcggccgggacgacacgatcgtgttctacggcgacaacttcaactggtgggcggcgtacgccctctgggtcttcagtcttttcggacatcgcgacgtgcggctactcgacggcggccggcagaagtgggtggccgaggggcgtccggtgacccgggacaagacggtccgggagcgggccggctacccggttccggtgcgcaacgacgcggcgatccgggccttccgggaccaggtgatgggccacatcgccggcgggcgaccgctggtcgacgtgcgttcgccgcaggagtacaccggcgagctgacccacatggcggcgtatccgcaggagggcgcgctgcgcggcgggcacatcccgggcgcggtcagcaagccgtggaagtccgcggccaacgacgacggctcgttcaagtcgcacgacgacctgatcaagatctaccaggatgagctgggcctggagtcgggcgacgacatcatcgcgtactgccggatcggcgagcggtccagccacacctggttcgtgctgcaccacctgctgggatatccgcaggtgcggaactacgacggctcgtggaccgagtggggcaacctggtccgcgcgccgatcgccaagggcaccgagccgggtggcctgagctga

SEQ ID NO: 2886 - DNA, 771 bp, Actinoplanes utahensis
atggcctggcgcagcttcgtggcgatgggtgacagcttcaccgagggcatgtgcgacgagtatccggacggcacctaccggggctgggccgatctggtggccacccggctcgcggtcgactcaggccccgacttcggctatgccaacctggcgatccgcggccggctgctggaccaggtgatcgccgagcagctcgagccggccctggcgatgcggcccggcctggtgagtttcgcggccggtggcaacgacatcctgcggccccgggtcgatccgcacaccctggtcgaacggatcgatccggtgatcgcccggatccgggccaccggcgccgacgtgatcatgttccggttcgccgacgtggccgtgcacatcccgggcgggcagcggatgatcggcagccgcgcggccgtcctcaacgacggtttccgggagatcgccgaacggcacggtgcccacctggtcgacctcttcgccgaccacgcctacctgcaccgcgacatgtggagcgacgaccgcctgcacctgtccgccgccggtcaccggcgggtcgccgggcacgtgctgaccgcactcggcgtcggtgtcgaggaggagtggatgctggtgccgccggctccgcagcccacgccgtggcggttggcggtgagcgccgacctgcgctgggcccgcgagcacctggcgccgtgggtgagccggcatctgcgcggtcgctcgtcgggcgatctggtgaccgcgaagcgtcccgtgctggccccgatcaacgactga

SEQ ID NO: 2887 - DNA, 390 bp, Actinoplanes utahensis
atggccaggcggatagcggacgtgatgacccgtcgagtggtgtacctgcccgccgacacccccctcgacgaggccgcgcaggccatgcgggatcagggcatcggcgacgtggtggtgacccaggggccggccgtgtccggcatcgtcaccgaccgggacatcgtggtgcgtgccgtggccgagggcctggcgccggcgaagaccacgctcggtgcgatcgccacccgggagctgatcatgatcgaggagagcgcgacggtggaggaggcggtgcaggcgatgcggtcccgtgccgtgcgccgcctggtcgtctgcgatgccgagcgcaatgcggtcgggctgctcagcctcagcgacatcgccctgctgccgctgccctccgccgcctga

SEQ ID NO: 2888 - DNA, 420 bp, Actinoplanes utahensis
atgccgccgaagctggccgagatcgtcgaggagttcgcctccgcgccccgcgaggtggtcctggagatgctgctggagttctccgacgcggtgccgcccctgccggccgatctggtcgggcacgagggcatggagcaggtcccggagtgccagacccagttcttcctcaaggccaccgttcagccggacaccacggtgaccacgtggttcgactgcccaccggaggcgcccaccacccgcgcgttcgccgggatcctggccgagggactggccggcgcgtccgccaccgagatcctggccgtgccggacgacctctacgcccggatgggcctggcccaggcgatcagtccgctgcggatccgcggcggcacggcgatcctggcccggctcaagcgccagatcaccgaacagcttccgtaa

SEQ ID NO: 2889 - DNA, 642 bp, Actinoplanes utahensis
gtggacatccaggtctggtccgacgtcgtctgcccgtggtgctacatcggcaagcgccgcttggagaacgcgctggccgatttcggcgagtcggtcaccgtcacctatcgggcctaccagctggacgcctccccggtcccccagccactgccgatcaagcaggcgatggcctcgaaattcggtgacgcggaccgggccgagcagatgttcgcccacgtcacggaaatcggcgcgagcgagggactgactctggacttcgaccgggtggtcgccgccaacaccttcgcggcacaccggctgatcgcctgggcggccgggcatggccggcaggcagaggtgctggacgcgctgcagcgggcctacttcacccacggggccgacatcgggtcactgcccgtgctggcgaagatcgccgcctcggccggcctggacggggcggcggccctgggctacctgacctcggaggccggcacggcggccgtcaccaccgacctggccgcggcacgggagctgggcatcacgagcgttcccacgttcgtcgtcgacggcaagtacgccatccagggtgcccaggaatccgccaccctgctgtccgccctggccgagatcacccgtcgcgaagccgtcgaagccggtcaatag

SEQ ID NO: 2890 - DNA, 588 bp, Actinoplanes utahensis
atggcggggacgggtcggggtaatgatggcggcgtgatggggagcctgcagaccgaatccgcacagtctcgtcttgatctgctggccgggccggtggccaaagcgctttcggtgtggccggaggacgcgccggtcgatgtcgatcaggtgctggtggcgtcgatcgatccggggctggcggataccgccgcgttctgcgaggcctacgggatcccgctcggtgagtcggcgaactgtgtgatcgtggccgggcgccgcggggagacggtgaggtatgcggcctgtgtcgttctggccaccacccgggccgatgtgaacgggaccgtgcggcggctgctcgacgtgcgcaagtgcagctttgcgccgatggacgaggcggtgtcgctgaccgggatggaatatggcgggatcaccccgatcgggctccccgacgactggccgatcctggtcgactcccgcgtggtcgccacgccgcacgtgatcatcgggtccggggtgcggcacagcaagatcgccgtggccggtccggtcctcggcgcgctacccggcgcccgggtgatcgaggggctcgccaaagaggccggctag

SEQ ID NO: 2891 - DNA, 600 bp, Actinoplanes utahensis
atgtctgagatcgtggaggaggcgaacgcagcggaacgccgcaaggctcgtatcggcacggtcagcgggctcgcgctgctgaccggcaccaccgcgatggcagcggtcggcggtggccatcactcgttcccggccaccgctctcctcgccctgctggctctcggcatggcccactcgttcacggtggagatccagcgccaggcgcatcgccgcaccggccgctggggccggcccgacacggtcaacaccgccctgctgtccggctgggccgtcgcctcactgaccgtcgccgtgctcccctacccgccgaccgcgatgcgtgtcatgggcctgctgctgaccaccagctacgtcgccgcctgcgcctatttcgtagccgaacgccaccgcgcgacagccgcccgccgctccacgcccccggcaccgcacccccgcgaggacaccgcgatcgaggccgcccacagccttgccaccgccacgctccagcccggtgagaacaccgcgatcgaggccgcccgcaccttggccaccccaacgccgcacccgagcgagaacaccaggcgggagacggcccgcatgtcgctggaagccgcgccttga

SEQ ID NO: 2892 - DNA, 573 bp, Actinoplanes utahensis
gtgcgggaggcccggtgggccggtcaggcgatgctgtcgccggccggttggcggccggtggaggccattgtcggcaggaccaccatcaggggcggcaccgccaccccgttcgtttcgatcggtagttccggcaccggcagccagtccaggccgagcggctcgggaccgctgccgtcgtcgggactgacccggggctcgccgtcggccaccgacaccgcgaacaccgatgtcatgcccgacggatacggcatctccaacacataccgcaggtcgctgaccaccaggccggtctcctcgaagacctcgcgccgcacggcctcctcgggggtctcaccgggctctaccccgccgcccggcagagtccaccactcgccgccaccggtgcgccggctgcgctcgtggaccatcagcacccggccgtcccgcacgatcacggcggcggcccgtcttcgttcgctcacgagtacgcaggctaaccgtcggaaaccgcgagcgcaggaatcgatcgctcctctgtggatatccgacagcggcagaacgggcaaatacggaactacgccttcggaacggtga

SEQ ID NO: 2893 - DNA, 522 bp, Actinoplanes utahensis
ttgcccgttctgccgctgtcggatatccacagaggagcgatcgattcctgcgctcgcggtttccgacggttagcctgcgtactcgtgagcgaacgaagacgggccgccgccgtgatcgtgcgggacggccgggtgctgatggtccacgagcgcagccggcgcaccggtggcggcgagtggtggactctgccgggcggcggggtagagcccggtgagacccccgaggaggccgtgcggcgcgaggtcttcgaggagaccggcctggtggtcagcgacctgcggtatgtgttggagatgccgtatccgtcgggcatgacatcggtgttcgcggtgtcggtggccgacggcgagccccgggtcagtcccgacgacggcagcggtcccgagccgctcggcctggactggctgccggtgccggaactaccgatcgaaacgaacggggtggcggtgccgcccctgatggtggtcctgccgacaatggcctccaccggccgccaaccggccggcgacagcatcgcctga

SEQ ID NO: 2894 - DNA, 510 bp, Actinoplanes utahensis
atggcgctccagcccgtgagcggcgaccagggacacctctgggcggcagcggacgggccgctggggcgtggtttctgcctgaccctggtgcgcggcaggaagcccgttcaggtggtgcgcacggtcggcgggaaggcccacgagatggtctactggcgccagctggtcggaccgggggacggcgaggcggccgggcggcggtacttcgtcggcatggcccgcctgagccactggacgctgatcctccaggatggtgacttcgacggcggcctcgggatggacccggcgatcgccgggcggctcgccgccggtaccgacgtggtggtctgccgatgcgacagggccgggcgggggcgggtccggacctatcgggacggggtggtgggcaccgacgtgaccgatcacaccgaggaggcgatcaggctcgtcgagaaacgtgccgggatccggctgaccggggcgttgctggagcagaaacggtatctgctggtcaccgttccgaaggcgtag

SEQ ID NO: 2895 - DNA, 447 bp, Actinoplanes utahensis
atgccggcgccaacgacaccggccgcgacggccgacacgctggacggcatggatcgaatctcgttgccggtcgtaccggcggtggccgcggcggcgctcgtgccctggaccatcggcctcgccaccctcctgccgcgcaccgccacggcccggcactggaacatcgtctgggccggcctggacgtcgcgatcatcgcgggcctcgcgtcgaccagctggctggcccgccgtcgtgaccggcgggtcaccccggccgccgtcgcgaccgccacgctgatgtgcgccgacgcctggttcgacgtgtgcaccagcgacgccggcctgccgttcgccacggcctgtgccgcagcggcgatcgaggtggcggtcgccgccacctgtctggtggccgcgcgcgcggccgatccggccgaaggttttcgggcccggcaatcggcgtcaaggtga

SEQ ID NO: 2896 - DNA, 600 bp, Actinoplanes utahensis
gtgccggcggtgctgtggtcgcgacgcacgtggccggccgtcgccggcctgctgatcggcgcggtcctgtggctcgtgccggccgccctgacgatgaccatcgtcggcgccgggatgctgatcgggtcggagcacccgccgccgggactgggcggctcggagaagctgggcggcacggtcggcgggacggtcccgctcgtcgtggtgctgcccgtgctgctcgcgctgaccttccggttcacggtgtggcaccaggcccggctccgcctcctcggtgccgacctggcaccgcccgccgcgcggccgcccggcatgtcgcgccggagttggctggcccgtcaggcggtgtccgccaccacctggcggcaggtccgctaccacgcgctcggcggcgcgttcctgacagcggccggcgtcgtcgtgctggccggtctggtgttcggccccggtttcgtggtggccgcggcgctcagcggcaagggcagcctgctgcagcggtcgccgatcgcggccctcggcgtgggcatggcggtcgccgcgggttggctcgcccggggtgccgccgccctcgacctggcgctggcccgccggctgctctag

SEQ ID NO: 2897 - DNA, 510 bp, Actinoplanes utahensis
atgaacctcgggatgacccgcgccgcggtcgccgacgccgatcccgcggtgcgcgcggccgtcgcggcggcgcacgaggaggcgaagcaggcgctcgccgagctgcgcgacctcatccgcggcctgtacccggccgtcctcgacgagctcggtctggacgcggcgctgtccggcatcgcggcccgctccccggtgccggtgcgactggtggtcgacctgcgcgggcggccgccggcgccgatcgaggcggtcgcctatttcgtggtgtccgaggcgttgtccaatgtggccaagcacgcggccgcgacccgcgccgatgtcgtggtgcggcagcagcccggcggtctcaccctggccgtcgccgacgacggccggggcggtgccgacccggtgcgcggcaccggcctgcgcggcctgcgccagcgcgtcgagtcggtggacggcacgctcagcatcgccagcccggccggcggcccgacgtcgatccgggtgtccctgccgtgcgggtag

SEQ ID NO: 2898 - DNA, 639 bp, Actinoplanes utahensis
gtgcgggtagtgctggccgaggattcggtgctgctgcgcgacggcctgtcccggctgttcgcctcccgcgactgcccggtcgtcgccgcggtgggcgacgccgaagcgctgctgcgggccgtcggcgagcaccggcccgacctactcgtagccgacgtgcggatgccgcccggctacgccgacgaggggctgcgcgccgcgatccaggtgcgccggcagtggcccggggtgggcgtgctggtgctgtcccagtacgtcgaggagcggtacgccaccaagctgctcaccggcgacaccagccggctcggctacctgctcaaggaccgggtggccgacgtcgacgacttcgtctcggcagcccgccggatcgccggcggcggcacggtgctcgaccccgaggtcgtgtcgcagctgctggtgcgccgcaccggcccactcgaccggctcaccccgcgcgagcacgacgtgctcgccctgatggccgagggccgatccaacgccggcatcgccggcgccctggtggtcagcgagagcgccgtggccaagcacgtgaacggcatcttcgccaagctggggctcgccccggcggacagcgaccaccggcgcgtgctggccgtgctgcgcttcctcggcggctag

SEQ ID NO: 2899 - DNA, 489 bp, Actinoplanes utahensis
atggccgttgcgacagccgtcatggtggcacctgtcgccgcgctggccgacagctacgcgccgtgcaacaccatggaatccacagtcaaggccggtcagacatccaaggcccagtccattacctgcgtgcagaagccgacctgcggcgaatcttggggacagatctacgacgtcacgtgggacatggtggttcacaccggtggtgtcacggtcaagtcgatgaagatccacgtgacgcacacccggggtgaggacatcaccctcggcgtgaagaacatccgcggcaccaacgcggacatcaatatcggtgggaaagatctgattccggccaatcagaccagctggaccaagacctacgacatcacggacaggtacttcgcgaagaacagtctcggcttcgtcgacttctggctcgcgatctcctccgacaaggccaacggctgtagcggtagctcgacctggctccgctacgggctcaagatcgcctga

SEQ ID NO: 2900 - DNA, 135 bp, Actinoplanes utahensis
ttgtcgatgctgaagaaactcctcatcgtggcagcggtcgtcggtgccgccaccctcgtggtgaagaaggtcaaggcctccagcgacgagcgtgccctctggcacgaggcgaccaccgctcctgacctgcgctga

SEQ ID NO: 2901 - DNA, 441 bp, Actinoplanes utahensis
gtgggggcggcccgggtctccgaggcggtccgttcggcccgcagcacggtgtctccggccgccgcacgcggtccgcggcgggcccggctgaacctcaagcggatcgacccctggtccgtgatgaagttctcgttcgcggtttcgatcgtgctgttcatcgtggtggtcgtcgcgacctcggtgctctacctggcactcgacacgatgggcgtgtggacctcggtcaacagcagcctgcaggagctggtcaccgccggcggcggcaccgacccgtccagcggcttccggatcaccgcctggggcgtgatcggcacgtcgatgctgatcggcgcggtcaatgtcgtgctcttcacggccctggccacgctgagcgcgttcatctacaacgtgtgcgccgacctggtcggtggcatcgagctcaccctggcggaacgggactga

SEQ ID NO: 2902 - DNA, 165 bp, Actinoplanes utahensis
atggccccgccgcccggtgagcccgctgccggacaggacaccgaggccaagcgcccgggcggccccgctgtggccaaggcctcggcggccgttccggtcgtgaccaagggcaagggcgccgcgcccgggaccgccgccgcacgtccggcgacgctagctagctag

SEQ ID NO: 2903 - DNA, 2514 bp, Actinoplanes utahensis
gtgactgacacacccgaaccccccgacggcgacgagatccccgcggagaccggcggcggcgtgacgcagcgcgtcgagcctgtcggcctcgaggtcgagatgcagcggtcgtacctcgactacgcgatgagcgtcatcgtcggccgggcgctgcccgacgtgcgggacggcctcaagcccgtgcaccgcaagatcctgtacgcgatgtacgactcgggcttccggcccgaccgcgggtacgtgaagtgcgcgcgcgtggtcggcgacgtgatgggcaactaccacccgcacggtgactcgtcgatctacgacgccctggtccggatgggccagccctggtcgctgcggtatccgctgatcgacggcaacggcaacttcggctcgccgggcaacgacccgccggccgccatgcgctacaccgagtcgaagctgtccccgctggcgatggagatgctgcgggacatcgacgaggacaccgtcgacatgcaggacaactacgacgggcgtaccaaagagccgaccatcctgccgtcgcgcttccccaacctgctggtcaacggctcggagggaatcgcggtcgggatggcgaccaagatcccgccgcacaacctgcgggagatcgcggccgccgtccagtggtgcctggacaacatcgacgcggacgaggccaccacgctcgacgcgctcatcgagatcgtcaagggtccggacttccccacgtacggcctgatcgtcggccagcaggcgattcaggacgcgtaccggaccggtcgtggctcgatccggatgcgcgccgtggtcgaggtcgaggaggaccagcgtggccggccctgtctcgtggtcaccgagctgccgtaccaggtcaacccggacaacctcgccgagcgggtcgccgagctggtcaaggagggcaagctcaccggcatcgccgacatccgggacgagtcctccggccgtaccggcatgcggctgatcctggtgctcaagcgcgacgcggtcgccaaggtggtgctcaacaacctctacaagcacacccagcttcaggagaccttcggcgccaacatgctggcgctggtcgacggggtgccgcggacgctgaacctggcgcagttcatccgctactacgtcgagcaccagatcgaggtcatccgccggcggaccgcgtaccgcctgcgcaaggccgaggagcgcgcgcacatcctgcgcggcctggccaaggccctcgacatgctcgacgaggtcatcgccctgatccggcgctcgcccacggtggaggattcccgccagggcctgatgacgctgctcgacgtcgacgagatccaggccaccgcgatcctcgacatgcagctgcgccgcctggccgccctggagcggcagcggatcgtcgacgagctggccaagatcgagatcgagatcgccgacttcaaggacatcctggcgaagccggagcggcagcgggcgatcatttccgaggagctgggcgaaatcgtccagaagttcggggatgaccggcgtacccagatcatcccgttcgacggcgaggtctccatggaggacctcatcgcgcgcgaggacgttgtggtaaccatcacacgaaccggttatgccaagcgcaccaaggtcgacatgtaccggtcgcagaagcgcggcggcaagggcgtgagcggcgcgaccctgcgccaggacgacatcgtgtcgcacttctacgtgatctccacgcacgactggatgctgttcttcaccaacaagggccgggtgtatcgggcgaaggcgtacgaactgcccgaggcgaaccgtacggccaagggacagcacgtcgcgaacctgctggccttccagccggacgagcacatcgcccaggtcatccagatcccgaattaccaggtcgcgccgtaccttgtgctcgccactaagaatggtctcgtgaagaagacccggctcgacgaatttgactccaaccggagcggtggcatcatcgccatcaaccttcgggaggatgacgaattggtgggcgcggctctggtggcttcggaggacgatctcctgctcgtgtccaagcacgcccaggccatccgcttcaacgcgaccgacgaggcgttgcgtccgatgggccgggcgacgtccggtgtgatcggtatgcgcttcggcgacaacgacgagctcctcgccatggaggtcgtccgcgagggcatggatgtgttggtcgccaccaacggtgggtatgcgaaacgcacaccgatcgaggagtatccggtgcagggacgcggcggcaagggggtgctcaccgcgaagatcaccgaacgtcgtggtggacttgtcggcgctctggtgatcagcccggaggatgaactgtttgccatcaccagcaatggtggtgtcatccggactcccgtgaagcctgtacggcgcacacgggatcggaacacaatgggggtcaagctgatggacctcccagaaggtgtaaccatcgtggcgcttgctcgcaatgccgacgagcctgacgaacaggactag

SEQ ID NO: 2904 - DNA, 2181 bp, Actinoplanes utahensis
ttgacggtgtccaggccgctacacgcagccatcttcgtcacgctacgcggtttttccagccgatcacgatccgcgggccgtccgcggcgaccggcgtgcatggttccaccggtggtccgctctccccgcggcgtcatcaggccggtgcctcctgcgcgccgatcgttgctgggcgcctgccaaccccgtgcggggcccctggggtccggtgcgagaaagcggccgaggatggcagagaacaatcaggagtacggtgccgagtcgatcaccgtgctcgagggcctcgaagcggttcgcaagcgtcccggcatgtacatcggctccaccggcgagcggggtctgcaccacctgatctgggaggtcgtggacaacgccgtcgacgaggcgctcgcggggtactgcgacacgatcgacgtgatcctgctggccgacggcggtgtctcggtcaccgacaacggccgtggcttcccggtcgacctgcacccgaagctgaagaagccgggtgtcgaggtggcgctgaccgtgctgcacgcgggtggcaagttcgacaaccaggcctacaaggtctccggtggtctgcacggcgtcggcgtctcggtggtgaacgcgctgtccacccggatggcagtgaagatccacaagaacggctttgtctggcggcagaagtacaacgcctccgtcccggaggagctgatcaagggcgaggccaccgagacgaccggctcgacggtgcagttctggccggacccggcgatcttcgagacggtcgagttcgacttccagacgatctaccgccggctgcaggagatggccttcctgaaccgcgcgctcaccatcaacttcaccgacgagcgccccgagttcctggacgagaacggtgagccgcgcaaggtcaccttcatgtacgcggggggcatctcggacttcgtccggcacctcaacgcgaccaagagcgcgatccacaagaccgtgatcgagttcggcgccgaggacaacgaggccggcatgggcgtcgagatcgccatgcagtggaacgagtcgtacggcgagtcggtctacaccttcgcgaaccggatcaacacccacgagggcggcacccacgaagagggcttccgtgccgcgttgaccacgatcgtcaacaaatacggcatcgagaagaaattcctcaagggcgaccagaagctgtccggtgaggacattcgggagggtctggccgcgatcatctcggtgaccctgcgcgagccgcagttcgagggtcagaccaagacgaagctcggcaacaccgacatgaagagcttcgtgcagaaggtggcgaacgagcagctcgccgactggttcgaccgcaacccggcggacgctcgcctgatcatcaccaaggccgaccaggcggcccgcgcccggatcgccgcgcagcaggcgcgcaagctggcccggcgcaagtcgctgctggagtccggctcgatgccgggcaagctggccgactgccagtccaccgacccgcgcgagaccgaactgttcatcgtggagggtgactccgcgggtggctcggcgaagcagggccgttccagcaagtatcaggcgattctgccgatccgcggcaagatcctgaacgtggagaaggcccggatcgaccgggtgctgaagaacaacgaggtccaggcgctgatcaccgcgctcggcaccggcatccacgacgagttcgacatcggcaagctgcggtaccacaagatcatcctgatggccgacgcggacgtcgacgggcagcacatccagacgctgctgctcaccctcctgttccgcttcatgcggccgctggtcgagcaggggcacgtctacctggcctcgcccccgctctacaagctcaagtggaacaagcggggcgacgacgcgcaatacgcgtactccgaccgggagcgggacggcctgatcgcgctgcgtcagcagaagaagccgaacgccaagccggatgacatccagcggttcaagggtctcggcgagatgaacttccacgagttgtgggacaccacgatggacccggacacccgcaccctgcgccaggtgaccctggacgacgccgcggtggccgacgagctgttcagcgtgctgatgggtgaggacgtcgaggcgcggcgctccttcatccagcgcaacgcgaaggacgtcaggttcctcgacatctga

SEQ ID NO: 2905 - DNA, 567 bp, Actinoplanes utahensis
atggcgcacgacaagggcctggacaacgtcgcggtgcactggccgcggacgaaccagtactacgacccggtggctcccgccgagttcgtggacttcggcgcgatcgccgacgctccggagatcgccgcgcccaccggcgcgctggcgctgcacatcgccaagaccggcacggtccgggccaccgcgtacaccgaactggtcgatctgttgctcggtctggagggcgtgctctacgccaccgacgcggccgccgaggacgaggacccggtgatcgacccggacggctgcgcgtggatcgcgggcggcctggagcggttcgtcgagggccacgagaagttcggcgacctggtcaccttcgacaccgtggccgaggtgctgcggaccgcgatcgccagcgggcggctcgccgagcagcagctgcggtggctcgaccaccggctggcggcgctgcgggacgacgccggcaacgcgccgcactggagtttcgcgcgcaccgagctggcggtgctggccggtttctaccgccgatgcgcggagcggggcttcgccatcttcgccgactactga

SEQ ID NO: 2906 - DNA, 312 bp, Actinoplanes utahensis
atggtcctacgacggcggttggtcgttctgctcatgctcgtgctgggctcggttcccttcgcggcgagcccggtcctggctgccacccggtcggtgccgtgccaggccacggcggctcggtgccagcacgagggcctcgcggcccgcgaccgggtctgggacggcatgcgctggtcgctgttcctgggcgcgggcgccggggtgctgctgctgatcatcggcggcgagatgtggtggctgggccgcaacgggcagaccacgccggccaacccggcggccgctgaccggaaacgatcgtcacccgtcgcctga

SEQ ID NO: 2907 - DNA, 531 bp, Actinoplanes utahensis
gtgccggacgagatgagccctgctgctgaggccgccaagggcggaccggagctggcccgtgccgtgctcgacgcggctctcgcgaaacggcgggagaattcccggcagccgcgccggcgcaccggcggcggtggtgagaagcggctgcgcggctattccggtcccgggcctgacccgcgcgacccgcagctgttcggcacggtgctgcagcggctgatgaagacgcgcggctgggagcggcccaccgccgaggcgaccgtcttcggctcctgggagaaggtggtcggcgcggacatcgccgcgcacagccgcccgatcaagctggacggcggggtactgaccgtcgaggccgagtcgacggcgtgggccacccagctccggatgctttccggccggctgctgaagcagatcgccggcgaggtcggccacaacgtggtgacccggctcaacatccacggtccggcggcgccctcctggtcccgcggcccgcgccgggtgcagggccgcggcccgcgggacacgtacggctga

SEQ ID NO: 2908 - DNA, 1131 bp, Actinoplanes utahensis
atgcacgtacgccgggtcgagctcgtcgacttccgttcctacgagcgggtggccgtcgacctcgatcccggcgtgtccgtgctggtcgggcagaacggcatgggcaagacgaacctcatcgaggcgctcggttacgtggccactctggacagtcatcgggtggccaccgacgcgcccctggtccggttcggcgccacctccgcggtggtccgttgcgcgatcgtccacgatggtcgcgagctgctggtcgagctggaaatcgtgccagggcgggcgaatcgggcgcggctcaaccgatcgccggtgcgccggccccgcgaggtgctcggcgccctgcggatggtgctgttcgccccggaggacctggaactggtccgcggcgacccgtcggaacgtcggcgctacctggacgacctgctggtcgcccgccagccgcggtacgcgggggtgcgcgccgattacgaccgcgtggtcaagcagcgcaacgccctgctgcggacggcatatctgacccgcaaggtcggcgggacccggggtcaggatctgtcgacgctggcggtctgggaccagcacctggcatatcacggcgccgagctgctggccggtcgactggagctggcggccgccctcggcccgcacctgaccaaggcgtacgacgcggtcgcggccggcaggtcggcggcgtcgatcgcgtacgcctcccgcctgggcgaggggctcgtccccgatcgcggcgccctggaggctgcgctgctggcgaggatgcaggagcgccggccggccgagatcgagcggggcaccaccctggtcgggccgcaccgcgacgatctgaccctggcgctcggtgagatgccggccaaggggtacgcgagtcacggcgagtcgtggtcgttcgcgctggcgttgcgcctggcggcgtacgacctgctgcgctccgacggcatcgagccgatcctggtgctcgacgacgtcttcgccgagctggacgccggccggcgggatcggctggccgcgctcgtgtcggacgctgcccagctgctggtgacctgtgcggtggccgaggacgtgccggccgcgctgcggggcgcccgcttcgccgtgaccctcggctcggtcgatcaggccggctga

SEQ ID NO: 2909 - DNA, 873 bp, Actinoplanes utahensis
atgcaactcggcctgatcggtctcggccgcatgggtggcaacatgcgggaacggcttcgtgctgccgggcacgaggtcgtcggatacgaccagaacctggatgtgagcgacgccaccagcctggccgatctggccgaaaagctgaccacgccgcgcgtggtgtggaccatggtgccgtccggcaagatcaccgaggacaccatcgacgcgctcgccgaggtgctctcgcccggcgacgtcatcatcgacggcgggaactccaagttcaccgacgatgccccgcgggccgagcggctggcgaaaaagggcatcaagtacatggatgtcggtgtctccggcggcgtctggggcaagaccaacggctatgcgctgatggtcggcggcgacaaggagacggtggcgcactgcatgccgatcttcgaggcgctcaagccggccggcgagttcggcttcgcccacgcgggcggaccgggcgccggtcactacgccaagatggtccacaacggcatcgagtacggcctgatgcacgcgtacgccgagggcttcgagatcctcgaggcctccgagcacgtcgacgacgtgcccgcgatcatcaagagctggcgggagggcagcgtcgtcaagtcgtggctgctcgacctgctggaccgggctctcgacgaggacccgaaactggccgggatcaagggttacgcggacgacaccggcgagggccgctggacggtcgacgaggcggtccgcttggcggtgccggcccatgtcatctcggcatcgctgttcgcccggttcgcctcgcggcaggacgactcgcccgcgatgaaggcggtggcggcgctgcgcaaccagttcggcggccactccgtcaagcgctga

SEQ ID NO: 2910 - DNA, 1134 bp, Actinoplanes utahensis
atgaagttccgggtggagcgagactcgctcgccgacgccgtggcctggacagccaagagcctgcccagccggccgtcagtgccggtgctggccggtgtcctgctgcgagtgaccgacggccggctgcaggtctccggctttgactacgaggtctccagccaggtctcggtcgaggtccaggcggacgccgacggggccgcactggtctccgggcgcctgctcgccgagatcaccaaggcgctgcccggcaagccggtggacatcgcctcggtcggcgcgcatctggagctcgtctgcggcagtgcgcgtttcaccctccccacgatgccggtggaggactatccgacccttccggatatgccgtccagcgcgggcaccgtcgacgccgctacgttcgcctcagcggtttcccaggtggccatcgccgccgggcgtgacgagacactgccgatgatgaccggcgtccggatcgagctgaacggctccaccatggcgatgctcgccaccgaccggtaccggttggcgatgcgcgagatcgagtggaccccggacgacccggagatcagcctcaacgcgctcgtcccggcgaagacgctgaacgacacggcgaaggcgctgggcccgctgggcggcgcggtcaccctggccctggcgcagggcaacgcgggcgagggcatgatcggtttcgccggtggcgcccgccgcaccaccagccgcctgctcgacggggcgaactacccgccggtccgctcgctgttccccgccgcgcacaacgccgaggcccggatcgcggtctccgccctggtcgaggtcgtccgccgggtcgcgctggtcgccgagcgcaccaccccggtgctgctgagcttcagtgaggacggcctggtcgtcgaggccggcaccaccgaggaggcgcgggccagcgaggcgatggaggcggagttctccggtgaggcgctgaccatcggcttcaacccgcaatacctgatcgacggcctgcagaacctgggcgcgccgaccgcggtgttttcgttcgtggacgcgttcaagccggctgtgatctcgcccgctggcgaaagtggcgaaatcatcccgggataccgctatctgatcatgccgatccgggtaacccgctga

SEQ ID NO: 2911 - DNA, 1842 bp, Actinoplanes utahensis
gtggccgatcaggtcgacctgggcaagctgtggcaggacacgctcagcgaattgtccgaggagatcgcttcccggcagcagcgtgcctatctccgattcacccggctccgggcgatcgtcgaggacaccgcgctgctgtcagttccggacgcgtacacccgggatgtgatcgagctgcgcctgcgcccggcgatcaccgaggcgctcacccgcaggctgagccggccgatccaggtggccgtcacggtccgcccgcccgaggacggcagcggcatccccggcacggtttacggcacgccggtcgaggccgaggcgcagccggccccgcgtgacgcgcagccgctgcactacgccgacccgccgcgcacccccgaccctaggccgtaccagcccgagctgcccacatatccggctgaacagcactatcagcagcccggtttcggccccccggaacgcgcgccggagccgtatccgacgggttccgcgcagcactcggcgccggccgcaccgtacgtccgcaatgttcctccggccagcgacggccaggaagcgctgttcgccgacccgatgccgccggcggcgcagccgcagcggccgaccgccgcccgtccgacggagaagaccgcggacccggcgccgaacgaagccgcgatcctgcggttgccggccgacccggcccagttgcgcgacaaccagcgccgtccggacgaccgccgcgacgatccgatgccgatgcgcggtgacaacggtcccggtcgcgcgccactcgacccgcgcggccccggctcgtccccgcgccccggcgggcaggacggcaaccggctcaacccgaagtacatgttcgagacgttcgtcatcggctcgtccaaccgtttcgcccacgcggcgtcggtcgcggtcgccgagtcgcccgccaaggcgtacaacccgctcttcatctacggcagctccgggctgggtaagacgcatctgctgcacgccatcggtcactacgccaccaccctgggccacgcgcgctcggtgcgctacgtctcgaccgaggagttcaccaacgatttcatcaacagcctgcgcgacgacaagacgcaggcgttccagcgccgctaccgcgacgtcgacatcctgctgatcgacgacatccagttcctggagaaccgcgagcggacgcaggaggagttcttccacactttcaacacgctgcacaacgcgaacaagcagatcgtgatcagctcggaccgctcgccgcgccagctggccaccctcgaggaccggatgcgcacccgcttcgagtggggcctgctcgccgacatccagccgcccgacctcgagacgcgtatcgccatcctgcagaagaaggccgcccaggagcgcatgtacgcgcccgacgacgtgctggagttcatcgcgtcccgggtctccaactcgatccgcgagcttgagggcgcgctgatccgggtcaccgcgttcgccagcctgacccgttccccggtccagctctcgctggccgaggaggtgctgcgcgacttcatgccggacggcgccgggccggagatcaccgccgaccagatcatggtctcgaccgcggactacttcggcgtctccctggaggatctgcgcgggcactcgcgcagccgggtgctggtcaacgcgcgccaggtcgccatgtatctgtgccgcgagctgaccgacctgtcgctgccccggatcgggcaggccttcggcggccgcgaccacaccacggtcatgcacgccgaccgcaagatccgtcagcacatggccgagcgccgctcgctctacaaccagatcgccgagctcaccaaccggatcaagcagaacagctga

SEQ ID NO: 2912 - DNA, 138 bp, Actinoplanes utahensis
gtgagcaagcgcacctaccagccgaacaatcgccggcgcgccaagacccacggcttccggctgcgcatgcgcacccgtgccggccgtgccatcctgtccgcccgccggggcaagggccgcgacaagctgtcggcctga

SEQ ID NO: 2913 - DNA, 357 bp, Actinoplanes utahensis
gtgctggccgcgacgcagcgactgcggcgtagcgcggacttcgccgcagcgattcgcggtggccgtcgagccggccgcgggaccctggtcgttcacctgcttatcgaggagccggcgcacgcctccgaggcgcgcgccggcttcgtcgtatccaaagcggtgggcaatgcggtggtccgtaacaaagtgcggcgtcggctgcggcatctggtccggccgctgctcgccgacctcccgccgggtgctctgctggtggtccgggcactgcccccggccgcgcaggcggggtacgccgaactcggcatcgacctggacggcgcgctcgcgtccgcccggcgtccccggcggccgcgatga

SEQ ID NO: 2914 - DNA, 1023 bp, Actinoplanes utahensis
ttgagtctcgactggatctactacgccatttcgtggatcctcctccgctggcattcgctctgggacgcgatcggtattcccgacgaccgcgtgctcggcacgaactggtcctgggtcctctcgatcttcttcctcgtggtgacgctgcgcgtcatcctcttcccggtcttcgtcaagcagatcaagagccagcgggccatgcaggcgctgcagcccaaggtgaaggcgctgcaggagaagcacaagggtgaccgggagacgctccagaaagagatgatggagctctacaagacggagaaggcgaacccgctgatgggctgccttccgatgttcttgcaggtgccggtcttcatcgggctcttccacgtgctgcgtcacctcaacccgaacctgccggagcacctgaagacgatctacggctggaagctggagcagttcaacagcgcgaccgcggcgcacctgttcaacgtgccgatcagcgccaagttcgggtcgaccccggccgagctggccgcgatgcacgccaacggcaccacggtgaaggtgctggccggtgtcctgatcctggtcatgatgggcaccaccttcctgaccagccggcagatgatcctcaagaccggctgggccgaggacccgcagcagaagatggtgcagcggctgatgctgtacggcatcccgtgctcgctgctgatctccggctcgctgttcccgatcggtgtggtcatctactgggtgaccaacaacctgttcaccctcggccagcagcagtgggtgctgcgcaagttcccgccgccgaacatggccggcaagggtggcgccaccacggcccgcccggcgaacgcgaccgccagcgacgtgaagaacccggtgcagcccggccgcagcggcggactgttcggtcgcaaggccgtggccgaggaggccaccccggtcgttgacaccaaggcgctggccccgaagccgggcgccaaaccggtgaatccgaagaagggcgcccggccggcgaacaaacccaagggatga

SEQ ID NO: 2915 - DNA, 588 bp, Actinoplanes utahensis
gtgaccgacaccagtactccccccgcctccgaatcgccggcgccctcggcggtcgcgccggagacggatgccgcgccctcggaagcggtatcggcggagggtaagaagtcggagagcgtcgcgtcggacagcgacctcttccggcagagtgagatcgccgcggactacgtcgaggggctgctcgacatcctcgactatgacggcgacatcgacgagctggtctccgccggccggccgatggtcgaggtcgtcggcgggcggctgcagccgctggtcgggcagcgcggcgcgacgctggaggcgctgcaggagctgacccggctggcgatcttccgggcgaccgggtcgccgagccggctgctgctggacatcggtggctaccgggcgtcgcggcgcaaggagctggccgcggtggcgcgcaacgcggtggagaaggtcaaggagcacggcgaggcggtccggctggagccgatgtcggccttcgagcgcaagtgcgtgcacgacgtggtgaacgccatcgccggcgtgcagagcgagtccgagggcgtggagccgaaccggcgcatcgtggttcgtgcggcggagtga

SEQ ID NO: 2916 - DNA, 888 bp, Actinoplanes utahensis
atgacggacccacgcttcggcgcgggtgagggcggcccgggcgttacggcgcccgggccgccctcgtctcgcggcccttccggttcgtatgccgcccgtcccggccttcccggcgcggccggggtgccggtgcccgccgaggagcctgccgacgtcgacgtgttgcagccccctgctgtcatggagatggctgctcgtgaggttttcggggaccggctggcgctcgccgggcggttcgcccagctgctggcgaccgagggtgtgttgcgtggcctgatcggaccccgggagacgccgcggctctgggagagacacctggtcaactgcggagttatgtcgcagctgttccctatcggcgcttcggtggttgacgtcggctctggcgctggtttgcccggtatcgtgctggctgtggctcgaccggatcttgagatcacgctggtcgagccgctggcacggcgtaccgccttcctgaccgagacggtggacgagctggaactgcacaacgtcacggtcgtacgcggacgggcatccgaggtgatcggtcaggtggccgacgccgacgtggtgaccgcacgagcggtcgcggcgctggacgtgctggccggctggtgtctgccgctggcccgggtcgggggcacgctgttggcgctcaagggggcgtcggcggaggaggagatcggtgagcacggggcgcagatcgcccggttgggtggcggccggccggagatccggttctgtggcgccgggctgatcgagccgccggcaacggtggtggagatcgtgaaggaacgggaagtggcggccggccgaggccgtgatcgtgtcgtccgggcggctcgtcgtgaaggccgcggcggcggacgggggaacaagcggaggggttag

SEQ ID NO: 2917 - DNA, 1437 bp, Actinoplanes utahensis
atgggcaagcggggcgcgcggaagcggaaatctttaccggcaggtggtgcggctgccgatgaacacgctgtgaccctccctcccccgtcgggtcggggcccgctgggccgcggactcgctatgcggcttgtgtcgggtgtgatggagtttgtcagcccgaccggcgatgacgatgcggcgttgcgctcgactcatccggtgcgcggacatggcgacgtgcgccctccggccgtaggctggccaggcgtcgatagtgtggaccggatctcccccgccgagacacacgtttcgccggccgacccgttcctagccaacagggataaaacggtgcatgagtacggtgtttcacgtgaaaccgagtcgcctcttgaccggccgtcgcgagtgaacgctggtgatcagggcgttccgcagccgcgtcctagtggtaccacttatgggtacggtgtgcctgcgcccaggactgatgcgccgctccccgccgctccagccgccgtggcgcccgtttccggaacgccggttcagccggtggagcatgtttcacgtgaaacgccgggcggggatgaggacgatccgcccctggccatggaagcgttgcgagctgtgcagattctcaacccgagtggcgagatcatcatgccgcgcccggatcacccacgggttatctgtgtcgccaaccagaagggcggcgtcggaaagaccaccaccacggtgaacctggcggtggctctggcgctgcacgggaaccgggtgctggtggttgacctggacccgcagggcaacgcctccaccggcctgaacgtgccgcaccacgccggcgtcccggacgtctacgactgtctgatcgacaacgtgccgttggccgaggtggcccaagccgtcgagggtattccgaacctcttctgcgtgcccgcgacgatcgacctggccggtgcggagatcgagctggtgtcggtggtggctcgtgagtcacggctggcacgggcgatcgccagccacccggagaagttcgactacgtcttcatcgactgcccgccgtccctcggactgctgacggtcaacgcgctctgcgcggcccaggaagtgctgatcccgatccagtgcgaatactacgcgttggagggcctcaaccagctgatcaacaacatcaacctggtccggcagcacctgaacccgacgctggacgtctccacgattctgctgaccatgtacgaccggcggacccgtctagccgacgcggtggagcaggacgtgcggaatcacttcggtaccaaggtgctcaacgcggtcattccccggaacgtgcgagtctcggaggctcccagctacggccagtcggtgatgacctacgatccgggatcaaggggcgcgaccagctacttcgaggctgcgcttgagattgcggtgcgtggggtcaacacgggaggcgcggcatga

SEQ ID NO: 2918 - DNA, 1062 bp, Actinoplanes utahensis
atgaagaaccgtccgcggggaggtctgggccgcggcctgggcgcgctgatccccacggcgccggcggccgagccggaatctccggtcgcggtcgccgctgacggtttgccgtcgtcggctccttcggtagccccggtgtccattccggcgccgtcacccgcatccgctcccccggccgtcgcggtcctcgccgatgacgagttggcgccggtgcctggggcgcgattcgctgagctgccggtgtcctccattgagccgaacgccaagcagccgcggcacgtcttcgacgaagaggcgctggaggagctgaagatctcgatccaggaggtcggcttcctgcagccgatcgtggtgcgggagctgggcgacggccggtacgaactggtcatgggcgagcgccggtggcgggcggcccaggctgtgggtcgggagtcgattccggcgatcatccgggacaccccggacgatgtgatgctgcgtgatgctctcctggagaacattcaccgagcgaacctgaacccgctggaagaggcggcggcgtactcgcagctgcttgaggagttcggggtttcgcacgaggaacttgctcggcggatcggtcggagccggccgcagatctccaacaccatccggttgatgaacctgccggcgccggtgcagcggcgggtggcggccggagtgctctcggccgggcatgcccgggcattgctggggctggagggttctgaggctcaggaggagctcgccaagcggatcgttgcggaggggctttccgtccgggcgaccgaggagatcgtgaaactggccgagtcggaggggccggcccggaaggcggcgccggcgcggcgggcgaaggttcacgcgccggctctgaatgatctggcggagcggctgtccgatcggttcgatacccgggtgaaggtcgacatcggtcggaataagggcaagatcacgattgagttcgcgaccgtggatgaccttgaacggatagtaggcatgatcggtgtggaggaggagggggctcgatcctcgactccgtccggggtggacagcgacgagtaa

SEQ ID NO: 2919 - DNA, 633 bp, Actinoplanes utahensis
atgcgactcgacgccggaatgaccgccatgatccgctcgatggctgcagacctcggactgccgttggtgggctactacgggctgcacgcgctcggtgctgacgacacgaccgccctcctcgccggcacggtggcggcggcggtccggatcgggtgggtggcgattcgcagccggtcgctcagccccttctccatcctgatggggtcggtgttcggcatcgggctggtgttcaccctcgtaaccggcgacccgcggttcatgctgatcaagcattccatcatgtcggcggtgatcgggatggtgttcctggcgaccgccctctgggggcggaagccgctgaccctatcggctcagcagagcttcatgccggccaaggcggcggaacttgcggagcaattcaaaaccagcgcggcggtacggcgtgggcatcgcaccgcttcgacggtgtggggggcgggtctgctcgtggaggcggcggttcgggcggtgctggttttcctgctgccggttgatgtgatggtcgggttgtccactgctctgacggtggtgacctttacggtgctgctggggtggaatgctcgctacatcgccgcgcacaggcgggctgcggcggcggtgctggtggcggcctga

SEQ ID NO: 2920 - DNA, 912 bp, Actinoplanes utahensis
gtgtctgagaacaccggctcactgcctgacttcacccgctggccctccttcccgttcgagggtgacatgcgggtcaagaagctcgctcccccggtggaggtggagccgccgcgcagcggcgaggatggggccgactgtgtggcctgcactacgcccgatgacgcgtacatctgggtgtcggaacgatggcgggtgcgggccatggaccgacctaccgggctgccggccgtgctgatcctggagtgtcggtcgcacctcgacctgggggacctgccgaaccttctggcggccgagctcggcgtgatgacggtccggctggagcgcgcgatccgatcgctcgacggggtggcccgggtgcacgtgaaccgatggggtgacggatccgcgcacctgcacatgtggtttctcgcccggccctatggccggctgcaactgcgaggcacgttcctgtcgctgtgggacgacatcctgccggtcattccggagccgcagtggcgagaaaacctcgcgctcgtcgctgcctggctcgccgacttcggtggccaggccaacgccgcgccggccccgatcgaatgggagtcgccctcgacgctcaacgtcccgaccggcaccggtgacgggcgcgaggagacccgccggccggcgacgctcggcgacatgcaggccgctgcgactccggcgacggactcctgggtacgtcacaccgacgccccgtccgccggcagtccacccgcctcggcggctccgtcgcccgccgcagaggccggtatcccccaccagtccaccgtgcccgccccagggtcgaccggcgtgatcgcgtcgacggagaacgagcggatcccgttcggcaccggaattctcagcaccggggccggggccgccgcagccggcgcgggaaacaccgacggatag

SEQ ID NO: 2921 - DNA, 963 bp, Actinoplanes utahensis
atgatcaccaccatggagttgcgagtcttggttctggccggcgggctttcctacgagcgggacgtctcgctgcggtccgggcgccgggtgctggatgcgctcaggtcccggggcatcgaggccgaactgcacgacgccgacgtgtccctgctcccggcgctgcaggccgacccgcccgacgcggtggtgatcgcgctgcacggggccaccggcgaggacgggtcgctgcgcggggtgctcgacctgtgcgcggtgccgtacgtgggggccgacgcccgcaccgcccgcctcgcctgggacaagccgtccgccaaagcacgcttgcgggagtcgggcatcccgacgccggactgggtggcgttgccgcacgaccggttctccgaactgggggcggtggcggtcctcgaccggatcgtgtcccggctcggtctgccgctgatggtgaaaccggcgcagggcggcagtgggttgggcgccgcggtggtccgggacgcggcggacctgccggcggccatggtgggctgtttcgcgtacgactcgaccgcgctggtcgagcagtacgtcagcggaacccggctggcggtgtcgatcgtcgacctggggtcggggccacgggcgctgccgatcgtggagatcgtgccgcgggacggggtgtacgactacgcggcccgatacacggcggggctgacgacgtggcatgtgccggcccggctgtcggcggcggtggcgtcccgggtgagtgagacggccctggcggcgtatcaggccctggggttgcgggacctctcccggatcgacgtgatcgtgggggaggacggggaagcgcaggtcttggggtgcaacgtttcgccggggatgacggagacgtcgttgctgccgttggcggttcaggctgatggggcggacctgggagagatcctgggggttctggtggaacgggcggttgatcggaaggctctttag

SEQ ID NO: 2922 - DNA, 1311 bp, Actinoplanes utahensis
atgaccggtactacccaggacgactacaccgatcgttatgcccggcgggtccgcgggatgacgacgtccgagatccgtgcgctgttcgccgtcgccagccggcccgaagtggtgtcgctggccggcgggtcgccgttcatcgccgcgctgccgctcgacgcggtcggcgagatgatgagccggctggccgtcgaccacggcgccaccagcctgcagtacgggatcggccagggcacgatcgagctccgcgagcggatctgcgaggtgatggcgctctccggcatccagggcgcgtcacccgacgacgtggtggtgaccgtcggcgggcagcaggcgctcgatctgctggcccggctgttcctcgacccgggcgacgtggtgctcgccgaggggccgacctacgtcggcgcactcggcgtcttccaggccgcccaggcacaggtgcggcacgtggccatggacgccgacgggctgatcccggaagcactcgaggaggccatcgcggccggggtggccgccggccgaccggccaagttcctctacacgatccccaccttccagaacccggccggcgtgaccctcagcgaacagcggcgggagcgggtgctcgacatctgcgagcgggccgggctcctggtgatcgaggacgacccgtacgggatgctcgcgttcgagggtgacgcgccccggccgctgcgggcacgacggcgcgacggggtcttctactgcagcacgttctccaagacgttcgctcccgggctgcgcgtcgggtggatcctggcgccccacgccgtacgggagaagctggtcatgatgagcgaagcgaatgtgctctgcccgagcgcgttcgcccagggcgcggtcacccagtacctgacgacgatgccgtggcgcgagcagatcaaggtgtatcgggagatctaccgcgagcgccgggacgcgctgctgagcgcgctcaccgacctgatgccggccggcaccgcctggacccgtccggccggcggcctgttcgtctgggccaccctgcccgacggcctcgactccaaggcgatgatgccgcgggcgatcgcggcgcgggtcgcctacgtgcccggaacaggtttctacgccgatggcaccggacgggggaacatgcgactcaacttctcgttctcggcaccggaacggcttcgtgagggcgtgcggcgcctgtccggggtgatggagcaggacctggcgatgcgcgcggtcttcggcggctccgcggccctgtcgtcccagcgccggcgcggtccggccgccgccgacgcgcccggccccgacttggcatga

SEQ ID NO: 2923 - DNA, 651 bp, Actinoplanes utahensis
atgtcgcgacgcctggtcaatctcaccctcgacaccctggaggacctgccgcgaccgtgccgtcagtgcgtgtactgggagcttgatccggtctccgccgagcgggcctgtgcctccggtgaccccggcctggagaaggaggcgtgggtctcccagacgctgctggagtggggttcctgcggcaagctggcctacgtggacggcatgccggccgggttcgtgatgttcgccccgccggcctacgtgccccgctcgatggccttccccacctcgccggtcagtgccgacgccgcgctgctgaccacggccaaggtggtgcccgcgttcgccggcggcggcctgggccggatgctggtgcagggcgtcgcccgggacctgaccaagcgcggggtgaaggcgatcgaggcgttcggcgacgccaagccggacgaggacgccgagggcgcctgcgtggcgccggtcgacttcttcctgtcggtgggcttcaagacggtccggccgcacccgcgttacccgcggctgcggctcgaactgcgtaccgcgctgtcctggaagtcggacgtcgaatatgcgctggagaaactgctcggctcgatgagcccggagaaactgctccgcccgatgcccgccaccagttcgatcgagaactga

SEQ ID NO: 2924 - DNA, 1152 bp, Actinoplanes utahensis
gtgcggtccatccgacgcggagacaccggccctgccgtttccgagatccggtcgatcctgatcggcctggagttgctcgccgagcccgagccggacgtcttcgacgagccgctggaaaacgcggtgcgcgagttccagcagagccgcggtctcggcgtggacggcatggtcggtgacgagacgtggcgcgccctggacggggcccgctggcggctcggctcgcgcaccctgttccactcggtgccgggcgcgctgaccggtgaggacgtgcatgcgttgcaggagcggctgctggagatggggtacgacccgggtcgccccgactccatctacggtgcccgcaccgcccgcgccgtcgcccagttccagcgcgaggtcggcctggccccggacggttcggtcggcccgcagaccatgaaggcgttgcgccgcctcggccgcaaggtggtcggcggccgcccacagtggctgcgcgaggcggaggcgttccgccagtccggaccgaacctggtcggcaagacgatcgtcatcgaccccgggcacggcggcggcgccgacaccggtgtgctggtgcccgacggcccgcttcgctggaccgaggccgacctggtgttcgacctggccgcccggctggagggtcggctcgccgcggccggcatgcgggtgcacctgacccgcggcccgcagccggccgaaccgatgagtggcaccgaccgggccgcgctggccaacagcctcggcgccgacctgctgatctcactgcacctcgacggtcatccgtcggaggcggccgagggggtggcgacctaccactacggcaccggcagcggtctgagcagcacggtgggggagcggctggcggcgctggtgcaacgcgaaatcgtggtccgcaccgggatgcacgactgccgcacgcacgccaagacctgggacctgctgcgcctgacccggatgccggcggtgcgtgtcgacctcggctacctgacctcgccggcggatcgggagcggctggtcaacccgatgttccgggagcagatcgtcgaggcgatcctggccgcggtgcagcggatgtatttcccggtcgagcgggacgtgccgaccgggtcgatcgacgtgcgggcgctgcggatggcgctggccgaccggacctga

SEQ ID NO: 2925 - DNA, 318 bp, Actinoplanes utahensis
gtgaaggtcgtcaccgacaagtcgttcgccaccgacgtgctggcgtccgacaagccagtgctggtggatttctgggctgagtggtgcgtgccctgcaagaaggtcgacccgctgctggccgagatcgccgagtccgagctgggttcgcaggtggagatcgtcaaggtcaacatcgacgagaacccgcagacggcgctcgcctaccaggtgatgtcggtgccgacgctggccatcttcaaggacggcgagcgggtgaacctggtgaccggtgccaagccgaagagcttcctggtcaacttcatcgagtcggcgctctga

SEQ ID NO: 2926 - DNA, 1227 bp, Actinoplanes utahensis
ttggctgaccgccgaatcgctggattatgcccggttcaacggcaaatcggcgctggtggtgcggttcagcgcggccaacggccagtgggcgtgggcgagtggcgtcaactgcggattgcccggtggcggcgcggacacgctcggttcggtcccggtacgctgaacggcacccccggcgtgaggtcggacacgagcgggaccggggggaatggtgaatgcctagcatggcgttctatcggcgtggacacaaaccttgaggagtcggcagtggacgaggtccgcaatctgatcatcatcggttcggggccgtccggctacacggcggcgctctacgccgcccgtgccgagctcaagcccctggtgatcgagggcgtgcagtccggcggtgcgctgatgacgaccaccgaggtggagaatttccccggtcaccgtgacgggatcatgggccccgagctcatggacaacatgcgggcccaggcggagaagttcggtgccgagttcatcaccgacgacgtcagccgggtagagctgtccgacaagccgaccgaggccggcaccgagggcctcaagaccgtctgggtcggcgaccagcagtacttcgcccgcgccgtcatcctggcgaccgggtccgcgtggcgcccgatcggcgtgccgggggagcaggaactgctcggccacggggtgtccgcgtgtgccacctgtgacggcttcttcttccgcaaccagcacatcgtggtggtcggcggcggtgactcggcgatggaggaggcgaccttcctcacccggttcgctgagacggtgaccatcgtgcaccgccgggacagcttccgggccagcaaggtcatgcagaagcgcgccctcgacaacgagaagatcaaggtcgagtggaactcggtggtcgaggagatcctgggcgcggacggcaaggtcgtcggtgtccgcctgcgcaacgtccagacgaacgagaccaaggtgctggacgtgaccggcgtgttcgtcgcgatcggccacgacccgcgcagcgagctgttcaagggccaggtcgagctggacgacgagggctatgtgaaggtgcagtcgcccagcacccggaccaacatccccggcgtgttcgccgcgggtgacctggtcgaccacacgtaccggcaggccatcaccgcctccggcaccggttgtgccgcggcgctggacgccgagcgcttcatcgcttcattcgtcgagctgtaa

SEQ ID NO: 2927 - DNA, 708 bp, Actinoplanes utahensis
gtgacactccgggacgtaccgcccggcggcctcggcgcgggcgatcccgtgccgagtgacgccgagctggtccgtgcccacgtggccggcgatcgggaggcgttcgccgagctggtccgccggcaccgggaccggctctgggcggtcgccctgcgcaccaccggcgaccgggaggaggccgccgacgcggtgcaggacgcgctgctgtcggcgcaccgcgcggccgccggattccgcggcgactcggcggtcaccacctggctgcaccgcatcgtggtgaacgcctgcctcgaccggatccgccgccgccaggcccacccgaccgtcccgctgcccgaccaccactccggcgacgaccgccggtccgccccggaacccgtcgcgcccacccccgaccaggacaccgtgctgctggtccgggaggcgctggccgccctgccggtcgagcagcgggccgcgatcgtgctggtcgacgtgcagggttacggggtggccgaggcagccgccatgctgggcatcgccgagggcaccgtgaagagccgctgcgcccgcgggcgcgcccggatggcgctcgccctccgcgacttgcgggaggctcacagtgagccggggcacgatgggaaccggaccggcgccgccggcgtcccatccaggtcgggcggcgcgacgccgcagccggccgggcgtgaggggagggaccagcggtga

SEQ ID NO: 2928 - DNA, 1554 bp, Actinoplanes utahensis
gtgacccaggtcggcgaaggccacgagaccgcggccgacgaggccggaccggtcttgaccttcggtgagcccgccgtcggggagatcctggccgagcgctatcagctggagcagcacgtcaacaacgacagcgccggccggcaggtctggcgcgggatcgacgtggtgctgcgccggccggtcgcagtcgtgctccggcacccgggcggcgactcggccaccgagatgctgcaggccgcggttgcggccagccgggtgatccaccccaatctggtcggcgtctacgacgccatcgacgagcaacagcgggcgtacgtggtgcgcgagtgggtcgacggcgagtcgctgcgcgatctgatcgcctccgagggcccgctcgacccggcccgggcgatcgcgatcgcccactcggtctccgacgcgctcgccgcggtgcacgccaccggcatgatccacggcaatgtgcacccgggcaccacactgatcggcgacgacggccgggtcgtgctggccgacgcccgcgccgacgccgcggacagctcggaggccgacgtccgggcggtcggcggcctgctctacttcgcgctcaccggacgctggccgcacgccgaggtcggccggtccgcgctgcccgacgccacccgggacggctccggcgcgccggccgccccgcggcaggcccgggccggcgtcccggcctacctcgacgacctcaccatggacctgctggacggccggatcgccgccccgccggccgaggcgctcaccgccgagctcggccggctcgacgccgccgccgaggacgaggacttcgaggacgtcgggccgctgcgcttcgtgcagggcggtggcacacccaccgagccggcccggagcacccgcaagatcctggtcggggtcggcgcgctggtgatcatcgcgatcgtcggcctggtcttcggcatccgcgcgatcaacaagtcgagccatcccgaggcgtcgccgtcgtcgccggtccaggccggtgcgggcgcccagcccagcagcgccggcacggccagcggcgcgccgctgggccagccgaagaagatcccgctgaccgccgacatggtccgcatcgtcgacccgccgcagggcgagcggaaggactccggcgagtccgacgccgtggtcgacggcaacccggacaccgcctggaagctttcgtactacctgcagcccaacttcggtggccgcaagcccggcatgggcgtgctgatccacctgaaggagccgcgggcgctgtccgaggtgcgggtctcgctctccgcccccggcgcggtcctcgacctgcgggtcggtgacaaggacccgggcgacaacagcgccggcgacgacaccatcgtcaagacgtacaagaagctcagtgacgcggacagcaccgacgtaagcaccggcgaccagccgatcctgaacggtttcgacccggacaagaaatatcagtacgtgctggtcttcctcaccaagctgccgcgcaacgaggacaccccgggctaccaggtcaacgtcaacgagattgagttgtacgggtactga

SEQ ID NO: 2929 - DNA, 1848 bp, Actinoplanes utahensis
atggtggcttccaacaatctcggtacggctctggaggcatcagtgaacggcggcctgtaccgcggcagcgacacggcccggggcgacgacggtctctaccgcagcgcccactccgcgggcctgcccccgtccgcggacgccgtcccgccgagccccgcgggctacagctcgatgccggccgacggctcggtcgccgagccggaggtgcccgaggcgccggaggcgggtggtggtggcctgctgcgctccagcgcgatcatggcgatcggcacgctggcctcccgggtcaccggcttcctgcgcaccacgctgctggtcgcggcgctgggcagcgcggccctcggggacgcgttcaacaccgccaacacgatgcccaacatcgtgtacgacatcctgctcggcggcgtgctgaccgcggcgcacgtgccgctgctgatccgcgcccgcaaccggtccgccgagtacggtgaggagttcgagcagcggctgttcaccatcctgctgggcctgctcgcgctgatcaccgcgggcgcgatgatcgccgccccgtggctgatcgacctgtacgcgagcaggttcccgccggcccagcaccgggtcgcgtcgatgttcctgctcttcttcctgccgcagatcttcttctacgggttcagcgccgtggccggcgcctcgctcaactcccgcggccggttcgccgccgcgatgtggaccccggtgctgaacaacgtcgtggtgatcggtgtgctgggcgccttcatggcggtgacgcacggcaagctcaccccggacaacatcaccgacggccaggtgacctacctcggcatcggggtgaccgccggcgtggccgtgcaggccctcggcctgatcccggcgatgcaccggatgggcttcaactggcggctgcgcttcgacttccgccgcgccgagctcacccagatctgggggatggccagctggaccctggtctacgtgctggcccagcaggtcgcgctgctggtctacaccaacctggccaacgcggccggcgcgcagggcgtcaaggaggggatcaggtacggcgtcggcctcaccccgtggaccaacgcctacatgttcttccagctgccgtacgccgtggtcgccatctcgatcatcacggcgatcctgccgaagatgacccagagcgccgccgagggccgcttcgaccggctggtcaccgagctgcgcgaggggctcggcctgtcgctcaccctgatgctgccggcggtggccgtgctcttcggcgcggccggcgagatctgtctggtggtcttcgcgcacggcaagtcgtcgccggccgacgccgcgatggtggccggggtgctgcgggtgttcgccgtggcgctcaccccgttcgcggtcctgcagctgctgcagcgcggtttctacgcgctcggcgacacccggaccccggcgatgatcgcgctgggctcgaccggcgtcggcggcctcaccgccttcctgctctcccgggtcctgccgaccgccgacgtcgtgctgggcatcgccggcgcgcagggggtggcgtgggcctgcggctgcgtgatctcggtcgtcgtgctgcgccggcgactcggccggctgggcggcggggcgctgttccgggtgatctccaaggccgggctggccagcctggccaccctgctcgtggtgttcctgatccaccacacggtcaccccgcacctccatgacagtttcccgctgaccgcggtggtgctggccgtggagggggtgctcggcctcggcgcgttcgtgatcgccgcgacgctgctgcgggtgccggaggtcggtcaggtgatcggcatggtgcgccgcaagctcggccgctga

SEQ ID NO: 2930 - DNA, 891 bp, Actinoplanes utahensis
gtgccgccgggcacgatggggcccgtgcccgtttctgaggcgttgagccggctgagcctcgacccgctgttctggaccggtgaactcaccgaacccgagttcctccgggtgtcgctgccggtgctcgacggttacgcgttcgtcctggagatcgagctgcccggcgacgagcgggccctcggcctgcgccggccggccgccagcgatccggtccacctcggctcggcgcccggcggcggcccgttcccggccgcgctgcgctggcccgagctggaggtgtgcgcccgggtgatcgcgctggccgacccgacgttgccgcatcccgggctggtggtcgcgctgctcggaccgttcgccccggccgccgcgccggacgaggggccgctgatcgcggcgatgcgcgagaccgcgtaccggtcgctgcgccgggcggtgccaccgccgccgccgtccggtccggagcaggcgccgctgccgctgttcaccgacgaccgctggtggccggcgccgcccgtgccgtcaccgcaggtgctggacgaggccgccatcgcggccctgagcggcccgggggagatcggtgaccaggtccgcgcggaccgacggttcccgcatgaggatctgacggacctgatccgccgtgccaccacacacctggcccacctccccttgcaaccctggtacgccgccgtgagcccgctggcccgccgcatggtgcacgccgggcacctggacgcggtgcccgatctgctggcggcgctgaccgaggccggttgtgatcatccgacgatcctcgacgcgctgagtgagccccttgtcccgctggaggcatgctgggtggtggagaccctcgccggagctgaaccgggcaccctccagcagcaccacgtgtga

SEQ ID NO: 2931 - DNA, 1572 bp, Actinoplanes utahensis
gtgagttcaccggtccagaacagcgggtcgaggctcagccggctcaacgcctcagaaacgggcacgggccccatcgtgcccggcggcactggcggtcaccaagcccgataccctggtaatcccatgtctgtgttgaacaatgcgtctgtgttgaacgaagcccagcagaacgcggtcgccgagttgctccgcgtctcacccgtcgccgacgagctggggcgccgcttcggcgccgccggccacgagttgcacctggtgggtggctcggtacgggacgcgctgctcggccgtctcggggatgacctcgacttctgcaccgacgcgcaccccgagcagaccctggccgtggtgaagagctgggccgacgcgatctgggagaccggccgcgagttcggcacgatcggcatccagaagaacggcctgcggatcgagatcaccacgttccgcgccgaggcgtacgacggggtcacccgcaacccggtggtgtcctacggcacctcgctgctcgacgatctctcccgccgtgacttcacgatcaacgcgatggccgtgtcggtgcccggccatgatttcaccgacccgttcggcgggctggccgacctggcgtcccgggtgatccggacgccggccgcgccggagcagtccttcggcgacgacccgctgcggatgctgcgggccgcccgcttcgcggccaaactgcagttcaccgtcgccgagccggtgatcgccgcgatgcgcgacatggcggccgacctggaccggatcaccgccgagcggatccgggacgagttcaccaagctgatgtgcggcaccgacccgatcgccggcctgcgtctgctggtcgacaccgggctggccgaccgcttcctgccggagatctccgggctgaagctggagatcgacgagcacgcccagcacaaggacgtctacgagcacacgctgatcgtggtgatgaacgcgatgcggctggagggcgacaccgcgcccgacttcgcgctgcggatggccgcgctgatgcacgacgtcggcaagccggccaccaaggcggtgggccgggacggccgggtcagcttccaccaccacgaggtggtcggcgcgcggctcaccaagcagcggatgaaggccctgaagtaccccaaggacgtcacctccgaggtggtcgggctggtcgccctgcacctgcggttctacgggtacggccggggcgagtggaccgattcggcggtgcgccgctacgtcaccgacgccggcccgctgctgtcccgcctgcacaagctgacccgatccgacgtgaccacccgcaaccggcgcaaggcggcccagctggccgccgactacgacgcgctggaggagcggatcgcccggatcgaggccgaggaggacctggccaaggtccgccccgacctggacggaaacgcgatcatggagctgctcggtgtgccgccgggcccgatcgtcggccaggcctggcgccacctgaaggagctccgcctggaccgggggccgctggatcgcgacgaggccgaggcggagctcttccgatgggcccgcgagcggggccacatctcctga

SEQ ID NO: 2932 - DNA, 1161 bp, Actinoplanes utahensis
atgaggaacctggatcgtgacctgcgcgtcaccgtcgccgacctggccgccggagcgccaccgctgaacgacctcgccatggtcgcccggatccgcggccgccggatccgccgccgccggcagaccgcgctcggcgcggccgtgctggtgctggccggcctggcgatcacgccgttcgccgtcttccggcggcacgccgagccggccccgccggccgtcgtgccgagtgtgacaccgagcagcacaccgccgccggtcgcggcgatccgcaccgactggtggaaggcgccgatcacgttgcccggcggcgtggtgatcacctcggtgagccggcgtggctcgttcaacagcctggacagcatccccgcgtcggcgggccggacggtgcacgaggggaacgtggcgctggaccgggccaccggccgttaccgcgtctaccccatcgactatcaggagttcgtcgcggcgccgaccggtcgatacgtgcgggtcgacgggaccgttggcggagtcggcatcctgaacgtgcagaccggcggcgtccggcagcttcaccacggcactggcagtggcgccatgcagtggtccgccgacggccagcggatgctgctgtcgctcaatgccggcggcatccggaccatcgacgcgaagaccggccaggagaccgatgtgaccatcccggacaccggctgcccggactactgcttctacacctggctgccgggggagaaggaggtcgccatcgggcaggtggatccggccgtcccgcagtccgaggaccggcccgacacggtcgggagcgtcaaggtctactcggcgtcgaccggtcagctgtcgcgcacgctgccggtccacggcgtcccggccggctcggcggcctggtcggcggacggccgatacgtcgtcgtgctgcccgacgccagccagccggacggcctgcgggtgatcgagacggcgaccggccgggtggtcggcaccatccccggtttccggttcgactacccggcggtcagcgatcagatccgattcatcggcaacgaccggatcctgaccgccgaggggctggacctgaactattacgacctgaccggcaagaagctggccggcatgcgactgcccgacgacttcgccgaccgcgacgtcgccttcggcgtcgagtag

SEQ ID NO: 2933 - DNA, 510 bp, Actinoplanes utahensis
gtgaaacaagcgctcgaagctgagttcaccgcgttcgtggcggatcgggggcaggccctgctccggatcgcgcacgccatgacgggggatcggcaggccgcggaggacctggtgcagggcgcgctcgccaaggcatacgcacggtggccgcggattcacggggaggccgaggcgtacgtacgcagaatcatctacaacgaccggatctccacctggcgccgggccggcaaccgcaacgaggtgaccgtcgccgaggtgccggaccggccgcaggccggacggcacgagcaggaggtgacctcgcgcctggcactgcgcgccgcgctgctttcactgcccgtccggcaacgcgccgtgctggtgatgcgttacctggaggaccgcaccgtcgaggagacggccgaggtgctcggctgccggcccgggacggtggccagtcaggcgtcccgcgcgctggccaagctgcgcgacgtgttcggcgtcgacgactggacggaggccacccgatga

SEQ ID NO: 2934 - DNA, 1470 bp, Actinoplanes utahensis
gtggcggaagaaacggtaagcaccgccgcgagactgctgagcaccgggcagaaggcgctcgccggtgcggccctggccgtgctgaccgccggcctggtcgtcgccccccgggtcaccgcggccgtgacggtcggcgcctgcgtgctgttctatctgctcttcgccctgttcaaggtgctggtcacgacagccgggcgcgggcaccggatgctgctcaccgaggtcctgtcctcgtcgacccgccagctgccgcactacggcgtgctgctgccggtgcaccgcgaggcgaacatgctgcgccgtctggtggcccgggtcagtcagctggactatccgcgcgaccggctgcacgtctatctgctgatcgagcacgacgacgagaagacgctggccgccgcggccgcgatcgggctgcgcgtgcacggcgacggcacggccgccgagggcccgctcggccacgttgtggtggtggtcgttccgccgggcggcccgaagaccaagccgaatgcgatgaacgtggcattccccattctggttgcggacggttgccgctacgtcaccatctatgacgccgaggaccggcccgatccggagcaattgcggctggccgtcgcgacattccgtctagcccgtcgtgacgttgtgtgtctgcaggccgaattggtcttctggaacgacgacacgaactgggtctccgctctgtactgggtcggttacaaagtgcatttccggcacttcctgcccggcctcgcccggctcggcctgcccgtgccactgggcggcacgtccaaccatttcaaggtcaacgcgctgctcgaggtggccctgccgggcggcctgatctgggatccgcacaacctgaccgaggacgccgacctgggcgcccgcctggccaccgccggataccgggtcgacctgatggcgtcggtgaccctggaggaggccccggtctccagtcgggtggtggacaagcagcagcgccgctggaagggcggctatctgcagaccgcgctggtgcacagccgccggccgtggcgcgcggcggcccggatgggcgtgcaccggtggctggcgttcctgctgatgacctacggcacgccgctcaccttcctgctcaacccgctgttcctggcgctggccggggtgtggttcgcgagcggctccgaggtgatcgtcgacctgttcccggcgccggtctactacaccgcgaccgggctgctggtggtcggcaacttcgggatcatgttggagctggtccagacgacgctggccgaggcgtcccgcaccagggggcgcttcgggctgctcaagtacatgttcatggcccaggtgatgtggctgtggatgagcttctcgacctacgtggcggtgttcgagatggtcaccggcaagcggggctggcacaagacgccgcacgggcatgccgagaccgacgacgacctggtgctcgtgctgcagggcgcgtcgtga

SEQ ID NO: 2935 - DNA, 2823 bp, Actinoplanes utahensis
gtggatgagcttctcgacctacgtggcggtgttcgagatggtcaccggcaagcggggctggcacaagacgccgcacgggcatgccgagaccgacgacgacctggtgctcgtgctgcagggcgcgtcgtgagagcccgtacgcggatgatcgctctcgttctcggggcgacgcagctggcggcctgcgggcggctcgcgccgagcatccccgcggcgcctcccgtcaccacggcggcggcgccggcggcgtcggtctccccggcggtgcggactccggcgcagctgggtgtgcagatcttctggcacgacgtcaagccggagcagctgcgggagaacgccggccggctgctcgactacgtggccgggctcggcgcgaacagcgtcgggctgacctttccgatctacaccgacggcccgaagccgacccgtgtctacatcaaaccgggcaatacgccgactccggcggacatcgcggcgctgaccgcggcggcgcgcgagcgtggcctgcgggtcctggtccggccgctgttcgacgaggtcaacctgcgtcccgccaaggtgtggcgcggctccatcaaaccgtccgatcccgacaattggttcaagtcgtattcgaccgtgttggccccgtacctgaccgcggcacagaccgcacatgcggacggcttcgtcatgggatccgaactggactcgatgaccacccacccggcgcagtggcggaccgcgatggcggccgccggcaccctgttccgcggacggctgatgtacgccgacaactggggtgcctggatcgccggccggggcggggtgcccggagcggaccctggcgtcgacgcgtacccccgcttcgatcttccggacacggccagcgtcgcccagctcaccgacgcctggacgaactggctgcggacccggcgggacggccggctcggcgagaccgtgatccaggaggtcgggatcaccgccacgcccggcgcgtacgccaagtcgaacgcctggcccgagccgggccagaagctggtgccgcagatccaggcgaactggttcgccggcgcctgtgcggccgcccggtcgctggggatggccggaatctacttctggaccctgggcgaacccggccgacgccaccgggtacgacgccggctccttcatcggccgtggcgatcaggcgatcaaggagtgcttcgcgtccggatggccgggccggtgagcaccaccgagcggcacctgtcgctgacccaggagatccggatccgcaacgtgcagcggctgcggcgcgtcgaggaccgccggacccgccggcgcgccgacccggcgatgatcggcgtcgggctggccgcgaccgtgctggccgtcgccgcgtgcgtgtacttctaccgcgccgggcgaatcctgggataccacgacacgtactcgcacctggagatcagccggcgcctgctggtcgggcggaccaccggcatcgcccagctcggggcgatctggctgcccctgccccacctgctgcaggcgctgttcgcctggaacacctggctgtacaccaccgggctggccggctccatcgtgtcgatgaccgcgtacgtcgcctcatcggtgctgatctaccggatggtgcgggtgtacagccccgggcgggcggcaccggcggtcgccggcgcggccgtcttcatgctcggcgccaacgtgctgcaccaccagtcgacctcgatggacgagctgccgttctacgcgttcgcgctggccgcgacatacgggctgatgcgctgggcggacagccggcagccgacctacctgctgcacgcggcgatggccagcatgctggccatgctctgccggtacgagggatggttcctggccggggtgttcaccctcgcggtgccggtgatcgcccgccgtctcggccactcctggcccgatacccggggcctgaccggcatgttcgccgccttcgggctgttcacctcggccgccggttggatgctctacaactggatgatcgccggctcgccgctgaacttcctgaccggaccgaactccagcgccgaccagatgtcgcgacgcaccaccgacgtggagaccggggatctgggcaggaccctgcacgcgtacgcgggggcgctggtcgccgaccacggattcgtcgtgttgggcctcgcggtggccggactcgtcgccttcctgctcggcgaacggctgtcggcgcgatcgctgccggtcttcgcgctcggctcggtgatgccgttcttcctctacacgatctatcgcgggcaggccccgatcggcatgccgccggtcaacgaatacgtgctcaacgcgcggttcggcttgatcgcggcgctgccggcggcggtgctggccggatatctgatcgcccggctgccggggcggacggcgctggcggcgtcgatcctggtgatcgcggcgctcggtgggctgaccacggtcaccttccggcaggacgcgctggtcagcgtgcgggaggtgaccgacgacctgtcgtcgcaacaggaccaggtgcgggtggccgccttcctggctgggcacaccagcgggccgatcatgctggacctggtcgggaacgagcgggcggcgttcccggtgctggaccgggtcatctacgacggtacgaaggtggggcggcgcaatgtctggcgggaggcgctgacgtcgccgcggtcggtgggtgccgaggtcgtgctgatgcgcggatccggggcgcggggccgggacgccgtctacaacgcgctgcacgacgcctcggcgatgcagggataccgggcggtctacgaagcggacggatacaccgtctaccagttgtcgtga

SEQ ID NO: 2936 - DNA, 456 bp, Actinoplanes utahensis
atgttcgtcgtcgagtcaccgatcgggccgctcggcgtcgccgtcgagggcgatgtcgtggtcggggtgcgcttcggcgcggcgcccgggccggccgccgagcatccggctgcggcccagctgaccgcctatttcgcgggcgagtcgaccgccttcaccgtgccggtgcggatgcgcggcggatccgatttcgagcgcgccgtctggaccgagatcgcgaaaatcccctacggcgaaatgatgacgtacggcgcgatcgccaccgccctgggcgaccccggtgcggcgcgcgcggtgggcacggcctgcaaccacaacccggtgccggtgatcgtgccgtgccatcgggtggtcggcgccggcggcaggatggtcggcttcgggggcgggctggagcgaaaacgccggctgctggagctggaggcgcgggtggcgctgacgcgcgcctggagctga

SEQ ID NO: 2937 - DNA, 858 bp, Actinoplanes utahensis
atggtggtggccgtcgccggatgcgacggcgccaagggcaagccaccggcggcggtgcagcaggatccggcacagctgatcgccgagctgaccagggggatctccccgtcgaacccgtatcgggatccgaaggcggacgagcgcaccacgatccgccaggcggcccgggcgatcgccgatcaggacgcgaacggcaaccgggacaggctgttcagcgatctcggcttcgtcgtgcaccgcgggacggacccggcgaccggccgcgccttcgacatgtacatcgcgaccggcaccgacaagcgcacctggggcgcggtgctgatcgacaccaccaggaaacccggcatcgtgctggaggtgccgcacaccggcttcgacctcaacaccgagaagctggggctggccctgcaccgcgaggtggacagcagcgtgctgctggtggccggggcgcaccggcaggcggccggcggcctgggcgacgtggcccacaacgacaagtcgctgttccacctgttcgccaccgagctggcgggcaaggggctggagcagttgcagctgcacggctacgccgacaagaacctgcccgactccgaggccgtggtgtcgaccggaaaggcccgagtcggcccgctggcgcgcgaggtggccgacgctctggccgacgccggcgtcgacatctgccgggcctggaaacgcaggtgcggtgaactggagggcaagaccaacgcgcagggcagggtggcctcgctggagggcgaccagttcgtgcacgtggagatgagctactcgatccggcgcgacccgggctcctgggaccggctggttccggacctggccgcccggatcaacgaaggctga

SEQ ID NO: 2938 - DNA, 1044 bp, Actinoplanes utahensis
atgaattaccagacctatacgcgcagccaggccaccctggtcacgctggccatcctgctggtgctggtcgggggtggctccgtcgcgtacgcggcggcccgctcgacgatgcccgaggcggtcgagatcagtctcggctccgaggaccagggctcggtcgcggccggactcggctaccgggtgcggcggggcgtggatccggcccgcaccgaattcctcgacgccaccggcaaggtcatggcgaccatgaccgacacctcgcggaccgtgcacctgaacgggccggagcgcaccttcgccgaggcccggttcaccaaggccaagctggtcaccgagtactgggtgcggctcgccccgaaaccctggcacaagggcgccgagaccgagaagtggttcgtcgactggttcaccaaggcgcgcaccgaccggtcaccggacgtgctggcgctcgccttcgagtacacgtacaccgcgaagccgaagaaggacgccaccggccggcagtactccggggacgcggcgttcggcccgctgtccgacatcgacccggacgggcgcgcggagaactccgacttctacgactacctgggcgtcccgtggaccttcccggacaagaaggagaagccgtcggcgagccacatccgcagcctggactgctccggcttcctgcggatggtctacggttaccggctcggctacccgctgcgcggcaccaacaaccccggtccgggtctgccgcgtcaggccgccgggctggccgcggtcgggccgggcacgctgctgatgccgaacaccggcaagcgggcggtgaacctggaccggctgctccccggtgacatggtgttcttcaacgccggtccgatcaagggcacgcacatcgagcactccgggatgttcctgggtgtcgacgaccgcgggcactaccgcttcatctccagccgcaccaaggcgaacggcccgaccatgggcgacgcgggcggcgagtccatcctggacggcaccggtcactgggccgaactctggcgcaccgcccggcgcatctga

SEQ ID NO: 2939 - DNA, 486 bp, Actinoplanes utahensis
gtgaccttcgggggagaactcagtgcccagctttccaccgcctgcctcggcatcggtctggtcttcgcgctgctctgctacctgaccaccaacctctccccgggcggaatgatcacccccgggtggatcgcgctggccctgatcgaggacaagatgcacgccgcggtgatcgtcgggatgaccgtggtcacctacacgctcaccaaggtcctgcagcgcatggtgatcctctacggcaagcggctgttcgcggcgatcgtgctgctcagcgtcttcctgcagctcaccctcttcgtgctggtccagcaggacctgccactgctgttcgcccaccagaccctgggcttcgtcgccccgggcctgatcacctatcagctggtccggcagccgcccaaggcgacactgctggccaccggcctggtcaccgccatgacctacggcgtcgcgttcagcggcatcgtggccggtctcgtgccgacgacctga

SEQ ID NO: 2940 - DNA, 1275 bp, Actinoplanes utahensis
gtgctgtatctctacgctgtcttctcggtctgctgcctggcgctgctggcggccggcgtgatcgagcaacgcaaccactaccgcaacctcaagctgatgccgagccgggtgctggtcaacggcatccgcggcaagagctcgatcacccggctctgcgccggcgcgctgcgcggcggcaacaaggtggtggtggccaagacgaccgggaccgcggcccgcttcatcttcccggacgccagcgaggagccggtgcaccgcaagttcggcatcgccaacgtggtggagcagatcggcatcgtccggcgggccgccgtgtaccacccggacgcgctggtgatcgagtgcatggcggtcatgccggcactgcaggagatcaatcagagcaagctgatccagtcgaacatcggggtgctctgcaacgtgcgcgaggaccacctggccgagatgggcccgaccctggacgacgtggcccgctcactgagccgctcgatgcccgagggcggcgtctgcatcaccgccgagaaggaccgcctggcgatcctgcaggaggaggcggacaagcggaagtgccggctgatcgcggtcgacccggagtcggtgacggaccgggagatggccggtttcggctggatcaccttcaaggagaacgtggcgatcgcgctggccgtcgccgcgcagctcggcgtcgaccggcagagcgcgctggccggcatgtgggccgcaccgccggacccgggcgtgctgtcggtggcccgggtgctgtaccgggacaagcgggttcggttcgccaacatcttcgcggccaacgaccccgagtcgacgttcatgaacatcgcgcaactggagaagcagggcctgatctcccggccactgaccatggtgatcaactgccggcccgaccgggtggagcgcaacgggcagatgggcgccctggccgagcgggtgcaaccgcagcacatcgtgctgatcggtgagatgacccgcagcgccaaggtcgccgtcccggccggcctgcaggaccgggtgaccgatctgggcaagatgcccggcgaccggatgctcgccgagctgatggcggtggtcggccccgacgcgtcgatcgtcgcggtcggcaacatccacggccagggcgaggtgctgctgcacgagctggcggcgctgcccagctgggagccgcagggcagcggccgctccgactcgatgctgcgggtctccaccacgcccggcttcgacgtgctcgccgagacagtttttctggaaaggacccaccggtga

SEQ ID NO: 2941 - DNA, 2202 bp, Actinoplanes utahensis
gtgtcaagccggtcggctcaaaccgttacgtcccgggcggcggagctcgctcaggagcaggaagagctgctggcctggcggcgccgcgcgctcactcagcaactgccggcggccgccttcccggccggcaccagcgcgccgtctctggcgtacctctgggccagcttcttcgtggtggtggccgcggtgctggggctcaccgtcaacgcgcacaccggcgccctgccggcgatcgccgactcgcagcgggacatcgcgatcaagctggccaacggcttcgaggcggagatccaccaggagaccacggtgctggaccggatcctgcagagccgtggcagcctctcgcaggccgatctgctggtgcgcgcgatcgccgacggcaaccgggtgaccggcgccgccattgtggacatgacaacgcgtaagtcggtcgtcgccaagggtgacgccgtgccgttggacgcactgcccaacccgctgccgtccggccatccggtcgcggtgaccaccgccgacgggcccatgctggtctacagcgcggctctggacggaacgcagtcgctgctggccgtccagccgatcttcatgcgcacgctgcgcctcaacccggacgccaagcacggcatccacctgctcaccggggacggcaagagcagcctgctgcagggcgcccacgcgatcgacgtggcgcaccaggcgaaggtgttcgacggcctgtacgggatcacctcgtccaaggtccgcgaggtgatcgtcgacgagtggccggacacccggctgatcgccgcggcggccccggtgggtcgcaccgggctggtcgtggtctccctgctgaccgccccggtcgccaagggcaccacggtgaccaagggcctcctgatcggggcgagcctgctcgccgtggccctgctcagcttcctgatcatgcgcaagtcgctggtccgcccggtccgcgagctgctcaaccaggccaaggaggacgccagcggggccaccaccagggaacgccggccgctcggtgtccgggaggcgcaccggatcgccaaggcgctcgccaccaccgtcggcgccgagttcccggagggccgccggtggcggccgtcggtgacccaggggctggcgctggccgcggtgatcgccctgctctggccggccgccgcggtggcgatggtctggcggtccccggacccgcaactgccggcgcagctggtgcgggacggcgagacccgggccgagagcgccgggttcaccctgggccacttcctcgacgacggcctggccaccgtctcccgcacctcccggctggtgaagaccgacgacctggcggcgaccggccacacgttgcagcgcgccctcgccgacgacgaccggctgcgcgcgctgtacctggtggacgagaagggcgaggtgctcagcaagaccggccggcagccgctgcgcaccccggtgccggtccccggcgaggtgggcatccacctcgacgacgcgatcggccggctgccggtggtctacgcctacaacgagctgcccagcgggtacgcggtgatcggcgagttcgacccggaccgtctgctcggacagatcggccgggtcaagggccgggtccgggtggtcgactcggagctgcggacgctgctcgactcccggggttacgtggcctaccagccgctgaccggccggctggcccgggaggtcgcggtggaggcgctgcccggcgtgaccgtcggccggggcgccgccgctgacggtcacccggagctggccgccgcggtcggcatggtggaaccggccagcgtcgcccacctggagtgggccgtggtggtcgagcaggacgtgtccggcgtgcggctgccggagatggtcgagcaccgctggctgctgctggtcgccgccgtggtggtgggcatcgtgctggtcacccacatgtggcagttctacatcttcgtggtgccgctgcgccgcctggcattcttcgccgacaagatgagcagcggcgacctggaccacccggtgccgccgcagcgccacgacgacatcggcgcggtcgccatctgcctggagatctgccgtcaggtgcggcacaccggctcggcccgcttcggcggcgcgctccggttgcgcggcgaaggcccggaccgcaccaccgtcctgtccctcgccgaccgcgccgtccggtcccacagccgctcgtcgaagggctga

SEQ ID NO: 2942 - DNA, 1203 bp, Actinoplanes utahensis
gtggcgagtaacccccagtcgacttctccgctcaaagcggtcctcagttgcctgaccgcggtggcggtctcggccggtgcgctctacgcgttcggaccctggtcagccgacactccggacctggccagcgccgcccgcccgctggacccgccggtgtcggtgcccggccgtacggtgtcggtgctcgccgcgggggacatcctggcccatccggaactgtgggaccaggctcgccgggacggcaacgggacgatggacttcgcgccgatgatggcctcggccaaggagacggtctccggggccgacctggccctgtgccacatggagaccgcggtggcgccacccggcgggccgtacatcggcttcccgaagttcagcgtcccccgggaggtcgtgcagggcatcaagagcctcgggtacgacggctgctccaccgcgtcgaaccacagcatcgaccagggtttcgagggcgtgcagcggaccctggacgcgctggacgcggcgggcctggggcacaccggcagctaccggaccgcggccgacgcggcgaagccgaagatctacacggccaagggcgtgaagatcgcgcatctgagctacaccaaggacttcaacgggttgaagccgccggccggcaaggcatgggtggccaaccagatcaacgtcacgaagatccgtaaggacgccgcggcggcgcgcaaggccggtgcacagatcgtgatcgtcagcatgcactggggcaccgagtacgagcacgagcccgacgtggaccagcagacctgggcccgggccatcgcccagatcaaggacgtggacatcgtcttcggtcaccatgcccacgtcgtacagccggtcgagaagatcggaaatacctggatcatctatggcatgggcaaccagatcgcccggcatgccgagccgatcaactccaatcgagacggagcgatgatgaaggtcacattcggcccatcctcggttccgggccggtggaaggtgatggctctggaggcgattcccacctttgtggacctcaatccgaacatccggctcgtcgacctgccgcgcgaactggcgaaacccgatctttcggccccgcagcggaagatctacgaggcggccgtcgatcgcatcgacggtaatctcctgacccatggggccagtgccgcagggctgatcgtccacggaaccggtaaatcctcctga

SEQ ID NO: 2943 - DNA, 1080 bp, Actinoplanes utahensis
atgggctccgtccgcgtcgccatcgtcggtgtgggtaactgcgcctcgtccctcgtgcagggcgtggagtactacaagaacgccgaccccaacgaccgcgtcccgggtctcatgcacgtgaccttcggcgactatcacgtctccgacgtgaagttcgtcgcggcgttcgatgtggacgccaagaaggtcggcatggacctgagcgaggcgatcgtcgccagcgagaacaacaccatcaagctgaccgacgtgccgccgaccggcgtcaccgtgcagcgcggcccgaccttcgacggtctgggcacgtactaccgcgagatcatcgaggagtcggaggccgagccggtcgacgtcgtccaggtgctcagggacgccgaggtcgacgtgctggtctcctacctcccggtgggctccgagcaggccgacaagttctacgcgcaggccgcgatcgacgccggtgtggcgttcgtgaacgcgctgccggtcttcatcgcctccgacccggagtgggcgcagaagttcgccgacgccggtgtgccgatcgtcggtgacgacatcaagagccaggtcggcgccaccatcgtgcaccgcgcgctggcgaagctgttcgaggaccgcggcgtcgagctgctgcgcacgtaccagctgaacttcggcggcaacatggacttcatgaacatgctggagcgcaaccgcctggtctcgaagaagatctcgaagacccagtcggtcacctcccagatcccgcacgagatgatcaagagcgacgtgcacatcggcccgtcggaccacgtgccgtggctcgacgaccgcaagtgggcgtacatccggctcgagggccgctcgttcggcgacaccccgctgaacgccgagctcaagctcgaggtgtgggactcgccgaactcggccggtgtgatcatcgacgcggttcgcgccgcgaagatcgccaaggaccgcggcatcggtggcccgatcctgtcggcctcgtcgtacttcatgaagtccccgccggtgcagtacagcgaccacgacgcgcacaacgccgtcgaggcgttcatcaagggcgagaccgagcgctga

SEQ ID NO: 2944 - DNA, 654 bp, Actinoplanes utahensis
gtgctggagttggcgatcctcgggcttctgcaggaagccccgatgcacggttacgagctccgcaaggagctggccaccaaactcggcacgctgcgcgccgcgatcagctacgggacgctgtacccgacgctgaagcggttgaagctggccggctggatcagcgaagccgtggcgaacaacaacgaaattgttcccccgatgaccagcaaacggggccgggttgtctacaagatcacggcggacggcaaggagcgcttctccgagctgctggccaccgccggaccggagacgtacgacgacgccggcttcggggtgcacttcgccttcttctcccgcaccgaccgggctacccggttgcggatcctggagggccggcggaggcgtgtcgaggagcgccgggaggggctgcgggagattctcgcccgcgccgccgaccgcctcgacgcgtacacgctcgagctgcagcggcacggactggacgcgtgtgagcgcgaggtccgctggctggaggagctgatcaccaacgagcgctccggccgcaccccggcattccgccaacgcgccggcctggccggcgcttaccccgactccgccgcccacccggctgcggaatccccctcggaaccaccgcgtccgcacctggaccggccgtga

SEQ ID NO: 2945 - DNA, 435 bp, Actinoplanes utahensis
atgcgcacgcagcgacaggtggtggactactcgcttcagaggcgagctgtcctgcgtgacgtgcgcaatggccggatcagtcccctcgaggtctgcgacgcctcgccgtacctgaagaacgctgcgacgttccacggcgagccgaccgatgagcggtgtccgatctgccgccgggagaacctgacgctggtgcactacgtctatggcgacgagctcaagcagtcggccggccaggcgcacaaagccgccgagttgccggtccttgcgatgacgctgcgtgagtgccaggtgttcgtggtggaggtctgccgctcctgctcgtggaaccacctgatcgagcgctacgtcctgggtagggacgcgctcgatgcggacgagccgcccatgcagtggaaaacaggttcggtgtcacacgtcggggagggccggcggtga

SEQ ID NO: 2946 - DNA, 2730 bp, Actinoplanes utahensis
atgaatccgtacggcgaaccgcagaatccgcgtgcccgggcccgagtgcccgggccttccgctgcttccggaccggacgagcaggaccgccccgccccggacgcgtaccggcggtccgccggttccgcggcggtcggtggccgcgcctcggtgggagccgcctccgtcggtgccgcttcggtcggcgccgcgtcggtgggttcggccgcggtcggtggccgcgcgtcggtcgggtcggcctcggtgggtgccgcctccgtcggctcggcggcggtcggtggccgcgcgtcggtcggatccgcctcgatcggcgggcgtgcctcggtgcccccgccgccgcccccgggtggcggcggctcaggcgggtcgggtggcggtgacggcggcggcggcaagcgtccgcgcaccaaggccgacaagaagtaccgccgggcgaacatcctgaccgccgcggccgcggtgctggtcatcatgatcggcgcgggcatcgtcggcggcacgtacttcttcgacgacgtcgagctgccggtccccaagcccgaagcgcagatgaacctcatctacaacgccacgggcggtctcctggcgcaggagggtgacccccgggtcaacgtgccgtaccaggacatcagcgacaacatggcgcacgccgtcgccgccgctgaggacaagaacttctacacccacaacggcatcgacctgaagggcatcgcccgcgccgcctggaacaacttcaccggcggcgacaagcagggcgcgtccaccatcacccagcagtacgcgcggcacgtcgccgacctcaaggcgatcagctacagccgcaagctgcgcgaggcggtgatcgcccgcaagctggagtcgaagtacaacaaggcccagatcatggggctgtacctgaactacatcgacctcggtgagggccggctcggcgcggaggccgcggcccggggctacttcaacgccaccatcaagaagggtggcgacggcaagctcaaggagatcaccccgtaccaggccgcggtgatcgcctcgatcatcaagcagccgtacccgaactccgtgcacaagggttacgacccgctggtcaacgagcccgcctcgcgggaccggtgggaatacaccatgaagaacatgctggacatgcactggatcaaccagcagcagtacgaccagcggcaatacccgaaggcccaggcgaagaccccggcctgcaagacctgtgccgacggcaagccggtcggcatgatcatgcgacacgtcacctacgagctgcaccagctcggcatcaccgacgacatcatccgcaagggcggcctgtcgatcaccacgacgatcgacccggacatccaggccgcggccgaggcggccggctcccgcaacagcgcgacctcgccgttgcacacccggcccagcacctaccagtccgcggtgatcggcatcgacccgaccgacggtgaggtgctcggctactacgccggtgacgatcccgagggcatcgactacggcggctacatggccggtgacggcagtggcgtgatggagagtggtgggcagtcccccgcctcgtccttcaagatctacacactgtccgcggcgctgaaggcgaactactcgttcaacacgctctgggacggcaacaaggagcgcgtcggcggcggcaagatcagcaacgccggccaggacggcggcaagacctgtaacgacaacggccacagcgtctccagctgtgacctggagcaggccaccgtcaagtcgtacaacttcccgttctactggatcgccgaccagctgcacccggacaaggtcgtcgcggccgccaaggcggccggcatccactacatctggaacaacgacggcaagcgcatcgacctcgaccacaccgacgcctcgacctgggacaagtacttcagcgacgagatcggcttcggtcagttccgggtgctcccgctggaccacgccagtggtgtcgcgaccatcgtcgcccagggcgtccggcaccagacgcacttcatcaaggcgatcaagtcggtcgacccgaccagcggcaagcagaccaacctgaagaccattcccaaggacggcacccgggtcttcgacgcggcccagatgtccgacctgaccgcggtgctcaagaggatcccggggcacgccaaccacaccctcgccggtggccgcgaggcggtcggcaagtcgggttcctgggagctcaaccagaaggagagcaccaagaacggcgacgcctggttcgtcggcggcatcccgcagctggctgccacggtctgggtcggcggcaagaagaaccgggttccgctggtcaacggcaacggcggcaagatgttcggcgccaacgagccggccgcgatctggaagaagttcatcgacgccgtcgccgagaagaagaattgggaaaagaaggacttcccgccgcggcagcccggtggcgacgacagcctgggcaacggcaagcccctgccggtgcagcagccgacgcaggacaacagccaggtctgtggtgcgctgtcgttcctctgcggtggcaacaacaacggtggcggtaacaacaacggcggtggcaacaacaacggtggtggcaacaacggcggtggcaacaacaacggtggtggcaacaacggcggtggcaacaccggcggcggccccggcaccggccccggcggcaccggcaccgggacgacgaacaacgacgggacgacgaccaacaacggcggttga

SEQ ID NO: 2947 - DNA, 1518 bp, Actinoplanes utahensis
atgagcgcgcaaccgtccaccgaccggcccgacgtcccgagcgcgacctcggacggtttcgtgcggggactgtcgcagatcatcggcgggccgctgggctcgcatgcgacccgcccggacgcccggccccaccgattctggaccgccccgcggttcgtcctggccctcacctgcctgatcctggcgctgtcctgggtgcagaagtcgccctgcatgagcggcgactggcagaagaacatgcagtacacccggttctgctacaccgacgtgctggccctgtactacgccgaagggctcagcgacggccaggtgccctacgtcggccatgaggtggagtacccggtcgtcaccggctacttcatgggcgcgatcgggctgccggtgcactggtacgggacgacgcagaacacgaagatcaatcagggcagctggttctacaacatcaacgcgctgatcctgtcgatcctggcggtcgccaccgcggcggtcctgctcgccctccgccggcgacgaccatgggatgcggcgatcttcgcgctctcccccatcctgctggtcaccgcaacggtcaactgggacttcctggccatcgggtttgccgccgtcgggctgtacctgtgggtgcgccggcagccggcctgggccggcatcctcctcgggctgggcgcggcggccaaactgtggccgctgttcctgctcgggccgctgctggtgctggcgatgcgcagcggacggatccgggcgttcgtggaagcggcgctcggaacggtcgccgcgtgggcggtggtcaacttcccggtctggtactggcatcacgaggcctggctcaagttcttccggctcaactcggaacgcccggtggactggggcacactctggtacgtcgggcgatacctggacggcaagtggaagagcggggcggccggcgaccagggcccgttccagtggctcagcgaccacgtccccaccctgaactgggtgacctacgcgctgttcgggctggcctgcctcgcgctcgtggcggtcgggctgctcgccccgaagccgccgcggctggcccagatggcgttcctggtcgtcgcgttcttcctgctgaccagcaaggtgtggtcgcagcagtacgtgctctggctgctgccgctggtggtgttggcccggcccaagtggggggcgatcctggcctggacggtggccgagatcgggtacttcgccgccttctacgccgagctgatcggtgccggcggcaagccggtcatccccgagggcacgttcgtgctggcctccgcgctgcgcctgatcaccgtggcggtcctgtgcggcctggtgatccgtgagatctggcggcccgagctggacgtcgtccggcagacctacggcggggcggatccggacgccggcgagctggacgggccggacgcgccgtggatcgagcggatgcggctcggcttcggcttgatcaagccgaccgggccggtcgagctggtgcccccggacgacccggtcgtcatgaaggcctag

SEQ ID NO: 2948 - DNA, 3480 bp, Actinoplanes utahensis
atgaccgagcagccgcaaccgctctcgaccacatccgctgacgacggcgcggaaacgccggggtcggggaagccgaggaggaagcgacttttcgggatcttcgggtccaagcgcgccgacgaaaagggcgtgactccgtcgccacctgcacaaccggcttcggcaccggaggggaaaccggctccggccccgctcccgatcgcgtcggagccggccacttcgggtggcgccgaggcgatcaaggatgtcgatgcggcgggggacgggaaagccgtcggcgcagcggtgccggcggccgccgaggcctccgatccgaaatcggccgatgcaccggctccggacgggccggcgtccggacaaaccgaaaagcgtgcttcttcagccgatgtcgccgatgaagccggggccgagatcgccggaaaagacggggacggcaagaccgacgaaaaacgcgccgggtccgcggactcgacggaccacaagcacagcggcggtacgcaggaagcggacgggacggccgcgaagagtgccgccgcgactccacaggggacgcgcaagcgtaaggagctgcccgagacgcgcccacccggagtgccccaggacccgtggcgcgcattcgctgccatcccggagaaaccgcccggccggatccgccgcggactgcgggcgaccgggcggtggttcatccacgaataccggctggcgatctacgcctgctcgctgctggcggtcgggctgacctggcccaccctgcgatatccgctgcacaccctgccgcacgacctcggcgacccgtcccggcaggcgtggcaggtcgcctggctggggcacgtgctgcggaccaatcccgtcaagatctggcagtccaacgcgtacttcccgaccggggacagcttcgcctacggcgacagcctgctgggctatgcgccggccgggctgctcggcgccgggcccgagtcggcggtgctgcgctacaacatcctcttcgtgctggcccacgcactgctgctgttcggggcgtacgcgctggtgcggcagctcggcgcccggccgaccggggcggcggtgggggcggccgccttcgcgtacgcgccgtggcgccttgcccaggaagggcacctcgacatcgtgtcggcgggggccatcccgctggcgctggcgctgctggcccgggggcacggatggtcgatccggtacgggttccggccggggaaacggcacgccgggtgggcggcgctgggctggctggtggcggtctggcagctcagtctcggcttctcgttggggttgccgttcgccttcgtgctggcggctgtggtgctgttcatgctggtggcggtgccgatccgacggctggtgcagcggcgccgccggaagaaggcggcggcgctcgcggcagccaccgcgacggcggcgggggagagcggcgtcgacaccggcaaacccgccgtgtccggtgcggaggccgcagtcagcaagaccgctgcggacggcaaggatccttcaggtgcccaggactccgcaggtaccaaagactctgccggtgccaaggactccgccggtaccaaacactctgccggtgccaaggactccgcaggttccaaagactctgcgggtgccaaagactctgccggcgttgaggaccctgccggcgttaaggactccgctggcggcgaacatgccctgcctggctccgaggccgcgggcggcgagaatcccgcgaccgcgaagggacccgccaaggccaccgacatgcccgcggccgacgagaagtccgaaacgggagaagatccggttgagggcggggaggttccggcagctccgggtttcgccgcggatgacaagaagggcgcggttgccagcgagggtgtgacactcgcgaaaaccggcgtcaaggcggatgcggtcgacagggagcagccgggggccgaggacacggcagcgggcggcagggtcaaggtcgcgtccgccgatgagatcaaggccgatggcggtgacaaggccggctcggatgccaaggccgatgacgccggcaggaccgatgacgccggcaaaggctctgtcggtgagaaggccgctggctcgacgaccgccggtgagtcggggaaggccccgggcgtagagaatcctgccgagacggagaaggccccggaggcgaagcagcctgccggggcggagaaggccgcaggcgcggcaacaggcgctgaggcggggaatgccgcggaggcgggcgcggagggcaagaaagacaccggggctgaggcgggcggcgcgaggaagacggctgaggacggcaaagacgctgaagccggcaagaacgctgaagccggcaagaacgctgaagccgggacgaaggacgccggggccgggaaggacgccggagccgggacgaaggacgtcggtaagcgtcgcggtaggcgggctggagcgggcgggcggcgcaggcggcggggggcgcggcatcggaaggagaatgcccggcccagccacgcggtgctcggatggcggcttctgctggccgacttcctcggcgtactgctgttcgccgggatgggtgtggtcctcgccatcccgtatctgcgggtgccggacgtgccggagcggtggaagcagatcgggctgctctcgccgccggtgcgcagcctgctgatcgggcccgccgagtcgcggatctgggggacggcgcacgccaccccgcgcggttcgctcggtgcggcggcggagatgtcgctgcttcccgggttcatgctgtacgcgctggcactggccgggctgatcttctcgatctggcggtggcggcagcggctgttcctgatcctcggactggccgtggcgatgatcctgacgctgggcacgacattcttcgccggccgctggacgtaccttccgctgttcgggcatttgccggcctcgttcgacctgctggtgcccggccggctgatgatctgggtgacgctggtgctggcgatcctggcggccggggcggtcgacgagttcgtccggcgaatcgaccacttcgccgcgcagcggaccccgccgtggccgagcccctggttgcgcctggccaccctcgtaccgttgctgctcgtgatcctcgagggctggaacgcgaccgcgcacccggtggccccggcccagccggccgcgatgcggaccgtgggtggccccctgctggtgctgccgacggccgaggtcaccgatcagaccgtgcagctctggaccacctcgcgctatcagcaggtggccaacggcggcggccgggtcgcggcggtccgccaggcggagatgcgtggaaaggtcgcctcgttccccgatctgaccagcatcgaatatctgcggtcgaacaagatcagcacggtgctgctgatccgttccgaggtcgccggcacgccatgggagcaggccggcgatctgccggtcgactcgctcggcatccgccgcgaggacctgcccgacgccgtggtcttccacctggactga

SEQ ID NO: 2949 - DNA, 774 bp, Actinoplanes utahensis
atgcgcatcggagcccatgtcgattccgccgacccgctggccgaggccgccgcccgcggcgccgaggcggtgcagttcttcctgtccgacccgcagagctacaagaacccggcaccccgtgccgacgtcgagcagctccgcgcttccgaggtggacatctacatccacgcgccctaccggctgaacgtcgcctcgcccaacaaccggatccgcatcccgagccgcaagctgctgatgacgcatgcccgcgcggccgccgagatcggggcgaaagggttgatcgtgcacggcggccacgtcgagggcggcgatctcaccgtcggcttcgacaactggcgcaaagccttcgagtacgcggagaaggacggcggcctccccctcccgatcctgatcgagaacaccgcgggcggcgacaacgcgtgcgcccgacggttcgacgacctggcccggctgtgggacgcggtcggctcgttcggggccggtttctgcctggacacgtgccacgcgttcgccggcggggaggacctgaccggcatcgtcgaccgggtcaaggcgatcaccgggcggatcgacctgatccacgccaacgattccaagggtggtttcgactcgggccaggaccggcacgacaacctggggagtgggaagatcgaccccgagttggtggtcgccgccatccgcgcctccggggccacggccattgtggagactccgggcggggtggccgggcagagcgccgacatcgccctactgcgggagcggtcgggctcctga

SEQ ID NO: 2950 - DNA, 966 bp, Actinoplanes utahensis
atgtcgcggcagttccgataccggatggcggcgctggtggccagcggtctgatcttcggcgtgccgctgctcaccaatggcacggcgaacgccgaccagctcgaacccggggcgcgccgggtcacctttgacggtggcatgctgggcctgtcctgcggctcgaagccgagcgtggagagactccgggtgccggccgagagcaccctgcacgtggtcaaccggaccgggcacaacgcccggctggagctggccggcgcgccgcgtggcgtgatcccggagaacggcgccgccgaggtggtgttccgccgcggcaccacgccggtggtcctcgacccggactgcgccggctcggacgacccggtgccgatgctggtcaccgcggtgccctcgaccccctcggcgctgcctgacccggcgcccggcggctcgaacgccggcacgctgccggcgatcgtcgcgggctcggcggggcagtcggtggccggctcggcccttccggacgacgacgccaccgggtcccggcccccgcatcaggtagccggcccgcgcggggtccgcgatccggaccggcgccggaccgccaaggtgcacgccgccggcgaaacgccgcggcaggataccgatcagaaggtcaaaaacgatggatcgcgtacgtcggtagcgggcggaccgacattcgcgggcatgccgccgggggagcgcaagaccgtacttccggcggaccgcgccgcggtggtgaccgcctccccggccggtaccgcccccgccgcggagtctcccgcggcagccgagccgcccatcctcaccgagccggcggcggaaccggtggccgcgatccggccgatgcggaccacccatccgatcggtctgctcggactcaccgcgatcgtctgcgtgctgggggtactgaccgccgcgattcgggcaatcgtgtcgcaacgtgcatctcggtcaaatctggcgtaa

SEQ ID NO: 2951 - DNA, 291 bp, Actinoplanes utahensis
ttgcgtcattacgaactcatggtgatcctcgacccttcgctcgaggaacgcaccgtggccccgtcgctcgaccagtacctgaacgtgatcaggaccgcgggtggctcggtggagaagctcgacgtctggggccgtcgccggctctcgttcgagatcaacaagaaggccgaaggcatctacgcggtcgtcgacctgcaggcgacgcccgaggccgtggccgagctggaccgtcagctccggctcaacgagtccatcctgcggaccaaggtcatccgtcccgagacccgctga

SEQ ID NO: 2952 - DNA, 573 bp, Actinoplanes utahensis
atggctggagaaaccgtaatcaccgttgttggcaaccttgtcaacgaccctgagctgcgcttcacccaatccggggcggcggtctgctcgttccgcatcgcctccactccgcggaccttggaccggcagtcgggcgactggaaagacggcgagccactcttcctctcgtgcagcgtctggcgtgacgcggccgagcacgtctccgagtcgctgcagcgcggcgcccgggtgatcgtgcagggccggctgcgtcagcggtcgtacgacaccaaagagggagagaagcgcaccgtcatcgagctcgaggtcgacgagatcggtccgtccctgcgctacgccacggcgaaggtgcagaaggcgagcaggtccggcggcggcgggggtggcttcggcgcctccggcggcggtggcggcggcaaccggcagttcagcggtggcaacaacagcgggggcggcggtggtcggggcaacagcaacgactacgacgacccgtgggccacggcagcaccggcctccagcggcggccgctccggcggcggcaactcctcgttcgacgacgagcctcctttctaa

SEQ ID NO: 2953 - DNA, 240 bp, Actinoplanes utahensis
atggctaaggctgctgcgcttcgcaagccgaagaagaaggtgaacccgctcgacaaggacgggatcacctacatcgactacaaggacaccgcgctgctgcgcaagttcatctccgaccgcggcaagatccgtgcccgccgcgtcaccggggtgacctctcagcagcagcggcagatcgcccgcgcggtcaagaacgcccgcgagatggcgctcctgccgtacacggcgacggcgcgctga

SEQ ID NO: 2954 - DNA, 450 bp, Actinoplanes utahensis
atgaagatcatcctcacgcaggaggtgtcgggcctcggcacccccggcgacatcgtcgaggtgaagaacggctacggccgtaactacctgctgccgcagggcttcgccatccagtggaccaagggcgccgagaagcaggtcgcggtcatcaagcgggcccgcgaggcgcgcgagatccgtgacctgggccaggccaacgaggtcaagggccagctggccggcctcaaggtcacgctgagcgcgcggaccggcaacggcggccgcctgttcggctcgatcaccccggccgagatcgtggacgccgtcaagaccgccggtggcccgtcgctggaccgccgtcgtctcgagctcccgggtcacatcaagaccacgggctcgtacaacgtccaggtcaagctgcaccccgaggtgaccgccacgttcccggtgaacgtggtcgccgccaagtaa

SEQ ID NO: 2955 - DNA, 1719 bp, Actinoplanes utahensis
gtgccggtcgagccgtcctacggcatgcgagagctgcccgcggccccggagcggcgggacgacgacacctcctggcggtcgaacggttacggcgagccgacccgggaccgggcgccgtccggcgagccgcgggatccgcgcaaacccgcctacggcgcgcagcgcgaacttcccagcggtccgaccccctggcccggcaccgatgactaccaggacgaacccggacggtacgccgatccgcgtcgccgcgacgaccgtgacgacccgccgtacggcggcaccggcggccgtggccagaacgatcggcgcccgtccgcctggaacggctccgaaccttcgtcctgggacggatccggcggctatcgccgggacgtctcccccggaacccccggttaccgcaccggccccgacactggcggcgggggttatcgccccgccggtccgggcggtgactggcgcgcggacctcaacggcggcgccggccatgatggtggcgccgccgtaaccaccggccccgcagggggaacctcgctcaccgccgctccggtctccgggacggccggctaccgtgccgccgcaacgccacccgccgcctccgtcccgggaccggccggcgactggcgcgccgagctcaacggcgccgcccccacgtcgagtgttccgggtgccggctcggctccggtcgccgactggcgcgcccagatgaacggctcgacggccgcccccacgtccagcgccgccggataccgggcctccgccgcggccggcaccgattggcgcgccgacatgggcgccgctccgaccgtgggcgcgaccgccccggtctccggcgccaccggctaccgcccacccggcaccccggctcccgcggccgacgactggcgccgggagatggcccgcgagtccgcccccgccgacggcgatccgcagcgtttcagcacctccgacttcccgcccttccggccgagcggttccgccgccgtcgagggcgccgccaacctggcgctgagcgccacctcggtgatcgccgtccccccggccagccccgcggaggctcccctcaccgcggacaccccgtggccgccacgccgccagcccggcaccgcggccgccgaggaagacacttcctggccgccgcgccgccaagccggcaccgcggccgtcgaagaggacacctcctggccgccacgccgccagcccggcaccgcagccgtcgaagaggacacctcctggccgccacgccgccaagccggcaccgcagccgtcgaagaggacacctcctggccgccgcgccgccaggtcagcggtgcactgttcgagaacaccggctcctacgagcgccgtccggtcagcagcggcgtgctctccagccgccagaacgacctgctcaacccggacgacgaggacgagccggaaacctccagcagcccgctggccgcggtcggctacaccgtcgtctggtacggcgtcccggtcgtcctgttcatcgccggaatgctcctgctcaacagcggccagcgtgcccacgccctgcaaaccctggccaacgccgccccggaattcggcatctcgctcacgttgagcatcatcgtggccttcggtctccgcttcgccaccagctcatggaaatccgccagcgtcggcctggccgccgcggtagtcggcggcggcctggccaccgtcctcagctccgccatcaccggcaacagcctcagctga

SEQ ID NO: 2956 - DNA, 1368 bp, Actinoplanes utahensis
atgtcacgcgagaggcgtgctgcggacccttggctcacccgtgaacgggaagcggagatcgacgacgccgagccgcgctggtccgccctcaccgacaccggcagcatgacgcccagcccggaggcgctcacctggcagcgccgcgccgacgcctgggcgcagcagagcgagatcgagccgtattcgggcggtggcggccaggccgtcgagccggccaaccggtggtccgacgtggccgccaccggccggcccaccttccccgccgacggcaccggctggcgcacccagacctcggagtggcgggccaccggggcgcgctggcggcagaccaccgagtggcgctcgtcgaccggctcacacgtctggcgctccaccaccgaggcctggcagcccggcgacgacgacgaacagcagcagccgaccatttccggcaccgcctggccaacccccgaggacaacacccgggacgtgtcgtcgagctggtccgcgaccaaaccggtcgagcagacctggagcagctccgggaccccgtcctggcagcagcccgccacctcgtgggacagcggccgccgcacccccggggagaacacgaccgacgtcgccggctgggaccgttccggcggctccggctggcagagcggtccgcgcgacgacggccggcactacgtccgcgaggacgaccgggcggcgtggcggcaggccgacaccgagtggtccacccggcgcggccgtcgtcgcgcgcccgagcccgacgagcagccctccggcggctccggctggtccagcggcgacgagacggacaactgggccggccacgccgacaccggcaacatctcgtacgcgccgacctcggcaccctccttcggcagccggtcggtgcgccgcggcccgcagcctccgccgccggacgacgccgctgctgcgcagcgtgggcagacccccattcagttcggcgtacgacccgggtcacgccgcgccgcgcccgacgagggcccgagcggcccgatcgacaccggcgccgcctccgcgggtcagcccgaacgccagcggggtcagagccgccgtgggcgcggcccgcagcggtacaacgccaacccgacgaactggcgcgaggacaccgcgtcctgggacgccgaaccggacaccagcaactggacccgcgacccggacaccgggcagtggagccgggccgaggacgatccgcgcgtgctggcctggcgcgccgaggcggcccgccgggaccagatgcggcagggcgacgccgatgagcagccgggccggggcgagcagcccacgccggacggtgcggtgggctggggcggccggcgcggacagtgggacgacgagccgagcgggctagctagctag

SEQ ID NO: 2957 - DNA, 1434 bp, Actinoplanes utahensis
gtgtcgatcaccgatgacgcacgaccggatccgcggccaccatctcagccgtccgggggaccccagagtggcggatccggccggtccgacgcgccgaccggcggttcgttcgataaggcgcccccgcaggacgtcgccgccgagcagggcgtgctgggcggcatgttgctgtccaaggacgccatcgccgacgtcgtggagatcctcaagaccggcgatttctaccgcccgatccacgccaccgtcttcgacgtcatcctcgatctgtacgggcgcggtgagccggccgacgcgctgaccgtcgcggccgccctggccgacagcggtgacctgcagcgcgttggtggcgtaccctatctgcacaccctgatcgagagcgtgccgaccgcggcgaacgcctcctactacgcccggatcgtcgccgaccgggcgatcctgcgtcgcctggtcgaggccggcaccaagatcgtccagttgggctacggcgccggcggcaacggcggccgcgacgtcgacgacatcgtcgaccgcgcccagcaggcgatctacgacgtcaccgagaaacgggtcagcgaggatttcgcggcgctcggcgacatgctgcagccgactctggacgagatcgaggcggtcggtgcctccggcggcgtcatgcagggtgtcccgaccggcttccaggatctggatcgcctgctcaacggtctgcacccgggccagctgatcatcgtggccggccgtcccggtctcggtaagtcgaccgcgagcatggacttcgcgcgcaatgcggcgatccggcacgggtgcgccagcgccatcttctcgctggaaatgagcaagatcgagatggtgatgcggctgctctccgcggaggcgcgggtgccgctgcacacgctgcggtccggccagctctccgacgacgactggaccaaactggcccgctgcatgggtgagatcagcgaggccccgatcttcgtcgacgacacgccgaacatgaacctcatggagatccgcgcgaaggcccgccgcctcaagcagcggcacaacctgaagctgctggtcatcgactatctccagctgatgtcctcgccgaagaagacggagagccgccagcaggaggtctctgagctgtcccgtggcctcaagcttctggccaaggaggtggagtgcccggtgatcggcgtcagccagctgaaccgtggccccgagcagcgcaccgacaagcgcccgcagctgtccgacctgcgtgagtccggctcgatcgagcaggacgcggacgtggtgatcctgctgcaccgcgacgactactacgacaaggagtcgccgcgcgccggcgaggccgatttcatcgtcgccaagcaccgtaacggtcccaccgacacgatcacggtcgcggcgcagctgcacctgtcccggttcgtcgacatggcgatctag

SEQ ID NO: 2958 - DNA, 342 bp, Actinoplanes utahensis
gtgactgaaaccactgatcgtgcggctgaccaggcgctgcggaacgatcttgcaaacgtctacggccgctacgaagaattacgctccggagtggacgaactacagcgcagcctggccacgatgcaggtgagcgccacatccccggacggcctcgtgcgcgccaccgtgaacgccgacggcgacctcgtcgacctgcgtctcgaccagcaggcctgccgcgagtggaatgtggagacgctggcccgggtgatcgtcgagacggtgcagcacgcgtccgccggcaagcaccgccaggtcgaacagctggtcaccacgcaccgcccgccggacgagaccgcctga

SEQ ID NO: 2959 - DNA, 147 bp, Actinoplanes utahensis
gtgcaccacgctccagccgcgcactacccgccgccggtgatccaccagccggtggtgcactacggacatcacggtcattaccggcatcacggctaccacggtcactaccaccaccggcgcagcttcctgcacgatctgttcgactga

SEQ ID NO: 2960 - DNA, 1482 bp, Actinoplanes utahensis
gtgaccaaacgcgccgacggactcacggccgacctcggcctctatctgatctctgcggcgttcgcgctggtcaccgggctgacctcgacactgtcgccgcatcgcggatggggcctgaccgccttctggggctacctggccgccaccctgatggtcgccgggcaacttctcaccggccggccggtgtccgatcggttccgcacctggcaggcgtggctcacctgggccgctgtcgccctcgtgcccctggtggtggaggcggtgcagcgggccggcgggcgcaccgaccgggcccaggacgaggtgctggtcgtcgaggcgatgggcaggtcactgctcgaccacggcacgccgtatctgagccgggccggcatcgccgcgctgccggtcgacgagcggctgctgggctaccggccgtaccagccaggcatggcggtcttcgggcttccgcgggccatcgccggtgaccattggtggacggatgcgcgggtctggttcgcgatcaccgcgatcctcgcggtcggctcggccgtcgcggtcctccgcgccgcacaccctttcccggtacgcgggttgcaggcggccaccgtgctcccggtgacggcgctgaccctggcgaccggcggcgacgacattccggtgctcgccctctgcctgctcgccctggcactggccgccaccgaccggttcgggtgggccggaatcgccgtgggcgcggcggccggcgccaagctgttcgccttcccggtggtggcggttctcgccgtgctggccctggtcagcggtcgcggccgccggctgctgcccggggcggtcgggctgccactgctggccctggtgccgccgctgctggtgaacgcggattcgctggtggagaacgtgctgcggttcccgctggggcatgggctggtgaccagcccggcgcagtcgccgttccccggatatctggtggcgcagcatctgccggccggtcacgtgctggcggccgggctgttgggcggggcggtgctggtgatcggatggctgctcctgcggcggccgccccgggatgcgggggcggccgcggcatactgcgggtgggggttgctcgcggccatcctgctgatgccgacgacccggttcggctacctgctgtatccggcggcgttcctggtgtgggcacataccctgcggcccggcgatgcgacggccgatcgcggagccgccacggccaatgccggcgccaccaccgccgatcccggcgccgccaccgccaccaccgctcatcccggctccaccaccgccgaccccggcgccaccaccgccaccaccgctcatcccggctccaccaccgccgatcccggcgccaccaccgccaccaccgcccatcccggcgccaccgccgccaccaccgccgccgatcccggcgccaccgccgacgccggggtcgccgccgccgatcccgttcaggagacgcacaggtccttccgccccatggcatga

SEQ ID NO: 2961 - DNA, 2520 bp, Actinoplanes utahensis
atgtctgagactggcaccaacgacgacgcgaccgatcagcggctccagctgctcgtcggtctcgtcgtcatgctggctgccggcgtcggcgccatctgggcggtgtacgcgtaccacgccccgcagccccgccccccgctcttcgtcctggcgctcctgctggccgccgtggtgaccaccaacaagctgcgggtcttcgtccggatccggtccaacttcttcggcaccgcctgggacgaggttccggtcctcgtcggcctgaccctgatccccccggtgtggctgctgctctgcgccgccgccgggcacgccatcctgcggatcgcggtgcgggccggcctgcgcaagaccgcgttcgcggtcgccaaggagacgctcgcggtgagcgcggcggcggccgcctttctggcgctggggatccggcccgacctgaccgccccggccctgccgattctcgccatcaccgccggcctgctggcctacgcgttcgtcgacgacctggtcttcgccccgatcgtggccaccaactcgcacatcggcatcctgcaggccgcccggcagaatctgctcggcaaggtgatcagccacctcggccagttcgtcgcctgcctgctcgtgctctgggtgctggccaccgacgcgaacgtcatgcttctgctggtcgtcccgctcgttgtggcttgcatgcacctctggcagtcgcgcaccacccgcacccggcaggagcgcgagtcctggcaacgcctggccaaggccaccgacgagctgaacgcggtcgacctgacccaggtgctgcattccgcgacgacccgcgcggcgcagatcttctcggcggccgaggccgccatcgacctgacggccggaggagccgatcggacggtacgcgcgaccggggcgcacgtgctcaccgacagcccccggacggccggcccgacgctgcccgacgagaccactgtggatctggtcgcccacgacggtgggctgcgcgtcggtgtgctgcgcctgcgtttcggcggcacggtccggctcaccgaggtggagcagtacaaactgcgtaccttcgcgtcggccgtctgcaccgcgatccgcaacgcgcaggcgtacgccgaactcgcccggatcgccgcggagaacgcgcacgccgcgacccacgatccgctcaccggcctgcccaaccggcgccagctctacgagcaggccggccacctgttcgccgacggcggtcacgacggcctggccgcgctcctgctgatcgacctgaaccacttcaaagaggtcaacgacacactcgggcacgcggccggcgacgacgtgctgcgcgaggtggcccgccggctcagcggcgcggccgagcccggcgacctggtggcccggctcggcggcgacgagttcgcggtgctgctcaccgccctgcccacgcccgcgctggccagccaccgggcggccgccatgctgggcgcactcgagccgggcatcgaggtcgagggcatgatgatcaccgtcgaggcggccggtgggatcgcactggccgccggcgcgggcggcgtcgaggagctgatgcgccgcgccgacatcgccatgtaccaggcgaaacgcgccggtgagccgaccacgatctacgcacacgcgcgggacaccgcggacgtcgagcggctgatgctgaccggcgagttgcgccgcgcggtcagcgagcacgagttcactgtggacttccagccgatcgtcgacctcggcagcggcgaggtggtctcggccgaggcgctggcccgctggcggcaccccgaccagggcgacctctcccctggccggttcctcgaggcggtcgaacgctccgggcagctgccggccttcgccgacgcggtgctggaggaatcgctgctggccatgcaggcgtggcgggcggccggattcgacctgccggtggcggtcaacgtgtcgccgcgcagcctgctcgacccgcacttcccggccaccgtgctggcccggctggaacgccacgacgtgccgcccgggcagctggtgctggagttgaccgagacgctcacgctcagccagatcgacgtggtcgagcggaccctcgccgagctgcgcgacgccggcgtgcggctggccgtcgacgacttcgggaccggggtgtcgtcgctctccgtgctctcccggatcccggtgcaccaactcaagatcgaccgcgggttcgtggccgcggtggagacctccgccgaggccgccgcggtcatccggaccaccgtcgacctggcccgcaacctgcagctcacggtggtcgccgagggtgtcgagagcgagccgcagcggcgggcgctgtgggagctcggctgcctcgccgggcagggccacctgttcgcccggccgctctcctcggcccgcttcctgagtaccctgcggcgcggttccggcggccggcccggcgtgctcgccacggcgttgcacgaggtcggtgcggtggtccggatgccggcccgccgggtcgccggatcatctctgccacacttgccggcgtga

SEQ ID NO: 2962 - DNA, 492 bp, Actinoplanes utahensis
atgccccaggaatcgcatctgacccacgtcgacgagtcgggcgccgcccggatggtcgacgtgtccggcaaaacggtgagcgaccgccgtgccgtcgccgccggcgcggtgcacaccaccgccgaagtgatcgacctgctccggggtgacaacctccccaagggcgacgccctcgcggtggcccgcctcgccgggatcatgggcgccaagaagacccccgacctgattcccctctgtcacccgatcgggctgcacggcgtcaaggtccagctggaactcggtgccgacgtcgtgcacatcaccgccgtcaccaagaccgcggaccgcaccggcgtcgagatggaggcgctcaccgcggtcgccaccgccggcctcgcgatgatcgacatgatcaaggcggtggacccggccgcgagcctcgacgcggtccgcgtgctccgcaaagagggcgggaagaccggcgactgggtgcgaccggagaaccgcccgtga

SEQ ID NO: 2963 - DNA, 474 bp, Actinoplanes utahensis
gtgaccatccgggcccgggtcatcgtcgcctccaaccgcgcggcggccggcgtctacgccgacaccagcggcccccgcctcgtcaccggcctgcgcgagctgggctgcgaggtcggcgaaccggtcgtcgtcccggacggcgagccggtcgccgaagccctgcgcgccgccgtcgccgaccgcatcgacgtcgtcctgaccagtggcgggaccggggtcaccccgaccgaccgcaccccggaggcgacccgcggcctgctcgacttcgagattccgggcatcgccgaggcgatccgcgcctacagccgtgaccgggtcccggccgccgccctctcccgaggtcttgccggggtcgccggccgcaccctgatcgtcaacctgcccggctccaccggcggcgccaaggacggcttggccgtcctcggccccctgctggcacacaccgtcgaccagatccgcggcggcgaccactga

SEQ ID NO: 2964 - DNA, 1218 bp, Actinoplanes utahensis
gtgagcactcctgcgattggctgggaccgggcccgcgagctcgcccaccaggccggcctgaccgccgccaccggcgtcgagcggatcccgctcgctgacggcgacggacgcaccctggccgagccgctgcgcgccctgaccgccctgcccgcgttcgccacctccagcatcgacggctgggcggtccgcggcgacggcccctggcgccgggccggtcaggtgctggccggcggcaccccgcccccgctcaccgaggacggcacctgcgtcgagatcgccaccggtgcgatggtcccggccggcgccgccgccctgatccgggtcgaggagtcggagatcggcgctgacggcacggtcaccggcacccctcgtcccagcccggagtggcgcctgcccggtgaggaggccgccctcggtgaggaactcctgccggccggcacgccggtggacccggcggtcatcggcgtcgcggccacctgcggtcacgagcttctggcggtacgccgtcagccccgcgccgccctgctcgtcttcggcgacgaactgctgacctcgggccggcccggcgacggccgcgtccgcgactcgctcggcccgcaggtcccgtcctggctgcggcgctgcggcgccacggtcacctcggtcagcggcccggtcaaggacaccctggacgcccacgtcgaagccgtccgcgccgccctggacaccgccgacctgatctgcaccaccggcggcaccatgcacggcccggtcgaccacctgcatcccgccctgaccgagctcggcgcggagtacgtggtcaacacggtcggcgtccgccccggcttcccgatgctgctggcccggatccccggccccgacggccgcccccgcttcctggccggtctcccgggcaacccgcagtccgcggtgatcgccctgatcagcctggtagccccactgctcaccggcctggccggccgcccgttccgcgccgaccttccgctggtgaccgcggcccggccgatcccgggccgcggccgcgacacccacctggccctggccaccctggatcacaccggccgcatcgccaccccggccggccacgtcggctccgcgatgctgcgtggcctggccaccgcccacggcttcgccgtgatccggcccggcgtccgggtcgaggccggcgacgacgtcccgttcctgcctctcccgctgcttcccggcgagcgcccgtga

SEQ ID NO: 2965 - DNA, 492 bp, Actinoplanes utahensis
atgaccagtcccgcagcggccacgccggagaccggcccggacgtcgaaccggtggacaccgccgaacggcggtcacgggtcgtcctcgccgaggtgctggacaccccactggatctggccgcgcacgaggccgccgtcaccgaccgccgcgccggcgcggtcgtctccttccagggcgtggtccgggaccacgaccacggcaggggagtgaccctcctcgaatacgaaggtcacccgtcagcacccgccgtgctgcgcgaggtcgccgaggagatcgccgccgaccccgccgtctacgcgatcgccgtctcgcaccgcatcggcccgctggagatcggcgacgtggccctggtcgcctcggtcagcaccgcccaccgcgcggccgccttcgcggcgtgcgcccgcctggtcgacgaggtcaaggcccgcctgccgatctggaaacgccagctgttcaccgacggcgccgaggaatgggtgaactgcccgtag

SEQ ID NO: 2966 - DNA, 1296 bp, Actinoplanes utahensis
atgccggtcacccagcgacgcgctccacgcgccaccagaaccagatccgcactggtcaccgtcggcgcactcggaaccctcgcgctcatctcactgacgctttcccggtacgggctgagcaccctcgcggtgacccacgcggcggtgcgggactggctcggcggcggcgggctgtacacgtaccgccaacccggaacacaggccggtgccgcgctgccgcccggactcgccatcatcctggcgcccctcgccctgctgccgctgaaggcggccggctggctactcgccctcaccagcgtcgccgcactactgctctccgccgtcgttctcaccaccccgatcgcccggcgacaccggcggcggcgcaccccgatcgccctcaccgcggccgccctcgccctgctcaccgaacccgtccgggcgaccctcggcgaaggccggcccgagttgctgctgttcggcctgatcgtcgccgacctcgtcgccctgcgccggcaactgcactggcccaccccggcagaccggcacccacccgaccacctgccggaacggctgcgccagggctggaccgaaggatcatgggcgggcgtcgggaccggactcgccgccgccttctccgtgacccccctgttcttcctcgccgggctcctcgtgctgcgccaacgccgggccgcggtcaccgcgctggccaccacgatcaccgtcaccctcgccgggctgctcttcgcaccccgcgagacggtcacctggttcggcgacaccctgtgggaactcaaccgcaccgaacccctgaacgcatccgacaaccaggcactcgccggaatgctcgcgcgcatctacggctacccggcgccacccgtactggtctggctctccttcggcgcgatgctgctcgccgtcggcctcatccgggcccggaccgcgaacctggccggcgacgaggtggccgccttcaccctgatcgggctgaccgcggccggcttcggaccgatgacgacgccggccgagatgctgtggctgctgcccgccgtgctggtgatggccgaccgggtggtgggccgccgcatggcgggcgggaccgggtgtgggcgggcggggcgggcggtgctcggcgggctgaccgtggggggatacgcgctgctgatcgccacgccgggggtgctgctccgctgggacgggtacgcggtggcgttgttcgtgctggtgggaatgctgccctggcggccggggccgatgtgggatcggcccgggccggggcgccgggcggcggcgatcccggggcctcggggtggttga

SEQ ID NO: 2967 - DNA, 579 bp, Actinoplanes utahensis
atgaagcccgtccgcaccgccgcccgagccatgctcgcctcgatcttcgtgatcagcggggtccgcgtgctgatcaagcccggtgagggccggatacaggcggcccgccgggtcaccgaccggttcacgccgctgctggagaaggccgacccgcgcctgcccaccgacccggccaccctggtccggctcaaggccggcaccgacgtgctggccggtctggccctggccaccggccggctcacccggcccgcggcggccgtgctggccgccggtctgctgccgacgacgtacgccggtcatccgttctgggcggctccgccggagcagcgcgccgagcagcaggtgcacttcttgaagaacctggggctgctcggcgggttgttgctcgccgcggccgacaccgagggcgagccgggtctgcggtatcgcacgacccacgcggtcgatcgcggacagcggacgctcacccatgcggtggaccggtcacgccgcgaggtgcgtcgcgcggtgcggaccgcgaagcgggaggcgaagatcgcggcgctctccgccggcgcggcacgcaagctgcccggctga

SEQ ID NO: 2968 - DNA, 1206 bp, Actinoplanes utahensis
atggatccggtgcggaacccgtatgctcccggcgccggccagcgtccacccgagttggccgggcgcggccgcgaactggacgccttcgacgtcgtcctggagcgggtcgcccgcggccgcccggaacgcagcctggtgctcaccgggctccgcggcgtcggcaagacggtgctgctcaataccctgcgctcggcggcgatcggccggctctggggcaccggcaagatcgaggcccggccggaccagtcgctgcgccgcccggtttccggcgccctgcacatggcgatccgcgagctcgccccgcaccaccgcgacccggaccgggtcgacgaggtgctcggcgtgctgaaggcgttcgcgttgcgggccaacgacagcaccgggaaactgcgggaccggtgggcgcccggcatcgacgtaccgccggctcggggtcgtgccgactccggcgacatcgaaatcgatctggtcgagctcttcaccgacgccgcgtcgttggccaccgacgtgggcaccggcatcgccctgttcatcgacgagatgcaggacctcagcggcaccgacgtgtccgcgctctgcgccgcctgccacgaactgtcccagctcggcgcgccgctgatcgtggtcggggccgggctgccccacctgcccgcggtgctgtccgcggccaagtcctactccgagcgcctcttccgctaccagcgcatcgaccggctcgaccgggacgcggccgacctggccctgggcgtgccggccgaacgggagggcgtcgactacgaccaggaggcgctcgacctgctctacgagaagtcgggcggctacccgtacttcgtgcaggcgtacgggaaggccacctgggatcacgcgccgcagtccccgatcaccgccggcgacgtgcagatggcggcgcccgaggcggagagcgaactggcggtcggcttcttcggctcccggttcgagcgcgccaccccggccgagcgggagtacatgcgggcaatggccgtcctctccggcgacccgggtaacgacatggacgccgcggtgccgacctcggacatcgccacctcgctcggacgcaagccggccagcctgtcgccggcccgcgacgccctgatcaagaaaggactcatctactcgggcgagcggggcacggtggccttcaccgtcccgcacttcggccggtacctccgaacacagccggtgtga

SEQ ID NO: 2969 - DNA, 624 bp, Actinoplanes utahensis
atgtcgcacaacggcccatactccggtccgccctggtccggcgggcggcccgaggagccgtatgcggaaccctccgatccctggggtgagagcagccgcgctgtcaacgatccggcatggggctccccgcagatcccccaccagcagttctccggttccccggcggcctcggcgcccgggccggccgccggaaggtccgggccgagccggcgcggcttcgcggtcggcgccctgatcgcggtgctcagcgtgctggtcggcggcgggctcgccaccacggtctggtacgtgctgggccgcaaggaccgggcgggcaccgcggcctcgacgccgccggccggggtgaccgtgccccgggtgcagcccagcgccgacgcgcggttcgccaaccgggggcagtgcatccgcaacgagggcaccaacgcggaacctcagctgcggatcgtggcctgcgcggcgaacacctacgaggtgctgaagcgggtcgacggccggaccacgggcgaaaaggacgcgatcgccaagtgcgcgaaggttcccgggtacaccaagtggtactactacgacaccgagtacgacgatgtcgacttcgtgctgtgcctgcgcgagtaccaaccggagtga

SEQ ID NO: 2970 - DNA, 507 bp, Actinoplanes utahensis
atgacccgtcaattctatggtgttttgtcgggttttctggtttccgccctactggctgcacgctgtggcccggttccccagctcgcggtgctgctgcccgcggccgccatcggcgtgcggctggcgctgaccgacctgcgcaccctccggctgcccgatccgctggtcgtcgcgctggccctggtcaccgggcttccgctggccgtgctggcgcccggccggatcctgccggccctggcctcggccgtgctggtcggcctcacctacctggtgctcgcgctgctgcccggacgcggtctcgggctcggcgacgtgaaactcggcgcggtcctcgccctgctgctcgggctgttcggcggatggcccgcggtgctcaccggcttcgcggtcgcccacctggtcggcgggctgaccgcggcctacctcatgatcaccgggcggggccgggtgttcccgttcggcccggcactgctgctcggcgcgctcgccgcgatcacagcagcctga

SEQ ID NO: 2971 - DNA, 3126 bp, Actinoplanes utahensis
atgcgagacgtggaggtcagcccggacacatacgtcgcggacctgcacattcactcgcggtactcgcgggcctgcagccgtgacctgacgctgcccaacctggcctggtgggctcggcgcaagggcatcgcgctgctgggcaccggtgacttcactcacccggcctggttcgagcatctgcgggagagcctggagcccgccgagtccggcctgttccggctcggcgacgagcagccggtcacccggcgactgccgggttcgctgcagggcaccgcaccggcccggttcatgctgagcgtggagatctccacgatctacaagcgggacgaccgcacccgcaaggtgcaccacctgctctatgcccccgacttcgagtcggccggccggatcaacaccgcgctcggccggatcgggaacctgaccgccgacggccgcccgatcctcgggctggactcccgcgacctgctggagatcaccctggaggccggcggttacctgatcccggcgcacatctggaccccgtggttctccgcgctcggttcgaaatccggcttcgacgcgatcgccgactgctacgccgacctggccgaccacatcaccgcggtggagaccggcctgtcctccgacccggcgatgaactggcgggtctccagcctcgaccgctaccgcctggtgtcgaactcggacgcccactcccccggcgccctggcccgcgaggccaccctgttcaccggcgccccggactacttcgccgtccgggacggcatcggcctggccggcaccctcgaattcttccccgaggagggcaagtatcacgccgacggccaccgcgcctgcaacgtcaactgggagccggaacgcacccgtgcggccggcggcctctgcccggagtgcggccgcccgctgaccgtcggcgtgctcagccgggtcgaggacctggccgaccgcccggagggtttcacccgggacgtccacgtcgagcacctgatccagctgcacgagatcctcggcgagatccacggcgtcggcccgaagtcgaagaccgtcgagtcgcaactcacccacctggtcgcgacgctcggcgcggagctggacatcctgcgcaaggtgccggtcgacgagatcggcaaggccggcggcgacgagctgcgggaggcgatcacccggctgcggcgcggcgacgtgcgacgggttgccggctacgacggcgagtacggggtgatcaccctgttcgagccgggtgagctgcgcaaccggtcgagcgccccgcaggtcgagacgctgttcgacatgttccccgagccgaaggcgccggcccggcccgccgcggagaagccgaagcccaaggccaagccggtcaaggcgaaaccggcgccgccgccgatcgccccgccgcccagcccgcacgagccgttcgagccgatgctggccgggatggaggaggtcggcaccggcctgctcgaccggctggacgcgatgcagcgggtggccgcctcggcccccggcggtccgctgctgatcgtggccggcccgggtaccggcaaaacccgcacgctgacccaccggatcgcgtatctctgcgccgagctcggcgtcttcccggagcgctgcctggcgatcacgttcacccggcgggccgcggccgagctgcgcgagcgcctggagagcctgctcggcgacgtggccgaggacatcaccgtgggcaccttccactcgctgggcctgaccatcctgaaggagaacgccaaggcggccgggttgaccgccggctggcggatcgccgaggagcccgagcagaagcaggcgcgggagcaggccggcgacgacgagagcgcataccggaagctgctgcgccagcaggatctggtcgacctggacgatctgatcagcgtgccggtggcgctgctgcgcgaggatcctgccctggtcgagcggtatcggaaacgctggcaatggatcttcgtcgacgagtatcaggacgtcgacgaactgcagtacgagttgctccggctgctgtccccggcggacgggaacctgtgcgcgatcggcgacccggaccaggcgatctactcgttccgcggcgcggacgtgcgctacttcctgcgcttcaaccaggatttcgtcgacgcccggctggtccggctgacccgcaactaccgctcgtcggcgccgatcctggccgccgcggtgcaggcgatcgccccgtcgtcactggtcagcggccgccggttggatccggcccggctcgacccggaggcgcagctggtcggccgctatccggcccgcagcgtctcggacgaggccgacttcgtggtccgcaccatcgacgagctggtcggcggcctgtcccaccggtcgttggactcgggccgggtggattcgcgcgcggccaccgccggggcgctgtccttctccgacgtggcggtgctgtaccgcaccgacgcgcagtccgggccgatcctggaggcgctctcccgggccggcatcccggtacagaagcggtcgcacaaccggctgcgggaccggcccggcgtcgaggtgatcgcccgcgagctgcggcacgccggcggtctcagcggccccctcgccgcccgggtcaggcaggccgcccaggggctggcccagcggtatgccgccccgaccctggacggtggccagatcgccccggaggacatctggtcggcggccgacctgctcaccccgctggcccagcgggccggcgacgaccttccgctgttcctgcagcagttggagaccggcgccgaggtggacgcgctggatccgcgcgccgaggcggtcaacctgctgaccctgcacgccgcgaagggcctggagttcccggtggtgttcctggtcggctgcgaggacggcttgctgccgctgcgctggcccggtgcgacgccgaccgatgaggagatcgccgaggagcggcggttgttcttcgtcgggttgacccgggcgcaggaccggctctacgtgagccactcggcgaagcggtcgcggcacggcagtgagcgggagcaacagccgacgccgttcctcgacgtgatcgactccgggttgttcgagcggttgggcgaggcagccccggcgaaaccgaaggatcggcagctcaggctgctgtga

SEQ ID NO: 2972 - DNA, 1317 bp, Actinoplanes utahensis
gtggtggcgttcgtcgcagtgatcatcttgctgctcttcgccctgatctgtgcctacgtgtggaaacggctcgtccgggacacgctgcgatcccggtgggggcggcgggtgggcacggtggtggccctggtgctcgcgctgctggtaccggcgacgctgatcggggtgcgggccggacacgtgaagtggctggcctggccgggttacctgtggatcgccgtgctgttctacctggtgatcactctggccgtgctggagatcccgcggctggtgctgcgggtgctgtgggcagaccgggggcgtaccgccgcaagcgccgcaggaccgctggtccggggcggcgtcgcggacggtgagttgcagccggccggggccgtcccggccgagggcagcgccggagtgaccgggtccggcgcggcggatccgagcggtgcgccgggtgcaccgctgccgacggcagccggcgaggcgccggcggacggcgggccgcctgcggggatcgaccggcggctggttctggcgcgcggtgcggcgatcttcgcagggctgaccgcggcgggtgtcaccggctacggggtgcgggaggccaccggggcaccacggatcgaccgggtgcggatcccgatcgccaagttgccgcgcagcatggacgggacccgcctggccgtggtgtccgacatccatctggggccgctgaccgggatcgggcacaccgagcgcatcacccgggtgatcaatgcggtgaacgcggacgtggtgtgcgtcgtcggtgaccttgtggacggcactgtcgcggaactggggcggctcgccgagccgctgcgcgggatcgagtcgcgacgcggcgcgtacttcgtgaccggcaaccacgagtactactccggcttccggccgtggatcgacgaggtggccgagctcggcatgcggccgctgcgcaacgagcgggtcgcgatcgacgggctggacctggccggagtgaacgacctgggtggggaggactacggcgatccggccgacttcggcagggcactcggtgaccgggacgtcagccggccggtggtgctgatggcgcatcagccgctggccgcccggcaggccgcgccctacggcgtggacctgcaggtgtccgggcacacccatggcggccagatggccccgttcaacttcgtcgtgaagcttcagcaaccggtagtctccggcttcggacaggtggacggcgtgccggtttacgtgaccaacggcgcgggtttctggggcccaccggtccgcgtgggggcgccaccgcaggtcacggtggtcgaactccgcgtggcgtaa

SEQ ID NO: 2973 - DNA, 243 bp, Actinoplanes utahensis
ttggtcaccgttcgctatttcgccggagcccgggcggccgccggcggggtgtcggccgaggaggtggcggccggctcgctggacgagctgagccgactgctgaccgaccggcacggggagcgcctcgggctcgtcctgacggcggccagcttcctggtggacgggctcacccgacatgaccggcgggcgccgctgcaggccggggcgacggtcgacatcctgccgcccttcgccggcggctga

SEQ ID NO: 2974 - DNA, 1041 bp, Actinoplanes utahensis
gtggagaacagccgaacgggcccggtggcggccgtgatcgcgctcgccgaccgcttcggccgggtcgcgaccgacctgcgcgtctccctcaccgaccggtgcaacctgcggtgcacctactgcatgcccgccgagggcttggcctggatgccgcagcccgagcagctcaccgacgacgaggtgatccggctggtgcggatcgcggtcgagcggctcggggtgaccggggtccgattcaccggcggcgagccgctgatccgccgcggcctggtcggcatcgtggccgcgacggccgggctgcggccgcgcccccggatgtcggtgaccaccaacgggatcgggttggagcggctcgccgggccgctgcgcgaggccggcctcgaccgggtcaacgtctcgctcgacacgctcgacccggcccgcttccgatcgctgacccggcgcgaccggcacgccgacgtgttgcgcggcctgcgcgccgccgccgaggccggcttgaccccggtgaagatcaacactgtgctgatgcggggggtgaacgacgacgaggccgcgccgctgctgcggttcgcgctggagcacggctatcagctgcgcttcatcgagcagatgccgctggacgcgcagcatcagtgggaccggcacaccatggtgaccgccgacgagatcctggccgcgctcaagcccttcgatctgtgtcccgacgtggtttcacgtggaacggctccggccgagacctggctggtccccggcttcgtcgacgcggccggcgcgccggctcgggtcggcgtgatcggcagcgtgacccgcccgttctgcggtgactgcgaccgcacccggctgaccgccgacggccaggtgcgcaactgcctgttcgccaccgaggagagcgacctgcgcaagctgctgcgcgacggggcgccggacgtggagatcgccgagtcctggcgggtcgcgatgtcgggcaagcgagccggtcacggcatcgacgacccggcgttcctgcagcccgcccgacccatgtccgccatcggaggatga

SEQ ID NO: 2975 - DNA, 894 bp, Actinoplanes utahensis
atgggatgtccgtcacccgaagcgcaagataaccgggtggacatggcgtatctgcgcgcgcacccggagcacctcccgacatttctcacccaccagcggatccgggagacaccgatccatcgcggagtcacctcgacgtcccggctgaccctcgacgacgggacgtcgctgttcgcgaagaccgcgacgtcgtgcgccgcggaggcggcgggactgcgctggctgcgcgcggcgggggcgacacccgtaccggaaatcgtggtggcgctgcccggcatgatcgcgatggaatggatcgaacccggtgccgccggccgtgcggccgcggagaccttcgggcgcggcctggccgcgctgcaccgcagcggcgcggagaccttcggcgcgccctggcccggctggatcgggccgctcccgctcgacaacacgccctccgcggggccgtggagcagctggttcgccgacacccggctgctgccctacctgagggcctcggtcgatcgcggtgcgctctccggcgccgacgccgcactggtcgaggagatcatcaagacgattgcggcgtacgccgtggaggaaccgccggcgcgcatccacggtgacctgtggccggggaacctgctgtggggggccgacgggcgcgcgtggctggtggatccggcggcgcacgggggtcatcgggagaccgacctcgcgacgatgtcgctcttcggcggcgtggcgcacgccgatgtgatcctcggcgcataccgggccgaatggccgctggccgacgggtgggaacggcggatcccgttgcaccagctgcacctgctgctcgtgcacaccgcggccttcggggcgggctaccgcgatgcggtggtggcggccgcccgcgccgtcctgcgcggatga

SEQ ID NO: 2976 - DNA, 504 bp, Actinoplanes utahensis
atggcccctgtcgtagtgcgttcgtaccggccgagtgaccactccgctggccggcggctgtgggctgagctcacccggcagcagcatcagatgtacggcgagtccgatgacgacggtggcgccggtttcgaggagtatctgacccgtctcgacctgtccggcctgtgggtcgccgaccacgccgacgacggggtgatcgggatggtcgggctgatcatgcgcaaccgggccggtgaggtcgagccggtggtggtcaccatcacccatcggcacaagggcgtgggccgccgcctgctgcagcacgtcgccggcgaggcgaagaagcggaacatgacctcgctgaccatctccccgtcgtcgcgcaacgtggaggcgatccgcagcctgcatgccgccggttacgacgtggtgtcgtcgatcgagctcaccatggatctggaccgccacgcccacgcctggcagcaggagggtctggagctgcaaggcctgccgttccgcaactga

SEQ ID NO: 2977 - DNA, 1065 bp, Actinoplanes utahensis
atggcacgcgccgctcccggccgccgggccacgctgccccgcatgacacccgactgccgcctcgccatccgcaacccgtccgagctcatcgccgtcgtgccgttcctgatgggctatcacccgagtgactgcgtggccctggtcggcctcgcccgggaccgggtcgacttcgctctctgccacgacctgcccggcccggactggaccgacggcgacgcccgggccgcggccggttcggtggccgacgccgtggcccggcagcgggcccgcaccgtggtggtgatcggctacggcccgcccggccgggtcagcccggcggtgctcagcaccgcccaggcggtccaggaccgcggggtggaggtgctggagatgattcgggtcaccgacggccgctggtggtcctacacctgtgccgacccgctctgctgcccacccgagggcatccgctgcctgccgggcgacagtctggtcgcggccgaggcgacctatcacggcagggtcgcgctgcccagccgccgggcgctgaccgcgcaggtggccgcggtcggcggggcggagcgcgaggcgatggcggcggccaccgagcgggcccggcgccggttcaccgacctgatcgccgacgatctgagcgccgaccgctacggcaggctgattcgccagcagggcgaggccgcggtgcgcgccgcggagaaacgctaccgcgcgggctcccgcctggacccggacgagaccgcctggctgggcgtgctcctggtgaaccgcaaggtggaggatctcgcgctggaccgggtgaccggacagggctggcagatccagctctggaccgatgtgctgcgccgcgccgagccggcctatgtcgcgccaccggcctgcctgctggcgttcagcgcgtggcgggccgggcacggctcactggcccgggtggcggtcgaccgggcgctggccgaggagccggagcatcagctggccggcctgctgcacaacgtgctgggccacggtctggccccgcacatggtggtgctgccaccgcgaggggctggcccgtggcggccgttcagacggtga

SEQ ID NO: 2978 - DNA, 873 bp, Actinoplanes utahensis
gtgaccacgcgctcggacagcgtgggtcgtaagctccgcctcatggggaggaattcggcgcggcggccggtggtgcgcatcgatctcggtgcggctccgggcgatcgccggcagcgccccgacgagctcgcggccgaggagccgctggagatccgggtgcgccggcaaccgctcgcggtcaccatgcgcacccccgggcacgacatcgacctgacgatgggtttcctgctcagcgagggcatgatcggcgccgccgaggacgtggtcacggctcagctgtgcgccgggacggacacccccaacacgtacaacgtggtggatgtcgtgctcgccgcgcacgtgccgccgccggtcaccgatctgagccgcaacttctacaccaccagctcgtgcggagtgtgcggaaaggccagcatcgacgcggtgcgcacccggtcgcgtttcgacgtggccgccgacccgctacgggtgccggccgccacgctggtcgagctgcccggccggctgcgggcggcgcagcgcaccttcgaccggaccggtgggctgcacgcggccggcctgttcaccgcggccggcgagctcctcgtcctgcgcgaggacgtgggccggcacaacgcggtggacaaggtgctcggatgggccctgcgcgacgggcgcctgccgctggccgggcacgtgctgatggtctccgggcgggccagtttcgagctcacccagaaagcctggatggccgggctgccgatgctggccgcggtgtcggcgccgagcacgctcgcggccgagctggccgacgagtccgggatgacgctggtcggcttcctgcgcgggtcgacgatgaacgtctactctcgggcggagcgggtcaccgtctga

SEQ ID NO: 2979 - DNA, 675 bp, Actinoplanes utahensis
atgaggcggagcttacgacccacgctgtccgagcgcgtggtcacgtccgccacccggtcgggatacggtactcacgtggggggatttgcggcggtggtcctggccggtggtgcggcgcggcggatgggtggagcggacaagccgacgctggccgttgccggccagtcgatgctgacccgggtgctggccgcggtgcacgacgctgacccgcgggtggtggtcggccgggtctccgccgacctgcccgttccggtgcacgtgacccgggaggagccacccggtggcggcccggtggcggccgcggcggccgggctcgcgctggtccccgagaccatcgcgtacaccgcgctgctcgccgcggacctgccgttcctcaccggagaggcgatcgacgtgctgcgcctgaccatggagtcggcgccgatggagggcgcggtctaccgggacaccgacggccggctgcagatcctctgcggggtgtggcgcacggctgccctgcgcgccgcgatcgaccggctcgccgagcggcgcggcggcctgcacggcgccccggtccgggagctggtcgagcagttgcgggtcgccgaggtgtcctggcgccgccccggcccgccgccctggttcgactgcgacaccgacgacgacctgcgcactgccgaggagtgggcgagatga

SEQ ID NO: 2980 - DNA, 246 bp, Actinoplanes utahensis
atgagcgagctggacaggtgggtcgccgcggcgagcgccgagctgggcgtgccgcgcgaggacgtggcggtcacgacggtgctcgacatggcgcgcgacgtcgcgcacagcgtggtccgccccggcgcgccggtcaccgcgtacctgatgggcctggccgtcggccggggcgccgacctgaccgaggtcgccgagcgggtcaccgcgatggcgctgagctggacaccggccaccgaacaggcctag

SEQ ID NO: 2981 - DNA, 1080 bp, Actinoplanes utahensis
atgacggcagaaggcgtggcggcgggcgactcacccgagggcgtgttgctcgacgaaccgaccacggccgacctacgggccaaggtcaccgaggcgtggcgggagttcgccggcgctctggccggggtcctgtcccgcctgcaacccggcgcccaggtcgacctcactctcgaccccaccgcgtccggcaccggcaccgcggtctattcggtcagcatccgggtgctgcccgacggcgtgaccgaggcgctcgcggtcggcaacgccgcgctgcccgccgagttccggatgaatcgggccgccgtcgccgacatggtcgcgctcggctggtccccgcccggcgtgctggccggctccggcgacttcttcggcctgcggtccgagcaggccaaggcgaccgccctggccaccatcgtgtcccgcacgctgcgggacgtctacggtgcgccgcacccggccttcctggtctacctggtgcacgacgacgaggacgagccgatcgacgccggcccgctggccaccgcccggcccgaggccggtctggacgccgggctcgacctgcgcgagctcgatgacgacccgctgctcggcgacatggtggccgacgaggtggtgccgctcgacgagcgggtccgcacggtgatcgccaccatgtcgaagacgacggtcgaccagctccaggtcgacgcggacggtgacgtcgggatccgggccggctcggcgatggtcttcgtccgggtccgggacaacccgccgctggtcgacgtcttctccccgatcctgaccgaggtggagccgaccgagcagctttacgtgaagctgtccgagctgaccaaccggatgccgatcggccggctctactgcgcgcaggacacggtgtgggcctccatcccggtgttcggccgcaacttccaggccgtgcacctgatgctggcggtgcaggtgatgaccggcctggccgacgagttggacgaccggctgcacggcgagttcggcggcaagcggttcttcggcgagggcgacaagccggccgcgcccaaggcgagcgacggcgagcaccgcaccgggatgtatctctag

SEQ ID NO: 2982 - DNA, 441 bp, Actinoplanes utahensis
ttgcagatggacgccgtcgaccagcgaatcattgcgttgctcgtcgcggacgcccgcgcctcgtacgcggagatcggcgccaaggtctcattgtccgccccggccgtgaaacgccgggtggaccgcctgcgcgcggtcggggtgatcaagggattcaccgccgtgatcgaacccgaggcactggggtggacgaccgaggccttcgtcgaactgttctgcaccgggcggaccaccccggcgcagatcaccgtggccacccggcggcaccccgaggtggtcggcgcgtacaccgtgtcgggtcaggcggatgcgctggtgcacctgcgcgcggccgacatcggtcacctggagcaggcgttggaacggctgcgcgccgagcccttcgtgacctcgacgcgcagcatgatcgtgttgtcccggctgatcgagatgccgttctga

SEQ ID NO: 2983 - DNA, 789 bp, Actinoplanes utahensis
atgtgtcccccggagcacttcacggtggagtacgcgatcaacccgtggatggacaccgcggtcgcggtcgacgccgcccgcgccgtgaagcagtgggagtcgctccgcagcaccctgatcgatctcggccacgtggtgcacgtgctcgacgcccgtcccggcctgcccgacatggtctactcggccaacggggcgttctcggtggacggcaccgtctacggcgcgcgcttccggtacccgcagcgggccgacgaggcgagcgcgcaccgcctcttctacgaggcggccggcacctggaagttcatcgccccggagcacgtcaacgagggtgagggcgacttcgcgtacctgcccgccgcgtacggcgggatcgtgctggccggctacggcttccgtaccgacccggccgcgcacgccgaggcgcaggaggtgctgggccggccggtgatctcgctgcgactggtcgatcccgccttctaccacctggacaccgcgctggcggcgctcgacgaccggcacgtcacgtactacccggaggcgttctcgccggcctcgcagcaggtgctcgcccagctcttcccggacgcggtgctcgccgaccgggcggacgccgaggcgttcgggctgaacctggtcagcgacggccgccatgtgatcctgaacaccgacgcggtcgggatgggccgcaaggtccgcgacgccggctaccagccggtccacgtcgacctctccgagctcaagcgtggtggcggttcggtcaaatgcgccgtggctgagctgcgcggctga

SEQ ID NO: 2984 - DNA, 549 bp, Actinoplanes utahensis
atgggacgcatgactgacgactcccgcaccaccgagcacaaggaagacggctctgtcatcgtcatgggccccgacggccgcccgatgggcaccatcgaggaggacggcaccatgagtcccgaggagccgggcaacctcatcgagcagcccgcgaaggtcatgcgcatcggcagcatgatcaagcagctgctggaggaggtgcgggccgctccgctcgacgaggccagccggggccggctgcgggagatccaccagcgttcgatcaaggagctggaggacggcctggcccccgagctgcgcgaggagctggagcggctctcgctgccgttcgagggggagaccccgcccagcgagcccgagctgcggatcgcccaggcccagctggtcggctggctggagggcctgttccacggcatccaggccgccctggtggcccagcagatggccgcccgcctgcagctggagcagatgcgcggcggccagggccgcccggcgctgccgatgggcggcatcccgggcaaggagcgccccaccgggcagtatctctag

SEQ ID NO: 2985 - DNA, 789 bp, Actinoplanes utahensis
atggggaactaccggctgatcgcgaccgacatcgacggcactctggtcgacgacgagcggcggatcagccaggtcaccctcgacgtgctggccgccgtcccggcgcgcgtcgtcctggtcaccggtcggccgctgcgctgggtcgaggagctctacgcccagctgccggccccgctgccggcggtctgcgcgaacggggcggtgatccacgacccgcacaccggtgaggtgttgtggagcgcgtcgctcaccagcgaggtgctggtcgacgtcgtcgagcggctgcggaacgcggcgcccgacctgaccctcgccgtcgagatggtcgacggagccttccggcacgagccggcctggccactgcgctggcccgacccgcgggtccgggtgatcgccgcgcccgaggagctcacctcggcgccggcgatcaagctgctggcccgctccggcaccgccgacccggacgacttcctggagctggtcaccaaggcgctcgacggggtggccgaagcgacccggtcgtcgtcctcggcgctggtggagatctcggcggccggggtgaccaaggcggccgggctcgcgtggtactgcgagcgggaggggatcaccgctgacgaggtggtcgccttcggtgacatgcccaacgacatcccgatgctgacctgggccgggcgggcggtggcgatgggcaacgcgcacccggcggtgcgggccgtcgccgacgacgtcacgctggcgaacgtcgacgacggcgtcgcggtctatctccgcgagctgtacgggctctag

SEQ ID NO: 2986 - DNA, 813 bp, Actinoplanes utahensis
atgctcaagcctgggcttcccaagctcatcgccacggatctcgatggcaccctcgtccgcagcgacgacacggtgtccgcctacacgcacgaggtgctgggtcgggtccatgacgccggcatccggatcgtcgccgcgaccggccggggcccccgcctgaccgcactgacccgcaacgacatccgggtcgccgactacctggtgctcgcccagggtggctgggtgctcgaccagaccgaggcgcgatacctgcggcaggcccggctgcccggccgggttctggccgacgtgctcgccgcgatggagtcggtcgccggcccgctctcggtgatgttcgaggcgctggagcacgacgactccccgctctggggcgactacgacccgacctggcgctacccggtcaccgtggaggcgcgcacccgggccgagtgcctcgacggtgacgtgatcaaggcgttcgcccggtccttccagcatcacgtcgacgaactgctggcgatcgcccggcgggtggttccgaccgacgtcgcgacggtcacccaggccggcctggactacgtggagatctgcccggcgcacgtcgacaagggcaccgggctcgcggtggtcgccgaggcggtcggcgtcgacccggccgacgtgctcgtcttcggggacatgccgaacgacctgccgatgttcggctgggccggctggggccgggtcgccgtcgcgaacgcgcaccccgagctgctggcggtcgccgacgaggtgacgctcaccaacgacgaggacggcgtggccgtgttcctggaccggctattgtccaggtga

SEQ ID NO: 2987 - DNA, 1260 bp, Actinoplanes utahensis
gtgattgacctgcgtctgcttcgcgacgaccccgacctgatccgcgccagccagcggctgcgcggcgagtccaccgagctggtcgacgacctgctgcgtgccgatgaggagcgccgttccgccacccagcggttcgagacggtccgcgccgagcagaggtccatcggcaaggaggtcgccaaggcttccggggacgagcgggccgccctgctgacgcgcaccaaggagctggccgccgcggtcaaggcggccgaggccgcggccggtgaggccgagcaggcactcaagcgcgcgcacctcgcggtgccgaacgtggtcgacggcgccccgcccggcggcgaggacgacttcgtggtgctgcgcgaggtgggtccgatcccggagatcgcggaaccgaaggaccacctggagatcggcgaggcgctcgccgcgatcgacaccgagcgcggcgccaaggtgtccggctcgcggttctacttcctcaccggcgtcggcgcgctgctccagctcggcatgctgcagctggccatccagcaggcggtggagcacggcttcaccccgtcgatcacgccgaccctggtccggccggagtcgatggagggcaccggcttcctcggcgcgcacgccagcgagatctaccggctcgaggcggacgacctctacctggtcggcacctccgaggtggcgctcgcggcgtaccactcgaacgagatcctcgacctgtcggccgggccgtcccggttcgccggctggtccacctgctaccggcgggaagccggctcgcacggcaaggacgtgcgtggcatcctgcgcgtccaccagttcgacaaggtggagatgttctccttctgccggccggaggacgccgccgaggagcaccagcgcctgctcgccatggaggaggagatgctggccaaggtcgagatcccgtaccgggtgatcgacgtggccgccggtgacctcggctccagcgcggtgcgcaagttcgactgcgaggcgtgggtgccgtcgcaggggcggtaccgggaggtcacctccacgtcgaactgcaccacgttccaggcgcgccggctcaacatccggtaccgcgacgagaacggcaagccgcagaccgcggccaccctgaacggcacgctcgcgaccacccggtggctgatcccgatcctggagaaccaccagcagccggacggctcggtgcgggtgccgaaggcgttgcagcccttcctcggcggccgggaaatcctcgaacccagccgttga

SEQ ID NO: 2988 - DNA, 705 bp, Actinoplanes utahensis
gtgtccgacaacccaaggctcatcatggttcacatgtcggagatggatacgggggccgtggtcgagttcggcgccccggaacgggccggattcctgcgcgggctggggcgcgatcaccgggtcgcgccgctggtgggcgggctggccgcggtggccgcgttcgggtcgctgatctccgagtggcaggtgaccacggtggacgggctggcgttcgggtcggacgaggtgggcgccaccaagaagctgccgaccgacctgttcgacctggacggggtcggcgcggcgtacaccgtcgggctgttgatcctggttgtcgcggtgctgctggcggtgcgcggaccggcggccgggcagcggtatgcccggctggccgggctgggcgtcggcgggacgctgctggcgctgctggcggcgatgttccggatgctcagcgggcagagccggctgatctcccggttctacctgatcgagatcgacaccgggcatctgaaggtcgccctgggccgcgggctgtggtgcgccgtggccggggtgaccgccgcgatgctcgcgctctggctgtccgggcgtgccaccgcacccgccccgccggtcgcggcgcgggctgtggcggcgccggacgacgagccgctggagttgagcatcacgccgaccgcgccgttcgcccacacgctcgacaatcgggacaaaccacacctccgataa

SEQ ID NO: 2989 - DNA, 486 bp, Actinoplanes utahensis
atgagccttgggttgtcggacactccatcgagccccggatgggttagcgttttgtccatgcctattcgttctgccacggcccgctgggaagggaacctcaccgagggttccggcacggttaagactggtaagggtggcctgcaggggagctactccttcaagtcacgcttcgaggagggcgaggggaccaaccccgaggagctgatcgccgccgcgcactccggctgcttctcgatggcgttctccaagggcctcgccgacgcgggcttcacgcccacgtcggtcgagacggtcgccaaggtgcacatggacaagaccgacgccggtttcggtgtctcccggatcgacctggagaccgtcggcgacgtccccggcatcgacgaggccaccttccagaagatcgccgagggtgccaaggagaactgcccgatctcccgcctgctcagccccggcgccccgatcagcctcaccgccaagctggtctga

SEQ ID NO: 2990 - DNA, 363 bp, Actinoplanes utahensis
atggtcggcgtgccggtggagatgagtcgcgagcgcttcgaggagctcgtcggtgaggccctcgacgaggtgccgcccgagctgctggccctgatgagcaacgtggtcttcctggtcgaggacgccccgccggacggcagcgacgacctgctcggcctctacgagggcaccgccctgaccgaccgcggctgggactacgccggcgtcctgccggaccggatcaccatctaccgcctggccaccctccgggtctgcgactccgagcaggacgtcgtcgaggaggtcgccgtcacggtcgtccacgagatcgcccaccacttcggcatcgacgacgaccgcctccacgccctgggatggggataa

SEQ ID NO: 2991 - DNA, 948 bp, Actinoplanes utahensis
atgcccggaacgccgcccgcccgtttcacctacctcggcccggagggcaccttcaccgaggccgccctgcgcaccatcccggccgccgagcacgggctgcgtacgccggctcgcagcgtgcccgaggcgatcgaggcggtccggtccggagaggccgacgccgccctggtgccgctggagaactcggtcggcggagccatcccggtcaccctggacgagctggtcaccggcgcgcccctgatgatcgcccgggaggtgctgctgccggtcgagttcgtgctggcggcggacacgctgaaaccgctggccgggctccgcaccgtcgcggcgcacccgcaggcgtccgcgcagtgccggcgctggctgctggccaacgtcccggacgcggtcgtggtcgacgtgttgtccaacgcggccgcggcgatcagcgcggccgccggggagtacgacgcggccctctgcgccccgatcggcgtcccgcgcaaccggctcaccgtactcgccgagaaggtcgccgaccgggccgaggcggtcacccggttcgcgctgctcacccggcccgccgcgccgccgccgccgaccggtgacgacgtcacctccctggctgtgtcgatccggcacgaccaggtcggcgcgctgctggcggtgctcaccgaactggccgtacgcggagtcaacctctcccggatcgaatcccggcccaccggcgagcagctgggcacctacttcttcttcctcgactgcaccgggcacgtggccgaggcccgcctgggcgaggcgctgcagggcctgcgccggatctgcgccgaggtccgcttcctgggcagctacgcccggcaccggctgcagccggaaccaccggtgcgggcgccggccggcctctccgacaccgacttcgccgactccgccgcctggctgcgccgcctgcgcgccggcgagcccggctga

SEQ ID NO: 2992 - DNA, 633 bp, Actinoplanes utahensis
gtgtccccgcacacccgcttcgtccctctcgtcgtgggcgccgctctactgacggcggcctgcggatcgccggccggatccgagcccgccggcacgccgtcgtacacgatcggcccgcagccctccggcgccggaccgctgccgggggcatccgtgccggtgccgggatacacgatgcccaaccccggatacacgatgcccaaccccggatacacgatgcccaacccgggttaccccaatcccggctacaacccgggttaccaccccggttacacgctgccgaccacgacgccggccgaggggccgctgaccaagtcgccgacgccgaccccggcgcacgccgccaagtgcggcgggcagccgagcccggcggacatcctggccctgatcaagggcaagcccgggatcccgtccaagacgctgcaggtgcaggacgggccgttctgctcggggacgtggtcgttcaccacggtgaaactggccggatccggtacggaccagatggagccgctcatggtggtggccaccgggaaagccgccacgctggccctggtcgccgccggctccgacgtgtgcaacgcgcaggtgcaggccgccccggccgggatccgcgtcatggcctgcggcttctga

SEQ ID NO: 2993 - DNA, 351 bp, Actinoplanes utahensis
gtgtgccgcctctcggccggttcaccccttcccacctccctgaccacgggtccggacgacaagagcgtcatctcggtgacctggggcctcgacgagatctcgatcatctgcccgtcccaccgggtgccggacggcgccgaggtcgacacggcatggcgatgtctgcgcgtggccgagctcgacctggcgatgaccggggtgatcgcgtcgctggcggtgccgctggccgaggcccgggtcaacatcgtcacgttctccacctacgacaccgactatctgctcgtgccgacggtccggctgaccgaggcggtcaacacgctggtcgccgccggtcaccgcatcgccggctga

SEQ ID NO: 2994 - DNA, 462 bp, Actinoplanes utahensis
gtggcgcatgttgagctctccctctcgggagcgttcgtcccccaggcacgcacaccggccgaggccgagttcgtcggcagcatcgagcgctgggccggcaccgtggcggtggccgacgagccctgcctgatcatcgacgccggcggcgccatcgtggccgtctcgccgtcctgcagtgagctgctcgggctgggcaagccgggcgacgcgatcggcaagctgctgtccaccgccctgcggctgatcgacttcacggccggcgccggcccgctcgacgagcccgaagcggagaagattccgccgctgctcgcggttcgcagtgagcggctggcccgcggtctgatgcgcgtcgtgccggacgccgggaaaccgccgctgaccgtcgacgcgatcgccacacccctgctcgccggcgaccgggtggccggttcgatgacgtttctgtcgcctgtgcactactga

SEQ ID NO: 2995 - DNA, 729 bp, Actinoplanes utahensis
gtgactgtcttccccacccgccctgctctgcccgtgcccgccaccaaccgagccctgccacccggcccgaccccgtcgcccacactggatcgcctcactccggtggagtgggcgcggcgtcgtcgtgccgaacgaggggcccggcggatggaggcggccggcgcccgcgcgctgacccgactcgaccgcctcggctccgcctggcgcatcgtggactggccgcgcgccgacctgtcccagtcttactacgagcccgacccggccgacgaccgcgccggtttcctcgccatcggccccggtggcgtctacgcggtgaccgtcgccgaccacgggcgttcccgcgtcctgatcgccggtgacgtggtgcagatcaacggcaagcggccggggtacgtcgcggaggctcgccgggacgcccgccgggccgccaaggcgctgtccgcggccgtcgggctgaacgtgccggtgaccccggtcctgaccttcgtcggctccggtgtgatcagcgtgcacggcctgcccaaggactgcctcgtcgccaccgacaaagagctcgaccggttgctcctcgcgggtggtgcccgcatctcggcggccaccgccagcaaactgtcggccgtcgccgagaacccggccacctgggcgaacgcgccctaccggccggctggcgactaccgttggtacagcaacggacagacggccgctgacaagcggccgacccgccggtaa

SEQ ID NO: 2996 - DNA, 1185 bp, Actinoplanes utahensis
gtgtacgtcgacagtgaagtcagccaactgcgcaccgtcctgctgcatcggcccggcaaggagcttgcccggctcaccccgaggaacagtggatcactgctcttcgacggcatcccctgggtcggacgggcccaggaggagcacgacgcgttcgccggggcgctgcgctcccgcggcgtcgaggtgctccacctcgaccggttgctcgccgagaccctggccgtgccccgggcacgggaggagctgaccgccggggtgctcgccgacccgcggctcggcgacggcctgcgcgccggggtggccggctacctggccgatcaggacccggagcggttggccgaggtgctcatcgccgggctggcccacgaggaggtcaagccgggcggtggcagcctggtctacgagatgttggagcgccacgacttcgtcatcgacccgctgcccaacctgctgttcacccgggactcctcggtctgggtgcgcgaccgggtggcggtgaccagcctggcgatgccggcccggcgccgggagaccacgctcacccacgcgatctaccggttccatccgcgcttcgccggcggcgacctgctctacgaccccggactggagcacgtcgagggcggcgacgtgctggtgctggccccgcaggtgatcgccatcggggtgggcgagcggaccaccccggccggcgccgagcggctggcccgccgggtgctgctggccggcctggcgcataccgtgctggtcgtgccgatcgcccaggagcgcgccaccatgcacctggacacggtctgcacgatggtcgacgcggacgccgtggtgatgtacccggtggtcgccgacaccctgcgggcctggaccgtcaccgcggacggcgaagagctgatcgtccggccgccccggccgtttctggaggcggcggccgaggcgatgggcatcgagcggctccgggtgatcgacaccggcctcgacccggtcaccgccgagcgcgagcagtgggacgacggcaacaacacgctggccgtggcgcctcgggtgtgcctggcctacgagcgcaacatcgagacgaacgcgcagctggagcgggccggcatcgaggtgatccggatccgcggctcggagctgggcagtggccggggcggcccgcgctgcatgagctgcccgatcgagcgggtgccgatctga

SEQ ID NO: 2997 - DNA, 954 bp, Actinoplanes utahensis
ttgcgcttttgctcgtttttcgccgcgctggaagcgcccacctcgccgcgtttccgacggcaccgcctacgctggtccctcgtgagcaagcgtcgtaagtcacagtcggagcccaggaccaaggtgcgcgacatcttcgtcgcccgccccttcgagggtctcgccgacgagccggagtgggtcgccctgcgcgagctggtcccggccgcctcggcgccactgaccctgaagccggagatcatcgaggagtacggggaccgtccggtcaccctctccaccgtgctcccgatggcctggccggccatgtcccgccgggacgggcaggtcttcatcggcctccagcggcacctgcagtccggtgacgtctcccgggacctggcggtggccatcctcgccgcgctgcggaccgccccgggcgacccggtgtcggtgccggccttgcccggcgagggcccccgcctgcaggacgtgctggccgacggcccgctcgagatcaccatgcaggacggcttcgagtactggctggacgcggaccagctgcacgacgccacggtcaaggcgtcgctggagcgggccaacgcctcgatctaccccaccgagcggctgagcgcggccaaggcggcgtactggtgccggatcgcgccggacaaggggcacgtccgctgggtgctcggcgagggcgaggacccggcgctggacgcgctggcccggctctccgcggccggcgagctgctgctgcgcgacgacaccaagttcgccgggatgttccgggcgcacgggctgctggtgccggtctgggacatccccggcgagccggaggcggccgactgggaggcgccgctggccgatttcgccaagcgctaccaggacacactggcgatcaccgagccgctcgacgcggcggggcgccgggccaagcagggtctgatcggccgtcagctgacgctgcgctga

SEQ ID NO: 2998 - DNA, 1194 bp, Actinoplanes utahensis
atgccggatcgtcccgactatccctcgctgacccggggtcagatcgcggtcctcgaccgcgtcaacgccggggagtccggcctgcccgtgttgcagcggctggtccgcctggcccaggaggctctcggcgcacgcggcgccggcttcgcggagtactcggagggccgcggccggatcatcgccggcaccggggtgtgcgagccggccgtcggccgtcgggtcgaccgcccgctggagtccgccggccgcaccctgctggtgccgctggacccggccctggactcgatcaacgacgagttcgcccggcagatcgaaggcggcgacctgcggcacatgctcggcgcccggtgcgagtccgggggcgccttcgccggttcgctgcacgtctacttcggcggcgccgacggcccgcccggcccggagcaccacgccgtgctggagctgctggccggccagatcgggcagctctacacccgcggcgccgggttgccggtgcacccggccgcgccgccggcccaggccgaccgggacctctgggtcgcggtcaccagccacgagctgcgcaccccggtcaccgtgatcaaggggtacgcggacacgctcaccaaccactgggagacgctcggcgagccggggcgccgggaggcggtccgggtgatcggcaaccgcgccggcgagctggcccggctggtcgaccggctgctctcggcggccagcgacggggtggccggcgccaccccggccgggccgttcgacctggtcgaagcgctccgggaggcggtcgacgagctgccggccgacctgcggcggcggctcaagctcgcgcacctgccggccggcctgccgccggcgtacggcgatcgcgcctcgatcgcgaccatcctcaccgagctgaccacgaacgcggagaagtactcaccgccggacaccacggtggaggtctgcgccggggcggacgacgacacgctgcgcttccgggtctccgaccggggagccgggatcgcgccggagcacgtcgagcgggccttcgaacggtactggcaggccgagggcggcgaccggcaccaccatccgggcgccgggctggggctctacctggtccgccggatcgtcgagcagcagcacggctgggtgtcgctgcggccgcgggagggcggcgggacggtcgccgaggtgcgactacgacgcgcctga

SEQ ID NO: 2999 - DNA, 1050 bp, Actinoplanes utahensis
gtggacggccggccacgcgcccggcgcccaccacctgccgatgatggaggtgccggcccggatggccgaggtgcccagcgacggcgaggtggtggtgatctgccgggccggcggccggtccggccaggtcgtcgcctatctgatgaacaacggctgggacaacgtgcgcaacctcgacggtggcatgaagtcctgggccgccgccggcaaggacatggtcagcgaggacgggcagccggcccgggtggtgtgagcaccggctatcgccccctggtgttcgcgcaccgcgggggcgccgacgcgctgcccgagcacaccctcggggcatacctgcgcgccctgcaggacggggtcgacgggctggagtgcgacgtccggctgacccgcgacggtcacctggtctgcttccacgaccgcaagctggaccgcaccagcaacggccggggcctggtcagccggcggacactcgcggagctcgacgagctggactacggctcctggcaccccgggtaccccgccgacgagccggacgaggacctcagccggctgctcaccctggaacgcctgctggaggcggtgcgcgactgcggccgcgcggtgcggttgctgatcgagaccaagcacccttcggtgtacggcgcggaggtcgagcgtcgcctggtgaaactgctgcgccgctacggtctggccgacccgaagccggacgacccggtgcaggtgaccgtgatgtccttcgccgccctggcgctgcgtcggatccgcgcccaggcccccggcctgcccaccgtgtacctgctggaggtgctcccgccgatggtcggcaaggggcgcctgccgttcggcgcgcggatcgccggcccgggcgtcgacctggtccgggcccgatccgggctgccggccgcgatgcgcgcggccggccaccagacgtacgtctggaccgtcaaccggcccgacgacctggacctggtcctgcggcaccgggtcgacggcgtgatcagcgaccggcccaagttcgtgctggaccggctggccgagctcgaccatgtgtga

SEQ ID NO: 3000 - DNA, 1101 bp, Actinoplanes utahensis
atgtctgcgaccacctcttccagcggcaactcctctggacgggcttccgtcccaccgccgtacgggcgagagccgggcccggggcgcccctaccggggtggccgcacccgcccgcgctggggccggatcgccctggtcaccggcgccacggtggtcctgctggcgctggtcggcacgatctacgcgttccactacgtgaacaagatcgacggcgacctgaagcggaccaacgccttctccgggctgtccaaggaccggccggccaagccgatcgacggcgcgttcaacatcctgctggtgggcagcgactcgcgggatccggacaccaaggacgaccaggccaacgcctggcgcgcggacacgctgatgatcatgcacgtgccggccgaccacaagaccgcccagctggtgtcgatcccgcgggacctgtgggtggtggtgccgcgcagcaacgacgcggcatgcagcgacggcagtcgcgccaagatcaacgcgtcgttcgccttcggtggcctgccccgcgcggtgcacaccgtcgagtgcctgaccgacgtgaagatcgatcacgtgatggcggtcgacttcggcggcttcaaggaggtcaccgacgcgctcggcggtgtcgacctgaaggtggaccagagcatcacctcgatccacccgccgcaccgggtgttcaccaagggcatgatgcacatggacggggcgcaggccctggactgggtgcggcagcgcaagcagttcgcccgcggcgacttcgcccggatgcagcatcagcaggagttcctcaaggcgctgatggacaaggcggccagtggcggcacgctgaccagcccgggcaagctcaacgacttcctgaacgcggtggccgccgcggtcaccgtcgaccaggatttctcgctcaaggacatggtcgagcagttccacagcctgcgcggcgacaacctgacgttcctgaccagcccgaacaagggcagcgagacgatcgccgggcagtccgtggtggtctccgaccgggagaaggcgctggccctgttccaggcgatgtccgcggaccggatgtccgagtggatgacggccaacccggtcaagaagagctga

SEQ ID NO: 3001 - DNA, 1668 bp, Actinoplanes utahensis
atgctgatggccgccgcgggcacgtccagcacctcccggacgctgaccatcacgctcttcctgatcttcgtggcgatcaccctggcgatcaccatctgggccagccggcagaccaagaccgcgaccgacttctacgccggtggccgccagttctccggcttccagaacggcatggcgatcggcggcgactacatgtcggccgcgtcgttcctcggcatcgccggcctgatcgcgctgtacggctacgacggcttcctgtattcgatcggcttcctggtcgcctggctggtggcgctgctgctggtcgccgagttcctgcgcaactccggccggtacacgatggccgacgtgctggcgttccggatgcgtcagcgcccggtgcgcaccgccgcgtcggtctccaccgtggtggtgtcgatcttctacctgatcgcccagatggtcggcgccggcgcgctggtctcgctgctgctcgggatcagcgccgacgagaagttcctgggcatggacgcgagcaccgccaaggtgttcacgatcattctggtcggcgccctgatgatcgtctacgtggtggtcggcgggatgaagggcacgacgtacgtccagatcgtcaaggccttcatgctgatgaccggtgcgctggtgatgaccctgatggtgctggcgcactaccggttcaacctgtcgacgctgctgggtgacgccgccgcgcagtccggcaagggcagcgccttcctcgaacccggcctgcggtacggggtggagacggccggcgacgcgacgaagaccttctacagcaagatggacctgctctcgctgggtctggcgctggtcctcggcaccgccggtctgccgcacatcctgacccggttctacaccgtgccgaccgcccgggtggcccgcaagagcgtgctctgggcgatcggcatcatcggtgtcttctacctgttcaccctggccctgggcttcggcgcggcggccctggtgggcggcaaggcgatcaccgcgcaggacaaggcgggcaacaccgcggcgccgcagctggcgcagaagctcggcatcgactacctgggcggggacaccggcggggcggtgctgctggcgatcatcgcggcggtcgccttcgccaccatcctggccgtggtggccgggctgaccctggcgtcgtcgtcgagcaccgcgcacgacttctacgccagcgtgatcaagaagggcaccgcgtccgagcgggacgaggtgcgggtggcccgggtcgccgccctggtgatcggcgccatcgcgatcgccctgtcgatcttcgcgcagagcctgaacgtggcgttcctggtggccctcgccttcgcggtggccgcctcggcgaacctgccggcggtgctgtacagcctgttctggcggcggttcaacacctcgggcgcgctctggtcgatctacggcggcctgctcaccgcggtgatcctggtgttcttctcaccggtggtgtccggctcgcccaccgcgatgttcccgcacgaggactggcactggttcccgctgtccaacccgggcatcatctcgatcccgctgggcttcttcttcggctggctgggcaccgtgctcagcaaggagtccgccgccgacaagtacgccgagctggaggtccggtcgctgaccgggcacggcgcgcactga

SEQ ID NO: 3002 - DNA, 378 bp, Actinoplanes utahensis
gtgccggaaagtccactcgcccacgaaggtggtgacaccgtgccggccacccccgagagatatctcgaggtgcagaactccgacgaattcgggcgtctgcgccacacccttcgccgtttcatcttcccgacgaccgtcgcgttcatcctctggtacgccctctacgtcctgctgtccgcgtacgcccgtgacttcatggcgatcaagctggtcggcaacgtcaacgtcgccctgctcttcgggctgttgcagttcgtctcgacgttcgtgatcgcctggtactacgcgcggttcgcggcgcgcaggatcgacccggtcgccgacgacatccaccggcagatcgagaacgcccccgccgacgaggggagcgtgctctga

SEQ ID NO: 3003 - DNA, 504 bp, Actinoplanes utahensis
atgacgatccattccactgatccgttcgcggtgccggacgaggagaaatcggcggtccgccggttccgcgggcgcctggccgcgccggtgacgatctggaccgcgcccgggccggccgggctgaccgtctcgtccacgctggtcgccgacggcgatccgggtcgggtgctcggcctgatcgacgaggagagcgatttctgggcggcggccgagcgggccgggcggttcaccgtggtcccgttggtcccggccgaccgacagctggccgatcggttcgccggcctgatgccggccccgggcgggctgttcgccaccggcgggtggcgggagaccgcgtacgggccggtgccggcgcacgccaccgcctgggcgcagtgccggttggtggactcccggccgtgcgggtgggcgatgctggtcgaggcggtgatcgaggcggtgaccttcgaggcgcccggcgcgccgctggtgcaccaccgcgggagttaccgcgaactgcgctga

SEQ ID NO: 3004 - DNA, 279 bp, Actinoplanes utahensis
atgcctcaggtggtgttgcgaccgggtgacgtcgtgcacgtcggggccgaggcgagcgtgcagttctccggcgagcgggcgctgaccttccggatcatccgggtcgacccccgggtcacctacgacggctggatctggctggacggctacgtggtcggtccggccggcaacgcgctgcagcggcgccgcatcttcgtgcggcaggacggcctgcgggcgatccgggtcaaccgggtgcccgcgccacggagcggatcccgtcccgtcggtcgcccctga

SEQ ID NO: 3005 - DNA, 858 bp, Actinoplanes utahensis
gtgctggccgccgtcggcggcctgctgtggtggtggagccggacgctggagcaggcgatggccggcaccgcgacggccgggcggcacgcgcgggtccgggcggacggccgcggcccggtcgaccggctgatgttcccctggtggccacggaacaggttcaccgccctggtggcgcgcgagacgcggtactggtggcgggagaaccggcgacgggccgggctggtcgcgctgaccatggccgggctggtgttgccgctgacctcggcgctgggtccgggcgccggactgaccggtggaatggccttcgtggccggtgcggtcgcgccgatcgcactggccaaccagttcggttacgacggcggcgcgtacgccacgaacctggcggccggcgtgccgggacggctggaggtccactcccgggcggcggcgcacgccctgttcaccgtgccgctgctgaccctggtcgcggtggtcaccgggatgctctccggcgacccggcccgaattccggcgcaactcggcacgctgctcgcggtgtacggcaccgggctggcggtgcttctgccgatctcggttcgcgccgcctacgcactgcccgaatcggccagcccgttctcgatatcgtccggcggcggcctgggaaagggactgccgagcctggccggaatggccggcggaatattcggcgcgctgcccgtggtgttggccggatttctgctggggccggcctggatctgggccgggctgccgatcggcctgggttacggggcagccgcttatctggtcggttccggaatggccggggatctgctcgaccgccgcatgccggaagtgctcgccgcggtgacgccgcgatag

SEQ ID NO: 3006 - DNA, 729 bp, Actinoplanes utahensis
gtggctgtgagcccgcgccacttcgtccggctcaagctgcggatcaccgcgaacgggctgcgcggccggccgacccgggtcgtgctgttcgtgctgggctcgtgcgccgccagcctgctcgccgtcctcggctacgcggtcttcgcgctgcccgggcacctgcacgacgcgcacctggccgggatgctgctgccgttcggtggcgcggtgctgctgctcggctggctgttcctgccgctgctgttcttcggggtcgacgagtcgctcgacccggcccggttcgccctgctcccgctgccccggcggaccctggtcgccgggctcggcacggccgctctcgccggtctgcccgccctcgccacactggccgccacggccgggatgacggacaccgcggcccggctcggcgggccggtcgccggggtcgccgagaccgccggggtactcggcggcctgctcctgtgcgtggccgtgagccgggcggtgaccagtgcgttcgccaccgcgctgcggtcgcggcgggcccgggacctggccaccatcctgctcgccgtggtggccacctcggtggcgccgctgcagttgctgctgctcgggctgctcgaccgggcggactggaccgacgtcgccgggatcgccgaggtgatcggctggactccgctcggcgcgccgtacaccctgggactggacgtcgcgacgggccgggccgggcctgggccgtaccgctga

SEQ ID NO: 3007 - DNA, 783 bp, Actinoplanes utahensis
atgacgacgccggcagcacccccggacgagtcgccggtgccggcgatgtcgctgcgcggcctgatccggcgtttcgacaccaaactcgccgtttccggggtcagtctggacgttccggccggttccttctacggtctgctcggccccaacggggccggcaagaccaccaccctctcgatggccgtcggcctgttacggcccgacgcgggccgggcccatctgctggggtacgacgtatggagcgcgcccacggaggccaaagccctggtcggcgtgctgcccgacggcgcccggatgttcgaccggctcagcggccccgagttgctcgcctaccagggcctgctgcgcggcatgccggccgccgtggtcgatcaacgcgcccgtgacctgctcgaggtgctggacctcggggtggacaaccgcaccctggtggtcgactactcggccggcatgaagaagaagatcggcctcgcctgcgccctgctgcacgcgccgcggctgctggtgctcgacgagccgttcgaggcggtcgacccggtcgcggccgcgctgatccgcgacatcctgcagcggtacgtcgccggtggcggcaccgtgatcttctccagtcacgtgctggaggtcgtcgagcggctctgctcacacgtggcgatcatgtcggacggcgtgctgcggatgcacggcacgatggcctcggtacgcggcggccggtcactctccgacgtcttcgtgcaggtggtggggggccgggtggccaccggctcggagctggcgtggctgtga

SEQ ID NO: 3008 - DNA, 762 bp, Actinoplanes utahensis
atgtcggtgcgacgatgctgcggctgcacgcccccgagtcgctgcgatcatgaattaaggatctttaaggtacggtccccggccgccgatgaacccgcgctcgtaatcaggggcatgaagagatttcgtaggaacggatccccccgaacccgcaagatcgctcttggcgccgtactcgccgtggtggccggtggcgcggtggccgtcggcaccgggatgagtcacgcgtccaccacgtgtgacggcctggatgaggcgctgcagcggaacctgtccttcatggccgatcagcaggcgcacccgaacgcgcagaccgacgccgtgctggccaaccgtcaggcggtggtcgacctgatcaacgtgcagcgccgtcaggcggggtgcaccggccaggtcgcccagccggctccggcgaaaccgaccagggccaccacggcaccgaccgcgaagccgccggtggccagcaccgcccccgccgcgaagccgccggcggcgaccggagggaccggcgccggtgaggtcgtctgcaagggctccacggtcaccctgtccggcgaggccggcgccccgttcgcctccagcggcaccttcccgatcggcacccggctcaaggtcaccaacctggacaacaacaagagcatcacggtgaccgtccagagcacctcgggaagctgcgtgctgctcaacaacgcagctttcgagcaggtgcgcgaggcgggcaaattcctgattcgccgcgcggtcatcgaacgggtcggctga

SEQ ID NO: 3009 - DNA, 504 bp, Actinoplanes utahensis
atgaccggtggtacgagtggaactacggccgggcggccgcccgggacatcatcggacagctgccacccatggctcatgatcgatgcggcgcctattgacattccgccgggggcggcaagactgccggacatggccgacgaatcgccgcccccgcgcacccgggtggtgctgggcgacgccaggcgcgccgccgacccctcccgcaccgacctggcgcagcagacgccggtcggtgaggccctggtccggggcctggtccgggcccagctggcgctcgcactgcggctgtcgctggtggtggtggccggcctcggcgcgctgccgctgctgttcgcggccgccccggcggtcggccgggtcgacgtcttcggcatgcgcctgccgtggctggtcctcggcgtgttgtcgttcccgttcctggtgctcgtcggtgcggcgtacgtgcacggggcggaacgcaacgagcaggacttcaccgccgtggtccggcgccccggccgatga

SEQ ID NO: 3010 - DNA, 1551 bp, Actinoplanes utahensis
atgtccacggcacccccagcgctaccgacggtacaaaacctgacaaaaggtccgcttcacgggccgtggccggacactcggctgttccgccgccgcctgccgggtcccgccggtccggctgctccgggcaccatcctggcgatcgtcgccggggtcgcggtcaccgcgctcaccctgccgctgggcgtcaccggcgtcggctggctgatcaccgcggtcgcctggctggccgtcctgctcaccgcccgcccgaccgccgggccggccttcccaccggtgcccgcggccggcgcaccgcggctcggcgcccgcctcccgtgggccgccgccacgatcggcctgctgagcgtgggcacgttccgctcggccggctggctcttcgccctctgcgtgggcaccgcgacactgaccttcgccctggcgatcggcgccggtcggtcgatgcgggcggtgctcacgacgtacacgctcgggccggtcgcggtgttgcgggccgggccctggctggtccgcggtctggcgcgggtgcgccggccgcggggcgccgcgccgttccggatcgccgcgaccgccgcggtctccgtcctgctgctggtcgttttcggtctgctgttcgcctcggccgacgccaccttcgcgtcggtgatcagcgcggtgctcccggaggtgagcctggacggcgtggcgcgctggatcttcctggccgggctgtccgcgccgctgctgagcggcgtcgcctacatgtggatcgccccgccccggcttaccgatctcgaccacaccgaggggatgagggtcggccggctcgaggcggccgtgccgctgggcctgctcaccctgctcttcgcggcgttcgtcgcggtgcagctgaccgtgctgttcggcggcgaccggcacgtgcggaccacggccggcctgacctacgccgcgtatgcccggggtggcttctggcagctctgcatcgtcaccgggctgaccctgctggtgctggccggcgccgcccgctgggcgccccgggaggcgcccggcgaccgggccgtgttccgcgccgtgctcggctcgctcacgctgctcaccctggtcatcgtcgcttcggcgctgttccggatgcaggtgtacatcgacacgtacggcctgacccggctccgcctgctggtcgcctgctgtgaggggtggttcggggtgatcctgctgttggtgctgctggccgggacgcgcacccgggcgccgtggctgccccgggcggcgatcgcggccggcgtgctggcgctgatcgggctggcggcggcgaacccggacctgatgatcgcccgcaaccagatgcaccggtcgccggaccgggtggacgccggttacctgtccgggctgtcgccggacgcggtgcccgcgctgaccggtgtggacggtccgcaacgggtctgcgtgctctaccggatcaggatgaccatgccggatgaccggtggtacgagtggaactacggccgggcggccgcccgggacatcatcggacagctgccacccatggctcatgatcgatgcggcgcctattga

SEQ ID NO: 3011 - DNA, 1104 bp, Actinoplanes utahensis
gtgcggatcgcgggtggcggcgccggcgatggggatgtggcgggtggggcggtgagggcgcggctgatgcaggcggtgcacgatgtggcggcccggctgttccggtggctgccccggccgctggacccggtgcggtcgatcaaggcgaagctgtcgctggcgctcggtttcgccggcgggatcgggctgctggtctttctgtggagcatcgacttctaccgggtcgacgtgctctggatcgcgatcgccgccgcgctggggctggtcacgctacaggtgatggcgcacggagcgacgattccgctgcgcgagatgaccgtcgcggcacggcagatggcgcgcggtgactacacgcaccggatccggacccgctcccaggacgaggtgggcgagctggcccaggccttcaaccagatggccgcggatctggccgccgccgaccggcagcggcgggagctgatcgccaacgtctcgcacgagctgcgtacgccgatcaccgccctgcggggcctgctggagaacatcgtcgacggggtggccgccaccgacccggaaaccatgcgcaccgccctgtcgcagaccgaacgcctcagccggctggtcgatgacctgctcgatctgtcccgtctggacgccggcgtggtcccgctgcgccgcgagctgatcagcgttccggagttcctcgacgaggtggtccgggaggcgaaggtgaacgcggacgggatcggccaggatgtccggttctcggtcgccgccccggctctggtgctgcccggcgaccgggcacggctgcaccaggtattcgccaacctgctggacaacgcggcccggcacagtccggccggtggcctggtcacgctgcgcgccgaacgccgggacgggcaggtgctgctggcggtcaccgacgagggtgacggcatcccggtggccgagcgggaacgggttttcgaacgcttcacccggggtgagcgcccggccggtggcggcaccgggctgggcttggccatcgcccgctgggtggtgcaactgcacgacgggacgatcgccgcggtcgagccggccgaccggcgcggcgcccagatccaggttcgcctccccctctaa

SEQ ID NO: 3012 - DNA, 969 bp, Actinoplanes utahensis
ttgggtcgctgcccggcttcggcccggcttggctcgcagcccggcttcggtcgcggcgcggcttcggccacggcgcggcttcggccgcagcccggcttgggtcgcggctcggcttgggtcgcggctcggcttgggtcgcggcccggcttgggtcgcggcccggcttgggtcgcggcccggcttgggtcgcggcccggcttcggccgcagcccggcttgggtcggcggtgggtgcggggaatttgttcggtggaggggagtcggcgtggagacgatgacggagcggcgggttctggtcgtcgaggatgagcgggccatcgcggatgcggtggccgcgcggctgcgcgccgaggggtttctggtgcaggtggtcggggacgggcccagcgcggtggaggcggctcggcgggtcccgccggatgtggtcgtgctcgacgtgatgctgcccgggttcgacggactggaggtgtgccggcggatccaggccgaacggccggtgccggtgctgatgctgaccgcccgtggggacgagaccgacctgctcgtcgggctcgcggtgggggccgacgactacatggccaagccgttctcgatgcgcgaactcgccgcccgggtgcatgcgctgctccggcgggtcggcaagaccggagcggcccgggtggcggcgccggccgggccgccgacgctgcggctcggggacctggagatcaaccaggcggagcggcgggtgcttcgcggcggggctgaggcgcatctgacgccgaccgagttcgacctgctcgtgcacctcgcccggaccccgcggacggtgctgccccgggagcggctgctggccgaggtctggggctgggcggacgcgtccggcacgcggaccgtcgacagccacatcaaaggcctgcgccgtaagctgggcgccgacctgatccgcaccgtgcacggggtcggctacgccctggacatcgaacgatga

SEQ ID NO: 3013 - DNA, 738 bp, Actinoplanes utahensis
atgagcctcgtcgtgctggccgtcgacgacgagccgccggccctggacgagctggcctacctgctgaacgcggacggccgggtggcgcatgtgcaccgggccggggacgcgaccgaggcgttgcgggtgctgcgcgacaccgaggtcgacgcggtcttcctggacatccggatgcccgggctggacggcatggagctggcgcgcatcctgcgccggttcgcgcatccgccggcgatcgtcttcgtcaccgcctacgacgacggggcggtggacgcgttcgatctgggggtcaccgactacgtgcggaaaccggtgcgggccgaacggctcggcgagtcgctgcgccgggtggccgggctacgggcggcgccggccacggcggtcccggccgacgaggcggcgatcccggtcgagctggccgggacgacccggatgctgccgcgatcgtcggtccggtgggtggaggcacagggcgactatgcgcggctgcacaccgcggatgcctcgcacctggtccgggtgtcgctcgcgacgctggccgagcgatgggcgaatgccgggttcgtgcggatccaccggtcgttcctggtacagctgcggctggtcaccgagctgcggctgaccggttcgggctatgtggtggcggtcggcggggtggagctcccggtcagccggcggcacacccgggagctgaaagaccggctcatccgggcggccaagcatgattgggggcgctaa

SEQ ID NO: 3014 - DNA, 609 bp, Actinoplanes utahensis
gtgcgcgcgctgcgggcgcagatcagcccacacttcatctacaacgcgctcaccgcgatcgcctcgttcgtccgcaccgatccggagcgggcccgcgagctgatcctggagttcgccgagttcacgcgatactcgttccgcgcccacggcgagttcaccaccctcgccgaggagctgcgttcgatcgaccgctatctcaccatcgaacgcgcccggttcggcgaccggctgcaggtgcggttgcagatcgcgcccgaggtgctgccggtcggcctgcccttcctctgcctgcagccgctggtggagaacgccgtccggcacggcctgtcccgcaaacccggcgtcggtatggtgagcatcgaggcccgggacgccggcgccgagtgccacatcaccgtcgaggacgacggcgtcgggatggatccgacggtcttcgggcaggacagcgcggacagcgaggacggccagcacgtcggcctggtcaatgtggacgagcgcctgcggtcggtgttcggcgatcatcacgggctggtcgtcgagaccgcccccggcgcggggacgagggtgagcatgcgggtcccgaaattccatccgcaggtgcgggcatga

SEQ ID NO: 3015 - DNA, 444 bp, Actinoplanes utahensis
gtggctgggcagatcgggagtgtgctggcggtcgtcgccgtgctggcggcgctggccgccgcggtggtggccgtgctccggctgcgggcccggcgcggcatcgcgaccaccatgcagcgggcgacctacgaggtgctgcacaccgcctcgctggccgccgagccgctgcgggccgggctgacccccgccaccgccgccaaggcggcccgccacctgcgcaccctgatcggcgcggccgggctcagcatcgccgacgacgagcgctgcctggcccacgacggccgcggcggccatcacaccgcccagctgaccgcggccgcccagcgcgccctgagcgcccggcgttcgatcgtgctcaccgccgccgagctgccctgcgaccgggtcgactgcgtggtccgtggcgccgtggtggcgcccctgcccggtccggacgctagctag

SEQ ID NO: 3016 - DNA, 1023 bp, Actinoplanes utahensis
atgcgcctcaccaagacccacctgatcatcgcgaccgccgccgtcgtcaccaccctgctgtccggctgccacgggggcagccggacgcagagcctctcgaccgtgccgggctcggccgtcgacacggccgtcgtgccgaccgccgcggcaagcgccccggtggcggccgcggcggtcgcgccccggctcggcatcagcttcttcggctgggaccccaagcacgagaactatctctacgtgcacaacggccaggccaaggtcgcgctgaagggctccgaggtctactacggcaacacggcggtcgccccggacggccacaggatcgcctgggtcgcggcgaaggaccgaagcctctgggtcgcgaacgtggacggcaccgaccgccgccgggccggcgccccggtgaacgagatgaactacagcatcgactggaccgccgacggcaccggcctgatcgccacccgcaacgccgcgccgaaccagccgatcgtgtacggcaccgtgcggatcgccgacgggagtttcaccgcgctgcccaagtcgctgcagggtggcctgcacttccggatgaccccggacggcaagcactacctgtacatcgccgacggcgtctccttcgcctccgccgacctggacggcacccacatcgtcaagacgccgatcatcggcgaccgcagcctgaagaagaacccgaggcacctgcgcgcggtcgacatcatcagctccgacgccaccggcgacatgctggccgtcaacacctgggacagcttcgagtacgaccggtcggtcggctcgtcgctggccaacaccctgatcgggcgggcgaccggccgggtgctcgcgctcccggtcaagggcgcggtggagcagatcctgttccgggccgacggcaacgtgctggtccgcagcaggtccggctcgacctggacgctgaccctgctctcgcccgcccgcaaggtgctgaccacccggacggaatcgtcgctcaccagcgggatcggcctgctcgccgtcgccggctga

SEQ ID NO: 3017 - DNA, 105 bp, Actinoplanes utahensis
gtgaccgtcctggtcacgggtcatttcgattttctggacaaaacttcggcgaaggtgtcacccggattcgcgcggacccgcgtctacacaggcgtcagtcactga

SEQ ID NO: 3018 - DNA, 1572 bp, Actinoplanes utahensis
gtgacgactagcctgcatcgcccaacgaccgacagcagccggagtaagcccgtgcggtacgacagcttcgagtggccgcagcaggatcagcagccaccgagcaacggtgtcccccgatcggcgtggacccgtcagcaccgccgagtttcccggtggcatcggccctacaccgcggtcctgatcgttctggacctgatctccacgctcggcgccagctggatcgcctcgctgctggagaaatcgcagagtggcttccaggacaagagctggtggttcttctccaacggcgcgctcttcaacttcttcgcgtacctggtgctcccgctcggctggctgctcctgctctggaccaacggcacgtacgaccgccgttacctgggcctgggcagcgaggagttcaagcggatcgtgcgcacctcggtcaccgtggtggccgccgtgtcgctgctcgcgttcgccaccaagaccgcgctctcccgcggcacggtcgccgcggtgtcgctgagcgcgctcgccttcatcctgatcggccgggtcggcgcccggcaggtgctgcacctggcccggcgccgcaccgggcacggcgcgcaccggatgatcctggtcggcacgctgcccgaggcgctcgaggtctacaccgcggtcacccgcagcccggccgccggcctgatcccggtcgccatccacatcaccgacggctacgccgcgacccgtggcatcgagacgccgatcccggtctacaccgggcgggacgtgctctcgctggtgcgcgaggtcggcgcggacaccatcgcggtgtgcggctcggccagcgccgagcccggcgagctgcgccggctggcctggcagctggagggcaccggcgtcgacctggtggtcgcgccgcagctcaccgacatcgccggcccccgggtgcacatccgtccgatcgagggcctgccgctgctgcacgtcgaggagccgactctctccggccccggctggctgatcaagaacctgctcgaccgggtcaccgcggccctcgggctgctgctgatcagcccgatcctggggatcatcgcgctcggcatccggctctccgaccccggtccggtcttcttccggcagacccgggtcgggcacgacggccagacgttcaaggtctggaaattccggaccatgtacgtcgacgccgaggagcgcaaggccaccctcgaagagctcaacgagtccgacggcatgctcttcaagatgaagcacgacccgcggatcttcgccttcgggcagaaactgcgggccacctcgctcgacgagctgccccagctgatcaacgtgctcaagggcgagatgtcgctggtgggcccgcggccgctgcccgccgacgacggcgactacctcggcgacgtacgccgccggctgctggtccgcccgggcatcaccggcctgtggcaggtctccggccgctcggacctctcctgggacgaggcggtccggctcgacctctactacgtcgacaactggtcgctgacctacgacctgagcatcctctggcgcaccatcggcgtcgtcctcaagcgcaagggcgcctactga

SEQ ID NO: 3019 - DNA, 1146 bp, Actinoplanes utahensis
atggagatggagcaagtccggtttttcggattcgatcagcgcggcaagatcgcgctgagcggccccgcccagcatcggggccatcggcagcagcgctttctgcctggccggcatcccggagatcgagtcggaactccgctggaacggcaccacggccacgccggccgcgcgcaactgctcgatctcggtgtcgacgatgacgttctccccggaggggatcgcctcgcgataccggttgtgtgcaaccaccaccttcacggtcgcaaacgctaccgtgagggggtgcccgaactccccgaggtcgaggcgctcgctgcttacctgcgggagcgtgcggtcggccactccgtgcagcgcctcgaggtcgcctcgttcagcgcgctgaagacgtacgatccggcgccctccgccctgaccggcctgccgatcacctcggccggccggcacggcaagttcctggacatcggcatcggcctggacgtgcacctggtcgtgcacctggcccgggccggctggctgcactaccgcgacacgttcaagtcgccggccccgctcaaaccgggcagcgggccgatcgcgatccggctgcggctcgacgacggctccggcttcgacctgaccgaggccggcacccagaagtcgctcgcggcctacctggtccgcgacccgcagaccgaggttccgggggtgtcccggctcggcccggacgcgctcgcggtcacccgcgacgagttcgcccggctgatccggtcacgcaacggccaggtcaagggcgtgctcaccgatcaggaggtgctcgccgggatcggtaatgcgtactccgacgagatcctgcatgtggcgaagatgtcaccgttcgcgttgaccgggaagctcaccgaggagcagctcaccacgttgtacgaagcgatgcgcgaagtggagaccgacgccgtgcaacgatccgtcggacagaaggcggccgagctcaagggcgagaaacgggccggcatgcgggtgcacgcccggaccggcctgccgtgcccggtttgcggcgacaccgtgcgcgaggtctcgttcgccgacaagagcctgcagtactgcgcgacgtgccagaccggcggcaaaccgctcgccgaccgccgcctgtccaagttggtgcggtga

SEQ ID NO: 3020 - DNA, 1497 bp, Actinoplanes utahensis
gtgatctcccgtcgtgctctcctcgccggctccgccgcggccgtcgccgccggtggagccggattcgccctcggccgcatcccggccgcaccggccgcccccgagcagaagaccccggtggcggccccgaagtatcgctcccggcccgatttgcaggccctgccggacgtcacgatcaccactccggcgaaccggacggtgcccggctacatcctgctcaccccggcctccgggcacgggctgtgggggccgctgatggtcgacgagaccgggtcgccggtgtggttccgcaaggtgcccgacccggccaccgtggcgatcgatctcaaggcccagatctatcgcgacaaaccggtgctgacctggtgggaggggaccatcgggggaaccggcgggcagggtgtcggccagggtgagttcgtcatcgccgatcagcagtaccgggagatcacccgggtccgggcggccggcaccgagcaggccgaccagcacgacttcgtgatcaccccgcgggacaccgcgctgttctgggtgtacgacccgatcgcctacgacctgtccccggtcggtggcccggccgacggggtgctgcacgacggggtgctccaggagatcgacatcgccaccggcaaacggctgttccagtggcgggccagcgaacacgtcacgctggccgagtcgtacgcgccgctgccgcagggtgatgcggcgcatctgccctacgactacctgcaccccaactcggtgggcctggacgcggacgggcatctgctgctctccgcccggcacacctggaccgtctacaaggtccacaagcagacgggcgcggtgctctggcgggccggcggcaagaagtccgatttcgcggtcgaggagcgggccgccttccactggcagcacgacttccgccggcgccgggacggcagctacagcgtcttcgacaacggggccgggatcaccaaggagcgcgattactcccgcggcctggtgttcaccgtggacgaggccgccaaaaagatcaacttcatggcggagtacgtgcacccggaccgggtgtcggcgccgacccagggcaacttccgggaactgggcgacggcggctcgttcatcgggtggggtcaggacccgcacttcaccgagcacaacgcggacgggtcggtgcggctggccgggcatctgccgctggacaaccagtcgtaccgggcgtacaaggcggagtggaccggcacgccgcacgatcaaccggcgctggggctgcgggtcgagggcggcaacgtgatcgtcaccgcgagctggaacgggcacaccggcatcgcccggtggcgggcccgggccggcggtcagccgcaggagctgagcaccacagtggaggcggcccggaccggtttcgagaccacgctgaccgtccagggcaccccggagtacgtggtggccgaggcgctggccgcgaacggcaccgtcctcgggtcgtcgtcagccatcccggtgcgcgtctag

SEQ ID NO: 3021 - DNA, 756 bp, Actinoplanes utahensis
atgaagacgcacttgtatcccgttgaaacccgccagccccggcagccgaccgcggccgactactacgcggtcaaccgtgggggcgggctgttcagcgaggcggtcagccagcggatcggttcccggatcgcggtcttcgccttccgccgcgacctcagccccaccctgctgaccatcgtcaacctcagcatcgggctgctcacctcgttcgtggtgatcagcgccgccgaggcggtcgccgacggccgggtgtggggctggctggtcggcgtgctggcgctggccggttggcagctggcgtacgcgttcgactgtgcggacgggcagctcgcccgggtcaccgggcgcagcagttcggccggcgggcgcctcgacgtgctgtgtgacgtggcggtgcagtccgccctggtcgcctcgctcgcggcgaccgccaaggtgcaggagccgggcaccccggcgtggctgctctcggcgttcgcggcgacctggatggtcaacctggtgacctcggtgatgcagggcggtggccaggcgtcgagcatggtgaccagccggtcgttgccggtgcgggcggtgaagctgatccgcgactacggggcggtgatcgccgtggccggggcggtgctggccgcggcgccccagctcacggtctggttcatcggagtcttcacgctggtcaacggcggttttctggcggccagcatcgcgttcaccggccgcaccgcgctgcacctagacgcgcaccgggatggctga

SEQ ID NO: 3022 - DNA, 1062 bp, Actinoplanes utahensis
atgccgctgctagcccgcagcgtgcagaccccgctgcacatcgaggtgcggcggggcgcggtggccgacctcggccggatcctcgccgacgggcggatctcggccggcggcgacgtcgccatcgtcgtcgggcccggcctcggcgagcggatcgtcgacctgctgcggcccacgctgcggtcggcgaccgtgcacgtcaccgccggcggcaccctggacgccgccctggagctggccggcaagctgcgcgccggcaactacgacgcggtggtgggaatcggcggcggccgcaccgtggacaccgccaagtacgccgccagccgctgggggctgccgatggtctcggtcgccaccagcctggccaacgacggtgtcgcctcaccggtggccagcctggtcaacgacgggatcaaggggtcgtacggggtgcacatcccgttcggggtgatcgtcgacctggacttcgtcgagaccggcccggagcgggtgaaccgggccggcatcggcgacgtgatcagcaacctcagcgcgctggccgactgggagctgggccggcaggtgcgcggcgagccggtcgacgggatcgccgcgtcgctggcccggatgggcgccgaggcggtgctgaccatgcccggcgacctgaacgacgacgcgttcgtcacggtgctcgccgaggcgctgatcgcgagcgggctggcgatggcggtctgtggcagcagccggccgtgcagcggtggctgccacgagatcatccacgcggccgacgcgttgtacccgggcaccgcgtcgcacggcgaactggccggactgggcgcgctgttctgcacgttcctgcggggcgaccggcggcgcttcggtcagatggctgactgcctggcccgtcaccaacttccccgatcaccgtacgacgttggtctgaccgtggagcagttcgtccaggtcatcgacttcgctccgcggacccgaccggatcgctacaccattctcgaacatctggcgctgacgccggacgagatacgtcaaaggctggccgagtatgaagacgcacttgtatcccgttga

SEQ ID NO: 3023 - DNA, 732 bp, Actinoplanes utahensis
atgatcggacttgtgctcgccgccggcgccgggcgacggctgcgcccgcacaccgacacactgccgaaagctctcgtcccggtcgacggcgacaccacgatcctcgacatcacgctgcgcaacctgtccgcggcggggctgcgcgaggtgacgatcgtggtcggttaccgcgcggacacgatcgaggagcgggtcgagaccttcgagcggcggtacggcgtgaccatcaccctggtgcacaacgaccgggccgaagagtggaacaacgcgtactcgttgtggctggccagggaccacttcgcgcggggcgcgctggtgatcaacggggacaccgtgcacccggtcgaggtggaacggatcctgctcgccgagcgcggccccagcatcctgctcgccgtcgacaccgttaaggagttggctgacgaagagatgaagacggtatttgacccgaacggccaactgacgaggatcaccaaactgatggatccctccgaggcgtacggcgagtacatcggcgccaccatcatcgaggcctccgccgcggcggcgctggccgacgcactgcgggcgacctgggtgcgcgacccgggccggttctacgaggacggcttccaggagtacgccgagcggggcggcgagatccgcgcggcggagatcggcaagctcgactgggtcgaggtggacaacctcgacgacctggtcaaggcccgggagatcgcatgccgctgctag

SEQ ID NO: 3024 - DNA, 1098 bp, Actinoplanes utahensis
atgaccgctgagcagctcatctcgttcgcccgtggcgctccgtcgctggacatcgtcgacgtggagggcctgaaggccgccgccgcccgcgccttcgacgccgacccggccggggtcaccgcgtacggcacgtccgtcggctacctcccgctgcgcaggtggatcgccgacaagcacggcgtctccccggaccaggtcatcgtgaccaacggttcgctgcaggccgacgcgttcctcttcggccacctggtgcagccgggcgacgacgtggtcgtggagaagcccacgtacgaccgcaccctgctgaacctgcagaacctgggcgccaaggtgcaccaggtgacgctgcggccggacggcatcgacgtcgacgagctgcgcgcgctgctggagtccggggtccgcccgaagctggcgcacatcatcccgaactaccagaacccggccggcctcacgctctccgaggagaagcggcgggcgctgctcgccctggccgagcagtacgagttcatcatcttcgaggacgacccgtacgtggacatccggttccgcggcgagccgctgccctcgatgctgtcgctggacaccaacaacctggtggtgcacgcctccagcttcaccaagacggtctgcccgggtgtccgggtgggttacctggtcggtccggccgcgctgatcgacgcgatcgcgaagaaggcgaccaacctgtacatctccccgggcatggtctccgaggcgatcgtgcaccagttctgcgtctccggcgacatcgagaagtcggtccgcaaggtcagcgaggcgttgggcgagcgggcccgggtgctggccgaggcgatccgcgaccggatcccgggcgccaccttcaccgagccggacggcggctacttcctctgggtggacctgccggccgacatcgatgtggagaagctgttcccggccgccatgaagaagggcgtcgcgatcgtcaagggcagcgacttcctgctggagggcggccgcaactcggtgcgcctggcgtactccgcggtcaccgtcgaccagatcgacgagggtgtccgccgcctggccgaggcgatcgacgaggtccggggccggtag

SEQ ID NO: 3025 - DNA, 1125 bp, Actinoplanes utahensis
atgagcgaacagaacggtgcgttcagtcgcaaccggccgttgtccaaggcctgggcggcccgggcgatgaatcggatcctcggcgccaacgagacgcatcggcatccggacgacgcggacgcccaggactccgcggtcgtcgactgcggtgtctatgtggccggtgagcggattcccggcctgttcaccccggacgaggcgttcgccgaggtccgccggcgtgacgacgcgttcgtctggctgggcctgcaccagccgtccgagcgcgagatgatcggcatcgcgcgcacctacggcctgcacgagctgagcgtcgaggacgcggtcaaggccgagcagcggcccaaactggaacagttcaacgacgtgcacttcctggtgctgcgcaccgcccggtacgtgccgcaccaggagctgaccgagagctctcaggtggtggagaccggccagatgatggtcttcgtgggcgaccggttcgtcatcaccgtgcggcacggcgaggcctccgagatgtcgccggtccgggccgacctggagaaacagcgggcgaacctgttgcagcagggtccatgggcggtcgcctacgcggtcaccgaccgggtggtcgaccactacctggaggtggccgagcaggtcgaggcggacctggacctgatcgaggagggtgtcttctcgcgcgaccgtagcgccccgatccagcaggtctaccagctgaagcgggaactggtggagttccgccgggcggtggtgccgctgcagcgcccgctggccgggatcatcgccagccagggcgtggtgcccaaggagatccggcggtacttccgggacgtgcaggaccacctcacgcgtaccgtcgagcaggtctcctcctacgacgacctgctcaactcgattctgcaggcccggctcgcgcagctctccgtcgaccagaacgacgacatgcgcaagatcgccgcctgggccggtatcgccaccgtgtggaccgcggcggccggcgtctacgggatgaacttcaaatacatgccggaaacccattggcggtacgggtatccggggctgatggcgctgctcgcggtgatcacggtgatcctctaccgggccttccggcgcaacggctggctctag

SEQ ID NO: 3026 - DNA, 174 bp, Actinoplanes utahensis
gtgggggatattcatcatcaccgactggtggacgcggtggccgggcacgacggcgatccgccccgccggcgatggctgcgcctgccggtcccgtcgctgctcaccggcgtgatgatcgccgcgctcacggccggtggcctggccgcctacgcgatgatcaccggccgctgctga

SEQ ID NO: 3027 - DNA, 573 bp, Actinoplanes utahensis
atgcgtggtgagctcggtcagagcgtggatcacttgaagcgcgccgcttcgatcgccgctcaggagaccaccgcgacggtcggaccccggctcaacgccgcggtcgagcgggttcagccggccgccgacaaggcgaaggacgtcgcgacgcagagctgggacagtgctctcgcggcgctgactcccctggtcgcggccgctgccgacaacgtgcggcaggcgggcaggaccggcaagaaggtgtccaagcgcgagctcaaggcgcagcgcaagcgcgccgacaagctgcagcgcaaggcggacaaggcgctcggccgcgagaagagcggccggggcagcaagctcgccgggtacgcgctgctgggcaccgccgtgggcctcggcgccgcgtggtacgccaagcgtcgcaaccaggcgcagtgggaggagtacgacgccgctcccaacccggtgaccagcacggccgccgccgacgacgcggcgttcgagccgctggagccgacggtgtacaccacgtcgaacggcacggcggcgagcgttgacaagaccggtaagaccggcccggccaagtga

SEQ ID NO: 3028 - DNA, 525 bp, Actinoplanes utahensis
gtggccgagacgatttacgccaccctgcacaccaaccacggtccgatccggctccagctgttcccggaccacgctccggcgacggtccggaacttcgtggagttggccgacggcaccaaggcgtacaccgacccgcggaccggccagcccggcaacgggccgtactacgacggcaccatctcgcaccgggtgatcgccggtttcatgatccagctgggtgacccgaccggcaccggccgcggtggcccgggcttccagttcggtgacgagttccacccggagctctccttcgaccggccgtacctgctggccatggcaaacgccgggccgggcaccaacggctcgcagttcttcatcacggtggcgccgaccccgcacctgaaccgccggcacaccatcttcggccaggtcgcggacgagcagtcggccaaggtcgtcgactcgatcgcgaacaccccgaccggcccgggcgaccggccgcgcgaggacgtcgtggtggagcgggtggagatcgagcgcgcctga

SEQ ID NO: 3029 - DNA, 909 bp, Actinoplanes utahensis
atgagtgaggctccttccacgtcgccggtgtgctatcggcacccttcgcgggagaccgtgctccgatgcagccggtgcgagaaaccgatctgcacctcgtgcatgaacgaggcgacggtcggccatcagtgccccgactgcgtcaaagagggacgtcgtggtcagcggcgcgcgctcaccgccttcggcggtgacgcggccgctggtcgcgccggttacgccgtgaccggcctggtggtggtcaactgcctggtgatggtcctgtcggtggctttcggcgggctcaagtcgatcgccggctcgggcggtttcatgggtctgggcggctccggcacccgggtcaccgacgccctcgaggtgatcggcctggcggtctatccggacggcgcgtggcacggtgtcgcgcacggcgagtggtatcggttgttcaccgcgatgttcgtccactacggcgtcgtgcacctgctgctcaacatgatggtgctgctgcagctcggccgctatctggaggcccggctgggcccgatccgcttcctggcgctctacctgctcgccggcttcggcggcaacgtggcgtgttacctgctgaccccgcagaatcagccttccggcggcgcctcgaccgccgtcttcgggctgatcatcggcatcatcatcgtgaaccggaagctcgccctggacgtccggtcactgataccgctgctggtcgtcaacgtgatcttcacgttctccatcgcggggatctccaaagagggacacctgggcggtctcctggtcggcgcgctggccaccatcgccctggtctatccggcgccgccgcaccggacggtgaaacaggcgatcggatggtcggtgatcttcctggcgctggtggtcctcgccgtctggcgcaccacgcagctcacctag

SEQ ID NO: 3030 - DNA, 702 bp, Actinoplanes utahensis
gtgaccccgtcgctgtcggccgcgagccggaccgggaccagcacgtcgcgcagcgcccacccgaccagcccgcagccgatcagcgcggcgagcgtccagcggaccggatcccgcccggcgaacgcgacggccagcgccaccacggcgaccgcaccgaccagtttgaggaccggcaggaccggccggacgcgccattgcatggggacactatggcaccacgatcgctgtaattccttattcaccagctcgggccgctgcctccggcgttcacacagcgttaaacatgtcatggacgtgatctcgtgtacgttcctccccgccaccgtcgaagccggcgtggccatccccagccggcacctcccgatcgtggagcgttgcgtcgaggccgacgacagcgcggtcctggtcacccactgcacccggccggaggcgccgctcgccggtgaccatctgctgctgctcacccggcgccgcctggtggtgatccagaagacgccggtgctgcaccgcctgcgcctgcacctgaacgccaacctgcggcacctgagcaacgtgacctggcgccccgacctgacccggccggcgctggagatggccgccaccgcggtggacggggtacgcgagcggttccggatcaagttcgcgaacaccgaggcggtgtggcgcttcgagggcgtcctgcgcgacgtcttcctagcctag

SEQ ID NO: 3031 - DNA, 906 bp, Actinoplanes utahensis
atgcgggacaccttcgtggccaccaccaccgcgctgctggacgaggatccgcggaccgcgctggtgctcgccgacatctccgccgacgcgttcgcgcccgcgctgcgccggcacccggaccgggcgctcaacgtcggtatccgggaacagctgatggtcggggtgggcggcgggctggcgctcaccggcatgcggccgtacctgcactcgtacgcgccgttcctgatcgaccgggcctacgagcagatcaagctggatctcgggcaccaggacaccggggcggtgctggtcagcatcggcgggtcgtacgacgcggcggccgccggatacacccaccagtcccccggtgacgtggcgctgctcgacaccctggacggctggaccgtgcaggtgccggggcatcgcgacgaggtgccggcgatgctgcgcgcggcggcccggcacgacgaccgggtctacatccggctgggactgcaggagaacgcccgcgcccacccggacgccgggcggctgcgggtggtcaagcggggcgggccgctggtgctggcggtcggaccgatgctcgacccggtgctggcggcgacccgggatctggacgtcacggtggcgtacaccaacacacctcgcccgctggacgtggagggcctgcggtcgctggccgagggcgaggtggtggtggtcgagccctacctggccggcacgtccgcgcggctggtcagcgaggcgctgagcgggatcccgcaccgggccctgcacctgggcgcggggcgggccgagatccgtgattacggaacgtggcaggaccacgcccgggagcacggcctcgacgcggccgggctgcggacgtcgatcacggcgtttctaggccaggaagcgtttctaggccaggaagcgttcctaggctag

SEQ ID NO: 3032 - DNA, 654 bp, Actinoplanes utahensis
atgaccgtcacgacgctgcgtcgcctcaccggtgacgagaaacacgcgcccagcgcacactccacactggatgtgatccgggtgctctacgagcggatcctgcggatcaccccggagaccgccgacgcgccggaccgtgaccggttcctgctctccaaggggcacgggccggccgcctactacgcggtgctggccgaccgcggcttcattccgcaggagtggctggaccggatggggcagtggcacagccggctcggcacccaccccgaccgggtgctgatccccggggtcgagatcggcaccgggtccctcgggcacgggctgggcctggccgtgggcaccgcgctcgggctgcgcgcacagggcttctccgagacccggacgtatgtgctgctcggcgacgccgagctcgacgagggatcgaatcatgaggcgatcgcgtacgccgcggccgtgcacctgccgctcaccgcgatcgtgatcgacaaccggtccgccacgcacggctggcccggtggcattccggcccgctttccgggctggagcgtctcgctggtcgacgggcacgaccacgacgagatcgaacagggcctgcgggtccgatccgggcggccgcacctggtcgtcgccagcctcgaggccaaggggagctga

SEQ ID NO: 3033 - DNA, 462 bp, Actinoplanes utahensis
gtggagaccctcaccatcggcgacatggccgcccgaagcggggtggccccgtccgcgctgcgctactacgagcgggaggggctgctgcacgccgcccgcaccggcggcaaccagcggcggtacgaacgcgccgacctgcgccggatcgccttcatcaagatcgctcagcaggtcggggtgtcgctggaggagatccgcgaggcgctcgccgagctgccggagaaccggacacccaccagggcggactggtcccggctgtccagccgctggcggcaccgcctcgacgagcggatcgcgatgatggaacggttgcgcgaccagctcaccggctgcatcggctgcggctgcctgtccctgcaacgctgcagcctgatcaacccgcgcgaccggctggccagccgcggcaccggcccgcagatgatattgaacccgccggccgcggaagtgtccgaggatcggtga

SEQ ID NO: 3034 - DNA, 309 bp, Actinoplanes utahensis
atggagcagctcggcagcggatacggggtcctctggtcaccgatcagtaatacgctcgccgatacgccggagaacatgctgagcgtcgttttcgccctcagctgcaccgggggtggagcagtgagcttcacggtcgacgccggtggcgcacggaaacaaccggcgcaggcgcattcctgtgacggatcggtggctcagcagagtatcgcgccggcgaagcacggcccggtcagcttctccgccgaggtcaccggatccctcgccggtagcttcgcgtacgcctactacgtggagaagacgcaaagctga

SEQ ID NO: 3035 - DNA, 963 bp, Actinoplanes utahensis
atgcgagcgatcgtcatcaaagacaggcaactgcattgggccgaggttccggatccggagccgggcgacggcgaggtggtcgtcgacgtcaccgcggccgcggtcaaccgggctgacctgctgcagcgtcagggcaactatccgccgccgccgggtgcgccggcctatccggggctggagtgctcgggggtgatcagtgcgctcggcccgggtgtcgagggacaccatgtcggggagcgggtctgcgccctgctggccggcgggggctacgccgagcgggtggccgtgccggccggtcagctgctgccggtgccggccgggctgtcactcgtcgaggcggcggcgctgcccgaggtcgcctgcacggtctggtccaacgtggtggcgcacgatcggctgcgcgccggcgaggccttcctggtgcacggcggcggcagcgggatcggcacgttcgcggtgcagctcggcaaggcgctcggcgcgaccgtcctggtcaccgcgaggtccgcgaaacacgagcggctgcgcgcgctcggcgccgaccatctcatcgactaccaggagcacgatttcgtacgagaggtgcacaccgccaccgggggccgcggggcggacgtgatcctggacatcatcggcgcgaagtacctggcccgcaacatccaggcgctggccgtcaacgggcggatctcggtgatcggcttccagggcggcacccgggccgagctcgacctgggtgccctgatggccaagcgcggcaccgtctcctccacctcgctgcgggcccggccgatcgccgacaaggcgcggatcgtggccggcgtccgcgaccaggtgtggccgctggtcgcggccggtctgatcaaaccgatcatcgacaccacggtgccgctcgccgaggcggccgaggcgcagcggctcatggaggccagcgaccacctgggcaagatcctcctggtccgctga

SEQ ID NO: 3036 - DNA, 672 bp, Actinoplanes utahensis
atggacggacagcgcgtccggccctcgggtgcgccccggatccgctcgctgggggacaccgtgacctacacaccacaccggccgccgaccgtccgggtgaccgaccccgacgacgacggtgtggacgagtgggcgctgcgctggcgcacccggatctgggtcggcggcggcctgctcgtcaccctggccctaatcaccttcggcatctgggcggtggcgaccgccgaccaaccggcgggcgggccggcggtgttccgtgggctgcccccggccggcccggccgacgcgtcccgcggcggcttcggtctgcgggtcaccagcgtgcgctgcggcgtctccgcgatcggcccggacgggctggaacaacgcgcgcacgggcagttctgtctgctcgacgtacgggtcaccaacaacggcaccgagccggcgttgttcgacagctcggcacaacgtgtctacgacgccgacggtgcagcatacgccgttgccgccgacgccgcggtttttctcaacgatgacagcccgacactgctcgacgagatccccccgggaacgtcggtggacggcgtcctgcccttcgacgtcccgaagaacgcccagctcagcgaggtgtccctgctcggctccggcgtcgcgccgggcatccggatgtcgctgcccgctcccgagtga

SEQ ID NO: 3037 - DNA, 924 bp, Actinoplanes utahensis
gtgctgaccgccggcgctctcgcgctggccgtcatcgcaccggccgtagaccctgccgagcacgccacggaggccgcaccggcccccacggccctgccggcgaacccggagtcaccggccttcgcgggtggcttcgccgcccgggacagccggatcctctccgacgacctcgacgagagcctgttcatgcggcgccaggccgccacggcccgggcgacccgggccatgcagcgccgggcggtcaccatccgcccggcgccactcgccccgctgcgcgcccgaccgggcgccccgtctcccggcgccgccccgaccgggcggtccgccgccgggcagcgcctcgcgcgatccgcttccgggcagcgtgccggtcaggggcagcggtccgcctccggtcagcgcggcaccgtcgagaagcggcccgcgttcgggcggcactcggcggagaacgcgctgcagcgggcggtccgtgccgcgcagcaccggacggtcgcccagcggcgcaccacggtctcgcaccgcggcatggtgcgccggaccacgcaccggacggtctcccggaccctgcgggtgtccggcggcaccgggcggatggccgcggtcatcgcgtacgccaaggcccagctgggcagccggtatgtgaccggcggcgagggccggggcggtttcgactgctcggggctgacccggcaggcgtacgcccgggccgggatgcggctgccgcactcgtcccgcgcccaggccgcccgggcccgcagcgtcgcccggggccaggcacgtcccggtgacctggtcgtcggctccggtcacgtcggcatctacatgggccgcggcatgatgatcgacgcgggcaaccaccgtaccggcgtcgtctaccgcaggatgtaccgcggcctgcgcgtcgaacggatccccggagcctga

SEQ ID NO: 3038 - DNA, 531 bp, Actinoplanes utahensis
atgagtcttgaccgagctctggcccccgatccgtacgatcttctaccgcaggtcccgtcgttcacggtgaccagcgcggacgtgacggacgggcagccgctcgacgagttgcacgcgcacaccagcgtcggcgggaagaatctctcgccccagctgtcctggtcgggctttcccgacgagacccggggtttcgtcgtcacctgcttcgacccggacgcacccaccggcagcggtttctggcactgggtgctggtcaacctgccgctctcggtgacctccctggaccgcggcgccgacccgttcccggacggcgccttctgcgtccgcaacgactacggcgagcgcaactacggtggctcggccccgccgcccggcgaccgcccgcaccgttacgtcttcgcggtgcacgccatcgacgtcgactcgctcgacgtcaccccggacgccacgccggcctacgtcggcttcaatctggccttccacaccctggcccgggccaccatccgaccgaccttcgaggtccgcggctga

SEQ ID NO: 3039 - DNA, 714 bp, Actinoplanes utahensis
atggcagacatcactggagaccagcggatccagtccgaagtgctcgaaggcctcgcaacggccgtgaaccaccgtcggtggttcgtcgagctcgctctcccataccttggggacaaccccatcgagatcggcagcggcctcggggactacgccttggagtgggccgagcaccttccgcgcttcaccgcgacggaggccgaccccgaccggctggtccagctcaaggagcggatggccgggcacgcgaacatcgaggtgcggcagatgctgctcccggcgcaggacgccgccggggagtacagcgccgccgtctcgtacaacgtgctcgagcacatcgaggaccacgtcggcgcgctgcgcagcatgcgtgaactcgtccgccccggcggccacgtgatcatcatcgtgccggcgttcatgttcgcgatgagccaggtcgacatcgccaccgggcacatccgccggtacacgaagaagaccctgggcgccgcctacaccgaggccggcctcgagatcgagaagatccactacgcgaacgccctgggcctgatcggctactacggcgccaccagcatcttcaagctggcgccgaaggagggcccgatggtgaaggtgtacgactcgctcgtactcccggtcaccaaggccgccgagcggatcgtccgcccgccgttcggccagtcggtcttctgcgtcggccgcgtcccgcgctga

SEQ ID NO: 3040 - DNA, 2085 bp, Actinoplanes utahensis
atggacacgcggaaaacacgcgtacatatcgtctctatcacgctgcggccgctcatcgtggaactcttccccacctcggttaggctcgccgatgctatgacgattacgggttttgactcgacgggccagacggccggtgagaacgttctgccgccccgccagttgaccgcagccgaggacctggacgccgagctgctggcactgggtggcggcctcatcaccgccgcgccgacctcccccgcgcccgccggggaaaacaccgctgagcaggctgaagcgcctgttcgccgccgtcctctgtggcgggtgccgacctggcgcgacgtggtggcgatagccagtttcctggccgtcgcgctcttcgtcaccgccccgttgtggctcaatcttgatcatgagttgcgcgatgatccgcaggatcaggctttcttcgagtggatgctggcgcacggtgcccgcgtgctcacggatggcgtatatccgttcttctcggatcgcatgaattaccccgatggggtgaacatgatggccaacacctcggcgttggccgtttcgttgccactgacgccggtcactcttctgttcgggccgcatgtggcgttcaacgtatttctcaccggcgcattggcattaaccggtacctcatggtatttggtgctctcccgccgcctggtcggctcgcggctggcggcctgggtgggcgcgctgttcgccacgttcgcgccgagcatgatcgcgcacgccaacggccacccgaacatcgtctcgcagttcctggtcccggtgatcatctggcggacgctggagctgcgcgtcccgggccgggcggtccgcaacggcctgctgctcgccggcatgctgatctggcaggccttcatcaacctcgagatcctcttcatgaccgcggtcggcgtcggcgtcttctgtctggtcatggggctggtccgggtccgccggcaccgcagcgagccgttcgccttcctgcgcgggctgatcgtggccggctcggtcaccctggcggtgctcgcctacccgttgagcgtgcagttcgccggcccccagtcgtacaagggcctgtccgaatacgtgcgcagtttcggctccgatctggcgtccttcaccgcctattcgacgcactcggtggccgggaatctcgaggttccgctgaccctggcgcagaacccgtccgagcagaacgcgttcttcggctggggactggtcatcctcttcttcggcctggtgctctggctccggcgcagcgccgccgcactcacgctcggcggcctcgggctgctcttcgcggcgatctcgctcggaccgaacatccggctcaacggggcggacaccggcgtaccgggaatctggtcgtttctgcatcaccttccggtgttcgactcggccgtcccgacccgcttcgcgatggcgatcgcgccgatcgtcggcatcgtcctggcgctcggctgccagcgtgccgcggaactggtccgcacccagccgcagacccgcggcccgatccgggtcgcgatgatcaccgcggtcgcgatggctctggtcccgctcatcccgcaccagctcgacacggtgaagatggagacggttccgtccttcgtgacctccggccagtggcggcactacgtcgacgacaaccacaccgtcgtcaccctgccgctgccggacagctactaccccgacccgctgcgctggagcgcgtacaccaagctcgacatgcggatcgccggcgcgtacgcgctgttgccgaaccagaacccgcaggacccgaccgaccacaccgcggcgttcgccccgccgtggcggcccaccagcggcctgatgtcctcgatccggcagggcaacccgacccccgaggtctccccggcccgccgcgagatgaccctggccgacctccgctactggaaagccggcgtcgtggtcctcaccccgcagacccgcgacatcgagatgctccgcaccatgtccgacctgctgggcttccgcccgacctggaccggcggcgtctggctgtgggacgtccgcaacctggtcgacaaccccgacgcggtcatcaccgcggacgccaccagctga

SEQ ID NO: 3041 - DNA, 783 bp, Actinoplanes utahensis
gtgaccgtcaccctggaacgtgtcggctcccgcccgctcgcgcccgtcagcgccaccctcgccggcatgttcggcggggtgcaggtgccctcgctcgctcccggcctgatcgtctccgagcaggccggatggacgcccgccacccacctcgccggccccggtctcagcccgctgctcgcctccgccggccgccggtggaacgcgcagccacacgccgccgcggccctcgcctggaaggcgtacacctactgggcggtgctgcccgccgtcctcggatgggcctcggcccgtcgcgtcccgctgatcaccgccggtaacgtcctgacgaatcacgacaacccgaccgtgatgatcacgctgggtctacgggccggcatcccggtcgccgtgctgcccaccgacccgctggctctcagcggacaccccgacgcggtggtcgtgcccgacgagaccgccctgctcgccgagttccgccgggcggtgctcgacgagcacctgacgccgctgctcgacgccatccaccagcgggtccgtctggggaaacggccgctgctcgggtcgctcgcctccggcatcgcctacggggtcctgcgatcggccgacacggtgccgggctcctcggcggagtcgatcgagaaactcctcggggtgctcgggatccgggacctgatcgacctcgcgcccggggcgaacgggcggcttgaggtgcagcgcaagacttgctgcctggctttcacactgccgaagccgaagctgtgcccggggtgctgcatcaagccgtga

SEQ ID NO: 3042 - DNA, 1530 bp, Actinoplanes utahensis
atgaccacctcgcccgtcgagcgggccgcagaccaattcgtctcggcgcttgcgcaatggcgggtggagcgcgggatgaccaagaagcagctcgccgcgcgcatgggcttcgatccctcctacgtcagccacgtcgagggccgccggcacaaaccgaccgaggacttcgcccgccgggccgaggcggtgctcggcgcgggcggcgcgatctggcagcgcttccaggagtacgacgagcttcgccacgcccgcaccccgggcccgcaccgcgactcgccggtgcggtcccagtggctgccgcccggcgccggcctggtggtcgagcgggagatcgccgagctggcctacaccgacggcgcgtaccggtgccgggtgctccgctcgctctacaacgccggcgtcgaaccggtcacccggtacctggtcaagatggccgtcgaccggtatccgaacgatccgaccggctccaaccgccaccaccgggagaacccgctcaccttcgaggaactggacgtccacgcggtcgccggcgagggtgacgccgccgagccgatgcggtggcgggtcaagctcgaccgggacgccgccaaggagatctggctgctgttcgccaacgagcgcggccagttcccgctctacccgggcgagcgcaccacgatccagtacgcgtacacggtcggcgaggagaagtggggccagtggttccagcgggcggtccgcctgccgacccgctcgctcaccgtccgcctgaatcttccggaacgcttcgaaccccaggtctggggcgtcgaggtgtccctgaacgcggaggtcccggtccggaccccgctggaacgccgcaacgagggaggtcgcgccattttcgagtggtccactgaccagcctttgttgaacgcccggtaccgcctcgagtggcggttccgtggcgccgacgcccccgtccacgacgatctggccccggccgagccggtgctgccccgcgcctcacaccggatgcgcgggatcgggatcatccagcgcggctccgacctgctccggcagcgggcccgtcacttccagctcccgcgcgaggcgccggccgcccgggagacggtcacccggctgctcacctcgctggcgcagctggaggatctgcacgagttcagcaagggggtgggtctggccgccccgcagatcggcctgccggtggcggccgccgtggtccgcgcgccggaccgggagatcgagccggtggtgctgctcaacccgcgggtggtcggcgagtcggcggcccgcgacgagcagtacgaggggtgcctgtccttcttcgactaccgcggcctggtcgtccggccgctgcggatcgaggtggaacacgcccgcttcgacggcgcccgggtggtgaccgtcttcgagcgggcgctggcccggctggtcggccacgagatcgaccacctggagggccggctctacgtcgaccggatgaagagcgacgcgaaactcgtcccggtcgcgcagtaccagcagaccggccgcccctgggactactga

SEQ ID NO: 3043 - DNA, 1110 bp, Actinoplanes utahensis
atgggagacctcgcacgcttgctcaaggagagctggagcctcgtcgaggagcatcaggacaaggtggccggctatttctacgcccggatgttcctgtcctacccggatctgcgggacctcttcccggtgcagatggacgtgcagcgcacccggctgctgcacgcgatcgtgaccgcggtgcagaccctggaggaccccgagcggttcgaggactacctgcggtcgctggggcgcgaccaccggaagttccacgtgctgcccgagcactacgaggtggtgggtggcgcgttgatcgagtcgatgcgggcgttcgccggcgagcagtggggggtcgagtacgaccaggcgtgggccgacgcgtacgcggtgatcgccgccaagatgctggccggcgcggagtctgatcagaatccgccgtactggtacggcgaggtggtgcagcacgagcgccggtcgcacgacatcgcggtcttcacggtgctgccgatgcagccgctggagtatcgcgccgggcagtacctgagcgtggaggcgagcccgtaccagccgcggctgtggcgtacgtactcgccggcgaacgcgccgcgccgggacaacacgctggagttccatgtgcgggcgctcggcgccggctgggtgtccagcgctctggtccgcaagctgaaggtgggcgacatgatcaaactggccgcgccgatgggctcgatgaccctggatcgaagatcgacccgggacgccgtgttcgtggccgggggcaccgggctggccccgatcaagtcgctgctggaggagctgacccggtacaaccggacccgctgggtgcacgtcttcttcggcgcgcggacccgcgaggacctgtacgacctggccgacctgaatcggctcgccgcccgttacccctggctgtcggtggtgaccgcgtgcagcgacgacccgaccttccccggcgagaacggcaacatctcggatgtggtcgcccggtacggcccgtggaacgagcacgacttcttcgtctccggctccggcccgatggtcaaggcgaccctgcggacgctggccgagctgcaggtcccgtcgatccggatcaagtacgacgcgttcagcgactga

SEQ ID NO: 3044 - DNA, 774 bp, Actinoplanes utahensis
gtgactctagaaggccagcggtccacccgatcggcgtaccccgccgagatcgccatcgtcctgctgctgtcgctcgggcagtcggcgatctggtcgatcgtgtcgctgaccgccaagctcaccgacggcaaaccgctggccagccacaccgcgacactcaacgcgccgatgtcgccccgtccctacctggacctcacgtaccaggtgctgaacatcttcttcgacctggtaccggtggctttggcgtggtatctcctgcgccgcgacggcatccggcccggccgagacctcggcatcgacttccggcgcccgggattcgatgcgggctggggcgccggcctggccgccggcatcggcctccccgggttgttgctggtgtacgcggcgatcaagctcggggtgtcggcgcagatcgtgccgtcggcgttgcagccctactggtgggcggtgccggtgctcgtgctgtcggcggtgcagaacgcggtgctcgaagaggtgctggtggtggggtatctgacgacccggctgcggcagctggaggtgtcgaccgggtggatcgtcgcggggtcggcggtgctgcgggggtcgtaccacctgtaccaaggctttggcggattcgtcggaaatatcgtgatgggggtgattttcgcgttcttttatctgcgtaccaagcgggtgatgccgttgatcgtggcccacagcatcctcgacatcaccgccttcgtcggctatgacctgcttccggactcctggctcacctggctccacccgtag

SEQ ID NO: 3045 - DNA, 1431 bp, Actinoplanes utahensis
atggaggagaagcagacgccgcgtgccagggatccgcgggcgcccttcagtgcgccggaggcggagcaggccggtggggggcgggggcggcgcggggcgccgccggccgttactttccagccgcctcggcctggggtcagtgctgaaggtcacccttccggggcttcttccggtacgccggaggacagcgaaccgccgcggccggcagccaaagccgcggggcgggccgccaggacttccagggccgcgcgcaccgtggcgccggtggacaacggggcggccggagcggccgacgggcagccggagcgggctgcggacgggacgggcgctgcgcggaaggcgccggtcaagaaggtggcgccgcggtcccgggcggcggcgaaggcggtgcccgctgcgaatgatcaggcggcgaccggtgacccggcggctgccgagacggtcaagcgggtggcgcggccccggaaagcagccgcgggcaagccgccggcgagcaagatgccagcgagtggagcaccggaagcggtgaaagcggaccggaccccgaccacggcggaagcggaccagccggcgaccgccacggcaccggccatgaccgcaccggcaccggccacaacggagaccgaccaggccgcggccaccacgacgccgggcacggcagaggcggatcgggtcacagacgccgcgacaccgggcacggcagaggcggaccaggtcacagacgccgcgacaccgggcacggcagaggcggaccaggtcacagacgccgcgacaccgggcacggcagaggcggatcgggtcacagacgccgcgacaccgggcacggcaaaggtgtacgcggtcggtgcgagcaggacgccggtggtgggcaacgccgcggagcggttgcactgggcggtggcggatcagatcgtggtggatctgtggcctcggctggtagcggagccgcgggacgcagcgcggattctggctgaggcggcggtgcagaccctggggccgcgcgcggcggcgtgggcggctcggacccgggccgcttatccggcggctacaccgcaggggctggcacgactggcgacggcgcagtctgtccgcgcggcggagcggcgggggatcctcagcgcgctgtccgggacgtacgcgccgatcgctcttgtcgcctcggccgcgttgacgcacgcggacctggtgttgcatgtcgccgcggcgtatggggtcgatccgacggatccggagcgtgcggcggagctggtggtgctgctgcccagctatcggggcggtgcggcgtgggcggcgctgcggctggccgatcgggccttcccgggggcgagcatgctcggcgcggtgctcggcgggcggaacacggccgaggcggtggcggtccgcgcggagcggcggtacgggtggtacgcgagccgcaggtcgcaggagtag

SEQ ID NO: 3046 - DNA, 2664 bp, Actinoplanes utahensis
atgttctctgatcatcgttcgtcgacggatgccgtgtcgatgacgggtatgcatccaccggcacggttctgggccgtcgaccttcatgtgcacacgccggggtcggcagatgttgatccgctgacgtatggggcttccgcggctgaagaggtcgtggcggcggcactctccgccgggctggacgccatcgctgtcaccgatcacaacacagtgcggtggtgcgatctggtggctgcggccgctaccgcgacgtctttgatcgtgctacctggcatcgagatcagtacgaccgaaggccatctgctggcggtgtgggatgaagggacaccgctgcatctcatggaggacgttctggtcgagctggggatacctcgtgtagaccagggaaggctggacgttgcaacccgcggcggcttcgctgaggctgccgaagcggtccatcgcagtggtgggatcgccatcgccgcgcacgccgaccgtcctaaaggtctccttcagttgacggtcgccgcgaacgtcagcaagatcatcctcaacccggccctggcgggggtggagatcgttgatccagaggcggccgagcgggtttcgtcgaagactgccggccgacgggagatggcctgtgttcggggctcggacgtgaccattcccggtgggaatgtgcacgtgttggagggcatcggtcggcggcggacgtgggtgaaggcttcccggccggatctttgtggtctcaagcatgccctcgctgacccggagctgagggtccgactggaggagccggcagagccggagcacatgatcatcgagtctgtccgggtctcgggcggttttctcgatgggcagacgttcgagctgtctgcagacctcaactgcctactggggggcacgggaaccggcaagtcactgttgatcgaggtgatccggtttgcgctggaccagcagaccgatagttccgactttccccaggtccgccgggaagtggactcacgtctcgatcatgcgttgagccagaacgcatcggtggaggtggtgctgcgccgcaagtgggcacggtgcgttgtgcgacgcgcctacttcggcgatcagtcaccgtcgccggagatgtccggcgacacggagcacttcgtgaacccctcgggtcgagttgccatccgggccttctcgcagagcgaggtcatcgaacatgcacgcacccgggtcgggcgtatgacgctgattgactcgggccttgatctggaagacctcgttgccgctgacctcgaagtccgcagccggttggcggacaacagccgcttgattgtggggctgcgtgacggcatccgcgaggcggaactcctgttggagcagcgtcccgttgtcgtcgagcgcttgaccgagctggggaagttgttcaacggcgatatcgtccggcaacaggccgcctggagccgagagcgtacgtggttcaactccctgacatctgccgatgcgctcgtggcgccacatatcccccaggtgatgtcgttcgtgcacgcggttgcggtcgaggccaaccgggacctgtacgaccgggcggccacggcgctgagtgcactggaggcgacgctcaagtccgttgatgagaaacttcagcaggcctacgcggcggcaggccgggagctggccggcatcgtcgcggaatggcgtgagcggcaacaagagttcgacgccaagctgcgggcggtcgtggcggaggctgacgtcgagggcaagggcctggagacgctccggacgcgcttgaccgagctgcaaacgaacaaggtcacgctcgatgatgttgcgacgaagctggagacgacgcttcgtcccgggttgcgtacggcgatggaacaccgcgaaaccatcattgaggaactggtggtgttgcggaaagagcgccgcaagcgccgcgagacccggatcaggctcttgaacaagctgatgtcgggcgtggtgcggataaagctggacagtgaaagtgaggacgaagactacggagcgcagatcgcggcactcgcgaaaggatctcgtcttcgtgcggacgtcttgcagcagctgtgcgcgaagtcgcaccccgtcaagctcattcgctcctttctggacgatgacgcagagggcgtcagcaaggtgaccggcgttgagagccgtcacatccagaccttgttcgagcatgtcatcgagcggcatcaggaggaagaattcctcggcctgcaatcgcttgagctgctcgacgggctctcggtggagttccgcaagcggggcgaaggggagtacgagcacatcgaacggctcgcgcacggccagaaatgcactgccatcctgatcatcgcgttggcggatggtgctgaaccgttgatcatcgatcagccagaggatgcgctgcatgctccctggatcgaggagtatctcgttgagcggctccgtggactgcgtggcagccgtcagtatgtgtttgccacccgtagtccaggcctggttgcgtcagccgacgcggaaatgatcatcacgctgacgtctggggccacgcaggggaccattgaggcgagcggatcgctggagcgctacgaccttaaccgccacgctctctaccaccttgaaggcgggccgcagccgttccggcggcggacgacgaagctcgggccatcgatgtccgccgtcgtttcctaa

SEQ ID NO: 3047 - DNA, 135 bp, Actinoplanes utahensis
atgccgatcgtcaagccgcatacccgccagggcaaacccgtcaagggctactaccggctcaattcaatctggaacttctggttcggcttcctgctcatgctgctgctgttcgccgtcgtcagcaaaggaaactag

SEQ ID NO: 3048 - DNA, 264 bp, Actinoplanes utahensis
atgccgcacgtctccgggcactaccgcaacggccggtgggtccgtccgcactaccgacgaagcacccccagggccgtccgcagcgccggaatgattcgcgtacgcggccaccgccgcgacgacggaacgtacgtccggccccacctgcgcaacgccgccccgaccctcacaccggcctcgagcaactcggactgggactggctgggctacctagccatgttgctgttcgtcttgttcctcatcggcgctgcaacccaggcgtaa

SEQ ID NO: 3049 - DNA, 2895 bp, Actinoplanes utahensis
atggatcttcgcgcctcgcgtacggcagtgcttgagggtctgagcgcgctcgcaccggacaatctcgtccaccgcttcgatcagcagcgactggatccgttaccgccggccgggccatgcgacccccggctcaacgacgcccagcaacgcgcttccgacgcctgctgcgctcccggattgcaggttgtgtggggcccgccgggcaccgggaaaactcatgtcatcgtcaacgccatcgaacgcctgatgacggcgggaaagcgagtgctactcgtatcgaacaccaacgtggcggtcgacaatgccgtcgagggcatcatcaaacgccttgcccccaccgccggccgagtgatccgggtcggtactccccgcatcactacggtagcccgtgacgagcgagtctcgctaaaccggctggtcgaagctcgccaacgcaccgccttggcgcgcctaagccgtctggaggacactatcgcggagctgcagagcaatcatccgcagcgccggctcgccgattcggaggctgcactggcgggtttcgaccctagcgagcatcgacgccgccaggcgcggcgggacaatcagcaccgagcgcagcagctgaccgcccaggtacaggcagcggccctgcatgccgctgaggcgaagggtaacctcaagcaagcgactgccgacgaactcttggcgcatctgctcgtcgccatggtctacgagcgcatagctcgacacgaccgggatcaggcagcgcaggggttggctgaggaggaacgcagcaccggattgtcgcgggcgatgtccacgatgcgccgccgacaggcccgcggtgccgcccaccgcgccgagcgcgaactggacgcaaagcggacggagcggaccgctgcggaagcccggttacggcaggccggcgcggaggtgtcccatgccctttacgtccaagcgcaggcagccaccattgcccaagcccacgagtgggccgcgcatgccgagctgcaccaaagcacagcggtccgggtaaaagaagccgcagccgaagccctggccgcggttcggcagcgactgagcatcgccgctgcggcagcacagccctccgagcaggatctgcaactgctccgcgaggcggaaatgcgcggtctgccgcagctgcatgaagagctgtccgcattgcggcaatccgctgtcgagtgcgaccgaaagatccgcgagtgccaaacacagcacgaccgcctcgtgaccgacctggcagacaagcggcccggtatgcaagccgcgctcattgccgaggccgccgtcattgcgacgacgctcagcatgctgacgctcaagaagatgatcctcagcacggcgttcgacatggtcatcgtcgacgaggccgcagcagccagcttgcccgaactcatgttcgcggtgaaagctgctcgtaccggcgcgacgctgctcggggactacctgcaaaacggacccttcgtcgatccgagcctgcccaaagaagatctgatcaaggccgtctacaccagagactgcttcgagatattcggactgactgatcccgcaaccgcgtcccagcaacccggctgcgtggttctgaccgagcaatggcgcttcggatgggaactgaccgagctagccaaccgggtggcctacggcggactgctgaccgccaaaaacccgaagacctgcgagatcgtgctcgtcgacaccgacggcctcggcaaagccctcagtggcatacgccgggcgcgtcccgacgctgtcgccgggacgtggccgatcggcgcgctcatcgctcgagctctcgccgagtaccaccacccccgtgatgggtccgtcggcatcgtgaccccttacaaggagcaggcagaaacgacgcaggaactgctcgccgaatccgcgtgcggcccagcgatcgaagtcggcacagcacacacctttcaaggccgcgagtgcgacatcgtcgtgttcgacatggtcgaggacggcaggggatgggtcgccaaaggcgctcacggctccgacgcatggaagttgcaagggctacggttgttcaacgtcgcgacgacccgggcccggcaacgcctctacctcatcggtgacggcgcagcaataaggcgccgcggcagcggccctcttggcgcactgcgacacatgattgacgccggcacgatccaacgtgtcctcgccagcgacctcctcggcatcgacgaggccaacgcgccagtcgaggaaaccgttcaccacgacctgtggagtgcgctccagccgtacatacggcttgtcggaatgtacgacgagaagcagatcatcgccgaggtccagcagcgcgtcgacagcgccgcgtcgtcggtatggatgtggagcccctgggtcggtaagcactccttgggtctgcaggacagcctggtcgccgctcacgcccgtcaggtcgaggtccgcgtcatggccttgccagagaaagagatcaacgctgaggtgcgggcaacactgaacgccctacgagcgcggctgccccacgtcgttctggtgcacaagatgcaccagaagattgtcgtcgtggacctgcggtggactttcgtcggcagcatgaacatcctctcgcaccctcgtcgaccggcagagggccgccacgaagtgatgatccagatcgacagcgcccgcttcgcccgccagatcctgtccttcgagctggccgaccagatgcgtaacccaccacgctgcgagacctgcggcaacaccatgaccgaggccaaagaagctgggaggtcacccgatcggcgttggctctggtactgcggtcgaatgatcaacggtgaaccgtgcccgcagacactggagttccctgaacgcaccggccgaaatcgcgccggttcagccccactcaagcgcaacagcacctcgtga

SEQ ID NO: 3050 - DNA, 132 bp, Actinoplanes utahensis
atgacgccggaagacctcgccgacgccgcgatcgacctggccgaggaaggcatgccgcgccgcgagatgccgatcgcagcggtcttcgagatgggcggggagatcatcgcctcgcctacaccagaaccataa

SEQ ID NO: 3051 - DNA, 1092 bp, Actinoplanes utahensis
gtgaccgacctcaatgaggctttcggtgccgtgcccgttctcgcctataccgatcacgagcgctacggtccgaccgtccaccgctccgtgcctgagtggattcagcgtgaagtgacatccctacgggtgcaggccgggcatcgcgttctggaaatcggcaccggctccggttacagcggcgccctgctcgcccgcctgtgcggaccacgcgggcgagtcacgagcatcgacatcagcgaggaactcatcaaccgggcgcgcgcgatccacgccgaacgcggagtcaccgagatcgactgtcacgtcgccgacggcctggccggcttccccaccgccgcgccgttcgatcgggcggtcgggtggtgcactccgccgcggcttccccggacctgggtcgagcagatcacggatggcggccggatcgtcgcctccctgccaatcgcaccgctaccgtccaccgccttgatcaccaccatcactgtcgacgccgggcagccccgagtgcaggccgtcgtcggtggggtttacgcccagagcaccccggcgcccgtggacgacgccgtgaccgtgcccggccggtgggtcgactactgcgaccgccaaccggatccgtcctggatagccatcagctggcgcaccgaagatccacacaacagcggcgcccgcgcggccctcgaccggctcctcaaccccgggcacaccgaaacctacggcgacatggaggccgactggcggtcctggagcgcccacaccgccgccccgcccgaccccggtctgagcatggtgtcgctgcgcaatcagatccgcgggatcggccacaccaccgccacatccgcagccgtgatcctgaccgacggcacgatcatcgccgacacaccggactcggcgtcgctaacggtcctacgcgagtggctaatcctctggcagcaggccggccgccccaccgccgacagcttcattccccgactggtccccaacacgagcatcgactgccccggcggggacctacagctagccgtgcccgctgacgcggtgccagcgtcgcgggccgctatcccgcagccgcgcgccggccgggtggagccggcatga

SEQ ID NO: 3052 - DNA, 786 bp, Actinoplanes utahensis
atgacgaagcggttcccggccatcgtggcggctggcagtaacgcggtcgtgaaccgcaacggcacgggcgggcatccgcgacgagacacacagccgttgtgcgtgtccgggcttgacgtacgcggtaggttcgccgggtcctgtcgtcgtcggccggtgaagccgcggagcggtatgaatgcgctgcgccggaggacgcaatggatccgactgcctgggaggcgttgcatgccgatcgctgatgcggagatcgccgccgccgttgccgcctacctcgaccggtatcccgcggagaaggcgttgctggccgagccgatcgagctcctcgcccggggcagcaactttgcctctcgacgcaatttcgacttgcacgtgaccgtcggcgcgttgctgacccgcggcggcgaggaaatcttgctggtcgggcatcgcgcgtacgggattccgctgcagccgggtggccatctggagccgagtgacacgactctgatgggtgcggcagtacgcgagctggcagaggagaccggtatcgatccgaccacggtcactaccgcgtccgcgacgcccgtgtatgtggagttcggtcgggtccccgctcgaccgcagaaggacgagccggaacatttccacctcgacctgggatatgccttcaccaccacaggcgacgtgggcagcctccaggagtcggaagtgacgagcgcggcctggtaccggctggacgaggccgaacgcctggtcggctcccgcgtctggcgagcctgcaacccctcggtccgcatcggctga

SEQ ID NO: 3053 - DNA, 162 bp, Actinoplanes utahensis
gtgatacggatcaagggcacggctctgttcgggccggtcattacgccggcgccgcgcggcgaggctgcgggccggctgtgggacggcctggtgctgatcgccggcacggacgggttcttcgagctcaaacaaacgcggacccgtaaagcgtcgttcgagtga

SEQ ID NO: 3054 - DNA, 546 bp, Actinoplanes utahensis
atgacacgccgcctgatcctggccccgctgctgctcggtgcggtggtcgcgctgaccgcctgcgacagcggtcccgccaatcccgcagacacacccgccgccaaaaaggatcagcagatgcaggtcatgaaacgcaccgacgccgagaacctggccaagaagctcgccgagcaggtcgcatccctcgtcgggaaaccgctcaccggatggcgaacgagttcggctgcctgtgagaacaccgacggggtcgtcgcctccgacggccgatgggacctcagcacgggcggcaacgtcgaagtggcccgggacgaccaggtcgccaccctcaacaagatccgtgacgactggaccagccgcggataccagatcaccgagttccacctgctgcccgacggcgacaccggtggaagcacctcggcattggtaccggaatccggcctgacgatctccgtccaatcaaccgtgccgcggaccggcatagcgatcatcgtggtcacaccctgctacaagcccgccggcaacgaaaaccccgccagaggctactga

SEQ ID NO: 3055 - DNA, 1656 bp, Actinoplanes utahensis
gtggtgaccttcgcggatctacgcgacgcgcgcgttgaccggcttacggtcgcggccgacgtctggcgtcagctcgccggcaagtgcagcaagcttgaagaccggactgagctggagttgtccaagccgttgcagaacggggcctgggaaggtgcggcggctaccgaagcgctgcgccggatgacgtccctggaagacgagttcagcctgtaccggatgaaggcccgcagcatcggcatgctgttggagcgaatcgccacggacttccagggcttgcagcagcggctccagtccgcgatcgacgcggctacctcgctcgggttgacggtgaccgcggacggtcgcgtccaggccgatgaggtgccgcaatccgccctgtcggatcctggcgcgctggaggtcaaccggctcgcgaaccagaacgccgacgtctacaccgaggtgatcgcctcgatcctcaaagatgccgaccacatcgatctcacctacgccggcatgctgcgcgacttcggccccgacgtccaaggcccgaacgagttcagctggcagcacaccaccgacgccgctcgcgagcttgccgggctgaacggactcacggcagacgacattaccgccgccggcaccaacccggcccaggccgccgcctggtggcacggcctcaccgccgaccagcgcgaactgctatcgatggcctaccccgccgaggtcggccgcctcaacggtctgccggcaaccgaccgcgacaccgcgaaccggctagccctgcacgaactgatcgggcaaggcgtgaaccagcgcgtcgacccgaacgatccacagcatcaacgcctggtcaacctgatgaaccggctcgacgccgccgactaccagaccggcaaaccgctctacctgctgtccatcgacaaccagggcaccggacgggccgccgtggccatcggtaaccccgacaccgcccggcacaccgccatgctcattcctggagtgaccaacaacctcgacgggatggttgaccagatcggccgggccgaccacatccgcgacgcagccgaactgctcggcgcgagcgacgtctcggtcatcgcctggctccagtacgaccctccgcagctcgacgactccatcgtcaccgcagccggctccgaccgggcgcaggagggcgccaccaacctgctcgcgttcaccgacgggctaagggtgagccacgatgccgggccggtgcacatgaccgcgatcggccactcctacggatcggtggtagtcggcgacgccaccagtggcggccaccggctggccgtggatgacgttgtcgtggtgggcagcccgggcatggacgtgcaccgggcctcggacctgagcgtcggcgcagaccacgtctgggccggcgccgcccccgacgatatggttgccagcccggacaccgccattccgttggagaccggcattccggtggccggcgacggcgtacaggccgcgatcaggttgaagcacggcgtcgaaccgcatctgccagaattcggtgcgcgggtcttcatgaccgatacaccagggcacacctcctactggcaggccgggtcacagagcctcaagagccaggcatccgtcgtcgtcggcgactacggcaacctgatccctcgatacggaaagtttccctcatga

SEQ ID NO: 3056 - DNA, 306 bp, Actinoplanes utahensis
gtgggcgacgaactgcatgtcgagcccgccgtgctgcattctgcgcggcaggtgtgcgaggacttgggagtcgcgtggagacgcgatgaacacggtgtcgaaccggttaccgaggacgccgccgccgggttgccgggctggatgaccgggcgggcgctgggagatttcgtctggtactggcaggacgacgtcaagaagctcaccggctatctcgaaaccttcggcgacgcgctgcagcgggctgcgctgacgtatgagcacaccgatcacgccagtgccgatctgttcgacatccgggggcgctga

SEQ ID NO: 3057 - DNA, 255 bp, Actinoplanes utahensis
gtgcggctgtccgtgggccggcgcgggcagtgctgggacaacgcggtcgccgagtcgttcttcgccacgatcaagacagaactcatccaccgccagacctggccgacccgcaaggcagcccaccaggcaatattcgagtatgtcgaagggtggtacaacacccggcgtcggcattccagtctcggctaccgcagccctgccgcctacgagggcggtgccgccatcagcctgctacccgccctcaaggtagcctga

SEQ ID NO: 3058 - DNA, 555 bp, Actinoplanes utahensis
ttgccgcaggacgtcgacatcctcaaacggacggccttttttcgcgcgggagacccggtgaacgtgtatccgttcatcgaggcggagcagaccggcaagcacaacgtcaagcgtgcgtgtgagctgctcaaggtctcccggtccgcctactaccagcacgcccgcggtgaacagtccacccgggaccgcgtcgacgcccggctgaccgagcagatcatcgcggtgcacgcggcctccaacggcacctacggggtgccgcgcatccacgctaagctggccgcggccgggctgcgacatggccgtaaacgcgtcgcccgccggatgagggctgccgggatcgccggcaagtgcccgcgccggtggaagaccaccacggtcgcggatccgcacgccggcgcccgcccggacctggtcgaccgcaacttccgggtggacgccaccgcggtcgatacccgctggtgcggcgacatcacctacatcaacacgtgggagggctggctctacctggccaccgtcatcgacctcgcgtcgcgccgggtggttctagctagctag

SEQ ID NO: 3059 - DNA, 174 bp, Actinoplanes utahensis
ttgtccagcatcatggagagcgtgggaaagaagcggtcgaggccgcggcgggcgttcacgcccgagttcaaagccgagatcgtggagttgtgtcagcgtggtgaccgcacggtggggcaggtcgcgagggatttcgacctgaccgagacggcggtgcgagcgtgggtcaagtag

SEQ ID NO: 3060 - DNA, 354 bp, Actinoplanes utahensis
gtggatctgcagttgtcagcgcggacaagtggggcgtgcaccgtggtcaaggtcggcggcgaagtcgatacggacactgtgccgcagctggaggcctttcttcagcaggtcgcggacggtggcggcgtccgggtggtgctcgacttggccgacgtgtcgttcctggattccagcggtctgggcgctctcatcgtgtggttcaaggagttgcagagcagaggcggtcggttgtgcgtcgccgcggtgcaggacctcgtcgcttacgtgctgcgggtggcggcggtggatcaggtggtgaatgtttacgacacggtggaggccgccgaggcgggcatgccgccgtcgacggcgtga

SEQ ID NO: 3061 - DNA, 465 bp, Actinoplanes utahensis
atgccgttgatcggcgtccttgtcacgctggtcggctacctgatcacgaacatcggccgtcctgtccctggcgtccgctacggcgtcgcgccggtcgccatcagccacgcgtcgatctgcggcgtcgtcgcgttgatcgcttcgccggtcgcgcctgccagccgcggaatcccggcagtccagaaggaactcccgccggtccgctgcctggtcccgctcatcagcgcgcgccagccggccctgcaggtcgatctcccgctggtcggcctcggcatcacgccgatccgccgcctcctcccgaccagcgaggtagcgctcgcgttcatccagaagccgccgccgttgcgagtcggccgatccggcgttcatcacctcaccatggagcgggatggcctgaactccactgggcaccgcttggccggcatgtggaccgggtgggctgtcggatttcgagaccggatttga

SEQ ID NO: 3062 - DNA, 1857 bp, Actinoplanes utahensis
atgggctggctgtcgaagcgtcggctcgcaaggcgcctcctggtcaacgcgatcaccatcgcggtgttggtggccgtcgccgtattgggctactcggtgtcccaccgccaggagaccatggccgggcaggcacgacaggcgcagcggttggccgagtccgcgcagcaggtgaaattccgggcggccgacttcaacggctggcagacggcatacgcattggacatcatccgcgccgtaccgggggccaccgccgacacctcacccagccgtgcgaagttcctcgacgcggcggcgaaattcgacagcgaactggacgccctggaagtgctgtcggcgtcgtccccgtccgcacggaccgtcgacgccgtcagggaggcgttcgaagccttcatgaccctcgaccggaccgtcgtgacgctgtaccgcagcggcaagccggccgaccgcagggccgcctccgaactcgtcctcggccgggagatccagctctacgggcagatcgccaacggttgtgacgccaccgccgcgctgtcggccgcggcggcggacaccagcatcggccgtctcgacgcggtgggagccgccatccggcgctacatcctgatcctgagcatcgtcgccgccgccctgacggtgctcggcgcgatcctcgccgaagcgcgacaacgggcgatcgcgcagcaggccaaagaggctcagcgaatggcgagcctgggacgtctggccggggggataacccacgacttcaacaatgtcctcgccatcatcctgaactacaccgacttcgtcgccgaacacgcttccccggaggcactcgacgatctcgcgcagatccgcaaggcggcgaaacgggcggccgggctcaccgcgcaactgctctgcttcatccggcacgaggccatccagccgcagatattcgacatcaacgccgcgatcaacgaagcgcacgccatgctggcccgcactctcggcgaacacatcgagctggtggtgatgccctcgcccgagccgctgaagatctgcgcggacaccggccagatccaacagattctggtcaacctcgccgtcaacgcccgtgacgcgatgcccgacggtggcaccttggtgatcgcggccagcgccgtcgacctcgaggagaaccaggcgaacgtgcacccgccggtggcggccggacgttacctccagcttctcgtcaccgacaccggtaccgggatgtctccggaaacggtggcccgcatcttcgagcccttcttcaccaccaagccgaaaggccacggcacgggactcggtctcgccaccgtcctggacatcgtcatcacggccggcggcagcatcgacgtctgctccaagctgggtatcggcacgaccttccggctgtacttccccgccgtcgacgtgccgtacggtcaggaatcggaaggtcgcaacgatgtggcaccgccgcgtggccacggccagagcatcctgatcgtcgaggacgaaccggccctcggcaccagcgtcgctcgcatcctcgccgccggcggataccaggtccggtccgccgtgagtggtcccgacgccctggccgcatacgcggacgacggctgcgatctgctgatcgccgacgtcgtcatgcccgacatgtccggctcccgcctcgccgagatcctgcaccgcaccgaccctcgcctgcccgtgctctacatatccggttacatcgacggcaacctcggcgccaaccgtctgtgcacacccgagaccagggtgatcgaaaaaccgttcaccgccgaccagctgctcgtcgcggtcggcgacgccctttccccggctcccgacgagaacggcatcaccggcggtcggccacggccggtctga

SEQ ID NO: 3063 - DNA, 1818 bp, Actinoplanes utahensis
atggccgtccacgtgggaaaacagcagggggtgttccgcttgcgggaacgcatctaccgccgattcggaaggtggagcaatcggcggatcgcggtgatcggcgcggggatcgtggtgctcggggcgctcggggtgggaaccgggatgtcctatgcggggcagaacgatgccggggccgagccgaatacgaactgttcgctgctcgtgccggcggatccgctcagcgctgcggggctggcgacgccgtacgagctgtcggggaccgggcgccggcgcggcgcgtgccatgaggcgaatcctgcccaggccgcgtttgtgcaagccagcgtggtggatccggcgaccggcaaggtcagcgtctacaacccgttggtgatcgacaaggggacgcggccggtgctggacccggtggtgccggtgctgccgaagaacgcggtggtggggatctggttcgggttcaacggggagaacctgagactggtggactcgcacggcagtctgcgcggcggcgcctgcgtgaacggggtggacggctcgctgttctcccagttcgcgtactgcaatgcgccggcgttcttcagcgcggcgcacacggcgatccgggccggcaaactgaaggtaccgccgctcggcaccggccgggacgggaagccgtgcccgacgacgcgtgacttcaccgtcgtggaccaggaccagagcgacaacgtgacgagcgcgtacctgatccgtggcagccatgtcgcgcaggacaccgcggccaaccgggcgcggctgcggcatgcgccggtactggtcaacggcagtgacaacctgctgctggtgcacttcgtggaccaggcactgggctgcacgccgttccaggcgccggacctggccgacaacggcacgctcaccacctcgctggcgctcaacgagttgcaggcggccgcgaaccagcgggatccggtcgcgctggtgccgccgaacgatccgatggccgaggtggacgggcgcttcgaccggacgaagctgaacctgtaccggcagggtgtcggcatgggcaccgtctccgggactcgggggctggcagcgccgtactgtcagcaattggttgatctggcgccgagccggttgcgcgccgaccgccgcttcacccagaagatcgcgtcgccggatccgggggtggcgaccaacctgttcaccttcctcgcgcagcgactgagcgggtcgtacggcaatctggggtgcgaccggctgatccggtcgccgaacccggtgcggctgcgaacccgcgacggggtggccgtcgacgcgtcgttccccggagcgaccgggaccccgaccgcgaccccgtcaccgaccgccaggcagacaccgaccgccagcccgtcaccgaccgccaggcacaccatgaccgccagcccgaccgtgaccgccagtccgaccgtgacggccggccgcaccatgaccgccaggcagaccatggccgccagcccggccccgagcagcgcacggcccagtagtgccaagcccggcagtccggcttccggcagttcgccaccgggcccgagcgagagcaccaccgtcccggacgacgcctccccgagtatcgagacggtcgcggccgacaactacacctactcgaacgacggcggcgcgcccaaggtcaccgcaccggaagccgccgccctgccgcccacccggaacgtcagcttcctggcccgcaccggcggcggctcgatggcgctgatcgccggctcggtgctgctgaccctggtcggtctgtcggtgctcgccctccttccgcgccgccggaacccgggcacgtactaccggtga

SEQ ID NO: 3064 - DNA, 858 bp, Actinoplanes utahensis
atgcgagagtcgtccggacatccggctcctgccaggtctgcctcggtaacggtcgaggcccttctggcgcggcgcggtcgcatccaacagggcctcatcgacgcggagatacgcgccacccggcgggcgatcctgacccagttccgcctgcgcctgcgtgctgacgtgggcacgctgtccagcaccgccttcctcaccctggccgatgagcccgccgtccacaccgccatcatgatcgcagtcagcggtgtcgcccgtccggatgcgctcctgctgcacacctgtgctccgggcgcggctccgctgcggctgacacggcaccgcggcctgccggaatccggcccgcatcaggtcgcccggatcggctcggcggtcgcctccgtcgtcccaccggagggggacagcgccggcccggtggtggtccacgatctgagcgccgccgtcgtcggcgtgagccggttggcgacgcggatgctgctcgatgcgggattccgcgcggtgcagtgctacccgatgcgtgatggggacggaccacggctcgggctgttgtcactgctgtaccgctcgccggaccggtatcccgtccaggagtcgctggcccggcatgccggcaaggcccttgcgcatctgagcgagacgagaatcgggacatgtccggtggtcgcgccgtcggccttccccggacccccggcttcaccaccggatgcagcgtgcctctccggtcttctcgcggtcgaaccctcaaggccgggagcgaagcggtcgaaccctcaaggccggggagcgaagcggtgggccggtgaacgaagcggccggctggccggcgttgacggcaagccgctcagcggagctcgatga

SEQ ID NO: 3065 - DNA, 243 bp, Actinoplanes utahensis
atgacacccgtgagcctggattccgacttcaccgggacgccgggccagcgggcggccgcctgcctcgccttcgctgcacgcgcgcgtgcccgagccgaccagctggaacgtaccgcgcagacgctgatcgaccgggccgcggtcgcccaccgggccgccgaggatgcgtccgcgcgggtcaccgggtcgtaccccgcggcgcggcgtcagctcctcaacgtctcgctcggggacacgccgtaa

SEQ ID NO: 3066 - DNA, 573 bp, Actinoplanes utahensis
atgccggccgcacagacccggtttcacggcatcacgccggtttcggcgtcgatggcccgatactggcggtccctgatcgccctggtcagcggggccctgagcgatccggtgtcaccgttgaactcgccgctgctcgccgaggacctggcccggacggtggcaaccggcgccctgcacgtcttcccgaacacgaccatgggccggcagcatgtgcccggtccgggcgccgtcacgccgggcgccgtccgccgcgccgtcgccttcgtcgacgccgacgcccacctgcctgtccagctgagcgagatcgcggcggcggccgggaccagcgcccgtgccctgcaatacgaattccgccggcacctcggcaccaccccgctgcgatatctgagccgggtgcgcctcgagttggcgcgccaggagctgcatcgcgccgacccgacccgcggcgacaccgtcggcgccatcgcggcgacaccgtcggcgccatcgcggcccggtggggtttcgccaacaccggccgtttcgccgcggcctatcgagccgcttacggcgtgtccccgagcgagacgttga

SEQ ID NO: 3067 - DNA, 204 bp, Actinoplanes utahensis
gtgatcggcgccgaccgggtgcggacgtccatcgattacggcggcaccagcggtacgggtttccacgactacgtgttcttcgtggtgcacaccggcagcgtgcagatcgacagcccgctcggcgggaccgtcgcatccgctgctgacgtcgcgttctatccgctcgggttccgatcgagttcgacatgcaccacttcgacgtga

SEQ ID NO: 3068 - DNA, 285 bp, Actinoplanes utahensis
atggacgtccgcacccggtcggcgccgatcaccggggtgtcgtgggtcagcgccgagaagcgcgcgccgttgcggaccggcgcgaagcgggacctgttctccgcctacatctgccggatgaattcggtgacctcggcttcgtcgctggacgagaacgacgatcgttgcacgagaccgggctgggacgtcgacatgagagcctcccgccctgaatgctacgcagccgcggcgtcaccggaagggggcgtgcacgatcgggttacccgccggaccggcgctgggtga

SEQ ID NO: 3069 - DNA, 882 bp, Actinoplanes utahensis
atgcgcgtgggtgaactggcccgtcggaccggcacgacgattcgggcgttgcgttactacgagcaggtggggctggtcgtgccccgccggctcggcaacggttaccgggattacgagccgatcgccgagcggcaggtcgcccagatccgcgagctgacggcgctcgggctcaccgtcgaggagacccgcccgttcgtcgagtcgatcgccaacgacgacgacgtctgcgccgccgcggtggccaccttccgcagtaccgtgaccagcctgcagacgcgcatcggtgagctgaccacccagcgggaggccctcgacgcccggatcgacgccgccgcgcaccggatcgtcgccggcaccccggtcaccggcgggccgccagccggtctgatcggccgacgcctgccggagctgcacttctacgccaccgacggccgcccgctccgcctggaccacctcgggccgggacgcagcgtcatcttcgtgtatccgctgaccggtcggcccggcgtcgacctgccccgcagcctgctggagatccccggcgcccggggtcagggcgactggctgcgcgaccaccacgccgagatccgcaccgccggagcggcccgcgtcttcggcctgtccgcccagtccaccggttaccagcgcgaactggtgcaccggctacggctgccgtacccgttgatcccggacccgaagctcaccctggccgccgccaccggcctgcccgtgcacaccaccggtgacctcgccgtctacgagcggctgacgctcatcgtccgggacgatcgggtggaacacgtcttccacccgatccccgaccccgcctcgcacgccctgcacctgatgcggtggctcacccagcgccggtccggcgggtaa

SEQ ID NO: 3070 - DNA, 1275 bp, Actinoplanes utahensis
atgacggcgatcagccgggtgatcggacggcagatcctcgacagccggggcaacccgagcgtcgaggtcgacgtggtgctcgcggacggctcgtccggccgggcagcggtgccgtcgggtgcgtcgaccggggcgaacgaggcggtcgagctgcgcgacggtgacccggaacgattccacggcaagggggtcagccgggcggtggccgcggtcaacggcgccatcgccgcggcggtgaccgggctggaggccgaggaccaggcgctcgtcgacacgacgatgatcgatctcgacggtaccggggacaagggacgcctgggcgcgaacgcgatcctcggggtgtccctggcgacggcgaaggccgcggcacaggcgcaccggcagccgttgtaccgctacctcggcggggccggcgcccggacgctgccggtgccgatgatgaacatcatcaacggcggcgcccacgccgacaacccgctcgacttccaggaattcatgatcgcgccgatcggcgcggagaacttcttcgaggccgtacgcatcgggtcggaggtgttccacacgctgcgtcgccggctggccgcggccggccacagcaccaacgtcggggacgagggcggattcgccccgaacttcgccgacgccgacgaggcgctgcgcttcgtggtccaggccgtccgggactccgggtaccggcccggcatcgacgtcaccatctgtctcgacccggccagctccgagttctaccggggcggcgcctacgagtacaccggggaaggccgcacccgcacggctgacgagcacatcgactacctgttggagctggccgcggcgtacccgatcagctcgatcgaggatccgatggccgaggacgacttcgccggctggcgcaagctcaccgcgcaggccggcgaccggatccagctggtcggcgacgacgtgttctgcaccgacgcggatcgcctgcagagcggcatcgacggcgggtacgccaacgcgatcctggtgaaggtcaaccagatcggcacgctgaccgagaccctccggaccgtcgagaccgcgcaccgggccggctaccgggtggtgatctcgcaccggtccggggagaccgaggacaccacgatcgccgacctggcggtggccaccaactgcggccagatcaagaccggctcgctgtcgcgcagcgaccggaccgccaaatacaaccagctcatccggatcgaggagcagttggggcggtccgcccgctacggcagcgctacttcttcccgctga

SEQ ID NO: 3071 - DNA, 612 bp, Actinoplanes utahensis
atgcaccgtgttctcaccgcatccctgatcgccgcgctcggcgtgtcactcgccgggtcgcccgcggaggccgccgcgctcggcgggtcgcccgcgcaggccgccaagcccctcgacgtggtaaagaaggcggtggccgcccggatcgacaagcggctcgacgccctccggaaggacgccgccgcgctcggcggggccaagcacctgcaggccgcccacaagcaggcgttgcagcagctcatcgacggccagtcggccggcctgaccgcgttgaagtccaaggtggagggcgagacgaccgccgcggggctgaaggcggacgcgcgcagcatggtggtcgactaccgggtgttcatgctgaccgggccgaaggtgcggctgtcggtggcgatcgacgccgagctggccgccgcggaccggctgcacgaccggcccggcgccgacgacgccaagctcgacgccgtgcagaagtcgctggccggcaaggtcgacgcgttgctcgcgatccagcccggtgcggacggtgcggcggtgcgcgcccaggtcacgacgatccgtacgaccgcgaaaggggcccgcagcgacctgaaggcgatcagcgggaagaagtag

SEQ ID NO: 3072 - DNA, 198 bp, Actinoplanes utahensis
gtggtcatgaagcgaaccctggctgtcgcgctcatgctcggcgcgctgatcaccggcggctgcgaccgtggcgcgccacgggcgacgaacccgccggctccggcggcgacgcaggccgatgacggcgtcgactcgctcctcgacgacgccggcacccagctcagccacgacgatcaacccgctgaagacgaggattga

SEQ ID NO: 3073 - DNA, 1158 bp, Actinoplanes utahensis
atgctcggacgatcaggacggcgctgggcgcaggtcgccatggccgctgccgccggcggcgcgctgctgctcggtgccgctgcccccgcggccgccgacgagcccaccaccggtgttccgtcgcggatgaccgacggcgccgtcaccctggtgctgggcggtaaggcccactcggtcggtggcatccagttcaccatcaagggccagaccgtcccgatcttctgcatcgactaccacaccgggctcgcggcgaacgagccgtacaccgagggcacctgggacgagtccgaggtcaaaaacctcaccaaggtgcagtgggtgctcgcccacggctacccgaacggggacatcaacgccctgctcaccgccgcccacgtgcagatgccgcagctggacgaggcgcggcagcgcaagctgctgtacttcggcacccagaccgccgtctggcacttcagcgacggcatcgacctgggcgcgtactccgacggcgcccggctcaccgacaagccgcagtacgacgtggtcaagggcatctacgactacctgaccaccaacgcggtggaccagccggagccggccgcccagctgaccgtcaccccggccagcgccaccgccaaggccggcgagaaggccggcccgttcaccgtcgcgggtccggccagcgcgatcagcgtctcggtcaagggcggctccgcggtcgacgccgacggcaagccggtcaccagcaccagcaacggcggcaagttctggctgaccgcggccgacgccggcaaggccaccgtcaccctgaacgccgaggactccgtctcgttcggccgggtcttcctgtacagcggtggcaaggacaagcaccagaagctgatcctgggttccagcatcggcaagccggtcaccgcgtccgccgaggccaccttcaccccggccccggtcaccacgaccaccgccgcctcgccgaagccgtcggcgtccacctcgaaggcctcgcagagcccgtcggcggccgtcccgggcgccagcaccagcccgacgtccggtggccacctggccctgaccggctcggccgccagcacggtcgccggcggtggcgtggtcctgctggtcatcggcggcctcgcgctgatgctggtccgtcgtcgccggacccgcttcaccagctga

SEQ ID NO: 3074 - DNA, 3018 bp, Actinoplanes utahensis
atgtcatccacatcggcggaccagcgcaagcgggacgcccagcgacaatggggcgccgaccggcggactgatcctcatccgatcgttccgcccccggtatccgaaggcaggatcacccggggccggctcgctatcgtggtgaccatcacggtgtgggccggttacatcgcctatacgattttcgagcaattcatcgtcggtaaggcgtacaacgcacggctgggtgccgaggcgatcgcctatatgctcgtcatcaccggtctcgccgcttccgcaatcgcctacctgatcacccggatcggctacttctatcgtggccgcggtcaccagcgggcgccacggatcatgctcgacgagttcatcggcggcaagaccccgtccttgacggttttggtgccgtcatatcaggaagacgagcggaccaaccgcagcacgctgctctccgccgctctgcaggaatatccggggctgcgggtcacgctgctgatcgacgacccccgggcgccgaagacccgggccgcccgggacatgctgctggccgcccgggcgctgcccggcaagatcgaggctgagctgcaggttccgtaccggcgggtggcggccgcgttcgcggccttcgacgagcaggtgcggttccgcggcggccatctggtggtcccggacgacatgcgccggctcgccgacgagtaccggttcgcctccgactggctgtacgacctgggcgcccggcaggagatggtcgaccacaccgacaccttcttcgtcgagcacatcctgcacccgctcgcggtcgagctgggccagatcgccggcgcgctggtcaagggtgccgacgagcaggtggcactgccgctgccgcggatgaaccagctgcacaagcggctcctcgcgatcttcgacgcgcaggtgaccagcttcgagcgcaagaagtacgtgtcgctgtcgcacgagccgaacaaggcgatgaacctcaacagctacatcgggctgatgggcggggcgtaccaggaggtcaacaccccgctgggaaccgcgctggtgacggccgggccgaaccgggctgatctggtggtgccgaacccggactacgtgctgaccctggacgccgacagcgtgctgcttcccgagtacgcactgcggctggtccacctcatggagcagggggcgttcgcgcagcatgcggtggtgcagacgccgtacagcgcatatcccggctcgggcacccgggtggagcggatctccggcgcgaccaccgacattcagtacatcgtgcaccaggggatgacccactacggtgcgacgttctgggtgggggccaacgccgtactccgcaagaaggctctcgacgagatctgcgaggtctcgtacgagggcgactgggagatcaagcgctacatccaggaccggaccgtcatcgaggacaccgagtcgacgatcgacctgggtgtccgcggctggaccctgcacaactacccggaacggctcgcctacagcgcgaccccgccggacttcggctcgctcgccatccagcggcagcgctgggccaacggcggcctgctgatcctgtcccggctcaaggaccagttcaaggcgaagagcaagcgcgaggacaagaaccggttcggcgagtacttcctgcgggtcaactacatggcgtccatcttctggagctccatgtgcctggtgatcatgctggtgtacccgttcaacaacgagctgctcaacccgttcctgctgctcatctcggtgccgtacttcttcatgatggcggccgacctgaagcacctcgggtacaagcggaccgacatgctgcgcatctacggcttcaacctgatcctgctgccggtcaacctctccggcagcatcgcctccctgctgcagctgctgaccggcgagaagagcgcgttcaagcggacgccgaaggtccgcaaccggaccaccaccgcgaccagctacctgctcctgccgctggccctggtggtgctctgcctctacacggtgtggcacgacgtgcggctgcaccagtggaacaacctggtcttcgccggcctgaacctggtgctgtcgctgtacgcggtgatcgccttcatcggcctcgggaacaccgtcgtcgacctggccacccatctgcgggactggctggtgccggtggccaccccgaagaaggtccgcaagtcctcggcttcgaagaaggccgccgcgcccaaggcggcggcgatcggcgactgggccaccgtgctgcactaccggcacgagaccggcgccaccgccgggcaggtcaccgtgcggctgcagcgcaccgacaccggcgcgtggaagaccgacaggcccacctcggcgagccgggcgcacctgttcgaggagttcagcttcttcacggtgttccagccgatccacaacatgatcaacgggcacgtggtcgggtacgaggcgctcacccgcttcgccgacggcagcaacccgcgcgagggtttggaggcggccgcccagcgcggcgtgcacgtcgccctggacgccgcgctggtccaggcggccatcgcgtcgtcgtcgtcgctgccgaacggcacctggctggccgtcaacgtctccaccgacctgctgcgccgcccgcacgagctggcgccgctgctcgccgaggccaagcgtccgctgatcgtcgaggtgggcggcccggtgccggccgaggtcgggcagctgggcggaaccgtccggctcgcggtcgacgacctggggttgggctacgagacgctggccctgctcgaatcggcccggccggcgttcctcaagctgagcctggacacggtgcagaacctggagaacgagacggcgcggcaggcgtcgatccggaccctggtggagttcgccgagcagcacggctgcacgatcatcgccgagggcatcgagacggccgcgcagcgggatgcgctggtggcctgcggggtgccgttcgggcagggcttctacctgggcaagccggtcccggtggagcgggtcctggccggcgtcggcggctggtga

SEQ ID NO: 3075 - DNA, 1605 bp, Actinoplanes utahensis
atgacggaccgcgccacagccgtagccgcgcgaacgggtatcgatccgctcgccgacccggattggcaggaaccggagcagccgcgccgccggctgtcgtggacgaggctgggaatgctggtgctcgcgctcggtgcggtcggcgccggcggcaccctcggcgtgatgcatctgcgggacacctccggtccgaccgcgaagtcctgggcggtgccgtacgtcgacgtcacgctgaccccgaccttccagttccaggacccgaccgcgaacccggccaagaacgtggccctcggcttcgtcgtcgccgacccgaagagcgcctgcgcccccagctggggcggcgcctactcgctggacgcggcggccacctcgctggaactcgaccgccggatcgaccagttgcgccaggccggcggcgacatcacgctgagcctcggcgggctggccaaccaggagctcgcggtggcgtgtgccgaccaggccaagctcaccgacgcgtaccgccaattggtgaaacgctatgacgtgaagacgctcgacctggacatcgaaggcaccgccgtggccgaccaggcgtccctgcagcgccgcgtgacagcggtcgccgcggtgcagaaggagcgggaggcggccggcaagccgctcgccgtgtggctgaccctgccggtgacgccgaacggcctcaccgacgacggggtcggcgtggtccgcggcatgctcgacggcggtgtcgcgctgcgcggcgtcaacgtgatgacgatggacttcaacaacggcgacagccacccgaacatgctgggcctgagcaccagcgcgctggacggcacccacaagcagctcaccgacctctacctgcggctcggtcagaagctcacctcgccgcaggtctggtcgcggatcggggccaccccgatgatcggccagaacgacgtcgacgccgaacggttcaccgtcgacaacgccaccggcctggccacgttcgcggtcgacaagggcctcggccgggtctcgatgtggtcattgaaccgggacgcgccctgccgcggcaccttcgccaacgtggtcgtgcactccaacacctgcagcggcgtcgaccaggacgcgctggccttctccaaggtcttcgccggtctgcccggcaaggcggccggcagcagcagccaggactcggtggacatcccgaaccaggcggccaccgtcgacgacccgaagaccagcccgtacccgatctggcgcctgaccgccctctacaccggcggctacaaggtggtctggcacggcgtggtctacgaggcgaagtgggccaactcgggcgtcgacccgtccgccgcacccgccgccggcacgcagaacgcctggtcggtgatcggcccggtgagcccggtcgagaaggcccccaagcccaccccggcggtcaccggagtcaccaggatctggaccccgggcaccgcctaccagcgcggcgaccgggtcctgttgaacggcctgccgtacgaggcgaagtggaccaccaagggcgagaccccgtcgaccgagttcccgatcgacgccgacgacccctggcacccgctcttcaacgtcccgggcgaacccaccaccaactga

SEQ ID NO: 3076 - DNA, 138 bp, Actinoplanes utahensis
atggtccgcgcccgatcgcgcgtcgcggacgtaccggccgggacatcaccacgccacccggcacgaccctgccgcgccggccccttcctcgacgtcttccgcttcctcctgcgcatcctgcgcggcgccgaccgctga

SEQ ID NO: 3077 - DNA, 666 bp, Actinoplanes utahensis
atgaagaagtacgacacccgcaccgccatcgccgccgtcatcgacatcccggccggccgggtccaggtcatcgccgccgaccgcaccgacaccgtggtcgaggtccggccgctggacgccgcgaagagccgcgacgtcaaggtcgccgagcagaccgcggtcgacttcaccgacgggatcctgcggatcgtcgccgaggcgaagaatcagatcttcggggcttccgggtccgtggaggtgaccgtccagttgcccgccggctcccgggtcgaagtgcgggcggccagcgccgagttccgtggcgccggccggctcggcgacgtcgtccaccgcggcgcacacggcgcgatcaagctggacgaggcggcgagcgccgacgtcagcaccgacgccggcgacgtcaccatcggacggctcaccggggcagccgagatcaggacgcagaagggcgacatccggatcgccgagacctccggcggcgacctgacgctgagcacccaggccggcgacatcaccgtggacaccgcggcgggggtctccgcctcgctggacgcgggcacctcgtacggccggatcgtcaactcgctgcgcaacgccggcggcgaggtcgaggtggcgatccgcgccaccacctcctacggcacgatcaccgcccgcagcctctga

SEQ ID NO: 3078 - DNA, 2193 bp, Actinoplanes utahensis
atgcaacgccgttgcaatggaatagcggtgaacgctacgctgagccgggaccggggagagggagtgcacgatgccgggcggcaggctcagtcagcaggaacgtcatcagatcgcgctggggttggccgacggcctcgcctacgcggagatcgcccggcggctcgaccggcccacctcgacgatcacccgcgaggtgctgcgcaacggcggtccggccggctaccgcgccgacctggcccagcacgccaccgagcgccgcgtccgccggcgccggcagtccgccgcccgcggcccggagacaccggcgtcgccctccggtcgcgacgacgccgccatccgggagtacgaggagtccttcaccgccgtcctgatggcctccggcctgccccggatggtggcccgggtgctgacctgcctctacacctccgacaccagcccgaccgccgccgacctggtcggccgcctgcaggtcagcaaggcctcggtgtccaaagcggtcgccctgctggagagtctcggcctgatccgccgcgagcgcgacaaaagtcgccgggaacggtacgtagtcgacgacgacgccctctatcagtcgatgatcgccagcgcccgggccaacgaacggctcgcggtgaccgctcgggagggggtgcgcctgctcggtccggacacgctttccgcggcccggctggagaacatcgcccgcttcgccgacttcgtcggggagagcatcgtccgcgccgccgaacaggcccgtgccctgctctccaccaggccaccggccgccggctgaatggggcggcgcgggctcgcacggcaggagcacaatgcaggcgtgacgagagaaacgctggtcggccggatcggaacggtgatcaccgcgatccgcggcggcgagcgtgcgggggaggtgcgtctggtggtcgccggtatcgcgcactactacctcgcctacgcggccgcacccgttcctcccggttccgaggtgctcgtcatcaatcaccgtggcgcacgccaaatcgacgtcgagccatggcccatcgaagaagggctgtaggaatgttcggttatcgggtgcccgcccccaacgaggcgctgctcatcagcggtcggaaacagcggggtgcggacgcgttgccgttcaaaatcgtcaccggacatggcgtcttcgtcatgcccgtcttctccaaggccacccgcctcacgctggcgatgcaggaggccgaggtggtcgaggactgctacaccaagcagggcctgaccctcggcgtgcaggcggtgatcgcgttcaaggtcggtgacgaccacgagtcgatcgccgcggccgcccgccggttccagggcgaccaggggcagatgcccacgctggtcggccggatcttctcgggccacctgcgcagcatcatcggcagcatgacggtcgagtcgatcatccgggagcagcagactctcgcggacgcgatcgtcgacgccagcaagaccgagatggcccggatcggcctcgccgtcgactctctgcagatcagcagcatcgacgacaagggtgtcggctacatcaaggcgctggcggcaccgcaccaggcccgggtcaaccaggaggcgcaggtcgcccaggccgccgccgaccgggagagcgcgatggcccagcaggagagcgcccgccaccaggcggagtactcgcggcagacggcgatcgccaaggcccagttccaggccgagatcgatcaggctcaacagaccgcgtcccaggccggcccgctcgccgccgcccgggccgcccaggaggtgctcgccgagcaggcgctggtcgcgcagaagaacgccgagctgcgtcaggcccagctgatcgccgaggtggtccgcccggccgaggccgaggccgagcggatccgcgccctggcccgcgccgaggcggatgccaccaagctgtccgccgaggccgccgccgcccaggaccggatcgccctggaccaggccatcatcgacaagctgccggagatgctccgcgccgccgccgagggcctgcagggtgccaacgtcaccgttctggacggcgccgagggcctgaacagtgtcgtcgcctcgctcgccgcccagggcatgaccatgctggagacgctgcgcagcggcatgcgccccgagccggcccagccgggcaacgcggtcgccccgatcaacgccaagtcggtcgcctga

SEQ ID NO: 3079 - DNA, 1863 bp, Actinoplanes utahensis
gtgcccaagaagaccacgcgtcgccgcatcgccagtgcgctgacgggggtgtcagtggcggccgctgcggtcgcgctggttcagcttccggcctcggcggctggaagcaccggcggaagtgcgctgctgccgccaattccggcgaacgcccgccacttcgcactgccctacgacaagatcccggccggagccgtgaaggcgaagaccggtccgctgaaggccggcaagcgcgccaaggccttccagacgccgggctcgaagacgaagatcgtcaacggtgacatcgcccactcggcggacttcccgggcgtcgtcggcatccagtccgacttcatcgccaatgacgccaacggcaacccggcgtggtggaccagcacctgcaccggcaccgttctcagcccgacccgggtgctcaccgccggccactgcacggtcgacctgccctacggctacacccaggtgatcgccggtcgggacaacctggccgacaacacctccggtttcgtcgcgcgggtctccaacacctggctgcacccgagctacaactaccaggcgcaggtcaccgacccgcagaacaccccgccgaagaacgacgtcagcgtcctggacctgaaggacgcgctgcccgacgtctacaaggcgaccgacctgatcgcccagggggcggccgacccggccgccggccaggacgcgaccatcgtgggttacggcatcaccaaggagggcggcagcgactccggcgtgctgcactccgcgacggtgcagacccagaaggacagcacctgcacccagccgagccagttcggcacccagttcgacccgacgacgatgctctgcgccggcgacgtggtcaaccacaaggacacctgccacggtgactcgggcggcccgatcttcctcggcggccccgcggcccgcgtcgagatcggcgtcaccagctggggcaacgtctgcggcggtgcctactacggcgcctacgcggctctgaaccagctctccggggcggtcaaggcgcaggtcaccaacctccagccgaccaacctggacttcaccggtgacggtcactcggacctcatcgtccgggagccgggcaccggctacctgatcgtcgcttccggcgccggcaccctggtcggcacgccgtacatcgacgagacgtcgtcgtacgacgtgggcttcaactactaccgctacctggacaagagccacaactacgaggcctactccaagctgttccgggtcaccaactggaacgcggacggcaacgagtcgatcttcggccgggaccggaacggcaccctgtggcagtggaagggtgacggccgcggcgatctggtctccaccacgccgaccaagatcggcagcggctggaacatgttcaccgacatcgtggtgaccaacaactggaacggtgacggccgctccaacctgctgggccgcaaggccgacggcacgctggtgatctacaacagcgacggtgccggcggctgggagaacccgcagggcacggtcatcggctccggctggaaccagttcaacaccgtgctgaccccgggctcctggctcggtgacggccaccagtcgctgatcggccgcaacgccgccggcgagctgtggctgtacaacagcaacggtcacggtggctggatcaacccgcgcggcaccaagctcggcaccggctggaacggcatgccgaccttcatgtccccgggtgacttcgacggtgacaacctggtcgacctgatcggtgtccgcaccaacggtgacctctacctgtacccgaccaacggcaagggtgcctggaagaacggccgcggcaagctcctcggctacagctgggactactacaaagccgtgttctga

SEQ ID NO: 3080 - DNA, 141 bp, Actinoplanes utahensis
atggtcacggtcaatccctaccgccgctggcgccgggccttctactacgcgaccgcggcggtcgtctgcgtgctcaccctcgccgccctgctgctgctggtgagcgtactgatcgacctcctgcacagcttcacgaagtga

SEQ ID NO: 3081 - DNA, 1485 bp, Actinoplanes utahensis
atgcccctgctgttcaccatcgcctggtatctgctcgtcggggccgccttcctgatcctcggcatcccgctgatcatcatcaccagtggcgtgatcctcgtccgctgcgccggcgcctacctcaaggccagcggccaggcgctgggcgtgcgacggccggacgcctccgtcccggtgcccgagccgcgggacgtgcccgcccacgtccattacctgtccgggccggccgggcgtgacctgcagcaggtcgccctgctcaccgcgcaggagacgaaacggcaggcggacctcacccggagctggctgaaacgcgaattcttccagttcagcatgagcagttatcgcaaagcggtcggcgttctggtcaccgtcggcacggtcggcggcgcggcgatcagcggcctggtgatgatcttcgtggcgctcggcgccctgctggtctggggcctgctgttcgtgctgggcaagagcctgctgtacctgctgcgcggcgtcgactcggcgctgtcccacctgcgcggcatcaaactgacctgcccgtcctgccaccaccgggtggtgtatccggcctacgactgccccaacccggagtgcacgcaccggcacgaggacgtccggcccggacggtacgggctgctgcggcgcacctgcgcgtgcggctaccggatgccgacactgctggtgctgggcagccaccggatgacggcgtactgcccgcactgccacgcggcgatggcctccggggccggcaccgcgcgcgagatcgtgatgccgatgctgggcgcgaccagcgccggcaagacccggatgatgctggccctggcggaaaccctgctgccgcgggccaccccggcggatgtgccgaccgggaacgccctcgccgagatgcgggaggcgctgcaggtccggggcgccacccggaagaccatcgcggaggacgcggtgcgggcgtactcgttcaacctgaccgcgaaccgggtgcggcggctggtccacatctacgacccgcccggcgaggacttcagcgactcggcccgcctgcaggctcgccggttcctccgcggggcgcacgccttcgtcctggtcatcgacccgttcgcgatcccggacgtgtggaactcgctggatcccgcgacacagcagcgataccgggcgatccgctccgcgcagccgccgagctacatcttcgagcaggtgctggacaacctgaccgggatgggggtgcggaccgcggacaaggccctggcggtcgcggtgaccaagagcgacctgaccgcgggcctgccgatcggcgacgggatcgacgacgacgtgcgcggctggctccgggaccgggtggggatggcgaacatggtgcggtcgatcgagaaatcgttcggggaggtccgctacttccacaccaccgcggtcttcgatcccggtgcgaccgacccgaacgtgcacgagctgctgggttggaccctccggcgatacggggtgaactga

SEQ ID NO: 3082 - DNA, 2223 bp, Actinoplanes utahensis
atgggcgtcccgcagatgtactacacgtcgtgcctgtccgggctgagcggcttccccggcttccagttcaacgcggtgacgcccgggatcagcgaggccgtgctgcgccgggtggagcaggccacggcgtatcagccgccgcgctcgctgggctgggagccgaccgccgagcagatcgcggacgccccggtgaacctctgctacctgcccggtgagccggccgtcctggcccgcacggtgttcgtcggcaccgactactcgcaccggctcggcaactacttcgtgcacgcgctgagccttcccgccggcttcgagggtgcgcggccgatcgacttctgggcggcggatttctgggtccacaccgagtcggactcccgcgagctgccggagctgaccccggtgccggccggccggccggacccgtcaccggagatcggccggctgccacggatgctcaccgcggtcgcgcgggccgtcgtcgccgagggccgcccggtgatcgtcgtggccgagcggagcgccgacgtggcccgctgcatcggtgccctgtgcgacctgctgcccccggggatggtccggcgcttcgccttcgccacctatcagtaccagccgggccgcggccgggaacacctgatcggcacggttccgggcagcggcttcgaggtgaccgagccggtactgcgcagcttcgcggtcttcgacctgaccggcgggccggagtcggcggccgacgagcacccgctggccgagctgctcaccgcggccggcccggagaacgcgcggatcctctgggacctggccggcgactacgccgcggcggaggatttcgacggctggtacccggcggtggcggccgccgcgctctgcgaacggctgccggtcaccgacggggacctggccgccgtgctggactggctgcccggcaacgccgcccggctcgggccccgggcggtcgcgccgatcgccgaggcgtgcctcgaccacgaggcgctcaccctgccgcagtgcctcaccctggtcgaggtggccgccggtgatccggatctgcgagcggcggccgaggtcagcgcgttcgacatgctgctgcgcgatccgtcgcaggcccccgcgccgcggctggaaacgccggaagcgcggcggtatgcccggcagcaggtgctgacccggctcgacggggcggtgccgggggcggacacggcggctgtgctcgacctggccgtccgggccggggtggagctgacggatcaggagttgaccgcgtacggccgagaattgatcctgcccttgatccttgtcgacccgcgcccgctcggggacgtgccggcactgcggcggggagtgctgcaggggctggcccgggtcgccggcgatcccggggtgctgcccgccctcgaacagctgggcgcgccggatgccgaactgcaggcctaccccgcgctgcagcgcctgttgcagctgtcccgcgcggcgaccgatccggcgaaacgggtgcccgcactgcgccttctcggaccggaccgcgcggtgctcgcggcgctgtgggccggcggctggggtctggaggaggccgctgaggtgatccgcgaggccccggacgagttctgggagtcggcggcgctggtcgagctgctggaccgggtgctggcgcggacccaggtgccaccgggcggatggccgcactacgtggccgctgccgacttcgccgcggtccgcgaactcaccggccggatgtcgccggccgcccggacccacgtcgagcaactccgcgccgcccgggagatgatccggtcggcttccccggcgcgcgcggtggtcgactactttggacatgtcggccagccggcgcgtgcctggctcggctcccaactgcccgcactgctggttacacaggacgcccgggcactcgccgagttgctgccggccgtgccgccggagatccgtcgccactaccgcgaccagctgagccgcacgctcgaccggcggccggccgacctggccgtcgccgccaccacgttcgaactgctgcacacccacccgaagcggtatgcggagctcgacgaggtgctgaccgcgacggtcgcccggtggaagacccgcgatctcgacgacctggagagatttctggcgaaaagcacgatcaaaggcttgccggggtacgtccgtcagtggcgtgagacgcgcgtgccgggccgtttcagccggttcctcccccggaagcggtga

SEQ ID NO: 3083 - DNA, 1191 bp, Actinoplanes utahensis
atggcgcgactgacctgcccgtactgctatcggcagttcgccgagcgggacatgctgttccgctgcagcgggctgcgcgcggccgacgggaagttctgccggccggcgcccgatccggtccgggtggagctgggcgaccgggacgaggtgccgccggtggtggtcgccaacggccggaagctgtccgcggtctgcccgcagtgcggcaacaccgcgacgatccagctctgcccgcactgtcacgcgcagctgccggtgcactacggcaagctcgacacccggatggtggcgatgatcggcgccaagttcagcggcaagtcggtcttcaccacggtgctgatgcacgagctgatccaccgggtcggccggcggttcgacgccgcggtgctcggcgccgacgagcggacccgccgggagttcggggccgaggagcacgcgctctacaccgatcgggtgctgccggcgaccacccggccggcccgggccgacgagcaggggcggcagccgttcgtcttcaagttctcgctcggcgagcggaaacggttccgcagcacgctgcggcacaccgtgctgtcgttcttcgacaccgccggcgaggacctcgagtcggcgcgcggggtggcgcagaacgtcggctatctgagcagcgcggacgggatcatcgtgctgctcgacccgctgaccgtgcccgggctgccggcgactctcggcctggacccgagcctgctgcccggcccggcggcggccggcgacaccccgctcaacatcctcacccgggtcaccgaggtgctgcagaacctgcccggcaccggcccgcaccggatgatcgacgtgccggtggcgatcgcgttctccaaggtggacgtgctctgggaggcgttgcccgcggacagcccgctgcgccagcccgcgccggacgagccgttcttcccggaacgcgacagcgtggccctgcacgaccacgtgcaggcgctgctgcaggaatgggagggcgggcagatcgaccagctcctgcacaagcactaccggacgtaccggtatttcgcgctgtccgccctgggcgccgtcccgtccgtggggatcgcctcccggcagcgggtggccgagtccggcatccagccgcaccgcgtcgccgacccgttcctctggctgctcagccggctcaaggtgatcgagacggggagggactga

SEQ ID NO: 3084 - DNA, 2601 bp, Actinoplanes utahensis
atgttcgacgccgagcggtaccgcgatgaggtgctggacccggcccggcgcaacgggaacaccccgccggccgacctgtgccggcggtacgcgctcgacccggcccggctgccccgcggtgccgccttcgacgcgcacgtcaccaccgtcgtcaaatattggcaggcgctgggcgcgcagcggatcgcgtaccggaagatcgtcgatgccctgaacgccgcccaccagcggctgcgcgagcaggaccggctcaccgccgagcatttccggaccgagcgggaacgcaccgcgcgggagaccggccggcagctcgacgagatcgtcaaggagctggccggcgacccggtggtgtccgccgccgcgctggccagcgcggccgcgccgctgggcggggcggcggtcgaggcgcagctgcgggagttgctgggccggcgccgggtccgggtcgccgacgagctgtggccgctgccggagaccccgccggcccgggcccgcacggtgctgagcagtgtgcgcaccctcgggctgccgctctccctgcacgtgctggccgacgagaagccgctcaccgggttcaccctgcgccgcggcctgcgggtcgacggccgcccgctgaccgtggcacagctcgacgcggcccgccgccgggccgaacgccgcagacaggacgagcggaagaccgcggccgacaacctgctgaccgcgctggccgccgcgctcggcgacggcaccctcgaccagctggtgctctgggagctgaccgaggcggtccgcccggccgccgggctgggcaagctgcgcgtggtggcccgcgaggtggcccggctgggtctgcagcgtgaggaggcggaggacttcgcgctggccgtgctgaaccggggcagccgggcgccggcccgccgggacgtggccggcgagatcgaggagttgctcgccgcgggtgcgctgcgggcggccgagcggctgctgtcgaccctgcccgccggggacggcgcggaggtgcgcgaccgggtgctggccgccgtcgcgcgggtcggcgagctggccgcacgggcgcagcgggagatcgccgcggggcgcccggagtctgcggccgaggtgctggccaccgcggtgcgcgaggccgccgacgacaccgatctggccgaccggctgcgcacgctggccccaccaccggcatccgcggtgcgggccggcagcgcggccggggaccgggtgacgatcggctggacgcccggcccggcgcgcaccggcggagtcacctaccaggtggtgcgcacccggcagcggccggcgggctcggccaccgacggtgacgtggtcggccgcaccggtggcaacgagctgtccgatccggacgccccggccggcgacgacctcttctacacggtgttcgcgacccgggccgacggggtctggtcgccgggggccgccgccgggccggtgtcgctgctgcccgaggtcaccggggtgcaggtggcggccgacgagacgagcgtgcgggtcacctggtcggcccggcccgacctgaccggctgcaccgtggtccgggagccgggcggggtcgccgtcacggccgggcgcaccgggttcagcgacgacgggctgcgaccggacgtcgagtaccgctaccggatccgggccggctatcccgcgctgtcggccgggatcaccgtggcggccaccccgcaggccgccccgaccgcggtgcccggcctgaccgcggagccgctgcccgggccgggtccggcccggttgcgactgacctggacgccgccggagagcggcgacgtgacggtgcgcgcctcggcacaccggccgcggtggagccggggcgcggagatcagcggggcggagctgtcgacgtacggccgggaaatgccggggaaagcggaccgcgcctcgctgacggtcccgatgcccgcagggcgggtgttcgtgaccgccttcagcaccggggccggccgggtggtggtcgggccgaccgtcacggtgacgaatgtggcgccggtcagcgggttgcgggcccggcgggtcggcccgctggtgcgactcagctggacctggccggagggcgtctcgctggcccgggtgcggtggtggcacgacgacgccccggagcaggcccggcaggtcgactgctggctgcgcgcctaccgggacgacggcggcgtggagatcggccccgggatcggcgcggtcaccgtcgcggtgtccacggtgagccgcgacgacgagggcgagaccgtcggcaccccggtcaccgcgcgggtggccggcggcggcgtgccggtgcactaccggttcgtgcaggccggcacgttccggcggcggacccggctggagctgaccgccgaacagccgtgcccgctgccggatctggtggtggtgcagtcgccgggccggatcgtgccgctgcgcgccgatcagggcaccgcggtggtacgcatcccggcgcagcgcctcgagccgggccacccggtgtcggtggaggtgccggtgcagagcgcgcgcgggccgtaccggctgggctgtttcgtcgacgatccggccggcggcgggtcggacgtggtgctcaagggaatcccggggggcggctga

SEQ ID NO: 3085 - DNA, 1821 bp, Actinoplanes utahensis
atgaggtgttcgccgcggtggcgggcgagccgttcgtcaccgggcggcacgcgccggccggcgccggcgtgccgaccgcggatccgtcgcgggaccggaccgtggccgagccgctcgccgccggcctggtcgagatcgagaccggccgggtgcgccgggccgcccgggcccgcctctaccgctacgaagagctcaccgaaagcgagtgatccccccatggcgaccttcggcatcgacctcggcacgacgtattcgtgcgtcgcgcacatcgacgacaccggccggccggcgatcgtcaagaaccggccgggtgacgacaccaccccgtcggtcgtctatttcgagagcccggacaacgtggtggtcggcaaggaggccaaggccgtcgccaagatccatccggatcaggtggtctcactgatcaagcggcagatgggccggccgttcgagatcaccgtgcacgggcagacgcacaccccggagtcgatctccgcgctgatcctgcgggagctggccgacgccgccacggagagcctgggcgagccggtccgggatgtggtgatcaccgtcccggcgtatttcggcgtcgccgaacgcgacgccacccgcaaggccggcgagatcgccggcctcaacgtgttgagcatggtggacgagccggtcgcggccgcgctgcactacgacgcgatcaacaccggaggaacgaagaccctgttcgtgtacgacctgggcggcggcaccttcgacaccaccgtcatccgcgtgtcccccgacgagatccaggtcgtctgcaccgacggcgaccaccacctgggcggcgccgactgggacgaccgcctcgcggagtacctgctggagcggttcctggccgagcaccccggttcggaggcggccgacgacgaggagttcctgcaggggctggcggccggcgccgaggacatcaagaagcagctgagccggatgcagagccgccggttcaacgcccggttcggcggggacaccgcgcagatcgaggtgtcccgggagaagttcgaggagctcacctcggacctgctggagcgcaccgtcacgatcacccggcgcaccctggagaccgcggccgggcggggtgtcaccgacttcgacgacgtgctgctggtcggcggttcgagccggatgccggcggtcagcgccgcgctggagtcgctcggcctcacgccccggatgcacgaccccgacctggcggtggccaagggcgccgcgcggtacgcgttgatcgagtcggtcaaggtgcacctgcccgcgtcgggcggcgaggccccggccgaggtggtcgacgaggtcgccgagcggctgaacatcccggcggagaaggtgcgcgcgctggccggcaagcgggtcgccacggtggtgccgcgggccttcggggtcaaggtggtcgacctgtccggcggccgtgagcacttcaccgtcacgcacgtgctgcgggccaacacgccgctgccggccgagaccgagccgcaccggttcggcaccgcgtacccgaaccaggtcgaggtcgcggtggagatctgggagcagtccggcgcggtcgagtcggacgccgtcgaggacaacgagcacatcgccgagggcctgatcagcggcctgccgccgttgccggtcggctcgccgatcgacatcagcttccagatggcggccgacgggctgctgcgcgtgcacgcggtggagctgaagaccggcaaggacctggacatcgaggtgcagatccggggcgggctgaccgacgagcaggtgtccgcggcgcggaacgcggtggcgcgctaccacgtctcggcgtga

SEQ ID NO: 3086 - DNA, 693 bp, Actinoplanes utahensis
gtgccgccaccgtcgcggtcaccacgatgcccgccaccgagcaggccgccgccgccgtcctcggcaccgtcgacgacgccctctgcgcctgatcaacccccggccacccgtcctgcgggacgggtggcaggctgggcggctatggacctgaccgtgatcctcggcccgatgaagggcggcaagtcgctggagatgatcagcctgctgtcgccgctgcagcacaccggcatcccgcaccggatctaccagtcggcgcggcacgggcgggacagcgcggtgatgtcgcgggtcggcggcagcctggacacattgaaggtgcacacgctggccggggcggcggagggcggtgtcgaggtgatcggggtggacgagatccacatgttcaccgtggacgacatcgccgagctcggggtggcggtgcggcgcgggatcaaggtggtggtggccgggatcgacctggatcaccggggcgagctgttcgcaccggtgcgggcgctgttcgagctggcgccggaaaaggtgatctatcgccgggcggtgtgtgacgtgtgccggtcgctggacgcgacgcacacccaggtgctggagcacggcaagccgttcatccgcgagctggccccgtcgacgccgctgccggacgacggcacctatacgtacgaggcccgctgccgccgctgcgtcgtcctcccgtag

SEQ ID NO: 3087 - DNA, 1080 bp, Actinoplanes utahensis
atgctgaagatcgtcgccgcggttctcgcggccaccctgctcaccgcccagcccgccgtcgccgccacccgggacccggtccgcaaggatctggcgaatctggtcgccgacggcttccccggcgcgctggcggtcgtccgggacgagcacggccggatccgcagaccggtcgccgggaccggagacaccgcgaccgggcgtccggtgcccgccgacgggcaggtgcggctgggcagcaacaccaagacgttcgtcgcggtggtcgtcctgcagctggtcgccgagcaccgggtgcggctggacgacccggtcgagcggtacctgcccggcctgctgcacggccgccgggtgaccgtccggcagatcctgcagcacaccagcgggctggccaactacaccgaatacctggcgctggacgacctgtccctgcgctaccggcacttcgcgccgcgggagctgctcgacctcgcgctggcccacccggacaccttcccggccgggacgagctgggcgtacagcaacaccaactacatcgtcgccggcctgctggtggagaaggtcaccgggcgaccgctggccgagcagatcacccggcgggtgatccgccgcgccgggctgcgccacacctacttcccggcggacggcgagaccgggatccgggagcggcatccgcagggctacctgacgctggccgacgggcagctcttcgacatcaccgacctggacccgtcgtggggctgggcggccggccagatggtcggcaccccgtccgacctcaacaccttcttcagcgcgctgatccacggccgtctgctgccggacgctcagctcgccgagatggagaagacggtcccggccgaactgtggcccggcgcccggtacggcctcggcctggtcagcttcccgctcagctgcggcggggtggcgtggggccacggtggtgacatccccggctacgagacccgcaccggcgtgaccatggacggccgtgccgccaccgtcgcggtcaccacgatgcccgccaccgagcaggccgccgccgccgtcctcggcaccgtcgacgacgccctctgcgcctga

SEQ ID NO: 3088 - DNA, 2193 bp, Actinoplanes utahensis
gtggctgacgaactcgccgcagaaaaccgcgccgaacgcgcgggcaagtgcccggtcgcgcacgggaccgcgtcgcacggcggccggggcaaccgtgactggtggcccaacgccctcgacctgaccgtcctgcaccgcaacccggtcgtcggcaacccgctgggcggcgacttcgactacgccgaggcgttctccagcctcgacctggcggccgtgaaggccgacatcaccgccctgctgaccgactcgcaggactggtggccggccgacttcgggcactacggcccgctgttcatccggatggcctggcacagcgccggcacctaccggaccttcgacggccgcggtggcggcggcgccggcgagcagcgcttcgccccgctcaacagctggccggacaacggcaacctggacaaggcccggctgctgctctggccggtcaagaagaagtacggcaagaacctgtcctgggccgacctgatgatcctggccggcaacgtggccctggagtcgatgggcttcgagacgttcggcttcggcggtggccgcgccgacgtctacgagccggaagaggtcaactggggctccgaggacacctggctgggcgacgagcgctacagcggtgaccgcgagctggccagcccgctcggtgcggtgcagatgggcctgatctacgtcaacccggagggcccgaacggcaacccggacccgctggcttcggcccgcgacatccgcgacacgttcggccggatggcgatgaacgacgaggagaccgtcgcgctgatcgccggcgggcacaccttcggcaagacgcacggcgccggcccggcctcgcacgtcggcccggagcccgaggccgccccgatcgagcagctcggcagcgggtggaagagctcctacggcaccggggtcggtggcgacgcgatcaccagtggcctggagggcatctggacgcccacccccacccggtgggacaacacgttcttcgagacgctcttcaagtacgagtggaccctgagcgagagcccggccggcgccaagcagtgggtgccgacctcgcccgacgccgagggcaccgtgccggacgcgcacgacccggcgaagcggcatgtgccgaccatgctcacctccgacctggcgctgcggttcgacccgatctacgagccgatctcccgccggttctacgagaacccggaggagttccggctggccttcgccaaggcgtggttcaagctgacccaccgtgacatgggtccgatcgcccgctacctcggcccggaggtcccggccgagccgcagatctggcaggacccggtcccggccgtcgaccacgagttggtcggcgcggcccagatcgccgagatcaaggccgccgtgctcgcctccggcctgaccgtcgccgacctggtcttcaccgcgtgggcgtcggcctccaccttccgcggcaccgacaagcgcggtggcgcgaacggcgcccggatccgcctcgccccgcagaacggctgggcggccaacgagcccgaccggctggcccgcgtcctgggcacgctggagaccctgcggtcgcagctgagcgccccgatctcgctggccgacctgatcgtgctggccggttccgccgcggtggagaaggcggcggccgacgccggcgtcaccgtcgaggtgccgttcaccccgggccgcaccgacgcgaccgccgagcagaccgacgtcgcgtcgttcgcggtgctggagcccacccacgacggcttccgcaactacctgggcaagggccaccgccggccgaccgagcagctgctggtcgaccgggccgagctgctcaccctgaccgctcccgagctgaccgtgctggttggaggtctgcgcgtgctgggcgccaaccaccaggacaccgggcacggcgtgttcaccgccacgcccggcgcgctgaccaacgacttcttcgtcaacgtgctcgacttcggcaccgtctggacgccggtcgacagcgacggcgagctgttcgagggccgcgaccgggccaccggcgcggtgaagtggaccggcacccgggccgacctgatcttcgggtcgaactcgatcctgcgcgcccagtccgaggtctacgcggccgacgacgccaaggagaagttcgtccaggacttcgccaaggcgtgggtcaaggtcatggagctggaccgcttcgacatctga

SEQ ID NO: 3089 - DNA, 183 bp, Actinoplanes utahensis
atgcccgtcaccaccgcaggccgtctggtggccggggccgccgccgtcttcatcggcgccgccctggtgatcctgagcggttctcttcccgcggacgtcggcaacgccgtctacttcgtgctgccggtcacctggctggcgatctgctgcgggctggccggcatggccctctcccgggtgtga

SEQ ID NO: 3090 - DNA, 3924 bp, Actinoplanes utahensis
gtggccgccgatgtcacccaggtgcgcaccgtgtgcggctattgcggcgtcggctgcggcatggtgctcgacgtcgcccgggatgccgccgggcaccgccgggtcctcaaggtgaccggcgacaaggatcacccggccaaccgtggccggctctgcaccaagggtgccaccagcgcggacatgctggcggccgagggccggctgggatacgcgctggtccgtgccgagcgcggcgcggagccggccaagcagccgctggaccgggcgatcgcggagaccgcgcgccggctgcgggagatcgtcgacgagcacggcccggacgccttcgccatgtacgtttccgggcagctgaccctggaggcccagtacctggccaacaagctggtcaagggcttcatcgggaccaacaacatcgagtcgaactcgcggctgtgcatggccagcgcgggcaccggctacaagctgtcgctgggtgcggacgggccacccgggtcgtacgacgatctcgaccacgccgacgtcttcctcgtgatcggcgcgaacatggccgactgccacccgatcctgttcctgcggatgatggaccgggtcaaggccggcgccaggctgatcgtcgtcgacccgcggcgcaccgccaccgccgaccgggccgacctgttcctgcagatccgccccggtaccgacctggcgctgctcaacggcctgctgcacctggtggacaaggacgaagagttcatcgccgcgcacaccgagggctgggcggcgatgccggatctgctggccgactacccgccggagcgggtggccgagctgaccgggatcccggaggcggacatccgcaccgccgccgcgtggatcgacggggcggcgaactgggtgacactgtggaccatggggctgaaccagagcacccacggcacctggaacaccaacgcgatctgcaacctgcacctggccaccggagcgatcagccgcaccggcagcggcccgttctcgctcaccgggcagccgaacgcgatgggcggccgggagatgggctacatgggccccggcctgcccggtcagcggtcggtgctggtcccggccgaccgcgagttcaccgagcggatctgggggctgcccggcggcaccctgcgcaccgaggtgggcaagggcaccgtcgagatgttcgagcggatggccgcggggcggatcagggcctgctggatcatctgcaccaacccggtcgcctcggtcggcaaccgccgcacggtgatcgccgggctggaggcggccgagctggtcatcactcaggacgcgttcgccgacaccgagaccaacgcgtacgccgacatcgctctgccggccgcgatgtggtcggaaaccgacggcatcatgatcaattcggagcgcaacctgacgctggtccacccggtcgtcgacgcacccggcgaggcgatgccggactggatgatcatcgcgcgggtcgccgccgcgatgggctacgcggaggccttctcgtatgccgacgccgcgcagatcttcgaggagatcaaactctttgccaacccgcagaccgggtacgacctgagcggcgtctcctacgagcggctggcgtccggacccgtgcagtggccggccgctcccggtggcccggatcgcaaccccgtcaggtacgcggacttcaccttcgccacggccggcggcagagccgtcttccacgcccgcccgcatctcgatccggccgagctgcccgacgacgactacccgttcgtgctgaacaccggccgcctgcagcaccagtggcacaccctgaccaagaccggcaaggtggccaagctcaacaaactgaacccgggcccgttcgtggagatcaacccggtggacgccgcggcgtacggcatcgccgagggcgaccaggtggagatcgcgtcccggcgcgggcgggccgtgctgcccgcggtgctcaccgaccgggtgctgcccggcacctgtttcgcgccgttccactggaacgacctgttcggcgaatacgtcagcgtgaacgcggtgaccagcgacgcggtcgacccgctcagcttccagccggagctgaaggtgtgcgcggtggcgctgaccagggtcgccgcgccggcgccggccgacatcccggccgggctcgggctcgacctgacaccgccggcgctgagcgaggggcagcggcgatacctggccggattcctggccggtctgccgccggggcgggtgggcgcgccggtgctgccgggcaacgcgccgttcgacccggacaccacgatgtgggtgaacggcttcctggcggggatgttcaccgacgtaccggacaagggtctcgatctgccgcaaccggccgccgggccgcgcctgcaggtcctctgggcctcgcagaccggcaacgccgaggacttcgcgcgcgggctgtccgaacggctggccgcgaccgggcaccagatcaccgtgcgcgggatggacgccgcggccgccgagctgctcgatccgggcgccgacctgctcgtggtgaccagcaccttcggggacggggacgcgccggacaacggggccgcgttctggcagtcgatcgccggggacggcgcgccgcggctggacgggcgccggtacgcggtgctggccttcggcgactcgaactacgacgacttctgcgggcacggccgccggctcgacgaacggctggccgagctgggcggcacccggctggccccgcgcgccgactgcgagccggatttcgaggacaccgcggccggctggctggaatcggtgatcacggcgctgaccgccaaggcggtgaaacaacccaccaaggccgccccgctgccgtccgttctggtcgggaaccgcctgctcagcggcccgggctcggccaaggaggtgcggcggttcaccttcgacaccggcgggctgctcgactatcgggtgggcgacgcgctcggggtgtggccggtcaacgacccggacctggtgcaggagtggctgaccgtgaccggcctgagcccggacaccgcggtggagctcgaccggatcggcatggtcccgctggccgaggcgctcacccggcacctggacatcacgaagatcaccggcgacctgctccggttcaccgccgaggtgggcggcgatccgcacctgaagaccctgctccgcccggacaacaagggcgagctggccaagtgggcctgggggcggcaggctgtcgacctgatcgccgagcagggcgtgcgggccccggcgcaggagtgggccggggtgctcaagcggctgcagccccggctgtactcgatcagctccactccgctgaccgagccggaccgggtcagcctgaccgtgtcggtggtccgcttcgacagcctgagcggccgcccccgcaagggcgtctgctcgacgcatctggccgacgcggccggcgaccgcgaggtgccgctgttcgtgcagaaggccccgcacttccggccgccggccgacccggccacctcgatgatcatggtgggtccgggcaccggggtggcaccgttcctcggcttccttcaggagcggcaggccaccggggcgtccggtgccaactggctgttcttcggcgagcagcgccgggagaccgacttctactaccgggaggagctggccgcgctctccgcggccggcaccctcagccggctcgacctggccttctcccgggaccagcgggccaagatctacgtgcaggaccggatgcgggagcagggcgcccagctgtgggcctggctcgccgagggcgcccacttctacgtctgtggagacgccagccggatggccaaggacgtcgacaaggcgctgcacgagatcgcggtcaaccacggccggctgtccccggaggcggccaccgcgtatctcaagcagctggccgccgacaaacgctacgtccgcgacgtgtactga

SEQ ID NO: 3091 - DNA, 1152 bp, Actinoplanes utahensis
atggcagcgcggagatcgatcggcatcgtcgtcaacggagtgaccgggcggatgggttaccggcagcatctggtccggtcgctgctcgcgatccgggagcagggcggcgtgccgctgcccggcggcgggcacatctggcccgagccgatcctggtcggccgggacccggaccggctggccgcgatcgccgcccggcacggcctggccgagtggaccaccgacctggccgccgcgctcgcccgaccggacgccgagatctacttcgacgcgcaggtcacccagcagcgggagaaggcgatccgccaggcgatcgcggccggcaggcacgtctacaccgagaagccgctggccgagagctccgaggcggccgaggagctggctgagctggccaccgccgccggcattcgccacggtgtggtgcaggacaaactgttcctgcccggcctgcgcaagctgaagcggctgatcgacggcggtttcttcggccggatcctgtcggtgcgcggcgagttcggctactgggtgttcgagggcgactggcagcccgctcagcgccccagctggaactaccggctggccgacggcggcggcatcgtgatggacatgttcccacactggaactacgtgctggaggagctgttcggcacggtccgcggggtgcagacgacgatcgcgacgcacgtgacgcggcgggtcgacgagcgcggcgaggagtacaccgcggacgccgacgacgccgcctacgcgatcttcgagctggcgggcggcatcgtcgcccagatcaactcgtcgtgggcggtccgggtcaaccgggacgagctggtcgagttccaggtcgacggcacgcacggcagcgcggtcgccggcctgcgcggctgcaagatccagcaccgggcgacgacgccgaagccggtgtggaacccggacctgccgctgaccggccggtcgttccgcgacgagtgggccgaggtgccggacaacgacgagttcgacaacgggttcaaggtgcagtgggaggcgttcctgcggcacgtcgtcgccggcgagagcttcccgtgggacttcgcgtccggtgcccgcggggtccggctggccgaggcggggctgcggtcggcgcgcgaggggcgccggatcacgctgggcgacgcctga

SEQ ID NO: 3092 - DNA, 807 bp, Actinoplanes utahensis
atgagccggttctcgttcaatcagatcaccgcccggtcgtgggacctgccggacctggtcgccgggtgcgtcgaggccggcgtcggacaggtcgcgctgtggcgcgagccggtcgccgaatacgggttggaacgctccgcggccctggtccgcgaggccggattgaccgtcaccacgctctgccgcagcggcttcttccaggagccggactggttcgacgacaaccgccgggcgatcgacgaggccgccgcgctcggcaccaccgtgctggtcctggtctccggcggcctgccggacggatcccgggacctggccggggcgcgccggcacgtgggcgacgcgatcgcccggctggtcccgcacgcggccgcggccggggtgaccctggcgatcgagccgctgcacccgatgtacgccgccgaccgctgcgtgatcaacacctgggaccaggccgtggcgatcgccgaacagcaccccgccgggcaggtcggggtcgccgtcgacacgtaccacctctggtgggacgacacggtgctggacaagatcgcggaggccggtgagcggatcgcgatctaccagctggccgactggatcacaccgctgccggccggggtgctgaccggccgggggctgcccggagacggctgcgtggacatgcgggccttccacgaggcggtggacagggccggatatgccgggccgatcgaggtcgaggtgatgaacgccgacctctgggaacggccggggcgagaggtgctctgggcggcgctcacggcgtacgaaagtgtgtttcagaggtccttgtga

SEQ ID NO: 3093 - DNA, 402 bp, Actinoplanes utahensis
atggcctttgacgaggtactcgcggaacggatccgggatcagctcggcgacgtcgacggggtgaccggcaaacggatgttcggcggcatcacctttctggtccacggcaacatggcggccggcgtgatgggcgacgatctgatcgtccgcctcggcgcaccagccgtcgcaccggccctcgccgagcccggcacccgcgtcttcgatttcaccggtcgcccgatgcggaactggatcgtcgtcgacggcgcccgcctggacgacgaggacctggcccgatggctgcgcgccggcgtggatttcgccggctccctgccgccgaaacagcacgaggagaaaggtggaagggaccggcccggacatcgtcggccgcaccggtcccggcttcacaaggacctctga

SEQ ID NO: 3094 - DNA, 546 bp, Actinoplanes utahensis
gtgaaacgaagtctggacgcggtcgacgaggcggagctcgtgcgccgcaccgccgccggtgaccggcacgcgttcgacgagctctatcgccgcacgtcgccgtggctcgccgtgcggctgcgacgccgctgctccgaccaggacgtgatcgccgacgtcatgcaggagacctatctggccgtctggcgggccgccggcgacttcgccggcacgaccgtcgccggcagcgcggccggctggctctggaccatcgcggcgaacagactggtcgacgccttccggcgccgcgcccgccagcagcaggcgcccaccttcgtgcccgagcccgcgcccgccgcggaggacgaggtgatggccggccgggtcggccaggagctggagcaggcgctgctcaccctcccggccgaggtccggcaggtgctgcgcgccatggttctcgacggcctctcggtccgggagacgtccgtgctgctcggcgtgcctgagggcaccgtcaaatcgcgggcgcggcgcgcccggatcgcactgcgggaggcgctgtcatga

SEQ ID NO: 3095 - DNA, 801 bp, Actinoplanes utahensis
atgaccgggcacccgagcccctcggtgatctcccgatacgccgacggcgacctgagcctcgacgaggccacggtctggacggtcgaggtgcacctcgaggagtgcgccgactgccggacacggctgtccggtgcggtgccggccgacgtcctgatcctgctcgaccgggtgagcaacggggtggatcagggcatcgcgtcgggtccgccgccgatcccgctgcggcgacgacgctggtcggcggcgcggcaccggtggctggtctggcacctgctgccgtggctcggcatgaccgcggcggccctcggctgcgcggtggtgctccaggcgctcgcacccaccctgccgtcgctggtgctgctgctggccccgatcgccccgctgcccggggtggcggtcgcctggagtcggggcgccgacccggcctgggagctgatcgccagcaccccggcggccgggctgcccctgctgctgcgccgcaccgcgacggtcctggcggtgatcgtgccggtgctggccctgatcagcaacggcgtcggcgtctcgctggccctgaccctgctgccgtgcctggccttcacgaccacggcgatcgcgctgggcgccgtcctgggcgtccgcctcgccgcgatcagcctggccagtgcctgggtggcgatcgtcgccgtccccgccgtgttcgtgatgcacctcccggcgatcctgctcccgggcagcgtcgcgatctgggtgtcgaccatcgtcgtggcggccgctttcacgctgagccccgccatccgctcccgccggttctcccgatga

SEQ ID NO: 3096 - DNA, 801 bp, Actinoplanes utahensis
atgcgtacggtgagcgcggctgagaccgcccccaccctccatccctgggtggtgcaggccgagggcctgcgcgtccgcgccggccggcatctggctgtcaacggcctcgacctcgcgctcggcggcggcgtccacggcctgctcgggcccaacggcgccggcaagacgacgctgatgcgcgccctggccacggtgatcgagccggccggcgggcagctgaccctgctcggcgagtccgtcgacggccgcgccgacctgcgccgggtgcggcgcgggctgggctatctgccgcaggccttcgggttctatccgcgcttcaccgtgcgcgagttcgtggagtacatggcctggctcaaggagatgccgaaaccggcggtgccgggcgcggtccagcgggcgatcgagcgggtcggtctcgccgaccgggccgaccgccggatgaaaacgctgtccggcggcatgctgcgccgggccggcatcgcccaggcgatcgtcaacgacccggcggtgctgctgctcgacgagccgaccgtcggcctggacccggagcagcgcctcgacttccgcgagctactgcgcgacctgggcaccgacagctgcgtcctggtctccacccacctggtcgaggacgtggtcgccgcctgcaccgacgtcgtgatgatcagcgagggccggctggtgttccagggcaccccggagtcgctgatcgcccagggcggtcccgacgacgcgggtgacagccccgccgagcgaggctattccgcgctgctgcgccgccaccgttcggaggccgcccggtga

SEQ ID NO: 3097 - DNA, 1287 bp, Actinoplanes utahensis
gtgacccgcatcctcggcatcgagctgcgtcgttcggccgcgctcggctccgtcctgatcctgaccgcgatcggcgtcgccctcatgttctacttcgaggaggccgactggaccaccggctgggtccagatggtcatgtccgagcggctctacctggcgctgctctggccgctgtccctggccgccggcgcctggcagggccgccgcgagtcccagtccaacgtggccgagctgttcgccagcaccccgcgcccgcgcgctcagcgtgccgcgccgaccctcgccgtgatggccctggccgtcgtcaccagctacctgctgatcgccctcgccgccggcacgaccctgatcggccgggccggctacttcccggcggccgtgccggccatcgccgcggtcggcgccctgtcgatgctcgccggcgcctggttcggcctcgccgtcggccgtctgctcccctggctgatcaccgcgcccgccctggccgtcgccggtctcgggctgctgctcggcctgccctccaccagccggcaccggggctggctggccaccatcttctcgccgatcttcgacatgaacatgccggacaaatactcgaccgtgcccggccgggccagcgtctcgcaggcgatctggatgatcacgttcgccgtcaccggtgcgctcctgttcgccgcggccggctggcgcacccgggtcgctgccctgctcccggtcgctctcggcgcggcggtggcgatcgcggtcatcccgcaccaggaccggctcatcgtggactcggtcgacccggtcgccaaagagctggtctgcgcccgcaacgagccccgggtctgtgtcagccgggtgcacgccggcctgctgcccgagctgctcccgcaggcccgcgaggcgctgaccaccctggcgaaactgcccggcaccccgacccgggtgcacgaggacaacagcacctacgtcccggacgttcccgcgccgaaaagtccggacgtcgccctgatccgcatcgacgtgaacaagagcggccacctggacaccgacctggcaccgcggatcgtcgccgcggccttcagcggacggcccgactgcgacggctccccgcgccaggcggagacgctggccgcggcgtactggctgatcggccgtgctccggcgatgctcgccgacttccaggacgagcaggacaccgccaacgccgccgccgagtggcagagactgcacgctctgcccgccgacaaggccactgcccaggtgatcgccatccgcgccgccgccacgaggtgcgagtga

SEQ ID NO: 3098 - DNA, 687 bp, Actinoplanes utahensis
atgccgcgcgcctcgtcgccgctcacggcgggcagcccggcccggcgtcggctgatgccttcgctgggcgcggccggcctgtcctcccgctggctgatgctctacctgcgttcacggcgggcgcccttggcgctcgccctggtcggagccggcacggtgctgctgtggattctgtgggtcaccacgtccaagacccgcgacgtcgactgccggatggtgcaggtcgcggtgctgctcgcggtcgcggccctgaccgccaccctgggcgcgcccgacgacgcactggaacgcaccggcgcggtcaactggccactccgccggaccgtgcacctgctggtcgccctgctgatcgtggtcggcctgctgaccgtcacgctgctcaccccggcccgcttcggccctgcgagcttcgtcctgcgcgacgcggccggactgctcggcctcaccgccctcggcgccgcctcgatcggcccggcccgctcctggttcgcaccgctcggctggaccttgacggccgtcatgttcccgctgggcgacggcaccatccagcagatcgtcacctggcaggcgcagccctcgggcaatgctcccgccacggtcacggctttgctgctggccctcggcggcctggtggcctatgccaacgccggcccgtcccggagagcacccgccgaggtcccggtctag

SEQ ID NO: 3099 - DNA, 1029 bp, Actinoplanes utahensis
gtgacttcctatgcggcggcggccgctcgttatgacgccatggaatatcgccggtgtgggcgcagcgggttgaagctgccggcgatctcgctcgggctgtggcacaacttcggggacgacaagccgatcgagacgcagcgggcggtgctgcgccgggccttcgacctcggtgtcacgcacttcgacctggccaacaactatgggccgccatacgggtcggcggagatcaactttgggcggctgctggccgaggatttccggtcgtatcgggatgagctgatcatttcgaccaaggccgggtatgacatgtggcccgggccgtatggggaccgtggatcgcggaagtatctgaccgcgtcgctggaccagtcgctgcggcggatgggtctggactatgtggacatcttctactcgcaccggttcgacccggagacaccgctcgaagagacgatgggggcgctggacgcggcggtgcgggccggcaaggcgctctacgtcgggatttcgtcctactcgcccgggaagaccgcggaggcggcggcgatcctgcgggaactgggtacgccgttgctgatccaccagccgtcgtattcgatgctgaaccggtgggtcgaggaggatctgctcggtgtgctggagcgggaaggggccgggtgcatcgggttctcgccgctggcgcagggcatgctcaccgaccgctacctgaacggggtgcccgagggttcccgggccggcgaacaaaaatcgttgacgaccgactggctcaacgacgagaacctgggcaagatccgggcgctgaacgcgatcgctgaacggcgtgggcagagcctggcgcagctggcgatcgcctgggcgctgcgggatccgcggatgacgtcggtggtgctcggcgccagcagcgtggcgcagctggagaacaatctcgcggcgctgggcaacaccgcgttcgccgcggacgaactggccgagatcgacaagtatgcgaccgagtccggcatcaacctgtgggcgcgctcgagcgattactga

SEQ ID NO: 3100 - DNA, 483 bp, Actinoplanes utahensis
atgatgtccggcttggacagtcgactacccgcgatgcttttcctggcggccgggcagttgaagatttctgcaacttcgaaactgcacaaggcacgtaaccgggccgcctcccccgcgttggtcggtgtgaatgactggaggggacccgccgtgtccgtgccgctgtatcaggcgaaggccgagatgttccggacactcggccaccccgtccggatccgggtcctggagttgctgcaggacggcccgcgcccggtccgcgacctgctagccgagatcgacgtggaggcctcgaacctctcccagcagctcgccgtcctgcgccgcgccggcatcgtcgcctcgttccgcgagggcgccctggtgatgtacgcgttgagcaccccggatgtcgccgacctgctcgccgcgggacgccgcatcctcggcgcggtgctcaccgaccgcgacggcctgctggtggagttgcgctcgcagaagcgttag

SEQ ID NO: 3101 - DNA, 372 bp, Actinoplanes utahensis
atgccggacatggacgtagccctcaaggacgcgatgcagatcgacggcgccatcggcgtcgctctggtcgaccgcagcagtggaatggccctcggtgtcgccggcggcgaccggaatttcgatctgaccgtggcggccgccgccaacaccgaggtcgtccgggccaagctgcgcaccatggagatgctcggcctgcgcgagaacatcgaggacgtgctgatcacgctggagtcgcagtaccacctgatccggccgctgaccgggcggtcgggccagggcctcttcctctacctggcgctgcacaaggagcgggccaacctcgcgctggcccgccaccagctcaaacggatcgagacgaatctggatatttag

SEQ ID NO: 3102 - DNA, 714 bp, Actinoplanes utahensis
gtgtcgccgcgctgctccgctacgcggacgcccgccgctgaacccacaggctgtgcacacagcctgtggataactcgaacgtgtgtgcgaacggcggcacgcggatggcaagatgttcgcgtgtcgcccaacgagttgcgtcccgcgtatccgatcacgaccgagcgtctcctgctgcgcccgctgaccgaggcggacaccgaggcgctgctctcctaccgcagccgccccgacgtctgccgctacctgccgttcgagccgatgacccccgaggtcatcgctgaccggctcgcgacctactgggccgcgacggtcctcaccgacgaggggcagtcgctgaccctgggcatcgagcacgccgagaccggccggctggtcggcgacgtgatcctgttctggcacagccgccggcaccgcggcggcgaggtcggctatgtgctgagccccgacgcggtcggccagggctacgccaccgaggccgcccaggccatgctccggctcggcttcgaggagctcggcctgcaccggatcatcgggcggatcgacgagcgcaacgagccgtccgcccgggtgctgcgccgcctcggcatgcggcaggaggcccggctcgtgcacaacgagctgttcaagggcgagtggagcaccgaggtcgacttcgcgatcctctccgacgagtggttcgctaaatatccagattcgtctcgatccgtttga

SEQ ID NO: 3103 - DNA, 1017 bp, Actinoplanes utahensis
atgcgactcaccatgctccgccggttgtacgaacgccccggaccgtgggcttcggtatatctcgacacgtcgcgggacaccgcggacgccgcgcggctgatcgagcagcgctggcacgcggcccgggagatcctcgccgaggccggttgcgacccgctcaccgtgcacgcgctggaggacgcggtcctcgatcatccggcccggcccgggcggcacggactcgcgctgttcgccaccgcgggggaggtgatcctgcggcaggcgctgcacgcgccgccggccacgacgatttcggcgtacgagccactccccgacgccatgccgatggtcgcccagttggccggcgagatccactacctgcgggtggccgtcgccccgtccggcacggcgatcgacgcggccgccaccggccggctgatcccgggcggcggatggtccccgccgttgaccgacctgacctggcgggccggtgccggcgacccggccgacgcggtcaccgagctggccgaccgcaccggcccggagctgatcctggtggccggcgccccgcaggcccgcccccggctcgtcacccagcttccggaccggtggcgcgaacgggtggtggagaccgagaacgccgtcccggtgcaggcgatgacggactgcgccgaggcgctgcggcgcgacacgctcgctcggctgcacgcccagctggcgcacgacggctcggccggcaacggcctgtccgaggtggtgagctacctgtcgcgggggcaggtggacacgctgctgatgatcgacgatccgtcgtccaccgagcggctgtggatcggccccgacccgcaccagctcagcgacgacccggaggaactgcgctcggccggggcggcgcacccgccgctggtccgggcggacgccgcgatgctgcgcgcgctggccgccaccgacgcgtcgatcctgctctgcgacccggacgagcacgacctgcgcggcggtgtcgccgcgctgctccgctacgcggacgcccgccgctga

SEQ ID NO: 3104 - DNA, 600 bp, Actinoplanes utahensis
atgactgacgtattcggtgcggtggtgcccggccggccgaccggggtgctcgccgacgtctggggccggtccgccgtccgcgacctcctgctgatcgtgggcgccgccggcgcggtgggcgccgccgcacagatcgccgtcccggtgcccggctcgccggtgccgatcaccgggcagacgttcgcggtgctgctggccggggcggtgctcggcccgggccgcggcgccgccggcatggtgctctacgcgctggccggggtgctgggcgtgccctggttcgccggtggcacctcggggtggccggtcgccaccggcggatacctcatcggcttcatcgtggcggcggcgctggtcgggcagctcgcggcgctcggggcggatcgccgaccggcgtacaccatcggtctgatgttgatcggaaatcttctgatctacctgttcggcgttccctggctggccctgatgaccacgatggacgtgcccggcgcgttctgccacggcctggtcccctacctgatgggcgacgcgctcaaaatcgccctcgccaccgccctgctgcccggcgcctgggccctgctgaaccgcaaacgccccggctga

SEQ ID NO: 3105 - DNA, 1944 bp, Actinoplanes utahensis
gtgaaatcccgtacccctgtcgtcgtcgccgcggtcgccgcaacagcggtcgcctcggtggcggtggcggtcgccggtccggcgaccgcccagcccaacgtggccgcctctcccgccgccgcggccgcatcggccgcctcatccctgttcgcggcccgccccgccgccctgcacgcggccgccgacgaggccttcgtccagcatgacgtgatctccaccgaccacctccagtacgtgccgttcgacaagacctacaagggcctcccggtgatcggcggtgacggtgtcgtcgtcaccgacctggccggccaggtcaagttcacgtcgacggcgcagagctcgccgctcggcgcggtcaacaccaccccggcgctgaccgcggccgcctccctcaaggtcgccaagggtcagctgaagacggtcaccaccgtcgaaggcacccgtctcgtcgtgctggccaccaccggcaccccggccctggcctgggaatccacgatccggggcacgaacgccggcgggccgagccggctcaccgtcgacgtggacgccgccaccggccgggtgctgcggacccatgagcacgtcaccgacgtgaccggcaccggcaacggctggatcaacggcacggtgagtttggacaccacgctctccggctccacgtacagcatgaccgacccgaccatgaccaccctgaagtgccaggacgcggcgtccaacaccacgttcaccggctccgacaacgtgtggggcaacggcaccggcaccaaccgggagaccggctgtgcggacgccctctacgtcgcgcagcgggagaaggccatgctgtccacctggctgggccgcaacggcttcaacggcagcggtggcggctggcccctgcgggtcggcctgaacgaccagaacgcctactacgacggcagccaggtccagatcggcaagaacaccgccggtcagtggatcgcctccgccgacgtggtcggccacgagctgggccacggcatcgacgacaacaccccgggtggcatctcgaacggcaacacccaggagttcgtcgccgacaccttcggcgcgtcgaccgagtggttcgccaacaacccgaacgacccgccggacttccaggtcggcgaggaggtcaacctggtcggcagcggtccgatccggtacatgtacaacccgtcgctcgccggtgacgacaactgctactccagcagcatcccgagcgaagaggtgcacgccgcggccggccccggcaaccactggttctacctgctcgccgagggcaccaacccgaccgacggccagcccaccagcacccggtgctccggctccggcgcgatcagcggcgtcggcatccagaacgccatcaagatcatgtacaacgcgatgctgatgaagacctccagctcgtcgtacctgaagtaccgcacctggacgctgaccgcggccaaggcgctggactcgagctgcggcctgttcaacaccaccaaggcggcgtgggacgcggtcaacgtgccggcccagtccgccgacccgacctgctccggcggcggcaccggttccccgagcccgtcgaccagcacgaccaccccgccgggcggctgcagcgccaccaacgacaccgacgtctcgatcccggacgcgggtgccgcggtctacagcaacatcgtgatcagcggctgcgcccgcagcgcctcggcgacctccaccatcgcggtcaacatcgtccacacctaccgcggtgacctgcgggtcgacctggtcgccccggacggcacggtctacaacctgaaggccacgtccggcagcgacagcgccgacaacgtgatcaccacctacaccaagaacctgtccagcgaggcggcgaacggcacctggcgcctcagggtccaggacgtctactcccaggacaccggctacatcaacagctggaccctgaccgtctga

SEQ ID NO: 3106 - DNA, 576 bp, Actinoplanes utahensis
atgggcgtcgtgcgatcttcccggtgggttccggtggcgggctggttcgtggctaccgcgaccagcatcgtgctctcctgggtggcgctgctcccggtgctgaatgcggcccgggccgatgccggggcgctgcccgagatcgatcaggtgccggccgccgacgtgcggacccctctgccatcccccgcggtgaccccgacgacgccggcgcccgcacccacgtcgccgtccgcgaagccgagcaggaagccgtcgaaatcaccggcggccgtccccaccggcaagccgtccaccaccaacgagaacgggtggacggtgaccaccgacggtgccggggtccggacgtacgtccgctccttcagtctcaagggcggccaggcggtcatcaggatgaccagcgagggcgtcgtctccctggtcaccgcgacgccggcggacgggtacgcggtggagaagacgcagagctcgccgggcgacatggcggtctacttcaacgagaccgcgcacagcttcatcatccacgccatctggtacaacaacgcgccttatgcgcaggtcgacgagatcggctcctag

SEQ ID NO: 3107 - DNA, 783 bp, Actinoplanes utahensis
atgctggtcgcggtagccacgaaccagcccgccaccggaacccaccgggaagatcgcacgacgcccatcctctcacctggtcctatggtgtacgccatggcgttgatcctgttggtcgaggacgaccgcaacatcgcggccgcactgacccgtgcgctgaccgatgccgggcacgtggtgcgtgccgtcggccaagccgcccaggcgctgaaaatcgtcacccaggaacggcccgacctggtcatcctcgacctcgggctgcccgacatcgacggcaccgacgcgctgcggatgatgcgcaccgtctccgacgtgccggtcatcgtggcgaccgcccggcgctcggaggcggacatcatcgcactgctcagcgccggcgccgacgactacgtgaccaagccgttctccggcgggcacattctggcccggatctcggcggtgctgcgccgcgcgcggaccaccaccgagcaggcgccgaatgcgatcaccgtgggcgagctggtgatcaagccacggcagcgccgcgccgagctgcgcggtgagccgctgcagctgacccgccgcgagttcgacgtgctggcctacctggccgaacgggtcggccaggtgatcagccggcgggagctgatgaaccaggtgtggaaccaggcccggatcggcgaggagcagaccatcgacgtgcacatctcctggctgcgccgcaagctcggggagaccgccgccaaaccgcggttcctgcacaccgtccgcggtgtcggcgtgatgatggtcgacccgcagtga

SEQ ID NO: 3108 - DNA, 1419 bp, Actinoplanes utahensis
gtggaaccaggcccggatcggcgaggagcagaccatcgacgtgcacatctcctggctgcgccgcaagctcggggagaccgccgccaaaccgcggttcctgcacaccgtccgcggtgtcggcgtgatgatggtcgacccgcagtgaggtgggcgctgaaccgcctcgccctggccatcacctcgatggtggccctggcgttcctggtcccgctggccgtggcgatctggcagatcgcccacgacaaggccgtctccgaggcgcggcagcaggccacctcgatggtgaccgtgctcggcgtcaacgccgacccgaccgcgctcaccaacgcggtggccagcacctccgccggaagcgccgggctgctcgccgtgcaccttccgggcctcgacccgatcggcacctcgcatctgaccgcgacgaccgtcgagagcgccgcgaaacagcgccgctccgggaccgtggcggccgccggcggagtcgcctacctgcagcccaccgtgctcaccgacggccggaccgtggtggtcgaggtgttcgtcaccgacgacgagatgcgccgcggcgtctggtccgcgtggctggccctcggcggcctggccgtgctgctggtcggcggttccacgctgctcgccgaccggctcggcgcccagctcgtccgggccacccggcagctcgccgcctcgacccgccggctcggcgccggcgagctcggcgaacgcatcgagccgaccggcccgcgcgagctgcgcgacgccgggcaggccttcaacacgatggccggcgacctgcgccggctcctggaccgcgaacgcgaactcgccgcggacctctcgcaccgcctgcggacgccgttgaccgcgctccgcctcgacgccgaagccattccccccggcccgatcgccgaccggatgcgcgacgcgtgcgacctgctcgacgaggaactcgacgcgatcatcaacggcgcccgcctgggcgtcgaggaacgcggcaaggagcagtgcgacctggtcgaggtgctggccgaccggctggccttctggtcggtgctggccgaggatcaggaacgcccctgggaggtggtcggcgggcacgaaccggtgccgatcccgctgtcgatgagcgacgtgatcctggtggtcgacgcgatgctcggcaacgtcttctcgcacaccgacgagggggtggccttccgggtcagcgtctcctccaccggcttgctggtcgacgatgcggggccggggatcgacgacccggaagcggcggtacgacgagggcacagcggcgccgggtcgaccgggctgggactcgacatcgtgcggcgtgccgctgacaacgtacgcggtcaattgatcgtcgggcgaagcccgttgggtggagcccgcgtcggattgctgctcacgtctcccgccgggtcttga

SEQ ID NO: 3109 - DNA, 843 bp, Actinoplanes utahensis
atggcagctctccctaatgtttcgcccggtaagagagccaggacgaaatgtctggagaccgacatgcgcaggaagatcgcctacccgctggccatcctcgggatggccggatcgaccctggtgatcacctcaccggctctggcccacggctacgtctcgtcgcccccgagccggcaggcccagtgcgcggccggcacggtcgcggactgcggcgcgatccggttcgagccgcagagcgtcgaggctccgaagggttcccgggaatgcaacggtggcaaggccgactacacggtcttgaccgacgactcgcgcggctgggcggcgacctccgtcggcacctcggtgaagttcagctgggtgctgaccgcccggcaccggacagcgagctgggtctactacgtggacggtaccgcggtcgccacgttcgacgacgggaacgcgatccccgaggccacggtcagccacacggtgaacctcggcaggtttccggggcggcacacggtgctggccgtgtggaacatcgcggacacggcgaacgccttctacaactgcgtggatctgaacatcggcggcggagctccgtccacgccggcgcccacgccgacggccgcgcccacgccgacggcggcgcccaccaccgcggctccgaccaccgcgccgaccgcgaccagcgctcccgcctcttcggccggcagcggtacgaagtgggcgccgggcgtcagctacaaagccggtgacgtggtgacctatcagggtgtctcgtaccggtgccgccagccgcacacgtcgatccacagctgggagccgtccgggttcactctcgccctctggctgccgctgtga

SEQ ID NO: 3110 - DNA, 651 bp, Actinoplanes utahensis
gtgccgccagccgcacacgtcgatccacagctgggagccgtccgggttcactctcgccctctggctgccgctgtgaggcgccacgtcgtggccggcgcgctgctcctctcgctggcggcatgcggaacagcgccgtccgcccccgccccctcgaccccctcggcttccgcggcggccgccggcgcgaccttcaacgcccgggacgtgatgttcctgcagatgatggtcgaccaccagcagcaggggctgcggctggccgcgatcggcgccggccgggccagccgcccggacgtcgccaacctggcccgggccgtcgacctcaccgagaccgacgagctcaccatgatgaagagctggctcaccggatggggtaggtccacccaggtggacaagcgggtgagcgtgcacgccgaccacggtggtctgccgagcaccaccgacgccgagatcgagtcgttgaagacggtgaagaaggcggacttcgagaccgcgttcctcaacctgttcctggcgcaccagcacaacgccgtggagatggcgcagctggagctggacaccggcgcgaacgagcagaccaggcagttcgcggagcgggtcaaggaatcccgcgccgaccaggtccagcagatgctccgcctgttgaacggttga

SEQ ID NO: 3111 - DNA, 1071 bp, Actinoplanes utahensis
atgcaggttatggcgggtcttctggtcggcgccctcctcgtcgcgcccacctgggaccatcccggatacgacgccgaggacagctacttcaacccgtccgcgatcgccgtccggcagctcactccgacctggtcggcgagcctgcgccaggtcgacgaaagctgctcgggcttctccgccccgatcgtcggcgacgaccaggtctacgtcaccgaccgcgagggcgtctcgagttacggcctcgacttcggcgacctgcggatccgcttcacgtgggattacgcgtacgacaacagcacgccgcggatggccctcgccggcggcctgctgatcctcgccgacgacgactgcaattcggcgagcgccccgcacggccggctgaccgccctcgacccggccaccggccggccccgctgggaccacaccgtcggcccgatcgtctcggcgctggtcgacaagaacgtgatcctggtgtccgggtcgtcgccgtccgacgagcagtccgtcgccgcctatcgggtcagcgacggccacctgctgtggagccgggtcgactacgcctccagcggcgtctcggcgaacggcgtcgtcccgctggagaagggcgacacgaccatcgcggtgggcgtgtccaccggaacggtgcgctggtcgcgaccgtcgccggcccgggtgcaggcggcgagcccgcacgcggaccgcttctacgccaccgacggatcgggcgcgctgctggcgctggacgccgccaccgggcgcacggtgtggacggcggccggtcgggccagcacgctggtcgccgccgacgggacccgcgtctacctcgcctccggctcgacggtgacggcgctcagcgcggccaccggccgggtggtgtggtcccgcaagctgtccgcggcggccggccagccggtggtggcggccggcgtcgtctacaccggcagccggatcctgaacgcggccaccggtgtgcccaccggccggacgctcgccggcctcgtcacgccggccggcgaccgcctctaccaggtcgacggcgcgcgcctgaccgcgtacggcccggttgcctag

SEQ ID NO: 3112 - DNA, 837 bp, Actinoplanes utahensis
gtggagctgctgcactccggcaaggttcgggacgtctatgcggacgggggcgacctcatcctggtcgcgtcggatcggatctcgatctacgacgtgattctgccgaccccgatcccggacaagggaaagatcctcacgcagctgtcgctgtggtggttcgaccagctcagcgacatcgtgccgaaccacgtgatctcctcgacggatgtgccgcaggagtgggcggggcgggccatccggtgccggcggctggacatggtggcggtggagtgcatcgcccgggggtatctggccggctcggggctcaaggactatcagcgggacgccgccgtctccggggtgccgctgccgccggggctggtcgagggatcgcggctcccggagccgatcttcacgcccagcaccaaggaggcggtcggcgccgggcatgaccagccgatgaccttcgagcaggtggtggagcaggtcggtaaggaccaggcggaggagctgcggcggatcaccctggagatctaccgccgggggtcggagatcgcggccggcaaggggatcctgatcgcggacaccaagatcgagctggggctggcggacggtgagctgatcctcggggacgaggtgctgacgccggactcgtcgcggttctgggcgaccgaggagtgggcgcccggcgacgtgcagcggtatctggacaagcaggtgctgcgggactgggcgacccgggagaccgactgggaccggaccgagccggggccggacctgccggagcacgtggtgcaggcgacccgagggcggtatgtcgaggtttacgagcggctgaccggggaccgctggagctag

SEQ ID NO: 3113 - DNA, 297 bp, Actinoplanes utahensis
gtgctcgagccgcgggaagagcgggaattcgacggcatggtggcccgcttgcgggacgccgacccgggctttacccgccgggtcgaccggatacacccccggcaacgccggcgctggttgatcctgaccatcctgctgtggacgatcgccccgatctgcctgctctacggcggctggacgggcgccctggaagcggtgctggccgccgcgtacggcggatggctgctgcgcaaacgccgccgggcggcggacgccccgtcgtggccgtcgtccaccgaccgccggcccaccgtctga

SEQ ID NO: 3114 - DNA, 612 bp, Actinoplanes utahensis
gtggatactctttctgaagcgcggtcgagcctgacccccgagggccgcagcctcctgttcaccgacgcgcgcaccgcctccttcttcgcacccacgccggtcaccgacgaggagctccgcgagatctgggagctggccaagtggccgccgacgcaggccaacacgcagccgctgcgggtgctgttcgtgcgtaccgccgacggtagggaaaggctgatcaagcacctcgccgagggcaaccgggcgaagtcgcagagcgcgccggtggtcgccgtgcttgccctggacaccgagttccacgagcacgtaccgcaggtcttcccgcacaatcccgggctcaagaaccttttcgagggcaacgtcgacaagcggatcgcggacggcacgttcagcgccgcgctgcaggccggatacttcatcatcgcggcccgcgcggtcggcctccacgccggtccgatgaccggtttcgacaaggccggcgtcgacgccgagttcttcccggacggccgcttccggtcgctggccgtcgtcaacctcggccacccggccgagaacgcgtaccgcgaccgcctcccgcggctggaccacgagaccacgctccactgggcctga

SEQ ID NO: 3115 - DNA, 321 bp, Actinoplanes utahensis
atgacggcggtggaggagaccccggcggcggggttggcccgcgccttcgagttcctcggccgccggtggaacgccgaggtgctcggcgtgctggagggcggtccggccggcttccgcgagctgtcccgcgcgatcgacgggatcagtgactcggtcctctccaaccggctgtcctgcctgaccaaggcgggtctgatcgcgcgtgacgtggaggccgggccgccggtcacggtgtcctattcgctgaccgcggcgagtcgcgcgctgatgccggcgctgggtcagatcgcccggtgggccgatcagcatctgcccgggtga

SEQ ID NO: 3116 - DNA, 183 bp, Actinoplanes utahensis
atgaccggcgccgtcaccgtggccgccatcgtcggcctgctgagcctcttctccggggtcgccctcgggtggtatctgcggcgcaccaacgactggtgccccacctgcggcgagcagctcacctgcggcgactgcaagatgagcgtgcactggcccgagcaggccaccgccagccagcactag

SEQ ID NO: 3117 - DNA, 300 bp, Actinoplanes utahensis
atgtcgagttggatgacgtccacaccgacggtcaccccgccccagcgggatccggcggatgtggcgccggccgagagctaccgcccggctgacccggtctgggtctatcgggacggttggcgcgccggcgtgatcgaggctgcctctccgcgcgcggtcacggtgacgtatcaccccggcacgcatcgcggcaccggcgtcgacaccttcacggctccctacgtgacctcccgcgaggacgatgacccgatgctcgacaaccgtggactccgcctggtccggcgaaggccgctggcatga

SEQ ID NO: 3118 - DNA, 891 bp, Actinoplanes utahensis
gtgagcgaggccacgcaggaggatgcggcgggcggcggcccgaccgtgctgcgcattctgctcggctcccagctccgcaagctgcgggagtcgaaagggatcacccgcgacaaggcgggatatgagatccgtgcctccggttccaagatcagccgtatggagctcggccgggtcagcttcaaggaacgcgacgtcgccgacctcttgaccttgtacggggtggagagccccgccgagcgcgaaatgctgctcagcctggcccggcaggccaacagccccggctggtggcagcagctcaacgacgtcctgccgtcctggttccaggcgtatctcgggctggaggcggccgcctcgctcatccgcacctatgagatccagttcgtcccgggtctgctccagaccccggagtatgcgcgcgccgtgatcatgctcgggcacgccggcgcgtccgccgaggagatcgaccgccgggtcgaggtgcgccggcagcggcagcagattctcacccgtccgggtggcccgcagctgtgggcggtcatcgacgaggcggtgctgcggcggccgatcggcggggtcgcggtgatgcgcgcccagatcgaggcgctcatcgaggcgtccaagctgccgagcgtgcggctgcaggtcatcccgttcaccgcgggcgggcacgcggcggccggcggcccgttctcgatcctgcgcttccccgagccggagctgcccgacgtggtctacgtcgagcagctgaccagcgccatctacctggacaagcgcgaggatctggatcagtacgcgatggcgatggagcgggtctgcatcgacgccgatccgccgaacgacaccccggagatcctcggcaagctgctgcacgaggtgggacggccgctctga

SEQ ID NO: 3119 - DNA, 237 bp, Actinoplanes utahensis
atgacctacgtggtcaacggcatgcctgccggtcagctgcagggcgtgacctggcagaagagccgtcgcagcaacccgagtggcaactgtgtggagtgcgccgtcctgcccggcggcgacgtcgccgtgcgcaactcccgcgaccccgagggtgccgcgctgatctacacccgggccgagatcgaggcgtttctcggcggggtccgggacggggacttcgacaacctggtggcctga

SEQ ID NO: 3120 - DNA, 390 bp, Actinoplanes utahensis
atgagtccgacgcgggtgagtgagctcgttcggtgtcacgggcatcgttccgtggcgcatccgcacgcccggtcgaggtggatggcctcggcgccgcgggtccgtgacgaccggctgcggccgagccggccacgctggccggtccacgagttcgccgaggccgactactgctacggcatcggtccgatccggttgcgcgtcgtgcgcgtcgaccggcaccggccgatcccgcacgagggcgaggtctggctcgcggtgcagggcatcgtggtcgacccggacggccgcgagggcgcggtgcgcgaggtgttgatccgggccgggtgcgtgccggtgccaccggtcggcaagcggacccggctgcgggtcctgcgggacacgccggtctga

SEQ ID NO: 3121 - DNA, 954 bp, Actinoplanes utahensis
gtgatcgggtggtctccggcgccggcctcctgggctgcgtcgaccacttctcggccgcctaacgatcaagcgtcggggctaggctggacggactgtcgaagatcgacggtccggcgcaaggaggcggtcgtgcaggacggtgacaactccgcaccccacgaggtcgcgccacccggcgtgaacatcaacgtgccgcactccgcccgcatctacgactactggctcggcggcaaggacaacttcgccgtcgaccgcgccgtcggtgaagcgatgatccaggccatccccggcatgcgctacatggccggggaaaaccggaagttcgtccaccgcgccgcccgcgacctggtcgccaaggagggcatccggcagttcctcgacgtcggcaccggcatacccacccggcccaacctgcacgagatcgcgcagaagatcgcccccgagacccgggtggtctacgtcgacaacgacccgatcgtgctggtccacgcccgcgcgctgatgctgagcagccccgagggccgcagcgaatacatcagcgccgacatccgcgacccccgctcgatcctcgacgacaaggtgctcaccgacaccctcgacctgagcaaaccggtcgggctcaccctgatcgccatcctcatgctgctcgccgacgacgacgatccgtggggcaaggtcgcggcgctgcgggacgcgatgccgtccggcagctgcctggcgatcacccacccgacggcggacttcaacccggacgaggtcggccgggccgtcgcggcggcgaccggtgcggggatgacgctggtcgcccgcacccgggacgcggtcgcccgcctcttcggcgactgggagctgctcgagccggggctggtgccggtgtcgtcatggcggccggacatcgaggcggacgatccgcaggcggcctactactgggccggggtggcccgcaaaccctga

SEQ ID NO: 3122 - DNA, 1575 bp, Actinoplanes utahensis
atggacgccgagaccctgtcagcagtcctcctcaccatcgaggaccgtcgatcctgggatgccacggccgagctggcccgcaccatcgacctggagcggatcgccgtcggcctgggcgacgagttgctcgccgcccgcgcccggctctgccagatcaacatgcggatgcgctgcggcgacgtggcccgggccgccgaggagatctggcacgtgcaccagtgggcggtcgaccacgacgcccgccggctgctggctcgcacccacctggtctgggtcaccatccacctgcacctgggcgatgccgagcaggggctggaacacgcggtgctcgccgtcgaactgctcgacgacagcgccaccgaacacatgcaggtctggcaccggaccaagctggccgacgcactctacttcgccggtgatctggacgccgcccgcgaacggtacacgcaggccgagcagatggcgcagcacctccagtcacccgcgctgaccagcgtgctgaacaacttcgcctacgtcgaggccagcaccggcaaccgcgaacgtgccgaggcgctggccgaccggctgcaacagctgtccgccgaatcgggcatcccgctcgagcccgcgttcctcgacacgatcggctcgatccaggtcagcaacggaaactacgcggccgccgccgagacgatgcggatctgcatcgcccggcacgccgagggcaaatgggacgacgccaacgacatggcgcaatacctggtcaccctggcccaggctcagcgcggcctcgaggagctggcgccggcccaggccagcctcgacgaggcacgccggctctgcatcgaacgtgacctgggcgagagcctggtccgggtgctccaggagcaggccgagctgttcgccgcggccggtgacttcgcggccgcgttccacgcgcacaaaaacttcttcgagatgcaccaccagcagcagtcgctgcagaaggaggcccgcgcccggacccggcaggcgatgttcgagacgaccgaggcccggcaggaagcggaacgcttccgggagcaggcccggcgcgatccgctgaccggactgcacaaccggcggtacgtcgacgagcggttgcccgggctcatcgagaccgaccggtcgctggcggtggccctggtcgacctcgaccacttcaagcagatcaatgacctgctctcgcacgacgtcggcgaccgggtgctcgtccaggtcgcccaggtgctggccggtgaggtcgcggccgcctgcccggacggtttcgtggcccggatgggtggcgaggaattcctggtcgtcctccccgacactccggtacgccgggcggcgaccgtgctcgacgccatccgccgggccgtccgcggccagcactgggcaccgatcaccagccacctgccggtcacggtgagtatcggcatcgccggtgtcggcgagccggccacacccggtcaggcaccccttctgtccattgcggacggtcgtctgtacgctgccaagcggggcggacgtgatcgggtggtctccggcgccggcctcctgggctgcgtcgaccacttctcggccgcctaa

SEQ ID NO: 3123 - DNA, 1575 bp, Actinoplanes utahensis
atgtccgcgtcgcgctcagagccgggagcgatgacccaccgcgagatcctggaggccctctccggcctgcttctcgtgctcttcgtcgcgatgtccagctccaccatcgtctccaccgcactgccgaccatcatcggcaagctcaacggcacccagacgcagtacacgtgggtggtcaccgccaccctgctgaccgccaccgcgtccaccccgatctggggcaaactcgccgacctgtacagcaagaaactgctggtccagatctcgatcgtggtctacgtgctgggttcgatcgtggccggcctgacgcagaacaccgagcagctgatcgccgcccgcgcgttccagggcctcggcatgggcggcgtgcaggcgctcgtccaggtcgccatcgccgcgatgatcccgccccgcgagcgcggccggtacaacggttacctcggcggcgtgataggcctggccacggtcgccggcccgctgctcggcggcatcatcgtcgacaccgactggctcggctggcgctggtgcttcttcatcggcatcccgatcgccatcgtcgcgctcatcgtgctgcagcggactctgcacctgccggtcgtccgccgggccgacgtgaagatcgactacctgggcgccaccctgatcgcggccggcgtcagcgtcatcctggtctgggtgtcgttcgtggacaactcgttcggctggctctcctggcagaccttcgccatggtcggcgccggtctggtgctgctcgcactggccaccctcgtcgagtcccgggccgccgagccggtcgttccgctgccgatcgtccggcagcgcaccaccgccctggccatcctgggcagcctcgcggtcggcatggcgatgttcggcggcgcggtcttcctgggccagtacttccagatcggccggggctacagccccaccaaggccggcctgctcaccattccgatgatgttcggcctggcgctcgcctcgacgatcgccggccggctgatcacccgcagcggcaacatcaagccgtacgtggtgaccggcacgctggtcctggtcgccggcttcggcgggctctccgtcctcgaccacgacaccccgctctggtacgtcgggatcgcgatgttcctggtcggcgcgggcgtcggcatgtcgatgcagaacctggtgctcgccgtgcagaacacggtggcgctccgggacatcggagcggcctcgtcgaccgtggcgttcttccgctcgctcggcggcaccatcggggtgtcggtgctcggtgcggtgctcgcccgtcgggtggccgactcgatgaccgaccagctcagcgccctcggggtgccggccgggcagtcgagctccggggtgagcgcgctgaacctgggcagcctgccgccggcgatccagcacatcgtgcgggtgtcgtacggcgacgcgaccgggcacatcttcctgatctcgatggcgatcgcggtggtcggggtgatcgcggcggtggcgatgaaacccaccaagctgcggagcactgtggatcttgccgctccggccgcgacgccggagccggcggccctcggcgcgaaatag

SEQ ID NO: 3124 - DNA, 621 bp, Actinoplanes utahensis
atgcaggtcgccggtaggctgccacgcatgagcgacgacggtggcctgcgggagcggaagaaggcggccacccgccaggccctgcacgaggcgtcgctgcgcctggcgttcgaacacggcccggaccggatcaccgtcgaggcgatcgccgacgaggccggggtctcccggcgtaccttctccaactacttcgccaacaaggaggaggcgctgttctacggtgacctgcagcggatgcgcctgctcgccggcaaggtccgcgagcagcccgccgggacatccccgtgggaggcgctgagcagcgcggccgaggccttctacggtgagctcggcgatctggacccggagtggatcgcgcgcagccggctggtccgccggcatccctcgctggccgccacccaggtgcagacgttcgccgcgctggagcagggcctggccgacgagctggcggcccgactcggtgccgccgacccgatcggcatgcggtcccggctgatcgccgccaccttcctcaccgtgctccgcgtatcgctcaacgtctggctggagcgccgccccgacctcacgttctgggacctcgcccgggacgcgatcgccgacgccggccgcggcttcgcctag

SEQ ID NO: 3125 - DNA, 1440 bp, Actinoplanes utahensis
atgcaacgcagccgtatgcggctcgccatctactcctcggccgcgctgctcgcggtcggtggcggtatcggcgcggcgttcgccgccaccgacggcggcacgggcagcctcaccgcgtcgttcgccaaggacagcgactggggcaccggctaccaggcgcactacacgatcaagaacggcaccgacgcgccggtcaacggctggcagctggtcttcggcctgccgtcgaccgcgaagctcggcagtgtctgggacgccgcggtgaccaccagcggcaacgtcgagaccgtgacgaacgcggcgtggaacccgacgatcccggccggcggcgagatctcattcggcttcgtcgtggccggcaagggtgacccggccagctgcacgatcaacggcgcgtcctgcaccgccggcggcgcgaccgcggcccccacggtgaccgcgaccgccaccgcgacggccaccgccaagcccaccgcgacgcccacccggaccgccaccagcccggccccgaccaggaccgcgaccgcgacgccgaccgccaccggcggcaccggctcggcgagcggggtgctggtcgcgccgtacgtcgacatgggtgtgctgtccaacggcggcaccctgtccgcgctggccggcggcggcaatgtgaagtcgttcagcctggccttcgtcaccgcctccggctgcaaggcgagctggttcggcgccttcgacccgcgggccaggcagttcgccgaccagatcggtgcgatccgctcggccggcggcgacgtcaaggtctccttcggcggcgccaccggcgtcgagctggcccaggcctgcacctcgaccagcgcgctgcaggccgagtaccaggcggtcgtcgacgcgtacgacctgaagtacatcgacctggacatcgagggtgcggcctcggccgacaccgcctcgatcaaccgccgctcgaccgcgctggccggtctgcagaaggccaacccgggcctgaagatctcgctgaccctgccggtgctgccggagggcctgaccgcggacggtctcaacgtggtcaagtcggccaagaacgccggcgtcgacctcgacctggtcaacatcatggcgatggactacggccggtccggccaggactacggtgacctggcgatccaggccgtgaaatcgaccaaggaccagatcaggtcgatctacggcaacagcgacgcggcggccttcaagatggtcggcgtcaccccgatgatcggcaagaacgacgacagcggcacgttctcccagagcgacgccagggacctggtcgccttcgccaacgccaaccacgtcggcttcgtctccttctgggagatgcagcgcgacaagaacgcctgccagggcgcactgttccagtgcaccaacatcagccagacggcgttcgagttctcgaagatcttcgcaggattcaagggctga

SEQ ID NO: 3126 - DNA, 558 bp, Actinoplanes utahensis
atggccacccggctccgtgcggatgcgcgccgcaaccgagcggccctgctcaccgctgcccgcgaggtcttcgcggagcagggcctggacgcttcgctggacgagatcgcccgtcgcgccggggtgggcaacgccaccctctaccgccggttcccgagccgccggcacctgatcgccgaggtcttcgccggccacatgacggccgcggtccggctcgccgaccaggcgctggagcaccccgacccgtgggccgcgttcatcggctacctgagccgggtctgcgagctgcaggccaccgaccgggggctggccgagttgctggtgaccgacgcgttcgacgacgacgagcggctgtccgcgctgcgcgccgcggcccagcagcgggcggtcgacgtgctcacccgggcgcagcgggccggccggctgcgcgccgacttcacccggcacgacctgtggctggtgatgatggccaacgccggggtgaaccggcacgcgaccgaaccccacgcctggcgccgccagctggcgctgctgatcggcgggctggccacccgatga

SEQ ID NO: 3127 - DNA, 747 bp, Actinoplanes utahensis
atgcagcagacttcgatcgacatcccagctgccgacggcccggccgacggttacttcgtcaagccggacggccccgggccgtacccgggaattctgatcttcatggacggcttcggggtgcgcccgcgactgcgggagatggccgaccggatcgccgagcgcggctatgcggtgctgctccccaacctgctgtaccgcgaccagcggagcccgctggtcgacccggctgaactggccgacccggagaagcgcggcgccgccttcggccggctgatgccgatgatgcagaacctcacggcgccgcggctggtcgccgacgtcaccgcgtatctcgacttcttggccgcgcaggagggcgtcgcgcccggcccggtcggcgcggtcggctactgcatgggcggccggaacgggctgatcgcgatgtccgcgttgcccgaccggatcaaggtgctgggcagcttccacgccggccgggtggtgaccggggacgagcacagcccgcacctgggggtgggcgcgatcaccggggaggtctacttcgggcacgccgacaacgacgcctcgatgaccccggaccagatcaagacgctcgaggcggcgctggacgaggccggggtgacctacacgtccgagctgtacgagggtgcgccgcacggttacaccatgtcggacacggcgatgcaccacccggccggcgagcagcgccactgggcggccctgttcgacctgctggaccgcaacttctag

SEQ ID NO: 3128 - DNA, 351 bp, Actinoplanes utahensis
atggatgtcgtcgacttctgggtccggtcctggacctcggacgacctggccgccgcccgccgggtgctcagcccgcacgtcgaggtggagtggaacctggacgccccggtcgacgacgaggagttgctgcaggtcctgcaccggatagcggtcttcgccgaccatgtcgcgctgaccgcccggacggacgcgctggacggcgccgcgctgatctacgatctcacggcgccgttcggcagtgcccggctggccgagttcctcgcggtcgaggacgagaagatcgtcgagatccggcacgtgtacgacgtgaccgcgatcgatcgatacttccccggcctgtacgccaactag

SEQ ID NO: 3129 - DNA, 1632 bp, Actinoplanes utahensis
atgcgcgccaagaaggtcacccgtcgcaccctgatcgccggtggcggcgccgccgccgtggccgtggccaccggggtcgggatcaacgcggtccaggcggacgccgccagcaccgcgccggccaccggttcggtgatcaccaagtcggggaggggcggcccgggcgccggcgccgccaagacgctggtcctgtacgacaccaccggcgactacggctggctgggcgaggtctacgccacccagacggcgaacctgagctcgcggttcggctcgtggacggcggcgccggtggcccggtacaaggccggcgacctgagcgcctacaccgcggtgatctacctgggctcgacgtacgacgagccgctgccggccgccttcctcaccgacgtgatggccaccaccaagcaggtcctctgggtctacgacaacatctggcagctggcggcgaaggacggcttcgccgccaagtacggcttcgccagcggcacgttcgacttcgccgacgtgaccgaggtggattacaagggccgcaagctcacccggggcaccgagaacaagtccgggatcatgaacctgtcgatcggcgacagcgccaaggtgaccacgctggccaccgcggtgcgggcggacggcaccggcttcccgtgggcggttcggtcgggcaacctgacctacgtcggggagatcccgttcgcctacgtcacccatgacgaccgctacctggccttcgccgacctgcttttcgacacgctcggcggcgggaccaccgagcggcaccgggcgctgatccggatcgaggacgtcgggccggacgccgacccggagcagctcaccgcggtggccgacttcctgttcgcggagaaggtgccgttcagcgtcgcggtctacccccggttccgggacccgaagggggtcggcaccggcaaggcccaggactacaccctgctcaacaagcccaaggtggtggccgcgctcaagtacatgcaggccaggggcggcacgctggtcatgcacggctacacccaccagtacggttcggtggccaacccgtacgacggggtgagcgcgaacgacttcgagttctacaaggcacacgtcgacgcgggcgacaacgtggtctacgacggtccggtggccgaggactcggcggcctgggcgaccggccggatgatgtcgtcgggtgcggtgttcctggccgccgggctgggctcgccgaggctgttcgagttcccgcactacgcggcgagcgcgccggactacgaggtggtcaacgccctgttcggcaagcggtacgaccgggggctgtacttcccgggcgtgctgaccggcgccaggttcgactactcccggcagttcggccagttcttcccgtacccggtgcgggacgtctacggctcgctggtggtgccggagaacatcggcaacgtggagaccgaggcgttcaacaaccacccggtccggctgccggccgacatcgtcgcctcggcgcagcgcaacctggtggtccgcgacggcgtggccagctgcttctaccatgcctacctgggcaccgaccatctcaaggacctgatcggggggatcaaggcggccggctacacgttcgtgagcgccgagtcgacgctttccgcctaa

SEQ ID NO: 3130 - DNA, 1689 bp, Actinoplanes utahensis
gtgcgcccgctacctgggctcgctgttcgcctccggcaacatcgcccggaccgcgctggtcgagatcctgcactacctggtctcgccgtgggcgaacgcggtggtcgcgatgctgctcacgctgaccggcacggccggcgcgctgggcctgctgatcgggcacccggtgccgatcctgcccagctggttcgccctgggcgagagcctcggcatctgggcggtggtcaccacgttccccggcctggtctgggtgctggtgcaccgggtcaagcgcggcgacgaggaactcccccggatgctgctcgccgccctggcctacccggcgttcctgctgctcggcctgaccgcgacctatcgcgcgctgggccgccagctgaccggcaagcaggcctgggccaagaccgagcggctcgtcgaggagccgctcgccctgaagaccgcctgatttcccgcaggcgccccaccatcccccatcgccagcaagtgaaggaaggctccccccgaatgtcccttcgcgaagtccatctgatcggcggcacccggccggaggcggtcaaactggccccggtcgcgctcgcgttccgcgaggccggcctgctcaagccgatcctgctggccagcggtcagcaccccaccatggtcacccaggcgctggccgccttcgacctggaacccgacatcacgctcaccgtcgagcgctccaccggcacccaggccgaactgctcaccgcgatgatccagcagctcgacgagctgtggtcggtacgcaccccggccgcggtgatcgtgcagggtgacaccaccaccagcctggccggcgcgctggccgcgttctggcgccggatcccggtcgtgcacctggaggccggtctgcgctccggtgacctggagtcaccgttccccgaggagggcaaccgccggctggtcgcccaggtcgccgcgctgcacctggcaccgacgccgctggccgcgatgaacctgctggacgagaagatcgccgcgagcgacgtgctgatcaccggcaacaccgtggtcgacgcgacgctggcggtggccgcccgccggctgccctacgagaacccggcggtggccgcggcccgcgccgagagcaccaagcgcctggtcctggtcaccgcgcaccgccgcgagtcgtggggcgagccgctggaccggatcctcggcgcggtcaacgagctgctggcgaagtacccggacatcgaggtggtgctgcccagccacccgaacccggcggtccgcgcccaggtggacgccgcgctggccggcgccgagcgggtcaccgtcaccgacccgctgccctacccggacctggcccggctgctgtccgaggcgtacctggtgctcaccgactcgggcgggatccaggaggaggccccgtcgttcggggtgcccgccctggtgctgcgcgacgtcaccgagcgcgtcgagtcgctgcacgcgggctgcgccaagctggtcggctccgacccggcggtgatcgtcgccgaggcgtccgcgctgctggacagccgggaccgccgggacgcgatgaccgccggcggcaacccgtacggcgacggtctcgccgcccggcgcaccgcccaggcgaccgccgccctgctcggcctcgccaccgccccggacgccatgccggtccggccgtccgccaccgagatcggagccaccgcctga

SEQ ID NO: 3131 - DNA, 96 bp, Actinoplanes utahensis
atgcgccggacgattccgggatgcggccgaaaggttgaggtcgcggtgacccacggtgcttttccggctacggagaaggcggccaccgtccggtga

SEQ ID NO: 3132 - DNA, 573 bp, Actinoplanes utahensis
gtgcgaggcggactggacgacgcgctcgacaagcttgcccgccgcgacgagctccggcggcgtgccgcggccggcgaggctccgggcactccgcccgcggtgaccgagctggtcgaggccatcgccggggtgatcgcccggttcccgcacctgggcgtcaccgtcggtgtcgagggtgccggcgatccggtgctgctgcacttcggattcgccgacggcaccgtgcaggtcaccgcggaccgcaccgtggtcgagcggaccgccgccgagccggcccgggcgcacgccgacatcgagatcgacctggacgatccggagccgccgccccgcggcagccacgacgaccaggaccggttcgggcccacctatgacgagccgccgaccgcggagcgcccgttcgtgacccccccggcgcccgcctatccgccgccgccggccgcctatgcgccgccggtcgaaccggccccgcagccgaagccgttccacgcggagcgcgccgcggaggagaccgagcaggccgcccgccggctggccgcgctgctccgcgacaatcccagcctgctggacgactga

SEQ ID NO: 3133 - DNA, 630 bp, Actinoplanes utahensis
gtggacttcgatccatcagctaaccgcgtcgtcgccaccgcgcgcatcccgggcggagccgcgccggccaagaaggcgccggttccggtcaagatcatcgtggccggcggcttcggggtgggcaagacgacgaccgtcggcgcgatctcggagatcgcgccgctgaccaccgaggccgagatgacctcggagtcgatcggtatcgacaacgtcggccaggccaccacgaagaccaccaccaccatcgcgatggacttcggcgtgctgaccatcgaccagacgctgaagctctacatcttcggcacgcccggccagacccggttcgccttcatgtgggacgacctggtcaagggtgccctgggcgcgctggtcgtggtcgacaccaaccggatcgacgactgctacccggcggtcgactacttcgagcgggccgggctcccgttcgtggtcggtgtcaacacgttcaacggcaacatggcgtacagcctcgacgaggtgcgctgggcgctcgcggtccgcgaggacgtcccggtgatctcctacgacgcccggttccgcgcctcggtgcgcgacgctctcctcgtcgttctggaccaggctctcgacaaggcgataaagatgaagtcgtag

SEQ ID NO: 3134 - DNA, 447 bp, Actinoplanes utahensis
atgacttccccataccccaccgcgcaaagtcagctcagcgccgaagccaaaaccttcaactggctgctggactccttcacgtccggaaccgcgggcgtgatcgaagccatcgccgtctcctcggacggtctgctgatggccatgtccgcgatcaaggaccggcccaacgccgagcggctggccgccgtggtctccggtctgaccagcctggccggtggcgctgccagctggtaccggctgggcgccctgaaccgggtcatcatcgacatggccgacggctacctgctggtcaccgcgatcagcgccggctcggtgctcggcgtcatcgccgaccggtcggcgaacctgggcactctggcgtacgagatgaccctcttcgccacccgggccggcggcgccctgagcccgcgtctgatcgccgagctgaagaacgccgtccagcaatga

SEQ ID NO: 3135 - DNA, 3531 bp, Actinoplanes utahensis
gtgacgtgtcggtccgggcgggtacctcggtgccggccggcaacccgacgggcagcccgtacgactcgatcccgaactacggcgacactccgaactacggcggcgggcgggagcgttccggtgctcttcggtaagttccgcatcctgggcaagctcgccctgctggtgctcgtgccgctgctgggtgttctcgccctgaccgtgccgatcatctacaaccgtgtccaggccgcgaacgaggcgcaggacacctcggacagcgtgcagctggccaccgcggtgagttcggcggtcctggagctccaggaggagcgcctgctgtcggtcggctacaccctgcacctggtcgacgagcccaccctggtggtgcagagcgccgaggccggcgagaaggtcgccgagctgctcgactccaaggaccgggtgctgccggccgatctgcgccgcgcggtgctgctggccaccaagctgaacagcacccggcagaacgtcctgaacggccagaccaacgccacctcgatcgtcaccgacttcaccagcgtcatcacgccgatgatcgacggcctcgggctgagcaaccactcggacctcaccaccaagaccggccagcaggtcttcgcgctggagcgctcgatgcgctccgacgacctgatcagccaggcctcctgctatctggcgtacgcggcggtgctgaaccaggcgcccaaccgcaaactgcggtccttcgcgccgcaggtgctgacgctgttcaacaactcgttcgcacagatccagtcggtgatcacccagtccaagggctacttcaccgacgcgcagtacaagctctacctgaacacccaggacgcgttccagtcccgggtgggctccggcttcgtcgacggtctggccaccaacccggcccaggcgctgaacaagctgccctcgatcacctcgctgttcccctcactgcagtccgtcatggtcctcggtggtttcgtcgagaagcgcgtggccaaggacgtggacgtggcggtcaccgccagccgtaacagcgccatccagcaggcgctgtacgtcggtggtggcgcgttcgtcctgctgatcctcgtggtcacgctctcgatcttcatggcccgcgcggtcgcccggccgctgcgccgcctgaccgcctccgccgaccgcatcgcccgcgccgccgaggccgagctggagcgggtggccgacgacgagtccgaggcccaggtgcggccgatccgactggatccggtcgacgtcgaggcccaggacgagatcggtgacctggcccgggcgttcgaccgggtgcagaccaccgccgcccggctggtggaacgccaggtgctcggccgccgtaacgtcgcccagatgttcggccacgtcggtcgtcgtacgcagaacctggtcggccgtcagctgtccctgatcgacggcctggagcgccgggagaccgacagcgaccgcctccgcgagctgtaccgactggaccacatgtccagccgtctgcggcggaacgcgtccgcgctggtcgtgctctccggtggcgcgggtgcgaacgagcacatggcgccgctgccgctgtccgacgtcgtccgtctcgccctcggtgagatcgaggactacacccgtgtcgaggtggacgtccccgaggagatcgtcgtggtgccggccatcctggccgacctcacgctgctgctggccgagctgctggagaacgccaccacgttctccccgccgcacaccagcgtcacggtctccgcggacgagctgcgcggtggcgcccgcctggcgatcatcgaccacggcctgggcctgcagcccgagcgtctggccgaggagaacgcccggctgacccgtcgtgagcgcctcgacctggcccccaccgaggtgctcggcctgttcgtggtcggccggctcgcccgccggcacggcatcgaggtcaccctcaccgacaccccggacggcggtgtcacggcctggatcgacctgagcccgcagcacctgatcgccagggtggagaatctggccgcccccggtatcccggccccggccgcggtgccgcagatcccgatgcagcgcgagccggtcgctcagcagagctacccgcagcagccgttcgagcagcagtacgggcagccggagtacgccgtgccggtcagcggggcgctgcgcggcaacaccgccgaggtggcgatcgccagcaccgcgatccgcaccgtcccgggcagccagcagccgttcgacccgaacaagctgagccgggccacccagacgctggagtcggtcccgtcctggaacgcgttcggcgggtcggtccccgcgcagccggccgtcgaggacccgtacgccggtcagccggtctacgatgccgagccggtgtactcgccgggcgtcgcctaccaggagccgagcgctccgtaccggcaggtggaggcgtcgcagggttacaacagcggcatcccggtggccgggcgcaacccggccgcgctgcccgaactgcccgccgccgggcagccggcctggggctccgatccggcgctgccggccggcccgtcctggagcggcaccccggccccgtcggagacctcgtggagcgtcccggagtccccggcgtccgggtggaacaccccggccccggcctcgccgtcgccggcctggaacaccccggccccggcctccccggcaccggcctggaacaccccggccgccgcctcggcggagccggcctggaacaccccggctccggccgagacccactggaacagcccgcaacagccggcggagccggcctggaacaccccggctccggccgtggaggcgccgatggctccggccagcaactcgggccacccggccccggctccggagccgaccgctccggaacccgtggtcagctcaccggccggcggcctcaagccgctgcgtcgccgggtgccgggcagccagctcccgatggactccggtcccaagcagcacgccgcggcgccgtcgcaggacgacgccctggccgcgcgggccgccttcgacgccttcgagcagggtgtcagccgggcgcacgagaccagcacctcgctgccggcgccggagttcgccggcggtcagtgggccatgccggcctcgctgccggaaatgcccgcgccgcagtggaacgtgccggcccccgccccggaggccgcgccgcagtggagcactccggcccccgccccggaggccgcgccgcagtggagcactccggcccccgtacaggaggccgcgccgcagtggaacaccccggagccggcccagcagtggaacgcccccgctccggccgcgccaccggccccggccgcgcccgcgccgccgctcggtggcggagggttgactcgccgcgtgccgggagcgaccctgccacgggacgagccgcaccaaccgattctcccgccggccccgaccctgatggacccggagcaggcacgcgcactgatggatcagttcgagtacggcgtcgcactcgccctgaatgaaactcagccacaacccgagggacaaccgcgatga

SEQ ID NO: 3136 - DNA, 1164 bp, Actinoplanes utahensis
atgtcagtctcggtgaacagccggcgaacccgtttacgctccgctctcgcggtgctgctgacggctcttgtcctgctgccggccgcgggcctgttcctgcgggtcctgcaagagaactcccagcagcgcgacaccgtccagctcgaacaggacggcgtcgagtacctgaccgtgctgggcccgctggtctcggcgctggccgagtcgcaggcgtcggcgctgcagggcgtcgccgcggagccggcctcggtgaccgcggccgtggcccgcgtgcagggtgtcgacgggcggctcggtgacgcgctcgagacgcacagccggtggagcgacctgaaggacaagatcgccaagctgccgaaggtgaccggcacctcggagcagatcttcacggcccacgtcgaggccgccgacctggccgtcgagctgttcgacgtggtccgggagaactccaggctcaaccgcgacccggaggccgacgtctcgttcctccaggaggtcgtcggccagctgatgcccgaggcggtcaccttcgtcagccggatgagcgactacgcgaacatggtccccgcggcccgcaccaaggcggacaaggcgaagctcaccgtgcagttcggctaccaggccctgaaggtccaggagacggtcgccaagctgaccgacagcctccaggaggcggtcgagagcaccaagagcaccaccctgagcggcaacctggtgagcaacctggactcgttccggcgcgggatcgaggccgccaaccgtggcgccaacatcggtggcgcgccgaacgtgtccacgctggtgaccgcgcagtcgaccctgcagaccgcgctgagcgcgctgagcggcgtcgtcctcaaggagatgtccggccggctcgacgaccggtccagctcgctgacctacaagcgcatcgaggccttcggcctgctcggcatcgcgatcgtgctgatcgtggtggccaccctgtggacccgcggccgcgcccgccaggtccaggccacgctggtcgagcccggccagggcagccgtgacgtgtcggtccgggcgggtacctcggtgccggccggcaacccgacgggcagcccgtacgactcgatcccgaactacggcgacactccgaactacggcggcgggcgggagcgttccggtgctcttcggtaa

SEQ ID NO: 3137 - DNA, 1671 bp, Actinoplanes utahensis
gtgggaagaattgacgaactcgccaaccgatacgtcgatgagtgggctgcgctgaatccgaccggagccaccgccgccggcatcaccggccacgacgaccagaccgacgacctctcccccgaggggttcgcggcccgggccgaactggtccgtcgcacgctcaacgacctcgacgtgaacgagccggaacacgagaccgagcaggtcgccaaggaggccatgcaggaacggctgggcctggaactggcccggctggacagcggcatcgcggccaccgaggtcaacgtgatcaccagcgccctgcacgagctgcggatggtgctcgacctgatgccggccgagggcgagcaggcggtggcgaacatcgtcacccggctggccgccttcccgcaggcgctgcggcagtaccggcggaccctgctggagggcgccgaccggggcgtggtcagcccgtcggtgcagctggccgcggtcgccgaccagtgtgccgcgtgggccgacccggaccgggacggcttcttccacggactggccggccggttgcaggcgtccggcgggctcgccgaggacctgcgccggggcgccgccgccgcgaccgccgccaccgcggacttcggccggttcctgcgcgaggagttggcgccccggggccgcgcgaaggaggccgccgggctggagcggtacacgctggcctcgcagtacttcctcggcgcgaaggtcgacctgctggagacgtaccactggggcttcgaggagctgcaccgcctgacccgcgagatgcaggccgtcgcggccgtcatcgccggtccgggcgcgtcggtggacgaggcggtcgccgcgctgaacgccgacccggcgcggatcatcccggacaaggagcggttccgggactggatgcaggcgctctccgaccgggcggtcagcgagctcaacggcacccacttcgacatcgagccgccggcccagaagctcgagtgctgcctcaccccgaccagcgacggcggcatctactacaccgggccgagcgaggacttcgcccgccccggccggatgtggtgggcggtgcccgccggccagcaggtcttctccacctggcaggaggtgaccaccgtctaccacgagggggtgcccggccatcacctgcaggtcagccagaccctgctgcgggccgaccagctgaaccgctggcggcggctgctggcctggtgctccgggcacggcgagggctgggcgctgtacgccgagcgactgatggacgagctgggatatctgaccgatccgggcgaccggctcggcatgctggacagccaggcgctccgggcgacccgggtgatcatcgacatcggcatgcatctcgaactggagatcccgcgggacaacccgttcggcttccacccggggtcccgatggacaccggagttgggctgggagttcctgcgggcgcactcccggatgcaggaggacgtgctgcgcttcgagtggaagcggtatctgggctggccggggcaggcaccgtcgtacaagatcggcgaacggatctggctgcaggcccgggccgaggcgaaacagcgcaagggcgccgatttcgacctcaaggcgttccatcgggacgctctggacctcggacctctcggtctcgacccgcttcgcagggcactgggcaggatttaa

SEQ ID NO: 3138 - DNA, 1059 bp, Actinoplanes utahensis
atggcatcccgtgacccggtcaccgacctgcggcgcatcgcgttcctgctggagcgggcgaacgaggcgacctaccgggtcaaggcgttccggtcggcggccgccgccgtggcccgcacccccggcgacgagctgaccgagcgcgccgcggccgggacgctcgccaagctggccggggtcggtgaggtgaccgcccggtgcgtcaccgagtcgctggccggcgaggagccggtctatctgcgccggctgctcagcatcgagggggccgacctgccggccgcggcggccgcgctgcgcgaggcgctccggggtgacctgcacgtgcactcggactggtcggacggcgggtcgccgatcgaggagatggcgctggccgcggccgacctggggcacgagtacttcgtgctcaccgaccactcaccgcggctgaccgtggcgcacgggctgacggccgagcggctccgccgtcagctcgaccacgtggcggcgctgaacgcccagctgccggacggcttccggatcctgaccgggatcgaggtggacatcctcgaggacggttccctggaccaggaggacgagctgctggcccggctcgacgtggtggtcgcctcggtgcacagcagactgcgcgacgacacggcccggatgacccggcggatgctgaccgcgatcgccaacccgcacctggacgtgctcgggcacatgaccggtcgcaaggtggccgccgccggggccggggacgccgcccaccggaccgcccggacccgcccaccgagcaccttcgacctggagaaggtgttggccgcgtgcgtcgagcacgacaaggctgtggagatcaactcccggccggaccggctggatccgccgaaacggatgctcaccgtggcggtcgaggccggctgccggttcagcatcgacaccgacgcgcacgccccgggccagctggactggctcggcaacggctgcgagcgggcggcgctgtgcggagtgcccgccgatcgggtggtcaacacctggccggccgagcggctgctggcctgggccgccgcccacgggtga

SEQ ID NO: 3139 - DNA, 1854 bp, Actinoplanes utahensis
atgcccaccgcgcttcgcgccgccgtatcggtcgtcatgctggccggtttctatctgctcggcctcgcccagctggtcctggtcggctggctgatcttcgagatctggcagcacctgcacggggcgggcgcggtcaagctcagctacctgctgctcgccgcggtcggcgcggtgctcgccgggctgtggcgggcgatccgggcgaagcccggccacccgcacggcctgatcgtcacccccgaccagacccccgagctgtggcaccaggtgcgccagctggccgccgaggccggcacccgggcgccggacgagatccggctggtgcccgaggtcaacgcggcggtcgacgaggagaccaggctgctcgggctgatcggcggcacccgccggctgtacatcggcatgccgctggtgcagaccttcaccgtcgatcagctccgctcggtgctcgcgcatgagctgggccactactccggctcgcacacccggctgtcggcggtcacctaccgcggtcggctcgccatgcacgagacgctgtccaacgtcggctcgttcaacgtgttcggctgggtgttcaaggcgtacgcctggctgtaccagctggtcagcagcgccgtcgcgcgccggcaggagctggaggccgacctcgcctcggtccgggtggccggcgtcgacgccgccgtctcggcgatgcgcgagctgcccgtggtcgacgcggcgtgggacttctacttcggccggtacatcggttacggctgggagctcggctacgccccggacgacgtgttcggcggattcgcccagctctaccaggcgcgcgccgacgagctggcggagatgcgtgaggccgagccggacgacgagacgtcccggtgggacagccacccggcactctccgagcggatcgccgcgatgcgcgccgcgccccgcacctcgcacgtgaccgacggccggccggccgcggtgctggtgcccgcggtcgagctggccggcatggcgctgcagcgcgaggtcgtcgacttcggcacccggaccgtgctgccctgggccgacttcaccgccgcgtcgatggcgatgcgcagccagaaccgggccgatcgggtgttccgcagcacggcccggcacgccggcgtgcccgaggccggcctgcccgaggtgttcggcctggtcgaggcgggccggctggccgacctggccaccgagttcttcccgcaggcgacccgtcgggaggcggtcgccgagttcgccgacgtgatggaaaccctgctcgggctcgccgcggtccgctccggcacggcccgctggcagcactcctggtccggcccggcccggctggtcgaccagaccggccaggtgctcgacctcggcgagatcgccaagctggcggtggtgccggagacgctggccgaggcccgcgcccggctggccgagcgcggcgtgcacgtggaagcggcccgggtggtcgaggccaaggccaccgggcagggcgccgacgtgctcggcgcggtgccgaacgtgaagctcgacggcggcgagcacgccgacctgatcgtgctggaccgcggcctgatcttcgtgccggcgccgaagtcgaccgacgacggggacaagcgggtgggtgtgctggtcgcgcagaactcggcggccgacctggcggcgcgctaccggtacgtcgcgtacgaggaggtgtccaccgtccggatcgagaaggagacgccgatcggtgcgacgctgctgctgcatgacggccggacggtgaccttccaggagcgctggagctcggaccggatgggtaggagcgtcgacgtgctgcgcaagatcctcggggagctgcaggagcgcgcggaccgctag

SEQ ID NO: 3140 - DNA, 963 bp, Actinoplanes utahensis
atgcggacgatcgactgggtggacggcgctgtcgagatcatcgatcagacggcgctccccggcgagctgcgggtgctgcgcctgcacaccgtcggggagctgatcgcggcgatccagtcgctggccgtgcggggtgcgccggcgctcggcgtggccggggcgctcggggtggcgctcgccgcccaggtgcacgccgacgatcccggggcgctggcgaacgccgtacgccggatcgaaaccgcgcgtccgacggcggtgaatctggcccgcggcgcgcaacgcgccgcggcccgtctgccgttcggaccggccgcggtgctggccgaggcctgcgtgctgcgcgatgaggagatcgccgcctcggcggcgcaggcgtcccgcggtgccgacctggtggccgagctgtgcggcgaccggccccggctgctcacccactgcaacaccggcggcctggccgcggtgaccgtcgggaccgccctcggcgtgatcggcgagctgcaccggcgcggcacgctgggcggcgtgatcgccagcgagacccggccgctgctgcagggcgcccggctgaccgcctgggagctcggccagtggggcgtcgagcaccgggtggcggtcgactcggccggcccgttcctgatggcccgcggcgaggtggacgcggtgatcctgggtgccgaccggatctgcgcgaacggcgacgtgatcaacaagatcgggacgtacgcgcacgcgctcggcgcccgccgggccggcctgccgttcctggtggtcgcgccggagaccacggtcgacaccggtaccccgtccggggcggacgtggagatcgaggaccgcggcgcggccgaggtgaccgcgtggagcgacgcggtcaacccggccttcgacgtcaccccgcacgacctggtcaccgcgatcgtcaccgaccggcgggtgatccggctggaccggggcgagaagccctag

SEQ ID NO: 3141 - DNA, 570 bp, Actinoplanes utahensis
atgcccggtcaggtcggacccatcagcggtgagcaggacggtctgctcagctttctcacccaggcgcgatacacgctcaaactgaccgcgtacggtctcaccccggaacagctgcgggccaccgcgagcgccagttcgctcagcatcggcggtctgatcaagcactgcgtctccaccgaggagggctggatcgccacggcgaccggcgccagccagaagccggacttcgcggcctaccacgagaacttcgtactcaccggcgacgagacggtcgaggagctcttcgcgcggtacgaccgggccgccgagcggaccgagaaggcggtcgccgagctcggcctggaccaccggatcccggtcgaccactcggtgccgtggaaccggccggacctcgaccacttcaccacccgctggatcctgctgcacctgatccaggagaccgcccggcacgccggtcacgccgacatcatccgcgagtcgatcgacggggcgaccgccttcccgctgatggcggccgccgagggctggccggagaccccgtggctcaagccctggaagaaggactcctag

SEQ ID NO: 3142 - DNA, 942 bp, Actinoplanes utahensis
atgcggatcgcggtcgtcggcctcggcctgatcggcggctcgctggcccgggccctgcgcgacgccggccacgaggtgtccggcttcgacaccgacccggcgacccgggagctggcccgggcggccggcctgaccgtgcccggctcggtcgcggccacggtcgccgggaccgaggtgacggtgctcgcggccccgctgccggtgctgcccgggctggtcgccgagctggccggttacgacggcgtgctgaccgatgtgacctcggtcaagggtccggtccaggcgctcgccgagcggcacggggtgcgccggttcgtcggcgggcacccgatggccggcaccgaggcgtccgggttcgccgccgccgacccgaagctcttcgagggctgcgtgtgggtgctctgtgtggagccggacggcaccgatccggccgactggctgatcctcgccgggctcttcaccgggttgggcgcgcgggtgctgccgatcaccgcggtggagcacgacaacgcggtcgcggcggtcagccacgtgccgcacctgctggccgcggcgctggccaccaccctggcgggcagcccgctgagacaggcgctggcggccggctcgttccgggacggcacccgggtggcggccacccgggccgagttgatcaacgcgatgtgtgcgggcaacgccaccgaggtgctccgcgagctgcagcaggtgatcagcgacctggtccagctgcgcgacgacctggccggcggcgacctgatcccgttcctggcggcggccggggagttgcggcgggcctggccgccgacgccgggctcaccgggccggacgaccgccgacgtgcgggcgctgctggcgctggggcggggcggcggctgggtcaccgccgtggttggcacggaattgaacaccatgcggccggaaactggccgcaatggcttctag

SEQ ID NO: 3143 - DNA, 639 bp, Actinoplanes utahensis
gtgcgaaaagcgttgacgatgatcgtggccctgggcctcgccgtggccggtgcgacgaccgcgtcggcggcggtcaccccgcggccggccccggcgccggcgccccgggtggtcccggcctggatgttcacctcgaagtacacgttcccggtggccgcctcgaacgtggcctggcacgacacccactccgcctacccggccaccgacatcttcgccgcctgcggctccacggtggtcgccaccgacaacggccgggtcctggagatcagcctggtcgacaggttcaggaagggcatgcccgacgggccgtacaacggcggcctgttcgtctcgatcctcggcaacgacggcgtgcggtactacggctcgcacctgagctcggtgaccaaggggatcgtgcccggcgcgctggtcaagtcgggtcagcagatcggcagggtcggccacaccggcaacgcgaacggcgtctgccacctgcactacgccatctccccgccgtgcgcgcagaccggggactggaaggtgcggcgtggcgtggtctggccgtactccttcctggcctcgtggcgcgggaacgggcagaagagcccggtcgacacggtggccgcctggaacaagtcgcaccactgcaaggcctga

SEQ ID NO: 3144 - DNA, 330 bp, Actinoplanes utahensis
gtgcgggtgcacggtctctacgccgggctgccaccgcgcccgatctatcgcgagccgcacccgatcggtgccggcccggtgctcagcggcctggcggccggcgcgctctggctgctgctgttcggcagcctcggccaggatctcacgtcgtacgcgtggtggacgatcggcgccgcggccgctgcctggctggtcgcgctggtcctgacccggctcggcgaccgcggggtggcgctcggcgtcgcctgctccagcggcatcggcctgtccgtcgcgatggggttcgtggccttccggtggatcgagacgttcaacttcccgctgtggtga

SEQ ID NO: 3145 - DNA, 204 bp, Actinoplanes utahensis
ttgacgaacgccgcccggctcggcactctcggcaccatggccacctcaccgcagcgtctcgacgcggatcgctgccgtcgccgactggaactgctggcggccctggcccacgccaaatcggtgcgtgagtcggcgccaccgcggcgggcccgcggcatgcgtctgcgcgagctgatcgccacccgtcgccgtaccacgaactga

SEQ ID NO: 3146 - DNA, 519 bp, Actinoplanes utahensis
gtgtcgattttcgctgccgctgtcgcccgtggaaagaacgggtggactgcgtcggagctggacctttcgggcctggccgacatcgacgaggtggtggatgcgctccgggatgccgagccggacgccggactggcgctgctgttcgtcgagagcgacgacgagtacctcgcgatcctgcgcctcgacgagggtgaggacctgcgggtcttcgggtccgactcggccttcgccgaggagtcccggatcggctcggtgctgctcggcgaggtggagacgccggcgctcggcgccgacgacctgaccgccggcgacaccgccgaggacgaggacgaccgcccggccgccgacccggacgccgacccgatcggcgacgccgacctgctcaacgatctgggggtcggcgcccagcggctgctggcgctctgcggccaggagggcatgctgccgtccgacatcaccgccgagatctgccagaagatcgggtgcggcgacgagatggaggagctgcgcgaggcgtga

SEQ ID NO: 3147 - DNA, 447 bp, Actinoplanes utahensis
gtgatccgtcgcgagcggcacgagcggtggatgcggcgggcgctgtccgtcgcctcctcgtcgccggccgacgtcccggtcggcgcgctcgtcctggacccggacggcgccgaactcgccgcggccggcaacgaacgcgagctgaccggcgacccgaccgcgcacgccgaggtgctggcgttgcgccgggccgcggccgcgcgcggtgcgtggcggctggacggctgcacgctggtggtcaccctggagccgtgcacgatgtgcgccggggcgctgatcctggcccggatcggcacggtcgtcttcggcgcctgggagccgaagaccggggcggtcgggtcactctgggacgtggtccgcgacccgcgtctgacccatcgcgccgaggtctacggcggcgtgctggagccggagtgcgccgagctcatgcgcggcttcttccgctga

SEQ ID NO: 3148 - DNA, 708 bp, Actinoplanes utahensis
atgagcgtgcacatcggggccaagccgggagagatcgccgaacgggtgctgctgcccggcgacccgatgcgggccaagtggatcgcggagaccttcctggaggacgcggtctgctacacccaggtccgcggaatgctcggcttcaccggcacctggcaggggcagcgggtctcggtgcagggctccggcatgggcatgccgtcggcctcgatctacacccacgaactggtcaacgagtacggggtgaagtcggtcatccggatcggctcctgcggcgccctggcgctcgacctgaacctcggtgacgtgatcgccgcgatcggctcggcgaccgattcgaacatgaaccggacccgcttcgacggcctcgtcgactacgcaccggtggccgacttcggcctgctgcgcaccgccgtcgacacggccgccgcccagggcgtcccgatccgggtcggcccgatcctggccgccgacgccttctacaccgaccggcccgacctgtacgactcgctggcccagtacggcgtgctggcggtcgagatggagtcggcggcgatctacacgatcgcggcccggtacggcgccaaggcgctcaccatcttgaccgtgagcgaccacatcaagcgcggcgaggcgatggactcggcgcagcgcgagcagggcttcagcaacatggtccggatcggcctggacacgatcatcgcctga

SEQ ID NO: 3149 - DNA, 420 bp, Actinoplanes utahensis
ttgcttcttctcggctccgccatcctcaccctcggcgtggcggcgtgtgacgacggcagcgtcgaaggtccgtacctaaagagcatcgagatacgagggcacgagcgggcgacgatctactacagccaagccgtctacgtcggtccttcgacgccgggcctacttgccgccgtgtctgcgccggagatgaccacgtcggctggcccggccagcctgtcaatcgatccgtgggagttcgtcggcagcggcagcggcaaggcggccgacggcacggactgccgggttcatttcgaacggcttgtcaagggaggggatcccaacgtcccgcactgggagcccacggccgagcaacgacgcaagcaggctaccggcgagttggagatcgtcagggtgtccgccggctgcccattcaaaccctga

SEQ ID NO: 3150 - DNA, 342 bp, Actinoplanes utahensis
atgcgggccaccatcaccgagcaccggcctgacgttgccgtgctgcaccttcgaggcgagctcgacgcggacacctccaacgagttgcgtgtcgtgctcgccgaactcctggaacgccccgtgcccaggatcgtggtggatctgaccgagctgaagttctgcgactcgatcgggttgagcaccttcatcatcagcaaagaggtgatcgtcgcccggggcggctggctcagtttcgcctcggccgatccgttcctgaccaagctgctgcggacggtcgggctgtcccggtacttcgcgatcttcccggaagtggacgacgcgatcgccgccggccagctgtag

SEQ ID NO: 3151 - DNA, 3528 bp, Actinoplanes utahensis
gtggctctcgccctctaccgaaagtaccggccgcggacgttcgccgaggtcatcggtcaggagcacgtgaccgagccgctgtcgcaggcgttgcgcagcggccggctcaaccacgcctatctgttctccgggccccgcggctgcggcaagacgtccagcgcgcgcatcctggcccgctcgctcaactgtgagcagggtcccaccccggaaccgtgcggcgtctgtgcctcctgcaggtcactggccaacgacggcaccggctcgatcgacgtgatcgagatcgacgcggccagccacggtggtgtcgacgacgcccgcgagctccgggagaaggcgttcttcgccccggccagcagccgctacaagatctatgtgatcgacgaggcgcacatggtctcgtcggccggcttcaacgcgctgctcaagctcgtcgaggagcctccggagtatgtgaagttcatcttcgccaccaccgagcccgacaaggtgctcggcaccatccggtcgcgcacgcaccactacccgttccggctgatcccgcccgccaccctgcggccctacctgcagcagctcaccgaggccgagggcgtcacggtcgagccggcggtcttcccgctggtggtccgggccggcggtggcagcgcccgggacaccctctccgtcctcgaccagctgatcgccggcgccggccccgacggggtgagctacgcccgcgcggtcgccctgctcggcgtcaccgacgtcgccctgatcgacgagatgtgcgacgcgctggccgccggcgacggcgccgccgcctacgagaccatcgaccgggtcgccgaggccggccacgaccctcgccgcttcgcctccgacctgctcgaacgccttcgtgacctgatcgtcctgcagcaggttccggacgcggccgccaaaggtctgatcgacggcccggccgaccagctcgaggcgatgcacgcgcaggcgtcccggctcggcgccgccaccctgtcccgcagcgccgacatcgtgcacaacggcctggtcgagatgcgcggcaccaccgcgccacggctcctgctggagctgatcaccgcccggatgctgctgcccggcgccgacgactccaccggggcgctgctccaacggctggaacgcctggagagacgaggcccgctcgacgccgccgggcccgccggggcgcaggccgcgcccgccgaggtacgcggtgacgacgccgcggtcgcgaccggctccgccgcgggtggggggccggtgctggacgggccggggggtgccaaggcggcggctctcgcccttgcgcggggtgctcggggtaaagccggtggtgctgcccgcccggtctctcccgctcccgcatccccggctgcggctcccgctgctgcggccccggctcccgctgctgcggccccggctcccgctgccgcggccccggctcccgctgccgcggctccggtcccggctgccgttcctgcgtcggtctccccggctgaggcggactggaaccgggtcgccgacgggccggccgacgtcgaggactacgacgacgcgccgccgtgggacgaggagcctccgccgccggtcgatcatgagccggtggtcgcctctgcgccgcttcccgccgagccttccggttcgcagcagccggcggcgggcccgaccccggcggttgcgccgcgggagcttcccgggctgccgcaggtgcgtaccgtctggcaggcgttcggtcccaagcacgacaagatccaggcgatgcagaacagcggcatcggcatccacgacgtcgacggttcccgggtcgtcttcctggccccgtcgcagcgctatgccgaccgcttcctcacctatcgcgaggtgatcatcgccgagttcaccaccgaactcggcggcgactgggacatcgactgccaggtcggcacccccacgccggaaaccgcaccccgcaactccccgccgcgcaccgccgcggcccccgcccggggctcggcaacaccggctcgcgaccagtccgccaccgcaccgcgtgaccagtccgccatccccccgcgtgaccagtccgccgcccgccgcgcggccccggagcggaacgccggccgcaccgagtcccgcccgtcccgcccgcagcgcaccccggccgacgccgacgacgacgggccaccagcggacgcgttcccgccggagcccaccgacgatccctacgccgagcccgcctacacgtcggctgtcggcggcaccgtcccgccggcgcccggcctccgggagcccgcgccgacgagacctgccggcgcgccgggcgatgccaccgtcccggcgctggccgtgcctggcggctccggcgtcagatccaccaccgcgccgacagctccccctgccatgccggcagcttcggccgccgcgcccaccgcttccaccgtcgcgccggcgaatgcggcggctgcctctcatgccgctccggtcagcggtgccccggcatcgcccgcggcacagcccgattccggcgggtcgtcgacaggtgtcacctccgccgcctctgattggccggagccggctcgtcccggttcgcgcccgtcgccgccgcccgccgacgatgactggcccgagccggtcaaacctggtagccgcgcacccgcaggcaactccggcccctccggatccgccacgaccgtcgagggtcaaccgaccgcaccggcttccgccgagcacagtgcggtcgggactccgtcccaccatgtagcgggccaggttcaccacgtggacagcagcggcgcggcatccggcggcccggctgtcgatgccgcggttggcggatcggcttccggtgccgtggtggggggatcggtttcgggagccgcggttggcgggtcgcattccggagctgtgcccgccgactcggatgacgagcccgcggataccggttcgccgtggcccaggccggccgcgcccgggcttccggtgacgatcgccgcccccgcggttcctgatgtggcccgtgccgcggctgacctcagcatgacggcgtcggcacaggcggccggcccggaccggaggacaccatcggctaccgcaaccgctgtgtcggcatccgccgccgcatccccgcccgcggtggcgcgtgccgcggcggcggtggagacgccggcggttgcccgctcggctgcgatggaggcggcgcgggccgctgcggcacgaagcgggaacgcgacgccgagcagtggtctggccgccgcgcgggcggccgccgctcgtggcgggggtggtgctccggtgcggaccgctgccggtccggggccggggggcgtcggcggcggctccgcgtggtcggacgggacgccgatcggtgaggcgccctacgaccccgagtacgacgggccgcccggcggtggtgccggctacgaggggttcgatccgggggacgagccgctggacgaggtcatcgacgagaagaccgcccgccagagcagcgaggagcaggccatgcagctgctgcgcgacgcgttcggcgccgagaagatcggcgagatgtag

SEQ ID NO: 3152 - DNA, 324 bp, Actinoplanes utahensis
atgcgccccggtgcacagccgaacatgcagcagctgatgaagcaggcgcagaagatgcagcagcaggtcgctcaggcgcaggccgagctggccgaggcggagctgaccggcacggccggcggcgggctggtgacggtgaccgtgaccggtctcggcgagttcaaggccgtcaagatcgaccctaaggcggtggacgccgacgacgtggagacgctggaggatctgctgctcgccgcgatccacaacgccgctgaggcgcagcgggagctggccgagcagaagatgggtccggccaccggcggcttctccctgccggggttctga

SEQ ID NO: 3153 - DNA, 594 bp, Actinoplanes utahensis
gtgtacgagggtgccatccaggacctgatcgatgagctgggccggctgccgggcgtgggcccgaagtcggcccagcgcatcgcgttccacgtgctttccgcggacccggtggacatcaaccggctgtccaccgccctgcgcaaggtgaaggaactggtccggttctgcaccacctgtttcaacgtggcggagtccgagcagtgccgggtctgccgcgatccccgccgcaccaacgaggtgttgtgtgtggtggaggagccgaaggacgtcgtcgcgatcgagcggaccggcgagttccgcggcaggtatcacgtgctgggtggggcgatcaacccgttggagggggtcggcccggacaatctgaagatccgcgagttgttgctgcggctgggcaccggtgaggtccgtgagctgatcctggcgacggatccgaacaccgagggcgaggcgaccgccacctacctggctttgttgatcaagccgatgggtatcgcggtgacccgtctggccagcgggctcccggtcggtggtgacctggagtatgcggacgagatcactctgggtagggcgttcgagggccgccgcgcgctctga

SEQ ID NO: 3154 - DNA, 1011 bp, Actinoplanes utahensis
atgtcgcttggcccagaagcgtcgatctctgacgacgctccgccgccaccggccgttgatgctgccgagacgcggggtcccgccgagaaggccatcgtcgggcgctccctcaagcagatcgcctggcgtcggctgaaacgggacaaggtcgcggttgccggtggcgtcttcgtcctcttcctgatcgccgtcgccttcctggcgccgctgctggccaagtggttcggtcacccgttcgacgagttccacggcgatcaggtcgaccagacattccagacgccgctcaagccgtggggcggcatcagcaaggacttcatcctcggtgtggagccggtgaacggccgggatgtgttcagccggatcgtctacggcgcgcagacctcgctgtcggtcgccttcctcgccgccttcttctccacgatcctgggcagcgtgttcggtctggcggccggttacctgggtggctgggtcgactcggtgatcagccgggtgatggacttcctgctcgccttcccccagctgctgttcgcgatcgcgctggtctcggtgctgccgcagtcgttcctcgggttcggcaaccgctggtcgcgggtgctcgtcctggtcctggtgatcggcttcttcggctggccctacgtcggtcgcatcgtccgcggtcagaccctgtcgctgcgggagcgcgagttcgtcgaggcggcccgcagcatcggtgcccgctcgccgcggatcctgttccgcgagctgctgcccaacctggccgcgccgatcctcgtctacacgacgctgatcatccccacgaacatcctcaccgaggcggcgttgagcttcctcggtgtcggtatcccaccgccgaatccgtcgtggggcggcatgctgtccgatgctctgccgttctacgcggacgatccgctcttcatgatcatcccgggcggcatgatcttcattacggtgctggccttcaacctcttcggcgacggcctgcgcgacgcgctcgatccgaaggctcggtaa

SEQ ID NO: 3155 - DNA, 1779 bp, Actinoplanes utahensis
gtggcaaataagacgaaggtgatggtggccgcggcggctgccctcacgctgggggtgaccgccgcgtgcggcggctcctccaagtcggacgacaagaagggctcctcggccgagggggcgggcttcaacgcggcggtcaccggggtggtcaacccgagtgacaaggccggcggcacgctgaacatgtggacgtcgcaggcgccggactcgttcgacccggcgatctcgtactacggctggaccatcaacatggcccggttcttcaaccggaccctgttggcctacgacgccaagccgggcaaggacggcctgaagctggttcccgacctggcctcggccgagccggagatcaccgagggcggcaaggtctacaccttcaagctgcgcagcggcctgaagttcgacgacggcaccccgatcacgtcgaaggacgtcaagtacggcatcgagcgcatcttcgcgcaggacgtcgtcccgggtggcccgctgtacctgcagcagctgctcgaccagggccagaagtaccccggcccgtacaaggacaccgacccgaacaagctgggtctcaagacggtccagacgccggacgactcgacgatcgtcttccacctggccaaggccgactccagcttcccgtacatgctggccctgccgggcggtggcccggtgccgcagaagcgggacaccggcgccaagtacgcgctgaacccggcctcctccggcccgtacatgttcgcgccgggcgccatccagccgggcaagagcgcgaccctgacccggaacccgaactgggacaagtccacggacccgatccgtaaggcgcttccggacaaggtcgtcctgacgatcaccacgaacgccgccgacatggacgaccgcctgatcgccggcaccgccgacatcgacgccgggcagagcggtgtgcagaccaaggcccgggccgacatcctgcgcgacccgaagctgaaggcgaacgccgacgctccgaacaccggcttcatccggtacgccgcgatgtcgaccaacgtcgcgccgttcgacaacgtggcctgccgcaaggccgtcatgtacgccgccgacccgaccacgctgcaggccgcccgcggtggcccggtggccggcggtgacatcggcaccaacatgctcccgccgaacatcctcggctcggacgtgaagtacgacccgtacaaccgggcgcagggcaaggcgcaggtcgaggaggccaagaaggccctgaccgagtgcggcaagccgagcggcttcgccaccaagattgcggtccggaacaacaagccggccgagatcgccaccgccaccgcgctgcaggcggccctcaaggccgtcaacatcgacgcctcgatcgagcagtacgacggctcgctcatctcgtccgtcatcggtgcgccgaacaacgtgcacaagaagggctacggcatcatgatcgccggctggggcgcggactaccccaacggctcgggttacctgcagccgctggtcgacagccgcttcctggtgccgaacggcaactacaacctgcccgaggtcaaggacccgtcgatcgacgggctgttcgaccaggccgccgcggagaccgacccgaccaaggccgccgatctgtacagccagatcaaccacaagatcatggacggcgcgttctacctgccgttcgtgttcgacaaggcgctcaactaccgcaacccgcggctcacgaacgtctacgagcactccgcgctcgccatggtcgacttccaggcgttgggcgtgagcgacggcaagtga

SEQ ID NO: 3156 - DNA, 1002 bp, Actinoplanes utahensis
gtgcttgcttacctcatccgacggctgatcaacgccgtcctgacgctgctcgcggtcaccctggtgaccttcggtgtcttcttcatggtgccgaagctcaccggtagtgacccggcgctgctgtacatcggcaagcaggccgaccccgtcgccgttcagggcatccgggagaagctgggtctcaacgacccggttctggtgcagtacggcaagttcgtgaagggcctcgtcgccggccgggactacaccaccggcgtcgaggtcacccactgcccggcaccctgcctcggctactcgttcaagaccgacgaggaggtctggccgaaactgctgggcgacctgccggtgacggtgtccctggcgatcggcgcggcgatcctctgggtgctgatgggcgtcatgttcggggtgatctcggcattgcgccgaggaacgttactggaccggacggtgatgggtgtcgcgctcgccggcgtctccctgccgatctatttcaccggtctggtcgccctgtcggtcttcacctacaaactcggctggctgaaggacgcggactacaccccgttcctggacagcccggtggactgggcccgcggcctgatcctgccctgggtcacgctggcgttcctgttcgccgccacctacgcccggctgacccgggcgaacatgctggagacgctcggcgaggactacgtccggacagcccgggccaagggcctcggcgagcgcaccgtgatcggcaagcacgcgctgcggtccagcctcacgccgctggtcaccgtcttcggcctggacctgggcgcgctgctcggcggcgcggtgctcaccgaggcggtgttcaacctgcgcggtctcggttacgaggcgctcaacggcatccggaccagcgacctcccgatcatcctcggcgtcaccctgttcgccgcgttcttcattgttctcgccaatctgatcgtcgacctggtctacggcatcatcgacccgcgcgtgcggctgggctga

SEQ ID NO: 3157 - DNA, 1023 bp, Actinoplanes utahensis
atgtcacgcccattcctcgaggtcaaggatttgaccgtccggttcgagaccgacgacggcatcgtgcaggcggtcagcgggtcgaccttcagcctggaggccggcaagacgctcggcatcgtcggcgagtccggctccggcaagagcgtcacctcgctggccctcctgggcctgcaccggacccgcagcaacgccaaggtcgccggcgagatctggctggacgacaaggaactggtcagcgcctccaacgaggaggtgcgggcgctgcgcggcggcaagatggcgatgatcttccaggatccgctgagcgccatgcacccgtacttcaccatcgggtcgcagatcgtcgaggcgtaccgggtgcaccaccccggggtgaacaagaaggtggcccgggagcgggccatcgacatgctcgcccgggtcggcatcccgcagccggcgcgccgcttccacgactacgcccaccagttttccggtggcatgcggcagcgcgcgatgatcgcgatggcgctggtcaacgacccgaaactgctgatcgccgacgagcccaccacggccctggacgtgaccgtccaggcgcagatcctggacctgattcgggatctgcaggaggagttcggctccgcggtcatcatgatcacccacgacctcggcgtcgtcgccgagctggccgacgaggtcctggtgatgtacggcggcaaggtgatcgagaagggcccggcggtggatctgttccagcgcccgcagcacccgtacacctggggtctgctcggctcgatgccgcggctggatcgcgaggtccgggaccggctcaccccggtcaagggcacgccgcccagcctgatcaacctgccttccggctgcgccttccacccgcgctgcccgtacgccggccgcaacggcgaccggtcgttcacggagactccggtgctgaccggcggggcccacgcggtcgcctgccacctgccgccggaggcgcgcgaaaagatcttccaggaagaagtggcccccaacctctga

SEQ ID NO: 3158 - DNA, 1038 bp, Actinoplanes utahensis
atgagcgagaacctgctcgaggtgaccgggctgcagaagcatttcccgatcacgaaggggctgttgaagcgccaggtcggcgcggtccgcgcggtggacggcatcgacctgaccgtgcaggccggcgagacgctgggcctggtcggcgagtccggctgtggcaagtcgacgaccggccggctgttcagccggatcctggagccgacggccggcaagatcgtcttcgagggtcaggacatcacccacaagtcggtcggtcagatgcggccgctgcgccgtgacgtccaaatgatcttccaggacccgtactcgtcgctgaacccgcggcacacggtcggctcgatcatctcggcgccgctgcagatccaggacatcccgacaccgcagggcctgaagaaggccgtgcaggagctgctggaactggtcggcctcaacccggagcactacaaccggtatccgcacgagttctccggcggccagcggcagcgcatcggcatcgcccgggcgctcgccctgcgcccgaaactgatcatcgccgacgagcccgtctcggcgctcgacgtgtcgatccaggcgcaggtcgtcaacctgctggaggacctgcagaacgagttcgacctgacctacgtgttcatcgcgcacgacctgtcggtggtccgccacatctccgaccgggtcgccgtgatgtacctgggcaaggtcatggagatcgcgccgcgcgacgagctctacaagaacccgcggcacccgtacacggtcgcgctgatgtcggccgtcccggtgcccgacccggtccggcgggaccgcgcgcagcgcacccgggtgctgctcaccggcgacgtgccgagcccgatcaacccgccgtccggctgccggttccgcacccgctgctggaaggcgcaggacatctgtgccacccaggagccgccgctggtggcgcggctcgacgacccggaggggcacctgaccgcgtgccacttcccgatcgcgcaggacgaggcggtcgccggtcgcaccccggcggcgacccaggcctga

SEQ ID NO: 3159 - DNA, 225 bp, Actinoplanes utahensis
gtgcccgggccgggcggggtgatgaccgacgaggtgggtgtggtcaccggtgacctcacgctgcgcaccgagctgaaggacggcgaggtgactctccgcgtgcagtacaaggacgcggacgagtggtacgtggtcaccgggggcaggtcgaaactggccgaccccacggacctggacgcggtgcactgcatcgctgtcgggctgctcaaccgccccgaggggtga

SEQ ID NO: 3160 - DNA, 663 bp, Actinoplanes utahensis
gtgcccccacgtaacacactgctcccgctcctgctcaccgtcaccctcgtcgccggttgccagaccgtcgacgccggctcgcccggcggcagcaccacgaccacgacccacgccaccaccgggtccggcgcatccgccggctcggtggtcaagcagctcgacggcctgaccgtcgtcgacaaggccggctcgatggccggttacagccgggagaagttcccgcactggaagagcaccggcaagaactgcgacgtccgcgactcggtgctggagcgcgacggcaccaaggtcaagaagtccggctgcaacgtggtggccggcacctggaagagcgtctacgacgacaagtcgctgaccgcaccgggccaggccgacatcgaccacgtggtgccgctggccaacgcgtggcggtccggcgccgcgaagtggaccaccgatcagcgcgaggcgttcgccaacgacctggaccggccacagctcgtcgcggtctcggcggcgtccaaccggtccaaaggtgaccaggacccgtccacctggaaaccgccggccaaggccgagtggtgcacgtacgccaccgactgggtaaccgtgaaggcgtactacaagctgaccgtgctccagaaggagaaggacgctctgaaggagatgctggagacctgttga

SEQ ID NO: 3161 - DNA, 1728 bp, Actinoplanes utahensis
atgtccaccttcgccgagaattcgcagcgttccagctcgatgcccttccagcggtacgagtcctatcagaaacagttcgcgatcgatctgcccgaccggcggtggcccggccgcgtcgtcgagcagaccccccgctggtgcgccgtcgacctgcgggacggcaatcaggcgctgatcgacccgatgtccccggaacgcaagcggcggatgttcatgctgctggtgaagatgggctacaaggagatcgaggtcggcttcccggccgccagccagaccgatttcgacttcgtccgccagctgatcgagcaggacctgatcccggacgacgtcaccatccaggtgctggtgcagtgtcgcgagcacctgatcgaccggaccttcgagtcgatccgcggtgccaagcgggccatcgtgcacttctacaactcgacctcggtgctgcagcgccgcgtggtcttcggcctggaccgggacgggatcaccgacatcgccacccagggcgcccggctctgccagaagtacgccgagatccacaccccggacaccgagatcttctacgagtactccccggagtcgtacaccggcaccgagctggagtacgcgctggaggtctgctccgcggtgatcgacgtgatcgacccgacgccggcccggccgctgatcatcaacctgccggccaccgtcgagatggccacgcccaacgtgtacgccgattcgatcgagtggatgcaccgccacctgccgcgccgggacagcgtgatcctgagcctgcacccgcacaacgaccggggtaccgcggtggccgccgccgagctgggcctgctggccggcgccgaccggatcgagggctgcctgttcggcaacggtgagcgcaccggcaacgtggacctggtcaccctggggctgaacctgttctcccagggcatcgacccgcagatcgacttcgccgacatcgacgaggtcaagcgcaccgtcgagtactgcaaccagctgccggtgcacgagcggcacccgtacgcgggcgacctggtctacaccgcgttctccggctcgcaccaggacgcgatcaagaagggtttcgccgcgctgcaggcggacgcggacgccgccggcaccccgatcgacgacttcacctggggcgtgccctacctgccgatcgacccgaaggacgtgggccgcacgtacgaggcggtcatccgggtcaactcgcagtccggcaagggcggcgtggcgtacatcatgaaggaggagcacaagctcgacatgccgcggcggctgcagatcgagttctccggcgtggtgcagcaccacaccgacgaggagggcggcgaggtctccccgcagcagatgtgggacatcttcgcgcaggaatacctggtcgagcaccagctgggcagcgccttcaagatcgagagctacagcacggccaccgtggacggcaaggtggagatcgacgtcgaggtgatccaccgggggatgcggcggccgctggtcggcgtcggcaacggcccgatcgacgcgttcacccaggcggtcgcgccgctcgggatcaaggcccgggtgctggactaccaggagcacgcgctgacctccggcggtgacgcccaggccgcggcgtacgtcgaggtcgaggtcggcgaccgcgccttctggggggtcggtatcgacgccaacatcgtcagcgcgtcgatcaaggcggtgaacagcgcgatcaaccgcgcccgctag

SEQ ID NO: 3162 - DNA, 792 bp, Actinoplanes utahensis
gtgcgccttccctccggatccgtccgcggcctgtccgcgctgaccgccgccctgctggccttcggcctggccgggtgcggcggtggcgacaccccggatgccgcgccgaccggctcggcgtccccgtccgcgtccaccgacccgaacccggacgcccgcaaccagctggccggcatggccgcgctggcgatggaccggcggtacgccgcgctctattcgttcaccggcggcgacggcgtcgcccgcaacgtggtggccaccgtggcgaacgacggcacctggcgggtggacatcgcgaacggcgcgctcggcggctcggcggacgtgtcgatcgtgcacaacccgaacggcgtctaccagtgcaccgtctcgatgtccggcgcgccgatcaacgccggctgcgtgcacgtggcgtccaagggcgagaaggtgccggccccgtacgacccccgggtgcagcgcctgttgcggcagtggctgccggtcttcaccgaccgcaacgcggccctcgcggtctcggtggcgcagccgctggacggcacgcagggctcggcgtgctactcggtcgattcgaacgccgcctccggggacgcgccggtcgacgtcggcgtctactgctacgccccggacggcatgctcaccgcggcccgggtgggtttcggcgtgctgaggctggtccgtcaggtggccgcgccgccgaccgtgcagttccccggcccggaggtgggcggcgccgcgatgggcatgtccgccgccgacccggtgcaggcgccgtcggccgcggccggctga

SEQ ID NO: 3163 - DNA, 1266 bp, Actinoplanes utahensis
gtggctctcgtggtgcagaagtacggtggttcgtcggtcgcgaacgccgagcgcatcaagcgcgtggccgagcggatcgtcgccgcccgcaaagccggccacgacgtggtcgtggtcgtctcggcgatgggtgacaccaccgacgagctgctcgacctggccaaccaggtgagcccgctgccgcccggccgcgagctggacatgctgctcacctcgggcgagcggatctcgatggcgctgctcgccatggcgatccacaacctggggtatgaggcgcggtcctacaccgggtcgcaggccggcgtgctgaccacctcggtgcacggcaaggcgcggatcatcgacgtcaccccgggccgcctgcgcaccgcgctggacgagggtgcgatcgccatcgtcgccggcttccagggcgtgtcccaggacaccaaggacatcaccacgctcggccggggcggctcggacaccaccgcggtcgcgctcgccgcggcgctgcacgccgacgtctgcgagatctacaccgacgtggacggtgtgttcaccgccgacccccggatcgtgccggacgcccagcacatcaagcagatcacctatgaggagatgctggagctggcggccggcggggcgaaggtgctgatgttgcgatgcgtggagtatgcgcgccgcttcaaggtgccgatccacgtacgctcttcgtactcgaacaaagaaggcacgctcgtcaccggctcgatggaggaccctgacgtggagcaagcactgatcaccggggtcgcgcacgaccgcagcgaggccaagatcacgatcgtcggtgtccccgacgagccggggtcggccggccggatcttcgagaccgtcgcgtcggccgagatcaacatcgacatgatcgtgcagaacgtgtcgaccgagggcaccggccgcaccgacatctcgttcaccctgccgaaggccgacggcccgaccgcgatgaccgcgctcgacaggatcaaggatcagatcaagttcaagagcctgctcttcgacgaccacgtgggcaaggtgtcgctgatcggcgccggcatgcgctcgcacccgggcgtcgcggcctccttcttcgcctgcatcggtgaggccggcgtcaacatcgagatgatctccacgtcggagatccgggtctccgtcgtctgccgcgacaccgacctggacaccgccgtccgcgccgtgcacgaccagttcgagctgggcggctcggaggaggccgtcgtttacggcggtaccggccggtaa

SEQ ID NO: 3164 - DNA, 1056 bp, Actinoplanes utahensis
atggggcggcccacgcttgccgtcgtcggagccaccggttccgtcgggaccgtcatgctcgacctgctctcgtcccggcgcgatgtctggggcgagatccggctgatcgcctcgacgcggtcggccggccggactctgacctgccgcggcgaaagtctccaggtgctgccaccctccccggaggtgttcgacggggtcgacgtggcgatgttcgacgtgcccgacgacgcggccgcacactgggcgccgatcgcggtgtcccgcggcgccgtcgtggtcgacaactcggccgtcttccggatggaagccgacgttccactcgtggtgcccgaggtcaaccgggaggcgctcgcccaccggccgcgcggcatcgtctccagcgccaactgcacggtcgccgcgatgatcatgtcggtggcgccgctgcacgacgagtacggcctgcgcgagctggtcctcgcgtcctatcaggccgcctccggcgtcggccaggtcggcgtcgacaccctgcacgaccagctcaccaaggtcgccggtgaccggctgctcgggtcccgcccgggcaacgtccgccaggccgtcggcgacgacctcggcccgttcccggccccgctcgccctcaacgtggtcccctggtccggcgacctcggcccgctcggctggtcctccgaggagctgaaactgcgcaacgagagccgcaagatcctcagcctgccggccctgaaggtctccgccacctgcgtccgcgtcccggtggtcaccggccactcggtcgccgtccacgccgtcttcgccgccgaggtcaccgccgacggcgcccgccaggtcctgcgcaacgcccccggcgtcatcctggtcgacgacccggaagccggcgagttcccgatgccgatcgacgccgtcggcaccgacccgtcctgggtcggccgcatccgccgcgccatggacgacccgcgagccctggacttcttcgtcaccggcgacaacatgcgcaagggcgcggcgctgaacacggtccagaccgcggaactcctggccgccgaactgaccacctag

SEQ ID NO: 3165 - DNA, 531 bp, Actinoplanes utahensis
gtgactgactccatcgacctcgcccgccaggtccgctccgtgagccgcctgaccggcgaattcaccctgcgatccggccgcaccgccaccgaatacttcgacaagtaccagttcgaggccgacccggtcctcctcgacaaactcgccgagcgactcgccgtgttgatcccggaaggcaccgaggtgctggccggcctggaaatgggcggcatcgccgtggtcaccgcgctggcccggcacgcccaactgcccaccgccttcgtccgcaaggaggcgaagaagtacggcaccgcccgcctcgccgagggcgccgaggtcgccggccggcgcgtgctggtcgtcgaagacgtcgtcacctccggcggccaggtcgtcatctccaccggcgagctccgcaagctgggcgcccacgtcgaccacgcggtctgcgtgatcgaccgccaggaggggggatcgcaggccctcgccgacgccggcatcaccctccgggccctgctgaccagggcggatctggacgcggcggcttcctga

SEQ ID NO: 3166 - DNA, 297 bp, Actinoplanes utahensis
gtgacgcccttcgccttgctcttcctcctcgccctggccggatcgacgtgcttcgcgctcggtcgggccttcggccgtggggagcgctacgagcgcggataccgcgagggattccgcgacggtgagaccgggtcgctggcccgggccacccggctgatgcaactcggtgaacggcagaccatcgcgccggtcgtggagaccatgctcggtccctactgcgtgccgcagcagatggcgccccgcccggtcggcccggcggtggccggagtgccggtccgcccgcagttcgccgtttga

SEQ ID NO: 3167 - DNA, 921 bp, Actinoplanes utahensis
atggacggagaaactacccttgccgtcatgcgtaagcgctcccttatttccgccgcggccgcgctggccgccgtcggcggcgccacgttcgcctatgccgccctcgtcgaacgcaacatgttcacgctccggcgcttcgacgtcccggtgctcgaaccggacgcggaaccgctgcgcatcctgcacctctccgacctgcacatgatgcccgaccagcggcgcaagcaggagtgggtggccggcctgagcggcaccgaccccgacctggtgatcgtcaccggcgacaacatggcctcgccgtacgcggtgcccggcgtgctgcgcgccctggaacccctgctcgacgtgcccggtgccttcgtcttcggctccaatgactacaccggcccggtctggaagaacccgctgcagtacgtgctgcccgagcgagagtacgtggagggcgccgacctgccctacgacgacctgcgcgccgccttcaccgacgccggctgggccgacctgaacaacgcccgcaccatcctcaaggccggcggccgctcgatcgagctggccggcgtcgacgacccgcacgtcgaccgcgacgactacccggcggtggccggcccgatcagcgccggcgccgacctgcacctcggcgtcacgcacacgccggcctcccgggtcctcgacccgatggccgccgacggcttcgagctgctgctggccggccacacccacggcggtcaggtctgcgtccccgggtacggcgcactgaccaccaactgcgacctgcccacccggctggcgaaggggctgcaccggtggccgggctcggacgcctggcttcacgtgtcggccggcctcggcacccacccgacggcgccgatccgcttcgcctgccgcccggaggcctccatcctgaccctgatcccccgctga

SEQ ID NO: 3168 - DNA, 480 bp, Actinoplanes utahensis
atgacggcaagggtagtttctccgtccatgggaacgctgaaagaccgcctgaacgatgacctgcacgccgcgatgaagtcccgggacgaactgaccacctcgacgctgcggatggccctgtccgcggtgcgtaccgcggaggtcgccggggacgaggcccgggagctctccgacgacgaggtgctggcggtgctgaccaaggaggcgaagaagcgtcgcgaggcggccaccgccttcgacggcgcgggtcgtgccgaccaggcggcgaaggagacggccgagggcgaggttctcgaccgttacctgccgaagcagctgaccgacgcggagatcgccgagatcgtgggcggggcgctggcggccggtggattcaccggtaaggcgcagatgggcccggccatgaaggcggcgcaggcggccgtggcgggtcgggccgagggcggccgggtggccgccgaggtgcgccgccggctcggctga

SEQ ID NO: 3169 - DNA, 2379 bp, Actinoplanes utahensis
atgcgcagacgcgatcacaacatcttcacgaacgccacctcgctgctcgtgtgcggcctgctggccggcgtggtggtggcggccgccgccttccccgcggcggcgatgtccggcctcgccgccaaggcgggcggggcaggcttcgcgagtctgcccagtgagatcaaagaattcagctccccgcagatcacccggatctacgcctccgacggccggaccctgatctcgcagttctacgacgagttccgcagcgacgtgccgctcaaggacatctcgaagaacatgcagaccgcgatcgtcgccgccgaggaccgcaagttctacgagcacaacggtgtcgacctcaagggtgtcgcccgcgcgttcgtgagcaacagccagggtgactcccagcagggcgcgtcgaccctcaccatgcagctcgtgcggatgtcgctggcctactcggcgaccaacccgcaggaggtgatcgacgccaccaaggacaccccgaagcgcaagatcaccgagatgaagtacgcgctgcagatcgagaagcagctctccaaggagcagatcctggagcgctacctcaacatcgcgccgttcggcaaccaggcgtacgggatctacgccgccagccaggtctactacaacaagaagccgaaggacctgacgatcggcgaggcgtccatgctcgccggcatggtgaaggcgccgaccagcttcaacccgacggtgaagagcggccacgaccagatccaggcgcgccgcgacaactacatcatccccggcatggtcgccatgaacgcgatcagcccggccgacgcggacaaggcgaagaaggagccgatcccgaccaaggtgaagccggtcagcaacggctgcgtctcggtcgcgaagaacagctggggcttcttctgcgactatttctaccgctggtggatgagccaggaggcgttcggcgccacgtcgtacgaccgcgagcggcggctcaagagcggcggctacaccgtgatcacctcgatggacctgaacggcaccgcctcggcccgcgccgagatcgcccagcgggaggccgacagcagccaggacgcgctgctgctggccggcgtcgagcccggcaccggcaaggtccggctgctcgccaccaaccggaagtactcgctggacgacccggaccacccgacgaacaagatctcgccggacccggccaagaagcgcaagaagatccgcgggtcgttcccgaagaccaccaacccactgatcaccggcggtggcgacatcgtgggttaccaggccggctcggtgttcaagatgttcaccatggtcgccgccctggagaacagcatcccgctgagctaccagatcaacgccccggtccgcttccactcgaagtacccggccggctacggcgagaaatccgcctgccccggcaccgacgactggtgtcccggcaactccagcaccaaggaggccggcgtctacaacatgtggaccggcttcggtaagtcggtcaacacgttcttcgtgccgctggagcagaaggtcggcgccgacaaggtggtcgccgtggccaagcggttcggcatccagttccgctcgacgcaggacatcaagaacgccaacaacgcggccaactggggcgccttcaccctcggtgtgatggactccaccccgctggagatggcgaacgcgtacgccaccatcgccggtgacggcaagtactgcgagccgaccccggtcgagcagatcaccaccaaggacggcgagaagatcgacgtcggcaagccgcactgcatccaggccaccaccaaggacgtggcgcgggccgcgctggacgcggcccggtgcccggtcggcgactcggcccagctgggcagctgcggcggcaacagcacggccggcaacacccacgacatcgtcggccacccggtgttcggcaagaccggcaccaccgacgccagcaagaccgcgtcgctgatcgtcggcaccacctcgctggtcgtcgccggttacatggccgacccggactggcccgaccacaacaacacgatgtcccacccggagatcaacgccacggtgcagtacacgctcaaggactacatgaagggcaagccgagcgttcagttcaagaccccgggcaacgacaagatctcgatcggcgacctgaagagcgtgccggacgtcacctgcgacccgctctccaccgccaaggacaagatcgagctggccggcttcgacccggtggagggccccagcgtggactcggactgcccggccggcaccgccgcgggcaccgacgaggaccgcacgatcaagggtggcgcggtgaccatccagatcagcaagggcaaccagggcaacccgaagcccggcaccacgaaacccgggcgatag

SEQ ID NO: 3170 - DNA, 303 bp, Actinoplanes utahensis
atggggatgatcagcgactggcccagcatggcggcgtgtcagagtggcgaccctgacgcgctgttcgtgcagggcgccgagcagaacgtggcgaagaggatctgccgcagctgcccggtgcgctacgaatgcctcgcggacgccctggacaaccggatcgagttcggcgtctggggaggcatgacagaacgggagcggcgtgccctgctgcgccgccacccgcacgtggcgagctggcggaagatgttcgaggccgcactgaaggagaagggcgccgacaaggtgctcgtctccacccgctga

SEQ ID NO: 3171 - DNA, 1110 bp, Actinoplanes utahensis
gtgaccgctccccggctcgacatcgacggcctgctcgccgatccggccatccggatcgtggtctgctgcggctccggcggggtcggcaagaccaccacggccgccgccctcggcgtgcgcgccgccgaggtgcacggccgccgcaccgtggtgctcaccatcgacccggcccgccggctggcccagtcgatgggcctgaccgagctgaacaacacgccgcggcaggtcaaggacatcgagggcggtgggctgtacgccatgatgctggacatgaagcgcaccttcgacgaggtggtcgagcagcacaccaagccggagcgcgccgccgagatcttcgcgaacccgttctatcaggccatgagctccaccttcgccggcacccaggagtacatggcgatggagaaactgggccagctgcgggccggcgacgagtgggacctgatcatcgtggacaccccgccgtcccggtcggcgctcgacttcctggacgcgccggcccggctgtcccgcttcctcgacggccggatgctgcgcatgctgctcgctccggcgcgcggcggccgcagcatgttcagcctggtcaccgcgtcgttcgggctgttctcccgggccgtgcagaagattctgggcgcccagttgctgaccgacctgtcgggtttcgtggcggcgctcgactcgatgttcggcggcttccggcagcgggccgaccagacctaccggatcctgcaggacccgcagaccgccttcctgctggtcgcggcgccggagcgggacgccatccgggaggcggcgtacttcgccgagcggctggtcgccgagcggatgccgctgtccgggctggtgctcaaccggatgcaccggaccgagccggccggcctgtccgcggaggcctcgctcgcggcggcgcagcagctgtcggcggacgccccgctcgcggcggacgtgctgcgcatccacgccggcctgctccggcagagcgagcgggaggtgcgggtcgcggcgggcttcaccgaggcgttccccgaggtgccgacgacctcggtcgcggcgcagcccgccgacgtccacgacgtcgacgggctgcgaacgataggcgctcttctcgcctga

SEQ ID NO: 3172 - DNA, 963 bp, Actinoplanes utahensis
atgggcgagcatcacggcaactggccggagcgactgcacatcgtgaccggcaagggcggcaccggcaagaccagcgtcgccgccgcactggccctgggcctggccgccggcggccgccgcacgctgctggtcgaggtggagggccggcagggcatcgcgcagctgttcgggctgcagccactgccctatgcggagcgccggatcgccaccaccaccggcggcggggaggtgcgcgccctgccggtcgacccggaggaggccctcctggaatacctggacatgttctacaagctcggcgcggccggccgggcgctgcgcaaggtcggcgccatcgacttcgccaccacgatcgcccccggcctgcgcgacgtgctgctcaccggcaaggtcaaggaggccaccacccggtcgcaggacggccgccgggtgtacgacgcggtagtcctggacgccccgcccaccggccggatcggccgcttcctgaacgtgaccgcggaaaccgcccggctggccaagatgggcccgatcaagacccagagcgacggggtgtcctcgctgctgcgttcgccgatgaccgcggtgcacgtggtcacgctgctggaggagatgccggtgcaggagaccctggacgcggtcgacgagctgaccggcctgggcatcccggtcggccggatcatcctgaacggcgcccgcccaccgctgctggccgccggccgggtgaccaaggcggagatcaagcgcggtctggtggcggccggcctgcccgccaccccggccaccgtcaatcagctggccgccgaggcgcaggcccacctgacccggcgggagctggaggagtccctgcgccacgacctgaccgaccggcgccggccgatgatcgagctgccccagctgcccgacggggtggaccgggccggcctggatgtcctggccggccggctgatgaccgacgccctactctga

SEQ ID NO: 3173 - DNA, 594 bp, Actinoplanes utahensis
gtggcacgcccggcacgagaaacccggcgaatggcggcacccccgcccgagcatctggcctgggagcactccccaccggccgaggtgccgccgcccgagccggagccgatctgggtgagcacgccgcccgccccgatcgcccgtacgccccggtcccggcgctcgacgatcttcctgtccgtggcgctggccgccaccctggcgctctgtggcggcggcgcggtctcggcgtacgtgatgttccgggacgccgacctgcccggctcaccggacccggccaccgcggtcaaccggttcctcaccgccgtctacacccagcacgacgcgaccgccgccgaggacctggtctgccgcaggtcccgggaccgggccaagctcgccgaacgggtgcagcagatccgcgactacgccgacgcctacgagggtgccggcttccgctgggacgaccccgcggtgaccgccggcaccggcagtgaggccgaggtcggcgtccgtgtggtgatgtccaccgaggacgagaaaaccgctgctcaggacctgcagttcacggtcgtgcacaagagtggctggctggtctgtgacgtctccggctga

SEQ ID NO: 3174 - DNA, 912 bp, Actinoplanes utahensis
atgctcgggcgggggtgccgccattcgccgggtttctcgtgccgggcgtgccacggcccctccgggggtggctggtgccagccgccgaccaccggatgttccatcgtggccgcctccgggagggcgtgccggccgcgctccggctcgggctccgtcacgtcactccccgcactggctcgtgtgctttccgtggcctttcccgctcagcctaaccaaccggtcggttcgccgggtcctaagctgtgccggtacccgacgaaggagtgtccgagccatgcagaagtgggagtacgtgaccgtgcccctgctggtacacgcgaccaagcagatcctcgacaactggggcgaggacggctgggagctggtccaggtggtaccggggccgaacccggagcagttgatcgcctacatgaagcgggcgaaatcgtgaccacgccgatcgccggcgacggtggcgtggacgcctacgcgaaactggccgagctgggcctgaccctgccgaccgtggtcccgccactggcgtcctacgtgccggcggtccagtccggcaatcatgtgtacgtgtcgggccagctcccgatggtcgacggcaaactgccgcggaccggcaaggtcggcgacgaggtgaccgtcgagcaggcggccgagctcgcccagatctgcgccctgaacgcgctggccgcgatcgaggcgctggtcggcctgggccggctcgtgaagatcgtgaaggtgaccggcttcgtcgcttcggcgccgggcttcaccggtcagccggccgtgatcaacggcgcctccaacctgttcggcgaggtgctcggcgagcaggggcggcatgcccgcagcgcggtgggggtgaccgagttgccgctgggcgcgccggtggaagtcgaggtcatcgccgaggtggcgtga

SEQ ID NO: 3175 - DNA, 810 bp, Actinoplanes utahensis
atggggggtgctgagcccgcgtcggctgaggtcgaccggctgccgggttgggtgtcgctgttgcgcgcccccaacccgggcccgatgaccttggacggcacgaacacctggattctgcgggcacccggcgccgacctggcgacggtgatcgaccccggtccgctcgacgaggggcatctacgccggatcgccgagcggggtccgtatcgatcgatcttgatcacgcacggtcatcatgatcacgtggagggcgccgcccggctcgccgggatgctgggcggtgttccggtccgggcggccgacccggagcacggtgcgggtttcgacccacgcgggagcctcgacgggaacggactcgaaatacaggtcctgcagactcccgggcacaccggcgattcggtgtgtttcctcgtcgggtacgggggtgagcgggtgatgttcaccggcgacacgatcctgggccgcggcaccacggtggtggccgcgccggacggcgacctgggctcctatctcgcgagtctggagctgctcacggcgtacgaaagcgtcccgatgttgcccggccatgggccggcccgcagcgacacagcggccctggcccgcgactatctgcagcaccgcagggagcggctcgcgcaggtcagagcggcgatggccgccggcgcgcggaccccggaagcggtggtcgacctggtctatccggacatcgacccgcgggtgcggttcgccgccgagtggtccgcggccgcgcagatcgatcatctgatccgggaatcagcggcgggggccgacggtttggaccggctgtga

SEQ ID NO: 3176 - DNA, 3567 bp, Actinoplanes utahensis
gtgtgtggcaccgtcgccgttcccggtgcgcgcttctgtcaccactgcggcgcggcactgccggctgccgccgcgatgccggccgccgagcgccggatcgtcaccgtgctcttcggcgacctctccgacttcacctcctggtcggaggacctggacccggagcgggtcggcgcggtcaccgaccgggtgctggcggcgctggccggggcggtcaagacgttcggcgggcacgtggacaagctgaccggcgacggaatcatggcggtcttcggcgccccggtcgcccacgaggacgacgccgaacgggcggtccgggccgcgctgagcatgcagcgcgcggtccgccgggtgctcgacgacgagcgtggcggtggcgcgccgctcggcctgcgggtcgggctgaacaccggcgaggtggtcgccggcatgcaggccggcatcgaatacacggtcatcggcgacacggtgaacaccgccgcccggctggccgacgccgccgcggtcggcaccgtctacgccggcgagcggaccagcaacggcacccggcacgtcgcctcctggcggcagctgcggccgctgcggctcaagggcaaacgcgaaccggttccgacgtacgagctgctcggcctgcacgacgccccgggcacccggtccggcctgggcgacgaggcgccgttcgtgggccgcgaggcggagctgggccgggtctccggccggctggccgaggcgatcgacgccggcgccccacgggtgctggtgatgaccgccgaggccgggatcggcaagtcccgcttcgccggcgaggtgaaacggctggccgccggcttcgaggcgggcggcgtccgggtcctgcgggtgcgctgccgggcgttcggcgagcgccgccgctacgcacccctggccgacctggtccgcaaggccgccggcctgcccaaggacgtggtcgccacggtcggccgcacggtcgtcgaggagcgcctgcgcaaggtcgcccagcggctcggcgtcaccctggacatcgaccggctgctggttctgctgggctacggcgaggccccggtcaacccgggcggcccggccgcgcccgccgactggccgccgagcgccaagcggatcgacgccgaggccatctcggtcgcggtcgccgacctgctcaacgcgatggccaccagctcgccgctgatggtgatcgtggacgacctgcacgacgccaccgccaccacggtggacgcgttgggcagcacgctgtcgcagctggagggcccggtcgtggtgctgctgctgggccggcccgagctggtccgcaccggcgcgctgagccgggtcgccgacgccgaggtgcacaacctgccgccgctgcgcggtgcggacgcgtcccggctgctcacctcctatctcaacggcggcaagctgccccagccggacaccgaccggttgctggccaccgcccagggcaacccgttctatctggccgagatggtcaccctgctgatggagcgcggcgcactgacccccgcggtgggcgccaacgcggccggcaagtggcagctcgccgccggttcgctcggcagccagctgctctcccgcgacctggcggcggtgctcgcggcgcgcatcgacgcgctgccggccgagccgcggtcggtgctgcgtgacgcgtcggtggccggcaccaccgtgccgaccggggtgctggaggcgctgcaggaacgccgcgcccccggggaggacctcgagccggccatcgacgagctgctgcaacgccgcatgatccaccgcagccggggcggcttccagttcaccaccccgctgatgcgcgaggcggcctacgccgggatcggcaaggccgacctggccgagcggcacgcccatctggcgacctgggccgcgccggagacggtcggccggcacgccgacggggccacccggctgcccctgaccgacaacgagcgggacgccttcgtggccgcccatgccgaggccgcgatcgagctggccgacgcggtacgcctgcgaccggacgcgaccgcccgggaggtggccgccctgggccgggccgcgctcggccggatggcccggcgtgcgctggccaacatcgagccggccgccgccatcgagtacgccgagcgtgccaccgcactgaccggcaccgacctgccgctgcccgaccaactcgtcctggcccgggcgatgctgcggctgggccgggccgaggaggcgctggcgtatggggagaagatcaccaagagcgccgccgaggacccggtctgccgggccgaggcgatgatcgtggtcggccgcgcgcacgaggcgctgggcgacggcggccgcgccgtggccgcctggcaggaggcgctggaggtggccaccgaggcgcagctgctgccggagcgggccaacgcgatgcgccggctcggcatggccgacttcctcaacgggcggctgagccaggcgagcagccggttcgccgccgcctaccaggtcaccctggccgccggcgaccggcacggccaagcctgggcgctgcagaatctcgcctgggtgaccaccacccggggcgacttcgccggcaccgacgcggtgctgggccgggccgcgcggctcttcgccgagctcggtgacccggtgggccggtcctggctgcgcggcaccacggcgttcgcccggctgctggccggccggctgcaggaggcccgtcggctggcccggatcttcctgcccttcggcgaccgggtcggcgagggctgggcggtcggcacgctgcgggtcgtcgaggcctatgcggcggccgagctgggcgacctgggcgcggccgacagccaggcccgccgggcgtaccgggagttccaggaggtctccgacgactggggttgcgggctggcgatggtggtgcgcggggcgatcgcccgcgggctcggcgagttcgaccacgccgccgacctgctcggcgacgcgctctggttcgccgaccggaccgggcacccgctgctgctcgggatggccggcacgttgcacgggttcgtcgcgctgcagcagggcgacctggccaccgcggaggccgacgcccgccgggtgatgaccgcggtggagccgcacaactcgctggcgccggcccaggtcggcccgcgggtgttgctcgccgaggcgcggacccgggcgggtgacccgcagaccgcgatcggcctgctcgcaccgatcgccagcgacacgtcgtccccgtcgctgctgttctcccggcggcacgcgctcgcctcgtacgcgtcggccctgctcgccgacggccgggtcgagtcggcgctgacctggatcgaacgcgcccgtgaggtgcccgccgaggacgtgcgcagcggggtgatcgcggcgatggtccgggcccgggtgctggccgccgccgaccgctgcggggaggcccgcacggcggccgaggacgcggtccggctgtcccgttccaccgagcagaccagtgagcgcgcggcggccgcggagctgcgggacactctcgcgatcaccgaggtggaggcgactccggcggaaactgtcgcgtacgcgtctgacgtgcccggatga

SEQ ID NO: 3177 - DNA, 981 bp, Actinoplanes utahensis
gtgacggagacaccgcctggcgccctgcccgtgccatatgtcccgggtatgtccggcttgtcggtcatggcccgtgggggatacgcgaccgtttaccgggccacccaggactccgtcgggcgcgaagtcgccatcaagatggagaacaggaccctcgacaacgctcgtgaccaggcccgattcctgcgggaggcgcgcgcggccggccgcatgtcgtcgcacccgcacgtggtggacctgttcgacgtcggtgtcaccgtcgaccagcacccgtacctgatcatggagctctgcgacgggtcgtacctggaccggatgcgggtccgcccgctcaccgccggcgaggcccgcgacgtcggcgtgaagatcgccgacgcgctggtgcacacccacgccaacggcgtgctgcaccgcgacgtgaaaccggccaacatcctgtattcgcagttcaacgcggcggtgctggccgatttcgggctcgccgtgctcggcgagatgcgcgactcctcggtcaccctcgaagtgctcaccccggcgtacgcgccgcccgagatgttccgccatgagcagccgtccggggccgccgacgtctactcgctgtgcgccacgctctacgccgtcatgtatggccgtccggcccgctggcccagcgatcgcagtccgagcctgatcagcctgatgaacctgttcgacgagccgatcccggagctgcccggcgtgccgcgggccctgaccgcgctgctgcgccgcggcatgcacaacgacccgcggggacgtccgtcggcgcaggagctgctccaggagctgagcaacctgcagctcgagccgggggcgccgcagcagaacgtctaccggtcgacatccacctatgtgccgccgccgcgaccacggccgattccgccgacgacgccgacgctcgacgaaaccccgacggtcgcgaccgaccggaagggattcttcgccaagtggttcagccggtga

SEQ ID NO: 3178 - DNA, 2004 bp, Actinoplanes utahensis
gtgatccgacgtctcttggtggccgaccgtggcgagatcgctcgccgggtgttcgccacctgtcgcctggtcggcatcgagacggtcgccgtctactcggacgtcgacagcgacgctccgcacgtcaacgaggccgactacgccgtccacctggaaggcagcaccccggccgcgacgtacctggaacagcacgccctgatcgcggcggccaagcgggccggggcgaacgcggtgcacccgggcaacgggatgctggccgaggacccggagttcgccgccgcggtgagcgacgccggaatgatctgggtcggtccgccggccgcgacgctgcgcaccctgcaccgcaagaccgagaccaagaagctggtggccgaggcgaaggtgccggtgctgcccagcttcaccgacccggagacggtgcccggcttcccggtcctgatcaagcccgacaccggcctcgggggcgccggcatgcgggtggtgcgggacgccgcgacgctggccgaggcggtcgcgtcgacccgccgcgaggtggacggcgacgtgttctgtgagccgtacgtgcccaacgtccggcacatcgaggtgccgatcctggccgacgcgatgggcgcggtggtgccgttcggcgagcgcgagtgctccgtgcagcggcgctaccagaagatcgtcgaggagaccccgtcaccggcggtcgacgccgcgctgcgcgaggacctgtgccgggccgccatcgtcgcggtccgggcgctcggcttcgtcggcgccggcgcggtcgagttcctgctcgacgcggacggcgacttctggttcctggaactcaccccgaccctgcagaccgagcacgcggtcaccgagtgcacctccgggtacgacctggtccggctgcagctgctggtcgccgagggcggcagcctgccgatgcccggcccgccgccgatccgcgggcacgccatcgaggtgcggatctgcgcggaggatccggcgtacgcctggctgcccagctccggcaccctgcaccggttcgcggtgccggacgtggccggcgcgttccgcccgctgccgcagcccggcctgcgcctcgactcgggggtagcggacggctcggtgaccggtcagcaccacgaaccgatgctcgccaagctggtcgcctgggcgccgtcccggcaggaggcggcccggatgctggcctccgcgctggcccgcgcccagctgcacggcgtggtgaccaaccgcgacctgctggtccgcacgctgcggcatcactcgttccgggcgggtgagatcgacaccggcttcctcgaccggcaccccgaggtgttcgccccgctgctctcctcggtcgacgcggtccggctctcctgcctggcgtccgcgctggccggggcggccgatcggcgggccagcgcgccggtgctgggcactctcccgtccggctggcgcaacgtcccgtccggctcgcagaccgcggtctacgacggcccgaccggcccggtcgaggtcggctaccggatgaaccggcacggcgaactcgccggctggtgggtccggccggtcgacccggaggagctggacctggccggaatcggacaggcgccggtcgacgagcacccgccgatcgtggtggtgtcggccagccgtgaccgggtggtgctcaacgtccagggcatccgcctcgcggtcctcgtgcaccgggtcggcgacgtctcctacgtcgacagccctgaggggtcggtgacgctgcgcgagatctcccgcttcccgctgcccgcgccggaggccggcgagagctcgctgatcgccccgctgcccggggcggtccgtcgcgtactggtcgttcccggccaacgggtccgggccggggagctgctgctgacgctggaggcgatgaagctggagcaccccgtccatgcgccatcggccggcgtcgtggcgtcgcttccggtgcatccgggggccgaggtggccaccggcgagctgctcgcggttctcgacccagagtag

SEQ ID NO: 3179 - DNA, 1368 bp, Actinoplanes utahensis
gtgaccgtgctcgacaccacgctggatccgcgcgaccccgcatacctggagggtcgcggcaccaccctgcaatggctcgccgcgctggaggtcgccctcgacgaggcgcgcgccggcggcggcgagaaatgggtgacccggcaccacgcccgggggaaactgttgccccgggaacgcatcgagatgctgctcgatcaggacagtccgttcctggagctgtccccggtggcggcctggggctcggagttcccggtcggggcgagcgtggtcaccgggatcggcgcggtcgagggcgtcgaatgcgtggtggtcgcgaacgatccgacggtggacggcggggcggtcaacccgtacaccgcggaaaagatccgccgggccgcgcggatcgcctcggagaatcggttgccgctggtcaacctggtcgagtcggccggtgacgcggccccggccgggagcatcgcccgggagttgagccggctgaccgccgaccgggtgccgaccgtctgcgtggtgttcggcaccaccagcggcgacgcggcgtacctgccggcgctctcggactacacgatcgtggtgcgcgggcacgccaaggtgctcaccatccatccgcagcggtccggtgtcgaggtgcgggccaccccggtggtgccgtccgggccggccggccccgccgaccagctcgccgaggacgaacgggacgggctgcgcctggcccggcagtgcgtgcgccggttcaactggcgcaagcagggcccggcgccgcgcaaccgtcagccgcgcgagccacggtacagctcggaggccctgctcagcctggccgcggccggctcgaacttcgagccgcgcgaggtgctcgcccggatcctggacgactccgacttcgacgagttcaaacccggccagggcagcgtgctggtggccggctggggcgagctgcacggttacccggtcggcgtgctggccagcccgggcatctggctgtctcccaccgaatcccagaaggcggtgcatttcctgcagctggccaacgccaccgccactccggtgatctttctgcggcatcccggtgagacgaagggcagcgacgacgccgacgtccgcaacgatgcccccctggtgcatgccatcgccaaatccacggtgccgcacctggtcctcaccgtcggtccggagcccggtggcaccccggcccgcgccgaccagccccggttccagttcagctggccgcgtcccccggcggatcgcgccgcggccgacgacggcgtcatcgacccccgcgacacccgcacggtcctcggcctctgcctgtccgcagtgcacagcgccgccgtggcgggtgccgaacacgtcggcgtgttccgaccttga

SEQ ID NO: 3180 - DNA, 678 bp, Actinoplanes utahensis
atggatgaggtactggcgcgcagcgggatcttccagggcgttgacccggaagccgccgaggcgctcgccaaggagatggacacgatcgaagtccgcaagggcgacgtggtcttcaacgagggcgaggccggcgacagcctgtatatcgttctgtccgggaagatcaagctcggtcgacgagcggcggacggacgacagaacctcgtctccatcatgggaccgtccgacatgctgggcgagctgtccctcttcgacccgggcccgcgcaccgcgacggccaccgcggtgaccgacagccggctcgcccggctgaagaagtcgtcgctgcgcccgtggctgaacaaccggccggagatcgccgagcagctgctccgcgtgctggcccggcgcctgcggcggaccaacgacgcgctggccgacctgatcttcaccgacgtgcccggccgggtggcgaaaaacctgctgcagatggccggccggttcggcacccgggacggtggtgtgctgcgcgtcacgcacgacctcacccaggaggagctggcccagctcgtcggcgcgtcccgcgagacggtgaacaaggcgctggccgacttcgcctcccgcgcgtggctccggctggacggcaagagcgtcatcatcctcgatccggagcgtctcgcccggcgcgcccgggtctga

SEQ ID NO: 3181 - DNA, 1179 bp, Actinoplanes utahensis
atgaattcgcaccccccgacccaccgcgacagcggatctgggcgatatgccctctatataaccctggtcggcgttgtcgtggccggcgccgccatcggcgggtatgcgctggtcaaccgggggaccgaggccgacgcgagctggcagtcgccggcgccgaccagggccgcggctgcccggaccgaatcgacccgcgcggcggcagccgccaccgcggtcaccttctcggccaccggcgacatcatgatggccaacgcgccgggcggcctgccgccgaacaacggcaagggattcttcgacccggtacgccgcagcctcgccgccgacctggtgatgggcaacctggaacagccgctcaccgaggacaccggcacctccaagtgcggcaccccggcccgggccaactgcttcgcgttccggtccccgccgtcctacgcccaggtgctcaaggccggcggattccagctgctcaacacggcgaacaaccacgccaaggacttcggcccgaccggcaaccggaacaccttccaggcactcgacggcgccggcctcaggtacaccggcgcgcaggaccagatcaccgtggtcccggtcaaaggcctcaaggtcgcggtcgtcggcttcgcgccgtacgccggtgtcaacaatctgaccgacctgacccacgcccgcagcctggtcgccaaggcccgcagccaggccgacctggtcgtggtgcaggcgcacatgggcgccgagggcccggcaatgaaccacgtcaaaccgggcagcgagatctacttcggcgagaaccgcggcgacccgatcaggttcagtcacgcgatgatcgacgcgggcgccgacctggtgatcgggcacggcccgcacgtggttcggggcatggagttctacaaaggcaaactcatcgcctacagcctcggcaacttcgccggcggcgggcacacgctctccaaggacgggatcctgaagtacgccgggatcctgcgcgtgacgctcaacgccgacgggtcgtacgccggcggcaccttcctctccacctgtctcaacgccgacggcctgcccacccgggacgccaccgcggaacacggccgccggctgatcacccagctgaccgcgaccgacttcccgacgaccggagcgacgatcggcggcgacgggacgatcaagccgtccgcgtga

SEQ ID NO: 3182 - DNA, 804 bp, Actinoplanes utahensis
gtgctggcgcggtcgacgaaacgcttcgccggggagacgccgatcgggcgcaaacgccgggcccacaggatggcccgggtgctcgccgacacccaccccgacgcgcactgcgagctcgacttcaccacgccgctccaactggcggtcgccaccatcctgtcggcgcagaccaccgacgtgcgggtcaatcaggtcaccccgcttcttttccagaaatatcggacagctgccgactatgccggcgccgaccgggccgagatggagacgatcctccggccgaccggcttcttccgggccaagaccaactcgctgatcagcctcggggaggagctgctcgccacgcacggcggggagctgccgcggaaactcgacgagctggtgaaactgccgggcatcgggcgcaagacggccaacgtgatcctgggcaacgcgttcgacgttcccgggatcaccgtggacacccacttccggcggctcaccaaccggttcgggtgggtcgacgaagaggacccggtcaagatcgaattcctggtcgcggagctgatcgagaaacgcgactggacgatgctgtcgcaccgggtgatctttcacgggcggcgggtctgtcacgcgcgcaagccggcctgtggggcttgcacactggcggcttcctgcccgtcctacggtctggggccgaccgaggccgcgccggcggcgaaactgctgaagggcccgcgggcgcgcgacctggcggtggcggccggtgtcgacccggacctcgtgccggtgggtgccgccgtcgagcccgactcggaggcgttgtga

SEQ ID NO: 3183 - DNA, 531 bp, Actinoplanes utahensis
gtgaggcttctggcgccggtcgcgatcgcggcgctgctgctcagcgggtgcacggccgccgcggtgaaggagtcgcaggccccgtcgccgttcgccgcctgcgcgccggccaccggcggcagcaccctgcccgacatcacgctcgactgcctgaccggcgacagcccggtgcgtctcgccgacctgcgcgggcccgccgtcctcaacatctggggctcctactgcggcccgtgccgcgcggagctgccggtcatccaaaaacttgcggacaccggcaagctcaccgtgctcggcgtcgacaccggcgacacccgggccgcggcgatctcgttcggcaccgaccacggcgtcagcatgcccacgctgttcgacccggaccgcaaactcgtcgcccagctcggcgtgatcagcctgcccagcaccatcttcgtcgacgccaccggcaagatcttcatttaccggtacgccatggacgcgcccgccctgaccgagcaggtggccaagcacgccggggtcacggtgacactatga

SEQ ID NO: 3184 - DNA, 711 bp, Actinoplanes utahensis
atgagccggggcgagctgctggaccggccggacgacctgccggagtggttcgagccgctgctcacccgggtctccgagatccgcgccgaggatttcagcacgctgcgccgcccgtccgggtccggtggccggtccagtgccgtgctggtcctgctcggcgccggcgagtccggtcccgacctgctgatcctgcagcgggccgcgagcatgcggaaccacgccgggcagccggcgttcccgggcggcgccaccgacccgtccgacgccgacgcggtcgccaccgcgctgcgcgaggcgaacgaggaggtcggcctcgacccggccagcgccacggcgctggccctgctcccggagctgtggatcccggtcagccggttctcggtcaccccggtgctggcctggtggcgccggccacatccggtgctgtcccggcagcctgaagaggttgaccacgtcgcccggctgccgatcagtgaactggcggaccccgcgaaccgtatccgggtgcgacatccgagtggttggatcgggcccgccttccaggtccgcggactgctcgtctggggtttcactgcgggggtgatctcggttttgctggacatggcgggctgggcgcagccgtgggagccgggtcggatcgtggaactgccggacgccgcggccccggtgccggccgcgcgtggcggcgcacccgatgaggtggtgccgtga

SEQ ID NO: 3185 - DNA, 1173 bp, Actinoplanes utahensis
gtggtcgatgtcatcctgatcgtgctgatgctgctgttcgcgatcagcggctatcgccagggattcgtgatcggggcgctctccctcggcggcttcttcagcggcgtgctgatcggcctccagctgggcccgctgctggccaagcagttcgctgacggcacggtccgcatgatcgtggcgctcgcggtgatcctggccctggccgtgctcgggcagaccctggcgggctggctcggcaccagcctgcgcaaggcgatcttcaaccgcccgctgcagcatctggacgacgccggcggcgcggtggtctcggtggtcgccgtgctgatggccgcctggctggtggccgtgccgatgggttccaccccgttcccggcgctgaacagggcggtccgcagcagcgccatcctcggcggcatcaacggtctgatgcccgagcaggcccaggcgctctcttcggcgctgcgcgagacgctggacaccaacggcttcccggacgtcttcggtggcctggcccgcacccaggccaaggaggtcgccgagcccgacccggcgctgaagaattcgaagatcgtccagagctcgaagcagtcggtcctgaaggttctcggcgccgccccgagttgctcgcgccgcatcgagggcaccggtttcgtctacgccgacgagcgggtgatgaccaacgcccacgtggtcgccggcacccgcgacgtggtcgtcgagaccgcccgcggccagctgaccggcaccgtggtcgtctacgacccgaaacgcgacctggcggtgatccgggtccccggtctgaaggccccggtcatgccgttcgtcagcaagaaggccggctccggtgcctccgcgatcgtcctgggctacccgcaggacggcccgtacaacgcccagtccgcccgggtccgcgacgtcggcgacatcaccggccccgacatctacgagtccggcgacgtgacccgcgagatctacaccatcaagtccctggtccgcagcggcaactcgggcggccccctgatctccccggacggccgggtcctcggcatcatcttcgccgcggccgccgacgacaagaacgtgggcttcgccctgaccgccgccgaagccgcccccatagccaaactcggcctggaaagcaccgagggcgtcaaaaccggcgggtgcgcctga

SEQ ID NO: 3186 - DNA, 1614 bp, Actinoplanes utahensis
atggcgacgccgacccgtgaccagagtgagcgcaaccatccggccgcagcggccgcggtgtcgtgcacccttcggcggtgcgcgttgctgacggtccggcatctcggggccgcggccctggccggtttcctcgtgatgacgccggcggcggcgcccgccttcgccgctgtgcgcccggcggtgttcgccgctccggtgcccggtggcgggtcgggtgccggctccgcgatctccctgacggtttccgggcgtcccgcggcggcccgctcgctcgcggcctcggcggtttccgcgcgctccgcggcggttcggtcgctcgcggtcccggcgatttccgcgcgctccgcggcggcccggtcgctcgcggtcccggcggtttcccggcgggcggtgacgaggcggccgctcgcggagcccgggttcgccgacgaggtggtcgagggccggccgctcgccgagccgggcaccgccgtagaggacaccgtccgggccgacgagtggcagctgcagaccctcgacctgcatgacgcgtggacctacgccgacggctccggggtcaccgtcgcggtgatcgactccggggtcgacgcgcaccaccccgacctggacggccaggtgctgcccggtctcgacctggtcaaccccaaggacgacggcgacaccgacccggtcggtcacggcacgacggtgtccggcatcatcgccggccgcagcgacgacaacaccggcgtggtcggcatcgcccccaaagccaaaatcctgccggtacgcgtgctggacgaggcgaatcgctacgacgacgcgctgatcgtggcgaaaggtctgcgctgggcggtcgaccacggcgcccgggtggtgaacctgtcgctcggcggcagcgcgaacagcccggctctggccgccgccctggactacgcgttcgccaaggacgtcgtggtggtcgcctgcaccggcaacgtcagcgccacctcgagcgcccacagcgtctggtacccggcccgcgagcccggcgtcctcgcggtggccggcatggaacgcaacggcaccgacctctggtcgggttcgatcaccggcccggagacggtggtcaccgcacccgccaccgagctggtcggcgcccggcccggcggatactggcgggtccagggcaccagcttcgccgccccgatggtcgccggcaccgctgccctgatccgctcccgctggcccgacatgtcagccggcgacgtgatcaaccggatcatccgcaccgcgaaggaccgcggcacccccggccgcgacgacgtgttcggtttcggcctgatcgaccccaccggcgcgctgaccgcgagcgtgcccagcgtcctggggaacccgctggacaccacgccgccggtcggcgtcggccgcctcggcagcgcgcccgcctccggcgaggcgcagtccgcccccaccgacgacccgtcgagccagccgctggccgccgcccccggcaccaacgccggcggctgggccgccaaggcgaccgcccagccggccccgcaccgcggccgttggatcgccatcagcctgttcgcgctctccaccgcggtcggcgctctcaccatccgccgcttcgcactcaccaccggctga

SEQ ID NO: 3187 - DNA, 3921 bp, Actinoplanes utahensis
atgggcaccgtggtgatcaagcggtccgagcgccgtccggcgcccgcgatcccggacggtgagctgctggtcgagccgcccccggagcgggcccggccggccgccgggcggtggcagcaggccctgatggtgttgccgatgctgggcggcacggtggccatggcgatgatgatgggccagggtcacggcggcatgtattcgtacgtgatcggcggcctcttcggcatctcctcgatcgccatgctggccacctccttcggctcggccaccggaccccgccgggccgagaccgccgccgcccaccgcgactacctgcgacacctcgccgtgctgcgccgccgggtccgggaaaccgcccgccggcagcgcgccggccagctgtatcgccatcccgacccggaccggctgtggtccacggcggccagccaccgggtctgggagcgccggccggacgacccggacttcggcgtggtccgggtcggcctcggcccgcaggccctggccaccccgctgctggcgccggccacccgcccgctgcacgagctggagccggtgaccgcgggcgcgctgcgccggttcctggacgcctactcggtcgtgccggacctgccggtggccatgtcgctgcgcgggttcgcccgggtccacctgcgcggcggcgaagcggcccgggacctggtccgggccgcgatcatccagctcgcggtcttccacgcgccggacgacctgctggtcgcggtctgcgccggccccgcccggcgggccgactgggaatgggtcaaatggctgccgcacgcgctgcacccggcccgctccgacccgctcggcccgctccggctggtcgccggcgatgccggcgagctggaccggctgctccacgacgtgctcgccgaccgtccccggttccagcccggcgcggcgagcgcggccggtccgcacgtggtgatcgtccgggacggcggcgagccgctcccacccggtgacggcatcgacggggtgaccgtgctggacctggacgcgccaccgccccggctgctcgaccgggccaccctggcgctcgaggtggaccggaccggcacgctgctcaccgccaccatggaggtggagaccgtggccgggcgggcggacggcctgccggcgaccaccgccgaggcgatcgcccggcggctgaccccgctccgcacggccggggtggccgaccccgacgggccgccggtaccggccgagaccggcttcgccgagctgctgggcatcggcgaccccgagagcttccgcccggcccggggctggcggccccggccggcccgggaccggctgcgcgcaccgatcggggtgaccgccgacggcctgccggtcgagctggatctgaaggagtcggcgcagggcgggatgggcccgcacggcctgctgatcggcgccaccggctccggcaagtcggagttgctgcgcaccctggtgctggcgctcgccggcacccactccccggagtcgctgaacctggtgctgatcgacttcaagggcggcgccaccttcgcgtcgctggaccggctgccgcacaccgccgcgctgatcaccaacctgagggacgagctgccgctggtcgaccggatggccgaggcgatcgacggcgaacttctccggcggcaggagctgctccgcaaggcgggcaacttcgccggcctgccggactacgagcgggcccgggcggacggggcggccctgccaccgttgccgtcgctgctggtggtcgtcgacgagttcgccgagttgctggtccacaaacccgacttcatcgagatgttcctgcagatcggacgggtggggcgctcgctcggcgtgcacctgctgctggccagtcagcgcctggaggaggggcggctgcggggactggacacgcacctgtcgtaccggatcggcctgaagaccttcaacagcgtcgagtcccgggtggtgctgggcgtcccggacgcggccgacctgcccagcgcgcccgggcacgcatacctgaaggtcggcaacgggccgttgacccggttccgcgggtcgtacgtgtccgggccgctgcgccgcaccggctcgccgggcgacccggccgggacgaccgagctgcgcgttctgccctacacgacgcgggccatggcggccccggcccgcccggcggcgatcgccgcacccgagccggccagcggctcgcccacgctgctcggtgtgctggtcgaccggatggccggacagggcccgccggcccaccgggtgtggctgccgccgctggactccccggccaccctcgacgatctgctgggcccgccgatcgtggccgccgggcgcggcctgacctgcgtcagccccgagctgcacggcgccctgcaggtgccgatcgcgctggtggacaagccgcgcgaacaggtgcgcgacacactctggctgcagctcgccggggccgccgggcacgtggcggtggtcggcggcacgctcagcggcaagtcgaccgcgctgcgctcgctgatctgcgggctggcgctgacccacaccccggccgaggcgcaggcgtactgcctggacttcggcggtgggtcgctgggcgcgctgcgcgggctgccgcacgtggggggggtgttcgggcggctggaggcggagggggtgcgccgcacggtcggcgaaatggtcaccctgctggccgcacgggagcgctcgttcgccgagctcggcgtcggctcgatgggcgagttccggcggtcccgcggcgggccggacgtgttcctggtggtggacggctggagcacggtgcgggccgacttcgaggagctggagccggtgctgaccgacctggcgacccgcggcctgtcctacggcatccacctggtggccgccgcctcccgctggatggatttccgcccggccgtgcgcgacctcttcggctcccgggtcgagctgcggctgggcgacaccaccgactcgtcggtgagccgccgggccgcgggcacggtcccggagcagcagcccggccggggcgtcatcgaacaccccggcgtccgcgagcagtggctgcacctgctcaccgcgcggcccgaggtctcctcgctgggcgacaccgccgagctggtcaaggcggtggccgcggcctggcccgggccggccgcgccccaggtccggctgctgccggcggtggtcgcgcaggccgggatcgccgacgccggcgacgggctgcggctgccgatcgggctggccgagaccgacctggaaccggtcaccgtcgacttcgccaccgacccgcacttcctgctgttcggcgacgccgagtgcggcaagtcgacgttcctgcgggtggtggccggtacggtgaccgcccggttcgccccggagcaggcccggatcatcctggtcgactatcgccgcagcctgatggacctgccggagaccgagcaccggatcgggtacggcatgcaggcccaacccaccctggacctgatgcggtcggtcgccggatacatggccaaacgcctgcccgggcccgaggtgaccgcccggcagctgcgcgaccgctcctggtggaccgggccggagctgttcgtcctggtcgacgactacgacctggtcgccgccgggccggtcaacccgctgaccccgctgctcgaatatctgccgcaggcccgggacatcgggctgcacctgatcctcacccgccgagccgggggcgccgggcgggcgctctacgagccggtcatccagcggctccgggagctctccgcgccgggtctggtgatgtccggagcgcccgaggagggcgcgctgatcggcagcgtgcgacccggtccgctgccaccggggcgtggtcgtctgatcactcggcgtgagggaattcgccttattcagctggcacttccggaatccgggcccgggacagactctcagtgcgattag

SEQ ID NO: 3188 - DNA, 636 bp, Actinoplanes utahensis
gtgcggaccggtctggcccgggtgacgatcagcaccccacgacgccgggtggacgtggcgctgccggagcgggtcccgctcgcggaactgctgccagaggtgctccggcacgccggcgaggacctggccgacaccggtgagcggcatggcggctgggtgttgcgccgcgtcgatggagccaccctcgaggtggggcgggggctgcacgcacaaggcgttcgcgacggcgaggtgctgcacctgagcccggccctggacgactggcccgaactggagtacgacgacgtggtcgaggcggtggccgagggcgcccggcggcgcggcggcgtctggaccgcctcgaccacccgggcggctgctctcggcgccgccgggatcgcgctgtccgccgggctgctgacgctgctcgccggcccggtgcgaggaggcggcccggcgcgtggcggcgggggcgcgggctggaccggtctcggcctggcagtcgtcctgctgctcgccgcgacggtggcgtcccgggcgtaccggatgcgcccggccgctgtcgtcctcggcggttttgccatggcgtacgccttcatcggcgccgccgccctggtcgtcggcgcccatccggccggcccgctgcccgccctctag

SEQ ID NO: 3189 - DNA, 315 bp, Actinoplanes utahensis
gtgctgcggtcccggctgttccgggcccggcggctgcggttgccgctgatcgccggtggcctggccgcgctcgccgcgctgggcgcggatctgctgggccgggtgggcagcgatgtgctgccggtcgcggcggcggcctgtgtgctgctcgccctggccgtggtgccggccgggacgatctggtcgcagcgcccggccgggccgctgtcggcccgcgtcgcccacctgttcgaactgctggtcaccgccgcggtgatcccggtcgcctgcgcggtcgccggcctgtacaccgcggtcagcggcatctcgctctag

SEQ ID NO: 3190 - DNA, 501 bp, Actinoplanes utahensis
atggatttcgacgttctggttgagatccccaaggggcagcgcaacaagtacgaggtggaccacaagaccggtcgtatccggctggaccggaccctcttcacggcgacacagtatcccgccgactacggctacatcgagggcaccctgggccaggacggcgacccgctggacgccctggtgctgatccaggagccgaccttccccggttgcctggtccgggcgcgcgcgatcggcatgtaccggatgaccgacgagaagggccgcgacgacaaggtcctctgcgtgcccttcgaggacccgcgccaggagcacctgcgcgacatccaccacctgggcgagttcgaccggatggagatccagcacttcttcacggtctacaaggacctggagccgggcaagtcggtcgagggcgcgacctgggtcggccgggtcgaggccgaggccgagatccgcgcgtccttcaagcgcgccgaggccgccgaggccgagggagagcactga

SEQ ID NO: 3191 - DNA, 1746 bp, Actinoplanes utahensis
atgtcgctagtctcccctaagtctgacgccacgggcgaggaggggcgtgtgacgaggcaagattcacagaacggaccggagtacaacggcgtgtctaacgggacggatcgcccggatgccggtaaatggcagccggccgcgccggatccggcgacgacggcgcagatcccggctccgggggcctacccgccgagcggcctgccgcccgcgccgcccgcggcgtccacgggtgacgcgtacgggaaagcctccgtgccgttgaacaccgcccgcccggcggtcccggctcccgcaccgccgccgcaacccgccgcggccccggaacccgacgcggagccggcggcgccggacttcttctcgaacccgaagatggcctcgatcgtgctcgccgccgtggtgctgctcgccgtggtggtcgtcggtgtggtggagaagcccggcccgatcgccggctggttcggtgactcggcgagtccggccggcgtgaccaccaccccggacccgaaaccgaccccggtgctggccgccgccgcggcgcaggggacggcgccgaacccgaccgcggtcaaggccgtcctggacccgctgatccggtcggcggcgctcggcggcaaggtgcacgtctcggtcatggacgtggcctcgcaacaggtgctctacgcgcagaacgcggacatcccgaccaccccggcctcgaccgcgaagctgctcaccgcggtgaccgtgctggccgcccgcggcccggcgtaccgcctgaccacccgggtggtggccggcgcgaagccgggcgaggtggtgctggtcggcggcggcgacccgaccctggcggtcaacgcgaaggcggagttccccggcgcggcccggttggatcagctggccgcccaggtgaagaaggcgatgggcgccaccccgatcacccgggtgacggtcgacacctcgctgttcaccggcccggagaccgggctcggctggtcacccgacgacgtctcgccggacgggcaggtggcgcggatccaggcgctgatgaccaacgccggccggatcaccccggtgcaccacgagaacggcggcgacccgcggttcgccgatccggcgctggccgccgggcgggcgttcgcgaacttcctcggcgtgccgtcggagaaggtggccaagggcagggccccggatgccggcaccgagctcggcaaggtggattccccgccgctggtccagatcctcgactggatgctgcaggagagcgacaacaccctggccgagacgatggcccggcaggtggcgatcgccgcacacaaggaggccagcttcgacggcgcctccgaggcgatgatcgccaagctgcgcgagctgggtctgcccggcgacgaggccgacctgtacgacggcagcgggctgtcccggcacgacggcctcagcccgaccctgctggtgcaggcgctggcgctggcggccggcgggacgagacccgagctgtccgcgatgttcgacgggctgccggtggccggctggtccgggacgctgcgcacccggttcgtcacgcccagcccgaaccgtgccgcccagggtgtggtgcgcgccaagaccggcacgctgagcggggtgaacacgctggccggggtgctggtcaccaaggacggccgggtgctctccttcgcgatcatggcgaccggcacatcgaacgcggccagtgccaagaccgcgctggacagggtcgccgcgaaactggtggcctgcggctgttcctaa

SEQ ID NO: 3192 - DNA, 1059 bp, Actinoplanes utahensis
atggcgcagttcgttgactgggatctggccgccgcgaccgccggcgcgctgtcgaaatcggggccggcggtctcctatgacgaggccgcccaggtggtcgccgagctgcgggtgctgaccgagcaggcggccggccacgtggcggcgtacaccgggctcagcgcgcaggtcgacgcgccgccggtgcgggtggtcgaccgccgcgactgggcgaaggcgaacatcgccggcctccggcaggtgatcaatccgctggtcaccaagctctccggggacaggccgccgggcgcgttcgccgacgcgatcggttcccgggtcaccggcgtgcaggccggcacgatcctggcctatctgtccggccgggtcctcgggcagtacgaggtgttctccgacgaccccggtcagctcctgctcaacgcgccgaacatcgtcgaggtcgagcgcaagatcggcgccgacccgcgggacttccggctctgggtctgcctgcacgaggtgacccaccgcacccagttcaccgcggtcccctggatgcgcggctacttcctgggccaggtgcaggcgttcgtcgacgcctcgcagggcggtgatcacctgctggagcgcctgcgccgtggggtggccggcctctccgacgcgctgcgcgacccggagagccgcgtctcggtgctcgacatcgtccagactcccgggcagaaagccgtgctggaccggctcaccgcgctgatgaccctgctggagggccacgccgagttcgtgatggacggcgtcggccccgaggtgatcccgagcgtcgagtcgatccgggccaagttcaaccgccggcgtgagggcggcaacccgctggacaagacggtccgccggctgctcggcatcgaggtcaagatgcggcagtacgccgaggggcacaagttcgtgcacggcgtggtcgagcgggtcggcatggagggcttcaacaagatcttcgagtcgccgctcaccctgcctctgctggaggagctcggcgacccggacgcctgggtggcccgggtgcacggccctcgcccggtcctcgactga

SEQ ID NO: 3193 - DNA, 675 bp, Actinoplanes utahensis
gtggcccggatcccggcgccggtcgccgcggtccgcacggcggtccgtcgcggcctggccgacctgccgcccgccgcgctggtgctggtggcctgttccggcggcgccgactcgctgtcgctggccgccgccgcccggttcgtcgccgcccgggtcggtctggtcaccgtggaccacgggctgcaggagggttcggaccgccgggcacgatcggttgcggcctgggcgcgcgccgccgatttcgatccggtacgcgtgtgcccggtcaccgtgaccgggctgcccggaggccccgaggcggctgcccggaccgcccgttacgaggccctggaggccgccgccgccgagaccggggcggccgcagtgctgctcgggcacacccgcgacgaccaggccgagacggtcctgctggcgctcgcccggggcgccggcccgcgcggcctgtccggaatgccggcccgccgcggggtgttccggcgcccgctgctcgacgtgtcccggtccgacacccgcaaggcgtgcgccgccctcggcctggctgcctgggaggacccgcacaacaccgatccggcgtacgcccgtgcccgggtccgtgccaccgccctgcccaccctggtggccgagctgggtccggccgtggtcggcaacctggcccgcacggcgacgctgctctag

SEQ ID NO: 3194 - DNA, 186 bp, Actinoplanes utahensis
gtgctgcaccgctgggcgctggagctgggggcacccggcagcgccctggcgtactcccacgtgacctccctggacgcgctggtcaccggctggcgggggcagggcccggcgcatctgcccggcgggatcgcggtggggcggcaaggaagtgacctcgttcgggtggttcccgccattatcaagtga

SEQ ID NO: 3195 - DNA, 594 bp, Actinoplanes utahensis
atgcggcaggctagagccatggctgatggctcttggtacgacgccgacatcgaccacgtgatcatctcggaggagcagatccgcgagaagatcgatgagctggcgaagcaggtctccgtggaccacgcggatgccgccgacggcatcctgctggtctgtgtgctcaagggagcggtcatgttcatggccgacttcgcccgttcgctggggcggcacgggccgtccaccgagatggagttcatggccgtctcgtcgtacgggcagggcaccacctcgtccggtgtggtgcgcatcctcaaggatctggaccgggacatcgccggccggcacgtgctggtggtcgaggacatcgtggactccgggctgaccctgtcctggctgatgaagtacctggagtcgcgtcaaccggccagcgtcgaggtggtcgcgctgttccgcaagccggacgcggtcaaggtgcaggtgccggtccgctacgtcggcttcgacatcccgaacgagttcgtggtgggttacggtctggacttcgcggagcgttaccgggagttgccgtacgtaggcgtgctccgccccgaggtgtacgcccgtagctga

SEQ ID NO: 3196 - DNA, 2031 bp, Actinoplanes utahensis
ttggcgcccgacaacagtatggaacgtacgcgtttcttccgccgcccggtggtctggatcattctggtgatcatcggcgtagtcgcgctgagctcattcttcaccagtggtcccagctaccagcgggtcgatacttcggtcgctctcgaccgtctgaaccagcccggcatcgagaaggtcgtccagaaggacaaggagcagacgctccagatcgacctcaagaaccccgagcagttcaacggcaagtcgacgagcaagatcgaaacccagtatccgtacgaggtcacctctgatgtctggaaggccgtccagcaagccaaggacgcccagcggatcagcgggacgatcaacgcgacggtctccggcgacaacatcctcctcagcctgctgatcaacctgctgccgatcgccattctggtggtcctgctgctgctgttcatgtcgcagatgcagggtggcggctcgcgggtgctcaacttcggcaagtccaaggcgaagatgatcaccaaggacaccccgaagacgacgttcgccgacgtggcgggcgccgacgaggcggtcgaggagctccacgagatcaaggacttcctgcagaacccggcgaagtatcaggcgctcggcgccaagatcccgaagggtgtgctgctgttcggctccccgggtaccggtaagacgctgctggcccgcgcggtcgccggcgaggccggggtgccgttctactcgatctccgggtccgacttcgtggagatgttcgtcggtgtcggcgcgagccgggttcgtgacctcttcgagcaggccaagtcgaatgcgccggcgatcgtcttcgtcgacgagatcgacgccgtcggccggcaccgcggcgccggcatgggcggcggccacgacgagcgcgagcagacgctcaaccagctgctcgtcgagatggacggcttcgacaccaagggtggcgtgatcctgatcgcggccaccaaccggccggacatcctcgacccggcgctgctgcgcccgggccgtttcgaccggcagatcccggtggacaacccggacatggagggccgcaaggcgatcctgcgggtgcacgccaagggcaagccgttcacgcccgacgtcgacctcgactcggtggcccgtcgcacgcccggtttctccggcgccgacctggccaacgtgatcaacgaggccgcactgctgaccgcccggcacgagaagcgggcgatctccaacgagtacctcgaggaggcgatcgaccgggtcatcgccggccccgagcgtcgtacccgggcgatgagcgacaaggaaaagaagatcaccgcctaccacgagggtggacacgcgctggtggcctacgcgctgccgcactccgccccggtgcacaaggtgacgatcctcccgcgtggccgctcgctcgggcacaccctggtcctgccgaccgaggacaagtacacccagacccgcgccgagatgatcgacaccctggcgtacgcgctgggtggccgggccgccgaggagctcgtcttccacgagcccaccaccggcgccggcaacgacatcgagaaggcgtccggcctggcccgcgccatggtcacgcagtacggcatgagctccaagctcggcgccgtgaaatacggcaccagtggtgacgagcccttcatgggccgcaacatgggccacgagaaggactactcggacgccgtcgccgccgacatcgactccgaggtgcgggcgctcatcgagctcgcgcacgacgaggcctgggagatcctggtcgagtaccgcgacgttctcgacaacatggtcctggagctgatggagaaggagaccatcacccaggacgacatgaaccggatctgcgcccgggtgcagaagcgcccgccgatgtcgccgttcaacggcttcggcaagcgcctgccgtcggaggccccgccggtgctcactcccgccgagcgggagaagctgaaggcgcaggccgaagcggatggccagttcgctgtcggccccaacgccaacggcgccgtggaaggcagcatctga

SEQ ID NO: 3197 - DNA, 576 bp, Actinoplanes utahensis
gtggagcaggccgtcgacctcgggcggatcgagaaagcggtccgggagatcctcatcgcgatcggtgaggaccccgaccgggatggtctcgcacgcaccccggcccgggtcgcccgcgcctacgccgagctgttcgccggcctgcgggtcgacccggcggaggtgctgaccaccaccttcgaggcggaccacgaggagctcgtgctggtccgcgacatcgaggtgcagagcatgtgcgagcaccacctgctgccgttcaagggcgtcgcgcacatcggctacatcccgggcgtcgacggacggatcaccgggctgtcgaaactggcccggctcgtcgaggtgttcgggcgacgcccacaggtgcaggaacgcctcacctcacagatcgccgacctgctgatggcgaagctgggggcgcgcggggtgatagtggtgctggagtgcgagcacctgtgcatggagatgcggggcatccgcaaggtgggcgcgcggacggtcacctcggcggtgcgcggcgccttccagaccgatggcaaggtccgcgccgaagctatggccctgatcaacgcgcgctga

SEQ ID NO: 3198 - DNA, 261 bp, Actinoplanes utahensis
atggcgagcgtcgaagagataaagatgaacatcgccgtctcggtgtccggggcggaccgcgcgatcgccggcattcagatggccggtgaccagctcgatcagtcgctcgcgatgctgcgcctgaccacggtcgggtcgtttcatccggcggcgacggccgctatcgcccatctggaacaggcccgggcccggctcgacgaggcaacccagttgacccgcgccgccatggattccgccaatcagtttcgcggcgggatttaa

SEQ ID NO: 3199 - DNA, 696 bp, Actinoplanes utahensis
atgacggagcaggcagagcagagcggactggttcccgctcaggccggcgcacccccggagagtccctgggcggcctatctggcggccgcccagcaactcgacgtggtgcgccgggcggccagcacgtcggccggcgagcaggctgccacgatcgccgcggcacgccaggagctcaccgcggtccgggcccggctggcgccgcagcgtgcccggctgatgcgcgatttcggcgtgcccgaaatagatctgctccccctggagggggaacgtgcgaccgcgcaggccgcgacaatcggtggcccggacgcggtcctggcggcgttgcagcaagccaggattaccgccgacgccgccgatcacgctttcatcggtccgattccgctcggcccgggacgcccctgggcgcgcaatcttctggtttacggtccgttcgcggcggccgtgctgttcgtgcagatcattctctatctggtcgcgccgagcggttcgctgccgacatacacgctcctctgcggcctgagcatgccgctgctggcattcggcctgggttgggccacgatcggtttcgtctggggtccggacgccgcgaaaggcggtccgccggtcgatcgcacgccggtcgtcggcatcgtcgcgtgcctcaccccggtgctgctcacctgcatgggtgtcggtctgcaacaactgctgaactga

SEQ ID NO: 3200 - DNA, 2778 bp, Actinoplanes utahensis
gtggcggattcggctctgcgggtccggcaggctgctgctttgcaccggcaggcggtggcggcggcggatgctgcggcggccgcgctggaggcgtttgcgcccagcgccgctgatccgcgggagcagcagcggcttgcggagcggctgcgggaggcggcggcgcaggtggcgcccgggtggctgggggcgccgctggatgcgctgacttcgcggatgccgcttgacggttcggggacgcaggttgctgccggagggacggaaccggggcggttcgtgcgggtcggggtggctcacctttctggtgccggacagtcccagtccgtcggtcctggacagcccccgcccgtcggtcccgggcagtcccaacccgtcggttccggacaacgccagcccgttggtctcggacaaccccaacccgttgatctcggacaggtccgacccgctgatgaggttcgatttccggcgatcgttccgctgctgggtgccgggcatttgacgatcgatgcgagcgccaccgatccgcgggtgttcgggctgatcagggcgctgcttctgcggcttttcgcggcggctccggcggggtcgctgctggtgcgggcggtggacgggatcggtgggggtgcggtcttccaaccgttcgaggagctcgccgatgccgggctgatgtcgccgccggcggtggaccggcaggggctgcgggatgtgctggccgaggcggagaagtggctgcggccggcccgcggggtcgggtcggacagtgtgcggcagacccgccgggccaaacgggaccggatgctgctgctggtcatcgccagtctgccggagctcaccgagggcgaggagctgcgtcggatcgccgctctcgcgcagcaggggccggagtcggggttgcacctgatcgtggccggttggccgccgccgccgttgaccgcggagacgactcaggcgccgctgccgcggaccaccgcgatcagtgtgcggaatccgttcgccgtggtcggtgacccgcccgggggatcgttcgggtcgacgccggaagcgccgtggctgaacgccccggttctgctcgacgatgagccgccggcgcacctggtcgacgcggtctgtcaggagctggcggcccgatcggcggccgcgtcccgggtgacgctggccgacctgctgccggagccgtccgaggagctgtggtcggcggacgcgtccgcgggtgtggaaaccgtggtggggcatcacggcgacgtgccgctggtgctgcgtttcaacgatctgaccccgcactggatggtcggtgggcgctcgggcgccggcaagaccgctttcctgatcaacgtgctgtacgggctgggcacccgctactcgcccgacgagctggccctctacctgctggacttcaaggagggcgtgtccttcgccgagttcgtgccgacgcaccgggaccgcacctggctgccgcatgcccgtgcggtcggggtggagtcggatcgggagtacggcctggcggtgctccgcgagttggatgccgagatgggccggcggtccatggcgtacaaaagagccggtgtttcccggtttgccgatcttcgcgccgtggcggcggaggaggggcgcgggcggccgctgccgcgggtcctctgtgtcatcgacgagttccaggtgctgctggccggcaacgatccgaccgcgagcgaggcggtgggactgctcgagtcgctggcgcgcaagggccggtcgtacgggattcacctggtcctggccagtcagacggtgctcggggtggaagctctctacgccaaacgggattcgatcttcggccagttcccggtgcggatcgcgctgccgggcggcggtgacgtgctggagccgaccaacgacgcggcggccggtctgccgctgggcagtgccgtggtgaacacggccggtggtctgggcggcccccgcggggcgacccggggtcacgaacgggtggttcggttcccggatccgcacgccgatcaggagtcgctcagcaacctgcggcaccggctgtggggtgcccgcgacccggaggcggtgccgccgcggatcttcgccgggtatgcgcatcagcatctggtcgacgaccccacctatcgggccgccctggccggccgggcgagtcgccccaccgccctgatcggtcgcatgatcgacgtgagcctgtcgacggccgccttccccctggattcctccccggggcggcacctggcgatcctgggctcgcaggcggccggttccgaggtgttggacgcggcggcgcgcagcgtggcggcgtgccacccgccgcgtaccgcccgcttcgtgatctgctccctggtcgccgagggcgacgcgctggccgcggccctggccgcggagatcagccaccggcaggaggtggtggtgaccgatgccgccgggctggctgccgaactcgccgacgaccagccgggctatcgggtggtgttcggcatggacgccgctccgccgggcgccctgaccggcctgcggcagctgctgcgcgagggtccgagccggggcgcgcacctgctgtcctggtggcggggggtgcgccggttcagtgaggagaccggcggcagcatgggccgcgaggatgtggccggcctgctgttcctcaacgttccgcaggcggatgtgtcgctgatgctggggcgggcggtcgactggcagccgcggccgaaccgggcgctgctgcacgaccgtcacaccgatcgcacggtcacggtggtcccgttcgtacagccggagggtgaacacccatga

SEQ ID NO: 3201 - DNA, 1968 bp, Actinoplanes utahensis
atgctgcggcggggggttgcgtttctctcagtcctcgtagtgatcgtggcggcctcaatcgcttgggcagtcgccaccccagccagcgcatacgccgtcccatcgaaagccccttcaggggcgtgcagcattgaggaatggaagaatgacctcaaaggctgcgtcgaccgactggagaaggtggctggcaaccgggtagattgcctagaccctccgactcccagtacgccggattcaggccttgccggatggtttgcggagcgtccgcagtcatccacaaaagatggacctcagggaatatatagcgagtacgggtacgccggatacagctacaatacatatgatctagacggcggttgcgctgccggtgccgtaaatgcagacaccggcatcgagaatactatggcaaatggcgagcttatggtcgccacggccgtaatcggcgcctctaacgcgctaagggagcgagcctgggacccggcaacaatgtggggctgggccgaccctctggtagaccaagcgaccaaagcggtttacgaaaaggtatttagcgtattcggcgtgatcacgctcgcgatagttggcctttacctgatatggcgttcacgccaagctgacatgggcgctgcaacaacaaccgccggatgggcaatcttggtaatggttgccgtaacagcaatcgccgcttggccagttagatcagctaatcttgcggatcaaaccttggtcaccacgctaggtgttgtccacgatgccgtcggacctcgcccgcaaagtggtggtaacggatgtcgcctgaagccaacctcatgtgaggatcagcggccaccagccgtgcgcgctagtgacaccgccacggagactatgctctatcgtaattggctgcgtggagttcttggctcggccgacagcgataccgccaaaaaatacggcgctgcactatacgacgctcgctcactaacatgggacgaagcacagcgcatccgagacaaccccggaacccgcgatggcatcctcaacggaaaaaaagagcagtggaagaaggtagccgaacagatcagtaaggaagacccggaagcatacgaatatcttcagggaaagaacggcatggaacgagtcggtgctgggttcatcgccgtcctcgctgcggtcatgtttgcaatgttcgaccttaccgcctcgatccttgtcctacttggattcttgatatttcgttgggcagtgattgcagcacccatcctaggaaccgttggccttcttcgcccggctagtgcaggaatccggcgcctaggcaatgccgttgtggcagccgtttttaatgtggccatattcggcacaggggctgccatatatttattcgcagtcgatctcatcatgaataccgcgagtttggccggttggctgcaggtcgtattggtttggctctgtggcgtcgtcggatggcttctcctacgcccgtaccgtagaattacgcaattgggcggcaaggataacgctgcggctatcgcttcggggggctcctggcatcgccgcttctttcgcgatatgcgcgaagctgccaaattggaggccgctgaaggcgccggctccccagcaaattttggaaagaatagccgtgtggtccgtgccgaaacacgcgacttacgtccggaagcccgcctcgaagactcgacgcatacagcaataaatactgcccattccaatgtggttgaacgagggctccccgcgcacccgccgatgcaaattcgtccggacggtagcgaggtcgtacatggtgaagccgctgccagtgctcattctatagccggcacgagtcagccttctcagagccggaaccgacctaggcgtaccgagtgggcagagccggaggccacagagaccccagcgtcgtacaccatctatcgaccgtctactggggcgacaattcaggaaccggcgactccacgggtgcgctccgaggcgaggtga

SEQ ID NO: 3202 - DNA, 2643 bp, Actinoplanes utahensis
gtgcccgcgacggtcaccgacaaagctccggcccgccggcgcaccaaggagccgaaggccgcgaaaccggccgcgctgcgcccccagaaactcaagttcaacgaccgcgatccggcgatcgagctggcgatcagcgagatcgccggccatctgacgttcacccagagcaccgtcaccgcctggtatcacctgcccgaggtccgctgggcgttccggcccgacgcggagcgcgaggcgctgctgagcgcgatctccgagcagtacgccgggctcgccggcttccgcctgcacctgcggcgcaccacccgcccgttcccggccgacgagtgggcccgcacggtcgactccttcaccacccggccgctgcccgacgtgccgggcgcgacatcctggtccgaccacctggtcgcggcgcagcgccatctgctctcggtgaaccacgcggagggccagacctacctgggcgtgaccttcgcccggcgctcgctcggcgacacgttctcggagcggatcctgcgcgctttcggccgcggcacgtccgaaaacgaacgacgcaaactcgggcgtacggtcgagcagttcgacgaggtgctcaacgccttcggcatgcgtggccggcgggtcactccgcaggagctggagtggctgctgttccgctcggtggcgctcggcatggccccgcccggcctgctctccccggtttccaacggccactgggagaccggcgatctgctggcgctgaccgagcaggtcgagcgctaccgcacgccgtacgggtcgacggtcaagctggtcaaccggatgaccggcgaggaacgccacgtcgcggtcctctccgtcggccggatggagccgctggagatcccggagcggcacgagccgtggatgcacttccacgagcgcctgccatggccgatggagctctcctcccggatcgacatcctcggctcgaacagctcgttcaggaacctggagcaccggctccggatgatccgctcgcagcagctcgactatgccgagcacggcatcgacgccccgcccgagttggaacgcctcgccaagcgcgccctggtgatcggcgacgagatgaccacgggtctgcccaccgattcggcccgggcgcacggctggcaccggatcgcggtcagcggcgccaaccgcgaggaatgcctggaacgcgcccgtcgcctcatccagctgtactcccgcgagttgcggatctccctgcagcatccgaagaaccaggaccagttggcccgcgaattcattccgggtgagccgatcgccaacaccggctacgtccggcggatgccggtcaaactgctggccgccgccctcccgcaggccgcctccacggtcggcgaccgccgcggcgacctgatcggccgcaccgccggcacctgccgtcgcccggtcttcctggacctgcacttcccgatggaggtccgggaacgctccggcctcggcgtgttcgtcgccgagcccggcggtggcaagtccaccctgatgggcgccctcggctacctgaacgcccgccgcggcgtacaggtgaccctgctcgacccgtccggtccgctcgcccggctgtgccagatgccggaactccgcccgtacagccgagttttgaacttgaccggctcggaacagggcaccctcgcgccgtacgcgttgatccccaccccgatccgctccgagttccccaccggcgccaccggcgaccgcgagttcgagatcgccgtctccaacgcccgcgccgagcgccgcatgctggtccaggacatctgctcgatgctggtccccccgcaggtcgccaaggaggcctccaccgccaccctgctgcgacacgcggtccgtcaggtccccgccgaggaaacctccaccctcgacgacgtggtcaccaccctgcagggtttgggcgacgacgagggccgcgagctggccaacctgctcctggacaccgccgagatgccgctcgccctgctcttcttcggccgccccccgcagcacctgctcggcgccgacgccgccctcaccgtcatcaccatggccggcctgcgcctccccgacctgaaaatcgaacgagaatactggtcggccgaggagtccctggccctgccgatgctgcacaccgcccaccgcctggccgtccgccgctgctacggcggttcgatgtccacccgcaaaatggtcggcctggacgaggcccacttcatggaaggctggcgctccggccgctccttcctggtccgcctcgcccgagattcccgaaaatggaacctggccgccctggtcgcctcccagaacccccgagacatcctcggcctggacgtgcagaacctggtctccaccgtcttcgtcggccgcatcgccgaggaccaggaaatcgcctccgaagccctccggttgctgcgggtcccggtccacgacggttacgaggccaccctggcgtccctgtcccaggtggacacgtcgtcccagcaccgcctcggcttccgggagttcgtgatgcgggatgtggacggccgggtgcagaaggtccgggtcgacgtctcctacgtcgaaggcctcctggaacacctggacaccaccccaggcccagcccagccccagttggcccctctcccgtccgacctggaggcctaa

SEQ ID NO: 3203 - DNA, 582 bp, Actinoplanes utahensis
atgaccacgaaccttccgcccgggcatccccgcgcgggcgcctccaccgccgacaggcagagtaacggtgtgcgcccgaacgactactcctcgcccgaggcggtcgagcagcccgacgagctggtcgccgcaccggggcacggcggcgtcggggtgttccaggcgccgaacgcggtgcgtccgctgagcacgccggtcgacacgacgatggacatcgactcaccgttcctcgatctgttcggtggcacggccgggccggcgcccacccgtccgggtgatcctccggcgaaaccggccgggaccaacggtcaccgtgccaacggatccggtccggcccgcaacggcttcccccacggcaccgtcaccgcgctgcccgcggccgccccgccaccatcaccggcgatcacgtccacccccttcgtcgtcgaggacgaggacgactggtcggagtacgacgagtggcctccgcgcggccccgaacagagccggcccgcaccgcacggccccgaagacagccggcccgcgccgcgccgcctgcccgccccggccccggagctggccgctcccgccctagctagctag

SEQ ID NO: 3204 - DNA, 363 bp, Actinoplanes utahensis
atgcggctccggaccgacgacgacatctaccgggcccgcctcgtctatctgggcccgcccggttacacgctgcccgtccacctgccgtacgcgcagtacggcatgttcgtcgtgctggtgcccctcttcatggtcatccactatctgatcacgttcaccttcgatccgttcccggcgtgggagatcgcgctggccatggtgtcgacgtcgtacgtgttccggcatgtcgacccggaccggccggcccgggtcgtcatccgcaccgcgctcaccgactggcgccgcacccgcgagtcagccgtcgagcggcgcgatccgagacttgtcgccactcgcatccgggttcgggaggagttggtatga

SEQ ID NO: 3205 - DNA, 297 bp, Actinoplanes utahensis
atgattgccaccgaggtcgccggtcacgtgatgacggcgctccagagcagtgtgctcgccgcaccggccgagcccaccggcatcaacacgtcgggcatcgtcactttcttcgcgaagaacatcgcgccgatcctgctcgccgtgctcggcgtgatcttcatcggtcgcgcgagccgcggtgaggtctccaaggtgctcaccagttccgcgatcgcgatcgtgggcctggcgttcatcgccggggcggcgaccctgttcttcgtcggtgacgcgctgattaagttgatcttcaactga

SEQ ID NO: 3206 - DNA, 951 bp, Actinoplanes utahensis
atgcatgaatgtgcgtcaccaggtcatcgtacacctgttcgaacaaccctcgccccgtacgctcggcgggtgctgactccgccgacagaagcccagctcatcggggctgatctgatgcatcgcgatcacccggtcgtgatgggcgtcctgaacgtcacgccggactccttctccgacggcgggcgctacaccgacctggacgccgccgtcgaacatggcatttctttgtacgcgcagggggcggacatcatcgatgtgggcggtgagtccacccgcccgggcgccgagcgggtcgacgccgcgaccgaggccgcccgggtggtcccggtgatcgccgcgctgaccgctgccggggtgccgctgagcatcgacaccacccgcgccgccgtcgccgaggcggcgctggcggccggtgccgcggtgatcaacgacgtctccggcgggctggccgacccgggcatggccgcggtcgccgcggcggccggctgcccgtggatcctgatgcactggcgcgggcactcccgcgacatgcaacgcctggccacctatcaggacgtggtcaccgaggtgcgcgacgagctgcgggcccgcgccgacgcggcggtcacggccggggtggacccggcgcggatcgtcctcgacccggggctgggcttcgccaagaacgccgagcacaactgggcgctcagcgcgcggctcgacgtactggtcgccctgggcttcccggtgctcttcgcggccagccgcaagacctacctgggccggttgctggccggcccggacgggacgccgcggccggtggacgggcgggaggcggccaccctggccacctcgctgctggcggtcgcggccggcgcctggggcgtccgggtgcacgaggtccgggagaccgccgacgcgctcgccgtctggcgcgccaccggagcgcctcggctggccctggagaagtag

SEQ ID NO: 3207 - DNA, 411 bp, Actinoplanes utahensis
atggggcagatcacactcaccggactgcgcgcccacggccggcacggggtctacgacttcgaacgggagcagggccaggacttcgtcgtcgacgtccggctcgacctggacctgagccgggccgcggcgaccgacgacgtcgccgacacggtgcactacggcgaactggccaccgctctggtcgcggtgctcaccggtgagccggtgaacctcctggagcgcctcgccgaccggctgctcgacgtctgcctggccgatccgcgggtgtccgccgccgaggtgacggtgcacaagccgcaggccccgattccgcacgagttcgccgacgtggcggtcaccctgcgcagagaaagcagagaaagcagagaagacggagaaagaggcaggggaagcgaacgggggagaggatga

SEQ ID NO: 3208 - DNA, 522 bp, Actinoplanes utahensis
atgagccgcgcggtgctgtcgctgggcgccaacctcggcgaccgcctggcccacctgcgggccgctgtcgcactgctgggcccggccgtgcgggcggtctccccggtctacgagacgccgccctggggagacgcggagcaacccgcgtacctcaatgccgtcctgatcgtcgaagacccggcagcgacgccgcacgactggctggagcgggcccgggcctgcgaggcggccgaaggtcgcgagcgcgacccggaccgccggttcgggccgcgcaccctggacgtcgacgtgatcgcggtctgggacgccgacgggcgcccggtgcaccgcgacgatccggagctgatcctcccgcacccgcgcgcccacctgcgcgccttcgtgctgaccccgtggcgggacgtgcagcccgacggtgagctgcccgggcacggcccgctgaccgggctgctggccacgcccgaactcgccgccgacgtcgccggagtcacgcctcgtccggatctgtcgctagagtcgtag

SEQ ID NO: 3209 - DNA, 525 bp, Actinoplanes utahensis
gtgagcgccaatcccgacggctccccgaccgggcgccggaccgacccgtcactgcaaccgacgagcgtctcggctctggtgctggccgccctcgtcggcgcggcgctgggctggctcctgctcggctacaacgagctgttctaccggctcaccccgctgccctggacgggggcgatcgtgctgctcgccctcgccgtggtcgagggctacctggcgcagaacaccagcgcccggatccagcgcaagcccggcgcgccgcgggtcgacccgctggcggtggcccgctatgtcgcgctcgccaaggcctcctcactggtcggctcgctgaccgcgggcttctccgccgggatcctgatctggctggtcacccagccgaccgattcggccaagtcggacctgccgacggtggccaccacgctgatcgccggggtcgcgctgatcggcgccgctctctggctggagcgctcctgccgggtgccggacgggccggatcgcgacgacgacgatcccgaccggcggcgctga

SEQ ID NO: 3210 - DNA, 1203 bp, Actinoplanes utahensis
atggcgtatgacgaggcgaccaccgatccggccgcatatcggcgccgcgtccagctcgacgacaccgccggcggtggcaacaccctcgaccagtcgctgtccgccccggtccccgccccgcccgtcgccgacgacggccgtgaccgcctcggcatccacctcggttgggaggtcgtcctcctggtcgtcgccgcggtgctcggcttcctgctctggcgggagagttcggccgccttccagcgtcccgccctggacggcctgctggtcaccgcctccgcgatcggcctggtcacgctcggcgccggcctctcgctgcgcgccggtgtgccgaacctggcgatcggcccgatcgtgctggccgccgagttccagttcgccgagaacggtgacaagggcctgctcgagtccctggtcccggcgctgctgatcgcggccgccggcggtctgatcgtcggggtgctgatcctcgtcctgcacgtgccgggatgggcggccaccctggcggccgcgctcggcgtgatcaccttcgaccagctgcgggtcgacgcggtcgcggtgcagggcacctgggagccgaccgaccgggccttcctgctcttcggcgggttcgcgatcctggcggtgctcggcgccggcctgggcgcgatcggcccgatccgccggttcttcggccggatgcgcccggtcggtgacccggccggccggcgtggcgccgcggtggtgctgccggtgctggtcgcgctgatcgtctccacggtcttcgcggccggggccggggtgatcatggccggtcagtccgccgggccgatccgacccggcaccggtctggagtggaccggcatcggcctggggctggcgctgctcggcggcaccagcgcgttcggccgccgcggcggcatcttcggctcgctcttcgcggtcgtcgcgctcaccctgttcctggactaccaggcccgccgggagctgcacatctcgctctacgcgaccgccggcgtgatcttcctggccggactgatcgccacccgggtggtcgagtcgtacggtcggctggcgagcgccgcgcgcaccaccgactggaacgccgcgccctccggcggcctcggcacgaactggtcgcccaccgccccggagacctggaacactccggccaccccggtgggcaccgaccgttgggacgacggaccgtggggcgccacccgctga

SEQ ID NO: 3211 - DNA, 294 bp, Actinoplanes utahensis
atgctgtcggtcatgaccacgcacggcttcgccgaactggacgctctgcccaccgaggagctgcgggaacgcgctttcgccaaggctcgggagaagcacgacgtccgcttcttctggtcggtgctcaagcacctgccggacgccgacgacgccgccgggctcgacggcgcgccgaactcgatcggcccgaccgtcgacgaggcggtcgcgctctggcgcgagctggagggccgtgatctgggcgagcgggagccgttgttgcgtgccgctttcatcgactatctgtcgaggtag

SEQ ID NO: 3212 - DNA, 495 bp, Actinoplanes utahensis
atggctctcgaaagcaggtacaagaccgcaaccggggcgggcacgctcgctgcgttcctgctcgtgctgatcttcggcagtccctggtacggggactgggtcaccgacgccgtcgacgggcgcaccggcgccggctggtggcttcatctgctgcactggccggcctggaagttcgacagctcggactcgctgcgcggcgtcatcgtcggtgatctccgggcgatcctggcggtcgtcctgaccctggtgttcctggtgctgctgcccggcacccagctggcccgggcccgcggcacgatcgcccagctgctggccggctgggcggcgtacgtcttcgcgggcgccttcgccgcgctgatcgccgtcctgttcgtcgccgaccccaccctgatgagcatcttccagaacagcggcgccggcgccgagtacggcatgttcgtcggctggatcgtcggcctcgccaccctgggcggtcgccggggcacggccggctga

SEQ ID NO: 3213 - DNA, 969 bp, Actinoplanes utahensis
gtggacgctaccgcggcatcgatcaccctggcggacgttggcaaggtctatccggacggcacggtcgccgtcgacaggttcagcctcgaggtgcgcgccggcgagctggccgtgctgatcggcgcctccggctccggcaagtccaccatcctgcgcatgatcaacaggctgatcgagccgacccgcgggacgatcaccatcgacgggcgcgacgtgctcggcgaggacccggtgaggctgcgccggcagatcggctacgtcatccagaatgtgggactcttcccgcaccagacggtccgggccaacgtcggcacggtcgccaagctgctcggctgggaccgcaggcggatcaccgcccgcgccgacgaactgctggacctggtcggcctggatccggcgcggtacgccaagcggtacccgcacgagctctccggcggtcagcggcagcgggtcggggtggcccgcgcgctcgccgcggacccgctggtgctgttgatggacgagccgttctcggcggtcgacccgatcgtccgggcccggctgcaggaggagttcctgcgcctgcaggccaccgtgcgcaagacgatcgtgctggtcacccacgacatcgacgaggcggtccggatgggcgaccggatcgcggtgctggccgagggcggccgtctgctgcagtacgcgccgcccgccgagctgctcagccgaccggcgtcggccgaggtccgggacttcgtcggcgccgaccgcggcatccggcgactcgcggtcaccccggtacgggaggtgatgtcggcgcccgtcggtgccgtcgacgggctgcccgccgtggacgccgcggccaccctgcacgacgccctggccgtgatgctcaccgagaatgcgagcacggtcctggtgaccgagaacggtcagccggtcggtcaggtcaccaggaccgcggtgttcgaggcaccggcccagagcgcggtctag

SEQ ID NO: 3214 - DNA, 720 bp, Actinoplanes utahensis
atgtccttcctgtcgtgggtcccggcatcgccggcgcttgccgcaccggccgatgacggcccggggaatccgtggttctcctggcggtacgtccatgagaacgccgacgccatcggcaccgccctgcgtttccacgccgggctgaccgcgcagaccgtgctggtcgcgctggtggtcgccgtgccgctggcggtcgtcgcctactggatcaaaccgctgaccgcgccgattctcgcactctccggcgttctctacacgatcccttcgctggccctgctgtcgctgctggccccgctggtcggcaccaccagcaccacgtcggtcctgatcgccctggtcctctacgccctgctggtgctggtccgcaatgcgctggccgggctcacccaggtcccgcccgaggtcatcgacgccgcgaccgggatggggtacggccggttcggccggttgctgcgggtcgagctgccgctggcgctgcccggcatcctgaccgggctgcggctcgccaccgtctccactgtggcgctggtcacggtcggttcactgatcggacagggcggcctcggcgatctgatcctcggcggtttccggaacaacttctacaaggccgagatcctcaccggcaccatcctctgtgtgggcctggcgctggtgctcgacctgctgctggccgggctgggccggctgctgacaccgtggacccgggggcgcgccgcatga

SEQ ID NO: 3215 - DNA, 717 bp, Actinoplanes utahensis
atgagctacttcaacgagggcatcgtctggctcaacgacccgctgaactggaccaacccgggcggcatggtcgaccggctgaccgagcacctggtgatcagcttctgggcggtcctgctgggctgcgcggtcggctggccgctcggcatctggctgggtcaccgcggacgcggcggcggcccggtgatcaccgcggccaacctgaccctggccgtaccgaccctggcgctgctgaccatcctgccgctcaccccgctgggcttcggcaaaccgccggtggtggtggccctcgcggtcttcgccgtgccaccgctgctggccaacgcgtacaccgggctgcgctcgatcgacccggagaccagggaggcggcccgcggcatgggcctgtccggcgggcagctgctgcgccaggtggagctgccgctcgcggtgccctacctggcggccgggctgcgcaccgcggcggtccaggtggtcgcgaccgcggcgctggccgccctggtcaacggcggcggcctgggccagatcatcagcgccggcttcggcatcgggatgagcaacggcggcggcggtcagatcgtggccggcggcctcgccgtggccctgctggccctgctcgtcgagggcctgctggcgctcctgcagcggctggtcacgccgcccgcgctgcgcacccggaagcgtcgtcgcagcgctgtgacggtaaccacgccataa

SEQ ID NO: 3216 - DNA, 1005 bp, Actinoplanes utahensis
atgcgtaacaacattttccgcacggccggcgttctcgccgcggccgtcgtcgtcctggccggctgcggcaaggccggttcctcgggcaccgaggctccgccgtcggcggccgccgcggccggcgccgggtgcgccccggtcgcgggcgacaagctcgtggtcctgaccgacgacaagaaactgcagaacaccgacaacgtcatacctgccatcaacaagaaggcggccaccccggagctgatcgccgcgctggacaaggtgtccaccgcgctcgacaccaccaagctggtccagctgaacaaggcggtcgacatcgaccgcaagtcgtccaaggccgccgcgcaggacttcgccacggcgaacaacctgaccgcgggcatcaccaagggcaagggcggcaacatcaccgtcggcgccgccaacttcagcgagaacgccacgctcggcgagctgtacggcatcgcgctgaccgcggccggctacaccgtcaaggtgcagcagatcggcaaccgcgagctctacgagccggccctggagaagggcgacatcaccgtcgtcccggagtacgccgcgaccctggccaccttcctctccggcaagatcgacggcaaggccgccaaggacccgtcgtcgcccgagctggagaccacggtcaccaacctcaaggcgctcggtgacaaggccggcctgagcttcggccaggccagcaccgcgcaggaccagaacgcgttcgcggtcaccaccgccttcgcccagaagtacaacctgaccacgctctccgacctggccaccaagtgctccggcgcggcgaccgtgctgggcggcccggccgagtgcccgcagcggccgaagtgccagcagggcctggtcgcgacgtactcgttccaggccggccggttcgacacgctggacgccggtggcccgctcaccaagaacggcctgaagcagggcaccatctcggtgggcctggtcttcagctcggacggcgcgctcgcggccggctga

SEQ ID NO: 3217 - DNA, 765 bp, Actinoplanes utahensis
gtgtgccacccggcgttcggccgtttcgtcccggacgcactctcggtaacatctgcccccatgccggaacgcgactccccagcgggacacagcgcacgcctgctccgcggcctcctctgggcgggggtgatcctcgccccggtggccggagccgtcgtgctgctcggcggcaccggcaactcggtccgcttcgggatcctgctgaccgcggtcagcgtcgtcctggtcggcgcttcggtcctgatccgcagcgatccggtgctgctgcgcatcgacgtcgaggaccgggtcgccgaggaggtcgaccggctccgccgcgggctgatcaccgagctcgccgggcacgcgtccgcggcgcccgacccgaaccggccgccgctgaccgagcatagggcgccgggccggcccctggcgatcgatcgcgatcagcagccgggtcacgacggtgagcacaccatgggattcgggccgaacgggcggggacggcagggcaacttcgtcgaacagcccggcttcgagacgccgcccgccccgcagaacgtccctgccccgcagggcttcgccggcccgcacgatttcgccggcccgcagggctttgacgagccgaccacctacggtcccggcccgcaggggttcgactccggattcgacgagcagcccagcggcttcttcgacgactacgcccagccggacgacggcccccagcacgcccccgagccgcccctgcccccgcgcccggccggcggccgcgccgtcgctagctag

SEQ ID NO: 3218 - DNA, 300 bp, Actinoplanes utahensis
gtgaacggcgacttcggctacgcaccgcacgacaacggctacgactacggtcccgacgacggcaacggctacggcccgaagtacggcaccggctacggtcccgacgacggcaaccgttacggcccgaagagcggcaccggcttcgaacccggcaccggcggcttccgccccacccccgacgaccccgcccagtaccaggcccgccgccaccgcccgtcagccaacgacaccaacgtcggctccctcgccgacttcgcgaacatgcccggctaccgcgacgaggcccccggcaactggtga

SEQ ID NO: 3219 - DNA, 1086 bp, Actinoplanes utahensis
atggttctcaacatcgggccgcagcatccgtcgacgcacggcgtgctccggttgaagttgaccctggacggggagcgggtggtgacctgcgagccgatcgtggggtacatgcaccgcggcgccgagaaactgttcgaggtgcgtgactaccggcagatcatcatgctggcgaaccggcacgactggctgtccgcgttctccaacgagctgggcgtggtgctggccgtcgagcggctgatgggcatcgaggtgccggagcgggcgatctggctgcggatggcgctggccgagctcaaccgggtgctgaaccatctgatgttcctcgggtcgtacccgttggagatcggcgcgatcaccccgatgttctacgcgttccgggagcgggagacgttgcaggcggtgatggaggaggtctccggcggccggatccactacatgttcaaccgggtcggcgggctgaaggaggaggtcccggccgggtggacgaaacgggcgcgacaggcggtggcggcggtccgcaagcggatgcccgacctggacaacgtgatccggcgcaacgacatcttcctggcccggaccgtgggggtcggtgttctgccggcggctgacgccgccgcttacggtgcttccggtccggtggcccgcgcgagcggtctcgatttcgacgtacgccgtgacgagccctatctgctgtacgaccaactcgacgtgcccgtggtgacgcggaccgcgggtgactgtcacgcccggttcgaggtgctgctggatcaggtgtacgcgtcgctcgacctggtcgaccagtgcctggaccgggtggagcggatcggcgggccggtcaacgtgcgcctgccgaaagtggtgaaggcgccggaggggcacacctacgcgtggaccgagaacccgctcggggtgaacgggtactacctggtgtcccggggggacaagacgccgtggcggttgaagctgcggaccgcgtcgtacgcgaatgtgcaggcgttggcgacgctgatcccgggctgcctggtgccggatctgatcgcgatcctggggtcgatgttcttcgtggtcggggacatcgacaagtag

SEQ ID NO: 3220 - DNA, 948 bp, Actinoplanes utahensis
atggagtccgccctgtacgggccggacggcttcttcgtgcacccccgcaccggccccgccgaccatttccgcaccagcgtccacgcctccccgctgttcgccggcgccctggtccgcctgatcgagcgggtcgatgccgcgctcggccacccggaccgtctcgatctggtcgatgtcggcgccggccgcggcgagctgctcaccacgatcggcctgatgctgcccgccggcctcgcggcccgggtccgcccggtcgccgtggagcgggcgccgcgacccgactccctggatccgggcatccgctggcggcacgacctcccggaggacatcaccgggctgctggtcgccaccgagtggctggacaacgtcccgctcgacgtcgtcgagactgacgagcagggtcggctgcgcaaggttctggtcgaccggcgcaccggtgccgagacgctgggcggcccggccgatcccgcggaggtcttctgggcgagccgttggtggcccggccccgggcggatcgaggtcggcgcgccgcgggacgccgcctgggcgggcgcggtggagcgggtgcggcgcggagcggcgctctgcgtcgactacggccatcggcgggccgagcggccggtgctgggcacgatcaccgggttccgcggcgggcggcagattcccccggtcccggacgggagttgcgacgtgaccgcgcacgtggcggtggacgcggccgcggcggccaccggtacgccgtacgaaatggtcagccagcggagggccctcggaccgctcggggtcagcggcgggcgaccaccgctgaccttggcgagcagcgatccggtgggctacctgcgcgccctgtcggcggccggcgaagccgccgagctgaggtcaccgaccgggctcggcgcgcactggtggctgtggcatccgatcggcgtcgaccttcccctcggctga

SEQ ID NO: 3221 - DNA, 906 bp, Actinoplanes utahensis
atgaacgtattgaccgtcggcgtgatcggcgccgggcgggtgggtgctgtgctgggtgccgccctgcagcgcgccggccatcgggtggccgccaccgccgccgtctccgccgcttcgcgcgagcgcgccgggctcctgttgcccggggccgcgatccttccggccgacgaggtcgcccgggcggccaccgacctgctgctgatcgccgtgccggacgacgcgctggccgctgtggtggccgggctgcgcagcaccggagcgctccgtccggatcaggttgtggcgcacacctcaggggctcacggactcgacgttttcggcgatgtgaacggcatggccctgcatccggcgatgacgttcaccggcaccgcggccgatctggcccggctgcccggcatcgcgtggggcgtcaccacccgcgaccgggcgttcgccacccggctggtcgccgacctgggcggcgcgccggagtggatcgccgaggacgcccgcccggtctatcacgcggccctggcgcacggcgcgaatcacctggtcaccctggtcaacgaggcggccgacacgctgcgcgcggcgggggtgcgcgagcccggccgggtgctcaccccgctgctgaccgcggcgctggacaacgcgctgcggatgggcgacgcggcgctgaccgggccggtctcccgcggggacgccggcacggtcaccaagcatctcgaacggttgccggctgccgtcgtaccggcctatctggctctggcgcggcgcaccgcggaccgtgccctcgcgtccgggcggctgcggctgcaggacgccgcggccctgctcgaagtcctgcatccggcgaacgagacggcgaacgagacggcgaacgagacggcgaacctgacggcgaacgaggcggcgaaggtatga

SEQ ID NO: 3222 - DNA, 831 bp, Actinoplanes utahensis
atgacccaggtggtgcacacccgcgacgcgctggccgccgcgctggccggggccgacgagatcgccgtcgtgatgaccatgggcgcgctgcacgaggggcaccggcagctgatccgggtggcccgcgagcgtgcccccttcgtcgtcgtgacgatcttcgtgaatccgctgcagtttggcccgaacgaggacttcgagaagtatccgcggaccctggaggaggacctggcggcgtgccgggcggagggcgccgcggtggtcttcgcgccgggccgggacgacgtctatccggacggcccgccgtcgatcacgatgaatccggggccgctcggcgagatcctggagggtgccagccggccgggacacttctccggcatgctgaccgtcgtcgagaagctgctccggctcacccgcgcggacgtcgccttcttcggggagaaggacttccagcagcttgcgctgatccggcggatggtggccgatctggagctcgatgtcgagatcgtgggcgtgccgaccgtacgggaaatcgatggtcttgccctgtccagccgtaaccgctatctcggcgccgccgaccggacggccgcgctggcgctctcccgcgcgttgcgcgagggcgccgcgcaccacgaggccggtgcggtcctggccgcggcccacaagatcttgcaagacgagccggccgtacgcgtcgactacctcgagttgaccggcgccgacctgggtccggtgccggcggacggcccggctcgcctgctggtggccgcccgggtgggcgccacccgcctgatcgacaacgtcccgattgttctccggaaggatgcctga

SEQ ID NO: 3223 - DNA, 429 bp, Actinoplanes utahensis
atgctgcgcaccatgctgaagtcgaagatccaccgggccaccgtgacgcaggcggacctgcactacgtgggctcggtgacgatcgacgaggatctgctggaggcggccgatctgctgcccggtgagcaggtggcgatcgtcgacgtgaccaacggcgcgcggctggagacgtatgtgatccccggcgagcggggcagcggggtgatcggcatcaacggcgcggccgcgcacctggtgcaccccggtgacctggtcattctcatctcgtacgggcagatggacgacgccgaggcccgggagtaccggccgcgggtggtgcacgtcgacgcgcagaaccgggtgatcgagctgggcgcggacccggccgaggcggtcccgggcatggccggtgacctggtgcggggtgatctgaccctggcaactcgctga

SEQ ID NO: 3224 - DNA, 951 bp, Actinoplanes utahensis
atgcgagactggcgtgcccggctccggcgcgcccgatcgggccccggcctgggcttcgatctcgccgccacactgggcgtgatgctgctcgccgcggccgggtgcggcaaccccggcaccgtcgacggcgacctcaccaacaactggggcgcgatggccccggccaccggcttcgagccgatcgcggacacctgccacctggcgaacttcgcggcgaccggcccgcgcgcgacctatgaggaggtcgactgcgcggtgcggcaccgcaccgagacggtgtacgtgggcacctactccggggcggccgccgacgccgagcagccgccgtcggagtcctcggccggggcgcgtgcggcttaccacacctgcgacgagaagacgaccgcgtacgtcggcgccccctggcgtaccgcccggctctggatcggggtcacccatccctcaccggccgcctgggcggggggctcccgctggttccgctgcgacgtggtggaactcgactcgatcgaggacgacggcgccctggtgcagcgcgcgggcagcctgcgcagcgtgctgagcgccccgtcggacctgctgctgggctgttacgcgatcaagctgagcgacagcggggcgatcgacaccatgccgccggccccgtgcaccgccgcgcacaacgcggagttcgccggggtgtgggacgcgccggccgacgccacctatccccaggggaacaccgcgtggaagaggttccacgacggctgccggacggtggtcgccacgttcgccggggttcccgacgacaagaacctggagtaccgcaccggcgtggtgtcgctgcccggcaacgccgacgtctgggcgcagggcgaccgcggcgtgcgctgttacctgtggctggacggggcccggctgaccacttcgatgcgggccaaggggacgaaggcgttaccggtccaataccagtga

SEQ ID NO: 3225 - DNA, 1647 bp, Actinoplanes utahensis
atgtcacctctcgcggatctaccggccctgccgcgccggctcgcggccgccgagcccggctggaccgagaccaccgacgtggtggtggtcgggtccggcgtcgccgggctgaccgccgcgctgcacctgcgggagcagggcctgcacgtcacggtggtcaccaaggtcaacatcgacgacgggtccacccgctgggcgcagggcgggatcgccggggtgctcgatccgctcgacacgccgcaggcgcacgcgtacgacacggagatcgccggtgtcggcctgtgtgacccggacgcggtgcgggtgctggtcgaggagggcccggcgcggatccgggagctgatccgccggggcgccgaattcgaccgcaacccggacggctcgctgatgctgacccgggagggcggccaccgggccgaccggatcgtgcacgccggcggcgacgcgaccggtgccgaggtgcagcgcgccctgcacgccgcggtccgccgcgacccgtggatccgcctggtcgagcacgccctggtgctcgatctgctgcgcgccgcggacggccgggcctgcgggatcaccctgcacgtgctcggcgagggctcggaggacggggtcggcgccatcctggcccgcgcggtggtgctggccaccggcgggatgggacagatctacgcgtccaccaccaacccgtcggtctccaccggcgacggcgtggcgctcgcgctgcgggccggcgcggcggtcaccgacgtggagttcgtccagttccaccccacctcgttcgtcacggccgacctgagttcggtgcagcggccgctgatctccgaggcgctccgcggcgagggcgcccacctggtcgacgaggccggtacccggttcatggtcggccagcacgagcaggccgagctggccccgcgggacgtggtggccaagggtatctaccgggtgctgcgggcgaccggggcggaccacgtctacctggacgcccggcacctcggcagagagtttctggagagccgcttcccgacgatcatggcgtccacccgggcggccggggtcgacccggccaccgagctgatcccggtcgcgccggccgcgcactacgcctccggcggcgtgcgcaccgacctgcacgggcggaccagcatcgccgggctctacgcctgcggcgaggtggcctgcaccggcgtgcacggcgccaaccggctggccagcaactcgctgctggagggcctggtgttcgccaagcggatcgccgacgacatcggccgcgacctgccggcccaggccgacccggtgcgtgtcaacatgacccccgcctgggtcgccgacgcgagcgtccgcgccgaggtgcagcggaccatgacccgcggcgccggcgtgctgcgtacgggtgactcgctggacaccgcggccaaggaactggcccggctggccgagtcccgggccaccccgaacaccgcggcgtgggaggcgaccaacctgctcaccgtcgccaccgcgctggtcgcctcggcccgcacccggcgggagacgcgcggctgccactggcgtgaggactatccgaccgcggccgacgagtggcgcggccacctgctcgactcgattgcttccgacggcagcatgacccaggacttccaggagatggcgtga

SEQ ID NO: 3226 - DNA, 858 bp, Actinoplanes utahensis
gtgatcgacttcgggttggacttcgcggaggtccagcggattgtgctcaccgcgctcgccgaggacctcggcgacccgccgcgcgacgtgaccagcgaggccaccatcccggccgaccaggtggacacggccgaactggtggcccgcgcggacggtgtggtggccggcctcccggtcgccgccgaggtcttcgcggtcacctcgcaggggcgcgccgagttccggcagatcaccgccgagggcgaccgggtgacccggggcgacgtgctggccgtcgtcaccggcccgacccgcgcgctgctcaccgccgagcgcaccgcgctgaacctgattagccggatgtccggggtggccacgcacacccgccgctgggccgacgagctgcggggcacccgggcgacggtgctggacacccgcaagaccacgccggggttgcggtcgctggagaagtacgcggtccgggtcggcggcggcaccaacaagcgcatgggcctgtacgacgtcgccatgatcaaggacaaccacaagctggccgcgggcagcatcaccgcggcgtaccgcctggtccgggagacgttcccggacgtggcggtgcaggtcgaggtgaccacgctggccgaggcgcaggaggcggtggcggccggggccggcttcctgctctgcgacaacatgagccccgagctgctggccgaggtggtcgccgcgatcggcggccgggccgagctggaggcgaccgggaacctgaccctggccaccgccgcggcatacgcggcgaccggtgtggactacctttcggtcggcgggctgacacactcctcaccgatcttggacatcgcgctggatctgcgaccccgctga

SEQ ID NO: 3227 - DNA, 759 bp, Actinoplanes utahensis
gtgctgctttgcatcgacatcggtaacaccaacaccgtgctggccaccttcgacggtgacaagctggtgcacaactggcggatcaagacggacgccgcctcgaccgcggacgagctgggcctgatgttccgcgggctgctggccggcgacgcggtggagatcaccggggtggccgcctgctcgaccgtgccggccgcgctgcgcaacctgcggaccatgctgaagcggtactacggcgacgtgcccagcgtgatcgtcgagccgggggtcaagaccggggtgcagctggccatcgacaacccgaaggaggtgggcgccgaccgggtggtcaacaccctggcggcgcacgccctctacggcggaccgtcgatcgtggtcgacttcggcaccaccaccaacttcgacctgatcagcgcgaagggggagttcctcggcggcgcgttcgccccgggcatcgagatctccttcgacgcgctcgccgcccgggccgcccagctgcgcaaggtggagccggccaagccgcgctcagtgatcggcaagaacaccgtggagtgcctgcagtccgggctctactacggtttcggcggtcaggtggaccggatcgtcgagcggatgatcgaggagatcggcccggtctccgcggtgatcgccaccggtggcctggcctggctcgtcaaggacgagtgccggacgctgaccgcgcacgagccgatgatcacgctgatcgggctccggatggtatatgagcggaacgtctga

SEQ ID NO: 3228 - DNA, 1509 bp, Actinoplanes utahensis
gtgaccgagcagaacgtgccagtgaccgaccccgccgacgaccttcccgagcagatgaaggtccgccgggcgaagcgggaccggatgctggccgacggcgtcgcgccctacccggtcaccgtcgcccggacgatcagcctggccgagatccgcacccggtacgcggagctgccgaccgacaccgccaccggcgaccaggtgtcggtcaccggtcgggtgatcttcatccgaaacggtggcaagctgtgcttcgtgaccctccgcgagggtgacggcaccgagctgcaggcgatgctctcgctggaccgggtcggcgcggagcggctggaggactggaagcgcctggtcgacctcggcgacctggtggcggtcaccggtgaggtgatcaccagccgccgcggggagctctccgtgctcgccgattcctgggcgatgagcgccaaggcgctgcgcccgctcccggtcgcgcacaagccgctttccgaggagacccgggtgcggcagcgttatgtcgatctcatcgtccggcagcaggccagggatacggtgcgtactcgcgcaaccgtgatccgtagtctccgcgagtcactgttccgccgcaattatctcgaggtggaaacgccgatgttgcagttgctgcacggtggcgccgcggctcgcccgtttgtgacgcacagcaacgcactggacactgatctttatctgcggatcgcgccggaactgtttttgaagcgggctgtggtcggcggcatcgaccgggtcttcgagatcaacaggaacttccggaatgagggcatggactccacgcactcgccggagttcgccatgctcgaggcatatcaggcgtacgccgactacaacgtgatgcagatccagacgcgggagtggattcaggaggccgcgcaggcggtcgccggttcgcacgtggtgacccacttcgacggcaccgagctcgacctgggcggcgagtggcgccagatcaccctgttcggcgccatctctgatgcgctcggcgaggaggtcaccatcgcgaccgacctggcccagctccagcggtacgcggagaaggtgcagctcggcgtcgaccccaagtggagcgccggcaagctcgccgaggagctcttcgagcacctggtgcagcacaccctgcagcagccgaccttcgtccgggactatccggaggagaccgcgccgctgaccgcgccgcaccgggagacccccggcctgaccgagaagtgggacctctacgtcggcggtttcgagctcgccaccgcctattccgagctggtcgatccggtgatccagcgggaccggctgcacgcgcagtcgctgctggcggccggtggcgacgccgaggcgatgcagctcgacgaggatttcctccgggccatggagtacggaatgccgcccagcggcggcatgggaatgggaatcgaccggctgttgatggcgctcaccggcctgggcattcgggaaaccatcctgttcccgttggtccgcgcggagtag

SEQ ID NO: 3229 - DNA, 357 bp, Actinoplanes utahensis
gtggccaagcagatcattcacaagctggtcgatgacatcgacggcggcgacgcggacgagacggtgaagttcgcgctcgacggtattcagtacgagatcgacctctcggagaagaacgccgccgaattgcgtgaggtcttcgcgcagtacgtcggcgcgggcaccaaggtggcccggggcggtgtggtcgtcggcggccgcgcggctcgtggccgcggcggcgcggccgctgaccgggagcagaacaaggcgatccgggagtgggccaagaaggccggttacgacatctccgaccgcgggcgcatcccgcaggagatcgtcgacgagtaccacgcgaagggcccgggccgggcctga

SEQ ID NO: 3230 - DNA, 2772 bp, Actinoplanes utahensis
ttgtccacaggctgtggaccgtgcggatttcgctgtccgcgtacacgttcgggtgggggaacagccgctgagcgtgcgaagttggctaaatcaacgtcgcggatcgtttcgaggggctgcgagggcccagcggatcctcccggcggcgatagagttactgcacgggtatcaccggtacccgtgcgctggccccgccagctgttgagacaggctcagcattggcgcacggcacgtgaggagcacgagggcatgttcgagcggttcaccgaccgagcgcgacgggttgtcgtcctggcccaagaagaggcccggatgctcaaccacaactacatcgggaccgagcacatcctgctcggcctgatccacgagggcgagggcgtcgccgccaaggctctggagagcctgggcatctccctcgagggcgtccggcagcaggtcgaggaaatcatcggtcagggccagcaggcgccgagcgggcacatcccgttcacgccgcgggcgaagaaggtgctggagctctccctgcgggaggcgctgcagctcgggcacaactacatcggcaccgaacacatcctgctcggcctgatccgcgagggcgagggcgtcgccgcccaggtcctcgtcaagctcggcgccgacctgaaccgggtgcgccagcaggtgatccagctgctctccggttaccagggcaaggagccggccgccgcgggcaccgccaccggcgaggccgcgccgtccacctcgctggtcctcgaccagttcgggcgcaacctcacgcaggccgcccgggagggcaagctcgacccggtgatcggccgggagaaggaaatcgagcgggtcatgcaggtgctctcccgccgcaccaagaacaacccggtgctgatcggcgagccgggcgtcggcaagaccgccgtcgtcgagggcctgtcccaatccatcgtcaagggcgaggtgcccgagacgctcaaggacaagcagctctacacgctcgacctgggcgccctggtcgccggctcgcggtaccgcggtgacttcgaggagcgcctgaagaaggtgctcaaggagatccgcacccgcggcgacatcatcctgttcatcgacgagatccacaccctggtcggcgccggcgccgccgagggcgcgatcgacgccgcctcgatcctgaagcccatgctggcgcgtggcgagctgcagaccatcggtgcgaccaccctcgacgagtaccgcaagcacctggagaaggacgccgcgctggagcgccgcttccagccgatccaggtcggcgagccgtcgctcgcgcacaccatcgagatcctcaagggcctgcgcgaccggtacgaggcgcaccaccggatcagcatcaccgacgctgccctggtggccgccgcgacgctggccgaccggtacatctccgaccggttcctgccggacaaggcgatcgacctgatcgacgaggccggcgcacggatgcgcatccgccggatgaccgcgccgccggacctgcgtgacttcgacgagcgcatcgcccaggtgcgtcgcgacaaggagtccgcgatcgacgcgcaggacttcgagcgcgccgcccagctgcgcgacaaggagaagcagctgctcggccagaaggcccagcgggagaaggagtggaaggccggcgacctcgacgtcgtgtccgaggtcgacgacgagcagatcgccgaggtgttgggcaactggaccggcatcccggtctacaagctcaccgaggaggagacctcccgcctgctgcgcatggaggacgagctgcacaagcgcgtcatcggccaggaggacgcggtcaaggccgtctccaaggcgatccggcgtacccgtgccgggctgaaggacccgaagcgcccgtccggctcgttcatcttcgccggcccgtccggtgtcggtaagaccgagctgtccaaggcgctcgccgagttcctgttcggcagcgaggacgcgctgatccagctggacatgtccgagttccacgaccggtacacggtgtcccgcctggtcggtgcccctcccggttacgtcggctacgacgagggcggccagctcaccgagaaggtgcgccgcaagccgttcagcgtggtcctgttcgacgagatcgagaaggcccacccggacgtcttcaacacgctgctgcagatcctggaggacggtcgcctgaccgacggtcagggtcggatcgtggacttcaagaacacggtcatcatcctgaccaccaacctcggcacccgggacgtggcgaaggcggtgtcgctgggcttccaggcctcggaggacaccgagagcaactacgaccggatgaaggtcaaggtcaacgacgagctgaagcagcacttccgcccggagttcctcaaccgcatcgacgacacgatcgtcttccaccagctgcgcgagcaggagatcctgcagatcgtcgacatcttcaccgcgcggatcgagggccagctcaagaacaaggacatgggcctcgagctgaccgacaacgcgaagaagtacctcgcgaagaagggcttcgacccggttctcggcgcccggccgctgcgccggacgatccagcgcgagctggaggacacgctgtccgagcagatcctcttcaacgagctgcgccccggccagatcgtggtggtggactgcgagggcgacccggccaacgtggagaagtccaagctggtcttccgcggcgcggagaaggcgggagccgtgcccgacgcggtgccggccgacctcggcgcgaccaccagcgaggagtga

SEQ ID NO: 3231 - DNA, 525 bp, Actinoplanes utahensis
atgagagcgcgtcgcatcggtcaagccgtcttctactccgccgggctcggcccggtcagcgcggccagcctcgggctggcggtctccggccgctcggcggccgccgaacacctgtccaccgggtggcagagccgcctcggcccgccacccgcgctacgcggccggcccggtccggtcgtcgccaacgcgctgctgggtctgctgctgggcctgctggcgttgattccgctggctctggaggccgatttcgtggcccgcggcatcctctacggctgggtcgaccgcggcccctacgacacctcctggggcggccccggccgcggcggcgcctgggcggtgcacttcctggtcggcgtcccgatcgcggtggccggcatcgccgccctgatcggcctggcggccatgcaccgccgctggaccgcccgcctggccggcgagcccggtggcgcctgggtgcttccggtcgcactgctcggcacggccgccgaggtcgccttcgttattgcctttctgcgccagatctga

SEQ ID NO: 3232 - DNA, 588 bp, Actinoplanes utahensis
atgcacgagatccgcgccgtctacgacgagcacaccatcaccgtctaccaggcgtattcgccggcgatcgcggtcccggcggtgcgcgccggacgattcgtgcccccgttcaagcgggagcggatgacctggatcaagccgtcgttcctgtggatgatgtatcgctgcggctgggccaccaaggagggccaggagcacgtcctggcggtctcgatcacccgcgagggcttcgagtgggcgctgacgaacgcggtgcacagcagttacgtgcggggggagtatccgagccgggacgactggcagcgcgagttgcgacgggccccggcccgggtgcagtgggatccggagcgggatctgcggttgcgggcgctgccgtaccggtcgctgcagctcgggctcggcggggaggcggcgatccgctacgccgacgagtggatcaccgggatcagcgacgtgaccgaccgggtccgggagatccgcggcctgctggacgccgggcaggacgcccgggcggcggagctgctgccgcccgagcatccctaccccgtggtcagccgcacaccgacggatccgcgtacgggctcctga

SEQ ID NO: 3233 - DNA, 870 bp, Actinoplanes utahensis
atgaacgacgacttcaccgtactgcgggagacgatggaccagctctccgcacacggcggcaacgcggatctgcacgaccggatgctgaccacctcgcgtcgcatcacccgccgcaaccgcatcgtcgcctccgccgcggtggcggtcgcggtggtggcgatcgcgaccccgttcaccctggtcgccacccgcgactccgcgcccggcccggtcgtcgccacccagccatcggtagccaccacctcgccgtccccggcgccgtccagcggtgaaccgctcacgccccaccaccacacgatggtgccggccagcccggcggggggttgcccggtcactcagcagcagctgatcgacacggtcaaggcatacgacagccggtggtaccagccgggcgacaagtggcgcgacctggaatgccacgacgggtgggcctcggcctggtacgtgcagaaggtcaagaacagcgaccccggcgccaccgtcttcaagtacgacacggccacccggaagtgggtcgtgatcggcagcggcagcggggactactgcacctcctacctgccccgcggcgagtggagcaagttccggatcgcctgcaacggcgtggatccggcccagccctgcccgaccggcaacaccgagaccatcgacgcgatcgaggccggccagtacgccgacaaggtggcgtccgacgacgtcgtgcaggaactggcctgcggcggcaagtacgcggtgcagcgcctgatcgacggcgccaagaccaccttcatcatgcagtggaacccggcccagcaccgctggcacccgatcgccgccggcccgtgccggaccgtcgtcaggagcccgtacgcggatccgtcggtgtgcggctga

SEQ ID NO: 3234 - DNA, 522 bp, Actinoplanes utahensis
gtgagtgaaaccacggggttcaccgacttcgtcagaagtcggacgccggcgctactgcgcacggctttcctcctgaccggtgatcggcacctggccgaggacctggtccaggacgcgctggcccgcacccatcgtgcggtccggcggctcggcgatgacgggcactacgaggcgtacacccggaccgccatgtaccacctgcaggtcagccggtggcgccgccgccgggtcgccgagtcgctgcccggcgagctcaccgagcgggctgacccggacagcgaccacgccggccgggtcagcctgcagatcgccctgcacaaggcgctggcccagctcaccgctcggcagcgagccgtgctggtgctgcgcttcttcgaggaccgcagcgaaaccgaggccgccgagatgctcggctgctcggtcggcacggtcaagagccagaccagcaaggcgctgacgcggatgcgccaggtcgccccggacctgatcaacgccggcacgatgaagggagcggaccgatga

SEQ ID NO: 3235 - DNA, 897 bp, Actinoplanes utahensis
atgactctcgccgacgaatccatcgcctggtacgacgccaacgcccgggatctgccgtggcggcagcccgaaaccaccccgtggggtgtcctggtgagtgaggtgatgctgcaacagaccccggtggtccgggtggaaccggcctggcgctcctggatgacccgctggccgacgccggccgcgctcgccgccgacccgcagtccgaggcgatccggatgtggggccggctcggctatccgcgccgggcgatgcggctgcacgcctgcgcccaggcgatcgtcgagcggcacggcgggcgggtgcccgatcagctcgaccagttgctcgcgctgcccggggtgggcacctacaccgggcgggcggtggccaccttcgcgtacgggcagcggcacccggtggtggacaccaacgtccgccgggtcgtctcccgggtggtcgagggcaagccggacgccggcccggccaccaccacggccgacctggtcgccatggaggagctgctgcccgaggattcggcgcgggcggcccgggcgagcatcgcgttcatggagctgggcgcgatcgtctgcaccgcgcgggccccccggtgcgccgattgcccgttccatgaggtgtgcgcgtggcggctgtccggcgagccgctgccggaggggccgagccgcaaaccgcagcggtacgccggcaccgaccgccaggtgcgcggacttctcctggaggtgctgcggcacgccaccggcccggtcccccggcagcgcctcgacgtggtctgggccgacgaggtgcagcgggcccgcgcgctcgccggtctggtcgaggacggcctggtcgagccgctcggtcacgaggacttcgtactggccggcgacgccccgaaagtcgatcgacagattctttga

SEQ ID NO: 3236 - DNA, 228 bp, Actinoplanes utahensis
gtggacgagctcgggaccatcgccgccgtcaccgaggcgctgaccgcggccggtggtgacgtcaccggcctgaccatgcagctcaccggcccgctccagctgaccgcggagctgccgccgggccgggccgacgagctggcccagctgctcgcggtggccgccgccgagctgggtgtcgaggtcaccctccgacccgccgagccgggcggcgccgccgtgacggcatga

SEQ ID NO: 3237 - DNA, 780 bp, Actinoplanes utahensis
atgcgtacgacggttggtcccctctcacccgcggtctactggcggcggcgggcggtcgtgctcggcgccctgttgctgggcatcatcgtgtggttcgtggcgtgctcgcacgacgacacgaaaccggacaccaagaacgcggcctcgtcgtacccgacgcccgccccggcctcggcgacgcccaagtcgtcggtctccggcaagcccggtgacagcgacaacggcctgctcgcctcggcgccggccggcaacccggtctatccggacccggtgcagtcgcagggcaacaacggtgacagcggcctgctgcccgccaacggcggtggccagaacggcggcggccagaacggcagcgggcagaacaccaacgtcaatcagccggccggcaacgcgtgcgcggacaacgagatccaggtgacgccggtcccggcggccacctcgatcaagcgcggcgccaacctggcgatcacgttgcggatccgcaacgtcggcaaccgcacgtgcacccgcgacgtcggcgccgacccgcaggagctgtacgtcgaagccggcgcgcagaagatctggtcctcggacaagtgcagcggcgtgcacggcaacgacgtgcagacgttcaagccgggcgaccagcgcgaattcaacatcacctggaacggccaccagtcgacggcctgcaacggcgcgacggcgaccggcccggcgcccgcggccgggcagtactcgctgcgcggccgcctcgacgggctcgtcagccagccggtcgtcttgaccctgtcctga

SEQ ID NO: 3238 - DNA, 510 bp, Actinoplanes utahensis
ttggtcgcggcgctcgagctgtacctggacgtcgacgcgacgcggcgggtccggacgctgtggcgcgccctcgaggccgagggcattcccacgctcggatcgctgcacccgaggcaccggccgcacgtttcgctcgccgcggcacggaccatcgagccgtacgcggcggcagccgccctggacggcctgaacgtcggccgtgggctcagcgtgcggatggacttcgccggccagttcgtcgggcgggtgctctggctcgggatcaccatgacacccgagctgatggaccaccatcgcgccgtgcacgagcggctggcggcgggcggggtcgaggtgtgggagcactaccggccggggctgtgggtgccgcactgcacggtgtcgctgcgggtgccgaacccgatgatggccgcggcgatccggcgctgtctggagatcctgccactgagcgggacgatcaccggggcggcgatcgccgatcacgcgaacgacatcctgcacccgctctga

SEQ ID NO: 3239 - DNA, 1077 bp, Actinoplanes utahensis
atgcgccgtgtcatgtctgttctcagtggcgccgccatcgccaccgccgcgttcgccgggctgtcgccggccgccgaggcccacggggcggggtcctgcgtgagcgccgcggacgccacctaccagcacactttcgacggccccggcggcaccgccacgatcaccgcgctgatgccgctgtgcgacggtgagtcgcaagacttctcgctggtgtcgtacacggcgccgaagaagtcgtacgccgtcccgcagttcgcctacgacgcgcagaccgcccggatcgatgccggcacccgcagtgtctcgctgcacgtcgcggtgccgggctgcttcacccaggtcgacacggtcttcggcgcggccgtgctgaacgagatcaccggcaacgacacccggtacggcaacgccaagctcggctcgtcgtccggcctgggcagtcactcctcgggccgggcggcctggtacaacggcggcgacggcgtctgctcgcccagccccgcggtgagcttcagcaccgactgcgacggcgtcctgcacatccacctgacgaacgccgcgaacgccggtgtcgacgcggtgttcgtgaccggtggcgagcggatccgggtcaaggccggccaggccgccgaccgcacggaccactccggcaggccggtcaccgttcgcgacaacagcttccggaccagcatcggtacgccgtcgaagccggccgactgcccgacgccgaccacgcccaccacgacgcccaccacggcgcccgccacggcgcccaccacggcgcccaccagcgtgccgacgagcgcccccaccagcgcaccgacgtccgcgcccaccaccgcgccggtgtcctcaccgtcggccggtgccgcgccgaccggccccgccccggtgagcccgtccgcctccgggggcgtgctcgtcaccccgaccgccggcgccaccacccccggcggcgacctcgcgctgaccggctcgaacgcgggcacgctcggcctctacgccaccggcctgctgctggtcggcggcggcctggtcgtcgccggccgccaggcacgcaagcgccgcttcaccgcctga

SEQ ID NO: 3240 - DNA, 1182 bp, Actinoplanes utahensis
gtgccgctcgaccgcgatggttccaagtccgccgccagttcatcgccgcggcccggcgtcaacggcgcgggccaccgcgcggtgaccccggcgaccggttccggcctcaccggtggcgccagcgatccgctgcgcgccaatctcgccctgatggcccccggcaccgccctgcgcgacggtctggagcgcatcctgcggggccgcaccggtgccctgatcgtgctcggccacgacgccgtggtggaggcgatctgcaccggcggtttcccgctcgatgtggagttctccgccacccgtctgcgggagctgtgcaagatggacggcgccgtggtgctctccagcgacggcacccggatcgtccgggccgccgtgcatctgatgcccgacccgggcatcccgtccgaggagtccggcacccggcaccgcaccgcggagcgggtggccaagcagtccggcttcccggtgatctcggtgagccagtcgatgcgcatcatcgggctgtatgtgaacggtcagcgtcacgtcctggacgattcggccgccatcctgtcccgggccaatcaggctctggccaccctggagcgttacaagctccggctggacgaggtgtccggcaccctgtcagcgctggagatcgaggacctggtgacggtccgcgacgccgtggcggtggtgcagcggctggagatggtccgccggatcgccgacgagatctcgggttacgtggtggagctgggcaccgacggccgcctgctcgccctccagctggacgagctgatggccggcgtcgactcggaccgcaccctggtcatccgggactacctgcccaccggccgcaaggcgcgcacgctcgacgaggcgctggtcgagctggacctgctcaccgccaccgaaatgatcgacctggtcgcggtggccaaggcgatcggctatccgggcgcctcggacgcgctggacgcggccgtgtcgccgcgcggtttccggctgctggccaaggtgccgcggctgccggcccagatcgtcgaccggctggtggatcacttcggcagcctgcaacggctgctgggcgccacggtcgaggatctgcaggcggtcgagggggtcggcgacgcccgggcccgcggggtgcgtgagggtctgtcccggctggccgaggcgtcgatcctagagcgctacgtctaa

SEQ ID NO: 3241 - DNA, 1419 bp, Actinoplanes utahensis
gtgacgacctctcggaccagttccaaggcagcccgcccggcctatgtctgcgacgcctgcggccaccagccccccaagtggctgggccggtgcccggagtgcggcgagtggggctcggtgatcgagtccacggtgaccgtcggggtctccggccgggtcgtcagttcccgcatgccgtccgagccggcgaaaccgatctcgcagatcagcgccgccccggccaaggcggtgccgaccggggtcggtgagctcgaccgggtgctcggcggtggcctggtgcccggcgcggtggtgctgctcgccggcgagcccggggtgggcaagtccacgctgctgctcgacgtggcccagcagtgggcggccggcgccggttcgccctcgctggtggtcagcggcgaggagtcggtgagtcaggtgcgcctgcgggcggagcggctcggcgcgctgcacgagcgcctcttcctggccgcggaaaatgatctgggcacggtcatcggccacctcgacgcggtccggccgggcctgctggtgctcgactcggtgcagaccgtctcggctccgggcaccgagggtgtgcccggtggcgtgacccaggtgcgggcggtgaccgccgccctggtctcgatcgccaaggagcgcgggatcgccaccgtcctggtcggtcacgtcaccaaggacgggcaggtcgccggcccgcgggtgctggagcacctggtcgacgtggtgctgcatttcgagggtgacaagcattcgtcgctgcggctggtccgcggggtcaagaaccggttcggcgcggccgacgaggtcggttgcttcgagatgcacgagggcggcatcagcagcctgcccgacccgtccggcctgttcctcacccgctatctggagccggtgccgggcacgtgcgtgacggtcgccatggagggccgccgggcgctcgtcaccgaggtgcaggcgctgatcggggccgaggtgcagggctccccccggcgcaccgtctccggcctggacagcgcccggctggcgatggtgctggcggtgctggagcgccggacgaaacagttgaagctctacaaccgcgaggtgttcgcggcgacggtcggcggcatccggctgaccgagccgtcggccgacctggcgatggcgctggcggtcgcctccggtgggctggatctcgcgatggcgccgaccctggtggcgatcggtgaggtcgggctgaccggcgagatccgccgggtgagcgcggtcggtcggcggctggccgaggcggcccggctggggttccgggtggcgctggtcccgccgggcagcacggccggtgagggcggcacgcccaggggcatggaggtgatcgaggtgggtgatctccgctcggcgctgcagagcgcggcgcgggcgtcggccgatcactccacccgatga

SEQ ID NO: 3242 - DNA, 255 bp, Actinoplanes utahensis
gtgccggccgctccgaccgtcaccaccgcgcagatcaccatcaagccgctcggctcggccctgttccactcgaccgacgccgacaagctccaggtggtcaacctgtccgacgcgctgcgcccgggcgagtcggtcaacctggtcttccacttcagcaacggcacgcccgacctgaccattcaggcgccggtcgcggtcccgctgagcccggcctcccgggcccccggtctggagaacgagaacaccgaggggtga

SEQ ID NO: 3243 - DNA, 387 bp, Actinoplanes utahensis
atgcgctcgctggtaacccgtcgcgccgccctggtcgcgggtgtcgccaccgtcggtgccatcgcgctggccggttgctcggccggtcaggtcgccgagaccgccatcctgaacacgccgatcgagggtgtgaacgcggacgccctcgccaccgacggcaccgtcagcgtggccgtgcgcaacgcgcaggtggcctacaacggcgtcaagggctacgccaagggcgagaacgcgccgctcgatctgaacctttacaaccggacggcaagcccggtcaccgtgtcgatcagcagcaccccggccaaccggccgcaggtcgtctcgggcacccaggtcggcttcgtgaaggcggccgcgccgaccaccgcggcggccgttcctagctag

SEQ ID NO: 3244 - DNA, 1272 bp, Actinoplanes utahensis
gtgctccaagatctcgccggccaccaccacgtcggccgcgccgtcggcgagcggcagcgcggtcacgtccccggcgaccgggacgacgccctcccgggcggcccgggtcagcccggcgcggcgcaggtcgatcccgacgtggtgatagccgaggtcgcggacgtgcggcgcgagcaggccaccaccgcagccggcgtcgagcagcacccggcccggcccggccggccgcgggatcagctcggcgcgggcggcggccagccagtgcagcagctcgaagccgccgccgggacgccaccactcgccggccagttcgtcgtactggcacggatcgttgcgccgcatcgacaccatgtgatcgagactcgcacggttgcgccccgcccaccaccgggcgggcccggcttgtggacaacccgggccggtggacaatggccgttcatggatcgccgaaggtcattggccctgctgcgcgccgcccacccggagccgggcgcggccgtcaccgtcgccatgacgctgctggccgtgggcgccgggcaccgcgccgggcggctgctctgcgtgttcctggcggtcgcggcgacccagctcgcggtcggctgggtcaacgactggctggacgccgaccgggaccggcgggccggacgccgggacaagccgatcgcggacggtgccgtgtcacggcgtaccgtcggcgtcgcgggtctggtggcggccctggccgcgccggtcgcggcgcttccgctgggcgcggccgccaccgtgacgatcgcggtggccgcggtcttcggcctgctctacgactggccgttgaaatcgacggcgttctcggtgctgccctatctgatcgcgttcgggctgctgcccgccttcgtggtggtcggcctgcccgggcatccgtcgccgccggtctggctggtggcggcggccgggctgctcggcgccggcgcgcacttcgccaacgtgctgcccgatctggacgacgacgcggcgaccggggtgcgcggtctgccgcaccggatcggtgccggcggttcccgcctggcggccgcggcgttgctgctgggcgctaccgcgacgctggtgctgggcccgcccggagcgccgtcgtggtcggggtgggcggccggcgcggccgccgtcgtggtcctgccgatcggggggtacgccgccgcccgcgcccgtggccggccggtcgctctgttccgggcggtgatggtggtcgccctgatcgacgttctcttgttgatcttcagcgggccggtggtgtga

SEQ ID NO: 3245 - DNA, 1044 bp, Actinoplanes utahensis
atgggcgtggcgttgcccccgtccaccgtgcagaacgacctgtgggacggcttcttcgcccagcactacgcgaacgggcggcgcggcctggcccggcgcatcttcgcgaactccggggtggtcacccggcaggccgcggtgagcccgctcaaggaggacgtctccggctggtccaccgagcggcggatgcggcgctaccaggacgaggcggtcccgctgggccgggccgcggcggaacgggccctcgccgacgccgggctcgccgccgccgacgtcggactcttcgcggtctgctcgtgcaccggctacgccacccccgggctggacatcctgctcgcccgggacctcgccatgtcacccggcgtgcagcgcctctttgtcggccacatggggtgttacgccgcgttgccggggctgggcgcggtgagtgaccacgtggtcgcccgcggtcggccggccctgctcctgtgcaccgagctgaccagcctgcacatgcagccggtcggcgccggcgcgcccgacgtccagcagatcgtctcgcacgcgctcttctccgacgcggccgcggccaccgtgctcaccccggcctcggccggcctccccggatacgcggtgcgcgagctcgccgcggtcaccgacagcaccaccaccggacacatgacgtgggaggtgaccgacctcggattccggatggggctgtccccggaagtgcccgcggtgctgtccgtgcacgtgcgggcgatggtggcggagctgctcgggcggcacgggctggagatcgcggatgtggacgggtgggcggtgcacccgggcgggccacggatcctggacgtggtgcaggagcggctcgggctcgacgacggggcgctggaggcgtcgcggggggtgctctcggcgtacgggaactgttcgtcgccgacggtgctgctggtgctgaacgcgctgcgcaaccgggcgagtccgccgcggcgggtggtgatgctcgctttcgggccggggttgacgctctacggggcgttgttggagttgtcgcctcgggggtga

SEQ ID NO: 3246 - DNA, 444 bp, Actinoplanes utahensis
gtgagcgaacggggacggggcgccatcctgcatgggctggccgccctggtcctggcggcgggcggcacctggtggtggcgcgccgcaccgcgggacgcctccgatccgcgcctgctcacctggcggctcaccgccgaacagctgctgccggaaaccggggaccaggaggccgccgagaccgtggcgctggctccgcgacaggactacgagaaggtgtccgacctcgacggcggaacgttccaggtctcggtgatctgcgcggggccggacgggagccgggcgcgggtgagcttcgggggaccggagagcgggctcgggctgaactgctccgggacccggacaccgcaggtgttctcggtgggggtcgggaccgagttgcggctgcgggtcaccgccgagggcgaggggccggtcgtcttccgctacacccttcagcgcgcctga

SEQ ID NO: 3247 - DNA, 771 bp, Actinoplanes utahensis
atggcaggcgcgagcgacaacggtggctggccgcccgacggcggttggcccgatgagctgcccgacctccctgaggagtggggcgtgatcgtcatccccgacgatctgtccgagctgtccgacgaggtcgaggcggtgcgcgccgagctgcacctgaccacggcggcgacgcgctggcagcgcctggcacgccgcccgtcgatgcgccggctgcgccgggtcggcacgctgatgctgcgcgccccggtgctgatcgtctcgatggccatcctggtgaccgttgccagcctgttcgcctcggcctggccgggcccggtccgccagccgtccgtgcagcgcacctcgggcacgacgccggccccgagcaacacgcttccggccctggaactggtcgccgccgacggcaagacggtcccgctgcgcggccggctgccggccgtggtgctgatcacagacggttgcgactgcgccgccctggtcgccgcgacggccgccgccgtccggtccgacatcgcggtcctcgccgtgtcgtcggcgcgtccctcggcgcccacccccaccggactgaccaccgcccaggccccgccgtccgacggcaaggcggtccgctacctgcaggatcccaccggcgccctccgcgagcagatgggcctcaccgggcaggacggcaccgccgccgccatcctggtcaacgagacgggcaccatcctccggaagttcccgcacgtcgtcgccgtcgagtccatccagcccgatctgcagcgcctctga

SEQ ID NO: 3248 - DNA, 486 bp, Actinoplanes utahensis
atggttttcagtgtcggcgagaccgttgtttacccccaccacggggccgcactcatcgaggcaatcgagactagggtcatcaagggcgttgaaaggcagtatctcgttctgcgtgtcgcccagggcgatctgacggttcgggtgcccgctgagaacgccgaggaagtcggcgtgcgcgaagtggttggcgaggaaggcctgggcaaggtcttcgacgtcctccgcgctccgcacaccgaggagccgaccaactggtcgcggcgctacaaggccaacctggagaagctcgcttccggtaacccgctcaaggttgccgaggttgttcgtgacctctggcgtcgcgagcgggagcgcggtctctcggcaggcgagaagcgcatgctcgcgaaggcccgcgacatcctggtcggcgaggtggccctcgctgagaagagcaccaaggacgaggctgaggttctgctcgacaaggtcctcaccgaggcctga

SEQ ID NO: 3249 - DNA, 732 bp, Actinoplanes utahensis
gtgatcgccgaccgcgacgtgaccgcgcagctcaatgctcgcggtgacgtcgcggtcgtcgttccggcggcgggggcgggtctccggctcggcccgggcggcccgaaagctctgcgtctgctcgacggcgagccgctgctcgtgcacgcggtccggcggttggccgcggccgcgccggtccgcatgatcgtggtggccgctccgcccgccgaggtcgacgcggtgtccgcgctcctcgccccggtggccccggtcaccgtcgtgcccggcggcgccgaacgccaggaatcggtcgccgcggcactcgcggtcgttccgccggacgttccgatcgttctggtccacgacgcggctcgatgcctcaccccgccctcggttacggagcgtgtcgccgccgctgtccgggacggtgccgacgcggtgatcccggtcctgccggtcgtcgacacgatcaaagaggtcgcggccgatgccaccgttctcggcacggtcgaccgttccgtgctgcgtgcggtacagactccgcaaggcttccgcgcctcggtgctgcgcgccgctcaccgggccgccgccgactcacacaccgacgacgccggtgccgtcgagaagctcggcatcccggtcctgtgcgtcccgggctccgacctcgcgctcaagatcacccggccgatcgatctggcgctcgccacgcacctcctggccctgccggacccggacgcccctaccgcctga

SEQ ID NO: 3250 - DNA, 489 bp, Actinoplanes utahensis
gtgatcattccgcgggtgggtatcggcacggacgtgcacgcattcgacgctgaccgggcctgctgggtggccgggctggagtggccgggggagccggggctggccgggcactcggacgcggacgtggtggcccacgcggcctgtgacgcgctgctgtcggcggccgggctcggggatctggggggcaacttcgggacgagccggccggagtgggccggggcagccggggtcacgctgctcgccgagacggcgcggctggtccgggcggccgggttcgcgatcggcaacgtgtcggtgcaggtgatcgggaaccggccgaagatcgggaagcggcgggccgaggccgagaaggtgctctccgcggcggtgggggcgccggtcaccgtgtccgggaccacatccgacgggctggggctcaccgggcgtggtgaggggctggccggagtcgcggtggcgatggtctacacggagaacgctcttccggcctga

SEQ ID NO: 3251 - DNA, 1305 bp, Actinoplanes utahensis
atggagcctgatcccacgccggaggagcatcgccagcgtgcgctcctgcttgccgacctcgggcgctacgacgaggccgccgacgagatcgcggccggcctcagcgtcgcccccggcggcacggccggtggcgtcggcgatgcggcgagcggtgcggccagcggtgcgcccggtggcgtcgacgacctgccgggcggtgggatcggtggtctcggcgatcaggcgagcggtgcgcccggtggcgccgatgatgcggtgagtggtgcggccggtggtcgtgtcggcggagccgggaaccggtccggggcggccgactccgcaagtggtgcggacaccgcggaactgctggcgacgctcgcccggatccatctggtggcggagcagccggtggaggcgctggccgcggccgatcgggcggcggcggcccgacccgtgtcgctgaccgcccacgtggtgcgggcgatggcactcgccgacaaccggcggtacgccgaggccgcccaggtcgccggggagattctgcgggcgtggccggaggacgcgtacgcgcaacgcaccggagccgcgctgctcagtgagtcgcgtaacggtcaggaggcgctgaacgccgcgtggaacggggtgcgggtggcgccgggcgaggccgaggcgcatctggtgctggcggtggtggcggcccggctgcggctgttcgatctggcgcagcgggcgtacggggaggcgctcgacctggatccggcgatcggggatgccggacaggacgtcgggatcgttcgcctggagcgtcgtcgctgggcccgggcgctggaggagctcgccgaggaggcgtcgctgaccgacgcggacgggtttccggaggagcgggcgccggcacgggccggtgtggtggagccgcccgcggtcagcctgccgcgcagggcggtgctcgacgtgtcggcggactcgatggcggcggtggtcgagacgatccggtacggcgcgaacggcaccctggtggccgccgtggtcaccgcggcgatgacggtggtcagcagcggaatctcgcgggtgtgggcggggctgatcggtttcctggtgttcgtggccgtggtgctctggttccgcagccgcctgaccgagccggccggcccggtgctggcccgcctgcggtcgaccgcccgcccgctggccgccgcgtggcatctcagcctggccgggccgctgttcctgctggcctatgccgtggtcggcgggctgccgacgctgatcgccggcatgctcgtcgccggtatggccgacctcatcgtgctgatccgccgccgctga

SEQ ID NO: 3252 - DNA, 858 bp, Actinoplanes utahensis
gtgtcgacgatcgtgcctccgctgtatgccgggctcgtcgatgacgcgtctctgctgccgcccagcccgaccggcctggccgacgcggaggcgaagtatcgcgagcacgccaccgcctggtatgcggatctgatcggcaccctgctggtgccggcctccgtggtgggcgccgagccggtgccgcgggtcccggccgcgctggtcggtgacatcccggccggtgcgctgccggccacggtggagaagctgcgcgccgccggcatggtgatcgagcatgtcgaggcggcggtggcgcggcggggcgaggatccgcagccggggttgtcgctgctgcgcacgatcgcggccggcgagctgggggcgaccgggtcggcccgggtctgggcggagatcccgctgagctggggtctgatcggtgctctggacacggtggccgaggcccgccgggagggtctgccgatcgctccgaagttccgggtcggcggcctggccgccgagctgttcccgactccggtggagctggccgcggtcatctgcgcctgccgggaccgcgagctggagttcaagctggcggccggtctgcggcatgccacccggcacaccgacccggagaccgggttcacccatcacgggttcctcaacgtgctggtcgccacgctgctggcggtggacggcggcgaggtggccgaggtggccgaggcgctggccgccacccacccggtgccgctggtggagccggcccgcgcgcaccgggacgatccgcgcccgctgttcgccgggttcggtgcggccagcgtggtggagccgctcaccgaattgatccggctggggctggtcaacggcggctacgagggctga

SEQ ID NO: 3253 - DNA, 1143 bp, Actinoplanes utahensis
gtgctgctgcgagcttcggtggcggtacttctgctgctggcgacgattctggtgggctggcggattctccggccggccgaggtgctggcgaccgccaagtccccctatccaccgctggtggtgtccgcgccgggggtggtcggccggctcaacgttgcgccgctgctcgtcgaggaccgcctgcgcgtctatgccgccaagcaccagttgcgcgccgacgagccggtcgacagcaagggggtgaacaccgcccactggtcgttgcgccgctggccggcccagctcagcggggtggtcgcggccggcagcacggtggtcagccgctggtcggacggcgcgatcgtggccctcgacgcccgtaccgggaaaatcgcctggcgggccggcggtccgcaggcgccggattatgccgggcaccggaccggcgccgcgaccgtctggagtcctccgggcctgcgggtcgccgccggcgccgtcctggttctgcaggatcagagattgaccgcgtacgacatgggcaccggcgccgtgcgctggcaggtcagcactccggccgcctgcgcggacggtttcaccactgcgggcggcgccttcgtctgcgggtccggcgccttcgacggggccaccggcgccgtgctgccgggctggccggccggcaagttcgcaccggtcggctgcgcggtcgcgagttcgggctgtgccggcttgcgggacggcgcgggccacggctggctcaccggccgggtcgccccggtccggtcggtcgctctggacgacccggatgccacggtcgccggcggcatcgtggtgtcgacggcgaacggcgtggtcaccggtcaccgcccggacggcagcgccgcctggggctggtccggcgccggccgggtgctcggcggcgtcccgggccgcatcctggtcctcaccgacgaccacttcctggtcggcctggactccgcggacggtcgggagcgctaccgcttccacctcgccttccgcaaggagaacgaccagtggagcctcggcggtcagatgatcggcgaccactatctggcgctcgagcggctgaacccgaagccgccggccgatcgggagtcgccgacctactacttcaccaccgacaccgtcctcatggtcgggctgtag

SEQ ID NO: 3254 - DNA, 1119 bp, Actinoplanes utahensis
gtgacgacgcgctccaccgaactgctccgggtggtgcaccggacgcccggcgtgacccgcgccgacgccgcccggctgctcggcgtcggcaccggcgcggccaccgagctggtcgccagactcagccgggcggcactgctgacacaggccccggccgcacccagcggcagccgtggacgccccaccacgctgctgctgccccaccccgacgggccgctcaccctcgccgtcgcgatcacccacgagggctggcgggtcgaggcggtcgagctcggcggcgcgatcgccggcagccggacgggcgggcacgccggcgccgcctggcccgaggtccgctcggcggtccgcggcgcgcttcaggagcttcgctcggcgtacgggcatcgtccgcgcgccgtgggcgtctccgtccccggcaccgtctcccgggacctgcgcctggaagcggtcggcaccggctggcacgacgtcgacctgaccgagctcggcgcggccggcgaggtcttcgtggccggcaacgacgccaccctggcggccgccgccgaatcgcaccgcggcgcggcggccggcgcgtcggtcgccctgcatctgcggatcgaatccggactcggcggcgccgtggtggacggcggtcgcccggtgatcggcgcccacggggccgccggtgagttcggccacatgccgttcggcgacccggctgtccgctgcccgtgcggcgcgcgtggctgctggggcatcgcggtggacgggcacgaactcgcccggctgctgggcgacccggaaccacccgacccgatcacctacgcccggcgggtgatcgccgccgcggccgccggcgggcgtacggtcaccgcggtgcgggccgtcgccgccactctgggccggggcatcgccggactggtcaacgggctggacgcggacctcatcacgctcggcgggctgggcgccgacctgctggcggtggcgccggacgagatcggcgcggcgtatcgggacgggctgatgtcgatccaccgtgagtcgccgccaccgatcgtggcggccgtcctcggcgaccgcgggccgatcgccggggcggccgaggaggcctggaccgccctgctgccgaccctggcgtga

SEQ ID NO: 3255 - DNA, 1326 bp, Actinoplanes utahensis
gtggagcgcgtcgtcacatccgttccctttcttatgctcttcggcagagcttattctgtgggggtgagttttcaccgccccgcgctggtcgtcctcggagcttccgcgttcttctacgtcaccgccgaaacccttccggtcgggctgctcccgcagatctcggccggcctgcacgtcaccgaggcccaggtgggcctgctgctgaccagctacgccgtggtcgccgcgctgagcaccatcccgctcaccgcgctcaccatgcggtttccccggcacaccctgatcgccgccacggtagcgatcttcgcggtctcccaggcggccgccacgttcgcgccgaccttcgtggtgctggccgcggcccggctgatctgcgcgctggcgcacggcgtcttctggtcggtgatcggcccgatcatcgcccggctggcgccaccgcaccaggtcggccgggccaccgcgctgaccttcctgggcaactcgctggcgatcgtgctcggcgtgccggccggcaccgcgctcggccagtggctcggctggcgggtcgcggtcgggctgatggcggtcggcggggcggtctgcgtggcgctgctgctcgcggtcctgccgaagctcccgccgatgccccgggacctggccgccggatcgcgggagcagctgcgcaacgcggtccggatcctgcgcaacccccgggtggtgcggctctgcgcggtcaccggggtgctggtgatcgggcatttcgcggcgtacacgtacatcgcgccgctggtccgccgggatgccgggctggacggcgccgggctcagcgccctgctgctcggttacggcgcggtcgggctgctgaccaccttcctggtcgggcggttcgtcgaccggcacccgggcccgctgctgctcggcctgctggccgtgcaggcggtgtcggtggcgctgctcgccccggtccccgggaccgtgcccacgatcgtggcgacgctgctctggggcggcgcgttcaccgccatcccggtgttcctcggagcggcgccgctgcgggtcgcgccgaccgcccgggacgcggcgtccgccgtctacgtggtggccttccagatcggcatcggcggtggcgcgttcgtcggcgaacggttcgtcacggccggccggctcggggcgctgccactgctcgccggggtgctcgcggtcatggccggggtgctggtggcgacgtcccggacggtgttcccggcccggatgtcggcggccgaccacgaccgggtgtccgccgaggctgactcgttcgagggcattgccgcccgcagcggccaccacgagcgcgcggcgtcgtag

SEQ ID NO: 3256 - DNA, 1077 bp, Actinoplanes utahensis
atgacccggctgacccgcgccgacctggacgcgctgcccgcctacgtccccggtcgcaacgtcgccgacctggcccgcgagctgggcgtcgccgaggcgatcaagctggccagcaacgaggtgccgtacggcccgctgcccggtgtggtggaggcggtcaccgaggcggcccagcagatgcaccgctacccggacatgggcgtgctggcgctgcgcgacgcgctggccgagcggttcggggtggccgccgagcgggtggtcaccggctgcggctcggtggccctggccgagatcctggtcaaggcgacctgcctgcccggcgacgaggtgatctactcctggcggtcgttcgaggcgtacccgatcatcgcggccggggccggcgccaccagcgtgcgggtgccgaaccggccggaccacgggcacgacctgaccgcgatggccgaggcgatcaccgaccgcacccggctcgtcttcgtctgcaaccccaacaacccgaccggcaccgcgctgcaccgggcggagctggaccggttcctcgcggcggtgccgtcggacgtgctcgtggtgctcgacgaggcgtaccgggaactcgtcaccgatccggcggtgccggacggcctggagacctacggcgaccgggccaacgtggtggtcctgcgcaccatgagcaaggcgtggggcctggccggcatgcggatgggctacctggtggccccgcccgcggtggccgccgtcctgcgcaaggtgctcaccccgttctccaccagcctggtggcgcaggcggccgcgctcgccgcgctgcggcaggagaccgaggtggtccggcggtgcgcgctggtcaccgcggaacgcacccgggtcaccgaggcgctgcggaaactcggcgtggacgtgccggacagccaggcgaacttcgtctggctgccgctgggtgaccggtcggcggcgttcggcgcggcctgcgagagccggggcgtgatcgtgcggccgttccagccggacggggtccgggtgacgatcggcacgccggaggagaacgacgcattcctggccgccgccgaggcgacctggtaa

SEQ ID NO: 3257 - DNA, 576 bp, Actinoplanes utahensis
atggccctggccgggctgggccagcggctggtcgcccggctgatcgacatcgccgtggtgctggtgctcaacatcgtggtcaacggatggttcgcctaccagtggtggcgggacttccacccgatcctgaccaggtacatggaccaggtgcaggccggcgccaagccggactacccggtgggcaccgagcggatggccaccctccagatgaccatcatcctgatctccaccctgctctggctgctctacgaggctccggcgatcgccggacgcgggcagaccctgggcaagatgatgatggggatccgggtcgtcgggctggacagcaccgagccgatcggcttccgccgagcgttcggccgctgggcgcagctcggcctctggagcctgttctggtggtgcctggtcggcttcgtggtgcagttgctggactcgctctcccccaccttcgactcgcgcctgcggcaggcctggcacgacaaggcggcccggaccgtcgtcgtggcggtcccggacggcgctcaaccgaccgtcgaggcgacgcccggcggcgatcttcctggaggaccccgatga

SEQ ID NO: 3258 - DNA, 165 bp, Actinoplanes utahensis
atgagttcccttcccgcgggttggtacaaggacccggccgacaccagcacccagcgctactgggacggtgagggctggctgggcaaggccatcccggccgacgcggtcccgccggacgggccgccgccggtggaggtggaacccgcgcccgtcccgcccgtctag

SEQ ID NO: 3259 - DNA, 1128 bp, Actinoplanes utahensis
atgacctcgctgccggaaaacccggaaaacaaagacgtcttccccgttaaaggcgtcgaccacctgcggttcctcgtcggcaacgcccggcaggccgcccacttctactccaccgccttcggcatgaagtgcgtcgcctaccgcggccccgagcagggctaccgcgaccacgccgagtacgtgctggtcagcggcggcgccaagttcatcctcaccggcatggtgcacgccggagcccccggcgccgagcacgtcaccaagcacggtgacggcatctccgacatcgccctgcaggtgcccgacgtcgacgccgcctatctgcacgccacctcgaccggcgcgcgcggcgtgaccgagccgtacgacgtgaaggacgagcacggcacggtccggatggcggcgatcgcgacgtacggcgacaccgtgcacaccctgatcgaccgctccggctacgacggcccgttcctgcccggattcgtggcccgcgagccgatcgtcgcggtccgtccgaagcgcttcttccaggccgtcgaccacgtggtcggcaacgtggagctgggcaagatggacgagtgggtggagttctaccggcgggtgatgggcttcaccaacatggccgagttcatcggcgacgacatcgccaccgactactcggcactgatgtccaaggtcgtggcggacggcagccgcaaggtcaagttcccgctgaacgagccggccgtctcgcagcgcaagtcgcagatcgacgagtacctggagtactacgacgggcccggcgcccagcacgtggcgctggccacgaacgacatcctgaccacggtcgacgcgatgcgcggcgccggcgtggagttcctggacaccccggactcgtactacgacgacccggagctgcgcgcccggatcggccaggtgcgggtgccgatcgaggagctgaagaagcggaagatcctggtcgaccgggacgaggacggctacctgctgcagatcttcacggccccggtgcaggaccggcccaccgtattcttcgagttgatcgagcggcacggctccctcggcttcggcaagggcaacttcaaggcgctcttcgaggccatcgagcgggagcaggagcggcgcggcaacctgtga

SEQ ID NO: 3260 - DNA, 489 bp, Actinoplanes utahensis
gtggcgactgagcaaggtgtccagctcgacgagcttgacgcccggttgatcgaactcctcgccgccgagccgcggatcgggatcctggagctgtcccggcggctcgccgtcgcccggggcaccgtccaggcccggctcgacaagctcaccgtccgcggcgccatcaaaggcttcggccccgaggtgaccccggccgcgatcggcttcggcgtgatgagcttcgtgaccctggagatcagccagcgctacggccacgacgcggtcgccgggcacctggccgagattcccgaggtcctggaggcacacacgatcaccggcagcggcgacatcctgtgccggatcgtggcccgttcgaatgccgacctgcagcgggtgatcgaccagatcgtcggctacgaggggatcagccgggcgcacacgatcatcgcgctggcggagctgatcccgtaccggacggtgccgctgacccgggcggcagctcggacataa

SEQ ID NO: 3261 - DNA, 1278 bp, Actinoplanes utahensis
atggcctcgggcacgtggaagggattcacgctggtcgccgccgtgaccgtgacggtgctcgcggccaccggtgtgtggaacccgttccccaggctctgggagtgggtcaacaccagcgggccggtcgcgcccggcacccgctggcagcagcggctgaccggcaccccgcagagcgtcgcggtgatcggcgacgcggtcgtggtcgaataccgcacctcggtcgaggcgtacggcctgaccgcggcggtgaaactctgggagagcgacgccgactgggccgcggtggccggccaggggtcggacgccgtggtggtcactggccggctgctcaccaagggataccaggtgctggacccgcggaccggcaccgtgcgccgggccgacaccacggccggggcggtctggacgtacgacaacgggatcgtcgatctgcactgtgccggcggcaacgactgccggctcaccgcatgggatccgaaatccggtgatcagctctggtcggtggcgaccggcgggatcggcttcgtgctgcacgcggcgaacccggacctgcccgacacgcaccggctcggcaccggcgacgtcgacgatcaggcggccggcccggcgcagatgcccggcctgctcggcctgcccgacggcgatcgggtgcgggtgatcgacaccgcgaacggacgcctggtgcagaccgtccagcccggcccggaccagcggatcgcggtgaccggcgaccgggtgctcacgatcaccggcaccgccagggacgggacctgctactacggcgtggtggccacctcgccgccgggcaaccgggcggtctggcggcgcgacgggctcaacctgcggaccgcgcagagcgactgcaagcaggaccgtgacccggccggcggatacgacgtgctgctcggcgtcgatccgtacggtcgccaggagctgatcaacgcggcggacggccggattctctggtacggcgacaagtccgccgaggtgctcacggtcgacgaccggtacgcggtgatccgcgacggcgacaccctgcgcggctggtcgttcgcccggggcaaggcggtgtggcgtcagggcggccgggccaaggcgggcgccacggtcaccccgaacgcggtgatcgtggtctcctccgggagggtgaccgcgctgaatccggcgaatggtgcggtacgtgccgatgtgcgtaccgatgcgaaggtcttcactgccgcacccggtggtttgatcctggtttccggtcgcgacatggcctatctgccgtacagctga

SEQ ID NO: 3262 - DNA, 1668 bp, Actinoplanes utahensis
atgagcagaggcgccgctttcacctactcgccgctcttgccgaccggcgacgacacgaccgagtatcgcctggtcacggacgagggcgtggacgtcgtcgagggaccgggcgggcgccgcttcctgaccgtcgagcccgccgcgctcaccgtgctgaccgccgaggcgatgcacgacatcgcccactacctgcggcccgcccacctggctcagctgcgcgccatcatcgatgatccgaaagcgtcgcccaatgaccggttcgtcgccctggacctgctgcgcaacgcgaacatcgcggccggcggcgtgctgccgatgtgccaggacaccggcaccgcgatcgtgatgggcaagcgcggccggcacgtgctcaccgacgggcgcgacgaggaggccgtcgcgctcggggtgtaccaggcgtacacccggctcaacctgcgctattcccagctcgccccgatcaccatgtgggacgagcggaacaccgggtcgaacctgccggcccagatcgagctgtacgccgaggacccgaacgggcatccggacgcgtacaagttcctgttcatggccaagggcggcggctcggccaacaagtcgtacctgtaccaggagacgaaggcgctgctcaacccgcagcggatgatgcagttcctggacgagaagctgcgtctgatcggcacgtccgcctgcccgccgtaccacctggccgtggtgatcggcggcaccagcgccgagcacgcgctcaagaccgcgaagctggccagcgccaagtacctggacaacctgcccaccgccggcagcatggcggcgcacggcttccgcgatctggagctggaggccgcggtcctcgaactgacccgcgacttcggcatcggcgcgcagttcggcggccgctacttctgccacgacgtgcgcgtcgtccggctgccccggcacggcgcgtcctgcccggtcgcgatcgccgtctcctgctcggccgaccggcaggcggttgccaagatcacgccgtccggggtgtggctggagcggctggaaaccgacccggcgcgcttcctgccggaggtcaccgacgatcacctggagtccgagcaggtcgtcaagatcgacctgaaccggccgatgtccgagattcgcgctgaattgagcaagtacccggtcaagacgcgactgtcgctgaccggctcgctcgtcgtcgcccgcgacatcgcgcacgccaagatcgctgagcggctggacgccggcgagccgatgccgcagtacctgcgtgatcacgcggtctactacgccggcccggctaagactccggagggttacgcctccggctcgttcgggccgaccacggccgggcggatggactcctatgtggagaagttccaggcggccggcgggtcgatggtgatgctcgccaagggcaaccggtcacagcaggtcaccaacgcctgcaagacgtacggcggcttctatctcggctcgatcggcggtccggcggcgcgcctcgcccaggactgcatccggcacgtcgaggttctggaattcccggagctcggcatggaggcggtctggaagatcgaggtggaggacttccccgcgttcatcatcgtcgacgacaagggcaatgacttcttcgaggccgtcacgaagccggttctgagcatcggcaagcggtag

SEQ ID NO: 3263 - DNA, 504 bp, Actinoplanes utahensis
atgcgacccgccatcctggccgtgatcgccggcagcgtgctgctgaccggcgccgcctgcgacagcgacgacgcgaaggtctccactgccggcgcgccgacgcccgcggcgccggtcaccatcgcgtcgccggactactcggccgacaccgcgcaggtctgcggcaagctcgacaaggtgttcaccggccaactcgacgacttcggggcggcgatcggcaaaatgatcgcctacaaggaggcgaagcaggccgacaacgccaccaaggcggagaaggcggcggccgacgagctgcagtcggccggcgagcagatccgcacggagaccgccggcgcgcagaacccggagctcaaagaggccggtgaggagtcggcgcgcaagtttgaggccagcgccaaggaccacgcctacctcaagaagatcaagagtacggccgacctcgacaagaccctcaagccccagctcgccgaatggatgagcccggtcgccggcttctgcggctga

SEQ ID NO: 3264 - DNA, 3006 bp, Actinoplanes utahensis
gtggaacggccccgtcgtcgactctgccgcaccgtgctctcgttccactgtcgatccactctcacccgtggactactctcgatcaccggcacggggaatgaggtggctacggtgcgctaccgcatcttggggccactgtccgtcaccgtcgatgggcagtcggtggctgtcacggccggacgtgatcgggtcgtgctggcgatgctgctcctgcgcccccaccggatcgtcggcgcgggcgagttgatcggggcgctgtgggacggcgacccgccggccaccgcccgcggccagctgcagtcgtgtatctcccggttgcgccgcattctgccacccgacgtgattgtcaccgaccgtgccggctacggcatccgggtcggcccgggcgagctggacgccgaggttttcacccacgcgctggagcaggcccggacgaacgccgatcgcgtcgcgttccgtgcggtcctggccctgcggcggggcccggtctgcgccgagctggacgcgccggcgatccggcaggccgccgcggtgctcgacgagcggtatgcgttggccgtcgaggactgggcggagctggagctggccgccggcaacgagcgggagctggccggtgagctgaccgcctacgtcgagcggttcccgctgcgggagcggttgcgtggccagctgatgctggcgctggcccggtcggggcgccaggcggacgcgctggccgagttccgccgcgcccgggacctgctcgccgacgagctgggcatcgagccgggcgaggagctgcagaagcggcaccgggagatcctccagggagatctcggtgaggtcgtccacgccgaggcggtgcggtgcctgccgcggacggtcggtgacttcaccggccgccgggagcagatcgagcgtctgatgtccgggatcggcgcggcaaccggcggccccgtcgtcgcggtgatcgacggcatggccggcagcggcaagaccaccctggcgctgcatctcgcgtcgctgctcggtgactgctatccggacgcgcatctcttcctggacctgcagggccacagcgaacgtgacccggtcgagccggccgcggcgctgctggttctgctgcgtcagctcggtctggcggccggggagatcccgctggaagccggtcgtcgggtcgacgtgtggcgcaccgagacggcccgccggcgcgtgctggtggtgctggacaacgccgcgagcagtgcccaactggccgacctgttgcccaccgcgccgggcagcctggcgctggtcacgagtcgccggcggctcaccgggctggacggggtgcgggtcgagtcgctgccggtgctcacccaggacgaggcggtgtcgctgctggcgcagatcgccggagcccgggtggacgccgagccggaggccgccgccgaggtggtccgccggtgcgggctgctgccgctggcggtccggctggccggggcgcggctggcgcaccgggcccgctggcgggtcgccgacctgctgcaccggctcggcgaggccgcgctgcccgagctggccgccgaggaccgttcggttgcgggcgcgttgactctcacctaccgccagctgccggagccgttgcaacgggtgttccggctgctcggggtgtatccggggaccgagttcgacgcgctcgcggtggccgcgctgaccgacctggcgcgcgacaccgccgaggacgtgctggacgccctggtggacgtgaacctggtcgaggaaccggatccgggcatcttccggatgcacgacctggtccgcgaattcgccgcgaccctcgccgccgacctgccagccgtcgaccggcaggccgcgctgaccggcgccctcgacttccagatgcacgccgcggcggcggccaccagcgtgaacaagcgggtgatcctgtggcgggacatcggctcgccccacccggcccggcccgatctgaccgttccggatccgatcgcccggctggagtgggagcggccgcagctggccgcccacatcacggccgcgatcgcggcgggccggctggacgatgcctggaagctggcccgggccgcctggcacttcctgtatttccgcggttacatggacgacgtccgggagctgaacacgctggcgctgccggcggccgaggcgtcgggtgaccgggccgcggtcgccaccgtcgccaactatctggcctcggcgtacgcccgtgccgggcaggccggcgaagccgagggatacctgcgcctctgccttcgactgcgcatcgagctcgggcagcacgcggcggccggcacctcgatggcgaacctggccagcgtctatctgcatcagggacggttgaccgaggcggtcggggcggtgcagggcgcgctgcgctactgggtctcctcccgggtgaaggtcaatgtcggctccgagctgggcgtcctgatcgacgctttggatctgctcggacgcgctgccgaggcgttgcaccacacccggatgcggatgttctccgcgatcgaccaacgggccgaggccgagctggccgcctcgctgttgtacctggcccggatccgctaccgggccggctggctgcgtgccgaggcggcgcaccggtatctcgacgcctgcctgcgcctggcggatcggagcggccaccggtcgatcgtcgcggatgcgcacaacgagcgggccgtgctgcaccgggacgccggccgcctggccgacgcggtcgccgagcaccgccgcgccgtcgagatgtcggtacgcatgagcgacgctcgccaccaggccgagttccgcaacgagtgggcggtcaccctgcgccggttcgatgacctggccggcgcccgggagctgcacgagcacgcccgccggatcgcccaggccgccgggaacccgtactcgatcgcccgggcgcacgccggactggccgactgcctggacccggccgatccggccgccgagcggcaccgcgtccaggcccgggagatcttcgaccggatcggcgtcccgcacgtctga

SEQ ID NO: 3265 - DNA, 1398 bp, Actinoplanes utahensis
gtgacgagcgatcagagtggataccggatcgaacgcgacaccatgggcgaggtgcgggttcccgccgatgccctgtggcgggcgcagacccagcgggcggtggaaaacttcccgatctccgggcgcggcctggagccggcgcacctgcgggccctggcccggatcaagggcgccgcggcccaggtcaacgcgcggctcggcgtgctggacaaggatctggccgaggcgatcgccgcggccgccgcgcacgtggccgatggtggttacgacgaccagttcccgatcgacgtcttccagaccggctccggcacctcgtcgaacatgaacgcgaacgaggtgatcgccaccctggccgcccgggcgctggaccgcccggtgcacccgaacgaccacgtcaacgcgtcccagtcgagcaacgacgtgttcccctcgtcgatccacctggccgccaccgaggcggtcagcgccgacctgatcccggccctggagcacctggccggtgcgctgcgggagcgggccacggcctgggccgaggtggtcaagagcggacgcacccacctgatggacgccaccccggtcaccctgggccaggagttctccggctacgcacgccaggtgctcaacggcgccgagcggctcaccgccaccctgccccggctcggcgagctgccgctgggcggcaccgcggtgggcaccggggtgaacaccccgccgggtttcgccccggcggtgatcgagctgctccgggagcagaccggcctgccgctgagcgaggcccgcgaccacttcgaggcgcagggtgcccgggacgcactggttgagacgtccgggcagctccgggtggtggcggtgagcctttacaagatcgccaacgacatccgctggatgggctccgggccccgggccggcctgcgcgagctgcgcctgcccgacctgcaaccgggctcgtcgatcatgcccggcaaggtgaacccggtggtgcccgaggcggtccgccaggtctgcgcccaggtgatcggcaacgacgcgaccgtcgccttcgccggcacccagggtgacttcgagctgaacgtgatgctcccggtgatggcccgcaacctgctggagtcgatccggctgctggccgccgtggcccggctgttcgccgaccgctgcgtcgcgggcctgacggcgaacgaggaggtggcccggggctacgccgagggttccccgtcgatcgtcaccccgctcaaccgggtgctcggttacgacgaggcggccgcgatcgccaagcaggcgctggccaccggccgcacgatccgcgaggtggtgatcgaacgcggccacgtgagcgcgggcaccctaaccgaggagcagctcgacgaggcactcgatgttctgaagatgacacggccgtga

SEQ ID NO: 3266 - DNA, 1653 bp, Actinoplanes utahensis
atgagaagacgcctcaccgccggcgccgtcgtcaccgtgacgggcctggcgttcctgaccggtgcgccagggtccgcggtcgcggagccggcggcatcggtcgactatacggtcgtggccgccgacggggtctccgccgcggatgcgacggccgccatccaggcggccggcggcaccgtggtcagcggcaacgatgccgtcggcgtgtacagggtgacctcggccgacacgacgttcgagagccgggcgagcgcctcggcggcgctgatcggcgccaccgtgcgcaaggccatcggatacgcgccgaacggcgtcgagaaggtggaggccggtctcgcggcgcgcggcgggaagggccatggcccggccaaggccgacccgctcgacgacaagctgtggggcctgtcgatgatcaaggccgacaaggctcgccggatcgagaagggggaccggggcgtcaccgtcggtgtcctggacaccggcctggacgcgtcgaaccccgacctggccgagcacttcagcagccggttgtcccgcaacttcgcccccgacctggtcgacatcgacggcgcctgtgaggtgccgagctgcctcgacccggtcggcaccgacgacggcgggcacggcacgcacgtggccggcacgatcggtgccgcgctcaacggtgtcggggtctccggtgtcgcgccggacgtcaccctggtcgagctcaagggtggtcaggactccgggttcttcttcctcgacccggtggtcaacgcgctgacctacgccggcgaccggggcatcgacgtggtgaacatgtcgttctacgtcgacccgtggctctacaactgcaccgccaacccggcggacagccccgccgaccaggccggccagcaggccatcatcaccggcatgcggcgggcgctgaactacgcgcacgcgcatggcgtgaccctgttcggcgcgctcggcaacaaccacgaggacctgggcaagccgcgcaccgacgcgtccagcccggaccacggcggtacgccgtacccccgcccgatcgacaacgcgtcctgctgggacctgccggtcgagggcccgcacgtgatcggggtgtcctcgctcggcccgtccggccgcaagtcggacttctccaactacggcaccgagcagatctcggtggccgcgcccggtggctggtaccgcgacggttacggcaccgacaccttccagaccgtcggcaacgagatcctctccacctacccgctcaaggtgctgcaggagaagggcctggtcgacgcggacggcaacgtcaccgcggcgggtgccggctcggtcgtcaaggactgcgccggcgacggccggtgcgggtactacacgtacctgcagggcacctcgatggccagcccgcacgcggccggggtgggcgccctgatcgtcagccggtacggcctgcccgacctgcggcacggtggcaggttcctgccgccggacctggtcgagcagatcctgtaccgcacggccgcgaagcacgcctgcccggaaccgcgcctgcagagctacgtgcaggagggccggtccaccgagttcgacgcgctgtgcgagggcgggacgaacttcaacggcttctacgggtacgggatcgtcgacgcctacgccgcggtcggcggtcgctga

SEQ ID NO: 3267 - DNA, 1419 bp, Actinoplanes utahensis
atggtgactcttcgcttgtatgacaccgccactcgatcggtccgggacttcgtcccgatgacgcccggtcaggtggggatctacctgtgtggcgtcaccgtgcaatcttccccacatatcggtcaccttcgctccgcggtcaactacgacgtgctccgtcgctggctgctgcacgaggggctggacgtgacgttcatccgcaacgtcaccgacgtggatgacaagatcctgcagaaatcgctggagcagtcccggccgtactgggcgatcgccttcgagaaccggctcctgctggagcacgactaccgcacgctgaacgtgttgccgcccacctacgagccgctggccaccggtcacatcaccgagatgcacgacctgatcgccgagctgatcgagcgcggccacgcctatgcggcggccgccgccaacggcgacgtctatttcgacgtccggtcctacgagccgtacggcgcgctctccgggcagaaaccggacgacatgcggtcggccgacgacgctcccgagcgggacaagcgcgacccgcgcgacttcgccctgtggaaaggcgtgaaggcggacgagccgcaggacgcgtactggccgtccccgtggggccgcggccggcccggctggcacatcgagtgctccgcgatggcccggcgctacctcggcgacgagttcgacatccacggcggcggcctcgacctgaccttcccgcaccacgagaacgaggtggcccagtcgcaggcggccgggctcggcttcgcccggttctgggtccaccacgccctgctgaacctgggcaagtccaagatgagcaagtcgctgggcaacgtcatcgacctggccgcggtcaccgcggccgggatccgcccggtcgagctgcgctactacctgggcagcccgcactaccgctcgcggatcgactactcggacgaggcactgcgcgaggccgccgtggcgtaccagcggatcgagggtttcgtccaccgggccgccgagatcgtcggcccgggccggcccaaggcggtgccgccggcattcgccgacgcgatgaacgacgacctgaacacctcggccgcgctcgcggtcgtgcacgacacgatccgcgagggcaacaccgcgctggccgccggcgacgagccggtcattcggggcgcgctgaccgcggtccgggccatgctcggcgtgctcggcatcgacccgctcgacaccgcctgggacggcggcgagagcgccaacaacctgaagccggtggtcgacggtctcgtcgcgctggctctggaacagcgggcccaggcccgcgcacggaaggactgggcggccgccgaccaggtgcgggaccagctcaagaacgcgggtattcaggtggaggacactccggccggtccgcgctggacggtaggagagcagcactga

SEQ ID NO: 3268 - DNA, 1128 bp, Actinoplanes utahensis
atgccgggtaattcacagaacgcgagcaagcgggtcacctcgaagaagggcgccgcggccggctcgggcggaaagaaccgctccagcctcaagggccggggcaagaccctgcccgccgacgagcggccgtggcacaagggttactcgggcaccgagaaactgcccgagaagaccgcccgtaagcaggacaaggagcgccgcgccgcggccgccgagggccgcacgcccaaggtcggccagcctggcaccaaggacaccacctggggtcgcggcggtggccgtgccccgggcatcacccgtgcccaggcgtcccggggcggtggccgggtgaccggtccgcgtggcccgcgggtggccccgggccgccggtccaaccccaccaaggaagggccggagctgctgctcggccgcaatccggtggtcgaggcgctgcgcgcgcaggtgtcggccaccgcgctctacgtggtgcagggcatcgacatcgacgagcgggtggcggagatcgtccgcaccgccggcgaccggggcatcccgatcctggagatcagccgcaacgagctggaccggatgaccggtggcgtgctgcaccagggcatcggcctgcaggtgccgccgttcgcctacgaggacttcgacgacctggtcgcggcgtcgctggagcagaccgcgccgctgctggtcgcgctggacggggtgaccgacccgcgcaacgtgggcgcggtgatccggtcggtggcggcgttcggcgggcacggcgtgttcatgaccgagcgccgcgcggccgggatcaccgccaccgcctggcgcaccagcgccggagcggcggcccgggtgccggtctcccaggtggtcaacctgacccgggcgatcaagtcggcgcagaagcagggcttcaccgcgatcggcctggacgccgacggcgagaccgacctctaccagctggaggcggcgatcggtccgctgatcgtggtggtcggctccgagggccgcggcctgtcccgactggtcggcgagacgtgtgacctgcgggtcagcatcccgatggcctcggatgtcgagtcgctgaacgcgagcgtcgcggccgcggtcaccctggccgaggtcgcccgccgccgcgtacacggctag

SEQ ID NO: 3269 - DNA, 1929 bp, Actinoplanes utahensis
atggcttctcacatgggggaatctgtgtctaataaacgccgcgccgcgcatctgctgctggccggtctcaccgccaccacggtctggtcgaccgggttggccgcgcccgcacacgccgccgggaccgccaccaccgccgccgccgggacggttgccgacccgaccaacgtcgccaccgacgaggacaaggtcaaggccgccgccgccatcggcgtcaaccccggcatcgacctgctcgtcctgaacgaccaggctttcgtcttcgccctctaccagcgcgacgaggccgggccgtacgtgaaggccgaggcgctgcgcacctacctgtcgtcggacccgcacgccgcctacgacttcatcgtcaatggcatcttcgtggcggccgacgacgacgcgcacgccaagatcgtcgaggagaccgccaaggcccgccgccgttcggtcgcggtgaccgtggggctcgacccgtccgagacggcgctgatcgagaggaacgaccgcgacttcatcttcgcggtgtggcagcgggtcaccgcgggcagccacgtctggaccgccgcccaggcggcgatcgccgacggcaccggccaggccgagtgggacgccttcctgaacaccggggcggcggccgccgccgagcaggatctgcgcgacattatcgtcgacggcgacgaggcgcaggccgcgaagctgcgggccgcccagctcgtcgccgccaaaaagtcgctgctgcagctgttgctgctgccggtgaccgacgagctggtgaacgcgccggaccggcagttcgtgctccacatccacaacaacgccaagggcgacgaggtctcgctggcttcccaggtcgcgctcaacacgccggacgacaagctggcgcaggcgctgaccgacttcatcttcaccggcggcgcggccgccaacaagcgggacgaggacgccgccgctgccaaggaactcgccggttacaagacccgcgtcaccgccatccgggacgccgccaagaccgacggctggctgcccaacctgctcgccgcggcgaaccaggcgctcaccaccggcaccctggtcgcgctgcaggccttcctgctcaagggccaggacgaggcgcgggccaaggaccagaagtcgtggggcaacgtggcgctcgccggcgaccgggtcggcatcctcaccaacaacagcgtcgcgtacgtcaaggagggcactccggccgcgacgtcctgggtcaacgagtaccccggcggcgtgaagcagctcgtcctcgccggcaaccggatcggcgtgctgctcaccaacggcgacgcctacgtcaaggagggcggcctcagcaccggttgggtgctggagcagagcaacgtcaagcaattgaccctggccggcacccggatcggcgtggtgctcaccaacggcatcgcctatgtcaaggagggtggcctcagcgccgcctgggtgatggagtaccagggcgtccagcagctcgcgctgaccaccaaccggatcggcgtggtgctcaccaacggcatcgcctacgtcaaggagggtggcctcagcaccggctggtccacccagcgctccgggatcaaggacatcacgctgaccaccacccggatcggcctgctcggcacggacggcaccgcgtacgtcaaggagggcgccatcaccggcaccacctggatcaccgagctgaccggggtcaagcagtacgtcctcaacggcacccggatcgccgcgctcaccaccggcggcatcgcctgggtcaaggagggcggcgtcagcacggcgtgggtgaacgaggaggacaacgtcgccaagctggcgctcgacggtgaccggatcgcggtgctgttcaccgacggcaccaccgcgctcaaggacggcggcctgagcgccctctggaccagccagaagagcgtcggcccgctcagctga

SEQ ID NO: 3270 - DNA, 1923 bp, Actinoplanes utahensis
gtgacgtttccagtgaaacgcctacgacgacgcctgctcgcaggcgttgccgtgggagtggcgagtgtcctcgtcacaccgcagatcgcggtggcgacgccgtacgtgcgggcgccgctcgcggccgcaccgcaggagttgacggtgcagcaggcgctggagcgtctgctgggcggtcaggagcgggcgtcgtcgcccgcgaacgatccggtcgacgacgccgagctggaccggatgctggtccaggatctggcggactacgacgcggatcccgaggtgcgggcggcggcggccgcggcgctggccaccggcgacgcggcgaagatccgggacttcctggacaacggcctgccggtctatcgcaaggacgccgagcagcataagaaggacgaggcggagcggaaccgggcgcagatcgacgagtggctcgagaccggtggcccgctcgtgcgcaagaacgggcaggccgcgctggactcgggcagcgatgccaagatcgctgacttcgtggccaccgggcacgcggcggccgagctggccgaccagcaggatgtgctgagcgccgcgcagaaggcgcagatgatccaggcccgggtcgagcagatggtcgcgcagggcggctacgaggtgcaggagctcggccaggcggcactggacagcgaagatccggcgatcatcgaggacttctacctcaacggttaccagctggccgcgcagcaggacgcggccgcacaacagcagatcaccgatgccctggccgcccgcgcgaaggcggtcgcggacctgaccgatctggcgcagcgggccgcgcaggccgcggacgcgcagcagaagatcatccaggcgagcgtcaccgcgacgaccgccctgaccgacgtgtccgccacgatgggcctggcgaaccggaacgccaagcaggccgacgcggtctacgccgccgacctgccgctgcgtaccgcgggcaagcccacccacaccgcggacctgaccagcctgcgcaccgtcgcgtgccaggacgcggccaacgccgcgcacagcgccgaccaggccaccgcgcaggccggtgtcgcggccaccgccgcggccacgctggagaagaccggcctgacccacggcatcacctggtccgaggtgacccaggcgcagtcggacgcggcggccgcgggccggttggccgccgagaccgcgtgtcatgcggccgaggcgaccgaggcggccggcaaggccctggacgccgaccacagcgcgaccgtcgacgcgaacaacgcggtgaagtaccggcaggccgcggagcgcgagcaggccgccgcggagaagctggccgacaaggcggagaagctcgccgccgccgcgcaggccgccgccgcggacgccaaggcgcagcggctgcgggccgagagtgacgcggccagcgcgcgacagcatgccgacaatgccgccgcgtactacgaggacgcccggcagaagcgcgcggtcgcccgagcggccgccgcggccgcgatccagcattcgctgaacgcgtacgacgcggcgaagcgggcgatcgaccagcagaacatcgtcgtcgccaagggcgccgtcgccaagcagaagcaggacgaggcgctggccgccggtgcccgcttcaaggacaaggcggatcgcgcgcaggcgctgatcacgaaggcctcgaaggacaacgagaacaccaagtccaaggagttcgaggcgcaggcggccgaggcccgccagctcgccgcggagacggcctgcaagaacccgcagacggccaacggctgtccggggaccgccgacatgcagaagatccgcgccgacgcggctcagatgcggaccgtggcgaaccaggccaagaccgcatcggacgcgtcgaaagcggcttcggacacggcggcgggggagtcgtcggcggccgcggcggactag

SEQ ID NO: 3271 - DNA, 1806 bp, Actinoplanes utahensis
atggcggcgcaggccggcagtgacgccggtgcggcgcagcaggcggcgaacaacgcggccggtttcgcgaagaaggcgaagcaggcctcggacaacgcgagcgcgctgtccaagaagatcaccggggtcagcgacacgatctcgtcgatctccgaagcgatgtggagcgtcgcccagtcgatgggcacgatggcgcacacgctgcaggacatcgcctggcaggcgtacaacgccgagcaggcggcggcagagaagaagctcaacgactggatcgacgacaaggcgaagtggctcaacgaccacatcggcgggtcggacgtcacgaagggcttcatcgacggcgcggccggcatggtcaaggggatcatccagaccagcaactgcgtgaccggcacgttcctgggcaccgacgcggccaccgacgagtacacggtgcccgacgtcagctacctgccgaactcggacaagtcctgcaagatgctggtcaagggcgtcaaggacctgctcagcgacccgaagcagctgctgcattgggacgactggaagaagaactggaagtacgcgctcggcgagaccctgttcgacgcgacgttcttcctggtcaccgacggcaccgggctgatcaccaagatcgccgagagtggcatcgcggcgacggccaagcaggcgatcaaggacatcgccaagctgtcggccaaggacatggcggccggcgtcgtcaagttcggcaccgagaagctggtcaacgcgatcaaggaactcggcgccaccgccaccgcccggatcatcgagctcggcgagtccctcggtgagaagctcaagatcaccttcaacccggacgagctgaaggcgatgtcgaacgccatcggcctcaagggcatcgacgccgtcgagggcgcgcttcgcgacctcaaggactcgccgctcatcaagggcctggaggatttcgccgaggagtgcttcgagggcaagaacagcttcgctcccggcacgctcgtcctgctcgccgacggccgtaccgagccgatctcggagatcggcatcggcgaccgggtgctggccaccgacccgatcaccggggccacccgggccgagccggtgaccgcgctgcaccgcaattacgacaccgcgctcgtcgacctcgccgtcgccgaccgggccgggcaccgcagcgtcgtgcacaccaccgaggagcacccgttctgggacgccaccactcgatcctggaccgacgccgcggccctcaagccgggcgaccggctgcgcgggctcgccggggcgaacgcccgggtcgcgtccgtccgctcattcaccggcggccggatcatgcacaacctcacggtggccgagctgcacacgtactacatcctggtgggcggcgcgccggtgctcgtgcacaactgcgccgacctgatcgccgacgacggcaagttccaaggccaggcgcataccctggacgagcacgtcgaccccgacctggcggcttcccagaagctggccatcgagaagaccgcgaagctcggctacgaggtcaagaacagtgtcttcaccgacctgcagaccgcgcagtcggtcgtcgactatgcgatcgccttcaacaaggaccggatcgggaagtggctcagcaacaaggacgcacctcaggagcttgcctggcaggggaaattcggcgccaagaattcgctgggtgtcgcgacggatgtccggggcctgcagacagcgtgcggaaacggcttcaggatcgtcctcaagaaggcgccggggcataagagcggcttctacgtcttcaccgcgtttccgatctga

SEQ ID NO: 3272 - DNA, 603 bp, Actinoplanes utahensis
atgccgctgtcaccgttcgaccggggaatcaccgccctggcgggaaccttcttcggtcccgagtggctgcaccacggtgatcggttcgacgtgctgcgcctcgcctacggcgcggaggccgacccgggtgcggtcgcggcgacacggcaggaagccctgctcatgctcgggggcctggccaccacagcggttcaagcgctgtggcaggcgggcacccgggcctgggtcggcatcaagcatgctccggacgccggccaccagtggatgcgcgagatcgtcgccttctgcgacgagtggtccgcgcgtcatcccggcccgtcgtccggcgcagagccggcggacgacggccgggaactgctgacttccgtgctcgccctcatcgccgaggtacggattccggaccgggaggtgaccgacgcgttggcggactgtgcccggaactgcactccagacctcgccctgcgctggctcctccaggttttgagcgtggctgatcacccgctgctcaccgcgtcgcagtacgacgtggtcacccaacttgccgagcacctgaaatacggcgaatacgtgctgcccgaccggggcgtcatcgtcgccgactga

SEQ ID NO: 3273 - DNA, 1890 bp, Actinoplanes utahensis
gtgtccaccaaacgtcaggccgcacatctgctgctggccggtctcaccgccaccaccgtctggtccaccgtgctgaccgccccggtgtacgccgccggcagcaccaccgccgccgccgcgagtgtggtggccgatccgacgaacctcgccaccgacgaggacaaggtcaaggccgccggcgccatcggcgtcaaccccgggatcgacatgttcgtcctgaacgaccaggcgttcgtcttcgccatctaccagcgggacgaggccgggccggccgtgaaggccgaggcgctgcgcgtctacctgtcgtccgattcacacgccgcctacgacttcatcgtccgcggcatcttcgtcgcggccggcgacgacgcccaggccaagatcgccgagacggccgcgcgggcccgccggagctcggtggcggtcaccgtcggactggactcgtccgagatcgcgctgatcgagaagaacgaccgcgacttcatcttcgcggtgtggcagcgggtcaccgccggcagccacgtctggaccgcggcccgcgacgcgatcgccgacggcaccggccaggccgagtgggacaccttcctgaacaccggggccgcggccgccgccgacctggacatccgggaggcgatcgcgaaggccgacgccgagcaggccgcgaagctgcgggccaagcagctggccgacgccaagacgtcgctgctgcagctgttgctgctgccggtgaccgacgaggaggtcaacgccccgaaccggcagtacgtgctgttcgtgcacaacaacgccaagggttccgaggtctcgctggcctcccaggtcgccctcaacgcccccgacgaccagctcgacaaggcgctgagcgacttcatcttcaccggtggcgcggccgccaacaagcgggacgaggacgcggccgccgccaaggaactcgccggttacaagacccgcgtcaccgccatccgcgacgccgccaaggccgacgcctggcagccgaacctggccgccgccgccgacgcggcactgaacaccgggaccgtggtgtccctgcagacgttcctgctcaagggccaggacgtggcgcgccagcaggacaacgagtacgcggcgacgttcgtccgggacttcaacggggacggcaagcgcgacatcgccgggatcgacgccaacggcgacctgaaggtgtacgtcggtgacggcgccggcaagctggccgagggcggcgcgatgtggccggtcggcggttcctggaagaatcacaagttcatcacctcggcggacttcaacggcgaccagaagaccgacgtcgtcgccatcgacgcccgcggcgacctgaagctgtacaccggcaacggggccggcaaggtggccgagggcggcgcgatgtggccgaccggcggcgccttcaccaactacaaggcgatcatcgcgggtgacttcaacggcgaccgcaagaccgacatcgccgggatcgacgcggccggcgcgatgcggctgtacctgggtgacggtgccgggaaggtgaccgacggcggcaccatgggcggcagctggggcggcttcaaggccgtcgtcgcgggcgacttcaacggcgaccgcaagaccgacatcgccggcatcgacgcgaacagcgacatgaagctctaccccggtgacggcgctggcaagattaccgcgggcaccgcgatgtgggcgctcggcggcaagtgggccggtttcaaggccatcgtcgcgggcgacttcaacggcgacaagaagaccgacatcgccggcatcgacgcgaacagcgacatgcggctgtacgtcggtgacggcgccggcaagctctccggcggcaccgcgatgtgggccaccggcggcaagtgggccggcttcaagcgcatcggctga

SEQ ID NO: 3274 - DNA, 1197 bp, Actinoplanes utahensis
atgcgatcaccatcttggcaggtggtaggaaaacaaatacggtggcgaggcagttccttctactcggatcgtccggcacgttcctgccggtggaaaggaagtcgattcaccatggctaccgtcacgtacgagaaggcctcccggatctacccgggttctgagcgccccgcggtcaacgagctgaacctcgagatcggcgacggcgagttcctcgtcctggtcggcccctccggttgtggcaagtccaccagcctgcgcatgctcgccggtctggaggatgtggaccgcggccgcatcctgatcaacgacaaggacgtcacgcacctgccgccgaagtcccgcgacatcgcgatggtgttccagaactacgcgctctacccgcacatgacggtgtacgagaacatggcgttcgccctgaagctgcgcaagaccccgaagtcggagatcgaccgggcggtcaaggaggccgcggccctcctgcagctggaggagtacctgacccgcaagccgaaggcgctctccggtggtcagcgtcagcgtgtcgcgatgggccgcgcgatcgtgcgtcagccgcaggtgttcctcatggacgagccgctgtcgaacctcgacgccaagctccgcgtccagacccgttcgcagatcgcgaccctgcaggcgaagctcggcgtcaccaccgtgtacgtcacccacgaccaggtcgaggccatgaccatggggcaccgggtggcggtcatgctggacggcgtgctgcagcaggtggacaccccgcgggcgctgtacgacacccccggcaacgtcttcgtggccggcttcatgggctccccggcgatgaacatcaagaccgtgccgctgaccgaggcgggcgccagcttcggcgcgctgaccatcccgctgacccgcgagcaggtcgccgcggcgcagagcggcgacggcaaggtgaccgtcggcttccgcccggaggccgccgacatcgtcaccgagcaggtcggcgcgctgccgatcgtcgtcgacctggtcgaggacctgggctcggacgcgaacgtctacggtcacgccgacctggccggcggctcggagcgtttcgtggtccgcaccgagcgtcgcaccatgccgcacatgggcgagacggtctacatcaagccgcagaccaactccctgcacgtgttccacgccggcagcggcgcccgtatctga

SEQ ID NO: 3275 - DNA, 1857 bp, Actinoplanes utahensis
atgccagctcccggtgacggctccgaggacaccgccgcgcacggccacgagcaagatcaagatcaacttcccgatccgcttgtgtacgccacgggcaccgccgccgcggccacccccacgccgactccgccgaccgctccgcacgagccgcccgtccgcaccgacacccggatggacgacccgctgccgccgcgccccgcctcgaccgaggatccgtcgatccgctacaccgccccggtcgacccgtgggccgacagcgcggcccaccccgccgaggcggcgcagatggcacaggcggcgcaggtggccgaagccgcgcagatggcacaggcggcgcacgtggccgaggccgcgcagatggccgaggcggcgccgccggtccgggcggggcacgacgccgagccgccgaccacggtcaccccgccggtcgcaccgagctccccggccggtccgcccgccgggggcacgagcggatcgacgtacgccgctcatcagccgcgagcgggcaccacctcgtacaagaaagggttctgggtcctgggcggcgccgcggtggccgccgccgtggccctcgggatcgccgcgaccatcctgctggggcccggtttccgggccctggactaccacgagctcgaccgggtcgcgcacttcccgccggtcgccgcgatctcctccacctgggcggccacccaggtgcgcggcgaccgcgcctacttcgcgagcgtcgacgagcagggcaccgccggagtcgtcgccgccgacaccggcacccgcaaggagctgtggcgcagcaccgaggcgggcaccgcgcacagctggcactcgatgaccgcgctgcccgacgcggtggcgctggtcgcagacccggattacagcaccagccagagcaccggccggctcgtcgtcctcgacggccgcaccgggcacaaacgctgggaacacgcgttcggcagcagcgacacgatgctgttccgggccggcatcctgctgctcgtcgaccggaccgacggcaacctgatcggcctggacctgaccaccggcacggaacgctggcgggacgcgaacccggacggctcggcgaacagcaccgtgctggacgtcaccaccccggacggcctgaccggaccggccaccaacgacggcttcccggtcgccgacgacgccggcgacggccggatcgtgcaggtggccggcgaccggtcggcccggatcgtcgacctcgccaccggcaaggtgggcaagacccggagcaacgtcgcgtacagcagcgacaagatggtggcgcaccacgggcggttgttcgtcgaagagtccgccaccgaccggctcgtcgcgtacgacctgaagaacttcgacaccgccgaacccgccgtgctgcacaccgcacgcaacggcgccgaggtcaccgacctgacgccgtgcggcgacgaccggatctgcttcgtcgaaaccgccggctaccagcgggacaaggccgaggccgtggcgtacgacctgaccgcccacaaggagacctggcgccggccggccccgcaggccgagaccctcgtcccggtcggtgacgcggtgctggtcaccaccggcaaatccacgacgctgctcggcgccgacggcaaggcgcagtggaccgacgagccgggagacgcggtccgcctcgacgccggcaacgtgctgcgcttctccgacacgctgtcgccgtcggtcgacgaccggatcctgaccggggtgcacctcggcgaccagccggccctgatcggccggctgcgcgacgtgcgcagctccacctgctcgtggaaccgatcggtgatcgcctgcgccggcgacaaggactacctgatcgcccgcttcgccggctga

SEQ ID NO: 3276 - DNA, 477 bp, Actinoplanes utahensis
atgcagacttttctgccctaccctgacttcctggcgagcgcccgggtcctcgatcagaaacggctcggcaagcaacgcgtcgagacgatccaggtactgcgcggcctcacccggcacgactacggctggcggcaccatcccgcggtcctgatgtggcgcggttacgaggaagccctggtccgctacggcctggcgatgtgcgaggtgtggaccgcctccggccatgccgacacctgcgcggacaccctgctcgccgacctgggcgccgccaagggcatcagcacggtccgcacccagccggagctggcccggatcgtcgggctgccgccctggctcggcgatccggatctgcaccgcagccatcagtccgcgctgctgcgcaaggacccggccacctaccgtccggtcttcggcgacgtcccggacgacctgccctacctctggccggtcagccggacgaccgccgtcagccggtga

SEQ ID NO: 3277 - DNA, 792 bp, Actinoplanes utahensis
gtgcgtaagttgtggtatgccggtgcgatcgccggaggactcctattcatcctcggagcgaccgggcccgccctcgcggaccccgcctcgccggtcggcggcccggtcgacgacgtgctgtcgcgcaccaacggactgcgcctgtccagcccgatcggcagcgacccgctgggccgcgccccgctgctcaccctgagccaggacaaccagcaactgttccaggtcaagccggggcagaacagcatcggacggtcacccgaggagaaggccgggggcgcgctgccggccgcggacgtgatcggcggcggcatccacaaccacccgggcgaccggttcggcgggtcgctcaagggcgtgccgctcaccgacacgaacaccggcgcggtgcgactgccgctgctcggcggcggccggctgccgatcatcagcgggatcctgccggacggcagccacaccgtggagagcgcctcccgccagtacccgctgctcgacgacctggacggcgatctgtccgtgcgcggcctgccgcggcgcctgcccaccaccaaccgggccaacctggccggactgccgctcggcggctcgccggtcgccccggccgacctgctcccggagagcagccggccgaagcacccggcctcggtcgcgccgtcggccagcccggagccgaccatgagcgcgtccgtggatccctccatgagcccgtcggtgatcccgtccggaagcctggcctccaacgtggacgatccgcggctgctccaggagccgatcgacatcccctcggcggactga

SEQ ID NO: 3278 - DNA, 1695 bp, Actinoplanes utahensis
gtgaacgtgagtacggagatccaccccgacgccgaaaacctgccccacctggtcgtctgcggcgccgatgcgctggtctggacactcgccgaggaattggcgaattcccgccatcggatcaggctgacggtgatcactccgcaccacatccggtccgacgtccccgacctgaagatcctcaagaaggtgggcgtcgagctgcgccacgccgaccggctggacgagcaggcgttcgaggacgccggcctggccggggcgaccgcgctcgctctggtcatgccggacgacatggtcaatctgcacgccgccctgtgcgcccgcgaggtcgagccccggctgcgggtggtggcccggatgttcaccaccgggctggccggcagcctggcccggatcttcccggacagcgaggtgctctccgacgcggagatggccgccccggccttcgtggcggcggcgctcggcgaggtcgcgccgacccacttcagctacggcgaccggaccctctacgtcgcccagcgcgccgatgtgccggcccgcaacgtggtgctcaccctgcgctccggtgtcctcctgccggccgagccggcgcccggtgcggcgggcccggacgatctggtgctggctcaggcggtcgggttgcccgccggcgacgacgtgacccgccgggtgctggcccgggccggccgtagccgccgtccgctgggcggcctgggccgcgcgctccgcgccgccctcaaccgcaagctcggcatcgccgtcctgatcacgctgggcaccacgatgctggccggtgccgtgctgaacatctgggacggcacccggcacaacctgtggcagtcgatctacgtcaccctgatgaccgcggtcggcgcctccgacgtgcaggacaaacgcaacccggtcgcccaggccgcccagctggtcctgaccatcggcggcctggccctgctcccgctggtcaccgccgccgtggtcgacggcatggtgaacgcccgcctggccctcgcccagggccgcctcaccggcgaactgcgcgaccacgtcgtgctggtcggcctcggcaacgtcggcacccaggtgctgcggcagctgcacgcgctcggcgtccgggtggtggccatcgaccggcatgccgacgcccggggcgtgaagtccgcccagcgccgcggcctcccggtcatcatcggcgacgccgcccgcgaggagaccctgcgatcggtctccatcgagacctgccgcgccctggtcgtcctgtccaccaacgactcggtgaaccttcaggccgccctgcacgcccgggccatccgcgacgacctgcgggtcgtgctgcgcctgttcgacgacgacttcgcccagcgcatcggtgccgccttcgacatcaacacgtcccgcagcgtgtcccgtctgtgcgccccggtcttcgccgccgcactgctggagcacaacgtcagcgtcagcatcccggtcgaccgccaggtgctggtcgtcggcacggtcaccgtccgcgagggctcggacctggacggcgccctgctgacggccgtcgacaagcccggccagacccgggtgatcggcatgtcctcggccggccagggctggatcgactggcgccccgacccccgccgcctgctcgtcaccggggaccggatcctggtcgtcgcccgccagagagccctgcgcgcgctggcccgctag

SEQ ID NO: 3279 - DNA, 1212 bp, Actinoplanes utahensis
gtgcgcatcacctccgccctcatcgaccccgcgctgctggacctgccgtggcacgtgccgctggaggactggccggccgaccatctggtcgcgctgccgcagggcatctcccggcacgtcgtccgcttcgtcaagctgaacggcgtcgtctacgcgatgaaggagacccgggagcggatcgccgagaaggagtacgacctgctgcgcgccctggaacggatcgacttcccggccgtgcaggcgatcgcgatcgccaccgaccggcagacgccggagggcgagccgctggagaccgtgctggtcacccggcacctgcagttctctctgccgtaccgcgcgctgttctcccgggtgctgcgcccggagacgatgaaccggctgctcgacgcgctggccgcgctgatcgtccggatgcacctgaccggcttctcctggggcgactgctcgctgtccaacacgctgttccgccgcgacgcgggcgccttcgccgcgtatctggtcgacgccgagaccggcaacctgtacccccggctctccgagggccagcgcagcgaggacatcgagatcctgcgcctcaacatcttcggcgagtgtctcgacctgcaggccgccgagctgctgcacgagtcgatcgacccggagacggtggtcgacgacatcgtggcccgttacgagcggctgtggcacgaggtgacctatgagcaggaggtcgcgaaggacgcccggcaccacatcgagcggcgcatccggcggctcaacgagatgggcttcgacgtcgccgaggtgtccatgtccaccgtggacggcggataccgggtgcggccgaaggtggtggacgcgggctaccacacccgccggctgatgcgcctgaccggtctggacgccgaggagaaccaggcccggcagttgctcaacgacctcgacgcgtaccgcgcggagagcgcgctgaccgacgaacagcaggccgcgcaccgctggctgaccgaggtcttcgagccggtggtccgtgcggtcccggccaccatgcgtcgcaagctggagccgcaggagatcttctcccagatcatccagcacaagtggttgctctccgagcgggccggccgggacgtggggatgggcccggcggtgcagtcgtatctgaccgaggttctcgtcaacaagcccgacgagcaggcggttctcggcgtcgaggcggaggagctggtctcctag

SEQ ID NO: 3280 - DNA, 1353 bp, Actinoplanes utahensis
atgcgacgcaagacagtgttcgtcgtcggagcgtgcgcggccctcgtgctggccggggtggccggcgcggtgacggcgacgcgcggcgacgaccatccggcccgggtgtggcactcggcgcccggggtgccgaaggtgcgggtggccgccgaggcgacgctgcgtgccgtgccgtcaccgacgtcacgcgcggcgaagaaggtcgatgaagcgccggtcgtcaaggcgccggatgacctccgccacgcgccgatcgtcgagtccgcacaggtcccggacgagccgggccggcagcaggtcggcgagctgctcagcgtcggcagactcctcggctatctggccggcccgccccgggagacgttccgctatcccggtgcgtcctacgtcaagctgcacttcgcccggatggccatgctgcccggcgactatgtgaccgtgtcgaacccggccgggaccgagtcgtaccgctaccagcccggcagcaccggccggtgggccatgtcgatcaccggggacaccgcggtggtccaggtgcaccgggcgctcgacccgctcggactgcggtccgccctcgacggcctcggcgtgaccgtcgaccgcgcggcgcgcgggttcagtcgtaccgagcaggcccgtgtccccgaggagaccaccgtgcgcccgggccggaccgggcgcgaggaatccatctgcggcccggacacctccgccgacgcggtctgctaccagtcggccgacccggtcgcctacgtcaagtcgaaggcgatcgcccggctgctgatcaacggcaccgagttgtgcaccggctggcgggtcgggccgaagaaccggatgctcaccaacaaccactgcctgaccacctccgaagaggcctacgacaccgaggtctggttcaactaccagtgcgccaagtgcggtgggtacgacgtgttcaaaccgaccaaggtctggggcgaccgggtcttctccaccgaccacgtgctcgactacacgctgttcagcgtcgacgccttcgagaccatccagcagttcggctatctcaccctcgatccggcccgcccggccaagggcacagagttgtacgtgccgcagcacccggccggcgaacccacccggatcgccggggcgaaaggtgacaaggccggcaactgcgccgtcgaggacgccgactacacggggtacgtcgcgcattccgacgtctcgtacctgtgcgacaccgcgggcggctcgtccggctccccggtgctgtcccgcaagaccaaccgggtggtggcgctgcaccacttcggcggctgccccaactcgggcgtccgtggcgacctgctggccgcgaagttgcgggcgtacctttaa

SEQ ID NO: 3281 - DNA, 714 bp, Actinoplanes utahensis
atgatccgacgccgcatcctgtcctggtggcccgacctgctgctgctcgcggcgttcgcggccctgaccggggcgctgatcaccggccacctgctcaccctcgatcagcgggtggccgactgggcgttcgaccaccagcccgcggtgccgtactggaccgcccgcgtcttcaactacctgggccagggcggcaaggtgctcaccccggtcgccctgatcctcaccggcctcctggcccatcggacccggtcggtgcgggcactgctcccgttcatcgccgcctacgtcgtgacatatgtgacgatcggtccgatgaagctgtatttcgaccgggctgcaccgagctatcccggcccgttcaagaccgagatgttcaacccggtcgccagcggccaggatgcgcgcagcttcccgtccgggcacgtgggcaactcgctggtctggtacgccgtcttcgccatcctgatcgccgagctgctccgccggaggctgacccggcgggagtcgtttgcgatccgggtgctgccggttgccgcggtgttcgtgaccacggtctacaccggtttccactggctcaccgactcgctcgccggcctgctgctgggcctcgtcctggcgcgcctgatcgagagaattccctgggacgacatcccgctgcccgcagcgggcggctggtcgcggcccgctttccgggattcggccgtacgcggctag

SEQ ID NO: 3282 - DNA, 822 bp, Actinoplanes utahensis
atggtctccgcgtgtgtccgcggcagcgagtcggcgtgcgcgcgggtggtgcgcaccagccgcccgatcgactggcgcaactgttcggcgatgtcggcgagattcggctcggtaggcatggtgctaatgtacaacagtgttgtacaacagtgttgtacaaaacggagggagttcgacatggaactgaccaaattcggccacgcctgtgtggtcctggagcacgacaaccgtcgcctggtgatcgaccccggcgccctgaccccggaggacgccttcgccggcgctgacgcggtgctggtcacgcacgagcacttcgaccacttcagcgccgagaagctgtccgccgcgctggccgccaacccggccctgcggctctggaccaacaccgcggtcgccgaagccttcgacggcgacccggcgcgggtccacgtggtcggcgagggcgacgctttccaggccaacggcttcgagatccgcgcctacggcgagtggcacgccgagctgcacccggacatcccccgcgtgcccaacatcggcttcctgatcgacgacgccgtcttccatcccggtgacgccctgaccgtgcccgacgtcccggtcaccacgctgctgctgccgatgcacgggccgtggtcccgggtcgccgacctgatcgactgggtccgtgagatcaagcccgcccgggccgtgggcgtccacgacggcgccctcaacccgctcggccaggccatgatcggcaacttcctgggcgaccggagcccggcccccaccggagtgcccttcgtccacctggcgccgggtgccgccctgccgttgggctag

SEQ ID NO: 3283 - DNA, 849 bp, Actinoplanes utahensis
atgaccggccaccggaccccacccgccctgggcgccgacgccagccgcgccgcacccgccctggacgccgacgaccgccgtcccacacccgccctggacgccgacgaccgccgtcccacacccaccctgggcggtgatagccgccatgccgcgccggccgtgggggcgggcgaccgtgacctcagcccgggggccggcgggagcgtgcgggtggtgatcgctgaggatgcggtgctgttccgggccgggctcacccggctgatcgaggatcacgggcatcgggtgtgtgcggccgtgggcgacggtgacgcgctgctcgacgcggtgaccgagcaccggcccgacatcgtggtggccgacatccggatgccgccgacgtacaccgacgaggggttgcgcgccgccctcgagatccgccgccggcatccggaggtcggggtgctggtgctgtcgcagtacatcgagacccggtacaccgcccggctgctggagggcaacgcgacgggcgccggctacctgctgaaggaacgggtggccgacgtcgccgagttcgtcggcacgctggtccgggtggccaccggtggcaccgcgctcgatccggaggtcgtcggccagttgctgcgggccacccgccgggccgacgggctggccgcgctgacgccgcgcgagcgtgacgtgctggcgctgatggcggagggccgctccaacgcgggcatcgccgacgccctcacggtctccggcggcaccgtggagaagcacgtggccgccatcttcgacaagctggccctccccccggccgacgcggacaaccgccgcgtcctcgccgtcctgcgctacctgggcacctag

SEQ ID NO: 3284 - DNA, 1125 bp, Actinoplanes utahensis
atggacccgtccccgacgacgtcgcaccggcgcccgggccgcgagctgatgttctgcctgtccgggctgccgttcgcgctgatcagcccgccggtgctgttcgtggccctcgtcgatctgctctggtgggtcgtcgacgacggtcggcgcaacccgtcgccggccgagatcgtggccgcggcggtcagcctggcggtcctgatcgggctggtggtgcggaccggggcggcggcccggctgggcgggctgcaccggcggctcgcggcccgctggctcggggtgcgggtcgcgaccccgccagacggtgcgagcggctggcgggtcatcgcctaccagatgatcaagctgccggtcgcgctgctccagggctatgccgtgttcttctgggtgggcgggctggtcaacctgggatatccactgtggtggggcgcgttccgcaaccacgcgccgggggtgcacctcagcccgctgccggtgtacacgccgttcggtctgttcgggcagggcacgttccgggtcgcgaccctgcccggcacgttcgccgcggccgcggccggcgccgcgatgctgctggccgcgccctgggtcacccgggccgcggtcaccgccgacgcgcacctgatcggccgcctgctcgggccggggcggctcgcccagcgggtccacgacctggaggtgagccgggcgctggcggtcgacgacgcggccgcgctgctccgccgggtcgaacgcgacctgcacgacggcgcccagatccggctggccaccctcgccatgaacctcggcatggcccgggagaagctcggcgccaccggcccggtgcccgacccgcaagccgcccgcgagctgctcgacgccgcgctccgcggcacccgggaagccctggccgacctgcgcggcctgatccgcggcatccacccgccggtgctcgacaacgggctggccgacgcgctcgcctcgctcgccgcggaccgcgccatgccgatcgacctgaacgtcgacatcccggtccggcccaccccggccatcgagtcgatcgcgtatttctgcgccgccgaactcctcgccaacgccgccaagcacagcagcgccaaccggctcgccgtccgggccgccggccgctag

SEQ ID NO: 3285 - DNA, 771 bp, Actinoplanes utahensis
gtgaccacgcgcggatacgggccggtccaggccgcccgcatggaatggatcaaactgcgcaccctgcgctcgacctggtggaccctcgccgtcacgatcgccgccaccgtcgggatcggactggcggtgggccacaacacccgcgacggctccggcgacgtggtcaacaacgcgctcgccggcgtcgtccccggcctgctgctcaccggcgtgctcggggtgctcaccgcgaccggggagtactcctcgggcaccatccgggccacgctggccgccgtcccgcggcgcccgctgatgctggccgccaaagccgcggtgttcggggcggtcacgctgctcaccggggagatcgcggcgttcctcgcctatgtcgcggtgcgggccaccctgcgcgccggcgtcccggcgcccacactcggcgatccgggcgtgctgcgcgccgtggtgctgtccggggccgccttcagcctgatcgggctgctcggcctgggcctgggcgcgatcgtccggcacagcccggccgcgatcggggtgctggtcgccggagtgtacgtggtggcccagttcctcgggatcatggcgcacgcggtcgcggcgtacatgccgctgctgatcctggagaactcactgagcaccacccggccggtgaactgcggcggcgaggcgtgcccgcacttcctgtcggcgtgggccgggatcgggatgatgtcgctgtacgccgcggtcgcgctgaccatcggcggatggctgctggcccggcgcgacgcgtaa

SEQ ID NO: 3286 - DNA, 723 bp, Actinoplanes utahensis
gtgatcgaggcacgcgaactcaccagacgatatggacggacggtcgccgtcgacgccctcagcttcgacgtgcggcccggcgccgtcaccggcttcctcggcccgaacgggtcgggcaagtccaccacgatgcggatgatcctcgggctggaccggcccgatgccggccaggccaccatcggcgggcggcgctatcgcgagctgcgctggccgctgcgcgaggtcggcgcgatgctggaggccaaggcgttccacccgggccgcaccgcccgcgggcacctggccgcactggccgcgagcaacgccgtgccccggtcccgggtcgacgaggtgctcgacatggtcggcctgaccggtgcggccgggcgacgggccgggaagttctcgctcggcatgggccagcggctgggcgtcgccgccgcgctgctcggcgacccgggcgtgctgttgctcgacgagccggtcaacggtctcgatccggagggtgtccgctggatccgcaccctgctgcgctcgctggccgcgcagggccgcacggtgttcgtctccagccacctgatcagcgagatggcgctgaccgccgagcggctcgtggtgatcggccggggccgcctgctcgccgacaccacggtcgccgcgatgtccgccgaggccgcctccctggaggacgcgttcttccagctcaccagcggatccgtcgagtatcggggagcaacgtcgtga

SEQ ID NO: 3287 - DNA, 1098 bp, Actinoplanes utahensis
atgacccgcatctccggccggatcgtcacccccggcggcgtcgtcaccgggcacctcgacatcgaggacgccacgatcgccgcgatcgtcgccgacgacaccgccggcgacgacgtgatcgtgcccggcttcatcgacctgcactgccacggcgggggcgggcacacgttcaccaccggcgacccggcggcggcccgcgcggcggccgcgttccacctcgggcacggcaccacgaccatgctggccagcctggtcagctcgccgttcgagctgatgcgggaggcgacactcgcctaccggccgctggtcgacgacggggtgatcgccgggatccacttcgagggcccgtacctgtcgtcggcgcggtgcggggcgcagaacccggcgttcctgcgcgacccggtcctggccgagatcgaagaactggtcaccatcggtgcgggcggcgtacggatgatgaccgtggcccccgagctggacggagcgctcgcggcgatcgcgtgtctgcgcgaagccggcgtgctcgcggcgatcgggcacaccgacgcgtcgtacgaacagaccctggccggtgtggcggcgggtgcctccgtggccacccacctgttcaacgggatgcggccggtgcaccaccgtgagcccgggccggtggtggggctgctcagctccaccgcgacggtggagctcatcggggacggcatccatctgcacccggggatgctggcgttcgccgcgaccagcgcgccgggccggtccattctggtcaccgacgcgatggcggcgaccgggatgccggacggggaatacgacctcggcgggcaggcggtcgtggtggccgaccgggtggcgcgactggcccgggacggggcgatcgcggggagcacgctgaccatggacgtggcggtgcgcaacgcggtggccgccgggttgccgctggagaccgcggtggcgatgtcgtcgaccaccccggctcggctgctggggctcgcggatcggggggcgctggccgtcggcctgcgcgccgacgtcgtggtgctggacgccgatctcgcgccgcgacgggtgctgcgggccggggtgggggttttcccccagtag

SEQ ID NO: 3288 - DNA, 942 bp, Actinoplanes utahensis
gtgacccgcttcgccgtgccggacagtgtcgtcatcgccctcgacgtcgggggcaccgggatgaagtgcgcgctggtccgcccgggcggggtggtgcaccacgaggaacggcacccgaccctggccggccgggggccgcaagcggtcaccgaggacatcctgggcgtcgccgaggggctggccggcaaggcccgcgccgatgggctcaccccgatcgcggccggcatcgcggtgcccggggtggtcgacgagaccaccggggtcgcggtctggtcggcgaacatcgggttccgtgacgtaccgctgaaagatcttgccgagcggcgcctcgggctgcccgcggccctcggtcacgacgtgcgtgtcggtgccctcgccgaggcccgcctgggcgccgggcgcggacgccggcacgtgctgttcgtcgcgatcggcaccggcatcgccggcggcctggtggtgaacggcaccggctactccggcgcgcacggggcggccggcgagatcgggcacgtgacggtccgccccggcggcgtcccgtgcggctgcggcctgcgcggctgcctggaggcggaggcgtcggcccgggccgtcggccgccgctacgccgaactgtccgggcaggccggggccaccgccttcgacgtggccacccgggccgcggccggcgaggaactggccggccgggtgtggcaggacgccgtcgaggcgctcgccgacgggctgctcgcggcgcaggcgctctacgacgtgagcgtggtggtgctcggcggcggcctggccgaggcgcgcgacgacctgctggtgccggtccgcgaagcgttcgcccggcgggtcaccttccaccgcacccccgagatcgtccgggccgagctcggcgacaccgccggctgcctgggcgccgccctgctcgccctcgactccctggggaccccgcaatga

SEQ ID NO: 3289 - DNA, 933 bp, Actinoplanes utahensis
atgacgcacgttaaggcggagatcgccagccaaccggactgctggcggcaggccgccaagctggccgacgcacccggactgccggcccgcggcgagcgggtcgccgtggtcggctgcggcacctcctggttcatggccaagtcgtacgcggtgctgcgggaacaggccgggcacggcgagaccgacgccttccaggcctccgacttcccgtacgggcggcgctacgaccggctcatcgcgatcacccgttccggcaccaccaccgagaccctcgaggtgatgcgcgcggtcggcgagagcacgccggtcaccgtgctcaccgccgacccggcccagcccgccgtcgacatcgccggcaacgccgtggtgctggacttcgccgacgagaagtcggtcgtgcagacccgcttcgccaccagcgtgctggccctgctccgggcccacctgggccacgacatcgacgccgccgcgatggacgcggaggtggccgtgcgcctgccgctgccggtccacccggcgctcaccgaccagatcaccttcctcggtcggggctggaccgtgggcctggccgaggaggccgcgctcaagtgccgggagaccgccggcttctggaccgagtcctacccggccatggactaccggcacggcccgatctcgatcgccggcccgcgccgcgtggtgtgggccttcggcgacgtcccgcccggcctggccgacgaggtcgaggcccgcggcgccgccttcgtgcacagccgccaccacggcggatacgcgtcgctgggccgctgggtcggcgggcgcgccccgctcgacccgatggccgacctggtcctcgcccagcgggtggccgtgctgctggccaccacccagggcctcgacccggacaacccgagcggcctgacccggtccatcgtgctgcccgactcgctgtga

SEQ ID NO: 3290 - DNA, 786 bp, Actinoplanes utahensis
gtggaccggtacgcgcgctggaatgccctgctggagctcctcacggacagcggccgggtgtccgtcgaggaggccgctgagcggctggacgtctcgcaggcgacgatccggcgtgacttcgatcagctggcccagcagcagatgatcacccggacccggggtggcgcggtcgccaacggggtctcctatgacctgccgctgcgctacaagagcgccaagcactcggccgagaagcagcggatcggcgaggccgcggcccgcctggtcaccccgggcaccgtggtcggcctcaacggcggcaccacgatcaccgaggtggcccgggcactggcggtgcgccccgacctgaacgccggcggcgagggctcccagctgaccgtcgtgaccaacgccctgaacatcgccaacgagctgctggtccgctcccggatgaagatcgtggtggccggcggggtggtccgcccgcagtccttcgaggtggtcggcccgctcggcggggcgctgctcaaggaggtcaccctggacatcgcgctgctcggggtcgacgccctggacgtggaactcggcgcggcctcccaccacgagggcgaggcggcgatgaacagcctgatggtggcccgggccaagcgggtcgtggtgatcgccgactcgtcgaagctgggcagccacgcgttcgcccggatctgcccgatcacccagatcgagacgctggtcacggactcgggcgcgtcgtccgcgacggtcgccgccttccgggacgccggcgtggacgtgatcgtcgcctga

SEQ ID NO: 3291 - DNA, 981 bp, Actinoplanes utahensis
atgaccgccgtactcgagatatcaggactgcgcaagacctatcgcagtcgcaagggtgtccggaaggcgctggacggcttcgacatggtggtggaggccggccaggtgcacggcttcctcggcccgaacggatcgggcaagaccaccacgttgcgtacgctgctcggcctgatcaagcccaatgacggccggatggcgatcctcggccaggaggtcccccgacacctgccgcaggtcgccggttcggtcggggcgatcgtggagagcccccagttcttcggcaacttcaccgcggagaccacgctgtcgctgctcgccgacgcgggcggggtggcgcaggcgcgggtgccggcggtgctggagctggtcggcctgcgggaccgggcccgggagcgggtgaaaacctactcactcggcatgaagcagcggctcgcggtggcgtccgccctgctcaaggagcccaaactgctgatcctggacgagccggcgaacggcctcgacccgggcggcatccgggagatgcgcacgctgatgcgcgacctgtccgattccgggatgaccgtgctgctgtccagccacatcctgggggagatccagctgatctgcgactcggtgacgatcatctcggccgggcgccgggtcgccaccggatcggtcggcgaggtgctcgcgaagcactcctcgaccggcgtgcgggtgcgcctggagccgggtgtcgacctggcgggcgccgcggcgatcctccgggcggccggcgcggcgctcaccgtggaacgcgaccacctggtggtcgggaacgccggcaacccggctcagatcaccaagttgctggccgaaaagcagatctacgtgtccgagctcagcccgatcgaggccgggctggaggacgtgttcctggaactgaccggcaccgcgccggtcgacggggcgaaccggcaggtcgatcaggtcacggcgacgcagggtgggtggggtcagtga

SEQ ID NO: 3292 - DNA, 993 bp, Actinoplanes utahensis
gtgagcctgttccgggcggagcggcgccggctgaccaagcggcggttcaccaggcttttcgtggccctcgggctgctggtgctggtcctggtggcggccggtgtggcggcgaccaaccagaaggccaccccggccacggtggcggccgcgcaggccgaggcggagaccgggtaccggcaggcggtgcagcagttcgccgaggacaagaagcactgccagcaggatccttcgcagttcggcgggaactgcgacaacctcggtgagccgcaacgggaggactacaaggcggagtactacatgccgtcgacgttcgacttccacgagcagttcccgaacatggtgatcaccttcgcggcgctgatggcgctggtcgcgttcgtcgtcggggcgtccttcgtcggcgccgagtggaacagcggcgggatgatgaacctgctgctctggcggccgcagcggctccgggtgctgtccaccaagctggccgccctgctggtctggctgaccggcctgaccgtggtgaccggcgcggcctggaccgggatctgctggctgatcgcgacccagcgcggcatcaccgcgcggatgaccccgggcgtctggcagtcgttcgggctgatgggcctgcgcggtctcgggctggtggtggtggccggcgcgctcggcttcggcgcggcgtcgatcggccggcacaccgcggcggcgctgggcgcggcgatcggcacgctggtggtgctgcagtacggcctggcgatcgtgctgtcactggccaaggcgcggttctacgagctctatctgctgccgacgtggatctccgcgtggatgaaccagtcgtacaaagtggtcgacgacaacgcgccgtgcgtgctggccggcgggtgtgagccgcccagctacacggtcacctggcagatggcgggcgggctgttcgccgcggtggccatcatcattgtgggtgccgcaatgtggacgatgcgtaagcgcgacatcacctga

SEQ ID NO: 3293 - DNA, 324 bp, Actinoplanes utahensis
atgcagcccgccgccgaacccaccggtgatcagcagcacatccccgcgccccgcaccgccgagccgtccgggcagccggaagtcgccgagcaaccggctctcagcgagcgtgaggagcagatcctcgcgttcgaggccaagtggtggaaacacgccggcgccaaggagcaggccatccgggacaccttcgacctctcctcgacccggtattaccagctcctcaatggtctgctggacaacccggccgcgctggaacgcgacccggtgctgatcggccgcctgcggcggctgcgatcgacccgggcccgcacccgccgccgctag

SEQ ID NO: 3294 - DNA, 2184 bp, Actinoplanes utahensis
gtggctgacgatctcaccctgaccatgacgtggcggtcaccggccgacgagggccgacgcgccctggtccggatgcatcccaccgcgatgaaggcgctcgaactggaaccgggccaggcggcgcggctgtccgggtcgcgcagcacggtggtgcgggtgatcgccgacgagaccaccgggcagaagcaactgcacgccgacgacctcaccttcggcaacgccggggtgccggacggcgggccggtcacggtcaccccgatcccgctgaccgcggcgagccgggtgatcctcagcgggccgcccggcgtgcacggcacgatcccgccggagatgctgcgccaggcgctgttcggcaagacggtcagtccgggcgacgacgtgtcgctgctgtcccaggaggtcttcccggaccgcaagccgccggtcagcccgtcgacccggtccagtctgagctcgcggttcccgtggtggaccaaccagctgctgaccgtcgagtcggtcgacgacggcgtgctggtcaccacgaagacggtggtcggctggcaggacggcccggccaccgccacggcccgggaagccgcgccggagacaccggccgccggcaccccggccgaggtgccgccgcccagcctggaggacctggtcgggctgcgcgcccaggccaaggagctgcaggagctgctcgacctcggcttcaaccatcgggaggtgctggccaagctgcacacccgggtggcgctcggcatcctggtctccgggccgtccgggtcgggcaagggcggcatggtccgggcggtggccgccacggtcggcgccgaggtgcggctgatctgggcgccggagctggccgcgctcaccaacgacgcggccgcccgccggctgcgcgaggcggccgccgcgatccgcggcgacaagcccgcggtgctgctcgtctcggacgtggaggcgctcgcgccgcgcgacgagccgggcccgatcgccacggtgttccgccaggtgctggccgaactggtggccggcggcgcggcggtggtctgcaccaccggcagacccgagtcggtcgacccggagctgcgcgcccccgacctgctcgccgtgcagctcaccgtgccgctgccggacgccgcgatgcgccgcgagcagctcaccgtgctgacccggggcatgccgctcgccgccgacgtgcgcctcgacgacgtggccggccgcacccccgggtacgtcgcggccgacctgggcgcgctggtccgcgaggccggggtgcgggccgcgttgcggcagaagacgtccgacgagccgagcgtcacgatggccgacttcgaggcggcgctggacgtggtccggcccacctcgatggccgagtcgaccctggaggtggccaccgtcacgctggacgacgtgggcgacatggccgaggtcaagcaggtgctgaccgagtcggtgctgtggccgctgacctatccggacacgttcgcccggctcggcgtgaccccgccgcgcggcgtgctgctctacggcccgcccgggtgcggcaagacgtacctggtgaaggcgatcgccgggaccggcaaggcgaacgtgctctcggtcaagggcgccgagctgctcagcaagtgggtgggtgacagcgagaaagcggtccgcgagctgttccgccgggcccgggaggccgcgccgaccctggtcttcctggacgaggtggacgccctggccccggcccgcggccagggctcggacggcggggtcaccgaccgcgtggtggccgccctgctcaccgagctggacggggtggaggacctgcgcaacgtggtggtgatcggggcgaccaaccggcccgacctgatcgacccggcgctgctgcgccccgggcggctggagcgcctggtctacgtgccgccgccggacgggccggcgcgggccgcgatcctgcgggcctccgccaagtcggtgccgctggacgagtcggtcgacctgaccgccctcggcgaggagctgacgggtttctcggcggccgactgctcggcgctgatccgggaggcggcgctggccgcgatgcgcgggtcgctggaggcgtccaccgtcaccgccgcgaacgtgagcaccgcgcgcgaacgggtgcgggcctcgctcgacgccgcccaggtcgcctggctggagtcgtacgccgaaaagcggaacgcctga

SEQ ID NO: 3295 - DNA, 2706 bp, Actinoplanes utahensis
atgtctgcgttaccccgggtgacccggcgccgggcggtcaccgccgcggtggtgctcgtgctcctcgccgccgcgaccgtctgggccgtgctgcccgcgcgggccgcctggacagcccaggatctgcggatcccggtccgcaccggcccggccggtgaccagcaggtcgagctcgacgcccgcttcctgctgccccgcgaccggtccggcacggtgcccgcggtgctgctggcgcacggcttcggcggcagtagggactcggtccgctcggacgccgagtcgctggccgcccgcggctacgcggtgctcacctggaccgcgcagggcttcggccgcagcaccggcgagatccacctggacagcccggactacgaggtcaaggacgcccggcagctgctcgactggctggccgcccgccccgaggtgcgcaccgacgcgcccggcgacccgcgggtcggcgtggtcggcggctcctacggcggcgcgctggccctgctgctggccgggcaggacccgcgggtcgacgcgatcgtcccgtcgatcacctggaacgatctggaccacgccttcctgccgcagtccgcggcgaccgacgccaccggggtgttcaagaagggctgggccggggtcttcttcggctccagcgcgggcggcgacaacccggcgtgcggccggttcgccgccgacgtctgcgcggcctacctgtcgatggcgaccagcggcaccccggacgcggcggccctggccctgctgcgccggtccagcccggccaccgtgctcgacaggatcaaggcgcccacgctgctcatccagggcgcggtcgacacgctcttcccgctctccgaggcggacgccaacgcgaaggggatcgccgccaccggcacgccggtccgggtggcctggttcaccggcggtcacgacggcggtgccgggcccaggtccgaccaggaccgggtcgaatacctgaccggccagtggctcgaccactacctcaagggccggggcgccgcccccggtgacgacttcaccttctcccgggtggccggtttcagcgcgatggaccgggacctggtcaccaacggctactccaccgactcgtatccggggacgaccggcaccggcagcacccgggtcgcggtgaccggtgcggcgcagccgatcgccaacccgccgaacggcaacccggccgcgctctccgccctgccggggctgggcagccggctcagctcgctgctcagcggcaacctctccgccgacatcccgggccagcacgccaccttcgccagcgcgccgctgaccgccgcggtcgacgtggccggtgcgccgacgatccggctgcgggccgcgtcgccgaccgggtcggcgacgctgttcgtcaagctctacgacgtcgaccagagcggcgcgccgacgctcagcgccgggctggtcgccccggtccggctcaccgggctgccgaccggcatcgagcaggcgcagccggtcacagtcaccctgccggcgatcgtccggcggatggaggccgggcacacgctgcaggtcgtcgtcgccacctcggaccaggcgttcctctcaccgcccgggccggccacctacacggtcgcggtcgacgggcagctgacgctgcccaccctggtgggcacgccgatcgcaacgccggcggcgctgtggtggtacgcgctggcagccctgatcgcggtcatcctgatcgccctggctgtcctgtcggtgatccgccgcgcccgccggcgtcgccgggtgactgccgtgcgcgacgacctcgccgacaccccgctggtggtgaccgggctgcgcaaggcgtacaaggacggcttcgtcgcggtcgaggagatcggcttcaccgtcgagcgcggccaggtggtcggcctgctcgggccgaacggggccggcaagaccaccacactgcgggtgctgatgggcttgaccacgccgaccgccggtgaaatccacgtcttcgggcaccgcctggtccccggcgcgcaggtcctgtcccgggtcggcgcgctggtcgagggccccggctttcttccgcacctgaccggcgagcagaacctgcgggcctactggcaggccaccggtcggccatgggccgatgcgcggttcgaggaggcgctggagatcgccggtctcggtgcctcgatccaccggcggaccaagaactacagccacggcatgcggcagcggctggccatcgcgcaggcgatgctggggctgcccgagctgctggtgctcgacgagccgacggacgggctggacccgccgcagatcgccgagatgcgccgcgtgttgcaacgctacgccaccgacgggcgggccgtgctggtctccagccacctgctcgccgaggtggagcagacctgcacccacgcggtggtggtgaacaaggggcggatcgtggcgtccggcccggtcggcgacatcgtcggcgagtcgccgtcggtcgctttcgaggtgtccgacgtgccggccgccaccgcgatcctctccggtctgggcgtgcgttcggtcaccccggacggcgccaccgggctgatcgtcgagatgaacggcacgccgcgcgccgacctggtcgcctcgctggtcaaagccggtgtcggcgtcgaccgggtggtgccgcgccgccgcctggaggacgcgttcctggccctggtcggcgacaactcgcgggggagtggagaccgatga

SEQ ID NO: 3296 - DNA, 876 bp, Actinoplanes utahensis
atgagcatcgatgtcagtccggatgccgcggcgggttaccgcccgtcgcgcaccctgccgatcgtcgccgagatccgccggcaggcgtcccggcgacgcacccagctggccctcggcttcatggtgctgctaccgctgatcatcctggtcgccttcgagttcggcagcgacaaccgcggcgacgacgacaacggcggtggtgcgttcagcagcctggtcgacctggccacctcgggcgggctcaacttcgccctgttctgcctggcggtctcggccggcttcctgctggtggtggtcttcgccctgttcgccggcgacacggtggccagcgaggcgagctggggcagcctgcgctatctgctggcgatcccggtgccgcgggcccggctgctcgcggtcaagctggtggtcgcgctcggctacgccttcctcgcgctgttcctgctggccggcaccggcctgctggtcggcacgctgcgctacggctggcatccgctgggcagcaccatcgccgcccggatcccacccgggcagggcgtgctgcggctgctcgccatcctcgcctacctcgcggtgatcctgctggtggtagccggcctggccttcctgctctcggtgctgaccgacgcggcgctgggcgcggtcggcggcgcggtcctgctctggatcctgtccagcatcctggaccagatcaccgccctcggctcgatccgcaccggtctgcccacccactacagcgacgcctggttgggtctgctgtccaccccggtgcagaccgaggatctggccaagggggcgatctccgcgatcatctacgcgacgctcttctggggcacggcgttcctgcgcttcactcggaaggacgtaaccagctag

SEQ ID NO: 3297 - DNA, 1284 bp, Actinoplanes utahensis
atgacgtctaccgtcagtgcacccgctgccatctccacctcgcccgcccgcggcctcgtctgccgtgcctgcggcgcgcagtacccgctggccgcgcagcacgcctgttacgagtgtttcggcccgctcgaggtggcctacgacgaggcggctctcgcgcgggtgacccgggccgagatcgaggcgggtccgcagaacatctggcgttacgcagcgctgctgccggccggccaggacccggccacccgggtgaccctcgaccccggcctgactccgctggtcagcgccccgcagctggccgccgagctgggcatcaccgcgccgctctgggtcaaggacgactcgcagaacccgacccactcgttcaaggaccgggtcgtctcggtggccctgaccgccgccaaggagctgggcttcacccggttctcctgcgcctcgaccggcaacctggccaactcggtcgccgcccacgcggcccgggccggcgtgcccagcatcgtcttcatcccgggcgacctggagcagggcaaggtcgtgatgagcgcgatctacggcggtgacctggtcgccatcgacggctcctacgacgacgtgaaccggctgtgcagcgagctggtcgagaccgacgagttcgaggacaccgcgttcgtcaacgtgaacgtgcgcccgttctacgccgagggctccaagacgctgggctacgaggtggccgagcagctcggctggcggatcccggcccaggtggtcatcccgatggcctccggcgagctgctcaccaaggtggacaaggcgttcagcgagctggtcgagatcggactcgccgaggcgccggagggcggctggagggtgttcggcgcccagtctcagggctgcaacccgatcgcggtggcgctgcacggcgacaccgacgtgatcaccccggtgaagccgaccgggatcgccaagtcactgaacatcggcgacccggcggccgggccgtacgcgatcgaggcggtccgccgcaccggtggctggatggactacgcggacgacgacgagatccgcgccgggatcagcctgctggcccgcaccaccggcgtgttcgccgagacggccggcggcaccaccgtcgcggtgctcaagaagctggtggagagcggcaggctggacccgacccgggagaccgtcgtctacaacaccggcgagggcctgaagacgctggacgcgatcgtcggcacggccggcccgacccaccggatcaagccgtcgctgcgcggtgctcgcgaggccggcctgctgggatga

SEQ ID NO: 3298 - DNA, 444 bp, Actinoplanes utahensis
atggccggccggtggcatgtcgcccggacgctgctgaccgcggtgaacgggaccaccggcgccgggctgctgctggccctgatcacccggacgagggtccgccgcgggcgcgacggggtgctgatcgccgagggctggcggttgccgatgcccccggcgtcctgcttcacggtcggctcggtgatcatcacgcggcgcagcgccgagtggctgctcgccgaggagcgggccgcgctgctcgcccacgagagccggcacgccgggcagtacgcggtgctgggtccgctgttctggccggcgtactgggtcgcttgtgggtggtcgttcacggcgaccggctcgtacggcgtccgcaacttcttcgagcgtcacgccggcctgaaggacggcggatatcccgaggatctgccgctgcgcccgtggctgcagcggctgaagcggtag

SEQ ID NO: 3299 - DNA, 495 bp, Actinoplanes utahensis
atggtgcgccggatcaccgcccgtgacgccgggcggatgcgcgccctgcggctggagatgctggccgacagtccgctcgccttcctggagaccctcgcccaggccgccgcccgctcgcacgagggttaccggcggcggctggacatggccgccgacgggccggagctcgcccagttcgtcaccgatccgggcgacgggccgctgctcgggcacgccggcggcaccgcgatcccggacgatccgctggtcaccgtcgtcttctcggtctacctgacgccggccgcccggggcggcaagatgctggccagcctgatcgaggcgatcgccgactggtccaccgcggccgggcggcacgagctgatgctcgaggtggtgaccggcaacgaccgggccgtccgggcctacgagaaactcggcttccaggacaccggggtgcggctgccgcacccgaccgtgccggtgctcaccgagctccagatgagacggcggctctga

SEQ ID NO: 3300 - DNA, 1623 bp, Actinoplanes utahensis
atggccaagatcatcgcattcgacgaggaggctcgccggggcctcgagcggggcatgaaccagctcgccgacgcggtcaaggtgaccctcggcccgaagggccgcaacgtcgttctcgagaagaagtggggcgcccccacgatcaccaacgatggtgtatccatcgccaaggagatcgagctcgaggacaccttcgagaagatcggcgccgagctggtcaaggaggtcgccaagaagaccgacgacgtcgccggtgacggcacgacgacggcgaccgtcctcgctcaggcgctggtccgcgagggcctgcgcaacgtcgccgccggcgcgaacccgatggccctgaagcggggcatcgaggccgcggtggccagcgtctccgagggcctccagcagctcgccaaggatgtggagaccaaggagcagatcgcctccaccgcctccatctccgccggtgactccacggtcggcgagatcatcgccgaggccatggacaaggtcggcaaggaaggcgtcatcaccgtcgaggagagcaacaccttcgggctggagctggagctcaccgagggtatgcgcttcgacaagggctacatctcggcgtacttcatgaccgacgccgagcggatggaggccgtcttcgacgacccgtacatcctgatcgcgaacagcaagatctccaacgtcaaggacctgctgccgatcctcgagaaggtcatgcagtccggcaagccgctggtgatcatcgccgaggacgtcgagggcgaggccctggccaccctggtcgtcaacaaggtccgtggcaccttcaagtcggtcgccgtcaaggcccccggcttcggtgaccgccgcaaggccatgctggaggacatcgccatcctcaccggtggcgccgtcatcagcgaggaggtcggcctcaagctggacgccgccgacctgtccctgctgggccaggcccgcaaggtcgtcatcaccaaggacgagaccaccgtcgtcgacggcgccggcaacggcgagcagatccagggccgggtcaaccagatccgcgccgagatcgagcggtccgactccgactacgaccgggagaagctgcaggagcggctggccaagctggccggcggcgttgcggtgatcaaggtcggcgcggccaccgaggtcgagctcaaggagcgcaagcaccgcatcgaggacgctgttcgcaacgcgaaggcggccgtcgaggagggcatcgtgcccggtggtggcgtcgccctggtgcaggccggcaagaccgcgttcgacaagctggacctggtcggcgacgaggcgaccggtgccaacatcgtcaaggtcgcgctcgacgccccgctgcgtcagatcgccgtgaacgccggcctcgagggcggcgtcgtggtggagaaggtgcgcaacctcgaggcgggtcacggcctgaacgccgcgaccggtgagtacgtcgacctgctggccgcgggcatcatcgacccggccaaggtcacccgctcggcgctgcagaacgccgcgtcgatcgccgcgctgttcctcaccaccgaggccgtcgtggccgacaagccggagaagaacccggctccggccggcgcccccggcggcggggacatggacttctga

SEQ ID NO: 3301 - DNA, 453 bp, Actinoplanes utahensis
gtgcacgccccgaagatcagtttccccggcgcgttcgcgcccgaatcgcacggctacccgccgcgctgggccgagatccccggcacccgcggctgcaccctggaagccctcacctacgccgggcgggccgaccggttcgccgccgccggcgcccggatccgcggcgtcagcacccagcgcgccgaccagctgcgcgcgttcgcggcacacgccgctctgccttacgagctgctctccgacgctgacggccggctcgccaccgccctgcggctgcccaccttccgggccggtggcggcgaccgcctcaaacgcctcaccatgctgatcgacccggccgggacgatccgggacgtgcggttcccggtcaccgacccggccgcgtcggtcgacgagatgctcgacctcctcggcggatactcgagtggggcaggccacattcccccgccagggtga

SEQ ID NO: 3302 - DNA, 2061 bp, Actinoplanes utahensis
gtgaccccggggagggctaacctgggacgggtgcgtgatccctccgtctcccgctacacggccggccgtctctccccgatccgccgcaccgccgacctgcggcggctccgcgacgaacagttcgacgtcctggtgatcggcggtggggtcaccggcgccggtgcggccgtcgacgccgcctcccgcgggctgaaagtggccctggtcgaggcccgggacttcgccgccggcacctccagccggtccagcaaactcatccacggcggcctgcgctacctggagcagctcgagctgcacctggtgcacgaggcgctcaccgaacgcggcctgctcgccacccggctcgccccgcatctggtccgcccggtcccgatcctcgtcccgctgcccgccgccaacccggtcaaacgggtctggcagcgcggttactacgggctcggcgtcgcggcgtatgacgtcttcgccggcgtcctcggcggcggccgcggcatgccgctgcaccggcacctgagccgcgacggcgcccggcacctgttccccagcctgcgcgccgacaagatcaccggcgcgatccgctactacgacggccagatggacgacgcccgcctggtggtcaacctggcccgcaccgccgccgcccagggcgccgcagtggtcaccagcgcccgggtcaccggcttcgtccgggaggcccgcgaggtggtcggcgtccgggtcaaggacctggaatcacccggctcacccgagttcgaggtgcgcgccaagaccgtcgtcgccgccaccggcgtgtggagcgacgacatggcggaaatgctgcgcgacgtcggcgtccgccccggcctgcgggtccgcgcctccaagggggtgcacctcgtggtgccccgctcggcgatcaccggcgaggccggcctgatcctgcgcaccgccacctcggtgctgttcgtgctgccctggggcggccactggatcatcggcaccaccgacaccgactgggagctggaccgctcccatccggccgcctccgcccgcgacatcagctacctgctcgaccaggtcaacacgattctcgaccggccgctgaccaccgacgacatcgagggcgtctacgccggcctgcgcccgctgctgtccggcgaggccgactcgacgtcgaaactgtcccgcgagcacgccgtcgtcgaaccgatgctcggcctgctgctggtcgccggcggcaaatacacgacctaccgggtgatggccgccgacgtcatcgaccaggccgtccgccgcctcggcggcgccttccgcccgtcgcgcaccgaccagctcccgctgctcggcgccgacggctacgccgccgcctggcgcgaccgccaggacaccgcccgccggcacggcgtcaccaccggcgtcatcgagcacctgctggaacgctacggcaccctgaccgtccacctgctcgccatgatggccgccgacccggcgctcgccgtccccctcgaaggcgccccggagtacctggccgtcgaggtcgcctacgccgccctcgccgaaggcgccctgcacctcgacgacgtcctcacccgccgcacccgcatctccttcgaaaccgcccaccggggcgtcgaatccgccgcccacacggcccgcatcatgggcgccgtcctcggttggaacgagaccgtccgcgaccgcgaggtcgagcactacctggcccgcgtcaccgccgaacgccaatcccagaccatgcccgacgatttgaccgccgatgccgcccgggtcggggctcccgacgtccgcggtttggcgggagaccgcgcacaccctcccgccgccgcttcccacctggaagccgccgcgtctccgcatccggaaactgccgcctcccacccggaaaccgctgcctcgcatccggaaaccgccgcgtctcacccggaaaccgctgcgtctcacccggaaaccgctgcgtctcacccggaaaccgccgcctcccagctggaagccggcgggtctccccgcccggaggccggcgggtctgcccaccctgacaggaccggccttctcgaagccgaacgttga

SEQ ID NO: 3303 - DNA, 288 bp, Actinoplanes utahensis
ttgatcctcgtcgacgagccgcgctggccgggccggggccacctctggtcccacctggtcagcgacgtctcctacgccgagttgcacgccttcgccgaaatgctgggctccccacgccgcgccttcgaccgcgatcactacgacatcccggcagcccgcttccgcgccgccctctggctcggagcaaccctggtgccaccccgggaactgaccgcacgcctgcgcgccgccaatctccgtcgccccaaacacctggccggcgggagcctccggaccgcttcccggtga

SEQ ID NO: 3304 - DNA, 1323 bp, Actinoplanes utahensis
gtgggccgggcccactaccgtgatggtcgcgtaacgcgaatccggcgagggggtcggcggttgaaccgcttgcagcgtgtccgggaaaacctgaggaaggcctacgacacgggacgggaggcggcccgggtgacccgcatcgaccggccacgacccgagccggagccggaggaggacgacttcgtcgcggtcccggccgagcccgccgtcgtgcacggctccaccaccagcctcgacgacgtggacgtgccgcactcgctgcggatcgcggcggcctggagctggcggctgatcgtggtcggcctggtcggttacgccggcctgcgcttcatcagccaggtcgatgtcgtggtcattccgctggccatcgcgctgctgctgaccgcgctgctcggccccgcggtcggctggctgcgcaaactgcacctgccccgctcgctggcgaccttcctggtgctggtgggcggcctgggcgcggtcgccggcacgctgaccctggtggtcaaccagttcatcgacggcctgccgcagctgaccgagaaggccaccgccggcgtccggcagatccaggactgggccaagaccggcccgctgcacctgtccgacaagcaggtcgaccgggccatcgattcggcgcagagctgggtgaacgacaacacctcgtcgctcacctccaccggcatctccaccgccgccaccgtcttcgagctgctcaccggcctgctgctggtgctcttctcgacgttcttcttcctccgcgacggccacaagatctggcgtttcatcgtccggctgttcccggtcagcgcccgctggtcgctggccgacgccggcgacgcctcctgggccacgctgggcgcctacgtccgcgcgaccgtcctggtcgccttcatcgacgcggtcggcatcggcctggccctgctgatcctcgacgtccagttcccgttcccgctggccgccctggtcttcctgggcgctttcgtccccatcgtcggcgccggcgtctccggcgcggtagccgtcctggtcgccctcgtcggtcagggctgggtcgtcgccttgatcaccctcggcgcggtcatcctcgtccagcagctggaaggccacgtcctccagcccttgatcatgggccgagcggtagccatccaccccttggccgtcatcatcggcatcgcctgcggcgtggtcctggccggcatcaccggcgccctggtagcggtccccctgatcgccgtcctgaacaccggaatccgccgcctctcccgccgccgcccagaaatcccccccgacgccatcgtcgtcaccgccggccacccgtcctga

SEQ ID NO: 3305 - DNA, 342 bp, Actinoplanes utahensis
gtgagtgccgataccgcccgtaccgagaccggactgccgatccggatgcttcatgaccgtgtcctcgtccgccaggacggcggcgagggcgagcgccgctcgaccgcgggcatcgtcatccccgccaccgcctcgatgggccggcggctgtcctgggccgtcgcggtcggcgtcgggccgaacgtccggtcgatcgtcgtcggcgaccgcgtgctgttcgacccggacgaccgttccgaggtggagctgcacggcaaaggctatgtcctgctgcgcgagcgggacgtgcacgcggtcgcggccacccgggtcgagtcggacgggaccggcctctacctgtag

SEQ ID NO: 3306 - DNA, 1944 bp, Actinoplanes utahensis
atggccgacgttccgaccgggtcgcccgatccggcgcccacctcgttgccggcgccctccccgggggcgccggatcccggcgcgcctccgggcgcgttgccggccgcattcccggtcacctcgccgggtgcggcggatccgggcgcatccccggtctccgctccgggggcgccggatcccggcacgtccccggccgcctctccggccacctttccggccccgccggtgtacgcgcccggccgggtgaccgccgaggaggtgccggccgacgcggtgccgccgttccccaccgagatggtgcagaccgtcgccccgatcccgggccgccgggccggctggcgccgctgggtcccggtcaccggcgtgatcgtgctgatcgccgcggccgccatcggcatgctgatcttcctgggctacagcatcggcatcgccggcctggccgtcggcctgaccgccgcgatcctcccggttccgctgctggccagcgcgttcgcctggctcgaccgctacgagccggagccggtcaaatacctgatcttctgcttcgcctggggtgccgcggtggccaccgcggtcgcgctcgcggtgaacaccggcgcctcctggctgttcgacaagatcggcctgccggacgccctggtcgcggtgctggtcgcgccgttcatcgaggagtcgatgaaggcgctcggcccggtcctgctgttctggcggcggcgcgccgagtggtccggcatcaccgacggcatcgtctactgcggcctctccgcgctcggcttcgccatggtggagaacgtgctctacctgggcgggcacggctacgccgcgggcgcccagcagtacgggccggccaccggcctgaccaacgtcttcctgatcttcatcgtccggatcctgttcaccggcttcgcccacccgctgttcacctcgatgaccggcatcggcctgggcatctcgtcccgctcggcggacaagcacgtccggtggctggccccggtcggcggctggctgctcgcgatgatcctgcacggcacgttcaacctgctgcccacgctctccgcggccaccggcaaatcattgatcatgctgtacggctatctcggcttcatggtgccgttcttcttcgccgtggtcggtttcgccatcgccctgcgcagctgggagggccgcctggccgagcgggtgctgcaccactacgtgcacaccggctggttcgcgccgcccgaggtggccgcgctgggcagcctcggccgccggcactcggcccggcagtgggccaagcgggtcgccgggccggccggcaaccgggcgatgcgcagcttccagttcgccgcgacccggctggcgatcatccgggacggcatgcagcgcgggctcaacggcgaccagaaagaaatgaccaaggcggtcctcgaggaacgcgaactgctcgccgcgatcgtcggctaccgcgcggtcttcgccggacgggacccgcagacgccgccggcctggtgggacgggcaggcgtaccggatcacctttccggacggggtggtgcgcacggtgacggcgccggccgagccggtgatgccggtgccggtgcggcttccgccgccgatgccggcgtatgcgggcgggtggggtcagccgagccccggctacccgggcggccccggctacccgggcgggcccggccacccgggggcgcagggtccctacggaacgccgggatatggggcgcccggccatggcgcacccggttacggcgcacccggttacggcgcgcctggatacggcgcgcctggatacgggccgccgccgttcgcgccgccgccttcgggttacgggccgccggccgcctacgggccgccttcgtccgccccgccgcactcggcgccgccgcactcggcgccgcccgcttccgggccgccgcagtatccggggcagtacccgccctacaggtag

SEQ ID NO: 3307 - DNA, 1146 bp, Actinoplanes utahensis
atgatcggcatcgcaacggagggaatgcgcgccgccacggcgcgggcccgggccgggctgatgctggcggtgcaggccggcctggccgccggcctggcgtggtatgtcgcacatcacctgatcggccggcccgcgccgttcttcgccccggtcgccgcggtgatcaccctggcctcctcggtcgggcagcgggtccggcgcaccgccgagctcgtcgccggtgtggcggtcgggatcggcgtgggcgacgggatcatcctgctgatcggcaccgggccggtccagatcgggctgatcgtgatcctggccgtgctggtggcgaccgcggccggcggcggctcgccgctgatcgtccagtccgcctcgtccgcggtcctggtggcgaccctcaccgtgcagaccggacacccgtggacccggttcttcgacgccctggtcggcggcgggatcggcctgaccgtgatgaccgtgctgctgccgctcaacccgctcagcgtggtacgccgggccgcggacccggcgctgcgcgccttcaccgccgggctgcacgaggccgcgctcgggctcgccgagggcgacccggacgtgatcgaagcggcgctgagccggttgcgggccgccgaggcgaccttcgcgaacttccgcaccgcgatcgacgcggcccgggagaacgtcgccttcgccccggcccgctggcgcaatcggggtgccctcgcccagtacgtcgacggcgccgcccagctcacctacgcactgcgcaacgtccgggtgatgatccgccgcgcgcagaccgcgctgaacgaccgggaacgcgtccccgaggtgctgcccgcctcggtccggcacctgggcgacgcggtcgatctgctccgccaggaatgggcgcgcggcgtgcccccggtcgccgcccgggaacgcgcgctgcgggccgccgcggaatccgggcgggcctacgacaccggggtcggctactccgggggcgtggtggtggcccagatccgcaccgcggtggccgacctgctgcgcgccaccggggtcgagtatgccgaggccaccctccaggtgcgcgccgccgtcggatggtccggacgcgcccaaggggcgcgcaaccggaccgggcggtcccggcaccccggcctcgggtga

SEQ ID NO: 3308 - DNA, 630 bp, Actinoplanes utahensis
ttgcccgaccggttccgggcggcggcgcgcggcgccggcgccaccgccgccgacgcggatctcgactccgccgcaaattacctgctgacccgctggaccgagccgcaacgccactatcacgacgtgacgcatctggcggcggtgctggaggtgatcgacgagttcgccgggctggcgccgcatccggaccgggtgcggctggccgcgtggatgcacgacgcggtctacgacccgcgggcactgggcgatgcgaacgagcgggacagcgccgagttcgccgccgggctgctggtcacgctgggcgctccggaggaggtggcggccgaggtggcccggctggtcgggctgaccgccgggcacgccaccgaggagaacgacccggacggcgagctgctctgcgacgccgacctggcgatcctggcggctgacgaggagcggtatgcccgctactgcgcggcgatccgtcgggagtacgcgcacgtgccggacggggatttccgggccggccggtcgcgggtcctgaccgagctgctgaagctgccgtcgatctaccggctggcgccgatccgggacgcgtgggaggcgcgggcgcaggccaacctgaaggcggaactcgaggcgctggcctga

SEQ ID NO: 3309 - DNA, 336 bp, Actinoplanes utahensis
atgacctctcctgttgccaacgcggccgccagctgcgccgctcctgaccagtccgctcccctccccgcgagcgtcgacctggagaaggaaaccgtcatcaccggcatcgtgcgcaccgccgagggcgaggcggtgggcggcgcgtacgtccgcctgctggacggctccggcgagttcaccgccgaggtcgtcacctccccggagggcgtcttccgcttcttcgccgcccccggctcgtggacgctgcgcgccctcagccggttcggcaacggcgagctcgcggtcgacgcgacccgcggcgtcaacgaggtctcgttcagcgtcgccaccgcctga

SEQ ID NO: 3310 - DNA, 849 bp, Actinoplanes utahensis
atgagtcgcgacaacgcactcgtttcggccgactgggccgagaagaacctggacaccccgggcatcgtcttcgtcgaggtcgacgaggacaccaccgcgtacgacggtggccacatccccggtgccatcaagatcgactggaagcaggacctgcaggacccggtccgtcgcgacttcgtcaaccaggagcagttctccgcgctgctgtccgagcgcgggatcagcaacgacgacaccgtcatcctgtacggcggcaacaacaactggttcgccgcctacgcgttctggtacttcaagctgtacggccacgagtcggtcaagctgctcgacggtggccgcaagaagtgggagctggacgcccgcgtctacaccaaggacgcgccgagccgcgcccagacgtcgtaccaggccaaggcgccgaacctggagatccgcgcgttccgcgacgaggtcgtccaggcgatcggggtgaagaacctggtcgacgtgcgcagccccgacgagttcgccggccgcctgctcgcccccgcgcacctgccgcaggagcagtcgcagcgggccgggcacatcccgaccgcgatcagcgtgccgtggagcaaggccgccaacgaggacggcacgttcaagtccgacgaggaactcgccaagatctacggcgacgccggcctggacggcagcaaggacaccatcgcgtactgccggatcggcgagcgctcctcgcacacctggttcgtgctcaaggaactgctgggccagcagaacgtcaagaactacgacggttcctggaccgagtacggctccctcatcggcgtgccgatcgccctcggcgacgagcccggaaaggcctga

SEQ ID NO: 3311 - DNA, 789 bp, Actinoplanes utahensis
gtggccgaggtgtacgagaccgctccgcgtcgccgtcggcggggccgcggcgtgctgatcattctggtcatcctgctggtcatcgtgctgggtgtcgcgttcgtggtggatcgcttcggccggtcgttcgccgagggcgtcatctccgacaaggtcgccgggcagatccgggcacagaaggcgtccagtgacaccccggacgtgaccatcgagggcttcccgttcgtcacccaggtgctcgacgggcactaccaggaaatccacatcgaggtgccgcacctcaccgccccggtggacaagacccggaagatcaacctggcactgctcgacatccacgcgcaggacgtgaaggcgtcgctggacacgctgcgcaacggctcgggcgacgtggtggtcggcaccgtgaccggggtcagcacgatcgactacccgcagttggtcgagctgatcgggcagaagggtgtgaagctctccgcgaaggacggcaagctgatcggcgcggccaccgtcaccgcgctcggccagcaggtcgatctgaccggcgcggccaagctcaccgtggtcgacggcgggatccgggtgcggttctccgacgtgcgggccaccaatctgccgaacgtcccgctgatccagaacctgatcgacgcccaggcgcagcggatgtccctcgatctggccgtgccgaaactgccgctgcaactcagggtgcaatccgtcgcggccggcgacgacgggctgaaagtccagttcggggcgcagaacgtgaatctcaacgccggcggcctgtga

SEQ ID NO: 3312 - DNA, 1047 bp, Actinoplanes utahensis
ttgggccgggggccggactctggcacgatcgctgtcgtgttcccctccatgccgcaggacgacccctgggacgccgacgcctcccgtgacgtcgcgcgcctcaacccgggccgccccaaagccgggatgtacggtgccgtgccggacgacgagcccgacgagcggcccacctcggagccgggcgacgacttcgacgacgagttcgaggagatcgaggtcgtcccggtccgacgcaagctgtcggtggcgatcggcgggttcgcggcgctgctcgcactggcgctgatcctcggcacgctgaccaccgggccgggcgtgcgcacgccgtacgcgatcgtgctcttcggcatccagctgctcggcctgctcgcctggaccatggcgctgagcccgccggccgcctcgctgaccgccgcggccagcgggctgaccggcctggtcgcctgctatctggccgccaccgcggacaccgccgggctgaccccgctgctctacgtcaccggcggcggtttcgtggccgcgctggccgcgcaggcggtccgcgccgaggaccggcaccggatcggcgactcctggcggaccacgctgctgatcgtcgccggcgtggtggcgtacgcgatcccgatcgtgctcagccgccagtccctgggctcgcaggcgatcctggtctgctgcgccggggccgggctggcggtgctggtcgcccggctggccgacgcggtgttcccgaaaccgcggatcgccccgcaggtgccgcgcggcgcggccggcgtggtgctgggcgcgatggccggcaccttcttcaccgcgtggctgggcagccagctggtctacccgttcaacccggccaagggcgcggtgaccgggctggtcgcggcggtcgccgcgatcctggtcgacctggcggtgaacttcggcgaggcgggccgccggctggccggtgaggcgccgacgctgtggctggcccggcacatgaccggtccgctgggcgggttcgcgctcacctttgtggccacctatctgctggtgcacctttatctcacctga

SEQ ID NO: 3313 - DNA, 723 bp, Actinoplanes utahensis
gtgagtgtggagatccttctgttggtgacggcacgtgccggtgagccatccgccgtgctgcccgccctggacctgcttccccactcggtcaggaccgccccgcgcgacgtgcgcaccctggtttccgggccgagcccggacgcggtgctggtcgacgcccgctcggagctctccgaggcgcgggccacctgccgcatgctgcacgccaccggcatcggcgtcccgctgatcgcggtggtcaccgaggccggcctgatcgcgctgaacgcggactggggcgtcgacgacgtgatcctggccagcgccggcccggccgaggtcgaggcccggctgcggctcagtgtcggccggctcaccaacgcgaccgccggcgccggcggctcgatccgcgccggtgagctcaacatcgacccggacacctacgccgcgaagctcaagggccgcccgctcgatctcacctacaaggagttcgagctgctgaaattcctggcccagcacccgggccgggtgttcacccgcgaccagctgctgcgcgaggtctggggttacgactacttcggcggcacccgcacggtcgacgtgcacgtccggcgcctgcgggccaagctcgggtcggagtacgagtcgatgatcggcaccgtgcgtcaggtcggctacaagttcgtggtcccgccgtccggccggcagctgcccgacaacgcgccggtgtcgctgccggtctaa

SEQ ID NO: 3314 - DNA, 834 bp, Actinoplanes utahensis
atgcagagattgcccgccgccgagatcgacgctgtcctggccctgaccgaggcggcgggctatccgctctccgaggatgtcgagctgcgcctgcgcaacggcggcggcgatcacctcctcgcacacgccgcggacggctccctggccggctacgccttcctcgaggacggcgccggcgagctggtcgtccacccggcgcaccgccgccaggggcacggcagccggctgctcgacgcggccggcccgggcgagctccggttctgggcgcacggtgacgatcccgccgcccgggccttcgccgagcggcgcggcttcctgcgcgaccgggtgctctggcagatgcgccgttccctgctggagccgctgcccgacatccccctgccggccggggtgaccgtccgcggcttccgccccggctccgacgagcaggcctggctcgaggtgaacgcgcgggccttcgcccaccacccggagcagggccgctggactctcgacgatctgttgctgcgcgagggcgagccgtggttcgacccggccggtttcctgctcgccgtcgacgtgacggaccggctgctcggcttccactggaccaaggtgcacaccgacaccgacccgccgctgggcgagatctacgtgctcggggtcgacccggccgggcaccggcgcggcctgggcgcggcgctgagcgtggccgggctgaagcatctcgccggccgcggactcgaggtctccaacctctatgtggacgagtcgaacaccgctgcggtgcggctctaccggtatctcgggttcgaggtccaccacgcggacatcaactaccgccgccccgcttga

SEQ ID NO: 3315 - DNA, 1101 bp, Actinoplanes utahensis
gtgaagttccagcggtccggtcttgttgccggcattgctttgactgcgaccatcgcgctcaccgcgtgcggctcggacaacaccgacaccaagggggacaccggcgccgccgccccgtccgccggcacctgcgttggtggcaccctggccgctcagggctccagcgcccagaagaacgcgatggccgaatggatcaaggcgtacaccgcctcctgctcggccgccaagatcgactaccagcccaccggttcgggcgcgggcgtcaaggcgctgatctccggtctcgccgacttcgccggctccgactcggcgctcaaggacgacgagcagccgcaggccgacgccaagtgcgcctcgccggctctcaacctcccgatggtcgtcggtccgatcgcggtggtctacaacatccagggcgccgacggtctgcagctgtcgccgagcctgatcgcgaagatcttctccggcaagatcaccaagtggaacgacccggccatcgccgccgagaactccggcgccaagctcccggacgcgaccatcgaggccgtgcaccgctcggacgagtcgggcaccaccgacaacttcaccaagtacctcagcaagaccgccgagggtgactggacctacgaccacgccaaggcgtgggcggctccgggcggcaccggcgccaagggctcggacggcatcgccgccaagctgaagagcaccccgaacaccatctcgtacgtcgagctctccttcgccgagaacagcgacctgcagaaggccaagatcaagaacggtgccggcgagtacgtcgagctcaccggcgacgccgcgggcaagaccatcgagggcgcgaaggtcaccggcaagggcaacgacctgaagctggacatcgactacaagaccgcgaccgcgggcgcctaccccattgtgctggcgacctacgagatcgtctgctcgaagtacgccgacgccgccaagggcaaggccgtgcagggcttcctgaagtacacctccagcgccgagggccagaagaagctggccgacctgggctacgccccgctgcccgagtcggtccgcaccaaggtcgccacctcggtcgccgctctctcctga

SEQ ID NO: 3316 - DNA, 1071 bp, Actinoplanes utahensis
atgggtgactatccctcccgctcggcgaacgccaccgccggtgacctgggcgtgactccccgtcacgcccggggcgccggctctggcgtgtccccgagcagttacgaagagcccccggtcggtggcggcggcgccctgcccaagaaatcccggttctccatggagaccggattccgcggtctctccctggccgccggcacgatggtgctggtcatcatcgtcgcgatcgccgtcttcctgatctcgaaggcagtgccggccatccgggccgacaaagagaacttcctgacctacaacttctggcggccgaacgaggccgagccggccttcggtgtcgccgtcctggccttcggcacgctgctgacctcggtcatcgcgctgatcgtcgcggtgccgatcgcgctgggcatcgcgctgttcctctcgcactacgccccgcgccggctggccaccccgctcggcttcgtgatcgacctgctggccgcggtgcccagtgtcgtcttcggcctgtggggccgtgacgtgctgcaggagccggtgcgggacttctcggcctggctcaaccactacttcggctggctgccgatcttcggcggggacggtccgttcggacagtcgatcatgctcggtggcctggtcctggcgatcatggtgctgccgatcgtcacgtcgctgtcccgtgaggtcttccagcagacccccgggatgaacgaggaggccgcgctcgcgctcggcgccaccaagtgggagatggtccgcaccgcggtcctgccgtacggcaagcccggtgtgatcgccgcggtgatgctcggcctgggccgcgccctcggcgagaccatcgccctggcgctgaccctcggcatcacctggcagatctcgttcaacctgatccagaccggcggcaactcgatcgccgccaacatcgccaacgcgttcggcgaggcgaacgacaccggccgcggcgcgctgatcgcctccggtctggtgctgttcgcgatcacgctggtcgtcaacatgacggcgcgggcgatcatctaccgccgccgcgagttccgggacagtgccgcatga

SEQ ID NO: 3317 - DNA, 1062 bp, Actinoplanes utahensis
atgagcatcgtgatgacgccggacaacatccgcagcaggaagttcccggtcgccgccaacctggcggtcgccgtggccgcactgatcgtctccgccgtcgtggtgctcgggaccggcatcggcaactgggtgctggtcgccttcctcggcgtggtgttctacctggtcggcctcaacctggccgcgtcccgggtggagggcaggcgcgccgcccgcaaccggatgtggcagaccctcatctacaccgcctgcgtgctggccgtcctgccgctggcctcggtggtgtggacgctgctcgccaagggcgtcgaccggctcgacggcgacttcttcggctcgtcgatggcgaacatcggcgcccgcgacgcgaacggcggcgcttaccacgccatcgtcggcaccctggagcaggtcggcatcgccaccctgttcgccgtgccgctcggcgtactcggcgcggtctacctggtggagtacggccggggccggttcgccaccacggtccgcttcttcgtcgacgtgatgacgggcatcccgtcgatcgtcgccggtctgttcatcctctccttctgggtgctgatcgtcagcccctggttcaacaacggggagccggagtactccggcttcgcggccgcgctggccctgaccgtgctgatgctgccgaccatcgtgcgctccaccgaggagatgctgcgcctggttccgggcccgctccgcgagggtgcgtacgcgctgggcgtcccgcagtggaagacgatcctcagcgtggtgctgcccaccgcggcacccggcatcgtcaccggcgtcatgctcgccatcgcccgcgcggccggcgagaccgccccggtgctgctggtcgcgggtggcctcgcccggatcaacttcgatccgttcgccggcggtcagtcgtcgctggccctctacgtgttccagcaggcgggcgacgcctctaagtactcgccggcccgggcctggaccgcagcgctgacgctggtcgccctcgtgctgatcttcacgatcggcgccaagctgctcgcccgccgcaacaaactgacccggtag

SEQ ID NO: 3318 - DNA, 777 bp, Actinoplanes utahensis
atggccaagcgcatcgaggcgagcaacgtctcgtcctactacggttccttcaaggcgatcgacaacgtctcgatgatcgtcgagccgaagacgatcaccgccctgatcggcccgtccggctgcggcaagtcgaccttcctccggtcgatcaaccgcatgcacgaggtcctgccgaacgcgcggatcgagggtcgcctcaccatcgacgaccagaacatctacgacccggacgtggacatcaccgcggtccgccgcatgatcggcatggtcttccagcggcccaacccgttcccgaccatgtcgatctacgagaacgcggtcgccggcctcaagctcaacggcgtcaagaagaagtcgatcctggacgacgccgccgagaagtcgctgcgctccgcgaacctctgggacgaggtcaaggaccggctcgaccgccccggcgccggcctctccggcggtcagcagcagcgcctctgcatcgcccgcaccatcgcggtcgagccgcaggtcgtgctgatggacgagccctgctcggcgctcgacccgatctcgacgctggcgatcgaggacctgatgttcaagctgaaggaccgcttcacgatcatcatcgtcacgcacaacatgcagcaggcggcccgggtcagcgacaagaccggcttcttctcgatcgacaagaccggcgagcccggccggctgatcgagtacgacgacacgcagaagatcttcagcaacccgtcgcagaagaagaccgaggactacatcaccggccgcttcggctga

SEQ ID NO: 3319 - DNA, 1794 bp, Actinoplanes utahensis
gtgcaccgaggcggccaccacgccgtcgatcgtgccgcccgccacgatctggtccagggtgtgccgggtcggcggcagcatcggcagatccgccgcatccgccggatcgatccacgccgtgcggtccgcctccccggagacgtcccgggcctcctgggcctccggcagcagagccacgaagaaccaggtgtcgaatcgtttcggctcgaactccggggtgatccaccgggcccacggcagcagcaggtcgtcgcgcagccgcagaccccggcgggccagcagatccgccatcgtcagctcccggcgcagcaccgccgcccgatcggactcccaggtgggatcgtcggcgtcggcgaccgtgcgatccggctcggcggccgggccggccagcaccacgccggcctcctcgaacagctcgcgggccgccgcaccgacgacggcgcgggcctgctcctcggacacgccgagccgccgggcccagtcgtcgcgcagcgtctccggccggtcggtggggtcgaccgcgccgcccgggaacgcgtagaccccgccgaacgccatcgtggtcatccggcgcagcacgtacacctggaagcggtgcccggcggccgggcggagcagcaccaccgtcgcggccggccgcgccggaaccggtgggccggcgaaatcgcgggcgcgctgcatcatcgcgggcggcaggggcatcggctcggtcacccgtcgatccttgcaccatcgcccgcctcacggcagccagccggccagtcccgccggcggaggcgggggacagggtccggtgggggcgatacggtactgatcatgacgggacagaacgttcgctggggcattctcgggctgggcgggatcgccgccacgttcgccgccgaccttccgctggtgccgggggcggaactcgccgcggtggggtcacgcgaccagaagaccgcggacgcgttcgcgcaacggtacgggttcgcccgggcgcacgggtcctacgccgcgctggccgccgacgacgaggtcgacgtcatctacgtggcgacgccgcacgcctaccaccacgcggcggcgctgcagtgcatcgaggccggcaaggcggtgctggtcgaaaagccgatcaccctggacctgccgaccgccgcccaactcgtcgaggccgcccggtcccgcggggtgttcctgatggaggccatgtggatgcgctgcaacccggccatccgccgggccgccgaactcgtcgaagagggcgcgatcggctgggtcagctcgatccacgccgatttcgggctgcagggtccgttcgccgccgaacaccggctgcgcgcgcccgaactcgggggcggcgcgctgctcgacctcggcgtctatccggtccacctggcccacctgttcctggggctgcccagctcggtgcaggcctgggcgcacctcaccccggaacgcgtcgacgaacacaccgggatcctgctcggctggcagtccggcgcggtcggggccctcacctgcagcatcaacggggcgagccgcaacgccgcgtcgatcaccgggacggacgggcggatcgacatcccgccgggcttcatggtgccgcggtcgttcacgctgagccggccggacaaggcgccggaaacgttcgagttcgacttcccgggcagtggctaccagttcgaggcggcggaggtgcagcgctgcctggcggcgggggagcgggaaagcccgctggtcagccagaccacgacgctcgaagtcatgaacctcctcgactccatccgcgagcagatcggcgtcatctactga

SEQ ID NO: 3320 - DNA, 1008 bp, Actinoplanes utahensis
ttgtctccggaactcgtcgccgtcctggcggtgatcgtcgccgcgatggtcttcgactacaccaacggcttccacgacgccgccaacgcgatcgccaccagcgtcagcacccgcgcgctgaccccgcgggtcgcgctcggcatggccgccgtcggcaacttcatcggcgcccacttcggcaccgaggtggccaagacggtcggtgacggcctggtctccctcccgctgggcattccgagtctgggcgtcgtcttcgccggcgtcctcggcgcgatcgcctggaacctgatcacctggttcttcggcctgccgtccagctcctcgcacgccctgttcggcggcctggtcggcgccaccatgatcgccggcatcggctccgtgcagtgggccaacatcgtcggcaaggtcctgctcccgatgatcctgtccccggtcgtcggcctgatcctcggcttcgccgcgatgatcgccctgatgtggacgttccggcgcggccacccgggccggctcaaccgcggcttccggcacgcccagacggtctccgcggccatgatggccatcggccacggcacccaggacgccgccaagaccatggggatcgtcgtcctggcgctgtacaccggcggttaccaggacagcgctgcacacatcccggagtgggtgttctgggcgtcggcgaccatgctggccgccggcacgtacaccggcggctggcggatcatccgcaccctcggccgcaagatcatcgacttgggcccggccgagggcttcgccgccgagacggtcgccagcgcggtcctctacttcaacgcctgggtcctgcacgcgccgatctccaccacccacacgatcacctcagcgatcatgggcgtcggcgccaccaaacgcctcagtgcggtccgctggaacgtggccggcaacatcatcatcgcctggctgacgactttcccgggcgcggcgctgatcgcctgcctggcctatgccatcgtccggccggccttctcctga

SEQ ID NO: 3321 - DNA, 939 bp, Actinoplanes utahensis
gtggacccgccggttcggctgggacggccgggagccgatcaccgccgaggagcgtcacctgctgcacgcgctggtacgcgaggcccacgacgaggggcgggcggtgcggatgagcgggctgccgcgggggccgcggcgggcccgggtcgcggtctggtccgagctgatcgcggccggggtggacgtggtcgccgacgccgatctcaccgctctggtccggcacctgcgccccgtgtccggtgggtgaacccggatagaccgatagagtgcgtgcggagatccaacgaaagcccgtcgatcgaggtccgcgccgtgaagttctcattccgtcctgtcgagggcgtcttctacgacctcttcaccaaggcctcgtacaacctggtgaaggggaccgagctgctcaacgagctggctctgcccggcgtggacgtccagtcggtcagcgagcggctcagcgacgtcgagcacgacagcgacgcgctcacccacgagctgtacaaaaagatcaactccaccttcatcaccccgttcgaccgggccgacatctactcgctcggctcccagctggacgacgtgatggatcacctggaagcggtcggcaacctgctctacctgtacggcctgaccgagctgccgtcgctgccccgcgagatgcacgagctgatcacggtcctcgaccagcaggcgaagatcaccgccgaggcgatgccccggctgcggtcgatgaagggtctcgaggagtactggatcgagatcaaccgcttggagaacgacggggaccgggcctatcggatgctgctcgtccggctcttctccggggagtacgacgcgctcaccgtgctcaagatgaaggaggtcgccgacgaactggaagcggcctgcgacgcgttcgagcacgtggcgaacacggtcgagaccatagcggtcaaggagtcctag

SEQ ID NO: 3322 - DNA, 885 bp, Actinoplanes utahensis
atgccgtcggtcaccgcagacgagttcgagacccaccgcgcctacctgacggcggtcgccttccggatgctcggcaaccgcgccgaggccgaggacgcggtgcaggaggcctggctgcgctgcgcgcagcaggacgacatccgggatccgcgcggctggctgaccaccgtcaccggacggatctgcctggaccagctcaattcggcccgggtacgccgtacgtcgtaccccggcgagtggctgcccgccttcgcggtcgacccggacgccgacccggccctgtacgccgaacgcgccgaccaggtcagcgtcgccctgctggtggtcctcgaacggctcagcccggagcagcgggtggcgttcgtcctgcacgatgcgttcggcctgccgttcgaggaggtggccgcggtgctcgacacgacgcccgcgacggcccggcagcacgcctcccggggccggcgcgccgccgccgacgggcagatccggcacaatgccgggctggccgagcagcgccgggtgctgcaggccttcctgctggccgcgcagagcggcgacatgcgcatgctggccgcggtgctcgcccccgacgtggtgtcgatcagcgacggtggcggcgtggcccgcagcgcgctgcgcccggtgctcggctgggagaaggtgggccggctgttccacggcatcctcacccgccgtgcccacgaggtgagcgatctgaaggtcgacccggtgctggtcgagggcggtgccgcgatgatgctgcgcggccgctggccggacgggtcaccgttgctctcggtgatcaccgtggccgtccaggacggccggatcaccggggtcttcacccagcagaacccggccaagctgcggctagacgacctcttgtag

SEQ ID NO: 3323 - DNA, 504 bp, Actinoplanes utahensis
atgccgagcgagatggtccgggtcatctacacgaagtacgacggttcggcgcatcgtgactatccggcccgccgcctggccgaggacgacctgggcatctgggtcggcgtgacccagggcaccgcttcggtctaccacggccgcccgtcggtggagcagatcccgttcgtcctgctcgtcccgcaccacgcctggtggacggggatgttcaacccgccgccgcggaccagcgaggtctactgcgacatcaccaccccggcccgctgggagggtgacacggtgcacatcgtcgacctggatctggacgtggtgcggcgtcgcgagtccggcctggtcgagctccgggacgaggacgagttcgacgagcaccggacgctcttcggctacccggacgacctggtgatgaacgcgaacgcggcggcccgcctgctgatgggccggctcggggacggctccgagccgttcgccacgcattaccgcaagcacctacaagaggtcgtctag

SEQ ID NO: 3324 - DNA, 1998 bp, Actinoplanes utahensis
gtgcccgcagctaccaagaagaaggcgaccgccggacaactcctcgccgcggcggtcggcgccgtccccgggggctccgcccgcccaggtcaggaggccatggtcgcggccatcgagaaggccatcaccgatcgcgagcacctgctggtgcaggccggcacgggcaccggcaagagcctcggctacctcacgcccgccctgctcgtcgagggcccggtggtcgtctccacagccaccctcgccctgcagaaccagctggtcgagcacgacctgccccggctcgccgcggcggtcgagccgctgctcgggcgaaagcccagcttcgccgtgctcaagggccggcaccactacctgtgcatggccaaactcgagcacgccgacgagcaggcgcccaccgacacgctcttcgacgacgccccggcgcccaaggccgggcagtggctcggcgaggccggccggctcggcaaacaggtcgtccggatccgcaaatgggccgacaagacccagaccggtgaccgcgacgagctcgacccgggcgtcgacgacaccgcttggcgctcggtctccatgccggcccgtgactgcgtcggcgccgcccgctgcccctacgggcaggagtgcttcgccgaggcgtcccgggtgcgcgcccgcgaggccgacatcgtggtcaccaaccacagcctgctcgccgtcgacatgctctccgagcggcacatcatcccgccgcacaagctgctggtggtcgacgaggcgcacgagctcgccgagcgggtgtcgtcggcgtcgcaggccgagctcacccccgaggcggtcgagcgggccggccgccgcgcccgcaccctgatcccgccggccaccgccgacgcgctcgccgaggccgccgacgcgctcaccgtcgggctcgccgacgtgccgcccggccggctcaccgacggcctgcccgacgggctgcgccaggcggtcacgctgctcgagtcggccacccgggccgggctcaccgcgatcggcgacgtcaagtccgacgaccccgacccggtccgcaaacagcaggccaaagcggtcctcgacgagctgtccggcaccgcccagcggctcctggaggaggacgagttcgacgtcgcctgggtggagaaatccgagatcggcgccgggcgcaaggcgctcgtggtggccccgctgtcggtgcacggcacgctgtcccaggcgctctacgccgaccgcacggtggtcgccgcctccgccaccctcaccctcggcggccgcttcgacacggtggcccgctcgctgggcctgccggtcgccgccgccgaggacacctccggtgacggctggacctccctcgacgtcggttcgccgttcgactatcccaagcaggggattctgtacgtcgcggcgcacctgccccgcccgatggcctccgggctgcccgacgccgccgccgacgaactgctcaaactggtgcaggcgctcggcggtcgcacgctcggcctgttctcctcccgccgggccgccgcccaggccgccgaactgctgcgcgccaagaccgacctgccgatcctgctgcagggcgacgagaccctgccgatcctggtccgcaaattccgtgaggagcgaaacagctgcctgttcggggtgatgtcactctggcagggcgtcgacgtgcccggcgacgcctgccagctggtggtcatcgaccgcctgccgttcccccgccccgacgagccgctggccgccgcccgcgccgccgcggccgacgccgcccgccccggctccggattctcctcggtcagcgtgccgatcgcggcggtccggctggctcagggagtggggcggttgatccgctcgaccggcgacaagggggtggtggcggtgctcgactcgcggctggagacggcccggggatatgggtcgttcctgcgccgatcgctgccaccgttctggtacacgacgcggtcggaggtggcgatcggcgccctcgagcgtctcgccaagagctga

SEQ ID NO: 3325 - DNA, 414 bp, Actinoplanes utahensis
atgaaacagatcgcctgcacccttctcgtcgccgctgacgggtcgctgttgctgcagctgcgcgacgacaaggcgccctacttcccgaacgtgtgggggcttcccggtggcgccgtcgagccgggggagacaccagccgaggcggcggcacgcgaactccgggaagaggcgagcctgcaggccgacgaacccctgcgcctgttcgagcggcaggaactgcccgccgagggccgggtgaagtactacttccacggccacaccgccgcgacgcaggcggacgtggtactcggtgagggtgcggcgatgctgttcgtgccggcggccgaagtgctggaccggccgttcactccgggcagcgcggaggtgatagcccgcttcctgggctccgcggaacaccgcgcggccgccggttag

SEQ ID NO: 3326 - DNA, 585 bp, Actinoplanes utahensis
atggctgccgtgacgggaccgggcgggaagcggcgacggtgggtggtcgccatggtcgcggcctggatcctggggctcaccgggctgtcctggtggtcgatccgcaacgacccggcgaccgtgccggagcagcgggatctcgggcaggcggtgccggccctgcggaaagccaccgggacgctgctcgcggcggcggacgggccgtgggcgatccggctggacgcgctgcggaccgagaaatgccggctcaccccggtgcgggacgggctggacgccaaacgggacctcgtcctgtatgtgggggagggccagacccgcgccgcactcgaccgggtggccggcgggctgccggacgggttcaaggccggggtgaccccgagccgggccggaagccggctgtcgttcttcgccgacgccggtgacttcatcgcgatcgagggcgaggccggcgccgccgatcagatcctgacactgaccctggacaccgggtgccggccgggacccgcgacgctgggcgcggatccggcggcgggcgcggcgccggccgtgttcggcaagacggtcgcggcgctcggcgctagctag

SEQ ID NO: 3327 - DNA, 183 bp, Actinoplanes utahensis
gtgaccctcgccggcgcgggcggggcgagcggcgaccggccgcgcgggatcccggagggcaccacgccgctgtggagcgggccggacggctgggcgtatcgggacggcgccgcctccgtggtggtcgacgccaccggacagaacctgacggtcagcgtgaccaccgggtgcggcggtcagtag

SEQ ID NO: 3328 - DNA, 960 bp, Actinoplanes utahensis
gtgatccggcccgcctccagcagcaggtcgatcaggtcgggtaacggcgcggcgtgcggcaggacgaactccgcggcccggccgggcagggcgaaccaggtcgactccccggtcagccacagcgacacgccgaccccggcggtggcggccgtcgcggccacgttgaacgcctggttgcagcgctccggggcgtcggcgccggcggtggccttgacgaccagcaaacgtgccatagcggccagcataagatggtccggacatggttacggagatcgggttcgtgagcctgctggtcgccgggatgggcgcgctggcgggcggtttcggttatctggcgattcggatttcgagggggcgttggtgagcggcgagacggaaaacccactgggcccgccgccgtggctgaacgccccgccggtcgacgcctacccctacgaggacacgcacgacctgcgggtcggccccgacctgcacccgtcgctgctcggcctgctgccgttcatcggcctgtggcgggggcgcgggcagggcggcttcccggcggaggaggactacaacttcgcccaggagatcaggatcagtcacgacgggcgtgacttcctgcgcttcgagtcccggtcctggctgctcgacgacgactcgcagccgctcggccagtcgctcaccgagtccggcttctggcggccggtgctggtcgacgggcgccccggcgacgagatggaagccacgatgatccgcccggacggggtcgccgagctctacctcggcaaggcggccacgacgcggctggagatgggcaccgacgcggtggcctacacgccgtccgggttgcacgtgaccggcgggcaccggttgttcgggatcgtggagggggcgctgctctacgcgcacgagatctcgatcgacaacagcgcgctgacgccgcacatgtcggcgcggttgctgcgtatcggcggctga

SEQ ID NO: 3329 - DNA, 585 bp, Actinoplanes utahensis
atggacatccccgacccactgcgccaggcggccgtcatggtcccgcggtgggctaccagcgaggccgggaccaccgtcgcggacgctgtcgactacctcgagcacaacgagtacgagatcgcgctcgacatcctcaccgaactgggcgatgcctacgccgccgatcaggcgttctggaacctcctggcagacgcggccacggagatgaacctgcaccgcgccacagcgtggtgtcactggagagcggcagaggctctccacggcatcatccgcgcggacctgcacctgttcggccctgagcagcctggtgcccgaaaggccgcgatacccggcgacggcatactgcgacccctgtggaatctcggattcgtcatgccggaaggtcatctcgacctgcacgccgcccgcatccgggtcgaaggggaaccccgactggaaccaggcgcatgcggatccatccgcctcgctccgctcgtccccgacagatggcggcacctgcgaccaggcgacgagatcaccatgcacgagcaggctccgccggccggaacggccaccatcacccagacgctgtttccagctcggtaa

SEQ ID NO: 3330 - DNA, 735 bp, Actinoplanes utahensis
atgagcgagcagatcctggtgtccccggccgacctgatgggcgacggggtgttcgagacgatgcacctgcgcccgtccggcccgtggctgctggccgagcacctggaccggctgggccggtccgcggcgctgctggaccttcccgtaccgccaagtcccgatctctcgtcttctgccgggcggacgggtgctctgcggatcatctacacccgcagcctgctgcacgtcagcgtgtccgacatcccggcgaccgtcctccgggaacgccgcgacggggtgcgggtgctcagcgccgggctcggcgtctccgtgacgaaccgtccaccgtgggcgctgtccgccgccaaatccctgtcctacgcgaccaatttcgcggcgcggcgctgggcggcgcggcatcaggccgacgacgtgatcggggtttcgaccgaggggtacgtcatggaggccccgacgtcgtccgtcgtctggctggcgggcgacgagctgtgcacggtgccggcggcggaggccgggatcctgccggggatcacggcggcgcatctgctgtcggtggccggggaggtggggctgcggggggtggagcggatggtgacgctgccggagctggcggcggcggacgcgatctggttggcgtcgtcgctgcgggggctggcggaggtggtgacgttcgacggggtggtgcgggagcggtcgcggtggacgccgcggttgctggagttgctgggcttctga

SEQ ID NO: 3331 - DNA, 450 bp, Actinoplanes utahensis
gtgaaactagcgaactatgctcgtggggtgtccgccacttcgcttgccgccatgctgcgtgagcgcggcctgcggctcaccccgcagcgtcagctgattctggaagcggtgcacgagctcggtcacgcgacccccgagtcggtgcacaacgcggtccgtgagcgggtcgccggtgtcaacatcaccacggtgtatcggacgctcgagctgctggaagagctcggcctggtcagtcacacccacctctcgcacggatcgccgacctaccacccggcgggcgaggggcagcatgtgcatctggtctgccggtcgtgcgggtcgatcgaggaggtggagccgtcggtgctgtcgccggtctgtgatcgcctccgcgacgaacgtcacttccgggtcgatgtcgggcacgtctccctgttcggggtctgtggaaactgcaaggagtcggagtga

SEQ ID NO: 3332 - DNA, 1026 bp, Actinoplanes utahensis
atggtcgaggatctcgacccgagttcggccgatgccggggtgccggcgcatttcggtgacccgatgaaggagcagcggctgctggagacgggggtcggcctggtcgaccggtcgcaccgggatgtgctcgcggtgccgggtccggagcgggccggctggttgcacacgctgaccacccagcacctgtccgagctgtccgcgaatcagggcagtgagctgctggtgctgtccccgcacgggcatgtggagcagcacgcgttcgtcaccgaggacggcaccacggcgtggctcgacaccgagccgggggccggcgcggggctgttgagatacctggagatgatgcggttcttcacccgggtggagccgcgcgacgcgacctcggagatcgccgtgctgtccctggtggggccggctgccgcggatctctttccggatctggcggagcctcgggtcggtgcggtgccgggtccgaagttcaccgccggcacggtgccggccgaggccaccgcgatctacgacgtacgcccgttcgagggcggcctggtgcgccgagtgcccctgggggtggatctgctggtgccccgccacgcgaagacgtcggtgatcgagaagctgggggtggcgcgggccgggctgtgggcctatgaggcgatccgggtcgccgcccgggtcccgcggctgcggcacgagacggaccaccggacgatcccggccgaggcggggttcatggccacggccgtgcacctggacaaggggtgttaccgcggccaggagacggtcgcccgggtgcaccatctgggccggccgccgcgccggctggcgctgctgcacctggacgggatcgccaccgatcacccgccggcgcaggggacgccggtggagctggacgggcgggcggtcggcttcgtcggcaccgcggtccggcatcacgagctgggtctggtggcgttggcggtgctgaaacgcaccgtggccgacgacgcccgcctcaccgtgggggagtcggcggcggcgatcgacgcctga

SEQ ID NO: 3333 - DNA, 843 bp, Actinoplanes utahensis
atgaccggcatgaccgggaccttgatcaccgtcgccccgaccggcgcggagagcagcaaggcggacgtgccggctctgccagtgaccctggacgagctggtgtcgaccgcgaaagagtgtgaggcgctgggcgcctcgatcatccatgtgcacatccgggacgcggatgcccggccgaccctggaccagggtcggctgcgcgccaccgtcgccgcgctgcgcgagtcgaccgggctgatcgtgcagctctcctcgggcggtgcggtgaccgacccggagacggaccggttggccgtgctcgatgccggcccggagatggcctcctgcacgatgggcaccgtcaacttcggtgacggcgtcttcctgaaccgctggtcgttcatcgtcgacctgcacacccgcatgcaggagcggggcatcgtgccggagtacgagatcttcgacctgggtcagctgaccaccctgcagcggctgctcggcaagtacgggctgccggccggcgggcacgtgcacctcgacctggtgatgggtgtgccgggcgggatgcccgggacggcggccgccctggtcgcctgcgagcaggcgatccgtgacctgccggccggcaccacgttctcggcgaccggaatcggtcgcggcacgatcccggtgatgctggcttcgctgtccgccggcgggcacctgcgggtcggcatggaggacacgatcacgtacgccaagggccgcccggtcgagtccaacatgcagctggtcgcccgcgcggtcggcttcgcgcagctcgcccagcgcccgccgctgaccccggcgcaggcccgcgagctgctcggggtgccggcccggtga

SEQ ID NO: 3334 - DNA, 912 bp, Actinoplanes utahensis
gtgaccgtggtcgcggaggtggtccgctccggcttcgtggagagcgtgcaccacggcatcgtcgcgttcgccgaccgccccggcgtcggggacaccaccggcccgttcttcccgcggtcgtcgaacaagccgctgcagaccgtcggcatgctgcgcagtggtctggtgccgcgcgaggagaccgacctcgcgatgatcagtgccagtcacgacggcgagccgtttcacgtggatcgggtgctcggcatcctggccgcggccggtctggacccggcggcgctgggctgcccggcgcagctgccgatgggcgagccggcccgggaggcctggctgcgcggtggtggcgacccggagcggatcctgatgaactgctccggcaagcacgccgggatgctcgccacctgtgtcgtcaacggctggccgctggattcgtacctcgatccgaagcaccccctgcaggtggcgttcgccgccgcggtcagcgacctgaccggcgagccgatcgcggcgaccggggtggacggctgtggcgcgccggtcctggcggtctccccgcaggcgctggcccgctcgttccagcggctggtcgaggcggcgccgggcaccccggagcgccgggtcgcggacgccatgcgcgcgcatcccgagctggtggccgggaccggctcgccggacaccgtgctgatggccgcggtgcccgggctgctgatgaagagtggcgcggacggcgtggtggcggccgcggtgccgggcgccggcgcggtgaccgtgaagatcgccgacggctcggcccgggcgcgcgtcccggtgctgctggcggcgctgcgccggctgggtgtcgagccgccggagctggccgagccggtgctcggcggcggcgtgccggtcggcgaggtccgctcggtctggtga

SEQ ID NO: 3335 - DNA, 402 bp, Actinoplanes utahensis
atggccacttccaaggacctgccgcaggacatcgggacgttcatccgtgacctgcggcagaccgcgaagatctcgctgcggcagctcgccgacaaggccggggtgagcaacccctacctcagccagatcgagcgtggcctgcgcaagccgagcgccgaggtgctgcagcagatcgccagcgccttgcgtgtgtcgacgcccgcgatgtatttgcgggccggactgctcgatggcgagggtcagcagggtgtgctggcggccatcgcggtcgacccggagctcacgatcgcgcagaagcagtccctgtcgcagatctacgagacgttccgcaacgagaacgctcgcaacgcggctcccgccgagtccgcgcccccgacagaccctgccgaggagacgaaatga

SEQ ID NO: 3336 - DNA, 474 bp, Actinoplanes utahensis
atgaccgagcagaccaagaccaggatcccgaccccgctgtacgccgccgccggtgccggtgacctcgcgtaccagcagcttcgcaagctccccacggtgctcaccgagctgagcgaccgggccgtcgcctcgctgcgcaccgccaacgagcaggccgccgagctgcagaagaaggcgtccggcaccgacttcgccgcgctgcgcaccaacgccaccacggtggccaccacgttcgcccaggtcgcccaggagcgggccgtcgcggcgtacaccgcgctcgtcgcccgtggcgagaaggtcgtcggcaccggcatcatcgagtccgccgaggtggtcaacgccgacatcgaggccaccgagcagccgaaggccgtcgaggccgccgtgcagcaggcgcaggccgtcgagtccgccgagacgccgaagccgcgcaagcgcgccaaggccaccccggcgccgaaggccgccgagtaa

SEQ ID NO: 3337 - DNA, 366 bp, Actinoplanes utahensis
atgatccgcgggccccggcattgccggggcccgcggcatagactgcccggcatgggctcttccgcgccgctgttcatctacgacgtccagttctggaccgagacggtcattctcatcctggccctgctcctggagctggtggccttcgtccactgcctcacccagcggggcgcggcattccaggcgctcggcaccctgcccaagggggcgtgggcggccatcatcggggtgtgcggcctgttcacctggtggggtcagggtgcgctgggcatcttcgggctgatcgggatcgcggccgcgctgatctatctgctcgacgtgcggcccgggctgagggacatcgccgacggcaagggtttctggtga

SEQ ID NO: 3338 - DNA, 936 bp, Actinoplanes utahensis
gtgaggggacgcttcgggccgcctccgccggacggcgggccacgcctgcagcgcggcgatcggaccgggccgcgctccgggcggcctacgctgccgggtcccgagaccgagctggtcaccctcgacccgggcgtacgccgaccgtccccgcgcccgcccgcacccgtgcacggttcctcgccgctgcgcctcgagcagctcgtcaccggcctcggcgaccccgtgacggtgttcgcgcacggactggccggggacatctccggcacccgcccgctgggcagcgcggtgaccggccgccgggtgttcttccacttccgcgggcacggccgctccgacgccccacccggaccgtggagcttcggcgacctggccggcgacctgcgcggggtggccgacctggccggcgcgacccgcgcggtcggcgtcagcatgggcgccggcgcgctgtgccgcctgctcgccgagaccccggaccggttcgagcggatcgtgctctatctgcccgccccgctcgacggcagccgaccggaggccgcgctgcgccgcctcgaccgtctgctcgcctcggtcgagtcgggtgaggccgcgatgatcgccgacgcggtcgaggcggagatcccggcggcggtgcgcaacaccccggccgggtggggcttcctgcgtcagcgggtcgaccagctgcagcgcgacgggctggcggccgagctgtcgacgctctggtcggcgccgccgctgccggacgagtcgctgctcaaggccttccgggggcgggccctggtgatcggctgccagggcgacgagatccacccggtggccggtgcggagcgggtagccgggctgctcgacgccgacctgcacgtctatgaccggccgtcgatcctgtggaccgaccgggcggacctccgtgagcggatctcggcgttcctgaacgcttga

SEQ ID NO: 3339 - DNA, 432 bp, Actinoplanes utahensis
gtgcgcttgtcccctaaatccgtttttatcggcgttctggcgatcggcctgcccttcgccgtcgtggtgggctgggccctgggcaccccggtcacccagactacggccgccccgggaaccggcggtgccggcggcagcgacggcctcggccgggccccgtcccgtccgcactacgcgtccggcggctacggcaaccacccggccgcaccggccggcgccgcgtccccgaccaccgcggccagcaccgtgatcaccaagacggtcatcgtgcccgcctccgccgcgcccgcgaccgccccggccacctcaccgccgccggtcctcaacgaaccgccggtgccgacacccaccacgatcaccgggccgcccgagccgatgccgtccgacagcgcctccgcgagtgcggccatcccggcgcccagcgcctcctga

SEQ ID NO: 3340 - DNA, 915 bp, Actinoplanes utahensis
gtgcggccatcccggcgcccagcgcctcctgacgcgcggcgcccgctgcctgccggtcgcggccggcgttgcttcgagtggcggacgggacaggcacgactaagctcccggatcgtgaaggaagatccgaatcggccggtggccgcggttcgtcagttcgtcaccggcgccggcctgctcgggcgcgggctcggcctcgtcctgcgcagcccccggatgctgggcctgggtctgctcccggcgctgatctccggcgtcgtctacaccatcgggctggtcgtgctggtccgcttcctgccgcagctctccgagcatgccacctggttcgccgcacactggtccggcttctggcgcgacttcgtcgaggtgctggccggcgccggcctgctcggcctggcgctgctgctcggcgtactcaccttcaccgcggtcaccctgctgatcggcgatccgttctacgagcgcatctccgaactggtggagaatcggtacggcggcgtgccggacgccgtcgacgtcggcttctggagctcgctgcgccgcagcctcgccgactcggtccggctgatcggactctccgtcctcgccgggataccgctgttcctgctcggcttcctgccggtcgtcggccagacggtgatcccggtcctggccggcgcggtcggcggctggctgctcgccctcgaactcaccggcgtcccgttccagcgccgcggccagcgtctgcggcaccgccgggtcgccctcgccaagaacgtcccgctcaccctcggcttcggcgccgccgtgttcggcgccttcctcatcccgctcggcgcgatcttcctgatgcccgccgccatcgccggcgccaccctgctctcccggcgggtcctgggccgccccatcgacatcaccacggtcggctccctgtga

SEQ ID NO: 3341 - DNA, 525 bp, Actinoplanes utahensis
atgcggatcgagctcgtcgagggcgacatcaccacgcggcaggtcgacgcgatcgtcaacgcggccaactcgtcactgctcggcggcggcggggtggacggcgcgatccaccgcaggggcggcccggagatcctcgccgagacgcgggcgctgcgggccgcccgatacggccgggggctcccggtcggccaggccgtcgcgaccaccgcgggccggctgccggcgcgctgggtggtgcacaccgtgggtccggtgttcagcgccaccgaggaccgctccgagctgctgcgcgcctgctacacgaacgcgctgcgggtcgccgacgaactgggcgcggaaacggtcgcgttcccgctgatctccgcaggcgtgtaccggtggccggtcgacgacgcggtccggcaggcgctgaccgccctgcggtccgcccgaccggagcgggtgaccacggcgtacctggtgctgttcggcgccggcaccgccgcgaccgcccgcgccgtcgccgagggctccgccgagctctga

SEQ ID NO: 3342 - DNA, 1020 bp, Actinoplanes utahensis
gtgacgacgcgggagcggcccacgctggaggcggtggcccggcgcgccggggtgtcccgggcaaccgtctcccgcgtcgtcaacgggtccaccacggtggccgccaccatccgggaggcggtcaaccgggccgtcgacgaactcggctacgtgcccaaccaggcggcccgcagcctggtcacccagcgcaccgactcggtcgccctgatcctgccggaaaccgcgaaccgggtcttctccgacgacctgttcttccccgcgatcatccgcggcgtcggcatggaactcgaagccgccgacaaacagctcgtcctcatgatgaccggctccgaagccggccaccaccgcgtcgagaggtacgcggtcgccggccacgtcgacggcgtcatgttcgccagcatccacggcgccgacccgctccccggcgccctcgcccgccgcggcatcccggtcatctgcagcggccgcccgatgaccgccggcagcgaccccgccgtcccctacgtcgacgtcgaccacgccggcggcgtcgcggccgccgtccaccacctgatccggaccgggcggcggcggatcgccaccatcgccggcccgcaggacatggtggccggcatcgaacgcctcgccggctaccacgccaccctgcaggcggccgggctgccggaactcgcggtcaccggcgacttcacccgcgaatcgggcatcaccgggatgcgcgagctcctcgcccgcgaccccgagctcgacgcggtcttcgtggccagcgacctgatggcccacggtgccctgaccgcgctgcgcgaagccggccgccgggtgccggccgacgtggcggtgatcggcttcgacgacttcgacatcagccggtacagcgacccgccgctgaccacggtgcggcagccgatcggcgagatcgggcagaccctggcgcggcagatgctgctgctgatcgccggtgagcaggacgtgccgaactcggtggtgctgccgacggagctgatcgtccgcgactcggcctga

SEQ ID NO: 3343 - DNA, 1449 bp, Actinoplanes utahensis
atgatgaaccggttaagttcagcggatcaaggaagcggtgaagacatgacggcaaccgtcacgtccacgtcggcgcagccggcgcgtgcggggatcaccttccccgacggcttcatctggggcgcggccacggcctcgtaccagatcgagggcgcggcgcgggaggacggtcgcggcccgtccatctgggacaccttcagccgaacacccggcaaagtgcacaaggggcacaccggcgacgtcgcgtgcgaccactaccaccggtacgtcgaggacgtggccctgatggccgacctcggcctggcctcgtaccggttctcggtcgcctggccgcgggtccgcccggacggcaccggcccggtcaacgcccgaggcctcgacttctacgaccggctcaccgacgaactgctcggcaagggcatcgacccggtcgtcaccctctaccactgggacctgccgcagacgctggaggaccgcggcggctgggccgaccgggagaccgccgaggcgttcggcgagtacgccgaggtcgtctaccgcaaactcggcgaccgggtcggcacctggaccaccctcaacgaaccgtggtgctcggcctacctcggctacggctccggcatccacgcccccggcgtgcaggacccggccaaagccctggccgccgtccaccacctgctcctcggacacggcctggcggcgcaggcgctgcgggccgccggcgcccagcgggtcagcatcacgctcaacccgtgcgaggtctacccggtcgacccggaaagcccggccgaccgcgccgcggcccacctcatcgacggcctcgccaaccggatcttcttcgacccgctgctgcgcggcgagtacccggccgacgtcctggagcacatcgcccggctcaccgacctctcctacctgcgcgacggtgacctggccaccatccagcagccgctcgacgtgctgggcatcaacttctacaacccggcgtacgtgtcggccaagcccggcgcgcccggcgccaaggactacccgggcagcgaaggcatcgccttccgcccgccggtcggcccggtcaccgacatgaactggccgatcgagccggccagcctcacccggctgctcacccgcatccaccgggactacccgggcaccccgctgatgatcaccgagaacggcgcggcgttccccgagggcccgatcgcggacggcaccgttccggaccggcgccggatcgagtacgtcgacggccacctgcgcgcctgccacgacgcactggccgccggagtcgatctgcggggatacttcctctggtcactgatggacaacttcgaatgggccgagggatacgcgaagcgtttcggtattgtgcacgtcgactacacgacgcagcagcgggtgctcaaagacagcgcgaagtggtaccgcgaggtgatcaagcgcaacgggctttcctaa

SEQ ID NO: 3344 - DNA, 762 bp, Actinoplanes utahensis
atgaacaggttgcacgcgacgaaggatttctggctggcggcgctgcgcgccgacgggccggccctgtgggaggccgtcgccgagaccggtcccggcgtgccggtccccgccatccccgactggaccaccgccgacctggcgttccacgttctggacctgctgcgctgggtgcgggcgacgatcgcccgcggggtcaccgaccgcccctccgctcccccgggctccgattcccggccggagtgggacgaggccctcgaccagctccggcgcgagctgaccgggacgatcgagacgctggaggcgctcgacccggatctgcccgcgtggaactgggcgccgcagccgaaacgggcggtgttctgggaccggcggatggcacacgagatctcggtgcaccgctgggacgccgaggcggcggccgggcggcccaccccgatcgagaccaagctggccaccgacggggtggccgagatcctcgacacctggctgccggccggcaaacggcaggggccgaccgacctgcacggcgtggtgcacctggtcggcacggatgcggaaaccgagtggttcgtccggctgcgcggggcggggatcgcgctgctggacaccggcacgatcctcgacaccgacgatcaccacgcccgggccaaggcgaccggcacggccagtgatctgcagttggcactgatgggccgcaaacgtaccgaccaattggcgttgagcggtgatccccgcctgatccaggctcttcgcaccggctga

SEQ ID NO: 3345 - DNA, 1077 bp, Actinoplanes utahensis
gtgcccgacgcattcgccgaccacctgactgacccgacgcccgccgcggaccgagtgctggcggcctatacgacgctacgcctcggcggcccggccggcacggtgaccaccgcggtcgagacggacgaagcggtcgccacggtgcgtaaagccactgccgagggacgtccggtcctggtcctggccggcggcagcaacgtggtgatcggtgacgccggcttcgccggggaggtgctgttgctgcgcacccgcgggatcgaggtggtctcggagagcgccggcgaggcggtggtccgggtcgccgccggcgagccctgggacgatttcgtggcgtacgcggtgggcaacggcctgtccggcgtcgagtgcctgtccggtatcccggggtcggccggcgccaccccgatccagaacgtcggggcgtacggccaggaggtggcgcacaccatcgtggcggtgcacgcctacgaccgggtcgccgacgagcagctgatgatgtccccggccgactgcgccttcggctaccgctccagcgtgttcaagcacaacgaccgctacctggtgaccgccgtggacttccggctggcccgggcggatcgcagtgccccgatccggtacgcggagctggcccgtcagctgggtgtcgaggccggcgaccgggtgccgctggagcacgcccggcagaccgtgctgaagttgcgggccggcaagggcatggtcctcgacccggcggaccgggacacctggtcggtcggttcgttcttcaccaatccggtggtgagcgccgcgttcttcgccgagctgaccgcggcgcgtggcgagatgccgcactggccgggcgcggacggcacggtgaaggtgccggccgcctggctgatcgagcacgccggcttcccgaaggggttcgccggcgccggggtggccatctccaccaagcacaccctggcgctgacccatcggggcgccggcgacaccggtgcgctgctggatctggcgcggaccatccgggacggggtgcgtgaccgattcggcatcacgttgcaccccgagccggtgctggtcaactgcgcactgtaa

SEQ ID NO: 3346 - DNA, 642 bp, Actinoplanes utahensis
gtgttcgacaaggtggtacgccgcgcctccgcgctcgcggccgcgcccgcactgctcgccctgccggtcgccctgttcgccctgccgcacgccgtgcacgcccagggcccggtggtcccgccccggccgccgggcatgcccacccccgccccggaacggttggggtcacccgatccggcgacctcgaccgtcatcccggccgcgccgatcaccccgcagatcgccgcggcgccggcggtcgacccggtgaaggcccgcgcccgcaccctgatgcaccaggtgatccgcctgaccaaccgggagcgggaggcgaacgggtgcgcccgcctcacggtcgaccacgagctgatcgtggcctcggtggcgcagagctactacatggcgcggacccggctgttcagccacgtgtggcgggacggctccaccttcgcgatgcgcgccgaacgggccggataccgcgccccggccggcgagaacatcgcctggggctacccgaccgccgccgaggtgatgcaggcgtggatgaacagtcccggacaccgggcgaacatcctcaactgcggagcgaagtcgatcggcgccgccatcgtgtacgcggcggacgggacgccgtactacacccagaccttcgggtggagctga

SEQ ID NO: 3347 - DNA, 699 bp, Actinoplanes utahensis
atgagtcgcctactcgtggtcgaggacgacccggacatcgcactcgccctgcggctgctgttcagccgggccgggtacgaggtggcccacgccgcggacggccgttccgggctgaaggaggcctacgccgagcaccccgatctggtggtgctcgacgtcggactgccggagatggacggctggcaggtgctggagcggctgcgggacgtgtccgacgtgccggtgctggtgctgaccgcgcacggccaggaggccgagaaggtgcgcggcctgcgcggcggcgccgacgactacctgaccaagccgttcgccaacaacgagctgctggcccgggtggaggcgctgctgcgccgctcgtcgagcggacagaacagctgggccagccagatctacgacgacggcctggtgcacctggacccgaccaagcgccgggtctatgtcaaaggcgacgagaagcggctcacgccgaccgagttccgtctgctcaacgcgctggtccggcatgccggagcggtgctttcgccgaaccagctgctgacccaggcctgggacgacccgaccggcatcggccaggagcgggtcaagttcgcggtcctgcggttgcggcgcaagctcggctggtccgacccggacgaatcgccgatcgaatcggtgcgcgggttcggctatcgctatcgacgtccgggcggagaggcctga

SEQ ID NO: 3348 - DNA, 423 bp, Actinoplanes utahensis
gtggaagaccttggcgagatcgtcggcgaattcctcatggagtcgcacgagaacctggaccagatcgaccgggacctcgtgagcctcgagcaggagccggggtcacgtgacctgatctcccgcatcttccgggcgatccacacgatcaagggcacgagcgggttcctcgccttctcccgactggagaagctcgcccacgcgggtgagtcgctgctctcccggttgcgcgacggcgtccagccggtcaccccggagaccatcaccgtcctgctgctctgcatcgacggcgtccgctcgctgctctcctcgatcgaggagaagggcaccgaggacgaggtcgacatcgacagcatgatcgtccggatcaaggcgcagatggacgcgccgaccgacggcgccccggcggccgcactagctagctag

SEQ ID NO: 3349 - DNA, 1611 bp, Actinoplanes utahensis
atgaacatggtcggcgagctggttctggcccgtaaccagctggtccgcggcgtgatggagatcggcgactccggcctggtgcgcagcgcccagcggctcggcatgatcaccagtgagctgcaagagggcatcatgaagacccggatgcagcccatcgagcacatctggtccaagctgccccgggtcatccgggacctgagcaactcgctcggcaagcaggtccagctggtgatggagggcaaggagaccgagctcgaccgcagtctgctggaagcggtcaaggacccgctgacccacctggtgcgcaacgcggtcgaccacggcatcgaggacccggagcgacggctcgccgccggcaagggtccggagggcacgttgaccctgcgcgcctaccacgagggtgggcacgtcgcggtcgaggtcgcggacgacggggccgggctgaacgtcgagcggatcgcgcagaaggccgtggagaacgggctgctccggccggagcaggtaccgaacatggacaagcgcgacatcatggcgatggtcttccagcccgggttctccaccgccgccaaggtcaccaacgtctccggccgcggtgtcggcatggacgtggtgaagaccaacatcgagaacatcggcggcgcggtcagcgtcgactcgacgcccggcgagggcaccgtctggcgcctgaccatcccgctgacgctcgccatcatccaggcgctcaccgtcgactgcggcgaccagcggtacgtggtgccgcaggtcgcggtcctcgaactggtcttcgtcgacgggcagaccaccaaggtggagtacgcctcgggtgccccggtgtaccgcctgcgcggcaagctgctgccactggtccggctggaccgcgcgctcggtctcgaagtcggtggcgaccagggcgtctacatcatggtgctgcaggccgacggccggcggttcggcctggtcgtggaccgggtgctgaacaccgaggaggtcgtggtcaaggccctgaacaccaggttcaaggacatcggcctctacgccggggccaccatcctgggcgacggcaaggtcggcctgatcctggacgtgtcctcgctggcccgccgctcccacctggccgtcgactcggagcgcgagaacgtcgccgagaagcgcggcccggccggtggtggcaccgagcgcctgctggtcaccgcggtcggcgagcgccgggtggcgatcccgttggacacggtcacccggctggaggagttcccgcgcgaccggatcgagcacgccggctcccgcgaggtggtccagtaccgcggccagatccttccgctcgtgcgcctgtcgcacctgctcggggcgtacggcgaggagttggagggcgacaccgtctcggtggtcgtctacagcgagggcggacggagcgtggcgctggtggtcgaccggatcgtggacatcgccgagaactcgacgacggcccgtcgggaggccgaggaggacggtctggtcggcaccgcggtgatccagcaacgggtcaccgagctgctcgacgtgcgccgggcgatcctcgccgccgaccccaacttctacagcgacgcgtccgacgagatgttggtggaggcctga

SEQ ID NO: 3350 - DNA, 438 bp, Actinoplanes utahensis
atggcgagtcgccagttcgccaccttcgaggtggacgggcagctcttcggggtggaggtgcataccgtgcaggaggtgctctcgtacaacgagtacaccccggtgccgctcgcaccacccgccgtcggcggcctgttcaacctgcgcggtcaggtgatcgccgcggtcgacctgcgggtccagctggggcttgcccggcaggccctgcagggcccggtgatgaacgtgatcctgcgcggcgacggggagccggtgagcctgctggtggacaagatcggcgaggtggtcgacctggacgaggagaccttcgaacccccgcccgacacgctcagtggtcccacccgcgagctggtggtgggtaccttcaaactcgacgggcggctcatgctggcgctcgacgtcaatcaggcggtcgatacgtaccgcgccacgaactga

SEQ ID NO: 3351 - DNA, 873 bp, Actinoplanes utahensis
atgtacagcctggtcagcgcccccgtcctgggcttcgacctgacccgcctgccgggcgggtcggcggcggccgacgtcctgctgcgcggtctgcgcctccaggccgccgacctgccggtgctcgccgagcggctcccggacgagggtgtccggggtccgctctgggtcgaggtggagagcgccgcgcgccggatgccgaacctcaagggcatgtcgaaggacgacccggcgggcaacctggccctggtcgagcgggcgccgatcggctcggtggacgcgctgctgacctgcctgcgctacgacgtgatgtcgtggacctgggaggggaccggccgggacgcgcggcagaccgaggaggcggccgcggccaccgcgctgctctgcgacgccgcggtcgggtgctacctgcgggaggtgctcgacgacgacgcccgacggcgactcggggccggctgggtggcggccatgaagaaggtgccggcgggcgcgccgatcgacctgggaccgcaccactacaccgtctccgccctgttggacaagctgcgcacgctgcggccggaggaccgaacccgggtcgtgaccgccgccgacgacgcccggcgcaacaccgccggctggtcgccggccgtgcactcggcgtcctgggctgcgtacctctccgatcgggtccgcaccgcggccgcggcgcagatgctgttggtgcaggcggtggacacggccgggattccgctggccgaccgggccggcggggtctggaacatgctcagcggcgccgtccaggcgctggtggttcgcgatctgctggacaccgcaacggcgcaccggctgctcgcgccggtcgtcgcggcactcggtccggcctggctcggttga

SEQ ID NO: 3352 - DNA, 444 bp, Actinoplanes utahensis
atgatctcggttctcgtcgtcgacgattccgtggtggtccgtcggctgatcgtcgacgctctcggggaggcgccgggcattcaggtggtcggcaccgcggcgaacggcctactggcacaggccaagatcgaccagctcaaacccgacgtggtcaccatggacatcgagatgccgcagatggacggcatcgaggcggtgcgtgaactccgcaaacggcacgccgcgctgccggtgatcatgttcagcacgctgtccgcggcgggcgccaccgccaccctggaggcgctctccgcgggtgccaccgactacgtgaccaagcccagcaacgtgggctcggtgaaggaatcgatcgaggcggtacgcgaacagctcgtacccaagatccaggcgctcggtgggcgccgtcgcccgccgcccggcgcgccgccgcgactagctagctag

SEQ ID NO: 3353 - DNA, 96 bp, Actinoplanes utahensis
gtgcagcaccttggtcagcgcgtccgggccgccggtggacgagccgatcgccaggatgtcgatccggccctgcgggccacggcgctagctagctag

SEQ ID NO: 3354 - DNA, 528 bp, Actinoplanes utahensis
ttgccggccgacctcccggtcccggtggtgatcacccagcacatgccgccggtcttcaccaagatgttcgccgaacggctggaccgcagcatcccgttgaaggtggtcgaggccggcgacggcatggaactggcgcccggcacggtctacatcgcgccgggcgaccggcacctgatcttcaaccgccggggcacgtcgacgctgacccagctcagcaacgcaccacaggagaactcctgccggcccgccgtggacgtgatgttccggtcggtggccgcgctgtacggcggcaccgcgttcgccacggtgcttactggaatgggacaagacggacgaggtggtgcgaaggtgctgcgagacgcgggctgtgagattctggcccaggacgaggcgtcctcggtggtgtggggcatgccgggcgccgtggtcggcgcgggtctggccgatgaggtgttgcctctcgaccggatcgcggcggcgctgctgaaccgggtgcgggtgggacggtccgcggcggtggcccgatga

SEQ ID NO: 3355 - DNA, 846 bp, Actinoplanes utahensis
atgaccctgtcccaggccgagttcaccttcgtcgccaacctggtgcgccgggaggcctccatcgtgctggcgcccggcaaggaatacctggtcgaggcccggctgatcccggttgcccgggtagtgggcgcgccaaacgtcaacgatttcatcgccgatctgcagaagcgcccgaacccgcagcatcagcggaagatcatcgacgcgctcaccaccaacgagacctccttcttccgggaccgggagccgttcagcgcgctcaccgacgtggtgctgccggagttggtcaagtcccgggccagtacccgcaagctgcggttctggtcagcggccagctccagcggccaggaggcgtacagcctggcgatcacgctgcaggagtcgctgccggccggctggtcgttcgagatccagggcaccgacatctccaccgcgatggtcgagcgggcgcagaaggcggagtacagccaggtcgaggtgaaccggggactgccggccacccagctggtgcagtacttcgagcgggccggcgcgcactggcgggtgatcccggcgctgcgccgcaacgtctcgttcaagcacatgagcctgaccgcgccgttcccgccgatgcagccgttcgacgtgatcttcctgcgcaatgtcctgatctatttcgacgtcgccaccaagcgacaggtgctgcagaacgccgccaagatcctgcgccccgacggctggctgttcctcggcgcggccgagacgacgatcgggatcgacgacaactatgagcgggtggccgccggccgcacatccgcgtaccgaatccgcaatgcggtgcccgcgggcgccgggagaaggggatga

SEQ ID NO: 3356 - DNA, 396 bp, Actinoplanes utahensis
atgacgccgatgcgcgccatggtgatcgatgactcgcgcgcgatgcgcatgatcctcaagcgcatcgtcacgaagctgagcttcgaggcggtcgaggccggcgacggcaaggaggcgctcgacctgctcgccgatatgaccgaggtgccggaactggccctcatcgactggaacatgcccaacatgaacgggctcgagttcgtcatgaaggtccgggccgacccgcggctgcgcgagatgaccctggtgatggtcaccaccgagagcgaacagagtcagatcgtccgagcgctcgccgcgggtgctcatgaatacgtcatcaagcccttcacggagggtgccatgatcgaaaaactggccctgctgggcctcgtgccgaccggagcgaactcatga

SEQ ID NO: 3357 - DNA, 486 bp, Actinoplanes utahensis
atgagcgtcgaagtcgacgtagacgagaacgacctcgctgagatggtggaacaggtctgggagtcgtacctggatccggagggcgtgagcccgctgatgcagacgtacgacgagaaccagccctcggaagtgcactcctcagtgtcgatcaccgggtcctggaccgggcacatcgtgtacgcgtcctcccgggccgccgcccagcgggccgcggccgccttcctggccatggaactggacgaggtgagcgaggaggacatctccgacacgctcggcgaactggcgaacatcgtcggcggcaacgtcaaggcgatgcttccgccgggttcgcagttgtcgctacctcaggtagtgctcgcgccggagagctcggcgcgttatccgaacaccgaacgcatcagcggcgtctatggactctgggaaggcgagccggtgtccatttcgatgtggcagagcagcaccgacacgaaggaggagggtgcatga

SEQ ID NO: 3358 - DNA, 363 bp, Actinoplanes utahensis
atgaagatcctcatcgccgatgacagccgggtgatgcggcagatcgtcgtccgtaccctgcggcaggccgggttcggcgaccacgacctgatcgaggccgcggacgggcaggaggcgttcgacatggccagcaagcagcagccggatctggtcatctcggactggaacatgccgcagatgaccggcatcgaggtgctgcggcaactccgggcggccggcaacaacgtcaagttcggcttcgtcacctcggagtgcacgcccgagatgaagacggccgccgaatccgcgggttcggccttcttcatcgtcaaaccgttcacggctgagcgattcgacgaagtcttcgctccaattttgggatga

SEQ ID NO: 3359 - DNA, 489 bp, Actinoplanes utahensis
atgtcagacgtctcggtacttcccggctctctagccgtacgcaatctgttcgaggatctcctcggccgcgaggtcaccgtcagccccggtgacccgctcagcgcggacgagatccggaccgccacggtcgcgatcttcaccgacaacagccagaagatctacgcggccatgggcctgcagctgagcctggcggccaacgccggcgccgcgctcggcctgctgcccccgggcgccgccgaggacagcatcgacgagaagcagctcttcccgaacctggcggagaacgtcggcgagctgtgcaacatcttcaccagcctgctcaacaaggagggggccccgcacaccaagctctaccaggtgatctacccggggatggagctgccggccgacgcccgcgcgatcctgctcgcgctcgggcggcgcctggacctgatggtcgaggtgagccggtacggcaagggcaagatgagcctgtcgctggcgccctga

SEQ ID NO: 3360 - DNA, 447 bp, Actinoplanes utahensis
atgacctcgccgacctctggaatgggcgccaccggcgcctcttcggacgccgcacaggccgccgccgcgctcaaggctgaggccgcgaagcggcaggccaaggacaaggacctgggggacaaggacaccttcatgaaactgttggtggcccagctcaagtaccaggacccgtccaaacccgccgactcgacccagtttctcgcccagaccgcgcagttcacccaggtcgagaagctggaagacatgatcggcatgatgaagtcgcagcggatgacgagcgccagcatgctggtcggcaagaccgtcacgtacatggacgccaacggccagtcgcagaccggcgtggtgtccgcggcgaagctcaacggggacagcgacccgaccctcaaggtcggtaacacggatgtggacctgtccaaggtcacggagattcagcagaccgcctga

SEQ ID NO: 3361 - DNA, 1275 bp, Actinoplanes utahensis
atgctgcgttctctctactccggcatcagtggcctgcacgcgcaccagcagatgatggacgtcaccggcaacaacattgcgaacgtcaacaccgtcggctacaagtcggaggcggtgcagttccaggacacgctcagccagatggtgggcgcggccggctcgccgcagaacggcatgggcggcaccaacccgtcccaggtcggcctcggtgtcaaggtcgccggcatcagcaagaacttcagccagggctcggccgagaccaccggcaagtccggcgacatgatgatccagggcgacggcttcttcatcacccggaccggcaacgagcagatgtacacccgggccggctcgttcttcttcgacgccaacggcacgctggtcaccaccagcggccagccggtgcagggctggaccgcggtcgacggcaaggtcaacgccggcggccagccgagtgacatcaagatgccactgggtgccaccatcccgcccgcggcgaccacccagatcaccctcaagggcaacctgaccagcgacttcccggagaacaagctggccaccgaggacaccgtgacgatcccggtcaaggtcttcgacaaggacggcgcgacccacacggtgaccgccaagttcacccgggccatcgacccgaaccgggtcgccggggacaccccggacaccacctgggacatcgcgctgtacggcgaggacggcaccgccatctccggcgcgaccggggagatcgacatgaccagcggcaaggcgatcgtcagcgccaccgacaccccggccaccggggagttggacaaggacggcaacatgcagatcggcgattacaaggtcaacatggccgacctgaccatgtactccgggctgtcggacgctcgggtgttctccaccgacgggcagaccgccggcgcgctgacctcgctcgcatacaccgtctcggacaccggtgagatcgtcggcgtgtacagcaacggcttgaaggagacgctgggccaggtcgccatggccaccttcaagaaccccgacggtctggagaaggtcggcaactcgaccttccgcagcaccgtcaactccgggtacgcccaggtcggtcagcccggcagcgccggcatgggccaggtgatcagtggcgccctggagatgtcgaacgtcgacctcgcccaggagttcaccaacctcgtggtggcccagcgtggcttccaggcgaactcgaagatcatcacgacctccgacgagttgctccaggaactcgtcagcatgaagcgctaa

SEQ ID NO: 3362 - DNA, 279 bp, Actinoplanes utahensis
ttgatcctcgtaactcgaatcaacggtgccgtgttcgcgctgaacccggacctggtcgagcgtgtggactgcacgcctgacacggtcgtcaccctggtggacggcaccaagtacgtcattgccgagtccgtgcccgaattcatcgactcggtgcgtcactaccgcgcctcgctgatcgcccaggcgagtcgtatggagcctgagcccacggccgccctctcctcgtctgacgacgagctcgacgccaaggtgctcccgctgcaccggaaggaccgctaa

SEQ ID NO: 3363 - DNA, 792 bp, Actinoplanes utahensis
atggacatctcaaccgtcgtcggggtgctcgccggactggcgatcgtcttcaccgtccagatcctggacggtggctcgcccagctccatcctgctgatcccctcgatgctgctggtcttcggcggcgccttcgcggcggccatggccggcggtgtgttcaaggacgtgaccgggttcggcaagcagctgcagaaggccttcaccgccaaggtgacgccgccgacccagctgctcgacaacgtggtcaagctggctgagcgggcccgtcgcgagggtctgctggccctcgaggacgcggtcaagacggtcgagcacccgttcctgaagcgcggtctgcagctggccatcgacggcaccgacccggacgagctgcacgacatcctgcacgccgaggtcgcggccaagaagaaggcggacaaggccggcaagaagttcttcgagaacatgggcggctacgcgccgaccatcggcatcatcggcacggtcatgggcctggtgcacgtgctggagaacctcgacaagccgaccacgctgggcccggccatctcctcggcgttcgtcgccaccctctggggtgtgctcagcgccaacatcatctggctgccgatggcggcccggctcgaccggctcagcgccgtcgagtccgaggagatggagctggtgatcgacggtgtgctggcgatccaggccggctccaacccgcgcctggtcgcccagaagctgcggagcctgctcccgccggacgagatgaagaaggctgaggccgcggcctcctcgaagaaggcggcctga

SEQ ID NO: 3364 - DNA, 1059 bp, Actinoplanes utahensis
atgagttccggtggcggcggcgccaagcgcaagaagaaggcccatgaggagcacgaggagcacgtcaaccacgagcgctggctcgtgtcgtacgccgacatgctcaccctgctgttcgtcctcttcgttgtcctgttctccatgagtgacatcaaccagaagaagttcgcccagctcgcgcagggtctctcggcaagcttcggctccaagagcgccgcgttcaccggtaactacgccccgctggacggctcggcgaacaacgcgcaggtcgtgcagatcgacccgggcgccaacccgggtgacgggtcctcgggtaccgagggcctgaaccagaagcagcaggaggccgtctcccgggcggtcatggcggaggaccgcaagaaggcctcggccaacgcggacaaggcggcgaaggaggcggagaacatgaaggcgatcgagaacaagatctccgacgcgctcgccgcggccaagctgctggacaacgtgaagttcacgatcgaccagcgcggcctggtcgtcacggtggtgaccaacgaggtggtcttcgccggtgaccgggcggacctgcgcccgaccggcgagaagatcctcggcgcgatcgccccgacgctggcgaagctgccgaacaacgtcgaggtggacggcaacaccaaccagctcaacgcgaagaccaggtactacccgagcggctgggagctgtccgcggcgcgggcctccaccacggtccggtacttcaccgggcacgggatcgcgaagaagcggctcagcgcggtcggtttctccgacaccaagccgctgatcgacccgaaggacccccgctcgatcacgatgaaccgccgggtggacgtggtcgtgctgaccatgctcacggccgaccaggcggcgctgctgccgtcggcggcgggttccgacgcgaagctgcacgccggtcagaccacggccgaggcgaaggcactggagaaggcggtcgagtccgccaactcgtcgagcaccaccaccggtacgaccggcaccacgaaccacagcacgctgatcaccgctgagacccgtaactga

SEQ ID NO: 3365 - DNA, 450 bp, Actinoplanes utahensis
atggctgacgagaaggacgcggctgcggaagcgccgaagaagtccaagaagatgatgatgatggtgatcgcgctggcactggtcgtgctgggcggcggtggcgccggagcgttcttcatgctccgcagcagctcggcgtcggcggcaccggtgaagggcatcgtcaccgcggcggagaacaccatcacggtgaacctggccgacgggcactacctgaagctcggcttcgccctgcagcagaccgacgcctccgccgaggcggtcgacctgagcgaggcgtaccagctggcgatcgaggagtacaccggcaggacgattgccgagctctccaccgacgcgggccgcgccaagctcaaggaggagctgaagggcaagctgatcgcggcgtacaccgagaagaagaagaagctcgtcatggacgtctacttcacctccttcgtgacgcagtag

SEQ ID NO: 3366 - DNA, 951 bp, Actinoplanes utahensis
gtgaccaccaccgcacgcacccccggcaagatgtcgcgccgtggccagggcggagggccgacggcctacgacttccgccgaccgatcaagctctcccgcgagcatgtccgcaccctgcagatcgccttcgagacgtacgcccgcagttgcggcaccctgctgaccacccggctgcgcgcggtcagcaacgtctcgctgatctccatcgagcagctgaactacgacgagtacgtggcgtcgctggccaacccgacgatcatcggggtggtcgccctcgatccgttgcccggcacggtgctgatcgagatcgcccagtccgcggtgatgaccgcgatcgaccacatgctcggcggccccggcggctcccagccggagcggccgctgaccgaggtggagatgccgctgctgcgcggcctgatcgagcggatgctgggcgagctgcgctacggcttcgagagcctggtcgacatccagccgcacctcaaggagatcgagtacaacgcgcagttcctgcgggcgcacgcgcccggcgacgcggtggtggtggcctcgttcgagaccaagatcggcgccgaggagtgcatctcgacgatctgcctgccgttcaacaccattctcccggtgctgtcccggcaggaggcggtcgtgctcagtgcggccgaacgccaggtcaaggacaaggcgctgcgcaatctcacggccggactttccgccgctccgatcgacgtagcagtgcgattccagcccattcggatgcgcaccgatgacatcgtggatctacgtccgggtgacgtcgtgccgctggggcatccgaccagccggccgctagaggtgaccgtgaacgacatcgtgttcgcgcatgccgttcccggtaatcagggtgcccggctcgcctgtctcgtcgtgccgtcccccaccgagaacgaatccaaggagtctggccgctcatga

SEQ ID NO: 3367 - DNA, 768 bp, Actinoplanes utahensis
atgaccgcccctgccatcaccgcgccgcagctcatcctggcccggaacgcggcggacgccgcgctggccgtcctgcccaccagccgggcactggtcgccggcgagccgatgaccccggacgggacgaccgcgatcgagggccaggcggtcaccgcgcgcttcagcggacccgccaccggcgaggtggtcgtggtggtcggtcaggacctggcggacgcgctcaaggagagcccgctcggcgaactcgacctgaccgcggcggtccggcccgcgctggaggccgcggcccgggtcttcgggccggtcgtgctggatcccggtcaggtgatggagccgcaggtcgcgctcagcgcgctggccgccaaagagggtgcggtcgccatcccgctgcgcgacgacgaggacatccgcgcgatgctggcgctgtcgttgagcccgtggccggacgatgatccgctggtggccgccgcgaccggcggcggggtggcccagcgcgccccggaggcgccggcggtcggccggcgcggcggcctcgacatgctgcacgacgtggagatggaggtctccgccgagctgggtcggacccggatgagtgtgcgggagctgctgtcgctcaccccgggcgccatcgtcgagctggaccgggccgccggcagcccggccgacctgctggtcaacggccggctgatcgcccgcggcgaggtggtcgtggtggacgagaacttcggcatccggatcaccgagatcgtctcgccgggcgccgagtag

SEQ ID NO: 3368 - DNA, 429 bp, Actinoplanes utahensis
gtgttccggctcctcatccaggtcgccttctccctgttcatcgtgctgttcatgatgtgggggctggcccgggcgctacggcgtccgttcggcgggcgcggccacggcccgctcaccgtgctcacccggcagcagctgggccgcagctcggcggtggcggtggtgcgggtggccgatcgggcgctcgtgctcggggtcaccgaacagcagatcagctatctgggcgaggccgagctcgacgtgttcgagcacgagaaggtggagcaccgggaccacctggtgctggagccgaccgagctgatcgacccgggcgggacggccctgccgggccggcatccggcggcgccggtggagcacggctcgatcctgtcgcccaagacgtggagctcgaccgtggagttcctgcgggagcggacgacccgaaaatga

SEQ ID NO: 3369 - DNA, 720 bp, Actinoplanes utahensis
ttgccaccgccccggctggtgccgcaggcaccgcgcacgtcgccgccgagcatcaacctgaacatcaacggcaccaacccggacggcagccgcccggcgtccagcctggtcatcgttctgggcctgacgctgctctcggtggcgcccgcgctgctgctgctctgcacgtgtttcaccaaggtcttcatggtcctcgggatcacccgcaacgcgctgggcctgaccacgctgccgcccaaccaggtgatcgccggactggccctgttcctgagccttttcatcatgggaccgaccgtctccgagatgaacaaggtcggcgtgcagccctacctcaagggcgacaagacccagtcgcaggccttcgacgacggcatcaagccgctgcgcgagttcatgtggaagaccacccgcgaggacgagctggccctgctgatcaaggtgtccggtgagaagcagccggcgaaccgggacgcggtgccgctgaccacgctggtgcccgcgttcgtgctctccgagctgcgggccgcgttcatcatcggcttcgtcatcttcatccctttcctgatcatcgacctggtcgtgtcggcctcgctgatgtcgctgggcatgatgatgctgcccccggtgaccgtcgcgctgcccttcaagctgctgctgttcgtgctggtcaacggctgggggttgatcatcacggcgctggtcgggtcgtaccggacgtga

SEQ ID NO: 3370 - DNA, 765 bp, Actinoplanes utahensis
gtgaactacgacgtgccgatcgcgcagatgctggcgatcctgctcggggcgtgccggaccggggcgtggatggtgatctgcccgccgttcaacacccggctcatccccggcccggtcaaggcgctgctctcggtcggcctggcgctgccgatggcgccgtacctgaccggcaccctgccctcgctggagacctcggcgctgctgttcagcgtgctgatgcagatcttcatcggggtcgcgctcggcttcatcaccatgctgctgttcgccgcgctgcaggcggccggtgacctgctcgacctgttcggcgggttcaccctggccaccgcgtacgacccgctcggcttcaaccagagttcgatcttcggccggttctacaacctggtcgcgatgaccctgctgttcgccggcgacgggcaccagctgatcctgcgcggcttcatgcagagtttccgcacgctgccgctgaacgtctcgttctccccggagacgttcagccggctgctgctcagcggcgtgggtgagatgttcgtgtccgccctgcagatcgccgggccgctggtctgcgtgctgttcctggccgacgtctcgctcggcctgctgaaccgggtggcgcccgcgctgaacgcgttccagctgggcttccccgtcaagatcttcctggtggtgaccctggccgggctggccatcgcggcgctcccgagcgtcctgcacaccctggtcgagcgcgcggtcacggcggtgatccggctcagcggcggctga

SEQ ID NO: 3371 - DNA, 1080 bp, Actinoplanes utahensis
atgtccggcgagaagaccgaacagccgacacagcaacggctcaaaaaggcgaaacaggaaggacagatcggccgtacgccggacctgggcgcctggctgggcatgctggccgcgagcgtgctgctgccccgcaccctgacgcaggcgatgcagcacgccgaggaggcgatcgccaagctgccggacaccatccagaacccggacccggccaagggcctggccctgctccgggaggggctgttcggcgcggcctgggcggtggccccgctggcgctgaccatgatggcggtcggcgtcgccgcggccggcgcccagggcggcatccgggtcgccaccaagctgttcatcccgaagttcaaccggctcaacccgttttccggcctgaagcggatgttcggcccgcacgcgctgtgggagctgaccaagtcgctgttcaagaccgcggtgctggccgcggtcctgtacatgacggtcaagaacatcgtcccgcagctgatgtcggccggccggctgccgctgaccgcgctgctcggcaccgtcaccaacgcggtgatctcgctgatccgggcggccgcggtggccggcatcgcgatggccggcgccgactacctggtggtgcgccggcgcacccagaagcaactgcggatgaccaaggaagaggtcaagcaggagaacaagaactccgagggtgacccgctgatcaaggcgcagatccgggcccggcagatggccatggcgcgcaaccggcagatggccgacgtgccgaccgcggacgtggtggtggtcaacccggtgcacgtcgcggtggcgctgcggtacgagccggagaagggcgcgccgcgggtggtggccaagggcaaggggccggtggccgccaagatccggcagctggccaccgacaaccgggtgccgatggtgcaggacatcgcgctggcccgggcactcaactcggggtgcgaggtgggtcaggagatcccggccgagttcttcggcgcggtggcgcgggtgctcgcgttcgtgatgagcctcaaggcacgcggctcggcggccggtctgcaccgcagccccgccatgacgtaa

SEQ ID NO: 3372 - DNA, 2043 bp, Actinoplanes utahensis
gtgaaaggccggaacctcggaaagctcgccgtgcccgtcggggtgatcggcatcatcatcatgatggtcgtcccgttgccgaccttcctgctcgacctgttcatcgccatgaacatcacgatggccctgctggtgctgctgatcagcatgttcgtcgagaagccgctcgacttcgcggtcttcccggcgctgctgctggtgatgacgctgttccggctggcgctcaacatcagcgccacccggctggtgctgcgcgacggtgacgccggcaaggtgatccatgcgttcggcagcttcgtggtcgggggcaacctggtcatcgggctggtgatcttctcgatcctggtcatcgtccaattgatcgtggtgaccaagggtgccgagcgggtcgccgaggtcggcgcccggttcaccctcgacgcgatgcccggcaagcagatggcgatcgacgccgacctgaacgccggcctgatcgacgaggacggcgccaagcggcgccgggccgaggtggccgccgaggccgagttctacggcgcgatggacggtggctccaagttcgtcaagggcgacgccatcgcggccatcatcatcacgctgatcaacctgatcggcgggttcgcggtcggcatcctgcagcacggcctggcgccggccgacgcgatgaaccagtacagcatgctcagcatcggcgacggcctggtctcccaggtgccggcgctgctgctctcggtggccaccggtctgatcgtgacccgctcggccacctccggtgacatgggccagaccgtcaccgcccagctcagccagaacaagctggcgctgcgcatcggcggtgccgcggccctcgccctctgcgtcatccccggcctgcccaaggtcccgttcctggtggtcggggtgaccgtgctggcgatcgcgcagcgggtcaaggagcagatcccggaggagaccgcgccgatcgccgaggcggtcgagatgccggccgccgactcgcccgagcagctgctcggcgagatgcggatcgacccgctggagctggccctcgccccggacctggtcgacctggtcgacgccagcagcggcgacctgctcgaccgggtgcgcgcactgcgccgcaagatggccctggaactcggggtgatcatgccgccggtgcgtacccgggacgacctggacctgccgctctcgtcgtacgcgatccggatctccggggtcgacgccggtgccggacaggcgccgcccggcacggtgctggcgatcggcgagggactgcaggcgctgcccggccgggccggcgtcgaaccggtgttcggcctggccggcaagtgggtcccggccgagatgcactatcaggccgagctgtccggcgcgacggtcgtcgatcgggcctcggtgatcatcacgcacctggccgagatcgtccgcaacaacgccagccggctgctcggccgggaggacgtgcgcgccctgaccgagatggtcaagcgcacccacccggtggtggtcgaggagctgaccccggggctgctcagcctcggccagatccagaaggtgctgcaggcgatgctcgacgagggcgtgccgatccgcgacctggtccggatcttcgaggcgctctcgctgcgcgccaagacctccgccgaccacgacggcctggtcgaggcggcccgggccgcgctgggcccggcgatcgccgcccagtacgcgagcggcggccggctcaccgtgatcacgttggacccgatgctcgagcagagcctgctcgagtccctgcggcccagcgacaccggggccttcatggcgatcgacggcatgcgtgccgaggcgatcgtcagtgaggccagccggctcgccgaagccgccgagcagcagggcctgaatccggtcctggcctgctccccacaactgcggttgccgctgatgcgactgctgcgcgccggctcccgccgggtgcaggtgctgtcgtacagcgagatctctggttccaccgcacagatcgagacgataggggtggtgaacggtgcctacgcgggtgctgcttga

SEQ ID NO: 3373 - DNA, 594 bp, Actinoplanes utahensis
gtgcctacgcgggtgctgcttgagggaccggccatcgagccgttactggctcaggtacgtgacgagtacggctcgcgcgtccggatcatctccgccgacaaggtacgaagcggtggcatcgggggcttcttcgcgaagcagcactacgagctctccgtcgaagtaccggacgcacacgaggacagtgaggacatggcgcaacagaccgtcgccgagaacggcgcaaatccgctggaacgcctgctcgagcaggccgagtcgcgggaccggaacgccttcgacggcccgccgccgggccgcccgcccacgccgaaactcggcgcaggccccgggctgggcgagcgcttcgagcggcagggtggccgggacgccgggatcggtgacaccggggccgcgttcgccgagctgatggccggcctggacatggccggtcacctcggcgagacgcagcgcggcgggcaccgggtgcggcagaccgccgacgccggggtgcgcccgttcaccccggccaccgtgaccgaaccaccggtcaacggcggcggccggctgggactgccggccgcgctgcccgggcggccggcgctagctagctag

SEQ ID NO: 3374 - DNA, 843 bp, Actinoplanes utahensis
gtgccgacgggcgcgccgatccggtccgccgccgaggtctacgggctctccggcgacgacgagccggcgccggtctccccgaccgcggccacgccgccaccgcccccggcgcccaagccggcgccgatccgggtcagcggcgacctcgacccggtgcagcgcaacctgatgaccgtcggcatgcccgaggacatggcgcggcagatcaccggcggcgacacctacgccggggtgctcagcgtgctggcctcccggccggccgcacccggcatcccggacggccccggggagatcctggtcatcgccggcgaggtgcacaccgcggtgccgatcgccaagcacctgctcgagcaggtccacgtcgaccagaatcacctgctgctggccgcgctctccacctccggcaccgggctgcactcgtcgcggctgatctccagcccggccgccgccgaatcgcgcgccgacaagctgcagacctcggaccacccgtggatcgtggtgatcgacgcgccggtgggcggcaccgacgagttctgggtcaacgagatgtgcgacgcgctcggcgcgaccgcgctgtgggccgtcgtcgacgccacccgcaaaaccgcggacaccgcccgccacctgcgcaacctcggcgaggtcgaggcgctcgtggtgcacagcgtggagctcacctcggacccggcgtcggtactcgggctggacgtgccgatcttctcgctggacggcaagccggccaccccgcacgcctgggccgcgatgctgtgcgcccggatcgccgccgaggtgatgccggccgccgcctcgccgcggcgggccacgcgagccgcccgccgatga

SEQ ID NO: 3375 - DNA, 402 bp, Actinoplanes utahensis
atgcggatcgcgccgctgcggctggacgccgacggcgtgcaccggctcaccgtgcagttgcacccggtcgacctcggaccggtccaggtggtcgccgagatccgcaacggggacatcagcgtgcagctcaccggcggcaccgaggcgggcaccgaggcactccgggccggcatcgaggatctgcggcgtgagctgcaggattccgggttcgggaactgttcgctggacctgcgtcagggcacgccgcaggaccaggcgcggcagcagttcgaggccgggggcgggttcggtcggcgcggcggtggcggcgagtcggggcggccgaacgccgatctgccggctgagccggccccgaccgcgacccgccgcgcgacaccgggccggctggacatccacgcctga

SEQ ID NO: 3376 - DNA, 498 bp, Actinoplanes utahensis
atgatcatgccgagttccgtgacgggaccggaccaccggcccgtgaccgagaccagccgccgggcgggcagccggcgcgaggacggtgcggacttcgggtcggcgctctccgccgagctgggcgacgaccaggatgaggtggccgagcagaccgccgaccgccgggacgccgccacccgcagcgccgaactacgcgacgccgccacccgcagcgccgaactacgcgacgtcgccacccgcagcgccgcgatgcgcgacgccaccgcccgcagcaccgaactacggaacgccgctcgggacgccgatctgcgcggcgccgcgattcgcggcaccggctcgcgcgatgtcacccgggccgccacggaccggaccgccacggaacgggccgcgacggaacgcgccctggcggaccggaccgcgacggaccgggccgccggcgaccgcgacgcgacgcgcgcggccaccgatcgggccacgcagcgcgccgcggctagctag

SEQ ID NO: 3377 - DNA, 990 bp, Actinoplanes utahensis
atgagcctgggtgtcaccggggtgctgggccgcatcgccgaactgcaggagcagctgggcctgaacccgccgcaggcgacggtcgacccgaccgcgtcctccggggacaagttcgcctccgccctggcccgggcgaccggcgccggccaggccccgggcgcggcgtccggcccgagcgggaacgatgtggtggcggcggcgaagaagtacctgggcacgccgtacgtcttcggcggcaccgacccgagcaagggcctggactgttccggcctggtccggcaggtctacgaggatctgggcatcaagctgccccgcaactcgtggcagcaggcgaccgcgggtcggccggtggccagcctctccgacgcgcggccgggtgacgtgctggcgttcggctcgccggtgcaccacgtcgggatctacctcggcgacaacaagatgatcgcggcgccgaagccgggcgaccacgtgaagatcgagtcggtgtacgagaagccgagcggcatccggcggatcatcgacgacgtgccggccgccgcggtgcaggacatgtcgtcgctgcgtccggccgggctgcgcggctcggtggccggcggctcgctggccggggtgccgtacgcggacctgttcctcaaggccggcgcccgctacgacgtctcccccaagctgctggccgcggtcgccaaggtggagtcgggctacaacccgaaggcggtcagcaaggtcggcgcgcagggcctgatgcagctgatgccgggcaccgcgaagggcctcggggtggacgacgccttcgacccggagcaggccgtgaacggcgccgcgaagatgctcaagggcctgctcaacgagttcaagtcggtgccgctggcactggccgcgtacaacgcgggcggcggcgcggtgcaccggtacggcggcatcccgccgttcagcgagacccaggcgtacgtgccgaaggtgcagaaggcgctggccgcgctcggcggctga

SEQ ID NO: 3378 - DNA, 471 bp, Actinoplanes utahensis
atgaaccgcacgttccgactcgttccggtgcttcgtgcacgtaaggcgcaggaggacgccgcgcggggcgagctgatccagtcgcgtgccgagatccgggaggcgcaggcgctggtgaagcgccgccaactggacctgatcggggccgatgcaccgtccgagggatcggcccgggccatggtggccgccctggtggcccggcagtcgctggccgccggcgtgttcggcgcccagcggatggtcaccgacgccgaggaggtcgagcgggagaagatggccgccctgaccgacgcggccaagcgccggcgtgcggtcgagatgctgtccgagcggcacgccgccatggtcaaggccaatgatctgcgcgtcgaccaggccaacctcgacgagttggcggtcaccgcgaaggcacgcaatgccgctcggggcgtcgagacgccgagtgccgaggagaacgggagcaacgcatga

SEQ ID NO: 3379 - DNA, 1308 bp, Actinoplanes utahensis
gtgaccgacgtcttccaccaccgcctgcgcagcgcggtcgaggcggcccggccctcggtgtccggccgggtcaccggggcggtcggcctgcgggtcacggtcagcggactcgaagcccgggtcggcgagctgctgcggatcggcaccggcccggacgcggtgctggcggaggtggcggcgctggacggacagcagctcaactgcctgccactgggcccgatcgccgggatcggcgccggcaccccggcggtcagcaccggcgggccgctgcgcatcccggtcggccccgacctgcgcgggcgcatcctggacgggctcggccgcccgatggacggcgggccaccgctgcgcggcgaactggtgggcatcgagcaggccccgccctcggcgatggaacggcagctcgtcgacaggccgatgtcgctgggcgtgcgggtcctggacacgctcgtcccgtgcggccgcggccagcggatcggcatcttcgccggctccggggtcggcaagtcgacgctgatgagcatgatcacccggggcacctcggccgaactcaacgtggtcgcgctggtcggtgagcgcggccgtgaggtccgcgagttcatcgagcacgacctcgggccggagggcctggcccgctcggtggtggtgatcgccacctcggacaccccgccgctggtccggttgcgggccggctcggtggccacccggatcgccgagtactaccgcgacgagggcgccgatgtgctgctgatgatggacagcgtgacccgcgccgcgatggcccagcgcgaggtcggcctctcggtcggcgagccgccggccacccggggctaccccccgtcggtcttcgccatgctggccagcctcctggaacgcgccgggccgggggcccggggcagtatcaccggcctgtacacggtgctggtcgagggcgacgaccacaacgagccgatcgccgacgcggcccgctcgatcctggacggccacatcgtgctggaccgcaaactggccaccgccgggcatttcccgagcatccaggcgctcgactcgatctcccgcgtcgccaacaagatcacgacgcgggagcagcgcgccgacgccaccgaactccgccggctgatggccgcccaccgcgacgtccgcgagctggtggagatcggcgcctatgtgccggggaccaacccggaggccgaccgggccaacgcggcctggccccggatcagcgcgttcctgcgccaggacatcgacgagcgcatcaccgccgacgacgcctgggccgccttgcgcgcccttctggcgacgacttag

SEQ ID NO: 3380 - DNA, 669 bp, Actinoplanes utahensis
atgagctcatcgcctgaccggtcggtgatccgcggggcggtggccgagaacgccaccgccgcccggttcgccaccaacctgcggatgcccgagccgaacgatccgaagcagttggaggaggagcggctgcaggcccggaccaccggctacgccgagggctgggcgcagggcaaacgcgacgccctggcggccgccgaggaggccgcggcccgggcccgggccgccgaggaacaccacgagcaccgccgggcggccgcgctggcgcacgcggtgaacgccctcggccgggccgtcaccgagctggagaaccagctcatgccgaccttcaccgaacttcaggacctggtgctgagcagcgcgttcgagttggccgaggcggtcatcgggcggaccctgcgcgacgatccggagcgcggccgggacgcgctgcgccgcgccatgaccgccgcgccggagcacggcgacgtgcgggtccggctgcaccccgaggactacgcccacctggtcggcgacgacccgggcaccttcgactaccagggccggcagatccacctgcacgccgaccccggcctgcggccgggcgacgcgatcgccgagaccggcaccgcgaccgtcgacgcgaccatcgaggcggccgtcgcccgggcccgggaggcgctgcggctgtga

SEQ ID NO: 3381 - DNA, 1026 bp, Actinoplanes utahensis
ttgaccacacccgcgctcaccacgctctccatgacgggcgtacgcaaagccgcgataatgctgatccagttcggcaaggaacaatccgcgcaggtgctggccaacatgaccgagaaggaggtcgaggccatctccgccgaggtggcgcgactgggcaagctcgaccccgtccaggtcgacgacgtgatggacgagttctatgcgatggcgaccacccggttcgccggtgccggtggcatggactacgcccgggagctgctggaggcgtcgctcggcaaggagcgggcggcgctgatcctggaccggctcgaagcgtcgatgaacgacatcccgttcaacttcctgagcaacgccgacccccggcaactgctctcgtacgtgcagtacgagcacccgcagacgatcgcgctggtgctcgcccacatcccggccggcctggcctcgtcgatcctggccggcctgccgctggaggtgcagaccgaggtcgcgcaccgcatcgcgatcatggaccgcacctcaccggacatcatccgccaggtggagagtgcgttgcagcgcaaactctccagcgtgctgcagcccgacgaactgtccacggtcggcggcctgcagccgctggtcgagatcatcaaccgggccgaccgcaccaccgagcggctcatcctggaggccctggacgcccgcagccccgagctggccgaggagatccgccgccggatgttcatgttcgaggacatcgtgaacctggaggaccgcgcggtgcagctgatcctgcgtcaggtggagccggccgatctggccaccgccctcaagggggtgccggagggcgtgcgcgacaaggtcaccaagaacctctccgagcgcggccgggagaacctgctggaggagatggacctgctcggcccggtcaaggtcaagatggtcgaggagtcccaggccaagatcgtcggtgtcatccgcaccctggaggactccggccagatcgagatccagcggggcggcgaggccgatgagctcatcgcctga

SEQ ID NO: 3382 - DNA, 1620 bp, Actinoplanes utahensis
atgaccgaccgccttcccgctccggtacgccgcatcacggacaccttcaagtccttcacgccgggacagaaggctgtcacgatcttcgccatcatcgcgctcgtcgtcggggggtacttcttcgcgacgtgggcggcgaaaccgtcgtacgcgatcctgttcaacaacctgtcgacgaaggatgccagcgccatcgtcgagtcgctgcagaagtcgaacaccagctacgagctggcgaacgacggccagaccatcatggtcccccgcgaccaggtgaacgctctgcggctgcagctctccggccagggcctgcccaacgacgagggcaccggctactcgctgctggaccagcagggcatcaccaccagtgacttcatgcagcacgccaactaccagcgggccctggagggcgagctggccaagacgatcaagtcgatcgacggcgtcgaggcggccaccgtgcacctggtgctgccgcagaaggacgtcttcgccgacaacgccgccaagccgaccgcctcggtactggtcgcctccaagtccaccaccccgctcagcaccgaccaggtgcaggcgatcgtgcatctggtcgcctccagcgtcgagggcctcgacccgacccaggtcaccgtcgccggcgcggacggcaagatcctctccacgggtggcggcgcggccgtcgcgaccggcggggacagcggctcggacgcgcagaccgtcgagttccagaaccggatgaacgcctcgctgcaggccatgctggaccggctggtcgggtccggccactcggtcgtcaccaccaccgccgacctggacttcgaccagaccacgacgcagagcaagacgtacagctcggatccgtccctgccgtcgctctccgagacgagcagctcggagacctacagcggcagtggcggcaacaacggtggcgtgctcggcccggacaacatccaggtgccgaacggcgccgggtccaacgggcagtacgccaacaagaacgacgcccggcagaacgcgctcaacgaggtacaggaggtgcgccgcaaggccccgggcagcatccggcggctcaacgtggcggtcctgctggacagcaccaccgccgcctccatcgacccgacccaggtgcagcagctggtcagctcggccgccgggatcgacgccacccgcggcgacagcatcgcggtcagcgccatgccgttcgacaactccgcacagcaggcggccaaggacgaactggccgcggcggccgccgcggaccggcagaacaagcagctcaccctggtcaagaccggcgcgctcgcgttcgtcgtgctgatgctgttcttcctggcctggcgggccagccggcgggccaagcggcgtcagcagctcaccgccgaggagaaggcgcacctggaggagatgcaggccgcgctggacgcccagcgccaagccgaactggaggccacccaggccatgcacgccgccgcgatgatcgagggcggggtcgccgtggaggagcgcgacgaggcccgcgaggaacggacccgcgagatcgaggagatggtcaaggagaagcccgacgagatggcgactctcctgcgaggctggatgtctgctgacgctacgcaccgctga

SEQ ID NO: 3383 - DNA, 336 bp, Actinoplanes utahensis
atgatcaaccccatcggcgccgtctccggcttcagtggcatttccggaatttcgggaatgtctggcatttcagatgacttgaatctggatgaggccgccaagacctccagccccaacaccgacttcgcccggatgctctccaagggactccagagcgtccaggcgtcccaggagaaggccaacgacctcggagtccaggtggccaacgggacgctgcaggacccggcccagtacacgatggccgcgaccgaggcctccctcgggctccagatgaccctcgccatccggaacaaggccgtcgaagccttccaagagatcatgaggatgcaggcctga

SEQ ID NO: 3384 - DNA, 393 bp, Actinoplanes utahensis
atgagcatcttcaacgccatcggggtcgcgggcaccggggtcacggtctaccgcaagtggctcgacgccgtctcggacaacatcgcgaacatgaacaacaccagccgcacctccgagaacgccttccaggcccggtacgtgcaggcccgcgcggcgcaggacggcaacggcgccgaggtggccgggatccagctgggcaaccccgagggcatcgtgacctacgagccggacaaccccctcgccgacgcgcagggcaacgtccgccggccggacatcgacatgggcagccagatggctcagatgatcatggcgcagcgctcctaccaggcgaatctgtcggtcgtcgaccgggcacgcgacgcgtacgcggccgctatcaacctcgggaagtaa

SEQ ID NO: 3385 - DNA, 348 bp, Actinoplanes utahensis
gtgttcgacgacctttccacgaacgcactgcgcgtcgcggtctccgggctctcggcccggcagaacgccatcgccgacaacatcgcgaacgtcgagaccccgggcttccgggcccgtaaggtcaagtttgaggaggccctgcagggcgcggtcgctcgcggccagtcgccgctgggcatcaccccgagcgttcaggagtcgctggagccgacccggctcaacggcaacaacgtcaacctcgacgaggagacgttggcgcacatcgacaccacgatgcgctaccagctcaccctgcgggccatcgacagcaagtacggcctgctgcgcgacgccatcaagggagcctga

SEQ ID NO: 3386 - DNA, 321 bp, Actinoplanes utahensis
atgaccgacaactggcgcagcgcctggaccgccgccctcgacgaactggagatggacgtcgcggcggtcgaggcgatgctcgccgacgagcaccggcacgccgagaccccgccggccgacatctggaagccgccgaccgacctgggcgcgctgccgctggagctcaagccgcgggcggacgagatcctcacccggcagctggccgcggcgcaggaactcgcccgccggctggtggcgaaccggcagcagcagacggtcacctcgcggatcgagaccggtgaagtgatcaaacgcccggtctacgtcgactgcgccatgtga

SEQ ID NO: 3387 - DNA, 375 bp, Actinoplanes utahensis
atgaccgccgctcacctccgcgaccgttacctccaggactcgatcaacaccgcctccccggcccggctgctggtgatgctctacgaccggctgatcctcgacctgacccagggtgaggaggcgctgcgcgagggcgaccgggacgccgcgcacgagcggatcacccacgcccaggagatcgtgctggagctgcgggtcaccctggacctggaggcctgggacggcgcgcccggcctggcgaacctgtacggcttcatcctcaccgagctgatcggcgcgaacatcgcgaagagcccggagcgggtagccggctgccgcacccttctggaaccgctgcgcgacgcgtggcgcgaggccgccgtcgcggcgaagtga

SEQ ID NO: 3388 - DNA, 1392 bp, Actinoplanes utahensis
gtgtccaccagctccgtcgacggcctcgtcagcggcatgcagacctcctcgatgatcgctcagctgatgcaggtcgaggccgcaccacagaccaagctcaagaccaaggtgcagaccgcgcagaccgcggtcgcctcataccagtcggtgaacgccaagctggccgcgaccaagtcggccgccggtgacgtcgtctcgctggcctcgtggcggtcgctcaacgcgacgtcgacctcccagacggtgaccgccaaggccaccggcggcctcgccggcatggccggcagcatcaacttcgacgtctcctccgtggcccgggcgcagaccagcacgctgaacgtcgacaccacctcgaccggcttcccgtccagcttccaggtcgagaccggcacctggtcgaccgacagcaacggcgccgacgtcttcaccggctccggctcgttcaccacggtcaacgtcggcaagccgtacgacgcggacgcggtcaccaccgcggtcaacgacgccgggctcggcatccgcgcctacacggtgaagaccggggacaccgccggcgtgatgcagttcgtgcagaacaagagcggcgccgccaacggcttccggatcaccggtctgaccggcagtgacggcaatccgccggcggacacctcggcgcgcgacgcgacgctgaccctgaaccccggcacctccaccgagtacaaggtctccagcagcaccaacacgttcagcacgctgatgcccggtgtgtcgatcaccgcgtcgaaggtcgagcagaacgtcacggtgggcgccaccaccgacgtcaacgcgatcgccggcaagttccaggcgatggtcgacgcggcgaacgcggcgctcggcgagatcaaggaccagacgaagtacgacgcgtccaccaagagctcgtcgccgctgaccggtgacttcaccgtccggcagatgacccagcagacgctgagcctggtcagcaacgggctgacctacgacaagacgacgaagaacccggacggcaccacgtcgaccgcggcggtcggcttcggctcgctcagccagttcggcatcggcctggacagcaccggccagctcaccttcgacgcggcggcgttcaccaaggcgtacaacgaggacccggccaaggtgcaggaggccggcaccgccttcgcgaagcaggtcaaggatctggccaccacccagacgaacaccgtgaccaaggtggtgcagggccggaacaacgagatcgacgcgctgaacgaccagatcgagaactgggacgtgcggctggccacccggaaggaagcgctgcagaagcagtacgccggcctcgaggcggcgctcggcaagctgaaagaccaggggacctggctctccggtcagctcgccggcctgcactga

SEQ ID NO: 3389 - DNA, 1191 bp, Actinoplanes utahensis
atgggtcttcgcatcaaccagaacatcgccgcccagaacgcgtaccggaacctgtcggtcaccgacaaccagatgcagaagtcgctggagaagctgtccagcgggttccggatcaaccgggcggcggacgacgcggccggcctctcgatctccgagggtctgcgcgcgcagaccggcggcctcaaggtggccacccgcaacgcccaggacgcgatcagcgtcgtgcagaccgctgaaggtgcgctcaacgagaccaccagcatgctgcagcgcatgcgtgacctctcggtgcaggccagcaacgcctcgctggacagcgacgcaaagcaggccgcgcaggacgagttctcgcagctcagctccgaaatcgaccgggtttccacgaccaccgcgttcggcaagtcgaagctgctcgacggctccttcggcaacaccaaccacctggtgaccaccactcccgccgtgatgccggcgggcggcacggccatgacgctgagcatcgacacggtcggcggcaccacgctgaacacgcccatcgcggcgtccttcaccaccgccgccaccggcaccgcctcgaccccgcaggacgtggccgacaacatcaacacgcagctgcagacagctctcaaggcgaacggccgcgaccccaacgagatcagcgtgaccgccaaggcggacgagaccggcaaggtcaccttcgaggtcaacagctcgtcgaccttcaacgtcacggcgtcgaacctggtcacggccggggcgagccagaccaacgccagcgcggcctccggtgacttccagatcggcgccaactccggcgagaagctgggcgtccacatcaacgaggtcagctcgaagagcctgggcctcaacaacctcaacctgaccacggcggccgtcggcacgacgccgtccggcgcctcgcaggcgatcgacgccgtggacaaggcgatcaagtcggtctccgccacccgggcccagctcggtgcgcaccagaaccggttcgagcacaccatcaacaacctcaacgtggcggtcgagaacctgtccgcgtcggagtcccggatccgcgacaccgacatggcgcaggagatggtgtccttcacccgcaaccagatcctgacccaggccggcacctcgatgctgtcccaggccaaccagtccgcgcagaacgtgctgtcgctcctgcgctga

SEQ ID NO: 3390 - DNA, 594 bp, Actinoplanes utahensis
atgccgattgggggaaaccactcagcggtacggcgaacatgccgacctgtccgaatgagcgggttgccgaaagggtgcagcccgacccgcgaaccgacggaggaccgggtgagcctgaccgacctggccagcgtcctgtggcgctctcgcgagctgctggagatgctgcttttcaagctggaggaggagcagttgcttctcgcggccaaccgatcccgctggctcagccacgccacccgtgaggtcgaggtggtcctcgaccagatccggcagaccgaggtcatccgggccgcctacgcccaggacgtcgcggccgagctgggtctgcccgtggaagcgtccctcggcgagctcgccgacgccgcgccggatccctggtcggacctgctgcatcagcaccgtaaggcgttcctgctcctgacgtcggagatccgggccctggccgacgtcaaccgggacctgctcaccgcgggacaacgcgcggctcgcgaaaccatgctcgtgttcgccgagactgtggaaacgtacgggccgcagggccagaccgtcaccggcggcgtgcgccgccccaccctcgttgatgaggcgatctga

SEQ ID NO: 3391 - DNA, 1461 bp, Actinoplanes utahensis
atgggcagcactttcagtggactcaacacggctctgacctccttgtacgcgcagcggcgcggcctggacgtcaccggccagaacatcgcgaacgcgaataccgagggctacacccggcagcgggtgaacctgcagtcgcagaacggcaacgtggttcccggcgtgtacgccaccaccagtgcggtcggcggcggggtcaccgtctcctcggtggaccggctccgcaacgccgcgctcgaccagcgcagctacagcgagcactcggcctcggcgtaccacaacgcccgggccgggcagttcaacctggtcgaggacgtgttcgccgagccgagcgacacggcgctgcagggccggctcgcggacatgtgggagggctggaacgcggtcgccgccaaccccagcgacctgtccgccaagtcggccatgctggagcagtccagcacggtcgccgccaccctgaacgacgcggcctccgcactgaacaaccagtaccaggcggcccgcaccgggctgaacacctacgtcgacgacgtcaacaaggcggccgactcggtggcgaagctgaacaaccagatcgtcatcgccacccaggccggcctgtccgcgaacgagctgcaggaccagcggggccagcagatcctcaagttgtccgaactgatcggggcgagcgccaccgagcagccgaacggcgcgatcaacgtcttcgtcggcagcgcgccgctggtcagcggcttcaacacccggcagatcgagatcgagccgggcagtgccacccggatcgaggacctggccaccagcgaggtcaacctgcgctggtcggacaccaaggcggcggtcggggccggcgggacgatgggcgcctcgatggaacttctcgccaagggcggcacgctggacgcgatgaccaagcggctggacacggtcgccgacaagctggccaccacggtcaacgcgatctacaagaaggggtacgcggtcgacggcacccagggggagtcgttcttcgtccgcaacgacaccggcgccgacaccggggtgaccgccgcgcagatcaaggtggcgatcaccaacccggcgaaggtggcgatctcgtcgggcgacccgaccggcgcgcccaccgcggccagtcccggcggcacccccaaggtgctcgacggcaaccaggcggacgcgatcgccgagctggccgactcgcggaccggcgcggacgccgagtacaagtcgatgatcggcgagctgggcgtctcggcccagtcggcgatccgccggcgtgacgtgcagaacgcggtgaccgatcaggtcgacgccgcccgggactcggaggccggggtcaacctcgacgaggagatgacccacatgctcacctaccagcgcgggtacgaggcggccagccgcgtgctcaccaccatcgactcgatgctcgaccaattgatcaaccgcaccggcatggtgggtaggtaa

SEQ ID NO: 3392 - DNA, 933 bp, Actinoplanes utahensis
atgaccagcccaagggtcaccgagagcagcgtgcgcacccgcgtgatggccagcctgcagcgcaacctgagccgcagccaggaggcgaccgaccggatctccagcggcaagcagctgacccgcccgtcggactcgccgaccggcacggtcaccgcgctgcaactgcgtggcgaggtgcgggccaacaagcggtactccagcaacgccgacgacgcggtcggccggctcggggtggtgcaggacaacctgcagcagacccaggagctgatcaccgtggcccgcaacctgacgctggaggcgaccagcgcgggcggcggcggcaccccggaggcgaacaaggcccgggccgcccagctggagcagatcaagggcaacctgatccagttcgccaactcgaagtacctcgaccggccggtgttcggcgggagcacgccggaccacgaggcctacgacagcaccggcaactacatcggtgaggggtccggcgagaccctgcgcgcgatcggcccgaacgccaaggtccgggtcgacgtgcggggcccggaggtgtacggcgccgacaagatcaccgatgccaacggcaatcaggtggacaacccggagcagttgttccacgttctcgactcggtgatcggggcgatgcggagcggcgattccaaggctctggacgacggtctgaagaatctcgataaatccgctgatctcctggaatccactctttcggacgtaggtgcccgatacaatcgggttacgcagatgaagcagtccgctgaggatcgtttgtcgtccgtgtcgtcgcagttgtccgatatcgaggatgtcgacctgcccaaggcgatcatggaaatgcagctccagcagacctcgtatcaggccgccctggccgccacggccaaggtgatccagccctcgctcatcgaattcctgaggtga

SEQ ID NO: 3393 - DNA, 438 bp, Actinoplanes utahensis
atgactactcgcaccatgtcccgaccgatcgaggccaccatgaccgatccgtcgctgggcctgccgaccatctccatggcgatccccatgccgggatttccgggacaccgggagttcgttctggtgcgcctgaacgacgacggcctgctctacgcgctcacgtcggtcgacgatcccgagcttcgtttcctggtggcgcctccggagccgttcttcccggagtacgccccggagatcgacgagtcggtgttcgcggcgctgaacaccaaggacccggaccgggtgctgctgctgaccgtgatcaccgcgagcaaggaggagaccaccgccaacctcctcgcccctatcgtggtggaccgcgacagcatgcgggccatgcagacgatcctcaccggctccggctacccggtccgggcgatcatgaaccgggcgttctga

SEQ ID NO: 3394 - DNA, 240 bp, Actinoplanes utahensis
atgcttgtgctgaccaggcgggccggggagagcgtgatgatcggcgacgacgtcgtgatcaccgtgctggaggcccggggtgacgtcatccggctcggtatccaggccccgcgggacgtccaggtgcaccgcgaggaggtgtaccgggagttgcaggaagcgaaccgcgccgccgcgtcgccgaccgacgaggcggtggacgccatctcccggatggtgcgggagaagccggccggctga

SEQ ID NO: 3395 - DNA, 750 bp, Actinoplanes utahensis
gtgggcgcagagcgggaatcagtcatcggcggcagtgcggtcggcaccgtgtgcgcgctggatctgacggtggatgcccacgtgcacaccgggttcgcggccgggcgcgacgccgtcggcgtggtggtctcggccgccgaccgggccgggctgaccgcgctcaccttcgccgaccaggccgggccggacaccacctggctgaccgcgtacgcggatgcggtgcgtcgggcccggcaccgtaccgagatgaccctgcgggtggccgccgaggtcgaggtggtccgtccggacggctggctggcgctgccggccgacctggcccagctggacgccctgtcggtggcggtctccgccctgccgctcggcgacgagctgctcgacgcgcgggcggtccgggcccggttggccggcggcacgctgaccgccgagcgggtcgccgggcagctgatcacggcgatcgtgcagggcctggcccgcgcctcccgctacgtgccgacccagctggcccgcccgctggcgctgctcgcccaggccgggatcgacgacgccgcggtctccgccgagatgctcgccgaactggccgccgcctgccgggccaccggcaccgtggtggaggtcagcgaggcgtggcgcagcccttcgccgcgcctgctcgccctgctgcgtgacgccggcgtgaccctggtgccggcgagtgacgcccggtacgccgccgaggtcggcggctggcagtacctgcgccgcatctga

SEQ ID NO: 3396 - DNA, 729 bp, Actinoplanes utahensis
atgagtatggttcagcaggccatcgaggtgagtgcaccgctgcacacggtgtacgagcaactcgccgcgttcgagaactatccgcggttcatgaccggagttcgccaggtcaccacgaccggcggcgaccagacccactggatcatggaggtggacgggaagcgccgcgagttcgacgcccagatcatcgagcggtcaccggacgagcgggtctcctggtcgaccatggaggggccgctgctggccgagacgctcacgctgcgcccgatgggcgagacgaagacccagatcgtcgcccagctcgaggcggacatcgcgttcctgatgcccagcgaccggcacggccaggagtcgctgaaccgtcggctcaaggccgacctgaccaccttcaagggactggtcgagagcggcgtgctgggcggccgtccgatgccgaccggagccagcgtcaagcgcctgcccggcccctcgcacacgctgttcagcccggcccgcgactacgcctcgccggcctcggtcgccacccgggtgcacaagcatccgccggctgccgcaccgcacccgggcgccggctgggacaacggcgcggccggcgtcgagttgcaggacgagcccggcggccgggccaccggcagcgcggccggcaccgccccgatgggtggccgcaccgcgcgggccgacatgtggggcaacggcatgatcaacgaagaggatcgcggcatcggctga

SEQ ID NO: 3397 - DNA, 1356 bp, Actinoplanes utahensis
atggggggatatgtgcgtatcgcggtgcgcggcgtgggcagaaaccggctgatcgccgggagcgccggggtcacggtcaccgtcctcgggttgctgcacacgcacgcgaccgatctcacgccgccggaggggctcaggctccctccggcggctgcgctgtttccggccggtctcgccctgctgatctacgcggcgccgcggggcggtcgggtgcggaccggggcggtcgcgctctgcgtactggccgcggtcgccctcgcgtcggcgtcgacgctggtcgtcgtcgccaccgcggcgctgctggtcgcggccgccgcgatccggcccggtgacccgggtcgtcccggcgacgcccgcccggaatacgccgagacgctgtggcagtcgatggacgaggccgtcatggtgctcgacgtcaactaccgggtgatcgacgtcaaccggcgctggcgggaactgaccgggtacgactccgcggcggaggccccgcccccaccgctgcccggcgccggcggcgactggctgctgtcgcgcgccgacggcaccgaggtaccggtgctggccacggtcgccgcgatcccggacgaggcgggtgccccgcgcggatacgtcgccacctacgtcgacatcgcggagcggaaacgggccgaggacgcgctcagcgaccacgccgccgagctcgaacgcggcaacgcgcagctggccgccgcgctggccttcaaaaacgacctgacctcgatgctgacccacgacgtggcgcagccgatcagctcgatcgccagcctggccgagctgctctgcgccgactgggccgacctgccggaggacatccggctggagctggccaccaagatcgacaagaacacccgccgcctgatcaagatgatgaacgacctgcagctgctgttccgcctggacaccggtacggtcaccgcccgccgggtgccggtcccgctgctcgaggtggtccgcgcggcctgcgccgagacggccggcgccggccaggtcgaggtcaccatcgacgaggacctgtccgcactggccgaccgcgggcacctgacgatcgtggtggagaacctgctgcggaacgcgatcgcgcacggggccgcaccggtccaggtgcgggccggccgggacggcccggagaccgtgcggctggaggtgcgcgacagcggccccggcatccccgacgacctgctgccggacctgttcggccgcttcatccggggcgccgggctgggcctgttcatcgcccggcacctggtggaggcgaacggcgggtcgatgcggtacgagcatgccgatcctcgcggcgcccgcctgctggtcatcctggagaccgcgccccggggatga

SEQ ID NO: 3398 - DNA, 213 bp, Actinoplanes utahensis
atgaccaccctgctgtcgcccgagatcgacaccgtcggcgagctcaccgagcgctgcgatcgctgtggcgcggccgccaagctggaggtgaccctgagcagcggcggcgacctggccttctgtggccaccacgcgaaccggatgcacgccgagatcgcgcgtgtggccagcaagatccgcctggaggaagggtttgcctgggcgggtaagtag

SEQ ID NO: 3399 - DNA, 1230 bp, Actinoplanes utahensis
atgctcggttccgacgcccgtcgcctggccgtccgtttcgcggccgtcgcgagcgccgccaccgcttctctttacggtttcaccggcgcggcctcggccgcaccggcaccggtcgctccggcgaccgggaccgtcctggaggccggggtggccggcgccatcccggacagctacatcgtcgtcctcaaggccggcgcttccgcctccccggacctcgtcgccggttacggcggtcaggtcctgaacaagtaccaggccacggtacgcggtttccacgcccggatgtccgctgagcaggcggcccgcctcgccgccgacccggccgtgcagtacgtcgagcaggacgccgtgatcggcgcgtcctcggtccagagcaacgccacctggggcctggaccggatcgaccagcgcgaccgcacgctggaccgcaagtacacctacggctcggcgaaggacgtcaccgcgtacgtcatcgacaccggcatccgtacctcgcacaaggacttcggcggccgggccagcagcggctgggacttcgtcgacggcgacaagaccgccgacgactgcaacggacacggcacccacgtggccggcaccatcggcggcgccacctacggcgtggccaaggacatcaagctggtcggcgtcaaggtcctcgactgcgacggctccggttcgtactccgacttcatcgccggcatcgactgggtgaccgcgcacgccaagctgcccgccgtggccaacatgagcatcggcggcccgcagagcaaggcgctcgacgacgcggtcgaccgctcgatcgccaagggcgtcgtctacgccatcgcggccggcaacgacaacaagaacgcctgccggttctcgccgtcggacacctcgaacgcgatcaccgtcggggcgatcgacaacgccgacaagcgcgcctcgttctccaactacggttcgtgcgtcgacatcttcgcgcccggcgtcaacatcaagtcggcgtcgagcgactcgaactccggcaccgagatcatgagcggcacctcgatggccagcccgcacgtggccggcgcggccgcgctggtgctcggcgcccacccgacctggaccccgcagcaggtccgcgacgacctggtcgcgcacgccgacgctggcctgatccgcaacccgggcaccggctcgccgaacaggtcgctctacaccggctacctctacgagaccggctccgccgccaagaagcactga

SEQ ID NO: 3400 - DNA, 423 bp, Actinoplanes utahensis
atgtccgaggcgccggtcgccgatacgccgaccgtcctggtcgtcgacgacgaagaagatctgcgcgacatcatgcgccgcatgctggagcgcaaaggctacgcggcgctgaccgcgggcgacccggacgaggcgatctcggtctgccgcgaccacccgggcgtgatcgacgtgctggtcaccgacctcaccctgcccggcggcaagtccggcggggagctggccggcacggtcatcaagatgcgcccgggcaccggtgtcgtgttcatctccggcctgcccaaggacatcgcggtcaccaagggcctggtcggcgacgacgccctcctggtgaagaaacccttcaccgccgacgctctgctggaggccctgaaacgggtcctccgcgacgaggcggagcgggacgacccgccaccgaactga

SEQ ID NO: 3401 - DNA, 753 bp, Actinoplanes utahensis
gtgaaaccggtcggcgcgatcacccgggggacgaccaacccgaaccggctgcgccgggtggacaactacctggcgttccgatgcgcggccgcgctgtccgaggcggccgcgccgctggtcgtcgacctcggttacggcgcgtccccggtcaccgcggtcgagcttcggggccggttggcggccgcggtccgcccggacgtcacggtggtcggcctggagatcgacccggtacgcgtggccgacgcccagccgttcgccgagcccccgttcctgcagttccgccggggcgggttcgagctggccgggctgtccccggtggtcgtccgcgcgttcaacgtgctgcgccagtacgccgaggacgaggtgaccgcggcctggcggcagatgaccggaacgggcgcgacgctgatcgagggcacctgtgacgagctgggccggatcgccacctgggcggtggtcgagggtggtgtcgcgtcgacgctgacgctgtccgcccggctgccggtgctggagcatccggcggtcttcgccgaacggttgccgaaggcgctgatccaccacaacgtgcccgggcatccggtgcacgaactgctgcgggcgctcgggcgggcgtgggagaccgaggccaccccgttcggcccgcggcagcgctggctggccaccgtccgccggatgcgcgccgacggctggcccgtgctggacgggccggcccgctggcgccggggtgagctgagtatgccctggccgggctga

SEQ ID NO: 3402 - DNA, 756 bp, Actinoplanes utahensis
atgcagagaatcgcagtggtcaccggggcttccagcgggatcggcgcggccacggcccgccgcctggccggtgagggttttcacgtggtcgccgcggcccgccgggcggatcgactggagtcgctggtcaaggagatcggcgcgggcgcgaccgcggtggcgtgcgacgtgacctcggacgagtcggtggccgggctggccgccgcggtgcaggcgctcggcgcgccgctggccctgctggtcaacaacgcgggcggggcgatcgggctggacccggtggcgtccggcgcggtcgaggactggcaggcgatgttcgacgtgaacgtgctgggcacgctgcgggtgaccaaggcgctgctgccggcgctggaggcgagcggggcggggacgatcgtgacggtcggctccacggcggcgttcacgccgtacgagggcggtggtggttacgtggcggccaagcacgcccagaccgcgctggtcgggaccctgcgcctggagatcgtcggccggccggtgcgggtggtggagatcgacccgggcatggtgcgcaccgacgagttctcgctgaaccgcttcggcggtgaccgggcgcgggccgacgcgatctacgccggggtggccgagccgctggtggccgaggacatcgcggacgtgatcgcgttcgccgccacccggccgcagcacgtcaacatcgaccggctggtggtccgcccgatcgcccaggccgcccagcacaaggtgcaccgggagctctag

SEQ ID NO: 3403 - DNA, 1290 bp, Actinoplanes utahensis
gtggccgaggtcagctggcccaccccacggcggatcgccaccgtctcggtgcatacgtcgccgctggagcagcccggtaccggggacgccggcgggatgaacgtctacatcgtcgaggtgtccaagcggctggccgcggccggtgtccaggtggagatcttcacccgggccacgtcgagcgacctgccgccggtggtcgagatgctgcccggggtgcacgtccggcacgtcaccgccgggccgtacgaggggctgaacaaggaggagctctcctcccagctctgcgccttcaccaccggcgtgctgcgggccgaggcggcccacccgccgggccactacgacctgatccactcgcactactggctctccggccaggtcggctggctggcccgggaacgctggggcgtgccgcacgtgcacaccgcacacaccctggccaaggtcaagaacatgctgatcgcggccggcgaccgcccggagccgaaagcccgggtgatcggcgaggagcaggtggtcgccgagtccgaccggctggtcgccaacacccggttcgaggcgcacgacctgatcacccactatcaggccgacccggcccgggtcggtgtcgtgcagcctggcgtggacctggaccggttccgtcccggcgccgccgaccgcgcccggttcgggttgccggagtccggccggatcgtcgccttcgtcggccggatccagccgctcaaggccccggacgtgctggtctccgcgctcgccgagatgcgggcccgtggcgccggcgaggtcaccctggtgatctgcggtggtcccagcggcagcggcctggatcgcccgtccgcgctgatcgagctggccgcctcactcggggtcagcgactcggtggtgttcctgcccccgcagaccggcgccgacctggccgccctctaccgcgccgccgacctggtcgcggtgccgtcctacaacgagtcgttcggcctggtcgcgctggaggcgcaggcctgcggcaccccggtggtcgcggcggcggtcggcggcctggtcaccgcggtccgcgacggggagagcggcgtgctgatcgacggccacgacccggccgactgggcccgggtcctcgaccggctgctggccgcgccggcgtaccggcgccgcctctcggccggtgcggtggcacacgccgcgcacttctcctgggaccgcacggtcgaggcgctgctgcgggtctaccgtgacgcgatgagtgaacaccgggccctgatcacggcccgggtggagggggcgacctgcgcatggtga

SEQ ID NO: 3404 - DNA, 486 bp, Actinoplanes utahensis
atggtgaaaaagttgatcgagcgggtgttgaccgaccgcgagctggaatgggagtcgaccggcgagtcgtcctatgtggtcaccttgcccggcacgcacaagctgaagaccgcctgcaacctgatcgtcggcgagcacgcgctgcggatcgaggcgttcgtgatgcgccagccggacgagcggcgcgaggatctgtgggcctggctgctgcgccgcaacgcccggatgtacggcgtcgccttctccatcgacgcggccggcgacatctacctgaccggccgggtgtcgctgaccggtctggacgaggacgagctggaccggctgctgggcgcggtgctcacctatgccgacgaatccttcgacacgatgctggaaatcggtttcggctcgtcgatccgccgcgaatgggagtggcgggtcaaacgcggcgagtccctggccaacctgcaggccttccagcacttcgcggctcccaccgagtcctga

SEQ ID NO: 3405 - DNA, 1266 bp, Actinoplanes utahensis
atgcgggggtggctgcgagccgcggtcggcgggctacccacggcgtactggtacctgtggaccggactgctgatcaatcgggtcggcggcttcgcggtgctctacctctcgctgtacctcaccgcggcccgcggcgccggggccgcactcgccggcctggtcgtcggtgcccacggcatcggcggcgtgctcggcaccctggccggcggcgtgctcaccgaccggtggggacgccgggccaccctgctctggtcgcacctggcctgctcggccgtgctggtcgccctggccgtcagcacgccgctgccgctgatcgccgggctctgcctgctgctcgggctgacccaggcgatgcccggcccggccttcgtcgccgcgatcaccgacacggtcccgggcgagcaccggctgcgggcgttcaacctgcagttctgggcgttcaacctgggcacggccggggcctcgctgctggccgggttgctcgcccggtggagctaccccgggctcttcctgctcgacgcggccagcacgctgatcaccgcggtgatcatcgcccggaaggtgccggagacgctgggccgggccggccgcggcggcgcccccggcgggctgcgcaccgtgctcgccgaccggatctttctcgccttcgtcggactgaccgtcctgcaggccctgctgagcagccaggcgaacacgatcgtcccgctggccatgcacgccgacgggctcggccccggcgactacggcctggtgaccgcgctcggcggggcgttgatcgtgctcgggcagctgttcgtgcccgggctcatcgacgggcgccgcaaggcccgggtgctggccctggcgatgctggtgaccgcggccggcttcgggacgctgacggtcgccgacagcctgccggcctatctgggcgcggccgccgtctggaccgtcggcgggatgctcgccgcaccacccaatgcggcgatcaactcggagctggcgccgccgctgctccgcgggcggtaccaggccgtgttctacctgagcttcccgttcgcctcgttcgtggcgccggcgctcggtggggccggcctggaacatctcgggccggggctctggccgatcgtggccggggtggggatcgtggccgcggccctgcatctggccgccggtccggcgcgggaacggcgcacggcccggacggcggccgcacccgggccggcgcaccgacgaccgacggccgccaaccgcgtcgatccgcaagcgaccgacggccgccactga

SEQ ID NO: 3406 - DNA, 1236 bp, Actinoplanes utahensis
gtgcgaggttggttgcgggaggccgcgggcggactgccgcggcagttctggttcctctggaccgggaccctgatcaaccggatcggctcgttcgtggtgccgtttctgagcatctacctgaccagcgagcggcacttcacgcagagccaggccggcctggtgatcggcctctacggcgtcggcggggcggtcggcacgatgaccggcggcatgctgaccgaccgttggggccggcgaccgaccatgctcaccgcccagttcggcgcggcggcactgatgctgaccctcggcctcacccacccgtacccgggcatcctgatcgtcaccaccctgctcggcgccttcgccgagggggtccggccggccttcggcgcgatgatggtcgacatcgtgcccgagcgtgaccgggtccgggcgttctcgctgaactactgggcggtcaacctgggtttcgcactcgccgcgatcgtcgccggcctggccgccgaggcgaacttcaccgtgctgttcgtcgccgacgcggccagcacggtgctcaccgggttgatcaccgtgctgctgctgcgcgagacccggcccgcccaccgcccggccgcctccggcgtggccccggccgccggcctggcgaccgcgctgcgcgaccgcacgttcctcgccttcatgctggtcaacctgctgaccgtgctggtcatgctgcagcacctgtcgaccctgccgatcaccatgctgactgacgggctgtccgccgcgacgtacggctgggtgatcgcggtcaacggcttcctgatcgtcgccgggcagttgttcgtgccgcggctgatcgccggccgccgcccgcaccgcgtcctcgcggtcgccgcactgatcatggggaccggcttcgggctggtcacgttcgcccacgccgcctggatgtacgcggtcaccgtggtgatctggacgctcggcgagatgctgcagtcgccgagcaacgcggccaccgtcgccgccctgtccccggccccgctgcgcggccgctaccagggactcaactcactgtcctggtcggccggcgggaccctcgcgccgatcctgggcgggctggtgctgcaggaccggggcacgaccgcgctgtggaccggctgtttcggcctgtgcgcggtggccgccgcgggacacctggccaccggtccggcccgggtccggcgggccgccctgctcactcgcgagacggacaccccctccggcgttcggtaa

SEQ ID NO: 3407 - DNA, 747 bp, Actinoplanes utahensis
atgactggaaccctggtgctgttgcggcacggcaacagcgagtggaacgccaagaacctcttcaccggctgggtcgacgtggacctggacgccaagggcgaggatgaggcccggcgcggcggagagctgctcaaggaacagaatgtgctgcccgacgtcgtgcacaccagcctgctgcggcgtgccatccgcaccagcgagatcgccctgcacatcaccgaccggcactggatcccggtgaagcggtcgtggcggctcaacgagcggcactacggcgctctgcagggcaaggacaagaagcagaccctggacacctacggcgaggagcagttcatgctctggcgccggtcgtacgacgtgcccccgccgccgatcgaggacgactcggagttctcccaggcgaacgacgcccgttacgccgacctcccgccggagatcaagccgaaggcggagtgcctgaaggacgtgctcgaccgcgccctgccgtactggtacgacgcgatcgtcccggacctgcgggccggtaagacggtgctggtcgccgcgcacggcaactcgctgcgcgcgatcgtcaagcacctggacgcgatctccgacgaggcgatcgcgaagctgaacatcccgaccggcatcccgctgcgctacgacctggacgagaacctgcgcccgatcacggccggcgggacgtacctggacccgcaggcggccaaggaggccgcggccgcggtcgccaaccaggggcgctga

SEQ ID NO: 3408 - DNA, 654 bp, Actinoplanes utahensis
atgcgcgaggagttccaggccgaactcaccgaggtgaaccggcttttggtgaccatggcagagtcggtgcgcgaggcgcttcgcaaggcgacgaccgcgctgctcaccgccgacctgcaggcggccgaggccgtcatcaagcgggacgccgacgtggacgcgatcttccagcaggtcgaggcgaaggtggcggacatcatcgtccgccaggcgccggtcgcgatcgacctgcgccgggcgatcaccgccctgcacatctccgccgacctggagcggatgggcgacctggccgagcacgtggccaagaccgccgcccggcggcacccgtcgccggccgtgccggccgagctgcgcccggtcttcaagggcatggccgagatcgccgaccagatggccgagaagatcaccaccgtgctgacgcacagcgacgccggcctcgcggccgagctggagaaggacgacgacgcgatcgacgacctggagcggcagcttttcaagatcatgctggccgacgactggccgtacggggcggagaccgcgatcgacggcgcgctgctcggccggttctacgagcggtacgccgaccacgcggtgaacatcagcgagcacaccatctacctggtcaccggggagccggtcgcgggtcagggctga

SEQ ID NO: 3409 - DNA, 1266 bp, Actinoplanes utahensis
gtggattggggatacgccgtcggctcggtctcagccgcgctggccgtcggtgtcggtgctgggctggccctcgcccgtgtccggcaaccgtcgccggtcgacgtggcccgggacggctcaccggaggggagagccgccatcgaaccggacgacgatcgcccggcgggtaagcacggcctgaaagggctgggccgcaagagtctcgactcgctccgggtgggagtcgtggtgctcgacgcggacgactatccggtgctggtcaacccggccgcccgggcgatgggcctgctgcgctccggcggggcgccgggcaccatcgcggcccatccgatcctgcgcactctggccggccaggtgcgccggacgggcgtacgccgggaagtcgaacttgatcttccgcggggccgggccggtggggcgcaggccccgctcgggctgcacctgcgggccgtggcgctgaacgcgtcgcacgtcgcggtcgaggcggccgacgtgaccgagtcgcaccggctggcccgggttcggcgggatttcgtggcgaacgtcagccacgagctgaagacgccgatcggcgcgctgcagctgctggccgaggccctgctggacgccacccagctgcccgagaccgcacccggggcgcagtccgaggacctgcaggccgcgcgccggttcgccgagcggatccaccacgagtcggcccggatgggccggctggtgagcgagctgctggagctgagccggctgcagggcgccgagccgctgcccacccccgaaccggtgtcgctggactgggtgatcgccgaggtgctggaccgcacccggaccacctcctcggcgaagagcatcgaggtcaccagctccgggccgaagggcctgatggcgtacggcagcgacagccagttcgccaccgcggtgaccaacctggtggagaacgccatcgcctactccggcccggacaccagggtcgaggtgaccgtccggcaggagtcggagtggatcgagatcgacgtccgcgaccagggcatcggcatctccccccaggacgtggaccggatcttcgaaaggttctaccgagccgatcaggcccggtcccgggcgaccggcgggaccggcctcggcctcgccatcgtcaagcacatcgccaccaaccacggtggccgtgtggacgtgaccagcgccctcggcgagggctcgacgttcaccctgcgcctaccggcgcgcccgcccgaatccccctcgctgtcaccgacggcaactgagatctag

SEQ ID NO: 3410 - DNA, 720 bp, Actinoplanes utahensis
gtgtcgacccggtcaccgacgacggaaggaactgcattggcccgcgtgctcgtggtcgaggacgaggagtcgttctccgacgccctgtcgtacatgctgcgcaaggagggcttcgaggtgtcggtcgccgcgaccggaacctctgctctcacgcagttcgaccggaccggtgccgacatcgtcctgctcgacctcatgctgcccgagatgtccggcaccgaggtgtgccggcagctgcggcagcggtcagccgtcccgatcatcatggtcaccgcccgggacagcgagatcgacaaggtggtcggcctggagatcggcgccgacgactacgtcaccaagccgtactcgccgcgtgaactggtcgcccggatccgcgccgtgctgcgccggcagagcggtgaggccatcgaggtgagcactccgacgctggccgccggcccggtccggatggatgtcgagcggcacgtcgtcaccgtcgacggctccggcgtgcagctgccgctgaaggagttcgagctgctcgaactgctgctgcgcaacgccggccgggtgctgacccgggggcagctgatcgaccgggtctggggcgccgactacgtcggtgacaccaagaccctggacgtccacgtcaagcgcctgcgctccaaggtcgagccggagcccggcgccccgcgctacatcgtcacggtccgcggcctgggctacaagttcgagccgtaa

SEQ ID NO: 3411 - DNA, 828 bp, Actinoplanes utahensis
atgagccgcgcacgacgccccgtggaagtgaaactcgacttccctcgggaatggatcgagttcctcgaccccgccgaccagcagcacctgatccgcgccgacctgacctggctgctgtcccgctggacctgcgtcttcggctccgcctgccacggcattctgcccggtcgcgccgaggatggctgctgctcgcacggtgcgttcttcaccgacgccgacgacgagaaccgggtgaaggcggcggccgcgaaactcaccccgcagacctggcagcaccaccggcgcgggttcaagaactggaccgagatggacaccgtggacggcaccaagccggcccggcgcaccgccacccgatccggtgacgggccgtgcgtgttcctcaacgacgcggacttcgccggcgggggcggctgcgcgctgcacgcccaggcgctgcgggacggcgagcacccgctgaagtacaaaccggacgtctgttggcagctgccggtccgccgcgagcaggactggatcacccgaccggatggcacgaaactgctgcagtcgacgctgaccgaattcgaccggcgcggctgggggccgggcgggcacgatctggcctggtggtgcacgtcgtcaccggaggcgcacgtcggcaccgagccgatgtacgtgtcctacggcccggagctcaccgagctgatcggcgagccggcctaccggagactcgccgagctctgcgccgcccgcctggccaccggcctgctcgccgtccacccggcgaccaccgcggccggggggccgaagcgcaaaggcgggcgcgaacccgcctccccccggtccgcatag

SEQ ID NO: 3412 - DNA, 819 bp, Actinoplanes utahensis
gtgacttcccgagttcccgtgctcctctccagctcctcggtcttccccgagccgacggcggccgcgttcgagatggcggccacggtgggctacgacgggctcgaggtcatggtgtggaccgacgccgtcagtcaggacgccggtgcactcaagggcctctccgaccactacggtgtgccggtcctctcggtgcacgccccgtgtctgctggtcacccagcgggtgtggagccccgacccgtgggagcggctcacccgggccgcgcagctcgccgagtcgctgggcgcccccacggtcgtggtgcacccgccgttcacctggcagcgtgactacgcgaagaatttcgcggccggcctggccagggtctgcgaccggcacccggatctgaccttcgcggtggagaacatgttcccggtcaagatggccggccgctggttcgtgccgtacacgccgggctgggatccgaccgagaccggcttcgacgcgtacacgctggatctctcgcactgcgccgcctcgcggatcgactcgctggacatggcggcgaagatgggcagtgctctccggcacgtgcatctgggcgacggcaccggtgcggggcgggacgagcatctggtgccgggccgcggcaaccaaccctgcgctgagctgctgcgatcgctggcgggtcgcggtttcaccggctcggtggcctgcgagatcaacacccgcaaggccgcgagccgaaccgtccgcgaggcggatctccgcgagtcgctggaattcgcccgacgtcatctcgcgccggcggattcgtcccggccggcgctccaagcctga

SEQ ID NO: 3413 - DNA, 183 bp, Actinoplanes utahensis
atgactgatcgccgctcccgccgcttccgggcacggcgattccggccgctgcgcgtccaggacgaatcgccgcaccctacgacccgcgggtggtcaccgcaggcgcactgcccgcgggtgccgccggagcctcggccgcgggatcaggccggtgtcagcgtcgcggtgctctccggtgtctga

SEQ ID NO: 3414 - DNA, 558 bp, Actinoplanes utahensis
gtgaacttcgatgcgtacgcccggacggcggtcgacctcgtcaacgccggcctggacgatctcgccgggctgcgggccctgttcgccggcgacctggaatacatgcgcgatcaggtcgtggagaaggacctggcggtcttccgccgggcccagcgccggctgcgcgaggtcttcgagtacggcacggccgagcgcgacgcggacgcggtgcgcgagctgaacacgctgctcgaggcatacccggtgcagccgcggatctccgggcacgacgccggggactggcacatgcacgtgaccagccgcgggtcgtcggtgagcgcggaatacctggccggcgccgtctgggggctcgcggtctggctgtgtgaatacggcagtgcccggttcggcatctgcgccgacgaacgctgcggcaacgtctacctcgacacgtcctcgaacaactgtcgacgcttctgctccgagcgctgcgccacccgctcccacgtggccgcccaccgcgcccgcaagcgagctgctcagacaccggagagcaccgcgacgctgacaccggcctga

SEQ ID NO: 3415 - DNA, 912 bp, Actinoplanes utahensis
atgttccgttccctgtttctcgccgcggccggctccgcccggctggcgcgcctggtcgagtccaccccggtcagcgcatcgatggttcggcggttcgtcgccggccgggacgccggcgaggtggtgcggacgagccgggggctggccgacgacgggctggcggtctccgtggacttcctcggcgaccagccggacacgccggagctggcgcgggccgtccgggacgagtacgtgtcgctgctggcccggctgggcgaggccggtctggccccggtcgccgaggtgagtgtgaagttgtcggcgctgggccggcgtttcgacgagaaggcggcgttcgagcacgcccgggcgatctgtgtggcggcggccgcggcgggcaccgcggtgaccttcgacgccgaggatcacggcagcaccgacgcgaccctggaggcggtgctggagctgcgacgcgacttcccgtcgaccggggcggtgctgcaggcgtatctgcggcgcaccgaggccgactgccgcgagctggcgaccgccgggtcccgggtgcggctctgcaagggggcgtacacggagcccgagtcggtggccttcccgtcgccgctggaggtcgacaaggcgtacgtccgctgcttgaacatcctgatgtcgggggccggctatccgatggtggcgacccatgacccgcgcctgatcgcgatcgccgaggaccgggcccgctggttcgaccgctcgaccggggagtacgagttccagctgctgttcgggatgcgcccggaggagcaggcccggctggccgacgacgggcacacggtgcgggtctatctgccgtacgggccgcagtggtacgcctacctgctgcgccgcctggtcgagcgcccggcgttcctggtagcggcggtttcctcccggaagtga

SEQ ID NO: 3416 - DNA, 213 bp, Actinoplanes utahensis
atgacgggtccagcccagaccgaggaacgcctctcggaggtacggttcctgaccgtggccgaggtggccacgctcatgcgggtctccaagatgaccgtctaccggctcgtgcacggcggtgacctcaccgccgtccgagtcggccgctcgttccgggtgcccgagcacgcggtacacgagtatctacgaggcgcgttctcccaaaccgcctaa

SEQ ID NO: 3417 - DNA, 102 bp, Actinoplanes utahensis
atgggctccgtggtcaagaagcgccgcaagcgtatggcgaagaagaagcaccgcaagctgctgcgcaagacccgcgtccagcgtcgccgtttgggcaagtga

SEQ ID NO: 3418 - DNA, 1032 bp, Actinoplanes utahensis
atgagccaggacgagttccgcgacatgctgcccgggcacgccgatttccggctgccggagccgccgccggtgcgcaaggtgaacggccggcgtccgatcccggagaagccggacgagcaggtcgccaagctggagtcgaccgccgagccccggcccgacgacgccggatccgccgccgagccggccgccccggtcgacgtgtgggatcagcggatcgccgccgggctcgccttcctgcgccgccggctggccggggcgtacgaggtggacgagttcgggttcgatccggagctgaccgaggcggtcttccacccgatgctgcgggtgctctatcgcgactggttccgcaccgaggtgttcggcgccgagaacgtgccggtcgacggcggtggcctggtggtcggcaaccattcgggcacgctggcgctggacgcgctgatgctcacggttgccctgcgggacagcccgcagcgtcgccatctgcggctgctcggcgccgatctggtgttccggatgcccgggctcagcgacctggcccgtgcggccggcgccacggtcgcctgcaacccggatgccgagcggttgatgaccggcggccagctggtcggcgtgttcccggagggcttcaaggggatcggcaagcgtttcgccgaccggtacaagctgcagcgtttcggccgtggcgggttcgtttcggcggcgctgcgcaccggcaccccgatcatcccggtcgcgatcgtcggcgccgaggagatctatccgatcttggccgacctgaagccgctggcccggctgctcggtgtgccgtatttcccggtcaccccgaccttcccgctgctcggcccgctgggtctgatcccgctgccgagcaagtggctgatccagttctgcgagccgatcccgaccgcgcatctgaccgagttcgcggacgatccactggtcgtctacaacctggctgaccaggtgcgggagacgattcaggcgaccctgcacgagctgctgcagaaaaggcccgatccgttcgcccggtga

SEQ ID NO: 3419 - DNA, 1140 bp, Actinoplanes utahensis
gtgaagttcccttttccgagctcccggagcgccgagcgcttcgcggagcaggtcgacgaccccggtggcgaccatcgccacctgcggggtcacgccgatgacgagctgaccgaactgctggcgctgagccgacgtctgtccgccgcccggccggccgggcaggtcgacccggagttccgggtcgggctgcgcgccatgctggtcgccacggccgagcgggacggcatcggccggaccgccgccgaggccgagccggaaccggccaccgagctgcccgcccgcgggcatcgcgccatcttcgggcgccggctgcgcacccggggggcgatcgtgctcggcgtcgccgccggcgcgatggcggtctccgggatctccgcggccagcgagaacgcgacaccgggcgacgcgctgtacggcgtcaagcggtccaccgaacgcgcgcagctggcgatcgccggctcggatgccagccgcgggcagctgtcgctggacttcgcccgcaaccggctgcgcgaggcgaccacgatgaccggggacgccgacagcttccggggcgtgctggacgacatggacgcggacacccgcaaaggcgtcaagctgatcaccacctcggcggtgtcccgcaaggacccggcccagctggccaccctggacacgttcgtcgccgcacagcgcaaggtgttcgagccggccatgcagaacctctcgtcggtcaaccgggagcgggcgctcacctcgctcggcctgctgcaggacgtctcgcagcgcaccggccagctccgcgagggcctggactgcgaaaaggtggtgcagaccggcgccgacgggctcgggccgaaactgcgtgactgcggcgaggacccgtccgacaagacgccgcccggcggcacccgcgccggtggcgacaggtcgacgagcaagccgaacaacacgaccaccaagccggtcgtgcccggctcctcggcgcaaccgggcgccagcaccggcgtgcccgggcaccggtccggcctgacaccgtccacgccggtgaacgggcgcacgacgaccagcccgacgccggccgggacgcccaccctcgacgacggtcacgaatccggcgacgagggcacgctcggcgggctgctgggcaacgtgttctga

SEQ ID NO: 3420 - DNA, 945 bp, Actinoplanes utahensis
gtgactcatgtgtacgccgagggcccgtaccaccgcgatgtcctcgccgggaggcaggcgatcaccgacggcctgaacgtgatccgcgaatcggtcgacggcatgatcaccaacgcgatccggggggacagcccccgccgcaccggcaaccgccgcccgctgaacaactcaccgtccgtgccggcgcccggcgccaacggcaagttcggcggcaaccggctcggcgcccggccaccggcccagccgaccgccggccagcgctccaacctgccggagagcgagacccccggcaccgaccacaccgtcgtgctgcccacccagagcaagaccgggccgccgaccgagacccagccgcccaaggcccggccggaccggggcgacccggcagccgaggtgtgggcgctggtcgagcgggcccaggccggcgaggccgaggcgttcggcctgatctacgaccggtacgtggacacggtcttccggttcgtctacttccgggtcggcaaccggcagctggccgaggacctcacctcggacaccttcctgcgcgccctcaagcggatcggcagtttcacctggcagggccgcgacctgggcgcctggctggtcaccatcgcccgcaacctggtcgccgaccacttcaagtcgggccggtaccggctcgaggtgaccaccggcgacgtgctcgacgccgaccgcgaggatcggggcccggaaggcagcccggagtccgcggtggtcgaccacatcaccaacgtcgccctgctcaccgcggtcaaacagctcaacccggaacagcaggagtgcatcgtgctgcgcttcctgcagggcttctcggtggccgagaccgcgcagacgatgggcaagaacgagggggcgatcaaggccctgcagtaccgcgcggtccgagcgctcaaccggctgctgccggaaggattccagtcttga

SEQ ID NO: 3421 - DNA, 1641 bp, Actinoplanes utahensis
atgtgcgctacgcgcaaagccgcgaatccgtccgaaatcggcatccggtatcaaggtcaccctggtccatcccggacgccgggcaacggaccggctgtccgctatcccggacgggtgacgtttgtgcgagactcgggcgtcgtggaggaacccgcccgcgatccggtcgcgcacgccgccgcccgccgcccggactcgcccgcgctgatcgccggggaaaccgtgctgacctgggcggatctcgacgtcaaggtgaccgcggcggcccgcttcgtggccgcgcgcacggcgccgggcgaccgtgtcgcatccgtgctcggcaataccgtcgacttcgtggtcacctggttcggcaccctgcgggccggccgggtcgccgtgccgttcaatccgggctgcacggtggacgaggcgacgcatgcactctccgacgccggttgtgcgctgatcgtgatcggacaggcggatcggttacgcctcggtctgggcgagtcgtgcgtcggtccggatttcgacaatgccccggcggccgagcttccgccggtggccgcgagcgatctcgcggcgctgctctacacctcgggtacgggtgggcggccgaaagccgccatgctgacccacgccgcgctcgccgcgaaccatgaccagctggacgcgatcgagccgccggtggtcgggccggacgacgtggtgctgctcgcggtgccgttcttccacgcctacggactgaacaccgggctgggcagcgtggcgcaccacgcggcgaccggcgtgctggccgagcggttcgacccggcggagacggccgccctgatcgcgcggcaccgggtcaccgtggtggtcggcgtgcccgggatgtatcaggcctgggtgcgggtgcccggcgctctggaggcgctggccggcctgcgaaccgcggtgtgcggcgcggcgccgctggaccgggccaccgcggcgcggttccgggcggtcaccggccggagcatcatgatcgggtacgggttgaccgagtccgcaccggtgctgaccaccacggcggtcagcgaccgggacaagaccggctcgatcgggcgccccctgccgggggtcgagctcatccttcgtacccgggccggtctcgaactctggcgggacggcagtgcgtcgccggaagaggatctcgccgagctcgacctcgcgccggccgtgtcggccgggaccgatccgggcgagatcgtggtgcggggcccgaacctgttcgccggttactggcccgacggtcgggacgggccggacgcggccggctggtggcccaccggtgacgtggcgtacgcggacggcgacggcgacctgatcctggtcgaccggatcggcgagctgatcctggtgaacggcttcaacgtctaccccgccgagatcgagcgggtgctgcacgcgcatccccgggtgaccgaggccgccgtggtcggccggccggaccgggagaccggccagcggccgcacgcgtacgtggtggtcgccggcgacccgccgccctcggtgaccgatctgcaggtgcactgcgcggtccggctggcaaggtacaaactgccgaccatcgagctggtcggcacgctgccgcggtcggccagcggcaaggtccgcaagagggagttgtcttga

SEQ ID NO: 3422 - DNA, 249 bp, Actinoplanes utahensis
ttgacccgcatcacgctgatcagccggggcggatgccacctgtgcgaggtggccgagcagacgctggaccggatcgcgccgggggactggacccgggtggacgtcgactcgtccgtcgagctgcagcgcgactacgacgaccgggtgccggtgatcctgctcgacggccgggagcacgggtactggcgggtcgaggaggcccggctgctgcgggatttggctcgacagcccggcgagccgcacctgtaa

SEQ ID NO: 3423 - DNA, 642 bp, Actinoplanes utahensis
gtgacagcaaagcacctggtctgggactggaacggaacccttctcgacgatctccacctggtcgtctcgtcgaccaacgaggcgttcgccacggtcggcgggcgggcggtcggcgcggacgagcaccggcggctcttccggcgcccggtcgcggagttctacgccgagatgctcggccgggcggtcgaggccgaggagttcggccggctcgaccggatcttccacgacgcgtaccggctcggtctgaccgatgtcggcctggccgccgacgcgctggccgcgatcaagagctggcccggcagccagtcgctgctctccatgtggttccacagcgagctggtgccggccgtcgagacgtacgggctggccgggatcttcacccggatcgacgggctgcgcaccgaggtgggcggcgacctgaaggccgggctcctggcgcggcacctggacgggctgggcgtggccggtgccgacgtggtgctgatcggcgactcgctcgacgacgcggccgcggcggactcggtgggcgccgcctcggtgctgtacaccgggggcttcaccgacccggtccggctgcgcgagtccgggcggccggtcgcggactcgctcgtcgacgcggtgaagatggctttgtcactctga

SEQ ID NO: 3424 - DNA, 738 bp, Actinoplanes utahensis
atgagtcagcagcgtcacggaagcacgcccggcgaggccggtggcgtcccggccttcccggacctcccggaggcgaccatcgcgcggctgcccgaatatctgcgcgccctccatcatctggccgaggccggtgccgaaacggtatccagcgagggtctggccgccgcagccggggtcaactcggcgaaactgcgcaaggacctctcccatctgggctcgtacggcacccgcggcgtcggctacgacgtcgccctgctcgtcgaccagatcgagtacatcctcggtctggacaagaaccgcgccgtctgcctggtcggggtcggcaacctcgggcacgccctggccggctacgccgggttcgccagccgtggcttccgggtcgtggcgctcttcgacgccgaccgcaagaaggtcggcgaggtgatcaacggcatggccgtgcgccacatcgacgacctggcccggctcgccgccgaggagtcgatcgcgatcggggtcatcgccaccccgcccaccgccgcgcagaccgtcgccgacctgctggtcgccgccggtgtgacaagcatcctgaacttcgcgccatgcgtgctgtcggtcccgccgaacgtcgatgtgcgcaaggtggatctcgccatcgagttgcagatcctctcgttccacgaacaccgtaaggcgtccctgaccgcccttcccggaggcggggaacccgcgggtgaccaggaggcagtcgggtcgtga

SEQ ID NO: 3425 - DNA, 1314 bp, Actinoplanes utahensis
gtgaatctcctcagcatcggtgcgtcctaccgcaccgccgacgtttccgtccttgaacggctcaccatcgcttcggcccagatcccggagatcctgcagaaactcgtcgcccagccgtacgtgagcgaggccgtgctggtctccacctgcaaccgcgtcgaggtgtacgccgcggtcagcgggttccacggcggcctcggcgacatctgcaacgtgctctcccagacctccggcatcccggccaccgagctggccggccacctgtacgtgcactacggcgaggccgcggtccggcactcgttccgggtctcctccgggctcgagtcgatggtggtcggcgaggcgcagatcctcgggcagctgcgtgacgcctaccacgcggccaccgagtcggactcggccggccggctgctgcacgagctgatgcagcaggcgctgcgggtcggcaagcgggcgcacgccgagaccggcatcgacaaggccggccagagcgtcgtcacggccgccctggaggtggccgccgaccacctcggcgggccgctcgccgggcggtccgcgttggtcgtcggggccggcgcgatgggctcgctgtcggtggccacgctcacccggaccggggtcggcccgctgcggatcaccaaccgcagcgcgtcgcgcgccgaccggctggccgagctgtacggcgccaccgcggtgccgctgtccgccctgcacgacgagctgcgcacggtcgacctggtggtcagcgccaccgcgtccaccgagccgctgctcacccgggacgtgctcagcgccgccctggccgcccgcacccaggccgacccgctggtcgtgctcgacctcgccgtgccgcgcgacgtggccccggacgcggccggtctgcccggcctgttcgtggtcgacatcgactcgctggccaccagccggcggtccgccccggccgccgccgagaccgccgcggtcgagcagatcgtcagcggcgaggtggacaacttcctcggctggatgcgcggcgccgaggtcgcgccgaccgtggccgccctgcgcacccgggcggaggaggtggtcaccgccgagatgcgcaggctcctcggccggcggccggaattcaccgaggagcagcgggccgacgtttcccgtacattgcaccgggtcgtccagcagatcctgcaccagcccacggtgcgggtgcggcagctggccgccgagccgggcggcgatcagtacgccgccctgctgcgcgagctgttcgacctggacgtccccctggccacccacgccgacgcggtacccgagatcggaggaaaaccgtga

SEQ ID NO: 3426 - DNA, 966 bp, Actinoplanes utahensis
gtgaccagtgtcaagccgctgcgcctcggtactcggggcagcaagctcgcgctcacccagtcgcagatggtcgccgacgagctgaccctggccaccggccgggccgtcgagctggtccggatcgtcacgcccggtgacacctcgtccgcgccggtcgcccagctcggggtcggcgtgttcgtctcggcgctgcgggacgcgctggtggccggcgagatcgacttcgccgtccactcgtacaaggacctgcccaccgccgagcacccgcggctgacgatcccggcgattccccgccgggaggacccgcacgacgtcctggtcgcccgggacggccgcggcctggccgacctgccgcccggctcactggtcggcaccggggccgtgcggcgcatcgcccagcttcgcgcgctcggcctggagttgcaggtcacgccgatccggggcaacatcgacacccgcatcgcgcgggttctcggcccggacgccgacctcgacgcggtgatcctggcccgggccggcatcgcccggatcggccggaccgccgacatcacccagacgctggacccgatgctcatgctgcccgcccccgcccagggtgcgctggcggtcgagtgccggtccggcgacgctgacctggtcgagctgctggccacgctcgaccacgcaccgacccgggccgccgtcgtggcggaacgggcgctgctggccacgctggaggccgggtgtgccgccccggtcgccgcatatgcccgcctcgtccggggcaggcatgccggctcggcccccgaggacgggcgcggcgaggagatgattcacctgcgcggtgcggtgatcagcccggatggggttcgagccatccggctgtcgcgcaccggaacgcccgccggggcggcggagatcggcaaggcactcgccgccgatctcctcgacgccggcgccgataccctgatggggagcacagaatga

SEQ ID NO: 3427 - DNA, 1587 bp, Actinoplanes utahensis
atgaccacccgcaccgcccgtaagccagccggacgcatcgcgttcatcggcgccggacccggcgacccggagctgcttacccgccgcgcgtacgccgcgttgaccgatgccgaccaggtggtccacgaccggggcgtacccgagtcgctgctggccgcggtccgcgcggacgccaaacccgacgcgcagttcagcccggccgagggcgcccccggcgacgtggccaaggtgctgctctccgccgccaagtccgggctgtccgccgtccacctggtggccggcgacccgttcggccacgagtcggtggtcaaggaggtgcaggcggtcgcccggaccgcggtgcacttcgaggtgatcccgggcatcgggcaggccgagggtgtcgccgcgtacgccggcgtgccgctgcccggcgtgcggatcgccgccgacgtcgacgacgtcacctcgctcgacttcgacgcgctggccggcgcggcccagaagggctcgttcgcggtcgccgtggacgccggcgacctcgccgcggtccgcgacgggctgctcgcggccggcgtcgaaccgggtgtcccggtcgcggtgaccggcgacggcaccggcgagacgcagtacaccaccacctcgacggtggacagcttcgtggccgccgcgctcggcttcaccggccgggtggtgctcaccgtcggggccgaggtcgccgagcgggacgcgatgagctggtgggagaaccgcccgctgtacggctggaaggtcctggtcccgcggaccaaggagcaggccggcgcgatgagcgcgcggctgcgggcgtacggcgccatcccgtgcgaggtgccgaccatcgcggtcgagccgccgcgcaccccggcgcagatggagcgcgcggtcaagggcctggtcgacggccgctacgcctgggtggtgttcacctcggtgaacgccgtccgcgcggtctgggagaaattcgccgagcacggcctcgacgcccgtcacttcggcggtgtgaagatcgcctgcatcggggaggccaccgccgaggcggtccgcgacttcggcatccagcccgagctgatcccggccggcgagcagtccagcgagggcctgctggccgagttctcgccgcacgacgagatcctcgacccggtcggccgggtgctgctgccgcgcgccgacatcgccaccgagaccctggccgccggcctgatcgagcggggctgggaggtggacgacgtgaccgcgtaccggacggtgcgggccgcgccgccgccggccgagatccgcgacgcgatcaagtccgggggcttcgacgcggtgctgttcacctcgtcctccacggtccgcaacctggtcggcatcgccggcaagccgcacgcccgcacggtcgtcgcggtgatcgggccgaaaaccgcggagaccgcggtcgagttcggcctgcgggtcgacacccagccgcagaacgcctcggtgccggacctggtcgaggcgctcgccgaatacgccctggagctgcgcgagaaactggcggcgatgcccgccaagcagcgccgcggctcgaaggtgcagggcccgacggccctccgattccgctga

SEQ ID NO: 3428 - DNA, 981 bp, Actinoplanes utahensis
atgtccttccccgacatccgcccgcgccggctgcggcgcaccccggccatccgccgcctggtcgcggagacccggctcgcgccctccgagctgatcctgccgctgttcctcaaggacggcatcaacgagccgaaaccgatcagttcgctccccggcgtcgtgcaacacagccgggagtcgctgctgaaggccgcccacgaggcggtcagcgccggcgtcggcggcctgatgctcttcggcgtgccggacaacgccgacaaggacgagaccggtgcggccggactcgacccggacggcatcctcaacgtcggcctgcgcgacctgcgggccgagttcggcgacgccacggtgatcatgggcgacctctgcctcgacgagttcacctcgcacgggcactgcggggtgctggccccggacggttcggtcgacaacgacgccacgctggagatctacggccggatggcggtcgcccaggccgaggccggcgcccacatggtcggcccgtccgggatgatggacggccagatcggggtggtccgcagggccctggacgcggccgggcaccaggacgtctcgatcctggcgtactcggccaagtacgcgggcgcgttctacggcccgttccgggaggccgtggagtccaccctgcagggcgaccggcggcagtaccagcaggacccgccgaacctgcgggaggcgctgcgcgaggtcgacctcgacgtcgccgagggcgcggacatcgtgatggtgaagccggcgctgccctacctcgacgtgatcgccgcgatccgtgagcgggtcaccgtcccggtcgccgcgtaccaggtctccggggagtactcgatggtcgaggcggccgccgccaacggctggatcgaccgcgaacgcaccatcctggaaaccctcacctcgatcaagcgcgccggcgcccagatcaccctcacctactgggccaccgaggtcgcgaagatgttgcgatga

SEQ ID NO: 3429 - DNA, 990 bp, Actinoplanes utahensis
ttgctgttcgtgggtgatgactgggccgaggaccatcacgacgtcgagttgatggatggttcggggcggcggctggccaaggcgcggttgccggagggtgtggcgggtatcgcccggctgcacgcgatgatcggcgagcatctcggcgaggccgacagtgagtcggcgcaggtcaagatcgggattgagaccgatcgagggctgtgggtgcaggcgttgatcgccgcgggctacacggtgttcgcggtgaatccgttgcaggcctcgcggtatcgggaacgcctcgcggtgtccggggccaagagtgacgccgcggacgcgcacatgctggccgacatggtccgcaccgactcgcaccagctgcgtgcgatggccggggacagcccggacgccgaggcgatcaaggtcgtctcccggatgcacaaaaccatgatctgggaacgtgaccgggcggtgctacggctgcggcacgcgctgcgcgactatttcccggccgccctggccgcgttcgacgacctcgacgccgccgacagcctcgaactgctgggcaaggcgcccgagccggccgccgcggcccggctgagcctgactcagatcagcgccgccctcaaacgcgcccgccgccgcggtgacctcaccgccaaagccaccgcgatccagacggtgctacgcaccggacacctgggtcagccggccgtggtcgccaccgcctacgcggccacgactcgttcgctggtcgcgctgctgctgaccctcaacgagcagatcgccgtcctgcaacaggaggtcgaggcccattttggccggcacccggacgctgagatcatcctgtcccagccgggactcggtgctgttctcggcgcccgggtgcttgccgagttcggcgactaccacgcccgctacgccagcgcgaaagcccgcaagaactacgccgcgaccagcccgctcacccgcgcctccggcaagaaaaagatcgtcatggcccgctag

SEQ ID NO: 3430 - DNA, 234 bp, Actinoplanes utahensis
gtgcacaacgaccggctcgccgacgccctgcagggccaagccttcaccgcgctacgcgcctcacccggcgcccgcgcctactacgacaggcaacgcacccgcggcatcggccaccgacccgccctgcgacaactcgccaaccgcctcgtcggcatcctccacggatgcctcaaaaccagcaccccctacaacgaaaccaccgcctgggcacaccacctcgaccaagccgcttga

SEQ ID NO: 3431 - DNA, 1083 bp, Actinoplanes utahensis
atgcgtacttttgcgtggtcagcacttccctgtgagtccgctgcacggcacgatgtacgggtgagggtgcgtgaatgggatccccgctccgcgtccgcggccgaggtccactccctggtggagacggtcaacgcggtgctggcgaccgacctccccgacgatccaccctggcgggacgtgcaggtcagggactatctcgccgagaccatgcccggcgagcggcggatctgctgggtcgctgaggacgatcggctcccggagggggagagcgagatctacgccctggtcagcattctgctgctgggcgacatcggcgtgctcgaaatcctggtcaagccgcagttgcgccgccgcgggctgggccgggaactgctcggggtggccgcccgccgggcgtacctggagggtttctcctcgatcggggtggaggcgatcggcggcaccccggcgatcgccttctacgagtcgctgggtttcgagcgggagtatgtggagacccgttccgtcctgagtctggacaccgtcgactgggccacgctgggcaccatggccagcggcatcagcagcggctaccgggtggagtatcacccgggcggcccgcccgccccgctgctcgaggcgtatgcgagggccaaggcgcaggcccagaccgacgacgacgatctggacctgacgccccgctcctcggatccggagcggctccgcgagtctctcgacacgctgcaccggcgcggcctcaagccgtacatcgtgctggccatccacgagtcgaccggctcggtcgccgggctgaccgaggtggtcgtcccggcccagcacccggagcgcgccgaccagtacgacacgatcgtggtgcgcgagcaccgcggctacggcatcgaccgcgccatcaaggcccggatgctgttcgagctgcgcgccgccgagtcaggcctgcgccaggtccagacctggaacgcgcagcacaacgaatccatgctcaaggtcaacgccgagctgggctaccagtccgaccgtgactggtacgaatacatcgccgacgtcggcgacctggtccgccgcctgggacctgccgatcaatga

SEQ ID NO: 3432 - DNA, 957 bp, Actinoplanes utahensis
gtgggtgcgtgggccaggcggcccagcgggcgcgtgatcatcccgagcgtcatcgctctgctgctgatcggtctggccggctccgccggggtctatctggtcccgcgggcgctggaggccgatccggcgccgagtgcgagcgcggcgctcggtggtgcgggtgcggtgccggcgccgtcggccagcgacccgtacgggatccccggcggcgggttctccgctcccccggccggcatcccgggcttcccgggggcgccggccaccgggttcggcctgcccaccaccggcaccccgggcctcgggaccggcctgggcacgggcaccggcccgggcaccgggaccgggatcaacaacggggtcggcaccggcgcacggccggccgacgccctggccggctgggcacaggcgaccgcggacaaggtcggcatcccggtggtggccgtccaggcgtacgggtatgccgaactggtcaccacgcagaccacgccgacctgccggctgaactggacgacgctggccgcgatcggcaaggtggcgtccgggcacggcagcgccaacggggcggtcctcggggtggacggggtggcgcaaccgacgatctacggcctgccgctggacgggcagggcgggcggcccctggtccgggacaccgatcagggcacgatcgaccaggatccggcgttcgaccgggaggtcggcccgatgaagatgatcccgagcgcctggcgggcgaacgcggtggacgccgaccgcaacggggtcgccgacatcaacgacatcgacgatgccgcgctggccgccgcctcgtcgctgtgcagggacgcccacggcagcatccgcaacctggcccgggccgatgcctggtgggacgcggtgctgaactacggcgcgctccgcccctcggctcagaagatcttcgacgccgccaaccagtacggccagaagagccgctcctga

SEQ ID NO: 3433 - DNA, 210 bp, Actinoplanes utahensis
atgccgcgttatgactaccgctgccgcgcctgcggtgccaccttcgagctgaaccgtccgatgcgcgaggccggcgatccggccacctgtccgcatggccacggcgacacggtgaagctgctgtccactgtcgccgtcacgggccgtggcggcgccgctccggcgggcggcggcggtggcggctgctgtggcggcggttgcggctgctga

SEQ ID NO: 3434 - DNA, 2586 bp, Actinoplanes utahensis
atgttcactgacatagaggggtctacacgactggcccggatgctcggtgacacctatcgcgctgtgctgaacgcacatcgctcagtgttacgtgcggcgctgagcgacttcggtggtgtggagctcctcaccgagggtgattcgttcttcgtggcgttcgacaacgccgacgccgctctggcggcctgtgtggaggcgcagcggcggctggccgcccatccctggccgcgggaggacgccgtgccgcgagtccggatgggactgcacaccggccgggccaccccgatcggcaccgagtacgccagcgccgaggtgcaccgggccgcccgggtcgccgccgccgcccacggtggccaggtgctctgttcggaggcgaccgcgctcgcggtcaccgccacctatgccacctcgggacacggccgggtcgcgacggcggccgcggcgacgctggccaccgtggacctgctcgacctgggcgcgttccggctgcggggcttcgacgacgccgagcggatcttccaggtggtcgcgccggggctggaccgggagttcccccgcccgcggaccgcggaggcgccgcggcacaatttgccggccgcgcacagctcgttcgtcgggcgccaggcggagtgcgccgagctggccgagctggtcggccggcaccggctggtcagcgtggtgggcccgggcggggccggcaagacacggctgagtctggccgtgggcgagcaggtggtcgacgcgtaccccggcggggtctggacgatcgacgcggtgagcgcggccggtggcctgcccgccgccctggtcgcggcgctggggctgcggccggagcccggccgccaggcgatcgagacggtgctggagcagtgcggcgagcgccggatgctggtcatcctgcagacctgtgacgccgcgccggggctgaccgcggcgctggcgcaccggctgctgtcccgctgcccgcggatggatgtgctgaccaccggccgggcgccgctgggcctggccggggagaccgtgtggcggatcccgccgatggccccggctgacgcgttcgccctgctcaaggagcgggccacggcggctcgtggcgggcggcgcagtgacgacgacaccgcgctggccgagctggccgcccggctggaaggttcgccgctggcgatcgagctggccgccgcccggctgcggctgttgccggccgaactgctggcccggcggctggacgatccgatcggtgcgctggacggggacgcctgcggcgagggccggcacgccagcctgcacaacaacctggaatggtcgtaccggagcctgggcagccgggccgccgagctgctgcatcggctggcggtcttcgccggcccggtcgatctggccaccgtcgactggtgcggcgagggcgctctcagcgcgctctccgagctggccgagaagtcgctgatcgaggtggtgccggggccgcgctaccggatgtccgggcacgtccggtcgtacgcgttgcgccgcctcgccgccaccggtgacgagacgtccgtgcgggatcggcatctggcctggtcgctggagatgctgtcggcggtggcggtggacaccgacgggcagccgcggaccgtgtcgctcaccgatctggggccgttcgtgccggagtggcaggccgcgctgcgctgggcggcccgctgcggggacgtgtccgccggcctgcgcctggccgcggcgctgagtccctggtggcgggagcacggcggggccggggaggggcgggacctgctcagccggctcggcgaacgggacggcgccgaagccgatccgacggagctggcccggtcgtacctgatccacgccgacctgaccggcgaccgcgcggagcgggacgacctcctgcggcgtgccgagcaggcggcccggcgggccggcaacgcggcgctgctggtccgggcgctgggcggccggcggatcccgctggacgagcgtgccgacgaggcggcggagagcggctgtcgtgcggtgatcgccgaggcggaacggaccggggtggtcaccgagtcgctgccggccgtgctggcgctggccgagctctactggcggcggggtgcgctgaccgaggcggccgagctgctcggcggcgcccggcagctggaggcgggccggccggaggaccgtggccggcgggccgtggactggctgctcggcatggtcgcgttgcgccggggtgacctggtggccgcgcacgatcacctggtggtggcgctgcgctcccggctgcggcacgggttccggggggcggccgcggacgcggtggcggcgatcgcggcccgctgcgcgctgggcggcgatccggtgaccgcgacggtgctgttcggcggagcggaggcggcgcgcggggcgcgccgcaccgagtcgttcgggagtttctggtccgagcggcaggccgcgttgcggctcgcgctgggcgatgccgctttcgatgccgcgtacgccgatggcgcgaacctgggtttcgatcggatcgtcgcgatggcgctggccgtcgagcatcccgacctggaggacggggcggcgcgcttcgcgcagatcgtgcggtag

SEQ ID NO: 3435 - DNA, 1002 bp, Actinoplanes utahensis
atggtccgtcagggaccgctgaaagcgctggctgtccggctcgcgatggcgctcgcgctggtgctgagcgcggtggcggtcgtctatgccgaccggggcggttaccgcgacgtgaacggggacggcctgagcctcctcgactgtttctactacgcggtggtctcgctctccaccaccggttacggcgacatcaccccgtcgacgcagggcgcccggctggtgaacgtcctgttcatcacgcccgctcgggtgctcttcctgatcatcctggtcggtaccaccctggaagtgctgaccgaccagtaccgcaggggcctgcggatcagccggtggaggcggaagttgaaggaccacgtggtgatctgcgggtacggcaccaagggccgggccgcggtcgacgcgctgctggagaccggctacgacaagtcccgcatcgtgatcgtggagaaccgggaggccgccgtccggcaggccaccgcgaacggcttcgtggtgatcgagggcaacgccacccgctcctcggtgctgctcgaggcggacatcaagaactgcaagtcggtgatcatcgcgaccgatcaggacgaggcatcggtgctgatcacgctgaccgtgcggcagctgaccgcgggccaggtgcggatcattgcagcggtccgcgagcaggagaacgcggcgctgctcaagcagtccggcgcgcaccacgtgatcgtctcgtcgtccaccgcgggccggctgctgggcctgaccacgaccgcgccgccgttgatcgacgtggtggaggacctgctcacccccgggcaggggatggcgctggcgatgcgctcggcggagcgggccgaggtgggccgtaacccgcgggagctgccgacgctggtggtggcgctgatccggcggggcaaggtactgccgctcggcggggagcaggcggtcaccatcgagaccggcgacctgctggtctacatccgcgacgacgccagcaccgcggccggcgtcaccgtctga

SEQ ID NO: 3436 - DNA, 1005 bp, Actinoplanes utahensis
atgggtgaaccgctgacgctgaccgccaaggacttcaagtccgaccaggaggtgcgctggtgcccgggctgcggggactacgcgatcctggccgccgtgcagggcttcatgcccgagctcggcatcccccgggagaacatcgtcttcgtctccgggatcggctgctcgtcccgcttcccgtactacatgaacacctacgggatgcactcgatccacggccgcgccccggcgatcgccaccggcctgtccgcgtcccgccccgacctgagcgtctgggtggtcaccggcgacggcgacgcgctctcgatcggcggcaaccacctgatccacgcgctgcgccgcaacgtcaacctgaagatcctgctgttcaacaaccggatctacgggctcaccaagggccagtattcgcccacctccgagctcggcaagatcaccaagtcgacgccggccgggtcggcggactcgccgttcaacccgctgtcgctggccctgggcgccgaggcgaccttcgtggcgcgcaccatcgactcggaccgcaagcacctgcagtcggtgctgcgggccgcggccgcgcacgagggctcggcgttcgtcgagatctaccagaactgcaacatcttcaacgacggcgcgttcgacctgatcaaggacgcggacacccgggacgagcacctgatccggctggaacagggacagccgatcaccttcggcgactactcggtcgtccatcccgagggcagcttcgggttgtgcgtccagcagggcggcacgccgatcgtgcacgacgcgacggtggaggacccggcgtacgcgttcgcgctgacccggctctccggctccgacctgaacaccacgccgatcggcgtcttccgggacgtccggcggccgtcctacgacgagatcgtccgcaagcagctgatcgacgctcaggcccaggccaccggcacgcccgaggagatgctcgccgatctcctcaacgccgccgacacctggaccatcatctag

SEQ ID NO: 3437 - DNA, 1854 bp, Actinoplanes utahensis
gtggccgctcccccgaaacgggtcgaacagctggaccgggtcgtcatccggttcgccggcgactcgggcgatggcatgcagctcaccggtgaccggttcacctcggagaccgcgcagctcggcaatgacatctccaccctgccgaatttccccgccgagatccgcgccccggccggcacgctgcccggcgtgtcgagtttccaggtgcatttcgccgactacgacatcctgactcccggtgacgcgccgaacgtgctggtcgcgatgaaccccgccgcgctcaaggcgaacctgtccgagctgccggccggcgccgacgtcatcgtcaacaccgacgagttcaccaagcgcaacctggccaaggtgggctacgcgaccagtccgctggaggacggctcactggccggcttcgcggtgcacccggtcgcgctcacctcgatgaccgtcggtgcgctggccggtctgggcatcccgaagaaggacgccgaacgcgccaagaacatgttcgcgctgggcctgctcagctggatgtattcgcggccgttcgagtccaccctgcgattcctggagcgcaagttcgccaagcggccggagctggtcgaggcgaacaagaccgcgttccgtgccggctggaactacggcgagacgaccgaggcgttcgcggtgcgctacgaggtgaaaccggcgcggatgccgcccggcacctaccgcaacatcaccggcaaccaggcgctcgcgctcggactggtggccgcggcggtccggtcgaaactgccgctgttcctcggggcctatccgatcacgccggcctcggacatcctgcacgagctgtccaagcacaagcggttcggcgtcaccacgatgcaggccgaggacgagatcgccgcggtcggggcggcgctgggcgcggcgtacggcggcgccctgggggtcaccaccacctccgggcccggcgtggcgctcaagggcgagaccatctcgctggcgatcgcgctggagctgccgctggtcatcgtcgacgtgcagcgggccggtccgtcgaccggcatgccgaccaagaccgagcaggccgacctgaacatggcgctgtacggtcggcacggcgaggcgccgctcgcggtggtggcgccgaaatccccgtcggactgcttccacgccgcgttggaggcggcgcggatcgcgctgacctaccgcaccccggtcatcctgctctccgacaactacgtggcgaacggttcggagccgtggctgctgccctcgatcgacgagctgcccgacctgaccgtcgagttcaccaccacaccgaacgcgccggacggcaggttcctgccctacctccgcgaccccgagacgctcgcgcggccgtgggcggtccccggcacgccggggctcgaacaccggatcggcggcctggagaaggccgaccggaccggcgacatctcatacgacccggcgaaccacgaattcatggtacgaaccagggccgcccgcatcgaggcgatcccggtgccggacgtggacgtcgaggacccgtcggaggccgcccgggtgctggtgctgggctggggctccacctacggcccgatcggggcggcctgccgggcgctgcgccagcggggcctcacgatcgcgcaggcgcacctgcgacacctgtcgccgctgcccgacaacctgggcgaggtgctgaaatcgtacgacaaggtggtcatcccggagatgaacctggggcagctcgcccacgtgatccgggccagatatctggtcgacgcggttccgttcaaccaggtcagcggcctgccgttcaccgccgccacgctggagagcatgctggaggacgtggtcaagaatgggtga

SEQ ID NO: 3438 - DNA, 438 bp, Actinoplanes utahensis
ttgcccacagtagccatccaccgctgccgtgggccagggtcttgggtaggctgccccttcgtggacggatatctcggctcgtacgcggtcctcggcctggtgctggcggccggggtgctgctgttcgtggcggcgttcggggcgaaccggctgctgcgcccggcccgtccggccgagcccgccggcaagcggatcccgtacgagtccggcatcgacccggtcggcggcgactgggcgcaggcgcagatccgctactacgtgtacgcgtacctttacgtgcttttcgcggtggaagcggttttcctcttcccctgggcggtgatcttcgatcggccgggtttcggcggcgccgcgatcgccgagatgggcgttttcgtcgccgtgctggcgctgggcatcctctatgcgtggcgtaagaagatcctgacctggacctga

SEQ ID NO: 3439 - DNA, 477 bp, Actinoplanes utahensis
atgagtcagcttctgctcttcattgtcgtagcactggtcgtcgggacgatcgtcttcggcgtgaccgttctgctgagcgggggcgactccgggctcaccgcggtggagccggacgggcagtcggtgccgctgcccggcgaccgcccgctcggtgaggacgacatcgccgcgacccggttcgacaccgcctggcgggggtaccggatggcgcaggtcgatcaggcgctgcagcgcgcggcgtacgacatcggctacaagagcgagctgatcggtgtgctggaggcggaagtgacggcgctgcgcgagggccggctggacgacgccgactcgctgcgtgccgcccgggaggccgcggtcgccccggccggcgtgccggccgagccggccgtgcccgccgagacgctggccgaggccgaggccggggacgcggacgccgagccggccacgagcgacgaggagccggcggagagccgatga

SEQ ID NO: 3440 - DNA, 705 bp, Actinoplanes utahensis
gtggttccagctgccgcccggctcggtcggcaagctggcctggccggtgctctggcccggctcgaaactcggcttcaccggcgcgctgaagaagttcgcccgcctggtcgagcagggccggctgccgtgaccggtgacctggtgatcggcgacgacgccaaggcccgctgcttctggggcggcagctcaccggagtacgcggcgtaccacgacgacgagtggggcaagccggtccgcggcgacgacgccctgttcgagcggctcaccctggaggccttccagtccgggctgtcctggatcaccatcctgcgcaagcgcccggcgttccgggccgccttcgacgacttcgcgatcgccaaggtcgcggcgtaccgggaggccgacgccacccggctgatggccgacccgggcatcgtccgcaaccggatgaaggtggacgccgcgctgcacaacgcgcgggtcgccgccgagctggctcccggcgagctgaccgacctgctctggtcgttcgccccgccggcccggacccgcccgtcgaccagggcggacgtcccggcgaccacgccggagtcgacggcgatggccaaggcgctgaagaagcgcggattcaagttcgtcggacccaccacggcgtacgcgttgatgcaggccaccggcatggttgacgaccacctcaccggctgctgggtgcccgtgcttcgatag

SEQ ID NO: 3441 - DNA, 507 bp, Actinoplanes utahensis
atggcgcagtggtcggtggtccttgatccggagcagtgggcgacggaacgcttgttccagcaggacgtcgtggtggtgcgcggcgcaccggccgggctcgcggccggcgacgaggcgctgctgctcgccgacggccacgtggtcgccgtgacccgggtggagaaagccggggagtacgccgcgctcgcctaccagcgtcgggctttcgacgagccgatcccggccgccgggctggccgccggcccgctcgccggggccgagttccaccgtttcgcggcccggttcgaccgggccccgcggaagcggagctggctggtcagcgtcgcgctgccgatcgaggcggccaccccggccgaggcggtccggcagtactggtcgcacgtgtccgacctgggcccgcgggagctgccgacctacgtctggccggccggggacgagctggccatgcaggccttcgtcctcggggccgaggcgaaccaggaccccgaggaagaaggcgaggactag

SEQ ID NO: 3442 - DNA, 789 bp, Actinoplanes utahensis
atgactgacgtgctcctggtcgaccgcaccgacgcggtcgtcaccctcaccctgaaccggcccgagtcgatgaactccttcaccgtcgacctcaaggtggccctgcgggacaccctggccgcgctggagaccgaccggtcctgccgggcgatcgtcctggccggcgccggcggcgccttctgtggcgggcaggacctgcgcgagcacgccaccctgctggagcaggggcacaccgacctgaacacggtccaggtgcactacaacccgatcgcccagcggctggccagcatgcccaagccggtggtggccgcggtacgcgggatggccgccggggccggcgcgtcgctggccctgctcgccgacttccggatcggcgggccgaaaacgtcgttcctgatggcgttcgccaacgtcgccctggccggggacagcggcatctcctggtcgctgccgcggatcgtcgggcacgcccgggcggtggagctgctgctgctggccgagccggtgcgggcccagcgggcgtacgagatcggcctgctgtcccggctgaccgaggatgacgagcacgtgctgccggccgcccaggaactggccgcgcggctggccgccgggccgaccgtcgcctacggcgcgatcaagcgggagctgtccatcggcgacgccggcacgctgtccgacgcgctcgccgccgaggcacaggcccaggcgatctgcggggccaccgccgaccaccgcaacgcggtcaagtcgttcctcaacaagcagaagccggcgtacgagggtcgctag

SEQ ID NO: 3443 - DNA, 798 bp, Actinoplanes utahensis
atgcaggcgcggtccgcactcttcgacctgtacggcgactacctgcgcacccggggctcgcgagccccggtggccgccctggtgcggctgctcgccccgctgggcatcgcggcaccggcggtacgcaccgccgtgtcgcgaatggtgcgccagggctggctgcacccactgcggatgaccgcgggaccgggctatctgctcacccccaaggcggcgcggcggctcgacgaggcggccgcccgggtgtaccgaaccggtcgcggcggctgggacggccggttcgatctgatcatgctgcacgacccgccgctggcacggccggaggcggaacgactcgcctttctggggtacggctcgctcagcgaccaggtctgggtcgccccgcgcgcctccgacgagctggacgcggtgctggacgaggcgggcgcggcgtacgaccggttcagcgccgcgcacacggccggctcgccgggtaccgccgggatcgtcggcagggcctgggacctggaccggatcggccggtcctaccgggagttccaggacgaactgcgtccggtggtgaaggcggtgaccggccgcagcccggacgaggaggcgtacgcggcccggttccgcctggtgcacgcctggcgctcgtttctgttccaggacccgcagctgcccgccgcgctgctgccggccggctggccgggggtgcgggccgcgctcttcttcgacaagcacgccgcccggctgcgtccggccgccgaccgttacgtcgaacgctgcctgcacgacaaaggtagattcggccaatga

SEQ ID NO: 3444 - DNA, 168 bp, Actinoplanes utahensis
atggcggcgatgaagccgcggacgggcgatggtccgctggaggtcaccaaggaggggcgtggcatcgtcatgcgcgtcccgctggagggtggtggccgtctcgtcgtggagatgaccccggacgaggccagcgcgctgggtgacgcgttgaagtcgatcgccggctga

SEQ ID NO: 3445 - DNA, 1398 bp, Actinoplanes utahensis
gtgttcgcaatcgggttcactgaagcattcgaccaggagcgcacctgggtggtgccggccggacacgtgccgccgggcgaggtcggcgacgagatcgccgcgctcgccggggtgctgccggacgagatcgtggtgctgccccggccgctgcgtcgcccggcccgggtcctgctggccggggtcggcgacggcgacgaggcgggctggcgggccgccggcgccgggatcgtccgggcgctcggcgacgacgagccggtccagatcctgctcccggacaacctgcccgcggccgcgctccgcggcctcgccgagggcctctggctcggcggctaccgctaccgcgacggggtcaaggcgccgcggtccggcgccgtcgatctggtggtccagaagccgactgcggcgtacgccgcggctctggcccaggcgtccgccaccgccaccgcgacctggctggcccgcgacctgaccaacacgccggcctcgaccaagaacccggagtggttcgccgaccagatcgtcgcgctcgccgacggccgccccggcctgagcgtgaccgtccgggccggcgacgacctggcccggttcggcggcctgctggcggtcggcggcggttcggtctcgccgccccgtttcgtcgagctgtcctgggccccggagggcgccaccacccacgtggtcctggtcggcaagggcatcaccttcgacaccggcggcatctcgatcaagccgcgcgacggcatgaagctgatgaagaaggacatgggcggggcggccgcggtgctcgccgccacgctcggcgccgccgagctgaacctgccggtccgggtcaccgcgctggccccgctcgcggagaacgcggtcagcggatcggcgttccggcccggcgatgtgatcacccactacgacggctcgaccacggagaacaccaactccgacgccgagggccggatcgtgctggccgacgcgctcagctacgcggccgaccggctcgaccccgacctggtgctcaacctggccaccctgaccggggcgaacgcggtggccctgggcaagcgcacggccgccctctacagcccggacgacgatctggcggcggcgctcaccgcggccggggaggcggccggcgagcggatgtggcggctgccgctggccggcgagtacacggagaacctgcgcagcgacatcgccgaccggatcagcgcgccgagcgggccgggctcggtgatggccgcgctgttcctgcgcgacttcttcccccgggtgccgtgggcgcacctggacatgtccgcgccgagctgggccgaggcgcacgacggcgaactgaccaagggcgccaccgggtggggcgcccgcacgctgctgcggtacctctcagcgcttgacggcggtcagtaa

SEQ ID NO: 3446 - DNA, 1002 bp, Actinoplanes utahensis
gtgggcgccggggccggcagcaccacggcggccggagcatacgggtcgcgccagggatcgtgcagcgcgtcgctccaccacggcgagccgggcccggggggcggccggtgccagttcccgccgtcggtcacgtcggaccctcccactcatcgctcgccaggctcggcctccagaatgacacggattcccggtggcgcggcgtccagtgctgaccgggaagcaccgaccggccggtttatccatcgacagcgccgtgcatcacgggtatccatcgctctactctcttatccgatgtgcgcggttccgatcggtcaccggcacgtcgcccgccccgcacggaggttcgtcatcatcggtcccgcccgctccttcggccagccatcgggccacgccgtgccgttcgccgagacctacgcgaccgaggacccgatcctgcagaccgcccgctcgctggcgaacgagctgggcctgccctgcgtctcgccgggcgccggctcggtgctgcgcctgctggccgcggccggcaacgccaaggcggtggtcgagatcggcaccggcaccggggtgagcggcatctggctgctgcgcggcatgcgcccggacggggtgctcaccaccatcgacgtcgagcacgagcaccagcggatcgcccgccgggtgttcgccgaggccggtttcgccccgtcacgcacccggatcatcagcggccggtcgctggacgtgctgccccggctcgccgacggcgcctacgacctgatcttcgtcgacgcggacaccaccgagttcgccgcgtgcaccgaggcggcgctacggctgctgcgcccgggcggggtgctgatcgtcaacggggtgcacgccggcggccggatcaacgacccggccgcccgtgacgtggacaccctgatggtgcgggagacggtgaaggtggtccgcgagtccgaggagtggattcccgcggtcatctccgccggcgccgggttactgaccgccgtcaagcgctga

SEQ ID NO: 3447 - DNA, 1236 bp, Actinoplanes utahensis
gtgaccgacggcgggaactggcaccggccgccccccgggcccggctcgccgtggtggagcgacgcgctgcacgatccctggcgcgacccgtatgctccggccgccgtggtgctgccggccccggcgcccaccggcggtccggccctggacccggtgcccgaccccgacgcgccccgccggtcgtacgctccggtgctgctgatctgcctgctcaccgccctgctcgcggggggtgtcggcggcaccctcgggttcgtcttcgcggtccgtggcggctatgtgggcgccggcggcacccggctcggcgcggccggccagcagtccccggtgagcgccgcgcgggacccgcagtcactcgccggcgtcgccaagaaactccagccgagcgtcgtcacggtgcacgtgacgggtgcgatcggctccgggttcgtggtgtccgcggacggttacgtgatcaccaacgaccacgtggtggacggcgccggccccaccatgtcggtctccttcagcgacggctccaccgccgcggccaagctcgtcggccgcgacccggagtcggacatcgcggtgatcaagatcgcaaaaggaaatctgcccgcggtcccgttcggcgactcggacgcgatcgcggtgggtgacccggtgctcgccttcggttcgccgctcgcgctggagaacaccgtgacctacggcatcgtcagcgcgctggaccggaccatcgaggccggcgagtccggcggcaccacccgctactacgccgccatccagaccgacgccgcggtcaaccagggcaactccggcggtccgctggtcaacgcggccggccaggtgatcggcgtgaactcggtgatccgttcggtcggcgggtcggaaaccgaggccggcaacatcggcctcgccttcgccatcccgatcaaccaggccaaacggatcgcgcaggacatcatcgacaccggcaaggcccggcgcacggtgatcggcgccgaggtgaccagcggcggcaccggcaccagcggcgccaagctgcgttcggtcgagccggccggcccagccgccgcggccggtctcaaggccggtgacgtgatcaccaagctggacgggcggccgctgcaggacggcaccgatctgatcgccctggtgcgcaagcacgccccgggcgcggtagtcgccgtggagtaccgccgcggctcgaagaccgtgtccgcctcggtcaccctgtcgtcctcgaccaactga

SEQ ID NO: 3448 - DNA, 441 bp, Actinoplanes utahensis
gtgttcgagaatctgaactggtgggagatcggcgcgctgctcatgctcgcgctgctgatcttcggggaacgcctgcccaaggtgctgggggacgggctgaagatgctgcgcgggctgcgggccatggcgcagaacgccacctccgacctgagcaaggagctgggcaccgacatccagctggaggacctgcatccgaaggcgttcatccgcaagcacctgctcagcgaggaggacgagcaggccctgcgcaagccgctgcagagcctgttcgacgacgtcaagcaggacctgaacggcgtcaagaccgagctcaacggggtgaagacgcacctcagcgagaccgcggcggacatccggggcgcggcctcgacctcccggcagacgactgcgccggtcgaggctccccgaccggcgcagcgatacgacttggacgcgacgtag

SEQ ID NO: 3449 - DNA, 1149 bp, Actinoplanes utahensis
atgtccgctcccgctcccaccctcgaggacgcgatccaggccgcgctggcgaccgtggacgaccccgagatccgccgcccgatcaccgacctcggcatggttcagggcttcaccgtgcaggacggcctggtcaaggtcgacctgctgctcaccgtcgccggctgtcccctgcgggacaagctgaacgccgacatcaccgccgcggtcacgaaggtccccggcatcaccggcgccgagatcaacttcggcgtgatgaacgaggagcaacgcaaggctctccagaccacgctgcgtggtggcggagccgccgagccggagatcccgttcgcccagcccggctcccgcaccagggtgtacgccgtggccagcggcaagggcggggtcggcaagtcgagcgtcacggtgaacctggccgccgcactcgccaagcggggcctgtcggtcggcgtcgtcgacgcggacatctacggccactcggtgccgcggatgctgggcgtggagagccggcccacccgggtcgaggacatgatcatgccgccgcagtcgcacggcgtgaaggtgatctcgatcggcatgttcaccgccggcaacgccgcggtggtctggcgtggcccgatgctgcaccgcgcgctgcagcagttcctggccgacgtctactggggcgacctggacgtgctgctgctcgacctgccgccaggcaccggtgacgtggccatctcgctggcccagctcctgccgaacgcggagatcctggtggtcaccaccccgcagatggcggccgccgaggtggccgagcgggccggcgcgatcgcgctgcagacccaccagcgcctggtcggcgtcgtggagaacatgtcgtggctggagctgccggacggctcgcggatggaggtcttcggcgccggtggcggccagaccgtggccgagtcgctgacccagacggtcggcgcgcgggtgccgttgctcggtcaggtcccgctggacacccgggtccgggaggccggtgacgccggcaccccgatcgtgctggccgacccggaggccccggccgccaaggccctcgacgccgtcgccgacaagctcgccgtccgccgcgagtccctggtcggcaagccgctgggcctgatggtgaacgccaagaagggctga

SEQ ID NO: 3450 - DNA, 522 bp, Actinoplanes utahensis
gtgagcgagccccgccgggaccgcctggatcagcctcgcgagccgggccgggtgcagctccccaagttcgacccggaggcgttcggccgctggtcggagagcatcgcgcggtacatgggcacggcgaagttcatcgtctacatgaccgtggtgatcggcgcctggttcctgtggaaccggctgatgccgatatggaagttcgatccgtacccgttcggcttcctcaccctggtgctgtcgctgcaggcgtcgtacgccgcgccgctgatcctgctcgcgcagaaccggcaggcggaccgggaccggatcgccatggacgaggatcgacgccgcgcgcagctgcagaaggccgacaccgagtacctgacccgggagatcgcctcgctgcggatcgccctgggggacgtggccacccgcgacttcatccggtccgagctggcccggctggccgccgaactggacgacgccgcgctgcgccgggagaagcgggcgcgtatcgagtgggaggaagaccacccctga

SEQ ID NO: 3451 - DNA, 1269 bp, Actinoplanes utahensis
atggggacgagggtttatctggcccggcttgccggcctgccggtgttcgaccccaacggcgaccgggtgggccgggtccgcgacgccgtggtccggttgcgcaccacgaaccgcccgccgcaggtggtcggcctggtcgcggagatggcgctgcgccgccggatcttcctgccgatcgggcggatcaccagcatggacgccgaggcggtcgcactcggcaccggctcgctcaacctgcgccgcttcgagaaacggccgaacgagctgctggccctggaggacctgctggaccgtcgggtgttcgtggcccccgagcagcagggcgccgaggagcatcagggcaccgtggtggacatcggcatggacctgaaccggaacaccgagtgggtgatcacccgggtcgcggtccgtgagcacaccgggcggctggcccggcgcgggcacgtctaccaggtggagtacgaccgggtccgcggcctggtcggccccaccgacacccagggcacgtcgaacctgctggcgctgctcgaccagatgcgcccggccgacatggcgaacgcgttgcaggatctgccggacgcgcggcgcaacgaggtggccgcggcactgagcgaccgcaagctcgccgacgtgctggaggagctgcccgagcacgaccaggtggagatcctggcccggctggaccgggaacgggccgccgacgtgctggagcggatggatccggacgacgccgccgatctgctggccgagttgcccaaggcggagcaggcggtgctgctcgacctgatggagccggaggaggccgccccggtccggcagctgatgagctaccggccgggcaccgcgggcagcgtgatgacctccgagccggtgatcatgacgccggacgcgacggtcgccgaggcgctggcccggatccgcgagccggacctgtccccggtggtggccgcgcaggtgttcgtcgcgcgggcgccgagcgccactcccaccgggaagtatctgggcatggtgcacttccagcggctgctgcgggagccgccgtcgtcgatcgtgggtgggctggtggacagcgggatcgagccgttgcggccggacatcgggctggccgagatcacccggcggatggcgacgtacgacctggtcgcgatgccggtggtggacggaacgcaccggctggtcggcgcggtcaccgtcgacgacgtgctggaccattcgctgccgcgggactggcgtgaccgggacgcccacgaggacgaggagccgctgtga

SEQ ID NO: 3452 - DNA, 882 bp, Actinoplanes utahensis
atgtccaccgtggcctacgagatcgtcgacgtgttcaccgaccggccgttctccggcaatccgctcgcggtggtgtccggcgcggaccatctcgccaccgatcagttgcagaccctggcccgcgagttcaacctatccgagaccacgttcgtgctgcccccgacgtccgccgaggcgacctaccgggtacggatcttcaccaccgacgaggaactgccgttcgccggccaccccagcgtgggcaccgcggtgacgctcatgcgccagggccacttcggaccgggacgggtggtgcaggagtgcggggcggggttgctgccgatcgaggtgaccgccgcgggcgcggccaccctgaccggggccgcaccccggctcggcgtgccggtgccggtcgaggcgctgttggagatcagcggcctgacggccgaggaccatgcctgctccggatccgccgtcgcccgcgaggcgggctgcggactcgattggaccttcttgccggtacgccgttccgccctcgcccgggtggtcatcgacgcccgggcggccgcccggcacggggtgaccgacctgggcatcttcgcctgggatccggagtccgccaccgcccacgcccggatgttcgtcgccggctcgaccgtctgggaggacgcggcgaccggatcggcggcgctcggcctcggggtgtggctggtcggtgccggctggctgccggcggacgggctgtcgacgtaccacgtcagtcagggctctgaaatgaaacgcccgtcgcggctggactgcacggtgaccgccgtgggcggcgccgcgacctcggcgacggtgaccggccacgtcgtcccggtcgccaccggccggatcgctgtcccgcccttcatcggttga

SEQ ID NO: 3453 - DNA, 498 bp, Actinoplanes utahensis
atgaccggggtgaacggtgtgctcgacgaggcgatcaagaaagcggccgtggcctggatctcggtgggtgacggcccggccttcgcgctctggtgcatgccggtggagtcgtcgctcgcggtgatcaccggccccggcgagcagcacgccgacgggctggccgaggcgacccgggccacggtccggctgcgcggcgaccacggtggcctgatcgtcaccaccgaggccacggtgacccggctcgatccggccggcgagcgctggtcggagatcgcgccgcagctggccggcaaacggctgaacgccgcgggcaccgccgacgaggtgaccgcgcgctgggcggcgggctgcgcgctgctgttgatcaccccggtcgagggtgggctggtgtccgctccggggcttcccgacgcgtccggggcggccgcgccgcgggagacgccggcccgggtgcccacccgtaaaccgttccggctgcaccgggtggtcaagcgctga

SEQ ID NO: 3454 - DNA, 699 bp, Actinoplanes utahensis
atgcccgcttaccgtgcggtggtgtttgacttcttcggcaccttgacccgctcggttcagcgtggtccacagcacgccgacatcgcccgggcgctcggcgccgatcccgaggcggtgctgggtgtgctgaaccggacgttccgggcccgggcctgtggccggtacgggtccgcggaggccaccctgcgctgggtgatcgagcaggccggcggccggcccggtccggccgcgatccgggcggcgatgccagcccgggtggacgcgctgcgcgccgacacccggttgcggccggacgcggtcagcgcgctcaccgagatccgccgccgcggcgtgcgcacggcgctgatcagcgactgcacccacgagcttcccgccttcctgcccgggctgccggtggcgccgttgctggacgcccagatcttctccgtcgagcagggtgtctgcaagccggatccgcggatctacctggccgcctgccgggagctggacgtcgagccgcgggactgcctctatgtcggggacggcggtagccaggagctgaccggcgccgccgcggtcggcatgaccccggtccggctggccgctcacgacctggccgaccacctggtcttcgacgccgacacgaccttcgccggccgcaccgtgcggtcgctcagcgaagtcgtggcgctcctggaccgcaccccggccctggtctga

SEQ ID NO: 3455 - DNA, 1365 bp, Actinoplanes utahensis
atgcgctcatcagggcatccgatctccgcgcttacgggattggcgctggccgtagcggtgtgcgcggtctcctcgtcggccccgctgatcgccttcgcggcggcgtccgcgcccgcgctggcggtcgccttctggcgcaacgggctcgcctcggtcgcgctgagcccgatcgcgctcggcccgcgccgcgccgaagtgcacgacgcggtccgcggccgccgccgccgggccggcctgttctgtgtgctcgccggggtggcgctggccgcgcacttcggcacctggatgccgagcgtgcaactcggcacggtggccacctcgaccgcactggtcgccacccagccggtctggcagggcctcatcgccgcctggcagggccaccgaccgacggccgccggatgggccggtatcgccctggcggtggccggcgcggcctgggccaccggggccgacgtcggcgtctccggccgggccgtcctcgccgacggcctggcggtcctcggcgcgatcttcgcggccgtgtacaccgccctcggcgaacaggcccgcgcggcgctgagcaccacgacgtacacctggatctgttacggcgtctgcgccctgatcctgctggtcgtctgcctggccggcggggtgccactgaccggttacaccccacgggcgtgggcggcgatcctggccctggtcgccggggcgcagctactcgggcattcgatgttcaactatgcgctgcagcacacgtcggcgacgacggtgagcgtgctggtcctgctcgaagtgcccggtgcggccctgctcgcctggctctggctcgggcaggtgccacgcagcggggcgctgcccggcctcggcctgctggtggccggcgtcgcggtcgtcatcctgggcgccgcccgggcttcgcgccgcggtcccgtcaccccggccctcgccgacgaaccaccctcacctgaccgcccgcgccaccccaccaccgggccgggccgatcggtgaccgcaccaccgcgccgccgcgccgccgcgccaccgcaccgccgcgccgccgcaccgcgccacggcgaccccatcaccacgtcacgccgccgcaccaccgcgtcaccgcaccatcgcaccgccgcaccgcgccacggcgaccccatcaccacgtcacgccaccggtccacctcgccatccggtttcccctggagcggggctcgtcgagccctgggctcctgggcgacccgtgggcccggcaggcggctgagcgggcggggcctacggcgtactccgtccagttgtgttttgcccgaagcggccgaggagtggcgggtggaccgggagcgtcatctacaacggccgaatttccagaaatgtcgtcgtatgtag

SEQ ID NO: 3456 - DNA, 645 bp, Actinoplanes utahensis
atgcatcgggtgcggctcggccggctactcctcgccggggtgctcatgatcggcggctgcggtgagtatgagaccgctgaccagccggaacagatcggggcaaccggcgagtggcggacgccgggatgcgagttcagccgggaaccggagttctccgaacgcggcgggctgcggatgccgctgaccccggcgccgctgcgtgacgcgatggaacgcatcgagcaggccggccggcaccgcttcccggacagcttcgccggcctggaggtcgaccagtaccgggtgcgcgcgatcgtctaccgggtgccgcggctctccaccgaattcgacgacttcatccgccagaccgcggcgaacacctgcatcgtggtccgggacgccgcgcacgccgtcgccgagttgaccacctggcacgaccgggtcgccgccgacctcgccttctggcaggtgcgcggggtgcggatcgtgacgatcggcagccggcacgacggcgccggcgtggaggtcggcgtccgggaggtggcgaaagcgcgggccgacatgccggcctactacggcgccgacgctccgttgatcttcgtggagcaggggccggcgacaccgttcaccgacgggtgggtggttctgccggaacacgacgactga

SEQ ID NO: 3457 - DNA, 975 bp, Actinoplanes utahensis
atgtttgccccgggttcccggagcaggcaggatcgccgcatggtcttcgacgcccgctccaccggcggaacccctacgcggcgtgacgccacccgaccggccgacggccggccaccccggtccggtgtgcccggcacagacccggaccggccggtcgagatcacgcccgaggtggtcgaggcggagttcgaggaagcgagcgcggaggctgcggtgacactgcgtctggacgggaaggtcgcgctggtcaccggcgcgggcagccccgacggtatcggctacgcgaccgcccgccggctgcgtgacctcggcgcccgggtggcgatcgtgtccaccacgcggcgcatccacgaacgggccaccgaactcggcatcaccggattcgtcgccgacctcaccgacgaatccgaggtcggcgccctcgccgacgccatcaccgaccaactcggcgacgtcgaggtgctggtcaacaacgccggcctcgcgtcccgggccagccccgaggtcctccgcccggtcgcccagctcaccctcgacgagtggaaggcggaaatcgaccgcaacctgagtacggcgttcctctgcagccgtgccttcgtcagcggcatggccgaacggggctggggccgcatcgtcaacctggccgccaccgccggcccggtcaacgccctgcccaccgaggccgcgtacgccgccgcgaaagccggggtggtcggcctgacccgtgccctggccatggagctggtcgccgacggcgtcaacgtgaactgcgtggccccgggcacgatctacaccgcggcatcgacggtcaccgagatcaagcagggtctgggcaccccgatcggccgccccggaacaccggacgaggtggcggcggcggtggctttcctctgctccccggcggcttcgtacatcaccggccagatgctggtggtcgacggcggaaacagcgtccgcgaggcccagttccgctga

SEQ ID NO: 3458 - DNA, 408 bp, Actinoplanes utahensis
atgcgtagtgctcagcagatcctggcggacgcgaacgtgatcgcggtggtcggcgcctcgcgtgattccttcaagccggcgcacacggtgccgttgcagatgctgcggtacggctggcggatcatcccggtgaacccgttcgtcgacgaggtgttcgggatcaggaccgtgccgacgctggccgacctggaggaaccggtcgacctggtcgacatcttccggccggcgcgagatgccgtcgacgtggtgcgccaagcggtggccatcggggcgccggctgtctggctgcagagtggcatcgtctcggcggaagcgcggcagatcgccacggacgccggcatcgactacgtcgaagaccgctgcctcgccgtcgaacgcgccgtcggcaacctcagcaagctcacctga

SEQ ID NO: 3459 - DNA, 1932 bp, Actinoplanes utahensis
atgcgatggtcccacctgtcggccggcgccggcgacgactcgctcccggacagggcagcgcccgcggcttcacccctgccgctggcgctgcccggtgcgaccgtgcgcaccttcgacactcccgggttcgccggcatgacgttctacgagatccgcgccaagtcgctgatcaaccgggtgcccggggcctcgcaggtgccgttccagtggaccgtcaacccgtatcggggctgctcccacgcgtgcacctactgcctggccggcgacaccccgatcctgctggccgacgggtccacccgccgtctcgccgagatccgccccggcgacccggtgatgggcacgatgggcgccggcccgcaccggcgttacgtgccgaccaccgtgctcgaccactgggccaccagcaagcccgcgttccgcgtcaccctgaccgacggcacccggctggtctccagcggcgatcaccgcttcctcaccgaccgcggctggcgccacgtcagccccgccgagccgcaccagccggcgctcgcgatcggtgacctgatgtgcggggtcggccacttcgccgagccgcccaaggagtcccccgactatcaggccggctatctctgcggcctgctccgcggcgacgccgccagccgggccgcccgcgagggtgacgcctggatccgcgccgacggctatctcgacgacgtctccctccccgacgcgctgcggtggcccgagctgccgtccggcgagtggtatcggggcttcctgggcggcgccttcggtgcggtcggccgggccgagcggctggccctcagcttcgagagcaccgaccgcatctacctgcgctgggtcaccgaggcactgacccacctgggcctgaccagccgcaccccggtccgctgccgcgccgaccgccccggacgcgtcgagaccggccgcgacctgtgggcggcgctgcgcttccggcacctcaccggcgccctcgacgccccgctggacgcctccggggtcggggtccgcgccgaccgccggctcgccgtcgccgacatcgaggacctcggcctcaccctgccgctgctcgacatctccaccggcaccggcgacttcatcgccgacggcgtggtcagccacaactgcttcgcccgcggcacccaccggtatctcgacatggacccgggccacgacttcgacacccgcgtcgtggtgaaggtgaacgccggcgagctgatccgccgcgagctcgccgagccaggctggtccggcgccccgatcgcgatgggcacgaacgtcgacgtctaccagcgcgccgagggccgctaccggttgatgccgcagatcctggccgcgctgcgcgaccacgccaacccgttctccatcctgaccaagggcacgctgatcctgcgcgacctcgatctgctccgccaggccgccgaggtgacccaggtcggtctggccttctcggtcggcttcgtcgacgagcggatctggcgctccgccgagcccggcacccccagcccgcagcgccgcctcgacgcggtccgccgcctgaccgacgccggcttcccggtcggcgtcctgctggccccgatcctccccggcctcaccgacaccgaggagtccatcgacgcgaccgtcgccgccatcgccgccgccggcgccacctcggtcaccccgatcccactgcacctccgtcccggcgcccgcgagtggtacgcctcctggatcgcccgcgaacacccccacctgatcccccgccaccgctcgctgttcgccaacggcgcctactccccgcgctcctaccaggacgagctgaccgctcgagtccgcatggccgcccgccgccacggtctgcaccgcccgactccgggtcagttccgcacgctgcccacctcggaggaggtgccttccacgccgaaatccgaccagctcacgctcctctga

SEQ ID NO: 3460 - DNA, 414 bp, Actinoplanes utahensis
atggcgacggttgcgctgaccacagcgaacttcgacgaggtcaccagctcggacggcatcgtcctggtcgacttctgggccagctggtgcgggccctgcgtgcgcttcgcgccgacctacgagcggtcctcggagaagcacccggagatcaccttcggcaaggtcgacaccgaggccgagcaggagctcgccgccaagttcgacatccggtcgatcccgacgatcatggcggtccgcgacggcatcgtggtgttcgcccagcccggcgcgctccccgagtcggccctggagagcctgatcgagaaggtcgagcagctcgacatggacgaggtgcgcgagcaggtcgcggcccacaagaaggcccacgagccgaaggcgcagagcaccggggagcccgcccgcgcggcgagctga

SEQ ID NO: 3461 - DNA, 633 bp, Actinoplanes utahensis
atgactgcgggcgaggaccaatccaccgaggtcggcgtcggcccctggcccggtgatcggcccgacggcgcgcactacgaccccgaactgctggagcacggcgaccggcgcaacgtggtggatcgctaccggtactggacccgcgaggcggtgatcgccgatctggacacccgccgccacgacttccacatcgcgatcgagaactggcagcacgacctgaacatcggcaccgtggtccgcaatgccaacgccttcctcgccgccgaggtgcacatcgtcggcctgcgcaagtggaaccggcgtggcgccatggtcactgaccgttaccagcatgtccggcaccatccgacgatcgaggatttcgtgggctgggcgaccgccgccggtctgccggtgatcggcatcgacaacctgcccggatcgcgcccgatggagaccgtcaccctgccgcgccgctgcgtgctgctgttcgggcaggaggggccgggtctctccgacgtcgcgcgtcacgcctgtacgcagttgttctcgatcgcgcagtacggctccaccaggtcgatcaacgcgggtgtggccagtgggatcgcgatgcacgcgtggatccgggcgcacgccggcccaccgcccgcctga

SEQ ID NO: 3462 - DNA, 663 bp, Actinoplanes utahensis
gtgagttgccccagatgtgctgatcaggtccggaagccggatctgatgcacagtaactggcgttgcgacaactgtggcgacgttccgccgttccatgtcgccgagcacatcagtgcggagatcgtcggaacggtgctgcgggagtcggcgtcgggcgccgagcggatgccgctctggggcccctggccactgcccgccgggtggacggtcaccggggtgggctgggccggcgacgaccgttccggggtgcgcgccaccgcgctcgcctgcagtgggccggagccgctcggcggcgggccggccgatctggtcttcatcgccgagcagccgggggtgggcctgggcacccggttcgccggcatccccggcatcgatcccggttacctgctctccgagacgctctccgactgcggggtcaacggcggtccacacgcgaagatcaaggtcggcgggcacccgactccactatggtgtgtcaagtcaccggaggatcgaagcgcgtacgtgagtgaggccaagggaatctggctctatgcggtagcgtggcccgcaagcgcgggctatctcctcgcggagcacgtcgtcctgcacgatctctccgacggggtgccagccgagctggtgttcggagcgccctcgccgtacctgcacggtcgtgtctga

SEQ ID NO: 3463 - DNA, 159 bp, Actinoplanes utahensis
atgatcaagaaggtgctcacctggcttggtattgcgttcttgatcttcttcatcgcattcaacccgagatcggcggccgcggtcttcgagtcactcgggggcacgatcgcggacatcgcacgaggcttcggcacgttcttcaccgacctcgtcgcatag

SEQ ID NO: 3464 - DNA, 816 bp, Actinoplanes utahensis
atggatcctggtgagccgcgcgacccacggggcgagggcgcccagcgccctccggacgacgacgacgccttcaggtatcgggaccccgccttcgaggacaccgatcccggtcagacgcgtgccgagacctatccggacgacgagcgcttcgctcatcaggcgcggcgtgccgacgagtacgacgatcccgatcagtacgaggcgccggtcttcaccgaggaggagctggaaggcctcgaccgtggcggcggcccgcggcgcttcctccccctggaggacgaaccgaccacactggtcgcccgctatctgttcccgaccgagcgttaccgcggtgagtggaagcggcactggatccacctgtccctgccgctgagcgtcggtgccggtgccaccctgctgctgggttatctggccggcttcctgacccggcagaacgtggacggcatggtcaccgtcgcggtgctgatctggctcggcgtgatcagctgggtggcgtggaaggtcttcgactggtatttcgaccgcttcatcctgaccaacaaacgggtgatggtggtcaacggcatcgtcacccgcaaggtggcgatgatgccgctgctgcgggtcaccgacatgaaatatgaacaatctgccctcggccggatgctgagctacggcacgttcgtgctcgagtcggccggtcaggatcaggcgctgcgcgaggtcaagcacctgcccaaccccaacgagctgtacctgcgggtggtcgaggagatgtacgagccgcaggcggtcgaggcgcggctgggcaaggacgatgagggagacgacgcctga

SEQ ID NO: 3465 - DNA, 756 bp, Actinoplanes utahensis
gtgatggcgatcaccgaccacgacaccaccgggggctgggccgaggcggccgcagcccggccggacgggttgcggctggtccgtggcgccgagctgtcctgccgctggcacggggtgcagccggggatctcactgcatctgctggcctatctgttcgatccggacgatccggcgctgaccgccggcatgctccggatgcgcgccgaccgggagcagcgggccgagcagatcgtggacctgctgcgcgccgacggggtgccgatcacctgggccgaggtgcacgggtacgcggcgggtggctcggtgggtcgtccgcacatcgcgcaggcactgatcagagccggtctggtggacacgacgacggaggcgttcgcgtcggcctggctgggcgcgcggtacttcgtacccaaattggatcttgatgtttttgaggctgttgaagcggtgcgagcagccggtggggtagcggtcttcgcgcatccgcgggcgaccaagcggggccgggtggtgccggacgagttgatcgtcgcgctggccgacgcgggccttttcggacttgaggccgaccatgaggatcactcgcccgaggagcgcgagcagatcagggcgctggcggatcggctcgggctggtcgtcaccggaagttccgattttcacggtacgcacaagacggtgcgcctgggagccttccagaccgcggtggaggtgtacgacaagatcgccgccgccgccaccggagttcccgttctcgggtga

SEQ ID NO: 3466 - DNA, 618 bp, Actinoplanes utahensis
gtgaatgtcaagctgttcggcgagttctacgtgaccctgctggtgatcgtcgatccgcccggcatggtcccggtcttcctggcgctgaccggcgccctgcccgcgaaggcccgcaaccgggccggcacccatgcggtgctgctcgcgctcggtgtgatcgtcgggttcgcagttgccgggcagaccctgctggactacctgcacgtgcggctgccagccctgcaggcggccggtggcctgctgctcgtgctggtcgcgttgcagctgctcaccggcaagaccgacgagcctgaggagcaggccggcaccagcaacgtggcgctggtcccgctcggtacgccgctactggccgggccgggcgcgatcgtggccaccatgctgttcgtgcagcggtacaagagcctcgacggatacctgatcctgggcgccgcgatcctggccgtgatggccaccgtgtggctggtgctgcgcttctccgggctgatcgtgcggctgctgcgcccggccgggatcgaggtgctcacccggatcgccggtctgctgctcgcggcgatcgcggtgcagctcatcgcggacgcgatcttcgccttcgtgcagttgtacgcgccgcgcctctga

SEQ ID NO: 3467 - DNA, 882 bp, Actinoplanes utahensis
gtgccccccaccaggaatcgcgccgccgtccccgagcagctcggcttcgccggcatgcccgagcgcctgttcgtctgcaccccgagcaagctcggggcatacctcgactgcccacgacgatatcgatattcgtacgtcgatcgcccctcgccgcccaagggaccgccctgggcgcacaactcgctgggcgccagcgtgcacaccgcgctgaagaactggtatgccctgcccgccgagcgccgcgagccggacgtcctgcccaccctgctgaaaagcacctgggtccgggagggctaccgggacaccgagctggagcgcgccgcgtaccgcaaggcgctgacctggctggagagctacgtcgccaccctggacccggaggacgagccgctcggcgtcgagcgggtggtcgccgccaaaaccgcggtgctcgcgctgaacgggcgggccgaccggatcgacgcccgggccggtgagcaggggccggaggcggtgatcgtcgactacaagaccgggcgcaccgggctggacgccgacgacgcgcgcggatcccaggccctggcgctgtacgcgtatgcggcgcaacgggtcttccgccgcccctgctaccgggtggagctgcaccacctgccgaccgggacgatcgccgcgcacgagcacaccgacgagtcgctggcccggcaggtccggcgggccgaggagaccgcgcaggacatcatgaccgcggagaaggcggtggccgccggggccgatccggacgaggtgttcccgaccaaccccgggtcactctgcgggtggtgcgacttccgcaaggtgtgcccggccggggcgcaggtggcggccaaggagccgtgggccgccgtcgagcacctgggcgccgcctag

SEQ ID NO: 3468 - DNA, 897 bp, Actinoplanes utahensis
atgagccgatcgcgtgatgcccgggtacccggtgaccgtgatgaccggacacccggcgatatgggacttttcggacctgattcggtcacctggaaactgcatcgggagccgatcctgatgctgggcgggctgcgctcgctctacatgcaggcgctgcacccgcgcgcggtggccggcgtcgcccagaactccggctaccgcacggacatgtggggccgcctgatccgcacgtccggttacgtcgccacggtgatctacggcagcacggccgaggtgaccgaggcgagcgcccggctgcgacggttgcatgccgggatgcgcggggtcgacccgcgtaccggcgagtcgttccggatcgatgatccggatctgttgcgctgggtgcacgtggccgaggtcgagtcgttcctgaccaccgcgctgcgggccggggtgcggctcaccccggacgagatcgacgcgtactacaccgagcagttgcgggccgccgcgctggtcggcctggacccggcgaccgtgccgggcaccgccgccgaggtcgccgacttctatgcggcgatccgcccggaactgggcctgaccagggatggcgcggaggccgcgatgcttctgaccgtcccgccgatcccggacagctggggcaaccgggcggtgcggctcggcctcaccctcggcccgacccgctgggcctatctgagcctggcgagcacggcgatcggcctgctcccaccctgggcgcgcaggttgtacggcgcgcccggctggccggtcaccgacctggccgccggcctgtccgcccgcggcctgcgcaccctgctcgccggagtgctggcggtgctcccggacgaataccggatctcccccgcccagcgggccgccctgcaacgcgtcggctag

SEQ ID NO: 3469 - DNA, 432 bp, Actinoplanes utahensis
atgtccaccggtgaagagctgctgcgcacgcatggcctgcgggtcacccgccctcggctggccgtgctcgaggtgttgaccggcggcggccacctcgaggtggacgacatcgccaggcaggtgcgcacccggctcgactcggtctccacccaggcggtctacgacgtgctgggcgctctgtcccgggccggcctggcccggcggatcgagccggccggcagcccggcccgctacgaggcgcgggccggcgacaaccatcaccacatcgtctgccgcggttgcggcgcgatcgccgacgtcgactgcgcggtcggcgagcgtccatgcctgacgccgagcgacaaccacggcttcagcctcgacgaggccgaggtgacgttctggggtttgtgcccggactgccaggcgcgccggctcgccgagaccgcatga

SEQ ID NO: 3470 - DNA, 474 bp, Actinoplanes utahensis
gtgttcgaccaggtcaacggcttacccgtccatgctctcgtgctgcacgccgccgtggtgttcgtgccgctgctcgccctcggcgcggtcgtctacgcgctcgccgcggcgtggcggccacggctcgggtgggcggtcgcgatcctcgcggtggtcgcgccgctctccacgttcgtcgccaaggaatccggtgagaagctgtacgaccggctggcgtcgcacggtctcaagggcaagggcctggagatcctcaacgatcatatggactacgggtcgatgacgctctggttcgccctgggtctcggcgtggtgagcctggtgctggtgggtctgacctaccggggtgggcgccggctgccgctggtggcgaacgcggcgttcgccgtggtgatcctcgcgctggcggtgggcagcgggtactacatcttcaagaccggtgactcgggggccaccgcggtgtggggcagttactga

SEQ ID NO: 3471 - DNA, 393 bp, Actinoplanes utahensis
atgtccacgtctagaagggtaagccgacatcgcttcggccgtcgtccccctccggctgtaccgtcggtgaacgtgagttcccccgacgacgacgcgttctggcagcggcccgatccgggcgccccctcgctcagcgggccgcctcagcaacggccggccacgcccgcggaaccggactatccgggcccgccgcgcgccgacccgccgcccccgcactggcggccgccgaccatcgccacgccgcccccgccacgcgccatgccggctcaggacatggacgccatcgacgaggcggagggtgccgcgcggaccgtgacgtacggggtcggcctggtcgccggcgccatcgccctgatcctgatgtgcctgctctgcggccgcgccctgctgtga

SEQ ID NO: 3472 - DNA, 180 bp, Actinoplanes utahensis
gtggacatcctggacggccccgagcgggacggtgacgccgagcgggtggtggacttcgagtcggaggaggctccgctgctgcccgaccagactcgggacgacaccgagcgtggctggggcgagcgtgactactccaacgacgatcgcctgctcgacgatcgtccgccgcactgggattga

SEQ ID NO: 3473 - DNA, 507 bp, Actinoplanes utahensis
atgggcagatcccgggaacgtctggatccggtgcgctggcgtgcgccgggccgtggctccctgctgcgactcaccgtgatcaccgcattgctcgccacggcagcggcagcggtcctggtctggtcgcgttccccggggacgtcctgcacgaccgcgggcccggcaccggcgaaacgatcgagcagcccccgagctccggtccgcccctccgcctccccggccccgcaaggcaggccaccgatcccggacggcaccgtcggcgtaccggtgcgactggccgacccgaccgccctggccctggttcaccccggcaaccgggtcgacctcatccgcctgggtgaccgggcggacggcaccccgatcgccagcgccgccttggtcctcgacgtgaccggcgccgatgacccggcaagcggcggtctcctgctggcgctcggcccggctcaggcgcagcgggcgctcactccaccgggcagcggcttcgccatcctgatccggcccggctga

SEQ ID NO: 3474 - DNA, 387 bp, Actinoplanes utahensis
gtgccagcagccgacagatccggaggagccgtgcctacctaccagtacgcctgcaccgagtgcggtgagcagctcgaagccgttcagtcgttctccgacccggcgctgaccgaatgcccgaactgccacggcaagctccgtaaggtgttcaactcggtcggcatcgtcttcaagggctccggcttctaccgcaacgactcccggtcgggcagcgtcagcgccgagaagtcgggcggctccggcgacaccgcgaaggacacctccaccaagtcggagagcacctcgaccgccgccgcgccggccaccacgaccacgagcagcgccccgtcgacatcctcgtcgaccaccagctcctcgtccggcgcgaaggccgccgccgcctcctga

SEQ ID NO: 3475 - DNA, 615 bp, Actinoplanes utahensis
atgtcggatttagccggtcctgcggaaaaatcaccctttgacaagatcactctgcgcacacaactactcaccgcacgtcgatcacgatcggccgccgaccgagccgtcgccgccacccaacttcacgatcacattcttgccctggtacggcgcgccaccccccgaaccatcgccgcgtatgtcccgtcgggcccggagcccggcggccccaccctgcccgacctgctgcgggccgccctcccgcccggcggccgcctgctcctgcccgtcctgctgcccgacaacgatctcgactgggcggagtacaccggctccctaacccccgcctcgcgcggcctgcacgagcccaccggcccacgcctgggcgtcaccgcgctcacctcggccgacctcatcctcgttccggccctcgccgtgggccgcgacggcattcgcatgggtcgcgggggtggctcctacgaccgcgcgctgtcccgcctgccctccccgggcccgctggtggtggctctgctccacgacggcgaaatcctcgaccgggtcccgtccgagccccacgaccgcccggtccacggcgtgctcaccccgtccgccggcttcatcgcctgcccggcctga

SEQ ID NO: 3476 - DNA, 2373 bp, Actinoplanes utahensis
gtgacattacgtggccggctcaccagcgccttcctggtggtcgtgctcggtccggtcctgctcgggtccatcttcgtcgcgctcaccgtctccgcggtcggccgggagcggacgaacgagcgcctcgaccatgccgtgacgaccgtccgggccgctgtcggggcgatctgcgggcagcttcaggcggccgccgacgcggtggcggtggtgccggcggagtcccggtccacggtcgccgaccagctgatcgatcgcggtctggccggggacatccgcgtcgatgacacgcgcccggcggcctcggggacgggtgacccgacgggcgtcgaggggccgggcggtccgagcgcgacggcccggggtgcgggtggcccgatcgggttggcccggcgctccggggtggcggcggcaccggaagccgcggcgccgccggtggtgatcgctcaggacggcgccgggctcgcgaatccggtcgggtggcaggactgcgccgcgccgcgcggcgggacgatcaccgcgctggccgcatcggcccgggccggggagatcaccgtggtcgccgcccagcgggtcgacgccgagctgctgcgccggttgggggagagcgcgggagtcaccgtcgctctcaagcttccggagaccgattcccggcagagtgacggcgagctcccggcgagtggtgatccgcaggctggaccgaccaacgggagtggtgatccgcaggcggggctgccggccgggggcagcccgggtgccgcagcgggaaggacgggcgactccgggcagcccggagccgggacgaccgggacggtgggggaggccgcgagccggcgggtggagccggcggcgggtcagccgctgccccttctgctcagtgccccggtggggcgcagtggcttccggtatgccgttctgccgctgatcgtgttggtcacggcggtgctggcggtgatcgccgcgcggtggctggcgcggtcgacgacgcggccgctcggcgagctcgcgtgggccgcggatcgggtggccaacggggacctggacacccgggtgccgatcccgcggccggatgagttggggcggctggcggggacgttcaaccggatgacccgggagctgcagtcctacgtgcaggcgctgaccgcgagccgggaccagctgcggcggcacctggcgatcctcggggacaccctgtccagcacccatgatctggaccggatcctgccggtgatcctgcgtacggcgatgaccaccaccggagcccgggccggactggtgctgctggtggatccggcggacgggtcgctgacggcccgctgcggcgccgggctgaccggggactgggatctgccgccggcggaactggtgaagcggcggctggccccggcacggggggtgctgggcgtggtggccgcctccggcgtcgccctgcgaggggcctccgggggcccgagccgggccgcggacgccgcggacgcaccgtcgggtggcgcgtctcacgtggccgggggagtcgttccggacgggccggtggcggtggtcgccgaggagccggtgtgcgagtcgtacctcgcggtgcccatctgtgcgccaccggtgggtgacatgttgctggacgaggcggaggccgggccggggacgctgggcgtgctggccctctatgaccggctggggagttcctccttcgacgatgcggacctgcggactctccggaccttcgccgggcaggccggggtggcggtgcgcaacgtgcgggtgcacgaggaggcgcagcggctgtcgctgaccgatccgctgaccgggctgtggaactaccgctacctgcgcgaggtgctgcggcgtgaggtggagcgggccagccggttcgggcggatgctcaccgtgctggcgctcgacctcgaccacttcaaggaggtgaacgacacgtacgggcatccggcgggtgatcaggtgctgggtgagttcgcgcggcggatccggatggggttgcgcgaggtggacgtggcgttccggcagggcggggaggagttcgtggtgctgctgccggagaccgacgcgtacggcggagtgatcgtggcggagcggctcggcgccctggtccgggaccggccggtcgtggtcgacccacggcgtccggggcaggccgaccggatcccgatcagcgtgtccatcggcatcgcggtcttcccggagcatgcggacaccgcccagggcgtgctcgatgcggcggacgaggcgctgtacgcggcgaagaacgcggggcgcgacacgtatcgtctcgcggagagcgtttcgtcccgaacggtcgaggggaatttcgctcccgcccccgccgggagcgggccgcaaccgccgcggcacggttccggccgatag

SEQ ID NO: 3477 - DNA, 912 bp, Actinoplanes utahensis
atgacgacgaacgcgcaagggtcgggcaagcgcgcggtgaaagcagtgattccggcggccggcctagccacgcgtttcctgcctgccaccaaagccgttccgaaagagctgctgccggtcgtcgaccggccggtcctgcagtacatcgtcgaggaggccgccgcggccggcatcaccgacgtgctgctggtgaccgggcgtggcaagacctcgatggtcgaccacttcgaccgtcgccccgacgtggagcagcggctggaggagaagggcgacaccgagcggctcgccgccgtccggcgcaccagtgagctggccgacatctacacctgccgacagggggagccgctcggcctcggccatgccgtcgggaccgccgcctcgcacgtcggggacaacccgttcgcggtgctgctcggggacgagttcgtcgaggagggcagcccgctgctgcccgacatgctcgacctgcaggcccgcaccggcggcatcgtgctcgccttcatcgaggtcaccccggaggagacgtcgcgctacgggatcgcctcggtgcgggagtccgacctgggcgagggcgtggtcgaggtgaccggcctggtggagaagccgtcgccggaggaggcgccgagcaaccttgccgtggtggggcggtacgtgctgcctggcaggatcttcgagacgatcgccggcaccaagccgggcagcgggggcgagatccagctgaccgacgcgatggcgacgctgctggccgagggcaccccggtgcacggcatcgtctaccgcggtgtccggtacgacaccggccagccgctgggctacctgcagaccgtcgtccagctcgcggctcagcgtcccgacctgggtgccgagttccgggcctggctcaccgacttcgtcggtggtcagaagggatga

SEQ ID NO: 3478 - DNA, 1311 bp, Actinoplanes utahensis
atgaccgctacggccgatgccgaggcggccgccaacgagctgatgcctctcgccgagtacctgggcagcgtgctgcgcaggttgcggacgctgcctccgctcgacctcgacctcacccaggcgcacgggaacgtgctcgcggccgacgtgatcgcgccgcacccgttcccggcgttcgaccaggccgcgatcgacggatacgcggcccgctgggaggacctggccggcgccgggcgcctcggcgcgcacccggcgttcgggcagcccgagcacccggcccgcggcgtccggctgaacgtggtcggcgacctgggagcggccagctggcgtccggtccggctgaccgcgggcacctgcttctcggtggcggccggggcgccgctgccgatcggggccgacgtggtcgttccggtgcactggaccgaccagggcatggccgcggtggagatcctgcacgccccgaaacgcggctccggggtgcgccgggccggtgaggaactggccgtcggtcaggtgctggccgccgccggggcgtacgtcacccccccgatggtggccaccttcgccgccgccggcatcgggcacgtgctggtccggcccagcccgcgggtggtggtcgtggccaccggcgacgagttggtcgacgtgggccggcccagccagccggggcaggtggtcgacgcgaactcgcacgcgctgaccgcggccgcggtggaggcgggcgcgctggcctaccggatcggcatctgcgacgacgacccggaggggctgcgcgggctgctcgaggaccagaccctgcgggccgacctgatcatcacgaccgggggcaccggtaccgggcccggcgacatgctgcgccgggtgctgtcccggcccggcaccggccgtggcgtggtcgagttcaccgacgtcgcgctctgcccggggaccgcgctcggcttcggcacggtcggcggcgaggaggtcccggtggtgtgcctgccgggcgagccgggcgccgcgctgatcgggttcgaggtgcttgcccggccggcgattcagctgctcgccggtgccgagccggtgttccggccgagcgtcaaggcgcacctgctggagaccgtctcgtcacccggtgggctgcgcgagttccgcccggcgcacgtcgcggaacgacggggtggtggttacaccgtgcagccgctcgccggagggccgtacactctgtccggtttggccgaggccaacggactgctggtgctcggcgagcgggtcaccacggcggcggccggctcgaccgtggacgtgttgctgctcgaccggaggcgatga

SEQ ID NO: 3479 - DNA, 636 bp, Actinoplanes utahensis
atgctcggggcgacccccggctggcccgctgtgctggcggacgggccggtgttgctgcggccgtaccagcgctctgacgcacgggcctggtccgaggtgcggatcgccaaccagacctggctggcaccctgggagtcggcgccgcccggaccgtgggcggagatgaactcgacccgggcgtacgcgtacgtgtaccgcgacatgcgccgcgccgcccgccgcggggacagcatgccgttcgccgtctgcctgctcgagggcggccgggaacgcctggtcgggcacgtcaacctgggcagcatcgtgcggcgggcgttcgcctcggcgtacgcgggctactgggtcgaccaccgggtggccgggcgcggcgtgatcccgaccgcgctggcgctcgccgtcgaccacgcgttcggtccgggcgggctgcaccgcatcgaggtcaacatccgcccggagaacgggccgagccgccgcgtcgtggagaagctgggcttccgcgaggaggcgtaccaccagcgctacatgcacatcgacggcggctggcgggatcatctggggtatgcgatgaccagcgaggaggtggccgccgagggcggcctgctgtcccgctggaaacgagttcgcagcagtaagtga

SEQ ID NO: 3480 - DNA, 264 bp, Actinoplanes utahensis
gtgccgacctcggtgctcctcgccgtcctcgccgcggccgggctgctcgccctcgccccggcgctggttcgccggtacgacgccaccgagcgcctcgccgcggaacgggcgtcgtcgacggcgcgggtgctccaacgccagcgccggcgtcgcaccgtgcccggacgccgaccgatcaaccccgggcgccgggttacggttacgctgcccgccccatcgggtgaaaaaccgccggcacccccgcgccgcctgcgcctggtctag

SEQ ID NO: 3481 - DNA, 126 bp, Actinoplanes utahensis
atgggcctcgaccgggaaccctccgacctgccggtcgccgcgaacggcggctcggtcagctaccgccgccgcggcggtctgcgcggccgcccctacgaggccggcggccgccaccacaccgcatga

SEQ ID NO: 3482 - DNA, 606 bp, Actinoplanes utahensis
gtggggtatctggccacggcgcaggagggcgcgtccggcagcgaggcgggtgtgcccccgcttttccagattgcggaggtgcggcagcagctccaatttcattcaccggtgtacgtcggcttctacctcaagccacctaaagctggttccgtcggcgacgtcgaccttgacgaccaggtcgccatcgtgatcgcggaacacatccgcaagcacccgcccgtgaacgtccagcttccggacatcacagaaggcgctcctgatcaaggacgacccccaactcggcgagcggttccgctgctattcacctcggagcagggcctacccatccacgacaaggcctgggccaagctttggacgcagtggcggaaggccgcagaagggcccgcagccggcactttccactcactacgccacttcttcgcgacgacgctcatcgaccaggcggttgagcccacagaggttcagaaggccctacggcacgccagcttgaagctgacgctcgagacctacgtgcactggtggccgaaacaggatcgcagacgaagcgtgatcagcaccatgttgaagcggtttgctgaaaccaaccggaaggcagttggcgggtga

SEQ ID NO: 3483 - DNA, 510 bp, Actinoplanes utahensis
atgaacaccgacgagttcgcgtgcggcacctgcggctcgacacacggcggccccccgctgagcttcgccgcgccggccccggattcctggtcgccggacatggccgacaccgaaggctgcctgctcgactccgacctctgcgtgatcagtggcgaacggttcttcatccgcgggctcatcgagatcccggtctgggactccggcgacgtcttcacctacagcatgtgggtttcgctgagccacccgaacttcacccgcgccgtcgacgtctgggaacaaccgggccgcgaaacggagcgcccctatttcggctggctcgccaacgccatccccggctacgaccccaccacgctcaacctcaagacgatggtgcacacccgcccggtcggccagcccccgtacatcgagctcgaaccgaccagccatccgctggccatcgagcagcgcgccggcatcttccgctcccgcgtcgaggaaatcgccagctaccacctgcacaatgccgcatag

SEQ ID NO: 3484 - DNA, 1245 bp, Actinoplanes utahensis
atgaaagcacccctgcccgacaacgagatcgagcggctggccgcgctgtactcgctcgacatcctggacagcccaccggagaaggatttcgacgacatcgtcgcgctggccgccggcgtgtgcgagacgccggtctcgatggtcagcctggtcgacgcggaccgtcagtgggcgaaggccaagaccgggccggatctcaccgagaccgcccgtgacctgtcgttctgcgcgcacgcgatcctcggccgggatctgctgatggtgccggacgccagcgccgacccgcggttcgccgacattccggcggtgaccgcgccggacggcatccggttctatgccggcgcgccgctgatgaccaccgacgggttcgcgctcggcacgctctgcgtgatggacaccgagccgcgccggctggccaccgaacagcagcaggcgctgcgcgcgctggcccggcaggtgaccgcccaactggagttgcggcggtacgcgtatgccctggccaacaccacggcccggctgcaggagctggagcggcgcaaggacgatctggccggactcgtcggcggggagctgcggtcgtcgctgcggctgatgtcgacctatctggagaatctgggcgacaccggctaccacgacatggagctggccgacctggtcgggcgggcggcggcggcgcactgccgcggcttccgggagctgatcgaccacctgacccagatggccgaggccggtctgggcggggacagcctgcacatgcggcaggtggatctgacccgggtgacgcagcgggcggtggaggcggtccggccgatcgcggccagcaagcacatctggatcctgaaccaggccggtgggccgtcgctgccgatcatcgccgatccggtgcggctggagcaggtgttgacccacctgctgttcgcggcggtgaagtacacgccggagggcggccgggtgcgggtcggcaccgagatggagtcgggtccgacggtgcgcctcgacgacatggatctgcccgacgggatgcggcccgacctgttcccgcacctgtactacggcgcgatcgcgaacccggcggacgtgcccgggccggaccgggggctggcggtggccaagcggatcctggacgctcaccacgcgacggtggcgctctccgaccggccgggtgacgggacgtcgctgcacgtggtgttcccgtacgcggacctgaccccggacgagctgatccgcgacctggccgtggcctga

SEQ ID NO: 3485 - DNA, 2334 bp, Actinoplanes utahensis
gtgagcggcacccggcggcgcatcctgccccgcccccgggtcatgctcggcaccctgctgctcggcctgttcgtcgccgtgctcgtggtgcaggcgtacatcaactccgaattcaccgccgaccacaaggagaccgaggtcggcgaccagtccggcgttccgctggcgatccgcggcggagggccgatcgtcaacaccaccggtggccaggagagcaccagccgcctgccggaccgcaccattgcgctgaccttcgacgacggacccgatccgacgtggaccccgaaggtcctgcaggtgctgcgcgacaacgacgcgcacggcacgttcttcgtcgtcggctcccaggtcgcccggcacccggagctcaccaagcacatcgtcgacgacggcaacgagctgggcctgcacaccttcacccacccgaacctgcagctgctcgccccgtggcggcggcacctggagctgtcgcagaaccaggtggcgatcgccgaggccaccggcgtgcacaccaacctggcccggttcccgtactcgtcgaagaccgaggcgatcgacgaggacaactggaagatcgtcaaggaggcggggcagtccggctacctggtcatcctcaacgacctggacagcgaggactggcagcgccccggcatcgaccagatcatccgcaacgccaccccgctcggcgacacctcggcgatcatcctgttccacgacgcgggcggcgaccgcgcgcagaccgtcgcggcgctcgcccgattcatcccgatgatgaaggctcgcggataccgcttcaccaccgtcaccgagggcctcaacctgggcatcgagcagcaggccgcgcaggtcaaggcgggccgggccgcggagagcgccacggtcatcccgacgctgccggagaacccgccggccccggccggcgacgtctggcgcggcgccgccctgatcaacacggtgcggctcgccgacgggctggtgaccgtggtggccgcgctgttcgtcgtggtcggcgcgctgaccatcggccggaccgcgctgctgctcctgctcgccggccggcacgcccggcagcgccgcagaccgggatggagctggggcccgccgatcaccgacccggtgtcggtgatcgtgccggcctacaacgagaaggagggcatcgaggcggcagtcaaatccctggcccggggcgactacccggagatcgaggtggtggtcgtcgacgacggctccaccgacggcaccgccgacatcgtcgaacggctgcggatcccgaacgtccgcgtgatccgggtgcccaacggcggcaagtccaacgccctcaacaccggcatcgccctggcccgccacgacctgatcgtcaccgtcgacggcgacaccatcttcgaacaggactcgatccgccggctggtgcaaccgttcgccgaccccacggtcggggcggtggccggcaacgtcaaagtcggcaaccgggccagcctggtcgccacctggcagcacatcgaatacgtgatcggcttcaacctggaccgccgcctctacgagacgctgggctgcatgcctaccgtgccgggcgcgatcggcgcgttccgccgcgaggcgctcgccaaggtgggcggggtcagcgacgagaccctggccgaggacaccgacgtcaccatggcgctgtgccgcgacggctggcggatcgtgtacgaggagcacgccaaggcgtggaccgaggcgccgaccaccctggagcagctgtaccgccagcggtaccggtggagttacgggaccatgcaggcgatgtggaagcaccgccgggcgctgttcgacaacggcccgtcgggtcgcttcggccgcgtcggcctgccgttcctcgccctgttcggggtggcgctgccgatgctcgccccggtcgtcgacatcatgctcgtctacggcctggtcttctgggaactgcaggagacggtgatcgcctggctcggcatgctcagcctgcaactgttcaccgcggcgatcgcgttccgctacgaccgggagccactgaaaccgctgtggcggctgccgctgcagcagttcgcctaccgccagctgatgtacctggtgctgatccagtcggcgacgaccgcgctgaccggcggccggctgcgctggcacaagctgcaccgggccggtctgaccacaccgtccgggccccctccggaacccgtggccaccacggtggccccggcggtcgagagctggccgccgaccgggcccgaggtgccccggcagcagcagccgaacgggcgggccggggcgccgccgaacgggtgggtgggcacgccgccgagcgggcgggcgggcacctag

SEQ ID NO: 3486 - DNA, 1641 bp, Actinoplanes utahensis
atgagacaccggaaaagtccaccacacgcccgggctccacttcaaagccaggcagcctacgatcgcggggtgacgacggcgacagctgagacagacctcacccccgcggatctccccgccgaggcggagccgtcccgtggcgtgcccgccctcatcaagcggcgcctgtcaaccctggacacccggctcgacccgtggtcgtggctggtcaccgcggtgatcacgatcgccgccgggattctgcggctggccggggtcagcaaccccaagggctacatcttcgacgaggtgtattacccgaccgacgcgtgggacatgctgcaccacggcgtcgaatgggacgagaagaccaacggcccggcgtacgtcgtgcatcccccgctcggcaaatggctgatcgcgctcggtgagcagatcttcggcaacaaggagctcggctggcggttcaccgccgcgatcgccggcaccctgatgatcctgatcctgatccgggtggcctaccggttgttccgctccaccgtgctggccggcctggccgggctgctgatgaccctggacggcttccagctggtgctctcgcgcaccgcgctgctggacatcttcctcggcctgttcgtgctgctcaccttcgcctgcatggtgctcgaccgggaccattaccggcgacgctgggaacgggccctggccgccggcttcgacccggcgaccacccaccggatcccgcggatcgtgccgtggtggctgctggccggcggcgtcttcttcggcctggcctgcggggtgaagtggagtgcgctgttcttcgccccgttcttcgccgcgatggtgaccgcctggcgctggcaggcccgccgctcggcccgggtccgcggtcccttcgtggccggcatcctcggcgacttcggctacctggttctcagcctaatcctgagcaccgtgttctacctggcgacctggaccggctggttcgtcaccgacaccggctacttccggcactaccggcaggccaacgggctcagcgagccgcccgtgctgggcgccctgctgaacctgatgcactaccactccgaggcgtacagcttccacagcggactgaccgagaaacacgtctaccagtcctggccgtggcagtggctgctgctcggccggccggtcgccttctactggaacggcaacggcaactgcggggcgtccagctgcgccgccgagatcctgctgctcggcacgccgatcctctggtggtcgttcctgcccgcgctgggcgcgctggtctggctgggcatcgcccggcgtgactggcgggcgtacgcgatcttctccggcgcgatggccagcctgctgccgtggttctacttcgcggtcaaggacggccgcacgatgttctccttctacctgatgcccgggctgccgtttctgatcctggcggtcgtctacgtcctcggggcgatcatgacgccaccgggtggaatggtgagcgggccggcacgcaccgatcggcagctggtcggcaccgtggtggtcgccacctacgtggtgctggtggcgctctgcttcgcgtacttctacccgatcttcgtcggcaagacgatgccctatgacgactggtcggtgcggatgtggctggggaaccggtggatctga

SEQ ID NO: 3487 - DNA, 762 bp, Actinoplanes utahensis
gtgtggtggacttttccggtgtctcatgacgaagcaggaccgggccgggtggtgctgaccggcgccccgctgggcaacatcggcgacgcgtcggcccggctgcgcgaggtgctggccaccgccgacgtgatcgcggccgaggacacccggcggctggcccggctggccaaggacctcggggtgagcgtccccgggcggatcgtctcctatttcgagggcaacgacgagcggcgcaccccggagctcatcgaggcgctggccggcggcgcgaccgtcgcggtgatcaccgacgggggcatgccgagcgtctcggaccccgggttccggctggtccgggccgcgctggacgccggctacccggtgaccgcggcgcccggcccgagcgcggtgaccaccgccctggccctctccggcctgcccagcgaccggttcgtcttcgagggcttcctgccgcgcaccggtgccaaccgccgttcccggctgcgcgagctcgccgccgagccgcgcaccctggtgctgttcgaggcgccgcaccggatcgccggggcgctcgccgacctggccgccaccttcggtgcggaccgtccgggcgcggtctgccgggagctgaccaagacgtacgaggagatccgccgcggcaccctggccgagctggccgcctgggccgaggccggcgacccgcgcggcgagatcaccctggtgatcggtggcgcgccggccggcccggcggcccggcccgccgacgacgagctgcgcgcctag

SEQ ID NO: 3488 - DNA, 984 bp, Actinoplanes utahensis
gtgaccggtaacgcgccgcagccagggaaaacaccagcgggagagccgtggggcgcggccgatcccccggacggctggtggcgcggcgaaaccgaccgggaaccgacctccctggagtgggcggaccgggcgcgcgaggccggcgcggacgacgccacccagcggctgaccgcgcccgggcagggcgaacggctggccacggccggcgagctgatgatcgtggagccgggacgaccgggcccggccgacgacgtaccggaaatggcgatcctgccggagccggacgaccgcaaccggcccaccattgtcctggaccagcagcgtccgccgcgcggaccgctgccgccgctgccggaaggcggcgtctcgccggcgaccgcgacccggctggaccggatggagaactcgccgttctggcagaccgacgaggcccggatcgtggccgaggcccgcaacgacccgcggcccggcaagcggcgccggcccccggccacccacccggtcggcgcgctgaccgcgctgctcgggctgagcctgctcgcggcgttcttcgcgtgggtcagcgcggagccgttctggctggccgtcgggcacggcgaccccgggtacgcgaccaccacgcactgtcacggcgacggcctcacccagcactgcaccggtcggttcgccagcgccgacggccggatcgcggtgcgccgggtgaccctgctcgggatctccggcggggcccgcgaacccggtgcggtggcccgcgcccggatggtcaaccgggacagcggccaggcctacgccgggccgcccgggatgctgctgcacctgcgctgggcgctgggcttcctgctggtgctgatctgcgggtacggcatcgccggcgcgaccggggcacgccggctggagtcgccgcgggcccggcgcggggcgctgctggccagcgtgctcgggccggtgttgctgctggccgggttcctggcggcggcctactga

SEQ ID NO: 3489 - DNA, 1884 bp, Actinoplanes utahensis
atgatcgggcgtgtcgggacaaatcggcagcgcggcaatccgttcgcgagctgcctgggcgggtcactacgcttaggcgtcatgagtcacgttctcgccgcggtcgcctggccctacgccaacggcccgcgccacatcggtcatgtttccggcttcggggtgccgtccgacgtgttcagccggtacatgcggatggccggccacgacgtgctcatggtctccggcaccgacgagcacggcaccccgatccaggtgcaggccgacgccgacggggtcaccccgcgtgagctcgccgaccggtacaaccgggtgatcgtcgaggacctgcacgggctgggcctgtcctacgacctgttcacccgcaccaccacccgcaaccactacgcggtggttcagcagctgttcgagggcctgcacgccaacggctacatcgtggcccgcaccacgctcggcgcgatctccccgtccaccgggcgcaccctgcccgaccgctacatcgagggcacctgcccgatctgcggctacgacggcgcccgcggcgaccagtgcgacaactgcggcaaccagctcgacccggagcagctggtcaacccccggtcccggatcaacggggagaccccgaagttcgtcgagaccgagcacttcttcctcgacctgccggccttcgccgaggcgatcggcgcctggctcgaccagcgggagaactggcggcccaacgtcctgaagttctcccgcaacctactcgacgacctgcagccccgggcgattacccgggacctggagtggggcgtgccgatcccgctcgacggctggcgtgaccgggccgacaagcggatctacgtgtggttcgacgcggtgatcggctacctgtccgcctcgatcgagtgggcccggcgcaccggtgacccgcaggcgtggcggcagtggtggtcggccgacgcccagggcaaggacgcgtccggctactacttcatgggcaaggacaacatcgtcttccactcggtgatctggccggcgctgctgctcggctactccggcgagggtgacaagggcggccaggccggcgcgctgggcaagctcaacctgcccaccgaggtggtgtcgagtgagtacctgacgatggagggtaagaagttctcctcctcgcgccgggtggtcatctacgtccgcgacttcctggagcgctacgacgccgacgcgctgcgctacttcatcgccgcggccggaccggagtccaacgacaccgacttcacctgggccgagttcgtccgccgcaacaacgacgaactggtcgccggctggggcaacctggtgaaccgatcgatctcgatggcggcgaagaacttcggcgagatcccgccggcactcgacctcactcccgaggaccatgccctgctggaggccgccaggaccggcttcaccacggtcggcgacctgatcgccaagcaccgacagaaagccgcgatcggcgaggcgatgaaggtcgtcgccgaggccaacaaatacctgtccgagcaggccccgtggaagctcaaggccgacgcggacaagccgcggcagggcaccatcctgcacgtcgcgctgcaggtggtcagcgacgccaacacactgctgaccccgttcctgccgcactcggcacagaaggtgcacgagctgctcggcggcaccggcgtgcacgcgccgatgccggagatccgcgaggtcgaggacctggacggcggccccggctacccggtgctgatgggcgactacacggtcggcgcccgctgggagtcggtgccgctggtcgccggcaccccgctgagcgcgccgaagccggtcttccgcaagctcgagccgtcggtgatcgaggaggagctggcccgcctcggcggcgacgcctga

SEQ ID NO: 3490 - DNA, 1035 bp, Actinoplanes utahensis
gtgaccgtgaccggtgaggacagtgagctgggcgccgacccgctcgacccacctctgatggcaccgctgcgccgtgacctgacctggcagcaggtgcagtcgatgagtcagtccgcggtgtaccgcgacgatgccacgctgcggcggatccgggagacggcggcggtgcgccgcggtacccggatgacgaagatcctgtcgccggcgcaggtggccgggcatctcggcggctggctgccgtacggtttctgctaccgctgctgtgacatcgcccacctgaccgagccggagcagctgaatctgctgcgcaccgatggcgcggtggacgggccggtggcgttcgggctgcgctggcgggccaccgacccgaccgatttcgagttgccggcctccccggcccagcccggactggccgcgctgccggcccactcgcgggtcggtgcgatggtgctcggcaccggtttcaccccgagcaccgacgacctgatcccggagtatgtgacggccggcttcgccgacctgccgctgccggccaatgcccagttggtggcgtacgtgccgggtggcgacgaggtggtgctgtacacctatcagccggagcagcacggctggctgcggctggccggcccgcgctggcgggggctgctcgaccagttgcccggggtcagcccggaccgggagtacgtgccgtgcaccgccagtggcaccgcgaagctggtcggctcgatcgacggcacggagtacgaggcggtcgccgacccgcccggtgagttccgggtgcgggcgctgacccgggccgcccgctatccggtgcagaccctgagccggcgggccgagcaggccctgtggcggggtgtgccgtgctgggtgctgcagcgcgacgagacctgggcccggctgcggctgctgcggccggacggcgaggcgttgaccgcgaccggcgcgcgctgttacgagcgtggggtgtacgaggcgtgggcgccggtcgacgagctggccgaccaccacatcgcggatctcgcgtaccagatgtag

SEQ ID NO: 3491 - DNA, 963 bp, Actinoplanes utahensis
atgaacggtcggttaccggaaaacgcgacgtgcagaatgtctcacatgccttcgagccctgcaccgtcggagaagcgccggcacaaggccgcgcgccgcgccggcgagttcccgcccgccccggacccgctggccgtgccggtcttcgacagccacacccacctcgacctgaccattcaggaggccggagtgcccggcggcccgtccgccgacccggtccaggcgctgatcgaagcggccgccaagaacggcgtcgaccggctcgtccaggtcggcgtcgacgtggactcctcacagtggggagccgacctcgccgaccgccacgatgcggtgctcgccgccgtcgcacttcacccgaacgaggcaccccgcctcaccgatctggacgaggcgctgcgccggatcgacgacctcgccgcccgcccccgggtccgcggcatcggcgagaccggcatggacaccttccgcaccggcgacgacggccgggccgcccaggagaccagcttccgggcacacatcgcgatcgccaaacgccacggcaaagccctgatcatccacgaccgcgaggcacacaccgacgtgctgcgcatcctcgacgacgagggcgccccggacaccgtggtgatgcactgcttctccggcgacgccgccttcgccaccgcctgcgtacgccgcggcttccacctcagcttcgccgggacgatcaccttcgccagcgccggcaacctgcgcgaagccgccgcggtcaccccgcccgaactgatgatggtggagaccgacgccccctacctcaccccggccccgcaccgcggccggcccaacgcgtcgtacctcatcccgctcaccgtgcgtgccctggccgccgcccgcggcatcgacaccgacaccctgtgcgccaccatctcggccaccggcgaccgcgtcttcggaccatggcgccggccggccggaccgcccgcctag

SEQ ID NO: 3492 - DNA, 888 bp, Actinoplanes utahensis
atggctgacgcactgctcggcccggcggagatccgggaactcgccgcacgcctcggcgtcgcgccgaccaagaagctcggccagaacttcctgcacgacccgaacaccatccggcgcatcgtggccgccgccgccctgcgccccgacgacgtcgccctggaggtcggccccggcctcggctcgctcaccctgggcctggccggcgccgtcgcccacgtgcacgccgtcgagatcgaccccaccctggccgccgccctgcccgccacggtcaccgccgcccacctcaccgtccacccggccgacgcgctcaaggtcaccggcgaccggttcgacccggcacccaccatgttggtcgccaacctgccctacaacgtcgccgtcccggtcgtgctgcacctgctcgccgaactgcccaccctgcgcggcggcctggtcatggtgcagaaggaggtcgccgaccggctggtcgccggtccgggctccaaggtgtacggcgtcccctcggtcaaactcgcctggtacgccgaggccagatccgccggcaaggtgccccccgcggtgttctggccggtccccaacgtggactccgggctggtcgccttcacccgccgcgaaccacccgccggcgtcccgcgcaccgacgtgttcaccgtcgtcgacgccgccttcgcccagcgacgcaaaaccctgcgcgccgccctggccggctgggccggcggcgccgccaccgccgaacagatcctccggcgcgccggaatcaacccgcaggcccgcggcgaatccctgaccgtcggcgagttcgcggccatcgcggcagcggcgaaaacgtcagagcacggcggtaagctcagcccatccggcgcacagcccgaggaggcgcaagcatga

SEQ ID NO: 3493 - DNA, 2745 bp, Actinoplanes utahensis
gtggggtccggacgacgacgagccgcgcccgtacagcggcccggtcaaggtccgcgtgccggccaaaatcaacctgcacctcgcggtcggcccgctgcgacccgacggctaccacgagctgaacaccgtctaccacgccatctcgctgttcgacgagatcaccgcccggcacggcgacaccctcaccctcaccatggagggcgagggcaccggcgacctcgccctcgacgagaccaacctgatcatccgcgccgcccgcgccctggccgcccgcgcccgcgtccccgcctacgcccggctgcacctgcgcaagagcatcccgctcgccggcggcctggccggcggcagcgccgacgccgccgccaccctgatcgcctgcgacctgctctggggcctcggcatgagccgcgacgagctcgccgaggtcggcgcccaactcggctccgacatccccttcctgctgcacggcggcaccgccctcggcaccggccacggcgaggcggtcagccccatcctggcccgccccaccacctggcactggaccgtcgccatcgccgacggcggcctggccacccccgccgtctaccgcgagctcgacaccctgcgcgccggcacctggccacccactccgctcggcagcgccgacaccctgatggccgccctgcgccagcgcaacccggaaatcctcggcgccgccctcggcaacgacctgcaaccggccgccctcgccctgcgcccccagctcgccgacgtgctcaaagccggcaccgaggccggcgccctcgccggcctcgtctccggctccggccccacctgcgtcttcctcgccgccgacgccacacacgcccaggagatcgccgacagcctcaccgaagccggcgtctgccgggccgcggtcaccgcccgcggaccccagcccggcgcgcgggtaatctagaccccatcgtggcgaacatcatcaacctggaccgggtcaacaagggctacggggccgccggtcagctgctcaccgacgtctccctcgggctcgacgacgacgcccgcgtcggcatcgtcggcctcaacggcgccggcaagtcgaccctcctgcgcatgctcgcgaaaatcgaggaacccgactccggacgcgtcacccaccgccgggacctgcgcgtcgccgccctcccacagacactcaccctggccgccgacgccaccgtgcgcgacgtcgtcctcggcaccgcctggctcgcccagggcatgggcgccgaacacgaatgggccggcgacgccggcgtgcgcaccatcctcgacggcctcggcatgggccacctcggcctcgacaccccggtcggcccgatgtccggcggcgaacgccgccgcgtcgccctggccgccctcctcgtccgcgacagcgacctgctcatcctcgacgagcccaccaaccacctcgacgtcgccggcgtcgactggctcgccacccacctgctcacccgcaaaggcgccctcgtcgtggtcacccacgaccgctggttcctcgacgcggtctgcaccatgacctgggaggtcgtggacgaacaggtgcacacctacgagggtggctacgccgcctgggtgctcgcccgcgccgaacgccagcgcgtcgccgccgccgtcgaagcccgccggcagaacctgctccgcaaagagatcgcctggctgcgccgcggcccgccggcccgcacctccaaacccaaattccggatcgacgccgccaacgaactcatcgccgacgtccccccggtccgcgacaccgtcagcctgcaacgcctggccaccacccgactcggcaaacaggtctacgacctggagcaggtcaccctcaacgccggccccaagccgatcttcaaagacctcaccttccaggtcggccccggcgaccggatcgccatcctcggcgccaacggcgccggcaagaccaccctgctgcgcctgctcgccggcgtcacccgccccgacggcggccgcctcgtcaccggctccaccgtccggcccgccttcctctcccaggaactccgcgagctgcccggccacctgcgcctgctcgaagccgtcgaagaggtcgccaaacgcgtcaaactcggcgaccgcgaactctccgccggccagctcgccgaagtcttcggattcaccgacaaacgcatctggaccccggtcagcgacctctccggcggcgaacgacgccgcctgcagatgctccggctgctcgccaccgagcccaacgtgctgctgctcgacgaacccaccaacgacctcgacaccgacaccctcgcctcgctcgaagacctcctcgactcctggcccggcaccatgatcgtcgccagccacgaccgctacctggtcgaacgggtcaccgacgcggtgtacggcatgttcggcgacggccgcctcgtccacctgcccggcggcatcgacgaatacctggcacgggtgcacggcacggcaccggccacccgcgtaccggccaatgaaccgcaagcggcgaccgccgccagcggactgaccgccagtgagctgcgccaagccaaaaaagacctggcccggctcgaacgccagatggacaaactcggcgagaaggaaaccaggatcaacgagagcctcgccgagcacggcagcgactacgaccggctcatcgagctggaagcccagctcaaagccgtccgacaggaacgcgaacaggtcgaacaggcctggctcgaactcgccgagcaggtgcccggaaactga

SEQ ID NO: 3494 - DNA, 462 bp, Actinoplanes utahensis
atggcgcatattccggtcaaccaccccctccggccgatgtaccgcctggccggtttcgtcgccggtgcctacctggtggtcttcggcatcatcggcttcgcacagaccgccggcgacaacttcaccggccacaccggcgaccgcgtgctcggccagagcagcaacctgctctggtcgatcatcagcctcgccgtcggagccctcgtcctgctcggcaccgtcgtcggccgcaacgtcgacgtcgccatcgacaaatacctcggctggggactcctcgtcctcggcagctacagcctggccaccatccgcaccgacgccaacttcttcggcgccagcatcgccacggtcatcgtgacctacctggtcggcctgctgctcatcacgatcagcctgtacagcaagaccgccgcacccgacaaggccggcgcgccgcgacaggtccgcgaaggacgcaccgcctga

SEQ ID NO: 3495 - DNA, 606 bp, Actinoplanes utahensis
atgtccgccgctcagcgccgtgagcagttgatcgccaccggccggcagttgttcgccgagcgcggctatgacgccaccagcgtcgaggaggtcgccgtccgggcgaaggtgtcgaagccggtggtctatgagcatttcggcggcaaggagggcctgtatgcggtggtcgtggaccgtgaggtgcgggcgctgctggagcggatcacggcggcgttgacggcgggtgatccgcgggagttgctggagcaggcggcgctggcgttgctggattacatcgaggaggagccgcacggttttcaggtgttgtcggcgcggcaggcgccggtgctggctccggcgaacacgttcgcgagtgtgatgaacgatgtcgcgcatcaggtggagcacattctgggtgcggagttccggtcgcgggggttggatccgcggttcgccgagttgtattcgcaggcgttggtggggatggtggcgctggtgggtcagtggtggcgggaggcgcgggagccgcggaaggagttggtggcggcgcatctggtgaatctggcgtggaatggtttgtcgcatctggagccgcggccgagcctgatcacccgcaagccctgctga

SEQ ID NO: 3496 - DNA, 882 bp, Actinoplanes utahensis
atgacgacgaaccggttccacagtgaggacgatcggcgggccgaggctcggaaactgcgcgtggacccgggcctgtcccggtcgcagctgatgaaaatgttcggcgtgggcaacggcacgctgaccgcgtggctccagggcctggagtcatccgaatggaccaagcggccgcgggcgaaggacaatctgcgcgagctggcgcgcgacctgcgggctcagggacggaccgtgccggaaatcgccgccgcgctggaggtgtcgaaatcctcggcttacctgtggacgcgcgacatgccactcgacgccacccctgaggaagcggccgcgcgtcgcagtcggcactcgaagtccgttgcggagaagcggtgggggccgcaccggaaggagcgggacctggcgcgcgaccggatgcgggccgaggtgtcgggctgggtcggggatctgtccgagcgggaggtgatcctcctgggctcggtggcctactggtgtgagggtgcgaaggagatgccatgggggccgcgggccacgagcctcaagttcgccaacagtgacccacagctgatcctgcttttcctgcgctatctggcgctgatgggggtcagctccgaacgggtgagtttccgcctcagcatccatgagtccgccgatgtcgagggcgcgacgcagtggtgggcgaaggtcgtcggggtggacgccggagagttcctccgacccaccctgaagaggcacaacccggccaccgtgcgaaagaatgtgggtgacttctatcggggttgcctcatggtcagcgtccgcaagtcggctcagctctactgggagctcgagggcgtcatggagggtattgcgctgagcgaagatcagagtgagcccgctatcatgtga

SEQ ID NO: 3497 - DNA, 1443 bp, Actinoplanes utahensis
gtgagccaggcccccagccgtaccgttgtcgtgcttgccgctggtgaaggcaagcgcatgaagtccgccacccccaaggtgctgcagccgctgctgggccgcaccctgctcggccacgtcctggccgtctcggcggcgatccgcaccgaccgcaccctggtcgtggtcgggcacaaggccgacgaggtgggcgccttcctcgccgacgcggcgccggaggcgaccccggtgttgcaggcggagcagaacgggaccggtcacgcggtgcggatcgccctggcggcggcccccgggctgaccgggaccgtcgtggtgctcagcggtgatgttccgctgctgcgtccggagacggtggaggcgctgctggccacgcacgagcgggcgggtgcggcggccacggtgctcagtgccgaggtggatctgccgggtggcctgggtcgggtggtccgggatgcgaaggggaacctggagcgtatcgtcgaggcgaaggacgcgtcgccggacgagctggcgatccgggagatcaattcggggatctacgcgttcgacgcggtgttgctgcgggaggcgctgggcaagctgtcgacggacaacgcgcagggcgaggagtatctgaccgacgtcttcgggatcctggcggcggagggccgtccggtggcggtcgaggtggccgagttcgcgtacgagacgctgggttgcaatgaccgggcggagttgtcgcggctgcgggtgttgatgcgcgatcgggtgaatgacgcgtggatgcggtcgggtgtgctgctgctggatccggcgacgacgtggatcgatgtgacggcgacgttggagccggacgcggtggtggatcagaactgtcagatcctgggttcgtcatcggtggcgaccggtgcggtggtgggcccggattcgacgctggtggactcgtcggtggcggcgggtgcgacggtgttgcggtcgcatgtgatcggcgcggtggtcggtccggaggcgacggtggggccgtattcgtatctgcgtccggggacgcggctggcgcgtaaggcgaaggtcggcgggttcgtggagacgaagaacgccgagttgggtgagggtgcgaaggtgccgcacctgtcgtatgtgggtgatgcggagatcggggcgaaggcgaatatcggcgccggcacgatcttcgcgaactacgacggggtgcggaagagccggaccgtggtgggtgaggcggctttcgtggggtcggattcggtgctggtggcgccggtggagatcgggccgggtgcctatgtggcggcgggttcggcggtggtcaaggatgtgccggcgggcagtctcggggtgacgcgggcgcagcagcgcaacatcgagggctgggtggcgttgaagcggtcggggacggtgtcggcggaggcggcggagcgggcccgggatatcacccctggccaggggtga

SEQ ID NO: 3498 - DNA, 1020 bp, Actinoplanes utahensis
atgcgaacccaccccctatccaacgggagcagcgagccgatgggcagcatcgtcgcggagaaccgtaagagtttgatgctcttcaccggccggggcttcccggaactggcggatgagatcggtcaggtgctcggtgtggcgccgacgccgtcggattcgtatgagttcgccaacggtgagatcttcgtccggttcaaggattcggtgcggggctcggacgcgttcgtggtgcagtcggtcaccgagggggtgaaccgctgggtcatggagacgctgatcatgatcgacgcgttgaagcgtgggtcggcgaagcggatcaccgtggtgttgccgttctatccgtattcgcggcaggacaagaagcaccggggccgggagccgatttcggcgcggctggtggcggatctgctgaagaccgcgggggcgaaccggatcttgacggtggatctgcacacggcgcagatccagggcttcttcgacggcccggtggatcacctgttcgcgatggacattctcgcggagtacgtggagaagaagttcgcgggtcgtccgatgacggtggtggcgccggattcgggccgggtgcgggtggcggagcggtggacggaccggctgggtgggtgcccgctggcgttcatccacaagacgcgtgatccgttgaagccgaatcaggtcgtggcgaaccgggtggtcggtgaggtcgagggccgggtgtgcctgatcgtcgacgacatgatcgacaccggtgggacgatcgcgaaggcggcggacatcctgttcgacgagggtgcggcggatgtgatcgtggcgtcgacgcacgcgttgttgtcggatccggcgacggagcggttgaagaacagccggatctcggagttggtggtgacgaacacgttgccgctggcgccggagaagcgactggacaagatcacggtgttgtcgatcgcgccgttgctggcgcgggcgatccgtgaggtgttcgacgacggttcggtgaccacgcttttcggtggcctgagctga

SEQ ID NO: 3499 - DNA, 612 bp, Actinoplanes utahensis
gtgtccgaggtaaagatcagcgccgagccccgtaccgagttcggcaagggtggtgcccgccgcacgcgccgggccggcctggtgcccgccgtgctgtacgggcacggtgaggcgccgcagcacatcgcgcttccggcccgtgagttcgcggcggcgatccgtcacggcggtgccaaccaggtgttcaccatcgacatcgccggtaactcgggtgccgtgctggcgctgccgaaggcgatccagcgtgacccgatcaaggactcgtacgagcacatcgacctgctgatcgtgaagcggggcgagaaggtccaggtggacgttccggtcacgctgatcggtgaggccgcgaagaacaccctgatcgtgcacgagtcgaacacggtcgcggtggtcgccgaggcgctgcacctgccgtcggagctggagctgtcgatcgacggtctggaggcgggcacgcagctgaccgccggcgacgtgaagctgccgaagggcgtggagctcgcggtcgaggcggacaccgtgctggcgatcatcaacgcggcgcagagtgtccagacggctgaggaggacgcggctgacgccgaggccgccgaggctgctgcagcggagtaa

SEQ ID NO: 3500 - DNA, 612 bp, Actinoplanes utahensis
atgtgtatccgggaggcggagagggtgacggacgaggcgccgtggctggtggtgggcctgggtaatccgggccgggagtacgccggtaaccggcacaacgtgggtttcatggtggcggatctgctggcgtcgcggctcggggcgaagctgggccgggcgaagcgggcgcaggccgaggccggtgagggtcgtctgggtttcggggggccgaagttggtgctggtgaagccgctgacgttcatgaacctgtcgggcgctccggtggtgtcgctggcgcagttcttcaaagtgcccgtggcgcatgtgatcgcggtgcatgatgagctggatgtgccgttcggccaggttcgggcgaagcggggcggcggcgagggtggccacaacgggctgcggtcgatgtcgaagtcgctggcgagcaaggactatgcgcgggtgcgcttcggtatcgggcggcctccgggccgtcaggacccggcggattacgtgctggccgacttctcctcggcggagcgtaaggagctggatttcctggtggatcgggcggctgacgtggtggaggcgatcgtgctcgaaggtgtcgagtgggcgcagaacaaataccacggaagttga

SEQ ID NO: 3501 - DNA, 1725 bp, Actinoplanes utahensis
atgtcgcaggacgtgtccgaaagccgggcggacgcgttgaccgagcccaccgtggaccttccgacgctgcgcgccgatccggtcaaccagggcccgcaagggccgccggtacgccgctcggggctcaacacccggatcccggggccggtcgccccgctgagcccgccgccgtccggggcgtctcagaaccagccgccacgcgcggtgcagggtgccggcgacccgcagcgcaaccaggcgatgagccggcatttcacgacgcgtccgaaccggtcgtcggcgacccgcccgttcatccgcccccgcggccggcacgcggcgatgtcgcgccggcagcgctgggagggccggtacgtgcgcaatctggtgctcggcgacctgtcggccgggatcgcggccggcgcggccgggttcggcctccggttcggcgatcaggtgaccgcgtggaacgaggcgtacctgctggtctccgccatgcttccggtggtgctgctggccgtgctggccgtgtcgcgggcgtacgagcggcgctatctgttcgtcggcagcgacgagtaccagcgggtgatccgcggcgggggcgggctgatcgccggggtggccctggtgtcgtacgccctcgatctggacctggccaggtcctatgtgctggccgcgctgccggcggccgtcgtgtcggtgctggtgctgcggttcgtgctgcgcaagcggctgcactgggcgcgggcccgcggggaggcgctgcgccgggtgatcgtggtcggtcacgagctgtcggtgatcgggatcgcccggcagctgcgccgcgagcgctatcacgggctggaggtggtcggcgcgtgcctgccgccgggcgccgacggcctggaggtggacctgccggtgtacggcacgttcgaggacgtggcggcggcggtggagcaggccgacgcggacaccgtggtggtgctcagctgcccggagctggacggggcggcggtgcgccggctggcctggcggctggaacgcgacgaggtggacctggtggtggccagcgcgttggtcgacgtggccggggcgcggaccacgatccggccgttcgacgggctgccgatgctgcacgtcgagcatccccggttgcacggcgggtcgcggctggtcaaggagctggtcgaccgggccggggcgctgctgctgctgatgctgttcgcgccgctgctgctgggcctggcgctgtgtgtgcggctcacctcgcgtgggccggtgctgttccggcaggtgcgggtcggccgcgacgggcagatgttccggatcttcaaattccgcagcatgtacgtcgacgccgaggcccggctgaacgagctgcggcacctcaacgagcacgacggggtgctgttcaagatgcgcgacgacccgcgggtgaccccgatcgggcgatggctgcgccgcttctcgctggacgagttgccgcagctgctcaacgtcctgtccggccggatgtcgctggtcggtccccggccgccgctgcccaccgaggtggccgcctacgccgatgacgtgcggcgacggctcgccgtcaaacccgggatgaccggcctgtggcaggtgtccgggcgctccgacctgtcctgggaggaggcggtccggctcgacctgcgctatgtcgagaactggtcgctcagtttggatctggtcatcttgttgaggacgatgactgcagtggtgcgttcatccggggcgtattga

SEQ ID NO: 3502 - DNA, 843 bp, Actinoplanes utahensis
gtgggcgagcagatcggtgccgagggcggcacaccaccggtgatcgatgccgcgttcgcccgctggctcgccgaccgggccgggcaggagctgctgcgggtccgcgccgaggtgggcttccacgacggcaaggcgctcaagacggccggcgacaaggccgcgcacgacctgctgcgggccgagctggcccggtggcgcccggccgacgcggtgctgtcggaggaggacgagcacgcccgggtcgcgtggcgcgagggggagccggacacggtgcgccccgaccggctcgacgcgtcccgcgtgtggatcgtcgacccgctcgacggcacccgcgagttctccgaggagggccgcggcgactgggcggtccatgtggccctctggaacgcgggcgtgctggccgccggcgcggtcgcgatgccggcccagcaccgcacgatcgccaccgaccacccgccggcgtacccgccgatgccgctggagtcggccaccggcggggcgatccggatcgcggccagccgcacccgcccgccggccttcgtcaccgcgctcgccgaggagctgggcgccgagctggtgccgatgggctcggccggggtgaagatcgccgcggtgatcagcggggaggcggacgcctatgtgcacgccggcgggcagttcgagtgggactcggccgccccggtcgctgtggcgttggccacgggattgcacgcctcccgcgtcgacggcaccccgctgagctacaaccaggccgatccgaagcttcctgacctggttgtttgtcgcaaagatctcgctcctcggttgcttactgcgatcagcaggcatcttccgtcacaatga

SEQ ID NO: 3503 - DNA, 912 bp, Actinoplanes utahensis
atgagccagacgaaggactatcgcgtctcgcatctggatgcactcgaagcggagagcatcttcgtcatgcgggaggtcatggccgagttcgagcgcccggtgctgctcttctccggcggcaaggactcgatcgtcatgctccgcctcgcggagaaggcgttcgccccgggacgcgtcccgttcccggtgatgcacgtcgacaccggccacaacttccccgaggtcctcgaataccgggaccgccgggtcgccgccctcggcctgaacctggtggtcgccagcgtgcaggaggccatcgacaccggcctggtccgcgagctgcccgacggcacccgcaaccggatccagaccccggtgctgctcgccgccgtggagaaataccggttcgacgccctgttcggtggcgcccgtcgcgacgaggagaaggcccgcgccaaggagcggatgttcagcttccgcgacgagttcggccagtgggatccgaagaaccagcgccccgagctgtgggcgctctacaacggcaagcaccacccgggcgagtcgatccgggtgttcccgctgtccaactggaccgagctcgacgtctggcactacatcgccaaggagcacatcgagctgcccagcatctactacgcgcacgaccgtgaggtcgtcgagcgcggcgggatgttctacgcggtcaacgagttcatccaggtgcgcgacggcgagaccgccgaggtccgccgggtgcgttaccgcacggtcggcgacgcctcgcagaccgcggcggtgctctccgacgccgacacggtggagaaggtgatcgacgaggtcgccgcgacccggatcaccgagcgtggcgcgacccgcggcgacgacaaggtcagcgaagccgcgatggaagaccgcaagcgagagggttacttctga

SEQ ID NO: 3504 - DNA, 1299 bp, Actinoplanes utahensis
atgagccagtccgttctggagccggacgccgcatccgcgcgcaacatggacctgctgcggttcgcgaccgcgggcagcgtggacgacggcaagtccaccctgatcgggcggctgctgtacgacaccaagacgatcttcgcggatcagctggaggcggtcgaggcggccagcgcgtcccgcggcgacgagtacaccaacctggcgctgctcaccgacggcctgcgcgccgagcgggagcagggcatcaccatcgacgtggcgtaccgctacttcgccaccccgcggcgcaagttcatcatcgccgacaccccggggcacatccagtacacccggaacatggtcaccggcgcgtccaccgccgacctggcgctgatcctggtcgacgcgcgcaagggcctggtcgagcagtcccgccggcacgccttcctgaccagcctgctgcgcgtgccgcacctggtgctctgcgtcaacaagatggacctggtcgactgggaccaggaggtgttcgagcggatcgccgacgagttcaccgcgttcgccgcgaagctcgacgcccccgacctgacgatcattccgatctccgcgctcaacggcgacaacatcgcctcccgttcggagaacaccccgtggtacgagggtccgtcgctgctgcaccacctggagcacgtgcacatcgcctccgaccgcaacctggtcgacgtgcgcttcccggtgcagtacgtgatccgcccgcagtccaccacggtcaccgactaccgcggctacgccggccaggtcgcctccggcgtgctcaagcccggcgacgaggtgatggtcctgccgtccgggctgaccagcacgatcgccgggatcgacaccgccgacgggccggtcgaccaggcgttcccgccgatgtcggtgacggtccggctgaccgacgagatcgacatctcgcgcggcgacatgatctgccgtccgcacaacgccccggccgtcgcgcaggacatcgaggcgatggtctgctggatggacgagagcgccccgctgcgggtcggcggcaagtacacgatcaagcacaccacccgcaccgcgcggaccgtggtgcgcggcctgcagtaccggctcgacgtgaacacgctgcaccgcgacgactgcgcggacggactccggctcaacgagatcggccgggtcaaactgcggaccacggtgccactgctcgccgacgagtaccgccgcaaccgcaccaccggcggcttcatcctgatcgacgaggccaccaaccgcaccgtcgcggccggcatgatcatcgaagcggcctga

SEQ ID NO: 3505 - DNA, 816 bp, Actinoplanes utahensis
atgggggtctacccaccgtatcttgacgatgactgcgcgccagcggtgtcggttcgtgtcgacttctcggcggatgcggccgtgtcgttgctgaccgtgcgcggttcgtggggtgacgacctgcgccggtcgacgtcggcgtcactgctccggtgtttcaccgagcatccggatgcgctgatcgtcgacctgagcgggctgcgggatccgcgcagcgagtccgtgccgacctggacgacggcccggacggtggcggcgacgctgcggccgccgatgcatctggccctgtgcgtcccgccggacctgccgctcgccgaccggatgcaggggctgggcgccggccggatgcgcagcgtgccgggcggccggttgctgccggtgtacgcgagggtgggccaggcacgggtggcggtggccggacggctgccggacggcgagcggatggcggtgacgctggcgcccgacgcggacgcgccgagcgcggcgcggaacctggccggggacgcctgcctggcgtgggggctgccgcggctgccgcatccgagccggctggtgatgtccgagctggtgacgaatgcggtggagcatgccggcacgccgatccgggtggtggtcacccggcgcggcgacggtctgcacctggcggtcgccgacgggtcgtcggcgatgccgcggctgctgcggccgacacgcccgagagcgggtcagccgctggacgagcggggccggggcctgcggaccgtgcacggcaccgccgcagtgtggggtgccgtgccggccgcgccgggcaaggtggtgtgggcgatcgtccgctga

SEQ ID NO: 3506 - DNA, 243 bp, Actinoplanes utahensis
atgacgactgagcagcactcgcccgccgacgacgcgcccgaggatgttcgcggcagtgagaccgcggagaacgagcccaacgaatacggcttctcgggtgatcccgctctgccggagtcgcacgaggtcgcgcaccttgccgagggtgagggtgagcggatcgcggtgccctccggtgatctgaccggagcgatcaccgacgcgatcgaggaggcgtcggaggggcacggccaccagcagtga

SEQ ID NO: 3507 - DNA, 975 bp, Actinoplanes utahensis
gtgaaactgctcgtcaccggcggcgccggttacgtgggcagcgtgaccagcagactgctgctggacgccggccacgaggtcgtggtgctcgacaacctggccaccgggtttcgcgaggcgatcgccccggacgccaccttcgtcgaagcggatatcgccgatgccggctcggtcctcaccccggacgccggcttcgacgcggtgctgcacttcgccgggctcatcgcggccggcgagtcgatggtcaaaccggagctctactggcacgagaacgtggtcaagtcgctggccctgctcgacgcgatccgggccgccgcggtgccacgggtgatcttctcgtcgaccgcggcggtctacggcaacccggtcgagctgcccatcaccgaggccgcggtcaaggcaccgaccagcacgtacgggtcgaccaaactgaccttcgacctggcgctcaccgccgaggcgttcgcgcaccggctggccgtggtgtcgctgcgctacttcaacgtcgccggggcatacatcaccgacggccacgagatcggcgaacggcacgacccggagacccacctcatcccgatcaccctgcaggtggccgccggcaagcgggacaggctgcagctgttcggcgacgactaccccaccgccgacggcacctgcgtgcgcgactacatccacgtcgaggacctggcccgggcacacctgctggcgctcgacgcggccaccccgggcgagcaccggatctacaacctgggcaacggcaacggcttctccaatcggcaggtcgtcgaagcggcccgcgaggtcaccggcgcggccatcccggtcgagaccgccccccgccgcgacggcgacccggccaccctggtggcctccgccgacctggcccgcgccgaactgggctgggtgcctcgcaaggacacgctgcaggcgatgatcggggacgcctggaccttctaccgcaagcacgtggcatga

SEQ ID NO: 3508 - DNA, 1068 bp, Actinoplanes utahensis
gtggttcgcggtatcccgtccgagactgacacaatgagcctcatgtccgacgccgtccgccgcccgcgagtgctctccggcatccagccgaccgccgactccttccacctcggcaactatctgggcgcggtgcgcaactgggtggcgctgcaggagacccacgacgcgttctactgcgtggtcgacctgcacgcgatcacgatgggccatgatccggtggcgcttcgtaaccgtactcggatttccgctgcccagttgctggctgtcgggctcgacccggagcgctgcacgctgttcgtccagtcccacgtgcccgagcacgcccagctcgcctgggtgctcagctgcatcaccgggttcggcgaggccggccggatggtgcagttcaaggacaagtcgaccaaggccgggcaggacagcaccacggtcggcctgttcacctacccgatcctgcaggccgccgacatcctgctctaccaggccgaccaggtcccggtcggcgaggaccagcggcagcacctggagctgacccgcgacctcgcgcagcggttcaactcgcggttcggcgccaccttcaccacccccgcggcgtacatcgtgaaggacaccgcgaagatcaccgacctgcaggacccgtcgatcaagatgtccaagtcggcctcctcgccgaacggcatcatcgagctgctggaggacccggcccgctcggcgaagaagatcaaatccgcggtcaccgacaccggccgcgagatcctctacgacgaggtgaacaagcccggcatcagcaacctgctgacgatgtacgcggcgctcaccgcccgcaccatcgacgacctgctggagcagtacgaggggcacggctacggcgacctgaagaaggatctggccgaggtgctggtcgagttcgtcaagccgatccaggagcggacgaagctctacctggacgacaaggcccagctcgacaaggttctcgcggtcggcgccgagaaggcccgggccgtcgccgccgccaccctcgcgtcgacgtaccggaacatcggcttcctcagcccggcccgcggggtctga

SEQ ID NO: 3509 - DNA, 531 bp, Actinoplanes utahensis
gtgggggatcccgcccggacgcgcatcggcgtcgcgatcgacatcccggagccctggggctcggcgctgacccgccggcgtgcggaggccggcgacccgcaggccgcctggacgccggcgcacgtcaccctgctcgggccgaccgaggtggacaccgacgcgctgccgtcgatcgagaagcacctggaggcggtcgccgcggcccagccgccgttcaccatccacctgcgcgggaccggtacgttccgcccggtcaccgaggtggtgttcgtcagcctggcgatgggcatcagcgagtgcgagctgctcgccgaggcgatcaccgggtccgcggagatcaaccggggcagccggtttccctaccacccgcacgtcaccgtcgcgcaggacgtgtcgcccgaggcgctggacgccgtcttcgacgacctggccggcttctcggcccgtttcccggtcgcgtcgttcaccctgttctcgcacggtggcgagggaccgtggcggcctcggcgtgacttcccgctcggcggctga

SEQ ID NO: 3510 - DNA, 921 bp, Actinoplanes utahensis
gtgaaccctatcgatcgggcgtatgacgcggtcgcggcccggatcatggcggggcgctaccgctcccgctatttcgaccacctgtgccgtgcgctgctgcgctacgacggggtgcagggcggccggctcgccgcggccagcgcgtactacggcttcttcgcggtgttcgcgctgctgctgatcggctattcgatcttcgggttcctgctgaccagcaacacccagctgttcgccgtggtgcacgacttcctgcggcagaacctgccgttcctggacgtgcaggcgatcctggagagcaagaacaccgtcggcatcgtcggcatcgccgggctgaccttcaccgggatcggctgggtggaggcgatccgctcctcgcagcgccacatctggcaggtgcgcgagcagcccggctatttcggcgtccggcaggccctggacctgatggtgctggtcggcatcctgatcctgctggcgctcacccagctcgccgtctacggcctggagacactgctcgactatctggccgacggcggcttccaggtcaccctgtcggtggtcagcctggtcctcaccctgggggtgaacatgctgctggccgcggcgttgctgggcgcggtgccccggctgcggatgaccgcccgccggatggctccgccggtgctgcaggtcggcatcgggttgatgctgctcaacaccgtgggcaagtccttcgtcgcgacggtgcagcgcaatccggcgtacgggctggtcggttccgccgtgggcgcgctggtctacctgtacgtcttccaccagttgctgctgttcggcgcggcctgggcggcgaccagcccgcacggccgggtggtggacctgtccgctgacgataagaccgcccccgtggggcaaaacctatggatccgggacgcccgcccgcgatga

SEQ ID NO: 3511 - DNA, 399 bp, Actinoplanes utahensis
atgatgtgtcgcgtggggactctcgtgacgctgcgcctgccacccggatcacctctggccgccgtgccgtgggtggtcaccatcgcctcgctcggcgaccgcgaggactgggacccggtggtctgcgggccgtacgagcgggaccacgcggtcgccctggcccgcgcggtggtctccgacgacgacctgatggcggtggtcgagccgatgctgccgctggactcggccgacgcgatccgcaaggagatcgaggcggtccggcaggccgccgaggacgacagcgagccgatcgacgagctgctcgccgagccggccggcagcggaccgcccccgatcaccccggagccggacgaggtgcgcgcgggttggcgccggctggccacccggctgaccgcctga

SEQ ID NO: 3512 - DNA, 198 bp, Actinoplanes utahensis
gtgatctggccgcggttcgggctggccatctaccgcgacgagcggtcgttcgcgcacggctcaccgacggcgtttctgtgggtgcacgcggtgctgatcgcggcgtcgctggtgatcgggtcgaccgtcggggtgctcggggtgcgcgcgtggaacgccgtacgccgaccggagaaagcggccgtgactgaaaagtga

SEQ ID NO: 3513 - DNA, 1071 bp, Actinoplanes utahensis
gtggcgattctcgcggcaggtgggctgacgctcgcagccgccgcttgtggtaaggcgccggagtcgagcccgtcgtcgggtggcagcgccagcgccgccgccgccgcatacaaggcctgcatggtcaccgacaccggcggcatcgacgacaagtcgttcaacgcctccgcgtgggccggcatccaggccgccaaggccgacgccagcaacgtcgacccgaagtacgtctcctcgtcctccgaggcggactacgagccgaacctgcgcaacttcgcctcgcagaagtgcgactacatcctcgcggtcggcggcctgatgggccccgcgaccaagaaggtctccggcgagagcgcctcctcgcagttcgccatcgtggacagcaacagctccgggccgaacgtctacccgatgcagttcgccacccagcaggccgcgttcctcgccggctacctggccgcgggctactcgaagtcgggcaaggtcgccaccttcggcggcctgaagatcccgccggtcaccatcttcatggacggcttcgccgagggcgtcgcctactacaaccagaagaagggcaagaccgtccaggtcctgggctgggacacggcgaagcagaacggcaccttcgccgacagcttcatcgaccagaacaagggcaagacgatctcccagaccctggtctcgcagggcgccgacgtgatcctgccggtcgctggcggcaccggcctgggcgccgcgcaggtcgccaaggactccggcggcaagatctcggtcatctgggtcgaccaggacggctgcaagtcggccgcgcagtactgcgacgtcttcctcagcaccgtggtgaagaacgtgcaggaggccgtcaaggagtccgtggtcaagggcgccaagggcgagaagctgtcggccaccccgggctacatcggcaccctggagaacgacggcgtcagcctggccccgtacaacaagttcgacagcaaggtcgacgccgccctcaagggcgagatcgaccagctgaagaaggacatcatcgccggcacggtcaaggccgagtcggccagcgcaccgaagtaa

SEQ ID NO: 3514 - DNA, 1572 bp, Actinoplanes utahensis
ttggaccgcccaccaggttccgtccacgacgtcggggagagtccgctgaaactggaactgcgcggcatcaccaagcgcttcggcgatctggtggccaacgaccacatcgacatcaccgtcgaacccggcgaagtccacgccctgctgggcgagaacggcgccggcaagtccacgctgatgaaccagctgtacggcctgctgcagccggacgagggccagatcctcgtcaacgacgagccgcgggtcttccgcagcccgcgggacgcgatcgcggccggcatcggcatggtgcaccagcacttcatgctcgtcccggtcttcaccgtggcggagaacatcgcgctgggcgccgaggagacccgcggcggcccgctcggctggctggaccgccgccgggcccgccgcgacgtgctggagacttcgaagaagttcggactgccggtcgacccggacgcgctggtcgaggacctgccggtcggcgcccagcagcgggtcgagatcgtcaaggcgctgacccgcgacgtcgacctgctcatcctggacgagccgaccgcggtgctcactccgcaggagaccgacgaactgctcgcggtgatgcgctcgctcaccgagatgggcaagtcgatcgtcttcatcacgcacaagctcaaagaggtcaagaagatcgccgaccggatcaccgtgatccgccgcggtcaggtggtcggcaccgccagcccggacaccagcgaggacgagctggccgccctgatggtcggccgtgcggtcagcctcgaggtggacaagcagccggccgagccgggccggccggtgttgcaggtctccggcctggtcgtcgacgacgaccgggggatccgcgcggtcgacggcgtcgacctggaggtccgggccggcgaggtgctcgggatcgccggggtgcagggcaacgggcagaccgaactggtcgaggcgatcatggggctgcgcgaggtgcgggccggccgggtcgagctcgacgacgaggatctggccgggctgagcaccaagcggatcctgcgctccggcgtcggctacgtccccgaggaccgcagccacgacggcgtggtcaaggagttcagcgtcgcggagaacctgatcctggacatttacgaccgggagccgttcggcaacgccttccgcctcgacctcgccaagatcggtggcaacgcccgggagcgggtcgcccagttcgacatccgctgccagtcaccggagaccgcggtcggcaccctgtccggcggcaaccagcagaaggtcgtcatcgcccgggagatgtcccggccgctgaagctgttcatcgcgtcccagccgacccgcggcgtggacgtcggctcgatcgagttcatccacggccagatcatccacgagcgggaccagggcaccgcggtgctggtggtctccagcgagctggacgaggtggtcgggctggccgaccggatcgcggtgatgtaccgcggccggatcctggccgtcgtctcgccggacaccccgcgcgaggagatcggcctgctgatggccggcatcaccagcggttccgcggaggagaagaagtga

SEQ ID NO: 3515 - DNA, 1233 bp, Actinoplanes utahensis
gtgaccgcccccacgaccaccgagaagccggtcgcgaagcaggagtcgttcaccagcgccttcctgcgcaacctctggtcgtcgaacagcgtcaccgtcacggtcctgtcgatcgtgctcgcggtgatcatcggcgcggtgctgatcgtcatctccgactccgacgtgctggccaagttcgggtacttcaccgcccggcccagcgacgcgctggacgccggctggacgctgatcagctcggcctactccgacctgctcaagggtgcgctcggcgacccggacgcgttccaggcctggttctccggcaccggtacctggcagaacgcgctttcgccgatctccgagacgctcacctacgccgcgccgctggtgttcaccggcctgtcggtgtcgctggcgttccgcggcggcctgttcaacatcggcgcccagggccaggcggtgctcggctgcatcgcggccggggtggccggcttcaccttcggcctgccgatcgtgctgaacctgatcgtcgcgctggtcgtcggcgtgctcggcggcgccctctggggcttcctgcccggcctgctgaaggcccggaccggggcgcacgaggtgatcaccacgatcatgctgaactacaccgccggactgctcctggcctggctggtcatccagaagggtgtccagcagcccggccgcagcgacgcgatcagcaaggtggtcgccgagtcggcgcaactcccgtcgttcggcggggtgctccgggtgcacctgggcatcgtgctcgcggtgctggtcacggccggggtcgcctggctgctgaaccggtccgcgttcggtttcgagctgcgcgccgtcggggcgaacccgcacgccgcgcagaccgccgggatcagcgtggccaagacgtacgcgctgctgatggcggtggccggcggcctggccgggctcggcggggcgacccaggtgctgggtacggcgtacgcgctgaccccgtcggtggccggcaacatcggcttcgacggcctgctggtcgcgctgctcggccgcaaccgcccgtggggcaccctgctggccgcgctgctgttcggcgcgctgcgcgccggtggcaaccggatgcagtcgttcaccgggatctcgctggaactggtcaccgtgctgcaggcgctgatcgtcatcttcatcgccgcgcccgccctggtgaaggcgatcttccaactccgtgccgcccgcaccaccgcgaagggctga

SEQ ID NO: 3516 - DNA, 1269 bp, Actinoplanes utahensis
atgtcgaccacgactgtggaggaaccggccgaggtcaccgcgcccgagccgttctggacccggcaccgccgcttcggcgtcgccctgatcctgctcggcgcgctcgccgccggcctgttcggggccctggcgccgagcaaggccgcgcggttcacgctcacccaggacgccggcggcgccgcgctgtcgatcaacggccaggtcggcgcggtgctgttcggggtgctcaccctggtggccggcggtctgctggccgccgggctgctccggcgctgggcgaacgcgttcctggtgatcggcatcgtcaccttcgtgctgtcgttcctgtgctggcaggtcgccgggcagttcatgtcgctgcaggacaccctgggcggcacgctggacctggcgctgccgctgatcctgggcgcgctggccggggtgctcggcgagcgctccggcgtggtgaacgtggcgatcgagggccagttcctgatgggcgcgttcgccggggccctggtcggcaccatggccggcagcgtctgggccggcctgatcagcgcggccgtcggcggcgtggtcatcgcggcgatcctggccgtgctgtcgatccgctacctggtcgaccagaccgtggtcggcatcgtgctgaacctgttcgcgctcggcatcaccggcttcctctacgagcggctgatgcagcccgacgcggcgaagtacaactccccgccgcagatgccgacctggcggatccccggactggccgacatcccggtgctcggcccggtggtcttcgacgccaccctgctgctctgggtcgcgctgatcctggtcgcggtcatccacttcgcgctgaaccggacccgctgggggctgcgcacccgcgcggtcggcgagcaccccaccgcggcggacacggtgggcatccgggtgcgcggcctgcgttacctgaacgtgctgctcggcggcgtggtggccggcctcggcggggcgtacttcacgctggtggcgaccggcagcttcaccaagaacatgaccgcgggcgccggcttcatcgcgctggccgcgctgatcttcggccggtacacgccgatcggggcgttcggggcggcgctgttcttcggcttcgcgcagaaactcgcgttctacctgagcgcgatcaacagcccggtgccgaaccagttcctcagcatgctgccgtacctcgccacgatcatcgccgtggccgggctcgtcgggcgggtccgcgcgccggcggcggacggcatcccgtacgtcaagagctag

SEQ ID NO: 3517 - DNA, 714 bp, Actinoplanes utahensis
atggagatcgactgggcggcgctacgagcagccgccatcgaggtgatgcgccgcgcctacgtgcccgcatccgacttcccggtcggcgtcgccggcctggtcgacgacggccgggtcatcgtcggctgcaacgtcgagaacgcctccctgggcatgaccctgtgcgcggagtgcggactggtcagcgccctgcacgcgagcggcggcgggcggctggtggcgatgtcctgcgtggatgccaccggcgcgccgctgatgccgtgcgggcgctgccggcagctgctctgggagcacggcgggccggacatgctgatcgaggcgctgccccggccgctgcggatggacgagttgctgccgcacgcgttcggctgggtggacatggccaaggtcaccggcccggccggcggcccggaggtgccggccgagctcgccaagtggcgcggtcggggcaccgtcttcgtgcacccggacctgtccggcggggcgacgatctggacggcctactgggagcgctcgtcgggcgccccgggcaccggcgaggagaagggcatcctggaggaggggccgaacttcccggccgcctcggccgcggtggcctggggtctggtccgcagtccgcgggtcgtggtggtggatgccgagggcggactgtcctgggcgggcgagggagagctgccggacggtattccgcagcgctggaaggacgaggcatga

SEQ ID NO: 3518 - DNA, 1278 bp, Actinoplanes utahensis
atgagcgggatcactgcggtagacgtcatccgggccaagcgggacggccgggcgctgtccgacgcgcagatcgactgggtggtcgacgcgtacacccggggggtggtcgccgacgagcagatgtccgcgctggccatggcgatcctgctgcgcggcatgacggccgccgagatcgcccgctggaccgccgcgatgatcgccagcggcgagcggctggacctgtccccggtgtcccggccgaccgccgacaagcactccaccggcggcgtcggcgacaagatcaccctgccgctgaccccgctggtcgccgcgtgcggggtggccgtgccgcagctgtccggccggggcctcgggcacaccggcggcactctggacaagctggagtcgatccccggctggcgggcccggctcggcaacgacgagttcatcggccagctgcgcgacatcggcgcggtgatctgcgcggccggcgagggcctggccccggccgaccgcaagctgtacgcgctgcgcgacgtgaccggcacggtcgaggcgatcccgctgatcgccagctcgatcatgagcaagaagatcgccgagggcaccggcgcgctggtgctcgacgtcaaggtcggttccggcgcgttcatgaaggacctggccagcgcccaggagctggctcggaccatggtccagctgggcaaggacagcggggtcaccacggtcgcgctgctcaccgacatgagcaccccgctcggcctggccgtcggcaacgccaacgaggtggccgagtcggtcgaggtgctggccggcggtggcccctccgatgtggtggagctgaccctggccctggcccgggagatgctgtccgccgccggggtggacgccgacccggagaagatgctcgcctccggcgccgcgatggactcgtggcgggcgatgatccgcgcccagggcggcgacccggacgcgccgctgcccggcccgcggcacaccgaggtgctccgcgcggccgccgacggcgtggtgaccacgatggacgcgtacgggatcggggtcgccgcctggcgtctcggcgccggccgcgcccgcaaggaggacccggtcagcttcggcgccggggtgcagctcaaggtcaagcccggcgaccgggtcaaggccggtgacgtgctgctggaactgcgcaccgacgacgaggggcggatcccggcggcccgcgccgatgcacaggccgcgatcatgatcgggaccgatgcccccgcctctgccggtctgctgctggaccgcatagcctga

SEQ ID NO: 3519 - DNA, 681 bp, Actinoplanes utahensis
atgacgaaggccgctcccgatccccgcgcggttcgcgaggccagcctggacgagttggcccggctggatctgccgctgccaccgccgtccttcccgctggtctgggagctcggcgacacgatagagctgcgcccggtcgccgagctggaggcccgggccgcggtgctgcacgtggtggtcgcgcggtgcttcgggatgcccaccgaggcggcgatgagctggctgctcagctcgcacctggtcgacctggtgacgccgccggagtggcagttcgtgatcggcgcgaagggcgaccaccggtcgttcgtgctgcaccacgacgcggtctttgcgctggcctggctgctcgggctgggccggcacctggacccgaccgtcccgccggacgacaacctgatgagccagatgccggacctgccggccggggagcccttcggccggtggcggtcccggtcgctggtcgcggtccgcgacgccgccgaggccgccgtcctgctcgacctgtactactgcctggactgggcgttccaggaggccgagcaggccgggctgccgctgcccggtgaggtggacagcaacgcgatcgggcagcgccggtgggcactggagtgggcggtcatcttccacgggccctaccacgacaaaccgccgggctgggaagaggtcgatctctcggtttaa

SEQ ID NO: 3520 - DNA, 849 bp, Actinoplanes utahensis
atgatcgatggcgcgttgccgtacctgacctgcccggtgtgccgcgggacgctggcccggcacgaccgggcgctgcgctgcccgctcgggcacagcttcgacatggcccggcagggttacgtggatctctccgcgggccggctgccgcacaccggcgacagcgccgagatgatcgccgaccgggccggtttcctggccgccggtcactaccgcttcatcgccgaggccctggccgccaccaccgcggaccaccgggacattcacgatcaggatcagctcggcgtacgccgtgagccgctgatcctcgacgccggcaccgggacgggcgactacctcgcccacgtgctggacgcctgcccgaccaccctcggcgtcggcctggacgtgtccaagccggcgctgcgccgggccgcccgcgcccacccgcgcgccgccgccgtcctggccgacctgtggcgcccgctcccggtcgcggacgccgccgccaccgtgatcctgaacgtcttcgccccgcgcaacggctccgagttccaccgggtgctgcgcccggacggccggctgctggtggtcaccccggccgccgaccacctgcgcgagctggtcgacgagcacggcctgctgcgggtcgacccggacaaggcggcccgggtcagcggcagcctcgacgatcatttccggccggtcggcgccaccacgcaccggcacacgatgcggctggacgcggccgccgcccgcaccctgatcgggatgacgccgagcgcccggcacgtcccggtcgagtcgctgcccacccgcgacgtcacggtgaccgcggcggtggtgctcacgacgtacacccgaaagccttaa

SEQ ID NO: 3521 - DNA, 1122 bp, Actinoplanes utahensis
atggctggcatcgcttaccccgagatcgtcaaggctcccaaggtcctgttgcacgaccacctggatggtggcctgcgtcccgccacgatcgtggagctggccgccgtggccgggcacgagctgccggagaccgaccccgaccggctgggtgagtggttcgccgccgccgccgactcgggctcgctggaacggtacctggagaccttcgcgcacaccgtcgccgtgatgcagaccgtcgagggcctgcaccgggtggcccgcgagtgcgcgctcgacctggccgccgacggcgtcgtgtacgccgaggtgcggtacgccccggagcagcacctggagcgtggcctgagcctggacgaggtggtcgaggcggtggacgccgggttccgcgacggctgcgccgaagcggccgcccagggcaccccgatccggatcggcacgctgctcaccgcgatgcgccacgccgcccgctcgcaggagatcgccgagctggccgtccgctaccgcgacgccggggtggtcggcttcgacatcgccggcgccgaggccggcttcccgcccacccggcacctggacgcgttcgagtacctgcagcgggagaacttccacttcaccatccacgccggcgaggcgttcggcctgccgtcgatctgggaggccatccagtggtgcggcgccgaccggctcgggcacggtgtccggctgatcgacgacatcaccgcgacggtggccggacccagctcggtcaccccgaccggcggcacccacgcggcgccgccggtgctcggccggctcgcggcgtacgtgcgggacaagcggatcccgctggagctgtgcccgtcgtcgaacgtgcagaccggcgcggccgagtcgatcgccacgcatccgatcaagctgctgcacgacctgcgcttccgggtcaccgtgaacaccgacaaccggctgatgagcggcacctcgatgagccgggagatgagcctgctcgccgaggcgttcgggtggggctgggcggagatgcagtggttgaccatcaacgcgatgaagtcggcgttcatcccgtacgacgagcgattggcgctgatcaacgaggtgatcaagccggcgtacgccaagttgctcggctga

SEQ ID NO: 3522 - DNA, 3576 bp, Actinoplanes utahensis
atgccgggcccgaatcaggaggacggtgacgtgagcaagcgccctagtgaggcggacggcgtcatgtcgcgtctgcgtcgacccacgggtcggctgcgagacctacccatctggtccaagcttggtctgatcatgcttgtgccgaccgttgcgacgatcatcgtcggtgtcaacggcctggtcgagcacatcgaccaggccgacaccgcggacaacaccaggacgctcgccacgctggcccaggcggccggcgggctggtcgaccagctgcaggacgagcgggcctacgcgatgcaggtggtgctcgcgcccaagtcgcccaagggcaacgaggtgttgaccgccgccaccaagaagttcaacgacgagcatgccaaggtcgaggcggccaaggatccgtacgcgcagcagcgcgcggccctggacacccagcccgaccgggtcaacctgctgctctcccggctggaccacaacctggccgacctcgcggcgtaccgcagcaaggtcaccaacaacaccgagaccgagctcagtgttcagggcacctacaacgcgctgatcaccgacctgctcgcggtccgggacgtcgccgcccagcaggccaccgacaccggcctgagcgaccacctgcgcgcggtcgccgaggtggcccgagtcaaggagttcgtctcccagcagcggttcatcggcctccaggtgatcgccggcggcaagttcagcaccgcgctccggcaggccttcctcaccgccaacaccggtatcgacctcgccgagagaaacctcaaggcggcggccaccgacggtgagaacgaggtcttcctcaagaccaccgaccagaacgaggcgcagcgcgccgcgacgaacctgaccgagccgctgcaggccaccccggggaccgacatctccaacctgcacctcaccgcggccgggtgggactcggcgatggccggctacgacgacacgttccggcaggtcgagcagcagctcgacaagaacatcgtgaaccaggccaccgacctgcggaacaccaccaaccggacggtcttcgtcgagaccagcgtgctgctcggcatgctgctgctcgccatcctgttcgcctggctggtcgcccgctcgatggcccgctcgctgcgtgagctgcgtcagggtgccctggcggtcgcccagttcggcctgccgcacgcggtgagccggctgcgcgacccggcgctgtccacctcgctcaccccggcgcaggtcgccgaccagatcgccgagccgctcccggtccgcagccgggacgagttcgggcaggtgaccgaggcgttcaacgcggtccacctggaagccgtgcggaccgcggccgagcaggccgccctgcgggcctcggtcgcgaccatgttcgtcaacctcgcgcgtcgctcgcagatcctggtcgaccggctgatcggtcacctggaccggctggagcgcggcgaggaggacccggaccggctggccgagctcttccagctcgaccacctggccacccggatgcgccgcaacgacgagaacctcctggtcctcgccggcgcggactccacccgtgtgcagcgcgagccggccgctctgatcgacgtgctgcgcgccgcgcagtccgaggtcgagcactacacccggatcgagttcggcgtcatcgaccgggagatcgaggtggcggcgcacgccgtcaacgacatggtccacctggtcgccgagctcttcgacaacgccaccgccttctccccgccgaactccaacgtgctcgtcgaggcgcgccgggtcggcgagaccgcggtgctcaccgtcgaggaccacggcatcggcatcagccgcgagcagctgcgcgacctcaacgagcggctggccaacccgccgaccgtggacgtggccgtctcccggatgatgggcctggtcgtggtcgcccggctggcgaaccggcactcggtccgcgtcgagctccgcccagccgaccgggaacggggtactgtcgctgaggtgggcctgcccgtcaccgtcctcgctgccgcggtctccggccggatgggtggctacgacgcgccgccggccgcgatgccgtcgttcggcgagcccctcgccctggaaagcggccgcgggggatacccgggcgtcaacggcagtgccaacggcagcaccaacggcggggtcccggcctggtccgacctgaccggcgcggcgccgtccaacggcttcggcgggaccaacggcttcaacggcggtcccaccggcttcggctcggccaacggtttcggcgccacgccgagcggcttcagccccccggcgaacggtttcggcgggcagaacggtagcggcccgaacggtttcggtggacagaacggcttcggcggcgcgccgaacggcttcggtccgcgcagcaacgagccgatgcccccgctgccgtccggcccgaccagcagcggcccgcagggtttcgccggtctcgacgagctggtccagcggcgcaacggcaacgactaccagcggcccgacggggagaccggcggcttcggcgcgaccattccgcgccagctcccggccaacccggaaagccagggccggtcgtcgttcatgccgccggtctcggcgccgccggtgccgtcggccccgccggtgacctcggccccgccggtgccgtccgcgccgccggtctccgccgccccgatctcggccgagcccacctcgttcgcctccgcgccgccggcctggccgccggtcgccggcgaccgcgagaccgccactccgcacgtcccggagaacctcgctgcggcgctcgacatgaccgccgagatcccgaggtaccgcccggacaccgccgagcagcgccccgaggtggcccggccgatcgacccgccgctggcatccctgcccgcgtcggccccgccggcgtacgaggcgatcgccccggtcagcggcccggccgccgaccaggccaccgcggccgcgcagatctcctcggcccgtgagggcgcggtgccgttcgccgacgagacgatggagctgccgatcttccgcgagctcgagtcggcctggttcaccacgacccaggcgacggccgccaagccgtcggtggccggcacgggcgaggaagcggtgatctcgcagcggatcccgaccggcgagcccaccacgcgtaccgccggggtgccccagcaggcggcctccccggaggcccgcgagctggacaccgcgtccgtcggcgcggctcccgcggctccggcggccgtcgccgccgggtcctacgccggcaccccgtcgaacccgtggcagaccgcggccgacgagggctggcaggccgcccgcaaggcgtccgaagtcagcatcgacacgaccaccacggcgggcctgcccaagcgcacgccgatggcgcaactcgtccccggcggtgttgaccggggcggtaactccgtccagcgccgtactcccgaaggggtccgcggtctgctgtccgcgtaccaccggggtgtgcagcgcggtcgcaccaaggaacaatcgaccaacctggaggagactccgggagggcagcagccctcgcaggctggcaaggagcatgaggcatga

SEQ ID NO: 3523 - DNA, 405 bp, Actinoplanes utahensis
atgacatctacgcaggatctcggttggcttctcgccaacttcgctgaccgcgttcccggggtcgcgcacgcgatcgcggtctccgccgacggcctgctcctggcagcctcgcgggatcttccccgggaccgtgccgaccagctcgcggccatcgcgtccggcctggtcagcctgacccagggcgccgcgcggtgcttcgagggcggcgctgttctgcagacggtggtggagatggacaatgggttcctgttcctgatgtccatctccgacggctcctcgttcgcggtactcgcggctcgcagctgcgacgtcggtcaggtcggctacgaaatggccctcctggtcgaccgcgtcggcgaggcgcttacccccgcgccgcggtccgcggccggggtgctgggctga

SEQ ID NO: 3524 - DNA, 381 bp, Actinoplanes utahensis
atgccggagcgtgatgaaccgaccggatcgctggtcaggccgtacgccgtgacccgcggtcgaacccggccgaaacttgagatagcgctggaagcgctggtcgagacaaccgtacgcggccgatccggaatgatccgcagcggacagggtggaagcgagcatcagtacatcgcggcgatgtgcgacaacggccgagtgcagtcgctcgcggaaatcgccgcacgcatgcaactgccgctcggtgtggcacgggtgatcgtcgcggacatggcctccgacggcctgctcgcggtgtacgagcccacctcgctcgaggacgagaccgacgcggtaggcacggaactgctggaaagggtgctgagtggacttcgcaggctctga

SEQ ID NO: 3525 - DNA, 612 bp, Actinoplanes utahensis
gtggacttcgcaggctctgacatgtcgcaacgtcccgctgcgggcggacgcgtgacatcggcgaagattgtcatcgccggtggcttcggcgtcggtaagacgacgctggtggggtcggtctcggagatcaccccactgaccaccgaggcgatcatgacttcggccggtgtgggtgtcgatgacaaccggcaggtgccgggcaagatgaccaccaccgtggccatggacttcggccggatcagcatcgaccgggacctgatcctgtaccttttcggcacgcctggccagacgcggttctggttcatgtgggacgagctggtccggggcgccatcggtgcggtcgtgatggtggacacgcgtcggctcgccgactgcttcgccgccatcgacttcttcgagcaccgccgcctgccctacctggtggcgatcaactgcttcgacggcatgcagtaccacaacccgcaggacgtccgggacgctttggcgatctcgagcgacgtgccggtcgtgagctgcgacgcccgcaaccgcgagtcgacgaagaacgtcctcatctcgctcgtcgagtatgtgctgacgatgcgtcggacgcgcgcggtggcgccggcctga

SEQ ID NO: 3526 - DNA, 1179 bp, Actinoplanes utahensis
gtgccgggaagccggacgccgggcctcgccagcacgtcgggcctcgccggcacgtcaggcctttccggcacttcgagcctttccggcacgtcgggtggtctctcgccggccgcgcgcagcccgctgtcaccggcgccgtcctcggctccgctgtcgccggccgcgcgcaatccggtctcgccggccgctcgcaacccggtctcgccgggtggcaccccgaccccggccgaggcgggcgagccgttccggcccaccctcaccaacgccgagctgaaccgggcccgggccgagcggcagcgcacggtcatcccggcccggcccagcacccggtcggcggccccgtcccccgccaccaacggcgcggcggccggacccaccgacttcgccctgccgatgccggcccagcgtcccggcgccgagagcgcggagccgggctcgcgggccaactggccgctgctgaacaacggcggcgacgatgccgcgctgcccgccgcctcggtgagcggggccggtgccgacggccggatcaggcccccgtggcaggacatgccgaaggaaccgcccgccctgcgcctggtcgagtcccagctcaacggcggcggccgggccaagctgcccgggctcgaccagctcggtgatccgccctcgctgcgggtggtcgacggcggtgcccgcggcgtcgacagcctcccgccgaaggtcaccgcgctggaccgcagcagcaccccgccggtgccgtccgacggcagcgacggcgacctgctgatcttcgcggccgcccggtcggcctggttcaccggcggcaccagcaccggtgactccggcaatgtcgactgggccaacccgaacgacagcggctggcgcgccgcggagaaggcggccaccccggccgtcgccgcggaaacctcggccggtctgccgaagcgggtcccccaggccaacctggtgcccggcgccacggtccgcgacgagcgcccgctgcgcatcgtccgggacgcggcatcgatcgcggcgcacaccaccggctacttccggggttggcggcgcggccaggagatcggcggcttcgccatgggcggccgcccgggccgcgaggccgccggcggctgggacttcacccgcgaccgcgagggcgccgacgagtaccgcaacggggcgggctacggcggcggccgctga

SEQ ID NO: 3527 - DNA, 906 bp, Actinoplanes utahensis
gtggcgctcgtgcgcgtgtactgcggtctggcgtcggctgatgatgcggtgcgatcggccacggccgctccactgaccatcgccgtggtggacgacgcaggccggctgctcggcgtccacgagatcagcgacgacccggccggttacgccctgctgggaacgctgctcgtggaacgtacgacggggttcagcgacgcggccgtggccgccgacagtgacgaccacgtcgtcacgtcgctgctgaccgccgccggccggccgctggtcgtggtcgacgacgacgacgcggacgacttcgccgagcgcttctcggacgacgactcccccgaggagatcaacgccccggccgccgcccggcgggcagtcgggctggcccgggccctgcaggccggggcgatcgccgcggtcaccctgcccgccccgcgcgagctggtcagctacaaaccggtgctggccgcgcacgtggccatgctggtcgggcgcaatgcggccgcggccgcgctgcgcgaggtgctgcgcgagctgtacccggccgccctgcgggcctatccggacccggcgcacccgatcgccatggccgtcctcgaggcgatccccgagcccggccggctgaccggccgcggcggcgacccggaacacgccgcgcaggaggtcgccgccgagctcacccgggccggcgtcggctccgaggaccagatcttctcgttcatcaccgcactgcaggtggcgatcagcgagtcgccgcgccgcggcggcgtcaacaagtcactggccccggccgccgccgaggcggtccggcacgccatcgccgcggtgcgcacctgcgacgccggctgcgccgcgctggtcggcacgctcgccgcccggtccggtggcccggcagccgagccgaacgtggctagctag

SEQ ID NO: 3528 - DNA, 867 bp, Actinoplanes utahensis
gtgaccagccagtccgacgagcccgaggcgtccgcgccggtggccgagaagtcccaagccgaggggctcaacgggcgtgagctctgggacgaagtccgtgtcgagccggtcgagatcgctctcccgggcggcgtgggcctgaccctccgcgcctaccggtcggtctccgagctgaccccgaccgagatcgaggccgaggaggaggacccgttcgacacgcgcaagcgcgccgccctcgacgaggacggcgaggagggcgtgatcgtcgacgaggagtacgaggcgctgctcgccgagggtgacgacgaggacgagacggcttccgacgagaaggccgagtccgatgacgaggcggcggaggcgagcacccagccggacgatgaggaagtacccatgttcctcagccacaagggccggttgctcgccttcaagaacgccgagtcgctggtctccttcattcgttcgggtgctccccacgatctcgcacaattggacacctggggtgccctggccgagcgggtacagtcgagcgacatcgacccgctgccggaggagcgttacgaactcgacctcgtggtggagaacctgcgcggcgggcacgacacctgggatctgccgctgctcatcgccgccggcgaggtggcccgtgacctcgggtacgcgcttcggctcaagccggtgatcctggccctgtcgcccggttccccgctcgacgacctcgacgagtccctccgcaccgcgcagaacggtggcatgggcggattcttcgggcgccgccggctgaagaaaatcggggcacaacaggcgagtctcggctggcgttcggtgatcggcaagatctctgctgctgtggactggcgtgactga

SEQ ID NO: 3529 - DNA, 840 bp, Actinoplanes utahensis
ttgcctaagtcagcgaagctcgtggagccggcggcgaccccccggctcaccgtgcgcaagacgtacaagctctacatcggcggcaagttcccgcgcagcgaatcaggacggacgttcgtggcagacggcgacaacgtggccctcgcctcccgcaaggacgcccgcgacgcggtggtggcggcccgggccgcacagcccgggtgggccggcgccacggcgtacaaccgcggtcagatcctgtatcggatcgccgagatggtcgaggcgcggcgggccgagttcaccggcctcggcgtgcccgcggccgaggtggacgccgcgatcgaccgctggatctggtacgccggctggtccgacaagatcgcccaggtggccggcggggcgaacccggtggccgggccgttcttcaacatctccgcgccggagcccaccggggtggtcgccgtcgtcgcgccggccggcctgctcggactggtcagcgtgctggccccggcgatcgtgaccgggaacacgaccgtggtgctggccgccgacccgcagatcgcgatcaccctggccgaggtgctggccacctcggacgtgcccggcggcgtggtcaacatcctgaccggggcgtacgccgagaccgccccgtggctggccgcgcacgccgacgtcaacgccgtcgacctcaccggcgccgcgccctcggtggcagccgaactcgaacgcaccgccgccggcacgctcaagcgggtgatccgccccgcggagcagcctgatttcctggctgacccgggcctgaagccgatgacgtcgttactggagacgaagacggtctggcacccgaagggctactga

SEQ ID NO: 3530 - DNA, 1419 bp, Actinoplanes utahensis
atgttcgcatacgcaccggcgccggaatcccgctcgatcgtctccctggagccgtcctacgggctcttcatcgacggcgagttccaggggtccggctctgtcttcaagacggtcaatccggcgaccgaggaggtgctggccgaggtcgccatggccggtccggaggacgtcaaccgcgcggtggcggccgcccgccgcgccttcaccggttggtccgccctgcccggggcggagcgggcgaagtacctgttccggatcgcccggatcatccaggagcggtcccgcgagctggcggttctcgagtcgctggacaacgggaagccgatcagggaggcccgggacgtcgacctgccgctggtcgccgcgcacttcttctactacgcgggctgggcggacaagctgccctacgccgggttcggcgccgacccgcggccgctcggcgtggccgcgcaggtcgtcccgtggaacttcccgctgctgatgctcgcgtggaaggtcgcgcccgcgctggccaccggcaacaccgtggtgctcaaaccggccgagaccaccccgctgtccgcgctgttcttcgccgacgtgtgccggcaggccgagctgccgcccggggtggtcaacatcgtcaccggggccggcgacaccggggcctacctggtggcccacccggacgtcgacaaggtggcgttcaccggctccaccgaggtgggccgggagatcgcccgcacggtggccggcaccggcaagcggctcaccctggagctgggcggcaaggcggcgaacatcgtgttcgacgacgcgccgatcgaccaggcggtcgaggggatcgtcaacgggatcttcttcaaccagggtcacgtgtgctgcgccgggtcgcggctgctggtccaggagtcgatcttcgaggagctgctggagtcgctgaagcggcggatgggcacgctgcgggtcggtgatccactggacaagaacaccgacatcggggcgatcaactccgcggcccagctggcccgcatctcggagttgtcggaaatcggggcgcaggagggcgcggcccgctggtcgccggcctgcgacctgcccgaccgcgggttctggttcccgccgacgatcttcaccggggtgacccaggcccaccggatcgcccgcgaggagatcttcgggccggtgttgtcggtgctcaccttccgcaccccggccgaggccgtcgagaaggccaacaacacgccgtacgggttgtccgccggcatctggagcgagaagggttcccggatcctggcggtcgccgacaaactccgcgccggcgtggtgtgggccaacacgttcaacaagttcgacccggcgtcgccgttcggcggctacaaggagtccggctacggccgcgagggtggccgccacggcctggaggcgtaccttgcctaa

SEQ ID NO: 3531 - DNA, 1014 bp, Actinoplanes utahensis
gtgatctacgacaaggacgtccacggcgatcaacctaccgttcattcaagatcaactgacctcgggtcgcatagaatcagtctcatgactgcgacagcgtccatcgggctgtccgatctccgcgccctcctgcacggcctccccggggtcgacaaggtgggcgtcgaggccagggcggccgcgctcggcacccgatcggtgaagacgagcagcaaggcccgggccatcgacctggcgatccggatggtcgacctgaccaccctcgagggcgccgacacgcccggcaaggtgcgcgcgctgtgcgccaagggacggcggcccgacccggccgacccgtcctgccccgcggtcggcgcgatctgcgtctaccccgcgatggtcccggtggccgccgaggcgctggccggctccggggtccacctggccagcgtggccaccgcgttcccgtccgggcaggccccgctcgaggtgaaactcgccgacacccgggccgcggtcgcggccggggccgacgagatcgacatggtgatcagccggggcgcgttcctggccggcgactacacccgggtgttcgacgagatcgtcgcggtgaaggaagcctgcggcggcgcccacctcaaggtcatcctggagaccggcgagctggcgacgtacgacaacgtccgccgcgcgtcctggctggcgatgctggccggggccgacttcatcaagacctccaccggcaaggtgtcggtcaacgccacgctgccgatcaccctggtgatgctggaggcggtccgcgacttccgggcacggcacgggcggcaggtcggggtgaagccggccggcgggatcaagaacaccaaggacgcgatcaaatacctggtgctgatcaacgagacggtcggcgacgactggctcagcccggactggttccggttcggagcctcctcgctgctcaacgatctgctgatgcagcgcaccaagctggccaccgggcactactccggtcctgactacttcaccctggactga

SEQ ID NO: 3532 - DNA, 633 bp, Actinoplanes utahensis
gtggacgtccttgtcgtagatcacccgctggcccagacccggctcaccgcgatgcgccggtccgagaccgagtccggggtcttccgcgcctcgctgcacgagctgaccacgatggtggtctacgaggccgcccgcctcttcgcggtcgagaagttcccgatccagaccccggtcgcggcgaccgagggcacccggctggccaatccgccgctgatcgtcccggtgttgcgggccgggctggggatggccgacgccgcgctggcgctgctgccggagtcgtcgatgggcttcgtcggcctggcgcgcgacgaggagacgcacgagccccgggcgtacatggagtcgctcccggccgatctggccggccagccggtgctggtcctcgacccgatgctggccaccggcggttcgctgctgcactgctgccggctgctggccgaccgcggctgcaccgacatcatcatctgctgcgtgctggccgcgccggagggtgtcgaccgcctggccgcctccgacctgccgctgcgcctggtcaccgcgtcgatcgaccagggtctcaacgagaaggcctacatcgtgcccggtctgggcgacgccggtgaccgtcagttcggcggcatgcgccgcttctga

SEQ ID NO: 3533 - DNA, 570 bp, Actinoplanes utahensis
atggtacagcattctcccttgctaccgatttctcagcgcggcgcgcgcgaggccggccgggcggtcctacgctgccctgtcatgcggtccatcctcgctacgctcggttacgtcctgtctcccggtggtgatcggattctgatgatccgccgcgacacccggcccgacgacctgcattacggctattacaacggtctgggcggcaaattgcacccggacgaggacgtggtcgccggaatgcgccgcgagatcgccgaggaggccggcctcgagtgccaccgggtcgacctggccggcaccgtctcctggcccggcttcgggcgcgacggggagaactggttcggcttcctgttccggatcccggagtggtccggcacgccgctgaccggcaacccggaggggtcgctgcactggatggcggtcgccgacgtgctggccggccgggtacccatgtgggagtccgaccggcacttcctgcccctggtcttcgccgagcagccgcgggtgttccacggcgtgatgccgttcgccggcgggaaagcccagtcgtggggttacacgacggggtga

SEQ ID NO: 3534 - DNA, 1110 bp, Actinoplanes utahensis
atgacgggctcccagcctgccattcccgccgctcgccccgtgatcggtgaagaggagatcgaggccgcggtccgagtgatgcgcagcggcatggtgattcagggcccggaggtcgcgggcttcgagcgtgagttcggtgagctggtcgaggggcgtcactgcgtggcggtcaactcggggacgtcggcgctgcagctgtcgctgctggcgctcgacctcaagccgggcgacgaggtgatcgtcccgtcgttctcgttcgccgcgtcggccaacgcggtccggctggccggcgccaccccggtgttcgccgacatcgacccggtgaccttctgcatcgacccggacgcggtggccgcggccatcaccccgcgcaccgtcgcgatcatgccggtgcacctgtacggccaccccgccgcgatggaccggatcatgccgctcgccgaggcgcacggcctgcaggtgatcgaggacgccgcgcaggcccacgccgccggcctgaacggcaccccggccggcgcgttcggcctggccggctgcttcagcttctaccccaccaagaacatgcactcgctcgagggcggcatgatcaccaccgccgacgccgagttcgcgcgcaagctgcgcctgctgcgcaaccagggcatggagcagcggtaccagaacgagatcgtcggcgcgaacatgcggctcaccgacgtggccgcggcgatcggccgggtgcagctgggcaagctgggcggctggacccgcaagcggcaggagaacgcggcgtacctgagcgcgaacctgaccggggtcaccgtgccggccgtcggcgagggcgtcgagcacgtcttccaccagtacacgatccgcttcgccggggaccgggacgccttccaggccgccctcaccgagcggggcatcggcaacgcggtgtactacccgatcccgatccaccgcctccggccgtacctgaccgaggacggccaggtcggcccgtggaagctgccggagacggagaaggcggccgcggaggtcgtctcgctgccggtcttccccagcctcacccaggaggacctggaccggatcgtcgtggccgtgaacgaggccgcggcggtggccgcatga

SEQ ID NO: 3535 - DNA, 1002 bp, Actinoplanes utahensis
atgagcgggctgcgcgccgttctgatcgggctgggcgccatggggcgcaaccacgcccgggtgttgtccctgctggacggggtcgacctggtcggcatcctggacccggcgcccggcgcgaccggcccgcacggggttccggtcgtcgccgagctggacgagctgctcgccctgaagccggactacgccgtggtggcctgcccgaccggcctgcacgaggagatcggcctgcggctggccgccgacggcgtgcacgccctgatcgagaagccgctggcgccctcggtcgaggcggccgagcggctggtcgccgcgttcgaggcgaagggcctggtcggcgcggtcggtcacatcgagcggtacaacccggcgctgcagagcctgcggacccgcctggaggccggcgagctgggtgacatctaccagattgtgacccggcggcagggcccgttcccgggccggatcgccgacgtcggcgtggtgatggacctggccacccacgacatcgacctgaccgcgtgggtcaccggcaagccgtacgagcaggtcgccgcgcagaccgtgtcgcgcagcggccgcccgcacgaggacatggtctcggtggtggccggtctgtccggcggcgtggtcgccaaccacctggtgaactggctgagcccgttcaaggagcggtccaccgtgatcaccggcgagcggggcagcttcgtggccgacacgctcaccgccgacctgaccttctacgccaacggcgcgttcggcaccgagtgggaggcgctgcgcgcgttccgcggcgtggccgagggcgacatggtccgctacgcgatcccgaagcgtgagccgctgctcgtcgagcacgagcggttccgggacgcggtggagggcaagcagagcgacatcgtgtcgctgcgccagggcatgcgcaccgtgcaggtggcggcggcggtgctgaagtccgcacgcgagggcatcaccgttcccgtgttgccggcccagggcgagtga

SEQ ID NO: 3536 - DNA, 1341 bp, Actinoplanes utahensis
atgaccggcaagttctcggagtcgcgcccgccccgggtgctgtacctgtcgttctacttcccgccgagccgggcgagcggcgtgttccgcgcccgcgcgaccgccaatcacctggctcaggcgggctgggacgtcaccgtgctgaccgcgccccgcgagttcttcgagtaccacctcgaaggcgccgcggacccggcgctggaggccacggtcgacccccggatccacgtggaacgacccccgatgaacacctacaactacgagcacgacgtacgccggttcagcacgttccgccggatgttcccgagcgtggcgagccggctgtaccaggagtcgcagaagcggatcttcggcgagcactacatcggctgggtccccggcgtgatgcgcaccgccgtggcccggcaccgcaaggcccgcttcgacctggtgctcgccaccggcaacccgttcgtctcgttcgccgccgcgcactatctgggcaagctgttccggatcccatacgtggtcgacttccgggacgcctggaccttcaaccagttcaccgaggagatccgcttccccgagggcggcctgatgatgaactgggaggagcgggtcctgcgggacgccggcgagatcgtcttcgtgaacgacggcatgcggcggtggtaccaggaccgctacaagttcgcggccgaccggatggaggtcgtcccgaacggctgggagcccgagctgctcggccgcccggactaccggcccagcgacccgaaccggccgctgcacttcagctacctcggcacggtcaccccgtacctgccgctggaggtcctggtcaacggctggaagctggcccgccagcacccgctgctggccgacgcgaacctcgacatccacggccacctcggcttcttcccgcacgaggcggcggccatccggccgcggctgggggagagcccggacaccggtgtggtgtatcgcggcgcgttctccaagaccgaggcggccgaggtctacgcgaagaccgacgggctggtcttctgcgtgcccggggcgaagttcgtgacctcgggcaaggtgttcgagtacatggcgaccggcaagccgatcgtctcggtgcacgagccggacatcgccgccgccgacgtgctcaccgggtacccgctctggttccacggccggaaactggacgcggacaacgtcgcccagtcgttcatcgccgcggcgaaggcggcccgggacctggaccggccgaccttcgagacggccctgcagcacgccgaccggtacacccgggaggccacactgacaccatgggagcaccgcttgcgagcgctggccgagggcggacgacgatga

SEQ ID NO: 3537 - DNA, 2073 bp, Actinoplanes utahensis
atgagcgacggtcaccggtcggtcgtctacgtcgcactgggcgagttccggatccgcgccgccgtcacgctgaccgcggagtacgccgcggccggcgcgaaggtgacgctgttcgccgggcggatcccggagtggaaggacgtcaaggcgccggccggcgtcactttgaagcgggtcggtgacaaagcctggccggagatccgcgaggcgctggccggggcggatctgctgatcgccggtgacccgccggcgatgccgatcgtcgacctggcccgcaaggagttcccccggctgaccgtgcggaccgacccacagggcgatccggagcgccggcccgcgccggccgacctggccatcgtcacgccgtggtacccgtcgccgaacgacaccttcgccggttcgttcgtcaaggccgccgccgagacggtgcaggggcaggtgggcagggtgtcgatcctcgccaccgaccactggttctacccgccgtggcggatggtcgggaacatgatcgacatcaccatgcagcgggagctgaagcgcttcggcggggtcaccgtgcaggacaccccggagggcgagctcacccgggtgatcgccccgcagccccgcaagcagccgtacgcgacgtgggcgaacgagcagatccgccggctgagggcggccctgcccaccgggcggatcgaggcgccgctggtgcacgcgcactccgggcacttcggcggcgtgatggcggccgcgctggcccgcccggacgcccggatcatcgtcaccgagcacgccaccttcctgcgccaggtgttcgcccagcccaaggcccgccagcaatacctcgacatgctcgcccgggcggagaccctgctctgcgtcagctcctcgctgcgcgaccaggtcgccgaggagttcccgtactacgcgcacaagctgcgggtggtgccgaacccggtcgacttcgagcacttcgcggtccggcccggcatgcccgaggcgccccggcgctgggtgtacgccggccggatggtggagcacaagggcgtgatgacgctggtcgacggcttcgcgctgatcgccgcggaggacccctcggtcaccctcaccctggtcggcgagggcaagctcgaggacgacctgcgcaagcggatcacagagctgaagctgaccgaccggatccagctgcgcccggccgtgccgccggagcagatggtggccctgctgcacgagcacgacctgctggtgcacgccagccagctggagacgttcgggatgaccatggtcgaggcggtggccaccggcaccccggtgctggtcgccgccagccagggcccggccgagaccctggagggcctggacggcatcgccggccggctcttcccggtcaccaagaagcccgaggtgctcgccgaggcctggcgcgagctgcgcgacgagtggtcgaaactggacctgccccgggcccgtgccgagctgcacgcgcggtacggcttcgaagcggtcggtgaacagctgctggacatctaccgcaacccggccccggccgaggccgcggcgccggtcccggtgccggccgaggacccggccgagcggatcatcgtggtggcggtcctgccgtcccgtccggcccgcacccgggacttcgtcaagcgggcccgggccaaggggtacggcgtcgacctgatcgtgccggacccggccaagtgggcccgcgaggcggaggatccgggcatcgtggtgcacgggatcggcaccgaggaggacccgcccggcgtggtcatccggccggccccgatgaccggctcggccgccgcgctggcgctgacccgcaccgtgcagggcaaggcgcgcacgctgcgcaccaaggtggccgccaaggtgggcaagccgaccgccgcggtcttccgcccgcacaccaagtggctggcgaccaggtcgatcctgccggccatcgatttcaccagggtgaagcgggtggtggtgaacggggtgcagggcgagcggatcggctggcagatcgcccgccgtcacccgggcctggaggtcaccaccgcgttgcggctgccgggcgacaagcacggctga

SEQ ID NO: 3538 - DNA, 1662 bp, Actinoplanes utahensis
atgaccgaggtcctgaagtcggctgtcaccagcgccaagcgattcaccaagaaggccgggaaccgggtggtcggcaaggcgctgagcatgccgcgcggccggcaggcgggacaggcgctgctgaccgcgcccgggctcagcgaccgccagcggcgcgccctgggccgccggatcgccggcaagctgagcacgctgggactgcccgccgaggccgccgcgacccggctgcgggtcgccaagcttctgcgcgagccgcggtcgcgggccgagtggatgatggccgccgccaaggacgagctggacgccggccggatcccggactttctcaccgaggccgtcaccgccgagctcgcggtcgccgaccagctgctgctccgcaaggacttcgacgcggccacccggtccgtcttccaggtgctgcagctgctgttccaccgggccgtccacttcgacgggatgacctcgccgatggcgccgcagccggccgagttcctcgcgccgctgcacctcagcctggtcgggcgcacgatggccacggcgcacgggcggctcaccccggccgtcccgccgccggccggccggccgcaccggatcctgttcgtcacccggggcaacgagaacttcctcggcgagatccgcgaccggtacgcggcgagtcccgatcacgaggtccgcacgctgagcctgctcgccgacgaggagaaggcgaagctggtccggatcccgttcatgatcaaacatctgctcggcggcgacccggcgtacggggagaagatccgcgagtggatccagcccgacctggagtgggcggacaccgtcttcgtcgagtggtcggtggcgcaggccgcgctggtcagcatggtcgacccgggcaccacccggatcatcgtgcggctgcacctgttcgaggcgttcaccatgttcccgcacctgatcgactactcccggatcgacgactacgtcttcgtctccgacccgctgctcgactacacccgggacgtggcgccgcggatcaccgagccgggcggcccgcggctgcacgtgctcaccaacgcggcccggctcgaccggttcgcccggcccaagacgccggaagcccggttcaccctggcccagatcggtcagagccggatcgccaaggatccgcgctggaccttcgcgatcctgcgggagctgcgcaggcacgacgaccgctacaacctcctgctggtcggcgccgacctggacggctcacccagcccgcaggcggccgcctaccaccgggagtacgtgcgcgagctggccgagttcgaggcgcagggggcggtccgccggctcgggcagaccgacgacgtggccggcgcgctcaccgggatcggcgtgatcctcagcgcctcggtgcgggagagcttccacctcggcgtgatcgagggcgcggccagcggcgccgtcccggtggtccgcgactggccgttcttcgccggccgggcacacagcgcccgcagcatcttcccggccgactggatggtcgagaccgtcgacgaggccgtccagcgcatcctcgcgcacaccgccaccgaggagatctggcaggagaccggcgccgcggcgacccggcatgcgctctccacctgggactggtcggtcgttcagcagcagtacgaccgcctcttcgacaactga

SEQ ID NO: 3539 - DNA, 1539 bp, Actinoplanes utahensis
atgggttcggacgaggcccgccgcatcgtcatgctcgtcgacaacggcgtgaacggcgattcgcgggtgcagaaggaggcacgttccgcggccgaggccggctgggacgtgacgctgctcggccgttcgccggacgacaaggagcacacctggatgctcggcccggcccaggtccgcctggtcccggtgccgttccacctggacaagcggccgcacgagttccgccgccgctgggtgatggcgccgctggcctacccgcagaacggggtcgccgagcagcgcggccagtgggtcaaggcctggcgggcgaacctgacgatggaccggctggtcagcccgggcggtgcgcgggagatctcgcgcaaggtgcagtggcaggcgtcccgggtggtcaacaagtgggtgtcggtccgccagcggcagacgaagaaggcggcgcgcgcgcgcaagacgctggacaccccgagcgacaagctctacacctggttctggagcacggtgcagggcccgcgcgcctggcgccggctggagccgcagctgtgggactgggagctggccttcggcccggtgctcgacagggtcaagccggacctgatccacgccaacgacttccggatgctcggtgtcggcgcccgcgccaagatccgggcgaagacccggggccgggacgtcaagctggtctgggacgcgcacgagttcctgcccggcgtccggccgtggaccaaccacgcccgctggcgcaccgcccagatgctgcacgaggcggagtacgtgccgtacgtggacgccgcgatgaccgtctccgacgacctggccggcatgctgcaggaggcgcaccggctgcccgagcgcccggcggtcgtgctgaacaccccggccgccgagcacgccccggcggacgcggccggcacccccctgcccgacctgcgcgagctgtgcgggatcggcccggacacgccgctgatcgtctacagcggggccgcgtcgatccagcgtggcctggccgtgatggtcgagggcctggcccggcagcccggcgtacacctggccctggtcaccaacaaccacagcagcgggtacatgggcgggctgcgcaagcgggccaccgcgctgggcatctccgaccgggtgcacttcctgccgtacgtaccgcactggcaggtggtgccgttcctggccgcggccaccgtcggcgtgatcccgatcttccacttcccgaaccacgagatcgcgctgatcaccaagttcttcgagtactcgcacgcccggctgccgctggtggtcagcgacgtgcgcacgatggcgtccacggtccgggccaccgggcagggcgaggtgttcacctccaccggcaccccggagacgcaggcgccgccggccgacgtcgacgcctacgtgcaggccgtgcagaaggtgctggacgacccggagcgctaccgggcggcgtacgacaagcccggcctgctcgacggctggacctgggacgcccaggcccgggtgatgaacgacgtgtaccgtcgcctcctgcccgaggcctag

SEQ ID NO: 3540 - DNA, 492 bp, Actinoplanes utahensis
atgctgatcaaggagttgccggcgctggccggcgggggccccgcggtcttctacaccggcgggtccgaggagctgttcgcggcgctgttcccgttcgagaagccggagcgggccgacccgcccgcggcgctgaccgtggtgttcgccggcccggccagcccgttccccggggtgccggcgctgccgccgggcggccggctgttgctgctgctcggctggccgatcgccgagctgccctaccacctgctgctggacccgctggtcgcggccggctgtcaggtgctgcaggcggtgccggtcgatcgggcgcaccggcacggcgtgcactgcgccgtggtggcggcccgggtggaccggctggcgccactccggtcgtacctcgacgattcgcccatcacgctggacggcgagtcgccggggctgcccgcgctgctgcggctgaccggcgagtacaccttcaccgacctggtcagccgcacgcagcggtcctag

SEQ ID NO: 3541 - DNA, 642 bp, Actinoplanes utahensis
atgacgcttctgagcggctccgaggcatcggcgtactgggatgatcggcacgagcgggagagcgacctccgctcgggcggccacatggcgttcgacgaggccaccaaccggatgttctacatgcgccggctggccctgctgatggacctgatcggactccagtcgtcgccggtcgccccgctcttcctgctggacgccggctgcggcaagggctggttcagtcgggagctggtccggttcggccaccgggtggatgcgatcgacggcagcctcaccgctctgcagcacgccgaggcggagggcggcgggccccggttccaccggtcctcgctgtccggctggcgcaacccctggctgtacgacgtggtgttcagcatcgacgtgctcttccacatcctcgacgaggacgagtgggaacgctcggtgcgcaacctggcgtcgctggtccggctcggtggacggctggtgctctccgactgggacgccggccacgaccaggctttcggcaactatcaggtgctgcgtgggccggggcgctaccggccacttctggagggactcggcttgcggtacgacggatggcaaccctacgacttccgggccagcgtcatcggcttccacgcgttcacccgggtcgggtga

SEQ ID NO: 3542 - DNA, 1284 bp, Actinoplanes utahensis
atgaagatctgtgtcgtcgccctgggcaagatcgggctgccgctcgccgttcagttcgcctccaaggggcacacggtgatcggcgccgacgtctccgagccgaccgtgcgcaaggtgaacgcgggcgaggtcccgttcccgggcgaggccgacctggacgtgaagctgaaggaggcggtcagcgccggcctgctcaccgccaccaccgacaccgcggccgcggtcgccgagtccgaggccgtcgtggtcgtcgtcccgctgttcgtggacgccgacggcaagccggacttcggctggatggagtcggccaccagggacatcgcccgcggcctgcgccccggcaccctggtcagctacgagaccacgctgccggtcggcaccacccgcaaccgctgggcgccgctgctgcaggagggctccggcctggtcgccggcgaggacttccacctggtcttcagcccggagcgggtactcaccggtcgggtcttcgccgacctgcgcaaatacccgaagctggtgggtggcgtgaacgaggcgtccgccgcgcacggcgtcaccttctacgaggcggtgctggacttcgacgagcgcgccgacctgccgcggggcaacggcgtctgggacctgggcaacgccgaggcggcggagctcgcgaagctggccgagaccacctaccgggacgtcaacatcgggctggccaaccagttcgcgcggtacgccgacaccctgggcatcgacgtgaacctggtgatcgacgcctgcaacacgcagccgtacagccacatccaccggccgggcatcgcggtcggcgggcactgcatcccggtctacccgcggctctacctgtggaacgacccgaccgccacggtggtccgggcggcccgtgaggccaacgccgcgatgccgtcgtacgcggtggacctgctcgccgcggccgtcggcgacctggccgggcgcagcgtgctggtgctcggcgcggcgtaccggggtggcgtcaaggagaccgcgttctccggcgtcttcccgaccgtcgaggagctgaagcggcgcggcgccacggcgtacgtgtccgacccgatgtacaccgcggaggaactcgaggcgcacgggctgccggcgtggggcggcgaggcggtggactcggcgatcgtgcaggccgaccacgccgagtaccggaccctcggcccggccgagctgcccggcgtcgaggtggtcgtggacggccggcgggtcaccgacccggagcggctcggctcgatccgccgcgtggtcatcggcggctga

SEQ ID NO: 3543 - DNA, 525 bp, Actinoplanes utahensis
atgaacaccaacaccaacgagccgttcatccacccctcggcggacgtggaggacggcgcccggatcggggccggcaccaaggtctggcacatcgcccacatccgctccagcgcgacggtcggtgacgacacggtgatcggccgcaacgtctacctggacgcgaacgcggtggtcggcagccgggtcaagatccagaacaatgtctcggtctaccagggcgtcaccatcgaggacgaggtcttcgtcggcccctgcgtcgtcttcaccaacgacctgcggccgcgcgcgcagaacccggactggacgatcaccccgaccctgatccgccgcggcgcgtcgatcggcgccaacgcgacgctggtctgcggcatcgaggtgggcgagttcgcgatgatcgcggccgggtcggtcgtcaccaaggacgtcgcgccgtaccagttggtgcgcggcaacccggcacggcccgccggctgggtcgacgagaagggcgagatcgtcagccgggatccggagcgacgcccgtaa

SEQ ID NO: 3544 - DNA, 684 bp, Actinoplanes utahensis
atgacctccattccgctcgccgaggaactcctacttctcgcgtacgacgatcagacgggtaaagcgaccggctcccggatcgggctcgatctcggcatggccgccgccgtgctgatcgatctcgcgctggcgggccgggtcgcctacgtcgacggctacctgcaggtcaaggacgagacgccgaccggcgacacgatcgccgacgcggtgctgaccaaggtggccggcgacccgccgcacaccccggcccagtggctgcagcgcctgcgccaccggctgcgcacccgggtcctggaggacctgtgcgcccgcggtgtggtcaaggacgtggatgagacccagctcgactacatccacgtgcaccgctacccgaccaccgacccggccttcgaggcggagatccgcggccgtctggccgaggcgctcacctcggacaagacgccgtccgagcgcaccgcggcgctgtgcacgctgctctgtgccgcccgcatggagccggccctgaaactccccgccgaccaggccgagcaggcccaccgccggcttgaggagatctccgcgggcgccggcttcgcggccggcgccaacctggaggactccatcgtgcgccccagcgtcgcgctggtggtcgccaccctgggcaaggcgatctcagccgccctcggcgctcccaaggcggtctga

SEQ ID NO: 3545 - DNA, 1629 bp, Actinoplanes utahensis
atggcaccagaagttgatattgagttgagggcggccgccgaggcctggctcgcggacgatcccgatccgtcgagccgggctgagttgcgcgcgctgatcgacgcgctcccggccaccgccggggagctgcgcgaccggttcgccggaccgctcaccttcggcaccgccgggctgcgcggccggttgcgggccggaccgaacgggatgaacctcgcggtggtcacccgggccgcggccggcctggtggcctggctggcccagcagggcggcgaggggccgctggtgatcggcttcgacgcccggcacggctctcgcgcgttcgccgagcagaccgcccgggtggcgaccgccgccgggcgcgccgcgttcctgatgccccgggtgctgccgacgccggtgctggcctacgcggtgcgggcgctgggcgcggtggccggggtgatggtcaccgccagccacaacccgccgcaggacaacggctacaaggtctacctcggggacggtgcgcagatcgtgccgcccgccgacgccggcatcgaggcggccatccgggcggtcccgagcgccgccgcggtcccgctgggcgacgcgggcacggtcctgggcgaggacatcatcgcggcgtacgtcgcgaacgccgccgccgtgctcacctcgggcgggccgcgggatctggcgatcgcctacaccccgctgcacggcgtcggtggcaccacgctggccgccgcattcgacgccgccgggttcgccgccccggccgtggtcgccgaccaggccgagccggacccggagttcccgaccgtggcgttccccaacccggaggagccgggcgcgatggaccacctggtcgcgctggccggggcgaccggggccgacctggcgatcgccaacgacccggacgcggaccgctgcgcggtggcgatccccggcccggacggcgcgtggcggccgctgcgcggcgacgagctcggggtgctgctcgccgaccatctgatccggcgcggcacgcccggcgtgtacgccaccacgatcgtctcgtcgacgctgctgggccggttgtgtgcggcccggggggtgccgtacgcggagacgctgaccggcttcaagtggatcgtccgggcggccgacgacctggccttcggctacgaggaggcgctcggctactgcgtcgccccggccatggtgcgggacaaggacgggatcaccgcggcgctgaccgcggccgagctggccgccgggctcaaggcgcggggccggacgctggccgaccggctggacgagttggccgtcgagttcggcgtgcacgccaccgatcagctctcgatgcgggtcgacgacctggccgagatcggcgcggcgatgacccgggcccgccggcggccgccggccaccctgctcggcgagccgatcggctcggtcaccgacctgctgccggagaacgacgtgctgaccttccgcaccgacgccgtccgggtggtgatccggccgtccggcaccgagccgaaactcaaggcgtacctggaagtggtcgagccggtcggcgacggtgacgtggccgcggcccgggaacgtgcggccggcggcctgcgcgcgctgcgcgccgagatcgccgccgtcctcggcatctag

SEQ ID NO: 3546 - DNA, 1875 bp, Actinoplanes utahensis
gtgactcagattccgacgtggagcagcggtgacgcggcctccctcaacgggcgcgcggcccccggcacgctgatcggcgggcggtacacgctgcgtgccgcggtgggtcacggcggcatgggcacggtctggcgggcggcggacacgctgctgcgccgggacgtggcgatcaaggaggtcatcctcccgccggggctggcgcccagcgaccgcgacgcgatgtacgagcgcaccatgcgcgaggcccgtgccgccgccgccctgcagcaccccgcggtggtccaggtctacgacgtggtgcacgagaacggccggccgtggatcgtgatggagctgctggacgcgcgcagcctggccgacatggtgatcgaggacgggccggtcgcgccccgggtggtcgccaagatcggcatcgcgctgctcggcgcgctcgaggtggcccacgcgcacggcgtgctgcaccgcgacgtcaagccggccaacgtgctgatctgcaacgacggccgctgcgtgctgaccgacttcggcgtcgcccggatgcccaccgacgtgcagctgaccacgcccggcatggtgctcggctcgccgcacttcatctccccggagcgggccatgggccaggacttcgggccgcccagcgacctgttctcgctgggcgtcacgctgtacacggcgatcgagggccgcccgccgttcgacaagggtgacccgatcgagaccatgcacgcggtggtcgaggacccgccggccccggtgatgcgggccggttcgctcaccccggtgctgatgggcctgctggagaagaacccggcccagcggatggacgtgcagaccgcccgcaccctgctgcgccagcagctggccggcccgctggccagcaagagcccgccgcacatgatgaccgacccgtattcggtggtgccctcgccgcggccggtgtcgccgccgccggccgccacccagcagatcccgccgcagcccagcggtcagatcggcggccgggccatgctcgcgcccggcgagtcgctcaccgaccacctgaccaagctggaacagcagaacagcaccggtggcggccgccggcgcgccccggagccggccgacgcgggtttcccgaccggcaccatgccggcgcaccaactgccccaggccacccggccgggcaccgtggtgaccagcccggccgccaagcgccggatggcggtgcagaacgccacgcagaccgtcaaggacgcgaccgccagggcccgggccaccttcctgggctggccgcgcaacaagcggctggcggtcggcggtggcgcggcggccgcggtgctggcgctgatcctgatcgtctcgttgaccggcggcggggacggcggtgcggccgtgcagaccccggtcgccggaccgcagaccggtgccgcggcgccgggtggcggcgtggccgccggaacccaggactacaagggcagcaaggcgatctcggtgaaggtgccggccggctggaccagggccgccggcgggacctacgtcgactacgtcgacccggccgacaagctgcgcaaggtgcgggtgctggccgagtcgggcaagtcgacgcccgagcacttcgtcaccgagatcgccccgaacgggctgaagaagtcggcgaactgcccgaagccgttcaaggccgtcggcaccgacaccaacctgcagatctccgggcacccggccgcccagctggaatacacgtgcggcaccggcgacgcgatgcggcacgggatctggcggatgacccaggtcaacggcacgatgtactccttcttcctgaccaccccggcggccgagttcgacggcagcaggaagtacttcgacgccatggcggacagcttccagctcaacctctga

SEQ ID NO: 3547 - DNA, 1566 bp, Actinoplanes utahensis
gtgaacgcagagtcgggtttcaccatcaaaccggtctacgggccggacgacgtgccttcggcggccgggtccgatcagccgggcgagttcccctacacccgcggcgtgtacccgacgatgtacacgaagcgcccgtggaccatgcggcagtacgccggcttcggcaccgccgccgagtccaacgcccggtaccaccagctgctcaaggccggcacgatgggtctgtcggtggccttcgacctgcccacccagatggggtacgactcggacgagccgatcgcgcacggcgaggtcggcaaggtcggggtggccgtcgactcgatcgacgacatgcggcagctgttcgccggcatcccgctcgaccaggtctccacctcgatgacgatcaacgcgcccggttcggtgctgctgctgctctatcagctggtcgccgaggagcagggggtgcccggggcggccctgcagggcaccatccagaacgacatcctcaaggagtacgtggcccgcgggacctacatcttcccgcccaagccgtcgctgcggctggtggccgacacgttcgcctactgccggaccgagatccccaagtggaacaccatctcgatctccggctaccacatggccgaggccggcgccacgcccgtgcaggagatcgccttcacgctggccaacggcatcgagtacgtgcgcgccgcgatcgccgcgggcctggccgtcgacgacttcgcgccgcgcctgagcttcttcttcgtggcccgcaccacgctgctggaggagatcgccaagttccgcgcggcccgccggatgtgggcccggatcatgcgcgacgagttcggcgccaaggacccgaagtcgatgatgctgcgcttccacacccagaccgccggcgtgcagctgaccgcccagcagccggaggtcaacctgatccgggtggcgatccaggcgctcggggcgatcgccggcggcacccagtcgctgcacaccaactcgtacgacgaggcgatcgcgctgcccaccgagaagtccgcccggttggcgctgcgcacccagcaggtgctcgcctacgagagcgggctgaccggcacggtcgacccgttcgccgggtcgtacgcggtggaggcactgaccgaccaggtggagcgggaggccaccgcgctgatcgagcgggtcttcgagtacggctccgcggtcgacgcgatcgagcagggcttccagaagagcgagatcgagcagtcggcctaccggatcgccaacgagatcgacggcggcgagcgggtggtggtcggcgtcaaccggttcaccgcggaggccgaggagaagtacgagccgctgcgcgtcgacccggcgatcgaggcggcccaggcggcccggctggccaccctgcgggccgagcgggacgacccggccgtgcaggcggcgctggcggatctggcgaaggctgccgccgggacggcaaacgtcctaccgtcgatgaaggaagcgttgcgtctgcgcgctactgtcggtgaggtctgccacaccctccgtggggtgtggggcgtatatcgaccggtcgagcgtttctag

SEQ ID NO: 3548 - DNA, 1494 bp, Actinoplanes utahensis
gtgaggtctgccacaccctccgtggggtgtggggcgtatatcgaccggtcgagcgtttctagacgtactcatggtgtgtcacgtcaccctcgtgattcgttacccgttggtgggctggcgggcctactcccgccgcccggcacgtttacgcgaccgttacatagtgtgacgaaaaacggactaagctgtcgcgcgtcgcaaaacccgacgaacttagagagtgatctggaacccgacgtgactactgctctgacggcgcccgacggcgccgatacggcgtggcccgagcctctgcccggcgccgaccccctacccggccagctcgaccgctggctcgccgcccggggagccgagctggtagcgatccgtcggcacatccacgcccacccggaacgatcacactccgagttcgagaccgcggccctgatcgcccgcgaactcaccctggccggcctcagtccgcggctgatgccccgcggcaacggcgtcatctgcgacatcggcgagggcgaccgggtcgtcgccttccgcgccgacctggacgcgctgccgctgcacgacctcaaggacgtgccgtaccgcagcaccgtggagaaggtcgcccacgcctgcggccacgacgtgcacaccaccatcctgctcggcctcgggctggccctggcccagctgcacgagcagggcgagcttccgggccgggtgcggctgctgttccagccggccgaggagcacatcccgtccggcgcccccgaggtgatcgccgccggcggcctcaaggacgtcgccgcgatctacgccctgcactgctacccgcagctgccggccggcctggtcggggtccgctccggcccgttcaccgcggccgccgacacgatcagggtgaaactgtccggccccggcgggcacaccgctcggccgcacctgaccgccgacctggtgcacgcgctcgggcgggtcatcgtcgacgtgccggcgctgctcgaccgccgggtcgacccgcgcgccggcgtctccctggtctgggggtcggtccacgccggccaggcgttcaacgccatccccggcaccggcgaggccagcggcacggtccgcatcctcaaccgggacgcctggcgcgaagcccccgagatgatcaccaaactgatccacgacgtggtcgccgcgaccggcgccggcgtcgaggtcgaataccggcgcggcgtcccgccggtgatcaacgaccggatggcgaccgcggtcatcgcgggcgccgccggggccgcactcggcgccgaccgggtcgtcgaggccgagatcagcatgggcggcgaggacttctcgttctacctggagcacgtcccgggcgcgatgatccggctcgggaccggggtgccggggtcggacgtgcggcacgacctgcaccagggggatttcgacgtggacgaggcgtgcatcgggcacggcatccgggtgatggcgcacaccgcgctcgccgccctctcgaccggcgccttctga

SEQ ID NO: 3549 - DNA, 957 bp, Actinoplanes utahensis
atgcggaaacggggttacaccttggccggcgccgtgctgctgtgcggcgccctgctggccggttgcggttcgggggattcctcggactcgtcggcgagcagcgacagagcggccgcgccggccgggggcaacgcggcgcccgccgaggccgccgcgggcgggaaggcggacagcggcaccgcgcaggacagcgtcggggccggccagcggagcacggcacagggtaaggacaccccggccgagtcgccgaacctgagcgtggaccagcggtcgatcatctacaccgggtcgatcaccgtgcaggtcaaggacgtgaacgcggcggccgcgcaggccaccggcatcgcggccgggacgggcggcttcgtcggtggcgacgaccggcagagcggcaacagcggcgccgccaccgccaccctgaccctgcggatcccggccgccaagttcagcgcggcgctgcagcagatcgccgggctgggggtcgagaagaaccgggcgatcaacacccaggacgtcaccgaggaggtcgtcgacctggacgcccgactcgccgtccagcaggcccgggtcgactccggccgcaagctgctggcccaggccaagtcgctgagcgacctggtcatgctggagaaggaggtcgccacccgggagtccgacctggcctcgctgcaggccaagaagcgccgcctcgccgacctgaccgcgctgagcacggtcaccgtcgtcctgctcggtccggacgccgcggtggccgccccggccgccgcctcccccggtttcctcagcggcctcaggaacggctggcacgccctggtcgcctcgctgtcggtcctgctgaccgtcctgggcgccctgctcccctggttcctggtcctcggcgtgccggcctgggccctctggtacttcacccgccgctaccgccgcgcccgctccaccccccagctccccaccccgtag

SEQ ID NO: 3550 - DNA, 636 bp, Actinoplanes utahensis
gtgcgcgtcacgaagctcacccacgcctgtctgcggatcgagggagcgggggtgctggtcgtcgatccgggtgaattctccgagaagtcggcattggacggtgccgacgccgtggtcatcacccacgagcacttcgaccacctggacgtcgccgcgctcaccgaagccgtccggcgccggccggagctccggatcttctcgcacgccgcggtgctcgcccagctcggcgagatcgccgaggcgaccaccgaggtgcggccgggcgacgagttccgggccgccggattcaccctccgggcgtacggcgggcagcacgcggtgatccacccgtacattccgcggatcgccaacctcggctatctgatcgacgacggagccggcagcctctaccacccgggtgactcgttcgtggcgccggacggcgcgccggtcgacaccctctgcgtgccgctgaacgcgccgtggatgaaggtgtccgaggcgatcgagttcgcccgcgcggtcaagccgggccgggccatcgccatccacgacggcctgctcaacgaccgcggcgcggcgatctcggacggccacctggagaggttctccgaaacccgctaccagcacgtcgccccgggtaccacgctcacctga

SEQ ID NO: 3551 - DNA, 1074 bp, Actinoplanes utahensis
gtgcctgaggtgatcgacgacgtggtgcggcggctgtacgaggagccgccggaaggtttcgtggcgaccagggcggccgcgatcgaggcggcccgggcggccggcgaccgggatgcggccaagcggctggccgcgctgaagaagccgaccgtggcggcctgggtggtcaatctgctcgcccgccggcggccggatctgatcggtgacctggtggagctgtccgcggcgctgcgggccgcccagcgggaactgcagggtgaccagctgcgggagttgtcccagcagcggcgggcgttcgtgtcggcgctggtcgccgaggcccgcaagctggccgtggcggccggcgccggggccgggaagctgccgctgggcgaggtggagaccacgctgaccgcggcgctgtccgatccggaggtcgccgagcaggtgcgcaccgggcggctgatccggtcggcggcttatgccggcttcggcgaggtgccgcgtccccggctgcggttgatcagcggcggcgaggacgccgacgtgaccgaggacgacgaggacgccgacgcgagcgatccggttgacgagccggccgcgaccgggcgatccagccgtggtgacgcgagcgatccggctgacgggccggccgcgacctggcgatccagccgtggcgacgcgggccggaaaggcgcgggtcccgacgaatcggatccggacgaggcggcgcggcgcgaggcggcccggaacgaggcggcacgcgaggcggaggcgcgggaacgggcggcccgggaacgccggcgccgcgaggaggagcggcggcgccgcgatctggaacgcgacctggccgccgcggaagccgccgagcgccgcgccgacgaacacctcaaccgcgccgaggaagccgaacgagacgcccagcacctggtggacgacctggacgcggaactggccgagctggaacgccgccgcaccgaggcggtcgccgacgtggcccgccgcaaacaggcccgccgcacggccgaacgcgagtccgccgccgcccgtcgtcgcgtcggcgacgttcaggccgccctcgacgacctcccctga

SEQ ID NO: 3552 - DNA, 972 bp, Actinoplanes utahensis
gtgtcgcgtccgtgcccaccctcggacgtcgcccttgcgggccgggcgctctggacgcgcagcggccagcccggcccgcaagggtcccggcgggagcagcgatcagttatcggccgcagcgcacgacatctgctccatgaatttgatcttgaccttggggcgcggcgcattcagcccggggattgtggatacggtggattttgtaaatcggtcaggcggggcagaatcgggcgggtgacccccgaacaggctgccgccaacgccaaggcgagcctcgccgccatcgtcggcgccttcgccgaatccccgcagaccctgcgccgcgcgcggctgctcgggctctccggctgggcctatcacgtgtcggcccgggccggtgcgctcggtgacgtgcggccggagacggtcgcggccgcggtggcgttcatcgcgccggaggcggtcaccgagggctgggaggcgaccgcgaagagttcgcagccgtccgaggtggccacctggcacctgcgcgagctgtgcacctggggtgcggagcaggtgggcggcttcccgcggctgacccggctgctggagctggccgagcgggtggtgggcgcggtcgacccggccgggctgccgctgttcgcggcctggcgggcgatgccggtgccgagccaggagccgggggcccgcgccgcgatgctgctgcacctgctgcacgagcaccggcagggggtgtacgtgatcgcggtccgcgccgggggcctgaccccgctggaggcgatcatggcggggccggagggggagaccggggcggtggcgctcggctggcaggcgccgtatccgtcggccggcccgctggtgcgccggctgatgtgggccgaggcggtggcgaattcgttggccgggcaggcctacggcaccctggaccggccggagcgggtggagttcgccgggctgctggagtcgctcgggcatcggctggtccgctga

SEQ ID NO: 3553 - DNA, 975 bp, Actinoplanes utahensis
atgccagccatgaccgcgcttccggacggctggaccacacgccggcccaccctcgacgacgtgccgctgattctggagctggtgcacgccagtgacatcgccgcggtcggtgagcccgacttcagcgccgacgaggtgcgcgacgagctgaccgggccgcacaccgacatgagccgcgactcgtggctggccttcgacgacgccgggcggctggccggctgggcctatccgcggaacccgaccggccaggcccgggactttctggaggtctacgtgtggccggggcgcggcgtgccggcccagcgcccgctgctcgacctgatgatggggcggatggccgagcgggccgccgaactgggccacgacccgtacacggtgcgggccggcgcgatcccgaccgagacggagtacatcgaggcgctgaccgcggccggcttcaccttcctcaagcagcacgcgcggatgcggatgtcgctggacgggatcggcgccgaggcgccgcgcccgccggccggggtgacgatccgcccggtgcgccacgacgacgaggccgagctgcgccgcttccacgcggtgatcgaggaggcgttcctcgactccgaccatccggcgatgagcttcgacgactggcggcggcaggccgcgaccggcggcccggtgccgtacgacgagtggttcgtggcggaggcggacggcgagctggccggggtgctgcagtccaccgagccggaggaccgcgacgagggctgggtgcgctatctgggggtgctccggccgtaccgcaagcggggtgtcggtgaggcgctgctgcgccgcgccttcgccgcctacgccgggaaggggcggtccgcggccgggctcggggtggacatggcgaacccgaccgaggccgcacgcctctaccggaaggtcgggatgaccccgctctaccgggcgaatgtgtaccagaccaccgtgccggcggcccgggcctag

SEQ ID NO: 3554 - DNA, 528 bp, Actinoplanes utahensis
gtgcatctgtgccgacacgcacttctcatattctcaccgaccgtcgttacgactatcgtcgtcgccgtgcgtcactacgccgcgtatggctcgaatctggacccagcccgcatgctggcctactgtccgcactcgccgatggtcggcgtggggtggatcgaaggctggcgcctgacctttgccggagaaggggaaatgggctgggagggtgccgtgacgacgatcgtcgagtcgcccggcgaccgtgtcttcgtctccctctacgacgtgcatccgtgggatgcggcacaactcgacgaggtcgagggggtgcccgccgggacgtaccagaaactcaccgtgcgtgtatcgacccttgacggtgaggtgcccgcctgggtgtacgtcttcgccggttacgagggcggcctgcccaccgcgtggtatctctccgagatcgccaccgcggcggagaaggcgggcgcgcccgacgactacgtcagcgacctgcggcaccgtccgaccgggacggcgtccccggaaagctag

SEQ ID NO: 3555 - DNA, 1401 bp, Actinoplanes utahensis
gtgagtcggatcgtgatcatcggtgggggaccgggcggctatgaggcggctctggtcgccgcgcagctcgacgccgatgtgaccctggtcgaggcggacggtcccggtggcgcctgcgtgctgaccgactgtgtcccgtccaagacgttcatcgccagctccgaggtgatgaccggataccgccacaacgaccggttcgggatccgctcccgcggcctggacggggtgagcgtcgacgcgaccgcggtcaacgagcgggtcaagaaactcgccctggcccagtccggcgacatccagaccaagctggtcaaagccggtgtcgacgtggtgcacggccgggcccggctgggcgaggaccggctcggccacacccatcaggtgctgatcaccccgcacgagggcaggccgtacgcggtcgaggcggacaccgtgctgctggccaccggcgccaccccgcgggtgctgccgaccgcccgcccggacggcgagcgcatcctcgactggcggcaggtgtacgacctgaccgagctccccgagcacctcgtggtgatcggttccggtgtcaccggtgccgagttcgccagcgcgtacctggcgatgggcgtgcaggtgacgctcgtctccagccgcgaacgggtgatgccgcacgaggacgcggacgccgcgatggcgatcgagcgggtcttccgcgagcgcgggatgaccattctcagccaggcccggggtgactcggtggtgaacaccggcaccggcgtgcgggtcaccctggccgacggccgggtggtcgacgcctcgcacgcgctgatcgccgtcggtgccatcccgaacacccgggacctcggcctggcggagtacggcgtggcggtcggccagggtggctacgtcaccgtggaccgggtgtcgcggaccaacgtgccgggcatctacgccgccggtgactgcaccggggtgctgccactggccagcgtcgcggcgatgcagggccggatcgcgatctggcacgccatgggggaggcggtcgccccgctgcggctgcgcaccgtctcggcgaacgtgttcaccgacccggagctggccaccgtcggcgtttcgcagaacgaggtggactccgggcgcaccccggcccgccaggtgatgctgccgctgaccggcaacgcccgggccaagatggccgacctgcgggacggtttcgtcaaactgttctgccggccggcgaccggtcagatcgtcggcggggtggtggtcgctccgaaggcgagcgaactgatcctgccgatcaccatggcgatcgagaacaacctgaccgtggaccagctggcccataccatcacgatctatccgtcgctgtcgggttcgatcgcggaagcggctcgtcagctgatgcagcacgagatccagtag

SEQ ID NO: 3556 - DNA, 678 bp, Actinoplanes utahensis
atgaccgaactgctgacgatggtggcctcaccggtactggtctacctcgcactgttcggatttctggcggtcgatgcactgatcccggtcgtcccgatccaggccatcatgatcactaccggtgcgctgaccgtctacggtcacctgcacctgggtgtggtcatcgcgatcggcgcgctcggcatgttcaccggcgacctgatcgccttcctgctgggccgctccaccgggcatcgcctgagcgcgctgcacgcccggttcgccccgcgcaccaccgactcccgcacccggcaggcagccgagcggttcacccgcggcctgcgcaagccggggccgctggtggtgctgctctgccggttcgtcccgggcggccggatggcgtccggctaccacgcgggccgcaccggctacccgatgcggctcttcgtggcatacgacctcggcgccgccctctgctgggccggttacggcggcctggtcgggcatctgggcggcaccgcggtcacccagtcggcctggcggctgttcgcgatcgcggccggcgcggccctgatcttcgggacggccggctggatcctcgcccttttcgggggccgcgagtcggctactggatctcgtgctgcatcagctgacgagccgcttccgcgatcgaacccgacagcgacggatagatcgtga

SEQ ID NO: 3557 - DNA, 765 bp, Actinoplanes utahensis
ttggcggtgcccgcgggctcggatctccccggttcggtgccgcggccgcgggccgccggtaggtcccgtatcggcggcccgtcccagcggccacccggcatcttgtcgctgcctagttatcctgggccggtgaccagaccgagctaccaccacggtgacctccgccgggccctgctgaaggcggccgccgactcgatcaccgaaaccggggtgaccgcgctcagcatgcgggatctggcccgccgggccggggtctcgcacgccgctcccgggcaccacttcgccgaccgggccgggctgctcaccgcgctcgccaccgacggcttcgaacagctcgccaaagccctggccacctcccggctggccagcaacagcctgctcgaactcggggtgacctacctgcggttcgcgctggccaaccgggcgacgttcgaggtgatgttccggaccgacctctaccacgccgacgacccggcgctgctggccgcgcggcgccaggcggccgacgcgctgtacgccggaatgaccgacctgccggacgcgccgctggccggcccggacgtggcgacccacgcccgggccgcccgcgaaggcaccgccgacctggtctccgacgaggtccgcgaagtcggcctggccgcctggtcgatggtgcacggcttcgccaccctgtggctcagcggggccttcccggacagcacccaggaagacccggtggaagcggcccgggtgatcctgggccgcgtccgggcgatgggacggtga

SEQ ID NO: 3558 - DNA, 1755 bp, Actinoplanes utahensis
gtgcggaagatattgatcgccaaccgcggcgagatcgccctccgggtcatccgggcctgcaaggacgccggcctgaccagcgtcgccgtctacgccgacggggatcgggacgccccccatgcccggctcgccgatgaggcgtacgcgctggacggcgagtccgccgccgacacgtacctgcggatcgacaagctgatcgcgatcgcggagcgggccggggccgacgctgtacaccccggttatgggttcttgtcggagaatgcggagttcgccgaggcggtgctggccgcggggttgacctggatcgggccgagcccgcagtcgatccgcgacctcggcgacaaggtgaccgcgcggcacatcgcgcagcgggcgggggcgccgctggtgccgggtacgccggagccggtggccgatgccgcggagatcgtggcgttcgccgaggcgcacgggctgccggtggcgatcaaggcggcgttcggcggtggtggccgcggcctgaaggtggcgcggacgatcgaggagatcccggcgctgttcgagagcgcgactcgggaggcggtcgccgcgttcgggcggggcgagtgtttcgtcgagcgttacctggaccggccgcggcacgtcgaggcgcaggtcatcgcggacacgcacggcaatgtcgtggtggtcggcacgcgcgactgttcgctgcagcgccgccaccagaagctggtggaggaggcgcccgcgccgttcctcagtgacgagcagcgtgcgagcatccacgagagtgcgaaggcgatctgccgggaggccggctactacggcgccggcaccgtggaatacctggtgggccaggacgggacgatctccttcctggaggtcaacacccggctccaggtggagcatccggtcagcgaggagacgaccggtatcgacctggtccgggagcagttccggatcgcggccggcgagccgctggcgatcaccgaggatccggtgccgcgcgggcacgcgatcgagttccggatcaacggtgaggacgcgggccgcaacttcctgccggcgccgggcaccgtgtcgacgctcgtctggccgtccgggccgggggtgcgggtcgacgcgggtgtcgaggcgggcagcgtgatcggcggcaacttcgactcgatgctcgcgaagatcatcgtggtcggcgcgacccgtgagcaggcgctggagcgctcgcggcgggtgctggacgagacggtgatcgagggcatcgcgacggtgctgccgttccaccgggcggtggtccgggacgcggcgttcgtcagcgagccgttcaccgtgcacacccgctggatcgagaccgagtgggacaaccgggtcccggcgttcagcgcgccggcgcccggcggcggcgaggccgccgaccgcgagaccgtcgtggtcgaggtcagcggccggcgggtcgaggtccgcctgcccaagagcctgcttgccggtacgcccggacccgccgccgccccgcagaaacgtgccggacggcctcgcggtggcgcctccaccgcggtcgcgagcggcgacagcctgaccgccccgatgcagggcaccgtcgtgaaggtcgccgcgcagaacggtgaccaggtcaacgagggtgacgtgatcgtggtggtcgaggcgatgaagatggagcagccgctgaccgcgcaccgggcgggcacggtggccggcctgtcgctggaggtcggcgccacggtgacggccggcgcggtgatctgcacgatcgagggctga

SEQ ID NO: 3559 - DNA, 666 bp, Actinoplanes utahensis
atggggcttgcgtggggttttggggcgcgcaggcttgtagtctcaccgtttgtgcagagtgacaacgcgtaccggctgattcttgcctcggccagccctgctcggcgggcgctgctcaccggggcggggatcgatgcggagatcattgtcagcggggtggatgagagcgtcgtcgaggcggaggacgcgtacacgctgagccttgcgctggcgcggatgaaagcgcggacggtggcggcggagctgccggcggatccggcggtgctggtgctggggtgtgactctgtgctggcgttcgaaggggagatcttcgggaagccggcggatgcacatgaggcagtgcagcggtggaaggcgatgcgcgggaagtccggggtgctgcacaccgggcatcacctgaccgggctggtcagcgggcggcaggcggaggccgtggggacgaccgcggtgcacttcgcggacgtgaccgactcggagatcgaagcgtatgtggcatccggggagccgcttcaggttgccggggcgttcacgctcgacgggcggggtggcgcattcgtggagcggatcgaaggggaccccgggaatgtgatcgggctgtcgctgccgctgctccgcaccctgctccgggacatggatgtgccgatcatcgacctctggcggcggtag

SEQ ID NO: 3560 - DNA, 1338 bp, Actinoplanes utahensis
gtggtcgtcgccaccgtcaaccaagggagccacctgatgttcgccaattcggacaacggcggcggaacggactggtcccagcggtccgtacccgaaatgtggtcgatgctcgccccacacgacggaaccacccacaaaaccttgctggtcacctggaagaaatccgccgacctgctgatcgatcacctgtcccgggtgaaacggtaccgggacaacctcgccgaagcctggcccccgaacaagagcaccgccgccgccaaatacctggaccgcctcgacgacctgatccagcacctgaccaacacccacgaagccaccatcgaaaaccaccgagccctgggcgccgccacctcctcgctggtcagcgcccgtcaaaaactggaatccatccaccaggaatacctggcgaaccagcagcagctggcgacctacgacgccaaggttcagcagaatgcccagccgttgagtaagtatcggggcataatccttcccccgaacacggcgacaccggctcggcagttggagcttgagcggcaggcgcaatccatcatgtccaccctgagcaccgaactaatccaagcccagctaaacatcaccaccccacccttgtacgaaatcgccaaaaatttcgatgatagtcgaccgttcggccaaccgggaccgaatacgacatcaaaaccttcaaacaaagctaccctgcccgctatcgatttttcgcgacataaactgcagtccgctcagccaggtggcgacaacaccggcgaatctggcagccgcagccctgtatcgaattcactacctccaccttctggccatgccccctccgcttcccgccccggcgagtcagaaccagcagttcctgcgagcgaggtgatagttccggagaagattccgcctatgggtgcaacacgtgcgcctgcagcagggtccactgccggaatccccggcagatacatcgaatcaaactcaaacagtgagattgttcgcccaaaaattggtcttccgccggaagacacccattccccaacccgaggatttcaaccacttccagccggcggcgtaattggcagtccgataattcctggaagcgcacgtcccgcctcaaacagcaatagagcgcaacgcatcaatccggcgggcgggatactcggacagcctgggatagccagcccatctacacctacaagaaggtcatctaggtcgcgcgatgagtccgcgagcgggcgatgggacccagaaaatccttgggaaacggataaaggagtagctccgatactactacctgcagagaaggcggtaatcgaccccggcccagtaatcggactcaaaaatgactag

SEQ ID NO: 3561 - DNA, 753 bp, Actinoplanes utahensis
gtggttccgaacgacgacctggtgcgcgctgacgctcagatatcggctgacatcaccgcgatggaagacttcgccagaaaattgctggccgaggtcgacaacaattacgcgccgcacgcggatcagttgtccaaccagctgctcacccgcctgccacccgccgacgcccgcttccacgagctgtccgcgttcgcgaccgtgctggagtccgcgcaggacacctgccagcagaacatctacaacttcgcgaacggcacccacggcttcgccaaagccgccgagcaggtgagcgagcagtaccgcggctcggacgctttcgcccgcgcccgcctcaaagatgtcgaagcggcactgtccgttgcgggcctgatcccgcccacctccggcgggccactgccggcggcgtcatcttcgggctcgacggacgcggccgccttctcggcctcgccgccggatccttcaccgcctgccggggccgtcggcagccctgcgtcatccgccgcctccagccctgcgcccgccgccgcctccagccttgcgcccgccgccgccaccagccctgcgcccgccgccgccaccagccttgcgcccgccgccgcctccagccctgcgcccgccgacggggcagccacctcttcaggcacctcttcatccgccccggccgtgccgccgcttgatccgtcgccggctgctccggccttccccgagtcctcaccgtggtcgtcgccaccgtcaaccaagggagccacctga

SEQ ID NO: 3562 - DNA, 1083 bp, Actinoplanes utahensis
atgtcttcttctcccccgctcgttgtcgctgatcggtaccggctggttgcgccgctcggtcagggcgggatgggtcgcgtctggcgggcgaccgatgtcgtcctgcaccgcgaggtggcgatcaaggaactggtgccgccgcccggtctgactcccggcgagcggcaggagatgcgcgaacgctcgctgcgtgaggcgcgggccatcgcccgcctcaacaacatcaacgtggtacgcgttttcgacgtcctgcgcaccgacgccgacccgtggatcgtcatggagtacgtgccgtcccgatcgctgcaggacacgctcgccgcggacgggccgtacaacccggtgcgcaccgccgagatcggcctcggggtgctgaacgcgttgaaggccgcgcaccgcgccggcgtcgtgcaccgggacatcaagccgggcaacgtgctgatcggtggcgacggccgggtggtcctgaccgatttcggtctcgccaccgtcccgggtgacccgaatgtgacgcgcaccggcctggtgctgggttccccggcctacatcgctccggagcgtgcccgcgacggcaccgccggcccggccgccgacctctggtcactcggcgccacgctgtacgccgcggtcgagggccagtcgccgttcgcccgcccgtccgcgatcgccacgctcgccgccctggccaccgagaacgtgccgcaggcccggaacgccggcccgctcaagccggtgctcaacggtctgctgcgcaaggatccggcgcaccggatcgacgccgaggaggcggagcgcctgctggcccgcgccgccggccgcaagtccaagatcagtttcccgatgagcccgacgatgcgccgccccggcgccggccgggaacgcccgtcgctgcccagcggcccgggcggaccaccggtgctgcccggcagcggtttcgtcaccgccaccggctcggcccccgtcgtgcccaccccgcgcccgccggtcaccggccgtcccgaccagccgaaccgcccgcacggcaccccgggcgcccccggctccccgggcatgggcacagcggcatgggcaacagcggcctag

SEQ ID NO: 3563 - DNA, 3021 bp, Actinoplanes utahensis
atgaccggtccgtccgccggccgcggcggtttcacgccgggccgcgccacggtcggccgcgccacccccggccagaagcccctcgacgcgacaaaggtcgacggccccgcgatcaccgacgaccagcccggcacccgcggcccgtccaacctcgccggcccgtccggccccgctgccacccgcggcccgtccgacccggccgggtccgacccggctggctccggcggtcgccgcggcctggctggttccagcggtcggccggacctggccggctccggcggtcggtccgaccaggcgggcaccggtcgttcggccgacctcgccggcggtcgtccgggctctccggcccgaccggtcccgtccgagctgccggccacccaggtcaacacggccagggtcggtttcaccgccgccgacgtggccgccaaccgccgcaagaaggcggctccggaacatgaggcttcgctcgccgccgccaccggctcctaccccgtcgtttccggcgccgagcaggaccccgacaacagctcgcggcagcaggacagcggtgcggcggcggcaacgcccggcgacgcgtccaccgtgccacccgcgaaggcgtccggctcgaaggccgcgacgagggatgcgcggcctggccagagttccggcacgccgaccgcgggcacgccgaccgcgggtacgccgaccgcgggcacgtcggacgcccggaccgccggaacatccgggccgaacaccgtgaacgcgccgggtaccgacacctcggaccctgtggggcgggctgggcgcgcggtttccgccggtgcggcgactgccgccgcgggccggtcgctgtccgattctgcccaggcggaatcggacaagatccgcgcgacgccgcagtctgacgagatcggcgcgcgcccggccgctgtcaccgagaaccggattgcgccgtacgcggcggagctgccggactccgagcccggccgcaccgcctccacggaatcggagcgagtgtcggctcccgccgcgaacatccagccgtccgtcagcagcggcgcccgtgacgccgatggcaccggcgacgccgaaccggccgactcgtcggtgtccacaggcgctgaccggaaagcggcctccgacagccggaagccggattccggcgatcagcagcccgtcgtcgacagccggaagccggagtccgccggcgctcagcccgttgccggcagccgcacgccgcagtccaacggccagcagtccattgccggcagtcgaaagccgggttcagacagccggacgcctctcgaccggcagagcctcggctccgattccggtggtcagcgctccgggtccgaggctcccgagtccgggttcacatccgaagccgatggtcagcggtccgggtccgggtccgggtccgggtccgggtccgacgatcatggatcaggggctggcggccagggttccgggtccggcggtcggacgtccaagtccagcggccagggctccaagccgggcggcccgggctccgagccgggcgaccgggcctctgggtccgacgaccggcggcagacggccagtgaccggaaatccgggtcaggcagtgagaagcgtgggtccggcagcctgaagcccggctctgccaaggaaagctcccgccaggatggcgggctcgatacggccggtgctacagccgctggagtggtcgcggacgcatcgagggcctccgcctcaacggcgtccgccccgacgacttccgccacgaaggcgacgtcgggcggtcccggcgccgacgccgagaccgccgatggatcggttgccgcggcggactctgaggcggaccgggcggccacgagcaaggccggagaagtggcggccacgagcaaggccggagaagtggcggcctccagcggggcgacggcaacgaccggtgcgaaagccgcaggcgaagcggccacggatacggtccccgccgaggcgaagggccgatcgcaggacaccgctgagtcgaatgccaaggcacagcgcgccaatgattcggagcgcgcggctgggccccgcctcggggtcgagtcggggccagggcctgcgggcaagcggaacgctgaatccggcggagccgcggaacgggcggctacgccgctcaccccggggcagcggcccggcggcacgccggagcaggatcaggaccggacttcggttgtcgacttcacggcgatcgtgccgcagtcgccggcggtgtccgcggccgagcatgacggtgcgacgcgggtggtgaaccagcttcccgggttccggccgtccagccgtcccgcgtggacgccgatctcgacccgtccggtggtccggcgggtcaacgggatcacgatcttcggcacgacgctgacccggcggcaggcgacgatcgcggcggccatcgtgctgaccttcgtcctgctgatcgggatcatcctggtgcaggcgttcggttcggacgacgacaagaaggcgaccagcaccaagccgggcgcggtcggcaccggcaaggtggcgccgccgggcaagcccgcggccagcaccggtgcggacaagccggccagcatgccgccgtcggctgctccgtcgtcggccgcgccgtcgggcggtgtcccggccggatggagcaaagcggacttctccggtttctccttggcgcttccgcagggctaccagatcgggcggagcgacgccggccagaccgagatcaaactggacgggaatcggctgctgatcgttctccgcggcaccgacacgcaggatccggcggcgcagttgaacagtgtcagccggtccgggttccaacgggtcgggtcgatcaggccgctgcagtatcagggccggcctgccgctgatctcgagtactactactacaccagccacggcaacaaacagcacgtcgtgcgccgggccttctcggtgggtggcgcctcgtaccagatctgctggtacacctcacccgatgactgggactcggccgccgccgagcgcgaggccgtgttcgccggtttccaggcgggctga

SEQ ID NO: 3564 - DNA, 210 bp, Actinoplanes utahensis
atgaactgccgacgacacggcagtaagcccacgctggcgctgtggatgctggtcgcgtgcgcggacatcgcgatcgtcgcggccgctgccggcccgatcaccgtcctgctcgtcctggccggtctgctggtcgctgccggcggcgtctacgcggcgcgaagtctcggcaaccgggccccggccgactccgcggcccgccgccgcgcctga

SEQ ID NO: 3565 - DNA, 768 bp, Actinoplanes utahensis
gtgcccggcgtgttgtcgatcgagggtttcagcggcctgcacgacgtgaacggcctcagcgatctgtgggaccggttgatgagcgcccagcccgaccccccgggcatcctggtcctggtcaccgcactgatcgggttcgccgcggtcttccggccggcctggcgggtcacccggaacgcggtgacgatcgcccacgagggcgggcacgccctgttcgccctgctcaccggccgccggctgcgcggcatccggctggagttcgacacgtccggcctgaccctgtcgtccggccgcccgaccggtgtcggcatgatcctcaccctggtcggcggctacatcgccccgtcgctggtgggtctcggcggcgcctggctgctgaacgcgaaccgcatcacgctgctgctctggctgaccgtgctcctgctgctggtcatgctgatcaacgtccggaacctgttcggcgtgttgtcgctgctggtcaccggcgcgatcgtgttcgccgtgtcgtggtacgcggcgccggacacccaggccgcgttcgcctggaccggggtgtggttcctgctgttcgccggcgtccgcccggtcttcgagctgcagagtctgcgccgccgcgggcggatgcgggactcggacccggaccagctggcccgcctcacccacctgccggccctgttctgggtgggcttcttcctggtggtgaacgtggcggtgctggtcaccggtgcgttcatgctggccggtcagtacctcccggccagcacgtaa

SEQ ID NO: 3566 - DNA, 1572 bp, Actinoplanes utahensis
gtgacaacgcagcccgacatccacacgaccgccggcaaactcgccgacctcgcgaaccgctcggacgaggcggtgcacgcgggatccgcgcgcgccgtcgagaaacagcacgcccgcggcaagaagaccgcccgcgagcggatcgagctgctgctcgacaaggattccttcgtcgagctcgacgagctggcccggcaccggtccaccgccttcggcctggaccgcaaccggccgtacggggacggtgtggtgaccggccacggcaccgtcgacggccgccaggtctgtgtgttctcgcaggacttcacggtcttcggcggttcgctcggtgaggtcttcggcgagaagatcgtcaaggtcctcgacctcgccatgaagatcggctgcccgatcatcgggatcaacgactccggtggcgcccggatccaggagggcgtcgtcgccctcggcctgtacgccgacatcttcttccgcaacgtccgggccagcggcgtcatcccgcagatctccctgatcatgggcccgtgcgcgggcggcgcggtgtactcccccgcgatcaccgacttcaccgtgatggtcgaccagacctcgcacatgttcatcaccggccccgacgtgatcaagacggtcaccggcgaggaggtcggcatggaggagctgggcggcgcgcgtacccacaacacccgcagcggcaacgcccactacctggcctccgacgaggaggacgcgatcgactacgtccgggcgctgctgtcctacctgcccagcaacaacctggacgagccggtcgtctacgaggaggcggccgacctgtccgccgccgacgccgacctggccctggacacgctggtcccggactcccccaaccagccgtacgacatcaagaccgtggtggagacggtcgtcgaggacttcctcgaggtgcagccgctgtacgcgcagaacatcgtggtcggcttcggccggatcgagggccgcccggtcggtgtggtcgccaaccagcccacccacttcgccggcaccctcgacatcgcggccagtgagaaggccgcccggttcgtgcgtacctgtgacgcgttcaacatcccggtgctgaccttcgtcgacgtgcccggcttcctgcccggcaccggccaggaatgggacggcatcatccggcgcggcgccaagctgatctacgcgtacgccgaggccaccgtcccgaaggtcaccgtgatcacgcgcaaggcctacggcggggcgtacgacgtgatgggctccaagcacatcggcgccgacatgaacttcgcctggccgaccgcgcagatcgcggtgatgggcgcgcagggcgcggtgaacatcctgtaccgcggcgatctcgcggccgccgacgacccggccgcccggcgcgccgagctcgtccaggaatacgaggacacgctggcaaacccgtacatcgccgccgagcgcggctacgtcgacgcggtgatccggccctccgagacgcgcgcgcaggtgacccgggcgttgcggatgctgcgcaccaagcgggagacgctgccgccgaagaagcacggcaacatcccgctgtag

SEQ ID NO: 3567 - DNA, 198 bp, Actinoplanes utahensis
ttggagccgtcggaacgggtccgtttcatacctgttgtcccattcgttacgcctcacgtgacgaactggatgaccgcggccgggctcgctttcatcgcggggggcctcgccacactgatcagtttccgcgcggtgctgttcggcggcgagaccgagccggagcggccccggcagcgcggccgtcggcaacctagctag

SEQ ID NO: 3568 - DNA, 1167 bp, Actinoplanes utahensis
gtgcatgccgacgagggtccggccttcccggatctggctccgccggacctggccttcccggacctggctccgccggacccggccttcctgcgtcacgccgacgacctcggtgcggggcccttcggtgacgagagcggcgcctaccccgcgatgccgtggggcgacgaggagatggccggcgacgaaccggccggcgaggcatcccgctacatcgacaacaccgcgtggcggaccgatcccgcggcggcggatccgccgcaggccggggacgatgtgcggtacgaccggagctacgccccgccgcgccaggcgatcgaccgttccgaccgggcctacggcgaccggatcgacggctgggtccgcccccgctaccgcgacctggacgatcgcccgccggccggggactactggacgccggtgccggacgatcgctacgccgacccggagccgtccgcccgtgcctacggctggccggtaccggtcgagcggctcccgtcggttcccgactacgagccggcgaccggtttcgatctgacgccgatgcaggcggccgagccgaccacgctggtgccgacctggccgccgccgtcaccggaccaccggatccgcctgccgcgctcctggtccgaccgcgaccggaacctccgcgacgcggccgaccgcgaccgggacgcccgggatgcggccggccgggatctgaacgcccgcgacgcggccgaccgcgaccgggacccccgggatgcggccggccgggatctgaacgcccgcggtgcggccgagcgcgactgggacgcccgggatgctgccgagcgcggctgggaggctcgggatgcggccgagcgcggctgggacgctcgggatgcggccgagcgcggctgggacgcccgggatgcggccgagcgcgactggaacgcccgggacgcggccgagcgcgactcctgggcaccctgggagcagcccagcgtgtcgcgtgcccggatcgtctcccgggacgggcggagtggtccgcgggccgtcccggcggtgaaccgggacgaaccctcctggaacgatccgtcgcggcgcagccgccgctccgccggtgacccccggccgcggccccgcccgcgtcccgccgcggtcgaccaggactatgtgagccggcactcggcaggcccgcaccgctga

SEQ ID NO: 3569 - DNA, 846 bp, Actinoplanes utahensis
atggcgtacaccgacctcgaccgcccgcccctctcggagcgcgcgctgacccgcgccctggtgcagcccggagcgctctggtcgcggatcgaggtgcgcccggagaccggatcgaccaacgcggacgccaccgaggcggcccgggccggcgccgcggagggcctggtcgtggtcgccgagcggcaggtcgccggccggggccggcgggaccggcagtggctcagcccggcccgggccggcctgaccctcagtgtcctgctgcgcccgggtaccgctgatcaggagcgtggctggccggccgccggcccgggtgcgttcggctggctgccgctgctggccggggtggcgctggccgatgcggtgtcccgggtgaccaccgtcgacgccaccctgaagtggccgaacgacctgctggccggggaccgcaagtgcgccggcatcctggccgagatggccggtgacgcgatcgtggtcggcatcggactcaacgtcagcacccgggccgaggagctgcccgcgacgaccggggtgccggccacctcgctgcggctggccggcgcggagaacccggaccgggaccccctgctgcgggcgctgctgcgcagtgtcgagcggtggtatgccgggtggcgtgaggcgggtggcgacgcggagatgtgcggcctgctcggggagtaccggcgccgctgcgcgacgatcggccgggacgtgcgggtgctgctgcccggcggtggggagctgctcggtgaggcgaccaccgtggaccgggacggccagttggtgatccgatcggtggacggtgccgagcatcgcgtctcggcgggggatgtgctgcacgtacgctga

SEQ ID NO: 3570 - DNA, 528 bp, Actinoplanes utahensis
gtgctccacctgcgtccccatgggaagtcggtggtcggcccggccctggtactggtgctgaccgtggccggcaccgtgatggccggggtgctgctgcccggcaaccagggtggccggatcggcttcggtctggtcgccgcgatcatgatctaccacgcggcgcggtacgggatcgcgccgctggcccggtggcggtgcacgcactacgtgctgaccaacgagcgactgctgctgcagcagggcgtcttcgcccgggagcggcgggatctgccgctgaaccgggtgaacgaccatgcgctgcgccagtcgctgctggaccggatcttcggcaccggcacgctggtgatcgactcgatcggcgagcagagcgcgcggctgtccggcgtgccgcaggcccagcgggtgcagacccggctctacgaactgatcgagctgagcccggcggacgacgaggacgccgaggaggagctcagctcttcagcgtggcgtccagctccgccgcgctccccgggacgtcgatcgcgctga

SEQ ID NO: 3571 - DNA, 549 bp, Actinoplanes utahensis
atgccctcaggcccaacgctgacggatcgcctgcgccgtctcgccccggaagccgtcgccttcggtgtcatcggagccggaaacacgctgctgtacatggcgatctgctgggtggccctgccgatcggcgcggtcaaggcgaacgtcatcgccacgctgatcaccaccacgctggcctacctggcgaaccggttctggacctaccggcaccacacgcgcaccgcgctgcgccgggagtacctgctgttcttcggcttcaacctggtgggcatggtgatccagtccggcctggtggcgatcggcaagtacggcttccacctgaacgagaaggacgacaagatccacttcatgctggtcaccatgatcggcatcgggatcgccacggtcttccgcttctgggcgtaccggaccttcgtcttcctcaagccgccggtcgacggccacgagggcgcgatcaccgggatggacgcgaccgccggcctggccgagctcagcgcgatcgacgtcccggggagcgcggcggagctggacgccacgctgaagagctga

SEQ ID NO: 3572 - DNA, 537 bp, Actinoplanes utahensis
atgccggcaccgccggttgagatcgtgcaacgagatcggcggcgcaggtgccgcgccggtaccctcgaacgggtgcggttgcggaagctggcgcgggaggcgggcaggttcggcacggtcggcggcatcgcgttcggcgtcgacctgctgctgttcaacatgctgcgcaacagtggcgtcgagccgctgaccgcgaagaccgggtccaccatcgtggcgaccaccctggccttcctcggcaaccggtactggacgtggcgcgacggcgcgcaccccaacctggcccggcagtacacgacgttcttcgtgctcaacgcggtcggcctgggcatctcgctggcctgcctggcgatcagccactacggtctggggcactactggccggtgttccgcggcaaggccgccgacaacgtcgcgggactgctgatcggcaccgccatcggtacgatcttccggttctggtcctatcgccggttcgtcttccgggccgagacacggaccaccggtgtgacaacgtcgtcacccaccctcccgtga

SEQ ID NO: 3573 - DNA, 765 bp, Actinoplanes utahensis
atgacgaccccgggcaacgacgtggactcggacacggatctgctcgccgccgtccgggccggcgacaccgccgcctacgggacgctctatgagcggcaccgggcggcggcgcggttgttcgcgttcggcctcgcccgcgatccggccgacgccgacgacctggtcgccgagacgttcgccaaggtgttcgcctcactgcgggccggtcgcgggccgctggtcgccttccgggcgtacctgcacaccaccatgcggcacgtctgctaccagcgggcccgctcggaccggcggctggagttcaccgacgacctgagccggtacgacgagggccagccgttcaccgacccggcgctcgaccggctggaacgcagtttcgccgcggccgcgttccgccagctgccaccccggtggcgcgacgtgctctggcagaccgaggtggagggcagcaccccggccgagctggccccgcggatgggtctgacgccgaacgcggtcgccgtcctggcccaccgcgcccgcgagggactgcgcagcctctatctccagcagcacgtgaccgcggccgagcacccggagtgccggtgggccggcgagcggctcggcccgcaggtgcgcggccggctcgccccacgcgacgcgcaccggatgcggacccacctcggacggtgcgcggactgccggggccggctcgccgagatccgggagatcgacggcttccgccactccccgtaccggcaacgtgaccatgccggcaccgccggttga

SEQ ID NO: 3574 - DNA, 1806 bp, Actinoplanes utahensis
ttgtctcacccccacacctcgcacccccgcctgctggcgtggatcgacgaggtcgccgccctgacaacgcccgaccggatcgtctggtgcgacggttcggacgccgagtggacccggttgaccgacgagctggtcgagtccggcgcgctggtccgtctcgacccggagaagaagccgaactcgttctgggcgcgtaccgacccgtccgacgtggcgcgggtcgaggaacgcaccttcatctgctcggccgacgaggccgacgccgggcccaccaacaactggatggcgccggccgagatgaagaccctgatgacggagctgtaccggggctcgatgaagggccggacgatgtacgtcgtcccgttctgcatgggcccgctggacgccgagaacccgatgttcggcgtcgagctcaccgacagcccgtacgtggtgtcgagcatgcgcatcatgacccggatgggggccgaggtcctgagcgcgatgggcgacgacgcggacttcgtaccgtgcctgcactcgatcggcgcgccgctcgaaccgggccaggacgacgtcgcgtggccatgcaacgagacgaagtacatctcgcacttcccggagacccgggagatctggtcgttcggctccggctacggcggcaactcgctgctcggcaagaagtgctacgcgctgcggatcgccagcgtggccgcccgggacgagggctggctcgccgagcacatgctgatcatgaagctgacctcgccggagggcgtggtccggtacatcgccggcgcgttcccgtcggcctgtggcaagaccaacctggccatgctcgagccgaccctgccgggctggaaggtggagacggtcggcgacgacatcgcctggatgcgcttcggcgaggacggccggctctgggcgaccaacccggagttcgggctgttcggcgtcgcgcccggcaccgacttccacaccaacccgaacgccatgcgcaccctggccaagggcaactcggtcttcaccaacgtggcgctgaccgacgacggcgacatctggtgggagggcatgggcgagccgcccgcgcacctgaccgactggaagggccaggactggacgccggagtcggaggcgccgtcgagccacccgaacagccgcttctgcaccccgatcgagcagtgcccgatcctcgccgacgaataccacgacccgcgcggcgtgccgatcgacgcgatcctgttcggcggccgccgcaagaccaccgtcccgctggtcaccgaggcacgcgactgggtgcacggggtctacctgggtgccaccctgtccagcgagaccaccgcggccgcggtcggccaggtcggcgtggtccgccgcgacccgatggcgatgctgccgttcatcggctaccacgccggcgactacttccagcactggatcgacatggccaagggcgcctccggcgacgcgtccaagctgcccaaggtcttctacgtgaactggttccggcgcgacgccgacggcggcttcctctggcccggattcggcgagaacagccgggtgctcaagtgggtgatggagcgcctggacggcaaggcagacgcggtggagacgccgatcgggcacgtcgccaccccgcagtcactcgacctgaccgggctggacatcgaccaggccgccctggaggcggtgctgcgcgtcgaccgcgacgagtggctggccgagctgccccaggtcaccgagtggttcgagaagttcggcgacaagctgcccgccgtgctctgggcggagctggacgcgctgcgcgcgcggctggccgacgcctga

SEQ ID NO: 3575 - DNA, 780 bp, Actinoplanes utahensis
ttgcccgtgatgagtgtgcgctccctggtctactccctctatgagcgccggctcgccggaaagttggtcggcaagccggtgccccgccacgtcggcgtcatgtgcgacggcaaccgccgctgggcccgcgagatgggtttcgtcgacccgaacgacggccaccgggtcggcgccgtccgggtcaaggatctgctcacctggtgtgacctggccggcatcgagcacgtcacgctctatctgctggccaccgacaacctgcagcgcccggccgccgagctggatccgctcgtcaagatcatcgaggatctggcgaccgagctggccgaggagggcaacccctggcggctgcggatggtcggcgcgctcgacatcctgccggccgccaccgccgccaccctcaaggccgcccaggagaagacgcaggaccgctccggcggcgtcgaggtcaacatggcggtcggctacggcgggcggcgcgagatcaccgacgcggtgcgctccctgctgcagcagcacgcggcctccggcggcaccctggaggagctggccgagatcctcgacgtcgagcacatcgccgagcacctctacacccgcggccagcccgaccccgacctggtcatccgcaccagcggggagcagcggctgtccggcttcctgctctggcagtcggcgcactcggagttctacttccacgacgccaactggcccgacttccggcgcatcgacttcctgcgggccctgcgctcctacggcagccggcagcgtcgttacggcgcctag

SEQ ID NO: 3576 - DNA, 807 bp, Actinoplanes utahensis
gtggcagagaccgagcgtccgacccatcccgcgagcgctgacgacgcctgggcgcgcaccgcccggcacgcgtcccggaccacgttcttcttcgacttcgacggggtcctctcaccgatcaccgagcagccggaggagtcccgtccggtcgccgggatccccgaggttctcgaccggttggccgcgcgggtcgcccgggtggcgatcgtctccgcccgtccggtcaccttcctgcgcacgcatttcgcgtcgctggcccacgtcgacctgttcggcctctacggcctcgaggtgtggcacgagggccaggtggtcaccaagcccgccgccctcgactacgaggagccgatgaaggagctggccgccgccgcccgtggggcgctggagcggccggtcgaggtggaatacaagcggctcgccgtcgccctgcactaccgcaaggatccggcccgcgccgcgcaggtcgagaaatgggcgctggagcaggccgagcagcacggtctgctgatccagcggggccgcatggtggtcgagctgaagcccccggtcgaccaggacaagggcatggtgatcaccgaggcggtccgcgacgccggctgcgcgtggtatttcggggatgacatgtccgacgtcaaggcgttcgacgcgctgcgcgcccgggaggcggtcgaccccggcttcttcggcatggcgatcgcggtggccaacgacgagaccggcgccgaggtgtccaacgccgccgacctcacgctcgcctcccccgaggccgtcgcccggttcctcgacgcggggctgcagaccttctga

SEQ ID NO: 3577 - DNA, 1419 bp, Actinoplanes utahensis
gtgacatctcgccgtaccgatgccggtgtcgcctcttcatccgacccggccgacaaggtgaccaagacccgtgccacccccgcccgccgtaaggtgcgggaccggcacgccgacgccgagcccgcccccgctggcaaggtcttcgtcctggacacctcggtcctgctgtccgacccggcggcgttccgccggttcaccgatcacgaggtggtcgtccccctcgtggtcatctccgagttggagggcaagcgccaccatcccgagctcggctggttcgcccggcagtccctgcggatgctggacgagctgcggatcaagttcggtcggctggatcagccggtgctctgcaacgacgagggcggcacgctgcgtgtcgagctcaaccacgccgaccagagcgcgctgccgcagggattccgcaacgactcgaacgacacccggatcctctcggtggcgctcgggctggccgcggagggccgcgacgtcacgctggtcagcaaggacatgccgctgcgggtgaaggccgcctcggtcggcctcaccgccgacgagtaccggcacggccaggccagcgaccccacctggaccggcatggccgacctggagctcggcgaggatcaggtcaaggcgctgtacgcgggcgacgagctggaggtcgaggaggcggacaatctgccctgccacaccggcctggtgatccactcgtcgcgcggatcggcgctgggccgggtcaccccggacaagacggtgaaactggtccgcggcgaccgggacgccttcgggctgcgcggccgctccgccgagcagcggatcgccctggacatcctgctcgacgagtcgatcgggatcgtgtcgctgggcggcaaggccggcaccggcaagtccgcgctggcactctgcgccggcctggaggcgaccatggagcgcaaccgccacaagaaggtggtggtgttccgcccgctgtacgcggtcggtggccaggagctcggctacctgcccggctccgagtcggagaagatgtcgccctgggcgcaggcggtcttcgacacgctcggcgccgtggtgcacgccaacgtggtcgaggaggtgctggcccgcggcatgctggaggtcttgccgctgacccacatccgcggccgcagcctgcacgacgcgttcgtgatcgtcgacgaggcgcagtcgctggaacgcaacgtgctgctgaccgtgctatcccggatcggccagaactcccgggtgatcctgacccacgacgtcgcccagcgggacaacctgcgggtcggccggcacgacggcgtgacggcggtgatcgaggcgctgaaggggcatccgatcttcgcccacgtcaccctcacccgttcggagcggtccccgatcgccgaagtggtcaccgacctgttggaggacatcccgttgtaa

SEQ ID NO: 3578 - DNA, 699 bp, Actinoplanes utahensis
gtgaatcggctctggagccggctcggagttcgtgcgctgtctgtcggtctgctcgccgcgggtctcggcggcggtctctacctcggacacggccaggacgaccagcagcagagcagccaggcgactctcgtggcccaggcgaacgcggaggagatcgcgctgctcaagcagcgtgaggcggaccacgccgcggcccgcgcctaccgccggacggccgaggacgccgccgccgagaaggcggccggcgaggcccggcaggccgcggcgaacgcgcgcaagctggaggtcaaggtgatcgccgacgcggcggccaccaagaaggccgccgacgccaagaaggcagcctccgggggcgcggtgccctacgccggccacatcccgtcctcgtgcaacgacttctccggcagccgccagatcggctgcgcgctgatgctggacgccggcttcaagatcgaccagttcccgtgtctcgacaagctctggaagcgcgagagcgggtggaactacagcgccctcaacaaaagctcgcaggcgtacggcattccgcaggcgctgcccggcaggaagatggccaagttcggcgccgactgggagtccaacccggccacgcagatcaagtggggcctcgactacatcgagggccgttactcctcgccctgcggcgcgtggggccactcgcaggaagtcggctggtactga

SEQ ID NO: 3579 - DNA, 786 bp, Actinoplanes utahensis
atggtccgaaatgtcgcttcgttcctggcgatcgtggtcacggtgctcgccgccggtgacgtgcccgcccaggccggcgccggcggacggcccatcctcgaagtggtcggcggcaacgtggccaagaccggcgagttcccgtgggtggtccgactgtcgatgggctgcggcggggcactgaccgcaccccgggtggtactcaccgccgggcactgcgtcggcccgaccggacccgacaagcggatcgtggtcaccgccggggtggccgacctcaaggcccgcaacgcggtcgtcgcccactccgtcgaagtggtccgggcccccgccttcaccaccgagacccgcggcaacgactgggccgtggtcaaactcgaccgggtgctcgacctgcccgccctgcccctggtgccggacgccaccggggacaccggcgacgtcaccgtgatggggtggggacagaccagggagggctccctgcggcaggaacgccggctgcactacgcgacggtgccgaccatcccggacgcgacctgcgccaaggcgtacgcggtggcgaaggtgaccctggtccagagcgactcgatctgcgccggacggcacggggtggacacctgccaaggcgactccgggggaccgatggtgcggcgcggggcggacgggcagtgggcgcaggtgggcatcgtcagctgggggctggggtgtgcgcgcgacgcctaccccggggtgtacacgcagatctccaagttccgggcggcgatcctggcggccacccgcaaactttcctga

SEQ ID NO: 3580 - DNA, 738 bp, Actinoplanes utahensis
gtgcgcgcgacgcctaccccggggtgtacacgcagatctccaagttccgggcggcgatcctggcggccacccgcaaactttcctgagtggcccggcgtgcgcgggcctgccaccatttcagccatgagctacggcgtgaccccgacgcgtgtcgacgcgcccgcgaaattcggcaccgaagccttctacgcgtccctcggacgcgccttcctgaccatgtgcgcggtcatccccggcctgttcctgatcgaggcgctcgacgtggcgctcggccagggcaccctggacatggccggcggcatcatcccgcaccacctcgacggcctggacggggtgctgttcagcccgttcctgcacagcgggtgggaccacctctacggcaacgcggtgccgctgatcctggtcggcacgttcgcgatggccggcggcggtcgccgcttcctctggtcgaccctggtgatcatgctgatcagcgggatcggcgtctggttcgtcggcgacccgtcgacggtcgtggtcggggccagcggggtgatcttcgggtatctcgggctgctgctcggccgcggcctgttcgaacgcagctggtggaacctcgcggtggccgcgttcgtcgggctcctgtactggtaccaggtctacaacatcctgccgaccgatcgggcggtctcctggcaggggcacctgctcgggctgatcggcgggctcgtggccgccgtcctgttccggcgacggtga

SEQ ID NO: 3581 - DNA, 1140 bp, Actinoplanes utahensis
gtgctcattgttaaccatgtcgctgaaccgggacttggcacgtcctcagatgccaggatcagtggatccacagccccgcaacgacgcgaggaggccgacatgcctgcccgggttccccaggatctcgaccgtaacatcgccctcgacctggtccgtgtgaccgaggcggccgccatggccgctggtcgctgggtgggacgcggcgacaagaacggcggtgacggcgctgccgtcgacgccatgcgcaagctcatcaactcgattcagatgcagggcgtcgtcgtcatcggcgagggggagaaggacgaggccccgatgctctacaacggcgagcgggtgggtgacggcaccgggccggaggtggacgtcgcggtcgatccgatcgacgggacgacgctgatgagcaagggtatgccgggttcggtctcggtgctcgcggtggccgagcgcggggcgatgttcgatccgagcgcggtgttctacatggacaagatcgcggtcgggccggactgcgccgacgtgatcgacatcaatgccggcacggcggagaacctgcgccggatcgcccgggccaaacggtccagcgtctccgatgtgacggtctgcatcctcgatcggccgcggcacgcccggctggtcgaggaggtgcggcaggccggggcgacgatcaagttcatctcggacggcgacatcgccggggccatctcggcggcccgcgccgagtccgacgtcgacgtgctgatgggtatcggtggcaccccggaggggatcaccgcggcctgcgcgatcaaatgtctgggcggcatgatccaggcgaagttgtggccgcgggacgacgccgagcggcagaaggcggtcgacggcggccacgacctggaccgggtgctgaccaccgacgatctggtgaccggcgacaactgtttcttcgtggcgaccggggtcacctcgggcgatctgctcaagggggtgcggtatcgctccggcggcgcgcacacccagtcgatcgtgatgcggtccaagagcggcacgatccgggtgatcgactcgtatcaccggctggagaagctggccctctactccgcggtcgacttcgacggccacctgccgaccgtcccgatcggcgaggagccgatcatctga

SEQ ID NO: 3582 - DNA, 900 bp, Actinoplanes utahensis
atggttaacaatgagcacgtggaacccgctgcccccgagaccgctccgacgccgcccccgaccccggtgacatcgccgccggcgtccgctgcggcgccctcgcccgccgcgggcccgacctccgccgccgagccggccggggccccgtcgccgtccgctcccggaccctcagccccctgcgccccgtcgggctccgcttccgcgtcgtcgggctctgcttctgtgtcgccaggctctgcttccgcgtcgtcgggctctgcttctgcgtcgtcgggctctgcggagttgccggcgtcctcggcgtcgggcgtcgccgcggagtcgtcggctgcgccggttccggccggggcgacgtcctcagcggctccggccgcgagcgcgtcgccgcggctcacccgccgggaggggcgggcgccgcgcgacatggcgctgtccctggcggtgctgatgatcccgatcgtgctgctgctggtcttctaccgggtggtgctcaacggcgacaagccgctcaccgtcgacccgtcctcgtcgttcgacctcgcgtccaggcacttcaccgtgctgaaaccggccggcctgggcaaggattggcgggtgaccgcggcgacgttcaaggatgagaagggcggcgccatcctgcgcatcggctacgtcgacccggacgacaacccggtccagctgatcgagagcaccacccccgcggacacgctcgtcccggccgaggtcggcaaggacggcaagcgcgccggcgcctaccgcaccgacgcccgcacctggatggtctacaccggccgcccgggcgaaacggccctgatcttctccgataccggccgcaccgtgctgctcgtcggcaagaccggacagcccaacctggaagccctcgccaactccctgaagtag

SEQ ID NO: 3583 - DNA, 204 bp, Actinoplanes utahensis
atgagcgacgacaatctcagctacgagcaggcccgcaccgagttggccgacgtggtcacccgcctcgagcagggcggcggcagcctggaggagtccctcgccctctgggagcgcggcgagaaactggccgacatctgccagcgctggctggactccgcccgcacccgcatcgacgctgcccgagccgcccgcgacgccggctga

SEQ ID NO: 3584 - DNA, 1245 bp, Actinoplanes utahensis
gtgagtgaagcccaggccgccaccgcaccggcgaagagcaccgccgacgagccctggccggtccgcgtcgtgacgcagaagatcagcgcctggatcgccaagctcggctgggtctgggtcgacggccaggtggcgcagatcagccggcgggccggctccggcgtggtcttcctgaccctgcgcgacccggccgccgacctgagcctctcggtgaccgtgcaccgcgacgtgctggagacgggcgcgcccgacctgtccgagggcgcccgggtcactctgcacgccaagccggagttctatcaggcccgcggttcgctcagcctgcgcgccgacgagatccgccaggtcggcctcggcgagctgctggcccggctggagcggctgaaaaagctgctcgccgccgagggcctgttcgcccgcgagcgcaagcggcggctgccgttcctgcccggccggatcggcctgatcaccgggcagaacaccgccgccgagcgggacgtgctgaccaacgtgcaccgccgctggccgggcgccgacttccgggtcgcccacgtcgccgtccagggaccgaacgcggtgccccagatcatcaacgcgctcaaggtgctcgacgacgacgagacggtcgacgtgatcgtgatcgcccgtggcggcggcagcgtggaggacctgctgcccttctccgacgaggcgctgtgccggcaggtgttcgccgcccgcaccccggtggtcagcgcgatcggccacgagaccgacaccccgctgctggactacgtcgccgacctgcgcgcctccacccccaccgacgccgccaagcggatcgtgcccgacctggccgacgagatccggctgatcgaccacgcccgccagcggctcgaccgggccgtgctcacccgcatcgaccgggagcggcaacgggtcgaggcgctgcgttcccgcccggtcctggcccgcccggaaacactgatcgaccagcgcgccgccgaggtggtcgcgctgcgtgaccgggccggccgcagcctggagcaccgggtgcgccgcgccgacgacgagctgcgccacacgctggcccggctgcgcgcgctgtccccgctggccaccctgcagcggggctacgcgatcgtgcagcgcggcgacggccacgtgctgcgtgcggccggcgaggtggacgagggcgacccggtccgggtccgcctggccgagggcgagttgaccgcagtggtgacctcaggagagaacgcatga

SEQ ID NO: 3585 - DNA, 1329 bp, Actinoplanes utahensis
gtgagcgccgcgaccagccaggcggcccggctcggcgcgatccggtgcagggcgagcaggatcatcccgccgagggtgacgaccgcgtggaacaccacgtacaccgggccgtcggtgccgctgaccaggtcgagcaggccgacgccgaacaggaaccagccggccatcacgcgcagcaccgtggagaccgcgggccaccggtcgtcccgctcggcactcatgaatccgattatcccggccgataccatacggacggggcgaaacggatcaacagccgttccggccggggttgtggccctgatcgcaggagggtggcggccggacggtggcacgtaccattgccgcgtgactgaagctcgtaagcgggtgttgctcgccaagccgcgtggttactgcgccggtgtcgaccgcgccgtgcagaccgtcgaggaggcgctgaaactctacggcgccccggtctacgtgcgtaagcagatcgtgcacaacaagcacgtggtcagcacgctggaggcccgcggcgcgatcttcgtcgaggagaactacgaggtgcccgagggcgccaccgtggtgttctccgcgcacggcgtcgcccccgaggtgcacgaccaggcccgcgagcgccggctcaaggcgatcgacgcgacctgcccgctggtcaccaaggtgcaccacgaggcgaaacggttcgccgccgaggactacgacatcctgctgatcggtcacgaggggcacgaggaggtcatcggcacctccggcgaggccccggcgcacatccagctcgtcgacggccccgacgacgtggcgaacgtcgtcgtccgcgacccggccaaggtcgtctggctgtcgcagaccacgctgtcggtggacgagacgatggagacggtggcccggctcaagacccggctgccgctgctgcagtcgccgcccagcgacgacatctgctacgccacctcgaaccggcagcacgtgatcaaggagatcgcgccggagtgcgacgtggtgatcgtggtcggctcgaccaactcgtcgaactcggtccgcctggtcgaggtcgccctcggtgccggcgcccgggccggtcacctcgtcgactacgccgccgagatccaggacgagtggctggccggcgccaccacggtcggtgtctcctccggcgccagcgtgccggacgagctggtgatggaggtgctggcgcacctcgcggagcgtggcttcggcgaggtcaccgagttcaccacggccgaggagcggctcaccttctccctcccgcaggagctccgcaaggacatgaaggccgccgaggcggcccgggccgctgccgccggctga

SEQ ID NO: 3586 - DNA, 1974 bp, Actinoplanes utahensis
gtggggtcagaagtcgccgccgccgccgaaatcgccgccgccgaagtcaccgccgccccagtcgccgccgccgaagtcaccgccgatgtcgttgccgcccaggtcgccgaggccgttcgcgtcgccgaagtcgttgcccgccagcaggccgtcctgatatccgtcggcgtacccgacgtcgccgaaggacggcgagaacagcgcgtcgaagatcagcatgccgccgagcaccccggcgccggtgccgagcgcggtcttccagaccggtgtcgaataccaaccggccgggaccggacggccctgcacccggccacccgggtagtagtacggggtttccgggcccggctgcggccccgcccggtaagcgtggccctgcacgctgacctcgcgctcctgggtgagctgcccggtgccccgcgaggcggccagcggcggcaggtcggggcccgggtcgaggcccatcgcgacgcgggcggcccgcacataggccagaccctccagcgcggactcgcgggccagctcgaactgccgcaccgaggtggcctgctgcaactggccgccggccgcgttgtagcgctcgccggcgtcggccagggcctgccgcgcggccggctcgtcggcgtgcaggttcatcatctggccgccgagccgctcgtaccaccgctgcgcgtcggcacgggcatccgcgagctgggtctgctgatttcttgccccgccacgctgggtggcgacgacgaccagggcgacgatcgcgacgatggccaggatgagcaacacgccgttcatgttttccaaagtacccgcggtggtcttgtcgtacccttctggcaatctgcggtggtgacgtactcgacgctcgctgtgatcctgatctgcctcgcggcgggcggcgccctgggctggctcgccgcccgggcgcgggccgccaccgacatcgcccggctggaggccacggtcgccgctgcccgcgatggtgagcagcggctggaacagtcgatgcgggcgctgtcctatgaggcgaccgcccagtcgcaggaggcggtggcccgcgcggtcgccccgctgcaggacacgctgcgacgctacgagcagcgggtcgccgacctggaacgcgagcgggtcgacgcgtatgccgagctccgcgagcaggtgcgggcgatgggcgtggtctccaccgagctgcgcggcgagacccggcaactggtctcggcgctgcgcaccccgcaggttcgcggccgctggggcgagcaccagctgcgccggatcgtcgaggcggccggcctgctggagcactgcgacttcgccgagcaggtcaccgccgagaccgaccgtcagggggtgcggcccgacctggtggtccggctgcacggcggccgcaccgtggtggtcgacgccaaggcgccgctggagggctatctgtccgccatggaggcccgcgacgaacgtgaccgggatctccacctcgaccagcacgcccggcatctacgagcgcatgtggacgccctgtcggccaaggagtactggtcggccttcccctccaccccggacttcgtggtgctgttcgtcccggccgacccgttcctggacgccgccctgcagcgcgacccggtcctgatggagtatgcgttccgccgcgacgtcgtgctggccacgccggccacgctgatcgcgatgctgcgcaccgtcgcgttctcctggcggcaggagacgctgaccggcaacgcggtcgccgtgcacacgctggcccgcgagctctacggccggctgtcgacgctgggcgaccacgtgagccgcctgggcgtctccctcaacggggcggtcagcgcgtacaacaaggcaatcggctctttggagtccagagtcctggtcagcgcacgcaagctggccgagatgggggtttccgacgaggatctgccgcagccgccccagatcgaggtggccccgcggcagccccaggccccggagctcagctga

SEQ ID NO: 3587 - DNA, 603 bp, Actinoplanes utahensis
gtggtccggtccaccataggaagcatgccgatcgcaccggagcaggtcgaggccccggccgaggacgccgtgttgttccggtcgtcgccggcccgcacgttcctcgcggtgttcgccgtgctcatgctgtcgtacctggtggtctccccgatcgtggggcggatcgcgcggggcggcggtgatccctggtgggtcaccacgctgcaggcggtagtcgtcggcgcggcggtcgccgggttctatgcattgtcagcgcgctcggcgctgaccacctgggtgcgggtctcggccggcgggctggaactcgccgcgcagggcagcgatccggtgctgctcgcctgggaggacatcgccgcggtgacggtgcgccgcagcggcctgcgaaccgtgctggaggtgaccccggtcgacatggacgcggtgcacccggtgcagggctcgggggcgggctggccgcagcagacggtgaccgcgcgcggcccggcgttcgccgccgacctcacccagatctggccgagtccgcgggcgctgcgccacgagctcacccgccgcctgcacccttacccccggccggccccgctccaccccgaacaaccctggtag

SEQ ID NO: 3588 - DNA, 1254 bp, Actinoplanes utahensis
atgacggagtcggtcagcgtcgcggtggtgggcgccggcagccgcggcggcatgtacgcgcgggtggccgcggacagcggccgggcccgggtggtggcggtcgccgagcccgacgacgagcggcgggaacgtttcgcggcggagttcggcctgccggcggaccgggtccaccgggactggacgggcctgctggccgggccgcgggtggccgacgcggtgatcgtggcgacccaggaccggttgcacgaggcgccggcggtggcgctgctcgggcacggttacgacgtgctgctggagaagccgatggcgccctccgaggcgagcgcccggcggatcgccgacgcggcgctggccagtgggcggatcttcggggtgtgccacgtgctgcggtacaccccgtacaccgcgatgatccgcgagctgatccgcgacggcgcgctcggcgacgtgatcaacgtgcagcacctggagccggtcggctggtggcaccaggcgcacgcctatgtgcggggcaactggcgttccgaggcgggttccgggccgatgctgctgaccaaggcctgccacgacgtggactggatcatgcacgtggtcggggacggcgtggcccgggtgtcgtcgttcggtgggctcgcccatttccggccggaccgtcagccggccggggccgcggaccggtgtgtggactgcgcggtggagcgggaatgcccatactcggcgaagcgcctctatctcggctgcctcggcgacccgaagaccgagcggtggccgctggggccggtgacctcggacgccaccgaggccggggtgctgcacgcgctgcgcaccggaccgtacggacgctgcgtgtaccgctgcgacaacgacgtggtggaccaccaggtggtgaacttcgagttcgccggcggagcgaccgcgacgctgaccatgaccgctttctcgccgtccgacggttaccggcgaacgcggatcttcggcagtcacggcagcctcgaaggggacgggcggacgctgaccctcaccgatttccgggacggcagcgagcgggtgatcccggtgccggccggcgccggcggcaccgcggccggtggccacggtggcggcgacgccggcctggtcgcggcgttcctgaccgcggtgcggacccgcgacgagtcgtatctcggctccggtgcggccgccagcctggacagccaccgcgtcgtgtgggccgccgagcgggcccgccacaccggaaccgtgatcactctctga

SEQ ID NO: 3589 - DNA, 2535 bp, Actinoplanes utahensis
atgactgatacgggaacgggccgcccgggcctacccgagcggccgtcgctggacgggctcgaggaccgctgggcgccgcgctggcaggaggagggtacttacacgttcgaccggtcgagggagcggtcggacgtgttcgccatcgacacccctccgccgaccgtatcgggtgcgttgcacgtcgggcacgtcttctcgttcacccacaccgacacggtcgcgcggttccagcggatgcgcggcaagacggtcttctatccgatgggctgggacgacaacggcctgcccaccgagcggcgggtccagcaccgctacggggtccgctgcgatccggcgctgccctacgacccggcctggcagccgccggaggctccggccgacccgccggtcgcgatctcccggcgcaacttcgtcgagttgtgctcgcggatgaccgctgccgacgagcaggcctacgaggcgatctggcggcggctcggcctctccgtcgactggggactgacgtatacgacgatcggcgaccgggcgcgcgccgtctcgcagcgagccttcctggctgccctggcccgcggtcaggcctatgcggcgcaggctccgacgctgtgggacgccggtttccagaccgcggtcgcccaggccgagctggaggatcgggagcgacccggcgccttccacacgctgcgcttcgctgggccggacgggccgatcgaggtcgacacgacccggccggagctgctgccggcctgcgtcgcgctcgtccatcaccccggtgaccagcggttcgcccacctgaccgcggcccggtcgccgctgttcggggtcgaggtcccggtcctggcgcatccgctggccgagccggagcggggcaccgggatcgcgatgatctgcacgttcggcgacctgaccgacgtcacctggtggcgcgatctgggcctgggcacccgggtcgtcgtcggccgggacgggcggttcctgcgcgatgcgccgtccggtgtcccggccggggtgtacgccgcgctggccgggcggaccgtggaggcggcccggcgggaaacggtccggttgctgcgcgcgtcgggtgatctgctcggtgagccgcggccgatcacgcatccggtcaagttctacgagcgaggcgaccggccgctggagatcgtcaccagccggcagtggttcctgcgcaacggcgggcgcgacccgctgctgcgcgagcggatgctggcccggggccgggagttgcgctgggttccggagcacatgcgccaccggtatgagcactgggtgaccgggctgaccggggactggctgatcagccggcagcggttcttcggcgtcccgttcccgctctggtaccggctcgacgacgctggcgagccggactacgaccagcttctcataccggacgattcggcactgccggtcgacccgacttcggactgtccgcccggattcgacgagtcggcgcggggccggccgggcggcttcaccgcggatccggacgtgatggacacctgggcgacgtcgtcgctcaccccgcagatcgccggcggctggagcgtcgacgacgacctgtactcccgggtcttcccgatggacctgcgaccacagggccaggagatcatccggacatggctgttcggcacggtgctgcgcgccgagcagcaggacggcgtgctgccctggcacaccgcggtcctgtccggctgggtcctcgaccccgaccacaagaagatgtccagttcccggggccgggcggtgccggccgggccgccgctggcggagttcggcgcggacgcgatgcgctactgggcggccagcggccggcccggggcggacatcgcctacgagccgggccagctgcggatcggccggcggctggcgaccaagctgctcaacgcgtcgaaattcgcgctccgcctgggcgcgtccgacgcgctgcggcagccggtcaccgagccgctcgaccgggcgatgctgggccggctggccgaggtggtcatcgcggccaccgaggcgttcgaccggttccagcactcggaggcgctgcaggcggtcgagacgttcttctggacgttctgcgacgactacatcgagctggtcaagagccgggcgtacgggtccggcccggccgccggctcggcgcacgccgcgctggccaccgggctgtccgtccaactccggctgttcgccccgttcctgccgtatgtgacggaggaggtctggtcgtggtggcgttacggatcggtccaccgatcgacctggcccacccggtatgagctgacccgggtcgcgccggacagcgagccggccctgctcgacctggccggcgacgcgctgcggcaggtccgcaaggcgaaatcggaccgccggctgtcgatgcgggccgacgtgccgctggccgaggcgctcggcccggccgccctgctcgatcggctggagctgatcggcggggacgtccgggccgccgggcggatcgccaagctcgacctgctccgggaccggaccccggagctggtcatcgcctgcgccttctga

SEQ ID NO: 3590 - DNA, 561 bp, Actinoplanes utahensis
gtgcccggaggcgccgatgacgatccagccgctgtacgtgctgtgcgacgtctcgaccagcctgcccgcaaagctcgggccaccgccgacctgctcctggcgcacctgtccacgcagctcaccggcggcgtcgagctgaccgcggcggtccgctggagcgtcgagctgcacaccggcgccgacgacctggtcccgctcgtcgtcagctgccgcgcatcgtcgtcggccggattcagccgggccagttcctcgctcgccgccaaggcctccggcggctgccagtccggtgtgtgcggctgcctgccgaaaccgcgcgactgcccatcacccggacactgtccacatcgaccaccagtgccgcggatccgtgtcgtagaggacgttgcgcccggagatgtcgccgaccacgacattctgggcatgcttcatcgtgtacgccgcggccaccgcccggaccagacccagccgcgccgtcagatccaccggcggcagacccgtccgcgccgccgtcatttcgtgtgcggtggggccatcgaatacgacacattgaccaacagatag

SEQ ID NO: 3591 - DNA, 711 bp, Actinoplanes utahensis
gtggcgccgggcccgcacactgacggcgtggggctgcctcggtgtgcggtctgtggccggctgatgacgctgaccggcttcgtcacgcccaacggtgagttgatctgtcatcggcatgctcatgagcagccgtcgacgtgttgtggtctgccggctgatccgacgctggccgcggagcgtccgttgtgtccgcggtgcgcggcgacggcggtgcgtacgcagcaggatgtgcggcgggtgttgccgccgatcgcggcgcggttgcgggcgttgtcgatctggacgacgaagccggtgcgggtgcgtctggtgccggtggccgagttgcaggcggattggcacgggtcgggtgcattgctcggcgggacggtgtgtgtgggttccgaggtggtcgatctgatggtcgtccgggatctgccgctggtgcgtttcggcgcggtggtcgcgcatgaggtgatgcacgcctatctggtgcagcacggtttcggggagttgccgccgccggtcgaggagggtctgtgcgagttgctggcgcatgcctggttgaagggggagccgggtgcgccggcggagtgggaacgccgccggatcatggacaacccggatccggtgtacggcaatgggttccgggctgcccggcaggccgcgctgcgggtcggtggggtgagccggatgctggcgcatgtccgccgttatggcgatctgccgtga

SEQ ID NO: 3592 - DNA, 498 bp, Actinoplanes utahensis
atgttgcggttttccacgatggacaccccgcccggcccgttcaccctggtcgtcgcggattcaggtgccgtccgcgccgccggtttcaccgtcgatgtcccggccctgatccgtctgatcgatccggccctggtggagcccgccgagcctgccgacgatgtcggcccggcgcaggccgcggtccgtgcctatttcgccggcgaccttccggctctggacacggtcgcggtcgagcagcgcaccggcggcgtgttcctggcgcacgcctggcgggtgatgcgcgacatcaagccgggtgatccggtgacgtatgcggactatgccgtgttggcgggccgtccggcggcgatccgcgcggcggccgccgcgtgtgcgcggaatgcggtcgcgttgatcgtcccgtgtcatcgggtgttgcggacggatggttcgttgggtggttaccggtggggtctgccggtgaagtcgtggcttctggagcacgagtcgtcggcgtga

SEQ ID NO: 3593 - DNA, 1545 bp, Actinoplanes utahensis
atgtccgaaagccgccagccgaagccccggcggacagagcagactcggggcatggagctggacttcgagcgttgctaccgcgccgtcgacagccgtgaccagcggttcgacggatgcttctacaccgccgtgcggaccaccgggatctattgccggccctcctgcccggccgtcacacctaaacgagaaaacgtgacattcttcgtgagtgccgcggcagcgcaacgcggcggattccgggcatgccgccgatgccggcccgacgcggcacccggatcgcctgactgggacgtgcgcgccgacaccgtcggccgcgcgatgcgcctcatcggcgacggcgtcgtcgaccgggaaggcgtcggcggactcgccacccggctcggctacaccgagcggcacctcaaccggatgctcaccgcggaactcggcgccggaccgctcgccctcgcccgcgcccaacgggcacagaccgcgcggatcctggtggaaacgaccgacctcggactcgcggacatcgccttcgcggccggattcggcagcgtgcggcaattcaacgacacgatgctcgaggtgtacgcgcaatcgccgagccgcatccgcgaaaagcgacccgtggcccgcggggaagccggcgtcatcaacctgcggctggcatatcgggcgccgctgcactcggcgtcgctgctcgccttcctcggggcacgaacactgccgggagtggacgagatcgtcgacggaggataccggcgggggctgaccctgccgcacggaacaggagacgtggtgctgcggcccggagacagatgggtcttcgcgacactgcgactcggcgatgtgcgggatctggcgccggcggtggcgcggtgccggcggctgttcgatctggacgcggatccggatgcggtggacgggatgctggcagccgatccggggctggaacaggtggtgcgggaagagcctggggtgcgggtgcctcgggcggtggacgggttcgagatggctgttcgggcggtggtggggcagcaggtgagtgtggctggggctcgggggattctggggaggttggtgcgggcggctgccgggggttcggggggttcggggagttctggggggctcggagactccggcccttcgggccccgcccccgcccccgccgccaccaccgatctgaccggattccccaccccggccaccatcgccgcactccccgacgcggccttcggcatgcccgccgcccgccgggccaccctccgcgccctggccaccgccgtagcctccggccacctggacctgaaccccaccgccgaccgcgacgaaaccaccgcccgtctgctggctatccccggcatcggcccgtggaccgccggttacatcgccatgcgcgctctcggcgaccccgacgtcttcctccccaccgacctggccgcccgtcgcggagccgccgctttgcacctccccgattccgccgggtccctgagcgtgcacgccgagcgctggcgcccctggcgctcgtacgccttgatccgtctgtggcgggccgcctga

SEQ ID NO: 3594 - DNA, 774 bp, Actinoplanes utahensis
gtgagcacggacatccggtggcggaccttcggtgacggtggccccaaggtcgtgctgctgcacggcggactgcagacctcggcgaacttcacgaagctggccggcgcgctggccggcgacttcaccgtgtacgtcccggatcggcgcggccgggcactcagcggaccggccgtggcggggcacgggctgcgcgccgagatcgacgatctgggtgcggtcctcggcgagaccggcgcgcgcaacgtgttcgggctcagttccggggcggtggtggcgcttcgggcggcgctcgagctgccgatcgagcggctggcgctctacgagccgccgctcaagcacggcgggcacgacccggtcgcctggctttcccggtacgaggcggagctggcccggggacgcaccgcggccgcgttcaccacggtcgtcaagggcaccggcggcgcgcggtatgtgccccgggccgcgatgctgccgctcgccgggttggccgtgcggaatccggacatcgccgcgctggtgccgacgatgcggctggacgcggccgtggtcgaggacgcggccggcccgctgagcacgtattccgctgtcccggcggacacgttgctgctcggcggcgaccgttcacccgcgtacctgcgatccgtcctgaacggtctggagccggtgctgccgcgggtctgccgggtgaccttgaccggtgtcgggcatttcgccgccgacaacagcggccggcccgcgctggtggctgccgaactgcggaagttcttccgatga

SEQ ID NO: 3595 - DNA, 1185 bp, Actinoplanes utahensis
gtgtcgggcatttcgccgccgacaacagcggccggcccgcgctggtggctgccgaactgcggaagttcttccgatgaggcttgcgtagactggcgttccgtgagcctcaccatcggaatcgtcggcctgcccaacgtcggcaagagcaccctgttcaacgccctgaccaagaacgacgtgctcgccgcgaactacccgttcgcgacgatcgagcccaacgtcggcgtggtcgggctgcccgacgagcgactgggaaagctcgccgagctgttcggcagtgagaagatcctgccggcgccggtgagcttcgtcgacatcgcgggcctggtccggggcgcgtcgaaggggcagggccggggcaacgcgttcctcgcgaacatccgcgacgcgtcggcgatctgccaggtggtccgcgcgttctccgacccgaacgtgctgcacgtcgacggcaaggtgtcaccggccgacgacatcgagacgatcaacaccgagctgatcctggccgacctgcagacggtcgagaaggcgctgccgcgcctgcagaaggaggccaagctcaagaaggagaaggccgccgcggtggccgccgccgaggcggcgttccaactgctcaacgacggcgtcacgctctaccagggcgccacggcggcgggcatcgacctcgacctgctcggcgagctgcacctgctcaccaccaagccgttcctgtacgtcttcaacgtcgacgaagccgagctcggcaacgagagcttcctcgacgagctgcgcgccctggtcgccccggccgaagcggtcttcatggacgcgaagatcgagtccgagctgatcgagctcgacgaggcggaggccctggagctgctgcagtccaccggccagtccgagcccgggctgaaccggctgatccgggtcggcttcgagaccctgggcctgcagacctacctgaccgccggcccgaaggaggcgcgcgcctggacggtcccggtcggcgccaccgccccggaggccgccggcgtcatccactccgacttccagcgcggcttcatcaaggccgagatcgtcagctacgacgacctgatggcggccggctcgatgtccgcggccaaggccgccggcaaggtccgcatggagggcaaggactacatcatgaaggacggcgacgtcgtcgagttcaggttcaacgtctga

SEQ ID NO: 3596 - DNA, 306 bp, Actinoplanes utahensis
atggaatgggtcttcgacggcgagatcttcgagtggcgcgggccggcgccgttcttcttcgtggccatgcccgagtcggacagcgccgagctcaaggatgaggcccgctcgctgatctactggggtcagatcccggtgcacgtcgtcatcggggacacggcgttccggacggcgctctttcccaagaacggccgctacctcgtcccgctcaaggacgctgtccggtcggcggcagggatcggcgaaggcgatctgatcacggttgccttacgtccagcctggccgtccgatgacgctcccgggtga

SEQ ID NO: 3597 - DNA, 639 bp, Actinoplanes utahensis
atgcagggcggaatcaggcgacacgcacccgctgggcgcacttgctacggtggcgacatgagcacggtgcccgagtggatgcgtccacctcgcccggagggatggctcgccgacgacctcgaccacctccccgaggtgccgcgacacaccgagctcatcgacggggccctcgtcttcatgatgtcccctcagcggatctggcacgctcgactcatcaccgcactggtcaacgttctctcggaccagacaccggccggcatcggggcagagcgggaaatcacgatccggctcgacgaactgaatcgccccgagcccgacattctcatcaccaccggcccctatgactggaacagcacctttttgacgcccgaccaggtgcttctggtgggcgaggtggtctcccccgaatcggcataccgagatcggacggtcaagctccgcaaatacgcggaggccggcatcgcgcactactggctcgtcgaggaagaagacgggtcaccggtcgtctacgcgtatgaccgcgacaatgcgaccggcttgtacgccctgaccgaggtccaccgccacaaactgcacaccatggcgcccttcccgatcacgttggacctggatcgcctggtcgccggccgctcgagctga

SEQ ID NO: 3598 - DNA, 588 bp, Actinoplanes utahensis
atgatcaacgccggggagcgggtggctcggatcgtgtcggaggtgctggcgccggcggtgctggtggcggcgctgctgatggtggtggggtggcatgccgggcagacgcccggggtgtcgcggtggtggggactgccgggggcgatcttcgcggcggtgatcccgctgggctatgtgctgcacggggtgcggaccggacggctgaccgaccaccacatcccggaccgggcggatcggcgggtgccgttgctgttcgggatcgtgtcgctcggggtggggttgatcgttctcgtgctgctcggggcgccgcgggaggtgctggcgctgctgatggcgggcgccgccgggctggtcgtgttcgcgctggtgacgcactggtggaagatgtcgatccatgccggggtggcggccggggcgctggctacgctgaccgcggtgtacgggccggtggtgctggccggggcgccgctggtgctgctcggcgggtgggcccgggtgcggctggccgcgcacacgccggcccaggtgatggtcggtgcgctggcgggcgcggtggtggccggcacgatcttcccggcgttgcgctga

SEQ ID NO: 3599 - DNA, 453 bp, Actinoplanes utahensis
atgggctggacgatcgaggaacgcgcgtgggacgacccggccggggcggcgctgcggctggcgcagcgcgccgagctggacgcccggtacggcagtgacgaccacgagccgggcggcgcgccggccgctgacgagatcgacgtgttcctggtcgcggtcgacggcgacgcggcggtcggttgcggtgcgctgcgccggctcgacgagcacagcgtcgaggtgaagcggatgtacgtcgcgccgggcagccgtggttccggtgtcgcgaccgcgatcctgcgggcgctggaggacgccgcccgccggcgcggctggacgacggtgcggctggagaccgggacggagcagcccgacgcgatccgcttctaccagcgtgagggctaccgggagatcccgttgtacggcaggtatgtgggttccacgatcagccgatgcttcgaacggctgatctga

SEQ ID NO: 3600 - DNA, 588 bp, Actinoplanes utahensis
atgacggtcccccgaaaagctgacccgcagtgcccgtcacgctcctggcgcgttccccctacgggccggtgtctgcacaccggtcgcaaggtcaacgggatgcgccaccgccgtacgatcacaggcatgcctgcgaccaccggacatctcgtaccgttgagcccggcggaggaagcggcgatgcgcgcgctcggccggttcctcctcgtcgtgccgcgggcactcgacgccgacctgatgcgcgaacagcgcatgtcggccagcgaatactcggtgctgcggcacctgtccgaaaccgacgaccagcggatgcggatgagcgaactcgccgccgcctgcgacatgtcgctcagcggcatgacccggctcgccgcgaaactcgaatccctcggctacgtcaagcggatccgctgcgaggaggacgcccgcggcgccaacgccgtcctcaccccggccggcctggcccgcctgcgcgaggcttggcccacccacctggccagcgtgcgccggcacatcttcgatcacctcggcgacctggacctgacgaagctggcggccgcgttctcggcgatggcgaccgagatctga

SEQ ID NO: 3601 - DNA, 270 bp, Actinoplanes utahensis
atgccacgaaagtcttggtgggcccgcctgcccttcggcgtccgcatgatcgccggcacgtcagcgctgctcgcgctggtcagtggtgggttggccggcgccgccgtgctgaacggcaacgacgggcagtccgccgagagcgccgagcagacactggccggcgacccgggcgccgcgcacctgcaggacgacccggaggtcgtcagccgggaggcggcggccgccgagccgctgccgctgcggcgcacccacctgccggcgccgccctag

SEQ ID NO: 3602 - DNA, 525 bp, Actinoplanes utahensis
gtggccccgaccgccacccagctcccggtcgcgaccggtgccgagctgcagcgggcgcgcgccgaggacccggccgaccggaccggcacccggtccccgcgggtggctccgaagcccaccgtgaccggccgggcgaagccggtggtgaccacccggaccgacaccgagatccggcccgtgccgttccgcacccgggtggtgcgcgacgacacgctgccccagggcttccaccggctgcagtcgcccggcgcgcccggcgaggagaaggtccgctacctggtcacgctgaccgacgggcggccgaccgggcggcggctgctggacaccacggtcacccggcagccgcagccccgggtggtggtcctgggcacccaggactgctccggtgcgttcgacctgtgcgtgccgctgggccggtccgcgtgcccgagcgcggcgccggtgcccccggaaccggacgtgccgccggtcgcggaggactcggcattgctcgacgtgcggctggagcccgccacggcctgctag

SEQ ID NO: 3603 - DNA, 834 bp, Actinoplanes utahensis
atggcactcaccgacgccgagctgaccgagatggcgcagcgcctgaccaccgttccgggcgtggtcggggtcgtgctcgggggcagccgtgcccggcagacccactcgccggagtccgacaccgatctcggcctgtactaccgggccccgttcgacaccgtccggctcggcgagctggcggtcgaggtggccggcgaccgggcccgggtcaccgcgcccggcgagtgggggccgtgggtggacggcggcggctggctgcggatcggcgatcatccggtcgactggatctatcgggacctggaccgggtgcacgcctgctgggccgaggccgagcaggggcgctacgagttccacgcgcagggcggccacccactcggggtgccggatcatgcgtacgccggcgaattggccctgggccggatcctcgccgatccgacaggggagctggccgcgctgcgacgccgcgtgtcggttttcccgaggccgctggccgaggccctggtggccgggttgtgggaggccgacttcctggtcgggctggctcgcaagggggtcggtcggctggacaccagctacgtggccggctgcctgttccggttggtcggggtgtgtgcgcacgcgctgcacggggcggccggccagtggctgatcaacgagaagggcgcggtggcggcggccggccggctgcccggcgcgccggcgcagttcgccgaccgggtggacgccgccttcgccgcgatcaacaacgatccgctgcatctgacactggccatcgacatcgccgccgatctcgtcctggagaccaccgaggcgtgcgcgatgatgttgcggtga

SEQ ID NO: 3604 - DNA, 774 bp, Actinoplanes utahensis
gtgcgcgatgatgttgcggtgaccgctgacgtccccaccattctcgccaccagcgccgggttcgaacgcggcccgctcggcggcttcgacatccgtcccggccgggtccaccatttcgcggccgagctggcgaatgcgggcgccgatccgcggatctgcgtgctggctcaggcgctgggcgacccggaagcgcggatcggcgcgttctactcggctttcgcttccaccgcgttcacgatgtcgcacctgcagttgttcccgatgccgaatgtcgaggacatccgtgcccatctgctcgcgcaggacgtgatctgggtggacggcggcagcgtggcgaacctggtcgcgctctggcgggtgcacgggctcgacgagatcctgtacgaggcgtggcaggccggagtggtgctcagtggctcgtcggccggctcgatctgctggcacaccggcggcaccacggacagtttcggattgcggctgcgcgcgttcaccgacggactgggctggctgccgtacagcaatggtgtgcattacgacgccgagggggagcgccggccgaagatgcacgagctgatcgccgacggcaccctgccggacggcttcgccaccgacgagggtgccggcttggtgtatcggggcacgtcactgcaggaggtggtggcggaccgtgcaggaccacgcgggtacgccgtgcagcgcaccgccgcgggcaccgtgaccgagacgccactgcccacccgcgttctcccggaatatcgtcaccgatcggcataa

SEQ ID NO: 3605 - DNA, 207 bp, Actinoplanes utahensis
gtgctggcccatctgcagaaaccgctgacccggacaccgagcggcatgctgctcggcgccgacctcgctccggcgccggcgggcggcggaggggaggggggtcagccgcaccggctggccctgctgctcggggcgaacgcggtctacgcggtggccctgctgctctcggccgtgctggtcgggctggccaccgtcgcgctgtcctga

SEQ ID NO: 3606 - DNA, 894 bp, Actinoplanes utahensis
atgccggccaagtatcgaaccgtgttcgggggcacctggggcctgctgtgcgcgctcctcggtgcggcctccggcgtcgcccagttggccggcatctccggccggaccggtcggtgggcgctcaccgccgtcttcctcgcctgcctgctctacttcgtggtctggttctggcagatcgccttcgtgctcaagatccgccaactgcgcgccgaactgctcgacgcgacgcaggcactcaccctgcagcgggccggtcaccagcactatctcgacgccatccagcggatcagtgagcgggagaagccgctgttcctggagaccttggaggtgctggtggcggtcggcgccgacgacgacagcgaccggatcgtggagaagcgggtgaccaccccggagccgctggtcacgcaccggaccatgcggccgatcgtgccgaccgacgaggagcggatgatccggctcgacgacatcgcgttcaaggccagccgggagacgttcgggacgatcaccgcgctgccgctggagcagacccggacgctgcgcgtgtggatgatcttcgacccggcgatgaccacgccgaccgagtggcaggtggagtaccggccgcgcgggctctggcggccgctgcgcgagcgcggctgggaccagctgacctgggaggaccggctgccgacggcgagcggcacgccgtccgcgttcacccgcttcgcgatcacgttcacgttcccggacaacgatcagccgccgagcgtcaaggagcggcaggggtacggcgtgctcagcgagccggtgcgcgacccgtccggccgctgggaggtggtgtggcgcgacgagaggccggccggccgccggtacgtctgggatctgacgcaggcggtcggcaggccgtcgtga

SEQ ID NO: 3607 - DNA, 363 bp, Actinoplanes utahensis
atggcagacgtgatctacgacaacaagagccagctcgagcaggtccagagcggactgctcgagggcgagaccatcatcgcggtctacgacgcgatcggcgtcggcaccggcttcctcggcctgaccacccgccggatcatcctgcaggacaagtcgttcgtcggtaagaagttcgcgatcaccagcatcccgtacagcaaggtcagctcggtgagcgtggtcagcaacaagagctgggccggccagttcttctccagcggcgagatcgcgatcacggtgggccagcacgtctacgaggtcgagttccgcggctcggacaaggcccaccacgcgcacaacctgatcctcagcctcgcctcctga

SEQ ID NO: 3608 - DNA, 315 bp, Actinoplanes utahensis
atgcgggctaggaaacgccggaccagtaccggctccgactatctgagtgacgccctcgcgttgctcggcgggtggacccgggacggggtgcaactgcgccgcgatctcgcgtgcgacgacagcgagcacgccgcgctgaccgagcggatcaaggtggcggccgacaccctcgcgatccgcccgaggatccggcgggtcgacgggcacacccagatctgcctgggtgaccgcgacggcgaggcactcaccgacggtgaggtcaccctggccgcccggatcgaggatttctaccgcaccgtggtcggccacgcgtag

SEQ ID NO: 3609 - DNA, 432 bp, Actinoplanes utahensis
ttggatctcatgccgtcggaacagtacgtcaagtccccgccgtcacccagggtgattgtggcggcagtgatcatcgtgggcgggcgggtgctcgcctgccagcgccgcagcccgcccgaggcggccggaaaatgggagttccccggcggcaaggtcgaacggggcgagaccgacgaggcggcgctggcccgggagtgccgcgaggagctcggcatcaccgtcgaggtcggcgcgcgggtcggccccgacgtgccgctggcccacggccgggccgtgctgcgggtgttcgccgccgaggtgctcgacggcggcgtgcccgaggcactcgagcacgccgacctgcgctggctgaccgtggacgaactgggcagcgtgccgtggctgcccgccgacgtgccgattgtcgcagaacttcccgctctgatggactag

SEQ ID NO: 3610 - DNA, 1659 bp, Actinoplanes utahensis
atggcaactccctggaaatccggaatcaacactggacgcgcaaaaacttacgccgctagtttatgcgcaagctgcgacctacatcactcggaggcgatctgcatgacgactctgtccctggccaccgttctggccgagagcgcccgccggtacccggagaaggtcgcgatcgtcgacgcgggcgcccggatcacctaccgcgagctctgggaccagacccgggcgtacgcggccggcctgcgcgagctgggcgtcggcgccggctccacggtcgccgtgatgatcccgaacgtggccgacttcccccgggtctactacgcggcgctggccgtgggcgcccgggtggtgccggtctcgctgctgctgcagccggcggaggtggcctacgtgctgtccgacagccaggccgacctgctcgtcacccactcggcgttcctgcaggtgggcgcggccgcggcgcagctgtccgggacccgcctggcgaacgtcggtccgctgccggccgagctgccgacgctgcccgagcggctggaggaggtgtccgcccgggtcccggcgctgcacacctacgtgacccggcaggccgaggacgtcgcggtgatcctgtacaccagcggcaccaccggcaagccgaagggcgccctgctcagtcacctcaacctggtgatgaacgcgaccgtcaacgtgttcgacgtgcacccgatcaccggcgacgacgtggtgctcggctgcctgccactgttccacacgttcggccagacggtcgggatgaacgcgacgttccgcctcggcggcaccctggtgctgctcccccggttcaccggcgaggcggcgatcgagctgatgctgcgggagaacgtggcgatcttccacggcgtcccgaccatgtacatcgggctgctggaggccgccgcgaaggcggagcggctgccgaaactcaagctctgcgtctccggcggggcgtcgctgccggtggccgtgctggagcggttcgccgagacgttcgggtcgcacatcttcgagggctacggtctctccgagacctcgcccacggcgaccaccaaccagccggcgtacggggcgaaggccggcaccgtgggccatcccatctggggcgtcgaggtggagatcgcccgcccggaggtacccgagcggatcgagttcctgccgaccggtgagctgggcgagatcgtgatccgcgggcacaacgtcttcgccggatacctgaaccgcccggaggcgaccgccgaggcgatcgtcgacggctggttccgcaccggtgacctgggcacccgggacgaggacgggttcatcagcatcgtcgaccggaccaaggatctgatcatccgcggcggcttcaacgtctacccgcgcgaggtggaggaggtgctggcccggcacccggcgatccagcaggtcgcggtgatcggggtggccgacgacacgcacggcgaggagatctgcgcggtggtggtgcgggaagacggcggcctgaccgagcaagagctgatcgactggtcgcgggagcgcctgggcaagcacaagtacccgaggcaggtccggttcgccgagtcgctcccgctcgggcccagcatgaaggtgctcaagcgggagctgcgcaagcagtattcgcataaacagcagggcaacgccgtctag

SEQ ID NO: 3611 - DNA, 630 bp, Actinoplanes utahensis
atggctcggccccggcaggcgctcctgacccgtgagcgcatcgtcgaggccgcggcggcgctgatcgacgcggagggcctggaggcactgtcgatgcggcggctggccaccgagctcggggtgcagggcccgtcgctctacaaccacttcgccaccaaggccgagatcgtcgacgcggtcgccgaggcggtggtcgcccaggtggacatcggggtgttcgccggttgcgactggcgcgacgggctgcggctgtgggcgaagtcgtaccacgcggtgctgaccgcccaccccaacatcgtcccggtgctggccaccgggcccggccggcgcccgcacgggctggcgatggccgaagcggtctacggcgcgctgctcgacgccggctggtcccgttcacgggccacccacatcggcgcgctgatgcgatatctgatcaccgggtcggcgctcggctccttcgcgatgggcttcgcggtcgacccggcgctctacgaccactatccgcacctgcaccgcgcccacgagctggcggcccaccgcgcggtggtcgacgagggcgctttcgaactcgggctggacgtgctcatcgccggcctgtccgaccactacgaccagggagtacgccgatga

SEQ ID NO: 3612 - DNA, 1410 bp, Actinoplanes utahensis
atgacgtcggaattccgggaacagctctacatcggcggtgcctgggtgccgccggcggcgggcgaccggatcgaggtggagaacccgtacaccgagcaggtgatcgggcacgtcccggccggcaccgccgcggacgtggacctcgcggtcgccgccgcccgccgggccttcgacggctgggccgggctgccgatgaccgagcgcggcgccgccctcgaccggctgcaccgggccctcgccgcccgggccggcgagatcgcccgcaccgtcggcctcgaactcggcaccccgctcaagatcgcgcaggcggtccaggccggcctgccgctcaccgtcctgcgggggtacgccgacgcggcgtcccgcccggtcgagccggagacgatcggcaactcgctgatcctgcgcgaggcggccggcgtggtcggcgcgatcaccccgtggaactacccgctgcaccaggtcgtcgcgaaggtcggtgcggccctggcggccggctgcaccgtggtgctcaaacccagcgagctcaccccgctggtggcgtacctgctgttcgacgccgcccacgaggccgggctgccggccggcgtgctcaacctggtcacgggcaccggcccggtggtcggcgcggcgatcgccgggcacccggacgtcgacatgatctcgttcaccggctccaccgcgaccggccgcgcgatcagccacgccgcggccgaccggatcgcgaaggtctcgctggagctcggtggcaagtcggccaacgtgatcctggaggacgccgacctggtcaaggcggtcaaggtcggggtgggcaacgcgttgctgaactccgggcagacgtgcaccgcgtggacccggatgctggtgcaccgcgcgcactacgacgaagcggtggcgctcgccgccaagaccgcggtcggttacgtcaccggcgacccgttcgacccggccacccggctcggtccgctggtctcggcggcgcagaaggaccgcgtacgcggattcatcgaccgtgccgacgcccggctggtggccggcggcccggccgcgccggtgcccggcaccgggcacttcgtggcgccgaccgtcttcgccgacgtcgacccggacagcgagctcgcccaggaggagatcttcggcccggtgctgtcgatcatcccgttcgacagcgacgaccaggccgtggcgatcgccaacaactcgaagtacggcctggccgggggggtctggggcagcgacgagcgggcgctcgcggtggcccggcggatccgcaccggcgccgtcgacgtcaacggcggctcgttcaacccgctcgccccgttcggcggctacaagcagtccggtgtcggccgggaactgggccggttcggcctggaggagttccagcaggtgaaggcggtccagcggtga

SEQ ID NO: 3613 - DNA, 1089 bp, Actinoplanes utahensis
gtgagccaccacatctccggtctggtcgtgacggcggccggcgccccggcgagcgtcgcggagctgcggcttcccgagatcgggcccggccaggtgcgggtccgggtccgggcggccggggtctgccactccgacctctccatgatcaacggcacgctgcggccgccgcacccgctggtcctcgggcacgaggcggccggcgaggtggtcgaggtcggcgagcacgtcacccgggccgcggtcggcgaccacgtggtgctcaactggcagccgccgtgccggacctgctggttctgcgcgcacgggcagccgtggctgtgcgccacctcctccggggtcgccgccctggagaacgggatcaccctcgacggcgcccccgtgcacgtgtgcctggggctgggtgcgttcgccgagcaggtggtcgccccggagaacgccgtcatccgcgtaccgccgcagttggatttcgaggtcgccgccctcctcgggtgttcggtgctcaccggatccggcgcggtccgcaacaccgcgaacgtgcagcccggcgaatcggtgctggtcatcggcctcggcggggtcggcctgtcggtggtggccgcggcccgggcggccggcgcggcgcaggtcatcgcggtcgacgtgaccgaggcgaagaagggcctggccgaagcggccggcgccaccgacttcgtggtctcctcggacgcgctgtccaaggacatccgggtgcgcaccgagggccgcggtgccgaccacgccatcgaatgcgtcggccgcgcctcgacgatccgcgcggcgtggcgggccacccggcgcggcggccaggtcaccgtggtcggcatgggtgcggccgacgacatggtgcagctcgccgccctggacatcttctcgtcggcgcggaccctgcgggcctccgtgtacggccaggcggacccggacatcgcggtgcccgccctggcgcgcgacgtgctgaacggccggttgtccctcgaccacctgatcaccgaccggatcgggctggccgacgtcccggccgccttcgaccggatggcccgcggcgagggcgcccgctcggtggttcacctctga

SEQ ID NO: 3614 - DNA, 2607 bp, Actinoplanes utahensis
atgggggagttcactggcgggtccgggctgctcgaacggtccgggcagctcggcgcgctgcatcaggcgtacgactcggtgcgccgcggccgcggcggtgtgctcgtgctgctcggcggagaggccggcggtgggaagaccgcgctggtgcgtcgcttccgggacgaggcgcggcccggccggccggtgctctggggcggctgcgatccgttgtggacaccgcgtccgctcggcccgttcctggagatcgcgcacgacgcagccgacagcggcccggtccgggagctgatcaaccgcggcgcgaaaccgtacgagctggccaccggcctcatcggggacgcccgggagcggcccggactgattctggtcctggaggacctgcactgggccgacgaggccaccctggacgtgctcagcctgctcgggcgccgcatcgacggcatcccggcgctggtcgtcgccacctatcgcgctgacgaggcgggccgcgggcatccgctgcgccggctcctcggcgagctgcagggcgcggcgatccggcggatgggggtgccaccgctgtccccggcggcggtcgaggagctggcccggccgcacgggcgggacgggcgggcgctgcatcgggcgacccgcggcaacccgttcttcgtcaccgaggtgctggctcgcgacgacggcgacgtgccgctgaccgtccgggacgcggtgctggcccgggccgcccggctgagcccggccgcggccgcggtgctcgacgaggtcgcggtcaccccgccgcacaccgagctgcgcctgctcagcgacaccgccggcgtggacgaggcggtgcgggccggcatgctggagtgcgtgccgggcggggtggcgttccgccacgagctggcccggatcaccgtcgaggagtcgctcagcccgcaccgccgcctcgacctgcaccgccgggtgctggccgcgctgctcgccgagccggacgcggccgacccgagccgggtcgcccaccacgccgacgcggccggggacaccgcggtcgtcctggagtgggcgccgcgcgccgccgagcaggccgccgactcgggcgcgcaccgggaggccgccgcccagtactcccgggccctgcgcttcgccgccggcctcggcccgatcgagcgcgccggcctgctggaacgccggtcgtacgagtgctacctgaccgagcagaccgacgagtcgatcgacgccctgcgggaggcgatccggcagcgccggctggccggtgaccgggtcagcgagggcaccgccctgtcccacctgtcccggcggctgtggtgcggcggctacatcgaggaagccgccgacgccggccgggcggcgctgcggctcctcggtgacctgccgtccggcccggagtacgcgatggcctgcaccaaccaggcgtcgatcgcgctgaacatcgaggagtacccggacgcgatcgagctcggcacccgggcgctgcggctcggcgaacggcacggcctgcccgaggtggtggtgcacagcctcaacaacctgggcaccatgcagctgctggccggcgaaccgcaggggatcggcaaactggagcgcagcctggcgctggccgagcaggaacggctggaggaacacatcggccgggcgtacatccacgtcgggtgggcgatgacccgggtccgttcctaccacctgtcgtcgtggctggaccggggtgtcaccgcctgcgccgacctgggcctggaggcgtggaagcactacgtgctcgcctaccgcgcccgctaccacctggacctgggccgctggccggaggcggtcgccgacgccgagcaggtgctgcgcgaggccaaaccggtgccgctgctgcgggtcatcgcgctcagcgtgatcggcctggtgcaggcccgcggcggcgagacggacccgtggccggtcctggacgaggcccggtcgctggccgcgaccagacccgagttgcagtacgtcgcaccggtcgccaccgcccgcgccgaagccgcctggccggccggcgccccggtcgaaccggagctcgcggaaacctgggagctggcccagcgccggcgcgcggtctgggtcctcggcgaactcgcctggctgcgccacctggccggcgagccgcaccccgagccgcccgccgcgcccctcgtcgaaccttacgcgttgcagctagccggtcacatcgaggcggccacggagcgatggcggaagcgcgactgcgcgtacgacgcggctctggccctgtccggcgcccccgccgaaacctcgctgcgcgccgccctcgccgagttccagcggctcggcgcccgccccgccgcggcggtcgtcacgcgccggctgcgcgcccgcggcatccgcgacatcccgcgcggcccgcaacgctggacccgcggcaacccggccgagctcacccggcgtgaggtcgaggtgctcggtctggtgcagcaggggctgtccaacgtggagatcgccgagcggttgttcctgtccaccaagacggtccaccaccacgtctcggccatcctgcgcaagctcggcgtcgcccgccgcggccaggccgccgccgaagcgtcccggctgggcctcaccccggcagattga

SEQ ID NO: 3615 - DNA, 588 bp, Actinoplanes utahensis
gtgaccacaccgccgcgcgtcgacggccgcaccgcccggtccgaacggacccgcaacgcgatcgtcgacgcccacctccagctgatccgcgacggggacctgcgccccaccgcggatcggatcgccaaactggccggcgtctcgctgcgcgccctgtggagccatttcgccgacatggaagcgctgatggcggccagcggtcagcgggtcctggagcagcgcgacgcgtcgtaccggaagatcccgtccgatctgccgctggccgagcggatcgacgcgttctgccggcagcgggcccggatgctggaggagatcggcccggccgcgcgggcgtccgcgctcaaggagccgttctccagcgccctgcagcgctaccggcggctgcacgtggcccgggtccgcgacgagctgaccgacgccttcccggccgagatcggcaccgacgaggacctgctcaacgcgctgaccgcgatcagcctgtggccggcctgggccacctggcgggaggcgatggaactgccggttgaggccgccacggccgccctcgcccgcagcctgcgctcgctgctgagcggcggcccgcggtag

SEQ ID NO: 3616 - DNA, 1206 bp, Actinoplanes utahensis
atggacttcgagttcgacgcgacgaccgaggactaccgcaagcggctgctcgccttcatggacgagcacgtgtacccggccgaggccggttaccacgccggcggggacggctgggagccaccggccgcgctgaaggttctgcaggccaaggcgaaagaggccggcctgtggaacctgttcctgcccggtgagcacggcgccggcctgaccaacctgcagtacgcgccactcgccgagatcaccggccgcagcccggcgatcgccccggccgccctgaactgcgccgcaccggacaccggcaacatggaggtgctcgccgagttcggcacccccgagcagcaggaacgctggctcaagccgctgctggccggtgagatccggtcggcgttcgcgatgaccgagccgcaggtggcctcctcggacgccaccaacatcggcacccggatcgagcgggacggcgacgagtacgtcatcaacggccgcaagttctacatcaccggcgcgatgaacccgaactgcaggatcttcatcgtgatgggcaagaccgacccggacgccgaccggcacgtgcagcagagccagatcctggtgccccgggacaccccgggcctcaccgtgcaccgcggcatgacggtcttcggttacaccgacggcgaccacggcggccacgccgagctgatcttcgacaacgtccgggtgccggcgggcaacctgatcggcgtcgagggcggcggcttcgcgatctcccaggcccggctcggccccggccggatccaccactgcatgcggctgatcgggatggccgagcgggccctcgagctgatgtgcaggcgggcgctgacccgcaccccgttcggcaagccgctggccgagcagggcgtggtgcaggactggatcgccgagtcccgggtccggatcgagcaggcccggctgctggtgctcaaggccgcctggctgatggacacggtcggcaacaggggcgcgcacaccgagatccaggccatcaagatcgtcgtaccgcaggccgtcgaatggatcctggacaaggcgatccaggcccacggcgcggtcggcaccagccaggacacgccgctcgcccagctctgggtggcggctcgcacgctgcgtctcgccgacggccccgacgaggtgcacaagcgctcgctggcccggcgggagttgaaccgctaccggagtcgtccgtga

SEQ ID NO: 3617 - DNA, 981 bp, Actinoplanes utahensis
atgaagggcctggatctggcgaagctccagagctatctggacagtccgccgctgaccgggacgatgttcgcgggcggccggtcgaatctgacgtacgcggtgaccgacggaacgcaccggtgggtgctgcgccgcccgccgctcgggcacgtgctgccgaccgcgcacgacatggctcgcgagcaccgggtgctggccgcgctctcgcaggcgggcttcccggtgccggcgccggtgctgctctgcaccgatcctgaggtgatcggggcgccgttctacctgatgcagcaggtcgacggcacgatctaccgggacgccgcgcagttcaccggggtggatctgcggcagctgaccctcaccctggtcgacacgctcgccgacctgcacgcgctggacccggagaagatcgggctgggtgacttcggccggccggagggcttcaacgcgcggcaggtgcggcgctggaagcagcagctggacgcgtcccgcagccgggagctgtccggcatcgacgagctgcacgcccggctggcggcggacatcccggccggcggcccgggcgccgtggtgcacggcgactaccgcctcgacaacgtgctgatcggcgacgacctgcgggtcaacgcggtgctcgactgggagatgtcgacgctcggcgacccgctcagcgacctcgccctgatgctggtctacgccggccggccgctgctggtcaaggacgggaagccgtacgcgccgatcgacctgcccgggcacccgtcgctggcggagatgtcggcgcggtacgccgagcgcagcggccgcgacgtcggcgacctgcactggtacgtcgggttcgcggcgttcaagctcgccgtcatcctggagggcgtgcactaccgattcaccaagggccagaccgtcggcgccggtttcgacaccgtcggcgcgatggtgcccacgctgatcgagcagggtcaccgagcgctggaggggaactga

SEQ ID NO: 3618 - DNA, 774 bp, Actinoplanes utahensis
gtgaagcgcgtcgtgatcaccggcgccggtggcgggatcggcgccgcgctggcccgccggttcgccgccgacggcgaccgggtcgtcgtcagcgacatcaacccggacgcggcgtccgcggtggcccgggagatcggcgccgtcgcggtcgcggccgacgcggcgatcgaagcggacgtacgcggtctgatcgaccgtgcctacgacgagctgggcggcatcgacctgttctgctcgaacgccggcgtcctcacggccggggacgagaacactccggacgagctgtgggaacgggacttcgcggtgaacgtgaagtcgcacgttcacgtgacccgcgcgctgctgccccggtggctggacacggacgagccgaaacggctgctgatcacggtgagcgcggccggcctgctgaccctgttgggcagcgcgtcctactccgtgaccaagcacgcggcgctggcctatgccgagtggctgcgcgccacgtacgcccatcggggtctgatcgtccaggcgctctgcccgcagggggtccgcaccgacatgctgaccggcgggaacgcccggggcagtggcagcgcggcgctgctcgccgagggcgcgctggagccgtccgcggtggccggcgtggtcgccgagggcctcaccgacaatcggttcctgatcctgccgcatccggaggtcgccgactactaccgcttgcgcgcgaccgatccggaccgttggctgggcggcatgaacaggatgcagcgcggcttcgaggcgggtgcctga

SEQ ID NO: 3619 - DNA, 750 bp, Actinoplanes utahensis
atggcggaccaagtggcgatcgtgaccggggcaagccggggaatcgggttcgccatcgcgcaacgattcgtggcgcagggcgcgaaggtcgtgatcaccggacgtgacgacgacgccctgcaggccgcggtcaaggagctgggcggcccggcggtggcgctcgggatcagcggcaagggcgacgacgcggaccaccggaccgcggtggtcgacgcggtcaccgcgacgttcgggccggtcaccacgctggtcaacaacatcgggatcaaccctgcgtacgggccgctcgccgccctggatctcaacgccgcccgcaagatggccgaggtcaacctgatcggcacgctgggctgggtgcaggaggcgttgcgcggcggcctcgggcagagcgagggcgggtcgatcgtcaacatctcgtcggtctccggggtgcgcccggcgcccggcatcgccttctacggcaccaccaaggccgcgctgatccacctcaccgaggagctggccgtcgagctggcaccgaggatccgggtgaacgcggtggcgccggcggtggtcaagacccggttcgccgcggccctgttcgaggggcgcgaggagcaggtcaccgcgacgtacccgctgaagcggctgggtgcgcccgaggacgtggccggcacggtggcgttcctctgctcgaacgacgcgtcctggatcaccgggcagaccatcgtgctggacggcggcgtcaccctgaccggggtggtcgagtga

SEQ ID NO: 3620 - DNA, 1263 bp, Actinoplanes utahensis
atgaaacgcaccacggcggtgttcctcgccgtcctcttgttcgccacggcctgtgacgggtcgtccaccaggtcgggcagcggcggcggcaccgtgcccggggtgaccgactcggaggtggtgatcggcacgcacatgccgctgaccggccccgcggcagccggctactccaagatcgcgcccgcctccaaggcctacttcgacttcgtgaacgcggccggcggggtcaacggccggaagatcacctacaaggtcaaggacgacggctacaacccggcgaccacccagcaggtggtgcgggaactggtgttgcaggacaaggtcttcgcgatcatgggcggcctgggcaccccgacgcattccggcgtgctggacttcctgaagaccaaccgggtgccggacctcttcgtggccagcggcagccgcagctggaaccagccggacaagtatccgggcacgttcggcttcaacccggactacaccgtcgaaggcaagatcctcggcacctacgtcaagcagaacctggccggcaagaaggtctgcttcctgggtcaggacgacgacttcggccgggacagcctggccggcgtcgagaaggtcctgggcgcggtggccgccaagcagacgtacgtgaccagcaacccgaacgtcggcccgcagatgggcgcgctcaagcaggccggctgcgaggtggtcgtgctggccaccatcccgggcttcaccgcactggcggtcggcaccgccgcgaagatcggcttcaagccgcagttcgtggtcagcaacgtgggcgccgacccgggcaccgtcggcaaggcgctgggccccgccgcgccgctgctggagggcgtggtctcggccaactacctgccgatcaacaccgatgacgccagcccgtggatccagctcttcaagaaggtcaacgcgcagtacaacggcaacgcggaattcgacaacaacgtcgtgtacgggatggccgcggcctacctcttcgtgcagtcgctgctggccgccggcaagaatctgacccgcgacgggatcctcgccgcggtcacgaagaacggtttccagggtccgggcctggtcccgctgcgcttcgccgacaaggatcactcgggatacggcggagagcagctcacccggatcgaaggcggcaaggcggtgttcctcgggcaggcctacaccacggatgacgcggacggcgcggtgcagccggtggcccctctcaccgtgacaccgccaccgaacgggatcccggcggcgtaa

SEQ ID NO: 3621 - DNA, 1011 bp, Actinoplanes utahensis
atgaccgacgtgcgggagaagccggctaccgccaccgcccccatccgggtcacccggcgcatacccccgctggggtacgccgtgaccggcgccctgatcatcctggcgctcacctacgtcctgccgccgttccgcaactaccagctggccaccgtcggcgcgtacttcacggtgaccgccggcctgaccgtcctcaccggactcaacggtcagctgtcgctgggacacggcgccctgatggccaccggcgcctacacgttcgcgctcacccagaacaggtggctgcacctgcccctgagtttcctggccgcggtcctggtcaccaccctggccggcacggtgatcgggctggccgccgcccgcctgcgcggcccgtacctggccggcctcaccctggcggtcgccgtcgtggtcccgtcggtgaccagcaccttcgacacgacgttcaacagcgatcagggcctgccggtggcactcgacccgccgccggaggtgatcccgatggagcagtggcaggcctggctctgctgggccggcgcgctgttgaccgctgccctgctggcgacgttggtgcgcggccggttcgggcgggatctgcgggcggtgcgggacgacgagaccgcggcgcggctcgccggggtgcacatcgcccgtacccaggtgatcgcctttgtggtgagcgccgcctgcgccggtctgtccggcgccctgttcgcctacctcgcgcagagcgtctcccccggcgcgttcccgctgaccctgtcgctgttcctggtgatggccatcgtgatcggcgggctggggcggctgatcggggcgctgctcggcgcggtgctgctggtcctgctgccggcgctggcgcagagcgccgccgagagctcgggctcgcagcatctggagggcaacctggccctggtgatcttcggcgtggtgctcgtcgtcgtcatgctcgccgccccgggcggcctcgcatccctgcgattttccacgatattcaggaggaaacgatga

SEQ ID NO: 3622 - DNA, 879 bp, Actinoplanes utahensis
gtggacagattcatctacctgacattcgacgggctgagccggggcgcggtctacgccgcgttcgcgctggccctggtgctgatctggcgggccgcccggatcgtcaacttcgcgcagggcgcgatggccgtcgccgcggtctacgtggcgtattcggtgacggacgcgaccggctcctactggctgggtttcgccgccgcgctgcttttcggcctgctgctgggtgtcgcggtggagaaggcggtgatgcgtttcgtcgaccatgcgtcgccgctcaacggggtggtggtcgcgctcggcctggtcctgatcgtgcagggcgcgctcggcatgctctacggcaacgagttccgcccggtgccgacgccgtttcgccgggacgcgttcgaggtcggcggggtggccctgctcagccgctacgacgtgttcgtcttcgtggcggtcggcgccgtggtggccgggctgacgatcctgttcacccgcaccccggtcggtctacggatgcgggccgccgcgttcgccccggacgtctcccggctgctcggcgtcccggtcggcggcatgttgacgctgggctgggcgctggccgcggcggccgggtcgctggccgggatgctggtcgtcccgaccgagctggggctgcacccgaccgcgatggacgtcgtcttcgtctcggcgttcaccgcggccgtggtcggcggtctggacagcccgatcggcgcggtcaccggcggcctgatcgtgggcctgctgctgtcctacgtcagcggatatctgggcgcgacggtcgccccgatggcggtgttgctgctgctcgtggtcgttctgctgggccgtcccggcggcctgttctcgagtgcgaaggcgaggctggcatga

SEQ ID NO: 3623 - DNA, 756 bp, Actinoplanes utahensis
gtgagcgccgccgggacgctggacgagcggtatcagaagcagcggacgctgctgcgggtggacgggctgaccgcggggtacggcgcggcgccggtgctgcacgacgtgcggctgcgggtgcgggccggagagatcgtcgccgtgctcggggcgaacggcgcgggcaagacgacgctgctgcggacgttgtccggcctggtccgggcggaccgcgggtcggtcgtcttcgacggcgaggacctggccggcgtgcgggtggagcagatggtccggcgcggcatcgcgcacgtgccggagggccgtggtgtggtcaccgagctgaccgtcgaggagaacctgcggctgggcgggttgtggcggcgcgaccgcgcggatgcggcacgcgccctggacgaggtctacggcctcttcccggcgctggcccaacggcgtgccagcgccgggcatcaactgtccggcggggagcggcagatgctggcgctgggccgggcgctgatcggccggccccggctgctgctgctcgacgagccgtcgctgggcctggcgccgaaggtgaccgcgcagatcatggcgctgctgcgggatctgcgggaccggaccggactggcggtgctgctggtcgagcagaacgtgcgcagcgccctgtcgatcgccgacgaggggatcgtgctctcgctgggccgggtggcgacccgaaaccgggccaccgagctgcgggacgacgccgacctccgacacgcctacctggggttctga

SEQ ID NO: 3624 - DNA, 915 bp, Actinoplanes utahensis
atgtcgacgcatgccgagttggagctcgaccacataaccgtgcgcttcggcgggctgaccgctctcgacgacgtctcgctgcgggtgccggcggggcgggtggtcggggtgatcgggccgaacggggcggggaagaccacactcttcaacgtcatctgcgggttcgtcacgccgacggccggggccctcgcgttggacgggcgggcctggcggccgcggccgcaccacctcaaccggctgggcatcgcccggacgctgcagggggtgggccagttcagcggcctgaccgtgctcgaaaacgtgcaggtcggagcgcgcggccaccgcccggagagaccggaccgcgggcgcgcggagggaccgggccggctcacgcagggcccggaccgcgggcgcgcggagggaccgggccggctcacgcaggagccggatcccgggcacacggggggatcgggccggctgatgcgggagccggatcgcgggcgcgggggcgaggggggccggctcggccgcggggggcgcttcggcgggtgggagcggcggtccgtgcgggaggcgttcgcggcgctggagcggtgcggggtggccccgtatgcggatcagcttcccggggcgctgccctacgcgatccgcaagcggatcgagctggcccgggcactcgccgcccgaccgcggatcctgatgctcgacgaaccggccggcggtctggacaccgatgagatccagtggctggccgggctgatccgggacgtcgggaccacggtgctgctggtcgagcatcacatggacctggtcatgtcggtctgcgacgagatcctggtgctcgacttcggcaagccgatcgcgctcggctcgccggccgagatcagtgcggacgagcgggtcaccgaggcctatctgggtgccgccgcgtga

SEQ ID NO: 3625 - DNA, 924 bp, Actinoplanes utahensis
atgacgcagccgccaccccgcccggaggatcgggacccggccaccccggcctcgccccgccccaccccaccgcccacggatccgctcaccgcgaacctcatcccgcccgtcgacccctggcccgccgccgccccgccccaggagccctatccgccggccgcgcctctgggcggctatccgccggcatcagcgcagggcggctacccgccggcatcagcgcagggcggctacccgccggtcccgccccaggtggcccacccgcaggccgcgcccggggaggcccacccgtcggcggcgtatccggcggcgtatcaagcggcccatccggcggcgtcgcagccggcccatccgccgccgccctaccgatacccggcggctttcggcggtccggcgcaggtcaagtcactgcgcgtgccggcggtgatggccaccgtcggcctgatcctgacgattctctacatcgtcatcctgtacaccgcggacccggtctcgatcaccctcggcgacgccccgcggctcgtcctgtatgtcggcatcttcgccacggtgatctacaccgtcgtcacgttcctggtctggctgcaccgcgcctcggccaacctttggaacaccggccaccagctcacatggggccccggttggacgatcggcgcctggtgcatcccgatcgccaacctgatcatcccaatgatgatcatccgtgaggtcgaccgtgagtcccgcgatcacggccccggtctcttcgccgcctacgccgtcagctggaccgtcagcgtcctgctggaacgcagctcacgcacggcctccagcggcaacacggtccatgtcgtggaaaccgtcgcgaccatcgccgccgcgatcacggccatcctcctcatccgccgggtcaccgccgaccaggagcagaggttccggactgtctga

SEQ ID NO: 3626 - DNA, 633 bp, Actinoplanes utahensis
atgagcagcgcatatcagccttcgatgctcgatctgatggggtcggcggagccgtcgctggagccgctgagcggggcggtccggcatcgtctcagcgccggggcgtgggtcgacgtgctgcccgggtggctgcacgggtcggacgcggtgttcgagacgctgctgggcatcgactggcgggccgagcgccgccggatgtatgacgatgtcgtcgacgtccctcggctgctgcgctggttcggcgcgggtgagccgctgccgcatccggcgctggccgccgcccgggcggcactgaacgcccactatgcgaccgagctcggggaggagttcgtgaccgccgggatgtgcctctaccgggacgggcgggacagtgtggcctggcacggggacaccatcgggcggtcggcgaccgaggacacgatggtggcgatcgtgtcggtgggttcgccgcgaaatctggtgctgcggccgcgggccggcgagcgggagacgttgcggttcccgctcgggcacggcgatctgatcgtgatgggcgggtcctgccagcggacctgggagcacgcgattccgaagacggctcggccggtgggcccccggatcagtgtgcagtttcggccacgaggggtggcgtga

SEQ ID NO: 3627 - DNA, 570 bp, Actinoplanes utahensis
atgccgtcgcttgtcacacccgcactgcccgccggctcgatgtccgaacgggaccagccgatgatcggcggggacggggtggcgttgcgggtctggcgggaggccgatcgggactccgtggtcacggcgtatgcggatccggcgatccaacggtggcactgcgactccatgaccccggctgaggcggaggcgtggatcgccggatgggccggacgctggcaggcagaaaccggggcaagctgggcgatcgtcgacgacgatcgggtggccggtcagatcgggctgcgacggatcgatctagccgaggcaacggcgcacatctcctactgggtgctgccggcgttccgggggcgccgcatcgcaccgcgggctttgcacgcgttgaccgactgggccttcggtggcctggggctgcatcgactggagctgaaccactcgacggccaacgccgcctcctgccgggtcgccgagcaggccggctatccggccgaggggatcaagcggtccgaggcgcggcacgccgacggttggcacgacatgcaccagcatgctcgcctcgccaccgactga

SEQ ID NO: 3628 - DNA, 993 bp, Actinoplanes utahensis
gtgaaccgacacttccgcgtctggcggggcgactcgtccggcggcgacctggaggacttcgacgtcgaggtgaacgacggcgaggtggtgctcgacatcatccaccggctgcaggccacccaggcgcccgacctggcctgccggtggaactgcaaggccggcaagtgcggctcctgctcgatggagatcaacggcatgccgcgactgggctgcatgacccggatgtccaccttcaccgccgacgagatgatcacggtcaccccgctgcggaccttcccggtgatccgggacctggtcaccgacgtctcgttcaactacgcgaaagcgcgcgagaccccggcgttcgccccaccggccggcgtcgcccccgggcagtaccggatgcagcagatcgacgtggaacgcagccaggaattccgcaagtgcatcgagtgctacctctgccagaacacctgccacgtggtccgcgaccacgaggagaacaaggaggccttctccggcccccggttcttcatccgcgccgccgaactggacatgcatccactggacgaccgcaccgaccgtaagcagtatgcgcagcagagccagggcctgggcttctgcaacatcaccaagtgctgcaccgaggtctgcccggaacacatcaagatcaccgacaacgccatcatcccgatgaaggagcgagtcgtggaccgccgctacgacccgctggtccgcctcggccgcagaatcttccgccgcgaccagctggaggccaccgccggatcacccctgcccgcaccgcgccgcgccccggccaccgccgagaccccgtccggccagcgcctccccgagggcccgccggtcggcgtcgacggacgcctggagatcgccgaactcgcggcgccgctgcagggcgggctctccccgttcggcgaggacatgacgtttccgctgccgctggagcgggtcacctaccaccatccggaggaagacccggcaaaacccgattag

SEQ ID NO: 3629 - DNA, 1890 bp, Actinoplanes utahensis
atgaccaccacccccgaacgccatctgtacgacgtcgtggtgatcggcgccggcggtgccggcctgcgcgccgcgatcgaggcccggctggccggcaagcggaccgcgatcatctccaagtcgctgttcggcaaggcgcacacggtgatggccgagggcggcgccgcggccgcgatgggcaacgtgaacagccgggacaactggatggtgcacttccgggacaccatgcgcggcggcaagttcctgaacaacttccggatggccgagctgcacgccaaggaggcgccggagcggatctgggagctggagacgtacggcgcgctcttcgatcgcaccaaggacggcaggatctcgcagcgcaacttcggcggtcacgagtatccccggctcgcccacgtcggcgaccgcaccggcctggagctgatccgcaccctgcaacagaagatcgtctccctgcagcaggaggacttcgccgagaccggcagctacgactcccggatccgggtgttccaggagaccacgatcaccgagctgctgctcgacggcgaccgggtcgccggcgcgttcggctactaccgcgactccggcgatctgctgctgttcgaggcgcccgcggtggtgctcgccaccggcggtgtcggccgcagctacaaggtcacctcgaactcctgggagtacaccggcgacggccacgccctcgccctgcgggccggcgccaccctgatcaacatggagtttctgcagttccacccgaccggcatggtgtggccgccgagcgtgaaaggcatcctggtcaccgagtcggtccgcggcgacggcggggtgctgcgcaactccgagggcaagcggttcatgttcgactacgtccccgacgtcttccgcaagcagtacgcggagaccgaggacgaggccgaccggtggtacgacgacccggacaacaaccgccggccacccgagctgctgccccgcgacgaggtcgcccgggcgatcaacagcgaggtcaaggcgggccgcggcagcccggccggcggtgtcttcctggacgtctccacccggctgccggccgagcagatcatcaagcggttgccgtcgatgcaccaccagttcaaggagctggccgacgtcgacatcaccaaggagccgatggaggtcgggccgacctgccactacgtgatgggcggggtcgaggtggacccggacaccggggccgcggccggcaccgtgctcgggctgttcgcggccggcgaggtgtccggcggcatgcacggctccaaccggctcggcggcaactccctctccgacctgctggtcttcggcaaacgcgccggtgagcacgcggcggcctatgtggacacgctggccaagcggccccggccggcccgggtcgacgtggccgcagccaccgaggtggcgctcgccccgctggtccgcaccgacggggagaacccgtaccgactgcagcaggacctgcaggcggtgatgggtgacctggtcggcatcatccgccgcgagggcgagctgaccgaggcgctcaaacgcctgcacgagctgcgcgcccgggtggcgaacgtgggcgcgggaggcggcgggcggcactacaaccccggctggcacctggccctcgacctgcgcaacatgctcatcgtctcggagtgcacggccaaggcggcactggaacgcgaggagtcgcgcggcggccacacccgcgaggaccacccgcagatgagcgcgcagtggcgccggatcaacctggtctgctcgctcgacgaggccggcgaggtgcacctggaacgcaagccggtgcccaccatgcgccccgagctgcgggacctgttcgagcgcagtgagctcgccaaatacatgaccgacgaggagctgggggacgagtga

SEQ ID NO: 3630 - DNA, 792 bp, Actinoplanes utahensis
atgacgacgacggcagcgaggccgggcggcgggcgcgcacgcgcggcgatcacggcccggacacttcggaccgaccgctggtggctggcgccactggtcacgttcctcgggctgaccgcctgggtggcgtatgcgacggtccgggtcttcctgcaccgctggttctacgtcgacgagtatcactacctgaccccgttctactccccctgcctgaccgaccggtgcggggccgcggccgagttcggcactcccctgccgagcttctggctgatcccggaggcggccctcaccctgccgttcctgctgctcttccggctcacctgctactactaccggaaggcgtactaccgcgccttctggatgtcaccgccggcctgcgcggtgccggacgggcacaagacgtactccggcgagacccggttcccgctggtcttccagaacgcgcaccggtacgcgttctacgccgcgttcctgatctcgatcatcaacacctgggacgcgatccgggcccagaccaccggcctcggcctgggcaatctggtcctctgggtcaacgtgatcatgctctgggcgtacaccgcctcctgccattcctgccggcacatcgtcggcggccggctcaagcacttctccagacacccggtgcgctatcgactgtggacgaccgtgtccaagctcaacgcccggcacatgcagctcgcctggatcaccctcggcaccctggcggtgaccgatttctacatcatggcggtctccgccggctggttctccgacctgcggctgatcggctag

SEQ ID NO: 3631 - DNA, 1434 bp, Actinoplanes utahensis
atgagttcggagttgcagatcgccgccaaggtcgtcgagctggtccgggagctcgccggccggtcggccgaggccgaggtcaacgtccggcaccacgccctggcgctgacccggttcgccaactcggcgatccaccagaacgtggccgagaccaccaccggggtgcgcctgcggctgcacctggacggccggacggcgtccggctcgaccaccctgaccggcgcggacgggttgcgggcgctggtcgagcggaccgtggcggcggcccgggtgaccccgcccgacccgggctgggccgggctgacccggcccgcggcgctgcacatctcggccggccacccgggctccggggagcactccgggctggagttcggcttcgacgaggcgaccgcccgggccaccccggcggaacgggccgagcgggtgcgggccttcgtcgacgcggccggcgggctggagacggccggcttctgccgcacgcagtacgtgtcggccgcgttcgccaacaccgccgggcaggcggtcgaggggcgcaccgcggaggcggcgatggacggcatcgcgcgcaacaacggggccgacggcgtcgcccggctggcggccgcccggctgagtgatctggacggcgcggcgctcggcgcccgggccacggccaaggcccgcgcgctcgccgagccggccgagctcccgcccgggcagtacgaggtggtgctggagcccaccgccaccgccgacctgctggagaatctggcggtcttcgggttcaacgggaagtcgtatgcgcagcggcagtcgttcgccgagttcggcgccgagcagttcgacccctcggtgaccatcgtggacgacccgctgggcagccgcggcgagccggcccccggcctgcccttcgacgacgagggcaccccggcccgctcggtggtgctggtccgcgaggggatcaccctggcggtggcccacgaccggacgtccgcggccgaggccggcgccgagtcgaccgggcacgcgtcggggacctcccggtcgtgggggccgttcccggcgcacctgcggctggaggcggcgctgcccgggggcggcggcacaccggacggtcccccgcaggtggccgtgtcggcccgcccgctggtcgcccggatgcgtcgcggcctgctggtcaccgacctgtggtacacccgggtactggacccgaaaacgctggtggtgaccggcctgacccgcaacggcgtgtggctggtggaggacggcgagatcacccgcccggtgagcaacctgcgcttcacccagtcctacccgcaggcgctggggccgggccgggtgctgggcatcggcgccgagtcggtgctgttgcccacctcctggggtgacgcgcggtatgcgtcgccggccctgcacctggcgtcgtggaacgtcaccggcaacgcgtcgggatga

SEQ ID NO: 3632 - DNA, 1131 bp, Actinoplanes utahensis
atgccggccgccgcggtcaccgcgagctgggccagcgactgccggatcgacccgctgtcggtgccgctggccgacaagggcgacctgctggtccgggccaccgccgcggccaaggcggcgggcgccgaccaggcccaggcgaactacgcgatctgggacacccgcaagtggttcgtctccagcgagggccaccgtatcgaccagcacatccgcgagtgcggcggcggggtgaccgcgcacgccatcggcgacggcgaggtccagcgccgctcgctgcccgggcagtacggcacgcgcggctgggagctgatcgaggagctggatctggcgggcaacgcgccgcggctggcccaggaggcccgcgagctgctcaccgccccgctctgcccggccggcgagaccaccctgatcctcggcggctcgcagctcgccctgcagatccacgagtcggtggggcacgccatcgagctggaccggatcctcggctgggaggccgccttcgccggcaccagctggctggatctgagccggctcggcgagctgcggtacggatcggacctgatgaacatcaccatcgaccccaccttcccgggctcgctgggcagtttcggcttcgacgacgagggcaccccggcggtcaaacggcacgcggtccgcgacggcgtctgggtcggcgtgctcgccgggcgcgactcggcggcggtcgccgggctggactacgccggcagtgtccgctccgacggctgggcccggctgccgatggtccggatgaccaacgtcggcctggagcccggcccgcacaccctcgacgagatcatcgcggccaccgacgacggcgtgttcatggacgtcaaccggtcctggtcgatcgacgaccgccgactgaacttccagttcggctgcgagatcggctacgagatcaagaacgggcggcggggtcggatgctgcgcaacccgacctacaccgggatcggcccccggttctggcagtcgatggacatgctgtcctccgagatcgtcgcctggggcacgccgaactgcggcaagggccagcccggccagatcgggcacaccggacacccggcggcgccggcccggttcaccaacgtgcgggtgggggtgcgcggatga

SEQ ID NO: 3633 - DNA, 219 bp, Actinoplanes utahensis
atgagccacttcgatgaggcgggcgcggcggtgcaagccgcgctcgacgccggcgcccgctatgcggacgcccgtgtcatggtctgccgcaccgagtcgatgacggcccgcaacggcgccgtcgaggacctctcctccgacgagaacgccggcctgggcgtgcgtgccctggtcggctcgagttggggcttctccgccgttcccgatctctccgactag

SEQ ID NO: 3634 - DNA, 1815 bp, Actinoplanes utahensis
atgctgaggggcgtggactaccccggactcgccgggcgcaccggtggcttccgccacggcgccccgcacgccgtcacggtcggcgccgacggggcgcggatcgtcttcctgcgctcgcccggccccgcggatccggcggccgcgctctgggcgctggacctggccgacaccacggaacggctggtggcgccggggccgatcgacgcgtacgcgatcgatcgcgacgcccgggtggcggccttcgcccgcggcggccggctctaccgcgccgacctgacgaccggcgcggtgaccgcgctgcagaccaccgaggcggtgtacgacccgcggcccgacccgcagggcgtgcggatcggctacgtcaccgatccgctggggtcggccacgctgcgggtcaccggcccggacggcgaccggctgctcgccggggagcagggcttcgcgtggcgcgagcacggcggcagcatcgcctggggggtggccggggccggcgcgccccagttcggccggacccggggctggtggtggtcgccggacggccgccaggtgctggccgtgcgcaccgccggcgggaccagcctgcacctgctcgacctggacgacggctgggtggacgtgcactgggaccgggagacctacccgcacctggcccaggtccgctgggccggcggcggcccgctgatcaccgtgctgcgccggatgcagcagcacggcctggtgctctcggtcgacccgcgcaccggggagacccaggtgcacgccgaactcgccgacgcccgctgggtggagccgatcccgggcacgccccggcacctgccggacggccgggtgctggtcggcggcgaactggcgcacgacggcttcgacgcgcgctgcctgttcgccgacggcagcctgctcaccccgcccggcctgtacgtccgccgggtggccggtaccctgccccgcccggacggcccggccggcgcgccggacctgatcgtcgagggcagtctgggcgaccccgcggtccgcgaggtgttccgggtgcgcacctcggtgggcggcggcggaccggaggtgacccggctggccccggccggcggcgaggtggtcaccggcggggacgtgctggtcgccggcggccgggtgtggcaggggacgaccccggccgggaccctgcggtcgctcgccgccgagctgccctaccacccggagccggtcctcgaacgggtcaccgaccggcggctgccgacggccgtgctctatccgggcggtttcgtcggcggcagcctgccggtcctgctcgacctgggcgccgggccgggcgagcagcaggtgcgcgccgaggcggccgcctggcaggaacggcagtggtgggccgacgccggcttcgccgtggtcagcatcgactaccgggggacgccgggggtggcccccagcttcgagaaggcgatccaccggcggctggccgacctgatcctcgccgacctggccgacgggctgggcgcgctcaccggcaaacatcccgacctggacctgacccgggtcgcggcccgcgggcaccggctgggcgggtgggtggcgctgctggccgcgctgcgcctgcccgggacggtccgctgcgcggcggcccgggagccggtgctggactggacggcggcgccccggccgatcgccgagcggtatctgggcgacccgaacgacgcggcgcacgtctaccggcaccacgacctgcgcgacgagatggccggggccggtgcggtgctggtggccgacgccggcctcgggctggccgacgaactcgcctggatccagcgggaactgggcacctga

SEQ ID NO: 3635 - DNA, 909 bp, Actinoplanes utahensis
gtggtcgcgcgtacagtatcggccgtgatcgcacgtgattcgctgcccgcgcgccgcctgctgctggtgcacgcccaccccgacgacgaggtgatcgggaccggcgccaccatggcccactacgcctccaccggtgcccacgtgacgctggtgacctgcaccctcggcgaggagggcgagatccacgtcccggagctggcccaactggccgccggtcaggccgaccagctcggcggttggcgcctggtcgagtgggagcgggcctgcgacgcgctcggtgtcgccgaccgccggatgctcggcggccccgggcggtatcgggactccgggatgatgggtctggcgaccaacggtcatccgcgcgcgttctggggcgccgacctggacgaggccgcggcgcacctggtcgaggtgatgcgggagatccggccccaggtcatgatcacttatgacgagaacggcttctacggtcaccccgaccacatccaggcgcaccgggtcgcgatgcgcgccgccgagctggccggcgccgacggcccggcgaagatctactggacggcccagccgctgagcgtgctgcgcgacggcatggaggcgttccgcgagtcggagagcaatccgttcgccgacgtggacagtgtcgaggatctgccgttcggcacgccggacgaggagatcgccgcccggatcgacggcaccgagcactacgcccgcaagaccgccgcgatgcgcgcccacgccacccagatcccggacaactcctggctgtacgggatggccggcgacttcggcggcgagttcatgggtgtggagtactacacgctggtcaagggcgagcggggcccgggcgggggcccgcacaggtgggagagcgacctgttcgccggcctcgacgtggccggcgaatga

SEQ ID NO: 3636 - DNA, 489 bp, Actinoplanes utahensis
gtgggagagcgacctgttcgccggcctcgacgtggccggcgaatgacgctccgggtcaccggcgtcgtcgtctcggtcgccgccaccctggtcgtcaccgtgatcgagctggtgctcagcgtgctccgggtcggtggggtgaccgggctgttccacggcgagttcgacgtgtggaccggcaccggccagctgatcgggctcgccatcccggtcaccgtcgcggccaacctggcgctggcctggttcgccgtcaccacggtcgagcggccctgggcgatcggcgtgccgtgggcgctgtggacactgctggtgctcggcgcggccggcacccggaccgccgagggcgactatctgctcggcggggacaactgggtggcactggtgatgatcctggccggcagtctggcgttcgcggtctacgcgtaccggatgatcatgaagccggtgaaggagccggtgcggccggagagcgaaccgactgacagctga

SEQ ID NO: 3637 - DNA, 468 bp, Actinoplanes utahensis
atgaggcagcagcgctggttccggatcacggtgctggcgatcgccctgttcgcgatcaacgcggtgacccggctcgtcgtccggttcggcgccgacggcacggacaccgcgcagaaccgcggctcgatcgtgatgttcgcggcgctcgcggtcctgctgggcggcctggtcttcgtctggtgccagcgccggcggccgagcgactggctgcccgacgtcggcttcggcgcgctggccggcatgctcctcaccgtcctgctcggcccgttcctgagcggcagtgagccgttcgccaacggcggcggcgacttcttcgcccagatctggctctacagcggctgcgcgatcgccggcgcggtggtcggctactgggtcgccgtgaccctggccagggactaccgctcccgctccctgcaggcgtacagccggcagcgcacggtcaagccgcgccgggtcgtccgccgctga

SEQ ID NO: 3638 - DNA, 963 bp, Actinoplanes utahensis
gtgctccgacagcaggatgtgggacaccgggtggtggtacggcgcattgtaggcgtatccggggatcggccgctgtacacggatgcgctgggtgagctcgtcgacctgaccgagaccgagatcacactcgccaccgacaagggaaccctgcgcgtcccgctgcgcgaagtacaccgggccaagcgggtgccgccggcccgtcggccgcacgccgccgcggtgatcgccctggaactcgccgccgacgcggcgtggccggcaccggtccgcggccggctgggcaactggctgctgcgcgcggcggacaactggaccggccgggccaactcggcgctcgccgtcggcgacccggaccggccgctggaggccgcgatcgacgcggtcgagcagtggtactccgaccgcggccagcgcccgctgatcaacacgccgttgccgctggccgccccggtcaccgcgatgctggacgaacgcggctggggcagccggccgctgaccctggtgcagaccgcggcgctggcgcccatcctggccgccccggcgggggacggcctgccgccggtcgggctggccgactcggccggcgacgactggtacgcgatggtggccgagcacaagggccggttgcccgaggccgcgctgcggatcctcaacggcgtgccggaccgggtcttcgcccacgtccgggacgccgacggggaactgctcgcggtggcccggggcgcggtcaccggaccggagcgctggctcggcgtgtcgctggtgcagacggcgccggccgcccgccggcggggcctggggcggcacgtggtgcgcgggctcgcccagtgggccgtgcagcgcggcgcgacccgggcgtacctgcaggtggaggagcggaacacggccgcggtggcgttgtacggccggctcggcttcagcacccatcacacctatctgacccgggaggcgccggccgcctga

SEQ ID NO: 3639 - DNA, 1230 bp, Actinoplanes utahensis
gtggaaggactacaccagcgcgaactacgagttcttcgaggatctcggttcgcccggtggcgcctccaaggtcggcaagatcgacaaggacaccccgttcgtgctggcccagccgccgcgcggggacgcacactgagcgctctggcgtcggctcttccggatttcccctgggacctgctggagccggccaagagccgcgccgccgcccacccgggcggactcgtggatctgtcgatcggcaccccggtcgacccggtcccgcaggtcatccggcaggcgttgaccgacgccgcggacaccccgggctacccgctgaccgccggcacgccgcagttgcgcgccgcgatcgccggctggctggcccgggcctgcggcgcctccggtgagctgggcgtgctgcccaccatcggctccaaggagctggtcgcctggctgcccacgctgctcggcgtgggccccggcgacgcggtggtgatcccgcaggtctgctacccgacctacgaggtgggcgtccggctggccggcgccgaggtgatccgctccgactcgctcaccgcggccggcccgcggcgggtgaaactggtctggatcaactcgccgtccaacccgaccggccgggtcctgcccgtcgaccacctgcgcaaggtggtcgcctgggcccgcgagcgcggtgcggtggtggccagcgacgagtgctaccacgcgctgggctgggagtccgagccggtgtcggtgctggccgacgaggtgaccggcggcgactacaccggtgtgctggccgtccactcgctctccaagcggtccaacctggccggctaccggggcgggttcgtcggcggtgatccggccctggtggccgacctgctcgcggtgcgcaagcacgccggcatgattccgccggccccggtgcaggccgccatggtcgccgcgctcaccgacgaggagcacgtggtcgtccagcgggagcgttacgcggcacgccgggagatcctgcgggccgccctgctcaaggccggtttcgagatcacccattcggaggccgggctctacctgtgggtcacccgcggcgaggactgctggcagaccgtcgaccgcctggccggcctcggcatcctggtcgcgccgggcgcgttctacggcccgtccgccgcccagcatgtgcgggtcgcgctgaccggcaccgacgaacgggtggccacggccgccgaccggctcgccgagggtctctga

SEQ ID NO: 3640 - DNA, 642 bp, Actinoplanes utahensis
atggccgagcgcctcccgaccgtcgtcgccaccggcgaggcggtccgggaggtgccaccggagctggccaccgtgcacgttcacacggtggccagaggacgcgaccgcgaagcggtcctgcagcggctcaccgaacggtcggcggccgtggcggtggtcctcgaccggttcgccgccgccatcgaacgccgggagaccgccggcgttcaggtccacccgcagaccaggcggcgcggcgagggcatcgccgagtatcacggcagcatcggcacccaggtgctgatcaccgacttcaccgtcctcggcgacctgctcctccggctcgccggcgaggagctgacctcggtctccgggccgtactggcagctgcgcccgggcagccgggccggagccgaggcccgccgggcggcggtcaccgacgcgctggcccgagccgcggagtacgccgcggccgtcggctcccggatcgaccggctgatcgacatcagcgacgtcccgacggccgagggaacgccgatgatggtcgccggagcccgggccatgagcgagacggccggcctggagttggagccggcgttgcagaccgtgcacgcccgggtccgggtcaccgtcacgatcagcgagccggccctgccgatctga

SEQ ID NO: 3641 - DNA, 1287 bp, Actinoplanes utahensis
gtgttccgggcacgcggcacgccccggtcggccagactcgaccgcatgcgcaccggcctcgggcatctgctgctgcgggtggcgaatgtgaatccgcgcagcgtgacgacccactcggaccgcgtcctgtaccgctcgatcggcgtcttcatcctgctctacgcggtgtacgccaccctcggcggcgccgcgttcatcgacgccggcagcggctatcggcatccctggttccagtggctggtcggtccgctcgtcgcgatcggtgtggtggcctacgaccgggcggtcgtcggccgggtcccgatcagcttcgaccagctggactccaccgacccggagcatctgctacgccgcccccacctcggtctgtatctgggccggatcgccctcgcgctgctgttcgccctgctggtgaccgagccgctgatgctcgcccggtaccgcggcgagatcgacgcccggctcgccgagacgcacagcgcgcagctgggccggctcgacgcgggcggcgcggtggccgactaccgggcccggctcaccgagctgcgctcggacaccgagaacgacgacgcggcggtccgcgccctcgccgaccgggctgccgggaagcgccgcgacgcccgcgacacgtaccgccaggcgctcgccgactcggccggctccggtgtcacccacagccccggctgcccgcgcaagggtttctgcgaccatctggtccatcgctcccggtctctcgacgagcaggccgcggcgctcgatcggcaggccgccggcctgcagcgcgaccagcgtccggagcgcgcggcccgggccgccgagcagtcccggctcaccgcgctgctcgacgccgagcggacggcgaacgccgacgccgtccgcggcgatgccggtttcggcgcgcggaccgccgcgatgtggcacctggtccgcgcggacttctggggcgtcggcgtgtactacctggggatcgcgctgctgatggtggcactggactgcgccgcgatcgggctgaagttcgcctcccgcgggaacgcctacgagcgcaacgaggcgcgggcggggcggttgtgggagcacgaggcagcgctgatcttcgagcgcgaggtgcacgacgcgcggacctacggggacgcgaccgcgaaggtgatcgccgacggcatcgaggcggcgagcagggatgtggagatcgctcaggcggcgacgcgtcgcgcgcgggcggtgctgcacagcgcggtcatcgtcgacccgtccgacatcgaacacttccgccccagggccgacgcctga

SEQ ID NO: 3642 - DNA, 1131 bp, Actinoplanes utahensis
gtggcggatcgccggcgtcggcgggcgtgtttcggggtggcggatcgccggcgtcggcggcgtgtttcggggtggcggatcgccggcgtcggcgggcgtgtttcggggtggcggatcccggtcattcattcgggcatgaccaggatttcggtagtgaccggcgcgagtggtggcatcgggcgggcggtcgcccggcggctggcggcccggggtgacaccgtcgccctgctggcccgcggcgaggaaggactcgaaggggcggccgaggacgtccggcgagccggcggcaaagcgctgaccatccccgtggacgtggccgactaccaggccgtcgacgccgccgcggaacgcgtggagaaggaactcgggccgatcgggctgtgggtgaacgacgcgttctccagcgtgttcgcgccgttcgtcgaaatcgagatgccggagttcgtgcggaccaccgaggtgagctacctggggtacgtgtacggcacccgggccgcgctgtcccggatgcgcacccgagaccagggtgtgatcgtgcaggtcgggtcggcgctggcctaccgggggatcccgctgcagagcgcctactgcggcgccaagcacgccatccagggcttcaccgagtcgctgcgggtcgaactgctgcacgagaagagcaacgtgcacgtcaccatggtgcagatgccggcggtgaacacgccgcagttcggctgggtgctgtcccggctgccgcgcaaggcacagccggtaccgccgatctatcagccggaggtggcggcgcgggccgtcgaatacgcggccgaccacccgaagcggcgcgaatactgggtgggcggatcgaccgcgctgaccctcgcggcgaacgcggtggcgcccggcatcctcgaccggtacctggcccggaccgggttcaagggccagcagactgaccagaaacggtcaccggatcagccggtgaacctgtgggaaccggccgacgagaaccgggacgcgggggcgcacggggccttcgacgaccgctccagcgaccgcagcgcccagctgtgggcctcccagcaccacgggctgctcgccgcggtcggcggtggcctcctggccgccggcgccgcctgggccctgggccgccgctga

SEQ ID NO: 3643 - DNA, 600 bp, Actinoplanes utahensis
atgatccggcgggacgtgctgacgtcgcaggggggcaccccaccggaggggcggatcgaactgtccgccgcggacaccgaggaaccgacctgggaggtccgggcaccgcggaaacggcgcttcgaccggcgatcccggaccattctgggggtggccgcgctcgccgcgatcctcgccaacgccggggcggcctgggcgtactggaagatcacgcagccccgccaggtggccggagcggggccggtcgtggtcgacatggtgctgcgcgggcgcaccgacctcaaccagatcctgcggcccggcaccaccgggaacctgatggtgaccgtcaccaacgacaagaccgtgccgatccggatcacctcgatcacggtcggcccgggcgccgtgctcgccgacccggaccaccgtggggccggctgcaccggcgtcgcggtgcaggtgaaccaggcggcgttccgggtctcctgggaggtggcgcggaacacgatcggcgccttcaccctcgacgacgcgctgaccatgccgcgtgacgtgccgaaagcctgcgccggggcgacgttcacggtgccgctgcgggcgaagggcgtgcagcgctga

SEQ ID NO: 3644 - DNA, 615 bp, Actinoplanes utahensis
atgaggcgccggaccgcgctcgccctgatggcgaccatcgtgggtggggcgatcgcggccggtagtgggctgaccgcctgggccacctgggcggtcagcgccacgccggccaccggcacggtccgcgccgaacggatgccggtggtgcgcaacctgaccgtcatgttcaccggcggaaagctgaccttcgcctgggaccgcaccaccttcgcctccggggcagcggtcggcggctaccgggtctacgcctccggcggatccgtcccggtctgctcgaccacggcgctgagctgtggattcgccccgcagggcaagccgcagggcacgttcgtggtgcgggcctgggccggcgggtgggtcggcgacgacagtgcgcccgtcacgtacgtaccgggcaagaagaccgtgaccggcgccgccggggtagccgcgcagcctccggtgaccggcgggacacccggcgctccggcgccgcaggcgacggccgaagcggccgcgaccacctcgccggccgccgccccggtggcgaaggcaccggcgacggccccggacagcagtgccccggtagcggccggcacgcccgcgacggtcgagtcggcggcctcgccgcaatag

SEQ ID NO: 3645 - DNA, 489 bp, Actinoplanes utahensis
atgcggcctgagcggatccggagtctgccgttccggaacggcagactccgcagcgggcagtggtgggcggcggccgccggggtggtgttcgtctgcgccggggtggcggccgcggtgcgggcacccgagccggaaccggtctcccgggacactcccgtcttcgggatccgggccgactcggtgagcgggctctaccccggggccgtccggcgcagccgggtgaccctgctcaacccctatccctatccgatcgtcgtccggtcggtcgacgcgcaggtcgcatcgacctcccggcgccggtgccgggcgtcggcccggaacctgcgggtcgaacggttccacgggcggctgccggtgaccgtcccggcccggggacgagccgtcgccggagaattcgaggtccacatgcccggaacggtcgacgacgcctgccggcgggcgaccttccggctgaccgtcaccggcaccgcgaggacggtgggccgatga

SEQ ID NO: 3646 - DNA, 495 bp, Actinoplanes utahensis
ttgttcggatcatcgctgcgggccaggcccgtgatcgtcgtcgcggtcgtcgccgggctgatcgtcaccggcggcgtggcctgggcgcagtggcgcctgtccgggtccgggaaggcgagcgccaccgcggggacggtcaccaaccttcagatgacggcgcagcccctgccgaatgcgccgctgtaccccgggaagcggaccgcgctgtcggtcaccgtgcacaacggcaacagcttcccggtgctggtcaccctcatccaggcgggctccgggccggtgacggcagacgccgcgcaccggaccgccggatgcctcaccaccggcgtctcgctgatcacgccggcgctggcggtgtcctggccgatcccggccagggcggacgagacattccgggtgtcgaacgcggtcacgatgaccaacgcgtcggactcggcgtgccgtggggcgacgttcaccatcccgctcgccgcgaccggacgcagcaatgcggcctga

SEQ ID NO: 3647 - DNA, 495 bp, Actinoplanes utahensis
atgcgcaagatgaccaagcgttccgccgttgtcgcctccgccgtcgccgtggcggtcgtcggagccggagccgcctgggccgcctggaccctgaccggcaccggctcggcgacggcccgcgccggcgacgttcagaccctgaccgtttccggggtgtcgtccactccgctggttccgggcggcaatgccgacgtcaaattccacgtcgtcaatccgaacgccttcccggtgttgatcaacggcatccacttctcgaacatcacggcatctggcgactgcaacgccggcagcgtgaccgcggtcagcaccgcgccgctgcccaccgctgctggcgctcttgagctcgccgcgaaagataccgtcgggggcggcgacaagaaggacatcacctacgccgggtcgctgcacatgagcaacgccgcgaccgacgactgcgtaggcgcgacgttcacgttcgacgtgctcctggacgccaagagcaacgcggcagcctga

SEQ ID NO: 3648 - DNA, 804 bp, Actinoplanes utahensis
gtgaacgctgagaccatcgcgactttgagcgcacgctctggttaccgtcggcgtgtgcgcagcagcccgccggatgacgacctcaacaccgcggcggccggctcgtccctgaccgggtgggagttcgcctggctggacgggctggccgtcgcggccgagccgtcctggtcgtacgtggagatcgcccgcccgctggtgcgcccggcccgcagcctgctcgacctggacaccggcggcggcgagctgctggccgagctggcccccctgccggcgtgcacggtggcggtggagagctgggcccgcaacaccccgatcgcccgggagcggctcgccccgttcggcgtcgaggtcctcaccgagctgccggccggcgaggacgagttcgacgtggtgctcagccgccatggccggctgccggccgcggacatcgcccgcctgctcaagccgggcggtgtgctgctcacccagcaggtcggcagcgacgacctggccgagctgaacgacgcgctcggcgccccgccgccacacccgcgccggtgggacgccgaggtcgcggcggccgccctgaccgcggccgggctgcgggtcaccgacgtgcgcgaggagcatccggcactcgccttccgcgacatccgggcggtggtccaccatctgcgcaccgtcccgtggcaggtgcgcaacttcagcccgcagcgatacgagcgcgagctcgcccgcctgaccgcggtcatccgggcccgcggcgagttcaccgcgcgggcgcaccggttcctgctccaagctcagcggccgacagaagcatag

SEQ ID NO: 3649 - DNA, 1041 bp, Actinoplanes utahensis
atgcggacgatcggtgcggcggcccgggccagcggcctgacggtcagcgccctgcggttctacgacagcgcgggcgtgctggtcccggccgtggtcgacccggacaccggctaccggcggtactcggccgagcagatccgggcggcccggctgatcgccgggctgcgccgggtcgggatgccggtcgccgagatcagccgggcggtggccgacctcgggcacccggaccgggtacgtgatcggctggacgcccacctggcccgcctggaggccggcctggccgacgcccgcaccgaactcctccgcctgcacaccctgctcgacctggaggagcacctgatgacccgcatcaccctgtccgccgccgacctgcgggccacgctggccgcggtccggttcgccaccaccgacccgatccccggcaccccgttccccgggggagtcctgctggaggcggccgacggcacgctgaccctggtcgccaccgaccgctaccggctcgcggtcgccgcgaccccggccgccgtcgagggctcaccggcccgccactatctgccgctggacttcgtcgaccggctgctggggctcaccaccggcaccgtcaccctcgacgtcgacgacgactcgctgcgggccacggccggcgatctcgacctgcgggccgccccggtggcggccgacttcccggattaccgccggctcgttcccgggcccggtcgccggatcggcgtcgaccccgccgagctgcgcgagctgctggccgacgcgccggaggtgcaccgggagcacgacggcgccacctacccggtgacgatcctggccgaggacccggacggtggcctgcgtctggccgccgagtcggagtggtccaccgacgccgggcggcacgtggcggtgaaccgcgagttcctgctccaggcggccgacgcgggcggccccggccagctgctgctggagctggacgggccggtccgaccgctgatcattcgcagtgccgccgatgaatcccgtttctccctgctcatgccggtccgcggctga

SEQ ID NO: 3650 - DNA, 603 bp, Actinoplanes utahensis
gtgctcacctccgccgtggccggctttgccgcttccgccgtgctgatcatcgcgatcggcgcccagaacgccttcgtcctgcgccagggcctgcgccgggaacacgtcctgccgatcgtcctgacctgcgccctctccgacgtcctgctgatctccgcgggcatcgcgggcctgggcgcgatcatcgccgcgcagccgcgactggtctccgcgatccgctggatcggcgcgatcttcctgctggcgtacgcggttctcgccgcccgccgggcgctgcgccccaccggcagcctcgatccgaccggccgcgcccccgccaccctgcgcgccacgctgctcacctgtctggccttcacctacctgaacccgcacgtctacctggacaccgtgctgctgctcggctcggtggcccagcagcacgcgcaccgctggtggttcggggtgggcgccgcgctggccagcctgacctggttcaccgccctcggcctgggcgcccgccgcctcgccccgctgctggcccgcccgaacgcctggcgggtcctggacggcgcgatagctctggtcatggcggccctcggcggcacactgttgctccaggcttga

SEQ ID NO: 3651 - DNA, 828 bp, Actinoplanes utahensis
gtggaccaggtacagctgcagaccttccaggccgtggtggagcagggctcgttcgaggcggccgcgcgggtgctgcacgtcaccccatcggcggtcagccaacggatcaaggcactcgaacgggccgtcgggcaggtgctggtgcgacgggccaaaccgtgcacggccaccgaggccggccaggcgctggtccggttcgccggacaggtggccctgctggaacgggaggcgctggcgcaggcgcgcggcgggacccgggtgtcgatcgtggtgaacgccgactcgctgaacacctggttcatgccggtgctcacccgggtgccgggcgcgaccttcgagatacacaccgacgaccaggactacaccgccgacctgctgcggtccgggacggtgatggcggcggtcaccgcggagaacgtggcggtccagggctgccgggtcgaggagctcggcgcgatgcggtatctcgcggtggcggcgcccggcgtggacttcgcgaccgctccgatgatcatctacaaccggaaggaccggctgcagcaccggttcctggaactggccgggctgacgccgcgcgatccggtggtccactacgtgccggcggcggcggccttcaacgaggcgatccggctggggctgggctggggaacggtgccggagcagaacgcccgggccctgctggactccggagaatacgtccagatgtttccggacaggttcctggatgtgccgttgtactggcagtactggcgcatcgagtcggctttgctgaacacgctgacggccgccgttcgcgaggcggccgtcagctcactgcgtaccggatga

SEQ ID NO: 3652 - DNA, 1092 bp, Actinoplanes utahensis
atgtcgaccagggcacgggtcaactcgaccgggtcgaccagcacgtccggggtcagcgggttggccatgtgcgcaccatacaaggccgtcccgagcaccggacgcacccgatcaggggcctccccgcctagtagggttcatgccgtggataccgcgatctcgacttcgcccgcgtggggcatcggcctggccaccgtgaccgccgacgggcaggtgctggacacctggttcccggccggtttcctgggtctgggtgaggagccggccgaggcgccggcgctgccggccgggctgaccggccccaagctgctgcccggcctggccacggtcgaggtccgcgccacggtcaagtcgctggccgagccgatcgccgacaccgccgaggcctacctgcggttgcacctgctctcgcaccgcctgatccggccgaacgagctgaatctggacggcatcttcggcctgctggccaacgtcgcctggacctcggccggcccgtgcccgccggaccgggtcgacgagctgcgcttcctggagcgggccgccggccggcacctggccgtctacggcatcgacaagttcccgcggatgaccgattacgtgtcgccgagcggggtccggatcgccgacgcggaccgggtccggctgggcgcgcacctggcgccgggcaccacgatcatgcaggagggattcgtcaacttcaacgccggcacgctgggcacctcgatggtggagggtcgcatcgtgcagggcgtggtggtgggtgacgggtccgacatcggcggtggttcgtcgatcatgggcaccctgtccggcggcggcaaggagaaggtccggatcggcgagcgcagcctgctcggggcgaacgcgggcgtcggcatctcgctgggcgacgactgcgtggtcgaggccggcgtctacatcaccgcctcgtcgaaggtgtcgctgccggacggccgtgtggtgaaggccatcgagctgtccggtgtgagcaatctcctgttctggcgcaactcggtctccggcgccctggaggcccgcccgcgcaagggcaccggcatcgagctgaacagcgctctgcacgccaacgattga

SEQ ID NO: 3653 - DNA, 1110 bp, Actinoplanes utahensis
gtgcgtccggtgctcgggacggccttgtatggtgcgcacatggccaacccgctgaccccggacgtgctggtcgacccggtcgagttgacccgtgccctggtcgacatcgcctccgtgtcccgcgacgagaaggtgatcgccgactgcgtgcaggacgtgctgcgcgaggccggtcacctcaccgtggaccgcgtcggcaacaccgtgctggcccgcaccgacctgggtcgcgcgcagcgcgtggtgctcgccggtcacctcgacacggtgccgatcaacggcaactttccgtccacagtcgtcgacgacctcatctacggctgcgggacggcggacatgaaatccggggtggccgtggcgctgcacctggccgccacgctgcccgacccggcgtacgacgtgacctacctgttctacgaggccgaggagatcgagcacgagttcaacgggctcaacctggtcgcggccggcaaaccggaatggctccgagccgacttcgcggtgctgctggaaccgacgtacggcgtggtcgaggccggctgccagggcaccatgcgggcgctggtgcgcacccacgggcgccgcgcacacaccgcccgggcctggcgcggggtgaacgcgatccacgcggccggcgaggtgctgcgccggctggaggcctaccacccgcggaccgtgacgatcgacggctgcacgtaccgggaagggttgaacgccgtcgggatcaccggcggcgtggccggcaacgtcgtccccgacgagtgcgcggtcgaggtcaacctgcggttcgcgccggaccggtcgcaagcacaggccctggaccacctcaacgaggtgttcgccggcttcgacctggcggtcaccgactccgcccccggggcgctgcccggcctggacgcgaccgccgcccgggaattcctcaccgcggtcggggtggcgccggccgccaagctcggctggaccgacgtggcccgcttcgcggcgctgggcatcccggcgctcaactacgggccgggcgatccgtcgctcgcccacgcgccggacgagcacgtcgagatcggccagatccgggacagcgccgcgaccctgcaccggtggctcgccggttag

SEQ ID NO: 3654 - DNA, 768 bp, Actinoplanes utahensis
atgacggagagcaccaacgagcgaccaccggccgcgccgcagcgtcatcgaggtgcggtcacgctgcgtcgggacgccgtgccaccgagcaccgccgacgagaaactgctggactcgcaccatcgcggtgagtggaagaccaaggacgcctggcgcgcgctgcgcatcctgtcggaattcgtcgagggcttcgacacgctggccgacctgccgcccgcggtcagcgtcttcggctcggcccgcagccggccggacagccccgagtgcgaactggccacccggctcggcgcggccctcgccgaggccggctacgcggtgatcaccggcggcgggccgggcgtgatggaagccgccaaccggggcgccaccgaggccggcggaatgtccgtcgggctcggcatcgaactccccttcgaacaggggctcaacgactgggtcgacatcggcatcgacttccgctacttcttcgtccgcaagaccatgttcgtcaagtacgcgcaggcgttcgtggtgctgcccggcggattcggcacgctggacgagctgttcgaggcgatcaccctggtgcagacccgcaaggtgacccggttcccggtgatcctgatgggcgtcgactactggagcggcctgctcgactggatcaagcggcggatgctcgacgacggcaagatcagcgaggccgacctgggcctgatccaggtcaccgacgacgtcaccgaggcggtccggatcatcgtggcggccggtgcggcccaggcagccgactga

SEQ ID NO: 3655 - DNA, 558 bp, Actinoplanes utahensis
atggccgcgatcggtgtcttctgcggctccgccgacaccgtcgaacaacgctggctcgacctggccgccgagaccggccgggcgctcggcgagcgcgggcacaccctggtctccggcggcggccgggtcggcatgatgggcacggtcgccgacggcgcccgggccggcggagcgcacaccctcggcgtcatcccgcagtgcctggtcgacggggaggtggccgacaccgcctcggacgagctgctggtcaccgacgacatgggtgcccggaagaatctgatgatcgagcggtcggacgcgttcctcaccctgcccggcgggctgggcacgctggacgagctgttcgaggtgtggacgacggcgacgctgcgggtgcaccgcaagccgatcgtggtgctcgacccggacggcttctacgacggtctgctgggctggctgaccgggttggtcgcgaccaggttcgtgcggcccggggcgatggagacggtgcgggtcgcccggtcggtgccggaggcgctggacgtcatcgagaccctcctggtggcgcccgcggagtga

SEQ ID NO: 3656 - DNA, 3003 bp, Actinoplanes utahensis
gtgagcacgccggccccccattccccggtgcgccggcccgactaccgcctggtccggcgtccccgcccggccgcgcccgagctgcgcgccgacccggtccagacccgggtggccgcgcacacccgcggtccgctgctggtcgtcggcggccccggcaccggcaagaccaccgcgctggtcgaggcggtcgccgcccgcatcgccgagggcgtcgacccggagcggatcctggtgctgaccttcggccgccgcggcgccgccacgctgcgcgaccggatcgaggcccgggtcgccgacgtgcccggccgcatcgtccacgagccgctggtccgcaccttccacgcctacgcgttcggcctcctgcgccgggccgccgccgagcgcggcgagccggccccgcgcctgctcaccggtcccgagcaggatctgatcatccgcgagctgctggccgtcgtcgaggacgaggacgccgccgacaccatcggctggcccgagtcgctgcgcccggccctgcccacccgggccttcgcccagcagctgcgcgacctgatgcagcgcgccgccgagcgcggcctcggcccactggagctggccggctacgccacccggctcggccgcgacgactggtcggccgccgcccgcttcctccgggaatatgtcgaggtcctctccctgcgcgacgccaccacccggggctcggtcgcctacgacccggccgagctcgtccgcgccgcctccggcctgctcaccgacgagcccgacctgctggccgccgagcgccgccgcctcgcccacgtcttcgtcgacgagctcgccgaaaccgacccggcccagatcgacctgctcgcccaggtcgccggcggcggcaaacccctggtcgccttcgccgacccggactcgtccatcttcggcttccgcggcgccgaccccgaggtggtggcacacttccccgaccgtttccgcgggccggacggctcaccggccccgacggtcgccctgcacaccaactatcgggcggcgccggccctgctcagcgcgacgtccggggtggcccggcggatgcgcgggccgatcgcccaccggccgatgttcccaccgcctccggccgccccggccccggtctccggctctgcggccccggccccggtctccggctccgccgccccgggtcccgtcgtggcggcctccgactcggcggcggttggttccggcgcggtgtcggggcctgttgtggcggtctctgagtcggcggcggttggttccggctcggtgtcggggcctgtcccggcggcctcggagccggccgcggccggctctgctccggtcgacggggtcccggccgcccgggtgccggccgcggggccgggcccggttcccgaggcggggatctcggcggacgggccggtggccggggcggtggtgcggacgttccggtcgccggcggcggagaccgcgttcatcgcgcacgcgctgcgggaggcgcatctgctctacggggtgccctggtcgcggatggccgtgctgatgcggtcggcgaccctgcagcagccgtcggtgcagcgggcgctggccgcgtccggggtgccgaccgtgatccatgccgaggatctgccgctgcacctgcagcccgcggtggcgccgttcctgctgttgctgcggtgcgcgctggatccggagcggctcgacgaggaagcggcggtcgcgctgctgcactcgccgctgggcggggccgacccgctcgccgagcggcggctgcggcaggggctgcgggcgctcgcgctggccgccggggatcggcggccctccggagagttgctggtcgacgcggtgcgcgaccccgccggtctcgacctggtggaacgccgctgggcccgcccggcacagaccatcgcccggctgctgaccgtggcccgcacggccgccgccgcgccggccgcctcggccgaggacgtgctgtggacggtgtggcgggccagcggcctggccgaccggtggtacgcgatgagcaccggcaaccgccgcccctcggacgccgcgcagtccggccgggcccgacagtggcgtgccgaggccgccgaccgtgacctcgacgccatggtggtgctcttcgacgcggccgcccggttcgtcgaccggctgcccggcgccggtgtcggcgtcttcctggagcatgtgctcggccaggatctgccggccgacaccatcgcgcccagcgccgatcggggtgacgccgtccggctgctcaccgcgcacgcggcgaaaggcctggagtgggacgtcgtggtgatcgccggcgtgcaggagggcatctggcccgacctgcggctgcgaggcagcctgctcggttcggagcgtctggtcgacgcggccgccggccggcccgcgaccggttcggaggcgatcgtggcgcagacctccgccctgctcgacgaggagcgccgcctgttctacgtggcggccacccgggcccgccgccggctggtggtcaccgcggtggcctcggcgagcagcgggggcgcggcgatcgaggagcagccgagccgcttcctgaccgagctggcggctccggggccgcgcccgggcgaccccggagccggcccgccgctgccgcccggatcgacgaacccggacgatccggggccgccgctgcctcccgagccgaccgaccccgacgatcccgggccggccgacgacgacttcccgccggatccggacaccgtgccgggcgagagcaacggggctgacggcgacgaccgcaacgcgatgcgggacggtggtgcggcccgggacggcggtgccacgcgggatgttggtacggcaggggacggtggtgccgcccgggatggtggtgcgggggagagcggtgcggcgcgggacggcgatgcggcgcagcagcacgcagcggcgccgggcggcgaagccggccaggacggttcggcggggcaggacggtgacggtgcggcggggcaggacggtgcggcggggcaggacggtgacggctag

SEQ ID NO: 3657 - DNA, 933 bp, Actinoplanes utahensis
gtggtcgcttctggagagacgcccagccgccggcgcgcagcggcggccgagctggcccgcctcgcggccgccggcgtgcccggtgcccatcccgacgagtggtggggcctgcgaccgctctccgacgaccggccgctggtcgacgacggcgagccggtcaaggtcaccccgtcggcgatggagagcgcactccgctgcagcctgcgctggctgctggaacgccacggcggcgcgcccccggccggtccggcgcagggcatcggcaacctggtgcacgccgccgcgatgctggccgaggacgcgcacgccgaccgggagaggctggtcgagtacgtgtcggcccggttcgactcgatcgagctggccgcccgctggatggccggcccggagcaggaacgcgccgaggccatggtggacaaactgctgcgctggctggccgcgaacccgcgccggctgctggcgatcgagcacgagttcaccgtgcggctggccgacgagcgccgtccggtgcagctcaccggccgggtcgaccggctggagatcgacgaggcgggccggctcgtggtgatcgacctgaagaccggcaagtccaccgcgctctccgccgacgtggcggagaacccgcagctggccggctatcaggcggcggtggacgcgggcgcgttcgccgactacggcaccgacagcgggggcgccgccctggtccagctcggcccgggcaaggatgcccgggagcagatgcaggtgccgatcaccgaggccaccgacccgcagtgggcgtaccagatggtgcgccgcaccgcggacacgatggccgctgccacgttctcggcggtggcgaacagccgctgccgggtctgcccggtgcgcaccagctgcccggtctccgggaagggtcgccaggtcgtggagccaccgaaggatcagtcgtga

SEQ ID NO: 3658 - DNA, 3666 bp, Actinoplanes utahensis
gtgagagccgccgccggcccccgcttcaccccggccgacctggccggcctgctccggctgccgccgcccaccccggaacagacctcgatcgtcgcgtacccgatgaagccactgctggtggtggccggcgccggctcgggcaagacggagacgatggcgtcccgggtggtctggctggtcgcgaacggctacgtgcatcccggcgagatcctcggcctgaccttcacccgcaaggcggccggcgagctggcgcaccgggtccgcacccggctcggccagctgatccggcggatcgggcgggacgacgggttcgccggcgaggcgaccatctccacctatcactcgtacgccgcccggatcgtcaccgagcacggtctgcgcggcgggttcgagccgtccgcccggctgctcaccgaggcggcccgctggcagatcgtcgactcgctggtccgggcgtacaccggggagatgaccgggctgaaccgcgcccccggcacggtcaccgacgacgtgctgtcgctctccgccgagctggccgagcatctgcgctccccggacgacctggccgcgtggaccggccggttcttcgccgagctgcaatccttccccgggcggatgtacaaggacgtgtccgaggtgctgcggcgtcagcagcaccggctcaccctgctgcccctggtgcgcctctacgagcagcgcaagctggacctggaggcgatggacttcggcgaccagatgtcccgggccgcgatcgtcgcccgcgaccatccggaggtcggcgagatcgaacgcgggcggtaccgggtcgtcctgctcgacgaataccaggacaccagccatgcccaggtggtgatgctgaacaacctgttcggcggcgggcatccggtgaccgcggtcggtgacccgtgccagtccatctacggctggcggggcgcctcggccggcaccctggaacgctttccgaccgagttcccggactccggcggccaccccgcctgggtgcacagcctgacccgcagctggcggaaccgcccggagatcctgcgggtggcgaacaccctgtcggccccgctgcgggcccaggtgggcgtgttgcagccggcggagcgggtcgccgaggcggtcgggggccggacggtcacctgtgcgctgctaccgacgtacgcccgagaggcctcgtggatcgcggaccagatgctgaccgcctggcggatcgccgccggcatgccgaaggcgttgccggaggagattccgctggagcgccgcccgaccagtgcggtgctggtccgggtgcgcagccagattccggtgctggaggaggagctgcgggcgcgcggcctgccggtcgaggtggtcgggctgggcgggctgctggacacgcccgaggtccgcgacgtggtgtgcacgctgcgggtgctggccgacccgaccgacggcgcgtcgctgctgcggctgctgaccggcgcccgctggcggatcggcccgcgcgacctggtcgccctgcaccggcggtcccgggcgatcgcggcggcgcggacgccggtcgatgagccggagggggtgctggccgaccggctcgacgacgccaccctgatcgaggcgatggccgacctgggcaccccgcaccagtattcgaccgagggcttcctgcggctggccgcgttcagccgggagctgtccgccctgcggcagcgcctcgaccagccgctgcccgatctgctcgccgacatcgagcggacatccgggctggacgtggaggtcgccgtccgcggctgggcggccggggacgccggtctggcccgggcgcatctggacgcgctcggcgaagccgccacccggtatgtgaacgagaacgaggccggcacactcaccggcttcctggccttcctggccgccgccgaggaggaggagcgcggcctcgaacccggccaggtcgacgtcgtcgagggcgccgtccagatcctcaccgcgcacgccgcgaaaggcctggaatgggacgtcgtctcggtcgccggcctgtgcaagggcgtctggccgggcctggtccgcgcctccgaccactacctcggcggcatcggtgtgctgccgttcccgctgcgcggcgacgcgtccgggctgcccgagctggacctggaggaggcggtcgagcagaaggacgtgaacaacgcgctcggcgggttcgcccggtcctggcgggaacacgacgagcgggaggaacgccgcctggcgtacgtcgcggtgacccggccgcgccgcctgctgctctgctccggctactggtggggcgacggggtgaaacgtccccgcgggccgtcggtcttcctcgacgaggtgcgtgcgacctgcgcggacggcgccggggtgatcgccgaatgggcgcctgagccggcgcccggggagacgaacccgagcgaggaggtggtggcgaccgcggaatggccggcggatccgctgggggtgcgccggccggcgatggccgcggccgccgacctgatccggcgcatgatcgccgacccggacgcttcggccgcggccgccttcgccgacctggccacggagaatccggaggtggcggcgcgggccggcctcgcggccgatctggtgggcatcgccggcccgggttcgctcccggtccgctcctcccaagatcatcaattggcggtacgccacgagcctcccgccgtgcctcccggctccgctgtgcctcccggctccgctgtgcctcccggctccgctgtgcctcccggctccgctgtgccggccggatccgcggagtctctggcgtccggtgacgggccgggctcggtcgggccggccggctcacccgaagccggcgtgcctgcggtctcctcggcaccttcggcggccgctttccaggctgccgatgggtccggcacggtttccgcgtcgcgcgatcgggcgggcctgcttgccgcggcggccgccgcggaccgggtggccgccgcggccgacccggacatcgcccgctggcgcaacgaggcgagactgctgctcgccgaacgcgacgaacgcacccgccacggcggcccgatcgaggtggcgctgcccccgcacctctccgtctcgcagctggtcgtgctgcgccgcgatccgcagtcgctggcccggtcgctgcgccgtccgctcccgcagcgcccggcgccgcacgcgcggcgcggcaccgccttccacgtctggctggagcagcgtttcggcgcggcccggctgatcgacatcgacgagctgcccggcgccgccgacgaccaggccgccggcgacgaggaactggccgagctgcaggaggcgttcctgaccggcgagtgggcggaccgcaccccgatcgacgtcgaggtcccgttcgccaccacgatcggcggcgtggtcatccgcggccggatggacgcggtcttcgccgacccgggggaccgcttcgacgtgatcgactggaagaccggccgccgccccaccggagccgaggccgaggccgccgcggtgcagctttccgcgtaccggatcgcctgggccacccttgccggggtgccgatcacccgggtccgggccggtttccactatgttcgcgagcaggtcaccgtccgccccaccgacctgctggacgtggccaccctgaccgccctgatcaccgagatcccggaggaggcgctctga

SEQ ID NO: 3659 - DNA, 423 bp, Actinoplanes utahensis
gtgctcggcatagacatggcacggcagctccaagcagccgggctgacctggaaacctcgcctcggcgaccggttcgcgatccccgaccgggacctcgacgacgaggttttcgtgctcagcaacatgacgatccaggtccacgaccgcccggagggccggatcctcggcttcaacggcaccaccgaatgggctctcgacgacgtggcgatcgacgagacgatctggctgccccgcgaggaccagttgcgcgaactgctcggcggcacgttccgctccctcgaccgggatggcggccactatcgggtgagcatcgacctgctcggcgaggcgctcaccttcgcaggcccgaccgccgaggcggcctacgccaccgccctgcgccacctgctcaccgccgccggcgcggcccagcccctcccctga

SEQ ID NO: 3660 - DNA, 357 bp, Actinoplanes utahensis
gtggggaagtctgccccaggcgctctttgtcgtaacccgggtttctccggtacgggcgatcagtacggcgacacgagtcccgcagaatgcgggtcttattacctcgttcacgctcataatgggcgggaacgatcgaccgtcgaggagacgatcatggttaccggcgtagtgaagtggttcaacgcggacaagggcttcggattcatcacccctgacgacggcggcgccgacgtcttcgcccacttctccgcgatccagatgtcgggctaccgcagcctggaggagaaccagcgggtcgagttcgaggtcacccagggccagaagggcccgcaggccgcgaacatccgttccgtctga

SEQ ID NO: 3661 - DNA, 837 bp, Actinoplanes utahensis
atgaccaccagtcaacaccaccatcgggtgcgccgccgcccgggcgtgcacggcgaaacacgctggacaaagtgccacccggcccagtcggttcccagaaatgtccgctaccgtgctgccatggaactggtgtatcccccggtcgtcgccttggccaagacgatgttccgcgtgctcgacctgaagatcgaggtcgagggcggcgagcacatcccgaccaccggcggggcggtcctggccagcaaccattcgagctacctggacttcatcttctgcggcttcggcgctcaaccggccaagcggctggtgcgcttcatggcgaagaagtccgtcttcgaccacaaggtcagcggcccgctgatgcgcggcatgcggcacatcccggtcgatcgcaaagccggcctcggcgccttccgcgaagccaccaccgccctggagaacggcgagatcgtcggcgtcttcccggaggcgacgatcagcgagtcgttcaccgtcaaagagttgaagaccggcgccgcccgaatggctcaggaggccggcgtcccgctgatcccgatggcggtgtggggcccgcaccggctctggaccaagggccgcaagaaggaactcaccaaacgccacgtcccggtcctgatcaagatcggcgaggcgatctcgatgcccgagggcgccaccgccgaggccgtcacggtgatcctcaagcagcggctcacctcgctgctggacgccgtgcagagggcctacccggagaaaccggccgacgacggcgaccgctggtggctgcccgcccacctcggcgggaccgcgccgctgccgcgaccggccgccgcggtctga

SEQ ID NO: 3662 - DNA, 888 bp, Actinoplanes utahensis
atgtccgagccgttcccgcagcagtccgcctggtcccggccgggtggggcgtggtcgtcgggcacggtcaccggcatcggcgtaccgccgcaatcgccgccgccgccacccgcctcgccggaaccgtcgcgacggtccggtccggagcgtcagcgacggcagttgttgatcttcggtggggtggccgggctgatcctgtccggcggcctgatcgtgctgctggtgatcgttttcagcggggacgatccgttcggccaccgggcgcacgcaccgaccgatgtccgcccgccgctggcgcaggcctgccccgcgccgaccgatccgccgggtgccgcgccggctcccgcaccgtccgcgccgcccgccgcgaccggcgcgcggaccgtggaccgggaggcgggcatctcctaccggcagtacggcgcgccgtggcgggtctggaaccaggtgtggcgggccggcacgctgaaggtcaactacaaggtcggccagcatttcgtgaccgagacctacagtgccggcgactatcacgcgtcgatcctgtcggcggcggtgccggcggccgacaacgacgcggtcaccctggatctgcagtgcgtgggacggcaggtcgccgcggacgtgcgggccaactactacccacagccgaacaccctggagccgctgcgcgacgaggtgaccacgctcggcgggcggcccgcctatgtcagcgagttccggctgcatttccacgcggccgggctgaccgccacctcggagctgtccgcggtggcggtcatcgatgtcggcaagccgtcggcggccgtgctctacgtgtccatcccgggcacgcaccggcagttcgactacgtgatcgacgacgtgctgagctcggtccggccgctgtga

SEQ ID NO: 3663 - DNA, 942 bp, Actinoplanes utahensis
atgcccactgaacctctctcctccgcgcgcgccgcgctcgaaggaacgttcgcgccggacgacggttacggtccgctcccgcagaagatcaagaccctgagcgagcaggaggtcagcggcctcgacgcgctcgacctcgaacccgagcgcgaccggggcaacctcggcctgcggatctggaagagcgcctggcccaagctggccgccatcgggatcgtgctgctggcctgggagatcgcctacgtcagcggctggaaaccgtcgtacgtcttcccgtcgcccaccgacgtcttcccgcagctgtgggacctggtgaccaccgccgacttctgggacggcgtgcgcctgaccatgacccgggcgatcaccggcttcgcgctggcggtcgccatcggcacggtgatcggcgccgcggtgtcccggttcgccccgctgcgcgccgcgatcggctcgctgatcaccggcctgcagacgatgccgtcgatcatgtggttcccgctcgccatcctgctgttccagctcggcgagaaggccatcctgttcgtggtcgtgatcggcgccgccccctccgtggcgaacggcctgatcagcggcatcgactacgtgccgcgcacctggctgcgcgtcggccaggtgatgggcatgtccggtttcgaccgctatcggcacctgatcctgccggcctcgctgccgtccttcgtctccgggctcaagcagggctgggccttctcctggcgcagcctgatggccggtgagctgctcgtcatcgtgcccggcacggtgtcgatcggcgtgcgcatgcagaacgcccgggacctggccgacaccccgctggtgatctgctacatcctcgtcgtactgatcatcggcatctgcatcgatcagctcttcaacgccgccgacaacgccctgcgcaagcggtggggcctgaccggcagctga

SEQ ID NO: 3664 - DNA, 744 bp, Actinoplanes utahensis
atgaacatcctcgagatcgacaacgtctccaagcagtacggttcgggcagcaccgcgctgctcgccctcgaccgtgtgtccctcgacgtccagcagggggagttcgtctgcctgctgggcgcctccggctgcggcaagagcacgctgctctcgctggtcgccgggctggacaagatcagcggcggcaccctgaacaccggcggccgcaaggtggccctgatgttccaggaggccgctctcttcccctggctgtccgtggccggcaacgtcgagctgccgctgaagctgcagggcatcgacaaggccgaacgccggaagcgggccgccgagctgctggagatcgtccggctgggcggcttcggcgacaagcggccgcacgagctctccggtggcatgcgccagcgggtcgcgctggcccgggccctcgcccagaacgccgacgtgctgctgatggacgagccgttcggcgccctggacgcgatgacccgcgacatcctgcacgacgagttggaacggatctggcgcgagcaggagctgaccgtgctcttcgtgacccacaacgtgcgcgaggcggtccgcctcggcgaccgggtgatcctgctgagcagccggccgggccgggtcatcgaggacttcaagatcggacacccgcgcccccggcgcatcgactcccccgaggtctccggccaggccgccgagatcaccgaccggctccgtgcggaggtcgcccgtcatgcccactga

SEQ ID NO: 3665 - DNA, 1083 bp, Actinoplanes utahensis
atgcgctcccgcacccttcgtgcgctcgcccttgccacggccgcgctcgcggccacgactgctctggccgcttgcgggtccgacgacgacagcagcaagaaggccgacactccggccggcacgccggccgaggcgaagaccatcaagctcggctacttcccgaacatcacccacgcgccggccctggtcggcgtcaacaagggcctgttcaaggacgcgctgaccggcaccgagctgcagacccagaccttcaacgccggcccggccgcgctcgaggcgctgctctccggcgcgatcgacgccacctacatcggcccgaacccggcgatcaacggctgggccaagtccaacggccaggccctgaagatcatcgcgggcagcacctcgggcggcgccggcctggtggtcaagccgaccatcaacggcccggccgacctcaagggcaagaagatcgccaccccgcagctgggcaacacccaggacgtcgcgctgcgcgcctggctcaagcagaacggcctgaacgccgacaccaacggtggcggcgacgtgtcgatcctgccgcaggacaacgcgaccgcggtccaggccttcgcccagggcgcgatcgacggcgcctgggtgcccgagcccaacctcagcaagatggtgctggagggcaagggcaagctgctcgtcgacgaggccaccctgtggccgaaccagcagttcgtcaccacccacctgatcgtcagccagaagttcctcaaggactacccgggcacggtcaagaagctgctgcaaggccacatcgcggcggtcaagtacatcaacgacaacaacgccgacgcccagaaggcggcgaacgcccagatccaggcgctcaccggcaaggcgctcaaggacgacatcctggccgccgcgttcaagaacctgaagttcaccaacgacccgatcgcgtcgtcgctgtacaccagcgcgcagcacgccgaggacgtcggtctgctgaagaaggtcgacctgaagggcatctacgacctcggtccgctgaacgacctgctcaaggcggccggtcagcccgcggtcagcgacgccgcgggcgcctga

SEQ ID NO: 3666 - DNA, 414 bp, Actinoplanes utahensis
gtgtacgtctcggctcgcacggactacgcagtccgcgccatgctcgccgtcaccgcggcgcacccacgtctggtcaaggccgccgggctggcggccgcgcaggacatcccgctgagcttcctgcagggcatcctgctcgacctgcgccgcgccgggctgctgcacagccaccgcggcgtcgacggcgggtacgccctggcccgcgcggccgaggagatcaccgtcggggacgtggtccgcgccgtcggcggcgcgctcaccacggtccgcggcctccccaccgccaccgcgacctatcacggcgcggcgatcgcactgcacgacgtgtggatcgccgtcgaggcggccatcgagggcgtggtcgaccaccggaccctggccgaactctccaccacctcaataaagaagaactag

SEQ ID NO: 3667 - DNA, 1308 bp, Actinoplanes utahensis
gtggcgtccagaatccagatccccgcgacgaaatatccggtcgaacggttcaccctcgccaacggtctgcgcgtggtgctctcgccggaccgcagcgccccggtcgtcggcgtcgccgtcgtctacgacgtgggcatccgcagtgagcccgaggggcgcaccggcttcgcccacctcttcgagcacctgatgttccagggctcggcgaatctggagaagctcgcccacttccggcacgtgcagggcgccggcggcagcttcaacggctccacccacctggactacaccgactacttcgaggtgctcccggccggcgcgctggagcgggcgctgttcctcgaggccgatcggatgcgcggcccccggctcaccgaggagaacctgcgcaaccaggtcgacgtggtcaaggaggagatccgggtcaacgtgctgaaccggccgtacggcgggttcccctggctgaaactgcccccggtgatgttccgcacgttccccaacgcgcatgacggctacggctcgttcgaggacctggagagcgccaccgtcgacgacgcgcagggcttcttcgaccgctactacgcctgcggcaacgcggtgctctcggtcgccggcgacttcgacgtggcggaggcgaccgccatgatcgagaaacacttcggcgacgtgcccgcccgccccgccccggtgctgcccgccttcgacgagcccggcctcgacggcgagcgccgcgagtcgtacgtcgaccgcctcgccccgctgcccgccgtcgcggccggctaccgggtgcccgacccgatcgccgccttcgacgcctacctgcccttctcggtgctcgccgaggtgctcaccgacggcgacgcgtcccgcctggtcgaacgtctggtccagcgcgaccgcacggtcaccaacatcggcggctacctcggcttcatgggcgacgagtaccaggtgcgcaacccgaccgcgctgctgctgcaggcacacctgccgcccggcggcgacgccggcaaggtgctgcgcaccgtcgacgaggagctcgaccggctggccgccgacggcctcaagcccggcgagctggagcgcacccaggcccggatggcggcccgcgcgctgcagagcaccgacgaggtgctcggccgggcactgccgatggccgtgctggagctgcagcgcggccggcccgagctgctcaacgagctgcccaagctgatcagcgaggtgaccgccgagcagatcgtcgacgccgcggccaccctgcggccggaacgccgcgccaccgtcgaagcgatccccggagccacctcatga

SEQ ID NO: 3668 - DNA, 1317 bp, Actinoplanes utahensis
atgaccgagatcctccccgacctcatcccggacaccgagctgacactgccgccgcaggccgagcggaaactgccgaacgggctgaccgtgatcgccatccggcgcgccgcggtgccgctggtcgaggtgcgcctgcgggtcccgttcggccgcgccccgctggccccggccaccctgctctcccaggcgctgttcaccggcaccgagacgatgacgatgctggacatcgccgccgaggtgcaggcggtgggcggcagcctggccgcggggctcgacccggaccgtctgatgatcagcggcaacgcgctcgccgacggcctcggccggaccctggagatcctcgccggcgtgctgaccggcgcgacctacccggccgacgaggtgctcaccgagcgcgagcggctctgcgacaacctccaggtgatgctcagccagccggcccacctggcccgggtcgcgctgctcaagcgggtgtacgccgaccatccctacgccgtgcagacccccgccccggaggaggtccgggcggtcgagccggatgccctgcgcgagctgcacgccgaccgggttcggccggccggctcgatcctggtgctggtcggcgacatcgacccggaccaggcgatcgacctcgccgagaagacgctgggcggctggaccggcgcggcccgcgacggtgacctgccgcccgccccggccctgcgccccggtgccctgctgctggtcgaccggcccggcgcggtgcagtcctcgctgcgggtggcgctgccgggcctgccccgcaccgaccccggatacgccgcgctggccctggccaacatgctcttcggcggctatttttcgtcccgctggacggagaacatccgcgaggacaagggctacacctacggcccgcactcggcgatcgagcacttcaccgccggatcggtgctggtcgcggcggccgaggtggccaccggcgtgaccggtccggcgctgctcgagaccacgtacgagctgggccgcctggccagcctcgcgcccggcgaggaggagctcgaacaggcccggcggtacgccctgggcaccctgcggctggggatgtcgacccaggccggcctggccgggctggccagcgtctacgccggcttcggcctgcggctggactacctgcgacagcactcggcggcgctggccgcggtcacccgggagcaggtcgccgaggtggcggccaggcacctggccccgtcccgcgcggtcaccgtggtgctcggcgacgccgagcagatcgagccgcagctggccgccctgagcacggtggagcgcgacccgcggtga

SEQ ID NO: 3669 - DNA, 987 bp, Actinoplanes utahensis
gtgaccacccctgagcaacccgacttcggcggcgagcagcccggcactccgccgctggcgcggaccaccctggaccgcgccgcggatcggcgcaaggacgacgcctggctggccgaggcctggacccgcggcctggtgctggtggtcgacctggcccagggcggccgggcgctggtcaccgaccgcggcgacggcggggtcacgctggtcctggtgccgtcggcggccgcgccggacgccgagcactggttcctcggcgtcgacccggacggcacgccgctctggaccatggacgccacgccgccgccggccgagggcgcccgcccggcgaccctgcgggagatcgggcatctgctcgacgaccgtgacgccgggctgttcacggccgccgcggcgctgaccaactggcacgccggccaccggttctcgccgcgcaccggcaagcccacggtggcggtggaggccggctgggcccgcgccgacccggacggcaagctgatgtggccgcgcaccgacccggcgatgatcgtggtggtgcacgacggggtgcccggcccggccggacgctgcctgctcggtcacaactcggcgtggggccgcgccgcggacggcctgacccggttctcctgcctggccggttacgtcgagccgggggagtccgccgaggccgcggtggcccgcgaggtccgcgaggaggtcggcatcggcatcggcgcactgcgctacgagggcagccagtcctggccgtacccgggctcgctgatgctcggcttcctggccgtggccgacccggcgcagccgctgcggctggacccggaggagatcgacgaggcgcactggttctcccgggacgacatcgccaagatgatcgccgggggctacgtgcacccggattcaggggtgccgatgagcctgccgatgcgctcctcgatcgccttttacctgatcgagaaatggctgaccgccggtgccggagatcacggctga

SEQ ID NO: 3670 - DNA, 882 bp, Actinoplanes utahensis
atgacccaggtggaagcgccggcgtggacgccgatgtccgcggaggagcgggaggcgttcgaccgcgacggttacatcgtcgtgccgtcggtgctgagtgagagcgagatcgaggccggtcgggccgcgatcctggggtattacgagaaggccaaggaaacgggcgagctcagcgcgaccggtgccctgcaccgcctgtcgccggtgaactacgtgcccgagctggccttcctgctcgaccaccccaaggctttcaagtacatctggtcgctgctcgggtggaacgtgcacgtgtaccactcgcacatcgacgtccacccccagctgcacgagcagcagaagcagtggtggcactggcaccaggacggcggccggcagaaccgggagatcgagaccgacccgcgtccgatgctgtcggtgaagctggcgtactggttctccgacgtcagcgagaccggccggggcaacttcaccgtcctgcccggcagccacaagaccaactggctgcccggcccgccgagccgtggcgtgccgtggccggccccggagggtgccgtccagatcaccgcgaacccgggtgacctggtcgtcttcgaccggcgcatctggcacgcccggtcggacaactactccgacatcacccgtgtcggcgccttcttcggctacaccccgcgctggatcgcgattcgcgacgaggtggccgacctgccgaacaagcccgagtgggcgaccatgaccgaggtgcagaagcagctgctcggcgggttcggcaacggcgacggtgaccaccagtggggtcactacccggcgaccacgccgctgtacggcgagctcaaggagcgcggcctgctcgactcgagcatccccgccctgatcccgtag

SEQ ID NO: 3671 - DNA, 315 bp, Actinoplanes utahensis
atgacacccccgcgggacgttgtgcgggatggcgtagtgccgtgtgacccgtatccgaaggagcccagtccgatgctgaccatgtactcgacgtcctggtgtgggtactgccaccgcctcaagtcgcagctcgaccgggagggcatcgcctatgaggtggtcgacatcgagcaggacgagacgtcggcggccttcgtccgcagcgtgaacggcggcaaccagacggtgccgactctgaagttcgacgatgggtcggcgctgaccaacccgtccatcgtccaggtcaagcagcacctggccacgctctccgcctga

SEQ ID NO: 3672 - DNA, 2142 bp, Actinoplanes utahensis
gtgcggactgaaacggtgctggccgggctcgacccggaacagcggacggcggtgacggcgccggccggcccggtctgcatcctggccggcgccgggaccggcaagacccgggcgatcacccaccggatcgcgcaccggacgctgtccggcgagatcaacccccggcacgtgctggcggtgaccttcaccgcccgggccgccgccgagatgcgctcccgactgaccgcgctcggcgccggcggagtgcaggcccgtaccttccacgcggccgccctgcgccaggtgcgctacttcgcgtcccggctgctggcgggtcgcggcatgccggagctgatggagagcaaggtccgcgtggtcggcctggccgccgcccgggccggggtgcgcgccgaccgcgcggtggcccgggacctggccggcgagatcgagtgggccaagtcgtcgctcgtcgagccgtccgagtacgccgtcgcggcggccaaggcgctccgtgagccgccgttcgagccggcccgggtggcggaggtgttcgcggcctacgagtcgctgaaacgccggcagggagtgatcgacttcgaggacctgctgcgcgccgcggtgtgggggatcgaggaccacccggacgtcgccgaccagatccgcgcacagtaccggcacttcgtcgtcgacgagtaccaggacgtcaacccgctgcagcagcgcctgctggaggcgtggctgggagaccgggacgacctcaccgtggtcggcgacgccagccagacgatctattcgttcaccggggccacctcgtcgtacctgatcgacttcccgcgccgctggcgcagcgccgtcgtggtccggctggtccgcgactaccgctccactccgcaggtggtggggctggccaacgcggtgatccggcaggcccggggcaccgaggcccggttgcgtctggagctggaggggcagcgcccgcccggcccggagccggagctcaaggtgttcccggacgagccgggcgaggcggccgcggtggcccggcggtgccgggagctgatcggctccggcacgccggccagcgagatcgccgtgctcttccggaccaacgcgcagtccgaggcgtacgaggaggcgctggccgaggccgaggtgccgtacgtggtgcgcggcgccgagcggttcttcgagcgggccgaggtgcgccaggcgatggtcgcgctgcgggccgccgtgcgctccattccgggcgagacgccgctggtcgaggcggtcgtcgagggtctggccgcgaccggatggcggcgcggccagccaccgccgggcggcgccgcccgggagcagtgggaggcgctggccgccctggtcgcgctcgccgaggagtacgccgccgagccggccgtgctgccgatcggcgagggtggccgggtgcagcgcgaggtcagcctggccgcgttcaacgaggagctggcccgccggtccgagcagcagcacgcgcccaccgtggcgggcgtgacgctggcctcgctgcacgcggcgaagggcctggagtgggacgcggtcttcctggtcgggctcgccgacggcacgctgcccaccacgtacgcgaagaccaatgagcagttggaggaggaacggcgcctgctatacgtcggggtgacccgggcgcggcagctgctgtggctgtccttcgggcagtcccggtcgccgggtggccgggcccggcgaccgtgccgtttcctgccgcagccggagcgcgccaccgcgggcgccggccggccctcggcggagcggagtcggaaagccgaccggcgcccgccgaaggtgtcctcctgccggatctgcggggccaccctgttggccggcgccgaccggaaactgggccgctgcccgacctgcccgtcggacatggacgaggacctctacgagcgtctgcagcggtggcgggcgagcaccgcggcggagctcaaagttcctgcttacgtcgtcttcaccgacgccaccctggtggccgtggcggaacgtcgtccgaccgatccggcccagttgctggcgatcgccggaatcggcccgcggaagctgggccagtacggcgaggcggtcttcgcgttggtggccggcgccggccctgatgatcttggccgaaaaaactttgaaaactag

SEQ ID NO: 3673 - DNA, 306 bp, Actinoplanes utahensis
atgaggatcaacaccatgctgatgcgtccgtcgatgttgccgtctgccgtctgcgctccatccgctctgctgcccgtcgccgctccgtcggcgctgctggctgccgagcgtgttctggctccgcaggctcaccaggtcttcagccagtcccaggccgagctgggcaaatgggctgtcgagcgggtgctcgcgagcggcgtcaagggcagcactggcatcaatggcaccaccgggttcaagggcaacgattccgtcaagcgctacacggatggaaacggcgtcccgcctcgaggaaggccggtctga

SEQ ID NO: 3674 - DNA, 363 bp, Actinoplanes utahensis
atgagtctggcgctggccccgatcgacatcactgtcgacatcgaggcaaacctgccctgccggaagttcgacccggacctgtggttctccgactccccggcccagctggagctggccaagtcgctctgcggggactgcccgctgcgcgtcgagtgcctggccggtgcggtcgagcggagcgagccctggggtgtctggggcggcgagatcttcgagcgcggcgccgtggtcccgcgcaagcggccgcgtggccgtccccgtaaggccgacgtcgcgcgcgacgccgagctggcggtcgaggtcgaggagcggctcgccgcgaacggtctcgactcccgcaacagcgttcggctggcggcctga

SEQ ID NO: 3675 - DNA, 1347 bp, Actinoplanes utahensis
gtgacggacataccccgccgtgcggcctcccggacggccaagctggccgccctgccgctcggcttcgccggccggaccgctctgggactgggcaagcgggccgtcgggatcgctgccgacgtcatctccgcggacattcagcagcgcaccgccgagcagctgttcagcgttctggggcagctcaagggcggcgcgatgaagttcggccaggcgctctcggtcttcgaggccgcgctgcccgaggagatggccggcccctaccggcaggcgctgaccaaactgcaggaggccgccccaccgatgccggtggccaacgtgcacaaggcgctcgccgagcagctgggaccggattggcgggagagtttcgccgagttcgacgacagcccggccgcggcggccagcatcggtcaggtgcaccgcgcggtctggaaactgccgccggcccggaagaacggcaagccgaaactgctgccggtcgcggtcaaggtgcagtatccgggggccggcgaggcgctggtcgcggacctgaaacagctgtcccggctggccggcatgttcaagatcattcagcccgggatcgacatcaagccgctgctcgccgagctgcacgagcgggtcgtcgaggagctcgactacgagatggaggcggagacccagcgggcgttcgccgccgccttccacgacgacccggacatcttcgtgccgcgggtggtcgcctccgcgccgcgcgtgctggtcaccgagtgggtcgagggcacgccgctgtccagcgtgatcgccggcggcaccgtggccgagcgggacgaggccggccggctgatggcgatcctgcacttctccgcgccggcccgggccggactgctgcacgccgacccgcatccgggcaacttccgggtgctgcccgacggccggctcggcgtgatcgacttcggcgcggtggcccggctcccggagggccatccggagccgatcggccggttggtccggctggccctggacggcgacgccgagggggtcgcggacgggctgcgcgacgagggtttcatcaaacgggacgagccgatcgacgcggaggcggtgctcgccttcctgcgcccgatgatcgagccggtcgcggtcgagcggttccgcttcacccgcacctggctgcgcggcgaggcgacccggctggccaacccccgctccccggcataccagctcgggcgcaaactcaacctgcccccgtcgtacctgatgatccaccgggtgacgctcggctcgatcggtgtcctctgccagctggaggccgaggcggcttaccaggagatcctcgaggagtggctgccgggcttcgccccgatcgcctga

SEQ ID NO: 3676 - DNA, 642 bp, Actinoplanes utahensis
gtggggccggccgacctgcccggcagcccactgatcggcaccgacctgggcagcccgctgcacaccgcggtggcggccgccgtccgccgggccgtgcccggcacccaggtctgcgaggtccgccgcgcaccggccagcctggtcgtccagctcgcccacgaccagccggtcgcgctgctcgccgccgcgcacagcacccgccggcagccgcacctcgcggtgcacatccgggacggcgccgcggtgatcgggccgttcgtgcccgccgccggccgaccctgcctgcactgcctcgacctgcatcggcgggaacgggacccggagtggccgggcctgcccgggacgggcggggttggcggcccgggcgggacggagccgtgcgcggtggcgaccgtgctggcggcggcggggttcgcgaccgccgaggcactgaccttcctggacggcgggacgccggacacgctgggggcggcggtggagatcagcgcgccggggcggacccgccgccggacgtggccgccgcatccggagtgcgcctgcggcgcgcgggcgcggcgatcccccattcacctgaggccgtccgcagcgacccagacaggactccccaaacgggcggagtgtggaggaagtgtggatccttaa

SEQ ID NO: 3677 - DNA, 378 bp, Actinoplanes utahensis
gtggataacaaatccgctccgcagcccggcagtgacaacctgtcacccatgacccacccgcccctcccccgggccccactcgcccggcccaccctgatccccgggctcgcccggatctggcgtgctcccgacgagctgcagctcggcctcgacccggcccgcgcggtgcgcctcgagctgcccgacccccgcctggcccgggtgctcgacctgctcgacggcaaccggccggaacgccaggtgctgctgcacgccgccgacctgggcgtcgccccggccgagaccccgccagctgctcgacctgctgcgccaggccggcctggtgctgccgcagtccgcactgctcccggccggcctgcccagcgccgagctagctag

SEQ ID NO: 3678 - DNA, 159 bp, Actinoplanes utahensis
gtggccgagaccacctacaacggctactgcgtcaaatgcaaggagaagcgtgacttccagggcaacgtggaggtctccaagaccggcatgaacatggccaagggcaagtgcccggtctgcggaacgacgatgaaccggattctgggcaaggccaagtag

SEQ ID NO: 3679 - DNA, 531 bp, Actinoplanes utahensis
atggcccgcgtgcgcaaacctgtcgtggaagtgcggcgcagtcagcgccggcgcaggacggtgtccgcgtatcgcgacggcgagcgcgtggtcgtgctcatcccggaccggttctcgcgcgccgaggaaaccgagtgggtcgagcggatgctcgcccgtctcgccgcccgtgaggaacgcctccggcacaccgacgacgagctgctcgcccgcgcccgccggctgaccggacgctacctagcggagtacgccggcctggtcgccccggccagcgttcgctgggtcaccaaccagaacggccgctggggttcctgcaccccggacgacgccaccatccgcatctcgcaccgcatccaggagatgcccgactgggtcgtcgactacgtcctgttgcacgagctggcccatctggtcgtcccgagccacaacgcgcgcttctgggagctggtgaaccgcttccccaaggccgagcgggcccgcggctacctggagggcgtcgccgccgccggctccctcgtcatggccgagtaa

SEQ ID NO: 3680 - DNA, 597 bp, Actinoplanes utahensis
gtgacgcggcgtgtggtggtggcgatgctggtcccggtgccgtggagcccgcccggggtggatccggcggcctggcgcggcgctctggccgaggacgtcgccgatctgctggcccgcctcgcgcaggccgaggccgcgatcgccgccaccgcgcaggaccgggctctggccgaggagatcgcctggcccggcatgcggatctacgagatcccgcaacccaccgtgctcccggtgctgcgggcggccgccgccgacggcttcgagcaggccgccgtcatcgccgccgacgccccggacgttcccggcatgatcctcggcaagctgctgcgcccgctggagagccgggcggtcgcggtctccccgggcggccccggtggcggcctgctgggcgtggccgccagcctgcccgccccggattggctgcccgaccacgatctcgacacggcctccgcccagtcgctgcgccggtccgccccgtcccccggcgaggtcacctccacaccaccgtggcgtcgcctccgcggcccggccgaccttgccactctggacgtggccttggaaggctgggacaacacccgagccctcctcgacacctga

SEQ ID NO: 3681 - DNA, 1296 bp, Actinoplanes utahensis
gtgcccgatatcccgttcggcttctccctgccgggcgcgcagccgcccgacccctccgacccgcagcagatgcagcagttcatggcgcagctgcagcagatgttcgctgcccccggcagtggcccggtcaactgggacctggcccggcaggtcgccgccagccagctctcggccagcggcgacccggcggtgaacatgttcgagcgccaccaggtcgaggaggcactccgcctcgccgacctgtggctcgacccggtctgcgcgctccccagcggcatccacaaggcggtcgcctggaaccgcaacgagtggatctacaacaccctcgacgtctggaagaagctgtgcgagccgatcgccggccgcatggtgggcgccatgggcgacctcgtgcccgaggaggcccgggcccagctcggcccgatgcagtcgatggtcgccacgctcggtggcgcgcttttcggcggtcagctcggccaggccttcggccagctcgccgccgaggtcctctcggccggcgacatcggcctgcctctcggcccggccggcaccgcggcgctggtcccggccaacatcaaggcgtacggcgagggcctggaactgcccgaggaccaggtgcggctctacgtcgccctgcgcgaggcggcccaccagcggctcttcggacacgtgccgtggctgcgcgcgcacgtgctgagcgccgtcgaaacgtacgccaacggcatcaccgtgaaccgggaggcgatcgaggaggcgatgggccgcgtcgacccgagcgacccggagtcgatgcaggccatggccctggaggggatcttcactccggaggacaccccgcagcagaaggccagcctggcccgcctggagacggcactggccctggtcgagggctgggtcggccacgtggtcgaccaggcggccggcgaccggctgccgtcggtcgcggcgctcggcgaggcgttccgccgccgccgggccgccggtggcccggccgagcagaccttcgccgccctggtcggcctcgagctgcgaccccgccgcctgcgcgaggccggcgccctgtggacggcggtcgccgaagcgcgcggtgccgcgggccgggacgccctctgggaccaccccgacctgctccccaccgacgaggacttcgccgacccggaggctttcgcccgcacccagtccgactgggacatcagcgaactcgaaggcctcgccggcaacccggagcccgggccggacgccccggagccgggcaccgacactccgcactccggcccggacgacaccgagaagtag

SEQ ID NO: 3682 - DNA, 1032 bp, Actinoplanes utahensis
atgagacgtcgcggtgtcaccgtcatcctgggcgccctgataaccgccctgctggccgcgggtgtcatggtcgcccccctgccctacgtggtgctcaagcccggcccgacggtgaacaccctcggttcggccgagggcaccgaggtgatccaggtgaccggggccaagacctcgtcctccgccggtgagctgcggctgaccacggtgaacgtgcagtcgcacgtggagctggtctgggcggtgcagggctggctgagtcaccaggacgcggtggtcccgcgtgacctgatctacccgccggaccagagcgagaagcaggtccaggagcagaacgcgcaggagtggaagcagtcgcagaccagcgccgagacggtcgcgctgcgcgagctcggctacccggtgcagacctacgtgcgcaaggtcaccgcgggcggcgccgccgccggcgtgctccaggagaacgacgtgatcacctcggtgaacggcaccgcggtgaccgggccgggccagctcacctcgctggtcaccgcccagccggcgggcagcaggctggccgtggggtacacccgggccggtagggcgggcaccgccgaggtgaccacgaaggccgcggacgacgagaagaagacgccgcgcctggggatcgagatcggcacccagcagccgcacccgttcaccatcaagatcgacctggacaagatcggcggaccgagcgccggcctgatgttcaccctcggcatcatcgacaagctgcgcgacgacgacctgaccggcggcaaggtgatcgccggcaccggcaccatcgacgacgacggcaacgtgggtccgatcggcggcatcccgcagaagctggtcggcgcgagcaaggccggcgccaagatcttcctggtccccaaggacaactgcgcggaggcgctgcgcaacgcggtgcccggcctgccgatggcgaaggtggccaccgtggacgacgcactcaccgcgctcaagaccttcacctcgggtggcacccccacaccctgctcggcatcatga

SEQ ID NO: 3683 - DNA, 3024 bp, Actinoplanes utahensis
atgcgtaacagtcccctaccgaggatgagccggcgcggtcgcgtcaccgtcggcgtcctggtcggggtcttcatacttttcacgctgctcggctggggcatcgacgcgtacacggactatctctggttctccgaggtcgacttcgccaacgtgttctccggggtgctggtcaccaggctgctgctcttcctgacggtcggcgcggtgctggcactgatcgtcggggcgaacctgtacctggcgtaccggctgcgtccgctgctgcggccgcactccgcggagcaggccacgctggagcggtaccggatggtcctcacgccccggctcggcacctggatcaccgtgctgagtgtcatcatcggattcttcgcgggactgtccgcgcagagccgatgggccgactggatgctgttccgcaacgcgcagccgttcgggcagaccgacccgcagttccacgtcgacatcgggttctacatcttcgactacccgctgctgcgctacctgctcggcctcggcttcaccgcggtggtgctgtcggtgctcggcgcgctcgccgtgcactacatcttcggcggcgtccgactgcagggcgtcggcgaccggatgaccaccgcggcgcgtgcccacctgaccaccctggtcgcggtgttcgtgctgctcaaggcagtggcgtacgttctcgaccggcgcgctctgctgctcgagcagcacgtttcgccggggctgtacggcgccggctacaccgatgtgaacgcgctgctcccggccaaggagatcctggcgtacatctccattgtggtggccgtcgcgatcatcgtgttctccaacgcggtgatgcggaacctggtgtggcccggcgtctcgctggccctgctcggcatctccgcggtcgcgatcggcggcatctacccgctcgccgtgcagaacttccaggtcaagccgagcctctcggacaaggagcggccatacatcgccaaggcgatcgaggccacccgggacgcgttcgacctgaacgccacgaaggtcaccgactacaccccggtgaccgcggcgaacggttccacgccgccgccggccaacctggccgacgacaccagcgcgcagaacgtccggctgatcgacccgcagctggtctcccaggctttcacccagtcgcagcagtcccgcagcttctacgacttcggcgagaagctcgacgtcgaccgctacacgatcgacaacaagacgcaggacttcgtggtcggcgcccgggagatcaacgacgagaagctctccgcacagcagcggaactggctgaaccggcacaccgtctacacccacgggtacggactggtcgccgcgccggccaacaaggtctgcgaaggcgccgggcttccgtacttcgtctccggcttcctcggcagcaacacctcggccaactgctcggcgccgaccgacgagctggaagccacccagccgcggatctactacggtgagcagtccaccgagtacgcgatcgtcggccagaccgacaagagcaggagcgtggagttcgaccgcccgaaggaacgggacaagaacgcgcaggggcaggacgaggacaaagaggcctcggaccccttcacgtacgacggcaagggcggcgtcgcgatcggctcgttcttccgccggctggtgttcgcgatcaagaacaccgagagcaacttcctgctctccgacgcggtcaacgccaactccaaggtgatgtacatccggaccccgcgcgagcgggtggagaaggtggcgccgttcctcaccatcgacggcgacccgtacccggccgtggtcgacggcaagatcgtctggatcctggacggctacacgaccgcccagacctacccgtacgcgcagaagatcaacctggcgaacgagacgcgcgacgagacgaccggggccggagccttcccgctggcccgcgacgacgtcaactacatgcgcaactcggtcaaggcgaccgtcgacgcgtacgacggcaccgtcaagctctacgagttcgacaccaaggatccggtcctcaaggcctggaaccaggccttcggcgggcacctgatcatccccaagggggacaccccggccgatctgatcaagcacttccggtatccggccgacctgttcaaggtgcagcgcaacctgctcaccaggttccacgtccaggacccgcagacgttcttcaccggcgacgacttctggcaggtgccgaacgccccggacgcaccgcaggccggggtcaagcagccgccgttctacctgaacgtcaagctgcccgtgcagtccgcgaccacgttccagctcacctccggggtcaccccgaacggccgggacaacatggccgccctgatctccgcgtcgtacgacaccaccggcgctccgcagctgcaggtgctcaagttgcccaacaactcggtgacacccggccccgtccaggtgcaccggctgatgaccaacaacgcgggcatctcccagcagctgttcgcgctcaaccgcaacggccagaccgtcctctacggcaacctcatctcgttgccactgcaacagggcatcctgtacgtcgagccggtctacgtccgcaccaccgcggccggtgcggcgccgctgctgcagaaggtgctcatgtcgtacggcgacggctccaacgtcgtcctcgagaacaacctgcaggacggcctgaaagccctcgccgccgccggcaagaacaacaacggcgggaccggcaccggcggcaacaccggcacgacaccacccgccagcggcaccggcccgccggtcctcagcggcgacctcgcctccgccgccgcggccgtcgaccaggccatcgagaacctgcggaacgcgcagaaatccggcgacttcgtggcccagggcaacgcgctcaaggccctcgacgacgcgatgagccgcttccagcaggcctcccaggcgaagggcgggacgaccaccggcaccgggccgtcggtcacaccctccaccgccgccaacccggcaccctccgcgagtgcgggcggctga

SEQ ID NO: 3684 - DNA, 2085 bp, Actinoplanes utahensis
atgcgtttgcgtcgcggattgatcatttccggattgttttccgctctgctgctcgctggaacgtcgggtgtccatccggcggccgggcaggcggatgccgggcacctccacggcgacgaggccgacgagatccgcgagcacatggcactcgacctcgccgatacgccgatcagcgagatcgagcgacggaccgcggtgaacgccgcgcggatccagcgggacaccggccaccgcccgggcaccccggtgtcccgggtggccgtttccgccgatcccgggcggtccggctcgtggagtccggtggtcggcacgccggtcgtcccggtcttcgacgcggtgctgccgaacggcaaggtgctcatctgggattcggtcggcgacaacgcggcggagtcgtatccggaccacgatttcacgcgggtgatggtctggaatccggctgacaacacgtacaaaagagttgatctgcaaggagcgaacatcttctgcgcgggtttcgcgcatctcccggacggtgacattctggtcgccggcggaaatgccgactcggcccttgacggaacggtttggacgcatatcttccactggcagaccgagacttggacccggggcgagaacatggcggtcggccggtggtatccggcggttgccgagaccgcgaacggcgaggaggtgatcgtcggcggcggcccgaagacggccgaggtctaccagtcggacggcgccctgcgcccgctcaccgccggcccgacgtacgcggcgcgggtctatccgttcctcggttcccggccggacagccagctccagctgttcggtccgcccaccacctcgtacaccgtcaccacctccggcaacggggtgatcaccgcgaccggcacgcgggacgcggtggcccgcgactacggcgggttcgccacctacgacgtcggcaggacgctggtgaccggcggcggcaacctgaccgagggcggggtcgcgcaggtgcccacgcggacctcggtggtgctgaacaccaccggtgcgggcgccaccgtgaccaccaccggctcactgtccaccgggcggcgccagctcaacaccaccctgctggccgacggctcggtgctggccaccggcgggttgacgagcaccaggaagagcccgctggtcgacctggacagcgcggccaccgcggcggagcgctgggatccggcgaccggggcgtggaccgtgctggccggcgccggccggatccggcagtatcattcgaccgccgcgctgctgcccgacggccgggtgctcaccggcggcggcggggtctgcgggatctgcaccacggtcggctatctggagaagaacatcgagtacttctccccgccctatctttatcgccaggacggcagcggccgccttgccgaccgtccggtgatctccgccgcaccggccggcgtcgacatcgccaccccgttcgcggtgacctccccgcaggcgtcgagcatcaggaaggtggcgctggtcgggctcgccgacgtcacccacggcatcgaccagggacagcggtacatcccgctgaggttcagcgccgccggcaccacgctgaccgtgaccggcccgccgagcggcggtgtcgccccgcccggctactacatgctgttcgtcgtcgacgcggccggtgtgccctcggtggccaaggtggtgaaggtggcccggcagccgaacccgctgatgagcccgatccgcagcgtcaacggcggcgaccgctgcgtcgacgtgcccgcggcggccgtcgcgatccggacgtacctgcaattctacgattgcaacggctccaaggcgcaggctctgacccgggttccggccgacgacacgctgcgggtgatgggcaactgcctggacgtgccgggcggcaatttcgcctccggacagaggatctggacctacacctgcaacggcagcgcctcgcaggcctgggagctcggccccggcggggtgatccggccggtcgggcatccgaccctgtgtctgcgcccggtcaccgccgacaaccaggcggagatccagatcatctcgtgcagtcgcagtctgctgcagaagtggcggtggtga

SEQ ID NO: 3685 - DNA, 684 bp, Actinoplanes utahensis
gtgcaacagacggccaggaccagccgtcgacgtgtcatctcattcacgccgccgatcgtggcggcaaccacccggcgcttcccaggaaacttgcgaagaccgcaaactgtcgggatggaccccgagctgaccacgctgctcgacggcatcggctcgcgcctgcgcaggatccggcaggaccgtgggctgaccctggccgatctggccgcggcgaccggcctgtcggtgagcaccctgtcccggctcgaatcgggcgggcggcggccgaccctggacctgctgatcccgctggcccgcacctaccggatggcgctcgaccacctgatcggcgcgccgcccaccggcgatccgcgggcgcacctcacgccgcaccgcaccgagccgcgcaccggaaacccgagcgtggtggtaccgctcaccgcgtaccccggccgtttgcaggtcttcaaacagatcctcggccccgggcagcgtccgccgaccccggtgacccatcccggacacgcctggttctacgtgctgtccgggaccgtccggctgctgcgcgggcccgtcgagtcggtgctgcagcccggggacgtggccgatttcgacaccggcgagccgcactggttcgggccggccggtgatggcccggcggagatcctgcacctgtacggcccgcacggcgaccggccggcgtga

SEQ ID NO: 3686 - DNA, 1374 bp, Actinoplanes utahensis
atgacacgtcgacggctggtcctggccgtctgttgcaccagcatcttcctggtcgggctggacaccacggcggtgaacgtggcgttgcccgcgatcggccgtgacctgcggctcggcctgcccgagctggagtgggcggtcgatgcctacacgctggtgctggccggtctgctgatcggctccggcgcgctggccgaccggatcgggcgccgccgggtgttccggctcggactgatcctcttcggtctcggctcggtcggctgcgcgctggcgccgggcctcggcgcgctgatcgcggcgcgggtcgtgcagggcgtgggtgcctcgatgctgagcccggtggcgctggccatcgtggtgagcgtgatcactgatccgcgcgagcgggcccgggcgatcggggtgtgggccgcggtcttcgggctcagcatggcggccgggccggtactcggcggcgcactggtcaccggactcgggtggcggccgatcttctgggccaacctgccgatcatcgtcgccgtcctggcgtaccccctcccggagtcccgatcaccccggccgcgccggctcgacctgcccggtcaggccctgttgatcgtgctgacgagcacggtcgtcgcggtcctcatcgaagggccgcgggccggctggtggtccggtttcgcgatggcggcgtacgcgatgatccccgccgccgcggccaccctcgcccgggtcgagtcccgccgcgccgaaccgctgctggatctcagcctgttccgccggcccccgttcgccgcggcggtcggcggcgccgtggtggtcttcgtcgcactgaacgtgaccctgctgctcggcacgctctacctgcagcgggcccgcggcctgagcccgatcgaggcgggcctggtcaccctgccgatggcggtcgccgccacgatctgcgccccgctctccgggcgtctggtcggccgggtcggccccggtctgccgctgcgcctggccggagccgggatcctgctcagcggggtgctgctggccggagtggaccgggacaccgggctgccggtcctgctggtggcgtatctgtgcgccgggatcgggatcggtttcgcgaacgcgccgatcaccaacaccgcggtcagcggtctgccgccggagcgttccggggtggccggcgggatcgcatcgaccgcccggcaggtgggggcggcgctcggcatcgcggtggccggtggtctggccggcagcccgcgggccggttgggccctggtcgccggctgcggggtgctgatcctgctgctctcggctatccggccggggtcaggtgctcggccagcacggacagttgcgtcttctgcgcctcggcccagcgttgccggcccgatgcggtga

SEQ ID NO: 3687 - DNA, 1449 bp, Actinoplanes utahensis
gtgactatctctgaaaccgtgaccccgacgccgaccgcggccggcggcgcggaacaccgctggacaccgcggctctggggcgtgctggcggtgctgtgcgcggtcctcttcctcgacggcctcgacgtctcgatggtcggcgtggccctgccgtcgatcggcgccgaactcggcctcaccaccacctccctgcagtggatcgtcaacggctacgtgctgggctacggtggcctgctgctgctcggcggccgcaccgccgacctgctcggccgccgccgggtgttcctgatcgcgctcggcgtcttcaccgtcgcctccctgatcggcggtctggtcgacgacggtggcctgctgatcgccacccgcttcatcaagggcctcgccgcggcgttcaccgcgcccaccgcgatgagcatcctgaccacgacgttcgccgagggtccggcccgcaaccgggcgctgtcgatcttcacggtcttcggcgccagcggctactcctccggcctcatcctcggcggcgtcctgaccagcctcggctggcgctggaccttcctggtcccggtcccgctctccctcggcgccctgatcgccgggctgttcctgattccccgcgacgaaccggccaccggcggcggccacgacctgatcggcgccgtcaccctggtcggcggcatgctctccgcggtgtacgcggtggtcaccgccccgcagcgcggcttcgacccgcgtaccgccgcggtgtcgatcctcgccgtcgtcctgctggccgccttcgtcgtcgcggaaacccgggtccggcacccgctggtccggctcagcatcttccggatcggcagcatcgtccgggccaacgccagcatggtggccctgatgggttcctacgtgagcttccagttcatgatgaccctctatctgcaggacgtgctgcactgggccccgttgcggatggccctcgccctgctcccggccggcctgctggtcgccttcagctcacccttcatgggccggctcatcgaccggtacggcaccgcaccactgatcgtcgccgcgatgatctcactgagcgccggctacctctggttcctggccacctccggcagccaccccggctacctgaccaccgtcctgcccacgatgctgctcctcggcggcggcttcgcgttcggcttcagctcgatcatggcccaggccaccgacggcatcgacgacgccgagcagggcctcgcctccggcctggtccaatcctccggccaggtcggcaccgccctggtgctggcggtggtcaccggcctggtcgcctccgccaccagcaccgccgccggtgacttcaccccgttccggcccggcgtgaacctggtcaccggtgtcgccgtcgccggcctcctgctcaacgtcgcggccctggcggtggcgcgtctgcgcacccgcaccccggcgagggccgcctga

SEQ ID NO: 3688 - DNA, 1377 bp, Actinoplanes utahensis
gtgctccggcgagatcccgcggcagccggcaccgtgaaagatccggacgtggtcggcccactctggcggatgaaatgccgcgaacagcgtcataccagtcaaaggcgtcgttaccgttcgaacgtggctatcaatcgaactcgtacagacacgtgcggtgaccgtctccgcgtccgggggtcgttcgccgtggccctggccgggctgctctcgctctccgcggtcgccatcccgcagtcctcggccgcggcgccgccggcaccggtcgcacaccagatcacgggcgtcgcggcccgcccccgcgcggccgtgcccggcgtggacggacgcgtcgcgatgcgaccggatggcaaagtcttcgccaccgtgagtgatgcggcggtgcggcagtggagcacggcgaccggccgccgggtcggaacgccgatcaccggcctcaccggacaggtccacgccatcgagttcagcgaggacggcaagctgctggcggtcgccgacgacggcggcgtggcgctgtgggatgccaccaccgggcagcggtccggatccccgctgatcggtcatgccgggccggtgcgctcggtcgccttcaacgcgggcggccgactgctggccacggccggcgacgacgggacggctcggctgtgggatctggccgatcggcgcctcctgcacgccctgaccgggcaggccggcgcggtgagttcggtggtgttcagccgggacggcaagcgcctcgcgaccacggccgccgacagcaccgtgcggctgtggcaagcggacagcggacgcccgatcggcaaggcgctgatcgtgagcccgggcccggtctatgcgacgagtttcagccccgacggcaaactcctggcggcctccggcggcggcgacgtcgtgcggctctggaacccggccaccggcgaaccggcgggcgagccgatcgtggccggacccgggccggtgtacgccctcacgttcagccgtgggaccaggctgctggccacttcctccggcggggacgacaccgtgcgcctgtgggacacggcgacccgccacccggttgccgccccgctcgccgggcacaccggaccggtgcgcgccatgcgcttcggtccggacgggaaactgctggccaccggcagtgacgacggaaccgtgcggttgtgggacgcggtgaccggacgtgcccacggtgcgccgctggccgggcaccaggggccggtctgggcgttgcggatcagccggaacggcaaacgcctggtcaccgcgggcgcggacggcaaggtccggctgtggcgactgcccagccggaaagcggcctcccctcggcacggccagaaggcggcccggcccgggtcgatccccctcggtgccgcctga

SEQ ID NO: 3689 - DNA, 150 bp, Actinoplanes utahensis
atggcatggggttcgaaggccctgccttcaggggagttgtcagccgtggccttccgggaccgtgaacggcgactgtccgaggtcggtgagccgtcactgatcgacggcggtgagctggggctgtcggagagcttgtcgtggcctgagtga

SEQ ID NO: 3690 - DNA, 1185 bp, Actinoplanes utahensis
gtgctgaaacgatcacgtgtgaaggtagagggcagcccgcgtcgcaagtggccgctgtggctgaagatcgtggtgccactgggtgtggtgctcgtcctgggcagtggcggcgccttcgccgctgtcaaggtcgcggagaacaaggtgaacgcggccatccccgatcaccagctgggcggctccgcggctgctccggtgcagcacgccgacatcaagggtgccaagaacatcctgctggcgagcctggacacccgaccgagctggacgaagacgcatcagccgagccacaccgactcgatcatcattttgcacgtgacggcggaccacaagagcgcgtacatgctctccattccgcgtgacctgctggtggacatcccgaagtacaacaacgggaagtatctgaaccgcgagcaccacgacaagatcaatgcggcgttcgccttcggcagcatgggtctcgacggcgacgacgccaccacgcagggcatgacgctgctggccgagacggtgcagaagcagttcggcatcaagccggacgccgctgcggtggtcaactacgacggcttcgtcgacatcctcaagcagatcaaaaaggtctgcctgtacgtcgatgagaacgtcacgtcgatccacatcgggcacaccaaggacggcaagctggcggtcccgttcaagaccacggcggccggcacgaacccccggcacctgtacgtcgatggtgagcaggtcattcccaacacgtacaaaatcggcaatcaatgtcttgatcccacccaggcgctggacttcgcccggcagcgggacctgctctcgccgctgcacgatggcgactacggccggcagcggcaccagcagcagctgctcaaggcgatcctcaagaccgcggtgagccagggcctcgactcgcccaccaagctgcccgggctgctgaccgcggtcggcaaggcgatgaccgtgttccggcagggcatctcgctcgaggactgggttttcggcatgcgcaacctgaacccggacgacatcgtcacgctcaagaccaacggcggcaagttccacgaggtgccgtcgggggtcggctcgtcggagggcctcaccgcggacagcgtcgccatgttcaaggccgccaaggacgacaccctggaggcgttcgtccagacccacccgacctgggtcgccaagacctga

SEQ ID NO: 3691 - DNA, 822 bp, Actinoplanes utahensis
atggagtcgccgccactgcccgtgcactacagccggcgggccgccctgcgccaccgcgccgcccatccgcgcggtctcccgccgggtgcgctgaccccggcgaccggcgccgcgaccggcacgatcccggtgatcctggtgcacggcaccaacggccgctcggccagcgactggttcaccctcgccccgctgctggccaacgcgggccgcgcggtctacccgttcgactggcggcgggcccgccccgggccggacgtcaccgccacccaccggcacgcgctcgacctggccgccttcatcgacgaggtccgggcgacgaccggcgccgaccgggtggacgtggtcggccattcctggggtgcggtcctggccggttacctgacccggtgcctgcccggcgagccggccgccggcacggtccgcacgctggtcgggctggcgcccacctacggcggcaccaccctgcacggtctgctgaaccggccgcaccggctcccggccgggctgcgccgctggctggacgcgaagatcccgacctggcgagagcagctgcccggctccccggtgctgaccgcgctgcggaccgctcccccgccaccgtcgacccggtacaccacgatcgtcacccggtacgaccagatggtcacgccgtacaccgcctcgctggccgccgtgccggacgccaccccggtgctgctgcaggatcacgcccggcgcgccgtcgtcgggcatctcggcatcctgcaccacccggccgccctcgcccaggtcctcaccgcgctgcacgggcggtcaggagccacgatcgcggacccgcagtga

SEQ ID NO: 3692 - DNA, 1278 bp, Actinoplanes utahensis
atgacgaatcaaaacgcggccaaaatcaggcaagccggtatatccgggcgaaatacggcgctctctgcggagcagccgtccccgccggtcaaccggccggcgagggatgcgccggccggtaaaccggcccggctcgccaccctggacgcactccggctgatcgccgcgctcgccgtcgccgcctaccacctgacggcgtcctggcgggtcgacgggcggcacaccccggcgtacttcctgccgcacctggcccacgtcaccgtctacggcttcctcggcgtcgagctcttcttcctgatcagtggcttcgtgatcgggatgagcagctggaaccggagcctcggcgacttcttcacctcccgggtcagccggctctacccggcgtactgggccggtgtgctgatcaccacggcggtggtcacgctcgccccgatcaacggcggcgtcccggtctccggaacccccgacctgcgccaggtcgcggcgaacctgaccatgctgcaggagccgctcggtgtcggctcggtcgacacggtgtactggacgctcttcgtcgagctgcgtttctacctgctgttcgcggcgctggtggcggtcgggctgacctaccgccgggtggtgctgttctgcgcggtgtggatgaccgtcgcggcgctgggcccgatgaccggcagccggtgggtgcaggtgctggccgtgccggactacgcgccgtacttcatcgccggcatcgccgcgttcctgatccaccggttcggccggtcctggctgctgttcggcatcgtcgggttcgcctggctggtcagcgtgcagcgggtgatcgaccgggtgaactcgctgcaccccggtttcaccgtgccgacctggccgggcgccgtgatcatcacggtcgcctacgccgtgatgctggccatcgcgctcggctggaccgaccggatccgttgggcctggctgagcaccgcgggcgccctgacctacccgttctacctgctgcaccagcgcctcggctacaccttcatccggcacacctaccaggcgacccacctgcccgtctggctgctggtggcgatcgccatcggcctgctcctgggcctgtcctggctggtgcaccggctgatcgagaagccgctggcggcgcggctgcggtccgggttgcggcagtcgctcaccgagctgcgggtcgcctcggccgccgacgcggccgccggcgcgctgccccggcagacccgggaggggcggctggtccgggccgcccgcgagctcggcggtgaccgatga

SEQ ID NO: 3693 - DNA, 762 bp, Actinoplanes utahensis
atgaggcacttggcggcggactgtacgaaatgcgccgcgctctgctgtgtcgccccggccttcgccaaatcctcggatttcgccgtcaccaagccggccgggcaggcctgccgcaacctgggtgacgacttccgctgcacgatccacgaggtgctgccggagcgcgggttccgcggctgcgtggtcttcgactgcttcggcgccggtcagcggatcacccaggagaccttcggcgggcgggactggcgcggcgccccggagctggccggcgccatgttcgccaccctgccggtgatgcgccggctgcacgagctgctctggctgctgaccgaggcactgaagctgggcgaggcgcgccggctgcacccgaagctggccgcggcccgggacgagatcgagatggtggccgcgcggtccgccgacgagctgcgcggactcgacgtggagccgtaccggcagcgggccgtgccgttgctgcgccgggccagcgagctggcccgcgccggtatcggcggccgccgcccggaccacggcggagcgcagctgatcggccgtggattccggggcgccgacctgcgcggcgcgagtttccgcggcgcgctgctgatcggcgccgacctgcgcggggcggacctgcgccgggccgacttcaccggtgccgatctgcgcggcgccgacctgcgcggggccgacctgaccggcgcactgttcctggccgcgtcacagctgcgcgccgcaatgacggacgacgatcccctctaa

SEQ ID NO: 3694 - DNA, 1212 bp, Actinoplanes utahensis
atgcggcatgtgtcgggcctggtgtggctgtcgacggttctcgggatcgtcggtctgctgctcttcgacttcttcgtccacgtccggcgggcgcacgtgccgaggctgcgtgaggcggcactgtggaccggcgtctacgtcagcatcgcgctgctgttcggcgccgggatctgggtggtcggcgggtccgggatgggccaggagtatttcgccggctacgtcaccgaggaggcgctctcggtcgacaacctgttcgtcttcctgctgctgctcggcagcttccgggtgccccgcgccgaccagcagaaggtgctgctcgtcgggatcgccgtgtcgctggtcgcccgcaccgcgttcatcctggtgggcgccgcgctgatcgactcgttcgcctgggtcttctacctgttcgggctgattctgctgctcaccgccggcaatctggtgcgcgggaaggccgggggcgagcagaccccgccggacaacgtggtgatccggctggcccgccgggtgctgcggaccaccgatacctacgacggcgacaaactggtcacctaccgggacggcaagcggatgctgaccccgatgctgctcgtgatgatcgcgatcggtggcaccgacatcctgttcgcgctcgactcgatcccggccatcttcgggctcacccagaacgtctacctggtcttcaccgcgaccgcgttctccctgctcggcctgcgccagttgtacttcctgatcgacgggctgctggaccgcctggtgtacctgtcgtacgggctgtccgcgatcctcgccctgatcggggtcaagctgatcctgcacgccctgcaccggaacaacgtgccgttcatcaacgccggtgagcacatcggggtcaccgagattcccaccggcgcctcgcttgccatcatcgtcggggtgctgctggtcaccgtggtggcatcgctgctcagtccacgcggccgggcgcagacgtactcggcggcggcccggcggcgcgccaccgagttcctcgagatcgagaaggatccggcctactgcgacgaggtgtaccacctgcttctcgacgaggagcggaacctgcagagcctgccggcgcggtaccggcagcacggcgacctgaccgacctgctgcgccgggcgcaccgggtgcacgccgagcgggtggcggccggccgctgctacgtacggcccgagccgtctgcggcctga

SEQ ID NO: 3695 - DNA, 957 bp, Actinoplanes utahensis
atgttccaccagcacttcctgtccgctccgggcaccgacctcggaccgctggacagcggcgagcgggtgctctggaaaggccgctgcgcggccgcggagtacgcgttcgacgaggcgtcctcgctaccgcgctggaccctgccggaagagaccgaggtcctggtcacggaccgccgggttcgctatacgtatgcggacgagagcacggtgcgtaatggcgagttgttctggctctggccgcagcacctgcgtgtgcagccgggcaaccgggacgccggccgcaccgccacggtgacccagatccagctggtctgcaacgggccggagggcagtttcccggccctggtgttcgccggcggcgacctggccacggtgggcgacgcggaccgtctggccaacgtgctgcgtcaggcgatcgcccggttccgggtggagaacgccacggagatcggggtggcgccggcgcacgcgcggatgctgtcgcgtcaggtgatcgggcccgagttcaccaactatcagggcggtgcggggcagacggtgacgctgctgggcgcggtcccggtgcccgccccggagcccgcctaccccgagccgatctacgccgaggccgtctacgacgagccggcgtacgaggagccggtctaccgggagccggtgtacgaggagcccgtccgtcaggagccggcctatcagcagccggtctccgggatgccgatctccgcctcccgcgggtacggcgagcggcccggactggccgccgacgccgagcgcgccgagcaggcgttgcgcgccgagcaggattcccggcaggcccagcccgacctcgcctcgcgcgcgtccagcctggccgcccggatcgccggtctggtcgccggcaccgacgaggacccgttcgggcggaccgccaacctgtcgtcctacctgaaccgtccggacgacgccgcgtccggccgctga

SEQ ID NO: 3696 - DNA, 852 bp, Actinoplanes utahensis
atggcacagcgcagggcatcgcgacggcgggtggagacggtcgcctcgggcgtcgcggagctggttccggacccggaccgggacaccgcgttcaccctgctgctggacggcgcgccgcagtcgcacgtggacctggccgacccggcgtacctgcagttcgagtacgtgcggcggatcgccgcggcgatcgacctggtggccgccccgggccggccgctgcgcgcgctgcatctgggtggcggcgcgctgaccctgccgcgctatctggccgccacccggcccggttcggcgcagcgggtggtcgagatcgacgggccgctggtcgagctggtccgccgggagctgccgctccccgcgcaggcgaacatccgggtccgggtgggtgacgcgcgcgaggctgtcgagggcatgcgcgacggcgggtacgacgtgatcgtgctggacgtgttcgccggcgcccgcaccccggcccatctggcctcggccgaattcgccgcgcaggtggcccgggtgctggccacggacggctggctgatcgccaacatcgccgacggcccgccgctgcggcacgcccgcgcccaggtcgccacgatccggtcggtgttgccccaggcctgtctggttgccgacgcgtcggtgctgcgcggccgcaggttcggcaatctggtggtgctcgccggtcgcaccccacccccggtggccgagctgacccggcgagccgcgggcgactggttccccgggcgggtggagaccgacctggagcgattcgcggccggggcggtcccggtgccggacgccaccgcgacagcgtcacccctgcccccggccggcctgttcgataaccgaaagtaa

SEQ ID NO: 3697 - DNA, 1635 bp, Actinoplanes utahensis
atggtggcgcgggaaacttccgactgttcctccgtgacagttgccgagcagaccctgaaccggcgtaccgcgatcggcggtgcggtcgcggccggcgccgccgccgcgctcaccacgggtacgcccgccctggcctcctccaccgccggccccggcctgcgcaccgcggtcgaaccgggtgtggtgatcgaggacccgggcgtcgccgggctccttcccgccgaccccctgctgcacctgctgcggcgggccaccttcgggcccggcccggaatccatcgccgagatccgcaggctgggcgcgaccgcctggctggaccggcagctcgaccccggctcgatcgacgacccggtcgccgacgagctgatctcccggctgccgctgtgcgggctgagcatcaccgacatccacgcccgggtcaccgccggacagctgaagctgcacgactggacgccgatgtggcagctgtcgttcgcggcgccgatccgggccatctggagcaggcggcagctgttcgaggtgatggtggacttctggtcgaaccacctcaacgtgacctgcccgtccggcgacgtgtgggacagccgcaccgactacgaccgggcggtgatccgcaggtacgccctgggcagcttcgccgacctgctcaaggcctcggcccggcacccggcgatgctcacctacctggacaaccggttctccacccggcaggcgccgaacgagaactacggccgggaactgctggagctgcacaccgtcggactgggctacaccgaggcggacgtcaaggacgcggcgaagctgctcagcgggatgaccgtggacaacaccaccggcgcctaccggtacgacgcggccaaccacgtgaccggcccggtgcggatcctggggttcagccacgccaacgccaccaccaccggcggcgaggcggcgaccctggccttcctcgactacctggcgctgcacccgtccaccgcccgccggatcgtcaccaaactgtgcgtccggttcgtcgccgacgagccgtcgcccgacctggtcaccaaactggtcaaggtctatctggacagccggtcggcgatcgcgccggtgctgcgggcgctgttcaccgcgcccgagttcgccgcggcgatcggggcgaagacccgcaccccgctggaggacctggcggccacggtgcggatcctcgggtacggaccgccgccgagcgggaccaagtcgttcgagtcgatctactggatggcccgcaacgccggtcacgccccgctgctctggggaccgccgaacggctacccggatgtcgccgccgcctgggcgtccccgtccggcctgctggtgcggtggaacttccacctgtcgctggccgccggttactggccgaccgacctggtcaagccggccgacctgctgaccgcgatgatcggtgcccggccggccacctaccaggcgctgatcgacgcgaccgcggagcgactgctcggggtgcggctcggccccgaccagaccgccgcgctggccgccttctacggcaagacaccggcctcgccactgaagtacaacgatcccgcggtgggctggatgtacccgtacctgatgacgatgctgctgaactcgcccaatttcgccctgagatga

SEQ ID NO: 3698 - DNA, 1260 bp, Actinoplanes utahensis
atgaggacgactgtgacctgccgagagaccctctcccgccgccggctgctggccgccggggccgcgggcgcgttcgccgggctggccggctcgcagctcgacacccagctcgccttcgccgccgacccggcctactccggtgacgtgctggtgctgctctcgctgcgcggcggcttcgacgggctgtccgcggtggtaccggccggcgacccggcctactacaccgcccggcccaccatcggggtgccgaagagccagctgatcggcgccggatcgttcttcgggctgcacccggcgctggctccgctgctgccgttctggaactcgggccggttggcggcgatccaggcggtcggccagccggccccgaaccggtcgcacttctccgccatggaggagctggagcgggccgccccgggcacctcgctgcgcaccggctggctcaaccggatgctcggcaccctgcacgccggcgaccccttcgacgcgatcgcgatgggtaccgcgcgcccggcccgggtgctcgccggcccggcgccgtacctcggggtcacctcggtggacgggctcgcgctctccggcgacgacgccaccaagccgctcgcggccaccatggcggcgctctaccgcggcgcgccggccgggctgaccggcccggtcaaccagctcaccggggcgctggcccgggccaaggcgttgaaggcggccgggtacacgccggccaacggcgccgtctacccggccaccgacctgggtggggcgctgcgcgacgtggcccggctgatcaaggcgcgggccgggctgatgaccgccacggtcgactccggcgactgggacatgcacgagaacctcggcatcgcccagaccggccggcggatgcacgaccagctggcccagctggccgcggcgatcgcggcgttcgccaccgacctcggcgcggacggcctgcgccgggtcaccctgatcacgatcagcgagttcggccggcgggtggcgcagaacggctcggccggcctggaccacgggtacggcaacgcgatgttcgtgctcggcggcggggtgcgcggcgggcaggtctacggcacctggcccgggttgagcccggcccagctctgcgacggcgacctggcggtgaccaccgactaccgggcggtgatcggcgagatcctccggacccgctgcggggtgggcgacgtggcctcggtcttcccgggcgtgacgccgtcctcactggggctggtttccggcattaccggataa

SEQ ID NO: 3699 - DNA, 381 bp, Actinoplanes utahensis
gtgacggtgaccagcaacctgttggccgagctcatcggcgggcaacggcgcccgcccgggccgccgccggccatcgcgatgccggcgatcctgcatgcggccaagcaccgggccgggccaccgctgaagatccgccggcacacctccgaggagggcctgccgttctggcgctgggactgcgacagctgcggggagtacggcggcggccggcaccatccggacgccgtcagccgcgccatgcggcactgctcggagcacccgcagcaccgctcgtcgctgctcccgcccgcgtcgtgccgcaagccggacacgttcctgccgttgcaccccatgctgtacgccctcgacgacgacccgccgccggagccgctgaacatctga

SEQ ID NO: 3700 - DNA, 180 bp, Actinoplanes utahensis
atgagcttcctggacaaggccaaggaattcgccgaccagcacgacgagcaggtcgaccagggtctggagaaggccggcgagcagatcgaccagcggaccggcgacaagtactccgagcagatcgaccgcggggtgaacgaggcgcagaagcggaccggggccggcgacacccagccctga

SEQ ID NO: 3701 - DNA, 1917 bp, Actinoplanes utahensis
atggacgcgcgactcgaggcgctggccgcggcacacggggtggccacctggtacgagaactaccagcgcaagcggaccgaggtggcccccgagtcggtgatcggggtgctgggcctgctcggcgtcgacgcgggcgacccggcggccgtgccggaggtcaccgcgccggaggtccccgggaccatcgtgctgcgcgaggggcagagccgggacctgccggcggccgccgagctcaccctggaggacgggaccacgcgcaccgtcgaccggctggccgggctgccgctgggctggcaccggctcggcgaccgcaccaccgtcgtggtggtcccggccgagctgccgaaggcgccggtcacctggggctggatgctgcagctgtacgcgctgcactcggccgagtcgtggggcatcggcgacctgggcgacctgcgggccttcgtgtcccagtgcggggacgccgggctggtgctgctcaacccgctgcacgcgatcacgccggtgccgccggtgccggcctcgccgtactcgccgtccagccggcgcttcgcgaactcgctctacctgcggatcgcggacacccgggagtatcagcgcgcggatgtcgacgtacagaagcgcattgatgcccttaaaccggagaccggcgaactgatcgactacaccgcggtgtggaccgcgaaactcgccgccctggaactcctctggccgctcgcggagcccgtcgacctggacgccgatccgggcctgacggatttcgcccgcttctgcgcactcgccgaacagcacggcccgaactggcagacctggccggaagagctgcgccaccccggctcccccgcggtgcgggccttccgcagcgaccggatcgccttccacgcctgggtccagcacctggtcgaggagcagctggaccgggcccgggaagcggccgccgggatgccggtcggcatcgtccacgacctggccgtcggcatcgacccgaccggcgccgacggctggctgctgcaggactcgctggcacccggcgtccgggccggcgcgccgccggacgcgttcaaccagctcggccaggactgggggctggccgcctggcgcccggaccggctgatcgccaccggctacgccgcctatcgggacatgctgcgccggatcttccggcacgccggcgggctgcgcgtcgaccacgtcgccgggctgtggcggctgtggtgggtgccaccgggcatgggtccggccgagggcacctacgtgcactacgacccggaggcgatgctcggcatcctggccctggaggcgcagcgcgccggcgccgtggtgatcggtgaggacctgggcaccgtgctgccggagatgaccgagacgctggaacggatgaacatgctcggctcgtccgtgctgtggttcacccgggactgggacaccggcgagttccggcccgcggccgactaccggcgcaacgcgctggccagcatctccacccacgacctgccgaccgccgccgggttcctggccggcgagcaggtggaggtccgcgcccggctggggcagctggccggcaccgtcgagcaggagtgggcgacctggaaggcggacaaggccgcgctgctggagctgctgcgcgccgagggcctgaccggcacggacccgaccagcgaggaggtggtgctggccatgcacgagttcctggcccgcaccccgtgccggctggtcaccgcgtcgctctacgacgtgctgctggaacgtcggcagccgaacctgccgggaaccttcgacgagtaccccaactggcggatcccgctcggtccggacctgtccgaggtggtgaaggatccgatcttccgcaaggttgccgggattctgggtaagcggaaggccgagacaggtcagagattgacggaagggaccacgccatga

SEQ ID NO: 3702 - DNA, 381 bp, Actinoplanes utahensis
gtgccgcggccagcgcctcgagtcgcgcgtccatgcgtttccctcccgtcggtccccggtcagtacccggctgatcggtggttactccgggtgcggtcgttgcttccatccgccagcatggggcacatggctcacatggtgaagtggtggacccggctggccgcggtggtgtccggcgcgatgctgaccctggtgatcccggtgcacgcctgggcggccggcaacgggacgtccgaggtggcggtcgaggcggcccgccgccgctaccggacccgaggcggtttcgggttcctcttcggtggtgggctgtgctgcctgttcgtgattgccgcgatcgtgttggtgatcgtgttgatttcgcggaatcgcaagcgccgctga

SEQ ID NO: 3703 - DNA, 1227 bp, Actinoplanes utahensis
gtggcagtcggttgcgggatcgcggccgtcctcagcattccgccggcgatctcggtcgccgcgaacgcctccgccgacgtgctgctcagcatcggccgcccggccctcgcctcgtcgacgctgagcgtggcctggctggcctccgccggggtggaccggggcgtcggcacccgatgggccagcggcgccaccgacggcaccgaatggctgcgggtcgacctgggcgccgcgcaggaggtcacccgggtccggctgcactgggcgcaggcgtacgcccggggctatcgggtgcaactctccgacgacggggcgacctggaccgacatgtaccggaccgaggccggcgacggcggcgtcgacgacctgcgcggcctgcacgggcacgggcgctacctgcgggtgctggccacccggcagggcaccccgaacggatattcgttgtgggacgtgcgggcgtacgggccgggcccgtacgcccgggtgcccgagtccggtgcgacaccgggcgccggggtgccgccggccgcggccgcgctgaccgcccacgccaagaaggagaccgcgttccagctcgtctccagcgcggagaactcgacgctgaactggcgcggcgagtacggctacctggaggatctgggcgacggccggggatacaccggcgggatcatcggcttctgctcgggcaccgacgacatgctggccgtggtcgccgactacgtgcgccgcaagccgtcgaacgtgctcgcgccgtatctgccggcgctgcgcggggtggacggcaccgactcgcaccggggcctggacccgggcttcccggccgcctggcgggcggccgcgaaggacccggtgttccagaagacccagcaggacgcccgggaccggatgtacttcaccccggccgtgcacctcgccgagtcggacgggctgcgggcgctggggcagttcgcgtactacgacgcggcggtgatgcacgggatctccgggctgcgggccatccgcgagcgggcggtccgggcccggagcacaccgtctcagggtggggacgagatcagctacctggaggccttcctggactcccgggacgtcgagatgcgccaggaggcggcgcacagcgacaccacccgggtcgacaccgcgcagcgggtcttcctgaaaggcagcaacctcgatctcgacacgccgctgacctggaaggtctacggcgacagctacaagatcagctcttga

SEQ ID NO: 3704 - DNA, 1239 bp, Actinoplanes utahensis
atgcgcaagttacgaatgttgctcggtgcggcgatagtcgccaccacgctcgcgtcctcgctctacgtctcgtcccgcaacgacaatgcggacgccgcggtcgtctggaacgaggacttcaacggcgcggccggcaccggcgtcgacacgtcccggtggaacttcgacaccggcggcagcggcttcggcaaccaggaactggagtactacaccagcggaaccggcaacgtcgcgatggacggccagggccacctggtgatcaccgcccgcaagggcagcggcggacacaacgactgctggaacggcacctgccagttcacctccggccggatccagaccgccggcaagttcacccagcagtacgggcacgtcgaggcccggatccaggtgcccaacggctccggcctgtggcccgccttctggatgctgggcggcaacaactggccgaccgacggcgagatcgacatcatggaggtcgtcggccgcgacccgaaccggctgttcggcaccctgcacggccccggctactccggcggcagctcgtacggcggccagcttctcgccggcgcgccgtggtaccaggcgttccacaactacgcggtggactggtcgccgaacctgatcgtctggaccgtggacggccaggagtacttccgggccaccccggactcgctgcacgccgccaagggcaacgtgaactgggtctacgagcacccgttcttcgtcatcctcaacctggcggtcggcggcaacttcggccagggcaacccggccgggctgccggccgagagcaggatgctgatcgactacgtgcacgtgagcacctcgaccacgccgaccacgccgccggccaccaccggcaacgcgctgaggagcaacctgaacggccgctgcatcgacatccccgggtccaacccggtcgacggcgcgcgcctgcagatgtacgactgcaacggcaccggcgcgcagaagtggaccttcaacagtgacggcacgctgcgggcgctcggcaagtgcatggacccggccggcggcgcgctgaccaacggcaccccgatccagctggtcgcctgcaacggcaacccggtgcagcggttcaccctgtccggcgccggcgacctggtcgacgtgtcggcgaaccggtgtgtcgacatcaaggacaacaaccgcgcgaacggcgctcagctccagctctgggactgcgccggcaccgcgaaccagaagtgggtcaagagctga

SEQ ID NO: 3705 - DNA, 723 bp, Actinoplanes utahensis
atgggtcacggggtgcgctggctgcggccgttgctggcggccgtggtcgccgccggcgggctgaccgtgcccggggtcgcgcacgcgtcgacggtcagcagcaccgtgttcagcgacggcttcggcggtgaccggttcgccccggtcgacgcgggccggtgggtgggcgacacccgggacgcctggctggacggtgacgggcacgccgtggtcggctcgtggctgctgaccgcggcgactttcggtcagtccggcgggcacgcatcggcgcggatccggaccggccggtggggcgccgcctggcaggcgctcggggtgctggggccggacggcggcgggatctccgggcaggccgagtcgctcggcgaccgggacaccgccgacggggatttccacacctacgcgatcgactggacccgcacgtcgttcgtctggtcgatcgacggcgcccaggtgctgcggctcaccccggacgacgccgggcagccgttccggctggcgctgaacctcggcggcggcgggcggtactcggacgcgatcgtggtcgactcggtgagcgtgtcggtgcgggtgacgctgaagccgggctggaagccgttcaccacctaccgcatcggcgatcaggtgagttaccggggcgccaactaccgggtgaaggcgcagcacacggccctgccggggtggcagcccgggctcgtaccggcgctcttcgaaaaagtttaa

SEQ ID NO: 3706 - DNA, 552 bp, Actinoplanes utahensis
atgcgagacaacgactaccccaccgaagtgagcgatccggaggcctcgggcctgccggacaccgccgacgacgactccaccgcgtacgacgaggtggacagcggccgatgggccgacggcccggacccggcggcgctcgccggggtcggcccgggcggctcgaaccggttcggcgacaccgcggaggaggccctgcagggcgaggggctggaccggcggctgcgccaggaggagccggacttcggcgccggggacaccggcggggcggaccgcgacccgatcgacgagacggtcgacgaccccgagcagcgccggctggaccgggacgtctggggggagagcccgacctcggacccggattccccggtctcgctctacgacgacggccagctcgacgacgacagcccgggccgggtgggccggctggtcgccccggacggcgggtccggcttcgacgacgaggcggacagcgtggcgtgggacgcgggcgcggccggcggtggtgccagcgccgaggagctcgccatgcacgagacccacgagctggactga

SEQ ID NO: 3707 - DNA, 729 bp, Actinoplanes utahensis
atgcacaatggagcgatcatgccgagcgaggttcgtcagctggtggaccgcggccagagttatcccctggtccggctgaccggggtgctcgacgcacggacctccgggtcggtccgctccaccctgctcgacgtgctcgccggtcagccggaggcggtcgtggtcgacgtgaccggcctgcagccgccccgcgaggaggccctggacacgctgcgcgcgctgcgcgaggagacccgggactggccggccgcgcggctcgcgctctgcggcgcgcagagcccgctgtggcagccggccggctggccggtctggcccgacccggagagcgccttcgcggccctcggcacgcccggcgccgggctgcgggtcagcctggacctggaaccggtgagcggggccgcgcgccgggcccgggagctgatcaccgagacctgcctgcgctggtcgcgggccgagctggccggggacgcgtgcatcgtggccaccgagatggtgaacaacgtggtggcgcacgtccgcaccccgatgcgggtgctgctggcccggctcggcgagacggtgagcatcgcggtccgggacggctcgccggtgctgccggcgttcaccgggccggtcgcccccaccgcgtacggcggccggggcctgctcctgatcgatgcggtggcggtccgctggggccggctggcgctgcctgacggcaaggtcgtctgggcccatctgaacgcgtaa

SEQ ID NO: 3708 - DNA, 735 bp, Actinoplanes utahensis
atggcccgattccgggcgctcgacctgaaggtggaggccaagccggatctgacgccggtgtccgacgcggacaccgcggtggagaaggcgattcgggcgaccctggcccgggcccggccgcgggacagcgtgctgggcgaggagttcgggcggtccgaggcggcggccggcccgggcacccggcactgggtgatcgacccgatcgacggcaccaagaactacgtgcgcggggtgccgatctgggccaccctgatcgcgctgatggagggcgacaccccggtggtcggcctggtctccgccccggcgctgggccggcgctggtgggcggcgcgcggcctgggcgccttcgccgggaggcatcagcacgccgcgacccggatcggcgtctcccaggtgcgccggctcgccgacgccagcgtctgttacgccagcctgaacggctggcaggcgaacggccggctgccgcagatgctggacgtgctgctcggggtatggcgcagccgggcgtacggcgacttctacggctacatgctgctggccgagggcgcgctggacgcgatggccgagccggaactgtcactgtgggacatggccgcgctgatcccgatcatcaccgaggctggtggcaaggtcaccgatctcgacggacgggtctgctccgacaagtcgtcggtgatcgccaccaatggcctgctgcacgaaagcctgctcaccgctctgaccccccggggttga

SEQ ID NO: 3709 - DNA, 1128 bp, Actinoplanes utahensis
ttgtacgtcgaagacgttgcccgagttcccggaactctgggcgggactcacgacagggagttagttctgccagggcgtaagcgggagtacgacgaggacgacgtgcgggtgcggccggggcggtcgtcgcgcccgcgcacccggacgcgtcccaagcacgacgacgcggtggacgcgctggtgatcaccgtcgaccgcgggcggtacgggtgtgtccaggaggacaccggggccgaccccgaggtgatcaccgcgatgcgggcccgcgagctgggccgcaagtcggtggtggtgggcgatcgggtggccctggtcggcgacacctccggcgacgccgggtcgctggcccggatcgtccggatcggcgagcgcacctcggtgctgcgccgcaccgcggacgacgacgacaccacgcccgaggggcggctggagcgggtcgtggtggccaacgccgaccagctggtgatcgtcagcgcgctggccgacccgccaccgcgcaccggattcatcgaccgctgcctggtcgccgcgtacgacgccgacatcgagccgctgctctgcctgaccaaggccgacctgtccggcccggagcaggtgctcgactactacgccgagctggacctgccgcacgtgctggtgcgcccgggcagtgacctggccgagctgcgcgagcggctggccgggcgcatctcggtgctggtcgggcactccggggtgggcaagtcgacgctggtcaaccgcctggtgccggacgcgttgcgggcggtcggcgcggtcagcgcggtgggcaagggccggcacacctcgaccagcgcggtggcgctgcgcctgccggccgtcggcaggtcgcgcaaggatccggggtggatcatcgacaccccgggcatccgcagcttcgggctcgcccacgtcagcgcggagagcctgctgcacggcttccccgacctggtcgagggcaccctggaggaccagccgaactgcgggcacaccgccgccgacacggactgcaggctcgacgcgtgggtcggcgaggggcgcgcggaccggcggcggttagactcgtaccgccgcctgctgtcctcaagagccggcgatctggactcgcgagatcacccggccgacgagtga

SEQ ID NO: 3710 - DNA, 1443 bp, Actinoplanes utahensis
atgagacgcagcgtacgccggtggaaacggtggccgcggacccggaacgccgtggaaatggtggagtcgcaacgatcacccggcgagaatcgctcgccgcgtcccgggaggcgggaacgcgcgccggaaatgtcggcgggcggcggcagaatggcctccatggctgctgaactccgcccctggctcgccccgtccgccgccggcccggtcaccaccaccgtgcgcctgcccggctcgaagtcgatgaccgcccgcgcgctggtgctcgccgcgctggccgacggtccgtcggtgatcgaggcgccactgcgggcgcgggacaccacgctgatggcgaccgccctgggcgcgctcggggtggccgtggacacctcgggcggcgacagctggcgggtcgagccgggcccgctgaccggcccggcccggatcgacgtgggcctggccggcacgatcatgcggttcctgccaccggtcgcggcgctggccgagggcaccgtcgagttcgacggcgacccgcacgcgcgcaaccggccgatgggcccgatcctcgacgcgctgcgcgccctcggggtgcggctggacgcgtcgccgaccggtgggctgccgctcaccgtgcacggcgccgggctcatcgagggcggcgcggcggtggtcgatgcctccggctccagccagttcgtctccggcctgctgctgtccgccgcccggttcaccaaggggctgaccctgcggcacgagggcccgccggtcccgtccgccccgcacctgcggatgaccacgcacatgctgcgcgcggccggcgccgtcgtcgacgagagcgtgccggacgtctgggtggtcgagcccggcccgctgcacgggcgcacctgggtgatcgagcccgacctctccggcgcgctgccgttcttcgccgccgccctggtcaccggcggcacggtcaccctggccggctggccggcgcagagctggcagccggtcgggcagctgaccgacctgctcaccgcgttcggcggcgaggtcacccgatcggcggacgggctgaccgtgcgtggcaccggcacgctgcacgggatcaccgccgacctgtccgaggtggccgagatgaccccggtgctgtccgccctcgcggtgctcgccgacgggccgtccgagctgcgcggcgtcgagcacatccggggccacgagaccgaccggatcgcggcgctcgccaccgagctgggccgggtcggcgccggggtgaccgagttcccggacgggctgcggatcgagccgcggccgctgcacggggcctcgttcgagacctacgccgaccaccggatggcgcacgccgccgcggtgatcggactctccgtcccgggcgttcagctcaccgacgtaggttgtacgtcgaagacgttgcccgagttcccggaactctgggcgggactcacgacagggagttag

SEQ ID NO: 3711 - DNA, 816 bp, Actinoplanes utahensis
gtgcctggcctgggcactacaggtcggcgactgccacggcgtctggggcggcaccacgccccgcgagcggcgggccatgctggtcgcctggcgcgagcgggtccagccggacggcgagccggtcgacgacggcgccacggacgacgaggaccgccggttcctgacgttggaacccgccagccgctgacagaatcggagcttgtgtccagctccgagcacatcgtcgaaacgccgcgcgggccggcccgggtccggatcaccggcccggccggcccggcgcgcgcccagctgttcctcgggcacggggccggtggtggcgtggacgcgcccgatctggtcgccgtgcacgacgccgcggtcgcggccggggtgcgcgtgcttctggtgacccagccctaccgggtggccggacggcgggcgccggcccccgccgggcacctcgacgaggggtgggccgcggtggtgcgggcccacggcgtacccggaattcccctgatcgtgggcgggcgcagcagcggagcgcgggtcgcgtcgcggaccgcggccgacctgggcgccgcgggggtgctggccctggccttcccgctgcacccgccgggcaggccggagaagagccgggcggcggagctgccggccgggatccccacgctggtggtcaacggcgaccgggacccgttcggggtgcccgggccgggcggcgcggtggaggtcgtggtgcggcccggtgcggtgcacgacctgcgcaaggatcttccgggcaccgtggcggccgtgctcgggtggcttgcacgacacggctgggccgcggaattctga

SEQ ID NO: 3712 - DNA, 747 bp, Actinoplanes utahensis
gtgcgggaacttctggatgctccggagtggccggccaccgagccggcgcccgccgccgccccggtgagcgtgagcacaccggttttcgagagcgtgactggggcactacccgtatcctcggcggggcggtcgaggggggagtccagggtggcccagaaagagcgtgtcgacgagcgtcgcgagcgcttcgagcgcgacgcgctgccgttcgtggatcagttgtacgccgccggcctgcgcatgacgcgcaatccggccgacgccgaggacctggtgcaggagacgttcctcaaggcgttctccgccttccaccagttcgaggagggcaccaacctcaaggcctggctgtaccggatcctgaccaacacctacatcaactcgtaccggcgcaagcagcggcagccgctgcagtcgccgaccgaggagatcaccgactggcagctcgcctccagcgagtcgcacacctcgaccggactgcgctcggcggagaccgaggcgctcgaccggctcccggacagcgacatcaaggaagcgctgcagtccctgccggaggacttccggctcgccgtctacctcgccgatgtcgagggtttctcgtacaaggagatcgccgacatcatgggcacgcccatcggcaccgtcatgtcccgcctgcaccgcggccggcgcaacctgcgccagctgctcgtcggatacgccgccgaccggggcatcacccgggccgcgtccgagccgcaggaggcgtga

SEQ ID NO: 3713 - DNA, 285 bp, Actinoplanes utahensis
atgccgagcgacgagaccgaacacgagaccgattgcagcatcgtgctcagcgaggtgtatctctacctcgacctggagtgcagcgaggaccgccgccgcctgatccagaaacacctggacgagtgctccggctgcctgcgcgagttcggcatcgagcacgaggtgaaggcgttggtcggccgctgctgcggcgacgagcgggcgccggccgagctgcgcgaccggctgcgcgtcaagctggtccagctggaggcccagaccgagacccgggagtaccttccgtaa

SEQ ID NO: 3714 - DNA, 75 bp, Actinoplanes utahensis
atggccaagaaggctcgcaagaagaaggcccgtaagaagagcggcgcgaaccacggcaagcgccccaacagttaa

SEQ ID NO: 3715 - DNA, 216 bp, Actinoplanes utahensis
atggccgaagaagtccgtgccgagatggtggccaacgtgtggaaggtcgtggccggcgtcggtcaggccgtggccgagggcgacaccctggtgatcctggagtccatgaagatggagatcccggtggtggccgagtccgacggcacggtgggcgagctcgccgtgcacgagggggacgtggtccaggagggcgacctgatcgcggtgatcaactga

SEQ ID NO: 3716 - DNA, 1542 bp, Actinoplanes utahensis
gtggacgcccaccccccggtcccgcacgacctcaccctcgcccgcgccgccctggacgccggcgagatgagccaggccgcccgccacctggccggggcgctgccccacgcacccaccctgccggagatccacgagctgctcagccgattggcggcccgggccgacggcgcgctggacctgttcccgctggagccgcacgccccggccggccgggtggccgcgcacgcacacctgctcgccgcggccggccgcccggaggacgggctggccctgctcgccgcggccagcgggcacaccccggacgtcgactgggccggggtgccgtgggtcagcgacccggtgctcggcggccggatcgacccggacgcactggcccggacggtgatgcggctgtgcaccgcggtcggcgacccggccccggcggcggccgccgagcccctgcgcccctacctgaccgtggtccggcacaccgtggccgcgcacggcgagcacgcgatgctgctgggcgccggctcggcgctggcccgtcggctgggcgaggcccggctcgcgatcgactgggcgacccgcggcgcccgctcccggccgtccaagctcggcgagatctggctgggctacgcgttccgcagtgccggccggatcccggaggcgctggccgcgctgcgccgggcggtcatgtacgacccggacgacctgtccgtctacgccgacgtggcggccaccctggccgacctgggccggctcgacgaggcactgagctggaccgaccgcgcgctggaacgcgacccgcggttcgactgcgtggtgcacaccgcgcagcggctgcggttccgcgccgacggcgaggtggcccacctgatcgcgctcgccgacttcgtccgcgaccacccggacgacacgcacgagcacaccgacctggacgactgctgccgggacgtgccgtggctgagcgggctgccggcctcgatgtcccggctggctcccggccgccccacagtcaacggcgatccgtcaccggacgcgcgggaccggctgctgcgggtcgcctcgaccggctggccgcacccgccggccgcctacgaccgggcgctgggcctggtcctggtcgagccgtgggagctgctcgcgctgctcggccatcccgcggtgaccggcgcggccgacccgggcgccgccgaggtctgggcctgtctcgggctgctgcaccacggttccgaggaggcgtggctggactccacccggcgtcggctgctgctcggcctgctcgacggcgaggtcgaccgggtcacccaggcggcgctgttcgcgctggtcacctacgcctgggtggatccggaggcgcgggccgacgtggccgccgtggtggccggccgattcgccgaggtggccggtgggccgcacgcccgggcggtcgccgagctggcgctggccaccccggagctggcccggccggcccgcgagctggccgcggccaccgtccgcacgccggtcatcccccgccagcgcagccgatcctacctgctgcgctggctgaagaaatga

SEQ ID NO: 3717 - DNA, 1038 bp, Actinoplanes utahensis
atgacagagcgaggccacgggatggcagcggacatagcggagcagccggagggattcgcccgcctgctcgacgggccgcacgccgacgcgatcgccggagtcgccgcggagatcgcggcccgccgcccgcgcaacgtgctcttcgtcggccgtggcacctccgaccacgccgcgctttacggggcgtacctcaccgagatccggctcggtctcccggtggccagcgcgtcgccgagcgcgatcaccctctacggcgcccggcccgacttcaccggcaccctggtgatcggggtcagccagagcggcggctcgcccgacctgaccggcgtgctctccgccgcccgggagaccggcgcgctcaccctcgcggtcaccaacaacccggagtcgccgctggcccgggccgccgagctggccgtcgacgtggccgccggacacgagcgcgcggtcgccgccaccaagacctacaccgccgagctgctcgcgatgctgctgctggtcgagggcatccgggccggcgacgggcggctgcccgccgaggagcgggccgcgctggccgggctgcccgcgctggccgccggggtgctcgccgaccacaccgccgaggacgtggcccagcgctaccggttcgcgccgcacatggtcaccaccgggcgcggctacgcctacccgaccgcgcgcgaggcggcgctcaaactgatggagacgtcgtacgtgccgacgctggccttctccggcgccgacctgctgcacggcccgctcgcgatgaccgacaccgacgtgccggtgctggccgtggtcggcggcggccccggcgggaggtcgatggccgacgtgctggcccggctcgaggagcgcaaggccgacgtgctcaccgtcggcccggccggcaggctggccgtcccgcccgtcgacgagcggtacagcccgctgctggacatcctgccgctgcagaagctggcgctcgcactggcgctggccaagggcgaggacccggacgccccccgcggtctgaagaaggtgaccagcacgctttag

SEQ ID NO: 3718 - DNA, 1539 bp, Actinoplanes utahensis
gtgtccaccctgcgcgatctcgtcgaggaacactccagcctgggttccgccgacatcgaccacctgcaccgcctggccggcgactggcagctgctctccgacctgtccttcgccgacctgctcctctgggtgccggtcaagggcgacaagccgcgggagttcgtctgcgtggcccaggtgcgcccgaccacggcgcccacggcgtatcaggacgaccaggtgggccggcgattcggcggccccgaggtggcccacctggaggtcgcgttcacccaggagcggatctggcgggagggcgacccggtctggtacggcgacaccccggcccgccacgaggccatcccggtgcgccgccgcgacgagaacgaccacgaggagggctacagcgaggtgatcgcggtgatcggccgcgacaccaacctgagcaccgcccgcacccccagccagctggagctcaactatctgaccaccgccgacgacctggcccagatggtcgccgacggtaccttcccgccggcccggcagcccggcgagatgaccacctcggcgccccgggtcggcgacggcctgatccggctggacgcctccggcaaggtcacctacgccagcccgaacgcccagtcggcgtaccggcggctcggcttcaacgcccacctggtcggcgaggagctggccgggctctccagccggctggccgccgacccgctggagggcaacgacgtcgccgagcggatccgctcctcgctgcgcggcgagttcccgccgcggatggagttcgaggcgcgcggcgccaccgtgctcacccgttcgctgccgctgctcccggccggcgtcccgatcggcgcgctggtcctggtccgcgacgtcaccgaggtgcgccgccgggaccgggcgctgatgaccaaggacgccaccatccgggagatccaccaccgggtgaagaacaatctgcagaccgtggccgcgctgctgcggctgcaggcccgccgggtggacgcgccggaggcccggatggccctggaggagtcggtccgccgggtcgcgtcgatcgcgctggtccacgagacgctgtcgatgtccagcgacgaggcggtcgagttcgacgggatcgtggaccgggtggcgaccgccgccaccgaggtctcggccaccagctttccggtgcacatgcgccgcgagggcaccttcgggattttgcccgccgagatcgccacctcgctcgtgatggtgctcaacgagctgctgatcaacgcggtcgagcacggcttcccggccggtgaggacgacgagcccgcccccgcgccggagcagccggccgaggtggtcgtcgccgcgcaccggttccgcaagcagctgcacgtcaccgtggccgacaacggtcagggcctgcccgagggcttccggccggacgccggccggttggggctgcagatcgtccgcgcgctggccaccggcgagctgcgcggcagcatcgagctgcgcaaccgggccggtggcggcaccgaggccgtgctggtggtcccgctcggcaagcgctga

SEQ ID NO: 3719 - DNA, 1692 bp, Actinoplanes utahensis
atggcgcccagcaacactcccgctacaccggccgcccgcccccgtaaggcgcgcggcgagggtcagtgggcgctcggacaccgcgagccgctcaatcccaacgagcgcagcaagaaggacgacaacccgctgaacgtgcgggcccggatcgagaacatctacgcccaccggggtttcgcctcgatcgacccggccgacctgcggggccggttccgctggtggggcctgtacacccagcgcaaggccgggatcgacggcggacgcaccgcggtgctggaacccgaagagctcgaagacgagtacttcatgctccgggtccgcatcgacggcggcgcgctcagcgtcgcccagctgcgcaccatcgccgacatctccaccgagttcgcccgcgacagcgccgacatcaccgaccggcagaacatccagctccactgggtgcgggtcgaggacgtgccggagatctggcgccggctcgaagcggtcggcctgcagaccaccgaggcctgcggcgactgtccgcgcgtggtgctgggcagcccggtcgccggcatctcggtcgacgaggtgatcgacggaacgcccgcgatcgacgagatcctgaagcggtacatcggcgacccggcgtactcgaacctgccccgcaagttcaagtcgcagatctcctggctggccgacgggccgtaccaggccaacgacgtctccttcgtcggggtcgagcaccccgaccacgggcccggcttcgacctctgggtcggcggcggcctgtccaccaacccgcggctggccgagcggctcggcgtctgggtgccgctggccgagatcccggacgtctgggagggcgtggtcgggatcttccgcgactacggctaccgccggctgcggcaccgcgcccggctgaagttcctgctcgccgactggggcgtggccaggttccgcgaggtcctggagaaggaatacctgggccgcgcgctgatcgacgggccggcgcccgacctgccggagaagccgatcgaccacatcggggtgcaccggcagcgcgacgggaagaactacgtcggcgccgccccggtcgtcggccggtcctccggcacccagctcggcaagctcgccgacctcgccgagcggcacgggtccgaccgggtgcggctcaccgcgtaccagaaactgctcgtcctcgacatcgccgacgagaaggtcgagaccgtggtcggcgagctgcgcgagatcggtctggaagcccgcccgtccacctggcggcgcggcaccatggcctgcaccggcatcgaatactgcaaactcgccatcgtcgagaccaaggcgcgcggcgaggaactcgtcgcccggctcgaggaacgcctccccggcttcgacgcggacatctccgtgcacctcaacggctgccccaacgcgtgcgcccgcacccaggtcgccgacatcggtctcaagggccagctggtcatgaacgcgcacggcgaacaggtcgagggcttccagatccacctgggcggcgcgctcggcatggccaagggggaaaccgccggcttcggccgcaaactgcgcggcctcaaggccaccgccgaggaattgccggcgtacgtcgagcgggtcgcccggaactaccgggacggccgcaccgacggcgagacgttcgccaactgggtgatgcgggccgaagaggagctcctcaaatga

SEQ ID NO: 3720 - DNA, 765 bp, Actinoplanes utahensis
atgagcatcctcaacgccaccggcctgggcctgatcaacctgggcgcgccgagcgcccccgctgaccccgcccgccgcagcgccgacgacctgcgcgcgctcgccctgcaggccgcgcaggacctggagggccggaccgccgaggagatcgccaagtgggcgaccgacaccttcggcgcccggttctgcgtcaccagctcgatggccgacgcggtggtcgcgcacctcttctcccgggtcgcccccggcgtcgacgtggtcttcctggacaccggcctgcacttcccggaaaccctcaaggtccgggacacggtcgcccgcacgatgaacgtcaacgtccgctcgatccgcccgcggatgaccgtcggccagcaggacggcgaatacggcccccggctgttcagccgcagccccgacgagtgctgcttcatgcgcaaggtcgagccgttggaacgggccctgaccgagtacgacgcgtgggccaccggcctgcgtcgcgacgagtcgccgacccgggccaacacgccggtcgtcgccttcgacgccaagaagggcaaggtcaaggtcaacccgatcgcggcgtggacccaggccgacgtggaccgctacatcagccggtggaacgtgccggtcaacgaactgttcaagaagggctacggctcgatcggctgctggccgtgcacccgccgcaccaaggccggcgaggacccgcgggccgggcgctgggccatgttcgagaagaccgaatgcggtctgcacgtctga

SEQ ID NO: 3721 - DNA, 255 bp, Actinoplanes utahensis
atggactggcgtcacgatgcgatctgccgcgacgaggacccggagctgttcttcccgatcgggacgtccggccccgcgctcctgcaggtcgagcaggccaaggccgtgtgccggcggtgccccgtgaccgaggaatgcctctcgtgggcactcgagtccggccaggacgccggcgtatggggcgggatgagcgaagacgagcggcgcgcggtcaagcgtcgcggcggccttcgcgtgtccgctcccaccgcttga

SEQ ID NO: 3722 - DNA, 951 bp, Actinoplanes utahensis
atgcgtgccttgctggtggtcaacccccgcgcgacgacgaccaccgagcgcggacgcgacgtgctcgtccgcgcgctgcgcagcgcgaccgacctgaccgtgcgatacaccgagcggcgcgggcacgccaccgtgctggcgcgcaccgcggccgaggccggtgtcgacgtggtggtcacgctcggcggggacggcaccgtgaacgaggcggtcaacggcctgctcaccgcgcccggcgcactggccggcctgcccggcccggcggcataccggctgcccgcactcgccgtggtccccggcggctccaccaacgtcttcgcccgcgcgctcggactcccccgcgactgggcggacggcaccagcgtgattctggacggcctccgcgacgggcggcaccgggtgatcaatctcggacgcgccgacgaccgctacttcaccttcgccgccggcctgggcctggacgccgcggtggtccgccgggtggagcaggcccggctgcgaggccggacctcgacgccgggcctctatctacgggcgatggtcggccaattactcaccgagacggaccggtccgatccgccgatgaccctcgaacgtccgggtgaggaggccgacaccggtctgggcacggtgatcgtgcagaacaccgccccctggacgtacgccggcaaccgtccggtggaccccaatccggacgcttccttcgatctcgggctcgatgtgctggccctgcgcaaactcaaggtttccgcaaccacgaggaccgtgacacaactcgcgtggcgatccggtgatccgcacggtaaacaagtgttacggctgcatgatcttccggagttcaccgtgatctcgtcccgcccccaggcattccagctggacggtgactatctcggcgagcggcagaaggtgcacttcgtgtccgtcccctcagcgctacgtgtgatctgctga

SEQ ID NO: 3723 - DNA, 99 bp, Actinoplanes utahensis
gtggtcgtcgtcgcgcgggggttgaccaccagcaaggcacgcatggcggcaccttaccggccggagcccgatccggcggtcggtatggtgcagccgtga

SEQ ID NO: 3724 - DNA, 396 bp, Actinoplanes utahensis
gtgaacgctgagaagcccgtgacgaccgcggcggcgtccctcgaatggggagtccggctgctctacctgcaatgcgcggggctggccgggctcacggcgtacctgattgtcctcgatctgacccggaccggagcggacgtgggcgtggcggccgccctgacggtgctggcggccctggccgccgtggcggtcttcctcgtcgcgcgggcgctgggccgccgccgggtccgagcccgcgggccggccgtggtcgtgcagctgttcctgctggccaccggcggtttcctggtccaggtcggaccactctggctgggtgtcgtgctgctcgtcgtcgcggcggtcaccgcggtgctggtgctgttgccggcaagcagccgagcgttgggtgtcgattaa

SEQ ID NO: 3725 - DNA, 690 bp, Actinoplanes utahensis
gtgcgcccgcccgcctatcagcaactcgcggacgatctgcgtgcggatatcacttcgggacgactgcagccgggcgagcggttaccgcccgagcccgagctgtgcgtcaagatcggcgtcagccgcagcacggtgcgcgaggcgttacgcctgctcgccagccagcatctgatcgtcaccacccgcggcgtgaccggcgggagcttcgtcgcgcatccggatgccgggcagctcgccgagggcctgtccaccgggttcgcgctgctcgcgcactcggccggggtggggctcgccgacctgctggagctgcgccgggcgctggaggtgccggccgccgggctggccgccatgcgacggaccgacgcgcacctcgccgagatgcgggcggcactgttcgacccggcgctcgacgatctggacaccatgctcgcggcgcactcggtgtttcaccgggcgctcgccaaggcgaccggcaacccgctgttcgagctggtgggccgcccgctgtaccaggcgtcgtacggcgaggaggtggtgtccgacctgccggagcaatactggccgcggatcgacgcggaccaccgggagctgcttgaccacctggtcgcgcgggatgccgaggcggcccggcagaccgcgtcacggcacctcgactacatcgcgctcaccgcgacggtgccgcgcccctga

SEQ ID NO: 3726 - DNA, 408 bp, Actinoplanes utahensis
gtgtcccagctgacccaggcggagccggaagtcggagacgacgtcgtgctcctgacggtgcccgccgacggcggttatctcggcgtgctccggacggctaccgccggcctggccgcccggctccacttcgccctcgacgagatcgaggatctgcggatcgccgtcgacgaggcgtgcgccatgctgctcgcgatcgccacccgtggcgccgagctggagtgccggttcgccgtcaccgacgacgcgctgaccgtggaggtcaccgtcgccacggtgcgcggtgcgcggctgccgtccgagtcgtccttcgcgtggaaggtgctgaccgcgctgaccacgtcggccgccgccgaggcgaacggccagcacgcgacgatccggttgctcacccggcgcaccgaatactga

SEQ ID NO: 3727 - DNA, 405 bp, Actinoplanes utahensis
atgcgacttccgcgtttcctgatgccgcgcaccgtggtcagcgcgcactgcgacctgccctgcggcgtctacgacccggcccaggcccggatcgaggccgagtcgatcaaggccatcgccgagaagtacgcggcgaacacggaccccgagttccgcacccgggccatcctgatcaaggagcagcgcgccgagctggtcaagcaccacctctgggtgctgtggaccgactacttcaaggccccgcacttcgagaagtacccgaacctgcaccagctcttcaacgaggccaccaagctcgccggcgcgtccggcgccaagggctcggtcgacgtcgcggtcgccgaccagctgctcggcaagatcgaggagatctccaagattttctgggagaccaagcaggcctga

SEQ ID NO: 3728 - DNA, 309 bp, Actinoplanes utahensis
ttgaagtggcaattaccactattcgccgtgctggtgcacggcccgtcgatggcgccggcactgcgtcacggcgacgccctgctcgtccgtcgcggcgcgcgggtaaggaccggcgacatcgtggtcgcccgcttccgttcccggccgggcctgctcgtcgttaagcgggcagtgcgggagcaggccggtgggtggtggatcgagggggacaacgctctggtccaggacgactcacgggcgtacggggtggcagatctcattggccgagtggtgtttcgctactacccccgtccagggcggttacgttag

SEQ ID NO: 3729 - DNA, 1314 bp, Actinoplanes utahensis
atgcaccgccgtctggcgcatactcgcgaccagcacgtgtcaggtgcgacgtatcaatgtcgatgccgtgtggagttcaccgtgtctttcttcagtttcgagctcgatcccgccctggccgctgatccggtcttcgacctgcaccgccggggcaagatgacgatgagcgcgaccgttccgctggccagccgggacgatctgtccctggcctacaccccgggcgtcgcccgggtctgcgaggccatcgccgccgacgaatcgctctaccccgactacacctggacgtcgaacaccgtcgccgtcgtcaccgacggatccgcggtgctcgggctcggcaacatcgggccgaaagccgccatgcccgtcatggagggcaagtcggtgctgttcaagcagttcggcggggtcgactcgatcccgatctgcctggacacccaggacgtcgagggcatcatcgcggcggtcaaggcgatggcaccgtcgttcggcgggatcaacctggaggacatcagcgccccgcgctgcttcgagatcgaacgccggctcgacgccgagctggacatcccggtcttccacgacgaccagcacggcaccgcggtcgtcaccctcgccgccctgcgcaacgccgccgccctcctcggccgctccttcgccgacctgcgcgtcgtgatcagcggcgccggcgcggccggggtcgcgatcaccaacaccctgatcgcggccggcgtccagggcgccaacgtgatcgtcgtcgactcgcgcggcatcatccacgccgaccgcaccgacctcaccgcgaccaaggccgacctggccgccgccaccaacgtctcgggccgcaccggcggcatcgccgaggccctgatcggtgcggacgtcctggtcggcgtctccggcgggagcatcccggaggaggccctctcgggcatggcccccggcgcgatcatcttcgcgctggccaaccccacccccgaggtgccgccggcgaccgcccacaagtacgccgcgatcgtcgccaccggccgcagcgacttccccaaccagatcaacaacgtcctcgcgttcccgggcatcttccgcggcgccctcgacgtccgcgccaccaccatcaccgacgcgatgaaggtggccgcggcagacgccatcgccgcgatcgtcgccgacgacctccgtccggaagcgatcgttccgtcaccgctcgacccgcgggtcgcaccggcggtcgccgccgcggtcgccgccgccgccgtccgtgacggcgtggcgcgccgcaccccggcgctcgcgccggttcaggcctgtcagaccgtctga

SEQ ID NO: 3730 - DNA, 942 bp, Actinoplanes utahensis
atgcgcgctgcctacgtgtcccagcttcagcccgacgagccgttgagcggcctgaccgtcggcgatctgcccttcacaccgccggcgggctgggtgccggtcgaggtccgggccagttcgctcaaccagcatgacgtctggtcgctgcgcggggtgggcctgcccgccgaccgcctgccgatgatcctcggctgtgacgccgccggggtgaccccggacggcgccgcggtgctggtctatccggtggtcgaggacaaggctgacccgcggggctattcgctcttctccgagcggcaccccggcacgctggccgagcgggtcgccgcgccccgggagaacctgctgcccatcccggagggtgtctccttcgccgaggcggcttgcctgcccacggcatggctgacggcgtaccacatgctcgtcacccgcggccgcgccgaccgggccggcgcgatcctggtccagggcgccggcggcggcgtcgccacggccgccgtcgcactcggcgtcgccctgggcaagcgggtctacgccaccagtcgacaccaggcgaaacgtgaccgcatcgccgagctgggcgcggtggcggtcgagcccggcgcccgccttcccgaacgggtcgacgtggtcatcgagtccgtcggcgaacccaccttcgaccactcgatgaagtgcgccgcccccggcgcccgcatcgtcgtctgcggcgccaccgccggccacctggcccgcatcgacctgcggcgggtcttcgccatgcagctggaaatcctcggcagcagcatgggcacccccgccgaactcgccgaactcctccagatgtgcgccaccggccgcatccacccggtgatcgactccacccacccgttcgacgccaccccggacgccttcgcccgcctgctgtcccccgacctcttcggcaaggtggtcatcacccactga

SEQ ID NO: 3731 - DNA, 1116 bp, Actinoplanes utahensis
atgacccgggtactcgtgctcaactgcggctcctcgtcggtccggtaccgcctcttcgacggcgccgacgtccaggccaaggggctgatccagcggatcggcgagccgggcggcgacgccaccgaccacctgtcggcgctgcgcgacctgatggaccggctcgacctgagcgacctggccgcggtcgggcaccgggtggtgcacggcggcgaacgcttcaccgaggccacggtgatcaccgacgaggtggtggccgcggtcgaggaactcgttccgctcgccccgctgcacaacccgggcgcgctgaccggtatccgggtcgcccgcgagctgctgcccgaggtgccgcaggtcgccgtcttcgacaccgcgttccactcgacgatcccgccggagggggtgatctgggccgtcgaccgcaccctcgccgaacgcttcggcctgcggcggtacgggttccacggcacgtcgcacgcctacgtgtcccgccggaccgcccacgtcctcgaccggccggtcgaggacacccgggtgatcaccctgcacctgggcaacggcgccagcgccgccgccgtcgacggcggggtctgcgtcgccacgtcgatggggatgaccccgctcagcggcctggtgatgggcacccgctccggcgacatcgaccccagcctgatcttccacctgcaccgcgccggcggcctgtcgctggacgagatcgaggactcgctcacccggcacggcggcctgctcggcctgaccggcgccaacgacatgcgcgaggtcctcgaccgggtcaccgccggcgacccggaagccgagctggcgttcctgacctacacccgccgcctccgcgaatacgtcggcgcctatctcgccgtgctcggcggtgcccacgcgatcaccttcacggccggcgtgggggagaactcttcccgggtcagggccgccgccctggccgggctggagcccctcggcatcatcgtcgacgaagcccgcaacagccgcaacgatctgatcatctccccggacggcgccccggtgacggtgtgcgtcatcccgaccgaggaggaactggagatcgccgacgagtcccggcgggccctggccctgccggtctga

SEQ ID NO: 3732 - DNA, 2073 bp, Actinoplanes utahensis
gtggcgcggagtgtctatgtagcgggcctgggcccggctgtcggcaagggcacggtggccctggggatcgtcgagctgctgtcccgtcaggtcgccggggtggcggtgttccggcccctggtcccggctgtcgaccgtgatccgctgctggccgccctgcgggagcgttatccctcgccggtgccggccgccgagtcgttcggggtcaccctggccgaggcggccgcgttgatcgccgacggccggcgcgaggagctcatcggccggatcgtcgagcggtatcgcgcggtcgagcggcagagcacctcggtcgtgatcatcgggagcgacttcgccgaccagggcgacgagggccacgacgaactgcctcgggagctggccttcaacgcccggctggcgaccgagttcggcagcgtggtggtgccggtggtgagcggggccgggcgcggcggggagtccctcgcggcggcggcccgcagtgcgtaccactcggtcaccgacctgggcgccacggtggccgcggtgatcgccaaccgggtgccggccgccgccggcggcggcccggcgccgagcctgcccgtcccgttctggacgatccccgaggtcccggcgatcgcggcgcccaccgtcggcgaggtcgccgacgcgctcgacgcgaccgtcctgtccggcacgcccggcgccctcgaccgggacgtgctcgactatgtcgtcggcgccgcccacgtgcccaccgtgctggagcacctcaccgacggggcactgctgatcactcccggcgaccgcgccgacctgctggtcgcggcgagcgcggcgcacgcggccggcacggtcaccctggccgggctggtgctcaccctcggcgagccacccgacccgcgcgtcgtgcgggtcatcgagcggctcggcaccggccttgcgatgctggtcaccaaggccgacagcttccacaccatcgccctgtccgaccgggtgcgggcccggctcagcacaccccgcaaggtgcaggccgcgctcggcgccttcgagacgcacgtggacaccgccgagctctccaaggtgctcgacgtggcccgctccgcccgggtcaccccgctgatgttcgagaacgatctgatcgaccgggcccgcgccgaccgccgccacctggtcctgccggagggcgccgaggagcggatcctgcgcgccgcggaaaccctgctgcgccgcggggtggccgagctgaccctgctcggcgatccggccgagatcacccgccgggcccgcgagatcggcgtcgagatcggcgacgcccacctgatcgacccggccaccagctcgtggcgcgacgacttcgcggcccgctacgccgagatccgcaagggccgcgcggtcaccctcgacctggcatacgacgtggtccgcgacgtcaactacttcggcaccatgatggtcgccgcgggctatgccgacggcatggtgtccggctcggtgcacaccacggcggccaccatccgcccggcgttcgagatcatcaagacggtgcccgaggtgtccgtcgcgtccagtgtcttcttcatgctgctggccgaccgggtgctggtctacggcgactgcgcggtcaaccccgacccagacgccgcccagctcgccgacatcgccctctcctcggcgacgaccgcggcagccttcggcatcgagccccgggtcgcgatgctctcctactccaccggcagttccggcgccggcgccgacgtggagaaggtcgcggcggccaccgccctggtccgggagcgccggccggacctgccggtcgagggcccgatccagtacgacgcggccatcgaccccgcggtcgccgccgcgaaactccccggcagcgcggtcgccgggcaggccacggtgttcgtcttccccgacctgaacaccggcaacaacacctacaaggcggtccagcgctcggcgaacgcggtcgcggtcggcccggtcatgcagggcctgcgccgcccggtcaacgacctgtcccgcggcgccaccgtcaaggacatcatcaacaccgtggcgatcacggcgatccaggcgggagccagatga

SEQ ID NO: 3733 - DNA, 177 bp, Actinoplanes utahensis
atgtacttcaccgatcggggcatcgaggagctggtccagcggcgcggcgaggagaccgtgacgctcgagtggctcggcgagcagctgcgcaccttcgtcgacctgaacccggagttcgagaccccgatcgagcggttcgccacctggctcgcccgggatgacgacgacgaggactga

SEQ ID NO: 3734 - DNA, 3708 bp, Actinoplanes utahensis
gtgtcgacgcagcagacttcgcaggacaacccactcgcggatttcggtcccaacgagtggatcgtcgacgagatgtatcagcgatacctggccgatccgaccagtgtcgaccctgcctggcacgatttcttcgccgactacaagccggcgaccgcctcgggctcgatcgtgacacccgacgaggccaccgcggcgaacgcgaccaagagcgccgccaaggccggcaccgacgcgcccgccgcggccaccgtggcgccggccaagccggtcaccccgcccgccccggcggcgaagaaggcggagccggtcaaggccgcaccgaagcccgcggcggcggcccagcccgccccggccggggcgaagaccacggtcctgcgcggcgtcgccggcaagatcgtgcagaacatggaggcctcgctccaggtccccaccgccacctcggtgcgcgcggtgccggcgaaactgatgatcgacaaccgcatcgtgatcaacaatcacctctcccggggccggggcggcaaggtcagtttcacgcacctgatcgggtgggcgctggtccgggcggtcgtcgcgcacccggagatgaacaacatctacgccgaggtcgacggcaagcccacgctggtccagccggagcacatcaacctcggcatcgccatcgacctggccaagaaggacgggtcgcgcaccctggtggtgccgtccatcaagaactgcgaacagatggacttccggcagttctggcaggcgtacgaggacgtggtccgccgcgcccggcgcaacgagctgaccatggacgactacgccggcaccacgatctcgctgaccaacccgggcggcatcggcacggtgcactcgatcccgcgtctgatgaacggtcagtccgcgatcatcggcgtcggcgcgctggagtaccccgcgccctacgccgggatgagcgacgagaccctcaccgaccatggcgtctccaaggtgacgacgctgaccagcacctacgaccaccgggtcatccagggcgcgcagtccggcgagttcctcaaggtgatgcacgagctgctgctcggcggccgggacttctacgacgagatcttcacctcgctgcggatcccgtacgagccggtccgctgggtgcgcgacgtcgcgcacacctccgagggccagatcgacaaggccgcccgggtgatcgagctgatccacgcgtaccgggtgcgcggtcacctgatggccgacaccgacccgctcgagttcaccatccgcaagcaccccgacctcgacgtgctgcagcacggcctcacgctgtgggacctggaccgcacgttcccggtcggcggtttcgccggcaagcagaagatgaagctgcgcgacgtgctcggcgtgctgcgcgacagctactgccgccggatcggcatcgagtacatgcacatccaggacccggaggagcgccgctgggttcaggagcgcatcgaggtcaagtacgccaagccggacaccgacgagcagaagcagatcctgctgcgactcaaccgggccgaggcgttcgagaccttcctgcagaccaagtacgtcgggcagaagcggttctcgctggagggcggcgagtcgctgatcccgctgctcgacgcggtgctccagtcgtccgccgaggccgggctcgacgagatggtgatcggcatggcccaccgcggccggctgaacgtgctcaccaacatcgtcggcaagccgtacgagaagctcttcaacgagttcgaggggtggatggaccccaagtcggcgcacggctccggtgacgtgaagtaccacctgggccagaccggcaaatacaccacgcccgacggccggcactccaccaccgtcagcgtggtcgcgaacccgtcccacctggaggccgtcgacccggtcctggagggcatcgtccgggccaagcaggaccgcctcgacctgggcctgcacggctacacggtgctgccggtgctggtgcacggcgacgccgcgttcgccggtcagggcgtggtcgccgagacgctgaacctctcccagctgcggggctaccgcaccggtggcaccgtccacgtggtcgtgaacaaccaggtcggcttcaccaccgccccggagtacagccgctcgtcgatgtactcgaccgacgtcgcccggatggtcgaggcgccgatcttccacgtcaacggggacgacccggaggccgtggtgcgggtcgccaagctggccttcgagtaccgccagacgttcaacaaggacgtcgtgatcgacatgatctgctaccgccgccgcggtcacaacgagggcgacgacccgtcgatgaccaacccgcggatgtaccagatcatcgacaccaagcgcagcgtccgcaagctgtacaccgaggagctcatcggccgcggcgacatcaccgtgcaggacgccgaggagcagctgcgcgactaccagtcccggctggaggaggtcttcaaggccacccgggacgcggccggcagcccgccgcggccgcacatcatcgccgaggaaccggagccgcaggtggccaccgcggtcgaggcggacaccgtgcgggccgtcggccaggcgcacatcgagctgcccgagggcttcaccccgcacaagcgggtccagcagctgctcgaccggcgggccaagatgtccaccgacggcggcatcgactggggcttcggcgagctgatcgcgttcggttcgctgctcgcccagggcgtcaccgtccggctcgccggtcaggactcccgtcgcggcacgttcacctcgcggcacgcctcgatcgtcgactcgcgaaccggcaaggacttcctgccgatcgcctcgctggccaccggcaccgcgcggttcttcgtgcacgactcgctgctctccgagtacgccgcgatgggcttcgagtacggctactcggtggagaacccggacgcgctggtcctgtgggaggcccagttcggtgacttcgtcaacggcgcccagtcgatcgtcgacgagttcctctcctccggcgaggtgaagtggggccagcagtcgtcgctggtgctgctgctcccgcacggcatggagggccaggggcccgaccactcgtccggccgcccggagcggttcctgcagctctgcgcacaggacaacatgcgggtggcgaacccgaccaccccggcgaactacttccacctgctgcgccgccaggccctgtccagcaagcgcaagccgctggtcgtcatgtcgccgaagtcgctgctgcggcacaagctcgcggtgtcctcggtggccgacttcacccagggcacgttccagccggtgctcggcgacgccggggtcaacggccagccgctggacgccggctcggtgaagcgggtgctgttctgctccggcaaggtctactacgacctgttccaggcccgggccgaccgcggcatcaccgacaccgcgatcatccggatggagcagatctacccgctgccggtggacgagctcaaggcggtcctggcgcagtacccgaacgccgaggacttcgcctgggtccaggaggagccggccaaccagggtgcctggtcgttcgtcgcgctcaacctgctggagcacctggagggcgtccggctgcggcggatctcccgcccggcggcggccgccccggcggtcggctcggccaagatgcacgaggccgagcagcaggcgctgatcgaggcgtcgctgccccgcccgtga

SEQ ID NO: 3735 - DNA, 399 bp, Actinoplanes utahensis
gtgagcccggacatcgatcgcgtgcgtcacaccgtggcgatccaggtggcccgggccaccgccagccgccgcccgtccgggccgtgcaccgccgagtccaccagggccttgcgaccggccagctcggacaccgcgccggtgatcacacaccgtgcgcccggctcgggcagcgcgacagcggccaccgccaaccggcccagcacgtacgggcggccctcgcggatcgccgcccagccgcccgggcagtccagcgccgcccacagcagcggcaggtcgacctcggccggcaccgtccacggcgcggcggtccggccgtccggcagacgccccgggaagatccgcaggccgtccccctcggcacggtccgggccgcacacgaaacaggtggggaaggggtga

SEQ ID NO: 3736 - DNA, 963 bp, Actinoplanes utahensis
atgggtggcgccgtccggcgccgcgccggcggcgacggcgaaggcgccggcgcaccagccgccgttgccggagccgggcggaccgttgaaacgtgcgggaattcgcatcctgcgaccttcgcacaagccgttcatcagccggacacgcatcgccacctgacccgacactccatcggcagctgtcacccttacacaggtcacatggcagttctgatgacagccgccgcacccaccgggaccagcggctacacgcttctcatcgcggatcgggcggcgcagatcgaggccgcacagcgactgcgtcacgacgtcttcgccggcgagctcggagccaccctcacgaccgcggccgacggacgcgacgtggacgcgctcgacgagttctgcgaccacctgatcgtgcgcgacgacgcgaccggcgcggtggtcggcacctaccggatgctcccgccgcgcgccgccgggcgggccggccgccgctacgccgacggcgagttcgacctgagcgcgctgcgcccgctgcgcgaccagctggtcgagatcggccgctcgtgcgtgcatccggaccaccgcaccggcgcggtgatgaacctcatgtggaccggcatcgcccggtatctgcacctgaacgacctgcgctggctgggcggctgcgcctcggtaccgctggccgacggcggcgggctggcggccggggtgcgggagcggatcaacgccgggcacctggccccgccggcgctgcggatccgcccgcgcaccccgtggacgcccccggccgatctggtcgccgacccgaaggtgacggttccgccgctgctcaagggttacctgcggctgggcagctgggtctgcggcgaaccggcctacgacccggacttcgactgcgccgacttctacgtgctgttctcgctggaccggctggacccgcggtaccgccgccacttcctgggcggcgaccgatga

SEQ ID NO: 3737 - DNA, 768 bp, Actinoplanes utahensis
atgagcacgctctggcagccggcctcgggctgcggggacgcctgccgcaccggcggcgggccgcgggcgcgcggctggaccgccggattccggctcaccgggatgctcctggtgctgctgctcggcctgctgccggccgcgctgatccgcggcgcggcgctgcgcacgctggcccggacgatgctcgcggtgatgggcgtgcggctgatccggcgcggcccggcaccgcgcccgggcagcctgctggtggccaaccacatctcctggatggacatcctggcgctggtcgcggtcacgccggtgcgcctggtcgccaagcacgacgtgcgggcctggcccgggatcggtgcgacggcgggccgcagcggcaccatcttcatcgaccggacccggccgcgggagctgcccgtgacggtgggcgaggtggcccgggcgctgcggggcggccgctcggtggcggcgttcccggagggcaccacgtactgcggggccgagcagggggacttccgtccggcgctgttccaggcggcgatcgacgccggcgccccggtggtgcccacctcgatcatctacgacaccgccgaggcgtcgttcatcggcgacgacacgctgctggagtcgctgctgcgggtggcccgggtgcgccggaccacggtcaccgtgatcaccgcgccggcgctgcggccgatgccgggggccgaccgacgggcgctggcgcgggccgcgcagcgcagcatggccgggcacgggtaccggctggccgcctga

SEQ ID NO: 3738 - DNA, 168 bp, Actinoplanes utahensis
atgctgcgctgcgcggcccgcgccagcgcccgtcggtcggcccccggcatcggccgcagcgccggcgcggtgatcacggtgaccgtggtccggcgcacccgggccacccgcagcagcgactccagcagcgtgtcgtcgccgatgaacgacgcctcggcggtgtcgtag

SEQ ID NO: 3739 - DNA, 729 bp, Actinoplanes utahensis
atggccgcccagacccagcgcaacgacacccagcctaagcagagcgaggcgaagttgctcgtcgtcgaggacgacgccaacatcctcgagctgctctccgccagcctgcgcttcgccgggttcgatgtgaccaccgcgaccagtggcagcgccgcggtcagcgcggcccgcagcgcggcgcccgacctggtcgtgctcgacgtgatgctccccgacctcgacggcttcgaggtgatccggctgatgcgcgagggcggacagcgcaccccggtggtcttcctgaccgcccgggacgggaccgacgacaagatccgcgggctcaccctgggcggcgacgactacgtcaccaagccgttcagcctggaggagctgaccgcccggatccgggcggtgctgcgccgcaccacggccggcgaggagcagccgtcccggctggtcttcgccgatctggagctcgacgaggagacccatgaggtctatcgggcgggcagccgggtgcagctctcgccgaccgagttcaagctcctgcgctacctgatgctcaacgccaaccgggtgctctccaaggcgcagatcctggaccacgtgtggaaatacgacttccgcggtgacgacaacatcgtcgagtcgtacatctcctacctgcggcgcaaggtggacaacgtgcaaccgcgcctgatccataccctgcgcggggtgggttacgtgctccgtaaacccgccgtctag

SEQ ID NO: 3740 - DNA, 1569 bp, Actinoplanes utahensis
atgatgtcgatctccgagcgggtgcgccaggcgttcccgccgcagcccaccctgcgcaagatctcgctgcggaccaaactcgtcgcgtcggtgctggtcctggtgttcgccgcgcttacgctgatcagctcggccagcaccatcgcgctgcgcacctatctgatgtcccggctggacgcgcagctcaccgagttctccgaggacgcggccgtcctcattcaggacgactcgggcatccgggtctacacgccgcgggattacctggtcgtgctcacgagcgtcggcggggtcggcgtcggcgtcggcagcaagagcagattgacgagcggcaacagcctgcccacgctgatcaccggggcggagaaggtcgccgagtacgacggcaagctgtacacgagccggtcggccgacgggttgtacacctggcgggtccgggtcaaggtgctggacaacggcgacgtgctcacggtcggcgagcagatgggcaacgtccagggggtgatcggccggctggtgtgggtcgacgtgctggtcggcacgggcgtgctgctcgccctcgcgatcgtcggcgcggcactggtccggcagagcctgatcccgctgctgcagatcgagcggaccgccggccggatcgcggccggcgactacagccagcgggtgcccgacccggaggtggacggcggtgagccgaccaccgagctcggccggctgtccaccgcggtgaacgcgatgctggcccagatcgaggcggccttctacgcccgggccacctcggagcggcaggccatggaggcggccgaggccgcccagctctccgaggggcgcgcggtgcgctccgaggagaagatgcggcagttcgtcgcggacgcctcccacgaactgcgtacgccgttgaccactatccgtggcttcgccgagctctaccgacagggcgcggtctccgacccggaggcggtcgcccgcctggtccgccggatcgaggacgaggccgcccggatgggcctgctcgtcgaggatctgctgctgctcgcccgcctcgaccgggagcgcccgctcaatctggccccggtcgagttgccggtgctggccgtggacgcggtcggcgcggcccgggccacccacccggaccggaccatcgagctggacgtccgggacgaccacgagcggctgatcgcgctcggcgacgacgcccggctgcgccaggtgatcgggaacctggtcaccaacgcgctggtgcacaccccgccggaggccaccgtggcgctgcgcctctacgccgccgggccggaccgcgcggtggtggaggtggccgacaccggcccgggcctgagcgaggagcagcggagccgcgtcttcgagcggttctaccgggcggacggcgcacggacccgcaacactcagcgggaggccaccgggaccgggctgggcctggccatcgtggcggccatcgtgcgctcccacaacggcaccgtcgacgtgctgagcgaacccggtcagggcgccacgttccgcgtcactttgcctaccataaatgtcgaaaaaaggttcacagaaaacatccaggactag

SEQ ID NO: 3741 - DNA, 1533 bp, Actinoplanes utahensis
atgaacgagaacgagaccaacccgcagcccgcggacgccggcgctgagcagttcagcacggagcgggtggagtctgagcagccgaccgcagcgcagccgccggccgccccgcagaacgccgctcacccgtccgcggctccgcagtacccgcagcagcccccggcgccgcagcacccccagcagccgcagcacccccagccgccgcacaatccttgggcgcagcccgtgccgggcggctaccagcagcccgccccgcagccgccgcacccgccccagtcgccctggcagcagccggtgtccgccgcccccacctcgggctacccccagtacgggcagcaccccggctacggtcagcagcccggctggcagcacaccaccaacccggagggcgtcgtcccggtctgggcccagccggtcgaccagccgccccgcaaccccggccgcggacgcaagttcgtgctggccggcgcggcggccgtgctgatcgcgctgctctccggcggggtcggcgccgccaccgcactggcggtgcacgacgacaacgcgccggccacggtgaagtccggcaacacctcggtcagccgggtggtggaccggtcgtcgctggcccagatcgcctccgcggtgcaggacagcgtcgtctccatcaccacccagtcgggtgagggctccggcgtgatcctcagcgccgacggctacatcgtgaccaacaaccacgtggtcgccaccgccaccggcgacacggtgaacatcatcttcgcggacggcaagaagaccaccgccaccatcgtcggcaccgacccgcgcaccgacctggccgtggtcaaggccaccggggtgtcgaacctgaaggccgccaccttcggggacagctcgcagatgcaggttggcgacaccgtgctggcgctgggcagcccgctcggcctggagggctcggtcaccgccggcatcatcagcgccaaggaccgcaccatccagtccagcagcgagcaggaccagcagggccaggggcagaacccgttcggccagtcgcagcagcaacagggcggcagcggcagcaccacgatgaccggcctgctgcagaccgacgccccgatcaacccgggtaactccggcggtgcgctggtcaacgtgaacggcgaggtgatcgggatcaactcggcgatcgccacctccggttccggctccggcaacatcggtctgggtttcgcgatccccagtgacaaggccaagaccgtggccgagtcgctgatgtccggcaagaaggtcagccacccggcgctcggcgtcagcgtcaccaccggggagaacggcggggccctggtcagccaggtcgtgtcgaagagcgcggcggacaaggccggcctgcagaagggtgacgtgatcaccaaggtcgacggcaaggacatcagcgagtccgacgacctggtggccgcggtccagtccggcacggtcggccagcagatgaccatcaccttcacccgcaacggcgccgagaagcaggtcaccgtcacgctcgccgaatcccagtag

SEQ ID NO: 3742 - DNA, 1689 bp, Actinoplanes utahensis
ttgacgtacgtcgagacccggaccagcgtctgggaagctttggccggccgggccccgaaagcggagtccggccccgccgactccgggctctggcacgccgtcgcggaccggctcaacccggctcgcgcccgtcccgaactgcggggcggcatcgaggtccggcaccgcaccacggtccgcggcgggcggtacgtgatgctccgttcgcccgaggagggcggccgcagctgctatctccggctgagcccggaggagtaccagctggccctgatgatggacggcagctgcacggtggcccggctggtcgccgagttcgcccggatcgccggccggctcgcccccgaccaggtccgccgggtggtcgccgacctggccggcaaccggatgctccaggagctgccccgggacgccttccgtccgctgcgcgagatgcgcccggagccgctgccgcagcgggtcggcggctcgctgctggccgccgtgcgcggccgccgggtgctctcggtgaacgtcgacggcacgctgaccggcctctacaacggcgccggccggctgctgttcacccgtccggcgttctggctgggggcgctgctgtcgatggccggcgcggtgctgttcctgttcagctgggagcgcggcaaccacccgctgttcctttcgggtgactcctacctactcggcgccatctcgctgctgttactcaacgtggtcgcgatgggcctgcacgagctgggtcacgcgctcgccgcgaaacgcgtcggccgtgaggtgccggccgccggcctgctgctgcacttcggcctgcccacggtcttcgtcgacaccagcgacgtctggatggccggccggcgggcccggatcgcggtcaccgcggccggcccggccaccggcctggccctggccggcctgttccagctgatcggcctgggcgtcccgctgctcggcggactcgccttcaagctggccttcctgttctacctgcacaccttcttcaacctcagcccgctgctgccgctcgatggtcaatacctgctgatggactggctggagatccccgacctgcgggcccgcggcctggcctggctcggtggccggctgcgccggcgcggtccgcgctggtcggtgctcgaccgggagggccggctgatcgccctgtacggcatgctcgccctgttctggctgggcgccgccgtcgcgctgggctaccggttgtggaccgaccgggtctccggcctggtcctcggcctctggtacgagggcctcggcgcccgcctgctgctcgccgtgatgctgggcggcctgctggccccgccgctctatttcctgctcggccggctcggcagcggatggcgccggtggcggcggcgttccgccgagcgcgaccaggaggccgacatgccgcaccgaatggccgcgctgcacgcctccgacctgggcggcctgcccgagccggcgctgcagtcgctggccgcccgggcccgctgggagcatccgcggatcggccggcagctggtactggccggtgcggagcaggccgccgtctacgtggtggtcgagggcgcgctgcacggccgtcgccccggcgacccgggcggcagcatccggcaccacgccggcccgggcagcgtggtcggcctggccgccgcgctcaccggccgcagcgccgcgctggactggcacgccgcctag

SEQ ID NO: 3743 - DNA, 1431 bp, Actinoplanes utahensis
gtgctgctcgccgtccccacctcgacggtggctaccgtgatcggcccgctgccgggcccgccgccgcacgagcgggccgaggccgaggcgctgttcgccgacaccccggcgctggccggtctggaggaggaccagcagctcgcactgatcgccgcggcccacccggtggacctggagccgggtgccccggtgatgctgcacggcccgacccacgcggtggtggtcgagtccggggtgatcgccatgccggacggtgtcgagctgcgccgcggcacgctggtcggcccggtcggcgacggcacgccgggcatggtggcgcagacccgcaccccggtccggctgtggatcatcccggacgcgtccgacctgccgccgctgatcggcacggaggcccgcccgggtgcgccgatgccggcgctacggcccggttcgccactcgccgtccgcccgggcgccgtgcacccgccgctggcggtgccgcccggcccgccggacagcggtgacgagttcgacgtcgaccgccatttcgagaagcgcatgtgggcgttcgtcagcgtgctggtggtcgtggtgctcggcggcctcgggctggacctgagcgccggtccggcctgggccgagatgccggccgagaaggtgctgctcaccgtcgaccggggcagcgccaccgcgcggaacgagacgctcgccgtcggcgaccggcgctatctgggcgccggcgcctcggtcgaggcgcccggcaagtcgcgggtccggctcaccttcccgggcggcggggcgttgctgatctgcccgggcgcccgggtcacgctgacggcggccgcggtgggcggcggccggcaggcgatcccgtccggccgggtcaccctggagtccgggcgggtgctcgccgacacggccggcaccagcggcggttaccggccgctcgccctgaccgtcggccgtgaccagggcgacgtcaccagcgccggccgggcctggttctcggtcgacctggcggcggtcaccgtggccaccggcacggtcagcgcgggcggggtgccggccccggccatcggcggcgacctgagctgcggcgacgggcagaaggtgagccgaccggcggcccccgagggcggcgaaccgtccgaggcgccgttcccctccgacacggcctcaccgtcggcgtcggccagcccgtccgggtcggcgagtccgagcgccagcgcgtcggccggcgccgacccgtcgccgagcgccagccggtcgccgagcgccagcccgtcggcgaagccgagtgtcaagccgtccacccggccgacggtgcggccgaccgtgcccacggtgccgacgaccgtgcccaccacggtgcccaccacggtgccgacgaccgtgcccacgacggtgccgacgaccgcgcagacgaccaccccggataccggcggcaactag

SEQ ID NO: 3744 - DNA, 861 bp, Actinoplanes utahensis
atggggcgcatggtcgacggtccggtggcgttcgtgctcggcggtggtggcgtgctcggcgcggtcgaggtggggatgctgcgcgcgctgttccgggccgggttccggcccgacgtggtggtcggcacctcgatcggcgcggtcaacggcgcgctggtggcggccgagccgggggaggcggtcaccgaccggctggtccggctctgggcgtccccggaggcggccgccgtctacggcgactcgatcggccggcagctgcgccggttcgcggcccgcacgcacctgcattcgccgctgccgctgcgccgtctgctggcgggggagctgggcgaggcggccaccttcgccgatctcaaggtgccgttccactgctgcgcggccagcatcgagcgggccgccgagcactggttcgacagcggtccgctggtcgacgcggtgctcgcctcgtccgcggtgccggggctgctgccacccaccgagatcgacggtgagcatttcgtggacggcgggatcgtcaactcgatcccgatcagtgaggcggtccggctcggcgcgcggctcatcttcgtgctgcaggtgggccgggtggagcggcagctgagcgtgccgcgccggccgtgggaggtggcccaggtggcgttcgagatcgcccggcggcaccggttcgcccgcgacatggcgtcgctgccggacggcgtacgcgtgcatgtcctgcccagtggcggcggcgaggtcggcgacgactccccatgggcctaccgcgacatggcgcgggtcggccggcggatcagccgggcctacacggcctcccggcgctacctggcggcgaatgtgcacccgctgccggacggcgagcggtga

SEQ ID NO: 3745 - DNA, 1155 bp, Actinoplanes utahensis
atgggcctaccgcgacatggcgcgggtcggccggcggatcagccgggcctacacggcctcccggcgctacctggcggcgaatgtgcacccgctgccggacggcgagcggtgagtctgccgccggtgtgggcccggcgcctggtcatcgccccggccatcgtgctgctcgccgccggtctgctgaccacactgccggtctggctgcttctcgcgctcgcggtgtcgccactggtccccggccggttgcgggtgccgcggctggtcttcctgctgatcgtgtacgtcgtctgggacgccgccgcgctgatcgtgctggccgcgctgtggattgccgcgggcgccggccggtggatccgcggcccggtgttccagcgcgcccactacgtggtgaccggcgcgttcctgcgcaccctgttctggttcgcccgctggtcgctgcacctggcgatcgacgtggtcggcaccgacccggacaccgcccagccgggccgcccggagatcgtggtgagccggcacgccgggccgggtgactcgttcacgctgatccacgccctggtcaactggttcgcccgggaaccgcggatcgtgctcaaggccgccctgcagtgggatccggcggtcgacgtgctgctcaaccggctgccgaacaggttcatcaccccgggccgtaccgccaccgaccggttggcggaccagatcggtgagctggccaccgggctggacgacaacgacgccttcgtgatcttcccggagggcggcaacttcacgccccgccgcagggtcaaggcgatcgcccgactgcgggccagcggtctggacgagatggcggtcaaggcggagggcctgcgcaacctgctgccgccgaaaccgggtggcctgctcgcggcgatcgacgcagccccggacgccggggtgatcttcgtggcgcacaccggtctggaccggatgatcacgatcggcgacgtgtggcgcgagctgccgatggacaagcgtctggtgatgcggttctggagcgtcccgccggaggaggtgccggccggcgagcgggagcggatcgactggctgtacgcctggtgggcccggatcgacgcgtggatcgaggagaaccggccggcgccgcggccactgtggatcgaccgcggcaccgcccggtga

SEQ ID NO: 3746 - DNA, 798 bp, Actinoplanes utahensis
atgcggactacacggctcgcactcaccgtggccacggcggcgttcgcggtggcgggctgcaccgcggacggcacgccggcgacctcggcgaccagtgccccggcggcctcggccgcggcggcgccctcggccagcgcggacccggcggcggtccaggccctgtccggcgcggccagcaccctcgggaacagcagcttcaagatgaccatgacgcagggcagcggattccagctgaccgcggacatcgacgcgccgcacggcaacggcaccgcggagatgaacgcgaagggcggcaacaccgcactgaccgtgaagacgctgctgttcggcaaggacctgtacgcccagatccccggcgtgacgcagggccagaactggacgcacctggacatggcccggctgccggacggctcgaacatcggcctcaagcccggccagatcgacccggcgaacaccgcgcagctgctcagctccaccaccgacgtgcaccgggccggggagggctcgtacgccggcaccgtggacctcaccaaagcggccggcgtggccgggatcagcaaggtcaccctcgacgggtacggcgcggacgccaagcaggtgccgttcgaggccaccctggaccagcaggaccggctggagtcgctgaccctgcgactgccctcggtggacagccgggagaccgcgccgctgcaggtcaagtactccgattacggccagacggtgaccgcgcagcggccgccggccggtcagatcagcgaggcgccggacagcgtctaccaggcgctgggcggcaagtag

SEQ ID NO: 3747 - DNA, 1149 bp, Actinoplanes utahensis
gtgagattcgaggtcagcaaggtcctcgacgccatcgaggcccggctcaccaccgatccggcgctcgcccgggccgtggtcgatctgtcggaggtggtgcggtacgccgacctcgacgggggccgtccggccagcctggtccggctcggcctgctggtcgacgccctcgggcgctacgtcgccgaggagaacgttccggtctacgtgatcgccccgcgcggcctgctctccgacaccgacctcacgtcgaacgagcgcatggtcgtgcgccgctgggccgacgacggcaaggtcgaggtggtcccgcagatggacgaccgggtgctggaggtggccgagatgctcggcctgccggtgctcacccgtgaccgggaggaccgtttccggcagacccgcccctgggtcgccgagccgggccggctgctcgcgctcgtctcccagcagggcggccccacattggtcgcccgggtcggccggggcgaggcgatcccgcccacgccgcggtcgccgctgggcgagcggctgctggcccggatctggaagtgccccgacttcaactgcaccacgttcggcaccggcggtgactcggacagcccgttcgccgacatgcgcaccttcaccagcccggtcgcccagccgccgccggccctgcgcgccggcgtgccgacctgcccgcggcacggcgagcggctcaaggacgccggcccgcggccgcacaccgaggtgctctcggtccggatcgacggggtgatccggcagcggttcaccgtcgccgaggatcagccggtcgtcgtcggccgcgcgccggagggcggcggcggagtgatgctgggccagtggctgaccgcggacgcgcgcaaatggatcagtcgcggtcacgtgcggttcgcgctgcgagccggggagatcaccgtgaaggacatcagcaccaacgggacgggggtccggcccgggggttcgcaggatgacgaggagcggatcacgctgcaccgggacgagagccgggtgctcgcggccgacgacgtggtggagctgtacgcgggggtgcacgtggggcgcgccaagctgtgggccaacggcggcgtcatccaaccacaatcggtcatggccgaggccccgaccatggcgatccgccccgtcggaagatag

SEQ ID NO: 3748 - DNA, 1215 bp, Actinoplanes utahensis
gtgacgaccgtggaattccgtaccgcagaggcgctggccgaggcggagcgctggacggcgcacaactaccacccgctgccggtcgtcgtggccgaggcggagggcgcctgggtcaccgacgtcgacggccggcgctacctggacatgctcgccggatactcggcgctgaacttcgggcaccggcaccccgggctgatcgccgccgcgcacgcccagctcgaccggctcaccctgaccagccgggcgttcgtgcacgaccagttcgccgcgttctgccgcgggctggccgagctgtgcggcaaggacctggtgctgccgatgaacaccggcgccgaggccgtggagaccgcggtcaaggtcgcccgcaagtggggataccaggtcaagggcgtgccggccgggcgcgccgagatcatcgtggcggacggcaacttccacggccggaccaccaccatcgtcagcttctccaccgacccggaggcgcgggccgacttcgggccgtacacccccggcttcgtggtggtcccctacggcgacgccgaggcgctcgcccaggcgatcacgccggacacggtcgcggtgctgctcgaaccgatccagggcgagggcggcgtgctgatcccgccggccggctacttcgcggcggtccgcgagacctgcacggcgaacaacgtgctgatgatcgccgatgagatccagtccggcctgggccgcaccggcaagaccttcgcgatcgagcacgagggcgtcgtcccggacatgtacgtgctgggcaaggcgctcggcggcggcatcgtgccggtctccgcggtggccgcgaacaccgacgtgctcggcgtgctgaagccgggcgagcacgggtcgaccttcggcgggaacgcactcgcctgcgcggtcggcagcgcggtggtcgggctgctgggcaccggcgagttccaggagcgctcggcgcggctcggggagcggctccgggccggcctcgaagggctgatcggcaagggcctggtcgcggtgcgctgccggggcctgtgggccggcgtcgacatcgatccggcgctgatgaccggccggcaggcctgcgaacgcctcgccgccctcggcgtcctggccaaggacacccacggctcgacgatccgcctggcgccgcccctggtcatcaccgaagaggacctggaccacgcggtcgcccaactggccgccgtgctggcaggctga

SEQ ID NO: 3749 - DNA, 936 bp, Actinoplanes utahensis
gtgaaaacgccgctcccggcgcccgtgtggggtgcccgcaacgattcgccgccgggtgcggtgatcacgcaacgatccgccgccggacgcatgattggaccggggtgcgcgaaggtcatccgcacctaccgtttctgcatgaccgccatgcgccgctacctgatgtgccggcccacccacttcgccgtcacctaccggatcaacccgtggatggaccccacagcgccgtacgacaacgcgctcgccgtcagccagtgggagaacctgcgccggaccttcctcgagctgggccacaccgtcgacctggtcgacccgctgcccggcctgccggacatggtgttcgccgcgaacggcggcacgatcgtcgacgggcgcgcgctgggcgtgcagttccgggacgccgagcgggccgacgaggcgccggcgtacgccgcgtggttccgggctgcgggcttcgagaccgagatgcccaagcacaccaacgagggtgagggcgacatcctgctcgccggcgacctgctgctggccgggacggggttccgcacctcgcacgcgtcgcacgccgagacccaggagttcctgcgccgtccggtggtcaccctgcagctggtcgacccggcgtactaccacctggacacggcgctgtgcgtgctggacgagacgaacatcgcgtacctgccgtcggccttctcgccgggttcgcagtccgtgctccggcagctgttcccgaatgcgatcatcgcaacggcggaggacgccgcggtgctcggcctcaacgcggtcagcgacggccgtaacgtggtgctgccggtccaggcgacgcacctgaccgaggagctgcgcaaggccggttaccacccgatcggggtggacgtctccgagctccgcaaggccggtggcggacccaagtgctgcacgctggaggtgcgctcgtga

SEQ ID NO: 3750 - DNA, 552 bp, Actinoplanes utahensis
atgcctaccttctcgcgcacggccacgaccgataccgacgagacggcccgggtcccggtgcggccccgccggggcgacgacgaacccaccacgcaggcggtcaccaagccggtgccggccaccacggtgaccgcgccgaccgcggccgagcgcaagccgatcaccgtcggccgcccggtcaccccggtcagcccggccgcgccggccaccccggtcgccccggtgcgccgggcccgcggcagcatgatggccaccctcggcctgatcgtcagcgtcgccgggatggcgctggtgctctccggcccgctcgccggatacggcgtcggtgtcgccggactgggtctgctgctctcgctgatcggcctcaacgccacccgcagacagcacgtggccggcaagaccgacgcgctgctcggcctgctcatctcgctgggtgccatcgtgctcggcgtgctcgccctcaacggccagctgagctggctgggcaccgacacgcagccgccggcgcggctgcgggagtggcttgacgcacagtttgcgaaccgcttctga

SEQ ID NO: 3751 - DNA, 606 bp, Actinoplanes utahensis
atgagtgttgaaccgaccatgcgcggcggcggcgcgtccttcgacgaccaggtcttcgagcgtctgctccgggagcggatcatcttcctcggcagcgaggtcaacgacgaggtgaccaaccggatctgcgcgcagatgctgctgctcgcctcggaggacccggaacgcgacatcgccctgtacatcaactcccccggtggctcgatcagcgccgggatggcggtgtacgacaccatgcagtacatcaagaacgacgtggccaccatcgcgatgggcatggccgcctcgatgggccagttcctgctctgcgccgggacccccggcaagcggtacgcgctgccccacgcccgggtgatgatgcaccagctctccggcggcatcggtggcaccgccgcggacatcgccatccaggccgagagcatgctgcacatcaagacggtgatgaacgaccggatcgccttccacaccgggcacaccgcggaggagatcgagcgcgactccgaccgggaccgctggttcaccgcccagcaggccaaggactacggcatcgtcgaccacgtgatcgccaaggcgtccgacgtgaacgcggtgtcgtcgctggtctga

SEQ ID NO: 3752 - DNA, 858 bp, Actinoplanes utahensis
gtggcgatcatcacgtccggccgggtgggcccgggcggctacctttggcgcgtgccggagggacataccattcaccgcctcgccacccgccaccgcgagctgttcgccggcgcgccggtgggggtgaccagcccgcagggccggttcgcggccggtgccgcgctgctcgacggccgggtgctggccgacaccgaggcgtacggcaagcatctgctgcaccactacgagggtgaccgcacgctgcacgtccacctcgggctgtacggcaagttcaccgagggggagccgccgctgcccgacccggtcggccaggtgcggatgcggatgaccggcccgtcgcactggctcgacctgcgtggaccgaccgcgtgcgaggtgctcgacccaccctcggtgcagcggctgcgggcccggctcggggcggatccgctgcgtgacgacgccgaccccgcccgggcgtatcagaaggtcagggccagcaccaagccgctgttcgcgctgctgctggaccagtccatcgtggccggttgcggcctgatctacgccaacgaggtgctcttccgggccgggttgtcgccgctgacaccgggcaccgcggtcggccgcgagctgtgggccgccctctgggacgacctgcgcgccctgatgaaggagggcgtcgcgcggggccggatcgacaccgtgcacaccgagcacaccccggaggcgatgcggcgtgctccgcgcgtcgaccggcacggtggcgaggtgtacgtctatcggcgcactgcccagccgtgcctggtctgtgccaccccggtcgcgatcggcccgctggccggccgcaacctgtactggtgcccggcctgccagagatga

SEQ ID NO: 3753 - DNA, 1317 bp, Actinoplanes utahensis
atgccgccgcacacctcgccgcacctgacgagccccggcgacgcagccgcgacgggtgggcggcaccgtcggccggacctcgccgtgggcccggcgctgcgctccacagtggatgcaccgtcgcccgtgcccgcgccccgtgccgcccggcaccgggccggcgacaccgggtcgtacagcaccgtccggtctgccgccggagcgccacggcactccgcggcccccggccgatcccgcccccggcggccggccaccggcacccaccgcgcgcccggcaccctgccgctggagacctggctggaggcggcgaagaaccggccgaccacggtgctcggcaccctggtcgtggccggcctgctgatcaccgcggtgccgctggcccagcccggccacagcgacccgggctcgctggccgccgccgcgcaggccgaggcctcggcgcgggccgccggtcagcacgataggacgaacgactccggcaaccggccgggcggaccgcaggcgcagcccgcggccggcgccaagcccacaccgtcggcggcggtcaccggcaagccgatcgaatcgcagcagctcccgccggccgccggcgccggtcccggccggtcgctgctgaccaccggcagccagacggtcgcactcaccttcgacgacggacccgacccggagcagacgccgaagatcctggcgatgctcgagcagtaccacgtgaaggcgacgttctgcctggtcggctcccaggtggcgagacacccggagatggtccggcagatcgtggcggccgggcacacgctgtgcaaccacacctacgaccacgacctgaccatcgcgaagaagacacccgcgaagatccgggccgacctggagaagacgaacgcggcgatccgggccgcggtgccggacgcggcgatcccgttcttccgggcgcccggcggcaacttcaacgaccggctggtgcagaccgcgcacgccgacgggatgtcctcgctgtactgggcggtcgacccgcgcgactgggagcacctgaccggcgagagcgatgcggcgcacgtcaaacgggtggtcgcgtcgatcaggaagcagatcaagccgggcgcgatcgtgctgtcacacgacttcaaccagccggacacgatcgcggcgtaccgggaactgctgccctggctgaccgagaactatcagctgggggtgccgtccggcaccggtgagaccccggccaccgccaagccggccaccccggcgccgtcgacgcccgctccggcgccgagcaccagcgccgacccggtggtcaccccgtcggcggccccgaccgagtag

SEQ ID NO: 3754 - DNA, 1161 bp, Actinoplanes utahensis
atggaagccgctgccgagggcacgacgactatctctgcccgactcgccgagcgcgccgagaagcgcgatctgctcacgctcggggtcgaggaggaatacctgctggtcgacgcggtcgaaccgcgcggcgtggaaaccgtggaggcggtgctggagcagatcccggagcagttccggggcggcgtccagcacgagtacctgcgcagccagatcgaggtggccagtccgccccagctggagctgatgagcctctacgaggcgatgaccgggctgcgcgaaacggtcgccaccgccgcggagcgggccgggtcacggctgctggcggtgggcgcgggcccggccgccgggccgaacacccgactcttcgacgacccgcggtaccaccggatgcgggagcgcttcggcgatctctcacccggccaggggctgtgcggtacacacgtgcacgtgagcatcccggatgcggagaccggcgtacaggtgctcaatcatctgcgcccgtggctgccggtgctgcaggcggcgaccgcgaactcgccgctgttcggcggccgggagaccgggtacgccagctggcgctcgatgctgtgggaacgctggccgacggtgggcccgaccccgtacctcacctcacacgagcactacctgacgctgatcgccgacctcgaggcgagcggggcgatgctcgacgaggggatgctctactggtacgcccggctctccgcgcggtatccgaccgtggagatccggatgggcgacgtgatgcccaccgtggacgacgcgatcctgctcgccgcgctggcccgcgggctggtctcgaccctgctgaacgaggtgcgcgacggcgtcccggcgccggacgtgccgcacccgctgctgatggcggcgcactggcgagcggccaaggacggtctcgagggcctcgggttggacttcgccacccgggagccgcgcccggcctggcggctgctgcgtcagctggtcgacttcgtccggccggaactggagcggcacggcgacctggagatggtgaccatgctgctggagcggctgcggacccggggcaccggcgcggcacggcagcgggcgctgctggccaagggggtgccggtggccggggtggtggactggctggcgcgcgccacccgcgggggagaatga

SEQ ID NO: 3755 - DNA, 684 bp, Actinoplanes utahensis
atgtccatttccggtctcttccacgccgtcgtcgacgccgcgcacaccggcatcaccgtcctgtccgggcatctcgaaccgctgaccggcgggctcgccgcggccgtcgcgatcgtcctgttcacgctgctcgtccgggccgccctgaccccgctcacctacctgcagatccgcaccgagcgccgccgcgccgcgctggcgccgcagatggcgaagctgcgggccgagcacagggacccgatggagctcgccaccgcgaccctggcgctgcagcgcgagcacgggatcggcccgttcgccgggctactgcccgggctggcccaggcgccgttcttcatggtcatgtaccgggtggcgctgcatccgccggccggcgcgatcgccggggtgccgctgaccgcgcacctgtccgccgggctgccggtcttcgccgtgctgctggcgatctcgggcgggatcgcctggtggtcgtcgcgccgggcggccgccccgcagccggtcccggtgccgggcgacgaccagcaggcggccgcgctgaccgcggggatgctgaggtacctgccgtggctgaccgtgctcgcggtggcctggctcccgctggccggcggcctctacctggtgacctccgccgcgtggaccgccggtgagcaggtcgtccggcgccggctggtcgccgccgcctga

SEQ ID NO: 3756 - DNA, 117 bp, Actinoplanes utahensis
gtgagcaggtcgtccggcgccggctggtcgccgccgcctgaccgggaagtccggcggccggagctggtcgccggacgcaaatatcgacagattgacaacttctcgaaacaagcgtga

SEQ ID NO: 3757 - DNA, 1404 bp, Actinoplanes utahensis
gtgtcccccatggcagcttcccggagagtcctcgcggtcggcgcggcggtcctgaccgtcgccgcgtcggtcgccttcgtatcgcaggccgaggcggccgtccccgccccgccggccggcatgtccctggtcttcagcgatgacttcaccggcgccgccggcaccgggctgaacaggtcgaactggctctacgacctcggcaccggctatcccggcggcgccggcaactggggcaccggtgaggtcgagtcgatgaccgactcgaccgccaacgtctaccaggacggcggcggcaatctggtgatcaagccgatccgggacgcgtccggtcaatggacgtcgggccgggtggaaacccagcggaccgacttcgccgccccggccggcggcagggtgcgcatcgaggcccggctgcagcagccgaacgtgagcggtgcggcggccgccggttactggccggccttctgggcgctgggcgcggcggcccgcccggtcggcgccaccaactggccgagcatcggcgagtgggacatcatggaggacatcaacggccggtcgtcggtcttctccacgctgcactgcggcaccccctcgggcgggccgtgcaacgagacgaccggtctgggcagtggcgagcgggcctgcgcgggctgccagaccggtttccacacctacgcggtggaatatgaccgcagcacctccccggagcagctgcggtggtatctcgacggcgccaacttcttcaccctcaactcgtcccagctggacgccaccacctggaacaacgcgacccaccacgggatgttcgtgatcctgaacgtggcgatgggcggcggcttcccggccgcgttcggcggtggccccaccgcggccaccgcgtccggcgtgccgatgctggtcgattacgtggcggtgtaccagtccgccggtggcacgacgccgccgaccagcacgccgccgaccagcacgccgccgaccacgacgccgccgagcgggtcccgggacgcgtatgcgcagatccaggccgagtcgtacgacgccgccgccggggtgcaggtggagacgtgcgccgagggcgggcaggacgtcggctacctcaccaacggtgactggatgcagttcgacaacgtcgacttcggcaccggcggggtgaaggacttcgtggcccgggtggcctccggggcggccggcggggtcagcggcctggtcgaggtgcgggtggacagccggaacaacgccccgatcggcaccttcgcggtggccaacaccggcggctggcagtcctggacgtcggtgccgggcaatgtggcgaatgtttccggcagtcacacggtgtatctgaccttcaccagcgggcagccggccgacttcgtcaacgtgaactgggtccagttccgccggtaa

SEQ ID NO: 3758 - DNA, 1278 bp, Actinoplanes utahensis
atgaagcgctcccgatcggtacttctcgcgacggtcgccgtggtggccgccgccggtacggccacctggttcgccggcgacgcgtccgcggcggcggcctgcgccacggcgtggagctcgtccgcgacgtacgtcaaggacaacgtggccgcgcagaacgggcacaactacacggcgaagtggtggacccagaacgagtcgccggccacccacagcggccagtgggacgtctggctcgacggcggcgcgtgcggcggcacgacgacaccgagttcctcgccgagcgcctcgccgaccacgtccaagccgaccaccccgcccgcctcgccgtcgagcagcccgaccggttccccgacggtccagccgaccggcaccggcagcctcccggcgcacttcctcaccgggtactggcagaacttcgtgaacggcgccacgccgctcaagctcgccgctgtcccgagctcgtacgacctgatcgcggtcgccttcgcggacgccaccgcgactcccggcgcggtcagcttcaccctcgacccgggcctggccggtgccgtgggcggctacaccgacgcgcagttcaaggcggacatcgccaccctgcactcgcgcggcaagaaggtgatcatttcagtcggcggggagaagggctcggtcagcgtctccagtgacgcggcggccgccaacttcgccgactcggtctacgcgctgatccgggcgtacggcttcgacggtgtcgacatcgacctggagaacgggctcaacgccacctacatggcgagcgcgctgcgtaccctgcgcggcaaggcgggctcgaacctgatcatcacgatggccccgcagaccatcgacatgcagagcaccggctcgtcgtacttcgcgctggccctgtcgatcaaggacatcctgaccgtcgtacacacccagttctacaactccggcgcgatgctgggctgcgaccagatgagcgcgtacggccagggcaccgagaacttcctggtcgcactcacctgcatccagacccagggtgggctgcggcccgaccaggtcgcgctcggcctgccggccaccacccaggccgccggcggtggctacgtcgccccgtcggtggtcaacgcggccctcgactgcctggcccggggcaccaactgcggcaccttcaagccgccggccacctatccgggcatccgcggtgcgatgacctggtcgatcaactgggacgtcagcaacggcaccaactgggccggcaccatcgctccgcatctggccaccctcccctga

SEQ ID NO: 3759 - DNA, 1197 bp, Actinoplanes utahensis
atgcgtacgagtaggaagatcgccctggtctccgccgtgctcgcggccggaaccggcgcggccgtgctcccgatgaccttcgccaacgcggccgccgcctgtgccccggcctggagtgccggcgccacctacgtcaaggacaacgtcgcctcgcagagcggccacaactacaccgcgaagtggtggacccagaacgagtcgccggccacccacagcggccagtgggacgtctggatcgacaacggcacctgtggcggcaccaccaccccgcccaccacgaccccgcccaccggtccgaccacccagccgccgacgaccggcaccaggatggcctcggcgccgtacgtctacccgggctggggtaacccgccggccccggcgaccgtcgtcaacgcgaccgggatcaagtcgttcaccatggcgttcgtcctggccagcggcggctgcaacccggcgtgggacggcgagtccggcctcaccggcggcgtgcacgccagctacctttcgcagatcaaggcggccggcgcggacgtcgtcccgtcgatcggcggctggagcggcaacaagctgggcccgaactgcaccacggtggacgccctggccggcgcgtaccagaaggtgatcagcgcgttcggtctcaaggcgatcgacatcgacatcgagaacaccgacgaattcgagaacaccgcggtccaggaccggatcctcggcgccctgaagatcgtcaaggcgaacaacccgtcggtgaagaccatcgtcaccttcggcaccacgccgaccgggccgagctactacggcacccggctggtccagcaggccaaggcgctgggcgcgaacatcgacgtgttcacccagatgccgttcgacttcggcggcggctcggacatgtacgccgccacggtcggcgccaccgagggcctgaagaacacggtgaagagcaccttcggctacaccgacgcccaggcgtactcgcacatcggcatctccggcatgaacggcctttccgaccagcaggagaccaccacggtcgacacctggacccggatccgggactacgccaggaacaacggcctggcccggttcaccttctggtcggtcaaccgggaccggggctgcgccggcggcggcgtggtctccgactgctccggcatcgcccagtccgactgggccttcaccaaggtcagcgcgggcttctga

SEQ ID NO: 3760 - DNA, 348 bp, Actinoplanes utahensis
atgagcaatgtgcccctgcgggagcccacgtttctggtgctcaccgccctggccgcggaaccccggcacggctatgccgtgatcgaggacgtggcccagatgaccggcggccggctgcggttgcgtgccggcaccctctacaccgcactcgaccgcctgcgccaggacggcctgatcgaggttgaccgcgaggaggtcgtccagtcccggctgcgccgctactaccggctcaccggggccggcgagcgcactctcgccgccgagaccgcccgcctgcgcgagcaggccaccatcgccgagcgccggttgaaggttcgtcgtaccaacctcgggggagccaccgcgtga

SEQ ID NO: 3761 - DNA, 969 bp, Actinoplanes utahensis
gtgaccactctggagtcccggtaccgcaggctgctgcggatctacccggcgacgcaccgggccgcctacgaggacgagatgctcggggtgctgatggccggctccccgccggatcgtcgcttccccggcccggccgatgcggtggacctgatccgcggcggcctcacggcgcgtctcggtcgggcacttcaaggacggcacggtacgggctggcgcgaggccgccgcggtcaccggcctgttcaccgcgctggtgatggtcagtgacaacgccggcaccctgatcagcggcctgctcgagatcaatctgtacggcgacccgatgcgggcccacgggctgaacgacgccctgctggccgacccggcgctgcggttgctggcctggctcgccctcgccgtggccgcgctgtccggccgtggccgggccgccgcgctgctgtcccgggtggtggtggcggcagagctcaccgcggtcctctggtgggccggcatggacacggcggtggcgatccggctgtcctgggcgccggttgtcgcgatcgtgaccgcgctgctgttcggcatcgtccgcccggcccgcccggtccgtgaggtgctgccccgccgcagcggtctgctggtcgcggccgcgctgccggtgatggcgctggccgagggggtgctcacgattcccgagctggcctggaggttcccgtacgggctccggacggtctgggcagatctgccgttggtgctgctcgtggtcgcggtggcgctgatcggcgccccggtccgcggtcgggtcgtggtgctcgggctcgccgtctgcgtcgggccggcggtcttcctgggcgtcggggagtcgccggcgctgccgccgctggtgctggtcctggctccggcggtggtcctcgcggccggcgtcgtcgcgctgtcgcgtgccgaacgttttgcggcccgccggcgcggagaacaagggggccatgagtga

SEQ ID NO: 3762 - DNA, 1692 bp, Actinoplanes utahensis
gtgccgaacgttttgcggcccgccggcgcggagaacaagggggccatgagtgaccggtggtatcagaaggcggtcgtctactgcctcgacatcgacacgttcgccgactccaacggtgacggctgcggcgacatcccgggactgatcggccggctggactatctggcccggctcgggatcacctgcatctggctgaacccgatccacccctcgccggaccgggacgacggctacgacgtcgccgacttctacaacgtcgacccccggttcggcaccctgggcgacttcgccgagctgctgcaccaggcgggcaaccggggcatcaaggtgatcatcgacctggtggtcaaccacacctcggacaagcacccctggtttgtctcggcacggtcgtcgccggactcgccgtaccgcgactggtacgtctggagcgagaccgcaccgccggaccgcaagcagggcatggtcttccccggcgagcagtcggagacctggagtttcgaccggaccgcgaagctctggtactaccaccggttctacaagttccagccggacctcaacatcaggaacccggcggtgcgcgaggagatcaagaagatctgcgcgttctggctgcagctcggcgtcgccgggttccggatggacgcggtgccgttcatcatcgaggagacggtgcccggcaacccgaacccggcgaagaacttcgagttcctcaccgaactgcgccagcacgtgcagtggcgtaggagcgacgcggtgctgctcgccgaggccaatgtcgagccggcccagctggtcacctacttcggcgacgagggtggctcgggcaaccggatccacatgctcttcgacttcatgctgaacgccaagatggtgctggcgctggcccgggaggatccggagccgatcatcgacgggctgcgcgagacccccaagctgccgccgggcggccagtgggccaccttcctgcgcaaccacgacgagatcgacctgtcccggctcaccgccgagcagcggcaggacgtcttcgaccggttcgggccggacgagaacatgcagctgtacgggcggggcatccgccgccggctcgccccgatgctgggcaacgaccggcgccggctggagctcgcctacgcgctgcagttcagcctgcgcggcaccccggtgctgcgctacggcgaggagatcgggatgggggacgacctggccctggagggccgggacgcgatccgcaccccgatgcagtggtccggcatgccgaacgccggcttctccaccgccgacccggccgacctgatccggccggtggtgatcgacgacggatacgggtacgagaagctcaacgtgaccctgcagcggcacgactcgaagtcgctgttggcctggttcgagcggatgatccggacgctgcgcgaggcgccggagatcggcagcggggcgtgcacccacgtcgacgtgccggcccccaaggggctgctcatccaccgtgccgacgacggcaccggcaccatggtcttcctgcacaatctcgggccggacgcggtgaccgccgacctgagcagcctggccgcggagtccgagctgcccaacgacgtgctctccgacaccgaatatccggatccgggcaagctgaccgagctcccggtgtccggttacggctatcgctggatccgcctgcgcaggaccgcctga

SEQ ID NO: 3763 - DNA, 765 bp, Actinoplanes utahensis
atgtcgcagtccgcatcgtccagggtcgccatcgtcaccggagccgcgcgcggcatcggcgaggcgatcgcgctcaggctcgccgccgacggcctggccgtcgcggtcgtcgacctggatgagggcgcctgcgccaacacggtcaccgcgatccacgacgctggcggcaccgcggtcgcgatcggcgcggacgtcgcctatccggctcaggtgaccgccgcggtcgagcgggtggtggccgagctcggcccgccggccgtgctggtcaacaacgccggtgtgctccgggacaacctgctgttcaagatgagcgaggacgactgggacaccgtgatgtcggtgcacctgaagggttcgttcctgttctccaaggccgtgcagaagcacatggtcgacgccggctacggccggatcgtcagcctgtcgagcacctcggcgctgggcaatcgcggacaggccaactacgcggcggccaaggcgggcctgcagggcttcgtcaagacgctcgccatcgagctgggtaagttcggcatcaccgcgaacgcggtggccccgggattcatcgtcaccgacatgacccgggccaccgcggcgcggatgggcgtcgacttcgccgacttcgagaaggcgatgatcggtcagatcccggtggcccgcgcgggccgtcccgaggatgtggcgaacaccgtctcgttcctggtgagcgagggggccggcttcgtctccggccaggtgatctacgtggccggtgggccgagggactga

SEQ ID NO: 3764 - DNA, 399 bp, Actinoplanes utahensis
atgagctcccgcagcgtgtcgttgaccagcacgttcctgatgctggcggccggcggggcgtcggcctgcagcaacgaccgctatcacgacgagggtttctactgcgccgatgagaacggcgtcatcgtcgacgaggactactgcgacgaccacaacggcatctatcacggcggcgggccgtactacatctaccactcgccgagctaccgttccggctaccgggtcggctccaagctgccctcgggcggcagccgcttcccgtacaacgactccggctcgcgcagcacgtacgggctgccgtcgaccggccgggtcggcaacggcacggtgaagagcggcgtggtcggcaagggtggtggcggcagccactccagcggacacggctcgtcgggcagctga

SEQ ID NO: 3765 - DNA, 1458 bp, Actinoplanes utahensis
atgcgacggattccgtacgggccggtccgggacggttggcggctgaccaatttcagtctcggtctgacctacaacgacgacctcctgccggacgggacgatgtactcgtactggcaggagggcccgtactacgacttctccgccgacgagatcgaggaactggagagcgccaccgccacgctgtacgacatgtgcctgcgggccggcgactggatggccgggcagtgcccgcggcgtaccgtcgagggtcgccggcgtggcttcatgacctcgatctgcacggccgaggcgtgcttcctgacccggatcgggatccccgagtacacccacgagcagatcctgcggacctggttcgacggcgacgcggagacgtggacgcaccaggacaaggacccggacatgcggctgccgatgcagacgccggacttctcgccgaccgtctacgggcgcttcgacctctggtacaacggggccggcagcaccccgcgcctgcttgaattcaacgcgcagacaccgacctcactggtcgaggccgcggtcatccagtggcactggatggaccagaccggggtcagccggcacccgtggcggcagtggaattcgatccacgaccggctggtcggctgggaggccaccccggacggcgagccggccgacccgggcgcctggcggcgcaacatcgccaaactgcgcgaggcccggccctggctgccggagaaacccaagatctatttcgcgtacgagacgtcggagacctcgggcgaggaccggatgaacgtcgcgtacctgatgtccaccgccgaggaggccggcttcccggtggaactgatcgcgatgagccagatcggctgggacgtggccggcgaccgggtggtccacgtgcccgcccccggccgggagaacgaatcccagccgatcgacgtgatcttcatgctgtacccgtgggagtggttctggcacgaggagggcggcaaggcgttcttccgcaacatggccgacccgtccaagcggggcacggtctggatcgaaccgccgtacaaggccgccctgctcggcaacaaagccctgctgccggtcctgtggaaactcttcggcgatgacccggagcgggcgaagtacctgctcccggcgtacttcagcggatccaagggtgcggcgacgctcacctcgtacgccaagaaaccggtctggggccgcgaaggcggctcggtcaccctggtccgcgacgggacgccgatcaccgacaacccttcggagtacgggtcggacggcctctacgtcgtccaggagttgtgcgagctgccgtcgttcgacgggctggagggcaccgtgcacccggtcatcggttcctggctgatcgacggcgagcccgccggcatgggcatccgcgagggtctcggcgtcgagggcctggtcaccaagaacacctgcaacttcctcccgcacgccgtctcctag

SEQ ID NO: 3766 - DNA, 990 bp, Actinoplanes utahensis
gtggatctggcgccacaagcccggtccggccgcgtgacgaacctcgccacaccgccgctgttcgccgcgctggcatccgcccggcggatcctgatcgccggggccggcggcggcttcgacgtctacgccggcttgccgctggcgttcgcgctgcgcgcggtcggggccgaggtccacctcgcgaacctgtcgttttccgagctcgaactcgtcgaccgggagtcctggatcgccgatcacgtcgtcgccgtgacgccggagtcgacgagcccggactggtatttcccggagggcacactcgccaggtggctggcggcgcacgacatgccgtcgacggtgtacgcgtttccgccgctgggggtgcagaccctgcgggcggcgtaccggttcctggtcgagcacctgaacctcgacgcgatcgtgctcgtcgacggcggcaccgacatcctctgccggggcgacgagcacagcctgggcaccccggtcgaggatctcaccagcgtcgcggcggtgaccgcgctggacgtaccggtgaagctggtcacctgcctgggcttcgggatcgacgcgtatcacggcgtcaaccacgtgcaggtgctggagaacctggcggcgctcgaccgggagggcggttacctgggcgcgctgtcgatcccggggacgagccgggaggcggtcctctaccgggaggcggtcgccgacgccgcgaagaacacgccggaccggccgagcatcgtcaacggtcagatcgccgccgccctcgccggtcagtgcggcgacatccagttcacccggcggaccagcggcagcgcactgttcgtcaacccgctgatggccatgtacttcaccgtcgacctggaccggctggccgcgcgctgcctctacctggaccggatcgagaacaccgtcggccgccgccaggtgatcacccgcatcgaggccttccgcgacggggtcaccacccgcatcccgcgggtgtttccgcactga

SEQ ID NO: 3767 - DNA, 435 bp, Actinoplanes utahensis
gtgtctgacgagacccccgtgaagacccgccccggtgacgccgctctcggcaccggcctgggccgggtgctgctgctggtgtacgggacgttcgcgctctccgcgagcgctcgcgcgctggtccagatcagcacgaagttcggcgaggccccgctggcctacctgctgtccgcgctggccggtgcggtgtacctcgccgcgaccgtgggcctggcccgcggtggcgcccggggccggctgatcgccctggtcagctgcacgatcgagctgctcggcgtgctgatcgtcggcaccctgagcatcgccgacaaggtggcgttcccggacgacacggtctggtcccgctacggcagcggctacggctatgtaccgctggtcctgccgttcatcggcctctggtggatctggcgccacaagcccggtccggccgcgtga

SEQ ID NO: 3768 - DNA, 492 bp, Actinoplanes utahensis
gtgcaccatgtgcgcccaggggcccgtaccgaacaatccgaaacgcacgatctgcccacccgtcctcttcaggatctccggggccggaagttaccagcccaccggcacgtcagtaacctgtgccgggtgaacggtcccctctcggtggcgacgatcgtcgtcgctctcctgctggccgcgtggtatttcctgcgcagcgccctcgaccgggcgcccagccgcctcgacctgctggccatgaccgggttcagcgctctggtcgcggtcctggtcgtggtcgcggtgatcggtctgttcgacggctcgcgcccggcggacaccaccaccttcgccggctatctggtcaccacgatctgcttcgccccggccgccacctggctggccaagctggagccgacccgctgggggagcctgatcctcggggtgggcgccgtcatcctgcccgtcctagtgctgcgcctgcagcagatcgcgtcggtgaccggtgtctga

SEQ ID NO: 3769 - DNA, 894 bp, Actinoplanes utahensis
gtgcgtttcggattgttcggtacgggcccctgggcgcacatggtgcacgccgaggcgctcgcgcagcaccccgaggtggagttcgccggggtctggggacgcgacccggcccgggccgccgagctcgcgggcaaacatcacacgcgggcgtacgccgaggtggacgccctgctcgcggacgtggacgcggtggcgatcgccctgccaccggacgtccaggcgccgatcgcgctgcgggccgcgcgggccgggcggcacctcctgctggacaagccggtgtcactgcgtaccgccgaagccgtggaactgaccgcggccgccgcggaccgggacgtggcatcggtggtgttcttcacccggcgcttcgtaccggagaccgagcggttcctcgccgaggcggtcgcggccggcggctggaccgaggcccggatcgaccacctcggttcgatcttcaccccgggcaacccgttcggcgcctcgccgtggcggcgcgaccgcggtgggctgtgggacgtcgggccgcacgccctcgccctggtactgccggtgctcggcgcggtcgccgaggtcaccgggctgtccgggccgcgcgatctgaccgtgctcgtgctgcggcacgagagcggggcgatcagccggctcaccctttcggtggacgcgccggccggcgccacgcgacaggccgccgagttcgccggggaggccggggtgtggccggtgccggccgtcgagttcgccgcggtggactgcttccgggcggcactggaccagctgctggcggccgccgcgggcgggccggccgcggccgtcgacgtgcgtttcggggcgcaggtcactgcggtgctcgcggccgccgatcaggccctggagcaaggccgggtcgtccggctctag

SEQ ID NO: 3770 - DNA, 462 bp, Actinoplanes utahensis
atgcccgccgggccggtgcggccgagccgtgcgcgcgttcgtcgggctgcggtgcggtgcgtcatgcagatctgtcccctcacctcacgcctgccgcggcgtccgcgtgggagccggctgtcgggacggtccgcccctggcaagcgtgacaggagaaaaagtattcgccccgctactttgcgtccatccgtaacgcgcaggttctgtccagttagcgcctgtttcggccgacagtcacttctgccgcgcgaaaccggcgcggccgtccggcccggcatacagaatgagggcatgcacgagaccgagactccgccagtctggcgcaccggcgccgagcagccctgggaccccgaggacctggccgtggcccagggcaggtatccgacgcccgagaacatcgcgcgtgctcgcgccgagctggagcgggacggcgcggccgcgatcgagcgcaccgtcccctag

SEQ ID NO: 3771 - DNA, 345 bp, Actinoplanes utahensis
atgaccggcctctgggacgccgagcgggacgccggcgaggtgatgcgggccctgcacggcctggccgccctgctgggccgcgacccggacgaggacaccctgcggctgatgcgtcagctcgccgagaacggcgtctcctcggccgcccgggtccgggactacctgcacgagcagcgcgggcccggcgacggggacgcggccgtggtggcgtccgtgctggcaccgtggcgggagtggacgccgtcgcggggtcacctgttcggggcgcaccgggggagcgggccggtgggtgcccggcggatcaacgaggtgccgcagccgcgccgctgcgacccgggagagtga

SEQ ID NO: 3772 - DNA, 996 bp, Actinoplanes utahensis
atgcctgacgcggccccgggcgccgtttcccccccggcgcccggcatcgtccacttcgccggcggcgccgccgaagacgcggctgacgtcctgcatcgtttctaccacccggtgtcgctgggcatgccggagaacgccgacaccaagatcggcatggaggtgatccaactcggacccctcaccgtcggtcatctcaccttcaccgggcgggtgacactcgccgcaccggccgccgacgcgtaccacgtgaccctgccggtggccgggcgggtgctggcccggcggggcgggcgggaggtcaccgcgggaccggccaccgccgtcgcgttccgccccggcgatccggtctacctgcggcccgaggcgccgtccacggagatcgacctgcgcatcgaacactgggccttggagagtgaactggccgcgctgctcggtcacccgatcgagggaacgatcgacctgccggccacgttcgcgctgaccggcggcccggcgcacagctgggcccggctgatccatctggtccacaccgagctggagcaccgatccagcctgatcttccagccgctgatcgccgagcacctgtgcagcagcgtgctgagcgggctgctgctgagcgtcccacaccgctaccacgacgagttggtcgcgccggccgccgccgggccgccgcggagcatccgccgggtgctggacgtcatccacgacgagccggaccgggcgttcacggtggccgacctggccgcgatcgcccggacgagcgtgcggtcgctgcaggagggtttccggcggcacgtcggctgcacgccgatggcctacctgcagcagacccggctgacccgggcgcacgaggcgctgcgggtggccgatccggcggtggtcacggtcgccgcggtggcgcaccgctggggtttcgcccacctggggcggttcgcctcggcgtaccgcacccggttcggcgtctccccgtcagagacgctgcgccgggccggctga

SEQ ID NO: 3773 - DNA, 468 bp, Actinoplanes utahensis
gtggcgtctcccagcgaacgccgcgtgcgagcgacctctatctccggccgtcgcatggtgtcccgcggcaagtcggcgtcggaccttccgacaccagaagagagggcagctgtgtatctgccgatcacgacccgccagctggccgacggcaccgtcgagatcgccccgagcggggaaatcgatctggacaacgcgcacgtcatgcgggacgccgtcaacgacgtcctgaccaccatgacacccagcaggatctgtctcgacctgcagcgcgtgatgctgatcgacagcatcgggatcggcattctggtggcctgcttccacaccgccgccgcgagcggcatcaagctggtggtgagccatcccagtgccacggtctaccggcagctctgggtctccggcctggtcggcctgctcggctgcgccgagccaccctccccgcgcacctcggtcgggctccgtccctcctga

SEQ ID NO: 3774 - DNA, 795 bp, Actinoplanes utahensis
gtgacgttcttcagcgaggggctgcggctcgaaggggtgctccggaccgcgccggggtcccgggccgccgtgttgaccggaccgttcaccggtgtcaaggagcaggtggtggccgattacgcggagcggctgaccgcggccgggatcaccaccctgacgttcgaccaccgcgggttcggcgccagtgagggccgccgcgggcatgaggacagtcagggcaagctggccgatctgcgggccgcggtgggggtgctggacggctacgaccggtcggtggtcggggtctgcctgggcgccggctatgcgatgcgggccgcggcgaccgatccacgggtgcgggcggtggtcgggatcgccggggcgtacaacagcccggcctggttcgccgagcggatgggcctgccgtcgtaccggtcggcgctggccgggatgctggagcgctacgacgaggagatcccggcggtcgccctggagggtgaggcggccatgccgggagaggagccgtggtcgtactactcgaagtggatcggctcggacggctggcggaacagggtgacccgcggctcgctgcacagcctgatgacgctggacgtgctcggggtccggccgctgctgccgccgagcctggtggtgcacgggcgggtggacgactactgctcgccggagctggccgaggcgatgcgggccgacgagacggtgtggctggactgcacccggcacgtcgacctgtacgacgtggacgcctacgtcagccgggcggtggaggtgaccgcggagttcctcggaaagcactga

SEQ ID NO: 3775 - DNA, 465 bp, Actinoplanes utahensis
gtggagttcttcgtaccggacgtcctcgacgaggggtgcgccacccggcaggccctggaacgcctcgccgtcaaatggcgggtgctgctgatctacgccctgagcgacgggccgcagcgtccggcccggctgcgccgccggatccccggcatcaccccgaaaatgctcaccgaaaccctgcgcggcatgcagaccgacggcctgatcctgcgccgcgtccacaaggccgacccgccacaacatgtggaatacgagctgacgccgctcggccgcaccctccgcgagcccctgaccgccatctgtgcctgggcccgcgaccacagcacccccgcgccgcccccggcgtcggccggcccggcgttcaccgcgccgcagccgtcggcgccgccgcaggacgccgtgccgacgcgggtcacgcggcgcgccccggtcagtcgttcagctgggtccgctggatctcggtga

SEQ ID NO: 3776 - DNA, 459 bp, Actinoplanes utahensis
atgacgggaagctggcggcatctgccgtctccggcgcggccggtcgcggtggctgccagtgcggcggttgacgccgtacagggaaatctggctgtcgcattcgatgcggccgtcgcggagctcgccgggctggagcaggcgcatgccgggttgatcctcgggacgacggtgcggctgctgctggaggacggacatccggacgggctggccgccgacgatgtgcgcgaggcgctggcgtcctgcgtgcgggcccatccggaagcggacccgcaggtggtgctctggctgctcgccggggcgctcggtgtcctcgacgaggacggcgcgccggggccgaagccggatgccctggcccgcaacgccatgctgctgatcaccgatctgctcgcggggcgggatctgcgggactggctcaccgcggccctcaccgagatccagcggacccagctgaacgactga

SEQ ID NO: 3777 - DNA, 369 bp, Actinoplanes utahensis
atgaccagcctggatgccgttgccgcctggatcgcgaagtaccgcaaggcgtgggagtcgaacgatccggacgacatccgcgatcttttcaccgatgacgccgcctacttcaccgccccctattcatccccctggcgcggccgcgaggccattgtcgccggctggctgaagcatcgcgatggtccgggcaccacgacgttctcctggcagccgttgatcgtcaccgaggaactcgccgtgatcgaaggtcgcacctgctatccggatcgcgaataccgcaacctctgggtactgcggctggatcacaccgggcaggcccggcagttcaccgaatggtggatgcaagccccgcagccgccggaacagtga

SEQ ID NO: 3778 - DNA, 1641 bp, Actinoplanes utahensis
atggcgatctccggacggcaacggctgaccgacgcggcactgagccgcctgttcggtcgggcgcccgccctgcacgggtactcggtggagcaggtccgcaccccgatgcgcgacggtgtccgcctcctcggcgaccacttcaccccggtcaccgaccggccgcgcggcaccgtgctgatccgtaccccgtacggccgcggcctgcccacctcggcgctgaacggccggctcttcgccgcccgcggctaccacgtgctgctacagagcgtgcgcggcaccttcggctcggagggcaccttcaccccgatggcccaggagaccgaggacggccaggacaccgtcgcctggctgcgcgagcagccctggttcgacggtcggctggccaccctcggcgcctcctacctgggctggacccagtggacgctgctccaggacccgccgcccgagctgcacaccgcggtgatctacgtcggcccgcacgacttccgggaagccgtctacggcaccggcgccttcaccctcggtgatttcctcggctggagtgaccagatcgtccaccaggaggacggcggcctgcgccgggtgctgtcgatggccaccgccccgcgccggctgcgtcccgccctggccggcctccccctgcccgaagccgccgagccggtgctgcgcggccgggccccgtggtaccggcagtggctcgcccacccggacggcgacgacccgtggtgggccccgtaccgggccggcgccgccctcgacaaggtgaccgtcccggtcctgctgatcggcggctggcaggacctgttcctcgaccagaccctccagcagtacaccgccctgcgcaaccgcggcgtcgacgtcgccctgaccgtcggcccgtggacacatctgcaggtcggactgcacgcggccggcctcgtcgcccgggagagcctggcctggctcgaccagcacctggccggcggcccggccgcccgcaagtcacccgtccgggtgcaccgcaccggcgaacgcgcctggcacgatctgcccgcctggccgcccccgaccgaaccggccaccttccacctgcgctccggccgccgcctcaccaccaccgctcccggcccggacgagggcgtcgccgccttcacctacgaccccgccgaccccaccccgtccgtcggcggccgcaccctcaccggctcgatgggcgtcaaggacaaccgcgccctcgaagcccgccccgacgtcctcaccttcaccaccgacccgttgcccaccgccgtcgacgtgatcggcggccccaccctcacgctcaccgtcaccgtcgacaacccgcacgccgacatcttcgcccgcctctgcgacgtcgacccgcacggccgctccctcaacttcaccgaccagcaccggcgcctcgaccccggccacccggccggcgagccgcaccggctggaactcaccctcgacccgtgcttccaccggttgctcgccggccaccgcctgcggctgcaactctccggtggggcgttcccacgcttcgcccgcaacccggggcgggtggggggcgggctggccgcctcacaccacacgatcgacgtggccggatgccgcctcacgattccggtggccaccgcgccgccgctcaccatccgctga

SEQ ID NO: 3779 - DNA, 1104 bp, Actinoplanes utahensis
gtgcgaatcggcgagcatttcggcaaactgcgtcgagtggacgagggacgcaaactcggtggccggtaccggctgctggacgaactcgggcgcggcgggatggccgtggtctggcgggccaccgacgaggtgctgaaccggctggtggcggtcaaggttctggccgggcggtacgccggtgacgaacggttccgcagccggatcctgcacgaggcccgggccgcggccacgttgtcgcatccgaacatcgcccagatctacgacttcggggaagacgattcggagaatcccgttccgtacgtcgtcatggaattgatcaacggaccgacgttgcagcagcgcatcgaggacgccccgctgccgccgcgccgggtgttccggatctgcggcgaggtggccgccgcgctggccgccgcgcacgaggacggcctggtgcaccgggacatcaagatggcgaacgtgatggtcaccccggccggcgccaaggtggtggacttcggcatcgccgcggcggccggcccggccgagccggaggaggggctgctcggcacccccgcctacctggccccggagcggctcaccggcggcgcgatcgagccggcgtcggacgtctacgcgctcggcgtgctgctgtaccgcctgctggccgacgagtcgccgtggaccgtggagacgaccacgcagatgctcagcgcgcacatctacgccgagccggccccgctgccggacctgcccggtgtgccggaggcggtcgccgacctggtcgaccgctgcctggccaaggagccggcggaccgcccgtcggcggccgaggtgtcggaggtgctgggcgacgcggcggaggcggtgtccccgccaccggcgccaccggccccgatgctgatgccgacgcggttcgacgagcagaccgaggcgatcgcggaggcccggcttccggtgtcagtggtccggccggtggccgcggatcggcgcacccgggtgctggccggcgtcgtgctggcgcttctgcttgtcaccgtgggggcgatctgggtcacccggtcggatgattccggcccgggcgggctcggcgccgggccaccggccagcgccggcgctagctag

SEQ ID NO: 3780 - DNA, 180 bp, Actinoplanes utahensis
gtgcacgaagccgcccttggtgtccagccgggtgccggccggcgccgtgtcctcggcgccgggctgccgccgccgcccggccccggaaccgcggacggcacggccgggccggagggacggacctgcgcgctggacggcacgtcactgaccaccgccgccgggcggtgcgacgctagctag

SEQ ID NO: 3781 - DNA, 192 bp, Actinoplanes utahensis
gtgcacgccgcctgcgccgccgggaacgtccggctgctcgactggacgccggccgacggctacagcgtcgagcgggtcgatccggggccgggcctcaccgcgtcggtgaccttcgcgagcgatgtgacccgggaccggatgtcggtgacctgtttcgccggcagaccgtcggcggtggtcctgccgctatag

SEQ ID NO: 3782 - DNA, 1050 bp, Actinoplanes utahensis
atgcagggcagtgaagtcggtcacggcaccgagtcaacgcggccggtgcgctccggcggcaaccatttagcgcagactgaaagcatggtcgcgatcgcgttgcccccggacgccgccacccggatcaggttcggcgtgtcctgcctgtgggaggtggtgaccagcctgcgggtgctgcacgggcggggggatcatcccgtacaccgccggtgggcggaccggaaccggccggggcccggcggcctgctcgcccgcctggtgccgccggccgggggctacgcccccgatttcctgaccccgccgccggccggcctgaccgccgacctcgacgccgaactgtcggttcttcgccagaccgaccacgatgtcgtccgtgcccatctcgcgctcctggcgggcgacccggcccccggactcgccgaggacccggaccgcggcctggcccggctctgcgacgagatcgcggcctactgggcgtcctcgatcgccccggactggccgcgcatgcacggcctgctcgacgccgacgtccgccgccgcgcccaccggctggccaccgacggcgccgcggccgtcctcaacgacctgcacgaccgggtccgctggaccggcggcaccctcctggtcgaccagcggcactgcaccgcctcggacgtcccggacggcagcgggctggtgctgatcccctcggtgttcgcctggccggcggtgctcaccgtctccgcgtggggcaccccgcaactcgcctacccggccgccggggtcgccaccctcaccgagaccccggcggccccgccggacgcgctcagcgcgctgctcggcgccggacgcgcccgcatcctgtccgaactgcacgtgccccgctccaccaccggcctggcccggcggaccgggctcaccgccggcggcgtctcccagcacctgcgtgtgctgcgcgccgccggcctggtcaccacccaccgggaggggcgctcgctgctcaactcgcgcaccgcggccgcggaaaccctgctcgccgcggccccgtccccggtgcggcggctcctatag

SEQ ID NO: 3783 - DNA, 750 bp, Actinoplanes utahensis
gtgaccgacttcactgccctgcatcagcccggctcgccgctcgtcctggtcaacgtctgggacgtggcgagcgcccggatcgtcgccgcggccggcgccgccgcggtcgccaccaccagcgccggagtggcctggagcctgggcgtgccggacggtgacgcgctcggccgggaagcggcggtggccgcggcccgccggatcgtcgccgcggtgtccgtgccggtgtcggtggacgtcgaggccgggtacggcgacccggcccgcaccctgcgcgagatggccgccgccggggtggccggggtgaacctggaggacggccgccgctcgatcgccgagcagaccgagcggctcgccgcggcccgggcggccgccccggcggtgttcctcaacgcccggatcgacacgctgctgttcggcctgggtgacgtgaccgaggcgatcgagcgcggccgggcctatcgggacgccggggcggacggcatcttcgtgcccggcgccaccgatcccgcggtggtcggcgcgctggtcgccgggatcccggggccggtgaacgtgatggccgggccgggcgcgccgtcgatcggcgagctggcgaagctgggggtggcccggatcagcctgggctcggcggtggcgcaggcggcgtacgggctggtggaccgcgccgcccgggaggccttcaccgggggcggctatgcggagctggcgggcgcggccgactacgggcggctgaacgagctcagtcgctga

SEQ ID NO: 3784 - DNA, 1155 bp, Actinoplanes utahensis
ttgatcttgtcctcggacacgggcggagcgtacatcaatagtcaccgtggggcagggacgtcacgccgacttcgcgcagccacccaccctctaccgattcccaatacatccgatttatccgggcaacgtaggtggaatagtgcaggggtggctctccaacgttccgcccgcgccgtggccgtcaccgccctgctgctcggcggctgctccagcacccacgaggcggctcccccgccgagccccggccccgaaccccgggtcaccgccgaagccgtcggcggccggccggagaccctcagagtcgcgccctacatcgacgtgacggccggcccggtcgcgatcgacgacctggccgccaccggacagaccgacttcaccctggcctatctgcaggcgccaccacagggcgcctgcgaccccgcgtggggcggccgaaccccgctggccgacgccacggtcaccggcgaggccgaccggatcaccggccggggcgggaacgtggtggtcgccaccggcggcccgaccggcacctacctggagagcgtctgcagcgaggagcagctggccggcgcgtaccgcaaagccctcgacgcggtcggcgccaaccgcctcgacgtcgacctggagcagcaggtcaccgtcgagccggtgatccgggcgctcaccgagctgcaggaggaccgggacaccgcgatcacgctgaccctgccggtcgccggagtcaccggcttcggcagcgacgcgatcaccatgctcaaagcggccgcggacgccgggctcaaggtcaccgtcaacgcgctcaccatgaacttcaacgcggccggcggcggctggggccgggccatgacgctcgccgccggcgccgcccgggccgccctggccggcgtgtggccggacaagtcggtcgaggagctgtgggagatgttcggcgtcaccccgatgatcggggtgaacggcaccggcgggacgaccaagccggccgacgcggcatacctgctgaagtgggcgaagagcaagggcgtcggcttcgtcagattctggtcggtgaaccgggacaccggggcctgcggcaacggcacggtcgccgcgaactgcagcgggatcatccagaccgcgtaccagttcaccatccagttccagaagttcagcgactga

SEQ ID NO: 3785 - DNA, 633 bp, Actinoplanes utahensis
atgtacgctccgcccgtgtccgaggacaagatcaacgatcgtcccttttatcgttccaagggattcgagctgctcgtgctcatcgtggtgggcgtgctcgtcgccgccggggtgcgcgcctacctgctgcagaccttctacatcccgtccgggtcgatggagaacacccttctcctcaacgacaaggtgctggtgaacaaggtcctctaccggttccgcgacccgcaccgcggtgaggtgatcgtcttccagcccccgcaggcctggggtgagggcgccgccgaccaggagtacatcaagcggatcatcggcgtcggcggtgaccgggtggtctgctgcgacccgcagaagcggctcacggtcaacgggcaggccctcgacgagccctatctgttccccggtgacgccccgtcggacgacaagttcgacgtcacggtcccggccgggcgcctgttcgtgatgggcgaccaccggtcggactccgccgactcccgcgcccacctggacgccgatcagggcaccgtcccggtcgaccgggtcgccgggcgggccttcgccatctactggccggcctcccgctggagctccctctccgtcccggacaccttcaagtcggtcccggacaagggctga

SEQ ID NO: 3786 - DNA, 1179 bp, Actinoplanes utahensis
atgagcgccgaagccgtcttcgccgatgtgaccggcggcgcgagcgcatcgcagtgggccgcgctggcggggggacacctctactcgaccgaaccctggctgaccttctgcgccaccgacatcggcggcgagacccgcaccggggcgctgcacgtgggtaccggcgacaccgccgcggcggtcaccgtgaccgccgtcaccaccgagaacaactccttctaccagtggcaggaccagctggtggcgcgtggtctgcccgcgcccggcccggtcggcctgctggtcggccagcggcgcggataccagacccacctgctggcccggcccggcgccggcgaccacgccggcccgctgctggagagtctgcgcaaactgcgcgccgaggtgcccggcaccgaggtgctgcccaccgccccgcgcggcccggcccccctggtgggtgtcttcctcggcacctccgacgtggccgcgctgcgctccgccggggccgacgcgctgcccgtgctgatcgccacggacgcctggatcccggtggccggcggatggccggactatctgcggtccctgccctccaaaggccgtcgtgattcggtcaagcaggaggtgaaagccttcgccgcagccggttacgaattggtcgaggacaccctgccgaattcctatgtcacggcggccgggctgctggcacggacgcaggagcgatatggtcatccctatgacctggacgtgctgaccgagtcatttcgccgacaggccgccgcgatgggcgacaaagcgcgggtgttgtactgtcggttgccggggcaacccccggtcggctattcgcttttctacattcacggcgacacccttttcgtgagggccgtgggattcgcctatgaccggctcattcccggcgccgccgaatacttcaatctggtttattacgcgagtgtccggatcgccgccgagcacggtctctcctggatccatccgggcatcgagtcggccgacgccaaggcgctgcgcggggcccgcctgcgcccgctctggctgctcgacctcgccgaggacagcgtgctgcgggactccggcgacctgatccgggcgcacaacgccgccgtggtccgccgtctcggcgagtcatcgccggcggtcgccaaggccttcgacgccgaccagtgccttccgtactgctga

SEQ ID NO: 3787 - DNA, 1284 bp, Actinoplanes utahensis
atgcccacttcagccctgctcttcatgggcgacctcgtggtgctggcccggcaggcccggctcatctcggacgccgcccgtcggggcctggccccggtcgccgtggtcggcctcggcaccgacctcggccggctcgacgcgctgcgcgccgacgccacccacccgctgtccgcgctcgccgaggtcgtccaggtcccggacgcctcgatcgccaccgtcctgcaggccgtgcagccgctgctgcgccgctacgaggttcgcggcgtggtatcggtcggcgaggtgttcgtcgagccggtcggcgtcctggccgattgcctgggcctgcccggggcgggcaccaccgcctcggtgatctgccgcaacaagctgctgcagcgcaccaccgtgccggagttctccccggagtacgaggcggtgccggccgatcggcgcgccacgttcaccgtcgaggccggccgcttcccgctcgtggtcaagccggccgggcggtactacagctccggggtgcgcctggtcaccgatcaggccgagctcaccgcggccctcaccgcgctgggcgacgacgagatcgccctggtggagagccgggtggtcggcccggagttctccgtcgaggcgatcgtgcagggcggcgtggtgctctggtccggggtcaccggcaaggagagcaacgagcacgagaccagctacttcaccgagctggcgcacaccagcccggcggtgctcgacccggacgaccaccacgcgctggtggccgcgaacaccgagatcatccgccgggtcggcctgcgcgacggcatcacccacgccgagtaccggctgagcagcgccggcccggtgctcatggagatcgcggcccggctgcccggcgacgcgatcaccttcctctgggagctggccaccgggcagccgaccgagatcaccatcatcgatctcgcgctcggcgtcccggccgcctacccggcgccccgccgccgcgcccgccagcacttcctctcccacccgcacggggtgctgggcgacgtgaccgccgacggcgtcgaggtcgtctggcccggcgtggacgaccgctggccggccttcaccccgcgggcggcggccgacgatccgcacacgcacgcggtcatcgtcggccggctgcccggcgacgtcctcggcgaccagatcgactccggccaccggtccgcctcggtgatcgtcgacgccccgctggacgccgacatcgaacacgccaccaaaaccgccgccggtcgggtgaccctcaccgtccggccggcctga

SEQ ID NO: 3788 - DNA, 867 bp, Actinoplanes utahensis
atgagccacgaggtcctgctcaccgtcaccatgctgcgcccggaggagaagctgctggcccgcgccctgcgcgaccgcggcatcgaggtccgcaccgcgctcttcggtgacctggccgaggtggtctccggtccggccgcgccgcctccgctggccatcatccgcaacgtgtcgcaccgcgaggcgatcgacgccgcgcgccggctcgaacacctcggcgtcaccgtcctcaaccggccgtcggcgatcgagatctgcaacgacaagggcctgcaggcgttggtcttcgaccggaacggcatcgcccacccgaagaccctgcacgtcttcggtttcgaccaggtccgggccgccgtcgaggaggtcggctggcccgcggtggtcaaaccggtgagcggctcctggggccgcggggtgaccaggctgactgacgaggccggggtggccgcgtggatcggcggccgcgagtcggtggacgccgccggcaaggcgttcccggtactgatccaggcgtacatcgacaagcccggtcatgacctgcgggtcctcgtcgtgggcgaccagccactggtcgccttccggcgggtgtcgcaggactggcggaccaacacccatctcggcgccaccgtcgagcgggtcgaggtgaccccggagatcgccaagctgtgccgtctggtcgccgacgcactgggcgacggcttctacggggtggacctggtggaggaccggagcaccggcgagttgctggtgctcgaggtcaacgccagccccgacttcgcccgctcgtcccaggtgcacggcgtcgacgtggccggccatctcgccgactacgcggcccggcgcctggaagccggggtgccggcatga

SEQ ID NO: 3789 - DNA, 1320 bp, Actinoplanes utahensis
gtgatcaccgacttcccgtccgcccccctgaccctgcccgaccccgaggagctcacggccgagctcgcggccctcggcggcccggcgatcatcccgcccacggcccgccgcaccatcttcccggtgatcaccaaggaggacgtgttcaacctcctgctggcccagcgggccgacccgcagcaggtggtcgccgacttcgccgaggcgtaccggtcgtacgtcggggcgcggtacgccctgcccaccgcgagcggcacgtccagcctgcacctggccctgatcggggccggcgtgcagccgggcgacgaggtgatcgtgccggccttcaccttcatcgccaccgcgcaggccgtggtggccgcgcacgcggtgccggtcttcgtggacatcgacccgcgcacctactgtctggatccggccgccgccgaggccgcgatcaccggccgcacccgggcgatcatgccggtgcacgtccacggcctgccggccgacgtgccggcgctgcgggcgctggccgaccggcacgggctggcgctggtcgaggacgcctcgcacgcccactccgcgcggatcggggacgcggtcgccggctcgttcggcgacgcggccggccagagcctgatggcggacaagaacttcccgctcggcggcgagggcggaatcgccttcttcgactccgaggcgggctggcgccgggccgtcgactacgtggcccggcacggcatcgactaccggatgtcctgggtcgccgcggcgttcggcgcgagccagctcaagcggctgccctactacgacgagatccgggcccgcaactcccgggtactcgccgacgcgctcgacggtaccgggctgttcgcgccgccgttcgtgccgccgggtcacacccacgcgtacaacatgtaccggatcaccctgcacccggcggcggccgggctggacgacctgcccggatacgccgtcaaggaggccgtgcacgagctgctggtcgccgagggggtgccggcccgcgagtggcagaacacgccgatcccgtgccacctgccgttccagcgtcgcaccggcttcggcggcgggtatccgttcacgctgaatccggccgcggcccgcgaccaccggcccgaggacttcccggtcacgctcggcatgctggacagcaccctggtgctgtgccgggagctgcgttcgccggtcgagtacgagcggatcctgcggtacgccgacgccttccgcaaggtggcccggcgtccggacgcgatccgcaagctggtggccgaccgggactaccggcggccgtacgagaaggcggcccgccttggctga

SEQ ID NO: 3790 - DNA, 1044 bp, Actinoplanes utahensis
ttggctgagcagcgcatccgggtcgccatcgcgggggccagcggctacaccggcggcgagctggcccggctgctgctggaccaccccgcggtcgagctggccttcctctcctcggagcggcacgccggcctgccggtggccgcgcagcacccggccctgcgcaaccaccccggggtggccggcctgaagttccggccgctcgacgagctgccggaaaccgacgtcgcgttcgcctgcctgcccaccggcgccctgccggcccggctgggtctgctggccgagcgcgcgaagcgggtgctgaacctggccggcgactatcggctggccgacccggcggagatccgcacccactatccggcgaccgccgagcacccggcgccggccccgttccgctacgtcgtccccgagctgaccgtgccgctgcccgactcccggttcgtcaatctgcccggctgcatggcggtggccagcgtgtacgccctctacccggcgctgcggcacgacctggtgcagcccggcgtggtggtcgacgcgaagaccggctcgaccggcggtggccggaactcgaccgagcagcatgccgaccgggccggcaacttccgggtccacaagctgcacgggcaccggcacggtccggagatccggcaggccctcgccgacctcgccgggtcggcgcccgacctgcagttctcggcgcacagcctggacgttccgcggggcatcctggtcaccgggtacgcccggctgcgctccggggtcacctcgctggaggtgaagcgggcgtacgcgcaggcgtacatcggcaagcctttcgtccgggtccgcccggcgcccaaggcaccgcaggacttccccatgctcaaggcggtggtcggctcgaacgtggccgaggtggccatcgcggtgcagggcgaccggctggtcgcggtggccgccctggacaacctgatcaagggagcgtccgggcaggcgatccaggtgatgaacctgcagcacggcctgcccgagacgaccggcctgccgttgacggcggccgccccgtga

SEQ ID NO: 3791 - DNA, 1848 bp, Actinoplanes utahensis
gtgacccggccgctgtacgtcgtcaaggtcggcagcagcacgctggaccgggacggcatccacgacgaactcgacgagctggtcgcgcgcggggcccgggtgctgctggtcgccggcggcgcggccggcatcgagcggcactaccgggcgatcggccgggccgcgccgcagctgcgcctgcccaacggcgacgtggtccggcactgcccggccgaggagatgccgcacctggtcgacgcgtacgagaaggtcaccctcccggcggtggagggcggtctgcggcggcgcggccggaccgcgtacaccgcggtggcggcccgcggcggcctggtcaccggacgtccgaaccggccgctgaaggtggtgaccggtgcggggcgcaccggggtggtgcgtgaccaccgggtcggtgtgccggaccgggtggacgtcacccggatcggcgcgctgctggacgccttcgacgtggtctgcctgtccccgccggtgctcgacccggacgacgggctgccgctgaacgtcgacgccgacgtgctggcggccgcgctcgcccgcgccctgggcgccgaccacctgcgcctggtcaccggcaccgcggggctgctgaccgatccggccgagcccggctcgacgctgcgccacgcctacccgggcgaggccatggcgtacgccggtggccggatgcggcaaaaggtgcgcgccgccgagctcgccctggacagcggcgccgacgtggcggtcaccggtccgcacacgctgcgcgaggcgtccggctggacccggttctggccgacccgggaaccggccgccgacctggaactgctcacccacgcggtgagtgtgccctcggtctccggcgacgagcgggagctcgccggctacctgctggactggtgcgccgcgcggggcatcgacgcggcgatcgacgaggtgggcaacctggtcgcgaccaagggggacggggaccgcaccctgctgctgctcgggcacctggacacggtgccgcaccactggccggcgcgctgggccggcaccgagctcagcggccgcggctcggtcgacgccaagggcagcctggccgcgttcctggaggtgctgtccaccgtgacggtgccggccggcagccgggtgcgggtggtcggcgcggtcgaggaggagatctcctcgtcgaagggcgccttccacgtccgcgaccactatccggcgcaggccgtcgtggtcggggagccgagcggctcgcagaccctgacgctgggctacttcgggctgttcaagctcggggtgaccgcctcgacgccgagcggccactcggccgggatggacgccgtctcggctccggacgcgctggccgcggtgctgctgcggatccgggaggcggtcggcaagctggcgccggaggcgctgagcgcggtcatcgacctgcgcaccgagtcgcatccgggcgggcatcgcgcggccggcgtgctcaacttccgggtcccgccggacgccgacccggaggaactgcgcgaggccgccctggcggtccgcgggccggacgtcgaggtcgaggtgctgcgcaacacccccggttacgccgggaagcggtccgggccgctggtcaaggccttcaaccgggcgttcgccggggccggcgtccgcccgcggtacgtggtgaagaagggaacctccgacatgaacacgctcgccaccacctggcgggacgtgccgatggtggcgtacgggccgggtgactcggcgctcgaccacaccgacgtggagcgcatcggcgctgacgagtaccgggccggccgtgcgatcctgaccgcggccgtcgagcagtggctgaccctgggcggcgaccggtga

SEQ ID NO: 3792 - DNA, 1266 bp, Actinoplanes utahensis
gtgggaggccgcccaggtcgccgcggcccgccggctgggcaatctggtgatcgtggtggaccgcaacggcggtcagaacgacggcctggtcgcggacatctcgccgctgcccggcctggccgaccggttccgcgcgttcggcttcgagacggccgaggtggacgggcacgacgtggccgcgctgtccgcggtcctggcacccggccgggacggcctggaccggccgctggcggtgatcgccgacaccgtcaagggcaagggcgtgccgccggtcgagggccgggcgaactcgcactacgtgaccatcgacgccgcccgggcggccaagtggaaggcactggtccgatgaccctcagcgggcgtgacgcctaccgcgacgagctgacccggctcgccggcagcgacgggtcgatcctctgtctggaggccgacctcggcggcaagggacatccgttccagaaggcccacccggaccggttcttcaacctcgggatcgccgaggcgaccatggtggacatggccgccgggctggcggtcgccggcttccggccgttcgtcagcacgttcgcgccgttcgcggcgctgcgcgcggcggagagcctcaagctcaccctcggctacctgggcgcgggtgtcaccgtggtggcgccgtacgccggcgtctccggcgcctggttcggcaccacccaccactgcctcgaagacctggccgtgctgcgcagcatccccggggtcaccatcgccgccccctacggcgagcaggagatgcgggcggtgatccgggccgcggcccgctccgggcggccgcactacatccggacgggacgcggcgcggcgtacgacagcctgcccttcgacggcgacgaccgcccgccggtgcagtggcagaccggcccggacccggcgaaggtctgcctggtctcggtcggcgaggagggcacccggctcagcctggaggcccgcgcggcgcggccggccgccgaccacgcccacctctgctacctcgaccacgagggcctgcgtgcggccgcggccgagctcgcccgccggcacagccggttcgtggtggtcgaggagcaccgggccgagggcggcatcgccgaggccctcgccctgctgctgcccggccgcacggtgaccggcgtcaacgccggccacggctggccctccgagggcggcgaccaccaccaggtgatgggcgggctcggcctggatctgccggccgtcctcgccgcactcgacgaccacctttccgacggagtgtga

SEQ ID NO: 3793 - DNA, 1629 bp, Actinoplanes utahensis
gtgtccgaactgcacatcgacttccggggcgagaccccgaccccggcacccaacgcgcccggggcgcgcccgggcgggcggctcatcctgctcgccgacgccgagccggaacacatggatccggcgcagacctacatcggcaccacgctggcggtcgccacggcgctgttccaccgcaccttgaccggctacctggaggacccggcgggtggcccgcggcggctggtcggtgacctcgccaccgacgccgggcgcaccgatgacggcggccggacctggacgtacacgctgcgcgagggactgaagtacgccgacggccggccgatccgggcacaggacgtcgcgtacgcggtggcccgctcgttctcgccgtacggcgtgtacggcccgcagttcctgcagcaggccctggccccggacggcggctacgacggcccgtacgcggacggcgcgccggcgcccggcgtcgagactccggacgaccggaccatcgtgttccgcctgcccgccccggaaccgctgttcccgctgctggccaccaccacgaccaccacgccggtgccggccgaccgggacacccgggagcggtacgagaccgactgggtcgccaccggcccgtaccgggtgcgcgagttcgtgccgggcagccactacctgttcgagcgcaacccgcactgggacccggccaccgacccgatccgcagccggaacgccgacgagatccgctgggagttcggcgtggaccgcgacgagcagacccgccggctgcttcacccggccggcgacgacgtgcgggcgatcgccaccttcgacgtcgcccaggaccgggtcgacgaggtgctcggcgatccggagctgagccgccgggtggtcgccggaccgtcggtctacctgcagtacatctacatcaacacccggcgggtcaccgacgtcgacgtgcgccgggcgctgaacttcgcgatcgaccgcgagacgctggtcgcgctggccggcggcccggccgcggcggagccggcgaccacggtgctggcgccgaacatccccggctaccggccgtacgacgcgtatccggccggggcttccggtgacccgctgcgggccaaggagctgctggccggcaaacagctgcggccgctggtgttcgcctacccggacaccctgcccaacgtgccggtcgccccggcggtcaaggccgccctggaacgggccgggttcgagatcgtcccgcgggcggtcgacaaggccgccttctacagcctgatgggcgacgcggagaacgactgcgacctgatctacggcgtgtggggtccggacttcccggacgcgtccggcgtcttcgacgtgctgttccgcggcgaccggctgaccgccgccgggaacatgaacctgtcctacttcgacgatccggagatcaccgcccggctggccgtgctcagccgggagccggaccggggcgcgctcgccgacgcgtacgccgagctggaccgcgacctgatggcccggcacgccccggtggtgccggtctactacaagcgccagctgactctgtacggcccggccgtgggcgggttgtcgctcagcgcccagtacttcgtgcccaacctcacccgcgcgtacgtcgccggctga

SEQ ID NO: 3794 - DNA, 1251 bp, Actinoplanes utahensis
atggacacctcgcccggcgccggccgcctccggtcggcggtcagcgcccgcttcggcggccttccgcgatcgttctggatcgtcttctccggaatgatcgccaaccggatcggcaccatggtcgtgccgttcctggtcttcttcctgggcgcccgcgggttctccaccgagctgaccggcaccatcgtcatcgtgctcggcttcggcgggatgttcgggccggcactcggcggcctgctcgccgaccggatcgggccgcgcctgacggtgatcgtcggcctggcgctgaccccgttcagcctgggcgcgctgtacggcgcgcccaacctggtcaccctggcgatcgcggccggtctgctcgggctgaccggcaccatctaccggccggcgtcgtcggccctggtcgccgagacggtcggcccggacgggcgggtcaaggcgttcagcctgctgcactggggcttcaacatcggcaccgcggtcgccaccgggatggccggcttcctcgcggtccgcggctactggctgctgttcctggtcgacgggctgacctgcctggtgtacgcggtgatcgtgctcgtcggcatcccgccggaccggcgtgccccggcggccgagcgggtgcacggcatcgggtacggcgtcgtgttctccgaccgtctgatggtcggctacctggtgctcagcgcggtcggcatcaccgtgtacacgcagaccgagttcaccctgccgctggccatccggctggacggtctctcgccctcggtctacggcgcggtcggcgccctgaacgcggtactggtcgtgctgctgcagccgctgctgttcggctggctgtccaaggtcgaccggatccgggtgctcgccgcgtcctgggtgctgatcggtgccggcgtcgccggcaccggcctggccgaccacctctggcagtacgcgatcaccgtggtcgtctggtcgatcggcgaggtggtcaacggcatcgtggccggctcgatcgtcgccgatctcgccccgcccggcgcacgcggccgctaccagggcgcgttcacctgggtctgggcgctcgcccggctggccgcgccggcgaccgcggtcggcctgttcggcacggtcggcccggccgtcctctggtggggctgcgcggtcggcggcctcctggccggcgtcgcctcgatcgccctcggcccggccttcgcccgccgcttcgccggcaatctcgagtccaccccgaaacaggaggcaaccgcatga

SEQ ID NO: 3795 - DNA, 1326 bp, Actinoplanes utahensis
atgaccgaccagcgcaccgaggcgtacaacgccctcgcccgggacgacttcagcccgctgcggcgggtcatggacgacgtcgagaaacacccgtcgctgagcaactggaccggctcctacctgccgcggccgctgttcgccgaccgccggcagctggacgccttcgccgccgacgtgctgaccctcttcgacgtgatcacctcgctgccggaccggctgttcgacggcgacctggaccggtacaccgcggcgctcggtgtcgagccgcgccgggcgaagctgatccgctcgctcggcgggatcaccccgccccggtacggccgggccgacatgtaccacgacggcacctcgttcaagctgctggagatcggcatcgccagcgaggtgggcggcgccgaccgggccggggagatcccgcgtgccctgctggagaacgaggcgttcgccgggttcgccgccgagcacggcctggactacgtgcacaccggtgagcgggtggcccgcaccctgcgcgccgccggagcctcgatcggcgcggccgagccggtggtcgtcctgctggaggcgcccggcgggctggcgaactacgcgagccactggaacaccttccgggacgtgcagcggcgtgccggcctcgacttccacgtcgcggagatcggcgacatcaccgaccgggacgggaaactgcacctcggcgacgtcgcggtcgacgtgatcctgcgctgcttcacggtcgaggagctgatcgccgagccggacggtgaggcgctggtcgagccgatcctgcgggcccaccgggcgggcagcgtggtgctgttcaccccgctggagagcaacctgttcgccaacaagggcgcgctcgcgctgctgtccgacccccgccggcgggccgctttcaccgccgccgagcaggccgtgatcgaccgggtgctgccctggacccggtcgctcaccgacgccgacgaactcggcctgatcgacctcggccgggagcgccgggagacgctgatcctcaagccgaacggctactacggcggggtcggcgtgatcgccggctgggagaccccggaagccgactgggagcgggcgctgcgcgagggcgtcgccgacggcgcgatcatccaggagcgggtggtaccgcgctccgagccggtggtcgacccgggcaccggcgaggtccagccgtggcaggcggcctgggggctgttctacaccccggagggcttcgccggggcgtacgggcgggcggtgccggccttcgagagcgcggtgatcggtgtgaccgcgtacaagaacacccgtaccgccggcgttttccactactga

SEQ ID NO: 3796 - DNA, 2703 bp, Actinoplanes utahensis
gtggcaggcggcctgggggctgttctacaccccggagggcttcgccggggcgtacgggcgggcggtgccggccttcgagagcgcggtgatcggtgtgaccgcgtacaagaacacccgtaccgccggcgttttccactactgagaatcactgaggggatggtcgtggcaggaaatctgtcccggatcgaggccgaggaacgcggccgcctgctccaggtgctgtcgtacgccgtcgagctggacctgaccggcgacgcgacgtcgttcggcaccaccacggtggtgcggttcggctgcacccggccgggcgccacgaccttcgtcgacctggccgtgcccgggctgcggcgcgccgtgctgaacggcgtgccgctgcccgcgacggcctacgacgccgaccgggggcggatcacgctgccggacctgccggcggacaacgagctgcggatcgaggcggtcggcgcctattcccgtaccggggaggggctgcaccgcttcaccgacccggtcgacgacggcgtgtacctgtacacccagctcgccccggcagacgcgcaccgggtgttcgcctgcttcgaccagccggacctgaaagccccggtcacgctgaccgtgctggccccggccggctggcaggtggccggcaacaccgcgggcacggcgtcgccggccggcggggacaccgcgcggtgggagttcccgccgaccccgccactgccgacctacgcggtcgcggtcgtcgccggcgactaccacgtcgtcgccgacgagtacccgtcgatcccgctgcggctctggtgccgccgatcgctggccggcagcctggacgccgccgagctgttcgcgatcaccaaggccgggttcggcttcttccgggacgcgttcgaggtgccctacccgttcggcaagtacgaccaggtgttcgtccccgacttcaacctgggcgcgatggagaacgccggctgcgtcacggtccatgagaagtacgtgttccggtcccgggtgaccggcctgatgtacgagcgccgcgccgagacgctgctgcacgagatggcccacatgtggttcggcgacctggtcaccatggcctggtgggacgacctgtggctgaacgagtcgttcgccaccttcgccggggtgctggccctggtcgaggcgacccgctggaccgacggctggaccacgttcgcgaacctgcgcaaggccgaggcgtaccggcaggaccagctgccgtcgacccacccggtggccgccgacatcgcggacatccgggccatcgaggtcagcttcgacgcgatcacctacctcaagggcgcgtcggtgctcaagcaactggtcgcgtacgtgggccaggaggagttcctggccggcgtccgcacctacttccgggcgcacgcctggggcaacaccaccctgcccgacctgctgcaggccctggagaagtcgtccggccgcgacctgcggccgtgggccgagcagtggctggagaaccccggcgtgaacgtgctgcgcccggtcgccacggtcgacgccgccggccgctacaccgcgttcgccgtacggcaggaacgcgggccgcgctgcccggtgctgcgctcgcaccggctcgccatcggcctctaccggctcggcccgggcggcctggtccgcaccgaccggctggagctggacgtcgccggcgagctcaccgagatcaccgagctgaccggcgccgaacagcccgatctgttgctgatcaacgacgacgacctgacgtacgcgaagattcggttcgacgaccgctcgctggccaccgtgctgacccggatcaccgagctgaccgatccgctggcccgcgcgctgtgctgggccgcgctctgggacctggtccgcgacggcgaactgccggccgaccggttcgcgtacacggtggccgccgccctgcccgtgctgatcgacggcacgctgctgcagaccctgctcgaccaggcgcgcacggcactgcaccgcttcgtcgccccggcccgtcgcgccgagctcttggcccggctggccgaggcgaccgccgccgagctcaccgccgccgagcccggctccgaccgccagctggtcctcgcccagcagttcgcggccaccgccgtcaccggcgctcaactggacctcctcgaggatctgcgggccggcgtacgcgttccgcagggcctggtcctcgaccccgacctgcgctgggcgctgctgcgccgcctcgtcgtgcacggccgggccggcgacccggagatcgacgcggagctggcttgcgaacccaccgcggtcaccgcccgcagcgccgccacctgccgggccgcccgccccaccccgcaggccaaagccgcggcctggtacgcgctgaccggcggcgagctgaccaacctggaactgcgggccgtcctggagggtttcgccgagccggagcatgctgcgctcctggaaccctatgccgcacaatatttccagcagatcgatcgggtatggagggaatggtcgagcgggatggcgcagcgtttcgtgaccggtgcctaccccgcctggtcggtcaccccggacacgatcgcccgcaccgacgcccacctggcccgcccggacgtccccgccgcgcaggcccgcctgctgcgcgaggcgcgcgacgagatcgtccgcgcccgccggctgctcgacctcgaagattggacggaaactccccgatga

SEQ ID NO: 3797 - DNA, 573 bp, Actinoplanes utahensis
ttggacggaaactccccgatgaccacccgagcgttcctcttcctgctggccagcgcccgcccggacggcaacacggagctgctggcccgccacgccgccgccgagctgccccccggcgccacccagcgttggatccgcctcgccgacaccccgctcgacacctacgcggacatccgccaccgggaacccccgcaggagcgcatccccaccggcgccgagcgcctgctgctggacgccaccctggaggccaccgacatcgtcatcgcctctccgctctactggtacagcctgtccgccgccgccaagctctacctggactactggtccggctggctccgggtcggcgcccccggctccttccgcgcccggatgaccgagaagaccctgtggggaatctccgtctacagcggcgacaaccccgcggacgccgatccgctgctcggcgccctccagaaatccgcggaatacttccccatgcgctggggcggcctcctcctcggccagggcaaccgccccgccgacatcctccaggacacccccaccctgacccgagccaagaccttcttcagctga

SEQ ID NO: 3798 - DNA, 810 bp, Actinoplanes utahensis
atgagcatgagcacgccgggtcccgaacgggtcccgtccaccgtcaaggtcggcaagaccaccggtcagggcaaaccgcccaccggcaagccggccggaaaccggcctcccgccggcaagggcggaaagggcggcaagggccgcaaagcggtcaccccggtcaaggtgagcggaggccgcaactggggcccgatcgccgtcggcacggccgtcgccctcgtcgcgatcggcatcatcggctacggcgtgtacgcctcgttccagagcacccgcgactggaccgagaagatggccgacatctccggcgtcgtcaactaccgcgcgcagaagaacccgcagctcgacgaccgcacccacaaggacggcgcgctcacctacctgaccagcccgccggtcggcggcgcgcacaaccaggcctggcagaactgcatgggcgacgtctacaacgcgccgatcgccaacgagcacgcggtgcacagcctcgagcacggcgcggtctggatcacctacaagcagggcctgcccgccgaccaggtcgcggtcctgcagaagaaggtcgagggcaaggactacatgttcatgtcgccctacaccggcctcgacaagaacgtctcggtccaggtctggggctaccagttcaagaccgacgacgtgaaggacaagcggatcgacgacttcgtcgccgccggccggatcaaggcctccatggagcccggcgccccctgctccagcggcaacaccaccaccggcccggtgaccgccggcagcaacggcagcaccatgaacccggcgcccaccgcaagctcatga

SEQ ID NO: 3799 - DNA, 1662 bp, Actinoplanes utahensis
gtgactcccgccaaccttgctgacactgttctctcagctgctcgtgccgttttcgagacgcgtgggctggatccggccgcgctgcccgccaccacgtcgctggagcggccccgcaatcccgagcacggcgactacgcctcgacgctcgccctgcagctgggcaagaaggtcggcgtggctccgcgcgagctggccgccgcgctggcggcggagctgggctcgcgggccgggatcaagtcggtggagatcgccggcccgggcttcctgaacatccggctggacgccgcggtcaccggcacgatcgcccgcaccgtggtcgaggccggcccggcctacgggcggaacacccagctcgccggtcagcggatcaacctggagttcgtctcggcgaatccgaccgggccgatccacctggggcacacccgctgggccgcggtcggtgactcgctgcgtcgcatcctggcggccgccggcgccgaggtgaccagtgagtactacatcaacgacgcgggcgcccaggtggaccggttcgcccggtcgctgttcgccgccgcgaacgggcagccgaccccggaggacgggtacgtcggcgactacatcaccgagatcgcccagcgcatcaccggtgccgacccggcgctggtgggccggccggccgaggcggtgctgccggtcttcctggagcgcggctacgagctgatgctcgccgagatccgggcgagcctggagcgtttcggcgtgcacttcgacgtgtggttctcggagaagagcctgcacgacggcggcgcggtcgagcacgccatcgcggagctgcgcaagcaggggcacatcttcgaggagggtggcgcgatctggctgcgcaccaccgacttcaccgacgacaaggaccgcgtgctgatccggtcgaacggggagaagacgtacttcgcggccgacgcggcgtattacatcaacaagcgggagcgcggcttcgaccgttgcgtctacctgctcggcgccgaccaccacggctacatcggccggctcaaggcgatcgccgcgtgtgccggcgacgacccggacgacaacatcgagatcctgatcggccagctggtcaacctggtccgggccggccagccggtccggctgtcgaagcgggccggcaacatcatcaccctggacgagctgctcgaggcggtcggtgcggacgccgcccgctactcactggcccggtcgtccaccgactcgatgctgaccctggacatcgaggagatcaccaagcactcgaacgacaacccggtgcactacgtgcagtacgcgcacgcccggatctgttcgatcctgcgcaacgccgacgagcggggcatgagcaagggcgaggggtacgacccggccctgctgtcgcacgagcgggagaacaacctgctcaagacgctcggccagttccccgccgtggtggccaccgccgccgagctgcgcgagccgcaccggatcgcgatctacctggaggagcgggtggccaccgacttccaccggttcttcgacgcctgccaggtggtgccgaagggtgaggccccggtcgaggacgtgaacgtggcgcgtcgctggctggccgaggccacccgaacggtgatcgcgaacggtttggccctgctcggcgtgtccgccccggagaggatgtag

SEQ ID NO: 3800 - DNA, 1386 bp, Actinoplanes utahensis
atgcgcgcacacgaggccggggcgctgcacggcgacctcggcaaccgcgggccggcctggttgcggacgcccgaggacgtgaacgccctcgtgccgcagctctggccgcgcacggtgacccgcaccgacgccgggtccctgcagatcggcggcgtcagcgtgaccgacctggcggccgactacggcaccccggcgtacctgctggacgaggacgacctgcgggcccgctgccgggacttcgcggccgccttcgccggcgcggacgtctattacgccggcaagtcgttcctgtgcaaggccgtggtccgggtggtcgaggaggagggcctgttcctcgacgtgtgttccggcggtgagctggcggtggccctggcggccggcttcccgccggagcggatcgggttccacggcaacaacaagtcggccgccgaactggcccgggcgctcgacgcgggcgtcggccggatcgtggtggactcgttccacgagatccggcgtctgaccgaactgtcccgcgagaccggtaaacgccccgccgtgctggtccgggtgacggtcggggtcgaggcgcacacccacgagttcatcgcgaccgcgcacgaggaccagaagttcgggttctcgctggccggcggcgcggcgttcgcggcctgcgcgcagatcctcgacgagaacgtgctggacctgcgcggcctgcactcgcacatcggttcgcagatcttcgacaccagcggattcgaggtggccgcccggcggatcctggaactgcaggcgcaggtgcgcgacgcgcgcggggtggagctgcccgagctggacctcggtggcgggttcggcatcgcgtacaccacgcaggacgatccgtcggcgccgggcgacctggccaagcggatcaacaagatcgtcgagtcggagtgcgagatggccgcgctgcgggtgccgcacctgtcgatcgagccgggccgggcgatcgtcgggccggccgtcctcaccctctacgaggtgggcacggtcaaggacgtggacggcatccggacgtacgtcagcgtcgacggggggatgagcgacaacatccgcaccgcgctgtacgacgcctcgtactcggccaccctggcgaaccgccgctcggacgccgaacccctactggcccgagttgtgggaaaacattgtgagtccggagacatcgtcgtgaaggatgaattcctgcccgccgacgtgcagcccggagatcttgtcgccgttccgggaaccggtgcctactgccggagtatggccagcaactacaaccacgttcctcggccgcccgtggtcgcggtgcgcgacggcgcggcccgcgtgatcgtgcggcgcgagaccgaggacgacctgcttgcattggatgttggatga

SEQ ID NO: 3801 - DNA, 1299 bp, Actinoplanes utahensis
atgagccaggggaaaccggtacgcctcgccctgctgggctgcggcaccgttggtactgaagtaatccgtctgttgcacgagcaggccgacgatctgaccgcccggatcggggccccgctggaggtcgccgggatcgccgtgcgccggctcggccgcgaacgcggcgacctgccggtcgatccggacctgttcacctcggacgcgctgggcctgatcaagcgcgacgacgtcgacgtggtgatcgaggtggtgggcggcatcgagccggcccgcacctggctggtcgaggcgctgcgcgcgggtaagagcgtggtgaccgcgaacaaggcgctgctggccgaggacggcggcacgctgcacgacgcggccgccgagggcaacgccgacctgtactacgaggccgcggtggccggggcgatcccgctgctgcgcccgctgcgcgagtcgctgcacggcgaccgggtgaccgcggtgaccggcatcgtgaacggcaccaccaacttcatcctctcctcgatgttcagcaccggcgccgggttccacgaggcgctggaggaggccaccgagctcgggtacgcggaggccgacccgaccgccgacgtggagggcttcgacgccgccgcgaaggccgcgatcctggcctcgctggccttccacacccgggtcaccgccgcggacgtgttccgtgaggggatgaccgcggtgacggccggcgacatggccagcgccaaggagatgggctgcacgatcaagctgctgtgcatcgcgcagcgcagcgccgacgcggtcagtgtccgggtgcacccggcgatgatcccgctcagccatccgctggccggggtcggcgacgcgtacaacgcggtgttcgtcgaggccgacggcgcgggcccgctgatgttctacggccggggcgcgggtggccggccgacggccagcgcggtgctcggcgacatcgtcgcggcggcccgcaacaagctgaccggcacccgggcgccgagcgagagcaactacgcccagctggcggtccgcccgatcggcgagtcgatgacccgctaccacatcagcctggacgtggccgagcgcccgggtgtgctggccaccgtggccggcgtcttcgcccagcacgaggtgtcgatcgccacggtccggcagtccggccgggcggacgacgccaagctggtgatcgtcacgcacagcgcgccggacgcggcgctggccgccaccgtcgcggcgctggccgagctggacatcgtccggtccatcgcgagtgtgctgcgggtcgagggtggggcgggctga

SEQ ID NO: 3802 - DNA, 369 bp, Actinoplanes utahensis
atgctcgatcacgtcggtttccagtgtgccgacctggccgccagcgccgcgttctacgacgcggtgctggccccgctgggcgcttcccggcagatggatttccaggtggccatcgggtacggcaacggacaccccgatttctggatcagcaccctgaccgagggggacgggttccgcgagtcgcacatagcctttggtgcggcggaccgggcggccgtggacgcgttcttcgccgcggcggtcgcgtccggggccgaggtgttgcacgagccgcgcctgcacccggagtaccacgagcactactacggcgcgttcgtccgcgacccggacggcaacaatgtcgaagcggtctgtcaccgtcctgaatag

SEQ ID NO: 3803 - DNA, 1050 bp, Actinoplanes utahensis
atgtggcggggtttgatcgaggcgtaccgggagcggctcccggtgaccgaggccaccccggtggtcaccttgcacgagggcaacacgccgctggtgccggcgccggtgctctcccagcgggtcggtgcggacgtctacctgaaggtggagggcgccaacccgaccggttcgttcaaggaccgcgggatgaccatggcggtctccaaggcggtcgaggacggcgccaagaccatcatctgcgcgtccaccggcaacacctcggcgtcggccgcggcgtacgcggcccgggccgggatcagctgcgcggtgctggttccccagggcaagatcgcgctcggcaagctgtcccaggccctggtgcacggggccaagctgctgcagatcgagggcaacttcgacgactgcctggcgctggcctcgaaactctcccaggacttcccggtcgcgctggtcaactcggtgaacatcttccgcctgcacgggcagaagaccgcgtccttcgagatcgtcgaggcgctcggggacgccccggacatccactgcctgccggtcggcaacgccggcaacatctccgcctactggatgggttatcaggaggacaaggaggccggcaacagcacgaagctgccgaagatgtacggcttccaggcctccggcgccgcgccgatcgtcaccggcaaggtggtcgagcagccctccacgatcgccaccgcgatccggatcggcaatccggccagctggaccaaggcgctcgacgcccgggactcctcaggcggcctgatcgcggcggtcaccgaccgggacatcctgaacgcgtaccggctgctggctcgtgaggtcggcgtcttcgtcgagctgggcagcgcggcgagcgtggccgggctgctgcagcaggcggcggccgggcagatcccggccggctcgcgggtggtctgcacggtcaccggtcacggtctgaaggacccggagtgggcgatctccacggcgccgtcgccgatcgtcgtcccgaacgaggcgctggccgccgcgaaggcgctagacctggcctga

SEQ ID NO: 3804 - DNA, 528 bp, Actinoplanes utahensis
atgatttttcgcgggggtgcactggtaccgtccgtcatcagatcgatgtgcggtggtcaccagcaggtcacaaaggagcgggcgctgagcgcgaacgagaagctcatcgcggacatcatgggcgcgcagatccggttgcagcacctgttcgccgacgaccggtcgcacccactcttctcgtcacacctgacgatgtcccagctgaaaatactcctgctgctctcccggcacgggacgttgcccggcggggagctggcccggatggtgggcgtcggggccgccgcactgagcggcatgatcgaccggctcgtggtgcaggatctggtcacgcgcacggaggatctcaacgaccgccggatccgccggatcggcctcacgaaagcgggcgctgagctcatcgagggcatcatcaccgcgggcatgacgaaacagcgcgagctcctcagccgactctcagccgaggagctcgcggtggtgcttcacgccaccgagattctggtgcgcgaggcggcgtcaggccaggtctag

SEQ ID NO: 3805 - DNA, 3219 bp, Actinoplanes utahensis
atgtcagctctgacacggctcagccttgccaaccgaggtctcgtcgccctgatcgcgatagtgatcagcggcttcggcctctatgcgattccgtcactcaagcaacagctgttcccgtcgatcgagctgcccgccgcgttcgtcagcgcggtgctgcccggcgcctcgcccgaggcggtcgagacggagatcaccaaaccgatcgaggacgccgtcaagggcatcgacgggatcgacacggtcacctccacctcgcgggagaacgtgtccagcgtcgtggtctccttcgcctacggcacggacatccagtccgcggtcaaccaggtcaccacctcgatcaaccggatccagtcgcagctgccggacaacgtcgacccgcagatcttcgcgggcggcaccgacgacatcccggccatcgtgctggccgcctccggcggcaccgacgagagcgacctgttcaacaagctcaaccagatcgtggtcccggagctgaacgggatcaccggcgtccgggacacccaggtcaccggcgcccgcagcaagcaggtcgtgatcacgccggacctggccaggatgggcgcgaacgggatcgcgccgaccgcgctcacctcggtgctgcaggccaacggcatctcgatcccggccggtgcggtcaccgacggcaccaggtcgttgaccgtgcaggtcggcaccccgatcaccacggtccagcagctgcaggacgtctacctgaccggctcgcgcggcccggtgcgcctcggcgacgtcgccaaggtggagagcaggctcccggtcgccgactcgtacacccgcaccgacggcgcggacagcctgggcatcgcggtcaccgcgcggcccgacggcaacccggtggagatctcccaccaggttcgcgacatgctggacaggctgcagaaggactccggcgccaagctcaccgtgatcaccgaccaggcgccgtacgtgcagcggtcgatcaagagcctggccaccgagggcctgctcggcctcgccatggccgtcgtggtcatcctggtcttcctgctcagcgtccgatcgacgctggtcaccgcggtctccatcccgctgtccgtgctgatcgccctgatcgccctctggaccggcgactacacgctgaacctgttgaccctgggcgcgctgacgatcgcggtgggccgggtggtcgacgactcgatcgtcgtcctggagaacatcaaacgacacctggagtacggcgaggagaaggtgcacgccatcctcgccgcggtccgcgaggtgtccggcgcggtcaccgcctccaccctcaccacggtcgccgtcttcgccccgatcgcgctggtcggcggcctggtcggacagatcttcgcgtccttcgcgatcaccgtgacggtggccctgctggcctcgctgttcgtcgcgctgaccgtggtgccggtgctggcgtactggttcctcaagccgccggccgccgacgtcgacaccgaggcgatccgccgggccgccgaggagaaggagctgcgcagcccgctgcagcgcggctacctcccggtgatccggttcgccaccacccgccgctgggccaccgtgctgatcggcatcgcggtgctgatcggcaccttcgcgctctccacccggctggagaccaacttcctggaccagtccggccaggacagcatcagcgtcacccagacgatgccggtcggcaccagcctggcggccaccgacgaggcggccaagaaggtcgaggcgatcgtctccggccgcaaggacgtcaagacgtaccaggtcaccgtcggcggcaactcggcgaacccgttcgccggcggcggcggtgccggcaccgccacgttccaggtcggtctgaccgatgacgcggacgccgacgtggtctccgaccagctgcgcgacgagttcgccaagctgtccggcgccggcgagatcaaggtcggcgagcagagctcggggctgggcagcaaccagctctcggtcgaggtgaccgccgctgacaacgacacgctgaccagcgcgacggagcaggtcaaggccgcgatggccgggatcggcggggtcgccgacgtggacacctcgctggccgccagcgtgccccggctggacgtggtggtgaaccgcaaggcggccgccgcggccgggctcaccgaggcgcagatcggccagaccgtggccggcatgttccgctccgccccggccggcaagctcaccatcgacggcgccagccaggacgtggtgatctcgttcggcgccgcaccggggaacccggacgcgctcaggtcgctgccgctgaccaccgcccgcggcccggtgccgctcagccaggtggccgagatcaagcaggtcaacggcccggagcaggtgacccgcacggacggcaaccggaccgccacggtcaccggcaccgtcaccggctcgaacctgagcaaggtgaaccaggacctgacgaagaagctggacgcgctgaccctgccgcccggcgcgtcgtactcggtgggtggcgtcagcgccgaccaggcggacgcgttcaaacagctcggactggccgtgctggccgccatcgcgatcgtcttcatcatcatggtggcgacgttccgcagcatcgtgcagccgatcatcctgctggtctccatcccgttcgcggcgaccggcgcgatcggcctgctgctggccaccggcaccccgctcggcgtgccggccctgatcggcgtgctgatgctggtcggcatcgtggtcaccaacgcgatcgtgctgatggacctgatcaaccactaccgcgcggccggcatgggcgtgcaggaggcggtgatcgagggcggccggcaccggctgcggccgatcctgatgaccgcgatcgcgaccatcttcgcgctcatcccgatggcgctcggcctgaccggcgagggcggcttcatctcgcagccgctggcgatcgtggtgatcggtggtctggtcagctcgacgctgctcaccctggtgctggtcccggcgctctacacgatggtggagaaccgcaaggagaagcggcgggccaagcgcgcggcgaagcgggcccgcaaggccggggtcgtcccggtgccggccgacgagccggtcgcggacgacgcggcgccggcgatggagcccgccgccagcggggcgctgcgggggtacaccgaccagttcgaggtgctcaagatgccgaagggcccggccgagacgcaggagtag

SEQ ID NO: 3806 - DNA, 1251 bp, Actinoplanes utahensis
gtgtcggcaaccctctcggtccttaccagaaatcgtgacttccggcgtcttttcgccgctgagctggtcgtcttcggtgccgactggttcgtcatggttccgctgctggtgctgctgccgcggctcaccgggcacggcttctggggcggtctggtgctggccgccgacaccgggatcaacgcgctgctgctgccctacaccgggacggtcgccgaccggcgggaccggcgccggatcctgatcgccgcgaacctcgcctcgttcctcgccgtgctgctgctgttcgcggtccggtcggccgcgaccgcgccgctggccctggtcgcgatcggggcgatggccgtggccaaggccttctaccagccggccagctcggccgcgctgccgaacgtggtggatccggccgacctgccggccgcgaacgcgatcgccgggtcggcctggggcacgatgacggtgctcggcgcctcgctcggcggcgtggtggccagcgtcttcgggccgtacgccagtttttcggtgaccgcggtcggtctgctggccgcgagcctgctcaccgccctggtccggcgtccgctgcaggccggcccggccgccgcggaggcgtcgccggcgagcgggccggcgctgcgcgaggcactgcgccacatcgccgtccggccccggctgcgggcgctggtcacggtgaagtcggcggtcggcctgggcaacggggtgctgaccgtgttcccgttgatcgtggccgcgcacggcgccggcgagctgggcgccggcctgctcttcgcggtccgcgggctgggcgcgctggtcgggccgttcgtgatgcgcccggtgctggcccggccggcctggctgttcaccggcctggccctgtccatgggcctgtacggcctcggctacctgggggtcgccgtgaccccgtggttcccgctggtgctgctgctggtcttcgtcgcacacttcgccggcggcgccaactgggtgctctccaacgtcgccctgcaggccgaggtgccggacgggctgcgcggccgggtcttcgccaccgacctgatgctcgcgacgctggctatcgcggtcagccagctgggtgccagcgcggtcgtcgaccgggtcgaccaggcggtggtgatcgccggctgtggcctggtcacgctggtttacgcgatcggctggtggctggccacccggcggctggcggcggattccggggccgggaatgggattgccggggcacggcatccgtcctga

SEQ ID NO: 3807 - DNA, 945 bp, Actinoplanes utahensis
atgggcctgaccttcgtcaccgaaccggtatccgtcagcaccccggcgaccagtgcgaacctgggcccgggcttcgacgcgctgggcctcgcgctgagcctgcacgacgacctgaccgcccgggtgaccgagggcggcttccacgtcgagatcagcgggcagggcgccggtgagctgccggccgacgaggagcacctggtcgtgcgggccatgctggccaccttcgacgagctcggtgagcgtccgccgggactcgcggtcacctgcgtcaaccggatcccgcaggcgcgcggcctgggcagctcctcggcggccatcgtgggtggcgtgcagctggcccgcggcctggtcgccggcggcctggagctgatcgacgaggcggccgcgctgcgcatcgcggcgcgcatcgagggccacccggacaacgtcgccccctgcctgctcggcggcttcacggtggcctggaccgaggccggtggcgcccgcgcggtcaccttgacgccggccgagggcgtgcgcccgacggttttcatccccgccgaacgggggtacacggcgaccgcgcgggcggcgctgccggccgaggtgccgcatcgggacgcggcgttcaacgccgggcggtccgcgctgctcacccacgccctgacgagtgatccgtcgctgctgttcccggccaccgaggaccggctgcaccagggatatcgcgccgcgggaatgccgggcacgtcgtcgctggtggcggcgctgcgttcggtgggcgtggccgccgtggtcagtggcgccgggccgaccgttctggcattgaccgaggtcccgggtgatttttacccgggcgcgcactggcacggcgaagtgctgggcgtggacggcgccggtgctgttgtgaaagggggtatggtggaacacgccgagcggggccctgttgccgcaggtcgcaagagttga

SEQ ID NO: 3808 - DNA, 348 bp, Actinoplanes utahensis
atgcagttccgggtggactcgggtttttccgacggaaggaatccattgagcgacaccaccgacgtgacgtcgggtgtttctgacgtcgctgacggcgccggcaccaccgcgaccgccacgaagcgccgccgcggcggcaccgggctgtccgcgatgctgctgcccgagttgcagagcctcgccgcctccctgggcatctccggcacggcccggatgcgcaagggcgagctgatcaccgcgatctccgagcggcagagcggtggctccgccgcggccgagccggctccgcggccgcggaccgaggccgccccggcccagtcggcccccgcttcggccccggctagctag

SEQ ID NO: 3809 - DNA, 1623 bp, Actinoplanes utahensis
gtgcaggccgaggccgccccggccgtcaccgagccggccgccgtggccgctcccgtggccgacaccaccgagcgcgccgagcgcccggagcgtggcgaccgcacccgtgaccggcagcgcggtgagcgcaccgaccgcggtgagcgcaccgaccgcggtgagcgcaccgaccgcggtgagcgtccggagcgggccgagcgtgccgaccgcggtgaccgcgccaacgagcgcggggagcgcaccaacgaccggggcgaccgcaacgaccgcggggaccggaacaacgaccgggtcaacgaccgttccggcgaccggggcccgcgcaccgaccagggtcacgacgacgacgacaacgacggtgagggtggccgccggagccggcgcagccgttttcgggaccgtcgccgtggccgcgaccgcgacgacagcccgcgcgaggacaaccggcgtgacggtggcggccgtgagccgcacgtctccgacgacgaggtgctcgtcccggtggccggcatcctcgacgtgctggacaactacgcgttcgtccggaccaccggttacctctccggcccgaacgacgtgtacgtctcgatgtcgcaggtcaagaagtacggcctgcgccgcggggacgcggtcaccggtgcggtccgctccgccccgcgcgacggcgacgggcagcggcgggacaagtacaacccgctggtccgcctggacaccatcaacgggatggagcccgacgaggcccgccggcgtcccgagttctacaagctgacgccgctctacccgcaggagcgcctgcggctggagaccgagccgcacatcctcaccacccgcatcatcgacctggtgatgccgatcggtaagggccagcgcgcgctcatcgtctccccgccgaaggccggtaagacgatggtgctgcaggctctggccaacgcgatcacccgcaacaaccccgagtgccacctgatggtcgtgctcgtggacgagcggcccgaagaggtcaccgacatgcagcgcacggtcaagggcgaggtcatcgcggccacgttcgaccgcccgccgcaggaccacaccacggtcgccgagctcgccatcgagcgggccaagcggctggtcgagctgggccacgacgtcgtcgtgctgctcgactcggtgacccgcctcggccggtcgtacaacctggccgcgccggcctccggccggatcatgtcgggtggtatcgactcgaccgcgctctacccgccgaagcggttcctcggcgcggcgcgcaacatcgagaacggtggctcgctgaccatcctcgcgaccgcgctggtcgagaccgggtcgatgatggacacggtcatcttcgaggagttcaagggcaccggcaacgccgagctcaagctggaccggaagatcgccgacaagcgggtcttcccggccgtggacgtctccgcctccagcacccggaaggaagagatccttctcggcaaggaggagctggcgatcatccacaagctccgcaaggtgctcagctcgctggagtccggcgccgccctggacctgctgatggaccggctcaagcagacccggaccaacatcgagttcctgatgcagatcgccaagtcgacacccggcgagtaa

SEQ ID NO: 3810 - DNA, 1170 bp, Actinoplanes utahensis
atgatcgtgcccggctaccgggaccacccgaccgagccctgggacccggacagcccggccgaccccggtgaggcggaggatttcctgcgccggtgctacaccgagaacccccggctcggcccggtcgagccccggctcgccatcatccgcgcgcagatcgccgccaccggcacctacgtgcacacccccgacgagctgacccacggcgcccggatggcctggcgcaacgccagccgttgcatcggccggctctactggcggagtctgctggtcctcgaccggcgccgggcgcggaccgccgacgagatctactccctgctggtacgtcatctgcagaccgccggcgacacccagatccgcccggtgatcagcgtcttcgccccggcccggcccggccagccgtacgcccgggtctggaacgagcagctcatccggtatgccggctaccgcaccgaggacggcgacacggtcggtgacccgcggctgcgcgagttcaccaccgcggttcgggccttcggctggcggggcaagggggaggcgttcgacgtgctgcccctggtggtcgagactccgtccgacgggatccgcctgtacgagctgcccgagcaaaccatctgcgaggtgccgatcagccaccccgagtacgcctggttcaccgagctcgggctgcgctggcacgccgtaccggcgatcgccaacatgcggctcaccatcggcggggtgcactacccgctggccccgttcaacggctggtatctgggcaccgagatcggcgcccgcaacctggccgacgccgaccggtacaatctgttgccggtgctcgccgcccggatgggcctggacaccagccgggagtcgacgctctggcgcgaccgggccctggtcgagctgaaccgggcggtgctgcacagcttcgaacgggccggggtgaagatgagcgaccaccacaccgagtcgcggcggttcctccaacacctgaacaacgaggagcgggccggccgcccggtgccggccgactggacctggatcgtgccgccgatgtccggcgggatcaccccggtcttccaccggtactaccgggagatggacctgcggccggccttctacctcgacgacgaggcggcggcactggcccgtgaagggatgcgcggctgcccgcatccgcactga

SEQ ID NO: 3811 - DNA, 621 bp, Actinoplanes utahensis
gtgcggaagtatccgcggacctgccatctgcccggctccccgggcgcctcggccgacgaccggatccagacggacctgtcgtggctggacggcgagctcgtggtgaccgagaagatggacggcgggaacctcaccttcacccgcgacgccatgtacgcccgctcccccgactccggcacccacccgtgggaccgcccggcgaaggcgttgtgggcgatgacgtcgtaccggattccggacgggtggcgggtctgcggcgagtcgatgtgggcccgccgcagcgtcgcctacaccgacctgcccggggtgttcctggtcttcggcatctgggacgagaccgacaccctgctcggctgggacgacacggtcgactgggcccgccggctggagctgccgatggtcccgctcctctaccgcggcgggagcctctccgaggcgtgcgccgcctgggccgcgcagcgcagcgaggagacctccgaggggtacgtggtccgggtgaccggacggatcccggccgccgacttccccctcaagctgctcaagtgggtccgcgcggagcacgtccgcaccgacgccgcctggcgccaccgggacgacttcgcggtcaacgagttcgcctga

SEQ ID NO: 3812 - DNA, 897 bp, Actinoplanes utahensis
atgacacgactgttgatcacgcggggcctgcccgcgtccgggaagaccacgttcgcccggaagctgcagccgggggtggtccgggtcaaccgggacgacctccggcggatgctgcacggcgagcggctcttcacccagtggtcggagtcgcaggtgacgcacgcgcagcgggccgcggtcgaggctctgctgcgcgcccgggcctcggtgatcgtggacgacaccaatctgcgggccagggtggtccgggagtgggccgagctcgccgtccgctacggcgcgtcgttcgaggtgcacgacttcaccgacgtgccgctggccgagtgtgtccggcgcgacgccgggcggcccgagcaggaccgggtcggcgcggacgtcatccgccggatgcacgagcgttatctggccgggcgcaacgtgccgctgccggtgccgttcgtcgacccgggcggccccggggtggtctacgcgccggatccggagctgccgccggtggtgctggtcgacatcgacggcacggtcgcgctgatgaccggccgcagtccgttcgagtggcaccgggtcggcgaggacgagccgaacccggcggtgatcacggcggtccgggcgatgcacgcggccgggcacgccatcgtcttctgctccggccgcgacgaggtgtgccgggcggagacggaggcctggctggagctgttcgtcgacgtcccgtacgaaggcctgttcctgcgcccggagggcgacagccggaaggatgcggtggtcaagcgggagatcttcgacaccgagatccgggaccggtggcgggtcgtcggggtgttcgacgaccggcagcaggtggtacgcatgtggcgtgcgctcggcctgaccgtgttccaggtggcggagggggacttctga

SEQ ID NO: 3813 - DNA, 1071 bp, Actinoplanes utahensis
atgacgctgctgcacgacgtcttcgatccggtcacgctgaccgaagcggtccagaacgggctggtccggacgcagcgtcacccccacctgccgctgaccatctacaactacaccgaggcctgccagtactccggcgcgtggacaccggtgacgctggcctgccgcggcctgatcgtggacgcgtcgggacggatcgtggcccggccgctgaccaagttcttcaaccacaccgaggcgcaggcaccggccctggacgccgccgcgccggtggcggtcaccgacaaggtcgacggcagcctgggcatcatctaccacgacggctccggctacgccgtcgccacgagggggtcgttcgcttccgaccaggcgatccatgccaccacactgttgcgcacccggtacgggtcgttcacgccgccggacggcctcaccgtgctcgtggagatcatctttccggccaaccggatcgtggtggactaccaggggctcgacgacctggtgctactcggcgccgtggagatcgccaccggccgctcgcacggcccggccgcggtgccggactggccgggcccggtggtcgagacgttcggctacgcgacgctggccgaggcgctcgccgccgcgccgcgcgccggccgggaagggctggtcgtccacttcaccgaggccgatcagcgcgtaaagatcaaatacgcggattacgtacgcctgcatcgcctggtgaccggcctcaccccgcgcagcgtctgggagatcctcgccaccggtggtgacctcgacgccctgctggagccgctgccggacgagttccacgtatgggcccgtggcgtcgccgcggagctgaccgccgaggtcgaggcgcgcgccgccgcggtcgaggcggcctacgccggcatcgtcgccgccctgcccgacgggtgggggcgcaaggagttcgcgctggccgcggtgcgcagcccgcaccggggtgagctgttccagcgcctggacggtcatgattaccgtccgggtctgtggcagcgggtgcgaccgtccgccgaccgggcggccgctggaggaaccgaggaatga

SEQ ID NO: 3814 - DNA, 399 bp, Actinoplanes utahensis
atgacgggaaggccgctcacgttatggcttgcgaaaccagttgcacctcctgatttccggccggtacgggaggcatggcagactggtacatcggccagtaagggttccggttcccgctctcactcatcacagagcgacccggcggcccgcatcatcgagagggaccgagaagacatgaagagcggtatccacccggagtacacgaccaccgaggtcatctgctcctgcggcagcaccttcagcacccgtagcaccgccaagggcggcgagatccgcgtcgagacctgcagcgcctgccacccgttctacaccggcaagcagcgcgtcctcgacaccgcgggccgggtcgcgaagttccaggcgaagtacgccaaggtcaacgccgcgaagaagaagtaa

SEQ ID NO: 3815 - DNA, 1089 bp, Actinoplanes utahensis
atgagcaacgaccgtttgagcacgcttctcgccgagtacgcggacctggagaagcggatggaggacccgtcgatccacgccgaccaggcgctggtccgccgggtgggccgccggttcgccgagctggcgccgctctacgcggcgcacgccgagctggaggcggcccgcgccgatctggccgccgccagggagctggccgccgaggatccggccttcgccggtgaggtggaggcggtcgccgccgtcctcccggcgctggaggagaagctcggcgagatgctgatcccgcgcgacccgagcgacgccaaggacgtgatcatcgagatcaaggcgggcgagggcgggcaggagtccgcgctgttcgccggcgacctgctgcgcatgtacacccggtacgcggaacgccgcggctgggtggtcgaggtgatcgactcgcaggagtcggacctgggcggcgtgaaggacatctcggtcgcggtgaagaccaagggggtgccggagggcggtcacggggtctggtcccggatgaagtgggagggcggcgtgcaccgggtgcagcgcgtcccggtcaccgagtcgcagggccggatccacacctcggcggccggcgtgctggtgctgcccgaggccgaggatgtggacgtccagatcgagccgggtgacctacggatcgacgtctatcgctcgtccgggccgggtgggcagtcggtcaacaccaccgactccgccgtccggatcacgcacctccccaccggcaccgtggtgagctgccagaacgagaagagccagctgcagaacaaggagtcggcgatgcgcatcctgcggtcccggctgctcgcccaggcgcaggaggcggcggacgccgcggccggcgacgcgcgcaaggcgcaggtgcggacggtggaccgctccgagcgggtgcggacgtacaacttcccgcagaaccggatcaccgaccaccggatcggctacaccgcgtacaacctggacctggtgctcggcggtgagctggacgcggtgctggacgcgctggccgaggcggaccgtcaggcccggctcgccggtgacacggagctcagccggcggtag

SEQ ID NO: 3816 - DNA, 1329 bp, Actinoplanes utahensis
atgaccgtgatcgagctgggccaggtgggtccgccggacgccgagccggagccgggaccggagttccggttccgccggcataccgtgagccgggcggtcgcggccgggctggccgtgctctgcgcggtcggcctgggcggtgccgcccgccccgcgccacccaccctggccgagagctggtccgccacggtcccggtggactcctacccgtacgccgtccaggacatcgtcctgatcaacagcggcgacccgggcagaccggaggtcagggcgctcgacgcggccaccggcgcgacccgctgggcggccacccacggcgagttcccgaacgggttgtcgtggagcccggagaacggccggctctactccgcgctgcacacccggaccgtgcagctcaccgacggggtggcctatttcggcaccggcacgatggcggtggacggccacaccggccggaccatctggcagcgcgacggcgaccaggtgggcgccaccgccggtgaggtgctgctcggcgaccgcgacgacaccggtctgatcaccaggctgcacctggtccgggccaccgacgcgacggagctctggcagcgcccgatcaccccggtggagaacgccgtggtcgacaacgggcggatcgtcttcgacaccaccggcggcgagatcaccacgctgcgcctcagcgacggggtgccgctggccacccggcggatcgacccgccgcaggccggcacccccggctcgtcctggcaaccccaggtgctcaacggcctgttctacgacatccggcggaccccggccgacaccgcggtgaccgcctaccgggtggacacactgaccgagacgtggcgggccaccgcctccggagcggtgtacgtgcaggactgcggcccggtggtgtgcgtcagcgacacgcatctgaccatcgcactcgacccggcgaccggcgcgcggcgctggcagctggccgagtcctccatcgagcggatcgacgacggccatctgctggtcggcagccgggacgagcagtccgcctggaccgtggtggactcccggaccggggccacggtggcgacggcgccgcccggcggcgcggtgctgaccgtgaccgggaagaggtatctggtggtgctgcgggacgtcaccgcgccggtgaaccacgtcgcggtcgcccgctgggatccggcgaccggccggcaagcgctgctcggctcacttcccggccggaccgacacctgctcgatgaccggcccccgcctgctctgctacggcggcggccggctcggcgtgacggacctggtcgccgccgccgggctcactaccgccggctga

SEQ ID NO: 3817 - DNA, 3150 bp, Actinoplanes utahensis
atgttgcccatgcagatgtgcaggacggtgaacggcgccacctcaggcctgcccctcgacgatctccggaacgacgtcgcgcagtttttccaccgggatcgagccgacccgcaggacccggggcacgtcaccggtcacgtcgaccaccgtgctcggccacgggtcggtcgccgggcccgcctccaggtagacgcgcgctgcatactccagctggtcgcgggcctcctcggcggtcagcggggagggcgagccgaccttgttcgcggtggtgaccgccatcgggccgacctcgcgcagcacctccagggcgaccgggtgcagcggcatccggacggcgaccacgccgccggtctcccccaggtcccactgcaggctcggcgaatgctccaccaggatggtcaacgcgcccggccagaacgcgtcggccaggtcccgggcggcccggggcagcgagtagaccagcccgtccagggtgtgccgggagccgaccagcaccggcggcggcacccggcggtccgagccgcgggcgtggtgcagctgggtgatcgcgtgcgaggtgaacgcgtcggcgccgatcccgtacaccgtgtcggtgggcagcaccacgagctcaccgctcctggccgcctcgacggccgccgcgatgccacgatcacgatcggcgatggcggtgcagtcgtagagcatcacgacgtgcagtctgccatgccgtcaccggcggcgggcggtggcgtatcggggccggccggtgagatcgtcgtgcgcggtcacctcggtgaaccggccgtccgcgcgcagcaggccgggcaccgccgcaccgtgcacgtcgtcgtgttcgacgccgatccagccgcccggccggagcagcgccgcggcgttcgcgatgaccggccggatcaccgacagcccgtcggccccgccgaagaccgcctcggccgggtcgtgatcggacacctcggggggcaccggggtgccgtcggggacgtacggcggattgcagagcagcacatcgacctgaccgtgcaagtcggacagcagacccggatcggtcacgtcggcctcgaccacctccaggttgccgacgcccgcgctgttgcgccgcaaccagggcagggcgtccgccgaccgctccacggcgagcacccggccggcgcccgactcggtggccaccgacaccgcgatcgctccgctgccgctgcacaggtcgaccaccagcgcgcccggcgcggtccgctcgatgccccagccggccagcagctcggtctccgggcggggcacgaagaccccgggcccgaccgcgagctccaggtgccggaacgcggccgtgccgagcaggtgctgcaacgggatccgctcggcccgcgcggcgaccaactcgcgcagccgggccgcctcgtccgcgcggatcgcgtcgatcagtatcagccgcccgcggggcacattcagcacgtgggcggcgagcaactcggcgtcgacccgcggagaggacacaccggacgcggagagttcggcggccgccgatgcgagttcgggtgccagacgggtccggcgggggtgttcgtcaggcggtgtcacggcataatcatgagacgtcgcgcacgccggggaccggccgggtcgcccagcgccgcgccgagcccggggaggcgcctggtgggttggttggaccagctcgcggagcatgccgatgatctgcgccgggccgggggcctgcagcagaacggccgctcggcccaggccctgccgatcctggacgcggtgctgtccaccgccaccgatccgaccacccgcgcctacgcgctgatccagcgcttcggtgcgctgatcaacctgggccgggtcgccgagctcgcggtcgcgatggcggcggccgccgaggcggtgcgcgaggtccccgacccctatctgcgtggccagatgcacgccttcgccgccctcggcgcccacctgcagagcaatctggaccgcggggtgacccacctggtgcaggccgcccgctcgctggctgcggtgccggaggccgacgaggagaccgcctggggctggcacgacctcgccatggcgtattcgtatctcggcttccacggccaggcgctgaccgcgatcgagcaggcccgcgaggtcggggcgagcgccgggctgacccccgaggtgttcgccgcccccggcatccggctgcgcaacgcggtctccctcgaccaccagggcgacaccgacggctgcctgcgggtgctgcgcgacatcgacgccgagctgtcccggtacgtcgcgaccgaccagctgcgcccgggcagccgcgcggtctacggctacgcgctggcccgccgcgcggccctgggcgagcccaccgaggacggcgcggcccgctggctgaccggcggcggcgacagcgtccgcacccgcgacctgcagcacctcggcgcggtctgcctgaccatcgcggccggcaagccggagcgggcgctcaccatgctcgagacggtgccggtctcggccgaggtgctgggcgcccccgagccggcccggttgcgcagcatctgccacgccagcgcgggcgaccacgccgccgcgcacgccgccgaccggtacgcgttccggctcgccgcccagcgcatcgaccagctccgcgacggctatctggacggggtcgcggcccggctggacgcccaggagacccagcgcgacccgcaccgctacggcgacgagacgctcaccgatccgctcaccggcctgcccaaccgccgccagctggagcactatgtggacgccctgctggcccggggcgagcgcgccgcgatcggggtctgcgacatcgtcgggttcaccacggtcaacatgcggcacggccgacactgcggcgacctggtgctgcagcggatcgccggggtgctggcccgggtgatgcgccgcggcgacttcgtggcccggttcgccggcgacgagttcgtcctggtgctgccgggcgccggcccgcaccaggcggccgaggtgtcccgccggatcagcgccgccgcggccgcggagaactggcaggtgctggtccccggcaccccgatcgggctggccgccggctggtccgaggtgggcaccaacgggcggggcctcggcgccgccctggcggccgccgcggcgagccggaaaccgacctag

SEQ ID NO: 3818 - DNA, 1407 bp, Actinoplanes utahensis
gtggcacgagggcgaggagatgaatccgccggccgcccggcaggttcgcgcccggcgtggctccgacgacggcttccaggcgcgcaagctgcgcggcgacttcatcgacgaggccgacctgatcctcaccgcgaccgccgaccagttcgactacgtggtggcgctgcgcccggacgccgccgaccggacattcgtgctcggcgagttcggccggctgctcggcgcggtcgacgccgccgcgctgcccccggccaaacccgaggcggagtcggtccaccagcgcggggcggccatcgtcgaggcggtggcccggctgcgcggcgccgaggcgccgctgctcaccgacgacctggacgacccgtggggccgcggcgaccagaccttccagcgggtggccgacgagatcgaggacaccaccgtcccgttcgccacgttgctgctcccgtgagccggcttgccccgccggacgccgcgggcatcgaccgggcggtcgcgattctgcgcgccgactcggtggtcgccttccccaccgagaccgtctacggcctcggtgcgaacgcgttctcgaaacaggcgatcggcgaggtctaccggctcaagaaccggcccgcctggaacccgctgatcgtgcacgtggccacggtcgaagcggcccgtgccctggccgccgagtggccggccgccgcggacgcgctggccgcacggttctggcccggcccgctcaccctggtggtgcgccgcgccgcgcacctggccggggtcggcgcggacaacgacacgatcgccgtgcgcatcccggcgcacgaggtggcgctgcgcctgctcgaggccagcggactgccgctcgccgcccccagcgccaaccgctccgagtcgatctcgccgaccaccgccggccacgtgctgcgcagcctgcccgacgtgccgctggtgctcgacggcggcccgtgctcgtggggcatcgagtcgaccgtgctggacctgaccaccggggtgccgacgctgctgcgcccgggcgcgctgagcctgcgcgcgctgcgcgaggtcaccggcacgatcgcgctgcgcgacacggagaccgcggacggcacggcccggccgtcacccgggatgagccgccggcactacgcgccgcgcgccaggaccatcatgctgccggcgctgcgggaggcggaccggtccgggctcgccgggcccgtggcgatcctgtcgtacgagggttgccccaccccgtcgtacgacctgatcgagatcctctccgccgacccccgtgagtatgcggcggacctgtacgccgccctgcaccgcctcgacgacgcgggcgccggcacgatcctggtccaggagccgccgcgcaccgaggactggctggccgtccgcgaccgcctgtcccgcgccgccgcctag

SEQ ID NO: 3819 - DNA, 2781 bp, Actinoplanes utahensis
atgatcttcgcaaggcaacgggggatggcggcgttcatcgtcgcgctgatggtgctggcgttcggaccgcccggtggacgggccgaagccgcgacagcccggtcggtcagggtgctgagcttcaatgtgtgcgggtcgtatcaggccgattgccggccactggaggcggcggacacctgggccgaccgggtcgcccagcaggtccgggcctgggactcggacgtcgccgtgttccaggagatgtgcgcggggcagcgggagttgctcgcccaccggctcccggcgaattaccggatcgcctggtggacgaaccggtccggggacaacggttgcgacaagtggctggtgcccggggtgaccgccgacgacgacttcggtgatgccgtgctggtgcgcacggattcgccggccaccacctactcccacgagctgaccgagctgtgggaccagggccggacggcgacggcggcctccgaggagaagcgcgaagtgctctgcatgggcaccgtcgtccagggccgggacagtctggcctgcacggtgcacctcgacacggtgagcgtcgaccagggcatgccggaggccgcggcgcagatgaccagctgggcggccggccggccgatcatcctcgccggcgacttcaacgccgacccgttcgacccgaacctgggggcgttctactccggtggcggcggcaccggcgccttccgcgaggtcgacgagcaggaccgcgcctacttcaccgacgggtgccggcaactggcgttctgccggtccggcgaaaccaccaccttcgccggcaccgacgaggcgggcaggcccaagccggcccgcaagttcgactacatgttcggctcggccgcgcaggtgcgctgggtgcggggcgacaccgtcgatcccgggttcagccgccgcgatcacaagatcctgcgcggcgaggcggtctgggccgacgaccggcagccgccggccgtaccggtcgtccagcccgccgccgaccagctggttccggattcccggagcggctggtccggggccaccgacatggtgaccgggaagttcaccgccgatgcgatcgacgacctggtggtccgctggtacgacggcgccgtcgacctgtatcccggcctgcccggcggccggctggggcggcccgtggtggtgcgcagcacccagggcagcggctggtcggacgcggccgggatcgccgccggcgacttcgacggcgaccacctcgccgatctcgcggtccgctggagccggaacagtctgttcgtctattacggcaaggacggattgcgggtcagcacgccggtgctgccggtgtggagcctgaacggcgtcacggagatcaccgccggggatgtcgacggcgacccggcgaagaaccgggacgacctgatcatccgccgggacgacggctcgctcgccgcgatcaccatcaccggggccacggccgcgccggcgcggcagctgatgccggccggcagcctgacggacgcgcggcacatcgccttcggcgacgcgtacggcccgcggcccggcgccgctgatcactacgacgacctcttcgtccgctggaacagcggcagcctgtacgcctatcccggcggcagcagcggtttccagcccttcgcgcaggtccaggcggccgcggccgacggccggaacgtggtcgccgccacggcgctcggcgatttcgacggcgacggcgtggacgacctggtcacccgtggccggcggcagagggcggcgcccgccgacgacggccggttgcaccgctaccggatcggcgccgacgggacgcgggaacaacccgcgctggcggacgccgagttcggcttcgccggggcgacccacctgacggcgggcctgttcaccgacccggaggcgcccgccgtggtggcccgctgggacaccggcacggtcaccccggcgatggctccggacggcggctacctgcggtgggacgacgtccgcgacatggcaccgctgaacctcggcgaccggctcgacgacgtggtgatccggcaggggaccgacgcggtctcggtggtgcccgttccgttccgggccgggcagtcgccggcgcaccccggacagccggtggcggcgccgtccggcggctggtgcgacggccgcggcatcgccgagctgaccgccggtgacgtgctcggcgacggccgggacgacctggtgctgcgctgtgccgacggtcgggtactcggctgtccggtgctcggcagtccggcgtccggcgacctgacggccggcgtgccggtggtgatccggccggccggcgacaccggcacggtcggcatgtacgccgacacgatcgacgggcatcgggccgtggtgctgcgcaccgcggacggcgccgccaccgcccgggtggccgacgacgccggcgggttcaccacccgggacggggtcttcccggtgggcgcctggaccggcgccgccgacatgatccgcgatccgcggggagacctgctggtccgctgggacagcggcggcgtgcggcggtacccggcgaccgtcccggactccggggctccggccgccctgacggtcgggtccttcgacgagtcgggaatcgaccatttccggtacgccgtcgacgcgcccgccgacagcgacgccgcgggatgggtcgacgtccggttcggccgcggggtgatcccgctcgacggcctgtcgccggggccgcacaccgtccacgtcatcgcggtggaccgggccggcaaccggtccggcgagctcgtgcgaccggtgggatga

SEQ ID NO: 3820 - DNA, 375 bp, Actinoplanes utahensis
ttgaggatcttcagcggttcgccgttcgaggaggagttcgcctacgcccgggcggtggccgacggcgaccgggtgttcgtctccggcaccaccggcttcgactacgcgtcgatgaccatctcggacgaccccggtgagcaggccgcgcagtgcctgcggaacatcgcggcggcgctggccgaggccgggagctcgctcgccgacgtggtccgggtccgctacctgctcaccgacgcggccgacttcccggcctgcggcccggccctgcgcgaggccttcggcgacgtccgcccggccgcgacgatgctggtctgcggcctgctggacgagcggatgaagatcgagatcgaggtggacgcgatccgccgcgcctag

SEQ ID NO: 3821 - DNA, 1488 bp, Actinoplanes utahensis
atggctgaagcacccccgttcggggcacagtctggagttatgcgctgtcttgtcacgggagctaccgggtacatcgggggccggctggctccacggctggtcgaggccggccatcgggtgcgctgcctgtcccgcagcgccggccgcctccgcgacgtcccgtgggccggccaggtggagatcgtcgagggcgacctcgccgatccggccaccctggcgccggccttcgacgggatcgaggtcgcctacttcctggtgcactcgctgggccagggtgacttcgagcgccgcgaccgggaggcggcggccaacttcgccgcggcggcccgggccgcgggcgtacgccggatcatctacctcggcggcccggagccgccgcccggcgacgtgccctcaccgcacctgcgctcgcgcgccgaggtggcccggatcctgctggccggcggcgtgccgaccgcggtgctgcgggccgcggtgatcatcgggtccggctcggcctccttcgagatgctgcgttacctcaccgagcggctgccggtgatggtcgccccgcgctgggtcgacaaccggatccagccgatcgcggtccgcgacgtgctgcggtatctgatcgacgcggccgacctgccgccggacgtgcaccgcggcttcgacatcggcggcgccgacgtgctgacctacgccgagatgatgcggcggtacgcggtcgtggccggcctgccccgccgggtcctgctgcccacccgggtgctcagcccgtggctgtcggcgcactgggtcggcctggtcaccccggtgccgaacgcgatcgcccgcccgctggtggccagcctggtgcacgaggcggtggcccgggagaacgacctggccacgctgctgcccggcccgccgccgctcggcttcgacgagtcggtccggctggccctgggccggatccgggacgcggacgtggagacccgctggaccggcgcctccgggcgggacttcgccgccgagccgctgcccagcgacccggaatggtccggcggcagcatctacaccgacgagcgggcccgcgaggtgcacgccccggccgaccggctgtggcgggtgatcgagggcgtcggcggggagaacggctggtactcgttcccgctggcctggtcggtgcgcggctggctggaccggatggccggcggcgtcggcctgcgccgcggccggcgcgaccaggaacacctgcgggtcggcgaggcgctggactggtggcgggtcgaggagatcgtgcccggccggctactgcggctgcgcgccgagatgcgggtgcccggacgggcctggctggagatgcgcgccgagccggacggcgacggcggctcggtctaccggcagcgggcggtgttcctgccgcacgggctggccgggcatctctactgggcgtcggtctggccgttccatggcatcgtgttcaacggcatggcccgcaacatcgcccggggagcggagaattga

SEQ ID NO: 3822 - DNA, 1290 bp, Actinoplanes utahensis
gtggaaacgttctggggtccggatttcgccgcgctggagcgggacgacccggagatcgccgacgtgctgctcgacgagctgacccgccagcgcgagacgctgacgctgatcgccagcgagagcttcgcctccccggcggtgctggccgcgctcggctcgacgctggccaacaagtacgccgagggctatccgggcaaccggtactacggcggctgcgagcacgccgaccgggccgaggagctggcggtcggccgggccgtcgagctgttcggcgccgaccacgcgaacgtgcagccgcactccggggcctcggcgaacctggccgcgtacgccgcgctggccgagccgggcgacccggtgctggcgctgggactgccgcacggcgggcacctgacccacgggagccgggcgaacttctccggcaagtggttccacccgatcgcgtaccgggtcgacccggccaccgagctgatcgactacgacgaggtgcgcgacctggccctggcgcaccggcccaagctgatcatctgcggcgcggtgtcgtacccccggctgatcgacttcggccggttccgggagatcgccgacgaggtcggcgcctacctgatggtcgacgcggcgcacctcatcggcctggtggccggccacgccgtgccgtccccggtgccctacgccgacgtggtcacctgcaccacccacaaggcgttgcgcggtccccgcggcggcatgatcctctgccgggccgacctggcccggcgggtggacaaggcggtcttcccgttcgcccagaacgggccgatgatgcacgcggtggcgggcaaggcggtggccctgcgcgaggcgggcaccgcggccttccggaggtacgcttcgcagaccgtgcgtaacgcgcaggcgctggcctcctggctgaccgccgaggggatgcgcccggtgaccggtggcaccgacacccatctcgccgtgctcgacctgcgcgagctgggcgtcagcggccgggacgcggaggcgcgctgcgccgccgccgggatcgccgtcaacaagaacgccataccgtacgacccggagaagcccgccgtggcctccgggatccgggtcggctcgccgagtgtcacctcgcagggcatgggggaggcgcagatgcgccggatcgcggagctcgtcgggatggcggtgcgctgcgatccggagacggccaccgggacgacccggctggccgccgtcggcgaggaggtgaccgacctggtgcggcgcttcccgttctacctgaagcaggaggttctggcgtga

SEQ ID NO: 3823 - DNA, 465 bp, Actinoplanes utahensis
gtgagcggcgtaatccccgcggcggtggagaaggacgtggacgacgaccttccgctgcccgatctgccgcccctgcccgccgacccgcgctggaaggtcgagcatctcggcttcctgaccgcggtctcggtcgcgctgctcctgtgtgccgcctcggccggcttcctgtccggcggtccggcctacgccctggccgcggccggtggcgtgctgatcgtgacggtcagccacacgctgaccacgctgatcgtcgcctgggccgacacggtccgcccggccctggtcatgccgctgggaatgttgacgtatgtcgtcaaatattctttgttcgggattattctggcgtttggcgtctcgtccgattggcctgccaagacggcgctggggctcggtgtcgtggccggggtcatggtctggaccggcgtgcaggcctggcaggtaacccgggcgacactccgaaggtga

SEQ ID NO: 3824 - DNA, 234 bp, Actinoplanes utahensis
atgaccggccaagaacctccccacgacaaacgcggtgacgaaggccccaccccgcccgattccggtgcgggcatgacggcagtcacctacctcatcgcgggcatgttggtctggggtgggatcgggtggctggtcgaccactacgtcggaactgagggcatcttcgccggcatcggcgcggtcctcggcatcggcctaggtgtgtacctcatcgtgcgccggctcggcgcctga

SEQ ID NO: 3825 - DNA, 792 bp, Actinoplanes utahensis
atggtgatcgttcagtcggcggtcctcgcggcagagttcccgcccagcgtcgaggacttctacctgcccagcatcctgccgtggggcgcggagagcaattactggttcaccaagatcacggtgctcgtctggatcgcggtggcggcgatcatcgtcttcttcctggccgcgtaccggaagccgcagctggtcccgaccaagaagcagtggctcgccgagagcatctacggcttcgtgcggaacaacgtcgcgatcgacatgatcggtccgcgcggggtcaacttcgcgccgtacctcaccacgctgttcatgttcatcatcgtgaacaacttcttcggcatcctgccgttcgtgcagctctcgccgaactcgcacatcgcgttcccggcgttcctcgcggtcatcagctatgtgatgttcatctatgtcggcgcccggaagcacggcttcttcaagtacctgaagcacgcgctgatcccgccggccccgtggttcatcctgccgctgctgatcccgatcgagttcttctcgaacttcctggtccgcccgttctcgctggccgtccgtctgttcgccaacatgttcgccgggcacatgctgctgctggtgttcacgctcggcgggttcgcgatgatcagcgccaacggcttcctcgccccggtgtcgatcctgtcctgggcgctgagcatcgcgctgaccttcctcgagttcctggtgatctgtctccaggcctacgtcttcacggtgctgacggcgagctacgtccagggcgcgctcgccgacgggcactga

SEQ ID NO: 3826 - DNA, 228 bp, Actinoplanes utahensis
atgctgctctccgaagttgttggtagcaccgccgccatcggttacggtctcgctgccatcggcccgggtatcggtgtcggtctcgtcttctcggcctacatccagtcgaccgcccgccagccggagtcgtcccgcctgaccctgccgtacgtctggatcggcttcgcggtcgtcgaggcgctcgctctgctgggcatcgcgttcggcttcatctgggccggcaagtaa

SEQ ID NO: 3827 - DNA, 549 bp, Actinoplanes utahensis
atgctcacgtatttggctgaaggggccgcgaagacgccgaacccgatccttcctgcctggcaggagatcgtcgtcgggacggtcgcgttcatcgtgctctgctttgtcctgatgaagttcgtcttcccgcagatggagaagacgttccgcgctcgcgtggacgcgatcgagggcggcatcaagcgtgccgaggccgcccaggcggaggcgaacgagctgctcgagcagtaccgcgcgcagctcgccgaggcccggaccgaggccgcccgcatccgcgacgaggcccgggccgacgccgagggcatccggcaggacgtgctggccaaggctcgcgaggagtcggaccgcatcatcgcggccggcaacgagcagctggccaaccagcgcgagtcgatcgtccgggagctccgtgccgaggtcgggacgctggccgtggacctggccggcaagatcgtcggtgaggcgctggccgacgaggcccgcacccgtggcaccgtcgagcgcttcatcgcggacctcgacgccgccggcacggcgggcgggcgctga

SEQ ID NO: 3828 - DNA, 822 bp, Actinoplanes utahensis
atggcgtccggcgtgaccaaccaggcctacgccgacgcggcggagcggctgcacgccgccaccgccacgtcgacgggcgcgcagctggccacagtcgccgacgagatcctgtcggtggccggcctgctgcgcggtcagccccggctgcgccgggcgctgaccgacccgtcccggcccggcgaggaccgcggtgatctgctccactcgctgctgtccggcaaggtcaccaaggtgaccgtcgacgcgctggccgccctggtggccggccggttctccaaacccggcgacctgctggacgccaccgagcggctgggtgtcgacacgctgctcggtgccgcccagaaggacggcaagctggcggaggtcgaggacgagctgttccggttcggtcagatcgtcgccggcagcccgcagctggtggccacgctcagtgacatcggtgcgccggtcgcgccccgggctaagctggtccgggatctgctcgacggcaaggcgcagcccatcacggtgtggctcgtccgggtcgcgctcgagggattcggtggccgtggcttcgaggcctcgctgacccggctggtcgagctgaccgccgcccggcgggaccgtgaggtggcgtatgtgacggttgcgaagccgatcaccgacgccgaggagtccgcgctgggcgccaagctcgccgcgatctacggtcgtgaggtctcgctgaaggtggacgtcaatcccgccatcatcggcggggtcagcgtccgggtcggctcggatctctacgacgggacgatcctgcggcggctgaacgccgccaagcaggcgttcgccaaatag

SEQ ID NO: 3829 - DNA, 1566 bp, Actinoplanes utahensis
atggccgagctgaccatctcctcggacgagatccggggggcgctagagcgctacgtctcgtcctattcgcccgaggtctcccgcgaggaggtcggcatcgtctccgatgcgggcgacggtatcgcgcacgtcgagggcctgccctcgacgatggcgaacgagctgctcgagttcgccgacggcacgctgggcgtcgcgtcgaacctcgacgtccgtgagatcggcgccgtgatcctgggcgactacgcgaacatcgaggagggtcagccggtcaagcgcaccggccgggtcctctcggtcccggtgggcgacgccttcctgggccgcgtggtcgacgccctgggccagccgatcgacggtctcggcgagatcgcgaacgaaggcttccgcgagctggagctgcaggcgccgaacgtgatggcgcgccagccggtgaagcagccgctgcagaccggcatcaaggcgatcgacgccatgacgccgatcggccgtggccagcgccagctgatcatcggcgaccgcaagaccggcaagaccacggtcgcgctcgacacgatcatcaaccagaaggcgaactgggagtcgggcgacccggccaagcaggtgcgctgcatctacgtggcgatcggtcagaaggcctccaccgtcgccagcatccggggcaccctggaggcgcagggcgcgctggagtacacgacgatcgtgtcggctccggcctccgacccggccggcttcaagtacatcgccccgtacaccggctcgtccatcggacagcactggatgtacaacggcaagcacgtcctgatcgtcttcgacgacctgaccaagcaggccgaggcgtaccgcgccgtgtcgctgctgctgcgccgcccgccgggccgcgaggcctacccgggcgacgtcttctacctgcactcccgtctgctggagcgctgcgccaagctctccgacgagctgggtggcggctcgatgaccggtctgccgatcatcgagacgaaggccaacgacatctcggccttcatcccgaccaacgtcatctcgatcaccgacggtcagatcttcctcgagaccgacctgttcgcctcgggtgtccgcccggcgatcaacgtcggcacctcggtgtcgcgcgtcggtggctcggcgcaggtcaaggcgatgcggacagtctccggccggctccgtctcgacctggcccagttccgtgagctggaggccttctcggccttcgcctccgacctggaccgcgcgtcgcgggcgcagctggagaagggcgtccggctggtcgagctgctcaagcagccgcagtactcgccgtactcgacggtcgaccaggtcatcgcgatctgggcgggcaccaccggccagctcgacgacatcccggtcgccgacgtccgtcgtttcgagcaggagttcctgcagtggttcaagtcgcaccagagcgacgtctacaccgcgatcgagtcgacgaatctgctgaccgacgacaacctcgagtcgctgaagtcgggtgtcaccgagttcaagaagtcgttccagtcgagcgcgccggccgagagcggtaactga

SEQ ID NO: 3830 - DNA, 933 bp, Actinoplanes utahensis
atggccggtcaggtacaggcgctgcgtcggcggatcaagacggtcaagtcgaccaagaagatcgccaaggcgcaggagctcgtcgcgaccagccggatcgcgaaggcccaggaacgggtcaacgcgtcccggccgtactcggtggcgatcaccaaggtgctggccgccctggcgtcgaacgcgtcggtggacaacccgctgctggtcgcgcgtgagcgcgtccagcgggcgggcgtcctgctgatcaccagtgaccggggcctggccggcgcctacaacgccaacgccatccggaccgccgagcagctgatcactcagctccgctcggagggcaaggaggtggcgctgtacgtggtgggccgcaagggggccagttactaccggttccggaaccgggagatcgcggccagctggaccggcttctcggagcgtccgaccttcgccgacgccaagaagatcggtgacggtctgatcgaggcgttcgcggccggttcggagaccgcgggcaccttcggtccggagggcatcgccggcgtcgacgagctgcacatcgtgagcaccgagttcaagtccctgatgacccagaccgcgaacgccaagccgctcgccccggtccaggtcgaggacgagaccgaggggcagtccgacgggctgcgtccggcatacgagttcgagccggacgccgacgagctgctcgacgcgctgctgccgaaatacctcaacacgcggatctacgcggcgttgctggactcggcggccagcgagtcggcctcccggcggcgggcgatgaagagcgcgtcggacaacgccgacgacctcctcaagcggtacacgcgcgagatgaactccgcgcggcaggctgcgatcacccaggaaatcagtgagatcgtcggcggcgccaacgcgctggccgcggcgggaagtgatgtgtga

SEQ ID NO: 3831 - DNA, 1458 bp, Actinoplanes utahensis
atgactgttcttgccacctccggtgcatccgagcccaccaaggcggagaccgctgtcggccgtgtcgtccgggtcatcggcccggtcgtcgacgtcgagtttccccgtgacgccatgcctccgatcttcaacgcgctgcacgtcgaggtcaccctctccgagggcaccaagaagctgacgctggaggtcgcccagcacctgggtgacaacctgctccgcgcgatctcgatgcagccgaccgacggcctggtccgtggcaaggaggtcacggacaccggcgcgccgatctcggtgccggtcggtgacgtgaccaagggccacgtgttcaacgccctcggcgaggtgctcaacgtcgacccgtcgacgctggacatccaggagcgctggtcgatccaccgcaagccgccggcgttcgccgacctcgagccgaagaccgagatgctggagaccggcatcaaggtgctcgacctgctcgcgccgtacgtgcgcggtggcaagatcggcctgttcggtggcgcgggcgtgggcaagaccgtgctgatccaggagatgatcatccgggtcgcccgcaatttcggtggcacctcggtgttcgccggcgtcggcgagcgcacccgtgagggcaacgacctcatcctggagatggacgagggtggcgtgctggacaagaccgccctggtcttcggccagatggacgagccgccgggcacccgtctgcgggtcgccctgaccgccctgaccatggcggagtacttccgggacgtgcagaaccaggaggtgctgctcttcatcgacaacatcttccggttcacccaggccggttccgaggtctccaccctgctcggccgcatgccgtcggccgtgggttaccagcccaccctggccgacgagatgggtgagctgcaggagcggatcacctcggtccggggcaaggcgatcacctcgctgcaggcgatctacgtgcccgccgacgactacaccgacccggcgccggccaccaccttcgcccacctggacgcgaccaccaacctggagcggtcgatctcggacaagggcatctaccccgccgtggacccgctggcctccagctcgcggatcctggccccggagttcgtcggcgccgagcactacacggtggcccgtgaggtccagcggatcctccagaagtacaaggacctgcaggacatcatcgccatcctcggtatggacgagctctccgaggtggacaaggtcacggtcgcccgggctcgccggatcgagcggttcctgtcgcagaacacctacgcggcggagcagttcaccggtgttcccggctcgacggtcccgctgaaggagaccatcgaggcgttcaagaagatctccgagggtgagtacgacaactacccggagcaggccttcttcatgtgcggtgggcttgaggacctggagaagaacgcgcacgagctgatgaagggctga

SEQ ID NO: 3832 - DNA, 1122 bp, Actinoplanes utahensis
gtgctgggcgtgaaaggtgtcctgggaacgaggaacgtcccgcgctgggcccggctcgccgccgtgttcggctcggtgctgatgatgatcagcggtggagtgctggtcggtgggcgagcgctgatctcgcggtacaccgccgggctggacgccgacggcagcctgatcggcgcgggcaccggtgccgccgagatccggggcccgatcaacattctgctggccgggatcgacccgcgggacgaccacaccgcgccgctgtccgactcgatcatcgtggcgcacatccccgcctcgatggatcaggtctacctgttctccatcccgcgggacctctatgcggccatcccgccgtttccgccgaccggcttcgccgggaccagatcgaagatcaacgccgcgatgtcgtacggcagccaggtcgccggtggccgtcacgacgtgcggcaggggtttcgcctgctggcccagacggtcagcgggctcaccgggatccgggacttccaggccggcgcgatcatcaacttcggcggcttcaaacaggtcgtcgaggcgatgggcggggtgacgatgaccgtggacatgccggtccgctcggagcacctgcggccggacgggcggccccggccccgccggccggagtgcgccgacaactcctgcccgcacccgtacatcgggccgcagaagacgtaccggccgggcacctaccacctgcaggcctgggaggcgctggactactgccggcagcggtacgggctgccgcacagcgactacgaccggcagcgccaccagcagcagttcctcaaggcgatggcgaagcaggcgctgagccggggcatggtgaccaacccggcgcggatgttgcgggtgctggacgcggccggtgacgcgctcaccttcgacggcaacggtcacagtctgctcgactggggcctggccctgcgcaacctgaacaccgacgacatggtctcgatcaaactgcccggcggcgcgctggtggagaacggcacctatctcggcgagcagttggcgcccggcaccggggatttcttcgcggccgtccgggaggaccacatccaggagtttctgctggcccacccggagttcgtgaaccggaacagctag

SEQ ID NO: 3833 - DNA, 282 bp, Actinoplanes utahensis
gtggccaaccaacttcacgtcgaggtcgtcgccgtcgaggagaaggtctgggccggtgaggccgagatgctcgtcgcgcgcaccaccgagggtgagatcggtgtgctgccgggccactctccgctgctcggcctgctcaaggagccgtcccaggtgcgggtgaaactcgccggtggtgagcagctcacctacgacgtcgccggtggcttcctctccatcgacgcgaacggcgtcacggtgctcgccgagagcgcgacgccggccacccccgagcagcactga

SEQ ID NO: 3834 - DNA, 468 bp, Actinoplanes utahensis
atgcgggttctggaagttttcgggatctgcctcgtcgcgctgctcgcgctgctgttcgccatcttcttccgccgccggctgctgatgctcggcggcggcaccatccgcctgcaggtccgcaccagcacgatggtgccgggccgcgggtggtcgcccgggctgggccagttcgtcggtgacgagctgcgcttccacaagatgttcagcctggcgttccggcccaagcgggtgctcgaccggcgcaccctggcgatcgccgagcgtcgcctgccgaccggtcccgagcggctcaccatgcccggccactgggtggtgctgcgctgcgccacggccggcgtcgacctggagatcgccatggccgagaccacggtgaccgggttcctgtcctggctggaggcgggcccgccgcgcgatccgggcagtgtgcccggccgctccatcttcggcccccgctccctcgaaagctga

SEQ ID NO: 3835 - DNA, 822 bp, Actinoplanes utahensis
atgcggattcgtatcgtcgacgccttcaccgaccgcccgttcgccggcaacccggccggcgtgctgatcctggacggggacgggtttcccgccgccgactggatgcagcgggtggccgccgaggtcaacctgtccgagacggccttcctgcaccgcctcccggccggctcggacgccggctgggcgctgcgctggttcaccccgggcgccgaggtcgccctctgcggccacgccaccctcggcaccacgcacgtgctgcaccgggccgggctgctcgacggcgccgcggtccgctacgccacccggagcggcatcctggcggcgaccgtcgccgccgacggactgatcaccatggacttcccggccgccccgctcagcccggtcgaggtggccccggagcttgccgcggctctcggcgtcgacgccacggccggtttctggaccggcccgaacaccgacgacatcctgatcgagctcgccgacgaggcggcggtccgcggtctcaccccggatttcggcgcgctggcccggcacacccgccgtggcgtggcggtgaccgcccggtccgcggagcacgacttcgtgtcccgtttcttcgccccggcggtgggcgtcaacgaggatccggtgaccggttccgcccacaccgcgctgaccccgtactgggccgggcggttgggccggaccgagctcaccggataccaggcgtcggcccgcggcggtgtggtccgggtggccctgcgtggcgaccgcgtcgacctggccggtcacgcggtcaccacgatcgacggcgagcttcaggtggcgatctccgcctcgtaa

SEQ ID NO: 3836 - DNA, 573 bp, Actinoplanes utahensis
atggctgtgcatctgacgcgtatctacacccgaaccggcgacgccgggcagacccggctggtcaacaacgaggtggcggccaagaccgatccacggatcgcggcgtacgccgacgccgacgagtgcaacgcggctctcggcaccgctctggctctcggttcgcttcccgacgacgtccgcgtggtactgggccgcatccagaacgacctcttcgacctgggcgcggatctcggcaacccgctggacgagaacccgccctacccgccgctgcggatcaccgaggagtacgtgacccgcctcgaagggtggtgcgacgagttcaacgagcggctggccgcgctggacagtttcatcctcccggggggcaccccgggggcggccctgctgcacgtggcccggacggtggcccggcgggcggagcggtcggcgtgggcgctgatcgaggcggacccggagcggaccggggtgctgccggcgaaatacctgaaccgtctctccgacctgctgttcatcctctcccgggtggcgaacccggacggcgacgtgaagtgggtgcccggcggctcccggtga

SEQ ID NO: 3837 - DNA, 1320 bp, Actinoplanes utahensis
atgcagtcccggcgggccccggcccatacgatggcccgcgtggatgtgatcagggtgaagggcggcgcgccgctcaccggggacgtcacggtcggtggcgccaagaactcggcgctcaagctgatggcggtcgcgctgctcggcgagggccgcagcgtcgtcgccaacgtcccccgcatcaccgacatcgcgatcatggccgaggtgctgcgccggctgggctgcgacgtcacgctggagggcaccgacgcggtcatcgacgtgccgctggagccgggcgccgaggccgactacgacctggtccgccggctgcgcgcgtcgatctgcgtgctcggcccgctgctggcccgccggggctacgtgcgggtcgcgctccccggcggcgacatgatcggctcccgcggtctggacatgcacgtctccggcctggccaggatgggcgcggagatctccaacgagcacggcttcgtgatcgcgtcggccccggccggcctgcgcggcaccaagatctggctggacttcccgagtgtcggcgccaccgagaacctgctgatggccgcggtgctggccaagggcgtcaccgagatcgacaacgcggcccgcgagccggagatcgtcgacatctgcgacatgctcaccgcgatgggcgcccggatcgccggcgccggctcgtccacgctggtcatcgagggggtggacggcccgctgcggccggtccggcacaccacgatcggcgaccggatcgtcggcggcacctgggcgtacggcgcggccatgacccgtggcgacgtcaccgtgcacggggtgcgccccgagttcctcgacatcgccctggacaagctggtcacggccggcgccacggtggagccgggggacaacaggttccgggtccggatggccgagcggccccggcacgtcgacatcgtcacgctgccctacccgggtttcgccaccgacctgctgccgatggcgctgggcctggccgcggtcgccgacggcccgtcgctgatcaccgagaacatcttcgacggccggttcatgttcgtgaacgagatggtccggctcggcgcggagatccgcaccgacgggcatcacgcggtcgtcaacgggcgggagcggctgtccggggcgccggtccgggccaccgacatccgggccggggccggcctggtgatcgccgggctgtgcgcggacggggtcaccgaggtcggtgaggtgcaccacatcgatcgggggtacccggacttcgtggccgacctggcgcgtctcggcgtggaggtggagcgcaccgacgtaccggagccgtccttcgatttctag

SEQ ID NO: 3838 - DNA, 336 bp, Actinoplanes utahensis
atggccacgagcgacggctggtatctgatcggcccgctgatcgccgtcggtctggtcggctttctcggcgccgtcttctggcgcatgggcctgcaacccaccgtcggtgcggacggttacgcggacggcctcgcgatcttcggcgagcaggaggattacggcctgctgtccccggccgcggtcaccgacgagcccgagatcgccgacgagatccggcggctgctgtccgccgcgggcatccgcgccacgagcgcgacccgccgcgacggccgggtgtgcgtgctggtcttcgccgaagaggtggaggaagcccgccgcctcgtcggatcgagctag

SEQ ID NO: 3839 - DNA, 849 bp, Actinoplanes utahensis
atggcgggtcgtctcgcggtcatcgggtcgggattgatgggttccggcatcgcgcaggtctcggcgcaggccggttggcaggtcaccatgcgggacgtcgacgacgcctcgctcaagcgcgggctcggtgcgatccgcgattcgctcagccgcttcgcggccaagggccggatcgccgagggcgacgtcgaggccaccctgcagcggatcaccccgaccaccgatctggaggcggtcgccgaggccgacatcgtgatcgaggcgatcttcgagaaggtggaggcgaaacacgacgtcttcaagcagctcgacaagatctgcaaggcgggtgcggtgctcggcaccaacacctcggccatcccgatcacccagatcgccgcgatcacctcgcgccccgagtcggtggtcggcatccacttcttctccccggtcccgatgatgaagctcgtcgagctcgtccgcggctaccagacctcggacgcgaccgtcgccgcggcccgcgacttcgccgagggcgtcggcaagacctgcgtcgaggtcaagcgggacgtcgccggcttcgtctccaaccggctcttctcggccctgctggtcgaggcgatcaagctggtcgagtcgggggtggtctccgccgccgacctggacacggtgatgaagctgggcttcgggcacgcgatgggcccgctggccacggtcgacctgaccggtctcgacgtgatgctgaacgcggcgggcaacatctaccgcgacacgcaggacgagaagttcttcccgccggagctgctgcagcggatggtgaccgccggggatctcgggcgcaagaccggcaagggtttctacagctactga

SEQ ID NO: 3840 - DNA, 774 bp, Actinoplanes utahensis
gtgaccgcacgtgaccggcagccgcccacccgcgactaccagctgatggtgagcgccctcgccgaggtgacccgccgccgcgacgccgaactcggccaggctgaacaggcctatcaggacagcgcggcgcgggccgccggcgaactgtcccgcgccgagaacgacgccctggccgccgaccgctgggccggcgcggccgcggcccaggtgctcgacgtcgaccgggaggcggcccggctctgggaccagctccggcgcgcccgcggcatgcgggtccgcgctctcggcgaagtccccgaacccgcgccgatcgaagccctcccccgggtcgccctgcaacgccgcccggccggctcggccgactccccggacatcgacggcagcgtcgtcgtccccggccgccagtcgccgcgcgccctgctggcccgcgccgccgaccggatcgacgaccgtttccgccccgggagccgccgcccactgccccgctggtcgctgcccctgctcccgctgatcggcgcgatcgcctcgaccgtcgccggcctgatcgccgccggcctggtcactttcggccacaccgccgtcttcggcgggctgctgatccgtggcctcgggtggctgaccttcctgatcgccccgtccgccggggttccggccgccgccgtgctcgcgcaccgtcgcctgcacgcccgcctggacatcggcggcatcggcctcaccctgctcggcggcatggtcgccgccaccctcctgtcgctctccttcgccacccactga

SEQ ID NO: 3841 - DNA, 2604 bp, Actinoplanes utahensis
gtgggtagtcaccgcaacgcgctggtcgccgcggtccgccaggagctcgccgaagcacgcggcacggcccgggcggtgctggccgccgccgagtcggcgcgcggcgaggcgcagggccggcgacggctggtccgcgacgcgtacgccacctgcctcaaccagctcgccgaagcccgcgaggcggcccgcgacgacatcgagcgacgcttccgcggcgaggccacccggctcgccgggcacctgcgcggcctggccacctccagcgccaccggcgcggccggtgcgccgtggcggctgtggtcacccagcgaacccgatccgggcagccggcccggcctgctccggatcggcgcgatcaccttcgaggagaccgccgccctgcccgggctgatcccgctgctggacgccgtgcacctgcatgtcagcggtccgtccccgcaggtcgacgacctgatcaccggggtgctgctgcgggcgctgggcagcacccgggccggggacgtgcacctgaccgtctacgacccggaaaacctcggcggcaccctggccccgttcgcgccgctcaacccgaccttcgtcgggccgggcggactcggctcgctcctcgacgacctggccgagcacatctgccgggtgcacgagtcgctcggcgggcagtacccgacgctggccgacatggtcgccgcccggcccgggccgcgcctggagccgtggaaactggtggtgctgctcgccgaccgggccacctcggtggagatgaccacggcgcagcgggctcaactgggccggatcgtgcggaccggcgtcgcctgtggcgtgcacctggtggtccgcggcctggaactggcggacgatccgagcatcgaacggatcgtggtccgggagcagatcgccacctgcggctcgctcggcagcctggagatccgcctcgacccgccgcccccacccgaccggatcgcggccttctgccggaccaccgccgagcggctgcaggccggcgccggcccggcccggctcgccgacctggagccggccaagcactggaccgagtcgtcggtgcacgggctggtcgccccgatcggcgacagcaccgacgggacactggtcgaggtgccgctcggcgacgacccgccgcacgcgctgatcggcgggccgtccgggtccggcaagaccaacctgatctacacctggctgggttcgctggccacccggtacgggcccgaagagctggcgctgtacctgctggacttcaaggaaggggtgtcgttcgcccggtacgcccccggcccgcgcgacccgagctggctgccgcaggtgcggctcgccgggatcaacgtcaacggcgaccgggagttcggcctggccatgctccggcacctgggtgaggaactgcgcacccgggcgcaggcggcgaaacgctgcgatgccggcaaactgtccgagctgcgggccgaggacccggccgggcactggccgcggatcgtcgcggtgatcgacgagttccaggtgctgctggccggccgggacgcggtcgccgacgaggcggtcgacctgctcgaagacctcgcccggcggggccgctcgcagggcatccacctgatcctggccagccaggacgtggccgggatccaggcgctgtgggggcggcccgggctgatcgcccagttcaccctgcggatcgcgctgcccaaggcgcgccggatcctggccgaggacaacctggccgccgcggtcatcccccgcttccacgcggtggtgaacaccgagtccgggctgtccggggcgaaccggatcgtccgcctgccggacgccggtgaccgtctcgtctggcgcgccctgcagcgcaccctgtggcgggaacggccggccggctgcgccgaaccacggatcttcgacggggacgcggtgccccggctgcccgggtcgctgcgcccggccggccggatgccggccggggacgcgccgatcgggtcgtcgccgggcgcggtgctcggcgagcggatcgacgtggccgcgcagcccgcccggctgcggctgggccggatgcccggacgcaacctggcggtgctcggcacccgggtcaccgaagcctgcgacgtgctgtccgcggcggcgctcagcctggccgcgcagggcccggcccacttcagcgtgatctgcctcgacccgtcggcgcaggcggccgcgaaccggttgtacaccgagttgccgtcggcggactggtacgacgccggcaacgtccacttcgacctggcgttcaccgacgtcccgcactacgtgatcgggttcgcgctggacgccgcccggcagcccggcctgcggactctgctggccgagggccccgagcggcgcacccacaccctcggctggtggcggtcggtcccccgcctccgcgacgacctcggcggcgtcggcgcccgcttcgacgcgatcggcgcctgggtcgccctcgacgtgcacggcgccgacctcgccccgctgcacccgcagccgggcggcccggcgtggtacccgcgcccgaggcgggcgctgttcttcgaccgatcggtgcaccgcaccccggaagtgatcatcccctatgaggtgaccagtgaccgcacgtga

SEQ ID NO: 3842 - DNA, 1830 bp, Actinoplanes utahensis
gtggctgcagaacggctggaccatcgtgatcctggcgatcctgctcgccatcgaggtggtggccgacaaggtgccggtggtggaccacttcaacgacgtggtgcagacgctggtccggccgaccgcgggcggcctggcgttcggggccggctcgtcgtcggagacggccaccgtcaccgacccggggcagttcttcggctcgcaccagtgggtgccgatcgcggccggggtgctgatcgcgttctgcgtgcacggggtgaaggcggcgtcccggccggtggtgaacgtcaccacggccggtttcggtgccccggtggccagcaccgccgaggacatcaccagtgtgctgctctcggtgctggcgattctcctgccggtactggtcctggtgggcctggtcctgctggtctgggccgcggtctgggtgttccagcgacggaagcggcgcaagcaggcgcggctcgcgggtgtcgaaacgcgtcgcctgtttggttgactctgcgggtgctcgccttcgccgttcccgcgttcgccctcagctggtggctcgccgcctacctgatcggccgggacccggggcggccggcactgcgctgggcgagcgccggcctgaccgcgtacggcgtcggggtcgccgcctggaccgtcgaccccggtgggcggaccgcccagatcctgatctgcctgccggccctggcctgggccggcagcgtggtcgcgctgctgccgctgccgccggccgagcggcgcccgatcgacgtcggcgccctggtcctcggcgtctcgttccagctgctggtgatcgcgttgccgggcgccgggaagctggtcgggctgaccccgctgggcggtgcgctgttcctgctgtggcgcgggcgggcgcaggtggtgccgcgtcgcctgccgctcgccctgaccctgatggctctgctgtacgcggcggcgatgaccgcgctgctggtcccgctcgatgccggcggcccggtgccggcgctcgccgcctccggggtggacctgctggtgttcggctatctgatcgctgtcgcgcacgcggtgaccggcggtgagcggctccggcccgacctgcgccggtcgctggccgccgcggccgccgtcctggttctggtcggcctgccggcgacattgacgttgtacgtcgttcccgccgacgccgtggtgacctgcctgcagttcgtgccggtcggggtcgccgcggccgcggccgggctgaccgggcggatgagccggctgctcgaccgggtcgcgctggccggggacgtgcggctgcgccacgaccgggccgcgctgttcctgaacgcggacgcgctgttgcgccgccgggagcgccggaccctggccgagctgggcgagccggagttcctccggttgacccggcgggcactggccgacttcaacgatctgaaccggctgtcccgcagcccgctgaccggtctgccggtggtggcccggcggatcgccgggcgtggggacgaccagccgcgggcccgggcccgggagttgcgggcggtgctgcgcgagtcggtgtcggcgctgcggccgaccggcccgttcggtaccaccgaggactggcggtactacaacacgctgcagttctgcggggtgctcgggctggatccgtacgcacggcggcagcggctggacgggctgagccgggaggcccggatggcggtcgactggttccggcgcaacgtgccggaggacaccatgcggcagtggcaccgggaggccgcgatgatcgtcgcgggccacctgtggagcgaggccctttctgacgacagatcacgacacgcagcgtccaatccgtcgtaa

SEQ ID NO: 3843 - DNA, 660 bp, Actinoplanes utahensis
gtgcgtctggtcatcgcgaaatgctccgtggattacgtcggacggctctccgctcatctcccgctcgccacgcggctgctcatggtcaaggccgacggctcggtgtcgatccacgccgacgaccgcgcctacaagccgctgaactggatgagcccgccctgcaggctgcaggaggcgccgggtgtctggaaagtggtgaacaaggccggcgaggagctgcggatcaccctggaggaggtcttccaggactactcctacgagttgggtgtcgaccccggcctgcagaaggacggtgtcgaggcgcacctgcaggagctgctcgccgagcacccggaaaccttcggcgagggctacacgctggtccgccgcgagttcatgaccgcgatcggcccggtcgacctgctgctcaaggacgccggcaacgcctcggtcgcggtcgaggtgaaacgccgcggcgagatcgacggcgtcgaacagctcacccggtacctcgaactgatgaaccgggacccgctgctcgctccggtcaagggcgtcttcgcggcccaggagatcaagccgcaggcccgggtcctggccaccgaccgcggcatccgctgcgtcgtcgtggactacgacaagctgcgcggcatggaacgcgacgagctcaccctgttctga

SEQ ID NO: 3844 - DNA, 483 bp, Actinoplanes utahensis
gtggacccgggccctcggcaccggcgtcgcaatgtcaggatcggcgtcgtggtggatgcggttaccccggaagagaacgcgctgctggccgacggcctgaggcgactcggcggccccctgtccggcctggtggcgcggctcatgccggccgacgtgcacgaggtcgaggtggccctgccgctgccccgcgacgaggcggagaggatcgccggggccgtgctgcaccgcgccgggcggccggccggccggctatgggccgtggtcggttccggggcgatggacctgaacccggccgtcgtcacggtggcggtcgtcgccgaaagcggcggcacgcacggggagggcggggccggcgagcaccgcggttgcgagacggtggtccgggtgcgcggggtcgccaaagaaggcctgatcaagcagtacgccggccggaaggccgccgagcggatcgcggccgggctggccgcgatcacgctggagtga

SEQ ID NO: 3845 - DNA, 393 bp, Actinoplanes utahensis
gtgacggtcgccgcggttgcgctgccgcttctcggcctggcctggctggccacgatggcgcggctggtcatcggcgccatcggcgaggggctggtggtgaatgcgaacgccggccaaggtgccgcggagacagcggccgcggagcgggccacggccgatttccggcgctgggcgaccatcgcggtgatcgagctcgccgccttcaccgtcgccgcgttcgtggcgcggatccgctgggtggggtgggtctcgctggccgtcaccgtcgccttcggcggcttcgccgggctgtccctgcgggacgacccggccggcccgcagccacggcccacgccgaccgtgtcgcagtgcatcgagcgcagcgggggcgacacccgatgccccgggggatga

SEQ ID NO: 3846 - DNA, 804 bp, Actinoplanes utahensis
atgagcaaccagatccgcgccaactccatcctgcccgccaagcgggaggacatcgagttgcagaccgcggacggcgtcaccctggtcggtgagctggccgtcccgctggaccgcgagccggtcgccaccctcgtctgcctgcacccgctgcccacccacggcggcatgatggacagccacgtcttccgcaaggccgcgtggcgcctgcccgccctggccggcctcgccgtgctccgcttcaacacgcggggcaccggcagcgtccgcggcaccagtggcggcagtttcgcggccgccaccgacgagagatacgacgtggccgccgccatcgaattcgcggagttccacgacctgccgaacatctggctgctcggctggtccttcggtaccgatctgaccctgatgtacggcctggacccggcggtgcagggcgcgatcctgctttcgccaccgctgcgcttctcgcagcccgcccacctggcggcgtgggcggcggacgggaaaccggtcaccgcgctcatcccggaattcgacgactacctgcgcccggacgccgcggccgagcgtttcgccgcgataccgcaggccgaggtcgtcccggtgcccggtgccaaacatctgtgggtcggcgacgcggaaaaggtgctggacgagatcgtccggcgcgtcgcgcccggcacgacgacaacccccttgccgcgtacgtgggacgggccgatggagagcggcgacatgaacgcgtacgccgatcgcacggtggccgccttcgccgacgtcgaggttcccgggccgctgcgcgactga

SEQ ID NO: 3847 - DNA, 321 bp, Actinoplanes utahensis
gtgagtccccgccgcaaccgtccccgccgcgacgccgaacccgacaccgggtcgcaacgccccggcatcaccgagcagcgcgtccagcagtggcaggacggggactggatggtgcgtaacatcttcggcgcggccgccaccaagacctatctgtgccccggctgcctgcaggacatccggcccggcgtcgcgcacatcgtcgcctggccgcacgacggcgccggcgacgaccgccggcactggcacaccggttgctggcgggcccgggaccggcgcggcccgggggtggagcgctcgcgcaacgctccccgctatgggtga

SEQ ID NO: 3848 - DNA, 1494 bp, Actinoplanes utahensis
atgacggcgactcacgttcccggcctgcccgtgatcgaggacggccaactgatctccaccaacccggcgaccggcgaggtggccggccgcgtgccggccgccgacgagaaggcggtggtggccgcggtcgagcgggcccgggcggccgccgcctggtggcagggcctcggctgggacggccgccggacccggctgctgcgctggcgcaccctgctcgtcgagcggatccaggaactggccgagctcacccggctggagagcggcaagccggtcaacgacggcatcatcgaggtgaccgcggccgtcgagcatctcgactgggcggcccggaacgcgaagcgggtcctcggcccgcgtcggatgcggacccggctgctgctcgccgagcacgtcggccacctggaataccagccgtacggcgtggtcggcgtgatcggcccgtggaactatccgatcgtcaccccgatcggcccgatctcgggggcgctggccgccggcaacgcggtcgtcttcaagccgagtgagtacacgccggtggtcggccagtggctggccgacacgttcgccgagatcgtgccggagcacccggtactgcaggccgtgcacgggctgggcgacgtcggcggggcactgtgccggtccggagtgggcaaggtgtcgttcaccgggtccacggccaccggcaagaaggtgatggccgcctgcgcggagaacctggtgccggtggtgatcgaggcgggcggcaaggacgcgctgatcgtcgacgaggatgccgatgtgcaggcggcggccgaggccgcggtctggggcgcgatgaccaacgccgggcagacctgcatcggcatcgagcgggtgtacgcggtcgccccggtctacgacgcgttcgtgagcgccgtggtggagaaggccggcagactgcgcaccggcgaggagatcggcccgatcaccatgccccgacagctggagatcatccgcgatcacatcgaggacgcgctggcccgtggtggccgggcggtgctcggcggggccgacgcggtgagcccgccgtacgtcgcccccacggtgctggtcgacgtcccggacgactcgaccgggatccgcgaggagaccttcgggccgacgctgaccatcaccagggtccgcgacgcggaggaagcgatcagcaaagccaacgacacggcgtacgggctgggtggctcggtcttcgggaagaagaacgcgatccgcatcgcccggcggctgcgctccggcatggtggcggtgaacggcacgctgaccttcgtcgggatgggcaacctgccgttcggcggcgtcggcgagtccgggttcggccggatccacggcgaggacgggctgcgcgagttcgcccggccgaaggcgatcaccgtgcgccgggcgcggtcgctgctgcccgcgatgaccttcgagcggaccccggcgcaggtgcagcagatcgtcaaggccctgcgcctgctgtacggacggaaaccgtag

SEQ ID NO: 3849 - DNA, 639 bp, Actinoplanes utahensis
gtgaccgaccaccccgcggttgaggtaagcgatctcacggtgagttatggcgcgaccccggtgctggacggggtcgcgctcaccgttccggccggcaccgccgtctgcgtcaccggggagaacggcatcggcaagtccaccctgctgcgctgcgtcagcggcctgcaacgggcggacgccggccggatccgggtgttcggcgcgacgcccggctccagccccgagttctgggccgcggtggtcaccaccgtcgagccgcccacctggtatccggggctcaccacgcgcgagcacgtcgagctggtctgccgcgcccacggccaggatccggacgaggccggcgtcgacgaggcgctggagcggttcgggctggccgggcacgccgacgcgatcccgccgtcgctgtcctccgggcagaagcagcggctcaccctggcgatcgcgctgatccggccgagctcgctgctgatcctggacgagccggagcagcgcctcgacccggacggccgggcgatggtcgccgcgatgctggtggactatctcgccaccggcggttcgctgctgatggccagccacgacgacaagttcgcggtcgcctccggggccgagctgaccacgatggagtcgctgaccccatga

SEQ ID NO: 3850 - DNA, 1491 bp, Actinoplanes utahensis
atgacgatcatggtcgagttgggcccggtccgccgctggatccaccagcgccaggtctcccatcgggagcgcggggcgacgctgggcaacctgtacgtcgccgcgctggtcgtcgcggtcttcggcgcgatgacacaccggcagctcaccaggggtttctggccggcccacccggatctcggggcgctgcccgcactcgctctcgggctgctcggcatcggcttcctgaccatgacgctgcgcgcgatcggtccggtcacgctcggccgccccgcggcgtacttcctgctcaccgcaccggtcagccgccgccggctgctgctgccgtcgttgcggttcgccgcgctcggcgcggccttcgccggcgcgctgatcaccttcgcgatcaccgggcacgccgcgccgcacgaccgggtgcccgcactgatcctcggcggcgcgctgatcggcatcggtctgctgctggtcgcggtggtcgcgcaacgggtgcgccgctgggccacgctcaccgaccggctcgccgtgctcaccgtggccaccggcgtcgcgctgctggtcatcgaccgggtcaccgctgccgatcggcccgcctccggcggatggccatcggcgccggcgctgctcgcggtcgcgggtgccctcacggtcgcggtcacggccgggttcctcgtgacggtacgtctgctgccccgcactccggacgaccggatcctggaagcctcgaaggtgaccggaaccctgttcgacacggccttcgggatggagccgtcgttcgtcaccgagatggtcgcgcggcgctactgggcgaaccgccggctgcgcaccacccgcccgccggcccgccttccggtgctgaccggccaggacttcctgctggcccgccgccgcctgccccggctgctgtggctgctcgccgccaccccgatcccgctgctgctgaccgccgccccaccctgggtcgccgccctcgccctgctgctcggcgcgatgatcgccggtggcaccacgaccgccacggtgaacaccgacgccggcaacccggtgctgctccggctgttgagcctgagctcccggcaggcgctgacccagcgtctctgggtccccggggtgctggcgttcgcctggtcgctgatcgcgctgatcctgatggagaccaccgggcatctgccggccggacggtggtggctgctcagtgtcccggccggggtgatcggcggggtcgccgcggtccgccgggcccgcgccggattcgtccgcaacgacctgctgccgctggacacgccgatgggcacggtctccaccggcccggtggtctacgcggtcgccggccccgacgccctgatcctgggcatcccgatcgtgatcgccttcggccggggcaccccgctgagcctcgacctgctgctgatccagaccgctctggccctgctgggcgcccgcgcctacctggccggcacgaccgactcggcccgggtggacctgcagccctga

SEQ ID NO: 3851 - DNA, 225 bp, Actinoplanes utahensis
atggatgccaccaccttcacgtgcccgcactgcgggagcgctgagatcatctgcgtgccgagcagcatgaacgacggctacaaccgcagcggcatgacggtcagcgccttccggacgatcccgttctcccgggtgatctgcctgcagtgcggcctggtccgggaatggatcaccgaccgcgcgcagctggacctgctgcgcaagaagttccggcccgagcagtga

SEQ ID NO: 3852 - DNA, 1476 bp, Actinoplanes utahensis
gtgcggcagcatgggggaatgaagcgccgctggcttttcgccgatcagttggggccgcattttctggacgagccggggcagccggctctgctgatcgaatcgaaggcggtgttccggcgccgcgcctttcaccggcagaaggctcatctggtgctgtcggcgctgcgccaccgggcgagggagggtgacgcgcggctggtgcgcgccgagacgtaccgggaaggggtcggcgaaccggtcagcgtgtgccatccgacctcacgggcggcccgcggtctggtccggcgactgccggatgtcgagatgctcgggccgcgcgggttcgtcacctcgccggaggacttcctcgcctgggccggtgggcgggagcacctgcggctggaggacttctaccggtatgcgcgccgccggcatgacgtgctgatggacggtgccgagccggtgggcgggcggtggaatctcgacgccgacaaccgggagccaccgccgcggggggccgggcggctggacgtgccggtgccacccgtgatccgcgaggacgagatcgacgaggaggtgcgcgccgacctggaccgctgggagcgggaggacgggatcaccttcgtcgggcacgacgggccgcggatgttcccggcgacgcgggccgaggcgctggagcggctgcggcacttcgtcgagcatcggctgccgtcgttcgggccgcacgaggacgcgatgctggccggtgacccgctgatggcgcacagcatgctcagcccggcgatcaacctggggctgctggatccgctggaggtcgtcgagtgcgccgaggacgcgtaccggcaaggggctgcgccgctggccagcgtggagggtttcgtccggcagattctcgggtggcgggacttcatctggcacctgtactggtatttcgagccgcagtaccgggccgtgaacgaactgcgggcgcgtcgcgagctgccggaatggttcgctcgcctggacgccgacgcggtgcaggcgcgctgcctgtccgacgtgctggccggggtgcgcgaccgcggttgggtgcatcacatcccgcggctgatggtgctgggcaactacgcgatgcagcgcggctggcggcccggggcggtggccgactggttccaccggtgcttcgtcgacggctacgagtgggtgatgacggccaacgtgatcgggatgagccagttcgccgacgccggacggatgagcagcaagccgtacgccgcgggcggcgcctacctgaaccggatgagcgactactgccgcggctgccggtacgacccgaaggtgcgcgtgggtgagcaggcctgcccctacacggccggctactggggtttcctcgcccgcaacgaggaggcgctgaccggcaaccaccgattggcccagccactgcgtctgctgcaccggctgaccgacctggacaccctggtcgagcaggaggagcaacgcggctcccgggcgccgtag

SEQ ID NO: 3853 - DNA, 1467 bp, Actinoplanes utahensis
atgtcgcacggcggtgaaatcttcggcctgaacggagactcggccaccgagcccagcttcgagttcgcgatccgcggttacgaacggaagcaggtcgaacgctacgtcgcccgtgccgagaacgagatcgccgcgctcgccgccgagcgggagcaggcgtattcgcagatccaggcgatggcggcccagatcgagcggctgcagcaggagatcacccaggcccggcgcaactccgggatgtccggtgaggtctccttccggcatctcggcccccgggtcgagcagatcctggtcctcgccgaggagcaggccgaggcgatcaaggcgtcggccaccgacgacatcgccggccggctcgccgaggccgaacggatccgggccgaggccgaggcgcatgcccacgacggcatccgcgacttcgagatcgcgctggccgcccgccgggccgaggaggagaaggcggacgccgccaagcgggccgccgccgacaaggcggtcgccaccgcccggcagaccgccgagcagatccgcaccgagagcgaggccctgctggcccgcgcgcgggcggaggcgcagcacctggccgacaaggcggccgccgaggcacagcggctgcgcgccgaggtggacggctacgtgcagtcgacccgggtgcagaccgagcaggagctcaaagccctgcgggagaagacgaaccaggagatcaccgcccggcgcaccgaggccgagcgggagcaggccgacctcaaggccgccgtcgagcacgagctggcgctgcgccggcacgcggtgatcgaggagctcggccagatgcgctccggcgtcgagaagcagtgcgccgacctgcgcagcgaggccgacaagtacgcggaggaggtgctgcgccgctccgacgagcaggccaccgccacccgcaaggagctggccgcgcaccaggagaagatcgcccaggccggccgggagctggaggccgcccaggccgaggtcaccgagaccgaacgccggctggccgccgcccgggagcaggcggaggccgccgagcaggagaccgagcgggtccggcagcgccaggccgaggcggcccgggaactggagtccgagctgcagcgggtggccgacgccaagcgggccggggaggccgctgagcggcatgccgcggacgtccgccggcaggtgcagatggaggcgaagcgggtggccgagctggccgccgccgcggtgctggcggccgccgcctcccccgacgatcaggagtcggccgccgtcggctccgcccccgtcgcttccgggtccgcccctgttgcttccggctccgcccccgttgcttccgggtccgcccccgtcgccgccgggtcggctccggttgcttccgggtcggctccggtggacaagtcgtcggaaaaggtgtccgcgtccgccaaggtgaccgttccgcaggcgagccgggtgcccgccgacgcggagtag

SEQ ID NO: 3854 - DNA, 1296 bp, Actinoplanes utahensis
atgccccagcagcaggatcagaacctggccttcttcgagaccgcgaacacccagcacgacttcacggtcgtcctgcgtggttacgaccgtcaccaggtcgacggacacatcggccggctgctcgccgcgctgaaccagtccgagcaggcccgcggtgaggccgaacagcggatgaacgacgcccagcgccggctccgccaggccgagcagcggctcaacgtgctggagcagaaactcgccgacagcaacaaactgctggaggagaacaaccggccgacgctctccgggctgggcacccgggtcgagcagattctccggctcgccgaggagcaggccaacgaccaccgcggcgaggccaagcgggagagtgagggcatcctctccgccgcgcgcctcgaggcccgggagatcaccgacaaggcccgcgccgaggccgccgcgatgaaggcgaccgccgagcgtgaggccggccaggtccgcacgcacgccgagcgcgaggccgccgagacccgggtgcaggcccgtcgcgaggccgacacgctgcgctccgacgccgaccgggagaccaagcagctgcgcacggtcaccgcgcacgaggtggccgagctcaagtcgacggtcgagcgcgaggtctcctcgctgcgcgccaccgccgagcgggagatcacccaggcccgggccaaggccggccgggaggccgaggagaaacgcgccgaggccaccaagatgctcgccgacgcccgcgacaagcgcgacaaggacctgcaggccctggcgctggagatcgccgagcgccgggagaaggccgagtccgaggagtcgcagcggcacgccgcccaggtcgccgccacgcagaagatggtgtccgaggccgaggagcgggcccgcgccgccgaggaccgcgccaaggagatcgagcagcgcgccgagagccgccgcatcgagagtgagcgcaccgccgccgaggcggtggagaaggcccgcgccctcgccgacaagaccgtctccgaggcccgttccgagtccacccgcctgctcagcgaggcccgcaccgaggccgagctgaccacccaggcggcccgccgcgaggtcgaggacctgacccggcagaaggacgcggtcaccaaccagctgggccagatgctgtccggtctgtccggcctggttcccggcgtgggtgcggccccggccgcggtcgccgccgccgttcagaaggccgccgagccggccgccgaggcggaaccggccgagccggccgaggaggccgaggcggagcccgccaagaccaactcctga

SEQ ID NO: 3855 - DNA, 513 bp, Actinoplanes utahensis
atgactgacgacacatcgagtaccggtcggcgcgagaatctcacactcgccggcgacgacctgccggggatcggcctcctccggatcgaccatgtcggcatcgcggtgcccgacctggacgaggccatccgcttctatggggaaaagttcggtttgcggtgtgtgcatcaagagaccaatgacgaacagggtgtccgggaggcgatgctcgccgtcggcgacggcgcgggcccgcggatccagctgctcgccccggcccggcccgactcggcgatcgccaagttcctcgaccgcagcggccccggcctgcaacaactcgcctacacggtggccgacgtggaggccgccgcggacgctctgcgggcccgcggcatgcggctgctctacgacaccccgaaacgcggcacggccggatcgaggatcaacttcgtgcaccccaaggacgccggcggggtgctggtcgagctggtcgagccggccgggccggtacgccgaccgggtgattcagcctga

SEQ ID NO: 3856 - DNA, 1182 bp, Actinoplanes utahensis
gtgaccagctctgtgatcgtcagtggcgcccgcaccccgatggggcggctgctgggcaacctcaagcacctccccgccaccgcgctgggtgcgcacgccatcgccgccgccctggcccgcggcggcgtcgcccccgaccaggtgcagtacgtcatcatgggccaggtgctgcaggccggcgccggccagatcccggcccgccaggcggccgtcgcggccggcatcccgatgtccaccccggcgctcaccatcaacaaggtctgcctctccgggctcgacgcgatcgcgctggccgaccagctgatccgggccggcgagtgcgagatcgtggtggccggtggcatggagtcgatgaccaacgcgccgcacctgctgatggaccagcgcaaggggaccaagttcggcgacaccacggtccgtgaccacatggcgctcgacggcctgaccgacccgtgggccggggtgtcgatgggcgagtccaccgaggtggccggcggcacgctgaacatcagccgggccgagcaggacgcgttcgccgcgctcagccaccagcgggcggccgccgcgcagcgcgagggccggttcgccgaggagatcgagccgctgccctccggtgaccgtcgggcgcccggcccgatcgacaccgacgagggggtgcgcccggacaccaccgccgagggcctggccaagctgcgcccggcgttccggccggacggcacgatcaccgcggccacctcgtcgccgatctccgacggcgccgccgcggtcgtggtgatgagccgggccaaggccgaggagctgggcctgacctggctcgccgagatcaccgcgcacggcaacgtggccggcccggacagctcgctgcagtcgcagccggccaacgcgatcaagcacgcgctgggcaaggcgaacctgaccgtcgaggacctcgacctgatcgagatcaacgaggccttcgcgcaggtggcgatccagtcgatgcgcgagctgaaggtcgacgagagcaaggtcaacgtcaacggcggggcgatcgctctcggtcacccgatcgggatgtccggcgcccgcctggtcctcaccctggcgctggagctcaagcgccgcggcggcggcaccggtgcggcgtcgctgtgcggcggcggtggccagggcgacgcgctgatcatcaaggttcctgcatga

SEQ ID NO: 3857 - DNA, 585 bp, Actinoplanes utahensis
atgaaacgctcccccaccgcgatgctgctgctggcgctgctgtcggaggcgccgatgcacccgtaccggatgcagcaggtgatcaaggagcgcgggcaggaccagctcgtcaacgtcgcccagcgcaacagcgtctaccaggctctcgaccggctggtccgggagaacctggcgcgcgccggggagaccgtccgcgaggccgggcggccggagcggacggtctacgagatcaccgacgagggacgcgccatgctgcgccgctggctgctggagatgctgccggcgccggcccgggagttcccggagttcccggtggccctggcgttcctcgccatgctgagcccggcggagacccgggagctgctgcaccgccggatcgaggcgctcaccgagcgggccgcgggaatcgacgcccaggcaccgcccgggctgccgcgcctgttcctgctggaggacgaataccggtccgccctgctgcgcgccgagctggactggctgcgcgcggtggtgcgtgacctggagaacggcacgctgacctgggactggaccatgatccaggcgaccatggcccagttcggttcctag

SEQ ID NO: 3858 - DNA, 1203 bp, Actinoplanes utahensis
atgtatagtcattacatgactaaaaatgctgccgtgatcggcgggggcgtggccggcaccgccgcggccatcgccctgcacagcgccgggttcgacccggtcctctacgaacgcaccgcgcaaggcgtggccgacgagcgcggcgcgttcctcaccgtcgcgatcaacgggctcaccgcgctggccgcgctcggcctcgacccggcgaaagtgctggacaagggcttccccacgccggccatggagctgctcggcgcgtccgggcggccgctcgccaggatgtcgctgggcgagggcacgctcaccatccggcgctccgacctctccgcgcggctgcgggccgaggcccaggccaggggcatcccggtgatccacggcgcggcactgacccgggcggtcaccggtgcggaccgggtcgaggcggagttcgccgacggtcgccgggtcacggcggagcttctggtgggagcggatgggctgcgttcgcgtacgcggcaatcgcttgatccttccgcgccggaaccgcactatctcgggctgctgaacgccgggggtttcaccgccggcccggtcgatccgcgtctggcgccgccgcccggcctgatgcggatggccttcggccggcgggcgttcttcggctgggcgaccgcgcccgacggctcggtctggtggttcgccaacccgcccagcaagcggccgatcgacgccaccgccgtcacgccggcatcgtggcgggcgcatctgctggacctcttcgacggcgacccgtcgtcaccggccgccgagctgatccgggccagcgacgagatcgtcggaccgtggaacaccgaggacatgggcccgatccggacctggcacgacgaccggatcgtgctggtcggcgacgcggcgcacgccctcgcgccgacctccgggcagggcgcctcgcaggccctcgaggacgccgtcgtgctggggcacgcgctgcggagcaaccccacgatcaccaccggattgcgggcgtacgagagcagccgccgtccccgggtggcgaaggtcgccgcgcacggccgccgcggcaacagcaacaaggtgatggggccggtcggggcggccatccgggacgcgatgctgcccacgatcttccgcctgctcaaccggaagggcgacccgcaggcgtggatcttcgagcaccggctgccgccgttgccggtcaggccttag

SEQ ID NO: 3859 - DNA, 1674 bp, Actinoplanes utahensis
atggacgcagccgagatccaggccgggcgcgagcgctggcagcgccgctacgacgcggcccgcaaacgcgacgccgacttcaccacgctctccgggaaccaggtggacccggtctacggcccgccggccggagccacccaccccggcttcgaacggatcggctggccgggcgagttcccgtacacgcgcggcctctatccgaccggctaccgcgggcggacctggaccatccggcagttcgccggcttcggcaacgcgcagcagaccaacgagcggtacaagatgatcctggccgccggcggcggcgggctcagcgtggcgttcgacatgccgaccctgatgggccgcgactccgacgacgcgcactcgctcggcgaggtcggccactgcggggtggcgatcgactcggcggccgacatggacgtgctcttcgacggcatcccgctgcaggacgtcaccaccagcatgacgatctccggcccggccgtcccgatcttcgtgatgtacctggtggccgccgagcggcagggcgccgacctgagcaaactcgacggcaccctgcagaccgacatcttcaaggagtacatcgcgcagaaggagtggctcttcgcccccgagccgcacctgcgactgatcggcgacctgatggagtactgcgcggccgagatccccaagtacaagccgctgtcggtcagcggctaccacatccgggaggccggggcgaccgccgcgcaggagctcgcctacaccctggccgacgggttcggctacgtcgaactcggcctgtcccgcgggctcgacgtcaaccagttcgcgcccgggctcagcttcttcttcgactcgcacctcgacttcttcgaggagatcgcgaaattccgcgccgcccgccggatctgggcccggcacctgcgcgacgaatacggcgccaccagcgagaaagcactgtggctcaaattccacacgcagaccgccggggtgtcgctgaccgcccagcagccggtcaacaacgtggtccggaccgcggtggaggcgctcgccgcggtcctcggcggcaccaactcgctgcacaccaacgccctcgacgagacgctggccctgcccaccgacgaatccgccgagatcgccctgcgcacccagcaggtgctgatggaggagaccggggtggtcaacgtggccgacccgctcggcggatcgtggtacgtggaggcgctcaccgaccggatcgaggccgaagccgaggagatcttccaacggatccgcgacctcggacacgacggcagcgtgacggcgggcattctgcgcggcatcgaggacggctggttcacggcgcacatcgccgaggcggccttcgcgtaccagcaggccttggagaagaacgacaagcggatcgtcggggtcaacgtgcacaccggcaccgtcgccaaggagctggagattctgcgggtgtcccacgaggtcgaggtggaacagcggcgggtgctcggcgaccgcagacgccagcgggacgcggcgcgggtcaaggccgcgttggacgagctggtggcggtgtcccggaccgagcagaacatgatcccggcgatgctggaggcggcccgggccgaggccaccctcggcgagatctgtgacgccctgcgggacgagtggggtgtctaccgggagccggcccgcttctaa

SEQ ID NO: 3860 - DNA, 939 bp, Actinoplanes utahensis
atgagcgacccacggaccactccgtcgatcttcacccgcggcgcggtcgatctcagcgcgctgcgtaccccggcgccggccaagccggccgcgccgagccgatccgccgccgccgacggcgcaccggccggcggcgtgccgggcaccctgccgggcctcgccccggaaacgatcgtcgacgtcaccgaggccaacttccagagcaccgtgctggagcggtcgctcaccgtcccggtcgtcctcgacttctgggccgactggtgcgggccctgcaaacagctctccccggtgctggagaaactcgccgtcgagggccagggcgcgtgggtgctcggcaaggtcgatgtggacgccaacccgcggctcgcccaggcgttccgggtgcagggcatcccgatggtgctcgccgtcatccagggacagcccgtcgaaggcttcaccggggtgctccccgagatccaggtcaagcagtacatcgacgcggtgctcaaggccgccggggtcagcaccggcgcggccgcgccggaggacccgcggctggacgccgccgacgacgcgctgatggtcggtgacctcgacgccgccgaggcggcgtaccggaagattctcgccgagtcacccgccgacgcggccgccgaggcgggcctggcgcaggtcgagctctaccgccggatcggcggcgccgacgccgaatcggcgctggcccgggccgcggccgcccccgacgacatcgaggcgcagcggctcgccgccgacatcgaggtgctcagcgggcaggccgacgaggcatacgcgcggctcgtggctctcgtcaagaagaccagcggagaggatcgtgacgtggtgcgcaagcatctgctgtcgctgttcgccgtcgccgggccggacgacccggcggtggcgggcgcgcggcgggcactggccagcgcgctgttctag

SEQ ID NO: 3861 - DNA, 2103 bp, Actinoplanes utahensis
gtgacgtggtgcgcaagcatctgctgtcgctgttcgccgtcgccgggccggacgacccggcggtggcgggcgcgcggcgggcactggccagcgcgctgttctagccaccgtcagacgacacaagcgggggagggcgtcgtgcgacgcatcgccgttctggacgcgccgtccaatctcggcctgcgcccgccgacgcccacatcggtgccgggctgcgccaaggcgcccggcgccctccgcgaccaggggctgctgccccggctcggcgcccgcgacgccggctgcctcaccccgccccgatacgacccgggtgactggcgtcccggcgacggcgtcgcgcacgccgccgaaatcgcggcatactcgcgcgccctcgccgaccggatcggcgccatcatcgacggcggcgagttcccggtcgtgctcggcggcgactgctccatcctgatcggctccgggctggccatgcaccggctcggggaagccgtcggcggccggatcggcctcgtcttcgtggacggtcactccgacttccggcaccccggcaacgcgtcctacgtgggcgccgccgccggcgaggacctcgccctggtcaccggccgcggccaggccaacctggcggcgatcgagagccgccgcccctacttccgcgacatcgacgtggtcgtcctcggcatccgcgcccaggacgaatatcgcctcgacctgcaagccgccggcatcgtcacccgcccggtcccgatgctgcgcgccgagggcgccgcccgcagcgcgcagtgggcccgcgaccagctcgtggactgcgcgggctactgggtgcacgtcgacgtcgacgtgctcgacccggcggtgatgccggcggtcgacgcaccggacccgggcgggatcgccttccccgaactcgaactgctactgaccgggctcgtcgaatcaccgcactgcctcggcgtggagatcaccgtcttcgacccggactacgacccggacggccgctacgccgcggagatcacctcagcggtggtgagcggcctggcgccggtccgcacggtgacgccgcggcccgacctgatcgccgcccgcaaggacctggccaaccagcccgccgcggcgccggccgcgcggaatgagtcggcccctgccgtcgggtcggctgtgggggctggggtccgggcggagtcggcctctcccgctgaggacgccgccgtcgtgggggctcccgcgtttgccgaggccgtcgaatctgctcccgccgcggagcttggcccggcttctgggcgtgccgcgcttgcggagcccgccgggcttgccgcgcttgcggagcccgccgggcttgccgcgcttgcggagcccgccggggctgccgaggcggaggcgtcggttatcgcgccgtcggtggctgagcgggcctccgatggctttttagccgaaatttcggacagtggtgcggagaccggtgcggagcctgagcgggcgggaacccccgctgaggaccccatcgatcgcgacccagccgaatcgaccggcgaggagctgtccgacggcgacccggccgcgccggttggtggtgggctgtccgacggcgacccggccgggccggttggtggtgggctgtccgacggcgacccggccgggccggttggtggtgggctgtccgatgaggagccggctgcatcggtagatgttgggatgtccagcgacgatgcggtcgcgccggttggtgggccttccggtgacgatgcggcgataccggttggcgaggagctgcccggcgaggagccggcagatgcgatcggcgagacgctgtccgacgaggagttgagcgagccgggagctgcgtccgagtccgagtccgagtccgagtctgagcttgaaaacgataaggacggcccggtttcggtcgttcccgcggccgaaaaaccggtgcgacccgagatcccgctgctctcccggccgctgggctcggcgccgctgctcgactcggagccgctgccggccaccaggcctggcatgctgcgcccccgcacccctgccgacccgcccgctgtcggcgccgccgccgtgccgcggccgggcttcggcccagcgatcccgccggtctactga

SEQ ID NO: 3862 - DNA, 1905 bp, Actinoplanes utahensis
atgcgccgcgccactgtcggattgactgccctgttcacgctggccaccgccggcttagcggggtgttcgggcgacaagccacaggacaccgtggtggacttcgtcaacggctggaagaacggcgacctcggcaaggtgggcttcgtcacggccggcggcggaaagatcgcctcggccgacgtgctcgccgcgatcaagagcacctacggcgacctcaaggaccagcccctggccgtctcggtggccggcgacccgaccgagtccggcgacgtcgccaccacgccgatcgacctgaagtggactctgcccggcaacgtcatctgggagtacaggtccagcgtccggatgaccaggcgcagcggcgacggctggcaggtgatctgggagccggccgtgctgcagccccagctcgaccagggcgagaaattccggctgcaccgggtgcccgcccagcgcggcaccgtcctggacgccgccggcaagcccctggtcggcccgcagaaggtggtggtcatcggggtcagcccggagaagatcacgaatctgccggcgctgaccaaggcgctcaccgccgcgttcaagaagatcaaggtcgacgtcgatctggccggcctcaaggaccgggtcgccaaggccgaccccggcgccttcctcgacctggtcaccctgcgccggcccgactacgacacgatccgcgatcaggtgcggcccctgcccggcaccgtgttccgggaggagacccggcagctggcacccacccgggtgttcgcccgcgccctgctcggcacggtcgacccggccaccaaggacgacctggacaaccggccgagcgagttgaccgccggcgaccaggtcgggcacggcggcctgcagggccggtacgaccagcagctgcgcggcacccccggcctgtccgtggtggcctccgccgaggcggccgacgcgtcggtccaggagaagccgatcttcacggccccgccggtgaacggcaaggacatcagggtcagcctggacaccgccacccagaacgcggccgaccgggcgatcggcgcgcagaaactgcccagctcgatggtggcgctgcggatcagcgacggctcggtgctcgccgtcgccaacgggccggacgccggcggggtcgacaccgcgctgaccggccaggtgccgcccggctcgaccttcaagatgatctcggcgtacgggttgctcagcaccgggaaggtcaccgccgacacggtcgtcgaatgccccaggacccgggtcgtcgacgggcagacgttcaagaactcgcacgacgaggcgctcggcaaggtgccgttccacgtcgacttcgcgaagtcctgcaacaccgcgttcgtcggcctgtccagccagctgggcgccgacgggctgaagcaggccgccgccgcgctcggcctcggcggcggctggaccatcggcgtcgacgcgttcaccggcaaggtgtccgacggggccagcccgaccgagctggccgccgccacgttcggccagggcaccaccgcggtcagcccgatcgcgatggcggtcgccaccgccgcggtggccaagggcggcttccaggcccccaaactggtcctcgacccggccccgccggccgcgcccgcccccgccgccctgaacccggccgcgctgcccgcgctgcgctcgatgatgcgcgaggtcgtcaccggcgggaccggcaccgccctcaaagccgtccccggcaagccggtctacggcaagaccggcaccgccgaattcgccaccggctccgacgagacccactcatggttcatcggctaccaggacgacatcgccttcgccgtcatggtgcagaaaggcggcgccggcgccgaagccgccgtccccatcgtcaaccagttcctgaccactctgacgaagtga

SEQ ID NO: 3863 - DNA, 4959 bp, Actinoplanes utahensis
atgcctgtcgccgacgaggcagcgaccgattctgatcagaaagattccagggggccagggcctgatcttccagcgcccggtcccgggctggccctgaccggccggctcggagcctccaccgaccagggagagctcgacgagccgctcccgaatgccgagcgcctggtcgcccaggccgtggagcgagccggcgacgaccacgccaccgcgttgctggtcgaccgcttctggcggttcgcacccgacgaggagctggtcgggtacaccccggaggagatgttcaccgccgcggtcgagcaccgcgagctggcccgcaaccgtctccccggcgagctgaagctggatctcaccgagccgcgcggcgcccagtcgcacaccgtgctgcaggtcgtcaccgacgacatgccgttcctggtcgactcggtgatcgccctgctcaccgcgcacaacctgcaggtccacctgatggtgcacccgctgatcgtggtgcgccgcgagccgctcggcgcgctcagcgagctggaggcggacgtcgagccggacgacgccatcgagggcgacatcgtggagagctggatccggatcgagatcgacccggtccgtcgcggcgaggcccgcgaccaactgctcaacgaggtccgccgggtgctcaccgacgtgcgcgaggcggtcgaggactggccgcggatgcgccaacgggccctggtgatctccgacgagctggccaccgcccgcggctcggaccgtcggctgccggtcccggagaaggacgtcaccgactcgatcgagctgctcaagtggctcgccaacgaccacttcaccttcctgggctaccgcgagtaccggctggacgacggggtcctgaccgcggtgcacggcagcggcctggggatcctgcgcggcgagagccgcccgcgccggctggacacgatggcgcccgaggcgtacgagcgggccatggagaagcgcctgctggtgatcaccaaggcgaactcccgggccaccgtgcaccgttcggcgtacctggactacatcagcgtcaaggtcttcgacaccgccggcgaggtggtcggcgagaagcggttcctcggcctgttctccagctcggcgtaccggaccagtgtccgggagttgccggtggtcaagcgcaaggtgaccgaggtgatggaccgctccggcctgtcgccgcgcggccactcgggcaaggacctgctgcagatcctggagacgtatccgcgggacgagctcttccagatcaagaccgatgacctgtacgaggcggtcatcggcgtgctgcggatggccggccgccgtcagctgcgcctgttcctgcgccgggacgggtacggccggttcatctcgtgcctgatctacctcccccgggaccggttcaccaccggcaaccggctgcgcatgcaggagatcctgctgcgcgagctgaacggcgtcggggtcgactacaccacccgggtgaccgagcggatgctggcccgggtgcacttcatcgtgcgcaccgacccggccgcgccgcccggcaacctcgacccgaacgtgctggccgagcagctcgccgacgccacccggatgtgggacgacgacttctccctggtgctggagcgcaagctcggtgacgagccggccaaggagctgttcaaccggtacgcgcacgcctacccggagagttacaagaacggccacacgccgtacgagggcatgcaggacctggccaagctggagctgctggaggagccgggccagctggagatgcacctgtaccgccggcgccggctgggggccgacgggtcgcccgagccggacgaccacgacatccggttcaaggtgtaccggttcggtgagccgatgatgctctccgccgtgctgcccgtgctgcactcgctgggcgtgcaggtcagcgacgagcggccgtacgagatccgccgcgacgacggactggtctacctgtacgacttcgggctgacgccgcctaaggtgcaccgggacctgtccgaggtgcgcccgcaggtggagaacgcgttcgcggccacctggcggggcgaggccgaggtcgacggcttcaacgagctggtgctgcgcgccgggctcacctggcgccaggtggtggtgctccgggcgtacgcgaagtatctgcgtcaggccgggaacgtcttctcccagcggtacgtggagtccaccttcatcgcgtacccggagatcgcccggctgctgctgcagctgttcgaggcccggttctcgccggccctgcagatcggcgagtcggatcgcacccggcgcgcgggtgaggtggcggcgaggatcaccgagctgctcgaccaggtggagagcctggaccaggaccggatcctgcggtcctacctgacgctgatcgaggcgaccctgcggaccagcttctatcagcggggtccggaggggcggccgaagtcgtacgtcgccttcaagctgaaccccgaggcgatcccggacctgccgcagccccggccgaagtacgagatcttcgtctactccccgcggttcgagggcgtgcacctgcgtttcggcgcggtcgcccggggtggcctgcgctggtcggaccggcgcgaggacttccggaccgaggtgctcggcctggtcaaggcgcagatggtgaagaactcggtgatcgtgccggtgggcgccaagggcggcttcgtgctcaagcagaagccgggcgaccgggacgaggcggtggagtgctacaagcgcttcgtgaccgccctgatggacgtcaccgacaacatcctgagcggcaagatcgtgccgccggtggacgtggtccggcatgacggcgacgacccgtacctggtggtcgccgcggacaagggcaccgcgacgttcagcgacatcgccaacgagatctcggtcggcaaggagttctggctcggcgacgcgttcgccagcggcggctcggccggctacgaccacaagaagatggggatcaccgcccggggggcctgggagtcggtcaagaagcacttccgcgacctgggcaaggacacccagtccgaggagttcaccgtggtcggcgtcggcgacatgtccggcgacgtgttcggcaacgggatgctgctgtccgagcacatccggctcgtcgcggccttcgaccaccggcacatcttcctggacccggcgccggacgcggccacgtcgtacgccgagcgccgccggctgttcgacctgccgcgctcgtcgtgggcggactacgacgccggcctgatcagcgagggaggcggcgtctacccgcggagcgcgaagaagatcccggtcagcccgcaggtacgcgccgcgctggacctggccgggtcggtgaccgcgctcagcccggtggagctgatgcgggcgatcctcaaggcgccggtcgacctgctcttcaacggcggcatcggcacctacgtcaaggcggccggcgagtcgcacgccgaggtgggcgacaagggcaacgacgcgatccgggtgaacggttcggagctgcgggtcaaggtggtcggcgagggcggcaacctcgggctgacccagcgcgggcggatcgagttcgcgcgcgccggcggccgggtcttcaccgacttcatcgacaactcggccggggtcgactgctcggaccacgaggtcaacatcaagatcctgctcggtggagcggtgaccgacggcgagctcggcatgccggagcgcgacgagctgctggccgcgatgaccgacgaggtcggcgcgctggtcctgcgggacaactacgagcaggcgacggcgctggccaacgcgcgggcacaggcgcactcgctgctgccggtgcaccggcggatgctgatcgcgctggagcaccgcggtgagctcaaccgggagttggaggcgctgcccacggaccgcgagctggcgctccggtacgagaacggcgaggggctcagcgcacccgagttcgcggtgctgctcgcctacgtcaagatcagcctggaacgcgaggtgctcgccgacgagctggtcgacgaggcgtggaccaaccaggtgctgcaccggtacttcccgaccccgctgcgcgagcggtacgccgcgcggatggccggtcaccggctgcgccgcgagatcatctcgaccgccctggtcaacgaggtggtcaaccggggcggtacgtcgttcgtcttccgcgccatggaggagagcggggcgtcggccgccgacgtcatccgcgcctacgtggtgatccgggacgtgtacggtctcaccgagatctgggcggcggccgaggcgctggacaacaaggtgcccactcccgcgcagacgctggtcttcctggagacccggcgactgctcgaccgcgcggtccgctggctggtcagcacccgccgctcgccgatcgacgtggccggcgagatcgccaagctacgtcccggcgtggcgacgctgctgccccagctccccgaggtgatcgtgggggcggagcgccgctcgttcgaggagcgggtgacgacgctggccggcaagggcgtcccggacgacctggcggacaaggtgagccgggtcttctacggcttcgggctgctggacatcctggagacggcgaccgccatcgagcgggacgtgaccgaggtggcccaggtctacttcgtgctctcggagcgcttcggtgtcgacgcactgctgtcgcagatctcccgcctgccccggggtgaccggtggcagacgctggcccggatggcgttgcggtacgacctgtacgccgccctggccgcgctcacggccgaggtgctgcagtcgaccccggagaccgcctcgccggacgaccgggtctcggagtgggagcaggtcaacgcggcgtcgatcgcgcgggcgtcgaacgcgatgggtgacgtcggggagtccccggccgacctggcggcgctgtccgtgctgctccgtcagatccgcaccctggtgaagacctcgtcggcggcctga

SEQ ID NO: 3864 - DNA, 1179 bp, Actinoplanes utahensis
atggccgccacccgcctcccgggcaccccccggttgctgcgcgccctcaacgaccgcgcggcgctggacctgctgctcagccgaggtccactgacccgggcccagatcggcgagctgaccggcctcagcaaggtcaccgcctcccagctggtcgagcgtctggaggagcgtggcctggtccgccgggtcggcgagcaggccggcggccgcgggccgaacgcccagctgtacgcggtcaccccgagcagcgcgcacgtgatcggtgtcgacgtcggcccggactcggtgatcgccgcgtgcgccgacatcaccggcgcggtgatcggccgggccgagctgagcaccaaggacaccgacgacccggtcggcgtggtgcaccaggcggtggtccaggccgccgcggacgcgggcaccgacatcacctcggtgcgccgggtcgtgctcggcacccccggcctggtcgacccggccaccggcgagatctccttcgcctgggacctgccccgctggcatcgcggcctgctcgccgacctgcgtcgcgacctgagcaccccggtggtcttcggcaacgacgtgaacctggccgcgatcgccgagtccagcaacggtgccgcccgcggcgtgtccgacttcgccctggtctggatcggtcgcggggtcggtctggccagcgtcatcggcggccggttgcaccagggtgcgaccggcgccgccggcgagatcggctacctgccggtgggtggcgccgaggtgccgcacaacgcctccaagcgcggagtcaagggcgccttccagaccctggccgccgccgaggcggtcaaggcgatcggcaagcagcacggcttccggggcgccgaggccgccgacgtggtgcgcgccgcggtcgccgccggcccggccggtgaaccggttctggacgagctggcccgccggctcgccctcggtgtcgcggccacctgcctggtgctcgacccaccgctggtggtactggccggcgaggtgggccgggccggcgacgccgcgctggccgaccgggtggagcgcgaggtcgccgcgatcacgctggtctcgcccaaggtcgtggtgaccggggtggccgccgagccggtgctgcacggtgccctgcacaccgccctggacgcggtccgcgacgaggtgttcggatcgaccaccgactga

SEQ ID NO: 3865 - DNA, 939 bp, Actinoplanes utahensis
gtgccctgcacaccgccctggacgcggtccgcgacgaggtgttcggatcgaccaccgactgaccgggtgagccgcggcacgccgtcgccgggagcggtccgcgcacatggttggatggacggcgtgctggaggctgccgtaaccgttccgcccgacgaggacaccgtcatcgcgttcgaccgcgtcagcgtggtccgcggcgggagtcacctgatcaacagcctgtcctggcaggtggagctggacgagcgatgggtggtgctgggccccaacggcgccggtaagaccaccctgctcaacatcgcgtccggccggctgcacccgacccgcggccaggcctgggtgctcggcgacagactgggccgggtcgacgtcaacgagctgcgcacccgggtcgggatcaccaccggccggctcgccgaccggatcccgccggacgagaaggtgctcgacgtcgtggtcaccgccgcctggtcggtggtcggccgctggcgtgaggagtacgacccgcaggacgtcgcccgggccagggagctgctcgcccagctgggcatgggggcgctggccgaccgggagttcggcaccctctccgagggggagcgcaagcgcacccagatcgcccgcgcgctgatgaccgaccccgagctgatgctgctcgacgagcccaccgccggtctcgacctgggcggccgggagaccctgatcggtcacctgaccgagctggccctcgacccggacgcgccggccatggtgctggtcacccaccacgtcgaggagatcccgccgggcttcacccacgggctgctgctgcgcgagggcagtgtggtcgcggccggcccgctcggcgaggtgatgaccgcggaaaacctgaccaagacgttcggcctgccgctgctcgtcgaccgtttcggcgaccggtacaccgcccgggcggcctga

SEQ ID NO: 3866 - DNA, 894 bp, Actinoplanes utahensis
gtgccaccccgggtggtggtcgtcggcagcgccaacatggacctggtcggcctggccgcgaccctcccgcggcccggcgagacggtgctcggcgacgacttcgtgatgacccccggcggcaagggcgccaatcaggcgatcgccgcggcccgggccggcgccgccacgacgttcctgggcgcgatcggctccgacgcgttcggcgtgacgctcggcgcccggctggccgcgaccggggtcgacatggcccacgtgcgcacgagttacggcccgtccggcgtcgcggtgatcatggtggaccgggcgggggagaactcgatcctggtcagcccgggggccaaccggacgttcgtggacctgaccgaggcggagcgggcctgcatcgccggggccgacgtgctgctctgtcagcaggagatcccggccgggacggtggcggcggcactggccgcggcccgggccgccgggacgcggacgatcctgaacgcggcgcccgcgcgggagttgtggccctccgtgctggacctggttgatttgctggtggtcaacgagaccgaggcccgggccctcaccgacatcaccgattcctcggcgatgtccggcttgctggcgctggtgccgcgggtggtgctcacgctcagcggcaacggctcccgttacgccgaccgggacggcaccgacgtgcacgtgccggccttcccggtcgaggtcgccgacaccacggcggcgggcgacgcgttcaccggcgccctcgcggtcgcctgggcggagggccgcgctctggtcgaggcggtgcgctgggcgaacgccgccggcgcggcctgtgtgcgcaaggtcggcgccagcaacgccctgccggaacgggccgagatcgaagcgatcttcgccggctga

SEQ ID NO: 3867 - DNA, 462 bp, Actinoplanes utahensis
atgaccacgtactaccgggatccggacgtgctgatcacttcgtccgggatccatatgaacggccgcgacttccggctgcccgaggtgcgccggatctggcacaccagaggtgcccggtcctggtcggtgatcgcccggcgcggcgcgctcggcctggccatcctgtcgccgctggcggtcggcgccctggcggtcgtggtggcgctgctgctccacaccgatgcgctgcacaccgtcgcgatgctgatcggcggcgtgctggtcgggctggccgtggtgccggtcgccgacctgctgctggagcgggtcgaccggtcctacgacgcgggcagtcgcaccatcgagatctggggccgggtgcccgccggcgacgtgctgctgctgcgcaccacgaacgcgcagcggttcggccggatctaccgggccctgctgcgcgcgctggagccggcggtgccccggtga

SEQ ID NO: 3868 - DNA, 774 bp, Actinoplanes utahensis
gtgggcgagttcgtacggctggagatcgcggacggcatcggcaccatccggttcgatcggcccccgatgaacgcgctgaacacccaggtccaggaggagctgcgggcggccgccacggccgcggccggcgacgagtcggtgcgcgccgtcgtggtctggggcggggcgaaggtgttcgccgccggcgccgacatcaccgagttcaccacggtcacctaccagcacatggtgggccgggccgcggcgctgtccggggcgttcgacgcggtcgcccggatccccaagccggtggtcgccgcggtcaccgggttcgccctgggcggcggctgcgagctggccctggcctgtgactggcgggtggtggccgaggacgccaagctgggccagccggagatcaagctgggcatcatcccgggggccggcggcacccagcggctggcccggctgatcggcccggcccgggccaaggagctgatcttctccggccggatggtcgaggccgacgaggcgctgcggatcggcctcgccgaccgggtggtcccggccgagaaggtgtacgagacggcactcgacctggtccgcccgttcgtcaccgggccggccctggcgctgcgcgccgccaagcaggcgatcgacgccggcctgagcatggatctgccggcgggtctggcgctggagtcgcaattgttcgccgggttgttcgccaccgacgatcgggtggagggcaccaccgctttcgtcgagaagcgcaagcccaagttcaccggacagtag

SEQ ID NO: 3869 - DNA, 2022 bp, Actinoplanes utahensis
gtggcagcccgacccggatgccaccctcccgaccagcccgtcgccggcgatgcggcacacacccgtaccgcatcggcagtccgcgccgaaagcggcgccgcagacgaccgcttccggccgtgccgtggtcgccccgccgccggcgccgaagcagcggcccaagccgccgcagagggccaagccggcaccccggcaacagcagcagccgcaacgaccgaccgggtcgaagcggcgccgcagccggacgctgcgcttcttccagatcgtgctcagcgtgctgacgatgatctgcgtcccgctcgccgcgctgatcctgtccttcggctacggcaacgggaaaccgctgcagagggacgcggtcgaggtcttccaggacatcggcaccctgctgcacctgtaccaagaccagaaatgacgccggtcgagggccacggcggggagctcgcgctcgcggccctgcgggccttcggggtgaccgagatgttcaccctctccggcggtcacgtcttcccgctgtacgcggccgcccacgagtccggtttcgggctctacgacgtccgccacgagcagtccgcggtcttcgcggccgaggcggtggccaagctgacccgtcgcccgggtctggccgtgctgaccgccggcccgggggtgaccaacggcatctccgggttgaccagcgcctatgtcaacggctccccggtgctggtgctgggcggccgcgcgccggctttccgctggggttcgggcagcctgcaggagctggaccacgtgccgctggtcgcgccggtcacccggtatgccgcgacggtcaccggcaccgcggacatcccgggcgcgatcggggcggccctgaccgcggcgctcaccccgcaccgcggcccggtcttcctggacgtcccgctcgacgtgatcttctccaccggccgggccgcggcgcccggcgagccggcgatcggggtgctggagcccgacccggacgaggtggccacggccgcccggctgctgcgggacgcggcccgcccggtgatcgtggccggttccgacgtgtgggccggcgacgcggtcgccgagttgcggaccgccgccgaggcgctggacgtgccggtgttcaccaacgggatgggccggggcgccctgccgccggggcatcggctcgccttctcccgggcccggcggaccgctctgggccaggccgacgtggtcgcggtgatcggcaccccgctcgacttccggctgggattcggcgatttcgggtccgcacgggtggtgcacgtcgtggacgcgccggagcagcgcgcgacgcacgtcaccccggctgtctcgcccgccggggacctgcgccggattctcgccgcgctggccggtacgacgggcgggcaccccgagtggatcaccacgctgcgggccgtcgaggacgcggcgagggcccgcgacgccgaggcgatggccgccgagaccgatccgatccggccggcccgcgtctacggggagctgcgcagggtgctggccccggacgcggtcacgatcggcgacggcggcgacttcgtgtcgtacgccggccgattcctggagcccgcccggcccggcacctggctggacccggggccgtacggctgtctcggcaccggcctgggctatgcgatgggcgcccgggtcgcccatcccggccggcagatctgtgtgctgatgggcgacggcgccgccggtttctccctgatggacgcggagtccctggtccggcaggggttgccggcggtgatcgtggtcggcaacaacggcatgtggggtctggagaaacacccgatgcgtgcgctgtacggcttcgacgtggccgccgatctgcagccgggcctgcgctacgacgaggtggtgcgcgcgctgggcggcgccggcgagaccgtggccagggcgtccgagctcggcccggccctgcggcgcgcgttcgactcgggcgtcccctacctggtcaacgtcctcacggatccggccgacgcgtacccccggagtgcgaatctggcgtag

SEQ ID NO: 3870 - DNA, 522 bp, Actinoplanes utahensis
gtggatgccgaggaacgcgtacggcaggcatatgaggcctactaccgacggctggtcatccaggccacgggcctggtaggtgaccttgccgaggcggaggacgccgtgcacgaggccttcgcgcgggtgctggcctcgccgcagtccttcctgcgggccgacgacgccgagcggtggttgcgggtcgcggccctcaatgtcgcccggacccgctaccggcggcggtggctgttcgaccgcctggtccgttcgggccgtgtggcgatcgccccggccgcggtaccggggatatccagtgatcgggtggcgctgttcgccgcgttgcggcggctggcgacaccgacccgggaagcggtggtgctgcaccacctggccgatctgtcggtggcggaggtcgccgccaccctcaacgtgccggtgggcacggtcaaggcccggctggcccgagggagagccgcgctcgcccaccatcttgccgacgatgaattccacccactgcccgcggaggtaggccatgcgtga

SEQ ID NO: 3871 - DNA, 786 bp, Actinoplanes utahensis
atgcgtgaacccagcttcgacaagctgcgctccgatgtcggtgacgcggtgcgccagcccgacttcaccaccgtgcagcacagggccggccggatgggccggcgccggcacgcccggcgctgggcggtcaccggcgcagcggtgatcgcggtcaccggtgcggtcctggcgatgcccggcctgggcgatgaccgcaacggagccgcctacgcctcgtggaccgccagtccggagacgctgtccgccggggacgtccaggccatcagccggggctgtgtggcgaagatcgatccactcttcggctacaccacggcgcagctggccgccgcccgcaagatcgtctccgagcgccgcgggagatacggcttcctctcgatcgtcacccacgactgggtcaccacctgcttccgagacagcaccggcaccgtgcggagccccagcaacatggggcgaccggtcagtgacgaagcgctcggccgcacgggtatcgagctgcagggctggggtgagctgcaagccggcgaaggctacatcctgatcatggcggggcacctcggcaccgacgtcaccgcggtagacgtcaacgtgcccgacggcaggacggtacacgccaccgtcgacgaccactacttcctggcctggctgccccagaaggcaggcgacggcgccggcatcaccttcacgatgacactcaccgacggaacgaccatcaaggacatctcggcgaggaaactgacggataaaatggggaccggcgaactcgccgattcgtccggcccatcatga

SEQ ID NO: 3872 - DNA, 327 bp, Actinoplanes utahensis
atggtccggttgttcatcttcttgaccgcggtcgcgctggtcctgctgatcctggcactgatcgcctgcctgtcggcggagcgggtgcgtgtcctgccccggccgttctgggtgctggtggtggtgctcgtcccgctggccggcccgatcgcctacttcctgtggggccgcccggtgcggacggccgcccgccgccccgccccccggccgtccgcaccggacgacgacccggacttcctgcgcgcgatggactccgagcagtcccgccgcgaccgtgaactgctcgcccagtgggagcgcgagctgcaccaggacgacgaaccttag

SEQ ID NO: 3873 - DNA, 300 bp, Actinoplanes utahensis
atgagcgatccgggcgccgccgcgcaacgcacccgtctggcctggcggcgcaccgggatgtcggcggccgcggtcgcactgctcgccgtccgccccgccttccacccggcggccgggccggcgcaatggctgatcgcgggcgccgcgatgaccggctgggccacgctgaccggtctgggtctgcaccgctcccccgccctgcgggcccgcccgccgcggtcgccggcccggacgatccgggcgtacgcgctgatcaccgcggcgttcgcggtcctcggcgggctggttgtcatgctctga

SEQ ID NO: 3874 - DNA, 450 bp, Actinoplanes utahensis
gtgacgaagtacgcaatctgtggcatcaccttcttgaccgatccggtcaataatcggcgggtgttcggtggcctgctgcagtggttcgacccggagagcgcccactcggagggcaccacgccggattaccggttctcgctggccaacgaacggaccttcctggcctggatccgcaccggcctggcgctgatcgccggcggcctggcctgcgcccagttcctgccgccgctgccgatcgtccggctccgcgagatcatcgcgatcgcgctgctgatcctcggcggggtggtcgccctgcgtgccgttgatcactgggcgcgcgccgagcgggccatgcggctcggtgtcgacctgccccgctcccggttcccggcgatcctcgcgatcgtcgtggcgctcggcgcggtgctgctggtcagcatggtcctctatcggattttcgcagcatga

SEQ ID NO: 3875 - DNA, 777 bp, Actinoplanes utahensis
atgaacatcgtcgtactggtgaagcaggtgcccgactccggtgccgagcgcaccctgagcgcgagcgacaacacggtcgagcggggcccggggaacgtcatcaacgagatggacgagtacgccatcgaggaggcgctgaagatcaaggaggcgcacggtggtgaggtgaccgtcctcacggtcggccccgcgggtgcgaccgactcgatccgcaaggccctctcgatgggcccggacaaggccgtccacgtgcaggacgacgccctgcacggctcctgcgcggtggccacctccaaggtgatcgccgccgccctcggtcagctgaacgccgacctgatcctctgtggcgccgagtccaccgacggccgggtccaggtcctgccgcacatgctcgccgagcgcctcggcgtggccgccctcaccggcgcccgcaagctcaccgtcgacggctcgcagctcaccatcgagcggcagaccgacgagggctacgaggtggtcaccgccgcgacgccggccgtggtcagcgtctgggacaccatcaacgagccgcggtacccgtccttcaagggcatcatggccgccaagaagaagccgctgcagagcctctccctggccgacctgggtgtgtccgccgacgaggtcggcttcgccggcgccaccagccaggtgctggagttcgccaagcgcccggcccgctccggcggcgccaaggtcatcgacgagggcaccggcggcgagcagctcgtcgcgtacctcgccaccgagaagttcgtctga

SEQ ID NO: 3876 - DNA, 933 bp, Actinoplanes utahensis
atggctgaagtactcgttgtcgtcgaggccggcgtcaagaaggtcaccctcgagatgctcaccatcgcccgcgggctgggcgaggtctccgcggtggtgttcggcgaggccgaccaggccaagctcgccgagttcggcgccgccaagatctacaccgcgtccggcgaggacgtggagaaccacggcgcggcccccaaggccaccgcgatcgccgagctggtcaagcgcgtgcagccggccgccgtgctgctcggctccacccaggagggcaaggagatcgccggtcgcctggcggtcaagctggacaacggcctgctgaccgacgcggtcgagctggccgccgacggcaccgccacccaggtggtcttcgccggctccacgatcgtcaagtccaaggtcacccgcggtatcccgatcgtgacgatccgtccgaactcgaccactccggtcgccgcccccgcgtcgccgtcggccgaggcgctcgcggtcaccgtcagcgactcggacaagctggccaccatcacccagcgggtcgccgagcagaagggttcgcgccccgagctcaccgaggccggcatcgtcgtctccggcggccgcggcgtcggcaacgccgacaacttcaagctggtcgaggagctcgccgacctgctcggcggcgccgtcggcgcgtcccgcgcggccgtcgactccggctactacccgcaccagttccaggtcggtcagaccggcaagacggtgtcgccgcagctctacgtggcgctgggcatctccggggcgatccagcaccgggccggcatgcagacctcgaagacgatcgtcgcggtcaacaaggacccggaggcgccgatcttcgagctcgccgacttcggcgtggtcggcgacctgttcaagatcatcccgcaggcggcggacgagatccgcaagcgcaagtaa

SEQ ID NO: 3877 - DNA, 1176 bp, Actinoplanes utahensis
atggcctacctcgatcatgcggcgaccacgccgatgctgcccgcagcgctggacgcctatgcggccgcggcccgggcgatcggcaacccgtcctccctgcacgcggccggtcgcagcgcccgccggatggtcgaggagtcccgcgagcggatcgccgcggtgatcggcgcccggccctccgaggtgatcttcaccggtggcgggaccgaggcggacaacctggccaccaagggcgtctactgggcgcggcgcgacgctgacggcaaacgccgccgggtggtcgcctcgtcggtcgagcaccacgccgtgctcgacgcggtcgactggctgggccggcacgagggcgccacggtcagcctgctgcccgtcgacggcgccgggcgggtcgatccggacggtttcgccgacctggtgcgcgcgcacggcgacgagatcgccgtggtcagcgtgcagtgggcgaacaacgaggtgggcaccgtgcaaccggtgcccgccctggccgcgatcgcggccggcgccggcatcccgttccacaccgacgcggtgcaggcggtcggccaggtgccggtcgacttcgcggccgccggcgtggccgcgctcaccctcaccgggcacaaactcggcggtccggtcggcgtcggcgccctggtcctgggccgggacgtgagctgcacgccgctgctgcacggtggcggacaggaacgcgacgtgcgctccgggaccctggacacacccggcgtggtggcgttcgccgtggccgtcgagaccaccgtccgggaacgcctcgactatgccgagcgcgtcgccgccctgcgcgacgaactggtccggcgggtgctggccgcggtgccggacgcgatctacaacggtgacccggaccaccggctgcccggcaacgcgcacttctccttccccggctgcgagggcgacgcgctgctgctgctcctcgacgcgcaggggatctactgctcgaccgggtcggcgtgctcggccggggtggcgcagcccagtcacgtgctgctggcgatgggcgcggacgacgcccgggcccggtcgtcgctgcgcttctcgctcgggcacgacagcggcgaggcggatctggacgcgctgctcgcggcgctgccggcggcggtggagcgggcacgacgggcggggtcctggaagacgccccgttag

SEQ ID NO: 3878 - DNA, 1113 bp, Actinoplanes utahensis
atgcgagttcttgcggccatgtccggcggtgtcgactccgcggtcgcggcggcccgggccaaggatgccgggcatgacgtgaccggggtgcatctggctctggcgcgtaacccacagacctatcggaccggcgcgcgcggttgctgcacgctggaggattcgcgggacgcgcggcgcgccgccgatgtgatcgggatcccgttctacgtctgggacatggccgacgagttccacgccggcgtcgtcgacgacttcgtcgaggagtacgcggcgggccgcacgccgaacccgtgcctgcgctgcaacgagaagatcaagttcgcggcggtgctggaccgggcggtggcgctcggcttcgacgccgtggtgaccgggcatcacgcccggctcggggcggacgggctgctgcggcgcagtgtcgacctgcccaaggaccagtcgtacgtgctggccgtgctgacccgcgagcagctggatcgggcgattttcccgctcggtgactccacgaaggagcaggtgcgggccgaggcggccgcgcgggggctggcggtggcggacaagccggactcgcacgacatctgcttcatcgccgacggtgacacccggggcttcctggagcggcgcctgggcgccgcgcccggggacatcgtggacggtcggaccggggcgaagctgggcacgcacaacggggcgtacgggttcacgatcggccagcggaaagggctggacctgcgggttccggccccggatgggcagccccggtatgtgctttcgatcacgcccgtgtcgaacaccgtgacggtgggccctcgggaggacctcgaggtggacacggtcacggccacgcgtccgatctggcacgacggttccgacgaaacggagtgcgaggtgcagctccgggcgcacggggaggtggtggccgccacggtcgcggtggattcctcgggattcgtcgcgacgttgcggacgccggctcgcggggttgccgcggggcaggcgatcgtggcctaccggccggatgccgcgggggacatcgtgctgggatcggcgaccatcacggccgcgacgcggtcatccgctgcgacgaccctgccggagtccgcgcatgcctga

SEQ ID NO: 3879 - DNA, 996 bp, Actinoplanes utahensis
atgcctgatcttccatggcccgccggtgccgcgaccgggatcggatccctgcccggcacggacgtcgccgaggcgcagcggatcgtcctcggtgagctgcccgccctgccgcacctgcccgagcttcccgagcgtggcccgggcgccgacatgatcgggcgcggcgccgggttcctcgtcgagctgccggtgcagctctacgccgggcgctggcagatcgccgcgcggccgggccgggacctgcggcgtaccgccgatctgctggaacgcgatctggaccagctcaccgagcaggccgacggcttcaccggcgccgtcaagatccaggcggccggcccgtggaccctcgcagcgagcgtcgacctgccgatcggcggccggctgctgcgcgacccgggcgcggtccgggacctcaccgactcgctcgccgaggggctccggcggcacgtcgccgacgtccgcaagcgggtgcccggcgccaccgtgctgctgcagctcgacgagccgtcgctgccgtccgtgctggccgggcgggtgccgaccgagagcgggctcggcgcctaccgggcggtcgacggcccggacgccgcggcccggctgcggaccgtggtggcggcggtggacacccccaccgtgctgcactgctgcgcgccggacgtgccgtggcaggtgatccgggacgcgtcgttcgcggcggccgccttcgatctgtcgctgctcaaggatctggacccggtcggcgaggcgatcgaggccgggctgggcctgctggtgggcgccgcgccgacccgcccggtggccgagcggcgaccggacgccaagcagatcgccgagcgggtgcagaccctgtggcgccggctcggcttcccggccgcccggctgccccggcaggtggtgatcacgccggcctgtgggctcgccggtgcgccccagccgtacgtccgggccctgctcaaagcctgtcacgaagcgggccggcggatctccgaggtgtga

SEQ ID NO: 3880 - DNA, 2442 bp, Actinoplanes utahensis
gtgaccacacccagcgcagagcccacggcggtggccgccgcccggcacgccgagctcgccgacgagatccgcgaccatcagtatcggtattacgtgctcgacgccccgatcatctccgacggccggttcgacacgctcctgcgcgagctggaggcgctggagaccgagttccccgcgctgcgcacccccgaatcgccgacccagctcgtcggcggctcgttctccagcgacttcgccccggtgcggcacgccgagcggatgatgtcgctggacaacgtgttcagtttcgacgagctgagcacctgggccgagcgcaccgtgcgggacgccggtggcccggtggcgttcctctgtgagctcaaggtcgacggcctggcgatcaacctgacgtatgagaagggcaggctggtccgcggcgccacccggggcgacggccgcaccggcgacgacgtgacccccaacgtgcgcaccatccgcgagatcccggagcggctggccggcgacgatgtgcccgacctgctcgaggtgcgcggcgagatctactttccggccgaggcgttcgccgatctgaacgcgtcgctggtcgagcagggcaaggccccgttcgccaacccgcgcaacgccgccgccggcagcctccggcagaaggacccgcgggtcaccgcctcccgcggcctgcgcatggtggtgcacggcatcggcgcgcgcgagggtttccaccccacctcgcagtcgcatgcctacgaggcactccgggcgtgggggctgcccaccagcagccggtggaaactcgtcgacgacatgcccgccgtccgagagttcatcgagtattacggcgagcaccggcacgacgtcgagcacgagatcgacggtgtcgtggtcaaggtcgactcggtggcgatccagggccggctcggctccaccagccgggcgccgcgctgggcgatcgccttcaagtatccgcccgaggaggtcaccaccaggctcctcgacatcgcggtcaacgtcgggcgcaccggccgggtcaccccgttcgcggtgctggagccggtgctggtggccgggtccacggtcgcccaggccaccctgcacaacgcgcaggaggtggcccgcaagggcgtgctgatcggcgacaccgtggtgctgcgcaaggccggcgacgtgatccccgaggtgctcggcccggtgatcgacctgcgcccggatgacgcccgggcgttcgtgatgcccaccgagtgcccgtcctgcggcaccaccctggccccggccaaggagaacgacgtcgacatccgctgccccaacagcgagtcctgcccggcccagctgctgggccggctggccaccctggcgagccgcgaggtgctcgacatcgaggtgctcggcgagaagtccgcggccgccctgctcgagtccggcgtcctgcacaacgagggcgacctgttcgacctgaccgaggacgacctgctgcgggtgccgttcttcgtcaacaagaacggcaagctcggtacgaatgccggcaagatgctgcagagcctggccgaggcgaagggccggccgttcgcgcgctatctgatcgccctgtcgatccggcacgtgggaccgacggcggccaccgcgctggctcgggaatacgggtcgatggatcggctggaggaggtgctcgcccagaccgcggcgcagccggccgcggtcgcggccagcgctgaggccgcctccctcgcccaggccgcttccgccgttgaggccgcttccgccgctgaggccgcttccaccgccgaggccgccggcacctccgcctcggtcgccggatccgctgcctcttccgggtcggtctcctccgatgcgtccggctccggtgcggcttccccggggaccgcggacccggccaggggaagcgacggggcggattccgcggaccctaccggggagggcgacggggcggattccgcggacccgaccggagagggtgacggggtggattccgcgggggccgccgtcgagcaggcgaagcggaaggccaaggcgatcgatccactcgccgccgtcgacggggtcgggccgatcatcgcggacagtctgcgcgagtggttcaccgtgccgtggcatcgggagatcgtccgcaagtggcgcgaggccggcgtgacgatggtcgacgagcgggtcgaggccggtccgcgcacgctggaggggctgaccgtggtggtcaccgggacgctggccggcttcacccgggatcaggcggccgaggcggtcacctcccgcggcggcaaggtcagtggctcggtgtcgaagaagaccggcttcgtggtcgtcggggagaacccgggcggcaaacacgacaaggccgtcagcctgaaggtgccggtgctcgacgaggccggcttcgaggtgctgctgaaggacggtccggaggccgcgcgggaggttgccgagctgggctga

SEQ ID NO: 3881 - DNA, 2154 bp, Actinoplanes utahensis
atgccatggagtgaattgcggctttggttgcttctgcggattccgttacgggtaagacgttggcggcatttgcgcgatttagatctatggtgtgagcgatcggtgatcgaggccaatcgtggaggtcgcatggatgccgttcgtccccgtacggccgcctccgggccgcgtcggcggcgcgcgctgctcgtcaccgtgggttcgaccgcgggcgcggagctgagtctctggggggccgcgcccgggatgttccgcgggctgccggccgtctactggatcatggcggggctggcggtggccgccgacctgcggccgcacccgctgcccggccggcgggtcagccgggtcgtgctgccgtccatctgcttcaccttcgccatcgtgctggcctggggtctgctgccggcgctcgccgtgcaactggtcgcggtgaccgtggccggcgcccggatgcgccagccggtcccgcgcacggtccacctcgccctgcagcacgtcgccggcctgggcgcggcggccctggtcatcgcactgaccggcgggcggatcagcccgagccccggtccgcgcgacgtggcgctcacctgtgccgcggcgggcgcctggatcgccgcccgatacgccgtggcgtccctggtgcgccggtggaccgcggaacggcgtacccgcaatcgccgccgggccccggcggacctgatggcgacggcggccctgcttctgctgtccccggtgctgctcgtcgccgcgcgggtcagcccggccctgctgccgctcgccctggtggcgctgcacgccgtgcaccggatggtccgctgggccggcgagtcggagcgggccacccgggtcgacccgctgaccggcctgccgaaccgccgcgccctgcagtcgaccatgtccgagcgcggcccggaccggcagcgcgcgctgatcctgctcgacctggaccggttccgcaccgtcaacgacgcgctcgggcacggtgccggcgaccggctgctggcccgggtcgccgaccggctgaccgccgccgtgccccggcacgacctggtggtccggctcggcggcgacgagttcgcggtgctcgccacccgggtcgagggcgccgcctcggcccgccggatcgccgagcatctcaccgaggcgctgagccggccgttcccgatggacggcaccccggtcgagctgaccgcctcgatcgggatcgcgctgcagtccggccgccgcgacggcgccaccctgctgcgcgaggcggagaccgcgatgtacgaggccaagcagcgtggtgaccaggtggcggtgcacggcccggacgcgccgcacgcctccccggaacggctggccctgctcgccgacctgcgtgacgcgctgcggcacgacccgcccgccgacgggatagtcctctactaccagccgcagatcgccatcgcgaccggcgaggtggtcggcgtcgaggcgctgctgcgctggcgacacccgcggcgcggcctggtcggtccggacgagctgctccgggtggccgagccgaccccggtgatgcgcctgctcaccgcccgggtgctggacgaggtgatcgcccagctggcgcggtggcgctcggaggggatgccgctgcgggccgcggtcaacgtgagcgcccgggacctgcacgccggggaggtcgccgaccgggtcggccggctgctgcgcgaccacgaggtcccggccgacctgctgcagctggagatcaccgagagcgcgctgatgaccgacccgcaccgggtgctggacacgatcacccggctggaccggatgggtgtggcgatctccctggacgacttcggcaccggctactcctcgctgcagcacctgcgtcggctgccgctggccgaggtgaagatcgaccggtcgttcgtgctcggcatggccaccgatccgggtgacgcggcgatcgtgcgctcggtgatcgggttggccgactcgctggggctgcgcgcggtcgccgagggggtcgaggacgaggccacctggctgctgctcgcggcggccggctgccatgccgcgcagggctggttccacgcccgtccgatgcccgccgacgagttggtcgagtggttgtcgcggtaccggccgattcgccccggggttcggcgcgggccgtggatcccggcgaaatag

SEQ ID NO: 3882 - DNA, 300 bp, Actinoplanes utahensis
atggccgccatctcccgcgaagaggtagcgcacctggcgcgcctgtcgcggctcgccgtgaccgaagaggagctggatcgattcgcgggtcagctcgacgtgatcctgcagtcggtcgcccgggtcggtgaggtggccgcggaggacatcccgccgacctcgcactcggtgccgctgaccaacgtgtaccgcgacgacgttccccagccgagcctcgaccaggacgccgccctctccggcgcgcccgacgcgtacgagggccggttccgggtgccgcgcatcctggacgaggaggactga

SEQ ID NO: 3883 - DNA, 1464 bp, Actinoplanes utahensis
gtgaccgacctgaccaagctgagcgcggcctcgctgagcgggctgatcgcggcacgcgaggtgtcggctgtcgaggtcgccaccgcgcacctggaccggatcgcggccgtcgacgatcgggtgcacgcgttcctgcacgtcgaccgggagggcgcgctggccgccgcccagcgggtcgacgacggcgagatcaccggtccgctggccggcgtgccgatcgcggtgaaggacgtggtgaccaccaagggcatcccgaccacggccgcgtcgaagatcctggagggctggaaaccgccgtacgacgcgacgatcgtcgagcgtctgaaagcggccggcatgccgatcctcggcaagaccaacatggacgagttcgcgatgggctcgtcgaccgagtacagcgcgtacggcccgaccaacaacccgtgggacctgggccgcatcccgggcggctcgggcggtggctcggcggcggcgctcgcggcgtacgaggcgccgctggcgatcggcaccgacaccggtggctcgatccgccagccgggtgcggtgaccggcacggtcggcgcgaagcccacctacggcggcacgtcccgctacggcctgatcgccttctcgtcatcgctggacacccccggcccctgcgggcgtaccgtcgaggacaccgcgctgctgcacgccgcgatcgccggccacgacccgcgcgactccacctcgatcgcccagccggtgccggacgtggtcgccgccgcccgccgtggcctgcagggtgacctgaccggggtgaagctcggcatcgtcaaggagttcgccggcgacggctccgagccgggcgtcctggccgccttcaaggagtcgctggaggccctggtcaagctcggcgccgagatcgtcgaggtgtcctgcccgcacttccagtacgcgctcccggcgtactacctgatcgcgcccagcgagtgctcgtcgaacctggcccgtttcgacggtgtccgttacggcctgcggtccggcgacgacggcagccgctccctggaggaggtcatgtcgctgacccgcgaggccggtttcggccccgaggtcaagcgccggatcatcatcggcacgtacgcgctgtccagcggctactacgacgcctactacggccaggcgcagaaggtccgcaccctgatcacccgcgacttcgaggccgcgttcgagcaggtcgacgtgctggtctcgccgaccaccccgttcgtcgcgttcccgttcggctcgcgcacctcggacccgtaccagatgtacctggccgacctgttcaccatcccgaccaacctgtacggcggcccggccatctcggtcccgtgcggcctgtccgagggtctcccggtcggcttccagatcatggccccgaccatggccgacgaccgcatgtaccgggtcgccggcgccctggagtccgccatcggcaccttcaccccgccgaccctctga

SEQ ID NO: 3884 - DNA, 1527 bp, Actinoplanes utahensis
atgacgtcccgtcgtcgggtttgcgagcggccgttcatcggttccaccgcgaatattcctcacgataacctgcgcggcatgcatcgatatctcgccgtcgtggcgctcggcgcgacggtcctgtgcgccggctgcacggacaaggccgcaccacccgccgtcgccaccgcgtcgcagcccgccgccgcccccgcgatcgactacaccgcctggcagggcgggaagtcggtcacggtcgccgaccggctgtaccccgagcacggcaatgccggcctggacgtcctgcactacgacctgaaactcgactggcagcccacgagcaaggtgctgaccgggacggcgaccctgcagatccgcccggtcaccgcggcgagtgagatcagtctcgacttcgccaacctggccgtcgacaaggtcaccgtcgacggacggccggccaccggcacgctcgccaaggacaagctgaccgtccccgccaccctgaccgccgaacagccggtgaccctggtcgtcgactaccacggcacaccgagacaggtcgcctacccgtcccaccgcggcgacgccgccgagggcgtcggcctgcgcccgaccaggagcggcggcctgtggaccatgcaggaaccgtggggcgcgatgacctggtacccggccaacgagctggtctccgacaaggcgctgtacgacatcgcggtgaccgtgccgcagggctgggcggccgccgcgagcggcacccccggcccggtcgagggcaccacgtaccactacagctcggcggcgccgaccgccgcgtacctgaccacgctcgccgtcgaccggttccgcaagacgtcgcagaccggcgcgcacggcctgaagttcacctactggacggtggcgaagaccgacgacagactgctcaccgagctgaagaagtcgccgcaactggtcagctggctcgaggcacaactcggcccgtacccgttcgacaccgccggcgcggtgctcagcgactcggtctcggccatggagacccagcagatgctcagcatcggccgtcaggccaccggccagaagttcgacccggcgtacttcgacgagatcctcgtccacgagtacgcccaccagtggttcggcgacgcggtcaccccgtccgactggaccgacctgtggctcaacgagggcttcgcccagtacatgcagtacctgtacgagcagaaggtctacaagctcaccgacgcccagctggagaccttcctccgccagcaggacgcccggctgcgcaaatcggtgggcccgcccggcaagccgaaagccgccaacttcgccgagagcaacgtctaccggtgcaccgcggcgatgctcaagcagctcaacgacgccctgggcgacaagaagttcttcgacctgatgaaggcgtgggtcgccgagcacaaggggacgaaccaggaccgggccgcgttcaccgccttcgtccgggagaagaccggcacggactacagcaagctgatcgacagctggctcgattccccgtccaccccgaagtag

SEQ ID NO: 3885 - DNA, 1500 bp, Actinoplanes utahensis
atgaccacgatcgcgctgccgtcctacgacgacgccctcagccgttacgagccggtcatcggcctggagacgcacgtcgagctgggcacccagacgaagatgttctgcggctgccggaccgagttcggcgccgagccgaacacccaggtctgcccggtctgcctggccctgcccggcgccctgccggtgatgaaccgggcggccatcgaggccacgatccggatcggtctcgcgctgaactgctcgatcgcgtcgtggtgccggatggcccggaagaactacttctatcccgacatgccgaagaacttccagacctcgcagtacgacgagccgctctgcgtcgacggatacgtggacgtcacggtcgacggcaaggagtaccgggtcgagatcgagcgggtgcacatcgaggaggacaccggcaagacgctgcacgtcggcggcgccaccggtcgcatccacggcgccaccgagtcgctggtcgactacaaccgggccggcatcccgctcgtcgagatcgtcaccaagccggtccccggcctcggcgcgctcgccccggagatcgccaaggcgtacgtcgccgagctgcgcgacatcgtccgctcgctgggcgtctccgacgtgcggatggagcagggctcgatgcgctgcgacgtcaacacctcgctgaacaggccgggcgaggagtggggcacccggaccgagaccaagaacgtgaactcgctgcggtcggtcgagcgggccgtccgctccgagatcatccggcaggccggtctgctcgacgagggcgtccggatcttccaggagacccggcacttccaggagacgaccggcgacacccggcccggccgctccaaggagaccgcgaccgactaccgctacttccccgagcccgacctggttccgatcgcgcccgacccggcgtgggtcgaggagctcaaggcgtccctcccggagaagccgagcgtcaagcgggcccgcctccgcgaggactgggggatgaccgagatcgacatgcagtcggcggtcaacgccggcgcgatcgagctgatcgaggagaccatcgcggccggcgcctccccggccggtgcccgcaagtggtggctgggtgagctggcccgccgctccaacgagctgggcgtcgagctggcgcaggtcggcgccaccccggcacaggttgctgagctgcagaaactcgtcgacgacgggaagctcaacgacaagctggcccgccaggtgctggagggcgtggtcggtggtgagggttcgccggcgcaggtgatggccgcccgcggcctcgaggtggtctccgacaccggcgcgctgcaggccgcggttgacgaggcgatcgccgcgaacccggacatcgcggacaagatccgggacggcaaggtcgccgccgccggtgcgctggtcggcgcggtcatgaagaccacgcgaggccaggccgacgccaagaccgtccgcgacctcatcctttcccggctcggcgtctcctga

SEQ ID NO: 3886 - DNA, 1641 bp, Actinoplanes utahensis
atgagtgagcccacgccctcctggcgccgacgcctgcgttcgaccgccgactccaccgtccgggtgtggcggcaccgctggttccgcggcgcccggatcagcgccgcggtcggcctggtcagcatcaccgccgcgatgatcggggtgatgctgttcgcgcacaccggcatcaacgtcggaccgttccgcgccgagatgtcgctgagcccgtccctggccggcggcaccgaggtggacatcccgccgctcggctcgctgcacctggacagccaccgcggcgccctgcacctcaaggtggcgctcggctcgctggaccagagccgcaccgaggcgctgatcgacaatccggcggcgatcagttcggccggggaccgggcggtcgaggaggtcaccaccggcgtcacccggctggccctgcgcgccatcgggctggccgtgctgggcgcgatcctggccgccgccctgatcttccgcagtgtccggcgcaccgcggcggccggcgtgaccgcgctggtggtcggcgccggcagtttcggcgtggccgccgccaccctgcggcccgacgcgatcagcgagccgcggtacgagggactgctggtgaacgccccggccgtggtcggtgacgcgcgacggatcgccgacaactacgggcggtacgccgagcagttgcagcagatcgtcagcaacgtcagccggatctacaccacggtgtcggcgctgccggtgtacgagccggccggcaacaccacccgcatcctgcacgtctccgacctgcacctgaacccgtcgtcgtggggcctgatccgcaccgtggtgcagaccttcgacatcgacgcggtgatcgacaccggggacatggtcgactggggcagcagcgccgagacgtcgtacgtgtcgagcatcccgtcgctgaacgtgccgtatctctacgtgcgcggcaaccacgactcggtggcgatccagtccgcggtcgcccgccagcgcaacgcggtcgtgctggacgacaagctcaccacggtcgacgggctgaccgtcgccggcatcggggatccgcagttcaccccggacaagagcgagacgaacaaggccggtgacacctccggttcggagattctcaccgcggccggcgaccggctcgccaagaccatccgcgactccggcaaaaaggtcgacatcgccctgatccacgacccggagatggctccgccgctggccggtgtcgtgccgttggtgctggccgggcaccggcaccagcgttcggtggccatgctgccggcctggaagccgccggccccggacccgtccgcctcggcggccccctcccccaccccgtcggtgtcggcggccgccgcgccgccgccgatcgcgacccggctgatggtcgagggttccaccggcggcgccggcctgcgcggtctggagggcgaggagcccaccccgctctccctgtcggtcctctacttcgacgagaaccacaatctgaaggcgtacgacgacatccggctgggcggcaccggcgaatcgaacgtcgagatgcagcgcaacgtggtcggcctggacaaggagcagccggctgtcactccggccacctcggtgccgtcaggggcgggacgcagcccggcggtcacgccgagccgctga

SEQ ID NO: 3887 - DNA, 1161 bp, Actinoplanes utahensis
gtgcgttcccgccgggcccgtgccgcgatcgcgacactcgccgtcgtgctggccctgacctcggggtgcagcttcggcccgcccggcccggatgaggccggcagcgcgcccaacctgcccggcccctcggtcgccgccacctccagcgccgacccgggtgagcccgacgtggtggccaccgtgctggccaagggtctggacgtgccgtggggcatcgccttcctgcccgacgggtcggccctggtcaccgagcgcgacaccggccgcatcctgaaggtgggccccgggtcggacgccgacggtctcaaggtcgccgaggcggcccggctgcccgaggtgcgcgcctccggcgacggtggcctgctcggcatcgcgatctccccgaaatacgcgtccgacaagacggttttcgtctactactccaccgccaccgacaaccggatcggccggctggttctcggcaaaccgctggagccgatcctgaccggcatcccccgctcggcccagcagaacggcggcgcgctcgccttcgggccggacggtttcctctatgccggcaccggcgacggcaccaccaccggcacccaggcgcccgatccgaagagtctgggcggcaagatcctgcggctgacccgggacggcaagccggccccgggcaacccggtgaaggattcgccggtctggagctccgggcaccgcaacgtgcagggcatcacctgggacaagacgaaacggatgttcgccaccgacagcacccagccgaaattcggcgagctcaacatcgtggagaagggcagcaactacggttggccgaaagccgacggtaaggcgggcgacagcaagctcaccgatccgctggccgcctggccgagcgccgagtcgtcgtgcggcggcgtggcggcgatggagagcctggtcgccaccgcctgtctgctcggcaagcggatctacctgctcaacgtgaccgccaacggcaccgtgctgggcaccccgcaacagctgctcaccgacaagtacggccggctgcgggcgctggtcgccgcgccggacggctcgctctgggtgagcacctccaaccaggaggacgccggcgagcccgatccggaggacgaccgcctgatccggctcgtcttctcggacggcggcgccggccggagctga

SEQ ID NO: 3888 - DNA, 750 bp, Actinoplanes utahensis
gtgttgctcggccgggccggcgcgaggggcgacacagccacgacaggtcctctgcgttcgtgccgggggaacggctcccgacatgcggggcggaacaagaggtcgttgcacccgaacaacgaggattcgccggaacgggttacgggtggcctcatcccggatcgtcgaccatggacggacggcggtcaatcgggccggtggacgactccggcgcccgaccctgtggatgacggtgcgggccgggggccggagggccggaaaacccgggtggggctcgtcgaacgcgagtgggacaatggccgggtgagccgacgtcccgccctccgcgtccgtaaatccggcaccgccctggtcgccgccgggatcgcggtggtcagcgcggtgccgctggccggcacctcctgggcgctcgcgccgctgctgctgatcccgctgaccgcgctggtctgggcgtggcgctcgggcaccgacgtcttcccggacgaggtgctcgtccgggccctgttcggcggcacccgggtgccctggagccggatcaccgggctggcacccgaccagcgcggccgggtgtcggccctgctcgacaacgggaacgtgatccggctgaccggcgtgacccgggacaacgtctcgctggtgctggacgcggccggcaagtccgcgaccggcaccgacgagccggccgacgagcccgcgaccggcaccgacgagccggtcgacgcggcggaccccgccgaagtggaccggtga

SEQ ID NO: 3889 - DNA, 693 bp, Actinoplanes utahensis
gtggctgtgtcgcccctcgcgccggcccggccgagcaacaccggccgggcggccctgttggccgtctgctcggcggccgcgctggtgctgctcaccggcgttttcggcctgttgcccggcccgctcaccctggccgtgggcgtgggcgtcgccggcctgtgcgcgtccgcctacctggtgcacgccgctctcgacatccaccacgccgacggcaccttcgtggcctgccgcggcgccggcttcgtcggaatgggcgcactggccaccgccctcacggcgctgatcccctggtggtcgccgccgcacgcggtgctctggctgaccgccgggctgggcgtggccgccggctgctacgtgctgggcgccgcgctgctgcccaacgcggcccgcacctggccgatccggctccggcgcggcttcgacggcctgggcctcggcgtcagcctgggatacgcggcctatctgatcccgcccgacggacagacccgcccggccgcccttccggcgctgctgatcaccgcgggcggcgtgtcgatcgtcacggtcgtggtgctgcgcgctcggccccgcccggtcccgacggtctggtgcggctgcggggcggccgtggtgctggccgcgctcgccgccctcgccgaggtgctggcgctcggcctgaccgggccggccgtgccgctgctcgggctggcctag

SEQ ID NO: 3890 - DNA, 1812 bp, Actinoplanes utahensis
gtggtcggggtggccgccgcgctctggcacctggtcaccacccggcacttcgacgccggggggatcgtcttcggcatggtgatggtcagcgtgctggtcctgcgcgagctgctggtggtccgcgacatccggcggtacgcgggccggctgcggatcgccgaggcgcacttccggtcgctggtggccggggccaccgacctcaccctggtgctcgacgaccggctcacggtccggtggcagtcaccggccgcggcccggctgttcgggctgcacgacaacgaggtggtcggccgggcgttcggcgacctgattcatccggaggacgccggcgacgcgctcgcggtgatcgggtcggtgctcgccggtgagcacgagggcgggccgccggtgctggtcagcgcccgcctgcgggacggctcgcagctctggcgggacaccgagtccacgatctccgaccagcgcgcggtgcccgaggtggccgccctggtggtgcacgtgcgtgacgtcggcgagcgccggcacctggagcgcaccctgcaccggatggcctacctcgaccagctcaccggcctggcgaaccggcgtgccctgatgcgcgacctgctggccgcccgccgccggccgggtggtcccggcaccctgctggtgatcgacctgcacgggctggccgaggtgaacgacacgcacggccgggcggtcggcgacgcggtgctgaccgaggtggcccgccggctgcgcgcgctgtccggcggcgaggacgtgccggcccggctggccggcgacgagttcgcggtgctcaccccggagtccgccgtcccggcctatgcgctggccacccgcctggtgtcggccctcgccgagccgtgccagctgcccggggcgcaggtgcggctgcacaccagcgtcggcctggccgagctggccggcgccgccggcccggaggaggtgctgcgccaggccgacctggcccggcagcgcgccgcccagctgggccgggacgccgtcgagtggtacgacccggacgtcgagctgcacctgcagcgccggatggagctggaacgccagctgcccggcgccgccgcccggggcgagctggacctggtcttccagccggtgagcgacctgcgcgacggccacccggccggggtggaggcgctgctgcgctggcggcatccggcgctgggcacgatccggcccgaggagttcctgccgatcgccgcggggctggggatcaccgacacgctgaacgagtgggccctcaacgacgcctgccgccacctgcggaactggaccggtggtgacgacgacttctgggtgtcggtcaacgtcggtccgcgggagctgctcaccgcccgcttcccggagcaggtgcggaccaccctgcggcggcacgcggtgaccccggaacgcctggtcgtcgaggtcgcgcagacctggatcgcggaggacgtgccggccgtggtggcggcgctcgccggactgcgccggctcggggtccgcgcggcgctggacgacttcggctccagccagacgtccctgacccacctgcgccggctgccggtcgacatggtgaaactgagcgccgagctggccggtgcggaggccgggaaaccggtgctcgacgtggtggtgggactggccaagcggatcggtctcgacctggtggccaagggcctggagacaccggagcagatcgagcgcgtcctggccgcgggctgccggtacggccagggcacggcgctggtgcccccggccccggccgagcggatcgaggcctacctggagacgcaccgcgccgaccgcggcagctga

SEQ ID NO: 3891 - DNA, 1020 bp, Actinoplanes utahensis
gtgaaacggcccaccatcgccgacatcgcccggcgggccggcgtgtccaagggcgccgtgtcctacgcgctgaacggccagcccggcgtgtccgaggcgacccgcaagcggatcctggccatcgcccaggagatcggcttcaacgccaacagcgccgcccgagccctctccggcgcccgcgcccgagccgtcggtctgaccctgtgccggcccgcccggatcctcggcatcgagccctggttcatgggcctgatcagcggcttcgaggccgagctcggcgcccagtcgtacgcgttgaccctgcaggtggtcgccacccccgagcaggaggtggaggtctatcgccgctggtggggcgagcgccggatcgacggcgtgatcgtcaccgacctccgggagaacgacgtccgcatcccggtcctgcagcagctgcagctgcccgcggtggtgatcggcggctccggcgagcccggcggcgtcacccagatctggtccgacgacggcggcgcgatcaccgaggcggtccgctacctggtggcgctcggccacacccggatcgcccgggtcagcggggtgcccgacctgctgcacacccaggtccgcacgaaggcgttcaacgaggtctgcgccgccctgggcctcggcgacgcggtcaccgtcccggccgactacaccggcgaggagggcagccgtgccacccgccggctgctgatcggcggcggccgccccaccgcgatcatctacgacaacgacgtgatggcggtcgccggcctggccgtcgcacaggagatgggcctctccgtccccggcgacctgtccatcgtcgcctgggacgactccccgctgtgcagcctggtccaccccccgctgaccgccctgagccgggacgtctccggctacggcgcccaggccgcccgcgagctcctgaccgccatcgacggcagacgggtcggcaacgtcaaagcccagaccgcgcacctcaccccccgcggcagcaccgccccaccccgccccgcctga

SEQ ID NO: 3892 - DNA, 2475 bp, Actinoplanes utahensis
atgagtgccaccggcggcgcgccgccgctcagccatcgccagatcctgcaggtgctctccggcctgatgctcggcatgttcctggccgcgctggaccagaccatcgtcgcgtcggcgatccggaccatcggcgacgacctgcacgggctcagcctgcaggcgtgggtgaccaccgcgtacctgatcaccgcgacgatcagcaccccgctgtacggcaagctctccgacatctacggccggaagcggttcttcgtcaccgccatcacgatcttcgtggtcgggtccgcggcctgctcgttcgccacctcgatgtaccagctcgcggtcttccgcgcggtgcagggcctgggcgccggcggcctgttctcgctggccctggcgatcatcggggacctggtcccgccccgcgaacgcgcccgctaccagggctacttcctcgccgtgttcggcgcgtccagcgtgctcggcccggtgatcggcggcttcttcgccggcgccgacgagatcctcggcctgtccggctggcgctgggtgttcctggtcaacgtgccgatcggcgcggtcgccctggtcgtggtcgccaaggtgctccacctgcggcacacccgccgcgaccaccgcatcgactggtggggtgcggtcgcgctgtgcgtctgcctggtgcccctgctgaccgctgccgaacagggccggacctggggctggacggggagccgcacggtgctctgctacgccgtcggcgcggccggactggtcgcgttcctggtcgccgaggcccggatgggcgccgaggcgctgatcccgctgcggttcttccggaaccggacgttcgccctcacctcgttcgccgggttcgtgaccgggatggggatgttcggcgggctcgccctgctcccgctctacctgcagatcgtgcacggcgcctcgcccacccgctccgggctgcaactgctgccgctgaccgccgggatcatggccggctcgctgatctccggtcgggcgatcagcgccaccgggcggtaccgggtctggccgatgctgggcgccccgctgatgatcggtgggatgggattgatgcactcactcgcggtggacaccccgtactggcgaaccggggtcttcatggggttgttcggtctcggcctgggtttcgtgctgcagccggtcacactggccgtgcagaatgcgatgccgccacaggacatgggggtggcgaccgcgtcggcgaccttcttccggcagatgggggcgaccgccgggaccgcggtcttcctcagcctgctcttctcccgggtgggcgaccggatccgggacgcgctgcgggtggccggggcggatccggcgttccagaagctgatggcggacccggcgaaccggcgggtgctcggcggctcgctcgacgacacctcgttcctgcggcacgtcgacccggtactggcgcggccgttcgagagcgggttcgccgccacgatcgccgacatctgcctggtggcgggtggggtgctgacggtggcgctgatcctgttcgcgttcctgccccaggtgccgctgcgcggctccgcgccggccggccccgccgagctctccccgtcctcgggctcggccaccgacctctccccgtccccgggatcggccaccgccagccccgcgtcctcccgatcgccccactccccctccccgcccgcccggtcggtcgacgcgctctcgctcagtggcgtggtgaccggccttgaccagcggccgctgaccggggcgcggctcaccctggccgacctcgccgggggccaggcggcccgggcggtgaccggaccggacggccggtacctgctcaccccggaggtggccggggcgtacctgctgatctgcgccgccgaccggcatcaaccggcggcgatccggctcaccgtgaccggagccgacgcccgcgacgtccgcctggcggccggcgggcggatcgagggcgacgtcgtcgatcagcacgaccggccggtggcggcggccacggtcaccctcaccgacgccgcgggcgcggtggtcgccagcgcgatcaccggcccggacggcggatacgtgctcgccggcctgtacccggccgagtacacgctgaccgggatcgcgcccggcgcccgcccggccgcccgcaccgtggtcctggacaccggtggggtcagccgcgccgacctgctgctggccggcaacggcacgctgaccggacaggtccgcgcggccgcctccgggcacccggtcccggaagcctcggtgatggcggtcgacgaggccggcgccgtggtcgccaccacctggaccgacgccgacggccggtacgccttcgccgacctggtgcccggcgcctacacggtgaccgcgagcggttacccgccggtggccgaccgggtggagttgatcggcgagctgaccgcccacgacatcatgctcggcgggccccgagagggatcccgattgatctccccctga

SEQ ID NO: 3893 - DNA, 2130 bp, Actinoplanes utahensis
atgaaatcccatctcgcccgatggtcgctggccgcgggggtgactctcgcggtgatcgcgccgctcgcggggagcgccgccgccaccgtgatcgccccgccgaccccgagggacggccggctcacccaggtcggcccgatcgccgagcacggcttcccggcctggtaccgggacagcaccggcgcccggctggagccctgcaccaccctcgacgacccgctctgtgccgtgctgccgaccgaggtccccaacgcggacctgccggtctcctacccggacaacttcccgggcgagttcttctaccagctcgccgacgcgaccctgacgctcaccgacgggaccaaggccaccatcggcctgaacgtcgagggcgcctgggccaacaacgcggtgatcccgggcgaccagatggtcttcggccgggtccggatccgcttcgcggcggcggccggccgccggttccggatcacccatccgtacggcatcgacgacctgaccgcggacgacaagggcgtccggatgaccgaggacgccggcgccatccccggcgcgttcggcagcgtgctcaacggccgggtcggcccgttcctcaagtgggacccggcggtcgcgccggccgccccgatcggctacatcggcgacccgggcgtcacccatccggtggtgggcagcccgtacggcaccaacttcgtccggatcgaggagctcgacccgcagtccggcgcggtgctcggccaggtcggcttcaccgaccagttcaccgtgcagggccggtacgccaccaacgcgggcgtcgacgtcgaccaggccaccttcaccagtggcccggacggctccggcgcggtcgaggtgtacgccaccagcgagcccggtcaggcgatcgagatcgccgcgaacccggcgctcggcatccgcggcacccggctgcgcggctccggcaacggtcgttactacggccgcttcgcggtggccgggccgctgccggccggtgcctcggtggagatcgtcaacgcctcggaccggccggtcgcccgcaagacccgcagactggtcgacgtcgtgcagatcaccgaggcgaggtacgacgccgacgcgcagaccctgaccgtggccgccaccagcagcgaccgggacgcccagccaggcgtgctgagcgtggccgggtacggcccgatcaccggccagccgttcaccggcgtgctggcggcgcccgccacggtcaccgtcaactcgtccagcggcggcgcggcgaccgcctcgctgctcggctcgggcgcggggttcggcccggcccgtccggtggccggggccaccacggacgcctcgccggtcgccggccaggtcgtgaaactcgacggcaccggctcgaccggggagatcgacgcgtacagctggacccagaccgcgggcccggcggtcaccctgaccggttcggcgaccgccaccgcgtcgttcgtcgcggcgacgcccggcacctacaccttctcgctgaccgtgtccgggccgggcgggcagagcctgcccaccgccgtcacggtgaccgtggtcccggccgccaagccggtggcggtggccggcgccgaccagacggtgctgcgcggcaaggtggtcgcgctggacggcagcgcgtcgaccggggccgagtcgtacagctggaagcagatctccgggccggcggtgaccctggccggggcgtcgtcggcgaagccgaccttcaccttcccggcgcaggcgctgcccgccgcgcccgggccgaacgccggtttcgtcttcgacaacgacccggtggtgctggagctcaccgcgaccaacccgaacgggacggccaccagccggatcaccgtccggccgcaggccgagacgttcccgggcggggtcaccgcgcggtaccggaccggcaacaacgagtggcggatcaccggcaccagcagcctgatcgcgggtcagcggatcaccgcggtgctcggtgacacgctcaccggccgggtgatcggcacctcgccggtcgacgcggcgggtgcgtacagcatccgggtcaccgggccggcgcccggcgcggtccggacgatcagcgtggtcaccacggtcggcggccgccagctggcggtcgcggtgaccatcaccaactga

SEQ ID NO: 3894 - DNA, 1857 bp, Actinoplanes utahensis
ttggccttactgaggtccgtttctcaactccggcccgcttcgggcgatcaccacaacgtgtggctacaggtcagcgtgctgggacaactcaccgtcgtcgacggtgacggcggcgtcctgcccgccggcgagctgccccgccgcgcccgccaggtgctcgccgtgctggccgcccggcacgaccggatccagtccaaggacgccctggccgacgcggtgtggggcgaggacctgccgggcaaccacgccggcgcgctggagcactacgtctcggtgatccgccgccggctgcagccgcagggcgggccggccagctggttcatcgtcacccgttccggcggctacctgttcgacaccgcgcgggccgggctcgacctggccgacctgcggcacctggtccgccggctggactcgctcggacccgacgacctggccgtgcaccagcagatcctggagctggcccggcacctgccgttccccgaggacccgtacgccgactgggccgagccggtgcgcgccgaggtctcggtcgccgcggtcaacgcgctgctccggctggccgccgcggcgctcgccgaggacgccccgcggtcgctgcggctggcccacgaggcgatcgagctgaacccgttcctggagtccggctaccacgccgcgatgaccgccgcggtggcgatgggccgcccggacgacgcgctgcgcatcttcgagcgctgccgccaggtactcaacagcgagctcggggtggccccgtccgccgagctcgccatgatcaagcagtcggtgctggccggccgcgaaacggccccggttccggctccgcccgcggccaccacgcccgtgccggcctcggttccgccggtcgccccgacgccacccccggttccgccggtcgccccgacgccgcagccggcgccgccggtcgcccggccaccgcagccggcgctccgggagcggttcctgggccggctcaccgagatccggctgatggtcgagccgggcaccccgccggtggtgcacttcgtcgggccgagcggctccggcaagtcggcgttcctggccgaactgggccggcacacccccgggcggatcggcatcggcgacgccggcccggccgtcggcgtgctccgcctgtcctggctgcgcagcgcgctgaccgcgctggacgcggcgcccgaggcgatcggggcggtcgaccgggcccggcccgaccagccgctgtgccaggccgacctggagctgatcgggcagaccttcgaccggccggagaccgtctacctggccgtcgacgacgcccgggatctggacgcggccagcgtcgccgagctcgcctggctcagcgggcactgcccgggcctgcggatcgtgctgacctacgactacccgtcccagctgtccgggcgcccgctggccgggctgggcacgccggtggtgatgcggctcagcccgctcaccccggcagagctggagccgctcggcgatccggcggtgccggccctgaccggtggcatcccggccctggtggcggtggcccggcggccggccgaggtggccggcgcggtggccatgcaggtggcccggcggcgcaccgagtggatgccgccgctggcctgggagctgctgcgggtctgcgcggtgctcggcgacctgggcgcggccgaactggccgggctcaccgggcagccggtcaccgaggtgctgggctgcgtcgacgcgctggtgcacgcgcatctgctgcgcgagtgcccggacggcaaggtcggccacgccgcctcgctgatccgcgacgcggtggccgcccaggtgtccgcggccaccgccatctacctgcgcaaacagcaggcggcggcctcctga

SEQ ID NO: 3895 - DNA, 1674 bp, Actinoplanes utahensis
atgggccgcgggaatctgagtcggcgcgacgtgctcaagggcgcgctcgcgctcggtggcggtggactgatcgtgatgaccgccggcggtgaggtggtggcggcgtcgagtcagctcgccgccaagaacatgccgaccccgttcacgaacatgttccgccgcccgccggtgctgatgccggccgaggagggcgtggacgacatgggcccgtaccagaagtaccggctcacccagaagctcggccgggccagcatcgtgcccggtctgaccaccacgatcgccggttacaacgggatcttccccggccccaccatgcgggtccggcagggcacccggaccgaggtccggatctgcaacgcgctctccgacgtgaacaagctcaacggacggccgttcagcacggtcacccacatgcacggctccgcctccctgccgcagtacgacggttacgccaacgatcagacgaaacccggtcaggtgaagacctacaagtacccgaactggcagcagggccggaccctctggtaccacgaccacaaccacggggacaccgcgcagaacgtgtactccggcctggccgcccagtatcacctgaaagacccgtacgagacggcgcagttgccgcaggacgagttcgacgtgccgctgatcgtcagcgacgtggcgttcaacgcggacggctcggtcgccttcgtgccggagggcaactccggcttcatgggcgacatcatcatggtcaacggggtgccgtggccgaagatgaaggtcaagccccgggtgtaccggttccgggtgttggccgccaccatctcccggtcgttccggttcgcgctgagcaccggcgacccgttctacatcgtaggcaacgacgccggcatgacgcccaaggtgaacgcggtgcagtcctggcggcagggcggggccgagcggtacgaggtgctgatcgacttccggaagtacaagccgggcaccaaggtcgacctgcagaacctgagcaacaagaacaacgtcgacttcgccaacaccggcaaggtgatgcagttcgaggtggtcgcggacagtgggccggccgacacgtacaagatcccctcgactctcgacctcggtccgcagcccttcgcgaaccgcggggcgatcgaggtcaacaagctgaagccggagatggccaccgcgcggcgccggctgcgggtggagcgcaagcagggcgagtggaccgtcaacggggagacctgggcggacgtcgaggcctccaacttcacccggatcctgggcaaccccaagccgtacgacgtggagatctgggacctggtcaacgagtcgggcggctggtaccactcgttccacatccacctgatcgacgcccagatcatcgggcgcaacaccaccgccgacggtaaggcgcatccctgggagggtggcggcaaggacgtcttctacctgggcgagaacgagacggtcaccgcgctgatgcagttcacgacgggggacggcaacgccggtggccggtacatgacgcactgtcacaacctggtgcacgaggacagtgacatgatgatccagttcgcggtcggtgacctggagacgaacaacccgatcatgatggatccgccgcggccggagaccgaggccgagatgcccgcggtctacgctccgagctacccgctgggcacctga

SEQ ID NO: 3896 - DNA, 768 bp, Actinoplanes utahensis
atggtcgccaagctccgcggaccggcgctcagcctgctgctggtgctcgccgcgttcacggtcgcggcctggtcgggcggctggttcgccacccggccgcccgggtcgccggccgcggccgcggtgatcagcgacgacgccggcgacgagatcgccaccaccaccttcgacgggccgatggtgcgcaagcgggcggcgctcgccgtgcacccggccaagggcgccgaccgggcgcacatcgcggccgaactccggacggcggcgacggccgcggggatcggtgagctgaccgacgcgacgttcgccgtgttcagcgccgacctgctgcgatatctggtgccggaggtgaccctggtgctgcccgaggggatcacggtgcagcgggccgaggcgttcatgcgggaccaccagccggacgacgtggcgttctacgtcgcgcagacggtgctggtgcacgacgtgaccttcgcggtggtgaccggcggggtggcgccggccgaggcgcagcggcgggaggacgccgagggcatcctcagcgactcgctgaaccactacgtgaccaccgtgcagccggccgggctgaccgtgcgctacttcggggcgctgctcagcgacggtcagatcggggcggtgcgcacggcgatggcccgggcggccgggacgacggcggatcgggtgagtgtggcggccagcgagccgggggccggcgtggacctgtccggcggcctgcccgacctcgacgcacaggcggagcatcacggacattaa

SEQ ID NO: 3897 - DNA, 5235 bp, Actinoplanes utahensis
ttgctgaagccgaagctccgttccgtcggcgtcgcgctggcggtgctggtcgccgtgatcatcacggcgccggccgccgccgtggccgccccgatcggccaggggttcaccgtgaccccggccgacctggcctacatcctgcagcaaatcaagatcgctgaggcgcacgtggccggcaccaccagcgcgaccggaccgtgcggcgcgctggcgatcggcccgctgcagccgttcggcctgcgcacggtcgacggctcgtgcaaccacctcggcaaaggtcaggagctcttcggcgcggccgaccgcagctttccgcgactcgtcccggcccagctgcgccccggctacaccggccggaacgcgaccgacgccgccccgcggcagatcagcaacctgatcgccgaccagagccgggcgaatccggcggcggtcgcggcggcccacggcggcgacccggcggccggcatcccgaacgtcaccccggacgccggcctgtccgcgccgtacaactcctggttcaccctcttcgggcagttcttcgaccacggcgtcgaccagacggtcaagggcggcggcgcggtgatcatcccgctcgccgccgacgacccgctggtgatcagcgagaaactgccgcccggcctgcggttcatgatcctctcccgggccgccggggccggcgacgccaagaacaccgacacgccgtacgtcgacaactcgcagacctactcgtcgcacgccgcccaccaggtcttcttgcgcgagtacgacgagcgcgcccaggacaccggccggctgctcagcggtgccgccggtggcctgcccacctgggacgacgtgcggcgccaggcccgcgacgtgctcggcctgcagctgagcgacacggacgtgctgaacgtgccggcggtgctggccgacgcgtacggcgacttcgtccccgggccggcccgcggcctgccgcaatacgtgaccgccagcggactggtcgagggggacaccgcggccccggtcgccgtgccggcgaacgtgctgcatttcgacacgcccttcctggccgacatcgcgcacgccgccgacccgtcccagccgggctacgacccggccctgctcggccggcactacgtggccggggacggccgggtcaacgagaacatcgggctgaccgcgatccaccagatcttccagtccgagcacaaccgcctggtcggcgacatccagcgggtcgccgccgaggccgggaccggcgccgagtggaccggtgagcggctcttccagggcgcccggttcatcaacgagatggaataccagcacctggtcttcgaggagttcgcccgcaagatccagccggcgatcgacccgttcgccggctaccaggagcagatcgacccggcgatcaccgcggaattcgcgcacgccgtctaccgcttcggccactcgatgctgaccgagaccatcgcccgcaccaccgcggacggcggcgacgactcgatcccgctgctcgacggcttcctcaacccggacgcgttcaccgaccacgggacgctcagcccggaacaggccgtcggcgagctggtcgacgggatggccgcgcagaccggtaacgagatcgacgagttcgtcaccgacacgctgcgcaacaagctgctcgggctgcccagcgacctggccgcgatcaacatcgcccggggccggtccgaagccatgccgtcgctcaacgccttccggcgcggcgtgcggctcaccccgtacgtcaactgggccgacttcggcgaacacctgcgacaccccgcgtcgctggtcaacttcatcgccgcgtacggcaacgacccgtcgatccgggcggcggacaccgtccccgcgaagcgggcggccgcccaggcgttgctgaactcgccggacttcctctacgccccggccgccaccaccggcgtcgacgacatcgacctgtggatcggcgggctcgccgaagccgccgtcccgttcggcggactgctcggcagcaccttcaaccacgtgttcgaacggcagctgaccgccctgcagaacggcgaccgcctctactacctggcccggaccgccgggatgaacctgcgcacccagctcgaaggcaacaccttcgccgagctgatcatgcggaacagcaccgtccgggggctgcgggcggacaccttcgccaccaccgactgcacctacgacctgacccggctcaccttcgccggcagccgcgtcctcgacgacccggcctccgcctgcgacgaatccgcccagctgctgcgcctgccggacggcaccgtcacgcagcgcgcgaaatccaaggcccagtccctctggctcggcggcgaggacaccgaccgggtcggcggcggcatcgacgacgacaccgtgtggggcgccgagggcgacgacgttctcgacggcggcagcggcaacgacgtgctgatcggcggcgagggcgacgacatcctcaccgacccggccggcaacgacatgccccgcggcggccccggcgacgacgccatcgacgccggccccggcaccgacgtggtgctcggcggcgacggccacgacttcaccgacggcggcgccaacggtgacgagaccttcgccggtgaaggcgacgacctgatctacgccggcgacggcgccgacaccgcgcagggcgacgccggcgacgactggatcgaaggcggtgactccgccgacacgctgcacggcgacagcgccaacccgttccccctcgacgacgccaaccgggccggcaacgacgtgctgctcggcgagggtggcgacgacgactacgacatggagggcggcgacgacatcggcgtccagggacccggcgtcgaccgctaccggggcggcaccggatacgactggtccgtcgccgacccggccgacccccagccgatcgacgccgacctgctgcgcaacctggccgaaccggtcaccgccgacacccaggaccgctaccgcgaggtcgaagcgctctccggcggcgccggcaacgacgtcctccgcggcgacgacgtggtgccgacgcagtcgccactgctcggctgcgacgcgctggacgccgccggaatcgcccggatccccggactcgaccggatcgtgccggcgccgctcaccccgcagtcggtggtcaccaaccgcaccgggcagccctgtcacctgcagggcaacgtctggggagcgggcaacatcctgctcggcggccccggcgacgacacgctgcaggggcgcggcggcgacgacgtcatcgacggcgaccgctacctcacggtccggctcgtggtccgcgacgccgacgggcacgagatccgctcggcgcactcgatgcgcgacctcgaagccgacgtcctcaccggcaccatcaaggtcaaggacatcgccttcgtccgcgagatcgcgacggcgcccggcgtcgacacggccgtgtacagcggcgaccgggccgcctacgcgatcacgccggtgaccggcggcctgcaggtgtccgggccggacggcaccgacctggtccgcaacgtcgaacggctgcagttcggcgaccagaccgtggacgtgaccgggctccaggcgtacctcggagtgtcggcgttcgccggggcgggggcggcaaccgtgctgatcaccgtgccggagggggcgtcggtgaacgggctgactctggagcggacgtccagcgagggggtggtgcggacgtcgttggcggcttccgcccgcagtgtggtggtggccgggttgacggcgggggtggcttacacgttccgggtgcgggcggagagcgctgcggggagtggcgcgttcagtgcgccgtcggatccggtgacgccggatgccgcgtccgcggacccgtcgggggcgggtgctccggggaccggtggtcctacgaccgctcctggcacggctgttcctacgatcgcggtgccgacgaccgctcctggggtcggtactcccactgtcgccgttcccacggttgccgttcctacgattgccgctcctacggtcgcgcctccggcgccgacgaatcccgcgcggccggtgatcccggtggctccggacgctccgcggatcggcctggcgaccgccggcgacgagagtgcgaccgtccaatggacaaagccggtcaatgatggcggaagcccgatttacgggtatgaagttcaagccctcgatgaccagaccggcatcgtcgtgggcgtggacgccgccgacgccaacgccacctccctcaccatgaccggcctcaccaacggccagccctacgctttctgggtccgcgccgtgaacgccgccggagccagcgacttctccgccatctccaaccgcgtgatccccggtcccgccggcggtgccggcgccccgtcgggcggttcgtccggcggtgcgggttcctcgggcggtgccggttcgtccggcggtgccggttcgtccggcggtgcgggttcgtcgggcggctcgggctcggcgggtggttccgccggcggatcctccggtggctcttccggtggctcttccggcgggtcgtcgggtggcggcacgcccggtggttccggaacgacgcctccgtcgaccggtcccggcacgccggccggcccggccgacccgtcgacgaccgagcgcaccgttcccggagctgcccggatcggcaccccggtcgccggcaacgcgctggccgtggttcgctggaccgccccggtcagcaacggcggctcgccgatcctgcgctacgagatccgtgtcctggactccaggaatcggcaggtcggaacgctccgggacgctgacgccaccgccgccgcccagacagtgaagtccctggtgaacggcacttcgtaccacttccgggtccgagccgtgaacgaactcggcgccggcccgtggtccggatcgagcggcgcggtcgtcccgcggaccaccccgcccgccccgcgctcactgaccgccacacccggaaaggcgggtggcgccggcaccaccgtcctgcgctggacgccgccgtcctccacggggggtgccccgatcaccgggtaccgcctcaccgtccagcgtctgaccggcaaggggaagcccaccggcgcctcggtgacgttcgccttctccggctccgtcaggtcggcgacgttcaccgcccctggcggtgtcccggccggaacccggtaccgcttcaccctgcgcgcggtgaacaccgccggccagggtcaggcccgctcggtcctcggttcggtccgctga

SEQ ID NO: 3898 - DNA, 1848 bp, Actinoplanes utahensis
atgcctgagctgcgctcccggacctcgacccacggtcggacgatggccggtgcccgcgccctgtggcgcgccaccggcatgaccgacgacgacttcggcaagccgatcgtcgccatcgccaacagctacacccagttcgtacccgggcatgtgcacctcaaggacctcggcggcctggtcgccgagtcgatcgccgcggccggcggcgtcggccgcgagttcaacacgatcgcggtcgacgacggcatcgcgatgggtcacggcggcatgctctactcgctgcccagccgcgagctgatcgccgacgcggtggagtacatggtgaacgcgcactgcgccgacgccctggtctgcatctcgaactgcgacaagatcacccccggcatgctgatcgccgcgctgcggctcaacatccccacggtgttcgtctccggtggcccgatggaggccggcaagacggtcgccatcgagggcatcgtccacgagaagctggacctggtcgacgcgatgagcgccgccgccaacgacaacgtcaccgacgcccagctggacaccatcgagcggtcggcctgcccgacctgcggctcttgctccggcatgttcaccgccaactcgatgaactgcctgaccgaggcgatcggcctgtccctgcccggcaacggctccacgctggccacgcacgcctcacgcaaggcgctgttcaccgaggccggccggctgatcgtgcagatcgccaaggagtactacgagaaggacgacgcgtcggtgctgccccgctcgatcgccagccgggacgcgttcgagaacgcggtcgcgctggacgtggcgatgggcggctccaccaacacggtgctgcacctgctggccgccgcccgggaggcggagatcgacttcagcgtcgcggacatcgacgcgatctcccgtcgggtgccctgcctgtcgaaggtcgcaccgaacagcccgaaataccacatggaggacgtgcaccgggccggtggcatccccgcgctgctcggcgagctgcaccgcggcggctccctgaagacgaacgtccgcgccgtgcacgctccgtccctggacgcctggctcaccgactgggacatccgcggcgggtcgcccacccccgaggcgctggagctgttccacgccgcccccggcggggtgcgcaccaccgagccgttcagcaccaccaaccgctgggccaccctggacaccgacgcggccgcgggctgcatccggtccgtcgaacacgcgtacaccgtcgacggcggcctcgccatcctcttcggcaacctcgccccggacggctgcgtcgtcaagaccgccggcgtcgacgagtccatctggaaattcaccggcccggcccgggtctacgaatcccaggacgacgcggtcaccggcatcctcggcaaggaggtcgtcgccggcgacgtcgtgatcatccgctacgagggtccgcgtggcggtcccggcatgcaggagatgctgtacccgacgtccttcctcaagggccgcggcctcggcaaggcgtgcgcgctgatcaccgacggccgcttctccggcggcacctccggcctgtccatcggccacgtctccccggaagcggccggcggcggactgatcgcactggtccagaccggcgacgagatcacgatcgacatcccggggcggagcatcaccctgaacgtcgacgacgagacgctggcgcagcggcggcaccaggaggaacggcggcccaagccgtactcgccggtcgaccgtcagcggccggtttcggcggcgctgcgcgcctacgcatcgatggcgaccagcgcgagcgacggcgcttaccggcgggttccggaatag

SEQ ID NO: 3899 - DNA, 2388 bp, Actinoplanes utahensis
atgaagatccggcagagtggcagcgtgcactcaccgtccggtatggagctggcgggcctcgcgggcctgctggccgccgtcccggcggtcgccctgctcgggcgctccggccgccgccacaccggggacgcccgccgggcccacctgctgctcgccggcggtggcgcgctgatcaccgcggccgccctggccgggatggccaccgcgctgctcaccgagcaccaccacggcctggccagccggacgctggccacgctgatggcgatcggcatgggatgcggcacgctgaccctgctggccggcacggtggcgctgcccggcgcggcccgcggcccggccgccgcgctgcggcacgtgctggacgggctggtgatcgcggccgcggtctggttcgtcggctgggtgctgatcgtccgcccgacccacctgctgggcgccgccacgccctacgagtgcgtcgcggtgatcctgccggccgggctggcggtggccggcctgggcctgaccggggtgctggccctgcacgcgcaccggccgcggcggcacagcgtgtgggtgggcgccggggtgagcctgaccgccgcggcctcggccggggtgtccagcggtgtctgccggcggggtgacgagctggtgctgagctcggtgctgctgctcagcgccgggctgttcctgatcgccggcgcggtgcgggccgccgaccggccggtgcgggtgaccggcgacgtgctggagcgcggcggggcgtacgcggtggttccgatgatcggcgtggtcggcgcgctcggctatcacctgacgcgcggcgggacgctcgacgcgtacggctatttcggcctcagcgtggagggcctggccctggtcgcacggcagttcctggccctggacgacgtccggcgctacacggtccagctgcgccagcgggagaagcacttccgcgacctggcgcacaccgatccgctgaccggcctggcgaaccggcgcggcctgcagctggcgctccgggagggcgaccggtgcagagccctgatcggcatcgacatggacggcttcaagacggtcaacgacctgcgcgggcacgacgtcggtgacgcggtgctggccgaggtcggcgcccggctcaagcgcaacctgctgaccggtgacgtggcggcccggctgggcggcgacgagttcgcggtgctgatgcgcgccgagccggaggaggcggtgctggccgcgcaccggctgctggccgtgctgggcgagccctacgaggtggacggcggtcagatcttcctgtccgcgagcgtcggcgtggccagcaccggtgagctgctgcacgacgccgacctggcgctgcgctacgccaagcagcgcggcaagaaccgggtcgagcagtaccaggcggggtacgacgagctgctgcgccggcgcggcacgctgaccggcgagctgcgccacgcgatcgaccgcgatcagctgcggctggtcttccaaccggtggtggcgttgccgtcgatgcgcccggtgggcgccgaggcgctgctccgctggacgcacccggagctgggaccggtccgcccggacgagttcatcccggtggccgaggagtccgggttgatcaaccggatcggcgcctgggtgctggagaacgcctgccggcagctcgccgactggctggccgccgggcacgacatctggatgtcggtgaacctgtcgcccaaggaactgcacaacgccgactacgccgggcaggtcgccgagatcctggccgacctgggtgtcccgccgcagcggctggtgctggaggtgaccgagcacgcggtcgccaccgacatggaggagctggtccgccggctggccgagctgcgcgcgaccggggtgcggatcgcgctggacgacttcggtgccggctattcgtcgctcacccagctgcgcaccctgccggtggacatcctgaagatcgaccacgcgctggtggccgagccggagtcgcggaccggcacggcggcgccgctggtcgacgtggtggtccggctggggcaccggctggggctggaggtgctggccgaggggatcggcacgccggcccagcgcgaggtggtggaggaggccggctgccggctcggccagggctcgctgttcggctggggggtgccggccgagcacttcgagtcgcggctgcgcaccatgcggccgagcggtccgcggccactgccggcgccgcgttccggcccgccgaagaatgcggcggcgcgcagccaggtggtccgcctcggcccgggaatgcggcagctcagagcgttgctgccgaccgatccggagttcgcggcgcgggtcgccgatcaactcgatgatcaaaatgtgggatcagttgactcaggccgtgagatggggcaaggttag

SEQ ID NO: 3900 - DNA, 1830 bp, Actinoplanes utahensis
atgacgagacccacgcccgagtccctcgcccaccgagccacgccggccaccgtcgcggcggccgtgaacaccgccccggcctcgaccgctccggtagcgaccacgggcgccggcgcgctcgtccggtcgctcgaggcgctcggcgtcgaggtcgcgttcggcattccgggcggggcgatcctgccggcctacgacccgctgttcgactcgaaggtccggcacatcctggtccggcacgagcagggcgcgggccacgcggcgaccggttacgcgcaggccaccggcaaggtcggggtgtgcatcgcgaccagcggcccgggtgcgacgaacctggtcaccccgatcgccgacgcgtacatggactcggtcccgatcgtcgcgatcaccggccaggtggcccgcccgtcgatcggcaccgacgccttccaggaggcggacatccagggcatcacgctgccgatcaccaagcacaacttcctcgtgcagaccgccgaggagctgccccggatcgtggccgaggcgttccacctggcggccaccggccgacccggcccggtcctggtcgacatccccaaggacgtgctgcagcagcagaccacgttcacctggccgccgaccctggacctgcccggttaccggccgaccctgcacccgcacggcaagcagatccgtgaggcggcccggctgatcgcccaggccaagcgcccggtgctctatgtcggcggcggcgtgctcaaggccggcgccaccgacgggctgcgcaagctggccgagctgaccggcatgccggtggtcaccacgctgatggcgctcggcgcgttccccgactcgcacccgcagcacctgggcatgcccggcatgcacggtacggtgcctgcggtctacgccctgcagaaggcggacctgctggtcaccctgggcgcccggttcgacgaccgggtgaccggcaagctggactcgttcgcgccggacgccaaggtggtgcacgccgacatcgacccggccgagatcggcaagaaccggcacgccgacgtcccgatcgtcggcgacgcccggcacgtgatcgacgagctgatcgccgcggtgtcggccaccgccggcggcgtcgagcagtacccggcctggtgggccacgctcaacgacatccgcgagcggtacccgctgggttacgacgagccgaccgacggcaccctcgccccgcagtacgtgatcgagcggatcggcgcgctggtcggccccgacgcgatctactgcgccggcgtcggccagcaccagatgtgggcgtctcagttcatccggtacgagaagccgggcacctggctcaactcgggcggcgccggcaccatgggctacgcggtgccggccgcgatgggcgccaaggtggcccagccggacacccaggtctgggcgatcgacggcgacggctgcttccagatgaccaaccaggagctcgccacctgcgcgctggagggcatcccgatcaaggtcgccgtgatcaacaacggcaacctgggcatggtccggcagtggcagaccctgttctacgacggccgctactcgaacaccgagctgggcacccacaagcaccgcatcccggacttcgtgaagctggccgaggcgctcggctgcatcggcctgcgctgcgagtcgaaggacgacgtcgacaaggtcatccagcaggccatggagatcaacgacgcgccggtggtcatcgacttcacggtcggcaaggacgccatggtctggccgatggtggcggccggcaccagcaacgacgagatcatgttcgcccgggacgtgcgtcccacgttcgaagaggacgacctctga

SEQ ID NO: 3901 - DNA, 519 bp, Actinoplanes utahensis
atgtccaacaagcacacgctgagcgtgctggtggagaacaagcccggtgtgctggcccgggtcagcggcctgttctcccgacgcagtttcaacatcgactccctggcggtcggcgagacggagaacccggacgtcagccgcatcacgatcgtggtggacgccgagtcgtctccgctggagcaggtcacgaagcagctcaacaagctggtgaacgtcctgaagatcgtggagctggacccggcgcagtcggtccagcgcgaactcctgctggtcaaggtgcgcgccgaccgggcgcagcgcggccaggtgctggagaccgtcgagctgttccgggcgcgcgtgatcgacgtcgctccggacaccctgacgatcgaggccaccggcaaccccgacaaactggatgcgttgctgcgcgacctcgagccgtacggcatcaaggagatggtgcagtcgggcctcgtggccatcggccggggatcccgctccatcaccacgggcccagccctgcgtgccgcctga

SEQ ID NO: 3902 - DNA, 1014 bp, Actinoplanes utahensis
atgaccgccgaagtgttctacgacgacgacgccgacctgtcgatcatccagggcaagaaggtcgccgtcatcggctacggcagccagggccacgcccactcgctgtcgctgcgcgactcgggtgtcgaggtcgtcgtcggcctgcaggagggttccaagagccgtccgaaggccgaggagcagggcctgaccgtgaagactccggccgaggcgtccgcctgggccgacgtgatcatggtgctggcgccggacaccgcccagcgcaagatctacgccgagtcgatcgccccgcacctgaccgccggcaaggcgctgttcttcggccacggcctgaacatccgcttcgagctgatcaagcccccggccgacgtcaccgtcgcgatggtcgccccgaagggccccggccacctggtccgccgccagtacgtcgacggcaagggcgtccccgccctgatcgcggtcgagcaggacccggacggcaacggccaggcgctcgccctgtcgtacgcgaaggcgatcggcggcacccgcgccggcgtcatcaagacgacgttcaaggaggagaccgagaccgacctcttcggcgagcaggccgtcctctgcggcggcaccgcggccctggtccagaccggtttcgaggtgctcaccgaggccggttacgccccggagatcgcctacttcgagtgcctgcacgagctgaagctgatcgtcgacctgatgtacgagggcggcatctcccggatgcgctacagcgtctcggacaccgccgagttcggcgactacgtctccggcccgcgggtgatcaacgcggagaccaagcaggagatgaagcggatcctcgccgacatccagtccggcgagttcacccgccacctgatcgccgacgacgaggcgggcggcccggagctcaagaagtaccgcgagcagggcgcgcagcacccgatcgaggtcaccggcaagaagctccgcgacatgatgagctgggtggacaggccgatcaccgagacggcatag

SEQ ID NO: 3903 - DNA, 1575 bp, Actinoplanes utahensis
gtgacttccattgtcctggtaaccgaggaattggccccggccgcaatcgatgttctcgccacggatttcgaggtccgtgcggtggacggcacggatcggtcggtgctgctcgacgccctgcgagaggccgaggcggtgatcgtccggagtgcgacgcggatcgatgccgaggccctggaacacggtccgcatctgcgtgtggtggcgcgcgccggcgtggggctggacaacgtcgacatcgccgccgcgaccgctcacggggtgatggtggtcaacgcgccgaccagcaacatcatctcggcggcggagcaggcggtggccctgctgctgtgcaccgcccggcacaccgcgaccgccagcgccgccctcaaggcgggtcggtggcagcgcgcgaagttcaccggggtggaggtgttcggcaagaccgtcggcgtggtcggtctgggccggatcggcgtgctggtggcccagcggatggccgcgttcggcaccaccgtgatcgcctacgacccgtatgtgcagccggcccgcgccgcgcagctcggcgtccgcctggtcaccctggaggagctcctccgggagagtgatttcgtctcggtgcacctgccccgcactcccgagacgctggggctgatcggcgagaaggaactcgccacggtcaagcccggcgtgcggatcgtgaacgcggcccgcggcggcctggtcgacgagcgcgcgctggccgacgcgatcgcggacggccgggtggccggcgccggcctggacgtcttcgagaccgaaccgctcaccacctccccgctgttcggcttcgacagcgtgacggtcaccccgcacctgggcgcgtccacggccgaggcgcaggacaaggccgggctggcggtggcgcagagcgtgcggctggcgctgcgcggcgagttcgtcccggaggcggtcaacgtgcgggccggcggggcggtcgacgaggacgtgcgcccgctgctgccgctggccgagaagctgggccgggtgttcaccgcggtggccggtggggtggccgcccgggtcaccgtggacgtgcgcggcgaggtggccacgcacgacgtcgaggtgctgcagctggccaccatgaagggcctgttcgcctcggtggtggccgagcgggtcacctacgtgaacgcgccgcggctggccgccgatcggggagtggcggtggagctggcgacgtcggaggacgccggcgagcacgccgccctgatcgtggtgcgcggcgcgctggccgacgggcggaccatcgcggtggccggggccggcacgaagctggtcggggtggacgggttcgagctggacctgccggccgacggggtgctgctgttcgtccgctaccgggaccggcccggcgtggtcggccggatcggcaccggcctgggcgcggccgggctgaacatcgcggcgatgcaggtggctcgggaggcggccggcggggaggcgctgatggtgctgctggtcgactccccggtcgagccggagctgctggcccgggtggcggcttcggtggacgcgagcagtgccgtctcggtggacctgcggggcacctga

SEQ ID NO: 3904 - DNA, 354 bp, Actinoplanes utahensis
gtggtgtgggcgatggacccggcggcggcgcccgaacaggtgcgcgccgccaatgcgcggtgtgccgagggcgtgcacccgcagcgcccggccgacccccgcgtcgtcgccttctacgacgctttgaccagcaattatccggatcgtgggccgcgcgcgacggcgcccggcacgccgtgggcgagcgcgccgctgcacgccgccgcggaccacatccagatgcggctcgacgagaactgcccggaccaggtgctggagacgatcgagcggctggccgccgagctcaacctcgacctgctcgacctgcaggacgggacggtctacccgccgttgcgcgccacgcaggtccgctga

SEQ ID NO: 3905 - DNA, 1032 bp, Actinoplanes utahensis
gtgagcgtggcgcggatcgcggtcgtggccggcgacggcatcgggaccgaggtgaccgcgcaggcgcgcaaggtcattgacgccgtcctccccggagtcgactaccaggagtacgacctgggcgcccgcctctaccaccgcaccggcgaggtcctcccgcgggccgtcgaggacgagctggccggccacgacgcgatcctgctcggcgcgatcggcgacccgagcgtcccgccgggcgtcctggagcgcggcctgctgctgaagctgcggttcgacttcgaccagtatgtgaacctccgcccgtcgaagctctggcccggcaccaccagcccgctcgccggggtgaaagccggcgagatcgacatggtcgtggtccgcgagggcaccgagggtctctacgtcggcgccggcggcgtcctgcaccgggacacccccgccgagatcgccaccgaggagagcctgaacacccggcacggcgtcgagcgggtcatccgcgacgcgttccagcgcgcccagcgccgcgaacgccgccacctcacctgggtgcacaagaccaacgtgctcacccacgccggcaacctgtggtcccgcacgttcgccgcggtcgccgcggagtaccccgagatcaccacggagtaccagcacatcgacgcggccagcatgttcatggtcagcaacccgcagcgctacgacgtgatcgtcaccgacaacctgttcggcgacatcctcaccgacatcgccgccgcggtcaccggtggcatcggcatggcggccagcggctcggtcaaccccgagcggaaatacccgtcgaccttcgagccggtgcacggctccgccccggacatcgccggcaagggcatcgccgatccggccgccgcgatcctctccgccgccctgctgctggagcacctgggccggcacgccgaggccgggcgagtaaccgaggcggtcgcggccgaggtcgcgtcccgcacgccgggcgcgccgctgcgtaccgccgaggtcggcgaccgcgtcgccgccgcgctctga

SEQ ID NO: 3906 - DNA, 1158 bp, Actinoplanes utahensis
atgggcgcactccgggtgcccctcgcatgcttatttctgcagaaagcaggtccccttgccatgagcggtggtgacaacctcgacttcgagatccgtccgaatcccgcgcccgtaggagacgctgagcgcgccgccctgctggcgaacccggggttcggacggatcttcaccgaccacatggtcaccgtgcgttatgccgacggcaaaggctggtatgagccgcgggtcgaggcccgggcgccgatcccgatggatccggccagtgccgtgctgcactacgcgcaggagatcttcgagggcctgaaggcgtacacgctgcccgacggtggggtcgccatgttccgcccggaggcgaacgccgcccggttcgcccagtcggcggagcggatggccatgccggccctgcccgaggacctgttcctcaagtccctgcacgagatcatctcgatcgaccggcagtggatcccgggcggcgaggacggcagcctctacctgcggccgttcgcctacgccagtgaggtcttcctcggcgtccgcccggcccaggagtacctcttcctggtgatcgcctccccggtcggaccgtatttctccggtggcgtcaagccggtctcggtctgggtcaccccggactacacccgggcggctcccggcggcaccggcgcggccaagtgcggcggcaactacgcagccggcctgtccgcccaggccgaggccatcgagcacggctgcgaccaggtcgtctacctggacgcggtcgaacggaagtacatcgacgagctcggcggcatgaacgtcttcctggtcctcgacgacggcaccctggtcaccccgccgctgaccggcacgatcctgcccggcatcacccgcgactcggtgatcagactggccgagcgcgccggccgccgcgtcgaggagcgggcgatcagcctccaggagtggcgcgacggcgccgcctccggccgcgtccgcgaggccttcgcctgcggtacggcggcggtgatcaccccgatcggcaccatccgcagcctggacggcgacttcaccatcgccgacggcggccccggcgagatcaccatgggtctccgcaaggagttggtcgacatccagcgcggccgcgccgaggacaccttcggctgggtccaccgcgtcttctga

SEQ ID NO: 3907 - DNA, 885 bp, Actinoplanes utahensis
atgcccagccaaacgcacgagaccctcatcgagatgttccggggccggccggcgctcgcggcggatgtgctcgaccggacgttgcggatccccgtgccggaattcgacgaggcgctcctggcctccgccgagctcgccgacgtcgcgcccaccgaataccgagccgacgccgtcgtcaccctgagccgggcgggcgtcgcggtgctcgccgtcatcatcgaggtgcagctccgcgtcgaccagcgcaagcgcttgtcctggccggcctacgtgggcaccctctacgcccgggtcggctgcccggtcgcgctgctggtcgtctgcccacaccccaagatcgccacctgggcggcaacggcgatcgccgtcggcccgcccggctcgacggtggccccgatcgcgctcggccccgaacagatacccgtcgtcaccgatcccgacgaggctcgttccagtcccgagctggcagtcatgtccaccctcgcccacctcgcccacatcaccgactccgagcggaccgcgctgctcaacgccacattcaccggactcgacaccatcgaaccgagccgcgccgctctatacactgacctcatgctcgcggtcatgccgcaggcggctcggaagctcctggaggattacatgatcactacggataacccttaccagagcgacttcgcccgccgctacttcgccgcgggtgaggcccggggtgaagcccggggtgaagccaaatccgtcctggctgtcctccatgcacgcggcatcgagacgccggagtcgttccgcgccaagttgatggcctgcaccgacgaggccctgcttgcccggctgatccagcaggcggccactgccgagcagctgggagacctggaccccgttgactga

SEQ ID NO: 3908 - DNA, 381 bp, Actinoplanes utahensis
ttgactgatccggctcctgacgtgcatccgcagatcccgccgtccaccggacgtccgagccatggcgcgcagagcgaggctgagcttgccatgatcgccgcgagtcaccactaccgcagcgacttcgcccgctgccacttcgctgagggctggatcaatggccgggcacaagcccgggcaaagacccgggcacagggcaaggccgagtccattctgaccgtcctcgatgtgcgcgggattgagacgccggagtcgttccgcgagaggttgatggcctgcaccgacgaggccctgctcggccggctgatcaggcaggccagcactgtcgagcagctggacgacctggactcgctggactccctagacgaacccgaaccgtag

SEQ ID NO: 3909 - DNA, 474 bp, Actinoplanes utahensis
gtgccagacttgccgcgtactcgatcaccggcattctgcgaaagggacgtcatggccgacgtgctgatccggcccggcctggccatccccgaggccgagctctcgtggcgtttctcccgctccagcgggcccggcgggcagggcgtcaacaccaccgactcccgggtggagctgtcctggaacctgctcgcctccgggctgctctcgcccgccttgaaggagcgggccgtcgaacgcctgggcagccgcctggtcgacggggtgctgacgatcaccgcctccgagcaccgctcccaactccgcaaccgggaggccgccgaggcccgcctggccatgcgggtgggcgaggcgatcgcggccccgccccgccagcggcgcgccaccaaaccgacgcgcggctcggtcgaacgccgcatcggcgagaagaaacgccgagcccagatcaaacgcaaccgccgcggcgacgaggactga

SEQ ID NO: 3910 - DNA, 1506 bp, Actinoplanes utahensis
atgccggtgatcgagtacgcggcaagtctggcacccgtccgctcgatcccgccacggggttatccacggacaccgggcggggtcgccgagacgaacgcggcggacaccgggcggggccgccgggacggcggatgcggggcgcaggagggacggaaccgagcgatacacggcatgatgggtcgggtgacgtcaccatccgcaccggtcgccacgaccgggtatccgtggcctatcgaaaccacgcggctggcgaacggcctccgggtcgtcgtcagcgaggaccggaccgccccggtcgtctgcgtcaatctctggtatgacgtcggctcgcggcacgaaccgcccggtcagaccggtttcgcgcacctcttcgagcatctgatgttcgagggctcgcagcatgtgaagaagaccgagcacatgcggctcgtgcagggcaacggcggttcgctgaacgcgacgacgaacccggaccggacgaactacttcgagagcatgccgtcggagcatctggagctggcgctctggctggaggccgaccggatgggcggcctggttccggcactcacccaggagacgctggacaaccagcgcgaggtggtgaagaacgagcgccgccagcggtatgacaacgtgccgtacggggacgcctggctgcgtctgctgccgctgctctacccgccggggcacccgtatcaccatgccacgatcggctcgatggaggatctgaacgcggccgccctggaaaccttccaggcgttccacgcgcagtattacgcgccgaacaatgcggtgctgacggtcgccggggatgccccgccggccgaggtgttcgcgctggccgagaagtatttcggcgggatcgagccggtgccggggattccgccggcgccgaacgggcatctggccgggccggcgaccgagccggtgcgggagacggtgaccgcggctgttccggcgccgcggatctacctgtcgcaccggacgtatccgttcggcaccgccggctatgacgcgatcaccgtgctggccacggtgctgggcagtggccggggcagccggctctaccagcggctggccgacggcaagcggatcgcgcagccggattacatcgggtcgtacggggtcgatctggcgcacgcgccggctccgctgatcgtgaccgcgaccgcgaaggacggggtgagcgtcgacgagttggaggcgggcctggacgaggtgctgcgcagcctggtcgacgagccggtcaccgaggaggagctgaaccgggccaaggcgctgctgaccaccggctggtggcggcaggtgtccacggtcggcggccgggccgacacgctggggcggtatgcgacgcagttcggtgatccggcgaccgccgggtaccgcctgccggcgtggctggcggtgaccgccgacgatgtcaccgaggcggccgcccgcacgctgcagaaggagtcccgggtcaccctcacctacctgccggagaaggcggaggaggcagcatga

SEQ ID NO: 3911 - DNA, 1341 bp, Actinoplanes utahensis
atgagtctcgtcacgacacgccccgagccgggcacggcccgcccgtacgcgttcccgtcggtccgccgggtgaccgcgcacggcggcacggtgatcgccgcgcacctgccgggtcagatgctggccaccgcgatcctgctgctggacgccagcgccgcccgcgagccggcgggccgggagggcaccgcgacggtgctcgccaagtcgctggaggagggcacgagcaagcgcgattccgcggcgtacgcgctggctctggaggggttgggcgccgagctgtccccgtcggtcgactgggacaccttccgggtcggcgtgtcggcgccggccccgcagctgaccggcgcggtccggctggccgccgaggccgcccgcacgccgaagctggatccggcggatgtggcccgggtccgcgacgacgaggtgaccgcgctgcggatggactgggcgcagccgggcccgcgggcggacgccgcgttgcgcggcgacctgttcgccggcgaggggcggtacagccggccgttgcacggtgatccggcctcggtggccgcggtgaccgtcgacgacgtgctcgccttccaccgcgagtggatgctgcggccgggggtgctgctggtcgccggtgacctggacgggctggacctgaccgagctggccgaggccgcgttcgccggcacgtccgggcaggccctggccgtggaggcgccgctgggcctggtggttccggcgaagccgcacgtgatcctggtggaccggccgggctcggtgcagtcgacgctgcgggtcggtcaccgggcgccggagcgggccaccccggactacgtgccgatgacgctgatggccacggtgctgggtggggcgttcacgtcccggctcaatcacctgatccgtgaggtgaagggttacacgtacgggatccgcggctcctatgcgatgacccgccgggcgggccgtttcgaggtggccgccggggtgcagaccgcggtgaccgggccggcgatcgcggacacgctcggcgagatccggcgcacccaggtggacggggtgaccgaggcggagctggcggtcgcccggtcgtggcgggccggtcagctgtcggtggagatgcagacgccgggggcgatcgccggggcgctggccaccctggtggtgcacgggctgccggacgactatttcgagacgctgcgccgggagtatctggaggccaccgtcgagcaggtgtccgcggccgcggcccggcacctggcggtggacgggctgaccctggtggtcgagggcgacggcgagaagatccgggcggaactggcggagttcggcgacctgaccgaagcggcactctga

SEQ ID NO: 3912 - DNA, 1032 bp, Actinoplanes utahensis
gtgacgtcccggagctggtcacgggtcgatagcgtcggccccatgacgatcaccgaggcgccaccggtcacgaccggacggcgcggagcgacgatcctgttctggctgctgctcacgcccggtctggtctggacggtgatccggctcagcggctgggaggccggtcggctcatccaggtgctgccgttcaccccgtacgtggcagtcggatcgtggttgccggccctgctggcgctgttcttccgccggtgggcggccggcgcggccggcgttctgatcgcggtcgcgctggccgcgtgtgtcctgccgcgcgccctgcccgacctggaccggggcccctcgcacggcgtcacgctgcgggtgatgaccgcgaacctgctgctcggcggtgccgacacgaccgagatcacccagctggtccgggacaacgacgtggcggtgctcgcggtgcaggagttcagcccggcggcgcaggcccggctgaccgaggccgggctggaccggctgctgccctaccattcgctggccgccgagccgggtgccagcggttccgggttgtacgcgcggttcccgctggccgatccggggcagaagcgcaaccacggcgggttcctgcagacgttcgggacgttgcaggcgccgggcgccgccccggtcttcgtcgagtcggtgcacccgctggcgccgtcggcgccgctcaccttccacgcctggcgggtcgacctgcgcgaggagccgcggtccgacggcgacaatccgaaccggatcctgctcggcgatttcaactcgacgctggaccacagcgcgctgcgggacctgatctcgcacgggtaccgggatgccgcggacaccgtcggcgacggactgatcggcacctggggaccgtacgacggcgatatgatccccccggtgatcatcgatcacgttctggtcgacgagcggatcggagtccgtgaggtgtccgtgcacggggtggacaggtcggatcatcgttcggtgatcgccacgctgaccctgccggcggcgtcgtga

SEQ ID NO: 3913 - DNA, 537 bp, Actinoplanes utahensis
gtgaacgtcacgatccgtccggtgacgctgaccgacgtgcccgagctgaccgaggtgatcaaggcgagccgggagcacctggcgccctgggagccgatccgtgacgagagtttcttcaccgtcgccggccagtggaagatcctcgacgatctgctgaacgccgggaccggcctgccgcacgtgatcctggtcgacggcgcgatcgccggccgggtgaacctgcagaccgtggtgcgcggcccgttccagtcctgcaccctgggctactgggtggcgccggcgcacggcgggcgcggggtcgcctcgttcgcggtgggcgaggtgctgcggctcgcgttcaccgagtacggcctgcaccgggtggaggcggccaccctgctgcacaacgtgcggtcgcagcgggtgctggcgaagaacggcttcgagcggttcgggatggccccgcgctacctgaacatcgccggcgactggcaggaccactacctgttccagaccgtcgcggaaaactggttggagcagcgcaaggccgagtcctag

SEQ ID NO: 3914 - DNA, 1209 bp, Actinoplanes utahensis
atgatcgatcaccgcaagctcggccgtgagctggacctgttcgactccgacccgctgatcggcgccggcctgccgttctggctgccggccggcgccgccgcccgccacgaggtggagtcctacctgcgcgagctggaacgtcgcgccggctatcagcacgtctactcgccggcgatgggcaaacggcagatgtacgagatgtccggccactggtcgcacttcgccgcggacatgttcccgccgatgccggtcggcgacgacgagctggtgctgcggcccagcctgtgcccgcaccacgcgctgatcttcaaggcccgccggcggtcgtaccgggagctgccgctgcggatcgccgagatgggtcagatgtaccgccaggagcggtccggcgtgctcggcggcctgtcccgggtccgcgcgatcgcgctcaacgacgcgcacgtcctctgcgcgccggaacaggccgccgaggaggtcggcggggtgctgcggctgatgcgcgaggcgcacgacgcgctcggcctgcggccggcgtcggtgcgcctctcactgcgcgggccgggccggcgatacggcggtcccgagtccgggtgggcgctttccgagcggttgctgcggggcgcgctcgccgacaaccggatggcgtacgtcgtaggccccggcgaagcggccttctacggcccgaagatcgacgtgcaggtggccgacgcggccggccgggagtggaccatcgccaccgtccagctcgacttccaccagccggaacgcttcgacctgtcgtacgtgtcggcgtccggggcccgggcccgcccggtgatggtgcaccgcagcctggccgggtcgatggagcggctgttcggtcagctgatcgaggagcaccagggagcgttcccggtctggtacgcgccggtgcaggtggccgtgctgccggtcggcgcctcggggaccgcctcgttcgccgccgacgcggtcgccgcgggcctgcgcgcggtggaggtccgggagggctcgctcggcgcccggatccgggccgccgccaaggtgccgtacgtggcggtgatcggcgcccgggaagccgcggccggcctggtctcgctgcggctgcgggacggccggcagctggacccgatgcccgggtcggcggcgatcgcgctgatcagtgcggtcgccgccgcccgccgacccggtcagctcctgccgagtccgtag

SEQ ID NO: 3915 - DNA, 1575 bp, Actinoplanes utahensis
atggactaccaggtgttcgacacgacgctgcgcgacggtgggcagcgcgagggaatcagctacacggtcgccgacaaactcgcggtcgcacgcctgctggacgacttcggtgtcggtttcatcgagggcggctggccgggcgcgatgcccaaggacaccgagttcttcgcccgcgccaggaccgagctgaacctccggcacgcggtgctggtcgcgttcggcgccacccgcaaggccggcgtggacgtggcggccgacccgcaggtgcgggcgctgctggaggccgacaccccggtggtctgcgtggtggccaagtcggacatccggcacgtggagcgggcgctgcgcaccacggcggaggagaacctggcgatggtccgggacacggtccggcacctggtcgccaacggccgccgggcgttcctcgactgtgagcacttcttcgacggcttccgtttcgacccggagtacaccgcgagcgtggtgcggaccgcgatcgacgccggcgccgaacgcgtgatcatgtgcgacaccaacggcggcatgctcccctcgatgatcaccaaggcgatcaccgaggtcgtcgagcggaccggggtgagcgccgaccggctcggcatccactgccagaacgacaccgcctgcgcggtcgcgaacacggtcgccgcggtcgaggccggggtgcggcacttccagtgcaccgcgaacggctacggcgagcgccccggcaacgccgacctgttcgccgtggtcagcaacctgcaactcaagctcgggctgaaggtcctaccggacggatgcctggagaaggcgacgcgggtctcctccgcgctcgccgagatcgccaacatcgcccccgacacccaccaggcctatgtcggggccgcggcgttcgcccacaaggcgggcctgcacgcgagcgcgatcaaagtggatccgctgctgtacaaccacgtcgacccggcggttgtcggcaacgacatgcggatcctggtgaccgagatggccggccgggccagcatcgagctcaagagtcgcgagctcggcatcgacctggccggccatccggacacgctcacctcggtcacccagaaggtcaaggacctggaggcggccggctggtcgttcgaggccgccgacgcctcgttcgagctgctggtgcgcagcgagctgccgggcgaggacgtgacccgcccgttcaccctggagtcgtaccgggtgctggtcgagcaccgcgaagacggcaaggtgatctccgaggcgacggtgaagctgcgggtcaagggcgagcgggtgatcgccacggccgagggcaacggcccggtcaacgcgctggacgaggcgctgcgcaccgcgctctcccaccaccatccggcgctgaggtcgttcgagctcaacgactacaaggtacggatcctggagggcagccacggcaccaacgcgatcacccgggtgctggtcgagaccggcgaccacaaccgcgagtggaccaccgtcggcgtgcacgagaacgtggtcgaggccagctggaccgccctggtcgacgcgctcacctacggactcggcaggagctga

SEQ ID NO: 3916 - DNA, 804 bp, Actinoplanes utahensis
atgccactatccgggctcaggggaggcgccgttccacttatcgagactagttttgtcaccgtggttgccgaatcttactcgcgaaatctcgggttctccgccacctacaacttccgcgacgtcggcggatacgccggcctcgacggccgcaccgtgcggtggcgacgccttttccgggccgactcgctgcaccgcatcggggacgccgacgcggccgccttcaccgccctgggcatccgcaccgtgatcgacctgcgccgtccgcacgaggtggagaagttcggccgggtgcacgaacgctacgggaccgactaccgcaacctggtgctcaagcacgtcgactgggaggaggtcgagcaccccgacgggacggtgcgcgagcgctggctggccgaccgttacctcaacttcgccgaggacggccgggaggcgatcctcgacgcgctgcggctgatcgccgacccggcggccgctccggtcgtggtgcactgcatggccggcaaggaccggaccggcacgatctgcgcgctcaccctgtccctgctgggcgtctccgactccgacatcgccaccgactacgggctgaccaccgaggcgatgcggccgctcaccgagtatctgctgcgcgccgacccggaagcggtcgagggcaacgagcacatgttcgactcgccgccggccgcgatgcggctgttcctggacgacctgcgggcgctgcacggcacggtcgaggactacgtccgggagatcgggctcaccagctccgagatcgacgcgatgcggcggcatctgctggagggctga

SEQ ID NO: 3917 - DNA, 1521 bp, Actinoplanes utahensis
atgcaccgcccctccgcccggcgcctgctcgccggactggccacggccacggccgtcgccctcaccacggcgacaccggccttcgccgccacgcccaaaatcaacgtcaccctggacgatgtcgccatcggcgccgggtatgcgatcaaggtgtccccggtgctgcgggccgaccgcgaggtcgagctcaccggcgcggtgatgacgtaccagctcaccggcactccggccggggtcaccctggccaacccggacgagttcggagactgcgcgagtcagacgccgaccaccttggtctgcaagcagccgttcggtatcagcatcggcccgtacggtgtgatgggttacctggaaggcgcgctgaaggcctcgcgcaccacgccgatcggctcgaccgggaagctgaccgcgaccttcgccgctgacggtgtggccccgatcaagtcgaccgcgaacgtcgtcgtcgccgagggcgtcgacctggtcgccggcaagccggacaagcacaaggtcaaggtcggcgagaccttcaccggcaccgtgacggtgacgaacaagagcgacaagacggtccacggcgtcggcctgagcggttacgcggactacgcctatgagccgaccgcgcagttctccaactgctcctaccacgagatccggatgaactgccggttcgatcaggacctcgagccgggcgccacctacgccctggagttcccgttccgcgtgcgcacggacaccgcggcgcccagcggcggcgcggccgagtacaaatggctgccggtcggtgactacgacgcgcagactaaggccctgaagaccacggccggcaccggcggcatgctgaagctgacgaaggtcgccgccgccacctcgcgggcccgccagaccgacacgaacccggacgacaactggtcgctgatcgacgtcgatgtgaccggtcagcagagcaccgacatcgcggccatcggcgacaaggtctcgggcgcggccggcaccgtggtcaacgccacggtcggggtgcgcaacaacggcccggcgacgcgggacaccaaccacgccggcgacgcggcgagcgtgctgcgcgtcacgatcccggccggtgccaaggtcaccaccgtgccggacggctgtgcggtcgccacggactggctccagagcgacaagaaggcggtgcagtacgtctgctccaccggctacctgttccgggtcggcgagaccgtcagctggacattcggtctgaagatcgacaaggtcgtgccgggcgcgtccggggcggtcgaggccaacccggcgtgtgagtgcgacatcttctcgaaggacaccgacaagtcgaacgacaaggcgctgctggtgctcaacccggccggcggtaccggtggcaccggtggctcggacgggcccggcctgccgatcaccggcccgcagggcgccgcgatcgccggggccggcggtctgctggtggccgcgggcgcggtcagcttcctcatcgcccgccgccggcgtacccgcttccaggcctga

SEQ ID NO: 3918 - DNA, 972 bp, Actinoplanes utahensis
ttgatcgcttcggctagatacattggtgcgatggggatcaagcaggtgagggcactcaccaccacgctgccctcggtcacctggatacccctcgcccgggcgcacgccgagcgcgccgaccagatgaccgcgggccaccgtgcccgccgggcgacgggtgagaaacacgccatcgaggacttcctctacgactactacggcacccgcccgtcgatgctgcgccgctggcatccgggcgtcggcgccggcctggtggccgcccccgacggcctggccgagcacgcgggctggaagttctaccagacccacgacgacggcgtcgtcgccctcgaccaggacgcgttcctgcacgcccgcggcgagtcggtgcgctacatccacggtctgctcaccgccaccgcgtcccgcccggtcttctccggctgcttcggcctgcacgagtgggccatggtctaccgcgacccggagcaccggcacccgctcccgctgcgcctgggccagcccgagaccgacaaggtggtcgagcagcacaccatccgctgcacccacttcgacgcgttccgcttcttcacccccgaggcggtcggcctcaaccgcctgcagcccacccgcgccacccaggtcgacctggaccagcccggctgcctgcacgccgcgatggacgtgcacaaatgggcgcagaaactcggcccggccgtgcccggcgccctcgccctcgactgcttcgccctggccggcgagatccgcctcctcgacatgcaggccagcccctacgacctggcctcctacggccaccccccggtcaagatcgaaaccccggagggcaaagccgagtacgtcgcccgccaacgcgaactcgcccgccgcgcggccgccctccgcagccgcctgatccgcgtctgcgaggccctcctcggcccggaggcggccgcccgcaaccgcgaggccgtcgcccccttcaaccaccgataa

SEQ ID NO: 3919 - DNA, 909 bp, Actinoplanes utahensis
gtgcggagcatcggcggcgagcagtcggtcgccgagccggtcatcgaggtccgcgacctgcggatgcgatacgggcccagggaagtgctggacggcatctccttcacggcgcgtcccggcgaggtgatcgcgctcctcgggccgaacggggcgggcaagaccaccaccatcgagatcctggagggcttccggcgccggtcggccggccacgtccgggtgctcggcgccgacccggagcgcggcgacgagcgctggcgggcccggctcggcgtggtcctgcagtcctggcgcgaccacggcaagtggcgggtccgtgagctgctgcagcacgtcggccagcactacaccccgttcagcaccggccggatcgtccggccctggccggtcgacgagctgctcgccgcggtcggcctgaccgccgccgcgcggaccagggtcagccgcctctccggcgggcagcgccgccgcctcgacgtggcgatcggcatcgtcggtcgccccgagctgctcttcctcgacgagccgacggtcggcttcgacccggccgcccgccgcgagttccacgacctgatccacgggctgaccgacatggccgacaccacggtgctgctcaccacccacgatctggacgaggcggagaaactcgccgaccggatcctgatcctcgccggcggccggatcatcgcgagcggctcggccgacgcgctgtcccgccaggtggccggcgagaccgagatccgctggacccgggacgggcagcggttcgtgcactcggcggcggacgccacgccgttcgtccgcgagttgttccggcagtacggggagcggatcggcgacctcgaggtgcgccggtccagtctggaggacacctacatgaagctggtgcacgaggcggagggcgcccgatga

SEQ ID NO: 3920 - DNA, 840 bp, Actinoplanes utahensis
atgaccccgatccggatgggcctgcgccgcggcgcgatcgaggtgcggcacacgctgaccacgccgagcgacctgtggacctacctcttcccgtccctgctgctgctcggcacgatctatttcatgcgcggcgccacggtgcccggcaccagcttctcgctgggcgcccgcacgctgcccagcacgttcggcatgggcttcgcgacgaccgggctgatgaccaccgctcaactgctgatgatcgaccgggaggacggcaccctgctgcgggccaaggcggtgccgcgcggcatgaccagctatctgatcggcaaggtggtgctggtcggcgggatggcgatgatcagcttcctgctcgtgctgattcccggcctcttcctggtcgacggcctggacgtgaccggcggcgactggctgaccatgctctggctgatcccgctcggcctggtcgccaccctgccgctgggcgcggcgttcggctcactcttcgaggacccgcgcaacatggcactgatcgtgctgccgatcttcgggagcatcgcgatctccggcatcttctatccgatcagcggctttcccggctggctgcagggtgtcgcccagagtctcccgctgtactggctagggttgggcatgcgctcggtcttcctgcccgactccctggcctcggccgagatcgcgcactcctggcggcacctggaaacgttcggcgtgctgaccggctggtcgatcctcggcctcgtgctggccccgatcctgctgcggcggatggccgcccgcgagtccgggtcggcggtcgaggcgcgacgcgaacgcgccctgcggcgggtggggcgctga

SEQ ID NO: 3921 - DNA, 243 bp, Actinoplanes utahensis
atggcgacggagatcacgtacaaccggatcgccatgctccgcgcggagcgcggcatctcccgccggcagctggcggacgccctcggcgtgcactaccagaccgtcggctacctggagcgcggcgagttcagccccagcctccacctggccctgcggatctgtcagtacttcgaggtgccggtcgaggtggtcttcgcgctggagcctttcccgcggctcggggcggcttcgcaatcggcgtag

SEQ ID NO: 3922 - DNA, 795 bp, Actinoplanes utahensis
gtgcgcttcgcccgttttgttcatgccgctggagtgtcgttcggcgtcgtcgagggtgacggcgcctccggcctcacggtggccgagatcagcagcctgccgttcgagaaggtcgtccgcaccggccagcgctgggccctgcccgacgtccggctgctcgcgccgatcttctccagcaaggtgatcggcatcggtcgcaactacgccgaccacgccgccgagatgggcaacgaggtgcccaaggagccgctgatcttcatcaagccgtccacctcggtgatcggccccggcgacgccatccgcatcccctcggtcaccacccaggtcgaggaggaggccgagctcgccgtcgtgatcggcgccaccggtgcccgccgcctcgaccgggccgccgccgagaaagcgatcttcgggtacacctgcgccaacgacgtcaccgcccgcgacctgcagcgcaaagatccgcagtggacccgggccaagggcttcgactcgttctgcccgctcggcccgtggatcgagaccgagctcgacgtcagcgacctggaggtccgctgcgaggtcggccgcgacccggcgaacctggaggtccgccagatcggccgcaccaaggacatggtcttcgacatccccagcctggtgtcgtacgtctcgcacgtgatgaccctgctgcccggcgacgtgatcctgaccgggacgccggccggggtcagcaggatcgagccgggggacacggtgtcggtgagcgtgcagggcatcggggagctgcggaactcggtcgtcgccctcgactga

SEQ ID NO: 3923 - DNA, 138 bp, Actinoplanes utahensis
gtggcgctgggccggttgtggcgctgggccggttgtggcgctgggccggttgtggcgctgggccggttgtggcgctgggccggttgtggcgctgggccggttgtggcgctgggccggttgtggcgctgggccggttga

SEQ ID NO: 3924 - DNA, 687 bp, Actinoplanes utahensis
atgagcggtgtaggcgttctcgacaaggcggttgtcatcctcgccgcctgtgtcgacggcgccagcctggccgaattggtagagcgcaccaaacttccgcgggcaaccgcacatcgcctggcacaggctctggagatccatcggatgctggtccgggacactcaaggaagatggcgccccggacctcgattgggtgagttggcgaacgccgcacccgacgttctgctgaccgccgccgagcccctgctttccgcattgcgggacgccacgggggagagcgcgcagctgtacttgcgccgcgccgacgagcgcatctgtgtcgccgccgccgaacgcgccagcggcctgcgcgacaccgtcccggtcggctcggtgctgccgatggtcgccggctccgccgcccagatcctgctcgcctgggagccgccggaagccgtcatgcccctgctgccccggtgcaagttcaccggtcgcaccctggccgaggtccgccgccgcggctgggcgcagagcgtcgccgaacgcgaaccgggtgtggccagcgtctccgccccgatccgcgaccggaccgggcgggtcatcgcctccatctcgataagcggcccgatcgagcgcctgggccgccgccccggcgaacgccacgccatggcggtcgtccgagccggccagcgtctctccgggctgtag

SEQ ID NO: 3925 - DNA, 1455 bp, Actinoplanes utahensis
atggtgggagtcactcccgacagcgggaaacccaggaccctggccgagaaggtctgggatgaccacgtggtgcgctcggccgagggagagcccgacctgctcttcatcgacctgcacctgctgcacgaggtcaccagcccgcaggcgttcgacggtctccggttggccggccgcaaggtccgccgcaccgacctcacgctggcgaccgaggatcacaacaccccgaccgggtatgcggatccctccttcaacacccgccgcggtgagctgctgaccatcgccgacacggtttcccgcacccagatcgagaccctgcggaagaactgcgccgagttcggcgtcgagatccgcccgctcggtgacgtgaaccagggcatcgtgcacgtgatcggcccgcagctgggcctgacccagccgggcaccacgatcgtctgcggtgactcgcacaccgcgacccacggcgcgttcggcgcgctggccttcggcatcggcaccagtgaggtcgagcacgtgctcgccacccagacgctgccgcagtcgaagccgaagacgatggccgtcacggtcgtcggggagctcggcccgggcgtcagcgcgaaggatctgatcctcgccctgatcacgcagaccggcaccggtggcggcaacggccacatcgtggagtaccgcggcgaggcgatccgcaagctctccatggagggccggatgacgatctgcaacatgtcgatcgagtggggcgccaaggccggcatgatcgcgccggacgagaccaccttcgcgtatctgaaggatcgccggcacgccccgcagggcgccgactgggacgccgccgtggcgtactggaagaccctggtcaccgacgaggacgcggagtacgacaccgagatcatcctggacgccaccaggatcagcccgttcatcacctggggcaccaacccgggccagggtgccgcgttgaacgacgtggtgccgaacccggcggacttcccggacgaggtggagcggggcgccgccgagcgcgccctggcgtacatggacctcaccccgggcaccccgttccgcgaggtcccggtcgacgtggtcttcgtcggctcgtgcaccaacggccggctggaggacctgcgggccgcggccgacgtgatccgcggccgcaaggtcgccgccggcgtccggatgatgatcgtgcccggttcctacctggtgcgcgagcaggcggaggccgagggcctggacaagatcttcaccgatgcgggcgccgagtggcggttcgccggctgctcgatgtgcctgggcatgaacccggacacgctgagccccgggcagcgcgcggcgtccacctccaaccgcaacttcgagggccggcagggcaagggtggccgcacccacctggtctcgccgcaggtcgccgccgccaccgcggtggtcggcaagctggccgccccggccgacctctga

SEQ ID NO: 3926 - DNA, 591 bp, Actinoplanes utahensis
atggacaagttcgtcacgcacagcggcaaggtgctgccgctgcgccgctctgatgtggacaccgaccagatcatcccggcggtgtacctgaagcgggtcacccgtaccggcttcgaggacggcctcttcagcgcctggcgcgaggacccgtccttcgtgctgcacaacccggcgcacgccggcgccaccatcctggtggccgggccgaacttcggcaccggctcgtcccgtcagcatgccgtctgggcgctgcgcgactggggtttcaaggtggtgatcgcggcccggttcggcgacatcttccggggcaacgcgctcaaggagggtctgctgccggtccagctcgaccagaagatcgtggagagcctctgggatctggccgagagtgagccggaaaagcagatcaccgtcgacctggccgagcgggtggtgcgcgtggatgacgcggcgtactcgttcccgatcgacgatttcagccgttggcgtctgctggaggggctcgacgacatcggactgacgttgcgccacgaggacgcgattagcgcgtacgagaagagccgtccgtctttcaagccggtcgtcgttctttaa

SEQ ID NO: 3927 - DNA, 957 bp, Actinoplanes utahensis
atgggggcgaatttcgttgggacacaacggatttttgccacgaatgtttgtgtctccaggtcagagggcataccgtgcgcgcagaatggcctgcgacgggccagttctcacgtccgggaggaaaccgtgaacaaggccgagctcattgaggcgctcgccgtcaagctgggggacaggaagacggcgaccattgcgctggacgcgttcatcagtgaggtgcagaacgccgtcgccaagggtgacaaggtctccctcaccggcttcggatcctgggagaagcggacgcgtaatgcgcgcaccgcacggaatccgcgaaccggtgagccggtgaaggtgaagaagacgtcggtcgccgcattccggcccggcaacaccttccgggacctcgtcgccagcggcaaaccggccaaggtggcgtccgccaagaagaccacgtcggcgaaggcggccgcccccgcgaagacgaccgcgaccaagacggccacggcgaaggccaccgccaccaaggccaccgccaccaaggccaccgccaccaagtcggcggcgaccaaggcgacggccaccaagacgaccggtacgacggcggccaaggcgaccggtacggcggccaaggcgaccggcgcgacggccaaggcgaccggttcgacggccaccaaggccggcaagacgacggtcaccaaggccacgccggccaagtcggcggcgaagaagacggcggcgccggccaagtcggcggcgaagaagacggtcgcgccggccaagccgaccgcgacgaaggcggcggccaagaagaccaccgcacccgccaagaccaccacgaccaaggcagcggccaagaagaccacggccgcggcgaagaagaccaccgcccgcaagaccgcggcgccggccccggctccggcccgggccaagggtgcctcgacggcccgggccgcgtcgagccgcaaggcgcgctga

SEQ ID NO: 3928 - DNA, 426 bp, Actinoplanes utahensis
atggaacgcggaccgagagggctgctcacccgggcatcgctggccgccggcctgttcgcggtgaccgtcgtcccgggatggacgctcggcgatctggccgagcgtgccaccggctggccggcgctggactggttgatcacctgcggctggtccggtgtggtggtggccgggtacgccccgtggacgtcgtaccgggcgcgggacggactggccggcgcggtcccgctctacggctggtatctggccggggtgctgagctggcgggtggcgctgctgccctttcgcgactgggaaccgcgccgcgacgagttgtggcgggcccgctggctgaccggtgacctgatcggtttctggcgggccgatcaggccggcgcgcggccggtcaccagcgcccgatcgcgagcagtcgctcgccggaccaggtga

SEQ ID NO: 3929 - DNA, 882 bp, Actinoplanes utahensis
atggccgcagcggtccgcgccgcgggcggggtcctgtaccgcccgggccgcgccggtgtgcccgagatctgcctggtccaccggccgcgctacgacgactggagcctgcccaagggcaccctgcggcggggcgagccggccctggccgccgcggtccgtgaggtggccgaggagaccggggtcgccggcatcccggagatgtccctgcccgagatcgcgtacgagctgcccggtgggcgccccaaaacggtgcggtactggctgatgcgggccgggacgaccggcccgatccaggacaccgccgaggtcgacaggctggcctggctgccgctgccggacgccgccgcgcgactgacctatccggacgagcggccgctgctcgaccgggtcgccgggttgccgccgatcacctcggtggtggcgctcgtccggcacgcgcacgccggcgaccggaaagactggtccggtccggactcgctgcggccggtcagcgtcaagggcggccggcaggcccagcgggtggccgcccggctggccaccttccagccgcggcggctggtcgccgcgacgccgctgcggtgcacccagacgctgcagccgctggccgcggcgaccggactgccgatcgtctcggacatcgcgttcgccgagccggacgacctgaccgccgggctgccggcgcggctcaaggaggcccgcggccggctggacgagctgcggcgcggtgaccgggtggtgatctgcagccagggcaaggtgatcccggagttgctcgccggcctgcgcgacgcaccggatccggagcccttcaagacccgcaagggcgacggctggctgctcacctggtccggcgagcgactgctcgcgatcgggcgctggtga

SEQ ID NO: 3930 - DNA, 2271 bp, Actinoplanes utahensis
atgcagaccccgccccggagctccgaatcccgccggcgtggcccgaacggccgcttcctgaccagagtcgtgcccgccggtcccgccgttgacgtcgcaccggccgacccggtgcaggaggcgggaatcggcgcggagccggcggcggccggcggcgaggcggcggaggcggagctgccggtggagccggtcgacggcgagtaccacctgcccgaggaccggttcctcaaccgggagatgtcctggctcgacttcaatgcccgggtgctggccctggccgaggacccgggcacgccgctgttggaacgtgccaaattcctggcgatcttcgcgagcaacctggacgagttctacatggtccgggtcgcaggcctgaaacggcggctgaacgccggactgccggtccgcaccggtgaccgctccaccctgcggcagcagatcgagacgatcaccgcccggaccgccgacctggtcacccggcacgccgcctgcttcgccgacgaggtccggccgaaactcgccgcggagagcatcgagctggtcagctggcgcgagctggacgcccccgagcagggccggctgcgcaccttcttccgcgagcaggtgttcccggtgctcacgccgctcgcggtggacccggcgcacccctttccgtacatctccagcaggtcgttgaatctggccgtcgccctgcgctatccggacggggacaaccccgagctgttcgcccggatcaaggtgccgaacaacgtgccgcggttcgtgaccgtgcagaacgacagccgcgcggtccgcttcctgcccatcgaggagctgatcgcgaaccatctcgaccagctcttcccgggcatgcagatcctcgaggtgcacgccttccgggtgacccgcaacgccgagctggaggtcgacgaggaccgcgacgaggacctgctgcaggccctggaacgggagctggcgcagcgccggttcggtccgccggtccgcctggaggtggccgcctcgatcagcgaccacgtgctcgacctgctggtccgcgagctcgacatggacagccacgacgtgctgcgggtgcccggcctgctcgacctgtcggcactctggcaggtgttcggcgagtgcgatcgggacgatctcaaggaccgccctttcgtcccggcgacccatccgcagctggccgacggcgaggtgccgcgcagcgtgttcaaccggctgcgggagtcggacatcctggtccaccatccctaccattccttctccaccagcgtgcagcgcttcatcgagcaggcggcggccgacccgaacgtactggcgatcaagcagacgctgtaccggacgtcgggtgactcgccgatcgtcgacgcactggtcgacgcggccgccgccggcaagcaggtggtggtgctggtcgaggtgaaagcccggttcgacgaggtcgccaacatcgcctgggcgcgcaccctggaacgggccggctgccatgtggtgtacggcctggtcgggctcaagacgcactgcaagaccgcgctcgtggtccggcaggagggcaaccagctgcgccgctactgccacatcggcaccggcaactaccaccccaagacggcgcggttgtacgaggatttcggcatgctgaccgccgatcccgaggtgggcgccgacgtcaccgacctgttcaacgtgctcaccgggtacagccggcagaccacgtaccgccgcctgctggtcgccccgcacggcgtccgccggggcctgctggaccggctggccgagcaggcgaagatcgcccgatccggcggcgaggcgctcgtgcagttcaaggtgaactcgctggtcgacgaggagaccacggacgcgctctaccgcgcctcgcaggacggcgtgaaaatcgacctgatcatccgcgggatgtgcacgatccgccccggtgtgcccggcctctcggagaacatccgggtccgctcgatcgtcggccggttcctggaacactcccggattttccggttcggcgcgggcgacgacgccgaatactggatgggctcggccgacctgatgcaccgcaacctggaccgtcgggtcgaggcgctggtcaaggtgaccatgccgtcggcccgcgaggagctgcgcaacgtcctggagctgtccatggcggacggcaccgagggctgggacctcgacggcgacggcgactggcaccggcacagcggcgacaccgccaaggcgcaggcgcacctgcaggagctcctgctgcgccgcatcatcggcaagaaggcctga

SEQ ID NO: 3931 - DNA, 1218 bp, Actinoplanes utahensis
atggggtacggccgcaagcgccgcgtcgagctgggccgggcgcaacgccggcaggtcgccggtgagcaccgcgcgatacgcggcgagaccggccacctcgtcggcgccggagcgcatcgcggcgttcagcccggcgcccggatcgggcgccacctcggcccccagccgtcgtacggcgtgcccggcgaccggatcgtccgtgacgacgatcaacccggccaccgtggtggcgctcaccacagcggtcacggtgtcgcagagcatcgccagcaccagctccggatgccgttcctcgggcaccgcgccgcgcaaccggctcttggccgcgtccagccgcttgaccggaatcaccgtcatccacttccgcaccgacaccccgcaagtctgcatgacgtgtaccggcaacacccctacctggtacgtcgggccggcagggggcatgatttcgtcgcagacgcaggcgacatggtcgccgatcgagggacgggagaggccgtggcgcagcacaggctcggattctggcagcgtttcgcggtgatgctggtggtccccgtcatgaccgtctggacgaagcggacctggctgaggatggaccgcatcccgcaggcgggcggggtgatcctggtccccaaccacgtctcgcacttcgacccgctggtcgtggcgcactacatctacaaggccgggcgctggccccggttcctcggcaaggccagcctgtggcgggtcccgatcgtgggaccactgttggtcaagaccaagcaggtcccggtcgaacgaggcagtgtggaggcggtgaaatccctggagtcgctggtcgacgcgctcaccgacggcggcgccgtggtcatctatccggagggcaccacgacccgcgagcccgacctgtggccgatgcgcggcaagaccggcgcggcccggctggcgctgctcaccggcgccccggtggtgccgatcgcgaactggggagcgcagcgcgtcttcgacccgcgcaccaacaagctcaagctgacccgggccggggtcaccgtcaccaccggcgacccgatcgacctgagccggtgggccggcgccgagccgacccgcgcggtcctcgacgagatgaccgaccacatcatgctcggcatccgtgatctgctgggcacgatccgcgacggcgaggcgccggcgctctacgaccggcccgctcggcgggtcacgaaatcggaggacgcgtga

SEQ ID NO: 3932 - DNA, 993 bp, Actinoplanes utahensis
atgagggccgccgtcatcggatccggagcctggggcaccgcgttcgccaaggtgctgggcgaggccggctccgaggtgaccatgtgggcccggcgcgggtcggtggccgccgagatccgggacgagcacggcaacgagggctcgctgcccggcgtccggttgtcgaagcggatcaccgcgaccaccgatctggccgaggcggtcgacggcgccgagctgatcgcgatcgcggtgccgtcccagacgctgcgcggcaacctcgccgactgggccggctacttccccggcgacgccaccgtcgtgtccctgatgaagggcatcgagctgggcacgctcaagcggatgagcgaggtgatcgtggagaccgcgggcgtgccggccgagcgcgtggtggtggtctccgggccgaacgtggcccccgagatcgccgccgggcagcccaccgcgaccgtggtggccggcgccgacgaggaccgcgccaagcaggtgcagcacgccctggccacgccgtatttccggccgtacaccagcgacgacgtgatcggctgcgagctcggcggggcgaccaagaacgtgatcgccctggcctacgggatggcgatctcgatcggcctcggtgacaacacccgggcctcgttgatcacccgtggtctcgccgagaccgcgcggctcggggtggccctcggggccgacccgctcaccttcgccggcctggccgggctcggcgacctggtcgcctcctgctcgtccccgctggcccgcaatcggatgttcggcgagcacctgggccggggcgagagcctggagcaggcgcagatcgccacccggcagaccgccgagggggtgaagagctgcctgtccatccgcgacctggcccgctcgcacggggtcgagatgcccatcgtcgagcaggtcgagcgggtctgtcacgagggcgccgacccgcgggtcgcggtgaaactgctgatgacacgagagatgaaacccgagtga

SEQ ID NO: 3933 - DNA, 1104 bp, Actinoplanes utahensis
gtgagctactccgacggcacccgctccgtccacgccggcctgcccgcgcccgaggtggggcagccgttcctgcccgggccggtcttcgcggcgccctaccacctggacccggtcaccgggccgggtcgccacgggtatgcgcgcaccgagcagccgaccagacaggccctggaggccgcgatcggcgagttggagggcggtccggcactggccttcgccagcggccaggcggccatcacggcggcgctgctggcggtgctgaaagccggcgaccgggtggcgcttcccggcgacggctatttcccggtccgcgcgttcgcccacggcgccctgaccgacctgggcgtgacgagtgtgctggtgcccaccgccgggccgtacccggacttcaccggtctgcggctggtgatgctggagacgccggccaacccgggcctggacgtcgccgacatccgggcggtggccgccgccgcgcacgcggccggcgcgctgctcgcggtcgacaacaccgccgccaccccgctcgggcagaacccgctggccctcggcgccgacctggtcgtggcgtccggcaccaaggccctgaccggccactccgacctgctgctcggctacgtcgcggcgaccgaccgcgagctgctggccaaggtcgagacgtggcggaaactgaccggtggcgtgcccggcgcgttcgactgctggctggcccaccggtcgatcgccacgatggacctgcggctggcccggcagagcgagaacgccgccgcggtcgccgatctgctggtgagccgctccgaggtgaccggggtgcgctggcccggcctcccgagcgatccgtcgtacgcggtggccagtgtccagatgcgccgggtgcccggcatcgtctcgttcgacctgggcagcgccgagcgggtggcccggttcctgtcggcggcgaaactggtcttcgcggccacctcgttcggcggcgtgcacaccacggccgaccggcgcgcccagttcggcgacgacaccccgccgggcttcgtccgcttctcctgcggcatcgaggacaccgccgacctgatcgccgacgtcacccaggcgctggacgccgcacggtga

SEQ ID NO: 3934 - DNA, 447 bp, Actinoplanes utahensis
atgggaccagcactccacgtgatcgccgggccggggccggggcaattggccaccatggcacaccccggtgacaccccgtggtcaccgccggaactcgccgctctggcccgggccggcgtgcacatcctggtctgtaccgcgcggcaccgtccgcccgcgacggccggcgtcgggatcgagctgatcgactaccccgatccggacgagacggctccgcgccgcgaggccaccgagatggtcgcgctggccacccggctcgcccgggaggtccgttccggtcgtttcgtggtcacccagtcgagcgccgaactcggccgcacgaccctgctcgccaccatgaccctggcgctgctcggcatccgtccgggtgaggccctgcgccggatcggcgtcgccccgggccaaccggtcgcccaggagtggctgcacgacttcgtcgcccgttga

SEQ ID NO: 3935 - DNA, 1104 bp, Actinoplanes utahensis
gtgacaaccccccggaagacccgtgtcgcgatcgtgttcggcggacgcagcactgagcacgccatttcctgcgtgagcgcgggtgccatcctgggtgcgctcgaccccgatcagtacgagaccgtcccggtcggaatcacccgggagggtcgctgggtgctcgccgccggagatccggcgcagctcgccatcgccggtgagcggctgcccgagatcaccgccggctcgggcagcgcggtggtgcttcccgccgacccgaccgccgccgagctgatcgtgcgcgacccggccgacggcgtcgccgagctcgccgagctcgccggggtcgatgtggtcttcccggtgctgcacggggcgtacggggaggacggcaccatccagggcatgctggagatggccgggattccgtacgtgggggccaacgtcttcgcctcggccgccgccatggacaaggagttcaccaagaagctggccgccgccgagggcatcccggtcgggccgtacgcggtgctccgggccggcatgtcgctcaccgaggcggacaaggagcggctcgggctgccggtgttcgtgaagccgtcgcgggccgggtcgtcgaccggcatcaccaaggtcaccgactgggccgacctggacgcggcgatcaccaaggcccgtgagatcgaccccaaggtgctcgtcgaggcggcgatcgtcggcagcgagatcgagtgcggcgtgctggagggtgagttcggcgggccgccgcaggcgtcgctgctcgccgagatccacatggacggcgccgactggtacgacttcgcgacgaaatacctggtgggaagccgctacacgatcccggccgcgctgccgcacgatctgacccggcaggtccaggagtacgcgctgcgcaccttcaccgcgctggactgcgccggcctggcccgggtcgacttcttcgtcaccgcggccggcgaggtctacctcaacgagatcaacacgatgccggggatgacgccgacctcgatgttcccgcagatgtgggcggccaccggcctggagtacccgaaggtggtcgaccggctgatccgcaccgccctgcgacgcggcaccggcctgcactaa

SEQ ID NO: 3936 - DNA, 654 bp, Actinoplanes utahensis
atggtcgacgtcgacacccccgcgaaaccggacgacagcacgccggacaacaccacccgggtcgccgccatctgggcgaccgcgatcgcggtgccggtggtcctgatcgtggggctcgtcgcctacctgcagatcagtaggtcgacgacgccggcggccgacccggcgccgtcggcgagcggcccggccgtggtgcccaccaccccggtccgggtcgacgcgcccgagctggacgcccgggccgcccaggtgtgcctggcggtcacctcgcagctgccggcccggatccggaacctgccggcccgcaaggtcagcgccggcccggagcagaacgcggcgtacggcgagcccgcgatcaccgtggcctgcggggtcacccggccctggatgtgcgagaaggccgacgacacctccggcacgtgcgtgccgctggtcgccgaccttctgctgatggaccaggtctgctggtattacaccgagggcgccggcaagaccgtcttcaccacgatggaccgagaggtcccggtgcaggtgaccgtgccggcgacgtacgacaagcgggcccagtgggccaacgagttctccgacatcgtgctgaagaccgacaagtcgatcaccgccggcgtgccgaacgggtgcgacccgggccgttag

SEQ ID NO: 3937 - DNA, 234 bp, Actinoplanes utahensis
gtggtccaggcatacatcctcattcaaaccgaggtcggtaaggcccgtgacgtggccgcggcgatcgagaaaatcccgggggtggtccgagtcgacgcggtcaccggcccgtacgacgtggtcgtactgaccgaggcgcacaacgtggacgaattgggcaccctgattgtgagcaaggtccagtacgtgccgggtatcacccggaccctcacgtgctccgtggtaaacctctga

SEQ ID NO: 3938 - DNA, 939 bp, Actinoplanes utahensis
gtgagcatcgcagagtccggtgaattcggactaattggtcgaattgtgtcgcgactcgacgccggttcggccaccctgctcggtcccggcgacgacgcggcggtggtgcgcgcggccgacagccgggtggtggcctccaccgacgtgctcgtcgagggacggcacttccgccgcgactggtgcggcccgcaggacgtcgggcatcgcgccgccgcggccaacctggccgacatcgccgcgatgggcgccaccccgaccgcgctgctggtcgcgctctgcgtgccggccggcctggacgccggctgggccgagggcctggccgacgggctcaccgccgaggcggcgctctgcggggcggccgtggtcggcggcgacatgtcggccagccccacactcaccgtcgcggtcaccgcgctgggcgacctcggcgggctcgacccggtccgccgctccggcgcccagcccggcgacatcctcgccctgtccgggcggatcggctacgcggcggccggttacaccgtgctgtcccgcggcttccggaccccgaagatgctggtcgaggcgtaccgccggccggccgtgcggtacgccgccggccccgaggcggcccggctcggcgccacctcgatgatcgacgtctcggacggcctgctgcaggacgccgggcacctggccgacgccagtgtggtggcgatcgacatccggtcggacgccttcgaggtgcccgatcagatgcgggacgcggccaaggcgctgggggtggacccctaccagtggatcctggccggtggcgacgatcatcccctggccgcgaccttcccggcggggacccggctgcccgaggggtggcgggagatcggctcggtgcacgacggatccggcgtcaccgtcgaccgcaagccgtggtccgggccgctgggctgggatcactttcgttag

SEQ ID NO: 3939 - DNA, 417 bp, Actinoplanes utahensis
gtggaactggtcgcggagaacatgcgcgacctcgccgagcggtatggcggcacgggcgacgacacgccgatccgggcggccgacttccttgcgccggacggtgcgttcctcgtggccgtccgggccgacgacggtgccctggtgggcagcgccgggtggcggcggcacggaacggacgccgagctcaagcggatgttcacccgggccgcggcgcgcgggctcggggtggcccggcggatgctggcggcgatcgaggagtcggcccgggaggccggctgcgaacgggtgatcctggagaccggggaccggcagccggaggcgatcgcgctgtacgagtcggccggatacgtgcggatcgaggacttcggctactacaaggggcacgagggcgtgctctcgtacggcaagaagatctag

SEQ ID NO: 3940 - DNA, 192 bp, Actinoplanes utahensis
gtggctagcgtgtgcgacgtctgtggcaagggaccgggcttcggccacaacgtgtccttctcgcaccggcggaccaaccgccgctggaacccgaacatccagtcggtgcgcactccggccggtggcgggacgaccaagaagctcaacgtgtgcacctcgtgcatcaaggccggcaaggttgcccgcgcctga

SEQ ID NO: 3941 - DNA, 1575 bp, Actinoplanes utahensis
gtgctggagaccctcgatgccgccgccgtgcaccgctggtgcgacggtgggctggaggcgctccgggcccaccagcgcgagatcgacgagctgaacgtctacccggtgcccgacggggacaccggcaccaacctggtgctcaccctcaccgccgcacgggaggcggtcgagtccgccctgcacgaggagccgcgtacgccgatcggccggctgatgggccggatggcgcgcggcgcgctgctcggggcccggggcaactccggggtgatcgtgtcgcagatcctgcgcggcatggccgacgcgttcgccagcgcggtcgccgtccgcggcgccgagctggcgcacgcgctgcggcaggccagcgaggcggcttacgcggcggtggcccgcccggtggagggcaccgtgctctcggtcgtcgcggccgccgccgagggcgccgggcggatcgggtcggacagtctgatcaccgtcgcccgggcggccgcgcgggcggccgccgaggcgctcgatcggacgccgcagcagcttcccgagctggcccgggcgggcgtggtggacgccggtgggcgcggcctgtgcgtgctgctggacgccctggtggacacggtggcggagacggcgttctcaccctcgccgccgccggttccgctgccggccgccccggtcgtcgaggaccactgcgagggccacggctacgaggtccagtatctgctggaggcgccccccgaggcggtggagcgactgcgcggtgccctggccgggctgggcgactcgctggtcgtggtcggcgatccgcccacgtggaacgtgcacgtccacgtccccgccgaggcgatcggcccggcgctggaggcgggtgtcgaggcgggccggccgtaccggatcagtgtcaccccgctggccgggaagcggcccggcgccgagtcgcgcggcgcggtggtcgtcgccgccggcgacggcctgaccgcgctcttcgaggccgagggcgcggtggtggtcggccgcaacccgtccaccgccgagatgctggccgcggtgcgcgcctgtgccgccgccgccgtggtgctgctgcccaacgacgcgaacacgctcgccgtggccaccgccgcggcccgcgaggcggaggccaccgggctgcgggtcagcgtggtgccgacccgctcgccggtgcaggcgctggccgccctcgcggtgcgtgaccactcccgcccgttcgccgacgacgtgatcgcgatggccgaggcggccggcgcctgccgctacggcgaggtctgcaccgcccagcgcgacgccctgacggtggccggcccgtgccgcgccggcgacctgctcggcctggtcgacggcgaggtgcacgtgatcggcgccgatctgaccgacgtcagtcaccgcctgctcgaccggatgctgggcggcggcggcgagctggtcaccctggtcctcggcgcggacgcgccggccgagctggcggacgacctgcggggccacgtgcaccgcatctggccgttcatcgagctgcagtgctacgccggcggccagccccgctaccacctgctggcaggagtggaatga

SEQ ID NO: 3942 - DNA, 2181 bp, Actinoplanes utahensis
atgaccacgaccgacaccccgctgaccaaggtgctgggggccaagacggcgaaggcgctggccgagcacctggagctgcacacggccggcgatctgatctaccacttcccccggcggtacgacgagcgcggcgagcacaccgacctgcggcagctggaggtcggcgagcaggtcaccgtgctggcccaggtgcaggggatcggcgtcaaaccgatgcgccagcgcaagggcaacatgctggaggtgaccatcggtgacggctccggggccaccctgacctgtacattcttcaaccaggcgtggcgtgagcgggagctgacccggggccgctgggggctgttcgccggcaaggtcaccgagttccgcggcaagcggcagctcaacggcccggcctatcagctgctcaaggtggacgccacgcaggacgaggcggccgaggagatcgaggagttcgccggcgcgctgatcccggtctatccggccgcccaggcggtgcccacctgggtgctcgccaagtgcgtgcgcaccctgctggacaccttcgagccgccgcccgacccgatgcccgccgaggtccgggcggcgcgcaatctggtcggcatcggcaccgccctgcgggagatccaccggcccagttcggacgccgcgctctactcggcgaaacaccgcctgaagtgggacgaggcgttcgcggttcagctcaccctggcccagcggcgggctcgcgcggcggcggctccgggcacggcccggccgcgccgccccggtggtctgctggacaggttcgacgccgatctgccgtacgagttgaccgacggccagcgatcggtgggggaggagatcgccgccgatctggcccgggcgcacccgatgcaccggctgctgcagggcgaggtgggttcgggcaagacgctggtctcggtgcgggcgatgctgcaggtggtcgacgccggtgggcaggccgccctgctggcacccaccgaggtgctcgccacccagcacttccgcgggatcggtgcgcagctgggcgcgctgggccgggccggtgagctcgacggtgacccggagggtacgcagctcaccctggtgaccggttcgctgggggcggcggcccggcgggcggcgctggccaaggtggcggacgggagcgccgggatcgtggtcggcacccacgccctgctctacgagggggtcgacttccgggatctcgggctgatcgtggtcgacgagcagcaccggttcggcgtcgagcagcgggacgcgctgcgcgccaaggccgcccggccgccgcacgtgctggtgatgaccgccacgccgattccgcggacggtggccatgaccgtctacggcgacctggagacgtcggtgctctcccagctgccgcgcggccggtcgccgatcgcctcgcacgtggtgcccgccctggagaaaccggcctacctcgaccgggcctggaaacgggtgcgggaggaggtcgcggccggtcatcaggcgtacgtggtgtgtccccggatcggcgagggtcccgaggacgagtcgcctccgtcggacgacgagccggcccggcgtccgccgctcgcggtgaccgaggtgctgccggcgctgcgggacatgtatctccagggtctgcggatcgagatgctgcacggcaagatgccgcccgaggagaaggacgcggtgatgcgccggttcgccgccggcgacgtggacgtgctggtcgccaccacggtcatcgaggtcggcgtggacgtgccgaacagcaccgtcatgatcatcatggatgccgaccggttcggcgtctcccagctgcaccagctgcgcggccgggtgggccggggctcggcgccgggcgtctgcctgctgcacaccgaggcggtggagggttccgcggcccgcgagcggctggatgcggtggccgccaccacggacggcttcaaactctccgagatcgacctggagcagcgccgcgagggggacgtgctgggcgcgtcccagtccggcaagcactcgcatctgcggctgctgtcgctgctccgggacgagaaactgatcaaggaggcccgggtcgaggcggccgggctggtcggcgacgacccggacctcacccgctacccggcgctggccgcgtcggtcgccgcgttggtcgacgaggaccgcgccgagtatctggagaagggatga

SEQ ID NO: 3943 - DNA, 336 bp, Actinoplanes utahensis
atgatcgttcacctctgcccccggtcggtctgggagtcggttgccgacagttacgccggcgacaccctggagtccgagggcttcatccactgctccgacccggagtgggtgcacgtgccggcgacgctgcgcttccgcggccgcaccgacctggtgctgctggagatcgacccggcgcgggtggacgtgccggtgatctgggaggagggcgtcccgccggggccggacgggcggctcttcccgcacatctacgggccgttgccggtcaccgcggtggtcgcggtccgcgacttcccgccgctgccggacggcagcttcgcgcccctgcgaccctga

SEQ ID NO: 3944 - DNA, 1515 bp, Actinoplanes utahensis
gtgaaaatcaagtcatcgcttcgccgcaccgctagcctcctcgcgggcgcggtcatcggcctgacgggcgtcgcggccatggccgcacccgccagtgcccacgacgcctgggtcaccggttccgccacgtgcggctcggacggcaagaacgtcgtcacctggaccctcaccaacgacttcggcaccgacgcgacggtcaacgacctcaagatccccgccggcgcgaccaagcccgtcgacgcgaacgggcacgagctcaccgagggctacgtgctgccccgccggcagaacaacgcgaacggccaggccgtcttcacgcaggtgttcgacggcggcaccgaggtgcagctgtccttcaccgcgacgtggccgacggacaacttcaccgagtcgtcgccgaacaacacggccaacgtgcagctgaagcaggactgcaccccgccggcgccggtctgtgaggccaccgccacccggttccaccacaccttcgcgctggtcgacggcaagtggaaggccgtcgtcaagctcgacgacgactcgaagctctgcaacgacgagccggtcaccctggtctcgtacttcgcgccgaaggcgagcgacaaggacggcgacaactggccgcagtacgagtacgagcacgcctcggacacgatcaccgaccagcaccgcaccgccacgctcgacgtcgcggccccggactgcaacacccaggtcgacctgttcttcggtgccgagaaggacatcatcaacccgatgacccagaacggcgcccggtacggcgaccgcaagctgggcagcggcagcggcctcggtggccggtccaagggcccgcagggctggtacaacggcggctccaaggcctgcaccaccccggccgtcgccccggtctccgactgcaccggtgagctgaccgtcaacctcaccaacaacggcaagctcggcaagtacgacgtgaccttcaccgtcaagttcggtggcgagaccaagaccgtcacggtggccgcgggcaagtccgaggccgtcaaggttccggccggcgccggtgacgtgaccgtcagcgcccccgggctggaggagaagacctacagctggagccgtcccgaggactgcccgctgccggccgtcaccatccagaacgactgcaccaacgtgaccgtcgtgatcgacaacccgaaggacgtcaccccggtgaccgccaaggtgacctacggcgaccagaccaagaccgtcacggtcaaggccgactccgaggagaaggcgaccttcaagctgaccgacgtcaagttcgccctggtggacttcgccggcatcaagatggaaccgctcaaggtcgcggtcaaggacatcaagtgcggcgcggtcggtacgccgtcgcccagccccagcggtggcccgtccctgccggtgaccggtgcggccgccggcagcatcgcgggcatcgcggcgctgctggtcggtggcggcgtggtggcgttcttcatcgcccgtcgccgcaaggtgaagttcaccgcctga

SEQ ID NO: 3945 - DNA, 627 bp, Actinoplanes utahensis
gtgggcccgtatcgccctggcgtagcgtcctggtgtgcttctcaggaacttcggcgggcgcggatgaccaggatcatcgcgggtgaccatggcggccggcggctgcagaccctgtccggtgcgcagaccaggcccacatcggaccgggtccgggaggctttcttcagtgctctggacaccatgacggatctgtccggagcgcggttcgccgacctctatgccggatccggcgcggtcggcctggaagcgctgtcccgcggtgccgaacacgtccttctggtcgaatcggacagcaaggcggcccgggtcgtccgggacaacgtggtggccctcaaggtcggcccggccgcgcgcctggtcaccggaaaggtgctgcaggtgctcgccgatcgcccggacggggggccgtacgacgtggtcttcgccgacccgccgtacgcggtgggtaacgacgagatggacacagtgcaacgagcgttgctggccggcggctggctggcgccggacgccgtggtggtgttcgagcgctccacccgtaccgagccgctgagctgggtggacggcctcaccggcgaccgcacccggcgctatggcgagaccacactttggtacggtcgccgatcatga

SEQ ID NO: 3946 - DNA, 480 bp, Actinoplanes utahensis
atgagacgagcggtgtgtcccggctccttcgacccggtcaccaatgggcacctcgacatcatcgggcgggccagccggctcttcgacgaggtgatcgtcggagtgctgatcaaccagtcgaagtccggactcttcccggtcgaggagcgcctcgaactgctcagcgaggtgaccgcggcgtacgacaacgtccgggtgatgtccttccacgggctgctcgtcgacttctgccgggaccagggcgccgccgtggtggtcaagggcatccgcgcggtcagcgacttcgactacgagttgcagatggcgcagatgaacatcgggctctccggtgtggagacgctgttcatgcccaccaatccgctgtactcgttcctatcgtccagcctggtcaaagacgtggtcaagtggggtggcgacgcctcggcgtaccttcccgacccggtgctggcccggctggtcaaccggctgaagcagaattag

SEQ ID NO: 3947 - DNA, 498 bp, Actinoplanes utahensis
gtggatccgctcgaccgtatcgacgagctcatcgagcacgtccaggacgcgcgttccgtgccgatgtcgcggacgaacttcatgttcgaccgcggcgagatgatcgaaaggctcgaggagctgcgcgccgagctcccctccgagttgcgcaaggcggccgcggtcctggacgagcgggaccggatcgtcgaggccggccggcgcgaggccgaccggatcatcagcgagggcgaggccgagcacgcccgcctggtgtcggtgaacgagatcaccgtgtccgccgagcacgagggcgcccggatcatcgccgaggcgcgcaccgaggcgcagcggctgcgtgaggaggtcgacgactacgtcgacaccgcgctggccaacttcgagcagttcctgaccagggcgctggcatcgatcgagcggggccgtgacaagatgcacgcgctccgggaaatcggaacattccagggtgaggacgctgaacgccctctcccgttttga

SEQ ID NO: 3948 - DNA, 564 bp, Actinoplanes utahensis
atgcccaagtcaccgcagagtcacctggatcccaggaagccgctggtcgtcgacacgacgaagctaccgcggcaacctggtgcgacgcgtgccctgaaacaggtggttccggcaccggcggacctcggcctggagttgatctcggtccctgagggttccgacctcgagctcgatctgagcatgacgtcggtctccgagggggtctacgtcagcggtgccgtgcggggctcgctcaacggcgagtgcggccggtgcctcaacgagatcgacaggtccttcgaggtgaccatcggggagatgttcgcgtacgcggacagcaccaccgaggagaccaccgacgaggacgaggtcggccggatgcagggcgacctgatcgacctggagccggcggtacgggacgcggtggtgctgaccctgccgaccaatccgctctgccggccggactgcccagggctgtgccccgagtgcggggtgcacttcgacgaccttcccgctgatcacagtcacgaggaagtcgacccccgctgggccgctttgcgcaatctatcgagtaacgaggagtag

SEQ ID NO: 3949 - DNA, 174 bp, Actinoplanes utahensis
gtggccgtccccaagcgcaagatgtcgcgcagcaacacccgctcgcgccgggcgaactggaaggcgaccgcggtctcgaccgtggcgtgcccccagtgcaagtcgccgaagctgccgcacaccgcctgctcggtctgcggcacctacaacggccgtcaggtcctcgaggtctga

SEQ ID NO: 3950 - DNA, 927 bp, Actinoplanes utahensis
gtgactcgcccgatcatcgggcggctcgtacctgagcagtggcgttccaccggtgccccggttcccgcacgggagcggggcaccgcgcggatcgccgtcgacctcctcggcggggaccatgctcccgccgtcgtggttgacggcgctctgcgtgccgtcacggacgacccgtccctgcacctgaccctcgtcggcccggccgaagccgccgacgcggtgctcgccgccctgcatccggcgcagcgccatcgcatcaccgccgtgcccgccggcaccgccgccgaagcggtcgccgccggcctggccgacgccctggtctccgcgggcgacaccggccagaccgtgctcgccgcggcacgcgccctgggccgccgacccggagtccgccgccctccgctcgccgccgtgctgcccaccgccgccggccgcctcgtgctgctcgacgtcggctcgaccgtcgacccggacgagcacaccctggtcatgcacgcccggctcggcgccgcctacgccgccgcggtgcacgacgtccccgagccgcgggtcggcctgctcaccatcggcaccgaacacggcaagggcgaccggctgcgccggaccgtcgcgccgctgctggaggaactgccgctgcgctacgccggcctggtcgagggcggcgacgtcgtgcacggcttcgccgccgacgtcgtggtcaccgacggtttcaccggcaacatcctgctgaaagccctggaagcggcgcacgccggaaaacgatccgacgaggtgcgtgcggccgtactgctgggtgtccgcggcatcgtggtcgtctgccacggcgccgccaccggcccggacctcgcccagggcattgccttcgccgccgacctgcaccgccgagacgccaacgccgcaatgatgtcgtacaacgaggtatcgcatgaatga

SEQ ID NO: 3951 - DNA, 738 bp, Actinoplanes utahensis
atgaatgacaagcgccgccgtccccccaccctgcccctggaagaagccttcggcgtcccgttcgaggccgacctgctggaacgcgcgctgacccaccgctcgtacgcgtacgagaacggcgggctgcccaccaacgagcgcctggagttcctcggcgactcggtgctcggcgtggtgatcacgtcggcgctcttccacaaccaccccgacctgcccgagggtcagctcgccaagctgcgggccagcgtggtcaacatgcacgcgctcgccgacgtggcccgcggactcggcgacggcggcctcggcccgcacctgctgctcggcaagggtgaggagaccaccggcggccgggacaaggcgagcatcctggccgacacgctggaggcgctgctcggcgcgatctacctggagcacggcctggagacggccggcgaggtgatccaccggctgttcgacccgctgatggccgaatcggccggccggggcgccgcgctcgactggaagaccagcctgcaggagctgaccgcggccctcgggctgggcgtgcccgactacgtgatcgaggactccgggccggaccacgccaagacgttcaccgcctgggtggtggtcgccggggtccgctacggcggatccgacgggcgcagcaagaagcaggccgagcagcgggccgccgcggccgcctggcgaatgctcaccgagcggagcgaagcagatggcgacgacaagcccgagtaa

SEQ ID NO: 3952 - DNA, 1200 bp, Actinoplanes utahensis
atggcgacgacaagcccgagtaaggcggcgccggccgtgacggacaccccggagccgcccgccgccccgcagaccctgtgggagaaggccggcggcggtcccggggtcgccgtcgcggtcgggctgctcgcgctgacccgggtcggccagctcctgatgatctggtggctgggcggcgcgtcgacgtcgcacggcggggtgtggcagcggttgctggtctgggacggcggctggttcctgcgggtggcgaacaacggttacccgcacggctacacctacgacgagaaccacgtgctgcaggcgaacgagctcgcgttcttcccgctgtacccgtcactgatccgcgcggtgtcggcgctcggcgtggcgcccggcacggccgcggtcgcggtggcctggctcgcctcgatcggcgcagcggtcgcgctgcacctgctcggcaccacgctgtacggcaagcgggccgggtgggcgctggtggcgatctgctgttcggcaccggtgtcggtggtgctgtccatggcgtactcggaaagcctgttcctggccctcgtcgccggcatgctggccgccgcgcaccgccgcgcctggctgccggccgccgtactcggcctcggcgccgccctgacccgcccgaccggtgccgccgccgcgatcgccctggcggtcgccgccgtgatggccctccgtgacgaacccaacaggatcaaaccgctggcggcggccgcgaccgcgctggccggtgtccccctgttcctgggctgggtcggctggcgggtcggcgactggaccgcctggttcaagatccagacggcggggtggggcacgtccttcgactacggccgcagcacggtccgcttcctgcacgacacgttcaccagcggcgacggctgggtgcaggtcagtgtcggcctgatcctgctcgtcgccctggccgccgccggcgtcgccctggcccagaaaccgtggccgccactcgcggtctacggcgtcgtcgcgatgatcctcgtctacggccaggccggcttctaccactccaagccccgcctgctgctgcccgtactgttgaccctgctgcccgcagtcctcgccgccgcccgcgcccgcccccgggtcgcgatcctgtcgatcaccgcctgggccgccttcggcctctggtacggcgcctacctgatcaccgtctggccctacacgatgtga

SEQ ID NO: 3953 - DNA, 858 bp, Actinoplanes utahensis
ttgcctgagctacccgaggtcgaaaccgtccggatgggcctggccaagtgggtgaccggccgcaccgtctcggcggtcgaggtgcaccacccccgggcgatccgccggcacctgcccggcgacacccacttcatcgccatgctgaccggccgcaccatcctggacgtcgcccgccggggcaaatacctgtggctgccgctggactccggcgacgcgatcatcgcccacctggggatgagcggccaactcctgatgcagcccggcaccgccgacgacgagaaacacctgcgggtccggttccgcttcaccgacgacggccccgagctgcgcttcgtcgaccagcgcacgttcggcggcctgtccgtctcggagggcggcgccgacctgcccgccgagatctcgcacatcgcccgcgacccgatcgacccgctcttcgacgacgacgccttctccgcccgcctccgcggccggcacaccgaggtcaaacgcgccctcctcgaccagtccctgatctccggcgtcggcaacatctacgccgacgaggccctctggcgcgcccggctgcacggcacccggcccaccgacaaactgagcagaccggccgtcgcccgcctgctgcagcacgtccgcgacgttctcggcgaagccatcgtggccggcgggacgagcttcgacgagctgtacgtcaacgtgaacggggagagcggctacttcgaccgctcgctcaacgcctacggccgcgagggcgaaccctgcaaacgctgcggggcgatcatgcgacgggagagcttcatgaaccgttcctcgttcagctgcccccgctgccagcccaaaccccgcctgacacacgccgcctga

SEQ ID NO: 3954 - DNA, 570 bp, Actinoplanes utahensis
gtgaagaccctgttccccgcgtacgcccatcccggccccgagctgcaactcgacgccgacacctggatcgtccgggaacatcccggcgaccggcgcaccctgcaccagtcgctgggccggatcgacctggactggggcagccgctcgctggccgacgtcctgtccgacgtggacgcctggcgggccgacggcgtcgagggcctgttcctggaccgcgccccggccggctccggcggcgtcggcccggtggccctcaccgtccgcctcgccgcccgccgcggcctgcaccgggtggtgctgaacccgggcgtgccgacccaccccctctaccgcgacctcggtgtccggatctgcaccttcgagggtccctggtcggcctaccagagctgggacggcgacggcacccgaccgggcgacgggcacatcgtccacggcgtcccggccgggctgctcaccgcggcacgccggctgatgggtcgccgcggcgccggcttcggtctggccaccgacgccggcccggacctgagcccggccggcgctcccggcggcggcgcccacagcgccgactga

SEQ ID NO: 3955 - DNA, 2559 bp, Actinoplanes utahensis
atgacgatcactcccccacgcgggaccgcgggaggctcgcggaccgctgcccgcacccggcgacggcgtgcgccggcgccgggcgagccccggcacgggttcggcgggccgggcccggaggagatgcccggtgcgcggcggcggcctcccctcccggatcgctacgaggagaatgccgatgcggtacgccgtcagcacggccccgccgcgaccgacgggctgggggcgcggctgtacgaggtgatgtcggactccgagcgggagacggcggtcgccgagacgctgctgttcgtgaaaccggccgtcggcgacgagccgccgccggcccccgagcccgggccgttcccggccgccggggacccggtgccgccggccgagacgcagctcttcccggcgccggcgcccgaagcggccggggcgaacccggacttcgaggggctgccggccgccgagacgatcctgttcacccggccggccgggtggaacgtcgccgcggaaccggatgcgccgccacggcgggaagtgacgccgctgaccgagacgttcctgttcgggacgccggcgcggcacgcgcaggagccccggtcgccgatcgacggggcggcggagacgctgctgttcgccgggctggcgcgggcgctcgccacccagccggaggagaccaccggcgaggatcccgcggagacggcgggggaggctcacgcgtaccgcgcaatcggggagagggaccaccgcggcgcgggacgtggacagcgggcctgggtggaacgggatcggaatgcggcgcagccgcttccgggagacacaccgcgacctcggcgggagtgggcgttcccggatgagtttaatgtgggcgaaatgcccgagtatgatagcggaaggccgggtcgggtcgttccgcggcggcgttcccgcgccgccgatccggagattcccaacggcgcctggaacgcccgctaccagcagtgggagctggaccagagccgcgacgccgaggcccccatcgttgcggagcccttcatcccggagtccttcgccgcggagtcgttcgccgccgagcccttcgccgcggaatccttcgccgcggaatcgttcgccgccgagcccttcatggcggagtcgatcgtcgccgagccgttcgcggacgagcccttcgccgcggacgagcccttcgccgcggaacccttcgccgcggaacccttcgccgcggaactcttcgccgcggaacccttcgccgcggaaccgttcgatctgccggatccggaaggctcgcgggagctgaccccggcccgcctcgccaaagcagccgccgccgaagccgcctggcgcgccttcgccgaaggcgaccgcgaacccggtgccgagatccgcaccggccggcgcgccaaacgccgctgggccccgaccttcctgctcccggtgatcctgcgctgcctgctctacctcggcccgctcagcgtcaccgtggccgcggccggcgcgctcagccgggtcgcctggcccgtccccgccgtcaccctgctcctcggctgggccgccgcccaggccctgaccagcgtcggcgtcaccgtcgcccggcgggccgggccggaagccgcggtccgcctgatcggcgccggcttcgccgccgtcaccgcgctctggtgcgccctggtctggatcgccccggccggcctgctcggccccgaccgcctgctcgccgccgcggtcggcgccggcggactcgccgcgctcgccacggtcaccgccgccctggtcacccgcgccgagagcgcggtgatcctctggtacatcccgtgctggctgctggccgccgccgtgctcgccaccgccgccggggccggttggacccggcacgtcccggtggaaacgctgcttccggccgcggtcgtcgccgtggtgatccgggcgttccgccccgccgtgctgctcggccgcgaatgccgcatcccgcgcctgaccgcggccgaacgccgtcgcggcctcgcctacctggtcatcggcatctcccaggcggtctgtgtcgccctgctctggcgatccggtccggctgtcacccccgccccggcggcgctgcccctgctgctcgcggtgcccatcctggaagcgctgatcggctggcacaccgcccgcatcgaagccggcctcgattccgccggatccgtcgacgacctgaaccggcacatccgcaacgtcaccgcgatcacgctggccggcctgctgcccccgctggccgccggcgcggcgctggcggtcgccgcgtaccgcctgccggccggtctgaccggcaccgccggcagccgtgacgcggtcctcgccctggctgccggcaccctgctcggcggggtcttcgcgatcaccttcctgctcgccgcccgcaaccgcaccgggatcgccgccaccctggcggcggtgccgctgtcgacgctggccatgccgctgctacagcagcggggctccgggccgctggcagcggcggtggcggtactggcggccacccacgtggccgggctgatcatcgtcggcctgaccgccgccgatctgcggaggaactcatga

SEQ ID NO: 3956 - DNA, 1503 bp, Actinoplanes utahensis
gtgaatccgaccccgtcccgcgagcgcatctgtctgctcaccggcggcggatacccgtaccgccgggacgccctcggaggatggtgccggtcgctcgtcgaaggactgcaccgcttccgcttcgagctgctgaccgtcaccgaccgggaactgccgtccgcgcccgcctacccgcttccgtcccatgtcgcctcgtcgcgcgtcgtcgcgctgggccgggagccggccggtgcccagcgccgccgcgcgcacctgcccggcggtgccggggacgcggtcgcccagctctgtcacggcctgctcgacgagaccgcgaccgacgtgttcgccgagggtttgcgcaccatcgcggagatggcggtgaaccggccgagcccgctgccccgcctcccactggccgacaagctgatggacgcgtggcgctgggggccgcagccggtcccggacaccctgccgaagctcagcgtgcgcgacgcccggaccgccgccatgctgctgcggcacgcgttgcgggcgctcgccgtaccgtttcccgaagtggatctggtgcactgcgtgggcggcaccacgccgctgctcgcggcgctctccggccggtggcggacgggcacgccactgctgctgaccgaggcgcgcaccccggtcacccggcagcggccggccgaggaacgcctgtcacccgcggtccgactggtgctgcggcggttccgcagcgcggtggcccggaccgggtatgccgaggcggagatcatcgcgccactgagcgcgtaccaccacggctgggcgctcaatctgggcgccgagccgacccggctggtacaggtgccggtcggggtggatccgaagagcttcccgggcgctgccgagctggaggatccgccgaccgtggtgtgggccggcagcggtggtccggacagtgggctgaccctggtgctggacgcgttcaccgaggtggcggcggctctcccgggcgccgtgctgcacctggtcggggtgaccgccgcgcacgaggagcactgcgccgaccagatcgagttgaccgggctgggccgggcgatccggctgcatccgctgcccgccgacccgcgggagcgtttcaccgtcggccaggtggtggcgcacgtgccgggcccgtccgacccgccgtaccgcctggtcgaagccatgatgtcgggtcgcccggtggtggccgtcgacatcggcccggcggccgagacgctcggcgacaccggggtggtggtgcccgccgacgacccgtccgagctggccatcgcgatcgtcgagctgctgcgggcgacaccgcgccggcgggcgctgggcgacgcggcccggcagcgcgcgctgaaccacttcaccgtcgaccgggtggtgcgggtgtacggcgctctctacaccgatcttgccgcgccgcccccggcgccggctttcgaactggcgctcgccgttccggcgccccggaccgagaccccggccacgttgcgctggctgaccagggaggactga

SEQ ID NO: 3957 - DNA, 195 bp, Actinoplanes utahensis
atggcgaaggccctctacggccacgtaggtgcggcgcccgatcggcgcctgctcgacgaggtcacccgactgcgttccagggtgcaatccttggagttcgagatcacccgcctccgggcggagaatgatcgtcttgcggcggcggccgccgaggcggacgacattctgcggctgaccgagccggccctgacctga

SEQ ID NO: 3958 - DNA, 2499 bp, Actinoplanes utahensis
gtgcacctcaagagcctgacggtgaagggcttcaagtccttcgcgtccgccaccacgttgcggctggaaccgggcatcacctgtgtggtggggcccaacgggtccggcaagtccaacgtcgtcgacgccatcgcctgggtgctgggcgagcagggggcgaaggcgctgcgcggcggcaagatggaggatgtcatcttcgccggcacggccggccgggcgccgctggggcgggccgaggtgacgctgaccatcgacaacaacgacggcgcgctgccgatcgactacaccgaggtgtcgatcacccggcggatgttccgggacggcgccagcgagtacgagatcaacggcaactcctgccgcctgctcgacatccaggaactgctcagcgactccggcatcggccgggagatgcacatcatcgtcggccagggccggctggacgcgatgctgcacgcgaagccggaggatcgccgctcgttcatcgaggaggcggccggggtcctgaaacaccgtaagcgcaaggagaaggcggtccgcaagctcgacgcgatgcaggtcaacctgaaccggttgaacgacctgaccgccgagttgcgccgccagctcaagccgctgggccggcaggccgaggtggcgcgccgggccgcgggcatccaggccgatctgcgcgacgcgcggctgcggctgctcgccgacgaccttttcaccctgcgtacgacgttggaccgggagatcgccgacgaggcggcgatgaaggaccgccgcgccgaggtggaggcggagaaccgggaggtccagcggatgctggccgacctggagttcgcgcacgccgaggacgcgcccctgctgcaggccgcgcaggacacctggtacaagctgtccaccctgcaggagcggttccggtcgacggagcagctggccaccgagcggctgcggcacctggccgccaccccggacgacgagcggccgggccgggacccggacatgctggaggccgaggcggagcgggtccgcgagcaggaggaggagctccgcgaggcgctcaccgacgaccagatgcggctggccgaggcggtcgagcaccggcaggacctggagcggcagctggccgcggccgagggtgagctgcgcgccgccgcgaaggcgatcgccgaccgccgcgagggtctggccaagctggtcggcaacgtgaacgcggcgcgggcccggacgtccagcgcggccgaggagatcgagcggctggccgccgcgcacgaggacgcgctgatgcgggccgaggcggcacaggccgaggtcgacgtggtcgccgccgagtcgtcggacgccgaccgggacaacgccgatctggacgcccggcacgacgaggcggtggccgcgcacgacaaggcggccgccgtggtccgcgagctgtccgacgcggagcgggccgcggagaaggacgcggccagcctcaaggcccgcgaggaggcgctggcgctcggcctcaagcgtaaggacggcgccggcgcgctgctggccaaggccggtcaggtgccgggtctgctgggcagtctggcgtcgatgctctcggtgcggccgggatacgagacggcgctctccgcggccttggacacgctcgccgacgcggtggcgctggcgagtctggacgaggcggtcgaggccgtccgtacgctgaagatcgcggatgccggccgggccgcgctggtcatcgccgcgccggccgggcccggtatgcagggatcgctggacgccttgcgtccggcgttgccggagggtgccctgtgggcgcccgacgtgatcgactgccccgagcagatccgcccggcgctcaaccgcgccctgcgggacgtggtgctggtgccggatctggccgcggccgccacactgatcgccgggaacgccgagctgcgcgcggtcaccccggagggcgacgtgctcggggcctgggccgcggccggcggttcggcgaaggcgacgagctacatcgaggtgcaggccgcggtcgacgaggcgaaggccggtcgggccgccgccgaggagcggatcgccgagctcaaggagcagctgtccgaggtccgggcccaggtcgccgagctcaagcaggcggtgcaggtcgcggcccaggcgaagcgggccgccgagggcgagcgcaacgcggccgcccgccggctggccgagttgggcgccgcggcccgctcggcgagggcggagagcgagcggctcggcgcgtcccggcagaaggcggaggcggcccgggaggccgacctgatgcgggtggccgagctggaggagcggctgcggctggccgaggacaccccgatcgacgaggaaccgtcgaccgaggagcgcgaccggctggccgcgctggtgccgcaggcccggcagaacgagatggaggtccgcctcgcggtccgcaccgccgaggagcgggtctcgtcgatcgccgggcgggccgattcgctgctgcgtcaggcgaaccaggagcggctagctagctag

SEQ ID NO: 3959 - DNA, 996 bp, Actinoplanes utahensis
ttgaccggatcgctggtcgccgcggccgagacccgggaccggatcgcgcacgagcgaaccagtcgcgaggccgagctgcaggaggtccgcgccaccgcgaagcgcctggtcaccgagctggagcggctgaccagtgaggtgcaccgggacgagatggcccgggccgagcagcggatgcggatcgagcagctggaggtcaaggcggccgaggacttctcgctcgacgtggacaccctgatcaccgagtacggcccggagcagccggtgccgccgacccaggccgaggtggccgccgcggagcgggacggcaagccggcgccggagccggtcccgttccaccgggccactcaggagaagcgggcgaacaaggcggaacgcgacctgaccatgctcggcaaggtcaacccgctggcgctggaggagttcgccgcgctggaggagcgtttcaagttcctctccgaccagctggaggacctgaaggcgacccgcaaggacctgctcaccgtggtcaaggacgtggacgaccggatcctcgaggtgttcacctcggcgttcgaggacaccgcccgcgagttccagcaggtcttccaggtgttgttcccgggcggtgagggccggctgatcctgaccgacccggaggacatgctgaccaccggtgtcgaggtggaggcccggccgccgggcaagaagatcaagcggttgtcgctgctctccggtggggagcgctcgctgaccgcggtcgccatgctgtgcgcgatcttccgggcccggccctcgccgttctacatcatggacgaggtcgaggcggccctcgacgacgtcaacctcggccggttgattacgctcttccagcaacttcgggagaagagccagctgctgatcatcacgcaccagaagcggaccatggaggtcgcggacgccctctacggcgtcaccatgcgagccggcgtcacgcaggtgatcagtcagcggctcaaccgcgacacggaggattag

SEQ ID NO: 3960 - DNA, 618 bp, Actinoplanes utahensis
atgcgcgaccgcgcccgggccctgctcatcgacctggacggcgtgctgcgccgcttcgacccggccccgatgatcgccgtcgaggtgaggtacgggctgaaaccggccgccctgctggagactgcgatgtcgtgggacatctaccggcccgcgatggccggcgagatcaccgacgaggagtggatgcggctggtcgccgaccggctgccgctggagcccgccgaggcggccgccgcggtggccgagtggcagccggcccggctcggcgaggtggacccggacgcgctggagttcgtccgcggggtgcgcgccgccggccgcccggtcgggctggccaccaacgccaccgaccggctgcgcgccgacctcgacgcgctcggtctgaccgccgaggtggacgtggtgctcagctcgtgggagatgaaggtgcacaagcccgcaccggagtacttcgagcaggcgtgccaggccatcggcgtaccccccgggcaggtgctcttcgtcgacgatgacgaccgggtgatccggggcgcgcggtcggccggtctgtccggatatcggtgggccggtaccgagcatgtgccgtatctccggaaagcgctcgacatcgattcgtga

SEQ ID NO: 3961 - DNA, 600 bp, Actinoplanes utahensis
atggggcgcatgtcggcttttcgcggcttgaccgcggtgctcctgctcctgggtgtggcggcgtgcgacgtcgcccacgacggcgagccgctgtacaccgccggcaccccggcgccggcgggaagcggcccggcgccggccggcttcgcgccggtcggcccgggtgaccggatccagccggggcggcagctcaccttcgcgaccgtgcagtccggcggccggtggatgctcaccgtcggcgcggacggggtcgtggtgctcaccgaccatctcgtcgaccaggcgctgttcgtggtcaccgagaccacgccgggcgccggccggttcctgctgaagacggcgaccggcgagcagtcctgcctgcaggtgcactcgccgggcaggggcagcgcgctgcggctcaagacggcgccctgcgacccggcccagcacgatcagatcttcaccttcccgctggcgcacgacggcaagggtgtgctgatcgaggtgaacggtctctacgccttcgccgccaccgacggcggcccgctggtggtgcaggagagcggcgagggcgacgcgatgaccgccttctccgtccgcgaccagggccccgcctaa

SEQ ID NO: 3962 - DNA, 522 bp, Actinoplanes utahensis
atgactacctggaccgcgcccgaggcgcaccgcgtacccgaaccgcacaccggcgacgagcgcgccatgctccagggctggctcgactatcaccggcagacgctgctgctcaagtgcgccggcctgaccgccgagcagctcaagctggccagcgccgagccgtcccggctgaccctgctcggcctggtccggcacatgaccgaggtggagcgctggtggttccgcaaccgcacgctgcaggaccccacggtgggcgacgtctactgcaccgacgacaaccaggacggcgacttcgacgacgtgccgggggcgaacgcggaggccaacttcgccgccttcctcgccgagatcgaggtgtgtgacgcggccgtggccgagctgccgctggagcacgagttcccgggccggcgcgggccgatcagcctgcgctgggtgtacacccacatgatcgaggagtacgcccggcacaacggccacgccgacctgctccgcgagcggatcgacggcgtcaccggcagttag

SEQ ID NO: 3963 - DNA, 1725 bp, Actinoplanes utahensis
ttgggaaggatgtgggcacccccagaccattggaaggccggtgccgtgaccgcgcaactcctcatcgggcccgtgctccgccgggtcgtcgccgatcgcgcgacgatctgggtggagacgagcgcccccgcgcaggtgcgggtcgagaccgacggcggcgccgccgggtccgccccgaccttctcggcgtacgggcaccactacgccctggtggtggtcggcgggctcgccccggacgccgcgcacgcgtaccgggtgctgctcgacgaccgtgaggtgtggccggtcgccggcacgccgtacccgccctcggtgatccgtacccgggccgccgacgacgccgcgcagccggtcagcctgctctacggctcgtgccggcaggccaccccgcaggccaccgggcggcagctgccgccggacgcgctggacgcgtacgcgcggcgcctgatggccgagccggagcaccgccccgacctgctggtgctgctcggcgaccaggtgtacgccgacgagacctcgcacaaggtgcgccggttcctgcgccggcgccgcgcggccgggcacgacgggccggccgaccaggtggtcaccttcgaggagtacacgaagctctacctggagtcgtggcgcgacccggaggtgcgctggctgttctccaccgtgcccagcgtgatgatcttcgacgaccacgagctgatcgacgactggaacacctcggcgtcctggcgggccgacatggcccggcagccgtggtggcgggagcggatcgccggcgggctcggctcctactgggtctatcagcacctgggcaacctgagcccggaccagctggacgccgacccgctgttccagaaggtgtcggtcgccggagacgccaccgacctgctgcgcgagttcgggctggcggtcgacgacccgggctcggcggagaacaccgacgtgccctaccagtggagcttcgcgctggacctgggccgcacccggctggtggtgctggacaacaggtgcaaccgggtgctcaccccgggcgcccgggcgatgctgccggccgccgagtgggactggttcctcgaccaggcccacggcgactacgaccacctggtgatcggctcctcgctgccgtggctgatgccgcccgccatccaccacctggaggcgtggaacgaggcgatcaccgagtcctggagcccgcgctgggcggccttcggggagaaggtgcggcgcgccttcgacctggagcactgggccgcgttcggcaagtcgttcgcggcgctcggcgagctgttccggcggctcggtgagggcggcgtgggcgcgcccgggcaccgggtcggcgccggtggggcgtacgcggcgcccgcgtcgatcagcgtgctctccggggacgtgcaccactcgtacgtggcccgggccgacttcgggcacgccatggccaccccggtgatgcagctgacctgttccccgatccacaacgaggtgcccctgccgctgcgcccgctgatgcgggtcagctggctgccaccggtcgcccgggtcgcccgtgggctggcccggtcggccggggcggccaagccgctgatccggtggaaacggctctccgggccgtacttcggcaacgcgatcggcacgctgatcctggacggcgccaccgcgcggacccacatcgagggcaccaccaaggacgggcggctgcacgaggtggtggcgaccacgtaccggccgtga

SEQ ID NO: 3964 - DNA, 1218 bp, Actinoplanes utahensis
atgaccaccccgaatcgccagtacgtggcccacgccacggccgggcggcgcatctgtcaggatttcggcatggaatacgtggtcaccgcattgatcctgctggtcgtcctggtcgtgggcgcggtgggactggtcgtgccccggatgcgccgcaaggagcttccgccgccgacggttccgcaggtgcccgcggaacaggagctgccgccgctcatcgagaagccggtcgagccggtcgagccggtcgaggtggttcaggagccgccggcgccggtcgtcgagacgcccgagccgaccgccggccgtctggtccggctgcgggcccggctggcccgctcgcagaccgccctgggccggggtctgctcagcgtcctctcccgggaccacctggaggacgacgactgggaggagatcgaggacagcctgatcaccgcggacgtcggcgtcgaggccacccaggtgatcgtcgcgcggctcagggagcgggtccgggtcctcggcacccggaccgtcgccggggtgcgcgagcagctcgtcgaggagctggtcgcggccctcgaaccggatctggaccgcagcctgcggaccgccccgcacgacggccgccccgcggtggtcatggtggtcggggtcaacggcgccggcaagaccaccacctgcggcaagatcggccgggtgctgatcgccgacggccggaccgtgctgttcggcgcggccgacacgttccgcgccgcggctgccgagcagctggccacctggggcgagcgggtcggcgcggagacggtccgcgggccggagggcggcgacccggccagtgtcgcgttcgacgcggtcaagcggggcatcgacaccgggatcgacaccgtgctggtggacaccgccggccggctgcagaacaaggtcggcctgatggacgagctcggcaaggtcaagcgggtggtggagaagcacggtccggtcgacgagacgctgctggtgctggacgccacgaccgggcagaacgggctggagcaggcccgggtgttcaccgaggtggtggatgtcaccggggtggtgctgaccaagctggacggcaccgcgaagggcggaatcgtcatcgcggtccagcgcaagctgggtattccggtcaagctggtgggcctgggcgagggcccggacgatctggcgccgttcgaacccgcggccttcgtcgaggccctccttggggagaccgcgtag

SEQ ID NO: 3965 - DNA, 798 bp, Actinoplanes utahensis
gtgacgcaggagccgctgcgcgagataccgctgcacggtggcaacgtcagcacggtgtcccgggtcggtgacacggtccggcgtaacgccggaccgtggacgcccgccgtccacgcgctgctcaaccatctggagcgggtcgggttcaccggctcgcccagcgcgctgggcatggacgagaagggccgcgaggtgctcacctacctcgacggcgagtgcggggagtatccgctggccccgcactgggtgaccgaggaggcgctggtcacggtcgccaccatgctgcggatgttccacgacgcgcagtacggcttcgtgcccccgcccggcgcggtctggcgctcgttcggcccgccgccgccggacaccgaggtgatctgtcaccacgacgccgccccgcataacgtggtctggcggccggacggcacgctcgcgctgatcgacttcgacttggcctcgcccggctcccggatctacgacgtggcctacgccgcgtggacctgggtcccgctgttcagcgaccgggattcgtacacgctgggctggaaacggccgaaccggccgcgccgcctgcggctgttcgccgacgcctacgggctgatcccgcgcgaccggcaccggctggtccgcaccataaggaaacggatcgtcgaccacgtcgagggaatccgccggatggcggccgccggcgacccggccttcgtccggatcgtgcacaaaggacatctacgcaggccgatgcgggatctccggttgctggattacgaacggcacaccctggagtacgccctccggtga

SEQ ID NO: 3966 - DNA, 1365 bp, Actinoplanes utahensis
atggacaccggtaataccgcgtggttgctcctgtcgtctgcactcgttttgctcatgacccccggcctggcgctcttctacggtggcctcaaccggtccaagggcaccctgaacatgatgatgatgagcttctccagcatcgggatcgtctcgattctgtgggcgctctacggcttcagcctctcgttcggcgccagcggcaacgcccgcctgaacaacatcatcggcaacctcacccagtacggcggcaccgacatcagctgggccggtgacctctggggcaccacgaagatcccggtctacgtcttcatggccttccagatgatgttcgccatcatcacggtcgccctgatcagcggctccctctcggatcgcctgaagttcggcggctgggtgctcttcgccatcggctggttcaccgtcgtctacgtcccggtggcccactgggtctggggcggtggctggatcggggcgaaactgcacgccctcgacttcgccggtggtaccgcggtgcacatcaacgccggcgccgcggcgctcggtgtgatcctggtcctcggcaagcgggtcggctggccgcgggacaacatgcgcccgcacaacgtcccgttcgtcgccctcggtgccggcctgctctggttcggctggttcggcttcaacgccggctccgagctgaccgtcgacagcgtcaccggtgtcgcgttcgtcaacacgcagctcgccaccgccgccgcgctggtcggctgggtcgccgtcgagtggatccgggacaagaagccgaccctggtcggcgcgtcctccggcgccgtcgccggcctggtcgcgatcaccccggcctgtggcttcatcgccccgctgccggccgtgctgctcggcctggtcgccggtgcggtctgcgccctggccgtcggcctgaagtaccgcttcggctacgacgactcgctcgacgtggtcggcgtccacttcgtcggtggctggatcggctcgctctccatcggcctgttcgccaccaacaaggccaacagcgcgatctccagcgcgctcggcgccaaggacggcctcttctacggcggcggcttcacccagctcggccggcagttcgtcggcagcgccgcggtcaccgtgttctccctggtcgtggcggccctgatcgcctacgtcctgaaggcgatcaagctgctgcgggtcagcaccgaggcggagatcggcggcatcgacatcgccgaccacggcgagagcgcgtacgacttcaccccggccgccgggtccggtggcggcagcgccttcgccctggcgggcctcggggcggccaggacggtcgacgccgacgggaaggctgacaccagccagaaggtcgccggttaa

SEQ ID NO: 3967 - DNA, 339 bp, Actinoplanes utahensis
atgaagctggtgaccgcggtcatcaagccgtaccagctcgacgcggtgaaggaggctctgcacgccctgggcgtcgccgggctgaccgtgagcgaggtgcagggatacggccggcagaagggccacaccgaggtgtaccggggcgccgagtacaccgtcgagttcctccccaagatcaaggtggaggtgatcaccgacgagatcgacgtggagaagatcgtcgacgcggtggtgaccgcctcccggaccggcaagatcggcgacggcaaggtctgggtgacgacagtcgacgacgtcatccgggtccgcaccggcgagcgcggcctcgacgccctctga

SEQ ID NO: 3968 - DNA, 2271 bp, Actinoplanes utahensis
atgaccaacccgttgagtgagcccccggccccgcccgcacggccgacggccggtggctcgctcgacaaactgcgcgaccacatcggggccgcggcacgcgacgagcgcgccgcggctctcgacgtctggctgcgtcagctgttccccagtcacctgcccggcgtcagcctgctcgcggtgggcgggctcggtcggcgcgactgcgcgccgtacagcgacctcgacctggtgttggtgcaccgcggggtggccggcatcgaccggatcgccgccgcgctgtggtatcccatctgggacgcccggctcggcctcgaccactcggtgcgcaccctgcccgaggcgctgtcggtcgcccacgacgacgtcaaggtcgcgctcgggctgctcgacgcccggcacgtggccggcgacgagacactctccgccgagctgatcgcggccaccggcgaccagtggcggcgcaccgccgtacgcctgatgccgcagctcaaggagctcaccgagacccgctgggcgagccacggcgaactggccttcctgctcgaaggcgacctcaaggaggcggccggggggctgcgcgacgtcaccctgctgcgcggcgtcggccgggccgggatcgccgacaccatgcgtcccgcggtgcgcgccgccaccctgcggctgctcgacacccgggacgccctgcacctggccgtcggccgtcgcgtcgaccggctggtcgcccaggaacgcggcgcggtcgccggcctgctggagatcgaggatccggacgccctgctgcgccgcgtctccggcgacgcgcggaccgtcgcgcacgcggtcgacgacgcctggcgggcgatcgaccggttgcgcggcacccgccgccgtggcggcatcccgtccgcaccgtcgcgccgcccggtcgcccgggacgtggtcgagcaggacggcgaactcgtgctggcccgcaccgcgatcggcccggtccccgaccccagcctgtccctgcgggtggccgccgcggccgccaccgtgcaattgccgatcgcccgggccacctgcgagtggctggccgcgttctgcccgccgctgcccaccccgtggccggccgccgcccgcgccgccctggtctcgctgctcggcgccggccccggcctgctcccggcctgggagacctgcgaccggtacgggctgatcgacgcctggctgcccgagtgggcccggatgcgcagcctgccgcagcaccacccgatccaccggttcaccctggaccggcacctggtgcagaccgcttacgaggcgacccggcacgcccgtgaggtggaccgccccgacctgctgctgatcggtgccttcctgcacgacgtcggcaagggcctgcccggcgaccacagcctcgtcggcgccccgatcgccgcggacatcgccacccggatcggcctgccaccggccgacgtggccaccgtcgaacggatggtccggctgcacttgctgctgcccgacatcgccacccgccgcgacctgagcgacccgaagaccatctccacggttgccgagcaggtcggcgacccggccaccctggacctgctgcacgcgctggcccgggccgactcgatggccaccggcccggccgcctggtcggactggaagggccggctgatggccgagctggtccgccgggtgcacaccgcgctggacaccggcgccctgccggagccgccggaacccgatccggaactgctcagcggcaccctgccggtggtgcacctggacggcgaccgggtgtcggtggccgcggccgaccgtcgcggcctgctcgccggggtggccgcctgcctcgccatgcaccggctggacgtggtcgcggcgaacaccggcacggtggacgggcgggcgatcgtcgaattcctcacccagccgcggtacgggacgccgtacgagccggtcgcgctcgccgccgacctgcgccgcgtcgcgtcgggggacgtctcggtgacccagcgggtgcgggcccgggcgatgagcgcccgcggtggcaccgccgaaccgaaggtgatctggcagcgggccgcggccaccggcgcggtcgtcctggagctgcgcgccgccgactcgccgggcctgctctaccgggtgaccgcggcgctggacgaggccggtgcggaaatccgggcggcccgcatctccaccctcggcggcgacgtggtcgacgcgttctacctggtcggcgactggtcgtcggacagcgaacgggaccgggtgcgcgacgccgtgctgaccgcggtgtaa

SEQ ID NO: 3969 - DNA, 2535 bp, Actinoplanes utahensis
atgatcgggtcactgctggacgaacaaccggcgacgctggtcgccgccgcggtgcgcaaccgcgccgtcggcctccgcgacgagctggcctatgccgggctgcgcggcaccggcacgttgagccagctgctggccgccgcccgtgccgggcgccgcgactggctgcgcgaacggggctgggcggtgcaacccgcccggctggcgatgctcgcgcagatcatcgcgctgcaggacgtgctgcccggcgaccgggccgacgcgctggccctcttcgagctgctcggcccacgggcggtgccaccccggcagcgcgccgtctacgcccagctggccgggtccgcccggatgcgggtggaccggcaggtgcgccgggagatcgccaccgacctggccaacccgttccggcatcccggccggtcggtgcgacggtggctgcggcgcttcaccgaggggctgccggagcccgcggtccgcctggacgaccgggccgacctgccgcccttcgaccggctgaccacggccgcgccggcgccgatcgagcggccggagaagatcagcgtggtggtcaccgcgtaccggccggacgagggtctgctcaccgccgtccggtcgatcgtccggcagtcctggcgcaacctcgaaatcctgctcgtcgacgacgcctccgggcccggattcgacgacgtgctgcggcgcgcggtggcgctcgacccgcgggtgcggctgctgcggcagaacgtcaacgccggcacctacgtggcccgcaacgccgggctggacgccgccaccggcgacttcgtcaccttccaggactccgacgactggtcccacccgcgccgcctggagctgcaggtcacgccgctgctggccgatccgcgactggtcgcctgcacctccgacgggcgccgggtcaccgccgacctcgtggtcacccggctcggccggcgcggcggcaaactcaacccgtccgcgctgctgctgcgccgcaccccggtcctggaccgggtcggctacctcgatgtggtccgcaagggcggcgactccgagtacatcgagcggatcgtcgccgcgttcggcccgcgcgcggtccgccacctgccgatccacctcgcgctgatccggctctccggcggctcgctgtcgcgcgccgagatcctgccctactggatccacccggcccgcgccgtctaccgctccggttacgtcgcctggcaccgccggatcgcggccggcgccaccccggcccaccggccgcgcgacggcgcgaaccgacccttcccggcgcccgcccacctgttgcgctccgatcggattcacccttcgattgccgcgtacgacgtgatcgtcgccgccgactggcgcaccctcggcgagagccagcggtccgccctcgccgagatcgacgccctgctcgccgcccggatgcgggtagccgtcctgcacctggaggactggcggcggcccgcccgggaacggatcccggtacaccgcaccatccaggaccgggtcaacgccgggcggctcggccaggtcgccctcaccgacgacgccgagtgcggcctcctgctgatccggcaggccgagctgctccgcttccccccggccgaactcctctccccgccgtccccaccctccgcgtcgcccaccgttccgggaggtggactgcgtccgggccgggtgctggtgctggtcgacgaggagccgagcggggcggtgcggccggtgccggtcctcggcgccgaaccgctgtggtgcccgcaggggccggacctgcgtgcggccctcaccaggctgccgctgaccgatttcgacctccccacggtcgctgtggcgcagtccctgccggggcggtcgccgtccgcacggccggtggtcggcgccgagatcaccgaccggcggcagctggccctcctggaccggctgaccgggatggacgtccggatccgggtcgccgacggggtccacctgccccggcagccggccggccggctcgtctaccgcaccgcggacctcaggtcgctggacttcctggcccagctcgacttctacctggactcggtcggctcgcggcggtcggtgctggacgccgtggcgatgggctgcgtggtgctgaccacggtcccgggcccggtcgggctccgctgccgcccggaccgggtggcgggggccatcacccagatcgtggcggatccggaccgggccgccgaacgactccgccaggaccggtcgacgctgcgcaccgcccacgatccggccctgttcgtctcgcgggtggcggcgctgctgtcagccaccacctcggagccggcaccggacatttcgggtgctgcggcatcggacccgggcacctcgggagtcgtcgacccgggtgctgcggcatcggacccggccacctcgggagtcgtcgacccgggtgctgcggcatccgacccggccacctcgggagtcgtcggtgcgggggccgcggcttcggatgccgcgggggccccggtgctgccggccgaggcgggggcggcggtgcgtaacgctccgtag

SEQ ID NO: 3970 - DNA, 1044 bp, Actinoplanes utahensis
atggtccgcaaactacgccggctggccggccgggcacgggctctcggcccgctcaccatcggcgccgtggtgatcacctcgctgctggtcgccgcggtcaccgtggccgccgtgtacgacgcggcccggatcgcggtctgcctgctcgcgctgctgctcgcggtggcggtggccggggtgctccgggtcaacctgcggctggccgggatgcgggccgaccggcgggagatccgcgacctgcgggtggtgctcgaccagacgcagcgccgggtggtgtccgcggtcgaacgccagcggctcaacaccgaggaccggcaccgggaactgttcgacgcggtggcccgggtccagcggatcgccgaccgcggtgtccgggacctgcggttcgccgtgccccgcgaggtggaggcgaccgtgcagctcttccaggggctgaccccgcgcgcgccgatgccgtcctccggcgacttcgcgctcaacccgaccgacctgctggagctgctcttcctggtccgcacccggcggccgcggctggtcctcgaactgggcagcgggacgtccacggtgtggctcgcctacgtgctcgaacaggtcggcggccggctgatctccctcgaccacgacccggactacgccgcccgcacccgcgccgcgctgcgggcccacgggctgaccggggtcgccgaggtccgcgatgccccgctcaccccggtcgagctgggcgagcggtccttcccgtggtacgacccggccgccctcgacgacctgaccggcgtcgacctgctgctggtcgacggaccgccggccgcggtcggcccggacagccggtatcccgccctgcccgtcctcgaaccccgcctcgccgaccgcgccaccatcgtcttcgacgacgcgaaccgcagcgatgaacaggccgccatcgagaactggctggccgccgtcgacggcctcgcccgcgaaggcgagctgctcggccgccacgccgttctctcctacgaccgctccaccagactcaccacagctacggctaccgcgccccgctga

SEQ ID NO: 3971 - DNA, 102 bp, Actinoplanes utahensis
atgggcgacgatcagttgtcggccgcggcgcacgacatctgctgcgagcattcgaccttgcttccgaccgtcagattccgcctggcccggccggatcagtaa

SEQ ID NO: 3972 - DNA, 486 bp, Actinoplanes utahensis
ttgcgctcgctgttccgccgccttgccgtcgtcgccgccctcgccccggccgccgccctcggcgtcacgctgctggcgaccccggccgacgccgccggagtctccgaggcgacgctgcaggccgacatcgtcaagctcaccaacgcccagcggaccgcgcacggctgcgccgccctgaaggtcgacgcccggctgatcaccgcggctcgcgggcacagcgcgtacatggctcagggtggggcgttcagccacaccggcaagggcggctccgacttcgtcgcccgcgagaaggccgccgggtacccgaagccgtccgcggagaacatcgcctggggataccgcagcggcaaggacgtcgtcgcggcctggatgaagagcccgggacaccgcgccaacatcctcaactgccagtcgaagacggtgggagtgggcgcgatctacagcaagggcggcgcaccctacttcacgcaggacttcggttactga

SEQ ID NO: 3973 - DNA, 2295 bp, Actinoplanes utahensis
atgcggacgcacatcaccccgggcgcgtacggatccgccctgctcgaccggcatctgcggagcctgcgcaagaccggcccggacgggcccgcgacggccgcgctgcgagcccggtccgcggacgcccgggcgctgctcgcgtacgccgccggcgtcaccgacctcgaccagttgctcagccgggcccgcgccggacgccccctgccggaccgggccgacccgtgggacgtcggcgaactggcccgggtgatcgccctgcaagatctggagccggaggaccgggccgacgggctggccctgttcgacgccctgctgcgggcccacgggccggccgcgattgcccccgcccaccagggtctgcatgtgcaactcgcgttcccggccggtcgggcggccgacctgctggagcgctaccgtgcggtgccccggccgatccgcgaggcgctcgccgtcgacctggccgcaccatcgacctggctgacgcggttcaacggcctgctcccggcgcccggcatcgccctgtccgagggcgccgggccgcgcttcgaccggatccggcccgggatcgccccgaccaccgccggcgggaccctgatcagcaccatcgtcaccacctaccggcccgagccggcgctgctcgtcacgatccgctcgctgatcgcgcagagctggccggaccaggagatcctgatcgtcgacgacggctccccggacaccgcgatcctggaccgggcggccgccctcgacccgcggatccgggtgctgcggatgcccgtcaacggcggcacctacctggcccgcaacgccgccctggacgcggctgccggcgagttcgtcaccttccaggactccgacgactggtcccacccgctacgcctggaacgccaggtggcgccgctgctcgccgaccgtggcctggtggccgtcacgtccgccgggatgcgcgtcaccggcgacctggtgatcacccgcccggggcatccgcaccatcggacgtacaacctctcgtcgttgatgatccggcgggagccggccctggagcggctcggctacctggacaccgtccgcaagggcgcggacgcggaatacgtcgaacgggcccgcgcggtcttcggccggcccgccgtccagcacctcggcggggagaccctcgccctgatccggctctccggcggctcgctgtccagcgccgatcaggcccccggctggctgcacccggcccggcaggcgtacctgtcggcatgccaggcctggcacacccggatcgtcgccggccgggaaccggcccgccggccacgcaccccgcagagccgcgccttcgccgcccccgccctgctcaccggcaccgcccggccggaaacctacgacctgatcctggccggcgacttcaccgcaccggagagcgccggcccgctgcgcgccctgaccggccgcgccgtcaccatggccctgctgcacctgcccaccctcgacgccgccggccgcaacctcgacccggaggtccaacgcatgatcaacctggccgaggtccgccaggtgttcctcgccgaccgcgcgcacacccggcttctggtggtccgcggcccggccgcgatcgctttcgccgccggcctgcccagcggcatcagcgccgaccacgtcgtgatcgagcacgatccggactggtcccccgccgcggaggcgctgaccgccgcctcgatccgcctgttcggcgtcgaaccggtcaccgtcccactgccgtgcaccgtcgacccgcgccgctggcaggcggtccgcacccggcccgccggcgaccgcccgatcctcggccgggccaccgctgacggccccgaccacctgcgaaccctgcgccgactggtccgcgacgccccggaatgcgacgtccgcgtgctggaccggtccgccgacgccaccaccgccttcggccggcgcaccccgctgaactggctcgtctaccgcgagccggacgtcaccccgcgcggcttcctgcaccagatcgacttctacctcggcctgggtgaccccccggccaccctgctgcccgccctggccgccggctgcgtcctgctgctccccccggagagggaggcggaatacggctcagcggccgtctactgcaccccggacgacctgcacccgacgatgcggcggatgcaccgcagcccggaacgctgggcagcccagagcggccgcggccgcgacttcgcccgccgccaccaccacggcgtgtacgccgacgcggtcctgacccagctacgcccggccgagctgccgaagccccgcaccgccggctga

SEQ ID NO: 3974 - DNA, 2196 bp, Actinoplanes utahensis
atgaccgcgaccgtccatgacgtggcgatcctctccgacttccggtatccgggcgggaactcggcggcgatcgcggccgaggtgcgcgcgcaggccgaggccgggttgcggaccgtcctggtgcacgtgccgtcgccgcacaaccgggacgggttgccgttcagcccgcggatcgccgagctgctccgcgacgggtcggccgagctggccacgccggacgcggtgacccaggccaagctgctggtgatccggcagccgcggatcttcaccgaggacctggcggtggtcccgcggatccgggccgggcgcaccgtgatggtgctcaaccaggcgcccggggatgccgccgatccggcgcggtactacgacttcgccgaggtgcgcgaccgggtcgagttgtacttcggtccggagatcgagtggatgccgatcagcccgcagatccggcagggcctgtccgatttgtcggaccaggactggcatgagatcatcgatgtgggcgagtggcccaacgatgtcccgcggaagcgggacatcccggtgatcggccggcacgggcgcgccgacctggtcaaatggccccccaccgcgggcgagctgctccaggcttaccccgacaagccggacatcagggtacgcgttctcggtggcggtgagatcgccacccgcatcctcggccgccgccccaccaactgggagatcatcccgttcggccaggaggagcctctcgccttcctgcgcagcatcgatttcttcgtctacttccaccaccccgatctggtggaagcgttcggccgcacgatcctggaggcgatggccgccggcgttcccgccatcatcggcgagcacttccgcccgatcttcggtgacgcggccctgtatgccaccccggccggcgtcgagcccctcgtccgccgcctgtgggccgacccggcgtcctaccgcgcggtcgcggccaaggcccgcgagttcgtcgacacccgctacggcgtcgcctcccacctggcccgcctcgccgaccgcggcgccggcgcccgccccgccgcccaccgggcttccggcacggcccggcacggcgagcccaccccccgcccccgcccggtcctgatgctcagcgacaacggcgcgggcctcggccacctgtcccgtctgatggcgatcggccggcgtctgcccgagcagcatccggcggtgatcgccacccagtcgtacggcgcctcggtcgcccaccgcgagggtttcctcaccgagtacctgccgtcccggaccgttctgggcctggccaagcagcgctgggccggtttcctgcaggcccgcctggaacacctggtcgacctgcaccgcccggccgtggtcgcggtcgacagcgtcccgcacgagggcatcgtggcggccgccgcggcccgcccggacgtcacctgggtgtgggtgcgccgaccgatgtggcggcgcggcaccggcgccgagtggatcgcccggggcgccgccttcgaccggatcctggagcccggcgagttcgccgcggcggtcgatcggggcccgaccgtggcggaccgggccggcgtgcacgcggtcgacccgatcatgctgctggaccgggcggacctggccgcgccggacgaggcccgggccgcgctgggcctggaaccgggccgtccggccgcgctgctgcagctgggcgccgggaacatcaacgacatcgcctcgccggtcggccggatcgcccggcagctgcgcgaggccgggttccaggtgctgctcgccgagtcgatgatcgcgaccgaaccgatgccgccggtgcccggggccacggtggtcaaggtgtacccgatcagccggtatctgcgcggattggacctggtggtcagtgcgtccggttacaactccttccatgagctgctcgctttcggcgtgccggcggtgttcgtgccgaaccgggagacgtccctggacgaccaggtggcccgggcccggttcgccgcctcctccggggcggcgctgtgggtggaggacccggacagcgacgagctggaccgggtgctggccgaggcggtccggcccgaggtgcgcgaacagctggtgcgccggtgcggggaggtgggcttcgacaacggagccggggccgcggcacgctggctggcggaactcgccgccgaaaccgtacgaagagccgagaacgtacgaagcggagcgtga

SEQ ID NO: 3975 - DNA, 261 bp, Actinoplanes utahensis
atgtccgatctgtccaccaagccggagctggagagactgcactgggagatcgccgcgctgaccgggcggatgcggtcggtcgagttggagcgcgactcctggcgggcccgctgcgaccggctcgtcgagcagcgtgaccgggagcgcgagaagagccggaagctggccgacagcggctcgtaccggctgggccgggccctggtgtcgttcgcccgcgacccctggcacacctcaccgcggctggtccgcggactggcctag

SEQ ID NO: 3976 - DNA, 372 bp, Actinoplanes utahensis
gtgcccgggcaggccggccggccgccggtcgccccgcgccgtccggcccacctgtacgtggcgatcgggctggaccacgacgccctgcgggacttcctggtgacggtcaaccagcggctgctggtgacgccggaccaccggccggtggtgctcaccgacgatccggcgttcgccctgctgcgcaagctcggggtgctgatggagtacctgccggaccgggccacctgggagcggcaccggcccgaccgggcctgggacgacctgctcgccgagcggcttgcccagctctgccgggaccacaacaccgagcggaccgtggtggtggaccggctgcacccgccggccctggccgacctactgaacacgcggtag

SEQ ID NO: 3977 - DNA, 1965 bp, Actinoplanes utahensis
atgagcctctcgccgaacttccggtccgacgtcgagggccttcgcgcggtcgcggtgctgctggtcgtgctgggccacgccggggtgccgttcgccgccggcggctacgtgggcgtggacgtcttcttcgtgatctccggcttcctgatcacctcgctgctgctgcgggagcgggcggccgggcggatgtcgatccgccgcttctacgcccggcgtgccctgcggttgctgccggccgccgcgctggtgctggtcagcacgctgctcgcggcccggctgtggctgccgccgatccggatgggcgacctggccagggacgcgctgtcggccgccgggtacgtcgccaatctgcggttcgcgctgaccggcacggactacctcaacgccgacgcaccgccgtcgccgttccagcacttctggtcgctggccgtggaggagcagttctacctgatctggccgctgctgctgatgctgccgcggcgccggccggtgctgatcgggctggtgctcgcctcgttcaccgccggggtgtgggaaaccacccggtcggcgccgtgggcctatttcggcccgcacacccgggcctgggaactgggcgccggggcgctggtggccctgttcgcgccgaaggtccgcaacgggtggctgggcggtgccgggctggccgcgatcctcggggcggcgctgtggtgcgacgacgccaccgcgtaccccggcttctacgccctgctcccggtggccggcacgaccgccgtgctgatcggcggcctgcccctgctggaggcccggcccctgcaggcggtcggccggctctcctacggctggtacctgtggcactggccgctgctgctgatcgggccggccgcgctcggccgggatccgtcactgccgctgtcgctgctgctcgccgcggccgggctcggcctggcctgggtgacctaccacctggtggagaacccggtgcggcaccacccgtggctgcgcgtgcggaccgccccggcgctcgggctgggcgccgccctgtccgccctggtcgccgccaccgcggtcaccatcgcgctgctgccgcacccggtgccggccggggcggcgatccgtgacctgcgggccgccacggcgcatgccaccgacccgtacgcggtggtcacccgggcggtccgggcctcccgcggcctgcgcgagctgcccgccaacctgacccccacgctggcccgggtcaaccaggacaaggcccgcgtgtgggcggacggctgccacgtcgaggcgccggtcctggtggcgccggccggctgcgaatacggcgacccggggtcgacgaccaccgtcgtgctctacggcgactcgcacgccgcgcagtggttcccggcgatggaccggctggccgagcagcaccactggcggctggtgtcgatcagcaagtcgtcgtgctcggccgcggacctgccgctctggcacgacgggctgaaacgtgagtacaccgagtgcgccgcgttccacacctcggccgaggcccggatccgggcgttgagaccggcgctcgtggtgatcgggtcgagcttcaactaccggccggtcgacacccgcaccgacgaggcggcgcagtggcgggccggctggcagcggaccttcgccgcactgggggcggcgaaggtcgcgctgatcgaggacaccccgtacctgggtggtgagcgggtcccggtctgcgtggcccgccaggcgcgcctgaagcggatcaaccggtgcggcaagcccgccacgtcggccctgcgcgggccggcgcaacgctcggtgttgcccggcctgaccggggtcaccgtggtcgacccggatccgtggctgtgcaccgacttctgcccgccggtgatcggcaacgtgctcgcctaccgcgactccaaccacctgaccacgaccttcgcccagacggtggcgccgctgctggacgcggcgctaccgcgtgttcagtag

SEQ ID NO: 3978 - DNA, 1659 bp, Actinoplanes utahensis
gtgtcgggtggtcgtccacgtcgcaacctcgttccggcggccctcgttgcgtttgctgtgactgcccagacgctgagtgcccccgccgatccggacaccggcccgcagcggcggtccgggcagccgacggtcgatccgcgcccgctgtggcgcggcgtgctgctgcgctcggcactggtcccgctgatcgtgctgtccccgctggtcgccgcgcaacccagtgccgaccaccggttcaacgtctacgccaacggggcacgctacctgacccgcccgtgggaactcgtcggcgcggcggtcacctcggtcccgcaatacctgaacctgggcaacttccgcccgctcggccggatcgccgaatggctgctggacaccctcaccttcgcgctcaccgacgtgttcggcctgcccgccaacatctcgctgcgcctagtctccttcctcagcgcgatcctgctcaccctggccgcggtggtgctgaccgagtgcgtgaccacccggggccgggcgttcgccggcccgccgtcgctgcccgtcgcggtgctgccgttcgcggccgccggcggtttcgtggccgccggccggaccagcaccacgatcctgttcggcgggctctacttcctcaccgcggcgctggtgctcctggtcgccgccgcggcggcgcacctcacgaacaacaccggactgggcgtacgcccgatcgtgctcgccctgacgctcggcctcaccctggcggccttcaacgagatggcctggctggccctgccactggccaccgtggtcgtcccgatccgcgcccggctgatcctgggccggtcctggcgggacaccctgaccggggccggcgcccggttcaccgggctgctctgggccgggttcctgccggtcgccgtcccggtccggctgatcatcgcggcccggtgcgcggccgggcgctgctactccggctccgatgtggcgctgcccggcgccccgggcgcgctgcccaaccggctcaccgcgtggatcccgccgctgatgtggcagcgggcgagcgagggaccgtacggtcacaccctcggcccggccctgctgctcgccctgctcgcgatgctcccgctggtgtggaagctgcggcgggagctgcccggccacccggccgccgaccgccggcaggtgctcgcgctggccgcgaccgcgctggccgtgctggtcccggccgccgccatgggcgccctcaacgagcagatgcagcacctcgccgcggccggctggtgggggctgggctggcgggacagcgcgctggccggggccggcggcgccctgctgaccgtggccccgatcgccaccctgcggcagcaccgggcccggctcgccgcagtgctgctgctggccgtcgtcgcggcggccggcgcctcggccaaccgcgactaccgggccggcaccgcgtcggagaagccggcgttcgtgcacgaccgggtggcccaggagatcgtcgacttcgaccgctcggcggccggcgacgcccgtcggtgcgagctgcgccggcagttccgggacagcctgccaccgggccgccggaccggatacccgcccgagctgcgccgcttcgaccaggccgtcgacgaggcgacccgcgagctggccgggcggcgcttctgcaccggggcgccggcatga

SEQ ID NO: 3979 - DNA, 1047 bp, Actinoplanes utahensis
atgacccccggccgcgtctccgtggtcgcgccggtctacaacgagggcgccggggtcgaccggttcgtcgaccggatgcgcgaggtgctcgccggccacgactacgaactggtgctcgtcgacgacggctcggccgacgactcgtggcgccggatcgccgggcacgccgcgcacgacccgcgggtgcgcgggctgcggctgtcccgcaacttcggcaaggaggccgcgctgctggccggcctggaacacgccgacggtgacgcggtcatcgtgatcgacgccgacctgcagcacccgccggccgccatcccggacatgatccgccgctggcgggccggcgcccaggtggtcgaggcggtcaaacgcaaccggaccggccagtcgctgagcagccggctgggcgcccgggtgttcaaccacgcgttcacccggatgaccaaggtcgacctggtgaacgccaccgacttccggctgctcgcccggccggcgctggacgcgctgctgcagatgcccgagcactcgtcgttcttccgcggcaccagcagctggatcggcttcacccgggaaaccgtggaggtggacatcgaccatcgggagggcggcgcgtcccggtggaccgcccgctccctgttccggctcgcggtcaacgggctcacctcgttcacctccgccccgctgcacctggtcaccctggtcgggctggccttcgcggcgttctccgcggtgctcggggtgcagaccctggtccgctggatgcaggggcactcggtggccggattccccacggtgatcctgctgctgctggtcaccgggacgttcgtgctgctcggcctgggggtgatcggcgaatacctggcccggatccacgaggaggtccggggccggccccgctacctgctccgggacctggccggtccgcgccggatggccgagcattccggcggccgcctcggcccgctcgatgtcccggtggccgagcgggccggcgggggactacggtcgctcgatgtcccggagcagtgggtggagcgtgcggagcggcggtga

SEQ ID NO: 3980 - DNA, 420 bp, Actinoplanes utahensis
gtgcggagcggcggtgagccggtccgggcgctgctgcccggtccgcgcctggcccgcgtggtccgctacggactcagcggcggcgccagtgccctcacccacttcggcatcggtctgtgcggcgtccacctgctgcacctgcgcccggtggtcgcctccacgaccgggttcgtggccagcatcgcggtgtcctacgcgctgcagcgctggtgggtcttccgctcgacgacgggccacgcgatcgccggctcccggttcctgatcgtcaccgcggtcgccttcaccatcaacacgctggtgctgtggctcggcaccgaggtgctcgccgcgccctacccgatcgtccagccgatcgcgctgaccctgattccgctggtcaactacttcctcaactcccgctggaccttcgctcaccgttga

SEQ ID NO: 3981 - DNA, 1263 bp, Actinoplanes utahensis
ttgagctacgacgttgtcatcctcggcctggggtacgtcggactgcccctggcccagcaggcgatccgggccggcatgtcggtgctcggcttcgacgtcgacgagaccgtggtcaagtcgctggccgccggccggtcgcacgtcgacgacctgagcgacgccgacgtggccgagatgctggccggcgggttccgggcgaccgccgacgagaccgagatcgccaccgcgcgcaccgcggtgatctgcgtgcccaccccgctctccgagggcgacggcccggacctgcgggcggtgaccggcgcgaccggctcggtgggccgcaacctgcgcgccgggatgctggtcgtgctggagtcgaccacctacccgggcaccaccgacgacgtggtccggccgctgctggagcggctctccgggctgaccgcggggatcgacttccacctggccttctcgccggagcggatcgacccgggcaacgccgagtacggcgcgcacaacaccccgaaggtggtcggcgggtacaccaccgcgtgcaccgaggcggcggccggcttctacggccggttcatcgaaaccgtggtgcgggcgcgcggcacccgggaggccgagaccgcgaaactgctggagaacacctaccggcacgtcaacatcgcgctggtcaacgagatggcccggttctgccacgagctggacatcgacctctgggacgtgatcaacgcggcgtccaccaagccgttcggcttccaggcgttctacccgggtccgggggtgggcggacactgcatcccgatcgacccgaactacctgtcccacaacgtgcgcagcaagctgggatacccgttccggttcgtggagctggcgcaggagatcaacgcgacgatgccggcgtacgtggcgcggcgggcgcagaacctgctgaacgcggacgggcaggcggtgcgcggggcgaccgtgctgctgctcggcatcacctacaagccgaacatcgccgaccagcgggagtcgccggcggcgccgctggcccgccaactggccgcgctgggcgcgacggtgtcctaccacgacccgcacgtgggcacctgggacatcgggggtgttccggtgtcccggacggaggatctggagggtgcggtggcctcggccgacctggtgatcctggtgcagaaccaccgcgagtacgacgcggaccacctggcgcggctggcgaagcgcttcttcgacacccggggcgtcaccacgggccgggaagcgcatcgactctga

SEQ ID NO: 3982 - DNA, 1749 bp, Actinoplanes utahensis
atgcgtaattaccgacatccacccataaaaggtatagaccgcaacttccgtctccgccgcggcgttgaagcacgcgtggtgcggcgagaggacgacgtgaccctgcgggcgatgctgcggcgggcgccctggccgatccggcggcggatcgcccaggccgggaaccgcctgctgccccggatcgcgccggaccgccggctgcgggtcgcccggaccctggccccgctggccggccgggtcgtccgcggggcccgggtggtcaccgcgaccagcccggccgaggtgcgccgggccaacctcgaccgggtgaccgcggccctggacgcggccggcgtcgactggttccgggtgccgggcaccgacccgcggcggaccgccctcggcgtaccggaaaccgatcgcgacctggtggaccgcctcctggggcggctcgcgggcggtgatcgcgggatgatccgccgggaccgacgggtggtgagcgtctgttggccggtcaccgacccggccggcggcctggtgctgggtcccgagttcggctgtgacgtggagttctggcgaaccgaccgggaccacctgacggcgccgcggcgcaatccggtcgcggaccggttcccggccggcgagccggtggtgaccgctcccgaggcgaccttcggggcgttccgcgcgaccgacgaccacagcctgcaccgcacccgacgggtcttcaccaccgccgtcccggaccggatcgacttcccgatcgacgcggtctacacctgggtggacggcggcgacccggcgtggcgccggcgcaaggccgaggcgctggccggcaacccgtgggtggccgggctgcacgcgcaggcggccaacgactcccggtacgccagccgcgacgagctgcgctactcgatgcgcgcgctgcactgcttcgcgccctgggtgcggcacgtctacctggtcaccgacgggcaggcgccggcctggctgaaccgcgggcatccgcggctgaccgtggtcgggcatcgggagatcttcggcggcaccggcaccctgccgaccttcaactcgcaggccatcgagtcgcggctgcaccggatcccggggctggccgagcacttcctctacctcaacgacgacgtgttcctgggccggccggtcaccccggacctgttcttcaccgcgaccggcctgacccgcttctttccgtcgccgtccctggtcgacctggccccgcgcgggcccggcgaccggccggccgacgccgcggccaagaacaaccggcggctgatcgagcaggccttcgggcgggtgctgacccgcaagatgatgcacaccccgcacccggcgcgacgcagcgtgctccaggagatcgagcggcgcttcgccgaggaggtccggggcaccgcggaacaccagttccggcacccggacgacgtgtcgatgctctcctcgctgcagcagtactacgcgttcctgaccggccgggcgatccccggcgagatccggcaccggtacgccgacctggccgacccgcacaccccgctgcggctggccgccctgctgcgcgcccgggacgccgacacgctctgcctcaacgacgtggacagcggcgaggccgcggtgcccgagcagcgggcgctgctggccgagttcctgccggcctacctgccgttcccgtccccgttcgaactcacgcaccggcccaccggcccccgccggccggcacccgccccgtccccgcaactcaccaggagaattccttga

SEQ ID NO: 3983 - DNA, 288 bp, Actinoplanes utahensis
atgcgcgaggttgcaccggcacggcatggtggtaggcagtcgatgaccgggaggctcgggatgggcaaagcagtgatgttcgtgctggcgctgatcggcggtgtggtcgtggtgagctgggtcttccacgcgctgttcggtgcgttcttctacctgctgctggtcgccgcggtggtcggcggcgggctctggctctacggcaaggtcaagcgcgagatcgccccggggacccgcacgcagcggcggatcgaggcggccacgaagacctaccggatgcgcaaccggtga

SEQ ID NO: 3984 - DNA, 1554 bp, Actinoplanes utahensis
gtgtttgacaccctgagtgaccgcctgtccgggatcttcaccaagcttcgcggtaagggcaagctcaccgacgccgacatcgacgccaccgcacgcgagatccgtctcgcgctgctcgaggccgacgtggcgcttccggtggtcaaggcgttcatcgccaacctcaaggagcgggcgcgcggcgccgaggtctcccaggcgctgaaccccgcccagcagatcatcaagatcgttcatgaagagctgatcaacacgctcggtggcgaggggcggcggctggtcttcgccaagcagccgcccaccgtgatcatgctggccggtctgcagggcgccggcaagaccacgctcgccggcaagctgtcccgctggctcaagaaccagggccatcagccgctgctggtcgccgccgacctgcagcggcccaacgcggtcaaccagctgcaggtggtcggcggccgggccggggtcgacgtctacgcgcccgagccgggcagtggcgtcggcgacccggtcaaggtggcgaaggactcgatcgaggtcgccaagcgcaccgccaaggacatcgtcatcgtcgacaccgccggacgtctcggcatcgacgaggagatgatgcagcaggcccgggacatccgcgccgcggtcaacccggacgaggtcatcttcgtcatcgacgcgatggtcggccaggacgcggtgcagaccgccgaggccttccgcgacggcgtcggcatcaccggcgtggtgctgtccaagctcgacggcgacgcccgcggcggcgccgcgctctccgttcggcacgtcaccggccagcccatcctgttcgcctccaccggcgagaaactggaagacttcgacctcttccatcccgaccggatggccagccggatcctcggcatgggcgacgtgctgaccctcatcgagcaggccgagcaggccttcgacgaggatcagaaggagaagatggccagcaagctgctcggtggcgagcagttcacgctggaggacttcctcgaccagctgatcgcggtccgccggatgggcccgatcgccaacatcctcggcatgatgcccggcatgggccagatgaaggaccagctggccgagctcgacgacagccacttcgatcgggtcaccgcgatcatccgctcgatgaccccgcaggagcgcaccgagcccaaggtgatcaacgcgtcccgccggctgcgcatcgccaacggctccggcgtcacggtgatggaggtcaaccagctgctcaaccgcttcgccgacgcgcagaagatgatgaagcagatgagcgggatgatgggcctgcccggcggtcgccggtcggccaccaagagctcgaagaacaagcgcaagggcaagaacaacaaccggccgcggacgggtggcgggctgcccggggggatgccggccggcttccccggcgggatgccgcagctgccgccggggctggacccgaacgccctggccggcggaggcatgccgcccggcttcaagctgccgaaactcgacttcaacaagctgaacaagccgaaagacgacgaacggtaa

SEQ ID NO: 3985 - DNA, 615 bp, Actinoplanes utahensis
gtgaccgctgcgccgcacttgagcgagttcgagatgatcgactatctgctcggccgagacgacctgaccgtcgacgacatcgcagaccttcccgaggatctccgatacgagttgatcgacggaaggctcgtcttgtcacccctcgccatgccgttccatcagtacctgagcttccaggtcgctaccgcggttcatgagttctgcccggacagcgtccttgtcaacgtggagcaggcggtcctgctggaccgcaggaacgagttgcgtcccgacatggttctggtgcgagaggagggcgcgctgaggtcaccggtcaggccggaggatgtgccgttggtcgtggaagtcatctcagagtcctcgaagaggttcgaccggaccgggaagctgaagaagtacgcctacgtcggaatcacgaattactggatcatcgatccattggccgatgacgtcagcttcacccagttcgcgctaggcgcggacggttcctatcggcagttgctggagaccagcgacctggtgacggtcgaccagccctggcaagtcacgctcgatctgccggcctggacgcggcgacgcgatcgcattcgtgcggtggcccggccggacatctga

SEQ ID NO: 3986 - DNA, 1077 bp, Actinoplanes utahensis
atggcgttgcatgtgcgtgggacggttttgccggacggtgaggtccgggacatctggctggtgggcgatcggatcaccttcgagccggtgggcggggccgagacgatcagcgacggcgggttcatcgtgccggggctggtcgacgcgcactgccatctggggatcgcctacggcgcgaaaccgatcgagagcctcgaccaggcgcgcgagctggcgcacaccgaccgggacgccggggtgctggcgctgcgcgacgcggggtcgccgttcccgtaccccgagttggacgacgagccgggcatcccgcgcctggcccgggccggccgccacgtggcgccgccgcgccgttatctgcgggacatcggcgtggaggtgcccgccgaggaggtcgccgccgcggtcaccgcccaggcgaaggccggcaccggctgggtgaagctggtcggcgactggatcgaccgctcggtcggcgatctcgccccgagctgggatgccgagaccatggccgccgcggtcgaggccgcccacgcggccggcgcccgggccgcggtgcacacgttctccgaggagggcgtcgagatcatggtgaaggccggggtggactcggtggagcacggcaccggcctgtcgctggaactgatcgacgagatggcccgccggggcaccgccctggtccccacgatgatcaacatccggaccttcgggaagatcgccgaccaggcccgggagaagttcgccggctacgccgaccacatgctcgccctgcgcgacaacttccccgaggtggtgctggccgcgcacgaggccggcgtgccgatctacgtgggcaccgacgcgggcggcgggatccggcacggcctggccgccgaggagatgctctacctgcacgaggccggcatcccggcggccgacgtgctggccgccgcctcctggaaggcccgcgcgtggctgggcttccccggcctggtcgagggcggcctggccgacctggtcgtctacgacgccgacccgcgcgccgacctgcgcgtggtccgggcgccccgccggatcgtgctgcgcggcgccgtcatccgctag

SEQ ID NO: 3987 - DNA, 1431 bp, Actinoplanes utahensis
gtgtccactgatctcgacgaactgttcaccacgctggggcggcaggccgacgcggtcccgatcggcaccgccgagcaggcccgacgccgcggcgcccagctgcgcacccggcagcgggcggtgctggccggtgccgccgccgtggtgctggtgctggccggggccggggtgctggcggtgcggcagcaccggctcaccgacccggtgctgccggccaccacgccgtcccggatccgcgggctggcgccactcggcgagccgctgccggccccggccggggagacctggacggcggcgcggatcgccggcgaccgagtgatcgggctgtcgaagacccgggcgatcgcgatcgacgccggcaccgggcggaccctctggacgctgcccgggctggacagcacctacctgggggtagccaccacggcgaagtcggtgatcctggtccgtcaaccggctccggccgtcgaggacatcaaggcgcccgacaaccgggtcctggagttccacgacccggccaccggggcgaaacgctggcagctgccgcacaccaccggcgaccggctggtcctgcaccgcgacgtggtggtgcggctgtccaaaaccaccgggcggatcgacgcgtacgacctggccggcggccggcggctgtggaccgccgcggccggggcgacgatgatcagcgggatgctgaccggggcggacgcctccgaggacgtctccgggggcggggcggcgctgttctccccggagtcggagaaggcgttcccggtcaccgacgaccggctggtgtcgatcacctcgggcgggcaggtggtgatccggaacatccggaccggcaaggtgcaatcccagacacgggcccggcgggacgcgcaagaactgatcgcctacgagggcatggtctacaccgaggagtcgacccccgggggactcggcatcggcacgccgcagcgcatcctctacgaccggcagggctcctgggcgatggaccggtacttcccgtgcggccacgaccggctctgcctgtacgagaccgacggcagcgacgtacgacttctcctgatcgacgccgtcggcggcaccgtgctgcgccgtactggagcggtgccgctgagcggcacgtcgtcggtccggctcgggcacgtgatgaccagtggcggcggcgacaagggcaccgcgctgtacgacgagaacgggcaggcccggtactccgacaacgggatcggcgggttcatcgacgacgggaacgtgctgaccctgacccgggacgccggcgacggccggttcaccgcccggggcgtctccaacatcgactaccggaaggtgacgctcgggacgatgccggagatctccgggcggtgcgactgggacaccgggctgctcacctgcccgaccgggcagggcctgtacagctggcggttcacccgctag

SEQ ID NO: 3988 - DNA, 489 bp, Actinoplanes utahensis
atggatttcgacggcttctaccgggacacctcccggcggctgttgcgctacgcgtacgggctgaccggggatccgggtgaggcgcaggacctggtccaggaggcgtacgcccgagcctggcagcgctggcgccgggtgtccggctacgaggacccggaggcgtggctgcgactggtggtgaaccggctgtccaccgaccgctggcgccggctcggcatccgccgcgcgcgggccgccgccgagccgccacccgcaccggtggccccgccgtcggaggacctggtgctgctggtccgggcgatgcgcgagctgcccgacgcccagcggcgcgcgctcgccctgcactacctgctggaccgttcggtcgcggacatcgccaccgagaccggcgtcgcgctgggcaccgtcaaatcctggctctcccggggccgggccgcgctcgcggccgccctcggcgcggtggaggaaggagccaaccgtgtccactga

SEQ ID NO: 3989 - DNA, 1407 bp, Actinoplanes utahensis
atggctcgcgtgctcactccccgtgcggaggatttcccccgctggtatcaggacctcatcgccaaggcgcagctcgccgacaacggcccggtgcgcggcacgatggtgatccggccggtcggctacgcgatctgggagcgtatgcaggccgacatggacgcccggatcaaggagcagggcgtacagaacgcgtacttcccgctcttcatcccggagaactacctgcgccgcgaggccgaccacgtggagggcttctcgccggagctggccgtggtcacccacgccggcggcaaggagctcgccgagccgctggtggtccgccccaccagtgagacggtgatcggcgagttcatggccaagtgggtcgactcgtaccgtgacctgcccctgctgctgaaccagtgggccaacgtggtccgctgggagctgcgcccgcgcaccttcctgcgcaccaccgagttcctctggcaggaggggcacaccgcgcacgccaccgagcaggacgcccgggaccacgcccgcgagatccacaagcacgtctaccaggcgttcatggaggagctgctggccatcccggtggtgcccggccgcaagaccaagggtgagcggttcgccggcgcgaccaacacgatgaccgtcgaggccatgatgggcgacggcaaggcgctgcagatgggcacttcgcacgagctcgggcagaacttcgccaaggcgttcgacatcacctactcgtccgccgaccgcaccgtcgagcacgcctggaccacctcgtggggcacgtccacccggatggtcggcggcctgatcatggtgcacggcgacgacaacggcctgcggctgccgccgcggctggcgccgatccaggtgcagatcatggtggtcaaggccggcgagggcgtcaccgaggcggccacgcagctgcgcgacgacctcaaagcagcgggcgtacgcgtgaagctcgacgaccgggcggacatccccttcggtcgccgggcggtggacgccgaactgcagggcatcccgatccgggtcgaggtcggtccccgcgacctggccaacggcaacgccgtggtggcccggcggatcgacggcaccaagtcgccgatcgcgctggccgaggtggccgccgcggtggtcgccgcgctcaaggccgaccagcagcggctctacgacgacgcgctggccttccgggtggagcgcaccgtcgacgtgaagacgctgggcgaggcgatcgaggcggcgcagaccggctgggcccgggtgccgtggtcggcgatcggcgaggccggggagaaggaggcgaacggcaaggcggtcaccgtccgctgcctgacccgcgaggacggctcgatgcccgagtcggacaccgaggacggtctggtcgcctacctcggtcgctcgtactga

SEQ ID NO: 3990 - DNA, 648 bp, Actinoplanes utahensis
gtgcgtttcaccgagggccggccggtcctctaccggaacttctccgccgaccggctggtcaacgtccgcccgtgccgggtggtctcggacgacgaccgcgggctgctgctctggctggcccgcggcaccccggtgatcatcgacgtccaccgggacggccgcgggacccgggacatgccgttcgccgagtgggcggtcgcgccgcgcaagcggatcgtgagcacctgggccggcccgggtgtcctgaagttcatcccgcccggcgccgaccactcggtctggttcttccgcaccgagcgggacaccttcaagaactggtacgtgaacctggaggcgcacgcgatccgctgggacgacggtgacgtcgccggggtcgacgtgatggaccaggatctcgacatccacgtcgacccggaccgcacctggcggtggaaggacgaggacgagttcgccgagcggctcgcccttccggagcactactgggtgcccgatccggaggcggtgtgggccgaggggcgccgggtgatcaagcagatcgaggcgggggagttcccgttcgacggcacctggaccgacttccggcccgatccgggatggcccgttccggcggagatcccgcccggctgggaccgtcccggggcacgatga

SEQ ID NO: 3991 - DNA, 528 bp, Actinoplanes utahensis
gtggccgttaagatccggctcctgcggatgggcaagatccgcaacccgcagtaccgcatcgtcgtcgccgactcgcgcaccaagcgcgacggccgcgccatcgagtacatcggcatctaccagccgaaggaacacccctcgctgatcgaggtcaagtccgaccgcgtccagtactggctcggcgtcggcgcgcagccgagcgagcccgtgcagcggatcctggagaagaccggcgactggcagaagttcaagggcctgccggccccggcgccgctgctggtcgcgccgagcaagcagagcaagaccgaggtctacgaggccgaggccaaggctgctgccggtctcgccgacaccaagccggccgccacgccgaagaaggcgaagggcgaggccaagccggccgccgcgccggaggccgccgaggccaagccggagcagaccaaggtcgcggacccggccgagccgaaccgcgaggctgtcgccgagacggcagaggacccggccggtgccggcgccgacgcgagctga

SEQ ID NO: 3992 - DNA, 258 bp, Actinoplanes utahensis
gtgccggcgccgacgcgagctgacggggcgctccggccggcgctggagcacctcgtcaagggcatcgtcgacaacccggacgacgtccgggtccgcctggtcgactcgcgccgcggcaagcggctcgaggtccgcgtgcaccccgaggacctgggaacggtcatcgggcgtggcgggcgcacggccaaggcgctgcgtcaggtgatcgggtcgatcggtgggcgcggcatccgcgtcgacatcgtcgacgcgtactga

SEQ ID NO: 3993 - DNA, 570 bp, Actinoplanes utahensis
atgctgctcgtcgtcggccagatcggtaaaccgcacggcatccggggcgaggtctcggtggtcgtgcggaccgatgagcccgaggcacgcttcaccgccgggcaggtgttcaccacggaggtcccccgggaccgccgggtgagcaccggcccggcggccgcgtccgcccccggcgctctcttcgaagttccgaaacagctcaccctcgagtcgatccgctggcatcagggccgcggcatcgcggtgttcgagggcatccacgaccgcaatctcgccgaggcgatgcgcggcgtgttcctgcaggtggacagcgctgagctggccccgccggaggacccggacgagttccacgaccaccagctgatcgggctgcgggtggagtcgctcgacggcaccgagctgggcaccgtgcagcggatcgagcatgctccgtcctcggacctgatcgtgctggccaagtccggcggcgggaccgcgttgatcccgttcgtcaccgtgatggtgccgaccgtggacatccccggcggccgcgtggtcgtcgatctcccggaaggtctgctcgatctgtga

SEQ ID NO: 3994 - DNA, 765 bp, Actinoplanes utahensis
gtgaaggtcgacatcatctcgatcttcccggactacttcgccccgctcgatctctcgctgatcggtagggcgcggaccaccgggacgctggatctcaccgtgcacgatctgcgcacctggacccatgacgtgcaccggacggtggacgacagcccgtacgggggcggtcccggcatggtgatgcgccccgagccgtggggtgaggcgctggacgcggtcggcagcccggaggcgaccctggtcgtgccgtccccggtgggccgaccgttcacccaggccgatgcgtacgagctggccgctcttccgcatctgatcttcgcctgcggacggtacgaggggatcgaccagcgggtcatcgacgacgcggccgatcggatgccggtgcgcgaggtgtcgctcggtgactatgtgctgttcggcggtgaggtcgcggtgatcgtgatcatggaggcgatcacccggttgctgcccggggtgctcggcaacgccgactcgctgaccgaggagtcgcacgcggccggcctgctcgaggcccccgtctacaccaagccggcgtcatggcggggccgggacgtgccggacgtgctgcgctccggtgaccatgggcggatcgcccgctggcggcgtaccgagagcttcgtgcgaaccgcgagccggcggccggacctgtacgcggcgtaccccccggagaacctggacaagaaggaccgcaaggcgctggccgaggccggattggagctcccgccacccggtgtggcaaagtag

SEQ ID NO: 3995 - DNA, 357 bp, Actinoplanes utahensis
atgaacacgctggacgaactcgacgcccagtcgcagcgcaccgacctcccggacttccgggccggtgacaccctcaaggtgtacgcccgggtcgtcgaaggcaaccgttcccgtgtccaggtcttccagggcgtcgtgatcggccgccagggcagtggcctgcgcgagaccttcaagatccgcaagatcagcttcggcgtcggcgtcgagcggacctacccgttcaacagcccggcgatcgacaagatcgaggtcgtcacccgcggtgacgtccgtcgcgccaagctctactacctgcgtgagctccgcggcaagaaggcgaagatcaaggagctgcgggagaagcagtccgtctga

SEQ ID NO: 3996 - DNA, 891 bp, Actinoplanes utahensis
atgcgaagcgtggatccgatggaagggtatcgaccgtcccggcggcggtcgctcatcaggcgcaaggaaatgcccctctggcaggagttgccgctgctgctcgtggtggcgttctgcctggccgtgctcatccgcaccttcctggtccaggccttctacatcccctccgggtcgatgcagacgacgctggagctcaaggaccgggtcctggtcaacaaggtcgtctacgacatgcgggacccgctgcgcggcgagatcgtggtcttccgcggcaccgacaactgggcgcccgaggtgaccgagccggtcagcaacacgttcggggcgaaactcgggcgtacgatcggtgacctggtcggggtgagccgccccggtgagcgtgacttcatcaaacgggtgatcggccttccgggtgacaaggtcgcctgttgtgacgaccagggccggatcacggtgaacgggatcggcatcgatgaggcttacatcgcgccgggccacaactccgacctgaaccagccgccgatcgccgggcagtgcaccagccgcaagttcgccgagatcaccgtgccgcccggtcagatgttcgtgatgggcgaccaccgcaaggtgtcccaggacgcccgctgccagggtccggtcccgattaagaacgtgatcggtcgcgccttcgtgaccgtctggcccaccagtagatttacgacgctcgaagtcccggacgtctggaaacagttcgcgcaacagcatccgacggccgccgccgggccacccggaccgcgcccgcggcaggatccccgggtggccggcagcctgtttccgctgctgatcaccgccgtgtggtccgcgcgttccagcatgtcgttccggactcgacgacgtaggctccgagcgtga

SEQ ID NO: 3997 - DNA, 663 bp, Actinoplanes utahensis
gtgattgacgagcagaccgaaaagcgccgcgggtcgttctggcgcgagcttcccattctgctgggcgtggcgattctggtcgccgtcctggtgcgcgccttcgtcctgcagacgttctacatcccgtccccgtccatggagcacacgctcaacgtgtgggaccgggtgctcgtcaacaagctcgtctacgacttccgtgacccgaaacgcggcgagatcatcgttttcaaggcgcccaccgagtggcagtccggcaacgagggcgaggacttcatcaagcgggtcatcggcaccccgggcgaccgggtggtctgctgcgacacccagggccggctgaccatcaacgggcactcgctggacgagccgtacatctacaccgacgcggacggcaaccggaaccaggtggccgacgagaagttcgacatcaccgtgccggccggtcggctctgggtgatgggcgaccaccgggaggcctccggcgactcgctggagcactatgagcagagcacggccaccgacacggccggcaagatggccgattcgacgatcaccatcgactcggtggttgggcgggcgttcacgatcttctggccggccggccgggcgacctggctgaccgtgcccgacacgtacgacgcgatcccggacgccgccggtcactga

SEQ ID NO: 3998 - DNA, 633 bp, Actinoplanes utahensis
gtgaccgactcgaaccagcccgccgtcgtggcgcgccgtgccggccgggtgctcctggtcgatcgggccgggcgcgccctgctgctgcgcggcggtgatccggcccggcccgggctgcactggtggttcaccccgggcggcggcctgcaggacgcggagagcaccgtcgaggcggcggcccgcgagctggccgaggagaccgggctgcgggtgtcgcccggcgaactgggcgggccgatccggcacgagcacgccgagttctcctacaacgggcgcgactaccggcaggaacaggacttctttctgctccgggtggcggtctggcaggtcgacacggcggggatggacgccgaggagcggctgaccatcaccgagcaccggtggtggtcggcggccgagatcgaggccagcgcggagctgatctatccggccgatctggcggagttgctccggtcccaggtcgacgggcccgccgcggcttctgagggcaccgcgggcgtcgcggcttccgggggcgtcgcggcttccgggggcaccgcgggcgtcgcggcttccgggggtgctgcgggtgcggcggctgcttcgggagcgccggtgcatgcggctgacggcgtaccggaaatgggcttttga

SEQ ID NO: 3999 - DNA, 846 bp, Actinoplanes utahensis
atgttggctcccgcccgcaccgtggtgcgccgagaggccgggctctacgcgttggagcaggcgttgcagcggcgcggtttcgcgcatgtcgccggcgccgacgaggccgggcgcggcgcgtgcgccggtccgctggtcgcggcggccgccgtgctgccggccggcaagcgcggagaggtgcccgggctggccgattccaagctgctcaccgcggcggcccgggaacgtgtctacgacgaggtggtcaaacgcgcgctggcctggtccgtgatgatcatcccgccgaccgaggtggacgcccgcggcctgcacgtctgcaacctggcggcgatgcgccgggcgctggcctcgctgaccgtccgcccggagtacgtgctgaccgacgggttcccggtcgacgggctcggcgtgccgggcctcgcggtgtggaagggcgaccgggtggcggcctgcgtcgcggcggccagcgtgctggccaaggtcacccgggaccggatgatggtggagctggacgggaaattcccggaatacggcttcgccgtgcacaagggttatataacggacgagcacagtgccgcgctgctgcggcacgggccctgcgccgagcaccgcttctcgtatgtgaacgtcgccgccgcctccgggcgcggcaacgtgccgccgcgagcgcgccgcccggcagcccggccggcggaccccgcgccgtcgctgttcgatgtttccgttaccgagccgctgctgcttccgcgcgcggctgagggtaccgtcggcgtggcgtcgggcgagcagcctcagccgtcgccgtcggtgggggaagatgaggccatggagggcgagacacgatga

SEQ ID NO: 4000 - DNA, 324 bp, Actinoplanes utahensis
atgagcgcagaggatctcgagaagtacgagaccgagatggagctgcagctctaccgggagtaccgcgacatcgtccgccagttctcctacgtcgtggagaccgagcgccggttctacctggccaaccaggtggacctgcacgtgcgcaactccgacggcgaggtgtatttcgaggtcgagatgcacgacgcctgggtctgggacatgtatcgcccggcccggttcgtcaagaacgtgcgggtgatgacgttcaaggacgtcaacgtcgaggagctggagaaaccggacatctcactgccggacgacgccggcttcggcggctga

SEQ ID NO: 4001 - DNA, 519 bp, Actinoplanes utahensis
gtgcggccggccagactcgccctcatgtctttcctgctcgccctcctgctggccgtcggactgctcggacttccgcacgagtcgccgccgggtctgagattcggctggccactcctgccggcccgggtgacgcggcccttcctggcgcccccggagccgtggctccccgggcatcgcggggccgacctggccgggcagcccggcgatccggtgcgggcggccgcggccggcacggtcgtctacgccgcggtgctggccgggcgcggcgtggtcagtgtggcgcacgccggcgggctgcgcagcacctacgagccggtcgacccggcggtcacggccggctcgacggtcaccggcggccaattgctgggccggctcgaccccgggcatccgggatgtccggtcgcggcgtgcctgcactggggcgtacgccgcaatgatctttatcttgatccgttgatcctgctgggtatcgggcgggtgcggttgctaccactgccagtggtgcagcaggctgggtag

SEQ ID NO: 4002 - DNA, 1188 bp, Actinoplanes utahensis
atgagcgccgaagatccaccgcagcccattgccggggcgcggttgctgttctcgctggatccggcggtgtcctatctcaaccacgggtcgttcggcgcgttgccgatcaccgtgcagcgcgcccagcagcgcctgcgggacgagatggatctgaacccgatgcgattcttcggcccgggcctgctggaccggatcatccacacccgacggcatctggccgctttcctcggcgccgacccggagggcagcgcgctcacctcgaacaccaccaccgcggtcagcctggtgctgcagtcggtccggttgaaggaatcggacgaggtgctgctcaccgaccacgcctacggtgcggtgacgatggcggtgcgccgggagtgccggcggaccggggcgacgacccggacgatcgcggtgccgttcggcgcgagcgggccggaggtcctgtcccgggtgcgggcggcgctgcggccgggacgcacccggctgctgatcatcgaccaggtgacctcggcgacggccacgctgatgccggtgcgggaggtcgtcgccgcggcccgggcgcagggcatcccggtgatggtcgacggcgcgcacgtgccgggcatgctgccggtgcgggtggaggagatcggcgccgatttctgggtggggaatctgcacaagtggggttgggcgccgcgcggcacgtcgctgctggcggtgtcgccggactggcggcggcggatcgatccgctggtcgtctcctgggagcaggatcagggtttcccgctgtcggtcgagttccaggggacgatcgactacaccccgtggctggcggcgccggccgggatcttcgcgatgcgcacgctgggcccggaagtcgtccgggagcacaatgcggcgctcgcggcgtacggccagcgggtggtcggtgcggccctcggtcatgcgccggcggatctgccggagccgggcggacccggggtctcgatgcggatcgtgccgctgccggccggggtggccaccacctttcccgaggcgcacgcgttgcgcgggcacatcgccgacaagctcggggtggagacgcagatcaacgcgtggggcggccgggggctgctgcggctgagcgcgcagatctacaaccggccggaggagtatcaccatctggccgatcgcctacccagcctgctgcaccactggcagtggtag

SEQ ID NO: 4003 - DNA, 1221 bp, Actinoplanes utahensis
atgacaagaaaacacggcacactggacgccgtggacgcctatcgacgacggcctcgggccaaacgggtgaccgagatgcacgaagcgttgccgccggcgctgcgggaggcggtggatcggttcgggcatcatctggcggtcgtcgaggaccggtcggcgcacacggtgcgggcctatctcggggatgtcgtctcgttgctcgcccacgcggccgagcaggggtgttcggcggtcggcgacctgggcatcgcggtgctgcgcggctggctggcggcgcggttggacgagggcgcggcgcgtacttcacaggcgcgccgggccgctgcggtccgcaccttcaccggctgggcgcatcgcatcgggctggcgccggccgacgccggctcgggcctggccagtcctcgcacccaccgcgacctgccgcacgtgctccgcgccgaccaggccgtggccctcgtcaccgcgcccagtctcccacccggttccggcaccggccgagaaccgaatacggcaggtgcgagcgcggcggacgccaccgggccggacgggagcgggcaggaggcgggcgagacggaggcggacagaggcgagacggaggcggacagagcgggtggcgatgtcgtcgcgatccgggatcgggcggtgctggagctgctctatgccaccgggatccgggtgagcgaactctgcgacctcgatcagaccgacatcgatcacaaccgccaggtcgtccgggtcttcggcaagggcggcaaggagcgggcggtcccctacggtcatcccgctcgcgacgccctcgccgcgtggttgcgtctaggccggccggtgcttgcggcggtgggcgacggccaggccgccgccggtgcaggtgatcatcggcttgcggtacgcggtcccgcccggaaccccgcccgaaccggccgccgtgccgggaggtcgctcgccgccgacgcgctgttcctcggcttgaagggtggccgtctgcagcccaccgtcgtccggcggatcgtcgccggggcggcgcggcgtgccggactgccgcacaccaagccacacgatctgcgtcattccgccgccacccacctgttggacggtggcgccgatctacgggccgtgcaggaactgctcgggcacagttcgctggcgagcacgcagatctacacccacgtctccaccgaacgtctgcgcgccgcgttcaaccaggcacacccccgcgcctga

SEQ ID NO: 4004 - DNA, 405 bp, Actinoplanes utahensis
atgatcgatcattcggcggaccgtgcggtgtttcggcagcttgctgacctgctgcgggatcggatcacgtccggggagctgggccccggggagccgctgcccagtgagctgcgccttgctcaggattacgggatcagccggacgacggtgcgccaggcgatcgggcagctgcggaccgaggggctcgtcacggtggatcggccgcgggggacgttcgtccgggtgcccgagccggtccaactggtcacgctggcccggggcgagcgcgccggggcgcggatgccgaccgacgccgagcgacgcaaacaccgcttgggcgaaggcgtcccggtcctggtcgtgacaagcgcggacggcaccgagacagtgcatcccgccgaccgcgtccaactgacccggtcctga

SEQ ID NO: 4005 - DNA, 231 bp, Actinoplanes utahensis
gtgagcgaacggcctgaatggaactgccgggcctgcgggcggccatggccctgctcgaccgcccggggaacgctgctgcacgaataccgcgcgtttccgtcactgctacggatatacctgtccgcccagatgtacgacgcgctggaagacatgatcatcgacggcgcgccgccgctgaacctgtaccagcgcttcctcggctgggcatggacagacccgcccgcaccgtga

SEQ ID NO: 4006 - DNA, 1122 bp, Actinoplanes utahensis
atgaaccttcatccacgcctcgacatcctcggtcagccagactttgccctgagccagatccgcgaccgccttcggaaagtccgcacggctggtgatctggtacgcccgctgacggctcacgccacccaggcggatgcgaatctcgtgtgcgcccatgaggcggatcggcttcactcccacatgatcgaccgtaggcgcgggacaattaggcgttcagcatcttgtccggagacaggtagtcgtcaagccagtacgatcgtcgccatgactagacgtcgcacgacaagtggacaggttcccgtttccccacgtcatcgccgtgactggcgcaccatgtggcgtcggtgccgctgcggcctacccgcaccgtgcatcgatcgcctggtgccgcccccggtcccacccttcccgttacggacctccaccccgagccgccccgagcctgcaaaattcgacaatgtcccacccgaccgacaaaagccccaccttgcggcggcgccccggcagcgtcggccctgcgacgagcttcgccgcccggtgacccaccaccctgctccggcagatgatcacgcgagccggagcagcccgctgaccggccatcccgctcccgcggacggccacgcaagccggagcagcccatccatcccccgccgtcccgaccacccggctactcccaccgcatccggcggccccggcgggcaccatccgacagacggctccggcggacatcacctggccgacggttccggctcgcaccacctgacaggcggctccggcggccatcacctggccgaaggccccactcgtcgccgcgcctgcttccacagcgacgccgttcgtgcgcgttttcccgacgtcgtcgctcccgaggtctggcaacgccatccggacgaccgggtgcacgccgccgaccagcaagtccgcaccgacgaccgacaaaccgacattgacgaggggcagccgtcggtcgcggtcggacgcgcggcggtgccacaaccgcgcccacggcacccggaggcgaacgtgggccgcgccggaaacctgacgcccgggcagcggtaccgcacggtgtgcaacgacccgttcaagaaccacatgcatcgccggcgaggtggccgctga

SEQ ID NO: 4007 - DNA, 1176 bp, Actinoplanes utahensis
atgagcgggccggggagtgagtcggaccgggtggcgcgggcggcgctgacctggctggcggagccggggaaccgggtggtctgggagatggttcagcaggccggggcgccggtcgtgctggagcggctgctggctggggacattcccgacacgtcgctgcggtcggcggttgccgcgcggtgcggggccggtgacgcccggcagatcgcggaggagaatgtcgaagcggccgcgcggatcggtgcgcggctggtcgtgccggccgatccggagtggccggcccgggtcgacgcgctggcgacgctggagatggagtctcggggccggatcaatcgggacacccggccgccgctctgcttctgggtgcgcggggcgccaccgctcggcgcgacgctggaacgctcggtcgccgtcgtcggggcgcgggcttcgacgggttacggcgtccatgtggccgccgacctggcgtacggtctcgccgaacaggggtggaccgtggtgtccggcggtgcggtcggcatcgacctggccgcccatcagggcacgctcgccgccgggggcgtcaccgtggcggtgctggcctgcggggtggatcggccctacccgctgtccaacacgacgacgttcacccggatcgccgcgcacgggctgctggtcagtgagtggccgccgggttccgatccgctgcgtcaccggttcctgatccggaaccgggtcatcgccgcggccaccgccgggaccgtggtggtcgaggccgcggcccgcagcggcgcgacacagacgatgagccgggtgatcgcgctggaccggccggcgatggtcgttcccggcccggtgacctcgaccatgtcggtcggctgccacgaactgttgcgcggcaacccgcaggcacggttggtcacctgcgccgccgatgtgctggaagaggtcggccggatcggcgagttcctggagcccgcgccacgcggccgggaacgcgtccgggaccggctggacgaggagtcggcgctcatcctggaggcgctgccacgccgccgggcggcgaccccggaggagatctcggcggaggcccggctggatgtacgcaccgtgctgcgacgcctgtccctgctcgaagccgccggcctggtggtccggaccgaggcgggcatcacgctggcgacgaggggcgggtag

SEQ ID NO: 4008 - DNA, 1590 bp, Actinoplanes utahensis
gtgcccgcagcggcgcggcgccacccgcgtcacccacctgagggcggcgttctgatgagctacgcccgggtgctctgcgtcggcctgatcggcgtcgccggccgcctcgtcgaggtcgaggccgacctctccctcggcctgcccgccgtcgtcctgaccggcctgcccgacaccgcgctgcacgaggcccgcgaccgggttcgcgccgccgtggtgaacagcggctgcgagtggcccaaccgccggatcaccgtcaacctgctgccggccgccctgcccaaacacggcagcggcttcgatctggccatcgccgccgccctgctggccggtgccggcgagctgccacccggcccgctggaccgggtggtgctgctcggcgaactcggcctcgacggcgcggtccgcccggtccggggcgtgctgccgatggtcgcggccgccgcccaggccggcatcaccaaggtgatcgtgccgctcggcaacgcccgcgaggccaccgtggtgcccggcgtcaccgtccgcgccgtcgactcgctgcgccgcctggtcgacttcgtccgcggcaccggccgcctgctcgaaccacccccggagtccccgcccccggcccgcaccggccccgacctggccgatgtcgcgggccagcagctcggccgctacgccctggagatcgccgccgccggtggccaccacctggccctgttcggcccacccggcgccggcaagacgatgctcgccgaacgcctgccgtccctgctgcccgccctcggcgacgaggccgccctggaggtcaccgccctgcagtcgatcgccggcgtgctccccccggacagcggcctgatccgccgcccgccctaccagtccccgcaccacagctccagcatggcgtccctgatcggcggcggcagcggcctggcccgccccggcgcgctgtccctggcccaccgcggcgtgctcttcctcgacgaggccccggagatagcccgggccaccctgcaggcgctgcgccagccgctggagagcggccgggtgatcctggcccgggcccgcggcaccaccgaatacccggcccaggtccagctggtcctcgccgccaacccctgcccgtgcgccaccaccgaccagcgctgtacctgtagcccacagatccggcgtcgctatctagggcgactttccggaccactgctggaccgggtggacatcaaagttgacctcctaccgatgcgggcagcgcagttggtcacccaggaatccccggtcgagtcgtcggagaccatcgcggaacgagtccttcgcgcccggaatgcggcggcagaacggtgggcgggcgacggctggacagtgaacgccgaagtaccaggaccggccctccggcgacagccatggctgttgccggcacgggacaccgccgtgttgagaaaggcgcttgaccgcggcacagtttcggcgcgcggctttgatcgagtccttcgtttggcctggacagttgccgatctcgacgggcgcggtcggccgtcaaccgatgacgtgtccgaggccttgcaactgcggaccggggagaacctcgcaatccgggagcagtcggcatga

SEQ ID NO: 4009 - DNA, 360 bp, Actinoplanes utahensis
atgacgactcagcgacaggcgatcggggcgtacggcgaacggctcgccgcccggtatctgcagaaacacgggctggaggtgctcttccgcaactggcggtgcgccgacggcgaggtcgacctgatcctgcgggacggcgacaccctggtgttctgcgaggtgaagacccgccgcaccgccaccttcgggccacccgccgccgcggtccacccgcgcaaggtacgcaaactgcgccagctcgccgggcgctggctggccgagtccggcgagcacgcccggcagatccgcttcgacgtggtggaggtgtgcccgcagcggcgcggcgccacccgcgtcacccacctgagggcggcgttctga

SEQ ID NO: 4010 - DNA, 894 bp, Actinoplanes utahensis
atggccgtagtgaccatgcgtcagctgctggagagcggtgtccacttcgggcaccagacccggcgctggaacccgaagatgaagcgcttcatcttcaccgagcgcaacggtatctacatcatcgacctgcgccagaccctcgactacatcgagaaggcctacgcgtacgtgcgggacaccgtcgcggagggtggccacatcctcttcgtcggcaccaagaagcaggcgcaggaggccatcgccgagcaggcgacgcgggtcggccagccgtacgtgaaccaccgttggctcggcggcatgctgaccaacttccagaccgtgtacaagcgccttcagcggatgaaggagctcgaggccctgggtgacctgagcggcaccgccgccggctacaccaagaaggagaccctccagctctcccgcgagaaggagaagctcaccaagaccctcggtggtctgcgtgacatgaccaaggtgccgtcggcgatctgggtcgtggacaccaagaaggagcacatcgcggtcgacgaggcccggaagctcaacatcccggtcatcgcggtgctggacaccaactgtgacccggacgaggtcgacttcccgatcccgggcaacgacgacgcgatccgctcggccgagctgctgaccaaggtcatcgccgcggcggtcgccgacggtctgatcgcccggtccggccgccaccgcggtgacgccgacaccaagccggaggccggcaccgtcgcggccggcgagccgctgccggagtgggagcgggacctgtacgagggtggcgacaagaaggccgccgaggccgccaccgagccggccgctgctgagccggccgccgccgagccggccgctgccgagccggttgtcgccgccgtccccgccgagtaa

SEQ ID NO: 4011 - DNA, 1017 bp, Actinoplanes utahensis
gtggcgacaagaaggccgccgaggccgccaccgagccggccgctgctgagccggccgccgccgagccggccgctgccgagccggttgtcgccgccgtccccgccgagtaagtcaaccgacacgcttccggccgccgccgttcgcgcggcggcggccgatttcccgactgacatcgagagaagagtcatggctaactacaccgccgcggacgtgaagaagctccgcgaactcaccggtgccggcatgatggactgcaagaaggcgctcgaggagtccgagggcgacttcgacaaggccgtcgagttcctgcgcatcaagggcgcgaaggacgtcggcaagcgggccagccgcaccgcggcgaacggcatcgtcagccacgcgggcaaggctctgctcgagctgaactgcgagaccgacttcgtcgccaagaccccggacttcgtcgcgctgggtcagcgtctggtcgagttcggcgagcagaacaaggtggcggacgccgccgcgctgctggccgccacgatcgaggacggcaagaccgtcgccgatctgattcaggactacgccgcgaagatcggtgagaagatcgtcctgaaccgcttcgtgatcctcgacggcaccgtcgcggtctacctgcaccgcaaggcgcaggacctgccgccgcaggtcggcgtcctcgtgcagtacaccggcaaggacgacgaggcggccgattcggacgcccgcggcatcggcatgcagatcaccgcgatgcggccgaagtacctgacccgcgaggaggtcccggccgaggtcgtcgagtcggagcgccggatcgccgagcagaccgctcgcgaggagggcaagccggagcaggcgatctccaagatcgtcgacggccgggtgaactccttcttcaaggacttcgtcctgctggagcaggcttcggtcgtcgacaacaagaagacggtcaagcagatcgccaccgaggccggtatcgagctcacccggttcgtccggtacgaggtcggccaggagtaa

SEQ ID NO: 4012 - DNA, 759 bp, Actinoplanes utahensis
atgacgatggtgaccgagcagtccgccacggtcgacgagaacccgccggccatgcggccgcgccgggtcgttttgaagctgtccggtgaggtgttcggcggcggcgcggtcggcgtcgaccccgacgtcgtgcaggcgctggccaagcagatcgccacggtgaaccggcgcggcatccaggtggccgtggtggtcggcggtggcaatttcttccgcggcgccgagctgcagaagcgcggcatggaccgcaaccgcgccgactacatgggcatgctgggcacggtgatgaactgcctggccctccaggacttcctggagaaggagggcatcgagacccgggtccagacggccatccacatggcccaggtcgccgagccgtacatcccgctgcgcgccatccggcacctggagaagggccgtgtcgtgatcttcggcgccggcgccggcatgccgtacttctccaccgacacggtgaccgcccagcgcgcgctggagatccacgccgacatggtgctgatgagcaagaacggcgtcgacggggtgtacaccgccgatccccggatcgatccggacgcccgcaagctggagaacatcaccttccaggagatcctgcagcgcgggctgcgggtggccgaccaggccgcgttcagcctgtgcgaggagaacaaacttccgatgctggtcttcggcgccgacggcgacgacaccatcgtgcgcgcgtgcgccggcgagaagatcggcacgctgatcaccgcctga

SEQ ID NO: 4013 - DNA, 558 bp, Actinoplanes utahensis
gtgatcgaggaaatcctcttcgaggcagaagagaagatggacagcgcggtcgagcacgccaaggaggagttcgccgccatccggaccggccgggccaccccggcgatgttctcgaagatcctggtggactactacggcgcgcccacgccggtgacccagatggcctcggtcggcgtcccggagccgcggatggtcatcgtcaagccgtacgacaacacgcagctcggcccgatcgagcgcgccatccgtgactcggacctcggggtcaaccccaacaacgagggcacccagctgcgcatccacctgccgcagatgaccgaggagcgccgccgcgacatgatcaaggtggcccgcggcaaggccgaggagggccgggtggcgatccgcaacgtgcgccgcaaggccaaggagcagatcgacaagctggtcaaggacggcgagaccggcgaggatgagggccgtcgcgccgagaaggagctcgacgacaccacgcaccggtacgtctcggtcgtcgacgaactggtcaaacacaaggaagccgagctgctcgaagtctga

SEQ ID NO: 4014 - DNA, 1023 bp, Actinoplanes utahensis
atgtcctacctcgatccgcgtgccgggcagaattccggcgacacctacgccgagccggcgtaccagaatcccgcctggcacgcggacgagcgggcgcccgacccgatgaaccacgcggacgagaaggcgcccgacccgatgaacagtgacgacgagtcccggcgcgggcccggcaagcgccgggccggccgggggcgcaagccggagggcaagagccgcgccggtcgcaatctgccggccgcgatcgcggtcggcctgagcctgggcctggtcgtcctggcctcgttgctggtctggtcgccggccctgctcggcgtggtggtcctggccgccggcgtcggggtctgggagaccagccgcgccctgtcggtgaccggtgcccggccgccggtgatcccgctgatcgccggcaccgccgtgatgaccggcctggcgtggtacgagggcgccgacgcgctcaccgtgggactggtcgtcacgatcggcgccgcggtgctgtggcgcctggccgacggtgtcgcggctgtccggcgggacttcacctcgatcgtcctgatcgccgtctacgtgccgttcctgctgagcttcgcggcgatgctggtccgcccggaggacgacggccagtggcgggtgctggccaccgtggtcgccgtggtgctctccgacacgggtggttacgccgccggcgtcttcctcggcaagcacccgatggccccgaagatcagcccgaagaagtcctgggagggcttcgccggttcgatcaccgcgtcggcgatcggcagcggcgccctgctgttcttcctgatgcacgtcccggtgtactacggcctgctgttcggcgcggtgctgtcggtggtggcggtgctgggcgacctggccgagtcgatgctcaagcgtgacctcggcattaaggacatgagcaacctgctgcccggccatggcggactgatggaccggctggactccatcctcttcgcggtgcccacggcctacctgctcttcgcgatcatcgcgccgaactag

SEQ ID NO: 4015 - DNA, 1179 bp, Actinoplanes utahensis
atgacgattcttccggtcatcccgatcagccccgaccagcctgacgcggtcaccacccgccgccgccccagcatgccgccgcgccatctcgccgacctcgacctcgccgcccgcaagagcgcgatggccgacctcggcgagccggccttccgggccaagcagctctccacccactacttcggccgcctggtgcgtgacgccgccgcgatgaccgacctgccgtcggccacccgggacaagctcaccgccagcctgctgcccacgctgctgcacccggtccgcgagcaggcctgcgacgacggcgccacccgcaagacgctgtggcgcctgcacgacggttcgctggtggagagcgtgctgatgggttatcccgaccgggtcaccgcctgcgtgtcgagccaggccggctgtggcatggcctgcccgttctgcgccaccggccagcagggtctgacccgcaacctgtcggtggccgagatcgtcgaccaggtggtctatcttgccggggtggccgcctcgggcgcggtgaccggctcgccgccccggctgtcccgggttgttttcatggggatgggtgagccgttggccaactatccccgggtgatcgaggcggtccgccgcctgacggcccccgctccggaggggctcgggctctcacaacggcacatcaccgtgtcgacggtgggtttggtgcccgcaatgcgccggttgatcgccgaacagctctccgtgactcttgcgctgtcactgcatgcccccgatgatgatctgcgcgatgagcttgtgcccgtcaaccagcgttggaaggtggccgaggtgctcgatgccgcgtttgattacgcggcgcagaccggtcgccgggtctccatcgagtacgccctgatccgggacgtaaacgatcaaccctggcgtgccgacctgcttggccgcctactgcacggcaagctggcccatgtgaatctcatcccgctcaaccccaccccgggcagcaagtgggatgccagcccgaaaccggtcgaacgggagttcgtccggcggctgcgggaggccggcgtggcggccacggtgcgcgacacccggggccgcgagatcgacggcgcctgtggtcagctggccgccggggagttgacgcaggcgggcgcagtgggcgtcgcagccgacgcggaggtggcacagtga

SEQ ID NO: 4016 - DNA, 1284 bp, Actinoplanes utahensis
gtgacgagtcagggacagcgtttccggcggcgcgcactgcgccggggctacaaggtcgacgaggtcgacgccttcctggaccgggtcgaggcgaccctcgccggtgagcaggtcggcccgccggtcggcgcccaggaggtgcacgacgtcgtcttccgggtgcgcttcggcggctacgacgagtggcaggtggacctgcacctcgaccgggtggagcggcagctcgccgagttcgaggagcggggcggccgcccggtcgacccgatgcgtgactcgatgcgcagtggcctgaccgccgaccgcaccggcggcttcgaccgcggtgagatggaccgcaccggcggtttcgaccggaccggtggcttcgaccgggccggcgcggccggtcagccttcgggtccgccggcgatgtccggtcccccgtcccgcaacggtggcatggccggtgcgggcatgggcgggccggggccgaacggtccgcagttcggtggtcccggtggcccgggtggccccggtatgggccagcagcagtacggcaaccccgggatgaacgccggcatggcgcagaccgagcggctgcccgccccgatccgcgacgaccggatgatgccgccgccgatgggtggccagcagctgccgcagcgcccgcagatgcagcaacccgacccgtatggcggccgttacgacgagccgacctcctacggcggtcagccgcagctgccgcagcgcggcgccccgcagggctatgaccagggcggctacgacgagccgacctcgtatgccggtttcgagccgggccggcacggccgcaccgacatgaccgccgagatccggatgccggaccgggacccgcggggtggctacggcggcccgccgatgccgcccggcccgccgatgggtggcggcccgatgcagcagcctccggccgggatgccgggttcgccgatgtcgggtgccccgatgagcggcccacccggcgggtacggacagccgcagcagccgcagctcggcccgccgatcggcgagccgggtggcgagctgtaccgcgtcgaccagttgcgccgcacgttccagccgcgacggttcggcagcggttacgacccgatgcaggtggaccggctgttcgagggcatcctgcaggcgatgaccgggcggggcccgatgccggtgaacgtgggcgagctggacatgctgcagttcggcctggtacccaacggctacttcgaggccgaggtcgacgccgcactgcgcgaggtcaaggacatcctgacccggcaccggtga

SEQ ID NO: 4017 - DNA, 237 bp, Actinoplanes utahensis
gtgtcggcgttggaagaacacgaggacgtctacgctccggaccagctgaagccgaccaaccgccggcgcgcccagcggggcgcgatcatctcggccgtggtgctgctgatgtacttctggggcaaccaggagggcaacaccgagaaggtgtggctcgtcgtgatcgcggtgctgctcatcctcgccgtgatcggcgacgcggtgctgcgcaagaccggtctgcgcgccaacgactga

SEQ ID NO: 4018 - DNA, 1563 bp, Actinoplanes utahensis
gtgcggatcacgggcaccggccatgcgagcatgcggatcgacacggccgcgggcagcattctgtgcgatccgtgggtgaatccggcgtacttcgcctcttggttcccgtttccggacaactcgcagctggactgggagacgctgggcgactgcgactacctgtacatctcgcacctgcaccgggaccatttcgacgccgagcacctgaagcggttcgtcagcaagaaggcgaccgtcctgctcccggagtacccgaccagccagctcgaggacgagctgcgggcgctcgggttcaccagcttcctgcggacgaagtcggacgaggtgcacgagctcgacggcggcctcaaggtgatgatccaggcgctgatcagcccgaccgacggcccgatcggcgactcctcgctctgggtggagtacgacggcgtccgggtgttgaaccagaacgacgcccgccccaccgacctggtccggttcaccgagctgggccacgtgcacgcgcacatgctgcagttctccggcgcgatctggtatccgatggtctacgagctgccggagaacgcgaagaccgcgttcggcaagcagaagcgggagcgccagttcgaccggacctggcgctacatcgacgacctgaaggccgatcacgtcttcccgatcgccggcccgccgtgcttcctcgacgacacgctgtggcagttcaacgacatccacggcgacgagggcaacatcttccccgaccaggcggtcttcctggaggagtacgcgaaggtcggcggcaccaacggcatcgtcctgctgcccggcagcgtcagcgagatcaccgcgaccggcacggcgaccaccgagcacccggttccggtcgacgagttcttcgcgaacaagaccgcccacctggaggagatgcgggcccgcaaggccccgatcatcgaggcggagaaggcgtcctggcggcacccggagatcgacgtcctgggcgcgatgaagaagcggatcgagccgctgctcgaggagtcgctctacatggcgaacggggtcggcggcccggtccggttcgacctgaccgactcgttcggcccggacggcgaggtggtcgagtcgatcgtcgtcgacttccccggcaagcaggtccggcagtacgccgacgagaaggtccggtatcgcttcaagaccggccgcgcgctcatcgagcacctgatccacatcgacgagggcgactgggtcaactcgctgttcctgtcctgccgcttctccgcggcccggatcgggcagtacaacgaattcgtctacgcgttcttcaagtgcctctccgaggagcgcctgcagtacgccgagggctggtacgacgagcacgagaaggcggtcgacgccgaggacatccagttcggcgactggaccgtgcagcgccgctgcccgcatctcaaggccgacctgtcccgcttcggcatcgtcgagggtgacgtgctcacctgccagctgcacggctggaagttcgacctgcccagcggccgctgcctgaccggcgtcggccacaagatccgggcgcacaaaacccaggatcaataa

SEQ ID NO: 4019 - DNA, 1944 bp, Actinoplanes utahensis
gtggtcggtgctcggcgtggtgctctccttcctcgccgtctggctgctgttgacgccggtggtggtctgggtcttccggtacgtcgcgccgggccgcccgccgtggctgccgaccgtcctgatcggctcgttcacggccgcgaacctgtccgggttcctgcacgggttcgtgctgttctgctcgctgccgctgaatctgggcacgccgttcggagggttcgacgcgatcggcgggacggtcgcggtcggcctgtggctctacgtgttccacacgatcgttcttgtcggattcgcggcaacgcacgccgtcaagccacatttaacggacgaatcaccgagggcggacgtcacctgagcgaggtaccgtcgctcggcatgacccccattcccgaccgcgccgacgtggtgatcatcggatccggtcacaacggcctggtctcggcgatcctgctggcccgcgccgggctcgacgtcgtcgtgctcgaggcggccggggtgctcggcggcgcgacccgcaccgagcacccgttcccccgcgtgcccggcctcggccagtccaccggttcgtaccttctcggcctgatgccgcccgagctgctgcgcaagctcgacgtcgacatcccgatgctgcgccgcgacccgcactacttcctgcccaccccgggcccggccggctcgccgcacctgctgttcggccgcgaccgggacgccacccggcagcagctggagacgttcttctcgccccgcgacgcggccgccgacgaggcgatggcggtggagatcgccgcgctgcgcgccgacctggcgccgtcctggctggaggagccgggcagcgtcgagcagatcgccgaccggcacatccgcccgcagctgcagagcaccttcctcgacctggtccgcggctcggtcgccgactacctggcccgattcggcttcaagagcgaattgctgaccagcatgtacgcggtgaccgacggcctgtccggtctcaccgccggcccggacgaccccgggaccgggcacaacttcctggtgcacaacatgtgccggctcccgggcgcggacagcacctggatgatcgccgaggggggcatgggcaccgtcgcccgggtcttcgccgacgcggcccgggcggccggcgcccggctgttcaccgacgccgcggtgacctcggtgacgatcgacggcggtgcggccagcggggtggtcctcgccgacgggcgcgaggtccgcgcccgggccgtcctcggcagctgcgacccgtaccggctgatgtcgctggtcccggccggcacgctaccggccccgctggtcgagcacctggagtcggtgcgccggccgggcaccacgctcaaggtcaacctcgcgctgcgggacctgccgcggttcagctgcctgccggagggcgcgccgtcgccgttcggctccacgatccacctgctgcccggcgccggcgactcgccgatggccgcgctgcgggacatgtgggcgcaggtgcaggccggtcgcctgcccgacgagccgaccatcgagtggtacgtgcacaccacggtcgacccgtcgctgcgggacgaggcgggacaccattcgtccgcgcttttcgtccagtcggtgccgttccagccggccggatcgtcctgggaggccgagctgcccggctacatcgatcgcctgctggcgatctgcgaccggtacgcgccgggcacgtccgacctggtcgccgacgtgttcccgctcaccccaccgggcatcgagcagcacttcgggatcaccggcgggcacatccaccacctcgacaacactgtcgccttcgaccggcgcatgccgtatttcaccggcgtcgacggcctttacgccggctcggccggcacccacccggcgggcagtgtgatcggcgccgccggccacaacgccgctgtgcgtctgctccaagaccttcaatag

SEQ ID NO: 4020 - DNA, 591 bp, Actinoplanes utahensis
atggccatgcccgcgcctgagcagtcattcgacatcctcggcaagctgaaccagccctggaccgcccagatggccgttgacctgctgcccgaggccaacggtcccaaggtcgaagtctttcgcgggagcgtggtggtgacccctcatgcccgatatgaccaccaggatgtccagctcgagctggcctaccggatgaaacaggccgctcggaaagccggattgtgggtctacgccgaggtcaacatcgtctccggagacgacctgttcatcccggacctggtggtactgcgccgatccgggggtgggaagaccaccatgccgatcgcggaggcggttctcctcggcgagatcgtgtcgaccgggaaccggcgaaaagacgtggtcgaccgcccgcgggagtacgcggccgccggggtgccctactttttgcgcatcgacttccggaatcgggtgccggcactggtcctgcacgagctggccgacggggagtatcaaccggtggcggcggccgccgcgggcggcaccttcgagatgcgcgagccgttcccgttcgccgtcgatccggaggagttgctcggcgagcaggactga

SEQ ID NO: 4021 - DNA, 1200 bp, Actinoplanes utahensis
atgcgtgagcttgtgctgctggggtcgaccgggtccatcggcacccaggccatcgatatcgtccggcgcaacccggagctgttccgggtggtcgcgatcggggccgggggtggcaacgtcgcgttgctcgcggcgcaggcgctggagctgggcgtcgaggtggtcggggtggcccgggcctcggtcgtgcaggatctgcagctggccttctacgccgaggcgcagaagcgtggctggtcgtccggcgacttcaaactgccgaagatcgtggccgggccggacgcgatgaccgagctggcccgctggccgtgtgacgtcgttctcaacggggtggtcggcagcctcggcctggcgccgaccctggccgctctggagtccgggcggatccttgcgctggccaacaaggagtcgctggtcgccggcggcccgctggtccggcggatcgccaaggacgggcagatcgtcccggtcgactcggagcattcggcgctggcccagtgcctgcgcggcgggcgggccgcggaggtgcgccggctggtgctgaccgccagcgggggagccttccgcgggcggcggcgcgcggagctgacgaacgtcacccccgaggaggcgctcaagcacccgacctgggacatggggccggtcgtcacgatcaactcggcgaccatggtgaacaaggcgctggaagtgatcgaggcgcacgagctgttcggcgtgccgtacgacgacatcgcggtgatggtgcacccgcagtcggtgctgcattcgctggtcgagttcaccgacggctcgacgctggcccaggccagcccgccggacatgcggctgccgatcgcgctggcgctggcctggccggaccgggtgccgggggcggccgccgcggtggactggacgctggcgcacaactgggagctgcgaccgctggacgacgaggcgttcccggcggtcgagctggccaaggcggccggccggtacggtcgctgccgtccggcgatcttcaacgccgccaacgaggagtgtgtggccgctttcgccgccggtcggctacctttcttgggcatcgtcgacaccctggaacgggtgctcgcggcggccccggatttcgcggagccgagtaccgtcgatgacgtgctggccgcagaatcctgggcgcgtgcccaggcacagcggacgatcgcgactgtggctgaaggagcctga

SEQ ID NO: 4022 - DNA, 1293 bp, Actinoplanes utahensis
atgctgttctggctgggttgtgcggccttcgcgctgaccatcctgatctcggtgagcctgcacgagctgggtcacatgatcaccgggaagcgcttcggcatgaaggtgactcagtatttcgtcgggttcgggccgacgatcttctcgttcaaggtcggtgagacggagtacggcctgaaggccatcccgctcggcggcttctgcaagatcgtcgggatgaccccgcaggacgacgacgtcgcgccggaggaccagcaccgcgcgatgtggcggttcccggtctggaagcggacgatcgtgatgtccgccggctcgattacccacttcctgctggccctggccggcgcctggttcatggccttcttcgtcggcctgcccaacatccacctcccgcagacccgtgccgagcagcgctcctggccggcctacatccaggtcggcgactgcctgccggtgcagaccgagctcaagaagctggacgccgcggcgcagaaggcggcggcgagcgccaagtgcgagccgggcgtcaacggcgcgatcgtcgcaccggccaaggccgccggcctgcaggacctggaccggatcaccaaggtcggcaacactccggtggccaactacggccagctcaccgacgcgatccgggcctccacggccggcccgaccgtcttcgagtacgtgcgggacggcaagccggccagcaccaaggtcaacctgatcagcgacgagcgcgcgccgatcgaggatccgaagggcaaggtcaccctggtctcggtcgccggcctggactgggacaccgaccagccgttggtcaaccactacaccgcggccggcgcgttccgcggctccggtgagtactcgtggtatctggtcgagggctcgttcaaggcgatggccaagatcccgcagaagattccggcgctgtggcactcgatcaccggcgacgagcgtgacccggacaccccgatcagcgtgatcggcgccagccgcctcggcggcgaggcgatcgagaagggggtgcccgaggtcttctggcagatcttcatctcgctgaacgtcttcatcggtctgttcaacctgctgcccctgctcccgctggacggtggtcacatcgccatcgcgtggtacgaacgggtgcgctcctggctctaccagcgactccggcgacccgatccggggcgtgtcgactactacaagctgatgccgctgacctatgcggtcatcctgatcggtggcgcgttcacgctgctgaccgcgaccgccgacatcatcaacccgattacgatcttcaagtga

SEQ ID NO: 4023 - DNA, 1173 bp, Actinoplanes utahensis
gtgaccgcgatcagtctcggaatgccggccgtccccccgccgccgctggccccgcgccgccagagccggcagatcaacgtcggaggagtcctggtcggcgggggcgccccggtcagcgtccagtcgatgaccaccaccctcacctccgacgtcaacgcgaccctgcagcagatcgccgagctgaccgcggccggctgccagatcgtccgggtcgccgtgccgtcccaggacgacgtcgaggcgctgccggcgatcgccaagaagtcgcagatcccggtgatcgccgacatccacttccagcccaagtacgtgttcgccgcgatcgacgcgggctgcgcggcggtccgggtcaatccgggcaacatccgccagttcgacgacaaggtcaaggagatcgcccgggccgcgtccgacgccggcgtgccgatccggatcggggtcaacgccggctcgctcgacaagcggcttctcgagaaatacggcaaggccaccgccgaggcgctggtggagtcggcgctctgggagtgctcgctgttcgaggagcacggtttccgggacatcaagatctcggtcaaacacaacgatccggtcgtgatgatccgcgcctaccgtcagctcgccgagcagtgcgactacccgctgcacctgggcgtgaccgaggccgggccggccttccagggcacgatcaagtcggcggtggcgttcggcgcgctgctcgccgaggggatcggcgacaccatccgggtctcgctgtccgcgccgccggtcgaggagatcaaggtcgggcagcagatcctggagtcgctcggcctgcgcgaacgcggcctggagatcgtctcctgcccgtcctgcgggcgggcccaggtcgacgtctacacgctggccgagcaggtgaccgcggcgctcgacgggttcccggtgccgctgcgagtggccgtgatgggctgcgtcgtgaacgggcccggggaggctcgcgaggccgacctcggggtcgcctccggcaacggcaaggggcagatcttcgtcaagggcaaggtgatcaagacggtgccggaggcggtgatcgtcgagacgctggtcgaggaggcgctgcggctcgccgacgagatgggcgcggagctgcccgacgagctgcgcgagctgctgcccggtcccacggtcaccgtgcactag

SEQ ID NO: 4024 - DNA, 879 bp, Actinoplanes utahensis
atgcgtgtcaaggtgtgtggatctggcaatgtggtagctgtgttgacggtgcccattcgccagctcggtgagcccgagcgcgtgtcggtcgagcggattctggacgccgacccctatgcgggtgcccagatcgccgagcgggtcgccacacacgggctgaactggtggcggtccgacgggcgcatctacggctatgagccggcccatcgcgtcgagtcgatcatctggtcgggcgcgcacctggtgccggtgggcgcgaccgcgccggccgtggcggcgttcgccgacctgctcagcaccgagccgcggatctgctcgtcgatcatcgggcgggccgaggcggtcctcgacctgtgggatcggctgagcgtgcactgggggcgggcccgggacgtgcggccccaccagccgctcctggtcaccgaccgcgcgccggaggtgccggccgacccggaggtgcgtctggtccggccgggcgaggtggatcagctgttcccggccgccgtggcgatgtacacggaggaggtcggggtctcaccgctgcaggacgacggcggccggggctaccggcggcggatcgccgagctggtcaagggccggcgggcctacgcccggttcatcggcgaccaggtgatcttcaaggccgagctggccatcatcacccggcgcaccacgcaggtgcagggtgtctgggtgcatccggagtatcgggggcgcgggatcgcgaccgcggcgatggccgcggtggtcgacgacgcgctgcgccgggtcgcgcccacggtcagcctgtatgtgaacgactacaacaccgccgcccgtcaggtctaccaccgctgcggcttcacctcggccggcgccttcgccaccgtgttgttctga

SEQ ID NO: 4025 - DNA, 621 bp, Actinoplanes utahensis
atgaggttcatgcacgagggacacgagcggcaccacggacacgggcgtcgcatgcgcggcttcggcttcccgcccggattccccttcggccccggcggtcccggcggcttcggtccgggcggccccttcggccccggcggcccgggcggcgacttcggtggccgcggcggccggcgcggtggccgcggccgggtcaacgtccgccccgccgtcctggcgctgctcctcgagcggcccatgcacggctacgagatgatccaggagctggacgcccgcaccaacggtctgtggcggcccagccccggcagcatctaccccaccctgcagctgctcgaggacgagggcctgatcgaggccaccgccgacggcggccgcaagagctaccggctcaccgaggacggccggcccgaggccgagaccgcggcacagaacccgccgtgggcccgcttcggcgacgacaccctcaaccaggtccaggacttccgcgacgcggcggtcgggatcttcggggcgctgaagcaggtgggcttctcggggacgccggagcagcggcagaaggcgctcgaggtgctcaacgagacgcgccgcaagctgtacgccatcctcgccgacagcgagtga

SEQ ID NO: 4026 - DNA, 723 bp, Actinoplanes utahensis
gtgacgcggtccgacaatgggcgcatgattgacgcctcggatctggccgcgttcgccgcgctgctggccgaccgcacccgggcggcgatgtgcctggccctgctcgacggccgcgcctggaccgccggcgaattggccacccacgccggtgtggcccgctccaccgccaccgagcacctggaccgcctgatcgccggtggcctgctcaccgaggcccgccagggtcgccaccgctacgtccggctcgccgaccccgcagtggccgtcctgctggaagatctcaccgcccgcctccagcccggccctccgccggtccgcaccctgcgggccgccaccgccgacgccgccctgcgccggggccgcacgtgctacgaccacctcgccgggcgcctcggcgtcaccctcaccgacgccctgaccagcgccggcctgctcgaccaggacaccgggttcgcgatcaccgacagcgggctgacctggctccgcgcgaacgcggatctgactcccgccgacctgttggccaaccgccgcccgctggcccgcgcctgcctcgactggaccgaacgccgcccccacctcggcggtctggccggcgcccggatctgccgaaccttcctggcccacggctggctcacccgcatcgggtccgggcgagcggtccgcgtcacaccgaccggcaggtcagcactcggccggctgctgggcgtgaccgaattcgactga

SEQ ID NO: 4027 - DNA, 975 bp, Actinoplanes utahensis
atgcgatggggcatgaccgttccgctcggcggcgttccgctgcccgaccacgccgccgttttcacggcactggccgacgccggattcaccgacgcctggtcctccgaggtcgccggcaccgatgcgttcaccccgctcacccttgccgccgcctgggagccgcggctgcgcctgggcaccgccatcgccccggtctacacccgcggccccggcctgctcgcgatgaccgcggccgccctcgccgagaccgcccccggccgcttccagctcggcatcggcgcgtcctccccggtcgtcgccggcgactggaacgccgccgacttcgtccagccgttcgcccgcagccgcgacaccctccgtttcctgcgcgccgccctgaccggtgacctggtcgacgaggcctaccccaccttcaccgtcaagcgcttccggctggaacgcccgccggccgtcccgccgcagatcctgctggccgccctgcgcccgcagatgctgcacctggccgccgccgaggccgacggggtgatcctcaactggctgtcggccgccgacgtgcacaccgccctggccgagacgaaagaggccgggcccgacttcgcggtcgccgcccggatcttcgtggtgccgaccaccgacgccggctacgcgcgcaccctcggccgccgcctgatcacgtcgtatctgaccgtcccggcctatgccgctttccaccgctggctgggccgcgccgaaatcctggagccgatgtggcaggcgtgggcggccggtgaccgcaagggcgcactggccgcgatcccggatgcgctggtcgacgagctgatcgtgcacggggcgccggacgaggtgcgggcccgggtccaggcatatgcggaggccggcatcaccgtcccggtgatggcgctgctgccgacgccggagctggagcgcggcggtttcccggccctgaccgagttgatcgcggcactgggccgttag

SEQ ID NO: 4028 - DNA, 888 bp, Actinoplanes utahensis
atggcggtgctcagcgcggccggcgccgggatccggcaccatcggcgctggctcgtgcgcgacctggacctggtggtcgagccgggcgagacggtcgcggtcgtcggcccgcccggcagcggacggaccagcacgctgctggcgctcgccggtcggttgcggttgtcggcgggcacggtctctttgggcggtacgtcgtcagtcggccatgtgcccggtgtcaacgaacccgaacccgctctcacggtcctggagcacgtgcacgagcggctggccctgctcggccgcagacggcgcgaggccacggcggtgaacctgcacggactggagccggatcggcgcgggcgggagctcacgccgtaccagaggcaggttctggggttggttctggccctgatggcgaagcccgcggtgatcgctctcgacgacatcgagagcgggctggacgcgggggagcgggcgcggctgtgggagctgatcggctcgctgacggccgcggggatcgcgatcgtcttcaccgcgcgtgaggtcgaccccgccgcggtctcccaagtggtgcgggtggggcacccggaatcgcctcaggaaccggaagcgccgaaggaaccgaaggaaccggaagcgccgaaggaaccggaagcgccgaaggaaccggaagcgccgaaggaaccggaagcgccgaaggaaccggaagcgccgaaggaaccgaagggaccggaagcgccggaagcaccgaaggaaccggaagtgccgaagaagccggaaacaccgaaggaaccggaagagccggaatcaccggaagaaccggatgaaccagtgaaggccgaagaaccggagacgccggaaacagcaggaaagccggaagaggcggagaggaaagcgaaatga

SEQ ID NO: 4029 - DNA, 2115 bp, Actinoplanes utahensis
atgatctcgctggccggaatggagttccgccgtttcacccgcagcaagctgaccgccgccgccctcgctgtcctcgccgtcgtccccctgctctacggcgccctctacctctacgccttctgggacccgtacggccacctcagccacatccccgccgccctggtcgtcgaggaccagccggcccaggaccagaagggcaacccggtccacgtcggtcaggacctggcccagaagctgatcaaccgcaaggtcttcgactggcacgtggtcgacgccgccaccgccgacgccgggctcaaatccggtaagtaccagatcgagctccgcatccccgccgacttctccggcaccctcgcggacgcgccgaatgcgaagaccgacccggagaacgcgcggctcagcgcggtcagcgacgattccaccaactacctttccggcgttttcgcccgcaccgccttcgatgaggtccgggcggccgtcagcgccggcgcctcggcgaagtactacgaccagatgctgatcggtttcaccgatctgaaggagcagaccgagaaggccgccgacggtgccgacaagatcaccgacggggccggtcagctgcacggcggcgccgcgaaggaggcggccggcgtcgacaaggcgcatgccggcgccgggcagatcgccggcaagctgaccaccgcgggccagggcgccgaccagctcgccgacggcctgcgccagctggaggcgggtgccggccagctggcgtcgggcaccgcgcaggcggccggtggcggccgccggttggccaacgcggtggacggcgtcgcggaccgggcggagccgatcctgcgcgcgaacgcgggaagcatcgagcacgccgcgacgctggtcgcgaacggcgccgatctgctcgccgcgaatgtcggcgcgatcgacaccgcggccgaccgggccgtgcgcgacgccaaggagctgcgcgcctacctggacacggtcccgtccagcgcgtacgcgaaacacctggccgatcgcctggtcgcggacgcccggcggattcagcgcaaggtgcacgccgccgacctcgccgggctgcgcgcccagctgcgggaggtcgcgaagaccgcccgcgcggtcgccgccgccgcgccgcacctggccgacgacgtggccaaggcccgctcccaggtggatcagctggccaacggtctggaccggctggccaccggtgccaagcagctcaagtccggcaccgcgcaggccgccgacggcgccacccggctccggaacggcgtgtaccgcctggccagcggggcccgccagctcgacaccggtctggccaagctgtccgacggcgggcacaagatcgccgacgggctcgccgacctgcagaacggcgccggtgagctggccggcaagctcgccgacggggcggggcagatcccgtcgtacgacgatgccgcgaagcggtcgggcattctggccgatccggtgtcgctggaccgggcggtgcgcaacccggccggcacctacggcgtcggtttcgcgccgtacttcctggccctggccctctgggtgggcgcgatgatcaactacatgctgctgcggccgctgaaccgccgttatctggtctccggcgcgcccgcaccccgggtggcgctggccggactgctgcccggcgtgctgatgggcatcattcaaacgatcatcctgtacgtcgtcgtgcacttccgtctcgggctgtccccggtccacccgtggctgaccctgggcctgctggccggcaccgcgaccgtcttcgccgccctgatgcagctgatcggcgccgccctcggcgcccccggccggatcatcgcgctggccctgctgatgctgcagctcacgtcgtccggcggcacctacccggtgcagacctcgcccggcttcttccagggcatccacccgctgctgccgatgacgtacgtggtggacgcggtgcggcacgccgtcgacggcggcgagaccggcccgatcgtgcacggctcgctggtcctcgccgggttcggcgtggtggcgtacctgctcaccgtgctggtcgcgacccgcaaacgccggatgcgcgtcgccgacctgcaccccgagctggtcctctaa

SEQ ID NO: 4030 - DNA, 585 bp, Actinoplanes utahensis
atggacggacgcagtcgccggcgtggggacacccggcagaagctgtacgaggccgcggtggagctgatcgccgagaagggtttctcggagaccaccgtggacgacatcgcgctgcgggcgaacgtcgccaagggcaccgtctactacaacttcaagtccaagaccgacctgttcgaggagctgctgcggcacggcgtcgggctgctcaccgacgagttccgcgcggcggtcgtgggcctgccaccccgggaggcggtgcgggccctggtccgggcccaactggcgtacatcaagaagtatcgcgccttcgcccagctcctcgtctccgagatgtggcggaccaaccgtgagtggcagcagaccctgatcctgctgcgggagcaggcgatcggcgtgatcgccgagtcggtgcaggccggcgtcgacgccggcgacctcccggccgacctggacgtccgggtcgcctcggccgccctgttcggcgtcggcctggtggtcgcggtcgactggctggtcttccagccggagcgcccgatcgaggacgtcgaggcgtcgatgctggcgatcgtccgccgcgtcgcctga

SEQ ID NO: 4031 - DNA, 822 bp, Actinoplanes utahensis
atgctgcgccgctggcgtgaccgcgtcaccccggaggtcgccggggtgcccgccggccgccgccggcgcgccgcgggtctgcgccgtgaggagctggccaccctggccggcatctccaccgactacctgacccgcctggagcagggccgcgccaccgccccgtccgcccaggtcgtcgagtccctggcccgggccctgcggctacccaccccggaacgcgacctgctgcaccagctggccggccacgccgcccccggccacgacgtcgtccccacccggatcaccgccagcgtccagcgcctcctcgaccgcctggcgcacaccccggtcgccgtccacgacgccacctggaccctgctggtggccaacgccccctacaacgccctgatgggcgacaccaccacctggcacggccggcaccgcaacgccgtgtggcgcagcctcgccggcacccccacccgggtcgtgtactccccgcgcgagagagccgaccacgaggcccgcatggtcgccgaactgagtctgaccgcctcccgctaccccgccgaccacaccctgcgccgcctgctccacgacctggccacggagtttccgcgcttcaccgagctgtgggagtccaccaccgcgccgccacccagcgacccggccaaacgcaagatcgtcgaccacccggcggccggccgcatcaccctggactgcgacaccctgctggtcgccaccgatgacctgcgcatcaccgtctacaccgccgagcccgcgaccgacgacgccgaccgcctcgcgctcgccatcgtcctcggcatccagccgttcaccccctga

SEQ ID NO: 4032 - DNA, 408 bp, Actinoplanes utahensis
atgcccagcaggatttcggatgacgccgacctcccggcgtacacgatgggccgggccgccgaactgatcggcgtgacgcaggccttcctccgcagtctcgacggcaccggcttgatcgaaccggaacggtcggccggcggccaccgccgttactcccgtcaccagctcgccctggccggccgggtccggatcctgctggacgagggtctcccgctgaccgccgcggtccggatcgtcaccctggaggatcgcctggacgccgcccatcagcggatccgggacctgggcggcacgctcaccgcgggcgaggacgcctcgatcccgatgcagacccggggcgccggcccgagccgtgccgacgagggcggggcgggggccggggagatgcgagcgcgacaggacgtgtaa

SEQ ID NO: 4033 - DNA, 1278 bp, Actinoplanes utahensis
atgccatcgtggaacgtcgaggagtggcggcggcccggaccgaccgcgcagcagcgccgcaacgacctgctgaccgggctgggggccaccgggctcgccgtgatcagcctgttcctgctgcgcagcaccggctacttcgagagtgaccgggcgccggcgatccccgaggaggtcttctgggcggtggccacgacggtgccgctggtctggcggcggcggttcccggacgcggtggcggtcgtcatctcggtgttcttcatcgccgggcagatccggttctcgcaggagcagatgatcgtcaactacgcgctgttcgcggcgatctacacgctcggtgcctgggggcgcaaccggcagcgtgcccggatgatccggctcgggatcgtggcggtgatgttcgcctggctgaccctgtcgttcgtgctgtaccacgacgccgtgtccgcgacgatgaccgacaagggctcgggtgagctgtcgaaactctggtcggcgatcttcatcagctacctgcagaacatcgtctacttcgggttcacctacctgatgggcaacgccgcctggcgctccgtctggcgtcagcaccagctggccgagcaggccgaggagttgcgcgcggcgcaggcggcggcggccgggcgggcggtgctggacgagcgggtgcggatcgcccgggagctgcacgacgtggtcgcgcaccacgtgtcggtgatgggcatccaggcgtcggcctgccgccgggcgctggaccgggatccggcccgggcggtcaccgcgctgaccgcggtcgaggacggcgcgcggaccgcggtcgacgagctgcgccggatgctcggcgcgctgcgcgccaccggcccggcgacacgggagtcgccgggcgccgggctcgaccgggtcgaggagatcgtcgagcgcgcacgggaggcgggcctccaggtcgatttcgggatcttcggtacaccggtgccactgcccgattccctgtcgcaggccgcctaccggatcgtgcaggagtcggtgaccaatacgctcaagcacgcgggggcgtccgggctggacatccggatccggtatctggccggggagttggagctggacgtggccgacgacgggcacggcggcgggggacgggccggcagcgggatgggactgatcgggatgcgggaacgggtcgcggtgcacgacggcaccctggagtgcggccggcgtaccggcggcggctaccgggtccgcgcccggctgccgtacgccccggcggccgtggagagtgccgcgtga

SEQ ID NO: 4034 - DNA, 660 bp, Actinoplanes utahensis
gtgagcatccgggtcctcctcgcggacgaccatcggctggtccgctccggcttccgggtcatcctcgagatggaggacgacatcaccgtggtcggtgaggccgccgacggggccacggcggtggagctggcactgcggctgcgtcccgacgtcgtcctgatggatgtggagatgccggtgatggacggcctggaggcgacccggcggatcgcggcgcagagcggcccgtcggtgttgatcctcaccacgttcgactccgacgactacctgttcgccgcactgcaggccggggccagcggattcctgctgaagaacggcaccccggaggcgctgaccgaggcggtgcgggtgctcgccgccggtgacgcgctgctcgccccggcggtgacccggcgggtgatcgccgagttcagcgcgccccggcagcggtcccccgagccgggggtacgcctcggcgagctgacgccgcgcgagcacgaggtgctggtcgagctggccggtggggccaccaacgcggagatcgccgccgccctgcacctcggggagaccaccgtgaagacccatgtcagccgggttctgatgaaactgggcgcgcgcgatcgtacgcaggctgtggtcatggcgtacgagatgggcgtggtgcgtccgtcgcgagaatga

SEQ ID NO: 4035 - DNA, 894 bp, Actinoplanes utahensis
atgaaccccgaactgagcgtcgacgcggtcgaccggtcgttcggtgagcggcaggtcctcaaggatgtgacgttcaccgtggcggccgggcggctcaccggattcgtcggtgccaacggcgccggcaagaccaccaccatgcggatcatcctcggcgttctggccgccgacgcgggcacggtgagctggcgcggcgagccggtcggccgggagatccgccagcggttcgggtacatgccggaggagcgcggcctctacccgaagatgagcgtcctggaacaggtcgtctacctgggccggctgcacgggctgggcgcggccgaggcccgccgccgcacgctcgctctactggaacgcctggagctggccgaacgggccgacgaccacgtgcagaaactgtcgctgggcaaccagcagcgggcgcagatcgccgccgccctggtgcacgatccggaactgctggtgctcgacgagccgttctccggcctcgacccgatcgccgtcgacaccgtggtcggggtgctgcgggaacgggccgccgccggcgccgcggtgctgttctccagccaccagctcgacgtcgtcgagcgcctctgcgacgacctggtgatcatcgcggacggcacgatccgcgccaccggcgaccggaccggcctgcgcgagcagtacgcactgccgcggtaccgcatcgaggtggccggcgacgccggctggctgcgcgaccagtccggcgtcaccctgatcgacctggacggccggcacgccaccttcgacctggcggtcgggctcgacgaccaggtggtgctgcgcgccgccctggaccgcggtccggtgcacgcgttcggtccggtccgccccaccctcgccgagatcttccgagaggtcatccagtga

SEQ ID NO: 4036 - DNA, 1056 bp, Actinoplanes utahensis
gtgacgacattcgaggccgccaaactcgtcgccgcccgcgaggtccgggtcaagctgcgcgacaaggccttcctcttcagcaccgtgctgttcctgctcatcgtggtcgcctcgatcgtgctgccgaccctgctcgacgggggcgccaccaaggtcgccgtgaccgacaccgcgaccgtggcgaccctgcagaagagcggtttcgaggtacgggtcgtcgccgacacgcccgccgcggaagccctgatccgctccggtgacgtcgacgcggccgtgctgcccggcccggtggtggtcgccgagcaggaccgtccggacgacgtgatcgcggcgctgagcaccgagccgcagacccgctacctggagcacagcgacatcgccccggccctgaagatcctggtgccgatcgcgttcgcgatgctgttcttcttcacctcgttcaccttcggcatgcagatcgcgcagagcgtcgtcgaggagaaacagacccgcatcgtcgagatcctggtgtccagcgtccccacccgcgccctgcttgccggcaaggtcttcgccctgaccgtgctcgccttcgcccaggtcggcctgctggccctggtcgcgatgatcgggatgaccgccacggacgccgcccccggcctgctcaacgccatgatcccggcgatcggttggttcctgccgttcttcgtgctcggcttcgtcatgctggccgcgctctgggccggggtcggcgccctcgcctcccggcaggaggagctggccagcaccacggtgccggtgcagatgctggtgctgatcccgttcttcctggccctcagcgtcccgcacgacggcatcctgatgaagatcctgtcgtacgtgccgttctccgccccgatcgcgatgccgatccgcctgttcgacggcacggccgccgggtgggagccgatcgtcgccgtcgtcctgctggccgcgaccgcgctgggtctgctcggggtgggtgcgcgggtgtactcccgctcgctgctgcgcacccaggtccgcaccccgctgatggccgccctgcgccggtcctga

SEQ ID NO: 4037 - DNA, 2064 bp, Actinoplanes utahensis
atggaaatgtggcttgcccgcaacggcaggaggtcgctgctgctcagtgccgtcctggtggcctgcgccgtggcggccgccccggccgctccggccgcggcgactccggcggccgtgccgagcggcgtgctgttcgacgacttccactaccgggatgccggggatccggcgctggccgtccacggctgggatgtccggaccggggccggcgggcccggtgtcgccgggacctggtcggcggacgcggtgagtttcccggcggatgactcggcacgcggcgggcaggcgatgcggctgcgggccggcaccgacggcaccgtcgggggaacgacgcaggcgcaggtgaacacggtgcggagcaagttctactcggggaccttcgccgcgcgggtcttcctgaccgacgcgccggtctcgggtgccgatgtcgatcggccggtgcaggctttctacgccatctcaccggcggcggatgcgcactacagcgagctcgatcacgaatatctgccgaacggaggctggggaaccaccgggccgcggcacttcaccaccgcgtggcacgatcccgatccggcggtcgaggaccgggtctccaccaaccaggcggggtcgctggccggcgcctggcatacgctcgtgatgaccgtcgagaacggcacggcagacttcttcgtggacgaccggaagctgctcagcaccgggtcgccgtactcgccgcgcgagccgatgatgatcaacttcaacgagtggttcgccgagtcggtggccggtgccggggcgacccgctcctgggacatgaaggtcaactgggtctactacaacagggccggagcgcagagcccggcgcaggtggcggcggccgtcgacggctactacgcgagcggcaccgacttcgtcgacaccgtcgcggccgggaccgtggcgcacgactacaacggtgacgggatcagcgacatttcgctgctctacgactacggggccacccaggcggccggctgcccggtcagcccgtcgcgggacaccgcgatgttcgacctgtccggccgggctgaccgcagcggcgggctgaccggcctggccacccagtggcggggcccgtgccaaccggtcctgccgcggttcaccacgtccggtgacttcaccggagacggcaggagcgacgtggcggcgttctacgactacggcagcgcgggcacgtcctgcccgggtgtcgaccgggtggcggtgctggtgtggccggccgacccggcgggcaccggcgcgctgctggagccggtcaccgcgtgggcgagttcctgcttcgggtcccggaccgcgttcttcgaacccggtgacttcaacggggacggcaagagcgatctggcattgctgtacgaccacggcgccggcaacctgcggatgctgacgctcagcgccaaggccgacgggagcggcaccttcgacggcgcggtggtccggtgggaggcgaccgactgggggaccggggtcaagttcgtcaccgccggtgacctcaacggggacggcaagagcgacctcgccctgttctacgactacggcacggcgggggccacctgtggcgggaactcgcaccaggcggtcttcgtcatgaccgcggacggcgcgggttccggcgcgctgagcacgccgatgaagggctgggagagcacctgcttcggtggcggcacgtcgtcggtgaaggccggcgacttcaacggggacggacgcagcgacctcggcctgctgtacgactacggtgccggccacgtcaagctgctcaccatcgcctcgggcccgggcgggctgcagggtctggccgcccggtgggagagcacccgctggggcaccggcacgaaattcgtgaccaccggcgactacaacggggacggcaagagtgacgtcgccttgctctacgactgcgggacggccggggcgacctgcaccggtgccgcccaccagatcgtctacgtgctgaccgcggacgggtacggcaccggcggtttcccggaggtggcgaagcggtgggagagcaccagtttcggggcgggcacccgattcgtcagctga

SEQ ID NO: 4038 - DNA, 1533 bp, Actinoplanes utahensis
atgagcactgaaccggccgttagcagcagcgacgaggaacgactcgcgcaactcggatacaagcaggaacttcatcgccggttgtccggcttctccaacttcgcggtctccttctcgatcatctccatcctggccggtgcgatcacgtcctatgtgatcgcgatgaacgccggcggaccgttcgcgatcaccatcggctggctgctcgtcggcgggatggtcaccctggtggcgatggcgatggccgaggtctgctcggcgtatccgacggccggcgcgctgtactggtgggcggcggcgctggccaagcggaacaaggccgcgtgggcctggttcatcgggtggttcaacttcctcggcgaggtcgcggtgaccgcggcgatcgacttcggggcggcgatcaccacggcggcgttcctgagcctgaccttcgacatggcggtgacgcccgggcggaccttcctgatcttcctggtcatcatcgtggcgcacggtctgctcaacacgttcggggtgaacctggtgcgggtgctctccgatgtgagcgcctggtggcacctgatcggcgtggcggtgatcgtggtgctgctggccgtgctgccggatcaccacaagccggtctccgaggtgttcttcgaggtgaagaacgcgaccgggttcggcttcggcgcagcgacggtgtacgccgtcctgatcggactgttgatggcgcagtacacctacacggggtacgacgcgtccgcgcacgtggccgaggagacgcacgacgcggccaacgcggcgccgcgcgggatcgtgatgtcggtggtggtctcggtgatcgccgggttcgtgctgctgttcgcgatcacctggtcgatccaggactacgacgccgaggcggcgacctcgctccagttgccgccggcgcagatcttcatcgacgcggccggccacaacgtcggcaccttcctgctgttcatctgcatggtggcgcagtggttctgcgggatggcgtcggtgaccgccaactcccggatgtcgtacgcgttcgcccgcgacggcgcgctgcccggctcgcggctgtggaagcaggtcaacccgcgcaccggcacgccgaccaactcgatctggctgtgcgtgaccatctcgacgatcctggtgctgccgtcgctgtggaacaccacggcgtacgcggcggccacctcgatcgcggtgatcggcctgtacatcgcgtacgtcggcccggtcttcctgcgccgccgcaacccggacttccgggccggcccgtggcacctggggaagtggagctccctggtcggctggatctcgatcgtctgggtggcgatcatctgcgtgctgttcgtgctgccgaccgccggcccgatcacggcgaagaacttcaactacacgatcgtcgcggtggcgatcgtcgtcggcggcgcgaccgtctggtggttcgcgagcgcccggcactggttcaccggtccgcgctccaacctgctggaggcggcggcgcacggcgagcagaccatgccgacggccaacgactga

SEQ ID NO: 4039 - DNA, 1347 bp, Actinoplanes utahensis
atggatctcgaggacctggacgtagcggtcggcaacggttcgatcgacaccgtcctgctggcgctcaccgacatgcaggggcgactgcagggcaagcggttgcacgggcggtacttcatcgacgaggtggccggcgcgggtagtgagggctgcaactatctgctcgcggtggacgtcgacatgaacaccgtcgacggctatgagatgtcctcctggtccaccggctacggcgatttcgtgatgcggccggacttcggcacgctgcgcagggtgccgtggcagccgggcaccgcactggtgctggccgacctgttcgacaccgcgggacagccggtggcaccgtccccgcggcagatcctgcgccgccagctggaccggctggcggcgcacgggctcaccgcgtacgccgggacggagctggagttcgtcctctaccgggacagctatgagcaggcgttcgacaggcactaccggaacctgaccccggccaaccagtacaatgtggactactcgttgctgggtaccgcgcgggtggaaccgctgctccgcaggattcgcaacgagatgtacggcgcgggcctgctcccggagagcgccaagggcgagtgcaacttcgggcagcacgagatcgcattccggtacgccgacgcgctgaccgccgcggacaaccacgtcgtctacaagaacggggccaaggagatcgccgcccaggaggggatggcgctgaccttcatggccaagccgaacgagcgggagggcaactcctgccacatccacttctcgctgcgcggccgggacgaccggtcggcgatgctgggcgacgggccggcgcacctgagcgtgaccgggcagcgggcgctggccgggctgctcgccacgatgcgcgagttcagcctgctgttcgcgccgaacatcaactcgtacaagcgctatcagccgggctcgttcgcgccgaccgcgctgcgctggggcgtggacaaccggacgtgcgcgctgcggatcgccggccacggtcagggcatgcgggtggagaaccgggtgccgggcggcgacgtgaacccgtacctcgcgatcgccgcgctggtggccggcgcggtgcacggcatcgagaacgagctgccgctggaggacgagttcgccggcaacgcctaccgggacgacaccgccgggcgggtgccgggcacgctgcgcgaggccaccgagctctgggcgggcagcgcggtggcggaaagcgcgttcggggcggatgtggtcgcccactacgccaacatgggccgggtggagctggccgctttcgacgccgcggtgaccgactgggaactgcgtcgtggattcgaacgcctctaa

SEQ ID NO: 4040 - DNA, 1398 bp, Actinoplanes utahensis
gtggattcgaacgcctctaagtgtgaggatcttgacgtgggcacaactgacgtgatcaacccggcggacgggcgggtcttcacgaccgtaccgtcgctggacctgaccgggaccgacgcggcgatcgagcgggcccgcaaggccttcgggagctggcgcgcggtcgcgcccggggaccgggcgcggctgctgcgccgcttcgcgacggtggtcgacgaccacctcgaagagctggcgcaactggaggtgcgcaacgccggccacaccatcggcaacgcccgctgggaggccggcaacgtccgcgacgtgctgcactactacgccggggccccggagcgactcgccgggcggcagatcccggtcgccggcggggtggacgtgaccttccacgagccgctcggcgtggtcggcatcatcgtgccttggaacttcccgatgccgatcgccggctggggcttcgcgcccgcgctggcggccggcaacacggtggtgctcaaaccggccgagctgaccccgctgaccgcgatccggctcggcgagctggccctcgaagccggcctgccggaaggggtcttccaggtgctgcccggcaagggcagcgtggtggggcagcggttcgtcacccacccggcggtccgcaaggtctgcttcaccgggtccaccgcggtcggcaaatcgatcatggcgggctgtgccgaacaggtgaaacgggtgacgctggagctgggcggcaagagtgccaacgtgatcttcgcggatgcggatctggacaaggcggccgcggccgcacccggggcggtcttcgacaacgcggggcaggattgctgcgcccggtcgcggttgctggtcgaggcttcggtgtacgaccggttcctcgccctgctggagccggccgtccagaaattccgggtgttggaccctgctgacgagaagtcggagatgggcccgttgatctcgtccggccagcgggacgtggtcgcgtcctatgtcgacggcgcggaggtggcgttccgcggcagcgccgcattcaccgacggctggtggttcccgccgaccgtgctgctcgcctcctccgcggcggaccggcactggcgggaggagatcttcggcccggtggtcagcgtgctgccgttccgggacgaggccgaggcgatccgtctggccaacgacaccgagtacggcctgtccggctcgatctggacccgcgacgtcggccgcgcgctgcgggtctcccgcgccgtcgagaccggcgcgctcagcgtcaacagcaactcgtcggtgcggtactggacgccgttcggcgggatgaagcagtccggtctgggccgcgagctgggcccggacgcgctgctgtcgttcaccgatgtcaaaaacgtgttcctggctacgggagattaa

SEQ ID NO: 4041 - DNA, 765 bp, Actinoplanes utahensis
gtggagcgtttgcaggaccgggtcgccgtgatcaccggcgccggcagtggaatcggtctggccaccgcgcggcgcttcgccgccgagggcgccaaggtcgtcgcggtggacatctcgcaggaggccggcaaggcggtcgcgcaggaggtcggcggcgagttcgtggcctgcgacgtcagtgatgaggggcaggtcagggcactcttcgacggggtggccgagcggcacgggcgggtcgacatcgccttcaacaacgccggcatctcgccgcccgacgacgactcgatcctggtcaccgggctcgacgcgtgggagcgggtgctcaaggtcaacacgaccagcgtgttcttctgctgcaagtacgcgatcccgtacatgcagcggcagggcaagggctcgatcatcaacaccgcgtccttcgtggcgctgctcggggcggcgacctcgcagatcgcgtacaccgccagcaagggcggtgtgctggcgatgacccgggaattgggcgtgcagttcgcccgggagggcatccggatcaacgcgctctgccccggcccggtggccaccccgctgctcatggagttgttcgccaaggatccggagcgggccgcccgccgcctggtgcacgtgccgatgggccggttcgccgagccggccgagatcgccgccgcggtggccttcctggccagtgacgacgcctcgttcatgaccgcgtcgcagttcgtcgtcgacggcggcatcaccggtgcgtatgtaaccccgctgtga

SEQ ID NO: 4042 - DNA, 693 bp, Actinoplanes utahensis
atgcgtccgatcatcggcataacgacgtacgtgatgcccgcctcctggggtgtctggcgtgacctccccaccgctctggttccctacgactacgccgccgcggtcacccaggccggcggccgggcggtgctgctgcccccggacgacatggacgccgaggtgctgcgggtgctggacggtctgctgctggccggcggcccggacatcgaccccgcgctgtacggcgagcggcccggcccgcacaccgtcacccatcccgaccgggacgccggcgagctgaccctgctgcgcgccgcgctcgaggccgacctgccggtgctcggcgtctgccgcggcatgcagctgctggtcgccgcgcacggcggcagcctgcaccagcacctgccggacgtgctcggccacgagcggcaccgggtggcccccggcgagtacagcgagcacgacgcggtcttcgtccccggcagccggatcgccgggttgatgggcgaggacgtgaccatcaactgcttccaccatcagggcgtcgccgacgccgggaagctcaccgtcaccggacgggccgaggacggcctgcccgaggcggtcgaggacccggagcggcgattcctgctcggcgtgcagtggcaccccgaggtgagccgggaccgccggctcttcggcgcgctggtgacggccgccgccgaacggagttga

SEQ ID NO: 4043 - DNA, 744 bp, Actinoplanes utahensis
atgcgcagaccgctgatcggcctcaccgcatacgcccagcacgtgcagtacggccggaacgagctgatggccggcatgctcccgatgacgtacgtgcgggccgtgcacgccaccggcgggcgggcggtgctgatcactcccgacgaccccggcaccgacgtgctggaatcgctcgacggcatcgtcttcaccggcggcgccgacgtggacccggcgcactacggcgccgcgccacacccggagaccgaggtggacgcggtccgggacgccgccgagatcatgctgatgcgtgcggtgctcgacgccgacctgccggtgctcggcgtctgccggggccaccaggtgatggcggtcgccaccggcggctcgctgcaccagcacctccccgatctgatcgggcacgaccggcaccgcggcgcggtcggcaccgacccgctggccgccggggccggcgactacggccggcacgacgtggtcaccgcggacgggtcccgcgcccacgacctgttcggccggcagaccaccgtgaactcgttccaccaccaggcggtggccgaccccggcgagttcgtggcgaccggctggtgcccggacgaccgggtggtggagatcctggaacatcccgggcgcagcttcgcgatgggcgtgcagtggcaccccgagcgcaccaccgacctgcgggtcttcgcggcgctcacccgggccgcgctgatcagccgggagatcgccgcggcctcggtgtag

SEQ ID NO: 4044 - DNA, 702 bp, Actinoplanes utahensis
atgggcgtcctgcccgcccggctgcgcgtcgccttcgagcgcggcggcgagatgggccggcggatggccgagctggactggtccgcctccccggccggggatcccgcgaggtggccggacgagctggtcggcgcggtggtgacgatgctcgcctcgcgcacccagatcctgatcgcctggggcccgcagcacaccgtcctctacaacgacgcgtacgccgccatcgccggtggcaagcatccggcgtacctgggccggccgggccgggacatgtgggccgagacgtgggacacggtgcagcggctgatccgccgggtgcatgagagcgacgaggcgttctacgccgacgaccacccgttcctgatcgagcggcacggcttcctggagcagacctacttcgacgtgtcgttcgacccgatccggtccgccgacggctcggtcggcggaatcatgtgcatcgtcgccgagaccaccggccgggtgctcggcgagcgccgggtgcggatcctcggcgcgctcggccgccggctggccgacctggccgtgccggccgcgctggccgccgaggcggtggccgcgctccgggtcggctcgctcgacgtgccctacgccgaggtggtgctcgacgcggccggcgcgcacccggcgatccgggacgtgatcaccaccggccggcccggccgggtgccgctagctagctag

SEQ ID NO: 4045 - DNA, 1551 bp, Actinoplanes utahensis
gtggccggcgcgcgggccgtctacgcggccgcggacaccgacgacgtgctggccgcgccgttcgccaccgggcaggtgaccgaccgggtgcgggccggcctggagttcggccgggtgcgccgggcgacggtcaacgggctgcgcgggctggtcgacgccgcggtcgcgctgagctcggtgaccggtatcgccgaggtgctcgacgtggcggcccggcacgtgcaggcgatgaccgcggccggccgggtggtggtctgcgtcccggacgcccgggccgagcgggacggcggtgccgaggcggacgccgagccggacgtgctggtgccgctgccggacaccgcgggggtgcagctcggcgagctgcgggtctggtccggcgcggacgggccggtgccgccggtcgtgttgacccagctggcccgcctgatcggtctgcggctggccaacgcccggctgtacgagaccgagcaccggatcgcccgcaccctgcagcacagcctgctgccgcagtcgctgccccgggtgccgggcgcggtggtggccagccggtacgtggcgggcagcagcgaggcccgggtcggcggcgactggtacgacgtgatcgccgacccggacggcgggctgtgcctggtgatcggcgacgtggtcggcaagggcgtgcaggccgcggccgcgatgggccagctgcggaacgcgctgcgggcgtacctgctggagggtttcgactgcggcgccgcactgagccggctcaaccggctggtggacacgctcggccggcggcagttcgccacggtgttctgcctgcgcttcgacccgatcacccgggtggcccggtattccgcggccggtcatccgtcgccgatccgggtgaccggcggcgaactcggctcgttcctgtaccgcaccgcgctcggcccgccgatcggagcgctgcgcgaggtcgcctacccggcgcacgaggtgcggctggcgctcggcgaccggctgctgctctacaccgacgggctggtcgaggaccggcggcagggcatcgacgccggcctggccgagctgaccgcggatgtggccaggccggccgagcacatcgaggacctgctggacacgctgctggccaaggccgcccggcaggtccgccgggacgacatcgcgctgatcgcgctgcaggtcaccgagccgaccgagttcgtgatgcggctgccggccgacccgacccggctcagtgtgctgcgccagcgcctggaggacttcctgaccgcgcacgcggtgccggacgccgaccagttcgacctgaccgtggcggtctccgaggcggcggcgaacgcgatcgagcacccggtcgagccggccgagccggtgatcaccgtggaggcctcgatgcagccggacgcgatcgtggtgatcgtgcgggacaccggtcagtggcggccggccaccgacgcgggtttccgcgggcgtgggctggccctgatcggcgccctgaccgagctgtccgtgcaccggtcgccggccgggaccgcggtgaccctgcggcggccgctgaccgcggcctga

SEQ ID NO: 4046 - DNA, 315 bp, Actinoplanes utahensis
gtggatcaagaggggcaggacccgactttcacggcgaccggcgcggtcgacggtgatcgggtggtcgtcaccgtgaccggcgaggtcgacatgtccaccgcgggcgccctgttcgagaccgccaccccggagcggatcaccggcgccaccatcgacctgcgggcggtcaccttcttcgactcggccgccatccacaccctgatccggctcgccgagcggtatccggaaacgctcgaggtgatcccctccgagcgggtgcgccgggtgctcgacatctccggcctgggcggccagccctggctcaggtcgcactga

SEQ ID NO: 4047 - DNA, 858 bp, Actinoplanes utahensis
atgaccgtacgtgcaccgctcgtgccgggcaagcagtcgcgtgagcgatcggtcccggccaccatcgtccgccccgaatacgtcggcaagaaacggcccgcgccgtggcacggctcgcacgtgcagaccccggagaccatcgagaggatgcgggtcgccggccggatcgccgcgcaggccacccagctcgccggcgagcactgcaagccgggggtgaccaccgacgagatcgaccgggtggtgcacgagttcatcctcgaccacggggcgtacccgtccaccctgggctacaagggtttccccaagtcctgctgcacctcgctgaacgaggtgatctgccacggcatcccggactccaccgtgctggaggacggcgacatcatcaacgtcgacgtcacggcgtacctgaacggcgtgcacggcgacaccgacgccacgttctgcgtcggagaggtcgatgaggaggcccggctgctggtcgagcgcacccacgaggcgatgatgcgggggatcagggcggtcgcgccgggacggcagatcaacgcgatcgggcgggtgatcgaggcgtacgcgcgccggttcggctacggcgtggtgcgcgacttcaccggtcacgggatcggcgagacgttccactccgggctgtacgtgccgcactacgacaagcccgacctgaccgtcgtgatggagccggggatgaccttcaccatcgagccgatgatcaccctcggcacccatgagtacgagatctgggcggacggctggacggtcgtcaccaaggaccgcaggtggaccgcgcagttcgagcacacgctggtggtgaccgaggacggcgtcgagatcctcaccctgccgtga

SEQ ID NO: 4048 - DNA, 756 bp, Actinoplanes utahensis
gtggaccgcgcagttcgagcacacgctggtggtgaccgaggacggcgtcgagatcctcaccctgccgtgaccccggtgatcgagcaccaccacgccgacgtctccggcggctggctgcgggccgcgaccttcggcgcgatggacggcctggtgaccaacatcgcgctgatcgccggggtcggcggtgcccaggtgagccggcacgcgctgatcctcaccggggtggccggtctggtcgccggcgcgatctcgatgggcatcggggagtacacgagcgtccgcacccagaacgagcagatcgccgccgagctcggcaaggagctgcacgagctgcgggtcaacccggacggcgaggccgacgagctggtcgcgatgtgggtggcccgcggtctgccggccggcctggcccggcaggtcgccgacgtgctcaagcggaacccggaccaggcgttgcgggtgcatgcccaggaggagctgggcgtggtgccggacgagctgcccagcccgtggacggcggccggctcgtcgttcgtctgtttctcggtgggcgcggtgatcccgctcctcacgctgctgatggggtacgacaacctgtgggccgccctggccgtcggcgggctcggcctgttcgcggcgggcgcggtggtgtcccggctgaccctgcgggcctggtggctcggcggcctgcggcagctcgtgctgggcgcggtggcggccggactgacgtacctcatcgggtcgttgatcggggtctag

SEQ ID NO: 4049 - DNA, 789 bp, Actinoplanes utahensis
gtggcgcaagttcgcccaggtcaccccgctgaccctgatctttccgggtcgcccgggcgcctgaacgaccagaatggggtggtgctcgacgagatcgacaccacctcgccccgcggttcgctcgccctccggctctgcgacgcgatccaacgtcgttggccggccgaggtgctggcgatcggcgtgcgcggctcggtggcccacgcggacgacaccgagaccagcgacgtcaacctgatcgtggtgacctatcgcccgcggaccgggccgcggccggcgctgcgcaaggtcgacggcgtgccggtcgacctggcggtgctcgccgccgacgaggcgatcgcccaggcccggcagctgaccccgcgctggccgctgctggccgaccggtacctgaccacgatgccgctgcacgacccgcgcgggtgtttccgggagctgcgcgaggcgcaccagaacctgcttgccgaggcccgcccggcggagtacgcccagctggcccggcacaactgggcgatcgcgaacggggcacggcagcgggcggtccggctcacccagtggtacgacaccgacgccgcgttggtgctgatcgcccaggcccgggtgaacgccgcgctggtcgccggcttcctcacccacacctggttccgcaacgccgcggacgcggtgcggcgcaccggggtggccgccgccgacatgcaggagctcggggcgatcctcaaataccaggccgaggagctggccgcccggggccgcccggtggacggcaccctgggcgcgctcttcgactag

SEQ ID NO: 4050 - DNA, 429 bp, Actinoplanes utahensis
gtgaaagatgaactggccgccgcgctcgccgccgagcaggcggcgatctgggcgtacggggtgatcggcgtgcacctgccgcccggcgccgagcaggaccaggcccgggccgccgagcaggagcaccgggtgcgccgcgacgacctggtcgagcagctggccgggttgcaggccggcgccgcgccgaccccggcgggctatcagctgccgttcccggtcaccgaccgggccgccgcgctgaaactggccgtccagatcgaggacggggtcgcccaggcctggcgcccggtactgccggtgaccgagaacacccagcgcaccaccgcgctgtccgctttgaccgcctcggcgatccgtgccacccggtggcgcaagttcgcccaggtcaccccgctgaccctgatctttccgggtcgcccgggcgcctga

SEQ ID NO: 4051 - DNA, 480 bp, Actinoplanes utahensis
atggtgttgactgatccggtgcggataggtgatgcggatcccacccggcggcgggtgctcgccgcgggcggcgttctggccgggacggtcacgctcagcggttgcggtctgttcggtgacgaccccgagccgccgaaggggccggacccgctgcagccggtgctggacgaggcggtcaccctggccgcgacgtacgaccgggtgatcctggcccagcagtcgctgagcgccacgctcaccccgatcgcccaggcgcaccgggcgcacgccgccgagctggcccgggtgatcggggtcaccgcgcccggcgccgccccgggcgcgtccatcgtcgacggcaccgtggccggcctgcgcagggcggaactcgccgcgcagaagaccgcggtcgccgcgtgccagagcgccccggccggccgggcggcgctgatcggctcgatcgccgccgcgcgagccacccacgccgaggctctgcgctag

SEQ ID NO: 4052 - DNA, 615 bp, Actinoplanes utahensis
atgacgcagcgtggtcgcgccggggcccggcccggcggccgcccgagcagccgctcggattcccggagtgcccccgccctgccgcgcgtcgacctgaccgcggctcgcgcccggctgcgcgaggtggtcgagccggtggtcgccaaggcgggctacgacctggaggacctgaccgtgtcccgggccgggcgccggttcgtggtccgggtgctgatcgacgccgacggcgggatcggcctggacgatgtggcggtcgtctcccgggagatctccgaggccctggatgccgcggatgagcggggcggcgaggtcctggcgggggagtatcaactggaggtcggctcgcccggggtggaccggccgctgaccgagccccggcactggcggcgcaacgccggccggctggtcgccgtcaacgggctgaccggccgggtgctgagcaccgacgacgacggcgtgaccctcgacgtggacggcgccgagcgcagggtggcctgggccgacctgggtgcgggcaaggtccagatcgagttcaagcgcctggacgaggccgagttcggcgacgaggacgacgccgacgacgaagatgaagacgaaggggagggcgaggagtga

SEQ ID NO: 4053 - DNA, 1017 bp, Actinoplanes utahensis
gtgaacatcgacctcgcggcgctgcgcgccctggagcgcgagcgggagatcccgttcgagacgatcctcgcggcgatcgagaccgcgctgctgaccgcgtaccggcacaccgagggcgcggagagccacgcccgggtggagatcgaccgcaggtccggcgtcgcctcggtgctggcgcaggagaccgacgcggacggcacggtggtccgggagtgggacgacaccccgcacgacttcggccggatcgccgcgatgaccgccaagcaggtgatcctgcagcggctccgggaggccaccgacgagcagcacttcggtgagtacgcggggcgcgacggcgacctggtcaccggcgtggtgcaggccgacgcggcgcgtgccgagaagggcatcgtgatcgtcgatctgggcaagctggaggcggtgctgccgcagtccgagcaggtccccggcgagtcctacgagcacggatcccggatccgctgcatcgtggtgcacgtggccaagggcttccgcggcccgcagatcaccctgtcccgctcgcaccccgccctggtgaagaagttgttcgccctcgaggtgccggagatcgcggacgggaccgtggagatcgccgcgatcgcgcgtgagtccggtcaccgtacgaagatcgcggtccggtccaccgtccagggtgtgaacgccaagggcgcctgcatcggtccgatgggccagcgggtccgcgcggtgatgagcgagctgcacggtgagaagatcgacatcatcgactggtccgacgacccggcgcagttcgtcgggaacgcgctgtcgccggccaaggcgctgcgcgtcgaggtggtcgacgcggccacccggacggccagggtgaccgtgcccgatttccagttgtccctggcgatcggccgggagggacagaacgctcggctcgccgcccggctcaccgggtggcgcatcgacatccgtccggacaacgaacccgccacagtcgcggaccgtgatgcggccgaggcggggaactga

SEQ ID NO: 4054 - DNA, 387 bp, Actinoplanes utahensis
atgcggccgaggcggggaactgaccggatacgcggtcgccgcgatcgaggggtagacttgtcctcggtcggcccgacgcgaacctgcgtcggttgccgtaaacgcgcgccggccgcttcattgctgcggttcgtcgcggtcggatccggggaagacctccggcttctgcccgatccaagccgccgactgccgggccggggagcgcacctgcatcccgatccggcctgcttcgagcaggcggagcgacgtcgagccttcgggcgggcgttgcgactcaccggtgttgctgatgccggattgcttgccgagcacatccgcacggtctccgtgccgtgcggaaccaccgatgacgaggcgttctcgccccgtcacgacccagcaaggtag

SEQ ID NO: 4055 - DNA, 177 bp, Actinoplanes utahensis
gtgccaggcaaggcccgcgttcacgagctcgccaaagagctcggggtcgacagcaagaccgttctcgccaccctgaaggacatgggcgagttcgttaagtccgcatcgagcaccgtcgaggccccggtggcccggcggctccgtggcgccctcgaggcgggcggcgcgctcccctag

SEQ ID NO: 4056 - DNA, 1830 bp, Actinoplanes utahensis
atgagctcgggtgctccgcgcggtcagggtcaggagatccggctgtcgcgtggcgcctcgctgtccgacttcgccgacaagatcaacgcgaacccgggctcgctcgtccaggagatgttcaacctgggcgagatggtcacggcgacgcagtcggtctccgacgacacgctgctgctgctcggtgagcacctcggcttcgacgtcaagatcgtcagccccgaggacgaggaccgtgagctgctcgcgcagttcaacatcaacctcgacgccgaggtggcggaggaccgtctggtcacccgtcccccggtggtgacggtgatgggtcacgtcgaccacggtaagacgaagctgctcgacgcgatccgcaagaccaacgtggtcgccggcgaggcgggtggcatcacccagcacatcggcgcctaccaggtcgtcgtcccccaccagggggaggagcgggcgatcaccttcatcgacaccccgggtcacgaggcgttcaccgccatgcgtgcccgtggtgcccaggtcaccgacatcgtcatcctcgtggtggcggcggacgacggcgtgatgccgcagacggtcgaggcgctcaaccacgccaaggccgccgaggtgccgatcgtggtcgcggtgaacaaggtcgacaagccggacgccaacccggacaaggtccggcagcagctgaccgactacggcctgctcgccgaggagtacggcggcgacacgatgttcgtcaacgtcgcggccaagcccggcatcggcatcgacgacctgctcgaggcgatcctgctgaccgccgacgcgtcgctggagctgaccgctccgatcgacgggccggcgcagggtgtcgcggtcgaggcgcacctggacaagggccgcggcgccgtcgcgaccgtcctggtgcagaagggcacgctgcgggccggcgactcgatcgtggcgggtggcgcgcacggccgcgtccgcgccatgctcgacgagaacggtcagcaggtcgccgaggccggtccggcccgtccggtgctggtcctgggtctgacgtcggtgcccagcgccggcgacacgttcctggccgccgaggacgaccgcacggtccggcagatcgccgagcagcggcaggctcgccgccgcgcggccgccttcgccaactccggcgccaaggccacgctcgagacgctcatggctcagctcaaggagggcgagaagacctcgctcacgctggtcatcaagggcgacagctcgggctcggtcgaggctctcgaggacgcgctgttcaagatcgagattccggacgagattcagctcaaggtcatccaccgcggcgtcggtgcgatcaccgagagcgacgtcaacctggcgtcggcctcgtcggagcagaccgcgacgatcatcggcttcaatgtccgggcctccaacaaggtcaaggagatggccgaccgcgccggcgtggagatccgctactacagcgtgatctaccaggccatcgaggagatcgaggcggcgctcaagggcctgctcaaaccggagtacgaagaggtcgagctgggcacggcggagatccgcgaggtcttccgttcgtccaagatcggtctgatcgccggctgtctggtccggtccgggctcctccgccgcaacgccaaggcgcgtatcctgcgcgacggcaccgtggtgggcgagaacgtcacgatcagctcgctcaagcggttcaaggacgacgcgaccgaggtccgcgagggcttcgagtgtggtctgaccctgcagggcttcggcacgccgcagatcggcgacgtgatcgagacctacgagatgcgggagaagccgcgggcctga

SEQ ID NO: 4057 - DNA, 1023 bp, Actinoplanes utahensis
atgtcccgttacgccatgctgctcgccccgtccgccaaccgcgtctacgccgaccaggcgtcccgcatgtcccaggcggagctggccgcgttcaccccggtgctgtccagtgcgccggcggagatcggggtgaccggcatcggcggggtggagtacgtgacgttcaccgccgagctgaccccgcgggacgtcgcccacctgtccaacctctcctcggcgtacgcgctgttcgagctggtcggcgacgacctgctgcggccggtcacgctgaccccgctggcccggtacgacagcgacctgatcaccatcccgaaatacgccgggaagaccaacgagcagttcaccaagctggtgctgaacctcacgctgctcgcctccgcctccgcgaccaagatgctggacgggcacctcaccgtgctggacccgctgtgcggccgcggcaccacgctcaaccaggcgctgatgtacggatacgacgcgatcggcgtggagatcgacggcaaggacgtcgaggcgtacaagctgttcctgcagacctggctcaagcgcaagcggctcaagcacaccgccgacctggtgccgatgcgccggcagggccgccgggccgcgcgccggctggaggtcacgatggcggccagcagggacgaccacaaggccggcgcggtgcagaaactgaccgtgctgcacgccgacaccaccgcgctggacgggctgatccggggcaacgtggccgacgtgctggtggccgacctgccctacggggtggcgcacgggtcgtacgacgacgccggcggcatctcccgccgcccgctggacctgctggagcgcgccgtgccggagtggctgccgctgctgcgtgccggtggcgcggtcggcctgtcctggaacaccaaggtggccaagcgggagctcgccgaggacatcctgaccgccgccgggctggagatcgtcgagcacgctgatctggcgcaccgggtcgatcagggcatcgagcgcgacgtgctgatcgcccgccggcgctga

SEQ ID NO: 4058 - DNA, 294 bp, Actinoplanes utahensis
atgtataccgagaccgcagtcttcgacatgctcctgcccggtgacgcgcaatcgctgaagcagaagcgcagctacgtccgcccgatcatcgcgatgctcaagaaattcgaggtcagcgtcgccgaggtgggcttccacgacctgcacggccgggcccagatcggggtggccgtggtcgcccccgacccggcgcaggcgcgcgccgtcatcgacacctgcgagcaccaggtggccggccggccggagatcgagctcctatcggtcaaacgtcgcctctacggtgacgacgactga

SEQ ID NO: 4059 - DNA, 510 bp, Actinoplanes utahensis
gtgacccgcggtgttacacagtcggaggtgggcgagatgtcggatccggccaagacgcggcggcacgcggagcgtgttcgtgagctggtggcctcactggtgcgggagatcaaggatccccgtctcggcatggtgacggtcacggacgcccggatcaccggtgacctccgggaggcgaccgttttctacaccgtgctcggcgacgtcaccgagcaggccgccacggcggccgcgctggagagtgccaagggcatgctgcgcagccgggtcgggcatgcgctggggctgcggcactcgccgagcctggcgttcaagctcgacaacgtgcaggacaacgtgaaggagatcgacgacctgctggccgcggcccggcaccgcgacgaggaggtgcagcggctggcggccggcaagaagtatgccggcgaccccgacccgtacaaggccgacgagccggccgaggacgacgaggacgagaccgagcgggtgggtgcccgcgaggacctcgggtga

SEQ ID NO: 4060 - DNA, 1017 bp, Actinoplanes utahensis
gtgacgctgccgtcagggcccgccgccgagcagtgggaggccgcggtcgccgcggtccgtgcgctcggcggcgacgcggcgatccagttgatctgccacgtgagcccggacggggacgcgctcggcagcatgctcgggttcgcgctggcgctgcgccggctcgggcacacccgggtccgggccaccttcccgggcgagttccgggtgcccacgccgtacacccggttgccgggcatcgagatgctggtgccggagccggaggcctaccatgacccggagctcttcctggtcttcgacgtggccgccgagtcgcggctgggcggcctggccgcccgggtcgcggcggcgccggtcagcgtggtcctcgaccaccacgcgtcgaacccgggattcggcacgatccgcctgatcgacccgtgcgcggcggccacctcggtgctcgccgaggagctggtcacccggctcggggtgccgctggacgcggagatcgccgagtgcttctacgtggcgctggccaccgacaccgggtcgttcaggttcgaggcgaccacggtggcggtgcacgagctggccgcccggctgatcgcgaccggcctgcgccccggcgagatctcccggcggatcttcgacacccggccgttcggtgccgtgaaactggccggtgaggtgctcggacgggcggtgctggaaccgtccgcggccggcgggcgggggctcgtctggacctacgccacgctggccgacctggaccggcacgaacaaccgccatacgtgctcgacacgttgatcgacccggtccggtcggtggccgaggccgacgtgacgctgctggtgaaacaggtggcggagaatgagtgggcggtgtcgctgcgcagcaagggcgcggtcgacgtgagccgtctggcgatctcccagggtggcggcggtcaccgcctggccgccggtttcaccggttatggggggcctggtgacgtggtggacaccgtgcgtcggctacttgacgaatttctggattga

SEQ ID NO: 4061 - DNA, 1314 bp, Actinoplanes utahensis
atgagcccgcctgcccagcaccgcaccggttcccgccagatcgccagcctcgccctgccggcgctcgtggtgctggccgccgaaccgctgtacgtgctggtcgacacggccgtcgtcggccacctgggacgcgcgccgctcagcgccgtcgccgtcggcggcaccgtgatgtcggtcgccgtctggttcggcaccctgatggcgtacgggacgaccggccgcgccgcccgccgcttcggcgccggcgaccgccccgccgccgtcgccgaaggggtccaggcctcctggatggccctcggcttcggcctcgtgctcagcatcctcggggtgaccctggccgggccggtcacccacgccctggccggcaatccggccaccgccgacgctgcggccggctggctgcggatcgccgccctcggcgttcccgggctgctgctcgccgccgccggcaacggatggatgcgcggcgtccaggacacccgacggccactgatcatcgtgctcggggcgaacgtgctctccgccgtcctctgtccactgctggtgttcccgctcggcctcggcctgaccggatcggcgatcgccaacgtcaccgcgcagtcggtcgggggtggactgttcctgctcgccctgatccgcgagacccggcacctgcggcccatcccggcggtgatcatcaagcaggtggtgctcgggcgggacctgctcatccgcggagccgccttccaggcctgcttcctgtccgcgaccgcggtcgcctcccgattcggggtcgccgcggtcggggcgcaccagatcgcgttgcaactctggttcttcgccgccctcgccctggacgcggtcgccatcgccgcgcagtcactggtcggggcggcactcggcgccggcgacgcggaccaggcccgggacatcgcgcggcgggtcaccatcgccggaggcatcgcggccgtcgggttcgccgtcctggcgggcgccggatcgtcggtgatccccggatggttcacccgggacccgtcggtgctctcccaggccgcaatcgtgtggccctggttcgtggcgctgctgccgttcgccggcatcgtgtacgcgttggacggcgtgctgatcggcgccggggatgtggcctacctgcggctgacgacgatgctggcggcgctgctgggcttcctgccgatgatctggctggcgtatgcgttcgacctcgggctcgggggagtgtgggcggggctcgggctgttcatcgtggcccggctgatcgccacggtttcgcggtggcggtcgtcgcgctgggcggtcatcggcgcgacccgctga

SEQ ID NO: 4062 - DNA, 882 bp, Actinoplanes utahensis
gtggatggattgatcgtggtggacaagccctcggggatgacgtcgcatgacgtggtggcgcggattcggcggctggccaagacccgacgggtcgggcatgggggcacgctcgatccgatggcgaccggtgtgctgatcatcggggtgaatcgggcgacccgcctgctgacctatgtgatcggtgcggagaagagctacgccgcgacgatccggctgggggaggcgacggtcaccgatgacgccgagggcgaggtgaccgcgaccgtcccggtggccggcgtggcggatgcggcgatccgcgccgggctggccgcgcaggtcggggagatcgatcaggtgccgagtgcggtcagcgctatcaagatcaatggcgagcgggcctacaagcgggtgcgggacggcgagaccgtggcgattccggctcgccgggtgaccgtgttccggctcgacgtgctggacatccggcggccggccgatcgggacgtgatcgacgtggacgtcgacgtgacctgctcgtcggggacgtacatccgggcgatcgcgcgggacctcgggacggcgctcggggtgggcgggcatctgacggcgctgcggcggaccgcggtgggcgcgatgacgctggcggccgcttcgacgctggaggagctggcggagcgggcgccggacgtggtggggctgccgatggcggaggcggcgcggcgggcgttcccgcagcgggtcgccgacgaggaggagacccggacgctgcggcacggtgggccgctggcggcggtggggatcgaggggccgtacgcggtgttcgacgccgacggcgaggtgctggcgatcgtgagtgagcggggcgggcgggcgcgggccgagatcgtgctctccccggcctag

SEQ ID NO: 4063 - DNA, 393 bp, Actinoplanes utahensis
atgagtcaccgcatcctgttggtcgaggacgaggagttgaaccggatgctggtcaaagcggtcctctcccgggccggcgtggacgcggtccgcgacgctgaactggtcgacgccaccaccctcaccgaggcccgcgcccgggtccacgacaccgagctggacctgatcctgctggacctgaacctgcccgacggcaacggcctgaccctggcccgcgagctgaagagcgcaccgcccgcggaccgccccaagccggtggtggtcgcggtcaccgccagcgtcctgccccaggaccagaaggccgccctggacgccggctgcgacgacttcctcgacaagccctacgccgccgccgacctggtcgccaccgtcgcccggaatctccggctctag

SEQ ID NO: 4064 - DNA, 2754 bp, Actinoplanes utahensis
atgagcgtcgagtggagccgtcttgtcctgctcgccgcggagctcaccttcgcggtcctcttcctgcgcgcgctcggcggatacctgcgccaccgcgacccgctgcgccgcgacgtggctctcgtcttcgcgccgtgcaccctggccttctgcgccgacctgctgcgccagagcctggccacccggccggccctggccggcgggttcacggcggtcgccctgatggcccagccggtgctcaccctgcggctggccggacggctgcgccgggtgccgccggcactgaccaccgcggccctgctcggcttcctggcgctggccggaccgctggcggtcgcccaccgcccggtcccggtcccgctcaaggtggcggcgtcgacctattttttgtccgtcgagttcatcgcggccgccctgctgtacgacacggcccgctgccggaccggcgccaaccgggcccggctgaccatcgccgcggccgccaccaccgccttcggcgtgatgatcatgctgctcggcgcctccggcggccacgtgtccggcgtccgcaccgccagccacgtgctggccctgatcagcggactgggctacctgatcgccttcgccccgcccgcgtggctgcgcgggctgttcgcggccgcggccgcgcactcggtcaccgagcggctgctgcgcgccccggccgagtccccggaggcggtctggcagacctacgccgagatcatgcgggtgcagaccggggccgacgcggtcgccgtgctgctgccccggccggacggtcagctgtggcagatcggctacgccggtccgccgctggacgtccccgacgagccgatccgcgccgccctgggccggccgggcccgctgcgcgacggcgacccggccctgctccgacatttcggtgccggcctggccgacgacttcgtcaccgcgctgcggatgccggtgccgcccgacatcgagggctgggtgctgctgttcaaccggtaccgcgggctgttcaacgacgacgacctgggcctgctcgccgagctcggcgggcacgccgggctgctcgccgaacggtccgcggtgaccgtgcgggaacgccggctgaccgccgagctgaccaactcggtggaggccctgacccgggccaacgaggcgaagagcaacttcctggcgaacatgagccacgagctgcggaccccgctgaacgcgatcatcggcttcagcgacctgatgcggctggaggagccggagggtgaccgccgccgggtgccggccgactgggtcgaccacatccacggcagcggccggcacctgctcggcctgatcaacgacatcctcgacctggccaaggtggaggccggccggatggacctgcgggtcgccccggtccgggtggacaccgcgatcgaggagctgctcaccggcctgtccccgctgttcgccgacaaacgcctgaccgtgatgaccgagctcgccccggtgaccgcgctggccgaccggctgcggctgcggcagatcctggagaacctcttctccaacgcgatcaagttcaccccggccgagggaatggtgacgatcaccacgggggagtccggggaacaggtcacgatcaccgtggcggacaccggggtgggcatcgcggacaccgacgcggaacgcgtcttcgaggagttccagcaggtcggcgacccggagcggcggcaggccgggaccggcctgggtctggcactgacccgccggctggtcgaggcgcagcgtggcgagatcaccctcagctcgacgcccgggcagggcagctcgttcacggtgcggctgcccgccgccccggtcacccggcccagcgccaccggtgcggcgaacgccccgtgtgtgctgctcatcgaggacgacccgcactcggccgagctgatgcagacccagctgagcaacgccggctaccgggtggaggtggccggcaccggggagagcggcctggccgtcgcccgcgcccacaagccggacgcgatcgtgctcgacgtcgaactgcccggcatctccggctgggaggtgatccgccggctgaaggcggacgccgcgctcgccgtcgtgccggtcttcttcgccagcatcctggacgaggccgcggccggcctggccctcggcgcgcacgactacttcatcaagccggtcgaccagccggccctgctcaacgcgctggccaacgcgatcgccgcccgcccggccccacgggtgctggtcgtcgaccacgacgacgcggtccgccaggcgatcgaggacggtctgcgggccggcggcgccgacgtggtctcctgcgccgacggccgggacgggctggcccgcagccgcgccgagaacttcgacctgatcgtctgcgacatgcagtccccgtccgcggacggcttcagcctgctcgccgcgatcgagcaggacccgtccggccggcacaccccggtcctcggtctgagcgcggccgccctggccgagcgggcccccggcgacaccgccccgctgatcgccaccgcgatggccggcggggtggtcgccgaggcgatggccggcggcgccggctgggacagcctggccccgctgctcggccaccacccgggcaccgcacacccggcgatcccgcaccacccggcctcgatccacccggcggtcccggcccacccggcggctcgccgcaccgccggcggcgcccacccaccggccggcgcggtcccgctgcgcagcgccgtaccgtcatcagggaaggaccggcgatga

SEQ ID NO: 4065 - DNA, 933 bp, Actinoplanes utahensis
atgcagcggtggcggggattggagtcggtgcccggtggctggggccgatcggtcgtgaccatcggcgtcttcgacggtgtgcaccgtggccaccaggcgatcatcgggcacgcggtgaagcgcgcccgcgacatgggtctgcagtcggtggtgatgaccttcgacccgcacccgtccgaggtggtccgccccggctcgcacccggcggtgctgaccgagtcggtgcgcaaggccgagctgatcgagcggctcggcgtggacgcgctctgcgtggtcccgttcacccgggagttctcccagctgggtccggacgcgttcgtgcacgacgtgctggtcggggcgctgcacgcggcggacgtggtggtcggcgacaacttccgcttcgggcaccgggccgccggggacgtggcgctgctggagagcctggggcgcaccttcggcttcaccgtcgaggaggcgccgctggtctcggcggacggcgtggtgttctcgtcgacgtacatccgcagttgtgtcgacgcaggtgacgtgcgcgccgcggcggcggcgctgggccggccgcaccgcctggccggcgtggtcgtccggggcgaccagcgagggcgggagctcggcttccccacggcgaacctgatgacgcaccgctatgcggcggtgccggccgacggggtctacgccgcgtggctgacccgggccggggagaatgccggccgatggcccgccagtgtttcgatcggcaccaatcccaccttcgaggggcgggaacgccgggtggaggcgtatgcgctcggtttctcgggtgatctgtacggcgaaagggtcagcctcgatttcgtcgagcacttgcgtgagcagcggaaatacgacgccatcgaaccattggtcgcgcagatccgggccgacgtggaagagacccgggtgttgctgcgttaa

SEQ ID NO: 4066 - DNA, 300 bp, Actinoplanes utahensis
gtgaatcggcaacacagaagtacggagatcatggcgctcgatcaagacaccaagaacaagatcatgacggagtacgcgaccaaggagggcgacaccggttcgcccgaggttcaggtcgccatgctcaccaagcggatcgccgacctgaccgagcacctcaagctgcacaagcacgaccaccacagccgtcgtggtctgctgctgctcgtcggccagcgccgccgcctgctgaactacgttcagaagaaggacatcgcccgctaccggacgctcatcgagcgcctcggcctgcgtcgataa

SEQ ID NO: 4067 - DNA, 2328 bp, Actinoplanes utahensis
ttgacagagcagaccgctctcggcactgaatctcgcacggcagtcatcgacaacgggtcgttcggcacccgcgagatcgtcttctccaccggccggctggccaagcaggccgccggctcggtgatcgtccagctgggcgacaccaccgttctctccgcgaccaccgcgagcaaggcgccgaaggagcacttcgacttcttcccgctgaccgtcgacgtcgaggagcggatgtacgccgcgggccggatccccggctcgttcttccggcgcgagggtcgtcccagcgaggacgccatcctcacctgccggctgatcgaccggccgctgcgcccgtcgttcaccaagggcctgcgcaacgaggttcaggtcgtcgagaccatcctcgcgctcgacccgtcccacccgtacgacgtggtcgcgatgaacgccgcgtcgatgtccaccaagctctccggcctgccgttcagcggcccggtcggctccacccgggtcgcgcacatcgacggccagtgggtcgccttcccgaccatcgaggagctggagcgcgccaccttcgacatggtggtcgccggtcgtgtgaccgccgagggtgacgtcgcgatcatgatggtcgaggccgaggccaccccgcaggcggtcaagctgatcgccgccggcgccaccgcgccgaccgaggaggtcgtggccagcggtctggaggccgccaagcccgcgatccgcgagctgtgccgcgcgcagagcgagctggccgacgtcgccgccaagccggtcgccgagttcccggtcttcctggactaccaggatgatgtgtacgccgcggtcagcgacgcggtgcgcggcgagaccgccgaggccctgaagatcgccgcgaagcaggagcgcgaggaagccctcgacctggtcaaggcgaaggcgcacgagctgctcgacgagcggttcgagggccgggagaaggagatcagcgcggcgttccgctcggtcaccaaggccgaggtgcggcagcgggtgctgcgcgagcaggtccgcatcgacggccgtggcccgcgtgacatccgtccgctgaccgcgcagatcggtgtgctgccccgggtgcacggctcggcgctgttcgagcgcggcgagacccagatcctgggtgtcaccacgctgaacatgctgcgcatggagcaggcgctggacactctcgcccccgagaagaccaagcgctacatgcacaactacaacttcccgccgtactcgaccggtgagaccggccgggtcggctcgccgaagcgccgcgagatcggtcacggcgcgctggccgagcgggcgctggtcccggtcctgccgtcgcgcgaggagttcccctacgcgatccgtcaggtgtccgaggcgctcggctccaacggttccacctcgatgggctcggtctgcgcctcgacgctggccctgctcgccgccggtgtgccgctgaaggcgccggtcgccggcatcgcgatgggcctgatctccgacgaggtcgacggcaagacccagtacatcgcgctgaccgacatcctcggcgccgaggacgcgttcggcgacatggacttcaaggtcgccggcaccagcgagttcgtcaccgccctgcagctggacaccaagctcgacggcatcccgtcggacgtgctggccggcgcgctgcagcaggcgcacgaggcgcgggccacgattctcggcgtgatgaacgccgcgatcgagtccccggccgcgatgagcgagcacgccccgcgggtcaccaccgtgaagatcccggtcgacaagatcggcatggtgatcggcccgaagggtcagaccatcaacgcgatccaggacgagaccggcgccgacatctccatcgaggacgacggcacgatctacgtcggtgcgaccaacggcccggccgccgaggccgccgtcgagcggatcaacgcgatcgccaacccgaccctgccgaagatgggcgacaagttcctgggcacggtggtgaagacggccgcgttcggcgcgttcatctcgctgctgcccggccgcgacggcctgctgcacatctcgaaggtgggcgacggcaagcgggtcgacaaggtcgaggacttcctcaacgtcggcgaccgggtcgaggtccagatcgcggacatcgacgcccggggcaagatctacctggacaaggtgcgcccggagggcgaggaggccccggctgcggctgcggctgcggctgcggacgccccgtcgtccgagggtcgcccggagcgggccccgcgggagaaccgcgagggtggcggcgagccccgccgtcgccgctcccggccggccggcgagcgccgcgactaa

SEQ ID NO: 4068 - DNA, 1332 bp, Actinoplanes utahensis
gtgacgtccagcgaccgcgggccggccggcaggccggcccgcgtttctaccaggaccctgcaggacggcgtgaagaagaccgtcctgccgagcggcctgcgcgtgatcaccgaggcgatcccgaccacccgcagcgccgccctcggcgtctgggtcgggatcggctcccgggacgagacgccggccatgtccggcgcctcgcacttcctggagcacctgctcttcaagggcacccacaagcgcaccgcgctgcagatctccgcggagatcgaggcggtgggcggcgagaccaacgcgttcaccaccaaggagtacacctgctattacgcgcgggtgctcgacaccgacctgccgctcgcggtggacgtgctggtggacgcggtggccgactcgatcctcgacccggccgacgtggagaccgaacgtggcgtgatcctcgaggagatcgccatgcacgaggacgagcccggtgatgaggtgcacgacgtcttcaccgaggcgatctacggcacccacccgctgggccggttgatctccggcaccccggagtcggtcaccccgatgacccggaaccagatcaacagcttctaccgcaagcggtaccgggcgccggagatcgtggtcgcggcggccggcaacctcgaccacgccaccgtggtccggctggtgcgcaaggcgctggccggcagcccgctggacaccggcccggccgagccggccccgccccgccccgacggcacccgggtccgcgtgcagaaaccgcacaccgtggtggtgcaccgggacaccgagcaggcgcacatcgtgctcggcgcgcccggcctgagccggtacgacgaccgccgcttcgccctgggcgtgctcaacaacgtgctgggcggcggcatgtcgagccggctgttccaggagatccgggagaagcgtggcctggcctactcggtgtattcctacgccagccagtacgccgacaccggtgtcttcggcgtctacgccggctgcgcgcccggcaaggcccccgaagtcctcgacctgatccgcaccgagctcgcccgggtggcggccggcgggatcaccgccgaggaactcgtgcgcggcaagggcatggtgaagggctcgtacgtgctgggcttggaggacaccggctcccggatgagccggctcgccaagtccgagctgctgcacggcgacctgatgggcgtcgacgacctgctcgcgcgggtcgacggggtgagcatcgccgacgtcggcgaggtggccggggccctgctgtcccgggaacactcgctggccgtggtgggcccgttcgacgagggcgacttcccgcccggctga

SEQ ID NO: 4069 - DNA, 759 bp, Actinoplanes utahensis
gtgactgacgtgctcgaacccatccgtgtcggtgttctcggcgcccggggccgcatgggcctcgaggtgtgcaaggccgtcgacggcgcccccgacctcgacctggtggcgctcgtcgaccacgacgacacgctgcaggcggccgccgaggccggcgctcaggtgctggtcgacttcaccaacccgggcgtcgtcatggacaacctgcgctgggccgtcgagcagggcatccacgtcgtggtcggcacctccggcttcaccgaggagcggctcgcgcaggtccgcggctggctcgccggcaggccggaggtgggcgtcgtgatcgcccccaacttcggcatcggcgcgatcctgatgatgcagttcgcggcccgcgccgcccgctacttcgactcggtggagatcatcgagcagcaccacccgcgcaagctcgacgcgcccagcggcaccgcgacacacaccgcccggctgatcgccgaggcgcgcaaggcggcgaactgcccgccgatgccggacgcgaccgaggacgaggtggacggcgcgcgcggggcggacatcgacggggtgcggatccactcggtgcgggcggccgggctggtggcgcatcaggaggtgctcttcgggcaggccggggagacgctgaccatccggcacgattcgttggaccgctcgtcgttcatgccgggggtgctgctcgcggtccgcgcggtcgtcgaccggccgggcctgacgctgggtctcgacgagctggtttcctga

SEQ ID NO: 4070 - DNA, 336 bp, Actinoplanes utahensis
atgaagaaggaatgtatggcccaacccgacgacatgctcaacgacgacgattaccccgcctacaccatgggccgcgccgccgacatcgtcggcgcctcgcaggacttcctgcgccgcctcgacgaagcgaaactgatcatcccgttccgctccgccggcgggcaccgccgctactcccgccatcagctgcgcctggccgcgcgggcccgggagatggtcgaccggggcaccgctctggaagccgcctgccggatcatcatcctcgaagaccagctcaaggaagcccttcagcatcgccgtgaccacgagcgccgccagcaggccggcgccgcctga

SEQ ID NO: 4071 - DNA, 204 bp, Actinoplanes utahensis
atggctaccggcatcgtgaagtggttcaacgccgacaagggcttcggcttcatcaccccggacggcggcggcgccgacgtcttcgcccacttctcggcgatcgcgacgagcggcttccgcagcctcgacgagaaccagaaggtggagttcgacatcacccagggccagaagggcccgcaggcggagaacatccgcccgctctga

SEQ ID NO: 4072 - DNA, 555 bp, Actinoplanes utahensis
atggctctcggcttcgtccgtcccgcgcgtcccgaggacgccggtgagatcgcgcgcatccagctcgtcacgtggcgcagcgcctaccgccggatgttcccggcgcacgtgctcgcccagctcgacgaggcggtgctggccggcgtctggaccgaggcgatcaccacgccgccgaccggccggcaccgggtgctgatcgcggtcgagcagggcgagcacgatcacgtggtggggttcgcggcggccgggccggccgacgagcaggccctcgccccggaggagccgccgctgccggacaccgtcgccgcggtcaccgacctgctggtcgagccccgctggggccggcgtggccacggcagccgcctgctcgcggcggccgtcgacctgtggcgcgaggacgccttcagctcggccgtcgcctgggtctacgactccgacacggccatgcgcaagttcctggactccgccggctgggcccccgacggcgccggccgagccctggacgtcgacgacatgctggtcccccagctccgcctccacgtcgcgctgacctag

SEQ ID NO: 4073 - DNA, 543 bp, Actinoplanes utahensis
gtgacgccatcgacgaaccccgcgactccggccggcagcaccgtgacgtcggtccggccgcagaccgatgccgacatcgaggcggcggccgcggtgcacgtgcggagcacccgggccagttatgccgggctcctgcccgccgagcatctggccgcgctggacccggcggtcttcgcccagcgccggcgggcgatggcggcgaagccggaggtgcacaccctggtcgccgagcgggacggtcggatcgtggggttctccagtttcgggccggaccgggaggatccggcgctcgccgagctgtatgccatctatgccgacccggactcctggggcaccgacgccgggtggcgactgttcgacgagagccgccgggtcctggccgaggccggctacccggaggtgcggctctgggtactggccgccaacgagcgggcccggcgcttctacgagcgagccgggatgaccaccgacggggtgcccgcgacacaccgggccgcggccgggatcgaactgccgaagctgcgctaccgcggtcctctgtag

SEQ ID NO: 4074 - DNA, 1218 bp, Actinoplanes utahensis
atgaccagtctcgagacgatctccgtcgcccaggcccgccgcatcacgctggccgcgcaggggttcaccgaccccaagccgggtggcgccaccgatctgcgccacctgcgccgggtgctgcgccgcctgcacctgatccagatggactcggtgaacgtgttgcagcgcgcccacttcatgccgctctacagccgtctcgggccctatccggccgatctgctggagcgcgcggcctatcagcggccccgggagctgttcgagttctgggggcacgaggcctcgctgatccgggccgacctgcagccgctgttccgctggcggatggcgcgcgccggggagagtgcgtggggcaccatgcgccggatcgtcgccgagcagcccgacctggtcgcctgggtgctcgacgaggtccgccgccgcggcccgatcacggcgaacgagatcgagcacgacgcgccgcgccgcaaggaccactggggatggaactggtcggtggtcaagcaggcgctggagtggctgttctggagcggccaggtcaccgcggccgagcgcaccacgtcgttcgcccggcgctacgacctgcccgagcgggtgctgccgggggccgtgctggccgcgcccaccccggagccggccgaggcgttccgcgccctggtcgagctctccgcccgggcgctgggcgtcgccgccgagcccgagctgcgcgactacttccggctgcccaccgcggcggctcgcaccgcgctcgccgagctggtcgaggcgggggtgctgcgcccggtcacggtccgcggctggaaaccggtggcctatctgcaccgggacgcgaaactcccgcgccgggtcgacgtggccaccctggtcagcccgttcgacccgctgatctggcagcgggaccggaccgagcggctgttcgacatgacgtaccggatcgagatctatgtcccgaaaccgcagcgtcgctacggctactacgtgctgccgttcctgtccggcgaccggttcgcggcccgtgtcgatctgaaggcgaaccggcaggccggcgtcctggaggtgccggccgcctggctggagccgtccgccgaccgggacgcgaccgccggggcgctggccgccgagctgcgccgcctggccctgtggctgggcctggacgcggtcgcggccccggtcgcgggcgacttcgccgacccgctgaccgcggcgctgaaggagctgtga

SEQ ID NO: 4075 - DNA, 555 bp, Actinoplanes utahensis
gtggcgctcatgagcaccgtcctcccgccgtggctggaggcccagccgctgcagggtccgccggtcccgcccggctggccggcatatcgccatgacgccggcccgccgcccgaccggatcacccgcttcttcgaccggctggccgcccgctccccgatgtggctggccccgctcgtggtgctggcctgcatgggcggcgcggtcggctacacgctgctcaccgacccggtgcatgccgaggccggcgcggagcccacgtgtctgctgaaatacacgaccggcttcgtctgcccgggttgcggcgggacccgcgccgcgtggtatctgctgcacgggaacctgccggccgcggcccggcaccacgcgatcttcgtgttcgcggtgcccttcctgctgtacatgtatgtggcctgggccgggcagcggctgttccgctggcggattcggcaactcacggtcagtccggccgtgatgatcacgttcatggcggtctgggtggtctggagcgtgctgcgcaaccttccctgggcgccgttcaccgctttctacgtgtga

SEQ ID NO: 4076 - DNA, 894 bp, Actinoplanes utahensis
atgacgcacgacccgcggccgttcggacggctgctgaccgccatggtgaccccgttcaccccggacggctcgctggatctggagggtgcggcccgcctggccgttcacctcgtcgacgagcagcgcaacgacgcgctcgtggtcagcggcaccaccggtgagtccccgaccacgaccgacgcggagaaggacgcgctgctgcgtgccgtggtcgaggcggtcggtgaccgggcccgggtcgtggccggggtgggtaccaacaacaccgcccacacgatcgagctggcgcacgccgcggagaaagccggcgcgcacggcctgctcgtggtcactccgtactacaacaagcccccgcaggccggggtgctgcggcatttcaccgcggtggcggacgcggccgggctgccgatcatggcctacgacatcccgcaccgggccggcacggcgatcgccaccgagaccctggtgcggatggccgagcacgagcggatcgtcgcggtcaaggacgccaagggtgacctgatcgccagctcctgggtgctgagccggaccgatctggccttctattcgggcgacgacgcggccaccctgccgctgctctcgatcggcggggtgggcctggtcggcacctcctcgcacttcaccggcgtgctggcgaaagagatgatcgaggcgtacgagaagggtgacaccgccaccgcgctggcccggcaccgcgcggctctccccctgttcaccggcattttccggtccccggggacgatcctggtgaaggccgggctgaacgcgtccggcctgcccgcgggcccggtccgctcgccgctggtggacgcgagtgacgaggaattgatccaactgcgccaggacgccgccgcggccggcatcgtgctctga

SEQ ID NO: 4077 - DNA, 1689 bp, Actinoplanes utahensis
atgagtcacgctcacgtggagctgggtccgccgccgccgctgccggagggcgccctgcgcgtcattccgctcggcggtctcggcgccatcggccgcaacatgacggtgctggagttcgacggcaaactgctggtgatcgactgcggggtgctcttccccgacgtcgagcagccgggtgtcgatctgatcctgcccgacttcggcccgatcctggaccggctcgaggacattcaggcgatcgtgctgacccacggtcacgaggaccacatcggtgcggtcccctacctgctggcccacaagccggacatcccgctggtcggctcggagttcacgctggccctggtcgaggcgaaactggccgagcgccggctggacccgtacacgttgaccgtgcgggagggcggcatcgagcggctcggcccgttcgagtgcgagttcttcgcggtcaaccactccatcccggacgcgctggcggtggccgtgcgcacccccgccggcctgctgctgcacaccggcgatttcaagatggaccaggtgccgctggacggccggatcaccgacctggccgggttcgcccggctcggcggcgagggcatcgacctgctgctctccgactcgacgaacgccgaggtgcccggtttcgtggcgccggagcgggacatcggcccggtgctgagccggatcttcggcaaggccaagggccggatcatcgtggccagcttcgcctcccacgtgcaccgcgtccagcaggtgatggacgcggcctgggagtacgaccgcaaggtcgcgctgatcggccgctcgatggtccgcaacatgggcatcgcccgggacctgggcctgctgcgcatcccggacggcctgctggtcggtctggacgaggccacccacctgccgcccgacgagatcgtcttcatgtcgaccgggtcgcagggcgagccgatgagcgccctgggccggatgtccaccggcgaccaccggcacatcacgatcacctcgggcgacaccgtggtgctggccagttcgctggtgcccggcaacgagacctcggtctaccgggtgatcaaccagttgtcccgggccggcgcgaccgtggtgcacaaggagacggcgaaggtgcacgtctccgggcacgccccggccggcgagctgctctacctgctgaacgtgacccgccccagcaacctgatgccggtgcacggcgagtggcggcatctgcgcgcccacgcccagctgggcatcgagtccggagtggccgccgaccgggtggtgctctgcgaggacggcgacgtggtcgacctggtcgagggccacgcccgggtggtcggtcgggtccgcagccgctacgtctacgtggacggcctggcggtcggtgacgtgagcgagtcgctgctgaccgagcggcggatcctgggcgacggcggattcatcgcggccaccgtggtgatcgactcggtgaccggcaaggtggtcggcgaaccgagcatctcggcgaagggcttctccgaggacccggacgcgttcaatccggtgattccgctgctcaccgcggccctgcaccggtcggcggaggacggcatcaccgacacccaccagctgcagcaggtggtgcggcgcacggtcggccgctgggtgaacgacgcgtatcggcgccgtccgatgatcgtcccgacggtcgtcgaggtttaa

SEQ ID NO: 4078 - DNA, 1581 bp, Actinoplanes utahensis
atgcagcgcagatcgatcgccgtagctgcggcggtggtggcggcgaccgcggcggcggtcgccttcaccctgccgtcgctggccggcacgacgccgaccggcggcagtggcgcgacgaaggcgagcgggggtgtttccccggaactgctcgccgcgatgaagcgtgacctggggctcgacgcgaaccaggcggccacccggctgaagcggtcgaagtgggccggcggggtgaccgcgaccctggccgcgaccaccggcgacagctacggcggggcgtggctcgcgtccgacggcaccacgctgaaggtggcggtgaccgacgcggccgcggcccggaaggtgaaggccgcgggcgccgtgccggtgctggtcaagcgcagcgaggcacagctggacgcggccaagggccggctggacgcgcaggtgaagtcggccgccggtctgaccgggtggtatgtcgacgcacccaccaacaagctggtcgtcgtggcacggccgggtcagaaggcggccgcgcaggcgctggcgaagcgggccggggtggctaccgacgcggtcaccgtgcaggtcagcaaccggctgccgaagccgctgttcgacgtgcgcggcgccgacccgtacttcatctcgctggacggcggcaccgcccgctgctcgatcgggttctcggtggagggcggcttcgtgaccgccggacactgcggcaccccgggcaccaaaaccagcggcttcaacaaccaggcgcagggcgtggtgaaggcttccgtcttcccgggcaacgccgacatgggcttcgtcgaggtcaacggccagtggacgccgcgtccggtggtcaacgacttcaagggcaacgagcttccggtgggcggcagcaccgaggccccgatcggcgcggcgatctgccggtccgggtcgaccaccggcacgcactgcggcacgatcctggcgaagaaccagacggtgcgctatccggagggttcggtgaccggcctgacccgcaccgatgtctgcgccgagggtggcgactcgggcggtccgtggctctccggcgaccaggcccagggggtcacctcgggtgggtccggtgactgcacggccggcggcgagacgttcttccagccggtcaacgagatcctggcggccaacaacctgaagctgctgaccaccggcggcggcgacgggggcggggcgaccgccgcgccgagcgacagcgcgaccgccgcgcccagcgaggccccgtccgaggccccgggcggcaacggtgacggcaccgcgaacgcctgcgccggcctggccgtgcagcgccagggctcgctcagcaaggccggtaccgcgcaggcccagccggacggcggcgccttccgggcccgggccggccggcacgtcgcctgcctgagcgcgccggccgggtcgaccttcgacctggtgctgcagcggctgcagaacggccggttcaagacggtggccaaggcggccgcggacggcacgctgagcgtcagtgagcgctcgggcaccttccggtacgtcgtggtggccacctccggcaccggcgactacacgctgggcttcaacgtgcagtag

SEQ ID NO: 4079 - DNA, 417 bp, Actinoplanes utahensis
gtgcaatcactcgacaacgagatgatcaaggccgctctggacgcgcgcgggttcgcgtacttcgtggacgcggacggcgacatcgccggcaacttccagggaaacctgatctatttcttccggctcggcgcgaacaaggagatgctgcagatccgcgcgatgatgcagcatgtcttcaccgtcgaggacgtgcccaggctctacgagttctgcaacacgtggaaccgcgaccagctctggcccaaggcatacgtgcaggtcaccgacgacggcgcggccgtcgtggtgggcgaggtgtcgaccgactgggaacgcggcgtcaccccggaacaactcgaccaggtgctgctctgcggcatcgccaccgggtgccggctcggcgacgccctgggcgaatggcgcaacggacagagctga

SEQ ID NO: 4080 - DNA, 2523 bp, Actinoplanes utahensis
atggatgtggcgggtcgggctaccgtgtcacccatggcgggccgtactcctccggcgagccggggccgcgccgcgtcaacgccgcgcggtgccgctacctcgcgtgcccggcaaccggctcgtcagccggccaagaaggccgcggccccgcgcaagcggacggcggccacggcgaaacgggcggcgcccccgccgatggtcggcccggcggtcggccgggggatcagcgcggtctggatgggcctggcgacgagtgtcggctgggtcgcccggggcgccggccgcaacgcccgcaacatcggcccggagcaccgccgcgacggcgccggtctgctgctgctcggcttctcgatcctgaccgcggtcgcggtctggggccggggcgccggccccgtcggccagcggctggccgacgcggtgcacctgttcttcggcggcctcggggtcctgctgccactgctgttcttctacggcgcgatccggctgatgcgtcagccggccgacccggagcaccgcggtcgcaacccggtcggctggtcggcgatcatcatcgccatcgcgagcctgctctacatctccgggcccaagggcgacgacgtcgcgctgaccggcaacggcggcctgctcggctacggggtcggctcggtgctggagcgggcggtcagcgtctgggtggcggtgccgctgctgatcctgctgttcgtcttcggcctgctggtgatcacggcgaccccgatcaaccggatcccggagcggttcgtgctgctcggcgagctggtgaccgggcgcaaccggccggtcctcgaggacgacgtcgaggacgacccggtggcggaggacgaggaggcgcggccggcgagggcgcgccggcgcaagccgtccccggtggtcccgctcgacgagatgctggagcccgaggagcccgacgaggacctcatcctgcacgacacggtcgtcctgcccaaggtgccggccacccgccgcaagccgccaccgcccgaccactcgccggccccggtcaaggtcgagcagctggagatctccgcggtggacagcggcgactaccagcggccgccggtcagcctgctcgccgagggcgccccggcgaaggcccgcagccgcgccaacgacgagatcatggcggcgctcaccggcgtcttcgaacagttcaacgtggacgcggtggtcaccggcttcacccgtgggccgaccgtcacccgctacgaggtggagatcggcccgggcaccaaggtggagcggatcacccagctgtcgcgcaacatcgcgtacgcggtgaaatcgcccgacgtgcggatcctctcgccgatcccgggcaagagcgcggtcggtgtggagatcccgaacaccgacccggagaacgtgtcgctcggcgacgtgctgcgctccccgctggcccagcgcgaccaccacccgatggtggtcgccctcggcaaggacatcgagggcggcttcgtcaccgcgaacctggccaagatgccgcacatcctgatcgccggcgcgaccggtgccggcaagtccagctgcctcaactcgctgctggtgtcgctgctcacccgggccaccccggatcaggtgcggctgctgctggtcgacccgaaacgggtggagatgacggcgtacgaggggatcccgcacctcgtcacgccgatcgtcaccaacccgaagaaggccgcggacgccctggagtgggtggtccgcgagatggacatgcgctacgacgacctggccgccaacggggtccggcacatcgacgacttcaaccgcaaggtccgcaacggcgagatcaccgcgccgcccggcagcgagcgggtgatcaagccgtacccgtacctcctggtgatcgtcgacgagctggccgacctgatgatggtcgccccgcgcgacgtcgaggactcggtcgtccggatcacccagctggcccgggccgccggcatccacctggtgctggccacccagcggccgtcggtcgacgtggtcaccggcctgatcaaggcgaatgtgccgtcccggctggccttcgccacctcgtcgctggccgactcccgggtcatcctggaccagcctggcgcggagaaactgctgggtcgcggcgacggcctgttcctgccgatgggcgcctccaaaccgactcgcatccagggcgcctgggtggacgagaaggagatcgcggcggtcgtcaagttctgcaaggaccagcgcgagccggagttccaggagggtgtcaccgacgcgccgccgacgaagaagcgggagatcgacgaggagatcggcgacgacctccagctgttgatccaggcgatcgagctggtggtgaccagccagttcgggtcgacgtcgatgctgcagcgcaagctgcgggtggggttcgccaaggccggccgactgatggacctgatggagacccggggaatcgtgggcccgtcggagggctccaaggcccgggatgtactcatcaaaccggacgagctggaagaatcgcttgccgccctcaaggtggactga

SEQ ID NO: 4081 - DNA, 474 bp, Actinoplanes utahensis
atgagcgccttccacctggcccagatcaacaccgcgcggctgcgcgccccgctggccgacccgtcgatggccgagttcgtcgccggcctgaccctgatgaacgagctggccgaccgctcccccggcttcgtctggcgcctgatcggcgacgacggcgacggcaccatcgccaccgacgccgaccccggccggatctacaccatgtcggtctgggagacccccgcgcatctgcgggcatacgcctaccagagcgaccacctggactatctgcgccgccgccgcgagtggttccacccccacggcccggacgccgccctggtcctctggtggctcccggccggcgatctccccaccctgcagcagggcctcgaccgcctcgaccgcctccgcgccgacggctccaccccggaggccttcaccttccgtgccccgttcccggccccagttctttcagagaccacccacggacggtag

SEQ ID NO: 4082 - DNA, 660 bp, Actinoplanes utahensis
gtgacgacttcggaggacctcggcgatctcgacgcggtgaccagcctcgccgacggcgtgcggcggcaggcgtaccggacggtggccgcgtcccgcgccccggtcggacgcgacgaggtggccgaggcgctcggggtcgggcgcacgctggccgcgttccacctggacaagctggtggccgccgggctgctggagacgtcgtacgcgcgccggtcgggccgtaccgggccgggcgccggacggccggcgaagctgtaccgggtggccaccgccgagcacgtggtcagcgtgccgccgcgtgcctaccgcacggcggccgagctgctggccgaggcactggaggagaccggcgccgaggagacgctgaaccgggtggcccgccgtcacggcgagcgggccgcggcggccgagggggacgtgttcgaggtgctggccgggcacggctacggcccggtggcggacggcccggagcggatcgagctgcggaactgcccgttccaccggctggccgagcagttccccccggtgatctgcgggatgaacctggccatggtcgacggcctgctgaccggcgccggcctggacgccgggtggcaggcccggatggacgccgcccccggccgctgctgtgtcgctctgtgtaaaaagcaaactgattga

SEQ ID NO: 4083 - DNA, 1461 bp, Actinoplanes utahensis
gtgtctgtaactcctcctccttctcgccgtgtcgccctcctcaccctgggctgtgcccgtaacgaggtcgactcggaagagctcgccgcccgcctcgacgccgagggctgggaggtcggcaccgacgcggcgaaagccgacgtggtgctcgtcaacacctgcggcttcgtggagaaggcgaaacaggactcgatcgacaccctgctcgccgcggccgacaccggcgccaaggtggtcgccgccggctgcatggccgagcggtacggccgggagctcgcggagaacctgcccgaggccgacgcggtgctcggcttcgacgactacaccgacatcgccacccggctgaacggggtgctggccggcgagaaattcgacgcgcacaccccgcgggaccgccgcgagctgctgccgatcaccccggtgcagcggcacgcggccaaggtggtcgtccccggccacgcgaccgtcgacgagcacaccccggcccacctgcgcaaggtgctgcgccgccggctcgacaacagcccggtcgcctcgctcaaactggccagcggctgcgaccggcgctgcgcgttctgcgcgatcccggcgttccgtggcgcgttcgtctcccgcgacccgcaggagctgctcgccgaggccgagtggctggcccggaccggcgttcgcgagctcgtcctggtgagcgagaactccacgtcgtacggcaaggatctgggcgacccgcgcctgctggagaaactgctcccgcagctggccgcggtcgacggcatcgtccgggtccgggcgagctatctgcagcccgccgagacccgccccggcctggtcgaggcgatcgccggcacgcccggcgtcgcggcctactacgacctgtccttccagcactccagcgagccggtgctgcgccggatgcgccggttcggctccaccgagcgcttcctggagctgctcgactcggcgcgccggctggccccggaggccggtgcccggagcaacttcatcgtcggcttccccggcgagacccggcaggacgtggacgagctggtccgcttcctgaccgaggcgcgcctcgacgcgatcggcatcttcgactacagcgacgaggacggcaccgaggccgccggcctgcccggcaaggtccgcccggagaccgtcaagcggcggtacgaccgggtggtggcgctcgccgaggagctctgcgcccagcgcgccgaggaccggctcggcagcatcgtcgaggtgctcgtcgacacgatcgacgacggcgagatcgagggccgggccgagcaccaggcccccgaggtggacggctccaccacgctggtcgccggcgaccagggggtcgacctggccgcgctgcgccccggcgacctggtgcgtgcccgggtcaccggcaccgagggggtcgacctgatcgccgtgcccaccgagatgatctccgccgcgcaggccgaccggtga

SEQ ID NO: 4084 - DNA, 465 bp, Actinoplanes utahensis
atgaccgaccacgactggcgggtcggcgcgtgcctggccttctgcgtggcctcggcgaccgacttcgtggacgggtggatcgcccgccggtggcacctggtcacctcgttcggcaagatcgccgacccgatcgcggacaaggcgctgaccggcaccgcgctggtcctgctctccgcgtacgacgtgctgccctggtggatcacggtgctgatcctggcccgggagtggggggtgacggcgctgcggttctgggtcatccggtacggggtgattcccgcgtcgcggggcggcaaactcaagaccgggctgcagacgctggcgatcgtctggtacctgtggccggtcccggcgccgttcgacgtggtgggcccctgggtgatgtacgcggcgctgctggtcaccgtggccaccgggttcgactacgtggtgcaggcgctgcgcctgcgacgtaccgccggcgtctga

SEQ ID NO: 4085 - DNA, 492 bp, Actinoplanes utahensis
atggagatgccggtggccgccgcggcggccgtgcacatgctggtcgagcggcggcagaccctggcgaccgcggagtcgctgaccggtggcctggtcgccgcgacgatcgtcgagatacccggggtgagcgcggtctaccggggtggtctggtggtctatgccaccgagctgaagggcacgctcgccggggtgccggcggccctgttggccgaacgcggcccggtcgacccggatgtggccggccggctcgccgagggcgcccgggaccgctgcggcgccgactggggcctcgcgacgaccggcgtcgccggccccgagccgcaggacggcaagccggtcggactggtctatgtggccgtcgccgggccgcccggcacccgggtgcgtgagctgaacctgaccgggaaccgggcggcggtccgcaccgaaagtgtgacggccgtcctgcaattgctcaccgacgtgctgcgtgccgcgccggcttcagtctga

SEQ ID NO: 4086 - DNA, 399 bp, Actinoplanes utahensis
atggtcctgctacgccgggttatcggcgacgcacttcgtgcgcgccggcagggacagcaccgcacgctgcgcgaggtgtcgaccgccgcgaacgtcagcctgggttatctgtccgagatcgagcgtggtcagaaagaggcctccagcgagctgctcgcggccatctgcgacgcgctcggcgcccgcctgtccgagttgctcagcgaggtcagcagcacgctgtcgctcgcggagaacatggagggcgtgctggtgccggtcgacgacaagccgggcgagccggcccgtcaggtggcgaccgacggcagcgtgtcggtctcggtgcgccaggagtcgcccctgaaggcgacgctgcacgccacccgcaacaagaagcgggacgtggtctacgcggcttag

SEQ ID NO: 4087 - DNA, 930 bp, Actinoplanes utahensis
atggtttcgcgtcggcttccgggccgcgacgcgaccgaccgagcgacattgaggggataccgcgagatggcgaacccgttcgtcaagggctggcattacatgatggcgctcttcggcgcgaaaattgacgagtacgccgacccgaaggtgcagatccagcaggccatcgaggatgcgcagcggcagcaccaggcccttgtccagcaggccgcggccgtcatcggcaaccagcggcagctcgagatgaagctgtcccgccagatgtccgaggtcgagaaactgcagggcatggcgcggcaggcgctcgtgctggccgaccgggcccgggccgccggcgacgaggccgaggcgcagaagtacgagcagacggcgcagaccctggccacccagctggtctccggcgagcagtcgatggaagatctgaagacgctgcacgaccaggccctcggcgccgccggtcaggcccgcaaggccgtcgagaacaacgcgatggtgctgcagcagcgcatcgccgagcggtcccgcctgctcagccagctggagcaggccaagatgcaggaaaccgtggccaagtcgctggagtcgatgtcgcagctggccgcgccgggcaacacgccgtcgctggaccaggtgcgcgacaagatcgagcagcggtacgcgagcgcgatgggccgcgccgagctggcgtccaactcggtcgagggccgcatgctcgaggtgcagaagtccagcctggacctggccggctcgtcccgcctggagcagatccgggccagcatggccggcgacaagctgggcggcgcggccgcccagccggcggtcggcggtcagcagaacgccacgccggccgacgcggcgggggtggcgcggctcgacgagatccgcgccagcatgaaccagaagcgcggcgacaccacggccgccggctga

SEQ ID NO: 4088 - DNA, 798 bp, Actinoplanes utahensis
gtggacgagcggagcagatacttccgccggctcaagaaactgcgtgggtcggcgcgacggtggagtgtgctcggcggcggcctgaccgcggcggccatggtgctggtcccctacgcggggatcggcatcgcggacgccgcgtgggccgccggggccggtgcctcggtggtgctggcccgctggcggtggcgtgactaccgcgagctgtccgcccagcccgcccccgagccggccctgcccggcccccggttcaccgccgccctggaacgcacccaggtcggccgcaccgtcctgcacgaggtgcgccggcagaagaaccggtatgcgatgcgtggctccgcgatcgccgacgcgtgggaccggctcgaccgggcctcgaccaccatggtcgggctggcgggccggctcaccggccccggcgagaccgccgcgctggaagccgccaccgccgaacactggctgcgagacctcggccagcgggtggccagcgtcgaacgcgccatcccgctcgggcagccggctcagcgagccgcgctggagcagtcgcacgccgccctggccgagcagttcgtcgagggcgtcaccgccttcgaggagctcgtggcggcggcggcgagctatgtggccgaggacgggcatccggtcgcggacacccggcacccggcgtatttcgggctggtcgacgcggcggaacgcctgcgcggcatcgccgagggactcgccgaactgcgggaccggacggcccggttcagttcgcccgggccggctccggctggcagcgggggcaccagtatgtga

SEQ ID NO: 4089 - DNA, 945 bp, Actinoplanes utahensis
atgccggaaggagacaccgtctggaacaccgcccgggtcgtggaacgcgccctcaccggtgaagtgctgaccggctgtgacttccgggtgccgcgcctggccgccaccgacctcaccgggtggacggtggccgagtcggcgagccgcggcaagcatctgctgctccgcctgacccgggagggtcacgacccgcacaccctgcattcgcatctgcggatggagggcgcctggcggacgtatgcgccgggggaacgctggaccggccgccccgcgcacctgatccgggtggtgttgcgaactgcccgctcggtcgccgtcggctatcacctgcacgatctgagcctgatccggaccgccgacgaggacagcctggtcggccatctggggccggatctgctgggtgccgactgggacccggcggaggcgtcccgtcggatcgccgcccgcccggaggtgccgatcgccgaggcgctgctggatcagcggaatctggccggggtgggcaatctgtacaaggcggagacgttgttcctgcgcggcctctggccgtggacccgggtggcggatgtcgccgacctgaccggcacggtggtgctggcgcagcggctggtcgcctcgaaccgggggcgttggacgcagaccaccaccggctcgctgcggcgcggggagacgagctacgtgtacgggcgccgggcccagccgtgccgccgatgcggagcagccatccagaagctggaaagcggacggcccgtccagaagctggaaagcggacggcccgtccagaaggtagagagcggacggcccctccagcaggcaggaactcagcgagccgaaagctccccgataaggatcaccagcggccggatcggcacgaaggcggagctggaggaccgcatcacatactggtgcccccgctgccagccggagccggcccgggcgaactga

SEQ ID NO: 4090 - DNA, 927 bp, Actinoplanes utahensis
atgcgtctcgtgatcttcaccgaaccccagcagggtgccagccacgacgacctgctccgggtcgccaaagccgccgaggacggtggcttcgacggattcttccgctccgatcactacgtcaagatgggggacgtgtccggcgcccccgggccgtccgacgcctggatcacgctggccgcgctggccgtgcagacgtcccggatccggctgggcacgctggtcagctccgcgacgttccggcttcccggcccgctggcgatcgcggtcgcccaggtcgacgcgatgagcggcggccggatcgagttcgggctcggcggcggctggttcgacaccgagcaccaggcgtacggcatcccgttcccgccgctgggtgaacgcttcgaccgcctcgacgaacaactgcaggtcatcaccggtctgtggggcaccccggccggtgagacgttcagcttcgacggcaagcactaccggctcaccgactcgccggcgctgccgaaaccggtgcagtcgccgctcccggtgatcgtcggcgggcatggcaagaagcgcaccccggatctggccgcccggttcgccgccgagttcaacgtccccttctccaagatcgacgagctgcccgcgcatttcgaccgggtacgtgcggccagcgccgccatcggccgcgccgaacccccggctttcagcgccgccgccgtcctctgcgccggccgtgacgacaccgaactgcgccgccgcgccgccgccatcggccgtgaggtcgaggagatgcgggagagcggcggcgtggtcggcacgcccggcgaggtggtcgagaccatcaagcggtatgccgaggcgggcgcatcccggctgttcctgcaggtactggacctgtccgacatcgagcacatcgagctggtggcctcggaggtgctgccgcacatctga

SEQ ID NO: 4091 - DNA, 4968 bp, Actinoplanes utahensis
atggtgggcgtgcgagaggtgcttgagaatttcggtccggccaccagggcgtggttcacggccgcgttcgccgcgcccaccgctgcccaggacggcgcgtggcgggcgatcggcgccgggcggcacgcgctcgtggtcgcgcccaccggctccggcaagacgctggccgcgttcctctggtcactcgaccggctggcccgggagccggtgcccgagcaggtgcggcgtcgctgccgggtgctctacgtcagcccgctcaaggcgctggcggtcgacgtcgagcgcaacctgcgggcgccgctcaccggcatccggcaggcggccggccggctcgggctgcccccgccggagatcaccgtcgggatgcggaccggggacacgcccgccgacgagcggcgcggcttcgcccgtacgccaccggacatcctgatcaccacacccgagtcgctgttcctgctgctcacctcggccgcccgggagtccctgcgcggcgtcgaaacggtgatcatcgacgaggtgcacgcggtcgcggccaccaagcgcggggcgcacctggccctctccctggaacggctcgacgcgctgctggaccggcccgcgcagcggatcgggctgtccgcgacggtgcgcccgatcgaggagaccgcgcggttcctcggcggcccgcagcacgtggagatcgtccggccgcccagcaccaagaccatcgacgtcaccgtccaggtgccggtcgaggacatgacccggctggacgagtcacccgcgggcgacgacctcgacggcgggcggcacacgccgtcgatctggccggcggtcgaggagcgggtgctcgacctgatcgaggggcaccggtcgacgatcgtcttcaccaactcccggcgcggggcggagcggttgtgcgcgcggctcaacgagctctcggcggagcgggtggagctggcgcggctcggcgagcaggcggccgagcacggtgaggtcccgtggcgcggcgggtccggagaccccgtggggccgccgggagcagcgccgcaggcacggctcgacggacccacggcgggggcgaaggctgggctcgacgaactcggggcaggcccgccggcgggactcgacgaactcgggacgggactaccggcaggactcgacgaactcgggacgggactaccggcaggactcgacgaactcgggacaggactaccggcaggactcgacgaactcggggcggggccgtcggcggactcgctgggctcggggatgccgatggggcgcggcggggggaggttccggcgtaccgggaaagcaacaagcgggaccggcaacggcccggcgccggggggaaggccgggcggaaagcccgccggtttccggggcaacggcgccgccgggatgcccgcagcggtgatggcgcaggccggagcgaccctcggggcggcacccgtcgtcgcccgggcgcatcacggcagcgtttcgcgggaggaacgcaagcagatcgaggaggcgctgaaatccgggcggctccccgccgtcgtcgccacctccagcctggagctgggcatcgacatgggcgcggtcgacctggtggtgcagatcgaggcgccgccgaccgtcgcggccgggctgcagcgcatcggccgggccgggcaccaggtcggggccgtctcgcgcggggtggtctttcccaagcatcgcggtgacctgctgtcctgcgccgtggtggcggaacggatgagtgagggggcgatcgaggagctgcgctatccgcgcaatccgctcgacgtgctcgcccagcagatcgtcgccatggtggcgctcgatgcctggccggtggacgagctggccgcactgatccggcgggccgcgccgttcgccgagctgcccgagtcggcgctgcacgcggtcctcgacatgctgtccgggcggtacccgtcgaccgccttcgccgaattgcgcccgcggctcgtctgggaccggggcaccgacctgctcaccggtcgccccggtgcgcagcggctcgccgtgaccagcggaggcaccatcccggaccggggcatgttcggcgtcttcctggccggctcggagaaagcctcccgggtcggcgagctcgacgaggagatggtgtacgagtcccgggtcggcgacgtcttcctgctcggttccacctcgtggcggatcgaggacatcaccccggaccgggtgctggtctccccggcgcccggcgccccggcccggatgccgttctggaaaggggactcccccggccggccgatcgagctgggccgggcgatcggtgcgcggctgcgggcgctggtcaaggccggtgacgagcgcgccaccaccgcgctgcgcgagtccgggctggacgagtgggccgccggcaacctggtgaactacctgcgcgagcagcgcgagtcgacccggcacctgcccgacgaccggacgatcgtcgtcgaacgtttccgcgacgagctgggcgactggcggatgaccgtgcactgcgtgctgggcgcccgggtgaacgcgccgtgggccctggcgatcggccggcggctcggtgaacggttcggcgtcgacgggcaggtgatgccctccgacgacggcatcgtgatccggttgccggacaccgccgaggagccgcccggcgccgacctggtcgccttcgacccggaggagatcctccagatcgtcgaggagtcggtgggcacgtccgcgctgttcgcctcccggttccgcgagtgcgcggcgcggtcgctgctgctgccccgtcgggacccgcgccgccggcagccgctctggcagcagcggcagcggtcggcgcaactgctcgacgtggcgcgcgagttcgccgacttcccggtgacgctggaagcggcccgcgagtgcctgcaggacgtcttcgacgtccccggcctgaccggcctgatgcgcgagatcgccggccgcaaggtccgcctcgtcgagaccgaaaccccgcggccgtcgccgttcgcgcgatcgctgctcttcggctacgtcggcgctttcctgtacgagggggacgcccccctggccgagcggcgcgccgccgcgctcgccctggacgcgacgctgctcggcgagctgctcggccgggtcgacctgcgcgagctgctcgacccgggagtggtcaccgagaccgaggcccagctgcaatggcggaccacccagcgcagcccgcgcgacgccgaggacgcggccgagctgctccggctcctcggcgacctctccccggccgagctggccgaacgcggcgtgccggaggactgggtggtgtcgctcgagtcggcccgccgggcgatccgggtgcgggtggccggcgaggaacgctggatcggcgtcgacgacgcggggcggtatcgggacgccctcggggtggccctgccggtcgggctggccgaggcgtacctggagccggtcgccgacccgctcggtgacctggtcgcccgctacgcccgcacgcacggaccgttcctcgcggcgacctgcgcggcccggttcgggctcggcgtcttcgtggtggagcaggccctcaaacggctgtccgcgaccggccgggtgacctccggcgaattctccccggacggcgccggcaccgaatggtgcgacgccgaggtgctgcgcatgctgcggcggcggtcgctggccgcgctgcgccgggagatcgaaccggtcccgccgaaggtgctggccgcgttcctgccccgctggcaccaggtgggcggcaacgcgcgcggtgtcgacgcgctggccgccgtcatcgaacaggtgcaggggctggccgtgccggcgtccgcgtgggagcggctggtcctgccggcccggatcgccgactacgccccgccgcaactcgacgagttgtgcggcagcggcgaggtgctgtgggccgggtccgggtcgatcgcgggtggcgacgggtgggtgaccctggcctacgcggactccgcgccgctgctgctccccccgccggacgaggagttcgcgctcaccccggcccaccaggcggtgctggacgcgctcggcgacgggcaggcgctgttcttccggtcgctgtccgaccgggccggctcgaccgacgacaccgacctggccgccgtcgtctgggatctggtgtgggccgggcatctgaccaacgacacgttcgccccactgcgcgcgttgctcggcggcagcggcgcgcaccgggcgaaagccgcgccggcccgaagccgctaccggcggcccgggcggccgcacctgccgtcccggaccgggccgctgaacatggccggccgctggtcccggctgcccgaccgggaccccgacccgacccggcgggccgccgccctcgccgacctgctcctggaacgccacggggtggtgacccggggcgcggtgatggccgaaggggtgaccggtgggttcgcggcggtctacccggtgctgagcgcgctggaggaacgcggggcggcccgccgcggctacttcgtcgaggggctcggggccgcgcagttcgcggtgcccggcgcggtggaccggctgcgggccctggccgagccggcggaactcgccaaacgcaccggggcgggcgggctggtgctggccgcgtcggatcccgccaacccgtacggggcggcgctgccctggccggaacggatcgtcgacagcggggacggtgagccggtcgccaaagccgggcaccgggccggacgcaaggcgggggcgctcgtcgtgctggtcggcggcgagctcgtgctctacgtggaacgcggcgggcggacgctgctgtcgttcgcggacgatccggaggcgctgaccgcggccgggcaggcgctggccgcctcggtgcggtccggggcgctcggggcgatgtcggtggaacgggcggacggagaatcggtgcatgcgtcgccgctgcgggaggcgctgaccgccgccgggttccgggctacgccgcgcgggttgcggctacgagggtga

SEQ ID NO: 4092 - DNA, 2307 bp, Actinoplanes utahensis
atggcggtcaggcagatgctcgtcgcaggccggtaccgattgctggaaccggtcggcgcaggtgggatgggacgggtctggctggcccgcgatcagatgttggaccgggacgtcgcgatcaaggagatcgtcccgccggactggatgagcgaggcggagaaggaccgtctgcacagccgcacgctgcgggaggcgcgcagcgcggcccggctgacgcatccgcacgtggtgcgggtgtacgacgtgctgcacgacgacggggtgtcgtggatcgtcatggagtacgtggcgtcccggtcgctctaccaggtgttgatcacccaggggccgtactctccggtcgaggcggcccggatcggcctggccgtgctcgatgcgctgaacgccgcgcaccgcgccggggtgctgcaccgcgacgtgaagccgcacaatgtcctgatcgggttggacggtcgtgtgctgctgaccgatttcggtctggccaccttcgtcgacgacggcatggtgaccacaccgggcctgatcgtcggctcaccgcagtacgtctccccggaacgggcgcgggacggcgcctccacggtggcggcggacatgtggtcgttcggggcgacgctgtacgccacggtcgagggtcagtccccgtacgcccgggacagcgccatggcgacgcttgccgcgctggcgaccgaaccaccgaatccgccgctgcgggcgggtccgatcggcccgatcctggaggggctgctccggtacgcgccggaggaccggctgtccgcggacgagaccgagcgacggctgcgcgcggtgctcggggagaccgggccggccgccgcggcgaggcccgcgaccgtggtcgcgccggtgaccaggatggtcgccgaggactcgccgacggtggcggccgttgcaccgccatccgaggcaaagaccgattcggatcgtacggaggtggtcccggtcgctaccggcgaactggttcgcaccgcggatctggcggggaccgggctggtcctggaaggggagtcgggtcccgccgaatttcccgaggaggacgaggcggatcacgacgatgacgccgaggactcggacggctggtggcagtccgggcgcggctacatcgacggcacgttcaccgtcaccgacgatctcgatgccggctccgtcccggcggccgccggccactcgcactacggtgccggccggtggaccgacggggggaaccgggccccgagcagttccggcgtgccgcgcgcccaccacaatcggcaaccctccgcggccgggcggccggcggccacccggttgctgcgccgtgggaaccaggcgacggtacgcggtatcccctcgccacgcagcccggtctccggcccgttgccggacaccggggtgccgcccggacgctgggcactgcatccgctgccggcgaaacggatctccacccgcgcggtgctcgccggtctgctggccgtcgctctgatcagcggcagcctgctcagcgtccatctgatgcagcgggacgactccgccccgcagatggtgcattcgcccatgccggccccgtcgggcatgtcgtcctccgggatgtccccatcggacatgtccccatcggacatgtccccgtcgggcatgtcgtcgtccggcatgcccgcgtccgggatgtcaccgtcgagccgggcctcggcgcccgaggcgggcgcgtcacagccgcgggcatcgccgaccgggtccgtctcgccggtgaccgccggtttctcgccgatcgtctgcgacgcgccggcgccgcaccatgccccggtggcgccgcaggccggtgccggccgcggcgtcgacggctggcgcctgcaggccggctggtcgtacttcaccgacgggaccggattccaccttccggtcccggacggctggacctatcagcggatcggcagcacgtactgcttccgggagccgcgcggaggccgggtgctgagcctggacgtgggccggccggccgcgaccgccccgctccagggatgccgtgccgaggaccggcggctgcgggcgagccggcaggtccgcgactaccgggcgatgtcgctggccccggtcgtcctgctgcacgcggcggtcgactgggagttccgttaccgcacctccggcggtgtgctgcggcgcgccaggacccgctggctgtcgatgggtggccgggcctacgccctcggctgggccaccccggaggccgcctgggccgccgaactgggcaagctcgaaatggtgtggagcaccttctacaccgacggcggcaccccggccagcgccagccgcggctga

SEQ ID NO: 4093 - DNA, 654 bp, Actinoplanes utahensis
atgctgggcatcaccgatttctggacgtacgtgctgggtgtggtcgccatcatcctgctgcccgggccgaactcgatcttcgtgctgtcggtcggcgcccgtcgtggcgtgcgggccggatatcaggcggcgtgcggggtcttcctcggcgacacggtgctcatggtcctctccgcgaccggggtctcctcgctgctgggggcttacccgccgctgttcctggtgctgaaatacgccggcgccggctacctggcctgggtcggggccggcatcctgcgcggcgcccgggcccgctggcgtggccggggcgaggtgtccgccaccgaggcgacggaggagccggccgagatgcagcggccgttccggcgggctgccgtgatcagtctgctcaacccgaaggcgatcctgttcttcgtctcgttcttcatccagttcgtccagccgggctacccgcaccccgccctgtcgttcctggtgctgggtgcggtggtgcagttcttcagcgcgctgtacctgacggcgctgatcttcgggggccgcttcctggtcgggcagttccagcggcgccggcggctggcggccggggccgcgaccggggtcggcgcgttgttcgtcgggttcagcatcaagctggccaccgccagcctgagctga

SEQ ID NO: 4094 - DNA, 1440 bp, Actinoplanes utahensis
gtgcagcgcggtggcgagcacccgcaccggcgggagggcggcgccgaactgccagtcgccgcgcacgacgccggtctcgatgctggccgaaatctcggcggcggtcccaccactgacctgatactgttctgccacacagacgattctgtactagtacaaaggcgaaagcaagcggtttcgccctcccgggaggtcctgatgaccgaggtctacgcgactaccgaccgcaccaccgcgacccggacccgccagcgcatgcactacgagcgcgaccgggcacacgccattctggacgaggcgtatgactgttcggtggccttcgtggccgacggcgagccacgcgtgctgccgaccctgcacgtccgcgtcggcgagacgctctatctgcacgggtccaccggcgcccggctggccctcggcgcccgcggtgacggcgtcccggtctgcgtcagcgtgaccctgctggacgggctggtctacgggcgctcgcatttccaccacagcgccaactaccgttcggtgatcgcgcatggcgtcgcccgtccggtcgccgacccggcggagaaggcggcggccatgcacgccctggtggagaaggtgggcgccggccgggccgcgggcagccggccgccgaccgaccgggagatggcgcagaccagcgtgctcgcgctgccgctcgccgaggtgtcggcccgggtcagggagggcggcgtggtcgacgagccggccgatctggacctgccgcactgggccggggtgctgccgatccgccgggtcgccggcccaccggagagcgacgcgggcgtcgccgtgccgccgcccgcctacctgcccggcaacccggcgaccgagtggcagaccccggctctgatgcagggccggctggtccggctggagccgctgtcgccggcacacgccgcgggcctgttcgaggcactcgacgacgaggaggtctggcgccacatcccccaacagcgggcgagcagcgtggcggacatggccgaggacgtcgccgaggtgatccggggccagtggcgcggtgaccgggccggctgggcccaggtcgacccggtcaccggcgtggtgatgggcatgacgacctaccacgacgtcgacccggaccgccgttcggtcgggatcggtcacaccatgctgggccgcaggtggtggcgcaccggggtgaacaccgaggccaaactcctgctgctggagcgggctttcgacgtgctcggcgcggccaaggtgttctggtacaccgatattcgcaacgagcgctcccagcaggcgatcgcccggctcggagccggtcgggacgggctgctccggcggcagcgtctgcgacctgacggcacctggcgcgacaccgtagtcttcgcgatgacggcggacgagtggccggccgcggcgcggcgcctgcgggaccgcttggctgccggctga

SEQ ID NO: 4095 - DNA, 1347 bp, Actinoplanes utahensis
gtggcagaacagtatcaggtcagtggtgggaccgccgccgagatttcggccagcatcgagaccggcgtcgtgcgcggcgactggcagttcggcgccgccctcccgccggtgcgggtgctcgccaccgcgctgcacgtgagtcccgccacggtcgccaaggcctatcaggagctgcggcaacgcggcgtcgtcgagaccgagggccggcggggcacccgggtccggtcccgtccgccggtggcgctctcccggtccgccctgcggcccccggtgccggccggcctgctcaatctctcctccggcgagcctgacctgagcctcctgccgcccctcgggccggccctgcgggtgatcgccgaccaggtcggcccgccgcagggctacacctcggcggcgaccatgccggagctgatcgaggcggcccggccccgcctgctggccgagggcgtgccggtcgccgaggccgcgatcgccgtcaccgccggcgcgctggactcgatcgagcggctgctcaccgcccacctgcgaccgggtgacgcggtcgccgtcgaggatccgggctgggccaacctgatggacctgatcgcggctctgggcatgcggccgctgccggtcgcggtcgacccggacggccccgagcccggctcgctcgacgccgccctgcgcgccggcgcccgagccgtagtgatcaccgtccgcgcgcagaaccccaccggcgccgcggtcagcgccatccgcgccgccgagctgcgcgacctgctcagcgaccatccggacacgctgctgatcgaggatgatcacgctgccgagctggccgaggcgcccccgcactgcgtcggcccggtgacccggtggtgggcgttcgtccgttccgcctccaaaccgttcggccccgacctgcggatcgccgtgctggccggcgacgagacgtcgatcgcccgcgtcgccggccggatgcggatcggcatgggctgggtctccaccgttgcgcagcggctcctcctgcagctctggcgcgacccggaggtcactgagctggtcgccgccgcggcccggtcctacgggtcgcgccgccgccggctgcgccatctgctccaggcccggggcgtccgatcatccggcgacaccggcatcaacgtctgggtgccggtccccgacgagacccacgcgatcgccggcctgcgcgacgccggctacgccgtggcgccgggcgcgctgttccggatcgcctcaccgcccggcatccggatcaccgtcagccctctcgccgagtccgacatcgaggccttggccgacgcggtgtcgaccgtcgtccacccggccgccacggggctgccgatgagatga

SEQ ID NO: 4096 - DNA, 666 bp, Actinoplanes utahensis
atgtcacggaccggaggtccggtcggcgcacagcaatgggtgccaccgcggccgcacagcatcgacgaactcaagcaggccgcagccgggtgtcacggctgtgagctctacgagaacgccacccagacggtcttcggccggggcgccccgaacgcgaagatcgtcttcgtaggtgagcagcccggtgacatcgaggaccagaagggcctgccgttcgtcggcccggccggccggctgctccgcgacgccgtggacgatgccggcatcgaccccgccgacctctacatcaccaactcggtcaagcatttccggttcgagctgcgcggtgcccggcgcatccaccagagtcccgggccggcccacatcaccgcctgccgtccctggctggtgagcgagttcgccctgctgaagccgcagctcgtggtcctgctcggagcaaccgcgggcaaggcgctgctgggcccgtcgttccgggtgaaccggtcccgcggccagctgatgccctggccggcctccgccgagcatcccgaggactttccggtggccgagatcagggcgctggccacgatccacccctcggcggttctccgagcggacaaccgggacatcgcctatcagggcctggtcgacgacctgaagatcgccgccgccgcgatcaccgcctga

SEQ ID NO: 4097 - DNA, 201 bp, Actinoplanes utahensis
gtgcgactgacggacttctggggacgccttgaacaggcgttcggcgcggcctacgcccgcagcatcgcggccgatcacgccttcgcggagctggacggccgcaccattgagcaggcgattgcgcagggtgtcgacacggctaccatctggcgcgccgtggtggcctcgtaccccgatcgggtgccttccaggctgcactga

SEQ ID NO: 4098 - DNA, 1047 bp, Actinoplanes utahensis
atggtggcagcaccggaccgggaaaaggcgctcgaactggcgctggcacagatcgacaagcagttcggcaagggctcggtgatgcggctcggtgagcggccggtcgtgcagaccgccgtgatcccgaccagctcgatcgcgctcgacgtggcgctcggcgtcggcggcctgccgcgtggccgggtcatcgaggtgtacgggccggagtccagcggtaagaccaccgtcgcactgcacgcggtggccaacgcgcagaaggccggcggcaccgcggcgttcatcgacgcggagcacgcgctcgacccggactacgcgcgggctctcggcgtcgacaccgacgccctgctggtgtcccagccggacaccggcgagcaggcgctggagatcgcggacatgctgatccgctccggtgcgctcgacatcatcgtcatcgactcggtcgccgccctggtgccgcgcgccgagatcgagggcgagatgggtgacagccatgtcggtctgcaggcccggctgatgagccaggcgctccgcaagatcaccggcgtgctcaacaacaccggcaccacggcgatcttcatcaaccagctccgcgagaagatcggcgtgatgttcggctcgccggagacgacgaccggtggtcgcgcgctgaagttctacgcctcggtccggctcgacgtgcgccgcatcgagagcctgaaggacggcaccgacgtggtcggtaaccgcacccgggtcaaggtcgtgaagaacaaggtcgcggccccgttcaagcaggccgagttcgacatcatgtacggcaagggcatctcccgcgagggctcgctcatcgacgtgggtgtcgagcagagcatcatccgcaagtccggcgcctggtacacgtatgacggcgaccagctcggccagggcaaggagaaggcgcgggagttcctcaaggagaacccggacgtcgccgccgagatcgagaagaagatcctggagaagctcggcgtcgggcagacctccggggacgctgccggtggccccgagctgccgccggtcgacttctga

SEQ ID NO: 4099 - DNA, 1206 bp, Actinoplanes utahensis
atggccggacgacgtggtgcccggtccgggcgcggctgggatgccctcccgccccggtccggcgccgatgcgccggacgacgaaaccccgggccgcggcccgggccaagaccgtcgcgattccggtcggcgtggctctgcggcccgtcgccggccggacgctgacgaccccagcctctggcagaccttcggttcctccagtgaggcctccgatgacaccgacctgtccgaagcacccggcgatgaccccgcctccagcgacgccgggtctgccggccgcttcggcgggcgcccacgcgaccgctccggcggtccggccgttcaaggcctgccctggagcggccaggcggcttccagcgatcagcccgtcgggagatcgggccgttcgggcggcggagcttccgacggtcagcccggcgggagatggggccgttcgggcggcggagcttccgacgatctgcccggcgggagatggggtcgttcgggcggcggagcttccgacggtcagcccggcgggagatcgggccgtccgggtgccgggggttccggcggtcagttcggcctagagatcggcggcccggagggcgaggggtcggacggtcggttcgccctgcgagcgggcgctcggggcggcgggggtgccggtgagcggaaaccggcgggacctgcgcagagtgagtcggagcgggcgcgggagatctgcctgcgccagcttgcggtgcggccgcggacacgtgccgaattggccaaggtgctggcccggaaggagatctccgaggaggtgatcgccgaggtcctcgatcggtatgacgaggtcggcatcatcaacgacgcggcgttcgcgcgggcctgggtgtccagccggcaccacggtcgtggcctggcgcgccgggctctcgccaacgaactgcggcagcgcggtgtggacgccgaggtggctggagaggcgctggagagcgtcgacgacgagtccgaggcagagaccgcccgggcgctcgtcgaccggaagctgcggaccgccagcggcacgccggaggcggtgttccgacgcctggtcgccatgctggcccgcaagggttatccggtgggcatcgccatccgggcggtcaaggaggcccttgccgcccgcgacgcggaagccgctgagttcgctgacgccgtggacgccgatgccctcgccgaccaggccgaagacccgcactcctga

SEQ ID NO: 4100 - DNA, 1725 bp, Actinoplanes utahensis
atggccccccaatactgggtgctggtagtagcgatcgtcgtgctcgccgtgtcggtgatcgtcggcttgaccctgggcgcccgtgcgctgggtcagctgcggaccgaacggcaggacgcccacgaccggcaggagcaggaggtcggtgtcgcgcaggcgaaggtcgccgacgccaatgccaaggccgcttcggtgcgtgccgaggccgccgccgcgaaagccgaggccgccgccgcccgggccgaggcccgccgggtgctggagaacgcgcacagcgaagccgacaccatcctggagcacgcccaccgccaggccgaggcggatgtggagcagctgcgcaccgcggcccggcggtccggggagcgggagatcgcgctgctcaacgccacggtgaaggagcaggccgcggaggtggagcggcgggctgcccggatcgacgagcgggagcggctgcacggcgaggaggtggagcgcctggtggagcgggagcgccggctcgtcgccctggagtcggagctggcgaagcgggaggcgaccttgaaggcccgggagacggaggtcgaggcggcggagaacaccaagcgccgcgagctggagcggatcgccgggctgaccacggagaccgcgaagggcgagctgatcgacgcgatcgagggtcaggcgaagcgggaggccgccatcctgatccgggacatcgagcaggatgcgcggagcaccgcggacacccgggcccggcacatcgtggtcgacgcgatccagcggatcgccagcgagcagaccgcggagagcgtggtcagcgtgctgcacctgccgagtgacgagatgaagggccggatcatcggccgcgagggccgcaacatccgggccttcgagtcgaccaccggggtcaacctgatcatcgacgacaccccggaggcggtgctgctctcctgtttcgacccggtgcgccgcgaggtgggccggttgacgctggagaagttggtgctggacggccggatccacccgcaccggatcgaggaggtcttcgacagcgccaagaacgaggtggagcggctctgcgaccgggccgccgaggaggcgctggtcgacgtcgggatcaccaacatccacccggagctggtgaagctgctgggccggctgcgataccggacgagttacggccagaatgtgctcaagcacctggtggagaccgcgcacatcgccgggatcatggcggccgagctgggtctggacgtgccgatcatgaagcgggcggcgttcctgcacgacatcggcaaggcactcacccacgaggtggagggcagtcacgcgctgatcggcgcggatgtggcccgcaagtacggcgagcacgaggagatcgtccacgccatcgaggctcatcacaacgaggtgccgccgcagaccatcgaggcggtgctcacccaggcttcggacgcctgttccggcggccggccgggagcgcggcgggagagcttggaggcgtacgtcaagcgcctggagcggatcgaggagatcgccggcggcaagctgggcgtcgagaaggtgttcgcgatgcaggccggccgggagatccgggtgatggtccgccccgacgacatcgacgacatcggtgcggcggtcctggcccgcgacgtcgccaagcagatcgaggaggaactcacctaccccggtcagatccgcgtcaccgtcgtccgcgagtcccgggtcaccgagttggctcgctga

SEQ ID NO: 4101 - DNA, 969 bp, Actinoplanes utahensis
gtgagtcagcagagcgttctctacgacgttccgggcccccgccagcgccgcatcacgctgatctccagcctgctcgtcgcgatcgggctgctggccggaatctactatctgatctatctgcccctgcaccacaaggggcaattctcgatgaagctctggggtccgctcatcgaccccggcaacgaggatttcagcgccgtgtgggaccgcatcggcgtcggggtcaagaacacgctgaccgccgcggtgttcgccatcatcggctccctgatcatcgggacgctgctgagcgtgctgcggatcgaactcgagtcgctggcccggcgccgcttccccggcatcgccgcccccgtcgctctcctgttgcgcgcgctcagcgtggcgctcgcgtgggcgacccggatctgcatcgaggtcttccgcgggctgcccgtagtcctcaccatcttcttcgtggcgcggggcctgcccgagttcggtgtcagcatggacaccctctggtatctcgtgatcggcctgacgatctacaactcggtggtcatcggcgagatcctgcgctccggcatgaccggcctgccacccggacagcgggaggcggccgccgcgatcggcctctcctcgccgcagaccaccatgatcgtgctgctcccgcaggctttccggatcatgctgcccgccctgatcagccagcttgtcgtggtgctcaaggacacctccctcgggttcatcatcagctacgaggagaccctgaacatcggtaagcagatcatcggcgtgctgagcaaccccatccaggtgtacgccgtgatcgggacgctcttcatcctggtcaactactccctctccaagctggctcaatacgtccagcggcgcctttcccgcggtcgcaagaccgccggcatgccgcgccggcagccgccgacggcagcgctgatcgcccaagccgaaggcgccggcggaaccgcctga

SEQ ID NO: 4102 - DNA, 711 bp, Actinoplanes utahensis
gtgagtgtgatcttcgatcgattcgacgtcttcgcgggcggcttctggctcacgctccagatctgcgtgctcgccgcgatcggcgccctgttcctgggcgccgtcgtggcggtgctccgcatctcccccgtcccgccgctgcgggcgctgggcaccgcgtatgtcaccgtcttccggaacatgccgctgaccgtggtcatgttcttcgccgcgttcgccctgccggctctcggctcgaacgccgacttcctccgcattccggtgctcgacgcgatcttcacccggctcggcaccgacctgccgtactttcgcttcgccctgatcgcgctggtgctctacaccgccgctttcgtctgcgaggcgctgcgctccggtgtcaacgcggtgcagcccgggcaatccgaggccgcccggtcgctgggcatgacattcggtcagaacctgcggtacgtcgttctgccgcagtcctggaaggcgtccatcgtgccgctcggttcggtgatcatcgcaatgatcaagaactccgcgctgatcggtttcttcggcgtcgtcggcgacctgtcacagaccgccgaccagctcacctcggcggagggcctcgccttcgtacccgtcgccatcggcgtctcgatcggatatctgatcatgactgtgcccctgggcgcccttctcgaccggatcgaacgcaggcaggcggtgaccgcccgatga

SEQ ID NO: 4103 - DNA, 882 bp, Actinoplanes utahensis
atgcgtttgcagcgtctcgcggctgttgccacggctaccgccctggtattcggcctggccgcgtgcggcgacaaatccgacgggggctccaagtcgggtgccggcagcaagtcgttccccgcgggtagcacgatggagcgtctcaacaaggcccagacgatcaaggtcggcaccaagttcgaccagcccggcttcgggctgaaaggactgtccggcaaaccggagggcttcgacgtcgagatctccaagatcatcgtcaaggaactggggattccggccgacaagatccagtacgtcgagacaccgtcgaaggtccgtgaggactcgatcgtgaacaacacggtcgacttcgtggtcgccacgtacacgatcaacgacgagcgcaagaagcgggtcgcgttcgccgggccgtactacgaggccggccagaacatcctggtcaaggcagacgactcgaccatcaccgggccggactccttcaaggacggcaccaagaaggtctgctcggtcaccggctcgacgccggccgagaagatcaagacgtacgtcaaagacgtccccagccaggtggtgctcttcgacacctacgacaagtgcatcgccgccctcgacggtggccaggtcaatgcggtgaccacggacaacgtgatcctgctgggctacatctcgaagaaccagggcaagtacaagctggccgggcccaacttcaccaaggagccgtacggcatcggcgtgaagctggaggacaaggacttccggacgttcatcaacgacacgctggagaagtcgttcgccgacggcagctggaagaaggcctgggacgacaccgccggcaagttcggcgccgaactgggtgccgcgccgacggtcaaccgctactga

SEQ ID NO: 4104 - DNA, 744 bp, Actinoplanes utahensis
gtggcaggcgaggctctcatcgttctggagaacgtgaacaagtggttcggcccgctgcacgtgctgaaagatgttgatctgtcggtcgagcggggcgaggtcgtcgtcgtcatcggaccgtccggttcgggcaagtcgacgctgtgccgggcgatcaaccggctggagccgatcgactccggctcgatcaccttcgacggtcagccgctgcccgccgagggccgggcgctggcccggctgcgcagcgaggtcggcatggtcttccagtcgttcaacctgttcgcgcacaagaccatcgtgcagaacgtgatgctcggcccggtcaaggtccgcaaggagaaaccggccgccgcccgggagcgcgcgatggcgctgctcgaccgggtcggcatcgccgcccaggcggacaagttcccggcccagctctccggcggccagcagcagcgggtcgcgatcgcccgggcgctggccatgcagcccaaggcgttgctcttcgacgagccgaccagcgcgctcgacccggagatggtcggcgaggtgctggacgtgatgaccgccctggcccgggaggggatgaccatggtggtggtcacccacgagatgggcttcgcccggcacgcggcgaaccgggtggtcttcatggccgacggccagctggtcgagcaggcgacacccgccgagttcttcgccaatccgaagagcgagcgggcgcgcgacttcctttccaagatcctgacgcactga

SEQ ID NO: 4105 - DNA, 2217 bp, Actinoplanes utahensis
atgacgacgacgacctcgccccgctcgaccgacagatcaacatctttcagcacgtgcagcgggccgaaccacttgttcacgttctccagaacgatgagagcctcgcctgccaccccgtgtccatccgctcgtcggtcactcgatgggtgccaccttagggggacacaggtatcggaatgcgacgagaatggtcacggagcggtaacgcagccggcgcggggcgaaagggacgtagaccatgacgggtatggctggcctctggaactggtccgccgccgggctgatcgagcccgagcgcgtgcggaacgccctggctggagcgttggaaaccccggtgggggagatcgccggggggggcttcggcggcctgctctgcgacgtttatcaggtcggtggcgattttccgacactgatcgatgtattcctggccccgggccacctcgccgaggagacgatcgccagcgcggtcgcggttcggctgggcgccgcgctgctgctgcccgacgacaccctcaacccgacccggtacgtgctggccgagccggacgggacgctgcgcgccgtgcacgtcgaggaggaggagaccgacgacggtgtcgaacggcggcatgcccgcccgtgcaccggcgccgacccggactgcgccaccggcccgggttgcgcccgctcccggttccgggccgcggcctgaccgcagtaccctggtcaattgccatgactaccgagatgcagagcagttccgggatgcccagcgccgcgcgcacctatgatgtgcgcacctacggctgccagatgaacgtgcacgacagcgagcggatctccgggctgatggaggacgcgggctacgtgcgcgccgctgacgccgacgccgccgacgtggtggtcttcaacacctgcgcggtccgggagaacgccgacaaccgcctctacggcaacctgggccacctgcgtcccacgaagctgaagaaccccggcatgcagatcgccgtcggcggctgcctggcgcagaaggatcagggcgacatcgtcaagaaggcgccctgggtcgacgtggtcttcggcacccacaacatcggctcgctgccggccctgctggagcgtgcccggcacaacgagcaggcgcaggtggagatcctcgagtcgctcgaggtgttcccgtcgacgctgccgaccaagcgggagtcgacctacgccggctgggtgtcgatctcggtgggctgcaacaacacctgcacgttctgcatcgtgccgtcgctgcgcggcaaggagaaggaccgccgcccgggcgacgtgctggccgaggtccgcgcgctggtcgccgagggcgtcctcgaggtcaccctgctcgggcagaacgtgaactcgtacggcgtcgagttcggtgacaagctcgccttcggcaagctgctgcgcgcctgcggtgacgtcgagggcctggagcgggtccggttcaccagtccgcatccgaaggacttcaccgacgacgtgatcgccgcgatggccgagacgccgaacgtctgccactcgctgcacatgccgctgcagtccggctcggaccgggtgctcaaggcgatgcgccgtagctaccgccaggagaaatacctggacatcatcgacaaggtgcgggccgcgatgccggacgccgcgatcacgacggacatcatcgtcggcttccccggcgagaccgacgaggacttcgagcagaccctcgaggtggtccgccgggcccgcttctccagcgccttcaccttccagtactcgaagcgtcccggcaccccggccgccacgatggcggagcaggtgccgaagaaggtggtccaggagcgctacgagcgcctgatcgccaccctcgaggagatcacctgggcggagaacgggaaactggtcggcgagaccgtcgaggtgctggtcgcggtcggcgagggtcgcaaggacgagcgcaccggccggatgagcggccgggcccgggacggccgcctggtccacttcgcgaccggcgacctcagcccgcgcccgggcgacatcgtcgagacggtgatcacctacgccgcgccgcaccacctcaacgccgacggcgcgccgctctcgcaccgccgcacccgggccggcgacgccgccgaggcgggcaccacgccgaagctcaagggcgtctcactgggcctgccgacgatcggtgtcccggcgccgctgccggccgccgagggctgcgccctctaa

SEQ ID NO: 4106 - DNA, 735 bp, Actinoplanes utahensis
gtgtcccggcgccgctgccggccgccgagggctgcgccctctaaggttctcgaccggctacccgctacccccgacggccatgatccgcgggacggatcctggccctttcccggtccacgcgcggccaggtcgtcccgcgatcgtgcaacctggccgccgccctcgccggtctatccggacgtgagagcagacagaggctcgggtaacaccgagcgtgacagccagttcgccggcttcgtggccgagcaacgcggccggatggtgtacaccgcgcggttgctgaccgccggtgacgcctttctcgccgaggatctcgtgcagaccgcgctgacgaagctctacgtctcgtgggcggccttcgggcgggccgacagcccggacgcctacgtgcggcgggccctcttcaacgcgctggtcgacgagcgcaaacggatctggcggcggcacgagcggccggtcgcggacgtcccggaccgggccggcgagctcgtcggcgcggacgacggcgatccggaactggcccgggcgctcggcgaactgcccccgcggatgcgcgcggcggtcgtctttcggttcgtccacgacatggacgtggccgagacggcccgggcgctgggctgctcagccggcacggtgaagagccagacggcccgggctctcgacaaactgcgtgccgcgctggggcagcccgccctcgcgaccaccttctccggccaaccacagggagccagctga

SEQ ID NO: 4107 - DNA, 723 bp, Actinoplanes utahensis
atggacctgcacaccagactcgagcgcttcggcggcccgatcgaggccgccgccgcggacaccatcgccgccgacgtggaacgcgggcagcgcgccctgcgccgtcgccgcaccttccggaccagcgcggtgaccgcgttcgggatggccgcgatcgtcgccaccatctcggtgaccggtgcggtcaccggcaccgcgccgtccgggccggccgtcgccgccagcctgccggccgccgccgggagcacgcccgccgcccgcgtcaagctggtcgactacaccggcgcgcagccgaagtggttcaccatcgacaaggtgccggagggctacttcgtccagaaggacgacgagggcggtctgacgatcgccccggcatcggtcaagaatccgccgccgggcgccgacccgtcgaaggatccgcggtacgacccgagcgtgctgaccgacaagatcggcatctatctggagccgacctggtaccgggagggcaacgacgacggcgagaaggtgacggtcggcgggttcccggcggtcctgcacggcgccgccccgctgcagcagctgatgatcctggtgtcgccgaaggtctacgccaccgtccaggcggatgtcccgctgacccgggaccagctcctggagctcggtgccggcctgcacgtgagcaaagaggccgtcgaccggatggccgcatcgaccggcaagaccggcaagaccggcaagtga

SEQ ID NO: 4108 - DNA, 951 bp, Actinoplanes utahensis
gtgctcgacgtgacccggctgcgggtgctggtcgccgtggcccggtgcgggtcggtgaccgcggccgcgcaggccctgcactacgcccagccctcggtcagccaccacctggcccggctggaggcggagaccggcagccggctgatccagcgggccgggcgcggcatccgcctcaccgacgccgggcggatgctggccgagcgcgccgaggagatcctgggccggctcgacgcggccgaggcggagctggcggcgcacaccgggctgcggtccgggcgggtgcggctggccgccttccccagcgcgctggggaccttcgtgccggccgcggcggccgggttcgtcggcgcgcaccccgggatcgacctgcgcttcaccgaggccgagccgcccgccgcggtgcggctgctgcgcagcggcgaggtggaggtggcgctgctgttcacctatcccggggagacggtgccggacctggacgggctgcggcccgagccgctgctcgaagagcggctgtatctggtgacgcccggcgaccgggccggggacaccctcgccgaccatcgggaccggccgtggatcagcggctgcgagcgctgccgggcggagctgctgcgggtctgcgcggcggccggcttcaccccggacatccgtttcaccaccgacgactacgtcgcggtgcaggcgctggtcgcggccggtctcggcgtcacggtcctgcccgcgctggcgttggccgcacaccaggatccgggcgtacggacggtggcactgcccgataccgcccgcaccgtctacgcggcggtgtacggggacacgccggacccgcccggcaccaccgcgctgctgggtcatctgcgggcggcggccgggctacccgcgtacgcgtcgatcgggaacctgaaccggccgcggaccgcgagcggaccgcggccgggccgcagcgggtggtga

SEQ ID NO: 4109 - DNA, 960 bp, Actinoplanes utahensis
atggagctgaccctcgccgacttccgcgccgcccacgccgtcgtccgccgccacctggcgcccaccccgctcggcggctacccgctgctggaccgggcggccggcgcgaccgtgctggtcaagcacgagaacgcgcagccggtcggcgcgttcaaggtgcgcggcggactgaccctgctggacgccctgccggccgccgaccgggcccgcgggacgctcacctggtcgaccgggaaccacgcgcagtcgctggcctacgccagccaccggtacggcgtgccctgcacggtggtgatgccggccggcaccgatccgggccgggccgccgcggtcgaggcgtggggcgcccgcgtggtgctggccggcgaccgcctggaggacgcccaggagcacgccggcaagctggccgcggagaccggcgcccttgcggtcagccccggggacacgcccgagctgctggccggggtcggcaccctgtacctggagattctggagcgggaaccggacctggacgcgatcgtggttccggtcggcagcggcaccggggcggccgcggcctgcctggtgagcgcggccctgggcgcgcgctgcgcggtgatcggcgtgcagtcggccgcctcaccggccgcacacgactcgtggcgggccggcgagttgctcgcccggcccaaccggtccacggtggccggcctggccaccgggcgcggctacgcgctgccgcagcgggtgatgcgggccggcctggccgatttcctgctggtcggtgacgacgagatcggggcggcccgacgactgctggcgagcgccgcgcacaccctggccgagggggccggcgcggccgcgctggccggggtgttgagccggcccgacctgttcgccgggcgccggatcgcggtggtctgcagtggaggcaacgccgaccgcgccgaactgggcacgatgatcgatggccgagggtga

SEQ ID NO: 4110 - DNA, 1815 bp, Actinoplanes utahensis
atggccaacttcccgcgcgcgccgctgtcgtcgtggggtgagcagcaccagcccgcggtgacgttgacgcgtgtggtgttcgccctgatcggcgcggccgccctgatgctcggctacgccggcctcgacgactatctggccaccgccccggcgggcagtcgggacccgctgaacctggcgtacgacacgatgcagctgttcgtgctgggctccgatccgctgcagggcggcacccgcttcccggtcgcgctgcagatcgcccggttcgccgcgccgctggtcacgctgtacgcggtcgtcgagggcggccgcctgctcctggccaccgaggtgcgccgctggcgggctcgccgctcccgggaccacgtggtggtctgcggtgacacctcggtggcccgcaccctggccgagcggctgcaccgggccggacgccgggtggtgctggtccgcacccggccgatcggcccgctggagctgcgcggccgcggcctgctcggcgtgcagggcgacgcccgcgagccggaggtgctgcgcggggcggcggccgggcgggccgcggtgatctactgctgcgccgagtccagcgcggtcaacctggcgatcgccgcgaacgccgcccgggtggccggcgacggtcaccgcgacctggccatctacgcccagatccacgagccggactgggcgctcaccctgcaggcccggcggctcggcgtgcccgacgcgggggcgcagcggctcgacttcttccagatcgaccagctggccgtgcaggtgctgctggcccggcagccgctgccggtccggctcggcggcgccgcgccgcggctgctgctggccggtgactcaccgctggtccgggcgctgctggtggaggtggcccggcactggcggctgcgccggggccggccggaccggcggctcgacatcgacctcgtcgcgccggacgccacccgggtgctggagcgggtcgcccggcggcacaccgttctgcgcgacacgtgccgggtcgtgccccgggagacgaccgtcgccgaactgctcgccggcgccccggccgacgcgtcgcgctacgagcgggcgttcctcttcttcgccgacgagaagtacgggctgcagctcgccctgaccgaataccggctctggcaccgggtcgccggcgacgtggtggtggccgtggacggcctggccgagttggccgacgcgttcagcccggaacacccgccgccgctgctggacccgctgaacgggcggctcaagctgttctcgccggccgcggcggggtgcgatccgacgctgatcgccgaggacctggccgagcggctggcccgactgatccatgagcggtacgtggtggcccggctcgcccgcggggatcggcgaggcgacgggctcggcgatccgtccggtgggcatccggcgatgaccgcgtgggccgatctgccggaaccgctgcgccgggcgaaccggctgcaggccgccgacatcggcccgaaactgcaccaggcgcactgcgcgatcgtgccgcgggacggtgccgcggacgatttcgcgttcaccgcggcggaggtcgaggagctggcgaagcgggagtcgcggcgatgggtcgaggcgaccctggccgaggcgcgggcccgggaggtaccaccggccgaacgaaacgtcccctttttgggggaatgggagcagcttccggccgaagggcaggagcgctgccgtagggcaattcgcgacattccggaaattctgggcgaggcgggcttccaagtcgtccgtttgtcggacactggagccgaccgggcactcttcccggcatga

SEQ ID NO: 4111 - DNA, 498 bp, Actinoplanes utahensis
atgattcgcatcggggtgacgggccacatcgggctcgaccggtcttcgcgccggccgatccgcaacgcgatcgtggccgaactgcgcaaacacaagccgatccacggggtcacctgcctcgccgacggcgcggaccggatcttcgtggaagcggtccggatctgccgcggcaccttcgaggcggtgctcccggtgccggagataagcgccgaaccggaagaagaccgggaactgcgcgaactcatccggtacgctaccgacgtcacccggctcaccgtgcccggcgcgccggagctcacctacgaggccgccagccgggaagtggtcgaacgcagcgacctgctgctcgcggtctgggacggcacgcaggccggggcgcgcggcggcaccgcggaaaccgtcgccttcgccagggaacagggcaaacaggtgcaccggatctggccggacggcgcgcgccgggtcgccgtcacctcagccgtcccggtctccgcctga

SEQ ID NO: 4112 - DNA, 1248 bp, Actinoplanes utahensis
gtggtccggcggcgccgggagaacgaggatgagctcatgaacgaggactggacggccttcggacgcgtggatgccgacggcaccgtgtacgtgaagaccgccgagggcgaccgggtggtcggctcatggcaggccgggacgccggaggagggcctcgcccacttcgcccgtcgtttcgaggacctggtgaccgaggtcgacctcgtcgaggctcgcctcaagtcgggcgcggccgacgcgtcccactcactgaccagtgtcaagcggctgcgcacccagctcgacgaggcgcacgtggtcggcgacatcgacggtctcaccgcccggctggagaaactttccgcgctggccgacgagaaggcgagcgaggccaaggccgcccgcgaggtcgcccgcaccgaggcgctggcccgcaagaccgccctggtcgaggaggcggagaagatcgccgccgacgccaccgggtggaagtcggccggtgaccggctcaaggagatcctcgacgagtggaagacgatccgcggcgtcgacaagaagaccgacggtgagctgtggaagcggttcgccgccgcccgggacggtttcacccggcgtcgtggcgcgcacttcgccaccctggacgggcagcgcaagcaggcgcagaccgccaaggaggagctggtcaccgaggccgagtcgctggccgcttcgaccgagtggtcgagcacggcgaaccggctgaaggagctgatgaccgagtggaaggccgcgccgcgcgccgccaaggaggccgagcagcgcctctgggagcggttccgggccgcgcaggacgcgttcttcacccggcgcagtgaggtcttctccgcccgcgacgcggagtaccagggcaacctggagcgcaagcaggcgatcctggccgagatcgaggcggtcgacgtggacgccgatccgcgcggcgcgcagaaccggctccgcgacgcgcaggccgcgtggcacgacgccggccgggtgccgcgggaggccgcggccgggctggaccgccgctggcgggccgccgaggagcggatccgggtggcgatggactcggcgtggcgcaagaccagcccgcaggacaacccgctgctgcgtcagatgcgcgaccaggtcgccgaggccgagcagcggctggagcgggcccgggcggccggcgacaaccggcggatcaaggaggccgagcaggcgctcgcctcgaagaagcagttcctggcgctggccgagcaggccaactga

SEQ ID NO: 4113 - DNA, 912 bp, Actinoplanes utahensis
gtgccctccagtcccggtccccgcgtggtcaccgtcgtcgggccgacggcggccggcaagtccgcgttgagcatcgcactcgcccacgaactcggcggcgaagtggtcaacgccgactcgatgcagctgtatcgcgggatggacatcggcaccgcgaaactgggcgccgccgagcgcgacggggtgccgcaccacctgctcgacatctgggacgtcacggtcaccgccgcggtcgccgagtatcaggcgctggcccgcgccgcgatcgacgacatcctggcccgcggccgggtgccgctgctggtcggtggctccgggctgtacgtgcgcgcggtcctggaggaattcgagttccccggcaccgacccggcgatccgcgcccgcctcgaagccgaacttgccgcgaccggcccggcaccgctgttcacccggctcggcgtgctcgacccggtcgcggccggccggatcctgccgtccaacggccgccgcatcgtccgcgccctcgaggtcatcgagttgaccgggcagccgttcacggcggcgctgcccgacccgaaaccgtattacgacacggtgcagatcggcgtcgaccgggatccggccgagctggacgagcggatcgcccagcgggtcgagctgatgtggtccgccggcctgctcgacgaggtgcgcgcgctggacgcggccgggatccgggatgggcggacggcctcgcgggcgctcggctaccagcaggcgctggccgagatcgacggggtgctgagcggggcgcaggcgcgggccgacacggtgcgcggcacccgccggttcgtccggcggcaacgctcctggttccgccgcgacccgtcgatcacctggctggacggcgccgccccggcactgctggccgacgccttggccgtgatcggctga

SEQ ID NO: 4114 - DNA, 867 bp, Actinoplanes utahensis
atgatgggcggcgtgtttttcaccaagggccacggcaccgccaacgacttcgtcatcctcgccgaccccgacggcgaactggagctgacgccggcactggtcgccgcgctctgcgaccggcggcgcgggatcggtggcgacggcgtgctgcgcgtggtgcggtccgcgaaacacccggcgggggccgggcacgccaccgaggccgagtggttcatggattactggaacagtgacggctcgatcgccgagatgtgcggcaacggggtccgggtcttcgcccgctatctgaccgctcgtcagctggccacgcccgggcccgcgggcctgccggtcgccacccgcgccggcgtcgtgcacgcggtggtcgacgccgacacgatcagcgtccggatgagcaccccccgggtgtacgcggcgagcaccgcccgggtcggcccgctgaccgtccccgggatcgccgtcgactgcggcaacccgcacctggtctgcgggctgcacgacggggtgacgctgtccggcctggacctgaccaccgccccgggggtcgaccgggcgctgttcgccgccggggtgaacgtcgagttcgtcgagccggtcatcgacccgaccccggacaccgaccgccacgtgcggatgcgggtccacgagcggggctccggcgagacgatgtcctgcggcaccggggccctcgcggtcggcgcggtggccctgcgcgaggccggcctggccaccggctcggtcaccgtcgacgtcctcggcggccgggtcgtgatcaccgccgacgcggccggctcgtggtggctggccggtccggcggtcctggtcgccaccggcgaggtcgacctgtcggcccttccggtcacctga

SEQ ID NO: 4115 - DNA, 1461 bp, Actinoplanes utahensis
gtggtgaccacccgcctgccgagcgcaggattttcgatcacgatccgtatcgccgtgaccgccgatgcctcgtccatcggccggctcaccacctgcgtcggcgaggccggggcgatcgtgacggccctggacgtggtggactccgacccgacccgggtgctggtcgacctgacctgcgacaccgccgactcggcgcacgccgaccaggtcgtcaagcagctggaggagcaggacggggtcgacgtccgcaaggtgtccgaccggaccttcctgctgcacctgggcggcaagatcgaggtcagttcgaaggttgcgctgcgcaaccgggacgagctgtcccgggcgtacacgccgggcgtggcgcgggtctgcatggcgatcgcggagaacccggccgacgcccgccggctcaccatcaagcgcaacacggtcgccgtggtcagcgacggctcggcggtgctgggtctgggcaacatcggcccggccgcggcgatgccggtgatggagggcaaggccgcgctcttcaagcggttcggcggggtggacgcctggccggtggtgctggacacccaggacaccgacgagatcgtcaagatcgtcaaggcgatcgccccggcgtacggcgggatcaacctggaggacatcgccgcgccgcgctgcttcgagatcgaggcgcgcctcaaggagcagctggacatcccggtcttccacgacgaccagcacggcaccgcgatctgtgtgctggccgccctgaccaacgcgctgcgcgtggtcggcaagcggatgcaggacgtcaaggtggtggtctccggcgcgggcgcggccggcaccgcgatcatgaaactgctgatgcgccagggcgtcggcgacatcatcgcgtacgaccgcaagggcgccctgcaccgcggcatgcccgacctcaacgagtcgatgcagtggctggccgaccacaccaaccgggcgaactactccggcgacctgcccggtgccatcgtcggcgccgacgtcttcatcggcgtctccgcccccaacctgctcaccggcgacgacatcgcccggatggcgccgcggtcgatcgtcttcgcgatggccaacccggacccggaggtcgacccgcgcgaggcccgcaagcacgccgcggtcgtcgccaccggccgctccgaccagcccaaccagatcaacaacgtgctggccttccccggcgtgttccgcggcatgctggacgtcagcgccgaggagttcaccgaggagatggccctggccgcggcccgcgccatcgccgacgtggtcggcgaagacaaactcaacccgacggtgatcatcccgagcgtcttcgacccgcgcgtgaccccggcggtcgccgccgcgatccgcgcggtggtccgcggcgtcccggcgccgtcgaacccgtcggccaccccggagtcggagctggaccaggcgccggaagggatcttctga

SEQ ID NO: 4116 - DNA, 1416 bp, Actinoplanes utahensis
ttgcgaaacacgtaccaggctcccgtgctcgacgagccggacctgacgaccggcgatctggagctggaggagcggcactcgctcaggcgggtggccggtctctccaccgagctcaccgacatcaccgaggttgagtatcgccagctgcgactggagcgcgtggtcctggtcggcgtctggaccgagggcagcgtcgaggacgcggacaactcgctgaccgagctggcccagctcgccgagaccgccggctcccaggtcctggagggcctgatccagcggcgccggcagccggacgcggccaccttcatcggccgaggcaaggtcgacgagctgcgcgacgcggtggtggccagcggtgccgacacggtcatctgcgacggcgagctgtccccgtcccagctgcgcaacctggagcagcagatcaaggtgaaggtggtcgaccggaccgcgctgatcctggacatcttcgcccagcacgcgaagagcaaagagggtaaggcccaggtcgagctggcccagctgcaatacctcctgccgcggctgcgcggctggggtgagtcgctgtcccggcagggcggcggcgccggtggcggtggctccggcggcggcggcgtgggcacgcgtggtcccggtgagaccaagctggagaccgaccgccggcggatcaaccagcggatcgcgaaactgcgccgcgagatcaaggcgatgcgcacggcccgggacaccaagcggtcccgccggcaggccagcggcactcccgcggtggcgatcgccggctacaccaacgccggcaagtccagcctgctgaaccgtctgaccgaggccggcgtcctggtggagaacgcgctgttcgccaccctggacccgaccacccggcggacctcggcggaggacgggcgggtctacacactgtccgacacggtggggttcgtccggcacctgccgcaccagatcgtcgaggcgttccgctcgacgctggaggaggtggccgacgccgacctggtggtgcacgtcgtcgacggctcgcacccggacccggagggtcaggtcagcgcggtccgcgaggtgctcggtgaggtcggcgccgaccggatccccgagctgctggtgatcaacaagatggacgccgcggacgaggagaccgtgctgcggctcaagcgcgcctggccggacgcggtgttcgtgtcggcgcgttccgggtcgggcatcagtgagctgagggcggccatcgcggagcggctcccgcgcccgccggtcgacatgcggatcctgctgccgtactcgcgggccgatctggtcgcccgggtgcaccggaccgggcaggtgctgcagtcccggcacctggacgacgggaccgagctgagggtgctcgtcgatgaacggctggcggccgatctggaggagttccgttgctga

SEQ ID NO: 4117 - DNA, 1401 bp, Actinoplanes utahensis
atgaacggctggcggccgatctggaggagttccgttgctgagagtcacctgtcccggggtgcgaaaagcgacacctatggacctttgaccagggttgatccacgcgttacaccgatgggtgacgccgcatgcgacactgtgcggatgcggcgtctcgtgttctcgatcgttctgggtgtgggcctggtggcgatcggtggcaccggcgcgtctgccgctgatccgacgccgacggcgacggtcagtgccaaggcgacggccggtaagaagatttgtgagatcaagagccctctgctcaacgaggtctccggtctggtcgcgacgaagtcgggattcgtcgccatcaacgacagcacggacgccacccggcgtttcgtcttcttcctggacaccaagtgcgccatccagcggaaggtcagcatcgccctctcccgtgacaccgaggacatgatcctgtcgccggacggcaggacgctctggatcgccgacaccggcgacgacgacgcgctcaagggccagcccgcccggtccaacgtcgggctgtggacgatgccggtgaccggggcgcaagcgccggtgctgcaccggctgagctatccgtcgggggaccagcacgacgccgaggcgctgctgctcgacggtgacggccagccgctgatcgtgagcaaggagatcggcgcggcacacgtctacaagccgtccggcccgctgaaggacaacaacgccaccggcgtgccgatgacccgggtcgccgagctggcgctgccggccaccgagacgccgggcaacgcgttcgcccgggtcttcaacaaggtgatcaccggcggcgcgatggcgcccggcgacggcaaggtggtcctgcgcacctacaccgacgcctgggagtacgacgtcaagggcggcgacgtgctggccgcgctgaagaccaggccccggaccacgggcctgccgaacgagccgttcggcgaggcgatctcgtacagcccggacggcaagacgttctacaccgtctccgacatgaacggcgacgcgaacaccgcgaactggatcatgcagtacgacccggccaccacggtcgccgcgcagtcgaagaaccagtcggacggcaccgcggacgcggcgtggtacacgaagctgagcgtgagccagatcacctacctggtgggcggcgtcggcctgatcggtctgctgctggtcggcgtcggggtgatcgggatcgtccggttccgcaaggcgcacccggccggggtgaccgtggacgacgcggactccgggccgctgggcaaggacgacaacgagctgatcggcgtgggcagtggcgccgggtacggcagcggcaacggcccggtctacggcagtcagccgcgacccggtgtctacggcggccagctagctagctag

SEQ ID NO: 4118 - DNA, 102 bp, Actinoplanes utahensis
ttgcgggcgctggggttggccgccctgcggacgctgcggctggccgccgtagacgccgccgccctgcggccgcggctgctgcggaccaccgcgcggcgctag

SEQ ID NO: 4119 - DNA, 792 bp, Actinoplanes utahensis
gtgtcgaccgacgaccgcacgagccgacagcagcaaccgatcaggcaggacccgggcagtgccgcggccgccatgcgccggcgcacaccgagccgggcccgttcggccgacgcgccgcagctgcgttcggtcaccccgctgaacaacgtcgccgagccggtcgccggtgccctcaccacccggcagcggcggatcctcgagttcatccgcgagtggggcgagaaatacggctacccgcccagcgtccgggagatcggcgaggccgtcggcctggtctccccgtccagtgtggcgtatcagttgaaggctctggagaccaagggctacctgcgccgcgacccgaaccggccgcgtgccgtcgacgtccgctcccccggtgagctggtcgacgacgaggcactgcgcgcggcccggccgcagccggcctacgtgccgctggtcggccggatcgcggccggcggcccgatcctcgccgagcaggcggtcgaggacttcttcccgctgccgcgcgagctggtcggcgagggtgaggtcttcatgctggaggtcaagggcgactcgatgatcgacgcggcgatctgcaacggcgactgggtggtcgtccgccagcagcccaacgccgaggccggcgacatcgtggccgccatgatcgacggcgaggcgacggtgaagagctaccgccagcgtgacgggcacgtctggctgatgccggccaacccggccttcgacccgatccccggcgacgacgcgaccatcatgggccgcgtggtggccgtgctgcgccgggtctga

SEQ ID NO: 4120 - DNA, 141 bp, Actinoplanes utahensis
atggtggtcaccggtggagctcggcacaccgcgccgccgttgcgcctgacccgccggggccgggtggtccttctcggtctcttcttcgcggtgtcggttctcgcgagcgttgttttgttcacgaccgcgtcccgcggctaa

SEQ ID NO: 4121 - DNA, 522 bp, Actinoplanes utahensis
gtgcgttgcccgtactgccggcacgccgattcgcgtgtcgtggactcgcgcgaggccgatgacggtcaactgatccgtcgccgccgctcgtgtcccgagtgcggcaagcggttcaccacggtcgaggaggcggtgctcgcggtggtcaagcgcagtggcgtcaccgagcccttcagccggaccaaggtcatgagtggggtgcgcaaggcctgtcagggccggcccgtcgacgaggactcgatcgcgctgctcgcgcagcgggtggaggaagccgtccgggcccgcggcgccgcggagatcccgagccacgaggtcggtctggcgattctcacgcccctgcgtgaactcgaccaggtcgcctatctgcggttcgccagcgtctacaaggccttcgactctctcgacgagttcgagaaggagatcgccgcgctccgcgaggcgccacccgtccgggacgccgggacgcgacacgccgtcgcgccgcggtccgggacggcccgtgtgcccaggatcaacggctga

SEQ ID NO: 4122 - DNA, 2964 bp, Actinoplanes utahensis
gtgtgcccaggatcaacggctgataacgaagttgtctacgagggggagcacatcagtatggccggagacggcatcaccgcgggtcgccagcgcagccggacgaacacgaacggcggcgacgcggcggcggccgcggggctgcgcgtggagcgggtgtggacgacggcgggcgtccacccgtacgacgaggtggagtgggagcgccgggacgtcgtcatgacgaactggcgggacggctcgatcaacttcgagcagcgtggcgtggagttccccacgtcctggagcgtcaacgccgcgaacatcgtgacgaccaagtacttccgcggcgcggtggggacgcccgagcgggagacgtctctgcgccagctcatcgaccgggtcgtgcagacctaccgccgggccggcgaggagcacggctacttcgcgagcccggccgacgccgaggtcttcgaccacgagctcacctggatgctgctgcaccaggtgttcagcttcaactcgccggtctggttcaacgtcggcaccaagtcgccgcagcaggtcagcgcgtgcttcatcctctccgtggacgactcgatggactccatcctcgagtggtacaaggaggagggcctgatcttcaagggcggctccggctccggggtgaacctgtcccgcatccgctcctccaaggaactgctgtcctccggcggcacggccagcggcccggtcagcttcatgcgcggcgccgacgccagcgccggcaccatcaagtccggcggcgccacccggcgtgccgccaagatggtcatcctcgacgtcgaccacccggacatcgaggagttcgtgcagaccaaggcgcgtgaggaagacaagatccgcgcgctgcgggacgccggcttcgacatggacctgggcggcgccgacatcgtctcggtgcagtaccagaacgccaacaactcggtgcgggtcagcgacgagttcatgcgggcgtacgaggagggcaccgagttcggtctccgtggccgcctcgacggcgaggtcatcgagaccatcgacgccaagaagctgttccgcgacatcgcccgggccgcctgggagtgcgccgaccccggcctgcagtacgacgacaccatcaacgactggcacaccaaccccgagaccggccggatcaccgcgtccaacccgtgctcggagtacatgtcgctggacgactcgtcctgcaacctggcctcgctcaacctgatgaagttcctccgcgccgacggcggcttcgaggtggagaagttcgtcaagagcgtcgagttcatcatcaccgcgatggacatctcgatctgtttcgccgacttcccgaccgagaagatcggggtcaccacccgggcctaccggcagctcggcatcggctacgccaacctcggcgcgctgctgatggcctccggcctgccctacgactccgacggtggccgcagcgtcgccgcggcgatcacctcgctgatgaccggcaccgcgtaccgccgctcggccgagctggccggcgtggtcggcgcctacgacggctacgcccgcaacgccgacgcgcaccagcgcgtgatgcgcaagcacgccgctgccaacgacgaggtccgcgcccagggcccggtcgccaccgagatcctccgtgaggccacccggcagtggaagaacggcaacaagatcggtgagaagaacggctggcgcaacgcgcaggcgtcggtgctcgccccgaccggcaccatcggcctgatgatggactgcgacaccaccggcatcgagcccgacctggccctggtcaagttcaagaagctggtcggcggcggctcgatgcagatcgtcaaccagaccgtgccgcgcgcgctgcgcagcctcggctatcccgaggagcaggtcgaggcgatcgtcgagcacatctccgagcacggcaacgtggtggacgcgcccggcctcaagccggagcactacgcggtcttcgactgcgccatgggcgagcggtcgatcgccccgatcggtcacgtccggatgatggccgcggtgcagccgttcatctccggcgccatctccaagaccgtcaacatgccggagacggcgacgatcgaggagatcgaggagatccactaccagggctggaagctcggcctgaaggcgctcgcgatctaccgcgacaactgcaaggtcggccagccgctgtcggccggcaagaccgcgaaggccgccgcgcccgccacggtcgaggccccggccgcggtcgagaaggtcgtggagaaggtggtcgagtaccgcccgatccgcaagcggctgccgaagaagcgcccgtccgagacggtctccttctcggtcggcggcgccgagggctacctcaccgcgtcgtcctacccggacgacggcctcggcgaggtcttcctgaagatgtcgaagcagggctccaccctggccggtgtgatggacgccttctcggtcgccatctcgataggcctgcagtacggcgtcccgctggagacgtacgtcagcaagttcaccaacatgcgcttcgagccggccggcatgaccgacgacccggacgtgcgcatggcgtcgtcggtgatggactacatcttccgtcgcctggcgctggacttcctcgactacgacacccgcgccgagctgggcatcttcaccgccaaggagcgcaccgcccaggcgcaggccgaggccgccgccgaggctgccacggtcgacctggccggcatggcggcgtccgctccggccgcgccggcggtcgctccggccgcgacgcccggcacgtccaccgtgacggtcgccgaggcgaaggccgccacgccggtctcggccggctcgtcgaccgaactgctggagatcaagaccgggcacgccgccgacgcgccgctctgcttcacctgcggcacgaagatgcgccgcgccggcagctgctacgtctgcgagggttgcggctcgacctccggctgcagctga

SEQ ID NO: 4123 - DNA, 534 bp, Actinoplanes utahensis
atgggccggcccgaggaactgcaggcggaggcacgttccgtgctcgcgctgctggagccgctgggaccactcaccccgaccggcagctacgtgtccggcctgatggtctggcgcgacctcgacgtcacgctgttcggcggtccggacttcaccccggccgacgtcctcacgctgctcggcagggcggtcgccatccccggcgtgaccggtttcgactatcgcgacgagcgcgacgccaaaccggccgatcagcgttaccaggtcaccatcacgctgggcgagtggcgtgtcgacctgtccatctggctgcacgacggccatccctcgaccgccgattggcaccgcgacctcgccacccggctcaccgacgaggagcgtcaggcgatcctggcgatcaagcagctctggcaccagcgcccggaatatcccgccgaggtcaacggcttcgacatcaccaccgccgtcgtcgaccacggcgtccgcacggcggtggagttcggcgtctggctccgcgagacccacggcggccgctga

SEQ ID NO: 4124 - DNA, 1182 bp, Actinoplanes utahensis
atgagcagcgtcgacgtcctgcccgcccgggttgccaccgccaggatcgccgtcggggtgacgttcgcgatgaacgggttggcgctcgccgggtggctgtcccgggctcccgcggtccgggacgggctggagttgtcggtcgccgggttcggcctgctgctgctctgcatgtcgggcacgtcggtcgcgtcgatcccgctggccggtccgctggtgcagcgggtcgggccggcccgggcggtgctgctggccagcatggcgatggcggccggtctggccgtgctggccaccgccaccctgctcggctcggtggtgctcgccggggtcgccctgctgttctgcggtttcggcaccagcacgtgggatgtcgcgatgaacgtcgaggccgccgacgtcgaacgccgcctcggccggaccatcatgccccgcttccacgccggtttcagcctgggcacggtcgccggcgccggtgtcggtgcggccgcgtcggccaccggggtgccgatcggagcccagctgtacgtgaccacggtgatcgtcgtcgcggtccagatcgccgtggtccgccgtttcctgccacactcgggtccggagccgggcagccggccggcgatgaccgccgggcaggcttggcgggaaccccgcaccctgctgatcggcctgatcctgctcggtttcggcttcaccgagggcagcgccaacgactggctggcgatcagcctggtcgacggctaccacaccggcgacacgctgggcgccctgggcttcggcgtcttcgtcaccgcgatgaccctgggccgcatgtacggcggcctggccaccgaccgctggggccgggtcccgtccctgcgcctcaccgccctgtccgccgcggccggcatcctgctggtcgtcttcggcggctcggtatggctggccctggccggcgccctctgctggggagtcggcgcctccctcggcttcccgatcgggatgagcgccgccgccgacgacccgatccgcgccgccatgcgagtgtccgtggccggctccgtcggctacgccgccttcctggccggcccacccttgatcggcttcctggccgaacacttcggcgtccgcaacgccctcctctgcgtcttcgccgccctcctcctcggcctcaccgcctcccacgccgccaagccacttcccaccagctga

SEQ ID NO: 4125 - DNA, 906 bp, Actinoplanes utahensis
atgatcaacgacagcctggtggacgcgggcggtgtgcagctcgcggttcgggacttcgggggcgaccatccgccactgctcctgctgcacggggccggcggcaacctcgcccacatgaccctcctcgcccgggcgttgcgcccgcaccaccgggtggtcaccgtcgatctgcgcgggcacggacggtccgcggacggtccgtggacctgggatgccgcgctcggcgacctggccgcggtctgcgtcgagctggagctggagcggccggcgatcgccggccattcgctcggcggcatgctggccacgctctggggtcagcggcacccggagtcccccggtgtggtgaatctggacggcagtccgccgcccacccgccccgaccagctgcccggcctcaccccggaccgggccgccgccgagctggagcggctcaccggcgtcttcgacatggtcgaggccgccgccggtcagaccgtcgaagccggcgaactggccgacctggtcgagcgccagcggatggcggcccgggaccgcggcgccaacgagaaggtgtggatcgagggtttccgccgcaacctggtccacggcaaggacggcaccaccaccttccggccgtccttcgccaccaccacccagctgcgcgccctgatgaccgagctggacctggccccggtccacgccgccaccaagtgcccgtcgctgctggttctggccacccgtgacctgcccgagcaggagccgttcgccgacctgtacgcggcccaccgccgctacgtgctggcccaggccgaggccatcccccacctgcgccacgtcgcgctggccgacgcctcgcacgccatggtgatcgaacagcccgaggcgctcgccaccctgatcaccacctttctcgcggaggcccgctga

SEQ ID NO: 4126 - DNA, 624 bp, Actinoplanes utahensis
atgttgctcgccgagcagatcatccgcttgctcgacatccggctggtcgatccgctggagatcctgctggagggggatcccggcgtggaccgcgtccgccgccgcctgcaggtgcgggcgtgggagtgggccgcgatgatcgagcagggcgaggaggccgaggcggtgcacatcatcgcccgcctgatcgccaccctctacccggacgatcacgcgttcgccccaccggtggagtggtggcggacaccgctcgggcaggcggtggtccgcaggatgggtcacccgttcgcgacgacggtctcctacgcgacggccggcgccatgctcggcatcacccgccaggccatccacgacctggtccggcgcggccggctgccccgagacccggacggcggcgttccggtcggcgccgtccgcgcccgcctcctcgccgccacccccttcaccaccccggccaccgcagccccgctcaccgcgtccggtgccacttccgcgggggcggcccaccgggttccggcgccatcggtggacttcgttcatccgagcggcttcttctccgcggcgagcggtgactccgacgacctgaccgacgccgaaccgacggggaacgaggaaacgcaatga

SEQ ID NO: 4127 - DNA, 555 bp, Actinoplanes utahensis
gtgcgcacggttctagccgcgctcggcgtcgtcacactgctcgccgccgcgggctgcaagaagcaggacacggacgccccggtctcgttgccgccggtcaccatcgtggagcagccggcggcttccgcgggcggcgcctgcatcctctgggattgggcgttcatccagcagaagatcggggtccggttctcggtcgccgccgccgaccaggtggatgacacgtccacctgcgtggtgcagacggtcgacggctcctggcccgacctgtcactgtcggtggtcgaggagacgaaggcggatgccaaggtgttcctggccaaccgcgtaccgaagaagggtgtgaagctgaagggcctcggcaaggcgggctatcggctgaccggtccggcggccgacgggcacggcccgacggtggagatcggctggttgagcgaggcggagcagttgcagacgctgcggttcaccttcgagaagggtgcggcgagctcgtcggtcaccgcgatgaacgacaggctgctggagctcgcgaaggcgatggacaccaccgacggctag

SEQ ID NO: 4128 - DNA, 690 bp, Actinoplanes utahensis
gtgaacgaccttgtcgacaccaccgagatgtatctccggaccatcctcgaactcgaggaagaaggcgtgcccccgctgcgcgcgcggatcgccgagcgcctgcaccagagcggtcccaccgtgagtcagaccgtggcccggatggaacgcgacggcctgctcaccgtcgagggcgaccgccacctggtgctgaccgagcagggccgcagcaccgccgtgtcggtcatgcgcaagcaccggctggccgagctgctgctggtcaacgtcatcggcatgccgtgggaggaagcccacgaggaggcctgccggtgggagcacgtgatgagcgactccgtcgaacgccgggtctatgagctgctcaacaagccgacccggtcgccgtacggcaacccgatccccggcctggaacaactcggcctgcccgaggacgacgcgaccctggaacagcccggccccggcgaacgcaacctggccttccccgggctgaccggcagcgtcgtggtccggcggatctgcgaaagcgtgcagaccaactccgacgtgctgcggcagctgcacgccgccgggatcgacccgggcacgacggtgaccgtcgcgcaggaacgggacggggtcaccatcgacaaggccggcgacaagatcaggctgccgcgtgaggtggcatcccgggtgttcgtcgccgcccgctga

SEQ ID NO: 4129 - DNA, 1188 bp, Actinoplanes utahensis
atggcggacgagacgacggcggcggtggtctgggacaaggccctgctcgactacgacatgggcgatcacccgctgaatccggtgcgggtcgagctgaccatggcgctcgccggtgagctgggcgtcctcgaccgccccggggtgcggttggtcactccgcggccggccaccgaggcggagctgacccgggtgcaccgccccgactatctggacgcggtccggcaggcgccgatcgatccgttcttcgccggctggggtctgaacactccggacaaccccgtcttcgacggcatgcacgagtcttcggcgcggatctgcggtgcgagtgtcgcggcggtcgaggcggtctggcacggcgccgcccgccgcgcggtcaatgtggccggtggcctgcatcacgcgatgccggcgcgggcggccgggttctgtgtctacaacgatccggcggtggccatcgcctggctgctggaccacggcgcgcagcgggtggcctacgtggacgtcgacgtgcaccacggtgacggcgtgcagacgatgttctacgacgatccgcgggtgctcacggtgagcctgcacgagacgccgctggcgctgtttccggggaccggtttctgcgacgagacgggcggcccgggcgccgaggggaccgcggtgaacgtgccgctgccgcccggcaccggggacgccgcctggatgaaggcttttcacgcggtggtgccgtcggtggtccgggcgttcgcgccggagatcatcgtgagccagtgcggggcggacgcgcaccggctggacccgctcgccgacctgatgctgtcggtggactgccagcgcgcggcgtatctggccatgcgggagctggccgaggaggtctgcgacggccgctgggtggcgctcggcggcggtggctacgccctggtcgaggtggtgccgcgggcctggacccacctgctggcggtggtcaccggggagccgctggatccggcgacccggacgccgaagtcgtggcggagactggcggccgggcgcagtccaggggtggaggtgccggagacgatgggcgacagcgccctgatcagttcccgcgcctggtccccggcgaccgaggacgacccggtggaccgcgcgatcatggccacccgcctggccgtcttcccgctgcacggcctcgacccgtacgacccccgggactga

SEQ ID NO: 4130 - DNA, 777 bp, Actinoplanes utahensis
atggagcgcagcgcagacgtcctgctcgccgacggcaccgcggtgcacctgcggcagatccggccggccgacgcgccggcgatcgtggagttccactcccggatgagcgaccgcacccggtatctgcggtacttctcgccctatccgcggattccggaacgcgatctgcagcgcttcgtcaacgtcgaccaccgggaccgcgaggcgttcgtcacggtcgccgcggacggccggatcacctcggtgggccgctacgagcggctcggcccggattcgccggaggccgaggtggcgttcgtggtggaggacgcccagcagggccgggggatcggctcggtgctgctggagcatctggccgaggcggcccgggaccacgggatcacccggttcgtcgccgaggtgctcccggagaacggcggcatgctgcgggtcttcggcgattccggctattcggtgcagcggcggtacgccgacggcgtggtgcacctgggtttcccgatcgcgcccaccgagaagtcgcgcgaggtgcaggagtcccgggagcatctgaccgagtcccggtcgatcgcccggctgatcgccccgcgcgggatcgccatctacggcgcgagcgccagcgggcacgggatcggcgccgcgatgctgggcaatctgcgcgacggcgggttcaccggcgcggtcgtcccggtgcatccgacggcgcccacggtggccgggctgaccgcgtaccggaaagcgtcggaggccggcgcaccgatcgacctggcggtgatctag

SEQ ID NO: 4131 - DNA, 1707 bp, Actinoplanes utahensis
gtggtcggcagcgccgggttcgccgaggccgggccggacggcgcggcccggcagcgggcgctgatcgagaccgcgcacgcggccggcctgcgggtgatcggcccgagcagtttcgggctggccaacaccgatccggcggtccggctgaacgcgaccatggcgccccggctgccggccgccggtcgggtcggcttcttcgcccagagcggtgcgctcggggtggcgctgctggccgaggcggatcggcgcgggctgggcctgtcgagtttcgtctcggccggcaaccgcgccgacgtgtccggcaacgatctgctgcagtactggcgggacgatccgggcaccgacgtggtgctgctctatctggagacgttcggcaacccgcgcaagttcgcccggctggcgcgccggatgagccgggagaaaccggtggtcgcggtggcctcggcgacccgtccgccgggtctggccggcgatctgccggggccggacgcgcacgcggtgaccgcgctgttcgcccggtccggggtgattcgggtggacaccgtgcaggagcttttcgacgtcggcatgctgctggcccatcagccgttgccggccgggcgccgggtggccgtggtcggcaactcgtcggcgctggcggcgctggccgaggtggcctgccgggcggccgggctgaccgtggccgagggctatccacacgatctgagcccgatggcgaccgcgcaggacctggccgacgcgctggccgacgcggcggtcgacgaccgggtggacgcgctggtggtggttttcgcgccgctggtgcccggccagcagctgtctgaggaggacgcggatttcgcggcggcgctgggcagtgtggcgctggccggggagaaaccgacggtggcgacgctggtcttcggccgggtgccgccgcgggttccggtctatccgtcggtcgaggaggcggtccgggcgctgacccgggtggtcaactacgccgagtggctgcgccgcccgccggggcggatgcccgcgctgtccgggctggatccggccgccgcggaggccgccgagagcacgacggagctgctcgccgcgtacggcgtcgaggtggtgccgtcgaccctggcgggttccgagcgggaggcggtcgccgccgcggacgcgctgggctatccggtcgcgctcaaggcggccggtggcggcttgcggcaccggatcgacctcggcgcggtccgcttggccattcaggatgaggatgacctgtgtacgtcgtatcgcgacctcgccgcggccttcggcccggaggtgctggtgcagaccatggtcgccccgggcgtcgcctgcgtcgtcgaggtggtcgaggacccggcgttcggcccggtggtcggtttcggtctcggcggggtggccagcgagctgctcggcgacctggcctggcgggccgccccgctgaccgaccgggccgcggaggcgctggtcgacgagccgcgcgcggccccgctgctgcacggttaccgggggtccaccccggtcgaccgggccgctctgatcgacctgttgttgcgggtcggccggctcgccgacgagcgcccgcggatccggtcgttgctgctcaacccggtgctggcccggccggacggcttctccgtgctgcacgccgcggcggaatggggcgagcccggcgtccgtccggacaccgggccgcgccgcctgcggtga

SEQ ID NO: 4132 - DNA, 1098 bp, Actinoplanes utahensis
atgccacctggacgctggcctcacctccgcttaacgcgcgggcgacgaagcttctggtcaccggcacggatgcggctggtaggcacgacgaacggggaggggactcaagtggtcctggagacgaaggcgacggttgaggacatcatgaccgacgaagtcgagcaggtggtcgacctcgacgcgacggacgagcggggcgtctccgccgacctggtccgcgcctacctcaacggcatcggccgcacccgcctgctgaccgcggtggaggaggtcaccctctccaagcggatcgaggccggcctctacgccgaggagaagctgccggccgcggacgccgcgctggccgagctgctggacatcgtgatcgccgagggccgggccgccaagaaccacctgctggaggcgaacctgcggctcgtggtcagcatcgccaagcgctacaccggacgcggcatggcgttcctggacctgatccaggagggcaacctcggcctgatccgcgccgtcgagaagttcgactacaccaagggctacaagttctcgacctacgcgacgtggtggatccggcaggcgatcacccgcgcgatggccgaccaggcccgcaccatccgcatcccggtgcacatggtcgagcaggtcaaccggatggtccgggcccgccgcgacctgtccgcccagctcggccgcgagcccagcatcgccgagatcgccaccgcgatggcggtgccggaattccaggtcatcgaactcatctcgtacgaccgtgagccggtcagcctcgaccaggcggtcggtgaggacggcgagagcgcgctcggtgacttcgtcgccgcggtcgacccgaaccagcccggcgagggcgtctcgcagggcgagttgcgcagcgaggtggagatcgtgctggccaccctctccgagcgagagtccgcggtgatccggctgcgcttcggcctggacgacggccgccagcgcaccctcgacgaggtcggccgcgaattcggcctcagccgcgagcggatccgccagatcgagaaggtgaccatgctgaagctgcgcgacccggaacgggcctcccgcctcgaggcctacgcggtctga

SEQ ID NO: 4133 - DNA, 786 bp, Actinoplanes utahensis
gtggtcttccggaggatgttgcaggcactcggggtgggcgggccgtccgtcgacaccgtgctgaccgatccgaactgctttcccggcggcttcctggcgggaaacgtccacatcgccggcggtgaccacgcggtcgacgtggagtacgtcgcggtcggcctgatgacccgggtcgaggtggagaccggcgacaacgagtaccagaccaatcaggagttccaccggcagcggctgaccggttcgttccggctggagccgggcgcccggcacgacgtgccgttccgcttcgaggtgccctggcagaccccgatcaccgagctgtacggccagcatctgcacggcatgacgatgggcctggcgaccgagctggaggtggcccgggcggtggacaagtccgacctggacgcggtgcaggtgcacccgctacccgcccaggaacggatcctggaggccctgctgcggctgggtttccgcttccacaaggccgacgtggaacggggccgggtctacggggtcgagcaggagctgccgttctaccaggagatcgagttccacccgccggcgcagtacgcgtccgggatcaatcagctggagctgaccttcctgcccacgccccggcgtctgcaggtggtgctggagctggacaagcgcggtggcctgttcaccgaggggcacgacgccttcggcagcttcgacgtcgactacgccaccgtggaccgggtggactggaccgcgcagctcgacgactggctgcggcagtccgcccgccgccgcgggttgttctag

SEQ ID NO: 4134 - DNA, 423 bp, Actinoplanes utahensis
atgcgggcgttggtgcagacggtgagccgggcgagcgtcacggtcgacgacgagatcgtcggatcgatcaccgacgggctgctggtgctgctcggcgtcacccacgacgacaccccggcgaaagccgccgacctggcccgcaagacctgggagctgcgcatcctggacggcgaccggtcggccgccgacgagaacgcgccgctgctggtggtgagccagttcacgttgtacggcgacgcgcgcaggggtcgccggccgagctggatcgcggccgccccggccgaggtggccgagccgctggtcgtcgcctacgcggaggcgctgcgcgcccggggagcgacggtggagaccggccgcttccgggcgcacatgctggtcgagagtgtgaacgtcggaccgcgcacgatcctgctggagctctag

SEQ ID NO: 4135 - DNA, 483 bp, Actinoplanes utahensis
gtgattctcccgtctgagtccggtcggtccggcgcacgacagcgcacgaaaccaggtccacctcgatcgcagagcgcaacgcccggcccggtcaccgggctagacaccgcccccgaccaggcaaatcctggcatcgatcagcggagcaccgccgagctattgagccactccgatccaacggacggacgtttgccgggtcccgcctggggcattcccggcccgaccatcacggaggtgcacatgagcagcgaagattccgacctgtccagcacggtcccggccggcaccgatccggaggaactgcgcaacggcggcccgtcgaccggcgggctgatgaccaccaccggcggcacggcgggaccggcgagtttcccgaaccggccgcgcaccggacccggcgtggcgccgaccaccaccggcgacgccaccaccggggcgctgcggaccccggccgacgagtacaccagcgaccaggccggctga

SEQ ID NO: 4136 - DNA, 1941 bp, Actinoplanes utahensis
atgcccctcaccagcaccaccggagggcggacgaccgaagccccgcgggccgcccgtccggcgcccgccaccactgccagccgcaccgcccgggcaccggacggcgacgccaatcggcgacaggcccgttcggtggccaaacaacagcaggcggccgagcggatcgcggcggcgaccgccgagatctccgcccagaacgccgaggccgcggaggcttcacggcagctcaccgactcgatgcagcagatcgcggcgggggccgaagaggcttccggcgcgacgcagcagagcctggccgcgatgaaccagatcgaggaccgggtcaaccggcaggagtcgaccacccgccaggtcgccgacctgagccaggccctgcaggtgctgctcaacgagacccggtccgggatcgtcgggctgctcaccaacgtcgagagcgcctcggcccggcagaccgagtccgtcgtcaccatctccgagctggagaagcaggctgacgagatcggtgagatcgtcaagacggtggcgcacatcgccgaccagacgaacctgctcgcgctgaatgcggcgatcgaggcggcccgggcccggcagcacggcaagggcttcgcggtggtcgccgacgaggtgcgcaccctggccgagaccagtgagcgcagcgcccggcagatccgcgacctgatcgacgaggtgcgcaactcggtcaccgagatcgccggcgcggtgcagacctccgccgagacggcccggggcgaggcggagaagggcaagtcgatcacctcgcagctggagaccatccgggccgacatgggcacgatcatggccggcgcgaccgagatggcggccgcggctgagcaggccaagcggtccgcgggcagtgccaagcagcggtccgaggagatcgcggcggcggccgagcagcagtcggcggcctgtgaggagtcgttgcagacggtcggtcagcagacccaggcgctgcggcagagtgagcaggcggccgaggcgctcgccgaggtctccgagacgctgcgcagcagcaccgacatcgccaagagcgccgaggacgtggcgtcggccgccgaggagctctccgcggcggtcgaggagatcaaccgcgcggccaaccagatcaacgtggcgatcaaggagatcaacactggggcccggaccgcggcggagaagggcgagcagacctcggtgctggtcacccagatcgagcagggtgcccagctctccgccgatcgcggtggcgccgcggtggaacgctcggacaccattctggagatgctcgccgccaacaaggaggcggtcgactcgatgatcgacgcgatcggccgggccgcccgcgagggcatcgagaacgtccggaaggtcaccgagctggagcagatctcccgccggatcgacaagatcgtcgacgccatcgcgaacgtctcgatccagaccaacatgctcgccgtcaacggctcggtcgagtcggcccgggccggcgagttcggcaagggcttcgcggtggtctccaccgacatccggaacctggcccgggactcggccgacaacgcggaccggatcaaggacctggtcaaggcggtgcaggaccggatcgtcgaggtccgcggcgacctggaggagaccagccggatgtcgctggccgaggtggagacggcgaaggccaccaccgcccggctggacgagatcgagcgggacatgcagcaggtccgcggcggcaacctggaggtccgcgagggcgccgagcagatcgccaaggtgctcggcgaggtgaagatcggtctggagcagatctccgcctcggcgaaccaggccgaacaactggccgggcaggcctccaccgcggcccgggagcaggcgcagggggccgaggagctcgcggccgcggtcgaggagatcgccgcgctcgccgacgagctgcagaacgccggctga

SEQ ID NO: 4137 - DNA, 1557 bp, Actinoplanes utahensis
atgagcgtcgacatggacgaggacgcggacctcggcgaggacaccgcggactacgtcaccttcgacatggtgggggagcggtacgccttcccgatgcgccgggtccaggagatcatccggatgccctcggtggtgaaggtgccgctcgggccgccgtccctggagggtctggccaacctgcgcggccgggtgctgccggtggtcaacctgcggcagtgctgctcgatggagcaggccgagcacgacgagacgacccgggtgatcgtggtcgacggcggcgtgccgctgggcttcgtggtggaccgggtggccagcgtgatcagcatcgatccgcaggacctggagccgggcgaggcggtgcaggccacggtccgctcggacgtgctggtcggggtgatcaagtcggacggcggggagatgaccacggtcctcgacgtcgaccggctgatcggcagccagttcgcccggctcgcggagaagcgcggccccggtggccgggagtcggtgacccgggtgtccggtgaggccgatccggatgccgatctggacgacactctggagctggtcagtttcgcggtcgagggccaggagtacgcgctgccgatcgaccaggtgcaggagatcgtccaggcgccggagtcggtcagccacgtcccgaacgccggcagccgggtgctcggtgtgatcgacctgcgcggccggctgctgccggtggtcagcatgcggcgggtcttcggcctgccggtcaccccgctggagccgcagaaccggatcgtcgtggtctccctcgacgacggcgtggtcggcgtggtgatggacaccgtgcgcgaggtgctgcgggtgccgcaccagctggtggcgccgctgcccggggtggtggccggggagggccgcaagaccgaggtggagtcggtggtccggctggaggacggcaaacggctggtctcggtgctgagcgtgaaccggatgttcgactcacccgaggtgcgtgacgagatcgccggatatcgggaggacgacgaggagatgaccgccgaacgggccagcgaggccgacgacggccgtggcgacgaggagctgttcgtcgtcttccggctcgacgatgaggagtacgcggtcgacgtcgacgccgtgcaggagatcatccgggtgccggaggcgctgatccgggtgcccaagtccttcagtttcgtggaggggctggtcaacctgcgcggcaccgtgctgccggtggtcgacctgcggacccggctgggcctggagcgcaccgagcgcgacgagcggcagcggatcgtggtgctgatcatcggcggggtgcggaccggcttcatcgtcgactcggtggccgaggtggcccgggtcgggcgcaacgtgctggagccggctccggaactctccgaggagcaggcgcgcgtggtctcgcgggtggccaacctgccggaccagcagcggatgctgctgctcgtgcaggtcgatcagctgctggcggccgagcaggcggcggtggcggccgagttgtgcgaggacgtcgtgtccgaggcactcgccggggtctag

SEQ ID NO: 4138 - DNA, 1038 bp, Actinoplanes utahensis
atgccaacttcggtcctggtcgtcgacgactcggcgctgatgcgccgggcgctcaagggcatgctggcggaggccggcgacttcgaggtgcacaccgcccgcaacggggtggacgcgctggaacagttggagcgcgtccacccggacgtggtcaccctcgacgtcaacatgccggagatggacgggctcacctgcctggcccagatcatggagaagcagcccaccccggtggtgatggtctcctcgctgaccgatcacaacgccctggtcaccctggaggcgttgcagctgggcgcggtcgactacgtgcccaagccgggcggcacggtgtcgctcaacatcgatgaggtcgccaccgagctggtgcagaaggtgcgcggcgcggcccgggcgaagctgaagcgcgccaccggtctgaagagccggatccgggccacgccggccccgctggagacccggccggccgccgtcgacctggtgctgatcggctcctcgaccggtggcccggcgctgctctccgacctgctgccacaactgcccggcacgctgagcgccccggtggtggtggctcagcacatcccggcctcgttcaccgcggcgctggcccggcggctggatgagacctgcgcgctgcgggtgcacgaggtggaccggatcatgacagtccggcccggcaacatctacatcggccggggcggtgccgacgtggtggtcgcgcgccgcaccgacggcctgatcgtgaagtcggccccggccgccgccgagtaccgctggcatcccagtgtggaccggctggtggcgtcggcacaccgctacctggacccggcgcggctggtctgcgtgctgctcaccgggatgggtgacgacggcgccaaggagatggccgcggtccgtgccggcggcggccggaccatcgccgaggccgaggagaccgcggtggtctgggggatgcccggcgaactggccgccaacggcggcgcgaccgaggtgctcccgtcgtacgagatcgccgaccggctggccgactgggtgcgctga

SEQ ID NO: 4139 - DNA, 615 bp, Actinoplanes utahensis
atgggactggtcaagaagccggctgccgcgccggaaccaccaccgagcctcggcccggacgacctgatcgcgctcctcgatcaccccgacccggagcgccgccgggaggccgccttggacctggccggggtgcccgaggcggtgcccgggctgctggcccgggccggcctggagaccgagccgcgggtccgcgacgcggtgctgaccaccctggccgggcacgacacggaggcggtcgcggccggtctggcggtgcacctggccagcgacgacgccggactgcggaccgcggtggcggaggcgctggccaccatgccgggctcggtcccggcgctgttgcccgacctgctcgcggcgcccgaccacgacgtgcgggtgatgaccgcgatggtgctggccgacctgcccgacccggaggcccgcacctggctggtccggatgatcaccgacgacccgcacccgaacgtggtcaccgccgcgatcgacgcgctgctgcccggggccggtcccgagcacgccgcggtgctggaggccgccgcccagcggttcccggacgacccgttcctgatcttcacggtccgggcggcgctgccccggctgaccggtacggcctga

SEQ ID NO: 4140 - DNA, 870 bp, Actinoplanes utahensis
atggcggccgcggcaccctcgggcaccggactttccgacgccgagttcgaccggttcaccgaatacttctacaagcgcaccggcatccacttcaccccgggcaagcggtacttcgtcgacaagcgggtggagacctgcatccgcagttcgccgttcgacacgttcgcgagctggttcgccgccctgcggatggaccggccggacatgctgcaggaactgatcaaccagctcaccgtcaacgagacgtacttcctgcgcgaggactaccagttcgacgcgatgctcagcacggtgctgccgaagaccctggccgcgcgcggcgggccgggccggatgtccggaccggtcaagatcctctcgctgccctgctcgaccggcgaggagccgtactcgatcgcgctgcgcctgctggaggagtgggaccagatcgaccatgtggacgtggagatccacggggccgacatcgacagcgaggtgctggccaaggcggcgcacgccagttacggcgaacgctccctgcagcgggtgccgaaagcctgggtgaacaagtacttcacctcggtcgggtccggccgcttccaggtggacgagggcatccggagcgcggtcacgctgcaccggatgaacgtctgcgacaccgccgcgatgaaggcgttccgggacttcgacgtgatcttctgccgcaacgtgctgatctatttcgacgagctgtccagtcgccgggccgccgagaacctgtacggggcgctgcgcccgggcggctacctcttcctcgggcactccgagtcgatgagccggatctcgccgatcttcaccccgacccgcctgccggagggcatcgtctaccagcgaccgaccggagcgaagtga

SEQ ID NO: 4141 - DNA, 381 bp, Actinoplanes utahensis
atgacccgggttcttgtagtggatgacgccgccaccgtgcggctctatcacaccagcctgctgcgcgacgccgggttcgaggtggccgaggcggcgaacgggctggaggccgtcgaggcggccatgaccacgccgttcgacctgttcctggtggacgtgaacatgccgaagatgaacggctacacgtgcatcgagacgctgcggtcggagaccgtcggcacggccgccccgatcctcatgatcagcaccgaggaccggcccggcgacgcggaccgcgcgtatcaggccggagcgaatctctacctggtcaagccggtcccggccgatcgcctgatccgggtcgccacgatgctcacctccggaaaggacccggaggcatga

SEQ ID NO: 4142 - DNA, 1026 bp, Actinoplanes utahensis
atgaacccgctgctgtcccagttcctcgccgaggcgaacgatctgctcgcctcggtcgacgacggtctgctccagctggaacgcaaccccggcgatcccgagctggtcaacgaggtgttccgggccgcgcacacgttcaagggctcgtccgggctgttcgacttccccgagctgacccggctcacccacgccgccgaggacctgctggacgcggtccgcggcggccggctcgcgctcgactcgggaatggccgacgacctgctggccgccttcgacctgatccgcggctggctggcccacgtcaccgcgcacgagcggctgccggccaccgccggccaggacgccgccgggctgatcacgaagctgcgggcgccgctcggcggcgagccttcggccgccgatcaggagccgatcgccgcggtacgacacgtcgacgccgctccggactggctggccgagctcggcaccgagtggttgatcgagaccgccacctggctcaacaccacgtcgtccaccctgcggttcctgcgctatctgcccgaccaggactgcttcttccgcgccgaggacccgctgcatctggtccggcagatcccgggcctggaccggatggtcgtggtcccgccggccacctggcccgccgtcgccgagtacgacgaatacgcctgcctcctctccttcgtggtggccacccgggcctcgtacggcgaactgcaccatcttttccgttacgttcccgatcaggtcagctacgtcgagctggacgccgccgcgatcaaccggcacctggagggcgaggacgccgaggagatcaccccgccgccggtccccgagccactcaacatcgaccccggcctggccgccgacgcccgcgcggtgctcaccgccgcgcaccgcaccctggccgtcggcgaaccggccggcacccagctggtcgccctgaccgcgtcggtcaccgcggcggcccgggcgctgggcgtcccgctcgatctgaccggcgccgacgccgaagcggtcaacgcctag

SEQ ID NO: 4143 - DNA, 1275 bp, Actinoplanes utahensis
gtgatcgccgcgctggccgctccgccggcgccggtgccggccgccgaaccggccggccgggccgacgaccccggcggtcaggtcggcacccgggtgctcaaggtcgaccaggagaaggtggaccggctgatggagctggtcggcgagctgaacgtggccaagaacgggctcaccttcctggccgccgcggccgaggaggagttcggcagtcgagcgctcagccgccggatcaaggaccagtacgccgggctgcaccggatcgccgaggagctgcaggccgccgtgatggacgtccggatgctgccgctctcggtcgccttcggccgcttcccccggctggtccgggacctgagccggcggctcggcaagaccatcgaactggtcaccgagggcgacgagacgatggccgacaaggacgtcatcgaggcgctcggcgacccgctggtgcacctggtccgcaacagcctcgaccacggcatcgagaccaccgaggagcggatcgcggccggcaagcccggcaccgcccggctcaccctggccgcggtcgccgacggggacgcggtgctggtcgaggtctccgacgacgggcgcggggtcaacccggcgcgggtcaagcagaaggcgtacgaaaaggggctgatctccgaggaggagctggagtcgctcagcgacagcgaggccgtcgatctggtcttccgccccggcttctccaccgccgaccagatctccgacctgtccgggcgcggggtcgggatggacgccgtccgggccagcgtcgagaaactcggcggcagcgtcaccatgcgctccgagctgggcaccggcaccaccacccggctgcggctgccgctgtccatggcggtcacccaggtgatggtggtcagcgtggccgggcagcgcttcggtgtcccggtcgacctggtggtggagacggtccgggtgccggccgccgagatgggccgggtgctgcaccaggacgtggtggtgatgcgcggcgaggtggttccggtgatcgacctggcccgggcgttgcagatgccctgggcggcggatccggaccgggaccgcgcggtgctgatcgtctcggtcaacggtcagcgggtcggcctgctggtcgaacagttccaccgggaggtcgacgtgatcctcaaaccgatggagggtctgctcgcctacgccgacgagttctccggcaccgcgctgctcggcgacggcctggtgctgctggtgctcaacctcaaggaggtgctcggccttgccgctcgagctgcatga

SEQ ID NO: 4144 - DNA, 276 bp, Actinoplanes utahensis
ttgccgctcgagctgcatgacgagaacgccaccctgatcggcgtggtcaccgtcgacgaggtggaacaactggtcggctggctgcgctcgtgccagcggccccgggtcagcctgcgccgttgcaaccatctgcacaccggcgcactccaggccctgctgcttttccggccgaagatttcagcagcaccgaaagacgccttcctgacgtcccaggtgctgccgctgctcaccgggagcaacggcgacaccggccgacaggggaccgaaccgccatga

SEQ ID NO: 4145 - DNA, 372 bp, Actinoplanes utahensis
atgaccaccgtgatgctcgtcgacgactccgccaccatgctgatgagcctcaagtcgatcctgaccaaggccggatactcggtcgagacggccgggcacggcaaggaggcgctcgacaagctcggcaagggcgtcaagcccaacctgatcatcagcgacgtgaacatgccgcagatggacgggatcaccttcgcccgtgaggcccggaaggctccgggtatgcggttcaccccgatcctcatgctgaccaccgagtcggatcaggccaagcgggtcgaggcgaagaacgccggcgcgaccggctggctggtcaagccggtcggaccggaccagctgctgggcgtgatcaagcaggtgctgcccggggcctga

SEQ ID NO: 4146 - DNA, 1047 bp, Actinoplanes utahensis
atgcctagccttctccgcaggctcacgctcgccccggaacagccggaggagcagggcgtttccggggatgtcgtggccgaggcgctggagccgatcccggcgtactgcgatgtgatcgacggccacgtcaaggacgtcatcgagcagaccggtgaggccgcacacgcgatcgtccagcagatggtgaagatcgactcgttggcggaggtgatggccggcgacgtcgcccagctcgccggcaccctcagccgcaccgaacgggagctgtcccaggtcagctcctccaacgaccagctggtcagccggctgatcgcctacttcctgcaccgcgaccaccagatccgggcgctcgtcgagcagatgcgtgagctcaaccagcacgtcacccagatcgaggaggtcagccgggccaccaacatcctcgcgctgaacgcgatgatcgaggcggtccgggccggcgacgccggcgaaggcttctcggtcgtcgccgacgaggtgcgcaaactggcgcaccgctcgtccgaggcggcgcacggcatcggcagcagcatcggcgacctgaccgcgaaactcgacgcggtactctccgacgacacccagttcgatcgggccgcggagatgccaccggtcaaggaggagaccgcgatgacccgccggctgggcggcatcgccaacgctcagcgggagatgtccgagatggtctccggcatcctgcgggacaccgtcgtcgccgcccgccaggtgcagaccagctcgaacgcgctgacctcggagaccaccggggcggtggggcacgtgcagttccaggacatcagtcggcagatgttggagcatgttgcggaggcggtcgccgacgtgcgcgggcaggccgagtcggtggccgggtacgcccagggccgggtcaccgccgacgaggtccgggacggggccatcaacgtggaggacctccgctcgaaacacgtgatggcccggcagcggttcacccatgccgcgcagaccggtgaggacgcctcagccgggaccgaaccgttgatcgaactgttctga

SEQ ID NO: 4147 - DNA, 672 bp, Actinoplanes utahensis
gtggagcctcgccgtgcagtcgctcggcctgcagcgaccggtgtccagtccggccgacctccggcgggtggccgaacacgtgatggaggtcggcgagctgagccgggtggccgggcgctcgctcaaggtccggctgatcacgtacgaggcgctggcccggacggtccagtcgtgaccgcgcggcaccccgaccggatccgcgacctggcccgcctcggtctcgaccgggaggaacaccgcggctacctgggcgagctggtcaaaaccgtggccgaccgcctgcagaccccgttcgcactggccgacgccctactcaacgacgcgcaggtgttcctggccggcaccggcccggtgccggactggatcggcgaatccggcggcaccccgctggagtgggcgttctgcacccgcttcctcaccaccagcgccccgttcaccgtcggcgacttcaccgaggacccggaacaccgggacaacccgctggtgcgcatcgagggggtccgctcctatgtcggtgccccgctgatctcctcgaccgggcacgtcctcggcggcctgtgcgcgctggacgtgcgcccgcgccacttcaccgaggacgacatgcgatatctcagcgggatggccgccgaaaccgtccgccgcatcgaggaccacgccggccgggccgcctga

SEQ ID NO: 4148 - DNA, 585 bp, Actinoplanes utahensis
atgtaccgcatgacgttttcgctgcccatcccggccgaggccaacgcgctgctggaccggagtccgctggccgtgctgctggggctggtgctggaccagcagatcaccatggagaaggcgttcacctcgccgctggtgctggcgcagcggctcgggcacgagcccaccgcgaccgagatcgccgacttcgatccggaggcgctggtggagatcttcgcgactccgccggcgctgcaccggttcccgaaagcgatggcggcccgggcccaggaggtgtgccgggtgatcgccgatcgctacgcgggggacgtcgaggcgctctggcgggacgcgtcgagcggggccgagctgtaccagcggatcttcgcgctgcccgggttcgggaagcagaaggcgcagatcttcgtcgcgctgctgggcaaacaggtcggggtgcagccgtcggggtggcgggcggcggccggtgggtacggcgaggagggcgcctaccggtcggtggcggacatcgtcgacgatgaatcgctggcccgggtgcgggagaacaagaaggcggccaaggcggaggccagggcggccaagggctga

SEQ ID NO: 4149 - DNA, 372 bp, Actinoplanes utahensis
gtgaagaagcagccctcggtcctgatcacggatgccgcgcggagccctggcgatcagttgcgcagccgcgaggtccggtacgtgttgatgatgggcacccgggtgggctgcctgatcctcggtggggtgctggtcagcgtgcggccgccgctgctcgccctgtggctggtgctgtgcctggccggcatggtgttcctgccgtgggccgcggtgctgatcgccaacgaccggccgccgaagaccaaggcggaacgggccgcggacgccgccgcccgggaacggcagcagatggcgttgaccgaggtcgtgcccgaggagcgggagccggtcacgatcgactccgagatcatcgaatcggacaaaaagctttaa

SEQ ID NO: 4150 - DNA, 897 bp, Actinoplanes utahensis
gtgccccgggtgatcgtcgtcggtgacctggtcaccgacgtgctggtggagcatgacggcccgatccggccgggctcggacacggccgccgcgatccgggtcagcggcggcggccaggccgccaacacggcggcctggctggcccgggccgggcaggccacgacgctggtcgccgcggtcggtgccgaccaggccggccgggaccgggtcgccgagctggtcgcggccggggtcggcgacgcggtgcgggtgctgccgggtgcggcgaccggcagcgtggtggtgctgaccggcgcgtcggaacgcaccatgatcaccgatcggggcgcgtgcctgctgctcgatccggcgcacgtgaccgccgcgctgcgggccgccgcgccgggcgaccatctgcacctgtccggctatccgctgctgcacgccgggtcccgcccggcgggcctggcggccctcgcggccgcgaggcagcagggcctcacggtgagcgtcgacgcggcgtccgccgcaccgttgcgggacgcgggtgcgtccgctttcctgacctgggtacgcgacgccgacctcctgctgtgcaacgcggacgaggcggacgtgctggccggccccgcccccgccgcggcacaggccacgcggctgaccgcgaccgtccgccatgcggtcgtcaagcagggcccggccggggcggtctgggccacccgcgacggttccgcatggtccgctccgggcctcagcgtgccggtcaaggaccccacgggcgcgggtgacgccttcgccgccggcctgctgacatcctggctcaacgacggctcgccgccggccgccctgcaagccggcgccgccctcggagcagccgctgtccaactcctcggcgcccgccccgatccctcccgatga

SEQ ID NO: 4151 - DNA, 960 bp, Actinoplanes utahensis
gtgggcaccgtgactgacttcgctattcgcttcggcgagcacgtgatccgtgcccgccgcgacggccgcccggtggtggccctggagagcacgatcatctcgcacgggctgccgcacccggacaacctgcgagtggcccgggagatcgagcagaccgtccgggacaacggggcggtgccggccaccatcggcatgatcggcggcgagctgatcgccggcctcgacgacgcccagatcgagcacctggcgctcgccggagacgtggccaagctgtccgtgcgcgacctggcgatcgccgccgcgcaccgggccgacggagccaccacggtcgccgccaccagcgcggtcgcggccgcggccgggatcggcgtgttcgccaccggcggcctgggcggggtgcaccgggaggcgaacctcaccttcgacgagtccgccgacctgaccgcgctggcccgcaccccgatcgtggtggtctgcgccggcgtgaagtcgatcctcgacgtgggcgccaccctggagcggctggagacgctgggcgtgtcggtggccggctacggcacccggcgtttccccggcttcttcatcaccgacggcggcttcgacgtcgactggcagctggactcgccggagcaggtcgccgacttcatccgggcccgccgcgaccaggacgtcaccaccggcgcgctggtgctggccaatccgctgcccaccgacgagcagctggacccggagctgcacgaccgcaccctggcgagcggcctggcggcgctggccgagcagggcgtcaccggcaaggcggtcaccccgttcctgctggcgcacttccactccagcaccgacgggcagagcctgaccaccaacgtccggatcatcctgcgcaacgccgcgctggcggcccggatcgcggtcgccgagagcgccgggaccgccgcgccgctcggcttctccgttccggcctga

SEQ ID NO: 4152 - DNA, 219 bp, Actinoplanes utahensis
gtgagcacccagatcctcgagcgtccggagaccaaggacgccgacaccggtccggagatgttccactacgtgcgcaaagagaagatcgcggagagtgccgtgatgggcacctacgtggtcgcgctgtgcggggagaccttcccggtcaccaaggtgccgaagaagggctccccggtctgtccgcagtgcaaggagatctacgaagccatgaaggcctga

SEQ ID NO: 4153 - DNA, 615 bp, Actinoplanes utahensis
gtggcgagcggatacggactgctcgtcgcggatctgatcggggtggcggtgttcgccgcctccggggcctcggccggcgtcgcgaaacgcctcgacctgttcggggtggcgttcgtcggtttcgcgtccgccctgggcggcgggatcctgcgcgacctgacgatcggcgcggtccccccgctggcgttcgccgactggcggtacgcggtgaccgcggtgctcgcctcggtcgcggtgttctggctgcaccctcggctgcaccgggtgcggcggacggtgctggtcctggacgccgccggcctcggactgttcaccgcgaccggcacactgaaagcgctcaccgccggggtgccaccggtcggcgcctgcctgctcggcatgctgaccgcgatcggcggcgggctgacccgcgacctgctcaccggtgagatcccggtcgtgctgcaacgcgacatctatgccagcgtcgccttgggcggcgcgatcctcgtcaccggaatgcagcggctcggccacaccggtccggtgccgctggccggcgccgcggccctgatgaccggggtacggctgctcgcgctctaccgacgctggtcggcgccggtcgcggtgccgtga

SEQ ID NO: 4154 - DNA, 1731 bp, Actinoplanes utahensis
ttgagcccgtctctgccgaatctggagatcttcccgccgttgcgggcctggcagcgcaaggcgatggtggaatatcttcgccgccgttccgaggacttcatggccgtggcgacgcccggcgccggcaagaccacgttcgccctgcggctggccgccgagatgctggtcgacggcaccgtcgacgcggtcaccgtggtctgcccgaccgagcacctgaagtcgcagtgggcgcaggcggcggcccgggtcggcatccagctcgacccgcgattccgcaactcggagatccactcgtcgcgggacttccacggggcggtggtcacctacgcccaggtcgggatggcgccgcaggtgcacaagcggcgcaccatcacccggcgcaccttcgtcatcctcgacgagatccaccacgccggcgactcgcgcagctggggtgacggggtcaaggacgcgttcgagccggccgcccggcggctgctgctcaccggcaccccgttccgctcggacgagaacccgatcccgttcgtgcagtacgagcgcggcatggacggcatccagcgctccaaggccgactcggtgtacggctacggcgacgcgctgcgcgaccgggtcgtgcggccggtgatgttcatggcgtactccggggagacccgctggcgcaccaatgccggtgacgagctggccgccaagctgggcgagccgatgaccaaggatctgatcgcccaggcctggcggaccgccctggaccaccgcggcgagtggatgccgcaggtcatgcaggccgcgcacaaccggctgctgcgggtccgggagggcatgccggacgccggtggcctggtcatcgccagcgaccagacggcggcccgggcgtacgcgaagctgctgcacgacctgaccggcgaggcgcccaccgtggtgctctccgacgacgacggcgcctccggccggatcgccgagttcgccgcctcgcagaagctgtggatggtcgcggtccggatggtgtccgagggcgtcgacatcccgcggctcgccgtcggcgtctacgccaccagcgcgtccaccccgctctacttcgcgcaggcgatcggccggttcgtccggtcccggcagcccggcgagaccgccaccgtcttcctgcccagcgtcccgcacctgctcggactggccagcgagatggaggcggaacgcaaccacgtgctcggcgcgcccaaggagaaagacgggctggacgacgagctgctggaacgggcgcagaagtccgaggacgccatcggcgacctggagaaacagttcgaggcgctgtccgcgaccgccgagctgcaggaggtcatctacgacggcacgtcgttcggcgtgccggcccgcaccgggaccgccgaggaggccgactatctcggcctgcccggcctgctcaccccggacgaggtgaccatgctgctgaacaagcggcagaccgagcagctggccgtgcagaaacgccacgagcaggaagcggcgaggaacgcgccggagccggccccgcgcgaggcggtcgtgccgatgagcgccggcgagcgccgggccaccctgcgccgccagctgaacaccctggtcgcggcgcaccaccaccgcaccaacctgccacacggcaagatccacgcggagttgcggcggctctgcggggggccgccgagcgcccaggccacgatcgagcagctggaggagcggatcgccacgatccagaccttctag

SEQ ID NO: 4155 - DNA, 1296 bp, Actinoplanes utahensis
atgcgggagaccacgcagcacgccgtacgcctgctggagcgggcgcagaccggcgacgccaccgcggcgctcgccgaggcggaaaccgtgctccgcagccctggcggcgacctcgcctgcatgcacttcgtccgggtggtgtgccggatcgcccagtccgacccggccggcgcgatcgccgcggtcggcccgatgctgtgcgccgccgagcgggagggcagccgcggctggcaggccgccggcctggccagccgcgcgtggcagcggctgcgcgccgcctcgaccggcgggatgaccgccgaccacgacaccgacgaggtgctccgcgacctggtcgccgccgagatgctggccgacggcgagcccgacccggtggccgcggtcaactcccgggtcgcggtcgccatcgggtggtacgagctgcggctgtacgagctggccgagccccagttcaccgtcgcgtaccggatgagcagtgcggacgccggccggaacggcaaccgggcgatgtggtcgctgaacctggccgagatgcacctgcgctgggcgctggagctgtaccagatccaccggccggccgaggccgagggccacagcgccgaagccgagcggtacgccatccgggcggccggcgaggtgtccggcgccgacgcggcctgctggcgggacaacgcgctgctctacgccgcctgcgcccgcgccgaccggcacgacccgggcggggccgcggccgacatcgtgcggtacaccgcgcgactgcgggaccgcggcttcccgaccgacgcgctggcgatcagccggcccttccacggggtggcgctgctgcgctccgggcggcccgccgacgccctcgcggtgatggccgaggcggccaccgggctgccgcccgacgcggactggctggtcgtcgccagcacccaccgcacccgggcggtcctgctggcccacctcggctcggcggacgccgcggccaccctggcctacggggacggcctggccgccgccctgtggcgccagcggctgaacacgctgcacgccgcccgtacccggtacgacctggaacagctgcgcgtccagcacgagcaggtcgcgaaggccgccgagatcgacccgctcaccggcatcgccaaccggcgcgccttcgaccaggcgctgcacgccgcgctgtcccggcccggcgacgctgccgtgctgctcatcgacaccgacaagttcaaggtgatcaacgacacgctgggccacgccgccggcgacgccgccctgcgcgccatcgcggccgcgctgctagctagctag

SEQ ID NO: 4156 - DNA, 267 bp, Actinoplanes utahensis
gtggcgcgcctgggcggcgacgagttcgcggcgctgctgccgggcgccggggcggcggaggcggccgcggtcgcccgccggatggtgcaggccgtccgcgacatcccggactgcctggccacggtcagcatcggcatcgccgtcggtccggctgccgccctgcacgacgtgctggaacaggccgacgaggccatgtaccgagccaaacaccgcggcggcgacggcaccgagacaaccttcaccccacagaaccgagccgccgcctga

SEQ ID NO: 4157 - DNA, 243 bp, Actinoplanes utahensis
atgaccccgactctcacgccgccagcgggaagcctggccggcacagcagccgatgaacggtgcgaccgctgcaatgcagccgggaagctccgtttgaccctggctggtggaggtgacctcgttttctgcggccaccacgccaaccgttacgccgaggatctggtgaagatcgcggtgcagttctccgccgatccggagttcacctggcgcggtgcgaacatgatgtcgaactccagcaactaa

SEQ ID NO: 4158 - DNA, 1548 bp, Actinoplanes utahensis
gtgacagaagcccaccagaacggtgccgacgttcgctctctcaccgaggccctgatcacccatgcccagggtgcgggcgggcagctcacttcggcccaggtcgcgcacacgctcgagtccgccgccgtcaacccggcacaggccaagaagattctgcgcggcctggtggacgccgggatcacggtcgtggtcgacggctcggccagcacccgccgcaaggtggccgccgcccgctccgccaccccggcgtcgaaggcgacgaccgccaagaccgccgccccggtgaagaaggccgcgcccgccccgaagcaggccgccgccccgtccaccgacccggcgaaggccacgccggccgcgcgcaaggcggccccggcgaagaaggccgcggtcaccgccaaggccgccccggcgaaagccgccaagcccggcgaggagggtcccgagggcgaggagatcgaccccgaggagctggccgccgagatcgaggacgtggtggtcgaggagccgcccgcgctcgtcgcggccgccgcgaccgacgccgccagttcggccaccgacggcgacttcgagtgggacgacgaggagtccgaggcgctcaagcaggcccgccgggacgccgagctgaccgcctcggccgactcggtccgcgcctacctcaagcagatcggcaaggttccgctgctcaacgcggagcaggaggtcgagctcgccaagcggatcgaggccggcctctacgccgccgagcggctgcgcgccgccgaggagggcgaggagacgctcgagcgcaacttcgagcgtgacctcaagtggatcaaccgggacggcgagcgggccaagaaccacctgctcgaggcgaacctgcggctcgtggtctcgctggccaagcgctacaccggccgcggcatggcgttcctggacctgatccaggagggcaacctcggcctgatccgcgccgtcgagaagttcgactacaccaagggctacaagttctcgacctacgcgacgtggtggatccggcaggcgatcacccgcgcgatggccgaccaggcccgcaccatccgcatcccggtgcacatggtcgaggtcatcaacaagctcggccgcatccagcgcgagctgctccaggacctgggccgtgagcccaccccggaggagctggccaaggaaatggacatcacgccggagaaggtgctggagatccagcagtacgcgcgtgagcccatctcgctggaccagacgatcggcgacgagggcgacagccagctcggcgacttcatcgaggactccgaggcggtcgtcgcggtcgacgcggtctccttctcgctgctgcaggaccagctccagcaggtgctgcagacgctctccgagcgggaggcgggcgtggtccggctgcggttcggcctgaccgacgggcagccgcggaccctggacgagatcggccaggtctacggcgtcacccgtgagcggatccggcagatcgagtcgaagacgatgtcgaagctgcggcacccgtcacggtcgcaggttctgcgcgactacctcgactag

SEQ ID NO: 4159 - DNA, 822 bp, Actinoplanes utahensis
gtgagcgagatttctccgggatcgacacccggcgagctgctggagatcgctgtccgggtggcccgggaggcggcggccacggcgagccggatgcgcggcgaggcgatcggcgacgtgcagaccaagagcaccgacacggacgtggtgaccgcggccgaccgggcggtcgagcggcaggtggtggcggcgctgcgggccgagcggccgggggacacggtgctcggcgaggagtacggcggggcggccggcgcggcgcccggcgcggtccgctggatcctcgacccgatcgacggcacggtcaactatctgtacgggctgccgcagtacgcggtctcgctggccgccgaggtcgacggcgaggtggtggccggcgtggtgcgcaacgcggcgaccggcgacgagtggaccgcgacccgcggcggcggcgcctggcgggacggccggcggatcagctgctccaccgagaccgtgctggggcaggcgctggtcggcaccggattcggctacgaccctcggcggcgggcccatcagggccgcgtcttcgcccagatgatcacccgtgtgcgggacatccggcgcctgggtgcggcatccttggacctctgcctcgcggccgagggcagactggacgcgttcttcgagaaaggtctcaatacgtgggatcacgcggccggtgggctgatcgcggcggaggccggcatggtcgtgtccggcctgggcggcgccccggccggtccggagatggtgctgctcgccccgccggcgctccatcccgccctgcacgacctgctggtggaggtggacgccgccggtgggccctag

SEQ ID NO: 4160 - DNA, 549 bp, Actinoplanes utahensis
atgagttttgcgcgcgtccgagcgctcgtcgtcgtcggcgtgctcgcggttgccgcgatcgtcttcgtgatcgtcgcgctggtgcgcgacgatcaggcggacatcgcggccggcggcaagtgtgccgccggcgctccggccgcggacattcacctgcccgacgacccggccgaggtgaccctgcagatcctcaacgggaccaaccgggccggcctggccgacagcgtctccaccgagttcaagaaccgccgcttcacggtcaaggacccgggcaagagcaagagcaagctcaagggcgtggcggagatccgcttcggccccgacacggtcggcaaggcgcagctggtcaaggcgtacttcctggctcaggcgaagatggtgtacagcgacaagcgcaagggcgagctgatcgaggtggtgatcggcagcgacttccagcagctggccaccaccaccgaggtcaaccagtcgctggtcgagatcggcgagccgaccctgccgccgggtgcctgcctcaagccggtcaccaagaagcccgagaacgactag

SEQ ID NO: 4161 - DNA, 297 bp, Actinoplanes utahensis
atggccaccgactacgacgccccgcgtcgcgatgaggtcgacctcggcgaggacagcctcgaggagctcaagtcccgccgcgccgactcccagtccggcgcggtggacgtggacgaggtcgaggtggcggaaagcttcgagctgcccggtgccgacctcgccgacgaggagctcaccgtcaaggtgctgccgatgcagaccgacgagttccgctgctcccgctgtttcctcgtgcaccaccgcagccagctggcgacggagcgcaacggggagctgatctgccgcgagtgcgcctga

SEQ ID NO: 4162 - DNA, 765 bp, Actinoplanes utahensis
atggatgccaccggcgacgacgaggagctgggccgcaccgttgcggccctgaccgccgacgacctggagtcgtccggccgtcggcgcctgctcggccggctggtgggtgacgtgcgccgtcgtggcgtgggccggttgttcaaaccccgggccgcgctgcgctggatggccgaggtggtcaccgacgtggcgccgcacatcccggtccgtgaccgggagacgctgcgccggcatttccccggcctggacgacgacgacctggcggatcggctgatccgcaacgccgcccgggccacggccggcgtgggcgcggccggtggcggggtggccgccgtcgagtgggtcgccgcgccggtgctgctgtccgcgccggtgctgctgtccgccgagacgatcgccgtggtcgcgatcgagatgaaactgatcggcgagctgcacgagctgtaccgggagccgatccccggcaacgggaccgagcgtgccctcgccctgatccagtcctgggccggccagcgcggggtcaacccgctggtgcccgggaccggggtggccagcgtgctgggcaccgccgcccgcggcgagctgcagaagaccctgctccgccggttcggccgcaacctgacctcgatgggcccgatgctgaccggcgccgcggtcgccagttacctcaaccggcgggccacccgctcgatcggcgacaaggtgcgcgacgacctcaggaagcgggctctgacgaggcctgaccggcccgcgctggacgactga

SEQ ID NO: 4163 - DNA, 492 bp, Actinoplanes utahensis
gtgaaggattcccgcgtgagcgacgtcgtcatcccggtccggctgatcgacccggatctgccgctgccggcctacgcacaccccggtgacgccggcgccgacctggtcgcggcgcaggacgtggagatcgcgccgggggagtgggccaagatcggcaccggcatcgcggtggccatcccggagggtttcgtcgggctggtgcacccccgttccggtctggccgcccgcctcggggtgacggtgctcaacgcgcccggtacggtcgacgccggttaccgtggcgaaatcctcgtcaacctgatcaatcacgaccgggcgcgggcggtgaagatctcccgcggcgaccggatcgcccaactcgtggtgcagcgggtggagcgggcggcgttccacgtggtggactcgctcgacgacaccgcccggggcacgggcgggcacggctcgaccggtggattcagcgaaggaaaggctggcagtgatgttctcccgtaa

SEQ ID NO: 4164 - DNA, 651 bp, Actinoplanes utahensis
gtgatgttctcccgtaagcgcgagggcgccaagcacgtacgcgcggccgacgcgccgccctccaaggcgctcgcccagagcctggcggccgatggggaggccccggcgcccgagttcgggccctgggacgtcaagcacgctccgggcgacgtgcagcggctcgacctgggcagcctgcagatcccggcgatcgagggcgtcgaggtgcgggtgcaggccaacccggagggcggggtcgagcagatcgtcctggtcgacggcgagagcgccctgcagctcggggtgttcgcggcgccgcggaccgaggggatctgggacgaggtccgcgaggagatcgccggcgcgatgaccgccgacggcgtggcggcccgcgaggtgaccgggcggtacggcaccgagctgctggcccgggtcaacaccccggagggcccggccgacgtgcggttcgtcggggtggacggcccgcgctggatggtccgggcgctgttccagggtgcggcggcggccgacccgggccgcgagggtgtgctgggcgtggcgctggagggcctggtcgtggtccgcgacgacgagccgcgcccggtccgcgagccgctgcccctacggctgccccgggagatggccgaacagaaccccgcacagcaggtttga

SEQ ID NO: 4165 - DNA, 378 bp, Actinoplanes utahensis
atgaccaccgagcagcgcaccggcctgcgccggttcctggacaggttgaccgcgaccgactccgagctcgatgccgaggagttgcagcgggatgcggtgaagtgtggcgccatgccggccgggcagtgccggcgtggccaggtcgtttcggtgtccggccggttgcgcaccgtggcgtacactccacggaccaacctgcccaccctggaggccgacctctgggacggcagtgacgtggtcacgctggtcttcctgggccgccggtcgatcgccggcatcgagcccgggcgccagctcaccgcgcgcggccggatcgcgatccgggacgaccgcaaggtcatctacaacccgtactacgagctggaggcgccgcggtga

SEQ ID NO: 4166 - DNA, 762 bp, Actinoplanes utahensis
gtgacacccggcaacgagccgcgccacgtggcgcacgaaaccgtcgaggagcggctcgccgaggacatcgtcgaggagctcgacctgcacccggcccccgctccggacgaggaggaggcgctcccgccgctcagcgagcagatcgccgaccaactgggcggggtgcgcgggctgatcgagtccagcatcccggtgctggccttcgtgctgttcaacgtgctgctcggcgaatcggtcgccggcctggacaagcagaccgcgctgacctgggcgatcgtcggctcggtcggctcggcggtggcgatcggcggggtccggctggcgcgccggcagccggtccggcacgcggtcaacgggttgttcggcatcgctctgggtgcctacttcgcatggaagagcggcgacgccaagaacttctacctgcccggcatcctgctcaccttcgggcaggcggcagcgctgctggtgtcggtggccttccgtaaaccgctgatcggttacgcctggggcatcatggccaacaagggccggcaggactggttcggcaacgcccggctgttccgcaccttccagtggctcaccctggtctgggtggcgtccctggcgctgcgcgccggcatccagttctacctgtggaagctcggcgaggcgaacgccctgggcatcgtccggatcctgatcagctggccgatctacgccgcgacgttcgccttcaccgcctgggccatccaccgggtcacctcggcccagaagagctcctag

SEQ ID NO: 4167 - DNA, 666 bp, Actinoplanes utahensis
atgcggatcgccatcgcgggagccggcaacgtgggccgctcgatcgcccaggagctgatcggcaacggtcacgaggtgatgctgatcgagcggcagccgcgccagctctgcccggagcgggtgccccaggcccagtgggtgctggccgacgcctgcgaggtcagcagcctggaggaggccgacgtggcgtcctgcgacgtggtggtcgcggccaccggcgacgacaaggccaacctggtggtgtcgctgctggccaagaccgagttcgcggtcggccgggtggtggcccgggtgaaccgggcggagaacgagtggctgttcaccgagcagtggggcgtcgatgtggcggtcagcaagccgcgcctgatggccgcgctggtcgaggaggcggtcacggtcggcgacctggtccggctgatgaccttccggcagggtgaggccaacctggtggagatcacgctgccgcgcaacgcgccgtacgagggcaagccgttgcgttcggtgccgatgccgcgggatgccgcgctggtggccatcctgcgcggcaagcgcgtggtggtgccgacgccggacgacccgctggaggccggcgacgagctgatcttcgtctgcacctcggaggtcgaggaccagatccgcgccgtggtgctgggcgccgccggctag

SEQ ID NO: 4168 - DNA, 666 bp, Actinoplanes utahensis
gtgcacgtggtgatcatggggtgtggccggctcggctccacgctcgcgcacagcctcgacacgcggggccatcaagtcgccgtgatcgatcagaacgccgacgcgttccggcgcctgggctcggagttcggcggcatcacggtcaacgggatcggtttcgaccgggacgtgctgagggccgccgggatcgagcgggcggacgccttcgccgcggtctccagcggggacaactcgaacatcatctcggcccggctggcccgcgagacgttcggcgtgcaccgggtggtcgcccggatctacgacgccaagcgggcccaggtgtacgagcggctcggcatcccgacggtggcgacgatccgctgggccgccgaccggatgttccgctacctggtgcccgaggcccacaacgaggtcttccgcgacccgaccagcgtggtcagcatcatcgaggtgccgatccacagcgactgggtggggcggacggtgaaggcgctggaggacggcaccggcgcccgggtggcctatctgatgcgtttcgggatggccgcgctcgcccagccgtccaccgtgctgcaggacggcgaccaggtcttcgcgctggtcaccgacgacaccgtgaacaaagtcctggacatcgccgggcgcgccggaaacgaggggcactga

SEQ ID NO: 4169 - DNA, 2043 bp, Actinoplanes utahensis
gtggcaagtaccacctccctagccaagcggctgcttctgggccggccgttccgttcggacaagctgcaacacacgctgctgccgaagcggatcgcgctgcccgtgttcgccagcgacgccctctccagcgtggcgtacgcacccgacgagatcctgctgaccctctcgatcgccggggcaggcgccttcgcgatctctccctgggtgacgctcgcggtcgcggtggtgatggtgaccgtggtcgccagctaccggcagaacgtgcacgcctacccctccggcggcggcgactacgaggtggccacggtcaacctcgggccgcgcgccgggctgggggtggccagcgcgctgctggtcgactacatcctcaccgtggcggtctcggtgtcgtccggggtgaagaacctcgcctcggtgctgccctgggactgggtgggcaacgaccgggtcgagatcgcggtcggcgcggtgctgctgctgaccgcgctcaacctgcgcggcctgcgcgaggccggtctggcgttcgccatcccgacgtacctgttcatcctggtcaccgtcgggatgatcctgaccgggctgttccgcgtctacatcctcggcgacgacctgcgggcgcccagcgccggcctgcagatcaccgccgagtccagccacctcaccagcttcgccttcgtcttcctgttgttgcggacgttctcgtccggctgcgcggcgctgaccggtgtcgaggcgatctccaacggggtgcccgcgttcaagccgccgaagagcaggaacgccgcgaccacgctgatgctgctcggcggcatcgcgatcgtgatgctgttcgggatcatcgcgctggcccggatgacccacctgcagtacgtcgaggaccagaccacccagatcatctccgggccggccaactacgagcagaagacggtcaccgcccagctcgccgaggccgtcttcgggcacggctcgggcctggtcgtgctggtcggcgcggtcaccgcgctgatcctgttcctggccgcgaacaccgccttcaacggcttcccggtgctcggctcgatcctcgcccaggaccggtacctgccgcggcagttccacacccggggcgaccggctggcgttcagcaacggcatcctgttcctggccggcgtcgcgatcgtgctgatcgtcgcgttccaggcggagccgacccggctgatccagctctacatcgtcggcgtcttcgtgtcgttcaccctgtcgcagggtggcatgatccggcactggaaccggctgctcaagattcagcgcgatccggagcgccgccgccagatgatccgctcccgggcgatcaacgcgttcggcatgggcctgaccgccgccgtgctgatcgtggtgctgatcaccaagttcctgctcggggcgtggatcgcgatcgtcgcgatgatcgtgttctacgccctgatgctggccatccaccggcactacacccgggtctccgaggagctgcagccgaccgaggaacgaccgacgctgccctcccgcaaccacgcggtggtgctggtcagcaaggtgcacctgccgacgctgcgggcggtcgcctacgcccaggcgacccggccggacacgatcaccgcggtcaccgtcaacgtcgacgacaaggacacccgggccatccaggccgaatgggagcgccgcgagctgccggtccagctgaccgtcatcgactcgccgtaccgggagatcagcaaaccgatcatcgactacgtcaaaggcgtgcggcgcgcgtcaccgcgcgacgtggtcacggtcttcgttcccgagtacgtggtgggccgctggtgggagaatctgctgcacaaccagagcgcgctgcggatcaagggccggttgctgttcgagccgggggtgatggtcaccagcgtgccgtggcagctgcggtccagccaggaccgggacctcgaccgcctggaccgtggcctgagccgggcgccggcgcgggggccgcggttccaccccgaggcgacggccgttcccgatcagccggccgaggagaaatcgtga

SEQ ID NO: 4170 - DNA, 1284 bp, Actinoplanes utahensis
gtgacgtcgcccgtcgtctcacccgctgatgatcttgtcgagggcgaccggatcgagctgaccgtgggggcgccggcgcacggcgggcactgcgtggcccgtttcggcggcccgcacggccgggtggtgttcgtccggcacgcgctgcccggcgaacgggtcaccgcggagatcaccgaacggcaccgcggatacctgcgcgccgacgccgtcgagatccacgaggcgtcgccggaccgggtcaccccgccgtgcccgtacgcccaccccggcggctgcggcggatgtgatctgcagcacgtctccggcgacgcccagctgcgttggaagacgcagatcgtccgcgaacagctggcccggatggcgaacctgcacaccgacgacgatttcgtccgcgtggaacccctccccggcggcctcctccactggcgcagccgagtgcggtacgcggtcgacgccgccggccgacccgggctgctccagcaccggtcacaccaggtagtgccgatcgaccggtgcctgatcgcccacccggccatccaggaactcgacctgctcgcccacccgtggccggacgcggccgcgctgcaggcggtcgccaccaccggcggcgacgtcgtcacccagcaacgcccggccgcgacctccggcgacccgaccgccttcggcgaccccaccgaggctgccggcggcgccggactggtccgtctcaccgggccggaacgggtcaccgaggtggccggcggccgccgctgggacctggcgcccgactcgttctggcaggtccacccggaagcagcggccacccttaccacggcggtgctggacatgctccggccggctccgggcgagaccgcctgggacctgtacggcggggcgggcctgttcgcggccgccgtggccgcccggaccggcgcccgcaccaccatcgtcgagtcgtccgcgctcggcgtcgaggcggcccgccgcgccctggccgacctgccgtccgtcgaggtggtccaggccaccgtcgagaccgcgctgacccgccgccggatcaccgggcctgtcgacctggtgatcctggacccaccgcggtccggcgccggcgccaaggtcgtccacggcctggccgccgcctccccccgggcgatcgcctacgtcgcctgcgacccggcggcgctggcccgggacgtgaagacgttccgctcgctgggctgggagctggccgagctgcgcgccttcgactgcttcccgatgacccagcatgtcgagtgcgtcgccctgctcctgcccgcctga

SEQ ID NO: 4171 - DNA, 873 bp, Actinoplanes utahensis
atgaccaccgagacaaccggcgcccgcctcctgcccggcgcgcccgtcgccgaggccgtcctggccgacgtccgcgaccgggtcgccaagctcaaggagcgcggcatccagcccagcctggccaccatcctggtcggcgacgacgacgccagcgccggatacatccggatcaagcagaagcaggccgccgagctgggcttcgagtccccgcaccggcatctttccggcgacgtcacccaggccgacctgctccaggtcatcgccgagttcaacgacgacaagagcgtgcacggcgtcctgatccagtatccgatcccggcccacctcgactacgacgccgccctgcagaccctcgacccggacaaggacgtcgacgggatgcacccgctcaacatgggccgtctcgcggtcggcctgcccggcccgctcccctgcaccccggccgggatcgaggcgctgctcgcccaccacggcgtcgaggtcgccggccgtgaggtggtcatcctgggccgcggcgccaccctgggccgcccgctcgccatgctgctggcgcagaagcggcccaccgcgaacgccgccgtcaccgtcgtgcacaccggtgtgaaggactggccgcgctacaccaggcgcgccgagatcctgatcgccgcggtcggcgtcccgcacatcatccagccggagcacgtgaagccgggcgccacggtgatcggcgcgggcgtccgctacgagggccgccgcctgctcccggacgtcgacgagtcctgcgccgaggtcgccggcgcgatcaccccccgggtcggcggcgtcggccccaccacggtggccatgctgttccgcaacgctgtcgccgcggccgagcgcgccaacccctga

SEQ ID NO: 4172 - DNA, 1404 bp, Actinoplanes utahensis
atgtccgtcgatgcccccgctccgcggcgccgggaccgcagccacctcctctatctctgcgtgctcctcgcgatggccctgggcatcgcggtgggcttcgccttccccgacttcgcggtcaagctgaagccgctcggcaccggattcgtcggcctgatccggatgatgatcgccccggtgatcttctgcacgctggtgctcggcgtcggctcgatccggcgcgccgcccaggtgggccgggtcggcgggctggccctcggctacttcctgatcatgtccaccgtcgcgctgacgatcggcctgatcgtcggcaacatcctgcaccccggcgccggcctgcacctgagccaggaactcgccaagaccggcaccgcccaggtgagcagaacggccgagggcggcgtcgacttcgtcctcgggatcatcccggacaccctgatctccgcgctgaccagcacccaggtgctgcagaccctgctggtggcgctgctcgtcggattcgccgtgcagtcgctgggcgcccgcggcgaaccggtgatcgccgcggtggcgctggcccagcgggtcgtcttcaggatcctcgcgatgatcatgtggctggccccgatcggcgcgttcggggcgatggccgccctggtcggcgccaccggcttcgccgcgctcaagagcctcgccgcgatcatggtcggcttctacgtgacctgcgcgatcttcgtcttcctggtgctcgggctgctgctgcggctggtcgccggagtgtcgatcgggcggctgctgcgctacctggcccgcgaattcctgctcatcctgtccacctcgtcgtccgaatcggcgctgccccggctgatcgccaaaatggggcacctcggggtgagccgcccggtggtcggcatcgtggtgcccaccggatactcgttcaacctggacggcaccgcgatctacctgaccatggcgtccctgttcatcgccgacgccctcgaccggccgctctccatcggccagcagatcggcctgctgcttttcatgatcgtcgcgtccaagggcgccgccggcgtcaccggcgccggcctcgccacgctggccggcggcctgcagagccaccggcccgacctggttcccggcgtcggcctgatcgtcggcatcgaccgcctgatgtccgaggcgagggccctcaccaacttcgccggcaacgcggtggccaccatcctcatcggcacctggacccacgagatcgaccgcgaccaggcggcccgggtgctgtccggcgaagcgccgttcgacgaatccaccttcgacgacgacccgcacgccggcggcaccccaccacccgccgtcgacgccgcctcccccgcttccgcttccgctccgccttcgccgctcgccggccctccgaccgccctgtga

SEQ ID NO: 4173 - DNA, 1923 bp, Actinoplanes utahensis
atgagcgactccccttcgaccccggccggcctgctggcgagcgtcaccggtcccggtgctctcaagcgactgtccgcggagcagctgaccctgctcgcggccgagatccgtgacttcctcgtggccaaggtgtcgaagaccggggggcacctcggaccgaacctgggcgtggtcgagatgaccctcgccatgcaccgggtcttcgactcgccgcgcgacaagatcctcttcgacaccggccaccaggcgtacgtgcacaagatcgtcaccggccggcaggacggtttcgacctgctccgccagcggggtggcctgaccggctacccgagccaggcggagagcgagcacgacctcatcgagaactcgcacgcctccaccgcgttgtcctacgccgacggcctggccaaggcgttcgcgctgcgcggcgaggaccggcacgtggtggccgtggtcggcgacggcgcgctcaccggcggcatgtgctgggaggcgctcaacaacatcgccgccacgaagaacaggctggtcatcgtcgtcaacgacaacggtcggtcgtacgcgccgacgatcggcggcctggccgaccacctctccacgctgcggctcaaccccggctacgagaaggtgctcgacctggtcaaggacgcgctcggctcgaccccgctggtcggaaagccggtcttcgaggtgctgcacgcggtcaagcgcgggatcaaggacgcggtcagcccgcagccgatgttcgaggacctcggcctgaagtacatcgggccggtcgacggtcacgaccagcaggcgatggagtccgcgctgcgccgggccaaggggttcaacgcgccggtgatcgtgcacgcggtgacccgcaagggctacggctaccgtcccgccgagcaggacgaggcggactgcctgcacggcccgggcgccttcgacccgcagaccggcgcgctcaccgccaagccgtcgctcaagtggaccaaggtcttcgccgaggagctggtgaagatcgccgacgaacgccccgacgtggtgggcatcacggccgccatggccgagccgaccggcatcgccgctctcgccaagaagtaccccgaccgggcgtacgacgtgggcatcgccgagcagcacgccgcgaccagcgccgcgggcctggcgatgggcggcctgcacccggtggtggcggtctacgccaccttcctgaaccgcgctttcgaccaggtgctgctggacgtcgcgatgcatcggctgccggtgaccttcgtgctggaccgggccggcatcaccgggccggacggccccagccactacggcatctgggacatgagtgtcttcggcgccgtccccggcctgcgcatcgccgccccgcgggacgccgccaccctgcgcgaggaactgcgcgaggcggtcgcggtcgacgacggcccgaccatcgtgcggttcccgaccggtgcggtcgccgcggacaccccggcggtgcgccgggtcggtcaggtcgacgtgctgcgcgaggcggagaagaaggacatcctgctggtcgcggtcggctcgttcgtcggcctcgggctggacgccgccgagcggctcgccgagcaggggtacggcgtgaccgtggtcgacccgcgctgggtgcgcccggtgccgatcgagctgaccggcctggccgcccagcaccgcctggtggtgaccctggaggacgggatccgcgccggtggtgtcggtgacgcggtggccgccgcgctgcgcgacgccggggtgcacgtgccgctgcgcgatttcggcgtgccggccggtttccacccgcacggcacccgggccgagatcctcgcctcgctgggtctgaccgcgcaggacgtcgcgcgggacgtgaccggctgggtgtccggcctggacgccggcacgtcggtggcggccccggcgatctga

SEQ ID NO: 4174 - DNA, 1308 bp, Actinoplanes utahensis
atgggtgcggagacggtcatcgacctcggtctcgaccggggggttccggagtcctacgagcgaccccggcgggccaccgtcccgcagtggttcgccccggtgctgctcgccctgctgctgctgatcagctccagcgcctcggccgccccgccgaaacccccgttcaccccgctgctgcggatcccgatgggcccggccgatccgtatctgatcaccgcggccggccgcctggtcacccagaccggcgacgtggtcaccgcctacgacctgacctccggggcgctgagctggcgggccggccggtccaccccggtcctgcggctgcgcaccggcgacgggatgctgctcatgcagccgtggaccatcggcggcgcggcggccggcaccaccgcgatctcgctggccaccggcgagcggcagtgggtcaatccgcgcagcgtgatcaccttcgcgggcagtgacgcgctgatcgcggtgaccggcacccggagcctgtccggcagcggccgccgggtgcagggtttgatcgaggtgctggacacgctcaccggggacacccgctggcgggtccgcgtgccgtccaccgcggtggttctcggggtgcccggcccgtccgacgccggcgcccggatgctggtggtccgcgacgaccgcacggcggtcctgcacgacgtggcggacggccgggtgctggccacccgggagctgccgtcggcgaactacggcccggacaacccggtggtggccggcggcacggtgctgctgcggcatccgggcgtctccgggatggaggtctccgcgtacgacccgctcaccctgcgcccgctgtggaccgaggaggccgacggcaccctcgatgtccgcccgtgcggtttgctggcctgtctgctcggtgggggcggggtgcgcgccgtcgacccggccaccggggaccagcggtgggcgcagcgcggctggcaggcggtcgagcagcggggcaccagcctgctcgcctaccgggaggccgacggcgcgctgccggccgccctggtggacagcgcgaccggccgggtgctgaccgacctgaccggatggcgtccgctggccggggcgaatcgggccggccgcctgctcgtcatccgggcggtgccggacggcgcgcgtaccatggtcgcggtcgccgacccggtcggcgggcggttgcgcacgatcgccggcctgccgcccggcaccggcgggtgcgaggccgctccggaccggctggtctgccgttccgcggcgggtgaactggtggtgtggtcctacgacgagacggccggtgcgcgctga

SEQ ID NO: 4175 - DNA, 1350 bp, Actinoplanes utahensis
gtggccctgatcgatctggaccgcgtcgccccgcccggcccgccgcgtgccgcgcgtcccccgatccgcgcctatcggcgtggcggcctcctgcttgccctggtcctgctcaccgtgctgggtggcgccgtgcccgcggccggcatctgctggcgctatctcggcgcgatcacctcgccgctcgccccggacgggccgatcgagctggccggcggccgggtgtacacggtgggcacggccggcgctgatccggtggtgaccgcctggagcacggacgacccgccgcggcggctgtggagtgtccgcgccccggtcggcgccggcccgggtgtggtcccgccgtcctcggtgaccgtccgtccggccggtgacgtcgcgctgctgaccgccggggtggccaccaccgcggtcgacgccgcctccggccggatccgctggtcgtcgccgatcgcggtgaccgtgctggccggcagcggcatcggcgtcacggtcgaccgggtgttccgcgccggcacggtgtacgaccaggcgtccggcgccccgggcccgctctacttctcggcgaccggcgagccgcacaccgagccgccgctgcgcaccgacgtccgcggcctggacctggccgacgggcacaccgtgtggacggtcgcgccgggcggcgcggtgacggtcgaccaggtgcccgggccggacccggccgtgctgatcacctcgtcggcccggctcagcctggtctccgggcggaccggcgagccggtgcgccaggccgacctgccccggttgtccgggcacgggccggccggtggcgcgctgctcggcgacgtcgccctggtcagctatcagaacccgggccggcaggtggcgtaccgggcgcgcaccctgcagcggctctggtcgcgcccggtgccggatctggtcgccgacccggcggactgccagggggtgctctgcgacggcgggcacggcaacctgcgggtgctcgatccgggcaccgggcaggcccgctggcggaccggggaggacgtcgacctggcgatccgcgccgggtacgtgctggagaccgacgccgcctccggtgaaccggtccggctcaccgacccgcacaccggggcgaccgcggtcgatctggacggctggtcggcaccggtggccggggcggccgacgcgccgctgctgctgcgccgccgggacgggcacggcgggcaggcgttcgccgccgtggtccccggccacgcggcggtccgcgagctgggctcggccggggtccggctgggcgactgcgacgcggacgggcactatctggcctgccgctccccggagggactgcggctctgggcgtaccggatctga

SEQ ID NO: 4176 - DNA, 201 bp, Actinoplanes utahensis
atgtcggtggacacgaaatccgtcgccgaagaccgcggtgatgaggacggcgccggctggccggctttcctggctcactcaccgggcgaggcccgcccggtcgtcaccgccctggtcggcgacgacccacaggtaaggtgtctagccagataccagctgatcgccctgtccgaccatgtggttcgtccaccgagacgatga

SEQ ID NO: 4177 - DNA, 663 bp, Actinoplanes utahensis
gtgcgcgtgctggtggtggaggacgagcggacgatggccgacgcgatcgcccgcgggctgcggcggcacgggatggccgtcgacgtcgcgtatgacggcgcacagggccacgagatggcctacgtcacccggtacgacgtggtggtgctggaccgggacctgcccggcatgtccggtgacgagatctgcgcggccctggtcgactcgggtgcgctgacccgggtgctgatgctgaccgccagcgcctcggtcgccgaccgggtcgagggcctgcaactgggcgccgacgactacctgccgaaaccgttcgccttcgacgaactggtggcccgggtgcaggcgctgggccgccgggccaccccgcccgccccgccggtcttcacggtcggcaacctggtgctcgatccgggccgccgggcggtcacccggggcgagaccccggtggatctgaccaacaaggagttcggggtgctggaggtgctgctcaaggcgagcggcgcggtggtctccagcgaggaactgctggagcgggtctgggacgcgaacaccgacccgttcaccaccacggtccgggtgaccgtgatgaccctgcgcaagaagctgggcgatccgccgctgatcgacacggtggtcggggccggctaccgggtcgtgaccacatga

SEQ ID NO: 4178 - DNA, 1233 bp, Actinoplanes utahensis
atgaccgtctatcaggggcagccggtccagcaccgggagagcttcctgcgccggctggcccggcccaccctgcggctgcggctcaccctgctgaacgggatcctgctggtggccgccggcgcggtgctggtggtgctggcctggttgctggtcgacgagccgctgcacccggccgacaggctgcgggtcgggtcgagtgtgacgctgaacgacggcaccacccgggaggcccggtcctggcagaccgagaccatcgacgaggcctccgaccagttgctggtcaaggggctgagcgcgctggtggcgatcagcatcatcgggatcgccggcggctatctggtgacccgccgggcgctgcggccactgcaccaggtcacccagaccgcgcagcggctcggtgaggagacgctggaccagcggatccggtatgccggggcggacgacgaggtggccgagctggcccgcaccttcgacgcgatgctggaccgcctggccggcgcgttcgagtcgcagaagaggttcgtcgctaacgcctcgcacgagttgcgcaccccgctcgcggtgatgcgcaccgagatcgacgtgacgctcagcgacccggacgccgacctggccgagtaccgccggatggcccgggtcgtccgggacgcctccagccgggcgaacgggctggtcgacgcgctgctggtgctggcccgttcggaggcgcagtccggccggcgactggtccgcaaggtgccggccgacctggccaccagcgtgtacaacgcgttgtcggcggtgaaggaggaggccgagcggatgcggctggaggtcaccacggacctggccgcggccccggtggtgggcgacccgagtctgctggaccggctggccggcaacctgatcgagaacgccatccggtacaaccacctgctcggccggctgtggctgcgcaccgtctcggtggacgggcaggcgcggctgatcgtcggcaacaccgggcacgaggtggagcaggccgaggtgcccgggctgttcgagcccttccgccggggcggctgggagcggaccgggtcgcggggctccggcctgggcctgtcgatcgtgcgggccgtctgcgacgcgcacggcggcacggtgtcggcgatcgcgctggccgacggtggcctggaggtcaccgtctcgctgccggccgccgacaccactccggtggtggcggcgaccgccagcgtgccgaggggccggagctag

SEQ ID NO: 4179 - DNA, 909 bp, Actinoplanes utahensis
atgtcgcaggacccctacccgggccagccgttccccggcgtgcccaacccgaacgtgccgccccaggaggggttgccgccgacccagccgttcccgggcgcctacccgcagccccagcagccggcctacggccagcagccgccgccctatgggcagcagcagccggcttacggccagcagccgcccgcctacggtcagcagcagccggcctacggtcagcccgcctacggccagccgcagcccagcttcccgccgatcccgcccgcgccgaagaagtcgaaggcgctgccgatcacgctgatctcgatcgccatcgtgctggtgctctgcgtcggcggcgtggtcgcgatcaacctgctcgccaaggacgacaagtccaagggcaccgccacggccaccagcacctcgtccaccaaggccaccgagggcggcgcggccaagccggccgccgacatcaccgtcgtcgagccgaagacactgggcggccggccgaaactcaccaccgccgagttcgccaccatcaccaagaccatgcaggagggtctgaaggacggctacccgggcgccaccaagtcgctcggcgcgttctacggcaccccggtgaagaagaacatggtgatgacgatcgcggtggccgcgccgatctccgacccggagctcgagctcgaccgcaacttcaccagcatgagcacgaccggcttctcggccgagcacatcaccgcggtggacaccggctcgttcggtggctcggccaagtgcggcgacggcaaggtctcctcggtcccggtcgccgtctgcgcctggtccgactcgggcagcgtcggcatgctcgtgtggtactacacgtccaagagcgccgcggagaagcagttccccgcgatccgcgccgaaatcgagaaggtcggctag

SEQ ID NO: 4180 - DNA, 2064 bp, Actinoplanes utahensis
gtgatcgagaacccgaacgaggtagtgaccaaggcgctgctgcgttccgtccgggtacccgggctggacaagccggccgcgctgatcaccctggacaacggcttcgaccacaagaagccgaacagcttcggcccggccgggctccagtcgctggacgaggcgatcaccggggctctcgcggcggacccggcgttcatcgcggtcaccggcaagccctacatcttctgcgtcggcgcggacatcaccggcatgccgctgctctcctcccgggagcaggccgtcgagctgggcgagctggggcaccgggtgttcgcccggctccggaacagcaccatcccgaccttcgcgttcgtcaacggcgcggcgctcggcggcggcctcgaggtggcgctgcactgccactaccgcaccgtctcctccggcgcgaccgcgctcggcctgcccgaggtcgcgatcggcctgatccccggctggggcggctcgcagctgctcccgaacctgatcggcatcgccggcgcggcgcaggtcatcctgcagaacccgctgacccagaaggtgctgcgcccgaagcaggccagggagctgggcgtcgccgacgcgctgttcgaggccgccgacttcctcgaggactcgctggcctgggcggccggcgtggtcaagggcgaggtcacggtcgagcgcccggagatcgaccgggacatgtgggacggcgtgctgtggttcgccaagaaccagctcgacgagaagctgcacggcgcggtcccgtccgccaacaaggctctggagctgctggctctggccaaggaggcgacgttcgaggacggcaccgcggccgagaccgaggcgctcgccgacctgatcatgggtgacgaggcccgcgccagcctgtacgcgttcgacctggtccagcggcgcgccaagcgcccggtcggggtgccggacaagtccctggcgcgcaaggtcaccaaggtcggcatcgtcggcgccggtctgatggcctcccagctcgccctgctgttcctgcgccgcctgcaggtcccggtcgtgctcaccgacctggaccaggagcgggtcgacaagggcgtggcgtacgtcaccggcgagatcgacaagctggtcggcaagcgccgcctggacgagggcaccgcggccaagctgcgcggcctgatcagcggctcggtcgacaagtcggtgttcgccgacgccgacttcgtgatcgaggcggtcttcgagaacctcgacctgaagaagaagatctgggccgagttcgagaccatcgtcaagccggaggcgatcctcgccaccaacaccagctcgctgtcgatcaccgagatggcggccggcctgcagcacccggagcgggtcgtcggcttccacttcttcaacccggtcgcggtcctgccgctcctggagatcatccgcggcgagcagaccgacgacgcgacgctggccaccgcgttcgccgtgggccgcgagctgaagaagtcctcggtgctggtcaaggacgccccggcgttcgtggtcaaccgggtgctcacccggttcaccagcgaggtcttcaaggcggtcgacgccggcaccccgctcgaggtggtgaacgaggcgttcgacccgatgggcctgccgatgcgcccgatcgcgctgctccagctggtcggcccggccgtggcgtaccacgtcggcgagaccctgcaccgcgccttcccggagcggtacgtggacagccccaacctgaagcggatcgtcgacgccggcctgccgctgctggtcgacgacgagatcaacgccgacgtggtgaagctgctcgaggtcggcgacaccgtgctcaccggcgacgaggtgcgggccaaggccctcgccgcgctggccgaggagatccggatcatgctggacgagggtgtcgtcgccgaggcgcaggacatcgacctgtgcatgatcctgggcgccggttacccgttccacctcggcggaatcacgccgtacctggaccggagcggtatcgcggagcagatcaccggtcagcgtttcctgccgaacgggctggcggacgttcgccggtcctga

SEQ ID NO: 4181 - DNA, 1197 bp, Actinoplanes utahensis
gtgccccgtgaagtacgcgaggtcgtcttcgtcgacggcgtccgcaccccgttcggcaaggcgggcggcatgtacgccgagacccgcgccgacgacctggtgatccgctgcatccgagagctgatcaagcggaatccccagctccccacggaccgggtggacgaggtcgcgatcgcggccaccacccagaccggcgaccagggcctgaccatcggccggaccgccgccctgctggccggactgcccaagacggttcccggctacgccgtcgaccggatgtgcgccggcgcgatgaccgcggtgaccaacgtcgccggcggcatcgcgatgggggcgtacgacatcgccgtcgccggtggtgtcgagcacatgggccggcacccgatgggtgagggcgccgacccgaacccgcggatcctgaccgagaagctggtcgacccgtccgccctggtgatgggcgcgaccgcggagaacctgcacgaccggctgccgcacatcaccaaggagcgcaccgacctcttcgcgctcaactcgcagctcaaggtcgccaaggcgtacgccaacggcaagctgcagccggacctggtgccggtcgcgatccgctcgtccgaactgggctggggcctggccaccgtcgacgaggcgccgcgcgagacctcgctggagaaactcgccacgctgaagacgccgttccgcccgcacggccggatcaccgcgggcaacgcggccggtctcaacgacggcgccaccgcggcgctgctggccgacgaggccaccgcccgcgagctcggcctgccggtcgcgatgcggctggtgtcgtacgcctacgtgggtgtcgagccggagatcatgggttacggcccgatcccgtcgaccgagaaggcgctgaagaaggccggcctcaccatcgacgacatcggcctgttcgagctgaacgaggccttcgccgtgcaggtgctggccctgctggaccactacggcatcgccgacgacgacccgcgggtcaacccgtggggcggcgcgatcgccgtgggccacccgctcgcctcctccggcgtgcgcctgatgacccagctcgcccggcacttcgaggagcaccccgaggtccggtacggcatgaacgcgatgtgcatcggtatcggcatgggtggcaccgtgatctgggagaacccgaactgggaaggcttcaagaagtga

SEQ ID NO: 4182 - DNA, 1302 bp, Actinoplanes utahensis
gtgaccgacgaaacacccctgcgccgtcgggacgcgccggagtcagcaggggacggaccgcacgccgtgccgcccgacccgagttctggcggttccgaggctgttcccctgacggcgccccgcgatggcacccccgccccggtggagagcgccgacggcctggccgaggtggtggcccggatggccgccggctccggccccgtcgccgtggacgccgaacgcgcctccggctaccgctacacccagcgggcctacctggtgcagctgcgccgggccgggtccggcaccgtgctgatcgacccgctgccgctggacgacctgcgcaccctggacaccgccctggccgacaccgagtgggtgctgcacgccgccagccaggacctgccgtgcctcgccgagctggggatgaagccgcgccggctgttcgacaccgagctggccgcccggctggccgggttcgagcgggtcggcctggccgcgctcaccgagcacctgctcggctactcgctggagaaacaccactcggcggcggactggtcgacccggccgctgccggagtcctggctgacctacgcggcgctggacgtggaactgctcaccgacctgcgcgacctgctcgccaccgaactggacaagcagggcaaggccggctgggcagccgaggagttcgcctcgctggtggccagcgccgaccggccgccccgggtccggcccgacccgtggcgccgcacctccggcatccatcgggtgcgaggtgcgcgggcgcagtcccgggtccgcgcgctgtggtacgcgcgggatgcgatcgccgcccggaaggactcggcgcccggccgggtgctgcccgactcggcgatcgtcgccgcggccgaggccgatccgaaggatgagcggaccctgctggccatcccgggcttcggcgggcgttcggtccgccggctggtcaagacctggctggacgcgctggaccaggcgcgggcactgccggacgacgcgctgccggtgaaccagccggtggaggggccgcccccgccgcaccggtgggccgaacgggatccgatcgccgcggcccggctggcccgctgccgccaggtggtggtcggcaccgcggagacctaccggctgcccccggagaacctgatcagtccggacttcatccgccggctggcctggtcgccgccggacgaggtctcggcgcagacggtgagcgacacgctgcgcggcttcggtgcccgcaactggcaggtcggcctcatcgccggccagctcgccggcgtcctgcccgcccccttcaccgactga

SEQ ID NO: 4183 - DNA, 1125 bp, Actinoplanes utahensis
gtgcgcagccgggtcccggcgcgccgattctcgatcgacttccgggttcaaccattgcgcggtttgctccgtatacccgggtgccacgccgacaccacccgggaggccgtgcggatgaccgccacctacgagcccttcacccccgagccgcgccgccatcgcgccgaggagtcctggggcggtcagtaccagcgctgggagccggccgcgccggagccgcggtggccgcaggagcatccgcagtggccggagcaggcgcggtacgaggagccgcgcccgcagtggcaggagccgccgcgcttcgaggagccgcgcccgcagtggcaggagccgccgcgcttcgaggcgcccgccccggcttacgaagcggtgccggcgaagcccacggcgtcgaaggcccggccggtcgtgatcggcctggtcgtcctcctgctgctggtcatcggctggcaggcgtaccggatcgaatccgtgatcaagagcagcaacgacctggccgccgcggtcagcagcgagcagaaccacagcgcggatctgcagaagtcgctcaccggcgtgttcgacccggagggcatctccaccgccaccctgcccagcgtctaccgggtccgggccggcgacttcaccggcaccgccttctcggtcggcaccaaggcgaagagcggcaccgcgaacctgctcaccaacttccacgtggtcgagtcggtgtacaaggccggcacccggaccgtccagctggagcagggcagcacccggatcagcgccaccatcgtcaaggtcagcgagaccaaggacctggccctgctggtcgccaagaagaccatcaagccgatcaaggtggccaccaccaaggtcaaggccggtcagcagatcgtcgtgctgggcaacccgctgggcctcgacgacaccgtcaccaccggcgtgatcagcgcgttccgcgagaacgacgcggacgggccgaccatccagttcgacgctccgatcaacccgggcaactccggcggcccggtggtcaacgccaaccgtcaggtggtggcgctggccaccgcgaaggcccgcgacgcggaaggcatcggcctcggcatcccgatcgccaccgtctgcgccctgttcgacgtctgctga

SEQ ID NO: 4184 - DNA, 1119 bp, Actinoplanes utahensis
atggaggaagagtatgccgatctccgcccgggccgccctcgccgcgccgccgggcgtcgctcactcacgtggcacgatgacccggtgacggttctcgacgattccccgttcgtccgcgcgtgccgcgggctgcccggcccgcacacgccggtctggttcatgcggcaggccgggcgctccctgccggagtaccggaagctgcgcgaggggatcggcatgctcgactcgtgccgccgccccgacctggtcaccgagatcaccctgcagccggtccgccggcaccgggtggacgccgccatcctgtacagcgacatcgtggtcccgatcgcggcggccggcgtcgatctggacatcgtgcccggcaccggcccggtggtcgccgagccgatccgcaccgccgccgacctgcagcggctgcgtccgatcaccgcggacgacgtggactacgtcgccgaggcggtccggctgctggtcgccgagctcggcgccaccccgctgatcggcttcgccggggcgccgttcacgctggccagctatctgatcgagggcgggccgtcacggacctacctgaagaccaaggcgatgatgtacgccgagcccgagctgtggcatgccctgctcgcccggctggccgagatcaccctcgccttcctgcgcatccagatcgacgccggggtgagcgcggtccagctgttcgactcgtgggccggcgcgctctccgaggccgactaccgcgagttcgtgatgccgcattcggcgcgggtgctgcgtggcctggacgacgccggtgtgccccggatccacttcggtgtcggcaccggggtgctgctggaggcgatgggcgaggccggcgcggacgtggtcggcgtcgactggcgcaccccgctcgacgtggccagcaagcgcctcggtccggacaaggccgtgcagggcaacctcgacccggcgatcctgttcgccggctgggacgtcgtcgagcgcgaggcccgccgcgtcctcgcccagggccagtcggctccgggtcacgtgttcaacctcggccacggcgtcatgcccgagatggaccccgacatcctcacccgcctcaccgcgctcgtccacgaggcatccgcacgctga

SEQ ID NO: 4185 - DNA, 1395 bp, Actinoplanes utahensis
gtgcggaagcggatcgcggttgtcggcggcgggatcgccgggctggcggccgctgtccgcctgcgggacgtgacgcgggcggacaccgagatcatcgtgtacgagcagagcggcgccctgggcggcaaactgcgcaccggtgagctggccgggctgcgcgtcgagcggggcgccgagtcgttcctgaacggttcgccggacggtggcccgtccgcggcggtccggttcgcccaccgggtcggcctcggtgacgccctggtgcacccggcggcccagccggcagccctggcgatcggcggggcgctggcccggattccggccggcaccctggtcggcgtgcccggcgacctgtccgcgctggacggtgtcgccctgccggaggcggacgcggacgccgacaccggccacccgctgctcgccgccggtcaggacatcgcggtcggcgagctggtccgctcgcggtacggcgccgaggtggtggaccggctggtcgacccgatgctgggcggggtctacgccggccgggcggatcggctgtcgctgcgggccaccatgccgcagctggcccgcaccgcggagaccgagcacaccctgcgcggcgcggtccgggccgcgcaggcgctgagccggcgcaccccggggcagccggtgttcgcggccgtggacggcgggatgagccggttgatcggggcggcggcgaccacggcacgcgcccggatcagtctgggactgccggtgcgcgggatcacccgtaccggcaatcgatggcatctgaccctggggccggcaccgcagccccagaccgacgaggtcgacgccgtgatcctggccgtgccggcggcgccggcggcccggttgctcgcggatctcgcgcccggggccgcggccgcgctcggcgacctggagtacgcgagcgtcgcgctggccgggatggcgctgccgcccggcacgcggctgcccgagctgtccggcttcctggtgccgccgggggaggggacgctggtcaaggccgcgacgttcttcacccggaaatggccgcacctgaccgggccggacggtccggtgatcgtccgggcgtcgctgggccgggccggggagcaggagcggctgcagctgagcgacccggcgctgctggcgatcgcgcaccgggagctgagcgagctggccgggacgcggctgccgtcgccgaccgcgtcctggatccagcggtggggcggtggcctgccgcagtacgcgccgggtcatccggatcgcgtggcggccgcgcgggccgcgctgcctgcggggatcgcgctcgccggggcggctctcgacggtgtcggcatccccgtctgtgtggccagcggggagcaggcggcggacgatgtgaacagttacctggaggcaagtgcatga

SEQ ID NO: 4186 - DNA, 702 bp, Actinoplanes utahensis
atgagcgagcagaccaatgcggctcggatcaacgagctgaacgccaccatccgctacacgatgtggtcggtcttccgggcgtccagcccgctgccggccctgcgcgacgagctggccggcgaggtcgacaccctgttcgagcagctcgcggcgaaggatgtgacgatccgcggcacctacgacgtgtccgggctgcgcgccgacgccgacctgatgatctggtggcacgccgccgactcggacgacctgcaggaggcgtactcgctgttccggcggacagccctgggccggcacctgaccccggtctggtcgcagatggcgctgcaccggccggccgagttcaacaagagtcacctgccggccttcctcgccggcgaggaggcgcggccctacctgtgcgtctacccgttcgtccgctcctacgagtggtatctgctgcccgacgccgagcggcgcgagctgctcgccgagcacggccggcaggcgcgtggctacccggacgtgcgggccaacacggtggcctcgttcgcgctcggcgactacgagtggatgctcgcgttcgaggccgacgagctgcaccggatcgtcgacctgatgcgtgacctgcgggcctcccgggcgcgccggcacgtgcgcgaggaggtgccgttctacaccggccgtcgccgctcgatcagcgagatcgcggctagcctgccgtag

SEQ ID NO: 4187 - DNA, 1176 bp, Actinoplanes utahensis
gtgtcgggtaccgggctcggtgtcgcggccgtccaggtcggggtaggcgcagttctgctcgaccacgaacacgtcactgcgcagccggaggatgtcgtacagcgtgccggcgggcaggtcgcggaaggacgcgacccgcagctcgtcatgcggtgcggggtgcatcggcacagcgtatgcggcgcgtcgtcaccaccgtcgccggtcccgcgttgtagtgatgaggctacggcctgtggaggacgcgatgatcaagcgcagcaagttgttcggcaacaagacccgggtgaccttcagcctcccggcggacgagccgtccggggtggtcagtgtggtgggcacgttcaacgactggcagccgggccggcacgagctgcaggtgcgccgcaacgggacccgcacggtcagcgtgccgctggacccgggggagtacgaattccgctacctggcgaccggcggcgtgtggttcgacgacccggagggcagcgaactccgcctataagcgtttcaccgcgtgcggtgaggagatgtgctggagtccgtcaaccgactcccgacgaagggcacatcgtggcagacgtcaagctcgcgatcatctactactcggccaccggcaccctgcacaggatggcgcaacgcctgcaggaggcggccgagaaggccggtgccgacgtgcgcctgcggcaggtcgccgagctcgccccgcccgaggcgatcgcctcgaacgcggcctggagccagcacttcgacaccaccaaggacgagccgcgggccgccgcggacgacgtggtctgggccgacgcggtgctgttcggcacgcccacccggtacggcaacgtggccagccagctcaagcagttcatcgacacgctgggcccgcagtgggcgcagggacagctggcgaacaaggcgtacgccgggttcaccgcgtcgatgaccgagcacggcggccaggagtcgacgctgctggccctctacaacacgatctaccacttcggcggggtggtggtggcgcccggctacaccgacccgctgaagttcgccgacggcaatccgtacggcgtctcgcacgtcaccggcggctcgaacgacgcgccgctcaccgacgtgcagtacgccgccctcgatcacctggcgcgccgcatcgtccagatcggtggccgcctgcgggcctag

SEQ ID NO: 4188 - DNA, 798 bp, Actinoplanes utahensis
atggccgtggacacgcagtacgaagatcttctccggcgggtgctggagaccggcacccgcaagagcgaccggaccgggaccggcacccgcagccttttcggcgagcggctgcgctacgacctgtcccaggggtttccgctggtcacgaccaagcgggtgcacttcaagtcgatcgcggtggagctgctgtggttcctgcgcggcgagacgaacgtgcagtggctgcgcgatcagggcgtgacgatctgggacgagtgggcctcggagtcgggcgagctcgggccggtctacggctaccagtggcggtcgtggcccacgccggacggccacgtggaccagatctccgagatcctggacacgttgcgtaccgatccggactcgcgccgcatgatcgtctcggcctggaacgtggggcagctcgacgagatggcgctgatgccgtgccacgcgatgttccagttctacgtggccgacggccggctgtcctgccagctctaccagcgcagcgccgacctgttcctcggcgtgccgttcaacatcgcgtcgtacgcgctgctcacccggatggtcgccgaccaggtcgggctgaccccgggcgacttcatctgggtgggcggcgactgccacatctacgacaaccacgtcgagcaggtgcgcgagcagctcggccggcaggcgtacccgttcccggcactggagatcgcgaagcggcccagcctcttcgactacgagtacgccgacttcaccgtcgtcggctacgagcaccacccggcgatcaaggcgccggtcgcggtatga

SEQ ID NO: 4189 - DNA, 468 bp, Actinoplanes utahensis
atgagcgtgcacctgatctgggcgcaggcgcaccgccgggtgatcggggcgggcggggacatcccctggcacgtgcccggcgagcaggcgatcttcaaggagcggaccgccgggtcgaccgtggtgatgggacgcgccacctgggactcgctgccccggcggccactgccggggcggcgcaacgtggtgctcacccgcgatcccgggtggaccggggacggggcccacgtcgtacacagtccggatctgattggcgaagttgacttctgggtgatcggcggggccgctgtctaccagctgtttctgccggtcgccgagcacattgtgcggacgtcgatcgagctggacgtggagggcgacaccttcgcgccggagctgggcccggactggaaggtgaccgcctccacggggtggctgaccgcgccgaacgggatccgctacgtggtggaggacctagctcgggtctag

SEQ ID NO: 4190 - DNA, 405 bp, Actinoplanes utahensis
atggcaaccgatgagaccaccctgcccacctccgaggacgagtggcggatccggctcgacccggacgagttccgggtgctccgccaggccggcaccgaggcgccctggagcggggagtacgtgaacaccaagaccgagggcatgtaccggtgccgcggctgcggggcggagttgtaccccagtgacacgaagttcgacagccactgcggctggccgtccttcgacgacgcgatcccgggcgcggtcaaggagatcgaggaccgcacccacggcatggtccgcgtcgagatccgctgcgcgcgctgcgacgggcacctgggccacgtgttccggggtgagggcttcaccgacaagaacacgcggcactgcgtcaacagcctgtcgatcaggctagacccgagctag

SEQ ID NO: 4191 - DNA, 486 bp, Actinoplanes utahensis
atggaagctgcatccccgacgttccggccgaccttccagcaggctttcggccacggcctctatctgggcgcgctcagcgcggtggcgagtgtcacgacgggggtgatcgccaccgtggtctggcccgggccggtcggcccgccggcctggtcctgggcgctgctggtgctggcgccgctggtgctcggcgtggtactcgggatcaccctgggtcgacgcaccggggtggaggtcggcagccgggagatccggacctcgtcgctgctcggcgagggcgaggtgccgtggaaccgggtggtggacctgcgcgctgagcggcgcggccggcgcaacgtggtctcggtgtatctggattccggggcgagcgtgcagctgaacgccccgtacagcgggggactgttcgccgccgacccgcagttcgagctcaaggtattcgctttgtcgcatctgtggcgcagccaccgtttcggtggtcttccgagttga

SEQ ID NO: 4192 - DNA, 306 bp, Actinoplanes utahensis
atgcaaacgtacgcaacagcaacagaacggatactcctcatgagctttgttcgtcgactggccgtgggaatccccgctgccggcgtcaccgccttcgctgcgctcgccatctcgtcgcccgtcctcgccgcgtccttcgacgccgcccacccggccgtgcacgccagcgccgaccgcggcaacgcgggctacggggccgcatcgccggcgaccaccacaccggccgccaccgcgccggccgccaccacaccggccgccggcggtccgaccgcgaccgtcgtggcgaccacgccgccggccgcctag

SEQ ID NO: 4193 - DNA, 102 bp, Actinoplanes utahensis
gtggtcgccacgacggtcgcggtcggaccgccggcggccggtgtggtggcggccggcgcggtggcggccggtgtggtggtcgccggcgatgcggccccgtag

SEQ ID NO: 4194 - DNA, 210 bp, Actinoplanes utahensis
gtgagcccgaccggtggcgccaagaccgtgccgggcggggtgagcccgaccgaggtgccgtcgccgatcaccaccaagggcagcggggtcagctccggctcgctgccgctgaccggccgcccggtgggcgcgaccgtcgcggtcggcgcggtgctggtggccggcggcgcgggcgcgctgtggtacacccgccgacgcaagtccgcctga

SEQ ID NO: 4195 - DNA, 1026 bp, Actinoplanes utahensis
atgccgaaagccgctgccgaggaacacgagatcgccggccacccggtccgcctgagcagccccgacaagatcgttttcgccgaacgcggcttcaccaaacgcgacgtcttcgagtattaccgttcggtcggcgacggcatcctgcgcgccctccgcgaccgaccgaccaccctgcaacgcttccccgacggcctggagggcgaagcgttcttccagaagcgcatccccacccgcggcgttcccgagtggatccggaccgccaccatcaccttcccgagcggccgtacggcggacgagctctgccccgccgacctggcccacgtcgcctgggccgcgcagatgggcaccgtcgtcttccacccgtggccggtccgcggcggcacccccgaccaccccgacgaactccggatcgacctggacccgcagcccggcctcggtttcagcgacgtgaccgcggccgccgaggtggtccacgaagtcctcgacgacctcggctgggtcggcttccccaaaacctccggcggccgcggcgtgcacgtgtacatccggatcgccccccgctgggatttcgtccaggtccgccgggccgccatcgccctggcccgcgaggtcgaacgccgccgcccgcaggcgatcaccaccgcctggtggaaggaggaacgcggccagcgtgtcttcctcgacttcaaccagatggcccgcgaccggacaatcgcctgcgcctactccctgcgagccaaccggcgggccaccgtgtccaccccggtgacctgggccgaactgcccaccatcaccccggacgacttcgacctgcgcaccgtcccccaccgcttcgccaccctgggcgacccacacgccaccatcgacgacgtccaccacgacctcaccccgctcctggagtgggtcgaccgcgacgagaaaaacggcctgggcgacatgccctaccccccagaccaccccaaaatgccgggcgaacccccgcgagtccagccctccaaaaagaaccccgccaactggcagtcctaa

SEQ ID NO: 4196 - DNA, 456 bp, Actinoplanes utahensis
atggagtttcgggttgctggtcgtgaagatgttcctgccgtactcgctctgctcgcggacgatgagatcagtcgcggtcgtgggttcggcgaggttccggcggagatcggggcggccctctgggcggcgtttgaggcgatcgccgcggatccgcacaacgagttgatcgtcggggtccaggatggggtggtggccggcacctgccagctcacctacctgccggggctgagccggggcggtgcctggcggatgcagatcgaggcggtccggatccgtgccgacctgcgcggcggcggccacggcgcggccatgatgcgctgggcgatcgcccgggccgaggaacgcggctgcgcaatggttcagctcacgtcggacaacaagcgggtggccgcgcaccgcttctacgaacggctcggcttcaccgcctcgcatgtcggcatgaaactcatactctga

SEQ ID NO: 4197 - DNA, 1566 bp, Actinoplanes utahensis
gtgcctcgtcgctcacgttcggtcctcgcactcctcgccgtgctggtcatgaccgccggtggttgcacactgccggcgttcgcgccggagggttccaccgacccggccacgccgggcggcggcgcatcggccgccgcggccggcggcaccgcgcagtggaaaccgtgtcccgacgtgccgacgaaactcgtcggccggggcgccgccggggtcaactacgactgcgccaccgtcgcggtcccccgcgactgggcgaaaccggactccggtcagacgtacgacctggccatgatccggatccgcgccaagtcgcagaaagaccggatcggctcgctgctggtcaacccgggcggtcccggtggctccggcgtcgacctcgccgtctacctgtcgttcgggcccggtttcaacggcctgcccacggagatcaccgacaggttcgacatcgtcggcttcgacccgcgcggggtgagccggtccagcccgctcaaatgcatcccggacgccgagcaggacgccagcttcggctccgaccccgacccggtcagccaggccgagttcgaccaggtcacggcgctgaacaagaagatcgccgatggctgcggccagaaatacggcgaccagctggcgaacttctccaccgagcaggccgcccacgacatggacgcgctgcgcgccgcggtcggcgacccgaaactcacctacctgggcttctcctacggcacgctgctcggcgcgacctacgcccagctgttcccacagaacgtccgggccctggtcctcgacggcgcggtcgacgccaccgaggattacgtgaccagctcggaaacccaggccaagggattcgagcgggccttcggcaacttcaccaagtggtgccaggcgaccccggcgaaatgcccgatctccgccgacccgcgcggcgcggtcaccgccgccatggcgaatgcggagaagtccccggtcaaataccgcgacggccgcagcgccaccgccgggtggatcttcgtcggggtgatttcctcgctctacaccgaaaccggctggaccagcctcgccgacgccatccgcgacctcggccgcggcgacgccaagggcatcctggacctggccgaccagtacgccgagcgcaaggccgatggctcgtactccaacctgttcgacgctaacctggccgtcaactgctccgacaccgagggcgcacccaccgtcgaccaggtccgcaaataccagtccgagtggcgcaagaaatacccgatgttcggcgccccgatcgccatcggcatgctcccctgcacctactggcccggcaaacgcgacccgtacccgaccggggccgccaagggcgccccgcccatcgtcgtcgtcggcaccaccggcgacccggccacgccgtacgagaacaccgcccacctggccgccatgctgggcaccgggcacgtgctcacctgggagggcgagggccacaccgcgtatccgtcgacgccctgcatcaccagcgcggtcgacggctacctgctgaacctgaccgtgcccaaggaggggttgcgctgcccggccaagtga

SEQ ID NO: 4198 - DNA, 1455 bp, Actinoplanes utahensis
gtgcgcccgcagcgccgccacggtcagcagcgcgctgtcccggcagcagccggtcagccgctgctgcagcggccggtcggcgtccagcggcgcgccaccgaaccgctcctcgtccaggtcgagcatccggctcacccaccgggtgtcgatgtcggtgagccgctccggcgggaagtcgatgccggaggcgcggtagtgcacggtcaggttgcgcaccacggccccgatcgcgtcggcgtcggcgggcagcgcggcgagccgctcgcggtgccggcccgggtcggagaatcgagtctgtcgtgtccagtccatgcgatcgatagtggagtctctccccgtggcagggtaaaggcttcccccgacgagaattccgggcagactgagcggatgcagctgccgatccagcatccggtcaagccgatgctcgccaagcccgttccggagatcccgcccggcctgatctacgagcccaagtgggacggcttccggtcgatcatcttccgggacggcgacgaggtggagatcggcagccgcaacgagaaaccgatgacccggtacttccccgaggtcgtcgaggcggtcctggccaacttcccggagcgggcggtgatcgacggcgaggtgatcgtcgccgacaccggtcgcaacaccctcgacttcgaggcactgcagcagcggatccaccccgccgccagccgggtcaagctgctctcggagcagaccccggccagcttcgtcgccttcgacctgctggcgctcggcgacgaggacctcaccgagctgcccttcgagcagcggcgggaacgcttgcggcaggcgttgggccaggccgaggcgccggtgtacgtcacgccggccaccgatgacaccgacaccgcgcgccggtggttcgaggagttcgagggcgccgggctggacgggctgatcgccaagggacgggagctcacctaccagcccgacaagcgggtcatgttcaagatcaagcacaagcggaccgcggactgcgtggtcgccgggtaccgggtgcacaagtcggcggagaaccggatcggctcgctgctgctcggcctctacgacgagcgcggcgtgctggcctcggtcggggtcatcggctcgttcccgatgaaggtccgcgaggagctgttcgaccagatgcagccgctggtcaccggcttcgacgggcacccctgggactgggccgcccaccagcagggcgaacgcaccccgcgcaagaacgaggtgagccggtggaacgccggcaaggacctgtcgttcgtcccgctgcgcccggaacgggtcgtcgaggtccgctacgactacatggagggcgtccggttccggcacaccgcgcagttcgagcgctggcggcccgaccgggagccccgcacctgcacgtacgagcagttggagcgccccgtccggttcgatctcgccgaggttctcaccagccgctga

SEQ ID NO: 4199 - DNA, 369 bp, Actinoplanes utahensis
atgaggatcccctacgagtacgcggtgatccaggccgtgccgcgggtcgagcgcggtgagctgatcaacgtcggggtgctgctctactgccagcgccacgacttcctctcggcccgcacccacctgaccgagtcccggctgctggccctcgacccgtccgccgacgtgcccgccgtccgcgccgccctggactcctgggaggccacctgccggggcggcggcgcctcggccgggatgcggctcggcgagcggttccgctggctggtcgccccgcgcagcaccatcctgcgggccgggccggtccacatgggcctcaccgtggaaccggccgccgagctggagcgactcgtcgggctactggtgcactga

SEQ ID NO: 4200 - DNA, 723 bp, Actinoplanes utahensis
gtgctacgtgaggtcaccgcgatcaggtatgtgacgcccctgagagagggcggttcgctgcccggcgtcgtcgaggccgacgacctcgggacgtacgtggtgaagttccgcggcgccgggcagggaccgaaagcgctggtggccgaggtgatcgccggtgagctggcgcgccgcctcggcctgccggtgccggagctggcccgcgtcgagctggacccggtggtcgcccgggccgagccggacgaggaggtccaggagctgatcaaggcgagcgccggcggcaacctggggatggacttcctgcccggcgcgctcggctacgacccgaacgcgcacccggtcgaggccgggctggccagccgggtgctggccttcgacgcgtacgtggagaacgtcgaccgcagctggcgcaacccgaacctgctgatctggcacggcggcctgtggctgatcgaccacggcgccaccctgtacttccaccacgactgggcgcgggccgaggcggtggtgcaccgcccctaccggtgggaggaccacgtgctcaagccgtacgccaccgcgctggccaccgagggcccggcgctggccgcccggctcacccgcgacctgctggccgaggtggtcgccctggtcccgcaggactggctggacgacggcgaccgcgaagcctacctcgaccacctcgcgcgccgcgccgagcgtccggaggcctggctgccatga

SEQ ID NO: 4201 - DNA, 534 bp, Actinoplanes utahensis
atgcgtttccggcctaccgacccgcccgccgccgacgacgccgccgcctggatcaccggcgccgtcccggacggctggttcaccgagccgcccgaggtcgtcaccgaccgcgacgagatcatcatctggggccggctgcccgagccggacctgccggccgaggccaccgacgccgaccgcgccgccgccctcgccggacggatcacccagttccgggagaacacccgcgacgaccgaatccgggtcgcccgccaggtcgagcaccgctaccagcgcaaggtcgcctggggcgtccgctgcggcagcgccgacgagctctggacgcacctgtccgcgccggtgatgacccggctgcgccaacccgagcgccaggtcctggacacgctcgtcgacgccggcgtggcccgctcccgctcggacgcgctggcctggtgcgtccggctggtcggcgagcacaccgaggagtggctggccggcctgcgcgacgccatgaccaaggtcgacgagttgcggaaacagggcccactaagctga

SEQ ID NO: 4202 - DNA, 882 bp, Actinoplanes utahensis
atggaagactcacgcttcaccagggcgaacctcctgttcgtcggcctgatcgcggtgttgggggtgggggccttcttcaccgccgtgcaatccgggcggcaggacagcgcgttgctcttcgtggcttttccgaccgtgctggctgtgctggtggcgctgtatccgaccggcaccacccacggcacggtcttccgcttcaccacggtcgccctgctggtctgcgccgtgcagctgcatgagggggcgatctgcgtggtgctcgccgcaccgctggtctacctggtcgcgcacggcgtcaccgggctggtccggatgtcgaaacggcgcggcaaccacctgtatgcgctgctgccgctgcccctcctgctggtcggcagtgcggaggggaccagcggcgacctccggatccacccggaccagtcggtcgaggtcacccgcgtggtcgccctcgcacccgaccaggtccgcgccgtcctggaggccggcccgcagccgacagccacccgctcgctgccgctgcgcctgctcgacgtcccggtgcccgagcacgtgcacggcgacggcctggcccccggcgaccgctggaccttcgtctaccacggcagctcgcacggccccggcggcgacatcgtcacccgggtcaccgatgccgggccggcccgggtcacctggagcgtcatcgaggacacctcgatcaccggccgctgggtcgggatgcgcgacgccaccctgacctggcacaccgtcccggccggcacctcgatcacgctgcgcgtcgactaccgccgcggcctcgacccgagctggtatttcggcccgctgcaggacggcctgatgcacgccggcgccgagcacctcctcgacatgctgtcgctgcgatga

SEQ ID NO: 4203 - DNA, 1260 bp, Actinoplanes utahensis
atgaccctcgtccggtacgcgtcgctgctgctgcccgccgcggccctgctcgcggccgggcggtatccgaaggcgagccgccaagaccgcgccggtgcattcctcgcgttcctgaccaccgccctcgggatcgccgtcctgcacgaggtggccacggcgtccggctggtggcggttcgccccggccgacggcgcctaccgcgggatgccggtcgacctgtggctgggctgggccaccctgtggggtccggtccccacgctgctgcatcgacacgtacggccgcaatatgctcttgccgttctgctctggctcgacctgatcacgatgccgcgcctggaaccgctgctgcacctcggcccgcactggctgctcggcgaggcgctcgggctgatcctgatcgccctgccggcgcagctgctcgggcgctggacggccaccggccggcacctgcagccgcgcgtcatcctgcagatgatcctgttcaccgggctgatcctctggctgctgccgaccgtcgtcttcaccctcggcgacgggggctggaatcacctggtcgccctgccccgctccacgctgaccgttctggcccaggtggcggcgctgctcggggtgcccgcggtcgccgccgtgcgggagttcgcggtgcgcggcggcggcaccccgttcccctgggatccgccggtgcggctggtcaccaccgggccgtacgcgtacgtcgccaacccgatgcagctgagcatggtcgccgagctggccctgctggccggggccacgcacagcctggcgctgggcgccgccacgctcggcgcggtcgccttctcgaccgcggtcgcggcgccccacgagcacggtgacctcggcgaacggcacggggaggggtggcgggcgtaccgacgtgaggtcgtcgactggcggccacgcggacgcccgtacagcgccatcgcctctgcttcgatcttcatcgacgacgactgcggcccgtgcgcggcgacccgggacttcctgctccggcgcgcgcccgtacggttggctgtcgtgcccgccgccacccacccgacgacgctgtggcgagcgcggtacgccgcggacgacggctactccgccgagggtgtggcggcggtcgccgccgcgttcgatcatctcggcatcggctgggcgtacgccggatggttcctgcgcctgccggcggtgaccgcgctcgcccagctgatcaccgacgcccagatcgccccaccccaccccgccggaggacaacggtga

SEQ ID NO: 4204 - DNA, 630 bp, Actinoplanes utahensis
gtgagcgacaccaaacaacggctgctcgacggcgccctggccgcggtccgcgaccacggcgtgaccgggacctcggcccgcaccatcgccgccgcggccggcgtcaaccaggccctggtcttctaccactacggctcggtcgacgaactgctcggcgcggcctgccggcaggccaccgaggcgcgggtggcgctctacgccgaccggttcgccgcggtcaccacgctgcgcgaactgctggaggtcggccgcgacctgcacaccaccgaactggcccagggcaacgtgtcggtgctggcgcagacgctggccgcggcgcagaccaacgagcggctggccgagccgatccgggccaccttccagctgtggaccgacgagatcgagaaggtgctgcgccgggtgctggccggctcgccgatcgccgaggtcgccgacgtgcccgggctggcccaggcgatctcgtcggcattcgtcgggctggaactcttcgagggcatcgacccggccggcgggcaccgggccatggaggcgatcgaccagctcgccgtgttggtcgaggtgatggacgaactgggtccgctggccacccgggtgctgcggtcccggatcaaaaaagccggcaaaaagtag

SEQ ID NO: 4205 - DNA, 1467 bp, Actinoplanes utahensis
atggacgatccgcgcgcccagcgacttttcggcgacagcacggttgcccccggcgatctggctttcagcccgttccgtgtcgaccgggaccggatcgtcagctccccgttcttcgcccgcctcgccggggtcacccaggtgatcagccccggcggggccgggctgctggtgcacaaccggctcacccacagtttgaaggtcgcgcaggtggcccgggcgatcgccgagcggatcggggccgccgagccggatctggcggagaagctgggcggctgtgacccggatgtggtggaggccgccgcgctcgcccacgatctggggcacccgccgttcgggcatctgggtgagcgggtgctggacaggctggcccggcagcggctgggcctgccggacggtttcgagggcaatgcccagtcgtatcggatcgtgaccagcaccgagatccgcgggcaggccacgatcgggttgaacctgacgaacgccacccgggcggcgatcctgaagtatccgtggacccggcacgactatccggagccgcacccccggttcatggatccgccgccgcgcggggcggccgcccacccggaggagccggcgggtggttcgacgaagttcagcgcctattcgaccgaggtcggcgatgtgcgggcggcccgggcgccgttcgccgggcgggtggcggactggcagcagacggtcgaggcgtcggtgatggacacggccgacgacatcgcgtacgccatccatgacctggaagatgtgcatcgggtcggcgtgttgcagcagggtgcggtcgccaccgagttgatggcgtggcagcggtggggcgccgagacggacctgcgccgggccggcggggcgatcgagtcgctgcgccgcagcctgcaccgcaaggagggctggatcgccgacgacgacgcgttcgccggcgcggtggagttggtccgggccgagctggtggacgggctgctggcccagccgttcgacgggtcggtgcaggccgaggcgcgggtggcggcgttctcggcgacctggacccggcggctggtcgactcggtggagttgaccgagcaggccgcggtgcgcagcgggcacgtgcagctgtccgtggcgcagtggcacgaggtgcaggtgctcaagttcgtgcagaacaggttcgtgctggcccgtcccgacctggcgctgcaccagcgcgggcagggtcggctgctgtcctcgctggtggaggcgttgctggcctggctgaccgatccggacgaggcggaccggctgccgcggcggctgcgggatctggtcgagctggccgagtcggagctgccggcggacaccccgcagcggatcggtcgggcccgcgggcgcgcggtggtcgacttcgtggccgggctgaccgacgggcaggcggtggggctgatggaggcgctgtccggtcgctcgcggcagctctggacggacgccttcgtcctgtga

SEQ ID NO: 4206 - DNA, 579 bp, Actinoplanes utahensis
gtgacgatcgatatcctccaggcgcagtcgcagttgatcgtgcgccagcgcattcgtttgatggtgaaccagtacgaggtccacgcggtgaccccggacgggcaggaagccggcatcctcgccttcgcgcagcagaagcggctggcgttcaaggagcaggtgaccctgtacaccgatgacaccaagcaggtgccggtgctgggcttcaaggcccgccaggtgatcgacctgggcgccacctacgacgtgttcgacgcggccggcgtggtgatcggcctgttccgcaagaagttcggcgcgtcactgctgcgctcgacctgggtgctggagcagccgggctggccggagatcgtcggccaggagcggaacgcgttcgtggcgatcctgcgccgtttcgtggactcgctgtcctggctgccgtaccacttcgacttcgtggtcgacggccggccggcgttctcggtggagcgcaagtggggcctgcgggacacctaccgggtcgcgatccacgagccgaacctggaccgtcgcctggtggccgcgatggccgtcgcgttggacgcgctgcagtcccggtaa

SEQ ID NO: 4207 - DNA, 1107 bp, Actinoplanes utahensis
atggcgaagcgtgttcgtacccgtacggtggtggctctggcgctcggcgccgcggcggtctgggccgcccgcgacctgcccgcgcagatcggcgcgagagcgagcggcgcccgccgcatgcggatggagtcctccccgcagttctccggcggcagattccgcaacacggtcccggccaccgaggtcacggccgcgtcgatgccgcgcctgttcgtcgccgcgatgaccgaccgtgacgcccgccgcccgcacctgccggtcccggtggtcaccccgcccaccgccccggccccggccgacggcctgcacgtcacctggtacggccactcgtccgccctggtcgagatcgagggccgccgggtcctgctcgacccggtctggagcgaccgctgctccccgtcccgcctcaccggcccccgccgcctgcaccagccccccgccccgttgcgcgagctccccccactcgacgcgatcgtgatctcccacgaccactacgaccacctggacatgaccagcatccagcacctggtcgacctgcaggccgccccgttcctggtccccctcggcgtcggcgcccacctggagcgctggggcgtccccgagtcccgcatcgtcgaactcgactggaacgagtcccaccggatcggcaccctggaggtgatcgccaccccggcccggcacttctccggccgtggcctcaaccgcgacgagaccctctgggccagctgggtgctgaagggcccgacccgccgcgccttctactccggcgacaccggctatttccccggcttcgccgagatcggcgccgaacacggcccgttcgacgtcaccctcgtgcaggtcggcgcctacggcgacgcctggcccgacatccacatgttcccggaggacggcgtcgccgtccacgccgacgttcgcggcggcctgatgatcccggtccactgggccaccttcaatctcgctctccacgactggtccgaacccgccgaccgcacctgggccgaagccaaggcccgcggcgtcaaactggccatcccccgccccggcgaacgcgtcgacgtcgacaacccgcccccggtcgacggctggtggcagcagatcgcctga

SEQ ID NO: 4208 - DNA, 525 bp, Actinoplanes utahensis
atggccggtcgacacgtctccacggccgcggacgtcgtcgcgctgttcgacgcgctggacgtgcaccgggtgcaggcctgcctcggcggtgggtgggctgtcgacgccctgctcggcgaacagacccgcgagcattccgacatcgacctgtggttgccggccacccacctggagtgggcgttccgcgccttcgccgccctgggcgtcgaccgtctgttccccacccccggcgaccgcccctggaacttcgttctccacgacggcgaccgccgcaaaatcgacctgcacctgtacgagacccgcccggacggccggctgcactacggctccgccctgaccggcgaacccttccccgccgccgccctctccggccgcggcgagatcatcggccgcccagtccgctgcgaagcccccgtctgggccgtcacctggcacaccggctatccaccccgagccgccgaccgccacgacgtccccctcctctgcgcccgcttcggcatccccctccccgagaccttcgcctga

SEQ ID NO: 4209 - DNA, 219 bp, Actinoplanes utahensis
atgatcactcgcctgctcggcgccctgctggccgccgtagccgtcccgttcctcgcctaccgcgccggccgcacccacgccgcctggcaggacgcccgctccacccgccgctcgctgcgccaggaccgccgcaccgcctgggcacacaccgcccgattagccgccggcgcgctcgtcctgctcgccggcctgaccgccgccgccctcggcctcttctga

SEQ ID NO: 4210 - DNA, 897 bp, Actinoplanes utahensis
atgcgaaccccccgcacgatcgccgtcgttgcccatcagaacaagaccctgggcggcgggctggacgagctacgccgccgtctcaccgaccacgacatcaagaaactgctgtggtacgaggtcccgaagagccgcaaagccccgaagcaggtccgcaaggcgctccgggagaaaccggacctgctggtcgtctggggcggtgacgggatggtgcagcgcaccctggacgtggtcgccggctcggacaccccggtcgcgatcatgccggccggcaccggcaacctgctggccggcaacctcggcatcccgaccgacatggaacgcgccgtggagatcgccttcgagggcgaccgcaagcgtctcgacctcggcaaggtcgacggcgagcacttcgcggtgatggccggcgtcggcttcgacggcgcgatgatcaaggacgccgacggtgccctgaaggaccggttcggcaaactggcgtacgtctggaccggcatccgccacgtcgacggcgacgccccgcgcaccaccatcaagatcgacggcaccgcctggttcgacgacacggccagctgcgtcctgatcggcaacgtcggcacgatcaccggcggtatccacgccttcgacgacgcctcccccaccgacggctggctggacgtcggcgtcgccaccgcccagggcgccctgcaatgggcccgcgccctcggcacgatggcggtgaagcggtcggacagctctccgttcgtccgcaccacccgggcccgcaagatcgacgtcaagctggagtcgaagctcgaatacgagctcgacggcggcgcccgctcccgcaccaagcggttctccgcctcgatcgtcccggccgcggtccaggtctgcgtaccggctgtgaccgataactga

SEQ ID NO: 4211 - DNA, 969 bp, Actinoplanes utahensis
atggccctgacccccgcaccggggacagggccatcggcttttctgtggcacagtttcgaggtgacctctgcgctgacccggcgcctgacaccgcccgagcggtatcagttcggcgcgtcggtgcgcccgctgctggtgccgaaacacgatccgtgcggcgcgatccgcgacggcgcgttctggctcgccttccgcggcccggccggtgccgcgaccctctgcctgaccagggcggccggtgagctgctggccaccgggtacgggccgggcgccgagtgggtgctcgaccgcgccgacgccgtcgccggcctgcgcgacgacgtcaccggctttcccgagctggcccggcggcatccggtggtggcgaaactggccggcacgttcaccggggtgcggatgccggccaccgggcagatcttcccccggctgctgcgcgccatcctggagcagaaggtcaccggcaccgaggcccatcggtcgtaccgggcgatctgccggcatttcggtgagcccgcgcccggcccggccgggctggtgctgccgcccgatcccgcgatgatcgccggcacggcgtactgggagttccaccggcacggcgtcgagcagcgccgcacccaggccctgctgcgcgccgccgcggtcgccgagcggctggagcggtgcgccgatccggccgaggccacccggcgaatgacggcgctcccgcagatcggcccgtggacggccgccgaggtggtccgcacggtgttcggcgacccggacgcggtcagcgtcggcgactaccacatccccaacacggtggcgtacgcgctggccggcgagccgcgcggcaccgacgagcggatgctggagctgctcgagccgttccgcggccaccgggggcgggtctgcgacctgctcgccctgggcggattgatggccccgcggtacgggccgcggatgccggtgcggtcgttcgcgcgcttctga

SEQ ID NO: 4212 - DNA, 1254 bp, Actinoplanes utahensis
atgcgaaggtcaaagtaccggcgcgccactggacccacatggttcagcggacgccgccggatcatcgccgtggcggccacgctggcggcgttcggcggcatcgtgacggttacgcagatctcgagcgccagcaccaaccccaacaccaagtccgcgctcgccgcctgcgacaacctcaaggcgggtgggcagaccaagttgtcgaccaacacccgccgcgacacgtacaccaccgacaacggcacggtcacccagcatccggacgacgggtcggccgatgtggcgacgacggcgcaggtgcgggcccggtgccgcgactgggtgatgaagaacgtcggcaacaaccagaacaaccggcgccgcgggaacaacaacaacggcgccggtcagaacaccggcggtcagaacaccggcggtcagaacaccggcggtcagaacaccggcggcggccagaacaacggcgccggcgcgccggcgagccaggcggccagcgcgccggccaccaacgccggcggccagaacaacaacaacggcggcggccagaacaacaacggcggcggcggccagaacaacaacggcggtcagaacaacaacaacggcggcgcccagaacaacaacggcggtcagaacaacaacaacggcggcgcccagaacaacggtggccagaacaacggtggcaacaacggtgccaccaccccgccgcccggtgccggcctcggcatcctcaccaacagctgcgcgaccagcaacctgcccgcccacgacggcttccagaagggcgaccgctgcgtcagcaccgagttcggtgaggtcggctcggcggccaacaacccgtcgctgctgatcacccaggcgccccgcgtggtcaaccggaacaccgccttcaccctcaaggtcagcacccgcaacctgatccgcgaccgcttcctggccgccggccagggcggttactacgtcgagtccagcgtgctgcagaacggcatcgtccgcggccacttccacaccgcctgccggatgctcgccaacaccaacgaggcgcccgcgccggacccggtgccggcgttcttcgtcgccaccgaggacagcaagggcggccgcaccccggacacggtgaccatccaggtcccgggcctgccgacgggcggcaccgcgcagtgcgcctcgtgggccggtgacggctcgcaccggatcccgatgatggagcgtgccaaccagacccccgccttcgacgtggtccgcgtccgggtccgctga

SEQ ID NO: 4213 - DNA, 759 bp, Actinoplanes utahensis
atgaagtcctggttggtgggtgcaacgaccgtggtgctggcgttcatgctgacgccggccggggccgcgcacgccgacgacggagttccggtgccgccgaacaccgggctcaccgacaccgcgaaaggcacggtcagtgccgcggacaaagacttcgtgatcaaggtgcggctggccggcctctgggagatcccggccggcaacatggcccaggagaagtcggacgacccgaacatcgtcaagatcggcaagtcgatctcggcgcagcacgtcgtcctggacgagctggaccgggccgtcgccaagaagctcggcatcgacctgcccaaccagcccaacggcgaccagcagggctggctcgccgagatgcgcaacgcctcgggcggccagttcaaccagatctacgtcgaccggctgcgcgccgcgcacggcaagatctttccggcgatcgccacgatccgcgcgtcgacccgcaacgacagcgtccgcaagctcgcccagcaggccaaccagttcgtcatgacgcacatgaccctgctggagagcagcggcatcgtcgactacggtgcgctgcccaccgcggccgccccggtcgctcccgggcagaagggcccggtgccgatcgacaaccagatgatcgccgccgccggcaacggtggtggagtaccgggtctcagcaacaccgtagtcctgctcgtcctggctgccgcgctggtggtcggcgtgatcaccacgatgcgcatcttccgttcgcggtag

SEQ ID NO: 4214 - DNA, 432 bp, Actinoplanes utahensis
gtgaccaagtcgctcaccggcacctcggtcgcccggatgggtcaggtcgtggagaaccagaacggtttcgttctgtaccgcttcgacgacgacggccacgacccggccaagtccaactgcaacggcgactgcgccaaggtgtggccgccggcgctgaccaacgacggcaagccgaccctcaaggacgtcgacgccaaactggtcggcacggtcacccgggcggacggcaccaagcagctgaccctcgccggttggccgctctaccactacgtcggggacaagaagccggggcagtggaagggccagaacgtcaacggcaagtggttcgtggtcacgccgaccggtaccaagaacctcacctgcctccccaagatctcgaagccggtggcgccgccctccggcagcgattccgccggcgactacagctactga

SEQ ID NO: 4215 - DNA, 174 bp, Actinoplanes utahensis
atggtcaccggcgtggcgctggcggcactcgtggcactgcccggttgcgctccggccggctacaacgcggccgactacggcaacgcggcccagcccgccgcggccgacgtggccgcgaccccgggcgccgcgtcgaccgccggtgcggtcgacccgaacgtcgccgggacctag

SEQ ID NO: 4216 - DNA, 777 bp, Actinoplanes utahensis
atgacacaggaagaccactacgacgtcgcgtcatacgccctgggcgtgctcgacgagcgcgacgccgcccggttcgaggaccacctgatcgagtgcccgcagtgcgccctcgagctggagtccttcgtccaggtggccgacgtgctggccgatgtggacgcggaggccctgctggccgccgagaagtcggagcaggacggcctgctgctgaacaagatgatccgcgaggtccggtcggaccggcagcgggccaacagccggcggctctactcgctggccgccgccgtggtcatcttcgccatgctctccatcggcgcactcttcgccggcggcaagtggctcggctcggacacgtcgaagaacccggcgaccaccgcgcagcgcggcagcgaccagctcgacccgctgccggacagcaacggcctcggcatcggcggcaccgcactgccgggcgagaaccacagcagtgcagactcgcgcaccaacgtgcggggggcggtcggcctggagaccaaggactggggcacgcagatctccttcgcggtcagcaacctcaagggcccgaagacgtgcgcactgaccatcgtgcaccgcgacggcacctcggagcgggtggccacctggacgatcggcgccaagggctggggcaccgccgccaacccggccccgctgatgctgcaggcggtcaccggcaccccgcgcgacgacatcgcccacgtgcaggtgcaggaactgacccccggtggcggttccgagactctggtgagcattctgtaa

SEQ ID NO: 4217 - DNA, 678 bp, Actinoplanes utahensis
atgcatgcggtggccgaggatcggctcacgccggagagggtgcgtgtgatggcgcgacactccgggagcaggtggcaggcgattgacggaggccgtggtgcacaggatgacggttcggtgatcccccgccagacggcccgccacgaggcgccggccagcggccccagccacgaggacacgctggtcaagctgctgtacgaggagcacgcgggaccgctgctgatgttcgtgctgcggctgaccggcggtgaccggcagcgcgccgaggacatcgtgcaggagaccctgctgcgggcctggcgcaacgcgcaccggctcggtgcgcagggccagcagtccctgcggccgtggctggtcacggtggcccgccggatcgcgatcgacgagcaccgcagcgcgaacgcgcgccccgcggagacgtacgaccgcgagctggagagcttcccgagcaccgcggacgacaccgaccgcgtgctgcagtcgatgaccgtgtcggatgccctccggcagctgagcaactcccaccgggagatcctgatcgagacctacttccgggggcggaccgtgcccgaggcggccgaggcgctcaaccttccgctgggtacggcgaagtcccgcgtgtattacgctctgcgtgcgctgcgtaccgctctgcagcagcggggggtgacggaatga

SEQ ID NO: 4218 - DNA, 969 bp, Actinoplanes utahensis
gtgacacggatgttcgtcgacgcgtgggacccggcgtacggggcgagtttcgagggcggggacggcgaggggccggcctcgcccagcagcgcgcaggtggaggtcgacgtcgaggtgccggccgccgcgtgggcgccgatcgacgtgccggccggggcccgggcaccgcgggtggtgttcctggtcgacggcgtgcgccgcaacgacgcgcagatctggacggcggaggaggacggcacctcgtacgccgggctggccgcctccttcgcggccggcgtggtgcgctgcgatctgggccgcggggtggccgagctggtggcggcgcgggtggggcgggggttgttcaccgcgagcccgtcgatcgccgatctgcaggccggcacggtccgctacgagatccaccggatcaacgggaccggtgaggcgagcaagctgccggccgcggtccaggggccgctcaccgcgctggagatcgagatctccagcgccgcccgggacaccggatcggacggcgccgacctgctgatcgtcgacggcccgctgcgcaaccggcgtcagctgccgcgcaccatcggctacatcaagacccagcagaagcagtatctgccgaccgccctcaccgcggtggtgaccgcgctgcgtccgggccagcgcaccccggtcttccacctgggctcgctgtggggcggctggtcctggtatctgcggctgcccggggccaccggcgcgccgtggtcggggatcgtccgggtggagtgttcccccgagctgaccgtcgatcaggcgatcgaactggccgggctgtccggggcgacgctgccgaggttcgcctcctcgtcgtacaaggatccccgggccccgcagaacctggtgccgatcgccgggctggagcgccgcctgcgcggcatgctgggtgactcgcgggtactccaccgggctctggcgctggccaccgcagcctcccgctga

SEQ ID NO: 4219 - DNA, 735 bp, Actinoplanes utahensis
gtgctgtccgcgcacggatccacggccgccgcgcaggacgcgatcgccgcgctgttcaccgccgccggggtgcggccgccggcgaccgccccggaggacgccgaggccaccctgatccgggcggccgcggtcgccgccgagcgggccgaggccgcctggcagcgtctggtggagcggcacaagcaggctcgcgagcagcaggagcggcggatgacgctgcagcgggagagccgggtggccaagtcgctcgccggtcacctgcgggccaacaacttcgagcgctggctgctggaggaggcgctggacctgctggtcgacggcgcctcgcggatcctgcgcgagctcaccggcgggcagtacgaattgatgcacgacaagggcgagttctcggtgatcgaccaccacgacgccgggttgcgccggggtgtgcgcacgctctccggcggggagacgttccaggcgtcgctggccctggcgctggccctgtccgagcaactggccgggatgagcaccaccgcggccagcctggagtcgatcgtgctggacgagggtttcggcacgctggacgccgccacgctcgacgtggtggcggccacgctggaaaatctggccgcccgcggcgaccggatggtcgggctggtcacccacgtgcaggcgctggccgagcgggtgccggtccggttcgaggtccacaaggacgcgcggaccgcgcacgtcgagagggtcggcctgtga

SEQ ID NO: 4220 - DNA, 1206 bp, Actinoplanes utahensis
atgaggccccttcggctggacatgtccggtttcacggtgttccgcgaccagaccaccgtggacttcaccgacgccgactacttcgcgctggtcggcccgaccggctcgggcaagtcgaccgtgctggacgcgatctgcttcgtgctgtacggccaggtgccgcgctggggtggcgcccgcgggatcggcaacgcgctcgccccgtccgcggccgaggcgcgggtccggctggtcttcgagtcggccggtgaccgctacgtggcgacccgggtggtgcgccgcgacggccggggcaacgtcaagacgtccggcgccggcctgcagctgatgccgcccggcttcgacgtgaccaagctggacaccggcatggacctgaccgacctgggcgaggtgctggccggcgtcccggccgagatggacgacgcggtgctgcacgcggtcggtttgccctacgagcagttcaccagctgcgtggtgctgccgcagggccagttcgccgacttcctgcacgccaagccggcggtccggcaacagatcctgatcaacctgctcggcctgcagatgtacgagcgggtccaggagaaggcggccgagcggggcaagaccgccgagaccaagctgaccatggtcgaccagtcgctggccgccctccaggacgccaccgacgaggcggtcgaggcggcggccgggcacctggcccggatgcgggagctgaccggcgcggtcgaggccgcgatgccggggctgcgcgaggcccgggcggccgagtcggccgcccgcgacgcccgggacacgctggacgccgagctggcactgctcgcctcggtgcgtactccggacaatctggacgaggcgaccggcgccgtcaccgcggcccgcgacgccgccgcccgggcggcgcaggcggtgcacgaggccgaggaggccgaggagaaggtccgcggcgagctggccgcggccggcgacccgggttcgctgcgcctggcgctggaccggcacaccgagctgtcccgcctggtcgagcaggagggctggttcgccggcaaggtgtcggtggccgagatggagtgccgggacgcgcgcgccgcggccgacctcgccgagtccgagcacaccggcgcgcagcagctgctggagcaggcccggcaggactaccgggacgcccagcagcgggaccgggcggtcgcgctgcgcgggcatctctag

SEQ ID NO: 4221 - DNA, 1152 bp, Actinoplanes utahensis
atgcgcatcctgcacacctccgactggcacgtcggcaaggttctcaagggccgcaaccggcacgacgagcacatccgggtgctcgcccaggtggtggagatcgcccgggcggagaaacccgacctggtgatcgtcgccggcgacctctacgacaccgcggcgccgaccgcggacgccacccggctggtcacccgcgcgctgtccgcgctgcggcagaccggcgcccgggtggtggcgatcggcggcaaccacgacaacgggcaggcgctggacgcactgcgcccgtgggccgacgcggccggcatcgagctgcgcggctcggtccgggacagcctgggcgacctgctgatcgagggcaccaccgcgggcggcgagcggtggcggctggtggcgttgccgttcctgtcccagcggtacgcgatccgcgccgccgagatgtacgagttgaccgaggcggaggccaatcagacgtacgccgatctgatcgcgcgcctgatcgccaagctcgccgagccgttcggcgagcccggcgtggtcaacctgatcacctcgcacctgaccctggtcggggcgagcaccggcggcggtgagcgcgaggcgcacaccatcatggggtacgccgtgccctccaccgtcttcccgcagaacacgcactacgtcgcgctcggtcacctgcaccgcgcgcagcgggtgatcggcccgtgcccggtgcgctactgcggcagcccgctcgccatcgacttcggcgaggaggagaacgtctgctcggtggcggtcgtcgacgtcggcgtggacagggcggcccaggtccgcgacgtgccggtgacctcggcgatcaccctgcgcacggtgcgcggcaccctcgaacagctggccacggtgaaccttccggaggcctggctgcgtgtcctggtgcgcgaggcgccccgccccggcctgcgcgaggacgtgcaggagctgctgccgaacgcgttggaggtacggatcgacccggacatgctgccggagcgcaccggggcccgggccgccgagcgcgccggccggtcgccgcgtgagctgttcggcgactacctggacagtcgcggcaacgccgaggagggtgtccgcgagctcttcgaccagctgtacgacgaggtgagcagcaaccaatga

SEQ ID NO: 4222 - DNA, 1746 bp, Actinoplanes utahensis
atgatccccgtgtctgacgaaacttcccccgtcgggcgggtgctcggcaccgccgacgcgaccccgctccagttctggacggccgtcgcccccggcagctacctgcagctcgacgacgtcgtgaccaccaggcgtgatctgcccgaccgcgagccggtgaccatctccggcgtggtcacccaggtccgcgcccggcacgagggcgcccagttcgactcggacgtgttcgccatcgccgacggcaccctgcccgcgatggtccaggaggcggccgagatcaccaccacccgggtcgacccggagctctacgttccgccggccccgggcgcgatcgtgcaccgcgcctccggcgaggaccgcgacgccgccctgcacttcgaccggatggagcgccgggtcccgatgggcaccggccgcgacggcgtcccggtcttcctgaacgcggacttcctggacggcacccgcggcgcgcacgtgtcgatctccggcatctccggcgtcgccaccaagacgagtttcgccaccttcctgctctactcggtgttccgctccggccagctcggcgccgacggggcgaacgcccgggcactgatcttcaacgtgaagggcgaggatctgctcttcctcgaccacccgaacacgaagctggacgaccccacccgggcctactacaagctgctcgacctgcccgacagcccgttcaccgacgtgcgggtctacgccccgccgcggcccggcgacccgtccggcgcccccgacgtgagcggccggctgaccggcgtcgacgcgttctactggacgctcgacgagttctgttccaccaagctgttgccgtacgtgttcgccgacgccgacgacgagcgccagcaatacaccatggtggtccactcggtcaccgcccacctgcaccgtttcgccgtcccggccgagggcgggatcagcatcgacggccgccggatcggctcgtacggcgatctggtcgaccacatcgtcgagcagctcaccgacgacgagacccgctccacctgggccggcagcgcggtcagcatgggcacggtcaacgcgttcgcccgccgcctgatcggcagcaagcgtgatctggcccggctgatccgcggcgacctggcgcagcgccgcccgcaccagatcaagaccgcggacagcgcccaggtcaccgtcgtcgacctgcacaacctgccggaccgcgcgcagcgcttcgtggtcggcgtcacgctcaagagcgagttcgaggagaaggagaaggccggcaccggccgcccgctgctcttcgtggtcctcgacgagctgaacaagtacgccccgcgggagggctcctcgccgatcaaggaggtgctgctcgacatcgccgagcgcggccggtcgctgggcgtgatcctgatcggcgcgcagcagaccgccagcgaggtcgagcggcggatcgtcacgaactcggcgatccgggtggtcggccggctcgacccggccgaggcgtcccgtccggagtacggcttcctgcccccggcgatgcgtcagcgcgcgctgctggcccggcccggcacgatgttcgtcaaccagccggacatcccggtcccgctctgtgtcgagttcccgttcccggcgtgggccacccgcaagtcggagtcgggtccgccaccggccgagacgctgcgctcgatcgtgcagtccgccgacccgttcgccgtgatcggcggccgggccggcggtgacgacgacatcccgttctag

SEQ ID NO: 4223 - DNA, 774 bp, Actinoplanes utahensis
gtggtgcgactgccagcaccggccggccgagccgaccccgccggtgaccggcccacccggcgagtgagcgccctcccggacacccgggacgggttggtcgagcgctatccgcgcgccgaccggcccaccctccgggtgaatttcatcgccagcgcggacggcgcggtcagcgtggacggcctctccgccgggttgcagggcccgggcgacaaggaggtattcgacaccctgcggatgctcggggacgcgctgatcgtggcggccggcacggtacgcgccgagcggtacgacgcgctgcgcctgaccgccgaggaccgggcctggcgggtggcgcacgggctgcccgagttcccgctcatggtgatcgtctccggttcgctcgacctggatccggagcaattgatcttctcggacgcgccgatccgcccgatcgtgatcacccaccggggcgcgccggattccccgatccgggcggtggccgaggtgctggagctgggcgacgaccgggtcgacctggccgccggggtggccgagctgcaccggcgcggcgccacccagctgctctgcgagggcgggccgggcctgctcggctcgatgatcgccgccgacctggtcgacgagctgtgtctcacggtggcgccgctgctggccggcggctcggccggccggatcgcgagcggtccgccgacgccgccgcggccgatgtcactgcggcacgcgctgacccgggaggacatgctcttcctccgctacacgcgtgtcgtccacagctga

SEQ ID NO: 4224 - DNA, 708 bp, Actinoplanes utahensis
atgttgctgcgggttcgagtcaccctgccggaccgtcccggcgccctcggtcaggtcgcgcgcaccctcggcgtggccggcgcggacatcgtccaggtggtggtgctggaacgtctcggcgggcgggcggtcgacgacttcaccgtggtctggccgggtgcggcccgggtcgaccggctgttggccgggctcgccgcgatccccggggtgcaggtcgacggggtgtggaaggccatcggcgcgccggtcaacgggggccacgacgccgaactgctcgcccaggtggcggcgaacccggcggacggcctggccaccctggtcgacgcgatgcccgggctgctggcggcggactgggcggcggccgcggtggtcccggccgactgggccagccgcaacggcgggcccgggacgggacacgagccacaggtgacgtacgcgagttggcgggccccgtcgccgctgcgcctgcccgaggtgaccccgctgcgggcccggccgttgaccgagccgggcggcgcgcggtacgcggtggcgccgttcggccgggccgggctggtcctggtgctggcccgcaccgacgaggcggagctgccggccgcggcgttccacgtgaccgaggtggaccgggtggcgcagctggtccgggcggccgcggtgatcctcggcgaccggctcgacacggtgaccgccgccaccgtccgggtgtga

SEQ ID NO: 4225 - DNA, 1044 bp, Actinoplanes utahensis
atggcgttgtggcggatccgggccacggtcgacgaccgccccggctatctctccgtgctgaccgcgagcctcgccctgaaatcggtcaacatcctcgccgtccaggtgcacaccaccgagggcggcgcggtcgacgacttcctggtcgacgcaccggacgcgatgaccgaggccgacctgctggccgcggtgaccaagggccgcgggcgggatgcgttcgtgacccgtgccgaggcgcagggcctggccgaccagcccacccgcgcgctcgcgatggccggccgcctggtgcacgagcccgactcgctcggcgagacgctggtggccctgctcgacgcgaccgacgtgcgctggcgtccgcacccggccttcgaccggcccggcgtgcacggcggtcggatgaccctggccgacccggccggcgggtcgtacgaggtgctccgcgcgctccccgcgttcacccccgcggagtacgcgcgggcccaggccctggtcgagctggccgccgcggtcacccgccaccagcgggagaacgtgaccttcctgctgcccgacggagccgaggtgaccctgcgcccggccaccgcggacgatctggccgccgtcgccgagctgcaccggcactgctcggccgcggccctgcggcggcgctatccggccggtccgcccaccgagtcccggctgcgccggctgctggagccggccggtgggctgactctgctcgcggtcaccacggccggccgggtggtgggcaccgccggcctgatcgtcgaggggcagctgggcgagatcaccgtgctggtcgaggacgcctggcagcgtcgtgggctgggcacggcgctgctgcgccggctgcgggcgcacgccgagcggtccgggctggccgcgctggtggcgcacaccggcgcggacgacgtggcgacgctgcgcaccctgcgccgcctcggccacggcgagctggcgcgtgacggggccctggccagcgtcaccctgccactggcgggtcagccggcgtccttggatactcccgccacctccgggtga

SEQ ID NO: 4226 - DNA, 177 bp, Actinoplanes utahensis
atgttctgcgaccggtgtggcgaggcgaccgccacgggcgatcacacggggtgcgcggcggcccgcgagctggagccgccccgttactgcccggagtgccgccgccggatgaaggtgcaggtgctgccgaccggctggacggccacctgcgtggagcacggcacccggcgagggtga

SEQ ID NO: 4227 - DNA, 996 bp, Actinoplanes utahensis
atgcctcagatcctcgaccgggcacgtgcccgggttctcgacggcggcgccggcctcgatcaggccgggatcctcgagatcctgcgactgcccgacgacgacctgcccgagctcctgcagctcgctcatgatgtgcggatgaagtggtgcggcccggaggtcgaggtcgagggcatcgtctcgctgaagaccggcggctgcccggaggactgccatttctgctcgcagtccggcctgttcgcgtcgccggtgcgggccgcctggctggacatcccgtccctggtcgaggcggccaagcagaccgccgcgacgggcgccaccgagttctgcatcgtggccgcggtgcgcggtcccgaccagcggctgatggaccagatgcggcagggcgtcaaggcgatccgggaggcggtcgacatccaggtcgccgccagcctgggcatgctctcccaggagcaggtcgacgacctggtcgacatgggcgtgcatcgatacaatcacaatctcgagacctgccggtcgttcttcccgaacgtggtgaccacccattcgtgggaggagcgctggtccaccctgcagatggtccgcgagtccggcatggaggtctgctgcggcggcatcctgggcatgggcgagacgatcgagcagcgcgccgagttcgccgcccagctcgccgagctggacccgcacgaggtcccgatgaacttcctctcccctcgcccgggcaccccgttcggtgaccggccggtggtcgagggcaaggacgcgctgcgggcgatcgccgcgttccggctggcgatgccgcggacgatcctgcggttcgccggcggccgggagctgacgctgggcgacctgggcacccgggacggcctgctcggcggcatcaacgcgatgatcgtcgggaattacctgaccacgctgggccgttcggccaccgccgacctggagctgctccaggatctgcagatgccgatcaaagccctgtcggcgaccctctga

SEQ ID NO: 4228 - DNA, 855 bp, Actinoplanes utahensis
gtggctgactggtccgagtcgctcgatcgcctggcccgcgaccgggccaaggcggggctcacccgtcacctgcggccacgtccggccgacgacgacgtcgtcgacctggccggaaacgattatctcggcctttcccggcacgtcgcggtgacctcggcggcgcggtccgcgattgcggcgtacggggtgggcgccaccggatcgcgcctggtccgcggcagcaccgacgcgcacaccgcgctggaatccgggctggccggctggctgggcgccgaggccgcgctggtcttctcctccggctacctggccaacctggccgtcgtccgggccgccgcggcggtctgcgacctggtcgtctccgacgcgtacaaccacgcctcgctgatcgacggctgcaagatctccggccggccggtggtggtcgccccgcacaacgacccggccgccgtcgccgccatcctcgacgcccacccgggccgcaccgccgcggtcgtcaccgagtcggtcttctccgtcgacggcgacctcgccccgctcgccgccctgcacgcggtcaccacggcccgcggcgccctgctgatcgtcgacgacgcgcacgcgctcggcctgctcggcccggccggcgccggcggcgtcgtggcggccggcctcgccgggcagcccgacgtgatcgtcaccgccaccctgtccaagtcgctgggcggcgccggcggcgtggtcgccggccccgcacgggtcatccgccacctgatcgacaccggccgcaccttcatctacgacaccgccccgccgcccgccgtggtggccggcgtccacgccgcgatcgacctggcccgggccgccgacgaccgctag

SEQ ID NO: 4229 - DNA, 915 bp, Actinoplanes utahensis
atgtcggatcctggagaagcaggttcggtcggtcggcgaccggcggaagcagccggggcgacgggagacgcggaatcagcggcgggctcggtgggcggcgcggcggggacttcggaagcagcggcgggctcggagggcgacgcggcgggggagccggacgtcaaggcggcggctcggcgggcggccacggccggtgagtggcacgggatcgtgctggtcaccgggaccgacaccgaggtggggaagacgatcaccacggcggcggtggccgcggcggcgcaggcggccgggcttcgggtggccgtggtgaagccggggcagaccgggacgatcaccggggagccgaccgatgcggagacggtgacccggctggccgggccggacacggtgaagatgctggccgagtatccggagccgctcgcgccgctggccgcggccaaggtggccgatctgccgccgctggagctctacgaggtcgtggacgcgatccgggccgaggcggacaagcacgacctggtgctggtggagggcgccggggggctgctggtgccgatgggattgcggccgtccggggaggcctggaccttcgccgacctggcgaccacgctcggggcgaacgtgctggtggtggcgcgggcggggctgggcacgctgaaccatacggcgctgacgctggaggcgctggagcggcgcggcgtaccggcgaaggtgatcctcggtgcctggccggccgatcccgagctggtgcactgggcgaatctgagcgagctggtgccgcacctggtcggtgcattgccggccggcgccgggtcgatggatccgggggtgttccggcggtcggcgccgggctggctgactccggcgctgcacggggttctggataattggcgggtgtgggccgaggaagcgggctga

SEQ ID NO: 4230 - DNA, 816 bp, Actinoplanes utahensis
atgacaagcgaagcgtcaccggggcgcagtgccgccgaccggagcgaggcaagccggcatcaggtgacgttcaccctgacgatcgactgtggtggcggcggcatcaagggttcggtgctggatgacgccgggacgatgcgggcgcatccgatccgggtgccgacgccgtatccgttgccgccggagctgttcgtcaagactctggtggatctgggtgggcagctgccgaccgcggaccgggtgacggtcgggatgccggggatgatccggcacggggtggtcgtggcgaccccgcactatgtgacgaggagcgggccccgcaccagggtcgaccccgacctgttcgaggcgtggcgcgggttcgatgcgcggaccgcgctggccgaggcgttcgggctgcccacgctggtgctcaacgacgccgaggtgcacggcgccggggtggtcgccgggaccgggtgtgagctggtgctgacgctgggcaccgggctgggctgcgcgctgttcgacgggggtgagctggccccgcatctggagatgtcgcaggcgccggtgcgctgggggatgtcgtacgacacgtacatcggggagcatgagcggcgccgcctcggcgacgccctctggtcgcgccgggtccgtaacgtgatcgacggtctgcggccggtcttcctgtgggaccgggtctatctgggcggcggcaactcgcggctgatcaccccggcacagctggcccggatgggcgacgacgtggtggtggtgccgaacacggcgggcatcgtcggcggcgtccgcgcgtggaccctgggccagcgatga

SEQ ID NO: 4231 - DNA, 768 bp, Actinoplanes utahensis
atgatcgcagtggccggcgacggtcgggtggcgggtaaggggccggcggtgctcccggccgctctcctgctggatttcggcggggtgctggccgacgcgccggccgcccagcggtccgcctcgccggagctggtgctgcggatctacaacctgatcaacggggtgctgtcgcccggccagattcagcaggcgttcgcctccggtggccaggcctatgcccgctggcgcgacgaggatgcgccggacgagctgctccaggccgaggtctgggaacgtttcgtgatccgggactggcccccggccgcgcaggtgccggtccgcggggcgatcgcgagactgagctacgactgggcgttccgcccgggctgggcgttgcggccgggcatccgggaggcactcgacgcgtacaccgcggccggtgtcccgctggccgtggtcagcaacactctcagcggcgcggcgcaccgggacttcctggccgcggccggggtcggtgacctgttcgcggtgcaggtctacagcgacgaggccggggtccgcaaaccgaacccgcagatgatctggaatgccaccgacgtgctcggggtggatccgcgggcctgctggttcgtcggggacagccggcgccgggatgtggcctgcgcccgccgcgccgacgtggcccgggcgatcctgatgccgtccggccggcaggatccgccgggcagccccgagccggacgtggtcgtcgaggacggccacgaactggccgagttgatcagatggtga

SEQ ID NO: 4232 - DNA, 630 bp, Actinoplanes utahensis
gtgctactcgatttcgtacgcgcccacaccgtgccggcgccggtcccgttcgtccccgagatccggctccggcaggccgacgagccgatcgcgctctgggaggccaccgaggccggcgggaccgagcagccgcccccgttctgggcgttcgcctgggccggcgggcaggccctggcccggcatctgctcgacgaccccggcctggtcgccggacgcagcgtgctcgacctggccaccggatccgggctggtggcggtcgcggccgccaaggccggggcccggcccgtggtggccaacgacatcgacccgctgtcgttggccgcggccgaggccaacgccgccgacaacggagtggtgatcgagaccaacgagggcgacctgctggacggcgacgagcggtacggggtggtgctggccggcgacgtcttctacagccgggagatggccgggcgggtgctgccctacctgcggcgggccgccggacggggatcgctggtgctggtcggcgaccccgggcgcgcctacctgccgaccgggctggtgaagcgggcgacctatgacgtgccggtgaccgaggcgctggagagctgcacgatccgcaccaccacggtctggcaggtcaccatctga

SEQ ID NO: 4233 - DNA, 3015 bp, Actinoplanes utahensis
atgccgacgcggtggccggccgccctcttcggcgggtggatcctgctcctcggggtgggctacgccgcgcaaccggccctgcacggctggctggtgctggccggtggcctgtccgcgctgggcgccgtgctgttcggcacctaccgcagccagccggacgaccgggtgccgtggtggctgctggccaccgcgaccgggctgtccggggtgggtgccgcgctgggcgacgcgcccgagtccgtcaccgacgagctgctctggctggcgccggccggcaccgccctgctgctgctgtcctatccggcgctggccgtggcgctggccgggttcgtgcgccgccgcaccggggcgtcccgggacgttccggggctgctcgacgcggcgatcgtcacctccggggtggcgctgctggtctggacgttcgtgatcggcccgcggatgtcggacgcgtcggtccgggggctggagcagctgctgccggtcgccgacctgctctgcctggggctgctgatccggctggagacggtgccggggcggctggtcgcgtccgggtactggctgggtgccggcaccggggcgatgctgatcgcggacgtgttgcgggcgcccgcgtacggccagctcgcgctctacgcgacggccgggacggcggcgctgatcccgtcgatggcggagctcacccggcggtcggaggcgccaccggcggagaccagccggggccggctggcgttgctggcggtggccgcgctggccgcgccgagcgtgctgatggtgaagatgtcgcaggacggccaggtcgccgggctgttcctggtggcggtgctgagtctgctgatgctcatgctggtgctggcccggatgggcggcatcatgaccagtcaccggcaggcgatgggccgggagcaggcgctgcgtgaggcgtccgcggcgctggtgtcagccgccgacgcggaggcggtgggtctggcggtccggacgacggtggcccagctgctgcccggtgatgtgccgcacggcgtggtgctggcgatcagcatcgcgcagtcggagccgctgtcaccggaggccgccgcgcaggccgcggtggaccgggacaccggtaccgcggcccggctggtgcagaccagggatgtggactgggcggtggcggtgcggctcacccagttcgccgagacgctgcgctgcccgatggtgctgcaggatcggccgaccggtgatcccctggtcggggtgctgcacgtgggtgcgccgacgtgggcgttgcgggagctgcagcggtcggtggaggtgctggccgggcaggtggcgctggccctggagcggatcgcgctgagccatcaggtgaatcagcgcaacagcgaggcgtacttccggaccctgatcctgaacaccgccgacgtgatcaccattctggaccggcaggaccggatccggtacgcgagtccgtccgctctgggggtcttcggcgccgatccgaccgggtaccgcctgcccgacgtgatccaccccggtgaccagagccggctggaggaggccctggccgcggtccgtggcggggacaccgtgcagcagctggatttccgggcggtcggcgccgggcgcaccgaggtgctgctggagatgcactgccgggatctgagcgcggacccgagcgtggccggcctggtcgtcaccatgcgggacgtgaccgagcagcggcagctcgaacgggagctgatccaccaggcgttccacgacgcgatgaccggcctggcgaaccgggtgctgttccacgaccggctcaagcacgcgctggcccgcagcgcccgggacggctcggtggtcggggtgctcttcatcgacctggacgacttcaagatcgtcaacgacacgctcgggcacgcggtcggcgaccagttgctgatcgcggtcgccaaccggctggccggggcgttgcgggcggacgacaccgcggcccggctcggtggtgacgagttcgccgccctggtggagaacgtgaacgacccgggcgcggtcgaggagaccgcgacccggatcctgaccgcgctcgccccgtcgatcgacaccgacgccaagccgctgcacgcggtggccagcatcgggatcaccaccaccctggaggcgcaggacgccgacgagctgctgcgccaggccgacctggcgctgtacgtggcgaagggggccggcaagaaccagtggcggcgctaccagcggcatctgcacgacgagatggtggcgcggctggagctgcgctcggcgctcgaccacgcggtcaacgagggccacttcctgctgcactaccagccgatcgtcgacctggtcagcagtgccgcggtgggcttcgaggcgctggtccgctggcatcacccgagtcgcggggtgatcaccccggaccagttcatcgaggtggccgaggagagcgggctgatcgtgccgatgggccgctgggtgctggaggaggcgctgcgcacggtcgccgactggcgccgggtcctgccggccgggcgcaccccgtacgtcagtgtgaacgtctcggtccggcagttccgcgaggccgggttcgtcgaccaggtccgggcggcgctgcagcacaccggggtgccgcccgggtcgctgatgctggagatcaccgagactttgctgatgaaggacgacgaggcgcgggtctgggcggatctcggggtgctgcgcgacatgggcatccggatcgcgatcgacgacttcgggaccggctattcgtcgctgggctatctgcggcagcatccgatcgacgtcgtgaagatcgacaagacgttcatcgacgacatggtgaccagcccgcagctggtcggcgggatcgtcagcctggcccggtcgctgcagctcaccgtggtggccgaggggatcgaggacctcgaccaccgggatctgctggtgcggatgggctgcccgctcgggcagggcttcctgttctccagcccgctcggcccgaccgaggtgctggcctggatgaccagcctggccgtcgccgtctag

SEQ ID NO: 4234 - DNA, 1080 bp, Actinoplanes utahensis
atgcgtgtcgtcatcgtgggcgcgaccggcaacgccggcaccgcgctgctgcgccgcctccggaccgaacccgacatcgaaaccgtcgggatcgcccggcgcgtcccgcaggacaccggcccctacgccgggatggaatggcacccggtcgacatcggccgggacgacgccctggaccggctcaccgcgatcttcgagaccgccgacgcggtggtgaacctggcctggcagatccagcccagccacgacacccggcagctgtaccggaccaacgtgctgggcagccgcgcggtgttccgggcggcgatccgcggcggcgtcagcacgctggtgcacgcctcctcggtgggggtgtactcgccggggccgaaatgggcgtacgtcaaggagagctgggcgcgcaacggggtgctggagtcgtcgtacagccgccacaaggtgctgaccgagcggatgctcgacgagatcgagtcggaccatccgatgatgcgcgtcgtccggctgcggcccgggctgatcttccagcgcgacgccggcaccgagatcggccggtatttcgccggcccgctgctgcccgcccggctgctgcgccccggctgggtgccggtcatcccggcgcacccggggctgcggctgcaggcggtgcacgccgacgacgtcgccgaggcctacctgcgggcgctgcgcgccgacgtgcgcggcgcgttcaacatcgcggccggaccggtgctcgatccgatggtgctggccaaggcgttccgcggggtgccgctgccggtgcccgggttcgcactggagggcgccgcggcgctgagctggacgttgcggctgcagccggtcgaccgcggctgggtgcggctggccctcaaggcgcccctgatgtcctgcgaccgggccgccggcgagctgggctggcggccgcgccggggcgcggtggacgcgctgcacgaggtggtggccgggctggccgaccgggccgggcgaccggagagcccgccgctggacccggccgcgagccagccgggacgcctcggcggcctgctgcgcggccgcctgccgggcaccggcaacccctactag

SEQ ID NO: 4235 - DNA, 348 bp, Actinoplanes utahensis
atggcgaagcagataattacccttctgaccgacgacctcgacggcggggaggccgaccgcactgtcgaattcggactcgacggtgtcaactacacgatcgacctgtccgagaagaacgccggcaagctgcgcaaggccctggaaccgttcctctcggcggccacccgcctgggccgttccggcgccaccccgccggtcgcccggcgcgccgccccggccgcgaccagccggtccagccgtgaccagaaccaggccattcgcgagtgggccaacaagaacggttacccggtttccgagcgcggccggatcccgagcaacgtcgtcgaggcataccacgccaagcgctga

SEQ ID NO: 4236 - DNA, 1641 bp, Actinoplanes utahensis
atgacggattacgacatcgtgatcgtgggcagcggcttcggcggcagcgtcagcgcactgcgcctgacggagaagggataccgggtcggcgtcctcgaggccggccggcgtttcacccccgagaccctgcccaagacgtcatgggacctgaagaacttcctctgggcgccgaagctcgggatgcgcggcatccagcggatcaccctgctcaaggacatcatggtgctgtccgcggccggggtcggcgggggctcgctggtctacgccaacacgctgtaccagccgcccgcgccgttcttcgccgacccgcactggtccggcatcaccgactgggccaaggagctggagccgcactacgaccaggcgtcccggatgctcggggtgaccacccagccgacgatgaccccgtccgacgtggtgatcaagcaggtggccgaggacatgggcgtcgggcacacgttccgccgcaccccggtcggggtgttcttcggcgagcccggcaagaccgtgcccgacccgttcttcggcggggccggaccggaccgcaccggctgcaccgagtgtggcaactgcatgatcggctgccgggtcggcgccaagaaccggctcgacgtcaactacctctacctggccgagagcaagggcgcgacggtccacccggacaccgaggtcaccaagatccggccggacggcgccggctgggtggtggagacggccaacggcaccttcaccgccgggcaggtgatcctggccgccggggcgctcggcacgcagcggttgctgcacgcgatgcgcgacaccggggtgctgccccggatctccgcccggatcggctcgctgacccgcaccaactccgaggcgctgctcggcgccgagaccaggaaggtgccggccgagccgttcagcaggggcgtcgcgatcacctcgtcgttccacccggacgcgaccacgcacatcgaaccggtccggtacgggcccggcagcaacgccatgggcctgctgtccaccctgctggtggacggcggcgggcggctgccgcgaccgctgcgcttcctggtcaactgcatccggcacccgatggtgctggcccactccctgtcggtgcggcggtggagcgagcgcacgatcatcgcgctcgtgatgcagaccctggacaattccctgacggtacgtcgcacccggcgcggccggttgacgacgagcccgggacacggcgacccgaacccgacctggatcccggtggggcacgaggcggtgcggcggatcgcggaccggatcgacggcttccccggtggcacggtcggcgacatcttcaacgttccgatgacggcgcacatcctgggcggggcgacgatcggtgcggacgccgacagcggcgtgatcgacccgtaccaccgggtcttccactaccccgggctgcacgtggtggacggttcggcggtgccggccaacctcggggtgaacccgtcgctgacgatcaccgcgatggcggagcgggcgatgtcgctgtggccgaacaagggcgaggcggatccgcggccggcgccgggcgaagcctacgagccggtggagccggtggcaccacactcacccgcggtgccggcacatgctccggccgcgctgcgccgcgccggaaaatag

SEQ ID NO: 4237 - DNA, 1605 bp, Actinoplanes utahensis
atgcctcgtcgccgactgttgttcctgctggccgtggtcgcgatgctggggcagatggcgttcgccatggtgaccacggcgacgcagctgacgccgaccatcgacgagccggtgtacgtcgccaccgccgaggtgtacacccagcagcacagcctgcgctacaacttcgagcacccgccgctcggcaagctgatcatggcgaccgggctggcgttcggcggcgcgcaccggctggacccggcgtatccgggcgaccagagcgcgctgggacgcaacctgctctacgagagcgggaacaacccgttccggctgctgctcgccgcccgggtcccgatcatcgtgctgacactgctgttcgggctggtggtgctggccttcgcgcgggacgtggcggggccgtgggccgctctgatcgcgctggcgctgtactcgttcgacccggatgtgatcgcgcacgggtcgctggccaccctggacgtgccggccgccggtctgctgctgaccgcgttctggctggcgtggcgggggcgggaacgcgcgtaccgctacctgccgctggccggcgtggccctcggggcggcactggcgacccgggccagcgcgctccccgccgtaccgctgatcgccctgctctgtggttggtcgatgtggcgtgcccagcggtcggcgagccggcgacggcgtctggtggccggcgccctggccgccgccggcgtggggttgatcgcggtcgccgtcgtctgggtggtctatctggccgtcgatccgcatctgcgctggacgaccccggactatctggcgcatccggacgggctgcgggcggccgcggtgcagtggctgccgctgccgcaggcgtatcgggacgggttgctgctgcagttccggctggaggcgcggacctacaacgggttcctgctcgggcaggcctaccgcggcaacctctggtactacctgccggtggcgctgctgatcaagacgccactggggatgctcgtgctgtggatcgccggcgcgctcacgatgatcctcgtgccgcggctgcgggccgcggcggtctacgtgctgccggtttcggcgctgctgttgctggtggcgatgaccggcagccgcgactacggcacccggtacgcgatcttcctgccgatgttcctcgcggtggcggccgggacggtcgcgctgatccggatccgccgggttccgtgggtgaccgcggcattgatcctgttcgtcgcgatcagctcagtgcgcacattcccctattacctgccgtactccaacgaggcgttcggcggcaccgcggacacccaccgcaacctgcacgactcgaacgtcgactggggtcaggacctggcccggctggcgcagaagctgaggaccgactatccgggtgaaccggtgtggctcgtctacaagggcagtggcgtgcccgcctattacgggatcaatgccaccgatccgtacggcgttccggaggaccgggtgcacggcctgctggtggtctccgactcccgggtggcgctggccggcgtgaagctccagcgcctgatcgacacgagcagagcgatcgaccaggtgggctacgcgatgaccatctaccggcggtag

SEQ ID NO: 4238 - DNA, 1668 bp, Actinoplanes utahensis
atggctgaccccgacttccggcaggcccgggacttcctgctcgctcatcgcgaggatcttcaggcggcgtacgacggtttccgctggccgcgcccggcgcacttcaactgggcgctggactggttcgacgtgatcgccgcgggcaacgacgcgcccgcgctgtggatcgtccaggaggacggcgccgagcagcggttctcgttcgccgagatggcggaacggtccagccgggtggcgaactggctgcgtgcccagggggtggcccgtggcgaccggatcgtggtgatgctcggcaaccaggtggagctctgggagaccatcctcgccgggatgaagctgggcgcggtgctgatcccggccaccccgctgctcggcccggccgacgcggtggcccgggtgacccgcggcggcgcccggcacgtgatcgcgatggcctcggcggtggccaagttcgaccaggtggatccggcggtcacccggatcgcggtgggcgcggcggacggctggcgcgatttccggtcggcgtacgcgtcggcccccgagttcgtgccggacgcggtgacccgggccgacgacacgctgctgctctatttcacctcgggcaccaccgcgcagcccaagctggtcgagcacacccacgtgtcgtacccggtgggccacctgtcgacgatgtactggatcgggctgcgccccggcgacgtacacctcaacatctcgtcgcccggctgggccaagcatgcctggagcaacgtcttcgccccgtggaacgccgaggcgtgcgtgttcatctacaactacacccggttcgacgcccggaagctgatggccgagatgcagcgctgcggggtgaccagtttctgcgcgccgccgaccgtctggcggatgctgatccaggccgacctgaccgagttgacgacgccgccgcggatcgcggtgggcgccggcgagccgctcaaccccgaggtgatcgagcaggtcaaggccgggtggggggtgaccatccgggacgggttcgggcagaccgagacgtccgtgcagatcgccaactcgccggggtgcccggtcaaggccgggtcgatggggcggccggtgccgggcttccggatcgcgctgctcgacccggtcaccggacgggaggcggacgagggcgagatctgcgtggcgatggagccgcggccggtggggctgatggtgggctatcacggcgacccggtgctgaccggcgagcggatggtcgacggctactaccacaccggggacgtggcctcgcgggacgcggacggctacatcacgtatgtggggcggaccgacgacgtgttcaaggcgtccgactaccggatctcgccgttcgagctggagagcgtgctgatcgagcacgaggcggtggtggaggccgccgtggtgccctcaccggacccggtgcggctggcggtgccgaaggcttacgtgctgctcgccgaggggtgggcggccgacgggacgaccgccgcggcgatcttcgagcacgcccgcaagcacatgccgccgtacgcccggatccgccgcctggagttcgccgacctgccgaagacgatctccgggaagattcgccgggtcgagttgcgcgccgccgaggtggccaagcacgccgacccggccgccaccccgccgggggagttcaccgggtag

SEQ ID NO: 4239 - DNA, 927 bp, Actinoplanes utahensis
gtgggcaccgcgcccgctgcgcgccgtgcacgcccgcctcggccttcgcgagcacggctgaaccgtcccgcgtccgggggtgtgacggccaccggacgcgggccgggtcgttgtccccggagaccagaaagggccctagtgacagtcaccctgcgggagatccgcgagcgcacctacaagccgatcgacgcgtggtggaccgtgctgctggtcgacccgctggccgcccggctggtgcgcctgatcgccccgtaccgccggctcaccccgaacgtgctgaccctggtcgccacggtgatcggggtcggcgccatggtgtgtttcgcccgcggcgacacccgctggctgatcgccggcgcggtgctgttccacctgagcttcgtggtcgactgcatggacggcaagatcgcccggctgaacgggaccggcacgatcttcggccagtggctggacttcgtgctcgaccgggtgcgggtgttcttctgcgcgctgaccctgttcggcgggcagtacgcacggcaccacgacgtgacgtacctctggttgatgtccgccgcgatcttcctggacctgatccgctatctcaacggcggtcaggtggccaaggtgcgccagacgatggtcgacgagctgggcgcgctggccgtgccggccgaggccggcgcgccaccgctgtcccgccgtggccgggccggcgccctgctgcgccgcaaccggatccggacgcacctgttcagcggcatcgagtacgagatgttcgtctacatcatcggcccgctgaccgggctgatcatcggggtcaccgtgctggccggggcggccctgctggccttcgagctggtcctggtgtaccgcttctggcagcaggccgcgggccatccggcccgactggccgcggcccgcgaacgcgttccgacaagcttctag

SEQ ID NO: 4240 - DNA, 2241 bp, Actinoplanes utahensis
atgacctctctccccaccaagccgccccgggccggcggcgaccagccggtcgccgccgcgcccggggccggcccggtcacccggttcgtcacccgcttccccaagctcgtcctgctcatcaccctgctgctcgccggtctcgcggtggcgttcagcggggacgtggtcagcgcgctcaagaccgggggtttcgacgatccgaacaccgattcggtacgcggccggcaggtgctgtccgagcacttccgggccgccgatccgaacctggtggtgctgatcgccaagccgggcggcagcgtcgacgacccggacacccgggccgccgcgcaacgggtcacccagcggctggccgccgaccccgcggtgaccgtggccggctcgtactgggcgaaccacctgccgcagctggccggccgcgaccacgacaccggcatgatcctggtgcacgtcgacggcgacgaggacacgagtgcggaccgggtggccgcgctgcacgaagacctcggccgggacttccaggaccagcagatcaaggtcgagttcggcggcttcacccagatcaacaacgacatcaacgaccaggtcaccaaggatctggcgaccgccgagtcgatcgccatcccgatcaccctggtgctgttgctgctggtcttcggcaccgtcggggcggccggcgcaccgctgctgatcggcctgttctcgatcgtcagcacgctgggcacgctgcggctgctggccgcgatcaccaacgtctcggtcttctcggtgaacatggcgaccgcgctgggcctgggcctggccgtcgactacagcctgctgttcgtgagccggtaccgcgaggagcgggtcacggcggcggatctgcgcaccgcgatcggcaacaccatgcgtaccgccggtcgcaccatcctgttcagcgcggcgaccgtcgccgtggccctgagcagcctgatggtcttcccgcagtactttttgcggtcgttcgcctacgccgggatcgccgtggtggtgaccacggtcggtgccgcgctgctggtgctgccggcgctgctcaccgtgctcggcgaccggatcgaccggtgggcgctgtaccggccgcgcgcctcctccaccttctgggcccggctggccggcttcgtgctgcgccgcccggtgcgcaccgcggccccggtgatcctggtgctggccgcgctcgcgctgccgttcacccacgtgcggttcggtgtggccgatgaccgggtgctgccgaagaccgccgagagccgggtggtcgcggacaccgtgcgcggccagttcgccgacaccggcagcggggccaccgtggtggtcgccgagcactggggcagcgggaccgacgggcggatccgggcggccgactacgccgcgcggctctccgaactgcccgcggtgaaccgggtggacagcatggtcggcacctatcagcacggcgtcatcgtgatcgccccggggcacgccgacccgcggtacgtcaacggcgacgccacctggttctccgtggtcagtgacgtcgagccgtactcgggcgcgggcgccgacctggcccgcgcggtccgcgccgtgccggtgccgggccgctacccggcgctggtcaccggaccggccgcgcagctggtggacatcaccggctcgatcgccgaccggctgccggtcgccgggatcctgatcgcggtgaccacgttcgtgctgctgttcctgctgaccggcagcgtgctgctgccgatcaaggcattgctgctgaacaccctgacgatgagcgcggtgttcggcgtggcggtctggatcttccaggacgggcacctgtccggcctgctcgggcagaccgggaccccgctcgcggtggccatcccggtgctgctgttctgcgtggcgttcgggctctcgatggactacgaggtgttcgtgctgtcccgggtgatcgagcggcacgaacagggcgccgacctgcacaccgcggtggtcgaggggatgtcgcgcagcgtccgggtgatcagcgcggcggccggcatcctgagcgtgtcgttcctggcgatgctcacctccggggtgtcgctgatccagttcttcgggctctgcgccagcctggcgatcatcctggacgcgctgctggtccggccggtgctggtgccggcgttcatgcggctcgccggggagtggaactggtgggcaccgcgcccgctgcgcgccgtgcacgcccgcctcggccttcgcgagcacggctga

SEQ ID NO: 4241 - DNA, 4569 bp, Actinoplanes utahensis
gtggtcgagttctggtcgaactcgctggccgcggcccatcaattccggcccgtaccgtcggctcggtggaatcacgaaacattctattcgacgaattttcgcgatacacattccacgtacaccgaccgggtggcctttcttgacgaggtcgagaagttcgccgccctgcaccaccgcatcccgccacggcgcgccaaggccatggacccgcaacaccggctcctggtggacctggcccgcgaggccgtccaggacgccggctgggagcgccggccgttcgaccgggcgaccaccggggtgttcgtcggcctcagcaccgccgactacaaggatctgaccggggcccggctgaccgcgagcctgctcgccgacgggtcgctgtcgagcgccgccgacgatccggcgctgctcgccgcgatcgccgaggcggccaagctggcgatcgacccgccgcagtcgttctcgatggccgggtcgctgctcaacatggccccggccacggtgagcgagctgctcgacctgggcggcccgtccttcgcgatcgacgccgcctgttcctccgcactggtcgcgctgcacgaggcggtcaaccacctgcgcaccggctcgtgcagcgcggcgctggtcggtggggtgttcctcaacctgacgccgaacgcgctggtcggcttctcccgggtgggcgccctgtcgccggccggggtgtgccgcccgttcgacacccgggccgacgggttcgtgctgggtgagggcggttcgctggccgtgctgcgcccgctggacgacgcactggaggccggtgaccggatctacgcggtgctcaacggcatcggcaccgccaacgacggcaagggtgccggcccgatgacgccgaaggccgagggccaggaggcggcgatgcgggccgcgtaccgcgacgcccgggtcgagccgggctcgatcgacttcctggaggcgcacggcaccggcaccacggtcggcgacagggtcgaggtggaggcgatccgccgggtgcgggccaaggccaccgaccggccctgctacctgtcctcgggcaaggcgatgatcgggcacacgctgccggcggccggcgccgcgggcgtgctgcggaccgcgctggcgctgcaccaccggaccgttccgccgcagccggcggccatggatccgcacagtgagctgccgctggccgaggcgggtctgtccatcaccaccgagccgaagtcgtggccgcagccggccgacgaccggcggcgggccgcggtgagctcgttcggcttcggcggcaccaatgtgcacgcggtgctcagcgaggccccggagccggagacggacggtgacgacgcggacggcacccgcccgtgggtggtgctgatctcggcggacaacggtgagctgctcacgtcgtacgcccagaggttgtcggtcctgatcgccgcggacccggggctgaccccggccgcggtggcccgcacgatggccagccggtccctgctgaccgcgcggctcgcggtgatgtgccggtcccgggccgagttggcggagcggctcgccgtggcggctcgcgagctggccgccggtgcgaccggacggctggccgccggcctgtacgcgagcaccgccccgctggcgccggagcagcggtcgctggccttcctctacccgggtcagggctcgctgcgtcccggggtgctgcgcgatctggtggcccggttcccggcgctggccgagcacgtgcggccgctggccgaccgggtggacgagcggaccggcgcgccggtcaccgacctgctctgcgacacgccgaacccgggtgacgaggagcgggtcagcgcgacccggatctgccagccgggcctgggggtggccggcatcgggatgacccagctgctcgccgagatgggggtgaccccggaggtgacgctgggccacagcgtcggcgagatggccgccgcggtggccgcgggggcgctgaccccggacgacggcatcgagttcctgatcgaccggggcgccgcggtgacctccggggaggaaccgccgcccggcacgatggccgcggtgcggatcgacgcggccgggttcgagcagctgcggatcgggatcgacggggtctgggcgggctgttacaaccatccgacgcagatcgtcgcgagcgggcaccgggacgcggtaggccggctggtcgagcgctgccgggaccgggatgtgccggtcgcgccgctgcgcgtgtcgcacgcgttccattcgccgttgatgtccgaggtggatctgcgggtcggtgagttcgtggccgggctgccggtgcgcaagccgatccggacactggtctccagtgtggatccggccgcgccgacggactcggagacgctgcgcgcgctctgggcccggcagggttcggcgccggtgctgttccgtgacgcgatcgatcaggcggtgcgggtcggggcgaagatcctggtccaggtgtcggccggggacgcgctgctcggcatggcggcgcagacgccggcggcgcgggggctggatgcgatcgcgctgatgccggccgagccggacgacggatatgccctgttggagggtctgggacggctggcggtggccggcgtgccggtgaacctcacgccgctgttcgaggggctcggtgtgccgttggccacactcccgccgtcgccgctggcaactcagcactactcgatccgtcgtacaccgggcagtgcgtcgttaagccgatttgtcagcaaaaaagagaccgcggtgcgcgagacgccgccaacccggcgcgaggctcagccggcgaccggaatcaggaacggagcgcagacccccgtgaacgacgtcatctccctgctgcgggaacaactggccgtactgcgcgacatcggcgccgagccgggggccgagccggccgccggagcggtcgccgaggtggtggccgcgccaccggcgccaccggcgctgccggccgccaaggaggcgcccgagaaggcggccccgccgaaggtccccgcccagcagccccgcaagaccgaggacaagcaggtcttcaccgaggtcgcggcgatggtcggcaagatcagcgcctacccggcggacaccgtgcgcccggaccagacgttcggcgccgacctcggcttcgactcgatcatgacggccgaactgatcgccgcggccaagcgccgctggccggatctcgacctcgccccggagcaggtcttcggcatcgagacggtcggcgagctggtgcagctgctccagcaggcgctaggcgtgagtgcgccggccccggccgcgactccggctccggagccggtgcaggacctggtgccgcgcgccggggacgtccgccggcccgaggtcgccgacgtgaccaagctcccggaggtcgtgcagttcgaggcgcgcggcaacatcctggagcgggtcggggtggccaacccgtactacatcgtgcacgacagcgtgatcaacgcccgcacctcggtgcacggccgtcagttgatctccttctccagctacaactacctggggctgtccgggcacccgatggtcaactacgcggtgaaggaggcggtggagcggtacggctcctcggtctcggccgcgcgcatcctgtccggcaaccgggcgctgcacgacgagctggaccgcagcctggcttcgctggtcggcgccgaggacgcgatctcgctgctcggtggccactcgacgaacgtcgggatcatcgggcacatggtcggcccggaggacctgatcgtgcacgacgcgctggcgcacgacagcatcctgcagggctgccggctctccggtgccaaccgccagccgttcccgcaccaggacctggccgccctggacgcgctgctgacccggatccgcgaccggtaccgccgggtgctgatcatcgtcgagggcgtgtacagcatggacggtgacatctgtgacctgccggcgctgatcgcgctgaagaagaagcacggcgcgctgctgatggtcgacgaggcgcacagcatcggcgtgctcggcgcccgcggcggcggggtcggcgagcacttcggggtggaccgcaaggacgtcgacatctggatgggcaccctgtccaagtcgctggccagctgcggcggctacatcgccggccggcacgagctgatcgagtacctgcggtacacgctgcccggcttcatcttcagcgccggcatgagcccggcgaacgcggccgcggcactggccgccctgcacatcatgcgcgaggagccgcagcggttgaaggtgctgcacgaccgggccgcgaccttcctgcggctggccaagcaggccgggctggacaccgggccgagcgccggcaccccggtggtcccgtgcatcaccggcgactcggtgaaggcactgaagctggccgacatgctgctcaagaacggggtcagcgcgaacccgatcatgtatccggcggtcaaggagcggctggcccggctgcggttcttcgtcaccgccgagcacaccgtcgaggacatcgagaccaccgtggacctgctggcccggcacctcgacccggcccgcgtgccgcagccggcctga

SEQ ID NO: 4242 - DNA, 471 bp, Actinoplanes utahensis
gtgagtgtgtcggtttgggtaaaacgcccgcttcgcctagttttgtgcgtcatgaagcacacgaccatgcggtggctcgctgcagccgtggcgctggccggcctcgccgcctccagccccgcccaggcggccccgtcgcaacctcgattcgcacccatccgcatgaacgccacggcgtactacggcacgctcgacgtcatcgcccgcgagacgctcggcctgaaggcgcacttcaccacctgggacggccacccggtcgccgggcttcccatccagttcaccaccaccggtgaacgcttcccgatgtgcgaggccaccaccgacttcgccggctgggccgaatgcaagaacggcccggtcccgccgccggtgtccctggcgaacctgctggtcaacggctacgacgccgtctggctcggcaaccgccggttcgccccggtcagtgcccacaacaacatcggcatcggctga

SEQ ID NO: 4243 - DNA, 1050 bp, Actinoplanes utahensis
atgaaaccgggccgccgaaccggttggctggtgggcatgacgacgatgacggagcggccgcgtgccgccggaagtgacttcgcggagctgagtcgccggatcaacgcggccggcctgatgcgccgccgcccaggctattacgcgctgcgcctgggcctggtggccgccgccctgatcggtggctggacagcgttcgccctgctcggcgcatcatggtggacgctggcggtggcggtcctgctggcggtggtcaacgcccaggtggcgctggtcgcgcacgatctggcacaccggcaggtgttccgcaccaaccggccgagctcccgggccggcctgatcgccggcaacctggcgatcggcatgtcgtacgggtactggatggacaagcacaccaagcaccacgccaacccgaaccacgacgacctcgatccggatgtcggtccgggcgtgctggtctggtcccgcgaggcggcggccggcaggggcttcctgacccggcatcaggcctggttcttcttcccgctgctcaccctgctcgggatctcgctgaaacacgacagtgtccgcgccctgctggacggcaccgtgaaacgccgcggcctggagttcacgctgctcacggcacatttcatcgggtacgtcgcggcactgctgctggtactgagccccgtgcaggcgctggcgttcttcgtggtgcatcaggcgctcttcggcgtctacctggggctgaccttcgcgccgaaccacaagggcatgccgcatccggacggcaccgaggacttcctccgcaagcaggtcctgacgtcacgcaatgtgcgcggcggccggctcgtcgacgcggcgctgggcggactgaactatcagatcgagcaccacctgttcccggcgatgccgacaccgaacctgcgcaaggcccagccgatcgtccggcgctactgcgcggagatcggggttccctacgagatgaccgggctcgtcgagtcctaccgccaggccctgcgtcatctgcacgaggtcggcaccgacctgcgcggggccgggcgcgtgtga

SEQ ID NO: 4244 - DNA, 1296 bp, Actinoplanes utahensis
atgatgcgcatggactcgcgtgactggatccggaacgggctccgggccgtgctcggcgggctgctgggcattccgctggcggtgctcaacctggtgctcttcgcgttctcggtgatcgccctgatcctcagcgtggtgcccgggctcggcttcgtcgcgttcccggcggtgacccggctggtccgcgcccgggccgacctggcgcgccggctcgacggccgggtcggcctgccgatcgcgcgaccctacaaacccgcacccgagcgcgcccgcctcggcggctggcggcactaccggtggatcctcaccgaccaggccacctggcgcgacctcgcctggctggtcccgggcgcatcgatcggcgccgtgctcggcgcgttgatcatcgcgctgccgctgtacggcctggagggcatcctgctcgtcccgttgtgggtctggctcggcacagggtggtacggatacggggtcatctggccgttcgacaccgtcggcgacgcgctgctctccctgccgcagggcacgctgttcctgatcatcggggtggccgcggcaccctacctgccgcgtttcggcgcgctcttcgaccggctgctgctcgccccgacccgcaacgccgagctgcgcctgcgggtcagccagctcaccgtcacccgggccgacacggtcgacgcgcaggcggccgagctgcgccggatcgagcgggacctgcacgacggcgcccaggcccggctggtgtcgctgggcatgacgatcggcctggccgaggagatggtcgaggccgacccgcgcggcgcgcgccggctgctggccgaggcccgggagaacagcagcgccgccctggtcgagctgcggcacctggtacgcggcatccacccgccggtgctcgccgagcgagggctcgacggcgcggtccgggcgctggccctggcgctgcccatcccgaccactgtggaggccgtgctgcccggccggctggacacgccggtcgagtcggcggcctacttcgcggtggccgaggcgctggccaacaccacccggcacagctttgcccgggtcgcccaggtggagctccggcacaccgggaacgccctggtcatgcgggtcagcgacgacgggctgggcggcgccgacccgaccggcggcacgggcctgcggggcatcgaacgccgcctggccgccttcgatggcacgatgagcctgtccagcccaccgggcggaccgaccgttgtgaccatggagttgccttgcgtgttgtcctcgccgaagatcacgccctcctccgggacgggctga

SEQ ID NO: 4245 - DNA, 639 bp, Actinoplanes utahensis
ttgcgtgttgtcctcgccgaagatcacgccctcctccgggacgggctgacccgcctgctgaccgcgcacggctgtgcggtggtgatcgctgtcgacaatggaccggcgctgctgccggccctggtcgagcaccgaccggacgtggccgtggtcgacgtgcggttgccgccgaccttcaccgacgagggcctgcaggcggcgatcgcggcccgcggcgtgctgcccggcatgccggtgctggtgctcagccagcacgtcgagccgctgtacgcccgcgagttgctctccgaccgcagcggcggggtcggctatctgctcaaggaccgcgtctcgcacgtcgcccagttcgtcgacgcggtccgccgggtggcctccggcggcaccgtcatggacccggaggtcgtccaccagcttctggtccgccgccggtctccgctgtccgccctgaccgcccgggaacgcgaggtcctcgggcagatggccgagggccgctcgaacggcgcgatcgccgccagactcttcatcggggagaaggcggtcagcaaacacatcaacaacatcttcaccaagctcgacctgccgccgtcggacgacgacaaccgccgggtcctcgccgtcctcacctacctgaacccctag

SEQ ID NO: 4246 - DNA, 1059 bp, Actinoplanes utahensis
atgacgttcaaacgaagcctgtcgatcgttctggctgtcgtcgcggcgctcgccactccccagccggcctccgccgcccccgcctcctggaaactcaccccgaccgggacgacggcgcggttccgcggtctggccccggtcagcgccaccgtcgcctgggtggccggcagcgccggaaccattctgcgcaccgtcgacggcggccgcacgtggatctcggtcggcccggccgacgccgccgccctgcagttccgcgacatcgaggcgttcgacgcccggcacgcggtcgccctgaccatcggcaccggcaccgactcgcgcatctacaccaccgcggacggcggccacacctggacccgctcgttccagaacgaggacgccgccgccttctacgactgcctcaccttcctcgaccgccgccacggcctggccctgtccgatccggtcggcggcaggttccggatcctcgccaccggcgacggcggccgcacctggtcggtcctcccggacaccggaatgccggccgcgcaggacggcgagttcgccttcgccgccagcggcacctgcctggtctcggccggcgggcgcgcctacttcgccaccggcggcggcgcgacctcccgggtgttcagctcccgggacctcggccggacgtggcaggtgaccaccaccgggatcccgagcggtcccagcgccggaatctacgggctcgccttccgcgactcccgcaacggcccctcctcgggcgactccggcaacgggctggccgtgggaggtgactacaccgctcccgccgcggccccggccggagccgccttcacccgcaacggccgtgcctggacgaccgccaccaccccgcccggcgaataccgctccggcgtcgcctgggccgccgggccgatcgccctcgccgtcggccccaccggcagcgacatctcctggaacgccggggtcacctggcaccgattcgacaccggcagcttcgacgcggtcgcctgcacccggctggcctgctgggcctccggcgaacagggccgcgtcgcccgtctctccttctag

SEQ ID NO: 4247 - DNA, 1701 bp, Actinoplanes utahensis
atgcaggtttcacccgcgtcgctgagagctcgcatcccgcggccccgccggcccgccgtaccgttcgcggcgatccccgtcccgaacccccggcggatcatccgggccccgctcagcctcaccggcgccgggctggccgccgtcttcttcagcctcgccttcaccccgtccctgctcccccgcaccggcatcctgcagggcgtcgtcgccgggatcaccgcggcgatggggtacgcactgggcaccgcgatcggcgcgctgatccgcctccgcttccggttctccccccgcgtcgtgcggatctggtggcgggtgctggccgtgctgctgctcccgatgatcgccacctgcctggtgctcggcgtgcgctggcagcgcgagttgcggatgcggctgggcatggccccggcccaggagtacgacatcgtccgcaccgtcggcgccagcctgctcaccttcgggctgcttctgctgatcgcccgcgccctgcggctggccacccacggctgcgcccaggtgttccggctgatcgtgccggaccgtgccgcctactgcgccggcaccgtggtggtcgccgtgctcagctacggcgcgttcgacggcctgctggtcgcccacctgttcgcggtcgccgaccggtccgccgccgtgatcaacagcgggaccggcaacggggtgcacgtgcccgcctcggcgctgcgctccggcagctcgcaatccctggtcggctgggacaccctcggccggcagggccgcaacttcgtcgccagcgcccccagccggcaggagctcaccgatttcgtgggccggcccgcacaggaaccgatccggttgtacgccgggctcgcctccgccggcaccatgcgtgaccgggccgacctgatcgtccgcgagatggaccggaccggcgccttccagcgctcggtggtggcgctgttcaccccgaccggcaccggatgggtcgacaacaaggtgacccagtcgctggaatacatgtacgccggcgacaccgccctggtctccatgcagtactcgtacctgcccagctggatcgccttcctcggcgaccgctccgaggtggtcgacgcggcgtccgccctgatcaccgcggtacgggcgcgctggtcgacgctgcccgccgaccaccggccccggctgctgctgttcggtgagagcctcggcacatacgggatcgaggccacctacggcgacgcggccggcctggtgaacggggcggacggggtgctgatggaggggcccaccttcgccaacccgatccaccggcggctcacccgggaccgggccggcaggtcgccggtgtgggacccggtgtacccgtcgctgccggtcggcttcgcggacaccgcggaggaactccgggaccaggcgggcgtccggcctcgggtggtgtacctgcagaactcgtccgacccgatcgtctggtggaactggagcctgctctggaagcggccgccgtggctccgcggcgaccgggggccggacgtgatgccgtccatgcactggttcccgtgggtgacgttctggcagacgacgtgcgacctggtcttcgccaaccaggcgccgaccggacacgggcacgtctacaagtcggggacggtggacggatgggcgacggtcgccccgccgccgggctggaccgtggccgacaccgtccgcctgcgcgccaaactcggcaactag

SEQ ID NO: 4248 - DNA, 2382 bp, Actinoplanes utahensis
gtgccgggtgcgggcggccaccgggcactaccgatggttcgatttcaccgcctcgaaccagatggccaacccggccctgaacggcgtggtgatcaacgcacgggacatctcggagaaccgggcgttccaggagcggctggcgcacgaggcgcagcacgacccgctgaccggcctgccgaaccggcgccggatgcaggacgcgctcagctccacgctgcgccgcgacccggtggccgtgctcttcgtcgacctggacgggttcaagccggtcaacgacgcgtacgggcacgaggccggcgacgagttgctgcgtcaggtggccgatcggctcagcggctgcatccgggccggggacgtgctggcccgggtcggcggggacgagttcgtggtgctgatgcccggcgtgctgggcccgaacgacgtggccgcgatggcgaaccgggtgcgggccgtggtggagatgccgttccggatcgccggccggcacatcaccatcggcgccagcgtcggggtgcacctggccggtcccgcggaggatccggattccgcgctgcgcgccgccgaccacgctatgtacgagatcaagcggtccggcgggagccgtgccctgcgggaggcgctggcgagtgtcgggaggcaccgcgcgcccgacgaaggttagtgcacactgggtgcatgaattctagggtgctgtcccggcgtgatctcgacttcctgctctacgaatggctcgacgtcacgtcgctgaccgcccgggagcggttcgcggatcactcccgggagacgttcgacgcgttcctcgacgtgtcgcagcagatcgccgagcgcgacttcgccccgcacaaccgcaagagcgacctgaacgagccgaccttcgacggtgagcgcgtgacgatcatcccggaggtcggccacgcgctgcgggtgttcgccgagtccgggctgctcggcgcgaccatggacgccgagcacggcgggctgcagctgccgcacgtggtgcagcgcgcctgcttcctctggttccaggcggcgaacaccgccacctccgcgtacgcgatgctcaccggcggcaacgcgcacctgctgctcgcgcacggcacgcaggagcagatccggcggtacgtgcacccgatgatcgaggggcgctacaccggcacgatgtgcctctccgagccgcaggccggttcgtccctcagcgacgtcagcaccagggccgtacgacaggaagacggcctctatcggttgaccggcggcaagatgtggatctccggcggcgatcacgagctcagcgagaacatcatccacctggtgttggcccgggtcgccggcgcgccgcccggggtcaagggcctgtcgctgttcatcgtgccgaagaagctggacagcggcgagcgcaacggggtgacgctggccgggctcaaccacaagatgggttaccgcgggaccaccaacaccgtgctggccttcgacgatgcgctcggtgagctggtcggcgaggagggtcgcggcctgcagtacatgttccacatgatgaacgaggcgcggatcggggtcggctccggcgcggtcgctctgggctacaccggctatctgcacgccctcgcctacgcccgggagcggcagcaggggcggccggtcaccgcgaaggacccggccgcgccgccggtcccgatcatcgaccacgcggatgtacgccggatgctgctggccggcaagacctacgtcgagggcggtctggcgctggtcctgtacgccgcgaaactgctggacgagccgtccccggagcacagcctgctgctcgacgtgctgaccccgatcgtcaaggcgtggccctcgcagtggtgccggctcgccgacgacctggcgatccaggtgcacggcggctacggctacacccgggagtacccggtcgagcagttctaccgggacaaccggctgaactcgatccacgagggcaccgacggcatccaggcgctcgacctgctcggccgcaaggtcaccatgcacggcggcgccggcctcaccctgctgctcgaccggatccgcgcggtcgccgccgcgtcgcccgccgacctcggtgacccggtgcggaaagcctgcgaccggctcgccgcgaccaccgcgaagctctgggccgatccggcgaccgcgctggccaacgccaccgcctacctggacgccgccggccacctggtgatcgcctggatgtggctcgaacagctggcggcggccggggaccggccgggcgacttctacgccggcaagcggctcgccgcgagatacttcgtcacccacgagctgccccggatcggcccgatgctggacctgctggattcgggcgacacgctgcttctcgaccttgaggacgcctggttgggttag

SEQ ID NO: 4249 - DNA, 960 bp, Actinoplanes utahensis
atggccggtaaagccaccgtcatcgaagtcggcgaccacgacgtccgggtctccaacccggaccgggtctacttcccggagctcggcgccaccaagctcgacctggtcgagtactacctggcggtgagcgacgggatcgtccgcgcgctgcgtgagcgcccctgcatgctgcaccgcttcccggacggcctggccggggagaaggtgcaccagaaacgggtgccgaacggcgcaccgccctggctggagacggtccgggtgacattcccccgctaccaccggtacgccgacgagctgtgcgtgaccaagccggccgacgtgatctgggcggtccagatgtccaccgtggagttccacccgtggaactcccggcgggcggacaccgagtgcccggacgagtggcgcatcgatctggaccccatgccggactgcccgttcgacacggtccgccgggtcgccccgatcgtccgcgaggttctcgacgagctcggcatcgcgggctacccgaagacgtccggcggccggggcctgcacatctacgtccggatcgagccgcggtggggcttctccgacgtacgccgcgccgcgctggccttcgcccgcgaggtcgagcgccgcgccccgcgggacgtcaccaccacctggtggcgcaaggaccgcgacccgtcggcgctgttcatcgactacaaccagaacgcccgcgaccacaccatcgccagcgcctactcggtccgcggcgtcccggaggccaccgtctccaccccgatcacctgggacgagatcgccggcgtccagccgcgcgagttcaccatccgcaccgtcccggcccgcttcgccgagctcggcgacctgcacgccaccatcgacgacgtccaccaccgtctggacaccctgctggagtgggccgaccgtgacgaacaggccggcctggaaactcccgaggaaccggagggaacctga

SEQ ID NO: 4250 - DNA, 336 bp, Actinoplanes utahensis
atgcgtcaaccgtcggagcaggtgcgggccggggccggggtgttcgcccggtccggggtcctgttggccctgatcgccgttctcacctgggccggcgagggcgtcaacggtgtctgctcccgcgacgacggggcggttgccgggctggcgaccggggtcgtgatcgcggtactgggttatccgctgctgctcgtcgccgggttccggcgcacccggcgtaaccgggcccggcgcggtctgctgatcggctggtcagccgccctgctcgtggctgtggctctgatcctggcggcaggagatcacgttcgcgggctcccggccggctgcccggtctga

SEQ ID NO: 4251 - DNA, 1335 bp, Actinoplanes utahensis
gtggtcgtcgctgagcatcaccagcggcaggaagaagttgttccacgacgcggccatcgagaacaacagcacggtgaccggggccgggcgccgcgagcagcgccatcccgatcatcaccggggtctgcaccagcccgaacccgaccacccggagcacactctggcggaccagcggatcctcgaacgccggggagtagtgctcgaacagcaggcacggacgtccatcgacggcgaggggtaacctgccggaagcttggcgcggtcggagggggcacattgcgtcgagaagtcacgctacgtgacgtggcggagctggccggggtttccagccgaaccgtctccaacgtggtcaatgggtatgcgaacgtcaccgaacggacccggtcccgggtgcagcgcgccgtcgaggaactcggataccggcccaacgtgctcgcccgcaacctggcccaggggcggtccgggcagatcgcactggtcgtgccgtacctggacacaccgtacttctccgagctgctgcagagcgtgttgcgggcggcccgggcgcgcggctacaacgtgctgatcgaccagaccgacggcgatccggaacacgagcgcgcgttcatcgcccacggctcccgccggctgctcttcgacggcgtcatcttcagcccactcggcctcgaccagcaggcgctcgccgaccacgacccgcaccttccgctggtcgtcctcggcgaacgcagcagcgacggcaccttcgaccacgtcggcatcgacgacgtggccgcctcccgccaggccaccgaacacctgctcgacctcggccggcggcggctcgccgcgatcggcgaccagccctacgccagcggcgaggcggcccagctgcgcacccgcggcttccgcgaggcacacaccgcgcgcgggctggccgcccgcgaagacctgatcatcggcacgccccggttcaaccgcagggacggcgcccaggcgatggcccatctgctcgaccgggccgacccaccggacgccgtcttctgctactccgacctggtggcgctcggggcgatccacacgctggtggggcgcgggctgcgggtgccggaggacgtcgcggtgatcggctacgacgacatcgaggacggcgcctacgccaacccgtcggtcaccaccatctccccggacaaggagatgatcgcgaccaccgccgtcgaacgcctgctgctacggatcgacagcccgaccccgccgccggccctggagctgcgcgccccgcacaagctgatcatccgggagagcaccgccggtcgtactcgtcagaccgggcagccggccgggagcccgcgaacgtga

SEQ ID NO: 4252 - DNA, 1509 bp, Actinoplanes utahensis
atgctccgtgcgcgtgtcgcattgaatccgggcgccgtcgtggccccggtcaaccgccggaccttcggctcgttcgtcgaacacctgggccgctgcgtctacaccggcatctacgagcccggccaccccggcgccgacgaggacggcttccgcaccgacgtgctggcgctggcccgcgagctgggcgtcaccacgatccgctacccgggcggcaacttcgtctccggctaccgctgggaggacggcgtcggcccgcgcgatcagcgaccccgccgccgtgacctcgcctggcgcagcatcgagaccaacgaggtcggcatcgacgagttcgcccgctgggcgcggaaggccgacgtcgagatcatgtacgcggtcaacctcggcacccgcggcgtccaggaggcgctcgacgtgcacgaatacgtcaaccacccggagggcaccgcgctctccgagcagcgtcgcgcgaacggggcggagaagccgtacggcatcaggatctggtgtctcggcaatgagctcgacgggccctggcagatcgggcacaaggccgcacaggagtacgggctgctggccgccgccacggcgcgggccctcaaatccgccgaaccggacctcgaactcgtcgtgtgcggcagctccagctcgaccatgccgaccttcggcgcctgggagtcgacggtcctggagcacgcgtacgacgtggtggaatacgtctcctgccacgcctactacgaggagcacgacggcgacctgggctccttcctggccagcgcggtcgacatggaccacttcgtgaacagcatcgtggccaccgccgacgcggtcggcgcccggctgaagagcaccaggaagatcaacctgtcgttcgacgagtggaacgtctggtacctctcccggttccagaacgcgccgctgccgaacgagtgggaggtcgccccgcgggtcatcgaggaccggtacaacgtggccgacgcggtggtggtcggcaacctgctgatctcgctgctccggcacagcgaccgggtgaccgcggcctgccaggcccagctggtcaacgtgatcgccccgatcatgaccgagcccggcggcccggcctggcggcagaccatcttccacccgttcgcccgcaccgcggcgctggccaagggcgaggtgctggagacccgggtggacagcccgacctatcagaccgccagatacggcgaggccgacctggtcgacgcggtggcgacccacgacccggcgaccggcgacgtgacgctgttcgtggtcaaccggtcgcaggacgggccggtcgagctgaccgtggacctcgccgccttcggcgccgggctcgcggtcggcgagtcggtcactctcgccgacgacgatgtacgggcggtcaacacccgcgacgacccggagcgggtgaccctgcacccgaccgccggcatcaccgtggacggcactacggtgaccgtcccgctgccgcgagtgtcctggacggcgctgcgcctgagccgctga

SEQ ID NO: 4253 - DNA, 318 bp, Actinoplanes utahensis
atgcgccggaaaagaacattcctgctgacctcgctggcgaccgtcgccgcgctcggcaccgcctggttcgcgctgcccgcctcggccgcgtccgccacagccaccctgcgtaccgtctccgactggggctccggctggcaggacgaggtggtcgtgagcaacgacggccggtccgcgatgacctcctggaaagtcgaattcgacctgcccgcgggcacctcgatcggcagtttctgggataccgacatggcggccgccggcagtcaccgcacattcacgaatcgtagttggaacggcgcgattccggtgggccagtag

SEQ ID NO: 4254 - DNA, 1299 bp, Actinoplanes utahensis
gtgacgttcggcttcgtcgggtcgggcgcgcagccggtgaactgcaagctgaacggcgccccctgcggcgactcggccccggtgccggtccccaccaccgtccccgcttcccccaccgcgcccgccacccctgccgtccccgccacctccgctcccgctacttccggtcccgtcaccacctccgccccggccaccatcccgccgagggaggctctgctcccggtcacggtgaccaacaagaccggccgcggcgacgccgtccatctctacgtcctcggcgtcaacctggacaccggcaaactcggctacgtcgaccgagcaggcaggttcaccgcctggtccggcggtggcgccgtcccgctcgccgccccggacgtctccatccccggaccggccaccggcgccagcaccaccatcagggtcccgcgcaacctttccggccgcctctacttctcgttcggccggaaactcgacttccgcctcacccgggacggcctggtccagcccgccccgtgggcggccggcgacccgaaccacgacatcctcttcgactggagcgagttcaccgtcaactcctccggcctgtggctgaacagctcccaggtcgacatgttcgccgtcccgcacacggtcagcgtcaccggcggctcgggcacgaccagctccaccggcaccccggtcgcgaacggccgccagcgggtgatcgacgcgatcaaggccagccccgacttcgccagaagcgtcgtcacccgctccgacggcaccgtcctgcgggtcctggcccccggcaaggccgccgacgccggcctgatgagccccacctatctggacccgtacatcgccaccgcgtggaacgcctacaccggcaggacgctcaccgtcaccccgttcaccgaccgacccacggtcagatacctcggtcgtacgtccgggaacgtcatgtccttcaccgacccggccggccgggtggtggcgtccttcacccgcccctccacggccgacgtctggggctgcgacggcgccctcggcgccccgaacgaccaggtcgtcggccccatcgcccgcaccctgtgcgctgcgctgcagcgctccacgctgggccgcatcgacacccagccggccggtcgggccgccgacttctaccagggcaacccggccaacctgtacgccaaggccgtccatgccgccatgctcgacggcaaggcgtacgccttcgccttcgacgacgtcctcaaccaggagtccctggtccacgacggcgacccccgcaccgcggcgatcaccttcaccccgttctga

SEQ ID NO: 4255 - DNA, 1206 bp, Actinoplanes utahensis
atggcccggccggccccgcgccccaccaccggaccgcccggtcgcaccttcgcatggtcctccccgtccggaccggcgatcgatgaacagcacctctcccagccggtcgagccgttcagcccgcaaccctggtcaccgctcgaccaggcggccgacgcgattgccgacgcgacgaccgacgcgacgaccgacgccgcggccgactccccgctcaccctgctccgcgagctcgaccgctccgtcgccgcgacgctggcggccggtgcgccgagcgggacggcggaatggcgggtcgtcgagacccggctcgacaggctcgacgacctgatcgtccgggtcggacggctgccgctggtcgccgatccgcaggcgctcaccgatcggctggccgagctgcgccggaccgacatccgagcgtgcctgcgggagatcgaccgggcctgccggcagctcggcgcagtggaacacgcgtggcacgacgatcccgagagcatgacggatctgctcgacaccgtgatcgagcagctggagaaccgtggcgagccggagatccggacgcttcccgggccggccggcggcctcgacgggtcggcgccccggcgtccgatagcggacctgaccatccgcgacagccgcgccgtggtctacggctgcggcaccacggtgcacgtcgtgcaccgctgcaccgtcgagcgaccggtgatcgaggtcgcgtcgctgctcgactacgacgaggcggccgacaccgaggcgtggttccacagcgtcgagccggtgcgggccacgggcaccgacggcatgcagacccggatcatccgctccagcggcgtctcgatcggcaccggaagccgtcagcacagcgtgttcacccaccggatcccgtcctgcaccgccgacctcggcgccgtcgtcgcactgcccccggtgcgacaggcgatcctcgaccaccgccggtccggggggacgcccgaggcgacggccgcactgcgggaggcggtccggcgggcggtcgacggcgtcgacgtcagcgtgctcgtcccggacggcatggtggcgcgtctggccgccgaccggctgcggacgccgagcctgcggggcggcggcccgacgctgaccatccggcacggcgccggtgtcgccgtcggatgggacacctcggtgaccggggagacccggatcgacgtgggccgcccgacggtccggtga

SEQ ID NO: 4256 - DNA, 4089 bp, Actinoplanes utahensis
atgaagcatccgggttctggctcgcgatggatgcggatcttgatcggcgccgcgctggtggtggcgatgtctccggcgccggtgcacgcggcggcggccgccccgaagccgaaactcgcccattcggtcaccttcgacggctattcgttcctgatcgacggccggcgcacgtacctctggtcgggggagttccactacttccggctccccagcccgagcctctggctggacatcttccagaagatgaaggcggccggcttcaacgccacctcgctctacttcgactggggttaccactcgccggcgcccggggtttacgacttcaccggcgtgcgggacgtcgacctgctgctcgatatggcccaacgggccgggctgtacgtgatcgcgcgaccggccccgtacatcaacgcggaggtggacggcggcgggctgccgggctggctcaccaccaaggacgaacagaaccgcaccgacgaccccaggttcgaggcccacgccgacgagtggctcacccagatcgaccggatcctggcccggcaccagttgaccaacggcaccggctcggtcatcgcgtaccaggtcgagaacgagtactacaccggtaccacagccggccgggcgtacatgcagcacctggaggacaaggcgaaggcggacggcatcacggtgccgctgaccggcaacaacaacggcacgttcaactccgggacgggcgcgctcgacgtcgacggcccggactcgtacccgcagggcttcaactgctcgaacccggccgcgtggcagggcgtgccggacatcagctacgaccaccctgccgggcggccgctgtacacgccggagttccagggcggcgccttcgacccgtggggcggccccggctacgacaaatgcgcgcagctgatcaacgaccagttcgcgaacgtcttctacaagaacaacatcgcggtcggagccaccgcgcagagcttctacatgacctacggcggcaccaactggggctggctgggcatgccggagaactacacgtcctacgactacggcgcggcgatccgggagacccgccagctcgatccgaagtactaccaggacaagctgatcggctttctcacccagtcgatgcccgacctgaccaagaccgacaagatcccggttaccgcgccggacgacccggcgatcgtcgacaccgcccggcgcaacccggacaccggcgcccaattccacgtgctgcggcacaacgactcgacctcgatcgcggtcgaccggacccacatcgcgatcgacttcaacgcccgggccggcacctcgtacacctacgacgacgccgatcccgccctgcagtacaccggcgcctggtcgcatgtgtcgaaccagagctacaccggcggcgattaccacaactcggaatcgttctcgaacgtcgccggcgactcgctcgccgtcgatttcaccgggaccgcgatccgctggatcggctccaagaccaacaaccacgggtacgcggacgtctacgtcgacggcgcgaagcaggcgaccgtcgacacctcgggcagcgccgcccaggccgtgctctaccaggcggccgggctggcgaccggtccgcacaccctgaagatcgtggtgaccgggacacacgccgccggctcgaccgacgacttcgtgccggtcgacgcgatcgacctgccgccggccgtggccaccgccgaggccgtctacccgagggtgccgcagaagccgggcaccgcgatcaccctgaacggccgcgactcggacatcatcgtggccgacgccaagctgggcgacagccaactgcagtactcgacgtcggaactgctgaccgacgcccggatcggctcgcgcgacgtggccgtcctctacggtgacccggggacggacggcgagaccgtgctgcgcttcggcagcaagcccgccgtccaggtgacaggcggcccggtcgagcagacctgggacccggcgaccggcgacctgcggctcgactacacccactccggcctgacccgggtgtcgatcaccccggcctgggggcacccgctgcagctcctgctggccgacaaggcgacggccgagacgttctggcggcaggacaccgcggcggggccggtgctggtccgcggcagccacctgctgcgcaccgcgaccagcgcggccggtggccgggcactggcgctgaccggcgacaacgcgactgacccgaccatcgaggtcttcaccgcggcgaccgcgatccggtggaacggccgtccgctacggacccggtcggctgggcccggcagtttcaccgccgccatcccggccgccgcgcccgtcaccctgcccgccctgaccaactggaaacaccaggccgagtcgccggaggcgcagcccggcttcgacgactcgagctggcaggtggccgacaagaccagcacgttcagcgtgaccggccccggctcgctgccggtgctctacgccgacgactacggcttccacaccggcaacacctggtaccgaggccggttccgcacatcggccgggaccaccggggtgcatctcagctccgattcgggcggcggcgcgcaggccttctcggcctggctcaacggcgtctttctgggcagctcgacgagcggcagcggcgacttcaccttcccggccggcgccctgcggacgaccggcgacaacgtggtctcggtgctgaccgtgaacatggggcacgaggaggactacaactcgagcaacggcaacaaggcggcccgcggccttaccggggcctcgctgatcggcgcgccgacggcgccggtcacatggcgcctccagggtgtccggggcggggaacgcgagatcgacccggtccgcggcccgctctcgaccggcggcctctacggcgagcgcgccggctggtcgctccccggcttcgacgaccgcgcctggacgtcgacgaccctgccgaaccgcgacaccacacccggcgtctcctggtaccgcacgacggctgacctgcgcctgccggccggtcaggacacctcgctcgggctgaccgtgaccgacgacccgccgcaccgctaccgtgccgagctctacgtcaacggctggatgatcggcaactacgtcaactacctcgggccgcagcacagcttcccgatcccgaacggcatcctgcgtaccgacggccgcaactcgatcgcgatcgcggtctggaacctggacggctcgaccggcggcctgggcgcggtctcgctcaccgactacggcagctacgcctcgtcgctgcgggtggccgacgttaccagcccgtcctacgacccgcggaagtacgccctgccggccgccccggacgtccacgtcgatttgcaggttccggccagcgtccagcccggcacggcgttcaccgcgaccgcgacggtcaccggtccgcggtcggtctccgacgtcgtcccggccctcaccgcgccggccggctggacggtcagcgccccgagccccgccaggacccgtgcgctgcccgcgatcgtgacgtggcaggtccggccgcccaccggcgcccagccgtcgacggccgcgctgacggcgaccgtcgcctactccgagcgcggccgccgctcgaccgcgcgggatgagcggatcgtcggcgactactccccgccgcccgccggctcggtcgcggtcagcgacctgccgttgctctccgccaccaacggttggggaccggtcgagcggaaccagagcaacggcgagcagggcgccggtgacggcaaaccgatcaccatcgccggtcagacctacgccaagggtctcggtaccaacgcggtcagcgacgtcgccgtctacctgggcggcaaatgcacccggttcaccgcttcggtgggcgttgacgacgagcagaaaggcgccggcacggtcaccttcacggtggctgcggacggtaagaccctggcgaccactccggtcctgaagggcgggcaggcggccgcctcgatcgacgtggacgtcaccggggcgcaggcgctcgacctggtggtcggtgatggcggcgacgggaacggcaacgaccacggcgactgggcgacccccaccctcacctgtagttga

SEQ ID NO: 4257 - DNA, 213 bp, Actinoplanes utahensis
atggcactgcgacatggttcacagcgtcgcgccggtgcaggaccagaagggctggggcaacgtcatgtacatcccgctacgccgtggcgcccacgcaacgaggcgtatgcggagagcgtgcgcgaggcgttcctgaccggcgcgagcccgagcgacttcccggccgaggactacgagaaggaccggcccgaccggttccgccccggcagctga

SEQ ID NO: 4258 - DNA, 135 bp, Actinoplanes utahensis
ttgacccatcatcgtgctgatccgaccgcgatccgatcgctcgcatcgtcaccgctttcccgcaccggtcggtaccccgacctcatggcggcgctgtccggcatcccggatgtgcgagccggcgactcggtctga

SEQ ID NO: 4259 - DNA, 516 bp, Actinoplanes utahensis
atgaccgcgctgatcatctccgtgtcatggccgaccctcgtgctggtgctgatcttccgaggtcagttcaaggagaagagcatcgcgggccggccgaccgcgccgctgatcatcggcggcatgggaattctgatcatcatcctcaacgcgtggtggttcaccctcacccccgccgtatgggcatacctcgtcgtctcggcgggcatcggcgcactcttcggcgcgctgcgcggccgcgccgcgcgggtgtattggtcaccgcagcagaaggcggccgtacgccgcggcggcgtcgccacctgtgcgctcttcctcgccggcctggtcgcccactacctggcggaggtcgctttcctccagaaggcgcccatcctcgcctatggaggcgctctgaccgtcaacatctacctcgccgcctcgatcggcgccgccggcaccgtctaccgacgccgggcccgagccttacgccacggccacaagctaccgatgacagcccttgacccatcatcgtgctga

SEQ ID NO: 4260 - DNA, 627 bp, Actinoplanes utahensis
atgcaaacgtttaccgacctggtgcgagaaccgaaggacgccgccagcttcaccgagcgacagcggcgggcccaactcaccgccgcgaccatcgatctgatcgccgagtcgggcatcgaggccgcgtcgttcgcagcgatcgccggacgcaccggcgccagcaagggcaccatcgcctaccacttcgggtcccgcgaggagttgctgctcgcggtgacccgctcgatctaccgcgacgcggccgacgcgatgagtcccgtgaggcaagaggcctgcgccgctgacgcactgaggtcgtacgtcgcgaccaacatcgcctggatcgccgcccgccggcaggccacggtcgccctgatcatcctgcgcaccagcggagtctccgccgtccgcacgttgtgcgccgccgtcgacgaggcgatactcgccgatctttcggcgctgatcgaggctgcgcgcgccgaaaccggcgttccgccggccggcaccgacgacctcgccagagcgctgcgcggcgccatcgacgcattcgccatcggcctcgcacggcgatccgcccacctcgacgccgacgcctacaccgccgtcctgcaccaccttttcgcacccaccgcggcggcaagccgatga

SEQ ID NO: 4261 - DNA, 114 bp, Actinoplanes utahensis
ttgatggagtacggcgcggcctggaccacgctggccgaccgcatggggaacccgttcgacgtcggctccagcctggcggcggcgcatcggttgaccatgcgaatcaatttctga

SEQ ID NO: 4262 - DNA, 1041 bp, Actinoplanes utahensis
atgcctccagcgtcgtcccggaaccactcccgggacagtggcaggaatgccatacatcttcaaaatcctgccacctccggttaccgtggggacatgttgcgcagtgtcgcggtgctgaccatgtccggggtggcacccttcgaactgggtgtcctctgtgaactgttcggttacgaccgctccgcggagggcctcccggcgtacgacttcgccgtgtgcagtgtcgacgcgaaaccggtccggtcccgccccgggttcaccatcgcacccacccacgacctcgcccccgccgagaccgccgacctggtcgccgtcgcccccaacgacctgcgcccggtcccggccgagatcctcgacgtgctgcgccgcgcccatgcccgcggcgcctgggtgatgagcgtctgcaccagcgcgttcaccctcggcgaggccggcctgctcgacggccgccgctgcaccacccactggctgcacacggccgccctggccgcccgctttccccgggccgaggtcgacccggacgtcctctacgtcgctgacggcaccatcctgaccagtgccggcacggccgcagccatcgacagcggcctgcacctgatccgcgaggagcagggctcggcggtcgccgcccagatcgcccgccggatggtcgtcccaccccaccgcgacggcggccaggcgcagttcatcgagacaccgatgcccacggtcagctgcgagaccatgcagccgctgctgacgctgctgctggagaccctggaccgggagcacaccgtcgacacgatggccgacatcgtgcacatggccccgcgcacgttcgcccgccgcttccgcgccgagaccggcgccaccccgcacgactggctcaccgcccagcgcgtcctgctcgcccgccgcctgctggaggagaccgacctgggcatcgacgcgatcgccgaccggtcgggtttcggcagcgcccagacgctgcggcaccacttcacgcagcgcctgagcacgacaccgcaggcctaccgcggcacgttcaaggccaaggtctga

SEQ ID NO: 4263 - DNA, 123 bp, Actinoplanes utahensis
atggaaatcgcgatgctcgtcttcttcgtcctgctcctggccgcctcactggccgggctgaccgccgacagccgggacagcgccgactggaaacccaccaacgacggccgccgcgccgcatga

SEQ ID NO: 4264 - DNA, 1698 bp, Actinoplanes utahensis
atgcacctctccagatcacgtttcgcggccgccggaattgccggtgtggctctcgccgcgagcgtgtccgtccccgcccaagcggcggccaccggggtcgacgcggttccgaccccgaagctcggctggtacaaatgctacgcgatcgccgagtgcgcgaccgttcagctgccgctcgactatgaccggccccagggcgcgaagaccgagatcgccgtcctgcgggtgaaggccaaggaccagaaacacaggatcggcagcctgttcgtcaacccgggcggcccgggcggctcggccaccgacttcgcgctcggcgcatcggacttcctcagtgacgagctgctgcagaagttcgacatcgtcggcgtcgacccgcgcgggatcggcgccagcgccaacatccgctgcttcaagacggtcaaggaccagaccgcggtcgtcgaccagctcaacatcgcgttcccgctgggaaggaagcaggaggcgtcgtacgtcgcgggcgcccgcgccctgggcaaggcgtgctcgtcgaccggcaaaccgctgtccggcgcggtgtccaccaccgaggtggcccgcgacatggacgtgatccgccgcgcggtcggcgacaggaagctcacctatctcggcttcagctacggcaccgcgctcggtgagtactacgccaacctgttcccggacaggttccgggcgctcgtcatcgacggcaacctcgatccgcgggcctgggtcggggccggcgccgcgggcaaccagatcctggatgcccgtctgcattcggccgacggtgcgtaccgcgccctgaaagagatcttcaagcgctgcgacagggccggggagaagtactgctcgttcgcggccggtgacccggagaagaacttcgcggcgatcgcggccagcctcaaggcgaagccgctggtgatcaccgacgaatcggggacgtacaccatcacgtacgccgatttcgtcagcgccgtgctcggcgggctctactcgacgtacgccggggagagcgcgatggacaccgcggcgcaggtggccgccctgatcaagggtgactcgccggcggccgtggcggcggcacgcacgaccctgctgaagcggatcaaggcggcgcgatcggtcggctacgacttcccgtacgacaacggtctcgaagccggcaccgcggtgatctgcaccgacggcacccacccgaagaacgccgcgacctggccggcggcgaccgcggcccgtgacaagcaggccccgtacttcggccgggcctggggctacatcgacaccccgtgcgcccgcgacacgtggaccgtgcgggacgaggatgcgtaccgcggcccgttcaaccacaggaccgcagccccggtgctgatcgtcggcagcttctgggatccggcgaccaactacgactcctcggtggcggtgagccggacgctgcccaactcgcggctgctgagcagcgacaactggggtcacaccgcgtacggcacgggtgactgcgccaccgccgcgatcgaccggtacctgttgaacggcacgctgccggccaagggcaccgtctgcgcggccgagcaccagccgttcaccgagccgatcgacccgggcacggtggcgacccgggtggccgcggccgccgcggtgcacggcaagcggctgccgccggtggtctccctccggccgaagtcgatcctgggctga

SEQ ID NO: 4265 - DNA, 642 bp, Actinoplanes utahensis
atgtccatcgcctggccccaggtcttcctctcgtgcgttcggcgccgcaccggcggactgtccccggccgcggtactgctctcggtcgcgatgccggccggctggctgacctacgggctgctgatcggggaccggatccaggtggtgtcgaacacactgaacctgatcgccggggtcgccgtgctgatcgcgttgctggccggccggccgaacctgcggggtgccgcgagcatcgccgggccggtttttttcgccatctgcgcagcggcgtcgagcgtgctgctgccgcacgtcaccgcggcccgggccggcgcgctgctcggcacggtgctcgcgctctcgtcgctgctgtccgcgctgccgcagccggtggccttgctgcgcgaccgcgcccaggacatctcgggactgtccgcggcgcgattccggctggccacggcggccagttcggcctggctggtctacggcctgggcaccggccagccggcggtctgggcgtccgctctggtcggggtggtcagcgcggtcacggtctgcttcgtgctgaccggccggcgtacgacggtggaccccgccgcgttcggcaccccgcagtggcgggacacggtgatcacccgcagtctggccgtgaccggcgtctga

SEQ ID NO: 4266 - DNA, 1167 bp, Actinoplanes utahensis
atgctgaccgacgtggacctgcccgcgcccggcctgctgtggacccgctgggcggcactcagcgcagtgacgaccggaactgatcgcggcacgctgtggtcggtcgatccgtcgggcgcccgccacgacgacccggcgaccgggtgggcccgcttcgctctgctcgacggccgccgggcggtcctgtacggcgcgcatcacgaccaccacgcggcggtgtcggccgacccggcggcggatccgctgaccggggcgccggactggctgccatggtcggagctcacgtcactggcagaaagtgatcagctcgggttcgtgctctggcacgatcagggccggtggtcgcgggtccggtaccggcggccctacgaggacggcctggccgacgtcctgtggccgctgctcaccgaggcggatgccgtcgccgcgctgcacgcccggcacccgcgggccgtcggtcgcaccacggccgccgccctgctgcacgccgcgatccgcggcgaggtcgacgccggccacctcaccgcgctgctgggtgaggaagctgacattccggccgcgctcgccatcgcgggccgggccggcctcacccccggcaccaccccgccccggatcccgcccggccggcgcccggcgatgcgccgggtccggcacctcagccacggcgaacacgaccggctggtctgggcggcgatgcacgacgcggccgagctgcggcgcccggccccgccggacaccgaggagctcggtgaactggtccgctggctgcgggaacgcgcaccggccggggacggccgatgttcactgctggcctacgcggacgcgaccagcttcagctcgcagcccggcgaccatccgccggcgtcgcggccggccgaggagcgatacgcggctttccgccgcttgaccgagctggtccgggccctgcgccgcgccgagtccgacccgcgttacggccgctggctgttcgtccgggtggagacgaccgccgcgggccacgagatcgagcgctgctacgactcgtggccggcgtggtggcacgacgacggcgtctccggcccgtggcgcaccgacctgcaggaggagacggacgcccgacacgaccgctggcgcccgtcctggaccccgctgctggacccggagatcgcctaccgccccacctcctga

SEQ ID NO: 4267 - DNA, 570 bp, Actinoplanes utahensis
atgaccaccgtcttcaccgagcacctcaccggcctgggcgagttcagcctggtccggctggatccggcggcgcacgccgacctggtccacacgtgggtgacccggccccgcaaccggttctggggaatgctggaccacacccccgagcaggtccgggagatctacgccttcgtcgacagcctcgacacccaccacgcctacctccagctcatcgacgaggggccgatcggcgtcttccagacctaccagccggagcacgacccggtgggcgggtgctacgacacccggcccggcgacttcggtctgcacctgatgttcgacccgggcgaccggcacctcccgcacctgaccagcgtcgtgatcccggcgctgctgcggttctgcttccgcgacccggcggtccggcgcatcgtcgtcgagccggatgtgcgcaacaccagggcggtgacccggatgcggcggcacgggttcgagccgggaccggagatcgacctcgggcacaagcgggcccggctggccttcctcacccgcgaccgctgggcggcgaccggtcaggaggtggggcggtag

SEQ ID NO: 4268 - DNA, 1785 bp, Actinoplanes utahensis
gtgagggtctaccgcgacgcgtacgggatcccgcacctgcgggccggttcggtcctcgaactggcctgcctgcaggggcgggtgaccgccgccgaccggggccggcagatcaccgtcgagcggctgcggtcgctgggccgactggccgccgtggccggcccggacgaggtgccgtgggaccggttcgcccggcgtgcccgcctggacgacaccgcacgccggtgtttcgccgggctgccggacgagacccggcggttcctgaccgcctatgccgacggcgtgcgggccggcgggtgcgactgggacccgtggtcgccgctcggtgtcttccaggtgcagcacatcctgttcgggacgtttccccacaagctgtggcgggagcacgtcgagcggaccctcggcccggcggcgaccggctggttctcggtcgagggaccgccgggcggctcgggcagcaacgcctgggcgacgcccgggcagatcgccggggatccgcaccggctgctcgagctgcccggcgtctaccagcagatccggctggcctgcgacgagttcgacgtggccgggctgaccttcccgggcgtgcccggggtgcagcacttcgggcacgccggggaggtggcctgggcggtgaccaacgcgatggccgactaccaggacctgtaccgggaggagttccgggagacccccgccgggctcgaggcccgggggccggacggctgggagccggcgcggcggcatcgggagacgatcgacgtccggggcgccgagccggtgccgatcgacgtcatcgagaccgcccgtggcccactgatcgacagcggcctcaccctgcgaacaccggcccgggtgtcgtccgacctgggcttcggcgccctgctgccgctgctgcgcgcgcgcaccgcgggcgaggtggcggacgccttcgccggctgggtggagccggtcaacagcgtgctggtggccgactccgcgggcacgctgctgcagctgaccgcgggccgggtgccggtccgcgacgaccgcaaccggcaggtgccggtgccggcctgggagccgcggcacacctggcagccggcttgggcgccgggtttccgggccccggtggcgagggcggtcaacgccaacgaccgccggccggacaccgcgccctacggcgtggacttctgcccgcccggccgggccgcacggatccgtgagctgctcgaccggggcgccaccgccgagcagatccacatggacaccgcgctgccggccgggtcgccgggccaccaggcgtggtcccggtcgcagacggcgcgcggcctgcacggtcatccggcgttgcggccgctgttcgccccgtccgggtacgacccgctcttcacgccgtggaccgacccgcgagcccggatcgggcaccacctggacggcgtcctcgacggtctgggcctgaccgtcaccgacacaccggcgcccggtccctggggcgcccggcacctgctcgccccggtggtgctgaccggcctggacgtcaccgtgccccgggtcgagctgggcggctcgtccggctgcgtgctgaacacgtccagcgtccccggggtcagcgaccggtgtacgcgcggcccggtggcccgctacgtctgggacctcgccgaccggcagcgcagccggtgggtcgtcccgttcggcgcgctcgacgaccccggctcgccgcatttctccgaccagttgccgctgtgggcgaacggcgacctggtgcccctcgtcaccgactgggaccgcctcaccctggagccccgatga

SEQ ID NO: 4269 - DNA, 2208 bp, Actinoplanes utahensis
atgcggctgatccccctcgacctcgaccgtgacctggagctgctgcaccggtgggtgacccacccgcggtcccgtttctggggactgcagggcgccggcccggaccgggtccgcgcggagtatcagcggatccgggacgacccgcaccaccacgcgtggctcgggctcgacgacgacggcaccccgctgttcctggccgagacgtacgagccggcgcacagcgagctggccggccactacccggtgcgccccggtgacatcggcatgcacgtgctggtcgcgcccccctcccggccgcgctccggggtgacctccgcggtgctgcgcgcggtgctcgacttctgcttcgccgacccgcggatcgaccgggtggtcgtggagccggacgtccgcaacgaggcgatcgcccggaagaacgcggaggccggtttcgtcgaggagggacaggtccggctgcgcgacaaggtggcccgcctcagcttctgcacccgcaccgggtacgagatgagcgtgccgcatctgcggccggccgtcatggcgtacgcgcatcggcggctgatcgcgaaggcgatcgccgagttcagtcacgagcggctgctcgcgccggaggatctcggcgacggcgcgtaccggctgggtgcgctgaccttccgcgcgcggcggttcgcgctggagcactgggtggtcgacccggactcgctggacggccccctcgatgccctcgacttcatcagcgggctgcgcgagacgctcggcatcccggagcgactgctcggcacctatctggaggagatcgccgcgaccctggccggcaccgcgtggaaggcgacccaccgccgggagaccgccgcgcagctggtgcacgccgacttcccgaccatcgaaacggcgatgaccgaggggcatcccggcttcgtggccaacaacggccggatcggcttcgggctgcgcgaccacgaggcgtacgcccccgaggcgggccggccggtccggttgcgctgggttgccgtccgcaaggatgccagtctgttcgtcaccgacggcgacgagcgggcgcactatctcgccgagctcggggccgccgggctggagcggcacgagcggtatctgagctcgctgggcttggccccggacgactaccgctacctgccggtccatccctggcagtgggagcacaagctgaccgtgaccttcgccgcggacgtggcgcgccgggcgatcgtgccgctcgacgagggcaccgaccggtaccgcgcgcagcagtcgatccgtaccttcttcaacgtcgaccggcccgaccggcactacgtgaagaccgcgatcgcggtgcagaacatgggcttcctgcgcgggctctcgccgaagtacatgcgggacacgccgccgatcaacgagtgggtggcgcaggtcgtcggaggcgacccggagctgcgggcatgcggcttcggtgtgctgcgcgaggtggcggcgatcggctacaccggcgacgcctaccaccgggcgggcacggccggcgcgtacaccaggatgctcgccgccctctggcgggagtcgccggtgccgctgctcgccgagggtgagcggctggccaccatggccagcctgctgcaccgggaccgggccggtgacgcgctggtcaccgcgctgatccgggagtccggccgggagccggccgcgtgggtcgcggcctacttccgggcctacctgcggccgatcgtgcactgcctgctcgcccacgatctcgccttcatgccccacggcgagaacctgatcctggtgctggccgatcacgtgccgagccgggtgttcctcaaggacatcggcgaggaggtggcggtgctcgacgaccggccgttgccaccgcgggtcgagcggatccgggccgaggtcagcgacgagatcaaggaactcgccctgttcaccgacgtcttcgacgggttcctgcggcacctggccgggatcctggcggtcgacggggtgctggccgaacgcgacttctggacgctggccggggactgcgtgcggggacacgccaaggaccatccggagctggccggccggctgaacctgctgcggcccacgttccggcattcctgcctgaaccggttgcagctgcgcgacacgctgcagatggtggacctcaccgaccaggccggctcgctgatcttcgcgggtgagctggagaacccgatcgcggtgttcgggtga

SEQ ID NO: 4270 - DNA, 1479 bp, Actinoplanes utahensis
atgcgacgagctgatgccccggctgcggcagcggctgttccacgacggcgccgcgatcgtcgccgggaccaccgtcgacggccatcactggctgaagttcaccgtgctcaaccccgccaccacggccgggcacctgcacgacacgctggacctgatcgaggcggccgccgtgctgcacggcccggcggtgccggcctgatgcgcacctacgacttcgccgccgtcggcgtcggcccgttcaacctgggtctcgcggcgctcaccgagaacgtgccggatctggacggcgtcttcctggacgcccggcccgggttcgactggcacccgggcctgatgatcgagggcgtcaccatccaggtcccgttcctggccgacctggtcacgatggccgacccgacgtcccggttcagcttcctcaactacctcaagcaggtgggccggctgtacccgttctacatccgggagaacttcttcccgctgcgggccgagtacaacgcgtactgccggtgggtcgccgcccagctgcccgcgatccggtggaacgcccgggtggacaccgtcacccacgacggtgaggcctacctggtgcacaccgccgcggagacgttccgggcgcgccggctggtgctgggcgtcggcaccgccccgcacgtcccggccgtcgcgggccgggtgccgcacgtgcacagcgccgactatctcgcccaccgggaccggctgcgcaccctggggtcgatcaccgtggtcggcagcgggcagagcgccgccgagatctaccacgacctgctcgccgggatcgacacctacggataccacctgagctgggtcacccgctcgccgcggttcttcccgatggagtacaccaagctcacgctggagatgacctcaccggagtacatccggtaccaccacggcctgccgatggcgacccgcgaccggctggcccgcgagcagcgtcacctccacaagggaatcagcgccgacctggtcgacgcgatccacgagaggttgtacgccgggagtctcaccggcccggtcccgacgagcctgctcaccggtgtcgagctgaccgacgtcacctgggacgcggcggccggccggtacacgctcggcctgcaccaccgggagcaggaccggtcgttcgccacgaacaccgaagggttggtgctggcgaccggatacacgccccgggtgccgtcgttcctggaaccggtccgggaccggatcaactgggacgcccgcggccgcttcgacgtggccgtcgactactcggtcgaccggaccggcaaggagatcttcgtgcagaacgccgaggagcacacccacagtctgaccgcccccgacctgggcatgggtccgtaccgcaactcggtgatcctgcgcggcctgaccgggcgcgaggtctatccgatcgaggagcggatcgccttccaggagttcggcgtccccacccggcagctggtgacgacatgcggctga

SEQ ID NO: 4271 - DNA, 1446 bp, Actinoplanes utahensis
ttggagcccgtattgccgcatctgttctcggggtccaccctcgacgcgtacacgtcggcggtgtggcacgcctcggccctgctggccgatcgggtgaaggcggtgcgccagccgtatgccggggcgaccgtggccgagctgcgtgagcaggtcgacgcggtcgatctggatcggccgctcggtgacaccggggcggccctgcacgaggttgcccggctctatctggacaacgccgtctggttccacgagccgacctacgtcgcgcacctgaactgcccggtggtcatcccggcactcagcgccgaggtgctcctctcggcggtgaactcctcggtggacacctgggatcagagcaccacggccacgctgatcgagcgccgcctggtggactggaccgccggccggatcggtttcgggcccgacgcggacggtgtcttcaccagcgggggcacccagtccaatctgcagggtctgctgctggcccgggagcacgcgctggagcggcgggaccgggcggaggcgctcccccggctgcggatcttcgcgaccgcccagagccacttcagtgtgatcaagtcggccggcatcctcggcctggccggcgacgcggtggtcggtgtcgcgaccgacggggacgggcggatggacgcggccgcgctggccgtggcgatcgacgacgtccgccgtgcgggcgggatcccgatggccgtggtcgccaccgccggcaccacggacctggggcgcatcgacccgctcccggcgatcgccgcggtctgcgggcaccagcggatctggttgcacgtcgacgccgcgtacggctgcggtctgctcgtctcgcgccgccgccggcacctgctggacggcgtcgagcgggccgactcggtcaccgtcgacttccacaagagcttcttccagccggtcagctgcagcgccctggtggtgcgccggggtgagtcgctgtcccggatcgcggtgcacgccgactacctcaacccccgcgccgcgaccgtccccaaccaggtggacaagagcctgcagacgacccggcgcttcgacgcgctgaagctgtggatgacgctgcggaccatcggtgccgaccggatcggcgacatgttcgacaccgtggtcgaccgcacgcacgagatcttcgcggcgatgcggacccggtccggcttcgagacgctggccgcaccgacgctgagcacgctgctgttccgcttccgcccggccgggatgagcgtggccgaatgcgacgagctgatgccccggctgcggcagcggctgttccacgacggcgccgcgatcgtcgccgggaccaccgtcgacggccatcactggctgaagttcaccgtgctcaaccccgccaccacggccgggcacctgcacgacacgctggacctgatcgaggcggccgccgtgctgcacggcccggcggtgccggcctga

SEQ ID NO: 4272 - DNA, 573 bp, Actinoplanes utahensis
atgaacgtccgggatgatccgttcaccggcggcgtgtccccgcgctaccgccgcatcgaccgcgaactcaccaccgcgatcatcgacgcccagtgccgcgactggaccgccgaccgccccgaccgggtcggtttcgcccgcctcggccacgtacgccacgaggtccgcaacgccgccgcccgctaccgcgtccagccgtcggcgatcagcagcgtcaccgtcccggtcgcgctggccgccgtcgccctcgtcgtactgcccctggtgctcctgatcccgcatgcgacccgcccgctgccgttggccgcgatcgcggtcgccggggtctgggcggcctacgcgctgcgcgccggcctccgccacctccaggtccgccgccaccgccgggccgccgacccacccgcgccgatcgacgaccctttcctgtacgcccgcctccgccgcgccatcgaatcctgcgcggcggccgcgcgtgccgaccgccactacccgcgccgggccgccgcggccgatctggaatacgccctggactggctgtccgcggcccaggaggaactcccccgcctccgctga

SEQ ID NO: 4273 - DNA, 2190 bp, Actinoplanes utahensis
atgaggtggtcatggccagtccttgccggcgtcgtcgaggtaacgctccaggcagtcgatggcctggcacagcagcaggtccgcgtcggccagccgggccagcaccggatcggtggtcatcgcgcggtgcagggccggggtgtgccagttggcgcggccggcgtggcgcagaccggccgacaccagctgcacccgggcccgttccagggcgaacgggactgccaccagcccggaccccggcgagtccgggagtggcggcaggtcggggggtacgccgcggcggcgcaggacggtggccaggtgcagggcggcggccagcaccagggcggagaacatggccacggcggccgggggtgccttcgtcgcggtggcgagcgcggcgcacagggtgaccaccacggcggtgacggcagtgttcaccagcatcgaggtcagggcggagcggcgggggagcagggcggccaggacggcgtcggcggcggcgagccggccgcaggcggagcggatccagacctgttccacgtcgccgttcccggtgagttcggcgaagccgtcggcgatcagcgcacgcacggcgccgacttcggcgggcagcgcgcgaaccggcgacatactcagcagaatcgcaccgatggggcggtggtgaactgtcaggtttctgcgtcgggccggcgccacccggcggcggggcgcgcaatggtcgaccgttgggctcatgtccacggggtggccgccgatcgtcccgccgtgcgcagacagtggctgaagctgccggccgggaccgtggcacggacccgggtcgccgccgtggcagtcggcggcatcggcatcgtgatgcagctgggtcagctgggcaacgccatgcggccggtcgcgttcagccgtgtctccggcgcgtcgatcgtcgccctggtgctcctgctggtggtcatgcaccggcggcagcgcagcggatggtggagcgtcccggttatcccggtgctgatcgcggtgggcgcggccggtctgcgggacccgctggccgcaaccgcgctgtcgctggccacgctgatcacctgcacgctctacgacacgccgcgccggtggctcgcccgggtggtggcggcgctggtggccctgccggccgcggtggccatctccccggacgtgctgccccaggcgccttcctggcacgcgccgtcggtgctcgccctgctgccgcagatcctgctgatgggcctgctgacccgggcgttccatctggcgctgcagcgccaggagcgggccgccgagcgggacgccctgctcacccgagccgggcagaagctgctcgcggtcaccgacaaccaggggatccaccgggtcggcgagcggaccgcgctgcggctggccgacatgcatcccggggtggtgctggtgatcgtggtgcgcgacgccgacgggctgttcgtggagttctgcgccggcgtcccgtccggaccggtcgggacccggctgtcgggggcggcgcccgatccggcggagctgaccacgctgctgcccggttacggtcactggcacacggactcgctgggcggcgacccggccaccgcgccggtgctgatgatggtcggcggccgcagggcggtcccggtggaggtgctggacgccttccggagcctgtcctaccaggtgacgttggccggcgaggcgcaccaggcgcgggtcgagctggagtaccgggcgaaccacgaccagctgaccggcctgccgacccgggcgaagttccgggcggcggcggaggcggcgaccggcggggtggcgctgctcaacatcgacctggacgggttcaagcgggtcaacgacgagcacgggcacgcggccggggacgagttgctggtcgcggtggccgggcggatcgccacggcggcgggccggcacggggtcgcggcccggttcggcggcgacgagttcgccctgctgctgaccggcgtcgaggatgccgggcaggccgaggcggcggccgggcggttgtgcgcggcgctggccgagccggtgcggctgggtgcggcgacggtccgggtcggcgccagcatcggggtcgcgctggccgagcccggtgtcggcgtcaccgacctgctgcgccgcgccgacctggcgatgtacacggcgaagcacggcggcaagaaccgggtggtccgctacggcgtggagtgtccggcggcggtctga

SEQ ID NO: 4274 - DNA, 735 bp, Actinoplanes utahensis
gtgaggatcctgctgctcggcgggacgaccgaggcccgccggctcgccgggctgaccgccgatgaccacgaggtgaccacctcactggccgggcggaccagcgcgccgctgcgcccggccggggacgtgcggatcggcgggttcggcggggccgacgggctggcccggtacctggtcgagcagcggatcgacgtgctggtcgacgccacgcacccgttcgcggcggggatcagcggcaacgcgggctcggcggccgcggccaccggcgtaccgctgctcgtcgtgcggaggcccggctggaccgcgacgccgggcgacgcgtggcaccgcgtcgcgtccctggaagcagccgtcgcgcgtctgaccggcggccgggtcttcctgaccaccggccggcagacgatcggggcgttcgcggcccgcgacgactgctggttcctggcccgatcggtggaaccgccggagccgccgctgccccggcgcctcgaagtgctgctcgaccgggggccgttcaccgtggcgggcgagcgggacctgctcctgcggcaccggatcgacgtgctggtgaccaaggacagcggcggatcggacgcgaagctcgtggcggcgcgggagctcggcgtaccggtgctgatgatcgaccgtccgccgctgccggcggccgcgaccgtgcccaccgccgaggccgccgccgcctggctcgctcagaccgccgccggacactccacgccgtag

SEQ ID NO: 4275 - DNA, 1212 bp, Actinoplanes utahensis
atgcgtgcggaaaaccctccggtggtcacggtcgtcgggatcggcgcgggcggtttcccggactacggcggtacgccgtcagcctcgctcgccgcggccgaagtgatcttcgggagcccccgtcagctggccctgctcccggattcggtcggggccgagcgggtgccctggccgtccccgatgctgcccgggctgcccgacctgttcgcggcccaccacggccgccggatctgtgtgctggccagcggcgacccgatgttccacgggatcggcgccaccctggcgacgctgctcggccccgagcggctgcgggtcctgccgcacccgtcgtcggtgtcgctggccgccgcccggctcggctgggacctggcccgcaccgacgtggtcagcctggtcaccgccccggtggcgagcgtcggccgggtgctgaacccgggccgccgcctgctggtcctgtcggccggcgcggacaccccggccgcggtcgccgcctatctgaccgcgcgcggctatccccgggcgcagctcaccgtcctggagcagctcggcgggccgcgggagcgggtgtgcaccggcgcggccggcgactgggcgctgccacccggcgacccgctgaacgtgatcgcggtcgagtgcggcgacgggccgccgcttccggtcgtcaccgggttgcccgacgacgcgtacgacggcgatgggcaactgaccaagcgggaggtgcgggcggtgacgctggccgccctcgccccggtgcccggcgcgctgctctgggacgtcggtgccggctccggcagcatcggcatcgagtggctgcgcgcccatccggcctgcgcggcgatcgcgatcgagtcgtccgccgagcgggtgacgacgatcaccgcgaacgccgccaggctcggcgtccccggcctgacggtggtgcacggccgcgccccggacgccctcgacggtctcccccggcccgacacgatcttcatcggtggcggcctgaccagggacggcgtgctcgacagctgtctcgcggcgctgcgcccgggcggccggctggtggccaacgcggtcaccgtcgagtcggaggcggtggtcgccgcggcatacgcgagactgggcggcgcgctgacccgcctgacggtgcagcgcggctcgccggtcggtggcttcaccggctggcgcacctccatgccggtgacgatctgggcggtaacccgttga

SEQ ID NO: 4276 - DNA, 1593 bp, Actinoplanes utahensis
atggccataccggccttccaggaccagcgtcagctgccggaggacgacgacggctacttcgccggcctgcgctcggacactgacgaccggccgtcctggaacgggccgtcgcatgccgggccgacctgggacgccatgccggaatggccggcggcggcgccgtcgcagccggccgatccctaccggcgcggcgacatcctggtcgagtcgaacacctcgccgaccggctggaaggccggcaccggcgtgccggtgccggaggaccggccgccggccgaggcgacctcgggcaaccggctgttcaccgtgatgctgttcttctccgggctggccaccagcgtctcgctgtggctgttcgacacccacgccggcgcggtgcacgacaccgccagcatgatgctggccaccggccggatcaccgggctgatcggcggctacctgctcttcatccagctgctgatgatgagccgggtgtcctggctggaggagtgggtcgggtcccgcgacctgctccgctggcaccgctggctgggcacgtcgatgctggtcgcggtgctcgcgcacatcgtcaccatcgtctacgcgtacgccctgcaggccgacaccggcgtggtggaccaggcgtggagcgtgatcaccacgttccccgagatgatcagcgccacggtggccaccggtctgctcgtgctgctctccttcacctcgatccgctggttgcggacccacctgccgtacgagctgtggcacctgatccacctcaccggctacctggtgctgctgctcggctacggccaccaggtcgccaccggcgcggacctgagcgggcggtacgcgtcgtacttctggcccggcctgggcgccctggtgatcgccgcgctggtctggggccggatcgtcgaaccggtctggctcaacgcccggcaccggttcagcgtcgccgaggtggtcgccgagggtgccaacacgttctccatctacatcgccgcgaagaacctggacaggctgcccgcacaggccggccagttcatgcgctggcggttcctgaacgccaacggctggtggcagtcgcacccgttctcgctgtccgccgcccccaaccgggagtggctgcggctgacggtgacggtggccggcgggcacaccgccaagctcggcgcgctgcggcccggcaccccggtctgggcggagggaccgttcgggacgttcacggcccagcggcgtacgcgtcgccgggccctgctgatcgccggcggctccggcatcgcgccgatccgggcgctgctggaggacatgccgccggacaccatcgtgatctaccgggccagccgcccggacgagctggtcttccgggccgagctggaggagctggccgagcagcgggacgcctgggtgcgctacatcgtcggctcccgcaccgacccggggccgcagcggctgttcaccgaggccggcctgcgcggcctggtgcccgacgtgaaccggcgcgacgtgtacctgtgcgggccgcccgggctggtcaacgccgcggtcgccacccttcgccagctcgaggtgccggacagccagctgcacctcgaccccttcgagttctga

SEQ ID NO: 4277 - DNA, 504 bp, Actinoplanes utahensis
atgcgtcgtagcaccgcagcagccgtcggcaccctgaccggtgcggccctgatcctcggggtgcgcctgagcgtgcagccgccggcggccccggcggccgaggccgcgcccgtcgcggatcagcagaccacggagccggccgcggggaagaagccggcttcttcggcgccgtcgaagaagaaggacgagaagccggccgacaaagcggccgacaagccggccgcgtcggggctgaaggacggcacctacaagggccgggccgtgcagaaccagtacggcaccgtgcaggtcaccatcaaggtgaccggcggcaaggtgaccgacgcgaccgcgacctaccccaagaacgggtacagcggcacgatcaacccgaacgcggtcaccaagctcggccaggagaccctcaaggcgcagagcgccaaggtcgacacggtctccggcgcgaccttcaccagcggctcgtacaagacgtcactgcaggcggcgctcgacgcggcggcgtag

SEQ ID NO: 4278 - DNA, 750 bp, Actinoplanes utahensis
gtgcggcacgtcgaacacgtcatgggtacggtcgtcagcatcgacctcgccgacgacctccccgagtcccggctgcgggagctgatcgcgtccacctgcgcctggctgcacgaggtcgacgcgcggttcagcacgtactcccacgacagcgaggtcagccggctgcggcggcgggagatccggcccgaggactgctcggccgacctgcggctcgtcctcgaccgctgcgccgacctgtggcgggagaccgacggctacttcgacgcgtacgcgcgcggcccgctcgacccgtccggatacgtcaaaggctggtcggtcgaggtcgcctcggcccggctcgcggcggccggctccacccggcaccacctcaacgccggcggcgacatccggatgcgcggcgccggaccgggcggcggcccctggcgggtcggtgtccggcacccgtgggaggccgacaagctcgcctgggtgctcggcgtgcgggacggtgcggtggccacctccggcacctacgagcgcggcgcgcacatctggaacccgcgcaccggccgggccgcggccgggctgcgggcggtcaccgtgaccgggcccgatctggcggtcgccgacgcgtacgcgaccgccgccctcgccatgggtgaacccggcctcgcctggctggccgaacgggtcgccgacggctacgaatcggcggcggtcaccgaggacggccgggccttcacctcacccggcctgccggtcatcgactag

SEQ ID NO: 4279 - DNA, 1209 bp, Actinoplanes utahensis
gtgagctggcgaaaccggttggatgacgggatgcagatccggcagatcaccgctgacgagcggaccgcgacgatgttcccgctgcagtcctacgcctggttgccgtccccgggcacgccggaggacgagacgaagcaccgggccaaccagcggtacttcgcgaccaccacgatgctggtggccgaggcgggtggggagacgctggcctgcgcggccggctacccgatgcggcagaacgtgcgcggggtggtgcacgacatggccggggtcgcgtcggtgacctcgcggccggaggcgcggcgcggtgggctggtgcggcagctgctggatcggctgctggcgcagtcgcgggagcagggctgcgcggtgagcgcgctgtacccgttccggccgagcttctacgcccggttcggttatgtcgggattccccgggtccgggtggcgcggttcgccccggaggggctctccgacctgctgcggcgcgagcttcccggttcggtccagcgtctgccggggcgggacggcttcgcggagtacgacgttctcacccaccgtctcctcgccgaccggcacggcttcgcggtcttcgacgagacccgttcgcagttgctgcgcgaggacccggtgtggatcgccctggcccgggtggacggggagacggtcggcgggctgcgctaccggatcgacgcgcacggtggtgacctgctggggtcgaatctgttcagcaccggtccgctgggccgcgcgctgctgctgcagttcctggcccggcatgtcgatcaggtgtcccgggtggaggtgctgctcggcgcggacgagctgcccgagctgtggggcaccgacatgaccgtgaccaccgcggcgaccgtgcagaacccggtcaggaacgccccgatggtccgggtgctggatctgccggcgctcgccggggtcgaggtgggcgtgggcgggatcaccgtggcggtgcccggggatccgctgatcggcggggtgtggcggctgggcgccgacgacgggcggctgaccgtgcggccgggcggtaccccggcggccacgctgaccgtcgcgggcctgagcgcgctggtctacggcgtgctggacccggtggaggtggtcacccgcggcctgggtgatctggaccgggacgcgatcacgcggctggacgcgctcttcccccgccgtacgccgtacatgttcgccgatttctag

SEQ ID NO: 4280 - DNA, 264 bp, Actinoplanes utahensis
atggccaacctgctgctcagcgtgatgggcgccttcgccgagttcgaacgcgccctcatcctcgaacgccagcgcgagggcatcgccgcagccaagcagcgtggcgtgtacaccggccgcaagccggcgctaaccaccgaacaagccgaccgtctccgcgaacgcgtcgccgccggcgagcgcaaagccgacctggcccgtgagtacggcatcagccgcgagaccgtgtacgcctacctccgcccgacggccgccaccagctga

SEQ ID NO: 4281 - DNA, 342 bp, Actinoplanes utahensis
gtggtcaggaaggcgaagaagaagcgcgtcggctacatccgggtcagcaccgtcgaccagaacaccgtccgccagctcgacgggatcgaggtggagcgggtcttcaccgacaaggcgtccggcaaggacaccacccggccggctctcgacgaactgatcgcctacgtccgcgacggcgacaccgtcctggtccactcgatggaccgcctcgcccgcaacctcgacgacctccgccgcctcgtccgcaccctgaccggcaaggcgtacgggtcgagttcgtcaaggagaacctcgtcttcaccggcgaggactcccccatggccaacctgctgctcagcgtga

SEQ ID NO: 4282 - DNA, 351 bp, Actinoplanes utahensis
atgccggtcaattcattgcccgctgagtggctgcgcgggacgctcagcctgtgtgtgctcggcctcctgtcggagggggactcgtacgggtatgcgatcacggaacgactggaggaggccgggcttggtgtgatcaagggaggcactctctatcccctgctggctcgacttgagtcgcaacagctggtggagccggtctggaggagtggtcaggggccggaccgtaagtatctgcatctcaccgacgctggacgttcggaacttaccgaccttcgatcacggtggaagcggttcgcgtccaccgttgactcgctggctcacggcaggacgaaggatgatcatggtggctaa

SEQ ID NO: 4283 - DNA, 507 bp, Actinoplanes utahensis
atggttctgaccttctccaccggagcctcagcgtccaccggggtgcttggcagcagctcggccagcgcggtcaaggccgacacgtacgccagcacgaatgcggcggcgcagaaggtctacgacgagaccttcaaatccctggagtccacgggctccgcttcgttcactgccgcagacggctcgaagcacaccatctcggtgagcgaccgggacatcgttctcgacggcaagtcggcaatcagcaagtcggcggccaggaccgggtcggtcgtcgggccgatggcgggcggcaccagcgtgtggtgcaaggccaagatcgcggctgcggtcgccgccctcgcagccgtcggcgtcgccttcatcgccttcatgatcaccgggctgtcggaaagcgcgatggtcgccatcgccggcatcaccatgcgggttagctcgtggcaggccgtcatcgcgggcgggatctccgtcgccgcgatcggcaacctgatcaaggaatacgtgtgctga

SEQ ID NO: 4284 - DNA, 2082 bp, Actinoplanes utahensis
gtgaccaccgctgcgggcggtgaaggtctcggcggaggtcgggtggtcggctcgggggacgcctgtgccgaccggggcggcatcgccaataccggtatctacatcgacctgcggcctgcgccgtcgcgaccggacccggtgtggccgatcatcgaggtttcttcactgcccgtgcaggcgtcagcgttccaaccccgtccggggctgcgtcagcgggtggaggcggcgcaccgggccggccgcgacgtcgtgctcacccaacccgaccagcaacaggcgttaggtcgggggacgcaggtgctggccggaggtggcggggtcggtaagtcgcagctcgcggcctggttcgcccggcaagccatcgcggaacgtacggatgtggtggtgtgggtcaacgccgccagcaccgaccagatcgtcaccacctacgccgccgccgcgaccaaagtcgcggcgcccggcgctgatgggaccgacccggccacggacgcgaaagcgttcctgtcctggctgaggaccaccgaccgggcctggctggtggtgctggacgacatcaccgacccggcacaggtgaggggatggtggccgccgcacgggcgtaccgggtggacgctggccacgacccgccgccgagacgccgtcttgaccggtgggggccggcaccgcatcgacgtcgacgtgtacagcccgaccgagtccgtcgcctacctggcccagcggctgaccgacggcgggtgcctgcacctgttcgacgagtcgacggcccaccagctcgggatggccctgggccatctgcccctggctctgtcccacgccgccgcctacatgatcgaccaagaggaaagctgcgccgcctacctcgaccgctacaccagcgccgcgccgctggcgaagctgatgccggccgaggctgacagcgacgactacggcatccccgtggccgtgaccctgctgctcggtgtagacgccgccgaccagcgcgaacccgtcgggttggcccgccccgccctcgggttggctgccctgctcgacccggccgggcaccccgacaccctgtggacgaccactgcggtcaccgactacctggcctcgcaccgcagcaccggtgccggcgtcccggtcaccgccgagcaggcccggcaggtgctacggctgctggaccgctacgggctgatcgcccacaccagcgccgacaccgcccgcagcgtgcgcatccacgcccagaccgcccgcgccacccgtgaaaccctcaccgaccccagccccgtcgcccaggcggccgcggacgccctgcgcgcggtatggcccgacatcgaccacggcaccaccgacctgatcaccgccttacgcagcaacaccaccaccttggccgagcacgccggtgacctgctctggcaccccgacgggcccacactgctgtaccgggccggaatcagtctgctcaacgccggcctgcacaccaccgccgtcgcctactggcagcacatgaccgaccaagccacccgactgctcggcgacgatcacccggacaccctcacggcccgggccagcctcgccgcctcgtatcggctggcggggcgtaccgccgacgccatcgccctggaggagcaggtgctcgtcgatacggtgcgggtgctcggcgagcagcacccgggcaccctgcgcgcccggggcaacctcgccgcctcgtatcggcaggcggggcataccgccgacgccatcggcctggaggagcaggtgctcgtcgatacggtgcgggtgctcggcgagcagcacccggacaccctgatcgcccggggcaaccttgccgcctcgtatcggcaggcggggcgtaccgccgacgccatcggcctggaggagcaggtgctcgtcgatacggtgcgggtgctcggcgagcagcacccggacaccctgatcgcccggggcaacctcgccgcctcgtatcggcaggcggggcataccgccgacgccatcgccctgcaggagcaggtgctcgtcgatacggtgcgggtgctcggcgagcagcacccggaaacagtggccatgggtgaagcgctacgcgcgtggaagagcacgacgtag

SEQ ID NO: 4285 - DNA, 471 bp, Actinoplanes utahensis
gtgaatagggaggcgctggtgtcgaaccttgagctgatcgtgggtgcgttggccgctggagcgagcgcgggggtgaaggacaccgcgtcggcggtggtgcgggacgcgtatgccgggttcaaggcgatgttgaagccgtgggtgcggggtgaggcacgcgcggcgttggacgcggacgagacggatccgcaggtgtggcaggcgcggctggggcaggagttgactgtctcgggcgcggtcgacgatgagcagatcctcgcggcggccgcggcgttgctggaagcggtggtggacgcggaccgggtcaccgacagcggtgctgccaccgcgaccgccggagggcacgccagcaccggtatcgccggcgcggccggtgaccgggcggcgcaggtgacccggtcgggggaggcgcgcgcggaggggcacggctcggtggccaacaccggcgtgtaccgctcgccgcggccgtga

SEQ ID NO: 4286 - DNA, 435 bp, Actinoplanes utahensis
gtggcgacctcgcgcagcctgcggttgagcactgcccgtgcacacggtccgacgccgtgccgcagggccaacaaatcaccgtccgagcccgcacgctggccgacatccacagcgcatcgtctgtctgctcaatcctcccgatactcaccgcgtcgaggtgcggaaggagcttccggatcgtctcgtcacacagcctgcaacgagtcatccgcgaggatcaacgatgacctcgccgtcaagctcagcgacctggccagggtcctacaggacgaggacagtctcgacgaaaccctgcaggcgatcgtggaagcggcagtcaacaccgtccccggcgcacagtacgccggactatcgctggtggaacacagccgggtggtgaacactcgggtcggcattgcagagctggtctttcaggtggacgaggcccgcaggtga

SEQ ID NO: 4287 - DNA, 204 bp, Actinoplanes utahensis
atgaacgtcggcaaaaatgtcacatggttcacgtcgagccgcagtggtgccgccgggcactgtgtcgagaccgcgttcctggagaacaaccaggtggctgtccgtgacagcaagaacagggccggcccgacgctgatcttcaccggtcccgaatgggaggcgttcgtggccggcgcgaaggccggtgaattcgacctgccgtag

SEQ ID NO: 4288 - DNA, 777 bp, Actinoplanes utahensis
gtgtcccgttcacatttttcacgcctcatccgggccgggctggcaggctccgtcgcactcacactcgcggcgatcaccacaccgaccggcgcgttcgccgccggcgccgacaccccggtcgacttcccgaacttcaacggctcgtcgcgcatgctcgaccgaaacggaactgccgacattctggtggccggtcgccggcaccagcgcatcctccggctcaccgccggtgggtacgagcagaccggctcggcgtgggccctgccgaagttcgatctcacgagctccttcgagacggctttcagggtctacctgcaccacggacggccaggcgccgacggcatcgcgttcctcatccagggagtcggtccgcatgccctcggcggctggggcggcggcctgggttaccggggcatcaagaagagcgtcgcggtcgagttcgacaccttccaaaacacctccgacccgagcagcaaccacctcgcggtcgtgctcaacggcgaccccgagcaccacatggcggccgccgacccgtcaattcccctctacgggcggccgttcaacgcgcggatcacctacaacgcggacgcacacgagctgaaggcgtacgtgaagtccttacgcgccggcacgaccgaggaactcgtcctcgacgagtcgatcgacttgaccgccgagaccggcgtcgacgcagcgtggctcggcttcaccggcagcaccggcacggcgctgtcaaagcaggacatctactcctggtcggtgcaaggcaccaagtcctga

SEQ ID NO: 4289 - DNA, 777 bp, Actinoplanes utahensis
atgcgcgcgggtagcgtcggcgccgtgaaccgtaccggtaggctctatgcgttggtggaggagttgcgcgctgcggcgccgcgcccggtgacggtcgcggcgctcgccgcccgcttcgaggtcagccgacgctcggtgcagcgtgacctacagaccttgctggagaccggagtcccggtccgtgcggtgccgggacggcgcggtggctgggtgatcgacccggcgatgaccctgcccccgatccggttcacccctgacgaggcatccgccctggtcctcgcgctcgccgccgtgggcagcaccgtcccgtactcagggtccgtccgctcggctctgcagaagatcgccgcctcgttgtccggccccgcctcggacgtggcccggaacctggccgcccgggtcgtagcgctgccgccccggcccggcccggcggttcgcggcgcggtagagcaggccatcaccggtcacgccgtgcttcggctgtgctacgtcgacagcgccggacgtgacagcgaacgggagatcgaaccagccgggctgctcacctcccagggccgctggtatctcatcgggtggtgccgcacccggcgcgcggcgcgcgggttccggctcgaccggatcctggcggcggcaccgaccggcgagccggcaccacctcgtgacctggctatgctgctcgactccgcagcggccagtgcaacgctgccggacgctctaaccccgctagcctgcgctaccgcgccagccccaccggcttcagagcgcactgccacatag

SEQ ID NO: 4290 - DNA, 936 bp, Actinoplanes utahensis
atgaaccttgtcgaccaagactgcctcgccgaaaccgaggcgttcaacgcacagtttgaggcagccgccgcgagccggccttcccgcgaagcgtcgctggacgcagcgacgttggccaccctgcgacgcaaccggctggccggcgatgcgccaccggtgcggctgccgcagggacgagaccgggtggtcgaggacgtgccggtgcgggtattcgtcccggaccacgtcgatggcgtgtacctgcatatccacggcggtggttggacgttcggttcggcggatgggcaggacgagcggctgtggcggctcgcccaacaagcgcggctggccgtggtcagtgtcgagtaccgcctagcgcccgagcacccactgccggccggggccgacgactgcgaaacggtcgcccggtggctggtgaaaaacagcgaggcggagttcggtgccggacggctacttatcggcggtgagtcggccggtgcccacttgagtgtgctgaccctgttacgcctacgcgaccgacatggcgtcatcggcgccttccaggcggcgcatttgctgttcgggccgtacgacctgtccatgacgccgagccagcggttgttcggctcccgtcgcctgctggccaacaccccgtcagcgcgggctacgtacgaacgcgtcacccccgggcttgacccggtacagcgccgtgatccgcagatctcgccgttgtacgcggacctgaccggcctgccaccagcgcgcatcgtggtcggcacgatggatccctggctggacgactcgctgttcctcgcgacgcggtggaccgccgccggggcacccgtacaactgaacgtggtcgccggcgccatgcacgggttcaccctgttcccgttgaccgtcactgaccgggaggaacgccgcggccaggatttcctgcgcaatgcgcgcgggtag

SEQ ID NO: 4291 - DNA, 1929 bp, Actinoplanes utahensis
gtgactgccggagccatctacggttccgtgcacgtcaacggccgcgttcccatttcctggccccaccgagtcggggtagtgccgccccgagcggactgccgtcagccgcgtggggaggacacgaccctgcacaccgccgggcccggtcacaccgtggtgtgccaggtcgtcaccggcctgggcggggtcggtaaaacgcagctggccgccgaactggcccaccgctactgggacgaacacctggtggacctgttggtctgggtgaccgccacctcccgcagcaacatcatctccgcatactcgcggacggccgcggagatcagcggggtcgaggacccggatccggagcagggcgcggcccggctgctggcctggctcgccgccaccgaccggcgatggctgatcgtgctggacgacctggccgaccccggcgacctacgcggcctatggccaccggtcccgccggtgggacgcacggtcgtcacgacccgccgccgcgacaccgccctgctggccggccggcacgtcatcgcactgggcctgttcacccccgtcgaggccgacacctacctgacgcacaaactggccggccagccgcacctgctcgatggggcgcgtgaactggcctgcgatctggggtttctgccgttggggttggcgcaggccgcggcgtatctgctggaccggaacctgtcgtgcacgggctaccgcacccggctggccgaccgacgccgccggctggccgacctgctacctgacgatggggcgctgcccgacgaccaccaggccaccgtcgcggcgacctgggcgttgtcgatcgagttggccgacgcgttgaagccggccggggtggcccggccgttgatcgaactggccgccctgctcgaccccaacggcatccccgccaccgtgttcgacaccgacaaggtcgccggctacgtcaacagccgggtcggccggccggtcgacgcagagcagttacgggacggtttgcaggcgctgcaccggctcagcctgctcaccgccgacaccagcaccggcatggtgcgggtacacgccctggtccaacgcgccgtccgcgacaccatccccgacgaccggctacccgaacttgccgccgtcgccgcggactcactgctcacggtatggcccgacatcgaccgcgatcccgcctacacccaaaccctgtacgccaacaccaccgccctgcacaccaccaccggcgacaccctgctcaccccagacgggcatacgctgttgttccacgcccctacccgtctcggagaaaccggccaggtcaacgccgcgatcaccgcctaccagcgactgttcgacacctgtctgcgggtactcggccccgaccacccccacaccctgaccacccgcagccaactcgcccgctggcggggccacgccggggacccgaccagcgccgccaccgcctacgaacagctgctcgccgaccggctgcgggtactcggccccgaccaccccgacaccctgaccacccgccacaacctcgcctactggcggggccaggccggagacccggccggcgccgccaccgccttcgagcagctgctcgccgaccggctgcgggtactcggccccgaccacccacacaccctgaccacccgcagcaacctcgcccgatggcgcggcgaagccggggacccggccggcgccgccaccgccttcgagcaactgctcgacgactatctgcgggtactcggccccgaccaccccgacaccctgaccacccgccacaacctcgcctactggcggggccaggccggagacccggccggcgccgccaccgcctccgagcaactgctcgacgactatctgcgggtactcggccccgaccaccccgacaccctgaccacccgccacaacctcgcctactggcgggggcaggcgcgtcgctga

SEQ ID NO: 4292 - DNA, 402 bp, Actinoplanes utahensis
atgtcgaatcttgaggtaattgtggcggcgttggcggccggggcgggcgctggtgtgaaagacaccgcatcagccgcggtcaaggacgcgtacgccgggttgaagacgatgttgcggccgtgggtgcgcggtgacgcacgcgccgccctggacgccgacgagaccgacgagaccgcgctgcaggggcgcctggccaaggagttgcaggcctccggcgccgtcgaggatgagcaggtccttgccgccgcgcaaaggttgctggccgcagccgacccggcgcgggccgcaacgtacaacatcaatgtcggaaccaactcgggcgtggtcggcggcacgatcaccgcaccagtgacggtcaaccacacgccgccggtccccccagtcccgccggcgacggcgtaa

SEQ ID NO: 4293 - DNA, 357 bp, Actinoplanes utahensis
gtgaccgcgctcgtaaccgagcacgttgcggcctgggccgacgggcagggctggcacgttgcgcgtgaagtgcccgccaggatcgcccggcagacccgcaatggcccgtaccaggcccgcctggacatgatgtgccagcgcccgggcaacctgccgccggtcgcgatcgagatcgaccggaccggcaaggtgtggtcgctgcgcaaactcgtggccgaagccgacgcgggcgcagtggcgctctgggttcgctggcgcggccgcacccggatcgcgatccccgccgacatcgggctggtagacatcagcggcgccggcccgaccatacggctgccgcgcggcgcgcgcccctggtag

SEQ ID NO: 4294 - DNA, 792 bp, Actinoplanes utahensis
gtgaccggcaagcgcacaggagacggcttcgccagcatcgccgcgatcgtcgacctcatcaaccacatgacccgatggcggcacatcagcggcctcgaactcatcccaccaggcaaggtcaccccacacatgttccggcgcaccatggccatgctgacccgtgacaccccaggagccgagatcgccgtcggcatgcaactcaagcatgtcgccacccgagccctggcgaaccgcatcaccagcagctacatggacaacgacccctcctgggcacgtcagctcgacaaatcgatcacggaacgccgtttcgagcgtctgaccgaactcttcgacgccgacaccgacggtcacaccatcggtttcggccctggcgccgaccgcatgcgcgaaacgttcgccgccgtccgcgcccaagccgagcagctacgcgccacaaaccaagcccgccgcggcgacatccgcgtcgaacgcgacctgctgcgccgcacccggatttcgatccggttcggcaaactcaaccactgcaccatgaacgacaacgatcccgccggggcaaagtgcctggaagacgccatcgtgccggacggccacctgggcccgctgctcgaccgcggccagcccagccgctgcgcgaacagcatcatcgcccccgcacacatcccgatctggagcgccgagcagtcgtctctgcaccacctgctggacaccgacaaactggcccccagccaccggcgccgtatcgaggccgaactcaaggaagtagaccgcgtcctcgatcggcaccacccatga

SEQ ID NO: 4295 - DNA, 681 bp, Actinoplanes utahensis
atgatcgacatcgagcctgacttctggggctatgtccggtccctcggcaatccgcaccgggtggccgcgcaggtgaccgcggcgaatccgaaggattgcggtgcccaggagaacagtgccgcgggcctggctcgttgcctgatcgcgatggcgcgcaggtacgcgccgaagaccaccgtgggcatgcacctgtcctgctgggactggcagaccgacagtgcggggtgcgcccgggactatcgggacctcggcgcatcgaaggccgacttcctggtcggcgacgtgtcggaccgggatgcgggctggtacgcgctgccgcagcacggcggctccaacggcttctggaccgacgcgaaggccgccgcggccctgcggttctacaagtcgatgaccgaggcggtgggccggccgctcgcgctgtggcaggtcccggtgggcaacatggcgcagaacaacaccctcaaccattatcgggatgacaaggtggactggttcttcgcccacatggaccaggtggcggccgcgcacgtcgtcgccctgctgttcggtgcgggtcagcaggagcagacctctctcctgtcccgaggccctccgccggcaagcccggacaccccgagcccctgcgcgccagcgccggaatcgacccgcagagcatcgacaactggtcgcagggcgacgtga

SEQ ID NO: 4296 - DNA, 312 bp, Actinoplanes utahensis
gtgacgctggtgaccggggaaaccgcgaccgcactggagttgaccgtccgcgtcgtcaccacgccgtacctgtccagctccggattctggagcacgataccggccgaccacctgaccacgacggtcgagcaacagcccggcgcgctggtctaccggttcacgctgaagccgggaacgagtctcggcgccggctcgtacaccttcgccgtgcagtaccaccacgctgtcggcggccgggatcccggccgggacacctaccgggcgacggccaccgtcggcggcaggccggtcgcggtgagcgggggcttctga

SEQ ID NO: 4297 - DNA, 882 bp, Actinoplanes utahensis
gtggcgggccgggatggcccagtggtcgccggccggcgaccagccggagctcgccgccctgttcgccaccacgccgcccccgatgccgcgatgaccgccccggggcagaccgccgacacgtcctccacctgcccgtcctgcggcgcggcgatggaggtcgcccacgacgccggggtgatgcgatgcccgtactgccggcgggagtcgcccctgccgggcgcgcagaccggctggcccttcggcgcgggtgccaccggcatgccgcgcatcaccgtcagcacccggccgctcctcacgccggacctggtccgccggcagaagaagatcgcctggatcgccggcggcggaatgctggtgttcctgctgatcgtcatggtcccgatcttctccagcttctcgcactccgccgcggactactcgtatcagcctcccgagaagaaggtgcaggaggtggcgatcggagccaccgcacaggtcaagggattcgaggcgacggtccgcagcgtcgactgcacgaaacagtcgatgaccaggacggccgacgacccggcgacctcgtgggacgagagcgacgtcatcaaggccgagggaaagttctgcgtcatcgccttctcggcgaagaacgtcggcgccaggaccgacacctatcccacgttcgacctggaggcctccagccccaccgagcgcgtgttcagccggaacaccagcgccgagtggtacctgaacaagaacaccgacgacctcagcaagccgatcgatccggggaagaccgtcgacagcttcctcgtctacgacgtgcccaccgactcgaaattcgcctacctgcggctgtccgacggcatcctgtccgacaccatcgtcaaggtgaagatcgacaagtga

SEQ ID NO: 4298 - DNA, 1089 bp, Actinoplanes utahensis
atgtcgatggcagacaagatacgcggcgaatttatcgacatcgtcgagtggctggacgacagccgcgacacgatcgtctggcgattcccgcggtaccacaacgagatcaagatgaatgcccgcctcgtggtccgcgaatcgcaggtggcggtcctggtgaacgagggcaccatcgcggacgccttcggccccggcacgcacactctcaccacccagaacctccccgtgctgtccaccctcaagggttggcggtacggattcgagtcgccgttcaaggccgaggtgtacttcgtcaacacccggcagttcaccgacctgaagtggggcacccagaacccggtgatcgtccgggaccccgaattcggcatggtgcggctgcgggcccacggtgcgtacgcgctgcgcatcaccgacccgcggctgttgctcaccgaactggtgggcaccgatccggagttccgcaccgaagaggtcgccgggtatctccagcagatgatcgtgagccggttgacgtccgctctcgccgccgcgaacgtgtccctgctcgacatggcggcccagcaggaggcgatcggcgcgcaactcaccgaggcgctcgccgggcaggtcgccccgatgggactgcggatcccggcggtgatcgtccggaacatctcggtgccgcccgaggtggagcaggccctggaccggcgtacccagatgggcatcatcggcgacctgcagcgatacacgacgttccagaccgccaacgcgatcgaggacgccgcccgcaaccccggcgccgccgggctgggcaccggaatgggcgtcgggatgctcttcggccagcgggtgggcggggccgccgcgccgcccgccatgccggtgcaaccaccaccgctgccggtgagcacgccgtggtacgtggctctgcatggcagccagcagggtcccttcgagctcggcaccctcggggtgcaggtgggcaccggtgcgatcacccgggagacgctggtgtggcgggccgggatggcccagtggtcgccggccggcgaccagccggagctcgccgccctgttcgccaccacgccgcccccgatgccgcgatga

SEQ ID NO: 4299 - DNA, 816 bp, Actinoplanes utahensis
atgaacagcaacgaccaccgagacctcgacgtgcggctgcgggccgcggccgaacccgtgggccggggccgcgtgcaccacccgtccgcccaggacctgctggaccgcatcgtccgctcgccgcgcaccggcggggcgccggtcaccgccccgcgccgggcggtacgccacaccggccgctgggcggtggccggtctcgccgccgcggccgtgtccgccgcggtcctggtgatccccggtctcagcggtgaccaggcggcgtacgcgtcgtggaccgggacccccgccgccctgggcgccggcgacacccaggcgctcagccgggactgcatgacgcagaagctgacccccgactggggctacacccaggcgcagctcgaccatgcccgcaaggttctcggcgaagcccgcggcgcgtaccggtacgtcgccatcgcgacacagcagtggaccgccacctgcttccgcgacaaggccgggaccgtgtactggggcagctcgttcgagtcgccggtcagcgacgggcagctgggcgccaagggcgtcgaactgcaggcctggggccagctcaagaccgacgaggggtacgcgcggctgatgtccgggcacctcggcaccgacgtcaccggggtggcggtcaccacgccggacggccggaaggtcgaggccacggtcgacgaccactacttcctcgcctggtacccggagaaagccggcgagacccggccgaccacgatcaccctgcgcctcagggacggcagcgcggtcccgaacctgtccgcctcggacctctacgacgccccgaaactcaactga

SEQ ID NO: 4300 - DNA, 588 bp, Actinoplanes utahensis
gtgaaccgatccaatgccccgatggtggccgagcggcgagcggaaaccccgcgggacgacgaggccaccttccgagccctgttcgaggcgacctacgacgacctgctctgcttcgtcgaacgccgcacccaccagctggccgccgaggacgtcgtcgcggaggtcttcctcaccgcctggcgccgcctcgacgacatccccggtgacctggatccggcccgtgcctggctgttcacggtggctcaccatgtgctgcgcaaccggcggcgcagcgatcaccggcagcacgcgctggccctgcgcatcctgcgcgaacccggcggaccggacccggtcgccgaggcggtggacatcgccggccgcgtcgacctcaaccgcgcctgggagcagctcagccaggacgaccagcaggtcatcgcgctgatcgcgctggacggcctgaccgggccgcaggccgcccgggtgctgggcatctcgaccaccgctttcagcctgcggctcatgcgtgcccgccgccgcctgcgtaggcactacaccggggtcgcggccgccgccgcccccaccagcgactcaggagtgaaccgatga

SEQ ID NO: 4301 - DNA, 213 bp, Actinoplanes utahensis
atgagcaacttcttgatcaaggcgggagaccgcctgctggcccgcgtcctgcggaccgaggtcgccggggcctgcgtcccggaccacggccagagctgcggatccatcacctacgtctgtcacctgggccggctctacaagcacgacccgggccgggtgcagtgcaacggccagtgcgtcaccaccgtcacctacgtcggcacctgcgactga

SEQ ID NO: 4302 - DNA, 522 bp, Actinoplanes utahensis
atgagcatcaccgtcgcggtcgcgctggccctggtcggcgccgtcaccgtgctcaacctgttcctgctcaccgcggtcatgcggcgcctgcgcgcgcacgaggccgcgcacgcgccggccgcgctggcgctgcccgagcccggtcaccggatcggcgcgttccgcacgaccaccccggacgcactgtcggaggaggacctcgccgagccggccgtcgtgctgttcgtgatgcccggctgcgcgccctgccacgagctgctggacgcggtgccggacgccggcttcgacccggcgcgtaccttcgtcctggtggccggcgacgccgcgctggcgcccacccgggagctggccgcgctggtgcgcccgctgggccgggtcgcggtgatcgacccggacggaccggtgaccgccgcgttcggcggcatccggggctatccgacggtggtgcacgtcgccgcgggccgggtggtcgccgccgaccgcaggctgagcgtgctggtccgctccgcggccggagcgtga

SEQ ID NO: 4303 - DNA, 1809 bp, Actinoplanes utahensis
atggcgggctccggcttctcccgggccgcggcgatctgcctgcggctcagctgggccgcgagccggccggccacggtcgcggtgatcgggctgtccgcggtcgccagtgtgctgcccgcgacgaccgcctggttcggcaaggagctgatcgacgagctgacccgcgggccggccgccgccaccggccgggccaccgtgttcgcggtggccgccgcgctggccggcgcggtgttcgccgggctggcgcagctcggcactttggccggggcgtacctgcagcgggagaccaacgcgcggatccaggagcggctgttcgcggcggtcaacggcttccacggcgtccgccgcttcgaggatccggccttccgggaccggctggagctggccggcaccggcgcgcagcaggctccggagagcgtcaccacgatgctctccggtaccctgcggggcgttctgaccatcgccggatacgcgggtgtgctgctgaccgtgtggccaccgatgctgctcctgctcgccctggccgcggtgcccgccttcgccacgtaccgccggatcggccgccgcgccgccggggtcagcgagtccaccgtggcccgcatccgccggcagctctcctaccggatgctgatgaccgaggcggtcgccgcccgggaggtgcggctgttcgggttgggccggctcttcgccggtcggttcgccgcgtcgctgcgcgagacgtccggcgcggagctcgccgaccggcggcgggcagccggcgccgagaccctgttgagcctggccggggcggtcgtcgcgctggccggcacgctggtgatgatccgcgaggtggccgccggccggctcagcgtcggcgggttcagcctgttcaccgccgccgcgatcggcgtgcagggcgcgctcacctcggtcctctcccagatcggcatggccacccgcaacctggccctgttccaccactacgccgaggtggtgggcgcggccccggacctggccgacggagaccgcccggtcgccccgctgaccgacgcggtcaccctggacgacgtctggttccgctacgacgaggacggtccgtggatcctgcgcggggtgacgctgcggatcccgcgcggcgccacggtcgggctggtcgggctcaacggcgccggcaagagcacgctggtcaagctgctctgccggttctacgatccgcagcggggcacggtccgctgggacggcaccgacctgcgcgacctgcggatcgccggcttgcggcggcggctcggcgcggcgttccaggatttcgtccggtacgacctgaccgccgccgagaacatcggagtgggtgacgtcgatcggctcgacgaccgcccggcgatccgggcagcggcccgggccgccgggatcgacgcggccgtcgaggcgctgccgaagggctacgacacgctgatcagccggatcttcctggacggtgacgacgccgacgagggggtcaacctctccggcggccagtggcagcggctcgcggtcgcccgggcgctgatgcgcgaggactgcgatctggtcatcctggacgagccgaacgccggcctggacgccgacgccgacgccgagatccaggcggcgctgcgcgcccacgccggcgaccgcaccacgctgctggtctcgcaccggctcggcacgctgcgccacgccgacgagatcgtggtgctctccggcggccggatcaccgagcggggcgaccacgacacgctgctcgccgccggcggcgagtacgcccggctgttccgcaaacagtcggccggctacgtgcccgcgggaggctga

SEQ ID NO: 4304 - DNA, 438 bp, Actinoplanes utahensis
atgtggtggctcgcggtgctcgccgtgccgctcgcggtggcggccgcggcccgggccgggttgcgggtggtcgaggtgcgggggcacagcatgaacccggcgtacgccgacggcgaccggatcctggtccggcgcggccgggcccggaccggccgcccggtcgtcttccgccgcccggatctcgccggcccggccgcggccgacgtcgactggctggtcaaacgggtcgtcgcgacggccggccagccggtgccgcaggcgctggccggcgtcgtcccggacgccgtcgtgccgcccggccggctgctggtccgcggcgacaacccgcacagcatcgactcacgccacttcggctacgtcgcggaggccgacgtgctcggcgtcgcgatccgccggctgtccaccggaacgggagtgcccgatcgtgccgtgccttga

SEQ ID NO: 4305 - DNA, 528 bp, Actinoplanes utahensis
gtgccgtgccttgagatcgccgcccggctgctgatcggcacggtgttcgcggtcgccgtggccggcaaggtgcgctccggcgccgcgtaccgggaacacgtccggtcgctgcggcggatgggcgtgctgccggaccgatgggtgccggccgcggcgggcgccgcggccggggcggaggcggtggtcgtggtgctgctcgcggtgccggcccggtggaccggggtgcccgggttcgctctggccggtggactgctggcggtgttcacggcggcgatcgcggtcagcctgcgcggcggcaaccgtgccccgtgccgctgtttcggcgcgtccagcacaccactgggcggtgcccacgtcgtacgcaatctgctgctcctcggtgtcgatctcgcagccctgaccgcgatgttcgtcgcggcgcggccggcgaccctggccggcggcgtcgtcgcggccctggccgggctgatcgccggcgccctggtgaccagctatgacgacatcgtcgcgctgtggcgcccggcgtga

SEQ ID NO: 4306 - DNA, 1104 bp, Actinoplanes utahensis
atggccgagccgggtcgctggaggggctggttgcggcggcggcgggtggagcagggcggacccggcaggcacgccgctccggagaccccggcgccgccggcgacgcagcccgagccggtggtgcgcgccgcggacaggacggacccgtggcgcccgatcgccggggagttcgcgctccggctgctcacccttacgtgggaagccgttcatcacatcggggaagccgaattccgcgagcaggacgccgaacgccgccagatcctgttccggatcgaccactcggtgacccgggtgcggcgactcgccgagaatttgcgggtgctcaccggcgagccgctcgacgaccctgatcagcaggtgacctcgctgcacgacgtgacgcacgcggccggggccgcggtcgagcactacgagcggctgcacttcggcccgatcgccgacctggcggtcaccgcgaccgccgccgacgacgtgatccggatcctcaccgagctgatcgacaacgctgaccggtactcgccgccgaccgaaccggtcaccatcgccgcgcacctgaccggcgacggcgacgtggtgatccgggtcgaggacaccggcatcgggctgaacccggcgcacctgccgtggatcgagagactgctgaccgacggccccggcgacggcgagctgcagccggcccacctggggctggccgtcgccgcggtgctcacccaccgccacggttcgctgcgcgtgcgcctggtgccccgccagccgcgcggcaccgtcgcgatgctgctgatcggcgccgacctgctctgcgagtccccccgggtcgccccggacgagtcgccggccgagaagccacagccggcgccgaacggccggaaccaccggaacgacgtcaccatggtgctcccggcgatgccgaaaccgatgccgcgccgggtgccggccagcgtccgggccaacggcgcgaccctgccgccgccgcccccggcctccaccgccacccacgagaccacctggcacgacgacgccgccgcgttcaacgccggcgtcgacgccgcccgcgcccagcaggaaagccccccaggcatcatggaagctgaaggaccgcaatga

SEQ ID NO: 4307 - DNA, 444 bp, Actinoplanes utahensis
atgactgacacccagcaaccggacgtctcctggctgatcggccagctcgtccgcgaggtaccgacgatcaccgcggtcgtcctggtctccgccgacggcctgcaactggcctcgtccgggcacctgagccgggagcacgcggagagcgtcgccgcgctcgccgccggattcctcggcatcaccggccagctcggcggcctgctgcagctcggcgccccggagaacctgagcatccgctacccgcacggccacctggcgttcctgcggatcgacgacccggccggcgagttcgtcgcggcgctgctggtcgcggcccaaccgcaaacccagatcggacatctcgggtacgccatgaccaccttcagccaagcggtcgggcacgccctgactccggagacccgtcacgcgctgcaccagcgcaccctgcccgcaccggttcgctga

SEQ ID NO: 4308 - DNA, 351 bp, Actinoplanes utahensis
atgggccgaaggccgggactgcactggaaggtgcgcccgtacatgaccgcgcggggccgcaccggcagccgcagccccctgttgatgcacaccctggtgtcgaccggaaaccggtacgacccggtgctggccgccagcctcaccccggcctcccggtccctctacgagcaggcccgccggacatcctcggtggccgagctgtcggcatcctgcgggctgccgctgggcctgacccggctgctgatcagcgatctgctcaaaatcgatcagctggtggtgcacgacgctcgcccctcgcaagatctagcactcctggagagacttcgtgcaggcctcctccgcctcacctga

SEQ ID NO: 4309 - DNA, 573 bp, Actinoplanes utahensis
gtgcaggcctcctccgcctcacctgagatgcactctgccaagatcgttatcgccggtgggttcggcgtcggcaagaccaccgcggtcgaggcgatctcggagatcccggcgatccgcaccgagtcgtggatgaccgcggccgccgcccagatcgaccacctcgatcccggtatcgacaaggtcaccaccacggtcgccatggacttcggccgcgtcacggtcgacgattctcttgtgctgtatctgttcggcacaccgggccagccccggttctggccgatgtgggacgacctggtccggggcgcggtcggcgccctggtcctggtcgacaccaaccatctggagaactcgttcgccgcggtcaactacttcgagaacgacgccgcggtgccatggatcgtctgcgtcaacctcttccacggggtgcagacccacgacctggccgaggtccgggaggcgctcacgctgcccccgcacatcccgctgatcgccgcggacgtccgcggctcccgcaacgtcgcgcaggcactgctggccgtggtgaaccacgcgacggagaaagcccgtcagtaa

SEQ ID NO: 4310 - DNA, 1251 bp, Actinoplanes utahensis
atgcgcaagattctgatcgtcggagccggccaggccggactccaactcgccctcagcctgcacgccgaaggctacgaggtcaccctcatgtcggcccgcacccccgacgagatccgcaccggctggcccacctccacccaggccatgttcgacctcgccctcggcaccgaacgggcgtacgacctcaaccactgggagcacgtcaccccacccatccacggcctgcgcccgcagctgtcggtcgaacgcggccgactcgccctggccttcaacgccccgctggagcgcccggcccagtccaccgaccagcggatcaagatgtcccgctggctgcaggatgccgaggagcgcggcgtcgaggtgatctacaacgcggtcaccacccaggacctggacgcgatcacccagctcggccgctacgacctgaccgtggtcgccgccggcaagggcgacctggtcgccatgttcgaccgtgacccggagcgctccccgtattccaccccccagcgcggtctggccgtcgcctacgtccacggtctcgaaccggacccggcctggcccgacccgcacgtcggcttccacgccctgcccggcctcggcgaactgttcgtcatcccggccctcacccacaccggcccgtgcgacatcctcttctgggaggcgatccccggcggccccctcgaccgctgggccggccaccccggccggatggcccccgaccagcatttggccatcaccctggaactggcccgcgaacacctgccctggctgcacgcccgcgcggagaaggtcgagctcaccgacgccaaagccactctgcacgggcggtacacgcccacggtgcgccggccggtcggccacctgccgggcggcggggtggcccttgggctggccgacgtcgtcatcgccaacgatccgatcaccgggcagggcagcaacaccgcggccaaagcggcccaccactacctgcaggcgatcctggcccggggcgacgaggcattcgacgaagcctggatgaacgcgaccttcgaaagcttctggggggcgcacggggcggcggtcaccggctggaccaacgcgatgctgcagcccctgccgccgcacgtgcagcaactgctgggggcggctaccgggagtgagacgatcgcccgtcggttcgcggccggcttcaacgacccgaacgacttcctgaactggttcgtggacccggagaaggcggcggcctacctcgccgaggtcagcggggcgtaa

SEQ ID NO: 4311 - DNA, 1074 bp, Actinoplanes utahensis
atgtctttccactggccgtgggcgctggccgcactgctggtcgtcccgctgctactcgtcgcccgctggtggctgaaccgccgccgcagacgcaccgcggtcacggtgtccagcgtcgccctgatccgcgccgccctccccggccgctccgactggcaccgccgcatcccggtcgtcctgttcctggccggcctgctcgccctggccggcggcgtggcccgcccgcaggcgcgggtcccggtggagtccgacaacacgtcgatcctgctggccatcgacgtctccgggtcgatgtgcagcacggacgtcaccccgaaccgcctgtccgccgccgtcgactcggcccgccgattcgtcacctcgcagagcgacggcaccagaatcggtctggtcgccttctccggcatcgccggcctgctggtcgcccccaccaccgacagggacgaactgctcgacgccatcgacaccctgaaaacggcccgcggcacggcgatcggccaggccatcctcacgtcgatcgacgccatcgccgagatgaacccggccgtcccggccaccggcgccgatctgggcgacaccattgcccgcggcgactacgagtcggacaccatcgtggtgctcaccgacggttcgaacaccaccggcgtcgacccggtcaccgccgcccgggaggccgcggcccgccgggtccggatcttcaccatcggtttcggaacgaccaggccgtcgccgatggtgtgcacggccgaccaggtcagcggcgactcgtttccgggcggcggcggtctcccgggcggtggcggcttcggcggcggccacggccgggtccaggagatcgacgaggacgccctgaaccaggtggccgacctgaccggtggccgctacttcaaggcccaggacgccgacgagctcaacggcgtcctgcacgatctgccgaaggagatcggcctgcaccgggccgacgtcgacatcagcttctggttcgtcctggtcggcgccgtcctcgtcgtcaccggcctggcgctgtcgctgtggtggagccgcccccgcgccaagatccacctgaagggctga

SEQ ID NO: 4312 - DNA, 969 bp, Actinoplanes utahensis
gtgagctttcggtacccgtacctgctcatcgtggcggtcctgctcaccatcggtgccgtcgtcttctacgtcggtctgcagagacgccgcgcagcggcgttgaaggcgtccggtttcggtgcgctgatcggcggcggcttgagacgtcacctgccgtacgcgttgttcctcgccgccctgcccatcctgctcgtcggcctggcccggccgcaggcgcgggtgtcggtgccgcgggtgtccgggaccgtgctgctcaccttcgacatctccaacagcatggccgccaccgacgtcagccccacccggctggccgccgcgcaggccgccgccaccgagttcgtcgaggcccagccggacacggtcgacgtcggcgtgctcgtcttcggcgacaccgcgctgctcacccaggcgccgaccggcgaccacccggccgcggaagccgccatcgcccgggtcagacccggcggcggcacgtcgctgggccaggccatcctggtcggcctgggcaccatcaccggcaaaccggtcagcctgcccaaggacggcgggacggcggacaccaggacgctcggctactggccgtcggccaccatggtgatcttctcggacggcgagaacaccggcggcccggacgtcgaagccgccgccgagatggccgccgcggccggggtgcggattcagacggtgggcgtgggcaccgcccggggcgccaccgtcgaggtcgacggctaccacctgaacaccgccctggatgagcgcacgctgaccgcggtcgcccaggtcaccggtggcgcctatcacgcggccggggacgccgacacgctgaaccgggccacgtcgtcgatcgacctgcggctgaccacgaggaaggagccgctggagctgaccgccccgttcgccggggccgcgttgctgctgctggcgctcggtgggctgctcggcacccgctggcacggaaggatcatctga

SEQ ID NO: 4313 - DNA, 918 bp, Actinoplanes utahensis
atgaccagcccacccgaccggctgctgcggcgcctggagtggcagctcggccgtcgcctcgacgggcgactgcagggcgcgtaccgcacggtgtggcacggcggcgggctcgacttcaccgacctgcgcgcctacacgccggaggacgacgtccggcacatcgactggaacgtgaccgcccggctggacgacccgcacgtccggcagtacaccgaggatcgcgagctgaccgcctggctggtgatcgacaagtcggcgtcgatgcgcttcggcggttacgaggggaaggagtcggcggcgaccgaactcgcggtgagcctggcccgggtggtgtcccggggcggcaaccgggtcggcgcgatcctgttcgacaacgccgcgcagcgggtgatcccgccgcgcgccggccgcgaccaggtcctgcggatcgcccacgagctgctcaaaccgccggccacggcagaaccgaaacggttccgcagggccacggagccgcccgccgccggcaccgacctggccgcgatgctgcggctggccgcgaccaccaccgcccgacgccgctgcctgatcttcgtgatgagcgacttcatcggcgcgcccggctggcaccgcccgctcggtcagctcacccaccggcacgaggtggtggtgatccgggtcgtcgacccggccgaactcgtcctgcccgacctgggtgtgatcctggtcgaggacgccgagaccggcgagcagctgctggtcgacaccggcgacccggtgctgcgcgggcggctggccgatcaggtgcgcgcccgcgaggccggactcgccgacgtgatgcgccgggccggggtggcgaatcaccggatcaccacggaccaggacctgatggcggcgctggtccatctggtgcaggcgtcgggaagggggcggcggtga

SEQ ID NO: 4314 - DNA, 993 bp, Actinoplanes utahensis
atgaccgggaacgacgccccgccggccgccgccggagacatcgagaaggtgctctacgaggtcaagaagatcatcgtgggccaggacatcctgctggaacgcctggtcgtggcgctgctggcgcgcggccacatcctggtcgagggggtgcccggactggccaagaccctcgccgtgaaatcgctggccgaggcgatcggcggggagttccaccgggtgcagttcacccccgacctggtgcccgcggacatcgtcggcacccgggtgtaccaccagcccagcggcgagttcaaggtgcagctcggcccggtcttcaccaacctgctgctggccgacgagatcaaccgggcgccggcgaaggtgcagagcgcgctgctggagacgatgcaggagcgccaggtcacgatcggccgccagacgcaccgactgccgaacccgttcctggtgatggccacccagaacccgatcgagaacgagggcgtctatccactgccggaggcgcaggtcgaccggttcatgatgaaggtggtgatcggctacccgaccgccaccgaggagttcgtggtggtcgagcgggccctggccccggccgcggtgctccagcggatcatcgacccggacaccctggtcaccctgcagcaggccgccgaccaggtctacgtcgacccgtcgctgatcgagttcgcggtgcagctggccaccgcgtcgcgcgacccggccacggtcggtttgacggacctctcgcggtacgtgaccttcggtgcgagtccgcgcgcgtcgatcagtctggtgctggcggcgcgggccctcgcgtacctccggggccgtgactatgttgtcccggaggacctctccgatctcgccctggacgtgctgcgacaccggatggtgctctcctacgaggccctctccgacgatgtcacccccgacgtgatcctcgccaagatcctggcgaacctgccgttcccggagcccgccggccggggccgctga

SEQ ID NO: 4315 - DNA, 978 bp, Actinoplanes utahensis
atgcctgctttacgggttaatgggcgatcttgcgtaccggagaccattggcggccgcacggggaattccgggaaatcgcttgtagcgtcaagaaatgctgagtgtggcggtcgtgccgtgatgaccgtgctccggccggacggctccgatcccccggagcccgctccgcaggagcccaccccgacccggctgagctcgtggaactcgcccgagcgtcgccgcaaggcgctgttcgccctggtcgcgctctgggccgtggtgatcaccgcggtggtgttcctgcgcggcgggccgaaagccaccccgcaggccaccgcgccgcagccgaaaccgtccgcctcgccgggaccgctcgcggtctcccagatctatcagacgttgctgccgtccgtggtgctgatccagaccaccggccacgacgcgaagaaggcgctggagtcggccaccggcaccggcgtggtcgcgaacgcggacggcaccgtgatgaccgccgaccacgtggtcgacggcgccgagacgatcaagctgaccttcgccgacggaaccaccgccccggccaaggtggcgaggagcaacccgaagctggacatcgccacgctgaccccggcgaagctgccggacacgctggtgcccgcggtgctcggcggcggcgtcgaggtgggcgacccggtggtggcgatcggcaacccgctcggcctggtcgattcgacgaccagcggcgtggtctccgggctggaccgcaggctcgaccgggacgagcagggtgacatcgccgggctgatccagttcgacgccgcggtcaacccgggcaactcgggcgggccgctggtcgacgaccagggtcaggtggtcgggatcgtggtctcgctggccaacccgagcggggccggcaccttcatcggcatcggtttcgccgtcccgatcggcgccgcgctcggcggtggcgagcagggcgacggacgagcaccacccctgtag

SEQ ID NO: 4316 - DNA, 762 bp, Actinoplanes utahensis
atgagcagcaacgaagaagccgaccttcccaccgcgccgaacctcttcccggccggtgcggtgaccaccctcccggcccgcgacccatggtccggggccgccgctccggcagccgcggggccggccgccgagaccgtgccgaccgccccggaatggacccgcaccggccagatcctggaggtcgccgggacttcgtccgccggctctccgtccgctggcgggccggcgacgggccccgtgtccgccgggacttcgtccgccggctctccgtccgctggcgggccggtgacgggccccgtgtccgccgggactccggccgccgagatcccgatgagcccgcaggccgtcccgccgggcgccgtgccgccgcccggatcgtgggcgccggtggccgtggcggggaggaagccgcgcagcccgaagacgatcctgatcgccgccgtcctggccaccgcggtggccagctccggcatcaccgccgggatcatgtccgcggtcggcggatcgtcgaccccggcgagttctcagcagggcgggccgggcgggcgcggtgggttccccggtggaggcggcggcttcggcgggatggaccagaacggcaccacccaggacgggaccaccgggcagggcggcatcgggcagggcggcgctgggcagggcggcattgggcagggcggcgccgggcagggtgggaccgcgcagaacgggaccactcagcaagggcggaccgggcagggcggcaccaccggcaccggcacctga

SEQ ID NO: 4317 - DNA, 345 bp, Actinoplanes utahensis
gtgggcggtgagttcgtggtgcgggggcggatcctgctgccggccggggagcggccggtgcgggccgcgcgggtggtgacccgggccgaggacgccgggcgggccgacgcgcccgcggtggtgatcgccgaggcggtgcaggaggccgtggcgttgccgggccgcgacggcgtgccgttcgagatcagggtgccggccgctgcggccggacggtgcacgctgcggttccacgtcgacgtcaccgggtcgggcggggtgaccgccggtgactacgtgtcgacccgggtgtatccggtcgccgccttcccggccggcctcgacgtgccgatgagtcgcgtcacctga

SEQ ID NO: 4318 - DNA, 1866 bp, Actinoplanes utahensis
atgacacaggtggagacgccgggtccatggcgtaaccagggcgagttccgcggtggcgaacgcggcaccgcgatgatctccggggtcacgttccgtccccggccggtggtgttcagccggatcgacgggctggcgatcttcgagggggacatcgccctcggcaccgtggaacaactggaacggcagctcgcggacgcgcgcgagcaggccgtggccggcgacatcgcctccgcggtggcgatcagcggcacccggttccggtggccgaacgcgctgatcccgtacgagatcgacccggccctgccggaccagcggcgggtgaccgacgcgatcgcccactgggaggcgaacacccggatccggttcgtggcgcggaccgcggccaacgccgggcagtacccgaactacgtccggttcagcgagcagggcggctgctggtcgttcgtcggcatgcagggcaacggcatgcagacgatcagtctgggcgccggctgcacggccggaaacgcgatccacgagatcgggcacgcggtcggtctgtggcacgagcagagccgcgaggaccgcgacatgttcgtccggatcaactgggccaacatccaggccggcctggaacacaacttcgaccagcacatcaccgacggcgacgacctcgagggctacgactacggctcgatcatgcattacccgcggaacgcgttcagcgccaacggtcaggacaccatcgtgccgctgcaggcgaacgtgcagatcggccagcggacgaaactgtcggcgagcgacgtggccgccgtccaccagatgtacgcggcgatcctgggaggaggctgggccggcggctggagcgaactgtacagcgacagcgaccacctcagctccctcgacgtgatcgccaacgccgacggccggctggaactcttcggcgtcaacgaggacgaccggatctggcacacctggcagacccggcccagcagcggctgggccggcggatgggccgagctgtacagcgacgtcgaccggctcacccagctgcgcgcggcccgcaaccgggacggccggctggagctcttcggggtgaaccgggacggccggatctggcacacctggcagaccgcgcccggcaacgggtgggccggcggctgggccgagctctacggcccgcacgaccggctcgtctccctcgacgtgatcaacaacgcggacgggcggctggaggtcttcgggatcaacgccgaggggcggatctggcacacctggcagaccgcgcccgacaacggctggaacggtggctgggccgagctgtacagcccggtcgaccgcctgcacaccctccgcgcggcccgggacgccgacggccgcctggagatcttcgggagcaacgccgagggccggatctggcacacctggcaggtgcggcccaacggtggctgggtcaacggctggagcgagctgtacagcccggtggaccggctcgtctccctcgacgtgatcaacaacgcggacgggcggctggaggtcttcgggatcaacgccgagggccggatctggcacacctggcagaccgctccgagcaacggctggaacggcggctgggccgagctgtacagccggaccgaccggctccgggtactgcgcgccgcccgcaacgccgacggccgcctcgaaatcttcggggtgaacagccagggacggatctggcacacctggcagatgcggcccgacggcggctggatcggcggctggcgcgagctctacaccgacagtgactacctgaccaacctggccgtgctcgccaacgccgacggccggctcgaagtgttcgggctcggcgaaaaaggccgtatctggcacacctggcagctttga

SEQ ID NO: 4319 - DNA, 375 bp, Actinoplanes utahensis
atgccgctgaccgggcgggccgccccccggcccgtcccgtcagcgcaagctgcgccgtcctacctgtcggcgaacaaaacaccgaccatccgggcctgggccgctcgtaacaaggtcgagctgtgcctgacgccgaccagcgcgtcctgggccaacccgatcgaggcgcagttcgggccgctacgcatgttcaccatggcgaactcgaaccacccaaaccacaccgtcctggcccgcaaactgcagcaatacctgcgctggcgcaacgccaacgcccgccaccccgacgtcctggccgcgcaacgccgcgaacgagcccgagcccgcagcgaacgccaacaacgctggggccgaccccgaaccaaggccgcctaa

SEQ ID NO: 4320 - DNA, 1449 bp, Actinoplanes utahensis
atggcacgactacgcaaaggcaccatcgcggtcgtcatcggctcactcagcctgaccgccaccacaccggcgcacgccgacgaaccggtcccggacaccaccccgccggtgatcacctccaccgggctcaccccgggacaacttgtcggcgcctacaagggcttcaagccgatcgtgtccgacaacagcggcaccacccagatgcaggtgctgctcaacggcaaactgagcatgacgatgcccgtcaactgggacggccctatccgactcaatgccaaagcgctgcccaccgacaccgaccttgacgtcaccctgcgcgtcaaggaccccgccggcaacacgaccgatgccactacccgggtgcacctggactccagcctgccgaccgccaccccttcgcccgcctacggcaccgcgatggagagcggaccggtcaccatcacgctgaccgacgtcccggacgacgtcacgaagattgcaatgcacttctacagcaccggccaggacgtcatccgcaccgaaggcccctggaccttccagtgggacgccagcgagcaatccgaaatcccgtacttcatcctgaccgaccgggccggcaacaccaacaacgtcatcaccggatacatcgtcgacaacgaccccccggtcatcgagcacctcagcaactacatcccgcagatcacgctcaaacccggcaccaccacaacgatcggcgcctacgccaccctgaccgccgtggtcaacgacaagtcgagactcagccgcaccgaatggtgggtcaacggcgtcctgcgcgccaccaaccccgacgaattccggctgaccccagacatgaccacgggcacgacagccaccatcgaactccgcgtctgggacggagcaggacaccctgccagcgcgatattcccgctcgcgatcgaccgcgtcggcccgagcatcagcaacatcacccccgacgccatggcgctcgtccggggcactagcttcaccacgaccgtcgtcgccagcgaccccaacggcgtcgccgacttcaccgtgtacagcggcagcgacgccgccagcggaaattcccagcagcaggtgccgaccggacgcgacggccgactcacctacacctggcaggccaccgaccgcttcggcaacgaaacctccgccagccgcaccgtcgtcgtcgacaacaccaaaccggccctcgcgttcggcgcagcacccgccaacggcgccaaactgaccaagaccgccacgatcaccgccaccgccagcgaccacaaccggatcgccaaggtgcaaatgttggtcaacggcaagatcgttgccaccgacaccacccccggctaccgcttcgtcctgaacccggccaagtacggcaggacgttcaccgtgcagctacgcgcctacgacaaagccggcaacgtctcccacagcagcacccgcacctaccaccgctga

SEQ ID NO: 4321 - DNA, 4773 bp, Actinoplanes utahensis
atgcgagctgcgtttacagttcggcaggcctgtgacgggtcgcgttgccgacggcggcgagataagacaccttttagttgcgaggaagaaatcttcaacatgcgtgtgctgaattcacgcccgcggtggctcgccgcggtcactgggatggcgacgctcgtcgccacctcgatgtcgtcgcctgcggtcgcggcgacacccgacggtgacgtcggctacgtcggtaacgtcagcaagacgacatccagcctgctgactaccgaccaagctctcgcgcaagcgcggaagaccggtacgaaggtcgaggtcaccgctgccaccacggcgaccgacctgctcaccgcgaatcctgatggcaccctgaccatgacccggacggccgcaccgatccgccagcgcgtcggtggccagtggaagaatctcgacgcgacgctgaccgccaaccccgacggcagcctgagccccgccgtgtcgacgagcccggtcgtgctctccggcggtggcaccagcccgctcgcgaagctttccggagccggcctcgggttcgatctcagcgttcccatgacgctgcctaagcctactgtcgctggtgacaccgccacctacgccgacgtcctgcccggcgtcaatctccaggcgacggcgtcggtgtacggcgggttctctgaggtgttcgtcgtccgtgacgccgctgccgccgcgaatccggcgctgaaaaagctcgtcctggccgcccatccgagcggtatcacgctggccagcgacgccgccaacaacgtcgccggcaaggacgcggccggacgcaccgtgctgtcggctcccacaccgctgatgtgggactccaccacgacagccgcgacgaccaccacccagcgctcggcggtcacgccgagcaccaccagccgcaacgccggggcggcccgggcggcgtccagcccggacggacccggagctgccgccaacgtggcgccgctgccgaccacggccacgagcaccggcatcacgctgacgccgggcagcatgctgcaggacagcaccacgcactacccgctctacatcgatccggacttccagtggacgccggccagcccgaccttgtcgggttgggcgaccgtcgccaaatcccatgcggacagcaactattggaaggccaccccggaccgccagggcttcttgcaggtggggtactccggcgacaccatcgtctcccgtacgctgctgaacttcgcgctgccctcggtgctcaaaggcgcgacgatcaactcggcagagctcaacatgtcgaacaactactcgtactcgtgcgacgccagaccgatcagtctgtatgcgccgaccaccaagctcacctccggtaacgccaagtggacctactgggatggcgtcaacctcggggcagccgtgcagacccagagcttcgctcacgggtatgacaccagctgtaagccaatcaccgtcggcttcgatgtcaccaagaccatcaacgccgacgtcaacgggagcaatccgcagaccctccagacgttcatgctcaaagccggtgacgaaaccgacaagtgggcctggaagaacttcctgctgtcgaccgtgtcgatgaccgtcacctacaaccacacgccggatgtgccgacgaagctgacaagcagccccagcaccgcttgcaacgcaagcccggcttcggcggtgggtaacggtccgctcagcctgtatgcctacgtgaccgacccggacgcggcggcgggcggctcggcttcgctgggcgccggcttccagctgtacaagacgcagtacgcgtccctgttcccctccaccggcgacggcgactcgaccaagctggtcgcatccaccccgatgagctcgacggccagcaacaagaacaacgccgtcctcaacgttcctcaggacacgctgagtaaggccgccgatgtcgacggcgccagcaacaagctgatcactcagttctcgtggcgggttcgggtaaccgacttccctgccagcccgagcgacaccagccactattcgaagtggtcggccccttgcaccttccggtacgacccgacgcgcactggcgcgcccaccgtcgtcctcgacaccaccgtcacggaccccagcgtcaacacgttcccgccggtccagggcaagaactcccggatcctcatcacgcccaatagcaacggcaccacgcccagcggctacctcatccaggtcaacggcggcgcgccttacaaggtcaccgcggacgcgaccggcgcaggcagtgcgcagatcaagccgacgcggttctccaacgtagtcaccgtgaccagcttgtcgcccggtggcaacatcggtgacaccggttccctgcccgtcaccgcctacgcggcgactccggcgcagcccgatgacttcaacggtgacgacatcgctgacttggtcaccgtcggcggcaccaacaacctcccgccgggtctgtggcttgccgccggcaacaacaacggtcaggtcatgcccgtggccgccaacatcggcgtctatggcaccggccaggcaaccgtccaaacccccaagtcctacaccggcacccaggtgatcaccggccggttcaccggctacggcagccaagacgtgatctcgtaccacacgcagaaggaccccgcggtagacccggccaccggcaccggctccatcctcaccggcagcggagacggcaccccgatacaaccgtccgactcgaatcagggcaccatctccggcctgcaggaaatcagcccggacgacttcagctccatccaaggcaccgagcccaaccaggtagcgacgctcaacaccgtcgccgctgacggcacggcgagtcctttcgcgagcctgctgggtaccagcaaagccgccgacggcacctaccacgtgaactacttcgagaacgtcaacggcacgttcggcaacccagtcacccttgccggcctgctaaacccggccggcggcaccgactggaaagattggaccatggccggcacgctgacccacgaccccacgacggggcacgacagcgccgacatgttcctctggaaccgcagcaccggcgctctcgcgctgtggcgcaacgtccaatacgacaacgggcccaagaccctgaccgccacgaagtacaccctcaacactgacgtgtccaagtgggcaaccgtcccgaccagcctgcaagccgccgacatcaaccgcgacggcacccccgacctgtgggcgttgggcaccggagcgaccgtcacttcgtacctggtcaccggcgtgaccagcacgaccggcactacgggcgccgtcgccaaccagacgccccagacgctggtcaccggtaaccacgcctggctgctcaacgaccaaaacagcggcaacgtcgacgccgcaacggctaaggacatcgtcggcgacctggacgcatccggggccacggccggcgcggccggcgccaccgacggggccacctgggacacgaacgacctgttcagccccgacgtcgagctcaacggccctgacgcgcacaccaagacgggctacctgaccaccaagtcgatgcccgtcccgaccaacgccagcttcaccctcagcgtctgggccaaacccaccaccggcggcaccgtcctgtcccaggacggcaagaacaccgccgcctacaaactgtgggccgaccccagcgacaaatcctggcgcttcgccatgagccagggcgacaccactaccgcaacgtgggactccgccactgccggccccgccagcgcaccgtggaacgcctggtcacagctcaccgtcacctacgacgccaccaccggcctaggaatcctctacgtcaacagcgtctacatggccagcttcacccacactgtgaagtggaccccggcagactccaacaccacgccgatgccgatgcgcatcggcgcccaccggtccggaaccggcaccgccaccgccggatacttcggcggcaaggtcgccttcgtccagacctggaacaggatgtggaagtacccggtcgcgggcaaccacgacttcaacggtgacggccgcaacgacgtcgtgacggtcggttccgacggcaagatgtggctttacgccaaccgcagcaccggcacctccaccttcgccgcccccgtctccatcggcgtcggctggtcgtcctaccgctgggacatctccgactgggacctcgacggctacgccgacctcctcgggtacaccaccgatggcatcctctggtggtaccccaacaaccacgcctccggattccgcagccgcgtccaactcggtgtcggctggaacggattcgtccactccaccggcaacgcggacgccaacatgcatccggaccacttcagcatcaggaccacgaccgacccctccggcaaggaccccatcggcacgctgtaccactacccgaacggctgctgccgggtggtcatcggccacggatggagcacgtaccggatggtccccggcgacctcaacaacgacaaccgcgacgacctggtcgccgtcgactccagcggcaacctgttcatctaccccaacaccggcaacccgggtgaccagatgttcaccgcgggccgcacgcagatcggcaccggctggggctccttcagatacgccgtcatcgacatcaacgtcgacggcaaacccgacatcatcggcgtcgacgccaacggcaacgcctacctcttccccggcaccggcgccggcaccctcggcaccaaaacccagatcggcagcggctggacgaccaccgtcgccaccaccatcggataa

SEQ ID NO: 4322 - DNA, 6552 bp, Actinoplanes utahensis
atggcggcagtcgcctccggacttgttctgacgctactggcctccgggcagggccaggctgtcgcggcgccctcgaccgcccccgcggcgaagacgaacccggctccggacgtcaagcccggacgtgccgtcaagggtgtctacgcgctgaagccggccaagcagccgcaccggcccgatccggccgagcagaagttcgtgccgaccgcgaccacgctgccgccggccggccatgccgcgatcacgatctccggcgctggcaagtcacacgccgcgggaagcgccgtttgggcgcagaccgtcgccgcggctaagactcgaatggcggccgcctccccggctgcggtcgacgtgcaggtgctcgaccagcagaccgcgaccaagctcgggatcaatggcgttgtcatgaccgccgcggcaccgaccgccggtaaggtccgtctcggcgtcgactacgccggcttcgcccaggccttcggcggcaactacggatcacggctgcacctggtccagctgcccgcctgtgcgctgaccaccccgcaggtggcggcgtgccgcaagcccgccgacctcggctcggccaacgacacggcatcgcagagcgtgtccgccgtagtcgatctgcctgccactccggcgacaccgcaggccgctcccggcgccagcacccgctccctggccccacagaaagccgcgaccacgcagcgcgccgctgtattcgccgcgaccgcggccaccggcggcgacggcggctcggccggtggctcttacgccgcgaccagcctgtccccgaccggcacctggtcggccgggagcagcaccggcgccttcacctataactacgcgttcaaggtgccgcccgccgcgaccggcatggctcccgaagtggcgctgggctacaactcgtcctcggtagacggcgagaccgtctccacgcaggcgcaggcggactgggccggtgacggctgggcgacgccgcagtcgttcatcgagcagagctttgtctcctgcgccgacgacccggagggcagcgcggcgccgaagaaaattgatgataggtgctacaacggtccggttttgacgatgtcgctcaacggtaactcgtcgtcgctggtctgggacgctaccaagaaggtctggaagtccgaggacgacaacggtgaggtgatcaccaaggtcaccgggtccaacaacggctccggcagctacgacacctcctactggaccgtcaccatgcgcaacggtgccgtgttccagttcggccgtaaccagctacctagctggacctccggcaagccgcgcaccaactccgtcgacaccgtcccagtctacgccgcacactccggcgacccctgctacaacgccaccttcgaccagtcctggtgcacgatggcgttccgctggaacctcgactacgccaccgacgcacacggcaacgcgatggcgtactactaccaccaggacaccaacacctacgcccgctaccagggcgccaccaagacctcgtacgtgcgcgacagctacgtcgaccacatcgactacggcttcaccgacggcaatgcctacggcaccgcacctaaccaggtcgtgttcaacaccggcgaccgctgcgtatccggcacctgtcagccgttgaactccacgaacaaggccaactggcccgacgtcccttacgacctgatctgcacctcgaccggcacctgcaacgtctggagcccatccttcttctccaccgtgcggctcgcttcggtcgtcacccagcagtactcgaccgccacctcgaagtacgaggcggtcgacacctggacgctggcgcacaccatgccggctaccggcgacagcacctccccgacgctgtggctgaactcgatcacccacaccggtaacgacaccagcgcccagccgaactcctcggcgatcaccgtgcccgccgtcaaattcgacagcatcaagctgcagaaccgggtcgacactgtctccgacggcctcccggcgttctaccggcagcgcatcagccagatcaccaccgaggccggatcgatcatcaccgccgactacagccgcaccaacgcatgcaccgccccggtaacgatcaccccgtcctcgaatacgtcgtcgtgctacccggtgcgctggaccccgccaagctacgtcgatccgatcaccgactggttcaacaaatacgtcgtcaccaagatcacccagagtgatccgaccggcagcgccgctgctcaggtcaccagctacagctacctgggtggtgccgcctggcactacgacgataacgagcttgtcgaggccaaatatcgcacttacggccagttccgcggttacggcaaggtgcaaacccgcaccggtgacctcacgaacgacaagcagacgctgtctgaggtcacctattaccgcggtatgagcaagaacaataacaccacgcctctgccattaactgattcccagggcggaagccatgaagatctcaacgagttggccggtaccacgctcgagtccaccatttatcgtggcgatggcggccccgtcgaatcgtcagaaatatcttcgtattgggtttctgacgctaccgcgacccggacccggactggcctttctgcgctgaccgcgaactgggtctcaaaagccgaaacgtttagccgtcagcgaatcgccagcggtgggacgccgacataccggtacacccagaccgataactcatacgatgccgacatcgcaagccttaccttcggttcgctgagacaaacctactcccacacggtgccggttgatgcgcagtacgatacctgtactacgaacacctacgctccggtcaacaagaccaagaacattgccggtctaatcgctgaaaccgaggtcgtgtctagggcgtgcggcggctacaccgccggcagcccgtcttcagcgcccggcacccttaaccgccttaccgccccggacagcgtcacccgccccgcacaggtggtttccgacgagcggtatttctacgacgaccccaccttctcaaccaccttcccgcaggccgtcgctccgactcgcggcacgcgcaccatggagcagcacgctaacggctggaacagcactggctatacatacaagacgactaacaagaccgagtacgacagctacggccgcactatcgctgcgtatgacggtaacggcaacaaaactacaaatgtatacaccaccaacgccgtcggcctcattaccagcaccactactaccaacgccctgaatcagaccgtggccaccaccaccctggacacgcggcgttctctgccattgacaatcaccgacgcaaataacgtcgtcaccaccctttggtacgacgcgctgggccgttccaaagcagtgtggctcaactctcgcaccaccgatctgccagcaaaccggctattcagttacaccctgtcgcagaccggaatctcgtcggcgaccacacagatcctgaacgacgtctcgcagtaccagctgtccacgctgatctacgacggcatgctgcgcccccggcaaacccagcagggaaccccgcgcggcggccggctggtcaccgacaccttctacgacagccgcggctggaccaaagcggtctacaacaactggtgggacgacaccaccacccccgacaccaacctggtctctgccgcgaacctcggtaagcaggtagccacccaaaccctgttcacctacgacggcctcggccgcgccgtgaaacaggaacaggccaaagacaacgtcgtacagaccggcgaaacgaccaccacggtctacgccggcgacgccaccaccgtcttcccggccaccggcggcaccgtcagcaccagctacaccgatccgctcggacgcacggtcaaaaccgacacctacaagacggtcccaaccctgaccacgccgagcaacaccttcaccggtgactacacctttaccggcggcacgaagatctcctcaacgttcggatacaacgaccaaggcctgcagaacagcatcaaggacaccgccggcaacacctggacgaccagctacaacctactcggccaggtcaccggcaaaaccgacccggacgcaggcacgtcaaccggcatgacctacgacggcaacggcaacctcacccaggccaccgactcgcgcggcaagaccatctcgtacacctacgacaaggccaaccgcaaaaccggcgtgtacgcggccaccgtcgcagcccaagccgccgcgaacaagctcgccgattgggtgtacgacaactccgacaacgccgtcaccggcatgaccaacccgatcggccagctcacctcgagtaccgcctactggggtgccaaccacgacgcctacaaaacccagcaacttggcttcaccatcttcggcacatccaagggcgtcaccgtcaccatcccgactgctgagggcacgcttgccggcagctacaccttcaacaaggcctacaccacgaccaccggcctacctctgcgtgacgtctacccagccgccggcggcctggcccaggaaatcgtcacctacggctactcgaccccttatgaccttctgaccagcagcgtcggcacgaacgcctacggcaagatcaccgtgttcgacgcctggagccgggtccagcaggaatccatcggttcctcacccacctacggctacgtcgtcaacaactgggacgcgcacactggccggctcaccaaccagaccgttagccgccaaaccggcaccccagccaccgtccactccacggactacacgtacgacccgatcggtgacatcaccaaactcgtcgaaacccggcaagggagcaccgccacctccgagacccagtgctaccgcgttgacggtttccgccgcctgcgcgccgcctggaccgccacggacagctgcgcggccgaacccaccagtaccagcaaagccacggtcggcgacgccctcggcgcctccagcgcctactggaccacctggaccttcaacgacctcggtgaccgcaccacccagactcagcacgccatcggcagcggcaacgacaccgtcaccaacttcacctacaacggcaacgccaaaaaccagccccacaccctgacctccaccgcggccaccaccggcaccaccacggtcaacaccgcttacacctatgacaccgccggcaacatggcgacccgggccgcgggcaagggcaaccagagcctgacgtgggatgacgccggacggctcaccgccatcaccggcagcaccgcgggcaacaccaacttcgtctacgacgccgacggcggcctactcctgcagaaagaccccggccagaccaccctgtacctgcccggcgaacagatcgccctcaacaccagcaccaaagccctcaccgcgacccggtattacacgctgcctggcggcggcagctgcatccgcaccggcagcacctacagcttcgccctcgccgaccacaacggcacacccacgctgtacctgaactccaccatgtccgcgccgacgtggcggcaatacaccccggacggtgcaacccgaggagcgggcggcgcgtaccccgacaaccgcggcttccttaacaagcctgtcaacaacagcacgggactcatccaaattggggcccggaattatgacccggctaccggtcgtttcatcagcgttgatccgctttttaatccagacgatcagcagtcatggaacgggtatgcctacgcggagagcaatcccgtagctttcagcgatccgtccggtcttcaggtcccgccggatgagcggatccctgggtggcagataagcggcgctccggcttggggaactagcggttttaacacaggcggcagcaacggcagtggcagcagtggcggcagtggcggaaagaagtcgacggcttcacttgatgaaaagacggcaaacggtctagaaaagatcagagctaagatagccaaaaagtatcaagtggcaacgatcgacgatctgcccgaggcgctacatgaatatgccctagaggacatcgagtccgaggcgtgcctgaaatacccgagtaggtgctacgacattctcagtgccatggcgagggatcaggtttttatcgcaaacccaggcgaaactaaggttgacggcccgtattcaaaatggaaagccgccaatgatgttgcacaagccactacagaggtcctagacgaagacccgaaacaggtcatggaaaaccatctcaaccctgaggagcgggctggcctgctaaggtcgatgaataacggcaagttctacaggttccgcatgttgtacggtcgcgctctacataaggcggtcgcagcgaaactgatgaagaggttccctggcgagtgggtatataaagaatcctggggtcccgatttgtttcacaagagcggagcggtcgtagaaattactaccgctggggagatgagtaatcatacaagtcgatcccaaagagagcatgaagcctatagggattatgaaggtgctgcctatgtgggctacgccaacgctccccttacgcagggagagatgttccgccttgcaggagaaatggcggcaggcaacgacaggtga

SEQ ID NO: 4323 - DNA, 765 bp, Actinoplanes utahensis
ttgccgagttggcccgcttgcagatctcaaaaaataagcgaagcggcggaccgtaagccgtcgccgatctgcgcggccgggtggtgcgacatctgtttcggggccgtccgactgaaccctaagggcgtttcgtttcgtcgatgtcagcattgccgcggctatgacggcgtgctggatggctacgtgccgatcggatcgtcggtcgcggacggactggagtccctgctgcaccgctacaacaacttcggcccggatcaccgatggctggccgcgcccctggcagcgctgacccgtggccttctcgtgcggcacctgcgctgcctcgaaacccgcttcggccccttggacttcgcgacccacgtcccgagctggggaggcgaccgccccttcgacccgctcccgaccgccgccagcctcatcagcgactggcccgtgccatggatcttcaacctaatgtcgaagaccagggaggggcgtccggcgcgtggtgtcgtggattcctcctactttcggtttaacgcctccacccggctgccggggttggcgatcctgcctgtcgacgacacctggacttcgggggcctccctggtgagtaccgcgaaaatgctgcgcgctcacggcgccgcccggatcgtaggcctcacggtcggccggcagctcaccgagggctttggcagctccgatgcggtgaaggcggcgctccgcgatatggcgttcctcccgcggatctgcgtgatctgcagctggagggcaacccgccggtga

SEQ ID NO: 4324 - DNA, 558 bp, Actinoplanes utahensis
gtgctggccccgcttcttcctgccgcgtccacgaccggtcgtccgccgaagtgggacaaacggcagctcatcgacgcgatccgggggcgaatccggatgggcaccccgtggcgtgacgtccctgccgtctacccgccctggcagacggtctacggcctgttccgccgctggcagcgtgacggcacctgggaccggatcctcgcggcattgcaggccgccgccgataccaacggcaggatcatctggacggtcagcgtcgactcgatgaccagccgcgcccatcagcacgccgccggcgctcgcaccaaaggcctgcatccccagcaagaaggaccaggacgcccaccgcaaggccaaaggatcccgcggcggacgcccgccgaagttcgacaaggccctctaccgcaagcgtcacgccgtcgagaacagcatcgcccgactcaagcgctaccggggcatcgccacccgctacgaaaagctggcagtccggttccaagccgccctgaccatcgtgatcatcggcgagtggctatgaccagcttccaaaacacgccttag

SEQ ID NO: 4325 - DNA, 330 bp, Actinoplanes utahensis
atgacctgcgccacggcgccgcctccctggcacgaggcctgcgcggatctgaagacgctgcaggatttgcttggacactccagcatcgtggtcaccgccgacacctacaccagcgtcctgcccgactcccagcgccgctgcgccgacgcgacggccgcgttggtgctggccgcggcccggcacacccgccaacgcatcaaggagaaagcggcgaagaaccggcccaccgggcgcgccggaaaagaagcaccttcggagaaatggcccaccagtaagaaacgaagccgcaggtcacgcagccgccgcaacccggtcagtcgcggaaagtga

SEQ ID NO: 4326 - DNA, 3558 bp, Actinoplanes utahensis
atgggtcggcacgccctgatactggggacggcgacctatcacgctgatcggaagctgaccccgctgcccggtgtccggcaggacgtcgagcaactgcagaccctgctggagaccgatggcgagttcgacagcgtcacggcgcgcatcgatcttcccgcagtgcagatgaaacagctcgtcgaggagttctacggtgcccggctcgccggcgatctcgcactgttctactactccggccacggggttctgcacggcgaccggcagtctctgttcctcgggacgatcgacaccgacacgtcgatcctccacaccactgcgttcgatgtcgaaggcatcctgcgccatatgctgaacgacaccaaggccggccagaaggtggttcttctggactgctgcttctcggggtcgttcacggcgcggcatcggttcaccggcggcgtgcggcaggagccccgtcggctcaagcgggaacgcggcacgttcctgctgcagtcgagcagccatctgaaggcctcgaaggcgcaaggtccggatcggccttcgcttttcaccgaggtgctgctcaccggtctccgcggcgcggcccaaggcaccgctgaagacggctggatcacggcgagcgacctctctcggtacgcgatgacggagatgtcgcgccgccgccgagaggagaagccggtcgagtcgagcgagggtgtcactgagccgatccctctggtcagcggatctgtcgagcgccggcgacacgtacccggcaaaccggctgaggagccggacgatgcaccgttcgacacggagcggtggcggcggctgctcggctactacgtcaactgcctgcagcgttccgccgttcttcagttcttcgtggatccggtagcgggtgactcgtatgtccccgcccccgccggccgtgaggtcgtgttctcggccagtgaaccggtccgcttcggagaacgaggacaacaactcgccaaggcggcggaggctggtggccgatccctgcagtacggctacccggtggtgacgctgtccccgaagggccggcagcagctccattgggcgccgttgctcgtctgcgatctgaccgtaggcgccgacgggttggctcatcccgcaccgccgcaacccagtcccgccctcgtcgaccacttccagttgtccgtggtcgaggccgacgagttgcgcgaggccgtagcggaacgactcgttcccggcgatcgccgatccctcgccgacgccgtgaacctggtcgccaaggcgttcggcctcaagccggcctcgccactcgatccgcagaacctggccggcagggttgaccgaggaccactcaaccgcgtgcagaacgccgggatgctgttcgccgccggaagcaccgagtcccccgatcgacaactgatcgaggacctgcaggagatcgtcaagaacgccgggaagatcgcgtcgaccgctctcggcgcgctgtcgaacgcgaacgacgacccgcgggtcgaacctgcggccgacgtgctgacggtggcgccgagctcggtgaacgagacccaggaggagatcatccgggctgcgatgagcaggccgttgacggttgcgcagggaccgcccggtaccggtaagagccagttggtcaccgccttgctggccactgccacggcggccgggcagagcgtgctgatcggctcgacgaacaaccgggccgtcgacgaggtggtcgagcgggtcaccgccatggtcggctccggcctgatcctgcgtaccgggaacaaggactaccggcagcaggaaccgcagtacctcgccgaggtgatgcaggcgtggccgccaccagcggcggacacgcgcggcccgttccacgagcttcgtctcgtggcacacgagatcgaacagctgcgggaagaactcgatcaccatcgccggctcgaacgagatctcgccgaccttgccttcgcacgcgacgcgacactcaccgacacggatgagcgcaccctggccaagctggtcgacctcaccgaacgggcgctacggagccgctggttcggatggtggtaccgcagacggctacggtcatccggggccttcgaccgcgatgcgatcaccgtcctcggcgagagtgcggtcatcgagcaatgctggcgtgaacgacagcggcaactcgtggcactgccacacgccgttgaggacgcatggcagcgcttacggaccttgcagcacgacaccagagccgagcacagcaaggagcttctgcgcgcccagatcgccacgcgggtcagcggaaacaccaccctgctccgcaatcgcgccgacgagatggccaagccgaacgggagcagctggacctacatgtcggccctcgtcaaggcgctccccgggtgggcggtcaccgcgaagtcggcccgccgactgcaaccccgggccggcctgttcgacctggtgatcatcgacgaggcagcccagtgcaccgtcgcggacatcctgccgatgctctaccgagcagaacgcgccctcatcatcggcgacccacggcagctgaccccggtcgtcgagctctccgccgacgacgaccgcagggagcaggcccgtgcgggactcggtcacggctggctgacgaatcggcgactgacctaccgcgaccattcggcgtacgaggcattcgccgccgcagcgggaagcaccatcctgctcgacgaacactaccgctgccacccggagatcatcgatgccccgaaccgggtggtctaccagaaccggctgaccgtactgaccgacccgggtcggctcgccgcaccggccgaacccgccacccgctgggtcgacgtgcccggccacttcaccaagggcgccaccggatcgggccggaacgccgacgagatccaggccgtggtgaccgaggtgcagcgggtgcgcaaggagtatccggaagcctcgatcggcgtcgtgactcccctggccgaacagcagcgccatctccagcgcgccctcctcgaccaggggctcaccgacaacctgctctgcgcgaccatccacaagttccagggcagcgagaaggacatcatggtcgtctcgccggtcggcgcccagggcatcagcgaacgcacccgcggctggctcgtcaaccagaccaacctgtggaacgtggcgatcacccgcgcccgctcccaactcatcgtcgccggtgaccggtcatggtggtccggacaacgcggtctgctggccgatctcgccagccctacccgcacgacagcagcaggtaccgatgtcggcccacgaccggccgatcggctgatcgccggccttcgcgagaccggactgacagtgcattgggaaacgccgctgccgggttaccccgtcgacttcacgatcagcctcggcgacaagcggctggccgtgctggtcgacgaccccgacggcgatccggacggccactcgctacgaagggtgctgagccgcctggacatcatcgcctccgccgcaacagtcaagcgggtaccggcatggcgctgcctcgccgaaccggaacaggttgtggctgagctgcgtgacgcgatcgggacagatctccactga

SEQ ID NO: 4327 - DNA, 375 bp, Actinoplanes utahensis
gtgtccgaggtcttcatcgaggtcagtttcacgccgttgccggaggacgacgacttcgttctcgaccagctgaccgaagaactcgaagaggacctgcgcgacataggcgaggtgagtcggctcgaagcgcccgctgttcccgacgggaagggcgtcggcgaggtcgtgcttgccgccgtcgccgcggtcgccggcaccgatccgggctacgcacaggcgctcgtcgacctcgtggtgggctttctccaccgtaatcagggtcgccgggcccatctgcggatcggggacgtcgagttcacgatcgatcaggcgaccaaggcggagacggccaagatgatcgacattgttcgtgatgcgatcgagcgttcccgctga

SEQ ID NO: 4328 - DNA, 1053 bp, Actinoplanes utahensis
atgacatcgacggacgatcgcgtattgaatgcggcaatgggtggtgatcgccgggctcgggaggacctgttccggcgacagttgccggtgatctactccgcggtcgcccggctggttcccgcggaacgtgtcgacgatgtcgtgcaggagaccgcgacccgggcgatcgaacacctcgacgagctccgggacacgtcccgcctgcgttcctggctgctgaccatcgcgctgcacgaggcgcggcgagaccgggcggcgcgctcggtggcacccgactggcgccttccggagcccggccccgatatcgatccacaggatgtggcggtcgcccgcgtgacgatgtccggtcagcggcgggaactggccgccgcgaccgcctggctggatccggacgaccgggagctgctcacgctctggtggctggagacgctgggagagatggaccggccggcggtggcctcgacgctcgagcaggaggccgcctacgtggccgtgcggttgcagcggctgcgggagcggctcatgaaggcgcgcgtcctcgtccgcgtactggccggcacggattcctgcccggagctggcggcggagtcgtccgggtgggacggcgagccttccgcgctctggcgcaagcgtttcctgcgtcacgtctcgtcgtgtggccgatgcggcgcggcgggcggcgccctgattccgccggagcggctgctgcccgccttcccgctgctggtgccggcgccggcgtttgccgcagtgtcgtccgcggccgccggagctccggcgaaggccgccggaacgcaggtgaagacggtcgtacgagcggtgcgccggttgcagtcgctgggtggcaacactgccgccgcggtggtggccacggtggcggtcgccgcggcgtcgatcggcgtttacgctgtccgggcgcatcgacccgaccccgccccggcggccgcggtggagccggcggctcccggctcgccggccggacgggccccgagcgcggcccccgcatcgtcggcaccggcgccggcccgggcctccgtcactctagctagctag

SEQ ID NO: 4329 - DNA, 396 bp, Actinoplanes utahensis
gtgaccgttttcgagaaggccacgcgggagaagttccgctacccgtcggccaagggcctgctcagcaccgaacagctgtgggacctgccgctgaccgccaagtccggtttcagcctcgacgacgtggccagggccgtcaacgccgagctcaaggccgtcgacaccgagtccttcgtagccaccgacggcaacccggccaaggccacctgggaggccaagctggaggtggtcaaacacgtcatcgcggtccgcctcgcggaggaccaggcggcgaaggcggcggccgccaagaagctggagaaggagaagctgctggcgatcctgggccgcaagcaggacgcggtcctggagaacctttccgaggaagagctcctggcccgcatcgacaacctgtag

SEQ ID NO: 4330 - DNA, 2070 bp, Actinoplanes utahensis
atgcgtttctccggcgaggcgggctccctaggatcggcggtgatcgagggggatgacacggtggacggtttccagcagttcgtgacggatgtgagcgcccgtctgtccacgatgtccaaggacgagctgttcgtcgtcggcgacgggctcgaccgggattcgctctggctcacctttctcgacgcctttccggccggcaccaatgtccgtttccgggagcggtccgagtacgactgttcgacctgccgcgtgttcgtgaagaacttcggaaacgtcgtcgagatccgcgacggacaggtgcgctcggtgtggtccggggtgtccgcgtccgacccggtgttctcggtcgtcgccgccgcgatggacgagttcgtcggcacgctgccgctgtccaccatcttccggtcgacccaggcgcggtacgggacgaagaccacccgggcgctgcgcgacggccgggtcgaggtgtgggaccacctgcacggcagggtggagaagcggcatcgcgccgaggacatcggcgcggcccggggcgtcttcgacgcggcggtgcaggtgttccagcgtggtctggccgagctgaccacgcccgccctggacaccgtcgtcgacctgatcgacgacaacgccctctaccgtggcgcggagcaccgccgggcggtgaccgagttccggtcgctgcggaacaggtggacgcaggcgacggaccgacgggccttcgtcttcgccaacgcggtgaacccggcggcccggttccgcaacacggtgatcggcaccctggtccaggatctgtccgcgggtgtcgatccggagcacgcggtccggtcgttcgagacgaaggtggcaccgcagaactaccagcgtcccaccgcgttgatcaccccggccatggtgcaggccgccatgaagacgatcgacgagctgggtgtcgaggagtcgttgcagcggcggttcgcccggctgtccgacgtgtcggtcaccaatgtgctgtgggtcgacaacgacacgcagtcgcggatgaaggacggcatcgaggggctgctcatgcaggcggccaccaccgggtcggcagcggcgcgcccgcgggacgcgaagccggaggaggtcccggtggccgtcttcctgaaggacatcatgcccggtgccgcggccatcgacctgtgggtcgccgacagccacgagccacacctggtcagtctcaccacgggccggcacccggacgccccgcggctgttccggtgggacaacgatttcgcctggtcgtacggcggcaatgtgaccgactcgatcagggagagggtcaagcgggccggcgggaacgtcaccggcaagctgcgggtgagcctgtcctggttcaaccacgacgacctcgacctgcacgtgttcgaacccaacggcgaccacatctggtaccaggacaagcgcaacaagctggacgtcgacatgaacgccggcggggcgttctcccgcgagccggtggagaacgtcacctggaccggcaccgtcccggacggggagtaccggatcgaggtgaaccagttccgcaagcgggagagcacccgggtcggcttcgtcatcgagaccgagagcaacgggcggatcgagcactatcgccacgaccgggcggtcggccagaaggagaccgtcgaggtgggccggatgacggtcaccgacgaggtgatcaccgccttccggccgggcgaggacatgcggctgggcagcgccggccgggaggtgtggggcatcaccaccgaacagttcgtgccggtttccaccatcatgtactcgccgaaccacttcgacggcaacgaggtcggcaaccgccactacttcttcatcctgcaggggtgcgtgaacgaccagccgacccggggcatctacaacgagttcctccgcgacgatctgctggcgcaccgcaaggtgttcgaggtgctcggcgaccgcaccaagtgtgagccggcgcaggatcagctgtccggcctcggcttcagctccacggtccgcaacgcggtggtcgccaaggtcaccatgaccggcggccggcgccgcctcatcagcatccagttctga

SEQ ID NO: 4331 - DNA, 267 bp, Actinoplanes utahensis
gtgacgttgaccggtgaacttgtggccgcggttgccgcggaactccgcgacctcggcgtggtccgcggaaagcaccaggcgctgatggtgcgcggcgagcgtggcgacacggtgctggtgaagctggaacgccatgccagcccgccgcggatggaggagttcgtcgtcgacatctcctctgcccttccacgacctcatgtgccggatcgaggacctgagcaccacggatctgcgggatctcacccgcttcttccggtcgcgctctga

SEQ ID NO: 4332 - DNA, 186 bp, Actinoplanes utahensis
atgccagcccgccgcggatggaggagttcgtcgtcgacatctcctctgcccttccacgacctcatgtgccggatcgaggacctgagcaccacggatctgcgggatctcacccgcttcttccggtcgcgctctgacgatcccagcctggctcagctggcggactggatcgagaagcacttccagtga

SEQ ID NO: 4333 - DNA, 1167 bp, Actinoplanes utahensis
atggccctcaccgacccgctggaactgctcgacgtcgccggactgctcagcgacgaggaacggcagatccaggagaccgtccgccggttcgtcgccgaccgggtgcgcccacacgtcgcggagtggttcgaggccggcaccttcccccgcgagctcgcgcccgagctgggcagactcggtgtgctcgggatgcacctggagggctacgggtgtgccgggaccagcgccgtggcgtacggcctggcctgcctggagctggaggccggcgactcggggctgcgcagcttcgtctccgtgcagggctccctggcgatgttctccatctggagatacgggtcgccggagcagaagcaggagtggctcccgcggatggcggccggcgaggcgatcggctgcttcggcctgaccgagcccgacttcggcagcgacccggccaacatgcgcacccgggcggtccgcgacggcgacgactggatcctcaccggcaccaagatgtggatcaccaacggcagcatcgccgacatcgccacggtctgggcgcagaccgaggacggcatccgcggcttcctggtgccgcgcggcacccccggcttcaccagccgcaccatcaagcagaagctgtccctgcgggcgtcgatcaccggcgagctgatcctcgacgaggtccggctgcccgactccgcccggctgcccggagcccgcagcctcggcgccccgctcagctgtctgaacgaggcccggttcggcatcatcttcggcgcggtcggcgccgcccgcgacgcgctgcaggtggcgctcgactacgccggcagccgggtgcagttcgaccggccgatcgcggccttccagctcacccaggagaaactcgccaacatggcggtcgacgtgaacaccggtgcgctgctcgccctgcacctgggccggctcaaggacgccggcaccctgaagccgcaccaggtcagcgtcggcaaactcaacaacgtccgcaaggcgctggccgtcgcccgcgagtgccgcaccatcctcggcggcagcggcatcaccctcgaatactcaccgctgcggcacgccaacaacctggagtcggtgctgacctacgagggcacctcggagatccacaccctggtcatcggccaggccctcaccggtcacgccgcctatcgctga

SEQ ID NO: 4334 - DNA, 819 bp, Actinoplanes utahensis
atggccgagctcgatgcgctcgaccggctgggccccggtgatcacgcctgcctcgtcttcgacgacgagtccgtgtgggcccgcggtgtggcgtcgttcatccggtccgggctgcgtcggcatctgcggatcatgtattgcgggcgggacgccgaccggctgccggccatcctcggcggcctgggcctgaacgtcggcgcggcgctggaatccggtcagctcgccctggcgggggtggacacggcgtacctccgcaagggggtcttcgatccggaagcgagcctgctggcctgggcggcgcaggtcgccgccgcccgcgcggccggctatcgcgggatggtcgggatcggcgacatgtcgtgggcgtgccggtacgccggcatcgagcagctcgcctggtacgaggcgcaggtgaaccggatctgcgtggacggtttcacgatgggcgtgtgcctctacgaccggcggctgttcagcgagccggacctgcgccgggtgacccgcacccatccggcgccgctgctgcgggcggtgcgcaccagcgagccgcgcggcctgcgggtcgccggggaggcggacctgtcgaaccggcaggcgctgcgcgcggtggtcgagcatctgatcgaggacaccgcggccggcccggaaccggtcaccctggatctgagcgacctgcggttcgccgactcggccgccgcccggatcctgctcaccccggcccgcgggaccccgctgcgggtcaccggggtgagcggcccgctgcgccggctgctggacttccactggtccggaccgcccgaggacctgcgaatcgagtag

SEQ ID NO: 4335 - DNA, 1743 bp, Actinoplanes utahensis
atgcgcggccaaccgtctgaccgtcgcatggacgagggcttcacgctgctcgaggtgctcgtggcgctggccgtgatcagtgccgcgatggccggtctgggcgcattcttcgtcaacggtgcgctcaccgtcgctcagcagcgtgatcaacgctacgccgcacggctcgccagcagcgcgctcgagcaggtccgcgccctggaaggctcggcgctgctcgacgggcgcggtcaggcgaaggttgaccagcagtgggcggaggtgcagagcgggccgttcgcgagcatgatgcagccgtacctgtcgcacatgctgaagctgggcatcccgaacagcaccgagggcgacaacgcggcgctgccgaccgtgcccaagccggtcaccgtcggcaccaccagctaccagcagagcatcttcgtcggcccgtgcgaggtctacgtgacccgcgacgacgactgtgtcgtgccgctcccgctgaccgacccgaaccgtcccaccgacgccacctcgatcctgtcgtactaccgcgtggtggtgctggagacctggcggcacaagacctgcacggcgcccggcaaccagtgcggctatgtcgcctcgacgctggtctccagcaagaaggacgacgccaagttcagttccacccgggcgatcccgaagatccgccagcccgacatgaaggtcttctaccgcaacctcaacaaggtctcggtcaagatgaaggtgaccggcggcaacctgccgaacacctggagcgcggtcaacctgcccgacgggctcagcatcgacccgcagaccggcatggtcggcggcacccccaccaagctgggcacctggtccaacgccaccaccggcacctacgtcagggtggtggagaacgcgccgccgaccggcacgctgtccccgcgctcggacaacgacaaggcgctcggcctgacctggaaggtgatcgacccgccggtcgccaggtcgcccgccacgtggagctacgccggcgccgcgatcagcatcgcgccggtcgtggtggacacctcggtgccctacacgtactcgatctccggcctgcccgccgagctgtcgttcgacccggccaccggggtgatcaccgggacgccggcgcagaccttcagcgccaccgtcacggccgtcaccaccgcgaactacgtcgcgatcgacgtgccgttcgcacacacggtggtccagccgctgaccctgcagccgatcaccgaccagacggtcgacctggtgtcgacggtcagcgtgcccgcggtcgccgccggcggtgacggaaagtacacgttcaccgcgaccggcctgccggtggagctgagcatcaacgccaccaccggcgtgatctccggcggcccggtgctcatcgccggccggtacctgccgacggtcacggtgaaggacgggctcggtgggtcggtgagcgtcagcttcgtgatgcaggtgggctcgccgtcgaccaccctgatgttcaccgctccggcggccgtgcagacctccagcgccggtaaggcggtgacgataccgatcaccaccaacgccgacgcgctcaatgtgaagggcgtcaaggtcaccgccaccgggctgccgacgggtgtctcggtggacaagaagggcgagaacctcaccggcaccccgctgctgcccggcgtctacaccgtcacgctgaccggtaccccgtcgggcaaggacgcgcaggtcacgcagtacacgttcgtctggacgatcctgtga

SEQ ID NO: 4336 - DNA, 711 bp, Actinoplanes utahensis
gtgccgccgtggaagcgccgtccggccgacgatgacgatcagggcttctcgctgatggaggtcctggtcaccaccgggatcatgtcggtggtgacgatcgtcgcggtgaccgccctgctgcagatctactccggcacccggcagatcgaacagaactcggtcgccggtgaccagctggacatcagctatgtccggctggaccgggagctgcactacgcgacgtacgtgtacggcccgaccccgggggcgaccaactcccggtcgtacctggagttcgcggttccgccccggcagaagctcctgacggacaccgtcgacccgcccgtccgctgccggcaactgatgttcgacccggtcaagaagacgttgacgatggccacctgggacctgcccggcaccacgccgggcaccccggccacgctcgccaccgacgtggtgctcgacgccggcgccacgaccccgttcgccgtcgtcaagccgggggacacgccgttcgtcaccgcgagcgccgggacggtcggggtgggtccgcagttcaacgccaactatctgatggtccggatccggttccaggcgaaggtcggcgacgccgtccagcgtttcgacaactcgttcacctcgcagaacatcaccgatgagaacgacggtgacacgtccgccgacccggtgccggacccggacaggaactgcagcaacgtagggaggccgtag

SEQ ID NO: 4337 - DNA, 1548 bp, Actinoplanes utahensis
atgatgacgcttcaccggtccggcgacgacgatcgcggatcgctgcccatcgcgatgatggtggtgctgaccggcctggtcctctcggtcgcggtccttccgatgatcgtccggcaggtcagcggggaacggtcgatttcggaccgcaacaccgccctggccggggcccgcatcggcctggacgtggtgatggcccggatcgcgtcggccagcatgaagatcgccgcgtccgacccctcggccgtcggcctcctggaggatctgccggactgcaggaatccggtcgagggtgacgtcggcgtgggccaggagaagctcaagtattcggtgacgatcgcctacaaggactccgagggcacctcgctcacctgtccgctcaccaaggtcccgaagaccgcggagctcaaatccaccggtgcgggctcgctgaacgtcgccccgatcggcaagcccgcccagtacggctcccgcgtcctgaacgcctcctacacgttcgcgctggacaacgacaaccagaaggcggtcggcggctccatccggatcgacacctcgacggtcggcaacctctgcatggacgcggtgtcgaagaccccggcggcgggcgcgccggtgaaggcgcggctctgcgacggcagcagcacccagcagttccagtacaccgaagagctctacctcaagctggtgaactcggagaccgacgcctacccgaacggcatgtgcgtgttcggcaccacggcgcacgccaacggcaaggcggtcgtgctgcagccctgcccgagcggcagcatcgtggccgacttccagtggagcctggacaacaacagcgagctgaagtcgaccagcccgacccggacggtggagaacttctgcatcaacctcaccaccggcagcaaggtggacaccccgctggtgctgaactcctgcagcagcaactcgtcgctgaacgtctggcgcttcgacgccggggtgggcgccggcatggccggggaggagacctaccagctggtcaactactcccagttcagccgctgcctggacgtgaccagtcggtcggtcacctcgacgtacatgatcgcgtggttctgcaagcaggacccgaacggtgtcgtggactggaaccagacctggtaccacccggtgccggtggctccggcggtcgagaagcagggcgtcatctacgtgatctcgagcggcaagcggtactgcctgaagtcgccgctggtggccaccaccagcagctgggtgacggtgaccgcgaccggctgcccgcagaccaccgtgaccagcaacgtcgggatccccgccgaactgctgtggaacgtacgccgggccaccggcagctacaccaccagctaccggatcgaggatgccaagggcctgtgcctgcagcccaccgacctcgccaccggggtcaagaacgtggatctccacgcggacggcaccagcaaggtgaaggtggccgtctgcagcagcgccgagctgcagaagtggaacgctccgccggacatcagcaactccagtccgctgaccggcgtcaaggagaactga

SEQ ID NO: 4338 - DNA, 2361 bp, Actinoplanes utahensis
atggagaccacgcaccccgccgacagccacgacctcatccgcgtgcacggcgcgcgggtcaacaacctcaaggacgtcagcgtcgagatcccgaaacgccggctcaccgtcttcaccggggtgtccggctcgggcaagagctccctggtcttcggcaccatcgcggccgagtcccagcggatgatcaacgagacgtacagcgcgttcgtgcagggcttcatgcccgcgctggcccggcccgaggtggacgtgctggacgggctgaccacggcgatcctggtcgaccaggagcggatgggcgccgacccgcgctccacggtcggtaccgccaccgacgccaacgccatgctgcggatcctgttcagccggctcggcgacccgcacatcggctccccgcaggcgtactcgttcaacgtcgcctcgatctccggcgccggcgcggtcaccatggcgaagggcggggtcaccaccagggaacgccgcagcttcagcatcaccggcggaatgtgcccgcggtgcgagggccgcggcgcggtcaccgacttcgacctgaccgcgctgtacgacgacagcaagtcgctgaacgagggcgcgctgaccatccccgggtacagcatggacggctggttcgggcggatcttccggggctgcggatacttcgacccggacaagccgatcagcgaatacaccaagcgggagttgaccgacctgctccaccgcgagccgacgaagatcaaggtcgacgggatcaacctgaccttcaccgggctcatcccgtccatccagaagtcgttcctggccaaggaccgggaagcgatgcagccgcacatccgggccttcgtcgaccgggcgatcacgttcaccacctgccccgactgcgatggcacccggctcaacgagggcgcccgcgcgtcgaagatccgcggggtgaacatcgccgacgcgtgccggatgcagatcagcgacctggccgcctgggtgcgcgacctcgacgagccgtcggtcgccccactgctcggcaaactccggcacaccctcgactcgttcatcgagatcggcctcggctacctgtccctggaccggccggccggcaccctgtccggcggtgaggcgcagcgcaccaagatgatccgccacctgggctcgtcgctcaccgacgtgacgtacgtcttcgacgagcccacgatcggtctgcacccgcacgacatccagcggatgaacgacctgctgcggcaactgcgcgacaagggcaacacggtcctggtggtggaacacaagccggaggcgatcgcgatcgccgaccacgtggtcgacctcgggccgctggccggggcgggcggcggcgaagtcgtctaccagggcaccctcgaagggctgcgggccagcgggaccctgaccgggcggcacctcgacgaccgggcggcggtgaagaacgacgtccgcaagccgtccggatttctggaggtgcgcggagcggaccggcacaatctgcgcggtgtcgacgtcgacatcccgatgggtgtgctggtcgtcgtcaccggcgtcgccgggtcgggcaagagcagcctgatccacggctcggtggccgggcgggacggggtggtcaccgtcgatcagggcgcgatccgcgggtcgcggcgcagcaacccggcgacgtacaccggtctgctcgaaccgatccgcaaacagttcgccaaggtcaacggcgtgaagccggcgctgttcagcgccaactccgaaggcgcctgcccgaactgcaacggcaacggggtgatctacaccgatctggggatgatggccggggtggcgaccacctgcgaggtgtgcgaggggcggcggttcgacgcgtcggtgctcgactaccgcgtcgcggggaagaacatcagcgaggtgctggcgatgccggtggccgaggcggtggagttcttcgcggcgggggacgggcggaatccggcggcgcaccggatcctggcgcggcttctcgacgtggggctgggatatctgacgctggggcagccgctgtcgaccctctccggtggggagcggcagcgggtgaaactggccgtgcacatgggggagccgggcggggtgttcatcctcgacgagccgaccaccgggctgcacctcgccgacgtggaacaactgctgggactgctcgaccggctggtggacgcgggacggtcggtgatcgtgatcgagcatcaccaggcggtgatggcgcacgccgactggatcatcgatctggggccgggcgcgggacatgacggcggactcgtcgtcttcgagggcacgccggcggagttggtggccgggcggtcgacgctgaccggtgagcacctggcggcctacgtgcgggcgtag

SEQ ID NO: 4339 - DNA, 555 bp, Actinoplanes utahensis
atgcgccgttacctgctgattctcgccctggggctggtctgcctgacctccgcggacaccgtcggggtgcggctggtggcgtggccggccccggcgcgcagctcggggccgctggtggcgcacccggggtggacctcgtgcgccggggtcgatgcgtccgacgagtcggcgctggcgctgccgctgctggacgacacgttcaccccggtggcggcggtctcctgcgccgtcggcccggaccgtaccgctgtgccgggcggtgccggtgcgcttgccgtggtgctccaggagcggcggttcgaggacgtcggcacgctggtggccgcactccgccagccggatcggaccgccgtgcgctccgatgcgctggtcgacggcgacctcttgtgcacgctggagaaacggcctgtcccgtgggtcgcggtgatcgacgcgcacgggcgctgggtgcaccccggactgcccgtggaggcgtgcgggcaggtgtcccaccgcctgctcgatctgatccgggccatgcccgccacacgggtggtgacgacgccactgcattga

SEQ ID NO: 4340 - DNA, 507 bp, Actinoplanes utahensis
atgcgcgacgacgcgttccgcgcgtacttcgaaaagcatcatgcttcgctgtcccggctcgcctacctgatgaccggggagacggcggtcgccgacgatctcgccgcggacgcgctcaccgaggtctggcggcactgggaccgggtgcaggccgccgacgatccggtcgcctacgggcacgggatcctgatgaacctggcccgccagtgggtccgccgccgtggccgggaacgactgatcgccctcgggctgtccgggcgggccacggccggcagcgacgtgcccgcggtgctcgacgtgcgcagcgccctgcgcaaactgccgcaccgccgccgggcatgcgtagtcttgcggtacgcgttcgacctgtccgagcgcgaagtcgccacgacgctgggcatctccgtcggcgcggtgaaaagcgccacctctcggggtgcgaaacagttggccggcctgctgggcgggacggtcacccggatcgacggctgggaggcggcccgatga

SEQ ID NO: 4341 - DNA, 879 bp, Actinoplanes utahensis
atgaggccctcggacgagcaccacgacggtccggcgcgcccccgtgccccgcgctccggcgacgcgccgcccaccgacgatcgactgcgggcggtgctgcgcgcggaggccgcggcgcaccggcccgaccgggaggcgatgctggcccgggtcaccacctcggtgatgagcgagccgatggcccgccgccggggcgggtcccggctgcggctggccctggtcggcgcgctggtcgcggtcttcggcggcggcggggtcgcggcgcagtgggcgctgaccggcgacggcgaccggaacgacgcgacgccggtcgtcaccgtcacggccaccacgcccgcgacgactccggctacgccgccgcccgccaccggccgtccggcgcccagctcggcggtcccgtccggcaccccgccgacgtcctcgaagccggccgttgtgggcgccccggcgaccagcccggccgccgtccggagccggcccgggaacacccgcgtcgagcaggggccgctctggtcggacggctccgtcgacgccggcggtgggtcgagcgtggtcaccctgaggaccggggagagaatcaccgcgctcaccgtcacgatccggctcgtcaagacgcccgggctggtctcgcgcggtggcaccaagtcggtgcccggcgccagcgtcaccacgaaggtcgaggaccggggtgacgcgttgctctacacgttcaccctgtcttcggccgaccgggtggcaccggggacgtacacgttcaccgcgaagtacgtgcacgccgacggcggccgggacgccggtggcgacacctacgaggcggtggcgacgaccgcgggcgggcagtccctcgacgtctacggcgacttctatccggcggggtga

SEQ ID NO: 4342 - DNA, 2451 bp, Actinoplanes utahensis
atgggccgcatggatcttcgccaaggcagccagggcatcggcctgcgacgactgggcaccaccgcggacgagttccaacaggatctgctgagcagcctctattaccgcaggggcaccacggtcgagtcggccagcccacgggacgcgtacgaggcgctcgcgctcaccgtgcgggatcggctcgcggatcgacgggcgcggacggcggcggcgcattacgccagcaatccgcggtgggtctactacctctccgcggagtatctgctcggggcgcagttggagcagaatctgctctattccgccacgggtgcgatcgccgcgcaggcggtcaaggcgctcgggcggacgctggaggagatcgaggacctggatgtggagccgggcctgggcaacggcggcctggggcggctggccgcgtgcctggtcgactcgatggcgacccgcgacattccggcggtcggctacggcatccggtacgacttcgggatcttccggcagtcgctggagaacggggcgcaggcggaacggccggacgactgggcgttccagggcaacccgtgggaattcccggcgcccgacgaccggcagacggtgggcttctacggacacaccgagccggtggccgggtcaccggtccggaagcggtggctgcccggcgaggtggttctcggcgagccgagccacatgctcgtcccgggctacgggacgcagacggtgaacatcgtgcggctgtggcgggcgcgaggcagtgaggcctcgttcgacctgtcgcggttctcggccgggcagtatgccgaggcggtgcaggaagcggtccgcgcggagaacatcagcaaggtcctgtaccccgacgacagcaccgagctgggccgcgagttgcgcctcaagcagcagtatttcctctgctcctgctcgctgcgggacatcatccggcggttccggatgcgcaacacggactgggacgacttcgccgagaagaacgtcatccagctcaacgacacgcatccgacgatcgccatcccggagctgatgcggctgctggtcgacgagtacgggctggactgggaccgggcctggtcgatcacccggcggacgttcgcctacacctgtcacacgctgctgccggaagccctggagacctggccggtgcacctgttcgagcggctcctgccccggcacctggagatcatctatctgatcaacatgctgttcctgcgcgaggtcgagcagcggttcccgggcgacaccgaccgggtccgccgaatgtcgatcatcggcgaggagggtgagcgccgggtccggatggcgcatctcgccgtggtcggcaccgaggcggtcaacggggtcgccgagctgcactcgaaactgctgcgcgaaaccgtgctgaacgacttcgccgacctgtggccggccaagttccagaacgtcaccaacggcgtctcgccccgccggttcgtcaaactcgccaacccgcggctctccgacctgatcaccgaggggctcggcggcgacggctggctgcacgacctggaacagctcgccgggctggaacgtctcgccggggacgcgtcgttcgccgaacgctggcgggcggtgaagcgcgccaacaaggtggacctggcggccggcgacccggactcgctcaccgacgtgatgatcaaaaggttccacgagtacaagcggcagcagctcaaactcctgcacgtgatcaccatgtaccaccggatccggcagcacccgaccggcgactgggtgccgcgcaccgtgctgttcgccggcaaggcggccccggcctaccacgccgcgaagagcatcatccggctgatcaacgcggtcggcgcgacgatcgcggcggatccggtggtcgcgccgtacctgagaatcgtgttcgccgagaactacaacgtcaccctggccgaacgcatcattccggccgccgacctcagcgagcagatctcgctggccggcaaggaggccagcggcaccggcaacatgaaactggcgctcaacggcgcggtcaccatcggcaccctggacggcgccaacatcgagatccgcgcccgggtcggcgaggagaacttcttcctgttcggcctcgacgccttccaggccgccgaggtgcgactcggcggatacgacgcgaaacgcttctacgaacaggacccggaattgagagcggcgctggacgccatttcggccgggatgttcggcggggtgggccgggaggtggcggactcgctgttgggctgggacgagtatctgacgctcgccgattaccggtcctatctggacgcgcaggaggaggtggagcgggcctggcgggatccgcggcgctggacccggctgtcgattctgaacacggcgcgcagcggcttcttctcctcggaccggacggtggccgactacgcagcccgcatctggcgggtggctccggttccggttccccattaa

SEQ ID NO: 4343 - DNA, 1773 bp, Actinoplanes utahensis
atggacacccggaactggaccgcctggaacaagttcatgggcctgtggaacgccgacacctgggcgtacgtgccggtcgacaacccggcgaacaccctggaagcgaccgccgacctgccgcccggcaactacttcgtcaccgcgatgtacggcatctacggcgtcgacagctacctgatcaccaagtcgttcacggtcggcgcccggggcgcgcgctactgggcggtgccgatgaccggcgagtcgtccggcacgttcctcgccacctacctgcgggcgcccggcaccttcacggcctacatgacgcccggggtcacctggtcccggctggtcgattacggcagccagaacctgaacctgaccgacgtgaacctcggctccggggagaccggcaccgccgagacggtcggcgccgggccgctcatgccgggcaccgggcggtacggctcgcagacccgccgtgaacgggacaagctctacctgtacgagccgatccagctcaccgacaccgccggcaacccgggctcggacccgtccacctcgcgcaccacgatgacgctcagcgcgggcgggacggttctcaagacggccgcgtcgctcagcctggccgcggacgtgccgcccgccgcacagctgtacacactggatcagaccaccacgcaccggtcacagcagtccctgctgaacaccaggatccagaacacctggacgttctcgtcggcgaccacgaccagcgcccgactgccgctgatcgacgtggcggtcggcgccaccggtctcgacgcccgcaaccgggcgtccggcgggcccgtccagttgaccctcacgccgtcgacccggtccagtgacgcggtcacccgggtcgaccggctggagtggtcggccgacgacggcgccacctggaccgcggcgtcggtcaccacgggcggcgcgtcgatcaccgtgccgcccggtgcggcgttcgtgtcgctgcggatcaccgcggccaacgaccgggccggcaccctggtccggacggtgacccgcgccttcgccggccccgccgaacccgccgacgagaagctcggcaccaccggcgaattcggcggcgagctggagatctccggcgtcacggtgaacggcgggcagcccctcaccgtcggcaccgcgggcaccttcgaggcgatgaccgcgacgtacgcggtcagcgacccggtcaacgcgaccatccggtccggcctggtgctctaccacggctcgtacacccagccggacggcatcatcccggccagcgtcaactgcgtccgattccagcaggtcatcggccggtgcaccgccgacttccggtcgtacgaccaccgctgggcgctcaacagcaacgccctggccggcgactggcacgtggcgatctgggcggagaacgcggccggcacccggatgatcgaccggcacgacgcggccaccgtgaccctcaggaaagccacccagctgaccaccgacgccaccccggaacccgtcgccaagcaccggacgatcaccgtcgcgggggcgctgagcagggcggactgggagacgtggacgttccggccgtacgccgggcagaccgtcgacctgcaattcctccagtcgggtgcgagcagctggaacgggctccggacggccacctcggatgccgcgggaaagctgaggacgacgacgccggcggtgacttccggggcgttccgctaccgctatgccggcgacggcgcgtcggccggaatcagcagcgccgccgactccgtcgccgtgcaatag

SEQ ID NO: 4344 - DNA, 726 bp, Actinoplanes utahensis
atgatcggacaggtcggcgacgcgccaccatcgggacgggcggcgacccctaccctggcatccgtgattcgtgcggtgatcatcgacgtggacgacacgctgtgcctgaccgaggcggcgtcgttcgacctggagaacgacgtcctggcgcaggtcggccagccgccgatgagccgcgcggtgcacctggccacctggggcgagacgctgctcgacgcgatgccgcaccggtcgccgggcgtcgacctggagcggttcgcggcgctgttccccgcggcgcatcagcggtatctggccgacggccgactcgacgtgatcccgccggacaacctggacgccctcgatcgcctggtcggcaccggtcacacggtcatgctgctgacctcccgcaccggtccggaggtgcagcacctgctggcgccggaccacgtgctggccggacgggtcacccgggcgtaccaccaggacaacacccggtaccgcaaaccggatccccgggttttcgacgaactgctcgccgagaccgggttccaccccgaggaatgcgtctacgtcggtgactcgccgggtgacgcggtggccgccggcggcgccgggatccgcttcatcgcctgcctgcagagcggggtacgccggctgccggacttcgacccccggttcgtgaccgccgccgtagcgacgttcccggaggtcccggcggcggtcaacgagttgtccgaggggtag

SEQ ID NO: 4345 - DNA, 783 bp, Actinoplanes utahensis
atgatcaccgcacgaatcacggatgccagggtaggggtcgccgcccgtcccgatggtggcgcgtcgccgacctgtccgatcatccgggatccggcagtcgtcggagccgccgcccggcggtggtgtgcaagactcccggctgtgctggatcggttgttgccccaccccgtgcgatccgctttcgccctcaccgacgatccggacgaggcgtgttacccgggtgaggaatcgctggtcgcgaccgcggtcccgaaccgccgccgggaggtggtgaccgcccgccgctgcgcccgcgaggcgctgctcgccctcggtcacgcccccgccgcgatcccgcgcggcccccaccgggaaccgctctggccggccggcgtggtcggcagcatcacgcactgcaccggcttccgtggcgccgcggtcgcccacaccggcgagctgaccggcgtcggcatcgacgccgagccgcacgccgcactgccgccccgggtgctgggcgcggtgaccgacccggtcgagcgcgccatgctggaccggctcgccaccacgcacccggagacctgctgggaccggctgttgttcagcgccaaggagtcgatctacaaggcgtggtttccgctgaccggccgctggctcggtttcgaggacgcccgcctggacatcgacccggacggcaccttcgtcgggcacatcctgatcgagtcgccgctgccccggctggccggccggcacctggtcgaccggggcctgatcctgaccgcggtgtcagttcccgcacaggggtga

SEQ ID NO: 4346 - DNA, 2130 bp, Actinoplanes utahensis
gtggcgctgctgctggccgtcgcgggcgggctggtggcgctggaccggcagcacgtggcggccacccggcaacgggaggcccaggcgagccagcaggaggcggcgtcccggcagtacgcggccgaggcggtgaacgcgctgaaccgggacgagatcgccgcggtccggcgggcactcgacagctggcaggtgcgcgagaccaccgaggcacgcggggcggtgctctccgcgcagatggtcaacgccatcggaacgctcggcaccgacccgggtggcaccgccgcggcgttcagcccggacggcaggcgcatcgcgatcgggcacggcgacgggtcggtccggctctgggacgccaccacgctcacgccggtcgggcagcggatggtcccgccgaaccggagcacccgcagctacacgcggtcgttggcgttctcgccggacggccggttcctgctcgccggcgtcgccgcgagaaacggcctgtacatctgggacgccgccaccggtgacctggtccgggccctgccgggcggcgccggggcggcctggctgcccgggacctcgacggcgatgggctggcgcaccgacaccaaggagggcatgcccttcgagctggggatgtgggacgccgcctccggacggctgatccggtcgttgccggtcggtgactacgccgcctacgacctcgcgatcagcgccgacgggcgatacgtggcggtcacccggcccgtaccgtctccggccaaggtgtggcggatcagcgacgggcggctggtcaccaccgtcccggacaccgcgtacgtcgcgttcgccccggacggcacgctgatcggcgcgaaccggctcggccagctcacccagtgggcgatcccgtcgggccggcgccggcaaacgatgatcaccgagtcggtgacccccttcgcggctccgatccgggtgactcccgacggcgtcgtcgtggtcaacaacggtctgcattcggtcgccctgttcgccctggccggcggtgatcgccggacggaggacaccggggtggcgtcgctcccgtcgccggcggtctccccggacggccggacgatcgcggtcaccggcgtcgacgcgccgaccgcggtgttccggcgggcgaccacctggctgccgcacggaacgcgggtgatcaccagcgccttcgcgccggacggccggcggctggcgaccgccggcgaggacggcaaggtgcgggtctgggacccgggctcccgggccctgctcaccgagatcccgaccgacggcgtcccgatctcggtcgccttcccggacccgggcacgctggtcgacagcaccacgaacggcagactcgaggtgcgcgacgcggcgaccggcaaggtgcgcgtgaccgtcccgctgcccggcacgccggccgacctcgccgtgtctccggacagatccctgatcgcggtggtcacccagcagtcccaggaggatctcaccaagcggggggtcaccgggcaggcggatcaggcgctcgtctacgacgtcggccggcaggcggtccgggcccggttcccgctgggcgccacgccgtcctcggtggcgttcagccgggacgggacctcgctgttcaccggactgaccgtggcgggcggataccacgacggctacgccctgcagcgctggcgcaccgccgacttcagcccggccggcagcgtcccgctcggctatcggccgctcgacatcgcggtgtcaccggtcgacggtgcggtcgcggtcaccggaaccaacggctcggtcgaggtccgcgagccggacggcgccccggtgcggtggcagaccccgccgcagattcagcaggtcgacgcgatcgccttcgcgccggacggccggacgctggcctccaccgagttcgacgggcgggtgcacctctgggacgtcggcgcccggtcgctcacggcgaccctgaacggtcacgactaccggtccggcgcgctcgccttcgcgccggacgggagcctgctggccagctccggcttcgaccacacattcggggtgtggcggctcgacccggtcgcggtcctcccggacctgtgccgggtcgcgcggatcgccagtcgcaacgacggcaagccgctctcacccctgtgcgggaactga

SEQ ID NO: 4347 - DNA, 1884 bp, Actinoplanes utahensis
gtgccggatccggacgacacccccggccccgtcgagcgcgctcgcgccggcgtgcggtcctgggtgcgggagagcggacggcgcggtcgcgcacgactgcgcagcgccgggccgtacgcgatcctcgccttcctgaccgcctcggcggtcgcaccggtggccggcgccgggctcggcgtcccgggggcgttcgccatggcgctggcccagctcgggggcctgggcagcaactatctcgccgacgtgctggccggcaccgcccagcggatgcgcggcggcggcccgatcaccgagcagcagtggcgtgacgcggtcgccgacgagctgctgccgctgctgaccgccggtgacgagcggggcgggcggctgcaggcggaggtctccgcggtgctgcacgagatcgacgcggtcgccaccgcgctgaccgaggcggccaccgccgacgacggcttccggcatcaactggaggcggtcttcgaggagctgggcagcgacgtcggctcgctgcggtggatgctcaccgacgtccggcggtcgctggacgatctgcggcagcagttcgcggggcagaccctgctgctgcaccggcagctggaacaggtccgccggcagctgctcgccgtcaaccaggagacggcccccgccgcgccgccgctgtccggctcggtgccgccctatcccggactggccagtttccagccggccgacgccccgtggttccgcggccgcgagacgcaggtggccgagctgctggcccggttgagcgagcagctggtgggcggtccgcccctggtcgtcaccggggtctccggcgtcggcaagtcctccctggtgcgggccggcctgctcccggcgatcggcgccggccgactcggcccggccgcgacggcctggccctggatcgtgctcacccccggcgccactcccctgcgcgacctggtgcggcacctcgccggcctgcccggggccaccccggagcaggccggtgacccggcggccgacgtcgacgggttgcttcgcgacgtgcgccgggagcccgcgtcgctcggcgcgctggccgggcgggcggccgccgggggccggcggccggtgatcgtggtcgaccagttcgaggagctgttcacccagtgcgccgacccggccgagcggctggccttcgcggccgcgctgaccgccgcggcgccggcgctggtgatgatcgcggtgcggtccgacttctatccggcctgcgtcgagctgccgccgctggcccgactcctggccggcgggcatgtcgtgctcggcccgctggacgccgggtcgctgcggcgggccgtggtcgagccggccgagcaggccgggctgaaggtcgacccgggcctgcccgagctgatgctgcgcgacctcggcgagggcggcgccggggccggcggttatgagccgggcgcgctgccgctgctggcacacgcgttgcgcgcgacctgggagcgacgggacggggatcagctcaccgtcgaggcctaccgggcgaccggcgggatccggcacgcggtggccgagacggcggaacggatctacctggggctgggcccggaggagcaggcggccctgcgcgcggccctgctctccctggtgacgatgaccggcaccggcaccgtggtgcggcggcgtggccggcggtccccggacggctcccgggtgctggaccgactggtcgccgagcgcctggtcaccgccgggaccgacaccgtggagatcagccacgaggcgctgctgaccgggtggccccggctggccggctgggtggcggaggcccggtccgatctggagctgcggcaacgcgtcgcggaggcggccgaggactgggaccgctccggccgcgacccggacctgctagctagctag

SEQ ID NO: 4348 - DNA, 429 bp, Actinoplanes utahensis
atgggtgagcgacatgcgacagtgcgcatcatgatcgatgcggacatcacccggcgggtggtcaccgaattcctggcgtacgtgcggtccggccgcgacccgggccgcgccaccgccctgatggcgccgcgggtgcgggcccaccaggtgcagtccgaggacccggtgacgatcgtccggacgcccgccgactacgccggtcacgtacaggagatgatcgacacctggggcgagttccacctgcaggtggaggacctgctggtggacggtgcccgagcctacgtccggctggcccagaccggccgccacaccgcgaccggccgggtggtccgccaggtcaacgcgatcgtctaccacgtcgagaacggccggatcaccgagtactggatgcagatcgaccgcgccggcctggccgcccagctcacctga

SEQ ID NO: 4349 - DNA, 963 bp, Actinoplanes utahensis
atgacggagcgcgcgtttcgattcggggtcatcgccgcgcaggcgcggaccggtgcggaatgggccgcgaatgcgcggcgggccgaggagctgggatacgacaccctgctcatcccggacaccctggtcacgctgtcgccgttcgcggcgctggccgcggcggccgcggccacccggacgctgcgggtgggcacgtatgtgctgaacgcccccaaccggaccgcggcccaggtggcctgggagacgcggagtctgcagacgatcagcgatgggcggttcgagctcggggtcggcggcgggcggccgggcgggcacgccgacaccgcggcgctgggcgggttgtgggggacgccgggggagcggctgcggcgcacggcggacacgatcgcggcggcacgcggcctgccgatgccgcccacggtgctggtggcggcctcgaaaccggggatgatgcggctcgcggcggaacaggcggacgtggtgaccttcggcctgccgccggtcgccacaccgggggagctggcgcgggcggcgacggagttccgtggcctgtcgaaccgggcggatcaggtggagctgctggtgggggtgaccgctttcgccccgaccatcttcgcgctgcccgcctggctgtcgcggcaggtgggcggggatccgcgggagatggcggcggccggggcggcgacgttcctgatcggggacgccgaccacgcggcggaggagctgctgcggcggcgagccgcgggaggtttctcgtacttcgcggtgaacgggccgttcatggaggccttcgcgccggtcatccagcgtctgcgcggcaccgggccggtcggcgggtcagcggagccggcggccccggacggcgaccgccgcggcggtgagcggcggccggcgggcacgcccggcccgtcgacgaaggtcgccgcggccagccggctccaccgcccgacggaggcctcgtag

SEQ ID NO: 4350 - DNA, 1203 bp, Actinoplanes utahensis
gtggcactgcgggacgaacaacttgaagatcgactgaccggcccgcgtcgggggcggaccctcgccctcatcgcgctcatcctcggcgcggccaacctgcggctcgcggtgaccagcatcgggccggtcctcaccgagatccgcgccggcctgcacatgagcggcacggtcgccggcctgctcacctcggtcccggtcctctgtttcgccaccgtcggcctgctcgcgccccggatcgcccggcggatcggcccggtgccggtcatcgccggcggcctggtgctgctcaccatcggcctggcgacccggcccttcgcgcccaactcggcggtgttcctgctgctcagcgcggtcgcgctggccggcatcgcgctcgccaacgtgctgctgccgtcgatcgtcaaggatttcttcccgacccaggtcggcgcggtgaccgggctctactcggtcgcgctgaacctgggggcgaccacggcggccgcgatcaccgtgccgctgaccgagagcttcggcgactggcgtctcgggctggcctgctgggcgctcgcggccgtggtggcgctgcctccatggctgctgatggcccgccggaccgggccgcgccgggccgcgccggcggccgccaccgcgccggtgcggatgatccggcagccgatcgcctgggcgctggccgtctacttcggcatgcagtccacctcggcgtacgtgatcatcggctggttgccgcagatctaccgcgactcggggctgtccgcggagaaggccggcgtgctctttgccaccacctccctgctcggggtgccgctggggatggcgctgtcggcggtggccgggcgggtccggtcgcaaagcctgatcgcgatctgcctgggggcgttcgggatcgccgggtacgccgggctgtgggcggaccccgcggcggcgccgtggctgtgggcggtcctgctgggcgtggtgaacacggccttcccgctcgtgctcaccatgatcgcgctgcgcgggcggacgccgggcacggtggtgcggctgtccgcgttcgcgcagggtgtgggatatctgatcgcgatcccggggccgatcctgatcggggcgctgcatgacgcgacgcacgggtggaaggcgccgctgggcatcatggtgggcctgatggtgccgcagatcgtggccggcgccttcgccggacgtgaccgccagatctga

SEQ ID NO: 4351 - DNA, 831 bp, Actinoplanes utahensis
atggcgaacagaccagcgcggccggcccatcagggcgtggtcacccgggtggagcggctgacgccgcacatggtgcgggtggtgatcggcggcgaggcgatcggccggctcgacgccgcgcgcttcaccgaccactacatcaaggtgctgttcccgcgcgacggcgtcacctatccggagccgttcgacgtcggcacgatccgcgagaccatgccgcgcgaggactggccgctcgtccgcacgtacacggtgcgtaagtggctgcccgaggtgcccgagctgtgggtcgacttcgtggtgcacggcgacgaggggatcgccgggccgtgggcggcgcgggcccggcccggcgacgtggtccggttctccggccccggcggggcgtatgcgccgtcgcccgacgcggactggcacctgctcgccggcgacgagagcgccctgccggcgatcgccgccgcgctcgccggcatgcccgacggcgcgcccgtccgggcgtatctggaggtcgacggtcccgacgaggagcaggagttgcccaccgccgcggacgccgagatcgtctggctgcaccggggtgaccggccggtcggcgaggcgctggtgaaagcggtgcgcgagctggagttcccggccgggcgggtgcacgccttcgtgcacggcgaggccggcttcgtcaaggagctgcgcggctatctgcgggtcgagcgggagctgccgatggagcagctgtcgatctccggctactggcgccgcgggttgaacgaggacggctggcagtccagcaagagggagtggaacgcgcaggtcgaacgcgaacaggagacccgctga

SEQ ID NO: 4352 - DNA, 462 bp, Actinoplanes utahensis
gtggtgcccaccccggccccgaccaagacggacaacggcggcgagacggtcgggcagaccaagtcgacgatcatcacgacgaagccgaccaccaaggcgccgaccaaggcggccaccgcctcctcgaccgccggcagcgactcctcgaccgccggctcctccggcggcgacccggcggccgccccggcgaagaccaccagaaaggccgagccggaggcgaccccgaccggggacgccgcaccggccgccgactacggcgtgaacgtcggcgcggccgacaacccggcgccgaagggcaccgggggcccgggcgagacggtcgccgagccgccggcgagcaccaagagcgggccgctgacgctgctcagcgaccacccggcggtgttcgggggcggggccgtggtgatccttctcgcgatcatcgggttcgccttcgcccggtcccggccgcggcggtactga

SEQ ID NO: 4353 - DNA, 768 bp, Actinoplanes utahensis
atgggaagcacgggtcaccgtcgtaccggcctcacggccgccgggtcgggacgtggccggctgctggccgccggtgcggtcgtgctggccgccggcggcgcgatcgggttcacccagttgtcgcacgccgacgagaccccgcaggccaaggccgcgagccagagcggcgcgggcaagatcgtcaacgggcagaagatcctcaccgacacctgcatcgacagccggctcccggcgcacgacggcttccagaagggtgaccgctgcgtctccaccgagttcggtgaggtggcctcggccgccaacgacgcgtcgttgctgatcaccgcggcgccggtggtggtcgcgccgaacacgccgttcacgctcaaggtgagcacccgcaacctgatccgcgaccggttcctcgcggccggcaagggcggctactacgtcgagtccagcgtgctgcagaacgggatcgtccgcggccacttccacaccgcgtgccggatgctggccagcacccggtccgcgcccgacccggatccggtgccggcgttcttcgtggcgaccgaggacggcaagggcgggcggacgccggacacggtgaccatccaggtgccggggctgccggccgagggcaccgcgcagtgcgcgtcgtgggccggtgacgggtcgcaccgcacgccgatgatggagcgggccaatcagacgccggccatcgacgccgtgcggatcctcgtccgcgccggaaacggtggcaaccagggcggcgggctagctagctag

SEQ ID NO: 4354 - DNA, 777 bp, Actinoplanes utahensis
gtgcgtctttcccgttcatcgcggcagacgcggggtggcctgctggtctccgccgtgctgtcgatactcgccgccgtgcccgccacgggcgcgccggccgcaccgagcgccatgcacgagagccacccgatcaccgacggccacgggcacgacctggagctgaacggcaccgccgcgctgatcacccggaccggcaccggcaagcggatcatccagctcaccgccggcggctacaagcagatcggctccgcctggtcgaccgggaaggtcgacctggaccggtcgttcagcacgtcgttcaaggccttcctgcaccacaaccggccgggcggggacggcatcgcgttcctcgcccagggccacgggccgcgcgcgctcggcggctggggcggcggcctcggctaccgcggcatccgccgcagcgtggcggtcgagttcgacaccttccagaactccaccgatccgaacagcaaccacctggccgtggtgctcggcggtaatccggaccggcacctcaaggcggtgaccgcgtcgattccgctgtacggcaagccgttccaggcgcggatcacctacggcggcgccgaccaccggctgcgcgtgtacgtgcggggcctgtaccgcaccgccaaggagaaattgatgctggacgagcgggtcgacgtggcgcgcgagaccggtgtccgtgcgggctggctcggcttcaccggcgcgaccggcgaccgggtctcccaccaggacgtctacgactggacggtcgacgcgccgcaggcgtga

SEQ ID NO: 4355 - DNA, 897 bp, Actinoplanes utahensis
atgcccacggtcgaccgtgtgctcccgcccgagaccggcaccgaagagctcgaggagctcgaacagctcgaggaactcgaccagatcgaacagtccgtgaccggtaccgaaccgccggcccggccggcggccgaagccgaacccgagccgctggtcagcgtcgtcgtgccggcgctcaacgaggcccgcaacctgccgcacgtcttcgcccggctgccccgggtcgacgaggtgatcctggtcgacggcggctccaccgacgacacggtggcggtggcccgccggctgcggccggacatccgcgtcgtcacccagaaccgcaagggcaagggcaacgccctggcctgcggcttcgccgcctgcaccggcgacatcatcgtgatgatcgacgcggacgggtcgaccgacccgggcgagattccccgcttcctcgaagcgctgcgggccggcgccgacttcgccaagggctcccggttccgcgccggcggcggcagtgccgacatcacccggttgcgccgggccggcaacaggatgctcagcgtcctggtcaacatgctcttcggcacccgctacagcgacctctgctacggctacaacgcgttctgggcctgtcaccgggacgtcttcgacctggacagcacgtcgccggcgccggccggcgcggacgggcggctctggggcgacggcttcgagatcgagacgctgctcaccctgcgggccgcccgcgcccggctggcgatcgaggaggtctccagcttcgagcacgaccggatccacggggtgagcaacctgaacgcgttcaccgacggcatccgggtactgcgcaccatcgcccgggagtggccgcgcggcctgcgccgcgggtcccggcagccggccgggcgggcggcacgatga

SEQ ID NO: 4356 - DNA, 1935 bp, Actinoplanes utahensis
gtgagcgcggtcaccgcccggcccgcgccggggctcgtcgggtcgcggtccggccgcccgcggtcgccggtcaccgaggcgctctggtgcgcggcctcgctgagcgtggcgggggcggccggcaccgcggcgatcgtgaccgcgtaccaccgggccgaatgggggcgtggcgggcagttcggctggttctgggccgggatgctgctgttcaccctgccggtcggctggtgggccctgcgccgcggcacctcgccgcggctgcggctggccgtgctgatcggctacggggccttcacctacctgccgaaactactgcggcacccgagcggcccgctctaccacgacgagtacgcgcactggggccagagccaccacatcctggccgacggccggctcttcgaggccaacccgatcgtccgggtgatcggcgactacccgggtctgcacgcctgcgtcgccggactggccgcgctcaccgggctgagcgtctggcaggccgccctgttcgtgctgaccaccgcgcacgtgctgctcaccctgggggtggcggtgctcgccgggcaactgcggccggacgcgcggatcgccgcagcggccgccgtcggctacagcctgaacagttcgttcctctacttcgacacccagctcggctacgagtcgctggccatcggcatcctggtctgggcgctggtcgcggcggtccgggcgagccgggccaccaccaccggggcccggctcggctgggccgcctgcaccctgctgctggccctggtgatgaccgccacgcaccacctgaccgcgctctggatgaccgggattctcgggctgttcgcgctggtcaccacggtccagtcggtgcgggtccgggagctgatcacgccggcccgggtggtctgggcgctgacctcgggcaccgcgctgatcgtggcgatctggctgggcatcatcgccccgcgcaccggcagctacctcgacccgtacctgggccgggcgctgacccagatcggcggcctggccggcggcgaggagggcggccgggagctgttcagcaagtcggtgctgccctggtgggagcagaccgcggcgtacatcgccccgggcctggcgaccgtcgccatgctcggcgcgctgctgctgtggtggcgtcgccggcacaccgaggagccggtcacccacgccgggatcaccgcgatgctgctgctcggcggcctgtacttcccggccaccctgctgatcctcaccccggccggggccgagggcgcgcgccggtcctgggcgttcagctatctcggcctggccatcgcggcggcgccggcggcggtggcgctgctcgacctgttcgccggccgggtgctgcgctcgatcgccggtgccctgctcggcacgatcggcgcggtgctgctggtcggcaacaacgcggccgggatgaatccgtcgtaccggttccccgggccgccggtctacggctcggacacccgggccgccaccccggaggtgctggccgcggcacactggctgctggacacccaggggcgcgggatccggctggtcgccgaccgctactccgggctgatcctgggctcgtacggtgagcagcagccggccaccgggtcggcgagcttcccggcgtacgacctgtaccgcgcccgccccgggcagccgatcgaccggcacctgctggcccagctgcgcgactggcatttcgagttcctggtggtcgaccggcggatggccgagcaggtgccggacatcaacatctacttcgagacgaacgagccactgcgccacgacggggtgcctgccttcgaccgggcgcagctcaccaagttcgacacgatgccctggttgatcaaggtctacgacggcccgcacctggcgatctaccgcttcgacttcgacagcctggctcacccgacggcgggacgcccccaatga

SEQ ID NO: 4357 - DNA, 1791 bp, Actinoplanes utahensis
atgggacgacgaggacgacgaggtgggcgtgcccgtgcagcgggtggccggcgaggccggcgaccgcccgggcgcgcggatccccggcacgttgcgcaccgccgcggccatcgtgctgccgatcgcgctgtcgctgctcgtcggcggggtggcgatccgcgcggtggagcggggctcgcacccggccctgcccggctacctgacggtggcgctgggcggctgggcggccgggctcacccacccggtcgcggtgccggcccgcggcctggccgtgccggtccggatcaccagttccgggctgccgaccagcaccgcctggctgcgcctgcgggtgggcgccgcggtcgtggcgacccgccaggtgaccgtgggcagcggcaaggtctacgcgctcagcgtgcgggtgccggcgttgccgccggacggctgcctgcgaccggtcgggatcagcgtgggcgggaccggcacggtcttctacgcccgctccgcgaccaccgtgccggcccggcggcggaccgcgtgctgatcaccgcgacccgccgggtgctggacgactcgctggcccgcaacagcctgctgatcatggcgacctcggtggtcaacggcgggctcggttacctctactggctgctggcggcgcgctcgctggctccggcgcaggtcggcacggccaccgcgctgatctcggcggccaccgcggtcagcatgatcgccaacctgggcgccgggcacatgttcatccaacggctgccgggcagcgccgcgccgctgtggggccggatcgtcggcggcggcctgctggccggcggtgccgccaccgcggccgcggccgccggggccgccgtgctggtgccgatggtcgcggtgaacttcggattcctggcccggccggccggcgcggtcgcgatgatcggcacggcgaccgcgatcaccgccaccacgctgctcgacaacgtgtatgtggcgcaccgggccggccacgggatgttcgtccgcaatctgggccttgccgccggcaaaatcgtcgccctgttgggtctgctggcgctgggcgtgcacgcggccggtgtcgtggtgctctcctggaccctgccgaccatcgtggtcagcgcggcgaccgtgctcgccgggctgccccggctgcggcccggtgcccggctgcggctgaccgggctggccgccgaggtgccgcacctgcgggccgcgctgaccggccaccacctgatcaacctgacccaggcgggcccggccgcgctgctgccggtgctggtcaccgcgcggctcgggccgggcgccaacgcgcacttctacctcgcctggatgaccgcgtcgatgctgttcatggtctccccggcggtcgcctcggcgctgtacgccgaacgcaccaacgccgcccgggtcggcctgcgccgggccgcgctggtggtgctggccatggtcggcgcgccggccgcgctgctgctcgcggccggcggccggatcctggcgatgttcagcgccggatacgccgccgaggggtcgatgctgttgcagatcctggtgctggcggcgctgccggacgcggtgaacaacctggccgtggcgcactggcggtcgctcggcgagttccggctctgccgccggctcaacgcggtccgcgcggtcgcctgcctgtcgctgtcctggctgctgctgcccggcgccggggtgaccggggccgggatcgcctggctgaccggccagaccatgtcggcgctgctggtcggcgcggtcgcggtcgcactctccgcccgccggaaggccctcgcctga

SEQ ID NO: 4358 - DNA, 1236 bp, Actinoplanes utahensis
atgaagatcctgcacctgtccaacctgtaccacccggtgatcggcggcctggagcgcagcatcgcgaccagcagcgccgagctggtccgccgcggtcacgaggtcaccgtgctgacccttgcgacaccggccacccgtcaagatcaagagatgattgacggggtacgggtccgccgcgtccgcagcgtcgccaccaccctgctgcccgggatgaacgcggacgccgccaagccgttccaccccaccgtggccgacccgttcaccaccaccgcgatcgcccgggtgctgcgcgccgaacacttcgacgtggtgcacagccacgactggatgatgtacagctacctgccgctgcgccggacccggatcggccgcccgcacgtgcacaccgcgcacgacttcgggctgacctgcgtgcgcaagaccttcgcccgggccggccggcagtgctccgggccgggtccgatccgctgcgtgaactgtgccggcgcgcagtacggcggaccgcgctcgctggccctgaccgccgggctgcacgcgcaccggcaccgcggcatcgacgtgctcaccgcgatctccacctcggtcgccgccgcgctcggccaggcacggctgcccggtgacctgccggtgcgggtggtctccagcctggtcccggacgggctggacgcgctcgccgaccgcacgccccggccggactggctgccggccggggactacctgctcttcgtcggggcgctcgggccgcacaagggcatcggggtgctgttcgacgcgtaccgccgactgtgttcttcctggtccggcccattgccggcgctcgtctgcctgggcacgccgcggcccgacacgccaccggctccgcccggcacgctgatccggcacgacgtgccgcatgcgcaggtgatggcggccttccggggtgcggcggccggcgtggtgccgtcgttgaacgaggggatgggccaggtcgcggtggaggcgatgctcggcggcgcgccgctggtcgcctcggccgccggcgggctcaccgacgtcgtcgaggacggggtgagcgggctgctggtgccgcccggcgacccggacgcgctgcacgccgcactgcgccgggtgctcaccgaacccggcctcgccgaccggctgcgggcggccggtcggcagcgcgggctggacttcaccgcggcccgcgtcgtcccgcagatcgaggaggtctaccgtgcctgtgtcgcgtcgtcctag

SEQ ID NO: 4359 - DNA, 1167 bp, Actinoplanes utahensis
gtgcctgtgtcgcgtcgtcctagggtcgtggtcgccggttccgggtggcacttcctgtccgggatcagctattacacctgtcgattgagcaacgctatggacgagcggtacgacgtgggcgcgatcctgatgcgccggctgctcccggcccggctctaccccgggcgcgaccgggtcgggcagcggctcagcgacctggcgtacgcgccgggcgtcgaggtcttcgacggcgtcgactggtgggccgcgccgagcctgccccgggccgtcgccttcctgcgcgagcagcggcccgacgtgctggtgctgcagtggtggaccggcgcggtgctgcactcctatctggcgctggcggccgccgcccggcggatggggatccgggtggtgatcgagttccacgaggtgcaggacaccgcggagctgcgccactcctgggcggcccgctacgtccgggcggcgatccgcccgctgctggcccggacgtccggggtgatcgtgcactccgcctacgaccaagatcaactgaaccgggtgtacgacctgggcggcctgccgtccgagatcgccctgcacgggccgttcgatcatcacggcggcacgggacagcgggtgccgggacccgacgggatcgtgcgcctgctctatttcgggacgatccggccgtacaagggcctggaagatcttgtcgccgccttcggcgacctcggagcgaaccatcggctcaccgtggtgggggagacctgggagggctggacgctgccgctggaggcgatcgcggcgtccccggcccgggaccggatcaccgtggtcaaccgctacgtgccggacgccgaggtcgacgaatacttcgcggccgccgacgcggtcgtcctgccgtaccggcgcagctcggccagcggcccgctgcacatcgcgatgagccacgggctgccggtcgtcgtcacctcggtcggcggcctcgtggaagcggccggaccctatccgggcaccgtgttcgtaccgcccggcgacccggccgcgctcgccaccggcatccgggaagccgccggcctgatcgggcggcggcacaccgacccgtcatcgtgggaccggaccgtggacgcctatgaacgcctcttcacccggatcggcatcggccgggacgtcgtcacctcctcgccgtcctga

SEQ ID NO: 4360 - DNA, 1659 bp, Actinoplanes utahensis
atgaaacttgtcggtcgacgtgccgcgattctggcctcttcacttctcctttccgtcttcgcacagcacggggtggcctccgcggccaccaagccggcgccggcgaaggcgaccgtcaagaccggggcggcaccggtgaagacgcctgccgccaagcccggggcggcgccggtgaagacgcccgccgccaagcccgcgccgaccccggcgaagccgggcccgggcggcaacgcgggtgcgggcgcacccgccggtgccaccgcggcaccggcgaaggcgacggtcaaggggacgccgacgctggcgagccggctggacgcggtgcgcaccgcgaagacgatcaactactacccgtcgaacgccgggtggtcggcgatgtggacccggttcgacgcggcgcggatcgaggcggatctgaccaaggcggccgcactgggcgccgacgacgtgcgggtcatcgtcttcccgagcacgttcggctatccgacgccgaaggcggactacaccgccaggctcaacaagctgatcagcatcgccgacgggcacgggctcaccgtcaagctgaccctgttcgactggtgggagggctacaccgacacggccggcagcgccgcgtgggccagggccgtcctcgccccgtacgcgaacgacccgcgggtcctgtcggtcgaggtgcagaacgagttcgacccgtccgacgcgcgcgccgtcacctgggtcaagaagatcattccgagcatccgggcggcggtgccgacgatgccgctgaccctgtcggtgtccggcgccaccgggtcgaacggtctgtcgcagatccgggcgacgctggccgcgaccccgctcgactacctggacttccacttctacggcaactcggagcggtcgctggccgagatccgcacggcgcaggccgcggcggccccgctgccgatcgtgatcggcgagaccgggctgagcacggtgtccggcaccgagggtgagcaggccgcctacctggcgcgggtgttcgcggcggcccgggtcgccggggtgggttcggtggcgccgtggacgctcaccgacttctccgacggtgccatcccgacgaattcggccgtgtcgaagatcccggcgcagtacaagtacggcctgtaccgggcggacggctcggcgaaggcggcggcggccgtggtgaaggcgtactgggccggtcaacctctgacgaacagcgtgctggacctgggtttcgaggcgccggccggcaattcgccgtggcggccgtacctgtccgatgccggccccgcggtgcgggtgaacggggtcgcgcattcggggtccggttcggtgaagttcaccggcacctcccacaccgatgacggcctgccggcgatccggaccgccccggtcaccccggtccagccgggcctgcggtggcacgccgaggcgtgggccaagggacagaacctgaccggtaccacccagatcgcgctgagctggttcgacgccaacgaccggtggctgggtcagacgtcgtcgagggcgttgccgaccggcacgaccggctggacgaagctgaccgtggacgcgaccgccccggcgggggcggccggcgtgcagctccacctgaagtcggggaacaaccggggcaccgcctggttcgacgacgtgacgatgtcctga

SEQ ID NO: 4361 - DNA, 1911 bp, Actinoplanes utahensis
ttgttcgccgacggccgggatccggcggcgggattggtgtggctcgccgacggccgaggtccggaggcgggatcggtgtggtggacggcgccggagggcggggccgggacgggaagcggcaaggtggggactgtgacggacggtgtggttcgtgggcggctttacggggtcgggctggggcccggcgaccccgaactggtcaccgtcaaggcggcccggctgatcgagaaggccgacgtgatcgcctatcacgcggcccggcacgggcgcagcaacgctcgggcgatcgccgccgggtatctgcgggacgggcagatcgaggaggcgctgatctacccggtgaccaccgggaccactgatcatccggggggatatcagggggcgatcgacgagttctacgagcaggcggcggggcggctggcggctcatctggacgccgggcgcgacgtggtggtcctggccgagggcgatccgttcttctacgggtcgtacatgcacatgcacaagcggctcgcgcaccggtacgagacggtcgtggtccccggggtgacctcggtgagcgcggcgtccgcggtgctcggccggcccctgatggaacgcgacgaggtgctcaccgtgctgcccggcacactgcccccggccgaactcgcccggcgcctggcggccaccgactcggccgccgtgatgaagctcggacggaccttcgacggggtgcgctcggcgctggccgaggccggccggctggacgatgccttctacgtcgaacgggccaccatggccgcggaacgggtcggccgcctgtccgacatcgatccggacacggtgccctacttctcgctcgccctcctgcccagccccgccgccaccgccttcgccgaagccaacggctcgctcgccgccggcggcacggcgagcgctcccgcggaccgggcggaggcatccgggctcgacgcgaagccggatgcctccggcgtgggcgcggacgcccgcggtgcggacgctcatggcgtgggcgtgggcgtgggcgtgggcgtgggcgtgggcgtgggcgcggacgcccgcggtgcggacgctcatggcgtgggcgcccgcggcatggacgcggcggcagccgttggttccggtggcggcgggggtgccggggcggggcgggtgaccgtggtcgggctcggcccgggggcggccgagtggctgaccccggaggcccgggcggcgctggcggaggcggacgatctggtgggatacacgacctacatcgatcgggtgccggtcgacgcgcggcagcggcggcacgcctcggacaaccgggtggaggccgagcgggccgcgttcgcgctggatctggccaagcggggacggcgggtggcggtggtgtcgtccggggatcccggggtgttcgcgatggccgccgcggtgctggaggtggccgaggacccgcagtggaaggacgtcacggtgcgggtcgtgccggggctcaccgcggcgcaggcggtggcgagccgggcgggggcgccgctcggtcacgacttctgcgtcatgtcgctgtccgatcggctcaagccctggtcggtgatcgagtcccggctggccggggcggcggcggccgacctggtcatcgcgatctacaacccggcttcgcagtcgcgcaaggagcagctggtccgggcacgggaactgctgctggaacaccgtgcgccgagcaccccggtggtggtgggccgggacgtcggcgggccggccgagtcggtgcgggtcaccacgctcggcgctctggacccggcgagcatcgacatgcgctgcctgctgatcgtgggctcctcccagacccgggcggtggccaccgggaacggcgatccggtcgtctacaccccgcggcactacccgaccgagggtggcacggcgatcccatag

SEQ ID NO: 4362 - DNA, 618 bp, Actinoplanes utahensis
atggactacgaacgcgacggcgcggagatctaccggcggtcgttcgcgaccatccgggccgaggcggacctgagcgggctgcccgaggatgtggcgcgcgtggtggttcggatgatccacgcctgcgggatggtcgacctggtgccggacgtgcggtacagcccgggggtggcggccgcggcccgcaaggcgctgctcggcggggcgccgatcctctgcgacgccgagatggtggcgtccggggtgacccggcggcgcctgcccgctgccaatgacgtgatctgcacgctccgcgatcccgccgtgcccgggatcgccgcgcggatcggcaacacgcgcagcgccgccgccctcgacctctggggcgaccgcctcgacggcgcggtggtcgcgatcggcaacgcgccgaccgccctgttccgcctgttggagatgatcgaggcgggcgcgccgcggccggcggccgtgctgggcatcccggtcggtttcatcggcgcggccgagtccaaggacgcgctcgccgagtccgggctggagtatctgatcgttcgcggccggcgcggcggcagcgcgatgaccgccgccgccgtcaacgctctcgcctcggaggcggagtag

SEQ ID NO: 4363 - DNA, 1956 bp, Actinoplanes utahensis
gtgcagcgaccgcagattgtcggcgccgccctgcgccagataggtgtgcgcgtccgcggcgatgccggccgggaccgacgacagcttcatcagatcggcgtccggcgccatctcgccgcccagcaccaccaccggcagatccccgccgagcagctcgtcgaggccctcctcccaggcccggcggccgcccaggatgcggaccacgaccagctccaccccgtccagcagggccggcagatcggccaccccggtgcgggccggattgcccagccgccatgccgagccgctggcccgggcgctgagcaggtccgtgtcggacgtcgacagcagcagaaacacgcgtgcgctcccctcggggtccgcgccccgggtagtaagaatcacggcgaccggagttcctggctcccgggcagctcacccggtgacagtggcgggaccgcgccggactcgcaccggcttcctccgcggcagtgccgctcgaattcacttgtcgtcgcacacgctaccgaacgttgtgacgccgctgacgattcagggggctgccgacccgaggctccggtcctgtcgggggccgcccgtagtatccgggccgtgagtcgccttcgacagtccgacaccgacgcctgccccggcgcgctgcggttgcacgccgccgccgacgggctgctggcgcgggtccggctgcccggcggcatgctcaccggcgcccagctgggctgcctgcgcgagctggccgaggagttcggcgaccggcgcctggagctcacctcccgagcgaacctgcagctcagagcactcccgcaagaccgggtggagacggtggcggcccgcctgcgcgccgccgggctgctgccatcggcaacccacgacgcggtacgcaacatcgccgccccgccgatggcgagcgacaccgtgcgggacctggtccggcgcctcgacgcggcgatctgcgccgatcccgggctggccgcgctgcccggcaagttcctgttcgctctcgggccggtcccgctcgcggccgacgtcaccgccgtcccgctcgccggctccccggccggcgaccggttcgccctgacgttcggggggcgcgacaccgggctgcgcgtgacccacgactcggtgatcgaggctctgctggcgagcgcgcacgcgttcctggccgagcgggaggcgcagcgcggcggcggcgcggccgcgtggcggttgcgcgagctgaccgacggcgcggcccgggtctccgcgcgtgtcgccgcggcgctcggtctcgccacggccgaggttcccgccgggccggcccccggtggaggcggtccggctgcgaccgacccgctggccggcgtgacgaccggacacgagcaggacgccgctggcgcgctggtcggcgtggtgaccggaaacgagcaggacgccgctggcgcgctggtcggtgtggtgaccggaaacgggcagttcgccgcgggtgcgctggtgccgttgggtcggctcgaaagccggcagtcgaggctcctggcggaggccgagcgcctggttgtcacgccgtggcgcggtgtgctggtccccggcctcactccggaggacgccgcggcctgggccgggcggatggcggcgaccggcctggtggtgaccccgacctcccgctggaccggggtcaccgcgtgcgccggccgccccggctgcgcgaagtcccgggccgacatccgcgccgacgccgaggtcgcgaccggcttcgccgacggcctgccggtccactgggccggctgcgagcgtgcctgcggcagcccggccggcccgcacgtccgggtggaggcgaccgcggcgagcccggctgcgcccggttcgctcggcgccggtggggcgggatacacggtgacgcgacgggcggatccggagacggtggtcgaggtcatgccggcgggagcgctgggtgacgtggtggcggcggcgaggagaggctga

SEQ ID NO: 4364 - DNA, 3540 bp, Actinoplanes utahensis
gtgtttctgctgctgtcgacgtccgacacggacctgctcagcgcccgggccagcggctcggcatggcggctgggcaatccggcccgcaccggggtggccgatctgccggccctgctggacggggtggagctggtcgtggtccgcatcctgggcggccgccgggcctgggaggagggcctcgacgagctgctcggcggggatctgccggtggtggtgctgggcggcgagatggcgccggacgccgatctgatgaagctgtcgtcggtcccggccggcatcgccgcggacgcgcacacctatctggcgcagggcggcgccgacaatctgcggtcgctgcacgacttcctgtccgacacggtgctgctgaccggcaacggcttcgccccggcggtggagagcccgcagtgggggatcctgccgcgagcagcagagggatcagggtcggacggcccgacgatcgcggtcctctactaccgcgcgcaccacatggccggcaacaccgcgttcgtcgatgcgctctgccgggcgatcgaggcgaagggcgcccgcccgctgccgatcttcacggcctcgctgcgcaccgcccccgacgacctgctggccgagctgcgcaaggcggacgccctggtggtgacggtgctggcggccggtggcacccgaccggcgacggcgagcgccggcggtgacgacgaggcctgggacgtcggcgtgctggccgagctggacgtgccgatcctgcagggcctctgcctgaccagttcccgcgccacctgggaggccagcgacgacggcctgagcccgctggacgcggcgacgcaggtggcgattccggagttcgacggccggatcatcacggtcccgttctcgttcaaggagatcgatcaggacgggctctcggtgtacgtcgcggaccccgagcgggcgtctcgggtggccggcatcgcggtgtcgcacgcccgcctgcggcacatcccgccggccgagcgcaaggtcgcgctgatgctgtcggcctatccgacgaagcactcgcggatcggcaacgcggtcggcctggacacgcccgcctcgaccgtggcgctgctggcggcgctgaaggacaacggctacaagatcggcgatttctcggcgtacgacggtgacgggctgatccacacgctcatcgcggcgggtggccaggatccggactggctcaccgaggagcagctggccggcaacccggtgcggatctccggcgcccgctatcaggcctggttcgacaccctgcccgaggatttccgggcgagcgtgacccggcactggggtccaccgcccggcgagctgtacaccgacaacggcgacatcgtgctcgccgccctgcgcgacgagaacatcgtggtgatggtccagccgccgcgcggtttcggggccaacccggtcgccatctaccacgacccggacctgccgcccagccaccactatctggccgcctaccgctggctggccgacgagttcggcgcgcacgcggtggtgcacgtcggcaagcacggcaacctggagtggctgcccggcaagaacgtcggcatgtccgcatcggacggcaccgacgcggcgctcggtgacctgccgctgatctatcccttcctggtcaacgaccccggggagggcacccaggcgaagcgccgcgcgcacgccaccctggtcgatcacctgattccgccgatggcccgggccgagtcgtacggcgacatcgcccgcctggagcagctgctggacgagcacgcgaacatcgccgcgctcgacccggccaagctgccggccatccgggcgcagatctggacgctgatccaggccgccaagatggatcacgacctcggtcaggcgcaccggccggacgacgaagagttcgacgacttcatcatgcacatcgacggatggctgtgtgaggtcaaggacgtgcagatccgcgacggcctgcacgtgctgggcgccgcgccgcagggcgaggcccggatcaacctggtcctggcgatgctgcgggcccgccagatgtgggccggccaggtcgccgcgctgcccggtctgcgcgaggcgctcggcctcgccgaggacgccccgatcgcgcgcgtcgacgagatcgaggccgaagccaggcgcctggtcaccgcgatggaggacgggggctggccggccgatgtatcggcgatctcggatgttccgcaagtgcgggacgtgctgcggttcgcggcgaccgaggtggtgccgcggctgagccgcaccaccgacgagctgaccaacgtgctgcacgcgctgaacggcggctacgtcccggccggtccgagcggctccccgctgcgcggcctgatcaacgtgctgcccaccggccgtaacttctactcggtcgacccgaaggcgatccccagcgcgctggcctgggagaccggccaggcgatggccgactcgctgctggcccgctaccgggccgactacggcgactggccgaaatcggtcggcctgtccgcgtggggtaccagcgcgatgcgcaccgccggcgacgacatcgccgaggtgttcgccctcatcggcgtacgcccgatctgggatcccgcctcgcgccgggtgaccggcctggagccgatcgcgcgcgaggagctgggtcggccccggatcgacgtcacggtccgcatctccggcttcttccgggacgccttcccgcacgtggtggcgatgctcgacgacgccttccggatgatcgccgagctggacgagccggacaaccacgtccgcgagcacgcgctgcgtgaccgggccgagcacggcgactggcggcgggccacgatgcggatcttcgggtcccgcccgggggcgtacggcgccggcatcctgccgctgctggacagccggaactggcgggacgacgcggacctggccgaggtgtacgcggtgtggggcggcttcgcctacgggcgggacctggacggggtgccggcccgcggcgacatggagaacgcgtaccgccggatcgatgtcgccgccaagaacatcgacacccgcgagcacgacatcgccgactcggacgactacttccagtaccacggcggcatgatcgccacggtgcgggcgctgaccggccgggcgcccgccgcgtacatcggcgattccaccaacccggacgccgcgcggacccgcagcctgaccgaggagaccgcgcggatcttccgcgcccgggtggtgaacccccgctggatcgccgcgatgcgccggcacggctacaagggcgccttcgagctggccgccaccgtcgactatctcttcgggtacgacgcgaccgccggcgtggtgaccgactggatgtacgagcagctggccacgacgtacgcgctggacgccgagaaccaggagttcatgcgccagtcgaacccgtgggcgctgcacggcatcaccgagcgcctgctggaggcggccgagcgcaagctctgggactccccgtcgccggacaccctgaccgcgctccagcagctctacctcgagaccgagggcgacctggaggacgggccggcctaa

SEQ ID NO: 4365 - DNA, 369 bp, Actinoplanes utahensis
gtgccgagcgtcgtcctggagctggtgcacctgcgggccagccagatcaacgggtgcggcccgtgcgtcgactcgggcgcacgtggcctgcgcaagaacggtgagaccgacgaccggctgttcgcggtcgccgtgtggcgcgagacgccgtacttcaccgagccggaacgggccgcgctcgccctggccgaatacgccacccggctggccgacaacccggacccggtgccggacgcgatctgggacgaggccgcgaagcacttcaccgaggagcagctggcggcgatcgtgctgtggatcgccaccaccaacttcttcaaccggatcaacgtgaccacccggcagcaggccccgacgaactggggttag

SEQ ID NO: 4366 - DNA, 708 bp, Actinoplanes utahensis
gtgcaccagctccaggacgacgctcggcacgtgccggcctggctgaccaccgtgaccggccgggtctgcctggacatgctgcgcgcccgcggctcccgccgggaggagccgccggtcgccgagtcacccggggccgaggatccggaacgggacgcggtgctggccgactcggtcggtgcggccctgcacgtcgtcctggagatgctcaccccggcggaacgtctcgccttcgtgctgcacgacctgttcgcggtgtcgttcgacgagatcgcggtggtcgtcggccgcagcccggccgccgcgcggcaactggccagccgggcccggcgccgggtgcacggtggatccccggccggcatggccgatttcgcccggcagcgcaggatcgtggacgcgttcctggcggcggcccgcggcggcgacttcgccggactgctcagcctgctcgacccggacgtcatgctgcgcatggacgactccggggcgcgcctcggcgagggcaccaccgcggagcaggcggcccggttcttctgcgggcgtgcgcacggcgcgatcccggcgaccatcgacggggcggccggggcgttcgtgcggacaccgttcggggcgcggatcgcgctgtccttcacggtggccggcgaccggatcatcgcgatcgacgcgatcatggacccggacgacgcaatcaccatcgagctgctgacctga

SEQ ID NO: 4367 - DNA, 774 bp, Actinoplanes utahensis
gtgcggcagactcagggcgtgcggaagatctacgtgatcgggatcggcgcgggcgacccggaccatctgaccctgcaggcggccaaggcgatcggccggacgaatgtgttcttcctgctcgacaagggtgaggccaagcagagcctgatcgacctgcgggagcggatcatccgggcgtactcgcatccgcacaagcggatcgtcgagggccgcgacccggaccgggaccgcaccccggccgactacaccggcacgatcgccgactggcgctcccgccgctcccaggtgatcgaggagctgatcgccgagcacctcaaggatgaggagaccgggtcgttcctggtctggggcgatccggcgctctacgactcgacgatcgcgatcctggacgagatcctggcccgcggcgcggtcaccttcgagtacgcggtgatccccgggatcagcagcgtctccgcgctggccgccaaacaccgggtcgggctgaaccgggtgggccagccgttccaggtgacgaccgggcggcggctggcagagggctggccggcgggcgccgacgacgtggtggtgatgctggacgcgcagcaggcgttcaccgcgtacccggaggccgagatcttctggggcgcctatgtcggcaccgaggacgagctgctggcctccggccgggtcgcggacgtcggcgacgagatcgtcgcgacccgcgcggaggcccgcgagcggcacggctggatcatggacacctacctgctgcgccgccgcgccggggactga

SEQ ID NO: 4368 - DNA, 1269 bp, Actinoplanes utahensis
atgtctgacccgttcggcggcttcgtgacagcggtcgcggccgccgccaagcccgacttcgacgatgtgatcgcccggtccacccgatatcgccgccgcggccgcagccggtggttcgccgcgatcgccgccacgattctgaccgccggtggcgggacggccctgggggtcgccgccggccgcggcaccccggatccctcgcccaccgccggggttgcgccgtggcgcaccaccgttgcgcgcaacgcgccgggtcccctcgcaccgcgcgagtatcggcagacccgtccggacttctgggtgcccgtcggctccggcgacaccctgaccggactccagacgcagatgcgggcgggcgacgtcgatcacctgtacctgcaatatcagaagtgcggcggcgacgggtgccaccagatgctggcgtccaccaccgatcgcggaaagacctggcacaagtttccgctgccggcaccgatcagcgcgatatacaagcaggcggaggtcacggacacgatcggtggcatggtggtggcgctgtccgcgccccgggtcgtgaccgcccagcgcctgccggtcatctgggccagcccggatgccggtgcgacctggcatcggaccagggtcgacacgggcgccaccgtgcccttcggctggcgggtccagccgaccgaggccggattggtcgccatcgacccggcaaccggggacggcaccatgtacctctcgtcgcaggcccgcttctcctcgacgatggtgatgtcgccccaggccgggatctggtggatggacgccgggaaggacgccctggacgccgaggtcagcagggatggcggacgaagctggtaccgatatccgctgccgctgccccgcggggcggggctctccaccatctggtgtcagatctgcaccggcgacggccggctcgtctacgtgacgcgcatgcacgagggtctgctgcatctgtgggccagtgtcgacggcgccgtcacctgggaggatcgggcgaccctggatgccgacggtccggtggtctccgtgctgccggtcgacgaccgcaccgtgatcctgcagggtgccggcggctcgttccgcagcaccgaccagggacggacgttcgtccgggtcgggccacggctcggccacgacgcgtaccggctgggcggcggtggcttcatgatcgcgaccgacagcgactccgacgagttcagcgcctgggtctccgccgacggcgccgactggaccttcgtacaccggccggaggttccctga

SEQ ID NO: 4369 - DNA, 549 bp, Actinoplanes utahensis
atgggtgagcatctaccccgccccttcccggcaggagcgcccgcagtggaccccgacatcgaccttcgcgagctgtacgccgcgtccgccggccggttggtggcccagctgtacggcatcaccggcgacttcgccgaggcccaggacgtggtgcaggaggcgttcgcccgggcggtggcccgtcccggcggcgtcctgcaggcgacgaacccggaggcctggatgtttcgggtcgcggcgaacctggcccgctcccgccaccgccgccgtcagctgttcgaccgggtggtgcggaccggccggctgcgcgccgccgaccccgccccggccatctcaccggaccacgtcgcgctggtcgccgcgctgcaacggctgccccgggccacccgggagaccgtggtgctgcaccacatcgcggatctgccggtggccgaggtggccacgatgctcggcatcagcgtcgagagcgtcaaagtccgactgttccgcgggcgccgcgcgctcgccgagttcctccgcgacacggacctggagaacacccatgtctga

SEQ ID NO: 4370 - DNA, 204 bp, Actinoplanes utahensis
atggctaccggtaccgtgaagtggttcaacagtgacaagggtttcggcttcatcgcgcaggacggtggcggccccgacgtcttcgcccacttctccgcgatcgcgtcgagcggcttccgcagcctcgacgagaaccagaaggtggagttcgacatcacccagggtcagaagggcccgcaggcggagaacatccgcccgatctga

SEQ ID NO: 4371 - DNA, 1176 bp, Actinoplanes utahensis
gtgatcctgcatgccgacctggactcgttctacgcgtcggtcgagcagcgcgacgatcccgcgctgcgcgaccggcccgtcctggtcggcggcggcgtggtgctggccgcgtcctacgaggcgaaagcgtgcggcgtccgcaccccgatgagcctgtcccgggcgcgggccctgtgcccgcaggcaatcgtcgtgccgccccgcatgacggcctatgcggcggccagcaaggcggtgttcgcggtgttccgggacaccacgccgatcgtcgagccgatctccatcgacgaggcgttcctcggcgtcgacgggctgcggcggatcagcggcacggccgaggagatcgcccggcggctgcgcgccgacgtgcgcgcccgcgtcggcctgccgatcacggtcggtgtcgccggcaccaaattcctggccaaggtcgccagcggggccggcaaaccggacgggctgctggtcgtgccgcccggcggcgagctggccttcctgcacccgctcccggtcgagaaactctggggcgtcggaccgaaaaccgccgaccggctccgcgaacggcagatccgcacggtcggcgacgtcgcccgggtcggcgaggccgcgctgatcgcgatgctcggcggcaacaccgggcggcacctgcacgcgctcgcccacaaccacgacccgcgccgggtcggcagcgggggccggcgcggctcgatcggggcgcagtgcgcgctcggccgtggccgtcgcgccccggaggatgtggaggcggtgctggccgccctggtcgaccgggtcacccaccggatgcgcggcgcccaccgggccgggcggacggtcacgctgcgcctgcggttcgacgatttccagcgggtcacccgctcccgcagcctgctcaaggcgaccctgcagaccggcgcggtgctgcggctcgcgaccgacctgctgcgcgaggcccggccgctgatcgaccagcgcgggctgaccctgatcggggtcgcggtgagcaatctggacggcgagggtggcgtccagctggagctgccgttcgaggccccgcggcaggacgggctggacgccgcggtcgaccgggtgcgcgaccggttcggcgcgtccgccctgcgccgcgccgacatgctgggccgcgagatgaacccgtcggtcccgatcctgcccgactga

SEQ ID NO: 4372 - DNA, 519 bp, Actinoplanes utahensis
gtgtgttcgaatcgggggaggggttgcgctgatcacatcgggggcgggaatcgcgtaccggcaatcccggttcgaaaggttgagtcacttacgctcaagctgatggagaacgaggagcccaccatgttgctcaccaccccgaccgtgcgcgacctcgagcgtctcaccgcccgggtcacctcgacccgcgccaccggcgcccggctcgacgcgtaccgcgaggacgacaccttccacatcgacatcgacctgcccggcgtcgaccccgcctcgatcgacatcaccgtcgacggccgggtgctgaccgtccgtgccgagcgcggacgcgccgagcgcgagggcgtccgttacctgatcgccgagcgcccggtgggcccggtcagccgccaggtccacctctccgagaagctggacaccgaccggctcgaggcgcggcacgacaacggcgtgctcaccctcagcatcccggtcctcgaggagcgcaagccccgccggatcgaggtcgccgtcgcgggctag

SEQ ID NO: 4373 - DNA, 663 bp, Actinoplanes utahensis
atgggaacggctgtctacccttgccgggtggatcagcgcactccgaccgtctaccggacccgttcctggacgaaccgtaaccgggcattgatcggcctgggtggtctcgccctgctgctgctcggctacggcatcggccgctggcaggacacgccgtccgccccggccgcggtcccggccgcgctgaccgcatccgccacggccgcggcctcctcggccccggtcgacacgccggcgccgagttcgccggcgcccaccccggtggagtacggcctgctgcaggccgagtcggccagtgagctggccggcattcaggcgcaggacacccaggacgagagcggcgggcagaacgtcggctggatcaaccggggcgaccatctgcgcttcgacaagtacgacttcggcgaggtgccggccaccaaggcgaagatccgggtggcctccgccgccggggtgtccggccgggtgcagatccggctggacggcctcggcaacgccccggtcggcgagctctcggtgagcaacaccggcgggtggcagacctggcgcaccgacgtggcggcgctgcgcccggtgaccggcacgcacacgatctacctcacgttcacggccccggacgacagcgagttcatgaacgtgaactggatccagttcgagcactag

SEQ ID NO: 4374 - DNA, 873 bp, Actinoplanes utahensis
atgctgatcagtttcgggttgccggtgtccggggcgtgggccgaggcggagacgctgacgacggtggcgcggcgggccgaggagctcggctaccacgggctgtggacgttccagcggctgctcgtcggcgaggagcaggagctggctccggtctatcagagcgtgctcgatccgatcgtcgcgctgagctgggccggcgcggtcacctcgcggatccggctgggggtctcggtgatcaacctgccgtacgtgtcaccggcgctgctggccaagcaggcgggcaccctggaccggctcaccggcggacggctcgacctggggctgggcaccggctggtcggagccggagttcacggcgaccggctcggacccgacaccgcgcgggcggcgcaccgaggagtatctggcggcgctgcgcacgctgttcgccgaggggacggcgagcttcgagggcgagttctaccgggtgccgccgagccggatgcggccccgcccggtccaggccggtggcccgccgatcctgctcggcggcggcgcggacgtggcactgcggcgggccggccggctcgcggcggggtgggtgagcagcagccgggccagcctggccgacatcgagcgcggggcgaaactggtccgggccggggcggccggtgcgggccggagtgctgacgacgtacgcatcatcgtccgtgccgttgcgccggaaggcgcttcctacccggagatccgggcaagcgtgcggcggttcgcggaggccggcgccacggagatcttccatgagcccaactgggatccgcggatcggcgggccggacgcggacccggtgcgcgcggccgagctgggcctggagatgctggaggaactcgcgccgtga

SEQ ID NO: 4375 - DNA, 2721 bp, Actinoplanes utahensis
atgactctcaacaacggggaaggcccggtggacatccgccgctgggtccacgtctgcatcgccgtcgctgcggtcctggccgtgctcgcggtgctggtcggcacggaggccggtggccggcaactggccgccgacgtctccacctgggcgctggcgatcctgccgatggtggccgccggcacctgcgtgtggcgcagccggctgttcaccggccgggcccgctggggctgggcggtgctcggcgccggcgtgttcagctggggcgcgggcgcgagttacacggtggccgagttctttccgcacggcggtgacccgcagatcccgtcctgggccgacctgggcttcaccggcctgatgctgctggtcccgctcggcctgttgatcctgccgagcggcgcgcagccgctggcgaaccgggcccgcagcgtcctcgacggtctgctggtcgcctcgtccctggtgctggtcggctgggtgttcgtggtcgacccccggctgggccacggcactgccgggaccgacctctacctcaccctgagctacccgctcggcgacatcgtgatggccaccatcatcggctacatgctgccgcagcgacgggcgctctaccgctgctcggccgacctgaccttcttcgggctcggcgtgatcggcttcgcgatctccgacatcggctacgcctaccagcggatgatccacgactaccaggccggcgcgctgatcgacatggggtggatcgccgggttctgcctgatcatcgtgggcgccgcccgaccgaaggacgccgagccgctcaagagcgagttcagcgcccgggcgcaggccaccggcgtgatgttcccgtatgcggcggtcaccgcggcactgttcgccagcgcgctgttccacctggtcagcgggcacagcagcccgttcgtgacgtggacccgctcgctgctgatcctgctgctgatcggccgtcaggtgctgaccctgctggagaaccggaacctgacccgcaccctggaggcccgggtcgacgagcgcaccgccgagctgtacgcccgggagcagcggttccacgcgctggtccggcacagctcggacgtggtcacggtgatcgacgcggacggccgggtgaccttccagagcgagtcgatgctgcgcgtcttcgggtacggcccggagctgttcgtcggccggcgctacaccgacctggtcgacgccgaggtggcgatgcggctggcccaggccatgcggcaggtcgcggtccggccgtacgccacggccaccctcgaagtcgtgcacacccaccgggacggccgcaagtgcccgtccgaggtgatcatcacgaacctggtcgacgacccgcacgtgggcggcttcgtgctgaacacccgggacatcagcgagcgcaaggagctgcaggagcagctggtgcacgaggcataccacgacccgctgacccagctcgccaaccgcgtgctgttccacgaccgggcgcaggccgcgctggcccgcaccaccgacctgaccgtgctgcacctcgacctggacggcttcaagcggatcaacgacagcctcggccacctggccggcgaccagctgctggtgcagatcgccgaccgggtccaggcctgcgtgcgggccgaggacctggtcgcccggttcggcgccgacgagttcgcggtgctgatcgaggcggccaccggcgacgaggccgagttcgtggcccggcgcatcctggacgacctggagctgccggtcgaggtcggcgcccggcggatccacgtgcgggcgagcatcggcctggccgccgcggccctgctggagccgaacgagccggacggggccgagcagctgctgcgcaacgccgacctggccatgcaccacgccaaggcggccggcggcagcatcttcaccagcttccacccgcggatgcgcgagggcctggtggagcggctcgagctggagaacgacctgcgcgccgcgctggagaaccacgaactgcgcctgcactaccagcccaccatcgacctggagaccagcgcggtggtcggtttcgaggcgctggtccgctggccgcacccgacccgcggcatgatcaacccgctggacttcatcccgatcgccgaggccaccggcctgatcgtgccgctcggccgctgggtgctgcacgaggcctgccggcaggcggtcgagtggagcgaggcggccgacgggcggccgctgaagatgtcggtgaacgtctcggtccgccagttcgaccagcaggacttcgccgagacggtgtcggcggtgctggccgagaccggcatgccggccgaccggctgtgcctggagatgaccgagtcggtgctgatgaccgacaccgaggccaacctggagcagttggtccggctcaaggcgctgggcctcaccctggccatcgacgacttcggcaccggctactcgtcgctggcctacctgcgccgcttcccggtggacaccctcaagatcgaccggtcgttcgtcgagcgcctcggcgtcctcgccggcgacaccgcgctcaccgacaccatcgtccggctcggcaagagcctgggcatggccacggtggccgagggcatcgaggagttcggccagctcgccgcgctccgggagatgggctgcggtttcgcccagggttactacttctcccggcccgtgccggccgtcgaggccgggcggctcttcctggagggcgctgacgcgccgctctga

SEQ ID NO: 4376 - DNA, 645 bp, Actinoplanes utahensis
atgccgatcaccgtgctcctcgtcgacgaccagcatctggtccgcgccggcttccgcagcctgctgcggcgcggccgggacatcgaggtggtcggcgaggcgtcgaccggcgacgaggcggtgcgggccgcccgggacctgcgcccggacgtgatcctgatggacatccggatgcccggaatggacggcatcgccgccaccaggacgatcctggcggcggagagcaccaccagggtcatcatcctgaccaccttcgagaccgacgagtacgtcttcgccgccctcgccgcgggtgccagcggcttcctcaccaaggaggtcgacccggacggcctgcgcaccgccgtccgggtggtcgcggccggcgacgcgctgctctccccgagcgtcacgcgccgcgtcgtcggccaattcacacaatatgccgacaagacgccggagcgggatcggctgaccgtgctcaccgaccgcgaacgtgaggtcgtcgccctggtcgccaccggcctgtccaacgacgagatcgccgcccgcctggtgatcagcccgctgaccgcgaagacccacatcacccgggcgatcaccaagctcggcgtgcgtgaccgcgtccagctggtgatcatcgcgtaccaggacggcctggtctga

SEQ ID NO: 4377 - DNA, 1116 bp, Actinoplanes utahensis
atgcgggtgacagcggccggacgacgcggtggaccggccgccgcccctagcgtcctgaccatgaacttcgtctatctcggcgccgccgcgacgctggtcggcgtgccggccggcctcgccatgaccgacggcaacaaacagagtgtgatgaccgtctcactagccgtcctgctggccctgctggtcctggcggcccgccgcctgccccgcaccacgctggtcgtctcggtactgaccgtcaccgccttccactcggccgcgctgaccacggccggctgggtgtggccggccaccgcggcgctggtgctgaccgtgctggccggtcgcccgcgtaccgccgtggtcgtggcctcggtcctgctgtcgttcggcgccggctgggactgggcggtcacccgccacggctccggctgggtcttcgcgcaggtcggcggcgagatgctgtggaccggggcggtgatcgccgcggcgctcgcctggcgcaactcggtccgctggcgggagctggagatcagccggcggcgggtcgaggagcgcgtggagatcgcccgcgacctgcacgacgtcgtctcgcacacgctcgccgtggtcggcgtgcacctgaacgtggcgctggacgccttcgacgaggacccggaggaggcgcgcgcctcgctgcggctcgcccaggaggtccgcggccgggcgatgaacgacctgaagtcgctggtcggcgtgctgcgtgcgggcgccctgccgagcctggccgggctggagccgctggccgagcaggtgcgcgcggccgggctgcgggtgtcgctgaccgaggtcggcgacccggtggaggtgccggcgccggtggccggggcggtctaccgggtggtgcaggaggcgctgaccaacaccgtccggcacgccggcgccaccaccgcgacggtgacgatccggtacgcgccggacggtgtgctggtcgacgtgcgcgacgacgggacgcccggcgggccgatcaccgacgggcacgggatcgccgggatgcgggagcgggtcgcggcgctcggcggggcgctgaccgccggacccgcggacggcggtttcgcggtccgtgccaccctgccgtgcaccgagccgaaggactga

SEQ ID NO: 4378 - DNA, 522 bp, Actinoplanes utahensis
gtgaccgccgcggaactgctcgccgcctcgggacgcttcccgatcgcccccggcctgaccgatcgtgagttcaccgacctggaagccgagttcggtttcaccttcgcgcccgaccaccgcgcgttcctcgcggccggcctgcccaccggcatcggctggcccgactggcgcggcgccgaccggaccgcgctgcgctcggcgctgatcgcgccggtcgagggcgtcctgttcgacgtggccgagaatgatttctggtacgaggggtggggcgccccgttcggcgaccgcgtcgccaccgcccgcgccggcctgatgatcgcgccccggatgatccccctctacgcccaccgctacctgccggcggcgatccccgggcatccggtgctgtcgatctaccagaccgacgtgctgtgttacggcgccgacatcggcgactggctgcaccgcgagttcggtctcggccggccggccgaccggcgggtgcgccccaccgtcccgttctggagcgccctggtctcctga

SEQ ID NO: 4379 - DNA, 2103 bp, Actinoplanes utahensis
gtggaccgagggtggggagaaggccgggctggacgcgctggtcggccggttcaccgcggactgcccgggccagcggttccgcaacggtgcggtggccggcggcgccggggtgaacgcgaagcaggagctgacccggcggatggcccggcacgacccgccggacaccttccaggcgcacgccggtgccgagctcaccgactacatcgacgccggccaggtggaggatctgacctcctactacaccgcgtggaacctgcgcggcgtgctgcccgccggcctggtcgacgacctgaccgtgcgcggccggatctactcgatcccggtcggggtgcaccgggccaacgtggtctggagcaacccggcggtgctcgcccgggccggcatcaccggcacacccggggacctgcccgccctgctggccgacctcggccggctccgggccgccggggtggaggcaccactcgcggtgggccgcgactggacccagctgatgctgctggaggcggtgctgatcagcgatctgggcgcgcaacggttcgccgggctgttcaccggcgccacctcgtggggcgacgcgctggtaacccgggcgatcgccgacttcgccaccctgctcacgttcgccaacgccgaccgggacaccctcgactggccgcaggccgagcggctgctgatcgacggcaaggcgggttatcagctgatgggcgactgggaggcggccgacctggcggccaagggggccaccgactaccgctggttcaccttccccggcaacggcaggaccttccagtggctggccgactcgttcacgatggcgaccggcgcgcccaacatcagcggcaccgagtgctggttgaaaacggtcagctcggcggccgggcagcaggcgttcaacagcgtgaagggctcgatcccggcccgcaccgacatcccggccgcggatttctcgccctaccagcgctcggcgatggcggattggaggtcggccaccccggtcccgtcctgcgcgcacggttcggcctgctcgcagccctggcaggcggccatcaccaaggccctcgacgggtacaccaccggccacgaccgcaaggctctgcaggccgcgctggtccgggccgccgcgcagttcctgcgatgatggcgggcatggctgaggagcgcgacggagtcccgctgaccaatctggatcaggagatcttcccggcggcgggcgccaccaagcgggatctgatcgactatctggacgcgatgtccgcccggctgctgccggtgctgcgggaccggccgctgtcggtgatccgggtgctccgcgggcaggaccggttcatgcagaagaacctgccgaaatacacgccggactgggtgccgcggaccacggtctgggcggaggcctcgcatcgcgaggtcacctacgcgctcggcaacgaccggcgcaccctgctgtggctcggcaaccagcgggccgtcgagctgcacccggcgctggcgctggcctccgccccgcaccggcagacccacctgatcatggatctggacccgccggaggacgacggcttcccggccgcggtggcggcggcgcggctggtccggcaggccctggccgaggccgggctgagcggtgcggtgaagaccagcggctccaagggggtgcacgtcttcgtcccactggccggcgacccggcacccgaggacgtcgccgcggcgcagcgggccgtggcggcccgcgccgagcggatcgacccggtgctggccaccaccgcgttcatccgcgaggaccggcacggccgggtgttcctggacgcgacccgggccggcggggcgaccgtggcggccgcctacagcccgcggatccggccgggggtgccggtgtcgttcccggtcgcctgggacgagctggacggtgtgaccccggccgacttcaccatccacaccgcgccggcgctgctgcgggacgacgatccgtgggcggccgcgatgccggcgccgcaaccgctggacgccgggctgatcgccgaggggcacaccatcccggtggcccgggtgcaggccatgcacgagggtaaacgccgggccaaggcgcgccgcgagagcgcgacggactga

SEQ ID NO: 4380 - DNA, 237 bp, Actinoplanes utahensis
ttgctcgggctggcccgccggtgcggtgcccgtccgggtccgccgatgcggcgcggcccgggcattgcgcgcggtcaaggcggtgggctggccacggcgtacggcaaccgtctcgctctcaccgtgatgaccgtgacgtacgcatcggccggtctgatcgtcctggccgggccgttccgcggtcggcgggatctcccggagcccgccgtgggtccggcgctttccaccgttcggtaa

SEQ ID NO: 4381 - DNA, 249 bp, Actinoplanes utahensis
atggcgaagttcatggacgtccacgacggcttcttcggcgtcaccgcccagcagttgaacgccgcgcacgacgccgacctcaagatcgagggtgaggagggcgtgcacttcgagcgcgcctggctggaccccgaggccggcaaggtgttctgcctgagcaccggtccgagcaaggaggccgtgatgcgcgtgcacgagcgcgccggccaccccaccacccaggtcttcgagctcaccgccgaggtctga

SEQ ID NO: 4382 - DNA, 252 bp, Actinoplanes utahensis
gtggccctcaccagtcccgtcctggtcggacggagcgaccagctggacctcgccgggcgccggcacaccgaagccgccgccggcgccggcgagctgctcctgctggccggcgaggcggggatcggcaagacccgcctgctccgcgagatcagcggccgcgccaccgccgccggattcgcggtgatcggcgccgccgccatgcccggcgacctggaggtggccgccggcctgctcgccgacctcggcgcctag

SEQ ID NO: 4383 - DNA, 114 bp, Actinoplanes utahensis
gtgcgctggtcgcgggcaggcggcgacgagttcgatcatctcgaccaggtcggcgaccagcagccgccgatgccggtccgggtcgccgccggcgccctcgcgctagctagctag

SEQ ID NO: 4384 - DNA, 1284 bp, Actinoplanes utahensis
gtggtggtggcccggctgcacgcggcactggccgcggcgtacatgctggaccgccggctcaccgaagccctcgaccacgggcagcgggcccgcacgatcctcggggacaacgacgacctggacgccaccgtcggctcggtcctgctcttccacggccggctcgacgaaggcatcggcctgctcgaagcggtgatcgcccgggccgtcgccggcaaccacgaacgcgaagccgcccgcgcctaccggatgctcggctcctccgcctcggtgctggtcgaatacgaccgcgcggagcgctggctggccgccggcatcgcctacgccgaacgggtcgaacgctgcaacgaccggcactacatggccgcgcacctggcccacgtccgctgggccaccggcgacttcaccggcgccgccgcccaggcccgggccgccctcgccgacgggcgtggtggcatcaccacccggatcaccgcgctgcacgtcctcggctacgccgccctgcccaccgaccccgtcgccgcccgcacccaactgcgggaagccgccgagctcggcagcggcatgcgcgaactgcagcgggtctcacccgcctggtggggactcgccgaactcgcgctcctggagaacgacccggacgcggcgatcgcccggtgcgaggacggctacgcggcgtcggccgccgtccacgacgccgcctacctctttccgtacgtcgtcaccggcacccgggcctacctggccgccagcggtcccacccgggcccgcgaatgggtcgcccgcaccggcgcgctgctcggcgaccgccggatccccggcaccctcggcgccgtcgaccatgcccggggactcatccacctcgccgaaggccagaccggaaaggcccgcacgtccctcgaacgggcgggtgaattctgggccggccggcggcgggtctgggagaacaccggcgcgctgctcgaccaggcgcggtgcgcccaccggtcccggcgccccggcgaagccgcccggctggtcgccgccgcctggaccacctggggcggaccggtgccggccggctggtcgatcagtcccaccgggaccgccggcacgtcgccgctgaccacgcgcgagctggaggtcgcccggctggtcgccgccggacgcaccgaccgggagatcgccggcaccctggtgatctcgccgcggaccgtcgccgcgcacgtcgagcacatccggaccaaactcggggtgacccggcgcacccagatcgccggatggctggcgacggttgaggcttcgagttaa

SEQ ID NO: 4385 - DNA, 807 bp, Actinoplanes utahensis
atgagcgttccggggaacactgtcatcctgctcgtcctgctcagcgcgttcgtgggctgcgtgggatatgcgctggggcggtggcacgaacggcgggagggcggggcggaccgggcggaggcgtaccgggacgggtatgaccacgcggcccgcagcgtgttcagcatggcggcccgggtggcggggcggcggcgggggcggggggcggtgcgggcctccgcggtggtgtcgccgcctgatccgtccgttgctccggtctcctcttcgccggccgctcctgctcctgtttccgctcccgcttctgctgctgccggtcctgttgccgtttccgggatgccccagccggtctccaccggtgcctctgccgaagcgcccctcgccggtgtgccctcttccggtgtgccctcctccggggtggctgcctccggggggcccgccgcaggtgtgtcgttcccggctccggaacccatcgtcgtgccgggccttccggagccggcggctgagggcggggtgcactactcgtcgctgcccgatccgcggtggggcgccgaggagaccgtctcgccgccgccggtgccacgcgcccggcactacgtctccacggcgggcgagacggacaccccggcgccgcgggaaggggccggccggcacaccgtgccggacgaactcgtgcaggcggccacctacaaactcgccgccgaccgggtggcccgagcccgggtaccccggtcatccggtgaaaccaccgatccgtccgaatcagatcagggcgggcggccgtcggtgccgcggccgcggggactgtga

SEQ ID NO: 4386 - DNA, 348 bp, Actinoplanes utahensis
atggtcaccgtcgatgatgtgcggcgggtcgcccgggacctgccacgaagcaccgaacacctgatccgggacagggtgaagttccgggtgggcaaaatcgtgtatgtcgcgttctcccgcgacgagacgatcatgggcttcggctatccccgacaggagcgcgacgcgctgatcgccgccgatccggtgacgttccacctgccccgcgagtccgacctgcggttcaactgggtgcaggcctacctggcgcacctcgacgagcaggagatgaccgagctggtgctggaggcgtggcggatgtgcgtgccgaaaaaggtgtggaccgcctacctgccacgcctggcctga

SEQ ID NO: 4387 - DNA, 660 bp, Actinoplanes utahensis
atggccgcggcgggccgtttccggcaacctcttgacggatcgtacgcggcggtagatcgtaatcatgtgcatacgactattaaggatcttcgcccgatccacgccgaggcggtccgcgcgaccgtggacctcgtcgcgcgggcgaccgtcgaggatctacggcgttcgaccccgtgcgccggctgggatctggccacgctgctcgggcacatgacggcgcagcaccgcggcttcgccgcggcggcccggggcaacgggtgggatctttcgcactgggctgcggctccggccggcgccgacttcgatgcgcggtacgccgaggccgccgccgacgtcgtcgcagccttcgccgccccgggcgccctggaccgccccgtgcatctgccggagttcacagccgaccgcacgttcccctgccacctggccctgaccttccacctggtcgactacgtcgtgcacggctgggatgtggcccgcacactggatctgccctaccacccgggcccggccgtcctcgccgccaccgtcccgatcgcccgcgccgtccccgacgacgccgcccgcctggccccgggcgccgccttcgccccggcgctgccggtcccgccgtccgccgaccctctcaccgaaatcctgctgctcctcggccgccgcccatga

SEQ ID NO: 4388 - DNA, 450 bp, Actinoplanes utahensis
gtggaaagggacgacctcggcgcgatggccgcgcggctcggccggcgcctgatcgcgatggaacagccgatcctggcccggcacggggtgtccatgtggggctacgtcgtcctgaacgccctggccgaaaacgcgatccgcacccaggccgcgctcgccaccggtatcggagcggacaagacccgcctcatcccgatcctcgacgacctgcagcagcgcagcctcatcgaccgcgaacccgacccggccgaccgccgcgtccgcctgctcgccctgaccggatccggtcagcggctgcaccgcgcggtacaggccgagatccgcgccgctgaggacgaactgctcgacgaactgccggccgccgaccgcgaaacgttcctgcgggtgctggcgattctggcccgccgcccggacgggaacggcctccgatcggttcagcccagcggctga

SEQ ID NO: 4389 - DNA, 660 bp, Actinoplanes utahensis
atggcatccctcactcggcaaccctcagcctccaccccgtccaccgtctcgcgccgccgggcctgctctccccgtgccggccacccttctccttcggaccgggcggcgcgtcccaccagggctcccccgtcccgtaccgccgaccggtcgcgctccgttccgccggccggcggtttcggtatggttcgcggcatgggtgaccacagccgcatcgtcgagatctacaccgacggcgcctgcgtgccgaaccccgggcccggtggctggggcgcggtcctccgctggggccgctcggagaaggacctctgcggcggcgaggccaccccgaccaccaacaaccggatggagctgacggctccgatccgggccctcgaaacgttgaaccgcgccccgctcaccgtcgacatctacaccgacagcgtctacgtccgggacggcatcaccaagtggctgccccgctgggccgccaacggctggcagaccgccgcccgccagccggtcaagaacgtcgacctgtggcaacgcctcgacgccgcggtccggcgccacgaagtccgctggcactgggtcaaaggccacgccggccacccggagaacgaacgagccgaccgcctcgccgcccgaggcctccaggaagccgtagccgccgcaaagctctga

SEQ ID NO: 4390 - DNA, 930 bp, Actinoplanes utahensis
gtgggtggcgacgtggccgcggtggagatacgggacgtcgtggtgcgctacggcgacacgacggccgtcaaaggggtgtcgctggacgcccggcgcgggcgggtgctggcgctgctcgggcacaacggcgccgggaagacgagcctgctgcaggtgtgtgaggggttccggaaaccggatgcgggcacggcccggatcctgggcatggatccgatcgccgagcatgacgcgctgatgccgcggctcgggatcatgctgcagtccggcggggtctacccgtgggcggccgcgggggagatcctgcggctgttcgcctcgttcgcggccaacccgctcgacaccggcatgctgctcgaccggctcggcctgcggaaggtggaacgcacccggttccgccggctctccgggggcgagcagcagcggctgagcctcgcggtggccctggtcgggcggcccgaactggtcttcctggacgagccgaccgccggaatggacaccgaggcccggcacaccacctggcagctgatcgaggagttgcgcgccgacggtgtctcggtgctgctgaccacgcacctgctcgacgaggcggagcggctggccgacgatgtggtgatcatgcggtccggcgaggtggcggcgaccggcacgccggccgagctgaccgcggcggccgggatcgacctgttggaggtccgcgccgacgcgggcctcgagctgacctccctgagggcgcggcacgaggtggtggagacgtcgccgggggagtatgcgatcaccggcgcgctggacacccgcgcgctggccgacgtgctgggctggttcgccgcggcggacgcgcacgtcaccgcggtgagcagccgccggcgcacgctggaggatgtctacctgtccctgaccggtaaccagagcacggtgggagccacccgatga

SEQ ID NO: 4391 - DNA, 768 bp, Actinoplanes utahensis
atgagcgtcgcgaccgggactttcacgccggcgcccgggcgggcgtcgatgcgtaccgtcatcagccggcagatccggatggagctgctgctcaccgcccgccggggcgaggcggtggtgctggccatgggggtgccgctgctggtgctgctcggcgccgggctgacccatgcgacgaacctgccgaccggcgaccggctcggcttcgtggtgccgggggtgctggcgctgaccgtgatgtcgacggcgttcaccggccaggcgatcaccaccggttacgagcggagttacggggtgctcaagcggctcggcgcctccccgctgacccggcccggcctgctgctggccaagacggcggcggtgctggtgcagatcgtgctgcaggtgctgttcctcgggctggtcggggtgctggtcggctggcgtcccgacctcgccgaggtcctgcccgcggccggggtgaccgtgctggccgcggccgggtacagcggtctggccctgctgctggccagcgtgctgaaaccggagacgacgacgggtgcggccacactgatctacgtgctgatgctgtcggtcggcgggatcatgttcgccgcgcccgacctggggacggcgggatggttcctgctgccgctggccgcgcacgcccaggcgctgcgcgacacgctgatgaacggggcgagcatcccgctgtcgatctggctggccctggccacgtgggcggtggtctggctgaccgcggccgcccgcagcttccgctgggagtag

SEQ ID NO: 4392 - DNA, 837 bp, Actinoplanes utahensis
atggaagcgatagaggtgtcgagcctccgcaaaacctatcgggacaaggaagcggtccgcggcatcgacctggcggtcggccgcggggagatcttcgcgctgctcgggccgaacggggcgggtaagacgaccacggtcgagatcctggaggggcatcgccggcgcgacggcggcaacgtgcgggtgctcggggaggacccgggcacggcggggcgtggctggcgggcccggatcgggatcgtgttgcaggacgccgatgacgccgccgacctcacggtgcgcgagatggtgcggcatgtggccgggttctacccgcagccgcgcccggccgacgaggtgatcgagctggtcgggctgaccgccaagcagaacagcaggatccggacactgtccggtgggcagcggcgccgggtcgatgtggcgctgggcatcgtggggcggcccgaactgctgttcctggacgagccgacgaccggtttcgacccggcggcgcggcggcagttctgggagctgatccgggcgctggccggggacggcaccaccatcctgctcaccacccactatctggacgaggcggaagcgctcgccgaccggctggcggtgctggccgacgggcggatcgtggccgagggcaccccggcgacgctcggcggccgggccgcggccggggcccgggtgtcctggcagcaggacgggcggacccgcaccgaacaggtcgccgaccccagcgatctgatccgggagctggtcgcgaccggtgcggacctgcgcaccctgacgatcacccgccccaccctcgaagacacctacctgaccctgatcggagccgaccgatga

SEQ ID NO: 4393 - DNA, 786 bp, Actinoplanes utahensis
atgagttcgatgagtctcggccggggccacgtggaggtgctgcagttcctgcgggaccggaccgcggtcgtcttcaccttcctgttcccggcgatgctcctgctgctgttcgggacgatcttcggcaacgactacgaccgggccggggcgagcgcggcccaggtctacaccgccagcatgctggcctacggggtgctgaccaccgggttcgtgacgatgggctccgggctggcgctggaccgcgaggacggcacgctgaagcggctgcggggtacgccgttgccggtcacgtcgtacctcatggggaagttgatcctggtattgaccttgagcgtggccgaggcggcgctgatcctgttggtgggcgtggtcgtcttcgacatgccgctgccgccggccagccactgggtgaccttcgcctggctgatgatcctgtcggtgacctgttgctcgctgctcggcgtcgcggtcagcgcggtggtcaggcatgcccgcagcgccggggcgatcctgaacgtgccggtggtggcgctgcagttcatctccggggtgttcatcaatccgatcacccagctgccgtcctggctgatcaccgtggcctcgttcttcccgatcaagtggatggcccagggcttccggtacgtcttcctcccggacagcatgaagtcgctggaggcggccggggcatgggagctgggccgggtcgccgtggtgctcggtgtgtggtgtgtgatcggattggcgctgtgcctggtgaccttccggtggagcgacaaggaccgatga

SEQ ID NO: 4394 - DNA, 1233 bp, Actinoplanes utahensis
atgggagctgggccgggtcgccgtggtgctcggtgtgtggtgtgtgatcggattggcgctgtgcctggtgaccttccggtggagcgacaaggaccgatgaccgactcggaggccgtgcacgcccgctattcccgctggtgggacacctactttttcgtgatcacggccgccggcgcggccgcggtcgtcacctccggcgccggggcggggcatcggggggtcgcggccgccgcgatcgtggcgatgctgatcgtgcacgccacggtcggctggcgggcggcgcgcggacccgacggaccgttctcgatcgcggtgctcggggtgcaggtcgcgctgttcatgctggcggcggcgagcgcgccggtggcgtcgtggctgctgttcgcggtgatcccgctgatcttccaactggccccggtgcgcctggcgatcggcgcggtggtgctggtcacgctggtgccgccggcggtcgacctggccgccgggaccggcaacctgaagaccgacctggtcatctcggcgatctccgcggggtccggcgtctggctcgggctgtggatcatccgggtgatccggcagagcaccgagcgggcgaatctgatcgccgagctggaggagagccgcgccgaggtggcccggctgtcccacgaggccggggtgaccgccgagcggacccggctggccggggagatccacgacaccctggcgcagggcttcaccagcatcatcacgctgatccaggcgtccgacccggagctgcgggacgagcggctggcgctcgcggtccgcaccgctcgggagaatttggcggagagccgggcgatcgtggccgcgctgtcgccgtccgcgctggatgccgggctgaccgacgcggttcggcggcagaccgcccggttcaccgaggagaccgggctggccgcgagtttccgcaccaccggggagccgcgcgatctggccacgccgatcgaggtggtgctgctgcgcgccacccaggaggcgctgaccaacgtacggcggcatgcccgggcgaacgaggcggcggtgctgctggcatattcgccgtcgtcggtgcgggtcgtggtgcgcgacgacgggtgcggtttcgacaccacgacgaacggcggcttcgggctgcccggcatgcggcagcgggccgagcaggtgggcggcaccctgaccgtgcgcagcgacccggacaccggcaccacgatcgagttggaggttcccgcatga

SEQ ID NO: 4395 - DNA, 618 bp, Actinoplanes utahensis
atgatccggattctgctggtcgacgatcacccggtggtccggatggggttgcgggggatgctcgacgcggaaccggacctcacggtgatcggcgaggcgtcggacggcgccgagggggcggagatcgcgctgcgggaccgccccgacatcgtgctgatggacctgcggatgccgggcgccgacggggtggaggcgaccggccggatcctcgccggcgacccgggcatccgggtgatggtgctgaccacctacgagtccgatcgtgacatcctgcgcgcgatcgaggccggcgccagcggttatctgctcaaggacgcgtcgccggccgacctcgccgacgccgtccgggcggccgcccgcggggagacggtgctcgcgccgagcgtcgcgtcgaccctggtccgccaggttcgcacacccgctccgccggcgctttcggcccgcgagaccgaggtgctgaaactggttgcggccggcctcaccaacgccgacatcggccgacgcctgttcatctccgaggcgaccgtcaagacgcacctgctccgcgtcttcaacaagctcgacgtcgccgaccgcaccgccgccgtgaccaccgccatgcgtcacgaccttctgtga

SEQ ID NO: 4396 - DNA, 1347 bp, Actinoplanes utahensis
atgaatatccgaggacgcgtggccctcgcggccgccgccgccgcggtcgtcgcgatcccctcgatggcgatggcgggcgattcgcaccgggacaacacctgggccgcgctgcacgccatcaagggcggcaccgcccgcaacgtcatcctgctgctcggtgacggcatgggcgacagcgagatcaccatcgcccgcaactaccaggtcggcgccaacggccgcctggccatggacaccctgccgctgaccggcgcgtacaccacctacgccgtgcagaaggcccacccggagctgcccgagtacgtgaccgactcggccgcctccggcaccggctggtcgaccgggcacaagacctacaacggcgcgatcagcgtgctgcccgacggcagcccggtgaagaccatcctggagctggccaagaaggccggctaccggaccggtgacgtcaccaccgccgagctgcaggacgccaccccggccgtgctcgcctcgcacgtcgtcgaccgcggctgcaagggcccgcagtcgatggccgcgtgcgccgtcaacgacaaggtcaacggcggcgccggctcgatcgccgagcagctggttcagacccgccccgacgtcctgctgggcgggggcaaggcgtacttcgaccagaccgtgcaggccggcaggttcaagggccagaccgtcaccgaccaggcccggagcgtcggctaccaggtcgtcaccgacgccaccgggctcgccgccgcctcctgggccgcgccgatcctgggcgctttcgcccccaacaacatggacctggagtggaccggccccacgccgacccgcaccggtaccgccccgtcgacctgcgccaccaacgtcgcccgcaacgccgcgcagccgcacctggtcgacatgaccaccaaggcgctcgacgtgctggaccggcagacccggcaccgcgacaagggcttcttcctgcagatcgagggcgcgtccatcgacaagcaggaccacgccgccaacccgtgcgggcagatcggcgagaccgtcgccttcgacgccgccatcaagaaggcgctcgactatcagaagaagcaccccgacaccctggtggtcgtcaccgccgaccacggccacaccagccagatcgtcgaggccgccacgatgggctacaccgccacgctggtcacgcacgacaacgccaccatgacgatcagctacgcgacgtcggacatcaccggctcccagcagcacaccggcaccgaggtccggatcgccgccggcggcccgcaggccgccaacgtcctcggcgtcaccaatcagacggacctcttcttcacgttcaagcgcgccctcgggatccgctga

SEQ ID NO: 4397 - DNA, 3339 bp, Actinoplanes utahensis
atgggtcatcgaccaatccaagcggcgtcgcacgagcgagtgccgttcacgttctggggacgacctcggatccggacagttctggcgaccgtggcagcggccgcggcggccttcgccccggctgtgatggtgcccgcgccggcgctggcagccaacccctccaccgttgacaacctgaccatcaccgatgccgggaactgggaaggcagcaaggtcaccttcacgctgacctacaccggcagctctcctggcgacttcaccatcgccaccgcggcgggctcggcgagctcaggggccagcgacttcaccgccacccccagcaagacctcgatcaccttcccgggcaccgcggccagctcgaacaactcgaccacggtgacggtggacacggcggccgacgcggacaccgccgacgagacgttcagcctggtggccacggacaccctgggcaacaccaagtcgggcaccgggacgatctacgcggtatccgtctacccgaccttcgggctgacgccgtcgacctcgaccgtggcggagaccgcgaccaaggacgcacagggcaacgtcacccagaagacggtgacggtcaccgccacgctgaccgcgccgctaccgcacgacatcagcatcccggtctccacggtcaacggcgcggacgtcgacccgctgaagaacgccacctccgccggtggcgtgctgcgggactacgacgcgctgccggcgaccgcggtgatcaccatcccggcgtacacgtacaccggcaccaccaccgttcagctgtacgacgacaacgtcgacgagacggctaccaatgggcagtccttcaccgtgcaggccacggacacccctgtggtattggcgaccaacgtaggcgcgagcaagagcaccattaccatcaccgatgacgaccctacgccggtggcgtcgatcggcgatgcgacgtccgcggttaccgagggcggggcgctcaacttcccggtgaccctggaccgcccgtccgacgcgaccaacctgtccgtcggctactacaccgcggccggcacgacgatgaccggctcctccgctggcagcccgtcagatgtcaccaccccgggcagcagcaccacgcccaacgtggccacgatcgcggcctactccacgacccggacgatcgcggtgccgaccgacaatgacgtcaacttcgagggcgcggagaacgtcaaagaggtcctgagcagtgccaacagcagtgcggttggcgtaacgatcggcacgaagtcgacgggcgtcggagtcatcaacgacaacgatgcgggcccggcagtcaccctcgcctcggtcagcacatcgccgggagtgttcccggagggcgactcgggcgagagggttcagaaggtcagggttaccgtcgccgcgggtacctaccccgtaccggtgaagatcgactgggcgaccagggacggctccgccactgcgggctccgactacaaggccgcctcgggcagcttcaccattccggccggcacggacaccacgagctggtacggcgacatccccatcaccgtctacggtgacgtggtcaaggagaactcggaaaccttctccatcgacgtcaccagctcgaccagcaccatcggcgcggtcagcggcgacaccaccatcactctcagtgaggcgggggagtcggacgccaagccgaccttcaacgtcggtgacgtctcggtgagcgagggcaacagcggtacctcgttcgcgaaggtgccgatcgtgatgagcggcgcctcgccgtccgacacggttttcaccacgacgttccatgccggcaccgccgtgggcaccagcaacggtgtgcccggtgacaatgactacaccgtccccaccgacagcacggtgacgatcaaggccggcgacacgaccggatacctgagcatcccgatcaacggtgacaccgtctacgagcgggaccaggtcttcagcgtcgacttcaccaccgccagcagcgacgtcaccaacacgaacacgccggacgtccagcacaccgcgcgggtcacgatcggcaacgacgacgcgcagccgacgctgaccttcaacagcagcaacgcgaccgagggccagccgatcaccgtcaccggcaagatcgtcggggtttccgagtacgcgtacaagctgggtctgaccgtgggcggcacggagaccaacgcggccaccacgggcaccgacttcaccgtgccggccagcctggcaaccacgtcgatcgcggtgccggccgggtactccggtgagctgaccgatattccgagcgtcggtggcggctacacctggtcgttcccgacgctggacgaccagatcgacgagccgaccgagggcttcaccgtcaccgcgaacgagaccaccggcgtgccgaccggcttcacgccggctgtcggaacctacaagatcgcggacgacccgctggacctgccgccggcgatcgccatcggcgacacgaccgtgaacgagaaggacggcactgccgaggtgccgatcgacctgaccttcaacggtgacgcgacgtcgaccacgcagaacgtgaccgtccagtacaacacctcggacggcaccgccaaggcgggcaaggactacacgctcaccaagggcactctgacgatcccgccgggcacgatgaagaccagcatcaaggtccccatcatcaacgactcggacatggaggacgacgagaccttctccgtgcggctcagcaacgccaacccgttgggcgcgcagatcaccagtggagactcgaccgtcaccatcaagtcggacgacacggtggcaccggtcaccccgacgctgatgctcaccggtccggcggccggcgccggcgcggtcaccgcgtggggcaaggccaccccgggcaccaaggtcatgctgtacggcgcggccctgcccgagatggacaagaaggacctgaagctgatcgacaccgtgacggccgacgcttccgggatgtacaagttcaagtcgctcacggcgaccaccggctgggcgttctacgtgcaggccgaggtgggcggcgcgacgtcgatccgggtcgtcaagctgaaccagtcgccggggctgacgctctcgacgagcaagggcaagctgggcgtgacggtcaacgggaacccgaaggcctccggccagacggtcaccatccagcgcaagagcggcagcaagtgggtgacggtcggctccggcaagacgacgtcgagcggcttcaagggctcgtacagcttcaagtcgggcaccaagctgacggtgcgggccatggtttcgggcagcagcagcctgggcatcaacgccggctactcgtccagcaaggccatcaccatcaagtag

SEQ ID NO: 4398 - DNA, 1977 bp, Actinoplanes utahensis
gtgaccgcgccgaacaggccgccggcgcggccgatgggcggcccgccggccgcccggatgatgatgggggccggcggcccgccggagaaactgcaggacttcaagggctccaccaagcgcctgctgcggatgctcgcaccgcaacgggccctggtcggggtggtgctgctgttcggtgtggcctcggtcttcctgtcggtgctcggcccgcgcctgctcggccacgccaccgacgtgatcttcaacggcgtggtcggcaagatgctgggccggaccctgccgcccggggtgaccaaggagcaggccgtcgagggcctgcgccagcggggcaacaccaagttcgccgacctgctggccgggatgaacgacgtgatccccggccgaggcatcgacttcgacaagctgatgcacgtgctggcctgggtggtcgtggtctacctgttcgcctgggtgttcggcgtactgcagggccggatcaccgcccgggtggtgcagaccgcggtgtacgacctgcgcaaccaggtcgaggcgaagctgtcccggctgccgctgtcgtatttcgacaagcagccgcgcggtgaggtgctcagccgcgccaccaacgacaccgacaacatcgcgcagaccctgcagcagaccttcgcccagctggtcaccgcactgctgaccgtggtcggcgtgctcggcatgatgttctggatctcgccgctgctcgcactgatcgcgctggtcaccatcccgctgtcgttcttcctgaccactttcatcggcaagcgggcgcagccccagttcgtcgcccagtggaagacgaccggccagctcaacggccacatcgaggagatgttcaccggacactcgctggtcaaggtgttcggccggcagcaggaggcggagggcacgttccgcgagcacaacgaccggttgttcgcctccagcttccgcgcccagttcatctccggcctgatccagccggccatgatgttcatcagcaacgtgaactacgtgctggtggcggtggtcggcgcgctgcgggtgacgtccgggtcgctgaccctcggcgaggtgcaggcgttcatccagtactcgcgccagttcagccagccgctgacccaggtggccagcatggcgaacctggtgcagtccggcatcgcctcggccgagcgggtgttcgccctgctcgatgcgcaggagcagagcccggagccggccgtccgggagatgccgccggtgcaggggcggatcgcgttcgagaacgtgtcgttccgctacctgccggacaagccgctgatcgagaacctgtcgctggccgtcgagccgggccagacggtggcgatcgtcggcccgaccggggccggcaagacgacgctggtcaacctgctgatgcggttctacgacgtgaccggtggccggatcaccctggacggggtggacatcgccaccatgccgcgcgagcagctgcgcgagcagatcgggatggtgctgcaggacacctggctgttcggcgggacgatcgcggagaacctggcgtacggcgccgacgaccacgaccaggcggcgatcgtgcgggcatccgaggccgcgcacgtcgacggcttcgtgcggacgctgccggacggctacgagaccaggatcgacgaggagggctcgaacgtcagcgccgggcagaaacagctgatcacgatcgcccgggcgttcctcgccgagcccagcatcctgatcctggacgaggccaccagctcggtcgacacccgcaccgaggtgctgatccagcgggcgatgaacaccctgcgcaccggccggaccagcttcgtcatcgcgcaccggctctccaccatccgcgacgccgacctgatcctggtcatggagaacggcaccatcgtcgaacagggcacccacgacgagctgatcgcggccgagggggcttacgcgcgcctctactcggcgcagttcgcccaggccgtcgccgaggtcgactga

SEQ ID NO: 4399 - DNA, 1737 bp, Actinoplanes utahensis
gtgctgatgaaactgcttcgcgtccacctgcggccgtactggaacacgatcggcctgatcgtgctcttccagttcctgcagacgctcgcgacgctctacctaccgacgttgaacgccgacatcatcgacaacggcgtgatcaagggcgacaccggctacgtgatgcggatcggcggcgggatgctcggcatcaccgtgctgcagatcgccgcccagatcgtcgccgtctacttcggggcgcgcaccgcgatggcggtcggccgcgacctgcgcgagtcgatcttcacccgggtgcagaccttctcggcccgcgaggtcggccagttcggcgcgccgtcgctgatcacccgcaccaccaacgacgtgcagcagatccagatgctggtgctgctcaccttcacgctgatggtctcggcgccgatcatgtgcgtcggcggcatcgtgctcgcgctgcgccaggacgtgccgctctccgggctgctgctggtgatcatcccggtcctgatcggcgtggtcggcctgatcatcagccggatgcggccgctgttccgcagcctgcaggtcaagatcgaccgggtgaaccaggtgatgcgcgagcagatcaccggcatccgggtgatccgggcgttcgtccgcgacgagcgcgagcaggcacggtacgaggtggccaacaacgacgtcacccaggtctcgctgagagccggcaagatcatggcgttgatgttcccgaccgtcatgctgatcgtgaacctgtccagcgtggccgtgctctggttcggcgggcaccggatcgacagcggcgcgatgcaggtcggcgcgctcaccgcgttcctcagctacctcatgcagatcctgatgtcgatcatgatggccaccttcatgttcatcatgatcccgcgagccgaggtctgcgccgagcggatccaggaggtgaccgccaccgagacgtcggtgacgccgcccgcggcgccggtcaccgaggtgacccggcacggcgagttggagctgcgggcggtcagtttccactatcccggggccgaggccccggtcctctccgacgtacggctcatcgcccgaccgcgggaagttaccgcgatcatcgggtccaccggcagcggcaagacgaccctgctcaacctgatcccgcggctgttcgacgcgaccgagggcgccgtgctggtcgacggcgtcgacgtccgcgagctcgaccccgacctgctgtcccggctggtcggcatcgtgccgcagcggccctacctgttcaccggcacgatcgcgaccaacctgcggtacggcaacccggacgccaccgacgacgagctctgggcggcgctggagatcgcccaggccaggagcttcgtggagaagatggacggccggctggacgcgcccatcgcccagggtggcaccaacgtgtccggcgggcagcggcagcggctggcgatcgcccgcgcgctggtgcaccggccggagatctacctgttcgacgactccttctcggctctcgactacgcgaccgacgcagcgttgcgggccgcgctgaccgaccacatcgccgacgccaccgtggtgatcgtggcgcagcgggtcagcaccatccgcgacgccgaccggatcgtggtgctcgacgacggcagggtcgtcgggacgggcacgcacgaggaactcatggacggcaatccgacgtaccgcgaaatcgttctttcccagctcaccgagcaggaggcaaacgcgtga

SEQ ID NO: 4400 - DNA, 1845 bp, Actinoplanes utahensis
gtgctcgcgcaacagcgggatggtcgccgcgatcaacgcggcccgccgctcacccggcgccagggccggttgtcgtctccgtcggttctccacgcggcacagcctactgagcgagcactcactcagccactgacttttgtcatggacccgcgtcgaaccggaaacggcacggtggcgtatcaaggagatgtgagtcaacagaagtcgtaccgccgggtcatccgccaggtgaccacgggtttcgccgcgatcctcgtattcctggcgctgatcctgccggaccagatcacccggctcccaccgggcaaccactggtacaccgcgctgctgcggatcccgctggaggcgctgatcgccggcgccgccctgctggtcgtcccggccgcccggtggcgccgccggctggccgccgcgctgggcctgctgctcggcgcgctgaccgtggtcaaactggtcgacatcggattcttcgcgatcctggcccgccggttcgacccggtgctggactggacgctgttcgacgacggctacaacttcctggtcgactcgatgggcaggggcggggcgctcggcgtggcgtccggcgtggtgctgctcgccgtcctcctgatcgccgggatgatctgggcgatgctgcggctcacccaggtggcgctggggcaccgccggctcgcctggagcgggctcggggcggccaccgcggcctggaccgtcctggcactgctcggcacccagctgatcggcggcctgccggtggccgcgcacgccgccgccgacctggcccaggagaccgccctcgcgctgcccaaggacctcgccgacaagcgcgcgttcgtcgccgaggccggcgacgacgcgtaccgggaccgccccgccgaccagttgctcaccgcgttgcgcggcaaggacgtggtggtctcgttcatcgagagctacgggcgtgacgcggtggagaacccggccttcgacggctcggtgctgaccgcgctcgccgacggcgacaagaaactggccgcggccgggttcgccgcccgcagcggcttcctcacctcgtccaccgccggtggcggcagctggctggcgcactcgacgttcctgtccggcatgtgggtcaacaacgagtcccgctaccggagcctgatggccaccgaccggctcaccctgacccgcacgttcaagaacgccggataccgcacggtcggcgtcgagccgggtgtcatctacgcgtggccggagggtgacttctacggctacgaccaggtgtacgacaaggccgcgctgaactatcacggcccgcagttcagctggtcgccgatgcccgaccagtacgcgctggcccagttccagaaggccgagtacagccgcccgaaccgcggcccgctgctcgccgagatcaccctcacctccagccacaccccgtgggccccggtccccggcatgctggactgggaccagctcggcgacggcagcgtctacggcccgatggcgcgtagcaccaacccgaaggacgtctggtcggacgacagcaggatcaagacggagtacgcccggtccatcgcctactcggtggacagcctgatcgggtgggccgccacatacggcgacgacaacctggtgatggtcttcctcggcgaccaccagccggcctccgtcgtggtcggccagaacgccagccacgacgtgccgatcgcgatcgtcgccaaggacccgaaggtcctcgaccggatcgcctcgtggggctggaccggcagcgtcaagccggccccgaccgcgccggtctggccgatgaacaccttccgtgaccgtttcctgcaggccttcgggcccgaaggcgatccgcactag

SEQ ID NO: 4401 - DNA, 816 bp, Actinoplanes utahensis
gtgaccgtttcctgcaggccttcgggcccgaaggcgatccgcactagaggctttcctcatccgcccggtaggaagccggccggctgtgccctcggcgcagccggccggccgtacgctcgtgcggtgctcgccgaaccgtcgctgacccaccgcccggaggacggccactccgcgccgctgctgctctggcgttttcccgagcccgtgctggcggcctccacggcggtcctcggcggcggcgtcggccggtgcgagtgggtgatcaacgccagcgtcccgatgtcctacgcccgcccggacccggcgaaccacctcgccgagctggccgccgccctgcacctcaccggccccggcatcggcctgctcaccggcgtcgacgtgcacgacatggtggccaccacggaggacggcgtcgaggtctgcgccaccgtcggcctgggcgccccgatccgggccgccgagccgggcgtgaccggtttcgcccatcaccccggcaccatcaacatcgtcatctggatcccgcagcacctcgcccccggcgctctgctcaacatcgtcgccacggcgaccgaggccaagacccaggcgttgtacgcgttgggcctgcacgccacgggcaccgccaccgacgcgatcgccgtcctctgcccggccgccggccccaccgcggcctacggcggcccgcgctcccgctggggcgccccgatgtcccgcgccgtctacgaagccgtccacaccggcggccacaccaacctgaccaccggccgctcctggtccagccgcgccgccggcccaccggcggatcggcggccgtga

SEQ ID NO: 4402 - DNA, 585 bp, Actinoplanes utahensis
atggaagcactggagctggcggatttccgggcggcggtggcccggatgtatctggagccgggcggtctgtcggatttccgcaggcggcgggacgagttgttcgccggccacccgcagtcgccgatcccggcggacgagcgggccggcttcgcgggcctgtcgtactttccgccgaacgacgacctgatcgtcgaggtcccggtgcgggaagcggacggggagctgaccatcgacaccggcgggccggacggcgccgtgcgctaccgtcgcgccggcatcctggagacgccgttcggtgagctgaccctgtggtggatcgccgcctacggcggcgggctgttccttccggtccgcgacaccacctgcggcacgcagtcgtacggtggcggccgctacctgaccgacaccgtcaagggcacccacggccgcggcctgcagtggctgcgccccggccgggtccgcctcgacttcaactacctctacaacccgagttgcgcgtacgacccacgctgggcctgcccgctcgccccaccggagaaccgcctcgcccaccccttggcggccggcgagcattcctaccactga

SEQ ID NO: 4403 - DNA, 570 bp, Actinoplanes utahensis
ttgcgcgcgtcacatcgccgctgcattcttggggacgtgccggaacggattagcgaagtcaccgccctgctggctgaggtgctcgcgccgcgggcgccgctcaccgtgatcgtcgacgggggcgatccgggcgcggcggcggatttcgcctcgcggctggccgcggccttcccggcgagcgcgcgggcctggagcatcgacgcggtgctcgggctgaccgggcccggccggggcggcggtttcgattcggcgctgaacgtgctggaaccggccaccgatcaggtgctggtgtatctgcgcggcgggccgcggaacaggttcgcggccggagacggggagcgccgggcccaggtggtgatcgaccaccgcgatccggactggccggtgatccggcacgtgcacccgtcgctggccgatcccgatcggtggtatctgtccgagagccgggccttcttcgcggctcgcgcggcgaactgggacgtcaagttcggtgacgatctgccggcctacgcccgggcggtgcgcgaggccggggtgcggcccggcgacgtggtgctggacgtgggctag

SEQ ID NO: 4404 - DNA, 456 bp, Actinoplanes utahensis
gtgggctgcggcaccgggcgggcgctgccggcgctggccgccgcggccgcgccgggcgggcgggtgatcgggctcgacttcaccccggacatgctggccgaggcggcccgggccggccgggacgcgtccgccacgctgctggtggcggacgcgcgacggttgccgatcgcgaccggtgcggcggacgtgatcttcgcggccgggctgatcaaccacctgccggatccggtggccgggctggccgaactggcccgggtgacccggccgggcgggacgatcgcgatgttccacccggtggggcgggcggcgttggccacccggcacggacgcacgctgcggccggacgagccgctcggcgcggcacggctggcgccgctgctggccggggcggggtgggtgctcacgtcgtacgaggacggtgaagatcgtttcttggccctggcgacccggctctga

SEQ ID NO: 4405 - DNA, 819 bp, Actinoplanes utahensis
atgccggacatgacgcagtggcaggcggtggtcaccgatctggacggcacggtcgtccccgcgggcggcgacctggtcagcgcggccaccctgaacgcggccgcccagctgcgccatcgcggcatcccgctgctggccgccaccgcccgcacccgcaacggggtgacccggctcggtgcgttcgccgggcacctgaccgtcgcggtctgccacggcggcgcgctcggctggaccccggaggacggcggccgcaccctgtggcagcgcaccctgcccgcaccggagctgcgtgacctggccgacttcagccgcacgctgccgggcgcggcgctcagcgtgttcggcgtggcctcctgggacctcacgccggaatacctggcgctgcgcggcagcccgccacccgagccgtggcggtccgtgccgctcaccgacatcaccgaccagccggcgtacgcagcggcgatccggcacgcctcgctcagctcggacgagctggtcgcccggctcaccgaggccgggttcgccgagcgggccacgctgacctacgcggcgccgcacctggtcgagatcggtccgccgggcgtcgacaaggcggccggggtggcccgcgccctggactggctggggatcgcgcccgagcacaccgtcgccttcggcgacatgcccaacgacctgagcatgctggccctggccgggcactcggtggcgatcggcgcggcccacccggccgtgctcgccgcggccaccgcccgggcgcccggcgtcgacgacgacggcttcgcggcccacctcgccgagctgggtctgatcagcgcctga

SEQ ID NO: 4406 - DNA, 1149 bp, Actinoplanes utahensis
atgggcatggtcaaggtggtcggcctggtgctgcacccgcgccgggactgcgggtcggcggtcgacaccatcgtgagctgggcagccgcccgcggggtgaccgtgctcggcctgcccgacgagatcaaccggatcgactgcagcgcggtcgcggtctccgccgaggagatggtcgagcgggccggcctgctcgtcagcctcggcggcgacggcaccatgctgcgcagcatgcgtctggtcgagggccgcaagacgccggtgctcggggtgaacgtgggacggctcgggttcctcgccgaggtcgacctgcccgacctcaaggacgcgctctcctcgatcgacgaccactcgttccgggtggagagccgcaccgcggtgcgcaccgtgctgcccgacgggcggcgggtcaccgcgttcaacgacatcgccctggtccgggtgcccgggcacgggttggccgcggtcggcatccgggtcgagggcaagcggttcgtcaactacgcggccgacgcggtgctggtctccaccccgaccggctcgacggcgtacagcttctcggccggcggcccgatcgtctcaccgaacgtcgagggcctgatcgtcagcgccgccgccgcacactcgtcgttcaaccgctcgctggtcctggacacctccgaacacctcagcctcgacgtgctgcccaccagcggccggctggcgatcgaggtcgacgggatcatcgaggggtacgccgagcccggcgccgccgtggagatcgaacccgtgccgggcgccgcgcaggtgatccggttcggcgagacctcgttctacgagcgggcgcgccgcaagctccgggtcgagggcagcgcccaggccggcgactgggacaccggtgacgcggtggtggtcgacagcttcgagcgccagcggtatgaggtgctcgtcggcggcgaggtggccggcatgctgcactaccgccgccacggcgaccgcgtcgagctgctgcacaccgaggtcgaccaggccttctccggtcgcgggctggccggccggctggcctcggcggcgctcgccgacgcccggtcccggtccgtgccggtcaccgccacctgcccgttcgtggccggatacgtcgaacgtcaccctgagttgaccgagctgagctga

SEQ ID NO: 4407 - DNA, 1659 bp, Actinoplanes utahensis
atgggccaagccgcgattctgaccgtcgacgacgacccctcggtctcccgagccatcgcccgcgacctgcgccgacgctacggcgaccggtatcgggtgatccgggccgggtcggccaccgaggcgctcgacgtgctgaaagagctgaaactgcgcggcggtcgggtcgccgtcatgctcgccgactaccggatgccgcagatgaacggcatcgagttcctggagcaggcgatggacctgttcccgcacgcgcgccgtgccctgctcacggcgtacgcggacaccgacgccgcgatccaggcgatcaacctggtcgacgtcgaccactacctgctcaagccgtgggacccgccggaggagaagctctatccggtcctcgacgcgctgctcgacgcctggcaggccaccggcgaccaggagatgccggacatccggctggtcgggcaccggtggagcgagccgtccttccagatccgcgacttcctggcccgcaacctggtgccgtacaaatacttcggcgccgacgagccggagggccgccgcctgatggaggccgcggacgccggccccgagtcgatcccgctggtggtgaccgccgacgggcgggccctgccccggccgagcgtgcagcaggtggccgaggcggccggcctgtccaccaacccgggccgcgacttctacgacctgatcatcgtgggcggcgggccggccggactgggcgccgccgtctacggcgggtcggagggcctcaagaccctgctgatcgagcggcaggcggtcggcggccaggccggccagagctcccggatcgagaattacctcggcttcccggacgggatctccggcgcgcaactgaccgaccgggcccggcggcaggccgacaagttcgccgccgagacgctcaacacccgcgaggtggtggggttgcgcaccgacggctcggcccgcacgctgaccttcgccgacggtggcgaggtgtcggcacacgcgatcctgctggccaccggtgtctcctaccgtccgctggtcgccgagggcgtggccgggctgaccggctccggtgtcttctacggctcggccgccaccgaggggccggcctgcgcgggcagcgaggtctacatcgtcggcggagccaattcggccggccaggcggcgctcttcttcgcgagatacgcgcgcaaggtcaccctgctggtccgcggtgactccctcgaatcgtcgatgtcgtattacctcatccagcagctggcccaggtgtccaacatcgaggtgcggaccaggtgcgaggtgatcggcgcgcagggcgacgggcacctgcaggcgatcaccatctgcgacagcaagggcgggacgaaagccaccgtcgagtgcggctacctgttcgtcttcatcggggcggagccccgcaccgactggctcggcgacgcggtggaacgcgacgggaaaggcttcgtgcgcaccggctcggatctgctggcgaacggcacgcgtccgcggggatgggatcgcgaccgcgatccgttctatctggagagcagtgttcccggcatcttcgccgccggcgacgtccgggccaactcgatcaaacgggtggcctcggcggtcggtgagggcgcgatggccgtcgcgctggtccatcgttacctggaggcgcagtag

SEQ ID NO: 4408 - DNA, 1470 bp, Actinoplanes utahensis
atgaccatcgaagcggacgagatccagctccagccctgcgaaccggggcggctcaccccggccgagctgaaatcgctgttcctgttcgagaagctgaccgacgagcaactcgcctggatcgccgagcacggctgcaccatgcgggtcgccggcggcggcctggtgctgcgcgagggtgatccggccgaccagttcttcgtgctgctcagcggaacgatcgcactgacccgccgggtcgggcaggacgatgtgcagaccagccgcaccgagcagcgcggcgtgtacatgggcgccaccaacgcgtacctgcgcgacgacggcgtgccccagcggtacatggcgtcgatgcgggcgctttccgacgccgagttcttcgtgctctccgccggagacttcggccggctcatgcgcgactggttcccgatggcgatccacctgctggaaggcctggcgctggggatgcgcagctcacaggcggcgatcggcgagcggcagcggctgcaggcgctcggtgcgctctcggccggcctcatgcacgagctgaacaatccggccgcggccgccgcccgggccaccggagcgctccgtgaacgggtcgcggcgatgcggatgaaactcggcaaactggccaagggcaaggtcgcgcccgaccggctgaccgcgctgctggagctccaggaggaggtgatcgagcgggccgcgaaggcgcccgtgcgcaccgccatgcagatcgccgacctggaggacgagctcggcgactggatggacgaacacggcgtgaccagcggctgggacgtcgcgccggtcttcgcgcagggtggcatcgacgccgagtgcctcaccgagatcctggcccggctcgagtcacccgagctgctcgaccaggcgatccactggatcgggtacgcgttggagaccgagcagctgatgagcgacatcgaggacgccaccggccgggtgtcctcactggtcaacgcggccaagcagtattcgcacgtggaccgctcggcgcaccagtggatcgacgtgcacaccgggatcgacagcaccctggtgatgctcgcccacaagatcggcaacggggtccgggtggtgaaagactacgaccggacgctgccgcaggtgccggtccacccggctgagctcaaccaggtgtggaccaacctgatcgacaacgcggtacaggcgatgtccggggcgggcaccctcaccatccgcacctaccgggaggacgaccgggtcgtcgtcgcggtcggcgacaccggaccgggcattcccgacgagatcaagaaacgggtcttcgagccgttcttcaccaccaaaccggtcggtgaggggaccgggctgggcctggacatctcctaccggatcgtggtcaacggccacggcggcgacctgtccctgcagtccgcgccgggcgacaccaggttcctggtgcgcctgccgctgagcgagccggcgtcggcgtag

SEQ ID NO: 4409 - DNA, 402 bp, Actinoplanes utahensis
ttggccacggttgcggtggagacgattgtcgaccttccggcggcgcgcgtgtgggaggcgatcgccgacgtgggggcggtgcacgagcggctcctgccggggcgcgtggtggccgccgagatcgacgggggcttccggaccctgacgatgccgaacggggcgcggatccgcgagctgctcatcgcgatcgatcatgagctgcgccggttcgcctatgcggtggtcgaggggcagggattgccgttgacgtaccaccaggccgcttttcaggttttcgaggtggaggaccaggccaggatcgtctggacgaccgatctgctgccggacgcgctggccggagcggtccgtgcccgcgtcgaacgcggcatcgtggagatgaaagcggtcctggaagcagcgtag

SEQ ID NO: 4410 - DNA, 867 bp, Actinoplanes utahensis
atggcggagtatcgggccagtcagaccgcggtgctggtgtgccagggcagggccgcggcacacgatcggatcgcgcccggccggttcgccgacccgaccgcgtgggaactgctccgcgacgacgagcggacccaggtcgacctggtgcgcgagcagcggttgccggccgactggaacggccgggtcggctacgagatggtgctgcgctgcgccgagatgatggtgccgcgcacggtggcgatcgacgaggcggtccgggaacaccgtacgccgcaggtggtgatcctcggcgccgggctcgacggccgtgcctggcggatgcccgagctcgccgaggtggatgtcttcgaggtcgaccagcccgcgtcccagcaggacaaacgcgaccgcgcggggaagctgccggggcgggcgccggtgttcgtcccggtcgatttcggccgggaccgcctgggtgacgcgctggccgccgccggacatcgcgccgccatgccgaccacgtgggtgtgggagggcgtggtgccgtacctgacgccggaggaggtgaccaccacggtgcgggcgatcgcctcgctgtccccgtccgggagccgcctgatcaccaattaccagactaaatcagcatccgccgccttcggccgtttcgtggtgcaggggatggcccggctcaccggccgcgccaacccgtgggccgccgaaccgtggcggtcgacgtggcgcccggaaagcatgtcgcagctgctcacccggcacggattcaccgtcgtccgggacaaccacctgctcgacctggccgccggcatgatggccgccacaccggacacgatctccttccgcaccagccgggtcacggtcgccgacatctga

SEQ ID NO: 4411 - DNA, 504 bp, Actinoplanes utahensis
atggacgtcacaggcctgctcgacgacgcgtacggccggctgcccgcaatggtggaatccgcggttcagggcctcaccccggagcagctgcgctgggcgccggcgccgggggccaacccgatcggctggctggtctggcacctgacccgggtccaggacagccacctcgccgagctcctggacaccgagcaggtgtacgtcgagggtgactgggcggggcgcttcggccgcaagcccgacccgtcggacaccggttacggtcacaccgcggcggaggtggcggccgtggttccggagagcgcggccgcgctcatcgagtactaccatgccgtacacaagcggaccgtgaactttgtgcgaggcctgaccgaagcggacctggaccggatcgtcgaccgcagatgggatccgccggtgaccctgggggtccggctggtcagcgtgtacgacgatgacgcccagcatgccggacaggcggcatatgtgcgggggctgctgtcctga

SEQ ID NO: 4412 - DNA, 729 bp, Actinoplanes utahensis
atgaccgagcgcgcgcaagcccggatctgggacggcatcgacatcccgaagaccatcgccggcaccctggccgcggtctccgccgcggtgatcggatccttcctcggtgtggccggcaccctggccggcgcggccctggtcagcctgatcagttcggtcggcaccgagatctaccggcatttcgtgcaccacggcacccggaagctgcaggccgcgttcgtgaccgcgccggccgccatcggcacccccgaggtggccgcggccccggccgcaccggccgacgcgccggccggcccgtcccggcggatccactggaagcggatcctgctcgtggccggtgcgctgttcctgctggcgctgggcacgctgaccacggccgagctgctggccggccgctccgcggcggatgccacgagcgggcgggacagcggggcgccgaccgtgttccactggagcggtaggcacaccaccgacaaaaagcaggctccggcaccttcgccctccaccactgcgaccggttccgatcagacggccaagcccgccgggaccaccgcccccgcggattccggccccggcccgaccgcgacgacgaaggcaccgcagccggagcagaccggcggcaccgggagcaccccggggtcggacacggcgaccgcgggcaccggtgatggtgctggtgccgacactcagcagaattccgagcagcactccgaccagcagggagactga

SEQ ID NO: 4413 - DNA, 1347 bp, Actinoplanes utahensis
atgtccctgcgacccggagcccgggcctgggcggtgtgggccgccggcctcgccgcgtacgtcatcgccgtcctgcaccgcacctcgctgggcgtggccgggctggacgcgcaacaccggttcggtgtcggcgccggcaccctggccagcttcgccgtgctgcagctgctggtctacgccggcctgcagatcccggtcggcctgctcctcgaccgtttcggatcactgcgcctggtggtctgcggcggcctggtgatggccgccggccaggtcctgatggcgaacgcccacgggatcaccggcgcggtgctggcccgcatcctggtcggcgccggcgacgcgatgaccttcatcagcgtgctgcgcctggtcccgcactggttcccgccccgccgggtgccggtgctgacccagctcaccggcctggtcgggcaggccgggcagatcatctcggcgatcccgctggccgccctgctggccggcccgggctggcgcaccgcgttcctcagcgccgccggcgcgggcgtgttcgtcgcgctggtcgcgctggccgccctgcgcgacaccccggagcgccggatgagcagcggcagcccggtcagcatgcggcagctcggcgccgacctgagcggcgcctggcggcacccgggcacccggctcggcctctggacccacttcaccacccagttcaccggcacggtgttcgccctcatgtggggcatcccgttcctgatcgccggtgaggggctgacccgcggcgaggccggatcgctgctcaccgtcttcgtgatcaccggcatggcggccggcccggtgctcggcacgctggtgcagcgctacccgctgcgccggtcgctgctggtgctcggcatcatcgcggtgaacctgggcgcctgggcgctggtcctgctctggcccggccgggcgccgctgccggtgctgatcctgctggtcgtcgctctcgggtcgggcggtccgggctcgatgatcggcttcgactacgcgcgcaccttcaacccgccgcaccgcctgggcaccgcgaccggcgtggtcaacgtcggcggcttcgtcgcgtccctgctcaccatcgagctgatcgggctgatcctggacgcccgcaccggtgggagtgccgactatcacatcgccgacttccgggtcgcgatgtcggtgcagttcctggtggccgcggccggtctgaccggcatcctgcgcacccggaaactggcccgtcgccggctggagcaggaggaaggcatcgtgatccggccgctgcgcgtggccctcgccgaacgacgggttttggccgcctcccgagcggtgaaggaggagggctggcgcgactga

SEQ ID NO: 4414 - DNA, 300 bp, Actinoplanes utahensis
atggtggtaaccccaagtgccgcggaggtgcgtgcgatgccgaagatcaacgtgtatctgcccgacgagctggccgaggcggtccgggagaccgggctgccggtatcggcgatctgccagcgggccctggagcaggcggtgcgccgggtgaccgcgatccgggagacctcactgggcgagctgtccagcggcgacctcgaggaacgcttcccgctgatgaccggccgtacccggaccgtgctggccctggcggtcgagcgcgcccgggcttcggccgcccgggccgcggcggccggctag

SEQ ID NO: 4415 - DNA, 1827 bp, Actinoplanes utahensis
ttgcgtcagcgtgacgacgtcgccgtgctgccggccttcaccgagatctcgtcggagatcgccggcaactggtcaccggccctctccccggacgggcggcacgccgcctacgtctccgaccgcggcggcaccccggccgtccgggtgcagccggtcggcagcgaccgggccttcgcgatcaccttcccggagccggtcgccgcggtcgcctggtcctccggcgggggctggctggcctgccggctgacccccggcggcgccccgcgccacgaggtctggctggtccgcccggacggctccgacccgcaccaggtcgccggtttcggcaccgacaccgcggagaacatgcgctggctgcccggccgcccgctgctggccgtcaccgagaacctcacccacgccctgctggtcgacgcggtcaccggcacccgcaccgtcgtcgccaccggcgacctgatctcgctctgcgacatcgacccggcgggccgcttcgccctgctgcggcaggggccccgcggcgcccgccggatcctctgcaagaaccttctcgccggtacgtcggagaccatcgcccccggtgagctggctctgttcagcccgggcggcgggtgcgtctacgcccgcagcgaggcgggcgagttcccggccctgatccgcgccaccgccggaacggtggaaacgctgaccaccgagccggtcgaactcgaaaccttcgcgatcacggcggacggccgcaccgccgccctgctctggaacgtgcgcggcggcgaatccgccctcgaactgcgcaccctcgaccacgtcgtcccgccggcctcctcccccacgggccgcgctttcgagcccaccgtgggaacgacgacgcggtcggtcaccgtgccgctgcccgggacggtgatctccgagccggtctggagtttcgacgggtcgacgctcgccttcaccgcggagagcccgggacagccgcagggcgtctgggcctgcgaccgcgacggtggcaacgtccgcccgatctccgccgagccggccgcccccgacgcggtccgtcccacgctggagaaggtcaccgcccacgacggcctcaccctgaccggctggctgttcacgccgccgggtggcaccgctgcgcatcccacggtgatctggctgcacggcggcccggaagcgcaggaacgccccgggcacggaccgctcttccaatccctggtccgccgcggcatcgcggtgttcgccgccaacgtccgcggatcgtccggcttcggccacaccttcgtgaacgcggacaacggggcgctgcggtacgacgcgatcgaggacgtccggtcctgcgcccgccatctgcgcgactccgggatcgccgggcggctcggcgtgatggggcgctcctacggcggctatctgaccctggccgcgctgtgcgcctacccggatctgttcgcggtcggcatcgacatctgcggcatgtccgactttgcgacgttctatcgctataccgagccctggatcgccgccgcggccgtcagcaagtacggcgacccggtggccgacgccgacctgctgcgcgacctctcccccgtgcaccgcctggaccacctgcgggcgcccctgctgatcatccacggcgagaacgacaccaacgtgccgctgatcgaggccacccaggtggccgagtccctcgccgcccgcggcgcaccgcaccgcctcgtcgtcttccccggcgagggccacgacctgctgcaccgctcgtcccgcgccgccttcctgcaggagaccgtcacctggctcaccacgcatctgtcaggtgatcagcggagccggcacgaatag

SEQ ID NO: 4416 - DNA, 1773 bp, Actinoplanes utahensis
atgtgcggaatcgccggtgagatctgttacggggagcgcgtcgcggacaccgacgcggtccgccggatgctgcccgtgctgcagtcgcgcgggccggacggcgagggcgtgtgggagcacgggcggatcgcgttcgggcaccggcggctgcggatcatcgacctgagcgacgccgggcggcagccgatgaccgacgacgtgctcgggctgaccgtggtcttcaacggctgcgtctacaactaccgggagctgcgcgaggagttgcgcgggcacggatacacgttcgtctccggctcggacaccgaggtgatcctcaaggcgtaccaccggtggggcgccgactgcgtcacgcacctgcacggcatgttcgccttcgcgatcgccgaacatgacaccggcaccgtcaccctggcccgggaccggctcgggatcaagccgctctacctcgccgagacgcccgggcggctgcgcttcgcctcgaccctgccggcgctgctggccgccggcggggtggacaccaccatcgaccgggtggcgctgcagcactacatgacgttccactcggtggtgccggcgccgcggaccatcctgtccgggatccgcaaactgcccccggccacggtccgggtgatcaaggccgacggtacggggtcggaacggacgtactggtcagccgcgttcacccggaccgctgaccgctctgccggcgagtgggcggaagcggtccgggagaggctgaacatcgccgtgaaacggcgcatggtggccgacgtgccggtcggcgtgctgctctccggcggtctcgactccagcctggtcgtcgccctgctcgccgagcagggccagcgggatctcaccacgttcagcatcggcttcgaggcggccggcggcgagagcggcgacgagttcgcctactcggacctgatcgccaagcagttcgggaccgagcaccatcagatcaggatcgggcacgaccgtttcctgccggccgtcgaccggacggtggcggcgatgagcgagccgatggtcagccacgactgcatcgccttccacctgctcagcgaagacgtcgcgcagcatgtcaaggtcgtacaatcagggcagggcgcggatgagatcttcgccggatacagctggtatccaccgctcgccggggtgccgcgcgagcaggccgccgaggcgtatgcgcgggagttcttcgaccgcccgcacgcggcgctgcgcgggcagctcaacccggcctggatgctcgaccgcgaccacgccgccgccttcgtcgcggagagcttcgcccggcccggcgcggacaccgcggtcgacgcggcgctgcggatcgactcgcaggtgatgctcgtcgacgacccggtgaaacgggtcgacaacatgaccatggcatgggggctggaggcgcgcgtcccgttcctcgaccatgagctggtcgaactcgcggcggcctgcccgccggagcacaagctggccgcggacggcaagggggtgctcaaggacgcggcccgcgggctggtgcccgacgaggtgatcgaccgtccgaagggatacttcccggtccccggcatccggcacctggaaggcgcgatgctggaccgggtccgcgacgccctgcacgccccggccgcccgggcccgggccctgttccgcccggagtacgtcgaggcgctgctggccgaccccaacacgccgcggacgacactgggcgcgaaccagctgtggcagctggcgctgctggagatgtggctgcaggacaagaacatctga

SEQ ID NO: 4417 - DNA, 2631 bp, Actinoplanes utahensis
atgcttggcgacgaccggaaatgggcacgtgacacatctgccacacccgatcggaacgctgagcggacttccgaactgaaggcggtagcaatggcggagtccctgaccctgggcgcggaggaggagctgcacgtcgtcgatgtgacgacgcgcgagctcaccccgcgggccccggagatcctcgaccgactcgacccggcgcacttctcggccgagctgcaccgctcggtcgtggagaccaacacgccggtcaccaccaccctggacggtctgcgcgaaggcatcacgcagcgtcgccggaccgccgtggcggtcgccgagtcgctcggcctcggcctggtggcggccggcaccgtgccgctggtcgacctggacgcgctgccggtcaccgggaccacccggtaccgccggatgctgcacgaataccagatgctggtccgtgagcagctgatctgcggcgcccaggtgcacgtcggggtgccggaccgcgacgaggcggtctcggtggcgcagcgggtcgccccggccctgcccgccctgctggcgctctccgccagctcgccgttctggatgggcgaggactccgggtacgccagcgtccgctcgctggtctggatgcgctggccgaccgccggcgacagcggcgtgctgcactccgcggccgagcacgagcagctggtcagcgacctgatcgcgtccgagacgatcagcgacccgaagatggtctacttcgacgtccggccgtccgcgcacgtgcccaccgtggagctgcgggtcaccgacgcctgcccggatgtggacaccgtggtgctgctggccgggctgttccgcgccctggtccggcgcgcccagcacgagcaccgcgccggcgtcccgctgccgcccgcccgtcccccgctgcaccgcgccgcgatgtggcgggcggcccgctccggcctggagggcgacctgctcgacctgccccgcacgccggcgccggtgccggccaccgtcgcgatcgagcacctggtcggcgagctgcgaccgcacctggaggagctgggtgactgggagcaggtctgcgacctgtccgcccgcgcgctgagccggggcagcgcggccgcccggcagcggcgcgccctggcccggcgcggccggatcgccgacgtcgtcgatctgctgatcaccgatacccggggcacggcggcggcctccgttgccggcggcggcctgtccgggcccgatcgattgctgccgtacgacgtggccggcgacgaggcgttcccggcggagtcggtggcccccgagtacgccgaggtgctgccggtgctcaccgcgctcggcgcgaccgggctgcgcaaacgcgaggacgcgcgggacgaggagcagcgcgccaacggggtgaccttcagtgtggccggcgaggcggccacccggctgttcccgttcgacctggtcccccggatcgttccggccgccgactgggccgagctgcgggccgggctgacccagcgggtccgcgcgctcaacgcgttcctctccgacgtgtacgacgaccgggcgatcgtcgccgagggcatcgtcccggagtgggtgatcgacggctcacccgagctgcgggccagcggcgcgctgatcggcggcggcgcggtgcgcgcccaggtggccggcgtcgacctggtccgggacgcggacggcggctggtgcgtgctggaggacaacctgcgggtgccgtccggcatcgcgtacgccatgcagaaccgccggctgaccgagagcatcctgcccgagctgccccggccgcggaacctgaccccggtcgaggacaccccggccctgctcaaggatgcgctgctcgccgcggccgggccggccgccggcgacgacccggcgctggtcgtgctcagccagggcccggaggactcggcctggttcgagcaccggatgctggccgaggcgatggacgtgccggtggtgcgcaccaccgagctgttcgtcgacgggggccgggtgcaccggctgcgcgacggcaagcgctatccggtcgacgtgatctacctgcggatgggcgaggacagcctggtgcacgcgccgggcgcggacgggatgccgctgggccccagcctggtggcggcgctgcacgcgcggaccgtgacactggccaacgcgctgggcaacgggatcggggacgacaaggcggtctacgcgtacgtcagccggatgatcgagttctatctgggtgagaaaccgctgctcgccgatgtgccgacctacctgtgcggggtcgccgagcagcgcgccgaggtgctgtcccggctggacgagctggtctgcaagccggtcgacgggtacggcggcgaccggatcgtgatcggcccgcacgccaccgccgacgagctggacgcgctgcgccggcagatccgcgccgccccgcaccggtgggtcgcgcaggacctggtccggctttccacccacccggtcttcgacgggcagcggctcgcaccccggcacgtcgacctgcgcgcgttcgtcttcaccggccgacagcccgtggtcgccccggcggcactgacccgggtcgccccggccggctccatgatcgtcaattcgtcccggggcggcggctccaaggacacctggttgctcagttga

SEQ ID NO: 4418 - DNA, 1071 bp, Actinoplanes utahensis
atgggcaacgtcgtcgtcatcaccgggtcggccggtctgatcggttccgagtcggtccgtcacttcgccggtctgggcatggacgtggtcggcatcgacaacgacatgcgcggttacttcttcggcgccgacgggtccaccaagtggaacctggagcggctgaccaccgagatcggcccgcgctacacccactactcgctggacatccgcgaccgtgaggggctcggtaagatcttcgcggagtacggccggagcatcggcctggtgatccacgccgcggcccagccgagccacgactgggcggcccgcgagccgttcaccgacttcgacgtgaacgcggtcggcacgctcaacatgctggaggcggcccgccggcacgcgatcgacgcgccattcatcttcacctcgaccaacaaggtgtacggcgacacgcccaactcgctgccgctggtggagctggacacccggtgggagctgcccgaggaccacaagtggttccagggcatcgacgagacgatgacgatcgacaacagcctgcactcgatcttcggcgccagcaaggtggccgccgacgtgatggtccaggagtacgggcggtacttcgacatgccgaccgcggtcttccggggcggcacgctgaccgggcccggccactcggccgccgagctgcacggcttcctcgcgttcgtcatgcgctgcgtgatggagcagcggaaataccggatcttcggctacaagggcaagcaggtgcgcgacgcgatccactcgcacgacctggtgtccgcgttcgaggcgttccaccgggcgccgcgggtcgccgagatctacaacatgggcggcgggcgcacctcgaactgcagcgtgctggaggcgttcgcgctggcctcggagatcgccgggctgccggccgacaccgagtacgtgccggagaaccgggtcggcgaccaccagtggtgggtcagcagcaccgcacggttcgaggagcactacccggactggaaggtgacgtacgacgtcccgatgatcctgcgggacatgtacgagtcgaaccgggacgtctggaaagcctga

SEQ ID NO: 4419 - DNA, 1134 bp, Actinoplanes utahensis
gtgagcaggtcgacgagcaccaccccggacgccgtcaccagatacgccggcagctcccggtgccgggcgtgggtgcggatctgcgccggatcgatcagccggaccccgaccacgatcagtaccgcggccagcaccgccatcgggatggtctccagcagcgccgcgcagaacagcacgaagactgcgatccacaccccgtgcaggatcgccgacgcccggctgcgcgcgcccgccgccacgttggtcgagctgcgcacgatcaccccggtcaccggcaggccgccgagcagtccggagagcgtgttcgccgcaccctgggcgacgagttcccggttgagccgggcgcgcggcccgtcgtgcatccggtcgaccgcgaccgcggacagcagcgactcgacgctggcgaccagcgcgatggtgagcaccgcgacggtgatccggcgcagcggcgcgtccggccagatcggcgtgatcagctcggcgagcggttcctcgggcaggtcgacccggaccacgccggcgcccagcacccaggccagcgcggtcaccgcggcgaccgccaccagcgcggcgggtaacacggtgatcttcacgaagcgcggccagagcagcagcaccgcgatggtgagcagacccagcagggtggccggggcgtggtggatggcgacctggccggggagctgccgcaggttgtcccaggcgttgctgtgcggcgcgccgccgagcagcacgtggatctggctgagcgtgatgaccaggccgatgccggccagcatgccgtgcacgacggcgggtgacagggcgagggcggcacggcccagccgggagatcccgagcaggatctggaccaggccggcggccgccacgatcgccgcggtgccggcgaagccgaattcggcgaccgcgccggccacgatcacggtgaggcccgcggccgggccactgacctggagcggggcgccgccgagggcacccgcgacgatgccgccgacgaccgcggcgaccaggcccgcgagcagcggggcgccggacgccgcggcgatgccgagcgagagtgggatggcgatcaggaagacgacgacggacgccggcaggtcccggcgcagcaactgcgtcagtacggacattaggtaa

SEQ ID NO: 4420 - DNA, 1197 bp, Actinoplanes utahensis
atgtccgtactgacgcagttgctgcgccgggacctgccggcgtccgtcgtcgtcttcctgatcgccatcccactctcgctcggcatcgccgcggcgtccggcgccccgctgctcgcgggcctggtcgccgcggtcgtcggcggcatcgtcgcgggtgccctcggcggcgccccgctccaggtcagtggcccggccgcgggcctcaccgtgatcgtggccggcgcggtcgccgaattcggcttcgccggcaccgcggcgatcgtggcggccgccggcctggtccagatcctgctcgggatctcccggctgggccgtgccgccctcgccctgtcacccgccgtcgtgcacggcatgctggccggcatcggcctggtcatcacgctcagccagatccacgtgctgctcggcggcgcgccgcacagcaacgcctgggacaacctgcggcagctccccggccaggtcgccatccaccacgccccggccaccctgctgggtctgctcaccatcgcggtgctgctgctctggccgcgcttcgtgaagatcaccgtgttacccgccgcgctggtggcggtcgccgcggtgaccgcgctggcctgggtgctgggcgccggcgtggtccgggtcgacctgcccgaggaaccgctcgccgagctgatcacgccgatctggccggacgcgccgctgcgccggatcaccgtcgcggtgctcaccatcgcgctggtcgccagcgtcgagtcgctgctgtccgcggtcgcggtcgaccggatgcacgacgggccgcgcgcccggctcaaccgggaactcgtcgcccagggtgcggcgaacacgctctccggactgctcggcggcctgccggtgaccggggtgatcgtgcgcagctcgaccaacgtggcggcgggcgcgcgcagccgggcgtcggcgatcctgcacggggtgtggatcgcagtcttcgtgctgttctgcgcggcgctgctggagaccatcccgatggcggtgctggccgcggtactgatcgtggtcggggtccggctgatcgatccggcgcagatccgcacccacgcccggcaccgggagctgccggcgtatctggtgacggcgtccggggtggtgctcgtcgacctgctcaccggagtggcgctcggggtgctgaccgcggtggcgtggcggcgtgcgtcacggctggcggtcggatcctga

SEQ ID NO: 4421 - DNA, 996 bp, Actinoplanes utahensis
gtgaccaaacgtcttgccgaggtggcgaagaaggccggggtcagtgaggcgaccgtcagccgggtgctcaacgggcgcgacggcgtctccgaggccacccgggcgtcggtcctgaccgccctcgatgtgctgggctacgagcgacccaccaagctgcggggggagcgggcccgcctggtcggcctggtcctccccgagctgcagaacccgatcttcccggcgctcgccgaggtggtgaccgcctcgctggcccagcgcggcttcaccccggcgctgtgcgcccgcacgatcggcggcgtccccgagtccgactatgtcgagatgctgctcgaccatcaggtctccggcgtgatcttcgcgggcggctcctacgcgctggccgacgcctcacacgagcactaccgccggctgaccgaccgcggcctgccggtggtgctggtcaacgcgggcgtcgacgagctgggcttcccccgggtgtcgacggacgacgcggtggcggtcgagcaggccttcgggcatctgcggtcgctgggccacgagcggatcggcatggtcctcggccccgaggggcacatcccgtcgcgccgcaagctgacctcgatgatccaggtggccggctggaccgacgacaagtgggtggagcgctccagcttctcgatggagggcgcccgggtcgccgcggccaagctgatcgagcgcggcgcgaccgggatcatctgcgccagcgacgtgatggcgctgggcacgatccgggcggcgcgccggctggggcatgccgtgccggctgacgtgtcggtggtcggcttcgacgactcggcgttcatgacctgcaccgatccgccgctgaccacggtgcgtcagccgatcgagacgatgggccagtccgccgtcgacctgctggtcacgcagatcgaggaggcccgggtggtgcgcgacgagctgctcttcgagccggagctggtggtgcgcgggtcgaccggcccggctccgcggtga

SEQ ID NO: 4422 - DNA, 1380 bp, Actinoplanes utahensis
atgtccgcaccgcagtaccggaaggccgtggcgttcgcgctcgcggccggcctgggactcagcctcgcggcgtgctccacgaagagcgacgacgagagcaccagcgccgacggcaagacgaccatcacggtggactgcatgccggtcggcaccgagaaggagctggtcgccaactggaacgccgacgtcgccgccttcgagaaggcgaacccgaacatcacgatcaagagcgtgagcgtcggcacccagtgcaacaacccgccggacttcaccgcccggctggccggtggcaccaccaccgacgtcttctacggctacatgaccgacctgcagcaggtgctcgactccggccaggcgatggacatcaccccgtacctgaccgacgagaacgtccccacctggaaggacgtcgacccggcgctcaagcaggtgttcaccgacggcggcaagacctacgcgctgccgatcaagaactactcgatgggcctggtctacaacacggtgctgttcaagaaggccggactggacccggcgaacccgccgaagacctgggccgaggtccgcgccgcggccaagaagatcgtcaccgccgacccggcggtcgccgggtacgccgactacagcgccggcaacaccggtggctggcacttcaccgccgagctgtactcgcagggcggccagatcctgacggccgaccacaagaaggccgacttcaacaacgcgatgggcaagcaggtcctgcagaacctcaaggacatgcgctacgccgacaacagcatgggctcgcgccagctgctgcagtggggcgacctgctgaccaacgccgcggccggcaaagtcggcatgttcatcggcgcgccggacaccacccagcagatcgtctcccagttcaagggcaggtactcggactgggcggtcgctccgctccccggccaggacggcctggccaaggccaccctcggtggcggcgacggctacttcttcaagaagggcctgaccgacgcgcagatcaaggccggcctcaagtgggtcgcctacgagaagctgacggtcggcaagggccagttcgactatccgcgggccaagccgcagaactacccggtgggcctgccccagccgctgctgttcaccagggacagcgcgaccgcgaaggccgagttcgacctgcgcaaggcgaacgccaacgtcgacccggcgatctactcgctcttcgaggcgcagcagctcccgatcaagggcgagccgaccaacgcccaggcgatctacgcggtgctcgactcggcgatgtccggagtgctgaccaacccgaacgccgaccccggcgagctgctcaagaccgccgagcagaaggtcgaccagctgctcgccgccggtagctga

SEQ ID NO: 4423 - DNA, 948 bp, Actinoplanes utahensis
ttggcgaccatcaccgccccgggcacgaccggcaagccggccgcccgcgtcgtccaggcccggaccggcgcgcggcgcagccgcaagatccgcgacaacctcaccgggtacgtcttcctgatcggcgcgatcctctgcttcgccctcttcacctggtatccgatgatccgcgggatcatcatgagcttccagaagaccaggcgcggcgtgaccacctgggtgggcttcgacaactacacccggatcatcgccgacccgagcttctggcccgcctggcgcaacaccgtctacttcaccgtgctggccctggtcatcgggtacgcggtcccgttcttcgtggcgatcctgctcaacgagctccggcacgccaagggctatctgcgggtcctggtgtatctgccggtcatgctgccgccggcctcggcgttgttcctgttcaagttctacgcgtacgacccgggtgacgccggcctgttcaacgcgatcctcaagttcctgcacctgcccacctcgcagtggatgcagtcaccgagcgccacgatgccggccatggtgatcgcctcgacctggatgaacatgggcagcgcggtgctcatctacctggcgtcgctgcagaacatcccgggcgagctgtacgaggcggccgagctggacggcgccgggctctggcgccggatctggaacgtgacgatcccgcagaccaggctgatcctcgggctgctcgcgatgatccagatcgtcgccaccatgcaggtgttcatcgagccgctgatcctggccaacggggccggcacgcaggactcggcgaccaccgtggcgtacctgatctatcagcacggcttctaccagaacgacctcaacggcgccgccgcactcggggtgatcatcctgctggcgctggccgccttctcgggtgtgtacctgcggctcaccacgaagaacgactga

SEQ ID NO: 4424 - DNA, 888 bp, Actinoplanes utahensis
atgtctcaagattccggcacccggacgctcgtctcgcaggcgcagctgcggcggggcaggggcaggtacgtctactggacgctgctcggcctggtcgtcctggcgttcaccctggtcttcatcggcccgctgtactggatggtgaccggcgcgctcaagaccggtcaggaggtcgcgcagaccccgccgaccctctggccgcggcacccggacgccagcaactacaccaacgcgtggcagaacctgaacctcggcaagctgctgttcaacacgttctactacgcgatcggcgcggtgctgttccagctggtcttcgacaccgcggcggcgtactcgctgtcgaaactgcgcccggtgctgggcaacgtggtgctcggcgcgatgctggccaccctgatgatcccggtgatcgtgctgatcgtcccgcagtacgtgaccgtgatcgacctgccgttcgtgcacaccagcctgatcaaccagccgctggcgatctggctgccgctggtggccaacgcgttcaacatcttcctgttgaagcggttcttcgactccatcccggaggacctgatggcggccgcccaggtggacggcgccggcccgttgcgcacgctctggtcgatcatcctgcccatctcccgcccgatcctcggcgtcgtctcgatcttctcggtgacctacgtctggaaggatttcctctggccgaagctggtcatgccggacccgtcgacccggaccgtgagcgtgggcatcgtggccttctccggtggctcgtcggtcaacgaggtgatcgccgcctcggtgatcgccgccgtcccgaccgtgatcattttcctgatcttccagcgcaacatcatgtccggtctgaccgcgggcagcgtcaagggctga

SEQ ID NO: 4425 - DNA, 1560 bp, Actinoplanes utahensis
gtgtccgcaaaagacagtgcgtggtggcgcgacgcggtcatctaccaggtgtatccccggagtttcgccgactccgacggcgacggcgtcggtgacatcaacggcatccgcgcccgcctgggccacctccgcgacctcggggtggacgcgatctggatgagcccgtggtacccgtcgccgatggcggacgccggatacgacgtggccgacttccgcgacgtcgacccggtcttcggcaccctggccggcgccgaggcgctgatcgccgaggcgcacgcggccgggatccggatgatcgtcgacatcgttccgaaccacatctccgccgagcacccgtggttcagggcggcgatcgccgcaccggacgcgcccgagcgggactacttctggttccggcccccgtccgaacggatgcccaccggctggacgggggagttcggtgggaccacctggacgaaggcgccggacggctcctggtacctgcacctgttcaccccggaacagcccgacctcaactgggagcacccggacgtccaggccgagttcgaggacatcctgcggttctggttcgaccggggcgccgacgggatccggatcgactcggccgcgctgctgttcaaggacaccacgctgcccgaggtcgaggagggcaggccgcacccgttccacgacctggacgcggtgcacgacgtctaccgggcctggcggcgggtcgccgacgactacgagggccgggcgctgatcggcgaggtctggatgccggacgtcgagcggttcaccaactacctgcggccggacgagctgcacgcggcgttcaacttcgacttcctcggctgcgcctgggacccggccctgctgcgctcctgcatcgaccgcaccctggacgcgcatgtcaaggtcggcgccccggccacctgggtgctctccaaccatgacgtcacccggcacgtcacccgctacggccggaccgacaccacgttcagcttcgagaacaacctcgacggcaccccggtcgacctggagctcggcacccgacgggcgcgggcggccgcgctgctctccctgtcgctgcccggcgccacctacgtctaccagggcgaggagctgggcctctgggagaacgagaacatcccggaagaacagatccaggatccgatgtacgggcggcgcgggcacacccgggacggctgccgggtgccgctgccctggtcgggcgacgaaccgccgttcgggttcagcagcaccgacccgtggctgccccagccggccgagtggaaggaccgcaccgtggcggcgcagaccggcgacccgaactcgatgctggagctctaccggtcggccatccggctccgcggtgagcatctcgacgaccccgcgatgacctggttcgaccacggcgacgacgtgctggcgtaccaccgcggcgccgatttcgcctgcctgctcaacctctccggcgcacccgttcggctgccggagcaccagaccatcctgctcgccagcggcccgctcgacggtgacctcctcccccgggacaccgcgatctggctgcgcctctaa

SEQ ID NO: 4426 - DNA, 2268 bp, Actinoplanes utahensis
atggccaaccgcaccgccccactcctcaccgcagccgtcgtcctcgcggccgcggtcaccacggtgatgtggcaatcacccgcggcgcaagccgccggactgtccccgttcgacgtcgccggacggggcgccaccgtgccgttcaccgagatcgaggccgagaaggccgcgaccaacgggacctccaccggcaccgaccgcacctacggcaccctgtcctcggaggcctccggtcgcgaggcggtcaccctcgacgccgcgggtgaatacgtcgagttcaccctgaccgagccggccgacgcggtcaccttccggtacagcatcccggacggcagaaacgcgtcgctggacctgcgcaccggctcgacgctgatcaggacggtcccggtcacctcgaagtacagctggtactacgggtactacccgttcaccaacaaccccggtgacggccgcccgcaccacttctacgacgaggcccgggcgctgttcggcaccacgtatccggccggcaccaagatccggatccaggtcggctccaccgcgcagtcgcccagcttcaccgtcgacctggccgacttcgagaacgtgccggacccgatcggcaagcccgccggcgccatcgacgcggtcgccgactacggcgcggaccccaccggggccaccgactccaccgcgaagatccaggccgcggtggacgcgggcagcgcctccgggcgggtggtctacgtcccgccggggaactacacgctgtacagccacgtgatcgtggaccgggtgacgctggccggggcgggtccctggtacaccgtgttcggcgggcggcaccccacccagcggaacctggcggccggcatctacggcaggtacgccaaccagggcgggcccagccggaacgtgacggtcaaggacctcgcggtgatcggcgacatccaggagcgggtcgacgaggaccaggtgaacgcgttcggcggcgccctgtcccattcgacgctggacgacgtgtggatgcagcacaccaaggtcggcgcctggatggacggcccgatggaccggttcaccatccggaacagccggatcctggaccagaccgcggacggcgtgaacttccacatgggcgtcaccaactccacggtgaccgacaccttcgtccgcaacaccggtgacgacggcctggccatgtgggcggagagcaccccgaacgtgggcaactcgttcacccacgacaccgtggtggccccgatcctggcgaacaacatcgtcagctacggcggccgggacatcacgatcagcgacaacgtgatggccgagaccgtcaccaacggcggcggcctgcacgtcgccaaccggtacccgggcgtgcagggccccaccgcggtcgccggcacctggacgctggcccgcaacaccctgatccggaccggcaactccgactacaactggaacttcgggatcggcgcgctctggttctggcccgactccggggcgatcaccggtgcgaccctgaacgtcaccgacaccgacatcctggacagctcgtacgccgggatccagtggatcggcaacggcaccagcgggctcaccctgaccaacgtgaccatcgccggggccggcacgttcgcgctgcaggtacaggcgccggccaccgccacgttcaccaacgtgacggcgaccgggatcgcgcagaacccgccgacatacaactgcaccggctccgggctcgcgatcaccgacggcggcggcaactccggctggcagacgccggcgccgtactgcgggccgtggccggcgccgcggtggggcaacagcaccaggcccccgccgacctcttctcccacaccttcgcccccggcgaacggcaacctggcgcagggcagggcggtgaccgccacgtcggccaacgggccgtacgtcgcggcgaacgcggtcgacggcaacgccgccacgtactgggagagcgccaacggcgcgttcccgcagtcgatcaccgtcgacctgggccagaaccgcacgctcgcccgcgtcgtgctcacgctgccgcccgcgacggcctgggccacccggaccgagacgctgtccgtcctgggcagcaccgacggctccaccttcagcacggtcaaggcgagcgccgggtacacgttcgacccggccggcggcaacaccgtcacgattccggtgaccgcgacctcgcgctacctgcgactcaccttcacggggaacaccggctggcccgcgggtcagctgtccgaactcgaggcctacgcctcctga

SEQ ID NO: 4427 - DNA, 3819 bp, Actinoplanes utahensis
atgtccagattcaggctcatagccgcagcggcggccgcgagcgtggtcgcggcactcgtccacgcccccgcggcgctggccgccggccccaacctggccgccggcaagaccttcagcgccagcagctacaccgacgtctacccggccggcaacgccggggacggcaacgccgacacctactgggagagcagcaacaacgccttcccgcagtggctgcaggtcgacctcggcagtgccaccccggtcaaccaggcggtgctcaagctgccgccggccaccgcctggaacacccgcaccgaaacgctgtcgatcaccggcagcaccgacggcaatgcgttcagcacgctcaaggcgagcgccggctacaccttcaacccgtcctcgggcaacacggtgaccgtcgacctcaccacggtcagcacccggttcctgcggctgaacttcaccgcgaacaccgcgtggccggccggtcagctctccgagctcgaggtgtacggaccggtcagcggcgacagccaggcgcccagcgcgccgtcgaacctgacctggacccagccggccagcgggcagatccggctgaactggaacgcgtcgaccgacaacgtcggcgtgaccggctacgacatctacgccaacggccagctccgcacctcggtggccgggaacgtcctgacctacaccgacagccagcccgactcggcgaccgtggcctactacgtccgggcccgggacgcggccggcaacgtgtccggcaacagcaacgcggtgacccgcaccggcgcgaccggggacacccaggcgccgaccacgcccggcaccctgtcctacaccaccccggcgagcgggcagatccggctcagctggggcgcgtccaccgacaacgtgggcgtgaccggctaccacgtgtacgtcaacgggacgctgaagacgacggtcaccggcaccacgtacaccgacagccagcccgacaccgcgaccgtcgcctactacgtgaaggcgcgcgacgcggccggcaacgagtcggcggccagcaacacggtgacccggaccggcgccccacagaccggcaccaacctggcggtcggcaagccgatcgaggcatcctcgacggtcttcacgttcgtcgccaccaatgccgacgacaacgacaccgccacctactgggagggcagcgcgtacccggcgaacctgaccgtgaagctcggcgcgaacgccggtgtcacctcggtggtggtcaagctcaacccgtccagcgactggggcacccggcagcagacgttcgcggtgctcggccgggaacagtcgtcgtccgcgtacaccaccctggtcggttccacgacgtacaccttcaatcccgcgaccggcaacacggtgaccatcccggtcaccgcgaccacggcggacctgcggttgtccttcaccgccaacaccggcgcgcccagcggccaggtcgccgaactgcaggtgatcggcacgccggcgccgaaccccgacctcaccgtcaccggcatcaccaccgcgccggcctcgccggtcgagaccgacgcgatcacgctgtcggccacggtccgcaacgcgggcacggcggcctcggccgcctcctcggtcaacttctacctgggtacgacgaaggtgggcaccgcctcggtcagcgcactcgcggccggcgccgccaccacggtcaccgcgtcgatcggggcgcgtgatgccggcacctacgccgtctccgcggtcgtcgacgaggccgacacggtgatcgagaccaacgacgccaacaactcctacaacagcccgaccagcctggtcgtcgccccggtcagcagctccgacctggtcgcctcggcggtctcctggtcgccgggcaacccgtcggccggccagaccgtcaccttctcggtgaccctgaggaaccagggcaccgcgcccaccggcagcggcgcccacaccgtcacggtcaccgtcctcaacgggtcgacgacggtcaagacgttcaccgggtcgtacaccggcacgctcgccgccggcgccgcgtccccgtcgatcaacctgggcacctggaccgccgtcaacgggaggtacacggtgcacacggtggtcgccgcggacaccgccgagctgcccgtcaagcagggcaacaacaccagcgacaaggcgttcttcgtcggtcgcggcgccaccatgccgtacgacatgtacgaggccgaggacggcacggtcggtggcggcgcggccgtcgtcggcccgaaccgcaccatcggcgacctggccggcgaggcgtccggccgccgggcggtcaccctcaaccagaccggcgcgtccgtccagtggaccacccggaacgcgaccaacacggtcgtcgcccggttctccatcccggacggcaccaccagttcgatcaacgtgtacgtcaacggcacgctgaacaggacgctggcgctcacctcgaagtacgcctggctgtacggcagcgagacggcgccgcagaactccggcaccggcccgcggcacatctacgacgaggcgaacaccctgctgaccgggtcgttcccggccggcagcacgatcaggctgcagaaggacgcggcgaacagcggcagcatcgcgatcgacttcatccagctggagcaggtcgctccggtcgccgacccggatccctcgaagtacgtggtaccgaccggtttcgaccagcagtcggtgcaggcggccctggacacggctcgtcaggacagcaccaagctcggtgtctacctgccggcgggtgactaccagacgtccaacaagttccaggtgtacgggcgctccttgaagatcatcggcgcgggcccgtggtacacccgcttccacacgccggacacgcagaccgagaccgacgccggcttccgggccgacgccaccgcgaacggctccacgttcgccgacttctcgttctggggcaactacacgatccggatcgacggccccggcaaggtgttcgacttcgcgaacgtctccgggatcaccatcgacgacatctgggccgagcacgtggtctgcctgtactggggcgccaacaccgacaacatggtgatcaggaattcccggatccgggacaccttcgccgacggcatcaacatgaccaacggcagcaccggcaacctggtcgacaacaacgagtcccgcgccaccggcgacgacagcttcgcgctgttctccgccatcgacgccggcggctccgacgagatcaacaacaccttctccaacctcaccagcctgctcacctggcgtgcggccggcatcgcggtctacggcggctacgcgaacacgttcaagaacatctccatcgcggacacgctgtgctactccgggatcacggtcagctcgctggacttcggctacccgatgaacggcttcggcgccaacccgcccaccgtgctcgacaacatctcggtggtccgggccggcggccacttctggggccagcaggtcttcccggccatctggatgttcagcgcctccaaggtcttccagggcatccggatcagcaacgtcgacatcctcgacccgacctactccggcatcatgttccagacccagtacatcggcggcaacccggtcaacccgatcaccgacacggtcttcaccaacgtgacgatcagcggggcgcagcgcagcggggacgccttcgacgcgaagagcggttacgggatctgggcgaacccgctgcccgaagcgggacaggggccggcggtggggtcggcgaccttcaccaacctgacgctgagcaacaactacagggacatcgagaacccgacgacgaccttcaccatcatccggaactga

SEQ ID NO: 4428 - DNA, 513 bp, Actinoplanes utahensis
gtgcacatcgaattcacccatgcgcggtcgcaggagtactttcaccgcagattcgccggagccgggtccaaggtcgccaggccgttcgcgattcccgcggccatcctcggagtgctgggctggctcgtctgctgcgccgccgggtcggtgcgtagcgagctggcggccggcggggtgctgatcgcggtggcagccgcgctcgccggtgtcgcgttcctgcggtggcggcaagaggtcgtcgtgccggccgactggcgagagccacgcacctacgtgctgaccgacgagagcttcacgtcctggaccgcgaagacatcggccaagcttgcgtggtcggcgttcacctggttgcggcaggaggacgacgcctacctgctgcgcaccatcgccggcaggacctgggacattccgcgagagccgctgaccgcggaacaggacgcggtgctggccgggttcctggccgagctgctggcggcggggtcggcggcccccgctgagcgggatcgatcgtaa

SEQ ID NO: 4429 - DNA, 510 bp, Actinoplanes utahensis
atgaccgactgggatcagggcgacagctggtcgtcgagcagtgcgggccaagaggactggtcggcgcaggaccggcaacgcgactcggcgaaccggttggccaacgtcagcaatgacatggcgaccgccacgcaggccgcggtgcacgcggcggagaccgcggtgcaggtgatccagcggctggaggcgagcagcaccgagatcggcaaggtggtgcagctgatcgcgacgatcgcgaagcagacgaacctgctggcgctgaacgcgacgatcgaggcggcccgggccggtgaggcggggcgcgggttcgccgtggtggccagcgaggtcaaggacctggcgaacgagaccgcgaccgcgacgaacgagatcggcacgcaggtcggcgggatccggaccgacacgcagaacgcggtcgaggcgatccaggagatgcagggcctgatcgaggagctggatcgctgccagaaggtgatcagcgggatcgtggtggagcagcaggccggctga

SEQ ID NO: 4430 - DNA, 390 bp, Actinoplanes utahensis
atggctagtaggagaccgccgagggctcgggcctgcccgtgcgggtcaccggcgtacgcccggtgttgcggaccgctccatgagggcaagccggcggagagcccggaggcgctgatgcggtcgcgcttcagcgcgttcgccctggatctgtccgattacgtccaggccacctggcatccggacacccgccccgcgacgctggagagtgatcccggcctgcgctgggtacgcctcgaggtacgggagacgaccggcggcaccctgttcgacgccgagggcaccgtcacgttccgggcgcatttccgggacaacgggacgcccggggtgctggacgagaagagccgcttcgttcggcacaacgcccgatgggtctatcacagcccggtgtga

SEQ ID NO: 4431 - DNA, 852 bp, Actinoplanes utahensis
atgtcggcaacgaggccgatcgaggacgggatcgtccgcgacttcaaggtcaatctctcgtacggggagtatctgcacctcgatgagatcctgggcgcgcagcacccggtgagcgtgcccgagcaccacgacgagctgctgttcatcctgcagcaccagacatccgagctgtggctgaagctgatcatccacgagctgcgcgcggtgctgcgcaacctggccaaggacgacctgaagcccgcgctgaaaggcctggcccgggtcaagcacatccagcggacgctgaccgagcagtggtcggtgctggccaccctcacgcccaccgagtacgcccagttccgcagtttcctgggcacgtcgtcgggtttccagtcgtaccagtaccgcgcggtcgagttcctgctcggcaacaaggaccgcggcatgctgccgatcttcgacgatcagccggccgcccgggaactgctggcggagctgctcggcaccccgagtgtgtacgacgagttcctgcactacctggcccggcacgggcatccggtgccggaggcgatcctggcccgcgacgtgaccgaggcgtacgagtaccagcccgacctggtgccggtcttccagcacatctacgagaaggccgagcagtactgggaggcgtacgaggcctgcgaggaactcgtcgacctggaggagaacttccagctctggcggttccggcacctgaagacggtggaacgcacgatcggtttcaaacgggggacgggcggctccagcggggtcggcttcctgaaggcggctctcgatctgacattcttccccgagctgtacgccgtccgcaccgagatcggagtgccccgttga

SEQ ID NO: 4432 - DNA, 1218 bp, Actinoplanes utahensis
ttgagccttctcgcccgcgccgccgacctggacgcggccgacccgctggcgaagttccgggagcggttcgtgccggcgccggcggtcgcgtcgtacctggacggcaactcgctgggccgcccgctgatcgcgaccgcccagctgatcgacgagttcgtccgcgaccagtggggcggccggctgatccagggctggaccgacggctggctggagtggccgctgaccctcggtgaccggctcggcgcggtcgcgctgggcgccgcggccgggcagacggtggtcgccgattcgaccaccgtgctgctgtacaagctggcccgggccgcggtcgacgcccggccgggtcgccgtagggtggtgctcgacaccgacaacttcccgaccgaccggtacgtgctggagggcatcgccgcggagcgtgacctcaccctggtctggatcaccaccgacccggtcaccggcatccacccggagcaggtggccgaggtggtcgacgaggacaccgccctggtgctgttctcgcacgtggcgtaccgctccggctggctcgccgacatcccggagatcaaccggatcgcgcacgaggcgggcgcgctgaccctgtgggacctgtgccactcggccggttcggtgccgatccggctcgacgagtggggtgtcgacatcgcggtcggctgctcgtacaagtatctgaacggcggcccgggcgcgcccgccttcgcctacctgcggcgcgaattgcaggacgaggtgcgccagccgatccacggctggatggggcaccgggcggcgttcgagatggggcacggctatgagccggcgcccggcatccgcgcgctgctcagcggcaccccgccgatcctggcgatggtgccgatgcacgccaacctggacatgctcgccgaggccgggatcgacgcggtccgggccaagtcgctgctgctcaccggctatgtgctggagctcgccgacgagtggctgaccccgctcggcgtcgaggtggtcagcccgcgcgacccggcccgccgcggtggtcacatcacgctgcgccgcgccgggttcgagcagctgctcgaacccctctgggccggtggggtgatcccggactatcgccgtccggacgggctgcggatcggcccggcaccgctgagcaccagcttcaccgaggtccaccagggcctcgccacgctgcgcgacctggccgggaagcaccggtga

SEQ ID NO: 4433 - DNA, 1287 bp, Actinoplanes utahensis
gtgaccgcttccgagacgccgccgtccgaggtctgcgacccggcctcgcctgcggcttcggcgtcgagcccgtgcggtggtgcgggctgcggcggtgccggctgcttcagccgtacgtcgaggtccgctcgtcccggcgaatccgatgccggcggtacgccgaggcccgcccgccccggcgagtcgccgtccgacggtccgccgcggcactcccgctccggccagtcgcggcccaccgtcacccgggttcccgacccgcgtgtcgacgaccggatcgactggttgatcgccgactcggtctggtggggcggccggctgcgccggggtgtggccctccgggtcgccgccgacggtcaggcgaagccggtcccggccgagatggccccgccggacgccgtccgccgtttccccggcacgctgctgcccggcctggtcgacgcccacgtgcacgccgccctggtcgatctcggcacggtccggtccggtggcatcgccgccgtctgggacctcggcggtgtcccggacacgctccgggagctggcggcccggtccgccgagccgggcaccggcctgccccatgtccgctacgccggcccgttcctgaccgcccccggcggctatcccagcgaccggacctgggccccgccgggcagttggcgggagatcacctcggccgccgacgcgggcgccgcggtggccgacgcgtggtcggccggcgccaccctgatcaaggtgaccgcgcacaccggtggcccgaccctgccgcagcccaccctgcgggctctggtcgacgccgcgcacgccgccaccctgccggtcgtggtgcacgccgagggcccgggaacggtcgccgccgccgtcgaagccggcgccgacctgctggcgcacaccccgtggaccgagccgctgccggacgcgctgatccgggcctgtgccgaccggatgacctgggtcagcaccttggacatccacggctggggcagcccggacgcggcgcaggggatcgccgtggacaacctgcgccggttcatcgacgcgggcggcaaggtgcgttacggcaccgacctgggcaacggcccgctgatcccgggcgtcaacccgcgggagctgcgggccctgcgctcggccggcctcacgccggacgagatcctgatcgcgatgaccgaacccggcactcccggcgtgacctggctgcccgccggcctcacgctggccccggacaccttcgccgactccctggccaccgcccgggtcctggacgacagcacccggccgcgcccggcctga

SEQ ID NO: 4434 - DNA, 1023 bp, Actinoplanes utahensis
atgatcgagcgggtgcgagtcgggctggtggggtatggcagcggcgggcggatcttccacgccccgctgatcgccgcggcggagaacatcgagttcgtcggtgtggtcaccacctccgaggaacgccgcaagcagatcgccgagcaactccccggcgtcgaggcgtacgactcgatcgaggccctggccgccgccggcgtccgggccgtggccatctcgacccccgcctccacccacgccgacctggcccgtgaggccgtccgcctgggcctggccgtggtcgtcgacaaacccttcgcgctggacgcgccgaccgcccgtgagctggtcaagtccgccgaggcggccggcgtcccgctgaccgtctatcagaaccggcgctgggactccgattacctcaccgtgcgcaaactgatcgagaaggggtcgctcggcacgatccggcgcttcgagtcccggatggaacgctgggcgcccgaccggctgccgcccgcggccggcggcggcaccctgctggacttcggctcgcacctggtcgaccaggcactcaaactgcacggcccggcccagcgggtgtacgccgaggtgcgcggcgagggcgagctcgacgacgacttcttcctggccatgcaccacctcagcggcgtcgagtcgcacctgtggggcagctggcggcaggccggcccgggcccgcgcttccgggtcaccggcaccgccgggacgtacatctccgccgagctcgactgccaggaggagatgctgaaagccggcaagaccccggccaagctcggcgaccgctggggtgtcgaacacgagcaccggtggggccacctgtggcgcggtacgaccggggcgccggtggagagctgccgcggtcggtgggactcgttctatccggcgttcgccgacgcggtgctgggcaacgggccgctgccggtggacccgtgggacaccgtgcgcgccatggaggtcctcgacgcggcccgcgtctccgcctccaccggccgctccgtcgccctctga

SEQ ID NO: 4435 - DNA, 792 bp, Actinoplanes utahensis
atgaccacccccctgccgcggcccgcgcccgcggcgcccgcctggctcacctggccgatccgggccgtcgcgctgatcgtcgtcttcccgttccggctgctctgggagctcggggtgctcgtccagcggttcgtggtgcggccggtcggccgggccctgggctggctgctgcgcacgctcctggtcgcgccgctgctccggctggtccgccagctgctgcagtgggtgctgctgccggtctggcacgcgctgcgctggctggtcgcggcgctggtcaccggggtcgcctgggtgctgcgccagctggtccgattcctgctgcggccgctgctggtgttcctcgggcggttcgtgctgttcccgctcgggcgggcgctggcctggacctggcacgtgctgatcgcgccggccgggcaggcggtctacaactgggtgctggcgccgatcgggcacgggatggcgtgggtgctgatcacgttctaccgccgggtgctcaccccgctcgggcaggcgctggtgtgggccgcggacgcgtcgtaccgctggatcctccgcccgatcggccgcggcatcgccgggaccgccgccctgatcggccgcagtctcgccgcggccgcccggatggtctaccggttcctgctgcgccccgccgggatcgcgatcgcgttcgtcgggcggcacgccgtcggaccggccttccgggcggtcggtgccgtcgggcgccggctgcgcgacgagatcgtccggccggccggaaatgtggtgcgcaccgcacggggactgcgccgctga

SEQ ID NO: 4436 - DNA, 924 bp, Actinoplanes utahensis
atggagccggcgcagcaggaacgcacaccgttcgccgacatcgacggtctgaccgcaccgatgacggacctggtgctgaccgcgctgaccgagatgggccggcatccggagatccgccgggtgcgccgggccgggttcgacgcgttgcgcccggcaccggggatgcggctgctggacgcgggttccggcagtggcgaggtggcccggtcgctggccgccgagaccggcccgcgcggcgaggtgatcgcactggactactcggcggcgatcaccgcggccgcgatcgcccggcacgacggcggcaacgtgcgctatgtcaccggtgacgtcggcgccctggagctgccggacgactgtgtcgacggggtgtggtgcgagcgggtgctgcagcacgtggccgatccggacgcggcggtcgccgagctgcgccgggtgacccggccgggcgggcggctcgtgctgatcgacacggactgggactcgctggccttcgacgggatgccggcgcggctgtgggcggagctgtccgcgtacgccgcccggcatttcaccccgccgcagcgggacatggggcgtacgttgcgccgccgcctggtcgcggccggcctgtccggcctgaccgcgaccccggtgacgtgtctgttcggcagtcccgagtcggcggcggtggtgctgccgatggtcaatccgcgggtgccggccgagacctggcagaccccgcccggcctgcgcgaggagtggctgtcctgcgtcgaggcggccggcgcccgcggcgacttcctcgccgtcctgaccatctgggtggtcaccggcaccgtccagcggtcgaccgctgccaccgggcgggcagagccgtcgccgactatcgttccacggggaccatccggtgcaggaggcggtccagcggcatgctggcgaagctga

SEQ ID NO: 4437 - DNA, 1476 bp, Actinoplanes utahensis
gtgaacaccaccgacatcacccgtcacaacatcaccatgcagcccgacgggcgccgcgtggtgatcaagctgttcgtgcccggcgaggacgcgcacgccacgcacaaccggaccgcctgcatgatcgagcggatgctgcagctcgacgagaacgacatcggcacgctgctcgaggacgtgctgaaccgcttctccgggcggcaccacgacatcctgtcggtcttccagcaccactacgaggtggtccagcaccgggtgccgccggagatcgagctgtcgccgcaggcccggacgctgatcggggcgtacttcagccacgagttctcggtcgaggcggcggcgctgtgcaacccgtcgatggtgccgcacccggaccagagcgacctggcccccggcgagctgcgcggggcgctgagcctgcggcagatcggcgaggggcacatctcctctatcgggttctgcagcgtgatcatcgggccgggcgcggcgatccgtctggaggaccgcgacggtccgctcgcgatcggcacccgggtcggcgccaagcacatgaagcaccagctgttcgcggcgctcggcgacgaggacatcgacaacgagtgctcggcctacatcctcaactcgctgcctgaacgctacgacgacgcggaattcgaggacatcctcagccacctgccgcccgaactgcaggcccggcccaccacgccgatgacgatggacctgatccggcggatcgtgctggacgactacgcggtgaccttcccggccaccatgccgctgcaccagcgggtcctctggccggccaccccgagcgagagccggggcatggaggacgcgcggttcgtccaggtgatcgacccggacggtcgcccggcctaccaggcgacctatacggcgtacgacggattcaacatttccggacgcgtcatctacagccgtgacctgcggcatttcgaggtgaccgcgctgcacgggccggccgcgcgcaacaagggcatggcgctgttcccgcggtacatcaagggccggaagatggccctgtgccgctccgacggcgaaaccctcggcctggccgtccgcgacgaccagcaccgctggcagccggccgggccgctgctcgtcccgcaccgcggctgggacctgatccaggtcggcaactgcggatcaccgatcgagaccgaggccggctggctggtgctcacccacggggtcgggccgatgcggcggtacgcgatcggcgccatgctgctcgacctggacgacccggccaaggtgatcgccgacctgccgcagggcctgatcgacccggacgagatcgagcgggaagggtacgtgccgaacgtgctctactcctgcggcgggctggtccacgacgggcggttctggctgccgtacgcctccagcgacgtccggatcagcttcgccagcatgccgctggaccgcctcctgcaccggatggtccccgtggaacgatag

SEQ ID NO: 4438 - DNA, 1083 bp, Actinoplanes utahensis
atgagccaggggctgcggctgattccgccgccggtccggctcaccgacgtaccggagccgcgcttcgatcacgtgctccggctctccgacgacaccgggctgctggaacacgcgcgcaccgcgatcgtccggcgcgagcacggctactgcgtcgacgacgtgtcccggggcctgctggtggtcagccgggagccccggccggcccccgaggtgctccgggccggtgaacgctacctggccttcctgacccacgcccaggacgccgacggcgcgttccgcaaccggatgggctatgaccggcgctggcaggacgagccgtcgctgggcgactggtggggccgcgccctgtgggggctgggcaccgcggccgcgcgcagcaccgccggctggatccggcgtgaggcgcggtacgccttccacctcggagccacccgccgctccacctggccgcgggcgatggccttcgccggactgggcgcggccgaggtgctccgcgccgacccgcgcgaccggctcgccgccgacctgctcggcgacgcggccacggtgatcggcctgcccgggtccgacccggactggtgctggccggaacgcgagctcacctacgccaacccggccctggccgaggtggtgatcgcggccggcgacctgctcggcgacgaggcgctgctcgccgacgggctgcggatgctcgcctggctgtgccggacccaggagcaccggggccacctgtccaccgtcccggtcggcggctggcggcccggctccgcccggcaccggcacgaccagcagccgatcgaggcggccgccaccgcggacgcctgcgccacggccgccgcggtgaccggcgacgagcgctgggacgccccgctcttccaggcgatcgcgtggttcctgggcgacaacgacaccggaacggtgatgtacgacagcgagactcatggttgttatgacggattgacggctgatggtcctaatctgaaccaaggagccgaatccactctcgcgctcgtctccacgctgcagcatgcccgcacgctggcgatccggagcgcgacccgaccgcaaggcggtttggcgtga

SEQ ID NO: 4439 - DNA, 1167 bp, Actinoplanes utahensis
atgcccgcgacatacgggtttttgagtacttatccgcccacacaatgcggtttggcgacgttcaatgcggcactcgccatgcatctggccgccggaacgcccggcgcaaccgccggatccggggtggtgcggctgctcgcccgggacaacaccagcggcggcatcgcactcgaccgggccgcgccccgggtggtgcacacctggcacaccgatctgcccggcggctgggcgggggccgccgccgcgctcaaccggttcgacgtcgcggtgatccagcacgagtacggcatctacccgggtgacgccggcgccgaggtgctgccgctgctgcacgcgctcaaggtgccctccatcgtggtgctgcacaccgtcctcacccaacccgacaccctgcagcgcgcggtgctggagcagatcgccgaggtcgccgatgccgtggtgaccatgaccgacaccgcccggcagcgactgaccacgaactacgcggtgaaccctcgcaagatcacggtgatcccgcacggcgccggcagccacgccggggtgccccgcgaggaccacgaccggccgcacctgctcacctggggcctgctcggcccgggcaagggcatcgaatgggcgctgcgggccctcgcgctgctcgacgacctgagcccggccccgatctacaccgtcgccggccgcacccacccgaaggtgctcgaacagcagggcgacgtgtaccgggacgggctcaagtcgctcgccgacgacctcgacgtgaccgcatcggtccgctggctcgatgcctacctggacgccggtgaactgtcccggctgatccggtcggcggacgcggtggtgctcccctacgactcgaccgagcaggtcacctccggggtgctgatcgaggcggtgggcgccggggtgccggtggtcgccaccgagttcccgcacgccgtcgagttgctggccagcggccccgggctgctcgtgccgcaccaggacccggaggcgatggcctgcgcgatccggcacgtgctggccgagcccggactgcccgggcgcctcgccgggctcgccggcgggccgaccctgcgctggccggcggtcgccgcccggtaccagtcgctggccgcccgcctgctcgccgaccgcgtgccgctgccggccgcgaccctcacggcatga

SEQ ID NO: 4440 - DNA, 1014 bp, Actinoplanes utahensis
gtgtgttttgtcgtgaagatcgcgctgctcgggccgatcgcctggcgcactcccccggtgcactacggcccgtgggaactgatcaccagcctgctcgccgaggggctgaccgcgcgcggcgtggacgtcaccctgttcgccaccctggactcggtcaccaaggccaccctggacggcgtcgtgccgaccgggtacgaggagagcgacagcctcgacggccgggtctgggaggcgatccacgtcagccacgcgctggcccgctccggcgagttcgacctgatccacaaccacctggactggctaccactggcgttctccgcacactgcgccgcgccgatgctgaccacggtgcacgggttctccggggcgaacatcctcccggcgtaccggagagcgaagtcccggttcgtctcgatctcggacagcgaccggtcgccggaactggactacgtggccaccgtgcaccacggcgtcgacctggacggactgccgctgcacaccaccggcggcgacgatctgatcctgttcggccggatccacccggacaagggcaccgatctggccgtcgagatcgcccgacgggccggccggcggctggtgatctgcgggatcgtccaggaccggcgattcttccgggagaaggtcgagccgctgatcgacggcgaccgagtggtctatctcggctcggtcggccccgaggagcgcggtgcgatcctcggctccggggcggcgctgctgcacccgatccggttcgccgagccgttcgggctctccgtcgtggaatcgatgatctgcggtacgccggtgatcgcgtaccggaagggctccatgcccgaggtggtggacgagggcgtcaccggacgcctggtcggctcggtcgacgaggcggtggccgcggtcgacgaggtcgccgccctggatcgccgggtttgttcggcccgggcgcgggaacgcttcggcgcggatcggatggtcgacgcgtacctggcgatttaccgaaaaatcgtctgctga

SEQ ID NO: 4441 - DNA, 1701 bp, Actinoplanes utahensis
atgacggattcgtggtggaagaaggcggtcgtctaccagatctatccgcggagcttcgcggactcggacggtgacggcatgggcgacctgcgcgggatcatcggccacctcgaccatctcgccgaactcggcgtggacgtgctctggttgtcgccggtctatccctcgccgcaggacgacaacggttacgacatcagcgactatcagaacatcgagccgatgttcggcaccctggagatcttcgacgagctgctcgccggtgcgcacgcccggggcatgaaaatcgtgatggacctggtggtcaaccacagctcggacgagcacccgtggttcgccgagagccggtcgtcgcgggacaccccgaaacgggactggtactggtggcggccggcccgcgagggcatggagccgggcacgccgggcgccgagccgaccaactggggttcggtgttcggcggcccggcctgggagttcgacgagaagaccggcgagtactacctgcacctgttctcccgtaagcagcccgacctcaactgggagaacccggaggtgcgccaggccgtctacgcgatgatgcggtggtggctggaccggggcgtggacggcttccggatggacgtgatcaacatgatctccaaggtcacgccgctgccggacgggcggctgtcggccggcgccgcatacgcggacggctcggccggcttcgtcggtggcccgcgcctgcacgagttcctcaaggagatgtaccgcgaggtcttcgacggccgcggtgagctgctcaccgtcggcgagatgcccggcgtcacggtcgacgaggcccgggtgcacaccgacccggccgagcacgagatcgacatggtgttccagttcgaccacgtctgggccgaccgcggtcctgacccgtggctgctgcagaaacttcagctgaccaacctcaaggcgatcctcggccggtggcaggccgggctcgccgaggtgggctggaacagcctgtactggaacaaccacgaccagccgcggatcgtctcccgctacggcgacgactcaccggagcaccgggtcgcctcggccaagatgctcggcaccgtgctgcacctgcaccgcggcacgccctacgtctaccagggcgaggagctcgggatgacgaactacccgttccgcggcatcgaggacttccgcgacatcgaggcgctcgggcagtacaagcaggccctggagttggaggggcgcagcgccgaggcggtgctgaccgtgctgcgcgcccgcggccgggacaacgcgcgcaccccgatgcagtgggacgactcgccgcaggccgggttcaccaccggcacgccgtggctggcggtcaacccgaactatccgcagatcaacgcggcggcgcagcgggccgacccggactcggtcttccactactaccgcagactgatcgagctgcggcacaccgagccggccgtcgccctgggcgacttcaccatgctgctgccgcacgacgagcggttgtacgccttcacccgccgcctggacgccaccgagctcctggtgatcggcaacttcaccggcgagaccgtccaggcggagatcgcggacgccgcgtcctgggcgcacgccgacgtgctgatcaccaacgtccccggcgccaccccgcggaacctgaccctggccccctggcaggccgtcgtctacaaacgcacggtctga

SEQ ID NO: 4442 - DNA, 552 bp, Actinoplanes utahensis
gtggacccggacccgccgctccggcgcgccgccccgcagccgccgcaacgcctgcccgaagacctcggtccatcccgcgctgagcgtgctggtgtgggtccacggcccgatcagcaggtcggtctccaggccggcgtcccggcgtcgccgatagagcgtgactggcgggccgacctactcgcgctctgcgtcatgcagcgcgcgctgatgctggcccacccgtggctgcccggcgtgctggccgggcgccggctgatcgggcgcaatctgctcggcttcctggagcacgggctgcgcgcgctgcagccggccgggctgcccggggtcgccgggatgaccctgctcggcctgctcaccggcttcgtggcgtcctacgtgaccagcgaactggccgacgcctcggacgcggtggcgcagatcggggcggcggtggcgaccggggacttcccgctgctggcccggacgctcggcgagggcgggacgccgctggacttcccgcgcatcgcggactggatgatcaccggtctggtcgagcgggcggaacaccggtaa

SEQ ID NO: 4443 - DNA, 2055 bp, Actinoplanes utahensis
atgcgccgcaaccggctcgccgcccgtctcgtcaccgccctggtcgccgtcaccccggcgatcgccctggccctggtcggtctcggcccggcgccggccggcggtgacccgctgctgcagaccttcgccctcaccggcggcctgcggctggccgcggacggcgccggcgcggacgtcgagcggtccctcccggaacgcgacaccaaaccgttcagcctggtcggggtcacctgggacgacccgcgcgcggtggcggccgggaccatccaggtgcgcacccgcccggccggccgccgcacctggacgccgtggcgcgagctggagaccgacgcgcccgacgagtccggcggccaggccgtccggggcgccagcgacccgctctgggtgggcccgtcggacggtgtgcaggcccgggtgatcgccgccggcgcggcccgggcgctgccggccgggatgcgggtcgacctgatcaacccggacgcccggccggcgccggtggcggacgcgatggcgccggcggcggccgagcggctccgccggatcgccggggtggagatcccggaccggccggtgccgcggatgctgacccgggccgcctggggcgccgacgagcggatggtgcgggagaagcccgcgtacaccggtccggtccaggtgttcttcgtgcaccacacggcgaccggcaacgactacagctgcgggtcgtcgaccagcgtggtccgcggtatccaggcgtaccaggtgaagagcaagggctggaacgacatcggctacaacttcctggtcgacaagtgcggcaccatcttcgaggggcggcgcggcgggatcacccgcaatgtgctcggcgcgcacaccctgggcttcaacaccgacgccagcgcggtcgcggtgatcggcgactaccgcggcaccgcggccggttcggccaccgaggtcgcggtggcccagctcgccgcgtacaagctgggcgcggccgggaacgcgccggacggccgggtggtggtcacctccggtggtggaccgaaataccggcccggcacccgggtccggctgtaccggatctccggccaccgcgacgccggactcaccgaatgcccggggaccagcctgtatcgccggctgccggcgatccgggcgctcgccggtggtgctccggccgggctgcgcttcgccaaactgaccggttcgacccgctggggcggcgcctactggacccgggggtcgctcaccccgctgtggtcgctgagcacccccgggcaactgctcaaccgattcgacgtgtacgtcgacggcgacctcgtcctctcccgggcgtccaccgaacgtctcggtcagcttcagctgagtcccggcccgcacaccgtcacggtcaaggccctgcacctgtccgggcgcagcgccaccgccaccgtcaaggtgatcgccgacgtcgagccgcccgccttcaccacgctgccgcaggcctcgctgagctccgggacgatcgggaccagcaccccggtccgactggactggtcggccgacgacccggccgggatccgcgccgccgcgatcagcggggccagccgggccaccctcgacggggcgatccgcagcctcaccggcaccgcaccggtgggcgccgcgtccagctggacggtggcggtcaccgaccatgccggcaacgaacggacggcgtcgatcagtcgtaccccggcaatcgtcgcggacagcgacgcgacccggaccggaagctggcggacggtatcggacagccatcatctcggtggtgcggcgtccgccgccgccagcgacagcgcggcgttgagctggaccttcaccggccgctccgcggccgtcgtggcggcccgcaacccggcggcgggccggctcaagatctatctcgacggcgatttcctggggtacgtcgatctccgctccgccgcgccgcaataccgccgcctggtctggacccaggcgtggagcaccgcgaacgagcacaccgtgaaggtcgtcccggaagccaccgccgggcgcccgacggtgaccgtggacgggctcgcctatctgcgctga

SEQ ID NO: 4444 - DNA, 1206 bp, Actinoplanes utahensis
atgcgggttctgatttccgggagcagtgtggcggggccggccagcgcattctggctgcaccgggcgggcgccgaggtgaccgtggtggagaagtcgcggggcccgcgcccgggcgggcacgcggtggacgtccggggcgtggcccggcaggtgatcgagtggatgggcatccgcgaggcgatccgggcccggcaggtcgacgagcgcggcttgaagctggtggataggcacaaccggtcgatgggccggatgccggccgaggcgttcggcggcgaggggatcgtcgcggagatcgagatcgcccggggtgatctggcgcagatcctgcgggacgtcaccgcgggcttcaccgactaccggtacggcgaccggatcaccgccctggctcaggacgccgccggggtggacgtcaccttcgccagcggcctgcgggaacgctacgacctggtgctcggggccgacggtgtgcattcgggggtgcgctcgctggcgttcggcccggaccaggagtacgtccggtatctgggcctctactcggcgtatttcacggtggccgatccgggcgacatggacaactggtacctgatgtacaacgagccgggcggcctggtcgccggcctgcgcccggagcggggcggcacggcgaaggcgcacctggggttccgcgagccgcggatgcgctacgagcggctctcccgggacgaggagaagcgggtggtcaccgagcggatggccggcgccgggtggaaggtgccgagcctgctcgcgcagatggcggacgcgcccgacttcttcttcgactcgatcaatcaggtgcacgtggaccgctggtggcggggccggatcgggctggtcggcgacgccggttactgcgggtcgccgatcgtcgggctgggcaccagcatgagcctggtgggcgcgtacgtgctggccggtgagctgagccggcacggggatccggagcgggcgttcgccgcctaccagagcgagatggccgggtacgtggcgaccggcacgaagctgccgccgggtggcgcggccgggatggccccgaagtccgccctgtggatcaagacccgggcgaagacgatgggcatgatgacccgctggccgatccgggacctgatggcgagccagttcgccaaggccgacgcgatcgtcctgaaggactacgggctgaccccggcgggcgctcagcgcagatag

SEQ ID NO: 4445 - DNA, 885 bp, Actinoplanes utahensis
gtggccgaggcggcgtacacacggatcgtggccgaactcagacgccggatcgacagcggtgagctgcgccccggcgaccgggtgccgtccgcgcgagcgatcacccgcgactggggagtcgccatcgcgaccgccacccgggcgcacgctgtactgcgcgacgccggcctgaccgtctcccggcccggggtcggcaccgtggtggccgggccggccccgcgccgcgaccccgacctcagccgggaccggatcgtcgaggtggcgatcgcggtcgccgaccgggacgggatggccgaggcgtcgatgcgccggatcgccaccgaactgggcgtggccaccatgtcgctctaccgccacgtgcccgggcgggaggaactggaactcgccatgatcgacgcggcgctgggcgagctgcgggtgccgccgcgatactccggggactggcgggccgacctggacggctgcgcccgcgccctgtgggagctgttccagcggcacccgtggctcggcctgaccatgtcgctgacccggccgcaggtctccccgaacgcgatgcggctcggcgagtggatcatggggacgctggggcggacccggctcgtcgccaccgaccggatgatggtccaggtgctgctgttcagcttcatccgcggggtggccagcgcgctgcaaccggaagccgaggcgatgcgcgacaccgggctcaccggcgacgagtggatggaggcccaggagaaggagttccagcgcttcgtcgaggcgaacccgatgccggcgtacgaggagctgttcctgcgtacgcccgacttcgtcttcgacctcgacgtgttgttcgagttcggcctggcccgcttcctcgacgggatcgccgtctggatcgggtga

SEQ ID NO: 4446 - DNA, 585 bp, Actinoplanes utahensis
atgccgtggtggggactgcccctcgtcgccgccgtgttcgcgctggccggcgccctggccgtccagttcgccgccgcccggaacaacaatctgctgagccgacggcggcgcacccgccggtggtacgaggaacggaagaccgcctatgtgcagctgctggccggcttcgaacgctcctacgtgcgcctgcgcgccggcttcgacgccggtgagaaaccgccggccctgctgcagtacgtcgacgagatcggcccggcgctgatgccggtccggctgctcgcctccggcccggtccgcagcgccgcgctcgccgtccacctgcagatggaacgcctgcacgggccgatgaacccggccggggtcagcggggtgcggccggagacccacttccgggaactcctcgcccaggtgccgctgatcatgcagcagttcgaggcggcggtccgcgaggagctcgggatcgaggcgagtccaccgaacccgccggcccacaccgccaacggcaaggcccgcctgccgaaacggtgggcgaccctgcgggctgcggactcggtggccacccggccggagcgcgacacccactga

SEQ ID NO: 4447 - DNA, 642 bp, Actinoplanes utahensis
gtgaccgatcaccgtgcccccctcgaccccgtctccgcggccatcgtcgacagcggcgtcgtcgccgtcctgcgcgctcccaccgccggcgctttcgcaccggtcgccgacgtcctcgtcgcggccggcatcaccgccctggaggtcaccctcacctcccggggcgccctcgacgccatctccggcctgcgccgccgcctgccgcagggcacggtcatcggcgccggcaccgtcctcaccccggacgacgccaaggccgccatcgacgccggcgccaccttcctggtctccccggtcctggacaccctcaccgaccagccggtcccgtgctacccgggcgcctacacccccaccgaggtctacaccgcccaccgggccggcgccccgatcgtcaaactcttcccggccggcggcctcaaacccggctacctgaaagacctccgcggccccctgcccaacgtccgcatcatgccgaccggcggcatcgacctcgacgacatcgccgactggctcaccgccggcgccgccgccgtcggcctcggcggcccactgatcggcgacgccgccaccggcggcagcctcaccgccctggccgcccgcgccaagcacgccgtcgacgccgtcaccttcgcccggtcatga

SEQ ID NO: 4448 - DNA, 897 bp, Actinoplanes utahensis
atgggcatcttcgtcgccgacgggatcggcgccttcgagcacgcgcgggcgttcaccctggcggtcggcggcgcggaaaccaacgtcgcggtcggcgtcgcccgcctcggcggcgccgccacctggctcggccgtctcggcccggactcgaccgggtcgctgatcgagggccggttgcgcttcgccggcgtacgcgtcctggccgtccgcgatcccgcccccaccggcctgatggtccgctatcggcgatccgcccagttcatccacgccgactatcaccgcgccggcagcgcgggctcccgcctgaccccggccgacctgccgctgaccgagctgcagcaagccggcatcctgcacatcaccggcatcaccccggccctcggcgacaccgcccgggccaccgtcttcgccgccgtcgaggccgcccgtgccgccggtgtcccggtctgtctggacgtcaactaccgcggcaaactctggtcccggttcgacgccgccccggtcctgcgggacctggtctcccgatccgacatcgtcttcgccggccccgacgaggcggccatcttcctgaacacggacgaccccctggacggtctgaccaagctcggccccaccgaggtcatcgtcaaggacgggccgcacggctgcaccgcactgatcgacggcgaccacttcaccgtccccgccctcccggtcaccgccgtcgacccggtcggcgccggcgacgcgttcgtggccggctatctggccgaccgcctggccggcgccactccggcgcagcgcctcaccaccgccatcaccgccggcgccttcgcggtcacggtccccggcgactgcgacagcgcgcccacccgcgccgacctcaccgccctctccggcgccgacatccaccgctga

SEQ ID NO: 4449 - DNA, 153 bp, Actinoplanes utahensis
gtgggcggtccggagcggtgcgtgtggtgcggggcggttgtcaccgtgctcagcgcggacgccgcctggtgggtggtgcgggtggtgcgcggcggctgtcaccgtgcccggcgcggacaccgcctggcgagcggtccggagtggtgcgggtag

SEQ ID NO: 4450 - DNA, 417 bp, Actinoplanes utahensis
atgcaacccaccccgttcaccccgtggtcgttccgggatcccgaggcgctgtccggtggctaccagccgaccgaggccgacgtcgtcgacgagaccggccggatcggcgtggacctggtcggttaccaggtcgaggcgaccgatgggcacatcggttcggtcgaccaggccagttacgacgtcggcggcgccttcctggtggtggacaccgggccgtggatcttcggccggaaggtgctgctgccggcgggtacggtgcagaacgtcgaccaggcggaccgcaaggtctatgtggaccggacgaaggatcagatcaaggcgtccccggagtacgacaaggacaccttcgagacgtccgcgtaccgggaccaggtcggtgactactacaccggcagctatcgcgattatccgcgctga

SEQ ID NO: 4451 - DNA, 822 bp, Actinoplanes utahensis
atgcgcgcggcgagttcgtcaagctccatgacctctaccgtatcgttgagacaccctgtgaggatttctccgcggagtggcaggagctgcatggcaaagtctcaaaggcgggcactgcgaccggtggacctggcgcggccacacgggctgtccgctcaggcgatccgcaactacgagcaggacggggtgatcccgccggcccgccggaccgcgagcggctaccgggcgtacgaggaacggcacctgctcgcggtgaccgcgttcctcgcactggccaaggcgtacgggcacggccccgccggggtgatcatgcgggcggtgctggccggcgacctggagaccgcgtacgccacgatcgacgccgggcatgccgaactcgcccgggaccgggagacgctgacggcggtcgaggcaaccgccgaggtgctgacggtgcccacccgacgcggggcggcgctgccggtcggcgcgctcgcgcaccggctcggggtgaccccggcgacgctgcggaaatgggaggaggcggggattctcgtgccggtccgggaccgggggcagcgggcgtactcgccggacgacgtgcgcgacgccgacctggcccacctgctgcggcgcggcggatacgggctgccgcacatcgcgaccgtcctgcgccaggtgcgcgacgcgggcggggcggcgtccctggcggcatcgctcagcgactggcgggctcggctcaccgatcgcggccgggcgatgctgacggccgccgcccggctcgccgaactgctgtccgtggagagccgggcggcggtcgtcatccgcgatcagcgcggataa

SEQ ID NO: 4452 - DNA, 489 bp, Actinoplanes utahensis
atgcagctcctgccactccgcggagaaatcctcacagggtgtctcaacgatacggtagaggtcatggagcttgacgaactcgccgcgcgcatctgccggcttcccgaggtggtccagctgatcgccgggcccggcaccggcgccccggagctgagctggggtgaccggttcttcttcgtaggggaggaccggatgcgcccgttcgccacgatcgtcgtccgggacgtgcccggcttcgacgagtgttccggcctggaccggccgggcgtcttccggctgaacctggagctgggccggtcccgtttcggcgacctgttcggtttcggcccggaggagttcgcggcgcgccggtccgggatcgacttcgccaccccggaccgctggttcccgcatccggtgtacgcggtgcagagctgggcctcggtggtcaacccggtgaccgtcgacgtggactccctgatcgggcacgcccgcggccggcggcgctga

SEQ ID NO: 4453 - DNA, 567 bp, Actinoplanes utahensis
atgaccgaagccttgatcgtcatcgacgtgcaggagtcgttccgggcccgcccgctctgggcggccgtcgacaacccggatctgatcccgaacgtgcagcgcctggtcgaccgggcccgggccgccgggcacctcgtcgtctgggtgctgcacgccgagccgggcaccggtggcgtcttcgacccggcgagcggtttcgtccggctgatggccgagctgaccccggcggacggcgagccgatcctggtcaagaccgtgcacaacgcgttcaccacgacggacctgcagttccggctgaccagcgccggcgtccgcgcggtgacggtctgcgggctgcgcaccgagcagtgtgtggagacgaccgcccgggtcgcctcggatctgggctatcaggtcacgttcgtcaccgacgccaccgccaccttcccgatcccgcaccgggacgcccccgacgacctggacgacccgcgtacgctgtccgccgcggatgtggtggcccgcaccgagtacgcgctcgccggccggttcgccacgatcacgaccgtcgacgaggtcgagaaggggtga

SEQ ID NO: 4454 - DNA, 882 bp, Actinoplanes utahensis
gtgagcctggtggtcttcgtgctcaccccgcaggtccacctgctcgacctggccggcccggcccaggtgttctccaccgctccggactacacgctgcactacgtcgccgacgccgacaccgtccccacctggcagggcgtcaccctgcaggcgtcccgggactggcccggcctcaccccggacgatctggtcctcgttcccggctggcgcgacgggtacggctacttccgaccggagacgctgcggcggctccgtgagcatcacgaccggggcggcacggtcgccagtgtctgcgccggggcggaagcgctgggccgggccggcctgctcgacggccgccgctgcaccacccaccacgatctgcaggacacgctggcccgcggctatcctcgggccggcgtggtccgtgacgtgctgtacgtctccgacgaccgggtggtcacctcggccggcatcgccagcggcatcgacctggcgctgcacctggtggcgctccggcacggcccggcggtcgccgcccgggtggcccgggagatggtcgtgtacgcccggcgcaacggggacgagtcgcaggccagcgcgatgctccggcatcgcgcgcacctcagcgacgtggtgcaccgggtgcaggatcggatcgacgcggcgttcgccgagccactgcggctggcgcagctcgccgccgcggcgggggtcagtgagcgtacgctcagccggctcttctcggcggcgacgggccgcacgccgctgcgctaccagcagttgctgcggatggagcgcgccgaatatctgatcggccacggcgcgaccgtggaggccgccgcccgggcggtgggtttcggcgacgcgcggatgctgcgcagactacgtgcccggaaatga

SEQ ID NO: 4455 - DNA, 1377 bp, Actinoplanes utahensis
gtgcagccccatgttgatttcccggccgacgagaccggccgccgcagtggcacggcgctgggccgcgcggtggtcgccgacgccctgcgggtcgtcgacccggccgcggccggggccgccgagcgggaggccgactggcggcgcggctatccgcggcacttccgggcactggtggaggccgggttgagcgcggacggcgcggccggttacgagatcgccgaggccggcctgttgtcgttgcacgcccggatccggtacgtacgaccggacggcgagttcaccctggcccaggcgttgctggcgggcggcggcgagccgtaccggacggtcgaggtgaccggctcggccgcgccggaccgcaccgtcggcctgctgccccgcctcgatgcctggcgggccgccggggtgatcgagccgtcgtgcgcggacgcggtgcgcgaggtggccgccgacccggactggcgggatctgagcgatctcactttcgcgctgctcggggcgggcgccgagatgggtccgctgcggtggctgctggaccggggcgccaccgtgctcgccgtcgacctgccccggccggatctgtgggagcggatcgccgggctggcggcgggttcggcgggccggctgttcgccccggtccgcggggccggcacgccgggcgccgacctgaccgccgatccgggggcggtcgcggcgtggctgctgagtttcgaccggccgctggtgctgggtaactacgggtacgcgccgggcagcgcctacccgaagctggcggccgtgaccgacgcgctcgccgtgcatctgcggcagcgccggccggacaccgcgttcgcggtgctcgccaccccgaccgatgtctacgcggtgccggccggcgcggtcgagcaggcccgggagcggtatgccgggcggggcgtgcgggcccgggcggtcgagccgctgtccggcgggcggctgctgcggccgaactatccgctgccgtcgacgccggggatcaacgacagtctggtgccgcagcaggggccgaactatgcgctggccaagcggatccaccggtggcgggcgacgctgggccgacgggacggggtggtcagcttcgcggtggcgccgccggcgcgcacccggtcggtgctgagcaaccggctgctcaaggcggcgtacgcgggcgcccatctgttcggtgtcgaggtcttcgacgcggccacggcgagcgagctgatggcgatcctgatgatccatcagatccgccggccgcgcgccgccgacgcggcggcctggcgcgacgagacggtggcggcggcgcacggcgggctgtggcgttcggcgtatcacgcccgcacggcacttccgatcgcggcggtacgcggtctgctctga

SEQ ID NO: 4456 - DNA, 1035 bp, Actinoplanes utahensis
atggggctgcaccgcgccagtatgtccttctcctaccaggggtggacgtcacctccgacgaatggccgcggatccggccggcggaggggcgctttcccccgcgggccagccgagtctgtcgatatgacaaccgtcgcagtcgccgcgccgccgcgccggcaccgtccgctgaccgtgctcacctgggcgtcgctggccctcgcggtgatcgccgggatcggcctgatcgccgacgcccgcatcctgaccggggtgccgatctggctcaagccgttcaagttcgccgtctcgttcgccctgtacgcctggacgctggcctggctgatctcggtgctgccccggcgcagccgcgtcgccgaaggggccgccacgatcatcggcgccgcctcggtgatcgagctggccgtcatcacggtgcaggtgatccggggcacgaccagccactacaaccagagcaccccgctgaactcggcgctctggtcggccatggggatgtcgatcatggtgctgttcgtggcgcacctgacgatcggggtggtggcactgcgccagcgggtcgcggaccgggccaccgcgtacgccatccgtctcggcctgctgatctccctgatcggcatgctggcggcgttcccgatgaccacccggaagaccgcgtccgggctggtcggcgcgcacagcgtcggcgtgcccgacggcgggcccggcctgccgctcaccggctggagcacggtcggcggggatctgcggatcggtcacttcgtcggcctgcacgcgctgcaggtgctgccgttgctggcgtacgcgctgggccgctgggcgggggaccggttcgacgcgacgacccgggcgcggctggtgctggtggcgggcaccggatacggcgtcctggggccgctgctcacctggcaggcgatgcgcgcggaaccgctgctgcggccctcagcggtcaccctcgccgcgttcctcgtcgtggccgtcgcgaccgcggccggcctgaccgccgtcgcgtcctcctccggcaggatgcgcgcatga

SEQ ID NO: 4457 - DNA, 408 bp, Actinoplanes utahensis
atgaccggcgccctgttcaccctcaccttcctgctcgccgccccgttctgggcgctgatgatcctgctgcccggctggaccggcacccggcggatcatcgggtcgccgctgatcgtgctgccgatcatcggaatctacgccgtcctgatcgtcccgaacctgggccacgtgctgcccgcggtcgccaaccccaccctcggcggcatccgcgacctgctcggcagcgcggacggcgcggcggccggctgggcccacatgatcgccttcgacctgttcgccggccggtggatctggctcgacgcccgcgaccgcggcatgcgccacctgatcctggccccgatcctgctgctcacgatcctgttcggaccgctgggtctgggcacccatctcgtcgtccgcaagtcctag

SEQ ID NO: 4458 - DNA, 1143 bp, Actinoplanes utahensis
atggctctcgacgcgcgggacaccctgacccgcatgctgctgctcgactgcagcggcctggcctacctgctcgtcatcggccgcaccggccacccgcccacccccctgcagtgggcgctggccgtgcccgccttcctgtccgccctcctgctgcaccgccaccccccgatcaacctgctcctgcagaccgcgctgttcgccgccgggatgctgctgctcgacgactccaccatcaaccaggtcggcacggcctgggcgatcggcgagttcgccctctgggccggcaaccggtggctgctggccggcggcatcggcatggtcgccgccacgtacctgatctgtgacccgcccgacgccgtcctgccctcggtgatgggcctggccaccagtctcggcctgcccaccctgatcggcctggtcgtgcgcaccacccgcgagctcggcgtgcaggccgagcaacgcgccgtctccgagcagcgggccgcccgcgccgacgaacgcggcgccatcgcccgcgaactgcacgacgtggtggcacaccacgtcgcgtcgatggtgctgcgcgtcggcgtcgcccagcacgtgctgcccggcgtcgacccgaaagtcgccgaggtcttcgacgacgtccaccgcaccggcacggccgcgctcggtgacctgcgccggctggtcgccgtcctgcgcgaccccgaccgcgcgcagggcgacgccgcactgaccgcgatcgagccgtcggcgctgccggccgccctcgacggcgcggtggagacagcgcggcgggccggggtcatcgtggaagcggagatcgacccgcgggtggccgggctcgacgcggtccgcgggctggcactgctgcggctcacccaggaggcgctgaccaacgtggcgaaacacgccgggccggcggcgcgggccgtcctgcgggtcacgatgggcggcgacgacctgcactggtcggtcaccgacgacgggggagcagcgcccggggcggcgcgggttcccgggggtgggcacggtctgaccgggatgcgggaacgcgtggagattctcggcggggccctggccgccgggccggagggctcgggttggcgggtctcgaccgtccttcccgcgccgctcccggacgggatcccggcatga

SEQ ID NO: 4459 - DNA, 627 bp, Actinoplanes utahensis
gtgatccgcgttctgctggtcgatgatcagcaactcatccgggccggtctgcggatgctcctcgacgccgaacccggcatggaggtgatcggcgaagccggcgacggccgcaccgcgatcgccctcgccgcccagctcgtccccgacgtgatcgtcatggacctgcgcatgcccggcgtcgacggcatcaccgccaccagccgcatcatggccgaccgccctgccatccggatcctcgtcctcaccaccttcggcgacgacgaccacctctacccggctttgcaggcgggcgcctgcggtttcctgctcaaggacgccccgcccaccgacctgctgaacggaatccgccaggccgccgccggtgaaagcccgttctcccaggaggtcctccgccgcctggtgcgccgagccgtccacgcccgccccgaacccccggcgcgcatcgacggtctcaccacgcgcgagcaggaggtactggacctggtcgcggagggcctcaccaacacggagatcgccgaacgcctgcacatcggggtgaccacggtcaaaacccacatcaccgcgctgatgaccaaaaccagcagcccgaaccgggttcgcctcgcgctcgtcgcccgccgccgctga

SEQ ID NO: 4460 - DNA, 2301 bp, Actinoplanes utahensis
atgatcccggccatggacaagtggcttgagttgattccggcggcggtggacgcggagcccgcgccggattcgcggcggtgggcgttcgccctgcagtggcacctcgcggcggccgaacgcggcagccccgactacggcaccggcgccgacctctacgagctgaccgccgagccgctgccctggcgccgcgaggacctgtcctgggcgctgcgggtcctcggcacggcccgggtcccctacgacggccaggcctaccgcctgcccgcggtcatcgccaaccagctgccggtcgaccagctccgggcgtacggtccggtgctcggcgcggtcctcgacgaggtgctgtccgactggaccatgcccaccgaggcccgccgctcgatcagcgcgcagtacgggaccgccatcggccggctcaccggcggactccccgcccacctgctgttcggagaggacggattcggcccgctggcccgccaccggctcggcgcccgggtgaccgaccccgcgacgagggacgcgctggccttcgcgatcacgctcaccaagccggtcccggcgaagagctggctgcggcaggcggagcgggtgcgcgccgccggcccggaggttcccgcgtcgatcggcaccgtgctcgccgccttcgtcgagctgggccggcccgtgcacgacgaccatgacctcctgctgcggggcttgagctggctgctgtccctggatcccggcgaggagtcgaccacgctcctgggacgcgtcgcggcaacggcggcgacaccctggcggcagggcggcgcacggttgacggccgcgatgaccgccgccgccacggtcgagatccttaccgaccggcccggccaggcgccggcgggcgtgctgggccggctgatgaacacccgcagccgccccctgcgcgaccgggtgtggacggctctggagcgcatcgcggccgcccgcggctgggcgcccggcgaggccatggagctcgccgtcgccgaccacgacctggccccggacagcacccaccgatatgccgccggcgacgacttcaccctcggcgtcgagatcatcggggagaaggcgacggtccgcgcctggcaggacggcctgccgctgcgcggtgttccggcggcgctgcgcctgcaggcgggtccggcgcgaacgctggccgcggaggtcaacaagacgctggccgccgagcgcgcccgggtggaggcgctgctcgcccaggaccgcacctgggactggccggcgtgggagcagcgctacctccgccacccggtgaccggcaccctcggccgccgcctgatctgggaggtgtccaccgccggcggcacctcctggacggcggccctgcccgagccggacggcgccggcggctggcggctcgccgggcactccggcgccgggtgttcggtgcgcctgtggcacccggtcctcgccgatccggccgaggtgaccgcctggcgcgaccgaatcaccaccgccgagttgcggcagccgttcaagcaggccttccgcgaggtgtaccggttgaccccggcggagacgcagaccggcacctactcgaaccggttcgccggtcacatcctgcgctaccgccaggcgaacgcgctgatgcgggtccgcggctggtcagccacctatctgggcacctggtccagcggtgcggacagtgcggcgaccaaggagttcgcggccggtgagtgggaggcctccttcgcccacgagtccgccggcccgctcggccaccgtgacgaggtcgagttctgctccaccgaccaggtccgcttcgcccgccgggaggggcaccgttgggagcccgcccgcgtcgacgaggtcccaccccgggtcttgagcgaggcgctgcgcgacgtggacctgttcatcggcgtcacgtcgatcgccaccgacgacagctggaccgaccggggcgagcacccgttccgcgcctactggcgggaaatcggcttcggcaccctgagcggcagcgccgaggtccgccgggacgtcctggcccgcctgcttccccgcctcacgattgccgctcggtgtgacatcgacgaccgcttcctgcgggtccacggcacccggaccacctacaaaatccacctgggttcggccaacatcctgatggaaccgaacgacgcctacctctgcatcgttcccaccggccgccacccccggctcgccctgcccttcgacgacgacgaacgcctctcggtcatcctctccaaggctttcctcctcgccgccgacgacaggatcaccgaccccagcatcctgcaccagctcccccgctga

SEQ ID NO: 4461 - DNA, 393 bp, Actinoplanes utahensis
atggccgaggtgctgatgcgggacgagacgatgaccgggcgggagatcgggtcctggatgctgccggatctgccggatcggatccccgcgcgggagttgctgcggttacgggtccgtgaggaggtggcccggttcaacgccgccggtggtgagctgtatcggggcctggtgcgaccggccgcggcgaccgagacgccgcacggcttccggatgccggccggcgggcggatcgacgagacggcccaggccgacgcggcatgtgcggcgttcgagcggaacgggttcgtgatgatcgccggggagcggcaggtggagagtctcgaccagatcatcgacctgcgccgggatgccgaggtggcgttcatccgcttggtcgcgctggtgggtggctag

SEQ ID NO: 4462 - DNA, 1884 bp, Actinoplanes utahensis
atgccgaggtggcgttcatccgcttggtcgcgctggtgggtggctagagcgcggtggtccggctggacgccggttcccgcgcagtgcccccgaagtgcggcggggtggctcacgacgtacggccgaaagggtgttgatgttgatcgtctcggtggcaggttggttcagggggtgtgcgggctcaagcgggggcggtggcggccgatcacgcggggcatgcgtaagtggaccctcggcgcccttctcacctcagcggtcgccgcctcggctgccctgctcggccctgccccggcgctggccgcagggaccgtgatcggcgcggagctgcccggtgcgctgccggggcggtacatcgtgaccctgaaggatcgggggaccgggccgagcgtgcacagcatgggcgccgggaggctggtgcgcagcttccgctcgattcccgggttcgcggcggagatgaccgcggcgcaggcgcggcggctggcggcggacccggcggtgcggtcggtcgagcaggaccgcatgatccacatcgcgacgcagaacaggccggggtggggtctggaccggatcgaccagcggagcgcgacactgtcgaagacgtacacggcgaccgatgacgggtcggcggtgcacgcgtacgtgatcgacaccgggatccggatcacacacagcgagttcggcggccgggcgtcgtacggctacgacttcgccgacggtgaccgcgtcgcgagcgactgcaacgggcacggtacgcatgtggccggcacgatcggcggcgcccgctacggggtggcgaagaaggtgcagctggtggcggtgcgggtactcggctgcgacggcggcggcagcatctccgacgtgatcgacggggtggactgggtgaccgagcacgcgatcaagccggccgtggcgaacatgagcatgggcggctcggtcagccggtcgctggactacgcggtgcaggagtcgatcgcgtccggggtgacctacgtggtggcggccggcaacgaggacgacgacgcccggtggagcagcccggcggacgtgccggcggcgatcaccgtgggagcgaccgacagccgggaccggcgcgcgtcgttctccaactacggcagcggggtggacctcttcgcgcccggcgtcgacatcaggtcgtcggtggcggacagcaacaccgcgaccgacgtctacagtggtacgtcgatggccgccccgcacgtcgccggcgccgccgccctgctgctggacgccaacccgagcctgacccccgggcaggtgcgggaccgcctggtggccaatgccaccaccggccgggtcgccgaccggatgggctcgccgaaccggctgctgttcgtgaccgcgcccccggcgaaaccggtgatcgcgacgacccgcacggccgccgcggtggtcggcaccgagttgtccacccggctggcgctcaccgcgaaccgggtcggatcgtggacgctggccggtgggacgctgccgccggggctgtcgctgaaccggtccggggtgctgtccgggaccccggcgcaggcgggcgactacgtggtgaccgtgcggttcaccgactacgtgccgcaggtggtcacccggcaggtgacgatcccggtggaggcgagcgtgccggtgatcgacccgacgctgcccgacgggcaggccggtgtctattacgagggtcagctgaccaccgcggaccagcgggacggcgtctgggcggtgaccgccggggcgctcccggccggccttaccctggacgaggcgtccggcttgatcagtggggtgccgtcggcgaccggcagcttcaccgtgcggttcaccgacccgtggggtcagacggcgaccgcggacttcacgatcacggtcggcgcggcgtga

SEQ ID NO: 4463 - DNA, 120 bp, Actinoplanes utahensis
gtggcgctggcggtggagcgtgtggcgcttcgtggtgaccgtgtggcgctggcggtgagcgtgtggcgctggcggtggagcgtgcggcgcttcgtggtgagcgtgtggcgctggcggtga

SEQ ID NO: 4464 - DNA, 480 bp, Actinoplanes utahensis
atgacggcaatcgttgtggtttccggcaatccgcgagccggctcccgcacatcggccctggccatcgcggtgggtgaggcgctggccacacggcacggcgcgcccgcgcccacggtgatcgaggtcggcacgctgggcgccggactgctcaccccgggcgactccggcacggccgccgcggtcgccgccctgaccggggctgacctgctggtggtggcgacaccgacgtacaagggaagctacaccggagtgctcaaggtgctcctcgaccagctgcccaaccaggcgctggccggcaaacacgcggtgccggtggtgaccgccgggatcgcgccgcaggccgcggcggccgaggcgctgctgcgccagctgctcggcgagctgggcgcggatgtccgggccgggctgccggtggtcgaggccgacctgccggagacggcggccatcgcgcagaagtacgcggcggccgcggactggtga

SEQ ID NO: 4465 - DNA, 624 bp, Actinoplanes utahensis
gtggcgctcgcgactaccatccggtatgcctatctaacagataggaatagtatccttgcagggtgccgccggatccggtggcaggagccgttgaaggagtcgcacatgtccgcgctcgccatcgcccatccgcgcgccagccatatccgccccgatctgcgtccggtcccggacctgccggagcaggctccggtcaccgtcaccatcagcatcgccggcggcgtcggcggccgtgaccgggtgctggccgcgctccgcgaactggttgacgccgccgggccggacgccgcgatcgagctcgacgagccggtcgagtcgcccgccgacggtgagatcgtgctggacccgcgggcgcgcaccgcgctgcgcgacggccgccgcctcgacctgagtcgcctggagtacgacctgttgctcttcctggcccagcacccgcgtcaggtgttcagccgcacccagctgctgacccacgtctggggtcatcggcacaccaccaaccgcacggtcgacgtgcacgtcagccggctgcgcaccaagctggacgatccggagctgatcaccactgtctacggcctcggataccggctggccgacgacgcgccgattgccgtgctggagcactga

SEQ ID NO: 4466 - DNA, 1041 bp, Actinoplanes utahensis
gtgctcaacccgaagcttcgccggccgatcgtcggcttggcggccggcatcctcatgggcagcgccctggtcgccgcgtcacccgcctcggcagccccggccctggccgacccgtccttcgcgccgtccgccctggccggccggatcgacgcccagctgggcacccgcgacgccgggtcctacctggacgcctccggcaagctggtggtcaacgtcaccgacgcggcgaccgcggccgacgtcaccaaggccggcgccaccccgcgctacgtcgcccgcagcggcgccaccctggccgccgccgacgccagcctcaaggtcaacctcaagaccccgggcaccgcgttcgccgtcgacccggtcagcaaccaggtcgtggtcagcgtcgacgagagcgtcaccggcgccaaactggccgccgtcaaggcgaccgtcgccaaactgggcgacgccgcccggctcgaaaccatcgccggcaggaccagcacccggatttccggcggcgacgccatctacaccagcagcgcccgctgctcgctcggcttcaacgtccgcgacagcgccggcacatactacttcctcaccgccggccactgcaccaacatcggcgcaacctggacgaacggctccagcacgctcggcacccgggccggcaccagcttccccggcaacgacttcggcatcgtccgctacaccaacacgtcggtcaccaagagtggcgccgtcggctcccaggacatcacctccgccggcacccccgcggtcggcgccaccgtctaccgccgcggctccaccaccggcatccactccggccgggtcaccgccctcaacagcaccgtcaactactcggaaggcaccgtctccggcctgatccgcaccaccgtctgcgccgaacccggcgacagcggcggctccctgtactccggcaccacggccctcggcctcacctccggcggcagcggaaactgcacctcgggcggcgtcacctacttccagccggtcgtcgagcccctcagcgtctacggcgtctcggtctactga

SEQ ID NO: 4467 - DNA, 207 bp, Actinoplanes utahensis
atggtcgacgaactccccgccctgcgcgaccacatggtcaacgacgtcatgccgctgctcagcaagctcgaccaggtcggccccgacctgcacaaactcctcgaggtcaccgaggacctgcacctggccatcgccggcctccccggcctgaaactcctccgccgccgcggcgaggaacgcaccgaggaccaccacgtcaaaccctga

SEQ ID NO: 4468 - DNA, 636 bp, Actinoplanes utahensis
atggcgtccctgctgtcccgagctgtccacctgtcccgcgtcgcgctcagcgcccccgcggtcgccgccgacctcacccgggccgcgatcggccaggtcatctccaccgcgggcgccgtcgccagcctcccggtccgcgccgccggcctcctcggccaggcagagctcctggtcacccgggccggcctggccgtcgcccggaccgaagacctcctgcaccgcgtcgccacggtgaccacctcggccgagaccacggtcgccgacgtccgcgacatcaccacggccgcccgcaccgccatcgccgaggtccaggcgatcaccgcggcggcgcagaccgcggtcggcgagatccaggccatcaccaccacggcgcacaccgcggtcggcgagatccaggcgatcaccacggcggcgcagaccgcggtcggcgaggtccgggccatcaccaccgcggcgagcctcgccctcgacgaggtcggtgcgatctcctcggcggccggcgacatcgtccaccgggcgggtgccaccgccgacgccgccggcaccatcatcatcgaagccggcactttgacgacctcagccgccgagatcgtcgccgaggccggcgcggtcagcgccgccgccctagctagctag

SEQ ID NO: 4469 - DNA, 1080 bp, Actinoplanes utahensis
atgggtccattctgcgcccggccggcaccgcgcgccggtgacggaacgtggtggtgctgcggctcaccgtcgaaattcggatatctgtggacgattcatagtcggcagcacacccataatcggtgtgggcagtgcatcatggctggcgtgcgacgtaccccccattggattctgatctttgccgccgtggtcgccgtcggaggtgtggccgtgctggccaagggtgtgatgggcagcggggacaccggcgcgacgtatctgaccgggagtagcaccggcaccgccgccgggaccggcgccggcagcagtgcgggtgcgtcgccggccgggccgagcgccgccgagctggccaggatcgcacgggacaagcaggtcaaggcgctggacgcggcgctgaggaagtatgccgcgaccgtcccggagttctccgtcgccgtgctcgacaagaagaccggtcagctgtacgcgttccgcggcgacaagagctacgagaccgccagcgtcgtcaaggtgcaggtgctctcctgcctgctgctgaccgcgcaggacggcgggcggcagctgaccgcctgggaggactcccgggcgaagaagatgatcaggctcagcgacaacaactccaccaccgacctgttcgggcatctcggaaggcaggccggggtgcagcggtgcgacaagcggatggggctgacccagaccaccgtgaactccagctggggcctgacccggaccacggtgacggatcaggtgaagctgctgtcccagctggtcgccgacaagagtccgctgagcgcgaagtcccgggcgtacgcgcacaccctgatgagcacggtggacaagggccagcagtggggagtgccggcggcagcgcgctccggtgagcagttcaccgtgaagaacggctggctggaccgttccaccgagcacggactgtggatcgtcaactcggtgggccggatcaccggcggggacaccgacgtctcgatcgcgatcctgtcgcacgggcacaggacgcaggcggccggcgaggtggtgatcgagaaggcgatcaagatgacccggacgtatttgaagtactag

SEQ ID NO: 4470 - DNA, 585 bp, Actinoplanes utahensis
gtgatcgccactctcggggcgctcggctggctgttcgctgtggtctgcttcggtgcgatcatcccgatcgtgccgaccggcgccgcggtcagcggcgccgccaccctcgccttccacgagcaccacccgatcaccatggtgttcgtgctggccgccggcgccgccggggcctacgtcggcgacctcgccatgtacgcgatgtgccggttcggcggcgagcaactggcccggcggctgcgctggctgcgcgacgaggagcatctggccgcggtcaaggaccggctgcgggaccgccaggtcccggtcctgctggtctcccggctgatcccgggcggccgggtgccggtgctgctcgcggccgctttcgcgggtctgtcctggcgcaccttcgtgatcgccaacctgccggcctgcgcgctgtggtcggtcgtctacgccgcgatcggcgtggccggcggctcggtgttcccccggccgtggcagggcgtgctcgccgcgatcgtcctgatcctcgtcatcaaccaggcgatcacctggtggaacaggcggacgtctagtacttcaaatacgtccgggtcatcttga

SEQ ID NO: 4471 - DNA, 777 bp, Actinoplanes utahensis
gtgagcacgacatcggtcacctggtgggggcacagcacggtgtggctcgccgactccggggtcaccctgctcaccgacccggtgctcaccggccggctcgcccacctgcggcggatggccggcccggcgcccgtcctggccggcgtgccggacgcgatcctgctctcccacctgcacgccgaccacttccacgtgccctcgctcaaggccgtcggcggtgagccgctgctggtggtgccggccggcgcggcggcgttcaccgcacggacgctgggcccgggcgtcgcggcgcgctgcgtggagctggcccccggcgacgaggtcacgatcggcgcggtccgcgtccgcgccgttgcggcgcggcacgacggcgggcgcggcccgtggtcccgggagcgggccgcggccgtcggcttcgtggtcgagggcgcttcgcggtcgtggtacgcgggcgacaccggcctgttcgaccagatgcacgacctcggcccgctcgacctggcgctgatcccggtcggcggctggggccccagcctgggcgcggagggccacctggacgcccgggacggcgccgaggcgctgcgccgggtcaaggcgtcgtgggcggtgccggtgcactacggcacgctgtggccgatcgggatgggccggatccgccggcacatgttcgacgagcccggcacccggttcgccgagttcgcggcgcgcgcctgcccggacacccgggtgcgggtgctggcccacggcgagacgctcaccgtcggaccggccgcgtga

SEQ ID NO: 4472 - DNA, 906 bp, Actinoplanes utahensis
gtgaccgatcttgatcaactgcggcagacgctgcgcaccaccctcgccaaggccggctggccggagcccgcgtggttcgagaccacccccgaggaccccggccgcggccaggcgaagcgggccgtcgccgagggcgccgagctggtcttcgcgtgcggcggcgacggcacggtgaccgccgtggtgaccgcgctgaccggcaccgacgtggcgctcgccgtgctgccggccggcaccggcaacctgctcgccgccaacctgggcctgggcaccgacccggcgaccgggctgcaggtggcgctggagggcggccgtcgccggatcgacgtcggggtgatcggcgaccagtgcttcgtggtgatggccgggatgggcttcgacgcgatgatgctgcaggacacctcggagaaggcgaagaagcacatcggctggccggcctacctggtcggggcggccaagcacctgctggaccggccgatgcgggtgcggatccggctggacggcggcgcgccgatgccgcgccggccgcgcaccgtgatcgtcggcaacgtcggtcggctccagggcggggtgcggctgctcaagcgcgcggcgccggacgacgggcagctcgacgtcgcgatcatcagccccaacaacctgttccactggttgcagctggccgccggcgtggccagccggcgggagcgggtgccgctgatggagacgttcaccgcgagccgggtggagatctacagcaaccgggcccagccccggcagctcgacggggatctgatcgcccccggcaaggccatgaagatctccgtacgccatcgggctctgctgctctgtgtgccgcaacccgacgcggacccggacctggcctatgacgcggaggcgaccgcgaaacgggcgaagtcgttgtga

SEQ ID NO: 4473 - DNA, 1701 bp, Actinoplanes utahensis
gtggtgggcggcgagcctgtccctggccgggtacatccggatcagcggcagcttcggcgccacctacggcccgctgaccgcgatgatggcgctgctgctctgggccaacctgaccggcatcgcgttcttcgtcggcctggccttcgccgcccagctcgaagcccgccgggtcggggcgaaaccggcccagcccgaccagtgggagcctgccggagttcccgcccagcgcaccgacggtgtaccgagcgagccgacggggtaagcacgcgtgccgtgtccgatgtgaaagcgcggcgcttcgccgaacgcagtgtgctgggcctgatcgcggtgatcgtggtcgggctcgggttcgcctcgttgctgctcctggtgcggttccactggaccccgctgcagagcctcgaccacgcggtggcggacgggctcaaccaccaggtggccggctccgacgtcacggtgaaaatcctgcagcagatctcctcgttcggcggccgggtcttcatgatctcgctggtcaccgtcgtggtggtgatgctgctgatccggcgccagcggcggctcgcgctgtacctggtggtcaccggggcgggcgcgctgatcctggacccgtcgctgaagacgctggtcgggcgggtgcggccggtggtggagtcgccggtggcgcatgcgccgggcaacagcttccccagtggacacgcactcggctcgatggtcgtctacgggatgttggcgctggtgctcctgccggtcttcaggtcgtacggccgctatgtcttcctgggtctgatgggcctgatcgtcgcgctgatcggtttcagccggatcgccctcggggtgcacttcctctccgacgtcctggccggctggatgctcggcatcgcctggatcggcaccaccgcgtacgcgttccgggtctggcgccgggagagcggccagcgcaccgagaacgtgctgcaggagggcctggagccggaggcctcgcacaacctggagatcgccccggccgaggaggccgtgctgccgcacccgtgggccaagggcgccgagatcctcgtcggctgggtgctcaccttcggactgctgtacggcgtgggttacaccgtgacgcactggaacccgggctgggacaacgccttcgaccgctggttgcagaccttccgcaccccgggcctcgacaagatcagctgggggtggagcaaggccggcgacacccacgccatcctggccgtctcgctgatcttctgcccgatcgcgctggccctgtggcggcagtggcggccggtgctgttcctggtcctggccatgttcggcgaactcagcctgttcctgaccagcgccgccgcggtcggccggccccggccggaggccgcccagctggacgggcagatgcccacctcgtcgttcccgtccgggcacatcgcggccacgctctgcctgtggaccgcgatcgcgatcatcgtgctggcccgggtccggcagccctggcggtggatcttcgtggtcctcgccgtggtgatgccgctcggcgtcgccctgtcccggatgtaccgcggcgaacaccacccgaccgacgtgttcggcgcgctgctgctcgcctccgcctggatcaacgtgctgtattggacggtgcggccgaacgcccacgccgtgacggccaccgaggccgccgtcgagaacaagcaactggtggtcacctga

SEQ ID NO: 4474 - DNA, 786 bp, Actinoplanes utahensis
atgcggatgatgacctggaacatcaagaccggtggggtggaccgggggcaccgtttccggctgccggccatcgccgaggtgatcgccgccgagaaacccgacatcctcaccctgcaggaactgcgcgacttccagcggggcggcgaacggcggatgcacgaactcgcctcggcggtcgggatgaccccgtacctggcgcggtccggcttcgggatgccggtcggggtgctcgtccgcgacccgctgcggatcacccgcaccaccggcgtcacctggcggctgcaccacgccgcggcggtcgtcgtggtggccacgccgtccggcccgctcaccgtgatcagcgcccacctcgacccgttctcgccgtaccggcggatgcgcgaggcccgctggctggccgcccggcacgccaggtcggcgcgggtgctgctggccggcgacctcaacggcctcgacccggtcagcgaccacaccgaggcgctggccagccagcagtcgatgttccgcaaacgccacctgtacccggacgggacggtcgacagccgggcactggccgccttcggtgacgccggcctggtcgacctgtggagccgggccggcagcggtgacgggcgcaccgtgccgaccaccgagggcggcggccgcgagttcggcgggatgcgcctcgactacgtgctcgccacccccgccgtggccgacggggcgcacgacatgcgggtggtccggggcggtgccgcggagcacgcctccgaccattatccggtacgcgttgacctcgacctttag

SEQ ID NO: 4475 - DNA, 423 bp, Actinoplanes utahensis
gtgcgcttgccgctggtgccgtccgccatcctgaccgtggtctacctggtcgggtacctcacgctgtcgatcgtctaccaccggcggtgggatgcccggctgcgggccgccctcggccggcggctcggcgccccggtcggctgggagtatcacgaccggtggcacgacccgctgagcgacgccacctccgccggatatcacggctgggcggctcagggtgacgcgtcgctgcggcagcggttcctggtgaacatcgcccacctcgccgtgctggtcctcgtcggggtcgggccgatcgcggtgtacctgttgatcgccttcgccggcctgatccacccgctggcgctgtgggcggcgctgttcctgttcatcccgatcttcgccctgttctgggccggccgctaccgctggaaccgcacctga

SEQ ID NO: 4476 - DNA, 609 bp, Actinoplanes utahensis
atgatcgaccagctgacggtgccaccgcgcgtcgtcgtgaccagcaccgtctccggcctgatgatgatgagcttcttcaccctggcctgggtgtccaacctcttcgccgggtgggccgcaccggccgcctggtcggccacggcgatcgccctggcctgcgtgctctgcttcgtcgggcgggccgtccagctgatccgatcccgccacgccttcccggccgagttgtccgaggaacagcagcggcaacggcgtaccagcggccggactttcgggctgctgttcggcgcggaggccgcggccatctgggtggtggtgctcctgctcggggccaccggcaggagcgactacgtcgtcccggccatcgccctgatcgtcgggctgcacttcttcccgatggcgcgactgttccgccgccgtgtcgatctctacatcgccgcctggacctgcctggtcgccgtcgccggcctgatcctgaccggcgtcaccgacctgccggcggcccgggtcgacgcctgggtggcggtcggcgccgcggcggcgaccgcggcctacggctggtacatgaccgggacggccggcgacctgctgcggcgggcggcgcgcggatag

SEQ ID NO: 4477 - DNA, 723 bp, Actinoplanes utahensis
atgctcactccctggtggcggacgcggaccccgtccgccgccccgtccaccggcagcaccgccgccaccccgatcctcgactggccgagcccgccgctgaccgaactgctggccgccctcggccccgtcaccgacccgtgggaccggctgcggtccgcccacacgctgatcgccgcccgggtccgcccggtctacgcggtcgacgaccagcagccggtttcggtgacgctgacccgcggccgcggatcgtgcagtcagcggctggcggtgctggaggcggtcgcgcgggcgtcgggtgtcgccacccgttgccgggccctggtggtggacgggcggttctggtatccgcggtttccccggttgcgccgtctcgttcccgccgaggtgctgctggcctggccggagttccggctcgacgaccggtgggtgccggtcaccgagttgttcggttcggtcgagcagctgagtgccggcggcggtggtttcaccaacagtggcggggagaccctcttcgacgcggtggcgcggaccgccgtggactgggacggggtgaccagcacgccgggcggctgctcgtcgtgtgacctgtccgcgacggtgctcgccgatctcggtcgcttcgattcccgcgatgaggtgttcgccgggtatggccagaccatgtgctggggcgcccggaccctcggcgggccgatcctgagccggtgggcgcccggccggtga

SEQ ID NO: 4478 - DNA, 1458 bp, Actinoplanes utahensis
atgcgttcccggacggcgcaacgccgcgcgacaggccttcactttcctccggatgacgtccgtaacacagcggaaacgcatgaggtcccggcccgaaaccgtggctggcgagtctgtatcccgctgatcgtaggatgccgcgccctggaggaaagcatgcccgctcacctggactccggggacaccgcctggctgctggtcagcgccgcgctggtgctgctcatgattcccggcctggcgctgttctacggcggcatggtgcggatcaagagcaccctgaacatgctgatgatgagcttcgcctgcctggcggtggtcagcatcatctgggtgctgtacggatactcgctggccttcgggccggacgccggcgacggtctgatcggtggcctgacgctggccggcatgaccggcatcggtcccggctcgctcagtggctcctcccccaccctggtcttcgcggccttccagatgatgttcgcgatcatcacggcggccctgctcagcggcgccatcgcggaccgcgccaagttcagcacctgggtggtgttcgtggccgtctgggtgaccctggtgtacgccccgatcgcccactgggtcttcaccccggacggctggatcgccgcccacctgcgcatcctcgacctggccggcggcaccgtcgtggagatcaactccggcgcgtcgggcctggccctggcgatcgtcctcggtcagcggctcggtttccgctccgatccgatgcgcccgcacagcatgccgctggtcgtcctgggggccgggctgctgtggttcggctggttcggcttcaacgcgggttcggcactcgccgccaacggctcggccggcctggccttcttcaacacccaggcgtccggcgccgccggcatcgccggctggctgctcgtcgaacgcctccgcgacggccatgccaccaccctgggcgcggcctcgggcgcggtcgccggcctggtcgcgatcaccccggcctgcggctcggtcaacccgctctgcgccctgctgatcggcgtcgcggccggggcgctctgcgggtacgtcgtgggcctcaagcaccgcctcggactggacgactcgctcgacgtcgcgggcgtgcacggcgtcggcggcttcctcggcaccatcctgatcggcctgctggccaccgccacggccaccggcggcccccgcggcctgctgttcggcggcggcctgtcgctgttcggccggcaggccgcggccgcggtcaccgtcgccctgttctcgttcggcgccacctggctgatcgccaccgtcctgcaccgcaccatcggcttccgcgtcgaccccgaccacgaacacggcggcctcgacctggccatccacggtgagaccgcctacgacctgggggtcgggggcggccacaccacccacgccgcccgaccgtcgtcgcaccaccacgccccggccgacgctagctag

SEQ ID NO: 4479 - DNA, 510 bp, Actinoplanes utahensis
atgacgatcgagtttccgtcgccgacccgtccggccggcggcaccgccgaggtcttcacgggctacctggcgtacttccgcgagacgctcctcgccaaggtcgcggcgctccccgagggggagcgccgcggcagccggctcccttccggttggtcgccggtcgagctcgtcaaacatctgcggtacgtcgaactgcggtggatcgagtggggattcgagggcgtggccttcgacgatccgtggggtgaccgcaacgtcgaccgctggtacgtgtcgccggacgagtccttcgccgacctggccgaggcgctgcgcgcgcagggcgcccacaccgacgcggtgatcgcgaagaccggcctgtccgcggtcgggcagcccggcccgcgctgggacggcgccgagccgccgaccctggagcgcatcctgttccacctggttcaggagtacgcccggcacgtcggccacctggacatcgtcgtcgagctctcggtgggcgccgtcggcgagtga

SEQ ID NO: 4480 - DNA, 1581 bp, Actinoplanes utahensis
gtgacgacggagacggcgaactgtgtccccaccgggttggctcaactcggtgccctggaggctgccgtggtggacctcgagacccgcccgcactcgcagttccggacggtgatcgaaccggcccgggtgatccgccggcaggctgaggagctcggcgccgaggagctgtaccaccgcgctgagctgctgctcgcctcggtggacctgcgcgagggccggatcggcgagggtggccagacggcgcaccgcgtccgggtctgggcggaacagcacgattcgccgtatctgctggcccgggcccaccggcagctgtcggtcttctaccggttcgtcggtgacgccgccgacggtctcaaacacgccgtgcagtgcgtcgcgcacctgcgcgacgacttccccaccacgatccgcgcccagcacctgatgtcgctgtcggtggccctggaggagaccggttcccgggccgacggcgaacgccgctgccgggaggcgctggccctgaccatcgccgccggcgaccatgagatgaccatcatggcgctcaacaacatggtctacagcgcctacgagaacgacgacgagccgaccgcccgcgcgctggtcgcccagatgcacgacatccagtcccgcaccggccaccggttcggcgccggcgagctggacaccctggcccgggtcgagctgatgggcggccactacgacgaggtggaggcgctgctcaccccggtcctggccgacctggtcgcggccaacgagggtgacgcgatcgccgagtgccgactcaccctggccctggctcgccggctggccggccgctacccggaggcgcagaccgccctggacgacaacctgcgcatctgcgaggagcgcgggctggccgcggtccgcgcccggatccgcgaggagcaggccgcgctgtacgccgccaccggccggttcgccgaggcatacgaggcgcaccgggtgttccacgcggagacgaccgcgctgctgtcggtgcagcgggacgcccgggcccgcgccctgcaggccgtcttcgaggcgaacgaggcccgccgggccagcgagcacttccgcgagatggccctgcgggacgccctcaccgggctctacaaccgccggtacgtcaacgagcgggttcccgccctgctcgccgaggccgccgagcggcacaccccgctgtcgctggcgatcctcgacctggaccacttcaaacgggtcaacgacacgctgtcgcacgccaccggcgacaccgtcctgcagcacgtcgccgagctgctggaggaggccatcccgggcgccggcctggccgcccggatgggtggcgaggagttcctgctggtcttccccggcatcggggcggacgaggccgcggtccgctgcgagcgcctgcgcctgcggatccgcgcgcacgcctggggaccgatcaccggcagcctccccgtcaccaccagcatcggcgtgatcacctcgccggacgggcacgggacgctgtccacgctgctgtccgaggcggaccgcaacctgtacgccgccaagcgcagcggccgcgaccgggtggtcgcgcatctgaccgcctga

SEQ ID NO: 4481 - DNA, 180 bp, Actinoplanes utahensis
gtggtgatctccggcggccgggccgggcagcggcccggcgagttccagcggttgccggccggcgcggtcgactacgaggtctacagcctggacagcgccgtcgactactgcttcacggtcgccgtgcagtcggccggtggcgcgctcgccgcctccgccccggtctgcacggcccgatga

SEQ ID NO: 4482 - DNA, 1095 bp, Actinoplanes utahensis
atgaggtacgtggctcctcccctcgccgaactcaccgctcaggctcagtccctgtcgtcggccggggatctcgccggcgcccgggccgtgctggccgaggtgctgcgctccgccgacgccgatccccgccgtgccaccgccgagctggccaccgccgccgcgctgttcgcccgggtgctgatcgcgctcggcgacccgcagtcggcccggctctgggccgccttcgcgcacgccgccgaggagcagttgcacggcacgcgggacgagcggacgatcgccgcggccgccctgcacgccgccgtcctgcaccggatcgggcagtacggccgggccgccctggtctatcacgacctggtcggcgagctggcgcacgtcgacgacccggacgcgccgcgggtgctggccgccgaggccgacctggccaccgccgagcacgcggccgggcactgtgccgccgcccgcgcccggctcaccgacgcctggcggcgccaccggcgccggtacggcgaggagtcaccggccgggatcaagatgctggcccggctcggcgcgatggagcgggagtgcggccgggacgccgcctcccgcgaccacctggccaccgcgctgcggctcagccacgagtacctgccggcggaccatccgctcgcgctgcaggcggccgcgctggccgacggcgaacgctccggccggcacacctgcggacggatgacccggccgtcgcgcgacgacgacaccgagctgcgccccggcgggttccggccgtttccgcgccgtcccacggtgcccgacccggacgcggtcggcagcgggtcgcggcgattcccgccggccccggacgacaccttcgacgacgccggtcagccgccgccggacaacctggcgaccgacccgaacggcacggtctatcaacagccgttctatctgagcgacctgagcctgccgggtgatcccgccggccggcacgcccgcgccgacacgccacccccgctgcccgggcggaaggctccggagtacggcccggacgggcgccccgtgccgatcggcaccgcccgccccgcccggccccgtcggggcgggcatcccgcgctctag

SEQ ID NO: 4483 - DNA, 888 bp, Actinoplanes utahensis
atgtcagtcacgacggtcaagcgcgagctcctcgtccggcacctcgaagcgtgggccgcggccgcggtgcatcgcggccgtagggccatctacgtgcacggatacgccgacgtggacggcggggcaagcgccgaggcggccgtgcgggtgctcgccgacctgccggacctggcccgcgggcgggaactgtccatggtggcggtgggtgacgacatgacgacaatcactccccggctgggcgaggtgcagcagcaggcgggtgccggggccggactgtcggtgctgccgatcgccgccacggtggaggtggcggtacgggcggccggggccaagaacgtaccgacgctgggctatctggacgccggggcggcgagtgaaccgccggcggtgcccaccgtggcgtgccttgccgccgggaaaccggcggaggtgctgctggtgctgccgcccggagcatcggcggatccctatcggacggccggttttccgctgctcaccgcggccgagctggcgaccggggaggaacccgggcaggtggtggtgttcgcgaccgggtcggggaagagcctggaacagttcaaggaggcgctctgggcggtcgacgagttcgccggcgtccggctgcgcgacccggccgacccggaacgccacctcatcgacatctcgctgcagccgcaccccggcccgctccgccgggagatcctggcgtacctgggccgggtgggcgcggcgacggtgagcgacctgcggacgttcgcgctgaccgggacggtctaccgggcggcggacgcgaatcgcgtgctgcacctgatgatcgacgccggggtggtcgcgcgcgagccggcgcacggccggctcggcggggacgtgctgatcagcccgatctag

SEQ ID NO: 4484 - DNA, 174 bp, Actinoplanes utahensis
atgggcctcatgttccgcagccgtaagaagttcggcccgctgatcctgaacttcaccgagaacggtttctcgtcctggagtatcaagatcggccgctggtcctggaactcgcgcacccgcgcgcaccgcgtcgacctgcccggcccgctgtcctggaagcaggacaagagctag

SEQ ID NO: 4485 - DNA, 456 bp, Actinoplanes utahensis
gtgcagatctccgcgcgcggcgactacgcggtccgggccgccctgagcttggctcaggcctacccgtcactcatgtccgcccaggccatcgcccaggaccaggaaatgccccgcaagttcctcgaggcggtgctcgctgacctgcgccgtgccggggtggtgcgggctcagcgcggcgccgagggtgggtacacactgtcccacccaccgcgggaggtgacgatcggccagatcatccgggcggtcgacggcccactcgccggggtgcgcggtctgcgtcccgaggagacgcagtacacgggggccgccgaaaatcttccgaacctgtgggtcgcggtccgggccgcggtccgtgaggtgctcgacgaggtgagcctggccgagctcgtcagcgggcggatgccggcgcacgtgcgcaagctgaccacccggccggacgcctggcagccacgctga

SEQ ID NO: 4486 - DNA, 936 bp, Actinoplanes utahensis
atgccagcactcattcatcgcgccgagcgcgtaccagcctgtataccgcccgcctgggcgggggtcggtgcctgtgccctgccggtggcggcgggatccgccatcggcctgctcgagtgtcacgcgctcgtgctgatctccacgggaccagtgcatgccgacgtagatttcacgtcccatctggccggaccgggaacgctgctctgggcgcgccccggccaggccatccgcttccagacgccgggaaagacgccaggaaagacgccgggaaagacgccaccgggggagacgaccacgggcgatacgaccacggtcgtcttccggcccggcctgttccagcccggcgagttgcccggcctgcatcccgacgatccggacggtccggccacggctccggtggtgctccctgacccgggcgcctggaaagccgcgatgacgcaactggcggccgacgccgaggggaccggcgccgcccggggcgaggtggcccgggctctgctccggcaccagctcgccgcactgctgttgcgcctgcggctgctggacggcggcggccacgactccggcaatgtggagagccgcaccttcgagcggttccgccgccggctggaggacggttatcagcagagccggcgggtcgaggactacgccgacgagctgggctgctcggtgcgcacgctgacccgggccagtctggcgatcaccggacggaccgcgaaacaggtggtggacgaccgggtggccctgcaggcgcggcggctgctggccgccaccgacctgtcggtcgccgagatcggccgggtcctcggcttcggggaaccgaccaacttcgggcggttcttccaccgcgagaccgggctgagtccgggccatttccgcggcgacttccacgagcgtccgaccgggatacccgggcaacgaccacccgctgactga

SEQ ID NO: 4487 - DNA, 432 bp, Actinoplanes utahensis
atgagtaccattcgtccaacgaccgtcgaggtcgagacctcgctgcggctcgtagcgccagacgcgacggcactgccggtgcgcgccagtctgcgttacgacccgtcggatccgtatgcggtccatgtgttgttccacgcggaatcagccggtggggaagccgtgagctggtccttcgcgcgggaactgctggttaccgggctcgacgagcccgcgggtatcggcgatgtccgggtgtggccgtgggccacgccgcgaggggacttcgtcgctctggcgttgtcgtcgcctgacggcaacgcgctgttcgaggtgccgcgcagtgtcctggtccgattcctgcggcgcacctatgtggtggttccgcgtggccgggaatccgaacacctggacgtggatgcggcggtgaatcgcctgctcgccggtcggtga

SEQ ID NO: 4488 - DNA, 408 bp, Actinoplanes utahensis
atgggtgtaaaaccggacgacagggctacggacgtgcgtctgctcgaccgtatccgttccacccccggcgggcggctcgctctgaagatcggcgtcggaaccgtcggcaccctggtcgtcgccatcggcatcgttctcatcccgttcccgggtcccggctgggccatcgtcatcctcggcctggcgatcctgtccctcgaattcgcctgggcgaaaacagtcctcaccctcacccgccggcacgtcaaaacctggaccacctgggccgcccgccaaaccctcgccgcccgcgccgccctcggcgcgctcggcctcgccttcgtggcggcggtggtctactacacggtccgcctcagcctgcacatcgacctgatcagggtcggtcgcgacctgctgccgagcgaatga

SEQ ID NO: 4489 - DNA, 1095 bp, Actinoplanes utahensis
atggcatgggtcgaaaaccgcggcgacggctaccgggtccgctaccggcgcccggacggcacggtcggcaccgacagcagccacaccaccaagaaagccgcccaggaccgggtgaaagccgtcgagaccgaacagcagcaggacacctatgtcgaccccagcggcggcaagatcaccctccgcgaatgggccgacctgtggctggccgcccaccaggtcagcaaaagcaccgccgctaaacaccagacctacctcaaggtccacctcctaccccgcttcggcgacaccccgaacaacgacatcacccgaatgatggtccggacctggatcaaagagctcagccagcgccgggcaccggccactgtcaccgacatcctcgccctgctgtccatgctcctgggcgaagccgtcgaagaacgccgcatcaccatcaacccctgccgccgtctacgccccgccgccgtcccgaaagccgaacgcccctgggccacccccgcccaggttctcgccatcgccagccacctcaaccagcccgaggccaccctcgtcatcaccgccgcctacaccggcatgcgctggggcgagctggtcggactgcaacgacacaactgcgacctccgggacgcccgcatccacatcgacccgaaagtgggggccctccacgagatcgccggcacccttgaactcggaccacccaagacccccgccgccgtccgcaccatcgcgctaccaccgttcctggtcacccggcttcgtgagcatctggacagccgcgaccacgtccacgtcttcgccggcgccgacggcggcctccaccgccgctcgaacttcgcccgacgcttctggcgacccgccaccgacggtgacccgaagaagctgatcgtccccgtcatccccggcatgcatttccacgacctacgacacacgcacaagacctggatgatcgaagacggcgtccccgaggtcgcgcaagccaaacgactcggccaccgcctacccggagtccgcggcatctacagccatgtcagccccgccgtcgaacaacgactcgtcgacggcctgcaaaagcgctgggaggacaccgcgaaacggtga

SEQ ID NO: 4490 - DNA, 2415 bp, Actinoplanes utahensis
atgagtggcctgacgctgcaagacctgctcgagttcgacgccgggccttggcacagtgcagccgacgtctggcagcaggttgcccgcggtctcgataccgcgaccgaccagctgatcgtgggcacccgtgatctggttgcggtgtggccgcacggcggtggatcggaagcggctcgccagaaggctgccatgctgcgggccgagttggaaaatacgtatctgccagcgaaacgcctggccgacgcgtttgaccagcacgcatacgcgatgaagagcctgcggagccaggcggagggaatcgtcgagtcggcgcggcacgctggctacaccgtcgactcggtggccgtcacgatcaccgcgcccgcgtcggcgtacatgggcggcgacctcgaccggaccgggcgggaaaccggcaccctgctcaacgacctgcgccaagtcgtggagtacgcacgcgcacaggacgacgcgacggccgccacgatcaacggcaacgtgccttcgcctcagaacggtttcggcgccagtccgccaggcgcagctgcccgggctgaggaactagcgaagaagctcctggactcgaactaccggcctacgccggctgaactcgacgaactgcggaacctgatcaccctgtacggccgagacaaggtcttcgactacgactttctgaccgcgctcggacccaaaggcttgctgcaactcaatggcgtgctggcgacctaccagcccgacggccccggcaaggacgccgacgggtggatgttcagcaacgagactgctgacacggtccgtgacctgcagaacggtctcggcttgatgctggcgaccgcgaccgagcacaccggcacccagaccggtccgcgcggggatacctacgtgcccggtgatcacgagctgtccggccagtgggttggcgacctgatggccgccggacgcagcaagatgaccgtcgtaggcccctacggcccgcctcaagatgtcaacgtctacgggtatcagctactaagcccgctgctccacaatgggtcatacgacgctcgattcctgactgcggtcggcggggacatggtggatttcgagatgtcacagggcaagaacagcggactgtggaccgctgaacgcggtgacaacctgcgcctggactggacccatggccatgacgacaataccgtggcggccggctacgaccctatgaacggcctgatggacgcgctgtcgcgcaatccggaggctactcgagacctgctcaccggtgtcaccagtttctccgcggacggcccggtcggcggtcggctggaccggctcgactacctgctcaccgaccggaactggaacgcggacgttcccggtggctccggctggtcgaacgaggtgatgcagcacggcggcgactacaagagcaccgcgctcgacgacttcggtaccgctctcgaatctgccaccactggtgagcccagcccgcaagcccggcatatcgtcgagtcgatcatctacgagaccggcgtcgacgagcaggctcagggctaccacaacggtgttatccccggtcacggcaagagtgaggacttcgcccactccgacctcatccagccgcagctgcgccagcacctcgcaaagatcacatccgcctatatcttcgacgtgaacctcaacatcgcggacggccacaatgcgatccccggccagaccctcgatgtcgaccacaaccacctggtgcgattcctagccgacctgggcaaggacccgggagcacacgagacgatcgccaaggccgaggctgcgtacgcggcaggcagctacgacgagatcctgtctggccggcagaacccgcacaacggccttgaccgcaacctgagctcgatggagaacgtctcgcacaactacggcagtgtgatgggtgcgctcgacaagggagcgaacgatgttcaccacatcaccagcgcccaactggacgaggcctacaacaacaaggtcgagagccactacaagatcgctggccgcttggtcgacgaggtcatgggtaaggtcaccagtaagatcacggtgccggtcgccggtgacctggccaaagagtacgtcgacggcctgatgtctcaagccgaggaacaggccaaggtcgacaacaccggccacgtcacgtacgaggtcggccagtcgcttggggccgccagaaacaccgcggtcggcctcaccgaacaagccctttacgacagcggcaaacttgaggatctgcctgagcggctcctggtggacggccatcccaagccggtgagcgcatgggacggcgacgatatcaaggaatggcagcggtggaaggcacacctcggccagagtgtgctgggtaatgccgccaatagcgccggggacaactatcaaaagggctacgagtgggcgggagagattctcaagtga

SEQ ID NO: 4491 - DNA, 687 bp, Actinoplanes utahensis
gtgaggagcaggacgagccggtccaagccgacgactctcggcgtgctgcttgccgccgtgacggtcggtctgacgacggcaagttgcacgagcgatgatccgcctgcgaccccaacggcttcgcatgcgacacccgtaagctccgctaggcccgtcctgacctacgacgaggcgtacaggaagttgccgatgaacgggaccaaggatctgccgatcacctgggacctgtccaagacaccggacgtcgacgcggtcctcggagcacgtcgaggtctggtgtaccggtactgggatttgagtgcgaccgactcgaccacggtcagcccgatcgggcgattcgtttacaccgagcggtactaccagcagttcctggcacccttcgcgacctcgacgagtgacaacccgtcgatcggcccgatctgggtcaaggtcatgggcgtcgagacgaacagcgcggatcgcatgacagtcacgttctgcgccgatctcggctactggcacgaggcccagcagaagaaccccggagtccgcaaggggcgagcgaaccttgagtcttacgtgatgcaggacgtccagagcagtgacggcgaacgtcattggctcgccgatgacctcctcgataaggatccggaccgtaaggcgaaatacggtacggagtgcacggaatgggctcaacaccagccctaa

SEQ ID NO: 4492 - DNA, 375 bp, Actinoplanes utahensis
atgatcgtcaccgccgcctccgtcagcgacaacacgatcggcatcgacctactcgaccgggccacccgcatctaccccactctcacgaaggcctggggcgatgccggcttccgcaccaaggtcgtcgaacatggcgccacgctcggcgtcgacgtcgagatagtcaccacggacccgcaggtcaaaggcttctcagtgatcaaacggcgatgggtcgtcgaacgcaccatcggatggctcatgcaacaccggcgcctggcgcgtgactacgaaactctcccggccacctcggccacaatgatccgcatcgccatgatcgacaacctcaccaagagagccgtcgacgaaaccaccccaacctggcaagacacctaa

SEQ ID NO: 4493 - DNA, 552 bp, Actinoplanes utahensis
ttgtcgatccgccccaaccacggccgcggctgggccccgcgaacgcatccggaccggctgccggcgacctaccatcgcacgcacggcatccgctacttccacggctgctacagcctcggcgacgaccagctctggggcgtgaaccggcgacgcaaaggcgcagaccacaccctgtccgcgctcaaatcgatccggaaagcgcggccggacggcgcaccgatctacgtaatcatggacaacctgtcggcgaacaaaacgccgaccatccgggcctgggccgctcgtaacaaggtcgagctatgcctgacgccgaccagcgcgtcctgggccaacccgatcgaggcgcagttcgggccgctgcgcatgttcaccatggcgaactcgaaccacccgaaccacaccgtcttagctcgcaagctgcagaaatacttgcgctggcgcaacgccaacgcccgccaccccgacgtcctggccgcgcaacgccgcgaacgagcccgggttcgcagcgaacgtcaacaacgctggggccgaccccgaacgaaggccgcctga

SEQ ID NO: 4494 - DNA, 597 bp, Actinoplanes utahensis
gtggcgcggctcgccgcggatcagcggcaggcgggatccgtacgggacgcggtcgacctgctggtccgccgcgacgggcatgccggcgccgctgagtggctgacgccgcgggctcaggacgacgactgggaatccgtggtactgctcatcgaacaggtggagctgagcggacaggcggatgctgccgcggagtggcgcctgcgggcggcggaacgcggtcacggcgaggtcgcccggcgtctggcggagagctacacggcagcgggcgatcatgtgcgtgccgccgccgtcctatggccatccgccaccacggaccgcagatcggcggggaagctgctcggggtgctggctgccgccggtgacattgatgggctcgagaagctgcaccgcacgcgagttttgcttcgcttggcgtacggggtgggagagctggcggacttcctggcctcgcacggccgggaggctgaggccgaggatgtcgagcagtacggcatcgagccggacggctccacggcgctgaagtggcagataccggacgacgtactggagaccttcgccgcggccgcggtcggtaaagccgtggctgaacaacgatga

SEQ ID NO: 4495 - DNA, 303 bp, Actinoplanes utahensis
atggatccggcccacctgcgcgacgtcctgtcgcgccacgaccccgaccctgaggcggtcctggcccagctacgcgccaagcagggcgcgcgacggcggcggcaggcgatgatcgccatgggcaccgcagtcgtgctcgtcgccggtggcatcggcgtctggtcccggctcggccaggtgccggcgaccccggactacaccgcgggtgcgtcgcccgccggcacgtcgccccccggtggcggccggctcgcgggcgctgacgcggatcaggccgccagcgcctgtctcgccctgccggagtag

SEQ ID NO: 4496 - DNA, 459 bp, Actinoplanes utahensis
ttggtcttccgcgaaggtctcctcgctggcgagtacctgccggatcaggtcaccgtcatacggcagctgcgccgctcgagcccatgttgccgccgccgtcaccgcggtttccggtgccacagccggagcgccgtattcagctgccctgttcgggttcagcacggcggaccatcgtgcgcctcccggtgctgccgcttctacgacggcacagtcgctgtccaggatgtaagccccgacaaccggcgcctgagtgtgagtggcaacggctgcgaccgcgcgtgcaagatctggttcggcaccgaagacctggcggaccagccagccatggtggtcgtcagcgactgcttgctggtgttcgccgaaagcgtcgagcgcaacgctgcgctcctggtcttgaggccggcggatagccacgatgtatccccagtagcccacggtcacgcaccttctcgctgttga

SEQ ID NO: 4497 - DNA, 312 bp, Actinoplanes utahensis
gtggccatcgatctgatcgtcgatctcaggagtaggaaaatcgagacgctcgacgacttctgggatgccgtggcgaagccctgcggactaccggcatggttcgggcgaaacatcgacgcctggcgcgacacgatccaggcgagagggatctcggacctcgtcgatcgccacgatgcggtcgtcgtccacgtcgatcgggcaggtctcttctcccggaaggaccatgaggccagagcgttgcggcaggccttcgccggccgccgttcgcgactcgtggttcatcagccaccaccttcggtaggccaagattga

SEQ ID NO: 4498 - DNA, 1302 bp, Actinoplanes utahensis
gtggctgactggtcgctactgacgggatggttgccgtgggtggtcaccatcaccggcgcgatcgcgttcgtgggattgttggctcgccgcgacaggagattctggacccgggtcgtaccgatcgtcctggcgtcggccgtcgccgcggtcgtcgcgttcgacatcgccgtcgagaaggtgtggcggccgttccccgatgagatccccacccacgacctcgtctggggggcggtgggcttggcggcggtcgcgctggccgccgtccggctgcggcggctctcctggcggttacggccggttgccgtggtggcagccctcgctgtcgtcaccacctcggcggtgcagatcaacgtctactggggcatgtacccgaccgtggaggccctgcgggaagccgcccacagcgaccgggcccggccgctgcccggcggcgtgcccccgagcgagctggtcacggccgccgcgggaacgatgctgatcgactcctggaagcccacccagcagatcccggcgcacggcgtcgtctacccggtcggtattcccggggtcgtctcccggttcccggcccgcccaggctacgtctacctcccgccggcgtacgcggtcctcccgcgaccggtcctccccgtgatggtgctgatggccggccagcccggggaacccaagcaatggctcaccaacctccgcctcgccgacacgctcgacgcgttcgcccaggcccaccgcggcctcgcaccggtcgtggtcgtcgtcgacgacctcggcgccacgacggccaacccgctgtgtgtcgactccccgctcggcaatgtcgagacctacctcacccaggacgtgccggcgtggatccgggcccacctgcaggtcgcctccgaccgacagcagtggttcgtgggtggctactcacacggcggcacgtgcgcgctgcaactcgccgtacgcgcgccctccctctacggcaaattcgtggacatctccggccagcgtgagcccaccctcggcgcccacgtcaccacggtgcagcgggtcttcggcggcgacaacgcggccttcacccgcatcaaccccttggacatcatgaaacggacccgtttcccgacgaccgccgcgttcctcgccgccggcaacgatgaccacagatatctacctcagcagcaggacgtgcgtgccgcctgccaggccgccggaatgcaagtcgaatggttgcagataccgggcaaacacaacatcacgttctggcgggaggccttcaggcaggcgcttccgtggatctccacgaacggccagctcgccgagagctga

SEQ ID NO: 4499 - DNA, 1179 bp, Actinoplanes utahensis
atgcgcggtacgccggtccagcgccgggatcccactcccggtcgccccaacgcgctgtcgctgctgcggcgcttcggcggctcctcgctgtcctacatggcgacgtggcggggcgtgcgacactggtccactccggacggccaggtggtggtgccgtaccggctggtgggctcggtcgcgctgacgatcagcgatccgatcggcgagcggagcctgatccgcggtgccgtgcggcaattcaccgcacactgtcgcagcaacggctggacgccctgcctgtacagcatcagtgaggaggtcagcacgctgctggccaccgacggctggcagttgttgagggtggccgacgacgcccgggttcccctggagctcctgcagttcaccggtcgccgctggcaggacatccggaccgcgcagaatcgcgcgcggcgcgagggcctggtggccgactggatctccttcccggcctccgcggccgcgatcaccgagcagatcgaggagatctccgcggcgtggatggcgcagaaggagatgcccgagatgaccttcactctcggcggcatcgacgagctgcgggacgaccgcgtgcgatgcctgatcgcggtcgacgccgagcaccgcgtccaggcggtcaccagttggcttcccgtctatcgcgccggtgcaaccgtcgggtggacgctggatatgatgcgtcgacggccggaagccacgaacggcgtcatggagttcctcatcgcgacggcggcgatgcagttcaagcaggagggtgccgaattcctcagcctgtccggcacaccgctgacctcggcccagcacgaatgccgcgtgccgcgactgcagcgcctgctggagcactccggtcggctgctggaaccggtatacgggtcgcgggcgctgcaggcgttcaaggccaagttccagccggtgtacctgccgctctacctggcctaccccgacgtcacgtccctgccccgcatcggtcgagccgtcatgcgcgcctacctgccggggttgacggtgcgccgggcgctgcggttggccgtgaccgtgctgcgaggatcgcggcgcgcccgatcgcgcggcagctcagcgagcgtcgccgtaacgcaccgcgctcagccggaggtggctgcgtgccgatgtgcccgctcgaggatgaggagacagggtggctga

SEQ ID NO: 4500 - DNA, 2490 bp, Actinoplanes utahensis
atgatccggctcgccgccgcgatgctgcgccgccggatcggcagcgcgatcgccacgctgctcgccctcaccgcgggcgtcgcgctgctcaccgccatgggcgcgctcctggagtcgggactgcgctaccaggctccacccggccagtacgccggcgccgacgtggtcgtcgcccgccacaccatggccttcacgccggaacagaccggcggcgaggagacggtcaccgtcgacctgcctgccggcggcaccgtgccggacgcactggcggaccggatccgccgcgttcccggcgtggccacggtcgtcgcggaccaccaggtcgccgtggtggtggcggggcccgccaccggtcatgggtggagcagtgcggtgctcacgccgtacaaaatcattgccggaagcccaccggccgggccgggagatgtggtgttggacgcccgcgtcgcgggcggcgccgaaccggggcgacgcaccaccctgctcgttgccggcgtcccgcaggaatacctggtcaccggcatcgccgagggaacgggaccggcgagcgtcttcttcaccgatgcccgggccaccgcgctctccgcggcacccggcagggcggcggcgatcggcgtgctggccgcgccgggcgtcgacgtccacgacctcgccgcccggatcggcacgctggccgacgccgacggcgccgacgcctactccggccggaacctcggcagggccgagcacgacccggcggctcccgaggagttgctgatcgcggtcggcggcaccttcggcggatacgtggcgctgctcgtcatgttcgtggtggccggcacgctcgggctgtcggtccggcaccgccgacgcgacctggcgctgctgcgggcgatcgccgcgaccccgggccaggtgcgccggatcatcgtcgcggagtccgggctgctcggcctgatcagcgcggccgccggtgtcccggcgggcctgctcgccatcggctgggcgcaccaccagttcgtcgaccggggtttccttccggcgagcttccccatggtcaccggcggtttctcggtcctgatcgccgcgggcgccatcctcgtcctgtccatggtgtccggtctgatcgcggctcgccgggtcacccggatccggcccgccgaggcgctcggcgaggcggcggccgagcccctgggcggcggccgggtccggctggtcttcggcgtcctgaccctgggcggggccggcgccgcggcgacgttcgccggcgccacctccggatcgaccgcggtgaacagcgccatcggcatgctctacctgttcgtcaccgccgtcgcgctgctcgcgccctggatcaaccgggtggccgcccacgtgctcggccccgcgctccgggcattctgggggcccagcggctacctggccgccaagaacctcaaggcgaacgccaaggggatgaccacggtgctgacctcgctggtgctgtccgtcgggttcggcggctcggtgtggttcctgcaggacaacgtgcagcgggcgacggtcagccagaaccgcgaaggcaccctggccgacgtcaccctcgtgtcgcccgcaggcctgcccgccgccgcggccgccgaggcgcggcgcatccccggcgtccgggccgccgtcggcgtccagcacacctcggtgctcacggcgagcgaatccgcggcaccggtcgaggcgcaggcgatcgacccggacggcgcggacgccgcactggacctgcgggtcgtcgccggccggctgtccgacctgggccccgagaccgtcgcggtctcccgcctgcaggcggacagtgccggctggacgctcggcggccgggcgaccttctggctgggcgacggcaccccggtcacgccgcgggtcgtcgccgtctacgagcgcggcctcggcttcggcgacgtgacactgccccggcagacggtcaccgggcacaccgggaacgccctcgacgagcggatcctgatccgcaccgagccgggcgcggcgaccgccgaggcgctcgccaccctggccacccgctacccgggcagtgcgatcgccaccacggtcggcctgaatgaccggctcgccgccgatctgtccctcggttcctggctcaacaagctgctcatcggtgtcatggtcggctacgcggcgctcgccgccgccaacaccatggtgatggcggccctggcccggcgccgggagctgtcgctgctgcggctggtcggcgtgaccgcgcgccaggccaagcgcatggtccacgccgagcaggtcggactgctgggcatcgccctggtcatcggcggcggcatcgcggccggcaccctgaccaccgtcgtcggcaccctgaccggcaacctgatgccgtacgtgccggcgctgggctggatcgccgtgctcggcggtacgaccttcctcgcgctggccaccacgatcctgccggtcgggcgcctgctcaggatcgcgccgatccacagcatcggcatcaaggaatag

SEQ ID NO: 4501 - DNA, 828 bp, Actinoplanes utahensis
atgctcgctcgcttccggcagtccggggaccccggtgcgatcgccgtccgggtcgaacaggtctcgcgcgtgtacggcgcgggtgagcagcaggtcatcgccctcgacggggtcgacgccgcgttcgagcgaggcacgttcaccgcggtgatggggccgtccggctccggcaagagcacgctgctgcaggccgcggccgggctcgaccggccgacgtccggacgggtgtggatcggcgacaccgagttgtccgggctctccgagacggcgttgaccaaactgcgtcgtaccgaaatcggctttgtgtttcaggccttcaacctgatcggggcgctcaccgtcgaggagaacatcctgctgccgctgcggctcgccaagcggcggcccgaccggcagtggaccaccgaggtgatcgcgcgggtcggcctcggtcagcggctccggcaccgcccggccgagctctccggtggtcagcagcagcgggtcgcgatcgcccgggccctggccgtccggccgaaggtgatcttctgcgacgaaccgaccggcgcactggacacgcagaccgccgcggaggtgctcaccctgctgcgggcggtcgtcagcgagcaggggcagacggtcatcatggtcacgcacgacccggtggccgcgtcgtacgcggaccgggtcgtggtcctggccgacggccggatcgtgcgggacatgccgcagccgggcgccgcccgcatcgcggaggaactcggcacgctgggccggccggtcccggcggggtcgtcggttccgcagagcccggccggtcagcaggctgtttcggggatgcggcgatga

SEQ ID NO: 4502 - DNA, 2064 bp, Actinoplanes utahensis
gtgccgggcatggtcagtggaacagcggatgtcgactgggcgtcgatggatcacgcctacggatcggccgaagaggtgccggcgatactgcaggcgctcggctccccggacgccgaccggcgcggccgggccctcgccgactactacaacaaggtgctccaccagggctccgtctattccagcacgacggcgagcctgcccttcctcctcgccctggcccgtgatccggccaccccggaccgggccgcgatcgtcgccctgctggtcaacatcggcacgaacgcggccgaggtcgccgacgcgggctacgccggcgaggaccacatcgaggccgtggcgttcctgcgggcgcacgcggcgacgttcctcgacttcgccggggacgccggctgccgggtgcgtcaggccgccatccccggcctcggcgtgctggtcgacgacgcacaccgctctctcaccgcgctccaggaccgctgcggcatgacgtcctgcctgatcgaacgcatcctggtggcccggacgacggccaccctggcccggcggctgccggtgatcgagcccgccgcgacggcatggctcgccgccctggcgagcgacccggccggtgagcccgagttccggctcgccgccctgatccaccacaccgggtgcaccccggaggcgatcgacgacgacccggtgccggccgtgctcgcgctgctgcgcgagatcgccgccgccgtgccgccggagcagccgtggccggagccaccgccggtcgagccgcccgccgacggcgtgcccccgttcgtcgccgccgcgttcgaggacctggaccgccacaaccggtgccacgcgctgaccacggacctgctgcagaccctgcaccggctgctgggcgcccgggtcgcgcagcgcaccgacctgctgatcgagcagttgagcagtcccgatcccggcgtccggctggacgcgatccggatggccgacgatctcgtgtggcacttccgccacgaccacaccgcattgatccggctcgtcgccgcccagctcggcgcgcgcaacctcgaggtcgcggccgaggcggcgacgctgctggagcggcaccacccgatcgccgagcccgcccgggaagccctggccggcctcctcgccgcccatgggccggacggctgggtcaccccgcgccggcatctgcgccgcctccaccagagggcggccatggcatcggcccgcctcggcgacccgcgggcgctgcccagcctcctggtggccttcgacgacgacgtggacacctggcgcgccgtccaggtggcgggcgccctgccagatgccgcgcaccagctggcgccacgcctgtgtgaccgcctgatcggcgccgacctgtccggggagtggccgtcccccgtgggcggcgtgctggccgccctggcaaccctcggcgccccctcctcgctgccggtgctcaccgaaacactcaccgccgcggcagcgcgaccggaccggacgctggtgagcgccgcgctgacggcgctgggcgcgctcggtccggcagcggccggcgcactcccggcgatcagggcggcggtcggcgccgacgacccgtggacccgggtcgcggccatcaccaccctccaggcggtcagcggtgaccacgacgagatcctgtcgccggctctcgcactgctcgacacccacgccgccgccggagcggccgacgtgctcggccggatcggtccaccggcctcggcggcgctaccccgcctgcgggccctgtccaccgccgaccacgacgggatccgcgtccacgccgccgcagccctctgggacatcggcggcgagcccgaggccaccaccgtgctggacacgcttcggcaagcctggcaccacgatccccggaccgtcgaccacgtcgcggcatgcctgcgccggatgggccggcacgccgccccggccgcgccgcagatccgggcggaactcgcccgccccgagcgccgcgggcagttcggggggatcggcaccgacgaggacctgcgacgcacgctcaccgaggtcctgatctcgatcgactccgcggccgggtga

SEQ ID NO: 4503 - DNA, 963 bp, Actinoplanes utahensis
atgaccatgggtcgccacgcccgtaaacctgcgacacgcacagtgcgctcacagcgaaacactggtgaccgcacagcagatctgggcactgttgccggcgtgccccgtcatgtcgcccgctcaggccgagccgccggttacctggcggccaccgcgctggccgtcgccgtgctcgtgctcgtcgcgggaccccgggcgatcgtctcgtccgcggcctcgctcgtcgcctcctggcagtcccccgggccggccgccgagcccccggcgacgacgccgtccgggccgtaccgggtggtcgggctgggcgactcaattccggccggcagcgtctgcggctgcacgtcgtacgtgtcgctggtggcccaggacgaggccgcccggcggagcaggacagccgacgtggcgaacctggcccagggcggcctgaccaccaccggcctgctcacccagctcggcgacgccacggtgcgccgtcagatcgccgccgccgacctggtcctgatcaccatcggagccaacgacttcgacaccggctcggtcgacgacgactcctgcgccgcacccgagctcagctgcttccagcccgccctcaaggcacagcagtcccagctcgccgacgtgttgaaacaggtcaggacggcactcgccacccgctcggcgacggtgctgatcaccggatactggaacgtcttcctcgacggcgccgtgggcgccacccacggcgccgactacgtccgcaacagcatctccctcacccggacggagaacacgcagatcgccgcggccgcgcgggcccagaacggcacgtacgtcgacctgttcaccccgttcaagggcaactcgggcgccgaggacgacacgtccctgctggccgccgacggcgaccaccccaacgccgccggccaccgccggatcgccgacgcggtggagtcggcggtcgcctcgacccgaccggccggctga

SEQ ID NO: 4504 - DNA, 1320 bp, Actinoplanes utahensis
atgagaagacactggcgccacctgctgaccgcggtggccgcggtcctcgccgccctggtggccaccaccacgctcgtccccgcatcgccggcggctgcggcggcattgaccgaggtcaccggattcggcacgaaccccaccggcatccggatgtacctgtacgtgcccgatcatccggccgccaagccggccgtcctggtcgccgtgcactactgcaccggctccggcccggcgttctattccggcaccgagttcaagtcgctggccgatcagtacggattcatcgtcatctacccctccacggtccgcaccggcaactgctgggacgtctcctcggcgggcgcgctgacccacaacggcaccagtgacccggtcggcatcagctcgatggtcaaatacgtccagcagcggtacgccacggatccggcccggaccttcgtcaccggcgcctcgtccggcggcatgatgaccaacgtgctgctcgccgactacccggacatgttcgccgccggcgcggccttcatgggcgtaccggacacctgtttccaggcgaccgcgggcaacccggccgacccgtcgcagcaggccggctggaacagcgcctgcgcgaacggccaggtcgccaggacaccggcccagtggggcgacgcggtccgcaactcgtaccccggctacaccggaacgcgcccgcgcatgcagttgtggcacggcaccgccgacaccacgctgaactacaacaacttcggcgaggagatcaagcagtggaccaacgtgctgggtgtcagccagaccccggtccgcactgacactccgcagtccggctggacgcgcacctactacggcaactcctcggcccagccgccggtccaggcgatcagcatcgccggggtcggccactccctgccgatgtccggtcaggccaggatggcgatcaccttcttcggcctggacaacaacccggtcccgccgtcctcgccgccggtgtcgccaccgccgtcctccccgcccccgtcgtcgcagccgccgctgccgtccggctgcaccgcctcgatcgcgctgaactcgtggaccggcggctacgtcgccaccgtcacggtcaccgcgggctcgtcggcgatcaacggctggaccgtcgccaccaccctcccggccggctccgccgtcaccaactcgtggagcaccaccggcagcggcaccaccggcgccgtgagcttcaccaatgtcggctacaacggctcggtcgccgccggccagaagacccagttcggcttccagggcaccggcagcggcccgacctcggccacctgctcggcccgctga

SEQ ID NO: 4505 - DNA, 849 bp, Actinoplanes utahensis
atggtcggcagcggtaggcgggcacggtgcgtcgtggccacgctgctcgggatgctcgtcctgccggccgcaccggcccgggccgtgaccaccccggcgaccgctaccgatcgggacttcgtccggcgggtgcacctgaccgccaccgcggtgggcgcggccagcgcgctggcccgggggatgagcgggaacacctcggtcaagaggttgacggcgcaggtcaccccgcagtgcgagcagctcgacgggttgagccgcagcgtggccgggacgctgcgggtggcactcaccgatccgctggccgccgagcagcagagtgcactcgcgacgctgcagcagagcggcggggaggctttcgacgccggatacgtcgactatctgtggcgggccgacagcgcgctgctgccgatcgccacgacggtgaagggcactacccgcaacgcggtcgtgcgacggctcgccgaacgggccgaggcggtcaccgcggaacagttgccgatgctgcaggacagcggcctgctgagaatgacggtgctgccgacgcccgcgacgcccgcgacgcccgcgacggccgcgtcggccagcgcggtcggccggctacccggcggggtgccgatggaccggcggctgatggcggaaacgcgctcgggcaccgggtatctcgcaccgccgatatggctccggctcgcggtgctgatcatcgcgaccgcggtggcgggggtgctgtcccggcgtctgctcacccggcgtcgaaccggccggccccgccgccgctgggcggcccggcggagtcgcggcaccgggcgcggcagtcccgggcggcattcccgggtgcggaggcctagctag

SEQ ID NO: 4506 - DNA, 1110 bp, Actinoplanes utahensis
atgcccagcgcgacgccgatcaggccggcgttgcggctcgggctgccggagccgtgccggcgggcggtgatcgcgccgagggcgatggcggtcgggccgaagacgatgttgaagaagaacaggccggcgacgcccaggaccagcgagccgacggcgcggtcgtcgaggctcgcgacgcgtttgacgaagttcatgtcgatcccttcgggaggtggtgggtcagcggcgggtcagggcggtggcgcgacggacgccgaacaggacggcggcggccaggaccacgccgaccgcgatcagcaccggctggccggtgagcagggtcgggccgacgagcagggcgatgagtgcgaggacggtcatcagcgcggccatcgtcgccccctttcagttgacagttgtgtactgaaacaccatagctcggggaacaggtgtttactgagtgacatgagccaccaccatccgccgcccgccgaccggctcagccggccggagcagaaggcgcgcacccggcaggcgcttctcgacgcggcgctcgccctgatggagcaccgcgggctgggcagcatcggcctgcgcgaggtgacccgcgcggcgggcgtcaccccgaccgcgttctaccggcatttcccggacgtggacaacctcggcgtggccctcgtcgacgagtgcctgggcagcctgcgcggcactatccgggcggtccgggacggggtcagccccagcgacgaggtgatcaaccggtcgatcggggtcctcgcccggcgggtgcgggagaatcgggagcacttccggttcgtggcccgggaacgccacggcggggtgccggcggtccgggccgcgatcgccgagcagctcgacctgttcgccgccgagctcgccaccgacctggccggcgacaagctggtgggcggcccgcgcttcgaccggtggatcgccaccgacctgcgcatgatcagcagcctgatggtgaaccacatggtgtggaccgcggcggccctgctggacgccccgcccgatgcccccggcgcccaggcccgggtgatcgacacggccggccgccagctgcggctgatcctgttgggggcccgctgctggaccgacggggactga

SEQ ID NO: 4507 - DNA, 1149 bp, Actinoplanes utahensis
atgctggcacggctggtggaccgctcggtggagcggatcggggagatgtctgccggcggccggtggttcgaccggcacgaggccgggatgatcgccgaggcctgggccgaccgggcccgggacgtgttcggcatgctcggggtgtggccccgggtgatgcgggaccgcaaggccaggacgatcctgcggcggatggccgacagccgcgccggcctgcgggactggatggtcgcggccggtggccccgggatggaccggctgctcgggccggctgccgcggagccgccgttctaccgcgacttccggggcagggtgcagccgggcacggtgtcgtccgacccggcggggatcgccgaggactacgacctggcccgggcgcgggtggcgtcggtgtgggccgagcgggccggggacggcctgcgggggagtgtccgggtgctggtgccgcgacggtatgccgacggcgaggccctgctgacgttcggcgccgaccgggtgcgggacctgtggttcgacagcgcggacggggccgggctggtggtgcgccggcacggcgacgggttcgaggtccggctcggcgcggagggggtcatgcgtaccgccgcattgtcgtgtttcccggtggatcagcagtggcatctgtcggcggccggccggaccgccgaccgggtgacctcgcggcgcaggccgccgacggccgcggacctgttcgaggactgggcggacggcgcccggggcgacgcgggggcggcattccaagcggcggtgcgccggctcgggagactgcgcgttccggaggagatggcccgcattccggtgggcgagctgtgcgaggcgctggtcggcgccggaacccgggcgctggccgccgccgacctgccgtccgagcagcggttcgccgcctggcgggacctcctggcccggtggagccgggtcggcccggacggccccgaggccgagggcgaactgccggcgggcgtccggctggccctcgtgacgtacgaggcggaacccgccgtgctgaccgcgatcttcaccggcgcggacgacgagcggctggccgccgcgaaactcccgtggccccaccgtctgctgctcagcggccaggccggcgagctgaccctgcccgacaccgcccacggcgcctag

SEQ ID NO: 4508 - DNA, 609 bp, Actinoplanes utahensis
gtggcgccgccggatcgactatcttccggaggtgtccgagaccccgatcgcgtcgctggcgctcgcgttcaccgcgcagccgggctggggcatgcagctgcgtcgcggcctggtgcaactgtccgaggcggacttcgggcggatccgtgccgccatgctggcggtgggatgagcctgaacacccggcacgacagcgccgacgacagccccggcctgctgctgtggcaggtgaccaaccggtggcaggccgcgcagcgggcggcgctgaaaccgttcgatctcacgcacgtgcagttcgtgctgctggcgacgctcacctacctgcaggcggaggggccggtgacgcagaaggcgctggccggccaggcggccaccgacccgatgatgacctcccaggtgctgcgggcgctggaggcccgtgccctggtgcatcggccgccgcatccggatgaccggcgggcgcgggcggtggcggtcaccgatgccggacgtgagctggtcaaccgggcggtggtcgcggtggaggagtgcgatgccgcgttcttcggcggcctgggtgaccggctgcccgccttcactcgcggcctgctggcgctacgcgcgaactga

SEQ ID NO: 4509 - DNA, 468 bp, Actinoplanes utahensis
atgcgaccctccgttctgatcccgatcgccgccgccctggcgctggccggctgctcctcctcgaacgagccggatccggccaccgccccggtgtcgagcgccccggtgtcgagcgccccggtgtcgagcgccccggtcaagagcgctccggtccggagtgccccgaccaagacggcggccgcggcgcgggggaacgggtgtccggtcaccgccgccacgctgaacgccgtccacgtcccggacgccggcgacgtcaaggtcaaggtggtgtcgaagagcatcaagtgtgccgacggttacgcgcaggccgatccgggcgtcgagggcagtgacggcgttttcgtctaccgctatgacgccaaggcgaaggcctggcggttcctgaccgccggcagctcgatcgactgcggtgcgatcgccattccgcgcccggccggcgacaagctctccgtctgctactaccagtga

SEQ ID NO: 4510 - DNA, 2835 bp, Actinoplanes utahensis
ttgagcccagatcgggtacgtggactacgacgctggatgaccgtgggcgcggtcgcggccgtggtggtggggatcgcggcgcccggggcgaacgcccagggcccggatgacgtgaccagccgggcgttcgctcagatatcggcgttgcagcagctcaagaagtcgatgacggcggccgagcggaagctcgacagccggctcgccgtggaactgcgccagcggtccgggcgggtcgcgacgagcgagctgcccagagtggacacccggatcgccgtcaccaagggcggcaccaccgaggtcgaggtgcacgccgaccgggtggacgccgcactgctcggccggctccgcgcggccggggccgggatccggtatcccagcgccaaggatcggtcggtgctggtcgaggcgccgctcggggtggtgacgacgatcgccgggtggtccgacgtgaccgcggtgaccgccgcgcgcggactgaccaccgggcacgagaccgacccgcgccgaaccgcgccggaaccctccaaagaggctcgtgcagccggcgtggaggcggctgtcaaggctgcggaaagcgtacgcccgctggccgtcgatcctcgtggttcggtggtgtccgaaggggatcgcacgcatgccgcggacactgcgcggacccgcttcaagatcagtggggtcggggtgaaggtgtgcgcgctctccgacggcgtggactcgctcgcggcctcccaggcgaccggcgacctgcccgccgacgtggacgtgctgaccggccaggacggttcgggcgatgagggcaccgcgatgctggagatcatccacgatctggtgccgaacgcgcggctcggcttcgcgaccgcgttcaccagcgaggtcagcttcgccgacaacatccgggcgctgcggttcaccgccggctgcgacatcatcgtggacgacgtcgtctactaccacgagagcccgttccaggacggcgcgccggcccgggcggtcaacgacgtgatcgctgacggggcgttctacttcagctcggccggcaacgagggcaacaagctcgacggcaccgccggaaactgggagggcgacttcgccgactccgggcgcgggatcgggaaattcgccggccgggcccacgacttcgacccgggtccgggcgtgcaggtgttcaacccgctctcgccgaacagcacccgatgcgtgacgacgctgtggtgggcggacccgctcggcggctcggccaacgactacgacctgtacctgctcgacgcggccggcaacgtcaccgacttctcccaggacgtccaggacggcaacgacgacccgttcgaggcgctggccaccggcaccgggaccaaccagcggctcgccgtcgtcaaattctccggcgccgaccggtatctgcagctcagcgtgttccgcggccggttcgccgacacgccgtacggcaccctcaagggcttctcgacgccgggcgcgctgcgcggacacgccgcctccgccggcgccttcgcggtggcggccgcgccggcccacgacgcgctgccgttcgacctggaggacggcgacccgccgaacccggccggaccgtacccgaacgtgttcaccaggcagaccgaaccggagcggttcacctccgacgggccgcggcggatcttctacaacccggacggcacggcgatcaccccgggcgacttcagctccaccggcgggctggtccggaccaagccggagatcaccgcggcggacggggtgctgacctcgatgtccggcttcgcgccgttctacggcacctcggcggcggcaccgcacgcggcggcgatcgcggccctggcgctgtctggcaacccggggctgagcaacgcggagatccgggcggcgctcaccgggaccgccctcgacctggcgccggccggggtggacaaccgcaccggcttcggggtgctgcgggccgacctgctgctgcgcgacaccggagcgacaccgcaaccgctggtcaagaccgggacgccgacggtcacgccgatcaccggggacggcgacgcctacctggaacccggggaacaggcgaccgtcgcggtgccggcggtgaacgtgggcgacgggacggcgaccggggtcagcgtggtcgtcggcgccgacgacccgcgggcgacggtgaccccgcacgccgcgtcctacggaacgatcgcggcgggcgcgacgaaggcgaagaactacaaactgacgctcgcggcggactatccgctggggcggccggtgaccctgaccacgaaggtcaccttcgccggaacgctgtcgccgaccaccgggagactcgtcgtgccgaccgggcagccggggacgagcgtgcgggacttcgcctacaccggcgcgccggtgccgatcccggacaacgatccgaccggggtcacggccaccgtcgacgtcagcggcgtcggctacgcctccgcgctgaccttctcgatcgacggtacggcgtgcagcaccgacgccggatcgcccaccgtcggcctcgaccacaccttcgtgggtgacctgatcgggacgctgaccgcaccggacgggcgggccgcgaccctgttctcccgcagcggcgcgggcggcaacaacctgtgccaggtcgtcttcgacgacagcgcgacggtggcgttcaccgacgccgagtcggcgaacgccccgttcaccgggacgtggcggccggacgggtcgctgtcgtccctgcggttgtcgccggtcgacggcacctggagcttccacgtggccgaccgggccggctcggacaccgggtcggtgcgggccttctcgctgcacctgaccggtttcgcaccggcctga

SEQ ID NO: 4511 - DNA, 354 bp, Actinoplanes utahensis
gtgatcttccaatccgagcgcaccttccaggtctggcgatactcggtgagccacgcgaccctgctgctgcgcagcaccaggaccgccgcccagccgacccggatcgacctgatcttcagcggggtgcgccggatgctcctgcagccgactttcgacgggatcaccgtcgcgctggcctccgccgaggaacgcgacgccgccgtgcgccgggtcggcggcgactggggcgaccgcgagctctatctcctggatccggcggcggccaacttcgtcgcctccgcaccgccggcatggcacgaggacgaggggtcgtacagcgacccctcgtacttccagtcgatgcttttcctgtag

SEQ ID NO: 4512 - DNA, 1758 bp, Actinoplanes utahensis
gtggcccggcaggcgcgcaacggcgcccgcggcttcgccgacaaggcgaagctggcctcggacaacgccgacctgctggccggtgacaccgagaagatgagcggcacgatcaccagcatctccaacagcgtgtgggacatggcccgcgggatgagcgggctggccaagacgctgatggacaccgcctggaaggcgtacgacgtcgagcaggcggcggccgagaccgcgtggatgcggtggttgcaggagaagagcgaccaggcgatcgaccactggatgccgtggggcgcggacatcgtcaagggtgccaaggacgacctgctggggatggtcgagggcctctggtacatcagcgactgcacggtcggcaccttcatcggcctggacccggcgaccgacgagtacacggttccggacgtcaccttctggcccaagccggacaaggcctgcaagacgctgcaggacggcttcggcaagctgctcagcgatcccaagcagctgctgcactgggacgagtggggcaagaactggcagcgcgcgctcggcatgacgatcgtcgacgtggtcaccctggtcggcaccgacggcatcggctcgatcttcaaggcgatcgagaagggcatctccaaggacatcgccaaagcgggtctcaaggatctgatctccggggccgccaaatacggcggtgagctgctgtcgaacgcggtcaccaagctcggtgcgctcaacgcggcccggatcctcgacctcgccgagtccctcgcgatcaagctgacgctgagcccggaggagatcgccgcgatggcccggtccatcgtggtcaaggggatcgacgccgtcgagcaggccttccggaacctgcgcgacatcccggtcgtcaagggtctcgaggatctgatcaagtcctgcctgtcccgcaacagcttcaccgccgacacccgcgtgctgctggccggtggcggcaccaagccgatcgccgagatcaccatcggcgaccgggtgctggccaccgacccggcgcagggggtgacgaagggcgagccggtcacccggttgttccgcaaccgggacaccgcgctggctgacgtcacgatcggctccggtgcggtgctgcggaccactcaggaacacccgttctgggacgcgaccacgcggtcctggaccgccgcggcggacctgcggcccggtgaccggctgcgcagcacggtgacggcgccgcgggtcgcggcggttcgcgcctactccggcgaccgggtgatgttcaacctgaccgtcgacgagctgcacacctactacgtgctggccggcaggacgccggtcctggtgcacaactgcgacaaaaacgtcgtgctgggcatcaaccggcactccgagggcctggcggcggagctccgcaagctcgaagagaccgcggatgccgtcacctacaacggcgacaacctgaaggggatcaacccggagagcggtctggcgggctggcaggagaaggtcaacgacgcgctgaagaacccgggctccgtgatccacgtcgcgctcgacgacatggagggtgcgacgccgctggaggcgttcatcaacgcctacaagaaggcgaagagcggcgactacggcgcgacggactgggagatggggcagatcggcttctacattcgcatggggtatcgggaatggggcagcatcaagtggtacctcaacggccgggccctgacccccgccgagatgccggagccgaactggctggagctgatgaagtcgtga

SEQ ID NO: 4513 - DNA, 1848 bp, Actinoplanes utahensis
atggcttcgagacttgctgcactgccgatgatcgccggagcgctggcggtggcgatcgccgtcccgcaggccgcgttcgcggcgccgccgaagagcgtcccgccggccgccgcggctccgttgaccctgacgcagatgctggagcggctggccgggccggccaccgcggtgccaccgctggccgacgggccggtcgacgacgccgacctggaccggatgctgtgccaggacctggccgactacgacgcggacccggcggtccgggcggccgcgcaggcggcgctggacacgaacgatccggtgcggatccgggacttcctggacaagggtctgccggtctaccgcaaggccgcggtcgagatccagaagatcaaggccaccgaggaccgcgccctggtgcagcactgggcggacaccgggacgccgatcctgcggcagaaggccgcggccgcgctggccaccggtgacgccgcgaagatcgccgatttcatcgcgatcggcaaggccgccgcggacgccgccgacgcgcagggcgtgctcagcgcccagcagcaggcgcagctgatccagtcccgggtcgagcagatggtcgcgcacggcggctacgaggtgcagtcgcaggggcagctggcgctggacagtgaggacccggaggtgatcgccgagttctacaaccacggctacgcgatcgccgctcagcaggacaccgacgcccagcacgagatcgaggacgccctggccgcccgctccgcggcggtcggcaacctcagcacgctggccgggaaggcggcccgggcggccaccgcgcagcagcagatcgtggcggcgagcatcagcgcgacgcaatcgctgaccgtggcggcgaactcgatgggactggtgaaccggtacgccaagcaggccgacgcgacctacgcgagcgacctgccggtccgggccgccgggggtgcgacgcacaccgccgacctgaccaggctgcgatccgacgcatgcgccgaatccgccaccaccgcacgcaacgccgaccaggtcaccgcgcaggccggggtggcggccaccgcggcgcagacgctgatcgacaccgggctgacgcacggcgtcgactggaacgaggtgctgcaggcgcagggtgacgcggccaccgcggcgaagcaggcggccgagaccgcgtgtcacgcggccgaggccaccgaggcggcggccaaggccctcgacgccgaccaccacgcgacggccgacgcggcgaacgcggtgaagtaccgccaggcggccgagcgggagcaggcggcggcggagaagctggccgtgcatgccgagaagctggccgcggccgcgaaggccgccgcggcggacgcgcacgcccaacggcttcgggccgaggcggcggcggcggacgcccggctccgggtgagtaaggcgcaggcctactacgagacggcggtgcgtcagcgccagatcgcccagcaggcggccgcggacgcgatcaaccacgagaagcaggcgtacgacgcggcggcgcgggcgatcgaccagcagaacatcgcggtgagcaagcacgacgaggcgaagcaggcgtacgaccggtcggtggccgccggtaagcacttccagcaggtcggcaagcagaccaaggacctgatcgaccgggcgaagaagtcggccgacggcgcgcactccaaggagctggaggcggaggcggccgaggcccgcaagatggccgccgacatggcctgcaaatacccgaacaacccgagcggcaccgggtgcccgggcacggccgagatgcagcaactcgcggccgatgccacccgggcgcgggcggacgccaccgcggcacgctctagctag

SEQ ID NO: 4514 - DNA, 1203 bp, Actinoplanes utahensis
atgcggcaggcccagcggttggcgagtgtccggtacgacatccggggcccggtgctgcgccgggcacaggagctggaggcggccgggcaccggatcctcaagctgaacctgggcaacccggcgccgtggggcctggccaccccggagccgatcgtcgccgacgtggtgcagaacctggccgccgcccagggttacagcgacgcccggggcgtctactcggcccgggtcgcggtcgcccagcactaccagaccctgggcgtgcccagcgtccagccggacgacgtgctgctcggcaacggcgtctcggaactgatcgtgatggtgctgcaggcgctgctggactcgggtgacgaggtgctggtccccagccccgactatccgctctggaccggcgcggtgaacctgtgcggcggccgggccgtgcactaccgctgcgacgagtccgcgggctgggagcccgacctggagcatctggccgcccggatcaccgaccgcacccgggccctggtcgtgatcaacccgaacaaccccacgggtgcggtctactccccggagaccctgctcgccatgatcgagctggcccgccgccacggcctgatgatcttcgcggacgagatctacgacaagatcgtctacgacggcgccgtgcaccacaccctcgccgcgctcgcgccggacgtcccggtggtcagcatgggcggcctgtccaaggtctaccgcgccgccggtttccgctccggctggctggccaccagcggcttcggccccgacgccgactatctggacggcctgcagctgctcgccaacatgcgggtctgccccaacgtcccggcccagcacgccatccagaccgcgctgggtggctaccagagcatcaacgagctcatccagcccggtggccgcctgatcgagcaacgcaaccacgcctgggaggcgttgaccgccatccccggcgtcgactgcgtcaagccggccggcgccctctacctgttcgcccgcctggaccccgccgtccacaagatccatgacgacgagcgcctggtcatcgatctcctggagcagcagcacctgctcatctcgcagggcaccggcttcaacctggacactccggatcacctgcgcctggtgttcctggcccccaccgaggtgctggacgacgccgtcgcccggatcgccaccttcctcgccgcctaccgccagtag

SEQ ID NO: 4515 - DNA, 996 bp, Actinoplanes utahensis
gtgtgcctctttcgtcagggtgtgttcgcggtatataccggtgaggtgccgcagactcatcgctccaccgacgcatttcagcaagtcgctctcggctaccggggcgagctgctggcgcactgctaccagatgctcggctcgctgcacgacgccgaggatcaggtgcaggagacgtatctgcgggcctggcgcgcctacgaccggttcgacgagtcccgtgcgtcgatgcgcacctggctgtaccggatcgccaccaacacctgcctgaccgcgctggagagccgggggcggcgcgcgctccccgccgggctcggggcgcccagcgacgacccgcagcagccactcacccaccgcgaggtgccctggctggagccgttcccggacgcgttgctggccggcgatccggccgccgtactgctcgggcgcgggcggttgcggatcgcgttcctggccgcgctgcagcacctggcgccccgccagcgggcggtgctgatcctgcgtgaggtcttcgacttcagcgccgccgaaacggcggagatcctggacatgacggtcgccgctgtcaactccggactgcagcgggcccgggcccggatggcgacggtacgcgtgaccgaggagccgtcggccggcgaccgcgccgtcctcgaccggtacgtcgcggcgttcgagtcggcggacatcccggctctggtccggctgctcggcgagaccccgatcctggagatgccgccctacgagaactggtatcgaggggtggccgactatgccgcgttctgcgcgcgggtgttcgcgatgcgcggcaccgactggcgggcgctgaccacctcgctgaacgggcagccgaccctcgcggcgtacgtccgccggggcgaccgctacgtggcgcacaccctgcaggtgctcaccatccgggacggaaaggtgctccggaacacggtgttctccgaggtcacgctcttctctcagagtggtttggtggaggaactggcgtag

SEQ ID NO: 4516 - DNA, 375 bp, Actinoplanes utahensis
atgtcacaaaccgtgcaggaattcttcgacctgtcggaagccgcctggatcgccggcgacgccgacgccgtggccgagctctataccgcggacgccaccgtggtgacctccggcgcggcgctgcgcagccgggcggagatccggcagttcttcaagaccggcttcgccggaccgctgaagggctcggcgccgctggaccgccaggaatcgatccggtacgccggcgccgacgtcgcgatcgtgagcagcaccagcgggatccggatggcgggcgagccggaggtgccggccgaccggatccgccgggccacctgggtgctgacccgcgaaggcgaccactggctggccgccgcgtaccacaacagcccggcgtag

SEQ ID NO: 4517 - DNA, 714 bp, Actinoplanes utahensis
atgtacatgtacctcgtacatgagacctgtacgttgtatggttgtcaagtgaccccagcagaacgactcagtcgggcggccgtcgccgagcgcgccctgcgcctcgccgacgaggaaggcctcgacgccgtcaccatccggcgcctggccaaggagctgggcgtcaccccgatggcgctgtactggcatttcaagaacaaggacgagctgctgctcggcgtcgtcgaccacgtgctcagcggcgtgcgggccgaccgcagcgccggcgacccgtggcagagacagctccgcgcgatcgtcgagactgtggtgggcgtcatgcgggaccacccgtgcctgcccgacctgctgcacgcggcggacaagacgcaggcggcgagcttcacccgggcgaccaacgacaccctggccctgctggccgacgccggattcgacgtcgaggaggggtactggatcgcgatgtacctgctcaacggcgctatcggactggtcggggcgcagccggaccgcccggccgacgtgccggccgggcgggcggaggagtggcggcggcagaaacgggtgcagatggagtgcctgccggccgacgagtacccgatgatgatcgagttcgcccggacgtaccggcgggcgcccgacgtcgaacgctattacgcgttcggcctcgacctgctgatggcggcggtcgagacgatggccgccgggcgccgctga

SEQ ID NO: 4518 - DNA, 1419 bp, Actinoplanes utahensis
gtggaacagaaccgtcggtggtgggcgctggtcgcggtggcgctcggcaccttcatgacgtacctcgacaacaacgtggtcaacgtcgcgctgccgtccatccagcgggagctcggcctgagcatctccggcctggagtggatcaccagcgcgtacatcctggtcttcgccggcctgctgctcgccggtggccgcctcggcgatgtcctcgggcaccgggtggtgttcctgtccggcctcggcgtcttcaccgtcgcctcggtcgcggccggcctctccggcagccaggagctgctcatcggggcccgggcggtgcagggcatcggcgcggcgctgctctccccggccgccctcgcgctgatcggcgagttcttcccggacccgaaggagcgcggcaccgcgatcggcatctggggcgcggtcggcgcgctcgccctggccgtcggcccgctcaccggcggcgtgctcagccagcacgtctcctggggctggatcttcctgatcaacctgccgatcggcgtcgcgaccctcgtgctgtccctggtcgccatgccgcgcgacggcgcccggacccgctccggcggcctcgatccgatcgctctgggcacctcgtccgtcgcgctcttcgccctgacctacgcgctgatcgagggcgacgccaagggctggacctcggccgtgatcctcggatcgttcgcggtcgccgcgctcaccggcatcggcttcgtggtgcagcaggcccgggccgccgacccgatggtgaacctggccttcttccgccagcggatgttcaccggtggtctgctcgcgatggggctgtgggctttcggggtcttcggcatctacttctacatggccatctacctgcagaacgtgctgggcttctcgccgaccgaggcgggcgccggcttcgtgccgctggccctgatcaccgcggtcggcgcggtgctggcaccccgcctcgaggcccggttcggcgtcgcccgggtgaccgcgttcggcctcgcggtgatgggtgcgtcgatcgccgggatcgcccggtacggcgagggcacccactacctcgacctgctgccctggttcgccctgtacggcgtcggcggcggcctgctcatcccgctgagcaacgtggtgatcggcgcgctgccgtccgggcgggccggcatcgcctccggcatgctgaacgtctcgcgtgaggtgttcggcctgctcggagtcaccgtgctgggcgcgatcctgagcaaccgggccggcgccgcgaccggcaccgagctgcaccgctatctggtcggctaccagttcgccctggtggtggccgcggccctgatcgtggccggggtgccgctgagcctgtggatgctgcgcacggcgcggccggcgccgcagatcacgccggtccctgtcctcgagacggtctga

SEQ ID NO: 4519 - DNA, 1221 bp, Actinoplanes utahensis
atgagagtcagcgccgtggtggccggtcttgtcgccgtcctggtctccttctccggcccgttcgtggtggtgctcaccgccgcctcggccgcccacctgacggccgcccagaccacctcgtgggtctgggcgatcgccatcggcagcggcctgtccggcctggtgctcagcctgctcagccggatgccggtgatcaccgcctggtcgacgccgggcgcggcgctgctggtcggctcgctcagcgcgtaccggtacaccgacgcgatcggcgccttcctgttcgccgccgtgggcatgacgatcctcggcttctccgggctgttcggccggatcctgacccgggtgccgcgggggatcatctcggcgatgctggccggcatcctgctgccgttcgccctggaggcgttccgccagctccccggcgcgcccgcagtcgtgctcgcggtgctactggcctacttcctgggccggcgcttcctgccgaactacgccgtgctgctggccctgggcgccggcaccgcggtcgccgcgctccgccacgacctgcacctgggcggcgtccacctggacatcgccaagccgctgttgaccctcccgacggtcaacccctcggcactggtcagcatcggcctgccgctgctcatcgtgaccatggcctcgcagaacgcgcccggcctggcggtgctcaagaccagcggctacgacccggacgaccggctgctgctgaccggcaccggcgtggtctcggtgctgctcgcgccgttcggcagccacgggatcaacctggccgcgatcaccgcggcgatctgcaccggcgagcaggctcaccccaacccgcggcagcggtacctcgccggggtggcctgcggcgccttctacctgatctgcggcttcctcgggaccggactggtcggcttcttcaccgcgctgcccaagccgctggtcgccgcggtcagcggggtggccctgctcggcgcgctgttgggcagtctggccggggccctggacgacaagtcggcccgggaggggtcgctggtcacgctgaccgcgaccgcgtccgggatgaccgtggcccatgtcggctcggctttctgggggctagtcgccggcgttggcgtacacctgctgctgaatcatcggccgcgacgtgcgggagatccgcaaccagacgacgaatccccagatcacgaagcccgcgtagaccgcgtacagcaccgctga

SEQ ID NO: 4520 - DNA, 717 bp, Actinoplanes utahensis
gtgacttggctcgatgacctgctgaccgcgttctacaccgccaaatggcaggtgaccgcggatcaggcgatctattggcgggagatcgtcggcaacgccttcgggctcggctcggcgctgttcgggttacgccgcagcgcgtgggcctggccggtcgggatcgtcggcaacatcctgctgttcaccgtcttcctcggtcaggcggtgggcaacgatcagggcaccccgctctacggccaggccgcccgccaggtcttcttcctgatcaccagcctgtacgggtggtggcgctggcgccgcaaccgccgcagcggcctgggcagcgcggtcgtcccgcactgggccggccgccggcaacgcctgatcctgctcccggtggccctgctcagcgtggtggcctgcttcttcgtcttccgcgcggtcggcgccggcttcccggtcccgtggtggtactacctggccgactcgtggatcttcgtggggtcgatcctggccaccttcgcgatggcccgcggctgggtcgagttctggctctgctggatcgccgtcgacctggtcggcgtccccgagctgctgcacttcggctactacccctcagcggtgctgtacgcggtctacgcgggcttcgtgatctggggattcgtcgtctggttgcggatctcccgcacgtcgcggccgatgattcagcagcaggtgtacgccaacgccggcgactag

SEQ ID NO: 4521 - DNA, 999 bp, Actinoplanes utahensis
gtgaccgcagcgatctcctgtcccgtgcagacccgtctctatgccgacgggaaggtggccgcgaaggatttcgggtacgccgagctcaccgcccgactccgcgcccatccgggcgcggtggcctggctcgacctgctggaaccctcggcggaagacctcgccgcggtggccgacgagtacggtctgcacccgcttgccgtcgaggacgcgctcgccgagcacgagcggcccaagctcgaccgttatccggatcacctcttcctcaacgtctacgccgtcgcggtgccggacgccgagggccggcccagcaaggtggagatcagcgcgttcgtcaccgagcgggtgctgatcaccgtgcacaaggggaagggcgacgtcgaccggctgaccgagcgctgggacgaggacccgtccggtctcgccgccggcggcggcgtcaattatctgctgtacgggctgctcgacgtgatcgtcgacggtcagtacgcggccgcccggcaggtcgacgaggcgatggactccatcgaggaccagatgctcggcgagggcggtgcgccccgcccggtccggatgcggggtttcgcgctgcgccgctcgctggccctgctgcgtcgcgcggtggccccgatgtcggacgtggtcgccgagctcacccggaccgacaacggcgtggtcgacgaggatctgcgaccgtactaccgggacgtcgaggaccacgcgaagcgctccctggagtcgatcgagcactccctcatccggatcaacgagctgatcgaggccgacctcaacgagcagagcaacgtcctcaacgacatcacccgcaagctcgccgcgtgggccgcgatcatcgcggtgcccaccgcgctgaccggctatttcggacagaacctgccctaccccggctatcagaagccgtggggtttcgtggagagcatggtgctgatcgtggtctcggccggtgccctctactactacctcaagaaacgcggctggttgtag

SEQ ID NO: 4522 - DNA, 654 bp, Actinoplanes utahensis
atgaccacggtcgaccttgcatcggtggacctcggataccacggcggcgacccggtcctgcgcggcgtgaccgtgcacgcgcggcccggcgagatgctcgcgatcaccgggacttccggatccgggaagaccacgttgctcaccgcgatggccgggctgctggccccgacgtccggcgtggtcaccgtggacggcgcgccgctgggcgaccgggacgccgcggtcggccgcggcgtggtcctgatcccccaggagaacgggctcgccgcgatcctcaccgcggccgagaacgtctcggtcgcggtgatcgccaccggcggctcgccggccgacgcccgccgccggaccgccgacgcgctcaccgcggtcggcctggccgggcaggcgaatcagctgatcgaggagctctccggcggtcagcagcagcgcgccgcgatcgcccgcgggctggccctgcgcggcacggtgctgctcgccgacgaggtgaccagcgagctcgacgcggcgaaccggcagaaggtgctggagttgctgcgcgccgaggcgcaacggggcgccgcggtggtgctcgccacccacgacccggaggcggccgcggcctgcgaccgggagttgcacctggccgacggggcggccacctgggcgcgcgcctga

SEQ ID NO: 4523 - DNA, 807 bp, Actinoplanes utahensis
gtggtggccatcggacggagattgaccgggctcgctgtcgccgcggtggcggtggtgctgctgcaaccgatggcggcgcacgcgaccgagccgggtgtgcccgacccgccgaaccagttgatcaccgacaccggcgagggcgccgtcacggccgccgaccgggacttcgtggtccgggtgcggctcgccgggctgtgggagatcccggccgggcagatggcccagcagaagtcgaaggacccgcggatccagcagatcggcaaggcgatcgccgcgcagcacgtggtgctcgacaagatggaccgcgatgtcgccaagaagctgggcgtcacgttgcccaacgtgcccaactccgaccagcagggctggctcggcgagatgcggagcgccgccgaaggcaccgacttcgaccagatctacatcgaccggctgcgcgcggcacacggcaagatcttcccggcgatcgccacgatccgggccagtacccgtaacgacagcgtgcgcaagctggcgcagcgggcgaaccagttcgtgatgacccacatgacgctgctggagagcagtggcatcgtcgacttcgcggggctgccgaccgcgccgccgccggccgcggcgacgaccgccccggcggccggggccggggccgggacgggaacagcgacgaacctgaccgcggctgagcagaagggctcgccgctcagctcgccggtggtcgccggggtggtgatcgccagtctcgccgcggcgttcttcatcacccgccgcttctggccgagcaaccagcgtcgccgtcgccgctactactga

SEQ ID NO: 4524 - DNA, 843 bp, Actinoplanes utahensis
atgaacggactcgcggtcgcctgccggcgggtggtgcacatctaccgtgccgaggcgggggacgtggtggccctggccggggtcgatctctccatagcgccgggcgagaccctcgccctggtcggaccctccgggtccggcaaatcgacgctcatcgcactgctcgccggcctgatgcggccgtcggcgggacggatcaacatcgggacgtacgacatgggcaagctctccgactcggagatctcccgcctgcgcggcaccgagatcggcgtggtcctgcagggcgccgcccgcaacctgctgccgtacgcgacgctgcaccgcaacatctggctcgcccagcgccgcgccgcgcacacccgtggcatcacactcgacgacccggaccgcatcctcgacctggtcggcctgcccggccagggccgccgcaaactcgccgacctcacccccggcggccggcagcgggccgccctcgcggtcggcatcgccaccggccccgggctgctgctcgtcgatgagcccacctcccggctggacaccgccggccgggacgaggtgctcgctgcactcgaaacggtgaaccgggaacgcgagaccaccatcgtggtggtcacccacgacaacgaggtcggcgcccgcctcggccgcgccgtcaccatccgcgacggccgggtcggcgccgagggccgcgacggccaggacttcgccgtggtcgccggcgacggcacggtccagctgcccccggaggtgctgggctcctatccgcccggcaccctcttcaccgtccagcacgtcgacggcgaggtcaccctggtccccgggggcaccgagaccgccgcctga

SEQ ID NO: 4525 - DNA, 945 bp, Actinoplanes utahensis
gtggccgtgcgcgacatcgccgtcttcaccggatccgcccatcccgaactcgccgcggagatctgcgagcacctcgcggtgccgctgctgccgaccaagatctcccggttcgccaacgactgcatcgaggtgcagctgcagggtaactgccgggaacgggacgtgttcctgatccagccgctggttcccccgacccaggagcatctcgccgagttgctcttcatgctcgacgccgcccggggcgcgtcggccggccggatcaccgtggtcctgccgcattacgcctacgcccggtccgacaagaaggacgcccctcgcatctcgatcggcggccgcctggtcgccgacctgctgaccaccgccggcgccgaccgggtgctggcgatgaccctgcactcgccgcaggtgcacggcttcttcagcatcccggtcgaccacctgcacgcgctgcgcgagctggcccaccacttccggggctacgacctgagcaacaccgtggtcgtctccccggacctgggcaacgccaaggaggcggccgcgttcgcccggctgctcgggatcgaggtcgcggccggcgccaagcagcggttcgccgacgacaaggtggtgatcaactcgatcatcggtgaggtcggtgaccgggacgtgatcgtgctggacgacgagatcgccaagggcagcacggtgttcgagctgctcgcccggctgcgcgagcgcaacgtgcgcagtgtgcgggtggcctgcacgcacgggctgctcaccgacgacgcggtgcagcggctggccgcggagaaggagatcgaggagatcgtctgcaccaacacggtgccgatcccggcgagcaagcggcacgagaagctgaccgtgatctcggtggccgcgccgctggccgaggcgatgcggcgcatacacaacggcgagtcggtcagcgccctgttcgtctga

SEQ ID NO: 4526 - DNA, 2022 bp, Actinoplanes utahensis
atgggtgtcatggcttaccccctccggtacgcgctcgccgacctcgccctcgcgctcagccgcgccgccacggatccggccgaggtgcgatccacggccgcccgcgccgccgctgacatgatcggcgacggcgccggggtgcaactgctgcgcgacgacggggagtacgaggcgatcgcgtaccaccacgtggcggacgaccgttccacggcgctggccaaggcgctggaccgggccggccgggcgcccgacgacgagtactccaccacgctggccgccagccggcgtccgatcgtgctggccggcgactcggcggcggcgctggccgggccgggcgacgggatcacggcggcggtgctcagcccggtgatcgtcgacaacacgtacgccggctatctgatcctgacccggcacaccccggacgcgttctattcgacgcccgaggtggagctggcccgcgacatcgccggtgagctgtcgctggcggtggccggcgcccgcgcccaggagcggctgcgggccgccgaggagcgctaccgccgggtcctggagaccatcccggaaggggtgctgcagctcgacccggagggcgtcgccacctacgccaacgagccgatcggtgtggtcctcgggatgccccgcagcgagctgatcggggtgtcgctgcgcggcttcctggacaatcaggggcagaaggagctggaccgccggatcgccgagtgcaagcagggccggtcgacggtgggcgccacccgcctgatgcgcgccgacgggtcgcggcgcagcgtgcggatgagcatgatgccgatccgcgacgaccacggcgagttcgccggcgtgctctgcatgatcaccgacaccaccgaccacatcgacgcccgcggcctcaaacgccagctcgaccacctgcgccggctggacagtctgggccagctgatcggcggcctgtcgcacgacttcaacaacctgatgacggtggtggccggctcggccgacatgatcctgagccagtccgcggacggcacgccgcagcagcagctcgccaaggacatcctggacgcggtggcgaccgggcggaccctcacgcaccagctgctcgcgttcgggcgcagcgagggcaaccggccggaggtgattcccatcccggatctgctcaccgacgtacagtccctgttcagtcggaccctcggtgagcacatcggtctggacctggccttcggaccggatgtctggccggtgcgcgcggagcgcgggccgttggagcaggcgctggtcaacctggcggcgaacgcccgcgacgcgatgctgcacggcggcatgctgcgggtggcggccaccaacgaggtggtcgagccgggccagctggccgagggcgcgccgaccggcaagctggtgcacctggtggtcaccgacaccggcaccggcatggacgaggagatccgcaagcgggccctggagccgttcttcaccacccggccgaccgcggccgggctgggcctggccaccaccgcggggatcgtgcagaacctgggcgggcacatcgagctggagtcgaagccgcggatgggcaccacggtgcacatctatctgccggccgccgaggagcgggcgcagccggccggtgagcgccgggagaagtccgcggtgatcggccgggtgctgatcgtcgaggatcagccggacgtggcgcagctggtgcagcggctgatcgcgccggccggctacgagatcgcggtggccaccgacgcgctgaccgcggtcacccaggtggcctccggcgcccggccggacctgctgatcaccgatgtggtgatgccgacgatgaccgggccggagctggccggggcattgcgcacccaccaaccggatcttccggtgctctacatgtccgggtacaccgcggcgtcgctggggccgcagttgcacctggacgacaacagcatgttgctggagaagccgttcacccgttcgaccctgttgggggcgatccggtcgctgtgcggcccgcagccgacgccctga

SEQ ID NO: 4527 - DNA, 954 bp, Actinoplanes utahensis
atgcaggattcgaccgacagcgagccactggccggacggagtgtcggcaattcgtaccggctcgtcaagccgatcgggcagggcgccaccggaacggtgtgggagggcgaggacagcaccaccggggaaccggtcgccgtcaaactcctgcacgagagcctgctccggcagccccggctggtcacccgcttcgtccaggaacgcaccatcctgctcatgctccgacaccgcaacgtggtccgggtccgcgacctgttcagcgtcggcgagaccctcggcctggtgatggacctggtggccggcggcagcctgcgcgaccacctgcaccgcgaacgcaccctggcgccggccgaggcggtgcggctcgccgcgcaggtcgccgacgccctcgccgaggcgcacgacctcgggatcatccaccgcgacctcaaaccggacaacatcctggtgctcgaacgcaacggccggctggagacccggctgaccgacttcggcatcgcccggatcctcaacgtgccgagcatgaccaccccgaacgcggtcgtcgggaccccgcactacatggcgccggaggcgttccacggggtcacccccagcccggccaccgacgtctacgcgctcggcgtgctcctctacgagctggtctccgggcagccgccgtacctcagcgactccgtcccggaactgatgcgcatgcatgccgagggtcgtccgaaacgtcgccccggcatccccgacgacctgtggagactcatccgcggatgcctctcggcgaagccccggcagcgtccggcggccgccgctctcgtgcgtgagctgcgcgaactcaaccgcaaactggccggaatcgcgccgctgccgccgcccgcgccgcccagcctgccgcccgccgacccggacgaccgggcggtcgacccgccggaactgcgcgacggcatccggctgccgcgctag

SEQ ID NO: 4528 - DNA, 576 bp, Actinoplanes utahensis
gtgctgctcgccgccggcgtcgccggctcgatctggcggcacggcggcaccccggcctcgccgtcggcgctgcccagccaccccgcgccggccgcctcggtccaggtcgtcccgcgccgaaaggtcgtttcctccacgaaacctgcgaaaccttcccgcgtacgtacgaaacgggccgtccagccgcgcccaccccagccggaggacgaggtgcggggcccgtgggagtgcgcgcccggcctcatgatcgacctggccacccgcagtccgctcgccccgaagccgtgccagtcgatcggccggaccgtgcagttccaggcgtccctcaccgcgccggccggcggccgcgcgcacatcgaggtgacgttgcgcgacgcggacaccggtcgtaccgtggccggccccaccacctgtgacgggctcaccttcaccggcggtcagatgacccgggcctgcggaccggccggcgccacaccgcgccgcggccgcaactacaccgtggtgatggccttccggtacgagcgggacggccacaccgcgaccagcaccgcccggggccgggtcttcacctggtga

SEQ ID NO: 4529 - DNA, 645 bp, Actinoplanes utahensis
atgagcttcgatctgtacgtctggcacgagccggaaccgatcacgcccgcgatcgccgagagccggctgcggcagggcgccttccgcccgcatcccgcggtccgcgccatgcgcgccgccctgctcgaccgcttcccacccggctccggcacgtggagcatcgtcccgccggcctccgacgaactcctggccctgtcggtcgcctggccccgggccggcgaggtgggcgccgccgtcgtcgcactggcccgcgagcacggcctggtctgctacgagccgcagagcggcctgctcaaccccaacgccgccgggcacctcgccgccttcaccctcacctcggcggccgggccggagatccccgaccccagttccgaccggatcgacaccctggtcggcgagctcggtccggacaaccacttcgtcatcctggaacgctccgacgggtggttcgtgcaggtgggttacgggccggcggccgggaccgagccgggacggtatgcgctggaatatcgggagggcgggccggagcatcacttccggaccgagacgaccgatccgctggaggcgtcgcggttgctgaccggattcctgaccggcgacgattcgtggaagcgccggtatgtctggcggccgctcttctcctag

SEQ ID NO: 4530 - DNA, 306 bp, Actinoplanes utahensis
atggcccgagtgaacacgctgctcttcctgctcgccgtcgcgctcgtcgtggtggcgctgatcgactgcctgctcaccgcccccgcccggctccggcacttcccgcgcgccgcctggctcgtgctgatcctctgctgcccggtcgccggcgccatcgcctggttccgcgccggccgccgtcagaacgccggccagggcgaaggcctcgccggccacgaaagcgccggccgcggcgaaaagccgatcggcccggaggacgacccggaattcatccggctactggccgccgcaatccgggaaggctga

SEQ ID NO: 4531 - DNA, 783 bp, Actinoplanes utahensis
atgagtagggctaccgtcctcgcctgtctcgtctcctcgtccgtcctcgcgctcacgatcgccgccgcctcccccgcccaagcggccggcgtcgactacgtcgccctcggcgactcctactcgtccggggtcggcgcgcccggacaatccggcagctgcctgcgcagcaactacagctacgccgcacagtgggcggcgaagcacagcccggcctcgttccagttcctggcctgcagcggtgcggtcaccgacgacgtgctgaacacccaggtcccggccatgaccagcggcgccgacctggtcagcatcaccatcggcggcaacgacgccggcttcgcgccgaccgtgctgacctgcctgaccagcagcgacgccacctgcgccgcgaaggtcgcggccggcaagacgtacgtcgcgaacacgctgcccggcaagctcgacgcgacctatcaggcgatccgtgcgaaggccccgggcgcgaaggtggtcgtgctgtcctacccgaacatcttcgacacctcgtcggcgctctgcgagatggacgccaccaagcgcaaggcgctgaacagcggggcgcaggccctggacgacatgatcaaggcgcgggcgaccgccgcgggcttcaccttcgccgacgtccgcggcaacttcaccggccacggggtgtgcgcgtctaggccgtacctcaacggcctgaccatcatcccgccgcagaactcctaccaccccaacaccaacggctacacgtacggctatctcccggctctgacgaacgccgcctga

SEQ ID NO: 4532 - DNA, 375 bp, Actinoplanes utahensis
atggacgagaaccgggcccgccgagtggtcgctcggctgcgcgagcgcaatgtcttcgctcatctgaaacttccgcacgccggtctcacgcagtacggcatccggatcgtgctgccggacggccgcgaggcgatctgggacaacgacggcaccgcgggcctggaggcccaggtgatgcgcgacggcgtgctggtcggcttcgtcgcgtcgatcccgggctccgagcggttcaccgacgagcagatcatcgacgccgtcgcgaccgcggactacgaccgcccgatcggccggtccgcgccggtcgccggacgccggccgaccccggcgccggccccgccgtccctggcgcaacgcttccgctccacgttcgggtag

SEQ ID NO: 4533 - DNA, 771 bp, Actinoplanes utahensis
atgccggagagccgtttcgaccaggctcgaggcatgcggaacacacccgtcgtcgagctgatcgacgtcaccaggagctacctcggcgtgcgcgccctggccggcgtctcggccaccttcaccagcggcaccttcaccgcggtgatgggcccgtccggctccggcaagtcgaccctcctgcactgcgccgccgggctcgaccggcccggcaccgggcgggtgctgctcggtggacaggacatcggcgacctgcgcgagccgaaactcaccgaggcgcgccgccgggtcgccgggttcgtcttccagtcctacaacctgctcgactcgctgacggtctggcacaacgtgctgctgccgcagcgtctggccggcgtccgcgccgaccacggctgggcccgcgaggtgctgcgccgggtcgggctcggcggtcgcgagcaggctcggccggcccagctctccggggggcagcggcagcgggtggcgctggcccgggccctcgccgcccggccgcaggtgatcttcgccgacgagccgaccggcgcactcgacctggccgccgggcgcgacgtgctgggtctgctgcgcgaggcggtcgacgacctcggcacgacgatcgtgatggtcacccacgacccggccgcggccgcacacgccgaccgggtggtcttcctggccgacggcgtgatcgtgggcgcgatggacgcgccctccgcggaccgggtcgcggcccggatgaccgaggtcagcgccgccgagggggtggcccgatga

SEQ ID NO: 4534 - DNA, 318 bp, Actinoplanes utahensis
atgatccggctggtgctggggtcgctgcggcagcaccgcggggcctacgcgggcacgctcctcgccgcgctgctggccgtcgcgctgctcggcggcggcgggctgctgctcttctcggtgctgaccgcgaagccgccggccgaccggttcgccgcggtgccggtggtggtcgccggcgcccgggaggtgagcctggagacggtcaccaccaaggcgaagaaggagggcaagaccaaggtcaagcacaaggtcaagaccgagcggctgaccggcgccgcgccactgccggccgacctggccgggcgggtcgcggcctag

SEQ ID NO: 4535 - DNA, 2172 bp, Actinoplanes utahensis
gtgccggtcggcgccgagctgcggatcaccacccgcaccgggacccggacgctgctggtcagcggcatcgcggcgccgccggggcgggacgcgctgcccgcacagggcgcggtgttcgtggccgacagcgaggtcgcggcgatctccgggctgaccgggcccaccgcgatcggcgtccgcccggcggccggtctggacccgtcggtgctccgcgaccggatcaccgcggcggtcggtgttcccgcgacctccggcacctccccggcgcccgcctcctccaccgccgctgtcccggcgtgggccttgccggccgcggcttcctccaccgcggctgtcccggtcggggccttgccggccgcggcgtcctccaccgcggctgttccgtccggagtcctgccggcctcggctccggcctcgggggcgtccggtggggccggtgcgatcgtggtgttgaccggtgacgaccgggtccgggctgatctgcccggggcgttgcccgactacatcgcgccgatctcgatcttcgggttcgtcatcggcatcaccgctttcgccgcgatcttcgtgctcaccggcacggtcacgctgagcgtccggcagcggctgcgcgagctcgccctgctgcgcaccgccggcgccacgcccggtcagctccgccggatgctcggccgggaggcgatcgtgctcgccctgatcgccgggctgcccggcgcgccgctcggcgtggtcctcgcccacctggtggcggcccggttccgggctctcggcgcggtgcccgccccgttcgtcgtccgggtcagtgtcccggtcctgctgctcgcaatcctcgccgggacgctggtcacctacgtcgcggcccgcctcgccgggcgccgcgcggtgcggatcgcaccgacccaggcgctgaccgagaccgcgaccgcacccaccggcggccgggccgtgcgggtcctcgccgctgtcgtcaccacggccggcgccgtcgcggtgctgagcttcgtccccctcgacggcccgttcgggatgggcatgagcttcatctccagcgcgctgctgctctgcgccgtcgccgccctcggcccgatcctcgtccggccgctgaccgccctgctcggccgggtgtccgggttggccggccgggtgtccggcttggccggcctgatcagccgcgccgagtaccggcgcgtcgccgcggtcgccgtcccgctcgtgctgatgttcgcgctcaacgcgaccatgctgctcaacggcagactgcaggaccggctcgccggcgtgcagcaacgggaacgcctggccggcgcgaccgcccaggtcgcggtgccgggcgggttggccctgcccgacgccgagcggatcgccgcccggcccggcgtgaccggtgcggcgctgctactgcccacccgggtgatcctcgcccagggtgggaagccggaggactacgcggcgcagggactgatgaccaccggcgccgacccggcgatcgacctgggcatccgggcgggggcgccgggggacggtctgggggcgagtgcggcggtggcccgacagtacggctggcggatcggggaaccggtcgacctgtggctcgccgacgggtatcgggtgacactgccgctggctatgacgtacgcccgcaatcgtggttttggagatcttgtcctgcccgccgcgctgatcgcggcccacgacccgaagggcctggtcagcgtgatcagtctgcgcggagcgccgggtgtcgcgcggggcctgccgacgatctccgcggcgaccgccggcggtgaccacgccgatcagcagggcgcgtgggagttgatggtggtgatttcggtgggcttcaccgcgatcgccgtggtcaacacgttcgcgatcgccaccgccgggcggcgcggtgaattcgccgcgctgcggctgaccggggccaccgcgggccagttgcatcggctggcggccggcgaagcggtcgtcaccgtgctgaccgggctgctgctcggagctaccgtgagcggcatcgtggtgggcgcgttcagcctcgcccaggacggtgcgctccgggtgatcgtggacccggtgacgtacgccgggatggccgccggggtcgccgcgctcggcctcgccgccggcgtcctcccggcccgtctgctgctgcgccggcgtgcaccggccatttag

SEQ ID NO: 4536 - DNA, 1230 bp, Actinoplanes utahensis
atgatcaagcgaaccgggcgggcgctgggctacctgatcaccggaccggtcgcgggactcgccggattcgtctggagcacggtcgccggactgctggtgaccgtgctggcggtcacccagctgcgggacccggcattcctgggcgccgcctgggtgacccggcacctcgcccgggccgaacgacggcgggccggctgggtgctgggggcccggatccccgacccgtacctggcgggcacgcccgtggtcgcccagccggccacctggcgtgacctcgcctggctggtgctgctcctgccgatcggcgtggccaccggggtggccggggtggtcacggcggccgtcgacgccgccgcgatcctggcaccggcggtgttctgggcggtgccgaatccgcacgcgccgttcccgatgcggccactgctcaccacggtgccggggcggatcgggctgaccgtgctcgggctggcgctgctgcccgtcgcggcccggctcgtccgggccctcgcggccgggccggcccggctggcggcggtgctgctcggaccgggcgaacacgggcggctggtggcccgcgccgaacggctcgccgaaacccggcgccgggtggtggacgcgcaagccgccgaacttcggcggatcgaacgggacctgcacgacggggcccaggcgcggatcgtggccgccgggatgacactcgccctggccgcccgcaaactccgcgccgccgcgcccccggcgtcgggccggcccgacggtggcggcgacccccggaccgacgtcgagctggcgcggcggcagctcgacgatgccctggccgagctgcgacggctggtccggggcatccacccaccgatcctcaccgaccggggattgcacgccgcgctggccgcactggccggggacagcccgttcccggtcgcactgcacggggacgcggccgcgcgctatccggccgcggtggaatcggcggcctacttcgtggtggccgaagggctcaccaacgcggccaaacacgccggggcggccagcggggagatcgacctgggcagagtgggtggggtgctccgggtgacggtgaccgacgacggtcgcggtggggccgacccggccggagcggggttggtggggctgcgccgccgggtcgaggcgctcgatggcacgctgacggttaccagtccgcctggtggcccgaccaggttggtcgcggagttgccgtggtcctcgtga

SEQ ID NO: 4537 - DNA, 804 bp, Actinoplanes utahensis
atgggcaccgatggcatcgaccgcagcgagcaccgaccgcaccgaaagcacctagcgcatcgacggcatcgacggcatcgatggcatcgcctgcaccgagcgcatcgaccgcatcgacgggatcgccggtgtcgcggggggaggggaagcgctgtgcgcatcgtgatcgctgaggatctgctgcttctgcgcgaaggcatggttcggctgctgaccgagaccgggcatgaggtggtcgcggcggtcggggatgcgatcgggctgctggcggccgtcgacgagcatcggccggacctgtccgtgatcgacgtgcggctgccacccggattccgggacgaagggctacgggcggcattgcggatccgggccgcggatccgggcgcacgggtgttgatcgtttcgcagtatgtcgagcgggcctacgccgctgagctgctcgccgacggacgtggcggggtgggatacctgctgaaggaccgggtgacggcgctcgacgacttcctcgacgcggtcgaacgggtggccgggggtggcacggcgatggacccggaggtggtgcggcagctgttcgcacgcggcggcggcaaccatggcatcgacgggctgaccgcccgggaacgcgaggtgctcgccctgatggctcagggcctgtcgaacgcggcgatctgcgagacgctggtgctggccccggtctcggtggagaaacacatcaccaacatcttcggcaaactcgacctgccgccggcggctgacgctcatcgccgggtccgcgcggtgctcacctacttcaatgccgccacctga

SEQ ID NO: 4538 - DNA, 1014 bp, Actinoplanes utahensis
atgccgccgcccttgaaacgcgccacggtgcacgacatcgcggccgccgcgggcgtgtcccggggcactgtcagccgcgttctgaacggcggttatgtctccgccgaggcccgcgcggcgatcgaggcggcgatcaccgaggtcggttatgtgccgaacaccgcggcccgcgcgctgaagatgcgccgttccgaagcggtcgcgttcgtcgcgctggagccgcactcactgttcctcgacgacccgaacatcggcgcgctgatgctgggcgcgaacgccgccctgtccctggccgaccaccagatggtcagcctggtcgtcgagtccacccgcgacatggagcgggtcgcgaaatacctgagcggcggcttcgtcgacggcgcgatcgtcgtctcggcccgcgcccacgacccgatcatccaggtcctgggcgacctgcgcctgcccgccgcgttcgtcggccacccgcccgatctcgaccacagcacgccctacgtcggaatagacaatcaaggctcggcccgcgagatcaccacccggctgctggccaccggccgccgccggatcggcatgatcgccgccgccgtcgaccgcgactccggcatggaccgcctgaccggtttccgcaccgcgctcggccccgcgttcaacccggacctggtcgccgaggtcccgcactacgattacggttccggcgtcaagggaatgcgtctgctgctggagcgcgaccccaccatcgacggcgtcttcgccgcctcggacgcgatcgccgccggcgccctggaaaccctgcgcgaggccggccgcaccgtccccacggatgtcggcatcgtcggcttcgacgacagcacatgggcggtccgcacccagccccagctctccacggtccaccagcccgccaaggagctcggcgccgctgccgcccacctcatcctccgccagctgcgaggcgaggagatcaacgtccccgcccagctactccccacccccatcatctggcgcgactccgcctga

SEQ ID NO: 4539 - DNA, 2175 bp, Actinoplanes utahensis
atgctcggcgggggcggggccgcgggtggcacgttggcggggcgcgaggtcgtgaacagggaagcggccgggaaggcagggcgagagagaccggcgatcaaagatgccgctgtggccattgacctggcgtcggacgtcgtcttagtgtgtgcacgttcacacatccgtaacgccgatgtcggcgcagggaaatgtgtgcacgtgcacacatcggtgaccaggagtttcatgaaaagcatcgtgctgggttgtgactacaatccggagcagtggacccccgaggtctggcgggaggacgtcgcgctgatgcgcgaggccggcgtcaagctggtggcggtcaacatcttcggctggtcgcacctcgagccgtccccgggccgctacgagttcgacgccctggacgaggtcatcggcctgctgcacgccggcgggatcaggctgaacctgggcaccggcaccgcctccccgccgccgtggctgaccaccctgcacccggaggcgctgccggtcgcggccgacggcaccacccgcttcccgggtggccgacaggcgtggtgccccagctccccggccttccgggagcgggcgttcgccctggtcgagcaggtcgccgaccgctacggcgaccacccggcgctggacctctggcacgtctcgaacgagctgggctgccacaacgcgctctgctactgcgaggccagcgctgcggcgttccggtcctggctgcggcgccggtacggcaggatcgaaaccctgaacgacgcatggggcaccgccttctggagtcagcggtacggcgactgggccgagatccagccgccccgcctggccctgtcggtccgcaacccggcgcagatcgtcgacttccaccggttcagctccgacgagctgctcgactactaccggagtgaggcggccatcctgcgggcccgctcggccgccccggtcacgacgaacttcatggtcaccgcgcacatccgcaacctggactactggtcctgggcgccggagatggacgtggtggccaacgaccactacctggatcaccggctgggtgatccgacggccgagttgtccttcgccgccgatctgacccgtgggctggccggcgggaagccgtggatgctgatggagcaggcggccggcgcggtcaactggcagccacacaacctgaccaaggcgccgggcgagatgctgcggaacacgctgacccatgtggcgcggggcgccgactcggtctgcttcttccagtggcgggcttccgcgcagggtgccgagaagttccattcggcgctgctgccgcacgccggcacggacaccgtggcgtggcgcgaggtgctgcggctctccgacacgctgggccggctgggtgaggtggccggcacgaccgtgcgagcggacgtcgcgctgctgttcagctgggattcgtggtgggcggcggagggggaggcccggccgtcgcaggcggtggagtatctggaccaggtgcacgcggcgcaccgggcgctgcgcgacctcggggtcacctgtgacgtggtggcgcccggggcggagctcacgtcgtacaaagtcgtcgttgttccctgcctctacatggtcgacgatctggcggcggtgcggatcgccgatttcgtcgcggccggcgggaagctgctggtgacgttcttcagcggcatcgtcgatgagcgtgaccggattcggctgggcggctacccgggtgcgttccgcgatgtgctgggtgtgcgggtggaggagttcgcgccgctcaagcccggtgacgaggtgcggctcagcaacggcgcgacggcgacgctctggaccgagcggctgcgggtcacgaccgcggagccggtcgccagttacctggacgggccgctgctgggggttccggcggtcacccgcaacgccttcggcgcggggacggcctggtatgccgcgacagcgctcgacgccggcgcgctgcgggacctgctgcgcgagatcaccggggtgacggcggagaagccgaagaacaccgaggtggtacgccgcggccactacctcttcgtgatcaaccacggcgccgagccgatcgagtacccggtgaccggattcgatctcgtcaccgagaaggcgaccgacgggctgctgcgggtcgagggcggcggcgtcgcggtggtccgggaggaatcatga

SEQ ID NO: 4540 - DNA, 861 bp, Actinoplanes utahensis
atgatcaagaagagagcgatcgccttcttcgtgctgccgttcggcgtgctgttcgtcgcgttctacctcgcgccgatcggtttcgccgtcaagcagtcgctctatcgcgtcacccgcaccggcacgttcggcccggcgcacgaggtgttcggcggcctgacccagtatcagcgcgtcttcgagaacgcgccgttctggcagtcggtcggccgggtcctgctcttcggcgtggtgcaggtgccggtgatgctcggcctcgcgctgctgctcgccctgctgctcgactccggtctggtccgggggcgccgcttcttccggctggccttcttcgtcccgtacgcggtgcccggcgtggtcgccgcgatcatgtggggcttcctctactcgccgaacctgtcgccgttcaccgcggtgacccgggcctgggatctgctctccgccgacctggtgctgtgggccatggcgaacgtggtgacctgggtctacgtcggctacaacatgctgatcatctactccgccctgctggccatcccgcaggaggtgtacgaggcggccaccatcgacggcgccggtccctggcgcaccgcgtggtcgatcaagattccactggtgatgccggcgatcgtgctgaccacggtgttctcgatcatcggcacgctgcagttgctggccgagccgcaggtgttccgcaccttcagttccgcggtgtccagcacgtacaccccgaacctgaccgtctattcgacgtcgtcgatcccgaacttcaacctggccgccgccttcagcgtggtgctggcgctggccaccttcgtcctctccttcacgttcctgaaattcacgcagcgagggggcgagaagtga

SEQ ID NO: 4541 - DNA, 828 bp, Actinoplanes utahensis
gtgaagtcgaagaccgcggccatggccgtgatgggcatctgcaccttctatttcctggtgccgatctggtggctgttcgtcggcgccaccaagtcccgtggcgatttctcgaacacggcgcccctctggttcgccgacttccacctcgggcagaacctgcgggaactgttcgcgtaccgcgacggggtcttcctgcgctggatggcgaacagcctcgcgtacaccggcggggccgccctgctcggcacgctgctcgccgcgatgtgcggatacgccctggccaagtaccggttccgcggccgggagctgatcttcaacatcgtcctcggcggtgtcctggtgccggccaccgcgctggccctgccgctcttcctgatcttcagcaagctggaggcgaccaacaccttctggtcggtcttcctgcccagcctggtcaacccgttcggggtctacctggcccggatctacgccaccgcgagtgttccggaagaactgctggaggccgcccggctggacggctcgggcgaggtgcgcaccttcttcaccgtctccagcaaattgatgtttcccgctctggtcaccatcttcctgttccatttcgtggcggtctggaacaacttcctgctgccgctgatcatgctcggcaacgagcggctgttcccggtgactctcggcctctactcctggaacacccaggtcaatcagcttcctgagctgcggatgctggtgctcaccggcgccctggtctcgatcgtccccctggtcgtcgcattcctgctgctccagcgcttctggcggagcggtctcggcagcggcgcggtcaagtaa

SEQ ID NO: 4542 - DNA, 2562 bp, Actinoplanes utahensis
gtggacctgggtctccgcggtctggggcgccaactcgatctcctcgggcgcgccggacaccagcggcaagtgggcggtcgcgccgatgccgcagtggaccgcgggcggcaaggtcgccggcaactggggcggctcgtcgacggcggtcttcaagggctcgaagcacccgtacgaggcggccgagttcgcgatctggctgaacacctcggaggaggcgttgaccctgctcaacgagaaggcgaacctctacccggcgaccaaggccggcgcggcgctcccggcgctggccaagggcgtcgacttctacggcggccagaagatctacgacgtgttcgcgcaggcctccacccaggtcaccccggacttcacctgggggccgacgatgacctcgacctacgccaccgcctcggacggcttcaaggcggcggtctccggcagcggcaccctgctggacgcgctgaagaaggcgcagacgtcgacggtcgacaatctcaagtcgcagagcatcccggtcgccgagtgaccttcacgcatctgcgggccgcgggcgtcagcttcgtgctgaacgcccgcggtgcggtgctgtactggggcgccgatctcggcgaactgccggacggattcgccgccagtcgcattccggcgatcccgcccagctccatcgacgtaccgctgcaattgtcattgctgccgtcgatcgaggacggctggaccggccgccccgctttccccggccatcggacccggatcactgccgttcagcacggtcagaacacgattacggtacgcgcagagcaagccggcaaaggcctggagctgacgaccgagtgcgagttgactcccgagggcgtgctccgcctgcgccaccgggtcgacaatcacggcctcgccgttgtcgacctggccgccctgaacgtgctgctgccgattcccccggaggccaccgagctgatcgatttcagcggcctgtgggcgcacgaacgccgcccgcagcgcgccccgctgcgcgacggcgtctggagccgggagagccgccacggccgccccggccacgacgacgcgttcctgctgatggcagccactccgggtgccggcttccggaccggccgggtgtgggcggtgcacctggcgtggagcggcgacaagcagatctgggcggaacgttcgcccctcggccagtccgtgctgggcgccggtgaattgctgtcacccggcgagatccggctggccccgggcgattcgtacaccaccccgtggctgatcgcggtctattccgagaacggcttcgacggcctttccgaccggctgcacccgtggatccgcgcctcccggagaaccgcgaagccccgcccggtcgtgctgaacacctgggaggcggtctacttcgaccagtcgctcgaccggctgaccgctctggtcgacgccgcggcggaatccggcgtcgaacgattcgtgctcgacgacggctggttcaccggccgtcgcgacgaccgccgggccctcggcgactggcacgtcgacccggtgatctggccggacgggctgcacccgctgatcgcccgggtcgaggccgccggaatggatttcggcctctgggtggaaccggagatggtcagcccggattcggtactggcccgcgcccacccggaatggattctcggcccgccggacgcgctcacctggcgattccagcgggtgctcgatctggccgtcccggccgcctacgcccacgtgctgggccgcctgaccgacctgctcaccgagtacccgatcgccttcctcaagtgggatcacaaccgtgacctgctcgaacccggtgccgcgcaccggcagaccaccgcgttgtaccggctgcttgccgagctgcgggcggccttcccggagctggagatcgagagctgcgcctccggcggggcccggatcgacctcggcatcctgccgcacgtcgaccggttctggacatcggacaccaacgatccgctggaccggcaactgatccagcgctggacgagcgtgctgatcccgcccgagatgctcggcgggcatctcggtgacggcgtcgcgcacgtcaccggtcgtacctccgcgctgggcctgcggatggcgaccgccctgttcgggcacgccggcatcgagtgggacctctcccgggcggccccggcggaccgggcactgatcgccgcctggaccgccgagtacaaacggctgcgcggcctgctgcacaccggcgtggtggtccgcgccgaccatcccgacccggcggtcctgctgcacggggtggtcgccccggaccgctcggccgcggttttcgccctggtcacgctgggcaacccggtcgccgcgctgccgccgccgatccggttccccgggctcgacccggaccgctcctacacggtgcggccgctgggccacccgccgcggatggtgcaggacgccccgccgccgtggctggccgaaggcgccgtcaccctgaccggccgggtgctcgccgaggccggcctgcccgccccgctgctggttccggaacaggcggccctgttcacgctgacggccgtcgcctga

SEQ ID NO: 4543 - DNA, 2640 bp, Actinoplanes utahensis
atggttcggcgctggattccgttcgccgtggcggggctgctcgtcaccaccgtgccgggcactccggccgcggccgcgactccggcgacgcggtacgtcgtgcggctcaccggttccgccacagccgaccgggtcgcccggtccgccggcggcaaggtccaccaccgcttcagcgcggcgctgcacggcttctccgccgacctcaccccggcggcggtggccaggctgcgccgcgacccgtcggtcgccgcggtcgacccggtgcgcccggtgcacctcgccgacacccagaccgggccggactggggtctcgaccgggtcgaccagcgcgcgctgccgctcgacggcaagtacacctggaccggcggcggggccggtgtcaccgtgtacgtggtcgacaccggcgtgatgaccacgcacaccgagttcggcggccgcgccaccgcgccgatcagcacggtcggcgacccgttcggcaccaccgactgccacggccacggcacgcacgtggccggcacggtcggtggcgccacgtacggcgtcgccaagaaggtgaagatcgtcggtgtccgggtcctcgactgccagggcaacggcaccgacgagggggtggcggccggcctcgactgggtcatccagaaccacgtcagcggtccggccgtggtcaacctgagcctcggcggcgacccgtccgcggtgatggagaccgcggtgaacaacaccatcgccgacggcatcaccgtggtcgccgcggccggcaacgacagcaccgacgcgtgccagcacagcccggcccgggtgcccgcggtgatcaccgtcggcgccaccgccaaggacgactcgctggccggctactccaaccgcggcccgtgcgtcgacctgctcgcccccggtgacgacatcacctccgccgccacctggtccaccaccggcagcaccgagatgtccggcacctcgatggccagcccgcacgtggccggcgccgccgctctgctgctcggccgcgagcccaccctcagcccggccgtggtcgccgcccggctcggctccgcggccacccccaacgtggtcaccgggctcaccgccgccacgccgaacctgctgctcagcacgctgaccacggtgttgccgctggccaccccggcgacccgccggctggccgacccgctgaccggccgggcctactcggccgggctgcaggccaccggcggtgtcgcgccgtacacgtggagcacggtcagtggcacgctgcccgccgggctgacgctgagcgcggccggacaggtcaccggcaccccgagcgccgcggcggcggccaccacggtcaccgtccgggtcaaggacaccggcggccgcaccgccgactcgaagatcaccctcgcggtgaaggcgcccggcctcccggcgatcggcgagttcgtgcccgcggtgcgcaccgccggcggcggccagtccttcagcgacgccggcggggtgtcgctgagcgccgacggtcgctacgccgcgttcgtctccaccgcgggcgacctggtcaccggcgacaccaacggggtcgccgacgtgttcgtcaccgacctgaccaccgccaccaccaccctggtcagccggaccaccaccggggcgatcgcggacgccgagagctgggagccggacatctccgccgacggccggtggatcgccttcacctccacggcgcagctctcgccggacgacaccaacgaggcccaggacgtctacctcgccgaccggaccaccggcgccgtcaggctggtcagccgcccgcccggcaagcccgcggccggcggctcccacgcgccgtcggtcaaccaggacggcaccagggtggcgtacctgtcgagcgaaccggtcctgtggggcggcaccgacccggcggtcatcgaccaggcgctggtcgcgacgatcgccaccggggcgcagacggtggtcagcgtgaccacggccggcaagccgcccaccgacggcaacagctatcacccggtgatctccgcggacggccgctacgtcgcgttcggctcggcggccgccgcgatcagcagcgccacgccggccggcaacttcgccgaccacgcgtaccgccgcgacctgaccgccaagaccacgaagatggtgtccgcgcacgccgacggcaccgccgacagctggggcgagctgctcgacatgtccgccgacggacggtacgtgctggtcacctcgatggatgagctggccggggacgtgggcgcggtctacacccaggcctactggcgcgacctgacggccggcacgatcaaggtcgccagccgggacccgggcgccgcctacaccgccgaccaggtgcagggcggccggctctcggacgacggcagccaggcgacggtgacggtcgagcacaccgactcggccgacccggcggcggccaggtccagcgtcctcgcggtcacgccgtcgaccggcgcgtcccgccggatcggtccgtggtacctgccgatgccgccggattacgccgggacacggcgggtgagtgacgatgcggtgctctccagggacggcacctatctgctcgcggccaccaccaacgcctcctcggtgccgggctacttcgccggcccgctgaccccggccgtcacccgactccgctga

SEQ ID NO: 4544 - DNA, 735 bp, Actinoplanes utahensis
gtggcacgaacagcgctaccagggcgactgacctggcaggtggccacggtctccgcggtccgcgcggagaccgcgacggcccgcaccctggtcctggacatccccggctggcccggccacctgcccggccagcacctcgacgtcaagctgaccgccgaggacggctactccgcgcagcgaagctattcgatcgcctcggactggcccggcgagggcccggtcgaggtgaccgtgcagcggctggaggacggcgaggtctcgccctatctgaccgacgtcgtcgaggccggcgaccagatcgaggtgcgcgggccgatcggcggctggttcgtctggcggtccgcgcagcccgccccggtgctgctggtggccggcgggtcggggatcgtgccgctgatggcgatgatccgggaccgggggcggcggcgcggccggcagccgttccggctgatctactcggtgcgcacgccggcggacgggtactacgccgatgagttgcggcggcgcgtgcgcgacgaccccgggctggacgtccacttcgtgcacacccgctccgggccggggccgaacaggcggatcgacgtggcgacggtcaacacgtacggttggccgcccgacttcgcgccggacgtgttcgtctgcgggccgaccgcgttcgtggagacggtcgccgacatcctggtggcgctcggacacgacccgaagaaggtccgcaccgaacgcttcggcggctga

SEQ ID NO: 4545 - DNA, 600 bp, Actinoplanes utahensis
atgggcatcatctcccggggcttcggcgggcggcggcgtgactccgcgccggacctgccgcccggtcaatatctgacacacgacttcccggtgctctccaccggtccgacgccgcgcgtcgacacggaccggtggagtttcaccatcagcaccgagaccggtgagaagcaccggtggaactgggcggagttcaccgccctgccggccgaggagatcacccgggacatccactgtgtcaccaagtggtccaagctcggcaccacgtggaagggcgtctcgctggacacgctcttcgaggacgtggagaccgccgcggactacgtgatggcgcacagcttcggcgggtacaccaccaacgtgccgctggcggatctgctcgacgggcaggcctggatcgcgtacgagttcgacggcgagccgctggaggaggagcacggcggcccggcccggctgctcatcccgcacctgtacttctggaagtcggccaagtgggtcaacggcctggagatgatgcacgaggacgagcccggattctgggaactcgccggttaccacatgtacggagacccgtggcacgaacagcgctaccagggcgactga

SEQ ID NO: 4546 - DNA, 1647 bp, Actinoplanes utahensis
atgcggggcaagctgttcacgggtctgttgacggcgacggcggtcgtcacgctgggcacggtggccctgccggtgtccgccgcgagcgccgccgaccgggcgccggtgcggctggtcaccacgacgctggacccgctgggccggccggtgatcaccgtgcgcgaggcgtcggccgggagccggcacctcgaagaggccggggccgaagtggacggccgggtgcacgccctcgatgcgaccacggacgggaccgacccgtaccgcgcaaggcagtgggatctggacaccatgcacgtgcccgcggcccgcagcatgtcgaccggcgccggggtgaccgtcgcggtgatcgacaccggggtggacgggagccatccggacctggccgggcaggtgctgaccgggtacgacgcgatcgccgggcaggccggcggcaacaccgacccgcaggggcacggcacccacgtggccggcaccgtcgcggcactgaccggcaacgggatcggcgtgtcgtcggtcgcgccgggtgtcaagatcctgccggtgcgggtgctcgacgcgaacggcaacgggtacgactcggacaccgcgaagggcatcgtctgggccgccgaccacggcgccaacgtgatcaacatgtcgctgggcgggaccgaccggtcgtcggcgatcagcgacgcggtgacctacgcccgaggcaagggtgtggtggtggtcgcggcggccggcaacgaccgggccgcgggcagcccggccaactatccgggtgccgacgacggggtgatcgcggtggccgccaccgactccggggacacggtcgccgcctactccaacgccggcggctacgtcgacgtggccgcgcccggcagcgcgatcctgagcacctatccgaccgcgctgggcgccagcggatacgcctcgatgagcggcacgtcgatggcgacgccgcacgtcgcggcggtcgcggcgctgctgctcgccgcgaagccggggctgaccccggatcaggtgcagaccgcgctggagacatccgccgccgacctcggcaccgccggcagggacgacgattacgggtacgggcgggtggacgccgccgcggcgctgaccgctgtcgatgccaccccggggagtaccccggtgagcacgccgcagagcacgccgccggtggtgtccgcgagtgtcagccgtaggtcggtcacctacggcagccggaccagcaccacgttccgggtgtccgactgggcggaccagcccgcctcgatctgcatctcggtcgccggcggctcgtgggcgtgtgactcggtgcgcaccagtgcggccggcaccttcacgctgacccgcacggcgaccgcctcgttccgtgcgcggctgacggcgggctcggcgtcggcggtcacgacgtacaccgcaatcggggtggtgtccttgacccgcaccgccaagcggaccctgacgatccgcgtctccggcgccggcggtcagaaactgagcctgcagcgatccgccgggaagcgctggacgaccgtcaagaccttcggtgcgaccggcagccgcagagtgaccggcctggtcagcggcggcagctaccgggcggtgctggcctcgaccagcaaggtgtccggtgtcaccagcaagacagtgaaggcctga

SEQ ID NO: 4547 - DNA, 483 bp, Actinoplanes utahensis
gtgcgatccggtcggccgcgaggtgcggttgaggtgccgttgatccgccgtagaatcgggcgtatgcctctgaccggtgaataccagcccggcaccctcgattgggcgcgcgagcaggccgagcagtacgaagcgaccggcggcgccggcaccccggagatcatcgtggtgaccagcgtcggcgccaagagcgggaaactccgcaagaccgccctgatgcgggtcgagcacgacggtgactatctggcggtcggctccctcggcggggctccgaagaatccggtgtgggtctacaacctgcggaagaatccgcacgtcgaggtgcaggacggtgcggagcggcacgactacgacgcccgtgagctgaccggcgccgagcgggaggtctggtggcagcgagcggtcgaggtgttcccgaactacgcggagtatcagacgaagaccgagcggatcatcccgctgttcgtgttgacccgccgctga

SEQ ID NO: 4548 - DNA, 1152 bp, Actinoplanes utahensis
atgcggaccccccaccagcccctcgaccgtgccaacggcgcggcggtcccggccgcccgcaccccgcagcagctgccgtcggcggccatgccgctgtccggctccgtcgacgacggcgaccggctggtggatctggtcgacctgatcgccctcgacccgttcgtcaccggccgcgagccgtacggccgcaccacctggctggagaatctgcgcgccgactccgcgctgaccgtcccggacgcgcgggtgatccgcgaggcggtcgaggacgacggtcacggccggctcagcgtcggcgacggctggaccctgcacgtgatgcgctggaagcagagccgtcgcgcccgggtcacggtcaccgcggtcagcggcgagctggccgaggcgatcctcacgaaggtgaccgcgggtgcggtcgaggaaccggccccggccgacgacagcgtgccggtcggcttctggcactacggcccgcacggcccgcgccgcacccagcgggagatcggcgccgcgccctgggagacgatcaagcggaactacgccaagccggtcggcgacaccctggaacgcctgatggcgatcgatgcgtccaccgtgaccggccgcctcctgctgctgcacggcgagccgggcaccggcaagaccaccgccctgcgcgccctggcccagcagtggcgctcgtggtgtcaggtcgactgcgtgctcgacccggaacgcctgttcggtgacccggcgtacctgatgagtgtcgccctcggcagcggcgaggacgacgagcccaggtggcgcctgctgatgctggaggactgcgacgagctgatcagcggcgacgccaaggcgagcgccgggcagtcgctgtcccgcctgctcaacctgaccgacggactgctcggccagggccgcaacgcgttgatcgcgatcaccacgaacgaggacctgtcgtcgctgcacccggccgtggtccggccgggccgttgcctggccagcatcgaggtcggccggctgccgtaccgggaggccgccgactggctcggcaccaccaccgggatcgggccggacggcgcgacactggccgagctctacgccctgaagaccggggccgagccggtcaccgttccccgccaggccccgcccaccggaatgtatctgtag

SEQ ID NO: 4549 - DNA, 1548 bp, Actinoplanes utahensis
atgcgcacctcgttccgggccgccatcgccggggtggcggccctcgccgtgctcggaccggtcgggtatttctggtacgacagcctggttcccggcacctacgacatggccgcgatgggctatccggacagcggcggcggaccggcggtggcgcacgaccacggcgtcgggatgtcggtcgccgacctgaggggcccgagcggaaccccggatgtcgcggtcaccctggtcgcccgcaaggagggcgcgaggtacacgctgaacggcagcacgcccggcccggcgatccgcgccgtccagggccagctcatccaggtgacgctggtgaacgcatcggtcccggacggggtgaccctgcactggcacggcgtcgacgtgccgaacggtgaggacggtgtggccggggtgacccaggacgcggtccgggaggggcagagcttcgtctaccgcttcgtcgccaaggatgccggcacctactggtaccactcccaccaggtctcccacgagcaggtgaagaacggcctcttcggcgccctggtgatcactccgcgcgccgagccggccgcgaccaccaccgggcaggccgagccgtcgcaggtcgcgatggtccatacctatcagggcaaacggacgatcaacggcacgcccgggtcgtccccgctgaccaccgccacggttcggctgatcaacacggacgccggcccgatccgggtgtgggtgaccggcacgaccttccggatcatcgccgtcgacggccgggacgtccacgagccgggcccgatccgggaccgaaacgtcctgctcaccgccggcggccgggtcgacctgcacctggacacccccggccggatcgacgtcggcggcgacgcggccctggtctctcccgaaggccggcccgcaaccgaaagcccggccgcgagcccaggcccggccgcagaccccggcccggcagcagaccccggcccgaccgctagcacaggcccggccgcagaccccggcccgaccgccggcagaagcccggccgcggtcctgcaggccgccccgctcccccgcgaaacggtcgatctcctggcctacggcacgccggccccgctcggcttcgacccggccgaagccggccgccgtttccggtacgacatcggccgccgcttcggcttcctcgacggccggcccggcatgtggtggacggtgaacggccacctcttcccggacctcccgatgttcatggtcggcaccggcgacatcgtccggatgaccctgcacaacggcagcggcgaggtgcacccgatgcacctgcacggccatcacgtggtcgtgctcagccgcaacggcgtcgtcgccaccggcagcccgtggtggaccgactcgctggacgtggccgacggcgacacctacgagatcgccttcgtcgccgacaacccgggcatctgggccgaccactgccacaacctggaccatgtcccggagggcctggtcgtccacctcgcctacgccggcgtccacagcgcgttccaggtcggcggcccgcaccacaacacccccgagtag

SEQ ID NO: 4550 - DNA, 423 bp, Actinoplanes utahensis
atgcgggctctgtatcgggcactcgccgggctgatcgcactcagtgtggtcgtccaggccgcggtcctcgccgccgcgtggttcatcgtcatcaaggacaccgacaacggtgtcgtcttcgacaagaacaatgagggaaactgggggcacgccgcgcacggcatcatcgggatgatggtcgtcccgctgctcgccctgctcctgctgatcatctcgttcttcgcccggatcccgggcggcgtcaagtgggcgctgatcaccgtcggcgtggtcgccctgcagatcgtgctggccatggtcagcttcggggtgccggtgatcggcgccctgcacggcatcaacgcgttcgcggtcgccggcgtcgcctcgatcgccatgcgtcaggcgcgggaatcgatcgccccgccggtcgccgtcgcctga

SEQ ID NO: 4551 - DNA, 1290 bp, Actinoplanes utahensis
gtgcgaggagaacaccggcccggcggccccgcgatcgctggccggcagcctgcggaggtggtgatggagcacgtggccgtcgtcgatctgggctacggggacgccggcaagggcacggtggtcgacgcgctgtgccggtccggccgggtgcgggcggtgctgcgcttcaacgggggtgcgcaggccgcgcacaacgtggtgaccgacgacgggcggcaccacacgttcagccagttcggcgccggcacgctgcgcggggtgccgacccacctgacccggttcatgctggtcgacccgctggcgctggccgccgaggcgggcgccctgggcaacccgttcgagctgctcaccgtcgacggcgacgcgctgctgaccaccccgtggcaccgggccgcgaaccggcggcgggaacgcgccgagcggcacggttcgtgcgggatgggtgtcggcgagacgatggcgtacgcgctggccgagccggatgcgccgcgggtcgccgacgtgctgcacccggcgcggctgcggcgccgcctggccaaggtccgggaggcgtacgggttcggcgacgcgccactcgacgacgtcgccgacgcgttcaccgcgttcggccgggccgtccggatcacccacgagagccacacgatgcggctgctcgccgagggcccgtgcgtcttcgagggcgcgcagggtgtgctgctcgacgagtggcgcggctggcacccgcacaccacctggtcgacgaccacgttcgcgaacgtggcggagttgtgcccgtcgttccgccggctcggggtggtgcgcacctacacgacccggcacggggccggcccgttcgtcaccgaggatccgctgctggacctgccggaggcgcacaacgggacggacgagtggcagggtgcgttccgggccgggcacttcgacgcggtcgcccaccggtacgcggtcgaggtggccggcggcatcgacgagctggccgtcacccatctggacgtgccggcccgcgagcccgcattgaagatctgcacgtcgtacgtggtggacggcgagcgggtcgaccggatcgtgccgggcccgcaccgcgacctggcacaccaggcggggctgaccgcgtggctgggccgggcccggcccgctgacctgcaccggccccccgactgggcacgggagatcggcgctcttctcggcgcgccggtaaccctggagtcgtacgggccgcgcgccggtgacaagcggatggtcccggagggagtagcccgtccggtgcggatacgccgtgcagcgtattgctga

SEQ ID NO: 4552 - DNA, 855 bp, Actinoplanes utahensis
atgggaagcggacgctggtccaccgacgtctggaccgccgccgagaactaccgcgcggcgaccgggcagagcgccttcgcgtacagcgacagcggcgcccggcaggcgcacccggcgctcgacccgcggggcgtcttcatgcgggagagccgggacagccgggagcacccggcgagcaccccgatcgtggtgatgttcgatgtgaccgggtcgatgcggcacgtgccgcgggtgctgcagacgaagctgccgcagctgctcggcctgctcacccgccggggctacgcgaccgatccgcagatcatgttcggcgcgatcggggacgccacctgcgaccgggtaccgctgcaggtcggccagttcgagtcggacaaccggatggacgaggacctgtcccggatcgtgctggagggcggcgggggcggcggccggcgcgagtcgtacgagctggccatgtacttcctggcccggcacgtggtgatggactcgatgatcacccgcgggaggaagggctacctgttcctgatcggcgacgagatgccgtacgacacggtcaagccggacgaggtgcgtgccgtgatcggcgacgagctgccgcaggccctgccgacccgggaggtgctcgccgaactgcggcgcaagttcgaggtgttcttcatcctgccgaccgccgccgggcacggcggcgaccgggcgatcctggccgcctggcgggacctgctcgggcagcacgtgctggagctcgacaacgtcgacgaggtctgcgagaccatcgccggcgcggtcgggatgtgcgaggagaacaccggcccggcggccccgcgatcgctggccggcagcctgcggaggtggtga

SEQ ID NO: 4553 - DNA, 1026 bp, Actinoplanes utahensis
atgaacccggggtacgccaccgccgagcagcggacacggaccagtcaccggatctccttcgaggacgcggccgcccggatcgcggcggcccgcaccttcgccgagctgatcgactccgggctgatcgacagcagagcactggggatcgagcggcgcaccgcgagcgggacggcgttcgtgaacgcccggcacgcgtaccggacgctggccaggatcgtgcatccggacgcggccggggcggcccgccgcgagccggcgaccgcggcgttcgcccggctcagcgcgctctaccacgagcgcggcgtggacggacacgtcaagccggagaggacgcggtggacagcccggccgctgttcgccgagggggacatcgccgagctgttcgaggacggcgacctgctcctcaagatcgcccgcgacccggccgacaacgacctgatggcggccgaggcgaacgccctgcgccggctgaacacgcacggacgacccggcttccgggcctatgcgcccaggctgacccgatcgttcagctaccacggacgtaccgtcaatgtcctgacccggcaacgcggcttccgcgacctggcgacggcgaccgatcggggactgcccgacctggtgtggatctggcgccggctgctggccggcctgggctgggcgcaccgcgccggcgtggtgcacggcgccgtgttcgaggaacacgtgctgatcgacccccgggtgcgcggcctggtcctgatcgactggtgttacgccacccccgtcggcgcgcgaccgagagcgctcatcgcacgccacgagcatcggtatcccttcgaggtgccggccgggcagccggtcaccgccgccaccgatctccacctcgcgaccagcctgatgaaacggctgttcgggacggacatgccactgcctctacgccggttcgccgacggctgcctgtacgacgcgccacggatgcgcccgcagaacgcgtggcggctcctggccgaattcgatgagttggtccccccgcggtaccggatctag

SEQ ID NO: 4554 - DNA, 762 bp, Actinoplanes utahensis
atggtggacgaggcgagcttcctggccggctacaacccccgggactacccctccgtcgccgtgaccgtcgacgtcgtcgcgctgaccatccgggacgggcagctctgcgtgctgctggtcgagcgcggcgagcagccgttcgccggccaccgcgcgctgcccggcggcttcgtccgcgaggagaccctcgaccgggccgcgctgcgggagctggccgaggagaccgggctggcccccgggccggaggccgacgccgacctggagcgggtctggctggagcagttgcggacctacggcgatccggggcgcgacccgcgcatgcgggtgatcaccgtggcctacctggcattcgcgccgcacctgccggagccgaccgcgggcagcgacgcggccggggcctactgggtgccggtcgacgaggccaaggatctggccttcgaccacgaccaggtgctcgccgacggcctggagcgggcccgcgccaagctggagtacacgccgctggccaccgccttcgtcggcaccgagttcaccatctccgagctgcggtcggtctacgccgcggtctggggcgaggagctgcacgccggcaacttccaccgcaaggtgctctcggtgcccggcttcgtggagagcaccggcgagacggcggcgcgcggcggcgagcggggcgggcccaaggcacggctctaccgggccggcgacgcgcggtcgctgcaccccgccctgttgcggccgacacgggaggacggggtgcgatga

SEQ ID NO: 4555 - DNA, 288 bp, Actinoplanes utahensis
atgacacagatgatgaatatgccgcgggtccagacctgcacggtcaccgactgcggctacaaccacgacgggtgcaccgcgttcgcgatcaccatcggggacctgaacgccgagtgcgacacgttcgtcggctccgggctcaccggcgggatgggcgtcgccaccgcccaggtgggcgcctgcaaacgggccgactgcaagtacaaccacgacctggagtgtcaggccccggcgatcaccgtgggcgcgtcggccgaccgggccgactgcctgacctacgagaagtag

SEQ ID NO: 4556 - DNA, 2280 bp, Actinoplanes utahensis
atgcgtaagtccagaaatgccgcgcgtccccggtgggcgcgtgttggtctgacgaccggggtggtcggtgccgctctgctcgtctacccccaggcggcgttcgccgcctcctcggtaacacccccggtcgcgccggtgggtggcagtgtcaccatcaacgacaccgccccgtccccgaacttcaccacggccaccggcagcacccgcgtccagatcatcacgacgggcacctgcgcggccacctacaccacgcccaccacgtcgatcgtgtcggcgaacgtgacagcggctgcggcgcagtcgggcggcacgcccggaacagtgaccttcacggtccccaccggcgtctcgccgggcaccaacggacaggccaagcggtacatcgcctgcgtgtacgccggcgtcacgggcggcaccagcacgcgggaaggtgcggcggccggctaccccttctacgtcgggacgcccgcgacgccgtcgccggcggccggtgtgaccggtggcggtaacacggtcaccctcaccgccggcaccggcgggccgatcttcaccggtgtcacgacgatcggtgcggcgttcaccctcaacacttcggactgctcgcagacctacggcacgccgacggcgaacctggccaccacggtgacccggacctccgacacggtagccagtctcaccgtgccggccggtgtcgtctccaccaccgccaaccccaccgcctacaacatttgcctgtacaacggcaacacctcgtccgcggcgctgttctcggtggtgccctacaccgccgggcagctgcaactgagccagaccaccggcccgtggcagggcggcaacggcctgaacatcacctcgccgaaccagttcctggccggcatcgacaacccgggcgtcatcttcaccagcggagcatgcccggcggcctacgactccggcgtgacagccaccaacattccggtcgacccggtgaacagtgtccggaagctgtcgaacacccgcctggccacgaccgccccggcgttctacgggaccgcgaacgacgccagcacggcgttcggctcagccgggtcgatcacctggaacctgtgcatctacgacggctccgggaacgggacgtccaacctggtcgtcgccaacccgtacaaggtgaccacgatccagacctcgaccggggtctcgccgaaggccggcccggcgctgggtggcagcctgatcaccgtcaccggcaccgcgttcccgaccgacccgaccctgatctcggcgacgctgggcggcgtgccgctgaccgacatcaacccgctgagcaccaccgcgttcacggccaggacgccgcggcacgcgcccgccagcaacgtcgcgctggtggtcaccacggccagcggttcacacacgctgaacaacgcgtactcctacaccagcgcgctggtgatcgcgccgaacacggcacccaacaaccgggtcgtccagttggtcgtggacggcgtgggcttccagagcgccagctggggcaacaccctggtcaccggggcgcacgtcttcctggtcaagggcagttacagctccactgacaacggcaacgtcgtgcgaagcaacgcgccggtcgcggactgcagcaacgtgctggtgctcagtgacaccgagctgatctgcaagctcgacctgaccacccggctggacgctaccggtgcggccacgctgtccgcggtgccgacggcgggcaacgccgtcgtcaccaccgccggcagccggctgatcaccggtaccgctttcgcccccacggatgtcggcaaggccgtcatcgaagccgtcgacgctcccgtgatcccggccggcacggtcatcaccgacgtgctcaacgccaccacggcggtcatgtcgaacgcggccaccggtaccgcgagcgcggcagacgtgaccctggcttcgccgctgacgtcggctgccacggtgacgacgaccaactcgtcgaccggcctcaccgccgtctcgccgaccctcggcaccggcgacgtcgggaagtacatcatcggcgccagcatcccgacaggtcggacgatcagcgcgcagggtggagcaaccggaaccctcagcgcggctgccgcctcctcgggtggcggcgtgcaccccgtcgttctggccggcaccactattccggttccggagggtgcctacaacatccagtacgtcagcaacgccgctgtcaacgcggtggcgaccgatcccagctacgtgcagagccagatctccagcacgtccacctttaccgtcgccgccttctga

SEQ ID NO: 4557 - DNA, 2283 bp, Actinoplanes utahensis
atgcgtaagtccagaaatgccgcgcgtccccggtgggcgcgtgttggtctgacgaccggggtggtcggtgccgctctgctcgtctacccccaggcggcgttcgccgcctcctcggtaacaccgccggtcgcgccggtcagcggcaccgtcaccgtcaacgacgactcggccccgttcatcggctccaacaccgaccgggtggagctgctcacgaccaccggcaccgcctgccccgcgacctacaccacgccgaccgcgtccatcctggccgcggcgtcgaccacctccagtaccacgagccaggtggtgttcgtgctgccgaccacggcgaccgcgggcagcaacggacaggtcaagaagtacatggcctgtgtgtacgccagcaacaccgccggctccagcgcccgcaagggcgccacgaacggttacccggtctacgtcggcaccgccccgaccgtttccccgacgtcgggcaccaccggtggcggcgccacgctgaccatcacggggggcaccggcgggccgatcttcacgggtgtcaccaccgtgggcgcccagttcgccacccaggccaacgactgcccgacgacctacgggaccccgacggcgaacgtggctaccacggtcacccgcacctcggactccgtcgccagcctcaccgtgccgtccggcgtcacctccaccaccgcgacgccgacgccgtacttcgcctgcctgtacaacggcaacgcgtccgcctcggcgctgatcgcggtggtgccgtacaacgtcggccagctctcgctgagccaggccatcggcccgtacggcggtgggaacaacatcgacatcacctcgccgaacccgttcctggccggcatcgacactccgggtgtcgagttcacccagggcgacacctgtgcgtcgacctataccgtgggtcagacggggggtacgaacgaaccgctcctgaccgccaacattcgtaaggtgacgaacaaccggctggcggtgacggcaccggcgttctacacctcgggtgcctacaccacggccctgggcaaccagccggccggggcgaccagcgttccgtggcagctctgcatctatgacgccgccaccgcccagggcaatctgatcgcgtccaatccctacaagacgaccaccgttcagacgctgagccggatctcgccgaatgccggcccggcgcttggtggcagcgtggtcaccgtggtcggcaccgcgttcccgaccgacccgacgcagatctcggcgacgctcggtggcgtgccgctgaccgacatcacgtcgctgagcagcaccgcgttcaccgccaagacgccgatgcacgcgccggccaacagcaacgcgctggtggtcaccacgcccgccggctcggccacgctgaccggcgccttctcgtacaccagcgcactggtggtgaacccgaagacggcgccgaacactcggagcctcgacgtggtcgtcaacggtgtcggcttccagggcgcgccgtggagcagcagcctgaccgccggggcgcacatcttcctgtcccggggcaactacagcaacgcctcggtcggcggtgcccgggcgaacgccccggtcgccgactgcaggaacgtgctcgtgctcagcgacaccgaactggtctgccggctggacctgacgaagcgtctggacctcaccggcacggcgctcctgtccgcggcacccaagtacggtgtgacggcgagcgtcacggcaggtagccgcgtcctcacggctaccggtggcacgttcgacgcctccgatgtgggtaaggccgtcgtcgaccccgccggtgtcgctctcgctaccggcacagtgatcaccaacgtcgtcagtggcacgacggcgatcatgaacaacccggcgtccgccacattggccaacaacgcgacgatcacgatcgcgtcgccgacctaccgggccgccacgatcaccaccaccggcaccaacaccgtcgccgccatcaccgggccggcgagcaccttcgtcgcctcgaccgacgtcggcgcctacccggtcaacgcgaacatcacggcgggaacgacgatccaggccgtgggcagcgacacgggcgccaccctttcggccaacgcggccaccgccggtgccagcgtcgcctccatcatctacagccagtacgtcccggttcccgagggtgcgtacaacctgcagtacgtgagcaacgccgcgctcaacgcggtgcagaccgacgccacgtacgtgcagagccaggtttccagcagctccaccttcaccgtctcggcctactga

SEQ ID NO: 4558 - DNA, 690 bp, Actinoplanes utahensis
atggccaacgaagaacagaatcaacccacccaggacctcactccgcgccccggaaagcgccggaagcaggccatggttgcggtcgccggagcggcggtggcgatctccggagctgccttcttcgccgccacgcaacaggacgacagcccgaccgcccgatccgcgacggtcgcggcccccgacgccggcgcctccgccgaccaggtcggccggatcgccgcggccggcgacgaactcacgaagtcgaaggcgggcaccgacccgtccctgccgccgtccgcgaaggaccgcgtcgacgccgcccgccgcgccgccgccaaggacggcgtgaagatcacccacccgctgcccgccaagcccgacccggaggcggacggcgcgaaggaggtcaccgtcggctccgccaagaagggccagacgatgcggatcatcaccgcccacggcgacctgaccggcacgcacgaactcgcctgggtcgccggcggcatcaccaggcacggcgacatccagtgctcgcagcagttcaagttctacaacgaggcagccccgaagacccgggacaacctgttggtctgctggcgcaccagcgcgcaccgcagcgtcatcacggtcgatgcgaagatcggcggccacccaccggtggcccagagcctcgccgtcatcaaccgcgagtggcacaaactcggctga

SEQ ID NO: 4559 - DNA, 1269 bp, Actinoplanes utahensis
atgatctcctcgcgacaattccgccgcgccctgctcgccgggacggtgacgaccgggctcgcggtggccggcggacccgccccggcgtatgccgggagcaccgcactcccgatgacgctcagcagtgccaccgggcccagcggcggcgggaacacgatcatcggcacggtcaccccgaccgccgcgaacccgaatccgttcgtggccgggagtatgcccaccgtgcagttccagtacaacacctgcaccgcgaacgcccgggcggtggccgcgatcaccgggaccggcaccgcggccaccggtggggtgctcaccgtgaaccccgacaacgtcaagcgcaacggcaccacccggatcgccttcgaggtgccctccgcgtcgtacccggcgaaggtcgacgacaaggacagcacgatcaacacgggcgggctggtgctgaccggaacgcagaccagcgccaagtggaacatctgcgtgtacgacagtgactccctctcgaccagcacgctgctcgcccaggcggcctacaccatcggggtacggccgaagatcaccgcgatcatcccgcccagcggggcggcgctcggcgggcagtcgatcacggtgaccggggccgggttctccgcgaccagcaacgcgaccacggccagcatcggcggggtgccgctgaccaacatcaaggtggcggcgaacggcaacagtttcaccgcgaccaccgggcagcgggcggccgccaccgggctgaccctgatcgtgaacaccccgggcgggcaggtgctcagcagcgacccggacaacaacgggctgccgcaggacgccgacgacaagacgccggacgcgccgatcaccttcacctacagcaacgggatccagatctcgccgaacaccgcgccggccggcacgaaggtcgacctgctgatcaagggggtcgggttccaacagatgaccttcgacaagagcgcggacgcgacgccgacctcggtgacggcacatgtgttcctggtcaaggacgcgtacgtggcggccagcaaccgcggcgtccaggagtgcaagaaggtgctggtggcgtccaacaccgacctggtctgcacgctcgacctgggcgccgacaggctgagcccgaccgacagttcggcggtgagcggcaagacggtggacgagggcagctacacggtgacggtggtcgccaacggcgccaccgacgccggggacgcggccgcgccgaccgtggtgagcagcggcgcgacgttcaccgtcgcaccctactga

SEQ ID NO: 4560 - DNA, 1194 bp, Actinoplanes utahensis
atgagacgcgcactgggcctggccgccgtgatcaccaccgggttggtgctgggcgccgccaccccggcctcggccgccgcggtgggcctgacactgagcagcaactacgggccgggcgggatcatcaagacgctgatcggcacggtcccgtcgacggtgaccggcgtgacgttcgcggccggggtcaaaccggtggtccagttccagtactcgacctgcagcatccacgcgagcgccatcacccagatcacctcgaccaacggcaccgcgaccaccgcgggagtgcagacggtcgacccggcgaaggtcacccggatctccgggtcgaagatcgccttccagataccgaccgggtcgtaccccgccggcaacaacctcaacaccagcggggtcgtgctggtcaacgggcagaccgcggcccggtggaacatctgtgtctacgacaccgactcggccctgaccagcacgctgctggccaccgcgcagtacacgctgtcgctcaagccgaccatcgccaccatcctgcccgccaccagcccgtccgccggcggccagacgatcacggtgaacgggaccgggttcaccggcgtcgccccgatcaccggatcgatcggcggggtaccgctgagcaacatccgggcggcgacgaccggaaccagcctcaccgcggtcaccggcgcgcacgccgcgggccccggcatggtggtcaccatcaacgcgcccggaggcacggtgaccagcgcggacccgaacggtgacggcagcaccggcgacgcgatcgacttcacctacagcaacgggatcaccgtgtcaccgcacaccgcgagccggggctcggtggtgaccgtggacatcaccggcgccggcttctcggtgcccaccttcgaaccctcgatcggcacgccgggcagtggcaacgcgcacatcttcctggtcaacggggcgtacgactcgtccagcaaccggggcgtcgccgaatgcaccggggtgaccgtggtcagcgacaacgaactggtctgcaccctcgacctgtcgatcaacgccctggacccgcagaacagcaacctgaccggcgcaccggtgcccgacggggcgtacatcatgacctgggtcgcggacgggacgcagggctcgaccggcgccaacccgtcgatcatcagcagcggatcggacttcgtggtcgcgccctactag

SEQ ID NO: 4561 - DNA, 2025 bp, Actinoplanes utahensis
atgaaggttgttctgcgccggtacgccgtcggagctgtcgccgccgccgcggtcgctggagtcgccgcgttcgcgctgccgaccggaaccgtcggatggacgccggtcacgtacggcctgcaccagaccgccgaccagctgctgcccgccaccgtcaccgcggagcagccggcccgggtggtcggcaccaccatcgaccgcaacggcaagccggtcgtcacggtccgggaggcgaccacccgcgacggcgccgcgaagctcgtcgaacaggcgcagaaggcggagaacgcggtcggcgtcgagatcgacgccaaggccgtcgcgctggacgcggtcaccggcggcgacctctaccgcccgcagcagtgggacctggccaggatgcgcgccaccgacgcctggcccacgtcgaccggcgccggggtgaccgtcgcggtgatcgacaccggggtggacgcgagcaacgtcgacctgaccggcaaggtgctgaccggatgggacgcggtcgccgacaagccgggcggcaacaccgaccagaacgggcacggcacccacgtggccggcaccatcggcgcggtcaccgggaacaccgtcggcgtctcctcggtcgcgccggacaccaggatcctgccggtgaaggtgctcggtgcggacggcagcggctacatgtcggacaccgccgagggcatcatctgggccgcggacaacggcgcccaggtgatcaacatgtcgctcgggtcgacgtcgcaggtgggcgcggtcagcaatgcgatcgcgtacgcccgcagcaagggcgtcacggtggtggccgcggccggcaacgagcgggccaacggcagcccggtcagctacccgggtgcggacgccggggtgatcgcggtcgccgccaccgactcggcggacaacgtggcgagctactccaacgccggcggctatgtggacgtggcggcgcccgggtcggcgattctgagcacctacccgtcggcgctgggccgcagctacgcgacgatgagcgggacgtcgatggcgtcgccgcacgtggcggggctggtggcgctgctcaagtcggtgaacggcgggttgacgccggaccagctcgagcaggcgctggagacgtccgccgtcgacctcgggacgccgggccgggacgacgattacgggtacggccgggtggacgccgtggcggcgctggcggcggtgacggcggccccgtcgtccgctccgacgtccgcgcccacgtccgctccgacctcggcgcccacctcggctccgacttctgcgcccacctcggctccgacctcggctccgacgtccgcgcccacgtcggctccgacctcggctccgacttctgtgcccacctcggctcctgtctccaaggcgccgacggctgctccgaccaccgcgccgacctccaaggcgcccacggcttccccgacgaccgcgcccacctccaaggcgccgacggccgcgccgtcgcccaccgtggccaaggccaagccggtgatcgtggcgaacccggcccgggccgacgtcaactacggcaccaccaacgtcaccacgttcacggtgaccgcggcggggcagccgtgggtgaagaagaacgcccagctctgcgtcgccgaaagcggcaaggcgttccagtgtgtcgacgtggtcacctcggccaccggcacggtcaccgccaaccgggtcgcgaccgccggctaccagctcgaactgcggatcgcggcgacgaccgcgaacgaggccgccaccggcgccgccgcctacaccgtgcacagctcggcgtacgcggtccgcaccggcacccggaccatgagcgtcagtctcgcctcgccggccggcctgaacgtcgaggtgcagcagctgatcggcggcagctggaagaaggtcctccagttcgccagcaacgccaccaccaccaaggccacggtcagcggcctcaccaccggccagcagtaccgcgtcgtcgttccgaccaccggctcgatcaccggcagcaccagcagcatcgtcgtcgcctga

SEQ ID NO: 4562 - DNA, 729 bp, Actinoplanes utahensis
atgagcgacgacgaccgccccgaccgcacgcgtgggggcagcgtctacgcctcggaggcggccaccgcgccacaccgtcgcggcctccagcgtcggcagacggcgatcggcatcgccggcgcgatcgcggtgctcgtcggctccggtttcatcgtgacccagctgatggacgcccggcaggacacgctgcccgaaccggcggcgctggcaccgctgaccacggcggcgacgccgggcatggagggcaccggcgtctccgccgtaccgggaaatctgcgggccccgcgcacgacgcacccggcggaggccgccaagcgcgccccgtcacccaccccgatgagcctccccgaggagccgggcgcgtcggcgccctatgcgccgtcgtcgatggcggtcgcccagcaggggcagcaggcgccggtcatccgccgggtcgaaacggtgcataacggcaccgttcgcatctccaccgcccgcgcggatctcaccggccgcggcgatctgcaactcgcggccgacaccggcttcgccgccggcgacggcatccgctgcaccaaccgcgtccgcttcagcccggacgaacccgccaccacccgcgagtacctgctgctctgctggcgtacctcggaccgccgcagcgtgatcacgatggcggtcgccgcccacggcgccccgacccccgccgacagcgccaagatcattatccgcgaatgggattcgctgggatga

SEQ ID NO: 4563 - DNA, 222 bp, Actinoplanes utahensis
gtgaccgagggcacggagcaccttcccgcccgtccgtcctgggactgccgggtctgcgcgcagccgtggccgtgcccgccggcgcgggagacgctcggacgggggcacaatcggatggatctcgccgtcaagatgtgggactacctggaagaggccgcgcgggacatgccgcaggtgccggcgccggagctcttcgaccgcttcctgcgctggacgcagtga

SEQ ID NO: 4564 - DNA, 549 bp, Actinoplanes utahensis
atgcttttccgccgtatccccgcgatgctcggcctggccgggctgctggttctcccggccaccgccgcgcaggccgccgcctccgagtcggacgccgccttcctaaaggccgctcaccaggtcaacctcgccgagatcgcggccggccggatcgcctggaccaagaccaccgacccgacggtgaaggaactggccgccaccttcctacgcgaccacatccggatggacgccgacctctacctgacggcccgtgagctgcgcgtgttcctgcccgccgaccccaccgaagagcagcaggccctggctcaccggtacgaggtggccggcaccgacacgttcgacgagtactacatcaccacccagctggccgggcaccgcgcggccctgcgactggcctccgacgaggccgccaacggctccgacgagtcggtgaaggcgcttgccgcgaaagccgtcccggtgatcaggcatcacgcggagcagctccgggacgcggcggttgcggcggggctggccggctacctcggtggtggcggccgccccagctga

SEQ ID NO: 4565 - DNA, 201 bp, Actinoplanes utahensis
atggcgaagaccggcctggaccgggacgcgtcaccggccgaccgcgccgtcggcgccctgctgggactcgttctgagccgaccggtcgacgaggcggtgaccccgatcctctatgccgcgaccgacaccgcggcgcccaccggctgccacatcggccccggccggccgttccgcccccgcggccgaccttcgagaggctga

SEQ ID NO: 4566 - DNA, 1260 bp, Actinoplanes utahensis
gtgagggcacaggcgggcgagcacgtcgaaccgggcgcgccgatggctgacgagaccacgtcgaccacggagagcaccgccggggcggcgcgggagcggatgcggcggtggcggctggtgctgggtggggcggcggaggagtcgctcggcaaggcggaggggcgggacggggcggtcgacggggcgctggcggcgctctacgactccggcggggacggggacgggaccggcagcaagcggtccgcggggctgggcgggtcggcgccgcgggtcgcgcggtggctcggcgacatccgggagtactttccgggcaccgtcgtgcaggtgatgcaggcggacgcgatcgagcggctcgacctgacccgactgctgctggagccggagatgctggcggcggtcgagccggacgtgcacctggtcggcacgctgctctcgctgaacaaggtgatgcccgacgccaccaaggacgccgcccggcaggtggtccggtcggtggtcgagcaactggagaaacggatcgcccagcagacccgggccgcggtctccggggcgctgaaccgggccgcccggatcaaccggccgcggcaggccgacatcgactgggaccggaccatccgggcgaacctcaagcactaccaggccgagcatcggacggtcatcccggaacggttgatcggttacgggcggcggagcagcgcggtgcaccgtgacgtggtgctctgcgtggaccagtccgggtcgatggcgtcctcggtggtgttcgccggggtgttcgcggcggtgctggcgtcgatgcggtcactgcggacgtcactcgtcgtcttcgacacggccgtggtggacctcaccgatcagctcagcgacccggtcgaggtgctgttcgggactcagctgggcggcgggacggacatcaaccgggctgtggcgtacagccagcaattgatctcccggccgcgggacagcatcttcgtgctgatcagcgacctgtacgagggtggtgtccgggacgagatgctgcgccgggtggcggagatgaccgccgccggggtgcaggtggtggcgctgctggcgctctccgacgagggcgcgccggcctacgatcacgagaacgcggcggccctggcggcgctgggtgtgccggcgttcgcgtgcacgcccgacgcattccccgagctgatggcggcggccatcgaacgccgcgacctgaccgcgttcgccgaacgcttcgccgaccgcaaagccaccggagccgccctgtga

SEQ ID NO: 4567 - DNA, 327 bp, Actinoplanes utahensis
atgagccagagttctgaggacgccgagctgttttcccactcggccgagcagccggcgggcggggagacgcctgcgctgccgacgatgctgcagttctcgcatccgacgcaggaggcggtgatcggctccgcctcgcacgcggccgagccggcggggcggctgttctcccacccgggtccggcgcggggcgcgacggagttcgatgagatgtccggttgggcgggccaggccggcggcgggcgtggcggcaaccggagcggaaaccgggaccgcggcccgggtggacggggcaccggaggacgcggcgccggcggactagctagctag

SEQ ID NO: 4568 - DNA, 2295 bp, Actinoplanes utahensis
atgcctgagaggttctacggcatccggcaccacgggcccggctcggcccgggcggtggtgcgggagctgacggcgcaacagccgacggtgctgctcgtggagggcccgccggaggctgacgagctggtgcgctgggtggccggcagcgacctggagccgccggtcgcgctgctgggctatgcggtggacgatccggggcgggccgcgttctggccgttcgcggtcttctcgccggagtggcaggcgatccggtgggcggtggacaacgaggtgccggtccgcttcttcgacctgccctacgcgtatcgggtcggcgacgaagacggtggtcccgccccggccgaggcttccccgcgggtcggcgattctcccccggtcgagggtgaccagccgtcccgtggggacggcgacgctgaggccggcggcgacatggaccggacggccgcgcccggacggccggtggatccgatcggtgagctggccgccgcggcggggtatgacgatccggagcgctggtgggaggacgtggtcgagcatcgcgggatgccggctttcgaggcgatcgcggaagcaatgacggcgatccgggaaggcgccgcggaggatcccgaggaccttccgcgggaggcctacatgcgcacggtcctgcgggaggtccggcgcaagcacgacaacatcgcggtcgtctgcggggcgtggcacgtcccggcgctgacccggaaggtgccggccaaggatgacaacgcgctgctcaagggccggcgcaagggcaaggtcgcgttcacctgggtgccctggacgtatggtcggctggcctcctggtccgggtacggcgccggggtcggttccccggggtggtatcaccacctgttcaccagcgcggactcggtcgtgccgcggtggctggtggacgccgccggcgtgctgcgcgccgagggtgtccccacctcctcggcgcacgtgatcgaggcgacccggctggccgaggcgctcgccgcgctgcgggggcggccgctggccgggctggccgaggtgaccgaggccgccgaggcggtgatgtgcgacggggagccgctgcgcacggctctgatcaatcggcggctggtggtcggcgagcggctcggctcggtgccggacgagatgccggccgttccgctggctcgggacttggccgcccagcagcggagcctgcggctcaaacccgaagccaccgaacgggagctgagactcgacctgcgcaaggagatcgacctgcggcgcagccggctcctgcaccggttgcggaccctggccgtgccgtggggcgagccggctcccgggcgccgcgggacgggcaccttccgcgaggaatgggtgctgcggtggcagccggagttcgcggtgcggctcgtcgagggcagcatgtggggcaccacggtggccgccgcggcgaccgcccgggtgacccggcgggcgagcacggcgcagacgctggccgaggtgaccgcgctgctggaaacgtgcctgctggccgatctccgggatgcgtatccgcgggttctcaccgcgctggacacccgcgccgcgctggacgccgacattcaccacctgatggcggcgctccccgccctggcccggacgctgcggtacggcgatgtgcggcgcaccgacgtcggcggtctcgcgacggtcaccgccagtctgctgaaacggatctgcgccggactgccgtcggcggccggttcgctctccgacgaggcggccaggcagctgcgggacggcgtggacggcgttcatcaggcggtcggcctgctcgccgacgacgatctgcgagaattgtggctggtgaccctggagtcgctggcccgccggccggacctgcacgggttgccggccgggcgactgacccggctgctgctggacgctgaccggctggatgccggcgaggtccgccgccgtctgcggctgccgctgaccgccgggacaccaccggcgcacggggccgcctgggtggaggggttcctggccggcggcgggctgctgctggtgcacgacgatgcgctgctcacgctggtcgacgagtggctcgccgacgtgccggcggaggggttcgatgatgtgttgccgctgctgaggcgtaccttcgggacattcgacgcgggcgagcggcgggcgatcggtgagcgggtggccggtccgcgggccggagcggcgcaggccgcagccgtgacgatcgacgagaaacgggcagtgtccgtgctgcccgtgctgggtgccctgctggggcgcgagatccgggtccgggaggacgcatga

SEQ ID NO: 4569 - DNA, 1140 bp, Actinoplanes utahensis
atgtcgtaccccggcggtagtttgcagttcgagccagctatcgggcgggccggtgggcccggagactcaggagttcgagtgaccgctcttcgaccgcacgccgaggatcagtatgccgacgagctgacccggctggccgccgccgacgaccgaccccgcccgcccgggtggcggttgtcgccccaggccgtggtgacctatctgctcggcgacggcgccaagatcaccccgaagtatgtggggccgcgccgcctgatcgaggtcgccgtctccaccctcgccaccgatcgggcgctgctcctgctgggcgttcccggcaccgccaagacctgggtctccgagcatctggccgccgccatctccggcgactccacgctgctggtgcagggcaccgccggcaccgccgaggaggccatccggtacgggtggaactatgcccgtctgctcgccgagggcccgaccgccgcggcgctggtgccgagcccgatcatgcgggccatgcggggtggctccatcgcccggctggaggagctcacccgcgtcccgtccgacgtgcaggacgctctgatcaccatcctctcggagaagacgctgccgatcccggagctgggcgacgaggtgcaggcgcagcgcggcttcaacctgatcgccaccgccaacgacagggaccgcggggtgaacgagttgtccagcgccctgcggcggcggttcaacacggtggtgctgccggttccggccaacgccgacgacgaagtcgagatcgtggcgcgccgggtggcgcagctcggccggtcgctggagctgcccgaggtgccggccgcgctcgacgagatccggcgggtggtcaccgtgttccgcgagctgcggagcgggctgaccgaggacggccgcaccaagctcaagtcgccgaccggtacgctctccaccgccgaggcgatctcggtgatcaccaacgggatggcgctggccgcccacttcggcgacggcaccctgcacccgggcgacgtcgcggccggcatcgtcggcgcggtgatcaaggaccccgtctccgacaccgtcgtctggcgggaatacctggagaccgtggtccgggagcggtccgactggctcgatttctaccgggccgcgcgcgatgcctga

SEQ ID NO: 4570 - DNA, 990 bp, Actinoplanes utahensis
gtggtcgactggacgaccgcgaccggcaccgagcggctgggacacctgatcaccctgcgccggtccgagccggcgcacgcgcggcggctggtggagagcacctggggcgccgactcctcggagaaccgcgcccggttcctcggcgccttcaccgacgggctgtccctcgacgacgaggagctgctggagcgggccctcgacgaccggcgcaaggaggtccggcagaccgccgtcgacctgctccgccgcctgcccggggcggcactcggcgagcggatgcgcgaccgggcgcacgccgcggtgcgcctggccgccgactctgcgcggctcctggtgacgccgccggccgagctggacgccgggctgcgacgtgacggggtgagcgcgaccccggcccacggcaccggggtcggcgcctggctgctggaggaggtggtcgccgggactccgctcacctcgtgggccgccctggagccgaccggttacctcgcgctggcccggggaaacgactgggtgacgccgctgctgcacggctgggccaaggccgccatcacccagggcgacgcccgctgggctgcggcgctgctggccggcgactccggcatgctgcgcgagggggttcgctgggaactgcacctggtgctcccgtccgacacattggcccggctggccgccgaggcgctgcgtgccgaggacgccgcggcgcaccgactgctggcactgcatcccgggccgtggccggaaccactgagcgtgacggtgctggagacgattctgcgccgggcgcgtcacgaccggcacacctggcagctcggcgagctgtgccggaccgccgcgctcgccatgcccccggcgtatgcggatctcgccggccggctggccgctcagctggagccggaggtggacccgagccgggtgcggccgatcgccgacctggcgcggacgctggcgttccgtgaggagatgctgcgcgagttgagcgagccgtga

SEQ ID NO: 4571 - DNA, 300 bp, Actinoplanes utahensis
gtgcccgccgaacgatggtccatcgcccaggccgagtcgatcgctcccgacgcctcggcgctcaagcgtgcccgctccgtggccgggcagttcggccccgtcgggctgctcgacgacgtcctctggggactgtgccggggctatcaggtcgccgccgacctgtccggccccgcgttcaagtgctcctgcccgagtttccagacgccctgcaagcatgccgtcggcctggtgctgcgctgggccgaggccggcgccgggcaggatcccgcgcccgactgggtgacccggtggcctagctag

SEQ ID NO: 4572 - DNA, 987 bp, Actinoplanes utahensis
gtgcgcgtcctgctgatcaccgccctcacacccgcggtctggggcaccacctacgcgatcaccacggaattcctgccacccgaccggccgctgctcgccggcgtcctgcgggccctgcccgccggactcctgctgctggcgatcacccggcaactgccgcgcggcgcctggtggtggcggtccgcggtcctcggcgcgctgaacatcgggttcttcttcgcgctgctgttcgtcagcgcctaccgcctgcccggcggcatggcggccgtgctcggggcggtgcagccactactggtcgccgggctgtccacggtcgtgctcggcgaccgcaccacggcccgtaccgtgatcgcgggcctgctcggcgccgccggcgtcgccctcgccgtcctgaccgccgccgcccgcctcgacccgatcggcatcctggccgggctggccggtgccgcgtcgatggccatcggtctggtgctgaccaaacgttggggacggcccggcgtctcgctgctgaccgcgaccgggtggcagctcaccgcgggcggactggtcctgctgccgatcatgctgctcggcgaggggctgccggcgtcactgaccggccggaacctgatgggctacggatacctggcgctgatcggcaccgccctcgcctacaccctgtggttccgcgggctggaccggctgccggccacccgggtctcgctgctcagcctgctctccccggtgaccgcgaccgtgctggggtgggcggcgctgggccaggcgctgacgccggtgcaggtcaccggcatggccctggccttcgccgcggtgctgtggggtcagtcatcgccggatcgcggtcgtcgtcagggggcctcatcgcaggtccgtgtcggtcaccacgcgacgcggcaagccggtgcgggcggcccggagcatcccgcggccgggcgcctcggtggtggtcacccggccgggcgcgaggcggcggagcgccggccttag

SEQ ID NO: 4573 - DNA, 489 bp, Actinoplanes utahensis
atgagggaacccgacggtgtcgatcggatcctggcccagtgggccgtcgagcgccccgacctggaaaccactgcgatgggcgtcttcggccgcatccagcgcatcgcccgcatcgcctcggacgccggcgagcgcgcctacgcggcgtacggcatcggccgccccgaattcgacgtgctcgccaccctgcgtcgctccggagcgcccttccggctgtccccgggcgccctggccgcctcgatgatgctcagcaccggtggcaccaccgcccgcctcgaccgtctggagaaggccggcctggtcgcccggtcacccgacccggacgaccgccgcggcgtcctggtctccctcaccgagcagggtttccaggttgccgaccaggccgtcaccgccggcctcgccgagcagcagcggctcctggcccacctcaccccggcccagcggtcccagctcgccgacctgctgcgagcggtactcagcggagactga

SEQ ID NO: 4574 - DNA, 189 bp, Actinoplanes utahensis
atgacagccggcgaggaccagcgtgatcagcgctacctcaccacccggatcaccgccgacgggcgcgacggccatcccggcgaagccgggcgatgtcggctggtggtgagccgcgcgatcatcgtccgccggctgtgtcgtcccggccggcccggatccgagcgcccggcacaccccgcacggccgtga

SEQ ID NO: 4575 - DNA, 1206 bp, Actinoplanes utahensis
atgtacgccgtcgtcgacctgcagaccaccggcaccaagaccacctggcacgaccggatcgtggagatcgcgatcgtgcggctggacgagaccggcaaggttctcgacgaatggtgcaccctcgtcaatccggaccgggatctcggcccgcaggagctgcacgggatcagcggcgccgaggcccgccgcgcgccggtcttcgccgagctggccggtcagatcgccgagcggctggccggacgtctgatcgtcgcgcacaatctgctcttcgacgccggcttcctcaccgccgagttcggcaagctgggtgtcgccgtgccggtcgacgacgagcgcggtctgtgcaccatgcgcctggccggacatttcctgccgaccgcgtcgcggagcctggcggcgtgccgggccgccgccggactaggtccgcaccgcgaacagtccgcgttgcacggcgcccgggccgccggcgagctgctcggttactacctggagcgggcgggtgatccgccaccctgggccgagctgctggacagtgcccggcaggccgactggccgcggctgagagtgaccacggtcgccgccgtcccgcgtcgccgtcccgaggagcgcgagccgcacttcctcacccggctcgtcgaccgcctgccccgccagctcgacccgaaggccgacgcttacctggcgctgctcgacggtgtgctgctggatcggcacatctcggcgagcgaggccgatcagctggtcgcgatcgccgccaggatcgggctgtcccgggccgacgccgagctgctgcaccaccgctacctgtgtgggctggccacggtagcgctcgccgatcagatcctcaccccggccgaacgcctcgacctggacggcgtcgccgagcttctcggtctcacctcggccgacgtcgaccgggcgctcgccgaaccggccgctcaggtcacccggtggcagctcaccccgggtgaccaggtcgtcttcaccggtgacctgcacccgccgcgcgagcatctcgaggtggacgcgctgacccacggtctgcggaccgcgcggaaagtcaccaaacagacgcgactgctggtggcggccgatccggattcgctctccggggtggccaagctcgcccggcagtacggcattccgatcgtcaccccggcggcctacaagacgatgctcgaggcgttgctctccgcgcagcgttga

SEQ ID NO: 4576 - DNA, 693 bp, Actinoplanes utahensis
gtggcggtgagcgatgcgtcgaaggggctcgtcctggtcgtcgaggatgagcggccgatcgccgacctggtccggctctatctgagccgggagggattcggggtgcaggtcgagcacgacggcgccgcggggctggcggcggcgcggcggctgcggccggtggcgtgcatcctggacatcgcgctgcccgggatggacgggacggagatctgccgccgactgcgcgccgacggcgactggacgccggtgatcttcctgaccgcgcgggacgacgaggtcgaccggatcctcggccttgagctgggtggggacgactacgtcaccaagccgttcagcccgcgtgagctggtcacccgggtcaaggcgctgctgcggcgggccgccgggccgccggaggaggacggcgtgcgccgactgggcccggtcgcgctcgaccggagccgccgcgcggccaccgtggacgggcaggcggtgacgctgaccgcgaccgagtttgatctgctcgcgcacctgctcggccggcccgggcgggtgttcacccgggaggagctgctggccgcggtctggggctacgcctcgcacgccggcacccgcacggtggacgtgcacgtggcccaggtccgggccaagctcggcggcgcggccggcctgatccgcacggtccgcggcgtgggctacaccgccgatgcgtga

SEQ ID NO: 4577 - DNA, 1458 bp, Actinoplanes utahensis
gtggcatccggtggtggcgggccagggtggttcggacaggtggcgtccggtggcggcgggcaggtgccggtgggtcggatcggggcggcggggatgcgtgagttcctccggacgctgaccgggcgggcggtcctggtcaccgtggccacggcggtggtttcggtgatcgtgaccgcgctggtcgccgtgccggtggcgatgcggtccacgaacacgcaggtgcgcgccgagctggtggagaagtcggcgatcgccgtcgagctgctcaccgacgagaaaccggccgcccgggaacggatcgcgaatcgtctgcgagccgacgacatcgagatctacctgatcaggcgtggtgtgccggatcgcgccgggctgccgccccgggtgatcgcccagatcagcggcggcgccctggtcgacgcggccggccgggtcggcgggcggccctcgttcatcgccgggcggccgctgaccggggtggacgccggggtggtgctgacccgaccggccgcgtcggggctggcgctgcgggtgctgggcagcgtctggtgggcgctgctggccggcctggtcggtggggcgctctccggtgcgctgctggcccggttcgtgacccggccgatcgagctggccgcggcggcggccgggcggctcgccgcgggggaccggtcggtgcggatcgcgcggcacggtccggccgaggcggtgcggctcgccgaggcggtcaatcagctggccgcggccctgcagaccagcgagggccgggaacgcgacttcctgctgtcggtctcccacgagctgcgaacgccgttgtccaccatccgcggctatgccgaggcgatcgccgacggggtggtcgccgcggacggcgcgccacaggccggggcgaccatgctggccgaggcggaccggctcgaccggctcatctccgacctgctggtgctgtcccgcctggaggcggccgacctgcccctggacgtggtccgggttgatgtggtcgagctgatccgggaggccggccgggcgtggtccgcgcgctgcgcggccgacgggccggcgctgtcggtggagctgccggacgccccggttatcgtcgcgacggacccggggcggatccggcaggtcctggacggcctctgcgagaacgcgctccgggtggtcccggccggtgcgccgctcgtcctggcggtccacgcgggcgggtccggtgcagtggtcgaggtgcgtgacggcggccccgggttcaccgacgacgacctcgcggtggcgttcgagcggggggcgctgaaccggcgctaccgggggatccgcaaggtcggcagcgggttggggctggcgctggcggcgcggctggtcgcccggctcggcgggcggatcacggctgggcacgccccggagggaggtgcgatgttcacggtcgagctgcccgacgagccggccgaccccggcacgctgcgatga

SEQ ID NO: 4578 - DNA, 771 bp, Actinoplanes utahensis
atgacccagcccatctgggggcccgtgcacgccgagatgtccgcgatcctgcaggagcacccggacgacgtgcccgccgtcgtcgaccagctcaccaagttgcaggacgttctctgccaggtgccgccgctgctcggtggtaacccgctggccgatttcaacaggctctacctggcgatcaccgagaacgtgctggaccggctgtatgcgggcaggttcaaggatccggcgttcctgtcccggctggacgtggagttcgccgcccggtacttcgacgccctgcgctactggacccacggcagcccggcctgccccggggcgtgggccggcctgttctcccgggtccccgggccgggcccccgcctgctgccgtccgcggtcgccggcgtcaacgcgcatgtcaacttcgacctgccgttcgcgctggtcacgacgttcgaccacctgggctccggcccggtcgacgacagcgaccagcaccacgactacctgcaggtcaacgacatcttcgccgaggagatcccgggcctgcgccgcggctatctcgaccgctggcagctgctcatcgacacgatgaacggcgacctcgacgactggtggcagggcgaaatggtggaatacacccgcaacgtcgcctggcgcaacgcccagaagatctgggcgctccggcacgaccagaccgccctggacaaggagcgccgccacctggaccgcacggccaccgggctgggcaaattgctcctgtccccgttcgccgacttcctgcagtag

SEQ ID NO: 4579 - DNA, 3303 bp, Actinoplanes utahensis
gtgccggccggccaggaggcgccccctcaacgcctgctggaccgacaggcccgcgcgcacggccgcggcggccgccgccggctcgaagccgtccacgccggtgccgaacaccgccatcaccgcgtctcccacgtacttctcgacgatgcccccgcagtcgcggaccgcgtgggcgacgaccgagaagtagtcccgttgcaacgcccgcacctccgcacagtccagccggtccaccagcgaggtgaacccgacgatgtcgacgaacagcacggtcacggtctggcgccgctcctgaccggcgacggtgatggtggtcatgtctcacgctccccagatcactgcgttgaccgggagtacggtgccagccgcgctccccctgcggatccgcagaacgacgtatctctgacagcatcaacgctcgtcatttttgtgacgcagaacagtccgaaccgacgacatggcggtaagggatttcgcattaggctgccggtcatggccagccagggggacgacgggccgcttgtcgggcgcaccggcacgctggccgacatacagtcctacctgcgcaacgcgggtcccggcgggacagccgcggtcttcgtgaccggggagagcggcgtcggcaagagccggctgctgcgggagaccgccgacgcgctgcgcggtgggggattcgcggtgctcttcggcacctgcctggacatcggcgacgcgtcaccgctgcacccggtgctgcaggcgctgcgccggcacgacagcgcgccggccaccggcgccggcggcccgggtgcgctgctcgaccgggtctcgcaagacctgcgcgcgattgccggggaccagcggctgctgctggtcctcgacgacctgcagtgggccgaccggagcacccgccagctgctgctctacctgctggccggcctgggtgacgtgcgcgtctcggtgctcgccgcgatccgcgccgaggccctgcacggcacccacccgctgcgccgggtgctggccgagctgcgccggttgcgctcggtccgggtggtcgacctggccccgctcgaccacgagcagacccgcgaactggtcaccgcgatcgccggcgacggggtgaccggcgaggacgccgatcgggtgcacaagcgcagcggcggcaacccgttcgtggtcgaggagctggcccgggatctgcgtgacggccgggtcgagctgtccgacacactgcgggagatcttcctggcccgggtcgacgaactgccgccgaacgcgcacgcggtggtgcacgcgctggccgccggggtcgagccggtcgagcacgcggtgctgtcccgggtggtccgcctgcccgaggacgagctgctggaggcgatccgcgccgcggtggcgtaccggttcgtggtcggcgacggcgacggttaccggctgcggcaccggctggtcgccgaggtgctggagcaggaggtgctgccggccgaggcggccgccctgcaccggcggtacgccgagtccctccaggcctgcccgaacggcccggatcacgcccgtctggcccaccactggcagcgtgcggggttgccgtcccgggcactgccgtcggtggtcgccgcggcccgctccgcggagagtctgtacgggttcgccgaggcgcaccggcactggaccctggccctgcggctgatcgacgacgacgccgcggaccgcaccgagctgctcgggcacgccgccgagtcggcccaccagtgcggcgagcaccagctggcgctgacccggctggcggagctggccggccgcaaggacgcccccgtcgagggcgagctgcacctgcgtcgcgcgcggtatctcgccgccgccggccgctcggagcccgccgagcgggagtacgagctggccctggagtccccggactgctccccccggctgcgcgccaccgccgccgccttcctcgccgagctgctgctgcacctggggcggtacgccgacgccaaccggcacgcccgggaggcgctggagctggccgcgatcaacggcgccaccgccgatctggtccgggccagcgccgcgctgggcttcagcgccgcgttccgggaggacccggacgccggcctggcggtgatccggcacgccgtggagatcgccgagcgatccggtcacccggacgacctgggcgtggcctacctgcacctggccgagctgctcaccggcccgttgaacagcatcgaggagggcgtgctggtggcccgccggggcgccgagcggctggccgaccgcggcgccggccgcacgtatcagacgcggctgctcgcgatcgccggcaacggactgttcagaatcggtcagtggacggaggccgacgcggtcctcgagcaggccatgcggcaccgcccgtccggggccgacgcggtcgagctgctgctcgcccgcagccgcctgtgggtcggtttcggcgaggtcgacaacgcccggcgggacctggacgcggccgccaccctgctggccggcggcggcgcccggcatgtgctgccgatgctcaccctgcgggccggcctggcgatgtggcagaaggagcacgccgacgcccgggccgcggtgcagcgcggcctcaccgagacccgctcggatgacctggtgctgctcggcgtgctggcctggcacggcctgcgggccgaggcggaggcgcacgccgccggctcgccggtcgacccgggcgcgctgcgccggctgaagaccgtggtgacgcgcctggaggcgggggcgaacgcggccgctcccgaggtccgtgcggtgctcgacggctacctctacctgtccgcggccgagctgagccgggtcgaggaccggcaggatcccgagccctgggcgcggtcggccgccctgtgggaccgccgccagcagccctatccggcggcgtactcgcggctgcggcacgccgaggtggcgctggcccgccggtcgcggcggacggcggcgatcaacgggctgcgccaggcgtacacgacggcgatcgcgatgggcgcccgcccgctggcgaacgagatcaaggcggtggcgcagcggttccgggtcgccctctcggacgacgcggacaccgtgccgatcgcgccgcccgagtcggatcccggcgatgagctggccattctcaccggacgtgagcgtgaggtgctggccgccgtggcggagggattgacgaaccgggagatcggtgagttgctgttcatcagcgaacgcaccgtcggcgtccacctgggccacatcttcgacaagctccaggtgcgtacccgcgtacaggccagccgggtttttcttaccgcagcctga

SEQ ID NO: 4580 - DNA, 2058 bp, Actinoplanes utahensis
gtgaccgcacagccagagaccttgtacggggctgctgacctcacgcacctggaggggctggacgctgtccggaaacgcccagggatgtacatcgggtccaccgacagccgggggatcaaccacctggccaacgagatcatcgacaactgcaccgacgagggcgtcggcgggcacgccacccggatcgccatcacgttgcacaccgacgggtcggtccaggtcgacgacgacggtcggggcatcccgaccgacgtgcacgccaagagcgggctgagcggcgtcgagctggtgctcacccggctgcacgccggcggcaagttcggcggctccggctacaaggcgtccggcggtctgcacggcgtcggcgcctccgcggtcaacgcgctgtcactgcgcttcgacgtcaccgtcaagcgggacggcaaggtccacgagatctccttccagcgcggcgtgcccggcgtcttcgacggcccggggccgcaggcgtcgttcaccccgcaggccggtctgcggatcgcccgccggatgaaacgcggcgagcccaccggcacctcgatccggtactggtacgacgcgcggtatttcgagaccggcgcccgactcgacgtcgaagcggtccgcaccaagctgcgcaacaccgcgttcctggtccccggcgtgcagtattcgctgttcgacgcgaccgccgaggagccgcacaccgagaccttccactaccccaacggcctggtcgacatggtggagttcatgactccggccgccgacaagccggtctccgggatcctggtcgtcaccggcgaggggacgtacaaggagaatgccgccgacgccaacggcgtcatgcagtcgaacgtcgtgcggcacgctcaggtcgagatcgccttccgctggggtacggggtatgagcggtccgtggagtgcttcaccaacacgatccgcaacgtgcacggcggcacccaccgcaaaggcttcgagcgggctctggtccgtgcgctgaccgaggccatccgcaacgcacgtggcctgctcaagcccaaggaggagccgcccgtcctggacgacttcctggagggcatgaccgcggtcatccacgtccgggtgccggagccgcagttcacctcgcagaccaaggacgagctgtccacggccggcgtcacccgggtgatgcagaccctcgtcgagtcgtacctgaaggagtgggtcgacggccggcgcaccaagaccgaggcgcgcaccgtcctgcagaaggtggtcgacgccgcccgggtccgcctcacccagaaacagcagaaggacgcggcccgccgcaagaccgccctggagggcgcgtcgatgccgcccaagctggtcgactgccggtccaccgggatctcccgcagcgagctctacatcgtcgagggggacagcgcgctcggcaccgcgcggatggcccgttcgtcggagtaccaggcgctcctgccgatccgcggcaagatcctcaacgtgcagaaggcgagcctgcagcaggtgctggacaacgccgagtgctcggccatcgtccaggtgctcggcgccggctccgggcgcaccttcgacatcggcgcgatgcggtacggccgggtcatgatcatggccgacgccgacgtcgacggctcgcacatccggacgctgctgatcaccctgttcgcgaagtacatgcgcccggtgatcgaggagggccggctgttcgccgcgatgccgccgctgcacaaggtggtcaccaaggggcgcaacggcgacaccgtctacacgtacacccagcaggagatggagacgaccgtcgcgcgcatcgagcgctccggcaagtccgtgcagaaaccggtgccccggttcaagggcctcggcgagatggacgcggacgagctgtgggacaccacgatgaacccggcttcccgcaccgtccggcggatcacgctggacgacgccgagcgggccgaggccaccctcgaactgctcatgggtgagcgggtcgagccccgcaagaactggctgatcgacgcggcgggccgcatcgatcaggagacgatcgacgcctga

SEQ ID NO: 4581 - DNA, 2526 bp, Actinoplanes utahensis
atggcacgccgcaagacccccgacaaccgcgtcgacctgtccgctttcgaccaggccggcgcccgggtcatcgacaacccgctgaccaccgaggtcgaggactcctacctggagtacgcgtattcggtgatccactccagggccctcccggacgcccgggacggcctcaagccggtgcaccgccgcatcctgtggtcgatgtccgagcagggccaccgccccgaccgcggctacgtgaaatcggcccgcgtcgtcggcgacgtgatgggtaaataccatccgcacggcgacgtcgcgatctacgacgcgctggtccgcctcgcccaggatttctcgctcaacgtcccgctgatcgacgggcacggcaacttcggctcgcccgacgacggcccggccgccgcccggtacaccgaggcccgcatgtcccgtgaggcgatgctgctggtcggcgagctgggcgagggcaccgtcgacttcaagcccacctacgacggcgacgacgtcgaacccaaggtgctgcccgccgccttccccaacctgctggtcaacggcacgtccgggatcgcggtcgggatggcgaccaacatgatcccgcacaacctgggcgaggtggtcgcggccgcccggcacctgatcacccacccggacgccgacctcgacgagctgatgcgcttcgtccccgggcccgacctgcccaccggcggccagctgctcggcctcgacgaggtgcgccgggcgtacgagacgggccgcggcgtggtccggatgcgcgcccgggcacagaccggcccgctggagggcggccgggggcgtcaggccatcacggtcaccgaactgccgtacggcgtcggtgccgaaaagatcatcgaggcgatcaccgacgaggtgaagggcaaactgctcacctccgggccgcggcgcgggcagcggcaggcggcccggttgcagggcatcgccgacgtcaaggacctcaccgaccgcgagcacggcacccgcctggtgatcgagtgcaaggtcggcgtcaacccgcaggcgctgctcgccgacctctaccggctcaccccgctggagacctcgttcggcatcaacaacctggtgctcgtcgacgggcagccgcgcaccctggggctcaaggccctgctggaggtgttcgtccagcaccggtacgacgtggtcacccgccgcaccgagttccgccgcaccaagcggctcgaccggctgcacctggtcgacggcctgctcgtcgcgctgatcgacatcgaccgggtggtcgcgatcatccggggcagcgacgacgcggccgcggccaaggcggccctgatgagcgagttcagcctcagcgacatccaggcgacctacatcctggacaccccgctgcggcggctcacccgcttcgaccggatcgagctggagaccgagcaggaacggctgcgcgccgagatcgccgagctcagccggatcctggacaacgaggacgtgctcaagcaggtcgtctccgacgaactggccgaggtgaccgccgagttcggtcgcccgcgcaacaccacgctgatcgacggcgacctcaaggaggtgctcgccgcgtccgcgccggccggcccgctcgaggtcgccgacgacccgtgccaggtgatcctctccgccaccgggctgatcgcccgcaccgcggcggagagcgaggagtccgccgaggcccgcaaacgcagcggccgggtcaaacacgacgcggtccgggcgatcatccactccaccgcccgcggccggatcctgctgatcaccaaccggggccgcgccttcaagaccgacgtgctgccgctgccggtgctccccgaacagtccggcacggtgtcgctgcgcggcggcatgtccgcgtccgagctggtcccgctggaaaagggggagacggtcgtcggcctggcgccgctgaccaccggcggcgactccccgggcctggcgatgggcacccggcacggcgtcgtcaaggtgtgcgcgccggagtggccggtccgctccgatgaattcgaggtgatcaccctcaaggagggtgacgaggtgctccaggcgacctggctgaccgacggctccgagtccctggtgttcatcacctccgatgcgaacctgctgcggttcccggccaaactggttcgcccgcagggtgtgaagggcggcggcatggccggcgtcaacctgtccggcgaggccgccgtgatctcgttcaacgcggtcgccaccgccgacacgtcgcacggcgagccgatggtcgtcacttccaccggcacccaggtcaaggtctccccgttcgcctcctacccggccaagggccgggccaccggcggcgtccgcgtccagcgcttcctcaagggcgaaaccgccctgacggtcgcctgggtcggtccccgccccgccggctgcagcaccaccggcgacccggtcgaactccccgaaccggacgcccgccgcgacggctccggcgccgcggttctgatgggcccccagctcatcggccaccacatcgaacgcgactga

SEQ ID NO: 4582 - DNA, 207 bp, Actinoplanes utahensis
gtgaccgacgcatgccaccgccgatcaccacccccggccgcagcccacgaggaaatcccccggctgggctgtgccctgctggtcaccccggcccccaccagcgacctccagcccgacgacctcgacaccatcgaagccgatgcccgggtcgcgcggcatcggcggaccaggacgggcaccgcgcctgccttcatcaccacaccctga

SEQ ID NO: 4583 - DNA, 444 bp, Actinoplanes utahensis
gtgcgacgtgatctcctggacctgccggtgctgctgctcggcgcggccaccaccctggtcgacagcatcaacgagggagtccgcgcccgcggcttcacggacctgcgcccggcgcacggcttcgccttcgtccgcctggctccggacggcgccaccgtcatcgagctggccgagcacctgggcgtcaccaagcaggccgccagccagatggccgacgaactggtccgcaagggctacgtcgagcgccacccccaccctcgggacgcccgcgcccgcctccttaccctcaccccccgcggctgggcctgcacccgagcggccgacgaggccgccaccgaggccctccaaccctgggccgacacgctgggcccggcccacctcgccaccgtccgctcggccctcgcccagctcaccacccccggccgcatccgccccacctggtga

SEQ ID NO: 4584 - DNA, 375 bp, Actinoplanes utahensis
atgggaatccatcgccgggatgaaggcgtggaacatcgtctgcacggctcggtcttccggtcctacgtgtcgccgggcagtgggagcgcggagctctgcgcctggcggctgcagatcgccgggggcacggccggggcgcggcaccgggtggatcgcgaggaggtgttcctggtgctggccgggcggcttcaggtctttctggacggcgtggtcgaggagatcggggccggagacgtgctgcgggtgccggtgggcgtggagttcggcgtcgacaacgtgggtgccgagaccgccgaggcctgggtcaccacgagcgtggggctgaaggccacgatggcggacggctcggtgatcagcccgccctgggtccgctga

SEQ ID NO: 4585 - DNA, 945 bp, Actinoplanes utahensis
atggaactacgcgacttcgggcgtctcggccagatcagcgcgctcaccctcggcggcggcggtatcggcgccgtctgggggccgaccgatcggcgcgaggcggtggccaccgtgcacgccgccctcgacgccggcatcaccatgctggacgtggcaccgtcctacggcgccgacttcgaagccgagcgggtggccggcgaggccatccgctccagctcccacccggacgtcctggtcacctccaaggtgggtctgccggacgacaccgaacgggacttcgccgcccggatccgccgcagcctgaccgacagcctgcggcggatcggccgcgaccacctggacgtcttcttcctgcacacccagctgcggaccgccgttcccgcgccgggcacgatcggccgggacggctatctcgaggccgccggcgagttcctccggctccgtgacgaaggtctgatccgggcctggggcatcaccgcggtgggccaccccgaccaggtgatcaccgtactcggcgacaccccgcgcccggacgtcgcccaggtcgtcgtcaacgccctcgacctcaacgccgactggtactttcccggcgtcgcaccccgcagcgacgccatcgtccgctccgcgaacgacaacggggtcgaggtcatggccatccgcgcggtcgcggccggcgcattgacctcctcccttgaccgtacggtgccgtccgcctccccggtcgcgtcagacttcgccgccgccgaaccgttccgcaagctggccgcggaatggggcgcgaccccggccgccctggcccaccgctacgccctgaccgtcccgggcgtgtccacggtgatcctcggcgtcaagaaccgcaccgaactggccgaatgcctggccgccgaggccgcgggcccgctcacccccgccgagctcaccaccatccaggccctgcgcccctga

SEQ ID NO: 4586 - DNA, 201 bp, Actinoplanes utahensis
atgcgtgcaggcgcggtcatcatcgtcatctggctactgctcggcctggtcgcggcgttcgagcggaactatttcaaggacaccggcgacgcgagctgcgcgaaagccggcaccgtcatcgtcaccgtcatcgccggcccgctcaactggctgggcgtcaacccgaagatcaagtgcgaggtgccgccgccgagcaagtga

SEQ ID NO: 4587 - DNA, 939 bp, Actinoplanes utahensis
gtgggcggaaggctatcagcggcgcttcggcctggtcgcggtcgactacgcgacccagcggcggacgccgaaacagagtgcgctgtggttccgggaccgcatacgctccggcgcgtgaccgactatctgacgatcaaccgggcgaactgggacgagcgggccaccccgcacgccgagtcgcccgactaccgggtcgccgacctcgtccgcgacccggcgcacctgagtgacgtggtgcgcttcgacctcccgctgctcggcgacatcaccgggcagcggggcgtgcacctgcagtgccacatcggcaccgacacgctctcgctgtcccgtcgcggcgcccggatgaccggtctcgacttctccggcgaatcgctgcggcacgcccgcgccctggccaccgcggcgcacgcggacatcgactacgtgcagagcgacgtgtactcggcgcgggacgcgctcggcggcgggttcgacctcgtctacaccgggatcggcgcgctcggctggctgcccgacatccgacgctgggcgtccactgtggcctccttgctggtgcccggcgggcggctgttcctgcgcgagggccacccgatgctgtggaccctcgactacgaccgcgaggacgacgtgctcgccatcgtcgaaccgtacttcgaacagaccgagcccctggtgtacgacgaaccgggcacctacgtcgccaccgaccaccggttcgtgcacaccgtgacgcacgagtggaaccacgggctcggcgagatcgtcagcgcggtcctcgacgccgggctcaccctgaccggactggtcgaacaccgcagcgtgccgtggaatgcgctgccccgccggatgcgtcggctcgacggcggcgagtggcagctgaccgaacgacccgagcggctgccgcacacgtacaccctgcaggcccgccgtcccgtttag

SEQ ID NO: 4588 - DNA, 1317 bp, Actinoplanes utahensis
gtgacattcatctggggcgtggccacctcggcctaccagatcgagggcgccgccgccgaggacggccgcacaccgtccatctgggacaccttcagccaccgggtcgtcggcgagcacggtgacgtcgcctgcgaccactaccatcggatgcccgacgacgtacagctgatcaaaagcctcggcgtcgacgcctaccgcttctcgatctcctggccgcgggtgcagccgggcgggcgcggcccggccaaccaggccggcctgtccttctacgaccggctggtggacgagctgctggcgaacggcatcgacccgtgggtcacgctctaccactgggacctgccgcaggagctcgaggacgccggtggatggccgcaccgggacacggcgtaccgcctcgccgatttcgccggtctggtcctcgaccgcctcggcgaccgggtccgcgactggcagacgatcaacgagccgtggtgcgtggcctacctcggctaccagcacggcgtgcacgccccggggcgacgcgactacggcgccgccctggacgccacccaccacctgttgctcgcgcacggcctggcgtacgaagtcctgaaaagacccgacaacacggtcgggatcgcgctgaacctgggcaccgccacccccgcctcggacgacccgctcgacgtcgcggcggcccggcgcgccgacgccggcgccaatcggatcttcctggacccgctggtcttcggccgctacccggacgatctgctggccgacctcgcggcgcgcgggcacaccctgccgatccgcgacggcgacctgcggatcatcggccggaaaccggacgtgctcggcgtcaactactacttcggacaggacttcgccggccgcgacgaggacggcaacacgcacgacgcggacggccacccgatcgtccgggagatcaccccggacgtgccgaagaccgcgatgggctgggcggtcaccccggaccggttcaccacgctgctgctgcgcctgcaccacgaatacgggctggcgctggcggtcaccgagaacggcgcggtctacgacgacgtgcccggcccggacggattcgtcgctgatcaggaacggacggcgtatctggagtcgcacatcgcggccaccctcgcggcgcgggcgcgcggtgccgacgtacgcggctatttcgcctggtccctgctggacaacttcgagtgggcggaaggctatcagcggcgcttcggcctggtcgcggtcgactacgcgacccagcggcggacgccgaaacagagtgcgctgtggttccgggaccgcatacgctccggcgcgtga

SEQ ID NO: 4589 - DNA, 1008 bp, Actinoplanes utahensis
gtgaacgagccggtgcttgagatcaagaacctgaatgtcgggtacgggctgggcgaccaggccgtccgcgcggtgcgcgacgtcaacctgaccctgcaccgcggtgaggtgctcgggctggccggcgagagcggctcgggcaagtccaccctggcgtacgggatgacccggctgctgccgccgcccggcgtgatcaccggcggtcaggtgatctaccaccccgagcagggcgaggcgttcgacgtgctcggcctctccgaccgggacctgcgcggcttccgctggtcggagacggcgatcgtgttccagggcgcgatgaactcgctgaacccggtgcacaagatctccacccagctcaccgacgtgctgcgggcgcaccggccggagatgaccgagacgcagcgcaacgcccgcgcccgggagatgctcaagctggtcgggatcgcggcggaccggatggatgcgtacccgcatcagctctccggcggcatgcggcagcgcgtcatgatcggcatggcgctgatcctgcagccacaggtcgtgatcatggatgagccgaccaccgcgctcgacgtggtgatgcagcggcagatcctcggccagctgatcgagctgcgggaacggctgggcttctcggtcatcttcatcacccacgacctgtcgctgctggtcgagttctcgaaccggatcgcgatcatgtacggcggccggatcgtcgaggaggcgccggcggcggcgatctaccgagactcgctgcacccgtactcgaagggcctgctcggctcgttcccggcgctgcgcggcccgcgccgggagctgaccgggattcccggttcgccgccggacctgaaggggatgccgaccgggtgctcgttccacccccgctgcccccgggcgttcgacccgtgcgccgggaacatcccggtgctcggccggccggacaccgccgacggatcgacccgatcggtggcgtgctggctgcaccccaccgagcagccggtcggttag

SEQ ID NO: 4590 - DNA, 1059 bp, Actinoplanes utahensis
gtgacgatccccacctccagcatcgagcaggtcattcccggtcagggctcgatggcgcagccggagaccgacaggccggccaaggccaggcgtcagcggttccgcttcgtcagcaacaagaaggccgccaccggcctggtcgtgatcgcgatctacgcgctgttcgcggtcatcggaccgtgggtcgcgccgtactcaccggacgcccgcagcaacgacctggtcaagccgccgtccggcgcgcactggctgggcaccacgcacctcggccaggacgtcttcagccagctcctggtgggcacccgcagcgtgatgttcgtcggcttcctggccggcatcatcgccaccgtgctgtcggtgctgatcggggtgaccgccggttacctgggcggcaagaccgacgagggcctctcggcgctgtccaacgtgttcctggtgatcccggcgctgccgctgatcatcatcatcacgtccaccctgaacaacgccgaggactggctgatcgcgctggtcatcggcctgacctcgtggtcctggaacgcccgggtgctgcgcgcgcagacgctgtcgctgcgccgccgggacttcgtcgacgcggcccgggccaccggtgagaagacctggcgggtgatcgtcttcgagctgatgccgaacctgaccgcggtgatcgcctccggcttcgtcggcacggtcatcttcgcggtgctctccgagatcaccctggccttcatcggcgtcacctccagcagcacctggaactggggcaccatcctgttctgggcgcagggtcagcaggcgctcgcccagcaggcctggtggtggttcatcccggccggtctggcgatcgcgctgctcggcacctcgctgtcgctgatcaacttcgggatcgacgagttcgtcagtccccgcctgcgcagcgccggcaaaaccaagatcaagacaatcgacggccgtacggttcggatgcgcatcggtttcacccccgtgctcagccacacgccggagccgatcacccacgccagccccacgcctgtcgtgcggacggaggtcaccccgtga

SEQ ID NO: 4591 - DNA, 981 bp, Actinoplanes utahensis
gtgaaatacctgctccagcgcatcgcgttctacctcttcacggcgtgggccgcgatcaccctgaacttcttcatcccgcggctgatcccgggcgacccggtgcaggcgctgatcgcccggtatcagggccagatcagctcgcaggccacccagtcgctgtacgtccttttcgggctggacaagaccaagagcctctggtcgcagtacgtcgactactgggtgcagctgttccacggcgacctgggcctgtcgttcgccttcttcccgaccccggtctccgagatcatcaagaccagcctgccgtggaccctgatgctggtcggcatcaccacggtgatcagcttcttcctcggcaccgggctgggcgtgctggccggctggcggcgcggctcgtgggcggacggcctgctgccggtgaccacgttcctctcctcggtgccgtacttctggctcggcatcatcgcgatctacctgctcaccgggccggacagcttcttcccgtcgtccggcggcttcgacaacggcctggtgccggcgttcgaccagtacttcatcccgagtgcgctgcggcacagcctgctgccggcgctgaccatcctgatctcctcggtcagcggctggatcctgagcatgcgcaacatgatggtgacggtgtccagtgaggactacatcaccgtggcgcacgccaaggggctctccgaccgccgggtggcgttgagctacgcggcccgcaacgcgctgctgccgaacgtctccgggttcgcgctgtcgctcggcttcatcgtcggcggcacgctgctcgtggagatcgtcttctcctacccgggtgtcggcttcgagctcttccaggcgctgggcgcctcggactacccgctgatgcagggcatcttcctgatcatcacgatctcggtgctggtggcgaacctgctcgcggacgtcgcgtacctgctcctcgacccgcgcacccgcaaggagggctga

SEQ ID NO: 4592 - DNA, 1056 bp, Actinoplanes utahensis
atgacgtcgatccccgacgcgaaagcgccggccggcgaggtggtgcttgaggcgatcagcctgaccaagcacttccccgtccgccggaagctgcgcgacctgttctcgaaccgcaaggacgcggtgcacgccgtcgatgacgtgaacctcacgctgcgccgggggaaggtggtggccctggtcggcgagtccggctcgggcaagtccaccatcgcccggctgctcgcccagctctacccgcgcaccggtggcgacatccggctacacggcgagacgacgaaggtcaggggcgggtcggcgttccgccggtactgctcccgggtccagatgatcttccaggacccgttcgcgtcgctgaacccgacgcacaccatccggtaccacctgacccggtcgctgaagatccacggcaacgccggccggaccgcgacggatctggaccaggcgctgcacgacctgctggagcgggtgcagctgaccccgccggaacggtatctggacaagttcccgcacgagctctccggcggtcagcggcagcgcgtggcgatcgcccgggcgctgggcgcgcagcccgaggcgctgctcgccgacgagccggtgtccatgttggacgtgtcgatccggctcggtgtcctcaacctgctgcgcgacctgcgtgaccggctcaacctggcgatcctgtacatcacccacgacatcgcctcggcccgctacttcgccgacgagacgatggtgatgtacgccgggcggatggtcgagggtggtgacagcgagaccgtcacccagtcgccggcacacccgtacaccaaattgctgatccactccgcgccggacccggaccggctgaccggcatctccgaagccgaaggcgaggatgccggcaacggtgagccgccgagcctgatccacccgccgaccggctgccggttccacccgcgctgcccggccgcgatgccgcggtgccgcaccgacctgccggtgcccctggagatcggcgacgcgcccggccactgggcggcctgctggctgtacgaccgcgacgaggtgtcgaagtga

SEQ ID NO: 4593 - DNA, 1686 bp, Actinoplanes utahensis
atgcagagaaggaagctgttcgcggtcgccctggcgggcgtgctcgccaccggcggcgtggccgcctgtggtgactcgccgaacaacaacaagaacgccagcaacagcaagggcgccgacttcctgtcgatcggcatgccgaacggcaccgtgaccgagagcaacaacccgttcctcggcacctcggccgccgcctcgctgggctaccgctggaccatctacgagcccctcggcatgtggaacaacgtcaagccggccgagcccgccaagccgtggctggccagcgacatcaagtgggcgccggactacaagcagctggatgtcaccatccgggacaacgccacctggtcggacgggcagaagctgaccgccgaggacgtggcgtacacgttcaatctgatcaagtcgaacgaggcgctgaacatcttcgcgctgccgctggaccagatcaccccgaacggcaacaaggtcacgatcgccttcaagacctcgcagttcaccacctggcacaagatcatcagtcagatcccgatcgtcccgaagcacgtctgggagaagatcgcggacccggccaaggacccgatcaaggaaccggtcggctccggtccgtacaccctcaagacgttcagccagcagggcatcgttcttgagcgtcgggagagcggttactggcagagcccgccggccgtcaaggagctgcgctacacgtcctacaccgacaacaacgcgcagaccaccgcgctggccaccggccagtccgagtggagcttcgtgttcatcccgaactaccagcagaccttcgtcgccaaggacccgcagcacttcaaggtgtgggcgccgggcgtgctgggcatccacggcctctacatcaacaccaccagggcgccgttcgacgacccgaagctgcgccaggcgatgaacatggtgatcaaccgggccgacatcttcaaccaggccgaggccggctacttccacccggagctgaagagcatcacgggcctgccgtccggcgccggtgacgctttcatcaccgacgcgtacaagggccaggacctgaaggtcgacgtcgaaggcgccaagacgctgctcgccggggccggctacaagctggacggcaccacgctgaaggacaagagcggcaagccggtcaccatcaagctcagcgacccggcgccgtggtcggactaccagaccacgctggagatcatcaagggcaacctggccgagatcggcatcgccgccacggtcgagaagccgaaccagaacgtctgggaccagaacgtgcagaagggtgacttcggcggcgtcatgcgctggaccaacggtggctcgacgccgttcgacatctaccagacggtgatggacggcgacctgctcaagccgatcggcgagctggcccagcagggcaacttcggccggttcaagagcccggaggcgaccgccgcgctcaaggcgtacgccaacgcgaccagtgacgcggaccgcaccaccgcgctcgcgacgctccagaagatcttcgtggagcaggccccgatgctgccgatcggctcggacaacgtcggcggcgcgatcagcaccaagaactgggtcggctggccctcggaggcggaccagtacgccccgctgcagcccacccagtccggcgcgctcgacgtgatcatgcacctcaagcccgccaactcctga

SEQ ID NO: 4594 - DNA, 1011 bp, Actinoplanes utahensis
gtgccgatcaccatcgccgacgtggcggcccgggcgaaggtcagcaagacgaccgtgtcccgggttctcaacggcaagggtgagctggacgagtcgaccgccgcgcgggtccgtgcggtgatcgaggagctcggctacgtccccagcgcccgcgcggtcaacctggctcgcggacgcacccgggtgatcggcatgctggtgccctcgctgacctggccctggatgggtgaggtgctgcagggcgcggtcgacgtgctggagtccgaggagtacggcctgctgctgttcaccttcaaccgcggcgacgagtcgatgcggcagttcgccgcccaggtcgccgccaagtcgttcgacggcctgctggcgatcgagccggagggcaccctgagctatctcgccaccctgcacagccgcggcctgccgatggtgctgatcgacgaccgtgaccagatctccggcggccagatcccgaccgtcggcaccaccaaccacagcggggcggccgacgcggcccggcacctgctggagatcgggcgccacaagccgctgctgatcaccggcccgtcccggttcgggtgcaccgtgcagcgcaccgacggcttcgccacggtctacgccgaggccggccacccgattccggaacactgcgtggtcaccggcgacttcacggtggcctgcggcgccgacgcggtcaagcgggcgttcgacgccggactcgacttcgacgccgtcttctgccacaacgacctgtccgccttcggcgccgtgcaggccatccaggacgccggccggcgggtgccggaggacgtcgcggtggtcggcttcgacgacatcccgatggcggcccaccatcagcctccactgtcgaccgtgcatcagccgatgcgcgagatgggcgaggcggcggcccgcacgctgctcgcccacttcgagggcaccgcgctgccgaaccggccgacggtgatcccggcgacgttcgtggcccggtcctcgacaagagccaagccctag

SEQ ID NO: 4595 - DNA, 855 bp, Actinoplanes utahensis
atggacctcggtttggtggagcaggtggcccggctcgacggctggctcggcgacggtggcgtggtggtgctgagcggggcgggcctgtccaccgactccggcatcccggattaccggggcccgtccggctcggcccggcgcaacaccccgatgacctatcagacgttcaccggcgatccgctggcccgccggcggtactgggcgcgcagtcatctgggctggcacacgatcggtctggctcggccgaacgacggtcatcgggcggtggcccgctggcaggagcgcggcctgctgcacggggtgatcacgcagaacgtggacggcctgcatcaggcggccggcgcccgggacgtggtggagttgcacggcaatctggcccggatcacctgcctggcctgcggcgcgctgaccccgcggaccgagctggcggcccggttgtcggcggcgaacccgaatttcgccgtggtcgcctcggcggtgaacgcggacggcgacgccgagctggacgacgccgcgctggacgggttcaccccggtcgactgcctggcgtgtggtggcctgctgaagccggacgtggtctatttcggcgagacggtgccgccggaacgggtgtcccgggcgttcgagctggtcgccggcgcccgcacgctgctggtgctgggttcttcgctgaccgtgatgtcggggcgccggttcgtgctgcgcgcggtgaagcagggggtgcgggtggcgatcgtgaaccggggggtgacccgcggcgagccgtacgcggatctggtgatcgacgcgccgctcggcgtggtgctgccgaacctggccgcggagaccgaaacgtaccgattgttgcctcgctga

SEQ ID NO: 4596 - DNA, 327 bp, Actinoplanes utahensis
gtgcgcgttgccggtcaccccggtaggttgatcagtgtgaccgctgtggcgcgtggggccgaccgttcgtgggacggtcgccgcctgctgcggttcctcaccagcctggcggttctcgccctggcggtgacgctgcgcctgccgttcggcggcccggtcgccgggcctgtcggcgggttttcggccgcgccttccgtcgggtcttccgtcgggtcttcggccgcgcctaccgcggggtcctccgccgcaccggcggcgtcagccgccacctcggacgcggctccggcggcggtgccgccggcggcaccggttgccgccgctagctag

SEQ ID NO: 4597 - DNA, 705 bp, Actinoplanes utahensis
gtggattccgccttcctgaattccgtcccgcaagccgtcgcgatctggctgatcatcgtgttgctgctcgccgtcgccgcggccaccgtctcggtgccccgcgtgctcaccgagcccgctccggacgtcaccgaccgcgagcggtacgccggcgaggtggccatcgcggccggccgcgcccgggcgaccgccgaccggcgccgtgccgactggcaggccgcccagcaggccgtcgacgacgcctgggcggcgtacgagaaagccgaccgggtcgcccggcggatcgccgcggccggggtgtacccgctgctcgaccgccgccgcaaacccggcgagaacgtcgaccgggaacgcttcctgcaccgcgcggccagcgagctctgccgcagccaggacctctccatcgaccagctcaacgacgtcttcgcgcaccgcggctggaacccgcggctgcatccggtccagcaggaatgggtgctggcccaggcggtccgggccaaccggctgaccggctaccgggaggcggtcgagcgggaacgcgccgcctggcggtccgccgacgccgccgccgaggcgctgcgcgggctgcgcgccgaggcgatggccgctccgctgctggtcgacgtgccggaaccggccgaccagcagtggtggaccgagcagtggacgaccgccgatctgccggcgagcgccgcaccggcctaa

SEQ ID NO: 4598 - DNA, 1050 bp, Actinoplanes utahensis
atggtggcggcgacaccggcggagacgtccgcggccgtggcgcggatgcaccgggcggccctggtcgaggacgccgtgcacgagatcatcgagcgcggcctgcgcaaccgtgggtggaagccgtacatcacggcctacaccggttacggcgcgcccggctgggcccgggtgatggcccgggtgctgctctcccggccccgcctggtccggcggaaacgggagaaggtgcgcggctggcgcagcttcaccaccaccccggtcagcggcgccacggtgcgcatcgaggtgggcggcagcgtcaccgagacccgcaccgaccgcagcggctacatcgactgccgggtcaagggcgacctcgcgcccggctgggccagcgtccgcatccactgcgagggcggggccccggtcgacgcgccgatccgggtgatcgacccggccgtgaagttcggcctggtctccgacatcgacgacacggtgatggtcaccgccctgccccggccgctgctcgccgcatggaacacgttcgtcctcgacgagcacgcgcggatggcggtgcccggcatggcggtgctctacgagcggctgatcaacgccaacccgggcgccccggtgatctacctctccaccggggcgtggaacgtcgcgcccacgctgacccggttcctgagccggcacctctaccccgcgggtccgattctgctcaccgactgggggcccacggccgaccgctggttccgcagcggtcaggagcacaagcgcaccacgctgcgccgcctcgccgacgagttccccggcgtcagatggctgctggtcggcgacgacggtcagcacgaccaggagatctactccgagttcgcccgcgagcacccggacaacgtggcggccgtcgccatccggcggctgtcaccgacccaggcggtgctggccggcgcggtgcccgggccgaccgagaccccggaggcggtgccgtccgggggcaagacgtggttcgccgccccggacggcgccggcctctggtccctgctccgcgacacggacctgaccaagtga

SEQ ID NO: 4599 - DNA, 840 bp, Actinoplanes utahensis
gtggctattccgcctcggcgggcggggtggacacctcggccacccggctgtgcagccggctccgaatctcgtccggggtgtacgcgcgtcgttggcgctccgcccgggcgatcaccaccccggtcgccgcgactcccgccagccccgccagtcccgctaccttccaccaacgcatctgctgagaatagacacgtggttgccgacatcagcctcgacgaggccattgaactgacccgcacgggcgacatctggatcttccggggccggtccgggcccgaccgtgccattcagaccctcaccaacagcccggtgaaccatgtcgggatgtccctggtgatcgaggacatgccgccactgatgtggcacgccgagctcggcaggagcctgcccgacatgtggtccggcaccttccaacgcggcgtccagctgcacgacctgcgcgacgcggtcaccgtctgggcccgccgctacggccagcggggctggctgcgccagctggagccgggcgtcacccgcgccatggaggacaaagccctcaaaacggtcgcgcgcctggacggcaccccgtttccgtccacctcccagctcgcctggcgctgggtccgcggccgggtcccgcagatccagccgccgtggaaaccggcgaagaccgacgccaccctggagcgcgcctactgcgccgaggtggtcgcggtcacctacgaggacatgggtctgctgccccgcaaccacaaggccaactggtacgacccgggccgcttctggtccggggacgagctcgaactcaccgcgggctacctgctgggcgacgagatctccgttcgggtccccgacgcctga

SEQ ID NO: 4600 - DNA, 414 bp, Actinoplanes utahensis
atgctcggtccgggccgcagtcaaaggctcatggcaaggaatggtcgatcgcttgacgcggtccaaccggaagggttcaggaaaatgatgaagaccgtacggggacgggcgacccgcgtggccgctgccgctgttgtggctaccgcggcgctggccgcgccgcagctcagcagcccggcatcggcggcgggttgcagcggcaccttcattctctacacggggttcaactacacgggcaattcgcagtactacagcactccggtcaacaacctgacgctgaaccggaatgtcgcgtcgatccgcaactactcgccgtgcaccctcacgctgaagacggacaacggcacctaccgggtcgtcggcaacggcggaatctcggccctcggccgctacgtttacaccatcaccaactga

SEQ ID NO: 4601 - DNA, 1359 bp, Actinoplanes utahensis
atgacatcgttcatcgagctaggcgtccccgccgttctgaccggcgccctcgccgagctcggcatcaccacaccgttcccgatccaggcggccacgctgcccgactcactcgccgggcgcgacctgctcggccgcggccgcaccggatcgggcaagacgtatgccttcgtgctgccggtcgtcgcccgcctggcggccgccccgacacgcccgaggccgggccgcccccgcgcgctgatcctggcgcccacccgggagctggccacccagatcgaggccaccctgcgcccgctggccgacgcgatgggtctgcgcaccctgaccgtcttcggcggggtcggggcgaacccgcagatcgccgccctgcgcaagggtgtcgacgtgctggtcgcctgcccgggccgcctcgacgaccacatccgtaacgggcacgcctcgctcgacgccgtcgagatcaccgtgctggacgaggccgaccacatggccgacctgggcttcctgccggtcgttcggcggctgctcggccagaccccggccggcggccagcggctgctgttctcggcgaccctggacaacggcatcgacgtgctggtcaagcagttcatgcgaaaaccggtcacgcaccacgtcgacgcggccgcgcaggccccggtcgagatggaccaccacgtcctgcacgtccagcccgacgaccggttcggcgtgctggtcgacctgctggccgcgcccggccgctcggtcgtcttcacccggacgaagcgccgggccaaggtgctcacccgccagctgatctcggccggcgtcccggccgtcgagctgcacggcaacctggcgcagaacgcccgcaaccgcaacctgtcggcgttctccgagggctccgcgcccaccctggtcgccaccgacatcgccgcccgtggcatccacgtcgacgacgtcgccctggtcatccacgccgacccgccggtcgagcacaaggcgtacctgcaccggtccggccgcaccgcccgggccggcgcccgcggcacggtcatcaccctgatgaccgacgaccagcaggccgacgtccgcgacctgacccgcaaggccggcatccgtccgctgacccgccgtgcccgccccggcgacgcactgctgtccgagctggccccgggagaacgcaccttcgtcaccccgggccagcaccagcccggcgccgccgtcccggacgtggatctcgacggtgcggcaccggccggcaccggccgttccggccgccgccgcgggggtcgccgacccgccgccaccggtaacgcttccgccgccgggtcgggcaccgcatccgccgcccggtccggcacggccggcgcgggccctagctag

SEQ ID NO: 4602 - DNA, 1032 bp, Actinoplanes utahensis
atgaacgatgtcattaagtgggtaactctccgtaggtcagctggagatcaatcctactggtcaccgacggcaaccttcctgcacccggtatcgaaccaggccgcactcagcctcgcagatctttttcctcagcgccggacgcccccactccggccggtactgaggagacccctgatgaacggtgaggcacctgccgtcgatcggcgtcgcgaggacatcgtgcgggcgaacatgcccctcgtcggccacctggtccgcgagatgctggcccgggtccccgcccacgtcaaccgtgatgacctgctgtccgcgggctacgccgccctggtcgccgccgcccgcgggttcgacccggagcggggtgtgccgttcccgcggttcgccgcggcccgggtgcgcggcgccctgctggacgagttgcgcgggctggactgggcgagccgttcggtgcgccagcgggcccggcgggccgatgcggcccgggaggagctgaccgccgaactcggccgcatccccaccccgcaggagctggccgaacggctgggctgcacggtcgaggacatcgagcacggcaacgacgacgtgcaccgggcgacggtgttcagcctgcagggcttcgccaccgcgaccgccgacgacctggtgaccgaacgcactcccgggccggaggagatgctgatcctgcgcgagcggctcggctacctgcggcacgcggtggacgccctgccggaccgcctgcgggtggtggtccagggctacttcttcgacgagcggccgatgtccgacatcgccgccgatctgggagtcagcgagtcccgggtgtcgcagttgcgggccgaggccctggtgctgctccgggacgggctgaacacccacctcgatccggcgatcgccgcgcagaccccgccgaaggagggctgtgtggcccggcggcgggcggcgtactacgaccggatcgccagccgcggcacgctgcgcagccgcctcgcgatgaccggcccggacggcctgccggtcccggcagccgcctga

SEQ ID NO: 4603 - DNA, 519 bp, Actinoplanes utahensis
atggacttcaacaccccgtaccgtcgcatcactgtcctcgccctggccgccgtcgccaccctcggcgtcacctccgcctgctccggcggcgatgacgccccggccggcaacgccgccgcggccgccgccggtggccccgagccgaaaaccctcgacggggcgaaggccgccgcgcagaccgtgttcgaccggttcagcggtggcgacttcgccggcgcctgggagatgtacaccagcgccggcaagcaggcgatcagcaaggacgactacgtcaagctcaaccaggcctgttcccgcaaggggctggcgatcaccctgaccagcgcgcggatggagggcgtggacaaggcgatcgtgatcgcgaagcagctggtggcggcgcagtcgtacaccatggtctacgagggcaacgggtggcggctggagccggccgcggaggggctggcgctgtacaagatgggcgcggccaaggcgatcgccgcccagaagaaggccggcacctgcgccaacaaccagtaa

SEQ ID NO: 4604 - DNA, 2277 bp, Actinoplanes utahensis
ttgtcaagctctagcgccgatttcgatgctgagcaggcttacctgaccgagctgtaccagcgcctcgatcagctgcgtgagcaggccgacagccggctcaagggcattctgctggaggccggtggcaccccgcaggggcggacccagcgcgaggccacccgggcccactacacggagcagctcgcccagatgaattccgtcgagaacggtctctgtttcggccgactcgacttcgccgccggcgacccccggtacatcggccggatcgggctgttcgccgaggaccgcgaccaggatccgctgctggtcgactggcgcgccgcggccgcccgcccgttctacctggccaccgcggtccagccggacggggtcacccggcgccggcatctgcgcacccgcggccgcaccctgaccggcgtcgacgacgaggtgctcgatctcgcggccggtgacgggaccggccgggaggacgtcaccggtgaggccgcgctgctctccgcgctgaccgcgaaccgcaccggccggatgcgcgacatcgtcgagaccatccaggccgagcaggacgaggtgatccgctccgggctgcccggcgtgctggtggtccagggcggccccggcaccggcaagaccgcggtggcgctgcaccgcgcggcgtacctgctgtacacgtaccgccagcaattgactcgcagcggcgtgctgatcctcggaccgaacaccaccttcctgcgctacatctcccaggtgctgccctcgctggccgagaccggggtgctgctggccacactcggcgacatgttccccggggtgcgggcccgggccaccgaaccggacgaggtggccgcactcaagggcgacctcggcctgatgctgcccgccctggagaacgcggtcgccgaccggcagacggtgccggacgacttcgtcgaggtcgaccacgacgggtatccgctgcggatcgagcgcgcggtgctggaggacgcgcgctcggcggcccgccggtcgggacgcccgcacaacgtggcccgggcggtcttcgtgaccgaggcgatccaccagctgtccctgcagatcgccgagcggatcggcgccgacccgctgggcggcgacaatctgctctccgaggccgacctggcggagacccgacgggagctgcgcgaggacatcgacgtgcagcagctgctgttcgacttctggccggtgctgaccccgcggcaggtgctgcgcgacctgctgaccgatgctgatcggctggagtcggccgggctgccgaccgtgctgctgcgcgacccctcggccgggtggacgccggccgacgtgccgctgctcgatgagctggccgagctgctcggggtcgacgacacgctgaagaagcgggagcaggagcgacagcgcgaggcggcgatcgagtacgccgagggcgtgctggagatcgtcgagggctcccggtcgctggacttcgaggacgtcgaggaggagatcctctccgcggtcgacgtggtggacgccagcgcgttcgtcgaacggcacgaggtgatcgacacccggaccgcggccgagcgggccgccgccgaccgcacctgggtgttcgggcacgtcatcgtcgacgaggcgcaggagctgtcgccgatggcctggcggctgctgatgcgccgctgcccgagccggtcgatgaccgtggtcggcgacgtggcacagacctccgagccggccggcagcacctcctgggagcaggtcttggagccctacgtcggccagcgctggcgcctggtcgagctgagcgtcaactaccgcaccccggccgaggtgatggcggtggccgcggacgtgctggccgcggtcggcgccggggtgcgcccgccacgctcggtccgctcgtccggggtgaccccgtgggcccgccgggtgccggtcggcggcctggtggaggaactgctggcggacgtccgcaaggaggccgccgcggtcgactccggccgggtcggcgtgctcgtcccggcccggctgaccggcccgctgggcaccgcgctggtggaggcgatcccgggcgcggctgtgggggagcagccggatctgctcaaccacgtggtgctgatgaccgtacggcaagccaagggtctggaattcgactcggtcctcgtggtctgtccggacgagatcgtcaccgagagcccgcgcggactctccgacctctacgtggcggtgaccagggcgacgcagcgcctgggggtgctgcacaccgaaccgctgcccgaggtgctctccgcgctcgcctga

SEQ ID NO: 4605 - DNA, 780 bp, Actinoplanes utahensis
gtgaccaacaatcccccgtcggacaaggcctccctcgacggacccggctccgtccctgacgccctgttcaccgatccccggctcgccccgctctacgacctgttcgacggcgaccgggacgacctccccgcctacctgacgatcatcgagtccctgcggcccgcccggatcctcgacgtcggttgcggtaccggcgccctggccaccctgctcgccggcaccgggcacacggtgatcggcgcggatcccgccgcggcctcgctggacgtcgcccgcaccaagccggccgccgaccgggtcacctggctgcacaccggtgcggccgggctgccgcaggcctggccgctaccggagcccgccgatctggcgctgatgaccggcaacgtcgcccaggtcttcgtgaccgacgatgactggacggccgcgctgcgcggcatccacgccgtcctgcggcccggcggtcatctggttttcgaggcgcggcgtccggagttccgcgcctgggagcagtgggatcatccgcccgccaccgcgggcggggtggagcgacggttcatgctcaccgacgtacgactgccccttgtctccttccggtatgaatatcgtttcctgtccgatgagacggtgctgacctcgacttcgacgctgtgcttccgcgaccggtccgagatcgaggagtcgttgcgggcgaccggtttcgaggtcctggaggtccgtgcggcgccggaccgtcccggtagggagaacgtcttcctctgccggcgggccgggacagcgtga

SEQ ID NO: 4606 - DNA, 921 bp, Actinoplanes utahensis
atgaccagcaccgtgacgaccgctgccgacttcgccgccgacaccgctcccgccacgccggtgctctccgccgcccagcaggaggagctgatccgcacgcacatgccgctggtcggccacctggtgcgggacatgctgagccggatccccaaccacatccaccgcgacgacctgaccagcgccggcctgcacgccctggtcaccgcggcccgcggctgggacccggagcgcggcgtgccgttccaccgcttcgccggcacccggatccgcggcgccctgctcgacgagctgcgctcgctggactgggcgacccgttcggtgcggtcgaaggcccgcaacaccgacagcacccggcagaacctgaccaccagcctgggccgcacccccacgccggaggagctggcgcaggcgctcggcaccaccacctccgagctgcaccagaccgacaccgacgtgcagcgcgccaccgtcctgtcgctgcagggcttcaccaccagctccgccgacgacctggtcaccgagcgcacgccgggcccggaggagatgctgctgcgccgcgagcagatcggctacctgcaccacgcgatcggctcgctgccggaccgcctgcagaccgtggtcaccgagtacttcctgcaggagcgcccgatggcggacatcgccaaggacctgggcgtcaccgagtcccgcgtctcgcagctgcgcgccgaagccctgtcgctgctgcgcgacggcctcaacacgcacctcgacccggagctggcgccgaccccggacaacccggagagcatcaccgcccgccgccgtgcgtcgtactacgccaccatcgccagcaacaccgacctgcgcagccgtctcgcgatgaccaacgcgcacggtcacacggcgcacggccgcgggctgcgcccgaccgccgcctga

SEQ ID NO: 4607 - DNA, 516 bp, Actinoplanes utahensis
gtgctgcgcatggacctgagtgacagcgccgcgggcatcaacctgatcaccggcctgctggtcgccggcggggtgctcggcgtgttcctgccggtcatccccgggctgctgctgagctgggcgggcgtgctgctgtgggtgctgctgacccccaccgactccgacctgaagtgggcgatgctggcgatcgccaccgggatcacggcgctcgccatggtgatcaagtttctgtggccagcccggaaacttcgcgattcgggcgtacggtcgtcgagcctgctggccggcggtgtgctcggtgtcgtcgggttcttcgtggtgccggtggtcgggctggtgctcggcttcctgctcggcgtctacctggtggaggcgagccggctgggcggtacggcggcgtggcgcaccacccgacgggcgctggccgcggtcgggctctccctgctggtcgaactggccgcggcgctgtgcctcgcggtgatctggttcgtcggggtggtcgcgaccgcttcctga

SEQ ID NO: 4608 - DNA, 1239 bp, Actinoplanes utahensis
gtgatccgccccctgctgaccatccccctgaccgccctgctcgcgatcccggccgtccccgcggccgccgcaccgaaaccggcacagcaggcgaaaacgggggcggaggtgccctgcccgcacccgaggatcgccaagccgagcgctcccccgcgcccggttccgccggcggacaacccccgggacatggcggtcggcggccccgacctggccactcacggcctggtcgtgccgcccggcgccacgactcccccggcggtcaccgccaccacctggatcgtcgccgacctggacaccggcgaggtgctcggcgcctgcggcccgcacgtctaccagaccccggccagcgtgcagaagacgctgctggcggccaccgcgatggatcggctcgacccgaagcagaacgtcaagatcgtgcagagcgacctggacatcgaggcgaacagctcggcggtcgggatcgtggtcggcggcacctacccggtcgccaccctctggctgggcctgctgctcaattccggcaacgacgcggcgaacgcgctggcccggatggccgggggcggcggcgccgacggggtggccaccacggtggcggcgatgaatgcgaaagcgcgcgagctgggcgccttccagacgcacgcggtgacaccgtccggtctggacggcaagggccagttcaccagcgcgtacgacctggccctgatcgcccgctccgacttcgcgaaggccgacttccgtaagtatgtgctgaccagaagcgcgcagatgccggcccagcgcagccccagggtcggcggcttccagtttcagaacgagaacaagctgatctacaactacccgggtgcgatgggcggcaagaccggtttcaccacggtggcccggcacagctacgtgggcgccgcccagcgcaacgggcgccgcctggtggtcaccctgctgggcgccgaggcgcatccgctgcgcggctggcagcagggcgcggcgctgctcgactggggtttcgcccagccggccggcgcctcggtgggccacctggtcacaccggcggaggcggcggcgctgaccgccacgccggagaaggcgagcgccggcgtctccggcacggcggcgaaaccggtggtgaagtcgcacagccggtcgctgatcgtggccggcaccggcgccgtggtgctggccgccctgccgctgaccctgctggcgatccatcgaggccggcgcagacgcttccggaagccgtga

SEQ ID NO: 4609 - DNA, 432 bp, Actinoplanes utahensis
atgcacgacgagcaggccgactggctggcgcatcaccggcgggccgtggccggccgggccgccgcgctggaggccgggcgcaccgccgaggcgcagcaggccgccgcactgctcgaggatttcgtccgccgggccgccgagcgtgggctggccccgcatccgctggtcgccaccacctacgacggccgctggtcgtatcggacccgggcccgcggctggtatctgaagcgcaaccgctcggtcgccgtcggcgaggacggggagtatctcgtgctcaccgtcccggcctcgctgcgcgcccggttcgtcggcgccgacctgtcgccgagcatgccgcggctgatcgtcggggccggcggcggtgacggcgagaccgtgccgctggagcatctgctggagcatcgtctggaagccggagcccgctggccgtga

SEQ ID NO: 4610 - DNA, 348 bp, Actinoplanes utahensis
atggcgcggcaggtaatcaccaccctgatcgacgatctggacggcaagaaggcggatcgcaccgtcgagttcagtctcgacggggtcagctacacgatcgacctttccgaagccaatgccggaaagctgcgcaaggctctggatccgtacatcaacgcgggaacgcggctcggccggacagccggtcgggtggcggcgcgcggggcggctccggcccgcaccgccggctcccgcgacgagaaccggttgatccgtgagtgggcgatcagcaacgggcacaaaatctccgagcgggggcgcattccgcaggaggtcagcaacgcgtatcgggcggcgcacggccgctga

SEQ ID NO: 4611 - DNA, 882 bp, Actinoplanes utahensis
atgcgtttcggcatcgtcatcctccccgaccagcgctggtccgaatcgagccgccgctggcgactcgccgaggagttcggcttcgaccacgcgtggacgtacgaccatctcggctggcgcgacctcgtcgacggcccgtggttcgacgcggtacccacgctgaccgcggctgccacggtgaccgagcggatccggctcggcacctacgtcgcgtcgccgaacttccggcatccggtgcacttcgcccgggaggcgaccgcgctggacgacatctccggcggccggctgctgctcggtctcggcgccggcgggatcggtttcgactccgccgtactcggcggcgcggagctgagcccgcgggcccgggtggaccggttcgctgaattcctggagctgttcgacacgatcctgcgctcgccgagcaccacctggcgcggggagtacttcgcggcggtcgacgcgcgcagcacgcccggcccggtgcagcagccgcgcccgccgttcgtggtggccgcgaacgggccgcgagcgctgcggctcgccgcccggtacggcgacgggtgggtcaccaccggtccgcaggcggagacggcggcggattggtggcgtgcggtgaccgagatcaagaaccgtttcgaggacaccctggccggctccgggcgacgcccggaatcggtcgaccgttacctcaatctcgactcgtcaccggtgttctcgatgagcagtgtggacgcgttccaggacgcggccgggcgggcggcggcgctgggattcaccgatgtgatcacgcattggcccaggcagtccagttggtatgcgggcgaggagaagaccctggaagcggtggccgccgggctgccgcggctgcgcgcgactatttga

SEQ ID NO: 4612 - DNA, 465 bp, Actinoplanes utahensis
atggagcacgccaacgatgtcgccgccgcgatcgagtcgtcggtggagtcgttggcggccgtgctcgaacgcgcccgggtcgcccggaccccggcggtcccgcccgcccagctgcgcgtgctcaccatcgtcgcggagaaccggcacaccaacatgagccgcctcgccgaggccctcgacgtggtgccgtcctcggccagccgcctctgcgaccgcctggaggcgaccgggctgctgcgccgggtcgtcgacccgcgggaccggcgagaggttcggttgctgctcaccccggccgcccgacggctgctggccgatttgcgggagcgccggcgggcggtgctcgccgaggtgctggagaggatgccggtcgcggcccggcaggacctggtgcgggcactgcgcgccttcgaggcggccgccaccgacgactcccgcaccgccggcgacgacctgcgctccgcctga

SEQ ID NO: 4613 - DNA, 1143 bp, Actinoplanes utahensis
gtgtccgaccaaccggtacccatcggttccctgctgcgttccaccgcccccgaccgcctgcccgaggtggccgccgagcacctgcgccggcacttcgccgccgagcaggtcgaggtgatggtcaccgacctgccccagcgtcgcctcgccccgctgctgagcccggccgcgcccgacaacgacccgtccgccctgcgcaccctggccagccagcgggtgaacacggacaccggccccggtggccgggcccgggtacacctgccgatctcctgctggggcgagcggctcggcgtgctgcgcgtcgtgctgcccgaccggcccaccccggaccagaccgaccagctgcaggcggtcgccgacgaactcgccgtgacgatccgcgccgccgaccgggccaccgaccgctaccgccgggcgcagtgcctggaacggctcaccatggccgccgaactgcagtgggacctgctgcccggccgctccctggacgacgagcggttccggctcgccgggcagctcgaaccggcctacgacgtgtgcggcgaccacttcgactgggcgctctccggcgaccggctcgccctcaccgtgctcaacggcgccggccagggcctggaggcggcgatcctcacggccaccgcggtgaacgcgatgcgcaacgcccgccgctgcggggccgacctgatcgaacaggccgagctggcctctgacgcgctgcacgcccggtacggtggcggcctgcacgccgccaccgtgctgctggaggtcgacctggtcagcggctgggtggaagcggtcgacgccggctcgccgcactgcatgatcggtcggggcaacgacatcagccaggtccgcctggaacagcagctgccgctcggcatgttcggggaggcgcactacgagatcgaacgcttccgcatcgaacccggcgaccggctcctcgtgatcagcgacggagtgcacgccgccgcacccggcggtggaccgactttcggcgaatccgccctgctcagcgcgttgcgggggactaggctgcagcctccggccgaggcggtcggtacggtgatgcggggcttgcgtgagtttcacgccggcgccgagccggaggacgacgcggtgaccgtgtgcctggattggcgccgctga

SEQ ID NO: 4614 - DNA, 393 bp, Actinoplanes utahensis
atgcgcatgtcggttcggctcagccttccccgtgaggtggacagtgtgcccgccgtgcgccggttgctgcgttgttcactgaccacgctgcagatcgaccgtcaggcgggcgcggatctggagatcgcgctgaccgaggcttgcgccaacgtggtgaagcacgcgaccggggccgaggacttcgaggtccgcctggacgtcggcgagcagcactgttcgatcgacgtcgtcgacaacggcgccgggttcgacccggacgaccggcccgagccgaccacggccggggagagcggacgtggcctgttcctgatccgcgcgctcgccgagaacgtgcggatgcagtcgagcccgcgcaccggctccctgatccacttcgagaaatccttcgcctga

SEQ ID NO: 4615 - DNA, 1767 bp, Actinoplanes utahensis
atggcgaaccaacccgacaccgccacggtggtggccgcgcgggccggcgacccggccgcgatcgaccggctcgtcgccggatacctcccactggtctacacgatcgtgggccgggcgctggaggggcacgcggacgtcgacgacgtggtgcaggagaccatgatccgggtcttgcgcagcctcggtgagctgcgcgagccggaggctttccggtcctggctggtggcgatcacggtgcgccaggtgcgggaccggttccgcaaccggcagagtgccccggacgcgctgctcgacccggacctgcgcgaccccggcgccgacttcaccgacctggcgatcacccggctggagctctccggccagcgccgggagaccgccgaggcgacccggtggatggacgaggacaaccgggagctgctctcgctgtggtggctggaggcctccggcgagctgacccgcgacgagatcgtcgacggcaccgggctgggccggcagcacgccgcggtccggatccagcggatgaagggccagctggagacggcgcgggcggtggtccgggcactgcaccggcagcccatctgcccggagctggcggtggtgatcgagccgtgggacggccggccgaacgcgctgtggcgcaagcggatcgcccggcacacccgggagtgccggatgtgcgccggcgcctggcaggacctggtcgcggccgagcggctgctggccggcatggccctgatcgcgccggcgccgcacttcgcgaagccgttgatcgccaccaagctcgccgccaaggtgggtctgggcgccgcgcagaaggcgctggtcaccgccctcgcggtcagcgtgatcggcgggggtggagcggcggtctacgcgttgagctcgcagaaggacccggcggcacccccggtcgcggccgtcgtgccggcaccggtggtcccggccgcggcggcgccgcgggtcagcccgtcggccacgccgcggcgtaccgccgcttccccctcggcgaaggccgccgtgccggccgccgcgatctcggcgaagaagggcgtcggcgtctggaagttcaccggctcggcggcggccctcaaggacgtccgggccggctggtactacgactgggccgcgcagaacgacgacgtccccggccccaccggtgtcgagttcgtgccgatgatctggggccggcagaacgtcaccggtgccacgctgcggcaggcgaagtccgagggccgggtgctgctcggcttcaacgagccggacatgggcgggcaggccaacatgagcgtcgaggacgccctggccgcctggccgcagctccaggcgaccgggatgcgcctggtcagcccggcggtggcgtacggcggggacaccgccggcggctggctcgaccggttcatggccggcgccgaggcgaagaagctgcgggtcgacgcgatcgccctgcactggtacggctcggacttcagcgccgcggcggtcagccagttcctcggttacgtcgacgcggtgcaccagcggtacggcaagccgatctggatcaccgagttcggcctgatgaacttctccggatcgccgaaataccccagcgacgcccagaaggtggccttcatcgagggcgccacggcggggttgcagaaacggtcgtacgtcgagcgttacgcctggttcgggctgccggccgtcggtgacagcgtcgacttcggcctctaccgggacgggcacagccccaccgaggcgggcaaggcctaccgcgccgcgggatag

SEQ ID NO: 4616 - DNA, 1008 bp, Actinoplanes utahensis
gtgagtttcatgattcggttcgggtacaaggcgtcggcggagcagttcgctccggctgacctgctccggtacggcattctcgccgaggagctcggtttcgactcggtcttcgtcagcgatcacctgcaaccgtggcggcacgacggcgggcacgctccggccgcgctgccgtggctcggggcactcgccgcgcgcaccgaaagggtcctggtcggcaccagcgtgctgaccccgaccttccgctaccacccggccgtcgtcgcgcaggccttcgccaccctgggctgcctcgcgcccggccgcgccatcctcggcgtcggctccggcgagtcgctcaacgaggtggcgctcggcacgcagtggccggacggcaaggagcggttcgcccggctcaaggaagcggtcctgctgatccagaagctctgggccgaggaccgggtgacgtacgaggggcagttctacaagaccgagaacgtcaccatctacgacaagccgtcgacgccggtcccgatctacatcggcgcgtccggcccggccgcgacccggctggccggccggatcggggacgggttcatcacgaccagcggcaaggggcacgcgctctacaccgacacgctgctgccggccgtaacggagggcgcggagaagggcggcaagaagatcgacgacctggatctgatgatcgaggtcaaggtgtccttcgacgacgacatcgaccgcgcccgcaacgacacccactactggggtgcgctggcgctctccccggaggagaagaccggcgtcgaggacccggtcgagatgcagcggctcgccgacgcactgccggtcgagcggaccgccacccggtggatcgtctcctccgacccggccgagcacgccgccaaggtgaccgaatacctggacatgggcttcaagcacctggtgttccacgcgcccgggccggaccaggagcgcttcctgcgcctctacgcggccgagatcctgccgcggctgcgcgaccgctcctga

SEQ ID NO: 4617 - DNA, 927 bp, Actinoplanes utahensis
atgccccttgcgtcacaccgaccgtcatcacccaccgtgagcgtcgtcatccgggccggcacggtcgccctgcccgtcctgctggccgggatgcccccggtcgacgagatcgtcgtggtggtcggacgccgggacggcaccggcaccgtggtgccgccgggcgcccgggtggtccggcagacccgcgccggcgccggcaacgcgctggcctgcggggtcgccgcggccaccggggacatcgtggtcaccctcgccgccgacggctcctgcgacccggccgaactgccccgctacgtgcaggcgctgtgcgacggatcggacgtggcccagggcgcccggcagcgtccgacgctcggggcgcggatcgtgttgtggatgatggcggcgctcttcggggcccggcgcaccgatcccggattcggttaccgtgcgttctggcgagacgcggccgggatgctcgaactacccagagtgagcggggttgacgcggtccgcggcgacggggcggagatcgacgcgctgctcaccgtgcgggccgggctgaacggactctcggtgaccgaggtgccgtccgcggccgccgcccggccggtgccgctcgtcgaggccgtcggcgcgctgctcggcgaatggcacacccggcgccgggtggccccacccgcaccggcggagagcatcgtggtgctgaccgggaaggcggacccggagcagacccgggtgctcccccgcatcgggaccgacgcggtgctgccgcggacctcgcgtccggccgcgtacgccggggtggaccgccgtcagggcccacgccggctccgggccctggagaaggagcaggccacccgcccccgcctgcgcgtgatcaacggcgagggcggcggcaccggaccgcgtaccggcaccttgcggtcggtaccaccggcgatctga

SEQ ID NO: 4618 - DNA, 870 bp, Actinoplanes utahensis
atgagactcgggctccatatctcgaacttcacctggccggagggcccgtcgcggctcgccccgaccctcgccgagatcgcctcggccgccgacgaggccggtttcgagcggatcagcgtgatggaccacgtctggcagatcggcgtcaacgggccgcccgagatggacatgctcgaggcgtacacgacgctcggcttcctggccgcgcacacccgccgggccaagctgctcaccctggtcaccggcgtggtctaccgcgagccgggcctgctcgccaaggcggtcaccacgctcgacgtgctctccggcggccgggccatgctcggcatcggcgccgcgtggaacgaggaggagtcgctcggcctgggcctgtcgttcccgccgacgcgggagcggttcgagcggctggaggaggcgctgcagatctgccggcagatgttcgccggcgacgaggccgcctacgagggcacgcactaccggctggcccggctgctcaaccacccgctgccgctggcccggcgggtgccgatcctgatcggcggcgccggggagaagaagacgctgctgctggtcgcgaagtacgccgacgcctgcaacctgttccccggcccggagctgcagcacaagctggacgtgctgaaacggcactgtgacacggtcggccgggactacgacgagatcgagaagacggtggtcttccgcttcgacccgggcgagcgcggggagaaggtcggcgagatcatcgacgcgatgcggcacttcgcggcgatgggcatcacggtgacccacggcgggctgcgcgacgcctgggacaccaagcgcttcgagctgttccgggacgagatcgtgcccgcggcggaggcgctgtga

SEQ ID NO: 4619 - DNA, 654 bp, Actinoplanes utahensis
gtgatcgaggcggtcgtcttcgacctggacggcgtgatcatcgacaccgaggaggtctgggaggaggtccgccggggctacgtggccgagcacggccgcgcgttcctgccggacagccaggaccggatgatggggatgagcaccgccgagtggtcggcgcacctggccgacgaggtcggggtgccgctgccggcgtcgcgggtggccgacgacgtgctgggccggatggccgagcgctaccgcgccgagctgccgctgattcccggcgcggtggagacggtccgcgcgctgggcgcccggttccggctggcgctggccagctcgtcggcccggatcctgatcgaccaggtgctggcgacggccgggttgaccggcgagttcgaggtcaccctgtcgaccgaggaggtgccgcgcggcaaaccggcgccggacgtctacctggccgcggtcgcccggctggggctgacccccgaggtgtgcgcggcggtcgaggactccagcaacgggctgcgggcggccggcgccgcaggcctcgcggtggtcgcggtcccgcacggcgtctatccggccgctcccgacgcgctcgcccaggccgccctggtggtgaccaaggtgaccgaggtgacgccggaggcggtcgcggcgttgcgctga

SEQ ID NO: 4620 - DNA, 1167 bp, Actinoplanes utahensis
atggacgtcctgatctcgggtgcgggcatcgccggtcccgcggtggcgcactggctggcccgggccggccatcggccgacgatcgtcgaggtggcgccgcggccgcgcaccggcgggcaggcggtcgacttccgcggcccgctgcacatgggcctgctggagcggatgggggtggtcgaggcgctgcgcgcggtcgagacgcacggcaccgcgttccgcttcgtcgacgagcacggtgatcggctgatggagtggccggcccacctggccggcggcgacctggaggtgcgccgcggcgatctgtcccgggtcctgtgcgcggcgagcaaggcgaccgcatacctgttcggcgaccggatcaccgcgctcgtcgagcacccggccggggtggacgtcaccttcgcctccggcactcagcgcaccttcgacctggtgatcggcgccgacggggtgcactccggagtgcgccggctggccttcggcccggaggagcgtttcgtcaagcatctcggctactacgtcgccacctggccggtcgccaacgagtggggcgatctgggccgcaccgcgctgttgcacaactcccccggccggatgatcagcatcggtcaggaccaccgggatccgagccgggccggggtgttcgccgcgttcgccgcgccggtgctgcgttacgaccggcacgacgcgggcgagcagaaggcgatcctgcgcgccaccttcgccggcctgggctggctgaccccgcggctgctggacgcgctggacgcggccgacgacgtctacttcgaccagatctgccgggtcgacgcgccggagtggacccgcgggcggatcgccctgctcggcgacgcggcgtgcggtgccaccatcggcgggcagggcaccggcaccgcgatcgtcgccgcccacgtcctggccggcgagctggccgcggccggcggtgaccaccgggtcgccttcccccgctaccggcagcgcctcgcgaagttcgcccggggcacccagaagggcggcgacaccaccggccgctttctggccccgcgcaccgcacggggcatccgcctgcgcaactacctgaacaaccggcagtggttcctggacgccacgttcaaggtcgcggccggccgcagcaccgacctccagctaccggaatacccgatctga

SEQ ID NO: 4621 - DNA, 645 bp, Actinoplanes utahensis
atggatttcctgtggcaggagcggaccggcggccgccgtgggccgaaaccggcgctgaccctgtcgtcgatcgccgacgccgcgatcgcgatcgccgacgccgagggcctggccgcggtcaccatgcagcgggtggccaccgacgtcggctacaccaagatggcgctgtatcggtacctgccgggaaagtccgagctggtcgcgctgatgctggagcgtgccatgggtgagccgcccgagctgccggccggtgactggcgcgccgccctcagccggtggtgtgagtcgctcatggcggtgttcgtcggtcacgcctgggctctgcaggcgctgaccggcaaccggccggtggggccgaacgagatcggctggatggaggccgccctggcctgtctccccaccgggctgaccggcgccgagcggatggacaccgtcgccgtcctggccggacacgcccgcgccctggccctacagccggccgagtccgggctggtcaccgccctgacccggcacgccgcccggttccccgcggtcggcgccgcactcgccgacatggccgtgcacggtggcgccgaccaggcattccgatttggactggagcgcatcctggacgggctggagaccttgatcacgaaacgcgtgtga

SEQ ID NO: 4622 - DNA, 1662 bp, Actinoplanes utahensis
gtggccgtgagcggactccggctcgacgtgggcttcgtcgactatctgatccttgcgatctacttcatcaccgttctcggagtgggcttcatggcccggcgggcgatccgcgacagctccgatttcttcctctccggccggtccatgccggcgtgggtgaccggtctggccttcgtctcggccaacctgggcgccctggagatcatcgggatggccgccaacggcgcccagtacggcatgatgaccctgcactactactgggtcggcgcggtcccggcgatggtcttcctcggcatcgtgatgatgcccttctactacggctcgaaggtgcgcagcgtcccggagttcctgcggcggcgcttcaaccagccgacccacctgttcaacgcgatcagcttcgcggtggcgcaggtgctgatcgccggcgtcaacctgtacgcgctggccctgatcctgcaggcgttgctgggctggccgctctggctgtcgatcgtgatcggcgcggcgatcgtgctctcctacatcaccctgggcgggctctcctcggcgatctacaacgaggtgctgcaattcttcgtgatcctggccggcctcatcccgatcaccgtcatcggcctggtcaaggtcggcggctggcacggcctggtggagaaggtgcaggccagcaagatcggcgacgcggcgctgcacacgttcgcgaacaccgccgactccgacaacccgctcggtgcgaactggatcgggatcatcttcggtctcggattcgtcctctccttcggctactggaccaccaacttcgccgaggtgcagcgggcgctgagcgccaaggacatgagcgcggcccggcggaccccgatcatcggcgccttcccgaagctgctgatccccgcggtcaccgtgattcccgggctgatcgccctggtcaccgtccaggggctgggcgccaaggagggtgacctcacctacaacaacgcgatcccgctgctgatgcgcgacctgctgcccaacggtgtgctgggcgtcgcggtgaccggcctggtggcgtcgttcatggccggcatggcggccaacgtgagcggattcaacaccgtcttcacctacgacatctggcagtcgtacgtccgtaaggaccggcccgacggctactacctgcgggtcggccggatcgccacggtgatcggcgtgctgatcgggatcggcaccgcgttcatcgcggccggcttcgacaacatcatgaactacatccaggcgctgttctcgctgttcaacgcgccgctgttcgcgaccttcatcgtcggcatgttctggaagcggatgtcggcctgggccggtttctggtccctgctgctgggcttcctcgcctcgctcaccctctacctggggtacctgggtgacgtcttcagtttcaactccgacctggaggagagcttctggggagccggcgcggcgttcgtcaccgcggtggtggtggccgtgctggtcaccttcttcaccccgagcaagccggaggacgagctgcgcggcctggtctacggcctggccgggtcgagcacgtccggcgagacgatcgtggccggcgaccgagtctggtggcgcaacccggtggtgctcggcgccgtcgccgtggcgctggccatcgttctctacatcccgttctggtga

SEQ ID NO: 4623 - DNA, 243 bp, Actinoplanes utahensis
atgaatcggctcttcgatctgcgcgcggtcatcggcggcatgttcaccctgtacggcgtgatcgtcaccctgatcggcatcttcgacagccccgccgacatcgccaaggcgcagggcgtccggatcaacctgtggatgggcctggccatgctggcgctcggcctgctgatgctgctctggctgcggctcaatccgcccaagccggtcgaggccggcgatgaccgggacacccctgaggtctga

SEQ ID NO: 4624 - DNA, 330 bp, Actinoplanes utahensis
gtgtgcccgagttgccttctcgttgcacagcccccggatatcttcaagaccggtggcggtgcgtccgataacggtggcatggatcccctcgcctcaatcagcagcctcgcctccggcggccagcgctccgctggctggcaggcgcagcttcgggtcgactacgtcgtgaacaaggtgactcagacccatcgtggtcagtccgaggatcaggtcaaacaggctctgtctgaccagctccgagtcttcggcgtggtgcccaacgccaagcagatggccatctacgcgcgggccatcgccgccctgcccgaattaccgcccaacaacaagtga

SEQ ID NO: 4625 - DNA, 1464 bp, Actinoplanes utahensis
ttgcgtgcgttgcgacggccggtcacggccgcgatcctcaccctggccaccctgctcgggttcggccgtccggcgctcgccgcaccggcggtcacctggtcggtctgccccgaggacgcgcatgtcgaatgcggcaccatgcgggtgccggcggactggtcgaacgcgtacggaccgacgatcgagctgcagatggcgcggcggaaggcgaccgacccggcacaccggatcggggtgctgatcgtgaacccgggcggccccggcggctcggcggtcaacatggccctcgacaccgacttcttcagccccgagctgcgcaaacggttcgacatcatcggcctcgacccgcgcggggtgggccgcagctccccggtgctctgctcccaggcgctggtcgacgcgaaaccgtccccgctgatcaccgatccggccgggttcgccgcgctggccggctacaaccggcggctggccgccgactgcacgtcccgcagcggcccggtggtcgagcacgccgacaccggcagcgtggtccgcgacgtcgaagcgctgcgggtggctctcggcgagccgcggatcagcatcttcggggcgtcctacggatcgctgatcggtgagctctacagcgaccggtacccggccacgctgcgggcagcggtgctggacagcgtgatggaccacagcgtcgacgtggacaccttcctcgcccaggagaccgccgcggtgcaggactcgttcaacgagttcgtcaagtggtgcgcccgggacacccggtgcgtgctgcgcggccaggacatcccaaaactctgggccgccctcatgcagcgcgccgcggccggcacgctgaaggacccgtacgacccgccggccaagctcggggtctgggagctgatctcggcggcgttcgccgcgttctacgacccccagtggttctcgttcgcgcactacctgcaggacgcggcggtgccggcccgggcggtcgcgcggcgggcccgcaccgtggccccgccggccgacctcacgccggacagcttcccggcggtgttctgcggcgactgggcgctgccggtcggcgacttccccgcgtaccgccgccgcctggacaacctcgcgaagatcgcgccgcaggtgcgggcgtcgccgctggcgctctccgcggccgccggctgcgtcggctggccggtcgccccggccgccccgcagcaccggttgaacccggccaggatcccgatgctgctcgtcaacgcgctgcacgacccggccaccgggcacgcctgggcgcagcaggccgcggtccagctcggcccgtccgcccggctgctcacctatcagggctgggggcacgtcgcgtattcgcacagcccctgcgtccaggcggcggccgagaaatacctgctcacgctggcattgccggcggtcggggcgacgtgtcccgcggtcgagcccgagccgttcggcatcgggtaa

SEQ ID NO: 4626 - DNA, 1770 bp, Actinoplanes utahensis
atgcggttcctttccgcgctagcagcgctttcactcaccagcctgtcgttgaccgcggtatcggcgcccgccctggccgccaccgggtcgacggcgcagggctacggcggcgcgatcgccaccgtcgacgccaccgccaccgccgccgggctggaggtgctgcgccgcggcggcaacgcggtcgacgccgcggtcgccgcggccgccaccctcggcgtgaccgagccgttcgcctccgggatcggcggcggcggcttcttcgtctactacgacgcccaccggcaccgggtcttcaccatcgacgggcgggagaagggccccgcgtcgatgacccccacctacttcgtgaacccggtgaccgggcagccgtacgccttcgacgaggcccgggtcagcggcctctcggtcggcgtgcccggcaccctggccacctgggaggcggccgcccgccagtgggggacccggccgctgtcccgggcgctcgacgacgccgccgaggtggccgaccgcggctacaccgtcgacggcgagttccgccgccaggtgaccgagaacgccgccgcgttcggacagttcgacgcgaccagggcgctctacctgccgggtggcgcgccgcccgcgatcgggacggtgatccgcaacccggatctggccgacacgtaccggctgatcgcccgtaagggcaccgcagtcttctaccgcggaccggtcggcgccgacatcctgcagaccgtcacccggcccccggtgtcgtccagcccctcctcgccctgggcctacccgatccgccccggcgtgctgaccgccgaggacctcgcttcgtaccaggtccgccgtccggcgccgacaagatccgactaccagggcttgtcggtgtacggcatgtccaccccgtcgagcggcggtaccgccgtgggcgaggcgctcaacatcctggacgcgtccccgctcgactccgcgtcgaccgtcgagaagctgcactactacctggaggcctcggcgctcgcgttcgccgaccggggccgctacgtcggcgcggacaccccgcgcccggtcctggacaccctgctctccgaccggtgggcgcggcagcgggcctgtcagatcgaccctcaccacgcactggtcaagccggtcgcggccgggccgtccgggtgcaccgcggcggccggcgcggacaccccggacaccgggatgagcaccaccaacctgaccgtggccgaccggtggggcaacgtcgtcgaatacacgctcaccctggaacagttcggcggcaacggcatggtcgtgcccggccgcggcttcatgctcaacaacgaactgaccgacttcaacttcaccggcacccagggcgacaatccggacccgaacctgcccggccccggcaagcgcccgcgcagctcgatgtcgccgaccatcgtgctcaaggacggccggccgtacctcgcggccggggcgccgggtgggtcgacgatcatcacgaccgtgctgcagatcctgtacgggcggctcgaactcgggctgaccctgccgcaggcggtcgccgcgccgcgggccgcgcagcgcaacaccgcgggtatccaggccgagcccgcgttccacaccacgtacgggccggagctgaccgcgctcggccatgtcttcgggccggacgcggcggagatcggcgccgccactgcgatcgaattcggtccgtgcgggtcgcagctcgcggtcgccgagccggtccgccggggcggtgggtcggccggggtcgtgcatccgcgttag

SEQ ID NO: 4627 - DNA, 918 bp, Actinoplanes utahensis
atgatcaatgtggtggcggtcgcgatgctggccggaatcgttccggttccggcacttcccaccccgatggcctacgtccgcggcggggacgtctacgtcagcgccggaccggccgagaagcggatcaccaccggggccgggtacgcccgaccccggtggtcaccggacggcaggcagctggccgtgctcagggacggccggctgtggaccatgaagccggacgggaccgggcagcggcgggtcagcgaccggccggccggcggggcgtcctggtcaccggacgggaagtggctggcgttcgcgtccacctcctgcaccggggggccgggcgtctaccggatcgcggccgccgggtcgggcaacccggaagtccttttccccgccgggtgccgcggtgaggacctgcccgaggtcgaagcgccgcagaaggtgaccgggtcgctggccgaccggctgcgggtggacgacgcggtggcctggtcgccggacggcaaacagatcgccttccggggcggggagtgtgacgcggtctacgacgcctgcctgagcatcgggacggtcagctcgggggaggagcggacggtggccgcgtacggcggcggcagcctgcagaacaaggggttcgcggcggtgccggcctggagcccggacgggaaacggctcgcgttcaccgcctaccaggagggggagacggcggctgagaacgagccggtgcacgtcgtcgaatgggatccgggaaccggcgccaagaggacggtcggggtgccccaggaccgggaggcggcgtatctcgacgccgggcacgcactggtcacctcacagacccggggccactcctgggtgacgctggtcgacctgaagaccggcgcccgcaccctgctccaccagggctcccagccgtcggcccggcctcgctga

SEQ ID NO: 4628 - DNA, 705 bp, Actinoplanes utahensis
atgactgagaccccccgcgacacgcccggccccggaatcgacgaacctcggccgatccggacttttcacccgaggcgggggcggatgagcagccggcacgcggacgcccacgccgcgctctggccgctgttcggcctgaccgtcctggacggcgaccgcaccccgctcgacctgccgcggctcttcggccgtgcggcgcccgtcgtcctcgagatcggattcggcatgggcgacgccaccgccgcgatggccgccgccgacccggcccgcgactacctggccgtcgaggtgcacaccccgggcatcggcaacctgctggccctggtcggcgacctcgggctgaccaacgtccgggtcgccctcggcgacgccatgcagctggtccaccggatcgccccggaggcgctcgacgccgtccacgtcttcttcccggacccgtggcccaaggcccgtcaccacaagcggcggctgatccaaccggcgaacgtggccctgctccgcgaccgcctgcaccccggcggtgtcctgcactgcgccaccgactggccgcactacgccgaagccatggccgaaaccctcgacgccgaccccggcctgcgccgcctccccgccggctcgccgcacacccgcccgcgcaccaaattcgaaagacgcggcaccgaggccggccggcccatcaccgacctgcgctacaccagaatctga

SEQ ID NO: 4629 - DNA, 879 bp, Actinoplanes utahensis
gtgggcaagaagaaggctgctgctctgctcgaggaccttgcgccggtcgaggagaccgtcgcggccgaggagaccaccgaatccacttcggtcgaggccgctccggccgcgaccgctgaggccgaagacgctccgaccgacgccgcttcgaccgagaccgctcaggccgaagacgctccgaccgacaccgcttcgaccgagaccgctcaggccgaagacgctccgaccgaggccgagcccaagaaggacaagaagaagaagggcaagaaggccaagaagtcggccgagcccatcaccgacgaggccgccgctgaggacagcgtggccgacgaagccgacggcgccgacgagcccgccaccgaggaagcgccagccgaggccgccgccgacaccgcggacgccaccgaggccgaggacaccgcggacgctccggccgacgacgccaccgaggaagcggcagccgaggagcccgcctcggaagcaccggccgcggaagaggccaccgcggaagagaccgccgtcgaggccaccgccgaggagaagcccaagaagggcaagaagaagggcaagaaggccaagaagactgcggaggccaccgtcgacgcggcgccggccgacgaggtcgaggcgccggccgacgaggaagtcgccgtggcggagacggctgccgaggaagctccgggcgaggaagctcccggcgaggaagccgcgaccgaggtaggccccgcggaggagaccaccgaggagaccgaggccgccgacgaaacggctccggtcgaggaagccgccgcggaagaggctccggctgcagaggccgcggtcgaggacgaggccgcggaggcgcccaagaagggcaagaagggcaagaagaagaagtga

SEQ ID NO: 4630 - DNA, 2298 bp, Actinoplanes utahensis
atgcggcgagaagaccccggcagtggcgccgggctgcccggaagggcgtcggcggcggaagccgcggcactcgcgcgtgcggccgagcttcacggggggacggccgtcgacgagcatcccggcttgccggcggccgccagcaaagctttcggcaaccgtgaggcgcgcgtgggcggtgacttccggcggatggccggcaccggcccggtcgcgggcagtgagcagaccgacggcgggttcggaccggcggacgggtcggtgcggcggcgggtcggcggtgaggtggccggcggggcgcacctgctgcgcgatgtgctcggcggggccatgctgccggtgctccaccgcggtgtgctgaccagcggcaccgccgatcagctggccgcgctgaccgcccgcggggcgcagacgccgagcgcgtgcatccagttcgtcgagggggagaagctccgactgtacggcagctggggtgtcgccgaggactgggcggcgatcgccgacaccccgctgcacggctcgctcggcgggctcgtcgtgcacgggggcggcgcggtgatcgtcgacgacgcgaccgtcgacgaccgggtgccggacggggtggtgcgccggcacggcggcgcgtacctgggacatccggtgcacgatcgggacggacaggtactcggcgtgtgctgtgcctacgacctgcggccgcgcgagtggtcgccggagcagatcaccgcggtggccgaggcggccgaggtcgccaccctgctgatcggcgagcagctggcgcggtacgagctggagcagcagcaccggttcctggacgcggtgctggagagcctgcacgacggcgtgatcgcctgcgacgccgacggacatgtcgtgttcgcgaacgagcggatgcgccgcacctgggccgacgacccgcgggacaccgacgagctcggcctgttccgggcactcgccggggaaccggtgcgcgacgagccgctggcccggcccagccggaccaaacggacccggcactttctgatcgacgcccagccgatcctcggaccggacggtcgggtggtcggcgcggtccaggcgatgcaggatgtgacccggcagcgccgggcggaacgcttccgctcctgcgagctcgcggtgaccacggcgctggccgaggcggcgagcatcgaggcggccgggccgcgggtgctggaggcggtggtcgccaccctcgactgggtgcacgccgagctgtggatggccgacgcgggtgcggcggtgatccgggcggcggcccggttcagcacgccgggctgggcgaccgggatcgccgtgccggacgagctgacctacggtcaggggctggccggacaggcctggcaggtcgacaaaccgctgtggatccgcgacgtgggccactcggacagcgtgatctccccggacagcgcccaacggctgcacgccgcgctggccattccggtgcacgacgggaccgggacgatcggggtgctgaccgtcttcaccgacgcggtcgaggacccggaggacgagctggtcgcgctgatgtccgggatcgccgcgcacctcgggcagttcgtcgaacgccgccgggtcgaggacctgcaacggcaactggtgcgcagcaagaacgaatacctggcgctgatcgggcacgagctgcgcaccccgctcacctcgatcagcgcgtacaccgagctgctgcgcgaggcggacgaggccaccctggtccgcgacgggccgcgcctgatcgccgtggtggaacgcaacgcgctgcaactccgggagatcatcaacgagttgctcgaactgtccgccctggacgccgggcacgccgacgtccggcgcaccccgatggacctggccgaggtggtccgtgacgtggtggaccgcacccgggtggcgatcggcgccgcccccgtggcgatcgacaccgacctgccggccgagctgatcgtgcccggcgaccgggaccggctgcggcacatcgtggagaacctgatcggcagcgcgatccggtacagcccggacggcgggcacgtcgaggtccgcctgcgccgggccgggcgggccgccgaactggccgtctcggacgcggcggtggacgtgccgcaggacgagcgggaaaagctgttcactggtcgctatcggaccagccgcggacatgagcggacgctgccgggcagcgggctgggactcacgctgagccgggcggtggtggaacgccaccacggcagcatcgagctgaccggcgacggggacggcacgaccgttctggtgcggctgccgctggacgcccggtga

SEQ ID NO: 4631 - DNA, 1416 bp, Actinoplanes utahensis
atgagcggcatgacgcgatggactccggatccgacgttctacccctcacccggcgacgcggccggcgcccccgcggagaagctggcgtacatcgccgccttcgaccgttccgccacccgcccggacgcgctcgcggtggtcgacaccgaccccggctccggcagctacggcagggtggtcggctggaccgacctgccgcacaccggtgacgagctgcaccacttcggctggaacgcctgctccagcgcgctctgcccgaccgccccgcacccgcacgtcgagcgccgctacctgatcgtccccggtctgcggtcgtcgcggatctacgtctacgacacccagcccgacccgcagaacccgcggctggtcaaggagatcagcgccgcggagctggcggccaaggcggactactcgcggccgcacacgatccactgcgggccggacggcatctacgtctccgcgctcggcgccggccagggcggcgggccgggcggcatcgcggtcctcgaccaccagagcttcgacgttcgcgggcagtgggaggccgaccgcggcgatcagaaactggcgtacgacttctggtggcacctcacccaggacgtgctggtcacctccgagtggggcacccccgacatgatcgaggacgggctggtgccggagttgctgctcggccggcagtacgggcaccggatccacttctgggacctggccaagcgcaccctggtgcagaccgtcgacctcggcgaccagtaccagatgacgctggagctgcgcccggcacatgacccggccgcgacgtacggcttcgtcggggtggtcgtctcggtcgaggacctttccgcgtcgatctggctgtggcaccgctccggcgggcagttcgaggtccgcaaggtgatcgacatcccggccgagccggccgacccggccgacctgccgcccgccctgcaaccgttctcggcggtgcctccgctggtcaccgacatcgacctgtcggtcgacgacaagtttttgtacgtgtcctgctggggcaccggtgagctgcggcgctacgacgtcagcgacccgttccaccccgtcttcgtcgactcggtgcacctcggcgggatcgtgcggcgcaccccgcacccggcgttcccggacgagccgctggccggcgggccgcagatggtcgaggtgtcccgggacggcaagcgcgtctacgtcaccaattcgctgtacggctcgtgggacgaccagttctacccggacggggtcggtgcctggctggccaaactggacgtgaccgacacgtcgttcacgctggacgaccggttcttcccgcacggcgacgaattccgcggcctgcgggtgcaccagacccggttgcagggcggcgacgcgtcctccgactcgtactgcttcccgtccgcaccgtga

SEQ ID NO: 4632 - DNA, 654 bp, Actinoplanes utahensis
gtgacctgggaaacctatgccgcgctgatcgcgctcggggccttccatgggctgaacccggcgatgggctggctgttcgcggtggcccggggcatgcaggaacgcagccgccgggtgatgctgctgtccctgcccccgatcgcggccgggcacctcgcctcggtcgcgatcgtcgcggcgatcatctcggccacccggtcggtggtcgccgcgaacgtggtcggcatcgccggcggcgcgctgctggtcggcttcggcctgtggcggctgctgtccgaacgccacttccgctgggccgggatgcggctgtcctcggcccagctggccggctggtccttcctgatgtcgtcggcgcacggggccggcctgatgctgctcccggtcctcaccaccaccccggtgccgggcgcgtcccacgccggccacgcgatgccgggcgccggcgccggcggctccccgctggccgccctgaccggcctggcggcggccggggtgcacaccgtcgcgatgttcaccgtgatggccggctgcgccctgctcgtctacgaattcctgggcgtgaacatcctgcgccgggcctggttcaacgtggaccggttgtgggcgggggtgctggtcgcggccggcgcgctgaccatcgccatcaccgcctga

SEQ ID NO: 4633 - DNA, 954 bp, Actinoplanes utahensis
atgtcttcgttcttctcgtcgtctgaggccgcggtgaaccctcggctcagccttctgcaactgtccatcggcggcctcctctggggcaccgccggcgtcgtcgttcaagtcgtggccgggcggaccggactcggcgcggtggccatcgggttctatcggctgctgttcgcggccgccaccatgctcctggtcggggggcgggcgcggcggcagatcggggtggctctccggtccgcgccggggacggtcgtgctggccggggtggggctcgccgcgtaccaggcgctctattttctcgcggtgcgcctcagcggggtgagcatcgcgaccgtggtcagcctcgggctcgctccggtgctgctcagcgtgtgggagacgatccgcacccggcggcggcccgaaaacgcgcaggccggcgcttcggtggcggcggtcatcgggttgctgctgatttcgggcacgaccggatcgaccgggtcgagcaccgggctgggcctgctcgcggcgatcgcgtccggcacggtgtacgccgcgtcgacggcactcagccggcacaccacgcagggggttccaccactggtgctgaccacgctgtcgtgcgcgatcggggcggtcgccctagcgccggtcgcgatcgtgcaggggctgacgttcacgccgggtgtcacgccgatcgtgctgctcgcctacctgggggcgatcaccacggctctggcgtacgcgtgcttctacaccgggttgcggcacaccaccggcagtgtcgccgtggtcgtcaccctgctcgaaccgttgaccgccgccgggctggcggtcgtcctgatcggtgagccgctggcgctgcccaccatcgtcggcggcctgctcatgctcggcgcggtgaccggcctgtacctgggcgccggccgccgcaccacacccgcggcatcgcgccggccggtccccgtcacggactga

SEQ ID NO: 4634 - DNA, 2367 bp, Actinoplanes utahensis
atggacagttgcagaaggctgagccgagggttcaccgcggcctcagacgacgagaagaacgaagacatgcgcgcactccgcagaggtgagtcggttccgggaccggcagcggaacgcagcgctacaacgccgccgagccgagctcaggcagcgacgacaccggctccgctcaggagcgcggcggcgagagacgcccggagaacccgttcacacccccacggtaacccacccgggccgcctgccccgcgtgcaccgcagcccgtcccgccggcctgcccggcacggggcgtcgccgggcctgagccgttgcccgggcctgaagcggcgccaggcctgagccgtcgtccgggcccgaagcgtcggcgacgcttgaagcgtcgcccacgcctgaagcggccgttccccggcgcgggcagcgcgccggggaacgggctcgggggagggccggccggtgactggccgaccgagccaccacggcgggtccgccgtcggtggcgttccgcccggtggccttgcgccggcggggaagcgtcggtgctgggcgaggccgggctggcggggaagcgtcggtgccggctcggcttccggtggtcggtaccggggccgggccggcggcggtggtggtggctgtcaggcggcgggggtggaccagatggcggtgaaggcggcggcctcgccggccagccagctttcgacgtcggcgtggcgggtggcggggttgaggcggtgggtgacgccgcggcggaggtcgaccaggaccgggtcggcgtccgggaggatctggtccatgtgccgggccatcaggtggagcatggcggtgaccagttccggggtgggcggctcctcgtcgaagtggatgcggaccgcctcgcggtggccgtcgtcgaagcgcaggccgaagtgcgggttgatcttcacagcgagggggccgacgctggccagggcatcgcgggtctggatcagcgtgaccgcctcggggtcgccgagcgaggccaggtaggtgcgggcgcccgagcgcagcgactcgtagagcggcttccaccggtctttcaccaggtcgacgacgccggcgagatagctgccgccggtgcggaaggcgatgtccgtcttcagcgctttgatcagctggctgtgcgggttgaaaccgcggcgccgctcccgctgcttgcgcagcccgccgacgaacgtggccttggcgggaccggtgcgcgagacataccgcgtgaagcccagcatcgttgcgtacggcgggatgacgggcacggggttggtcgagatcgtggacagggtggacgtggtcacgtcggtctcctcactcgcgctgcaagccatcgaacaggcgttcgaaaccgtccgaagatcagcagctcagggcccctctttcgtacacacattctaatcgacgggtacgacattcccaaccgcacgggcggcccgccgggcgtcgaggaggatcgatctcggacaggccgggccgtgccgtgccgcggccgcggggccgcggcggaaaggggcggccgcggcggaaaaaggcggccgcggcggaaggggcggccgcgggttccacgaagcgggacgagtgccgcgcccgtgccggtgcgatggccgagaatgggacgtgtggccctgatccgctgtgacttcgactccgaggcgctggaactgcgtacctcgatgacggtgatcctgcccgacgaagacgccggcaccccgccgccggtgctctatctgctgcacgggttgaccgacgacagcaccgcgtggagccggttcacctcggtcgagcggtatgcggccgagtacgggctcgccgtgatcatgcccgaggtgcaccggagcttctacgccaacgaggcgtacgggatgcggttctgggacttcctgtcggccgagctgccggagacggtgcgcaagttcttccgggtgtcggggcggcgcgaggacacgttcgtcgccgggctgtcgatgggcgggtacggcgcgatgaagtgggcgctgcgcgagccggagcggttcgcggcggcggccacgctctccggggctctggacctggcgtacatccaagaacatgatcttcgaccgcacatgcgcgccctggtcgcacgggtgttcgcggaccgggtggtggccggcggtgacgaggatctgctgcatctgctgcgcaccggggatccgggccggctgccccggctgatgctgcgctgcggcaccgaggatcatctgctcgcgcagaaccgccgcttcgtcgccgcgtgcaaggcgcacggggtggagctcgatgtgaccttcagcccgggcgggcacgcctgggactactgggacgcccagctcccggccgtgctcaggtggatgctggaccacaagtag

SEQ ID NO: 4635 - DNA, 1431 bp, Actinoplanes utahensis
gtgcgggacgtgcgcggcgtagcccagcgcggcatgcccgttctgcccgagccggaattcgagcaggttgccgacgctggccggcacctggacccgctgcagccacgactcgtgttcgccgagcagactcttgtcggtggcgtgcgcggtcatgctgaccgggcgggtgtgggggacggccatcgggatcgcgttcagcccgatggtggccttgaccccgaggcggtcgatcaggccggtgagggcggcgatgaagcgctcccactgcaggtccggctcggggccggtgagcagcaggaacgggatgccgagctggtcgcggacgaggtgcagggcgagcaccgggtcgtcgtagctctcgaagtggtcggccacgaagatcatcgggggccggcgggaccggtagtcgagcagctggtccaggtcgaaggtggcgacgacctcgctctccaaattttccagaaggctttcccgggcgagctggatcgcgctgcccgcgtcgacgaacccggtcagcgcctggatgagcaccgggccgtccagggccggcaactccccggccacctcgtagagcccgtgtgggtcgagcacgctgcggacctcctcgaagacgtcgcccgctctcgcgggctttccgctgccaacagccgggccgcagagttcattccggcctcttcgcatcattacgtacgacggggcccgccggatgggtgggcggcgccctgccgggtatccgaccgtgccgacgctgtgacgatggccaccaaacgtctcgcgaccggcctgccatcgcgatcggcggctaagcccccggcggatccgcccgaacctgaaggcgtgccgaggatccggaaagccgtcgccgtcgccctgcccctgctcgccggctcgctgctgctggccgcctgcgcctccgccacgaccccgcaggccgccccgtcgcccaccgggacgccgtggctgctgatggccaccggcagtgtcgccccgtcgccgacccgcagcgtctcgcccggcaccaccccgggcctcgccagcctgccgccgctgccctccgggtcggcgaccccgcggcccagcggcagccccggctgtgacccggcggtcttcaagggcggccagatcaacggcctcgacgtcaccgcgggcagcaccaccgccaccgtgaaatggttcaacccgggcggagaccagctggtcgactaccacattctggcggtcagccagaagctggtggtcggtgcgcagccggagacgccgggctggctcaccgtgacgccgaccgcctgtggctggatgaccgccacggtcaccgggctgatcccgaagacgccgtacgtcttctcggtggacggcatgtggctgcgggcgggcacggacggcacctacacccgcacggtggcgcgctcgggtgtgatcaccacggcctga

SEQ ID NO: 4636 - DNA, 1575 bp, Actinoplanes utahensis
atggagagcatcgtcgacacggtcgtgctcgtggcgatctcggtggtcggcgcggcgctcgcccggcgactcggtttcgtggcgccgctggtcctgctggtggcgggtctggcgctgtcgtacgtgccgggtttcccgcaggcgcacctggagccggagttcgtcctgatcggcatcctgccgccgctgttgtacgtggcggccctgcagacctcggtgcccgccttccgcagcgcgttacgcccgatcctgctgctcgcggtcgggttggtgctgctcagcgccttcgtgatcggtttcgcggtgcactggctgctgcccggcgcgccgctggccgcctgtgtcgcgctgggcgcgatcgtcgccccgccggacgcggtgtcggcgaccgcgatcgcccgccgggtcggcctgccccggcacgtggtcaccatcctcgagggcgagagcctgctcaacgacgcgaccgcgctggtgatggtgcgcatctcggtgagcgcgctgtccgggaccgcggtcggtttcggggagatcggccggcaggtcgcgcagaaggccggcggcggcatcgtgatcggcatcgtcgccgcggtggccgccgcgaagctgcaccgctggatcgaggatccgctgctcgacgacgccgtgtcgttgctcaccccgttcgtcgtggtgatcgtcgccgaggagttgggcacctccagcgtggtggccgtggtgatcaccggcctgtatctggggcaccggatcccgtacctgttgtcggccacctcccggctgcagacggacgcggtctggcggctcgtcaccttcctcctcgaaggcgtcgtcttcctgctggtggggttgcaactgcggatggtggtggacgggatcgagaccggcgtggccaccacggtcagcgtcacggcgctggtcttcgggctgctggtggcggtccgcttcgtgtggatgtatccggcgacgtatctggggcggctcttcccccgggtgcgggcgcgcggcccccgggtgccggtcagcgtgccgaccgtggtggcctgggccggcatgcgcggcgtggtgacgctggccgccgcgcagacgctgcccctgccggggctcagggacgtcccgatgtatccccgggacctgttcatcttcgtggctttcgcgacgatcgtgctgaccctgctgctgcaggggaccacgctgccgggactggcgatccggctgggcgtgcgcgaggacaacagcgcccaggacgcgctggccgaggccggcatccagcacgcggcgagccgggccgccctggccgcgctggaggagaacgcggacggcgcgcccgcctcggtcgtcgaccggctgcgcgggctggtcgagagccgctccaacaacgcctgggagcggctcggcagccagcagcaggaaaccccctcggccgcgtacgggcggctgcgacgcgagatgatcagagccgaacggcacgtcttcaagatcgcccggaacgagggcaggatccccgaggaggtgctggtccgcgcccagcgcgagctcgacctggaagagtcccagctgcgacggagtgaagagtga

SEQ ID NO: 4637 - DNA, 264 bp, Actinoplanes utahensis
gtgatctgccagcatctcaaggagtccggcgagccggccccgctcagcgcgtacgaggacggctgcccgcagtgcgtcgccggtgggttcgacgactgggtgcacctgcgtctgtgcctgtcgtgcggcctggtcgcctgctgcgactcgtccccgcgccgccacatgtcggcccaccacgccgagaccggccacccggtgatgcgctcgttcgagccgggggagacctggcgctggtgtttcgacgacgagcagctcggatga

SEQ ID NO: 4638 - DNA, 933 bp, Actinoplanes utahensis
gtgtttcgacgacgagcagctcggatgaggatcctcgtcgccggggccggggccaccggcggcttcttcggcggccggctggccgaggccggacgggatgtcaccttcctggtccgggagggccgggcgacggtgctcgccgagcgcgggctgcggatcaggagcccgggcggtgagacgcggctgacgccccgggtgatcacccgcgtcgaccggcactacgacctggtcgtcgtggcggtgaagagctatgccctggacgcggtggtggccggcctgggcgccgcgatcggcccgcgcacggtggtggtgccgctgctcaacgggatgcgccacgtcccgacgctgatcacggcgttcggcgtggagcacgtctggggcgggctctgcatgatccacgcgacgaccgacgagcacggcgacgtggtgcagatgaccgggctggcccggttggtgtgcggcccgctcgacggcggcccggacgaccggatggacgcggtggccgcggcgatcggcgaggccggtttcgacgcgcggacctcccggcacatccgcgccgagatgtgggagaagtgggtcctgctggccacgttgggtgcggcgaccacgctgatgcggggctcgatcggcgcgatcaacgcggcgccgggcggcccggaggtcaaccgggcgatcgcggacgaggcgatcgcggtggccaccgcggccggtttcccgccccgcccgcaggcccgggagatcgtccacaccacgatcggcagcagcgagccgaccacctcgtcgctgtatcgcgatctggtcgccggccggccggtggagggcgacgcgatcgtcggtgacctggtcgccgagggccgccggcacggcgtccggacgccgctgctggccgccgcccacaccggcctcgccgtccattccgcctccgtaagctga

SEQ ID NO: 4639 - DNA, 1248 bp, Actinoplanes utahensis
atgaggcggatcctgatgctctcctgggagtatccaccgctgctggtgggcggcctcgggcggcacgtgcacgcgctggccggggcactcgccgcggccggccacgaggtcaccgtcgtgacccggcacgcgcccggggccctcgtcgaggagcacggcgacggggtacgcgtgatccgcgccccggaggacccgcccgccttcgaggtggccggcggtgacctgctggcctgggcgctcgccttcaaccacacgctcacccgggccgcgctgcgtgccgcgcgcggccgccgcttcgacgtggtgcacgcccacgactggctggtcgcccacgccgccgtcaccctgcgcgaccacctggacgtgccgctggtggcgaccgtgcacgccaccgagtccggccggcaccagggatggctgccggccgcgcacaaccggagcatcgacgacatcgaacgctggctgtgccacgaggccaaccgggtgatcgtctgctcggagtacatgcgggccgaggtgacccggcacttcgaagtgccggccggccgggtcgacgtggtgcccaacggggtggacgcgctgcgctggcgggcgcggccgcgggcggtcgcggcggcccgggacgaatatgccgggacgggcgggccgctgatcagcttcgccgggcggctggtctacgagaagggcgtccagcacctgctcgcggcggtaccggaactgcgggaacgctttccgggactgcgggtggtcatcgcgggcgacggcccgtaccggcgggaactggaactcgccggccgcgagctgggggagaccgtgagtttcgccggattcctgaccggccatgatctgaccgcgctgatggcggcgtcggactgctacgtcgtgcccagcatctatgagccgttcgggatggtggcggtggaggcggcggcggccgggacaccggtggcggtggcggcgaccggcggactgtccgagatcgtcgagcacggggtgaccggggtgcacttcccggcgggtgacccgggcggcctggcggcggcggtgagcggggtgctcagcgaccaggagtacgcgcgggggctggcgtcgcgggcccgggcgcgggtggtcgaggacttcaactggccgtccatcgcggcgcgcaccgcgcaggtctatccggtggccgccgcgccgcggatctcctcgaagatcctggcggcgcgggcgatgtccggcgagatccactccgccatgagggtgtga

SEQ ID NO: 4640 - DNA, 1812 bp, Actinoplanes utahensis
gtgttcgaaaacgagcatagagacgacgtgccgcgcatggatctcctgaccttcggtccgcaggtgtgcggcgtccccgcaccggacgccggaacgggacgggaatggctggtcagcgacggtctcggcgggtgggcctcgggcaccgtgagcggcctgcgcacccgacccgaacacgccctgctgtgcgtcggcggaccgggacgcacgccacacgtggcgttggcctcactcgatctgaccgtgacgctcgccacgggcaccaaagtcccgctttacacccatgcgtgggaatccgggcgcctcgatccggccggctaccgcctcctggagacgttcaccctcgccggcggactgccccgctggcgctggcggatcggcgacgtggtgatcgagcgcgaactcgcgatgcggcccggcctcgccgtgatccatcgcgtgctcagcgcgcccggcccggtcaccctgaccgtcgccgcgatgtgcacctggcgcgccgcggccaccagccggcgggccgacggacccgggctgcggatcgagccggccgccgacggggtggtcatcgaggacgcgtaccggctggccggaaccggttggcaggctgccgggcagtggcatctgggcgcccgcaccggcgagcagatcgaggacctgtggctggccgggaccttcggcaagcaggtcggaccgggcgagagcctggagatctcggcctgggccggcgatccggcggtacgcccgccggcgccgccggtggtcctggccgcggcgcgggaacgggcccatcggctggtcaccgcggccaaggcggaggggtacgcgggaaccctggccctggcggccgacaccttcatcctcgacggcccgcaggtggccgacggctacccgtggtcgggccggccggccccgctcgccgcctacgagggcctgttcctcgacaccggccgcgccgacgagggccgcgagctgctcaccgccctggtcgagcagccgtccggcgaggtcgacttcccgctctggctggtgcacgcgatcgaccggcacgtgacccgcaccggggacagcgacctggcccgcgcgtcggccgtcccgctcggccggctgctgcgccagtcgctggccgcctcgcccggcatgcggctggatccgcacgacggcctgctcaccctgcccgccgacggcggccgggccggcaaactcgtggagctcaacgcgctctgggtgaacgccctggccggcctggccgacctgctcgccgagggcgggcgcgacgacgccgagccgcgcggccggcacgcggtcgcccgcgcctcgttcctgcgacgcttcccggcccccgagggctggctccacgacatcgtggaaggcccggccgcgccgtacccgctgggcgccgggacgcagcatgacgatccgacgctgcggccgtaccagctgctcgcctggtcgctgccgcacgggccgatgcgcggcggtggcgacgggccggtccgggccgtgggacgggccctgctcaccccgtccgggctgcgcacgctcgccccggacgaatacggctacgacggctcgcaaccggaccagggccgggtgcggccgtggctgatcgggccgtacgccgacgcctgcgcggccaccggccggccggtcgacgggttgctcgacggcctggccgcgcagctcgccgaagccggcctcgggtcggtcggcgaggccgcgcacggggacgcgccgcacccggcggtcgggcggccgttcgacgcgctggccgtcgccgagatgctacgagtggagacgaggtacgccccatga

SEQ ID NO: 4641 - DNA, 2112 bp, Actinoplanes utahensis
atgcaggtctggcctggtcaccggtatccactgggggcgacctacgacgggaccggtaccaacttcgcgatcttctccgaggtggccgaggcggtcgagctctgtctcttcgacgcctccgggaacgagcgcaaggtgctgctgcacgagcaggacgccttcgtctggcacgcgtatctgcccggtgtcgagcccggccagcggtacggataccgggtctacgggccctacgagccgcaccgcgggctgcgctgcaacccgcacaagctgctgctcgacccgtacgcgcgggcggtcgactcggacatcgactggcatccctcgctgtacgcgtacgagatgggcaaccccgaccagatgtcggacctcgactcggcgccgtacatgcccaagggcgtggtggtgaacccgtacttcgactggggcaacgaccgccggccggacatcccctaccaccactcggtgatctacgagacccacgtgaaggggctcacccagcggcacccggagattccccgggagatgcgcgggacgtacgcggcgatcggccatccggcgatcatcgagcacctcaagagcctcggcgtgaccgcggtcgagttgatgccggtgcaccagttcgtgcacgacaaccggctgcacgacctgggcctgcgcaactactggggttacaacacgctgggcttcttcgcgccgtaccacggttattccgggaccggcacgctcggccagcagacccaggagttccgcggcatggtcaaggccctgcacgcggccgggatggaggtcatcctggacgtggtctacaaccacaccgcggagggcaaccacctcgggcccaccctctcgctgaagggcatcgacaaccgcacctattaccggctggtcgacgaccagccgcagttctacatggactacaccggcaccgggaacagcctgaacgtgcgcagcccgcagagcctgcagctgatcatggactcgctgcgctactgggttaccgagatgcacgtcgacggcttccgcttcgatctcgcgtcgacgctggcccgcgagttctacgacgtggaccggctctccaccttcttcgaggtggtccagcaggacccgatcgtcgggcaggtcaagctgatcgccgagccgtgggacgtcggcccgggcggctaccaggtcggcaacttcccgccgaactggaccgagtggaacggcaagtaccgggacacggtccgcgacttctggcgcggcgagccggccaccctggccgagttcgccagccggatcaccggctcggccgacctctaccaggacgacgggcgcaagccgttccactcgatcaacttcgtcaccgcgcacgacgggttcaccctcaacgacctggtcgcgtacaacgacaagcacaacgaggccaacggcgaggagaaccgggacggcgagagccacaaccggtcctggaactgcggcatcgagggccccacccaggacgagaaggtgctggagctgcgcgccaagcagcgccgcaacttcctggcgacgctgatgctcagccagggcgtgccgatgatctcgcacggcgacgagctcggccgcacccagcagggcaacaacaacgcgtactgccaggacgacgagatcagctggatcgactgggagaacgcggacgagcagctgctcgagttcgcccgcaagctgaccgcgttccggcaccggcaccaggtgttccagcgtcgccgcttcttcaccggtctgccggtgaccgcgcgcggcggcggcgacccgctgcccgacctggagtggttcaccccggacgggcggccgatggccggcgacgactggggcaacgacttcggccgggcggtcgcgctgttcgtcaacggcgagggcatccgcgagcgcggccagtacggccagcggcacgtggacagctcgttcctgctgttcttcaacgcgcacgacgcccccatcgagttcgccacgcctcccgcggagtacggggagaagtgggagaaggtcatcgaaaccgccgaaccgtccccggatcgcccctcggtcgtcgaggccggccacaagatcctggtgccggaccggtccctcatcgtgctcgacaggacggtgtga

SEQ ID NO: 4642 - DNA, 2268 bp, Actinoplanes utahensis
atgcgccccagcagtacgtaccgagtccaagtccgtcccgacttcccgctgaaggccaccgccgagatcgccgactatctggccgatctgggcgtgagccacctctactcggccccgttgctgaccgcctcgcccggctccgagcacgggtacgacgtggtcgaccacacccaggtcagcccggagctgggcggcgcggacggcctgcgggcgctgtccgcggcgctgaagaacgccgggctcggcctggtcgtcgacatcgtgccgaaccacgccggggtggccgtcgccaaggccaacccgacctggtgggacgtgctcaagcgcggtcgggaatcggcctacgccaagttctacgacatcgactgggagcgggggaagatcctgctcccggtgctggccgccgacccgggcgcgctcgacgagctcaaggtcgagggcgacgagctggtctactacgacaagcgctacccgatcgcggacgggaccggtggcggcaccccgcgcgaggtgcacgaccggcagcactacgagctggccgactggacccgtggcgactccgagatcaactaccgccggttcttcgcgatcaccgagctggccgggctgcgggtcgaggacccggaggtcttcgaggccacccacgccgagatcctgcgctgggtccgcgagggcctggtcgacggcatccgggtcgaccacccggacggcctgcgcgacccggcgggatacctgcagcggctgcacgacgccgctccggaggcctggctggtgatcgagaagatcctggagccgggcgagccgctgccccgctggccggtcgccggcaccaccgggtacgacgcgatggccgaggtcaacggcgtgttcgtggacaccggcacggaggccttcttcgatacgctggaccaccacctgaccggcgccaccgtcaccttccagaacctgacgcacgacaccaagcaccacgtcgccacccggctgctcgccgccgagctcgcccggctcgcccggctggtccccgaggtcgaggcggcgccgcggggcctcgcggagctggccgcctgcttcccggtctaccgctcctacctgccgggcggtgcccggcatctggcgcaggcgcgcgccgaggccggccgtcggcgtccgcagatgatcagcacgctggaccggctcaccggccggctgcgcaaccccgccgacgagctcgccatccgcttccagcagttcaccggcgcggtgatggccaagggcgtcgaggacaccgggttctaccgctggacccggttcgtggcccgcaacgaggtgggcaacgacccgacccggttcggcgtctcgaccgacgagttccacgagtgctccggcgcccgccagcaggactggccggacacgatgacctcgctgagcacccacgacaccaagcgcggcgaggacgtccgggcccggctggcggtcctgtccgaactgcccggcgactggaccgaggtggtgcgccgctgggtccggctcgctccgctcccggaccccgcgctggcccatctgatctggcaggtcacggtcggcgcgtggccgctgtccaaagaccgattactggcgtacgccgtgaaggccgcccgggaggccgcgacctccaccacgtggcagcagccggacgaaccgttcgagaccgcgctgcgggagatggtcgaccggatctacgacgaccccgacctgcaccgcgaggtgaccgatttcgccgcctcgatcaccccgcccggctggtccaactcactgggccagaaactcgtccagttgaccatgcccggcgtcccggacgtctaccagggcaccgagctctgggactactcgctggtcgacccggacaaccggcggccggtcgacttcgccgcccgccgcgagttgctcggccgtctcgacgacgggtggcagccgccggtcgacgagaccggcgccgccaagctgctggtggtcagccgcacgctgcggctgctgcgccggcggcccgagctgttccgctcctaccggccggtgttcgccgaggggcgcctcggtgagcacgtgctcgccttcgaccgcggcggcgtggtggcggtcgccacccgcctcccggtcggattgtcacgccacggcgggtggcacgacaccaccctgtcactcgacggccacagttggacggaagtgttcacgaataccagctacggtggaaaccgcctggccgtcgccgatctgctgcagacctatcccgtcgctctcctggtgaaagaatga

SEQ ID NO: 4643 - DNA, 1734 bp, Actinoplanes utahensis
atgacaaccttcgaggtatgggcgccggagaagtcgcccaagctgcgcctggacgaccaggagcacgagatggagccgggcgacggcggctggtggcgcctggacgtgcccaccgccggtcccggcaccgactacgcgtacgtgttggaggacgtcgccgccccggtccccgacccgcggtcggcctggcagccgcagggtgtgcacgggcccagccgggtctacgaccacgccgccttcacctggaccgaccagcgctggcccggccggcagctgcccggcgcggtgctctacgagctgcacatcggcacgttcaccccggccggcacgttcgacgccgcgatcgagcgtctcgaccacctcgtcgacctcggtgtcgacctggtcgaactgctgccggtcaacgcgttcaacggcgagcacaactgggggtacgacggcgtctgctggtacgccccgcacgaggcgtacggcgggccggacgggctgaaacggttcgtcgacgcggcccacgccaagggcctgggcgtggtgctcgacgtcgtctacaaccacttcggcccctccggggcgtacgcgccgatgttcgcgccctacctgagcgccgggcagaacacctggggcagctcgctcaacctggacggccccgactccggcgaggtccggcggtacatcgccgacagcgtgctgatgtggctgcgtgactaccacatcgacgggctgcggctcgacgccgtgcacgcgctgcacgacgagggcgcggtgcacctgctggaacaactcgcggtcgaggtggagtcgctgtccacggcgctgcgccgaccactgacgctgatcgccgagtccgacctcaacgatccgaaactgatcaccccgcgcgaggccggcgggtacggcctgcacgcccagtgggacgacgacgtgcaccacgcgctgcacagcctgctgaccggggaacgccagggctactacggcgacttcggctcgctggactgcctgcgtaccgtgctggagggcgcgttctaccacgccggcacctggtcgtcgttccgcaaccggcggcacggccgaccggtcgaccggcagcgcaccgcgggccaccggttcgtcgccttcctgcagaaccacgaccagatcggcaaccgggcgatcggcgaccggctcaccgccacgctgtccccgggactgctcaaggtcggcgcgacgctgctgctgacctcgccgttcacgccgatgctcttcatgggcgaggagtgggcggcgagcagcccgtggcagttcttcaccagccaccccgagccggagctggcggccgcggtgcagaccggacgccgccgcgagttcgcccggcacgggtgggccgaggcggacgtgcccgacccgcaggacccggccaccttccaacgatccaagctggactggtcggagctcggcaaaccggagcacgccgagatgctggccctgtacaagaagctgatccggctgcgccgtgaggtgcccgacctgaccgatccctggctgtccgaggtcgaggtgtggcacggcgaccagttcgtggtgatccgtcgcggccggcacgcggtcgcggcgaacctcgccgagacgccgcagacggtgagtctgcgcgccgttccctcggcggtgctgctggccaccgccgacggcgtcatcctggaacgcgaccgggtcgtgctgcccccggaaagcgccgtggtcgtccgcacctcgcgctga

SEQ ID NO: 4644 - DNA, 453 bp, Actinoplanes utahensis
gtggagcgggtccggcacgatgtggccgtgacgaatgtgcccgacgaccttgtcgccgccgagccggacgagccggggaagcggaaccggtggtatgacaactgcgactgcggtcccgggtgcgatctgccggattgcgacgttcccggctgtgactgcgatggtcccggctgcgatctcttccgattgagcagtctgctgaccgttgtcgcgctgctcgggcatcgatcgaccgaacggcccgcggaacgcctggtggtggccgccatccggggttaccggaaagtgtcgccccggctgcccacccggtgccgattcacgccgacgtgcagcgcctatgcgttggcggcgatacaaaagtacggtctgggcagagggctgcggctggccgccgatcgactgcggcggtgcgggccgcgggtgccgctcgggaccggcgatccggtgccgtga

SEQ ID NO: 4645 - DNA, 1368 bp, Actinoplanes utahensis
atggggtctgtgggacaaccgccggaatcggcgtcggacagcggggcttctccgggcactacgcggattccggctgctccgggtgtttccgggccgccgggcgtctcggctcccgcttcttcgccgggcgggtcgggtgcttcctcggcgggcagggtgggtgcttcttccgcgggcgggtcgggtgcttcttccgccggcgggtcgggggtgcgggactccttccgcggtggggcgctgctcggtgacctggccggcgggattccaccgcagctgcgccgggtgtggaagctgcggcggcggaccgtggaggacatcgccgcgcgcgacatcgcggtgcaggaggcggtcgacgaggggcggctgccactgccggtggagcccgggacgctgcccgagccggagccgctgccggagcgggccgaccggttcaacatggcggcgctgcgactggccgggctggggctggcgctggcgctggcggtcgggatgaccatggtgcggctgctggtgggcgggccgccgtcggtcgccgatctgcgggcccagtccggcgtggacggctggccggtgctgaccgtcggcgtcaaggacgatcagtacgggacggcgtactacaacgagaaaacgaagatctggtcgggattcgacatcgacatcgcgtacatgatcgccgaagatctcggtttccgtcgcagccaggtgcacttctacggcatggagtccgaggaccgggcgcggatgcaggcgaacgacgagaaaggcaatcgcgtcccggtcaagatggtgatcgcgagttacagcatcacaccggaccggatcgccgccggagtgaccttctcgcagccgtacctttacaccgaacagtcggtgatcacgctgaccggacacagtccggtcgccgccctggaggatctgcgcgggcagaacgtctgcacgctgtccacctcgaccagtgaggccgcgccgtcgcgcgtcggggccaacgtggtccgcaagaaccgcgtccgggaatgcttcgccatgctcgacaagcacgaagtggacgcggtcaccacggacgccgccatcctcgccggatggaaagcggaattccccgcgaaatacgcccactgggacctcggactggacgccaccgaggcgtggggcgtgaacgtcggcgacaaccccgccttgaagaagctggtcgatctgacgctgtaccgctcctacgccgatccgcacgacgaccggtgggagaatgcgttccggaacaatctgcaggtcgaggtggcggagaacggcaagacgccgatcgcggtcgccgagcagccccgggtcacccggcccgacgtccggcagctcccgtgggaggacccgctgggatga

SEQ ID NO: 4646 - DNA, 1026 bp, Actinoplanes utahensis
atgaccgactactacgccaaaggcccggtgatcgcgccccgccggcggcgcgcccagctcaactggctgctcaccgtcctgccggccttcccgctgatgctgctcgtcctgcgggtctggtacctgagccgccaggacctgccgaccatgctgctgatggtccagtacatcaacccgctcggcatgatcagcgccctgttcatcacgctgagctgggcgatccccgcggtgatcctgatcctgcgggtgctcggcggaatcctgctggtgagcaacccgggcgacgccggacggtcgccgatcgcggtcgccgcgctgcggatgcccgactgggtggtgctgatcgccgtactgatcgccggcttcacctggcagctgcgcctgctgccggcgctggagatgctggtggtcgcggtgctcgggctgaccgcggtgcaacgcctgcgcgtcggacgcccggtgatggcctggaacaccctggtcgtgccgatcctggtcggcgtgctcacctggatcttcgtctggcccggggtggtcagtgcgatccgcggtggcgaacagggcaccgcgctgatgctcgcggtgccgccgctgctcggtccgctgctcaccgggccggtcccggcccgctgggcgcggctggtcacccactggccggccgtggccgccgccaccgcgctgccgatcgtcgtcggcgtggtcttcctccgcgcgccggtgctgccgcgcagcgccatcgaggtcgggccgccggacggcccggtgcgcgaggtgatcgtcgggcagctgatcgcggtcgacgacacctccaccaccatgctgctgtcgacgggtgaggttaccttcattccgaacgggcagatgcgatccaagattctctgtccggagccggtgcggccgccggagagcgcggtggcggtccgcggctggccggtcgaggagaccgtactggaatggatcgcgccgacacggaaggtgaccgaaatcgatcctcgatgcctaggacggccccatgacccggcctga

SEQ ID NO: 4647 - DNA, 723 bp, Actinoplanes utahensis
atgaccttgcacctgcggtgggcagccgtcaccgatcaaggacacgtccggagcaacaacgaggactgtcattacgccggtgaccggctcctcgtcgtcgcggacggcatgggcggcatggccgccggcgatctggccagccggatcaccgtggagtccatggtctcgctcgacgccccgatcgacaccgacaaccagatggacgcgctgcatcgcgggctggaactggccaatcggcggatcgccgagacggtcgtcgccgacccctcactccagggcatgggcaccacgctgaccgcggtgctcttcaacggcgagcgggcggccatggcgcacgtcggcgactcgcgggcctacctgctccgcgacgggcggctcaaccagttgaccaaggacgacacgtacgtccagatgctggtcgatcagggcctgatcaagccggaggaggcggccgggcatccccgccgggcggtcgtcacccgggtgctgcagggcgagccggtcagccccgcctacgtgatcgtcgagccgcaggccggcgaccggtggctgctctgcagtgacggactgaccgtcgtggtgaacgatgtgaccatcgaagaagagatgcgaaccgttcccgaccccaaggcgtgcgcggagaggctcatcgatctggcgttgcgcggcgggggaccggacaacgtcacggtgatcatcgccgacgtgaccgacggggactga

SEQ ID NO: 4648 - DNA, 2901 bp, Actinoplanes utahensis
atgctcgcggcccggacactggtggtgatcacgacggcgcgcttgatcgggactgtggcgctcgccctcgccgtggtggcggtcggcgagttcgtgggcgcgccccggctctacaccgacaccgcgcagctcgccgcgggcgccatcgcggcgtgggcctgcctggtcgtggcgcgccaccggctcggcatcccgcgcagttggcggcggctcgcggccggcggcctggccgcctggacggcggtccgcgtctggtgggtggtgcaggacgccgccgggcacgaccggctcgcccacccgaccctcttcgacgccggcttcgtggtgctgcccgcctgcatgctgatcggtctgctcacggccacccgcacccggccccgcccgatacccacctcgccgcggcgcgaccaggtggcgctgctcatcgacagcgtgctgatcaccggatcggtgctggccctgggctggtcgctgatcccggcccggacactggacgtcatcgccagctggcagaccctcggctggtgggtggccgcctacccgatcgccgacctggtgctggtcaccatggtggtgctgctgctgaccacccggcccgactcgccggccggccggcggccgctgatgctgatcggggccgggctggtcgcgttcggggtggccgacagcgtacgcctcctcggcctctgccccgcctggctggaaaccgccggccacctgctcggcccggggtgcatcgcgctggccgcgctcagcccggccgccccggccccgaccccggccgaccggacgacgacgcaacgggactggttccacctgctgctgccctacgtgccggtcctggtcaccggcgtggtgctgctggcccgcacggccaccgggcatccgctgacatcgttccaggcctacctcgggtggctcggcctcggcctggtcgtgacccggcagatgatcaccatcctggacaacacggtgctgctgcaccgggtcgcggaaacccaacggcggctgcaccaccaggcgtaccacgatccgctgaccggcctggcgaaccgtgccctgttccgcgaacggctggtcctggccctcgacgccaaccagcacctgggtactccggtggcggtcctcttcgccgacctggacgacttcaaactgatcaacgacacctacggccacgcgatgggcgaccgggtgctgcacgccatcggtgagcggctgcgcgcctcggtccgtccgcaagatctggtggcccgtctcggcggcgacgaattcgcggtggtgttggaccagagcgacacggtgccgccgaccgtaccgcgaccccgcggggcggtgtcggcgctgcggcgggccatgggacggcggcgggggtatgtgctctcggccgccggcatccgcgtctccgcggcgtcacgcgcggcgtcccgcccggacggtggccggcggtccggcgacacccgtcccgcgcgccgccgcaccgacttcccgccggcggcgtccggttcggagtgggccgcttttcccctcgctcccgcagggtctccgaaccacgccgatgattccgccggctccgcccccgctgctgcgggttccgggtcgggggccgcttcgcctaacaccggtgcgtcctcaggttcggtcgccgttccctctgctgcggcctcggcttctgctgtgccctctgctgcggcctcggcttctgctgtgccctctgctgcggcctcggcttccgctgcaccttccgctgcggcctcggcttccgccgtgccctccgctgccacttctgcttccgctgccgccgggccgcgggcggcggtgtcgtcgaacggtgcggctttccccggtgcgggggcgtcggtgaacggcgcgggttccggcggggaggggtggccgtgggtggtggaggcggaaggggtcggcgagcgggtgctggccgccctccgcgagccgtacgtgatcgacggccgctccgtcaccgtcggcgccagcatcggtctggtcgctgccgaacccggcgaccgtctctccgccgacctgctgctacgtcgcgcggacgccgccatgtacgcggtcaaacgccgcggcaagggcgccatgatccgctacaccggcccggtccacggcccgagcgccgacctgccgcaactgctggccggcgcactcagcggcggcagcccggccgcggccggtttcgaggtccactaccagccgatcgtccggctcagcgaccgcgccaccgtggccgtggaggcgctggcccgctggaccgacccggtcgccggcccggtccaccccgacgtcttcgtcaccatggccgaacgcaccggcctggtctccgccatcgacgacttcgtgctggaccaggcctgcaccgacgcgcacgccctcgccgaacggtacggccgtccgatcgccgtccacgtcaacgtctccgccggccgcctcggccagcaaggcctggaagacgccgtcgacgccgccctgacccggcacgcgctgccgcccgaccgcctggtcgtcgagatcaccgagaccctgcgcatccccgacctgccgcgcgccgccgcggtggtcgaacgcctgcgcgcccgcggcgtccgggtcgccctggacgacttcggcagcggctacaacgccctcgcccagctgcacggcctggcggtcgacacggtgaagctcgactcgacgctgaccgacgtcgacaccgccccggaacgagccggaaccctctgccgctccgtcctggccatctgcgcggacctcggcatcaccgtcgtcggcgaaggcatcgagaccaacgagcgcgccgaggccctggcagcgctcggctgcccgctgggccagggatacctcttcggcccaccccgacgtctgtccgaactcgatcaccccaaccgctga

SEQ ID NO: 4649 - DNA, 774 bp, Actinoplanes utahensis
atgacgaacacgttcacccccgcggagaagacctggctgtcccggctcggctcactgcgccaagtggtgcggcaggaggtggtggcacggcaactggcgcagcgcctgagacctgacgcgcccagggtgctcgacgtcggctgtgggcagggcacgcaggcgatccggctggcccggcagggctacgacgtcaccgccctggactcgtccgagcagatgtcggcggcactgggtcgcgcgctgagcgaggagtccacggcggtgcgctcccgggttcatgcggtccgggccgatgcgagccggctcgccggaaccttctcgccgggctgcttcgacgtggtgctctgccacggcgtgttgatgtacttcgcggatcccggcccgttgctgaccgacctcgcccggatgctggcgcccgggggcacactgtccctgctggtccgtaacgccgacgcgctcgcgatgcggccggcgctgctgggcgactgggcgatggcaggcgaggcgttcggcacgacgacgtacggcaatcgtctcggcatccgcgcccgggccgatcggctgtccgatctgaccgccgcgctggccgggcgggggcttgaggttttcgcctggcacggcgtccgggtcttcaccgacacggccgctgatgacgctccgctgccggcggacaacgaactcgcgcggatcctcgactgcgagacccgggccggtgccacggatccctatcgcggggtcgcggccttgacccacatcttcgcccgccgtccctga

SEQ ID NO: 4650 - DNA, 141 bp, Actinoplanes utahensis
gtggagctggtggcatcggtcgtgggcggtgcggtcgtcggcttcggttggtcaacggcgtgggtggtgggcggtgcggtcgccggcttcggttggtcaacgacgtgggtggtgggcggtgcggtcgccggcttcgggtga

SEQ ID NO: 4651 - DNA, 678 bp, Actinoplanes utahensis
gtggcccgccgggtgcggcggctcggcgccatcaccctcagcagcagacgactgaccgatcccgatcccgccgcggtgcgggccgccctgctgaccggcctccgcgagacgggcctcgggctgctcacctggaaccgctccgccgacgaactccgcgcccggctggccttcgcccacgccgcgctcggcgacccgtggcccgacgtttccgacaccgcgctgctcgaacacgccgccgactggatcgatccgggctccgccaggcgccggtccgacctggccaaaatcgacgtcaccgcggcgctgcggcggctgatgccgtggtcggtcgccggccggctggacgaggtcgcgcccgagcggctgccggtgccgagcggctcgcagatccggctggactactccgacccgggcgcgccggtgctcgcggtgaaggtgcaggaggcgttcggctggcgggacgccccacggctggccgacgggcgggtgccggtgctgttgcatctgctctccccggccgggcggccggtggcggtgacccgtgatctcgcgtccttctgggtgcagggctatccgcaggtccgcgcggagatgcggggccgatatccgcgccatccctggccggaggacccgatgaccgcggcacccacccgccgggccaacccgagatcccgatga

SEQ ID NO: 4652 - DNA, 1749 bp, Actinoplanes utahensis
gtgctgattcgcgccgacgccctccccgacctaccggttcgcgacctgctgccggaggtgaccgccacgctgtccggagccggggcggcggtgctggtcgccccgcccggcaccggcaagaccacgctcgtcccgctcgccctggccgacgccggccgggtcatcgtcgccgagccgcgccgggtcgccgcccgcgccgccgcccgccggatggccacgctgctcggcgagccggtcggcgagcgcgtcggttatgcggtgcgcggcgaccggcgcgtctcccggcgcacgctgatcgaggtggtcaccaccggcctcctggtccgccggctgcaaaaagatcccgagctgtccggtgcctcgacggtggtcctcgacgagtgccacgagcggcacctcgactccgacctggccctggcgttcctcgtcgaggcacgcgcggtgctccgccccggcctgcggctgctggcgacctcggccaccgccgacgccgaccggctggccgaggtgctcggccagcccggcagcccggcgccggtgctcaccgcgcacgcgcgcacccacccggtcgaggtgatctggtccccgccacccggcccggtcgcaccaccgcacgggctgcgcgtcgaccccaaactcctcgaccacgtcgcggcgaccacccggcgggcactcgccgagggcgacggcgacgtactggtcttcctgcccggcgcccgggagatcgagctggtggccacccggctgcgcggcgtcggcgccgacgtgctgccactgcacggccgtcagtccggcgagacacaggacgccgcgctgcgcgcgggcccgcgccgccgggtggtgctggccacagcgctcgccgagagcagcctgaccgtgcccggggtgcgggcggtggtcgactgcgggctcagccgggtgccgagaatggaccactcgcgcggcctgggagcactggtcaccgtcccggtgtcccggtcatcggcggtgcagcgggccgggcgggccgggcgcgaggcgccgggccgggcctatcggtgctgggccgaggcgcagcatgagcggctcccggcgcagtccgagccggagatcgcggccgccgacctgaccggcttcgcgctcgacctggccctctggggcgacccgtccggcagcggtctggcgctgcccgaccagccgccggccggggcgctgcgggcggccgtcgccacgctgcgcgacctgggtgcggtggacaccgacggacgggtgaccgcacggggacgggcgctggccggggccgggctccacccacggctggcccgggcgttgctcgacggggcggcgctggtcggggcgcggcgggccgcggagatcatcgcggtgctcgacgatccgcgatccgcgacagacgatctggtggcggcggtgcggcgggcccgggccgcgggtgatgccggttggcgatcggaggtacgccgattgacctccgccgcggccaccgacctgccagcccccgccgccgagccggcagcggcggccgcggccgccggttcgggctcgggagcgagtgccggtgcgggtgcggccggggctggggctggcgctggggctgcagctgggcctggggctcggattccggatgatctggctacgggcttggtggtcggcttggcctatcccgagcgggtggcgctggcgcgtgagccgggtggcccgtcctatctgatggctggcgggaccgccgcggacctgccgctagctagctag

SEQ ID NO: 4653 - DNA, 717 bp, Actinoplanes utahensis
gtggtcttgccggtgccgggcggggcgaccagcaccgccgccccggctccggacagcgtggcggtcacctccggcagcaggtcgcgaaccggtaggtcggggagggcgtcggcgcgaatcagcacgcggacagtctggccgattccaccgacaagttttcgcggcctgtggacagccgccggttatccacaggcccggttccggcgtggcgaaaggtggcagggtggccgtgttgccttttcggtccgccggcgcacgccgcgggcccggcatgttcgagtgatcaatggaggggtgcggtggggatcttcaggcttcgcgggatcaccgggtcgcggcggaggcgagtgcccggtgcctgctgacgacggcacggccgccgaggcgcacgcccggatctcgacgcacatcctcgacaccggcaccggtgatccggccggagacgtctacgtgcggctggaacgccacgacgcggacggctggtcgacggtcgccgagggccgcagcgacggcgacggccggttgcgcttccgggtgccgatgcgcgactggcaggccggtggctatcggctgctgttctacgtggagccctatctcgggcaggactgcttcttcccggagatcatggtggccttccacgtccgtgacccggaccggcagtatcacgtgccgctgctgctcaaccggtacggctacaccacctatcggggaagctga

SEQ ID NO: 4654 - DNA, 1536 bp, Actinoplanes utahensis
atgaccgagatcctgtctgacgcggccgtggcgttcgtcgccgatctgaaccggcggttccggccgcgccgcaacgagctcctccaggcgcgtgccgcccggcgggccgagatcgccgcgggagccagcctgggcttcctggcggagaccgcggacatccgcgccgccgagtggtccgccccgccggccccggccgacctgcaggaccgccgcgtcgagatcaccgggccgaccgagcgcaagatgaccatcaacgccctcaactcgggcgccaaggtgtggctggccgacctggaggacgccaacaccccgcactggtccaacgtggtcgacggtcagcagaacctgtacgacgcgatccggcgcacgatcacgctggagaccgacaagaagacgtacgagctgaacggcggtccgtacccgaccatcgtaatgcgcccccgcggctggcacctcgacgagcgccacctgccggtggacggcgagccggccgtcggcgccctggtcgacttcgggctctacttcttccacaacgcgaaggagctgctggagcgcggcagcggaccctacttctacctgccgaagatggagtcgcaccgggaagccgcgctctggaacgacgtcttcacctatgcccaggagcagctcggcatcccggtcggcacgatccgcgccaccgtgctgatcgagaccatcccggccgcgttcgagatggaggagatcctctacgcgctgcgcccgcacatctccggactcaacgccggccggtgggactacctgttcagcatcatcaagtacttccgggacaacccgcggatgatcctgccggaccgggccgcggtgacgatgaccgcgccgttcatgcgggcctactcggagctgctggtctccacctgtcaccggcggggtgcgttcgcgatgggcgggatggcggcgttcatcccgagccggcgcgacccgaaggtcaacgagatcgcgctggccaaggtcaacgaggacaaggagcgcgaggccggcgacggtttcgacggttcctgggtggcccaccccgacctggtcccggtctgccaggcgatcttcgaccgggtgctcggcgacaagccgaaccagctgtcgaagctgcgccccgacgtcgccgtcgacgcccgggacctgctcgacgtcgcggcgctggacgcccaggtcaccgaggccggcctgcgcaacaacgtcaacgtcgcgctgcaatacctggaggcgtggctgcgcgggaacggggcggtggcgatccacaacctgatggaggacgcggccaccgcggagatctcccgctcgcagatctggcagtggatccacaacggggtcaagctgcccgacggcaccccgatcaccgcggaactggtcacccggatcgaggacgaggagctcgccaagatcaaggagacggcgggggagggcggccggttcgacgacgcccgcaagctgttcgagcgggtcgctctcgccgacgacttcgccgacttcctgaccagcgcggcctacgactcgatcgactga

SEQ ID NO: 4655 - DNA, 1518 bp, Actinoplanes utahensis
atgatcacgccgcagaccgcgctgagcgcggcgagccgccaccttcgcgtcatgcgcggaagggtacgccacagggtcgccaccttccgcccggaggggtgcagcacgtggcaagagaccgcggcgccgatccgcaactccgcgaagcgcggcgagtcgatccggaaccccgcgaagcacggcgagtcgatccggaactccgcgaagcacggcgagtcgatccggaactccgcgaagcacggcgagtcgatccggaactccgcgaagcgcggcgcgtggatccggaaccgcggcgcgtggatcggaacccagccaaccgcagcgcgccgatccggaacgttcatgggacagaatggggcggtgccccgaaccgtgaccctggtgctggtcgacccggccggtgacctgctcggtgcgatgccgccgttctccgtcgccagcccctggtggcaggaggtggccgaggtggtggcggcggccggcgccgaggtcaccgtcctgcgcctgctgcacgccgaccggccggcgccgcccggcgggcacgtcacctacctcgccgagacccgggctcggcctgccgggctgaccccgctcggcgccgacctggtgccgcacgccctgcgcgccccgtgggccgagccgggcggccccgccgtgacgctggcctgggcggccggcgtcctggaccggctcgggtttcccggcctgaccgccgtccagcagcgcacctggaacctgtcggcgatctggcggatggacggcccggacggcccggtcgcctggctcaagcaggtgccgccgttcctcgcgcacgagccggccgtgctcggcctggtcgtcgaggtcgcgccgagcctggtgccctacgtgctggccgccggcagtgcggggcggatgctgctggcacacgtgccgggggaggaccggtacggcgccggcgccgacctgtgcgcccggatcgccgaggctttccacccggtgcaggagcactacgccggccgtgtcggcgaactggccggtgtccccgaccgtcggctggacgccgcgcggttcgccgccgtcgccgcgccctacctgtccggcatcccgggcctgaccggcctgatcgacgacctgccgcgccggctggccgccgtggccgcctgcggcctgcccgacaccctcctgcacggggacctgcatcccggcaacgtccgcaccgggtccggcccggacagcctcgtgatcgtcgactggggagacgcggcgatcggcaaccccgcgttcgatctgctgcgtctcgtcgacgggctggccgatccggagccgatcgtcgcggcgtgggcacggcgatggcgggtgacggtgccgggcagcgatccggagcgtgctgtcgagctgttgcggccggtcgccgggttgtggaatgccgccacctacgccggtttcctcgccaacatcgagcagtcggaatggccctatcacgccggcgacgtgccggactgcctcgccgcggcggtcgccgcagccggagcgtga

SEQ ID NO: 4656 - DNA, 1146 bp, Actinoplanes utahensis
atgagtacggtgtgctgcatgacggatctgcggcggcgctatatcgatctgatccggcaggacggcgtgtccctgtcgccggagttggccacggccttcgggtcggtgccccgggagttgttcgtgaccggtggtttccaccggcgtgacggcagctggatggagccggtcgacccggatttcctgcccactgtctacagcaacgacgtcctggtcaccaaggtggacggcgaccggccgatcagctcgtccagccagccctccctgatggcgatcatgttggcggccctcgacgtccggccggggatgcggatcctcgagatcggcgccggcaccggttacaacgcggcgctgctggcgacgctcggggcggaggtgaccagtgtggaggtgcaggaggacgtcgccgcccacgcgcgtgccgcgctggcccgggcggggatctcccgggcgcgggtcgtcaccggtgacggttatccgggatctcccgatgcccggtacgaccgggtcatcgtcacggtgggtgtcgccggcctctcaccccactggttcgcccagctggacccggctggcttcgtcgtcgcgccggtcgagcacgccggccaccatccggtgctgacggtaaccggatcgggcaccggccgggtggtctgctcggccggtttcatgggcgccgccggcccgctcggcgcccgccacccgggcagccacccgcccccggccggcgtactgcacggcctgaccgaaaccgccccgccccgctgggatccgccgttggacagcacggcctatcgggatctctggtacgcggccggcgcctgggaccgccgggtcacccgcgccacccttcccgcgggggaggtcgtccgccgggatgcccggcatgccttccgcagcggtgaggacatctacctgaccctgctcgacgagaccggaaccggtggcgcggtgctcctcccggacggctcggtgctggccggtggcggtgacgcggaccggcgtaccgccgacgccgccgccctgatcgaccgctggcatcgccggggtcgtccgccgatgcgcgcctggcaggtcggcctgacccgggccggcgacccggatgccccgatcctggtccccacgacgtggcagcctgccgacgactaa

SEQ ID NO: 4657 - DNA, 120 bp, Actinoplanes utahensis
gtggcagccggccgacgatcaggagcgacgtggcagccggccgacgatcaagaacgacgtggcagccggccgacgatcaagaaggacatggcggccggtcaggagcgggcgcccaggtag

SEQ ID NO: 4658 - DNA, 669 bp, Actinoplanes utahensis
gtgcccgcggtgaacgcaagcgccgccgcccgggtcgtgctggccgaggacggggtgctgctgcgggaggggctgatcggggtgctcgggcggttcggcttcaccgtggtggacgcggtgggcgacgccgagcacctgatcgcctcggtcggcgtgcaccagcccgatctggtggtcaccgacatcaagatgccgcccggcttccacgacgagggcctgcgggcggcggtcgagctgcggcggaaccgccccggcctgccggtggtggtgctgagtcagtacgtgcaggaggagtacgcgtcggatctgatcggcaccggcgacggcgtcggctatctgctgaaggaccgggtcgccgacatcgaggacttcgtggcggcgctgcgtaccgtcctggccggcgggaccgtggtcgacccggaggtggtgcggcgcctgctgcaccggccacgggatccgctggccgggctgtccccgcgggaacgggaagtgctggggctgatcgccgaggggcggtcgaactcgtcgatcgcggcggcgctgttcgtcagcgagaccgcggtcggcaagcacatcggcaacatcctgggcaagctcggtctgcccccgacggacgacaccaaccggcgggtcatggcggtgctgacctacctgggcgcccgctcctga

SEQ ID NO: 4659 - DNA, 1116 bp, Actinoplanes utahensis
ttgcggcctgaccgtgctgctgctcccgctgctggtcgccggccgcgagatcctgcacggtcacccgccccggccggccgtcgtcttcctggtcgtgatcgccgccgggatgctcgccgtcgccgccccgctgatcgcgctgccggtcgccgcgctggaacgccgccggctgcgcctggtcgacccgcgcccgctgcgcgcacccggccggccggaccggccgccgcgctccgggacgaggcgacctggcgcgcggtgctctacaccgtgctgctggccctgctcgccccgccggtcttcctcgccgcctccctctgggtgtccgtcgaggcgctgatggtggccagcccgttcggcatcggcacctgggagttcggcaactggcaggtgcacggcggagcgcacagcatcccgctcagcgtgctcggcgtcttgctggccccggtcacgctctacctggccgggatcctggcggccgggcacgcgatgctggcccggcggctgctcggcgccggtgacccgctgcgcgaccagctcagcgacgtggcccagtcgcgggcccggctggccgacgcgttcgacgccgaacgccgccggatcgaacgtgacctgcacgacggcgcccagcaccggctgaccagcctcaccctgcacctcggcatggcccggctcgacctgccggaggactcgcccgccgcgggcccgctcgggcaggcgcacacccaggcgaaggagttgatggtggtgctgcgcgacctggtgcacggcatccggccgcaggtgctgaccgatctcgggctgccggcggcgctgcgcgagctggccgccacctcgccggtgccggtcaccgtcgagaccgacatcgtggcgcggccgcccgaggggatcgagaccacggcgtacttcgtggccgccgaggcgctcaccaacatcgccaaacatgcccgggccaccgccgcccgggtccgggtgaccggcgacggcacccgcgtcgatctggagatccaggacaacgggcggggcggggccgacccggcggccggcaccgggctgaccggactcgcggaccgggtggccgccgccggggccgctgctgctggccagctagctagctag

SEQ ID NO: 4660 - DNA, 1647 bp, Actinoplanes utahensis
atgcgcgcggcggacagggggcttacggtgagggcatcatcgacctcagaggggttgcccgtgccattggaggactggcttctgaccgccgccgaacgcggcaacccgcacaccggcatacccacgtggtccgctggaaacaccgccgaacccctgattcacggaaaaaggtacttcgcccggctgaccgagcgggtggagaagctccaggcgggtgaccacctgttcttcaccgactggcgcggcgacccggacgagttggcggtcgacggcggcccgacgatcgccgagttgttcgccgcggccgcccgccgcggggtgatcgtcaagggcctgctgtggcgctcccacctcgacaagctggcgtattcggaggaggagaaccggaacctcggtgaccagatccgggaggccggcggcgaggtgctgctcgaccagcgggtccggcgcggcggctcacaccaccagaaactcgtgatcctgcggcatcccgggcagccggcgctcgacgtcgcgttcgtcggcggcatcgacctgtgccacagccgtcgcgacgacgacgatcatcacggggatccgcaggcggtgcggatggcaaaggcgtacgggccgaccccgccctggcacgacatccagctggagctgcacggtccggtggtcggcgcgctcgatctcactttccgggaacgctggcgtgacccggccccgctcgatcagcacgggccgatctccaccgccatcgacctgctgaatcacgccgatctggacgccgatcatctgccgccgcaaccgccggacccgccggagtgtggcccgctgaccgtgcaggtgctgcggacgtacccggcgatgcgcccgaaatactccttcgcgccgctcggcgagcagagcatcgcccgcggctacaccaaggcgatccgccgcgcccggaaactgatctacctggaggatcagtatctgtggtcggccgaggtcgccaagctgttcgccgaggcgctgcagaccaaccccgagctgcacctggtcgcggttgtgccacggcacccggacgtggacggccgcttcgcgctgccgcccaacctggtcggccgggagcaggccatcgaactgtgcaagcacgccgcgcccgatcgcgtgcacgtgttcgacctggagaacaccgagggcacgccgatctacgtgcacgccaaggtgtgcgtgatcgacgacatctggtgcagcgtgggcagcgacaacttcaaccgtcggtcatggacccacgacagcgagctgtcctgcgcgatcctcgacgacacgcccgacgagcgcgagccggccgacccggccgggctgggtgacggcgcccggcgtttcccccgcgatctgcgactcgcgctgacgcgcgagcatctgggcctccccgccggcgccgggtccgccgagctcatcgatccgatcgcggtcgtacgaaggatggacgcggccgccgcggcgctgcgcgactggcgcgacaacggccggcacgggccgcgcccgccggggcacctgatcccgcaccagaccgaacgcctcccgtggtaccagcgcgcctgggcgacccccgcgtaccgcctgatctacgacccggacggccgtccctggcgcgatcgccgggccggccggtggtga

SEQ ID NO: 4661 - DNA, 126 bp, Actinoplanes utahensis
atgagcagtgagccgctgaccaccgacgtcgtacccgaagtcgccgaatccgccgagaccggactgctcgtcacgatgctgctgctggtgcttttcggcaccgcagcgatgctttacctcttctga

SEQ ID NO: 4662 - DNA, 1200 bp, Actinoplanes utahensis
atggactggattccgcgtttcgccgaggtcgtggtccgggcaggggtcaacatccaacccggacagggtgtcgtgctcaacaccgacaccgcccatctggaggtcgcccgggcggtggtcgaggcggcctacgcggccggcgcggcctgggtcgagccggtgtggagtgacgggccgatgcgccggtccgcggtcgaccactccgatctggccgacctcacctcctcccggccgtgggcgctgcagcgcatccgcgagtgggccgaccagggcgccgcctggatcaccctgatcggcgacgccgacccgcacctgctcgacggcgccgatccggcgaaagccgccgcgatccgcaccggggagatggtcgcccggcgcgacgcgatgatcggcaagctgcgctggacggcggtcggcgcgccgaatcccggctgggccacccaggtctacggcgagcccgacctggagcggctgtggcaggccgtcggcatcgcgatgcgcctcgacgaggacgatccggtgcaggcgtggcggcagcgctcggcgacgctggccgagcgcgggacggcgctggacgcgctgggtctgaccgaggtgcgctatgtcggggagggcaccgatctcacggtcggcctgatccccggctgccactggaccgggggcggcatgatcgacgacgccggcatcccctacctggcgaacattcccaccgaagaggtgttcaccagccccgaccggcggcgcgccgacggcacgctgcgggtcaccaagccggtggcgatcggcgggcgggtggtcaccgggctgcggctgaccttcgcgggcgggcggatcaccgcggtcaccgcggacgagggcgccgacgtggtgcgggcccagctggagaccgacccgggtgcgcgtcatctgggcgaggtgtcgctggtcgacaaggagagccggatcgcgcggaccggcacgctgttccacaacatgctcttcgacgagaacgccgcttgccacgtggcgtgggggcagagtttcccgttcgccgtgccgggcggggtggcgatgaccccggagcagcgtgccgagctggggctgaactcctccggggtgcacaccgacgtggtggtgggcggcgccggcatcacggtgaccggcaccggcccgcgagggacggtagagatcatccgggacgacgagtgggtccttgtttga

SEQ ID NO: 4663 - DNA, 237 bp, Actinoplanes utahensis
atgaccgaggcaaccgacctcgccgccgccgcgagcagcgccgacccccgggtcgggctgcgcgccgtggtggcactgcgccgcctgctggagggcctggagcacctgcaggtggccaatgcgcgcaaaagaggctggtcctggcaggagatcgccgacgtgctcgaggtgacccgccagggcgtacacaagaaacatgcgcacctgatgccgatgaccgatccacgggagggctga

SEQ ID NO: 4664 - DNA, 624 bp, Actinoplanes utahensis
atgttcgagcgattcaccaaggaggcccgcaccgtcgtggtccgcgcccagatggaggcccgcgaactgggccacacggtgatcggcaccgagcatgtgctgctcggcctgctggctcaggacagccgggccgccgcggtgctgcaccgggccggcatcgagcgcgcccgggtccgggacgccgtggtgcgcgccgtcggcgaccgcaccgacgaggccgccgtcaccgccgaccaggatgccgaggacgcggccgcgctcaaggcgatcggcatcgacctggacgccgtccgggccgccatcgaggagaatttcggggccggctcgctgcgcctgccccgcccggcgccgaagaagagggggatcttcggcaaattctccgcccccaccaccggcggccacatcccgttctccaaacggaacaagaaggtgctggagcttgccctgcgcgaggcgttacgcctcaagcacaagttcatcgcacccgaacacatcatgctcggcgtcatccgcgagggtcagggcctggccatgcggatcctcgccgaccagggcaccgacttcgaccggctccgcgccgacctcgaccgctccctcgaagccggcgccgccaaccgttcctga

SEQ ID NO: 4665 - DNA, 951 bp, Actinoplanes utahensis
atgcctgcaatcaccgtcgatgacgttctcgttctgccgcgcctgccgaagctggacccggtcgcgacggagtttcggccggttcgccgcctgacgaccgcgccgcaggggtacgagggtgagggtttcccggtgcgccgggccttcgccggggtgccgctgagcgagctcgacccgttcatccacctggaccagatgggtgagatcgactacgcgccgggtgaacccaaggggaccccgtggcatccgcaccggggattcgaaacggtcacgtacatgatcgacgggatcatggaccaccaggattcgctgggcggcggcggctcgatcaccaacggcgacactcagtggatgaccgcggcgagcggcattctgcacatcgaggcgccgcccgagcacctggtcaccagcggcgggctgttccacggtctgcagctgtgggtgaacctgccggccgcggccaagatgatcgacccgaagtaccaggacatccgcggtagggagtcggccctggtcaccacgccggatggtggggggctgatcaggatcatcgcgggtgaggtcgccgggcacgccgggccggggtcgacgttcacgccgatcaacctgacgcatgtgacgctgcagcccggggcgcgactggacctgccgtggcagccggattacaacgcgctggtctacaccctctccggcgagggctgggcgggcaccgacatgcggccgatcagactcggtcagctggccacgttcggggcgggcgacgcgatccgggtggaggcgaagagcgagctcgacctgttcatcatgggtggccggccgatccgcgagccggtggtccactacggcccgttcgtgatgaacacgaaagccgagctgcagcaggccttcgaggactttcagaagggtcggctgggcgtcattccggcgagccggctgccgcacaccgattga

SEQ ID NO: 4666 - DNA, 1176 bp, Actinoplanes utahensis
gtgcgttccgccgattcgggcggctaccttcgtcgtgaccgcctcgggcagtgcagtccagtcaatgcgcatcgatcagttggcctttcagattcccgggtggggcgggcaacaggacttcgcctcgccgacccggcactcggggtcgacgaagtagccggtggcctgcaacgccgggagcatgtatcccatggccgagccgtcggccatgccctcggtgatgatcggtacgtggtgcacgaagcctcccgcgatctgcttgcccgcggcgagatacggctcggcgtgttgcagcgacacgtgtcaggcgatgtcgaccggctcggtcgggacgacgcggaacgaccggccgtcgggcagcagccggccgaagtcggggtgatgatgacggactacacagacctccttcccgtcgcccatcaggcggttgacctggcacggaagatcatgcgcacgatgcaaccgggtgcactgaccgccaagggcgaccgcgacatggcgagtgaggtggactacgcgatcgaggaccaggtccggaccttcctcgccaagcgcattccagagatcggctttctcggtgaggagaacggcctcagcgggacaacggagaggctggtgtgggcgctcgacccggtagacggcaccgtcaacttcgttcacggttccccgctgtgcgctgtctcgctcggcttgatcaccgagaaccgctccgttctcggcgtcatcgacttgccctttctcggtagccgctactccgcggccgagggcaacggcgcccatgccgacggccagcccatcctggtcagcacgacgcagcgaatcagcgatgcggtggtggcgctgggcgactacgcggttgggcaggacgccgccgagaagaaccgggcgaggttcgcagtcacgcaacggctcgccgcgagcgtgcagcgtgtccggatgcacggatcagctgccatcgatttggcgtggctggccatcggtcgggtcgacgccgtcgtcatgctggccaacaagccgtgggacaccgcggccggcgtggtcatcgcgcgcgaggccggcgcactgatcgccgaccgcgacggctcgccccacagcttcgcgtcgtccgcgacgatcgccgccaaccctgggctgctcagcggcatcctcgatcttgcgggcggcgaccacaggtag

SEQ ID NO: 4667 - DNA, 867 bp, Actinoplanes utahensis
atgcgcattgactggactgcactgcccgaggcggtcacgacgaaggtagccgcccgaatcggcggaacgcacgccgtccccgccgaggccggcgaccacgcggagatagccgcaaccgtcagcgggactgccgggaaggttttcgtcaaggcggcctgcaccgagttcggcgtccggtcactgcgctacgagctgcgggtgagtgaggccgtgaaggggcctcactcgcccgcggtcgaatggcacttcgaggcggccggctggctggtcgtgggcttcgagcactgcgacggcccgcacgccgacctgtcaccggggagcccacaccttgatcttctggctgaggcgctgacagggctcggcaagacactggcgcccgaggtgccgctgttcacgccgacgggccggctcgggttcccacatccggcgatggacggtgacgttctcgtccacagcgacctcgccccgaccaacttgatggtgagctcccgcggcctgttcatcgtcgattgggcattcgccaccagagcggcgccctgggtggagctggcaatgctgacacagtggttgatcggtagcggccacacgcccgagcaggcggaacactggctggcgcggtttcccgcatgggctgaggtcagcccggacgtccttgacgacttcgcctcgaagaacgcaacgaagtgggcatcgagagccaagcccggctcgccggcctggatgcacgacctcgcggactggaccgggcagtgggcaagtcaccggcgtgcggcggaggagacccggatcgtgacgatcccgcccggcccgcggcgggcggtcaaggcggatcccggtgccggtctggggaccacgccgccgaggtga

SEQ ID NO: 4668 - DNA, 156 bp, Actinoplanes utahensis
atgaccgacctcctcgacccggagagcgacctgtccggcacgcaggcggccgtcgatgcggccaacgggcagctgcacgagatcatggaccggcagacggatctgcagcagtccgccgagtgctccggcacccacctcgaccgttggtactactga

SEQ ID NO: 4669 - DNA, 1176 bp, Actinoplanes utahensis
atgagcgaaacgcaggccgccccgcccccggcccgctggcgacgggcagccttcgccctggcgacggccgccgccttcctgttcggcatgcccgccggaccagccggcgccgcccccacggccgccctttcccggattgccgccggatatgcgcacagttgcgccatccgcaccgaccacagcctgtggtgctggggcggcaacagcaagggtcagctcggcgacggcagtaccgtcagccacggcagcccgacccgggtcggcaccgccggcgactgggccgccatcgacgccggcaccagctacacctgcggcgtccgcaccgaccacagcctgtggtgctggggcgccaacacccgcggccagctcggcgacggcagcacgaccagccggaacacgccgacccgggtcggcaccgacagcgactgggcggtcgtcaccaccggcgacagccacacctgcggcgtccgcaccggcggcaccctgtggtgctggggcttcaaccggctcggccagctcggcaccggcatgtcggtgtacaccgcgaccacgccgctgcaggtcggcaccgccaccacctggtcgaccgtctcggccggtttcgcacacacctgtgccacccgcaccgacggcaccctgtggtgctggggcgacaacggcgacggccagctcggcctcggcgtgctgaccccgtcggtcaccccggcgcaggtcggcaccgccaccaactgggcgacggtgaccgccggctacgccttcaactgcgccacccgcaccgacggcaccctgtggtgctggggcgacaacggctacggtcagctcggcgcgggcggcacgtaccagaccgcgcccgcccaggtcggcagcggcaccacctggaccagggcggacgccggcttcaacaccgcatgcggcgcccggaccgacggcaccctgtcctgctggggcaacaacgccaccggccaggtcggcgacggcagcacggtcaaccgcggcaccccggtccaggtcggcgccaccaccacctggaccggcgactacgccaccggctaccagacgtgcggattccgcgccgaccagagcctgtggtgctggggcaacaacgccaacagccagctcggcgacggcaccaccactcagcgcaccaccccgggccaggtcaccctgcccagctga

SEQ ID NO: 4670 - DNA, 450 bp, Actinoplanes utahensis
atggccgaaccgctcagcgagacccagatgcagcactggcgcgcgttcatcgagagctcgtgggcgctgcacaccgcactggaggacgagctgcgcgccgcgaccggcctgagcatgaacgactaccacgtgctcgtcgcgctcgccgaggctccggaccgccggattcggatgggcgagctggcgaaccggctggtgctgtcgccgagccggatcacctaccagatcagttcgatggtcaaacgcggactcgtcgagaagcagagctgcccggacgacaagcgcggctacgaggcggtcctgaccgatgccgggctgaccgcgctgcgcgaggccgccccggcgcacctcgaaacggttcgacggcgattcatcgaccggctggagcccgacgagctggcggtgatcggccgggcgttcgccaagatcagcgacgcgcatcgctcctag

SEQ ID NO: 4671 - DNA, 777 bp, Actinoplanes utahensis
atggagcggcacatgcggatcagaggctatgcaccgatgacaccctgttgggtggagttggcgagtgcggaccctgcgcgagcggcgcagttctacggagagttgttcggctgggagtcagccggtgaccgcttcaagctcaacgggcgggccgtggccggcctgacccgcagcgggtccgaccgtccggacgggtggctgacgcatctcagcacgcccgacctggaggagaccctggagcaggtggcactggccggcggcacctgcctgagccacccggccgacgcgcacggagggcgccgggcgatcgtggcggacccggccggcgcggtcatcgggctgtgggagccgtccgacttcgcgggggcgcaggccggcggcgagcccggcacgatgtcctggccggaactgatcactgacgacacgcacaccgccgcccggttctacgggtccgcgttcggctggctgctgcgccacgacttcggcgtcggcgaatggctgaaccaggcgcacgacgcgatcgccggactcaccccgggctaccggggcgcctggtggcgggcggcgttcgaggtggaggacatcgtggaggccgcggcacgctgcgagcgtctcggcggggccctgatcgccgagccggccgaggccggcctgaccgaattcgccgagctccgcgacccgttcggcgcccgtttcacggtcgccgcgctggtgcaccacccggtcgagctgaccgtttcgctcggctcgctgcccgctttccagcgcttcgcataa

SEQ ID NO: 4672 - DNA, 2124 bp, Actinoplanes utahensis
atggtcggctcgggagcggcacgcccgccagcgatctccacgctgcccgtgcagtccgccggtgcgaagggctgcgcggccctggtgcatgccttcgactggtcgcgcacctcgctcggcccgctcgagcggtgggatcacgcggtgcgcacggcggtcgatcttatgctggagtcaccggtcgcgatgatgctggtctgcggcgccgactacgtggtgctctacaacgacgcctacgccgaggtgctgggcggccggcacccggtggcgctgggccggccggccgtgcaggcgttcggggaggcctgggaccagccggggatgagcgacgtgatcggccgggtgttccgcaccggccacgccgtgctggagccggagagtcaggtcacgctgcgcccgggtggcgcggagccggccttctacacccgcgggcattcggtggtgcgcgactcgcacgggacgatcgccggggtgctgaccgtggccgccgagaccacccaggtggtgcaccggctgcagagtctgggtgagctgaccgcacggctggccggcgctctcaccatcgacgatgtcacgcgggtcgtcctgacgtacgccatggcgtcctttgatcttgatcattgcgccctggccgtcgacgacggcacggcctaccgtttcgtccgccggatccgcggcgagatgctcgacgaggccgacgagcgcctccccccggtctggcgccggatcgccgccgaccaggccgcgcctctggtcgcggcggcggagaccggcgcggcgaccttcgtcgccgacggcgagccgctgcgggccgtcgcgcaggaccggcacgagcggcgggtgcgctccctggccgccctgccgttgcgcaccccgtccgtgcgcggggcgctgaccatggggttccgccgcgcccatgcctggctgccggccgagcgtgccctgctgcgcgccgctgccgagctggtggcgcaggccgccgagcgggcccgccgcttcgaggcgcagcacggcaccgcccagttgctgcagcgcagcatgctgcccgagcatctgcccgagctggacacgttccggatcgccgcgcgctatgacgtgggcgtcgacggcaacgccgcgggtggcgacttctacgacgcgttccgcctgctcgacggtcggctggcgatggtgctgggcgacgtggccggccacgatgtgcgggccgccgcggtgatggggcaggtccgggcggcgctgcgggcgctggcgctgaccgatccggccccgccgagcgtgctggccgggctggaccggctggtcggctcgctgggtgccgagtcgcggaacgaggagatcttcgtgaccgtcgtctacggcgtgctcgatccggcggacgggtcggtgacgctggccagcgccggtcatccgccgccggtgctgcgccgggccggcctcggcggcgggccggccaccgcggagctggtcaaggtgccgccgggcgccccgctcgggctgggcggccgctggcagaccggaacgctgacgctggagccgggcgacaccatcctgatgtacagcgacggtgtcgtcgagcgccgcggccacgcgttgaacgccggcctggacgccctggtcgcggccgccgccgggtcggccagcggcgatccgcgcaacatgtgctcgctggccaccgccgcggtcgcgggcaccaccgacgacgacgtggcggtgctcgcggtcgagcacgcgctggccatgagccggtcggcgacgatgcatgtggccgccgagccgaccgggccgagccgggtccggcagtggatgtcggcccggctgcgcgagtggcaggtgccggagccggtgatcggcgcggccatcctgtgcaccagcgagctcaccaccaacgcgctgctgcacgccgggaccccggcgcaggtgcacatcgacctgaatctggagcgtctgctggtctcggtggccgacaccggcacccggggcagcgtgatccgggcacgggccgacacgctcgcgagccgcggccgcgggctcggcctgatcgaggatctcagcgactcgtggggcaccgaccccacggtgcgtggttcgacggtctggttcgagatgctgctcaacagagagtga

SEQ ID NO: 4673 - DNA, 747 bp, Actinoplanes utahensis
atgtcgcaccggccgaccgtccgattcttgacgatctgcgagacagtcgccccgcactgcgtcaccgtgcgtgatctggcgtgtgacctgcgtgttctcagatcatttatagtcgccgccgtgactggtgacaccacgggggagcccgtccccggcagcgaggcgcaggctcccgtcgagggcgggctggacgggtggtccgcgtcggcggagacggccgcggtgccggcgccggcgccggccgaggagatcctcggattcgccgcgacctcggaaccgtatccggtggtaccgcggctgcggctcgtggtcccgccggcctccgccacgcccggcggtccgccctcgggcgttgcgtcggccgctgtcgcgatcgtgcgcggctggctgtcccggcgccggccggtggtggcggccggcggcgagacggccgacaccgggacgccggcggtgctgagcgcggtctaccactacgacgacggcagccaccggggctcggtgcaggtggtcaacgccggtggcggggaggcggcggactggaccgtcacgctcagcgtgccgggcggcgagccggtcacggtgacctccggggaggtcgcggtggcacagtcggggacggtcgtcacgttccggccggccggtgcggcgctgggcgccggcgacacggtcaccttcggcttcgggttcgcggcggcgccgacgagcgctcccgtcggatgtgccgtgaacggttccgcccgctcctga

SEQ ID NO: 4674 - DNA, 357 bp, Actinoplanes utahensis
atgaacggactcttcagcaacgccgccgcccgcgctgccctccgctccgcgcacgcctcgctcgccgacctgaccgccgccgtcggcgtcagcggtctcgccgccgcccaggccaacccgggcctgatgtccgtcatcgaccagcacgcggccggcgtccgcgacagcctcgacgccgacacccgcccgctcaccccgatcctgctggccgcctacgccgagggcgtccgcgacgccgcgttccagcacggctgggtggcccccgagggcgagatcgactggtccgagaacgactgggtcctgcgtcgccttctcgccgtctgcagcctcgcccgcacgctgcccaacccgcgctga

SEQ ID NO: 4675 - DNA, 498 bp, Actinoplanes utahensis
atgacgggtgggaacgggacggccgcggaggcggcacgggggaacgggacggccgcggaggcggcccgggagagcggaccggatgcggcgcatcggcggcccgacggcgtggacgatgtgaccgtcgaagccctggggaagttgagcgaggcgctggagaccgtggagcgcgtccgggggcacctgtactcgctgcaccagctgatcgggtcggcggacttcaagctcgacgaggcggtgtcgctgttcatgcagggtgggcagaccgcgatcgcggagcggatcgagcgcgagctcatcgggcgcaacgtcgtgccgggtcggtggacgtttcagctcgtcgaagagttcgatgacgggtattacagcgagttccgccggctggagcgcgaggctcgggaggaactcgtgggcgggcggcgtcatctctacgaggcggagctgaaggaacgccggcgaactcacggacgtcccggccacgaggcccggccccgctga

SEQ ID NO: 4676 - DNA, 312 bp, Actinoplanes utahensis
atggttgagcggctccgacgcaacactgagggcaccatcggacaacgcagaatcggccgaacgggtgacggcgatccggacttatcgcgccagaatttccgggtgcgatctgccggattcctgtctgaacgtcagcgccgcctcgcgtgggtcggcttcctcctggccgccttccaggcgcccctggcggcgaagctcatcgctgacgcctcctggttcttcgccgtcgtggtggccctggtggtcgcgacggtcatcatcgccgacgacgcgcagcgtcgccgcccccgccaggccaactaccaggagtag

SEQ ID NO: 4677 - DNA, 762 bp, Actinoplanes utahensis
atggtgccctcagtgttgcgtcggagccgctcaaccattgccgtgatcggtgcgtctgccctggtcggagcgctgtttgcgggattcttccggcgatcaccgcaggtggcgcagccgatactaccagtaaccgagagagtgcaggcgggtccgctgctggatcgcaccggggcctggttgacggtgggggacccggccagccgggtccgggtgcagacggcgaccctgccggggctgctctaccggatcagcgcggcttccgacgccgggatcgtgccggtggtgacccggcgcggtgggcgggtggcggtgcgattccgggctacgcagggtgacggtctggacgaggtgcacatcgtgttgaaccgggatgtccggtgggacatccggctgccggccgggggcggcgagcagcagctgaacctggcggacggccaggtgagccgggtggagctgggcgcgtccgggctggccgaggtgacgctgccggacccggccgggacggtgccggtgacgttcaccggtggggtgggcaccgcggtgctgcgggccggaccggcggcggtgttccggatccgtctggagggcggagccggagcggtggagacaccctgggtggtcaacaacgggacgccgtccggcgcggtcctgcaggaggccgggtggccccgggccgccgaccggtacgcggtccgcgcggtggccgggatgggcagtgtgatcctgcgccggagcgggccggacccgcggccgacaccctga

SEQ ID NO: 4678 - DNA, 183 bp, Actinoplanes utahensis
atgaccgatcacgtcgaaggcgcctggcgcgacgagaagaaactgccggtggacgagctgacccgggcgatggcctcctgggacaccgacgggcaggacgacccgagcgacaacgagtacgggcggcaacccgacgaccgggacgcccggccgagcaccacgggactgaccggaccacagtga

SEQ ID NO: 4679 - DNA, 465 bp, Actinoplanes utahensis
gtgagcacggtcaccgagttcgttgacgtcaacgtcccggtccgcacctgctacgaccagtggacccagttcgaggagttcccgcgcttcatggagggcgtcgaggagatccagcagctggacgacacgcacatgcactggaagaccaccatcgccggggtgacccgggagttcgacgcgaagatcaccgagcagctgcccgacgagcgggtggcatggaccgccaccgacggcgagaagcaggccggtgtggtcaccttccaccgcctggacgacacgcacacccgggtgacggtccagctcgacttcgacccgcaggggctggtcgagctcgccggcgacaagctggggctggtcgaccgccggatcaagggcgacctgcaccggttcaaggagttcatcgagagccgcggcgggatcaccaccggcagctggcggggccacatcgaccggcccggcatctga

SEQ ID NO: 4680 - DNA, 399 bp, Actinoplanes utahensis
atggaacggggaaacagcaagcacggcgcggtgctggacgaccagatggcctcggaggtccggggcatcttccggggtccggccgggggacgcgccgacgagtcgcacacaccggagcccgccggagaggaccagccggaggtcaccatcgccccgaacggcgatttcggccgcggcgtcccgaacggcgtcggcagcgcacagggtgaggccctgagccggttcggcagcttcctgggccgcaacgccttcccgggtgaccgggccgcgctggaggcctcggcgcgcgccatgtccgccccggacgacgtgctgcgccggatcggaacgctgcccgaggggcagacgttccagaacaccgctgaagcctggcatgcgagtgaaggaggagacgcgtga

SEQ ID NO: 4681 - DNA, 1584 bp, Actinoplanes utahensis
atggtggatgcgatcgtcgtcggggccggccacaacggattggtggccgcaaatctgctggtggacgccggttggtcggtccggatgctggaggcggccggggagccgggcggtgccgtccgctccggcgagttgaccgcccccgggtacctttcggatctgttcagcgccttctacccgctggggttcgcgtcgccggtgctccgggacctgcacctggagcggtacgggctcgcatggacgcacgccccgaacgttttcagtcacgtgctgccggacgggcgggccgccacgatcagccgggacctcaccgcgacgatggcctcgatggaggcgttcgcgcccggggacggcgagcggtggaaacacgcgtacgacgactgggcggacgtctcggaccgcatgctcccggtgatcctgcggccgttcccgccggtccgggacggtctgcggctggccggccggctcgggtcggtggattccctgcgcctggcccgccgcctgatgctctccgcccgggaactgggctcggagctgttcagcggcgagggtgcccaggtggcgctggccggttgcgcgctgcacaccgacctgtcgccggaggaggcgggtggcggggtctacggctggctgctgtccatgctcggccaggaggtgggctggccggtgccggtgggcggggccggccagctgaccgccgcgctggtccggcggctgaccgagcggggcggcgagatcgtctgcgggacccgggtgagccgggtgctggtggcgcgcggccgggcgatgggggtgcggaccgtggacggccgggactggcgggccgcccgggccgtggtcgccgacgtgccggcgccggcgctgttcctggacctggtcggtgagcggtggctgcccggtcggatggccgaggacctggcgcacttccgctgggacggggccacggtgaaggtggactgggcgctgaccgggaggatcccgtggcgtacggccgaggtggccggctccggcacggtgcacctgggcgccgacctgaacgggctgacccggtactccggcaagatcgccaccggagaggtgccggagcacccgttcctgctgctcgggcagatgaccacggctgatccgtcccggtcaccggcggggacggagagcgcctgggcgtacactcacctgccgcaccgcgaggactggccggccgacgagatcgcggcgcacgtggagcggatggagggggtcatcgaggaacaggcgccgggcttccggaacctgatcgccgggcggcacgtcttcgccccgggcgatctggaggcggcggatccgtcgctggtcgggggcgcgctgggcggcggcacctcggccgcgttccagcagctgttcctccgtccgatccccagcctgggccgcgccgacacgccggtcgaccggctctatctgagcagctcgtcggcgcatccggggggcggcgtgcacggcgctcccggggcgaacgcggcccgcgcggcgttggcccgggaccgggcgctgaccgggggcgcctaccgcgccgtgatcaacgccggtcaccgagcgatctacgggtga

SEQ ID NO: 4682 - DNA, 438 bp, Actinoplanes utahensis
gtggccactgtgactcgtaccgtgcaggcatcccccgaccgcgtcttcgccgtgctcgccaacggctggtcctacagcgactgggtggtgggcacctcccacatccgcgacgtcgagcaggactggccggcgaccggctcgaaactgcaccacaaggccggcccgtggccgttgtcgctgcacgactcgtcgaccgtgctggagtgcgtgcccggccgggagctcaagatccgggccgggctgtggccgctgggcgaggcggtggtcgacatcgtgctggagccggcgtccgacggcgcgacccgggtggtgatgcacgaggacttccagtccgggccgctgctctggatgcgcaacaagatcaacgatctggtgctgcaccagcgcaacgtcgaggcgctgcgccggctcgccgacatcgccgaatctcacccgtag

SEQ ID NO: 4683 - DNA, 1191 bp, Actinoplanes utahensis
gtgcgaattgcgatgatctccgagcacgccagcccactaggcgtgggcgaccagcacgcccacgtggccgaactctccaccgcgctggccgagctcggccacgaggtgcgcgtctacgtccgtcgcaccgatccggcggtgcccgagatcgtcccggtcggggccggcgtgcacgtcgtccacatcccggccggcccgcccagcccgctgccggacgaacaactgctgccgcacatggcggagttcgccggccggctcaacgagctgtggcagcgcgacggctggacgccggacgtcgcgcacgcccatttctggaccagcggcctggccgcggtcaccgccgcccggcaggccggcatcccggtggtgcagtcgttccacgagctcggcacgattcagccggccggcgccggcccgtcccgcaccggctacgagcgggccctcgggcgggccgtcgaccgggtggtcgcgcagacccaggacgaggtgcagggcctggtccggatcggggtgccacgggcccagctgaccgtcgtcccggccggcgtggacagcgagcggttcaccccggacggcccggtcgccccccgcgacccggaccgcacccgcatcctctcggtcggcaaactcgtcgagcacaaggggttcggcgacgtcatccaggcgatgcgctacgtccccggcgccgaggtggtggtggtcggcggtccgccggccgaccagctcccggccgacccgggcgccaagtcgctgcgcgcgctcgccgaacgcttccaggtcgccgaccggttccggctgatcggcgcggtcccgcaccgggacatgcccagctggtaccgctccgccgacctgctggtcgcggcgccctggcaggagcagttcgaacgctccgcgctggaggcgatggcctgcggcgtgccgatcatcggcaccgcggtcggggggttgaccgagaccgtcgtcgacgggctgaccggcgacctggtcccggcccgcgacccacgggcgctcggcggggccctgcgccggctggtcaacgacaaggtgcgccggttcacctacgcgaccgcggccctcgaccgggcccggcaggcgtacagctggaagcgggtggccgcgcagatcggctcggtctactccgcggtcaccggcctgcgccgcaccaccgccgagccggaagtggtggcctag

SEQ ID NO: 4684 - DNA, 903 bp, Actinoplanes utahensis
atgacagtcatcgaggtcagcaacctcagcaagcgttacggggacacggtcgcggtccgcgacgtgtcgcttgccgtcgaggacggcgagatcttcggcatcctcggcccgaacggggccggcaagaccaccaccgtcgagtgcgtcgccgggcttcgcgagccggacggcgggacgatcaccgtgctcggccgcgcaccgcgggatccggcgctgcggctccaggtcggcgtgcaactccaggagagccggctgcaggacaaattgacggtacgcgaggcgctggaactgtacagcgccttctatcccgagccggcggactggcggacgctggccggtgaactcgggctcgagggcaagctgcgaacgtcgtacagcaaactgtccggagggttgaaacagcgactctcgatcgcgctggccctgatcggcaacccgcggatcgccatcctcgacgagctgaccaccgggctcgacccggccgcccgccgggacacctgggacctgatcgagtcggtccgcgaccgcggcgtcaccgtcgtgctggtcacccacttcatggaggaggccgagcgactctgcgaccggctcgcggtgatcgacaagggcgcggtgatcgccctggacaccccggccggcctggtggcccgcaccgagaccgggcagacgatccggttccgcccgtccgccccgctcgacgacgccctgctcaccgcgctgcccgaggtgcgcggggtgcgccggctcggcgaccgggtcgaggtgaccggcaccggcaacctgctcggcgcggtcagctcgatgctcgccgtccaccagatcgtcgccaacgacctgcgcctggagcaggccagcctcgacgacgccttcgtccgcctgaccggcgtccccacccaggagtga

SEQ ID NO: 4685 - DNA, 741 bp, Actinoplanes utahensis
atgaacgtcttcgtcaagctcacccgcaccgaactgaaactgcagctgcgcgagccggtcacggccttcttctcgctgctgttcccgaccatcctggtgatcatcctggggagcatcccggcgttccggaaaccgtcgccggagctgcacgggggccggaccatcgacgtctacgtcggcatcgcggtcgcgctcagcgtcgccatgctcggcctgcaggtactgccgatggtgctggccgcctaccgggagagcggcgtgctgcgccggatcgcgaccactccggtccggccgatcaccctgctcgccgcgcagatggcggcgctgatggtgatgtcactcggctccgcggcactgaccatcgcggtcggattcgtcgccttcgacgtgcccctcgcgggcaacttcgccggcttcgtgctcgcctatctgctctgcgcggccggcgtcttcgcgatcgggctgctgatcgccgcactggcgccgaccggcaaggccggcaacgcgatcggcaccctgctgttcttcccgtcgatgttcttcgccgggctgtggacaccgcgcgagttcatgccgggcatcgtgcagaagatcggcgactacaccccgatgggcgccggcgaacgcgccctgcacgacgcgatgaccgggcactggccgaacgggctctcggcggccgtcctgatcggatatctggccgtcttcggcctcggggccgcgcggctgttccgctggaactga

SEQ ID NO: 4686 - DNA, 1233 bp, Actinoplanes utahensis
atgcaggaacagcattcccgccgtcattcgggggtggcgggcgcgttgctcgccggatcgaccgtcctggcggtcatcgcgacctggaccgatctaccccaggagccgcttccgctgaccctcggcgtggtcggcgccaccctggtctggatcctggcgttccgcgctctgccgccgacccggtatcagcgggcgccgtcgatcgccctgttcgtggctctgatcgtgctcagcgccctgctggtctggtgcaacccgctgttcggcttcttcgtctggaccgggtacctgttcaccgcgtacatgctgcccggctggtgggcgctggccggcgcggcggcggtcgcggtggtcaccgcgaccgcccagatcggcggccccgccctggtgcgcggcgccggcgggctgcttctgttcggcacgctgctggtgctcaacgcgggcatctcgatgaccatgacctggaacgagatcggcaaacagcgcaccagcgagcgacggatccggacgatcgacgcgctggcccaggccaacgcgaaactggaggaggcgctcaaggagaacgccggcctgcacgcccagctcctcgtccaggcgcacgaggcgggcgtgctcgacgagcggcagcggatggccggcgagatccacgacgtgctcgcccagggactgaccggcatcgtcacccagctggaggcggccgaggcgcaacccgccgaccgggagaggcacctggccacggcgaaacgactcgcccgggagagcctcaccgaggcccggcgttcggtgcaggcgctgcggccgcagcgcctcgacggggcggccctgcccgacgcgctcggtgaggtcgtcgagacctgggccgggatgcacggcgtacgcgccgatctgatcctgaccggaacggcccggcggctgctccccgagatcgagaccaccctgctgcgcaccgcacaggaggccctggccaacgtggcccggcacgccaatgccggccgggtcgggctgaccctgtcgtacatggaggacatggtgaccctggacgtccgcgacgacggcgacggcttcgacccggcccggccccgggaggtcaccgcggccggcggcttcggcctcgacgcgatgcgcgagcgactcgcccggatcgccggcaccctggaggtcgagtcagaatccggcggcggtacggcgttgtccgcgtgcgtcccggccatcgcgatcggggcggccgcgtga

SEQ ID NO: 4687 - DNA, 633 bp, Actinoplanes utahensis
gtgatcggggtgctgatcgtcgacgaccacccggtggtccgtgacgggctgcgcggcatgttcaccgccgacgaccggttcaccgtgctcggcgaggccggggacggccgggaagccctcgccgtcgcggcggcggtccagcccgacgtgatcctgatggatctgcggatgccggtgatggacggggtgaccaccatccggtcgctccaggagagcgggtcggtggcccgggtgctggtgctgaccacctacgacaccgacagcgacgtgctgcccgcgatcaaggcgggggcgaccggatatctgctcaaggacgcgccccgggaggagctgttccgggcggtggtggccgcccaccgaggggagtcggtgctgtccccggccgtggccgggcggctgatggggcgcctgcgggcgccggccggcgagaaggagccgctcagccagcgggagctcgaagtgctgacgctgatcgcccggggatgcagcaaccgggagaccgccgggaggctgttcatcagtgaggcgacggtgaagacccacctgctgcacgcgtacgccaagctgggcgtccgcgaccgcgccgcggccgtcgccaccgccttcgagcgcggcctgctcggccgggattag

SEQ ID NO: 4688 - DNA, 1110 bp, Actinoplanes utahensis
atggaacgcgcgacggtgatcggggcgggggtcggcggcctgaccgccgccgtggcattgcggcaacgtggctggaaggtcaccgtcctggagcgggcggccggcctggaacaggtcggcgccggcctcgcggtcgcgcccaatgccctgcggaccctggacactttcggtctcggcgatccgctgcgccggctctccggcatcgccggcgcggccggtgtccgccgcccggacggcacctggatcgcccggagcaacgccgacgaggccaccgaacgatacggcgatccggtgatcgcggtgcaccgcgcgacgctcgtcgatctgctcgccggggcgctcccggaaggcacgatccgattcggccagaccgtctcggcggtcgacccggacaccggcacggtggtcaccgccggcgggccgctgccggccgacctggtggtcgcggccgacggcatcaattcggccgtacgcggtcagctcttccccgatcacccgggcccggtctacaccggcgtgtccagctggcgcttcgtcgtcccgcaccccggcatctcgatcatcccggccgagacatggggcgccggcaaggtgttcggcacggtggtcctcggcgacggccgggtctactgcttcgccaccgcccccgccgcgcccggcggccggggcaacgagctgccccggcacttcgccgcctggcacgatccgatcccgtcgctgatcgccgccgccggcgacaccgtcacccgcaccgacatccgctgcctggatcagccgctgccggccctgcaccgcggccgggtcgccctgctcggcgatgccgcccacgccatggtcccgaacctgggccagggcgcctgccaggcgatcgaggacgccgcggtgctcgcggcccaccccggcgacctggcgcggtacaccgccgagcgtctgccccgcaccaccggggtggcccgcgcgtcccgccggatcgcccggatggccggcctggccaacccggtcgccgcctggctgcgcaacaccggcatgacgctggccggccgcctcggccccgacctgatcctgcgccagatggacccggtcctcacctggcgcccaccggaggtctaa

SEQ ID NO: 4689 - DNA, 411 bp, Actinoplanes utahensis
atggtgaccatgactgatcacaggagtgctccggcgccgcaggtgtggccgtcgctgcgggccgaggactgtcgggggctgatccggttcctggtcaccgcgttcggcttcgtcgagaacgtgacctacggcgagggcgaccgggtcgaccacgcccagctggactggccgccgggcggcgggatcatgctgggttcggtccgcgacgacgaggtgtcgctgccgccgggcaccttcggggcgtacgtggtgaccgacgagccggacgcgctgttcaagcaggcccgtgccgccggggcgcaggtggtgcgggagccgttcgataccgattacgggtcgcgggacttcgccgtgcgggacccggagggcaacatgtggttcttcggtacctaccgcggcgagccgcggtag

SEQ ID NO: 4690 - DNA, 504 bp, Actinoplanes utahensis
gtgacggacgaaccgctctacgccaagctgggcttcaccgacgccgagtgggggctgctggtcggcctcccgcatgcggtgctcaccgcggcgagcgccgccacccctgacagtgcccgcaagacccgggccgagagcgcggccggtctgggccggatctcggatgcccgggcctcggccagcaccctggtcaccgcggtggccagcgccgcggtcgccgaggccggcgacccggagctgggcgaggagccgccggtgatcgagccggccgacccggccggctatgccgaggacgtgctggaccgggcgtccgaggcggccagcctgctcgcggcgaaggcctcggtggccgacgccgaaacgtaccgccactggctgctggagatcaccgacgcggtggtcggcgcggccaccaccggtggtctgctcggcatcggtggcgaaacggtcaccgaggacgagcgcagcttccgcgaccacctggccagcgcgctggccgcctga

SEQ ID NO: 4691 - DNA, 714 bp, Actinoplanes utahensis
atgaccttcttcaccccgtccaccgggtgctgcgacaatccctgggtgcgggaagtggtcgacggaatcttcgagatccgatacgcgggcgtcaacgtccatctggtggtcaccgacgacggcgtgatcctggtcgacaccggctgggccgggcagaccgcggtgatcgagcgggcgctgcgcaagctcggccgtccgctcaccgaggttcgggcgatcctgctcacccaccaccacgccgaccacgccggcggcgccgccgacctgcgtcagcgcaccggtgcccggctggtcgcgcacgccggcgaggccccgctgatcaacggcgcgctccgccccgagctgccggcccgccgcctggcccggctgctggcccgcccgctcgccccggtccccagcaccaaggtcgaccagctggccggcgacggtgccgagccggtccccggtttcaccgtcctgcacaccccggggcacgcccgtggtcacctgtcgttcctgctcgaccgggccggcggcgtgctgttcgccggcgacgccgcggccagccgccgcggccgggtcaccggcccgaacgtgatgttcaccgccgagccgccgcgggccggcgagagcctggcccgcctcgccgaacgcgacttcgagcacgccgtcttcggccacggccgcccgatcgtcggcggcgccgccgcccgcttccgcgaagcggtcgcctga

SEQ ID NO: 4692 - DNA, 246 bp, Actinoplanes utahensis
atgatcgatgggcgcatcctgcggcgctccgccgcccggctggtgcgcaccctggccaccatcctgttcgcggtcggcgtggccggctcggtggtgtccgccgtggtcctgctgatcgccctgacggcggcggaccggttcacccgcccggcagccgacgccttcatcaccttcggccggctgctcgccgtcgccgcggtcctctacctggtcggccgcctcctgcgccggcgggaccggagctga

SEQ ID NO: 4693 - DNA, 1665 bp, Actinoplanes utahensis
atgaaactccccatttacggcccccgcctgcggaaggtggctcgcacccacttcgggtggccgtcgctgcgccccggacagttcaagccgatgcgcgccgtgctgcgccgccgcgacgccctggtggtgctgcccaccggcgccggcaagtcggcgatctaccagatcccggccgtgctgctgcccgggccgaccgtggtgatctccccgctgctcgccctgcaacaggaccagatcgcggcgctcaacgagcgcgccgacgcgaaggtccgcgccgtgcgggtcagttccgccgagacaccgcgcgagcagcaggaggcgatcgaggagctccgcgccggccgcgccgagttcctcttcatcacccccgagcaactggccaacccggaacgcctggccgaggtgaaatcgctgaaaccgggcctggtcgcgatcgacgaggcgcactgcatctcggcctggggcccggacttccggcccgacttcctggccctcggcgacatgatcgagcagctcggccggccgccggtgctggcgctgaccgccaccgcctccccgccggtccgcgaggacatcatcgcccggctgcgactgcgcgacccggagatccacgtctccgggctggaccggcccaacctgttcctcgaggtcacccactgccccgacgaggcgtaccggtggcggcggctgaccgcgctgctcgacgaggggcagcggccgggcatcatctacgtccccacccggcgcgccgccgaggaactcgccgagaaactcaccggcgccggctaccccgccgagttctaccacggcgggatggccgccggcctgcgccagcagcgccacgaggacttcatcgacgacaaggtcgacatcatggtggccacctcggcgttcggcatgggcatcgacaagccgaacatccgctgggtggcgcacaccgccctgcccgattcaccggacagctacttccaggagatcggccgcgccggccgcgacggcgaacccggccgcgtcctgctcctctggcgcgccgaggacgaggccatccagcggttcttcaacggcggcggccccgaccccgacgagctccgcgagctggccggcgtgctgcacaagggaccgatcaccaagaccgcgctgcagaaggagaccgggctcggcccgcgccgcctcgggcagtacctcgccctgctggaacaggccggcgccgtccgcaccggtaagaacagcaagctgcgggtgccggccggcgccccgctcccggcgaaggcggccgaggccgccgtcgccgagttcgagcggcagcaggcggtgatcaagtcgcggaccgacatgatgcgcgccttcgccgagagccggcagtgccgcaccgagaccctgctcgcctacttcggcgaggagatccggcgcacctgcaaccactgcgacaactgcgccgacggcagcgccgaggcggtcaacgccgccgaggaggagggcccgttcccgatccacagccaggtccgccacggcgaatggggcaccggcatggtgatgggctacgaggaggagaagatgaccgtcctgttcgacaccgtcggttacaagactctctccgtccccgtcgtcgtccagcaacagctgctgaccggcgaggcgtcggccgcggagaaacggatgaagtga

SEQ ID NO: 4694 - DNA, 129 bp, Actinoplanes utahensis
gtgccgctcacccccctcgcggaagccaccgtcgattggtcccaggtgcacgccgtccggctgctcggcgtcgcgctcgccctgctgttcctgctgtgggcgatccggcgcatgttcggcggcaagtag

SEQ ID NO: 4695 - DNA, 1530 bp, Actinoplanes utahensis
atgtcgaagcacggcgatctgcccgaacttgccgctgcggtccttcagccgggattcgtcggcacctccgccccggactgggtccgccgatggctcgccggcggcctcggcggcgtcgccctcttcgcccgcaacgtcgagtcaccggcccagatcgccgcgctcaccgcgcaactgcgcgccgagaaccccgacgtgatcgtggccatcgacgaggaggccggcgacgtcacccgcttcgagtcccggctcggcagctcccggcccggcaacctggcgctcggcgcgatcgacgacccgcggctcaccgaggcggtcgcccgcgatctcagctgccacctggccgccgccgggatcaccctcgactacgccccggacgccgacgtcaacagcaaccccggcaacccggtcatcggcgtccgcgcgttcggcgccgaaccactgctggtggcgcggcacacggccgctttcgtccggggactgcagacgtacggcgtcgccgcctgcgccaagcacttccccggccacggtgacaccagcgtcgactcgcaccacgacgtgccgctcatcgagcggaccgccgagcagctcgaagcctgcgagctcgtcccgttccgcgcggcgatcgcggccggcgcccgggtcgtgatgaccgggcacctgctcgtcccggcctacgacaccgacctgccggccaccctgagcccgcggatcctgaccggtctgctgcgcgaggagctcggcttcgacgggctgatcgtgaccgacggcatcgagatgcagggtgtgcgccggcgcttcgggctggcgggtgccacggtccgcgccctggccgccggcgtcgacgcgatctgcgtgggcggcgaccacgccgacgagcagaccgcgatcctgctgcgggacgcgatcgtcgccgcggtgcgctcgggtgagctgcccgaggagcgcctgcgggacgcggtggcccgggtccgggcgctcggcgcgtggacgacgcgtacgcagcaggaagccggcgtggtccgcggaccccaaccggagtcggagatcggctacaccgccgcccggcgggcggtccgggtcacccgcaccgcgcacgcgccggagctcccggtgatcggcgtgccgcacgtggtcgagttcgcgccgccgcgcaacatcgccatcggcgaggagacgccgtgggggatcggggcgccgctgaccgacctgctgcccggcaccacctcgatccggctcggcgccgaggacctgaacggcctctgcgatccggcgagccgggtgctggacggcgcggccggccggccgctggtgctggtcgtccgggacgtgcaccggcaccggtggatcgaggacacgctggccggggtgctggccgtgcggccggacgcgatcgtggtggagatgggcatcccggtgaccgtggtcggcggggtgcacgtcgcgaccttcggggcgacccgggcctgtgggctggccgcggccgagctgatcgccggcgcggtggtgccggagccgatcgcggcctga

SEQ ID NO: 4696 - DNA, 288 bp, Actinoplanes utahensis
atgagcgaccacccgttccgggacaacaccgtggcgcaccggttcgagctggcggtcgacggcgcggtgggcgcgctggcgagctaccggatgcgcggcgaggacgtggtggtggtgctgcacaccgagacgcatccggacatgcgggggcgcgggctggcgggcgagctggcccgccggacgctcgccgagatccgcgagcggggctggcggatcgtgccggcctgcccgttcttcgcccactacctcagtgggcacccggaggacgcggagctggtcgcccactga

SEQ ID NO: 4697 - DNA, 825 bp, Actinoplanes utahensis
atgtcctccgccacctcgaacgtcaaataccacgcgtcccgcgcggcgaacagcaagcctctggagtatctggcccggggcggcttcgtcggttacggcatcatccacctgctcttcgcctggatcgcgctgcaggtcgcgttcgacggttcgggcaaggagagcgaccagtccggcgcgctgtccgagctcgccgccaagccgttcggcaaggccctgctggtgatcatcgcgatcgggttgttcgcgatggcgctctggcagctgttcgccgcgatcgacgggcagagcggcgagcagaaccggagtgcggtcgccgaacgggtgacgtccggcatccgggcggtcctctacgtctacctcggctgggtggcgatcaaggtggtccggggcgcgaacgcctcgatgggcgacaattcggagagccggtcggccgggctgatgcagcactccggcggccgctggctggtcgggctggccggtctggtggtgctcggcgtcgggatcgggatcttcgtgtacggcctgcggaagaagttcaccaagcggctcgacacggcgaagatgccagcttcggcccggcagaccgtcatccggctcgggatggccggttacagcgccaaggggctggcgtacgcgatcgccggcgtcctgttcctcaccgccgccgtcacctacgacccggacaaggcccgtggcctggacgccgcgctcaagacgctggccgggcacccgtggggggtctggctgctggcactgatcgcgctcggcatcgcggccttcggggtgttctgcttcgctcaggccaaataccgcaaaatctga

SEQ ID NO: 4698 - DNA, 1212 bp, Actinoplanes utahensis
ttggggcgctggcacagcactcgaccatggagaggactgttcgtgtccagcgttctgactgccgtgctcggcatcaccggggccgccgtcgcggccatcgtgatcgtcgaagcgtcccaccgggtgatgctgcgcatcggtcgccgttcgcccctggccgccgacctggcccgcaccatgcaccggccgttcctggccacgctgaccctgatcgcggtgcaacaggcggtccgggtgttcggcggcgacttcccgggccgggccgccgtggtgcacgcgctcgtcatcgtctgtatcgccgcgttcgcctggctggtggccgcgctgctgctggtgctggaggacatgacgctggcccggtggcgcaccgacgtcccggacaacctgcgccgacgccggatcaagacccaggtggtgatgctgcgccgggtgaccgtcgcctcgatcgtggtgctcaccgccggcgtgatgctgatgaccttccccgggatccgggcgctgggcgccagcgtgctcgcctcggccgggctggtcagcgtgatcgcggcgctggccgcgcagagcacgctcggcaacgtgttcgccggcatccagctcgccttcagcgacgcgatccgggtcgacgacgtggtcgtcgtcgagtcggagtggggccggatcgaggagatcaccctgacctacatcgcggtgcagatctgggacgaccggcggctgatcctgcccacctcgtacttcaccaccaagccgttccagaactggacccgcagcagttccgcggtgctcggcaccgcggagatcgacgtggactggtcgacgccggtcgagccgctgcgggccgagttgcgccgggtctgcgagggcaccgaactgtgggaccggcgggtctgcgtgttgcaggtgaccgaggcgaccggcggtacgatccggctgcgcgcgctcgtcagcgcggccgacgcgggcgctctgtgggatctgcgctgcctggtgcgggagcgcctggtcggctggatgtgggagcaccagcgcggcgcgctgccgcggacgcgcacccagctcgacgaggtggacgacggggcggcaccgatacggcagtctcggagggcggcggaggcctcgccggacgcccgggtgttcagtggtggcaacgacggcgaggcgcggggtgtggcgttcggagcggcggaaaacgacccggcgccggccgcgcggtga

SEQ ID NO: 4699 - DNA, 432 bp, Actinoplanes utahensis
atggccgatgtgctcaacggcagagcccgaccgttgtccgaacagtccaccgcggagttggtgcaacgggccagcgagcagctcagccggctggtcaaggatgagctgacgctggccaaggccgagctcgccgagaagggcagacacgccgggatcggcgtcggtctcttcagtggcgccggtgtcttcgcgatgtacggtgtcggtgccctgatcgcgaccgcgatcatcgcgctggacctggtctggccgctctggctggcgagcctggtggtcaccgtggcgatcttcctggtcgccggtgtgctggcgctgatcggccggtcgcagttccgtcgcgtggcgccggccgagccggtggccgcgatcgagggtctgaaggctgatgtcgacgaggtcaggcacgcggtcaaggagcgaggccggggatga

SEQ ID NO: 4700 - DNA, 312 bp, Actinoplanes utahensis
atgagcgagagcagcaacggtacgacaggcaagcccgacctggtggcgctgcgggccgagatcaagcagacccgggccgagctgggcgagacggtgcaggcgctggccgcccgggcggatgtcaaggcgcgggcccgggagcaggtggcgcagacccggcagcggctgctcggccaggccgcggcggccggtgatcggctgcaggcggtctcggccgggacggtgcgcgccaaccagttgccggtggtgctgatcgcggccgggctggccgcggtcgtcggagtgatcctgatcgtgcgggggaggcgctga

SEQ ID NO: 4701 - DNA, 273 bp, Actinoplanes utahensis
atggcggggaaactgggcaagatcgccctcaagccggtgaacgtggtggcggggatcgccgccggcgcggtcgccgggctgcttttcaagcaggtgtggaagctcgcctcgggcgacgacgacgccccggacgccggcgacgaggatcgtggctggggtgaggtgctggccgccgccgcgctgcagggtgcgatcttcgcggtggtgaaggcggccgtccatcgtggtggcgcggtcggcgcgaagcgtctgaccgggcagtggccggactag

SEQ ID NO: 4702 - DNA, 204 bp, Actinoplanes utahensis
atggcgcaaggaaccgtgaagtggttcaacgcagacaagggcttcggcttcatcaccgtcgacggcgggggtgctgacgtgttcgtccacttctcggccatccagacgagcggttaccgcactctggaggagaaccagcgggtggagttcgagatcgcccagggccagaagggcccgcaggcggagcaggttcgcccgctctga

SEQ ID NO: 4703 - DNA, 249 bp, Actinoplanes utahensis
atggtgaacaatgaaaccgagtccaccgccggcgaccccacccggttgcgcggctggctgagcatgtccctgggcctgctcggcatcgtgctcggcaccgtgtggaccctgcagggtctcgacgtcttcgagaacgaactgatgagcgaccagccggcgtgggccgcggccggtggtgtggtgatcgtgctcggcctggctctcgtggtaatcggcatgcgccgacggaccggcggatcgctttcctga

SEQ ID NO: 4704 - DNA, 978 bp, Actinoplanes utahensis
gtggaaaaacgaagctttcgccgaatgggccgcgacgcctcggtgatcggcctgggcgcctggcagctcggcgccgactggggcgacgtcagtgaggccgacgcgcacgcgaccctgcaggccgcggtcgacgccggggtcaccttcatcgacaccgccgacgtctacggcgacggtcgcagcgagcagatcgtcggctcgttcgtgaaggaccgacccggtctcaccgtcgccaccaagatgggccgccggctcccccaggtcccggcgaactactcgatcgacaacttccgggcctggaccgaccgttcccgcgccaacctcggcgtcgacacgctcgacctggtccagctgcactgcccgccgaccccggtgttcaacagcgacgaggtcttcgacgcactcgacacgctggtgcaggagaagcggatcgcggcgtacggggtgagcgtcgagaaggtcgaggaggcgctcgccgcgatcgcccggccgggcaccgccagcgtccagatcatcctcaacgcgttccggctcaagccgctcgagcgggtgctgccggccgccgccgaggccggtgtcggcatcatcgcccgggtgccgctggccagcggtctgctctccgggcgctacgacgagcacaccacgttcgccgcggacgaccaccgcaactacaaccggcacggcgagtccttcgacgtcggcgagacgttctccggagtggactatgcgaccggcctggaggcggtccgccgactccgcccgctcgttccggagggcgtcacgatggcgcaattcgcgctgcgctggatcatcgatcagccggccgtcaccgtggtgatcccgggtgcgcgtaatcccgagcaggcgcgcgccaacgcgcacgccggggacctcccgtcgctttcgccggaaacccgggaaatgatcaacgcggtctacgatgagttgattcgcccccaggtgcacgacaaatggtga

SEQ ID NO: 4705 - DNA, 744 bp, Actinoplanes utahensis
atgtgggatccggccgtgtaccagcgctacggcaccgaacggtcccggccgttcttcgacctgaccacccggatcggggcgcggcgaccgcgcgaggtcgtcgacctcggctgcggcttcggcgacctcacccgcaccctggccgagcgctggccggccgcccggatcaccgggatcgactcgtcccccgagatgatcgccgcggcgaccggcggcgacttccgggtcggcgacatcgcggactggacgcccgggccggacaccgacgtcgtggtcaccaacgcggcgctccagtgggtccccggccaccagcggatgctcacccgctgggtgcgcgaactgcccgccggcgcctggctggcgatgcaggtgccgggcaacttcggcgcgccgtcgcaccggctgctgcgcgaggtcgccgccgggcacggcgtcgagcgcggcatccgggagtcgccggtcgacgagccgaccgtgtacgccgagagcctgaccgccgcgggcgccgcggtggacgcctgggagaccacgtacgtgcacctgctgccggtcgacggccccgaccacccggtgctgcgctggatggagggcaccgccctgcgcccggtgcgggccgcgctgaccgccgacgcgtggacgtcgttccgggccgagctgggcgcccgcctcgccgaggcctatccgaccggacacgcgcacgtggcgttccccttccgccgtatcttcgtggtggcgtcaatctag

SEQ ID NO: 4706 - DNA, 1026 bp, Actinoplanes utahensis
gtgtccgacctgaccgagttcatcaccggcctgcccaaggccgaactgcacgtgcaccacgtgggttcggccagcccgcggatcgtcgccgagctcgccgcccgccacgagggcagttcgccggtgccggccgacccggccgcgctcgccgactacttcgagttccgcgacttcgcgcacttcatcgagatctacctgagcgtggtcgacctgatccgggacgccgccgacgtgcggctgctcacctacgagatcggccgggagctgagccgccagcgggtgcggtacgcggagctcaccgtgacgccgtactccagcgtgcgccgcggcatcccggcgccggccttctgcgaggcgatcgaggacgcccgggccggcgcccgccgcgacttcggggtcgagctggcctggtgcttcgacatcccgggcgaggccgggctgccggcggccgaggagacgctgcggatcgcgctggaggagaggccggacggtctgatcagtttcggtctgggtggcccggagatcggggtgccgcggccgcagttcaagccgtacttcgacaaggcgcgggccgccgggctgcacagcgtgccgcacgccggcgagaccaccgggccggagacgatctgggacgcgatccgcgacctgggtgccgaacgcatcggccacggcatcgccgccgctcaggacgagcggctgatggcccacctcgccgagcacgggatccccctggaggtgtgccccacctccaacctgcgcacccgcgcggtcgccgacctggcccggcacccgatcaccacactggccgcggccggcgtcccgttcagcgtcaactccgacgacccgccgatgttcggcacctccctggagcgggagtacgcggtcgccgccgagctgctcgccctcgaccacgccggggtggccgacctggcccgcgccgccgtccgccacagcttcctgtccccgcagggcagggccaccctgctggccgagatcgacggctacgccgcgggcttcccggagtaa

SEQ ID NO: 4707 - DNA, 141 bp, Actinoplanes utahensis
atgcgtgacgtgctgaaccacccggacaccgaggaggaggagccgcgcttcaaccgccggcgcctgatccgctggctcaccatcctcaccatcggcacggtggtgatgctcgccctctggcaggatccgctctatccctga

SEQ ID NO: 4708 - DNA, 633 bp, Actinoplanes utahensis
atgtcggtgcggctgacctggagcgccgcgtcggacaccgcgacctacgaggtgtcggtcggtggcaagccggtggccaccaccaaggcgacccgggcgctgctgatcggcctcaagccggactcggcgtacaaggtcgaggtccgcagccggacgaacaggtaccacgcgaccggcagtgcgcacaccgcccccgccgcccgcccggtgcagaattcctggttcgtcctgaccaactcgctgaccggcggcgccgccgacctctacgcggcccgcgccgccgacggcacgccggccactctcggcccggccgacggcggcaaccagcagcagtggcagctcagcccggccgcggacagcggcagctacacgctgatctcccgggccagcggcaaatgcctgatgccgctcggcggcaccccggtcgccggcgccccgctggtccagggcgactgcgccaacgccggcgcccgctggcgtctgcaggcctccgacttcggcttcacgctgcgcagcgaaaccggcgacctggccgtcggcgtcggcggccagcgcttcggctggcaccgggtgctggccctggagccggacaccgggcagcgccaccagagctggaccgcggtgccgagctga

SEQ ID NO: 4709 - DNA, 1359 bp, Actinoplanes utahensis
atggtcccctcccaccgcccacccgcacgtcgaggagatgccttgcccgcgcaccgccggtcagccttccctggctcacccggcagccgccgccggccgtcacgctccgcaacctctcgactcctcccggtggcgctcgggctgaccctgctcggggtcggcggcgtcgtcggtcccagcgtgatcggcgcctcgtcgcgtaaggacccgggccgcttccagctgaccgcgctccccaaggacgcccccgaccagggcctggtctacgagggtctgaagccggtcgcggccggcgcgctgtgcgccgggtcgtacctgctggccgacgacacctgcacgcacggcccggaccgggcgcccaccggcctgtcggtgcgcgaggacgtcgccccggtcaccgccgcgaccaggctgcccggcacggtgcgcaccatgcacccggtggtcgtcccgaccgacgccgagatcgcccgcgacctgggcggcagcgcgctcaccccggacgcgccggcgctgatcccggacccggccccgggcaacgccgacttcgtgctcggcccggccggcgtggcctgcgacggcgacggccaggacggcaagcgggtgcagctgctctacgtgtacgccgcgggcaccgccacccggtacaaccggtacgtcaactcgttccgcacctgggcggccggcgtcgacgcgatcttcgacgcgagcgccggcgagaccggcggctcccggcacgtgcggtatgtgaccacgccggagtgcacggtcgcggtctccgaggtggagctgccggccgggtcgctggactcgttcaccgcgaccgtcaaggcgctcggcaacctcggctacaaccggaccgaccgcaagtacctgatgttctccgacgcgaacgtctactgcgggatcggcacctacgtcgacgacaaccggccgggccggaccaacaacaacaacgccggcccgtcctacgcccgggtcgactccggctgttggagttcggtgatggccgcgcacgagctgacccacgcgttcggcgcggtgctcaacggcgcgccgaacggcaccggcgcgggcggctgcctggacgactacgacctgctgtgcggccccgaccggtccggccgggcggtgcggtcgtcctgcccgaaggcgcacgaggtgcgcctggactgcggccacgacgactacttcaacaccaacccgaagccgggcagctacctggacacccactggaacgtcgcgctcagcgacttcctgctgcgcagcgacggcggcaacgacatcccggacgtacccggcgcggtcacccccgacccgggccaggccgccgcgccgccggccgccctagctagctag

SEQ ID NO: 4710 - DNA, 1542 bp, Actinoplanes utahensis
atggcggcagccctcggtcggcgaggaccagaccatcgacgtgcatttgtactggctacgccggaaactgggcgagtccgcggcgaagccccgttacctgcgcaccgtgcggggggtcggattccggttggtggcgccggactgaggctgcggctggcgtacacgaccgccgccaccaccgccgtcgccgccctggtcttcctcgtcccgctgggctggggcctgcgctccgaccaccgcgaggaggcactcgccggcgccgcccgggccacctccacggtggccggcgcgctgctggccggcgcgggcgacaagggcgtggccgccgccgcggcgacggccggcgatccggtcgtgcacgtgcccggcctggcgcccaccccgggcggccgggccaccggcaagcagatcgacgaggccgccagccggccggacgccagcgtgatcgaggtgccgggcggggtgatccggctgcagccggtgaccgccggcggcaaggcctgggtggtcgaggggttcgtgccggcctccgagctgaccgagaacaccgcgcgggactggtggctcctgctcggcctggcggtggtgctggtcggcggctcggtgatcgtggtcgaccggctcgcccggggcgcggtcaactcggccaacaacctggtcgaggcggccctcgcggtcggcgacggcgacctcggcgtgcggatccacccgtccgggccgcgcgagctggccgaggccggctacgcgttcaaccggatggccgaccgcctggtcacctcccgcaccgacgagcgggagctggtcgccgacctgtcgcaccggttgcgcaccccgctgaccgcgctgcggctggacgccgaggcactcgacccggacgacacgcagatcatcgacctgaccgccgacgaggtcgaccggcggcgcggcatccggcgcatccggcaggccatcgccaccctggaggacgaggtcaactccctgatcaacactacccgccagacggtcgccgcacaggtggcggccaaccccgaggagggcctgtgtgacgccagcgaggtggtccgggaacggatgtcgttctggtcggcgctcgccggcgaccaggagcggcagtaccgggtgaccggcgcacacgtgcggatcccggtgccggtcccccgcgccgacctggccgccgccctggacgcggtgctcggcaacgtgttccgctacaccccgcagggcaccgccttcgaggtggcgctctcccgccgggacggctgggtggcgctgcgcgtcgacgacgccggcccgggcatccccgacccggagaaggcactgcgtcgcgggcagagccagcagggctccaccggcctcggcctggacatcgcccgccggatgacccagtcgaccggcggctcggtcagcctggaccgggccacgctgggcggcgccagcgtggtgatgctgatcgccgacgccgacgccaccccgaaaacccccagccgtttcggcctggtcggccgcggtggtcgcggccgccgcggccagcgggccacctga

SEQ ID NO: 4711 - DNA, 1197 bp, Actinoplanes utahensis
gtgccaggcgccgagcggggcggcccgcatcgccgcgccgttgccgcacgacccctgcccgtggaaggcggccgcggcggcgatcggccagggcagcccttcgcggatctgccggagcatcaccacggctcccgggccgtacccccgatagggttcgcagtgctcgccgagcaggagggcgaaggcgtcccggtcgaagtcgccctcctcgaggacggccaccaggcagcaggcctgctcggtgtcgtcggtccaggcccagacgcccgcgggcacccgggcgtcgagcaggtcggcgggccggttgccgggcacgaaatactgcgcgccgagggcgtcgccgacgctcaggccggccaggctgtccagggccagcgcgcggcgcgtatcggggaagagggtgaacgtcatcggtggttcggatcgtattccatcactgagggtcatcaaagcatctcgttccatgagcctttaggtttcccccgccggagacagtacggtcttcgcatggccacggtgttgctcgtcgaagacgatcatgtcgtgcgtggtgccatgctccgttcgctcgccgaccgtgggcacgccgtgcacgccgtcggcaccgcgctggaggccctccggcgggtcgccgcggagacccccgacctggtggtgctcgacctcgggctgcccgacctggacgggtcggacgcgctgcggatgctgcgcgggatcaccgacgtgccgatcatcatcgccaccgcgcgcgacgacgagcagaccgtggtgcggctgctgcgcgccggcgccgacgactacatggtgaaaccgttcaccggcgcccacctggacgcgcggatcggcacggtgctgcgccgggtcggccgggccagccgggccgcccagcccgccgtccacgaggtgggagaattacgggtcgacgtgggcgagcgcagcgccaccctcggcgaccagccgctggcgttgacccgcaaggagttcgacctgctggcctatctcgccgcccgcccgggccgagtggtctcgcgtcgtgagctgttggaggaggtatggcggcagccctcggtcggcgaggaccagaccatcgacgtgcatttgtactggctacgccggaaactgggcgagtccgcggcgaagccccgttacctgcgcaccgtgcggggggtcggattccggttggtggcgccggactga

SEQ ID NO: 4712 - DNA, 1155 bp, Actinoplanes utahensis
gtggtcttccacccgaagggtggggtgatcaagcgggagatggaggactacgtccgggcccggcacatcgaggagggcttccagtatgtggggaccccgcacatcaccaaggagaacgtcttcgtgacctcggggcatctgccctactacaaggacacgatgttccccccgatgcagttggagggggcggactactacctcaaggcgatgaactgcccgatgcacaacctgatcttcaggtcgcgcgggcggtcgtatcgtgagctgccgatgcggctgttcgagttcggcaccgtgtatcgctacgagaagtccggcgtggtgcacggcctgacccgggtgcgtggcctgacccaggacgactcgcactcctacgtgaccgccgagcaggcgcccggcgagatcaagcacctgctgaacttcgtccgctcgctgctcgacgacttcggcctggacgactactacctggagctgtccacccgggacccgggcagcgacaagttcatcggcaccgacgagcagtgggagaacgccaccggcgtcctggagcaggtggccagggagtccgggctggacctggtgctcgacccgggtggggcggccttctacggtccgaagatcagcgtgcaggccaaggacgcgatcgggcggacctggcagatgtcgaccattcagtacgacttcaacatgccggcccggttcggcctggagtaccaggcggcggacggctcgcgtcaggagccggtgatgatccactcggcgaagttcggctcgatcgagcggttcttcggcgtgctcaccgagcactacgcgggtgcgttcccggcctggctggcgccggtgcaggtggtcggcatcccgatccgcgacgaccacgccgactacctgtcgtcgttcgtggagcgcctgcgccgggagggcatccgggccgaggtcgactactcgtcggaccggatgcagaagaagatccgcaccgcccagcagcagaagatcccgttcatggcgatcgccggcgacgacgatgtgaacggcggcaccgtgtcgttccgctaccgggacggctcgcagcgcaacggcgtgacgctcgacgaggccgtggcgcacgtggtggagatcgttcgctcccggatcaataccgggccctcggccgcctga

SEQ ID NO: 4713 - DNA, 519 bp, Actinoplanes utahensis
gtggtggtgatggatgtgaccggcgagccggacggcctggagcgactctggacgccacaccggatggcctacatcaccggggagaacgcgcccgcgggctgcccgttctgcgtcgcacccggcctgccggagggggacagcctggtggtcgcgcgcggcgagctggtcttcgcggtgctcaacctgtatccgtacaatccgggccacctgatgatctgcccctatcggcacgtcgccgactacaccgacctgaccgaggaggagacggccgaggtcgcggcgtacacccggacggcgatgcgggtgatccgcgcggtgagccggccgcacggcttcaacctggggatgaaccagggcgcggtggccggtgccgggatcgccgcgcacctgcaccagcacgtggtgccgcggtggggtggcgacgcgaacttcatgccggtgatcgggcggacgaaggtgctgccgcaggtgctcaccgacacccgggtcatgctggcgcgagcgtggccagcatcctga

SEQ ID NO: 4714 - DNA, 570 bp, Actinoplanes utahensis
atgggccatcgtgaagagctgctgaagggcgccaagaaggcgctgctggagaagggctatgcccgcaccacggcccgggacatcgtggcgttgtcgcgcaccaacctggcctcgatcggctatcactacggctcgaccgaggcgctgatgaccgcggcgatgctcagcgccatggaggactggggcaacgcgctcggccgggcgctggccgcccccgacccgaccgccgacccgctgctcgacttctggcgccgggtgatcgggtcgatccagaccgaccggccgctctggctggccagcatcgaggtggccctgcaggccgagcacaacccgcagctcaaggagcagctcgcgggcgggctcacggccggccgcaccgggatggcggcgatgctcaccggcatcgccgaggatcagctggacgaggcgaccgtgcgctcgctcggcgcggtgcagatggcgctgatgtccggcgtggtcacccagtggctgaccgacccggccagcgctccgtcggccgaggaggtggtggccggcgtcaggatgctggccacgctcgcgccagcatga

SEQ ID NO: 4715 - DNA, 1182 bp, Actinoplanes utahensis
atggtaagtggcatgacgaactcacgggtactgatctccggcgccggcatcggtggtccggctctggccttctggctgttccagcggggcttcgaggtcactgtcgtcgagcgcgcgtccaccgtccgcgagggcggctacaaggtcgacgtgcggggctcggccaccgccgtgctgcgcaagatgggcctgctcgacgcggccaaggcggccgacaccggcatgcagcagatcacctacgtcaagccggacggcagcccgatcgccaagctcccggccgacctgctgatgggccgccgcggcgacgacctggagatcatgcggtgggacctcagcaagatcctctacgaggccaccgaggatcgggtggagtacgtgttcggtgatgcgatcgcctccctcgccgacgggccggacggggtcgacgtcaccttcgagcacggcgcgccccgccggttcgactacgtggtgggcgccgacgggctgcactcggccacccgccggctggtgctgggcgagaccccgctgaccttcctgggcgcctacatctcgatcttctcggtccccaacgacctgggcgtcacccgcgaggaggtgttctactcgcgacctggtcggctgatcttcgcctacgcgatggagcccggccagccggcccgcgtcggtatggtcttcgcctcccccgagcggcgctacgaccaccgtgacccggccgcgcagaaggcgatggtccgcgaggcgttcgccgggcagggttggcgctccgacgagttcctggccgccatggagaccgcgcccgacttctacttcgactcgatgagtcaggtcgagctcccgtcctggtcgtccggccgggtggtgctgctcggtgacgccgcgcactgcccgtccccggcctccggccagggcacctcgctcgccctggtcggggcgtacgtgctgggccggcacctgggcgagccggagggcctcgcggcgtacgagcgggagatgcgcacctacgtggagaagaatctggccttcggccgcaagatggtcaaggacatggtccccggtggccgcctcaccatcgccttccggcactacgggatgcgcaccctgaaataccacccgcagaaggagaaggtgatcaacaaggtgctggccccgatgcacgaggcggccaacgcgatcactatctga

SEQ ID NO: 4716 - DNA, 2160 bp, Actinoplanes utahensis
atggcgcagaagacatcggagaaggggctcgccggcgccgccgcgccggtggtgaccgagcccggcagagttcgtaacgtggtgctggtgggtcactccggcgccgggaagacgacgctggtggaggcgctgctggcggccaccggcacgatcccgcgcgcggggaccgtcgcggacggcaccacggtcaccgatcacgatccggcggcggtccggcagcaacgctcggtggcgctgtcctgcgcgccactcgtccatcaggacgtcaaggtcaacctcctggacaccccggggtacgcggatttcgtcggcgagttgcgcgccggcctgcgcgcggcggacgcggcactgttcgtggtctccgcggtcgacggggtggacgagtcgacggtcgcgctctgggaggagtgcgccgcggtcggcatgccgcgggccgtcgcgatcacccgcctggaccatccgcgcgccgactacgagcaggcgctgcaggactgccaggaggcgttcggcgagaacgtgatgccgatctaccagccgatgctgggcgacgacggccggtcggtggccggcctgatcggcctggtgtcgctgcgggtgctggactactcggccggttacccgccgcgggtcggcgaggccgagcaggcccacctcaacccgatcgccgacgaccgcaaccagctcatcgaggggatcatcgcggagagcgaggacgagaccctgatggaccggtacatcgccggtgagctgatctccaccgacgcgctgatcccggacctggagaaggcggtcgcccggggcaacttctatccggtcgtgccggtctgcgcggccaccggggtgggcctggacgcgctgctcgacggcctggtcagcgccgccccgtcaccgctggagcacgacctgccggtggtcaccggggtggacggcgcgccccgcccgccgctggtctgcgacccggacggcccgctggtggccgaggtggtgcgcaccacgatcgaccggcacgtcggccgggtgtccctggtccgggtcttctccggcaccctgcgaccggaccagacgctgcacgtgtccgggcacggcatggccgagcgcggccaccccgaccacgacgccgacgaacgggtggcgcacgtctacaccccgctcggcgccacgctgcgcgaggtgggtcggtgcgtggccggggacatctgcgcgatcaccaagtccgggtcggcggagaccggggacacgctctccggtagggacgacccgatcctgatgtcgccctggtcgatgccggagccgctgctgccgatcgcggtcgtcgccaagacccgctcggacgaggacgccctcgccaagaacctcgcccgcctggtcgccggcgacccgacgctgcgcctggagcgcaatccggacacccaccagctggtgctctggacgatgggcgagtcgcacgccgacgtggtgctcgatcggctccgggcgggcggcgtcgagctggacaccgagccggtgaaggtgtcgctgcgggagaccttcggcgccgcgtccaagggacacgggcggcacgtcaagcagtccggcggccacgggcagtacgcgatctgcgacatcgagatcgaaccgctgccgcgcggctccggtttccagttcgtcgaccgggtggtcggcggcgcggtgccgcacaactacatcccgtcggtggagaagggcgtccgcgcccagctggagaagggcatcatcgccggttacccggtcgtcgacctgaaggtgaccctggtcgacggcaaggcgcacagcgtggactcctcggacgccgccttccagaccgccggggcgctggccctgcgcgaggcggccgcggccgggcaggtgaccctgctggagccggtggacgaggtggtggtccgggtgccggacacctacgtcggcgcggtgatgagtgacctgtccggccgacgcggccgcccgctgggcaccgacaccgccgaggacggcgggcacagcctggtccgggccgaggtgccggcactggagctggtccggtacgcggtggagttgcgtgccctctcctcgggagccggcacgttctcccggtcgtacgtccggcacgagccgatgccggcccacctcgtcgaggcggtgaagaaggagcacgccgtcagatag

SEQ ID NO: 4717 - DNA, 621 bp, Actinoplanes utahensis
atggcaaagatcgtccaagtaacggcccgtgccgtcgtctcgtacggcgtcaacccggtcgcacgttccctgctcaagatcggcgtctcacccgacgccgtcaccgtcgcgggcactgtcggggtgctgatcggttcgtacttcggtgcgcgcggtcacctcttctggggcacctggatcgtaaccgcctgcgccctcaccgatgtgctcgacggcacaatggcccggcttcggggcagttccggcagattcggcgcgcttctcgactcgtcgatggaccggatcgccgacggcgccgtgttcggcgccgtcgtctactacctggccacccagggcaatccgtacggcggtgtccccgccgcgctgatctgcctggccgccggtcaggtggtgtcgtacgtgaaggcccgcgcccagtcgctgggcctggacgccgacgtcggcgtcgccgagcgcctcgagcgtctgatcatcgtcggcatcggcggcctgctgggcagcgccgggctggcctggggcctgcccgccgcgctctgggtgctggccgcgctctcgctgttcaccgtcttccagcggctgctgcacgcccggcgcaccgagcccaaggtcgcggccgagtga

SEQ ID NO: 4718 - DNA, 867 bp, Actinoplanes utahensis
gtgaaggaccggctgaccacgctcggctacctggccggctggcggctggtgcgggcgctgccgctcccggtcgcccgggcgctgttcaccacggtcgccgaccgcgcctggaaagccaacggcaagggcacccagcggctgcgccgcaactaccggcaggtggccggcccggacatgccggagaccctggtccgggacgggctgcggtcctatgcccggtactggatggaggcgttccggctgccgtcacagacccgggagcagcacgtggccggcttccacatggaggccgccagctatgacgagatgaagagcgtcatcgccgagggcaacggcatcgtgctggccctgccgcacatcgccaactgggacgcggccgcggcctgggtggtgtcgcacggctggcagatgatcaccgtgcaggagcggctcaagccggaggcgctgttccaggcgttcatggactaccgggagagcctcggcatgcgggtgctggcgctgaccggcggtgagcgggcgccgctcgacgtgctcgccgagcacctgcggcagggctgggtggtcccgctgctggccgaccgggacatgtcccgcaacggcgtcgaggtggagttcttcggcgggcggacccggatgccggccggcccggcgatcctcgcggtgcggtccggcgccccgatgtatgccgtcgacatgtggtactccgagcatcgcgtcgaggcccggctgcgcaagatcaccccgccggtggacgggccactcgacgagcgggtgaaacgcaccacccagctgatggccgacgccttcgcggccggcatcgccgaacacccgcaggactggcacatgctccagaaactctggctctag

SEQ ID NO: 4719 - DNA, 1137 bp, Actinoplanes utahensis
ttgcggatcgggatcgtctcgccctactcgttcgacgtgcccggcggcgtgcagaaccacatcatggacctcgccgaggcactgatcggtctcggacaccacgtgagcgtgctggccccggccgacgaggacgccgagctgccgcactacctggtaccggccgggcgggcgctgccgctgccgtacaacgggtcggtggcccggatcgccttcggcccggtctccaccgcccgggtgcgccgctggctggcccgtggcgagttcgacgtgctgcacgtgcacgagccgctgacccccagcctgtcgctgctcgcggtgctctccgcgcgcggcccggtggtggccaccttccacaccgcgatgacccgctcccgggcgctcgccgtcgcgcagaacttcctgcagccggtgctggagaagatcaccgcacggatcgcggtcagcgaactcgcccgcaaggtgcaggtcgaacacctcggcggcggcgcggtcgagatccccaacggcgtcgcggtggcgaaattcgccaccgccgccgccctgcccggatggcccggcgagggcgggaccctcggtttcctcggccgtttcaccgagcctcgcaagggcttccccctgctgcgtacggcgtttgtcacgctcgcccgggagcgtcccggcctgcgcctgctggtggccggcccgggcgaccgcgacgagctgttcgaccggatcccggccgagctgcacccccgggtcgagttcctcggcctggtcagcgaggcggacaaggcccggatgctgcgcagcgtcgacatctacgtggcgccgaacaccggcggcgagagcttcggcatgatcctcaccgaggcgatggcggccggcgccacgatcgccgccagcgacctcgacgcgtttcgtcgggtattggacggtggccgggccggcgcgctgttccccaacggtgacgccgccgcgctcaccgcgctgctcagcgcgctgctcgatgatccggtgcggcgcgctgacctggcaagctgcgcccgccaggtggtcggtacgttcgactggccgagtgtggccgcccgggtgctggaggtctacaccacggcgatcgaggcgaccgacggtcgggtcttcgacgccgacgaggcctga

SEQ ID NO: 4720 - DNA, 501 bp, Actinoplanes utahensis
gtgctgggtgcgatcctctcggcgtacctcggctggatcgcccagcgggtcgaacgggtgcacgcccgcgcccagtccgccgagcgggccctcgacgcccacctgctgcgccgggccgcggcggcggccgtggtcgccgagcgcaccgatgcggtggagctctacgcggccgcccggctggccctcgacgcgggccctgaggaacgtgagtcggcggagaacgacctgacccgccagctgcaggggatcgagctggacccggcggacaccgcggcgcgcacgctgatcgcctccagccgccgggtggtgctggcccggcaggtgcacaccgatctggtgcgcgacgcgctgaccgcgcggcggcgcaaggtggtccgggtgctgcggctgcccgggcgctatccgcgcccccgctacttcgacatcgtcgagccggtcatgccgccgctgccggtgtccgccgccacgcacgaggcgccgctgccggtccaggcggtctga

SEQ ID NO: 4721 - DNA, 897 bp, Actinoplanes utahensis
atgtctgagaaccagccggccgtcggaaccgcccgcgtcaagcgcggcatggccgagatgctcaagggcggcgtgatcatggacgtcgtcacccccgaccaggcgaagatcgccgaagacgccggcgccgtcgcggtgatggcgctggagcgggtcccggccgacatccgcgcccagggcggcgtgtcccggatgtccgaccccgacatgatcgacggcatcatcaacgccgtctccatcccggtgatggccaaggcccggatcggccacttcgtcgaggcccaggtgctgcaggcgctgggcgtggactacatcgacgagtccgaggtgctgaccccggccgacttcgccaaccacatcgacaagtggcagttcaccgccccgttcgtgtgtggcgccaccaacctgggcgaggcgctgcgccggatcaccgagggcgcggcgatgatccgctccaagggcgaggccggcaccggcgacgtctcgaacgcgaccacccacatgcgccggatccgggccgagatccgccgcctgcagaccctgccggaggacgagctgtacgtcgcggccaaggagttgcaggcgccgtacgagctggtcaaggaggtcgccgaggcgggcaagctgccggtggtgctgttcaccgcgggcgggatcgccaccccggcggacgccgccatgatgatgcagctgggcgccgagggcgtgttcgtcggctcgggcatcttcaagtccggcaaccccgcgcagcgtgccgccgcgatcgtcaaggccaccacgttccacgacgacccggacgtgatcgccaaggtctcccgcggcctgggcgaggccatggtcggcatcaacgtcgacgagatcccgcagccgcaccgcctggccgagcgcggctggtga

SEQ ID NO: 4722 - DNA, 594 bp, Actinoplanes utahensis
gtgctggccctgcagggcgacgtgcgcgaacacctgtccgctctggccgagtcggacgtgctggcccgaccgatccggcggcccgaggaactggccgacgtcgacgcgctggtgatccccggtggcgagtccacgacgatgagcaacctggcgatcactttcggactgctcgacccgatccggaaacggatcgcggacggcatgccggtgtacggttcctgcgccggcatgatcatgctggccaccacggtcctggacgggcggcccgaccaggagtccttccagggcatcgagatgaccgtccggcgcaacgcgttcggccggcagatcgactcgttcgagggcgccgtggagatcgagggcatcgagggcggcgagttccacgccgttttcatccgcgcgccctgggtcgagcaggtcggccccgacgtgcgggtgctgggtcgcgtggcctccggggacgccgccggtaggattgtggccgttcggcaggggaacctgctcgccacggctttccacccggagctgaccggcgaccttcgcgtccaccggtacttcgtcgagatggtccgccaggccgcacccgcacggtag

SEQ ID NO: 4723 - DNA, 753 bp, Actinoplanes utahensis
atgtccggccactccaagtgggcgacgaccaagcacaagaaggcggtcgtcgacgccaaacgcggcaagatgttcgccaagctgatcaagaacatcgaggtcgcggcgcgtaccgggggcggcgacccgtccggtaatcccaccctctacgacgccatccagaaggcgaagaagtcctcggtcccgaacgacaacatcgaccgggccgtcaagcgcggctccgggctcgaggccggcggcgccgactggcagacgatcatgtacgagggttacgggccgaacggcgtcgccatcctgatcgagtgcctcaccgacaaccggaaccgcgccgccaccgaggtgcgcacccggctgacccgcaaccacggcacgttcgccgacgcgggcagcgtgtcgtacctgttcaaccgcaagggcgtggtgatcgtccccaagggtgagctgaccgaggacgacctgatgctggccgtcctcgaggccggcgccgaggagatcaacgacctgggcgactcgttcgaggtggtcagcgagccgaccgacctggtcgcggtccgcaccgccctgcagagcgccggcatcgactacgactcggccgagtcgtcgctggtgccgaccatgacggtcgaggtcgacgaggacgccgcgcgcaaggtgttcaagctgatcgacgcgctcgaggactgcgacgacgtgcagaacatctacggcaacttcgatgtctcggatgagacgctagctcaaatcgagggctag

SEQ ID NO: 4724 - DNA, 636 bp, Actinoplanes utahensis
gtgatcgtgggatgggctgaggacttggacgtctcgggtgacacggcgccttgggaacgaccggacttgggtcggtggcttggagacacgccgccggcccagttcgacatcatcgccggaatgaagatcgaccgcctgtcgcggaaccttcttcacctcgtccggctgatcgattgggcggctgagcgcggcaagtacgttgccgcgtacatggacagcgtcgacacgtccgacaagaccggcgaactgatcgccaaggtactcgcactcttcgctgagttcgaaggtacgacgatcgcagagcggtcagcacagtcccgggaacaccttcgccggataggccgctggcatggcggcacggcgccctacggttaccggcccgtccggaactccaaccgtgcaggtggggtgttcgagcatgaccctgataccttgatcgttttccgcgagatcgtcgaacgggtcaaggatggcaagagcatccgtagcgttgctcaggatttgaacgctcgcggtgttctatccccgcgggaccatgccgcggactctcttaggtctagtcggcgacctggaggtcatggagaagcgattcattcccggcgcggaccatacggaagaactccggaaagtcgataa

SEQ ID NO: 4725 - DNA, 135 bp, Actinoplanes utahensis
atgaaagatcagaaagaagccaaccgcgaagacggcaatacccgcaagtccgtatccgacagccttcgacagaaggcgatctacctcgcttcggtcggcagtcaggtgcagcttgatggagtagtacgcccctag

SEQ ID NO: 4726 - DNA, 561 bp, Actinoplanes utahensis
ttgaatgacccggtgctgcacctgtcagccctcgaggatctggacgtcgaggaccttgcccacctgccccgcggctatcgctacgaactgcacgacggaaacctcgtcatcatgacgcccgcctcctaccggcatcaggacatggctgggcgcatctatgtcatgcttctcgcggtcggtgcccgagcatttctcgatcctggagtgcgcgggactcgggagcgggactgtcgtctgcccgatgtcggtgtcgtcgccgctctgccgccgaacaccgccgactacgcgaacttgccaggttcggccatgagcctcgtggtcgaggtgatctcggagaagtcgccgaacggcgaattcacccacaaggccgactggtatgccgagcagggcatcgcggagtactggatcgtcgagcgggacgccgagaagtcccacgacgacgccacggtgcatattcaccggctggtgacccatggcgacaagccggactatttccgcgagcggactctgccgctctcccagctggagcgggagtatgccgcgaagcgggcggcaggctag

SEQ ID NO: 4727 - DNA, 654 bp, Actinoplanes utahensis
atgccgagcacgcgcatcacggcctcccctcacgtacgtgtgttcgacaccctagtacgcggttctcttgcgcccgccgccgacacgcctcgaccatgggtacgggaggtcccgatgaacgtcatcccgccgatgcaggacgatccgccaccggagttcgtccaggtgatcgcggcgcacgagccggtgctgcggcgcgaggcactgcgcctgaccggcggcgatccggtgggttacgcgatctacgaggaggcgctgaccgacctggccggccactggcgtcggttgcggttctggagccgggtgaccggcaccgacgtgcccggtgactacctgcgccagcgcatcctgaagcggacccgggcatggcgggaggatcaggtctacgaggtggaggtccgggtgctgcgcaccccggcgccgtttccggtcccggtgggcggtccggcgccgagtctcgctctccgcaaggcttcgctgattgacggtacgtcacgagcggggctgctgaccctcgccgacgccgccgtggcctggtgtcacgcatggcgccgctccgagcaccgccggatcctccggctgatcatcggcggcctgctcctgatcgccaccatgatccagaccatgtcctggctcgccggccccggttcctag

SEQ ID NO: 4728 - DNA, 528 bp, Actinoplanes utahensis
atgcgcgtgctcggcatcgatccgggtctcacccggtgcggcgtcggcgtggtcgagggggtccccggccgccccggcacgctgatcgcgtaccacgtggtccgcagcgagccggacgaggacatcgcgatgcgcctgctgcacctcgaccgcagcctcgccgagctggtcgccctgcaccagccggagagcgtcgccgtcgaacgcgtgttctcccagcacaacgcgcggaccgtgatgggcaccgcgcaggccagcgcggtcgcgatcctggccgggtcgcgggccgggctgccggtgcagacctacactcccagcgaggtgaaggcggcggtcaccggctccggcaccgccgacaagaagcaggtcaccgcgatggtcacccggctgctgaggctcgacgccccgccccgaccggccgacgcggcggacgccatcgccatcgccatctgtcacatctggcgcgggggcacccgcgcccggatccaggccgcggccgtggccgccgcccgcaggagcgcccgatga

SEQ ID NO: 4729 - DNA, 603 bp, Actinoplanes utahensis
atgatcgccagtgtgcgcggccgagtcgccgcgatcctccatgacagcaccgtggtcgaggtgggcggtgtcggcatgcgggtcttctgcacgccgaacacgctggccgcgctgcgcaccggcgcggaggcccggctggccaccacgctgatcgtccgggaggactcgctcaccctgtacggcttcgccgacgacgacgagcggcagctgttcgagctgctgctgaccgcgaacggggtgggtccgcggatcgcccaggcggtactcgcggtgcatcagccggacgcggtgcgccgggccatcggcggcggcgacatcgcggcgctcacccaggtgccggggatcggcaagcgcggcgccgagaagatgatcgtcgagctgaaggacaagatcggcccggtcggcttcggcgatgccggcggcaccggcgtgctggccggtgcctggcaggagcaggtccggcagggtgtgctcgcactcggctggagcgccacccaggccgatcaggcggtcgccgcgatcggcgagacgatcgacggtgaggtcccgccggtgccgattctgctgcgccaggcgatccggctgctgggtaggacccgatga

SEQ ID NO: 4730 - DNA, 1047 bp, Actinoplanes utahensis
atgaccgacgacttcctgtccccggaggcgggcgacgaggaactggacgcggaggccagcgtccggcctcgccggctggccgacttcatcgcccagcaccgcgtccgcgaccagctggagctgctgctgaaagcgtcgatgggccgcggcaccccgcccgatcacatcctgctgtccgggccgcccggcctcggcaagaccaccctggcgaacatcgtggcggccgagctcgggaccgggatccggaccaccagcggtccggtgatcgagcgttccggcgacctggccgcgatcctgaccgggctgggccccggcgacgtgctgttcatcgacgagatccaccgcatcgccaagccggccgaggagctgctgtacagcgcgatggaggacttccgggtcgacgtggtggtgggcaaggggccgggcgccaccgcgatcccgctggacgtggagccgttcacgctggtcggggcgaccacccgggccgggctgctgagcgggccgatgcgcgaccggttcgggttcgtcgcgcacctcgatttctattccccggccgacctggacgcgctgctgcaccggtcggcgcggatcctcggggtgccgatcaccgcggcgggcgccgccgagatcgccggccggtcccggggcacgccgcggatcgccaaccggctgctgcgccgggtccgtgactacgccgaggtgcgcggcgacggggtggtcaccgaggagatcgcccgggccgcgctgcaggtgtacgacgtcgacgcgctcggcctggaccggctggaccgggcggtgctgcgggcgctgatcgagtcgttcaaggggggcccggtcggcctgtccaccctcgccgtcgcggtgggggagcagtccgacacggtggaggaggtgtgcgagccgttcctggtgcgggccgggctgctggcccgcacgccgcgcggccgggtggccaccgaggccggttgggcccatctggggaagactccgcccaccgacggcaggtccggggtgtttcagggtgacctgttcgcgcgagatgcgtga

SEQ ID NO: 4731 - DNA, 438 bp, Actinoplanes utahensis
ttgacgccccggccccgccccgcagcggtcccggtggcctacggaaggctgtttctcgtgcacctggccgcgtcctccagctctaacccgctggggctgttcctgccgttcgtcctgatcctcggtgtgatgtatttcctgatgatccggccccagcagaagcggcgccgtgaggcgatggagatgcagaacaagctcggggcgggcgacgcgatcgtcaccatcggcggcctgcacggcaccgtggtgaccgccgaggacgacgtggtcctgctggagatcgccgagggtgtacaggtcacgttcgcgcgcccggcgatcgcccgggtggtcacccgcgccggcgagccggccgaggccgccgcggagccggtcgtcgcggagccgatcgtcgccgagccggagagccccgtcgtcgacgtccgcaagcaggactga

SEQ ID NO: 4732 - DNA, 570 bp, Actinoplanes utahensis
atgcatcctggacgccaactcggcgtgctcggcctgatcttcgtcgtcctgtatctgttcgtcttcttcggcgggcacgccaagggcaccttcaccgatcgcctgaagccgaagatgggcctcgatctggtcggcggcacgcaggccacgtacatcgcgacgcaggccggtggcgcaccgaccccggaggcgatggcgcaggcccgggacatcatcgacaagcgggtgaacgccctcggtgtcgccgaggccgacgtcgtcatccagggcaagaacaccatcgtggtctccctggccggtgaggcgaaggaccagctcaaagacctgggcaaggccgcgaacatgcggttccgcctgctcaccggcaccaccatggacgtgtcgaagaacgcgctgaacccggcctcgccggcgcccagcgcggcagcgtccggtgccccgtcggtcgcgccgtccggtgcggccgtgccgaagagcggcgccagcgccccggccgcggtcgtcagcccgtcgaagggcaccggcggccagggcggtggcgaggcggtgccgagcgccctagctagctag

SEQ ID NO: 4733 - DNA, 1128 bp, Actinoplanes utahensis
gtggccgcgctcagcccgcagatgcagttcaacgtgccgacgatcagctgcgaccagctgaaccagcggccgaacggctcgatcgacgacccggcgcagccggtggtggcctgctacagcagccaggccaaggtcatgctggacccggcgaaggtggtcggtaacgacatctccagcgccagcccgcagctcgaccagcagaacggtcagtgggtcgtctcgctggacttcaagagcgacggccagaagaagtgggccgacctcacccgggtggcgttcaacgcgacctccagcgacccgtgctacaccgcgatccagtcgctctacggcacgtcggtccagcactgcgcggtcgccgtcgtactggacaaggagatcctgtcggcgccgcagatcaccgcggtgctgaccggctcgtcgcagatcaccggcagcttcaccgcggcgaccgccaagcagctggccgaccagctgaagttcggcgcgatcccggtgaccttcacctcgggcccggcggagaccatctcggcgtccctgggtctgcagcagctgcaggccggtctgctggccgccgcgatcggcatgggcctggtggcgatctacgcgttcttctactaccgcctgctcggctcggtcatcttcctcagtctgctgctctccggtctgctcaccttcggtgcgctggtgttcctcggccggaccatgggctatacgctgtccctggcgggtatcgccggcttcatcgtgtcactgggtgtggcggccgactcgttcgtgatctacttcgagcgactcaaggacgagatccacgagggccgtacgccacgcagcgcggtgccgcgcgcctggcaccgggcccggcggacgatcatctcggcgaacacgatcaccatcatgtgtgccgtggtgctctacatcgtgtcgatcggcgcggtgcagggtttcgccttcgcgatgggtctctccaccgtgctcgacctggtcgtggtgttcctcttccggcacccgatcatgaccatgttcgccaacaccaaggcgttcctgtcgccgcgggtcagcggcctcggccgggtcctgcgccgcaacccgacggaggagcccggctcctcgcgtgtgaaggaggcctga

SEQ ID NO: 4734 - DNA, 1170 bp, Actinoplanes utahensis
atggcccgtgaaggactcgcgtcccgcctctacgcgggtgaagcgaacatcaacatcgtgggccgccggaagatgtggttcacgatcgcggccgcgctggtgctgatctcgatcggcagcttcgtggtccgtgggttctcgctcggcatcgagttcgccggtggcacctcgttcagtgtcccggccgagatcagcggcaagagcctgacccagaacgagatctccgacgcggtggcgaaggcggtgcggtcggccaactcggaggccaccgtcggctcgacccagaaggtcggcaacggcccgggcgccagctacaccgtgcgagcctcggcgctgtccgcggccgagtcggagtcggcgaagaccaccctggtcaaggacctgggcgtggaccccgccaagatcagtgacaaccaggtgtcggcggcctggggcggtcaggtcacccagcaggcggtgatcggtctggtcatcttcctggtgctggtggtcgcctacctgatcgtccgcttcgagtggcggatggcggtggccgcgctcgcctcgctcgtcctcgacctcctgctgaccgcgggcgtgtactcgctggtcggcttcgaggtgacgccgtccacggtgatcggcttcctgacgatcctcggttactcgctgtacgacgtggtcgtcgtcttcgacaaggtgcaggagaacacccgcgggatcaccgcgggcagtgtccgcacctacagcgaggcgaccaacctggcggtcaaccagaccctgatgcgctcgctgaacaccggcctggtggcgctgctgccggtcggtggcctgctcttcatcggtgccggcctgctcggcgccggcacgctgaaggacctgggcctggtgctcttcgtcggcatgggcttcggggtgctctcctcgatcctgttcgccgcgccggtgctgagcgcgttgaaggaccaggacccgaagatccgggcgcacaacgcccgggtgctgacccggcgggccggccgctcggaggacgtggcccggggcgagcgccgcccgggcaacgccaccgactcggacgtcccggcgatggccggtagcaccaccccgcgcccgggtgcccgcccggcggcccggcgtggcgccaaccgcggcggcacggccggcaaccggccggacggcaagcggcgctga

SEQ ID NO: 4735 - DNA, 801 bp, Actinoplanes utahensis
gtgcccgcccggcggcccggcgtggcgccaaccgcggcggcacggccggcaaccggccggacggcaagcggcgctgacaacgcggccggcggcagccggcaacggtacggaacacgggacggcccggcaccgcgtgagcggtggcgggccgtttcacgtcaggtcgatccgggcagcgggcgccggtgccccggcgggggcgcggtcgcgccgatccgctggtctaggctgtccgccgtgactaccgagatccccgcggcgcccggcgacagcggccccgagctggccgccctggtcgcgggtgccagcatcgacgtgccggacttccccaagccgggcgtcgtcttcaaggacctgatgccgctgttcgccgacgcggtggtgttccgccgggtgatcgacgggatcgcggcccatcacggggccggctcgttcgacgtggtggccggggtggaggcgcgtgggttcgtggtggcggccgcgctggcctatgccaccggcaccggcgtggtcccgatccgcaaggccgggaagctgccgcgcaaggccctgtccgcctcgtacgcgctggagtacggcgaggccaccctggaggtgcacgaggacgcgttcgtcgccggacagcgcgtcctggtggtcgacgacgtgctcgccaccgggggcaccgcggccgccgcgatggacctggtggagcgggccggcggcacggtggccggcttcaccgtgctgatggagctgggtttcctgggtggccgggagaggctcgccccccgtacagtgcacgcgctgttgaccgtttga

SEQ ID NO: 4736 - DNA, 2433 bp, Actinoplanes utahensis
gtgtccagcgacgtcgtccctccggcggagggcacggtgcaaccgacccaggacccgcggaccggcacgggcgatgtcgcgcccgccgaggcccgcatcgatgacaagaccgccggcgatccggagaccacccagccattcacgccgaccggggagacctccggcttcgggttcgccagcgcgcccaccgggcgccgggtgcgggcccggctggcccggttcaacgcgccctggcagagcacccaggtcagcgaggtgctcgagccgctgatcgcgacgcaccgggcgagccaccccaagggcgacgtccgtcagctgcagaaggcgttcgacgtcgcggcccgctggcactcggggcagtaccgcaagtccggcgacccgtacatcacccatccgctggccgtcgcgaccatcctggccaacctgggcatggacaccaccaccctggtggcggccctgctgcacgacacgatcgaggacaccgactacggcctggagcagatgcgcaacgacttcggcgccgaggtggcgctgctggtcgacggcgtcaccaagctcgaccgggtcaagctcggcgacgcggccaaggcggagacgatccgcaagatggtcgtcgcgatggccaaggacccgcgggtcctggtgatcaagctggccgaccggctgcacaacatgcgcaccctgaccttcctgccccgcgccaagcaggagcagaaggccaaggagacgctggagatcctggccccgctggcccaccgcctcgggatgaacacgatcaagtgggagctggaggacctcgccttcggcaccctgttcccgaaacggttcgaggagatcaaccgcctgatcggggagcaccagccgcagcgggaggcgctgctgcgccaggtcaccaaccgggtcagcctcgacctcaagtcggcgaagatcaaggccgagaccaccggccgccccaagcacctctactcgatctatcagaagatgatcgtccggggccgggacttcaacgacatctacgacctggtcggcgtccgcatcctggtcgacacggtccgcgactgctatgccgcgctgggtgtgatccacgcgaactggcagccggtgccgggccggttcaaggactacatcgcgatgccgaaattcaacatgtaccagtcgctgcacacgacggtgatcggcccgaccggcaagccggtcgagatgcagatccgcacgttcgcgatgcaccgcacggccgagttcggcatcgccgcgcactggaagtacaaggagcagaagggcgcgacgatcgtcggcccgccggcgcacatcgacgagatgacctggctgcggcagctgctcgactggcagcgggaggcgagcgacccgtccgagttcctggacgcgctccgcttcgacctctccagccaggaggtctacgtcttcacccccaagggggacgtgatcccgctgccgaccgggtccacgccggtcgacttcgcctacgcggtgcacaccgaggtcgggcacaagtgcatcggcgcccgggtgaacggcaagctggtgccgctggagtcgacgctctccaacggcgacgtgatcgagatcttcacgtccaagtccagcaccgccggccccacccaggactggctcggcttcgtcaagagcccccgggcccggaccaagatccgccagtacttcaacaaggagcgccgtgaggaggcgatcgaggacggcaaggacgcgatcgtcaaggcgatgcgcaagcagggcctgcccctgcagcggatgctgaccagcgagaatctcacgacgatcgcgcgtgacctgcacctgcccgacgtctcctcgctctacgccgcggtcggcgagaacaccgtctcggcgcagtcggtggtcgccaaactggtcgccggcttcggcggcgaggagggcgcggtcgaggacatcgccgagaccgccgtcgcgacccgcccgccccgcaaccgcagcaccgcgcaggacccgggcgtggtggtcaagggcgtctcggacgtgtgggtgaaactggcgcgctgctgcaccccggtgcccggcgacgaggtgttcggcttcgtcacccgctccggtggggtgagcgtgcaccgggccgactgcgccaacgctcaggacctgcgcgagcaggaggagcgggtggtcgaggtcagctggaagccgacgtccgcgtcgacgttcctggtggccatccaggtcgaggcgctcgaccggcacaagctgctggccgacgtgacccgggtgctctccgaggagcgggtgaacatcctgtccgcgacggtcaccaccacgcgggaccgggtggcggtcagccggttcaccttcgagatggccgacccgaaacacctgggccacctggtggccgcggtgcgcaaggtcgacggcgtcttcgacgcgtaccgggtcacttccggagcctga

SEQ ID NO: 4737 - DNA, 831 bp, Actinoplanes utahensis
gtgtcgtcgatcaaggaccggcagcgcgcggcggcgcgggcccggctcgagaaggagatggccgagcgggccaccgccgccaagaaccgacgccgccgccaggcgatcatcggttccgccctcgccgtggtggtgatcgccggtgtcgccgtgctgctcgtcaaccacctgaagaaggacgacaagaagcccaccgccggcgccagcgccctcccggccggcaccgtcgcctgcacctggaccccggccggcgcgaccggcggcaaggtcaaggaggtcggcaccccgccgaccgcggtgccgaacaccggcaccagcacgctgaccctcgacaccaacctcggcccgatcgaggccacgatcgacctcagcaaggccccgtgcaccggcgccagctacaagttcctcgcgtcgaagaacttcctcgacaacaccaagtgccaccgcctggtcaaccaggacggcttcaaggtcctgcagtgcggcgacccgttcgccaccggcaagggataccgcgagaccgacggtcagggcggccccggctacatgatggccgaggagaacctgccgaccgacacgaacaacccgtatcccgcgggctcgatcgcgatggcgaagacgcagcagcccggcacgaccggcagccagttcttcatctgcgcggacaacacccagctcccgccgcagtacacgctgctgggcaagatcaccaagggtctcgacctggtgcagagcgtggtgaaggccggtgacgacggggcgttcgcgcagtcggccggcggcggtcacccgaagaaggaactcgacatcaagacgatgacggtctcctga

SEQ ID NO: 4738 - DNA, 870 bp, Actinoplanes utahensis
gtggctcccagcaaggaccggcagcgcaagctcgcgcgcgcgaaatacgatcgccagatggctcgccgggccgttcgggagcgtcagcgccgccgcgtgctggccggcgccggcaccgcgctcgctgtcgtgctggtggtcgccgccggcctgtggatcggcggcgtcttcgacggcaagggcaagtcgaccaccaccgaggcgcaggacgactgcatctggacgccgttcgacaagtcgaagaacgccaatctcaaggaggtgggcaccccgcccaccaagaacgtcccgcagaccggcaccgagcagatgacggtcaccaccgacctgggtgcgccgctcgtcgcgacgctcgacgtcgcgagcgccccgtgcgccgcggccagcttctcgtacctggccggcaagcagttcttcgacggcacgccctgccacgaggtcctcgacatcggcgcggtccactgcggtgacccgagcggcaccggcctgggcggcccgacgtacagctactacgacgagaacatcccggaccggccggcgcccagcgcctccgccggcgcgggcacggtggccaaacccaccgtgctctaccccaagggaaccgtcgccacgatcggcaacccggccggcagcaacggcagccagttcctcatcttcttcaaggactacgcgccgaccgccgccccgacctactcgatcctgggtcaggtcaccggtgggctggacacgctggcgaaaatcgccaagatccccacggtcgccgacagcgccggtgacaaggtcactcccaaggagaagatcaccatcaagagcctgaccgtcgccgcagacactgtcgcggcagcaccctcggcgagcgtgcagtcgtga

SEQ ID NO: 4739 - DNA, 699 bp, Actinoplanes utahensis
gtgctcgtcgccagctttccggcgcaggccttcggcaccaactgctatgtggtggccgccggcccgggcgagcagtgcctgatcgtcgaccccggcatcggtgtgctcgaccggttggacgaggtgctggcccagcaccggctgtccccggccgcggtgctgctcacccacggccacctggaccacaccttctcggtcgccccggtctgcggcgcccgcggcatcaccgcgtacgtgcacccggacgaccgggagatgctggccgacccgtcgaaggggctgagcaccgacctgagctcgctgttcggcggccgcctgcagtactccgagccggacgacgtcgccccgctgaccgacggcgcggtcctcagcctcgccgggctgcaggtcaccgtcgaccacgcacccggccataccggcgggtcggtgctgttccgcctgccgggcgcgggctcctcctgggacgcggaggagctctgtctctccggggacgtgctcttcgcgggctcgatcggacgcaccgacctgccgggtggcagcaccccgacgatgatggcgtcgctgcgggacaagatcctgccgctcgccgacgacaccgtcgtgctgcccggccacggaccggccacgaccatcggccgtgagcgcgcgtcgaacccgtacctgcgggacctgaccgcggcgcccggccgcttcctctga

SEQ ID NO: 4740 - DNA, 1311 bp, Actinoplanes utahensis
gtgcctatttccggcttccctgagtggctgccgccccagcgcatgatcgagcagtacgcgctggacaagatccgttccaccttcgagctgtacggtttcgccccgctggagacccgcgccgtcgagccgctggagacgctgctctccaagggtgagacgtccaaagaggtctatctgctgcaccgcctgcaggaggacgagtccggcaagcgggaggaccagctcggcctgcacttcgacctgaccgtgccgttcgcccggttcgtcgtggagaaccacggcaagttggtcttcccgttccgccgttaccagatccagaaggtgtggcgcggcgagcgcccgcaggagggccgctaccgcgagttcctgcaggccgacatcgacgtggtcaaccgggacaccctgccgttccacttcgacaccgagatgccgctggtgatcggcgacgtcttccggtcgctgccgatcccgcgggccaccatcctggtcaacaaccggaaggtctgcgagggcttctaccggggtctggggctggcggacaccgcgcaggtgctgcggaccgtcgacaagctcgacaagatcggcccggacaaggtggcggccgcgctggtcgagacggccggggccaccgacgcgcaggccgcggcctgtctgaagctggccggcatctcggcggcggacgcctcgttcgtggacgcggtccgcgcgctcggcgtcagcgacccgctgctcgacgagggcctggctgagctggagcaggtggtggtggcggccaacgagcacgcgccgggcctgatccgggccgagctcaagatcgcgcgcggcctggattactacaccggcaccgtctacgagacccaattgcaggggtacgaacgtttcggctcgatctgctcgggcggccggtacgagacgctcgcgtcggtcggcaacacccgtttcccgggcgtgggcatctcgatcggggtgtcccggatgctcggcctgctgttcggacagaacgctgtgtcggtgtcccgcaccgtgccgacgtgcgtgctgatcgcgctgcccagcgaggagcagcggagcgtctcggagcggaccgccgcggcgctgcgccggcggggcatccccaccgaggtggcgccgacggcggccaagttcggcaagcagatccagttcgccgaccggcgcggcatcccgttcgtctggttccccggcgagccggacacggtcaaggacatccggtcgggggagcaggtcgaggcggacaccgcgacctggaccccgccggccgccgatctgcacccggtggtcaccggagcctga

SEQ ID NO: 4741 - DNA, 522 bp, Actinoplanes utahensis
atgacccagactcaggcatcgctcgtggcgagccggacccgcaccttctcctggaccgacccggccgagcacgcgcggctgttcgtggagcgcagcgggctggaggtgctccaggcgatggcggccggcgaggtgccacccccgccgatcttccagctgatcggcggcaaccggctggaggtcgaaccgggcagcgtcacgatcacgctggacccgcaggagttccactacaacccgatcggcaccgtgcacggcgggatcatcgccaccctgctggacaccgcggccgcctgctcggtacagaccacactgcccgccggcatcggctacaccagcatggacctcaacgtgaagttcctgcgcgcggtcaccgtcaacaccggtctggttcgctgcaccggcacggtcctgcagagcggccgccgcaccgcgctggccgaggcgcgcctgaccgacgcccgaggtcgcctggtcgcccacgcgacctcgagctgcctgatcttcgacctgcccaaggcctga

SEQ ID NO: 4742 - DNA, 564 bp, Actinoplanes utahensis
atgcctgagtctgggtcatggacgcaggctggcacccgcttgctgcatctgtcaacgagacctagccttcacggcatggtcagccacgtcacaccgccggaagccctcgactgggacgtggacaactgcaccatctcgcgagccatggagatcctcggcgagaagtggacgatgctggtgctccgcgagatcttctccggcatccgacgcttcgacgacatgcgggtgcgtacccggataccccgacaggtgctcgccaaccggctgaccgccctggtcgcggccggggtgctgcgccgtgagccgtaccaggagccgggcgcccgggtccgccacgagtaccggctcaccgagaagggcttcgacctctacccggtgctgatcgccctggccggctggggcaaccgctacctggccgacccggccggcccgccgatccagttcgtgcaccgcgagtgcgcggccgaggtggatgtggcgatccgctgcgccgacggccacgacgtcaccgaccaccgcgacgtgctgccccgcccgggtccgggcgcccggcgccggggctag

SEQ ID NO: 4743 - DNA, 888 bp, Actinoplanes utahensis
gtggacgcccggctactgctgatcgggggcgccgccgggccggcactgctcatccgcttcgtcgagctggccgggtcggcgtccgcccggatcgtggtgatcgccaccgccagcgcggagccggccgtcgccgaggagtcctccgtcggtgccttccggcagctgggcgccggatcggtgcgcgcgctgcggctggccagccgggccgacgccaacgcccccgcggcggccgccgcgctgcgcgaggccaccggaatcttcttcaccggcggcgaccagcggcggatcaccacggtgctgggcggcaccgcgaccgactcgctgctgcaggagctggtggccggcggtacgacggtgctcggcgggaccagcgcgggcgccgcgatgatgtcggccaccatgatcatcggcggcgacggtcccggagtgaccgcggccagcgtgcagaccggtcccggtctggaattcctgcccggcgtcctgatcgaccagcacttcgcccagcgcggccggctgaaccggctgctcagcgccgtcgcgctctacccgcacgagctcggcctcggcatcgacgaggacaccgcgatcctcaccgacggcgaccggttcgaggtgctcggcagcggcgcggtgacggtcgtcgacgccggcgccgccaccgacatccgggtcccgcccagcgggccgatcgccctggccggagtgcgcgtccacgtgctgccggccggccacaccttccacctgaccggccgtcggccggggatcggggacacccctcatgaagatcgagagcctgcgccgcctgcgcggccccaacgtgtatctgtcccggccggcggtggtggcccggttgcgcctggaggagctgaccggccgggagacctctga

SEQ ID NO: 4744 - DNA, 2838 bp, Actinoplanes utahensis
atgaagatcgagagcctgcgccgcctgcgcggccccaacgtgtatctgtcccggccggcggtggtggcccggttgcgcctggaggagctgaccggccgggagacctctgacgtcaccggcttcaccgaacgcctgctgcgggcgctgcccgggctggccgagcaccactgcgcggccggcgcgccgggcgggttcgtcagccggctgcgcggcggcacctacttcgggcacgtcaccgagcacgtctgcctggagctgtcccagctgatcggccgggacgtcagcttcgggcgcaccgtgtcggccggcgagccgggcctctacgacgtgatcctggagtgcccggtcgacgagtcgcccgagtcccgggtgcccggcgagctgctggaggccgcggtggacctggtgctggcggtgcaggccgggcaggcggggcagccgccgcgcctggccgagctggccgccctcgccgagcgggaggcgaccgggccgagcacccgggcgatcatcgcggccgcccggcggcgcggcatcccggtcgagcggttcgacgacctgagcctggtccggctcggctggggcacccggcggcggatggcctgggccgcgatgaccgaccggaccagcggcgtcggcatcgacatcgccggcgacaagcacgtcacccgctgcctgctcggcgaggccggcatcccggtggcggccggcggcgcggcgaccaccgtggaggaggcggtgcggctgctggacgagctcggcgctccggtcgtggtcaagccccggcagggccgtcagggccggcacgtggtgctcgggctgggcacccgggaggcggtcgagcgcgcgttcggcgaggccggcggcgacgtggtggtcgaacggcagctcgccggccgcgactaccgggtgctgatggtggccggcgaggtggcggccgcggccgagcggatcgccgcgcacgtggtcggcgacggtacgacgaccctggccgggctggtcgagcggaccaacgccgacccgcgccgcggccccggccactcccgggtgctgacccggatcgcgctggacgaggtggcgctgcgggtggccgggatcggcccggacgacgtgccggccgagggggagacggtctggttgcgcgagtgcgccaacctgtccaccggcgggaccagccgggacgtcaccgaccaggtgcacccggacgtgacccggctgtgccagcgggtggtcgccctggtcggcctggacatcgccgggatcgacctgcgcctgccggacatcggggcgccgctcccgccggccggggagaccgagccggccggcggggtgatcgaggtgaacgcggtgcccgggctgcggatgcacctggccccggtacgcggccgctcgcgggacgtgggcgacgcgatcgtccgggcgatgttcccgggcggctccgacgggcggatcccgaccgtcgcggtgaccggcacgaatggcaagaccaccgtcacccggttgaccgcgcacctgctcggcggtggcgggcaccgggtcggcgcggccaccaccgacggggtgttcgtcgacggccgggcggtgtacctggccgacgccaccgggccgcgctcggcacagcaggtgctcggcgacccgcaggtggacatcgcggtgctggagaccgcgcggggcgggctgctgcgccgcgggctgggctacgactggtcggacgtcggggtgatcaccaacatcaccgcggaccacctgggtcaggacgggctggactcgatcgaggacctggcgcacgtcaaggcggtggtggccgaacgggtccgggacggcggcacgctggtgctcaacgccgacgacccgtgggtgcgcagcctggcgtcccggccccgggtgcgggccgaccggaaacgactggtctggttcgggctcgacccggggaacccggtgctgaccgagcacctgggccggggcgggaccgcgtacctgctgcaggacggttggctcgtgcaggccaccggggcccggcgcacgccgctgctgcgggtggccgaggtgccccggggcgtacggcggcgccgccctgcacggcgcggccaacgcgctcgccgcgatcgcggcggcccgggccctgggtgcccgcccggagaccgtggcggcccggctcagcgagttcgacccgggcgtcgacaacccgggccggggcaccctgctgcggctcggcgacgtctcggtcttcctggactacgggcacaacccggccgcgctcgccgccaccctgcgtaccctgcaccggctctggggggcgaaccggtgcgtggccgcggtgacgctgccgggcgaccggcgcgacgacctgctggccgcgtccgcccagattctggcggacgggctgacccgggccgtgctctacgacgaccaggaccggcggggacgcgcgccgggggaggtgccggcgctggtcgagcgggagatgcgggcccgccggccgaacctgcgggcggtccgcgcgaacgggttccgggaggcggtgaccaccgcgctggatctggccgagacgggcgacgtggtgctggtgatctacgagaagtgggggccgatgcgggccttcctgaccgagctgggcgccggcccggccggtgcccggccgatgacgccggtcaccgccgcggtgcgagccatcccacaactggtgtcaagcagtgtgacagatcatggacatttttgatctctctgcgtagtgattcattgaccgatcgtgtctgtctccacgatggagtgacccggtacttgaaacagcaagttccgacgaagcgggcaatccctaggtccgctcgtggcgctgcgtga

SEQ ID NO: 4745 - DNA, 942 bp, Actinoplanes utahensis
atgagcacggcggacctacccggttcgggactgctcgccgggcgataccggctggtcgagcggctcggtgccggcgggatgtcagtggtgtggcgagggttcgacgaagtgctgggccgtcaggtggcggtcaaggtcctcccgccgtccaccagcgcggacccgtcgttccggcgccgactgcgcgccgaggcgcaggccgcggcgcggctgagccacccgcacatcaccaacgtctacgactacggcgaggccagcacggtcgacggcgagcccgtgccgtacgtcgtgatggagctcgtcgacggcgagtcgctggccgccgtcctggcccgggtccgcaccctgccgtggaaccaggccgtccggatcagcgccgacgtggccgccgccctggccgccgcgcacgcgcgcgggatcgtgcaccgcgacgtcaccccggccaacgtgatgctcaccccggccggggcgaaagtggtcgacttcggcatctccgccctgatcggggagaacgacaccgacccggacggcagcctgctcggcacccccgcctacctggcccccgagcggctggaaggcggccaggtcagcccggccaccgacgtctacgcggtcggcctgctgatctaccggatgctgatcggtcagctcccgtgggacgtcggcaccaccaccgcgctgctgcgcgcccaccagtacgtggagcccgacccgctgccgccggtcgacggcctgccccgcgaggtggacgccctggtcggccgctgtctggagaaacggccggccgaccggccgccgaccgccgaggtggcgcacctgctcgccggcgtcgcggccggcgcccaggccgccgcggccaccggcttccggggcgactgggaggacagcggcgaggacaccacgatcctgccctccggctacccgtacgcggggatgggctag

SEQ ID NO: 4746 - DNA, 861 bp, Actinoplanes utahensis
gtgtcgccgtccgccccggccgacgaccggtccccggcccccggcaggcggcaggtgcgcacccggcgggccctggtggtggccggcaccatcgcggtgatgagcgcgctcacctacggctggagcctggccgcgcccggtgccggggacaagcgcgccgacgcggtcacgcccggcccgagcgtggtgcccgcggccggcaactgcatcgtcagctacgccgtctggtcgcaggagaaggggcgcttcaaggcccaggtgaccctggccaaccggggcgacaagccggtcgacgactggcagctgtggttcctgatgcccggcgaccagatcctgtccggccggtcgctgacccaggaccagcgggcggtcaccgtgcactcggcgagcaccctcgctccccagcagaacaccacggtcgagatcgccgggcggttcgccaagagcaacgccgccccgatgctgttccagctcaacggcaagacctgtcaggcgtacgtgtcgagttcacccggccagccctcccggccggtcgagcagctctccgacggctccgtgcggctcggcgaccccgcgtcggacagcacgccggcgcccggcatctcgatcgacccggtcggcatcgtgcacatcacgccgagcaccctgccggcgcgtccgtcgaccatcccgctgcccggcagcagctccaccgccaccgggggcggcggcagcaccaagccgagcgacggggcgtcggacaccgtccagccggagccggcccagtcgccgaccagcaaggcgccggtggagcagccgtccaacccgccaccggggctgcccggcgcgtcgctcgacggctgcgacagccaggactgctga

SEQ ID NO: 4747 - DNA, 252 bp, Actinoplanes utahensis
atgatcagcattgtgaaggatctggccgccgaggcgcttttcgtctcctgtctgcagccgtccgagtacccgacccgccgcgcgctggaggacgccatcaccagcaccttgctgcagtacggcagcgacggctgcgccgcgggggtggccgccgagttcggtgaccacccggatatcgcggtccgccggatgcgctgggtgcaggccgagctcgccgaggtcatcacgttccgcgccccggctctccactga

SEQ ID NO: 4748 - DNA, 1017 bp, Actinoplanes utahensis
atgaaaaaactccacaaaagcaaccgagttcggccgtcactgcacccgacggcgaccactgttcttctcgtcagccggtttcatcagccggttagtacaagcgaggaggactacgtgaccgccacgaccgaactccccgccaccatcggcgtcatccacgacgcgccctccgcgcgcgacatcgaggacctgatccgcgaacacatgccgatggttggccatctggtccgggaactgctcaaccgggtgcccggccacgtccacgcagatgacctctcatcagccggtttcgcggcgttgctcggagcggcccgctccttcgacgtgacccgcggcatcccgttccaccgcttcgccgcggtccggatccgcggcgcgctgctggacgagcttcggggtcaggactgggccagccgatcggtgcgggcccgggcccggcgggcggccaccgcccgccaggagctcaccgccgccctcggccgcacccccagtgacgccgaggtcgccgagatgctcggcgtggggatctccgaactggccagcgtcgaggacgacgtgcagaaggcgtcgctgctgagcctgcagggcttccccaccggggcggccgaggagatggtgccggaactgtccgagggccccgaggacctgctgctcaaacgggaacgcctcggctacctgcaccaggccatccaggcgctgcccgaacggcttcgccaggtggtcgaggagtcgttcctgcaggaacagccgctcagcgaggtggccgcgcggctcggggtgaccgagtcccgcatctcccagctgcgcaccgaagcgctgcgcctgctccgcgaggggctgaacagctcgctcgcgccggaactgctcaccgtcgcggccggtggcccgcgtacccgcaagggctgcctgcagcggcggcgcagcgagtatttcgcgaaggtgcagcagcaggggaacctgcacacccggctggcgctcaccgacagtcacggcgtaccgatcgcggtcgccgcgtaa

SEQ ID NO: 4749 - DNA, 1089 bp, Actinoplanes utahensis
gtgagcaccgcccccgatcgccacgcggtggggcacgatgtgtcggtgcgcgccatcgtgatcgactccgcccgtgcccggcccgaggtgcgggaggtgcccgagcccaccgccccgcccggcggcgtggtcgtccgggtgatggcgaccggcctgtgccgcagcgactggcacggctgggccgggcacgacgacgacatcaccttcccgcacgtgccgggccacgaactggccggcgaggtgaccgcggtgagcccgggggtgacccgctggcagcccggcgaccgggtgaccgtgccgttcgtctgcggctgcgggcgctgcgactggtgccggacgggtcaggcccaggtctgtcccgcgcagcagcagccgggattcacccacgcgggctcgttcgccgagtcggtcgccctgcacgccgccgacaccaacctggtcgccatcccggccggcgtctcgttcaccaccgcggcgagcctgggctgccgcttcgccacggcgtaccgcgggctggccggccgcgcccgggtcaccgcgggggagtgggtgaccgtggtcggcgccggtggcgtcggcctgagcgccgtgatgatcgcgcgggctctgggcgcccgggtgatcgccgtcgaccgcaacccgcgagccctggccgcggccgccgcgatcggcgccgggcacaccgtgctgaccggagccggcgtcgacgtccccggcgcggtggcggagctgaccgacggcggcagccacgtgtcggtcgacgccgtcggcagcgagcagacctgcgccgatgcgatcctcgcgctgcgccggcaagggcggcacgtgcagatcgggctgctgcccccggtcggcgggcacccgcgggtgccgatgtcccgggtcatcggatgggaactcgacgtgctgggcagccacgggatggcggccgccgactacccggcgatgatggccctcatcgagcagggccggctgcggcccgaccggctgatcgaacgcaccgtcgggctcggcgaggccgcggccctgctgcccggtttcgatcaggccaccgtcgccgggatgacgatgatcgacccggcccgctga

SEQ ID NO: 4750 - DNA, 1569 bp, Actinoplanes utahensis
gtgacctctctggaccgcggccgctacgcggcgctgtacggcccgaccgccggtgaccggatccggctggccgacaccgacctgctgctggaggtggaggaggaccgcagtgccggcccacggccgggggacgaggcggtcctcggcgtgatccgcgagtcggtggggcagtcccgggcggcgcgggccgacgggacgccggacacggtggtcaccggggtggtggtgctggaccactggggtgtcgtgaaggcggacgtcggcatccgggacggccggatcaccgcgatcggcaaggccggcaacccggacatcatggacggtgtccatccggacctggtgatcggggcgagcaccgagatcatcaccgggaacggccggatcctgacggccggcgcggtcgacagccgggcgcacctgatccgcccggccgtcctggacgccgcggtcgcggccgggatcaccacggtcgtcggcggcggcaccgggccggccgagggtgccaggggagccacggtcaccccgaacgtctggcatctggcccggatgctggcggcgatcgacaccttcccggtcaacgtgctgctgctcggccgcggtgacacggtgtcgccggaggcgatgtgggaacagttgcgcggcggggccggcggcttcgcgctccacgaggatgggggctgcacgccggccgcgatcgacgcctgcctgcgggtgtgtgacgcgtccggggtgcaggcggcgatccacgccggcacgcgcaacgaggccggttccgtcgacgacacggtgcgggcgatcggcggacggccggtccacgccggggccgcggcggcgatgatcacggtggccgcgcaacccaacgtgctgccgtcgtcggcggatccggccgggtcggcgacgccggccacggatctgctccacgatctcggcgccgtctcgatgatcgggtcgggggcgacgggccgccccggcgaggtgatcctgcggacctggcggacagcgcatgcgatgaaggcgtggcgcggtccgctcgccggtgacggttcgtcggacaacaaccggatcaggcggtacgtcgccaagtacacgatctgcccggccatcgctcacgggatggccgcccaggtcggttccgtggagccgggaaagctcgccgacctggtcctctgggatccggcgttcttcggtgtccgtcccgtgctggtgctcaaaggcggcatgatcgcgtacgcgcagacgggtgacgcagccgcgtcgaccctgccgccgcagccggcgatgccccgcccgatgttcggcgcccatggcgtggtgccggcccacacctcgctggcgttcgtcgcgccggccgcgatcgacgccctgctcagcgaccggatcggggtgcgacgcgcgctggtcccggtcggcgacacccgggcggccggcaaggcggatctgccgctgaacgacgcgatgccccggatcgaggtgcacgcgggcagcggcgaggtgcgggtcgacggcgaggtggtgcagccgcagccggtcaccgagatgccgctggcgcagcggtacttcctgttctga

SEQ ID NO: 4751 - DNA, 408 bp, Actinoplanes utahensis
atgatccccggcgaggttctggccggggacggcgacatcgtgatcaacccgggtcgggtgacgcgggacctgaccgtgcgcaacaccggtgaccggccggtcagtgtcggatcgcactttcatttcgccgaggtgaacacggccctggagttcgatcgggcggccgcctgggggcatcggctggcggtgccggccgggacttcggtgtgtttcgatccgggggccgctcgggaggtggtgctgattccgctcgccggcaaccgggtggtgccggggttgcgcgggctggccggcgggccgctcgacacgctgccgccgcccgccgagccggacccggccgacatcgaacccgccgggtccctggacgaggacaccggtgaggcccagccgaacgggagcccccggtga

SEQ ID NO: 4752 - DNA, 303 bp, Actinoplanes utahensis
ttgttcctcagccgacatgagcaggagcgtctgctcatccacgtggcggccgacgtcgcccagaagcggcgggatcgggggctcaagctgaatcaccccgaggctaccgcgatcatcaccgccttccttctggaaggggcccgggacggccggagcgtcgacgagctggtggccgcgggcggtcgggtgctgacccgggacgacgtgctgccgggcgtgcccgagatgatcgccgaggtgcgggtggaagccaccttcccggacggtccgaggctgatcgccgtgcccgggccgatcgcatga

SEQ ID NO: 4753 - DNA, 2217 bp, Actinoplanes utahensis
atgcctacacccggagagttgctcggtggacggtatcggctggacgaccggatcgcggccggtggcatgggcgaggtctgggcggcgaccgatgccgtgctgggccggccggtcgcggtcaagacgctgctcggtgaccatgggactgatcccgggttcctgaatcggttccggcacgaagcccgggcgatggccgcgctgcgccatccgggtgtcgtggcggtgtacgacttcggggacaccggggacggcgcctacctggtcatggcgcatgtggccgggcagccgctgaaccgggtgatcgcggaccggggacatctgtcggtggccgagaccatgtcgatcgtggcgcaggcggggcgagccctgcaggcggcgcacgaagcggggatcgtccaccgggacgtcaagcccgggaacctgatcatcgagccggacgggacggtggtgctggtcgacttcggggtggcccgatcggcgaactcgatgacgctgaccggcgcgcgtgaggtggtgggcacggcgctgtacatcgctccggagcaggtgtccaagcaggccacggggccggcggcggacatctacgcgctgggggcgttggcgtatcactgtcttgccgggcggccgccgttcctcggtgacaatccgctggctgtggcgctgcagcacgtcaccgacgagccgctgccactgtcccgggacgtgccacggcaggtgcgggacctggtcgggaccgcgctcgcgaaggatccggcggaacggttcccgtccgctgccgccatggccgcagccgcggaggtcgccgctcaggagattgccggcgggggcgtcgccgcgcggaccggggcttcgctcgctgcgctgtccgccgccccgggctcgatgcccggcttccccgcggcggcggccacctcaggctcgatacccggcaccccgacagccgcagccaccccaggctcgacgcccggcaccccgacagccgcagccaccccaggctcgacgcccggcaccccgacagccgcagccaccccaggctcgacgcccggcaccccggcagcggcgacggcaatcgacgcgacggcaggctctgggaccatgccggaccggcccggtcagacgacaagcgccacacccgggatcagcgacgggagcgctgccgagagcgccgggatcgggaccggcggccagaacacggccgccagaaccgacatcgccgagcagaaccagaacacagccgccaggaccggcgtcgccggccaagcccggaacacggaggccggggccggtggaggcggacgggatgacgtgacccaggcggtggcggcagcggcgggggcgggaatcgtcgcccgggccatggtgggagcgcctcggtatgaggatcgtccgccggtcggtccggtgcgtgatggacacacgatggctgacgggggcttcaccgcgctggatgtggcttcggcgcccggagcgacagcggctccacagagcggagcgaatccgcggagcgacgtggatccacggagcgacgtggattcaccggtcgtggcgccgcggcgggctggcatcggggcgacttcgctggcagcgggtgccgctgcggggagcgcggtcgcaaacggcggtgcgggccgccccggtgggaggttcgccaccggtggcaacgccccagggaccagccagggcgaggcctccttgccggcatacgaaacagccggccgggcagctgcaagcggggcaacggtcggccgggcagatggtggggcaggtgctggcggggccaggcgcgggctggtcgtcgccggcgtggtccttctggttctgctgggactcggggcggtcgtggcgctggccgatccgttcggctggttcggggatgagccgtcgggcggggctccgggtggggcggtgaagccgtcggcggttgtctcgcaccggccgtcgaccggggcggtgaagaacggcggtgggcattcgagtcagccgcggcggtcgagtgcgcccgctctgccgggcgggaacgccaccgcgccgaccggggcggcgaccgggaaacctaccccgacggagaccgcgggaggcgagaccagtgcgccggcagaggatccgacgacggcgcagcctacggagacgtccaaggatgacagcggcggcaccggtggcggggaggacaacaacgattccggaagcggaaagagcggctccgacaccgagaactga

SEQ ID NO: 4754 - DNA, 381 bp, Actinoplanes utahensis
atgcccaagcgcgctgtgatgaccgacaaggcggcgccggtcggcggcccgtactcgcacgccgtcgtcgccggcgacaccatctacctggccggtgccatcccggcgctgcccgatgggacccgggtgaccggcactttcgccgagcaggcacatgccgccttccggaacctggccgcggtcgccgaggccgccggagcgagcctcgacgacgccgtgcgggtcggggtctacctgcgggatttcggagacttcgccgagatgaacgagatctaccagcagtacatcaagggcgaacaccgtcccgtccggacgactctcccggtcccgctggtcggcttcgacatcgagatcgacgccatcctctacgtcggcgattga

SEQ ID NO: 4755 - DNA, 1257 bp, Actinoplanes utahensis
atgacgttcgacatcctgctcaccggcggcactctgctgccggccggccccgggccggccggggtccggcgcaacatcggcgatgtcgcgatccgggacgggcgcatcgccgcgatcgggccggccctgccccgcgacgcccaccgcgtggtggacgtctccggacgactggtcaccccgggcctgatcgacctgcacacgcatgtcggaccgggctactggggaatcgaccccgacccggtggcgtggcactccggggtgaccacatgggtggacgccggctccgccggggcgtacacgttggacggactgcgccgggtcgcggccgcggccaccgtccgggtgcccgccctgctcaacatctcggcaatcggcttggccggccgcaccggggaaagccgcgacctggccacctgtgacgtccccctggcgatcgacaccattcagacccaccgggaactcatccgcggcgtcaaggtgcgcatcgaccgggacaccgtcggcgacaacgggatcgagccactgcgccggggcctgaccgcggccgaggcctgcggagtgccggtgatggtccacatcggcaccgccccaccccggctggacgaggtgcttgacctgctacggccgggcgacatcgtgacgcactgcgccagcggcatcgccgccccactcggcccggcggtgcacgcggcagccggacgtggcgtgctcctcgatctcgggcacggctccggcgggttcgccttcgacgtcctccaggcgcaactcgacgcggggctgatgccgcacaccgtctccaccgacctgcacgcccggtcgctgtacgggccggtcttcgatctgcccaccacgatggccaaactcctggcggtcggtgtcccgctgcccgaggtgatcgccgcggccaccgtccacccggcccgggcgctgggactccctggcggcaccctcgcgatcggcgctcccgccgacctcgcgatcttccgggtacgcgacgaggagttcccggtcgtcgacgcgcaccgggaggtccgcatctcgccggtgcgcctggtgaacgaagccacctacgtcggcggcgccctgctcccgccgcggctgccggccccacccgcaccgtggatcccgctcaccgaagctcagcgcgccgccctcgaccagcgggcgcgccacatccgtgacctgctcgccacacccttggtcggggtggacgggctggccgaacagtttccgagagatcaaccgaggagttcatga

SEQ ID NO: 4756 - DNA, 1425 bp, Actinoplanes utahensis
gtggctcgttcatcctgcctccttgacctgcggagcgttttccagcacgctactacgagccacatacgaaccaccagaagagacgcgatgatcatcgggatcgtggtccactcgggtcagcggggccgcttcaccgaggcggcccgcacgctgaccggcgtctccttcgcctgggccgtctacgagcgggaggaggagatccgggaccgggtcaccacgctcctggccgccggcccgctcgacggtctgctgctcgggccggtcccgcacgcccgagccggcgatctggtgccgcccggtctacccgtcgcgatcacccgggcggccgcgctcgacctcgccctcgcctgggcccgggcccgcggcaacggctggcccgccaccccggtcagcatcgacaccttccccgacgagacggtcaccgaggtggccgacgcgctcgccctcgaccgttccgccatcgccacccttccgttccggcccgagcagccgatcgccgaggtggtggccttccaccaggagcacctggcgcgcacggccgcgccctacgtcatcaccgtccgcaccggggtggccgcggcgttggacggacggacagcggtcctgcaggcgatggccacgcccggcacggtccgggcggatctgcacgacctggtctcccgggtgcgcggtcagcaggccgacgggcaacggttcgccgccgccgtcttccgcgcccccgcgcccggtgcccgggaggccctgcgacaggccctgtccgcgcttcccgagctggccgacgcctggatcgacgagcacgggccgcgcgcagtcatcgccttcgccccggccggggtgttcgagaccctcaccagccattgggtcagtctgccgggcggcttccaccgaggtcgccgtgaccacggacagcccggcgagcccccggcggcggagccggacgccacggtcgaggatccggccggcccggcggtcgggttcggcatcggcgcgtccgcccgcagcagcgtggcgctggccgagcaggcggcggatcgcgccgagcgcgccgggtccacgtccggctacctgatcaccgaggacggcgtgatgatcggcccgatcggtgcggccgatccacccctggcctattcgtatcgtgagcacggcggtctggaggagctcgcggtgcgcgccggactgagcgcggcgacgatgtcccggctggccgctctggaacgctccctggccgggcgggcgatcacaccgggcgagctggcccgggcgctcggcatcaccgacccgagcgggcgccggctgatccgcaaactcggcgaggccggtctggtcgccggtgagggcagtgcccagccgcaccacaaggggcgccccacccgcctctaccggctgaccatccaggcagcgctgacggcgggcggtgccggatga

SEQ ID NO: 4757 - DNA, 1629 bp, Actinoplanes utahensis
atgaacgagccacttacgagcatcgtgccgcgaccggcccgggtcacgtccggcgagggcgccttccacctcggccccgggaccgcgctggacgccgggcccgccctgaccggggtggccgcctggttgcgtggcgcgctgggccgggtgatcggcggccaccttctgcccgggccggacgggatccggctgcggacagttccggagcttgcaccggaggcctatcagctggaggtgcgcgataccggcatcgagatccggggcggctcaccggccggcgtcttctacggcgcgcagactctccggcagatgctgcccccggtcacgctacgccgcgcgcgcctgaccgacggcccgtggacgattcccgccggccgggtcgacgatgcgccccgcttcccctggcgcggcgtgatgctggacgtcgcccgccacttcatgccggtcgccgacgtgctccgcctgatcgacctgatcgccttccacaagctgaacgtgctgcacctgcacctgaccgatgaccagggctggcgactcgaggtgcccggccgcccacggctcacctcgatcggcgcctggcggccggccaccatgctaggctcccgccggcacgagcggttcgacgcccgcccgcacggcggcttctactccgacgacgacctgcgcgagatcgtggcctatgccgccgaccggcacatcaccgtcgtccccgaggtcgacatgccggggcacatgcaggccgccatcgccgcctatccggagttgggcaacggcttctccggcgacgtccgggccggctggggcatctccccgcacgtgctcaacctgggaccggaggcgctcgacttctgtcgcaccgtcctcgatcacctctgtgacctcttcccgagcgagctcatcgggatcggcggcgacgagtgccccgccgacgagtggcatgacagtccggtcgcccaggcccgcatccgggccgagggtctgggcgggccggatcggctgcagccctggttcaccacccggatggccggccacctcgccacccggggccggcgcgtgttcggctgggacgagatcctggccggtggcgcgccgcccggagcggtgatcgcggcctggcgtgggcccggtcccgcggcgcacgcggcccgggcggggcatccggtggtgtcgtgtccggacatgtcggtctatctggactatcgccagtcggacgaccccggagagcccacgccggtgggcacccggctgaccatcgaggacgtcttcgcgttcgatccggtcccgcccggtctcactccggcggagaccgcgctggtccgcggcggtcaggccaacctctggaccgagcacatggagtccgcccgccgcgtcgactatcaggcctttccgcgcctgtgcgccttcgccgaggcggtctgggggccggccgagcgagacttcaccgagttcatcagacgcctgccggcacacctggaacgcctggatgccctcggtgtgaactaccggccgctgagcgggccgcgaccgtgggacgcgcgaccggacgcgcccggcaatccgcgtacgcgcaatgatcgtctcgcggaattgcgggagatgaccgcggacctggagcgggagcggtcatga

SEQ ID NO: 4758 - DNA, 918 bp, Actinoplanes utahensis
atggtggagatcgcgctgccggactcgttcacgcgtcgcgtcgcgcagtgctggggcgctccggggacccgctggctggctgatctgccggagatagccacccgggtgctgcacgactgggatctccacctggaccggccctgtccgctgagcctgaactgggtgacccgggtgcgccgggcggacggatccgccgcggtgctgaagatgggcatccccggcgcggatcatctgtcggacgaggcggcggcgctggagttcttcgccgggcgaggcgcggtgtcgatgctcgcccacgatgccgcacgcggcgcgatcctgctggaggaggtccgcccgggccggccggcccgatcgctggtgccggaccgggacgaggacgcgacagccgcactgatcggggtgatccgcggactgcaccgccccgcgccgcccggcatcgccctgcccgagctggccgcccgccgcgccaccttcgacgagcatctgcggcgtttcccggatgacggcccgctgccgcgacacctggtcgagcgggccgggcggctgctcaccgaactgtgcgagaccgcgatcgagcgcgtcgtgctgcacggtgacctgcaccacgacaacgtgctggccgcgggccgcgagccgtggctggtgatcgatcctcacgggctgaccggcgatcccggttacgagatcggcgccatgctctacaacccctacccgatggacgacgacacggtgctgcgcctggtgccggggcggatcgagcagctcgccgacgggctcgacatcccgatcgagcgggtggtcgcctggggtttcgtacaagcggtgctgtccgaagtgtggaacgccaccggcgacggcatcgccaccgggcggccgttgcgcctggcgagtctgctgctgccccgcctgccatga

SEQ ID NO: 4759 - DNA, 1191 bp, Actinoplanes utahensis
gtgacgatcgactggcggagcaaaggattctggctgccgcacggcggccggaccgccgagcagatcgcgtccgaacggccgagcatcttcggcggcggtttcacctggccgctgctggtgatccggcaggccgcggtcgaggcgaacatcgcgacgatggccgcctactgccggcggcacggatgcgacttcgccccgcacgccaagacgacgatggcgcccgggctgctcgaggcccagttgcgtgccggggcgtggggcctgaccgtggccacggcgaatcaggctctggtgctgcggcggctcggggtgcagcgggtgctgatcgccaaccaggtgctcgacccgatcgcgctgcgctggctggccggcgagagtgacgccggctgggaggtgtatttccaggtcgactcactggccggggtgcgcgcggcggccgcggccggacggatccgggtcctcgtcgagctggggcatccgggcggccgtaccggtgtgcggacgctggacgaactggaccgggtggcccgggccgttgccgccgcgccgggggtcgagctggccggactgaccggctacgaggggcagcttgccgacctggcggaggtcgacacctatctggatcggctggccgcggggttcgagcagctgtccgctgccgggctgctcccggaggagccgatcgtgtcggccggcgggagcgcctggttcgaccgggtcaccgatcgtctcaaggcgcttgccccgcgggcgcggctgatcctgcgcagcggggcgtcggtcacccacgacgacgggttctatcgggagcggacgccgttcgtgcgcgtgcccggcgaaggaccgctcaccgcagccctggaagtctgggcccaggtgctgtcggcgcccgagcccgggctggcgctcgccgggatgggcaagcgggacgcgccgttcgacgaggggctaccggtgccgggggaggtgcggcggccggacgggacgacggcgccggccgacgggctccgggtgacccggctcaacgaccaccacacctatctccaggtggccgacgggaccgtagtggagcccggtgacctggtgcggttcgggatctcgcacccgtgcacggcgttcgacaagtggcgcgacatcccggtggtcgacgagcagcggcgcgtggtggacgtgctccatacgtacttctga

SEQ ID NO: 4760 - DNA, 753 bp, Actinoplanes utahensis
gtgggccgtaaagtccggtcaatggggtgggaggggctgtggcagtggggtgatgatgtcgctcgtctcgaaccgcttgccgagggagtggccaacgacgtgtggactgtgcgggtcggtggtcgtgtcgcggtcggtcggctcggagtcaggagcgacgccgatctcgcctgggaaaccgggttgctcggccatctccaccgtgcgggactgaccgtgccggtgccgattcccaccgtggacgggcggctgttcgccgccggcctggtagtgatgacgcatgtggagggcgggccgcccgagacccgggacgactggcgtcgcgtggccgaaacgctccacaagctgcatcggttgacgcgggactggccgcagcgtccggggtggcgatcgtccggcgatctcctgcacgctgaaaccgggacgaggatcgacctgcgggcgatgccaccggaaggggttgcgcggtgccgggcggcttgggcgcggctcgtcggacgtccgacctgtgtcgtgcacggcgatctcaatccgggcaacgttcgcatgaccggggaacgcgtcgcgctgatcgactgggacgagtcacgggtcgacgttccggagctcgacctggtgctgccggacaacgctgccggtctggacgatggcctgtacgacgtggccgcacaggcttcggcggcgtgggaggccgccgtgtgctgggaggacgactatgcggtcaggcggcttgccgaggtgcgagcccgctga

SEQ ID NO: 4761 - DNA, 522 bp, Actinoplanes utahensis
atgcggtcaggcggcttgccgaggtgcgagcccgctgagagcgcccttcagggaaattccgtcgccgcgaccaggtggtcgtttgtggtgcggcggggaggccacggtcccgggatcgcggtcccggggtgcgaaaagcgggtgacggaagatgttgaccttggaactctgggcggcgtgatggagacgatgacgttgtggcggccgacggggccggaggaatgggagctggtgcgggcgtcgggacggaagcggtggccggcgcggctgccggatcagccgatcttctatccggtgctgaacgaggactacgcggtgaagatcgctcgggactggaatgtggcggcttccggggtggggttcgtgaccaggttcgagatcgatgcggcgttcgcggcgcggtatccggtgcggcaggccggggggaacacgattctggagctctgggtgccggcggaggagcttgcggaattcaacgaccacattgtcgggacgatcgaggtcgtgcacgagtttcggtga

SEQ ID NO: 4762 - DNA, 297 bp, Actinoplanes utahensis
gtgagcgggggccgggccgggctgcgcttgcccgccgccgctggccgcggtcacgaccggcccggattccccgccgccggcagttcctgcttcctgttccctgccgctgacggtcccggcctgctccccgccgctgacgggtcctggttgcggcttcgtgtggtcgacgagtcctgcatgctgctccctgccgctgacggttcctggttgcggtgtcgcgtcgccggacgacccctgttgcggcaccgcgccaccggcggttccgggctgcggctgaccaccgccgacggctcttga

SEQ ID NO: 4763 - DNA, 393 bp, Actinoplanes utahensis
gtgacgtacgccaaagaggctctggacgtgcgcatcggctgcgccgcggtggtctacctcgacctggacgaacctcgcgccggggtcggggcgcagatcggggatctgcggtatgacagcaggtgcggaaacggcccggcccggctgagtctgggggcgggcgcgaccgccggcagcagtgtcgcccgaacggatctcgacgatgacggctgtctgcgggccatccggaacgggccgctggagccgggggccgcggtgaacgtcagggtgggcacggccctctgcgtgctgacggcggcccagccggcgaagctcgtgctggtggagatcgccggggtgggggtgaccgggaatctgagcctgcgggcgacgtcctggctggcgcctgcttga

SEQ ID NO: 4764 - DNA, 1803 bp, Actinoplanes utahensis
gtgatcaggacccatgacgccggcagtctgcgtgccactgacgccggcacgacggtgacgcttgccggttgggtggcccgccggcgggaccacggcggtgtcatcttcgtcgacctgcgggatgcctccggtgtggtgcaggtggtcttccgggaggaggacgcgcacgcactgcgcaacgagttctgtgtgaaggtcgtgggtgaggtcaacgcccgcccggccggcaacgagaacccggatctggccaccggcgccatcgaggtggtcgccagcgagctgaccgtgctctccgaggcggccccgctgccgctgccgatcgatgacgcggtcaccgcctcggacgacatccggctcaagtatcgctatctcgacctgcggcgttccggcccggcgaaggcgctgcgcctgcgcagccgggcgaaccagatcgcccgtgaggtgctgcacgcgcacgacttcaacgagatcgagacgccgaccctgacccggtcgacgccggagggcgcccgcgacttcctggttccggtccgtctgcagcccggtgcctggtatgcgctgccgcagtccccgcagctgttcaagcagctgctgatggtggccgggatggagcgttactaccagatcgcccgctgctaccgggacgaggacttccgcgccgaccggcagccggagttcacccagctcgacatcgagatgtcgttcgtgacccaggacgacatcatcgcgctgggcgaggagatcgtcgccaagctgtggagcgagctcgccgactaccaggtgcagctgccgattccgcggatcacctggaccgacgcgatgaaccgctacggttccgacaaacccgatctgcggtacggcgtggagctcatcgagctcaccgactacctgcgtggcaccgagttccgggtcttcgccggcgcgatcgacgcgggcggctacgtcggcgcggtcgtgatgccgggcggcgcctcgcagacccgcaaggagctggacggctggcaggactgggcgaaggcgcgcggcgcccgtggcctggcctacgtggtgctggacgcggagaccggcgccccgcgcggcccggtcgcgaagaatctgtccgaggcgcacctggcggggctggccgacgcggtcggcgcgaagccgggcgacgcggtcttcttcgccgccgccaccgagcgccgcgaggcgcaggagctgctcggcgcggcccggatcgagatcgccaagcgggccaagctgatcgacgagagtgcctgggcgttctgctgggtcgtcgacgccccgatgttcgaaaagactgacgagggcggctggaccgcggtccaccaccccttcacctcgccgaacgacgagtggctggacaacttcgagtccgccccggacaaggcgctggcgtacgcgtacgacatcgtcgtgaacggcaacgagatcggcggcggcagtgtccgtatccaccgcggcgacgtgcagagccgggtcttcgacctgctcggcatcaccccggaggaggcgcaggacaagttcggcttcctgctggaggcgttcaagtacggcccgccgccgcacgccggcatcgccctgggctgggaccgcacctgcatgctgctcggcgggttcgactcgatccgcgaggtcatctcgttcccgaagagccgtggcggcttcgacccgctgaccggcgcgccgaccccgatcaccgcgcagcagcggctggaggcgggcgtcgacgccaagccgaaggcggccgcgggcacgccgggcaccgacggccaggccgccccggtggagcgctccaactag

SEQ ID NO: 4765 - DNA, 525 bp, Actinoplanes utahensis
atgcggggccgccgctgttttgtgagactggtcggcgtggagccgaccatcgtccagtgcgccgagcagccctatgtcggccgtcgtgagtcgatcaccatgaccgagttcgcgcgggtcgccgaccatctgcccaccatgttcgccggcctggggcggcgcggcgtccgggtcagcggcgccccgttcttccgttaccgggtgatcgacatggccgccgagatggtggtcgaggcgggcattccggtcaccggtccggtcaccgtggagccgccggatttcatcgacacgctgcccgccgggcgctatgcgacggtcagccacgtcggccatccggaccaattgatggcggtcaccgcgcggctgctcgactgggcccagcgcaggggcctgacctgggacatgaccccgacgccgaccggtgagcgctgggccgcgcggctggagatgctgatgaccaacccggccgagcagcccgacatgcacaagtgggagaccgtcctgctgttcaagctggcggattga

SEQ ID NO: 4766 - DNA, 576 bp, Actinoplanes utahensis
atggcggacaagctcatcgaagtgcggctcaccggcccgcagatccgcgcgttggcccagccgctgcgtctgcgactgctcggacggctgcgccaggccggtccggcgacggccacccgcctcgccgccgacctggacaccaacaccggcgccaccagctaccacctgcggcagctcgccgaggtcggcctggtgatcgaggaggcgcggccgggctccggccggcaacgctggtggcgtgcggcgcacgacacgtcccacttccggcgcagctactacgaggacgatccggaggccaccgcggccgccgagtggctcgagacgtatcaggtcagccacttcgcccaggccgcggagaactggcggcgcgccctgcccggcgagccggagagctggcagaacgccgccgggatctccgactacacggtgcacctggacgccgcccgcaccgaggcgatgatgcgcgagatcgaggcggtgatcgagcgctaccggcaggcgggccaggacgatccgcggcccggcacccgcccggtgatggtcgtcgcggccgcgctgccgagggtcgcatcatga

SEQ ID NO: 4767 - DNA, 1281 bp, Actinoplanes utahensis
atgagccttccggcacgccaggtccgcctgcgctacctgatcctgatcacgctccgctggctccccgtcggcctgaccatcccggtgctggtgctgctcccgctggaacgcggactcaccatcgcccaggccggcgtggtcaccgccgtccagggcgtcaccgtcatggtgctggaactgccgaccggcggattcgccgacgcgctcggccgccgcccggtgctgttgctggccggcgcggtcaacctggtctcgctgagtctgtactgcgtcgcccacacggtcgggttcttcgccgtggcctggatgctgcagggcgtcttccgggcgctggacagcggcccgctggactcctggttcgtcgacgagtcgctggcggcggaccggaacgccgacatcgagaccgggctcagccacggtgaggtggtgctcagcctcggcatcgccggcggcgccctgatcagcggcggcctggtctggctcgggccgatcgggccggtcagcgcgctcaccgtgccggtggcgctgtccatcctgctcagtctgctcagcacggtggcgatcgcggtgctcatgcacgaggagcggcccgctctcggcctggccgcactgtccgcctcgatccgcggggtgccgatcgcgatcggctcggcgcttcgcctggcccgccgctcccgggtggtgctcgcgctgatcgcggtggagatcctgtggagcttcgggatggtctccttcgagaagctgatgccgatccggctcagcgaggtgctggccgacaaggacgccgccgcctcactgatgggaccggtcagctcggccgcgtggggcgcgtcggccgccggcgcggccctgatccccctgctcgtccggcggatcggcgcaccccggaccggcttcacgctgcgcctgctgcagggcgccacggtggtggggatgggcgtcctggccggcccggccggggtggtcaccggcttcctgctcacctatgcggtgcacggcgcggccaatccggtgcacaacgcgctgatgcaccggcaggccgagggcgaataccgcaccagtctgctgtcgctcagctcgatggccagccagcccggcttcgcgatcggcgcgatcctgctcaccgcggtcgcgcagagtgtcagcaccagcgtcgcgatcgtggccggggcgatcgtgctcgcggccgccgcaccgctctatctggtgaaacccaagtttcacgaacccatcgacgggggtaccagcctgacatcggctctcacccccggaggaacctga

SEQ ID NO: 4768 - DNA, 1785 bp, Actinoplanes utahensis
atggaaacggacgggcttttctccctcgcgcagccggacctgccgccgccggcgcacaccgctgccgccgccggcttcggcgccccggcggccgacgcgccgctgcccgtccggatgcgcccggccagcctcgacgagctggtcggccagcagcatctgctcgcccccggtgccccgctgcggcagctggtcaccggcgccagcccgatgtcggtgatcctctgggggccgcccggcaccggcaagaccaccatcgcgcacctcgtcgcgcacgccaccgaccgcaagttcgtggccatgtccgcgctcaccgccggggtcaaggacgtgcgcgcggtgatcgacacggcccgtcgcgagcgccgcgccggcggcccgccgaccgtgctgttcatcgacgaggtgcaccgcttcagcaagacccagcaggactcgctgctcgccgccgtcgaggaccgcacggtcaccctgctcgccgcgaccacggaaaacccgtacttctcggtcatctcgcccctgctctcccgctgtgtgctgctcaccctgcaggccctcgaggagtccgacgtgcgcgccctgatccggcgcgcggtcaccgaccagcgcggcctgggtggcgcggtcacgctttcccccgaggcagaggaccacgtggtacgccttgcctcgggcgacgtccgcaaagcactcaccgccctggaagcggccgccggttccgcggtcgcccagggctccgccgagatcgacctggccaccgccgagcgcgcagtcgacgtggcagccgtccgctacgaccgggacggcgacgcgcactacgacgtcatcagcgcgttcatcaagagcatgcgcggcagcgacccggacgccgcgctgcactggctcgcccgcatgatcgtcgccggcgaggacccgcggttcatcgcccggcgcatcgtgatcttcgcgagcgaggacgtcgggatggccgacccgcaagccctgctcgtggccaccgcggccgcccaggccgtgcagctcatcggcatgcccgaggcccagctcaacctcgcccaggccgtcgtgcacatggccaccgcccccaaatccaacagcgtcaccgcggcgatcggcgcggccatgaccgatgtccgtgccgggcggggcgcagcggtgcccacccacctgcgcgacgcccactactccggcgcgcgcggcctcggacacggccgcggataccgctacccacacgacgacccgcgtggcgtcgtccgccagcagtacgccccggacgacctcgtcggcaccgactactatcggccgaccgaacacggggccgaacgcgccgtcggggagcgggtgccgcgcctgcgccgaatcgtgcgggggctgccccgtgccgcttcggcggacagtgcggaccgcgcggcgggtggtgcaacggctccggatgcgtcacagtcgtcggcggcctcctcaccggaggccggcggggcgggaggatctgtggcggtttccgcctcggtgcctgcttcgttgcccgttgcggcgggcggcccggccccggtggcggacggtggtgcggattcgggtccggcggctgtcctggcggacggtggtgctccgggtgcgggttcggacctggcgagcggtggggttgcggtgtctgcctcggcgggcacgggtgggacggaaggttccgccggcacggcgacgggatcgggtacggcgcaggccgggccggatgccggcagtgacggggaacggtcagacgagcgcggcgacgccgccggggaggaacagccgtga

SEQ ID NO: 4769 - DNA, 1239 bp, Actinoplanes utahensis
atgcctgggcagcgcggcggcccgatgcccggtgggcagcccgcgccgcagggccaggtgccgccgggtgggcgtcccgggcctcagggccaggtgccgcctggcgggcgtcccgggccgcaggggcagatgccgcttggcgggcgtcccgggccgcaggggcagatgccgcctggcgggccttccgggccgcaagggcagatgccgcctggcgtgtcgatgccgcagccgggtggtccggtgcccggtggccagcaggatactggtcgggctgggccgcatcagatgccgcctggccagatgccgtccggggcgatgccgccggctcgtcgcggcggtccgggagcgccggtgtctccgggggcgcggtccggtgggcccgttccgcccggtgcgcgggccggggtttcgccggagccgggtgccggtcggcggcaggtggatcccggtcagccgggattcccggcacaggcgggaccggcggggcaacccggatatcccgacccgtcggtgtcaccggcgataccgcgttccggtaacgctccggagatccccggtgtccaggccggggggccggatccgagaggcatgacttccggcgtacgcccggtctcgcccggcgtgcgaccgacctcgccggccgccccggcgcgtgaccggttccgtgcagcggcggccccggcgcccgtggacgttcagccgtccggcccgatcccgcccgccgtctatcagacggggccgattccgccggtcggtggcgggttcccgcccgacaccgtgccgccgagcgtctatcggaccgacacggtgccgccgagcgtctaccagaccggtccgattccggtcggtcccacgtccggtggccccggtgcggacgatcccggtggccgagcgcggggacggaaccggcgatcccgcgccgagagcggtccgaacgctccggccgaggtttacggcgcccggccggccgacggtttccagggccgccccggcagcggtgcacaggggccacaccatgcgccggacggcgtctacggtggcaccggcccgcagccggtctccggcgcgccggtccctcatgcggctcccgacagctcgacccctggcgctccgaacggcccgcgcggcggtgcggcgcggccgacctcaggctcgcacgctgccggtcccgacgggacgcgtggtggttcggcacgtccggtttcgggttcgcacgctgccggccccgaggggacctag

SEQ ID NO: 4770 - DNA, 1815 bp, Actinoplanes utahensis
gtggtggttccgctcgtcccgtttccggtgcgcacgcgcagccggaggatcggttcggcctggctgccggtgccgcgggtggccccgccggccgccgtgcgggtcgtgcggccggtccggacccccgggaccatggcaccgggcgacacgaggcggcgggcacggccggttccgacccccgcgaccagcacctcggacggcatgaggcagccggtggacccggcatggccggcggaccgagggtgcccggtggaccggggggtgccggcggacccggaatgccgggcaggcccggggcggtcggtggacctgaggtgcctggcggacccggaatgccgggcaggcccagggccgccggtggacctggggcgcccaacggacccggaacgcccaacggcttcggaacgcccaacggacccggggtgcccaacggacccggggtgcccaacggacccggggtgcccgggggtgcccggcgggccgggagtggccgggggaccgggccggcccggagtggctggtgggtccggcacgcctgacggccccggggggcctggcgcggccggcatgcccggagccggtgtgcccgggccccggcggaccgggcccggagatgggcggccgattcgcgcggctgcggcggtgccgccgccggtggttccgggacggcagggaaagcgttctccggccatgcccggacgggccggcgcgatggcggaaagcacctccggagtcatccagccgcccgccccgcgcggcggcaacggtcagctgcagccggacgaggacggcttcaccaccgatcggcgcagccagaccggctcgatcatccccggccagggcagcgtttccgtgccgggtcagcccggcccggggcgtcgcggccgcggcgagccgcaggacgctcgcgtaacggccgacacctccgcgggcatgggctcgcccgaacggagccagggtttcccggcgggtgccggttcgcccgagcagagccagagtttcccggcgggcatgggctcgcccgaacggagccagggtttcccggcgggtgccggttcgccggagcggagtcagggttttccggcgggcatgggctcgccggagcggagtcagggtttcccggcgggcatgggtggtcctgagcagagtcagagcttccgtgccgggctgggtgggccggaacacgggcaagcgttccccggcggggctgggccggagtccagtcaggccttcccggccggtgccggtggaccggagccgacttcgcggggtcgtcgtcgccgggcggtgccggagcagggtgccggggacgggcgtggtccgaggcgagaccagggctccccggcaggccggcacggggccgagccggagtatgggcaggacttcccgggcgaggcgccgaccggtcgccacggacaggggcccgagcagagtcagggtttcccggccggtaccggtacgccgagcgggccggtctcgccggcgcccggaccgcgtggcggcggtccgcggcgcgggggcggcgctgcgacggcgggtgccgcggccgccggtgcgatcccgggactggaggggccgggtagcgcttcgacgcggattccgggcaacggcgcgccccggaatgttcccggtggtccgggtcgtggtgcggcaggcgtgcccggcaccggctccggcggtccaggtcgtggtgcggcgagtatgccgggtaacggtcccggtggtgtaacaggcgtacccggtggcggcccaggtggtccgggtcgtgctgcggcgggtgtaccgggcggcggcccgggtggtccggctagctag

SEQ ID NO: 4771 - DNA, 1080 bp, Actinoplanes utahensis
gtgccgggcggcgctccggtccccgcgacgggcaaggggacgggcaaggcttcggtcccaggccagggccggaacgacgggttcggtccggggagcggtgacgggttcggtccggggagcggcgacgggttcggtccggggagcggtgacgggttcggcccggggaacggcgacgggttcgggccggggagcggtgacgggttcgggccggggagcggcgacgggttcgggccggggagcggcgacgggttcgaaggcggggacgggtccgggagtggggacggggacggtttccgggacgagggtggcaagggcaccggcaccatcgcggttgcccgcgccgggagtgctgccggcgtaccgcgcaatcggaccggaatggacagcgggcccggcggcgaaccggagcgtggtctgtcggagcttcggcagaagctccggtcgcagcgccgcctgcggctgatcaccctgaccacgctggccgcggtcgtgttgctggtgctgcccgccttcttcgggatccgcgcggtcagcagcgacccggtcttcgcctcgctggacgcgctgaacgtgccgtcctgggccgatcagaagccggacgacaagaacagcggcagccgctggtgtttcggcgactgccggttccgggagcgcacgaccgaatcgcagcggccgttcaaggagacgaccgaggcctacagcaaggcgctgaccgaggccggttggtcgccgtggaaggtggccggctgcccggagtcgccgatcaaggccgaggagggcacctacacctgctggcggcgtgatgagttcactctggacctggcggtcggcctccccggttgcgcggtcgatcaggtggccgcggatgcgctgccggatgccgggaccgaccaggcggaggccgggacgaagggcgcgcagaagtgtgcggacggatcgacggtcagcatcaaggtgcgtgacgagatcaccgatgagcggggcaaggtggatcagcatccgggcccggtgggcgcaacgccggatccggttctgaaccagaacgatccgctcttgcagccgacaccgcaggcgtcgtga

SEQ ID NO: 4772 - DNA, 450 bp, Actinoplanes utahensis
atgaacgccggagaaatcgcaggtctgatcgcggcgggcgccttcctgatgctcgtcgtcgtgctcgctttcccgctgctgaagctggggcgcacgatcgatgccgccacccggggcatcaatgaggtggtcgatcgcaccggtccgttgctcggcaacgtgaacaccaccgtggaaaatgtgaacaccgcgctcggccaggtccaggtctccctggacggggtgaacctgcagctggccaaggtcgacaccatgaccgagcacgtgcagaacatcaccgcgaatgtcgccaacctggtcaccgtggtctccgcggccgcggcgaatccgctggtcaaggtcgcctcgttcgggtacggcgtgcgtaaggccgcccgggcccgcagtgccgccgaggaggaccgtgaggtccgcaccgagatcaagcgccgtcgcaaagccacccgctga

SEQ ID NO: 4773 - DNA, 291 bp, Actinoplanes utahensis
atgaaacgcctgctctggctgggtgtcggtctcgccgtcggcgcgctggtggtgcgcaagctcacgcgcaaggccgaggagttcaccccgaccgggatcgccacctcgctctcgcaatccgctggcgggctcgtcgagtcgctgcgtagcttcgtggaggacgtccgcgacggcatggccgagcgggaacagcagatccacgaggcgttcgccgaaggggttctgtacgaggacaagttcgccgagctgcgcgacgacacgcggcccggttcgcaggaggggaatcgatga

SEQ ID NO: 4774 - DNA, 2682 bp, Actinoplanes utahensis
atgaagacggcggaagtcaagcggcgcttcctggcgcatttcgaggctaacgggcacacggtggtcccgagtgccccgctgccggccatcgacgacccgaacctgctgttcatcaacgccggcatggtgcagttcgtgccgttcttcctgggtcagcgcaccccgccgtaccagcgggcggcgagcgtgcagaagtgcatccgcaccccggacatcgacgaggtcggcaagaccagccggcacggcacgttcttccagatgaacggcaacttctcgttcggcgactacttcaaggcgggcgcgatccccctcgcctgggagctgtcgacgaagccggtcgaccagggcgggttcggtctcgacccggagaagatctgggcgaccgtctacctcgacgacgacgaggcgatcgagatctggaagcagaccggtctgcccgccgagcggatcgtgcgccgcggcaacaaggacaacttctggtcgatgggcatccccggcccggccggcccgtgttccgagctgtactacgaccgtggcccggcgtacggcaaggagggcggcccggaggtcgacgaggaccggtacctggagttctggaacctggtcttcatgcagcacgagatcaccgacgtgcgctcgaaggagcagttcacgatcgtcggtgacctgcccaagcgcaacatcgacaccggcatgggcctggagcgcatcgcgtcgatcctgcagggtgtcgacaacctgtacgagatcgacgaggtccggccgatcctggcccgcgccgcggagatgaccggcaagaagtacggcgcgcactccgggcacgcggcgagcgagagccacccggacgacgtgcgcctgcgggtgatcgccgaccacgtgcggaccgcgctgatgctgatcggcgacggcatcgtgccgtcgaacgagggccgcgggtacgtgctgcgccggatcatgcgccgggcgatccggtcgatccggctgctcggctggcagggcccggcgttcaccgagctgctgccgatcgcgcgggactgcatgtcgccgtcgtacccggagctggccgaggagttcgggcggatctcgacgtacgcgtacgcggaggaggacgcgttcctctccacgctgaaggcgggcaccacgatcctggacaccgcgatcaccgagacgcgcgcggccaacaagacgcagctctccggtgaccaggcgttcaagctgcacgacacgtacggcttcccgatcgacctgaccctggagatcgcgcaggagcagggcctgcaggtcgaccaggacggtttccgccggctgatggccgagcagcggaaagcggcgaaggcggacgcggcggcgcgcaagaccgggcacgcggacctgtcggcgtaccggtcggcgctggacgccggcggcaccgtcgagttcaccggttaccaggagatctcccgcgagtcccgggtccgcgcgctgatcggcgccaagggccgggtcgaggtcgccggtgagggcgagaccatcgagctggtgctggacaccaccccgttctacgcggagggtggcggtcagcagtcggacaccggcctgatcaaggtcggcggcggtcaggtggaggtcttcgacgtccagcagccgattcccgggctgatcgtgcacaaggcgcgggtcgtgcagggtgaggtgcgcgccggtgagtccgggctcgccgagatcgacgtgacccgccgcaaggcgatctcccgctcgcacaccgcgacccacctggtccaccagacgatgcgcaacttcctcggcgagtcggccacccaggcgggatcgctgaacgcgccgggccgtctgcggttcgacttccacaccccgggcgcggtcaacccgtcggtgctcttcgacgtcgagcagcagatcaacgaggtgctgctgcgtgacctggaggtcaacgcgttcatcacctcgcaggaggaggcccgccggctcggtgcgatggcgctgttcggtgagaaatacggcgatgaggtacgggttgtcgaggtcggcgattacgcccgggagctctgtggcggcacgcacgtggcgcgttccggccagctcggcctggtgaagattctcaccgagtcgtcgatcggctcgggggtgcgccgggtcgaggcgctggtcggcatcgacgcgttcggcttcctggccaaggagcacctgctggtgtcccgcctggccgacctgttccgggtgcccggcgaccaggtcgccgaccgggtcgagcagaccgtcacggcgctgcgcgacgcggagaaggagctggagaagctgcgcgcgcagatggtgctggcgggtgcggccgggctggtcgaccaggcgaaggagctgcgcggggtggcgttcgtcggcaccgaggcgccggagggcgcgggcggcaacgacgtgcgcacgctggcccaggacatccgcggcaagttcgatccggcccgcccggcggtggtcgcggtgaccgcgcggtcaggtggcaaggcgacgctgatcgtggcgatcaacgcggcggcgaagggtcgcggcctgtccgccggcgagctggtcaagggcgcgctgtccggccggggtggcggcaacgccgacctggcgcagggcggcggcgttccggcggccgaggcgccgaacctgctcgccgcggtggagaaggcgctcgccgacgcgaactga

SEQ ID NO: 4775 - DNA, 462 bp, Actinoplanes utahensis
gtgacgcacggcttcacccggggcgtgcgcctcggggtggacgtcggtcaggtgcgggtcggggtcgccaagtgcgatccggacggcatcctggccagcccggtcgtgaccgtggcgcgggaccagcaggccggcgaggacaagctccccaccgacctggcggagctggtcgcgctggtggaggaacacgaggccgtcgaggtcgtcgtgggtctgccggtggcgctcaacgggcgtgagggcgtggcggccggccacgtccgggcgtatgcgcagcggctcggtgcgctggtcgcgccgcggcccgtcgtgctctccgacgagcggatgtcgaccgtcgtggccagccgtaggctgagcgaacggggtgtccgcgggcgtcggcagcgggcggtcgtcgaccaggcggccgccgtggagatcctgcagggctggctggacgcgcagcggaggcagacttaa

SEQ ID NO: 4776 - DNA, 1182 bp, Actinoplanes utahensis
ttgagcgacaacgacctggatcccatgttcgagggagccgaggacccgggccggtggcggcatcgcaagaaggaacgcggccgcgggcgtacgatcatggccctcaccctggtgctcctgctgttcggtgcgctgggtggcgtcggctacatcggcttcggcaagatccgcagcttcttcacggtcgaggactacgacgggccgggcaccggtgaggccgtcgtcgaggtgaagtccggcaacaccgccaccgacatcgccaacaccctgttcaaggcgggtgtggtgaagagtgccgcggcgttcgtcgacgcggccaaggacgacccgaagagcaaggacatccaggtcggaacgtatctcctgaagaaggagatgaaggccaaggacgccctggccatgctgctcgacctgaagaacaagaacgtcaacaaggtcaccatcccggagggcctgatctcgctgcagatcttcgaccggctgtcgaagtcgaccggcatcccggtcgacgacttcaaggcggccgcgaagaacgtgcagaagctgggcgtgccgtcgatgtggttcaagcggcgcgacggcaagaaggtcgacccgtcgaagatcgagggcttcctctacccggcgacctacgagttccccaaggacgccaaggccgaggacattctcaagatcatcatcacgcacttcaacgacgagatgaccaagctcgacttcgccaaccaggcgtccaagctcaacatctcgccgtacgaggcgctggtcgccgcgtcgatcgcccaggtcgaggcgctgctgccgcaggacatgggcccggtcgcccgggtgctctacaaccgggcttacaccggcgagttcccgtgcagctgcatgcagctggacagcatggtcaactactacctgcggatcagcggcaaggacgccaaggcgtcggagaacctgctgcgcaaggagctgcacgacccgaagaacccgtacaactatgacgccaagggcctggcgatcacgccgatcagcagccccggcgaggtcgccctgaagggtgccgtcaccgccccgaagagcaattacttcttcttcgtgacgatcgacaaaaagggcacgatggcgtacgggcggaccaacgacgagcaccaggcgaacatccgaatcgcctgccagaacggtattccgatctgctga

SEQ ID NO: 4777 - DNA, 1188 bp, Actinoplanes utahensis
atgctcgacgatctggattcggtgctggcggaagaacagcagccacagccggacgcgccgcgccacaagcggggccggaccggccggtcggcgatcgcgttcttcctcagcctcgtcctgctcgccctgctggccggcggtggctggctggtctacagcaaggtgaaaggcttcttcgtcgccgacgactactccgggcccggcggcgccgagacgatcgtgcaggtgcagagcggccagtcggccacggacatcggcaacacgctgtaccaggccaaggtggtggcctcggcggaggcgttcgtcgacgccgccaaggacaacaaccgcagcaagaacatccaggccgggtggtacaggctcaaggtgcagatgaaggccgccgacgcgctgaccctgatgctcgacccgaagagccgctgggtcacccgggtcaccctgcccgagggcctgtcgtaccagcagaccttccagaagctgtcggaggccaccaagatcccggtggccgagttcaccaaggcggcgaaggacccggtcgcgctcggcgtcgacccgtcctggttcacccgcaccgacggcaagaaggccgacaagaccgacatcgagggcttcctgttcccgtcgacctacgagctgtcacccaaggccgacgccaccgacgtgctcaagacgatcatcgcgaacttcaacacccagatggaccagctggagttcgtctccacggtgcagaagacgcgcggcgggatcagtccgtaccaggcactgatcgtcgcctcgatcgcccaggccgaggcactcaaggacgaggacatgcccaaggtgtcccgggtcgtctacaaccgggcgtacggcgatttcgcctgccactgcctgggcctggacagcacggtcaactactggctgcggatcagcggcaagggctcgaaggcgtcggagaagctcaccaacgccgacctgcacgacccgaaggacccgtacaacacgcacgacaagccgggcctgccgcccgggccgatcggcaacccgggcctgggcgcgctcaagggcgcgatgagcccgaccgagaacttcccgtactactacttcatcagcgtcgacaccaagggcacgatggcgtacggcaagaccggcgacgaccacgagcgcaacaggcagctcgcctgtcacaacggcatcccgctgtgctga

SEQ ID NO: 4778 - DNA, 861 bp, Actinoplanes utahensis
gtgcagaccaccagttcgcgccgcgcggccgtgctcggcaagccgatcgcccactcgctctccccggtgatccaccgcgccgggttcgccgcggccggcctgaccggctggacgtacgaggcgatcgagtgcgccgaggcggagctgcccggcctggtggccggcctcggcccggagtgggccggtctgtcgctgaccatgccgctcaaggagaccgcgctcaccctggccgcctcggccaccccggccgcgatcgccgccggcgtggccaacaccctgatccgtcaggacgacggcgggtggcatgccgacaacaccgacatccccggcatggtccgggtgctgcgcgcggccggcctgggcgccgggacgggccgacacgcggccaaggaggcgccgccccggatcaccgtcctcggcggcggcggtaccgcccgggccgccctggccgccgcggccgagctcggcgccgaggtggtcaccgtggtcacccgccgccccgaggcccgtgccgaactggagccggtggccggcgcgctcggcgtcaagctggacggggccccgtggtcggccgccgccctggacgccgacgcggtgatctccacggtgcccaagggcgccgccgacgcgctggccgccgaggtcacctggcgctccggcggcgtcttcttcgacgcgctgtacgacccgtggcccaccccgctggccgcctccgcgatcgccgcgggcgtcaccgtggtgtccgggctcgacctgctgctggcccaggcgctgagtcagttcgagcaattcaccggggtggccgaggccccggaggaggcgatgcgcgccgcgctcgacgaggcggcccgcaaccggtag

SEQ ID NO: 4779 - DNA, 1179 bp, Actinoplanes utahensis
atgctgcgctggcttactgcaggtgaatcgcacggaccggcgctcgtcgccatgctcgagggtgtgcccgccgggatcgaggtgacgagcgccgacatcacccgtgacctcgtgcgccgccgcctgggctacgggcgtggcgcccggatgaagttcgagcaggacgaggtcgagttcatcggcggggtccggcacgggctgacgctgggcagcccggtcgcgatccgggtcggcaacaccgagtggcccaagtgggagacggtcatgtcggccgacccggtcgacccggacgtgctggccgcccagtcgcgcaacgccccgctgacccgcccgcgccccggccacgccgacctggccggcatgcagaagtacgggcacaccgacgcccggccgatcctggagcgggccagcgcccgggagaccgccgcccgggtcgccgtcggcgtcgtcgccaagcagctgatcaggcaggcgctcggcatcgagatcgtgtcgcatgtgatcgagctcggctcggtcgccgcgaagaccggcctgatccccaccctggacgacttcgaccggatcgacgccgacccgctgcgctgcctcgacccggaggccagcgcccggatggtggccgaggtcgacgcggccaagagggacgcggacacgctcggcggcatcgtcgaggtcctcgcctaccacgtcccaccgggcctcggctcacacgtgcagtgggaccgcaagctcgacgcccggctggccaccgccctgatgtcgatccagtcggtcaagggcgtcgagatcggcgacggcttcacccaggcccgctcccgcggctcggtcgcgcacgacgagatcgtcccgacggcggacggcgtccggcgggtcaccgaccgggccggcggcctggagggcggcatcaccaacggcgagccgctgcgcgtccgcgccgcgctgaagcccatctcgtccctgaaccgggcgctgcagaccatcgacatcaccaccggcgagccggccaccgcgatcaaccagcgctccgacgtctgcgcggtcccggccggcgcggtcgtcgccgaggcgatggtcgccctggtcctggccgaggcggccaccgagaagttcggcggcgactcggtcgccgagatccgccgcaacctcgcctcctaccgggacaacctggtggtccgctga

SEQ ID NO: 4780 - DNA, 504 bp, Actinoplanes utahensis
atgcccccgcgcgcggtcctggtcggcccacccggcgccggcaagacgacgatcggcgaggcggtcgccgccaccctcggcctgtccttcaccgacaccgacacgatcatcgagcagcgggccggcaagccgatcccggacatcttcgtcgaggacggcgagcccaccttccgcaccctggaacgcacggtcgtcgccgagtcgttgtcctccttcgacggcatcctctccctgggcggcggcgccatcctggacgagaccacccgcgccctgctgaaggaccacacggtcgtcttcctctcggtggagctggcggacgccatcaaacgggtcggcctcggcgccggccgcccgctgctggcgatgaacccccgggcgacgatgaagttcctgctggaacagcggcggccgctctacaccgaggtcgccacccacacggtgctgaccgacggccgcgggcccgaggagatcgcccccgaggtcgccgccctcctgcgggcctag

SEQ ID NO: 4781 - DNA, 1167 bp, Actinoplanes utahensis
atggatattcgtcgacgggggccgccggacggaaccgcccacctggcggaaccgcgccgagcacagcggacagaagcgcggctcgcggatagggtgacggccgtggtgacgcgaatcccggtgcatggtgaccgcccgtacgacgtgatcgtcggccgcggtctgcacgacgagcttcttccgatgatcgacggcgccgcgcgggtggcggtggttcatccggcggcgctgcgggagcgggccgaggcggtcgccaaggcagtcggtgggtgcacggtggtgccgatcgaggtgccggacgcggagaaggggaagaccgtcgaggtcgccgcccggtgctgggatgcgctgggtgccgccgggttcacccggaccgatgtggtggtcggggtcggcgggggtgccaccaccgatctggccggctatgtcgcggcggcctggctgcgcggggtgcggtgggtgccggtgtcgacctcggtcgccgggatggtcgacgccgcggtcggggggaagaccgcggtcaacatcgcggccggcaagaatctggtgggggcgttccacccgccggccggggtgatctgtgacctggacgcgctggacacgctgccggccgaggacatcgcggccgggctggccgaggtggtcaagggcgggttcatcgccgacccgcggatcctggagctgatcgaggcggatccggacgcggcgctggacccgcgcggcgaggtgctgcgggagctgatcgagcggaagatccgggtcaaggccgacgtggtcggggtggatctccaggagtccggactgcgggagatcctcaactatgggcacacgctggggcacgcgatcgagcgccgggagcggtacacctggaagcacgggcatgccgtggcggtgggcatgatcttcgcggccgagctggggcggctgtccgggcggctggacgacgcgaccgcggggcgccaccgggagatcctggtgcggctggggctgcccacgtcgtacgaccgccatgccttcggtgagctggaagccgggatgcgcgtcgacaagaagacgcgggccgccaccttgcgcttcgtggtgctggacggcctggcgaagccgggcatcctgaccgggccggacgacgacctgctgcggcgggcgtacgcggcggtggcgcgatga

SEQ ID NO: 4782 - DNA, 420 bp, Actinoplanes utahensis
atgatctacgtgttgaacgggccgaacctgaaccggctgggcacccgggaaccggacatctacggcacgacgacgtatcaggacctggtcgacatgtgccggaccgtcgccgatgatctcggcagggagatcgccgtccggcagaccaacgccgagtacgagatgctcggctggctgcacgaggccgccgacgagggcgccgacgtggtgctcaacccgggcgcgtggacgcattacaacatcgcgatccgggacgcctgcgcgatgctgcgtggcaagctgatcgaggtgcacatctcgaacgtgcacacgcgtgaggagttccggcaccactcggtgatctcggcggtggcgaccggggtgatcgccgggctcggtatcgacgggtaccggctggctttggagcacatctgccggtag

SEQ ID NO: 4783 - DNA, 558 bp, Actinoplanes utahensis
atggcttccaccaacgacctgaagaacggcctggttctcaacctcgacaaggagctgtggtccgtcgttgagttccagcacgtcaagcccggtaagggtccggccttcgtgcgcaccacgctgaagcacgtgctctccggcaaggtcgtcgacaagaccttcaacgcgggcaccaaggtcgagacggcgaccgtggacaagcgcacgatgcagtatctgtaccaggacggcgacgactacgtcttcatggacctggacacctacgagcagatccacgtccccggcgccacggtcggtgacaacgcgaactacctgctgcccgaggcggaggccacggtcgcgctgcacgagggcgtcccgctctacatcgagctgccgaccagcgtcttcgtcgaggtcacctacaccgagccgggcctgcagggcgaccgctcgaccggtggcaccaagccggcgacgatcgagaccggcgccacggttcaggttccgctgttcatcaccaccggtgagaagatcaaggtcgacacccgcgacggccgctacctcggccgcagctga

SEQ ID NO: 4784 - DNA, 435 bp, Actinoplanes utahensis
atggcggaaggtcccaagaaggaacggctggcgcgccgcaaggcgcgcaagcgggcgctggacgtccttttcgaggccgacatgcgcgatctgccgccgagccaggtgctggtcacctatctcgaccggatcgcgaagccgcaccccgagcacctggcgtacgcgatcaccctgatcgagggtgtcgccaagaacatcgaccgggtcgacgagctgatcgccagctacgccgagggctggacgatcgaccggatgccggtcgtcgaccgcaacctggcccggatcgccgtctacgagctgctcttcgagccggacgtggacgacccggtggcgatcaccgaggcggtggagctggcgcgggagatgtcgaccgacgacagcccgaggttcctcaacggtctgctggaccggatcgccgctttcgccacaaggtag

SEQ ID NO: 4785 - DNA, 489 bp, Actinoplanes utahensis
atgccgtctgagtacgcgaagtcactgggcgctcgtctgcgctccattcgccagcagcagggcctgtccctgcagggcgtcgaagagaagtccaacggccgctggaaggccgtcgtggtcggctcgtacgagcgtggcgaccgtgccgtgaccgtctcgcgcctggccgagttggccgacttctaccgggtgcccgtctccgagctgctgcccgacggcagcggcatccgcctcgaggccaccaacaagatcgtgctggacctcgagaagctgtacgacaccaccggtgaggacctcgcctacgtggcgcggtacgcccgggcgatccagcagcagcgtggcgactacaacggccgggtcctctcgatccgcgccgacgacctgcgcgcgctcgccatcgtgtacgacatctcgccgtccggcttgatcgagcggctcaccgagcagggcgtcctggtggccgacccgcgggcgttcttcgcgagctga

SEQ ID NO: 4786 - DNA, 648 bp, Actinoplanes utahensis
atgatcaaagcctgcgccactggtaacgtagcgtcagccagacatcctttaacgacccgtcccgtgaggcggggaaggaggtccgccgtggcacagccacgcgcagacgcgcccagcaagatcattttagccgggtccgacctgtcccgggtcgtcgaccggatcgcgcaccagatcctggagaagacgtccggcgccaccggcaccgtgcttctcggcatccccacccgcggcgtcccgctcgcgcaccgcctggccgcccggatccacgccttcgagggcgtcgaggtcccggtcggctcgctggacatcacgctctaccgcgacgacctgcgcctcaaggcgacgcgcgcactgggccgcaccgagctgccgcccggcggcatcgacggcctgcgggtgatcctggtcgacgacgtgctgttctccggccgctcggtgcgcgccgccctggacgccctcaaggacctcggccggcccagctcggtgcagctcgcggtgctggtcgaccgcggtcaccggcagttgccgatccgcgccgactacgtcggcaagaacatccccacggcgttgagcgagagcgtcaaggtcgctctcaccgaggtcgacgacgccgatgaggtacgcctgatcggagggctgcagtga

SEQ ID NO: 4787 - DNA, 921 bp, Actinoplanes utahensis
gtgatcaaacatctgcgttcggccgcggacctggacgccgcgaccgccaccctgatcctggacaccgccgccgagatggccgcgctctccggccgtgaggtcaagaagctgcccgcgctgcgcggccgcaccgtggtgaacctcttctacgaggactccacccggacccggatctcgttcgaggcggccgccaagcgcctctccgccgacgtgatcaacttttcggcgaagggatccagcgtctccaagggcgagagcctcaaggacaccgcgctgaccctgcaggcgatgggtgccgacgccgtggtgatccggcacgcggccagcggcgccccgcaccggctggcgaactgggtggagggctcggtggtcaacgccggcgacggcacccacgagcacccgacccaggcgctgctcgacgcgtacacgatgcgctcgcgcctgggccgcctcgacgggctgaacgtggcgatcgtcggcgacgtgctgcacagccgggtggcccgctccaacgtgctgctgctgaccacgctgggcgcaagagtcaccctggtcggcccgccgaccttgatcccggtcgacatcgcccctgccttgtccaaggagacccgagtctcgtacgacctggacagcgtcctgccggacagtgacgtggtgatgatgctgcgcgtgcagaccgagcggatgcaggactcgtatttcccgtccgcccgggagtacagccgccgctacggactggacatgacccggatgcgcaaactgccggagcacgcgatcgtgatgcaccccggcccgatgaaccgcgggatggagatcgcgcccgaggtggccgactcgccccgatccaccatcgtcgaacaggtcgccaacggcgtcagcgtccggatggccgtcctctacctgctcctgggaggcaagtga

SEQ ID NO: 4788 - DNA, 1269 bp, Actinoplanes utahensis
atggcgtacctgctcaagggcgtctcgattctcggcgccgcgccgacggatctcttcatcgacaacggcgtcatcgcggaacgcaccgcagaagcggacccggtggtcgtcgaggcggccggtctcgtcgccctgcccggtctcgtcgacgtgcacacccacctgcgcgaacccggccgcgaggacgccgagacggtggagaccggctcccgcgccgccgccctcggcggctacaccgcggtctgcgcgatggccaacacgtccccggtcgccgacaccgccggcgtcgtcgagcaggtctggcgcctgggccgggaggccggcctggtcgacgtccagccgatcggtgcggtcaccgtcggcctggccggcaagcagctggccgagctcggcgcgatggccacctcggcggccaccgtgcggatcttctccgacgacggcttctgcgtcgccgacccgaagctgatgcgccgcgccctggagtacgtgaaggcgttcgacggcgtgatcgcccagcacgccgaggaacaccggctcaccgagggcgcccagatgcacgagggcgaggtcagcacccggctcggcctgaccggctggccggcggtcgccgaggaggcgatcatcgcccgggacgtgctgctgaccgagcacgtcggcagccgcctgcacgtctgccacgtctcgacggccggctcggtcgaggtgctgcgccaggccaaggcccgcggcgtccgggtgaccgccgaggtcaccccgcaccacctgctgctcaccgacgagctcgcggcgggctacgacccggtcttcaaggtcaacccaccgctgcgtacggcgaaggacgtcaccgccctgcgccaggcgctgctggacggcgtgatcgacgtggtggccaccgaccacgccccgcacgccgtgcaggacaaggaatgtgagtggtcgtacgcccggccgggcatgctcggcctggagaccgccctgccgatcctgctgagcgtgttcggcgagcagtgggacctgatcgccgaccggatgtcggtcgccccggcccggatcgccgggctgagcgggcacggcggcgacctgaccgaaccgggcacaccggcgaacctgacgctggtggacccgtcggcgcgctgggtcgtggacccgggcgctctggcgagccgcagccggaacaccccgtacgcgggaatgaccctgccgggccgcatcgtggcgaccttcctgcggggcgaggcaaccgttctcgacgggaaggcagtcaagtga

SEQ ID NO: 4789 - DNA, 1107 bp, Actinoplanes utahensis
gtgaccaaggcaatcctcgtactggaagatggccggtctttcaccggcaccgcatacggcgctgtgggggagaccttcggcgaggcggtcttcaccaccgggatgaccggttaccaggaggtgctgaccgacccgtcgttccaccggcaggtcgtggtgcagaccgcgccgcagatcggcaacaccggcgtcaacgacgaggacgacgagtcggaccggatctgggtcgccggatacgtggtccgcgacccggcccgccgcccgtccaactggcgcgcgaccggcgacctgggcgagcgcctggccgccgagggcgtggtcgggatcagcggcatcgacacccgcgccctgacccgccacctgcgcgagcgcggcgcgatgcgggtgggcatctcctcgctcgacctggacgtccaagccctgcgggaacgggtcaaggcccagccgcagatgctcggcgccgacctgtccgcccaggtcaccaccggcgagcgctacaccgtgccggccgagggcgagcaccggtacacggtcgccgcgctggacctggggatcaagcgcaacgtctcccgccggctggccgcccgcggcgtgaccacgcacatcttcccggcgaactcctcgatcgaggatctgctggcggtcagccccgacgcggtgttcttctcgcccggcccgggcgacccggccaccgccgacggcccggtcgcgctcgcccgggaggtgatgaaccgcgaggtgccgctgttcggcatctgcttcggcagccagatcctcggccgggcgctcggcttcggcacctacaagctcggctacggccaccgcggcatcaaccagccggtgctcgaccggaccaccggcaaggtggaggtgaccagccacaaccacggcttcgcggtcgacgctccgctcgacgaggtgctcaccaccgacttcggccgggtcgaggtctcgcacgtctgcctcaacgacaacgtggtcgaagggctgcgcggcatcgacgtgcccgcgttcaccgtccagtaccaccccgaggccgccgccggcccgcatgacgccgactacctgtttgatcggttcgtcgagctcgtcgagaagaagggctga

SEQ ID NO: 4790 - DNA, 3318 bp, Actinoplanes utahensis
atgccgaagcgtgaagatctcaagcatgtgatggtgatcggctccggtccgatcgtcatcggccaggcctgcgagttcgactactccggcacccaggcgtgccgggtgctgcgcgccgaggggctgcgcgtctcgctggtcaactcgaacccggccacgatcatgaccgacccggagttcgccgacgccacctacgtcgagccgatcacccccgagttcgtcgagctggtcatcgccaaggagcgcccggacgcgatcctgccgacgctgggcgggcagaccgcgctgaacaccgcgatcgccctgcacgagagcggcgtgctggacaagtacggcgtcgagctgatcggcgccaacgtcgaggccatccgcaagggtgaggaccggcagctgttcaaggacatcgtcgccaaggccggcggcgagaccccgcgctcgcgggtctgccactcgatggacgaggtgcgcgccacggtcgccgagatcggcctgccggtggtcatccgcccgtcgttcaccatgggcggcctcggctcgggcatggcgcacagcgacgccgacctggagatgatcgccggcgccggcctggccgcctccccggtgcacgaggtgctgatcgaggagagcgtgctcggctggaaggagtacgagctcgaactgatgcgcgaccggcacgacaacgtcgtggtcgtgtgttcgatcgagaacgtcgacccgatgggcgtgcacaccggcgacagcgtcaccgtggcgccggccctgaccctcaccgaccgggagtaccagaagctgcgcgacctgggcatcgcggtgctccgcgaggtcggcgtcgacaccggcggctgcaacatccagttcgcgatcaacccggacgacggccggatgatcgtgatcgagatgaacccgcgggtgtcccgctcctcggcgctggcctccaaggcgaccggcttcccgatcgcgaagatcgccgcgaagctggccatcggctacaccctggacgagatcccgaacgacatcacgctgcagaccccggccgccttcgagccggccctggactacgtggtcgtcaagatcccgcggttcgcgttcgagaagttcccgggcgcggacaaggagctcaccaccacgatgaagtcggtgggcgaggcgatgagcctgggccgcaacttcgccgaggcactgaacaaggcgatgcgctcgatggagacgtcgcaggcggggttctggacctacgctgacaagaccgacgatctgcaggaggttctggaggcgctgaagacgccgcacgacggccggctctacaccgtcgagcacgccttccggctgggcgcgaccgtcgagcaggtgcacgcggccagcggccggatcgacccgtggttcctcgacgagatcaaggcgctggtcgacctgcgcgccgagatcctggccgccccggtcctcgacgaggaactgctgcgcaaggccaagcggtccggcctgtccgaccggcagctcgccgcgctgcgcccggagctggccggcgaggacggggtccgcgcgctgcggcaccggctggggctgcgcccggtctacaagacggtggacacctgcgcggccgagttcgccgccaacacgccgtaccactactcgtcgtacgacgaggagaccgaggtcgcgccgagtgaccggcccaaggtgatcatcctgggctccgggccgaaccggatcgggcagggtatcgagttcgactactcgtgcgtgcacgccgtacaggcgctgcgcggggtcgatttcgaaaccgtcatggtcaactgcaacccggagacggtctccaccgactacgacaccgccgaccggctctacttcgagccgctcaccttcgaggacgtcctcgaggtgttccacgccgaggactcctccggcaaggcggccggcggccccggtgtgatcggcgtgatcgtccagctgggtggccagaccccgctcggcctggcgaaccggctcaaggcggccggcatcccgatcgtcggcacctcgcccgagtcgatcgatctggccgaggaccgcggcctgttcggcacgctgctcgccgagaacgggctgcgctcgcccgagcacggcaccgccacctcgttcgaggaggccaaggcgatcgccgacacgatcggctacccggtgctggtgcgcccgtcgtacgtgctgggcggccggggcatggagatcgtctacgacgagcccacgctgaagggctacatcgagcgggccaccgagatctccccggaccacccggtgctggtcgaccggttcctggacgacgccgtggagatcgacgtggacgcgctctgcgacgccaccggcgaggtctacctgggtggcgtgatggaacacatcgaggaggccggcatccactccggcgactcggcctgctcgctgccgccgatcaccctggccgcctcgcacctggccgaggtgcgccgctacaccgaggcgctggcccgcgggatcggcgtgcgcggcctgatgaacgtccagtacgccctcaaggacgagcagctctacgtcctggaggcgaacccgcgggcgtcgcgcaccgtgccgttcgtctccaaggcgaccggcgtgcagctggccaaggcggccgcccgggtcatgctcggcgccaccatcgccgagctgcgcgccgagggcatgctggtgcccgaccgcgacggcggctcggtgccggccggcgcgccgatcgcgatcaaggaggcggtgctgcccttcaagcggttccgcacgctcgccggcaacaacgtggacagcctgctcagcccggagatgaagtcgaccggtgaggtgatgggcatcgacgccgggttcggccaggcgttcgccaagtcgcaggccgcggcgtacgggtcgctgccgaccagtggcaagatcttcgtctcggtggcgaaccgggacaagcggtcgatgatcttcccggtcaagcggctcgccgacctcggcttcggcatcgtcaccacggccggcaccggtgaggtgctctcccggtacggcatcgactgcgagatcgtcccgaagcactacgagagcccgggcacgaacgccgtcgagctgatcctggccggtgagatcgccctgatcatcaacaccccgcagggctccggcgcgagcgcccgccaggacgggtacgagatccgcagcgccgcggtcaccgccgacatcccgtgcgtgaccacggtgccgggggcggccgccgcggtgatgggcatcgaggccctgatgcgcggcgacatgagcgtgcggccgctgcaggacctgcaccggctgctccggagcgacctctcatga

SEQ ID NO: 4791 - DNA, 1029 bp, Actinoplanes utahensis
atgaatctgttccgcaacgccgtccggccggtgctgttccggctgggcggcggcgacgccgagaccgcgcacgagtggacgctgcaccggctcgcctcgatgccgccggccgcccgtgaggtgatgcgccgccggtacgccttctccgccccggtggaggcgttcggcgtgcggttcccgaaccgggtcggcctggccgccgggatggacaagaacggcctggccctgccggcctggccggccctcggcttcggtttcgtcgaggtgggcacggtcaccgccaagccgcagccgggcaacgaccggccgcgcctgttccgcctgcgggagagcgaggcgatcatcaaccggatgggcttcaacaacgccggcgcggccgccctggccgcgcggctggaggagctcgggccgatcggtgtgccgctcggcgtctcgctgggcaagtccaaggtcaccccactggacgaggcggtcgaggactaccgggagtcgtaccggctgctgcacccgtacgccgactacatcgcggtgaacgtctcctcgccgaacacgccgggcctgcgcagcctccaggatcgcgacgcgatcaaggagatcctgaaagcgctcagcggtccggtcccggtgctcgtcaagatcgccccggatctgaccgagccggccatcgccgagcttctcgaggtctgcctggagcacggtgcggccggcctgatcgccaccaacaccaccctggcccgcgacggcctggccccgggcgatcggcacctggccgccgaggccggcgggctgtccggccggccgctgaccgagcgggcccgcgaggtggtccgcttcgtgcacgaggagaccggcggccggctgccgatcgtcggggtcggcgggatcctgtcggccgacgacgcctcccggatgctggatgccggggcgacgctggtgcagctctactccgggttcatctacaagggcccggatctggtcaaggcggtcgctcagggtgcccgcccggcccgcgcgacgacgccgcgatga

SEQ ID NO: 4792 - DNA, 1275 bp, Actinoplanes utahensis
atgagccccgtcgagcgcgagctgctggcgctcgaccgggcgcacgtgtggcacccgtacgggccgatgcccggccgcagcgatccgtatctggtggagagcgcggccggggtccggctgcgactggccgacgggcgcgagctcgtcgacgggatgtcctcctggtgggcggcggtccacgggtatcgccacccggtgctggacgcggcgctcgccgagcaggccgggcggatgagccacgtgatgttcggcgggctcacccacgagccggccatcacgctggcccgtacgctggtcgagctcaccccgcccggcctggagcacgtcttcctctgcgactccggctcggtcggggtcgaggtggcgatcaagatggcgatccaggccactggccgccgccggctcgccacctggcgcggcgggtatcacggcgacacgttccacccgatgagcgtgtgcgatccggacggcgggatgcactcgctgtggaccggggtgctgccggcgcagatcttcgccgccgcgccgcccgccgatttcgaccaggcctatgccgattccctgcgggacatgattgcggcgtacgccaccgatctggccgccgtgatcgtcgaaccggtggtgcagggcgccggcgggatgcgcttccaccatccggagtatctgcgcgtcctgcgcgaggccaccgccgagcacggcgtcctgctgatcttcgacgagatcgccaccgggttcggccgcaccgggcagttcttcgcggccgggcacgccggcgtgagcccggacatcatgtgcctgggcaaggcgctcaccgggggatacctgacgctcggcgcgacgctgtgcaccaccgcggtggccgaggcgatctcggcggggccgggcggcgcgctgatgcacgggccgaccttcatgggcaatccgctggcctgcgcggtggcgaacgcctcgctggggctgcttcgcgacggcgggtgggcggaccgcgtacgcgtgatcgaaaccggtcttaccgagggtctggagccgttgcgggacgcgcccggggtggccgacgtccgggtgctcggcgcgatcggcgtggtccagctggaccacgaggtcgacgtgccgcgggcgacggcggccgcggtggcccagggggtctggctgcgcccgttccgggacctgatctacacgatgccgccgtacgtcgccgacgaggccgacgtcgcccggatcaccgcgggcatcaccgcggcggcgctttctcacgagcagaggggtacacgctag

SEQ ID NO: 4793 - DNA, 831 bp, Actinoplanes utahensis
atggaaaccttcggggaacgcctccacgccgcggtcgccgagcgcggcccactgtgtgtcggcatcgatccgcatgccgctctgctcgcccgctgggggctctccgacgatgtcgccggcctggaacgtttcgcccgtacggtggtcgacgcgctggccgatcgggtggcggtgctgaagccgcagtcggccttttttgagagatttgggtcacgcggcatcgcgattcttgagtcaactatccgacagtcccgggaggccggcgctcttgtcctgctcgatgtgaagcgcggcgacatcggctcgacgatggccgcgtacgccgccgcgtacctggatccagcgagtactctccgctctgacgcgattactgtgagtccctatctcggggtcggctcgctgcgcccggcattcgatctcgcgaccgccaccggcgccggaattttcgttctggcgctgacctccaacccggagggcgcttccgtccagcacgccgtcgcgccaggtgggagcactgtcgcgcaaaccgtgatcgacgagatttcccagctcaacgcgggtgtgagccctctcggaagtttcggcctggtggtcggcgcgacgatcggcgacaccgggcacgacctggccggcgtgaacgggccgctgctcgcgccgggcctcggagcgcagggcgcgacgcccgccgacctgcgtcgtgtcttcggcgaaagcctgcacaacgtgttgccgtcgtactcacgcgaagttctctccgcgggcccggagatcgccggtctgcgggccgccaccgaccgtgttctggacgactgccgcgccgcgctcgggtga

SEQ ID NO: 4794 - DNA, 318 bp, Actinoplanes utahensis
gtgccgctcccgtcactgagccccgagcagcgcgctgccgcgctggaaaaggccgcggaagttcgcaaggctcgggccgagctgaaggaacagctcaagtccggcaagaccaccctcgccgccgtgctcgaccgcgcggaggccgatgaggtcgtcggcaagctgaaggtctcggccgtgctgcaggcgctgccgggcatcggcaagatccgcgcgacccagatcatggagaagctgaagatcgccgagagccgccggctccggggtctcggcgaccagcagcgcaaggccctcctgggggagttcgctgcgaactga

SEQ ID NO: 4795 - DNA, 594 bp, Actinoplanes utahensis
gtgagcatggatgacgacgcgcgcccggcagcccgcctcaccgttctttccggcccctccggggtcggcaaggacagtgtgatcgagctgatccgggcgcgctcgccttggatccggttgtcggtgtcggtcacgacacgcaagaaacgcgactacgagaccgacggcgagcactatcacttcgtgacccggtccgagttccagcggctgatcgacggcggacagctgctggagtgggcagaatttgcggggaacctctacggcaccccccgcgcgcaggtcgagggctggctccagcagggccggcccgtcctgttgaagatcgacctgcagggcgcccgccaggtgcgggccgccatgccggcggcccagctggtcttcctggccccaccgagcgtcgacgagctccagcgccggctgatcggccggggcaccgacgatccggagacgatcaagcgccgactggcgcacgccgacgaggagctcgccgccgagtccgagttcgacgtcaccgtggtgaacgacttcgtcgaacgggccgccgacgagctggtaggcttgctcggttcgttatatctagcccacgagcattaa

SEQ ID NO: 4796 - DNA, 261 bp, Actinoplanes utahensis
gtgggaactgtcgccaaccccgagggcatcaccaacccgccgatcgacgagttgctggacaagacctcgtcgaagtactcgctggtgatcttcgcggccaagcgcgcccgccaggtcaacgcctactacagccagctgggcgagggtctgctcgagtacgtcggtccgctggtcgagaccactccgcaggagaagccgctctccatcgcgatgcgggagatcaacgccggtctcctcaccgccgagccgaccgaccactaa

SEQ ID NO: 4797 - DNA, 1212 bp, Actinoplanes utahensis
gtgaccgaggtcgttctgggggtgtgcggcggcatcgccgcgtacaaggcgtgtgagctgctgcgcctgttcaccgagtcgggtcacggcgtgcgggtggtgcccaccgccgcggcgctgcagttcgtcggcgcgcccacctgggccgcgctctccggccgcccggtcgccacgcaggtgtgggacgacgcccacgaggtcccgcacgtgcggatcggccgggccgccgagctcgtcgtggtcgccccggccaccgccgacatcctggccaaggcggcccacgggatcgctgacgacctgctcaccaacaccctgctcacggccacctgcccggtcgtctacgcccccgccatgcacaccgagatgtgggacaatccggccacccgggccaacgtcgccacgctgcgctcgcgcggcgcgctggtcatcgagccggcggtgggccggctcaccggccgggacaccggcaaaggccggcttccggagccttcggccatcttcgagtacgcggtgtccgccctccgcggccgtcccgacctggcgggccgccacgtggtggtcaccgccggcggcacccgcgagccgctcgacccggtgcgcttcctgggcaaccggtcctccggcaagcaggggtacgcgctggcccgtgccgccctggcccgcggcgcgaaagtgacattgatcgcggccaacgtgacgctgcccgacccggccggtgccgatctggtgagggtgggcaccaccgaggagttgcgccgggccaccgtcgaggcggccggctcggcggacgtcgtggtgatggccgccgccccggccgatttccgcccggccaccgtggccgaccagaagatcaagaagaccgacgacggcctcccggccccgatcgccctggtgacgaacccggacatcgcggccgagctgggcgcggccaagcggcccgggcagttgttggtggcgttcgcggccgagacgcacgacgccctcgaacacgcccgggcgaaaatgatccgaaagcgggcagacctcatcgtggtcaacgaagtcggcgtcgaccgggtcttcggccaggaccgcaacacggtcactgtgctgggcacggacggtttcaccgaggcactcgacgagctctccaaagacgatgtggcgaataggattttcgaccacgtcgtggaccgcctggatgcccaggtcggcggcggtcggccgctctga

SEQ ID NO: 4798 - DNA, 1191 bp, Actinoplanes utahensis
gtggcacgccgcctgttcacttccgagtcggtcacggaaggccacccggacaagatcgctgaccagatcagcgacgggattctcgacgccctgctcgcgcaggacccgcgcagccgtgtcgcggtcgagaccctgatcaccaccggccaggtgcacgtagcgggcgaggtcaccacccaggcctacgccgacatccccagcatcgtgcgcgacaccatcctgcggatcggttacgactcgtcgaagaagggcttcgacggcgcgtcctgcggcgtgagcgtctccatcggctcgcagtccccggacatcgcccagggcgtcgacagcgccatcgagctgcgcgagggtgactccgagcacgtcctcgaccagcagggcgccggcgaccagggcatgatgttcggcttcgcctgctcggagacccccgagctgatgccgctgccgatcgccctggcccaccgcctggcccgccggctctcggtcgcccgcaaggacggcctgattccgtacctgcgcccggacggcaagacccaggtcaccatcgagtacgacgggctgcgcccggtccgcctcgacaccgtggtcgtctcctcgcagcacgccgcggacatctcgctggactccctgctcaccccggacgtccgcgagcacgtgatcaacccggagctggagggcctcggcctcgacaccgacggctaccgcctgctggtcaacccgaccggccgcttcgagatcggcggcccgatgggcgacgccggcctgaccggccgcaagatcatcgtggacacgtacggtggctacgcccgccacggtggcggcgccttctccggcaaggacccgtccaaggtcgaccgctccgcggcgtacgcgatgcgctgggtcgccaagaacgtggtcgccgccggcctcgccgagcgctgcgagacccaggtggcgtacgccatcggcaaggctcagccggtcagcctgttcgtcgagaccttcggcaccgagaacgtgccggtcgagcggatcgagaaggccatcaacgaggtcttcgacctgcgcccggccgcgatcatccgcgacctggacctgctgcgcccgatctaccagcagacggccgcctacggtcacttcgggcgggagctgcccgacctcaagtgggagagcaccgaccgcgcccaggacctgaagaacgccgcgtcctga

SEQ ID NO: 4799 - DNA, 2205 bp, Actinoplanes utahensis
atggcgaccaagagtgtgcgagcggatcgggagccggcagagcacctgccggtcgcccgggtgtgcgtcgacgtccagctgccgcacctggaccgcccgttcgactacctgatctccagcgccgacgacgccgccgcccagcccggggtgcgggtcaaggtgcgtttcgccggccagctggtcggcggcttcctgctgtcccgggctgaggcctccgagcatcagggcaagctggcctacctggaaaaggtcgtctccgccgagcgggtcctcgaccccgaggtggcccgggccgcgcgggcggtcgcggaccgttacgcgggcagcctcgccgacgtgctgcgcctcgccgtccccccacgccacgcccgggtggagtcccagcccgtccccggaaacgccggcgccggccgatccctcggcgagggcgacgggtcggttccggagggcggccggtcggtttcggagggcggcggcgggtcagtttcggagggcggccggtcggtttcggagggcggcgggtcggtttcggagggcggcgggtcggtttcggagggcggcgggtcggttgccggaggcggcggcgagtcgtcggtccgggaggccggcccggccgcaggcgctcgcccgccggctcccgatctcccggagcccgcgcccggcggctgggattcctatccgaccggtcccgcctttctggccgcgctgcgggcggggcgtcccgcgcgcgcggtctggtcggcgctgcccggggaggagtggccgctgcggatcgccgaggccgcggccgcgaccgtgcgcggtgggcgtggcgtcgtcatcgtcgtcgccgacggccgggatctcgaccggatggaccgggcgctcaccaccgccctcggaccggaccggcatgtcgcgctgaatgccgcgctgggccccgccgagcggtatcggcggttcctggccgccagccggcatcaggttccggtggtcgtcggcacccgggccgccatgtgggcgccggccgccgacctggggctggtggtgatctgggacgacggcgacgatctgcatgccgagccgcggtcgccctacccgcatgcccgggaggtgctgctgacccgcgcgcaactggccgggtgtgccgccctggtcggcgggttcgcgcgtaccggggaggggcagttgctcctggagaccggatgggccagggagatcgtcgccgagcgcggggtgctgcggcggcggcagccggcgatctcgccgaccggggacgatccgcagctggcccgggacgccggtgcggtgaccgcccggctgcccagcgtggcgtggcaggcggccaagcaggccctgcaggccggggcgccggtgctggtccaggtgccgcgccggggctacctgccgtcggtggcctgcgccgagtgccgcaccccggcgcggtgcccggagtgctccggtccactggccctgcacgccgcccgggacgtgccgttctgccggtggtgcgggcggaatttcccggcctacgagtgcccggcgtgcggcgagcggcggctgcgcgcctcggtggtcggggccaagcggaccgcggaggagctggggcgggcgtttccgggtgtgccggtgcgcacgtccggccgcgacgagatcttgaacacggtgccgggcaccccggccgtggtggtggccactcccgggtcggagccggtggccgacggggggtacggcgcggtgctgctgctggactcctgggcgctgctgagccgggccgatctgcgggccgccgaggagaccatgcgccgctggctgaacgcgtcggcgctggcccggtccggctcggccggtggccgggtgatcgtggtggcggacggttcgctggcccccgtgcaggctctgctgcgctgggatccgggctggttcgccgcccgtgagctggccgaacgccgcgagctcggctttccgccggcggcccggatggcgtcggtgaccggtcccgccccggcggtggccgagctgctgagcatcgccgacctgccggacgggacggagcagctgggcccggtcccggcccgggaggagcaggagcggatgctgctgcgggtgtcccggtcccgggcggccgggctggcgcacgccctgcacgtggcggccggggtgcgcagcgcgcgcaaagcggcggtcccggtgcggatccaggtggacccggccgacctcttctga

SEQ ID NO: 4800 - DNA, 558 bp, Actinoplanes utahensis
gtgaccgtccagcccatccgtctcttcggcgacccggtgctgcgcactgcggccgacccggtcgtcgacttcgacaaggaactgcgcaagctggtcaaggatctgaccgacacgatgctcgacgagggcggcgccgggctggccgccccgcagctcggggtcgggctgcgcgtgttcaccttcgacgtggacgacgtggtcgggcacatcgtcaatccggtgctgtccttccctgacgaacaggagcaggacggtccggagggctgcctgtcgattccgggcgtctacatcgacaccaagcgccggcagaacgtggtggccaacggcttcaccgagtacggcgacccggtgcaggtggtcggcaccgggctgatggcgcgctgcgtgcagcacgagaccgaccacctggacggggtgctgttcctggaccggctggacgcggccgcccgcaaggacgcgatgaagcagatccgctccgcggagtggtacgacgcggccaagccgccgatgatcaaggagagcccgcacggccggggcatcttcggcgtggggcggtga

SEQ ID NO: 4801 - DNA, 927 bp, Actinoplanes utahensis
atgcgtctggtcttcgccggtacgccggaggtggcgctgcccagcctggaggcgatcgccgcgtccgggcacgagctgctggccgtggtcacccggccggacgccccggcgggccgcggccgtcgcctggtccgctcgccggccggcgcgtgggccgacgagcacggcatcgaggtgctcaccccggagcggccgcgcgagcccgagttccaggcccggctgcgggagctggcgcccgactgtgtgcccgtcgtggcgtacggcgcgctggttccgccctcggccctggagattccgaaacacggctggatgaacctgcacttctcgctgctgcccgcctggcggggcgcggcccccgtgcagcacgccgtcctgcacggcgacgaggtgaccggggcgagcgtcttcgagctggaggcggggctggacaccggcccggtctacggcaccgtcaccgaccagatccggttcaacgacacctccggtgacctgctgacccggctcgcgcacgagggcgccgggctgctggtcgcggtcctcgacgcgatcgggtcgggcaccgcccgggcgcatccgcagccgcgcgacggggtcagcctggcccccaaactgaccgccgacgacgcgcgggtccggtggaccgacccggcgttcgcggtcgaccggcggatccgggcgtgcacgccggcgccgggcgcgtggacgacgctacgcgacgaccggctgaagctgggcccggtccggccgatcgcgaacgcaccgcatctgcagccgggggagctgcgggtggagcgcacccaggtgctggccggcacggcgacgacgccggtgcagctgggtgaggtccgcgcggccggcaagaagccgatgccggccaccgactgggcgcgcggtctgcgtctcgaaccaggggagaagctggcatga

SEQ ID NO: 4802 - DNA, 1470 bp, Actinoplanes utahensis
gtgacggaacatcgggcttcccgcccgcacggcgccggcccccgccggccggccgggcccggacacccgcgcgatcagcgcagcggccgggctccgcgggccgggcggccgccgtccgacccggcgcgccaggcggcctatgaggcggtcgccgccgtgcaccgcgacgacgcgtacgccaacctggtcctcggcgagatcctcggcggtatgggcctgcacgggcgggacgcggcgttcgccaccgagctgacctacggcacgctgcgcgccctcggcactctcgatctgatcatcgcctcggcggccggccgtgaggtcgcccggatcgacccgccggcccgcgacgcgctgcgcctcggggcgtatcagctgctctacacccgggtgccgacgcacgccgcggtcaaccagacggtcgacctggtgcgctcggtggcgcccggcgcgtccgggttcgccaacgcggtgatgcggacgatctccgagacgccgctggagacctggctggagcggctcgcgccgaactacgccgacgacccggtcgccaacctgtcggtgctgcaccaccatccgcagtggatcgtgcgggcgttcgccgaggcgctgggcggcgacctggaggagaccgcccggctgctgatcgaggacaaccagccgccggccgtgcacctgtgcgcgcgcccgggccgggccgacgcggtggagctggccgacgaggtcaacggtgtgccgggagccttctcgccgtacgcggtctatctcaacggtggcgctccgcgcgacctggccgccatccgtgagggccgtgcgcacgtgcaggacgagggctcgcaactggtcgcggcggcgctgctggccgccccggtcgagggccgggacacccgctggctggacctgtgcgccggcccgggcggcaagaccggcctgatcggcgcgatcgcggccggccggggcgccgaggtgaccgcggtcgaggtggccgagcaccgggcccggctggtcgagcaggccaccgaggggatgccggtgacggtcttcccgatggacgggcggtccgtgggccgtgatccggacctgccggaggaggcgttcgaccgggtgctggtcgacgcgccgtgcaccggcctggggtcgttgcgccgccgccccgagtcgcgctggcgccgccagccggccgacctgccgccgctcacccggctgcagcgggagctgctggtggccgcgctgcgcgcggttcgcccgggcggcgtggtcgcctacgtgacgtgctccccgcacatggtggagacccaggtgacggtcagcgagggggcccggcgcagcggcgtcgaggtggacttcgtcgacgcccggccgctgctgccgccgggcatgccgggtctgggcgccgggccgacggtgcagttgtggccgcaccggcacggcaccgacgcgatgttcctggcggtcctgcgccgcaccgcctga

SEQ ID NO: 4803 - DNA, 681 bp, Actinoplanes utahensis
gtgacgtcatcgccgatcatcgcgccgagcatcctcgcctccgacttctcccgcctcgccgaggaagtgcacgccatcgagggggcggccgactgggcgcacgtggatgtcatggacaaccacttcgtgccgaacctgacgatcggcctgccggtggtccaggggctgcgcaaggcgacgacgatcccgttcgacgtgcacctgatgatcaccgacccggagcgctgggcccccggctacgccgaggccggggcctacaacgtgacgttccacgccgaggcctgcgacgacccggtcggcctggccaagacgctgcgcgcggccggcgccaaggccggcctggccatcgaccgggacaccccggtggagccctacctggagctcctgccccatctggacaccgtcctgatcatgacgatcaaggccggcttcggcgggcagaaattccttcccgagatgctcgacaaggtgcgtgacgtccggcgccgcgtctcccggggcaacctggacgtgcgcatcgaggtggacggcgggatcgcggccgacaccatcgagcaggccgccgaggccggcgccgacgcgttcgtggcgggcaccgccgtctatggggctgccgatcccgccgaggcggtgcgtaagcttcgggcactggccgccgatcgcatggggatctcgaggtga

SEQ ID NO: 4804 - DNA, 1008 bp, Actinoplanes utahensis
gtgagtaccgctgagccggggcccgtggtcgacgacttcgggctcgacgatgaagagcagcgacccgatctcatcctggtcgtcgacgacgaccaggacatcgcgagtttcgtcgagttcaacctccggatgcagggcttcgaggtgatccgcgcgcgcgacgggcaggaagcgctcgacctgatggagacgcaccgtcccgacctggcgatcgtcgactggatgatgccccggatggacggtgtcgagctgatccgcgcgctgcgcgccgacccgctcacctcggccctgccggtgatcatgctgaccgcccgcagcatgacggtggacaaggtggtcggcctgaccaccggcgccgacgactacctgaccaagccgttcgacaccgccgagctgatcgcccgggtctccaccacgctgcgccgcaacaaggagttccgcgaggtctccccgctgaccggcctgcccggcaacgcccgggtccgccgcgagatcatcgaccggatgcgggccggcggcgactactcggtcggctacatcgacgtcgatcgcttcaagagcgtcaacgacgtgtacggtttcgaccgcggcgacgagttcatcaccgccctggcgcgcagtctgcagcgggccagcgccgccaccggcaagccgtcgatcttcctgggtcacatcggcggcgacgacttcgtcttcatctgccaccccgaccaggtgctccccctgacgaagaacatggtgaccgacttcgagtccgccgccgaccgtctctacgacccgagggacgcccagcgcggctacatcgaggtccccgaccgccgcggcaacaagcaccgcgccgcgctggtcaccctgtcgatcggcgtcgcgcaggccacatcgggcggccgccagttcgctgacccgcggatggtgatcgcggtcgcctcggagatgaagaaggtggcgaagtcccagccgggctcgtatgtcgcgatcgaccgccgccgctccgacgccgaggactga

SEQ ID NO: 4805 - DNA, 678 bp, Actinoplanes utahensis
atgcccgcaacgccgccccgcaaccgttcgaaacccggaatgccgcccctctaccgcgccgcccgcggcagcctcggcctgctcctgcgcggcctgtggccgaccaccgtcaccggcctggaaaatctgccatcctccggcgcgatcctctgcgccaaccaccacgccatcgccgaccagatcttcctcggcgtcaccaccccccggcacatcgccttctgggccaaagccgaatacttccgcggcaacccgctcacccgccacgtggtcaccggcatgggcgccattccggtcgaacgcgccggcggccgcgcggtcctgaccgccttcgacgccgccatcccgattctcaaggccggcggcctggtcgccgtcttcccggagggcacccgctcccccgacggccgcctctaccgcggccgcaccggcgccgtccgcctggccggccaggccggcgtccccatcgtcccggtcggcatcctcggcaccgaccgcatccgccccaccggccgccacctcccgcgtccgcagccgatcaccctgaccttcggccccgccatcgaaatccgggtcaactcggcccgcgatgcccgccgcctcaccgaccgggtcatcgccgccatccaatccctgaccggccaggaatacgtccccacatacgccccggcacgccgctga

SEQ ID NO: 4806 - DNA, 597 bp, Actinoplanes utahensis
atgcccgctgacgacgccttacgcgaccgcctggtccgagtcggcgcggagttgttgcgcacggaaggtccaggcaccctctcactgcgtgagatagcccgccgcgccggcgtctcgcacggcgcaccgcgccgctacttccccacccacctgtcgctgctgtccgcgatcgcccacgtcggcttcgccgacctgaaaacccaggtgcaggcggcactcgaggcggccggtccggatccgcgccgccggttggccacactggcgaggttgtacgttcgtttcgccgccaccgatcgcgccatgttcgacctgatgttccgccacgacctgctgcagagtggcggcgagctgggcctgcggcacgccgcgctccccctgttcacccttctggtggagctggtcaccgcggtccaccccaccccggacccacccgccgagatcaccgcggccgccctctggtccgccctgcacggcctggccgagctctcgaactggggctcgctcaccctggccaccggcgaaaccgatcccgcctcggtgatcgacgccatcctcaccgcacatctaggcccacgtcgcaccacggaaggcgcttga

SEQ ID NO: 4807 - DNA, 1182 bp, Actinoplanes utahensis
atggacgtcgacgcactccgggccggcactccgggctgccgccaccggattcatctgaacaacgcgggcgccgcgctgatgtcgcaggcgacgctggacaccgtggtcgcacacctgcggctggaggccgagatcggcgggtacgaggcggccggcgcggtcgccgaccgggtcgccgcggtctacgccggtctcgccgagctgctcggcgggcgggccgacgagatcgcgctgttcgacaatgcgacgcacgcctggcaggcggcgttccacgcggtgccgctgaaggccggcgaccgggtgctgaccgggcgcaacgagtacggcagcaacgtgctgggctacctgcaggcggcccggcgggtcggcgccgagatcgtcgtggtgccgaacgacgagcacgggcagatcgacacggtcgcgctcgccgggctgatcgacgagcgggcgaaagtgatcggcctgacccacgtgccgacggccggtggtctggtcaatccggccgccgaggtggggcggatcgcacgggccgcgggggtgccctatctgctggacgcgacgcagtcggtgggccagttcccggtcgacgtcaccgagatcggatgcgacttcctgtgcggtacggggcgcaaattcctgcgcgggccgcgcggcaccgggttcctctgggtccgcgacggcatccttgagcagctcgaaccgcacgtggtggagatccagtcggcggactgggacggcgcgcggggcttcggctgggtgcccggggcgcagcggttcgccacctgggagctgaactacgcggcggtgctcggtctgggcgcggcggtcgaccaggcgctcaatctggggctcggcgagatcggcaagcgcaacgcggagctcggcgaccggatgcgcgggctgctggaggacactcccggcgtgaccgtttatgacctcggtcgcgagcggtgcgcgatcgtcaccgcggaggtggccggggtgggcgccgagcaggtggtggcgcggctcgccgagtccggggtgaacgtgacctcgaccgtgccggcgcaccagcagttcgacaccgaggaccgcgatccgccgccgctggtccgcttctcgccgcactactacaacaccgaggacgaggtcgagcacgcggcgaccctggtcagcgccatggtcaccaagccgttgtga

SEQ ID NO: 4808 - DNA, 1056 bp, Actinoplanes utahensis
atggtgaccgaggacgaggcgatgcgccgcgcgattgcgctggccgcccggggcctcggcacgaccagccccaacccggtggtcggctgcctgctgctcgacgccgccggcgaggtggtcggcgagggcttccacgcgtacgccggcggcccgcacgccgagatcgtcgcgctggcccaggccggcgagcgggcccgcggcggcacctgcgtggtgaccctggagccgtgcaaccacaccggccgcaccggcccgtgctcggacgcgctgctgcaggccggcctgcgccgcgtggtgatcgccgtcgacgatccgaacccggtcgcctcggggggcgccgccaccctgcgcgcggccggtgtccaggtggagaccggggtccgccgcgccgaggcggagctcggcaatctcgcctggctgaccgcggtgcgccgcggccggccgttcgtcacctggaagttcgccgccaccctggacgggcgctcggccgccgccgacggcaccagccagtgggtgagttccgccgagtcccggttcgacgtgcacctgctgcgcagcaccgtcgacgcgatcgtggccggggtcggcaccgtgctcgccgacgacccgcagctgaccgtccgcgatctgcgggacggctcgctcgccatcagacagccgctgcgcgtcgtcgtcgactcgcaccggcgaacgccggagaacgcccgggtccgggacgcggcggcacccacctggatcgtcaccgccgacgaggtcggcgccgggccggacggccgcgtcgacctgaccgccgtgctcaccggcctgtacgaccgcggcatccgcaacgtgctgctggagggcggcccgacactggccggcgcgttcctggcggccggtctggtcgaccgggtgatcggctacgtcgcgccgaaactgctcggcgccggccgggccgccctggtcgacgccggcgtcggcaccatcgccgacgcgctcgaactggacttcaccgacatcgcgcagatcgggggcgacctgcgcttcaccgccacgctccgccacaaggagaactga

SEQ ID NO: 4809 - DNA, 1209 bp, Actinoplanes utahensis
atgtctgagagcatcgagcgcgcgatcgccgagatcagggccggccggccggtgatcgtggtggacgacgaggaccgggagaacgagggcgacctcatcttcgcggccgagcatgccaccccggagctggtcgcgttcatggtccgctacacctccgggtacatctgcgtggcgatcaccgagtcggacgccgaccggctggagctgccgccgatgtaccacaccaaccaggacaagaagggtacggcgtacgcggtggccgtcgacgcccggcacggcgtcagcaccggcatctcggccgccgaccgggcccgtacgatcagcctgctcggggcggcgagcaccgagccgtccgacctctcccggcccggccacgtcgtcccgctgcgggccaaggcgggcggcgtgctgcgccggccggggcacaccgaggcgtcgatcgacctggccgtgctggccggctgcaccccggccggcgcgctctgcgagatggtcaacgacgacggcaccatgcagcggatgcccgacctggagaagttcgcggccgagcacgacctggtcctggtcaccatcgccgacctggtcgcctacctgcgggagcgggcggaccggaagatcgagcgggtggtcgagacggtgctgccgaccgagcacggcgtgttcaccgcggtcggctaccgcacccaggcggacaacggcgagcacgtggcgctggtctacggcgacctgtccgacggtgaggacgtgctggtccgggtgcactccgagtgcctgaccggggacgtgttcggctcccggcgctgcgactgcggcccgcagctggacgccgccctggagcgggtggcggcggccgggcgcggggtggtcctctacatgcgcgggcacgagggccggggcatcgggctgttgcacaagctgcaggcgtaccagctgcaggaccgcggtttcgacacggtcgacgcgaacctggagctcggtctgccggccgatgcccgggactacggcacgggcgcgcagatcctgtgcgacctgggcgtgcgatcgatgcgcctgctcaccaacaacccggccaagcgggccggcctggagggctacggcctgcgggtcatcggccgcgaggaactgccggtccggctgcacccggagaacgtgcggtacctgcgcaccaagcgggaccggatgggccacctgttcgaggcgttgggctga

SEQ ID NO: 4810 - DNA, 477 bp, Actinoplanes utahensis
atggccggcttcggtgatccgcacatgcagaccgtcgacgcggccgggctgcggctcggcatcgtcggctcgcgctggcacaacgacctggtcgaccacatgatcgaccgggcccggtcggccgccgaggcctgcggggtgaccgaggtgatcgtgacccgggtggccggctcggtggagctgccggtcgtcgcgcaggcactggccaagcgctgcgacgcggtggtcgccctcggggtggtgatcaagggcgagacccagcatttcgagtacgtctgtgacgccgtcacggccgggctgacccgggtggccctggacgagcagaccccggtggcacacggtgtgctgaccgtgcacagcctcgggcaggcccgcgaccgggccgggctggaggactcgatcgaggacaaggggtggcagagcacggtggccgtcctggacgccgcgctcgccatccgcgaggtggagaagttctga

SEQ ID NO: 4811 - DNA, 741 bp, Actinoplanes utahensis
gtggtgctctcctgcagaaacgtgcgcaaggtgttcgacgggcggaccgtcctcgacgacctcagcctggacgtcggcgagcacgaggtggtggccctgatcggcgcctccggctcgggcaagtcgacgctgctgcgctgcgtcaacctgctcaccgagatcgacgacggcacgatcggcctggacggcgaggagatcaccgacccgcggatcgacccggacctggtgcgccgcaggatcgggctggtgttccagtcgttcaacctgttcccgcacatgaccgtgctgcagaacatcaccctggccccgacccgggtgcacggccggccggccgccgaggcccgggcccaggcactggagtggctggagcgggtcgggctggccgacaaggcgggcagttatccggaccggctctccggcggccagcagcagcgggtggcgatcgtccgggccctggtcaacagcccgcggctgctgctgctcgacgaggtcacctcggcgctcgacccggaactggtcggcgaggtgctcaccatgatccgtgacctcaagggcgagggcatgaccatggtcctggccacccatgagatgggtttcgccaagcaggtcgccgatcgggtggccttcctggacgccggccgggtcctcgaacaggggccgccggagcaggtgctcggcgaccccgtcgaggcacggaccaggcagttcctggcccggatcatcgaagccggtcggctctag

SEQ ID NO: 4812 - DNA, 1407 bp, Actinoplanes utahensis
gtggacgtcggtgacgttcaccaacgcgatcgcgcccgggcccaagaagttcgacttcgacatcaaccagttctccatcaccgacgagcgccggcaggcggtcgacttctcctcgccgtactacctcgtgcggcagaccgtgatcacgacgaagaagtcgaagatcgcgggcgccaagtccctggccgacctggccggcgccaagctgggtgcccaggtgggcaccaccagctaccaggcgatcaccgacgtgatcaagccgaccgccaagccgtcggtcttcaacagcaacgacgacgccaaggcggcgctggtcaacggcaccgtcgacggcatcgtggtggacctgccgaccgcgttctacatgaccggcgccgagctcaaggacggcgtcatcatcggccagctcccgcaggtcggcgtgcccgagcagttcggcctggtgctcgacaagggatccaagctgaccggctgcgtcagcaaggtggtcgaccagctgcgccaggacggcaccctcgcggtgctggagaagacctggctctccgacggcggagcgcccgaactccagtgacctacgcaccgagtcagcggcagcgtgagcggttcgcctaccgtcgccggcaggcgatccgctcggtcctgctcgccgccctctccaccgccgtggccgggacgctgctcggcgtcgcgatcaccggctcgcccggctggccccgggtcaagcagtcgttcttcgaccccgaggtggcccgcaagtacctgccggacatcctgaccgggctctggctcaacctgaagctgctctcggtgtgcgcggtcctcgcactgctgctggggctgctgatcgcgatcctgcggaccacccgcggtgcggtgttcttcccggtgcgcgccctggccaccggatatacgtacgcgctccgcggcctgccgctgatcatcgtgctgtacctgttcgcgttcggcatccccggcctgcgcctgcgcggcacgccggacgtgctggtgctgggcgccgcagcgatcatcgtcacctacggggcgtacctggccgaggtgttccgggccggcatcgagtcggtgcaccccagccaggtcgccgcggcccgctcgctggggctcggctatcgccggacgatgcggcacgtggtgctcccgcaggcggtccgccgggtcaccccgccgctgctcaacgacatcgtcgcgctgcagaaggacgtcgggctgatctcgctggccgggccgatcgacgcgatccgggccgcccagatcggcaccgccgagtcggccaacttcaccccgtacgtcgtggccggggtgctcttcgtcctgctcgccctgccgctgatcgcggtcaccgactgggtgacgctgcgcgccgcccgccgccagaacgcggggtcctga

SEQ ID NO: 4813 - DNA, 264 bp, Actinoplanes utahensis
gtgaagacgttcgaagaactgttcgccgagttgcagcgcaaggcggcggagcagacccccggttcgggcacggtcgccgcgctcgaacgcggagtccacttcatcgggaagaaggtcgtcgaggaggcggccgagtcctggatggccgccgagcacgagggcaaggaccggaccgcggaggagctttcgcagctgttctaccaggcacaagtcctgatgatcgccagtggtctcaccctcgaggacgtgtaccgacatctctga

SEQ ID NO: 4814 - DNA, 843 bp, Actinoplanes utahensis
atgctgcgcatcgccattccgaacaaggggaccctgtccgcgccggccagccagatgctgagggacgcgggctaccgtcagcgcaccgacccgaaggacctcgtctgccgtgacgaggccaacaatgtcgagttcttctacctgcggccgcgcgacatcgcgacctacgtcggctcgggtgacctggatctcggcatcaccggccgggatctgctcgtcgactccggcgtgccggccaccgagctgctcgacctgaacttcggcggcgccacgttccgctgggccgccccggccggcacgctgacctcggtggaccagatcggcggcaagcggatcgccaccgccttccccggcctggtcggcgcctacctggtcgagcacgagctgaaggccgaggtggtccgcctggacggcgcggtcgagaacgcggtccggctcggggtcgccgacctgatcgccgacgtggtggagaccggcgccacactgcgccaggccggcctggtcacgctcggcgagccgctgatccgctcgtcggccgtgctgatcggccgcgacgtccaggccccggccggcgccgcgcagctgctgcgccggctcaacggcgtgctggtcgcccgcaacttcgtgatgctcgcctacgacgtgcgggccgacctgctggagcaggccaccggcctgaccccggggatcgagtcgccgaccgtctccccgctgcaccgggagggctgggtcgccgtgcaggcgatggtccagcgcagccaggtgcaccgggtgatggatgagctgtacgacctcggcgcacgtgccattctggtgaccgacatcgccaactgcaggttgtga

SEQ ID NO: 4815 - DNA, 459 bp, Actinoplanes utahensis
atgactgacgtggttttccggccgagaaggatccgctgggtggccggcccgatcgcggccgccgtcgcgatcttcttcaccgtgctcagcttcggtctgcacggccagggtggtttcgaccactccgggcaggtcggggtgggcagcttccagcgcggcgaccaggtcgcgatgatcgggctgggcatcctgctcgggctcggcatcctgaccttctgccggccccgggtggccgccgacgagcagggcgtgcacgtgcgcaacgtggtgggcggttacgacctgccgtgggacgtggtgcgcgcggtccggttcgaccggaactcgccgtgggcgcagctggagctcttcgacgacgagcaggtgtcgatccacgcgctgcaggcggtggacaaggactacgcggtggacggggtgcgcgcgctgcgggccctgcattcggcctctcacaaggcctga

SEQ ID NO: 4816 - DNA, 615 bp, Actinoplanes utahensis
gtgaacgaacagatccgggctcgagaggtccgtctggtcggtccggagggtgagcaggtcggcatcgtgccggtcgagcgtgcgctccaactggccgcggatgtcgatctggacctggtcgaggttgctccgatggcccggccgccggtgtgcaagctcatggacttcggcaagttcaagtacgagagcgcactgaaggcccgcgaagcgcggcgcaaccagcagcagaccgtcatcaaggaaatgaagcttcggccgaagatcgacccgcacgactacgagaccaaaaagggtcacgtggtgcggttcctcaaggcgggcgacaaggtcaaggtgacgatcatgttccgcggtcgtgagcagagccggcccgaactgggcttccggctgctccgtcggctcagcgaggagatctccgagctgggcttcgtggaggccagtccgaagcaggacggtcgaaacatgatcatggtgctggcaccgcaccgggccaccaaggccgcggcggtcgccgccaccgcggccggagtcaagcctgcccgtgagccgcgcgaggacgacggcaccgaggttccgtcggccgagactgccgacagcacagcagcagcagagtag

SEQ ID NO: 4817 - DNA, 195 bp, Actinoplanes utahensis
gtgccgaagatgaagagccacaccggcatgggtaagcgggtgaaggtcaccggcaagggcaagatcgtgcgtgagctgaccggcaagcgccacctgctcgagcacaagtcctcccacgttacccgccggatgaccggcactgtcgtggtggcgaaggtcgacgtcccgcgagtgaagaagcttctgggccgctga

SEQ ID NO: 4818 - DNA, 393 bp, Actinoplanes utahensis
atggcacgcgtcaagcgggcggtaaacgcccagaagaagcgccgcaccctgctcgagaccgcgagcggctaccgcggtcagcgctcccgcctgtaccgcaaggccaaggagcaggtgctgcactcgatgcagtactcgtaccgtgaccgccgtgaccgcaagggcgacttccgccagctgtggatcacccgcatcaacgcggcggcccgggccaacggcatgacctacaaccgcctcatccagggcctgaagctggccgaggtggaggtcgaccgcaagatcctggccgacctcgcggtcaacgacgccaccgcgttcgcggccatcgtcgaggtcgcccgcgcggccgtcgcggccgagggcaccggcggcgccgccgcccaggctgcctga

SEQ ID NO: 4819 - DNA, 774 bp, Actinoplanes utahensis
atgtacacgccgcgtacgccccgaatcgtgtcggcccgccgcctgcagcgccgccgggaccgcgacgccgccgggcggttcctcgccgagggcccgcaggccgtccgcgaggcgctggccgccggcgccgtgctggagctgttcggcaccccggccgggctggaccggcacgccgaactggccgcccaggcccccgaggtctccccggtcaccgacgacgctctggcggcgctggccgagacggtgcagccgcagggcctggtcgcgctctgcgagcaggtcgacgtgccgatcggcgaggcgctcgccaagggcccgcagctggtcgcggtgctcgccgagatccgggacccgggcaacgccggcaccatcctgcgcaccgccgacgccgccggggcgggcacggtgatcttcgcaggggatgccgtcgacccgtacaacggcaagtgtgtccgtgcctcggccggctcgctgttccacgtcgacgtggtccgcgccccgctcgacgtgctcgacctgctgcaggattccggcctgcaggtgctcgccaccagcggcaccggctcggacgacgtggactcgctgctcgacggcgggctgctggccgcgccgaccgcgtggctgttcggctcggaggcgcacggcctgcccggtgagctgctcgacgcggccgaccgacgggtgcgggtgccgatctacggcggggcggagagcctcaacctggccgccgcggccgccgtctgcctgtatgcgagtgctcgcgcccaacgctga

SEQ ID NO: 4820 - DNA, 1062 bp, Actinoplanes utahensis
atgtcctaccgtaacgatccgtacgatccgaagcaggccgccctgctcgacccgtcggctctcgaagaatcgatcaaggccgccgacgccgccttcgccgacgccgcgtcgctcgacgacctgcgggcgctgaagccggcgcacctcggcgaccgctcgccggtgtcgctggcccgccgggagatcgggtcgctgccgccggccgcgaaatccgacgccggcaagcgggtcaacgaggcccggcaggcgatccaggcggcgtacgagtcgcgcgaggccgagctggaagccgaccgcgccgcccggatcctcgtcgaggagcgggtcgacgtcaccctgccgtggaaccggcgcccgcgcggcgcccggcacccgctgaccacgctgatggagaccatgggggacatgttcctcggcatgggctacgacatcgtcgacggtccccagctggagctggagtgggccaacttcgacgcgctcaacatcggcccggacaacccggtgcgcggcgcctccgacacgttcttcgtcgacctgcccggcctggtgatgcgcacccacacgtcgcccgggcaggtgcgcaccatgctcacccgcaccccgccgatctacgtggtcagcccgggccgggcataccggaccgacgagctggacgccacccacaccccggtcttccaccagatcgagggcctggtcatcgacgagggcatcaccatggcccacctgcgcggcaccctggaccacttcgcccgggcgatgttcggcccggacgcgcggacccgctggcggccgcactacttcccgttcaccgagccctccgccgagttcgacgtctggttcgcccagcaccgggacggcccgcgctgggtcgagtggggcggctgcggcatggtcaaccccaaggtgctgaccgcctgcggcatcgacccggaccggtactccgggttcgccttcggcatgggtgtcgagcggaccctgatgttccgcaacggcgtcagcgacatgcacgacatggtcgagggcgacgtgcggttcaccacgaacttcggaatggagctctga

SEQ ID NO: 4821 - DNA, 2463 bp, Actinoplanes utahensis
gtgaagacgtcactgtcatggctgcgggaatacgtcgacctgccggccggcctcaccgccgagcggctcgacctggcgctgaacaccctcggcatggaggtcgagtccatcgtcgaccaggccgccaccgtccagggtgacctggtcgtcggccgggtcctcacgatcgaggagctgaccggtttcaagaagccgatccgcttctgcacggtcgacgtcggccgggacgcgccgcaggagatcgtctgcggcgcccgcaacttcgccgagggcgacctcgtcgtggtgatcctgcccggcggcgagctgcccggcgggttccggatcggggcgcgcaagacgtacgggcgcaactcgcacggcatgatctgctcggccgccgagctcggactctccggtgaccactcgggcatcatcgtgctgcccgcggggacgcccggtgccgacgcccggccggtggtcggactggacgacgtcctggtcgaggtggagatcaccccggaccggggatacgagatgagcgtccgcggcatcgcccgcgagctcgccacccatttcggggtggcctaccgcgacccggcggcgatcccggccgccgccgcgaccggcgactcgccgtggccggtcaccgtcgaggacaccgtcggctgcgaccggttctcggcgcgcgtcgtgcgcggcatcgacccgcaggcgcagtcccccgagtggatgcagcgccggctgatccaggccggtatccgggccatctcgctgccggtcgacatcaccaactacctgatgctggaattcggccagccgatgcacgtcttcgacctgcagcgactgcgcggcgggctgaccgtgcggcgtgcccgggccggcgagaagctcaccacgctggacggtgtcgcccggatcctcgacgccgaggacatggtgatctgcgacgagaccgggccgatctcgctggccgcggtgatgggcggcgagaccagcgagtggcagccgggcacggtcgacgtgctcctcgaagccgcgcactgggatccggtgatggtggggcgcaccgcccgccggcaccggctgttcagcgaggccgccaagcggtgggagcgcggcgtcgacccgcagctcaccctgcccgcgctggagcgcgcggtggcgatcctgctggagcacgccggcgggaccgccgacgagcggatcctcgacctcgaccacgtggccccgccggccgcgatccacctgccggccgagctcccgtcgaaggtcatcggcctgccctacccgccggaccggatcgccgagctgctcaccgcggccggctgcacggtcgccggcagcgacgtcgtcccgcccagctggcggcccgacctgcaggccccgatcgacctggtcgaggaggtggcccggctcggcggctaccacgacatcccgagtgtgctgccgccggccggggccagcaacgggctcacccccgggcagcgccgccgccgctcggtcggccgcgcgctcgccgagaacgggtacgtcgaggtgctgtcctacccgttcgtcgcgcccggcgccgcggaccagctcgggctgccggccgacgacccgcggcgcagcgcggtccggctcaccaacccgctgtccgaggaggagccgctgctgcgcaccaacctgctcggcccgctgctcggcacgctcaagcgcaacctgggccgcgggcaccgggacgtggcgctcttcgagaccggcacggtgttcctgccgcggctgaccgcggaggctccgccggtcctcggcgtcgaccggcggccggacgccgacgagtgggcgcgggccaacgcgatcgtccccgaccagccgtggcacctggccgcggtcctgaccggcgacgccgccccggccggctggtggggtgagggccgcccggcgagctgggcggacgccatcgaggccgcccgcatcgcgatcgccgccgccggggtgcccgccgcccgggtcggggtccgcgccgccgagcaggccccgtggcacccgggccgctgcgccgcgatcctggtcgacggcgaggtcgtcggccacgccggcgagctgcacccggccgtcgtctccgccctcgaactgccgaaacgcaccagcgcgatggagctttcgctggacgcgctgccggacgccccggtcgtcgacgccccgctgatctccacgttcccgccggcgctgatcgacgtggcactggtcctggaccgcacggtgccggccgacgaggtccgcgccgccctggccgagggcgcgggttcgctgctggaatcggtggcactgttcgacgtgtacgagtcggcgcagctcggcgaggggaagcggtcgctggcctacaagctgacgttccgcgcgccggaccggacgctgacctccgacgagacgatcgccgcccgcgacgccgcggtggcggtgacgacggcgcgcttcggcgcgaccctgcgcggcgcctga

SEQ ID NO: 4822 - DNA, 309 bp, Actinoplanes utahensis
atggtcgccgcaccggcctacggcgccttcttccgccacggcgccggaacgacgggcctgcacgagctcgcctggttcctgctcgccaccgccaccctgctgctgatcctgatcgtcgccgaccgctccctgtcccgcctcagcaccactgccgacgaaaaccacctcggcaccaccgacgaccagaaccgtcccgggatcgcagccggtactcacgtcggtgaggaggatcgtcctggttccaccgccgacacctccgccgacgaggaccgccggcgaagtacccacccgaaaggatcaccctcatga

SEQ ID NO: 4823 - DNA, 345 bp, Actinoplanes utahensis
atgcggcaggcctacgcgcaccacgcgaccctcgtcctcgacccgtcagccgacccccgggcacccggggcggcgatcacgctcgcactctgcggcgcccaccggcatgccgggccgtgcccggtggcaccgcaccacaccggcgccgaggcccgcgcggacggcctgcacctgcggatcctcttcgcggtcgcgccggaccgggtggacgcggtgcgggccgcgatcgacaccgcgttgagcggggggccgtggcggctggtggagtccggctgtgcgcggatcgatccggccgagcgggaccacgcgcggcgtctcctgaaaagtgtcggaccccgcggctag

SEQ ID NO: 4824 - DNA, 1377 bp, Actinoplanes utahensis
atggaaccgctcccgaccagaccgctgggctccctgtacccggacgccctgtggaccgccggcgaccccgcgctcccggtgctcgagccggacggcatccacccgctgctcggcgcggtcgcccgcgcgttcgccgatcaccgtccgctcaccctctcgccggacgccgtctggctgaccatcctggagggcgtcgcccgccacatccacctgaacgccgacgacctgcgcgaccgcctggtcggccatcagggccgtgatctgctgacggtcgtcgtgcgcggcgaaccggtctggcccgatgtggtggccaagctcgccgggatgctcccgtcccgcctcggcgcgagcgactgcgatttctccaccagcaccgaggtcgaccggatggccggtcgcgtggtgctgatggacgcctattcgccgtacttcgcctatcgggtttccgtcctctgcggcatcccgtcgatctctctgaccgggacggcggaggactggcggcggatccgcgcccgcgtcgacgtgctcgccggggcaggcctcggcctggagaagtggtgccgctcgctcgccccgatcgccgatcacttcgtccgggcggcggccggcgccgcggatccggaattctggaagcggatctacaatccgatcgacgcgtacggcggtgacaagtccaccggctggatcacgcgcctgtacccctacgtgggtgagtccggcagcccgaatccgctgctcgacctcccgctcggcgagccgcggaacgccaccgggccgggcgtctcgaccgatgcggtccgggccactctcgcccgcgtgcggatgctggtcgagaacgcgattaccggcgaacagaccacggtcgccctgcatgccggcctcaccgcggtggtccaggagccgggcggctcgttgcgcccgatctccggttgtcatctgacggcggccggccccgaactcgacgacgttctcgatcggctggaccacgagggcgagatggacccacccgggcatccggccctgctcgacctgcccgaggtggccgcgctgtatcgacgtttcggctccggggtcctgttcggcggcgcctggcggctgagggtgtccggcactttcgcggagttccaggccgactggtgggtggcgccggtcttcgatctggccgacggacggtcggtgtgcgtggtgaaacactgggagtccgcgtggagttactggatcgccgtgccctgggcgagcgacaggacgattgaggaccccgccgatgtccgggtctacgggacctcactggccgccctgctggagggcgccctggacaccggcggggatctcactcacctggacagcggttcgctgtctcagtacttggcgatgtag

SEQ ID NO: 4825 - DNA, 747 bp, Actinoplanes utahensis
atggatctgcgcattcagcgctccgtcgtcgccaatctgcgtaaccggccgcacgcggccgagtccgggccgttcgtgctcggcctggatcacggcaccgacagtccgcacatcaactacgccacgccggttcccggcgcgacgatcacccgggacgatgtcgcggcgctggtcaccgcattcggtggccgggcaccccggctggagtacgtcgtgagctgtgccccggagctcgaagacctcctgatcgaggccggcttcgcggtcgagtcccgcaacgagtacctgatctgcacaccggagacactggtgacggcgggcgccccggacgggttcgagatcctggaaccggcgaccgacgccgcgttgaccgggatgatctcggcacagaacgaggcgttcggcggctcgttcgaggccgcggccgattcggtggcccggtatcggcgcaaccggtcgctgggcgcggtgctggtcgccgcgtacaccaccggcggcgaggcggccggtggcggcacggcggtggcgccacacgacgggctcagcgaagtcggcgggatcgcggtccgccggcggtaccgccgccgggggctggccggggcgatcaccgcggcgatcgccgagcggctgttcgccggcggggccgacgtggcctggctggaggcctccggcgaggactcgtggcgggtctacgagcggatcggcttccggccggcgggtcagcggctctacatcgccaagtactga

SEQ ID NO: 4826 - DNA, 1356 bp, Actinoplanes utahensis
atgacgaaacggcgagtcctcctgtccgccgcgatggcggcgccgctggccggaccggccaccggggcacaccggcggccgccggacgccgagctgcgggcgatcctgcgcgcgatcgacccggtccggatcgaggcgacggtgcggcggctcgccgccttcggcacccggcacacgctgtcgtcacagaccgatccggggcgcgggatcggcgcggcgcgggattggatccacgatcaattgcggtcgtacgcggaggccgccgacggccggatgaccgtcgaggccccgtcgttcacccagccggtctcaccgcgcgtgccgaccccgacggtcatcaccaacgtgatcgccaccctgcgcggcagcgtcagccccgagcggatctacgtggtcaccgggcactacgactcgcgggtgaccgacgttctggaccacaccagtgacgcgccgggcgccgacgacgacgcgtccggggtggccgtggtgctggaactggcccgggtgatggcccggcacagcccggaggcgaccatcgtcttcgccgcggtcgccggcgaggagcagggcctgtacggctccgaccacctggcccagtcgttccgggacgccggcgccgacatcgaggccatgttcagcaacgacatcgtcggcaccggcgacgcgcacgacggcagccggcccgagccgcacaccgtgcggctgttcgtcgagggcgtccccaccgcggagacccccgccgaggcgggtgtgcggcgcagcgtcggcggcgagaacgacgggccgtcccgccagctcggccgcttcgcccgcgaggtggcggcgaatccgcagaccggcatggacatccgggtggtctggcgccgcgaccgctacctgcgcggcagcgaccacgtctcgttcctgctgcgcggctacccggcggcccggttcaccgagcctcgggagaacttcgcccacgagcaccaggacgtccgggtcgtcgacggcgtgcagtacggcgacctggtggaattctgcgacttcgcgtacatcgcccgggtggcccgggtcaacgccgccaccctgtggagcctggcgaccgcacccggcaccccgaaggacgtggtgatcgacaccacccggctcaccaacgacaccaccctgcgctggaccctcggcaccgagcccgacctggccggatacgagatcgtctggcgggagaccaccgcaccggactggaccggcgcgcacgcggtcgggctggtcggcaccgccaccgtcgacatctccaaggacaacgtgcagttcggcgtccgcgcggtcgaccgcgacgggcaccgcagtccggccgctgcgccgaagccgtcggcctga

SEQ ID NO: 4827 - DNA, 558 bp, Actinoplanes utahensis
atgaccgcaccgcgccgctcggacggcacccgggccgcgatcctcacggcagcccgcgagcgcttcgccgccgacgggttcgagcgcgccaccatccgcgccatcgccgccgacgcgcggatcgacccgtccctggtgatgcgctactacggcaacaaggagaagctgttcgccgccgccgccgagttcgacctgcggctgcccgacctcaccgcggtgccgcccggcgagcacggccgcgccctggtcgcgcacttcttcacccgctggtccgaggatgagacgctgctcgccctgatccgggccggcgtcagccacgaggccgccgccggccggatgcgcgagatcttcgcggcccaggtcggcccgatcgccgcccgcctggcccccgacccggcctccgcacccacccgcgccgggctgatcgccacccagatcctgggcttcgccctgtgccgcttcgtgctgcgcctgcccccggtcaccgcgctcagcgaggccgaagcgatcgcctggctggccccggtcgtgcagcgctacctgcacgacaccatctga

SEQ ID NO: 4828 - DNA, 1371 bp, Actinoplanes utahensis
atgcacaccaccgtggcgatcgtcggcgccggccccaccggcctgctgctggccggcgacctggcccacgccggcgtcgacgtgaccgttttcgagcgccggtccggcacgtccaacctgacccgggcgttcggcgtgcacgcccgcaccctggaggtcctggacgcccgcggcctggccgacgagctgatcgcgaccggcgccaaggtcgcccggctgcgcctgttccagcagatccgggtcgacctgtccgagctgccgtcgcgctttccgttcctgctgatcaccccgcagtacaacgtcgagcgcctcctcgaggagcgcgcggtcaaggccggcgcgcggatcgtccgcggcgccgagctgaccggcctcgaccagggcacgctgaccttcggcacgcagaccgtgaccgccgactgggtggtcggcgccgacggcgtgcacagcgccgtccggcaggcggccggcctgccgtttcccgggcggtcggtgctcacctcgatcatgctggccgacgtgcggctggccaccccgccggacgatgtgctggcggtcaacgcggtcggtgacgcgttcgcgttcgtcgccccgttcggcgacggctggcaccggatcttcgcgtgggaccgccaccaccaggtctccgaccgcgagccgctcacgctcgacgaggtccgcgcggtgacccgacgggcgctgggcaccgacttcggcatcgtcgagagccgctggatgtcgcgcttccacagcgacgagcggcaggtccccagctaccgcgccggccgggtcctcctggccggcgacgcggcgcacgtccactcaccggccggcgggcagggcatgaacaccggcctgcaggacgccgcgaacctgtcctggaagctcgccgccaccgtccagggctgggcgccggccggcctgctcgacacctaccaggccgaacgccacccggtcggccggctggtgctgcgcagcagcggcgcgctgatccggctcgcgatgatccgctcggtggccggccgctggacccgcaacaccgccggatccgcgctgatggcactgccgccggtgatgcaccgcgccgccggcgtcctgtccggcgtcggcatcgactacccgcacgcgccacgcgccgccgaccaggaactccgcgacggcagccggctctacgagaggctgcgcgacggacggcacgtccttctcaccgacgatcgggtccccgccgattacgccgtacgcctgaatgtcgcaccgcctcgcgatccctccccggaagcgaccctgatccgccccgacggccacgtggcctggcacggccccgccacggacctccccggcgccctgcgcacccacctcggctccgtctga

SEQ ID NO: 4829 - DNA, 870 bp, Actinoplanes utahensis
gtgcacgaccagccgatcccagtgcgccagcccggcgcaggccaccacggtcgcgccgggacgctgccagatccgggcgccgtcggccgcggccgcccaccgtacgaagagatccacgcgaccatggtggcaggacgttcccggcacggatccggtaggcggccgcgggtgcccgcctgtcacagtgggcgcgtgctgaagctcccccggctgcgtcccgcctcgctgttcctcgtgggcgggctggccaccgccctctccgtcgcgctggtcgcggccagcaacctgtgggtccgcgaggagtccaccggccacgtctactcggtggccgacgtgccgagcgccccggtggcgctggtcctcggcgcccaggtggacccgcccggcgagccgtccgccttcctggccgcccggctggacctggcccgccggctctatcaggccggcaaggtgaaggcgatcctggtctccggcgaccacgccgactggtcgtacgacgaacccggcgcgatgctggtctggctggtcgcgcacggcgtcccggcggaccggatcgtgatggaccacgccggcttcgacacctacgactcgtgttcccgcgccggccggatcttcggcgtccggcaggcgatcgtggtcagccagtccttccacgtgccccgggcggtcgccctgtgccgctccctcggcatcgacgccaccggggtcggcgacgacacgcagcgcgccaacaagccgctgtgggcccgcggccaggcccgcgagtgggccgccgccgtcaaagccgcctgggacaccggcaccggtcgcgacccggtcttcctcggcccgcacgagtcgggcgtggacaccgcggtcgcccacggctga

SEQ ID NO: 4830 - DNA, 99 bp, Actinoplanes utahensis
atggcccgccgcgccgctcagagctgccgggccgcggccaccttgcggatggcgaagcccaatccggtgtacgtcgcgaccgccgccgtgttgtggtaa

SEQ ID NO: 4831 - DNA, 354 bp, Actinoplanes utahensis
atgaatgcagatgacattgccgacaagttgcagttcgaatggagcgcagacggcggattcctgtacgggctgcggtacgggcacttcgatccgcttgccgcagaacggttcctgagcgtcctgaattcagtcgacccggaggatccggctcgttttgagcctagagtggtgggcagattatggctcattccctactacatgctgtcgcacctgcataattccgaacgtcaaggcctggacatcagtgaacagcagagagtgatgttccgcgccaacgacgtcctggccgtgattttcggcggccgaggtggtacctcggccagtagcggtggtgccgagcaggccgtcagctag

SEQ ID NO: 4832 - DNA, 945 bp, Actinoplanes utahensis
atgtccaaggcagtcggcctcaagggcatcgacgcggtggagaacctcctccgcaacctcaaagacacccccctgataaaggggatcggcgacttcatcgagcgctgcttcaagcgcaacagcttcacccccgacacgcgggttctgctagcggacggcaccagcaaggccatcgccgacgtccgcatcggcgaccaggtgctggcgactgatgccaccacgggatacacctcagcggaacccgtcaccaacctgatcaccaatactgacaccacgttcactgatctgaccgttcaggtggctgatgggcagtcggctgttctgcacaccactacccatcacccattctggggctccgacaccaagtcctgggtggacgccgggcagctggcgcccgggtccgcgcttgctacgccgtacggtggtatcgccaaggttgccgctgttcgcagcttccagggcagccagcagatgcacaacctcaccgtcgcggcactgcatacgtattacgtgctggctggcgatgttccagttctcgtgcacaactgtggggtcgacgagccgattcccacagatttcgcgcccaacaccgtgtaccgagccgtccggaaggacgaggatccggccaagggtttgttcgccaggggcgatggtgacgtcgagccctggcagcacgttctgtcaagtcctagcgactccccgtggatctcgacgaccaaggatccggcggttgccttcggcaagtacatgaagaatggtctcggcgtggttaggatcgacctcaccaaggttccgagtgagatggttgatgctgccggaaatctgcgtgtgccgccgggctacgaatggatggaaatcggagagacggcattgcgcgaccgtgaattgttgattcgcggcactatcccggccgatgcgatcacgggatattggccggccggttag

SEQ ID NO: 4833 - DNA, 864 bp, Actinoplanes utahensis
ttggcggcgcggtcgaaggcggtcgcggatcttctagatctggcgcagcgggccaagcaggccgccgacgcgcagaagaagatcatcgaggcgagtgtcgcggcgacgaaggcgttgaccgatgcggcgaacgcgatggccttggcgaacaaggaggccaagcaagccgacgcgatctacgccgcggatgtgccgcggcgtcaggcaagccagccgacccataccgccgacctgtccgcgctgcgcggtcaggcgtgtcaggacgcgtcgatcgcggcgcaccagtcggatctggtgacagcgcagtcgggtgtcgcggcgacggcggcgcagacgttggagaagaccgggctgtcgcagggcatcgcgtggaccgaggtgacgcaggcgcaggctgacgcggggaccgctgcgaggctggccgccgagaccgcgtgctatgccgttactgcgaccgaggccgccggcaagacgctggacgccgatcacaacgcgacggttgatgcgaacaacgcggtcaagtatcggcaggcggcggagcgggagcaggccgccgcggagaagctggcggacaaggcggagaagctggcggctgccgcgcaggctgcggcggccgacgcgaaggcgcagcggctgcgggccgagaaggacgcggccagcgcccatgaacacgctgacaacgcggccgcttactaccgggacgcccgccggcagcgcgacatcgcccgggcggcgaccgcggcggcgattcagcattcgctgaacgcctactctgcggccaagcgggcgatcgatcagcagaacatcgtggttggtaagggagccgaggccaagcagaagcaggatgaggcgttggctagctag

SEQ ID NO: 4834 - DNA, 2247 bp, Actinoplanes utahensis
atgcccgcggaaaccccctacctcgaccctgcgctccccgtggagcagcgggtcgacgacctgctcagccgcatgacgctggccgagaagatcgggcagatgctgcagctggacgcccggcaggacctggccgagatcattcaggacaaactggccggttcgatcctgcacacctcgccggccaagctgatcgaggcgagcgagctgctgtcccgcacccggctgaaaattccgctgctcaccgcggaagactgcatccacggccactcgttctggccgggcgccacgatcttcccgagccagctggcgatggccgcctcgtgggacccggcgctgctggaacgggtcgcccgggccaccgcggtcgaggtctcggccaccggcatccaccagaccttctccccggtcctgtgcatcgcccgggatctgcgctggggtcggatcgacgagactttcggcgaggacccgctgctgatcgccgacctgggcgccgccatgatccgcggataccagggcaccggcctgaccgacccgaccggcatcctggccaccgccaagcacttcgcgggctattccgagacgcagggcggccgggacgccagcgaggccgacatcagccgccgcaagctgcgctcctggttcctgccgccgttcgagcgggccgccaaggagggctgccaggtcttcatgctcggctaccagtcgatggacggcgtgccgatcaccgccaacaaatggctgctcaacgacgtgctcaagggcgaatggggcttcaccggcacgctggtcaccgactgggacaacgtcggccggatggtctgggagcagaaggtctgcgccgactacgccgaggccgcggcactcgccgtgcaggccggcaacgacctggtgatgaccactcccggtttcttcgacggggcacaggaggcggtcgcgagaggcctcctgacggaggcggacatcgatgcggccgtacgccgtatcctgcgcctgaagttcgaactgggcctgttcgagaacccgcgcaccccggacgccgagcggatcggcgccgtgatcggctcgccggagcacaccgcgctcaacctggaggtggcccggcgctcgctggtgctgctgcgcaacgacggcacgctgccgatcgacccggccgcggccagccgccggatcgccgtgctcggcccgaacgccgacgacgtctccgcccagctcggcgactgggccggcaactccggtcaggtcggctggatgccggacggccacccgcgggagctgaccgccaccgtgctggacggcctgcgcgccaccgtgccggccggctgggagatcgtccacgagcgcggcgccgacatcgagcgactggtgccggacccggagggcgagacgttcccggacgggcagccccgcccgccgatctccgagtcggccccggtggacccggcccggatcgccgccgcggccgagctcgccgccggcgccgactacgcggtcgtggtggtcggcgacaccgtcaacctgaccggcgagggctgctccaccgccaccctcgacctgctcggcggccagatcgcgctgctcgacgcggtcgccgcgaccggcaccccgacgatcgtcgtgctgatcgactcgaagccgctggcgctgcccccgtccgcactcggtgcggccgcgatcgtgcaggcgttcaaccccggcatgcgcggcgggcaggcgatcgccgagctgctcctcggcctgatcgagccgagtggccggctgcccatctccgccgcccggcacgtcggccagcagccggtgtactacaaccagctgcgcggccagcacggcacccggtacgccgacctcacccaggacccgctgttcgccttcggcgagggcctgagctacaccacgatcacgtacgacggcctggccatcggcgagcccgaggtcccggccgacggcgtggtgcgggccaccgtccgactctccaacaccggcacccggccggccctggaaaccgtccaggcgtacgtgagcgacctggtcaccagcgtcacctgggcacaccgcgagctgaagggctaccgccaggtggtcgtcccggcgggcgagagcgtcaccgtggagatcgagatcccggccgccgactgcaccctggtcaccgccgacggtgaccgggtcgtcgagccgggcgacttcgagctgctggtcgggccgaactcgcgcccgtccgccctgcagtcggcgaaattccggatcagctag

SEQ ID NO: 4835 - DNA, 1182 bp, Actinoplanes utahensis
atgagttcggccgatcgagtgctgcggggagccgcggaagcgatcgaacacatctccggcatctgcttcaagaccggcccgccacgccatctcggcgtcgagctggaatggaccacacaccacgtggatgacccggccgtcccggtcccggccgcggacctgcgtgacgcgttgggggtgcacgcgccggccgccctcggcaatccgcaaccggtgccgctgcccggcggcggcacggtcaccgccgaacccggcggtcagttggagatctcgtcggcgccggccgatgcgctgcccgccctgcacgcggcggtcaccgccgaccacgccgccctggccgggatgctcgcccgggccggcctgcgcctcggcgaccggggcatcgacgagcaccgggaacccgcccggatcctggacacgccgcggtacgccgcgatggaacgctccttcgaccgcgctgggcgcaccatgatgaccggcaccgcgggactgcaggtctgcctcgacgccggggaggcccaccagatcgccggccggtgggcggcgctgcacgacttcgggccgccgctgctggcgctgttcgcgaattcggcggtgcacgccgggcgggacaccggctgggcgtcggcccggatggccgcctggtacggcatcgacccccggcgcgccggcccggccttccgggagtccggctccccggccgaggactgggcccggtacgcgctcgacgcgccactgctctgcgtgcggcgcgacgacgggcggtgggacgcgccgcccggggtgaccttcgccgactggatcaccgacggcacaccgaccgtgtccgatctggagtatcacctcagcaccctgttcccgccggtgcgcccgcgcggctacctggaggtgcgctacctcgacacccagccggggccggactggatcgccccggccgcggtgctgaccgcgctgatggccgacgacgtgatcaccgctcagggccgggagatcgcggcgccggtcgcggggcggtggcgggccgcggcacgggacgggctgcgggatccggcggtccgcgcggcggcggccggactggccgagctcgcctgccggcacttcgaccggacggggctggatgacgtcgtccgaaagcaggtttccgatgttgttgacgcgcgcctgaaggggaacgctcgatga

SEQ ID NO: 4836 - DNA, 1293 bp, Actinoplanes utahensis
atgatcaaccccgacaagaacctgatcgccgccgaattggagcgatcgcgggcccgcaccgccctgctgaccgacgcggtcgacgacgacgacctcgtcgcgcagcactcgccgctgatgtcgccgctggtctgggacctcgcgcacgtcggcaaccaggaggagctctggctggtccgggacgtcggcggccgcgagccggtgcgtcaggacatcgacgagttgtacgacgcgttccagcacgcccgcagcgaccgccccgccctgccgctgctcgacccggccgaggcgcgccgatacatcggccaggtgcgggacaaggcgctcgacgtgctcgaccgggtgcgcctggacgagcggccgctgctcgccggtggcttcgcgttcggcatgatcgtgcaacacgagcagcagcacgacgagaccatgctcgccacccaccagctgcgcggcggctcgccggtgctctccgccccgccgcccccgcccggggacgcccgggtgcgcggcgaggtgctgatccccggcggcccgttcaccatgggcaccgacaccgacccgtgggcgctggacaacgagcggccggcgcacaccgtcgaggtcccggcgttcctgatcgacgccaccccggtgtccaacagtgactacctcgccttcatcgacgccggcggctacgacgacccgcgctggtggtcggcgcggggctggacgcaccggcacgaggccgggctgaccgcgccgatgcactggctgcgcgacggtgacgcctggctctaccggcggttcggccggatcagcccgatcgccggcgacgagccggtggtgcacgtcgactacttcgaggccgaggcgtacgcggcctgggccgggaaacggctgcccaccgaggccgagtgggagaaggccgcccgctgggacccggcgaccggccgctcccgccgcttcccgtggggcgacgagccgcccggcccggaacacgccaacctcgggcagcggcatctcgcgccggcgccggccggggcgtatccggccggcgcgtcgccgctgggcgtgcaccagctgatcggcgatgtctgggaatggacatcgaccgactggcacggctatcccggattccgggtgttcccgtacgccgagtactccgaggtcttcttcggcggtgactacaaggtgctgcgcggcggctcgttcggcaccgacgcggccgcctgccgcggcacgttccgcaactgggaccacccgatccggcggcagatcttcagcggcttccggtgcgcgcgggagctcgtctga

SEQ ID NO: 4837 - DNA, 741 bp, Actinoplanes utahensis
atgtgccgccacctggcctacctcgggccgcccgagccactgtcggcgtgggtgttcgacccgccgcacgcgctgtcgcaccaggcctgggcaccacgtgacatgcgcggcgggggcaccatcaacgccgacgggttcggcgtggggtggtatccgcccgagggcgggccgccggtccggtatcgcagcgcgatgccgatctggagcgatccgacactgccccggctcgcggaggtgaccaggtcgggggcggtgctcgcggcggtccggtcggcgaccgaggggatgccggtgatcgcgacggcgacggcgccgctccaggacgggcggtggcttttcagccacaacggggtggtccgcggtttccccgggaccctcgccgacctggccgccgcgcttcccgtcgaggacctgctgaccctcgacgcgccgaccgatgcggccgccctgttcgctctggtacgccatgggctgcgcgccgggaagaccgcggaggaggcactcctgtccgtggtcaccgccgtgctgcgggtcgcgccggactcccggctgaacctgctgctgaccgatggtgatcggatcctggcgaccactgccgggcacgcgctcgccgtccgggcgaccggcgacgccgtgctggtcgcctccgagcccctcgacgaccaccccgcctggcggccgctcccggaccgccggctgttgatcgcgacccccgctgcggtggaattaggagagctgtga

SEQ ID NO: 4838 - DNA, 972 bp, Actinoplanes utahensis
gtgacttcgctggagaagcatctcgacgagcgtgacctggcccgatccctgcgcgccgacgtgcgcgacggcctgagcgccgacccgaaacggctgccgccgaaatggttctacgacgcccgcggcagccggctcttcgaggacatcacccggcttccggagtactacccgacccgcaccgaacgcgccatcctgagcgcggccgccgcggagatcgcccggctcaccgacgcgaaaaccctcgtcgaactcggctccggttcatcggagaagacccggctgctgctcgacgcgatgctggggcggggcacgctcggctccttcatcccgttcgacgtgtcccagagtgccctcgctgaggccgtcgacgcgctcagcgtcacctaccccggcctgagcatcaccggcgtggtcggcgacttcacccggcacctgcgccacctgcccgacggcgacagccgcctggtcgccttcctcggcggcacgatcggcaacctgatcccggccgagcgctccgccttcctcggcgacctgcgctccgtgctgcacgcgggtgagtggctgctgctcggcaccgatctggtcaaggaccctgccgtgctggtgcccgcctatgacgacgcggccggcgtcaccgcggagttcaaccggaacgtgctgcatgtcatcaaccgcgagctgcgggccgactttgagccactcgccttcgagcatgtggccgcctgggacccggatcgggaatggatcgagatgcggttgcggtcggtgcgggcgcagacggtgcggatcgaggatctggacctgaccgtctcgtatgcggcgggggaggagatgcggaccgagatctcggcgaagttccggcgggagcggcttgcggcggaactggcggcggcgggcttcgccctccgccattggtggtccgacccgcaggactggttcggcgtctccctggcccaggccgtcactgattga

SEQ ID NO: 4839 - DNA, 597 bp, Actinoplanes utahensis
atggccgacgttgaactgatcgtcaccgacgccgaggcgctgcgcgcatggctgaccgaccaccatgcgacctcacccggcgtgtggctggccctcaccaggaagggcggcacggccacgaccctgacgtggcagcaggcggtcgacgaagccctgtgcttcggctggatcgacggccaggcccgcaagggcgacgacgccctgtcctggatccgcttcaccccacgccggccccgcagcgcctggtcccagcgcaacgtcgcgaacgtcacccgcctggaggccgccggccggatgaccccggccggccgtgccgcggtcgaggcggcccaggccgacggccgctgggccgccgcctacgccccgccctcggaggccgaggtccccgacgacctggccgccgcgatcgccgccgacccggccgcccaggccatgttcgacgtgctgaccagaggcaaccgcttcgccctgatctaccgggtcaacgcggtgaaacgcccggagacccgggcccgcaagatcaccgagatcgtcgccatgctcgcccgccacgagaccttccacccccagaaggcgaaaccggcgccgcagccgtag

SEQ ID NO: 4840 - DNA, 354 bp, Actinoplanes utahensis
atgcgacatgatcagtgggacccgcgtggccctggcgggcgcctgctcaccgtcgcgacggtggcggcgatgacgctggcctgcctggtcctgagcggctgcacgttccaggatgcggagtgcagcgacggggagtatccggcggcgcaggtggacggcccgggaagctactgcgtccccgatggacaggagcccgatccgggattcgtccgttacccggccggcagagtgccccggcacgtcggggacgaatgggatgtctactggcagtcgcatcggctcgacgcacagggcaacgagatcccggacggtccacggccggcggtgagtgtcgcggtctcgccgtcccgctga

SEQ ID NO: 4841 - DNA, 1818 bp, Actinoplanes utahensis
gtgcggagacatgcaccaggccgacgacctgatccaggaggccgtcaccaaactcttcgtccgctggcccttgcgggacgtcggcaacctcgacggatacctgcgcaccatgctggtgcggaccttcatcgacgagcgtcggcgcgggtggtggcggatccggctgttcgcccaccccggcgacgattccctgcccggggtcgtgccggcgtccggcgacgccttcccgatcgccgaccggaccgacctgcaggcggctctggcccgcctgccgcggcgccagcaggcggtgctggttctccgattcctgtacgaccagccgatcgacgtcgtcgccaccatgctcggctgctcgagcggcacggtgaagagtcagacggcccgcggactggccgcgatgcgcaccttgatcggcgatccgccggccggcaccggtccggtcggcgccggctcggccggcactggttcggccggcactggttcggctggcgcgggttcgggcggcactggttcggtcggtaccggttcggccggcactggttcggtcgacgccgtgaggggagcgctgcggtgagccggagtgggttcgatgagcagtacggccgggatctgctgagtcagcttccgcccatgccggacctgcccccgcacgtcgacctgtcggctgcggtcaccgcgggcaggcgccgtcgccgggcacgccggatccgtaccaccgtcacggcggccaccctgacggccgcgctcgtcgtagcggcgcccctggccgtccgcatgcaacgacgcagcgagcctcccgctgacccggcgccggcggcgacggcagctgccccggtcgcctgcacggcggcgtggctcccgatgccggacgccggcaccggtgcgcgcgtcctgaccgccggcgatgcgaccggccgctggtacgccggcagttatcgcgctcaacaggggaacggtgacaccgtcatcctgctgtggcatgacgggcggttggtcaggacgggccgattccccggtgtgggccagaagatcaacggcatcaatgccgccggtacggccgtcggtcagaccatcgacgaccggcggtaccggccctacgcgtatgtcggtgctcaggcggtgcggctgcccggtgtcaccgagggtacggccgtcgccgtcaatgatgccggcgtggtcgtcgggtcccggatggccggcgaccacccggtgccggtgcgctggcgatcggtcagcgaggcggccgtggacctgcccctgcccgccgggtacgggaccggcgaagccatcggcatcgacaaggacggcaccgtcgtcggctcgatcggtccgcacggtggtgttcccgagcagccctacctgtggcacccggacgggaccggggaactgctgccgctgccgatcgtgcagggccggccggcccgggttttcgacccgtccggcatccgggacggctgggtcgccggcgtcgtggtggcggcgggagacaagaccctgcgtccctaccggtacaacgtcgtcgaccggacgttcgagtcggttgccggccgcgacgtcgcgatctccgcgatcaacggcagcggctgggcggtcggttaccacaccggtgcgccgggaggatccgtgctgttcgccggaccgcgagagacgagactgcccgccgtccccggtgccggtgagcccgacacccgcgcggtggtgatcagcgacgacggccggaccgtcgccggcgacgggcggaacgccgcccaccggacccagcccgtgctgtggcactgcgacgtggaaacgatggcgggcaccgcgggacaccggtag

SEQ ID NO: 4842 - DNA, 1236 bp, Actinoplanes utahensis
atgaccaagcgcaagatcgtgctcgccttctccggtggactggacacctcgtacgccctcgtggatttccgcgagaagggctgggaggtggtcaccgccaacatcgacaccggcggcctgcacagcggtgaggcggaggcggtcaaggcccgcgccgaggaactgggcgcggtcgagcaccacgtcgtcgacgcccgcgccgagctgtacgaccgggtcgtcacctacgcgatcaaggcgaactacctgcgcaacggcgcctacccgtcgtgcgtcggcgcggaacgcctgatccaggcggagaaggtcgtcgaggtcgccctgcgggtcggcgcggacgccgtcgcccacggctccaccggcgccggcgccgaccacgtccggtacgacgcggtgatccgcgccctggccccgcacctggagatcatcaccccggtccgggacgagcgcctggtccgcgaggaggaggccgagttcctgcgcagccgcggcttcgcggtcagcgagaaggtcaagaagtactcgatcaacgagggcctgatcggcacctcgatcggcggcgaggagacctacggctcctgggagtacctccccgaggacgcctggacgtacacgaagtcgatcgaccaggctccggagaccggcgtcgagctgcacctgaccttcgacaggggcgtcgtggtcgacgcgaccgtcgacggcgccccgctggtcgccgccgacgccccgaactacgcgatcctctccgagctcaacgtgctcggtggcgcccacggcgtcggccgcggcatccacatgggctccaccatggtgggcaacctggcccgggtcgggttcgaggcccccggcatgctgatcctcatcgccgcccaccgcgaactggagaagctggtgctgtcgaaccggcagcaggccaccaaggcgcagctcggcaacacgtacggcgacctgctgcacgaggccgtctacttcgacccgatcatggacgacttccgcgccttcctcgactccagccagacccgggtcaccggcaccgtccgggtgaagctgcacaagggcaacatcgtcctgctcggctcgtccagcccgcacagcctgctggacgccgccacccgggccggcatcgtctacggccacggctcgtcggcctggaccggcgagcaggcccgggccttcgcccacatgtacgcgatgccgggcagcatcgcccgcctcgccgccaacccggcgccatag

SEQ ID NO: 4843 - DNA, 894 bp, Actinoplanes utahensis
atgaccttcccaccctcggtggagacccgcttcccgaacttcgccgaccacaccggcaagctcgccggtctcggcgtggagttcttcctcgcctccaacgagacgatccggccgcacctcaacgagcagccgtacgggcacaagctgagctggctcgacttcaccgacaccggtgagcgggactggtcggtgcgcgacttcctcaacctgttcaacgtgatcaacggcatcgcgttcggcgaccggggcatcccgatgccgcagtgggtgatggtcgacctgatcctgatgccggccgcggcgctgatcgccggcctgccgcaggacgagttcgcggccatggtggagcgctcgacgttccgcttcgacaccgacgtgaagcagctgctgcgcaaggtgcaggaggacatgcgggccggtggctacaccggcccggtgccggtcggcggctactgcgcggcgccgtccgcggaacccgggcgctgggtggggtggtcgctctggtcgctgatgccggccgtcgggctgggcaaggcggccaaggcgctggccctgtccgcataccgcgcgcagaagctcgacggcgtcacccagtacgacaacagcgcgctcaaggtgcacaccgagttcggcgcgctgaaggtgctggtcgccacggtcccgttccacacctcgccgggctcgttcgtgtaccagtccgatctgaccctgccggccgacgcggcgctgcccgagccggcgttcctgctcgacccgttcgactacgaccgccagcaggcgatgcagaaggcgatcgaggcgggcagcagcgagttctacgtgcttccacccggccacgtcgtccaggacggcaggacgtacgtgccgatcttcgaaaaggaacttccccgatga

SEQ ID NO: 4844 - DNA, 492 bp, Actinoplanes utahensis
gtgactcgtgcaggccggcacgcccggatcgtcgaactgatccggggccggaccgtgcgctcacagaccgagctcgccgacctgctcgccgccgagggcgtgcaggtcacccaggccaccctctcccgggacctggaggagctgaacgcggtcaaggtcagcggcgcctacctgatcccggaggacggcaagcggccgctgcgcgaaaccaccggccagggcccggcccggctgatccggctgctcaaggagctgctcaccggcgtcgactcgagcggcaacatcgccgtgctgcgcaccccgccgggcgccgcgcagttcctggccagcgcgctggaccggtcgggtctcgcggacgtggtcggcaccatcgccggtgacgacacgatcctcgtggtcgcccgggacagcgggcccacggcgggcgccgacctcgccgagaaactcggcaactggagccggtcggacaccgaccgtgaggagacccgatga

SEQ ID NO: 4845 - DNA, 933 bp, Actinoplanes utahensis
gtgaccctgcgccacttcctccgcgacgacgacctgagcccccaggagcagtcggacgtgctcgacctggccgtcgagatgaaggccagccggttcgccttcaccccgctggccggcccgcgctcggtcgcggtcttcttcgacaaggcgagcctgcgcacccggctgtcgttcgaggcgggcatcgccgagctgggcggccagccgatcatcgtggacacgcagaacacgcacttcggccgcggcgaaagcctgtccgacgccggccgggtcgtctcccgctacgtcgcggcgatggtctaccgcacgcacggtgacgagcggctggccgagctggcctcgggcgtcgacgtaccggtgatcaacgcactgtccgacggataccacccgtgtcagctgctcgccgatctgctcaccatccgtgagcggttcgggacgaccaggggcagaatcatcgcgtacgtcggtgacgccgcgaacaacatggcgcattcctacctgctggcgggcgccaccgccgggatgcacgtccgggtggccgggccgtccggcttcgatccgtcgccgtcggtggtcggccgcgcgtccgagatcgcggcgtggaccggcgggtcggtcgaggtgttccgcgatccccgcgaggctgccgacggggcgcacgtgctggccaccgacacgtggacgtcgatgggccaggaggaggacggcaaggaccggctcaccccgttccggccgtaccagatcaacagcggcctgctggcggtcgccgcgcccgacgcgatcgtgctgcactgcctgcccgcgcaccgcggcgacgagatcaccgacgaggtgatggacggcccgcagagcgtcgtcttcgacgaggcggagaaccgcctgcacgcacagaaggcgctgctcacctggttgctggcggtaaacgagaagtga

SEQ ID NO: 4846 - DNA, 1974 bp, Actinoplanes utahensis
atggctggagcgcttccacggcgcgacgatcgtgatcaagtacggcggcaacgccatgatcgacccggagctgcagcgcgccttcgccgccgacatggtcttcctgcggcatgtggggatcaagccggtcgtggtccacggcggcgggccgcagatcaaccggatgctccagcgggtcggcatcgagtcggagttccgcggcggcctgcgggtcaccaccccggagacgatggagatcgtccggatggtgctcaccggccaggtcggccgggagctggtcggcctgatcaaccagcacgggccgtacgcggtgggcctgtccggcgaggacgcccggctgttcaccgcggtccgccggggcgccacgatcgacggcgagcaggtcgacatcggcctggtcggcgacgtcgaccgggtggacacctccgcggtcgacgatctcatcgcggccggccggatcccggtgatcgccacggtcgccccggacgccgacgggctggcgcacaacgtgaacgccgacaccgccgcctccgcgctggccgtcgcactcggcgcccgcaagctcgtggtgctcaccgacgtgcccggcctttacaccaactggccggacacttcctcgttgaccagcgagatcgacgccgacgcgctcgccaggctgctgcccggcctggagtccgggatggtccccaagatggaggcctgcctgcgcgcggtgcgcggcggggtcccgtcggcacacgtcgtcgacggccgggtcgcccactcgacgctgctcgaaatcttcacggaagaaggattcggtaccatggtggtcccctcatgacgacgctcgtcgaacgctggcagcagtccatgatgaacaactacggcaccccggcgatcgctctggtcaagggtgagggcgcggtgctcaccgccgaggacggccgacggtatgtcgacttcctcggcgggatcgcggtcaacgcgctcggccacgcccaccccgccgtggtggccgccgtcacgcagcagatccagcaggtcggccacgtctccaacctgtacatcgcggagcctccggtggccctggccgagctgctgctggcgttggccggccggaccggccgggtgctgttctgcaactccggcgccgaggccaacgaggccgccttcaagatctcccggctgaccgggcgcacccacatcgtggcgaccgacggcgcgttccacgggcgcaccatgggtgcgctcgccctgaccggccagccggcgaaacaggacccgttccggccgctgcccggcgacgtcacccacatcgcgtacggcgacgtcgccgccctggcggccgccgtcaccggtgagaccgccatggtcatcctggaaccgatccagggggagaacggcgtggtcgtgcccccgcccggttacctggccgcggcccgggagatctgcacccgcaacggcgcgctgctcaccctcgacgaggtgcagaccggcatcggccgcaccggccactggttccaccaccagggcgagggtgtcgagcccgacctggtcaccctggccaagggtctcggcggcgggctgccgctgggcgcctgcctggccttcggcacggccgccgacctgctcaccccgggctcgcacggcaccaccttcggcgggaacccggtctcctgcgcggccgggctcgccgtggtccgcacgatcgccggcgagggcctgctcgatcacgtgaagcgggtcggcgagcagctgcggcgaggcatcgaggggctgcggcacccgttcgtcaagcaggttcgtggcgcgggcctgctgctcggcatcgtgctgaaccagccgaacgccgcggagatcgcggcgcggctgctcgacgccggcttcctggtgaacgccgccaagccggacgtgatccggctcgccccgcccctgatcatctcctccgatcaggcggacgccctgatcgctgccctggacggtattcggtga

SEQ ID NO: 4847 - DNA, 1170 bp, Actinoplanes utahensis
gtgaccgtcacccacccccggggcttccgcgcctccggcgtcgccgccgggctcaagaccagcggaaacccggatgtcgccctcgtcgtcaacgacggaccggactacaccgcggccgccgtcttcaccggcaaccgggtgaaggccgcgccggtgctgtggagccagcaggtggtcaagggcggagtgatccgcgcggtcgtgctgaactccggtggtgccaacgcgtgcaccggatcgcagggtttccgggacacccacaccaccgccgagcacaccgccacggtgctgcgtaccaccaagcggatgatggtcggccccggtgacatcgcggtctgctcgaccggcctgatcggcgagcttctgccgatggacaggctgctgccgggggtgaacgccgcggtcaaggcgctcgccacggacggcgggccccgggccgccgaggcgatcatgacgaccgacacggtcgccaagaacgcggtggcccagcgcgacggctggtcggtcggcggtatcgccaagggcgccggcatgctggccccggcgctcgccaccatgctcgtggtgattaccacggatgcgtcggcggacaacgagacgctggatgcggcgctgcgcgcggccacccgggtcaccttcgaccggatcgacgcggacggctgcatgtcgaccaacgacaccgtgctgctgctggccagtggcgcctcggaccggcagccgacactcgccgagctgaccgccgcggtcaccgaggtctgccacgacctggcccagcagctgatcgccgacgccgagggcgccaccaagcacatcgcgatcgaggtggccggcgcggccagcgaggccgacgccgtacaggtgggccgcacggtggccggcaacaacctggtgaagaccgcgttcttcggcaacgaccccaactggggccggatcctggccgcggtcggcaccaccagcgcggcgttcgaggccgaccggatcgacgtggcgatcaacggcgtctgggtgtgccgcaacggcgccgccgccgaggaccggtcgaaggtcgacctgtccggccgggacgtccgggtgacgatcaacctgcacgagggtgagatgaacgcgacgatctggaccacggatctctcgcacgcctacgtccacgagaattcggcatacagctcatga

SEQ ID NO: 4848 - DNA, 1002 bp, Actinoplanes utahensis
atgggaatccgggtcgcggttgctggagcgagtggttacgcgggcggcgagttgctgcgcctgctcgccgggcaccccgagttcgacctgatcgcggcgaccgcgcacagccaggccggtcagcacgtgacgtcggtgcacccccagctcaccgggctggacctgactctcggcagcaccgacgcggccacgctcggcgacgctgacctggtctttctcgccctgccgcacggtcagtcggcggctgtcgcgggacagctgccggccggtgtcaaggtcgtcgacctgggcgccgacttccggctggagagcgccgagcagtggacccgctactacggcggcgggcatgccggcacctggacctacggcctgccggagctgcccggcgcacgcgcggcgatccgggccgccaaccgggtggccaacacgggttgttatgcggccaccatcatcctggcgctcgccccgctgatcgccgcgggcgtggccgacccggccgacgtcgtggtggtcgccagctccggcacctcgggcgccgggcgcaacgccaaggcgcacctgctggccagcgagatcatgggtgacctgtcgccctacaaggtcggcgcgcaccagcacgtcgccgagatcaagcaggccaccggtgccgactcgctgtcgatgacgccgatcctggcgccgatgccacgcggcatcctggccacggtgaccgcgaaacgacgcaacggcggggacccgcgtgaggcgctgcaggcggcctacgcggacgagccgttcgtgcacgtgctgcccgagggcgtctggccgcacaccgcggccaccgccggctccaactcgtgccacctgcaggccacggtggacgtcgactccggccgcatcatcgtggtcagcgcgctggacaacctcggcaagggggccgccggccaggcggtgcagaacgccaacatcatgttcggcctgccggagacggccggcctcagcgtcttcggagttgcaccgtga

SEQ ID NO: 4849 - DNA, 897 bp, Actinoplanes utahensis
atgccgatcctgtccctgaaacccgtcgtcctgcccgcacccggccgcggtgacgacctgcaggtgcgggtctccgcaccggccgccggcaccggcctgccggtgatcgtgttcgcgcacggtttcggcggcgcgatggactggtacgacccgctcgtcgaccactgggcggcgaacggtttcgtcgtcgtccagcccaccttcctggattcggcgacgctcggcgtgaccccggccgatccgcgccatccgaccatctggcagacccgggtcgacgacctgagtcgggtcatcgacgacctcgccccgatcgtcgaggcggtgcccggactggccggccgggtcgcccacgaccgtctcgccgtcgccggccactcctggggcgggcagtccgccgggatgctcctcggcgcccgcgtcctcggcgccgacggccggcccggcgcggaccggaccgatcaccgggtccgcgccggtgtcctgctggccaccaccgggctcggcggggaccagctggccccgttcgcccgggagcacttctcgttcatgaacccggacttcgacacgctgaagacgccgaccctggtcgtggcgggtgacgcggaccagtcggcgctctcgacgcgcgggccggactggttcaccgacgtctaccacctcagtccgggggcgcagggtctgctgacagtgttcggcggggagcatctgctgggcggcatccacggctaccgcgcggccgacaccaccgacgagagcccgcggcgggtggagctgatccgccgcgcctcgaccgcgttcctgcgcacggcgctgggcatcgacgccacggcgtggcacaccgaggtcgacgccgtccgggccacgcccgacccggcgggtcgcatcgacacgaagtga

SEQ ID NO: 4850 - DNA, 831 bp, Actinoplanes utahensis
gtgcggagacccgcacctgcaggtcgtcaccgcggccgggtgcgggcaggacgacgggtttcagggacaggatcggcatggtggctccttcgggggccgccccggaccggagcggcgttccgtttcaccgtacggagcgacgctccgtttcgcaagggcgaggggagcattgctccggttggctgttcggcatggcacaatcggggggtgagcaaggaatcgggaggcgcgccgccgagacgccgggcggatgtcgagcgcaacgagagcgcgctggtcaccgcggccgccgaggtgttcgccacctccggtgtcgacgccacggtccgcgaggtggccgccgctgccggcgtcgggatgggcacgctctaccggcatttcccgacccgggcggccctgatggtggcggtcttccggcaccagatcgatgcctgcgccgaggccggcccgaccctgctcgccgccgcgcccaccccgttcgccgccctgctcgactgggtccacctgttcgtcgacttcctcggcaccaagcacggcctggcgaaggtgtggcagggcgacgacgccggtttcaccgagctgcaccagctctttctcgaccgcctggtcccggtcctgtccgagctgctgggggcggccaccgcgtccggcgaggtggtcgccgacatccggccctacgagctgatccgtgccgtcggcgacctggtcgcctggaccgtgcaggaccccaactacgacgtccgccgcatcgtcacgctgctcgtcaccggcctgcgccagatccagccggagcgttccgggccgtccggcttcgatctcgtccaggtttag

SEQ ID NO: 4851 - DNA, 684 bp, Actinoplanes utahensis
atggacaaccaggcgcggaagctctcgaccgggtcgaccgtcggcgggcgcatcttcggggccgccttcggcctcgtgttcgccggcgccggcgtgttgttcgccgcggcggacgtgttcgccgattcgttcgacccgttccgggcgatgtcggactgcgtgacgtccggcgacgtcgccgggattccggccgacgcgctgccgtccggcgtcaccacctgcgactggctgcacgagggcctcaccgccttccagatcgccggcctgctggccggtggcctcttcgcgctggtgggcctgctcatcgtggtggcctcggtgcgcgggtcggcggcctggctcgacgggtcgaggctgcgggtccggcgaaccttcggcacccgcgtcgtcgacctggcgacggcagacgtcaccgccggcatcgtcacgcacaccgacagcagcgactccgggccggtgcgggtgcggcgggtgcccaccctggtggcccgcgagcccgccaccgggcgcaaggtgaccctcgcgctgcagggcatcagcctggaccgcctgccaccggtcgagctccgggcgctcgccgacgccatcgtgatcggccggccggagtcggatgtggacgcgttccgggtcgccgagcagctgcgagcgatggcggacgacccgctggagctgcatcggcattga

SEQ ID NO: 4852 - DNA, 630 bp, Actinoplanes utahensis
gtgccgttcatcgccctgggccttctcgccggctgtggtcatgccgccgagacctcctccggaacggtggcgacaccgacgcccccggtatcgacaccctcgtccgcccaccccggctcgcggtgcccggcggagggcgtccgtctggagctcgacgagggcgacgccgcgatgggcctgcgggtccgcggcatcaccctggtcaactgcggttcccgcacctatcggctgaacggttacccggtggtgcgtgcactcgacgaggaccgcgcgccgctcgaccttcaggtcctgcagggggtcacggagatcgtcggctccagcatgccgtgggacggtccgccgcggccggtgacgttggggccgggtcagcgtgccagcgcggcggtggcctggcgcaacacctacgacgacatccgcaagcccccggtcgatgcgaccttcctgcggatcgagccgctcgccggccgcccggcccagaccgtcgaggcggacctcgacctcggcagcaccggccgtttcgggatcagcccctgggtggcggttccggacaccaccgccgcgccggcctcgtcgccgccggctccggccccgtccgacccggtcgcatccgacatcccgctgccgtga

SEQ ID NO: 4853 - DNA, 1257 bp, Actinoplanes utahensis
gtggctgaacccggttcccttgcggaagccgtgaccgaacgcgctccccgcgcaccagccggcaccgaaccgggtccgcgagccggggcgttgtccgccatcgggctctacgtggtgctgcgcgtgctcagcctcgaggtgatgtacgcgctcgccgcccaggcgcacagccgctcccccggccgccaggtcttcccggacgggtcgatcggcaaccagtggcgcagcttcacctccgcggcggacgcgctgctctcctgggacggccgctggtatatcaagatcgccggcagcggtctgggcggcccggtcggcgcggtcgacgccgacggcgtgccctacgagctgcggctggcgttcttcccgctctacccgtggctggcccggccgttgaccttcctgccgttcgtcaacccggtcgccgcgtgcctgatcgtctccctgatctcggcgatcgccgcggcgtggggcatctatgccgtcggccggctgatccgcgatcaccggaccgggctcatgctggccggcgtctgggcggtcgcccccgccgccatgacgcagaacggcgcgttcaccgaatcactgttcaccgccctcgccgcctgggcgctgtgggccgtgctcaccagacgctggctgctggccggtgcgctcgccggcctcagcggcctgagccgccccaccgccgcggccctgatcggcaccgtcggcctggccgcgctgatcgccgccgcccgccggcgcgacggctggcgaccctgggccgcgatcgtgctggccccggccgggctgatcgcctacctgaccttcgcctcggcgcgcctcggcggcttcgacgaatacaccagcatccacgcgaacacgttcggggcacgctgggaccacggcgccaacaccgggaagatggtcagcgacatcctgctcggcgtggacgacgacaacgccgccaaaccgatccgggtgatgtcggcgctgttcctcgccggattcatcgtgctgctggtgctgctggccggccgggtgccgtggccggtgaccgtctacaccgcggcgatgctcgtcctggccgccgggaccagcacacacatctcgatgatcgggcggcatctgatgccggccttccccgtgctgctgatcccggcgatgctgctggcgcgcgcgtcgaaccggaatctggggatcgtgctgggggcgttggcgttgctctcggggtggtatgcgggatggttgccgtttatttccgggcaggcgatctga

SEQ ID NO: 4854 - DNA, 1431 bp, Actinoplanes utahensis
gtgccggagagtgacgagccgacccggctctggggtgcccggttcgccggcggcccggccgaggccctggccaggttgagcgtcagcgtccagttcgactggcgtctcgcgccgtacgacctgctcgcctcccgggcccacgcccgcgtgctggccaacgccggcctgctcgacgccgaggagctcggccggatgctggccgccctcgacgacctggagcaggcctgcaccaccggcgagttccgccccacgatcgaggacgaggacgtgcacaccgcgctggagcgcggcctgctggagcgcctcggcgcgctcggcggcaagctgcgcgccggtcgctcccgcaacgaccaggtggccaccgacctgcggctctacctacgcgatcacgcccgcggggtggccgtcgcgctgatcgagctggccgacgcgctcaccgagcaggcggcccgcaacgtcggcaccccggcccccgggatgacccacgtgcagcacgcccagccggtcagcttcgggcactggctgctcgcccacgtgcaaccgctgctgcgcgacctggaccggctgcgcgactgggacgtgcgcaccgcgatcagtccgctgggctccggcgcgctggccggctcgtcactgccgctcgacccggccgcggtcgccaaggagctgggtttcgccgcccccgcgccgaactcgatggacgccgtcgccgaccgggacttcgtcgccgagttcctgttcatcaccgcgctgatcggcgtgcacctgtcccggctgggcgaggaggtggtcctctggacctccaccgagttcgggtgggtcgagctggacgacgcgttcgccaccggctcctcgatcatgccgcagaagaagaacgcggacatcgccgagctggcccggggcaagagcggccggctgaccggcggcctggtcgcggtgctgaccatgctcaagggcctgccgctcacctacgaccgggacatgcaggaggacaaggagccggccttcgacgcggtcgacaccctggagctgctgctccccgccctggccgggatgatctccacgatgaccgtccgggtggaccggctcgcggccgccgccccggtcggcttctcgctggccaccgaggtggctgactggctggtccggcgtggcgtgccgttccgcgacgcgcacgagatcaccggcaagctggtggcgctctgctcggcccgggagtgcgagctggaggacctgaccgacgacgatctgaagacggtgagcgagcacctcgacccgtcggtgcgcgaggtcctgtcggtgtcctcggccctggccgcccgcaccacgcccggctcgaccggaccgggcccggtgcgcgaccaactcgccacggtgcaacacaaactggacacctggcggcagtgggcggtggagaaggccgtcccgcgctga

SEQ ID NO: 4855 - DNA, 1062 bp, Actinoplanes utahensis
atggctgatcttgatctcaccggcgacgtggtcgccctcacccgggtggtctgcgacatcccctcggtcagcggcgacgagaagcggctcgccgacgccgtcgagagcgccctgcgcgcgtatgcccacctggaggtgctgcgcgacggtgacgcggtggtggcccggacgagcaccggccgccccacccgggtcgtgctcgccggtcacctcgacaccgtgccgatcgccggcaatctgcccgtcgtcgaggacggtgacgtgctgcgcggtcgcggcaccgtggacatgaaggccggcgtcgccgtcatgctgcacctcgccgcgaccctgaccgcgccgcgctacgacgtcacctatgtgttctacgatcacgaggaggtcgccgcccggctgaacggtctcggccggctggtccgccaccatccggagtggctggccggcgacttcgccatcctcggcgagcccagcgacggcacggtcgagggcggctgccagggcaccatgcgggtgaggatcgccgtcccgggcgtcgccgcgcacgccgcccgctcctggcggggcagcaacgccatccacagtgccggcgccgtgctcgacatcctgcgagcctacgagccgcggcagccgatcgtcgacggtctgcagtatcgggagggcctgaacgcggtcaagatcgagggcggcatcgccggcaacgtcatccccgacctgtgcaccatcttcgtgaactaccgcttcgccccggaccgcgaccccgacgccgccgagacccacctccgcgaggtcttcgccggcttcgacctggaggtcaccgaccgcgcacccggtgcccgccccggcctcgaccagccggccgccaaggagttcgtcgacctagtcggccgcgaaccgcaggccaaactcggctggaccgacgtctcccggttcgccgccctcggcatcccggcgatcaattacggccccggagatccgctgcaggcccacaccgacaccgagttcgtcccgattcccgagatccacaccgccctcgagaacctgaaaacctggctgaccgcctaa

SEQ ID NO: 4856 - DNA, 1050 bp, Actinoplanes utahensis
atgcgtgcacggatggcggacatcgcccgtcaagcccaggtcagcgaggcgacggtctctcgcgtcatcaacgaccgcccgggcgtctccccggaaacccggcaggcggttctcaccgccctcgacgtgctcggctacgagcgccccgagcggctgcgcaaacgcagcgccggcctggtcggcctggtcgtgcccgagctggacaacccgatcttcccggcgttcgcccaggtcatcgagtccacgctggcccagagcggatacacgccggtgctctgcacccagtcccccggcggggtcaccgaggacgagtacgtggagatgctgctcgaccggcaggtctccggcatcgtgttcgtctccggcctgcacgccgacaccaccatggacgtcgagcgctatcaccgcctgctcgcccgcccgctgccgatcgtgctggtcaacgggcacaccgacggcatcgacgcgccgttcgtgtcgtgcgacgagcagctcgccggcgacctggcggtgggtcacctggcctcgctcggccaccgccggatcgggatgatctccggtccccaccggttcagtccggtgcagcgcaaactcgacggctaccgggccgccatgcagcgtgagctcggtgtcccggcggccgacgccgacgacctggtcgagctcaccctgttcggtgtcgagggtggcgaggtggccgcggagcgactgctcaacaagggtgcgaccggcatcatctgcggctccgacatgatggcgctgggcgcgatccgggcggctcgccggcgcggcatgcgggtcccgcacgacgtgtcggtgatcggtttcgacgactcgccgctgatggccttcaccgacccgccgctgaccaccctgcgccagccggtcgcggcgatggcggtggccgccgtccggtccctcgtgtacgacatcaacggccatggctcgcccaggtcagagtaccttttccggcccgagctggtggtccgcagctcgaccgcgatggcgccggcacaccgcgctctgaccgccgacgcctcggctgcctga

SEQ ID NO: 4857 - DNA, 1254 bp, Actinoplanes utahensis
atgcgcatccgcaccgccggcgtcatcgcggcgagcatgctctgcctggtcggcgccgccgcctgtggcgacaagaagaccagcacctcggccggccccaaggccagcgccgccaccggcgagctgatcatctgggccgacgacaagcgctccgccgcgctcaagccgttcgccgacaagttcggccaggagaacggcgtcaccgtcaagatccaggcgatctcgaaggaccagcagaccaccttcctcaccgcctcgcagcagggcagcggcccggacgtgatggtcggcgcgcacgactggatcggcaacctggtgcagaacggcgccatcgacccggtgcagctgtccgacgcgcagaagagtggcctgcagccgggcgcgctcaaggcggtcacgttcaacagccagacctacggcgtgccgtacgcgaccgagaacatcggcctgatccgcaacaccgacctcgcgccgaccgcgccggccaccatcgaggacgtggtcgcgcagggcaagaagctggtcgccgagaagaaggcgtcggaggtgctctgcctgcagtccggcccgaccggcgacgcgtaccacgcctacccgctgtacgcctcggccggtggctacctgttcggcgccgccggcaacggcgacctggacccgaaggacctgggcgtcggcaagcccggctcggtcgccgcgttcgagaagctgcgcgccttgggcgagaagggtgacggcgccctgaagcgctcgatcagcccggacaactcggtcgccaccttcaccggcaagaagtgcgccttcctggtctccggcccgtgggcgaccgcggacgccaagaaggccggcatcaactacgacatcaccgcggttccgccgttcaagggcggcaaggacgccaccccgttcctgggtgtgcagaccttctacgtcgcggcgaagggcaagaacaaggcgctggcccaggagttcgtcaccaactacgtgaccaccccggagctggccgtcgcgctctaccaggccgacccgcgtccgccggcgctgaccagcgccctggaccaggtcaaggcgaacgacccggacgtggccaagtgggccgaggccggtaagaacgccattccgctgccggcgatccccgagatggccgccatctgggagccgttcggcaaggccgaggccgccgtcatcggtggcgccgacgccaagtcgacggtcgacgccgctgccaagaccatctcggccgcgatcaccaagtaa

SEQ ID NO: 4858 - DNA, 1557 bp, Actinoplanes utahensis
atgacgacgcagctcgaagggcccgccgcgacgcgggcccttcccgcccccgaggccgaagtggaaaagagcagttcgctgcgcagccagagcatcaagatcgtgctgctgggcctggtcgtggcaatcgcggtgtgggccgccttcccgctggcgggcggcgagcactggatcgggctgggcatcctggccgcgaccaccgccgggctgctctacctgtatctgtcgccgcggcacatcccggcgaagtacctggtgccgggcaccatcttcctgatcatcttccagatcttcccggtgctgtacacggccggtacggcgttcaccaacttcggtgacggccaccggggcaacaaggctgaggcgatcaccgcgatccagaccgcctcggtgacccgggtgcccggctccaccgaataccagctcaagatcctggccaagggtgaccagctggcgttcctgatcaccgacccgaagaccggcaaggtctcgctcggcgacgccggcgggctcaagccggtcgacggggtgccggccgggtacaccgtgctcaacgccggtgaggccagcgcgcgcagcagggagatcaccgatttcgcggtgccgaccgcggcgggcgcgatccgctcggcggggctctcccgggcgtacgaaggaaaggctgttcgcgcctttgatccggcgaccgacagcatcagggacacgacgaccggcaaggtgtggaaggccgacgacggtcagggcgcgttcgtcgcgaccgacggggaacgcctggcgcagggctggaaggtcaacgtcgggttcgccaacttcacccgggtgctcaccgacgacaccatccgctcgtcgttcgtgggcacgctgatctgggacttcctgttcgcgatcggctcgaccggcggcaccttcctgctcggcatgttctgcgcgatcgcgctgcagtcgacccggatgcgcttccgcgggctgtaccggatcctgatggtgctgccgtacgccatgccgtcgttcgcgatgctgctggtctggcgggacatgttcaacaccgacttcggcctgatcaacaacgtgctggggatccacgtcgactggctcggcacgccgatcaccgcgcagctggcggtgctgctggtccagctctggctcggctacccgtacatgttcctggtgaccaccggcgcgctgcaggcgatcccggccgagctgaccgacgccaccaaggtggacggcgccggcccgttccaggcgttccgggcgatcaagctgccgttgctgctggtcgcgctgaccccgctgctgatctcgtcgttcgcgttcaacttcaacaacttcaacgcgatctacctgaccaccgagggcggcccgttcccggccgacaatccgaacagcggcgccaccgacctgctgatcacctacacgtaccggctggccttcggtgggtccggcgcccagtacggcttcgccgcggccatctcgatcttcatcttcctgatcgtggcggtggtctccgcggtgagtttccggcgcacccgggctcaggaagaggtgtactcatga

SEQ ID NO: 4859 - DNA, 852 bp, Actinoplanes utahensis
atgaccgcgaaatggttcaaggacaccggctggcggcacctcgtcgccgtcctcgcggtggtcttctcgctcgggccgatcctgttcgtgctctccgcggcgctgaacccgctgggcacactgtcgtcgagcacgctgatcccgagcggggcgtcgctggacaacttctcccggctgttcaccgacacgaacttcccgcactggttcctcaactcggtgatgatcgccgggctggccagcgcgagctcgatcttcctgtccgcgctcgcggcgttcgcgttcagccggcgacgcttctccggccgtcgtaccggcctgctgttcctgctgttgatccagatgttcccgcagttcctggccgtggtggcgctgttcctgatcttctcgacgatcaccgacctgtggcccgaaatcggcttcaacacctggtggggcatgatcctgctctatctgggcggcgcgctgggcgtgaacacctggctgatgaagggcttcttcgacaccgtgccgaaggagctggacgagtcggccacggtcgacggtgcctcgcacaccgggatcttcttccggatcctgctgccgctggtctcgccgatcatcgcggtcgccggcctgctcgccttcatcggcaccatcaacgagttcctgctggccaacctgttcctgcgggacggcgcctcgaagaccctggcggtcggcctgtacggcctggtccagggctcggaccggaacaccaacttcggcatgttctgcgccggcaccctgctcaccgccatcccgacggtcggcgtcttcatgtatctgcagcgctacatcgtcgagggactcagcgcgggcgcggtcaagggatag

SEQ ID NO: 4860 - DNA, 5325 bp, Actinoplanes utahensis
gtgctcagccttcttctcccacttctgaccgtcccggctgccgaggcgtccgccgcttcgaatgagcccagcgcctcggtgatcgccaactgggggtccgacaagccggcgagcaacgagcagtactacttcgtcctgccggaccggttcgccaacggcgagaagtccaacgacaagggcggcctcacgggggaccggctgtcgaccgggtacgaccccgccgacaagggcttctaccacggcggcgacctcaagggcgtgatcgacaagctcgattacatccaggggctcggcaccaccgcgatctggctcgcgccggtcttcaagaaccgtccggtgcagggcaccggcgccgacgtgtcggccggttaccacgggtactggatcaccgacttcacccaggtggacccgcacttcggcaccaacgcggacctcaagaagctggtccagctcgcgcaccggcgggggatgaagatcttcctggacatcatcgtgaaccacaccgctgatgtcatcaaaaaccgggagaacaagtactcgtacatcgacaaggcgacctcgccgtacaccgacaccgagggccagccgttcgaggacaagaactacgcgaccggcaggaacggcttcccgaaggtcgacgcgacgtccttcccctacacgccgaccgtcgacccgaaagacaagaaggtcaaggttccggcgtggctgaacgacgtcacgatgtaccacaaccgcggtgactccaccttctccggcgagaacagcgagtacggcgacttctacggcctcgacgacctgtggaccgagcgtcccgaggtggtcagggggatgaccaggatctacgccgactggatcggcgcgaccggcatcgacgggtaccgcctggacaccgtcaagcacaccgacctggacttctggccgcagttcacggccgggatcaaccaggccgcggccaaggccggcaagccgggcttcttcatgttcggcgaggtgtacagcgccgaccaggagatcgagtcgacgtacgtccgcaagggcgggctgccggccaccctggacttctcgttccaggccgccgcgcaggcgttcgtcaccggaggcggcaccgcggccgggctctccgacgtgtacgccaaggacgacctctacaccacgccgaccaccagcgcggagcggctgccgaccttcctcggcaaccacgacatgggccggatcggctcgttcatcgccgccgcctcgaccgccgacacccagctcaagcgcgacgagctcgcgcacgagctgatgttcctgacccgcggccagccggtcgtctactccggtgacgagcagggcttcaccggcccgggcggggacaaggacgcgcgccaggacatgttcgccagcaagaccgcggactacctgaaggacgacctgatcggcaccgaccgcacgcacgcggtggacaactacgacaccgcgcacccgctgtaccggacgatcgcgtcgctggcgaagctgcgcaaggcgaacccggcgctggtcgacggcgtgcaggtgacccgctacgcggcgaccggggccggtgtcctcgccgtctcccggatcgacaggacgaagcggaccgagtacgtggtggccgccaacaacgccaccaccacccagacggtcagcttcgccacctcctcgcccggggccaccttcaccgggatctacggcggggcggccccggtggtcgccggcgcggacggcaaggtcaccgtcacggtgccggccctgtccaccgtcgtactgcgctccaacgctcccgaagccgtgccggcggccgcgccgaccgtgaccctgaagccggccgccggcgccaaggtcgcgacccggaccgagctgaccgccgagaccaccggcgacccgctcgccacggtcaccttcgcggcccaggtcggcgacggaccgtggaagctgctgggcaccgccgacagggcgccctaccgggtgtatcacgacctggacgggctggccggcggcaccccggtgaagtacaaagcagtggtgcgggacagtcgcggacgactcgcttcatcgtcgacgagcatcacggtggccacgccgacgccggcctccacggtgggctacgcgatcgtgcactaccagcggccggccggcggctacgccgactacggcctctacacctggggtgacgtggacccgtcgatgtcgacctcgtggccgaacgggcagccgttcgtcggcgaggacgcgtacggccggttcgcctacgtcaagctcgcgccgaacgccaagagcatgggcttcatcgtggtcggcaaggacggcgtgaaggacaccgacgcggaccggtcgctggacccgacgaagaacccggaggtctggctcaaacagggcgatcccgccgtctacaccacgccgcccgcggtgcagcaggaccagggcaaggcgatcatccactggcgccgggccgacgggaactacgacggctgggggctgcacgtctgggacggcgccgcgaccggcaccgactggggcagcccgctcaagcccacgaagatcgactcgtacggagcgacgttcgaggtgccgctggccgacggcgccgccgggctcagctacatcatccacaacggcgacgccaaggacctgccgaccgatcagcgcctcaccttcgccgacgcgggccacgaggtgtggctgctcgccgggcagcaggaacgcctgctgccgctggtgaagacggccggcggcaccggatccaccgatgtcaccaaggagtcggcggtctggatggaccgctcgacactggcctggcagaccggtggcagcaccgacggcaaggtctacgacctcgtgtggtcgccgaccggcgggatcggcgtggcgaacggcgagctcaccggcgactacaagaccgtgtcgctgcacgcgaaggggaccggcctcaccgagaggcagcgggaccggttcccgcacctgtggcagtaccgcgccttcaccaccgacgcccggaacgtggcggacatcgtgcgaggccaggtcgtggtcaccgagcggaacaccgacggcagactgctcgccgcgaccggcgtgcagaccgcgggcgtgctcgacgacctctacccgaaggcggtcgacgccgagctcggctacctgcacggccgggtcgcggtctgggcgccgaccgcgagcagtgtcgagctggagacctacgacaacgcgacggcgtccagcgcgacgctggcgaccatgaaacgggatgaccggaccggcgtctggtcgctcccggtggcccggggcgactacggcaagtactacaggttccgggtcaccgcgtggcagccggccgcgcagaaggtggtcaccgcctcggtcaccgacccgtactcggtcgccctgtccaccgactcgaagcggagccggttcctggatctgaacgacccgaagctggccccggccggatgggacaggctgcgcaagcccgccgccacggcgccggcgaagatccagatccaggaattgtcggtacgggacttctccatcgccgactcgtcggtgcccgccgccgagcggggcacgtacgcggcgttcaccgaggcccgcgcggccggggtgcggcatctcgcggatctcggcaaggccggggtcacccacgtacacctgctgcccgtcttcgacttcgcgacggtgccggagaaccgggccgaccaggcgcagcccggctgtgacctggccgcgctgccggccgactcggatcagcagcaggcctgtgtggccaaggtggccggctccgacggctacaactggggttacgacccgctgcactacaccgtcccggagggcagctacgccgtcgacccggcggaccggacccgggagttccgctccatggtggccgggatcaacaacgccggcctgcgcgtggtgatggacgtcgtctacaaccacacgtcggcggccggcaccgacccgaactcggtgctcgaccagatcgtgcccggctactaccagcggctgctcgccgacggcacggtggccgactcgacctgctgcgccaacaccgcgccggagaacgcgatgatgggcaagctggtcgtcgactcggtggtcacctgggccaagcagtacaaggtcgacggcttccggttcgacctgatgggccaccacccgaaggcgaacatcctggccgtgcgcaaggccctcgacaagctcaccctcaagcgcgacggggtggacggcaagaacatctacgtctacggcgagggctggaacttcggcgaggtggcgaacaacgcccgcttcgtgcaggccacccagcagaacatggccggcaccgggatcggcacgttcaacgaccggctccgggacgcggtccgcggcggcggcccgttcgacgacgacccgcggatccagggcttcgcctccggtctggccgactcgggcaccgacaacgcccggctgctgcactaccaggacctgatcaaggtggggctgaccggcaacctggccggcttcgccttcaccgggaacgacggcaaggtcgtcaccggtaaggacatcgactacaacggcgcgccggcgggctacaccgcggcgccggacgaggcgatcacgtacgtcgacgcccacgacaacgagatcctgtacgacgcgctcgcctacaagctgccgcagagcaccacggcggcggaccgggcccggatgcagtcggtggcgctggccaccacggtgctcgggcagggtgtcggcttcgtggcggccggcagcgagcggctgcgctccaagtcgctggaccgcaactcgttcaactccggcgactggttcaacgcgatcgagtgggactgcaccaagggcaacgggttcggcaagggcctgccgccggccgcggacaaccaggcgaaatggcagtacgccaagccgctgctcgccgacccggcgctcaagccggactgcgcggcgatcaacctggccgacaaccggtatcgggagctgctccggatccggacgtcgtcgccggtcttcggcctggcgaccggcaagcaggtgcagcagcgggtggcgttcccgctgtccggcaagaccgagacgcccggcgtgatcacgatgacgctggacgcccgcggcctcggcgggaagtggaagtcgatcaccgtggtgttcaactccacgtcggcgaccgcgacccagacgctgcccgccctggccggtaagaaggtcgcgctgcacccggtgcagcaggcctcggccgacccgctggtgcggaccgcgtcgttcgccgcggcgaccggcacgttccgcgtcccggcacgtaccgtctcggtgttcgtgcagaactga

SEQ ID NO: 4861 - DNA, 687 bp, Actinoplanes utahensis
ttgagaggtgggtgttcgccgcaagctgctgatcggctacctgggctgcggctgcccggctcgttcatcccgatggccgaggagaccgggatcatcgtggagatcgaccggtgggtgctgctggaggcatgccggtcggtcaagcagtggcagaccgacgacccggcgaccgcgccggcctgggtgagcgtcaacctgtccgccacccacctggagatgcccgacctgaccgaccaggtggcgtacgcgctctcggcgaccggcctggccccgagctgcctggtgctggagctgaccgagacggtgctgatgcgcgacctggcggtgaccgccgcccggctggaggaactgcgcgagctcggtgtcaagatcgcgatcgacgacttcgggaccggctactcgtcgctgggctatctccgcgacatcccggtcgacgtgctcaagatcgaccgctcgttcatcgacgggatggccggcaacgggcgccagcaggaactggtcaacgcggtcatccagctcgggcacacgctgggcctgcgggtggtcgccgagggcatcgaggacgcggaccagctcaacctgctcaccgtgatgggctgccggttcgtccagggctaccacctgggccgcccggagccggtcgcccagctccaggaccggctgtcggctccggtcctgcagaactga

SEQ ID NO: 4862 - DNA, 888 bp, Actinoplanes utahensis
atggatctcaccatggcgctggccgggctgggtgtcggcatcatcgtcggactgaccggcatgggtggcggcgcgctgatgacgccgatcctggtgctgctgttccacgtcaacccggtcgccgcgatcggcagcgacctggcggccagcgcggtgatgaaaccgttcggcggcgcggtgcacgccaagcgcggcacggtgaactggaagcttgtcggctggctctgcgccggcagcgtgcccagcgccttcctcggcgtgctgctgctgcgcctgctcggcgacgacagggcggtccagcacaccgtcaagatcgccctcggggcggcgctgctgctggccgccgccggcatggtcgccaaggcctgggcgagccggcgcaccgccgacgccccgcccgccgcgatcaccgtgcggccgctgcccaccctgctgatcggcatcatgggcggcctggtggtcgggctcacctcggtcggctccggctcgctgatcatcgtggcgctgctcgccgtctatccgaagctgcgcgccaacgacctggtcggcaccgacctggtgcaggccgttccactggtcaccgcggccgcgctggggcacgccctcttcggcgacctgcacctggacatcgccggcgcggtggtgctcggctcgatccccggcgtgctgatcggctcgcggatctcctcgcgggccccgggcggcctggtccgctccgccctgatcatcgtgctgctggccagctcgctgaagctgttcgacctctccgcacagctggtcggcgtgatcaccggcggcgccctgctggtcgcgatcggcctggggctgcgcgccaggaggcggacgaccgccaccgggccgcagcaccgcgagaccgtcgcggtctga

SEQ ID NO: 4863 - DNA, 222 bp, Actinoplanes utahensis
gtgccggcaactgaagagtcctgcgcgaaccgccgaatcctccgatcaatgggggccccagcgtggcgccggaccgacggccccggtctcccggccgccgcggtgctgatccccggcggggccggttaccggttcgcccagggctttcacttcgcccgcccgatgccggccgaggacatcgcgccgctgctcggggatcccagccgtcgggaatctcgataa

SEQ ID NO: 4864 - DNA, 201 bp, Actinoplanes utahensis
gtggatgagcttgtgctggagatgctgcgcgacgacctcgaccgccgggtgaccgcggcggccgccaccatggccgacacgctgcgactgctcaccgcggcgcgcgagctggccggggatgccccgggtggcgagtcgctgcgcgcggcgatcgaggagctcaccgcggcccacgcggatctgctggtcaggagtcggtga

SEQ ID NO: 4865 - DNA, 1617 bp, Actinoplanes utahensis
atggcaagcgccgcggcctcggcgaacccggcggcggcatcgatcgcccgcagcacggccacccgccgctcgccgaggcggacgcgccgcgccgcggccagctcggcccgcagcaccatcagcttggtcagacagtcgtccatcaggttcagcacttcatcatgcatggtgggtgcctcctggccacgcactgcgaccggaccgctgggtcgtagctccgcaccgagcccgggagcgacgttcggttacttggcgtcgagcctacgttcacttcttgttcttgcggttagcccgttgttacatcccgactcccgggacagaagccgacatcagggacgtcccgctgacctgggagcgcgcccaccgacatccggaaagaccgcaggcagcgccccggatgtgccagaaacgagagccggaaccgatcatgccggcccggccggcgcctcctcggcggccgaggcgtaccggtattcgtcggttcgcggaccacgacccggtcgccgccagcgcccgccggaccccgaacagcgcgagaagacgacgtcgtccatccctgagggctgtgtcactgtccgagccggccgggccggcggcgtctaccgtgtggcggtggagatcggactctggtcggtggtcgccgaacccgaggcgctcgccctggccggtccgggggcgacgctgctcaccggcgcggacgccgcctacgcggtcgggccggacgccgtcgtggtgatcgccccgggtggcggggccgacgagatggtgctgcccgggccgttccccgaactcctcgaggagcgcctggccggggtgttgcgaccggcggtgcgggcgttcgcccggctgccgcagggctgcctggcactgggcgtggcccggtccgccgagctcggctaccggcgcggggcgctgcacgacatccggttgcgcttcgaggaggcgctgccgcccggtctgctggagcccggccccgagtggctcgacatggtgggccacgacccgaccggcgcgatggagcggtttatcacggcgtggtattccggcgtaccggcccgccgcgttccggatgtcgatccgatgggtcagccgacggcgttgcgggcgttccaccgggtggcggccgggcggcccgaggtgtacggaatctcctcgcgcatcctgccggagccgctggccgaccgcccggacggtctgatcaccttcggtcatgagggcgacggcatgttcaccctcgcgatgccgcccggcgaggacgatccggaggtcttctacgacgggctgagcgaccggctgctgcccgagcgggagcggctcgccggtttcctgctcaacgccgcgctggcccgggccgcgatggacgggccgctgggcgggatggcgttcgtcgaccgcccgcaggcgcagcggatcatcgccccgctgcgccgcgtcccgttgcggccgatgcgctggccatgcctgttctcccggtgttacgccgggcccggcacggtggtgctgctcggcgaggacgacgccgactggtgcgagatgtacgtcggggtccgccatcccggcctgctgcgccgcctgcgccggctcggcctcgactgggagtcgttcaccgactcctga

SEQ ID NO: 4866 - DNA, 1647 bp, Actinoplanes utahensis
atgactgtcctccctagtgccgcggagcttcccggcgtcccggtcggccgccgcgccgttctgctcgccggcctgaccgccggtgccggcgcggtcgccgcggccgcgctgccctcggtcgccggcgcggccggttccgccttccagcacggtgtcgcctccggtgacccgctcccgggcggcatcctgctgtggacccgggtcacccccacccccgaatcggtgccggcctccggcctcggcccgcaggtggacgtggactggcaggtcgccaccgacgccgggttcgccacggtggtgcggtccggcacggtcagcaccggcccggaccgcgaccacaccgtcaaggccgacatcagcgggctcagcccggccaccacgtactggtaccgcttcggcctgggcggcgagtggtcgccggtcggtcgcacgatgaccgctccggccgccaccgacgccatcgcccggctccgggccggcgtggtcagctgcgccaactgggaggccggctacttcgcggcctaccggcacctggccgagcgcggcgacctgaacctggtggtgcacctcggcgactacatctacgagtacggcaccggccagttcgacgccggcggcacggtggtccgcactgtggccccgctcaacgagacgctcaccctggccgactaccggacccggcacgcgctctacaagacggacccggacctcaaggccctgcacgcctcggtgccgtggatcatcacgtgggacgaccacgaggtggccaacgacatgtggagcggcggcgcggagaaccacaccccggccaccgagggcgacttcgcggcccgggtcgccgccgcccggcaggcgtacgccgagtggatgccggtccggctcgccgcggacggccacatctaccgccggctgcgctacggcgacctgttcgagctctcgatgctggacctgcgcacctaccgttcgcagcaggcgtcgggtgccgtcgtcgacgacgaggaccggaccatcgccggcgccgcccagctcaactggctcaccgacgggctggtcaactccaccgcactgtggaagatcgtcggcaacccggtgatgatctcccgcctcgacgtgctggccctgccggcctggctgctcggcccgctcggcgagctgatcggcgtcccgcagaacggcgtcgtgctcaacgccgaccagtgggacggctacaacgccgaccgggagcgcctcgtcgacaccctgcgcgcgcacgacaccagggacgtcgtcttcatcaccggggacatccacaccagctgggccaacgagctgaccaccaaggacaccggcaccgcccatccggccgcggccgaattcgtcgtcccctcggtcaccagcgacaacatcaacgacgcgctgggcaccagcccgggcgggccgctcagcctgctcgccgccagcctgatccgggccaccaacccgcacgtcaaatgggtggagaccgacgggcacgggttcggggtcctggacatcacccgcagccggtgccggatggactggtaccacctcgccgaccggaccaggaaggacagcgccgccaagtgggtgcagggctggtcggtcggccgcggctccgccaagatccgtaaagagtccgcccccggctga

SEQ ID NO: 4867 - DNA, 1731 bp, Actinoplanes utahensis
gtgcgcggcccgggccaccgaccaccaggcctgagccgccgatcaccgggcctgagtcaccggtcaccaggcgcgctcagccgggtgccgccccggagtggatcactgctagcatcccgcgccaccatcacaccgaacggggttgcattgcgcaggctcactctcctggccgcggcggtcgtcacgctgctgccggtcaccctcctgagcaccgccgggtcggcgtcggccgcgtccggaacgttgacggtcaacacctacgaccggtcgggccaggtcttccacacctcgctgcggatcatcaacctgtccagcaaccagagttacaccgcgtccagcttctcggcgaaggcactgccgaagggggcgtacgcggtgatcaccgacatgtggaaccagcgcgacggcaccgacacgctgggcgccaccatggtgaccgtgccggccggggcggtgaccgcgaccatcgacgcccgcggcggccagccggtgggggtgcggctggaccagggcccgggcgccggctatgcgcagaccgtgcgggcggcgatctgttccgaagccaccggcgccccgatcaaggtggacgcctacaaccagcccggcaagctgttcgtcctctcgaacaattccacccacctgcgcttctcctggtcctcgatctggcagagccagggcggcaacgagacctggatggtggccggcggcccgcaccccaaggtgccggccggggtgcacggcacgatcgcggtgtcctcgctgggcacggtcagcgcggccgtccggcgcggcccggccggcagcgaccaggccggcctgaccttccacgaggacgacgactgccacccgggctacggcgtcggggtgttcggcggccccgccccgggaaccgcgaaggtgcacgcgagcgccgggaagtggcggctggacgccgactggtcggcggtggagaccggtggcgccaccgccggtctcggcttcgactggcgcaaggtgaccgtggcggcgggccggacctccagcacgacgttcttcgcctcggcctggggaccggcgtaccacgtaccggagatgatgacgggcgccagcctcaacttcgacacctcgacgatgttccgggacccgggtaacgccgacgaattcgaggcgagcgagcggtccctggtcacgctcaccgacagtcggagccgggtggtgaagcagcagtggcggcagaactgggccgacggtgaccccggcttcatcgccaaggtcccggccaagggctggtacacgctgcaggtcaacgcccgccgctaccggcccggcatcacctacccggcggacctgctctcgtcgagctcgcaggcgatcttccgggtcagcctggatcccgaggcccggccgtacctcaccgacgtgcaactgccccgactggcgccggccggcctgaacctgaacaaccagggcacggccggcggcaccacggtggtgcagatcctgccggaccgccgctccgggaatccggacatcacggtcggccgggcgagcgcgatcaggacggtgacgctgctggcgtcgttcgacgagggccggacctggacgtcgatgccggtgaccggcagcggcacgacctggcagggaacggtcaccaacgcgatgagcgggcgggtctggctgcgcagccgggtcacctcggtcaacggcgcgtacggggaggtcaccatcgcccgggcgtacgccctgggctga

SEQ ID NO: 4868 - DNA, 585 bp, Actinoplanes utahensis
gtgcgtggccggccgccggtggaccgaaaccggcccgcggtggccgggcgggcactagcgtctgcggtgatgatgtcgcatcgggggctgctctggtacagcgtgctgtgcggggccggcgtgctgtgggcgggcgccctggtcgtggcgctcgcactcggccatcgtccggtggacaaggtggtcgcggtggggatcgccgcgctgttgacggtgccgggtttcgcggccggcgtgctggccaaccggcgggcctaccgcacgcagcagccgcgccggctgtggtccctggcgtcctgggtgccgccgcacgtgccggtctgggcggcgatcgcggccggggtggtcttcttcggcttctggttgacgatcgtgctggccttcgtcgcgctgcagggcaatccggaggtccgcgccgacggcacgtacgtgctggccgaccacgaccggctgaccgtggtggaccgcaccacctatgaccggcagttggatcacgagcagcagatctcgctggccgtgctgggcgccttcgcggtcggcggcgcgttcctgtgcgcggcccgggccaccgaccaccaggcctga

SEQ ID NO: 4869 - DNA, 789 bp, Actinoplanes utahensis
atgacaccgcaagccaccgtcacgttcatcggcaatgccaccaccctgctccggctcggcgagttcaccctgctcaccgaccccgcgttcgggcacgccggcagtcgtgtccacctcggttacgggatgtggaccaggcggctcatcgacccggcgatgaggttcgccgatctccccccgttggatgccgtcctcctctcccacctgcacggcgaccacttcgaccgggccgcccgccgcagcgtcccgcgtgatctgccgatcctcaccaccccgcaggccgaacgccggctgcgcaggcggcactgggacgcggcccgcgggatcccggtctgggacgccaccgagtggcagcgggccggccagaccctgcggatcaccgcactgcccggccggcacggcccggggttcgtcgaccggttgctgcccgacgtgatgggttcgctgatcgagtgggagcgcgacggcgagccgctgacccgcatctacatcaccggtgacacgctgcaccgcccgttcctctcggagatccgggagcgctgcggcgagatcgacgcgatgctcatccacctgggcggcacccggatcctggggctgctggtgaccatggacgggcggcagggcgccgcgctgaccggcctgatccggccgaaggtggcgctgcccatccactacgacgactaccgggtgatgaagtcgccgctcagcgactatctgcgtcgctgccgggagaacgtgcatccgctgcgccgcggcgaaacctacgacctgccgctgcgggtccgctga

SEQ ID NO: 4870 - DNA, 2334 bp, Actinoplanes utahensis
gtgtcaagtctgtcaagcctcgccgaggaacaattccacctcggcgtgctctacggccgtctcgacgagctgcgggcacaggcgcggaatcggctcgacgaagcccggcggcagggcggcggcctgccctcctggcggtcccatcgcgacgccgccacccaggcgtacgccgaacgcctcgcccggtacgacgccgtcgaaccgggcctctgcttcggccgcctccacctgcgcgacggcgacagcctgcacatcggccggatcggcctgcacgacccggaccgggcgctgctcgtcgactggcgcgctccggccgcccgtccgttctacaccgcgaccgcgatcaccccgcaggacgtcaccctgcgccgccacatccgcacccgcgaccgcaccgtagtcgacctcgacgacgagatcctcgacctcgacaccgccaccgaccggtccctggtcggcgaagccgccctcatcgccgccctgaccgccgaccgcaccggccggatgcgcgacatcgtcgccaccatccaggccgaacaggacgcggtgatccgctccgacgccggcggtgtcctcgtcgtccagggcggacccggcaccggcaagacggccgtggccctgcaccgcgccgcctacctgctctacacccaccgcgagcagctcgccgcccgcggcgtcctgatcgtcgggccgaacgccaccttcctccgctacatctcccaggtcctgccgtccctcgccgaaaccggcgtgctgctcgccaccctcggcgacctgtaccccggaacgaccgcgcggcgggccgaaccggcggaggtcgcggagatcaagggccgggcgacgatgccggaactccttgccggggccgtccgggaccggcagcggatcccggagacgccgctggagatcccggtggacgggcatgtcctgcggctcaccgccgcggactgcgtcacgccccgcgaacaggcgcgcgcatccgggctccggcacaatccggcgcggccgatcttcgccgccggagtgctgaccgcgcttgccgggcagatcgccgaccggatcggggacgatccgttctgggatgatccgctgggtggggacgatgcgctggccggccccaacgtcctcgatgaggacgacctggcggacatccgggcggaccttgccgaaaacccgcgggtccaggccgcgctcgactcgctgtggccggtgctcaccgccgctcgactgctgaccgatctgtacgcctcccggccggccctgctctccgccgccaccgaccccccacccgtcgccgcgcctgtcccggtgtccgaagggccagcggacgggggtgggccggtggccggaagactgctgagcgttgccgagtgtgcggcgctgtggcgggagccgggcggcggctggtcgcccgcggacgtgccgctgctcgacgaggcggccgagctcctcggcgaagacgaccgggacgcccgggccgcggccgcgcgggagcagtcgcggcggctcgcctacgcgcagggcgtcctggacatcacggccggatccaagtcgttcgagctggaggacgacgacgaggccgcgatcccgaacgccgccgacatcatggaagccgacatgctcgccgaacgcttccaggaccgggtccacctgtcgaccgccgaacgcgccgccgccgaccgggaatgggtcttcggccacgtgatcgtcgacgaagcccaggaactctccccgatggcctggcgcctcctgatgcgccgctgcccgagccgctccatgaccatcgtcggcgacctggcccaggccggcagtctcggcgcccccaccacctggtcggaagtcctcaccccgtacgtggccgaccgctggcgcctggccgaactgaccgtcagctaccgcaccccggccgagatcatgtcctacgccgaacgcctgctggccaccgtcgaccccacgatcgtcccgcctcgcccggtccgctccaccggcgtggcaccgtgggaagccaccggcaccctcaccgacctggccgcccgggtcaccgccgacatcgacgcgttggccggcggccgcctggccgtgatcgccccggccggccaccaggcagccctggccgccgccctgccggccctcaccaccggcccgtccccggacctggaggatcacgcggtcctgctcaccgtcgcccaggcgaagggcctcgaattcgacaccgttctcgtcatcaaccccgcggagatcctcaccgactcccgccgaggctcccacgacctctacgtggccctgacccgccccacccggaacctcggcgtcttcactctcctaccccgctga

SEQ ID NO: 4871 - DNA, 621 bp, Actinoplanes utahensis
atgacgtacgggtggatggacctaccggccgaagccgtcgacgaggcggcccggcaacttctcggctggcacctgaccgccaacggcgtgaccgcccggctcaccgaggtcgaggcctacagcggcctgggcgcggacccggccagccacgcccatcgcggcctcaccaaccgcaacgcggtgatgttcggcccggccggccgcctctacgtctaccagatctacggcatgcactactgcgcgaacatcgtctgcggcgaatccggccgggccgccgcggtcctgctccgcgccgccgccatcgtcgacggccacgacctggcccgcgcccgccgccccgccgcccgccgcgacaccgatctggcatccggcccggccaagctcatgcaggtgctgtccctcgaccgggccgccaacgacacctcggtcatcgacggatccgggccggccaccctcaccccgccggccggcgcggtgggcgccgtcgcagccgggccccgggtgggcgtgacctcggcccatgatgtgccctggcgtttctggctcgccgacgatccgacggacagtgcctaccgccgccacacgccgaaaccgcgggccgtgcggcccctcccccgctga

SEQ ID NO: 4872 - DNA, 1005 bp, Actinoplanes utahensis
atggcgcaggggcacaacggggatggcgcgcccgacccggagacggtcgtggcgggggtggccgagtcgcggccggtcgacgcggaggtcatcgaggcgctgcgtgcggccaccgcgcaccgggatggtgcggccgaggtggcggatccggcggagccgtccatcctggacgccgagccggaagccgccgagcccgaagctgccgaacccgaagctgccgagcccgacggcgccgacgccgcgacggtgccgccggaggtcggcggcaccggactcccgcgtaccgccgcgatcgggaaacgctggggcgcgctcatcgccggcgtgctggcggtcgtcctgctggttctgatcggtctggcctgcagcggggtcttcacctccgccgctccgcccaccccgctgccgtccgcggatcccctgaccccgagcgctccgggcagttccggcctgccggccacgccgaaggccgcggtccatccggcccgcaccgccggcgacctggaccaggtgtgcggcgggaccttcttcccggcctcgccgaagtatcagggccggggtccacatccgattctgatcagcgcccgcgagcggctggatctgaccgaccgggcgactcgcacgttgcaccgtttcgccttcgcgggcgcggcgagcggcaagctgacctgggcgccggccgtgccgaaggtgcagctggtcgcctgtctcgatctggccggtccgggtgccaggctccgggactgtccgggtgacacggcgaagtccccgaagctgccactggtggtcggcaggtatcggctgaccgtggtcgaggtggcgaccggccgcaccgtcgcggagtccgagctgaccggggccgggaagtcctgcccgtgggtggcgatgaccggttctgacaagacgctgtattcgtcggtggacgacaaccagctctatcgggcgttgaaagccccggtcgctcaggcgattcccgggtcggcccagccgagaaagcgttcgtag

SEQ ID NO: 4873 - DNA, 252 bp, Actinoplanes utahensis
atgctggtgccgcgcaccgaacacgtcggggaacgcccctcgtgggactgccgggtctgcggccgtccctggccgtgcgccaccgccaaagtggaactcgccgagcagtaccaccacttctcgcacggcctgtcggtctacctcggatcctgcatgatcgaagccatcgacgactgggccgccggcaccggcggcccgcccgccgacctctacgaacgctttctcggctgggccgacccgggaatcgcctga

SEQ ID NO: 4874 - DNA, 864 bp, Actinoplanes utahensis
atgtcgacggtacccagacggcaggtcggccggctgctccgacagttgcgcgagcaggccggcatctcgctgatggcggccgcgcaggagctggagttctcccgggcccggatgtaccggatcgagaacggtgaggtcccggtccgcaagcacgacgtgatcgccatgtgcggcgtctacggcgcgcccgggcacatgaccgaggtgctgatcggcctggcgcaggagtcgaaggcgaagggctggtggcacgcgtacggcgatgtcgtcccggcctggttcgagctctacgtcggcatggagcagggtgcctgccggcttcggcagtacgcgccgagcgtgatcccgggcctgctgcagacccgggagtacgcggagttcgtcttcggtcgctggctcggcgacgacccggtcgcggtggagaacgcggtggcggtgcggctggagcgccagtccctgctgcagcgcagtcgcccccgggcgccgcgcctggaagtgatcatcgacgagggggtgttgcggcgcggcgtgccggacaccctgggcatgcagaagcagctcgcccacctggtgaacgtctccacccggcagaacgtgagcgtccgggtcctgccgttcgcggccggcccgcaccaggcgtccagttccggccagttcaccgtgctggagttcccggcggtcggcacggcctccccggaaccgacgaccatctatggcgagaacctcaccggcgcgctctacctggataagctcgccgaggtcgagacgtacgagcggatctggtccgcgctcgacgcgatcgccctgagccagtccgactccgatgacctcatcggcacgatcatcaaggagagcgatggctga

SEQ ID NO: 4875 - DNA, 213 bp, Actinoplanes utahensis
atggctgacctgtccggtgccgtctggcacaagagcacccggagcggcggcaacgggggtgactgcgtcgaggtggccggcaacctcccgggcatcgtggcgctgcgggacaccaaggatccggacggggcgacgctgatcttctcccgcgagcagtggcacgccttcctggccggggtccgggccggcgagttcgaccaccgggcacgctga

SEQ ID NO: 4876 - DNA, 735 bp, Actinoplanes utahensis
gtgtcgctctccgctgccgcccgtttccgatacacactggtggcgggctcgacagccgtggtcatcggctccggattcatcctgatgggcctcggtggcccggactccgcgcaggccgattcccgctcggccgacgttccgctcgcggccgccacgaccgccaccgccgccgcgaccgcctccccgggcgccgccgtcgagccgtcgaaggccacccccggccggaccgcctccgcgtcccccgcgacggcgcggacctcggccacgccacgtccgaagagcagcaccatcaaggtggcgaccggcaccaccaggtccgactcggcgacggtcctggacgcggtggtggcgcacatcaacgcggcccgcgccgacgagggactgcccccgctgaccctggacgcgcagctctcgaaggcgtcggcgaagcacaacgcgctgatgatcgacggttgcggcctggagcacaactgttccggcgaggccggcatcggcacccggtacgtcggcgtgcagtggcacaccgcgggggagaacatcggctacgcctccacccggagcgaggccgagacgatcgccacggccaacggcatcaccgactcgatgctcgccgaggtggcccccaacgacggtcaccgcaggaacctgctgaacaaggacttcaccaggatcggactgagcgtcgtccgcgacggcaagggcctggtctgggtgacgcaggacttcgtcggctga

SEQ ID NO: 4877 - DNA, 555 bp, Actinoplanes utahensis
gtgagacggtccgcggccaagcgtgtcgaggtgctggccgcggccggtgaggtggtcgcggcccgcggcgccgatgccacccggttcgccgacgtgagtgcggccaccggggtcggtgtctccaccctgcagtattacttcggcacccgcgaggacatgctgatcgcggtcttccggcacgccgccgagcgtgacttcgagctggtcggcgagcgtctggccgggctgaccgacccgtgggaccggctgctggccatcgcccggcacctcggcagtgacctctcctggcggctctgggtggagagctggcgctgggcgtcacgggacgccgaggtccgcgcggacgtgctcgccgactacacccggtggcgggagctgatcgcggccaccatcgaggcggacaacccgatgcgggtggcccggcaggtgctcgccctgatcgacgggctcgccctgccggtggtgctcggcgacccggccgtcgaccgggccgccgcgaacgagctgctggaggaggcgttagcccggctgctgggtcgtgccccggccctctag

SEQ ID NO: 4878 - DNA, 1035 bp, Actinoplanes utahensis
atgacgcgttatggaccgatgttcgggccggactacacgttcctcggcatccccgcctgcgactggcgggagccgtcgacctacgcggacgccgacgtcgtgatcgtgggcgcgccgttcgacgggggcacctcgcaccgccccggcgcgcggttcggcccgcaggtcatccgcggcaccgactacctggcccacgacggcacccgcccgcacatggcgatgcgggtcgacgcgctgggcgccgacctgaccgtcaaggacgccggcgacgtcgaggtgttcagcggggagatcgagcgcagctgccgcagcatcgaggaggcggtcgggttcatcgcccggcacggcgcgatcccgctggtcctcggcggcgaccacaccgtcacctggccggacgtgaccggggtggccggcgcgcacgccgcgagcagggtctcggtgatccacttcgacgcgcacgccgacaccggggacatcgagttcggctcgctgtacggccacggccagccgatgcgtcggctgatcgagtccggcgcggtccgcggcgaccggttcctgcaactgggcctgcgcggctactggccgggtccggacatcctggactggatggccgaccagcggatgaactcgttccacatgagcgagatcgtcgaacgcggcctggacgcggtgctggacagcgcgttcgccatcgccctggacggctgcgacggcgtcttcctctcggtcgacatcgacgtctgcgacccgggccacgcgcccggcaccggcactccggagcccggcggcctgaccgcccggcagctgctcgacagcgtctcccggatctgccacgagctgcccgtggtgggcatggacatcgtcgaggtgtccccgccgttcgaccacgcggagatcaccgcgatgctcggcaaccgggtggtgctggaggcgctgtccgggatggcgcggcgccgcaaggacggcgacgggccccggtggaagcggtcgacccccctgctagagggccggggcacgacccagcagccgggctaa

SEQ ID NO: 4879 - DNA, 516 bp, Actinoplanes utahensis
gtgctcgaaatgctgatctccttcctccggaaaatcctcggcggcccgaccgaggcgcccacgcggtcgggcgtgtccaagaagcccgcggccccccggcccccggccccgcaacctcgccccccgcgtcatctccccacccgggaccgcggccgcaccatcgactacgcccccgacctcgacggcgacgccgaccccggcgagatcgtctggacctgggtcccctacgaggacgacccgtcccagggtaaggaccgtccggtcctggtcgtcggccgcgacggccgcaccctgctcggcctgatgctctccagccagagcgaacgcgacggccagcgcaactggctggcgctcggcgccggcgactgggaccgcacccagcgtcccagctggatccgcctggaccgggtcctggaggtggacgaggacggcatccgccgggagggcgcgatcctcgaccgggaccgcttcaaccgggtggcggccacgctgcggagcgaatacggctgggcataa

SEQ ID NO: 4880 - DNA, 864 bp, Actinoplanes utahensis
gtggttcggcgagccgggcccggccgagcgggaggccggtctgcccggcgagttcgtcccggaggagaccaccgtgctggtcgccgagcgcgacgtgttccgggtggccggagcctggagcatcgacccgaccacgctgaccggtcccgcccccggccccctgcggatcggcgcggcggcctgaacgagacggaggccgaccacatgcgcaagtacgtgatcatgggcgtgcagggcagcggcaagggcacccagggccagctgctcgcccgcgacctggacctggtccacatcagcgtgggcgacatcttccgctggcacgtgcgcaaccacaccaagatgggtgcccaggtcaagcggatcatggcggccggcgagctggtcggcgacgacctggtcgagtcggtggtccgcgaccgcctgcaccagcacgactggaactacgggttcgtcatcgacggcttcccccgcaacggcccccaggccgagttcttcatggagagctacgacctggacgcggtgatccacctggagctgcccgacgacgaggtgcgccgccgggtgctcagccgccgcctgtgcccgaactgcgggatggactacaacctgatcgccgaccgccccgagcaggagggccgctgcgacatctgcggtcacgagctggtcacccgggccgacgacacgcccgaggcgctcgaggcgcggctgcgcgactaccacgagaagacccgcccggtgctggagctcttccagcgtaaggaggtggtccacgacgtcgacggccggccgccggtcgacgaggtgcagaacgcgatccgcaagaccctcggcctgccgccgcacatcccgcaaccggaccgctga

SEQ ID NO: 4881 - DNA, 1425 bp, Actinoplanes utahensis
atgcatttgacgttagatacggtcgatcttagcgtcgtttccatgagacgtgagagattcaccctggtcctcatgtgcgcgaccgtgctggccctgcaggccctggtcgcgggcatcaacctggccatcccgcggctcgccgcgagcagcctgcacccgggcccgggcgatctggtctggatcgtcgacgcgtatgtgctggccttcgccggcctgctgatcccggccggcgcgctcggcgaccggctgggtcgcaagggcgtgctgctcgccgggctggtcctgttcggcgtcgccaacctgatcagcgcgtcggcgcaggacgtcgcggtgctgcaggccggccgggcgctcggcggggtcgccgcggcgctggcccagccggccaccctggccctgctgctgcacgccacccggccggaacgccggccgcacgcgatcgccctgtggaccgcctgcatgggactgggcgggatggccggcaacctgatcgccggcgtggtcctgcagtattccggctggccggtcctgttcctggtcttcgtcccggtggccgcgctgctgacggccggcgtcgcggtgtgcgtcccgcgggcgccgcggcacgacgcgtcgatcgacccgctgggcacggcgctgctcaccggcggtctcttcgcctggctgtacggcatcgtcgaggggccggagcggggctgggccgacaccgtggtgctgtcctcgttcgccgccggggcgctgacgctggccgcgttcaccgggtacgcgctgcgggccgcgcggccgctgatcgacccgcgggtcttccgggtccgcacggtccgggccggcgcgttcggggtcggcgcgaccttcttcgcgctgttcggcctcttctacgtcaacgcgcagttcctgcaggacgtgaaggggtactcgccgctgctgaccgggctggcgatcgggccgctggcgatcggcatgggcgtcgtgtcccggcgggcggtcccgctcacccagcgctacgggccgcggccgatgatcgcgatcgggctcggtgcgatcgtggccgggctcctgctgctctccaccgtggacgcggcgacggcgtacccggtctacgccggatatctgttgctgatggcggccggcatgggactgtgcgcgccggcgctgaccggcgggatcctggccgggctgccggcggcgaacgccgggctcggctccgggctgaactcggcggcccgggaggtcggcgcggcgctcggggtggcgctgatcggcacggtcctcgccgagcaccacgcgctgcggtccccggccgacctggtgagcggcctgaccgtcggctaccggatcctggccgcgatcctggccgccgccgcggtgatcgtggtccgcacctggccggccccggcacaccgcgcggagcccgtcgccgcgtga

SEQ ID NO: 4882 - DNA, 942 bp, Actinoplanes utahensis
atgcatgcttcacaaggaaagattgcgtcgtacgcaatgaatctggatctgaatcttctgaccgccctggacgccctgctggaggagggcagcgtcggtggcgcggcccggcgcctgcacctgtccgagcccgccaccagccgtgccctgggccggatccgcgccgcgatcggcgacccgatcctggtccgctccggccgccggatggtcctcaccccacgcgccgtcgaactgcgcaccgaggtgcgcgccctggtcgagcgcgcccaggcggtcttcactccgcccggcccgcccgatccggccaccctgcagcgggtcttcaccgtgctcgccgacgacgtggccaccgccctcggccccgaactgctggcccgggttcagagcctggctgctggcgtcaccctgcggttcctcggcgaggacccggcgtcggacggcaccgtgcagctccgcgacggccgggccgacctggacatcggcgtggtcgacgacgccccaccggagatcaccgtcgaaccgctgttcaccgaccggatgaccgcggtcgtccgggccggccacccgctgctgcgcggcccgctgaccccgcgccgctacgccgaggcggtccacgtcagcgcctcccgtcgcggcagactcaccggcccgatcgacgaagccctggccgaacacggcctgacccgccgggtggcgctggccgtccccaccttcggcgccgccctgatcgtcgtcgcccgcaccgacctggtcggcctgatgcccgcccgcctcggccgccccgccatcgacgcgctcggcctgatcgccgtcgaccccccgatcccgctcccgcccaaggagatcgccatggcctggcaccagcgctacaccgccgacggcacccacgcctggctccgggcccgcgtccgcgaaaccatcgccagcctcgccgccacctga

SEQ ID NO: 4883 - DNA, 762 bp, Actinoplanes utahensis
atgtacgcggaggaacgccagcaggagatcgtgcggcgcgcccgggccgaggggcgggtcgacgtggtgacgctggcggacagcttcgcggtcaccgcggagaccatccggcgggacctgaccgtgctggagcgggccggggtgctgcgccgggtgcacggcggggcgatcccggtggagcggctcggcttcgagcccgcgctggccacccgggacgccgtgctgatcagtgagaaggagcggatcgccaaggccgcgctggccgaggtgccgcaggacggtgccatcatcctggacgccgggacgaccaccgcccggctggcccagctgctgcccgccgaccgggagctgaccgtggtggtcaactcgccggtgctggccgccatgctcggtgtcaagccgaacctgtcggtgctgctgctcggcggccgggtgcgcggcaagacactggccaccgtggacgactgggcgctgcggccgctgtccgagatgtatgtcgacgtcgccttcatgggcaccaacggctgcaccgtcgaacgcggcatgaccacccccgacccggccgaggcggcggtcaagcgggcgatgatcgccgcggcgcgccgggtggtgctgctcgccgaccacaccaagatcggcaacgactatctggcccgtttcggcggcctcgccgacctggacctgctgatcaccgacagtggcctggaccacgagctggccgccgaggtcgaggcggccggtgtgcggatggtgcgggcatga

SEQ ID NO: 4884 - DNA, 942 bp, Actinoplanes utahensis
atgatcctcaccgtcaccctgaatccgagcgtcgaccgggcgctggaggtcgatgccctgctccgcggtgaggtgttgcgggcggtggattcgcacatcgacccgggcggcaagggggtcaacgtgtcacgcgcgctgctggccaacggcgtccggtcgaccgcggtggtgccgaccgggggcgcggagggggagcaactggtcgaccttctgcgaggcgagggggtggacctggtggccgtcccgatcgtcgggcggacccgttccaacatcacgctggccgagccggacggcacggtcaccaaggtgaacgaggccggcccgaccctgtcggcggccgagttcgggcaggtcagcgatgcggtgctgaccgccgcccggtcggccggctgggtggtgatctgcggcagcctgccgcccgggccgtcggtggccgacttccaggcgctctgcgagcggctggtggcggccggggtgcggctggccgtcgattccagcggcccggggctgcgggccggggtgaccgccggcgcggccctggtgaaaccgaaccgggaggagctggccgaggcggccggcaccgaactggcgacgttcggtgacgtgctggaggcctgcgagcggctgcgcaaggcgggcgccggcgcggtgctggccagcctcggcgcggacggtgcggtgctggtcgaggagtccggtgtgctggccggccggtccccggccggtgtgccgcgcagcacggtcggcgccggggacgccctgctggccggtttcctggcagccggcgcacggggggcggacgcgctgatcgagggcctggcctggggtgcggcggcggtcagcctgccgggcagccggatgccgggaccgcgcgacctggaccgttccaccatccacatcgaccacgatccggacccggcccggcccctcggccgggactga

SEQ ID NO: 4885 - DNA, 1113 bp, Actinoplanes utahensis
atggcctctacgtacacccccgaggtcaccggcggtggtttccgtgccgcggtgcagaaactcggcggccacctggccggcatggtgatgccgaacatcggcgccctgatcgcctggggcctgatcaccgccctgttcatcccggtcggctggatcccgaacgcgaacctggcgcagctcgtcgacccgatgatcaagtatctgctgccggtcctgatcggttacaccggcggccgcctggtgcacggccagcgcggcgcggtggtcggcgcgatcgccaccttcggtgtggtggtcggcgcggacgtgccgatgttcctcggcgcgatgatcatcgccccgctcaccgcgtacgtgctccggctcttcgacggcgccatcgagggccggatcaggcccggcttcgagatgctcgtcgacaacttctcggccggcatcatcggcgcgggcttcgcgatcctcggcaagctggcgatcggcccggtcgtcgacgggctgaccaaggcggccgggaacgccgtcgactggctgctcgcgcacagcctgatgccgctcgcctcgatcctcgtcgagccggccaaggtgctgttcctgaacaacgcgatcaaccacggggtgttcggcccgctcggcgtgcagcaggtgcaggagcacggcaagtcgatcctgttcatgatcgagtcgaaccccgggccggggctcgggctgctcaccgcgtatctgttcttcggcccgaagtcgctgcggcccagcgcgccggccgcgatgatcatccacttcctcggcgggatccacgagatctacttcccgtacgtgctgatgaagccccgcctgatcctcgcgatgatcgccggtgggatgtccggggtggcgaccttcatgatcaccgggaccgggacggtggcgacgccggcgccgggcagcatcttcgcctacttcgcggtgaccgccaagagtggctatctcggaatgatcctcggcgtgacgatcgccgcggcggtgaccttcgcggtggcgtccgcgctgctcggcttcggcaggctgaagtccgaccaggagctcgacgagcaagccgaacccgcgccggcggaagtcgcccctcagcaagcctga

SEQ ID NO: 4886 - DNA, 309 bp, Actinoplanes utahensis
gtggccaccatcaacggcaaggacatccacaagctggtcgtcgcctgcgacgccggcatgggcagcagcgtcatgctcgccagcacgctgcgcaaacagctcggcaagaccggcgtgacggtcgagcacaccccggtcaactccatcccggccgacgccgacctggtcgtctgccacagcggcctggccgcgcgggcccggtccatcgcccccggcaaaccgatcgtgccgttccagatcttcctcggcgacccggcggtcaccaaggtggtcaaggccatccagcagggcaccgatctccatgtctga

SEQ ID NO: 4887 - DNA, 444 bp, Actinoplanes utahensis
atgtctgagctgctggaccgccgggcgatccggctggccgagacggcggcggaccgcgacgacgcggtccgccgcaccggccgggcgctggtcgagatcggcgccgccgacccgggctacgtcgacacgatgctggcccgggagcggtcgatctccacgtacgtcggtgccggcgtcgccatcccgcacggcaccctcgacggcaagaacctggtccaccgggacgcgctggcggtgctgcggttcccggagccggtcgactgggacggcgagccggtcaccctgtgcgtcggcatcgccgccaagggggacgggcacgtcgagctgctcgccgccctcgccgagatcctgctcgacgaggaccgggcccgcgacctgcgggacgccaccgacccggacacggtgatccggctgctcgcttcgatcaaggaggagtctgagtga

SEQ ID NO: 4888 - DNA, 1032 bp, Actinoplanes utahensis
gtgaaggtcgtacgattccacgctcccggcgacgtccgtttcgaggatgtccccgagccgcaggccgggccgggcgaggtgaagatccgggtccggaactgttccacctgcggcaccgacgtgaagatcgccaagttcgggcatcaccacatccacccgccgcgggtgatgggtcatgagatcgccggagaggtggtgcagggtacgggtgactgggtgccgggcgaccgggtccaggtgatcgcggccatcccgtgcggcgagtgcccggactgccggcgcggccggatgaccatctgcccgaaccaggtgtcgatgggctaccacttcgagggcggcttcgcgcagttcatggtggtgccgcaggaggtcctcaaggtcgacggcctgaaccggatcccggacggcgtcacgttcgccgaggcgtcggtggccgagccgctcgcctgcgccctgaacgcgcagaacctggcccgggtcggcgacggtgacgacgtcgtggtgatcggttccggcccgatcggctgcctgcacgtacggctggcccgggcccacggcgccgcccgggtgttcctggtcgagctcagccgccagcggctggacatggccgcgaacctggtcaagccggacgccgcgatctgcgccgccgaggtcgacccggtcgaggcgatcctcgggctcaccggcgggcgcggcgccgacgtgatcatcacggccgcggcctccggcacggcgcaggagcagggcatccagatggccgcccggcagggccggatcagcttcttcggcgggctgcccaaggacaagccgaccatcacctgcgactcgaacctggtgcactaccgcgagctgaccatcgtgggcgccaacgggtccagcccggcgcacaaccggcaggccctggaactcctcgcctccggcgcggtcccggtcgccgacctgatcacccaccggctgccactggacggcgcgatcgacgcgttcggcatcgtcgagcgcggcgaagccatcaaggtcaccatcgagccctag

SEQ ID NO: 4889 - DNA, 276 bp, Actinoplanes utahensis
atgcccacacgtacggtcgcggtcggttccgccagcggactgcacgcccggcccgccaagatcttcgtggcggcggccgcggcggcgccggtcagcgtcaccatccgggtcggtgagcgcaagccggtgccggcgagaagcatgctgtcggtcctggcgctcggtgcccggcggggcaccgaggtgaccctggaagccgacggggacggcgccgagcaggccctcgacacgctcgccgcactgctggcgaaagacctggacgcggacgatgcctga

SEQ ID NO: 4890 - DNA, 1590 bp, Actinoplanes utahensis
atgcctgaggtgacggtgctcaccgggatcggcgtctgccccggcgtcgccgccgggccgctgctgcgcatcgccacggcgccggcgcttcccgcaccggttgcggtcgccgatccccgggccgagacgattgccgcgtacgccgccatcgccgaagtcgtcgcggacctgacccggcgagcggaccgcgccaccgaggccaccgtggccgacgtgctccgcgccgaggcggccatggcggacgacgaggagttgcgcgacgccgtccgggaccggatcgagggcggggccgacgcgccgcacgcgatccacgccgcgttcgcgacgttccgcgagatgttcgccgaggcgggcggctatctcgcggaacgggtcgcggacctggaggacctgcggaaccgggcggtggcggtgctgctcgggctgccgatgccgggggtgccgcagccggggcatccgttcgtgctggcggcgcgggacctggcgccggcggacaccgcggatctcgatccgtcgcaggtgctggcgctggtgaccgaggtcggcgggccgaccagtcatacggcgatcctggcccgggcgctggggctgcccgcggtggtggcgtgccggggggtgctcgacctgcccgggaacagtgtggtggaggtggacggcgggaccgggcgcgtgacgaccggcgacttcgacgtccgattcgcgcccggaaacgcggagaaatcgatgctgagcggcccgggggccacctcggacgggcacgcggtgacactgctggcgaacgtgggatcggcgaaggacctggccgccgccggggaggcgcacgccgaggggatcgggctgttccgcaccgagctgctcttcctcgaccgcaccgcggagcccacgatggacgagcaggtgaccgcgtaccgcgacgtcttccgcgggatggccgggcggcgcgtggtgatccgcaccctggacgccggcgccgacaagccgttgccgttcctgcaccaggacggcgagccgaacccggcgctcgggatccgcggcctgcgcgtcgcccggcagcgcccacaggtgctgaccacccagctcgctgcgatcgccgcggccgccgccgacaccggggcggacgtgtgggtgatggccccgatggtgtccacggtggccgaggcgaccgggttcgcggccgccgtgcacgcggccgggctgccgaaagcgggcgtgatgatcgaggtgccggccgccgcgctgcgcgccgccgacctgctgcgggtggtcgacttcctgagtatcgggacgaacgacctgagccagtacacgttcgccgccgaccggatgtgcggcgacctggccgagctgctcgacccgtggcagccggcactgctgcagctgatcgggatgtgcggggaggccgggcgggcgaccgggaaaccggtcggcgtgtgcggcgaggcggcggccgatccgcggctcgcgccggtgctggtgggcctgggcatgaccagcctgtcgatgtcgccgcgggcgcttcccgcggtgcgcgcggcgctggcgaatcacacgtacgccgcatgccgtgccctggcggagaaggccgggtga

SEQ ID NO: 4891 - DNA, 504 bp, Actinoplanes utahensis
atgagcaagtatctgatcagcgctgccgccgtggtgctggggctggccggcaccgccggggcagccctcgcgaccgagccggcgccgaccaccacagccgcacccgcggcgacccgggcgacggcgccgcagaccgccgtcacgacgaagcaggcggtcgcggtcgtcgtcgtccgcaccggcggcggccacggcggccagtccgtgttcaccctggtcggcgcggccaaccgggaggaggccgaggtgctgcacctggcctccacgccggagttccaggccctgcggccgaggtacgcgccggcgcacccggcgagcggccggtacacgtaccggatcgaggcgggctaccgcgacaagaccaagaagcgggtgctcgtcgtggagggcacgccgggcacgccgaaggtcgcactcgacgtgatccggatgatggtcgacgtgcccgcccccgacctgtcccacctgccggtccagttcccgcccggcttcccgttcaactga

SEQ ID NO: 4892 - DNA, 753 bp, Actinoplanes utahensis
atgggtcacctgggtagcgcggaaccgccgatcgagatcggtaagaagaaggccgaggcgcggctggccgaggcgcagcagcggctgctccggttgcggctgctgctgggtgggcagatcggggagccgaagcagatcgggccgccgctgtgcgtgctgttcgagggctgggacgcgtccggcaagggtggggcgatcaagcggctggtggcgccgctcgatccgcggcacgtgcgggtgtcgcagttcgcggcgccgacgtacgacgagaagcggcaccatttcctgcagcggttctggaccgtgctgcccgggtccggcgggatgaccgtgctggaccgttcctggtacgggcgggtgctggtcgaacgggtcgaggggttcgccaccggggagcagtggcagcgggcgtacgacgagatcaacgagttcgagcgcacgctgaccgccgagggcatgatcctgatcaagttctggatgcacgtctcggacagagagcagctggaccggttccaggatcgggccggtgacccgctgcgggcctggaagctcaccgacgaggactggcgcaaccgggagaagcgggacgcctacgcggaggcgatcgaggagatgctggaacgcaccgaccggccgaaggcgcgctggcacgtgattccgggtgacgacaagcagtacgcgcgcttcgccgtggtggagcgggtgtgtcacgtggtggagaagcggctcgccaagctagggcggttatcctga

SEQ ID NO: 4893 - DNA, 1257 bp, Actinoplanes utahensis
gtgactttcgtagacgatctgatgtggcgcggactgatccaggactcgaccgaccccgacgagctgcgcaaagccctcgacggcggctcgatcacgttctatgtcggcttcgaccccaccgccgcctcgctgcacgtcggtcacctcatgcaggtcctcaccgcgcgccgcctgcagcaggccgggcaccggccgctgctgctggtcggcggcgccaccgggcagatcggcgacccgcgcgagtccgccgagcgcactctcaacccgccggaggtcgtcgagagctgggtgcagcggatccgcgagcagctcgcgccgttcgtcacctacaccggcgacaacgccgccaccctggtcaacaacctggactggaccggctcggtgtcggtcgtcgacttcctgcgcgacgtcggcaaacacttcccggtcaacaagatgctggcccgcgacgtggtgcgcaaccggctggagagcgggatcagcttcaccgagttcagctaccagctgctgcagtccaacgacttctacgagctgcacgtgcggcacgactgccggctccagttcggcggctccgaccagtggggcaacatcaccgccggtgtcgacttcatccgccgtcgcggcgccggcccggtcaacgcgttcgtcaccccgctggtgctcaagtccgacggcaccaaattcggcaagaccgagggcggcgcggtgtggctcgaccccgccatgaccagcccgtacagcttctaccagttctggatcaacagcgacgaccgggacgtcagcaggtacctgcggtacttcagcttcaagtcccgcgaggagctggaggaactggagaaggcgaccgccgagcgtccccaggcgcggctggcgcagcgcgccctggccgaggaactcaccgcgctcgtgcacggcgaggaggaggcccggcaggcgatcgcggccagccaggcgctcttcgggcgaggttcgctcgacgaactgtccgccgacacgttgcgcgccgctctggccgaggccggattgctggcggtacgcggtgagctgccgccggtcggggtgctgctgaaggaggccgggctggtggcgagcgcgaacgaggcccgccggacgatcagcgagggtggcgcctacctgaacaacgagcggatcaccgacgctgaggcgacggtgccggccgccgcgctgctgcacgggaggttcctggtgctgcgacgagggaagcggaccttcgccggtgtcgaactgacggcctga

SEQ ID NO: 4894 - DNA, 1008 bp, Actinoplanes utahensis
gtgcgctcggagctgaccgcgctggcccgggacgtggccgacaaggtcgcccggcacctggtggcggccggcacgatcatcgacgaggactccgaggtcgccctgcagcacgctatcgcggcgcgccggctggcgtcgcggatcgcggtggtgcgcgaggcggtcggcctggcggcgtacgcggccggcgactggaccacggcgatcgcggagctgcgcacctaccaccggatgaccgggcggcagacgcacctggccgagatcgccgactgcgagcgggcgctcggccgtccggagcgggcgatcgacctgtaccgcggcgccgacatggcgaagctggagaagtccggcgcgatcgagctgctgatcgtggcggccggcgcccggggtgacctcggccagcacgacgcggccgtggcgatgctccaggtcaaggaactgaccgcggaggagaccgcggactgggcggcccggctgcggtacgcctacgccgacgcgctgctcgccgccggccggcgtgacgaggcccgcgagtggttcgtccgggccgccgccgtcgacgaggaccagctcaccgatgcggccgagcggatcctcgaactcgacggcgtggtcatcgagggcgacgacgaggacgacgaggacctcgacgacgatgcggccgaggacggcgagggcggcgacgtcagggcccggtccggcgccgatgacgacgaggaccgggacgacgacgaggacgaggacctcgacgacgaggaccgggccgactcggacgaggacgacgacttcgacgacgaagacgacgaggacgatgacacggacgaggcggacgccgagccggtcaccgtggccgagaccgacgtcaacaccgacgccgtgaaggccgacaagcacgaggttccggcggccgtgttcgaggcgcccccggccggcaaggccgaggacgaggacgacgagaagggcggcgacgagttcgacagccgcccggacgaccggccgcgggcatga

SEQ ID NO: 4895 - DNA, 999 bp, Actinoplanes utahensis
atgaccgaccacctcgccggcggttacgacctcgccatcttcgacctggacggcgtcgtcttcctgatcgacaagccgatcccgggcgcggccgaggcggtcgagcggctgcgcgcggacgggacgtcgatcgcgtacgcgacgaacaacgcgtcccgccgggccgccgatgtggcctcgctgctcaccggcatgggtgtcagcgccgcaccggccgaggtgctcacctcggccggcgcggccgccgcgctcatcgccgagcacgtgcccgccggttcgccggtgctggtggtgggtgccgaggcgctgcgtggcgaggtgcgggacgccggcctgaccccggtcgagtcggcggacgagtcgccggtcgccgtggtgcagggctacggccccgaggtgggttggcggatcctgtccgaggcggcactcgccgtccgggccggggccacctggtacgccaccaacaccgaccggaccctgcccagcccgcgcggcccgctgcccggcaacggctcgctggtcgcggtgctgcgcacggccctggaccgggaaccggacgtggtggtcggcaagcccgagcccgccctgttcaccaccgcggcctcgctcgcgaaggcggagcggccgctgaccatcggcgaccgtctggacaccgacatccagggggcggtcaccgccggcatggacagcctgctcgtcctgaccggggtcagcgggccgagggaactgctggaggcaccggccgaacggcgcccgaagttcgtcgccgccgacctgtccgggctgttccgcccggccggtcaggctgcggtgccggccgccgaggtggacggctggtcgctggaccgggacggtgaccgggtcaccctgaccggctccggcgacccggtcgacgcactgcgcctgctgtgcggggccacctgggacggcgtcccggccggtaccgtcagcgccggctcggccgcggccaccgaactgctgaaatcctggggcctctga

SEQ ID NO: 4896 - DNA, 231 bp, Actinoplanes utahensis
atgaatcacgtccgccccgacgttccccagatcgacggcacctgcaccggtgagaatgtgcatgagagagccgagcgggtcgcggtgcccgatttcgactacatgagctcgccgatggtcgccatggtcgacggcatcttccacatcgatccggatgccccgccgctgccccggcgtcatcaccgaccgcgcccggcgcagtaccacaccgacccggtgcaacccttctga

SEQ ID NO: 4897 - DNA, 1281 bp, Actinoplanes utahensis
gtgacttcgcttacgttgccacgcggcgcgcggctgtccgatgcctcctggcgtgcccggcaccggatcatcagccggctgctctggtgccacgtcccggtcttcctggtggtcggcatgctcggcccgcgcccccgctgggaggtgttgatgctggtcgcgggcgtcgccggctgggccgcgctgatcccggtcatgcccaaccagcaggcgcaggcgtcacacaccggcgtcgggttgatcgcctgcacgttcgtggcgatcgagctgtccggcggatcgatgaccgcccacatccacctgtacgcgatcctgatcttcgtggcgctctaccagatgtgggcgccgctgatctgcgccgtgctggtcgtggtggtgcaccacggcgtactcgggctgatcgcgccggaacgcgtgttcggcatgcaccacatgggtgtcgggtccgcgatcgaacaggtcgccgtgcacgccggcctggccgccgtcgaggtcgccggaatcgtcgtcttctggcacttcgccgaacaggccgagcgggagaacgagcagctggcggccgaagccgcggcggcccgggaggagaccgaacgggccgagcgggaagccgaccaccgggctgccgaagatctgcggctgcgctccgcggaggccgccgcccaggcccgccggatcagcgaggacgtggcgtcgatcagcgcgcaggcgcacgcggcgatctccgcggtcaccgcggtcgaccgggagctggccgcgctgaccgcgtcggtgcgcgacatcgcgtcccggtcggcgaccgcggccggcaccgccgccgacggcaaggaggcggccgcgtcggccggcgagaaggtgcgcgcactggaacgctcggtcggcgagatcgccgacgtgaacgcgatcatcgcgtcgctggccgaccagacgaacctgctcgcgctcaacgccaccatcgaggcggcccgggccggggagatcggcaagggcttcgcggtcgtcgccggcgaggtgaaagacctggcccgggagaccgcgacctcggtggaacgggtcaacacggtgatcaccgcgatcgtggcggagaccgacgacgtcgcgcagaccttcaccaggacgaccgaggcggtggacgggatccacgagctgcagctctccatcgcgtcgtcggtggaggagcaggcgaccgtgctggccgaggtgaccaagcaactgtcgacggcgaccgcgtcggccgatcaggtgctgaccgggctgcaggagctcgccgccaccgcgcggtag

SEQ ID NO: 4898 - DNA, 336 bp, Actinoplanes utahensis
atggccaccgtggacgagtgccggcaggcattgcacgacctggccacgcgcctggaggcgaacgcggaggcccgcggccgcctcgacttcgaccgctccctggcctgccgggtcaccgacctggccacggccttccacgcccggatcaccggcggcctgctgaccggcatcgccgacggcgacgacccccaggcgaagatcgccctcagcacgaccagcgacgacctgctggccctgatcgccggccggctggacatcacccgtgcgatcgccactcgccagatctcgatcaaggcgaacccgttcgacctgctcaagctccgcaagctgctctag

SEQ ID NO: 4899 - DNA, 309 bp, Actinoplanes utahensis
atgccagacgcatggcgggcttatctggacctggcgctcgggcttaccgaggcgccccggaaaaaggcgcagcaagtcgccggtgagctgctcagccggggtggtgcgacggcggcgcaggtgcagggcctggtcgaggacctgctctcggccggcatcgccaaccgggaggcgctgaccaacatcgtccgcttcgaggtggatcgcgcgctcgggcgggtcgggctggccaccgcggacgaggtgtccgagctgaccgggcgggtgcgggacctggagaagcggctgcgggaggcactagctagctag

SEQ ID NO: 4900 - DNA, 339 bp, Actinoplanes utahensis
gtgacgttcccgcaaggtgcgcagggcgggccgcggcccggtggtttccggccgggtccgccatccggtgaattccggcccggtccgccacccggtgggttccgtccggggccgccgccgggcggcccacggccgccggcggatggcggcgagccggtggcggcggcgcattaccgcaccggcgacgatggactggtggcggagaccggtcacgcggcggtggacgcggtgctaagttcgctcgccaacgccgcgcggctggccccggccgagcagatcgccgagtacgaggccgcgcaccaggtgctccaggacaccctggccggcatcgaccgctga

SEQ ID NO: 4901 - DNA, 927 bp, Actinoplanes utahensis
atggcccgccgtgcgcgtctcgacgccgagctcgtccgccgtaagctcgcccgttcccgggaacaggccgcccaactcgtggcggccggccgggtccaggtccgggggaccgtggcccacaaggtggcggccatggtcgacccggccgatccggtgctggtcaccggcgaggacccgcagaccgagtacgtgtcccggggcgggcacaagctggccggggcgctcgccgcgttcggcccgaaagggctgaccgtccaggggcggcggtgcctggacgcgggcgcgtccaccggcgggttcaccgacgtgctgctgcgcgccggggccggccgggtggtcgccgtcgacgtcgggtacgggcagctggcctggccgatccggaccgacgggcgggtcgacgtgcacgagcggaccaacgtgcgcacgctcaccgccgaggccatcggcgggccggccgacctggtggtggccgacctgtcgttcatctcgctgcggctggtgctgcccgcgctggccgcctgcaccgcgccggacggcgacctggcgctgatggtcaaaccacagttcgaggtcggcaaggagcgggtcggcaccggtggtgtggtgcgcgactggcggctgcgggccgaggcggtgctggacgtcgcggcggccgcggccgagtcgggcctcggtgtggtcgacgtgaccgccagcccgttgcccgggccgagtggcaatgtggagttcttcgtctggttccggcgcggcgccccggccgcggaccgggagcgggtggaagcggtggtcgcggccggcccgtccggcgtggtgctgcccgaggagtccgtggcgtcggccggttcgtccggcgcggtgctgcccgaggagtccgcgtccgtggtggcgcgggagaatcagccggttgccccactggaggacagatga

SEQ ID NO: 4902 - DNA, 888 bp, Actinoplanes utahensis
atgactcggtcggctttgctggtcacgcacaccggacgccggcagagtacgcagcatgcccgcaccgtggcgctcgatctgatcgccgcggggttcgaggtgcgggtgatcgccgacgaggtggccgatctgggcctgcccgacgaggtgatggcggtcgaggggccggccgcggccgacgacgtcgagatcgtgctggcgctcggcggggacggcaccttcctgcgggccgccgagctggcccggccggtcaaggccccgctgctcgggatcaacctgggcaaggtgggcttcctggcggaggccgagatcgagcacatcgaccaggcggtggccgagatcgtggccggcgactacgcggtcgacgaacggctgaccctggacgtgcgcgcggagtacgacggccgcctgatcgccgagtcctgggcgctcaacgaggtgaccgtggagaagggccagcgggcccagatgctcgaactgatggtcgacgtggacgggcggccgctgtcccgctacggctgcgacggtgtggtgtgcgccacaccgaccgggtcgacggcgtacgcgttctcggccggcggcccggtggtctggcccgaggtggaggccctgctgctggtgccgatcagcgcgcacgcgctgttcagcaagccactggtgaccgcgcccacctcgaccttcgtgctgaccgtcgacccgtacacgtcgttcgcggtgctctgctgtgacggacgccgcacctgggacctgccgcccggctcccgggtgaccgtcgagcgggggcagctgccggtccggctggtccggctggccccccggccgttcaccgacaccctggtggcgaaattcgagctcccggtggtcggctggcgcggcaaccggcgctga

SEQ ID NO: 4903 - DNA, 1758 bp, Actinoplanes utahensis
gtgctggaggaactgcgcatcaccggactgggcgtcatcgacgacacgaccctgcggctgtcggcggggatgaacgtgatcaccggtgagaccggcgccggcaagacgatggtcgtgaccggtctcggactgctgttcggcggccgtgccgacgccgggcgggtccgcgccgacccgggccgggccacggtcgagggacggctgcggctgcagggcaccctgggcgacgcggtccgtacccggatcaccgacgccggcggggagaccgacgaggacggttcgctgctgctgagccgtacggtcaccgccgagggccggtcccgggcgcacgtcggcggccgcagcatgccggtcgccaccctgagcgagctgggcgagcaggtgctggccgtgcacgggcagtccgaccagctgcgcctgttgcgcccgagcgagcagcggtccgcgctggaccggttcgccggccccggccacgaaaaactgctggacggctatcgggaggcgttcgcccgctggcgcaaggtggtcgacgacctggccgaccgccggcgcaacgcgcgccagcgctcgcaggaggccgacctgctcaagctgggtctcgacgagatcacccgggtcgacccgcagcccaacgaggacgaggacctgcgcgccgaggtgcagcgcctggagcacgcggaggggctgcgggtggctgccgccctggccgcgcaggcgctggccggcggggtcgaggcggccgacgacaccgccgacgcgaccaccctgctcggcaccgcccggcgcaccctggagggccagtccggcgtcgacgccaagctgggcgacctggcgctgcgcatcgaggaggcggccaccctggtgggtgacgtcgcctcggagctctccgcctacctcggcgagctggacgccgacccggcccggctggaggcgatctacgagcggcgggccgcgctgcgcgggctgacccgcaagtacgccgacgacatcgacggcgtgatcgcctgggcggagaacgcgaaatcccgcctcggtgagctggacagctccgacgagctgctcgacgagctggacaaggagcggcagcggctggccgccacggtcggtgagctggccggccggttgaccgcggcccggcgcgaggcggcgacccgcttctccgaggcggtcagcgtcgagctggccggcctggcgatgccgcacgcccgggtcgaggtggcggtgctgacccatgccccgtcccgggacgagccggcggtcaccgtcgacggccaggagctgggcgccgggccggacggcgcggacgaggtggagctgcgcctgctggcccacccgggcgccccgtcgctgcccctgcagaagggtgcctccggtggtgagctgtcccgggtgatgctggccatcgaggtggtcttcgccggggccggtggcccgccgacgctggtcttcgacgaggtcgactcgggggtcggcgggaccgcggcggtggagatcgggcgacggctggcccggctcgcgcgcacccatcaggtgttggtcgtcacacacctgccgcaggtggccgctttcgccgaccggcacctcgtggtggcgaaagacaccggtggcgcgatcaccacgagcggggtgcgcatcgtcgaggagaccgagcgcgcccgggagctctcccggatgctggccggcctgcccgattccgatctgggtatcgcccatgcggaggagttgctggcggtcgccggtcgagagaagcgcggatga

SEQ ID NO: 4904 - DNA, 1179 bp, Actinoplanes utahensis
atgcgacttcccaccttgcgccgtgtgcgcaccagcgagccgggcccggtctccggcgtggcccggctcgaccggcgcaccaagcggctgaccggccggctgcgtcccggcgagatcgccgtgatcgaccacgtcgacctcgaccgggtcgcggccgactcgctggtcgcctccggggtgaccgcggtgctcaacgccaagccgtcgatctccgggcggtatccgaacctcgggcccgaggtgctcatccagggcggcgtggtgctggtcgacaacctgggcgaggaggtcttcgccgggctgcgcgagggccaggtggtcagcgtcgagggcgaccaggtgctgctcgacggcaagccggtggccagcggcacccggcaggacgcggagacggtcgccaagagcatggccgacgcccgcgagggcctgtcggtgcagctcgaggcgttcgccgcgaacaccatggattacctcaagcaggagcgtgacctgctgctcgacggcgtcggcgtgcccgacgtgcagacccggatcgccggccggcacgtgctgatcgtcgtccgcggttacgactacaaggaggacctcgacgtcctccgcccctacatccgggagtacaagccggtcctgatcggcgtcgacggcggtgccgacgccctggtggagaacggctacacccccgacatgatcatcggggacatggactcggtcaccgacgacgtgctgcgctgcggcgccgaggtggtcgtgcacgcctacccggacgggcgcgcccccggcctggaacgcgtccgcaacctcgacgtcgacgcgctcaccttcccggccgcggccaccagcgaagacctcgccatgctgctcgccgacgagaagggcgcctcgctgatcgtggccgtcggcacgcatgccaacctggtcgagttcctcgacaaggggcgcggcgggatggcctcgacgttcctcacccggctcaaggtcggcggcaagctggtcgacgctaaaggcgtcagccggctctaccggcagaacatctccggctcggcgctgctgctgctggtcctgtcggcgctggcggcgatggccgctgcggtggcggtctccacggtcggcaaggcgtatctgaccgtggtgtccgagtggtgggacaatctcgtcttccagctcggcaatcttctctga

SEQ ID NO: 4905 - DNA, 927 bp, Actinoplanes utahensis
gtgatcaacttcaggtaccacgtggtgtcgctcaccgcggtcttcctcgcgctggcgatcggcctggtggtcggcaccgccgcgctcaacggcccggtctcggagaaccttcgcgagcagctcaccacgctcaacaaggacaacaacgtcaagcgggaccaggtcaaccagtacaaggaggagctgaaccgcagccaggacttcgccgcccaggtcgcgccgtggctcaccacgaagctgaccgggcgcaaactggccgtggtggtgctgcccggcggcagggactcggccgacggcgtcgtcaagatgctgaccacggccggcgcgacgatcaccgcgcggatcaccgtcgaggacaagttcctcgacccggggtacgcgacccagctgctcgacctggccgatcagtcgtcgcagccgaccatcccgtcggccggcctgccgtccaacagcgacggggtggagaccgccagcgcgctgctcgccctcaccctggaccagggcgccaccgtggtgaacccggacgacgtcaccgcggtgctgaccgcgctcgccaagcccggctacatctcggtggccgagaaggcgagcggtggcgccgaggggatcgtgctggtcgccggtgccccggccaccgacaaggacgccggaaagaagaccgccaacgcggtcaccgtggccaaccagttccaccgctaccgtccgctggtcgtggccggggacggcgccggcgacaacaacctggtgtccgcgatccgcagcgacccgacactggtcaagcagatctccacggtggacaacgcgagctccgtgcaggggcaggtcgccaccgcgatggccacccacgagcggctggtgcagaacaaggtcggccagtacggcctgggcaccggcgccacctccctggtcccctccgccgcgccgtag

SEQ ID NO: 4906 - DNA, 768 bp, Actinoplanes utahensis
gtgcgccgcgatccgcaggcggccggcctgcgccggaccaacttccacgggcgcacggtcaccctggccggcgggccggccctggccgccggagcgaccatcggcgcggccagcggagcggccaccggccggctcaccgcggcggtggtcgccgcgggcgcggtcagcggcgcggtcggcctctatgacgacatcgtcggcaaccggcccgagcagacgaccgcgaaaggcttcgccggccacctgggcgcgctgcgcgagggccgggtcaccagcggcctcgtcaagatcggcggggtgggcgcggccgggctggtcgcctccgcgctgatcggcagtcgccgcgacggtgcgttcggccgcggcgtcgacgtgctgctcggcgccggcgtgatcgccggcacggcgaacctgctgaatctgctcgacctgcgccccggccgggcgatcaaggccgggatgatcctcggcgccccgctcgcggtgggccggcacgcggcgatcaccgccggcacgctcggcgcgagcgccgccctgctccccgccgacctgaacgaggagatcatgctcggcgactcgggggccaacgccctcggcgccctgctcggcgtcgcgtacaccgcccgcaccggcaccttcggccgcctggccgccctggccgcgctcgcctcgctcaccgcggccagcgagagggtcagcttcaccaaggtcatccaggacacgccgtggctgcgcagcctcgacgacctcggccgccgaccggcgtga

SEQ ID NO: 4907 - DNA, 1755 bp, Actinoplanes utahensis
gtggctgcgcagcctcgacgacctcggccgccgaccggcgtgacctccccgaacaacgccgacgccactcccgcgccgccggctgcttcggcaagcccggccgctccggcgccgccggtccccgccgccggcgcgtccacggtcccggccgggtcggcgagtgccgttgcgggcagcgggacggggacggcggcgaagatcgccggcgcggcggcgctgatcaccctgctcaccatcctggcgcggatcgtcgggttcggccggaccgtggtcttctactacaccgtcggtgagggcgggcacggtggcctgccggatctttacttcgccgcgaacaccgtgccgaacatcgtcttcgaactggtcgccggcggggcgctggccagcctggtggttccgctgctggccggggcggtcgccgacggggaccgcgcccgggtcggccggatcacctcggcgctgctcacctggatggtggcgctgaccgtgccgctcgcgctgggggtggcgctggcggccggcccgatcgccggcctgctgcacggtgtgccgccggagcatcaggccatcgccgcccggatgttgcggatcttcgcgccgcagctgccgctctacggcatcggcatcgtgctgaccggtgtcctgcaggcgcaccatcggttcgcgtggccggtgatcgcgccgctgctgtccagcgtgacggtgctgaccgcctatctggcgtatgccggggtcgacggcgcccggaccgatgtcgacgggctgtccaccgcgggcgagctcatcctgtcggtgggcaccaccctcggcgtcgtggtgctcagcctgtgcctgctgatcccgctggtcaggttgcgcctgccgatccggccgggcttccgcttcccgggtggcgagggccgccaggcggtgcggctcggctgggccggtgcggtcacagtcggcgcgcagcaggtggtggtcgcgttgatcgtcacgctgggggcgcagcagctggcccggtacaacggcgcccagacggtgttcctgctgccctgggcggtgctcgccgtgccgctggcgaccgcggtctacccccggctcgccgatgccgtggtgcggcgcgacgaggacgcctacgcggtctccctggccggcaccgcgcgttcggtggtgctgctggccgggttggggacggcggcgctggccggtctggccgtcccggcgtcgcacctgatgaacgccgagggcgccgccccgggaatcgtcggcttcgcgcccgggctgttcggctacgcgctgttcgccctgctgtcccgtgcgctctacgcccggggcgcgacggtcgcggcagcgaccgcggccgggatcggatggctctgcgccggtgtcgccgtcgtggtggccaccgccggtttcgccggcggcgcggagctggccgggctggggctggccaacgcgctgggcatgaccgtgaccggggtgctgctggtactggcggtgcgccggcatgccgggccggcggcgctcgccgggctgggccgggccgccgtggccgcggtggtcgcggccggtctggcagcgctcgccgggtggggtgtggtggccgggctccggtcggctttctggccgacggccgggattttcggcagcctggcggagggggtgtcgggcggcgcggtggtggcggcggtgttcgtggcggtcgcgttcgcgctggaccggcgtgacctggggcccctcgccgggaccgtgtccccgcgatggcgaaggtag

SEQ ID NO: 4908 - DNA, 1137 bp, Actinoplanes utahensis
atgaggcgcgaggagaggggtagaccgctcgtgagcagcgacgacgggtggcacggttcggtcgtgctggtgctcggctcggcgaccggcggcaccggcggacacgtcctctcgctggcccgcggcctggtcgcggccggctgccgggtgctggtctgcggtccggccgccaacgacgagcactacgggttcggcgcggccggggtggagtacgcgccggtggagatcccggcggatccggggccgcaggattccggggcgatccgggcgttgcgcaaggcgatcgccgggcgggacgccgacgtgatccacgcgcacgggttgcgggccgcgttcgtggtgtcgctggcccgcaccggggtgccgctggtggtcacctggcacaacgcggtgctcgccaaggggctgcgcgggcaggccggcgccctggtggagcggatcgtggcgcgcaacgcggcgctgaccctgggcgcctccgaggatctggtggagcgggcggtcgcgctgggcgcgaggaacgcccggctcggtccggtggcggcgccggcgatgcgggcgccgaaacggacccggcaggcggtccgggccgagttccagatcaaggggagcacgccgctgatcctgtcggtcggccggctgcatccgcagaagcactatgacctgctggtcgatgcggcggcccggtggcgggagctggacccggcgccggtggtggtggtggccgggtcgggtcccagctacatgcccctggcgcagcgggcgtcgcggctgcacgccccgttccagctgctcggccaccggggggacgtgccggatctgctgctcggcgccgacctggcggtggtcaccagcgactgggaggcgcggcagttgttcgcccaggaggcgttgcgggccggggtgccgctggtcacgaccgcggtgggcgggttgcccgggctggtcggggacgccgccgtgctcatcccgccgaacgatctggacgcgctggacaacgccgtacgctccgtgttgtcggacccgcagcgccgggcggacctggccgcccgcggtccgctgcaggccgcgacctggccggacgagaccgccgtggtgaccgcggtccgcgccgtgtacgccgaggtcagcgcccggtga

SEQ ID NO: 4909 - DNA, 2238 bp, Actinoplanes utahensis
gtgaccggccggctggaccagatccggcgggtgcgtccgccgggcaccccgcggggccgcggcgccgccgcctgggtgccctacctgctggtgctgctgatcggcgccgcgacgctggccgggttgacgatccgcccggccggggacaccaagcggggtgccgccgactacgtggtgatcgccgccgcggccgggctccgctgggacgacctcgacccgcagcgcaccccggcgctgtggcgggaggcggccaaggggtccaccggctggctgtcggtgcgctcggcggatcaggtgacctgcccgtcggacggctggctgacgctcggctcgggcaactacgcggcctgggacacccgtccggtgcgcggccgttgcccggcgatcaccccggatctgacccggccggacacgatcggcgcgagcgtgaccgcgcagagcaccgtggtccggatgaatcaggatcggctgccgtacggcaccaccccgggcgccctggccgagtcggtgcgatgcacggtggcggtgggccgcaacgccgcggtggccgccgcccgcccgttcggccgggtcgacgagtacgtggacaccctgcccgacgatccgcgcaagctgctctccgactgtgtgctcagcatcgtcgacctcggcacgatcgccggttccggtgcggagcggcaggccgcggtcgccgccgcggacgcgaacctggcccgggtgctggcggcccgcccggagcggtcgctgatgctgatcgccggggtggccgacaccgacgccacctcccggctgcacgtggcgatcgccgagggggagggctggcagggtggccggctgacctcggccggcaccgggcgcgacggttacctgcagctgatcgacgtggcgccgacggtgctggcggtgctcggccggccggccccggacaagctgttcgccgggtacgcggcgagtgtctcgggggaccgcccggacgacccggccaaggcgatgcaggggcacaacgacgcggatcggcgggcgatcgcccagcgcggcgtcgcgtcgatcttcttcacggtgctggctgccgtacaactcatcctgttcgtcggtgtgattccggttttgatccgtgctcgccggcatgccggaccggtcgcgccgccgctgccgccgcgccgcctggtcgcggtgctggaggcggcgctgatcgcggccgcgctggcgatcccggccgggctggtcgccgacgtggcgccgtggtggagtgcggatcatccggcctggatgttcggcgccgccacgttcgcgctgatggtggccgggacgtgcgcggtgcggctggccccgcggttccggatgacgctgtggccgatgggcgcgaccggggcgctgagcgccatcgtgatcgtggtggatctgctcaccggggcgcggctgcagctcaacggggtggccgggtattcggcgacgcacggtgtccggtacgccggtctgggcagtgtcggcctgggcgtgttcgtggccggtctgctgctggccgccggctgtctggcccagtgggtcgggcgccggtggcggccgaccgtggtggtgctgttcggcggcctgggcgtggtgatggtcggcagcccctatctgggggccgatccggtcggcgcgatcgcggtcaccaccggggtgtgcgtggccgccgcgatgagttcggggggctggctgaccttcgcccggttcgcctgggcgggggtcggcgcgatcgcggtgaccgccgggttcgccgccttcgagctgcaccgggcgccgctggagcagggcaccctgggccggttcctgagcgcgctgggcagtgggacggccggtccggcgatgcagcgggctgccgcggccaacgggcaggccctgctggacagtccgctgagcctgctggcgctggccggggcactgatgctggtcttcggccagttctcgccgtggggtggcctgaacagggtgtacggactgcatccggcggtgcgggcggcgatcgccggcaccgtggtggcgtcgatcacggccggagtgttcggcggcaccgcgctcggggtggccggcgcggccgccgcgaccgcggtcccggtggccgtgctgaccgcgttgcgggtgctgctgcatgccgcggatcgcaccccgccgcccggtcagaccgacgggccgggcggcccgttgttgcgcaaagccgacgaggatcaacggacagtgaccgaaggggccggctga

SEQ ID NO: 4910 - DNA, 1740 bp, Actinoplanes utahensis
atggggcgaggacgccccggtctgcagatctggaacgacaggcgaccacgggagcgggccttggcctcaacagtgcgcgacacgcggcacatcttcgtcaccgggggcgtcgcctcctcgctgggcaagggcctcaccgcctccagcctcggcaatcttctcaccgcccgcggactgcgcgtcgtgatgcagaagctcgacccttacctgaacgtcgacccggggacgatgaacccgttccagcacggtgaggtcttcgtcaccgaggacggggcggagaccgacctggacgtcgggcactacgagcggttcctcgaccgtgacctgtccggcaaggccaacgtgacgaccggccaggtctactcggcggtcatcgcccgggagcggcgcggcgagtacctcggtgacaccgtgcaggtgatcccgcacatcaccaacgagatcaagagccggatcttcgcgatggccgacccggacgagaacggaaacgtcccggacgtggtgatcaccgaggtcggcggcacggtcggcgacatggagtcgctgccgttcctggaggcgatccgccaggtgcgtcacgaggtcggccgggaccacgtgttctacctgcacgtctcgctggtgccgtacctggcgccgtccggcgagctgaagaccaagccgacccagcactcggtggcggcgctgcgcaacatcggcatccagccggatgccctgatctgccgcagtgaccgggagatccccgagaagatgaagcacaagctggcgctctactgcgacgtcgacgccgaggcggtcatcgcctgtccggacgcgcccagcatctacgacatcccgaaggtgctgcacgacggcgggctggacgcctacgtcgtgcgccgcctgggtctgtccttccgcgacgtcaactggcagacgtggaacgacctgctggagcgggtgcaccacccgaagcgcacgatcacgatcgcgctggtcggcaagtacgtcgacctgcccgacgcctacctgtcggtctccgaggcgatccgcgcggccggtttcggcaacaccgtgaagatccagatccgctgggtgccgagcgacagctgcgagacgccggccggcgcggccgccgccctcaagggtgtcgacggcatcgtgatccccggcggcttcggggtgcgcggcatcgaaggcaaggtcaacacttcccggtacgcccgggagaacggcgtgccgatcctgggcctctgcctcgggctgcagtgcatgaccatcgacgcggcccgcaacctggccggtctggccggggcgaactcgctggagttcgacgagaccgccacctacccggtgatctccacgatggccgaccaggaggacatcgtcgccggcaagggtgacatgggcggcaccatgcggctgggcgcctacccggccaggctgaaggacggctcgatcgtcgccgaggtgtacggcgcgaccgagatctccgagcggcaccggcaccggtacgaggtgaacaacgactaccgggacaagctcacccaggcgggcctgatcttctccggcacctccccggacggccggctggtcgagttcatcgagctggaccgtgcgacccacccgtacttcgtggccacccaggcgcacccggagctgaagagccgcccgacccgcccgcacccgctcttcgacggtctgatcaaggccgcggtcgcgtacgcggccgccgacgagctgccggtcgaggcgagttga

SEQ ID NO: 4911 - DNA, 549 bp, Actinoplanes utahensis
atgggcttcgagcacgagacggtcggcaccgtcgagcgctaccggggggcgatcttcgacgtggtcaccgacgaggtgacgatgtccgacggcggcaccgcccaccgggacgtggtccgcaacaagggcgcggtcgtggtggtcgccctcgacgaggacggccgggtggtgctgatcaagcagtaccggcacgcgatcggcgccaagatctgggagctgccggccgggctgcgcgacgtcgacggcgaggacccggcggtcaccgcggcccgtgagctggccgaggaggccgacctcacggccggccgcctcgagcacctgatcgagctgcacacctcgcccgggttcagcaccgagcacgtgctggtctacctggcccgcgacctggctccggtgccggtggcggaccggttcgcccggcacgacgaggaggccgatctggaggtcgtccgggtcgcgctggacgaggcggtcgcgatgatcttccgcggggagatcaccaacgcggccgcggtcgccggtctgctcgcggcggcccgcacccgctga

SEQ ID NO: 4912 - DNA, 1344 bp, Actinoplanes utahensis
atgcgcctgaccgccgtgttcaccgcactcgccctggccgccggcccggtggcggtacaccgcccgcccggcctggactggggcccgtgcgagcagccggacgcgaacctcacctgcgccaccctgaccctgccggtggactgggccgacccgcacggcgccaccttcggcacggtggtgaccaagcgggccacgccgcaccaggacgccagggtgggcacgctcgtcttcggccccggcgggccgggcgactccggggtggaccgggtccggatcaacaaccggttcagcgccgaacagcgggatcggttcgacatcgtcagcttcgacccccgtaccgtcaagcggacggccgcgcccacctgcgcgccggaaccggaccgcccgcccctcatcctgcgcgaccaggcggatttcgacgccgcggtgaccaccaaccggtcctactggcagcggtgccgggcgagcaacgaggtgttcgcgcacgccgactcggtgagcatcgcccgcgacctggacgcgctgcgacgggcgctcggcgagcggcggctgaccttccagggcagctcctacggcacggtgctgggccagatgtacgccgaacggttccccgatcgggtgcgtgccatcgtgctggagagcgtcttcgacccttacctgccgctcaccgagttcgtccgctccgaggccgccgcctcgcaggacgttttcgaggagttcgtggcctggtgtgccgggcacaccgggtgcgcgctgcacggcagcgacgtccgcgccgtctggcggtccgtgctgcacgactacccgggcgtgagcaccttcgaggtggccgcgctgccgatgggcctgaccccgaactgggcgctgctggccaccacgatcaggaacgcggcgaacggcacgcccccgccggtaccgaagctcgacgtggcctccgggatcttctgcgcggacttcccggcggacgtccgcgacttccgtgcctaccagcggctgctcgcgatcaccgcgaaggtgtcaccggacgtgccgtacggcgccgggatgctggcgatccgcacctgtctgggctggccgcagccgctcgccaacccgccgcaccgcctcgacgtgcacacccgcaccccgctgctgctgctcaacgccgtgcacgacccgcggacgccgtacggctgggcccggcacgtcgccaccgaactgggcgccagcggtcggttggtcacctacgagggcgccggccacggctcgtaccaggccaccgcctgcaccaccgcgatggtcgaccgctacctgatcgacctcacgatcccgccgccgggcgcgtcgtgcccggcggcggagtga

SEQ ID NO: 4913 - DNA, 255 bp, Actinoplanes utahensis
gtgaccggcgaggccgcaccggtcgtcccggtcctcaccgcccacctcaggtgccgccggtcggcgctgcaggtggtcgcctgcctcggcgagatcggcccggccgcggccgccgccgtcccgctgctgcgcgccgaggtggagccgccgctgccggtctggacgcacggcgccgactacgaccggatcctcaaggacgaggcgtggcgggcggcgtgcacggcgaccctgaaccggatctccggggcaccctaa

SEQ ID NO: 4914 - DNA, 114 bp, Actinoplanes utahensis
gtgggcggtgaggaccgggacgaccggtgcggcctcgccggtcacccgccagtaggcgaccgccgcctcaccggccgtcgcgcagtccggcgcggcgaacagctagctagctag

SEQ ID NO: 4915 - DNA, 1137 bp, Actinoplanes utahensis
atgttgccgtgcaggtcgtgcagcgcgtcgtcgtcaccgccggcgagcgcccggatcaggtccgggacgtcctccgccgggccgtacgcgtgggtcagcgacgcccagtccaccgttgcaagatcgtccagcacatgcaagaaggtaccgagttgcggccggcgcaggggccaaagggggtggtcacaccgtccaggccggttccagcgggacgccgtctccggacgagcacgcggcgaccgccaacggctgcccgtcgtcggcgaccgcgagcagcgcggcgagcgtgtgcccgggccggacaaaatcggcatcggccggaggatgggacggaccgtacgcgaaccgtatgatccgggcggtggcgagggtggccgggaacggcttgccgaaggcgcggaccacctggaagtggtgcacttcggcgcgccggaaggtgtcgcgctggccggcggcgatcgcgtcgtggccgtcggccatgaacgcccgcagggcggcccggtcccgccagcagccgacgatccgggcggtgcacgggtcgctccagccgcccgcctgggccaggaagccgggccggccgcgcagcgccgaccagccggcctgcgcggcggcgaagccggccacgtcggtcacttcgcagacgatcaccttgaggagcacggcgatattttgtcggacccgggtagtaggttcacgacgccctactggatggaggggatcgtgacctttccgaagctgcagtccgtggtgctggacacgccggacgcgcgggccctggccgagttctaccggcacctgctgggcctgcgatatcggcccggcgacgagcccccggcaccgggggaggacgacgagaagggccgcgactggctggtgctggagggtgacggcggcatgcggctcgccttccagcaggagcccgggctgaaaccgaccacctggccggacggcaccgtcccgcagcagatgcacctggacaccgcggtggactcggtggccgagctgaaccggcagcacgagcgggccctgagcctgggcgccacgctgcggttcgaccgcagcgacgacgaggacgagccgctgcgcgtctatgccgacccggccggtcacatgctctgcatcttcgtcgcgtcgtaa

SEQ ID NO: 4916 - DNA, 423 bp, Actinoplanes utahensis
atgcctggacacggtaggtacctagaggatagtaatgattttgtgacgagcgttaccagcaccgaccccctgcaggcctgcccgatcgccccggtggtcgacatcgtcttcagccgatggaccacaccgatcctctggacgctgcacgagagcggccggctgcgtttcgtcgagctggagcgccgcctcccgacgatcacgccgaaggtgctcacccagcggctgcggcagctggaacgcgacggcctgatcacccgcacctaccacgcggaggtgccgccgcgcgcggagtacgagatcagcgacctgggccgcagtctcgccccggtcttcgcccagctggccacctgggccggcggtcacctgggcgaggtggaccgggcacgcgccgcttacgacgcgacgaagatgcagagcatgtga

SEQ ID NO: 4917 - DNA, 804 bp, Actinoplanes utahensis
atgatcgtggtgacgggggcgaccggcaatgtgggccggccgctggtggcgacgctgaccgagggcggcgcacgggtgcgggcggtgtcccgcgcggcgccgcggtggccggccgacctggccgacccgccgagcctacggccggcgctggccggggcggaggcgttcttcctgctggtctcgggcgccggtgcgcacctggatgggccgaccatcctggacgaggtgaaagccgccggggtgcggcgggtcgtgctgctgtcctcgcagggcgccgcggcccggccggcgcacgccccgctgcgggcgttggaggagaccgtgcgggggtccgggctggagtggacggtgctgcggccgggcggcttcgcctcgaacgcgctggcctgggccgagtcgatccgcgcccggcgggaggcgcgagccccgttcggtgacgtcgggctgccgctggtcgacccgcgggacatcgccggggtggcggccgcggcgctgaccgatccggcgcacgcggggcgggtctacgagctgaccgggccggagctgagcacaccgcggcagcgggcggcccggatcggtcaggcgctcggcgaggcggtgcgcttcgtcgagcagaccgtggacgaggcccgtgcgcagatgctgggattcatgccggcgccggtcgtcgatggcacactcgccatcctcggcgcgccgaccgccgctgagcagcggatcaccccggatgtcgagcgggtgctggggcgtccggcgggcactttcggagggtgggccgaccggaaccggcacgcattccagtga

SEQ ID NO: 4918 - DNA, 804 bp, Actinoplanes utahensis
atggcacactcgccatcctcggcgcgccgaccgccgctgagcagcggatcaccccggatgtcgagcgggtgctggggcgtccggcgggcactttcggagggtgggccgaccggaaccggcacgcattccagtgatcatccggtgtcgcacggtaacttgtccgctgtggacatgctgtcgatgatcgccgatgagcgccgccggatcgcggagctgatcgagtcgctgaagccgagtcagctgatcacgcccagcctctgtgccggctggacggtgcacgaggtggcggcgcacctctgcgcgccgtggatcttcggggcccggcggatcgtgccggcggtgatccggcacggcttccgggtgcaccgggccaatgccgacctggtccgcgacctggcgctggacctgaccgccgacgagatcgcgctgcagctgcgggcgaacgccgagttcgacttcaacccgccggtggtcgggccgttcgggcagctcaccgatctgcaggtgcacgggcaggacatctgccgcccgctcgggttgacccgggacctggtgcccgaacggatgctgctcgcgctggacttcctgatcagcccgaaggcgcgcggctcgttcgtggcgcgtggccgcttggacgggctgcggttcatcgccaccgacctggactgggagggtggtcagggcctgctgaccgtgcggggcgcgggggaggcgctgatgctggcgatgacggggcgcccggtggtgctcgacgagctgcacggcagcggggcggcggcgctgcgggcacgactgctcggttga

SEQ ID NO: 4919 - DNA, 1506 bp, Actinoplanes utahensis
atgggagcgctcccaatccgtccccgtcgattggtatcccccatgagactccgcacgatggcgttgttcgcggccggtgcgctggccaccgcgggcaccctggtcacagcgctgcccccggcgtccgcggccagtgccggctgctccgtcacctacaagatcgccagccagtggcccggcggcttccagggcgacgtcagcgtcaagaacctcggcgacccgctcacctcctggagcctcggcttcgacttcccggacagcgggcaaagggtgacccagggctggagcgcgacctggagccagagcggcgcgcacgtcaccgccgcctcgatgggctggaacggctcactggccaccggcgcgaccgtgggtgtgggcttcaccggcaccttcagcggcgccaacccggtgccggccgccttcaccctgaacggagtggcgtgcaacgggacggttcccgcgtcgccgtccaccccgcctccgccgtccggcgccgcccccgctctgaaagtcagtggcaacaagctggtcaccgccgccggagagacgcggcggctgctcggggtcaaccgctccggtggcgagttcgcctgcattcagggcaacggcatctgggacggcccgatggaccaggcctcgatcgacgccatgcgcacctggaagatccgcacggtccgggtgccgctgaacgaggagtgctggctgggcacggcggacgtgcccgcggcgtacggcggcgcggtctaccagacggccgtcaaggactacgtgaccctgctggtcaggaacggcatcacgccgatcgtcgagatgcactggaaccacggcctgtacaccggcccgtcgtccgggtgcagcgacgtcaaggcgacctgccagaagccgatgcccgacgcgcagtacgccccgtccttctggaccggggtggccggcgccttcaagggcgacgacgcggtcgtcttcgacctgttcaacgagccctacccggagcgggccaccggcgacgccaccagcggctggaagtgctggcgtgacggcggcacctgcaccggcatcggttacccggtggcgggcttccagagcctggtcaacgcggtccgggcgaccggggccaccaacgtgatcctggtcggcgggctggcctacgccaacgacctcagccagtggctcacctacaagccgagcgacccgctgaacaacctggccgccttcgcgcacatctacaacttcaacacgtgtgccaccaccgcctgctggaacagccagctggcgccggtcgccgcgcaggtcccgctgacactcagcgagatcggcgagaacgactgcgcccacgggttcatcgaccccctgatggactgggcggacgcgcaccaggtcggctacctgggctggacctggaacacctgggactgctcgaccggcccgtcgctgatcagcaaccacaacggcaccgccaccgccttcggccagggtctcaaggaccggctggccagggtgtccaactag

SEQ ID NO: 4920 - DNA, 1209 bp, Actinoplanes utahensis
atgagtggcggctttccctggcttctcgtcgaccagaacatcgacgacggcgacgcggtcgtggcggcgtgcgccgacatcgacggcctgttcgccgacccgggtgagccgccggtcgagcggtacacgctgctcggctgcgccccggccggccggctgcgcgcggcctgcgacggctacggcgcgccctggctgggcaacatcggactggagacgatccaccggccggagtcgaagcatccccgggagtgctgggagtgcaccgaggagttgctcgacctcaccgtggtgtcggccagcccgaccggctacggggtgttcgacgtggtcctggagggccggctgcggatcgatccggagcaccgcaagcggcgccgcgggccggaccgggccccggaggccgacggctacgtgctgaccgggatcaccggcgagggcgaggagacgttcggcacctgccaggacgtgtccggagtgttccggtcccggccgcagcgggtgccggcaccggcgacgctgatcggctgccggcccgagccgcggctgcggcgggcgatcgacgcgttcacccggggcgccgcccggcaccggcggatgatcatcgcgtcgatcttcagcgtggccgacgacggcaccgcgacgcacatgctggacagcgggctgggcgccgaggtgtccgccgtgcgcccgtcggtgctcggcgacgggctgctcgacgtcgacttcgggagctcctacggggatgcgatcaaaggcggtcgcccgcacggggcccgggagatctgggagcgctggcaggccggacgaccgaccgagcgggggcagtgggcggcgtacccggcggcgctgcggcacgagtgggccggcgccgcgctggcccaccaccggccggggccggaccggccggccgggcggacgtaccacctggacggccggcacgtgaccgacgaggacggcttctactgcgcgatcggcgaggcgatcaacggcccgggcggatacttcgggtggaacgccggagcgctgcacgactgcctgctcggcggctggggcgcggcgcccggcttccggctcgtctggcacgactcggcggtggcccgcaagcacctggtccccggttacgaccgccgcgactggtgcccggcgatcaccatggaccacctcctcgcctggctggccgaggacggggtcgaggtcgacctgcgctga

SEQ ID NO: 4921 - DNA, 1116 bp, Actinoplanes utahensis
gtgaaaatcggcattcccagcgaggtcaagaacaacgagttccgggtggcgatcaccccggccggcgtgttcgagttcgcccgggccggacatcaggtgttcgttcagagcgcggccggactcggctcctcgatcaccgacgcggactaccgcgaggccggcgccaccatcctgcccgacgccgactcggtgtggtccgaagccgacctggtgctcaaggtcaaggagccggtggccagcgaataccatcggatgcggcccggccaggtgctgttcacctatctgcacctggccgcctcccgggagtgcaccgacgcgctgatggaacaccgggtgaccgggatcgcctacgagaccgtcgagctcgccgaccggtccctgccgctgctggccccgatgtccgaggtggccggtcggctcgcgccccaggtcggcgcgtaccacctgatgcgccagggcggcggccgcggcgtgctgatgggcggggtgcccggcgtctacgcggccaaggtggtggtgatcggggccggtgtgtccgggatgaacgcggccgcgatcgcgctcggcatgcaggccgaggtcaagctgctggaccgcaacatcgcccggctgcgggccgccgacgccgactatcgcgggcacctgcagacgatcgcctccaacgcgtacgagatcgaacgcgccgtgctcgacgcggacctggtggtgggcgcggtcctggtgcccggtgcgaaagcgccgacgctgatctccaacgatctggtggagcggatgaaaccgggcagcgtgctggtcgacatctcgatcgaccagggcggctgcttcgaggcgtcccggccgaccacccacgacgacccgacctaccgggtgcacggatcgatgttctactgcgtcgcgaacatgcccggggcggtgccgcacaccagcacctacgcgttgaccaacgtcaccctcccgtacgctctggaactggccaaccggggctggcgcgacgcgctgcgccacgaccgggcgctggccgccgggctcaacacccacgacggtcacgtcgtctacggcccggtggccgaggcgcacgggatgccggtgacgttgctgacggaggtgctgagctga

SEQ ID NO: 4922 - DNA, 618 bp, Actinoplanes utahensis
gtgcatccgcccgcgccaccccggcggctgccccgggcgctcgacaccgaccaggtcgaacgactgctcgcggtgcccgccgcggacaacccgttgggtctgcgggaccgggccctgctggagttcctctacggcaccggggcgcggatctccgaggcggtcggcgccgacatcgacgacctgcaactgggtgcggacagtgccgccacgctgcgcggcaagggtggccggacccggctcgtcccggtcggcggctacgcccgtaccgcgttgcaggcctatctggtgcgggcccggcccaccctggccgaggccgggcggggcaccccggcgatcttcctgaacgcccgtggcggccggctgtcccggcagagcgcctggaccgtgctgcaccgctgcgccaccgcggccggcctgccggtcgacgggccgcacgcggtcagcccgcacacgttgcgtcactcctacgccacgcatctgctcgacggcggggccgatgtgcgcgtcgttcaggaactgctgggacacgcctcggtcaccacgacacaggtgtatacgctggtgaccgtcgagcgcctgcgggaggtctacgcgacctcccacccgcgcgctcgttag

SEQ ID NO: 4923 - DNA, 930 bp, Actinoplanes utahensis
atgtcagggaacgaccgtgcggaggcctggaccaccgcgctccgcgatcagcagaattccctggatctgggcgccgacctcggtcctgccgaccccacggcgtacacgatgcgccgtccgatcccggagccgatgccgaccgatcggcacggccccgcgcggatcatcgctttggcgaaccagaaaggtggtgtcgggaagacgaccaccaccatcaatctgggcgccgccctggccgaatacggccgcaaggtgctcctggtcgacttcgacccgcagggcgcctgctcggtcgggctcggggtcaacccgcacaacctcgacctgagcatctacaacctgctcatgcaggacgacgtcaccaccgaggacgtcatcatcaagaccgatgtcgccgggctgcacctgctgccggccaacatcgacctctccgcggccgagatccagctggtcaacgaggtggcccgggagatggccctggcccgggcgctgcgctcggtccgcaaggagtacgacttcatcctgatcgactgccagccctcgctgggcctgctggcgatcaacgcgctcaccatcgcgcacggcgtgctcatcccgctggagtgcgagttcttctcgctgcgcggtgtcgccctgctgctcgacaccatcgacaaggtgcgcgagcggctcaacttcgacctggaactcgaaggcatcctcgccaccatgtacgactcccgcaccacccactgccgccaggtgctgcagcgcgtggtcgaggcgttcggcgacaaggtgtaccagacggtcatcaccaagacggtgaagttcccggagtcgaccgtggccggcgccccgatcactacgctggacccggcgtcctcgggcgcccgcaactaccgtcagctggctcgcgaggtcatcgcctccaaggcagaacgaggatag

SEQ ID NO: 4924 - DNA, 678 bp, Actinoplanes utahensis
gtgctgttcgcgctcgggacaccggtcgcgttcgccgcactggtcgtctccttcatcgctgccgtgatgctgcgcgccgtcgcgatccggttcaccgcacgcactgtcggcctcgccgagcgcggcgaccgtctcacccccagcctgcgccacgacctggacccgttcggtgcggtcggtgcggccctcggcggcatgggctggggcaagatcctcaccgtcgacgacgtgccgcgctggcggggccggggccgggcggcggcggtcttcgcggccggtccggtcgcctgcatcctcgccggtgagctgctggtcgcggcgttcgcgctgatctccgccgacgacttccggttccagagcctgacggtcggcatggtgttgcacggcgtcgacggcccgctgccgtacggccagcaggtgctgttgtcgttcggggtgggactgctggcgttcgggttgctcgcgctgatcccgatcccgccgctggacgggttcggcatcctgtacaacgcgatcccccgccccgggcacggaatgcagtggatgcggctgtggttcgaggacaagaacatcggcgtcctgctgctgctgatcttcagcctgttccccggtggctatccgctggtcctgatgatcctcgacgtgctcggccacttcttcctgcgcgcctgggcctga

SEQ ID NO: 4925 - DNA, 849 bp, Actinoplanes utahensis
atgcccccgacagtcgtgatcaccggagcttccagcggcgtcggacgggccagcgcgctcgcgttcgcccgatgcggcgcacggctcgcgctcgccgcccggtccgcggaagcgctggaaacggtcgccgccgagtgccgcgcgctcggggcgcgggtggtgaccgtcgtcgccgatgtcaccgagccggcgatggtgcgggaggtcgccgccgccgtcgaccgcgtggacgtctgggtgcacaccgcggcggtgatggcgtacgggcggttcgaggacgtgccggtcgaggtgttcgaccaggtggtgcgggtcgacctgctcggggcggcgaacgtcgcacgggtcgcactggagacgttccggcggcagcggcgcggggtgctgatcttcggcgggtcgctgctggggacggtggtgacgccgtacacgagctcgtatgtgaccagcaagtgggggctgcgcgcactcgttcgggcattgcggctggagacccgggacgccgccgacatccatgtctgcctggtgtcgccgggggcggtggacaccccgatctaccggcgggcggccaacttcgcggggcggtacgggcaaccgccgccgccggtggattcgccggagaaggtggcggcggcgatcctgcggtgcgcgcggcggccgcggggcacggtgaacgtcgggatcgcgaacaagatcatcagcttggggttcgtggtgacgccggcgctgtacgacgtgctggtggggccgctgatgcgacgcggcggactgtcccgggagcgggtcgggccgcacaacggcaacgtgttcaccccggtgcaccacgccgccgccgaggaccgccgatga

SEQ ID NO: 4926 - DNA, 444 bp, Actinoplanes utahensis
atgggcagagccaagcggatctggttccggctgctgaagcacacgatcaaccgcccggcgatcgccacggtccaccgcggctggggcccgctgtcggtcgtccagcacgtcggccgccgcaccggcacccgctacgagaccccgctgctcctggtccggcgcggcccggatttcatcgccgaactcacctacggcccggacgtcgcctggctgcgcaacgccgaggcggccggcggctgcacggtcctgcaccgcggcgccgcctaccgcatcgtcggcatcgacgacttcccggccggtgccggtgttcgcgctttcggggttcccgccgggctcgtcctgcggctgacccgccgccggcacttccggatcctccgtggggtccgcgggcacgcgccatgggcggaccccggtgccggcccggccggcaaacggtggccttga

SEQ ID NO: 4927 - DNA, 591 bp, Actinoplanes utahensis
gtggtcaccaccgcacccgtgcggctgtcccgttccctgcagcgcctcgccggcgtcgccggtctgctcggcgccaccgtgctcgtggtcaacgcggccaagcgcgcgcacctcgttccgacgtccgcggtgacgcagttgctcgcaccgttggccgaggtcttcgccctggccctgatcaccgccctctacctgatctgcgaggggcggatcggccggctcggccggctcaccttcgcggtgaactacgtcgcgctggccgcgctcgtcggcgtcgagttcgtcatcaacctggtgttctcccggctgagcacggatcagatagcggatctgcgcgccggcccgctgggcgtggcgctgaccgtcgcgtccatcctgttcctgctgggatcggtgggcttcgccatcaccctggcgtccaccgcgatcccgccccgaggcgcactggcgctctacgccctggggtcggtgccggtggcactgcgcgccttcgtgccggaacaggttctcgacgtgtccctgttcgtgctggccatcggggtgtcctggctgtcggcgtggctggtcggcacccgtcgcgccgacggctga

SEQ ID NO: 4928 - DNA, 579 bp, Actinoplanes utahensis
atgctgctccccatgccgggccccaagaacgttctcgtcgacatctggctgctctcctcggtggccaccgcactcgtcgccgaggagctcgccgacagcccgttgtccgtggacgagttcgcgctgtacggcctggtcagcgacctcggtccggtgaccgccacccagctgtcccagtggaccggcatgtcgcccaccacgctgtcggccatgctgcgccgctgccaggcgcgcggtgagctggcccgcacgcccaatgccgccgaccggcgcagcacgctggtggaactgacggagcagggacgcgcggtgtacggcgcggccctcccggcgctggccgtcgcgcagcaacggctcgccgagcacctcgacctgccggacgacgatgcccgggccaccctccagcgggtggacgcggccacccgcgcggcgttgaggctgccgccccggccctatcgcgtcagcgcgccgccggtcaccggtggcctgccggccggcaccgccgggttgacggccgaccaggaggccgaggtgcgggccttcgcggcctggctgcgctaccgcgacgcggcggggtga

SEQ ID NO: 4929 - DNA, 756 bp, Actinoplanes utahensis
atgcagatcgccatcgtgctctacccggggatgaccgccctggacgccatcgggccctacgagatcctccggttcctgccggacagcgaggtgcgcttcgtcggggcggagcccgggccggtggtcaccgacagcggggtgctggtcctcgggatcacccacggctacgacgagacgccgcggcccgacctggtgctggtgcccggctccgggccgaacaccgcgacggcgatggtcgaccggcagctcaccgattggctgcggcgggtccacgagacgacgacgtggaccacgtcggtctgctcgggcgcactgatcctggccgccgccgggatcctgcggggccacccggcgacgacgcactggatcgcccaggacgcgctgaagtccttcggcgccgccgcccgccgcgacgaccgcgtggtccggtccggcaggatcctcaccgcggccggggtgtcggccgggctggacctggcgctgtggctgaccggcgagatcgccggccgcgaccacgccgagacggtgcagctcttcatcgagtacgacccgcggccaccgttcgacgccggccacccgtccaaggcccgcccggagatcttcgaccgcgccgaccgcctgggccgccgcatcgcgatgtcacccggcgcgttccgggcggtcgccacggtcgcctggcagcaggccctccggcgcacccgccgcaccgcggagaaccgccgcggcgaccttgaccgcggccgcaaccggcggtga

SEQ ID NO: 4930 - DNA, 2199 bp, Actinoplanes utahensis
atgctcatcggtcctccatcagatcagcgtcacctggatgccggtcggtgtcgcctgggcggctccggccagcgggaagcgcaggtcggcgttcgcagaccgcttccgcccggccgggtcggtgtagccggcgatccagtgcacctgtccccagccggtgatccgcacccccgacccggccagaaagccaccgtcgacgaacacctcggcctgcggatacgcggtgatcgtccagcgcaccgcgacgccggtacccggtacgttcagcccgaacgggcagccgggcggctgcgcggcggtgctcgccgcgcagcggtccagcccggcgcgcacctgcccacggatgtcgtcgagagcgccgtcgaccagctccggcaccccgaactgcagcggtgcgacgtagtcgaacccaccgttctgcacgaatccggtcgcccggctctcgccgaacagcgtgtccggggcggcgaccgcctcgtaggcgccggggaaggccacggtcacccggccggcggcgccgagcccgaccccgttcacggtcacctgccggccgcgctgcccggccacggcgagccggacgaacggcaaccgcaaccgccagcggtggttctcctggaccgccaggacgttctcggtgatcgcccggtcgtcggcgcgatagtcgacctggacgatccgggccggggcgccgaactgggtgccggcgtcggtcgtcgcgcggacctccgcgtcgcgggggcggtgcgcgcgggccttcagggcggtgtcgctgagcagcgggtactgcgaggtgtcgaggtcgacggagccggccaccaggcgcagggcggcggtggcgtccccgtcggccagggcgtcgaagtagcgcgcggcgacgctccgcggatcgtcggcgacccggcgggtcaccgcgatcgccatcacacccacggcgagcagcagcaggagcgcgatgagcggggcggggcctctccggcgtacacccggatggtggtgatccggaacgggcgccgggggcgcggtgggcgtcggcggcgcggccgagacgaccggcgcggcgcagtaaccgcaccactgccgctccaccgcgacgtcacccccgcaacggaagcacagggtcgtcaccacgtcatcggacgctaccggaaaccggcttttcgctcaggagcttccgaaacggtcaactgttcggtgcgccctacactggccgccatgctcttcctggtggtcgcctatgacgggtcggagctgctcgacatcgcctgcgtcacctcggcgctcgccatcgcgaaccggatcggcgccgacccgccctaccgcaccgtgctggccacgccgggcggccgtccggtcgcctgcgactccgggctgcgcctcgacgccggtgccgagctcgaacggatcaacgaaccgctcgacaccctgctggtcaccggcggcaacgggcacgagcaggcggcggccagcccgatcgtcgtcggacacgtccgccggttggcgcccctcgcccgccgcatcgcctcggtctgcaccggctccaccgtgctcgccgccgccgggctgctcaccggacgaagagcgacgacccattggcggtacgcggcggagctggccgcccgatacccggacgtcctggtcgacgccgagccggtgtggatccgcgacgggcgggtggcgacctccggcggggtgaccagcgcgctcgacctcaccctcgccttcatcgaggaggaccacgggccgacgatcgcgcgcggggtggccctggggacggtcgcctacctgcagcggcccggtgggcaggcgcagatcagcatgttcctggcccggcgcggggccgacgacttcgtgtgccgccgggccaccgaccacgtcgccgggcatctcaccgacgacctgagcagcggggcgctggcccggcggttcggggtgagcgagcggcatctgacccggctgttccaggcctacgtgcagctgaccccggcgcaatacgtgcgacgggcgcggaccgaggcggccgcccatctgctcgggtcgaccgggctgccgatggccgccgtcgcccggcggtgcggtttcgggtcgaccgagtcgctgcggcaggcgttcctcgaccgctacgggatgcccccgtcccggtaccggacccggcgacccgcccggctacggcccctcgcggacctcccctccccgggatga

SEQ ID NO: 4931 - DNA, 945 bp, Actinoplanes utahensis
atgagcatctccacgctggggccgggcaacggcgacgtcgcctaccggatgcagagcctgcggcacggcccggccgagccggtgctggaccgtggtgtaccggccgggacgctgctgcggctctggctgtgggcggccgtgcccgcactgatcgtcggggcggtcttcggcttcctggcgctggtgctcttcgcggtctccgggcccggcctgagcgacgggaccacgcccggcgacgggatgctgtcggccggctcgatgctcggcttcatcgtgttctggacggtgctgctggcggtccggatcgacgagccggtgggggagtggaccaccctgctggaggagcgctggcagggtgcggactcggcgtacgcggcgatctacgcgaccctgcggcggcgcgggatcccggtggaggtcgacgccgtacggctgcgcagtgatctgctgccgccggaggtggtcgacaaccgcctgctgatcgcggaccgcgactaccgcatcgcggtctcgatcttcccgtacggaagcgggctcagcgtgggctggacgatgtggcgcgggcggcgcggggcgacggtgctcgggaacttcctgcgggacgtcggtgccggcatggtcgggcagggtgtgcgggccgaggatctgctgcgcggggagcgggtgcgggcgttgcgggaggcggtgcacgcggcggtccgggagggcgccgaggtggccgcgcagggtctcgtggtgccgatcgggccggcgttcggggcggaggtgccgatcctggatctgcgtacgtcggtgccggctttccccgccttcgccgcgccgccggccccaccggccacggccccaccggccacggccccaccggccactgccccggccccggccgcggtgccgccggccccggcggtggtggagtcggacgagcccgggccgccggtgagctga

SEQ ID NO: 4932 - DNA, 951 bp, Actinoplanes utahensis
atggtctacggtcggcacgtgcttgaagagcccgccccgccggcaccggatgccgccgtccccgactccggcggcttcaccgtgcggctgcacaacttcgagggccccttcgacctgctgctgcagctgatcggcaagcacaagctggatgtcaccgaggtggccctgcaccaggtcaccgacgagttcatcgcgtacatccgcggcatgggcgacgactgggatctcgacgagacgagcgagttcctgctggtcgccgccaccctgctcgatctgaaggcggcccgtctgctgccctcggccgaggtggaggacgaggaggacctggccctgctggaggcccgcgacctgctcttcgcccgcctcctgcagtacaaggcgtacaaggaggccgccgcgcacctggccgagctggaggcgaccggcgcgcgccgctggccgcgcctggtcaccctggaggagcggtatgcgcaggcgctgccggacctggtcctcgggatcggcccgcagcggctgttcaagctggcgctcaagcagttcaccccgaaaccggggccgccgcaggtctcgatcgcgcacatccaccaggtccgggtcagtgtccgggagcacgccgagctgctgcgcgaccggttgcgccgggccggtctggccagtttcagcctgctcgtcgccgactgtgagagcaccctggaggtggtcgcccggttcctcgcgctgctggagctctatcggcagaatctgatcgatttcgagcagccggtgtcgctggacgagctgaccgttcgctggatcggcggtgaccgcgaggcggagctcaccgtcgacgactacgagggcagcccggagaagatcaccgacaagccggaccgttcgggggacccgggcgccgaccggcttgacgcggtcgccccgggcagtgatcttggggccgtggaggagagtcagtga

SEQ ID NO: 4933 - DNA, 891 bp, Actinoplanes utahensis
gtgagcgacgagcagtccgagtccctggccgcgcagatgggcgcgtgggtgcccccgtgggagcgccgccgcgacgagcccgaccgtgagttccaggacgcggtggacgcgccgcaggacatcccgggacaggagccggagccgacggagatcgaggtcgagccggagatccccgtgcccgacccgatcgaggaggcccccgagccgcgggagccggccaccccggtcgacgaccccggcgcctacctggccgggttccaggacgccgcggccgctgtcgcggagatcaccccggtcgtggtgccggctcaggccgccgccccggaggccgtcgagcgctcgctcgacgacgccgagctgaccgccgcgctggaggccatcctgctggtcgtcgacgagccgaccagcgagctgaagctggccgaggtgaccgagcagccggtggagcgggtcacccgcctgctcgacgacgtctcggcgcgctacaccgcggccggtcacggtttcgatctgcgccgcgcggccggcggctggcggctgtacacccgtccggagtacgcggcgtacgtcgagcgcttcgtcctcgacggccagtccgtccggctcacccaggccgcgctggagacactcgccgtggtcgcctacaagcagccggtgaccaggtcgcgcatctcggccatccgcggtgtgaactgtgacggcgtcatgcgtacgctggtcactcgcggcctgatcgaggaagtcggcaccgagccggaaaccggggcatacctgtaccggaccaccagcctcttcctggagaagctcggcctcaactcggtcgatcagctgccgccgctcgccccgttcctgcccgacgatgtggaagaagtacttgatgcctcaggctga

SEQ ID NO: 4934 - DNA, 765 bp, Actinoplanes utahensis
atgtggaagaagtacttgatgcctcaggctgacaccgccgaacgcctccagaaagtcctggcggcggccggtgttggatcccggcgcgcctgcgaagacctgatcttccggcggcgcgtcacggtcaacggccgggtcgccaaactcggcgacaaggtcgatccggccactgccgagatctacgtcgacgggcagcgggtgatcaccaacaccaagctggtctacgtcgcgctgaacaagccgcggggcgtggtctccagcctcgacgacgacaagggccgcaccgagctcgccgacttcctcgacgacaacttcgagcagcggctgttccacgtcggccggctcgacgccgactcggaggggctgttgctgctcaccaacgacggcgggctggcccacaagctgatgcacccgtcgtacggcgtctccaagacctatctcgccgaggtggtcggcccgctgccgcgcaccgtcggccgggccctgcaggccggcgtgatgctggaggacggtccggcgaaggtggacgcgttccgcctggtcgacgccgtcggcaagaccgcgcaggtggagatcaccctgcacgagggccgcaagcacatcgtgcggcggatgatggacgaggtgggtcacccggtgacccggctgatccgcaccgcggtcggcccgatccggctcggtgacctgcgccccggcggtttccgccacctgtcgaacgccgaggtcgccgccctgttcaaggccgtcggcgacgacgaggcctga

SEQ ID NO: 4935 - DNA, 528 bp, Actinoplanes utahensis
gtgacgaccgggtatcgtcctgcgatcgtgagcgaagttactgatcagtcaccggagttcatgccgcgggtcgagccgaagcggggtcccggccggctgctgccggccctgatcgcgctggtggtcggcgccggggcgaccttcggcgggctctacctggcgggctggcgggcgcagccgcagcgggagttcaacgtctcggtgttcctcaaggagaccgcgacccagcagcagaaggacgcggtccaggcggcgctgaagaagctgccgaccaagggcgacgtgcacctgcagaaccgggccgaggcgtacgccgagatgaaggacacctacgcccgggccgggcagccgctgcccgactacgtgaccgagcagaacctgcccgagtcgtaccgggtggccaccaccggccgcgagttcgactgcgcgccggtgacgccgctgaaggagaacaccggggtgaaccgggtcctggtggtgatgaccgcgctgtccaaggacaagccgggcgccgagatcggctgctga

SEQ ID NO: 4936 - DNA, 795 bp, Actinoplanes utahensis
atgacaagctcggcggacgtcaacgggatcacggtcagctacgacgactacggtgacggcccggccgtcgtgctggtgcacggccacccgttcgaccggtcgatgtggtggccgcaggtcgccgcgctgaccgcgatcggctaccgggtggtcgccgccgacctgcgcggctacggcggcagcacggtggtgccgggaaagaccaccctggagatgttcgcccgggacaccttcgccctcgtcgaccacctggggctcgacgaggtggtgctgggcggcctgtcgatgggcggccagatcgtgatggagtgccaccggctgttcgccgaccggatcgccgggctggtgctggccgacaccttcgcccagggcgagacgccggagggacacgcgcaccgcaaccgggtcgccgaccggctgctggccgaggggatgggcggctacgccgccgagaacctgcccaggatgatggccgcctacaacgtcgcggccatgccggaggtcgcccggcacgtgtacgccatgatgctgaacaccgctccggagggcgccgccgcggccctgcgcggccgggccgaacgccgcgactacaccgagctgctcacccgggtcgaggtgccgacactgatcgtggtcggacgcgacgacgagttcaccccggtcgccgacgccgagtcactgcaccggctgatccccgcgtccgcactgaccgtcgtcgacaacgccggccacctgccgaacctcgagcagccggaggcgttcaacgccgcgctgaagaccttcctggaccagtga

SEQ ID NO: 4937 - DNA, 1830 bp, Actinoplanes utahensis
gtgacgttcacggtcgacgagttcagcgcatggaacgaccagcttctcgcccgccgcgcggtgacccgccggtcgctgttgctgaccgcggtcgcggccggcgtgggcagccagttccggctggcccggcaggccttcgcggcggcgggtggcaccaccggcggcgccggtgtggtggtctccgggcggcatctgtccttcgtcccgggggccggtgacataccgctggacgcgatggcggtcaccgcgcagctggtcagcagcaccggatcacttccggccgccttgcgggcgtacgtcgacgtcggcgacgcgcccggcaactacggcacccgggtcgaggcggcggtcacccatctggtcgggcagtacgcgatcccgggcgggccggtcgccagccagttctacgccaaggcccggatcaccgggctgaagccgaacacggtctaccactaccgggtgcggctctcggacgggacggtgaccggcgacgcccatttcaccaccgcgccggccgccgccgagccgttcaccttcaccgcgttcgccgacgtcggcacgaacaccgcgccccgggatccggcgcgggtctggccggccgggatcttcgacgacaacgcgtacgggccgaacgatccgattgccgggaagtacgggaccgaccggacgccggccgccaccatcacccggttgatggacacccagcgacccgcgttcacgctgctggccggggacatctgctacgccaacacgtccgggaccgggctgccggccgacgacaccacggcgctgaccgggaaggcgccggccgggaggaacctgttcaacccgaacgtctgggacgtgttcctgaaccagatcgagccgcaggcggcgtacacaccgtggatgttcgccaccggcaaccacgacatggaaccggtgtacggcaacaccgccgttctcggtgacagcccgacccacgggtacggcggtcacgtgcaacgcctggacttcccggcgaccggaccgcggggctgcccgtcggtgtaccgcttcgtgtacggcaacgtcgggctgatctcgctggacgccaacgagctgtcctgggagctgcagtcgaacaccggttactccggcggcgcgcaggtggcctggctcaaggacacgctcaagcgctggcgggcggccggctccggggtggacttcatcgtcgcgttcttccaccactgcgcgttctccacagcgcacaaccacgcctccgacggcggggtgcgggccgcgatcgagccgctgttcacccggtaccgggtggatctggccgtgcagggacacaaccacctgttcgagcggaccgacccgatcagacacggccggcggaccagggcggcgccggacggcgcgacggtgcatccggagaaggacgggacgacgtacgtctgcgtcggctccggtggccgcccccgctatccgttccgtccggcgccgggtgccccggcacccgcgccgccgggggtcgtcccgaagggcgagcagaagctgcccgagggccagcggtatcgcgggcaccgggccaacgggcgggagaacacgtcgtccacggtcgccaacagctacttctgggccgagcacaacggcaaggcgaccaagggcgtccgggtgcccgagtcggtggactggtcgcaggtccgctacgacgggtacgcgttcatcgccgtcgacgtggtgccgccccggctcgccggcggacgcaccacgctcaccgtgcggaccctcgccgacgcgctgcccggctccggccaggcgcacaccgagatcgaccggatcaccctggagcggaccgcggggtag

SEQ ID NO: 4938 - DNA, 1593 bp, Actinoplanes utahensis
atgccggccacgtggcgcatgccgggcagcgcggcgacctggtggcactggtcgagcgcgctcgactcgatccagctggagggtgaagcgaaaacagacacactggcagacaaaactgacgctctttcccaggaagaagaggcgagaaaaggaaaccggggagattcgtcagtacgtcatgcgggacagttttgccgaccccgagcgcggcggcaaccggatatcccctggcatgatccacccatgcctctgctcaccgcgctgttgcgggacacggacgttcccggcttcgtcaccaccgtggaccggtcggtcagccggcacgagctgctcgcgatggccaacgccctggcggccaggatcgccggccgtcggatggtcgcggtcgaagccactccgtatctgtcgacgatcgtcacggtcaccgcggcattgctggccggcgtgccgatcgtcccgattccaccggacgccggtgagctggagcgggcccacatcctcagcgactccggtgccgacctcatcacgtacgacctgagcgaaaaatcggatgagacgccggcggaacccggcccgaacacccccgccctcgtcctctacacgagcggcaccaccggcgcccccaaaggcgtggtgatctcccgccgggcgatcgccgccgacctggacgccctggccaccgcctggcagtggaccgcggacgacgtcctcgtccacggcctcccgctctaccacgtccacggcctcgtcctgggcgtcctcggcccgctacggatcggcgcgagactgcgccacaccgggaaacccacgcccgaggcgtacgccggcactcccggcaccatgtatttcggcgtccccaccgtctggtcccggatcgccgccgccccggaccgggcccgcgccctggccaaggcccgcctgctggtttccggcagcgccccgctgcccgtcccggtcttcgaggccctgcacgagctgaccggccagtccccggtcgagcgttacggcatgaccgaaaccctgatcacggtcagcgcccgggccgacggcgaccgccgggccgggcaggtgggcatcccgctggacggcgtccacacccgcctggtcgacgagaccggcaccccgctgcccgacgacggtgtcagcatcggccacctgcaggtgtgcggtcccaccctgctggacggctatctgcgcggtgccggcgtccgcccggccgagctggtcgacggctggttccccaccggtgatgtcgccacgatcggcccggacggctggcaccggatcgtcggccgcgcctccaccgacctgatcaagagtggcggctaccggatcggcgccggcgaggtcgaggacgcgttgctgctgcacccggcggtgcacgaggcggccgtggtgggcacgccgcaccccgatctgggtgagcaggtgaccgcgttcgtggtcgccgacccggtcgccccggtggagctgatcgcctgggtggcggagcggctggccgcgcacaaacggcctcgaacggtgcacctggtgccggagctgccccgcaacgcgatgggaaagatccagaaaaaacgtctcaaaacggattag

SEQ ID NO: 4939 - DNA, 1086 bp, Actinoplanes utahensis
gtgtctgttttcgcttcaccctccagctggatcgagtcgagcgcgctcgaccagtgccaccaggtcgccgcgctgcccggcatgcgccacgtggccggcatgcccgacctgcaccccggcaagggggccccgatcggcgcggcgatgctgtcgtcggtcctctacccgctgctggtcggatccgacatcggctgcggcatcgcggtcttcccgttccggctcaaacgcgccgtgccggagaagctcgccgcccggttccccgacctggacgtgcccgaccctttccacatgccgccggttattgagatccccgatccgttcggcacggccggccccgccctcaccgacagcctcggcacggtcggtcgtggcaaccatttcgtcgaactggcccgcgtcgacaccgttttcgacgctgaccacgccacccgcctgggcctgtcccgcggcgacctcgtgctgatcgtccacagtggttcccgcggtctcggcgagcggatcctgcgcgcccacaccgaggtgcacggcgccggcccggccgccgaccccgaggcgtacctgtccgcccacgacgccgccgtccgctggggctcgctgaaccgccgggtgatgggcgcccgggtcgcggacgccctcggcgccccggtcgagcccccgatcatcgacgagtgtcacaactccgtcgagatccgcgacggcctctacctgcaccgcaagggcgccgccaacggcgacggccgcgacgtcctgatcgccggcacccgcggcaccccgtcgtttctggtcgccggccacgccggcgccgacgccggcttctccgtggcccacggcgccggccgcaagatgtcccgagccgacgccctccggcgcggcaaagtcaaacacaccatcgaagaattacgccgtacgccgttgggctcccacgtggtctgcgccgaccggcagttgctgttcgaggaggcgccgagcgcctacaagcgcatcgagcaggtgatcggggacctgaccggccacgccctggccagccggatagccagcaccgttcccctggtcacctacaagaccgcccacggcggccggaaatga

SEQ ID NO: 4940 - DNA, 801 bp, Actinoplanes utahensis
atgaaccgccggacacggatcggtcagggtgcttctgtcggtcccggttcgtccgtcgtcgcttccggtggtgggcgggcggtcgggtccggtggtgcttccggtggtgggcgggccctcgggtcggatggtgcctccggcggcggtcgggccgttgcgtccggtggtgaggcggtcgcgcgcgttcagctgctgctgtcggcgggtcgcgggccgcaggagtgttcgtgggcggtcgcccagctggcccgccgcctggaggcggacgcgcgtcgccatcggctcgccaccgcgcgcctcgcatcgatgcccggcgagcaccccgcgacgtaccgttccctgctggtgcgcgtctgcggcccggccgacgcggtccgcgcgttcgccgcctcctggaccggcaccctgtgctggcaggcgccgagcccctaccgcaccggccccggccgcaagaactggtatgtcaccgcccagcccggcgacctcgacacaccacacaccgccttccgggaatccgacgtggacatcgtcccggtccgcaccggcggaccgggcggccagcaccgcaacaaggccagcaccgccgtccgcgccacccaccgcccgtccggcctggtcgtggtcgtcgacacggaacgccggctctccctgaaccgtgccgccgcgctgcgcctgctccgcgaccgcctccgccggctcgacgaggccgccgcccggcaggcggtcacctcccgctggcgtctgcacgacgacctggtccgcggcgatccgacccgtgtggagcgccccttacactcgtga

SEQ ID NO: 4941 - DNA, 951 bp, Actinoplanes utahensis
atgggcgctactgtaagtgacctgatccgtatcgtcagtgacgatcatcataacggggacatccccctggtctgggacgcctaccgattcgccgaccgtgcccaccgcgggcaacgccgccgcaccggcgaccggctgatcacccacccggtcgcggtcgcggcgatcgtcgcggaacacggcggctcaaccccggcggtgtgcgccgccctgctgcacgacgtcatcgacgacgcccgcatccgcccgtcgaccgtgcgccacgagttcggtaccaccatcgccgacctggtcgacgacgtcgccgcccgagtcgtccgcgacctcgacctgtccccgcccacaacgccccctccccgccggaacccggttccgctgcgtcgcgccccggttgcaccaggtcgtgacctgcttccggccggccgtgacctgcttccggccggccgtgaccgaatttcggccaaccgtgaccgaatttcggctggccgtgaccgaatttcggcccgccgtgacctgatgctgatcactgccgctgatcggttgcacaacctgcggaccgtccagccgctgccaccatcccggcagcgggcggtgtccctcgacaccctgacgttccatgtgccactcgcccggcacctgcgggcccccgcgatcgtgacggagctgaccgacctggcctgccggcatctgatcaccgccgaccggcccggcctccggatccgatcccggcgcctgttcaccgtcgcccgccgcaccgacccccgctggatcaccgagaccaccgcggccctcggcggcggcgccctcttgaccagcggcatccttcccgagtgggccgtcgccaccggcggcgccggcctgctgaccctgctcaccgccgcactcttcagccgcgacccgaaggccgccgatcgtctcgcctcgctgatccgcgcctggcgccgcgactga

SEQ ID NO: 4942 - DNA, 1275 bp, Actinoplanes utahensis
atgtgccgggccggccacgcgcctaccgtctgtcgcatgcggacacttcggcgaaccatcgcaacggtcctgctggcggcggtggcagcggcgggcttcggcacgcccgctgccgccgggccgtcgccggtcgcgcggggcaggctggtcgcggcccatcccgtcacgacgtaccagtcccgggatcaggtcgcggccttcctcgcggccaaccacttcgacgccaccattgcgcggtacggggtgagcctgcaccagctcatctaccgcacggtcgatccgaacggccggcccaccaccgcgagcgggctgctcgtgctcccgctcgacggctcgtcgcacctgcgcacggtgtcgttcgggcacggcacgtcggtgtatcgcggggatgccccgtcactgggcaccgacccgttcctgaccgggccggcgatctcgttcgcgtcggccggcttcgccgcggtcgcgcccgactatctggggctcggcgccggcaccggcccgcacccgtggatggacgtgccgaccgagacgagcgcgtcgctcgacctgctccgggcggcccgcacgttcaccgccgggcagggccgtgagctggaccgggaggtgtacgcgtcgggcttctcgcagggcgcgtcggccgcgctcgggctggcccgggcgctgcggtccggggccgacccgtggttccgggcggccgcgatcgcgccgatcagcggtgggtacgcgttgcgccgggtggagatcccggcggcgctggacccggcgtccggggtggtgccgcggctggcggcggcctacctggcgtacctgctgacctcgtacgaccggtggcacgacatctatccggatccggccgtggtgttcaccgcggactacgtcagtatcggcgacctgttcgacgccggccatcccggtgcgcaggtgctcgccggggtgcccgagtcgcccgccctgctgctcaccccggccggccgtgacctgctgtcgcacccgcgaggccggttcgcggcggcgctgcgcgaggcggacagcgtctgcgagtggacgcccggggtgccggtccggctgtacttcagccccggcgacgagcaggcggtcaccggcaacacgacggcctgccgggggtcgttcgccgcgcacggcgtccgggtcccggtggtcgacgccggggtggacacctcgtacgacggcatggtccacgagggatccgagctcctcgcggtgccgatgatcacccgctggttcgccggactggccgggatgtccctctga

SEQ ID NO: 4943 - DNA, 681 bp, Actinoplanes utahensis
gtggcgctagaggtacggccggcgaggtgcgtcgtggcagtcgacggcccgtccggctcgggcaagtccaccgtctcccggcgcctggcctccgcggtcgacggcgtctacctggacaccggcgcgatgtaccgggcggtgacctgggcggtgctgcaggcgggcgcggacctgaccgacccggagtcgatcaccaagatcgccctggagaccgaactgtcgatcggcaccgacccgcaggcaccgcacttcgccgccaacgggacgaacgtcgacgcaccgatccgcggccccgaggtgaccgccgcggtctccgccgtcgccgcggtcccggccgtgcgtaaacacctggtcgcgctgcagcaggcgatcatcgcgggccagccgcggatcgtcgtcgagggccgcgacatcgcctccgtcgtcgcacccggcgccgacctcaaggtatatctgaccgcctcgtccgccgcccgcgcccagcggcgcagcgccgaggacgccaccgatgtggcggccaccgaggcggacctgacccgccgcgacacgctggactccagccgcgccaccgacccgctgcgccaggcctccgacgccatcgaggtggacaccaccggaatgggcatcgacgaggtcgtccagcaccttttgactctgctgaacagcaaggtaagtaagtga

SEQ ID NO: 4944 - DNA, 1437 bp, Actinoplanes utahensis
gtgactgaatttcccgccgacctcgacatcaacgatttcgagggtggcctcgacttcccctcccccgcgggggaggacacctccgactccttctccggcccggtgccggtggtcgccgtcgtcggccgtcccaacgtcggcaagtcgacgctggtcaaccggatcatcggccgccgccaggcggtcgtcgaggacgtgcccggcgtcacccgcgaccgggtgccctacgacgcgtcctggaccggccgccgattcaccgtcgtcgacaccggcggctgggaacccgacgccaaggaccgggccgccgccatcgccgcccaggccgagatcgccgtccagaccgccgacgtggtgatcttcgtggtcgacgtgacggtcggcgccaccgacgtcgacgaggccgccgtcaagatgctgcgccgcagccacaaaccggtcatcctggtcgccaacaaggccgacaaccagaacctcgaactcgaggcggtctcgctgtggtccctcggcctcggcgaaccccaccccatctcggccctgcacggccgtggctccggcgacctgctcgacgacatcctcgacgcgctcccgcccacccccgccgtgatcgagggcgccccgcgcggcccccgccggatcgccctcgtcggccgccccaacgtcggcaagtccagcctgctcaaccgcctcgccaacgaggaacgcgcggtcgtcgactcggtcgccggcaccaccgtcgacccggtcgacagcctggtccagatggacggcgaaatctggcagctggtcgacacggccggcctgcgcaagcgcgtccaccaggcctccggcacggagtactacgcctcactgcgcaccgccggcgccgtcgaggccgccgaggtcgccgtggtgctgctcgactccggcgaggtcatcagcgaacaggaccagcgcgtcatcacccaggtgatcgaagccggccgggccctggtcatcgccttcaacaagtgggacctggtcgacgccgaccgccggttctacctggacaaggagatcgaccgcgacctcaaacgggtgacctgggcagtccgcgtcaacatctccgccaagaccggccgggccgtcgacaagatcgccccagcggtacgccgtgccctggcctcgtgggagcagcgcatcccgaccggggcgctcaaccagtggctcaccgccctcacgcaggccaccccccacccggtccgcggcggccgcgccccccgcgcgctcttcgcgacccaggcaggcgtggccccgccgcgcttcgtcctgttcaccaccggcccgttcgacgcgggctacctgcgcttcatcgaacgcaagctccgagaggagttcggcttcgaggggacgccgatcgagctgtccgtgaaaccccgcaagaagacggggccgggggggcgggggaaagctcatgggtga

SEQ ID NO: 4945 - DNA, 375 bp, Actinoplanes utahensis
atgagcatcttcgacctctacggtcagacccagcacctcgaacgcctcgatccgcagggcgtcaccgacttcgtcaacgacgaactgatcgtcagcgacatcgactcccggcaggccctggaagacctggcctggatgaccgccgggctgttcagcgacggcaacggactcgcccagctctacatcgacgacggctgggacgtgaccgacgggagccatcacgggctcaccgaacaacagcggggcgagctgatcgcccgcctgggaaccatcgcgcacaactgcggccagctcgtggccgaactctgccgccgcgcgtcggccgtgaaacgcgaatccgggtgggacccgctcgtcaccaccgaacccatctga

SEQ ID NO: 4946 - DNA, 882 bp, Actinoplanes utahensis
gtgagcaccatcgcctgcgatccgctcggcaccgaccgggtgcctgtcgggcctggcatgtcgatgttcgatcccctgttcatcggcatcgacgagtttggcgagcacgtcacgctcgacatcgtctaccacaacctgcttaccgctggtgagcccggcggcggcaagtccggcctgctcaacctcgtcgcggcgaccgccgcactcagcgacaacacccgcctgatcggcatggacggcaaatgggtcgaactcggcccctgggaaccgatcatggacgccttcatcggcgacgacatcgacctggccatcaagaccgtgcgtcgcctgctcaccgtcgcccgcaaccgctaccgctggctgctcgccaaccgccgccgcaaaatcacacgggaggacaacctctccacgatcatcaccatcatcgacgagatcgcgatgttctcgaccgtgctaggcaccaaggcccaacaggaagagttctcgaccctgctccggggcctggtcgctctgggccgcgcctgcgccatgcccgtcgtcggcgccacccagcgcccctcctgggacatcatccccgccagcctgcgggacctgttcggctaccgctgcgccttccggtgcaccaccgtcggctcctccgacgtcatcctcggctccggcctcgcagaggtcggcttcgacgcctccaccatcagccccgacaaccccggcgaagccctgctgcgcgccgagaagaagctcccgtacccgatcaaggcggcctggctgtccgacgacgacatctacgccatcgccgactatgccgcctggctacgccgccctaccaatcccgccaccacgacctcctacaccgggcgcacccaatgggagatggcggcatga

SEQ ID NO: 4947 - DNA, 327 bp, Actinoplanes utahensis
gtgagcctgtcgtacgtcaaccctgccttgacacctaccgccccggccggtgacagccggccttcgaagccgcgccgccgcgacgtcgtcgagaacgacgaatacgccgccttcgtccggcgcatcatccgcgccttcgccaaacgcgtcgccaccggcgacgtcgaagccctgcgcgacatggtcggactctccgcccagctcgacgacgccatcagcgaggccgtcatcggcctgcgcgcctacggctattcctgggccgaaatcggcgaccggctcggcatctcccgccaagccgcccagcaacgctggggaggcgataaatga

SEQ ID NO: 4948 - DNA, 417 bp, Actinoplanes utahensis
atgaccacctccgccctgaccaacgactacctcgaagccctcggcgcccgcaccggcatccgcgtcgagttctacgaccccaccggcagccgctacggcttccccaccttcccctaccggcaggcgcccgagcacctggccacccgacgccagctgcgcgccgacggcctctgccccaacggctacgaccccgtcgcccagatcctgtggatgcaccgcggacaacgccgcgtcgcctacctctaccggcgcgacctcgccaagccgaaacgtgttcccaccgcggcgcagctcgcggtcgtcgccaagatgctgctcgcccgccgcacctgcgactcctgcggcgtcacccgtgactactacatcccgcgccgcaccggtatctgcctgagctgcgaagtaggaggcagccgatga

SEQ ID NO: 4949 - DNA, 291 bp, Actinoplanes utahensis
atgagcctcatcgacctgggcaagcacctggccaccgacaactgcctgtggtgcatcggcggcatgagccccgccggtatccacccggacctcggcccggtcctgtgcctctgcccgaccgagcagtggtgcgacgaatgcggcagcacgtcgctgttccccgccgaatacgaaaccctcgacgaccgcatcaacgaactgttcgacgacggcctgtccgccgtctggtgcgaagcctgcatgggcgtcgtcgcggtcatccccgtcaccaacgacggaggcatccgatga

SEQ ID NO: 4950 - DNA, 510 bp, Actinoplanes utahensis
atgaaccctctccgcaggaaggcggcccaacagccgaccaccggcccggccgcccccgcgagcgtcaacctcaccgaacagttcgccatcgagtacgccaagagcgccgtcccgaacatgctcaaggccatcgacagcgtcaaacgctacaaccgagccaccctcatcggcgcactgatcaccagctacctccaccaggcccactacctggccagcaccggcgcgggctacttcgcctacctacccccggcgatcttcgacaccgccatggtctcgatgctgatcgtcgtccgcacccccggcatcgtcaaagacgccaaacgctgggccatggccgtcttcatcggcgcagccctgctctcggccaccgtcaacttcgccgccccggcgacctcggcatgcgcatcgtcttcgccctggtcgtcgtcgtggtcatcggcgtcgaactcgtcgccggacgcatccgccccgacttcaccgccatcgacaaacaagccaccgaactcatga

SEQ ID NO: 4951 - DNA, 495 bp, Actinoplanes utahensis
gtgctcatgtcaggcagcgatcctggtggtggcgagctgcgggccgtggtggccgacgaaggtgctggtgatgtgccgttcgatgacggtgatgcggcaggccgggcattgccgatggtggggttcgtgacggccgcagtcgataacggcggtcttgtcgccgcagcggatggagatggggttgcggcaggggccgccgtcgacggtggcgacgatggtgcggcgggtgtcgaacgggtgcagctcagggttggctgggcaggtgtgggtgatgtggtggatgtcgacgtggacgaaggtcatcgggcgccgccggtcagggtcgggatgtgcccgttgatgcgtgccgggttggtgtcccggatggtggtgatcagggtttcggcgacggccggggtgatgttgagtcgcagggcgaggtcgtcggcggtgatgggctggccggtggtctgctcgtgctggacgaccgagaaccgggcggcgggcagcaggtga

SEQ ID NO: 4952 - DNA, 294 bp, Actinoplanes utahensis
atgaccttcgtccacgtcgacatccaccacatcacccacacctgcccagccaaccctgagctgcacccgttcgacacccgccgcaccatcgtcgccaccgtcgacggcggcccctgccgcaaccccatctccatccgctgcggcgacaagaccgccgttatcgactgcggccgtcacgaaccccaccatcggcaatgcccggcctgccgcatcaccgtcatcgaacggcacatcaccagcaccttcgtcggccaccacggcccgcagctcgccaccaccaggatcgctgcctga

SEQ ID NO: 4953 - DNA, 1797 bp, Actinoplanes utahensis
atgagcacgtcgacgctggacctcgcaccccgggagaactctgcccggggtgcgggctcgaacgccgacgcctggacacccccacccgccgactacaccgcagccggccaagccctcacccgcgccacccaacccggctacttcgactggctcgaccacgtccgcgccgccgccgggtgcacccgcccggtccggctcaccggcaccctcgacaccatcgaagccaccaccgggcgcctgctcgactcccggcacaccgaccaacttcccgatgccgctatctacaaggcctgcggtaaccggcgctccaccgtgtgccccgcctgcgcccgcacctaccagcgcgacgcgttccagatcctgcgcgccgggctcatcggcggcaaaggcgtccccaccacggtcgcccggcaccccgccgtgttcgtcaccctcaccgccccctccttcggcgcggtccacacccgccacgtccgcaaacacacctgcacgaatcgcgcccgctgtagctgccgccccgaaccctgccacgcccgccgcaaccccggcctctgccagcactaccaacccgccgtctgctgggcacgccacgaacccggcgacccccagctcggccgtcccctctgcctggactgctacgaccaccagcaccacgtcgtctggaacctgttctccggcgaactctggcaccgcaccaaacaggacgccgaacgccgcctcgccaaactctgcaaagcccgcggcatcccgttccacgaggtcagcaacggcaaaaacctgcgccggatcccaccggtccgcctcgcccacggcaaagccgccgagatgcaacgccgcggcgcggtccacttccacgccctgatccggctcgacggcatcgaccccaccgaccccacccgcgtcgtcgccccaccacccggcatcggcctcaacgacctggtcgacgcactcaccgccgccagcgacatcgacttcaccaccccagaccaccctgaccggccggacggctggccgatggcctggggcgaacagatcgacatccgcccgatcagcctcaccggcaccggcgaagtcaccgacagcatggtcgccggatacctcgccaagtacgccaccaaaagcaccgagatcaccggccacaattcgacgcgcatcaccggcgacaccatcacgcagcacgccgatcccgccggagaccacatcgcccggctcatccacgcctgctggcatctcggcaacgaccccgacgccccagctggcaaaacggcgatccgactccccgtctacaccggcaccgccggtgccaaaatccggcagccctttggagcgccccgccactgtccggactgcggtacccgcacccgctaccggacctgccctgtatgcgtcgccgaacgtcaagccagccttgacacccaacggcccaacgaccgccagcccaccccatacgcccggctccgccgctgggcgcacatgctcggcttcggcggccacttcctcaccaaagcccgccggtactcggtcaccttccgcctgctccgcgagactcgcatcgacttccgccgggctgagcccgatccggccgacaacgccaccgtgcacaccgtcgaccacctcgacgaaaccacgcttatcgtcggcaccctgaccttcgccggagtcggctggcacaccaccggcgacgcactcctcgccaacaccgctgcggctcaggcccgcgagcgacaagccatcggccgagaggaactcgcgcacgaagcgagcacgtcccggcctgtcgccttgaacgccgcctga

SEQ ID NO: 4954 - DNA, 207 bp, Actinoplanes utahensis
ttggacggcatcaccccgaaggcgctctaccgcatcccggaagccatgcggatgctgagcttgagccgttccgtcatctatgaactgatccgctcggggcggttgcgcaccgtcaaggagggtcgcacccggctggtcccggccagcgccatcaccgcctacgtcaccctgctcgaacaggaaagcaagaaaggagtcgccgcatga

SEQ ID NO: 4955 - DNA, 1167 bp, Actinoplanes utahensis
atgaccaaacgccgcagccgtggagacggcgggctgcactgggacgaacagcgccagcgctggatcgcctcggtcaccgtcggatacaccccggccggtaaacgcatcgtccgtaaggcaagcggcaagaccaagaccgaggccaacaatgcactccgtcagaagatccgtgagtaccaggacgggctgtcgatccccacgaccggctacacggtcgccgacgccgtcacggactggctcacctacggacttcccgacgtcgacgaggaaacggtcaacaactacacgctgctggccaacggtcacatcatcccggcgatcggtgcacgcaagctccgtgaccccagcaaacagaaggaactcagcgccaccgacattgacaggtggctggccgacaaagccaagattctcagcacccgcacgctgcgactgctgcactcgatcgcgaatcgcgccatcaaccgagcgatggcccgcgacaaggtcatgcgcaacgtcgtcgcactctgcaaggtaccgaccggcaccgccggacgaccctccaagtcactcacctacgagcaggccaaagcgctcctcgtcgctgccgagtcgagcagcctgcacgcgtatgtagttttgtcgctgctgaccggtgctcgtaccgaggaactgcgagaactcacctggcagcacgtcgacctggtcggacgtccggacgccgagccaccgattccgccggccatccacgtatggcattcggtgcgcgcccacggtgacaccaagaccaagaagtcacggcgttcactcgccctgccggttcgctgtgtccgggtcctcaccgcgcaacgcgcggcgcacggagatccacgaccggatgactacgtctgcgccagcaaggtcggcacccagctcgaccggcacaacgtgctgcgagccttccgcgcgatcgtcgcggctgtccccggaatgaatccggctgaatggacgccccgcgaattacggcacagtttcgtttcgctgctgtccgacaatgggatgagcatcgaggaaatcgccgacctgtgtggtcattccggcacctcgatcaccgagaccgtttaccgccaccaactgcgcccggttctgctgaacggcgcggtggccatggaccggatcttcggtccggatgacactcctggggcttag

SEQ ID NO: 4956 - DNA, 855 bp, Actinoplanes utahensis
gtgtccaaatctacccgtcccggccgttctgggcgaggctccggaactgtcaccgtcatcgagcagcgggtacatcgctcggctgccgagaacgcgcgtttcgcgttcatcttcaccgtcatcgtgagcggcctggtcgctctggtcgtggccaagggccacatgcacccgctgctggccgcgttcgtcgcggctccgatcgccgctgtctgcggcgccctcgtctgggcactggtccgtagctggccggtcctgcgaatgctctggtggtggactcccgaaatcggagccaccgtcctgctggcctggggctggaccgccctggccgccagtacctcacaaatcttgaccgcggtcatccttgccgtcctggtcggcggcccggcctgcgttccggtcctgcgccgctggaccgtcgccatcttctggtgtgtcgccgtgcggcatcgcctgcgcgtctgcttctcgcagttcatcatcaccaaccgctccggtagcctcccgctgatcctcggagcctggcccaccccggtgggggaacgagtctgggtcctactgcggcccggcctgtcggtcgattacctcacgcagcaggtcggcaagatcgccgtggcctgccatgccaaaacggtcagggtcgacctggccggtagcaccaattctgcgttcgtgcgcttcgacatcaagcgccgcgaagtcctcaccgccaaggtgagcacccccctgatcgacgagatcgatccgatcgtgccgctcgacgataaagagtcggccactgtcacgggcctcgacctgcccgacatcgacgacatcccgacggccaccgagccggccatcccgaaactagctagctag

SEQ ID NO: 4957 - DNA, 210 bp, Actinoplanes utahensis
atgttccgttactacgtgtcctacatgttccaagggggctacggctccatcgacatccactcgaaaaatccgatcaccgaacagggtgatctcctcgagaccaaagacctcatcaaccaggccgctggccgcattcttcctggcctcacggttatggccttctcccggtacggctcggtgcagccgaagccccagcgcgctcagcgctga

SEQ ID NO: 4958 - DNA, 393 bp, Actinoplanes utahensis
atggagggcggagccgatcggctcaacaaaaaggttcgggattccagttggatccctggaacgaaggagatcttcgtgaagctgtacgtggacacgaccggcaagcaggtgacggtgtcgaagccgaccgagccgaagaacgaccagaacggcaaccagcgttccgagaagaacactggccggcccatgtggtccacccaggtcatcgtgctcgacgagaccggcggcgaggtcatcgccatcacgacggctggcgaaaagccgaacgtgacggtgggacagctcgtcgccatcgagcagctcgaggccattccgtgggcgaccaacgggcgtaacggcgtcgcgttccgtgcggtgtcgctgaagccgctctccggtgcctcggcgaagtag

SEQ ID NO: 4959 - DNA, 1335 bp, Actinoplanes utahensis
atgacgccgctgcggctggaaaggcagaagctcggctggtcgagaacccgccttgctcacgaactggagcgacgggcgcagggaagattcagcctggccaccagagcgagtcttctgcggatgatctcagcgtgggaaagcggcgcgcgagacacctcggacccgtatcgcactctgctgtgcgaggcgtatggccggaccgctgacgagttgggcctgggtggtggcaccgaccgagcagaatcgagcgtcggcctgtcctacgcttcatcgcttgacgcggcagccgcaatactttctgaccttgcccggttcgatgacatgaagcaccctgcggtgagccagggccgctaccagcccgatgcgttgaacgcggtatgtctggactggctgttcggcacagcctcgaatgacatgccagcaggcgctggaaaacgcgtcaccatgaaggacgtcgaggagatccgcgccaccacgtcgatgttcgacagcctggatcgccgattcggaggggagaacgcccgcagtatggccgtgcgttttctgcgcgaggcggtgctgccgagattcggcaagacatccgaccagaccgtaactactgagctttacagagcagcagcgatcctctgcgagctgatcgggtggatgtcgttcgacacctcacgcaactcgttggcacagcggtatttcacccaagcgctgcgattggccgaggcagctggtgaccgcgcctatgcctcgtacatcttggcgagcatggcggaccaagcgctcttcctgaagaggcctgaccaggcgctacgacttgcacaggtcgctcgcgatgcgggggaaaaggccggcgttgcggtggccacaaccgaggcgagcatgctggaggctcgcgcattcgcagcccagggtgacgagagcggctgcaccagggcgttgcttcgcgcggaagccgccttcaacagcatcagcgcagacgacaacccgagttgggcgaaccactggggtgacatcttgtttgccagtcacgctggcacctgttgggtcgatcttggtgcgccgaaggaggcagcgagcttggttcggacagtctgggacagcgcgaaggatcaggcccgtcgtcgggtctacagcggcgttcagctcgctcgcgtggcgctgcttacgaacgaggtggaacaagcggtgtcgtatgggatcgccgcccttgaggcgacgagcggcttgacttcgaatcgctcgttgcagcagcttcgcgacctgcgtgatcagcttggaaaccatgccaagcatcctgctgttgtggagttcgaggagcgcgctcgattggtgctggccgcttga

SEQ ID NO: 4960 - DNA, 537 bp, Actinoplanes utahensis
ttgagtaccgtaagcctcgtgacgttggccgaggacctggaccgcgaaggtgaacccgagcgggagttcaaccccgggatcgcgcagcgactacctaggaagcgggttgctggcggagcgctgatccgcgactcggctgatcgaatcctgttcgtcgtgccgaactacaagcccctgctggacatccccggcggcattgccgagggcaacgaatctccgctcgcagcgtgccgacgtgagatcaaggaggagatcggcctagacctgccgatcggccgacttctcgtggtcgactggatcccgcagcacggcgtgtggccggacggcgtgatgttcatcttcgacggcggccggctaaccgacgacgagtcccgcgacctgaagcacaccgatgatgagctggtaggactgaagttccttgccctcgatgatgcacgccatcagcttcggccctcaatggttcgcaggctcgaagcagggatagaggccttgtccgatggagagccgcggtatctggagttcggtcggactcagtaa

SEQ ID NO: 4961 - DNA, 126 bp, Actinoplanes utahensis
gtgactaactgggtgacaatcgccaacgatcatggcggacaagcgtggacgctgatggacgtggacccgcaggtgagcagtgtgttgaccaagttcattcaagatcatgagttgctagctagctag

SEQ ID NO: 4962 - DNA, 1137 bp, Actinoplanes utahensis
atgactgtcggctcgtacgaactctccaacggcaagaccaactggtacttcgtcatcgacctcccgatgggagacgacggaaaacgacgccagcacaagcgccgcggattcccgaccaagggcagtgcgaagaaagcggaaaccgaagcgcggaaagcgtacggggacgcgagcatcgccgctgatggaagcgtcgcggcggagctggacggctggttgtcggagcgtgaactcgatatcgaagagaccacgctggacagctacaagaacatcattcggatgtacgtggtcccgcacatcgggggccggcagctctacagcctcgacaagcgggtcgtgcaggacatgtacaagacgctgttgcgggagggcggcaaggacaagaagccgttgtcgccgacgacggtgcgcaccacgcaccgggtgttgcagcaggcgttcaaggatttggggatcaatctggagaacgtgcggcagccgcggccggccgaacgtgaggatcacggccgtaagggggtgtggtcgccgcagcagtcgaagacgttcctgcggcatcaccgcgatgctcgactgtatgcggcgtgggcgttggcgatcgtcgcgggtatgcgccgtggggagctggcggggctgcgctgggcgaagatcgatctagatcaggggatcgtgtacgtgcatatccagcggacgatttgcgggaacaaggtgatcgagaaatcgccgaagggcaagagtcgccggccggtagcgatcggcccggcgatggtgagggtgctgcgtgagcacaaggtccggcaggacgctgagaaagcggaggccgggctgttgtatcacgaccgggactacgtgttcccgcgtgaggatggggagccgtactacccgcggtacttcaccgacatgtgggagaaagcttgcctggaggcgggggtgaggcagatcgtgctgcacgacgcccggcacacgtccgcgacggcgggtgcggacgctggtgtcccggagcatgtgatgcagaagcggctcggtcatgcggatgggcggaccacgcgggaggtgtacacgcatgtgttgccggagagcgagcgtaaggcggctgagttgatggactcggcgttgcaggactgggacgaggcggcctga

SEQ ID NO: 4963 - DNA, 399 bp, Actinoplanes utahensis
ttgcgactcctcgcggaagcccgatggcgccatcccagcaacacctgccgcttcgaggccgagtacctgtccatcaccgaggaccccgccgacaacaatcccgagcggtacttcgtcgagctgtcagcaccccaccccgacaaaagccacagcagcctctggactctggaactacagcagtggatcccggactacgacgactccgaggacgacggatccgccaccagcgaaaacatcctcgactgccatctcgacactccaccagccgtcgaccagatcgtcgccctgctcaacctctgcaccgaccaccccagcttgctgaccacctgggccaaaacccccatcggcaattcgctcgccggcaccccgtacgtcgtcgacgaacgccacgacgactaa

SEQ ID NO: 4964 - DNA, 321 bp, Actinoplanes utahensis
gtggcgaacgcgctcaccgtgatcgccgagcaccgcggcgaagcgtggaatgaactcgcccgcatccgcgacagctaccaccggcgaattagcccttggctgactctgatgctgcaccgagcggtcaccgcgacaccaacggagacgctacgccatccgacctcaccgcgtcttcttcccgtcctgcccggcgccatcctgagccctgacccgggcatgccggaccccgattacctcacccaccgcatcgcccgactcggcaccggcgggactacccagccgtgcccaccgaaaggatcgacatggacaacgcactggtga

SEQ ID NO: 4965 - DNA, 327 bp, Actinoplanes utahensis
gtggcccggcggccgcaggtgtggaatccgcgtgcttcaggtgaaagcctgaccctcgtcgaagtcaccggcccggacggcggcgaggaagccggcgaaatccgcgcggcttacctgcagtgcgtcggcgtcggggttcttcgagtcgcggatcaagatttggtcgtcgacggcggcgacttcgacgcaggtgctggtcgcgcagcggctgctgcgttgccacgccgggccgccgctcaccagtgcgttgtccatgtcgatcctttcggtgggcacggctgggtagtcccgccggtgccgagtcgggcgatgcggtgggtgaggtaa

SEQ ID NO: 4966 - DNA, 96 bp, Actinoplanes utahensis
gtgctggtcgcgcagcggctgctgcgttgccacgccgggccgccgctcaccagtgcgttgtccatgtcgatcctttcggtgggcacggctgggtag

SEQ ID NO: 4967 - DNA, 120 bp, Actinoplanes utahensis
ttgatccgcgactcgaagaaccccgacgccgacgcactgcaggtaagccgcgcggatttcgccggcttcctcgccgccgtccgggccggtgacttcgacgagggtcaggctttcacctga

SEQ ID NO: 4968 - DNA, 480 bp, Actinoplanes utahensis
atgctgctctacgcccagcccgccagccgcatcgtccgtctcaccagcgacgacatccttcgcgacggcgatcaagtcctcatccgcctgggcacaccgccctcaccagtccctgaggcactcgccggcatcctgctccagctcgtcgacggccaaccggacccgacgagcgccgccaaccccggcaaccgctggctgttccccggctacagggccggccagccactgcatccgagaaccctgctgctactcatccaccagcccggcatccccgccaaagccacccgcgtggccgcattacgccaactcgtcctgcaagcccggcaccagtcatcgccgacgccctcggctaccacaacaaacacgtcgccaaggtctggaccaaaacaggtggcacctggaagacctacgtccccggcgaccacagcaaatgaccatccgatggggcgttcctgtcctcatatacgcagttgtttatga

SEQ ID NO: 4969 - DNA, 195 bp, Actinoplanes utahensis
atgatccatttccttcatcactacacggagatcatgactgatcctgcgcactttgccgccgagatcacgatgatgctcttagtcgatgtgctcttcctcggactgatctggccactgctacgtcgagccatcgacaggcgggtacagaaccggcaccgcgccatcgaggacgccgacacccaccagcctcgataa

SEQ ID NO: 4970 - DNA, 276 bp, Actinoplanes utahensis
gtgcccaagccctacccccgggagtttcgcgatgacgtcgtgcggatcacccaaggccgtgacccgggcgtgacggtcgagcgaatcgccaagaacttcggggtccacccgatgacgttgttcaagtggctgcgccaagccgaactcgacgccggcgccgagcccggcgtgagtcgcaatgattccgccgagctgcgcgaggcccgcaagcggatcaagctcctcgagcaggagaacgaggtcctgcgccgggccgcggccagtcaggccgcgtga

SEQ ID NO: 4971 - DNA, 1224 bp, Actinoplanes utahensis
gtgtccaagcctcgttgtccgcgcaagccacccggtgccggcccggagcaagcgaaacgtgatcactaccttcgcctcatggcgcagggcatgaacaactcggcggcctgcagggaagtcgggatcaaccgtcgcaccggcacccgctggcgatacggccggaccatcatcagcgcggacggcgagtccagggtctatgcgccgatcgctgtgccgaagcgggctgtttcggcccgctacctgtccgagtccgagcgcatcaccatcgctgacgagcaccgagccggcagctcgattcgggcgatcgccgcactgctggaccgagcgccgtccaccatcagccgagagatcagccgtaacagcgacccggcaaccggcgactaccaccccttcgccgcccaccagcaggcggcggcacgtcgcccacgacccaaaccagcgaagctacaaaccaacaccgagctgcgcgacctggtccaagagttgctaaatcaacggtggagcccggagcaaatctgccgtgccctgccgctgcaacatcccgaccggccagaactgcggctaacacacgaaacgatctatcaggcgttgtaccggcccgatcgaggcggcctgacacgcagtcgctcgccgctgctgcgcaccggccgcacgtatcgcaagcgccgtcgcagccgcgagcaacgcactccgcggttcaccgacagctcgaacagcatccacgaccgtcccattaccgccgacgaccgcggcatacctggacactgggaaggcgacctaatcatgggcgcccacaaccggacggccatcggcaccctggtcgagcgcagcacccgctacgtcatgctcgtccatgtcccgcaaggtcgcaacgccgcacactttcgcgaccagctcatcaccgcgttctcgaccctgccgacggagctaaggcagtcgttggcctgggatcagggcgtcgagatgggccggcatgccgagttcaccgccgccaccagcacaccggtctacttctgcgacccggccagcccctggcagcgcggctcgaacgagaacaccaacggcctgctccgccaatacttccccaagagcagcgacctcagcgtgcacaccgccgaagacctgaccgccgtagccgccgaactcaacaaccggccgcgcaagaccctcggctgggacacccctgccctgcggttcgcccggttactcgccgaagccgcatga

SEQ ID NO: 4972 - DNA, 564 bp, Actinoplanes utahensis
atgatcacgtttactgatctgccgagaaccgtgcactcgacaacgcatcgcggcactgcaactatggagcctgtgccaggtcgaccaccaccaaagccgtacgacttcgccggtccgagagcacgctacttcaaagcactgatccaaatggtaatcgggatagtcgccgttctcggcattggcgtatggctagtcgtcaaactgtttgaacgcccgttcccggcagtgcacgatctcagtgacgggattttcggcggcatcggcttcgccctcggattggcagccgtggtggagctcgcctacaccttgttcaccgatggccccgatgaggcgctgaacccggtgatgctgggtgttgcggctgcactgttaatccaacttggcagggtcgagactttcaaactcggcgaggcgctggccggactgctatacgcggccgcgttggccggtctatttgcgactaggcgttggctggccgagccggaggacgaacagagctggagcccgccggcaggctgggcaaaacgatggcgtcgtggctctaccaagtggcatgtacgttag

SEQ ID NO: 4973 - DNA, 726 bp, Actinoplanes utahensis
gtggcaaaggtatcggcgggagcgggcactggtctgtatgcatctcggccgaggcagcgtacatggacctgcggagatcattgcatccgaccttgtcgatcaacgccgcaggttggttgtcgcgacgcgttgtcgaccacgtccagcggggcgctgctgcggagcgtgcgacactccctgatcgtggacaccgatgatgtgtggcaactggttgaacaggctcgacgggagcgggacggctcactgcaggcagacgaggttgcacaacgcatggtcgagttgctggcagaacgtgagccagctgagattgcctccttcgctcagcccttgtgggatctgctcgccgagtcgtaccgggtcgagctttgggcggccgcctacgtagtcaacggcggtgcctctgatgacggtttcgactacttccgcggctggctgatcactcagggacgcacggtgttccagcaagcagtcgccgatccggacactctcgccgacaaccccatcgtcatccaatccgctgcagccggcgagtgtttggaggatggagatgtcctcaacgttgcctcgaacgcgtacctggcagcgaccggccatgagctgccacatgatgccttcaccatccggtacccggaactcgacttcacctgggacttcgacgacgaggctgagatgcgtcaacgcctgccgcgccttaccgatttgcactaccagtcggccgaggcataa

SEQ ID NO: 4974 - DNA, 3792 bp, Actinoplanes utahensis
atgtacaaccggccgacgaagtcggctgcgccggccggggcggggacaccgtccggggtgccgctcagccacggcagatcgagcaggccgttcccgtcgacttcctcgaacgtcaggtgggggaccggatggatctggtacccgaacatcagcgcagcgtcgtaccgcatggtcatcgtggtctcctcccttcttcaccgatcatggcgggcacggtgcccggccggatctgttccgggcgatcctcgccgccacggaccgcccgctaccgggcagtcatatagggctacacagcgcctcgttcccgcccgacaacccgcccggagccgctcctgcgcccggcagccggcccgagtgaccgccgctggcaccggagtggcgccacgccaaagggggcaacaggatcctcatgggatgggcttcgcggaggccagcggccgctcactatggccggcatggaccggtaacaggctcacctcggtcgccacggacgcgcccgccgcgggcgcttccgcaccgacctggacctacacctacgacggcagcaagctgacccgggtctgcagcccgctgtcggccacctcatgcaccagctacacatacgtttcctcctcgcactaccgctcagtggtgctcgacgacaacccggcagcgtactggccgctcggcagcaccgcagccagcctcgagaacgtcgtagcgcgcagccccgacgagaacaaggccaccgcccgcaacgttgtagccaaccggcccggcgcattggccggctcgccggacggggcactcggcttcaccggcgccgctgacagctatgtgacgctgccggaggcactgctggctccgtccgtggcgttcagcatcgagctgtggttcaaggccgccgccggcaagtccggggttctcttcgggtcccaggcgatgcagattcccgccgtctcagccggtgggtgggcgcccaacttgacagtcggtatcgacggcaagctgcacggctaccagtggactgccggcggttcagcctccagcccgatggtttcgcccggtgtggttaccgacgggcagtggcaccacgcggtgctcaccatggccgttgacaagcagagcctctatctcgacagcgcgaaaatcggtgagatctccggcaaggtcgtcgaccacatcgggatgacccggcactacttgggcaacggatacaccaaggactggccgtcgatgggggccggatacttcccgttcaccggtgagatcgatgaggtcgccgtctaccggcatccactttcagccgcccaggtcagcgcgcattacagcgcgcaggcggccacctcacggttggccacggtggtcgaaccggggcagttcaccgccacgtccgcgacctacgaccacgcgtccggccggatcaccactatgaccgaccgcaacggcgcccagtggaccctggcgccgccaacagtcggcaaccgggttcgcgtcgtcaccttgtcatcgacggcccacgacgccatcacttatacctacgacgccgaccacaacggccgactggtcctgcgtaccgacagtgccggcagcggcgactgggaatacgatgccgccgggttcgtcaacaactacaccaaccccaacaaccgcacccgctacttctattacgaccagcggggtaaccggaccattgacgtcgacaggtacaacggcacctggcgataccgctactacggctacgacctctacaacgatccgctcgacccccgcaacgaccagctgcaatggtcgaccgacggccgcagcgacggaatgtcctacgagcaccgcacctggtactaccgcgacgagaaaggccggccaaccgcggtcgtcaaacctagactgcccgggcaatccagcccgaccgcacgcaaagacttcacctacaccaccggcaccgaggacgcgatcggcggcggcaccacaccccctggcctgatgtccaccgagtcgaacttcgccggcggcatcacccactactactacaaccgcgcaggcgaccgagtacgcaccgtcgacccggtcgggctgaccaccgaggtgagctacgacgcgatcggccgcccgaccacctccaaaatcagcgccgtcgtgaacgacgccacggtcgactacggcaccaccacgaccacctacaacacggcatcgctgccagacaccgtaacgtcgccggcaatcgtcaacccgatcaccggcatcacccacaccgcacgcacgaaatacacctacgacgccgccggccacaccacgcaggtcgacaacagcgacaccacaggcggcgacgccacccgcacctggaaaaccgggtacgacccggccggccgggtcacctcctccaccaccccggacggcgccgttgtcaccaccgagtgggatcaggccggcaaccaagtccgcgaaaagcggcccggcgggcagatcctggaatacaagtacgacgacctcggccacctgaccgagacggccaccaccggcgacggcgttgaccccatggacccagccacgacccggatggtcgtggagtcgcgcgcatacgaccctgccggccagctcgcctcggtggtcgacgcgatgggacgcgaaacggcgtacacctactgggaaaacggcttcctggaaagcatcaggcagatcaaacgcgacgccgacggcacgatcgcgtccacggttttgcagcaatataacaactacgacggcgccggcaacgtggtgcgccgcaccgaggccggcggcgtcgtgcacgactacctgtacgacaacgccaacaacctcatccaggacgtcctcgacccggccgggctgatgcgctccatctcctaccggatgcgcggcgacggccagccggaatcagtggtctccggcaacggtttggcactgggcgtcaacacccccggtgaatccgccgtactgtccaacagcgggtccctggtcgacgggtcgcaggcccgctacgccgacggcaccacgtccttcacctacaagttcaccctgcccgccgacaccaccggcgccagcgtgaacatcgatatcgacaaccaattcctcgtcgagaccagctcggacaacagcacgtggaccaagatcttggaggagacgcgcgacattcgcgacggctccaaccgcgcggtccgcaccctcgacctaactccggctctcggggccggcaagacggtctacctgcgggtgcgtgacagccagccagccaacggctggggcggccgtgtcgtgcgctcggacctgcgttttcagcgtgccggcgcgcccccggaggcggcaagtttcggctacgacgcgatgggccgtgccaccagcaccacgatgaccgatcctacggacagcccacaggcgctgatcacggcgaccaagcgtgacccgcgcggcctgccggtctcggtcaccgacccggccggcgcggtcaccagctacacctacgacaacgccggtcggcaggaaaggatcgtcgagcccgccaggtcggtatggcgcaacggcgtcgccaccgacaacgtcaccccgacctcggtggccggccgcaacacgttcggcgaactgaccgagtcacgcgacgccaacggcgcagtcgcacgaatcgtgcgggacggagcgggccgccaagtcgagcaaatcctgcccgcctacaccccgcccggcagcaccgcgatcacgccgagcaccaagaccgcatacgacgatcgcgggctcgcggtgaccgagaccgacggcctgggccgggttaccagctacgagcacgacaaaacggctggctga

SEQ ID NO: 4975 - DNA, 1941 bp, Actinoplanes utahensis
atggcgcaacggcgtcgccaccgacaacgtcaccccgacctcggtggccggccgcaacacgttcggcgaactgaccgagtcacgcgacgccaacggcgcagtcgcacgaatcgtgcgggacggagcgggccgccaagtcgagcaaatcctgcccgcctacaccccgcccggcagcaccgcgatcacgccgagcaccaagaccgcatacgacgatcgcgggctcgcggtgaccgagaccgacggcctgggccgggttaccagctacgagcacgacaaaacggctggctgaccagcgtcaccggacccgaccccgacggcgacgggcccaagaccaaacccgtaacccgttacacccacgaccgggtcggcgagatcctcgagacgaccgacccgctcggcgcccggcgcctggccacctacgacgagcgtggcaaccaggtcaccgacaccgtgaccgaacgggccggcggcaccacctactactacacgaccaccatgaccccggacgaccgcggccggaccaccgcgatcaccacaccgctcaaccacacgaccaagaccagttacaacaccgccgacgagcggacaacaaccaccgacgccgacggtgtactcaccgagttccgctacgacgcgtccggccgcaccatcgcgcagatcgtcggcacgatggcaaccggctggacctacgacgcgctaggccgcaccatcgcggtcaccggacacaccgtcaccaatggcgtgctgtccgcgccgctgcgtaccagccgaaccagctacgaccgagacagccgggtaacgcgcaagacctccgccgagggccggatcaccgactacggctacgacggcggcggcaacgtacgcaccatcacccagctgcgcacacccaccgaccctgcctccgcagtcacggtcgggctcgactacgacgcactcggcaaccgcacccgtaccagcgacggcaaccagcatgtcaccgaataccgctacaacgactggggcgcgcccgtcgaagcggtggaaccagccaccgccgcgcacccggcagccatggaccgcacctggaccttcatctacgaccagggtgcccaagcgatccgtgccaacctgcccggcggcgtgtccgtcgaacgcgactatgacgggctcggccagatcaccacggaacgcggcagcggcgccgagggcgccagcaccacccgatccttcgactacgacgcgctgggacaactccgcaaggccagcaccaccggcggcgacaacacctacagctggaacgaccgcggcctgcttaccgacgtcgccgggcccggtggcaccgctacctacacctacgacgccgaaggccggctttccaaccgcagcgacggggccggcccagccgcgttcacctacaccagcgccgggcggctcaaaacggtcaccgacccgctgatcgcaaaaacgctcacctacacctatcgccccaccggtgaggtgcaaacagtcagccaaggcaccggatcgctgtcacgcacctacggctacgacaacctgggccggctggccagcgacaccctcaccaaagccaacggcacccagtccgccaagctcgcctacacctacgacagagacgacctgctgaccggtaaagcgtcaccggaatcgccggcgacggcgccaacgcttacggctacgacggcctcagccggcaaacctcatggacacgacccgacaattcgaccgtcgcgtacggctacgacaacgcttcaaaccgcaccacggtcagcgccggcaccgacacccgcacctacgcattcgacgagcgcaaccggctgctcaccgcgaccggcggcacacaacccagcttggctaacacctggtcaccgcgcggcaccatccgcagcaccaccgaaaacagcgccaccaccacctacacgttcgacgccttcgaacagatga

SEQ ID NO: 4976 - DNA, 1725 bp, Actinoplanes utahensis
ttggctaacacctggtcaccgcgcggcaccatccgcagcaccaccgaaaacagcgccaccaccacctacacgttcgacgccttcgaacagatgaccacggccgccgaccccggatacacagtcacctacgcctacgacgcacaaggacgggtggccacccgcaacggcatcgcctttggatacggcggaatcgacaactcgccagtactcgtacccggagccgggcacaccccccgagggcagatcttccgcgatcccgactcgcgaccgctgtcagcgaccctggacggcagccccggccgcgggctattcgccgatgcccgccacggcgacatacgcggctcgtacgacccggccgacggcagcctgaaccgatccgccgtctacgacccgtccggtgaagtagttgcctcgaccgcagacaaactgcccttgggcttccagggcggctggtctgaccaggacaccacactgctcaacaccgacagccgctggtacaaccccgaatcggccggattcaactcccgcgacacctacacccttaagcccgatccggcggcacaagccaaccagtacggctacggcaacgccagcccgctaaacaacatcgacgccgacgggcacaacccgctcgtggcgctcggcggcgtattcctgggctccaacccggtcggctgggccatcctcgggatagtcgcggttgccggcaccggatacctggcttaccagggctaccaatcgtacgagtacagccacaacgtcgccaacagcgccagcagctggggcggcatggccacgcagaccagttcgtacgcgtaccagcaaaacgcgtacgcagctcacctcagcgcggcagcggcgcagggtcaggcccaggccacctaccagctcgcgatcgcgcaggcggccgccaacgcgcacgtggctgcaatgaccgccgcgtacaacgcctacgtcgcgcagcggatcgccgcagcgcaagccgcagccgccagactgaaagccgagaccgacgccgctgtgaaactcggccaacagcgtctcgccgcggacgcagcccagcacgcggcggccgtcaaggcagcccaaccgggaccagtcggtaccacggtggtcaagccaccagcggcgatcgctctagtcggtggcgccggcctggtcaccaacattgacgcgacgaagcagctgcccgggacggtgtttgctggcgcgggtggcaacgacgcaccgaacatcgcggccgcagcgggcgcagtggccgccaccgaagggctgcagattgccggcggtgataacggggacgacgacggctgtggccagaaggcagccgaggatctcgcggaggggttggccgactgggttgatcccaacgacatcaacttttcgcagcggacagtctcgccaaacgactacgtgcaatcgatgaaggacggcacctgggactggaacagggagggcaccgcgctgcgtgtgcttgagcgtgacggccagttggtcagctatgacaaccgccgcttggacgccgctcgcgaggtgcgtgccgaagacccgacgtaccgagtaaagatcgaagttcttgaccccgaggcggctaacccagccaaaagcaccggcatgaattgggataaaagcttcgagaagcgtatgacgagcaagcggaacaaggacgagaatggctgccgggtaccgtggcagggcttgcatgagcggccgaaatgggagtga

SEQ ID NO: 4977 - DNA, 231 bp, Actinoplanes utahensis
ttggcccgcggcatccagccgggcgaagaatccttccgatccgtgagcaccttcaccactgattatgtagccgtccgggactgcggtacgcgccgactcgtctacctcagccaccgcgtctgggtcaacggcgagtcgctcggccgggttgaacggctcgccaacctcgaaccggctcaaagccgcaccgtcaacctcgatggcgcgggcagtgccatccgcccggtatag

SEQ ID NO: 4978 - DNA, 774 bp, Actinoplanes utahensis
gtgggagttgatcgagccggtactgccgccgtggccggcgaaggctccggggccgcggccggtcccggaccggctgtgtctgcagggcattctgtttgtgctgcataccggcatcggctgggaggatctgccgcaggagctcggcttcggctccgggatgacctgctggcgccggctgcagtgctggaccgaagccggcgtgttcgaccaagtgcatcagatactgctggccaggttgaacgcggcgaatcggatcgactggtcgagagcggcgatggacggcagtcacatcgacgcgaaaaagggggtgccgggacaggcccgtcgccggtcaaccgcggcaaacccggctcgaagcaccacctgatctgcgacggcaacggcactccgatctacgtgctgaccagcggtgcgaacgtgcctgacatcaaacgggccctcgatctgctcgactgctacccgccgatcgccggtcggcccggccggccgcggcgacgcttcggcgccttgctggccgacaaggcctacagcagtgcagcgttccgtcaggcctgccgcgagcgcggcaccgaaccgatcatcccgaagcccaagaccaccgggatcaagggcctgggaaagctgcgttacgtcgtcgaacagaccttcgccctgctgcaccagttccgccggctcgcggtgcggtgggaacgccgactcgacatccacgacggcctggtcagcctcgcctgtgtcctgatctgctggcgccgagtgattaactggacccgctaa

SEQ ID NO: 4979 - DNA, 678 bp, Actinoplanes utahensis
atgcggcaacgacgccctccgctccagcgccgaacccggacgctcaccccgaagaaagagagacacagaaccatgtcccgaatgacccgcagcgcggtccgaggaatcctcgcgaccctgatggtgcttctcggcgccgtcgcgacgctcatgacgtcgccgaccgcagccagcgcctcaccaatcggcgccaccgagctaggcgccgtggacctgggcggctactgccgctcacaaggcaacgtggacgccgtgctgtccggcggcaccgcttacgactggcactgccgcacccgggatggccagaacacggacctgtcgttcacgaaggcatgccagtggacctaccccggtgaattgcccggttccgcggccttcgtcttcgaccggatcgacaacttctacgccccggcgtcggtgcagtgctggaaggccagcacggatgaggtcaccgcgccggctctcgacggctactgctcgcatcacccgacgggcgaccgtgcggtgctgaccggcaataccgtctacgactggaagtgcgagtcgcaaagccccaacgggccggtctactcccccgtgaacgtgctccaggcctgccagcagaccaagatgcgcaacagcgccgtcgaccgcttcaccaacttctacgacccgtactcctggcagtgccgggtgtaa

SEQ ID NO: 4980 - DNA, 474 bp, Actinoplanes utahensis
ttggagcgggtcagcgatgaggtcagcttgccgctgccacctgctccgccttactactcaccggccagttgcggaccagagcacggaaggttcgactcggacgagatggtcgacgtcgaagaccccgagatgccggcgaaggtcaacgctggctggctgcacatggctaccgaatacggcgtcctcgacagccgtcgtgagttccttctcaacgtcaactacagcgaccctgaagaggtcgaacccgagtacgcctgggtcagggtccggctgtcggaccattgggatctggccggaggccactcgaccgccctgcgaagcggcttcggagggctgttcaccgatcggttcgtgccggagttctccatgctctccaccgaccacaaggcgatgctcaacacgaccgtctggggcaacggcaccgtcagcaccatcgtcatccgccccgaccgccgcgagcacacggtcgattga

SEQ ID NO: 4981 - DNA, 147 bp, Actinoplanes utahensis
gtgcagctgaccgaagtactcgacgtgcttaagcgcctcatcgaagcagccgaacaccccgatatcaccgaggtcagcgtgttctcccgcggccccgaactcccgcgcaacggcatcgccgtgaaagaccgctggtccggcgcgtaa

SEQ ID NO: 4982 - DNA, 339 bp, Actinoplanes utahensis
gtggctggtcaagctggcactccggtcgaatgggacctcgaacagttcaaggttgaagccccacgctggcgtgacgccgtgcatccccctgcagagatttacatcaaggtcgaaagatggtggcggctgctgaaacgcgtcgacgcccgtatcgaggctgtcccggtccgcccggagaacaatcccgagggcaacctgtggtggatgtgggtacccgacgtcgaatgggaggacgagcacggacgagggttccggctttcgtgctacttccgcgtgtacgagaaagacgatcctccacgcctggtctgtgacgagttccgcagcgagcggacgaggtaa

SEQ ID NO: 4983 - DNA, 660 bp, Actinoplanes utahensis
atgacctttcgtgacaagtccgtgatccgacaacagtcgagtgacgacatcgatacgtttcgtggtgtgaagagttcagcgccgaccaccggcgaagccaccaacgcggactcttccacgtccgtggatgtgccaactacctcaccctcggacggcttgagccgcgacctcgcgccgccgtacgttgcgccgatgaccaccagcgccagctctgtcatcaccgccatcaacacccgacggccgggcctgaagcccgcaaaacagcacatgctgatgttttttatgcagggccaccaccttgcctggcgcgaccgggccctgttcgacgagcccatgcacgccaccgaacgagccgttgagatcgacgccagcgcggacagcgctgagcctcagatcacggacgaagcagccctgaacaccatcgggtacgtcatcgcccggtacagcgcactgtcaccagccgacctacgcaccctcatccaggcatcgcagccgtggcagacagccaccaaaccgggctccgaatcccgcatcgagtgggcgctcctgcgcgactggttccagcgcccggacgagaccgacgacccggacgatgagcgacccaaccgtgccgaggtggccgcagccgaggcctacctggcgtctcgcgcccggaagtaa

SEQ ID NO: 4984 - DNA, 246 bp, Actinoplanes utahensis
ttgaccgcccgagacgggcagaggctcaacgactggatcgccgcggtcgtagccgacgaccagcctgacctgcgatccttcaccgccggcctgcgccgtgaccacgacgccgtcgtgaacgggctgaccatgacctacagctccggagtagtcgaagggcacgtcaaccgcatcaagatgatcaagcgccagatgtacggtcgcgccaacctcgatctgctacgcaaacgaatccttctcgcctaa

SEQ ID NO: 4985 - DNA, 342 bp, Actinoplanes utahensis
gtggccgacctgggcgcgctgcccaaaggccgcgccgtggtgctggcctccggatccgtgccgaccctggtgcgcaccctgccgtggatgagcggcccgcacgccgcggcggtcaccgcgtcgatccgggcccacgacccggccgccgaggacacgatcgccgaggccctggagtcgctgcgcgaggtcgagcaacaggaggcgaccgccggcaccccatggacctgcgcacctacctacggccgctgcgggccgccgtcggccgaccaccggcgccacgtcggccgccgaaacccgtcagctgaccagctggctgctcacccaccccgaccgactcgctga

SEQ ID NO: 4986 - DNA, 1281 bp, Actinoplanes utahensis
atgaccccgccgagcggcctgagcattcaggacgaccttctggacgtgatccagaaggtgctgcagggagccgccgccaacctacgccccgatctggaacgccggatgcgcctggccgccgcggagctggccggcgggggctccacgatgatcgtcgcggaagcggtgatggacgccctgcagttgctggaagtcgatcttcggagccggcgtgcggcgatggccgacccccgccgccgggcgtgcctcgccttcgaggcgcgtgacgacgagggccgccttcgcgcgtttcaggcacaagccggcaaatggccacgggcactcagcgacgcgttgtcggcgaccatgtcggacatcgagttcgccgtgcacaactggttgcgagccctgctcgatgagggcatcgcggtgatcgagtcacaagggctggccggcgccgacctcgacggctggctgcgacagcgcctcgtggtcgagaccgaagcggtacatcgggcgttgcacgtggccgcgcgcgagatcggcgagcgggtcgccgcctcgatcggggtgagcgaggccgtgccgccggtgcatctcgacctcgaaccgccggcggagctggtcgcccacatccgccgcggcccacgggtgctgtctgagcggcagacgatggccacccgtctggtcggcgtactcatgccagcctacagcggcatcatgatcgccctcatcgttccccggttcctcggcctcgcgatgccgtactggctgtccacggccgttgcggcgtccggtgcgatcgccttgggcgggaccgccctagccggggagaagcagcggcagcgcagccggcgcaacagcgagagcgccgccgagctgaggtcgctcatcgacaccttccggatggccgtcggcaagcgggcacgcgacgggatccgcgccatcgagcggcagatgcaggccgggttgagcgaggcggtgaccgaccagtcccagcggctgctcgcagtcgccgaggcgtcgcgacgttcggctcaggcgggcgagcagccggagcaggccctggccgccatcgatatcgacctcgctttcatcggcgagctgcgagaacgtacccgacaactcagccctccccgccaagcgctgcccgcgcccggtgagcagacgatggccctcgacgccgtagcactccccagcgcctcgggatcgcccagccacccctgtcccgcgcgaccagccggctcgaacggcggctcggcgtcaccctgctcgaccgcgaccaccacggcgcccggctga

SEQ ID NO: 4987 - DNA, 306 bp, Actinoplanes utahensis
atgagcatttggcagagttccctcgaaggcggcagcggatgtctcgacctcggtcgcggtttgttcggcggcggggacacgagcatcggccccgggcagcagcacaacggaggatggggtggcgccgatgactgcggcgacgacgccgacggcgaccacggctgggtcggtcacggcggccacccgggccagggcagcttcgacgactgcgacccgggccggggcagctccgacgactgcgacccgggccggggcggcaacggttcgatgggccacgaccaccacatgatcccgttctgccactga

SEQ ID NO: 4988 - DNA, 240 bp, Actinoplanes utahensis
atgctcatttcacgtccttgctatcgggggggtctgacgtctacgccaacgacggaaccggccccaggacaccgagtccatgcgggcgacaaacctcaccaccggggatctcgcccaccggacatcaagggccacctgcccaaagccgacctcgtcgtcgacgcgctgccctggaagctctgcgacaccgaagcgcagcgcaagcgcgcccgcggccgcgtcgcgtccctcgctcactag

SEQ ID NO: 4989 - DNA, 525 bp, Actinoplanes utahensis
gtgcctcaaccgtggcggcccgcgaagacgccgtgcacctcggtcgggggcctgcagggcgtcggcttcgccgcggacccggccagccgcagggatctattgctggtgacctcctccgacgggcacggcttgttcgatgccgtcagcgggcagaagctggctcgagaccgggacctcgaccccggcgtgccctgcccggacggagacctgtgctgtcctgggctgggtccgatcgcggcgacgtctgtgcggatcgccggattgcacggcggcgggttgcacaccggcacccgtgacggctggctgatcgacgtcgtcagtcccgactggccgaaccagcgtgttctgctctcctacaggagtgaccccttcagcggcgaggagggcgccacgtggtggcacattttccactcgagattttcggagcttcgagcggccggcttctcgccctccggtagcaccttggtggtcgccaccagcagcgacatcaccgtctggacgagggagcggccgccagtcgcctga

SEQ ID NO: 4990 - DNA, 543 bp, Actinoplanes utahensis
atgccgatgagacgtcgccctaagtcttacgtccggaccatgctcacggttggctctgcggccgcgttgtccgccgcctgcgggcaggccggtggcccggtagcaaccttggccggcgcacctcacggcatcgtggtgaaccgtggtggtgtcgtcgaggtgctcgatgacaccaccaccggcaccgtccgacaggtcaccgagcaagacacgggcggtaccagcgcggacccgctcgccatgaccaaggtgcggcagctcgccgcacacaccatcgccggtctgcgcgcaggacggttggttgccttggaccccgcgcatgccgaccgaccgcggaccgtcgcgccggccagcgattggttccccgacactgcgctgaccggcggctgggccgtcaccgaatcgctgaaccagccgccgtgtcccgcgatcgacggcaccgccgcaggcacaacccgctaccggctggaacgccacgacctgtccaccggcaagacactcaggacgacatgccggccgtgtggtccggatcccggcttctga

SEQ ID NO: 4991 - DNA, 525 bp, Actinoplanes utahensis
gtgacggcacgaccattgaccggcgaaccgctggccctggacctggtgaacactgagtgggtcgaccatggccgcacggtggacctcttcgacgagcccggcggactgctggcatggctccacgagcagcacctgaccggcaaccacaccaccgtcgcggcacccctgcgacaggcccgatcggcgctgcggcaagctcttgaacaacccgacgagcacgccgaacagcagctcaacgcgatcctggcgcgcggcgtcgtgcggtacacgctgcaccagggcgccgtgcgtgagggctcggacgtcgacgccgactggtctgccgcctggcacgccgtccgtaattacctagacctgatacgccaggatcccacccggatccggcgctgcgcccaccccgcctgtgtcctctacttctttgacatctcccgcaacggcacccgccgctggtgctccatggacggctgcggcagccgcgccaaagccgcccgtcactaccaacgccaccggacaacacccggctga

SEQ ID NO: 4992 - DNA, 675 bp, Actinoplanes utahensis
atgccgcaccactaccttcagcacctgacgaccgcgccggttgccgccgcccaacagcgctacggcagccgtgccgccatcgagcgcatgatcgccggctgggacaccgacgccctgctcggcgccgacgagatcacgttcatcaccgcccgcgacggcttctacctcgccaccgtcaacaccgacggctggccctacctgcagtaccgcggcggcccaccgggcttcctgcacccgcttgacccggtcgccgggcacagcgtcctggcctgggccgacgttcgcggtaaccggcagtacctgtccgtcggcaacctgggctgctcaccgcgggtgtccctgttcctgatggactacgcccaccgtcgacgactcaagatcctgggaacggcaaccgtccacgacatccgcgacggcatgccggcccacctcgccggcaggttcggcaccctccgcacgcccggcgtggtggaacggctcatcaccgtcgaggtccacagctacgactggaactgcccgcaacacatcacgccacgctggaacgaagccgaactgcacgacgctctcgcgccgatccgtgaccagctcacccagctccaggcggagaatgacgccctgcgcgacatggttcgccgaaaccgcttccagcagcacccgtcccaggagacctcatga

SEQ ID NO: 4993 - DNA, 483 bp, Actinoplanes utahensis
atgaccagagacccatccagcacgccgcaacccccacggcatccgctgccacccttcactgtcgacaccgcccgcgccaaagtccaggccgccgaggacgcctggaacacccgtgacccccgacgcgtcgccgccgcgtacacccccgacagcatgtggcgcaaccgcgacacctttctgaccggccgcgccgagattgaagcgttcctgacccataagtggagacgcgaactggactacgccctgcgcaagcaactttgggccttccacgacaaccgcatcgccgtgcggttccagtacgaatggcacgaccccagcggccaatggtggcgcagctacggcaacgaacagtgggaattcgacgagcatggatacatgagtcgtcgcgaagccagcatcaacgacgtggcgatcaaccccgaccagcgacgcatccacggccccaggccggcccacgacaccaccgacatccccttgcgctga

SEQ ID NO: 4994 - DNA, 663 bp, Actinoplanes utahensis
gtgcggccgggcaaccttcgcgcccgaatccgacagctaacctcgcaggcgtgccggagggattccttcaccgtgcgcgtaagcacttcgagccgacccgcccgtaccctgggagccggcactatcgccctgtccgtgggtctcggtcttctcaccggtctcctcgacacaccgcagtcggcctccgccgcgaccaggtcgccggccgtcaccaccacgcaggtgttctcacagacaagcgtgccattcagccagagcggcctcaccctcaaggcggtggcgtcccagtccaaggcggcagtgtcccgggcggccgcgaaccggatcatgatcgaagcggccaagcacaagggcaagctgtacaagttcggcgccgccgggcccaagcggttcgactgctcgggctacaccatgtacgtctacaagaaggcggcgggcaagaagctgccgcacaaggcgaacctgcagcagcggtacggcaaggccatcgccaagtcccgggcccgccccggtgacctgatcatcatccgtgacggctcgtacggcacgcacgccggcatctacgccggtggcggcatgatgtgggccgccccgcgggccggcaagacggtcaccaagcagaagatctggagtaggaactacgtggtccggcgcctggtctga

SEQ ID NO: 4995 - DNA, 1095 bp, Actinoplanes utahensis
atgaccggcgacggacggcatgagaacgcagcgcttgtccgcgaaaacggaggcttaaccctgcgattcgctggctcgtgcaatcctgaagcgattcagatcctccgagccggcgtatgcggaacagacctgcagatactacggaatgcgcggcccgacgctgcccggatccttggtcatgaagggctcggaatactcccggacgagcgacgctacgtcttgttcaatccggttgaccccgatgaccaggatcgcatcctcgggcacagctacgatggtatccaccagcgttatctcgatgccccggggaggccgcctctggtgtcggctgcgccgaacctgcctgccgatctagccgtcctcgtggaaccgctggcggcagtgctttatgggtgggaactcgcggcaccccgctcctcggtagggatctggggcgctggcacgaccggagtgcttgtcgccctggtcgcagagattcgtggcgtccgtgctcacctaattcatcgccgtaccgaccggctggcctttctgcgctccactgtgcagctgctgtccacacagacgtcgacgaagttggatcaacgtcgtgcggcccgccttgacggtgcgttcatctgcctaccgagagaaggtgctcacggcgcgctggccgacgcattggacgctgtcggggacaacgccacgattgacctactgggcgggttcggcaccaacgaccggcaccccgacctgcccggtgtggatctgggtcagatccgccgatccaacgtgtgtggctcgccggtactcggcgctgtgacccctgcacggactcgtggtggtaagcaggtgtcgcttaccggccatcgaggaacgtcagcggcacacatggctgaggctcaggacctgctcatcgaacacgccgaacggttcggcgcattgattacacacgtgctcgcactggacgtcgcaggcctcgaagtcgagcgcatggctcgtggcgggacgcgcccaagcggccgcgccgagtacatcaaggtggcaattgatccgacgatgcccgacggctctcgtcggaggccagactggacaacgaccatcgaggatttgaagtag

SEQ ID NO: 4996 - DNA, 147 bp, Actinoplanes utahensis
gtggataccatcgtagctgtgcccgaggatgcgatcctggtcatcggggtcaaccggattgaacaagacgtagcgtcgctcgtccgggagtattccgagcccttcatgaccaaggatccgggcagcgtcgggccgcgcattccgtag

SEQ ID NO: 4997 - DNA, 984 bp, Actinoplanes utahensis
atgtgcaagacctttggggagagcagatccgggcatatttctccgcgcgaggagttgctgccacggtcttccgcatgcaggcgggagaggatgcgaagaccagcgcgacggcacttgccgtcgcagcggccgcggacgaggtcggcatcaggcgtcgggatcccatcatcgcggtcggtggggggggtcgtgaccgacaccgtgggtctggcggcgagcctctaccgccgaggaaccccatatgtccggattccgaccacgctggtcgggatgatcgacgctgccatcggagcgaagaccggcatcaacgtgggtgagcacaagaatcgcctcggaacgtactacccggctacgaacacgttggtagacccccagttcctccgaacgttgccggctcggcatgtgcgcaatggcatggccgagatcatcaagatggcgatcgtgaaggagcccgtcctgttcaagcttctcgaaagcgatccagagggtttgatcgccgcgcagttggtcagcgatgacggccaagagatcatgaaccgagccatcaccagtatgctggaggagctcgagccgaatctctgggagaacgagctgcgacgactcgtcgatttcggtcataccttcagcccgcggctggagatgtgcgccaaacctccactgctgcacggcgaagctgttgccatcgacatggcactttgctgcgcactggcatacggacgcggtctgatctcggccaccgacgtgaagcgcatactgaacctgctgcaccggtactcccttccgatcacgcacccgacatgcgatgtcgacctacttcaggaaggtcttgaagagtcgacccggcaccgaaacggtaatcagtactgcccgcttcccgtcggcatcggcgccgccgaattcgttgagggtgtgaccaatgccgagctcgcgcgcgcgggcgagttgctcgccatgttcgcccaggcggaagaggcccaggtatga

SEQ ID NO: 4998 - DNA, 987 bp, Actinoplanes utahensis
ttgacaacaccggtgcttgtcttcgatctaggcggaacgtggtttcgagtcggcctttcgcacatcgacggaagcgtcactctgctgggcaggtatcctgccatcagtcgtgcgacacatccggaactgccggtggccgaactgcagcaacgaatggtctcgttcatcgtcgacgaatgtgtccgacatgcgtcgactgacgtgggaatctccatcggcgccgcagtcaacggtcacaccggcctggtcctgagcagcgcgcccctgtgggggcccggtacctgggagctgccgctgacgcagaagctgtgtgaagcgcttcccgcggttcggtactcggtggtcaacgacgtttcggcacaggcactgtcgctgctggacgaaacggcctcaagtgactccatggcggcagcgctcaccgtcagctccggcatcgcataccgcacgatagatctcgcctccggccatatccctctcgatcccgaccacggggttcaaggcgagatcgggcacctgccgagcgctttcccttggcgtgggacctatctcagcgccgtgtgcgaatgcggcgttcaggaccatgtgagcgcgttttcctccggccgggcgatcgagcagttgttgcctcgactggctggacccgactggaacatcgccgccttcggggaagcgtgtcgaagcggtgacgcactggccctggagctgcttgacgccttcactctcccgctcagcacggtcctgctgtatcaggccacgctgaatccacaggttcggcacacggtactgctcggcggcgtagtcgacgaactcggcgaaatctaccgggacagcgttctgaagaaccttgcacggctggggttgtacgaggtcacgtcccgtgactctggatattttgatcgacgtatcaaaatcggaaatggcgacggactcgaggcattgaaaggggcggggttatacgcccgaaggaacgggagggcgattcaatga

SEQ ID NO: 4999 - DNA, 987 bp, Actinoplanes utahensis
atgtcgcccggcagactggacagccgtaggttctttgatgcggcctatacacgccggttccttcgtgaagagctgaccaccgttgatggtaaggctgacgcttatgccgtagaggctcgcttccgtcagacgctttacgcctgcgcccaagccacccatgccgacgacagcgggctgggtatgcagatccgtcaagtcggcctcggcatgttccggccagacgcgatcgccgccgggaaggccgtacccactctcgagtatctgcgtcggttcgactgccacccgtacgcatacttcccggttcagatcaccgcgaaggagtacgaggagatctggagataccagctcaacgtggcatccggtgagcgactggcgctactcgatctgatgttctcgtggtcgcagtccatcctggtccagttccgccgcaccgcggcggtgatagacgtaccggtcaccgtgctgatggcagacgtcaaggggcctgcggatccggtgaaccgcgaaggctgggaactccgcgcacaccttgccagccccagtcgggtggagacctacttccacaccgccgacgaaccggcggacgtggtgcgcgacggcggacttctcctcggcgcgcgaaggttcgcagaaatgctggccgaaccctgcgatgaagcgcgcgacgtcgcaggcgccatcgcccgcctcgcctcgacgatcgccaccgatgctcgtgcggcggaggccacatccgacgcgaccgtctcgcccggcatcgtagatccagatcccctcgtggagatcgaccttgccaaaagccggcgagtcgacacctggcagatcatcaggcatttcggcgccgcgtgcgagatgtacagcggaccaggtcggcccaccatctggcaggcaggctctgacggatggtggaaccgtgtcgggctgctcgcagatcgggacaagtggctgacagcaactgccctgggggatgggacggatcagcgttga

SEQ ID NO: 5000 - DNA, 1635 bp, Actinoplanes utahensis
gtgctactcgatgccacggtgcgtccggccggcggcgccgcgccgttgtggacgccggacaggctctggtcccaaggccccagtgtctttcttcatgaccaggctacggacggcgtccacgaggcacacctcgcgcacggcgacgagcctgtgctccggttcggtcactggcactcgcaggaagcttggtgggcgctgcagctgggacggacgcgcgccgcgcaccttcaacgtcacctggccggcctgccgaacggggctcggacgcgggtgagtgcggtcgccgcgtggacggagaacctcagccttgtcgcgctgaacgactatgacgaggtcgacccaccgagcctggtccttttcatcggcgaccggatcagccacgtggtgaccctcgaccgagagtacgcggcacacgtgggcgacgcctgtttcgcctcaccagagcgcatagtcgtcaccgacgactatcttcatctggttcagtgtctcgacctctccggcaggatcctctggcgccgaggcgaacgcggcaagccgggtgccgacatagcagcgctgttcacgccgatcgcctgctgtgctctcgacggcacgatcgtgatcgccaatcggcggtcctcagacctgatcacgctcgatctcgatggaaacgtcattcaggcgagcattcccggcgcgcacgtgcgttcggcgagtgcgatgacagccttggatgacaaacatgccctgatctccgatgcgtatgcgggcagcctccacctgctgaccgcgaacagggacaggtggacgctcgagaacgtcgcccacccggagccgacgcctgccaccggcgaattctcgttccctcgtgcaatcctgtccgtcgacgagcggctgctgatcgcggacacgaacaacagccgccttctgtgctttcccggtgatccgccgctggcgctgcccgtgcccggctggccccgttccgccatcgtggtggacgacgccgtgctggttgccgacggcctcggcagcgtccttcgtaaacatccgcgacacctgtcagcggacacgccggggatccctctggaggtgcgcgatcggcagggtcgtcccgtcgctctggctgatccacaccatcttgctcaccacgacgcgaacagcttctggttgacggacagctccctcaatgacgtgttgttgatcacgcttgacggcaccgtgtcatggcgctggaccgaaagcccgttggcagacctggcgccactgtccgacccgcaccagaccctcccgctgacgggaacggacgaaatactcgtcgtcgactcgctgaaccatcgggtgctccaggctgcaccgagcacgggggcgttccgggcagtgctcggagacgacgcagaagaggcgatcgaataccctcgtttcctgctccccatccccgatggctggcttctttcctcagaaagtccgggttgcctttcgacctttgactcgaaatggcggcaccgtgcccagctcgcggtccaccccgcggactcgccccggccggtccacatggcagaaccgccacgggcgctgttcgccacggcggacttcctgtatgtcccggacttcatgagaggagtggtgtatgtcgcccggcagactggacagccgtag

SEQ ID NO: 5001 - DNA, 1290 bp, Actinoplanes utahensis
atgatgaacaggctcgccatcaggggcggagaggccgtccgaactgcgccctggccggtgtggccacgtcccgcagaaggcgcgagtcaggcgctggaaaccgtgctccactccggccgatgggccatcagcggcccgtaccgtggcacggagtcgtttgagcggcagttcgctcgcgcgtttgcggcctataacgactcagcgcactgcattccaacagccagcggcacggcgagcctgatgatcgcgctggaggcctgcggtgtcggcgccggcgatgaggtcattacgccaggcatctcgtgggtggcgtcgctgtccaccatcacggcggtcaacgcgatcccggtcatcgtcgacgtgaaccctgacacgctgtgtatcgacccggacgcggtcgaggccgcgataacaccccggacgaaggcgattatcgccgtacatctatatagcgcggttgccgacctggaccgcttgagcgcgatcgcggacaagtacgacatcaccctgatcgaggatgcggcgcaggctcacggcgctgcccatcgcgaccgcaaggtcggcacgatcggtgccgtcggggcgttcagcatgcagcacagcaaggtcctgaccagcggcgaaggcggagcgacgattacctccgacggaggactcgcccggcggatggagcaactgcgtgccgacggtcggtgcttggcaaaagtccctccgaggccgggatggatggagctggagcaggtcggcgagcagatgggcagcaatcgttgcctttcggaatttcaggctgccgttctggtcgcacagctcactgcgctggatgcacagaacgcgactcgagcacgcaacgcgatgctgctcgacaagcttctcgccgacgacggttgccgccctcagcagacttcttcaggtacgacggcgcgtacctattacgcgtacgctgtttcgcttccggagggtgcgctgccgggcgtgccgcgtgagctggtaggcgaggcgatcagtgctgagctgggtttcccggtgaagccgccttacctgacgctgtcgcgaagcaagctctaccgtccagagacgaggcgtcgtttcgcactaggcgcagaccacctccgcaggttggacacatcccggttcgagctgcccgaatgtgacgcggcgaacggccgtgtgcttaccttccaccacgccgcattgctcggcgacgaggcggatatgcacgacattgccgcggcgttcgccaaggtccttcgcaacggcgccgtgctctcttcggtggcgacggggtcctga

SEQ ID NO: 5002 - DNA, 420 bp, Actinoplanes utahensis
gtgagcgtagtcactgttgccgggcactcaccgcgtgccttcaccgcaacgtcgttcacttctgtggagatcgatccaccgctgatttccgtgtgtgtgagtcaagatggatcagcatggccgaccttacgggacgcctcgcacatcgccgtcaatgttctctctgaagatcaggaggatgtggctcgactcttcgccacacccggcatcgacaggcttgccatccatggcgactggcgaccgggtgaacagggatgcccgttgctggggtcagtcctggcgcacctggagtgcaaggtcgcccattatgtggaggccggccgacacgcgatcgtgctggccacgcccaccagtctcgcctggcgggaggggcgcccgctgatgcggcacggcggcacctacacggcacttgcctactag

SEQ ID NO: 5003 - DNA, 1563 bp, Actinoplanes utahensis
gtggggaacatacagatcgatgaacacgctgacctcggctgcccgccgggccgcagcggggacaatggcgaggacgccttattgcacagcgctctcgatgcggcggtcgccaataacgctgaagcttccgccatcaacaacggcacggagcgctggagctactcggagctgcagcggcagagctttcgcttcgcgaactggctgatccagctcggcgtgcagcgcggcgaccgcgtattggtacggttgacaaatacgcgcgagttcgcggcgatcctttttggttgctcccgcatcggggctgtcatggtgccgatcagcacagaaatgagacagttccatctgcgcgcggtgatcggggacgcggacccgcgactcgtggtcaccacggattccgatgtgccgctgatgagccaggtcaccgagcgaccggttcacgcgctcagcgcggtcgtcgagcagatgcggaagctcccgatgacggcgcccgcggtaccgacacccgcaccgaatgaccttgcgctgctcatctacacgtccggtagcaccgcgttgccgaaggcagtggtgtgcccgcacgcgcaggtcgccttcgccgcacatgccatcgcagcggagctgggctaccagacagacgatgtcgtcctgtgccgcctcccgttctccttcgattacggcctctaccaactcctcctggcttccatagccgggtgtgaggtgttcgtgccgccggcggacagcccggacctccagctcctgcagtggatccgccgacacggggtgacggtcgtccccatcgtcccgtcgctcggtcagatgctggtccggcttgccggacggacctcagaccagacgagccttcgcatgatcaccaacaccggcgccgccctgaacgaggacctcattcgacagcttcaaaaggcgttcccgaacgtcacgatcaggttgatgttcggtatcaccgagtgcaagcgcgtctcgatcctggagggcgacggagtgctgctccggccgacctccgtaggtcgcccgctcggcggtacgagcgtcacgatcgtcgacgacgacgaccagcccctgccgcctgggcggacggggcagatcgtcgtccgggggccccatgtcatggccggctactggaacgcgccggagctcaccatgcagcgcttccgtctcgaccgcgagaccggcacggtcgccctttacaccggggactacgggtacctggacgcggagggatatctctacttcgcgggtcggcgcgacgacctcttcaaacgtcggggtacccgagtcagcgttctcgagatcgaggccgctgcggtggacatcccgggcgtgcgcgcggcagcggtcctgccgcccaccgccgatggtgacctggtcatgttcgtggacgccgcactgacgggcccggaggtcctccgggagatgtcggtccggttggagcccgcgaaggtgccgtcgcactgccacgtcgtcgcctcgctgccgttgacccccaatggcaagaccgacaagaagtcgctggctgaccacctgctgaagggcgcgacatcgtga

SEQ ID NO: 5004 - DNA, 1242 bp, Actinoplanes utahensis
gtgaaccgtcgtgagtttgtcgagcggttcggcagtccgctctacgtctacgacctcgaccgggtcgacgctgcactcgtggatctgcgggcgagcgttcctgagcaggcgacgctgttcttctcgcagaaggcgaacccacatcccgctgtcgtcgaacggctcatcgccgccggctgccgggccgaggtgagctcctccggcgagctggccaccgcgctgggtgtgggcgccgatccgcgcgagtgtctttacaccggccccgggaagacggcgtcagagatcgccaacgctctgggaagcggggtgcgccgcttctccgtcgaatccgaggcggaccttgagcgcgtggcgtcagtcgcgctggcgcacggcgtgaccgcggagtgcatcgtacggatcaacggcctgagccccgccggagcaagcggcctgcggatgaccggcatgccgtcgcagttcggattcgatctggcgacgtcgccgccggactggaaccgcctgctcgccaccccgggcgcccgcatcgtcggactgcacttctttccgctgaccaacgccgtcgaccaggagagcctcttccgcgagttcgccgccagcatcgacatggcggcgcagctacgcgacgagcaccagttggcgctggagttcctcgacatcggtggaggcttcggttgcccgtatgcccagccgggtgaacgccctacgttcccggacctgcgagcccagctcatcgaagtcctggacgagcgcatgcgcggttggcgggacggtaggccggaggtcgcgttcgaatccggacggtacctcgtgggcgatgccggcactctcttgtgcacggtcacggacgtcaaggtgagtaagggaaagacgtatgcggtgctggacgccggcatcaaccatctgggtgggctgtccggtatcggtcgggtgctgcccatggcccgcccagaggtggtcgacggcagccagggcggtcgaccggagagagccgtcaacctggtcgggccgctgtgcacgtcggcggacctcatcggccgcgaagttcgaaccgcggtaccggagccgggcgacatcctggccatcccgaacgtcggcgcgtacggcctcaccgcgagcctcatgggattcctgagccggccggtcgccaccgaggtggtggtgcggcgcggccatgagccgactgcctcacgtctcgagctgcgccgcacatctatagaggaagagaacaatgacgcctga

SEQ ID NO: 5005 - DNA, 267 bp, Actinoplanes utahensis
atgacgcctgaccttgacccgtctttcgtgcggctcctacaacgcagtctcggcggtgccgccgaagcggagccgctccacccggacgccgacctccgtgcgctcggactggactcgatgggaatcatcggcctcctggtcgacctcgaggaggagttcggcgtcagcttcccggatcacgcactgacgttcgcgacgttcgcgacgccgcgcacgctgtggagtgccctcgccgaactccggtcacccgtcgacgggctggcgtag

SEQ ID NO: 5006 - DNA, 1203 bp, Actinoplanes utahensis
atggcgacgcctaccatggagcacaccctgcggtccgacgtacggcagcgagccgaagcggtcctgccgaccctcgccgcgcacgcgacccggatcgacgccgaggcgttgtttccggtggagagtctggactgcctccggtcgagcggtctcatgggtctcctcgtgcccgtggaacacggcggactgggcggtggcattcccgacctcatcgaggtggccggcctactcgcctcccggtgcctgtccacggccatgatctgggcgatgcactgccaacaggtggatgccgtcgtccagttcgcgggcccgcagctgcgcgccgagctgctgccgcggatcgcgggtggtgaggtctatctgggttccatcacttcagagcggaccaaaggcggccatctgttcaccagcgcgtccccgctggagccggcaggtgatgacttcctgctggacagggacgcgcccattgtcaccggcggcgcgtacgcggacggcttcctcaccacgatgctcgccgcgccggacgcgccaccaaccgaggtgacgctcgtctatgccgatcgttcacagatggccatcgaccaacgcggcacatggaatccactgggcatgcgtggaacgcacagcgtcggccttcacctccggggacaggtacccggcacccaggtggtgggggagcctggggggttccgccacgtagcggccaacagcctggtgcccctcgcgcacctcgggtggtcggcctgctggctgggcacggcaaagggggctctccgggagctgctcgcgctccgagccccccaccgaccgcgtggcctcgatccgaagtcggaactcgtggccgcgcgcgtcgcccgggtccggatggagctcgaggtggtgagcacgtacctcacccgggtgtgccaggaggtgatggagcgtcgagcaaacagccgagacctcgacgagcccgccacgcagatccacctcaataccctcaaggtcatagcgtcggagtcctgcttccgcgccatcgacggcatcgtcgagatcgcgggcctggcccaagggtaccggcgcgatgcagcagtgcctttcgagcgctacttccgagacctccgctcggcgagcctcaactacgccaacgaccgactcctggtggccaccggggtactgagtatgctggaccgctcggtgcgcctcagcggagagcagacatga

SEQ ID NO: 5007 - DNA, 972 bp, Actinoplanes utahensis
atgagggcgcagtccgaggtacggcatgggctgtcgatgctcctcgtcgacgtcgataccgccatcgagaccgactggcacgggtacgagggccacgaggaccttgtacgggtcgaggatccaccggtcgaggcgtgggaggcactcgccggtgcgggtctcctgcccaagcctgagtggctgacctgggttgccgactgccagtcgagcgaggacgagttcctcggacgcatgccgcgcaaggaacggcaaagcatagccgcggcccgccggcgcgccgccgccgacggagtgcggctcaggctcggcgacctcgactccacctatctggatgcctttctgcctctctacgaggcgaggactgccgagaagcgccatggctggtccgtcgtcagcgacatcagaggcgacctgttggccgacgcggccgactacttcgtggtctctgcgtggaggggcgatgagttcgtgggcggatgcatcaacctggcaccttccgagggagccatgcggatccggttctccgcggtcgaccagtccggccggtatgccagtctggctcgggcgctgtacctggaagccattcgggaagcgcgcgtgcgcggctaccggtcggtcagtctcggtaccgacccgaacctctacgggcacgtggtcgagcccggcctgctgcgcttcaagtctcggctgggcttcgagcccaagccgtcgcatcaggtaaccggcaagcccgccagtgactgcgccgacctggtgctcgggttcgccgcgctcatggacccgacgatcatgttcagttaccgcaccaacgcggtatcgtccacggcatcggagctgcaggcggagatctacagctacagcgcggacgtcgccgtggaccagcacacggcagcgttgtcgttcccggttcgtagacacgtggtcgacaggcgcccgaccgcgtgcgcgaccggcaatacggcgcccaggtaa

SEQ ID NO: 5008 - DNA, 1143 bp, Actinoplanes utahensis
gtggtgcttgcccccgttcatcaacgcgcgcaggagtggtcattcctgcaggctctgtcggtactcgacgggcgccccggcgcacacgacgccgcccgtgcgctcgcggagaccgagctggacttcgattacctgaccgtgcaggcgctccggcaccaccttgctcccgccatgtggcggtttctcgtcgacaacgggatcgagaaccggttgagcgatccggtactcgcgtcgttcgggagcctcgcgcagatctgcgactaccggacggaggagctgatcgacgaggcgtctcgcgtcgcggacgcgatggccgccgccggcgctcgcctcgcgttcaccaagggcgtcgtgaaccagtccaccctgtatgacaactccggcacgcgggtcatggccgacatcgatctgatgatcccgccggacagcaccgcgatcatcacggaaacccttacgagcctcgggtactccgtcgcgaaggagtacgacgcgcgtacgaacagcctcgtggacctgccccggtcccgccgcatggtgtatcggatgtaccccgaccacctgccgcacttcacgaagctgacgggcaatcgggcgcagccgctgatcgagatcgacgtcgcgttcagcctcacctggttctccagcgcgtggcagatcccgatggacgcggtactacgcgatctggactcggtgttggtacggccgggacggtccgaccgcacccttccgacactgacgccggcatattcactgctgttcatcgtgctgcatctcttccgcgaggcgtggttcatcacgaagaagcccgtgcggctgaaccagttcgcggatgtcgtgcgcctctggcgtcggatcggggcgaaccacgcctccgagatcatcaaggtggtggaggacaacggcgtcggcccggcggtgggctgggtctgccaccacgtcgacgcgatgttcgataccgatatggcggcgacgttgggtacggagcggtatgccgaaccgcgctggctgaccagcggcgtcgcggaggacggcagcttcgtgcaatggcacggcgacatgcgcgcgaggctcgccggcggtgagcccgtcatcttcacgccggccggggagccgccgttcggggcggcggcgcgcgggcgttag

SEQ ID NO: 5009 - DNA, 1257 bp, Actinoplanes utahensis
gtgcgtgaggttgcggtcgccccgctgacactgggccagctgtcgtgtctgcgcaccctcgagcggatgcctgccggctcccccgatggcctcaacctggtgcggtcgtgggacgtcccgccgggccagacggtcaccagcgtgctgaacgcactggacctgctcgaggcccgacacgagtcgcttcggacgatcttcccggacaccccttcactcgcggtacgtcaggtgatcctcgcgccgcggggcgtatcggtcgaggtgctggaggtgaccgacgccgcagacgccgaccggcacgcgcaggagcttcgtcgacgcaccttctcgctggactcggagaaacccctgcgcggcatggtgttcaccatcggcggcgtgcccgtgcgggcggcgctgtgctggcaccacatcgccgtggacggttgggcgatccagcggctgcaccgcgagttcgccgacattctggccggccgcactctgacggaccccgcggtgagctgtcgtgaactggcatgggaggagcagtcggacccggcagtcgagcggaccgcgcgggcggtggagtactggacacgaaccgttggtgacgtgcccagcggccgagcggcctcgctgggcaccctccgtacccggtgggcgacgctgcgctcgtccacgatgcgcgaggcggcgaggctactcgcggcagagtgtggggcgtcgttgcacagcgttgtcctggccgcctactgccatgcgatcgccgagcgggacgacaccgattcaccgttggtggcgctgatctccggcaaccgggccggcacccgcatgaagcaggtggtgggcacggtggagcaggtatcgccggtgcgcgtgcaagtcgatccggcggagagcttctcggccctggtgcggcgggtgcactgggacacgatcacggcgtatcgccacggaaggcacaatgtggatgtcgtgtcgcgcgaggtgggatcgctggggtacgaggggtccggtttcggtttcacgtatttctacaactacatgccgcgccccgcgcggagtaccgtcgccgcaccagcacacccgccgacacggataacgacgcgggacgcgggccgggacaacggctatcccgtctacctcgtcgtcgatgacgacactgagctgacctgcgacctgcgcgatgcgccacccaccccggggtacgaaccgctggagcggctcctgtcctgcatccagcaggtcgtcgcagccgaggcggacggcggaagctga

SEQ ID NO: 5010 - DNA, 1230 bp, Actinoplanes utahensis
atgcttctcttcgttgagtcggcccccaccggagccggaatgtcacatgttcggtgggccgtcgatcacggcttcgacgccgcatatgtgagcgccaaccccgagtgggcgccggagcgcctggggggcgaggtgatggaaacgctcgaaagtcgtggtcgtgtcttcaaggtgccgtcctccgaggtcaccgaggtgcccgcgtggctcgtcagcagcatcgagcaggccgccggcccgtccggcgtggtgtgcggactggaccgcagtctgcctttcgcggccgcgctggcggaggcggtgggcgccccatacccgtctgtgccggccatgcagactttccgtgacaagcgggcggcacgccgcctgtacgacaaactcgggattacctctgcccgatgggcggcgccggcagacgccgacgaattcgtggcgttcaccgaggagattggcggcccggtcgtactcaagaactgccgcggcaccggcagtatggatgtgcgactggtggagtcgtccaccgaggcgcgcgagcggtacctcgagctcagcaacgctgagcggtacctcgacggcgatctgatggccgaggaatacctcaccgggccgctatacagtctcgaaacgattgtctccgacggaacgtgtcaccacctgggagtgaccgaccgtcagatcggccccaacccgggtttctgcgaggtttcttacactttccccgtccaggtgccgtggcagtacgagaatgagatgcggcgggccgtcgaggcgtgcgtccaggcgtacggcatcaggcagggaatgctgcacacggaattcatcgtgacaagccacggcgcggccatcgtggagctgaatgtgcgccatccgggtggactgctgacgatgatgatgagcgactgcctgaacagttccgtctcggaaatcctgagcttgtccgcgttgcagatgccgctgccggatctcagccacaacggaaaggcgtcgacaacggtcaccgtgtatccgcaggtggccggtcgactcgttcagatgcgcggcttggacgaggtgggtgcggcaccgttcgtcgtgcaggcgctgccctccgccgccccaggggattgggtccaaccgccgaccgactaccgcggcgctctctgccagattcgcaccgtcgccgaatccagcaatctgtcgttcaatgctgccatggctgcggcgcggggcatctccgccgtcgtcgagtag

SEQ ID NO: 5011 - DNA, 1260 bp, Actinoplanes utahensis
atgtcgagtaacggtcgattcggcgcgctggtggagcgtccattccgactgttgtggagcggacgcaccgcatcggcggtcggtgattcgctaatgccggtcacggtgacgttcaccgtgctgtccgtcggcggatccgccagtgatatcggattggttctggccaccacgatggtggcccgcatggtgcttctgatcttcggcggggttcttgccgaccggctaccgcggcggctgctgctcatgggcagcgacgtgttcctgttctgcgtgcagacggtagtcggaatccttctcctgcaaggccacaaaagcgtcgggatgctcctggtggcggcgctctgttatggcgcggcgtcggcgatctcgaagccggcactcatcggtatcgtgccgcagaccgtcagcaatgcgcggctgcagcaggcaaacgcgctcatggagctgtccaagagcggtgcggagatcctcggccccgccgtcgcgggtgccacggtcgccctggcctcgccggggtgggtttacctgctcgacgccgccacgttcctggtcagcgcggtgaccgtcatcggtctccaactcgcgcccatggcggacagggagccggagagcttcctcaagaacatcgtcggcggctggcgagagatggccgcgcgcacctggtactggggtgcggtgtgctgccacggggtgtggaacgtcggctcctgcgcgttctacgtgctggggccggccatcgtggcaacccagaccggcggtgccgcaagctggggtctcgtcagcgccagcatggctggtggcgccgtggtcggctcggcggtggcgctgcgagtccagccccggcggcccctcgtggcggcacatgtcgctctcctgctggtagtgctgcagttgtccgcactcatcggcccctctccgaccggtgtgatcatggcagcggggttcgtgagcgccgcgggcatcgcctacgccaacaatctgtggacgacctccgttcagcggttgattcccgagaaggtgctgtcgcgggtgaactcctacgactggctcgtctccttcgcggtggcgccgctggggtacggcgcagtcggaccgctctcggagaagatcggcaacgcggcgactctcgagatcgcgctcgtcatcgtcatcgccgccgccaccgcgatcatgttggtacccggcattcgggcactacagcagacccgaagcggcgcgttggagggatggcccgagctcgcggcgcgaggcgatgcctga

SEQ ID NO: 5012 - DNA, 2202 bp, Actinoplanes utahensis
atgtgtggattggccggatgcgccgctctgggtggagcatcgctcggcggcgatgccgaggccctgctccagcggatgaccgcagcggtctcccatcgaggtccggacgggcgtgcgttccaccgctcggagtccgtcaatctggggttcacccggctctccctggtcgacccggtcggtggcggacagccgctgagcaccgacgacggatcactggtgctgatcgccaacggtgaggtctacaaccatcgtgagctgatcgccggcctgccgaccgggaccaagatgcgtaccggctcggactgtgaggtgctgctgcatctctaccgccgcgacgggctgaacttccttgacgccgtacgcggcatgttcgcggtggtgctctgggaccgcaaccggaatcggctgattttcgcgcgggaccgcttcggcatcaagccgctctactaccaccgcaaccaggaacggatcatcttcgcctccgagatcaaggcgctgttcgaggatccgtcctgtccccgcgagattgactggctgggcgcgctctccgaccagatgatgaccggtgccatggtgctggacgacagccagccgaggtcctggttcaaggagatcgaacttgctccggctgcctccatcgtcaccatcgacttgctcaccggcgacacgaagacccatcagtactggtcgttcccgaccttcgacggcgcccggaccggctcagaggccgaactgatcgaccgctaccgggatgccctcgcgtcctcggtggccgagtgcggtgtggcggacgtcgaggtcggcctgttcctcagcggcggcatcgactccgccgccgttgccgcgttcgcgcctgagaagcctcggacattcaccgccctcaacggcagcacgctgctcaacggggacgccgaatacggtgaccgcatcgcacgccacgtcggcctggtcaatcatcaggtgctcttcgacaccaccgtcacgcccagcgcggatgaatggaagcggctgctctggctgctcgagacgccgctggccgggcccgaagccttctacaagtatgagctctaccggtacgtcggcgcgtatgcgccggaaatcaaggcgatgctgctgggcggcggcgcggacgagttcaacggcggatactcggtgtccttcgcgggtggaggagactggaccgacttcgagtccaacgtccgccggatggagctgcgtacggcccagtggacccggcccgacctgggcacctggtgggagcagtcggaccggtcgctggtccgggagtccgtcctgcgtgacgccgccggcggaaccggccgggacgcctacgacatgttgttccgatggaagtaccgggacgtgcagcagtacaactgctggcacgaggaccgtacggccgcgggcaacggcatcgaggcccgggtcccgttcctcgatcaccggcttgtcgaactggtcgccgcggttccgaagcaactgcgcccggcgctcgtctgggacaaacaaatcttgcggcgcgccatggcgggcctgcttccgcaagacgtcgtcaaccggcccaaggttccgttcttctacggcgacggtgtgctgcacacctaccggacgttcgtccggatgctcgcgcagaacggtggcgtcctgctcgacgaggccttgagcggcgccggagccaggcaattcctcgacgcggacaacattcggacggctctgcacgggctgcagcaggatcccgcctcaggccacgtcgagtttctgctgcacgcggtgaaccttggtctgctggagcagatgacgcacagccttccggcccggcccgccgaggcggtcaccgcagcggtgcccgagagcatcaccgtccacgattgggacgagcagcggagctcgatcgaggaggcggtgcttcagcgcccggccatcgacgacgagacggttgtcggtctcgcggacggggcgctgctgctgcattcccccgacgacccggcgacctggtacgtagtcgtcgacggcgccatcgagtatgtgatcgacgaggatgacaacccgcactggccggctctgctccgtgcactgggcgaggagacaccgctgggtgtggtccgagagactctcggcatcaccctcgccgtcgcacgtgacctggtggtcgaaggtctggagtccggtgtgctcacgctgtccgccgaggtcgtgggatga

SEQ ID NO: 5013 - DNA, 789 bp, Actinoplanes utahensis
atgaccgtcaccaacgtgcgcgctggtcgagtccgtcggccgtacgccacctcattcgatcgaccgggttggacgctggactcacggcggctcatcgccatgtcctgtgtggcggcgttcagtgtcggcttgtggagcgtcggcggcgactgggccagagtgatggccatcgtcgtgatcgtcgaggctctgctgatgtgtctgccgtggcgggtaccgcgcaccatgcgcagtggtgtgagcttctgggcggagacgctgtgcggtctcctcgccccgatcgtggcggtcaccatgacggtcgtcacccggccggcctggctgaccgcaggagccgactggtggtggttcggggccgccgttgcggtggcggccggactcatcgccctcagtgacctgcgtctgccgtcactgctgtccggagagttggccttcgtcttcggcccgacgccgcgggcacacggcgcggcgcgcgcgttcgccaccacggtctgcgcggtgggtgaggaggcggtgttccgggtgccggcgttgctggtcagcccagccgcgcccgtcggcctgctgggtgcgatcgcgttcgtcgcgaggcaccacattcagcccggcacgaaccggcgcggcacgatccgctcaaccatggtggagattgccgcgggagtgctgctcctcggtttgacagtggcgtccgggtcgatctatccggcgctcctcgcgcacattctcaacaacattcccaacgtgatcctggagcttcagcgggagaacgacgacaggggctggacatga

SEQ ID NO: 5014 - DNA, 783 bp, Actinoplanes utahensis
atgatcatcgatcgcgagcacatcttggccgagatgaaggttcgtgccctggtgcccgacgactgcctcgctgttttcgcggtgggctcgatcgcccgcggctgggcaaatccgggcagcgacttcgacttcatcgcgatcaccgcgcggccgtggtcggtgcagggcgcccgaagtgttccggtgccgctggaacccaatgcggttcaggcgctggaactccaggtgggggagcgtcggtgggagatcgcctactggctcgacggacagatcgaccagatgttggccaaggcgagttggcaacagttcgacgccgggatctcctcgctgaaggtgctgaccgatcccgaggaactgctgttgggccgcttccccaccgcggtgccgctgctcggcgcggactggctcgaacgccgccgcgcgcagctcgcggagtcggcatacaaggcgttcatgaccacccgctcgcttgccgaggccgacggcaatgtggaggacgttttcgggatgctggccgcgggtgacgcgcacagcgccgtgctggcggcccgcaaggcgttcgggcacatcgttgatgccctactggagagcaacaacgacttcgcatcgcggtcaccgaagtggcgcgcccgccggatgcgcgacgccggcctgcccgttctcccgttcgagcggtactgggcggtcgagaccatggccgacttcgacgagcaggacccggcggcatgggccgcgcgggtcgcccacctgtgcaaagacctttccgtggagatcgagatctga

SEQ ID NO: 5015 - DNA, 342 bp, Actinoplanes utahensis
atgggccgcgcgggtcgcccacctgtgcaaagacctttccgtggagatcgagatctgatggctaccgccggcaccctcaccgcccagtccgttgtccagcgtgcctccggcgcccggtttcggaaattccgcggcaagctgttcgtcgccaacgcctcgctggccttcgagctggacgagatcgccgagttcatcttccggcaggtcgacggcgagtcgtcggtggaagcgatcggtgcgaaggtagccgccgagtacgacgtcgacgtggccgaagccgtcgccgacagcctcgaactactcagccagttggcccagaacgacatggtgcattccgtgtga

SEQ ID NO: 5016 - DNA, 1020 bp, Actinoplanes utahensis
atgtgtggaaccgttggcctgttcatcggctgtgccgcgctgtcgtactgccccaaagaactgctgctacagaccgcacagcaggcggtcggcaacgagcccgaatatcgcagtccgtttcgcaactggcacgagcgcgcgagcgtccgtcaggcaccgcgtcgtctcctcaccgagggggccatccggccgtacttcccggccgaactcgtaccggtgacccgccatcccctgatcaaggggctggccccggaaaccttcgatgaggtgctcatccagcacctgtatcgatatctgaacttcaccgcacgcttggaatattcggtggtgaaccgcacggtcctcggcatcgcgtccggctcggtgggtgtcaccctgcccgaagagatgcggttcgacgcctacaagatgtactgcgacgaggcctaccacacgctcttctccgtcgacctcgcgcgccaggttcagcagcgttccggcgtggtcgcccggctaccggatgagccgtacttcatcgtccggctcaaacagctgatagcggaactccccgagcgtgatcgagcgcttgccgagctcttgttcgtcatcgtttccgagactctcatctcggcaacgttggcggacgttccggaatgggacggggtctccgcggcggtccgcggcacagttcgggaccacgccgccgatgagggccggcatcacgcctatttcgcggctttcctgagattcctctggggccagctgtcatccgacgatcgtcgtcgggcagccgtgctggtgccccggctgatcgacatcttcctcagaccggatgtgccggcgctgcgggcagagatggtcggctacgggctcaccgcggaggaggccgagtgtgtcgtcgatgaaacctacacgccggatgtcgtccgagagcacgtagcggcgacctcacgacaaaccgtccgttacttcgagtctctcggggcattcgacgacccgcttgccgcggacgaattgcaccgttacgggatggcatcttga

SEQ ID NO: 5017 - DNA, 1119 bp, Actinoplanes utahensis
ttgaacacgtacaccgaccagctagcacttccgatcgaagtgcactgccacggtttcggccgggtggatttctccgagttcgccacacttgacctcgaagagctagaccgccagtgcgccgaggagggcgtgctgagcatcccgacgctttacctgcaccgggaccggttgaccgacttcgagcagttcatgcaccgctatcacgcgttgcgccgggccggtcggttgccccatgtcgcgggggtcgctctggaaggcccgctgctggccagccacggtggcacgccgaaggccacggtgtgggcgccgacccggcacgagtgggagcggctggcgaagctgggctcgctaggcctcgtctacaccgtcgtgtcgcccgatgccttcaccgcggcctccggtctctacgaggctctcgacgatcggcacccgcgcctggactggatcgtccccctgctcatggagcacggagttcgtcccgcactgggacacttcacccgggccgacgagctggccagcgccgaattggtacatgacatcgtggaaatggcctggcagagcgagtggaccgggcagggggcccgggtggtcaccgatcacctcttcaacgacatgccgttgcgcatccggcacgctttccggacctcggcggcccgcaaagtcagagacagtacgctcgccgcgtacgacctgccgaactggactttggcggacatgggcgagatcgccggcccggttcccgcggtgatcatgcgggaagcggccgcgggtcggctgtcggcctgtatcaatttcgatggcgagcacgtcgatctggcgatcgccacccgcgcggtcgaactgatgggttactccaacgcgatgatgatgaccgatcgctgcgactcggctcgcatcggcggccaggctctgcatcagaccgaggagaacggactgtggtaccaggacggcggtattgtcgccgcgggttcccagccgctcgccaagcagatgcgtaacgcgcaggtcaacggcatcagcgacgccgatctttggcagctcgccacgtcgaccgcgcaccgggcgttcggcaccggcgtgcggaccgacctggccgccctcagcgtcgattcgcagtga

SEQ ID NO: 5018 - DNA, 678 bp, Actinoplanes utahensis
atgttggacgcgctgaatcgcctgacagtggactggtccgacctgcccaaggcgcggcagcagaccaaggagatcctcaccgccctggccgaggacaagaacgcgcttgaggagctgctggcccgggctcgggaggaggaagacctcttcgacaagtgcgagcaccatcggctgctcgacaagttggtgatctacgatgcgctggaccgcgggttccgcatccgggtccacgtctcgaccgaggaccaccgggaccggccgcacgaccaccgattctccttcacctcgctgattctgcgaggcaactaccggcacgtgcgtcacgagttggtgggcaacctgggagacgtgccgaacgacgttcaggacgacttcgacgcgcgcgagtccgacctgcgtgtggtcccgcgcttcgtgacgactgagcgggccggcaactgctacaccctgcaccacagcgagatccacaccacctacaccaccccgaagacggtgtcgctgttcctccggggtccggcggagaaggaacgctcgctgatcaccgaacgggagaccggccgggtgtggtggcggttcggcgaagaccaggagaaggcgtcgcgccggggaagtaaacggatcagcaagcagtacttcgatgacctgaccggccggctgcgagccatggaggtgctctga

SEQ ID NO: 5019 - DNA, 699 bp, Actinoplanes utahensis
atgaccgaaacgatgacgagtggtgcggtgatcagtgcgcaggagcgggccgccgtggaattcatggcgtcgctgccgaccgtgcggtgggatgacatcgaggccgcggctgaggtgaccgagcggatcgcgcgtcgtctcggcgacgaccgggagatgctgggcgccctcgtcgaccgggtccgccggacgccggagctgcgtaagaagtgtgaatgccacgccctcgacgacaagattgtgatctgggacgatccggagaagggtctgcggatccggttgcggctggcgaataccaatcagtacgaacgggtgcacaatcaccggtacagcttcaccgcatacatcctgcgcggggcctaccagcacacgctgtacgcgaccgaccaaccgttggacgacaccgcggacgtcgaccggttctggccgcacttcatccgtgaggagccggcgggccgctgcatcacgctgcaccatgatcagctgcacaccacgatcaccgagcccgagaccatctcgctgatgatccaaagtccggctcagaagcgccgcgctttcatgatccggcgctcggacggtcacgtctggtggcgtgagggggccgccgacgaaacggcggagcggcgggccgaggttcagatgtcggacgagcgtttcgagcactgggtcactcggctgaaggcgttcggcgtgctgtga

SEQ ID NO: 5020 - DNA, 741 bp, Actinoplanes utahensis
gtgagcatcactcagaaggttctccgctacggcgactcgtcgtggcagcgcatcgacatctacgaaccgggtgacagcgcaccgcgctgccgggcggtactgatccacggtggtttctggcggcacgaccgcaccgcgctcgacctggagccactcgcgtgtgctctggtcgcccgcggatgcggcgtggcggtcctggagtaccgcccggtgtgggacggcggcgcgttcccggcctccgtgcaggattgcgtcgcggccatggccgcgctcgaggggagcgacgagcggtggcgggacgccgtcgtgaccggccactccgccggcgggcacctcgccctgagcgcgttggccggacgagccggaaagcgccgggtcgtgctgctcgctccggtgaccgatctggagtcggctgccgaactggaggtgggcgacggcgcgatcggccactttttggcgaagcatcatgctgtcggcggccgtaccgtcgaggcggttccggtgatcggatccgccgacgtcacggaactggtggtcgttcaggccgagaacgatcaagcggtcccgtccgcgctgatggaccgtcaggtcgcccggtggcggcacgacggtctgccggtgacccaccacctggtcgcgggggcccggcacatgcacctggtcaacccgcagcgaggcggtagcgatgtgaccatggccttgctgaccggcgccgagttgtcgacagggaatccgcggtga

SEQ ID NO: 5021 - DNA, 822 bp, Actinoplanes utahensis
gtgaccgatgccgtgacggttcgtacggtcgggttggatcaggcgacgactccgctccggatcggggtgctggtctcggcgaccggcgccaatctgcgcaccttgctggacatggcggcggctgacccggatacgtacgaggtggcgctggtcgcatcacacgcgccaggggtgcccgccatcgacgttgcccgcagcgccggagtaccggcgtggcccggcgacttcgacgactactgtgggctgtcctcccaggcgagcaccgacgcggaccgtgcgcggtaccgcactcgcgcacgggagtggcatgaccggctgaacgcacgcatcggcgcatgggaggccgtccacggacgcctggacctgatcgtcctggcttaccaccgatggatcgagggcgatctgcttcagcgtttcgccggccgcatgatcaatcagcatcccggggatctgagtctgctcggctccgccggcgagcggttgttgatcggcaaggacccggtgcgcctggccatgaaactcggacatcggtcgacgcgtacctcgtgcttcctggtcgacggcacccgcgacggcggcgccgtgctctgcctcgggccgtcggtacccgtggaagatcgtcgtcccacggcggccgaggcgcacgagcaggagatgcggcagaaagcggcgagcgatcaggtggcgctgcgctggaccgtacgggccatcgcagaaaagcgcctggcgatcgacacggccgcgacgcaccgggacggcagcccggtggtgctcatcgatggaacgcccacgccgctgggcggaaggagattcgggctatga

SEQ ID NO: 5022 - DNA, 1005 bp, Actinoplanes utahensis
atgagccacccggcgaccgagacggttcggcggtctgcggtgcccgccacggccctccaacggctgaccgtcgatgcggcgaaggatgcggcataccgccacgacacctacttccgggaggggctgtggtccttcgagcggcatgcccgcccggagcgccaccacgacgtcacgttcgtcgtgctcaagcccgacgccatcgccggccgtcgtggtgagcaggtactcggcattctgcgggagcgtggttgggcggcggtcgcggcgacgaccgtccgcttcgatcccctgctcacccgggagatctggcgttaccagttcaacgcggcatcggcccagcggatcgcggtcgtcgaccacctcctgggctccggcccgtcgttgctcgttctgctgtacgacaccagttccgcggacctgccggccagtgtgcgcctgacggcggcgaaggggtcggcggaaccgcgtgccgcccgtgagggcgacctgcgtacccggatcggccgggtcaacggcctgttcaacttcatgcacaccgccgatgagccggccgacgtggtgcgggaactacagctcttctcctaccaggcaggctgggactggtgccgggacgcactgcgggaccctgcggccgtactcgcctcggcgaatccggcagcgtcgatgcgtgcgctgctgaaccaggtgacgaccgaaattccggctcacgacctcgatctgccggccgcgctgcgccggctcgccgccggtcaggatcgatggtcggagctggcgctcgatcacgcacgcgtggacgaggtcgacctgtggctggctgagcttcgtcgcacgccgctgccctccggcaccggccgatgggacgtgttgaccgtgctgaccggctggatcgagtgcaacgagcccgatgtcgccgcgctgctggacacccctctgccagcacggtgggccgccatcaccggccaccggccggtcgacatgccgaggagtgcgagatgccccagctga

SEQ ID NO: 5023 - DNA, 1338 bp, Actinoplanes utahensis
atgccccagctgaatgcgaccgtgccggtaccgccatttgtgggcaccgggaatctgatctatcggtcggcggtggtgccccgattcgtcggcgcggccggctgcttcctggaggctgaagacggccgccgatacctcgacgcggaggccgcgaacggcaccgctgcctggggatatgacaagtccctgttggctgaggcgttgctgcgctgcgccgagttgccggccctgccgtcattctgcgagtcgtcgctgcgagtgcgtgtcctgagccgcctggagcggctgttctccgaggtcatcggtgcacccggacgcgttgagctggaccttggtggggctcagggcatggagaccgcgctgcggatcgccttcagctcccggggacccggcacggtcatcgtcttcgaaggagcgttccacggccgctccggtgtgaccagcatgctcagctccagcccgcgctatcgtgagttgctggcggcctgggggctggaagtcgtccggctgccgagtccggactgccggagctgtccgcacaacatcacggcagactcctgcacgcccgggtgcatcacggcggtctcgcgatggggatcggagctgtccggcgtgggcggaccaggcttccggcggaaggcctcggcgttcatcttcgaggcggtccagaatgtcggtggcatggtccagccggatcccgtcctgctgcgagccgccgccgagcacgcccggagccagggtgccttggtcatcgctgacgagatcttcaccggcatgcaccgggtcgggccacgctggggctttcagctggccggcatcgagccggacatcgtggtcaccagcaagggactgaccaacggcgcggcggcactgagtgcggtgtgggctcgcgagccgctggcagacgcggcccactacccgccgggaagccactcgtccacctatgtcggcatcccgcatgcgctcgcggtggtcgacaccatgctcgaccgctgggaggcgtgggccgaggtcgagcacgacgtcgcgaacctggaattggccatgcgcggccgcctcgaggaactggcgaagcggcacccgtgggcgatcgatcaggtggacgccctcggcgcgaccgcgcgaatcgtgctcaccggaccccatgccgccgacctccggcgactgtgcggaacggtccaccctcagcacggcttgctggtggcctccacgggaatggctcccgacgtcatcaacatccacccgccgttggtgttcggcgctgccgaactggacctgatggccgaaatcctcgacctggccctcgacgcgttgcggaccgagggagagccggcatga

SEQ ID NO: 5024 - DNA, 1218 bp, Actinoplanes utahensis
atgtggcgactgcgcaccggatatcgaagagctgctgttggccgcgcgggccgatctgggacacgaagaggtgcggtgcacatgaccgacagtcagcccgttctggtgggcgcgatcctggagaacggcattcccctcgttctcgagccgaccgcagcgtccgaggcgctggtcgccgtcgtgtttccggtagcgggcgacgatcttgcggaacgggtggtcgctcagcaactggccgacgcgttccaccgggcggtccgggcggacgggtcatccggtgtcgtgctggctgacggacttctgaccgcgtggtgccggacaccgccggagcgggtagccgagatgctgccccgctttgccgacgcgctgctgcgaccagactgggacgcggaggcctgccgatcggccggcgccgcggctgcgaagaagccgcacgacacccgggaccgggcggtgaatcagctccggagcctgctgttccccgacaatctggccgccccgggcaacgctgggcagtgttgcgatctagaaaccctggttgaacggcaccagaaaatgctgacccgccggcccgtgatcgtggcctctggtccgtcggtggcgctggacgcgctccccgcggcactcggccttctcggcgagccgcgacagttcggccacggacccggccgggccccggggtgggcggcggtgtccgtcggtggcgtgaacctgggatccgggaccggcgacactcccacctggctggtgctcggcgcccgcagcgtcgacgccgaaggagtccggccggatgcgttgatcgtgcttgccgagctcttcggctccggtccggcatcgctgctgcggcggacgttgaccgacatcggcatcaccggccagctccacagtgcctacgttgccggcgatgcgccctggtggtacgtcgcgctggaagtcccggccggccaggtcgccgagctggagtcgatcgttcgggagaccttcgaggtcatcatcgatcggcgcctgtccgaatccgccttcgaggcggcgcgccgggccgcatgggctccccggccggaccacgtccgcgaactcacccgcctgattcatcgggccgccgccgagctggaccagccgggcgctgctgcggcgccaaccccggaaacgctgaccgcgcacgatgtcgcggtggcggcccgccgggtcctggccggctacgccgttaccgtcgcctga

SEQ ID NO: 5025 - DNA, 651 bp, Actinoplanes utahensis
atggaccgcgttcttgaccgcctgcagagacttgactggtcacggatcgaggttgccgaacgggttgccggtcaggtcaccgatgtcgtcacgactccgggcgcgttacgcgaactgatcgacaatgcgctcggcgacaaagatctgctgaccatgtcagaatgtcaatggtggggcgaccgcattgtgttgttcgacgacccggacagcatggttcgcattcgtttgcatcgtttcgaccagggtacccattttccgcacagtcaccgttggccctttcacacgaaagtgttgaaaggcaagtacattcatcgcctttacggtcctgaatcgtatgtcaggcagcaggtggaatccggggtgaccacgctgacgcccagcacgatccgtacggagaccgaaggctgctcctatgcgatcgatcagcacatggtgcattcagtgacgtcggcgacaaatacgttttccttggtggtgcaggggccacggctcaaggaacagtcgttgcgtacggcgcaggacgggtcgctcatctggaagggcggccgggcgaccgagaccacagccgcggtgaagcaggtattgatgggcgcggaccggctgcaggaggttcgcgagctggcgctccgttccggactgatcgacaagtag

SEQ ID NO: 5026 - DNA, 1194 bp, Actinoplanes utahensis
atggatcttctcaagccagtcgtgaagccgtatgagtggggttcgcgatacgctgtcgccgagcttcagggccggtcgaccccgagcctgggcccggaagcggaattatggatgggtgcgcatcccggtggtccatcgggcctcgatcgcgacggcgcggtcactgatttggaaaaggtcgtggccgccgacccggaaggtgagatcggtgagtcggcggtcaaacaattcggcccccggctgcccttcctgctcaaggtgatcgcggcggaaaaggccctgtcgattcaggtgcacccggaccgccagcaggccgaggccggattccgggaggagaatgagaggatcctcgccggcgcgacgtcgacccgcacctatgtcgacgactggcccaaacccgagatcgtctactccctgacgccgttccaggcactggctggtttccggtccgcgccggacgccgccgccctgctcgatgaactgggcgtgccccagctcgcgccgatcgctgagacgcttcggcagagcccggccggcgatgcccgcagcgatgcactcgtgcggatcctcacctggccgactgaggagcgagccgccctgctcgacgcggtggtggcggcttttgggcgggtcgccgcgggcggcggccgatacgcgccggcgtgcgcggcgatggcgcaggtggccgtggaccatcccggcgacctcggtctggtcgccgggctcctgctggagtacgtggagttgccgccgggtgcggccctctacatgccggccggcggggtgcacgcctatctcaagggtgtcggcgtggaagtgctggcgaactccgacaatgtcctacgcgccgggctgaccggtaagcacatcgacgtggccgagctggcccggatcgcccagcccagcgtgccgattccgcaggttcaggcgaccacggtgagtccgggcgtgaccgcgtacgacgtcccggcgccggaattccgcctgtacgtgatcgagccgcgcggcggccggagcgagccgtccgccattggcccgcgcatcctgctgtgtctcgagggccgggcggtcgtgcgtgtcgccgccggtgactccgtggagctccatcgcggcgagagctgctttgtggcggcccgcgatggtgcggtcaccgtgaccggtgacgcccgggtggtcatggcgagcgtcggataa

SEQ ID NO: 5027 - DNA, 1245 bp, Actinoplanes utahensis
atgacttcgaccgatgagaagaccacaccggtcggcggacgacaatccagtctgttttggcgctattggacggcatcaacggtcagttcggccggcgatgcggttaccgcgatggcgttgccactggtcgcggtgcaggtgctgcacgcttcgacgttcgagatcagcctgatcaccgccgccagcttcatcgcctggatcgtgatcggactgcccgctggtgtcatcgtgcatcgattcccgctgcgcggcacgcagatcgccatggatgtcgcccgggccgccgcactgctatccatcccgctcgcacatctggccgggatactcaccctggcacaggtcgtcgcggtggccttggtgatcagttttgcgggcgtcatcttcgatgtcggcaactccaccttcctcccggccatcgtgaccaaggaggaactcacctcccgcaacagcctcacctccggttcccaggcggtgacccaggtggccggcccgtccctcggcggcatcctggtgcagcttctgggtgcggtgaccagcttggtggtcgacgtcatcagctacctcgcgtcggcggtgctcctggcgagcctgccccgcccgcaggcggcagcgcccgtcacccgcaacgcgtccgccgggcgaatgatcagggacggctggcggtacgtcgtccatcacgaggtcgtccggccatgcgtggccgccgccacgacgatcaactttgtcgcgggcgggttgatggctctcaccccggtgtttctggtccggacgctgggggcgccggtcggtgtggtgggcctgctcttcgccgcggaaggggtcggcagcctgatcggcgccgccgtgacgacccggctgtccaaggtgctcggcagttcgccggcgatccggtgggccactctggtcggtgcctgtttcgcgctcctcctgccgcttgccaccgccaagtggggactggtgctcttcgccgtcggcaacatcggattcgcgatcgggatcgtcgtcctcagcatcctcacccggacccatcggcaggcaaccacgccgcccgagttgctggcccgggtcatggcgacggtccgtttcatctcctggggtgcggtcccggtcggtgcggtgaccgcgggcgtgctcgccacctcgttcggtaaccgggaggcgctctgggtcatcgtgggcgcggccttcctcaccccggcggtgttgtggggcagttcgctgcgcggaaagcgtgacctcgcctaa

SEQ ID NO: 5028 - DNA, 672 bp, Actinoplanes utahensis
atgtggatcaccatacacaccgatagacggcggccggtccatcgaatcgggctacccggcggcggctccttccgcgggcgtacggtccgctcgggcgagggtggcgtacgggtggagcgttacggtggtgtgggcggtgtccacactggtgggctcccgggggaggtggcaggactcgtgccggtggtggaggcgtcggtggtcgccgggatggtgatcgcgtgggcggtgcgcaaggctcgtaaggctgctggccgcgcggatgagacggtggacgcggcgatcgacgcgggcgcgggccggttgcatgatcttgtcttgtcgcggcttggtggtccggtgcaggaggatttggccgaggaagcggcgagtgagtcggggcaggtcagtgagttgactcggcagcaggtcgagttggcggtggctgcggcggcgcgccgggacgagacgttcgccgagacggtgactgatctgttggagcagctgcgtcaggcggaccgggcggcgggtacgcacatttcggcggcgccggggtcggcggtgttcatcggtgacgtgaccgcgaccgcgtacgacgatgcgacggcgatcgggcaggccggcaccgtgaacatcggtgatcggctcggggagcggccggaccctacccagccgggtccgtccggccactga

SEQ ID NO: 5029 - DNA, 3483 bp, Actinoplanes utahensis
atgccgggagcgggagtgctcgggcatggtcagcagggcggggtcagggtcggtacggccacgacggtgaacgtgttcctgtccgcggcaggcccgttggtgacagcacggtcggcgtatctggcgcagttgcgccggatcgcgccgccggtgttggagggccgcgaagccgagttggcggaactggcccggttctgcgtggagcctgggcggggttcgtatgtgtggtggcaggcggacgcgtgggcaggcaagtcggcgttgttgtcgacattcgtgctcaatccgccggatgagctcagtgcgcgggtgcaggtggtggccttcttcatcaccgcccggctggccgggcaggacacgcgggaggcgttcgttgcggcggtgaccgagcagatgggcgggttgaccggccggcagccgccgaccgtgcccgacgaggggctacgggaggcgtggctgctggatctgctcgaccaggccgccgctgcctgcaccgcgcggggggtgcgcctggtgttgctggtcgacggcctggatgaggaccgcagcagcgccgccggcgtccacgcgcacagcatcgccgggctattgcccggcgacccgccggcggggatgcgggtgatcgtggcggggcggccgaacccgccggtgcccgacgacgtgccggactggcacccgctgcgggatcccggcatcgtgcgccggctgtccccgtcgcagcatgcacgcgatctgcggcggctcggccaggcagaactcaaacgcctgatcaaaggcaccgcagtcgagcaggacctgctcggcctgctcaccgcggcgcgtggtggcctgtccgggcccgatctgcgggagttgaccggcgccgggctggccgagatcgaggacgtgttgcacaccgtggccgggcggaccttcacccgccgcaccgccgaatgggatcccgacagcggacccgaggtgtatctgctcggccacgaggaactgcagcatgccgctaccgcctacctcggcgaaccccggctggccggctaccgtgcccgcctgcacgcctgggccgacacctaccgcaccaccaccaccaccgacggccgcccgccgtggccggcaggcaccccggaatacctgctgcgcggctaccctcgcatgctgaccaccaccggggatgtgccgagactggtcgcgttggccaccgatccggagcgccacgaccggatgcgggatgtcagtggcggcgacaacgccgctttgaccgagctggctgcggccgccgcgctgctgcgacgggaggcccatcccgatctgcgtgcgttgctgcgcctggccgtgcaccgcgaccgcctgctccgccgcaacgagcggatgccggatgagctcccagcagtgtgggcggcgctcggcaaccgcaaccgcgccgaggcgctggcccgcgcgatcctccgtagcgaccgcggcgcggacgaggccctgaccctgctggcggaggaggtcgcgcggaacggcgactacgacgaggcacggcagctcgtggcagagacccatctgtacgcacgcgccggagcgttctgccgcttggccatgctggcccatacgggcggaggcgacgagcagcccgaggggctgttggcggccgccgagagggccgccgcggctgtgacgaccgacgtggaggttcgcagtttcgcgttcgggcacgtcgcggtcgtgcgcgccgcagtcggcgacctcgccggcgcgctcgagacgatcgacaggatcgaagtcctggatcgcggcttcggtgaagtactgattcgcgtcgcggagctcgccgcggccatggacgacgagccggccgtccgcgcgatcgtcgattactggcgaccggacggcttcgaagacccgccgcagtggttgctcgcgcagtcggtgatgctggcggagctggtcggtgatctcgagcgagccgaggccaaatcagccctgatcacgtcggagacaagccggtgtgcggcacttgcgttccgggtacgcgcggccgaggctcagcttgccgcggactacgcccgctcggcgggggacatcgctctgtcagcgccggacgagaatcgcgtcacggcgcaactccacgtcgtgcgcgcctggatcgcggcacgggacctcgaggcgagcgtccagacgctgcacgagatgtcggtccgcgaggaccaccattttcctgatcgatccgcactcgagcgtgcccttgaggcggtcgcggaacaggcgttggcgaacggcgaggtggagctggcggcgggcctcgcggtggtcgccgcggagcgtggtctgcgccgggcgaacgctgacatgatcctgatccgtgccctcgtggaccacggggagttgtcacgggccgagcgcatcgcgcgggcgggcacggacttcgcggcgaacgcgaacgccttggcggtcgtcgcatacgcccgcgcccgcgcgggcgaccacgaacgggcggccgaaatcgccatcgagatcgagcagtcggtccgcaccgccgccggcctcgattcgccggtcgcgctcgccgaactcgccctcgtcctgctgaaaacgggctcacacgagcatgtcggccggcttgtcgcacagatcctcggcggcatcatgtccgatgcgcaggacgactacgaccgcgaactggtggcggtgagacttgtcggcgaactggttcggtgcgagcggttcgccgaggcgcaggcgctgacgaacgcgctggacccggacggcgactcgtggatcaccgacgtgtacacctacgcccggcgcaacgacggtcaacgcgggcaggtcatcgccgagccggaggctgcggagccggtcgaggtccgtatcggcgtgtcgatccagggaagcagtgaccaagagatccgcgacctgttcgaggcggcggagcgaagggagcggccgtactacacggcggccttggccgaggccggacgcgtcgaactcgcggagtcgctggccctcggtctcgacgatctcaacgagcggaccggggcgctggcgccgatcgtgcggccggcctgcgagcgtggcgacgtcgaactcgccgaacgggtcagcttggcgatcccgcaggaccatgagcgcgcgaaggcactggcgacgatcgctgggcaggtgccggacgataaggagcgggcggatcgcgcggaggcggaagcgcgcggcgtgcgatttgcggaggaacggtccgaggcgctggcggcgttctcggccgcgatgttcgccgtcggcgacgtcgaccgggcgctgtcggtcgcccgcagcatcgaccgtccgcccgaacgggccaaggctctcctggcgatcgcagatcagctgtcgccaccggcccggcggcgattgatcgcggaggcgctgtccttcgccgcctgggacgtcgtcctaccgtggctcgtcgcgcatgagccggctgcgttggacgtcgtggtcgaggagctcggcgtgaccggcgacgcctga

SEQ ID NO: 5030 - DNA, 2487 bp, Actinoplanes utahensis
gtggaacaacgagccgtaagggcggccgacgaggccaccctcgccgaggcggcgaagcgtggcgaccgtgccgcgctcagcgaactgatccgccggtgcctgcccgtggtgtattcggtcgtgcgccggcgaacctcagggcccgatgcggacgacgtcgtgcaggagacgtttctccgggccgttcgccacatcagctccgtgcaggacccggccaggttccggtcctgggttctggccatcgcggtacgcgagagcaaccggcgccattgcatgcacagctgggagttcgaccagtcggtggacgaggacatcgagggcgtcgcggatacggttgaccaggagaggcggatcctggcccggatggcactgagcgaacagcgccgcgagatcgccgaggcgaccggctggctggactctgacgatcgggatctgctcgctctctggtggttggaactggcaggtgagctcgatcgcgaacagcttgccgcggctgccgagctcgcccctggccacctgcgggtccggctgcagcggctacgggaacgcttggacctgtcccgtgccatcattcgtgtccttcggctccaaggcaccgcacacgggtgcgccgtattggccgacgtggcggccggctggaacggaaccgcagcgccgctgtggcgcaagcgactggcccggcaccttgatgagtgtgagggctgcggtcgcgcccggcacggtttggtgccggccgaccggctgctcagtggggttccgttgctggtagcgccgccggccctcgccgacgcggtcggcaccgcgacggcgcagatggccgcttcgaaggcttccatcggtgcccgccccaagccgggccacgtgggcaaggtgcttgccggtaagcccgccgccgtggcggccgccacggcaaccatcctgacattgagttcggtgtacgcgtactcccgggcgcaggcccccgcgccccgggagagcaccacgtcgcagacggtcgtggcagcaccgacgaccagcttgggcccgtcgccggtcgggtcggtgtccgcgccacccgtcagcagccccgccgactcgccactgacccgctatgtgtccgccaaggcgccgaacggcgggaacggttccttcggccgccccttcaactccctgtcccaggcctgtgccgcggtgccggtgaacggcactctgcgcctcgcagcaggggcttacgacctgggtgacaagacgtgtgacctcgccaagggggcaagcctgatcggtgcggggcagaatgccggaggatcgacgatcaccggcagcgccccgattctgatccgggtgcagaatgccaccgagaggaccaaccggcagcagatcgcccggttcgcgttgcgcgggggcgtctcggccacgcaacgcggcccggccgaaacggggctatggctcaatcgcctgtacggtctggatgtccatcacctgacggtccagaattttcgcgccaacggcatcaagctggcggacatcgtcgggtcgaagttccacgatctgaccttgaacaacaacgccgaagaccggggcaacggttgctccggcaacttcacggtcggcaacctgaccgacacgacgatcaccaacctgacagccagggacaacatcggctacggcatcaaggcgtcgcccatcgacgacggagccggcaacaccagcggcgatctgcgcaacagtcgcgtcacgatgaccaacgtggtgtgggccgacatcgacatcgccgtcagtcaagcccggtgcgccaaatggaacacgctcggcgcggagttctggaacgtccgctcgatcggcacgaaaatgacccggctacgcatcaacgcgccgctctccctgggacagctgggatcattcgactcaacgttcgaggtctcgaactcctttttcgacctgccctgtgacagccggcgcaacatgtacgccgtcgaagccggcatgaacggtctctacttccacgacaactacgtctactgcgggctgtacaccctctacagcgaggaaggccgcgacatctcgcaacgcttccggatcgagaacaacgtcatcgacggcgccagcgggcctggcgtcttctggatgccacagggcatggagaatgccaccttcaccggcaacacggtcatctcgaagattcgcattttcaacctgggcgatacgaggaagtcctcgatcaccctgcgggacaacatcttcctctcgcgcagtgccgcccagcggccgtcgctcggccttgacggtccgggtctccaagtgaccgccgaccacaatctcttcacgaacgtcgggccggtgggtacccgggtgtcgaccggcgaccccttcccgagccgggccgacgtccaacttccccgccgggcggcggacctgagcccgtaccgggtggccgggtcgggagtagccgcccgagccggagtcgggggccggccggtcggtgcggacgtccccttcgaggtcggttga

SEQ ID NO: 5031 - DNA, 2940 bp, Actinoplanes utahensis
gtggtccgcgtgctcctcgagagcggggcagaaatttcctcgaatcctgttacccccgctgacccccacgggtctccgccgcaaagtccagtacctcgtgctggcggaagggagaactgtgatgcgaccggatggtggcgagcccgagcatgtcgcgctgaactggggcgatctgatggccttccagaggctcgccgcggagctcaacttcactcgcgcggcagcccgcctgagcatcacccagccggccctgtcggtacggatacgtcggctggagcagagcgtcggagctcggctgctcgaccgcagtacccgggtggtgcggttgacgacggcgggtcgcttgctcaaagcctggaccgatcacgccgcccgcagctggacggaggtccagaagatgatggtggacccgccggaacctgcttccggtaccgccacagcggtgaaccggctgccctgccgtgccgtatgaaagatcatcaacacgatcggtcagtcccgggcagggcgacgacagcacggcgacgacgggatggctcatggtcaggttggcccgcacatgccgccgacggcacggtgacgattccacccggtcgttctgaagggagtacgccgttgaccccgccaagcgtcgccgctgatctgatcctggcggcacggggtggcgaccagtcggcgctcgaccggctgatacgtgatcatctgggcctggtcttcaacatcgccgcccgtacgctcccccgggctgatgccgatgacgtcacccaggagaccatgatccgagcggtggccggcctgcccggtctgcgcgaccccaacagcttccggtcctggctggtagccatcgcggtacgcgagacccggcgtcgcggcaatcggctcggcgccgatcagcagcggatcaccttcgccgacaccgatgacctggtcgccgtcgaggccggcgtcgaggaccacgtggtacaccgggtggacgtcgcccggcagcgccgcatgctcaccgccgccacctcctggctcgacccggatgaccgggaactgctgggcctgtggtggctgacgcaggtcggcacgatgtcgagcgctgagatggcctcagcgctgggcatctccgcggcccatgcccgcgtccggctgcaacgattgcgtacccggctgcatgccggccgcctgatcgccgaggcggtcgccgcgctggacacaccgcacaagtgcgacgatttgcgggccctcgtcaagggttgggacggcagccctgcgcctgtctggcgcaaacggctgaccaggcacgtcgacgattgtgctcggtgtggcgcgcccttcccggccttgttgccgccggagcggctgctgctcaccgtgccgttgctggtgccgcccgagcgcctgttcgacacgatcgtcgccggtcacgagatggtgccgtcctcggctgacgggccgcagcaccgcggacgcggacggcgcggtgtcgtcgccgccgcggctgtactcgccgtcgcgctggcggtgggtctgttcgtcgtcgaccgttcgccggcgcccgtggtcgtcaccgcaccgccgccggccacctcggcaccggcccactcggccggtccctcgccgtcgccgccggccccgacatcgacggtggccattggcgcgggtgccggttccggtgggccctcctggtcggcgcgacagctgccgcccaccgacggtggccgctacctctacgtctcgggtcggggcgacgacggcaactcgggtcggacacgtgacgaggcactgcggacgctgcgccgggccggcgagctgaccgagccgggtgacacggtgctggtcgacgacggcgagtacagcgacccgggccgcaacagcgtggtgacgatcgagcgctccggtacgccggaccggtggatcacctgggctgcgttccccggtgcccacccggtggtccacgccgcgcagtggcagggcatctgggtacacgcctcctacatcaccgtcgccggcctcacggtgaccgggatgcgcgcgaaactgagtccgcaacagatcgcggcggcgaagaacggtgacgtctccgatccggccgtgtccaacagttgcatcgcggtcaccgagcaggcccgcgcggatccgccccggcggcccacgcacgtggtggtatggggtaacactctcaccgactgcaccctggccgggatctccgtgcagtacgccgaccatgtgacagcggcgtacaacgtgacccgccgtaacggctggtactcaccgtacggcggcagcgggatctcgttctcgaacctctggaactccgacggccggaccgatgtgaagatggtcgtacggggaaacgtgagttcggaaaatcagaacctcgtcccatgcctatgcagcggcaccacccgcaaaatcaccgacggcaacggcatcatcatcgagtcattgaccaacgaggacgtgcacggcgcaccgctgttccaagctccttacaccggccgggtcctggtggagaacaacgtttcctacaacaacggcggacgcggcatcaatgtcttcaagggtgcccacatagacatcgtgaacaacactctctaccacgacgccacccatccggccatcaccaccgatcttgcgatcaccctcgccgacgacgttcgtgtggtcaacaacatcgtggtcgcgggccggggtgtccccgccgccgaggtgtccggctcctcccgggtctcgttcgaccacaatctgcttgccggcagtcgctccaccccgccggatccgaacctgctgacgtcggctccgcattttcgggatgcggcggacggcgacttccggctgcgcgcgggcgatccggccatcgacagcggtaccgcgaaggctgctcccggcatcgacgcggaccgcatgcctcggactcgaccagtggatcgcggagcgtacgaggtgcggtag

SEQ ID NO: 5032 - DNA, 1815 bp, Actinoplanes utahensis
gtgcctcagtccttgcatgtcgcctggcccgccgccgggtcgcgccgccgccggacacttctcatcgccgtttccgccgcggtcactgtcgcggcagtcggcgtcaccgcccgtatcggagccttcgccgacgacaaaccggcgatccgcgatctgaccctgctcgacgccgtcggcaatcgaccggtgtccggccggaagccgctgagcggtgatgagaccgtggacctggcggcgttgggcacccgcgagctgagtgttcaagcgaatcccgtggggaaggtcggcagtattcggttccaggtcgacggccggaccaccagggtcgagaatcaccagccatacctgctcagcggggacgccgagaacggtaaggacgtcctcccgtggacgcccgccgccggcaagcacaccgtggtggtcactccgtacagccgcgccgacggcaaggggaccaccggggtcccgatccggatcaccctcaccgtgatcgactccgcgggcaccggagcgccggcgcgatcggccgggcgcaccgccggagcgggaatcggtggacctacgtgggcggccggcactctcgcacctacccagggcggccgtcatctgtacgtcagcgccaccggcgacgacaagcagtcgggtctcaccgccgccaccgccctgcgcactctgcagcgagcagccgacatgacccggccgggcgacaccgtggtgatcggcaacggaacctactccgcccccggaagacagttcgttctcggcatcaggcactccggcacgccggacaaatggatcacgtacgcgagtgcgccgggagccgatccgcggatcgaggccgccggctggcaaggcgtcgccgtgaacgcccggtacatcatcgtcaccgggctcaccgtgcacggtgccacggaccggctgaccgcaaaacagaaagacgcggcccgcaacggcgacgagaaagacccgatgatcaacaccagctgcatcgccgtgtccgagccgttcggcggcggcgagtcgacgtacccacaccacgtgcgcatccacggcaacaccgtctacggctgcccgctcgtcggcatcagtgccatgcactccgactacgtccaggtgacgaataatctgagcttcggcaacagcaactggtcgccgttcggcggcagcggcatctccctcttcgaggcctggaacagcgacggcaccaccggcgccaagctcgtcgtccacggcaacgtggtgcgggacaatgcctcgttcgtgaagtgtggctgcagcggcttcaagaccatcacagacggcggcggcatcatcgtcgactcgttcgacaaccgggacgccaggatcaaaactccgtaccaaggccgcaccttggtggagaacaacctgtcctatgacaatggcgcccgtgggatcaacgtcttccgcagcgcccacgtcgacgtcgtcaacaacaccgtctaccacaacggcgcacagccgtcgatccaggacaacatgagcgttatccgggccaccgacgtacgtgtcaccaacaacatcctggtcagccggggcgctgtcaccgcggccacccgatcggcggtcaccgacgtgactttcgactccaacctcatcgtcggcacaagcaccgtcagcgacccgcaccggcgcaccggcgaccctcagttcgtcgacccggccaacggcgacttccgactcgagagcgccagccccgccatcaactccgcggtgggcttccccgtcgcgccggtggacgccaccggagcggcgcgcaccggcaaacgggatctgggagctttggagacccattga

SEQ ID NO: 5033 - DNA, 486 bp, Actinoplanes utahensis
ttgccggggccgggtggacgtgcgacggttcgctgccgttcgcgcccaccggccgggcggcgggtccgtaccccctcacgacagggcatgacaccacagatgagcatttccacgatcgacaccgaggatgccgaccgctgccggcgcgcgctcgccgaggagcaggccgccagcctcgccgcgaccgccaactgggcgcacgtcgacaaggaccgggtccatcgcgactggcacgacctgtacggcgagatcgccgccgccatcaccgcaggcgcccagccgcgggacgaggcggtccaggaactgatcgcccggcaccacgccgtcgtcagccggttctacacccccagcatggacgcctacctcgggatggcactgctctacgccgaggatgaggacatgcgcacctggcacacctcctaccacccccggatggtcgagttcctcggcgcggcgatccggcactacaccgacacgcgccgctga

SEQ ID NO: 5034 - DNA, 561 bp, Actinoplanes utahensis
gtgttcgcggacagccgccgggcgagtcccacgcgcaggatttccgggaccgcgctgcagaaacgacgaagccgcctgatcacggctgccggggttgctgacgctgtcatgaccagagccaccgggccgggagagaggcgggggactgtgctggatcggttgtccgtgcgccgcaccgtggtggtgtacgggccgcgcgccgcggaccacgtgtgggacagctacgtacggccgcagcgctggccggagtggtcgccgcagatccggtcggtggattaccccgccgagacactccgcccgcacaccggcggcgtcgtgcacgggccggtcgggctccgggccggattccggatcaccggcgtcgacccggccggtccggtgcgcagctggacgtggtcggtgtcgatgctcggcgtccggctcgttctgcggcacaccgtcgagccggtcgccggcggcacccggaccgggctcaccgtggacggacccgctccgctggtgatcggttacctgccggtcgcccggtcggcgctgcgtcgcctggtcagccgggaccggtga

SEQ ID NO: 5035 - DNA, 468 bp, Actinoplanes utahensis
atggcgcaacggcgatacaactgcgggtgcggcaagaagcggtaccgcgacgagccggccgcgctggccgccgcggccgccgacgagcgggcccatcaggtcccggccaccacctaccggtgccccggcggactcgcctggcatgtgaccgcgcacggtttcctgccggaggcgttgcggtcggtggggcggcggctggcgtacgaactggccgagcacggccgggtcgacctggacgacttcggcacgcgggtgcttcggctggacacgcgcccggaccagcggcagcgcgaccgggtccggcagtgcgcggaacagatggccgggctcggcctggcccggccggacgacggcaggccggcgccgggcagtcacctggtggccgtgaacctgcccgggttgcgccgggtcgttcaggtcggactcgacgcgtaccggcaggagcggaccccgcccgggcaaccctga

SEQ ID NO: 5036 - DNA, 735 bp, Actinoplanes utahensis
atgattctcgatgtgaaggctgtcgtgcgcgctcatccggtcctctccgccgtggtggtgacggtgctgtggcacgcggcgctctacgccgcggtgcaagtgctgccccgcaccgtgccggagccgtcggccgacctcgtcgcgaccgtcgcgaacctcgtcgcggccggggtgcccctggccgcggtggcgctgctgcgctggtggcggcaggccggcctcggccggccggtgacccgtcgcctccggctgacggtgccggtcctgctggtgaacctgacctatgccgctcccggactcaccggcggtgcggcgcggtacgccgccaccgcgtcgctgtgcctggccgtcggggtcagcgaggagatgctcagccgcggggtggtgcagcgcatgctgtggccgctcggccggacccgcgccacggtgggcgtcgctgtgctgttcggcctcggccacgcgctgagcgcggtgtggttcagccggccctgggatgactcggtcgtccaggtggtgaccaccacggcattcggcttcgcctatgccgcgctgcgctggcacctgggttcgatctggccgttggtggtgctgcacgccatggacgacttcttccagttgcgcagcccgggggcggcgcccctgtggtggcaggccgccgtggtcctggtcttcgtcggctacggcggttggttgctgaggcagcccggaagcgccacgccgccggcggcgagctga

SEQ ID NO: 5037 - DNA, 1194 bp, Actinoplanes utahensis
gtgagatcacatcaggggaagcggcgtctgcttttgctcgcatcggtcgtcgcgctgaccgcgagtctgctcgccggcacgcccggcgccgccgcaccggccggtcactccgcccaggccactctggacagcgtgctggccgctcaatatgccaagtcgccactggtgccgggaatcggcgcccgggtcgacgcgccgggcctgcactggacggcggcggtcggccacgacgatcgggcggccggcaccccgctgcgcaccgacgtcaccttccggatcgcctcggtcaccaagaccttcaccgcggcggccgtcctcgctctggccgaccggcaccggctggacctcgacgcacccgtcgccaggtatctgccccgcccgtatccgcagctgctgcgccgcgggggctaccgcccggacctgatcacggtgcggcacctgctcgcccacaccagcggcctctacgactacggcgaggacgccggctaccaggaggccgtgctgagcgacctgcaccgccactggaccccggccgagcagatccgatgggcgatggaccacggcgcaccgtacggccgcccgggcgagcgttaccactacgcggacaccggctacgttctcctggcccgcatcatcgagtccgtcaccggcatggctcaggccaccgcgtaccgccacctgctgcccttctcccggctcggcctgacggcgacctggttcgagacgctggagccggcccccggccacgctgcggaccggcgcgagcaccagtactacatcgaccccacctccggcaccgccctggacgcctactccgccgacccgtccttcgacctgtacggcggtggcgggctggtctccagcctggcggatctcgaccgtttctaccgcgggctgctggagggccgggtcatcagccggtcctcgctggccaccatgctggccgtcacgccgggcgctgagggtgaccgggcgggcatgggcatcttctcccgcaccctcgacggcgtcacctgctggtggcacaacgggttctggggcgccgccgcactgtactgcccgcgataccggctggccgtgtccgtcaccaccggcgccttcgtcgccgatcccgagcacgcgacacccggcgccatcaccgacgcggccgccctcgcggacgcggcgatcggcctgctgcgggccaagggctga

SEQ ID NO: 5038 - DNA, 663 bp, Actinoplanes utahensis
gtgacgatccgggtcctcgtcgccgacgaccagcatctgatgcgggcgggactgcgcgggatcgtcgacgccgccgccggtctgaccgtcgtggcggaggcggcgaacggactgcaggccgtgaccctggcccggcgccactgcccggacgtcgtgctgatggacatccggatgccggagctggacgggatcgaggccacgcgcgtcatcaccggggacacccccgcgcgggtgctggtgctgaccaccttcgacctcgacgagtacgtgtacgccgcgctccgggcgggtgccagcggcttccttctcaaggacaccgcgccggctgacctgcacacggccatccgcgtggtcgcggcgggcgacgcgctgctcgctcccggtgtcacccgccgcctcatcgccgagttcgcggcccggcccggcccggtggcgccgggcgccggggtcccgcccgggtgggctgcggtcaccggccgggaacgacaggtgctggcgctggtcgctgagggcttgtccaacgccgagatcggggcccgcctgcacatcacggcgggcaccgcgaagacacacgtcggaagcctgctgaccaaactggacgcccgtgaccgcgtccagctggtcgtcctggcctatcgcggcggcctggtgccgctgcggtga

SEQ ID NO: 5039 - DNA, 1134 bp, Actinoplanes utahensis
gtggtgatcgactgcggcctcgccgcctgctacggcctgatcatcggggccgtggcgactcacccggcccgttccggcgtcgcgtcgctcggcgccggctcgctcggcgtggtggcgatcgtcctcggccggcgtcttcccttggtggcgctggggcttctggcaaccgggtgctggctcagctcggccttccggccggccgccggcaccctggccatgctcgccgccgttccgatgctgttcctgctcttcagctccgcgctccggggcgggcgcgtggtcgtcgccgggagtctgctgctggcgctggccggcgccgcgggcaccgcgcagccgcggccgggcctgcgcggcggggttctggtgtacgcgctgctcttctgcacggcgtgggccgtcgggctcgcggtgggccggcagcggcgctacgacagggaactggtgcgctaccacgccctgctcggtgaggtcgaggcggaccgggcccggcgtgcggccgcccgggagcggatgcggatcgcgcgggagctgcacgacgtggtggcccacagcatgagcgtgatcacggtgcaggcggctctcggcgagctcgtcatcgccgagcggcccgccgaggccggcgccgcgctcggcgtcatccagcgcaccggacgtgaggcgctcgccgatctgcgccggctgctcaaggtgctgcgcagcgacgagacggacgacggcgcggtggctgtgtcgccgatgccggggctcgcggatctggacgggctcgtggcccggaccgcgcaggcaggtgtccgggtcgaggtgcgcgtcgagggcccgatacggacgctggcgcccggcgtggacctctcggcgtaccggatcattcaggaggcgctgacgaacgtggtccggcacgccggcaccgacgtggcgcgggtcgtcgtccggtacggccgggacgacgtggccgtcgaggtgatcgacgagggcgtcggcgcggccgcggcgggcaacccggccggcgggttggggctggccggcatgcgggaacgggcggcggtgtacggcggcgagtgcagcgctcagccgctgcccggccggggcttccgagtcgtggcccggctgccgctgtccgccgggggcggcgcgtga

SEQ ID NO: 5040 - DNA, 1569 bp, Actinoplanes utahensis
atgcagcgaagcacgacactcggccggcagagaccgcgtccgccgtggggcctgatcgtgatagccggctgctacctggtgctcgccggcgcattcctggcgacccggggcagcgccgccttcttcgcgaccgtgattccggtgggcttcctgtccggcaacatcatcgctctgggtttcggtgtccgcgccgcccgtcaccgggggttgccgggccggtcgcgacgggcatgggcgctgatcgcggtgagctcggccgccctcatcctgtcgatcgtcggctacgccgcgacgggccaggccgggaacacggccgtcgtgccgtcgctcggtgatctggcgcacgcgctcttccccccggcgatgctggccggtctgctcaccttccccaccaccggccgcagccgccgggaggcgacgaagaacctgctggacgtgctgaccgtggtgggctgcgggttcatgatcctctggttcctggtcatcgggcccacggtcgccgccggtggcctgtccgccctgcagttggccaccgcgatgggctacccgctcggcgatctggcgttgctgctgggtgccgtcatcgtgctggtgcggggcaccacagccgaccgcaagccggtgttgttcctgatcaccgcgctgtccttcctgatcgtcggcgacgcctatctcggttacatcaagagccacccgcacgccggcggcaccccgacgtggcagctgggctgctggctgaccgcctggtacctgatggccttcgccgccgccctgcagtgccaccaggcgagccggcagcatctcgccgagcgccaggaggagccgctgcggcgggtgagctccctgccgtacctcgcgaccggggtggcgtacctggtgctgttctgggcggcctggctggccggtctctacccgtgggccggtctggtggccggagccgccctggtcaccggggcggtcgccgcccggcagctggtggcgctccgggagaaccaccagctggtcgtgacggacaatctcaccggcctggcgaaccgcagacagctgcatgccagcctggcgcgcgctctggagcgcagccgccgcctggacaccccgatcggtgtgctgcaaatcgacatgaacggcttcaagcagatcaatgacacgctcggccacgaggccggcgacgccatgctggtcgcgttcgccaaggtcttgaaggacagcgttctcgggtcggacaccgtggcccggctcggcggcgacgagttcgcggtggtgatgaacaactgtggcggcagtgccggcgcggtcacggtggcccagcggatcatcgatgcgatggccgagccggtcatgatcgccggccagccgcgccggccgggggccagcatcggggtcgccgtcatggaagcgacggcgctgccggacagcaacgccgaagcgatccggaagctgctgtacgacgcggacctcgcgatgtacgccgcgaaactgcagaagccggcgaacgcctggtccctgcacgtcccggaccccgagccgaacctgacggccttcgcggaccagggcagcgacctgaggtga

SEQ ID NO: 5041 - DNA, 237 bp, Actinoplanes utahensis
atgatcagtgaggaatcggcgcaggggctggttcgcagtggcaggtgtgacggtcagcgttccgctcacggtgatgtcgatcgggtcgtcgccgtgcgggtgtcggtgcagctgccatcgggcctgctggaccgccgcggcatcggtcaccacctcgaccgggtcagccgcgccggacgtcgccttgaacccgttcatcatccgggttcacgacgcacacgacgcggctcgccgtaa

SEQ ID NO: 5042 - DNA, 405 bp, Actinoplanes utahensis
atgaggattgcctggggattggctctcatcggagccaccgccgctgcagctgttgctgccgctggtccggtgttcgcggcgacgccgtcgtcgaagcccgcccgtaccctgtccagcatgcaggcggcggtggacaccaaggcccagcacatcgccgccaagatgcagacggtgcaggcaaaagtcgcgagcaagccgcactttgcggcttcgaagacgatcctgctggctgacatcaccaagacggtgtccgacaccgcggcctggcgtaagcaggtcgactcggcgaccacgaaggccggcgtcatcgccgccaaccccgctcaccaggcggtgaaggaggacctggccaagctgcgcgctgatctggccgcggccaagacagcgaagccggcacaggagtaa

SEQ ID NO: 5043 - DNA, 2286 bp, Actinoplanes utahensis
atggggagtctgcgtcgacgaccgtggtggcattcggccgtcacgtccggaatcgcggcagccggtgtgctgtggttcctctggtggtcgtcgaccgggatcggctcgatggcggtggcgtatctgttcatgccggccggcctgctctcggcggtgctggccatccgggcgatggtgcgcgccgtcgcgccggcgccggccggtcgacggttctggcttcagttgtccgcaggctgcctgctgctggcagtcgggtacggggtgttggcggtcgcggcgttccgcagccgcccggcctttccgccgatgccggccgttgcgaccgtcggggtctgcggtggcgtgctcgtcgcgatctacgccgttgcccgggtcccgctgggtgtcaccagcgggtacgaacggggacggcagtggctggaccggaccattgcgtttctcgggtgcacggcggtgctgtttcacttcggcctcgtgccgctggtctactccccgcgccccagggatctgcccctgaccgcgatgatgatgctggcgttcctgctggcggcggccagcatcaccaaggtctcccacatcaacggcggccctgtcgaccgggtcgccatccggctgctcgccgggacgggcctggtcgccgccgtggtggccatcctcgtggtcgaccgcggcacggactggccgctgctggctcaggcgctggtcctgccgttcgtgccggtgctgatcacgctggcggcccaccggcagcaggtctccacggcggcgccgccacggcggtcgaatacctggctgccgtacctggcggtcgccgcggttcaggtgacgatgaccgatgtgctgctgcgccggaccggcgaccggggccaggtggtggccgtcatggcgaccctcgtcatcgggctggtcatggcccggcagtacctggtcatgcgagaaaacgtccgattgctgggtgaacggaaggagtccgagcggcggctgctctacgaggcgacccacgacccgctgaccgggctggcgaaccgggcgctgttccgctcgtggctggacacggctctgccatccggtgacaccaccgtgctgctggccgatctcgacgacttcaagaccgtcaacgactccctcggccacgatgtcggtgacgagttgctggcggcgttcgccctgaccttgcagaccacggtgggtgacgacgggcgggcagtgcgtctcggcggtgatgaattcgcggttttgatcaatgggcccgctgcggtcggcgactcggtggcccggcggctcatgaccgcgttcgacgcgccgatcagcgcgcaccggctgttggttcacgccagcatcggcatcgccggggcgaagcccgggacgacggcgagcggtctgctgcgtgacgccgacatcgcgctgcacaccgccaaacaacgcggcaagggcaactggatccgctacaccgccgacctgcagcagccggtgttcgccgacgcgcagctgggagccgacctgcgccgggccctggacgccgacgaattccggctgctctaccaacccgtcgtcgatcttgccgaccgccggatgatcggggtcgaagcgctcgtacgctggcatcacccgcagcgtggcctggtgccgccactggacttcatcacgaccgccgaacgcaccgggttgatcgtgccgctgggccgctgggtcctgcgggagacctgccggcaggccgccgcctggctggccgagttcgggcccgatgccctgcagaaggtcgaacccaatgtctcggtacgtcaactgcacgaccccgatttcgtcgatgacgtccgggccgcgctggccgacagcggactgcccgccgagaagctggtcctggaactgaccgaatcgtcggtcctgcgcgggcctcgggtgtcgcgggtgctccacgaggtcaacgagctcggggtgcggttggcgctggacgacttcggcacgggtgagtcgtcgctgagtctgctgcggtcctttcccgtcgcgatggtcaagctcgacaagtcgttcgtcgacggcatcgaactggacgagccgggtaccgcgcgggccgacgcccggcaggcggtggcccgcgcggtcatgcagctggcggatgccctggggctggaggcggtcgccgagggcatcgagaacgaagcgcaggcggtgcggttgcagaggctcggctacaccgccgggcagggataccacctgggccggccgatggaggccgcacagatcacgggcctgctggttctgcagcggcaggacgcggctgcctga

SEQ ID NO: 5044 - DNA, 528 bp, Actinoplanes utahensis
atgcggacactggccgaccaccccttgactgctggcccggagctgacgccaccggcggagccggcacaggtcaccgtgacggtgatgctgccggatctcgatcacctccccgcctgggcgaccgtcttgcaggactggctgcgacagagctccggcgaccaggccgatgaaccacgtgacgccgccggcaccgaccagccgcagaccgcatcggcaccggcttcggtacccgaactggtggtgaacccgaccgctcgcaccgcccatgtggtcggccgcgcgctgcggctgacccggcaggagttcgacctgctgctgtttctcaccacccacagcggacgggtgttcacccgcctgcagctgatgcaacaagcgtggaaaggacccgctgaccgcaacgaacgctgtgtcgacgtctacgttcggcggctgcgggtccaccttgccggccggggcccgaagatcaccaccgtgtacggcgtcggctaccgcctcgacgacagccaccacgccaccgttaccacgtaa

SEQ ID NO: 5045 - DNA, 1044 bp, Actinoplanes utahensis
atggactcgccccgttcggtccacccggacgacctgcgtgagctcggctggtcaccggccgacgacctgcggttcgccgacactccggatggccggcgcccgggccgggtggtgatcatgcacggccgggcgctggaactggcctggttccccggcgacggcccggccgtgcacgacacgttcgagctcggccgggacctgaacctgcggccggtcgccggcgactgggtggccgtccaggacgggcgggtggtcgaggtcggcccgcggcgcaccgcgctgcaacggccggacccgaacggcaaggacacccaggtcctcgcggccaacatcgacaccatcatgatcgtgcagccgatcgaccggccgctgaacctggaggcgatcgagcggctgcaggtgatggcctgggacagcggcgccgcaccggtgctggtcctgacgaagtccgacggctgccccgacatcggcgcggcgctggaccaggccggccaggccgcgcccggcgtcccggtgctggtgaccagcgccctcgatcggcagggcctggaggagctgcgcagccatctgggccccggtaccaccaccaccatgctcggcgcctccggagtcggcaagacgtcgctgctcaacgcgttggagggccgcaacgagcaggtccagcaggtgggggccggtggggccggccggcacaccaccaccacgcgccggctgttccgtacctccgccggcggagtgctgctcgacgtgcccgggatccgctcgctggacctgctcaccaccgacgagggcgtcggcgagacgttcgccgacatcaccgaggcggcccggcactgccggttccgcgactgcgggcacgccggtgaccgcggctgcgccgtcgaggaggcggtccgggacggctcgctgccggagcgacggctggagagctggcgcaggatccagcgggagcaggcgtaccaggaccgacgcaacgacccggccgcgatggccgagcagcgcaaggtctggaagcagatgtgcaaggaggccaagcgccgctga

SEQ ID NO: 5046 - DNA, 741 bp, Actinoplanes utahensis
atgatcaaccactggccgctttccgacctgcgcctgcgtacgccccggctggagctgcgttggcccgacaacgacgatctgaacgcgctggccgaccgcgccaccgagggcgtccacgagcccgggttcatgccgttcttctcgcagtggaccgacggcgaaccgacggtggtcgcccggcggctgctgcagcggcagtggcacgccaacgccagctggacagccgacgactggacgctgtacctggtggtcgtgcacgacggcacggtggtcggcacccagagcctcggtgcccgcgacttcgctcacggccgcgaggccctggtcaccgcgtggctgggccgccgctatcagggtcagggcttcggcaccgaggcgcgcgccgccatgctggcgctcgcgttcgagggtctcggcgccgactacgtgctgtccgtggtccggcagaacaacctgccgtcgctggcggtcagcaagaagctcggtttcgccgccgacggcgtccagaccaacgtggtccgcggcgagcaggtgcacagcaaccggctgcggctggaccgggactcgtggcgcagcaaccaccgcttgccggtgacgatcgagggcctggctcccgcgctgccgatgttcgggctggccgacgacgagccggcggccgccggggtgctgaccgtgacgccgcgggcttcggtgctctccggcatccgatacatcgacgaagccgacacctacgatcactga

SEQ ID NO: 5047 - DNA, 1284 bp, Actinoplanes utahensis
atgctgagcgccacctggacccggctgcgggcactgcccggccgggccaagatcctgctgtggaccaacgcggtcagctcgttcggcggcggtctggtgctgccgttcctctggatctacctcagtgaggtgcgcggcctgccggtctgggtgcccgccgcgacgctggccgtgcaggccggcaccgcggtggtcggcggcctgatctggggcgcgctgctggaccggctgccgtaccggatcgtggtgccgacggtcctggtcatcgccggcctgggtaccgccgcgtacgccgtggccggcaccccggccgccgccctggccaccgcggtcggctacggcatcgggatcagcggcgtcggcacggtgctgcgctcgatgtacgccgcggtcaccgagggcacccagcgcaccctggccttctccgtcgacttcgccgtgttcaacgcgatgaccggggtcggcgtcgcggtcggcggcctggtcacggtcgcccacttcggcaccgcggtcgaccgcttcggcgccctgtacctcatcgacggcctcaccttccttctcgccgccgccgtcaccgccgccctgctgcccggcggcaggaacgagccgggaaaggccgccgggaaaccggccggcggctacctgagcgtgctgcgcgacccgcggctgctggccctgctcgccgtgatgctgctgacctcggtggtctgctacggccagttccgctccggcctgcccggctacctgaccggcaccggcgcggtgggcgccggtgggctgtcgttcgccttcaccctcaacatcgtggtggcggtggtgacccagttcgtggtcatgccggcgctgcaccgggtgcggcgcaccaccctggtcgggctcagcggcctgctcttcgccgcctgctgggtgctggtgctggccgccggcacccacaccggcaccacggcgatcgccttcgccgcggccggggtgacgtgcctgtcgatcggcgaggtgctcgtcgtcccggtgctcggcgcgctgctcaacgacgtggtcggcgaccacgtccgcggccgggcgaacgccctgttctccacgatgctgtcgaccggcagcgtgctcggcccggccctggccgccctgctgctgccaccgcaccgcggcctgcccctgatgggcctgctcatcgccgtcagcctgctcaccagcgccctggtctgggtgctgcgcggccggatctccgacgacgtcgacttcgaacgctccccctccaccccgaccgaagaaatggaactcgcatga

SEQ ID NO: 5048 - DNA, 1035 bp, Actinoplanes utahensis
gtgagcgccccggtccggtcggccgccgcgccgatccggttgcacctgagcgagaacccgatcgggcccagcccgctggcccggtcggcggcccatgccgccctggacgacctgcacatctaccccgacccggcccgcgtcgagctcaccagcgcgctcgccgagcacgcgaaggtcgaccccgcgcaggtcgcggtcgccaacggcagcgacgagctggtgctgctgtccacgctcaccatcggtgaccgcgaccggcccggcctggtgaccgcggcgacgttccccggctaccggatctgcctggacacggtcgggcgcgggcaccgggagctcgccctgcgcgacgggcggctcgacgtggcggcgttcgcggccgggctcgccggcgccggggtcggctacgtgtgcaacccgcacaatccgagcggcaccgcgctgaccggcgccgagtgggaggtgctggtcgaggcggcggcacggaccggaacgccgctgatcgtggacgaggcgtaccaggagttcgccccggccggaacgccgtgtgtgcgggactatctcgaccgtggggcgccgctgctgtcgctgcggacgttctccaaggcgtacgcgctggccggggtgcggatcgggtacgccgtcggcaccgccgagctgatcggccggttgcgctcggcgcagggcacgatgccgttctcggtgaaccgggtgggccaggccgccgccatcgcggcgctgaccgatcagaagcatcttcacgacgtacgggaaacgatcgccgaccgccgcgagtggttcgtcgaacggctgcgtgacaccgggcgcaccgcgctgccctcggtgaccaacttcgtcgccgtggcagtccgccgcgacagtgccgagctggaacgcgagctcgagcagcggtacgggatcctggtccgcgacgccggccggttcggtctcaccggatacctacgggtgtcgctcggcgccgagaccgagctcgtcgcgctgctgaccgcgctggacaccctggatccggcatgctga

SEQ ID NO: 5049 - DNA, 372 bp, Actinoplanes utahensis
atgacaaccgcccagatccgtacggacctcccgctgttcaaagccgtcgccggccaccaccagcccgcgccgttctacctcacctccgacatgttcggcggcctgccggtgcagctggccggtggggagctcagcgacaaggtcggcaagccggtcgccgacccgcacacccacccggtgccggagatctacctgctggtgtcgccgaacccgggcggggcgcggatctccgtgctgctcgacggcgacgagcatgagctgagctcgccggcgacgctgtacatcccggccggcgccgagcaccggttcgtgaccctggcggccgaaccgggcagctactgcttcggcgtcctgctgggtgaggacgcgtga

SEQ ID NO: 5050 - DNA, 1041 bp, Actinoplanes utahensis
atgaccctgtcccccgcccgctccctgcccaccgactggcacggcaccgccaccgtcccgatcgacgccgaccaggtcttcaacgggtacgtggccgcgaacgtggtcttcgccctggaccggctcggcgtgtgggcgcggctcgtcgagggtccgctgcgggtgaccgcgttcgccggcgacctgcacgtggacgagcggatgttccgggagctgctgcgcgccgccgccacgttcggctacctgaccggtgacgccgataccgtgcgcctcaccccggccggtgtcgagatggccgcgatgcgtggctacttcacctgggcggtcggcggctacaacgaggtgttcgccggcgccgccgggatcaccgccggtgaccgccggttcggcgtggacatccaccgtgacgaggcgatggtggccaccgggtcggcgcagaacgacggctcgttcatggcccggatcctcgacgacgtgctcggcgagctgaacttcgacgtcctcgccgacctgggcagcggagtctcggcccgggtctgccgggtgctcggcgaccgggccggcgcccgggggctgggcctggacatcagcggccccgccacccagctggcccagcagaccatcgggcaggccgggctgaccggccgggtcgaggcgatccagtgcaacgtgctcgacgtcgtgctgcgccaggaacaccgggccgccctggccgaggtggacaccgtgatgagcttcttcctgatgcacgacctgctcgccgacccggccagccggtcccaggtgctgccgcggatgcgcgaggcgttccccgcggcgacgacgttcgtgctggccgacacgatgctgcggcccgcccaggacgagtcgtcgctgccgatcttctcgaccgggtacgaactggcgcacgcgctgatgggtgtcccgctgcacacccgcgacgagtacgagacgttgttcgccgccgccgggctgcggccgcgccgggtcgaggcgttcggcaccccgcactcgtggctctacgtgctggacgccgagtga

SEQ ID NO: 5051 - DNA, 1548 bp, Actinoplanes utahensis
atgagcatcaggttcctgccgctctccgcgcgcagcgcggccaccctgacccggctgcgggaacggatcgcggaccacctggtcgcgcacccacgggtggcactcgacgacgtggccgccaccctgtcccgtggacgcgaaccgttccggtaccggtgcgtggtggtcgccggcgaccgggacggcacggtcgcggccctgcgcggcgagcgcccgacgatccgcggcgccgcaccggccggccgggcaccccggttggtgttccgcttcggcgacggtgcgcgggacgggttcgggcgggacgcctacgaccggctcgccacggtgcggcgggtcatcgacgacctggatgccgccctgaccgaacggttcggcgccccggtccggctgctcgacgcggcggccggcggcaccccggccgcccccggcgatcgggccgccgccgtgacggtcgccgtggggtacgccatcgccgagcagctgcgggagtggggcgtcaccgccgacacctgcaccggcgccggggtcggcgcccgcaccgccgcggtgctggccggtgagctcgacatcaccaccgcggtggcccaggcctgggccggcgagccgcactcgccggctcccgggacggccgagccctccccgtcgggcccggacactcagccggccgcccccgacgtgctgtcggtggagatcggcccgcggcccggcttgtcaccggccggggacatcgtcgtcgccgtcctgcccggcgaggacgaggtggccgcgctcgccgccgcggcggccgaagtgtggtgcctgggcgccgacgtggtgctgtccgctcccggcgaccgggtgcacctgcccggctacccgttcgagcgggccgccgacgccgacccgcggccggcggccgcacaggccgtcaccaacgcctggcgcgaggtgttcggcacgtcgacgcccgggaccgagctcggccccctggtcaccctgcgccgggccatcgcggcacgatggggctacgcgccgacgctgccccagctcgcggcggcaccggatgaccggcaggtgctggccgacctgaccgagatcgcgaccgccgagtccgggtccacccggcgggaacgaccgctgaccgcccgcgagcagcgcctcgtcttccacgacgcggtacgcgccggcagcagcagcgccgaacacaccgtgcagctcagcatcccgctggagcgggaacccgacccggacgccctggacgccgcgctgcgcgacgcccagttggcccgcccgctgctacgcaccgtcttccgccgccgtgacgaccgctgggtcgccgcggagatgccccacccgctggtcacgttgacccgatccgcacccggggccgaggccgccgaccacgccttccagccggtcgacgcgcccctgctgcacgtagccctgcgcccgtacgacgatcgcaccgatctcgtcgtggcgctgcaccaggcactcgccgaccacctggacatccaccagctggccgccgaactgctcgacaccgcaaccacaaggagcccgtcatga

SEQ ID NO: 5052 - DNA, 4386 bp, Actinoplanes utahensis
gtgctgaccgggcgcccggccaccgccgagcagtcccacctgtggctggcggtgcagcgtgaacccgagtccggccggttcaacgtcccgatcgacctgctgatcaacgggccgctcgacgccgacgcgctgcacggcgcgctggccgacctgctcgcccgccacccgcagctgcgcagcgcgttccgcgccgacgacggcgagctgcgccagtacttccccgacgcggtcacggtggcgctgcgcgaggagcaccgccccggcccgtaccggccggaaccggccctggcctgggcagccgaggccggtgcgcggccgttcgacctcaccgaggcgccgctgctgcgggccgacctgctgcgggccgacgacgccgcgttactggtgctgaccgcacaccacctggtgaccgacggctggtcgtgcggggtgctggccgaggatttcgtacggttctaccaggcccgtaccggcggcgccggtgccgtgtccccgatgccggaacccacggtcccggccgcctcggaggccgacgcccgctactggcagcagctgctcgacgacgagtgcgggccgctcgccccgatccccgacctggtccgcaccggcgacgggcccggcccggccgcccaccgcacctggaccctcgacgcgagcggccgcgccggcctggccgggctcgccgagcgcgggcaggtctcggccgcggtcgcggcgctcggcgtgtggacgctgctgctgcacgcctggagcggtgaacccgacggcgtgctgggcatgccgttcgccggccggctggacccggcgacacacgccgagatcggcctgttcacccgggtcctgccggtgcgcagccggttcgaagcgcagcgcccgttccgcgcggtgctgaccgacctgagcgggcaggtgctcgactcgctgttcgcctccgaggtggacaccgaggcgctgcgcgcggccgtcggcgccccggagctgcggaccgttttcgcttatcagggccgtggccagcggcactggacggtcggcggaactgagctgcgcatcgtcgagcacgagctggaatccgccaagtacgacctggccctggccgtcgcggaggggtccgacgagaccgtgctgcgcctcgactacgacgcggccgtctacaccgccgccagcatcggtgaactcggcgaccagctgtgcgcgctgctcggcgcggccgccgccgaccccgaccgaagctgcctggacctgctcacggtgctggccgaacggcgcccgcacgagcatcagcacggcgccgaactgtccgatgcggacgcgtcggtgctggtgccgcaccgggtgctggagcacgcggcacgccgccccggtgcgatcgccgtccagcacggcgccacgtcgctgagctacggcgacctggtggcccgagccggcgctctcgcgcactggctgaccgggcaggcggtccggcccggcgacatcgtcgcgctgctgctgccggccggcgtcgacacggtcgtggccatgctggcctgctcgctggccggtgccgcgtacctgccgctcgacccggcctacccggacgcccagctggagctggtggtcgccgacgcggcgccggtgctgctgctggccgaccccgcgcagcgagaccgctgccacggtctccccaccacggtgtacgacctgagcgacgtcctggccgccgccgccggcctgccggcacacccgccgcaggtgccgatcgacggcgccaccacgctcaatgtgctctacacctccggctccaccggccgccccaagggcgtggtgctgccgcacgcgggtgtcgcgcggctggtcggccggcccgagttcctgccgctcggcgccgacgacgtcctcagtcacctgtcgccgctgaacttcgacggcgccacgtacgagatctggggtgccctggcgcacggcgcccgcctggtcgtgctggacaaggagctggtcctcgacccgcgtgcgttgcgcaccgcgctgcgcgagcacggtgtcaccaccctgctggtcaccactcccctgctcaaccggatcatcgaggacgcaccggacctgctgcagtcgctgcgccgggtctacttcggcggagagctgatctccgtgccgcacatccggcgggcgctgcgctggtgcgggccgggcacactgctgcacagctacgggccgaccgagaactcgttcacctcgacctggcacccgatcgccgcggtggccgagggcgcccgcagcgtcccgatcggccggccggtgccgggcaccagcgcgtacgtggtgttcgagggcactctgcggccgaccccgcccggggttcccggcgagttggtgctcggcgggaccggtgtggcggacggctacctcggcgacccggcacgctccgcggagaagttcgtcgccgacccgttcgacccgcggccggacgccaggctgtaccgcaccggcgaccgggtccgctgggacgccaccggtgagctggagttcatcgggcgcaccgacaaccaggtcaagatccgcagccagcggatcgagctcggcgaggtggaggccgcgctgctcgcccacgacgcggtcgagtcggcgttcgtgacctgccgggtcggcccccgcggcgacaaggagatcgtcgggtacgcggtgctgaccgacccggacgagctggcggggctgcgccagcacctgcgggcgcggctgcccgggttcgccgtaccacggcatctggtgccgatcgagcggctgccgctgaaaccgaacggcaagatcgatcgggcccggctcccggcgccgtccgacggacccgcgccggcgcccgcgcccgcgcgcaccggacgccggctcaccggtggtgtgacggctccggtccgggcggcgtgggccgaggtgctcggcaccgacgggttccgcgacgacgacaacttcttcgacgtcggcggtcactcgctgcttgtcgtacagctcgccgccgcgctgcaccggcacaccgcggccaggccgaccatcgccgacctgttccgggccaccacggtgaccgcgcagacccggctgctgatcggcgacgccccggccacgacggccgccgcggtcgccgtgaccgaccccggtgacgacatcgccgtggtcggcatggcctgccggttcgccggcacccccgacctcgacgcgttctggcggaacctggtggccggccgcgactgcctgcccaacgccgccgacccggtcgcccacgagtacgccgacggccgccgccgggtagcccgctggggcatgctcgccgacggtctgggcttcgacgccgggctgttcggcttcgaccccgagcaggccgccacgatggacccgcagcacggcatcctctacgagtgcctgtggggcgcggtcgagaacgccgcgctgcgcatggccgacatccaccagcgcaccagcctgtacgccggacgtgcgaccggccccggcccccgcgccctgccggaccgcgacgagtcgacccgggccgacgaggtggtcggcagcgacgccacgttcatgccgagccggttctcctactggttcgatctgttcggcgagagcctgctgctggacaccgcgtgctccacctcgttggtggccgtgcacctggcctgcgagagcctgcgccgcggcgccagcgactacgccctcgccggcggcgtctcggtcagtcacccggcggacggcagctacacctacgtgcccggccacctgtacgcccgggacggcttctgccgcccgttcgaccagctggccagcggcacggtcggcgcggacggggccggagcggtgctgctgcgccggctcggcgacgcgatccgcgacggcgacccgatccacgcggtcatccgcggcagtgcggtgaacaacgacggccgggccaaggtcggttacaccgcgcccggggtcgacgggcaggcccgggtgatccggcaggccctgacgtccgcgggcctgagcggcgccgacatcgactacgtggagggtcacgggaccggcacgcggctcggcgacaccatcgaggtggccgcgctgaccgaggcgctcggcgcggacgggccaccggtggcggtcggctcggccaaggcgtcgatcgggcacaccaacaccgctgccggagtggccggcctgatcaagacggtgctcgcggtccgggagggtttcctgccggccaccccgcacgtcagcgaaccgatcgacgagctgcgccggcacggcgaccggttcaccgtgctgcccaccgggcgggactggccccggcacgaccggccgcggaccgccggggtcagctcgttcggtgtcggtggcaccaacgcacacgtcatcgtccagcagttcgtaccggcgggagaaaccgcatga

SEQ ID NO: 5053 - DNA, 270 bp, Actinoplanes utahensis
atgaccacacctgccatctccgacacggacctggccgccacgatccgccgggagtgggccaccaccctcgggcacgacgacgtcaccggtgacccgaacttcttcgccgccggagggcactccctgctcgccatcgcgatgatgggccggctgcggaccaccctcggcgccccgctcccgctgcggctgctcttcgacaaccagagcgtcacggagctgaccagcgcggtgcgcgccctcgtgcccagcggcagcgggacaccgtgctga

SEQ ID NO: 5054 - DNA, 1761 bp, Actinoplanes utahensis
gtgggtgaaccggatctgatccacgaacggttccggcgggtggtcgccggcgacccggccgcgatcgccctccacgacggcggcaccgcgctgacgtacgcccaggtcgacgcgcacagtgaccgggcggcggcggccctgctcgcggccggggtccgggccggtgaccgggtcggtgtctgcctggaccgcggcgtcgacctaccggtggcgctgctcgcggtactcaaggccggcgccgcctacgtgccgctcgaccccgaccatccggccggccggctcgcctacgtgatcgaggacgccgggctgacccacgtgatcgcggacgagtacggcgccgcccggctgcccgccgtcggcacggtgctcgcctggtccgctctgacggcggtggacggtaccgtcggcaccggaccggccggcaccgcgtacgtcatctacacctccggctccaccgggcgtcccaagggcgtcgtggtgccgcaccacaacgtcgtcgcgctgatcgacgcggtccgcgaggacttcgccctgcacgccggcgacacctggacctggttccactccgccgcgttcgacttctcggtctgggagatcttcgggtgcctgctgaccggcggccgcctcgtggtcgtgccccgctggacccgccgcacgcccgaggacttccggcggctgctcgccgagcaggcggtgaccgtgctcagccagacgccgtccgcgttcgccgggctgctggagctggagcgccacgacgccgcaccgctgccgctgcgtctggtgatcttcggcggggaaccgctggacacccgcgcgctgcgcccgtggctggaccggtacccaccgcagcggtgccggctggtcaacatgttcggcatcaccgagaccaccgtgcacgtgaccgcggagaccatcggccacgagcaggtacggaccggctcgcgcagtgtcggcaggccgatcgccggctgggcggtccggatcgtcggcccggccggtcagccgctgccgcgcggtgagatcggtgagatcgcggtggccggcgcgggcctcgccaccggatacctgggccggccggagctgaccgcacagcgtttcgtgaccgatccggacacgggccgacgctggtacctcagcggggaccggggccggctgctgtccgacgggcggctcgaacacctcggccgcaccgacgctcaggtgcagctgcgcgggcaccggatcgaaccggacgagatccgggctgtgctgctggaggacccggtcgtggtcgccgccgccgtggtgccgcggaccgggccgggcggggacgcccgtctcgacgcgtacctggtgctgaccgccggcaccggcccggagcagctcgccgcgatccggcggcgggcggcccggatgctgcccgactacatggtgccggccacggtcaccgccgtgccggcgctgccgctgacagccaacggcaagctcgacccgggcgcgctgccggaaccgcaccgcaccggggccaccggcgccgacgacggtcccgccgacggcctgctgtcggcctgccggtcggtgctcacccccgccctgcgcccggacgacaacttcttcgacgccggcggcaactcgctgctgctcgcccggctggccggcgcgctgcgcgccggcgacttcccgggcgtcaccgtccgggccctgtacgagaacccgaccgtacgccgtctcgccggccacctggccgccacggccccagctccgagggaaatcgcgtcatga

SEQ ID NO: 5055 - DNA, 813 bp, Actinoplanes utahensis
gtggctcgccgccgcgaccgtgaccgacctgcacacgtcgtacctgcgggtgtgcgaggtgctggcggccggcaaccgctaccgctaccgccgtccggcgaccgacctggaaatggcctcatgactcccgtacccctgctctgtttcccgcccgcgggcgccggcgccggcttctaccacgactggcgcggcgtacggcccggcctcgacgtgcacggcgtcgagctgcccggccgggagaagcggttcgccgagccgccgctcaccgcgatgaccgcgctggtcgacgacctcgtaccgggcatcctcgaccagaccgcggaccgccccgaggtggtcttcttcgggcacagcttcggcgcgtcggtggcctacgaggtggtacgcgccctcaccgcggccggccgcaccgggctgaccctgatcgtcagcggcgccgccgcaccgggcaccggcacccggcccgcgatcaccggcctgcccgacgacgagttcgtggccggggtacgccggatcgccggctaccggcacccggccctggacgacccggaactgcgcgagttgctgctgcccgcgctgcgcgccgacgtcacctgtcaggagcagtaccgacccgccccgctgccccggctcgccgtgccggtcgtggcactccgcggcgccgccgacgacctggtcacggcgaccgacgcggcccgctggtccgaggtgaccgacggccggttcatcggcgcggagctgcccggcggccacatgtacctggtcgacgccgcccccgtggtgctcgccctggtggagcggtcccgtgggtga

SEQ ID NO: 5056 - DNA, 1722 bp, Actinoplanes utahensis
gtgggcgccgggctatcccctcgacggcaccctggccgccggtggcgcgttcctgcgggcagccgcggccggcctgcaccggcccggcttcggcatgtaccagatcatcgagcgcgagtccggccaggtggtcggcgacatcggcttccacggcgccccggacaccgacggcgccgcggagatcggctacggcatcgtgccggccttccgcggccggggcctggtgtccgagtcgctgcggtcgctggcacagtgggcgttcacccagccggacgtccgggagttgcaggccggcaccgagccggaccacaccccgtcgcagcgggtgctgacccgggccggcttcacctacaccggcgtgcaggacggcgagcaccgctacctgcggacgcgaccggcgacgtcggcgtgaccaccgtcgcctacttcgcggcggccgggtcggccgggctcgccgacctgctcgacgtcgccgagggctggtgcgagctggtcgtcgtcaacaccggtaaccggccgtggggaccggccgaggtggccgccctgaccagcctggcccactacgtcgacgtccgcgacctcgaccccgacgccctggccacggccctgcgccggtacggcgtcaccggcctggtcgcgttcagcgacgacctgctgccccgggtcgcggcggtggcgcaggcgctcgatctgccgtaccacgacccggtcaccgctgaggcactgctgcgcaaggacgtacaacgccaccggctccgcgccgccggggtcgagacgatgcgctgcgccacgttcgacgacccggcgtcgctgaccgccgccgtcgcccacgtcggtttcccggcagtgctcaagccggtggtcggcaacgccagcgcgcacgtcacgccggtcgacgacctggcgtcgctgcacctggcatgccggcgcgccggggaggacctcaacctgccggccatcgccggtgacgcgttcggcttcggcgccgccggcacgtggcagctcgaggaacggctgcgcgacggcgcccacccgggcggcggctggctcggcgactacgtgtcggtcgagagcgtggcgctcggcgcaggccggtaccggcacttcgcggtcaccgaccggctgccgctgacctggccgctgcgcgagaccggcatggtctccccgacacagctgccggccgacctgctggaccgcgtcctggcgctggccggggcggcgctggccgcgctcggcgtcgagcacggcgtgacacacaccgagatcaagctgactccggacgggccgcgggtgatcgaggtcaacggccggctcggcggcttcgtcgccggcctgctcggccgggtcaacggcgaggacccggttcgtctggccctgcgcgccgctgtcggcgacaccaccgccggggaccaccgcgatcccacggggtacgccctggtcctggtcgtccagccgccaccggacgcggtgcgtctggaacaggccgccgacctggccgagctgcgcgcggtgcccggcgtctcccgcgtcgacaccggggtcatgcccggcgaggcggtcgactaccgcaccggcacgctcggccgggtgcagaccgtgtggctcgccgccgcgaccgtgaccgacctgcacacgtcgtacctgcgggtgtgcgaggtgctggcggccggcaaccgctaccgctaccgccgtccggcgaccgacctggaaatggcctcatga

SEQ ID NO: 5057 - DNA, 828 bp, Actinoplanes utahensis
gtggtgcgcacgtcgcgtgacgggcggccgggcgaggcccagcggctgctcaacccggcccagcccgatccactgctgcgctacgagtacgaccggggcagcaactacgaacaggacacccgcctgaccaccgcgctggccgcgctggtgccggaggccgagctgcaccatcccgaccaccggttcttccaggtgctgcacctggtcaccgagtacagctgggtcgccatccaccaggtgctgtgcgacctggccgcggcgctcgacgacgaccgtccggtgccggccgcccggctgctcgaccgggccaccgggctgggtgtgctgccggtgcaggcgatccggctgctcagcgactcgctgccgcagctgagcctgctcgccatgcgggccgcgttcccgcccaacaccaccgggctcgactcgccgggagcccgcaatctgcgccgggcgtcgcgggcggtgtggaccgcgttcgagggggcactggcccgcgccgggctggacctagacgcgctgtccgcggccgccgaaccccggtacaccggcgacaccgggccgttgctgctggccgacgtgatgatcgggctgcaccgcttcgacgcccggatcctggagtggaagcaggtccacctgaacatggtctggctgctgctcggcggccagccgcaggccgagaccgaccccggcgacgcggacaaacccagcagcctgcgcggcaggtccatcagcgacctcgagcggatggcagccagccccatgttcccgctcctctggcagcacagcaccaccgttttccaccggatgacccgagaggacaccccatga

SEQ ID NO: 5058 - DNA, 1269 bp, Actinoplanes utahensis
gtgacctgttccacctggctcgatcccagctctgccgacgtcgtccgccggcttcgctcgtggcggacgagccgcgtgaccggtcagcccgcggagttcccgtatgaagtcgtcacccagcacgtccagcgtaccgggaagcatcacctggccgcaccgctgatcgaagagctggaccggacccggcagttctgccgggccggcggcggggtgcggctgcgcttcctcgactgcctgctcgacaaacacgacggcacgtaccggtatgcgacctatctgtcgttgccggtgctgcgcggcctggtcgacgggccggacgcggtgctcagcgcccgtgacctggccggcctgctgatcgccgacgtgatgcgtttcgagctggaggcgctgcacgggcgccacgacctgctgccccacggccgcccgccgctgcggaccgtcaagaagcggttgcaccacggcctcggccacctggaccggcacagcgaccgggtcccggccgcccggcacctcgacccggcagcgccggagcaggccgacgagctgctggcctcgctgccggtcagcccctgcccgctggtccgggaacggttggccatgacggttcaccccgtgcacgtgctgcacgacgagtacctgttcatccgggtgctgcagagctacgagacgatcttcacgggactggtcgggtcggccgggcacgcgctgaccgggctgcgcgccgccgacgcgggcgccacctgtgcacatctcgacgacgccgccaccgcgctggagcgcgccgggctgctgttcaccctgctggccaccatggacccggacgcgttccggcacttccgggacttcaccgaaggggccagcgcgatccagtccgagcattacaagcgcttcgagctgacctgcggcacgccccgcgacgagcggctgatgtcaccggcgttcggcaacgtgccggacgtactcgaccaggcccggcgcgggccggacacgatcacccgggcatacctggacgcgcgccgggaccgccggttcggcaccggtgagcagctcgccgtcgacgccgggctgacccggctggaacgggcccaccagcggtggaagtcgacccatcacagcctggccacccggatgctcggcgacgcgaccggttccggctacaccgccggggtcccgtacctgaaggactgcctggacaaccggttgttctggggtctcggcgtggacctgacggtgaccgccgcggaggtgagtggtgcgcacgtcgcgtga

SEQ ID NO: 5059 - DNA, 219 bp, Actinoplanes utahensis
gtggaacaggtcacgaccgacctcctttcagtcttggcagttcgtccggcgcggcagttcgccgccggtatggagatcgtctcgtcggtggccgccgctcgacagtgggctgttccggccagcggcggcggtgtcccgatgtggccgccgcccggcgaccagcaccaccaacgcaaagtggatcaatacgtgtattttcctacgcgtgatccgaagtga

SEQ ID NO: 5060 - DNA, 978 bp, Actinoplanes utahensis
gtggccggtgccgtctaccggacgctcctggcgaaccccgatgcacggctccaccagctcggtacgaccgtgggcatcaccgatgagcaggcgcgcgacgcgctggaccggctcgccgagttggccctcgtgcgacgctcggaggacgacgaccaagccctgccgctgctgaacgacccgccggccgcgctgtccacactgctggcccgccagcaggtgcggatggccgagcagcagctggagttcgagcgcaacaaggccgcggtcgccgaactgctcgcggcgagcagcgcagccggcgctgacctggagcccaacgaggtcgagcgggtgctgggcctggacgcgatccgccggcggatcagtgagctggccagctgctgccgcgaagaggtgtggaccttcaacccggacggggcgcagtcggcgcagaaccgcagcagcgcgcggccgatcaacgagcagaccctgcagcgtggggtgcagatgcggtcgatctacctggacagcattcgcaacgaccagccgaccttcgaccacgtgcaggatctgatcgacctgggtgcggaggtgcggaccacctcgacgctgccgatccggatgacgatcgtggaccggaccaccgcggtcgtgcccatcgacgaccgcagcagcggccggggtgcgttgatcattacgggccgggggatggtggccggtctggccgcactgttcgtctcgacctggcaggcggcccgcccgctggcacaccgtaagacccgcgagccgggccagccgagcgagcaggaacgcgcggcgctgcgcctgtgggcgcagggcgcgaccgatgcgagtgtcgcccgtacgctcggggtctccccacggaccgtgcgccggatgagcgagaacctggccgagcggctgcgggccaagagccggttcgaggcgggcgcgcgggccatggaagtgggctggctgaccgccgccgacttcatctga

SEQ ID NO: 5061 - DNA, 294 bp, Actinoplanes utahensis
atgtatctgatcgcggcctgggccttccccgctcacggtgaactgacgcgtgaccgggtggcccaggtgctcgagcggcgcctgcccgaggccggcatcgtgcacctctggctcggcgaacgcgacggctggcgagtgatcgggatgtttctcgacggctcgccggccgatgacccggagcacaccgtcgtggaacgggtgcggcaggccatcgcctccgtcgtgggatccgacccgacgatcgtgctggcggagatcgtgccgttgccgtcggcggtcgccggatcgttgtag

SEQ ID NO: 5062 - DNA, 195 bp, Actinoplanes utahensis
atggaactcattcgtgtcgtcgtcgcgtcgatggtcagcgacgactggggctggcaggtgctcggcgcgggcgtgaagctcaccggcgactggggctggcaggtgctcggcgccggcatgaagctcaccggcgactggggctggcaggtgctccgggccggcctgaccgtcaccggcgactggggctggcagtaa

SEQ ID NO: 5063 - DNA, 1497 bp, Actinoplanes utahensis
atgtcccgggtcgccgcgcgggtgggcgccgcgacgatagttctcactgcgacggtggcggtcgtcaccgccgtcgcggccctgctcggccccggcgtcccgatcggccgggacagctcgttgtacgtcctgtacaccctgtccgtcatgctcgcgagcgccgcctgcctgtgcagagccgtggtgacccgtctggaacgcccggcctggatcctgctcggcgccgcgctcctgctgtgggcctgcggaaacgtctacgcccaggtctggctgcggcacctggacagctacccgctgttgagctggggcgacgctgcctggctgtcctggtatccgcttgtcggcgctgccctgatcatgctcatgcgcacccggatctccgcagtgccccgcaacctgtggttcgacggcgtcatggtcggctgcgccagcggagccgtgtacgccgtcgtggtcttcggcggacggtcgaccgctacgaaaggttggatcgacctgctcgccgggttcgcctatcccaccggtgacatcgtgctgctggccatggtcaccagcgtgctgatcgttcacggctggcgactgcacgggggatggggctggctggtggtcggcctcgccggaagcaccgtgatcgacggcggatacctggccgagcaggtctcggaccggctcctctacggcacctggccggtggtggcgttcgcgttggcccgttcggcctggcagcccatgccccgggtggagcaggtgaaactcaccggtcggcggatgttcgccgcgccggccctgtgcgcgctcgtggtgctggccgtcctgctgcacgcggtgtatgcccacaccaacccggtcgcggtgtctctggtgacggtcagttacctcacgctgatggcccgggtaggtcttctcttcgccgacgtgcgacgcgcgcagacgttgctggaagcggcacacgcggcggccgatcagctgtcccgcaccgacccgctgaccggtctcgcgaaccggagggccgtcggcgccgttttcgaccagacgcgcggaagcgggcacggcgtgggtgtcctgctggtcgacatcgaccacttcaagcaggtcaacgaccggtacggccatgaggccggcgatgccgtcatcgtcgcggtgaccggccggatgacccgcgcggttcgccgcggggatgtggtcggccgctggggcggcgaagagttctgcgccctgctcgacgccatcccggatctggaagtgctgcgccaggtggcggagaaggttcgcaccgcggtgtgcggcgagccggtgctgctgccggacggccaccgtgtcgacgtgaccgtgtcggtcggcgccatcctgatcgatgacctgacccccctcgacttcgccatcagcgccgccgacgaacggctctacgccgccaagaacgccggccgcaaccgggtgcgcgccagtgtcgcggcgccgtacgacgccccggcgtcgcaggcgaactcaccggcgtaa

SEQ ID NO: 5064 - DNA, 396 bp, Actinoplanes utahensis
ttgtcccggctgacggctgccggcgacgaagccgtccaccggtccgggattcgtctgcactacgccaccaaatgggctcgccgggccggtgccggactgcatgccgccgccggcgaggtggcgcgcatccgcggacgcagcgcctgcccccatgacacgggtgtctgccccgatcacggcgccaccctgcgcggtgccgacggcgtcagctggtgcggccaccagggctgtggccggcgctggtcctacagccgccagtcattgccctgcaccgaaccggtcatgttcctggtgggcacccctgacggagcagagcaaccgacatgcgtcgggcacgcccgcgccgcgcgcctgcagctgtgcgaggtgaagattcttccactgcggatccgctga

SEQ ID NO: 5065 - DNA, 1431 bp, Actinoplanes utahensis
atggggccttgggcgtgccgtggttttgtagcggccgggctggtgctcgcgctgggttttctactcaccggcccggtgtcgcagagcgtgctgtacgggatggccggcgccgccgcctcggcggcgctgctgaccgggctgcgccggcaacggccgcggccggcgcgggcatggtggctggtctgggcctcggtgcagatcaacctgaccggtgatgccgtgctgggcctgcgggtgtgggtcttcccggactccgcggccctggtcctgctcgagagcaccgtctacctgatgtcgtacctggcgctggccgccggtctgacggtgatcgtgcacaaccgctcagccggccgggaccggggtgcgaccatcgattcggccatcgtcgcgtgctccctggcgctgcccctgtggttggtggccgtcacgccggtgctcgacgagccggctcagccggtggccatcctggtgttccggctcgccttcccgatcggcgacgcggtgctgctcaccctgctggcccgcctgttggtcagcggcagcggccgcagcatgtcgctgtacctgctgctggccgcggtctgctgctggctggccggggacgtggccaacgcggtgctggccgagcgcggcacgctggcgagctactggggcggagtgctgtactgcctcggctacaccgccttcggcgcggcggccctgcacccctcgatgccggccctcgcgacgaccggctcggcgcccgcgccgcggttgaccaccggccgcctgacggtgttggccgggctgtcgctgctcccgccggccctgctgctcggccaggcgttcaccggccggcaggtgcaggccgtgccgatcggggtggcgtgcgtcgtgctgttcctgctcgtggtcgcccgcatggtgggcctgacccgtgaggtcgaacggcaggcacgggaactgtcggacctggcgagccgggacgcgctgaccggcgtcggcaaccgccgctcctgggacgcgcggctgcacgacgcggtcaccgccgcgcacgacgccgggggaacgctggtgatcgccctgctcgatctggaccacttcaagcgctacaacgacactcatggtcatcaggccggcgaccggctgctcaagggcgccgccgcggcctggcgggacgtgctgcgccgcgatgacgtgctgtaccgctacggcggtgaggagttcggcctgatcctgccgggcgcgtcgcccggtgacgcggtgaagctgaccgagcggctgcgggaggtggtcccggacggccagagcttctccgccggtgtcgccgcgctgcacggcacggagaccgtggaggaactggtcgcccgggccgacgctgcgctgtacgaggcgaaggcgcacggacgcagccgggcccgggtggcggccgtcacgccgaaggccgcctga

SEQ ID NO: 5066 - DNA, 516 bp, Actinoplanes utahensis
atgatcaggttcgccgccgtgcaggacgtcgccgagatccacgcgatggtccgggagctcgccgcatacgaacgggccgccgccgaggccaaggccaccccggagcagttgcggcaggcgctgttcggcgcgcatcccgcggcgtactcgctgatggccgaggacgacgacaccggtgaggtcgtgggtttcgcactgtggttcccgcgcttctcgacctggaccgggacgcggggcatgcacctggaggatctctacgtacggccgcacgcgcgcggcggcggccacggcaaggcgttgctcgccgcgctcgccgacatctgcctgcggcacggctacgagcgtttcgagtggtgggtgctgacctggaacgagccggcgatcggcttctaccgtgcgctcggcgccgagcttctggacgactggacggtgtgccggctcagcggtgacgccctggagggtctcgcccgcctggcgtccgccgccggaccggggtccggcgcgacggacgtctga

SEQ ID NO: 5067 - DNA, 174 bp, Actinoplanes utahensis
ttgcacgtgcagacggacctggatgaggcgatagcgacgttcgaccgccgtgcggtcgagtcccgggtggcggcagccgatcagcgggcggaggagatccgaacgtcgtttccggcgaccgagtggccgtcgctcgccgcagagcggtaccttcggctgggggcacacggctga

SEQ ID NO: 5068 - DNA, 225 bp, Actinoplanes utahensis
atggacgccctctgcgaacgcggcatcgccgggaacaaccattccggaggcaagcgcggcttccgcgtatatccgccctgggtgatcacgacaagtcgtcaagccatcaactcgcaaggatggcaactcggctacttcctgtccgtgaacgacggcatgtcgctcgacatcaaccgggcgagggatctgtaccacctggcgaatcaagctgcccgcagacagtga

SEQ ID NO: 5069 - DNA, 588 bp, Actinoplanes utahensis
atgcggaactatctccggtggatggtgctcggtaccgttgtggcgatatctgcgctggctggccactggatcttgggtgccggcaccaaagcgcggtatgagcccgagccccttccgacgaacgtcagtgcgatcatggcttcgtacggctacaagaaaagcggggacaactcggagagttataccggccgcatattgggcgcggagcattatttctactgtcccactgaccaggattgcaacacggcagccggcaatgccgcacatcctcccgtcgacatctacggtgctacggctgtgggtgtggaagtctggtggccgccggcgcttcccgccaaggacagcccgctggcgggcaaacgcctgaccatctgcacgtatacgccggaggcgatctcttcggcacgtatcaccagcgatgagtgggccaagaacatcgcctcgctgtcccaggcggcgcgaggtctggtcaccgagaagatggcggcaagcccgcaacgcctgccggcggctccggaagatgtgcaagccattcccgtgaacgggtggcaatgcctggtgccggcgggggtgcggccgtttcggtga

SEQ ID NO: 5070 - DNA, 1506 bp, Actinoplanes utahensis
atggacagatcaaggattacatccgggctcagccggttcaagggccgctggcaggtcggtgccgtcgccgcggtcgccgtggcggtggccggcgtcgggttgggggtggccttcgccggcgagaccgtgccgaccgtcaactgcccgcaggtccggctcaccgtcgccgtgcccgcccagcagcaggccgacgtgcagcgcaatctcgtcctgctcaacacgcagatcgatgaggcgaaccagcggctgcgcacctcggcggggcagggcggccccaacttcatccagaacgccatcctgggcccgctgcgggacaagcggttcgccacgatcaaccggatcgagaccgcgatcggccggaacgccccgaagccggatttgaacgccgagggcctctcgggctgctcgctgaacaagggcggcggtgcgtcgaagaagcagaacaccgcgcccccacaagccccggccgcaaagccgaccaccgcgccggccagcaaaccggcggccgccaagccggcggccaccaagccggccacgaaggcacccacgccggacgtgcagacacccggcggatcgcccgtggcgatcaacggccagctgagcgtctgcggggtgcacctgtgcaaccgcgcgggcaagccgatccagctgcgcggcatgagcagccacggtctgcagttcttccccaactgtgtcaacgccgactcgctggccgccctgcgcaacgactggaacgccgacttcatccgcctgtccatgtacgtgcaggagggcggcctggaaagcgacccgaccgacttcacgaacaaggtcaacggcctggtcgaccaggccacgaaactcggcctctacgcgatcgtcgacttccacatcctcacgccgggcgaccccaacttcaatctggcccgggccaagaccttcttcgccgatgtcacggccaggcacgccggcaacaccaatgtgctctacgaggtcgccaacgagccgaacggcgtcagctggaccgcgatcaagtcgtacgccgagcaggtcatcccggtgatccggaagaacgcgccgaacagcgtcgtgctcgtcggcacccgtggcttctcctcgctcggcctctccgacggcagcgacgagaaggagatcctcgccgacccggtcgccttcaagaacgtcatgtacaccttccacttctacgccgcttcgcacggggcggaccgccgcgctgtggtggcccgggcagccaccgagcttccgttgttcgtcagcgaattcggcagccagacgttcaccggggatggcaggaacgacttcgccagcaccaccgcctggctcgatctgctgaaagccaacaagatttcgtacgggatgtggagtctttccgacggacgggagagcaactcggtcttcaaacagggcacctgcgccggcaccaccttcgcgggcaccggtgtgctgaccgaggccggacgctacctgcgcagccgcatccgcaccggggtgggcgatccccactga

SEQ ID NO: 5071 - DNA, 2421 bp, Actinoplanes utahensis
atgcgcactgaaaccggtcggcgccgtgtgtccaccgtcccgcccccgccccgacgactgctcccccgggcactgctggccgtgtgctgcacgctggcggcgaccggcgtcgtcggcgggttcgcacgacccgccgaggccgccaccgcgatcacgctgaacggcgcgtccgcgggccggacgttcgacggtgtcggtgcggtcagtggcggaggcggcaacagccgtctgctgatcgactatcccgagccgcagcgcggacaggttctcgactacctgttcaagcccggctacggcgccgccctgcaggtcctcaaggtcgagatcggcggtgacaccaactccaccagcggcgccgagcccagccacgcgcactcccggggcgatctggactgcaaccgcggctacgagtggtggatcatggaggaagccaaacgccgcaatccctcgatcaagctgatgggcctgccgtggggcgcgcccggctggatcggcaacggcacgttcctctccggcgacctgaccggttacctgctgtcctggctgggctgcgcgaagcagcacaacctgaccatcgactacctggtgcccgcgcagaacgaaaggcagtggaacgcggccacgacgatcgccgtgcgcaacgcgctcaacgccaacggctacggcgccgtcaagctcgaggtcgccgaggactggacctactcaccggccgaccagttcgccggcaacacggccctgcgcgacgccgtcgacgcgatcggcgtgcactactcctgcggctacctcgcggatcagacgacctgcaattcctcgggcaccgcgatcaactccggcaagtccctgtggtccagcgagaacggctcccaggactacaacggtggcgccaagcccctggcccgcggcatcaaccgggtctacctggacgccaggatgaccggctacctgaactgggacctggtcgccgccaccaccccgaacaacctctggtcgacggtgggcctggtcctggccaaccagccgtggtcggggtactacgcggtcggcaaggacgtctgggcgatcgcgcacaccacgcagttcaccgcgccgggctggaagtacctggacacctcctcgggctacctcggcgggaaccgcaccaacggcagctacgtcacgttgaggtcgccgagcaccaccgactacagcaccgtcatcgagaccatggacgcctccggcgcccagacactcgatctcaccgtcaccggcgggctgtccaccggcccggtgcacgtctgggcgtccaacctcaactcgaacaacccggccgacctcttcgtccgccaggtcgacatcacgccgtccggcgggcgctactcgctgaccgtgcagccgggctaccagtacaccgtcaccaccacgaccgggggcggtaagggcacggcggccagccccgggcaggggtcactggcgttgccgtacaccgacgacttcgagggttaccccgccgggcgggaagcccggtacctgatggacatgcagggcgcgttcgaggcggccgcgtgcggtggcggacgttccgggacctgcgtccggcagaccggcacccaggcgccgatcacctggaagacgctcagcgacccgtacgccgaactcggcaacaccgcctggagcaactacaccgtccagtccgacgtcatgctggaacgctccggacacgtcgaactgctgggccgcgtcggcgggcaggacctgatgaacccgggcgcgctcaacgcgtaccacctgcgggtcagcgacagcggcgcctggtcgatcctgcgcaccaacacctcggcgcagacgaccacggtccgcagcggcaccaccgccacgctcggcaccggccgctggcacaccgtcgccctgggattctccggcagcacgctgaccgccaccgtcgacggcaccgtggtcggcacggccgatgacgccacgttcggcacggggctcgccgggatcggcaccggccaaggccagaccgcccagttcgacaacctgcggatcaccgccggccccggctccggcacgtccctggcgctgcgcaacgtcaacgccggacggtgcctcgacgtgcccgacaacgcgcagaccagcggcacgcaactggcgttgtgggactgcaacggcggcgtcaaccagcagtggacccgcaccaccggaagacaacttcaggtgtacggcaacaagtgcctggacgcgggcacctcgggcagccgcaccgtcatcgcggactgcagcggggcgaccgggcagcagtggaatctcaacgccgacaacaccgtcaccaacgtgcagtccggtctctgcctggacgccagcagcgccgggacggccaacggcaccgcggtcatcgtctggacctgcaacagcggcgacaaccagaaatggacacggagctga

SEQ ID NO: 5072 - DNA, 1332 bp, Actinoplanes utahensis
atggtgcggaaaagactcgccgtcctggccgccgtgatcagtggggcactgggcctcgcccttgccggcgccttgccgagcgacgcgttcgccaccagcgccgcggcgccgacggccggctgcggccaggctcccacgctggccggcggcacccacacgatcagcagcggcggtcagaaccgcagctacatcctgcggattccggccggctacgacggtaaccacccgtaccggctggtcttcggcttccactggaacggcggtaccgccggggacgtcgactccggtggcaccgacggctacaactggtcgtactacgggctgcggcggctcgccgacgccgccggcaacggcaccatcttcgtggccccgcagggcatcggcaacggctgggccaactccggcggccgggacctcaccttcgtcgacgacatgctccgccagatcgagggcggcctgtgcgtcgacacctcgcagatcttctcctcgggcttcagctacggcggcgccatgagctacgcgctggcgtgcgcccggccgaccgtgttccgcgccgtcgcggtctactccggcggcaacctcagcggctgcatcagcggcacccaggcggtggcctacatcggactgcacggcctgcgcgacaacgtgcttcccatctccagcggccgagccctgcgcgacaccttcgtccgcaacaacggctgcaccccgcagaacccgccggagccggccaacggcagcctcacccacatcgtcaccacctactccggatgccgcgccggctacccggtggtctgggcggccttcgacggcgcgggccacgatcccggtcctcgtgacggctgcacctgcgacggctggcagacctggacctccggtgtggtttggaccttcttcgcccagttcggcggcggcaccccgcccagttcgccggcacccggcggcgcccggcagttggtgggcgaacagtccggccggtgcgccgacgtgccgaactcctcgaccgccaacggcacccaggtccagctctgggactgctccggcaccgccggtcagcgctggacctggacctccggtcggcagctgcaggtgtacggcaccaagtgcctcgacgcgaacggtcagggcaccgccaacggcaccgccgtgatcatctgggactgcaacggccaggcgaaccagcagtggaacgtcaccgcgaacggcaccgtcaccggccagcagtccggactgtgcctggacgccaacggcgccggcaccgccaacggcacccggctgatcctgtgggcctgcaacggcggcgccaatcaacggtggagcctgcgcggctga

SEQ ID NO: 5073 - DNA, 795 bp, Actinoplanes utahensis
atgactgtcatcgttgacaccgctgcccgcgccgacgcgtcggcgagcaccgaccgggccagcgagttgatcaacgccatggcggtcctgccggccggtcacccgtcccggcccggtctgcgggagcgcgccatcgaggcatggctgcccctggcccggcacctgtcgcagcggtacgccaaccggggcgagccgcgcgacgatctgtaccaggtcgccgtcatgggactgatcaaggcggtcgaccggttcgagaccgatcgtggcgtcgacttcgccggtttcgcgatcccgaccatcgtcggtgaactcaagcggtacttccgggacaagacctggtccgtccgggttccgcggcgtctgcaggaactcaggctggccatcaccgcggccaacaacaccctgtcgcacaccctggggcgcgccccgacggtcaccgacatcgccggctacctcgacgtcagcgaggacgaggtcatcgagggcctcgaaggggcccgtgcctacaactcgacgagcctgtcgacaccgatgagcgagagcggcaccgagctcggcgacaccctcggcggccccgacaccgggtacgaggaagtcgagcgacgcgtcatgctcggcccggccatggcccatctcgacgagcgcgagcagaagatcgtcaccctgcgcttctacggcaacctgacgcagcagcagatcgccgagcagatcggtatctcccagatgcacgtctcccggctgctgaccaaggccctggccaaactgcgccgcaacctcgacggcgccacgcgctga

SEQ ID NO: 5074 - DNA, 999 bp, Actinoplanes utahensis
atgatcgcgcaccaccgggacgaccatgcaggcggcacgttcctgcacagcgcgctgattccgggtagcgacgaggagctgacgaccaccctggtgagagaactgcaccggtccgcgcaccgcctcgatgaggtgctgcttgtcgtcagcgaccgcacccggcaactgctgaccgggccgttgcggccgctgaccgacctgctgacctggggtgaccccgccgcgtactaccagcggctcggatccgcctacgaggacttccgccggcacctggccgaacgggcggccaccggacgccgggtccatgtcatcgccgaaccggacctgaccgaccatctcgacccgggcgccgctccggtccgggccgacgcctacctggcgtacgaggcggtctgcaacgacacctacgcaccgtacggctgcgccgtcacctgcatctgggacagccggcaccacccggcgggcatcctcgacggcgcccgggccacccaccgctacctgctcaccccgcacggccggcagcccagcccgcacttccgttccgcggacgactacctgctgggccggcggccactgccgctccccgaggtgccgcagcgggtggaccacgacctgaccctggccacggcggccgacctcggcagcctgcgctcggccctgcacggctgggcatccgacctcggtctcgccaccgatcccgccgaggatctcgtcgtcgccgtggtcgaggtcgccagcaacgggctccgccatgcgggcaccgcggtccgggtccgagcctggcaccggggcagcaccctgatcgtccagtgcgacgactccgccggccttccggtgcccgccaccgcgggatatcaccgtcccgaccccggcagcgccgcacccggcggccgtggcctgtggctggcccggcagctggccgacgtcgtgctcatcgacgcgacgcccgccgggacctcggtacggctacagttcccgcacgccgtcatgcaccactga

SEQ ID NO: 5075 - DNA, 1254 bp, Actinoplanes utahensis
atggatccgtcggtagaggtggcgctgtccgggatgctggcggccgccgaggacgcaaccccggtgaacgcggtggaggccgtcacccgggaactcgggacggcgctgcatgccagcagcgtttccttcctgatcgctgacctcagcggccgggccctggtccggctggcacacgtcccgctcggcccggcgggcggccgccgtgacggcggcgaggtggcgacggtgctgccgttcgacggcggcccgcaggaggaggcgctacgcacccaggcagtgcaggtcaacggcggcgacccggaatggaccgtgctggcaccggtcaccgaacgcggcgaggtgatcggcctgctggagatcgtcgtgcccgccgagcccgcaccccaggcgctcgcggagatcgaacggaccgcacacgccctcgcgttcgtggtgatcgccaatcgccgccacaccgacctgttcgagtgggggcagcgcaccaccccgttcaacctctccgccgagatccagcgacgactgctgccggccgccttcacctgcgaaggtggctccttcaccctgtccggctggctcgagccggcggcgagcgtcggcggggacaccttcgactacagtctggcccgcgacaccctgcacttcagcgtcaccgacgccatgggccacggcgtgaccagcgcactgatcgccaccctcggcgtggccagcctgcgtaactcccggcgtgccgggcacagcctcaccgagcaggccgaccgggccggtgccgcggtcgcggagcacgccccggcccgcggtgccttcatcaccgcggtcctcggacgcctcgacctcaccagcggccggtgcgacctggtcaatgccgggcacgtaccgccgatcctgatccgcggcggccacccggaggagctgacgctgccccgcaacctggccctgggcatgttcccgaatcgccgagtcagcgccggcgcggtgaccctggaacccggcgaccgcctggtcatcgtcaccgacggcatgcgcgaacgcagagccgccgccctcgacctgacggcccggctccgatcgctcgccgccctgcacccccgcgaagccgtacgcgccctggccgacggagtcctcgacgtcgccggcccgaccctcgaggatgacgccaccctgctgatcatcgactggcacggacaccacggcaggcaacgccgcacccgcgccggcgccgacgtgtccgccgccacctcagccgacggccgctga

SEQ ID NO: 5076 - DNA, 354 bp, Actinoplanes utahensis
gtggatctgcagttgtcagcgcgggatggccgggcctgcaccgtggtgaaggtcggcggcgagatggacatggcgaccagcccgcagctggacgacttccttcagcaggtcaccgacggcggtgccgtccaggtggtgctggacctcggcgacgtgtcgttcctcgattccagcggtgtgggcgtcgtgatggtgtggttcaaggagcttgacggcaggggcggacggttgtgcgtcgccgcggtgcaggacatcgtcgcgttcgtgctgcgggtggcggtggtggatcaggtgctcgacgtgtatgacacggtcgaggccgccgaggccggcatgccgccgttgacggcgtga

SEQ ID NO: 5077 - DNA, 900 bp, Actinoplanes utahensis
gtgcccgacaaccagtacgaacctcagcacccccaggatcagtaccgcacgccggacgcgcaggacagcgaccggatctcgcaccccggcatcaccggtgagatggacgtcgtgccggatcacggcgaggacagctaccacggaaccggccggctcgacggcaagcgggccgtcatcaccggcggggactccggaatcggccgggccgtggccatcgccttcgcccgcgagggcgccgacgtgctgatctcctacctgcccgaggaggaggacgacgcgcgggagaccgcacagctcatcgagaaggccggtcgcaaggcggtcaccgcacccggcgacatccgcgacgaacagcactgcgcgaccatcgtggcgaaggcggtcaacgacctcggcggcctcgacatcctggtcaacaacgccgcgtaccagatgtcgcaggacgacggcctgctggacatcaccaccgagcagttcgatcgggtgatgaagaccaacctgtacgccattttctggctgagcaaggcggccgttccgcacatgcgaccgggttccacgatcatcaacaccgcgtcgatccaggcgtacaacccgtcgccgaacctgctcgactacgccaccaccaaagccggcatcgtcgccttcaccaaagccctcggcgccaacctggccgacaagggcatccgggtcaacgctgtggcccccggaccgatctggacaccactgatcccggccaccatgcccaaggagaaagtcgagtcgttcggcgaggacaccccgctcgctcgtgccggacaacccgccgaactggcgcccgcgtacgtcttcttcgcctcgcaggaatccagctacatcaccggcgaggtgctcggggtcaccggcggcaaacccctggcatga

SEQ ID NO: 5078 - DNA, 123 bp, Actinoplanes utahensis
gtggcgcgggcctttcaggcataccacagcatcggcgaggcctatacgatcctgtgcgagcgcgccgcggtgcacggcaactcgctggccattgaggcggaggacgtcgtccgtcggtggtga

SEQ ID NO: 5079 - DNA, 1500 bp, Actinoplanes utahensis
atgaccggcggcaacccctttcagaatgtcggccagccggctcggggcgaccgcttcgtcgggcgcgaggatctggtcgcccgagtgcgcggcatcgtcgaaggcgatcggccgtcgaacatgtcgatcatcggcaaccatcggaccggtaagaccagcttgatctaccgtagcctgatcgacatcccggcggtccggccagatctcgccgtcgtactaatcgggatcggcaaggtcggacggattgaggatgtcttccggctgatcggacgcgccactgtggaggcgctcgacggcctgccggcacgcgacctggccgggtttacggccaccctgaacgcgctcgaggccgagtccagttggtacggcatcatgagtcagttcatcaagcttttcagcaccattcatcaacgccgcctgaaggtgctggtcgtcctcgacgaatttgatcgaatcaacctggccggcgttcagactgcgcatttccaattgttgcgtgacctgtgcaccgaggattggtcctcgaccggtctcgtcaccgtctcccgtcagcgtgtcaagacactggagctcggctcgaccaatgggtcctgtctcgaccaggtgttggctgttcgcacgtacaccaatctgttcgagcctgtcgaacaaaatgcgatggttcggcgggctcgcgcggcgggggtcgaccttgagcgacacaatgagtggatcacaagcgtggccggtcgtcatccgtacctcctagagcttctctgctacgagctggtggaaagctcgggcgacaccgacttggcgtaccggaacgtgcgctccgcgtacgccgacttcttcgctcgccttattcgaatcatcgatgccgacctggatggttcgggtgtcgacaagctctatcaggtcattgacggtatcggcctcgacgtctctatcgacgacgcccttgcgctgatccgctacggtctcgtcgtcgagacggacgaccagtcgctggtgccgttctctgccgaattcggtcgttatctgctctcgatcgccgatggtcgcgatttccgtagcttgtggctcgactgcgaagtgggtttgcggcgcctcattcgatcagtcctttcagaggccgctccggacggcgacagtctcggcctgctgcccgcttccttcagtaagatcgtcagcgacgcccgatcccggcaaggtcgctacagacccgtcgtcgactgctcactggacaccatcgactacctgaacccgaacgaccttttccagattatcgtggtgcgatgggatctgttcgaggcggtcctcggggaaacgagaggcgcctggcaacgccgcagcgaggcagtcattcgagcccgtaatgaggtcatgcacattcgaccgattccaggcgaaatccgactgctggccgagacggcggtcaccgcaatcgtgacgactctccgcgggctggggcacttgcgttcggtctccaccctaggcgtgatcaaccaatcgggctaa

SEQ ID NO: 5080 - DNA, 4389 bp, Actinoplanes utahensis
gtggatcttgaccttgttcaggcggttgccaaggtcggcgacttcatctatgtgtaccagaccaccggccatcagatcgctgggacgttggccacgctgagcatgagccatctcgtagtggaggagcagggcaccgggatcaagcacgcggtcgcgctggccagcataatcaccgtgaccaccggccagccgcagaaggccaccgctgcggaaccgatcccgcccaatgcctcggtgccgccgccggtcgaaccggctgcgcgcatcccggaagcaccgccggtcattccgcgcctgatcgtgccctctggcgcggcgacgatcattatgcagcgtccattggccgcgccggatttcgtcacgtatgccaacgacgagctgttcaacgtgcacagccacgaggctgcactggaccgcgtccgacagcagctcgagtacgccgttcgagtgaaagagctcgatccgcgcttcggccggtgcacgagcatggccacagagatggaccagatcctgctcggcgaaccgcattcgagctcggccttccggctggccggctacctgcactacatggctggccatctacagacggccagcgaccgctatctaagtgcggcgctcatcgtcccggatgtcgcgccctattggtggctcgacacggcgatcgcggcacttcgcgccgaccgggtggatatcgctcggcaggggctgatccgctatatcgacggcacgacgccgcaggaggatccagacgcatggtgggcgttgctggcattgtgcgaacggttgggcgctgctggcctgctccacctgatccgcccggaggctgaggcgacgcccgaggtacgacgttcggtgcttgaggcctgccacagcctcgccagcagtgcgggtgatgtggaactcgcggcccgtgccgcgaagatgctgcagaacggccctgaagcggccgtcctctcggtgccgacactcccgtccctggatatgccggcccgaatcaacccaaagagcgtgacaccgcgaatcgtgccggcaccacccccgcagcggccgctaccaccgccggccaagccggccactcgccagcgacgggcggagcggaacgagtatgaccaggccaagtacctcgagcaccgggccaaggacttggagcgggcgaaaatggcctatcgggacgcgatccgaaagaacatcaatgcggagagtgcgatcaaggacctggcgtggctgacccgtagggtcgatgggccggaggccgctctacaggtaatcgaggaagagttcgctgatcggttgccgccgagcgcctccctagatcagatcctcatcgacttttacatgggttcccagcggtacgaggacgcgttacggctgctggagccgatgctcgccggacatttggaggcggggcagcgcaaggtggtgttgcggcggatctgccaggccaaactcagcctttcgcaggacgccacgccatacgctgaggagctgttgcgggtcgcgccgtcggaggcgtcggcccgccgcacatacgccatcgcattgatgcgccgggaccaaccaggcgacctggaccaagccgaagaggtcatcgaggaactgcgcagcaaggaggacgcgcaggcactggagatcgtggacaagatccggcagatgcgcgagggcggcagcacagcagacctggacttgctggtccgccgcctgtccgacatcaggttcgaggcgatctccgactttggtcagtacatcctggacaatttcgccgaggccgccgacggcatcaggcagcaacgcaagtttgccgctaacgacatccgctaccttcggactcgagcacaggaggcacgcaacaagcgcagccgggagaggtacgacgcgtacatctcggccgcgagaatcgagctcgaggtctccaccgttgacggtggcgggtccgaaagcgctgagcgtaacgctcaagctttctttgatctgctgctacgcgggctcaccgcgctcggtgacaccatgctgtcaaccaacaccgaggtagccagggaaatctacttcgaggctctggccttggccgatcagctccggcaaccgaccatgcaggagtattggaacgccctgcagcgctaccttcggtcgattttcgacagcccggagtccctcacggtgtcccacgaccgaggcggcaacagtagtctgtcggcggccgaggtgggcgccgccctcgccgacgacctccgggaagttcccgagcaaagtgttcaacagctgttcgaggcggtcgacgagctcgcagcccgcaccagattcgcctctgagtcggctatccgtgcgatcgagcacgtcccctcgcttgcccgggcggcccgccggcacctggccgagttcctggatctccggtcccccgatgtgaccaccgaacgggtaatcgaggcgtggcgggaagcaggtctgcgccggcagtccgaccgcgacgagatcgaacagcagttgcgactcctgcatggcctagaagtcggcgaggtcagtcttgatcgcgccttcacggtgttggacaacctgcacagcgagcggacggtcgcgctggcggtagaccgagaagcctgccgaaagttgcagacgaacttccggctgctgcagtatgggctcaaggagcccggtttcgaggagcgcgagttccgctacctgcaggtacaaggcgcgatgagggactttgccgaacaggtgaaggcggcaccgacccggctggccgttcggaacctgttgccgatcgcctcccgcaccctggctcaggtggacaagacgttagagcggctctacgccgatcgtgagcccgacccgaccctctcgctggcgctcgtcgagtacaccccggacctgcacaaccggatcaccgtgcaggtgaagctctacaatgagcctagctgtgcgcccgtggagtcgcccgagttggtcgtcaacctcgccgccgcggccgatggcatcaaggtgctcgatgtggtgaagtccgtgccgaccgtgcgcggcggcgacgccaagatctcgtcgatccaggtggagctgagcaaggaactggtcgcatcgggcgctttcagcctgccgatcgacgtcacttaccgcacccgtaccaacgaaaagggccggatcagtgcgacgctcgccgtacgcctgatgtccgaggccgacttcaccaagatcagccctaacccgttcaaggatggtgccgccggccgtaccgtcaccgacccagatatgttcttcggacgcgaggaactcgtcgatcagattgaggcgctgctggtcgaggcgaccgggcccggcgctggcgtcgcgatctacggacagaagcgggctggtaagtcatcgattcgtctgcacctgtcccggcggctcgagaagagcgaccggttcctggtagtcgatgttgccaacatcgggcaattggcaccggtcagtgtcggcgaagcaaacgctaccctacagatcctgctgtggacgattctcaccaaggccgacgccgtcgttcggcagcggtccgctgcgctgggcgatccgatcgaattcctgccggccgacctgccccgggacgagttcctcacgagcagggtcccggtcggcgacttcatcaccgtgttcgagcgcttcaacgctgaggccgcgcgccacagcgagtggcgtgatcgggcatttatcgtgctgatggacgagttccaattcatagcaacctggattgccgaagggcgagtctcgtccactttcgttcaggcgctcaaggcggtcttggagcagcgattgttccaccttgtggtggtcggcctcgacgccatgcaatcattcatcgacaagtacgccaacgagttcggcgtgttcgacaaacgccgggtcaactacctcgaaccacggtacgctttggagctcatggaccgaccaatccggatcggcggtcccgacggcgagtcacggtaccgggagcgggcgcaggaacagattctaagtctcaccggcggcaacccgttctacatccagcgattctgctatcagctggtggaacacatgaacagctcgaaggcgccgctggtgactgaggccgacgtcgaacttgtccgggaatggctgctcaacgaatttggcccgggcgacttcgacaacctggagaccagcggcgagccatccaccaccgccatcgcgacggaggcggtccgcgaagtcctcaccgcggtggcggtcgctgccaacgacggccgagcgacgatcgaagatgtggaacggaggtgttccgtaccgaacgtggtctcgatcctcaaggatctcgaggcgcgtgaagtcgtcgtccaggaagcgggcgcctaccggatcctggtacgtctctaccacgactggctccgccgaagggtggcctga

SEQ ID NO: 5081 - DNA, 612 bp, Actinoplanes utahensis
atgccgatgaagtcggccgactgggccctgatcatttctgcggctgcgttgttgatctccctgggcggcacagcagcggcgatctggcaggctcgtattgcccggcacgcggcggaaatttccggccgagccgcggatgcgagctccgcccaggccatcgccgctatccaacagacgaatgtgctgagacgccagctttccgccgaggacgacgaccgcgctttgcgcgacgccccggaattcgttattgaattcgttggtgaaggcgagtggggcacctggcggacagaccgccgtggcggtcgccggtttgccgcgatctcgcggcacaacaacccgtcggtccatgactgggtgaagcggcgccagctagttctcgggcaccgacgcggtccggcggtgcgcacctcgatcgcagtcgacggccggcaaccgccagatgccgaactgctcgaccctggcccgttcgacatggtcgagggcgccagccgacggattccgatcgtcacggtgcacgcgctcgagggcgcggagttgaccgtggtgatcaccagcgaggagttgtccgggcagggtcgccgctgggtcagccgtcgcgtattggcactgtga

SEQ ID NO: 5082 - DNA, 1506 bp, Actinoplanes utahensis
atgacgatcaacgaagcggtcctcctggtcgactggctcaatctcagcatccacctgaagaatcagcgcctgtccttcggctccgatctggtcggcgatctgatcaagatcgctcgtgacgagtgcgcccggcatggctcgccagacttggtgcgcgctcacttcgtcggtgagcagttcgcgcccagtgtagaaggtgcaatcaccagcacctttattgctcgcatccacaagacccgcaccgccaaggaacaggccgatcttgtgctcgcggtgctggcgatggatcacattcacgccccaggcggcgggcccggactgtttctgctggccaccggcgaccaggatttcattccgttggttgaccgcatgatcgaggcccgggccgaggttgtgctcgtcgtcgcctcgacgcgcacgctctccccggagtatcggcgcatcgcggcccagcaaaacgtcaggctgctgtcgctcaccgacgtcctggacatcgagccgctgccggagtcggacgccgaagcggccgctacccgggtgctaagcctctaccgggtgtgcatggccggcggtgtcctcggcggcgaccagacccgcaatatacgcatgcttgcggattggggcctgctgcagccgggcgatgaagaggtagagcacactgcgtgcctgcagcagttcgctcgggtcgatacccgtaaggtcgccgtgccagcaaagcgggacaccggtaaccgccccgccgtgctgcggcgcacctacctgaatttcgcgtctgcgaccgtcctggacatcgtcgaagacgcggactgggtgcttaggcgtacaggcaatgccgcacggctgccgaccatcggcgacctgggggtaggccggttcgcagccgacgacggccggcgccttgctcgggtcatcggcgcgatgaaggacgtgggctggcttatggagcggtcggacggccggttcgagtcgcgcctggagtggtcggccgacgggctgctggagccgctgtggcgggtaatctgtgagatcaaccggagggcattcgccagctacaccgagggtgtgtcccgcgatcggctattccaggatctgcggtcaaccccgatcgccgccgacatagaccggaagggcggcaaggccgcgcacgaggtcatcgaccatgcccgccggatcggcgtcatcgacgccatcccagcgggatcggacggctatgcactgacggtcatcgagactcacccagtggcccactcggttgccagcgccctgcgtacgctcggcaatctcctggcggaccaagtcggcgtcgccgttcccgagcacgaggtgctcgctctgatgcgcgaacgagacgagcacgccgacgcccaggttctcttcggttacgacaaccgcgaccgccagcggtttctgcgagtgctgcgccgttccagcttgctggaccggccgcaaggcagcgagccgatggtgcggctcaaacgtacgccgtggctggaacggatctcctga

SEQ ID NO: 5083 - DNA, 882 bp, Actinoplanes utahensis
atgagcgacgtttcgccggacaccgcacggctcacgttccgggccgcagagccgatccacgggatgatctacttctcaccgcacggccgcgacacctatgccggcatcggcctgacgggccgcgccatgacgtacttcgcaccgcggtcggccgcgatgggtccggtgcccgcggaagtcaccgtggcgacgttcttcaacttcaacccggacgcggtccggtccgcccttcccgcggcctgggacatcgccactgcggcacaggtcgtcgaggcgcggtacgaggccgtcgaccgttcactgcgccaggcctggggcgacgacaccggcggttccgcggtacgcgaggccgccgacctcgcgcgccgcgccgccgagcgggcgtgcgaccgtctcccggggcggccgctgttcgcggcgcacgcctcgctggcgtggccacgcgcgcctcatctggtgctctggcacgcgcagacgctgctccgcgagttccgcggggacagccacgtcgcgctgctgcacaccgaaggactcgacgggccggaggcactgatcacccacgccgccaccggtgccgtaccgccggaggcgctgcgcgtcagccgattctggagcgacgaacagtggaacgcgggcatcgaccggctccgcgcgcggggatggctcgcccctggccccgacctcaccctcaaccccgaaggagagcgctggcgccgatccctcgaagcccgcacggaccagctggccacctacccttacgaggcgatcggagcggacggatgcggccggctggccgacctgacgaccccgttgagcgccgcggtgatgaaggcggacctcaacttcccctcggccctcgccacccagcgccgagaccgctga

SEQ ID NO: 5084 - DNA, 678 bp, Actinoplanes utahensis
gtgcaacctgccgtccccccacgccgtgccaaactgggccgccccgcccggatcacgcaggagatgatcgcggccagggcacaggccatcgtggacgccgagggtgtgcagcacctgtccatgcgccggctgtcccgcgagctggagaccacaccgatggcgctctaccactacgttcgggaccgcgacgcgctgctgttgatgctgctggcgaccaagaccgagagcacgccgctgccgcacttcccggccgagccgcgcgactatctcctggccgcggcggtgcacctgcaccacctgctcgacgggtgcccgtggctgcccgagatcctcgggtcgcaggagctggtcggcgtggtgaccctgccggccgtcgaacacctgctggaggcggccatccggtgcggcctggaccggcaggaggcggtcgagctctaccagctgctgtggagcttcgtggccggggagctgttcatcaacgcgggcacgcgcaagcccgagcagccgtcgcgacgccaacggctgctgaccacgctgcccgccgaggagtacccgcacctggccgcgctgtccgagcagtggggcgagctcatcgccggcgaccacgtgcaccggggcctggcgggcatcatcgacggtgtgctccgcgaccggtccgggccatcgcaggacgggtga

SEQ ID NO: 5085 - DNA, 1533 bp, Actinoplanes utahensis
atggctcagttggagccgaagaggggcggggctctcgccgccgtcgccctggcccagttcatggtcacgctggacatgaccatcgtgaatgtggccctgccgtcgctcggcggtgacctggggttcgagccgacccagctgccctgggtcgtcaacgtctacgccctgctgttcggcggtctgctgatgctcggcggccgggccgccgacctgttcggacagcgccggatcctgctgtccggcacggcgctgttcgccctcgcgtcgctggccggcggcctggcgcaggcgccctggcagctgatcgcggcacgggcggtgcagggcatgggcgccgccctgatggccccggcggcgctcgccctgctcaccctcacccagcgcgagggccgggaacgcacccgcgccctcggcgtctacgccgcggtctcggccgtgggcggcgccgccggtgtgctcagtggcggtctgctcacccagttcgccgggtggcggtgggtgatgctggtcaacgtcccgatggccgcctgcgtcgtggtgctcgccctgatcggcgtcccgggcgggcagctcagctccgggccccgccgcacactggacgtgcccggcgcggtgctggtcaccggcggcgtcggtgcgctcgtgctcgggttgctgcgcaccgaccactacggctgggcctccgcgaccaccctggtcaccctgggcatcgccgtactgctgatcgtgctcttcctgctctgggaggcccgcgggatcaagagtgatccactcatccggctcggcctgctggccaagcgcaacgtcgccggcgccaacctgttcatcctcctgctctgcgcgggccagttcgcggcgttctacttcatctcgctctacctgcaggacgtcctgcatctggacgcggcccgcgccggcgcggcctttctgccgctcaccctcaccgtggtcgtggcgatcaacatctccacccggctggttccccggctcgggcccaaacctctgctggtgaccggcggcctgctggccgccgccgggttcgcgtggttcggcgccctcgacgccgacggcggcttcctcaccgacctgctgggcccctcgctgctcaccgggctgggcatgggcctgtccttcgtgccgctcaccggcgccgcggtcggtggcctcccgcggcacgaggccggcatggcctcggcggtgctcaacagctcccggcagatcggcggcgccctcggcctggccgccctggtgaccgcgcaggcgtcgcgcaccgatgcccggctcgccgccggtgacccgcctctggaggcgctgaccagcggattcgggatcggcctgagcctgtccggcgccctactgctggccgccgcactggtggccctgatcgtgctccccggtaagcgggccgccggcgtcccggccggcgagccagcggcccagcgcggcgcgtcgtcgtcttccccgtggccgacgaacgcgcccgctgggtcgcccccgctcgacgccgcctcgtccgtgaccgagccgaggtga

SEQ ID NO: 5086 - DNA, 1767 bp, Actinoplanes utahensis
atgaccccgccgaccggcctctggccactgctccggccgcaccgctaccaactgctgggcgccctgctcctgcagaccgtcagcgccgtcggcggcgtcgtgccctacctggccgtcgtcgagctcggccgcgagctgctcgccccgcacgcccccgaccggcaccgggtctggctcgtcgtggcggccggtgcggccggcctgctggtccggctggtcgccggggcactggcctcggccgtcgcgcacgccgccgacagcagcctccagctgtcgttgcgccggctgctggcgcgtcacctgaccgccgtgccgatgagctggttctcccgccagagcgcgggcggcctcaaccagatcgtccagaacgacgtcaacgacctgcacacgctggtcgcgcacacccccggcgaactgacctcggcggtggtggtccccggcctcgccctggtctacctggccgccgtcgactggcggatgacgctcgtggcgctcgtcccggtcctggtcgggctcgtcctgcgccgggcgctgtccaccgagcgacgcaagcgcgacgagcaggaggtggacgcggcgatggggcgcatcgcggtcgcagcggtcgagttcgtcgagggcatcgcggtggtgaagacattcggcgggggtggccgtgcccaccaccgcttcgtcggcgccgctgacgacttcgcccggctcttcctgcgctgggtgggcagcgcggcctggctcgcgtccctggccacgctggtgctgtcgccgatggtggtgctgctgaccgtgctgaccggcggcgccgcgatgatcggtgcgggtgccctggcaccggccgacctgctgccgttcctgctgctgtcgctggccctgaccgcgccggtcgccgcgctggcccacggcctcgacaacgtcaacgcggcccgccgggcggccggccggatcggggcggtactggccgagccgcccgccccgcgtcccgcggcgccgcggctgcccgacggccacctcatcgagctgcgtgacgtcgggttcgcctacgacgaggagcaccccgtgctgcaccacctcgacgtggtcatcccgcccggcagcaaggtggccctggtcggtccgtccggggccggcaagtccacgatcgcgcagctgctgctcggcttcctgaccccgaccaccggatcggtccggctcggcggcgtggatctgcgcgacatcgagccgtcggcgctctaccggcggatcgcgttcgtgccgcaggacgtgcgcctgctgcgcaccagcgtggccgacaacatcgcgctggcctcgtcgtcggccgggcgcgacgaggtggtggccgcggcccgcgcggcgggtgtcgacgaccatctgggcagcctgccccgcggctacgactcggtggtgggcgaggacgccgggctgtccggcggcgaggcgcagcgcgtctcggtcgcccgggccctgctgctcgacgcgccggtgctggtcctggacgaggcgaccgcgttcgccgacccggtgaccgaggcggcgacccgcgcggcgatcgaccgcgccgggcagggccgtacccgggtggtgatcgctcaccggctggcgacgatccgcgacgccgacctggtcctggtcctgtccgagggccgggtcgccgagcgcggcaccttcgacgaactgctcgccgccgacgggctgctcgccggcatgtggcgcgcccagcaggaggacgccaccggggtggcgaccgcgccgcagagaggaaccgtactgtga

SEQ ID NO: 5087 - DNA, 1710 bp, Actinoplanes utahensis
gtgatcaccctgctgtcgcgcatcctcggacccgactatgcgcgcccgctgcaccgggcgatcgccctgatggcgatcgcgtcgatcgccgagggcctggcctacgcgctgctgatcccgctgctgcgggcattgctggccggcgacacatcgggcgccttgccgtggctgggcgcgttcgccggtgcgacggtggtcgccctgctgctgcggttccgcagcgacgtcgccggcttcgccaccggcgccgcgctgtcccggggactgcaccaccgcctcggcgaccacctggcccgtttgccgctcggctggttcacccgccgccggctcggcgaggtcggcatgctcaccagtcgcggggtgctgtccacgatggcggtgcccgcccaccggctgcagccgatgatcagcgccgtgctgaccccggcgaccgtcgcgctcgtgctcttcctcgtcgactggcggctggcgctggccgcggtgctgaccgcaccgctgatcctgctggcccaggtctggaccggccggaccaccgcgagcctcgatcgggagcgctcgatcagtgccgacgaggccgcgagccgggtcgtggagtatgtccgggcccagccggtgctgcggatgggcggcaccaccggccgtggcttcggattgctcgactccgcgctggtcgagcagcagcgcaccgggcgccgggccgcgatcagggcgatccccggggtgctggcgctgtcgctcacggtccaggccgggctgaccgcgctgctcgtgctcggcgcggacctggccctcggcgggcggatcgcgacggtcgacctgctggtcgcgctgatcctggccacccggtgcgtcgacccgctgctgtcgctgtccgacctcgccggccagatgcgcaactcgcgggaggagctggaacggatcgacggagtgctgtccactcccacgctgcacgagccggccgagccggtcgcggtgcgcgccggtgatctcgaactcgacgacgtcaccttccggcgtgatggccgcgaggtgctgcacggcgtctcggccgtcgtcccgaagggggcacgcgtggcgttcgtcggcccgtccggcgccggcaagagcaccattctgcagctcatcgcccggttccatgatccatattcgggaagcgtcagactcggtggaaacgatctcaaaacgctggcgtccgggcagctcgcgcagaacgtttccatcgtgtttcaagatgtgtatcttttcgacgggacgatcgcggataacgtgcggatgggccgacccgaagccaccagcgaagagctttccgcggcggcccggtcagcgcatttgacggaggtgatcgagcgtcttccgcagggctgggacacccgggtcggcgagggtggcgcggcgttgtccggtggcgagcgtcaacgcgtttcgatcgcgcgtgcgctgctgaaggacgcacccgtgctgctgctcgacgagcccaccgcagcgctcgacccggtcagtgaagtagcagttcaaagtgcgttggacggtctcatggtcggccgcacggtggtcatggtggcgcaccgtctgcgtaccgtgcggcatgtcgaccgcgtctatttcgttgaggaggggactatcgtcgagtcggggacccatgacgagctgctcgcgcagggaggccggtatgcgaatttttggaacatgacgcatatgaggcactgttaa

SEQ ID NO: 5088 - DNA, 1923 bp, Actinoplanes utahensis
atgccgacgaattccgcgctttccgaaaacagcgataccatcgatcggagctcttattcacaaggtgctgccgacgatttacgagccttcgcctcgacactattgggcaggtcgctgacccccgacaccgacggcacgtcactgatcgagctcggactgcagtcgttgcacctgatgcggctcgtcgggcggctgcggcgggcgggccggacggtcggcttcgccgagctggccgccgatccgaccatcaccgcgtgggcccggctgctgggcgacgatccccccgcggaaccggcggcggaccgggagccggcgggcgacgagcccgccggcgacgtgccgttcacgctgacaccggtgcagcaggcgtactgggtgggtcgcggcgacgaccagccgctcggtggtgtcgggtgccacgcctatctcgagttcgagacgcgtgacctggacgtcgcgcggctgggcgaggccttccgcgccctgctcgcgcggcacccgatgctgcgcgcggtgttcgccggggacggcacccagacgatcgccgccgagtcgggctggtccggccccgaggtgcacgacctacgatcgagcacgccggccgaagccggggcggcgctgcgccggcttcgggagggcttgtcgtaccggcggttcgcggtgtcccgcggcgaggtcgtcgacctgcaggtcagccgcctgcccggcatggaccggctgcatttcgacgtcgacctgctggtctgcgacgtgcagagcatccgggtgctgctggccgacctggccgcgctctacgacgggcggcggccacccgagctgagcctcaccttcgccggctacctgcgccgccgtgccgcgggcgacgcgccggcccgggcctcggcccgcgactactggcacgcccggctggccgacctgccgggcgggccacgccttcccctcgcgatcgagcccggccggctggacaccacccggttcacccggcggatccggcgattgagcccaccggaatgggcggcgctgggacagcgcgccgcggcctgcggagtcaccccggccaccctgctgctgaccgcctacgccgaggtcctctcgcgctggagcggcgaccggcggttcctggtcaacatcccactcttcgaccgggatcgcgaggtccacccggacgtcccccacctgatcgccgacttcaccagcctcaccctgctcgacgtcgacctcgacgccgccggcgacttcgccgggcgcgcccgggcgatccagcgacgcctgcacgccgacctcgatcacagcgcctacagcggtgtcgaggttctgcgcgacatgctgcgcgccgacccggaatcgccgcggaccgcgccggtggtgttcgcctgcaacgtggacgcgccgctggtgccgcccgccttcgccgagcggttcggtgacttcacgttcatgctgtcccagaccccgcaggtctggctcgacaaccaggtctacctcgaccacgacggcgggctgacgatcgcctgggacgccgtcgaggacctcttcccggtcggcctgctcgaccacatgcaggacgcgtacgccggcttgctgcggtcgctggtcaccgccgagtgggccggggagccggcgatcggcctgccggagagcacccggtcgcgccgcgccgaggtcaacggagccgtccgcgcgcacagcgggctccggttgcacgacgggttcttcgcccgggcggcgcgagaccccgggcggccggcgctgctcgggggccacgacggctgcctgacctacggcgagctcgccgaccgggcgtgccggatcggcgccgccctgcgagcccggggtgtcggccgcggcgacaccgtgctggtgagtgcgcccaagggggcggatcagatcgcggcggtcctgggcgtgctcgccgctagctag

SEQ ID NO: 5089 - DNA, 1023 bp, Actinoplanes utahensis
gtggacctgcccggcgtcgccgactgcctgcgggcggccggtgaggtggtcggcgcggccgtcaccgcgcccggcgcggccggtctggtcgtggagtacgccgcgcacggcggtcgcacggccgacctgctgctggccggcggcacccgcggcgagggcacgacctacgtgacggtcagccgcttcccggaggtgccggcggccgcccgggcccggctcgccggtacggccacgatccgtggcgaggacggcacgacggtgccggacgacctgctgcaccgcgccgacatcgggctgatcaacgacacgttcgcgatcacctcaccggccgaggcactggccggtctgcggcccatgctgcgccccggcgcccgggtgctcgtcgtggccggcgccgaggacagcccgtccgcgctggtgctcggtccgctgctgcgcggcccgggtccgcggcgggccgccccgccggtcgcgtcgtggctggccgggttcgccacggccgggttcaccgcatgcgagatcgtgtgccccggcaacggcgtggccctgatcacgggctgcctcgacgagaccgccccggtcgtggccgccggccgggtcctggactgggtcgcgacgcgcctgcccggtcacatggtgccggcccggctggtggtggtgccggccctgccgctgagtgccaacggcaaggtggatcggggcgccgcgctgcggctggccgcggccaccccggtaccggcggccgagtccgcggcgccacggggacacctcgaggaggccgtcgccggactgtggcggcgctcgctcgggcgggacacggtgggccgccacgacaacttcttccaggccggcggcgacagcgtgctggccacccggatgctcgccgacatccgggcgacgttcggcacgaccctgccgatggtcgacgttctgcgggcgccgacggtggccggcatggcccgcctgatcatcgagcgctccggcgccggtgccaccgaagagacggaatccggcgtgctctag

SEQ ID NO: 5090 - DNA, 810 bp, Actinoplanes utahensis
atgacaacgaccgaagaaaccgctgcgcgcgcggcgcagggaccgctgcgccgatacgccgtccgcccgcacgcccgggcccgactcgtctgcctgccgcacgcgggcgggtcggccagccagttccgccggtggtcggtggacgcaccgtgggatgtggagatcctcgtggcccagtatccgggtcgggaggaccgctacggcgagccgcctcacgaggcgatgtccgccctggtcgccgaactgctcccggcagtcgtggccgaccgcggttcacccgcgcgccgaccgaccgtcctgttcgggcacagcatgggtgcctcggtggcgtacgagctcgcgtgccggctcacggctctgggtgacccgccggccgggctggtcgtctccggccagcccggacccgggcgcctgcgccgtaccagcctgcacacggccggtgacgacgagctgatcgcggatctgacccggctgcggggcaccggcgaggccgtgctgcgcgaccgggcgctgctcggtgcgctgctcccggcgatccgcagcgactaccgggtgatcgagacctatcggccaccggtccaccgcccgctcggcattccggtcacggcgctgcgcgccgtcgacgacccggaggccgacgcggacgaggtccaggcctggcgtgcggtcaccaccggcagtttccagacgtacgtgctgccgggcgatcacttcacgctgctggaccccggcggcccggcgctggcccgggtcatgtccgccgtgcgcgcggcggtcggtgccaccgtgtccccaaccttcgcgccctga

SEQ ID NO: 5091 - DNA, 1635 bp, Actinoplanes utahensis
atggacagccgcgtgctcgaaaactgtgttccctggcccgacgagatcaccgtcgcctatcggcaggcgggttactggaccgacgaggtcctcggtcgatggccggccggtgaccccggccgcgccggccgccccgccgtggtgaccgccgggcgcacgatgacctacgccgaactcgaccgggcggccgaccgccgcgcggccggcctgctcgaccgcggcatcggacgtgccgaccgggtcgtcgtccagctacccaacgacgtcgacctggtcgtgtgcatcctcgcgctgctgcggatcggcgcactgccggtcttcgcgctgcccgcacaccgcaccatggagatcgtcgacctggtcgaggcgtccggcgcccgggcgtatctgtgcgccgacgtgctcctcggtcacgacttccgggccatggcggccgaggttgtgcggcggacctcgacgctcaccgaggtcttcgtggccggtgcgcccggcgacttcaccgcgctcgccgacgtcgacgccgagccacggccgatcaccccgccggcccccggcgacgtggcgatgttcctgctctccggcggcaccacgggcaagcccaagctgatcccgcgcacccatgcggattacgcgtaccaactgcgcgccagcgccgaggtctgcggcgtgggcccggacagccgggtgctggcggcgttgcccgtcggacacaacttcccgctgggctgcccgggcgtgctcggggtgctgcgcgccggcggcgtggccgtgctggcgccgtcgccggcgccggacgactgcttcccgctgatcgcgtcggcgggcgtgaccctgaccgccctggtgccgccgatggtgccgctctggctggaagccgtcgagtggctgccggacgacctctcctcgctggaggtgctccaggtcggcggcgcgcgcctggatccggtgacggcgggccgggtcgtcggcggcctcggctgccgcctgcagcaggtcttcgggatggccgaggggctgctcaacttcacgcgcctcgacgacccgccggagctggtgctcaccacccagggccgcccgctctccccggccgacgagatcaggatcgtcgcgccggacggcacggaggtcgccccgggcgagcccggcgagctgctcacccgggggccgtacacactgcgcggctactaccgggcgcccgaggtcgaccgggtccgcttcaccgaggacgggttcttccggaccggcgacgtcgtccgggcccggcgcaccggtcacctggaggtggtcggacggatcaacgacgtcgtcaaccggggcggcgagaaggtgcccgcgcaggagctggaggagctgctgaccacgctgccggcggtggccggcgccgccgtcgtggccgtgcccgacccggacatgggcgagctgacctgcgcctgcatcgtcgcccgggagtcgcagggcgcaccggagctgcacgagatccggggcgccctgagcgagcgcggggtggccgccttcaagctgccggaccgcctcgtcgtgctggaccgcttgccgctcaccgccgtcggcaagatcgacaagaaggccctcgcggcgcgcgccgccgtgcagacgaccggaggaggagcccgatga

SEQ ID NO: 5092 - DNA, 1311 bp, Actinoplanes utahensis
atgaccaggcactatcgaaccgcggtgatcgagacgagcgacgagccgatcgcctgcgccctcgcagtggccgacctgttcgacgactacgtcgtctacgaggcgccggacggctggtacgtcgccggcggctgggccgccgaggtcgtggtcgggccgcggacggtgcggtgcgtccacgacggacaggtcaccgagacgccgtgggacgacgacccgctcgtgccggtgcgccgcttcctcgacgggctgcccctggccggctggcgggcgtacggctggtgcgccttcgagctgggcgcggcgatcgccggcctggagcccccggaggacgtgctcgcccacttcctgatccccaccgtcgagacgcggctgcgggggacgcaggccaccgtgcgcggcctcaccgccgaggacctcgccctggtggagcgccggctcaccacgccggtgcgccgggccggccgggccgccggacgcgcccgggtcgacctgggcgccggcaccgccgagtaccaggacgccgtggccaccctggtcggcgacatccgggccggaaagctggagaaggccgtgctgtcccgggtgatcggcgtgcccgagaagatcgacttcccggcgagcttcgaggtcgggcgccgccgcaacacgccggcccgctcgttcctgctcgacatgcgcggtctgcaggtcttcggcttcagtccggagatcgtgctgagcgtcgatgccgacggcacggtggtgagccagccgctggccggcacccgggcgctgtccggcgacgccgagaccgacgagcggctgcgccatcaactgcgcaccgaccccaaggagatccacgagcacgcgatctcggtccgggtcgccgtcgaggagctgcacgagccgtgccggccggacaccatcgcggtgtcggagttcatggcggtgaaggagcgcggctcggtccagcacctgggctcgcaggtgaccggccggctggccgagggccgggacgcttggtcggctctggccgccgtgttccccgcggtcaccgcctcgggggtgcccaagcaggccgcctacgaggcgatcagtcggctcgagggccagcggcgggggccgtacgcgggagcggtggtgaccgtcggcgcggacgggaccatggacgccgctctggtgctgcgcagcgcgtactcacgggacggggtgacctggctgcgggccggcgccggcgtcgtcgggcagtcccggccggaacgtgaactggaggagacccgcgagaaactcggctgcatcgccggttatctcgtggtcagcgaaggctga

SEQ ID NO: 5093 - DNA, 1866 bp, Actinoplanes utahensis
gtgtccacggggacgaacatccacatcgagttgctggggccggtccgggcctggcgcgacggccaggccgtgcacctgggcccgccgaaacagcgtgccgtgctggggctgctggccagccgggcgggcgaggtcgtcggcgtcgaacagatcgccgacgcggtctggggatccgacatcccgcagaccgcggccaacggcgtgcacacctacgtggcgggtctgcgacgggtgctcgagcccagccgcagccggcggcagaccggcgaggtgctggtctcggcggtcggcggctactcgttgcagaccgacgcgcgggccgtcgacaccgcgctcttcacccagatgatcggcgaggcccgccagctgcgcggcggcggcgacgtgaccggggcggtggagacgttcgaggccgctctcaagctgtggcgcggcgaggcgttcggcggcgtgcccggcccgttcgccgcgctggagcgcagccggttgcaggacctgcgcctgaccgcggccgaggaccacgccgcgtgcctgctcgacgcgggccgccacaccgaggcggtcggctggctgaccgaggcgatcggcgaggacccgctgcgcgaacggctgcggggctccctgatgatcagcctctatcggtccggccggcaggcgcatgcgctgcgggtcttccgcgagacctgtgagctgctgcgcgacgagctcggcatcgaccccagcccggagctgcgtgagctgcaccgccagatcctggtcagcgacccggccctgggcgccgccgccgcgccgccgagcaccccggtcgccgtggttccaccgctcccggcggcgccaccggtgcagttgccggccgtgccgtccgggttcgccgggcgcgacgaggaactggccctgctcagccgcgagctgctgcgcgcggacggggacgagggagcggtccggctcgccgtggtcgacgggccacccggggtgggcaagaccgccttcgcgctggagctggccaagcgcatcggcgggtccttcccggacggtcagctcttcgtcgacctgcgcggcaccgacccggccagcgcgcccgccggcccggccgagtgcctgctgttcctgctgcgcagtctcggcgtgcaggacgcgcgcatccccgatgacctggtcgggcggatcgcgcactaccagagcctggtgcacgcacggcgtctgctgatcgtgctggacgacgcccgcagcgccgaccaggtccggcccctgcttccgcgcggttcgtcgtgcgttctggtgacgagccgggtccggctcagcggcctggtcgcccgcgacggggcgcaccgggtgcccatccggccgctcgatccggaggtgtcggccgaactgctggcgcacctggccgggcgggagcggatgcgcccggacagcccgatcacccggcgcctggcgcacctgtgcgggcatcttccgctcgcgctgcggctggccgccaacgcgttcgccaccgatcccggccatcccccggccgagctgctcgaacgttacgtcgccgagcccagccggctggaccggctggccgtcgccgacgatgcctcgaccagcctgcgggcggcgctggacgtctccttccaggcactgccggacgacgccgcccggatgctgcggagtctgggcgccgcccggcgcgagacgatcaccgccaccttcgccagcgcggtcaccggcgctccccggcagcaggtgcagcagcagctgaccgtgctggccgacaaccggctgatcgaggaggccggcccgggcgagtaccggctcaacaacctggtggccctctacgcccgggagtgtgcaggcgatgccggccgggagcgggcgtcctga

SEQ ID NO: 5094 - DNA, 1605 bp, Actinoplanes utahensis
atgcgtgtcttgctgatgagtgggctcggccccgccaacctcaactcgggatacctctccgggtcgctgctggagggggaccgcggcccacgggcgacgcaggtgctgcagcgggccgggcaccccgacctggacgtgaaccagctggccttcgagaagggtgggcgccggtacgcactgctgcgcccccgccccgactcggtgccgcacctgacctcggtcaccctcacctcgatcctggccgccagcggccacgacttcgtgcgggtgccgctggaggaggtgtggacgtcgcaggcccggccaccttccggtgacatcgacgtggtgctgctctcctcgaccttcatctggaacgaagggatcgtggccaccgcgctgaagtggatcgccacgcacgtgcccgacaccccggtggtgatgggcggccagtacacgaacctgaagttcatgccggtgatgcgcgatcaccccgaggtgatcgcggtggtccgcggcgacgccgaggagagcctgccccgggtgctcgacgccctgcaggccgcagccacgctcgacggcatccccaacgtggtctggcgcgacgggccccggatccagatcaatcccctcgcgtacgtcgacatggagctctttccgtccccgacggtgagcggctcggcgccgatcgtcccctacgagtcgatgcgcggttgtccgttcgactgcaagttctgctcgttcccggccgcgtcgccgaagtggcggtacaagtcggccgagaagatcgtgcacgactggacggcgtacgccgcgcacaacgacgccaagatgatctcggcgatggactcgaccttcacggtcccgccgacacgcctgcgtcgcctgctggagttgctgcccggcgccgagacgccgccgtgggagggcttcagccgggccaacaccatcaactcgcccgagctggtggagaacctggcccggtcgcggtgccggcaactgcacatcggcttcgagtcgatgaacgacgagacgctcaaacggatgagcaagcgggtgagcgtacggcagaaccggcgggccggtgagttgctgagccgcagcgacgtcggctattacgtcttcttcatcgtcggctacccgggggagacccccgaggcgttcgccgacaccagcgacttcctggtcgacgagtacgtcggtcacttcgcgctcagcaggttctcgatcaccgacgagacgatgccgctctggcaggaccgcgacgagctgcgcatcgtctccgacgacccgaccgatccgaccgccgcgtggtcccacgtcggcatggacagcgccgaggcgtcccggttgcagaaggagaccctcgaccgggtgcgccacggcagcgagacggccgtgctgcacctgtggcagcactccttccagcactggctcatgccgcaccgggaccgtttgaccaacatccgggtcgagaagtgcgtggaacggatggcgatggcaccggtcgactatcccgacgtcgcccaggcggcgaaggtcgtcaacgacgaactcggcaaactgcgcgacctcggcatcgaacggaccgacgattcccggacgctgtgccgggacgcgatatag

SEQ ID NO: 5095 - DNA, 1260 bp, Actinoplanes utahensis
atgtcctcccagctattcggagtccccgacgaattcgacgtcatcgtcatcggcggtgggccggccggtgcgaccacggccggtctgctcgcccagcgggggcacagcgtcctggtcctcgatcgcgagcggttcccgcgctaccacgtcggggagtcgctgatccccgccttcatgcgcccgatgaaggagctcgggctgaccgagcggatggacgcccgcggcttcgagcgcaagtacggcggcaccctcatctggggcaacgagcaggtgccgtggcagttctcgttcatcgagggcgggtacgagtacgcctaccacacccgtcgcgccgacctggacgcgctgatcctcgaccgggcccgtgagctgggcgcctgcgtcgtcgaggacgccacggtccgcgagacgatcgatgtcgacggccgggtcaccggcgtccgctacgcgctgcgtggcggcgacggcctcgtcgaggcccgggcccggctggtcgtcgacgcctccgggcaggcccgggtgatcggccgccggcagaccggcgtgaagtggcacgacgaactgcgcaacgtcgccgtctggacctacttcgacaactgcgagcggctgcccggcgacgagtacaccaacatcctcatcgagggcctcgacgagggatggttctgggggatcccgatcgacaagggcacgatcagcgtcggctacgtgacgcgcgcgtccatggccggcgagggcgaccagaagctcgagcagatcttccgcgagcaggtcgagcgcaccaccaagctgaagaagatgctcgcgcccgggcggcgctcggccggattccggacggcccgggactggtcctatcacagcgaccgtttctacggcgacggatgggttctcgtcggtgacgcggcagccttcgtcgacccgctgttctcgaccggtgtcgccctggccacgctggccggcagcaccctcgcgaaaatcgtcgaccagatcatcgagcacccggagatcgaggagaaggcactggaccggtacgccaccgcgtactcgaatttcttcgacgagatccggacattcgtcgagcggttctacgaccgtacgaaatataaggagttttatcacagcctggcgcaggaaatggttgatccggagcagaagaacaagccgtcgcaggacttcgtcacgctgatctccggaatgagcggcaaacacgcgatgttccacatcgacctcagcgacctgatcgccgcggacgacgggcgatga

SEQ ID NO: 5096 - DNA, 1275 bp, Actinoplanes utahensis
atgagcagcacccaggtgcagctgctcttcgtcgacctggccctcatcctgctcctcgcccaggggttggggcggctcgccgtcctggtgcgccagccgccggtgatcggcgagatcgtcgcgggcatcctgctcggccccaccctgctgcacggccggctgtccgccacgctcttccccggcggcgtccggccactgctgggcgcgatggctgccctgggtgtgctgctgttcatgttcggcgtcggggtggaggtcgagcaccacgtcctgcgcggccggggacgggccaccgcgctgtgcgccctgggctcgatgctcgtgccgttcctgctcggcgccggactcgccgggacactgctgtccggccaccgcacggcgagcccgaccggatacgtgctcttcgtcggtttggccgtttcggtgaccgccttcccggtgctggcccgcatcctcagcgaccgcgggctcgcgacgaccgcggtcggcggggtggcactggccgtggccgcgctcgtcgacgtgatcgcctgggccgcgctggccggcgtgcaggcgttcaccggcggtcccggacagcactggcgggtggcgctgatcctgcccttcgccgcgttcctggcgttcgtggtgcgcccgctggcccgccgctggctgctgtccgcccgggccggcgccgacccgggggagccgtcgccgctgcgcttcggcgtggtggtgatcggggcgctgctcagcggcgcggcgaccgaggtgatgggcctgcactatctcttcggcgccttcatgttcgggctggtcatgccccgtgagggggcccgtgggctgcgcgacggtctgttgcgtcaggtcgggcgggtcaccgcgctgctgctgccggtctacttcgtcgtggccggcctgcaggtcgacctgagccacctgggcgtcaccgcgttcctcgaactgggcgcgatcctggtcgtggcgatcgccggcaagttcgccggcgcctacctcggcgcccgcacgcagggcctggccgcccggccgtcggcggcgctggcggtcctgatgaacacccgaggcctcaccgagctcatcatcctgggcgtcgggctccagctcggcctgctcgacggcggcctctactcgctgatggtggtcatggcattggtcaccaccgcgatgaccggaccactgctggccctggtctaccgcaagcccgtcgagatcaccgtcccggccccggccgcgtcccccgcgctgtccggcgcggccggccgcgccggctga

SEQ ID NO: 5097 - DNA, 1659 bp, Actinoplanes utahensis
atgaatcagcacatcgccggcaagcgagacacctacgacgtcgccatcctgggcgccggcatggccggcggcatgctcgccgcagtgctcgcccgccacggcgtacgggtcctgttgctcgacgccggcgtccacccccgcttcgccgtgggggagtcgaccatcccgtacacctccggcatgacccggctgatcgcgcagcgctacgacgtccccgagctcaaggcactgtccagcttcaagggcatccgcaccagggtctcgcgctcctgcggccagaagcagaacttcggcttcgtctaccaccgggagggacaggcacaggatccgggacagatcaaccagctggtggtcccgtcggcgatccggaccgagacgcacctgttccggcaggacgtcgacgcctacctgttccacctggcggtggccaagggggccgtcccgcgactgggcaccaggatcgagaacatcgagatcgacccggacagcggggcggtgctgcgcagcacgaccggcgaggagttccgggccgcttacgtcgtcgacggcagcggcttccggtccccgctggccgacgcgttcagcctgcgggagacgccgacccgggcgcgcacccacagccggacgatcttcacccacatggtcggggtcacgccgttcgacgacgcgccggcggcccggcaccacaagaacccgaacccgtggcaccacggcaccctgcaccacgtcttcgacggcgggtggctctgggtgatcccgttcgacaaccaccccagctcgctcaacccgctctgcagcgtcggtttgacgctcgacccgcggatccatccccaggacggccggtccgggcagcaggagttcgacgacttcctggcccggttcccgcagatcgcccaccagttccgcggagcgtccgccgcgcggccctgggtgagcaccggacgactgcagtactcggccaagcaggtggtcggcgaccggttctgcctgacctcgcacgccgccggcttcatcgacgccctctactcccgcggcctgaccaacacgatggaactggtcaacgccctggcctggcgcctgatcgccgccgcccgcgacggcgactggtcgaccgagcgcttcgcctacctggaggcgctgcagcaggggctgttcgacttccacgacgacctggtgtacgcctcgttcgtcgggttcggcgactacgagttgtggaacgccgtcaaccgcacctggatgctcggcacgatgctcggcaacgtcatgctcgaggacgcgtactaccgcttcctgcgcaccggcgacgacgcggtcttcctcgacctggagaacagcgcccgccccggctcgccgctgccggtcagcgacggcttcaaccggatgggcgtgctggcccgcgagctgtgcgagtccgtcgaggccggcaccaccaagccgggtgatgccgccgccgcgatcctcggccacatcggcggcgccgacttcatcgcgccctccttcgccttcggcgagcgcgacacccgctgcttcaacatgacgcccgccaagatggcgcgcaacgcggtgtggtgccgccgggaggccccgcccgagatcggccctcgaatgatcaacgccagcaagggtctcgtgcggatgcggctgcgcggcggcgagtga

SEQ ID NO: 5098 - DNA, 6183 bp, Actinoplanes utahensis
atggagacacatcaccacatggacgagaccccgcttgccgtggtgggcatggccggccggtttcccggcgccgccgacatcgacggcctgtggaagctgctgatcgacggcgccgacgccatcggcccggtcccggcccggcgctgggacgcgggcgccgtgctcgacccggaacgggcgatccagggcgtcggcggcttcatcgacggcgtggaggagttcgacgccgggttcttcggtgtctctccgcgcgaggcggccgcgatcgacccgcagcagcgcctgctgctggagacggcctggcgcaccctcgaggacgccggcatcccggcggccggtctcgccggatcccgaaccggtgtctacgtcggcgcctcctggcacgactacgagctggtccgtgggcgcagcgccgcaccggccacgccgcacagcctggtcggcaacgcgctggacgtgatcgccgcccgggtgtcctacttcctcaaactgcgcggcccgagcatgaccgtcgagaccggctgctcatcgtcgctggtggcgctgcacctggccgggcaggccctgcgctcgggggagatcggcgcggcgctggtcgccggggtcaacctcatcctcgacccgcacgtcacggtcggcctgacccacttcggggcgctctcgccggacgggcgctgcgccacgttctccgacgaggccaacggtttcgtccggggcgagggggtcgccgcgctctgtctcaagactctcgaccgggcgctggccgacggcgaccggatccacggggtcatcgcgcggaccgtggtgaacaacgacggcggcggggagagtctggtcactcccagcccggacgggcaggaggacctcatccgctcggcgtacggcccgccgggcgagcccaccggtccggcgcccttctacatcgaggcacacggcaccggcaccgaccggggcgacccgatcgaggtcaccacgctcggccggctgctcggccgtcccggtgacgaacccctgcacgtcggatcgatcaagacgaacatcggccacctcgaggcctgcgccggcctggccgggctgatcaagctgctgctcgtgctgcggcaccgggtcgtgccgccgagcctcaactcggcgcgcctcaacccggccatcccgttcaccgacctgggcgtgcgggtggtgcgtgaaccggtgccggtgccggccggccccgtccggctgggcgtgagctcgttcggctggggcggaaccaatgcccacgtggtggtgcaggacccaccggtgggcgggccggaggccgggcgggacggggcttcgaccggacttcccccggtgaccatgctgtccgccaaggactggccgtcgctgacccgccgggccgctgacctggccgccgccgtacccgccgccgccgaccgggtgcccgggctggcgggcaccctggcctggcgacgcgaccacttcggggtgcgggccgcggtggtcggatctcggccgcaggagctgcgccggctgctcgacgcgctggccggccgggccgaggacgcccaggacgaccccggtctggtcaccggccgcgcggtcgagaccggccgggtcgcgttcgtctaccccggccagggcgcgcagtgggcggggatgggccgcgagctgtaccgcgacagcccggtgttccgggacgtgatcgaccggtgcgccgtggccctgcgcccgcacctcgacgaggacctgctggacgtgttcgccgccggcggcgacgaccgctggatggaccgcctcgaccggctgcagcccgtcctctgggcgaccgcactcggcctgaccgcgctgtggcgtgcctgcggcgtggaacccgacgtggtgatcggccacagccagggcgaggtggtggcggccaccgtcaccggcgcgctcagcctcgacgacgccgccctggtggtggcccggcgcagccggatcgccgcccgcaccagcggtcgcggccggatgctcatggtcgacctcgacgtcgactcggcgtacgccgcgctggagggtttcgaggacaccgtcgcgctggccgcgcacaacggaccgacctcgtgcgtgctctccggcgacgccgactcggtgctgatcctcaaggaactgctggaggccgagggcacgtactgccgcctggtcaacgtcgactacgcctcgcacagcccgcagatggacgcgctgcgccccgatctgctcgacgcgctgagcgccgtccggccccggccgggccgtcccgcgatgatgtccacggtgcgccgggcgctggtgtccggcaccgagttggacgccgcctactgggtggacaacctgcgccgtccggtgatgttcgcggacgcgatcggcgacctgctcgacgacggcgtcacgcacatcgtcgagatcagcccgcacccgatcctggtcaccccgatcaagcgggtctcggcacggcgcgcgcacgccccggccgtcctggcgaccctgcggcgcggtcagggcactgtcggagacttcgcgacggccgccgcggccgcctacgtcgccggcctggagccgttcggcggcctgccgcgcgagggtgtggccgccgcccccggatatccgctgcggccggagccgtactggccggtggaggcccccggcgcctggtccggcacccagggcttcgccgcccggctgcgcccggcaccggacgacccgggcagctggaccgccaccttcacgctctcctgcgccggggtgccgtggctggccgagcaccaggtgcacggtgtgccggtcctgccgggcgcggccgtgctgacggccctgctgtcctgcgcacggcagcggtggcgggcggccccggggctgatcaccgggctgcggctcaccggcgcggtggctctcggcgaggccccggtcgggctggccgcccactggcgcgacaccgcccggggcgccaccgtccggctgctcgcgctgcccgaggcggccacgacgtgggaggagaaggcgaccgctcgtgtcgtccgcgctcagcagccccgcctggcgccggccttccccgacgatctcgccgcccggctcacccatgacgccgacgacttctaccgcctctggcacgggcgcggcctgcagtacgggccggctctgcgcggcatccggcgcctggccgccggcgacgggcgggcgctgggcgagatcgtgctcgccgagcggctgcgcgcggccccgtcccacggcgccccgcatccggccctgatcgacgccgcactgcaggtggcactggccgcctgtgagccggccggcgacaccgccgtggtgccggtcgcgctgggcacggtcgagattctgcgggcgcccgaggacaccacggtcacgctctggtcgtacgccgagcgccgcggtcccgccgatgccgacgtgatcgtcttcgacgaggcccggcacccgctgatggtgctgcgcggcctgcggttcgagcccctggccgagcacggcgcgagcgcggacgacgcgttgcgctaccacctcgcctggaccgagccggtcgagccggaccccgtgcccgtccccggccgatgggcgctctgcaccccgccggccgggtccggtgacgcgctggccgaggcgatggcggagctgggcgccgaagtcgtgcctcaccggtcgggcgacaccgtgcccgacggcctggatggcgtcgtcttcctcgcgccgtccgcgtccgccgactgcgaaacccaggaacgtgggctcagcgcgctggccggcctcgccaccgccggcaccgccgccgggaccacgccgcgcctcgcggtgatcacggccggcgcacaggccgtgacggccgacgacgtcgtgaacccctgcgccgcgctctactggggcttcacccgggtgctgcgccgcgagcacggcgagctcggcgcgcgcctgatcgacgtcgacgcggccggtccggagtgggccgcccgggccgccgccgaggtgctcggagcctccgccgaggaccaggtcgccctccgcgggcgacggcgtctcgtggcccggctccgccccgggccgggtgcgccgcccgtgctgcccccgccggtcaccccgccgcagccgttccgcggcgcggtgaccgacgcggggcagctgatctgggtgccggaccgcgtgcgtcgctgcggccccggcgaagtgagtgtcgcggtgaccgccgcggccgtcgacgagcatgacgaggcccggctgcgcggtgccgccaccggtgacggggacaccagcctcggcacctcctgtgccggcatggtcaccgcggtcggaccggacatcaccggcatcgcggtgggcgaccgggtcgtcgcctgcactccgggcgcgctggccgccgaggtcaccgtccgggccgatcacacccggccggcgcctccggcgctgagcgacgccgaggcggccgccctgccgctggtactcaccaccgcctggcacgccctggtccgcctgggtggggtggagaccggcgacaccgtgctgatccacgcgggcaccgacggcaccgccctggccggcgtcgcgctggcccgcctgcggggcgcccgggtgctggccaccgcgggtgacacgaccgcgggggaactggccgagtcggccggcgccgcgctcgtggtcgacacccgcgacccggactggacacggacggtgctgtccgccaccggtggccgcggcgtcgacatggtgctgcacccgcaggccaacccggacgtggagatcgaggacagcctgaccgtgctcggcgtcgagggccgcgtcgtggtgctgggcgccgacccggtccgggtgcacccaccggacctgctgcgtcccggcgtggggctcagcgtctgcgacgtccggcaactgctcggccggcacccgcaccgcttcgcccgcacgctcgaactggtgtgggatctggtggcggccggccgggtgccggccctgccggtgcggaccatgacgtacggccaagcggcccgggcggcgccggaccggaaccgccgcggcgcgcagcggctggcgctgaccgacccggccaccgccaccgaggtgaccccggtgccccgccccgacggtcagttccgggccgacggcgcctacctgatcaccggtgggctcggcgcgctcggcctgtcgctggccgagcatctcgccgaccggggagcgggcgccttggtgctgctcggccgctccggcccggaccccaccgcggagctgcgggtcaaggcgatgcgcgcccagaacgtccaggtcgaggtcgtcgccggcgacgtcgccgacagggacgcgctcggcgcggcgctggccggcgtccgggaccggatccccccgctgcgcggcgtcgtgcacgcggccggcgtcctcgccgacgccaccgtggccagcctcaccgaccggcacctgcacaccgccgtcggcgtgaaactcggcggagcccggcacctcgacgcgctcacccgcaacgacccgctcgacttcttcgtcctcttcagctccgtggccgggctgctgggcaacccgggccaggccgcctacagcgcggccaacgccgccctcgacgcgttcgccgaggcccggcgccgggccggccgggcgaccacgagcatccagtgggggccgttcgccggcatcgggctggccgcggccgagcggggacgcggcgaccggttggccagccgggggatgggcggcatcgagccggaggcggcgtgggcgctgctgaccgcggcgctcgacgaggaccggccggtcaccgcctatgtcgacctggacctgcggcgctggttcgacgcgaaccccgagacggcggccctgcccagctggcgcaccctgctcgagctctcgcgccgggacggcggcccggcggtcgccgacggcgacttcctggcccgcctgcacgcggcggagggtgcggaccggctgcgggtggccgagatcaaggtgcgcgagctgaccggccgggtgctgcggctggacccggcggccatcgaggccgacgccggtttcaagtccctcggcctggactccctgctcagcctggaactgcgcaaccgactggagtcgatcttcggcctgcggctgtcaccgaccgtgctctgggcccacagctcggcccgcgccctggccggcgcactctgcgagcgcctgaccccccacggaggaccgacgtga

SEQ ID NO: 5099 - DNA, 1536 bp, Actinoplanes utahensis
gtgacatccgagaccgaatccgccgaccggggcccgctgcgccgggccatggccacgatccgtacgttgcagagccgcctcgccgcccaggacgagaaccggcccgtggcgatcgtcggcgccggcctgcggctgccgggcgggatcacgagcctggccggctactgggacgcgctcgccgcgggccgcgacctggtcgctccgatgccggcggcccggcaggcccggttcgccgccgactgggcgacgctgccgcggcgcggcgccttcctcgacgacgtcctcggcttcgacgccgccttcttcggcctgagcccgcgggaggcccggcacctcgacccgcagcaccggctgttgatggaggtcgcctgggaggcgctggaggacgcggcgctgcccgccgaccgactcggcagccgctcggccggtctcttcctgggcatcatgtggcaggactaccgcgactggcaggccggcgagccggacgccttctggacgaccggcaacgggcacaacttcgcggccgggcggatcgcctacaccctgggtctgaccgggcccaccctggccgtcgacacggcctgctcctcctcgctggtcgccctgcacctggccgtgcaggcactgcgccggggcgagtgcgaggtggccctggccggtggggtgaacctcatcctgtcgccgcggtcgacgcggctggtcgtcgagacgcgctcgctggcgccggacggccgctgcaagagcttcgacgccgccgcgaacggcttcacccgcggtgagggctgcggcgtggtggtcctcaagtcgctcgacgcggcgcgccgtgacggcgaccgcatccatgcggtgatccacggatcggcggtcaaccaggacggccggtcgggtggcttcaccgtgcccaacgtcctgtcgcaggtgcggctgatcgaggacgccctcgccgacgcgcggctcaccgcggccgacatcgggttcgtcgagacgcacggcaccggcaccgcgctcggcgacccgatcgaggtggaggcgctggccgccgcgctcgggcgccgcaacggcggcgcgccgctgccggtcggggcgggcaagacgaacctgggacacctggagtcggcggccggcgtcgccgggctgctcaaggcggtgctcagcctccggcatcggcaggtcccgccggtcgtgcacttccgcaccctcaacccacggatcgacctcgacggcaccggtatcgtcgtgccggcgcggctcaccgagtgggcacccggggcgggccgctacgcaggggtcagctcgttcggcatgagcggcaccaacgcgcacgtcgtgctgggcgccgcggagccgtccggcccgccaccggacgacgccccggccccggccgggttcgagatctcggcccggaccgagccggcgctgcgcgagctcgccgcccggtacgccgcccggctggccacactgcccgccgccgacttcccggccctcgcgtccaccaccgcgaccggtcgcagccggctggccgagcgtgcctgctag

SEQ ID NO: 5100 - DNA, 1227 bp, Actinoplanes utahensis
gtggtggacctgccggccgatccgcggcccaccgacgtccgcccgatgctcgacctgatcaccgccgatgacccgccggagctgaccgccgtccgcgccggcgtggtgctcgccgcgcggctgaccccggcacggcccggcgcggggctgccggagttgcatccggacgccacctacctggtcaccggcggcctcggcgcggtgggccgccacctgaccgcggagctggtcgcccgcggtgcccgccatctgctgatcatcggccggcggccccgcgcggcgctgcccgacccggccaccggtttcctcgccgaactggccgctcagggagtcgacgtccactatcgcggcgacggctgcgacaccgccgtggacctggccgcggcctgcgctcccctcgccgggctgccgcccgtgcggggcatcctgcacctggccggcaccgtgaccagcgccgcccccgcagatctggacccggccgcgttcgccgcggccgccgcggccaaggccggcggtgcctggctgctgcaccgggccgccgtcgactggccgctcgacttcttcgtgctggtttcctcggtctcggcgctctggggctccaaggggcacgccgcctacgccgccgcgaacggcgcgctcgacctgctcgccgcgtaccggcgcgggcagggactcccggcgaccagcgtggcgtacgggccgtgggccctcgacggggagggcatggcggaccgggcgacccgggagcgcgccgagcgcaccggcatcggcgcgatgggcgcggccgaagcccgttcggccctggccgtggcggtgcccggcgccgcgggacacgtgatcgcctgtcgcgccgacctggttcgcctcggccgcgtcctgccccggttgcgcgccggcctgctggccggccacgccgaaccggtcaccgggacggccgccggaccggtcagcgggacgaccgccggaccggtcgcgccgccggcgcccgtcgatgccgccacggtgcgcgacacggtcgcccacctgctcgccgtgcaactcggctacgacggtgccgccgacatccgacccgacatgggcttcgccgacctcggcctcgactcgatcaacgcggtcgacctggccgagcggctcaccgcccggctgggccgggccgtgccggtcaccgcgctcttcgaccaccccagcgtggccgagctgaccgcgtacctgaccggcgctagctag

SEQ ID NO: 5101 - DNA, 5166 bp, Actinoplanes utahensis
atggcctgccgcttcccgcaggcggactcggccggggagctctgggaactgctggacgccgggatcgacgcggtcggcccggcgcccgcggaccgctggggcagcgggatcctgcgcggcgggcgggtcaccaccgaccagggcggctacctgcgtggcatcgacctgttcgacgccggcttcttcgacgtgccggcccgtgaggcgcgcagcatggacccgcagcagcggctgctgatggagacggcgtggcacgcgctggaggacgccggcatcgccccgtcggcgctgcgcggaaccgcgaccggggtgttcgtcgggatcagctacgccgactacgcccggctgttggcccggggcggcgccgacgacgtcgacgcctactacgggaccgggaccgcgctcaacgcgacggccgggcggctcgcgtacgccctgggactacacggaccggcgctggccgtggacacggcctgctcctcctcactggtggccgcgcacctggcggtgcgcgccctgcgcgccggggaagccgacgcggccctggtcggcggggtcaacatcctgctcgacccgatgtcgtcggtggcggtgagccaggcccacatgctggcgccggacggccggtgccggaccttcgacgccgacgccgacggcttcgtccgcgccgaggggtgcggtgtgctggtactcaaacgcctcgccgacgcccgccgcgacggtgacgacgtgctcgcggtgatccgcggcagcgcggtcaactccgacggtgcctcgtccggcctcaccgtgcccaacggcagcgcccaggagcggctgctcaccgcggcgctggccgacgccgggctgcccggccacgccgtgtcctacctggaggcgcacggcaccggcacccggctcggcgaccccatcgaggtggccgcggcctggcgtgcgctcggtcccggccgggacaccggcgagccgctgctggtcgggtcggtcaagagcaacatcgggcactgcgagtcggcggccgggctcgccgggatcgtcaaggtgctgctcgcgctgcgccacggccggatcccggcgaacctgcacttccgtacgcccaatccgcacgtggactgggccgggacgaatgtccgggtggtggcggccggaaccccgtggccgcgtggcccggttccccgggtggccggtgtctccggcttcggcttcaccgggacgaacgcccacctggtgctggccgaccccgatcagccctcggtgacaccaccgacccgacccggctcggcacacctggtgaccgtgtcggcgcccgacccggacggcctggcccgggtgaccgcggcctggcacgaccggctcaccggcgcggccgacggcgacctcgccgcgctggccgcggtgagcgggcgcggccgcacccacttccggtaccggcggtccgcggtcgggcgtaccggcgccgatctggccagggagctgaccgccgccggaccggtgtacggcgcggcgcaaccgccgcgggtcgcgttcctcttcaccggccagggcagccagtacttcggcatgggacgcgacctgtacgagacggagccggctttccgcgaggtgttcgaccggtgcgacgacctgatgcggccgcggctgggcacgagcctgaccgagctggtcttcaccggggaggacgcggccgcgctgcaccagacgagggtcacccaaccggcgctggtcgccctggcgctgtctctggtggcgacctggcgcagttggggcgtggagccggcgaccgtcctcgggcacagcgtcggggagatcgcggcggcggtctgcgccggcatcctcgacctgcctgccgcctgcgagttcgtggtccggcgggcggagctgatgcagagcaccgggcccgggcggatgctgtcggtgccggcgccggagaagctggtcgaggagtggatccgggacaccggcctggatctggccgcggtcaacgggccggaggcgacggtggtcgccgggccggccgacgcgatcgaggccctggccgcgcgcctgagcgccgagaacgtacggcaccggccactggccacctcgcacgccttccactcccggctgatggatccgatcctggaccggctgcgcggcgagctggccgggctgcgcacggcccccgagacgattccgctggtggccaacctgaccgggcagaccgggaccaccctcgacgccgagtactggtgcgagcaggtccgccggccggtgcgcttccacgacggcctggtacgcctgggcgaaatcggcgccgacgtgctgctggagatcggccccgaccgtacgctcaccaacctcgccggtgccgccgggctggtaccggccggtggggccgtgtcctcgctgcgccgggggataccggcacgcacggccatgctgaccgccgcggccgcgctgtaccgggccgggcagcggctggacttcgaccgcgtgcacccgacccgcccgggacgggtggacaccccgcgctatccgttcgcccgcacgtcgtactgggtgcggccgcaaccggtcgccgccacgacaccggacgcctcggccggcccggcgtggggaaccgaactgcgctcgccggcgctgccggggcgcgtgttcgcgagccatcgcagtaccacctacccggcccatctgaccgaccaccggctcttcggcacggtctccgtaccgggcgcatcccagctggccacggtcctgtccgcgctctccggtggccgcgacaccgtccggctgcaggacgtgcacttcccccgggcgctggtgctgcacgagggcgagcgctacgagcagcaggtgatcgagtcagcggggccggacggtcgccgggtcaccgtgcagagtctggtccacgaggagaccggccgctggcaggagcatctggtcgcgcggctgccggccgagccgcccgcgaccggcgccgacgacggcccccgggccgaccacctgcgtcaccgggctgaccgggagctgaccggtgaacggttctaccggcacctgcacctgctcggctaccacctcggcccgtcgttccgctggatcgaccacatctggatcgccggtgaccaggcgctggtccgcctgacccgcccggtcgagacacgggaggatccgggtgggtacgcggtgcacccgggactgctcgacagctgcctgcagagtgctgtctgcttcgccgtcgacggcgagccggacggcgagccggacagcgagccggacagcgggggcgcggggttggccatccccttctcggtgtcgcgcctggcctggcacgaacgcccggccgccgacgcggagctgtgggcccacgtgcgggttcggcgcgacgccgatggtgccgggctgctgcgggtgggctcggccgacatccgcctgaccggtccggatgggcggacgagcgtgctgatcgaggacttccggttccggtacgcgccgcgcgcgctcgtggaggcgtcgctgagcgcccgggcggaggtgcggcgcgtcgactggacgccggtcgtcgatgacggcgaacggccgggcagcgtgacggtgctcggttcgccgccgatcgagaccgcgttgcgggaggccggtctgcgactcaccggcctcgacgccgacgtgctggtcgacgcccggttcaccgccgatcggccggcccccgcgcagatcgccgccgaggtgacccggatcctccggacgctgccggcggatcgcggctacgccttcgtcggcccgcccggaccggacggccgccccgtcgtggaggcgatctccgggctgttggccggcctgcgggccgagcagccggaccggcgggtgcgcgtcgtcgagccccgcgaaggctggcgcccggagcacctcgcggccgcgctgaccgcggcgatcccggaggacggcgtactgctcgccgccggcccggacggcctgcgcgcccggcatctgaccggcctgcggccgccggcgtcaccaccggtctgggacacggccgggtcggcgctgatcaccggcggcctcggcgcgctcggcctgagcgtggcctcgttcctcgtcgcgcgcggcgtccggcacctcaccctgatggcccggtccgggcccgacgagccggcccgtcaggtcctcgccgacctggccaccgccggcgcgaccgtccaggtcctcaccggcgacgtcaccgacccggcggactgccgcacggcggtcgagcaggccggccgggacgcgcccgtacgcttcgtcctgcacctggccggtaccaccgacgaccgggccttcgacgggctgacgccggactcgttcgactccgtcttcgcggccaaggtcaccggggcggtccagctcgccgccgcggtcggcacccggccgctcaccgcgttcgtcctgttctcgtcggcgtcggcggtgctcggatcggccggtcaggccaactacgccgccgcgaacgggtacctggacgggctggccacggtgctgcgcggagccggcgttccggcgaccagcgtcggctgggggccgtggagcacccgctaccgtgacgggctcgccgacacccccgcggtacgccgggcgatgagcgtccgtgggctccgcgccctcaccgatgagcaggcctggccggtgctcgacgcggtgctggccggcggccccgatcggctggtcgtcgtggccgggggcgccgagccggccgtcccaccgtccccggcgccaccggccgcggcgaccgaccgtggctggctgcgcgaccggctcggcgacccggccgggctgcgggccgcgatcgggcggatggtgggcgaggtgctcggcgacccggggccggtcgaccccggcctcgggttcatggacctcggcctcgactcgatcatgacggtcgacctgcagcggcgtctctcgcacgcgctcggccgggacctcccggtgaccgtggcgctcgaccaccccacggtcgaccggctggccgcccacatcgaacccgcggtggccggggaggccaccgagccggcggacgacctcaatcggctcgaccgggacgacctcgatccgctcgaccgggacgacctcgatccgctcgaccgggacgacctcggcgagatgtccctcgacgacctcgtccgcgcggtccgcgccgacgtcgcgacggaagggtga

SEQ ID NO: 5102 - DNA, 1656 bp, Actinoplanes utahensis
atggaccagcaggagatccggcagctgatggcgacccagctggagaagtcgcgccggctgcaggcccggatcggtgagctcgaggcggcgtcgcgcgccccggtggcggtggtcggcatgggcctgcggctgcccggcggggtgaccacgccggaggactactgggacctgctgcaccgtcccggcgacgcgtcccgcgagatcccggcggaccgaccggggctgcgcgcggtctacgacccggtgcccggccgggccgggcggtcgtacgtggaccgcgccggcttcctcgacgacgtggccgatttcgacgccgagttcttcggcatctcgcagcgggaggcggcacggctcgacccgcagcagcggatgctgctcgagacggcgtgggaggcgctggagcgcgccggcgtcgcggtgcggcgcgccgaccggctcgacgtcggcgtctacctgggcatgatggcctcggagtacaacgagcggttcgccgaccgcggcgacgccggccgggtcgacccctactacaccaccggcggcggtctctgcttcggcgccggccggatcagctacgtgatgggcttcaagggcccggtgatcagcgtcgacaccgcctgctcgtcctcgctgtcggccctgcacctggccgtgcgcgcgctacgttccggcgagtgccggtacgccctggtctgcggcagcaacctgctgctgtcggccaacctgatggtctcgctgagccaggcacgggccctctcgcccggcggccggtcacgctcgttcctggccggagccgacggatacgggcgcggcgagggcgtcggcgtgctggtgctgcagcgcctggccgacgccgagcgggaacgccgtcccgtcctggccgtggtccggggcaccgcgatgaactccgacggcgccgcttccgggctgaccgcgcccaacggccccgcgcagcaggaggtggtccgggccgcgctgcgcgacgccggcatcgacccggctgagctcggctgggtcgaggcgcacggcaccggcaccgcactgggcgatccgatcgaggtgcacgccctggccgaggtgctgggcgagagcatccggcggcgcggcgtccccctggcgatcggcagtgtcaaggcacgcctcggccacctcgaggccgcgtcggggatcgccgccgtgatgaagaccgcgctgatgctgcggcacggcgagattccggcggcactggatccggaggacgggccgctcaacgagcacatcgactgggccggcctgccgttcaccgtgccccgcgaccaccaaccgtggccggcggtcccgggcgggcgggtcgcctcggtcaactcgttcggcatgagcgggacgaacgtgcacgcggtgctcgccgccgccccgccggtcccggacggcgacccggtcccgcccgagcagccgcatctgctcaccctgtcggcccgcagcatgccggcgctgaccgcgctggcccgggcggtggccagccggctgggcaaggcggcaccggccgagatcgcgtcgatctgccacacgctgcgatgcgggcgcaccgcgttcccgtaccggctcgctgtcgtcgcctcgaccgggccggacctggcggtacgcatcgaggaggcgctgcggcggccgatcgccgcctag

SEQ ID NO: 5103 - DNA, 531 bp, Actinoplanes utahensis
gtgcccgagccgggcaccggtccggcccggctcgcctggggtgaccggcggtatccgctgaccaccccggaactcaccctgaccgccgtcgcggccctgttcgaggacggcgccgacctgcggttcgacgccctgcgcggaccgcacgaccgtttcgtcgacgacctgccgacctatccgttccagcggcggcgctgctgggtggacgagccggtgccggacggcccggccgtgaccgccgcgcccgagcgggccgacggcgccgtaccggacgccgccgaccggacggccgtgcacgattacctggccgcgcggctgcgggaggtgctcgacgccgacgagctcgacgagcagcgctcgttcctggacagcggcggtgactcgttcgcctcggtgctgttcgtccagcgggtcgaggaggcttacgaggtcggcgtgcgccccgaggacctgccgctcgacctgccgctggccgagttcctcggacggctggcggccggcgtcacccggcgcaccgggacagcgtcgtga

SEQ ID NO: 5104 - DNA, 765 bp, Actinoplanes utahensis
gtgaccggcctgttcgtgcagccccgacgcctggccgacccggagctcaccctggtggtcttccaccacgcgggcggctcggcggccgggtaccacccgctcacccggtggctgccggcgagctgggatctgctgatcctggacatgccggggcgcggcaaacgcgtgcgcgaacccctgccggagacaccggcccggttctacgacgggctgcgccgcgacctgctgagcctgcccggcaccgggccgtacgcgctgttcgggcacagcctcggcgcggtcgtcgcggtggaggcggcgtacgcgctgcgcgagcgtggcatgccgccggtgtgggtgggcgtctgcggtcgtctcccaccgggccggtccctccgcacgcccggcctcgccgccgacatgcccgacgaccggctgctggcggcgctgcacgccctcggcggtctgcccgacggcctggacagcgtgcccgccttccagcggcgtttcctcgagctgctccgtcacgacctgcggatcctcgacgcgcatcggccggatccggcgcgcgggccgctcgccgtgccgctgaccgtcttcgggagcaccgacgacccgctgaccccggttccggagctcgccggctgggcggcggtgacgaccgccccggtccggcagcggatcttccagggcggccacttccccttccggcgcgacggcttccgggagctgggggcggcgatcaccaccgagatccgcgcgctgtcgctgaccgacgggagatga

SEQ ID NO: 5105 - DNA, 522 bp, Actinoplanes utahensis
atgaccatcgatccgatcatcggcacgcccccggccggcgacctgcggctgctgatggcgtcgttcccgaccggtgtcagcgtggtgaccgcgctgggggagtcggcggttccccgcggcatgacctgcacgtcgctgtgcagcgtgtcgctggacccgccggtcctgctggtctgcctgcgctcggacagcccgacccgggaagcggtggcgagcagcagccggttcgcggtgaacctgctgcatgcccggtcccggcagatcgcccacatgttcggctccggccgggccgaccgcttcgacctgatccagtggcgccacggcgacggggcggccgggccgcacctggtggcggacgcgcacacggtcgccgactgctcggtcatggcgacccacgtcgtggggacccacacggtggtcatgggtctggtcgagcgggtcaccgccctccgcgagcaacacccgctgctgtacggcttgcgccgctatgccacctggcccgactcccctgagccggcctga

SEQ ID NO: 5106 - DNA, 975 bp, Actinoplanes utahensis
atggtcgcaggacccacccggcacgccctggtgctcggcgccgggctggccggctcgctcgccgcggccgccctggcccgccacttcgacacggtgacgctggtcgaccgcgacgacctcggccccggcgccggcccgcgccggggcatcccgcaggcgcgccagtcccacctgctgatgggcgcgggcgcccgggcgatggagcgcctcgtgcccggggtgctcgccgacctgcgcggcgccggcgcgcacttcctggccgcaccgaccgaggtggccttcctgaccaagtacggctggctgccccgcacaccccacgacgagtacgtcgtctgctgcggacgtgatctgctcgaccgggtggtccgtgaccgggtgctggcccggcaccggatcgacgtgctcggcgcgcacgacgtcgtggggctgctcggcgggccggccgcgatcgacggtgcggtgctgcgcgatcggcgcaccggcgaacggtccacggtcgccgccgacttcgtggtcgccgcgaccgggcggtccagccgggtcgcctcctggctgcgggaggtcggtctgcccgaggtgccggacgaggtggtcgacgccggcacggcgtatgcgaccaggatcttcgacgccggcctgcccccgggccggcgcccaccggcgatcgtcatgatcgccaacgtgaccggtgacgcggtcggcggcgtgttgctgccgatcgaggacggcctgatgaccgccacgatgatcggcatgcgcggctcggagccgccgaccggcgacgccgagttcctcgccttcgccaagcagctgccccacccggggatcgccgacgccctcgccgccgcgcagccggtcggtccggcgcgcgggttccggggcctggtcaaccgccgttcgctcttcgagcggctgccgacctggccggagcggttcgtggcggtcggcgacgcggcggcggtgctgactagctag

SEQ ID NO: 5107 - DNA, 288 bp, Actinoplanes utahensis
gtgcagcgcgccgtccggcggcgcggccgcgacgcctgggacctgtcggtcagcgacgacctgcgtcatccgcgggtgctcggcccgcggcccggcccggccggacgtctccagaaccggtacgccgaccggatcacccacgtcgcgaccgcccgcccgccggtggctcgggcgctcgtggacgtcatcgccctggcgaagccggtgtcggcgctgctgacaccgcgactgctctgggccgcggcccgcggaccggatcggacacgacggcaggaggccgggaagtga

SEQ ID NO: 5108 - DNA, 960 bp, Actinoplanes utahensis
gtgatcgaacatcacgacgtcgcactgagtggagtccgtctgcacgtggcggagcagggcaccgggcccctggtggtgctgctgcacgggttcccggagttctggtactcgtggcgtcaccagctcgccggcctggccgccgccggctaccgcgtggtcgcgccggaccagcgcggctacggccgcagcgaccgtcccgccgacgtcgaggcgtacacgctgccgcagctggccggtgacgtcgtcggcctgatccgggcgctcggcgagaagcaggcgttcgtggtcgggcacgactggggtgccctggtcgcctgggcggtcgccaccatgcggcccgacatggtgcgcgcggtggccggcgtcagcgtgccgccgctggcgccgcgcggcccgcagccgccgctgctcgcggcccgggagcggttcggcggccggttctactggaactacttcgagacgccgggcgtggccgaggccgaattcggcaaggacctcggcacgacgttccgccggatgctgttcggtgcctcgggcagccgaccggccgacgccggtccggtggcgcccctggtgccgcccggcggcgggttcctggacctggcgcccgagccgccggtcaccctgccgccgtggctgaccgaggcggacatcgcggcctacgtcgaggcgttcaccgggtccggcttcaccggcggcctcaactggtaccgcaacctggaccgcaactgggagctgaccgccgtgtacgacggcgccgtcatcaccgtgccggccctgttcgtcatcggcgagcgggacaaggccttcaccggggtggcggcgatggacgccgcggtcgccgccctcgcacccggccaccggggaacggtcgtcgttccgggtgccggccactgggtccagcaggagtccccggagcacgtgaccgggatcctgcgggagttcctggccacggcctga

SEQ ID NO: 5109 - DNA, 1197 bp, Actinoplanes utahensis
gtgaccaccgcacccctcgatctcgccgcgctcggcgacgatttcgcccgcgatccgtaccccgtctacacccggttgcgtgagcagggccccgttcaccgggtctggatgccggagggcgccgaggtgtggctcgtcgtcggctacgacgaggcccgcgcggcgctcagcgacacccggctgtcgaagcagtggcactccgcgagcgagtcgttcccgatcaagagcccgtccggcagccacatgatgaactccgacccgccacagcacacccgactgcgccgcctggtcgccggcgagttcaccccgcgccgggtggaggcgttgcgcgagcgggtccagcagctcaccgacgagttgctggaggcggtgctggcccggccgggcgaccgattcgacctggtcgacgacttcgcgttcccgctgccgatggccgtcatctgcgagctgctgggggtgccgttcctggaccgcgcggaggtgcgccgctgggccgacgctgcggtctcctccagcgttccggccgagcggcaggccgccgcgcgcgacgccgcccgcttcatcgacgcgctcatcgagcagaagcgcgccgagcccgggcccgacctgctcagcgcgctgatccggaccaccgacaccgacggcgaccggctcagcgccgacgagctgcgcggcacggtcttcctgctgatcgtggccgggcacgagaccaccaccaacctgatcggcaacggcgcgtatgccctgatggcccatccggaccagatggcggcgttgcgggccgatcccggtctgctcgacggtgccgtcgaggagatgctgcgctacgacggcccggtggagagcgcgacgttccgcttcgccctcgaaccgatctcgatcggcgacgtgaagatcgcgccgggcgaggcggtcatggtcgccctgaactccgccaaccgcgacgccggccgcttcgccgaccccgagcgcttcgacatccgcagggccaccaccggccacgtcgcgttcggccacggcatccaccactgcctgggcaacgcgctggcccggatggaggtccgcatcgcgttcgccggcctgctgcgagccttcgcccgtctggagctggacgcacacccggccgcgctggcgtggcgtcacggcatcctggtccgcgggccgcaccacctgccggtgcggttcacccgggcctga

SEQ ID NO: 5110 - DNA, 675 bp, Actinoplanes utahensis
atgcagtcttccccgtcgcgtggcggccggatgggacgccctccccgcctgtcccgggaggccatcgtcgaggccgccaagcggatcctcgccgaggagggtgccaagaacctctcgatgcgccgcgtcgccaaagacctcgagagcaccccgatggcgctctaccaccacgtcaaggacaaggacgagctcctgctcctgctgctggaggcgcacgccgggcagttcccgcgcaccgacatgccggatgacccgcgcgaccacctgatcaaggccgcccagctgttgtacgacatcctggccgactgcccgtggatcgtcgaggtgctcgcctccgacgacctgatggcggtgtccgccctgtggatagtggagaatatcatcgatggcgccgtgcgctgcggcatgacgcccgaagaagccgtgtacgcctatcgggtgatctggtattacaccgccggtgaactgatgctgcgcgtcgctcgggaacagcgttacgcccgacccgacgccggcgcacatcgggagaaggcattcgcgaacctggaccccgagcagttcccgcgcctgtcctcactgtccgaactgtggccggccctgacctcgcgcgacatgcaccggccggggctgatcgcgatcgtcgacgggctgctgcgccagaccgtcggacgctga

SEQ ID NO: 5111 - DNA, 1089 bp, Actinoplanes utahensis
atgcgtgagccggccctggtcggggtgctcggtgccggcggcgcggtgggcacggtcgcggtgacctgcctgctcaccgggggtggcgtccgggtgagggccggttgccgccgcccgggcccggcgcgggccggggtgcggccggtggccgtggacgtgaccgacccggccacggtgcggcgcttcgccaccggctgccgtctcgtcctggactgcacggccccggcgtacacgctgatggaccgggtgcgcgccgccgtcgtcgacgcgggcgccgactacgtgtcggtgatggacgacgggcggacgccgcccccgcccgccgggcgcaccgtcgtgctggccgcgggcgtctcgccgggtctgtccgggatgctgccgcgcctgctggccgagggactcaccgggccgctgagcttcaccggggcgtacgcgggcctcggtggcctcaccgccggcgccgccgccgactacctgctcagtctggacgccgggtacggcgtcgcgctggccggctggcacgggcgggaggtgccgcgggcgctgcaggtcgacgaggacttccgggtgccgactgtcgaccgggcgctgaccggatatccgtacctgaccgcggagctgcgccggcaggcgctcatgctgccgctggcccgggcgtcgtggttcaacgccttcgacggcccgcacctgctggccgcgacgacccggcgacgcggggccgggccgcccggcgcggaggcgatcgccgagctcgtccgggcgagccggctcgacgccgccggccgtcgcccctaccaggtgttgcacggcgagctcgacggatacaccgacgacggccggccggtgcaccgctcggcggtgatccgcgggacggacggctccgccctgaccggtgtggtcgcggccgaggcggtgctgtccgtgctgggcgggcaggtgcggcccggtgtccggtacgcctcggacgtcgtcgactcgcggcggctactggccgcccttcagcgccgtctgccggatacggtggtgcggttcaccggggacgtcccgtgttcgacggcatcggcggagcaggtcgaaggcgtcctctaa

SEQ ID NO: 5112 - DNA, 5478 bp, Actinoplanes utahensis
atggccattgtggagacggtggcggccctgcgggcggccggcatggtgctgtacgccgagggcgacgacctccgctatcaggcgccgaagggcgtggccaccccggaacggctgcgctggctgcgtgaccacaaaccggacgtcctggcggtgctgcgcgcggacggcgacgagttcggcggcccgctcgccgccgaccccgagcgggccggcgagccgttcccgctgaccgaggtgcagtcggcgtatctgctcggccggggcagcgcgttcgagttcggcggggtggcctgccacggttacctggagctggccgtcccggactggccggttcacgaggtggaggcggcctggaaccgactggtggcccggcacgccatgctccgcgcgaccgtcgcggccgagggattccagcaggtcgcggccgaggtgccccattacccggtcgcacacgcggatctgcgtgacgccgggccggaggcggtccgggaggcgatcgccaccgtgcgcgagcagctgtcccaccgggtgcggcccaccgatcggtggccgctgttcgatctgcgcgcgaccagcacacccgacggtctgctgctgcacttctcgatcgacctgctgatctgcgactacagcagcttccggctgctgctggacgagctgcggcgcgaggtgaccggcgagggcggcgacgccgcgccggccgtcaccttccgcgactacgtcctggccctgcagggcatcggggagacggaacgtcaccggcgcgaccgtgagtactggttcagccgggtcgacgagctgccgcccgcgcccgagctgccggtccgcgcggacgcgccactcgcggcgccgcacttcacccgcttcgccacccggctggccgggccccgctggcagcaactgcaccggcgcgcgaccgacctggggatcaccgcctccaccgcggtgctgggcgcctacgccgagacgatcgggcggtggagccgccacccccgtttcaccctgagcctgaccgtgcagaaccggctgccactgcacccggacgtggcccgggtcatcggcgacttcagctcggtcagccttctggacgtggacacgaccccggtcgcggcgttcggcgagcgtctggccaccctgcacggacggctgtggcaggacctcgatcaccgcctctgcggcggcgtcgaggtgctgcgggagatcgcgcgccgccggggccgggcggccgcggccctgccggtgacgttcaccagcacggtgagcggcgccccgacgcccggcgccggcctgatgccgggagcgcgcctgaggtacgggatcagccagacgccgcaggtgtggatcgactgccagatgatggcggaggacggcggcctgctgctgcactgggacgtccgggacggcgtcctgcccgacggggtcgccgccgacatgttcgccgccttcaccgagctcgtcgagcggctcgccgacggtgacgccgtcgacgaggcggacccggtcgtgctgccccgccggcagcgggagctggtggccgcggccaacgacaccgccgagccgcgggtgcgcgggcccctgcacgcggcgttcctggaccgggcgcgccgcgaccccggacgggtcgccgtgatcgcggccgggtgcacgctgacctacggcgagctgctcgcccgggccgagtcgctggccgggctgctgcgcgacgccgggtgcgagccgggcgagcgggtcggggtcgtcgcccccaagggcgcggaccaggtcgtggcggtgctgggaatcctgctcgccgcggccgcctacctgccggtcgatctggggcaaccggcccggcggcgggacacgatcctgcgcgacgccggggcccggttcgtcgtcaccgacgcggtccacgccggggagctggccgggtcgggcgtggtcacgatcgaggcggatcggctgcccgcgacaccggcccggccggccgaggcgcccgggcccgtcgggggcgacctggcgtacgtcatctacacctcggggtccaccgggacgcccaagggcgtcatgatcagccacgaggcggcccgcaacacggtcgacgacatcaaccggcgcttcggcgtcggcgccgacgaccgggtcctcgggctcgcgcagctcggcttcgacctgtcggtctacgacgtgttcggcccgttgtcggtgggcggcgccctggtgctgccgcaggccgaacggcgcggggacccgtcgcactgggccgagttgatggtcaccgagcgggtcagcgtgtggaactcggtgcccgcccagatgcagctgttgaccgagtatctggcggcggcgcccggccacgacctgagccggctgcgggtggtcatgctctccggcgactggatcccggtcaccctgcccgacaccgtgcgccgccacgccccctcggccgaggtgatcagcctgggcggggcgaccgaagcctcgatctggtcgattcaccaccgtgtcggcgcggtcgacccggaccagccgagcatcccgtacggccgaccgctggccaaccagagcttccacgtcttcgacgacgtgctgcgggagtgcccggagctggtggtcggcgagctgtacatcggcggcgccggcgtggccctcggctacctcggcgacgcggcgcgcacggccgaacggttcgtcgaccacccgcgcgacggacggcggctgtaccgcaccggcgacctcggccggcggcttcccgacggggagatcgagttcctcgggcgcgaggacggccagatcaagatccgcgggcaccgcatcgaggtcgccgagatcgaggcggcactgctcgcccaccccggagtgcaggcggccgcggtgatcccgtacgacgacgaggccggacgccatctcgccgccttcgtcgaacccgcggcggcggaccgcgccccgctgccggagcggctgcccgagaccatggccgcggcggccgcggcgcgcatcggcgccgtcgaccggggtcgggtcgccgagatggtggagctgctcgaccgtgccgccctgcagtcgatcagccgactgctggtggactgcgggctgttcgccggtgtcgggagccggcacagcgaccaggagatcatcgagacggtcaaggccgctccggcgaaccattatctggtgcgacgatggctgggcgccctggagcacgagggcctcgtccgacgggacccggacaccggcgcgtaccacggcctgacccggccggacgaggccgcggcgaagcgcctgcgggaccgcgtcgacgtcctggaaccggccgtccggtggggcgccgagctggtgcgctatcaccggacctccgaggagaacctgcaggcgctggtccgcaacgacatcgacctcaagacgctgctgttcccgcacgggcggctcgacaccgccgaggccgcgtaccgcgacaacctgatcagccgctacaacaacgcggccgtcatcgccgcgctgcgcacgatcgccaccgggcactccggcggtggcccgctgcggatcctggagatcggcgccggggtcggcggcaccagcaccgagctgatccccgcgctggacgacctcgccgtcgagtacctgttcaccgacctctcgcacttcttcctcaatgcggcggccgagcgcttcgcggcctacccctgggtccggttcgggctgttcgatctcaacgccgaccacgtcgagcagcagatgccggacaacgggttcgacgtgatcctgctggccaacgtgctgcacaacgcggtgcacgccggccgggcgctggagctgctgaaggggttggtgcggcccggtggctggctcgtcttcatcgaggccacccgcgacgcgtaccacgtgatgacctcgatggagttcaatgccgggctcaccgggttcgaggacgagcggcgggagaccgggaccacgttcgtgccccgcgaccggtggctgtccctgctcgacgaggccggcgccgaggtggtggccacactgccggccgccgacgacgccctgtcgctgatcgggcaacacgtcttcgtgtcccggttcaaggccgaccgcgcgccggtggaggtcgcggacgtacagcggcacctggccgaacgcctgccggagtacatgcttccggcccagctgcacaccctcgaccggatcccgctgaccggcaacgccaaggtggaccgcgggcggctggcccggtggacggtccgcggcgggcggcacgcggccggctcggcggcgtcggcgcccgccgacgagaccgaacggctgctggccgacatctggtgcgcgatcctgccggtcacccggatcggccgggacaccgacttcttcgccgcgggtggcgactcgctgctcgtcgcccagctggtcgggcggatccgggaccgggtgccggccgcccgcgacgtcgagtgggaccacctgctgcgccgggtgctgaaccggccgacgatcgccgacatcgcggcctacctgcgctcgctcgagtcgtccgggccggcgccggccccgtcgtcgctggtctccgtgggcgaccgggcccgccggcccgccgccggccccgggcagccgctgcatgtgctcgtgcacgacggcaccggcaccctgatcccctaccgggcgctggtccgggagctctcccccgacgtgccgatggccggcctcgtcctcgacgacgagcaggagtacctcgacagcgacccgcacacgctgaccggcacgctggcccggcggcacgccgccaccctggtcgcggccggccacgaggaggtccacctgatcggttactgcatgggcgggctgctcgtcaccgagctggccacccggctgacggcggccggcatccgggtcgccgcgaccacgatcgtcagcagttaccgggtgccctacctggtcgaggacgacctgctggccgagtacatcttcgcccgggtgatgcgagccgacccgatccggctcggttacccggccgacgagaccgagacccggcggatcgtcgccggggcggtcgcccgccacggcgggcgggtcccggagggcagcctgctcgagccgggtgaaaacggcgtacgcccggagacggtcgccggattccggcgcctggccgcgatggaccccgatgagcggctgaccgcgatcggggcggccatgccggtctccgacgccgggctgacctccgtggaccggctgcgccgccagttccggatcgtcaagcacagcctggtcgcggtcgcctcgcaccggcccacgccgtacgacggtccggtgaccttcgtccggcagagcggtgaggcgcaggtcttcccggggatgcaccgcgacatgagcgactactggcgcgacgtgtgcaccggtgagctgcgcatcgtcgacgttcccggtgatcacttcacctgcatgcgaccaccgaacgtgccggccgtggcccgggccgtgcgcctcgccgtgccgcggggcgagcatgcgtga

SEQ ID NO: 5113 - DNA, 1356 bp, Actinoplanes utahensis
atgagacgcagttacgcactggtcgccctcgccgtcaccaccctggtggcgctggcgttcgtcatcccgctcgcgctgctggtgcacagcgccgtgcaggaccgtgcgatgcgcgaggccgaacgacaggccctcggcctctccgccgtggtggtggtcgccaccgaccgcgacctcgtcctcaactcgatcatgagcacccgcgccgggcagaacggcgagctcgccgcgcacctgcccaccctgggcaccgtcggcgtcagccgggtcacgcccgacgccgtcatccaggtgcggcagcgggagacggccggcaccgtcgatgtcgacggcggccgggtctacctgcggccggtggcgctgccgcagggactgatcgcggtcatcgaggtgttcgtcccgggcacggcgctgcgggccggcgtcggaacggcggtgctggtcctcgtcctggaggcggtggtgctggtcgggctctgcatggcgctcgccgaccggctggccgcccggatcgtccggtccacccgcgacctggcacggaccgcgaccagcctgggcgcgggtcaactgcatgcccgggtacgccccagcggcccccgcgagatcgaggaggtcggcgcggccctcaacctgctcgccgaccggttcctggagctgctcgcgaaggagcgggcgctcgccgcgaacctgtcccaccggctgcgggtgccgctgaccgcgctgcgactcaacaccgaggcgctgaccgccggcgaggaccgggaccgccagctgcgggtcgtcgaccggctggagtacgagatcagcgcggtgatcagcgaggcgagccgtcccctggccgcccggccgcgcctgcagtgcgatctcggcgccgtcgtggccgaccgtaccgggttctggggcgcgctcgccgaggaccagggccggccgtggcaggccgacccgccgcccgacgggctcaccgtgccggcggcctggtcccgggtcaccgaagcgctggacgtcctgctcggcaacgtcttccaccacaccggcgaggacgctgcctgccgggtcaccgtcgtccggtcggacgggtcggcgaccgtgatcgtcgacgacgccggccccggcttcaccgacccggacgccgcactggcccgcggcgccagcgacgccaactccaccggcctggggctcgacatcgcccagcggctcgccgccgacaccggcggcacactgacggtgagcggcaacgaatggggcggcgcccgggtcagcctcaccctgggcacgctgccggacgagacaccggccgccgcaccgcgccggcgccgctggtggcacggcctcggcggcgcccacgcccgccggtga

SEQ ID NO: 5114 - DNA, 555 bp, Actinoplanes utahensis
atgggccggagctggagttatgttgcggggtggctcgcggtgacgatcaccgcggtcgccgtctcctggttcggtgtccggctcggcgtggctccggcgatcacggacgagcctccggtggcgatcgacgtgaaccgccgttacaccgagatccggttcgggctcgcggagtccgcgacgccgagccgggccgcgcccggcccgtcgaagtcccctccgtcgcacaccccggcaccgccggcgcacagccggacgcccagccgccagccgagcgcccggcccccgtcggcaccctcgccgtcaccgacgccgacggtggaccagcggccccggtaccggatcaacgccgacgccgggacgatcaccgtcgcctattcggcgacccgggtggacgtggtcggcgccgatccactgcccggttacacggtcgacgtcgtccggcgcagcgacaccatcgtcgtggcgcggctgtcccgccccggccacacctcggccatcacggcgtactggaacgatggcccggcggcccaggtcatcgaggactacggcgcatga

SEQ ID NO: 5115 - DNA, 687 bp, Actinoplanes utahensis
atgccccaggtgttggtgatcgaggacgacgtcgacgtccggcaggcggtcggccggttgctgagcgcgaccgggcacgacgtccggttgtgcgcgacggccctcgacggtctgcgcgaggcggccgcgtgggcgccggacgtggtggtgctcgacctcggactgcccgatctcgacggcgcggccgtcctgcgccggatccgggccacctcgcaggtgccgatcgtcgtcgccaccgcccgcgagcaggagagcgagatgatccggctgctgcgggccggcgccgacgactatgtggtcaagccgtactcggccgagcagatcgaggcccggatcgcggccgtgctgcgccgcggccacggcggcccggcggccaccggcctgaccgtgggcgggctgtcactggatccgcaggggcgcacggccagcctcgacggggtgccgctgcagctgtcccggctggagttcgacctgttggcgtacctgatgcagcgggcgggcacggtggtgacccgccgtcagctgctgtccgacgtgtggccggcggagagccgatcgctggagacggtcgacgtccacgtcacctggctgcgccgcaaactcggggaacgggccgcccagccccgctatctgcacactgtccgcggcgtcggtgtccgcctctccgcgccggaacccggccgatag

SEQ ID NO: 5116 - DNA, 669 bp, Actinoplanes utahensis
ttgaagcacaaagtcgcggtggcgagcggcatagcggccgtcaccgtagcgggatcgatcgccctgaccatgccgcagggcaacgccgctaccaccccgagccaccagcagcccgcggccgacgggccggcgccggtcgcgctggccacgtcctcggccgcggacctggttaccaacaaacccaagaccttcttcaagagccggtacgacaagctcgaccggcgccaggtggtcagccagaacggcctgcagtacgtggtgtacgaacgcacctaccgcggcctgccggtgcacggcggtgacgcggtggtcgtcgccgacagccgcggccgggtgctcaacgagtacgtcgcgcaggagcaggcgctgtccatcccggtcaccgcgaagatctccgcggccgccgcggcgaagaccgcgcgcaagcagctcgccagggtgaccacggtgtccccggccacgttgcaggtcgtcgcgcagggtgccggtgtgctggcgtacgaggtggtcgtcgccggcgccaagcgtgcccccggcggtctggccccgagcaacctgcacgtcttcgtcgacgccaccacgggcaaggtgctgcccgacctgacccgggacgacatcgtcgacgcggccgggcacggcgcctactacggcgacgtcctagctagctag

SEQ ID NO: 5117 - DNA, 138 bp, Actinoplanes utahensis
gtggcccgctcggtcggggagacgtcccgcgaggcgatctcctacaccggcacggccggcagctaccggtaccggatcgtctcgtacagcggctccggcaacgccgttctcggctggaacgtccccgccgcgagctga

SEQ ID NO: 5118 - DNA, 504 bp, Actinoplanes utahensis
gtgcgacagtcacacatatcggtagtcctcgcggcgctgctgctggccggagtcgccggctgcgccaacggcgagccggccgcagcgccaccgccggtggccgcctcgtcctccgcgacaccggcgtcctccgccatgtcggcgcccacggcttccgcggcccgtgccgtcccgctcaccgtcacccggcgcggcggcttcgccggcgtcgaagagagcgtctcgatcgccgccgacggctcggccaccgccacccgcaagggtcaggcggccgcgccggtccgggtgccgaccgccaccaccaccgagttgcggcggctgctgggcacgccgggcctggccgcgcaggcgtcgccgtcgcccggcgcgccgggctgcgacgacggcttcgagtacacgttcgtcaccccgtcggcgaccacggtcgtgcaggactgcgagggcgggcacggggccaccctcgaccggctgctgaccctgggcgccggcctgttcgcccactga

SEQ ID NO: 5119 - DNA, 1416 bp, Actinoplanes utahensis
gtgaagaacaaggtggtctggctgctgctcggcgcgacggtgctggcggcagccgcgatgtggtggcgccggggaacgccgacctccgacatcatctacttcgcctggacggtcccgctggccgtcgccgtctgtgtcaccgcggcgcgccagccggccagacggaaccgggcgccgtggtgcctgatcgccctcgcgctggtgctgtggctcagcggcgacggcgtgcagaccctgcagtactacgccggctacgtgccgccgttcgggctctcggacgtgctctggctcgccggctaccccgccatggcggccgccctcctgatgatggcccgctaccgggcggccggccgcgtccgcggtgtcgtgctggacgggctgacgctgacgttcgccgccgggatcgcggcgtacgtctacttctgcctgccgatcatcgacgagggcttcagcaccctggagagcgtgacaccggccctgtaccccttgggcgacgtcatgctgctcgccggcgtgctcatgctgttcctctcccccgggcgacgcggcggacccacctacctgatgctcgtcgccgcgacgctgtacctgctcaccgattcggccaacaacgtcctcatgtacgtggtgcacagcgacgtctcgtgggacctggacggcgccgtcctgctcggcaactgcctgctcgccgcggcggggttgcacccccgccgcggcgagctcaccgagccgggccgggccgtcgaggtgctgcaccccgcccgggtgctcttcctcggggcggccctggccaccgcgcccacggtcgtgctcacgcacaccggcctgggtcccggcggtcgcaccatcctgatggcggccaccctcgcctgcatcgcctgcgtgctgatccgcttcctgcaggccgtccgcgggctcgaacgcacccaggcccagctggcctaccaggcccggcacgacccgctgaccggcctggcgaatcgtgccgccttcaccgagcacctggacgaggacaccgccggagtgctgctctacctcgacctcgacgggttcaaggcaatcaacgaccgcgacggtcacgaggccggagacgccgtgctcaaggcggtcggccagcggctcaccgcggcggttcgcagcagcgacctggtggcccggctcggcggtgacgagttcgtcatcgcctgcaccgcggcggacgtcacgtacggccaggacctggcgcagcggatcgtcacggaggtgtcgcgcccggtcgagttcggcgggcgacagctcgccgtcggcgtcagcatcggcatcgccgcgcacgtcaccacgtcccccgatgcgcggcgggccgcgctgctcgcggccgacgaggccatgtacgcggcgaagcaccgcggcaagggcaactgggtagtcgcggcgtag

SEQ ID NO: 5120 - DNA, 243 bp, Actinoplanes utahensis
gtggcgtacggcataccgccggagcgggtctctcagcccgtggccggtccccgcgccccgatgcccggcccgcagagcgccccgagcatgaccaacgggtcggtcaccgtcacgctgcccgcccgcagcgtgacgacgctcgtgaccaccgtgggcggcaccgtcccacccggcccggcggccagcccgtcggcgagttcgtcgccggccggcggcgccgggcccgggtggtctacacgatga

SEQ ID NO: 5121 - DNA, 3351 bp, Actinoplanes utahensis
atgagcacctggagaccgtcaagatcgggttccaggccactcacaccggcaacaccgccgaaccggccggtttcaccctcgacggggtgccctgcaccgtggtgtgacgcacatgtcgtccagcggcacatcgatgggcgacggggccgccaggccggccggcacccctgcccaccggcgcaccatggcggtcgcggtggcgttgtcggccggggcgaggccggcgatcttcgcgccgtggttcgcgcccggggcgacgaacagcgccgagtcgtggcggctcggggtgaagcgttcggcgctccacggatcgttctgcccgtacacgaagagcatccgttccgaggcggtgcggacccaccagtcgacgtcgagcatcggcagcgggtggtggacccggcgcagttcggccggcagggacgagttcgcggtgtagaggcccgggtagtggcgcaggccgcgcaggtgctcgaaccgcaggctgggccagcccagctggctcgccgcctggtagtagtacggccagtagtactccaggccctggtcggtgtagaagctccacccggccacggcgtcggtccaggcgtacaactcgtcgtcggtcgccgtggccggcggcaccgccgcgcagtcggcggccgtgctgtactgccagaacgcccacaccgagtccagcacggtcatctcgaacgagcggtccgcggtgcccagcgtgcgggtgaaggtccagccctgcgccgcggcatccgcttgcaggtgggcgaccagccgggtccggcgccgcagcgcttcgcgctgcacctcgtcgagcgcggcgcggcaggaggcggtcccgacggtgtcgaagaaggcgtcgtacgcgcggtcgaccggattgatcgcgtcatccggtgccacataggcgaccacgccgtcgacgtcaccggggtagaagcgccggtggtacaccgaggtcatgccgcccttgctgccgccggtctgaatccagcgaccggtgtagacgccgcgcagcgcggtgacgatccggtgctcgtcggaggcttcctgccagatgtcgagatccgaccagtcggccggggccgggcgcgacggggtgaagaagcggtgctcgaccgacacctggttggcgcccagcagcgccgtcggctcggtctgcgtcggacgcggactggcggccaggccgtacccgctggtgtagaggacggtgggcgcggtggtcgaccggtgcagcagggtcagccgctgctcgtagccaccccgtcccggatggcggtgatcggcgggctggcgataggtcaggacgaagaaccggtagccggcgccctgggtgtcggagacgacggtgatgccggggatcgcggtcagctgatcccgcagcgggtcgtcggcggcgcgtgccggcgtgaccggggtgacggccaccagcaggcaggcgaggatggcgacaagacgttttcgcacgccgtcatgctatcgataaaccctaatacatcaacgggtcatccgacggccatctccggccgcttggttgcggggatgctcctgttcacttctcgcgcccgcaggcgggcggcagtcgtcggcggtaccaccgccgtcctcgttcttgcctcgatcggcaccgcctgggccgacccgttcggctggcgaggcggccgccagcatccgttcgccgtgcggccggacaccggtgccgcgtccgccaacgtgctggccaacgatcgcggcgccaccgcggtggtgcgcagcaccggcctggacgacccggcggccggcagcttggcggtgcaccccgacggctcgtacgtcttcacgccggcggtgccgggaagccacggcacggtgcacttcggctacaccgcgaccgacgcggtcaccgtctactccagtgcggtgcggggcggcgcccggattccgccgctgggcggcctggagggtgcggacggcagcaccgtgccgatctccggtggcggttacggctcctcgttcgtcgcggcgccggggcggcccggctggttctacggggtcaccgaccgcgggccgaacgtggacgacgacggaccgagcgggcagaaggccttcgccgatcccggattccacccgcagatcgggctgttccagctggccggtggcagggcggtgctgcagcggacgatcgtcctgaaggcgccggacggcaccccgtacaacggcctgccgaatccggtgaccaagcgggccgcgagctccgagaagaccgaggacctgtacggcgactacatcgacccggcgcagccgtacacggtgcccggcaccggtccggcggtgaccctggacccggacgacggctacgactccgagggtctggtcgcgctggccgacggcagcttctgggtctccgacgagtacgggccgttcctcacccacttcgaccgggacggcaccgagatcgagcggctgtcgccgtggggcgccgacgccgggcacaacgtcgacaccgcgcacccgctgcccgccgagctggcgctgcggacgaagaacaagggcatggagggcctcaccgtcaccccggacggtcggaccctggtcggcatcatgcaggcggcgctgaccgtgcccgactacggcaccgacgccaagggtaaaaccgttaaaccgggcaacgtctcgccggtccgcatcgtgacggtcgacctgcggacccgggccgtccaccagtacctgtatctgctcaccaacccgaacgccacgggcggtgcggtcagcgagatcaccgcgctgtcggccacccggttcctggtcgacgagcgcgacggcctgcaggccgggccgggccgggcggtggccaagtacctgtacgagatcgatctgaccggcgccaccgacgtcaccggcaccggcccgctcggctacctgatcggcggcacatcgatcgaggcgtacgtcggtgacgcccccaccgcgaaggccgcgctgctgctgtcccaggccggtgtcatcccggtcggcaagagtccgtacctcgacctcggctccgtgctgaaccagctcgacccgtccggcaggttcttcggccacgacaagatcgagggcgtcgcgacctccgacggcggccgcgtgctgtacctcgccaacgacagcgacttcggcatcgaccacctgctcggccgggacgaggcggcctgcgaggcgtccgggctgtccgacaccaccgcctgcgcgccggtgaagtcggcgaccaccgggaagttcctcgtccaccagaagacgctggacgccgccggcgtggccgacgacggcgaactgctgcgggtcgacctggccaagctgccggtggtgctgggcagcaccacggtcaccatccggtactga

SEQ ID NO: 5122 - DNA, 1590 bp, Actinoplanes utahensis
atgagatcgatggcaagaaaggccgggctcgcgttcaccgccgccgcgctggccctggccggagccgcgtacggcgtgacgtcggcgtcggcgtccgccgaggcggccgccccgctgaccactcctcagctggtgaccgacatgggcgccggctggaacctcggcaaccagctcgaagccagcaacaacggcatccccggcgagacggcgtggggcaacccggtcatcacgcaggccctgatcaaccgggtgaaggcggccggcttcaggacgatccggattccggtctcctacctgggcgccatcggcgccgccccgacctacacggttgacgccacctggctgaaccggatccaggaggtggtcgactacgcgtacaaccagggtttgtacgtggtgatcaacatgcacggtgacggctacaaatccgtcacgggctcgtggctgatctgcgacgccgccgaccagacgacggtcagggcccggtaccagaaggtgtggcagcaggtcgcgaccaggttcgcgagctacaccgagcacctgatcctcgagtcgatgaacgaggagttcgacggccagtacggcaacccgacgcagccgtgctactccaacatcaacgcgtacaaccagatcttcgtcgacacggtccgcaggaccggtggcaccaacgcctcgcgctggctgctcgtccccggctggaacaccaacatcgactacacggtcggcaactacggattcgcgctgcccaccgaccagtaccggtcgacgtcgatccccggcaccgagcagcggatcatgatctcggtccactactacgacccgtgggacttcaccggccaggaggacggcaccgtcacccagtggggcccgaatgccaccaaccccgcgaagacgtccacctgggggcaggccgactacctcgacggccagctgaagaaggtgcacgacacgttcgtggcgcgcggctacccggtcctggtcggtgagtacggctcgatcgacaagaccgcggcggaccccaccaacaaccggtaccgcgccgactacgcgcgcgccctggtcaccgcggccaagaagtacggcgcggccaccgcgtactgggacaacggctacaccggggcgtacggcttcgggctgttcaaccgcagctccgcgacggtcacccagcagagcatcatcgacgccatcatcagcgcggccggcggcaccagcacgagcccgccgcccggcggcagcccgtcggcgaccccgtccgcctcgccgtccaacaccccgaccggcgcctgccgggtcaccaccgcggtcagcgcctggaacaccgggctgaccgacaacatcacgatcgtcaacaccggcggtacggcggtcgacggctggacgctgaccttcaccctggccgccggacagacgatcacctccggctggaacgccacctaccgccccgccaccggcaccgtcaccgcgaccgacgtcggctacaacggcaccctcgccgccggagcctcgaccaccatcggctaccaggccacccacaccggcaacgccgccgccccgaccggcttccgcctcaacggcgccgcctgcagctga

SEQ ID NO: 5123 - DNA, 2853 bp, Actinoplanes utahensis
atgtgccgagggcctcgccgtgctgacggtcgcatgagcacccggcccgaggacgaagccgcggaacgctggatgtcgctgagtcggcacccgaacgtccgcgcccgctactacgccgacgccgagcaggtcgacggcggcccgctgcgcatcgacgccgtgtccaccatcgaccaggccctcgacatcgcgatccaggccgcccggggcctcgagcacgcgcaccgccacgacgtcgcccacggcgcggtggggccggacgccgtgctggtcaccccggacggcaccgtcaagatcaccggcttcggcgtccccgcggcggccgcctggcaggccgacgtgaccgccgtccggagactggtgcgcgagctgggcgggcccgccctgccggacggcctgcggatggcggacgtcatcgaccgcctgaccgggacctaccggcaggagtgcggccggccctacccgcgaccggcccctgtcccgctcacccggacgtcggatgagctcaccgatcacggcatcatgctgaccgtgctcggccgcgtcgacgccgcgcagtcccttttcgaccaggcactggccgtgcatccggggcaccccgaggccacctaccacagcggtctgctgcgctggcgcaccggcgaactgaccgacgaccggctgctggccgccctggacagcgatcacctgcgcgccctggtccatctggagcgcggcgatgccgccgccgcgctgccgctgctgctgcggaccgcgaaggacaccgacgctttccggtacgccgtgcaggccgaacgcccgcaccggctgcagccgcgcacggttcaggtccggccggggatccgctcggactcgctgcacgcgggcccgggccggcaggtcgaccacgtacgcctgagcgccgacggccggatcgccgcgaccgccgggaacgagacggtgcaggtgtgggacaccaggacgggccgatgcctgcaggaggcgcacgagcacaccgccacggccaccgccctgcacctcaccccggatggggggcacgtgctgtccggcaccggcgacgggaccgtctcgtggcgcaccgctgaggacggcaggctgcggcgacggctggagaccggcgaccgggtcgtcgacatctggaccgaccccgaggcacggaccgccgtgatcacggtgcggagtgggttgcaggtgtgggacctgcacgcgggccggctgctgcgggtgatcgaccccggcggaccgatcatcggggccggggtgtcggccgacgggacgcgggccgtgtcgtccggcctcgaccgtgtcctgcggctgtgggacctgcggaccggagagtgcctggcacacctcgaagggcaccgttccctcgtcggcgtgatccggctcagcgccgacggccgggtggccgtctccgccggccagttcgacccggtgctgcgcgtctgggacctcgacagtggacagtgccgccatcggctcaccgggcatgtccgtgaggcacgcgggctggacgtcagcgccgacggccggtacgccgtgtcggcgggcgggaccgaccacaccgtgcggctctgggatctgcggatcgggcgctgccagcgcacgttcaccagcgactacgacgacacggcggcgctgagcgcggacggccggaccgcggcggccggtgggttgagcggcgtggtgcgggtgtgggacatcccggcgcccaccggctatgccgcgccgccccagccgtgcgtgccacgctcgtacgccgcaatcgtcgtgatcaacgccgaggcggacaccctcctcgatcgggcggagcgggcgatcgccgaggaggatttcggcacggcgcacgccctgctggtccggttgcgcaccgaccggcggcatgatcggacgccgcgtgccctgcgtgcctggcagcggctgagcgcccggatcgaccgcgtcgcggtcgaggacgtgctggtcacgcgcacgctgcacggtcacaccgaccgcgtcgagtcgatctgcgccgtcccgggcagccgcaccgcgatctccggcggccgcgacggcacgctgcggatctgggacctggaatcgggcgcgtgccttcgcacgctcaccggccacaccggctcggtgctgtcggtcaccaccgacggcaccggtcgtacgatcgtctcggcaggccgcgacaagacgatccgggtctgggatgccgagtccggtgcgtgtgtgcgcacgctgaccgggcagggcagcgtcgtgtactcggtggcggtcagtgccgacggccgccgggcggtgtccagcgcccgcgacggcgaccgcctgctggtgtgggacctgaccaccggcacccgcctgcgccgcctggacggccacaccggcggcgtgccgaccgtcgccatcaccccggacgggcggctggccgtctccggcagccacgacggcacggcccgcgtgtgggatccggacaccggagactgtgtgcgcgtcctcgaccccgaagaagtggaggtcgttcggctcagcgccgacggcggcagcgtcctcaccgtcgactccgacggccgcgccgggctgtgggacctcgcgtcgggcgatcggctgcgcgccttcgagccgccggactggtcgcacctcgccgacgtccagctcagtcacgacggccgctacgccgtggccgcgggcgaccacctgctgagtctgcacgacctcgcgaccggcgacccgctgttcgaacccgcggaccggccggacgcgatcaccgcggcctgcctgagcccggacggccgtttcctggtcgccgcctgccgggacacgacggtccgggtgtgggagctgacctgggacctccggctccggtag

SEQ ID NO: 5124 - DNA, 1890 bp, Actinoplanes utahensis
atggacgacgcggtgatcgcctgggagcggccggcccgcaggctgcggccggcactccgggtcgacgtggagggtgccgaggtggtggccgtcgtcaccggcggcgacggccgcaccctgctggcggtcgccggcggggacgggccgcccgcggtcgtgtcgctgtgggacacggcgaccggcgagcgggtcggcgagccgctgacccacccggcggaggcggtcctggcgatggtggcgctgcccggcctcctcgcggtcgcctacgccgacgccgacggtccgctggtgcaggtgtggcgcccggcatcgggtgagcgggtcggcgcgcccctgcccggcccgttcgacgggtcgggcctggcggcggtttcggttccggacggccgtcacctgctcgccgtcgtcgaggaggtggcgggcacgctgcgactgtgggacccggccaccggcgatccggtggccggtccgtggccgccgggcatctgggcggtgacggcggcgaaaacctcggacggccgtcccctgctgctgaccctgcacggcgacgacagccaggcggtggtccgctcctgggatccgctgaccggggatccgctgggccaggtgctgcgtacccggcacgacgaggcccacccgcatcggctggtggccctgccgcaaccggacggccggctgatcctggcggtgtcccgaggggacgaggacgacggtctcgtcacccggctgtgggacgcggccaccggccggcggatcggcggcccgatcgagggtgccggcccactggccgtgcccggcccggttccgttgctggccgccgggggcgggctgtgggatccgggttccggccgccgggtcggtgacgccggcacgaacggcgtcccgcggccggtggcggcagtgcccggtgaccccaccctgctggccgggccgggcccggacggcaccctgtggctgtgggatccggcggagacaccaccgctgcccgacgccgaacgggtcggcccggtggacctgctggcgccggtgacgctgcccggcggccgcacggtgctgaccaccggcgtccgcttctgggacgtgctcaccggcgaacccgcccgcgctcccctgaccgggcacgccggggctgtcaccgccgtggcgtcggcatccctgccggacggccggctcgtgctggtgacctgcgaccaggccggcaccatccgctcccgggacccggtgaccggcaagctcctcgccgaggtgcccgcggcccgctcgcacgtggtccgctcgatggcgccgatcgtcatgccggacgggcgcaccctgctcgccgtcggcaacgacgtgaacgtcctgcggctgcgcgatccggagaccggggccagtgccagcgacatgttcacccggctcgaccggccgccgctgcgggcggtcgcggcggtgccgatgccggacggccgcacgctgctggccgcgagcaacgccacgccggcacgcggcggcagctgggcggcccggctgtgggatccggtcaccgggctgccggtcggcgacccgttcgccgagcgggcgccggtgtggtcgctggccgcgacaccggccgggcacgaccgtgtactgctggcggtcggcaccgccgacggcacggtccaggtccacgacgtcgtcagccgggaggtcctcggcgagctacccggccggcacccgtgcctgctcaccgacgccggcggcgggcaggtgctggccgtcgcccgccgggacgaggtcgagttgcgggatccgctggactggcgccgcctgagctcgcaccggatgggcagcaaggtgctcaccctggccgcggccggctcccggctggcgatcggatgtgccgagggcctcgccgtgctgacggtcgcatga

SEQ ID NO: 5125 - DNA, 159 bp, Actinoplanes utahensis
atgcgtgcgctgcttgtcaccctcggtgttgccgcggtggtgctgatcgtgctgggactgctgctcaaagcgctgaagtggctgctgatcatcggcgtcgtggcgctgatcgcctcgatcgtcctcggggtcgtcaagggacgccgcgcgttgcgctga

SEQ ID NO: 5126 - DNA, 153 bp, Actinoplanes utahensis
ttggccggccggcccaccgagcggcaatcccacggcatcggcaccgccgtcattcacaccgccgaggctttcgccgcccgccgcggtcaccgccacatcggcctcggtgtcggcgacggccgccacccgagactcctcagctacgcgacgtga

SEQ ID NO: 5127 - DNA, 411 bp, Actinoplanes utahensis
atgggtgatcatcagctttgtcgtctttccgttaatgacggcgaactggagctcgccggcccgccggccgcactccgtgccctcagccagcggctccgccagtcaggtgcgacacctctggaggtagcgatcgccggcggctctgtggtgcaggaggtgaccggcggcccgctgctcgtcggcctgcgagatgcgaccacgttgcatgtttccggcggccgcgaatacctcgacatcttgtgggacgggctcgacggcgtggcgcatctggccgaggccgcggacgaccggggcgtgaaccggcatcagcacatcgagtaccttcccggcgacgaatatcgatcgccggactcaaaccccttagtcatcgtggccgactggccgcaagagccgatcccggtgccgcgttga

SEQ ID NO: 5128 - DNA, 471 bp, Actinoplanes utahensis
atgctcgacgatgaactcgtggagatcagcgaactgctgcagccgggtgtgaccaagccccacgtcgatcacgccgcgcgtgcttcctggctcgccgccatgcacgaggcgatgagaagcgtcggcggggccgttgtcaccgctgccgaggaaccggcggtgggccgcaactattaccgggtgggcgtggaagcccgtgacagtatcgcaggggccatcttgttcaacgcggccgcggtgttggtcgctgcggccgaggcgaccgatcctcaggagatcgctgtggtgttcgcagccgtgccaggcagcggggtgttctcggagcgaggatttcaggtggccagcccagaacagctcaatgaaccgctcagcgagcaccatctgcacgcgctcacggcggatgagcggcgtgatgtcgtctaccaccgtccgtctcgactcggagatctgctgttcaactggttcgactga

SEQ ID NO: 5129 - DNA, 384 bp, Actinoplanes utahensis
atgagctggggccagccgtgtcggctcgggccgagaccctgggaacggctgggactcgaatggcggcttcgcccggtcgcgccgaaccacggcaagccggtgatcgtcagtgagttcgagtcggcggcctggcagggcggcctgctgatctggatcagcggcgaagcggagcttgatgccgtccgtgtctccgatgatcaagcggttagcaagcactacgacctgaccgggctggacgacctggaagtgctgctcggcgaactggacgctctgctgacctccggtcgcgttcccgatgccgccgttgtccaccagcatccgttctgccagataccggccatcgccggacaacacggcgcgatcgtgccgagaagcggacgttga

SEQ ID NO: 5130 - DNA, 708 bp, Actinoplanes utahensis
gtgtcggagaatgggctgatgtcgcacgcgcacgtccttgtccacccttcgccgctgggcgcgcgtgcgcaggatttcttgactgcgcacgcgcgggtggtgcctgttgaggcaggaccgagcgatgacgagtgccgggctgcgatgcgctcggtgcttggacacagcgacgagagcgccctgaccactttccggcgcatccagcaacgatattcggggttgacctacttcagccatttccgcggcgccgagatcgtgttcgagccctcgttcgaggtggatcgcgataccgcgcaggttcttttcgagtacgccgtcatggacgtcacgcccgacggttgtcgcagtggactcgtacggcccgacgaagcggtgtggttcggctttctgcacgtggatgtgccggcgtttccctcgcttgaccactttttggagtgtgatgccctacttcatcacgcccgccagcagcggcttttgtccgccgcgactccgctggatgccaatgcctacctgaccgccctccgcgctcgccatccaggcctacggccggtgaaatcggcaagcggattctcagtgggttggtggagcgatgacgagcgactcgtgtacgtcaacggcttcgaagcgcgactggcggctgacggacgcgccatgagccctgtgccgaccgtcgtgacgacctggctcatcgacgaaccccttcgatag

SEQ ID NO: 5131 - DNA, 174 bp, Actinoplanes utahensis
gtggagggctccggctcttggcggacgttcgcgcacctaccggtggatcgcctgcgccggctggagcggaggtgcctcgacttcgccggcggtggggctgagtgcggaggcgacgaagccgaccgcgcccggattctcccgcaccgcagcgccgacccggcaccatccacgtga

SEQ ID NO: 5132 - DNA, 1338 bp, Actinoplanes utahensis
gtgcgcggacttctgctggcggcgtcgaccgccgtcctgctgacctgctcccccacggtgcccgcggcgggcggcttcgcgatgcgggtgctcgccgccggcctacggaacccctgggaggtgctgaccgggccggacggctggctctgggtgaccgagcgcagcgggcaccgggtgctgcgcatcgacccgggaaccggcgccaccagggtggccggcaccgtcaccgaagcggtcgggggcacgcgggggcaggacggcctgctcggcatggcgctgcggttgccggacgtctacctcgcctacagctacgacgccgacccgtccgccggcatgcgggagcaattcaagatctccgatttccggtacgacgcctcgaccggcacgctgcgccaccacgccgacctgctgaccggactgccggccagcccggatcacgacgccggtcggctcgtgctgggcgaggacgacaagctctactacacgatcggcgaccagggcaacgaccagctcgaccggttctgcctgcggaaccgggctcgcgacctgccggccgggccacgggaccggtccgcctaccagggcaaggtgctccggctcgaccgggacggcacggttccggccgacaatccggtgctcggcggcgtacgcacgcatgtctggtcctacggccaccgcaatccgcagggcctggtcttcgggcacggccggctgtactccagcgaacagggcccgaaaaccgacgacgagatcaaccagatccgcccgggcggggactacggttggccgcgggtcgccggccgccgcgacgacaaggcctaccggtacgccgactggtccgcttcggcgccggcgccgtgctcctcgctgacctacagcgactacacgatcccgccctcggtgcccacctacaccgagaccggcttcaccagcccggcgtacaccgatccgctgcgcaccatcggcaccgtgcccgacggctacgatttccgcgacgcacgctgcaccggcgccgcgaacatgtgctggcccaccgtggcaccgtcgagcctggacttctacgacgccccgggcatcccggcctggcgcgggtcgctgctgatgccggccctcaaggacggcacggtgtaccggatcccgcccggcggcgccggcgacccggtcgccgaactgcacaccgtcgaccgctaccgggacgtcgcgatcagcccggacggccgcaccgtcttcgtcgccaccgacccgtccggaaccaccctcggccgcgacggccggcccacgacgaacctggagcacccgggcgccatcctcgcctaccaccacaccgcaccctcctga

SEQ ID NO: 5133 - DNA, 198 bp, Actinoplanes utahensis
gtgtccgcgttcgtggacggctgcgaccacaactacggcacaccgacccagtgcgtcccgctgaccttcccgggcggtctcaccgacgccgccacgaagtgcgcctggctgacagcgcacggcttcaccagccttgtcgtggccggtcgggacgaccagaggctcgaccccgacggcgaccacgtcgcctgccggtag

SEQ ID NO: 5134 - DNA, 2916 bp, Actinoplanes utahensis
atggatcgtggtgatggacgccgacctgcagcacccgccggagatcgtgcccggcctggtcgcggcgggcgtccgggacggcgccgacctggtcgtcggcagccggtacgcgggcggcggcaaccgcgacgggctggccggcggataccggcggctcgtctccggcggctcgacggtcgtcaccaagctactgttccgcactgcgctgctgcaggtcagcgacccgatgagcggcctgttcgcaatccgcaccagctccctggaggtgggcgagctgcggccgctcggctacaagatcctgctggagctggtggtccgcaaccggcccggccggatcgtcgaggtgccgtactccttccagccgcggcacgccggcgagtccaagtcgtcgatcgccgaggggctgcgcttcctccggcacctcgggctgctgcggttcggcgcccagcgctcccggctgctgatcttcgcgctgatcggcctctccgggctgctgcccaaccaggccgcgctgtgggcgctgaaccacctggccggggtgcactacctggccgcggccgtactcgccaacctggtcgcggtcgggtggaacttcgcgctgaccgacacgctgctctaccgctcccggcgggcgcaccgcagcctccggagccggctcagccggttcttcctgctcggcaacgccgacctgctgctgcgcatcccgctgctggcgctactggtcgacggggcgcatctcggcgtcctgccggcgaacctggtcacgctggtggtgtcgttcgcggcccggttcctcatctcggacaaggtgatctatcgggcgcgcaccctccggccggtgccggcgtgacggtgctcaggtcgtaccccaggccgtggttgagcgggacggaccgcaagcgcatcggccaagcgctcgtcgtcgccctcctcgcggtgctcgccgctacggtcccggcagggccggcgcgggcgagcgccaacctggtcgccaaccccggcctggagaacctcgacccggccggcttcccggtgtgctgggagaagtccggctggggtgatcagagcttcaccttcggggtgagcagccccggccacaccggcgccaccgccatgcggatcagcctcgccacctcgcccagcggggaccgcaaggcgatgatgctggagaacccgtcgtgcgcgccgaccgtcacgccgggacaccagtacgacctgtccgcctggtacacgacgagcaccgcgaacaccgtgatgaccgtgttccggcacgacttggcgcaggggtgggtgtactggaccgatctggcgacgctgccggtggcctcggcctggacgcggaagaccgtgcgcacgccgcaggtgcccgcgaacaccgaccagatcgtctggggcgtgaccatctacggcgtcggcacactgcagaccgacgactacgcgatgaacgacgtgaccgcgccggcgaccggcacctcgtgcagtgccggggacgcctgcaccaagggcgtgtggcaggtgtcgccgttcgactcgccggtccggggcatccactcggtggtgctgcgcaacggggacgtactgctggtcgccgggtcggggaacaacccggacgacttcgcggcgaagaccttcacaaccgcggtctaccacccggcgagcggcacgttcagcagcgtggcgaccccggccgacctgttctgctcggggcatgtgcagctgcccgacggacgggtgttgatcatgggcgggaacaaggcctatccggcggccgacggcagccacgggtacgagggtctgcggagctcgtacgtcttcgacccggccaccgacagctacacccgggtcgacgacatgaccgcgggatcctggtatccgtcggcgaccgtcctgggcaacggggatgtcatctcgctgggcggcctcggggaggactcgtccggcacggtggcgacgcagtacttctcgaatgcccagcagcggtggctgggtctgggcgaggcgcaccagacgtgggccttctgggggctgtacccgtcgatgatcctgctgcaggacgggcggctcttctacaccggcagtcacgtcttcgggaacgggttgccgggcaccggggcgtcgatctacgactacggcgcgaacaccatcactgcggtgagtgggctgcggaacaaggacgagcgcgaccagtcgacgagtgtgctgctgccgcccgcgcaggaccagaaggtgctcaccctgggcggcggcaacatcaacaccaatgtggacgccaaccggctcaccgacatcatcgatctgaaacaggcgaatccggtgtacgcggcggggcccgcactgccggccgcaaagatgtacgtgtcggcggtgctgctgccggacgggaaggtgttcgagaccggcggaggcctgcacaaccgggccgatccggtctacgaggcctcgatgtacgacccggccaccgccacgttcaccgccggcatggcgaccgacccggtgccacgcacgtatcactcgtcggcgttcctgctgccggacggccgggtgatggcggtgggcgacaacccgggggacgggacgttcgacatgcggctgtcggtctactcgccgccgtatctgttccgcggggcgcggccgcagatcctggccatgcccgacaaccggtgggcatacgggtccagccacacgatcacggtggacggcccgatcctgaaggcggaactgatccggcccgaggccgtgacgcactccagcgacccgaaccagcggttcgtcgacctgccgatgtcggtgaacgggaccacgatcgggctgaacctgacgtcgaacccgaacatcgcgccgcccggctggtacatgctgttcgtggtggggacgaacggggtgccgtcggtggcgcagtgggtgcacgtcggatga

SEQ ID NO: 5135 - DNA, 1566 bp, Actinoplanes utahensis
atgaccacgatcgacctggcccggcccgccccggtcgtcccggcagcgggcagtgacgtaccgccgcgacatcgcgagggacgagcggacctggccgtggccctcggtctgaccgcggtgatcgtcgctctgctgacctggaacatcaccggtttcccggcggccagcgacgacgagggcacctacctggcgcaggcctgggcggtgcagcacggccggggtctggcgcactacacctactggtacgaccatccgccgctggcctgggtccagctggccgggctcgcctggctcccgaaactgctcttcccggcgctgaccgcggtcgccgccggacggatcgcgatgctgccggtgcaggccgccgggctgctcctggttcacctggtcagccgccggatcgggctgccgcgctgggcggccgcgctggcgctggtcacctacggcctgtcgccgctgtacctgaccatgggacggcagatctacctggacgcgttcgccgtggtgtggatgctcggcgcgctggccctggcgctgtccccgcgcaggcacctgtggcacttcgcggcggccggcggcgcggccgcggtcgccgtgctgtcgaaggagacgatcgccgtcgtcctgccggccgtggtcgtggcactgtggcagaacgcggcgcgcagctccacccggccgtgggcgttcggcgccttcctcagcggcctcgtcctcatcggctgcttctacccgctgtacgcggtgctgcgcggcgaactgttccccggcccggggcacgtgtcgctgatcggcgcctgggagttccagctgggctcccgggccggctcgggcagcgtcttctcggccggctcgggggcgtcgtcgctgctgcactcgtggctctactacgactcggtgctgctgatcgccggggcggtggccgccttcgccgggctcgcgctgcggcgggtccggccggccgcgctggccgggacgatcctggtgctggtcgcgctgcggccgggcggctacctgccggccatgtacgtggtgcaggtgatgccgttcttcgcgatcgcgatcgccggggtgatcgcctgggccgtcgccacgctgcgccccggacgcacccggtggcggtgggcgatcctcggcaccgcggtggcgctgtcactcacggtggtggtcccccgctggtacgtcggagaccaccgggcgctgaccacgaccgacaacgcgccgtacgcgcaggtcgccggctatctccacgagcggctggccggctcgcagggcgggacgatcgtggtcgacgacgtgctctggctcgactgtgtcgacgccggttacccgccggacagggtgctctggttctacaaggtggacctcgactcggcggtcgccgagcggctgcccggcgggtggcgcgacgtcgactacatcgtctcgacaccggccatccggcaggacccgaacagcctgcccaccatccggaccctgctgacgaactcgaccgtgatcgcctcgttcggcccgccggacggcctgatcgagatccgccgtgtggccaaggaggcaacgtcatga

SEQ ID NO: 5136 - DNA, 1236 bp, Actinoplanes utahensis
atggttttcgtctcggtggtcctctcggcgttcgccgtggtcaccctgtggtggacgatgcacgcctggcgtacgccggagaccctggccgccacccggttcgcaccgccggacggcgaacagcatctgacgttctccctgctcgtcccggcccggcacgagcaggccgtactggagcacaccgtgcagcggttgctgcggtccacccacgaggcgttcgagatcatcgtgatcgtcgggcacgacgacccggagaccgccgcggtggcccaccgggtcgcggcgggggcgccgggccggatcctggtggtcaccgaccacaacgaggtgaagaacaaaccacgggcactgaacaccgcgctggcctatgcgcggggtgacgtggtcggtgttttcgacgccgaggatcaggtgcatcccgacctgctggaacacgtcgaccacgcattccgggcgaccggcgccgacgtggttcagggcggtgttcagctgatcaatttccattccagctggtacagcctgcacaactgcctggagtatttcttctggttccgcagccggctgcacctgcacgccaagaagggtttcatcccgctcggcggcaacaccgtgttcgtgcgcaccgacgtgctacgcggcgcgaacggctgggacggcacctgcctggccgaggactgcgacctcggggtgcgcctgtcgagccgcggggccaaggtggtggtcgcctacgactccacgatcgtcacccgcgaggagaccccgcactcgctgcccggcctgctcaagcagcgcacccggtggcaccagggcttcctgcaggtgctgcgcaagggcgagtggcggcggctgcccacgctgcgccagcggatcctcgcccgctacacgctgaccagcccgttcgtgcaggccttcgccggcgtggtgatcccgatcggggtggcgatcgcactctgggcgcagctgcccgtgctggtcgccctggtcaccttcctgcccgtgctgccgatggtggccaccctgatgttccaggtgatcgggctgcgcgacttcggcaaggagtacgacttgcggatccgttggcaccactacgcccgcctgatcatcggcgctttcccgtacgccatcgtgctggccgtggcggcgctgcgagccgtctggcgcgaatacaccggccgccgcaactgggaactcacctcccacgtcggcgcgcacctgaccgaggcggcggcggcatga

SEQ ID NO: 5137 - DNA, 597 bp, Actinoplanes utahensis
gtgagttctccgcaccccgccgccccggtcggccgcccccggtccagcggcgcgcgacgcctcggcggctccgcccgcgaggagatcgtggacgccgccgccgcgctgttcgccgagcgcgggtacgcggccacctcgacccggatgatcgccgagcgggtgggcgtccggcaggcgtcgctgtactaccacttccggaccaaggagcagatcctcgccgagatgctggaggccacggtccggccgtcggtcgactacgcggccgccctgtcggcgcagggcctgggccccgccgacacgttgcgcgccctggtccgctacgacgtcggggtgctgctcggcgcccgctggaacatcggtatcctgtacgcgctgccggaaatcgccaccgagccgttcgcgcacttccgggccggccgggagcagctccgcgtcacctaccgcgagctggccggcggcgtcatccccggcgacctgatcctcggcctggtggagagcgtgatcgggatgcgccgcgatctggccgtgctgccgccgcacgaccaactgcaggacgccatcgccgcggccgccctgcgcctcatcgagaacgattga

SEQ ID NO: 5138 - DNA, 1551 bp, Actinoplanes utahensis
atgaccaccaccaccagcaccgacgccgcggacctgcgcggcttcggctacgagcccgaacttcgccgcagcatcggcagctacgcctcgttcgccgccggcttctccttcgtctcgatcctgaccacggtcttccagctgttcgccttcggcttctcgttcggcggcccggcgttcttctggacctggccgctggtcttcctgggccagttcacggtggcgctcaacttcgccgagctggccgcccggtacccgctgtccggttgcatctaccagtggtcgcggcggctcgccggggccacggtcggctggttcgccggctgggtcatgatcatcgcgcagatcgtcacggtggcctcggccgcgatcgccctgcaggtggtgctgccgcagatctggtccggcttccagctggtcggtggcgacccgtcgctcacctcgaccaccggcgcgaccaacgcggtcatcctcggcgcgatcctgatcgcgctgaccaccctggtgaacgtgatcggcgtccggctgatgtcgatcatcaacagcaccggcgtcaccctggagatcatcggcgtcgccgcggtggtggtgctgttgctcgtgcacgccgagcgcggccccggcgtggtcctgcacaccggcggcctgggcagcggactgtcctatgtcggcccgttcctggtgtcggcactgatggcggcgtacgtggtggtcggcttcgacagcgccggggagctcagcgaggagacccacgacccgcggcacaccgcgccccggaccatcctgcgggccctcgccgcggccgggatcggcggcggactcctgctgctggtggcactgatggccgcccccagcctgaccgacggccggctcgccaccgagggcctgccctacgtgctgaccagccgcctcggcgagaccggcggccggatcctgctgatcgacgtggccatcgcggtcgcggtctgcaccctggcgatccagaccgcgggcagccgcatgatcttctcgatggcccgcgacgaggtgctgccgttctccgccgcgctcagcagggtgaacccgcggaccggcaccccggcgctgccggccatcgtggtcggcgtcggcgcggccgcgctgctgctggtcaacatcggacaggccgccctgttcaccgccctgaccagcgtctgcatcgtgctgctctacctcgcctacgccctggtcacgatcccgctgctggtccgccggatcaagggctggccggtgaccgggccggacgtcaccaccaccgagcgcggcggccggctgttctcgctcgggcggaccggcatcgtggtcaacggggtcgccgtcgtctacggcctcggcatgatcctcaacctgggctggccgcgcgcggaggtctacgacccggccggcgcccactggtacctgcactacttctcgctgctgttcgtcgccgccacgctgatcggcggggccctcgcctacgcccgctaccggacccgggcgatgtcgctgcacctgccgtcgttcccggccgtcgtcgccgagggggaccccgcatga

SEQ ID NO: 5139 - DNA, 807 bp, Actinoplanes utahensis
atgagtaccgccaccacggccggcgcccggcagcacgcgcgggcgcaggccgggaccgtcaccgaacacatgccgatcgtgccggccagccgggccggggcgggcctggtctgggccgagaccgtcccgggcggcggttacgcgagcaagcggctggcccgcggcaccacgctgcggctgaccgccccgcacggcgacgcctgcgtctcggtgctgctgttcaacgccgacgaaccgtgggaacgcctcaacgtcgccgacaccgtcaaggtcctctggcaggcgtacgtcggcgaggggcacctgctcctgtccgaccagggccgggtgctcgcctcggtcacggcgggcgccgcggatctctcggacaccttctgcgggacgacgacgatcacgagcaacatccggcggtacggcgacggcagcgcccactcgggcacccccgccgggcgtgagctgttcaccctcgccgccgcgaagcacgggctgacccgccgggacctgccgccgagcatctcgttcttccagggggtccgggtcggcgacgacggccggttcgccccgcccgcggcggccgggccgggtgccaccgtggagctgcgtgccgagatgccgctcaccgtgctcctggtgaacgtgccgcacccactcgatgagcggacgacgtacacctgcaatgccgtcgaggtcagagccgcgaccggggccgcgaccgcgcccaccgaccgcctgtggtctcgcagcccggagggcgagcgggccttcctgaacaccgccgactacctcaccgcgcgggggatcgcatga

SEQ ID NO: 5140 - DNA, 606 bp, Actinoplanes utahensis
atgacgaccgttctcgaccagatcgtcccggcgcgcgcgccgtggtcggcgatcgtgcgccacgaccagaccttgaccatcgtggacctgcacggcaaccaggccgtcgactgcctgatctacaacgccgccgacaccgccgagcggtactcggcgccggacaccgtcgcggcgcagggcgggatcttcctgaccaccggcagtgtgctgcgctccagcgaggggaacccgctgatgacggtgatcgccgacgaggtggggcggcacgacacggtcggcggggcgtgcagccgggagagcaacacgctgcgctacggccaccacacccagcatcagcacgcctgcgtggagaacttcctgatcgagggcagccggtgggggctcggcaaacgcgatctggtcagcaacatcaactggtacatgaacgtaccggtcgacccggacggcagcctcggcatcgtcgacggcctctccgcccccgggctgaccgtcacgctgcgcgccgagctggacgtgctggtgctggtctccaactgtccgcagatcaacaacccgtgcaacggcttcgacccgacgccggtccgcatgatcatctcggagggctga

SEQ ID NO: 5141 - DNA, 3480 bp, Actinoplanes utahensis
gtgttcgacaccctgctcgtggccaaccggggtgagatcgcctgccggatcatccggaccgccgcccggctcggcctcaagacggtcgccgtgttctccgagccggaccgggccgcgccgcatgtgcggatggccgatcaggccgtgctgctcggaccggcgccggcccgggagagctacctggtggtcgaccgggtcctggcggcggcgctgtcgaccggggcgggcgccgtgcaccccggatacgggttcctgtccgaggacgccgcgttcgccaccgcggtggaggcggccgggctcgcgttcgtcgggccgacacccgcccagctgaccgcgttcggcgccaagcacaccgcccgtcagctggcgagcgcggccggcgtgccgatgatccagggcaccgggctgctgtccggtctggacgaggcgctcaccgccgccgcggcgatcggctacccggtcatgctgaaggcgaccggcggcggtggcggcatcggcatgcaggcgtgcttcggcccggaccagctcgcccgggcctacgaccgggtggaacgcctggcggtcgccaacttcggcagcggcggcgtgttcctggaacgcttcgtgccgcgggcccggcacgtcgaggtgcaggtcttcggcgacggcgccggccgcgtggtggcgctcggcgaccgggactgcagcctgcagcggcgtcatcagaaggtggtcgaggaggcgcccgcgcccggcctgccggcggcggtccgcgaccggctgcacgagtcggcggccgcgctgtgcgcgtcggtgggctaccggtcggccggcaccgtcgagttcgtctacgacgcggcccgggaggaagcctcgttcctggaggtgaacacccggctgcaggtggagcacccggtcaccgaggagatcttcgggatcgacctggtcgcctggatgctgcgcctggcccggggcgacgcgggcatgctcgacgagccgcggcgggcggccggggtggcggtggaggcccgcgtctacgccgaggaccccacccaggaccaccggcccggcgcgggactgatcaccgacgccgtcttccccggcgacgtgcgggtggacggctgggtggccgccgggaccgaggtgggcaccgcctacgacccgatgctggccaaggtgatcgtcaccggagcgaccaggggcgaggcgttcgccaacctgcgtaccgccctggccggaacccggatcgacgggatcgagacgaacctggggctgttgcgcgcggccgccgcgcacgaggacgtgctggcggcgcgacactcgacggcgaccctggccggagtgcacgacaccgagccgcgggtcgtggtgcagcggcccgggacgctgacgacggtgcaggactggcccgggcgcatcgggctgtgggaggtcggggtgccgccgtccgggccgatggacgacctgtcgttccggctgggcaacagggcgctcggcaatccggagggggcgcccggcctggagtgcacggtggacgggccggcgctgcggttcaccgccgagaccacggtctgcgtgaccggggcaccggtgccggtgagcgtggacgggcggccggtgccgcagtgggagccggtggtggtgccggccggtgcggtgctcgacgtggggacggcgaccgagggagggttgcgggcgtacgtgctgttcgccgggggcctggacgtgccgcggtacctggggagcgcggcgacgttcacgctcgggcagttcggcgggcatggcgggcgggcgttgcgggtcggcgacgtgttgcgctcggctgtcggcgcgatcggggccggccggcccgtcgccgcgcccccgcacatcggtcatgactggcggatcagggtgaccgaggggccgcatgccgccccggagttcttcacccgtgaggacatcgacgccttctacgccgccgagtggcaggtacacttcaactccgcccgcaccggcgtgcggctggtcggaccgaagccccgctgggcccgcaccgacggcggcgaggccggactgcacccctccaacatccacgacaccccgtactcggtcggcgccgtcgacttcaccggcgacgtgccgatcctgctcggcccggacggtccgagcctgggcggcttcgtgtgcccggccacggtgatcacctcggagcggtggaagctggggcagctcagcccgagggacacggttcgtttcgtacccgtcgacgaccttgatttcacgcccttgatcaggactcgggacgacggcgtcctggcgaggaccgacgacgccacctaccggcgttccggcgacgacaacctgctcgtcgaatacggcccgatgaccctcgacctcggcctgcggatgcgcgggcacgcgctgatggaccggctgcgcgccgaaggcctgccgggcgtcgtcgacctcaccccgggcatccgctcgctgcagatccacatcgacccggcggtgctgccggtccgcaagctgctcgacgtggtccggtcgatcgagctgcccgcggtccgcgatctcgaggtgcccagccgcaccgtgcacctgccgctgtcctgggacgacccggcgacccgggaggcgatcgcccgctacatgaacggggtccgcgacgacgcgccctggtgcccgtggaacatcgagttcatccgccgggtcaacggcctcgacgcggtcgaggatgtctaccggacggtgtacgacgccagctacctcgtgctcggcctcggcgacgtgtacctcggcgcgccggtcgccaccccgctcgacccgcggcaccgcctggtcaccaccaagtacaacccggcgcgcacctggacgccggagaacgcggtcgggatcggcggggcgtacctgtgcatctacggcatggagggtccgggcggctaccagttcgtcgggcgcaccgtgcaggtctggtcccgctggcagcgcgaggccggcgacccgtggctgctgcgccacttcgaccggatccggtggtacccggtcggcgcggaggaactgctcgacctgcgggccgacatggccgccgggcggcaccggctgcgcatcgacgacggcaccttccggctcgccgaccacgaggacttcctcgccgcgaacgcggactcgatcgcggcgttccgggccacccaggcggccgcgttcggcgccgaacgcgacgcgtgggcggcggccggtgaattcgacccgcggcccgaacccgaagcggcgcccgccgccgggcaggtgaccgtgccggacggcggcgcgctcgtcgaggcgccgttcgtgtccagcgtgtggcgggtcgacgtgcggcccggcgaccgggtggccgcggggcagccgctgctcgcgctggaggccatgaagctggaaaccgtcgtcaccgcgccgcgcgccgcgacggtcaccgacatcctcgtcaccccgggtgcgcaggtcgcgccgggcagtccgctggtggtgctggcatga

SEQ ID NO: 5142 - DNA, 1647 bp, Actinoplanes utahensis
atgagaccgacgacccgggtacgcgccgcgtacgaccgccttgcccgcaacgagcggccggaagcgtggatcacgctgcggccggtgacggacctgctcgccgacgcggtcgtggtggaggcgcgactcgccgccggagaggaactgccgctggccgggaagctcgtcgcggtcaaggacaacatcgacgtggcggggctgccgaccacggccggctgcccggcgtacgcctaccggccggcggtcagcgccacggccgtgcaacggctggtggacgccggggcactgatcctcggcaagaccaatctggaccagttcgccaccgggctggtcgggacccgcagcccgtacggggcggtccgcgacgtgcgtgacccgacccgcgtctccggcggctccagctcgggatccgcggtggtcgtcgcgctcggcatcgccgacctggcgctcggcaccgacaccgcggggtcggggcgggtgccggccgcgttccagggcatcgtcgggatgaaacccacaccgggcctggtgccgaccgacggggtggtgcccgcctgccgcagcttcgactgcgtgaccgttttcgcccgcaccctcggggaggggcgtcaggcgctcggcatcatcagcgacccgatgccgccctcgggcgcagcgccgccgcatccgatcgtcgcggtgcccgaccgctgcgagctgaccgcgctgtcaccggaccggctcgatgcgttcgagcaggtcaccaaggatctcgaagccgccggtgcccggctgcggccgatccggctcgccccgttcctggccgcggcgaagctgctctaccagggcggcttcgtcgcggaacgctacgccgccgtcggcgcgttcatcgacgagcatcccgccgaggtcgacccgacggtgcgcgccatcatcggcgccgcccgcgacatccccgcccacgtgctggtcgccgacaccgaacgcctcgaccggctgcgtgccgaggcgatggccgagtggggcgacgccgacgcgctgctgctgccgaccgcgccgacgcacccgacgagcgccgaggtcgccgccgacccgatcggcgtcaacgccacgctcggcacctacaccaacttctgcaacctgttcggcctcagcgcggtcgccgttccggccgccttcggcgtccagatcatcgcccggggattcgccgacacggtcgccgccgacgtcgcggccctcgtcctcggcgaaacaccctgcggcggtacgaccggaaccgggctgccgttgctcgtggtcggcgcccacctgaccggtcagccactgaaccaccagctcaccgagccgggcggccgcttcctgcgggccgtccgcaccgcggcgcactaccggctgcacgccctgcccaccgacccgcccaagcccgggctggtccgggtggccgcgggcggcgcggcgatcgagggggaggtgtgggcgctgccgccggacgcgctcggccgattgctggccgggctgccgagcccgatggcgctcggtccggtgcggctggcggacggcacgacggtcaccggcttcctgtgcgagggtgtcgccgccgaaggtgccccggacatcaccgggcacggcggatggcgcgcctacctgtcgtcccgggcgggatcgtga

SEQ ID NO: 5143 - DNA, 717 bp, Actinoplanes utahensis
atgatcccgggatatctggacgggtacgaaccgccgatcgtcgactcgcccctggtcgacggctccgcgctgatggcgcacgacctgttctggccggcgttcctgtccaccgtgggcggatctgcaacggcgccgtacgctttcggcgctgatcctgccgacctcgacgagatggtcgacgctttcctggacgagcacgagtggccggtgttctcgctgctgctcgccggcaccggtcagctgcacgtcgtgatgcggaaccttcccgacgacggcggtgtcgactacgttctcgaccccggcaccgggagcaggtcgattccgctcgctgcgctggacggacacttccgagggccggcactcgcctggccggagctgatcgacaccgcgcgaccccccggcgcccctcacacgtccgctgaacgactgctgcttctcctgccggcctgcgcagatcgcgaccgccccagcgacgtgaccgagatggtggcggccgccctcaccgctgtcggcgccgtgtccggtacccacgccgtcgccgaagagttgctcgacagccctcgcttctggacgcgcgactgcggatggaccatcgttgaccaagccttggtgtgcctcggatcgcacgcctaccgcagcgccgacgccgagctgacatcaagcgacctccgcctggtcaccgaggcattccggagcacgtcagccgacccggcgtag

SEQ ID NO: 5144 - DNA, 879 bp, Actinoplanes utahensis
atgtcgatcacgatgcagcttgcgacgccggattcgttaggcgagatcgttgaggcggtagcggtctggcagcacaccggcgggcccgtgcagcttcatccaggcgacctcgggtggcactggaggttcggcgggcgggagttggccgaggccgtccgggtgtggacccgtaacgggcagatcctggccgttggcctggtggacgacggggtgatccgcatgggcatcgcaccgggcgtcgacgaggacgccgcgttcgccgcccggctgctggccgatctgtcggatccggggcacggggtactgcccgacggcgccggggccgtcgaggcccgtttcggcgctgctcttcgacacctcctccgtcgcagcggttgggtgcccgacgaaccgtggaccccgttgtctcgcgaactgatcgagccggtggaggactgcgggctcagggtcgaggtcatcgaggcgcacaacgttcgggatcggttcgtcgatgatcgggtcgcggtgcaccgggcggcgttcgccaactcgacgttcactgtggagcgctggcgcgcgatggccgctgccccgccctaccgtcgggcccggtgcctggtcggttacgacggcgacggcgatgcggtcgccgcggcgacggtctggtcggccgggggcgggcgaccgggtctgctcgaaccaatgggcgttcatcgggatcaccgtggccacgggtacggccgcgccatcacggtggccgcggccgccgcgttgcaggagatggggtcgtccagcgcgatggtgtgcaccccgagcagcaacgtcggcggcgtggcgacgtacgtctcggccggctttcagaaggtcccggacgttaccgacttccgccgcacgagttga

SEQ ID NO: 5145 - DNA, 297 bp, Actinoplanes utahensis
atggctaccagcacccacgcacacgagaacgtcgccgtgaagggaaaccggttccggggcgaggagaccaagccctccttcaagaccactgagctgattgtttatgtgctcgcagtcatcggcgtactgatcgcctcttacaccgtcggcgacggggccgccaacaacggcaccgaccatttcgccgctgacaaagcgtggtggtacatcacgctgctgaccatcggctacatgatcagccgcggcctggccaaggccggtagccgcagcagcgacgtcgacccgcgcacgcactga

SEQ ID NO: 5146 - DNA, 306 bp, Actinoplanes utahensis
gtgggtcctgatgagaacacctatgtccgggatcagaacgcccgtgtggatccgatgctcaccatcggcacgatcaccgccgcggggctgcgggacattctcgccgacctgcccgacgacgccgtggtggtcgtcgcgagggatggagcgggcgacgacacctgttcaccgttggccgatgtggaggagtgctggtacctcgcggcgtccggtgagtccgttcccctcgggcgtgacggcgacggcaatgtccacgagcccggccccggcgacctgtacgccgtcctgctgcgccccacctgctga

SEQ ID NO: 5147 - DNA, 441 bp, Actinoplanes utahensis
gtgcgccacccaccggagccggacagcccctcgacgacccagctcatcgagcggttcgtgctggccagcagcacgtactaccaggagttcgccgccgtggccgaccggcacgacctcaactccacgcaggtcaagctgctgatcctggtgcaccggccgcagtccatgcgggcgctggccaagcagctgtcctgcgacgcctccaacgtcaccggcctcgtcgaccggctggagcgccgcggcctggtccgccgcgacgtcgcccccaccgaccgccgcatcaagatcatcgggcggacgccggcgggcgaggaggtggtcggaatggtgcgcgccgagatggcggcgacccaccgggccctcgcggccttcagcgacgacgagcgggcgctgctcggcaccctgctgacccgcatgcacgccgccctcgacgagagctga

SEQ ID NO: 5148 - DNA, 1494 bp, Actinoplanes utahensis
atgtcttcccccgccgcgcgccgcgagaccgtgctggtgctggtcctcggtgtcgccaccatggtggtgtcgatgatgcagaccctggtcgtgccgatcctcggcctgatcgggcacgacctgcacgccagcacctccgaggtcagctgggtcaccacggccacgctgctgtccgccgccgtcttcaccccgctgctcggccggctcggcgaccagtacggcaagaagcccaccctgctcgccgtcctggtggtgatggtcgccggctccgtgctggccgccctgacccactcgctgggctggctgatcgtcgcccgggtgctgcagggcgcggccaccgccatcttcccgctggccctgtccgtcgtccgggagcacctgcgcccggaacggctgcccggcgcgatggccctgatcagcggcaccctcgcgttcggcggcggcctggcactggtcaccaccggcctgctcacccagggcgcggacgccgacttccaccgggtgttctggctctccgccggcctcgccgtgctcgccctgctcgccgtcgccgcgatcgtgccgtccggcgggcaccgcagcggcggccgggtcgacgtgtggggcgcgctcagcctggccggcgtcctggtggcgctgctcctgccgatctcccagggccacggctggggctgggccagcgcccgcacgctgggctgtttcgccgccgcggcggtcctcgccgtcgtctgggtgctgatcgagcggagcgtcgccgagccgctcgtcgacctgcggatgttcacgcaccggccggtgttcttcaccaacctggccggcatcctggtcgggttcggcatgttcacccagtcgatcggcatctcgtatctggtgcagatgcccaccgcgctggccggctacggcttcggcgcctcggtgctgcgcgcgtcggtggaatacctgctcccggccgcggtcgcctcgctgctcgccgcccagctcggcggcgtcctgctgcgccggatcggcgcccgcgccaccctggtcgccggcgccgccctcggcgcgggcggcttcgcctggctggcggtcacccacacccggccggcctcggtgatcgccgccggcgcggtgatcggcgccggcgtcgccctgggctacgctgccatgcccgcgctgatcatggccagcgtcccgcaccaccagtccggcatcgcgaacggcatcaactccatctcccgctccaccggcagcgcgatcggcagcgccacggtcacctccctgctggccgccgccagcgtgcccggcctgccgccgggtgtgccgccgctgcccgccgaaagccagttcacgctcagcttcgtcctggccggtgccgccttcgccgtcctgatcgtgatcaccctgaccggcctgcgccgccacccgcagaccccggccaccccggccgcccccgccatcccggcgaccgaccccatccaccccgatccggcgccggtggcggccgcgcgctga

SEQ ID NO: 5149 - DNA, 1077 bp, Actinoplanes utahensis
atggctggaacgggttgcgcaacagccccccggggtctggaggccgccgtcgtcgagctggtccgccgcggcccggagcaccgcatccacgtggtgctgaccgccgaccgctgggcggatctcagcgccgggctgccggagtccgtcggcacccggctggagctgcggttgcgcgacgccgagcggtcgatggtcagccgtcgtgccgcgctggccgtgccgcgccgcgatcccgggtacgggctcaccccggacggccggcatttccggtccgccgcgccgtggccagacgcggccgtgccgatccgggccgcctggtcggggcagacggccccgcagatgcggatgctgccggagctgctgagcccggcggacctgccggaccggcccggggagggcttcccgatcggattggacgagtccactctggaaccggtccggttcgatccgggcgccgaccagcacctggtggtcgtcggcgatccgggatccggccggaccggggtgctgcggttgatcgcgcagtcgatcgtggcccgttgcatgccggcggaggcccggctgatgctggtcgatccccgccgcggcctgaccggcgcggccgacggccggcacctgctgatccacgccggctcccgggcggcggtggccgacgccgtcgccacggtccggcaggcgatgaccgaacggcttcccggcccggaggtgaccgccgaacggctgcgcaagggccgctggtggcgaggaccggacctgttcgtgctggtcgacgactacgacctggtcgccggcacggacggcgacccgctggccgaactggtccccctcctgccgtacgcgcgggacatcggcctgcacctgatcgtcgcccgtcgcacggcgggcgcggcccgggcgatgtacgagccgctgccccgcatgctcaccctgctgaacagcgcgttcctgctgctctccggcagcccggcggagggccctatcgtcggtgacgtccgccccgccaagcagcccccgggccgcggcacgctggtcacccgggccggcgtccgggtggtgcagacggcgtacccgcaatag

SEQ ID NO: 5150 - DNA, 1485 bp, Actinoplanes utahensis
atggccgggtgccgtcgccgtgcggtgacccccggtttaccggcgcgcggccggggaacgcgggcgtccctccggaaaggacgcccgatgaccgttcaccgcaccaccggcggcccggcctggacgcccgccctgcccgccggccgggtgatgtgcgccgacagtaccggccgggcactgctcgccctgtcggtgccgcccggggatcgtcgcgacgacaccctctcccgggtgccggtgctgggccgtcacggcgagctgccggaccgggcccgccgcgccgcgctgaccgcggaggccgccggcgaggccctgccggtggcgctggccgggcacgtggacgcggaggcggtcgcccgctgggtgaccgggcaccaccggtcaccacgctatccggcagtggtcctcggctcgccgcacggcgccgcggtgcacctggcggccgcgtgcggggcggcctggctgccgacgtccttcacggtcaccctcccgtggccgggcggggaccccggtgactgggcggccgcccgggactggggcgcccgcctggccgggcccatcctggaccgcaatcccggggtcaccgtgcggcaggtgcacgatcccgtgtcccgcggcgtcctgtgtggtgcgacggtgtccctgcaggtgcggtggcgcacgctgcccgcggcgtaccggtcgttcctcaccacccgcggtccggacggcgtccacctgttcgtccgcgacctgcggacctggccggtggacggcggcccacccggctacagcttccagatcgggtcgccggtcgccggcggcgacccggccgactaccgcggcggcgatgacgccttcggccggctgctgcaccggatcggcgccggcgactggaccgacccgccggccggcacaccccggcactacgccgagaccagcggcgagcccggcctggaagcggagatccggaccgtggccgcggccggcggatcggccggccaccggttgctctacagcgacccgcacgcgctcagcgccgccgtcgccgacctgcaccgggcgtggctgtcacccccgccgggcgcccggcacgccctggtcggcaccggccggatgaccgatccgtggcaggcgttcgacgccggcgtcgtgccctactggtgcgagtcgtcgtcgcacgccgcggccaccgccgcggagtggtggctggccggcagccggccctacgaccggatcaccgtgctgcccgacccgcccgggacaccgcacggccggctggccgccccggcgcactggcgttcgatcgccgccttcgccggccggggcgccgtcggcaacctgctggcccgccggtatcccaccctgccggcggcggccgggcacgccaccgactacctccggcacgccaccacggcccccggccggcgccccccgatcccggccggcgaggcggtgcgacacctgagccggcaccgcaccgtccccggcctgatgatcctgtga

SEQ ID NO: 5151 - DNA, 96 bp, Actinoplanes utahensis
atgaaatcaccgcgccgcgacggcacccagccgcgaaatcaccgcgccgcgatgacacccagccacaagatcgccgtcgcgacgacacccgggtag

SEQ ID NO: 5152 - DNA, 240 bp, Actinoplanes utahensis
atgtacaccggcgcgcagcaggcctcggccgccgcgcacggctacccgccggcgatgccgatgcggccgcccgcggtctggccggtcgccgtggtcacgctgttcttcggcatcttcggcctgatccccgcggtcatcgccaccggcaaggcacgccagcaggggatcgccgtcagccgttactggctcgccttcggcctcccgctgatcttctggctcggtgtcgtcgccgcgcggtga

SEQ ID NO: 5153 - DNA, 621 bp, Actinoplanes utahensis
atgcccggcaccgagcccgtccttctgccgcccagcgccgacccgaccttcgccggtccggcctacggaccgccgccggcttcgggggcggccgcgcccgcctacggtccggcggtcgagatgccggctccggctccggcctccgcgatgccggccccggcctccgcgatgccggccccggggtacgcgatgccgccgcaggggtacgcgatgccgccgcaggggtacgcgatgccggcccagggatatgcgatgccggcaccggcatacgggatggctccgggttatggcgcggctcccggttatggcgcggctcccggttacggggcggctcccgggcaggcggcgatggtcggtggcggcgtcgcgatggcgggcggcgccgcggcgatggtcggcggcggggcggccatggccggcggcaccgcggtcgcggccaccggtgccgccgtcgccggcacctcggtgatctccggcctcttcatgatgttcttcggtgccctcctgagcctgaccatcatcggcgcgatcgtcggcatcccgatgatcatggccggaatggccaccgccggcttcggcgccgcggccggcaccaccgcgatggtcgccctagctagctag

SEQ ID NO: 5154 - DNA, 1281 bp, Actinoplanes utahensis
atgacaccccgcaggactctcgccgtagtagccgcactgaccctgagcacactcggcctcgccgcctgcggaggcggtgacgactccagcggtggcaacgtcacgatggagctctgggagaacgccaccaccggccccggccgggcgttctgggagaaggcggccgccgactaccaggccgcccaccccaccgtcacaatcaagatccaggccgtgcagaacgaggaccttgacggcaagctgcagaccgccctcaactcgggcgccgcgccggacatcttcctgcagcgcggcggcggcaagatggccgcgatggtggacgccggtcaggtcaaggacatcaccgcggacatctcggcggagacgaagcaggcggtcccggaggcggcgctcaagaccgggcagatcgacggcaaggcgtacgccgtgccggtcgcgatcctgcccggcggcctctggtacagcaaggacgtgttccagaaggccgggatcaccgccccgccggccacgatggacgagttcaacgccgcggtcaccaagctgaaggcgaacggcaccccggtcgcgctcggcgccaaggacgcctggccggccgcgcactggttctacttcttcgcactgcgctcctgcagcaaggcgaccctggacgcgaccgccgagagtaagaccttcgacgatccctgctggaccagagccggtcaggatctgcaggcgttcgccgccacccagcccttcaacaacggcttcctgaccacctcggcgcagcagggcgcgggcagctcggccgggctgatcgccaaccacaaggccggcatggagctgatgggcgcctgggacccgggcaccatcgcctccctcaccaaggatgccaagccgctgcccgacctgggcttcttcccgttcccgtcggtgccgggcggccagggtgacccggccgcggtgatgggcggcacggacggctactcgtgctcggccaaggcacccagggagtgcagcgactttctcaactacctgctcaccaaggacgtgcaggaggcgtactaccggggcttcaacgcgctgccggtgaacagggcggcccagggcgcggtcaccgaggactacctcaaggcggtgctcgacacctacaacaaggcgccgtacgtgtcggtctggctggacaccctgtacggccagaacgtcggcaacgccctcaacgtcagcatcgtcaacctgctcgccggcaagggtgacgtcgccgggatcatcaaggccgtgaacgacgcggccaagaagggctga

SEQ ID NO: 5155 - DNA, 918 bp, Actinoplanes utahensis
gtgcccgcacgacggggagccggatgggcgcagcggctggagatcgctgccctgtccggcccggcgatcctggtgttcctcgccttcgtgatcttcccggtgctgatggccgggtactacgggttctaccgctggaaggggttcggggttccgaccgacttcgtcggactggacaactaccgcaccatcctgcaggacagcgcgttccacgacgtgctgctgcacaacggcctgatcgtggtgctgtccctggtcctgcagggcccgatcgcggtcgggctggccatgctgctgaaccgccggatgcgcggccggtcgatcctgcgcgtgctgatcttcgtgccgtacgtgatcgccgaggtgatcgtcggcacggcgtggggcctgctgctgcagagcgagggcgcggtcaacggcgtgctgcgctcgatcgggctgggcgggctggccgcggactggctctccgacccgaagctcgccatctggaccctgatgctggtcctgacctggaagtacgtcgggttcgcggtgatcctgttcctggccggcatgcagaacatcccggaggagctcagtgaggcggccgcggtggacggggcgtcgttctggcagacccagcggcggatcaccctgccgctgctcggcccgaccgtccgaatctgggcgttcctgtcgattctcggtgcgctgcagttgttcgacctggtctacatcatctgggggcagtacgtcgcgtcgaccgccggcacctcgaccatggtgacgtacatggtcaccgaggggcgcaacgccgcgaactacggctacggcaacgcggtcgcggtcgtgctgttcgccatctccatgatcatcgcgctcgtgtaccagcgtttcgtgctgcgccgcgacaccgagggcgcgctcaccggagggcggtag

SEQ ID NO: 5156 - DNA, 825 bp, Actinoplanes utahensis
atgaagagcagaacagccggcaacccggcggtctacctgatcgccctgctgctggtcggtctgatgctcggcccggtcgtctacatcgtcatcgggggcttccggaccaactcgcagatcatcaccgacccggccggcctgccccggccgtgggtgttcaccaactacgccgacgtgctggcgagcagcacgttctggcgccaggtgggcaactcggcgatcaccgcggtggcgacgacgatcggggtcgtcacgctcggggtgatggccagctacgtgctggcccgctaccggttccgcgggcggggcgcgatgtacgcgctgttcgcggccggcctgatgttcccggccacggtggcgatcacgccgctctacatcctggtgaagaacctgggcctggtgaacaccctgcccggggtgatcctgccgcagatcgccttcgggctgcccaccacgatcatcatcctggtgccgttcctgcaggcgatcccgaaggagatcgaggaggcggcggcgatcgaccggtgcagccggctcggcttcttctggcggatggtgctcccgctgtcggtgccgggcctgatcaccaccggcatcctggcattcatcaccagctggaacagctacctgctgccgctgttcatcctgaacgaccaggacagcttcacgctgccgctgggcgtgcaggcgttcgcgtcgcagtattcggtggacaccgcgaaggtgctcgcgttcacgtcgctgtcgatgatccccgcgctggtcttcttcagcctcttcgaacgccgcatcgtcggcggcctgaccggagccgtcaaaggatga

SEQ ID NO: 5157 - DNA, 699 bp, Actinoplanes utahensis
atgacatcgctgcacgtggcgaccaccggagccgacgacaccgacgggtcggcgcggcggccgttgcggaccatcaaccgggccgcggcgccggcccgccccggcgacaccgtggtggtgcacgccggcgagtaccgggagtgggtgaccccgcgacgcggcgggctcagcgacaaccgccggatcacctatcgggccgccgagagcgagcacgtcgtcatcaagggctccgagcggatcaccggctggcagccggacggcggcacggtgtggacggtggccgtgccgaacacgctgttcggcgacttcaacccgttcgtcgaggaggttgccggccgcgacgtgaaacaggccgggtacgcccggcgcaacgtctacgccgcgggtgcccggccgttcgccggcgaacgcgacccggtgatcctggagtgggggaccgccacggtggtggtggacggcgaggaggtgcacctggcgaccgacttcccggccgggatcgacgaggccgcggcggtcccggtgggtgggcgggacctggaacgggtccggttcgccgacgccgagttcgaggagcgcgacggccgccccgccatgctcacgaccgacctgaccggcgtcatcaaagatccggagcggcggtacgcggcgggtccgatcgtcgctctcaccgcggggccgcgccgggtccgggtctggtga

SEQ ID NO: 5158 - DNA, 1662 bp, Actinoplanes utahensis
ttgcgtcaccggcgggggaacgaccgaacggatccgatgacacttctcgaccacgtgcggcggccggcggtactcgccgggctgctcgccggtgtgctggggctggtctggacgctctggttcgcacacgacgccggcgacctggccgcccagtacgcctggacctcgttcgtccgcgagcatccctggtcggcgtacaacatgtcctggtacggcgggatgcacccggcgtcgtacagcgtgatctcgccgtatctgatggcttggctgggcgtccgcaccaccggggtgctcgcctgcacggccggtgccgccctgggcggcctggccctgacccggttcggcgtgcgccgcccgctgctgccgtcggtgtggctggcgatcgcggtctgggccaacctggccgccggccgggtcacctacctgctcggcatggtgttcgccctgatggccgccctgctcgccccgccgcgcagcgggccgcgcccggaccgcccggtgctggccgcggccctcggcgcgctggccaccctgtgcagcccggtcgccgggctgttcatcgaggtgctggccgcggcgctgttcctggtcggccggcggcgccgggcctacctgctggcggccggcccgccggtggtgatcgcggccacctcgttgctgttcccgttctccggggtgcagccgttcccctggtacgccgcgctggccacggtcgccgccgcggtcgcggtcggcgtgctcaccccgccggcctggcgcacggtccgggccggtgcctgggtgtacgccgtcggcgtggccctgtgctgggcgctgcccaccccgatcggcagcaacgtcgaacggctcgcgctgctggtcggcgcgctgatcctgttctgcgcggccccggcgcgccgcacccgccgcgccacggtgacctatctggcggcggccgcgctcgccgtctggaccatggtgcagccggtcagtgacgtgatccacacctcccgggtgaccgaccggaccgcggccgacgcgcgcccgctgatcaccgagctgctccggctggacgcccagcgcagccgggtcgaggtggtgccgctgcgcacccactgggaggcgtccgtggtggcgccctacatcgccctggcccgcggctggaaccggcaggccgacgtggaacgcaacccgttgttctacgacgacacgctgaccccggattcgtaccgtgcctggctgaccaactggagcgtggcgtacgtggtgctgcccgcgatggaaccggacagctcgggcatcgccgaggcgcagatcatcacggccgggcagccctggctgccgctggtgtggcaggacgccgactggcgggtctaccgggtggagggcgccgatcccctggtctcggcgcccgccaccgtcgtgtcggccgggccggccgcgctcaccgtgcacatgccccaggccggcagcgcactggtccgggtggcctggtcaccgtggctggcgatcgacggggccgccgacgactcggtgccgcgggcctgcctggcccgcagcggggagtggaccgagctgtccgcgccgacggccggcacctacacgatcgaggcccggtacgcgttgagcaggggcacaccgtgcggcatcacccggcacgaccccgacacgccgccccgctga

SEQ ID NO: 5159 - DNA, 1542 bp, Actinoplanes utahensis
atgcgcgtcgcactggtcacgctgtacgtcgctgcgggcctggtcgccgcggcgtactcggcgctgtcctggcgccggcggcaccgctcgtccctggcgatctcgctgggggtgatcctggcgagcgccgcgctctggtcgctggcccaggcggtggcggccgtcgccacgtcccgggcggtggggctcgccgccacctatgccatgttcccgggcgtcgcggcgctggtcgccgcgttcttctggcacaccaccgtgttcaccgggggcccgccggaagcgctcagagggcggctccggctgctgctcgtgcacccggtgctgctgaccgcggtggtggtgaccgacccgtggcaccacgcgttcttccggtcgatcagcgattatccgggcggtggggtcgttccgcacccgggcccgctgtactgggcacataccgcgtactgctacacgatcctggcgaccggcgccgcgcgtgcgatcggggcgatgcgccgggcggtccgcgggcatcggcgggtcttcgtcatcttcctgggcggcgcgctcgccccggcggccggcaacctggtgagcgtcgtggccgggctgggcgagcagcaggtcgatctgaccccggtgctgttcctgatcaccgcctcgatgtggtggtgggccgaacgggccggggtgacctcccggcggaccccggtggcgtacaagcaggtcatcgccgcgttgcaggacgcggtgatggtgctggacccggacggccggttcctggacgtcaacccggccgcggccgagttgctcgccgggctgaaccccgcggccgccggcgccgtggtgggccgccgctggcaggagatcaccgggccgcggctggcggcgacgttcgacggcgaaggccagcagacggtcaccgcggccagcggccgggtgtacgacgtgcgggtggttcggatgggtgaaccgggcggcgactcaccgggcaccgtggtggtggtccgcgacgtgaccgagctggaacggctccgggccgaactcaccgaccaggccgtccgggacggtctgaccggggtgttcaaccggcggcacctgaccgcggtgctggacggccggatccgcgaggcggtcgccggcggccatccgctgtcggtcgtgatgatcgacgtcgaccacttcaaggcggtcaacgacaactacggccacgcggccggcgacgaggtgctgacccggctggccggggagctgtccgcggcggtcggcacggccggcacggtggcccgctacggcggcgaggagttcgcggtcgtgctgcccggaaccggcgtccgggaggccgccgagctggccgagggatggcgggagcggtgcacccggctcaccgtgcccaccgcgtgcggcccgctgcggatgacgttcagcgccggggtggcgcagctgaccccgtcgacccgggccgaggagttgctgcgccgtgccgaccgggcgctctacggggccaaggaggccggccgcaaccgggtggtctgggactccctgaccgccgccaccccctga

SEQ ID NO: 5160 - DNA, 540 bp, Actinoplanes utahensis
gtggcggcggccggcggcaccccggtcgcggcggtcgcggtggccggggtgatcgccgccgacggcccggcctgggagcagtctcccgcggacctcgaccgcgacctcgcggtcaacctgcacggggtggccaacctggcccgcgccgccatccccggcatgctgggcgccgccgatccgtcccgatgccggttcgtcgccgtcgtatcgtccgcggccgagcgcgggctgccgctgctcgcctcgtacgtggcggccaaacacgccgcgctcggctacatccgcgccctcgccgcggacctgggcccgtccgggatcaccgccaacgcggtcctgcccgggagcaccggcaccgagctgctgacccggacggcccgtgcctacggcctggccggggcccaggatttcgcccggcaccaacggctggggcggctgctcaccccggccgaggtggccgccgcggtcgcctggctgtgctcggcggccgcctcggcgaccaccggcgcggccctggccgtcgacggcggcttcacgggctga

SEQ ID NO: 5161 - DNA, 252 bp, Actinoplanes utahensis
atggaagcggtggagatgagagtcgattccctggagcccgtccggccggtcgcggtgatcaccggagccggccgcggcatcggcgcggcggtggcccgcgccctggccgccgactacgacctggtcctcggcgacgcgcccggtccggccgccgagaccggcctgggctaccggttggccaccctcaccgagctgaccgcggtggccgcggactgccgggccgccggcgcccgggtggctgcccctagctag

SEQ ID NO: 5162 - DNA, 1227 bp, Actinoplanes utahensis
atgggcagggactggttcgagagcgtcgcagtggcgcagcgccgggcgcagcggcggcttccccggtcggtctacggcgcgatcgtcgccggctccgagcgcggcgtgaccctcgacgacaacctggccgccttcgccgagctggggctcgccccgcacgtggccggtcaggccgcgcagcggtcgctggccaccacggtgatgggccagccggtcgccctgccggtgatcatctcgccgaccggggtgcaggccgtgcacccggacggggaggtcgcggtggcccgggccgcggcggcgcgcggcacggcgatgtcgctcagctcgttcgccagcaagccgctgggcgaggtggtcgccgccaacccgcagaccttcttccagatgtactggatgggttcccgcgacgagatgctgcggcgcatggacgacgcccgccgggccggcgccaagggcctgatcgtcaccctggactggtcgttctcgcacagccgggactggggcagccccaccatcccggatcggatgaatctgtccgcgatgctgcgccacgccccggagacgctgcgccggccccgctggctgctggcctacctgcggcagcgccggatccccgacctgaccgtgccgaacctggccgacgacggggtggccccgaccttcttcggcgcctacggccgctggatgcagaccccgccgcccagctgggacgacgtgcgctggctgcgcgcgcagtggggcgggccgttcctgctcaagggcgtgatccgggtcgacgacgcgcgccgcgccgccgactgcggcgtgaccgcgatctcggtctccaaccacggcggcaacaacctggacagcaccccggcgccgatccgtgcgctgccggccgtggtcgaggcggtcggcgaccgggtcgaggtgctcctcgacggcggcatccggcggggcagcgacgtggtcaaggcggtcgcgctcggcgcccgggcggtgctgatcggccgggcctacctgtgggggctggccgccaacggtcaggccggtgtggagaacgtgctggacgtgctgcgcaacggcatcgactcggcgctgctcggcctgggccgcgccgacatccgcgacctgcggccggaggacgtggtcgtcccggccggcttcacccggcggctcggcgccggggtgcccgccgcgtccgccgcgcccgcggcctccgcggcgttcgaggtgatcggctga

SEQ ID NO: 5163 - DNA, 273 bp, Actinoplanes utahensis
gtgcgaacaacaccggcgccgggcgtcacgtcccggattctggagaacgggcacctggagctcttcgtcggcgacaccggccggcgcctgcagtggggccgggtcagcgcggcggtgtggatcgcgctgcggcagcaccgcgggcagtgcaccgccgccgccgacatgctggcggacctgtgggacatcgaccggatcaacatgcgcaccgaggtggagatccgggtggacgagtggtgcgacgccggcctgatgtgccgggagcgggactga

SEQ ID NO: 5164 - DNA, 1038 bp, Actinoplanes utahensis
gtgcctgctcgacggtcacccgctggtggccgagctggcgctgggcccgtaccggctggagctggtcgagaacccgggcgcggtcgcgggcggcgcgccgctggtgctgccgtgcgccgatccgggcgcggtgctggcccgggcggtggccgccggcgcgccggtcgaggcgggcgtcgtccgggacccgaccgggcaccgcatcgtcctcgagcccgccgccaccccggtggcgcagatctgttgaccagcaccgaccgagaggttctccccgtgacccagcaagcacccgatccggggctgtggttccgccgtttccaccccgcgccggccggtgacgtccggctggtctgcttcccgcacgccggcggctccgcgagcttctacttcccggtctccaaggcgctgagcccgcggatggaggtgctggccgtgcagtatccgggccgccaggaccggcggtccgaggcacagctcaccgatctgcacgtgctcgccgaccggatcgccgaagcgctcgccccgctgaccgaccggcggctggcgttcttcgggcacagcatgggcgcgatgctcgcgtacgaggtggggctgcgcctggaggacgccggacggcacgacctgacgcacgtgttcgcctccgggcgccgggcgccgtcgtgttaccgcggcgaatccgtgcatcagcgtgacgacgagggcatcctggccgagctgcagcggatggacggcaccgacccgcggctgctgaccgacccggagctgcagcggatgttcctgccggtgatccgcggcgactatcgcgcggtggagacctaccggcaccggccggacgcggcgctgcggtcggcgctgaccgtgctgaccggcgacagcgacgcgatgaccacggtggccgaggcgcgggactgggccgcgcacaccaccggccacttcgacctgcgggtcttcccgggtggacacttctatctggtgccccaggcggccgcggtgctcgacctgctgagcaccacgctcgccccacttccgacgtactga

SEQ ID NO: 5165 - DNA, 1464 bp, Actinoplanes utahensis
atgcgccaccggtgccggggcggacgcggtaaggggccgggcaggggcccgcctaggggttcacagcaccgccgggactcatatgttcaccgtcgcggtcggctgaccgccccgccgacacccgaggacttaggcatgacaatactggccccgaccctcgtcggaacggagcgcttccgggctctgggcccgcgtcacatcgatgagatcgcggatcgctacggtcttcccgcggacctccgcgagtccgtccggctggtgtcggcggtgctcccgttccgggtcaacgagcacgtgctgaacacgttgatcgactgggaccggatccccgacgacccgatcttccagttggttttcccgcaggccgggatgctgtccgccgacgacggccggcaggtcgccgccgcgctgtccgatggggaccggacgcggctgcagacggtggtccgggacatccgcggccggctgaacccgcacccgtccggccagatggagcacaacgtgccgcgcggcgcggacggcgaaccgctggccggcgtgcagcacaagtaccgcagcacggtgctgtacttcccggggcagggacagacctgccactcgtactgcacctactgcttccggtgggcgcagttcgtcggcgacgccgacctgcggttcgccgcgcagagcccgcaccagctggtcgagtacctgcaccggcacccgtcggtcaccgacgtgctggtgaccggcggcgacccgatggtgatgtccaccgaacggctgcgcagccacctggagccgctgctcgcggtgccgaccgtgcgcaccatccggatcggcaccaagtcgctggcgtactggccgcaccggttcggcagcgacggcgacgccgaggaggtgctgcggctgttcgagcagatcgtcgcgaccggccgcaacatcgcggtgatggcgcacttcagccatccgcgggagctggagccggagccggcccgctgggcgatggagcggatccgggccaccggggcgctgatctactgccaggcgccgctgatcgcccgggtcaacgactcggccgcggtgtggcgcgagatgtggcaccgggaactcgcggccggcgccgtgccgtactacatgttcgtcgagcgggacaccggcccgcacgagtacttcaaggtgccgctggagcgggccgcgagcatcttccgggaggcctaccaggatctgtccggcctggcccggacggtgcgcggaccggtcatgtcggccaccccgggcaaggtgatcgtggacggggtgacaccggccggcgatggcgaagcactgcagctgcgtttcctgcaggcccgtgatccggccctggtcggccggccgttcctggcccaccggtcgccgaccgcggcctggctcgacgagctggtgctgcacccgtcgaccccggccgacatcgccgccgcggtcggctcggcggtgtcccgatga

SEQ ID NO: 5166 - DNA, 1254 bp, Actinoplanes utahensis
atgacccgccacatcgcccccaacatggccctggaccagcggatcgccgagcggcaggcggccggcgaacggatcgtgcacctcggcttcggcgaggcccggctgccggtcttcgccccgctggccgaacggctggcggccggcgcggcccgcaaccggtacggcgcggtggtcggcgacctgccggtgcgcaccgcgctggccggctacttcacccgccgcgggctgcccaccgagcccggccaggtgatgaccgcgccgggcagcaaggcgctgctgatcggggtgcagctggccctgcccggcgacatcgtgctgcccgcgccgtgctggaacacctatctgccgcaggcggtgctggccggcaagacgccgatcacggtgccgatcccggccggctgcggcggcgtgccggatccggagctgctgcccggggcgctgcgggcggcccgcgcggccggccaccatccgcggatcatgctgctcaccctgccggacaacccgaccgggacggtcgccgacccggagacgatccgccggctgtgcgcgatcgccgaccgcgaggatctctggatcctctccgacgagatctaccgcgacatcctgcacggtcccgaggtggccttccgcagcccggccgagctgctgcccgagcgcaccgtggtgaccaccgggctgagcaagaacctggcgctgggcgggtggcggatcggcggggcccggttcccggcctcgccgcagggcgagcggctgcgggccgacgtggccgcggtggccagcgagacctggtcggcgctggcccagccgatgcaggaggtggccgcgtacgccttcagcgagccgccggagatccgccggcacctggcggccggggcccggctgcacgccgtcgtggcccgcgcggtgtacgagatcatggtgggggccggcgccacctgccgcccgccggccggtggcttctacgtctatccggacttcgagccgctgcgcggtcacctggccgggcacggcatcaccgatgcggcgtcgctggagcacgaactgctggagaccgccggggtcgccgtgctcggcgggcaccaccagggcgacgacccggcggcgctgcggttccgggcggccaccagcctgctctacggcgacaccgacgcggagcgtgcggcggcgctggcggcggcggatccggtggcgctgccgcacatccgggacatcctggcccggctcgaggaaggcctggccaaactgtgccgatag

SEQ ID NO: 5167 - DNA, 960 bp, Actinoplanes utahensis
gtgccgataggagactcgcgggtgacgtacgacggtgcggcgatcgtctttcccgggatgggtccgctccgctacgcggaggcggcccgcttcctgatgttcaacccggccgcgcggcggctggtcgcggtcgccgacgagacgctcggctaccggctgctggatcgctggcgcgacaccgagggcgactattcggcgtacgcgcaggccgccttcctggtcacctgcctggccctggccgagtgggtggccgagacccacgacgtgacaccgtcggtgatcgccggtgccagcttcggcggcaaggcggcggccgcgtacgccggcgcgatctcggcaccggacgcgatccggatgaccgccgggatcgcccggtgtgaagaggagtacttccgccgcgagcaccgcgacgtggtcaccgtgtcgttcgcccgcaccccccgggagcggctcgacgagatcctggccgacctgaccgccgacggcgggtggcacgacttctcctgctacgtcgacgacgacctgcacatggtgtcgatgtccgcgcagcggctggactggttccacgcccgggtccgccaggccggcgggctgccgctctacgtcaccgacccgccgatgcactcggccgcgttcggtccgctgcgcgagatcgtcgagcgcgaggtgttcgccggggtgcggttcgccgacccggatctgccggtgctggccgaccaggacggcagcctgcggcgcaccgccgcgggggtccgcgacatgctgctggacggcctggtcatgccggtgcgctggccgcgggtggtgaccgcgctgcgcgacgccggcgtcggccgggtgtacgtggccggcccggacagcctgttcggccgggtccgccgcaccaccgacaacttcgcggtggtgaccgccaacccgcggctggcgatgacgccgcgccgccgcccgctgccggtctga

SEQ ID NO: 5168 - DNA, 318 bp, Actinoplanes utahensis
ttgcccgccgcccggcggtgttctttcgtcgacctgaaaagggcattcttcaacgagggagacgacattatgtgggatgtgaagttcgaggagatggtccgccattgtttgccatttctcccgagcggcgaacagctcgaagcggacgccgatctgcgtgatctgggactcgattcgctgggcaccgtggaattgctctcggcgctggagaagggctaccaggtccgcttcaccgacgagatgctgagcatggacaccttcgccaccccgcgcaccctctggggcgcgctgtccggcatcgtcccgaccgcggtctga

SEQ ID NO: 5169 - DNA, 1527 bp, Actinoplanes utahensis
atggacgacgtcgcgctctcgctgccctcgagattcctgcgggggctggcgctgggccccggccgcaccgccctgcggatcggctcccagcgggtctcctacgccgagctgcacgagctcgcctgcgactgggccggcgccctgcgggccgcgccggacgggccgccggccgcggtcggggtgctggccggcaagaccttcgaaggttatgccggggtgctcgccgcgctgtacgccggggccaccgtggtgccgctgcacccggacttcccgatcgcccggacccggtacatgctgcagaccgccggtgtctcggcggtgatcgccgacccggccggctgggccgccctggaccggctgcacgccgaggggctgcgcctgcccgcggtcggtgacgggccggccggcgaccggctcaccatcggcgtccgcgccgccgacgcactcgccgggccggtcgcggccgacccggacggcgccgcctacatgctgttcacctccggctcgaccggccggcccaagggcgtgccgatcggccggggcgccgtcgcgcactacttcggcctgctggacgcccgctacgacttcggccctgacgacgtcttctcgcagaccttcgacctgaacttcgactgcgcgatgttcgacctgttcggcgcctggggggccggcgccacggtctgcccggtgcccgcgcaggcgtatcgggacctgcccggcttcgtcgccgaccggcggatgaccgtgtggttctccacgcccagcgcgatcgggctgatccgccggatgggcggcctgggcgcgggtgcgctgagcggactccgctggagcctgttcgccggggaggcgttgcgcgccgccgacgcggtggactggcaggccgccgcggaccggtccacgctggagaacatctacggtccgaccgagctgaccatcacggtcaccgggcaccggtggtcgccggccacctccccgcagcgctgcgtcaacgggctggccccgatcggcaccgtgcaccccggccacgaccacgtgctactcggtgccgacggcgcggaggtgccggccgagggcgagctgtgcatcaccggtccgcagatgaccaccggctacctcgacccggccgacgacgcgggccgcttcctggaccgcgacgggcggcgctggtaccgcaccggtgaccgggtccgccggctcgccgacggggagctggtctacctcggccggctcgactcgcaggtgcaggtccagggctggcgggtggagctggccgagctggagcacgcgctgcgcagctgccccggggtggaggacgcggtggccgtcacccggcccgccgaggaggggctggagctggttgtctactacaccggccaggtgaccccgccggcgctgctggcccgccggctgcgcgacatcctgccggccgggatgctgccccgcgtctaccgtcacctgggcgagctgccgctgaactccaaccgcaaggtggaccggggccggctggcgcgggacctagctagctag

SEQ ID NO: 5170 - DNA, 1644 bp, Actinoplanes utahensis
atggcaacctacggcagcgcgccgtttcacccacccctagatccccctatcccgggtccaccgcgcccgcgattctctctagactccgcattcatgaccattgtcgaaatacatgcgccggaaatgctgcatgaatttcttctgcagcatgccgcgacccggcccggcgcgcccgccgtgatcgagcagtcgcggaccacctcgtacggcgaactgcgcgagcgggccgaggcgtacgccgccgcgctggccgggctcgggctcggcatcggccaccgggtcgtggtcgacgcggacacctcggctccggcgatcgccatgctgatcgcctgctcgatgcggggcctgacctacatcccggtgagcccggagacgcccactccgcgggtcctctcggtggccgcggcggccggcgcggtgctgcacctgcagacgaccgagggagagcgcaccgggctgccgccggagctcggcgccggccggttcgggccggacagcctggaggtgacgcacctgccggcgatcgcgccgaccgggcggaccgcctgcaccccggtcgatccggcgtacatcgtgttcacctcgggcaccaccggccggcccaagggcgtggtgatgagccaccgcgcggtgctcagcttcttccgcggcatgctggcgcaccggatcgtcggcccggacgaccgggtggccaccacctcgccgctgcagttcgacttctcgctgctcgacatcggcctggcgctgggcagcggggccgcggtgctgcccgtgccgcgcccgttcctgcgctggccccggcggttcctgagcttcctggcggccaccggcgccacccaggtcaacggcgtgccgtcgatctggcggccggtgctgcgccacgagcccgaccagctgggcacgctgaccgcgctgcgcggggtgctctactccggtgagccgttcccgctgcccgagctgcggcagctgcgcaagctgcggccggggctgcggatcgtcaactgctacggcagcaccgagtcgatcgcctgctcgttcaccgacgtgccggacccggtgccggacagcggcgacggcgtgccgatcggccccgcccacccgggtgccgagctgttgctgctcggcgaggacggccgcccggtgtccggcgcgggcgtgctcggcgagctgtacctgcgcagcccggcgctgttcagcgggtactgggacgacccggccaccaccggccgggtgctggtgccggacccggtggagccgcgctccggccagctcgtgtaccgcaccggcgacctggcgacccggggcggcgacgggctgttctactacagctgccgcgccgactcccaggtgaagatccgtgggaaccgggtggagctcggcgaggtggaacgccggctgctggacctgcccggggtgggcgcggccacggtgctggcgccgccgcggccggacggcgagccggtgctgtgcgcgttcctggccgtcgctgccgaggccggcctgacggaggcgcgggtcagcgcgttctgcaaggagacgctaccggactacatgatcccgtccgaggtgcggctgctcggcgagctgccggtcacggtgaacggcaaggtggacaaggccgcactgctggccggccgggagtga

SEQ ID NO: 5171 - DNA, 1737 bp, Actinoplanes utahensis
atggagcgtgcggccatgcgcgattctcgcgggaccggttcggtcggcgatcacctggcacagcggcgggccggtctggccggatcgctgcgcgacctgccggtgcccgagcaggtgcgccggctgcggagcctggtgaccgggcaactgctgccgatcctgcggacgatccgcccggccgaggagatcgtggtggccggcgccaccccgttccgcgagcagggtctcgactcgctgggcctggtcgacctgcacgcccggctgaacgccgccaccgggctggcgctgccggtcaccgtgggtttcgaccacccgaccccggatgcgctcgccgcgtatctgcgggccgagctcctcggtctggccgagagcggcgccgaggtggtggccgcggcccgggccagcgacgagccgatcgcgatcgtcggcatcggctgccacttcccgggcggcgccgactcgcccgagcaactgtggcggctggtcgccgacgaggagcacgtgcacatgccgttccccgccgaccgcggctgggatctggacaacctcttcgacgacgacccggagcgggccggcaccacctacgtgcgacacggcgccttcctcaccggcgcggccggcttcgacgccgcgttcttcgggatcggcccgcgcgaggccgccgcgatggacccgcagcagcggctcgtcctggagaccacctgggaggcgctggagcgggccgggatcgatccgggcaccctgcgcggtggccggaccggcgtcttcatcggagccgaaccgcaggagtacgcggtacgcctgcacgaggcgcccgacggcctcgacgcttacctgctgaccggcaacaccaccagtgtcctgtccggccgggtcgcctacctgctcggcctggagggaccggcgctcaccgtcgacaccgcgtgctccggcgccctggtcgcgctgcacctggccgccgagtcgctgcgccgcggcgagtccgccctggcggtggccggcggcgtggcggtgatcggcgcccccggggtgttcaccgcgttcagccggcagcgcgggctggccccggacgggatcgccaagccgttcgccgcggccgccgacggcacctcgttcgccgagggcgccggcctgttcgtgctggagcggctggacgacgcccgccgcaacgggcacccggtgctggccgtgctggccggcaccgcgatcaacaacgacggggccagcaacggcctgaccgcgcccagtggcgccgcccagcggcaggtgatccggcaggcgctggccaacgccgggctcaccgccgaccaggtggacgcggtggacgcgcacggcaccggcaccacgctgggtgacccgatcgaggcgcgggcgctgatcgccgcgtacggcccgggccgggacgcggaccacccgctctggctgggctcggtgaagtcgaacatcgggcacacccaggcggccggcggcgccgccgcgctgatcaagatgatcatggcgatgcgtcacgacctgctgccccgcaccctgcacgtcgacgcgcccaccccgaacgtggactggtcggcggggacggtccggctgctcaccgaggcgacaccctggccgcggcgggaccgcccgcgccgggccggcgtctccggcttcgggatcagcggcaccaacgcgcacgtcatcatcgaggaaccggccgccgtcccggagccggagcggcccgccgcgccggtcccgccctag

SEQ ID NO: 5172 - DNA, 1260 bp, Actinoplanes utahensis
gtggtcaccggcgtggcccgggacgcccggctcgcctacctgttcaccgggcagggcgctcagcggttcggagccgggcgcgagctgtacgccgcgtacccggtattcgcggccgcgctccaggacgccgtcgcccacctcgacctgcacctggccgtgccgctcggcgaagtcctgttcggcgcctccgccgacctgctggaccgcaccgagtacgcccagcccgccctgttcgcgatcgggacggccctgttccggctgctggagtcgtggggcctgcgcccggacttcctggccggccactcgatcggcgagctgaccgcggcgcacctggccggcgtgctgtcgctggccgacgcggccgccctggtcgccgcccgcggccggctgatgcagcaactgccggccggcggcgcgatggtcgccgtgcaggccaccgaggacgaggccggcccgctgcgcgacgccgatctggacctggccgcgatcaacgggcccgagcagatcgtgctctccggcacccgggacgcggccgaggcggccgccgcccggttcgccgcgctcggccgccgtacccgcttcctggacgtcagccacgccttccactcgccgctgatggagccgatgctggaggagttcggccggctcgccgcggtgctcgactaccgcccgccggcgatcccggtgatctccggggtcaccgggcgcccggccaccaccgaggagctcaccgaccccggctactgggtgcggcacgtgcgggccgcggtccgcttccacgacagcctgacctggctgctcgacgagaacgtcggcaccttcctggagctcggcccggacccggtgctgtccgcgctgggccgtgcggcggtcaccgaccgggcgaacgccccggtcttcgccggcacgctgcgccgggaccgcgacgaggcccgcgaggtggccaccgcggccgcgaccgcgcacgtccgcggcgcccggctggacggcaccgggctgttcggtgcgcccgccacggccgtgccgctgcctacctatcccttccagcaccagcacttctggctgcacggcgcgcagaccggccgggtcgacgccccgggcctcggccagatcgcggcccggcacccgttcctcggcgcggtcgtcccgatggccggcgccggtgcgaccgtgctgaccggacggctcgccctggccgaacacccctggctcgccgaccacgtggtggccggcgccaatctgctgcccctagctagctag

SEQ ID NO: 5173 - DNA, 4320 bp, Actinoplanes utahensis
gtgctcgggcacgacgacgccgggcaggtcgacgaggaccgggcgttcagcgagatcggcttcgactcgctggccgccgtggaactgcgcaaccggctggccgacctgaccggcctgcgcctgccggccacgctgaccttcgactatccgacctcggtcgcgctcgccggccacctggccaccgcactcggcgaggcggccggcgcaccggtccctgcgccgtccgccggcccggcgccgaccgacgagccgatcgcgatcatcggcatggcgtgccgctatcccggcgacgtcaactccccggaacagctgtgggacctggtgctgcgcggcggggacgcgatctccacgttccccgaggaccgcggctgggacccggacacctacgacccggcgcccggggtgcccgggcgcagctactccaacgagggcggcttcctgcgcgacgccgccgagttcgacgccggcttcttcgggatcagcccgcgcgaggcccaggcgatggacccgcagcagcggctgctgctcgaggtggcctgggagaccttcgaacgctccggagtggacccggcgagcgtgcgcggcaccgggaccggtgtgtacgccggcgtcatgtaccacgactggggcctgcgactcggcacgctgcccgaggagctcgccgcgtaccacggcaacgggagcctggccagcatcgcgaccgggcggatcgcgtacaccttcggcctggagggcccggccgtcacggtcgacaccgcctgctcgtcgtcgctggtcgcgatccacctggcggcccaggcgctgcgccggggcgagatcgggctggcgctggccggcggtgtcacggtgatgtccaccccggacaccttcgtcgacatgagccggcagggcggcctctcctcggacggccggtgccggtcgttcggcgccggcgcggacggggtcggctggggtgagggcgcgggcctgctgctgctcgaacggctctccgacgcccgccgcaacggccaccgggtgctcgcactcgtgcgcggctcggcgatcaaccaggacggcgccagcaacggcatgaccgccccgaacggcccgtcccagcagcgggtgatccggcaggcgctcggcgcggccgggttgaccacggccgacgtggacgtgatcgagggacacgggaccggcacccggctcggcgacccgatcgaggccgaggcgctgctcgccacgtacggccgggaccggccggacgatcggccggtccggctgggctcggtgaagtcgaacatcgggcacgcgcaggcggccgccggcgtggccggggtgatcaagatggtcctcgcgatgcggcacgaactgctgccccgcaccctgcacgtggacgaggcgtcgccgcaggtggcctgggactccggcgcggtcgagctgctcaccagcgaacaggcctggccccggtcggcgcgcccgcgccgggccggtgtctcctcgttcgggatcagtggcaccaacgcccacctgatccttgaggagccacccgcggccggacccgtcccgccggtcggtgacctgccgctacccctgctgctgtccggccggtcggccgccgccgtgcgcgagcaggccgccctgctggacacctacctgcgggaacgcccggacagcgacctgacggcggccgccctggcgctggcgacgacccgggccgcactgccgttccgggcgagtgccgcggacccccgcgacctggccgcgccggtggtgaccgaggccgggcccggccggaccgccttcgtcttctccgggcagggggcgcagcggctcgggatgggtcgtgggttgtatgcggcgtttccggtgttcgcggccgcgttcgatgcggcgttgaccgatccgggtctgcggggggtgatgtggggtgacgatgtcgaggcgttgaatgcgacgggtgtggcgcagccggcgctgttcgctttcgaggtggcgctgttccggctggtggagtcgtggggtgtgcgggccgatttcgtggccgggcattcggtgggtgagctggccgcggcgcatgtggccggggtgttgtcgctggatgacgcgcggcgtctggtcgctgcgcgggcgggtctgatgcaggccctgccgccgggcggggtgatggtcgccgtgcaggccgccgagtcggtggtccggccgctgctggtcgagggcgccgacgtcgccgcggtgaacgcggccggctcggtggtgctgtccggcgaacccgcggcggtcgacgtggtgctggccggcctgcccggggtgaagacctcccggctgcgggtgtcgcacgcgttccactcgtcgctgatggacccgatgcttgccgagttcgccgaggtcgccgccggaatcgaccacggtgtggcgcggatcccggtggtgtcgacgctgaccggtgcggtggccgacttcgacgccgatcactgggtgcgccaggtgcggcaggcggtgcggttcgccgacgccgtgcagcacctggaagccgccggcgtgacgcggttcgtcgagatcgggccggatgccgcgctcaccccgctgatcgacgcgaccggcatcgcgacccagcgccgcgaccgggacgaggtgaccgagctgctcgccgcgaccggccgggcctggacccacggcgtgcgcgtcgactggaccgcggtgcgcccggcgccggtcgccgcgctgccgcacgatctgccgacctacgcgttccagcggcgccgctactggctcgacgtcacccccgccggtgacgtcggcgcggccgggctcgacccggtcgagcacccgatgctggccgccgcggtcgtctctgccgccgacggcgggctggtgctcaccggccggctcagcgcggccggccccggctggctcgccgaccatgacgtcctgggccgggtcctgctgcccggcaccggcttcgtcgagttggcgctgcgcgccgccgaccaggtgggcggcgcgggcgtcgaggagctcaccatcgaggcgccgctgaccctgccggcccgcggcggcgtggccgtccaggtggtggtcggcccggcctccggcgccgggatccgcacggtggccgtgcactcccgcgccgaggccggcgcgccctggcagcggcacgccaccggcaccctcaccgccgtcgcggccgagccggacttcgacctgatggcctggccgccggccggcgccgccccgatcgaggtgaccggcgcgtacgagcggctgcgcgaccgtggctacgcgtacggcccggcgttccgcggcctgcgcgccgcctggcggcacggcgacgaggtgtacgccgaggtcgccctcccggagagcgcccacgccgacggccgtcgcttcggcctgcaccccgccctgctcgacgccgccatgcacgccgacctgctcggcgacgacccggacgcgccgaccctgatgccgttcgcctggaccggtgtcaccctgcacgccaccggggccaccgcgctgcgggtccggatccgccgggtgcgcggcgacgaggtgtccgcgatgtggatcgccgacgacaccggccgcccggtggccaccgtcggcaccctggtctcccgaccggtctcggccgcccagctgcgcgggtccaccgcggccggcgacgcgatgttccggatcggctggcaggcccgcccggtcaccccggacggccgggtgctgcccgaggccggcgccgcggcgcccggcccgctggtggcgctcaccctgcgggcctccggggcggatgtcccggccaccgtccgtgccgtcaccggcgacctgctcgaccggctgcgcgcctggctcgacgacgacgcgaccgccggttcccgcctcgtggtggtcaccgaccgggcggccgccgtgcgggacggtgacgacgccgacccgcgcaccgcccccgtctggggtctggtccgggccgcgcaggccgaacaccccggccggcttcagctgatcgacaccgacggcacgccggaatcggacgccgtcctggcggccgccgccgcgaccggtgagccggaactcgccgtccgggccggtcaggtgctgatcccgcggttcgagccggcgcccggcggcgaccgggagatcccgtggccgaccggcggcaccgtactggtcaccggcggcaccggcgggctcggcgccctgctggcccggcacctggtcaccgagcacggcgtgcggcacctgctgctcaccagccgacgcgggccggacgcgccgggggccgccgccctggccgacgagctgcgcgccgcgggcgccgaggtcaccgtcgtcgccctagctagctag

SEQ ID NO: 5174 - DNA, 6264 bp, Actinoplanes utahensis
gtggccgcgatgatcgccgcggtgccggccgaccggccgctgcgcgccgtgctgcacgccgccggtgcggtcgccggcggcaccctcgccgcgctcaccggcgagcacctggacacggtgctggcacccaaggtggacggcgcctggcacctgcacgacctgacccgggaccggcagctcgacgcgttcgtgctgatctcctcggccggcgggtcggtgctggcggccgggcagggcgactacgccgcggcgaacgtcttcctggacgcgctggccgcgcaccgccgggccgccggactgccggccacctcgctcgcctacggcatgtgggcggtcgacaccgggctcggcggcgcgctgggccgggccgacctggagcggatgcgccggctcggcctacccgccctggaacccgccgcggccctcgaactgttcgacgcggcggtccgccaggacagcccggccgtgctgctcacccgggtggaccggaccgcgctgggcgcccgcaccgacgagctcccggccctgctgcgccggctcgcgcccccggcccggcgccgtgccccggccgcgaccgaaccgaccgcgttcaccgaccggctggccgggctggccgaggcggacctgctgcgcaccctgatcgacctggtgcgtggtcaggtcgccacggtcctcgggcacgagggtgccgcggcggtcgcccccgaccgggcgttccgcgagctcggcttcgactcgctggccgcggtggagctgcgcaacgcgctgagcgccaccacgggtctgcggctggccgccaccctggtcttcgaccatccgacgccgcgggcggtcgccaccgagctggccaccatgatcggcggccggccggcggccgagccggcggcgccggagcgcccggccaccgtgcgcccggccgacgacccgatcgccatcgtcgggatcagctgccggttccccggcggggtgcgctcggccgaggacctgtggcggctggtcgccgccggggaggacgcgatcggcccgttcccggccgaccgcggctgggccggggacagcatctacgaccccgagccgggggtaccgggcaagacgtacacccgggccggtggtttcctctacgacgccgcctacttcgacccggagttcttcggcatcatgccgcgtgaggcgctggccatggacccgcagcagcgcctgctgctggagggcgcctgggaggcgttcgagcgggccggcatcgacccggccgggatgcgcggcagccgcaccggcgtctacgccggcgtgatgtaccacgactacgccagccggctccccgagatccccgccgagctgaccggatacgtcggcaacggcagcgccgcgagcatcgcctccggccgggtcgcctacaccctcggcctggagggcccggccgtcacggtcgacaccgcctgctcgtcgtcgctggtggcgatccacctggcggcccaggcgctgcgcaacggcgaggtcgccatggcgctggccggcggtgtcacggtgatgtccgcgccggagatcttcgtcgagttcagcgagcagcgcggcctggccgccgacggccggtgcaaggcgttcgcggccgccgcggacggcaccgcctgggccgaggggctcggcatgctgctgctggagcggctctccgacgcccgccgcaacgaccacccggtgctcgccgtgatccgtggctcggcgatcaaccaggacggcgcctcgaacgggctgaccgccccgaacggaccgtcccagcagcgggtgatccgggccgcgctggacgccgccgggctcgccccggccgaggtggacgcggtcgaggggcatggcaccggcacccggctcggcgacccgatcgaggcgcaggcgctgctggccacctatggccgggaccggacggacgaggacccgctctggctcggctcggtcaagtcgaacatcgggcacgcccaggccgcggccggggtgagcggcctgatcaagatggtgatggcgctgcgccacgagcagctgccccgcacgctgcacgtggatcagccgtccccgcaggtggactggacggccggggcggtccggctgctcaccgagccggtcgcgtggcaacgcggtgggcgcccgcgccgggccggcatctcctcgttcgggctcagcggcaccaacgcccacctgatcctggaggaggccccggccgagccggtgaccacaccggtgcgcgttcccggcccggtgctgctgccgatctcggcccgcaccgcggcggccctgcccgaccaggccggtgcgctccgcgcccacctggccgagcagccggacgcggacctgggcgacgtcgcgtactcgctggccaccggccgtgccgcgctcggccaccgggccgtggtgctggccgccgaccgggatgcggccctggccgggctggccgaggtggagccggtgaccgccggcgacgggctgaccgccttcgtcttctccgggcagggggcgcagcggctcgggatgggtcgtgggttgtatgcggcgtttccggtgttcgcggctgcgttcgatgcggcgttgaccgatccgggtctgcggggggtgatgtggggtgacgatgtcgaggcgttgaatgcgacgggtgtggcgcagccggcgctgttcgctttcgaggtggcgctgttccggctggtggagtcgtggggtgtgcgggccgatttcgtggccgggcattcggtgggtgagctggccgcggcgcatgtggccggggtgttgtcgctggatgacgcgcggcgtctggtcgctgcgcgggcgggtttgatgcaggccctgccgccgggcggggcgatggtcgccctgccggtgcccctggaccgggtcgagccgctgctcaccgcgggggtggacatcgccgcggtgaacggtccggcctcggtggtgatctccggcgccgaggacgaggtgctgacgatcgccgccgccttcccgagcgcgcgccggctgcgggtgtcgcacgcgttccactcgtcgctgatggacccgatgctcgccgacttcgccgaggtcgccgccggaatcgaccacggtgcggcgcggatcccggtggtgtcgacgctgaccggtgcggtggccgacttcgacgccgatcactgggtgcgccaggtgcggcaggcggtgcggttcgccgacgccgtgcagcacctggaagccgccggcgtgacgcggttcgtcgagatcgggccggatgccgcgctcaccccgctgatcgacgcgaccggcatcgcgacccagcgccgcgaccgggacgaggtgaccgagctgctcgccgcgaccggccgggcctggacccacggcgtgccggtcgactgggccgcgctcaccccggccggccggacggtcgacctgcccacgtacgccttccagcgccgccgctactggctggaggcgcccccgtcgcgtcccggcgacccggccggactgggccagcacgacgccgcccacccgatgctcggcgcggtcgtggtcgccgccgaatccggcacggtcaccctgaccggccggctgtcggtgcccacccacccgtggatcggcgaccactcggtgctcggcaccgtgctgctggccggcaccagctacgtcgaactggcgctgcgggccgccgccgaggtcggctgcgacgtggtcgaggagctgaccatcgaggccatgatgacgctgcccgaccagggcggcgccgcggtgcaggtcgcggtcggcgccccggacgcggccggccggcgcggcttcaccatccactcccgggccgaggacgccccggccgaggtgggttggacccggcacgtctccggcttcctggcccccggcgcgccggtcgccaccaccgcgtcgttcgggctgaccgcctggccgccgccgggcgccgagccggtcgacatcagcgacgtctacgactacctgaccgggcagggctaccactacggcccgatgttccgcggcctgcgcgccgtctggcggcagggccgggaggtcttcgccgaggtggccctgccggacgaggcgcgctccgaagccggccggttcgggctgcacccgtcgctgctggacgccgcgctcagcgccaccgacttcctcgacgggcgccgcccgcaggatgtcggcggcacccagctcccgttcgcctggaccggggtggccctgcacgccggcggcgccaaccggctccgggtccggatcaactgggtcggctcggatgccggcgccggctccgaagcggtccggctgcagctcgccgacccggccggccggccggtggccacggtcgaatccctggtggtccgcccggtcaccccggaccgggtggccgccgcggccaccgcggccagcggcgcccgccggctggacacggtgttccgggtgaactggacacacctaccgctgggcggggcgaacacggcggtcgccgggcgctgggcggtgctcggcgaggacgtcttcgggctcggcccgaccgtgccggtcttcgccgatctgaccgccctgcgcgccgccggccggccggctcccgaggtggtgctgaccggcaccgcgccggccgggggagacgtgcccggcgccacccgggaccggttcgacgagatgctccggctgtgccaggagtggagcgccgaccagcggttcgcccagtcccggctgatggtggtgaccaccggcgcggtcgccgtcgacgacgaggccgccgaactcacccaggccccggtctgggggctggtgcgcgccgccgaacaggagaaccgggaccggttcgtgctggtcgacgtggacgacccggggcgggccgcgccgctgctggcccccatcgcggcggccggggaaccggaggcggcggttcgcggcagccaggtgcgggtgccgcgcctgacccgggccaccgcaccggccaccggtcatccggcgccctgggatccggccggaaccgtcctgatcaccggcggcaccagcggcctcggcgcagtcctggcccggcacctggtcaccgcgcacggcgtgcggtatctgctgctgctcagccggcgcggcgcggacacgccggaggccaaggcgctcagcgccgatctgaccctgctcggcgccgaggtcaccgtggccgcctgcgacgtcgccgaccgggaggcgctggccggggtgctcgccgcggtgccggccgaccggccgctgcgggccgtggtgcacgccgccggggtgatggacaacgccatgctcggctcgctcaccgcggaccgggccggccgggtgctgcggcccaaggtggacggctcctggaacctgcacgaactgaccggagacctggacaccttcctgctcttctcgtccacctccggtctgctgatcggggccggtcaggcgagctacgcggcggccaaccggttcgccgacgcgctcgccacccaccggcgggcggccggactgccggccaccgcgctcgccttcgggctctggaccaccccgaccggactgggcggtggcggattcgacgcggcggccgaggaacagcggatggcccggctcggcatgccggccttcgacacggccgacggactggcgatgatcgacgaggcgctggcgctgggggaggcgtcactggtgacgatgcgggtggacaccggggcgctggccgcggcgccggccgcagccgtgccaccactgctgcgggagctggcgggcacgccggtgacgcgtacgccgcaatcgtcggtgaccgccgtggcgcccgcaccggaggcgagcctggagcagcgactctccgccctgaccggcgcggaacgcgccgacctcctgctcgacctggtggtggcgcacgtcgcgcaggtccgccacgacgaaccggacgcggtcgaccggacccgcggcttcaccgaactcggcctggactcgctggccgcgatcgaactgcgcaaccggctcagcacggcgatcggcatgcggctgcccgccaccctgatgttcgactacccgaacccgacggcgctggccggattcctgctcgaagagctggagccgaccctggcaccgccgccggccgcgccggaccccgacgccgaacggctccaggcggcgctggccgccctgaccccggcccggctgcgcgaggccggactcttcgaccgcctgctcgcgctggccgcgggcgacaccggcccgtcgatcgaggagatggacgtggccgacctcgtggcggccgcgatggcgaccaccgacaacggaggagaatga

SEQ ID NO: 5175 - DNA, 915 bp, Actinoplanes utahensis
atgccgacagccaagggaaccgtcgcgttcggcccgcaccgcacctggtaccgggtgaccgggcagctcggcgccggccgccccgccctcgtcgtgctgcacggcgggcccgggatcacccacgactatctgaagaacatcgccgacctggccgccgacggctggccggtggtccactacgaccagctcggcaacggcgggtcgacccacctgccggagcgcggcgccgacttctggacgcccgcactgttcctcgccgaactcgacaacctgctcaccgggctcgggatcgccgacgactacgtgctgctcgggcactcctggggcggcatgctcggcgccgcgcacgccgccacccgcccggccgggctgcgcggcctgatcgtcgccaactcgccggcgtcctacccgctctggctgcaggagatgaaggtcctgcgcgaccggctcccggacggggtgaacgacaccctgctgcggcacgaggcggccggcaccgtcgacgaccccgaatacctggcggcgagccgggcgttctacgagcggcacgtgtgccggcgggtgccctggcccagcgactacatggcctcgttctacgagctgtacaacgacccgaccgtgtaccggacgatgaacgggccgaccgaattccacgtcatcggcacgctgcgcgactggtcggtcatcgacctgctgccctcggtcgcggtgcccaccctggtgatcagcgggcggcacgacgaggccaccccggccaccctccagccgtacctcgacctggtgccggacgtgcgctgggagctgttcgaggagtccagccacacgccgaacctcgaggagccggaccgtttccgcgaggtgctcggcgccttcctcagcgagttgacaaggagcccgcgatggcagcaggactga

SEQ ID NO: 5176 - DNA, 495 bp, Actinoplanes utahensis
atggcagcaggactgaccgaacggacgtcgatcgccgggttccgcgaggcgatggcgtccttccccagcggcgtcaccatcgtcaccaccaccgaccaggacggccactggtgcggcttcaccgccacctcgttctgctcgctctcgatggacccgccgctggtgctggtctgcctggcccgcaccgcgcgctgccaccccggcttccggaccgcgcgatcctgggtgatccacacgctgacgccgggccaggccgggctggcgatgcggttcgcggaccggacggcggacaagttcggcggcggcgaattcgtggccaacgcgcagggacacccggtgctgcccggcgcctgcgccatcgtcgaatgcgacgcgtactcgcagcacgaggcgggcgatcacaccatcctgatcggacgggtcaccgccgcccgggtgcaggcggccgagccggccgtctacttccggcgcggcttccgcgaactgtcctcctga

SEQ ID NO: 5177 - DNA, 522 bp, Actinoplanes utahensis
gtgacggaacgggaacaggcgttggcgatgggctccatcgcggagtatggccgctacgtgcgattcgcgtgtccggcctactccggtgaatggctcttcttcgccccgatcggcacgctgacgacggccggcggcatcgtgggcatcgtcaagggcggcggcggcctggcagactggatcttcctgccgctgagtctgatcgtgggcctggcgatggtcggtctgtgcttccggccggcgttcgagcggcgccgaggcggccccacgccgcggctctactgcttcgaggacggtgtcgtggtggccacccgcggcgagctgcgggcgttccgctggaccgagctcaccgtgcacagcgtcgactggacctccggcagcggggagaactacagcagcgggacgcgccggacctggaccgggccggacggggccgaagtcgtcaccttccgcggggacgagccggagcgggccggggaccgggacatgcgcaagctccacgaggcggcgctgcggtcccggtga

SEQ ID NO: 5178 - DNA, 612 bp, Actinoplanes utahensis
atggcaacgcaccaggatgcttccgcggccaagtcccggtccggccgcccgcagatcacctcccgggaccatctggagaaggtggcgttccggctgttcgcggagagcggcttcgacgccaccacgatcgacgggatcagcgacgcggccggcatcgggcggcgtaccttcttccgctacttcgcctcgaagaacgacctggtctggggtgacttcgacggcgagctggcggtgttccgggcctggttcgcggcggtgccggccgaccggccgatgctggacgcgatccggcacggggtgatcgcgttcaacacctacccggccgcgcaggtggcgctgcaccgggagcggatggccctgatcctgcgggtgcccagtctgcgggccgattcgacgctgcggttcgtgcagtggcggcaggtgatcgcggatttcgtggcggcccggcgcggcggccgcccggacgagctctacccggtgacgatcggtcactgtgcactgggcgcggcgctcgccgcgtacgaggtctggctggaggacgagaccgccgacctgccggcgctgctggccgagtccctgcgggtgctgaccggcccgcaccaccacgcgtga

SEQ ID NO: 5179 - DNA, 297 bp, Actinoplanes utahensis
atgagcgtgaacggcaagtggcagatcgtcgtcaactccccggtcggccgccaggaggccatctgcgagttcgaggccgagggcgccgtgctcaccggcaagtgctacagcaacgacgtcgtggtggagatccaggacggcgtggtcgccggcaaccaggtgaagttcgtctgcaagatcaagcagccgatgccgatgaagctctcgtacaccttggtgatcaacggcgacaagatcagtggtgaggtcaagccgggcctgttcccgaagcaggccgtcaccggcgttcgcctctga

SEQ ID NO: 5180 - DNA, 825 bp, Actinoplanes utahensis
atgagcacactcgtcactacggtcgcgcgcccggccggcgtgcggcaggtccggtacggggtgctgggccggttccgggtgggtaccggcccggacgagatcgatccggggccgcacaagatgcggctgctgctggcgctgctgttgatccgggccgggcaggtggccaccccggagcagctgatcgacgacatctggggcgcggatccgccgcgtcgggcggtggcggcgttgcaggtgtacatctcacggctgcgcaaggtgctgcggccggcggacggcgatctgagcatcgccacgcagaagaacggctacctggtcacgctggacatgggcgaggtggatcaccatgtcttccagtcgctgctggcgcagggcaggacgctggcccgagaggggcggcacgcggcggcggtgaccgtgttggaggaggcgctggcgctgtggcggggcacgccgctggacgggttgcacgacagcgcgcgggtgcgggcgttcgccacctggctgcaggagctccggctggagtgtcacgagctgctgatcggatcggggctggcgctggggcggcaccgtgatctggtgggccggttgtacgggttgaccgcggagcagccgttgcgggaggcgttccggcaccagctgatgatcgcgctgtaccgatcggatcggcgcgccgacgccctgctggtgtttcaggatgcccgggcggtgctgcgtgagcaggtcggcgtggagcccggccgggccctcgccgacctgcatttcgccatcctgaacggcgacgagcagttgtaccgggggctcagaggcgaacgccggtga

SEQ ID NO: 5181 - DNA, 270 bp, Actinoplanes utahensis
atgatcggcgtcggcttgagccgcagctcagggctgctgccgatcaatgccgtccgtcactctcccgtcgggcagtccaacggttggtacgtatggcaaggcggcccggcgccacaggatgacgacttcttcagcccgatccacgtcgagcacgccaacatccactttcccgagttggtggcctacctggctctcccacccggcatcggcgtcatcctcgctccaggctatgagtatatttggcacgatgaggcgtttctcgagccgtga

SEQ ID NO: 5182 - DNA, 591 bp, Actinoplanes utahensis
atgatctctgcgcggcaccagcttgtcgccgacgccgccctcgacgtgctggcccgccatggttcacgaggcctgacgcaccgcgcggtcgacgcagccgccgacttaccacctggctcaacgtcctactactaccggtcgcgcgcggctctgctgagtgcctgcgtccagcgactggtggaacacgacaacaccgaactcgacgctatggcatccacgatcactgcgtcggacccgaccaccttggctcaatcccttgcggaggtcctgcaccgctggctgaccaccggtcgacagcgccacctggcccgctacgaactcaccttggagtcggtgcgccggccagaggtcgccgccgaactccgccattccggaagcggcctgcgccagcggatcacggtgattctcgccggacttcatgccagcgatcctccccgccaagcgcgatggctcgtcgcctgcatcgacggcatccttttcgacaacattgccggcgccaactcgaacaacgccatcgacgtcatagaactcaatgcggctacgcgagacctcatcaatgccgtactacccgcgcgcgacgtagatccctga

SEQ ID NO: 5183 - DNA, 1197 bp, Actinoplanes utahensis
atggatgtagaggaacggcgatcggcggcaatagtcgggggtggcatcggggggctcgccgccgccgttgccctgcaccgggcggggtggacggtagcggtctacgaacgatctccaacccggagcgggatcggtgcggggctgaccttgtggccgaacgcggtgcgagccttgcatgccttggggctcgccgaagcgctacggtcccgggcgatggccgtacgcgctacggccgtgcgccgccctgacggccgttgcctgacacaaacccatgccggccagttgctttcccgttacggctctccgcagatggcgatcgtgcgagctgatctggtggagatgctcgcgtccgcgctgccgcccgggtgtctgcggccgggcatgaacgttaccgacatcgacgccggcggcctggaccggcaagcaggcatccgctgcggtgaccaacttatccgcgccgatctcgtcgtcgcggccgacggcgtcaactccgggctgcgccaggcgctctggccggcccagccgccagcggagtatcgcggatacgtggcctggcgcgccatcgtgcgcgccccctcagcccaagtcggcggggccagtgagacgtggggccgagcagcgcggttcggtatcgttccgataggcgatgacctggtctatctctacgccaccgcgaccaccactgctcgcgagcccggcgcggacgaactggtcgacctccgccaccggttcaggcactggcacgacccgattccggccctgctcgatgctatcgaacccggcgctctgttgcgccacgacatcacggcgctacatccgccgctgcgacgtcttcaccacggcagggtggcgttcctgggcgacgccgcccacgccatggagcccaatctcggccagggcgccggcctggccatcgaggacgccgtcgtcttggcacacgcggtagccgacggttcgtcgatcgtcactggcctcgccctctatgaccaagcccgagccggacgcgtcacccggctcgcccagcagtcccgcctactgggccgactcacgcagagtccctccgctgccgtcgcagccttgcgcaacatcaccattcgcctgatacccgatcggctcgcgctgcgcgggttcgacgccgcagcaagctggcatccgccgacgctgcgtccggcaaccaccacacaggagcacctatga

SEQ ID NO: 5184 - DNA, 450 bp, Actinoplanes utahensis
atgaacccccaaatttcgccgcgccgcagcgcctgcgccatcggagcctggtctctgatcgccaccggtgccgtccatgcggccgccatcgccttgggcaccgcagcagccacacctcccgccgaacgggtcgcccgccaggcgatggccgccacacacgtcgacatagccggaatcgaccgcaccctgtggcagcttttcaccgggttcagtgcggcaatggcactattcatcttcggtctgggagcactgaacctgctcgcgctgcgccgcgcaccacaactgttcttcgacactcgggccgctctcgcgctcaacctcagcatcctgcttccggcattcgttctgtcagtcctgttattccctccgccgccgatcgtgttcctcggcgccagctgcgcggcattcggatacgccctcacccggtcttccacgcgaacccgagggtaa

SEQ ID NO: 5185 - DNA, 201 bp, Actinoplanes utahensis
gtgaacgcccggatccgccgggcggtccgggcccgcgggcacttcccgaatgagcaggccgccctgaaatgcgtctacctcgccgtgatgtccctcgacccgaccggcaccggccgccgccgctgggcgatccgctggaaacccgccctcaacgccttcgacctcgccttcgaaggacgactcaccgcaggccgcaactga

SEQ ID NO: 5186 - DNA, 150 bp, Actinoplanes utahensis
atgctcgacgccggcgttaacctccgcgacgtccagatcgctgcccgccacgccgacccgcgcaccaccatccgctacgaccgggcccgcaagaacctcgaccgacacccgaactacatcctggccgccttcatggcctccggaacgtag

SEQ ID NO: 5187 - DNA, 285 bp, Actinoplanes utahensis
gtgatcataattgcgggaaggcttcacgttgcaccggccgatcgtgatcgctacctcgccgaggtggcgaacgttgctcgcttggctcgcgaggccccgggatgctcggacttcgtgcaggcggcggacgcactggacgacacgcggataaacgtctacgagcgatgggaatctgatgatgatctgcaccgattccgtgccgcaggagggccggccttggaccttccacccctacaggacgcgaacgtacggaagtacagaatctccagtgacgaggagccgtaa

SEQ ID NO: 5188 - DNA, 474 bp, Actinoplanes utahensis
atgagcaccgacgaggcgagcggcgtgccacgccgatacgagatcgatccggatccggcttgggacgggtcggacgaccaggacggcgtgctcaccgtcgtgctgtcgtgggtgcccgacccgttggtcggccgcccgccggaactagccgccagtccggagttggttgcggcactgttggcagatgggctcaccggtttcatcaccggtccggcgcgggccacgtacgacgaagacgccttcgacggcgcgggggttatgaccccacccgagctggtccgccttatcgtcggcggggatccggcggcggactttttctacgggtggggcgaggggctcgtcgtctcggagcgggctcttgctctgcttcagacccgctgtcgcaacctgacggtacggccgaccgatgagccccgccctgacatgctgtcgcttctgggctggcagctgccaccggtcatttcgcgggaatga

SEQ ID NO: 5189 - DNA, 1065 bp, Actinoplanes utahensis
atgggaaatgcggtggaggtatcgctgccgtcggaggccggcgtgatcgtggatttggcgccgatttccactggcgggtccgcttggctgtttctggacgatgccgggcagatcggcaaatgggatcgcagcacagcgacggttcggcatcttgcgacaacgacggtgcccgacgaatcgggccgtgagccgtggaacggtcgcgttgttcgtcgacgtctgcatgcctctgccgacggagcttttgctgcggtggtgaacgattatggccgcttcggtgaggtgttggacctgggggccggcggggtcacattaaccttggacggcggcggatacgaggaggggactgtccctttctccctcgttttcgccgagcacgacggcgctacggtggtggtgcaccgcaccaattggaaccgcttggacgtgtcgcacgccggcacgggagcgttggtgaccgctcgatcgtcgacgtccaccgattcacacatggagagtgagcacggtctcgactacttccacggtgcgttgtatctcagccctgacggtcggcggatcctcgacgatggatgggtatggcatcccgtcggtttcccggtggtgtggcgtatggaccagtggctgtccgtaaacccgtgggaatccgaagatggccagagccggatgggcctgtgcggccgggaatactactgggatcacccgatggtctggatcgatgaaactcgggtagccgtcgaaggcatcggcgatgacgccgatgacatccggcccggggctcggctgttcgatacgacccggtccagccagggcggattgtggcgagaggagaccgccgtcgaaacggcgtgcatccccggcccgtcgggccgcttcttcagcgacggggtgcacctgttcagttccggcgatgacgaactggcggcttgggatctggcaaccgctgctctggtcggcgttgtcagacggtttgcgcccacccattacaaccggcacacaggcgagtttctccagctcagtgacgaaaacagcgtgctggtttgggcgcacccgaagacggcgagctag

SEQ ID NO: 5190 - DNA, 348 bp, Actinoplanes utahensis
atgaccaccgcacggccggacggcttcaacgaactgctgcacttcccggtccggctgtccctggtgtccctgctcgcccccgccgcccacgccgacttcagctatctgcgcgaggcgaccggcctcagcgactcggccctcagcaaacagctgaccaccctgcaggacgccggctacgtcgaggtccgccgcaccggccgccgcgcgaccgcccggctcaccgacagcggccgccacgccctcaccgaccacgcccgcgccctgcgcaccctcctcggcgccgccctggacccgaccaccgccggcccgaccaccgccggcccggcgatccccggcccggccacctga

SEQ ID NO: 5191 - DNA, 444 bp, Actinoplanes utahensis
atggacgccaccgaggccgcgaaggcgcttgccgagatcgaccagcgcggccggcagaccctgcgccagggcagcccgcgccgggtccccgcctggttcgcctacggttcggcggccgccctggccctggcctgcgccggcaacgacatgaccggctgggtccgcaccgcgatgctcctgaccggcgccgccacactgatcatcctggccgccgcgatggaccgggtgaccggcgtccggctgcggatgcgcgccgtccgccgggccccgtgggccctgttcgccgccgccgtcctggccaccgtcatcggcgtcggcacggtgctgcgcctgctcgacgtcccggccgacggcaccctgtccggcctggccggggccctggtctggatcaccgccatcggccccacccaggccgccgccggtgccccgcggaacccggcatga

SEQ ID NO: 5192 - DNA, 612 bp, Actinoplanes utahensis
atgaatatctgtatgctgacctccgtgggacatcgcgaagatctgctagaaggtgccaaggcctgcctctacgcgaagggttacctccgcaccaccacccgggacatcgtcgccgcctcagggaccaacctcggctcgatcggctaccacttcggatccaaggaggtgctgctcaacctggcgctgatcgaggccctcggcgagtggggcaccgaactggccgccgccctggccgcgcaacccgacccggaggccggcccggtcgagcggttccagctcacctggacccgggtcgtcagcctgttcggccggcacggcggcctgctggcggcgaacttcgaggtgttcgcacacgcgcagaacaacgccgacgtccgcgaaatgctgctgtccggtctcaacgagggtcgcgaggggctcggccggatgttctaccggggcgacgacgacgacacccgccgcgccatcggcaccttctgccacgcgctgatgaccggggtgatggcacagtggctgatcgacccggccagctcggcgaccggcgccgacctggcggtcgcgatgcgcgccctggtcgccgagctcaccggagccaccgccggcggggcgtag

SEQ ID NO: 5193 - DNA, 1584 bp, Actinoplanes utahensis
atgacgcagatcaagcggcaagcagggcgccgggagtggatcgcactcgccgtcctctccatccctccgctcctggtttcgatggacatcaccgtcctctacttcgcgattccgcagatcacgaatgaccttcggcccaccaccacgcagcagctgtggatgatcgacatctacggcttcctgctcgccggcatgctgatcgcgctgggtgacctcgccgaccgtcttggccggcgcacactgctgctgctgggcctcgccgtgttcggtctcgcgtcgctcggtgcctccttcgccaacagccccgagacgctgatcgtggcccgagccgtgcaggggatcggggcggccgcgctgatgcccgccggcctcgccctgctgcgcaacctcttcgaggatgacgggcagcggcggacggcgatcaccatctggtcgatcggtgtcgcctccggcgccggcatcggcccggtgatcagcggcgtgctgctgcacaacttctggtggggctcggtcttcctggtcaacgtcccgatcatcgcggtggcgctgatcctgaccgcggttctggtgcccaacttcaaggtcgcgcccggcagcatggggcgcttcgacttcttcggcgcgctgctgtcgctggtcgcggtgctggccatcatctggggtgtcaaggagggtgcgatcaacggcttccacgccaagccgctgaccgcgctgatcggtggcctggtcgccgccgcgctgttcctctaccggcagacccacctcacgcacccgatgatcgacccgaagctgttccgcaccaagggcttcaccccggtgctcgtgctcagcctcaccggcttcttctgcgtgatcggcttcggtgtcttcagcacccagtggctgatggaggtcaagggtctcggcccgctgcaggccggtctctggatgatggcgtcgccgctgctggccggcggcatcgtcccggtcgccaccggcatggtcaacaaggtccgcccggcctacctgatcaccggcggcttcgtcctggccaccatcggctacgtgatcatgtcgcaggtcaaggcggacagcccgatcctgctggtggtctccggcacggtatgcatcggtatcggtaccgcgtcgatcttcgcgctgctcaccgacatggtcatcgcggtggccccggtcgaccagacggccgcggtctcggcgctgtccaagaccatgcaggagctcggcggcgccctgggcatcgcgatcttcggcaccgtcggcgcctcggtctaccggcactacttcgacgcgcacctgccgagcggtctgccggccgacgtggtcgccggtgcccgccagacgatgggcgccgcgagcggcatcgccgcctcgctgcctgaccaggtggccaagccgctgctggaggtcgcccggatcggcttctccaactcgctggccaccacggcggtggtgggcatcgcggtggccgccggctcggcgctgctgaccgtgacccgcctgcgccacgtgcggtacacgaccgaggaggtggcggcgaaggccaccgccgagccggccgaggccgagatcgcgccggtcgcctga

SEQ ID NO: 5194 - DNA, 2808 bp, Actinoplanes utahensis
ttggaattcatagaaatcggtaatgcgctggagcgcctgctcgccatcctggcggtggtggcgcacggactgggccggctggtgctggtcagcgggggactcggcagcggcaagagcacgctgctgcaccggttctggcgggaggccggtcagggggacgcggtcttcctgagcgcgtccggttcggtcgccgagagcggcctgcagttcggcgtcgtcgagcagttgttcgtcagcggcgacctgcccggcgacctcgccgaccgggtgctcctgcgggtcggcgaggcggccggccagagcgaggaagcgccggacccggaggcgctgaccgagatcgcccgggaatcctgcgccgcgctgctcgccctgtcccgggagcgcaccgtcgtggtgctcgtcgacgacctgcagttcgtcgaccaggcgtcccgcgaggtgctgctgttcctggcccgccggctgcgctcggctcccgtgctgttcgtcttcagtgagtggctctggccgcagcccaccctgcccgggtaccgcgccgagctgtcccggctgccgcaccgccagatgtgcctgtccgcgctgaccgagcgcaccgtcacccggatggtggagcgggagctgccggcggcggccgcggcggcggtggcgccggccatctaccggcagagcgcgggcaacccgctgctggtggcggcgctgctggacgagtaccgggcccggcccggctcgctggccgacgggctcgcctcgggccgggcgttcggccaggccgtggtcgcctccctgcggcgctggggtccctggctgctggacgtggtccaggcgctggtggtgctcggcgaccgggccaccgccgccgacgtctcccggctgtgcggggtgcgggtcggcaaggtgcagcaggtgctggagatcatgacctcggccggcctggtcgaggacggccggctgcggcacgtcgcggccagcgacgcggtactcgacagcatgccgccggaccgcctggcgcggctcaacgggcaggcggccgaggtgctgctgcaggccggggacaccgggatgcggctggccgagcacctggtcgcggccggtgcggcggagacctcctgggcggtcaccgcactgctcgacggcgccgagcgggcgctggccgcggaccgggtcgagttcgccatgcaatgcctggagctggccctgcggggcagccgggagccggagcgcaaggcggtgatcggtgccagcatcgtgcgcgcggcgtggcggatccagccgtcgctgggcgcgccctaccgggagcacctgcggaccgcggcgctgaccggcggcctgtccgacaccgacgtgttcgtggcgctgcggcaggcgctgtggcagggcgacctggagaacgcgaccgcgacgtaccaggcgctgaccggccccgggcggcactcggatccacaggtcgcggcccgtgcccggctggcctaccagtgggtgcacggccccgggcagaccctggtggccgaggccgaccagccggacccgcggaccggcgacgacctgtggagccaggccgcgcacacgctgggcaaggtctggggcgagcgggtccgcaagtcgatcacgatcagtgccgagcacgtgctgcgcagcagcccgctgggcgacaccacgatcgaggcgatcggcaccgcgctgctcgcgctgaccctgagcaaccgggccgaggaggcggcggtctggtgcgaccggctgatcgacgaggcccgccgccgcggcgcgcgcacctggcaggcggtgctgagcagcctgcgggcccggatcgcgctgcaccgcggcgagctgggcacggcggtgcggctggccgaggactcgctgcggctgatgcagccctccgactggggcatctgcgtgggcctgccgctgggcaccctggcgatggcgcagaccgcgctgggccggcacgaggaggccgaggccaccctgcaccggccggtcccggacgcgatgttcggcacccgccacggcctgtggtacctgcgcgcccgcggccaccaccacctggcctgcgaccggttgctcgcggcgctcaccgacttccaggactgcggccggctggcccgaaactgggggatggacgtgccggccctgctgccctggcgcagcgacctggccgaggcgtacctgcggctgggcgagccgggcaccgcccgcccgctggtcgaggcgcagctggagcgggccggtaccgccgacgtggcgacccgcggcatgtcgctgcgcatcctggcggcgtgcggcgaggcggactggcgggagtcgctgttgcgcgaggcggtcgaggcgctggagaagaccggggaccggcgggagctgtcccgggcgctggtcgacctgagccaggtctactacgactccggtgatctgggtcaggcccggaacctggcgcgccgggccgagcaggaggccaaggcgtgcgagatcccgctgcgggcggcgcaccgcgacgtggcctgccatgccggggcggtccgcggtgccgagccggtcgtgccgaccgccgccgccggggacgaacaggtcccggtctccggcgcggtgctcagcggtgcggagatccgggtggcccggctggccgggctcggccacaccaaccgggagatcagcaagaagctgttcctgaccgtcagcacggtcgagcagcacctgacccgggtgtaccgcaagctgggcatcaccagccgggccgagctgccggccggactggccgcgcgaggccaggagttgggcgtggccgagccgtccgagctgtacaccgccggctga

SEQ ID NO: 5195 - DNA, 432 bp, Actinoplanes utahensis
atggtggcgttcagcgagtcagcggtcatcgacggcgatgccgccgcgatgtggagggtgttgacggatctcccggcactgccgcagtgggatccgcacatggaggggatcggcttcgacgggccgttccaggtcggtgccgagggctggaccaagcccaagggcgcgccgaagggcaggttcaccgtcaccgccatcgagccggagcgcagctactccacccggtcgccgatgccgatgggatcgatgagcgtcaccaacacgctcgagccggtggccggtggcggcgtgaagatcacccggcagatcgaggtgcgcggcggtttctcgccgatgttcaagtggttcttcatgaagccgatgcgccgtgacctgctggcgaccttccaggcgctgggtgccgaggccggccgccgctccacggccggctga

SEQ ID NO: 5196 - DNA, 1428 bp, Actinoplanes utahensis
atgaccaaggctgttgtgctcggtggcgggatggccgggatgctcgcggcgagcgtgctcgccgagcgggtggaccgggtgaccatcgtggagagcgacacgttcccgggcgggccccaggcgcgccgcggactcccgcagggccaccacttccacatgttcatgggcggcggtgtggacgccctcgacgagctgctgcccggcatgagcgacgcgctgtacctggccggggcgcaccgccggcggttcggcgacgagttcctcggcgtctccggcaacggctggggtcgcccctacgacggccgggcctacgtgctggcctgcagccggccgctgctcgaccacatggtgcgcacccgggtgctggccgacgaccggatcgaggtgctcccggcgaccaaggcgatcggcctgctcggcgaccggacccgggtgaccggcgtacgggtcgagtccagcgaccgcagccgggccggcgccggcggcctcggcatcgccgccgacctggtgatcgacgcgaccgggcggacctcgcacgcccccgagtggctgaccgagctcggcgccccgcgggtgcacatggacacccaggacgccgggttcgcctacgccgggcgcacctacgaggcgccgaccggggccggcgtcgacttcccggcgatcctggtgcaggccgacgccggcaccgggcgcccgggccggggtggcggcatcctgccgaacgaggacggccgctggatcgtcgcgatgatcggcacccggggcgggcacccgccgaccgacgaggccggctacctggagtacgcccgcgggctggccgacccgctgatcggcgagctgctcgcggcggcccgcccggtcaccgagatccgcgcctaccgggggctggtcaaccagcggcgctactacgaccggctgccggtgccggagggtttcctggtggtcggcgacgcggcgatgacgctgaacccgaactacgccaccggcatgtcgatggccgcgttcggcgccctggagctgcgcgacgagctgggccggcacggcctgaccggcgacctgacccggcgggtgcagaccgcgatcggcaaggcgggctcggtgtcctggctggccgccaccaccaacgacagctggttcccgggctcggaggcgaacttcaagctgcgcggggcgaaggcgcagaagggtttcgtgcagcgctggaaccgggtggccgcggagaacgccgacgtggcccgggcgacctacgaggtggccaccttcctggcgccacgcaaggcgatgatgacgctgccgctgatgctgaccgtgatgcgcgggccgcggctgccgcagctcacgctggacgaggcgatccggtcgtaccccaatttcgcggaccccctggccaagctggacctgggcgtcggggtgcccggcgcccgctga

SEQ ID NO: 5197 - DNA, 4761 bp, Actinoplanes utahensis
gtgggcgacgaggaaaagctcctaacgtatctgcggaaggccaccgccgagttgcgggacgcccgtcagcgcatcaccgaactggagtcggccggcaccgccgacgatccggtcgcgatcgtcgcgatggcgtgccgctacccgggcggggtcacctccccggaggacctcgccgacctggtgctcgacggccgggacgcggtcgccggcttccccgacgaccgcggctggaacgtggagggcgtctaccaccccgagccgggggagccgggccggacgtacacccggcagggtgccttcctgcacgacgccgcctggttcgacgccggcttcttcgggatcggcccgaacgaggcgctgctgatggacccgcagcagcggctgctgctggagatctcgtgggaggccttcgaacgggccgggatcgacccccggtcggtgcgcggcagcgcgaccggggtgttcaccggcatgatgtaccacgactatccggaggcgcacagcaccggatcggtcgcctccgggcgggtgtcgtacgtgttcgggctggagggcccgtgcgtcaccgtcgacaccgcctgctcctcctcgctggtcgccgttcaccaggcggtccagtcgctgcgcaccggggagtgccggctggcgctggccggcggggtggcggtgatggccaccatggacaccttcatcgagttcagcaagcagcgggcgctgtccgcggacggccggtgcaagccgttcgcggctgccgccgacggcaccggctggggcgagggcgccggggtgctgctgctggaacggctctccgacgcccgccgcaacggccacccggtgctcgccgtgatccgcggcgtcgccaccaaccaggacggcgccagcagcgggctgaccgccccgaacgggccgtcgcagcagcgcctgatcgccgccgcgctggccgacgccggcctgaccgcggccgacgtggacgcggtcgaggggcacggcaccggcaccgtgctgggcgacccgatcgaggcgcaggcgctgctcgccacgtacggcgcggaccggcccgcggaccgcccgctctggctcggctcgctcaagtcgaacatcgggcacacccagtcggccgccgcggtcggcggcatcatcaagatggtcatggcgatgcgccgcggcgtgctgccccgcaccctgcacgtcgacgcgccgtcacccaaggtggactggtccgccggacgggtcgagctgctcaccgaggcccgtccgtggccggcgggggagcgccgccgccgggccggggtgtcctcgttcggggtgagcggcacgaacgcgcacgtcatcctggaggacgtcgccgacgagccggcgcccgacgacacggcgccggcaccgggaatcgtcgcctggccgctgtccgcggccagcgccgacgggctgcgcggccaggccgcccggctggccgagcggctccccgacgccaccccggccgcgatcggccacgccctggccaccggccgggccgcgctgtcgcaccgcgccgtggtggtcggcgccgacctgcccgagctgctgtccggcctggccgaggtggccgccggggagcacgaggcgggggtcagccacgaccggcccgcggtggtgttcaccttccccggccagggcgcgcagtgggacggcatggcggtcgagctgatcgagaccgccccggccttcgccgcggccctggagcgctgcgccgacgcgctcgcggagttcgtcgactggaacctgctcgacgtgctgcgcggcgttcccggcgcgcccaccttcgaccgggtcgacgtggtccagccggtgctctgggcggtcatggtgtcgctcgccgagctgtggcgcgagcacggcgtcgagccggccgccgtgctcggccactcgcagggcgagatcgccgcggcctgcgtggccggcgccctgtcgctggccgacggcgcgcgcgtggtggccctgcgcagccgggtgatcgcgaccgggctggccggcaagggcggcatgctgtccgtgccgctctcccgggcggtcgccgaacagcgcatcgagcggttcgccggccggctgggcctggccgcggtcaacggccccggctcggtggtggtctgcggcgaaccgaccgccctcgacgacctggtcgccgagctcaccgaggccgggctgcaaccgaaacggatcaaggtcgactatgcgtcgcactcgcactacgtggcggagatcgaggcggaggtccgggcggcgctggccccggtgcggccccggccggcgagcgtcccgttctactccgcggtcaccggcggcctgctcgccgacaccaccgtgctcgacgccgggtactggtaccgcaacctgcgccagaccgtgcagttcgaggacgccacccgggcgctgctggacgacgggcacgcgctgttcgtcgagtgcagcgcccacccggtgctgcaggtcggcctgcaggacaccatcgccgacgcgggcgcaccggccggcaccgtggagtcactgcgccgccaggacggcgggctgcgccggttcgccggttcgctggccgccgcctgggcgcgcggtgcgacggtcgactgggcgcggttctcgcccgcggcccggcccgccgacctgcccacctacgcgttccagcgggagcggtactggatggcgccggtggccggcgccgacccggtgtcgctgggccagcagccgctgcgtcacccgctgctgggcgccgcggtcccgctgcccggcaccgacggcctggtcgccaccggccgggtgtcgctgacctcgcacgcctggctggccgaccacgacgcgctcggcgccgtgctgctgcccggcaccgcgttcgtcgagctggcgatcaacgccggcgcccaggtcggctgcggggtgctcgccgagctgaccgtgcaggccccgctggtgttgccggaccgtggtccggtggcgctgcaggtgctggtcggcgggccggacgaggacggtgcccgcccggtcgcggtgcacgcccgcgccgagggcggcgacgccccgtgggtctgccacgcggccggcctgctcaccccggacgacggtgggccggccccgggtcacccggacgacagctggccgccggccggcgcggtcgccgtcgacgtcaccggagcctacgacgggctgctcgggcgcggctacgcgtacgggccggtcttccagggcctgcgggcgctgtggcggcgcggcgacgaggtgtacgccgaggtcgccctgcccgagccggcgcacgccgacgccgcgctgttcggcctgcacccggccgccctggacgcggccctgcacgccgccctgctcacctccgacccggacggcacggtgctgccgttcgcctggaccggcgtccggctgcacgccaccggcgccaccgagctgcgggtccggctcgccccggccggcaccggctcgtcgatccacctcaccgatccggccggccggccggtgctctccgcggacggcctggtcagtcggccggtctcggccgagcagctggccgcgcccggtgcgccgcgggacgtcccgtaccggctggactggatgccgatgccggcggccgggaccgcgccgccggtccgctggcgggaggtcggcggcctcgacgagctgaccggcgacgacgatctgcccgacgtggtgctgctgcgcgcgcccgccgccgacccggccgatctgccggccgcactgcgcgagaccggcgccgcgaccctggccacgctgcgccgctggctttccgaaccggcgctggacggccgccggctggccctgctggtcgagccggacacgctgctcggcgacacggtccgcggcatgctgcgcgccgcccaggcggagcacccggacaccttcctggtgctcgaccacgacgggcgtcccgagtcgctggccgccctgccggacgcgctggccgccggcgagcccgaggtgtccatccggtccggccgcccgcacctgccgcggctggtcgccgccggtccgccggacgccgctgcgcggccggatccggcgggcacggtgctggtcaccggcggcaccggcggtctcggtgcgctggtggcacggcagttgaccaccgattgcggcgtacggcatctgctgctcaccagtcgccgaggacccgccgccccgggtgccgaggagctggtcgccgaactgaccgagcggggcgtccaggtgaccgtggccgcgtgcgacgccggcgaccgggccgcgctggccgccgtgctcgccgcggtgcccgccgagcacccgctgaccggtgtggtgcacgccgccggggtgctcgacgacggcctgatcgcggcgcagaccccggagcgactggacgcggtgctgcgcgccaaggccgacggcgcctggcatctgcacgagctcaccgccgacgccgacctggcgatgttcgtgctcttctcctccgtcgccgcgaccctgggcggcccggggcagaccacctacgcggccgccaacggcttcctcgacgcgctcgccgcgcatcgccgcgcggccgggctgccggccaccgcgatggcctggggcctgtggaccggcgccgggatgggtgaccggctgcgcgaggccgacgtgcggcggatggcggccgacggcctgcccccgctgccggtcgccgacggcctgacactgttcgccgccgcgctgcgcaccgacgccggccaccaggcgctgctgcggctggacccggtggtgctgcctagctag

SEQ ID NO: 5198 - DNA, 1623 bp, Actinoplanes utahensis
gtgcgccggcgggccgccgccgtgctcggcttcaccgacccggccggggtcgacccgggccgggccttccgggagctcggcttcgactcgctggcctcgctgcagctgcgcaacgcgctgaacgcgctgaccgggctgcgcctgccggccaccctggtcttcgaccacccgtcctgcgccgcggtcgccgggcacctcgacgagctgctgatgggcgccgccaccgcggacgaccgcgcgggggaccgggtggcgaccgcggacggcgagccgatcgcgatcgtcgggatcggctgccggttccccggcggcgcccgtggcccggccgggctgtggcggatcgtcgacgagggcgccgacgtgatcgccggcctgcccgccgaccgtggctgggacctggacaacggttaccacccggagcccggcacgccgggccggcactacgcccgcggcggcggatacctgcacgacgcggccgagttcgacgccgagttcttcgggatcagcccggccgaggcgctcaccatggacccgcagcagcggctgctgctggaggtctcctgggaggccctggagcacgccggcatcgacccggccacgctggccggcaccgacaccggggtgttcgccggcctgatgtaccacgactacccgctgaacaccgcgaccggctcgatcgcctccggccgcctcgcctacacctacggcttcgagggcccggccgtcaccgtcgacaccgcctgctcgtcgtcgctggtcgcggtccacctcgcggtgcaggcgctgcgccgcggcgagtgcgggctggctttggccggcggcgcgaccgtgatgtcgacgaccgagaccctggtcgacttcagcatgcaggccggcctgtcgccggacgggcgctgccgctcgttcgccgccggggccgacggcaccggtttcgccgagggcgccggcctgctcgtgctggaacgcctcgccgacgcccgccgccacggccacccggtgctcgccctgatctccggcacggcgatcaaccaggacggcgcgtccaacgggctgaccgccccgaacggcctcgcccagcagcgggtgatccgcgcggcgctggccgacgcccggctcaccgcggccgacgtcgacgtggtcgaggcgcacggcaccggcaccgtcctgggcgacccgatcgaggcgaacgcgctgctcgccacgtacggccgggaccgtcccgcggaccggccggtgcgcctcggctcgatcaagtcgaacatcgggcacgcccaggcggccgccggagtggccggcgtgatcaagatggtcgaggcgctgcggcacgacacgctgccgcgcaccctgcacgccgtgcagccgtccccgcacgtcgactgggacgccggcgcgatgcggctgctcaccgagccggccgcgtggccgggtggggaccggccgcggcgcgccgcggtctcctcgttcgggatcagcggcaccaatgcccacctgatcctgaccgagccgccggccgccgcgccggcggaggcaccggtcgccgccggtgccccggtggtgccgtggctgctgtccgcccgcagcccgcaggcactgcgcgagcacgccgccgggctagctagctag

SEQ ID NO: 5199 - DNA, 996 bp, Actinoplanes utahensis
atggacccgatgctggacgacctgcgcgacgttgccgccggactggaggcggccgccccgcggatcccgctgctgtcgacgctcaccggacgctgggcgacggccgaggacatcaccaccgccgggtactgggcgcggcaggtccgcgagccggtccggttccacgacgcggtggtggcgctggccgcgaccggcgcccgggtggcgctcgaactcggcccggacgcggtcctcgccgggctggggccgcactgcgtaccggacagcgatctggacttcctgcccaccctgcggcgggaccgggacgaggagcgggccctggtcaccgcggtcaccgcggcacacgcccggggtgtcccgatggaccgggccgcgttgctggccgggaccggcggcgtgccggtcgacctgcccacctacccgttccagcgccggacctactggctgaccgccggggacagctccgggatcgccgcgctggccggcgcggtcgacagcggggacgacgcgttcgacgccggactgcccgcgatgatcgccgggcagagcccggcccagcggcacctgaccctggtcgacatggtccgggtgcacgccgccgcggtgctcgggcaccccgacgtggctgcggtgccgatcgaccggccgctgcaggaactgggcttcgactcgatggccgcggtgtcgctgcgccgccggctgaccgccgcgaccggcctcaccctgcccagcaccctggccttcgaccaccccacctgcgaggcggcggcccggttcctggccacccggctggccgaggagcgggaaccggacgaggcgctggcgaccgtggtgcggctggagacgctgctggccgacactaccccgaccgccgaggtcaccgcacgcctcgaggcgctgctgcggacctggaacgaccgggccgccaccggcggcgacgggctcagcgacgaggaactgttcgcccggctcgaccgggaatacgggggcgtctga

SEQ ID NO: 5200 - DNA, 1392 bp, Actinoplanes utahensis
atgggacaggacgagacgatgagcgacgaccgactccggggctacctgcggcgggccgtcgccgacctggacgacgccaaacgccggctgcgcgaggccgagcagagccgccacgagccgatcgcgatcgtgtcggccgcctgccggttcccgggcggggccgacacctcggaacggctctgggacctgctggccgccgggaccgatgcgatcagcgacttcccgatggaccgcggctgggacctggccgccctgtacgacccggagcccggcacgccgggtaggacctacgtccgtaccggcgggttcctgcacgacgccgccgacttcgacgccgacttcttccggatgagcccgcgcgaggcccgggagaccgacccgcagcagcggctgctgctggagaccgcgtgggaggcggtggaacgggccgggatcgcaccgaccgcgctgcggggcaccccgaccggggtgttcgccggcgtcgtctaccacgactacagcaccgacggcgggcccggcggcctggccagcgtcgcctccggccggatcgcctacctgatggacctgaccggcccggtggtcaccgtggacaccgcctgctcgtcctcgctggtcgccctgcactgggcggtgcgggcgctgcgctccggcgaatgttccctggccctggtcggcggcgccaccgtgatggccggcccggcctcgttcgtcggattcagccaggaccgcggactctccccggacggccgctgccggtcgttcgcggccgccgccgacggcaccgcctggggcgagggcgccggcatgctgctgctggaacggctcggcgacgcccgccgcaacgggcacccggtgctggccgtggtgcgcggcagcgcggtcaactcggacggcgccagcaacggcctgaccgcccccaacgggccggcccagcagcggctgatccgggccgcgctggccgacgcccggctgcgcgccgaccaggtcgacgcggtcgaggcgcacggcaccggcaccacgctgggcgacccgatcgaggccgaggcgctgctcgccacctacggccggcagcgccgcgacgggcggccactgtggctaggctcggtcaagtcgaacatcgggcacacccaggccgcggccggcgtcggcggcatcatcaagctcctcgaggcgctgcggcacgaaaccctgccaccgaccctgcacgtcgacgaaccctccgggcacgtcgactggaccaccggtgacgtccggctgctcaccgaggcggtggcctggccggccggggacaccccgcgccgggccgcggtctccgccttcgggctcagcggcaccaacgcgcacgtgatcctggaggaggcgccggccgaaccggccgccctagctagctag

SEQ ID NO: 5201 - DNA, 2379 bp, Actinoplanes utahensis
atggacccaatcctcgacgaattctcgaccacgatcgcttcgctggagtacgccgtaccggccatcccgatcgtctccacgctcaccggccgcccggccaccggggacgacctgcgctccgccgactactggacgcggcaactgcggcagcccgtccgctacgccgacgccgtccgcgccctgcacgacaccggcgtcaccatcgccgtcgagatcggccccgacggcgtgctcagcgcgatgggccccggctgcctggacccggaggccgcggtcaccttcgtgccgctgctcaaagccggccgtcccgagccggacgaactggtcggcggcctcgccacggcccacgaccacggcgccgcggtggactggcccgcattcttcgccgggaccggcgccgcccggaccgacctgcccacctaccgcttccagcgcagcccgtactggcgggacaccccggcggtcaccgccgacccgctggccccgctgcactaccgggtcgagtgggcgccggtcgacatcggtccgggcgccctgaccggccgctggctcgtcctgcacggctgggccgaccggcgcgtcaccacggtcctggacgcgctggccgcgcacggcgccgaggtcgtcgcgatcccggtctccggcctggaccgcccggcgatcgccgccctgctggccgccgccccggccgccctgccggcgccggtcggcgtgctctccctgctcgccctcgacaccaccgcgcaccgcgaccacccggagatcagccgcggcctggccgacacggtcaccctggcccaggtgctcggcgacgccggcgtcaccgcacccctgtggtgcctgacccagcacgcggtcgcggccggcgaccggcacgacgtggacgccgggcagagcgcggtctggggcctcggcgccggcctcgccctggaacgcccggacacctggggcggcctgatcgacctgccgccggtcctcggcccggccaccgccggccggctcgccgccgtgctcagcggcgccaccggcgaggaccaggtggcgctgcggccggacggcgcctacgcccgccggctcacccggcccagccccggcaccaccggcgacagctggcagccgcgcggcacggtgctggtcaccggcggcaccggcgccctcggcgggcacgtcgcccggtggctggcgaccgccggcgcggaccggatcgtgctggtcagccgccgcggcgaggccgccgacggagccaccgagctggccgccgagatcaccgcgctcggcgccgaaccggtgatcgtggccggcgacgtcgccgaccgtgacgcgctcgccgccgtcctggaccggttcccggtcgacgcggtcgtccacgcggccggtaccgcccagccgatggccccgctcgaagagctcaccctggccgggttcgcggccaccgccggcgccaagaccaccggcgccgtccacctcgacgccctgctggccgacaccccgctggacgctttcatcctgttctcctccggctccgccgtctggggcagcgccgcccaggccgcctacggcagcgccaacgcccacctggacggcattgccgccgcccgccgggcccgcggcggcgccgccgtgtcgatcggctggggctcctgggacgccggcatggtcgacgccccgatcgccgccgccatgcgccggatcggcgccccggcgatgaaccccgccctcgccgtccgggcgctcggccgggtcggcgccggcgccgacccgcaaccggtcatcgccgacatccagtgggaccggttcagccccgcctacacgctggcccggccccggccgctgctgcacgacctgcccgaagcggccgtggcgccatccgccccgacggccgccgtcgacaccctggccgcgctgtccgccgcggaccgcgccgacgccatcgaccgcctggtccgcaccgcggtggccggcctgctcggctatgccgacccggacgccgtcgacaccgaccggccgttcaccgacctcggcttcgactcggtctccgcggtcggcctgcgcacccggctcaacgagcggaccggccgcaacctgcccagcacgctggtcttcgatcacgtcaccccgggcgcgctcaccgaccacctgatcggcctgtacgccgcggacggcgcgccgccctcggccatggatcacctggcccggctggaacaggcggtggacgccgccgccccggacgacccggaccggcgcccgctggccgcccggctgcgcgccctgctcggccgcctcgacggggccgccgacgccgacgacgtcaaccagcgtctcgacggcgccacggccgacgacgtgctggccttcatcgacgccgaattcggctcctga

SEQ ID NO: 5202 - DNA, 2058 bp, Actinoplanes utahensis
atggcgactgacgacaaggtcctcgaatacctcaagcgggttaccgcggacctgcaccagacccggcgccaactgcaggagcgcgaggaggccgacgccgagccgatcgcgatcatcgggatggcctgtcgctacccgggcggggccgacaccccggaacaactctggggcctggtcgccggcggcaccgacgcgatcgccgcgtttcccggcgaccgcggctgggacctcggcccggacagcgccggcttcgcccgggtcggcggtttcctcgacggggccggcgacttcgaccccgcgttcttcggcatgagcccgcgcgaggccctggtcaccgacccgcagcagcggctcgtcctggagaccgcgtgggaggccttcgaacgggccggcatcgcgcccgccacggtccgcggccaagccgtcggcgtctacatcggctccggcatgcaggactacggcgccctgctcgacctgtcgccggaactcaccgaggcgttcctgggcaccgccgcgaccagcgcggtgatctccggccggctgtcgttcgtgctgggcctcgaaggcccgtcgctgaccgtcgacaccgcctgctcgtcgtcgctggtcgcgctgcatttggccggccaggcgctgcgggccggggagtgcaccctcgcgctggccggcggcgtcatggtgatggccacccccggaccgttccaggcgatgagccggcagggcggcctgtccagcgacggtaggtgcaagtccttcgccgcgggtgccgacggcacggcctggggcgagggcgcgggtgtgctgctggtcgagcggctgtccgacgcgcagcgtctcggtcacccgattcttgcggtggtacgcggttccgccgtcaactccgacggcgcgtccaacgggttgacggcgccgaacggcccgtcgcagcgtcgggtgatccgcaaggcgctggcgtcggctcgcctgtcgtcggcggatgtcgacgtggtggaggcgcacggcacggggaccgtcctcggtgacccgatcgaggcgcaggcgctgctggaaacgtatggccaggatcgtgagcggccgctgctgttggggtcgatcaagtcgaacatcgggcacacgcaggctgccgcgggtgtggcgggtgtgatcaagatggtgatggcgatgcggcacggggtcgccccgcggtccctgcacctggacgaaccgacaccccatgtggactggtcgacgggaaacatccggctgctgtcggagcctcaggagtgggtggccgacggccgtccccgccgtgccggtgtctcctcgttcgggatcagtggcaccaacgcgcacgtgatcatcgagcaggccgagaccgtcgccccgcccggcgacgatcaggggccggtcgtgctgccgctgtcggcgcgcacaccggatgcgctggccgacctcgccgagcgcctccgcggggtcgccggggacctgcggccggtggacgtggggtattcggtggctaccgggcgccaggtgttcgagcagcgtgcggcggtggtggccgggtcccggaccgagctgaccgaccggctgagcacggtgaccgcgtcgaccgcccgtgccggtgacctgggtgtcgtcttcacgggtcaggggtcgcagcgtctggggatgggtcgggagttgcatgcgcggttcgcggtgttcgcggcggcgttcgatgaggtgctcgccggattcaccgctgatgtccggaaggtcgtgtggggtgatgacgctgaggcgttgaaccggaccggttctgcccagccggctctgttcgctttcgaggtggccctgttccgactgttcgagtcctggggcatccgcccgaccgtgctcggcggccactcgatcggcgaactggcggcggcgtacgtcgccggagtgtggtccctcgaagacgcgtgtcgtctggtggaggcccgcggccggctcatgcaggcgctgcctgcgggtggggcgatggtggctctgccggtcagcgcggaccagctggttttgacgcccggcgtcggcatcgccgcactcctagctagctag

SEQ ID NO: 5203 - DNA, 2613 bp, Actinoplanes utahensis
gtggagctgcccacctacccgttccagcgcgaccgctactggttggacgccgagttccgcgccgccgacgtcgcctcggccggcatcgactccaccgaccacccgctgctcggcgccgtcgtcaccctcgccgacccggacaccgtggtcctcaccggccggctgtcgctgcccacccaccgctgggtcgccgaccacgtcatcgccggcgccgtgctgttcccgggcaccggcttcgtcgaactcgccgtccaggccggcgaccaggtcggccacgacgtggtgcaggacctgtcgctgatcgccccgctcgtcctgaccgaaaccgaccgcttccagatccgggtcgtcgtcggcgcccccgaggccggccgccgccccctgtccatctactcccgccccgagggcgcctccaccgaaccctggctgctgcacgccaccggccagctcgccgccgcctcggccaccacctcgcccggcgcctcgctcagcggcacgtggccaccggccggcgccgagccgatcgaggtgggcgaggtgtaccgggaactcgccgagggcggctacacctacggcccggccttccggaacctgcgcgccgcctggacctccggcagcgacgtgtacgcggagatcgccccggaaaacctcggcaccgaccggttcctgctgcaccccgccctgctcgacgcggccctgcacgccgtctcacacaccggggtcctgggggacagcgcggttgtcccgttctccttcaccggagtcaccctgcgtgcctccggcgcggcggcgctacgggtgcggctgtcgcacaccgggccgcgcaccctgtccatcacgatcgccgactcggccggctcaccggtggccacggtggactccctggtcatgcggccgatcagcgaggcggtggggagtgccgccgagccggtccaccagctcgtctggcagccgatcgacaacgccggcgcggccgccccgaccgccggcaccggccacgccgccgggggagccgcccaggccatcagcgccgcggcgaacgtcaccggccaggcgttgagcgcggcggcgaccgccaccggccaggcgctgagcgcggcggtgaccgccaccgcccaggccctcagcgtggccgcccaggccatcagcgccgccgcccacggcaccggccgtgccgccggaccggctgccccggccgctaccgcatctgcccacgccaccagcggtgccgtctacgccaccggacccgacggcgctcaggtcgaggtggtcgaggcgggagcgttcgacccggggccgggggccgcagtcccactgcgggtgcgtgcggtgctggccggggtgctgcggaagctgcaggagggcaccgccgtcgtcgtggtgacccggtacgcggtcgcggtcgcggacggcgatgtggtggacgtggtgcaggcgccggtgtggggtctggtgcggtcggcgcaggcggagaacctgggccggatcgtgctggtcgacaccgacggcggcgacatcgccggagccctggccagcggtgagccggaggccgccgtccgcggcgcgcgggtcttcgcgccacggctggtccgggccgcccccggcgagggcgtctcgttctcgggccgggtcctggtgaccggtggtaccggtgggctgggtgcgatcatcgcccgccacctcaccgagaatcatgagatttcggatctgctgctggtcagccggcgtggactggaggcgccgggcgcccgcgagttgcgggcggatctggagcggctcggggcaacggtgcacgtggtcgcctgcgacgtgtccgaccgggaggcggtcgcggcgctgctggccgccttcccggtcgacggcgtggtgcacacggccggcgtgctggacgacggggtgctcgacgcgatgaccccggagcgcctcgaccgggtcctcgcccccaaggcggacgccgcctggcacctgcacgagctggccggtgacctgaccgccttcgtgctgtactcctccgcctccggggtgctcggcaacccgggccaggcgaactacgcggcggccaacaatttcctcgacgggctggcccagttccggcgcgcccggggtcttccggctgtctcgctggcctgggggctgtggggctccaccggcggcatgggtggtgaactgtcggccgcggacgccacccggctcaacgccaacggcatccgcccgatcaccccggaacgcggcgtcgccctgttcgacgccgccctcgccgccggcacgccggtggccgtcccggtctcgctggacctcggcgtgatccggcggcggctcgacttcgtgcccgcgctgctgcgcaccctggtgccgagcacccgccggcggcggcccgcaaccgcgcagtcgtcgctgcggcgcaccctggccgcccttcccgagcaggaatggccggccgccgtgctgcaggtcgtccgcggtcaggtcgcgtcggctctgggctacgccaccccggccggggtggagatcggccgcgccttctccgatctgggtttcgactcgctgtccgcggtcgagttccgcaacgccctggccgcggtggtgggcatcaagctgtcgctagctagctag

SEQ ID NO: 5204 - DNA, 738 bp, Actinoplanes utahensis
ttgctgttggggtcgatcaagtcgaacatcgggcacacgcaggctgccgcgggtgtggcgggtgtgatcaagatggtgatggcgatgcggcacggggttgccccgcgcacgctgcacctggacgagccgtctccgcacgtggactggaccgccggcaacatccagctcctgtcggaggcccaggaatgggtggtcgacggccgtccccgccgggcgggtatctcgtcgttcggcatcagtggcaccaacgcccacgtgatcatcgagcaggccgaggagtctccggtgacgccgggggctgatgatgacggtccggtggtggtgccgttgtcggcgcggacgccggaggcgcttgctgatcttgccgatcggctgggtgaggtcgcggcgagtctgcgtccggtggatctcgggttctcggtcgcgacgagccgtgcggtgttcgagcagcgcgccgccgtggtcgccacctctcgcgcctccctgggggaggccttgcgcaccgctaccgcctcgaccgctcgccccggggacctgggtgtcgtcttcacgggtcaggggtcgcagcgtctggggatgggtcgggagctgcatgcgcggttcccggtgttcgcggcggcgtttgatgaggtgctcgccggcttcaccgctgatgtccggaaggtcgtgtggggtgatgacgctgaggcgttgaaccggaccggtttcgcccagccggctctgttcctagctagctag

SEQ ID NO: 5205 - DNA, 2340 bp, Actinoplanes utahensis
atggactcgctcgactactggcgggaggcgtggtccggcgccgctgccggcctcggctcgggcgacgtctcctccgccggcctgaccgctcccgatcaccccctgctgggggcggtggtgaccctgcccagcaccggcggtgtcgtgctgaccggccgcctcgcggtgtccgcgcagccgtggctggccgatcatgtcgtcggcggcacgatcctgttccccggcaccggcttcgtcgaactcgccgtccgggccggtgacgaggtcgactgtccgttcgtcgaggagctgaccctgatcgcgccgctggcgctggccggtccggacgccgccgcccagctgcgggtgaccgtcatgcctaccggcgaggccggccggcaccgggtcgaggtgcactcccgggccgagcacggcgccgccgagtggcggttgcacgccgaggcggttctcgccgaccgtgccccggcagccgggttcgacctgttccagtggccgccggccggtgccgagccgctggatgtcaccggcctgtatccggcgctggccgaggccggtctgccctacggtgcggccttccgcgggctgcgcgcggcctggcggcagggcgccgatgtgctcgccgaggtcgccgtcgagggggccgagtccggccggtacgggctgcatcccgcggtcctggacgcctgcctgcacgccatcgcgctgaccgagggcagcggggagacggcgagcctgccgttcgcctggtcgggcgtgaccctgcacgcggccggagccgccgcggtacgggtccgggtcacccctaccgcccccggtgagggggtgcgcctgcaggtcgccgacgccaccggcagcccggtggccaccgtcgactcgctgaccctgcgcccggtcgacgcggccgcgatgcgcacgaccggtgtggacggtctgctacgtctcgcctggcagccggtcgtttccggcaccgccgtcccggatgacgtcgtcgttctggaggcggcacggttcgacccgggtccgggtgtcgccgttccggtacgggtgcgtgcggtgctggccggggtgctggcgaaggtgcgggagggtgatccgcttgcggtggtgacccggcatgcggtggcggtcgcggatggcgatgtggtggatgtggtgcaggcgccggtgtggggcctggtgcggtcggcgcaggcggagaatccgggtcggttcgtgttggtggacaccgatggtggtgatgtggccggggctctcgccggtggtgcggctgaggtggcggtccgtgggggcgaggtgttcgcgccgcgtctggtgcggtccggtgtcggcggtgacgggtcggtgttctcgggtcgggtcctggtgaccggcggtacgggtggtctgggtgcggtcgtcgctcgtcacctggtggatcatcacgggatcaccgacctggtgctggtgagtcgtcgtggtgtggatgccccgggtgcggctgagctgcgggctgatctggagctgctcggcgcgacggtcaacgtggtggcgtgtgacgtgtcggatcgggacgcggtcgcggcgttgctggacgagttcccggtcgacggcatcgtgcatacggcgggtgtcctcgacgatggtgtgctcggttcgatgacgccggagcgcctcgatcgggtgctggcgcccaaggcggatgccgcgtggtatctgcatgagcttgccggtgagctgtcggcgttcgtggtgttctcctcggcggcgggtgtgttcggcaatccgggtcaggcgaactatgcggcggcgaacaacttcctggatggtctggcgcagcttcggcgggcgcagggactcccggccctctcgctggcctgggggctgtggggttccgccgacagcggcatgggcggcgacctctcggccgccgacctcggccggatgcgccgcagcggtgtcgtcccgctgaccgaggcgaagggcctggccctgttcgacgccgcggtctccaccccggccccggtcctggtcccgctcggcctggatctttcgggcgccgacccgctggccgtcccggagctcatgcagggtctgctgcgccgccgaccgtcccgcaccgccgtctcggccggcgcgtcggtctggcgctcccgcctcgccgacctggacgagcccggccgcctggccctgatgagcgacctggtttgcgcgcaggccgcatcggtgctcggcttcgcctcggcggatgccgtcgacgccgggcgtgccttctccgatctgggtttcgactcgctgtccgcggtcgagttccgcaacacgctcgcggcggcggtcggcatcaagctgtccctagctagctag

SEQ ID NO: 5206 - DNA, 4224 bp, Actinoplanes utahensis
ttggagacctacggccaggaccggccggacgaccggccgctgctgctcggctcgatcaagtcgaacatcgggcacacgcaggctgccgcgggtgtggcgggtgtgatcaagatggtgatggcgatgcggcacggggtcgccccgcgcacgctgcacctggacgagccgtctccgcacgtggactggaccgccggcaacatccaactgttgaccgaggcccaggaatgggcggttgacggccgtccccgccgggcgggtgtctcctcgttcgggatcagtggcaccaacgcgcacgtgatcatcgagcaggccgaggagcccccggtgaccccggggaccgacgacgagagcccgattgtcgtgccgctgtcggcccgcaccccggacgctctcgccgctctcgccggccggttcgccgatctgctggaggccgaccccgcgatccgaccgctcgacctcgccttctcggtcggcaccaagcgcgcggcattcgagcagcgcaccgccctgtccggcgcggaccgcgccgggttggtggcccgggcgcgacgggcggcagggggtgcaccgacccctaccccgatccgcaagggtccggtcggggtggtgttcaccggccagggctcgcagcgtctgggcatgggccgcgagttgtacacagcgttcccggtgttcgcggcggccctcgacgaggtgctcgccggcttcaccgcggaggtgcgtgaggtgatgtggggcgacgaccccgcacccctgcacgagaccggtttcgcccagcccgccctgttcgctttcgaggtggccctgttccgtctgttcgagtcctggggcgtacgccccggggtggtcggcgggcattcgatcggcgagctggcggcggcctacgtcgcgggcgtgtggtcgctcgaagacgcgtgtcgtctggtggaggcccggggccgtctgatgcaggcgctgccggcgggtggggcgatggtggccctgccggtgagcgcggaccgggtcgctctgacggccggtgtcggcatcgccgcgctgaacgggcccgcgtccacggtgatctcgggtgtcgaggccgaggtgctggcgatcgccgagcagttcccgaacgcacgccggctcaaggtgtcgcatgccttccactcaccgttgatggagccgatgctggccgagttcgccgccgtcgccgccggcctcacctacgcgaagccggcgtatccggtgctcgccgcgggtgacgtgacggatccggcgttctgggtcgcccatgtccgcgatgcggtgcgtttcaccgacaccgtcgccggtttggtcgagcgcggcgtcggcacggtcctggagatcggcccagacgcgacgctgacgacgttgatcggttacaacaccgacgagctggcgacgatcgccgcccagcagcgggacaccggcgaactgctcgccaccgccaccgccgccggccgcctgttcgagaccggcgccgcgatcgactggaccgccttctacgccggccgcgacgcccgcgcggtcgagctgccgacctacccgttccagcggcagcgcttctggctggacgccctcgactactggaaagaggcgtggtccggcgccgccgccggcctcggctcgggcgacgtgtcgtcggccggcctgaccgctcccgatcacccgctgctgggcgccgtggtggtcctgccggacgacgagggcgtcgtgctgaccggccgcctggcggtgtccgcgcagccgtggctggccgatcatgtggtcggtggcacgatcctgttccccggcaccggcttcgtcgaactcgccgtccgggccggtgacgaggtcggctgcccgacggtcgaagagctcaccctcgtcgcgccgctggcgctgaccggcccggacgccggcgcccagctgcgggtggtggtctcgcccgccgacgcctccggccgccgccgggtccgggtgcactcccgcccggagcacagcgccggcgagtggcagctgcacgccgaggcgaccctcaccgaggagaccgctcccgccgggttcgacctgctgcagtggccgccgaccggcgccgaaccggtcgacctgaccggcggttacccggccctggcggaggccggctacggctacggtccggcgttccaggggttgcgtgccgcctggcgccggggcgacgagatcttcgccgaggtcgcgaccgacgaggccgacgccgaccggtacacgctgcacccggccctgctggacgccgcgctgcacgcggtgctgctcacccacgcggacggcgacggtgacggccgaatcgtgctgccgttcgcctggtcgggcgtgcaagcgttcgccgacggcggcccggcgacgatccgggtccggatctccccggccgggaccggcgacgatctcaccatccgggtcgccgaccgggccgggcggccgatgctgaccgttgcggcgctgacctcccgtccggtcgatccggcggcgatgcgagccgccgacgtggacggcctgctgcgcctgtcgtggcaggcggtcgcacccggcaccgcggtcgctgaggacatcgtcgtgctggaggcggcgcggttcgaccccggtccgggtgtcgccgtcccggtacgggttcgcgcggttctcgacgcggtcctggcgaggcttcaggagggtgagccgtcggtggtggtgacccggcatgcggtcgcggtcgcggacggtgatgtggtggatgtggtgcaggcgccggtgtggggtctggtgcggtcggcgcaggcggagaatccgggtcggttcgtgctggtggacaccgatggtggtgatgtcgccgcggccttggccggtggcgaggctgaggtggcgattcgtgggagcgagctgttcgcgccacggttggtgcggtccaccgtcaccgccggtgggccggctttcgcgggtcgggtcctggtgaccggtggtaccggcggtctgggtgcggtcgtcgcccgtcacctggtcgatcagcacgggatcgtcgacctgctgctggtgagccggcgcggcccggacgccccgggggcggctgagctgcggactgacctggagcggctcggcgcgacggtcaacgtggtcgcctgcgacgtctcggatcgggacgcggtcgccgggctcctggaggagttcccggtcgacggtgtggtgcacacggccggtgtgctggatgacggtgtgctcgcctcgatgacacccgaacggctcgacagggtgctggcgcccaaggcggatgccgcgtggcatctgcatgagcttgccggtgagctgtcggcgttcgtggtgttctcctcggcggcgggtgtgttcggcaatccgggtcaggcgaactatgcggcggcgaacaacttcctggatggtctggcgcagctccggcgggcccagggtctgccggcggtgtcgatggcctgggggctgtggggttcgaccggtggtgggatgggcggggagttgtccccggccgacgtcgcgcggatgcgccgcggtggtgtcgtcccgctgaccggggccaagggcctggccctgttcgacgccgcggtctccactccggccccggtcctggtgccactcggcctggacctcgacggcgccgacccgcagctggtgccgccgctgctgcagggcctgctgcgccgccgcccggcccgctcggcgggtgcggccggcaccccggacggcgccgagtggcgggcccggctcgccggcctggaccggcccgaccggctcgccctgctgctcaccctggtccgcggtcaggccgcgacggtgctcggcttcgcctcggcggatgccgtcgacgccggtcgggccttctccgacctgggcttcgactcgctgtccgcggtcgagttccgcaacgccctcacggcggcggccggcatccgcctgtcgccgaccctgatcttcgactatccgacccccgcggccctggccgagcacctgctcagccacttcgccgacggcccggagacggacggcggcgaggccgaggtgcggcaggtgctgcgggacatcccgctcagccggctgcgcgacgccggcctgttggacgccctgctcgaactgggcggcgtccgcgtcgccgcggcggagagcccggagccggcggaaaccctgtccatcgacgagatggacaccgaaagcctgatctctcgggcactcgaagactttgacttcggcgacacgacgcagggagcgtga

SEQ ID NO: 5207 - DNA, 2052 bp, Actinoplanes utahensis
atgcccagttctgaggaaaagcttgtcgaagccctccgagcgtcgctgaaggaagcggaccgcctgcgtggccagaaccgcaaactgaccgccgccagccaggaacccatcgccatcgtcggcatggcctgccggtatccgggcggcgtggtctcccccgaaggcctgtgggacctggtcgccgacggcgttgacggcgtctccgagttcccgaccggccggggctggggcaccgacatcttcgacccggtcccgggcgcggccggcaagtcctacgtccgtgagggtggtttcctgcacgacgcggatctgttcgatccgggcttcttcgggatctcgccgaacgaggcgctcgtgatggatccgcagcagcggctgctgctcgaagtgtcgtgggaggtgttcgagcgggcgggcatcgacccggtgtcgctgcgcggctccgataccggcgtgttcgtcggcatgatgtaccacgactacgccgccaactcgtccacgggcgcggtcgcctcgggccggttgtcctatgtgctcgggctggaagggccgtcgatgacggtcgacaccgcgtgctcgtcctctctcgtctcgctgcatctcgcggcgcaggcgttgcgggcgggggagtgttcgctggcggtcgtgggtggtgtcgccgtgatggccacgcctgaggtgttcgtggagttctcccgtcagcgtgggctctctcctgatgggcgttgcaagtctttcgccgcgggtgctgacggcaccgcgtggggcgagggcgcgggtgtgctgctggtcgagcgtttgtcggatgcgaagcgtctcggtcatcggattcttgcggtggtacggggttcggcggtgaatcaggatggcgcgtcgaacgggttgacggcgccgaacgggccgtcgcagcgtcgggtgatccgtaaggcgctggcgtcggctcgcctgtcgtcggcggatgtcgacgtggtcgaagcccacggcaccggcaccgtgctgggcgacccgatcgaggcgcaagccctgctggaaacctacggtcaggatcgtgagcggccgctgctgctcggctcgatcaagtcgaacatcgggcacacgcaggctgccgcgggtgtggcgagtgtgatcaagatggtgatggcgatgcggcacggggtcgccccgcgcacgctgcacctggacgagccgtccccgcacgtggactggaccgccggcaacatccaactgttgaccgaagccgaggagtgggtggtcgacggccgtcctcgccgggcgggtatctcgtcgttcgggatcagtggcaccaacgcgcacgtgatcatcgagcaggccgaggagcccccggcggcctcggggaccgacgacgagagcccgattgtcgtgccgctgtcggcccgcacgccggaagcacttgccgacctggccgaccggctgagccgggccgccgcggatctgcgtccggtcgacgtcggcttcacggtggccaccggccgctcggtgttcgagcagcgtgccgctgtcgtggccggcaccggtgccgagctgaccgccgccctgagtacggtgaccgcgtcgaccgcccgtgccggtgacctgggtgtcgtcttcacgggtcaggggtcgcagcgtctggggatgggtcgggagctgcacgcgaggttccccgtgttcgcggcggcgttcgatgaggtgctcgccggcttcaccgctgatgtccggaagatcgtgtggggtgatgacgctgaggcgttgaaccggaccggttctgcccagccggctctgttcgctttcgaggtggccctgttccgactgttcgagtcctggggcatccgcccgaccgtgctcggcggccactcgatcggcgaactggcggcggcgtatgtcgccggggtgtggtccctcgaagacgcgtgtcgtctggtggaggcccgcggccggctcatgcaggcgctgcctgcgggtggggcgatggtggctgtgccggtcagcgctgatcagctggttttgacgcccggcgtcggcatcgccgcgctgaacgggcccgctagctag

SEQ ID NO: 5208 - DNA, 2781 bp, Actinoplanes utahensis
ttgcgctcgaccggcctggtcgcttccggtcacccgatggtgggtgcggtcgtcaccgccccggacggcccgcgcgtggtgctgagcgggcggctgtcgctggccgcccagccgtggctggccgaccacgcggtcggcggcaccgtcctggtccccggcaccggtctgctggagctggcgctgaccgccggccgccaggtcgacctgcccgtggtggacgagctgaccctgatggccccgctgctgatcccgccggccgacggcgtggtggtgcaggtcgtcgtcgacgacccggacgccgccggccgccgggccgtcgcggtgtactcccgggtcgaggacgccgccgacgaccagccgtggacgctgcacgcccagggcacggtcagcgacgagctcggcggcgaccgctgggacgcgctgcaatggcccccggccggcgccgaaccggtcgacctgaccggcggttacccggccctggccgaggccggctacggttacggcccggcgttccaggggctgcgggccgcctggcgccggggcgacgacatcttcgccgaggtcgccaccgacgaggccgacgccgaccggtacacgctgcacccggccctgctggacgcggccctgcacgcggtgctgctcacccgcgacggcgacggtgacggccggatcgtgctgccgttcgcctggtcggaggtcagcgtccacgccggcaccggcccgtcctcgatccgggtccggatctccccggccgggaccggcgacgacctcaccatccgggtcgccgaccaggccggccgcgcgatcctgacggtcgccgcgctgacctcgcgtccggtcgatccggcggcgatgcgcgccaccgacatggacggcctgctgcacctcgcgtgggaccggatcgaggcgggtaccgcggcccccggcgaccacgaggtcgtgatggcggccgctttcgacccgggtaccgggacgccggtcccggagcgggtgcgtgcggtgctggccggggtgctggcgaagctgcaggagggcacctccctcgcggtggtgacccgtaacgcggtcgcggtcgcggacggcgatccggtcgatgtcgtgcaggcgccggtatggggcctggtgcggtcggcgcaggccgagaacccgggtcggttcgtgctggtggacaccgacggtggtgacgtcgccggggctctcgccggtggtgcggccgaggtcgcgatccgtggaaacgagctgttcgcgccacggctggtgcgggcgagtgtggccgacagcccggtgttcaccggccgggtgctggtgaccggcggcacgggtggtctgggggcggtcgtcgcccgccacctgatcaccggttacgccgtacgggacctggtgctggtgagtcgtcgtggtgtggatgccccgggtgcggctgagctgcgggctgatctggagctgctcggcgcggcggtcaacgtggtggcgtgtgacgtgtcggatcgggacgcggtcgcggcgttgctgggcgagttcccggtcgacggcatcgtgcatacggcgggtgtcctcgacgatggtgtgctcggttcgatgacgccggagcgcctcgatcgggtgctggcgcccaaggcggatgccgcgtggtatctgcatgagcttgccggtgagctgtcggcgttcgtggtgttctcctcggcggcgggtgtgttcggcaatccgggtcaggcgaactatgcggcggcgaacaacttcctggatggtctggcgcagctccggcgggcgctgggactgccggcggtgtcgatggcctgggggctgtggggttcgaccggtggtgggatgggcggggagttgtccccggccgacgtcgcgcggatgcgccgcggtggtgtcgtccccctgaccggggacaagggcctggccctgttcgacgcggcggccgccgcgcccgtcgtcatcccgatgggcctggacctgaccggggccgacccgctgctcgtgccgccgctgctgcagggtctgctgcgccgacgaccgtcccgcaccgccgtctcggccggcgcgtcggtctggcgctcccgcctcgccgacctggacgagcccggccgcctggccctgatgagcgacctggttcgcgcgcaggccgcatcggtgctcggcttcgcctcggcggatgccgtcgacgccggacgtgccttctccgatctgggtttcgactcgctgtccgcggtcgagttccgcaacgccctggccgcggtggtgggcatcaagctgtccccgacgctgatcttcgactacccgacgccggccgtgctggccgaattcctgctcgccgagctgaccggtgccggcgaggatgtgatcacctcgacggtcgtggccgacgacgacccgatcgtgatcgtgggcatggcctgccgctatccgggcggcgtggtctcccccgaaggcctgtggaacctggtcgccgacggcgtcgacggtgtgacggagttcccgaccggccgtggttggggcagtgacgtcttcgacccgaacccggggacgccgggcaagtcgtacgtccgtgagggcggtttcctgcacgacgcggacctgttcgatccgggcttcttcgggatctcgccgaatgaggcgctgatcatggatccgcagcagcggctgctgctcgaagtgtcgtgggaggtgttcgagcgggcgggcatcgacccggtgtcgctgcgcggctccgataccggtgtgttcgtcggcatgatgtatcacgactacgccgccaactcgtccacgggctag

SEQ ID NO: 5209 - DNA, 1275 bp, Actinoplanes utahensis
ttgtcctatgtgctcggtttggaagggccgtcgatgacggtcgacaccgcctgctcgtcctctctcgtctcgctgcaccttgcggcgcaggcgctgcgggcgggggagtgttcgctggcggttgtcggcggggttgcggtgatggcgacgcctgaggtgttcgtcgagttttcgcggcagggtggtttgtcgcgtgacggtcgttgcaagtctttcgccgcgggtgctgacggcaccgcgtggggcgagggtgccggggttttgctggtggagcgtttgtcggacgccaagcgtctcggtcatcagattcttgcggtggtacggggttcggcggtgaaccaggatggcgcgtcgaacgggttgacggcgccgaacgggccgtcgcagcgtcgggtgatccgtagggcgctggcgtcggcgggcctttccaccgcggacgtcgacgtggtcgaagcccacggcaccggcaccgtgctgggcgatccgatcgaggcgcaggcgctgctggaaacgtatggccaggatcgtgagcggcctttgctgttggggtcgatcaagtcgaacatcgggcacacgcaggctgccgcgggtgtggcgggtgtgatcaagatggtgatggcgatgcggcacggggttgccccgcgcacgctgcacctggacgagccgtccccgcacgtggactggaccgccggcaacatccaactgttgaccgaagcccaggagtgggtggtcgacggccgtccccgccgggcgggtatctcgtcgttcgggatcagtggcaccaacgcccacgtgatcatcgagcacgttgacgagccctcggtgacgccgggggctgatgacgacggtccggtggtggtgccgctgtcggcgcggacgccggaagcgcttgccgatcttgccgatcggctgggtgaggtcgcggcgagtctgcgtccggtggatctcgggttctcggtcgcgacgagccgtacggtgttcgagcagcgcgccgccgtggtcgccacctcgcgtgaaggattgcgcgcaggcctccaggctgtgaccgcatccgttccgcgttccggcagcctgggtgtcgtcttcacgggtcaggggtcgcagcgtctggggatgggtcgggagctgcatgcgcggttcccggtgttcgcggcggcgtttgatgaggtgctcgccggcttcaccgtggacatccggcaggtcgtctggggcggtgacgccgcgacgctgagccagaccggtttcgcccagccggctctgtttctagctagctag

SEQ ID NO: 5210 - DNA, 7050 bp, Actinoplanes utahensis
gtgaccgactatctcgccgagtcctggctggctgaggagatcggcggactgcgttccaccggcatgaccgcttccggtcacccgatgatcggcgcggtgctgtccgcggccgacagcacccgggtcgtgctcaccggccggttgtccctgaactcgctgccctggctggccgatcacgcggtcggcggcaccgtcctggtccccggcaccggtctgctggagctggcactgaccgccggccggcacgtcgactgcccggtggtggacgagctgaccctgatggccccgctgctgatcccgccggccgacggcgtggtggtgcaggtcgtcgtcgacgacccggacgccgccggccggcgcgccgtgtcgatctattcgcaggacggcgaccggccctgggtgcggcatgcccagggcacgctgagcgccgacgccggagcagagcgctgggatgtgctgcagtggcccccggccggtgccgaaccggtcgacctgaccggcggttacccggccctggccgatctcggctacggctacggcccggtcttccaggggctgcgcgccgcctggcggcagggcgacgagatcttcgccgaggtggccttcgacgaggtggacgccgaccggtacacgctgcacccggccctgctggacgcctcgctgcacgcggtgctgctgacccacgacggcagcgccggcgacggccggatcgtgctgccgttcgcctggtcgacggtgagcgccttcggcgacccgggcaccgggccgaaggcgatccgggtgcggatctcgccggtcggggacagcggtgacatcaccgtccgggtcgccgaccagaccggccgggcggtcctgaccgtctcggcgctcacctcccgcccggtggacccggccgcgatgcgcgccgcggacagcgcccacctcctcgaggtcgcctggcagccggtcgaggccggcacggcggccgccgaggacgtcgtcgtgctggaggcggccgccttcgacccgggcccgggcatcccggtgccggtgcgggtccgcgccgtcctcgacgcggtcctcgcccggctgcaggagggcgccgcgctcgcggtggtcacccggcacgcggtcgcggtggccgacggcgatgtggtggacgtcgtgcagagcccggtgtggggcctggtccgggccgcccaggcggagaacccggggcggatcgttctgatcgacagtgacggtggggatgtctccggcgcgctcggcgcgggggagccggaggtcgcggtccgcggtggtgtgctgtcggtgcctcggctggtgcgttcgtccgggggcggcggcggtgtctcgttcaccggccgggttctggtgaccggtgggacgggtggtctgggtgcggtcatcgcccgccatctcgtcgagaatctcgatgttcgcgagttgttgctcgtcagtcgtcgtggtcgggatgctccgggtgccggtgatctcaaagcggatctggaggggctcggcgcgacggtgaatgtggtcgcgtgtgacgtgtcggaccgtgacgaggtggcggcgttgttggcggcgttcccggtcgacggtgtggtgcatgcggctggtgtggcggacaacggggtgatcggctcgatgaccccggagcgtttcgaccgggttctggcgccgaaggccgacgcggcgtggcacctgcacgagctggccggggatctgacggcgttcgtgatgttctcctcggccggtggcatggtcctcgcggccgggcaggccccgtacgcggcggccaacaacttcctcgacggtctcgcccacctgcgccacgcccggggcctgccggcggtgtcgatggcgttcggcctgtgggcggtcgacgccggcctgagcgcgttcctgcaggaggccgacttcgagcggctgcgccgccagggcctgcccccgctcaccgagcaggagggcctggccgccttcgacgccgcgctcaccgccggggccgccctggtcgtgccgctgaaggtcgacccggccgtcccggcacgcggcgacgacaccccggcgctgctgcgctcgctgatgaaaccggcgtcgtcccgggcccgccgggccggtggcagccaggtgctgctgcgccagctcgccgggctcggcgccgccgaccgggccgccgccctgctcgacctcgtccgcaaccaggtcgccgcggtgctcgggcacagctcgccggccgtggtcgagccggaccgcgccttccaggagctcggcttcgactcgctctccgcggtcgagctgcgcaacgtgctcaacgaggtcaccggtctgcgactgccggccaccctcgtcttcgactacccgtcggccaccgcggtcgccggctacctcgacacccagctgaccggcgccggagccgacgccgcgccgccggtgaccaccacccgccgggccgacgacgagccgatcgcgatcgtggcgatggcctgccgctaccccggcgacgtgaccacccccgaggaactgtggcggctggtccacgacgggatcgacacggtctccgacttcccggacaaccggggctgggacaccgcccggatctacgacccggagcccggcaagttcggcaggacgtactccaaggagggcgcgttcctgcacgacgcggccatgttcgacccggcgttcttcgggatcagcccgaacgaggcgatcgccatggacccgcagcagcggctgctcctggagcttgcctgggaggccgcggaacgcgccgggatcgacccggtcaccctgcgcggcagctccaccggggtgttcgccgggctgatgtaccacgactacgggcagggctcggaccgcgcctcgtccagcggcggcagcctggtctccggccggatcgcctacaccctggggctggagggcccggccgtcacggtcgacaccgcgtgctcgtcgtcgctggtggcgctgcactgggcggtacaggcgctgcgctccggcgagtgctcgctcgccctggccggcggtgtcacggtgatgtccacgccggccatgttcgtcgacttcagccggcagcgcgggctgtcgccggccgggcggtgcaagtcgttcgcggccggcgcggacggcaccggctggggcgagggcgccggcctgctgctggtcgagcggctctccgacgcgcggcggctgggccacccggtgctcgccgtggtcaaggccaccgcgctcaaccaggacggcgccagcaacggcttcagcgcccccaacgggccgtcccagcagcggctgatccggcaggcgctgtcggtggccggcctcggcacggccgacgtcgacgtggtcgagggacacggcaccggcaccgtgctgggcgacccgatcgaggcgcaggcgctgctggagacctacggccgggaccggccggacgaccggccgctgctgctcggctcgatcaagtcgaacatcgggcacacccaggccgcggccggcgtggccggggtgatcaagatggtgatggcgatgcggcacggggtggtgccccgcacgctgcacgtcgaccagccgtccccgcacgtcgactggaccaccggcaacatccggctggccaccgaaacccgggactggcccgcggtggaccggccgcggcgcgccgcggtgtcctcgttcgggatcagcggcaccaacgcgcacgtcatcgtcgagcacgccgaggaccccgcgccgcgccgggagccggtgaccgtgcagggctccgccctggtctggccgctgtcggcgcgcaccccggaggcgctgaccgcgctggccgggcggctggtgcggctgctggaggcggacccgggcctgcgcgccgtggacgtcggctactcgctgggcgggcgcccggtgttcgagcaccgcgcggcgatcaccggcggctaccgctccgagctgctgtcccgggcgcggaaggtgacaccggtcgcggcccgtcccggggcggtcggggtggtcttcaccggtcaggggtcgcagcggccgggcatgggccgcgagctgtacgcggcgttcccggtgttcgcggcggcgttcgacgaggtgctcgccggattcaccgtggacatccggcaggtcgtctggggcggtgacgccgcgacgctgagccagaccgggttcgcccagccggctctgttcgctttcgaggtggccctgttccgtctgttcgagtcgtggggcatccgcccgaccgtgctcggcggccactcggtcggcgaactggcggcggcgtatgtcgccggggtgtggtccctcgacgacgcgtgtcgtctggtggaggcccgcggccggctcatgcaggcgctgcctgcgggtggggcgatggtggctgtgccggtcagcgctgatcagctggttttgacgcccggcgtgggcattgctgctttgaacggccccacgtccacggtgatctcgggtgtcgaggccgaggtgctggcgatcgccgagcagttcccgaacgcacgccggctcaaggtgtcgcatgccttccactcgccgctgatggaaccgatgctggcggagttcgctgagatcgcgggcggcgtgacgtacaacaatccgcgttttccgatcttgacctctggcgacgtcaccgatccggcgttctgggtcgcccacgtccgcgacgccgtgcgtttcaccgacaccgtcgccggcctggtcgagcgcggcgtcggcacggtcctggagatcggccccgactccaccctgtccacgctgatcggcctgaacaccgccgccctgacgaccgttcccggccagcagcgcgacgccgacgaggcggacgccgcggtcgccgccgtcgcccggctgttcgagaccggcacccgggtcgactggaccgcgttctacgccggccgcggcgccctccgcaccgaactgcccacctacccgttccagcgcgacgagtactggcccggcgagcaactcctgctcaccccggacgcgaccagcatcggcgtggacaccatggagcacccgctgctcggcgcggcggtgccgctggccgactcggacagcttcctgctgaccggccggatcgcccggcagtcccagcgctggctcaccgaccaccaggtcttcgacagcgtgctgctgcccggcaccgggttcgtcgagatcgccgtgcaggccggcgagcaggccggctgcgacctggtcgaggagctgaccctgatcgcgccgctggtcatgccggactccggcgcggtgctgcaggcccgggtcagcgcgccggacgagaccggccggcggaccgtcaccgtccactcgcgggcgcaggacgcggccccggacagccggtggacgctgcacgccgaaggggtgctcggccacggcgacggcgcgctcccggacgatgtcgcggtgtggccgccggccggagccaccccgatcgacctggacggcggctacgacctgctggccgaccggggctacggctacgggccggccttccaggggctgcgggccgcctggcagctcggcgacgacctgtacgccgaggtggaactgcccgaaccggtccgggccgaggcggccttctacggactgcatccggcgctgctcgacgcgaccatgcacgtcctgaacttcgcgggcggcgagggcgctcccgaggggcaggcgatgatcccgttctcctggtccggggtcaccctgcacgccaccgggagcaccgcggtccgggtcgcgctgatccggcaggacccggcctcgctcaccatgcggatcagcgatccggccggggcgccggtcgccacggtggccgggctgaatctgcgtccggtcgcggtcgagcaactgcggccggggggacgcgcggacgcgctgtaccggctggactgggtgggtcggaaggcggccggtggcacgctgcccgcgtacgccgacatccgcctggaaccgaccgtcggtgacgtgcccgcggccgtacgccgcaacaccgccctggtcctcgaccgggtgcaggcgttcctggcggacgaatcgcgggccgggacggtgctggccgtggtgacccggcacgcgttcgcggtggccgacggtgacccggtggacatcgcgcacacgccggtgtggggtctcgtgcggtcggcgcaggccgagaacccggggcggatcgtgctggtcgacagcgacggtggggatgtctccgcagcgcttgcgagcggcgagccggagatcgcggtgcgtggcggtgagctgtcggtgccccggctggtgcgttcgtccgggggcggcggcggtgtctcgttcaccggccgggttctggtgaccggcgggacgggtggtctgggcgcggtcatcgcccgccatctagtggaaaaacatgaaatctcggacctggtgctcgtcagtcgtcgcggtctggacgccccggaagctctcccgttgcgtgctgacctgcagcggctcggtgcgaccgtgaatgtggtcgcgtgtgacgtgtccgagcgtgacgaggtggcggcgttgttggcggcgttcccggtcgacggtgtggtgcatgcggccggggtggcggacaacggggtgatcggctcgatgaccccggagcgtttcgaccgggttctggcgccgaaggccgacgcggcgtggcacctgcacgagctggccggggatctgacggcgttcgtgatgttctcctcggccggtggcatggtcctcgcggccgggcaggccccgtacgcggcggccaacaacttcctcgacggtctcgcccacctgcgccacgcccggggcctgccggcggtgtcgatggccttcggcctctgggcggtcgacaccggcctcagcgcctacctccaggactccgacctggaacggctgcgccgccagggcctgcccccgctcaccgagcaggaagccctggccgccttcgacgccggcctcaccgagggccaccccctggtcgccccgctgcgcgtcgaccaggcggcgctgcggtcccgggtcggcgacctgccgcccctgctgcgcggcctggtcccggtcacccgccgccgggccgccaccggcgccgctagctag

SEQ ID NO: 5211 - DNA, 1077 bp, Actinoplanes utahensis
gtgctcggcttcgccgccaccctgctcggccacgccgacccggccgcgctcgacccggaacgcgacttcctggaggccggcttcgactcgctgaccgccatggacctgcgcaaccacctgaacgcggcgaccgggctcgacctgccgccgatggtcatcttcgacaacaagagcccggcccggctggccgcctggctgcgcgccgaactcgccgtggacacgaccgcggcggagaccggcggggacacgctcagcgcgctgttccggtccggtctggaggccggggcggtgggggaggcgtacgacctgctccgctcggtggtccggctccggccgcggttccgcaccgtggacgaggtcggcgacctggcgcccgcggtcaccctgcgggagagcgactcggagctgccccggctgatctgcctgagcaccccgatggccaccggcggcatgcaccagcactcccgggtggtcgcacacctgggttcgccgcggcacgtggtcgccatcccgacccccggtttcgtggccggcgaacgcctgcccgcctcggtggacgtggccgtgcaggcgctcgccgagcaggtgctgcgggccgccgacgggcacccgttcctgctgctcggctactcctcgggcggctccctcgcctacgcggtggccggctacctggaggagcgcggcatcgagccggccggcgtggtcatgctcgactcgttccgggtcgaggacgaggcggccggcgccaccatgccgatccgcgaactgaccctgcggctgtacgaccaggagtcgctgttcggccgcttcgacagcgcccggctgtccgcgatggcctgctggttcgacctggtgccgcagctgccggtgcggccggtacgggcgcagaccctgttcgtccggtgcacccagagcttcctggagctcgaggagggccagcgggactgggaggccgagccgctcgggcccggccagaccctggtgccactcgccgcgaaccacttctcgatcatcgccgagcggtccgacgcgaccgccgaggtgatcgaccggtggctcaccgcgcacgccctctga

SEQ ID NO: 5212 - DNA, 1488 bp, Actinoplanes utahensis
gtggctcaccgcgcacgccctctgacagcaccccttccttcacagaaaggccggccggtggccacttccgtcgaccagatcgttgacgcgctgcgcaagcagatgcgcgagaacgagaccctccgccagcagaacggcagcctgaacgcggcgctggccgcggccgccgagccgatcgccatcgtctccatggcgtgccgctacccgggcgccgtgacctcccccgacgagctgtggaagctggtcgccgacggcaccgacgcggtgtcggcgttcccgtccgaccgcggctggcccaccgacgtctacgacccgcaggagggccggcccggccgcagcgtcgcccgcgagggcggcttcctgccccgcgccaccgacttcgacgccgacttcttcggaatcagcccgcgcgaggcgctgaccatggatccgcagcagcggatcctgctcgaatgcgcctgggaggcgatcgagaacgccggcgtcgacccgcgctcgctgcgcggcaccccgaccggcgtctgggccggcgtgatgtatcacgactacgggttcgggaccagcgacggcagcatcgtcagtggccgggtcgcgtactgcctggggctggagggcccggccgtcaccgtcgacacggcctgttcctcctcgctggtggcgctgcactccgcggtccaggcgctgcgcgccggcgactgcacgctggccctggccggtggtgtcacggtgatggccaacccggacatgttcgtctacttcagcacccagcgcggcctcgcccgagacggccggtgcaagtcgttctcggcgcgggcggacggcaccggctgctccgagggcgccggcctgctgctgctcgaacgactctccgacgcccgccgcaacggacacccggtgctggccgtggtgcgcggcagcgcggtcaactccgacggcgcgtccagcggcctgaccaccccgaacggccggtcccagcagcgggtgatccggcgggcggtggccgacgccggcctcaccctggccgacatcgacgcggtcgaggcacacggcaccggcacccgactcggcgacccgatcgaggcgcaggcgctgctcgccacctacggccgggagcgggcgccgggcggcgcgccgctgctgctcggctcgctcaagtcgaacctcgggcacacccaggccgcggccggggtcggcgggatcatcaagatggtccaggccctgcgccacgaggaactgccgatctcgcggtacgccgacgaccccaccccgcacgtcgactggaccgccggcgcggtcgagctgctcaccgccaaccggccctggccgcgcggcgagcgggtccgccgcgccggcgtgtcgtcgttcgggctgagcggcaccaacgcccacgtcatcctggaggaggcgcccgacgcgccggcccccgccccggcaccggcgtcgggacactggccgctcgccctgtccgggaccaccccggctagctag

SEQ ID NO: 5213 - DNA, 2424 bp, Actinoplanes utahensis
gtggtgctggccaccgaccgggcacaggcggtcaccgcgctggacgcggtggccgccggcgagccgcacccggacgtgctgaccggcaccgtcccggccggcgccccgccgcgcgccgggttcctgttcaccggccagggctcgcaacggcacgggatgggccgcgaactctacgacgccttccccggcttcgccaccgcgtacgacgccgtgctcgccgaactcgacccgcacctgggccggccgctacgggacatcgggccggacctgctcgacaccaccgaatacgcccagcccgcgctgttcgccttcgaggtggcgctggcccggctggtcgagtcgtgcggggtccgtcccgccgtgctcggcggccactcgatcggtgagatcagcgccgcccacctggccggggtgctgccgctcgccgacgcctgccggctggtcgccgcccgcggccggctgatccagcagctgccgtccggcggcgcgatggtcgccgtggccgcctccgaggacgaggtgacgccgctgctcaccgcggacaccgggatcgccgcggtgaacgggccggccgcggtggtggtctccggcgacgccggcacggtgctcggcatcgccgcgcggttcccccgcaccacccggctgcgcacctcgcacgccttccactcaccgctgatggacccggcgctgcccgcgttccagcagatcgccacgaccatgtcgtacgccgttccggacacccgcatcgtctcgatgaccaccggccggcgggccgaggccggcgtgatcgacacgcccgggcactgggtgcggcacgtccgggaaccggtccgcttcctcgacggggtccgggcgatggccgccgagggcgccgcgctgctgctggagctgggcccggacgcggtgctgtcgccgctcgccgagaccgcgctgccggacctggtcgcctgcccggccagccggcgtgaccagccggaagtgcgcaccctgctggccgcgctggccaccgcgtacgtcaccgggatcacggtggactgggcggccctgcacgccggctcggatgtggtccgggtgccgctgccgacctacgcgttccagcgccgccggttctggtccgaggcccaggtgtggcccgccccggaaccggccgcgctcggcctcgccgcggccgcgcacccgttgctgtccgccctgctgcggctgcccgacggcggcgcggtgctgaccggccggctgaccgccgcggcccacccgtggatcgccgaccacgcggtgcacgccaccgtgctgctgcccggcaccgccctggtcgaactggccgtgtccgccggcacccggctcggctcgccggccctggatgagctggtcctggccgcgccgctgaccctgtccggcgccgaggcccgcgacctcacggtcaccgtcggcccgcccggcccggacgagcggcgcccgatccggatccactcccgcccggccggtgccgagcacgcgccgtggcagttgcacgccgacggctcgctcggcgccgcccacccgcgaatcccggccgcggacctggcgacctggccgccggtcggcgccgagccgatcgacgtggccgacgcctacccgcggatggcgcgccgcggctacgactacggccccgccttccagggcctgcgggcggcctggcggcgcggggcggacaccttcgccgaggtgcggctgccggccaccgacgacgggtacggcctgcatcccgcgctgctggacgcggccatgcacgccgacatcctggccgacgacgggccggcgctgctgccgttcagctggaaccgggtggccgtgcacgcgaccggcgccggcacgctgcgggtgcggatccggcacgacgacggcgacgcggccaccatcgcgctggaggccgccgacgagaccgggcaaccggtgctcaccgtcggctcgctcgtctcccggccggtcaccgccctccccgcgggcgacggccaccacgagtcgctgtacgacatcgcatggcgggccgtcacgccgccggccggcgtcaccgagtcggccgaggtgcacgtctgcgtcaccccggccggcctggacgtgccggccgcggtccgggcggtcgccggggaaaccctgcacgccgtccagcggtggctcggcgacgccggccgccgccggctggtcgtggtcacccgcggcgcggtcgcggtgcccggcgacgacggcgtcgacgtctgccaggccccggtctgggggctgatccgggccgcccaggccgaacacccgggccggatcgtgctggtcgacgcggacccggcgaccagcgttccggacgcggtgggcaccgcgctcgcggccggcgaaccggagctggccctgcgcggcccggccggatacgtgccgcggctggctccggcccctagctag

SEQ ID NO: 5214 - DNA, 1155 bp, Actinoplanes utahensis
gtgctggtcaccggtggcaccggtggcctcggcgcgctggtcgcccggcacctggtggcccggcacggcgtcggccggctgctgctggtcagccgccgcggcccggccgcacccggcgccgaccggctgcacgcggagctgaccgcgctcggcgccgaggtcaccgtcgcggcctgcgacgtggccgaccgtgcggcgctgcagcggttgctcgccgaggtgcccgacctgaccggggtggtgcactgcgccggtaccgcggagaacgccctgctcgaggcggtcaccgagacgcagctgcgggacgggctgcgggccaaggcggacgccgcctggcacctgcacgagctcaccgcggaccggccgctcaccgcgttcgtgctgttctcctcggccggcggtctggtgctcgcctccggccaggccgcctatgccgcggccaacgtcttcctggacgcgctggccgtgcaccggcgggccgccggcctgcccggcacctcggtcgcctacggcctgtgggacgtcgacaccgggctcagcgccggcctggcggagacccaccgggcccggatgcggcacctcgggctgccgccgctggccgccgaggacgggctggccctgctggacgccgcgctcaccgcggaccggccgctgtcggtgccgatccgggtcgacgcgaccgcgctgcgcaaccgcaccgacgaggtgccggcgctgctctggacgctggccgggcggacccggcggcgggtggtcgcggccgagccggcggccggcccggcggcgctggtggcccggctcgcggcgctgcccgcggcggcccaggaacgcgccgtgctggagctggtccgcaaggacgcggccgcggtgctgggacacgaccggcccagcggaatcgccgccgaacgaggcttcctcgacctcggcttcgactcgctgaccgcgctggaactgcggaaccggctcaacgacgcgaccgggcaccggctgccgccgacgctgatcttcgacttccccagcccgggggcgctcgccgcgcacctgcaccggaagctggtcgccccggccgccgcgcccatcccggcccgggcggacctgtccaccgccaacgccgaagacctgttcgccatgctcgacgcggagctcggcggctga

SEQ ID NO: 5215 - DNA, 1260 bp, Actinoplanes utahensis
atgcgattcggactgctgtaccaccaccagctgccccggccgtgggccgacgacagcgaggagcggatgctcctggagtccctggagcagatcgagctggccgacaagctcggcttcgactacgtgtgggagaccgagcaccacttcatggaggagtattcgcactcctccgcccccgaggtgttcctggcggccgcggcggcccgcacctcgcggatccggctggcgcacggcatcgtctcgctcccgcccggggtcaaccacccggtccgggtcgccgagcgactggccaccctggacctgatctccggcggccgggtcgacttcggcaccggccagggcagcacccagctggagctggaggcgttcggggtgtcccgggccaccaagcaggagcagtggcaggaggcgctggaggtggtgacccggctgctcaccgagtcgccgttcaccgggcattccggcgcgttcctggacctgccgccgcgcaacgtggtgccgaagccgaagcagaagccgcatccgccgctgtgggccgcgtgcagccgcccggaggcggtggagcaggccgcgcgcaacgggctgggggcactgtcgttcgccttcatctcgcccgaggaggccaaggcccgggtcgacgcgtactaccgggtgatcgcgtccgagcagtgcgtcccggccggtttcgcggtcaacccgcagttcgccctggtgctgccgttctcgtgtcacgaggacgaggaggtggcgctggaccgcggtctggagggcgcgcacttcttcgcctactcgttcatgcactactacgtgaacggcaagcaccggcccggccagtccaacgtgaccgaggacttccagcggttgcgcggccaactcggcctggtccgtgacccgggcgcggcgttcctggccgcggtggacgacaagacccgcgaggagcgggccgcgctgcgccgttgcatcggcacgccgaagcagctgaccgagacgatccgggcgtacgaggaggccggcgtcgaccagatcatcttccaggcccagatcggcgcgaaccggcactgcgacatcctggagtcgctggagctgttcgcggccgaggtgctcccggaattcgccgagcggcggcccgcgcgggaggccgccaagcaggagcggctggccgcggcggtgcaggcggcggtggcccgcaagccgcggcagagcgccgacgtctcggactacgtggcccgggccgagcgcccggagatgatgcggcgctga

SEQ ID NO: 5216 - DNA, 849 bp, Actinoplanes utahensis
atgggccgcgtggagaacaaggtcgccctgatcacgggcgccgcacggggacagggccgcagccacgcggtccgcctcgccgaggagggcgcggacatcatcgcgctcgacatctgcgaggacatcgacgtcatcgactacccgatgggcacggcggaggagctggaggagaccgcccgcctggtggagaaggccggccggcgggtcttccaccgccgggtcgacgtccgggaccgggccgcggtgcacgccgcgatcgacgacggggtggccgagctgggccggctggacgtggtgatccccagcgccggcgtgaaccagctgggcgccgaccggccgctgcggacgttcaccgagatcgtcgacgtgaacctgtccggcgtgctgaacacggtgcacggcgcgatcccgcacctgggcgcgggcgcctcgatcatcatcatcggttcggcggtcgggctgatgcccgggcacggcgagtccggcccgatgggtctgggcggggccgcgtactcgatggccaagcagaccctggtgctgtacaccagcctgttctcggtgcagctggcgccgctgaacatccggatcaacgcggtgcacccggcgaacgtcaacacccacatgatccagaaccgggcgacgtacgagatcttccgccccgacctggacgagccgaccgccgaggacgcccgggagggcttctacgcgttccagggcatgccgatcccctacatggagccgcaggacgtctcgcacgcgatcgtctacctggcctcggacgagtcccggtacgtgaccggtctgcagttcaagatcgacgccggcgcgctcggcaagatgggccgctga

SEQ ID NO: 5217 - DNA, 2769 bp, Actinoplanes utahensis
gtggatttcgagaatgcgtacgaccggatggaattgcagagccgggcgcccacgacggcgggctttcccccggccctgccctatccgggcacactcaccctgctccaggacctgctgaccgagtcgtccgccagccggggccggctcgcggtcgtctccggcggccaggccagcggcaagacccggctgctcaacgagttcgccgagaccgccgaggagggcggcgcgctgctgctgcgggcgtccgcctcgcgcggcgagtcggccctccggttcggcatcgtcgagcagttgttctgcaccacccggctgccgatcggggtggccgaccggatcgccgggctgctcaccgccggcggtgaggacaccaccgcgttccgggcgatcttcgcggtgatgctggacctggcccgcggcggcccgctggtggtcaccgtcgacgacgtccagttcgccgacccgcagtcccagcagctgctgctctacctgcaccggcggctcggaccggcccggatcctgctggtggtcaccgagtggaacacgccgcgcccgggcacctcggcgttcagcgccgagctgacccgccgcccgcacgagcgggtgctgctggcccggcccggcgtggccgaggtggccgggctgatcaccccgcggctgggcgccggtggggccgcgctggcgcccctggtgcaccggctcagcggcggcaacgcgctgctcgccctggccctggcgatggacctgcacaacgccggcgtccccggtggccgggagccgggcgtcgccttccggcacgccgtgctcgaatgcctgtaccggtgtgacgccccgctgcgcgacgtcgcgtacagcctcgccgtgctcggtgactacgcgcaggccgacaacgtcagccggctgctcgggatcaccaccgacgaggtggcccaggcggtcgccgtgctcaccgaggcggggctgctcagcgacggcgcgttccgccaccccagcgtcccggagctgctgctcgagacgatgccggccgagcagcgcggcgcgcagaacctggccgccgccagcctgctcgatcggtgcggcgccccgcccaccgagatcgcccgccagctggtgatgggcgggcagccgccggagccgtgggcggtgccggtgctgcgcgaggcggccgatcaggcgctcgccgccgaccgcgtgcagttcgcgatcaagtgcctgcggctggcgctgtccgccgggctgaccgacgggcagcggatccggatcaccgcgatgctggtccgcgccctggaccggctcaacccggcggcggccgcgccgcacctgccggagctgctgtcggcgctgcgccgtggcgagctgaccggccgggacaccgcggtggtgatccgcaacgcgctgtggaacggccggctcaccgaggtggccgacctgatgcgcacggcgaacacgcacgccctgctgaccgagccggggatcgccgccgagctgcggctcaaccagtacatcctgttcggtcagctgccggagagcttcccggcccgggaggacgcggccggcaacatcttcgcgcgggcgatcgacgcgctgtgcacgatgtggcggtccggcccggacgcgtcggtgatcgccagtgccgagcaggtgctgaccaactattcgctcggcgacacgacggtgagcacgatcgccgcggcgctgtccatcttcacccacggcaaccggcacgacgaggccgcgacgtggtgcgagcggctgatcgcggacgccacccggcgcggcgcggcgagctggaccgcggtcttcagttatctgcgggccgaggtggcgctgcgtcgcggcgatctcgcggtggcccgcgactacgccgaggaggcgctgcgccggctcgccccggaacactggggtgtgctggtcggctatcccctgtcggtgctggcgaacgcgctgacctggctcggcgagcacgaccgggccggcgaggtgatgcgcacgacggtcaccccggcgccgatgctgtccacgctgtgcgggatccgctatctgcaggcccgcgggcggcactacctggccaccgagcgggtgttcgccgccgccaaggacttccggcaggtgggcacgctggcccgggaacgcaatctggacgtgccgtcactggtcccgtggcgcaccgatctggccgaggccagcgcccagctgaaccgcccggccgaggcccgggacctgctgcaccagcagttccagcagcgtggtctggacggccgggcccgcggtgcggcgctgcggctgctggccgggctgggcgacccggcccgccgggtggggctgctcaagcagtcggtgtccgccctggaggcggcctgcgaccggtacgagctgggccgtgccctgcacgacctgagtcaggcccagcggcaggccggtgacgtggaacggtcccggcagacggcgagccgcgccgcgcaggagatgaaggcctgccacgcctcggacaccgggctcgcgccggtggccgcaccggagccgggcagcccgccggccgggcgcccccgggcggccgcggccgacgaccgggccgccgacatgacgctgagcaaggccgagcagcgggtggcgacgctggccgcgcagggtcactcgaaccggcagatcgcccgcacgctgtacatcacgatgagcaccgtggagcagcacctgacccgggtctaccgcaagctcaacgcccggtgccgcgaggacctcgcgctgctgctggccggtccgcgggtgttctga

SEQ ID NO: 5218 - DNA, 207 bp, Actinoplanes utahensis
atgatgaacgacgtgagtcggacaatcgacgccacgctcatcggcggtccggcggactttcccccggagtttcgtaaccagcaggtcgccgccggcgcgggaaaagttaaggttgccttctatggcggttacgagcacttcgagaaccgggacagcgaaacgccggaaatcctggtatgggtcggccggacccgcgtcgccgaatga

SEQ ID NO: 5219 - DNA, 153 bp, Actinoplanes utahensis
atggttgaggcttcaatggcgcaggacgacagcacggtgaccgagccggcgctcgcctccggcgtcccggtgccggcctccggcgtcccggagctcctcgaggagctgctggtcgagtccgtgtcgatcgatggtatgtgtggtgtctactga

SEQ ID NO: 5220 - DNA, 309 bp, Actinoplanes utahensis
atggtatgtgtggtgtctactgacccgcaccgccgccccttcgatctggacctggcctgggagctgcacccgcgggtggcggtccggccggaggggttcggcgccctgctctaccacttcggcacccgggagctctccttcctgaagagcccggacctgctcaccgtcgtgcgcgggctcggcgagcgcgacaccgcccgagccgcgtgcgtcgcggccgggctgcgccctgaccaactacccggatacgccgtggccctggccagcctggccggatccggcatgatccgccgccgcgaggacacctga

SEQ ID NO: 5221 - DNA, 1410 bp, Actinoplanes utahensis
atgacgacaccgatgccgctgaccggtcacttcgagcggggactggccgcgccgatctgcctgacctgggaactcacctacgcgtgcaacctgtcctgcgtgcactgcctgtccagctccggccggcgggacccgggcgagctgaccacgcaggagtgccggcggctgatcgacgagttcgagcggatgcaggtcttctacgtcaacatcggcggcggcgagccgaccatccgccccgacttctgggacctggtcgactacgccaccgcccaccgggtcggcgtcaagttctccaccaacggtgtgcggatcaaccgggagcgggccgcccggctggccggctccgactacgtcgacgtgcagatctcgctggacggcgcgaccgccgaggtgaacgatgcggtccgcggcgccggcacctacgccaccgcactgcgcgcgatggacaacctggccgaggccggattcgccggcttcaagatctcggtggtggtgacccgggagaacgtcggccagctcgacgacttcgcggccctcgccgcccgctacgacgcccagctgcgactcacccggctgcggccggccgggcgcggcgccgacgtctggccgcgcctgcacccgaccgccgaccagcagcgcgtcctctacgactggctggtcgaccacgacggcgaagtgctcaccggcgactccttcttccacctcgccgcgtacggcaagccgctgtccgggctcaacctgtgcggcgccggccgggtcgtctgcctcgtcgacccggtcggcgacgtgtacgcctgcccgttcgccatccacgacaccttccgcgccggcaacgtccgcgaccacggcggcttcgccgcggtgtggcggtcctccgagctgttcgccggcctgcgcggcgaacagtccggcggcgcctgcacctcctgctccgcctacgacgcgtgccggggcggctgcatggccgcgaagttcttcaccggcctgcccctcgacggacccgacccggaatgcgtccgcggccacggcgctaccgcactggccaccgccggggcgacgccgcgacccagccccgaccactcgcggccggcgcgggcggcgcgcgccgtcccgatcagcatcggccgccccggaagcgtccccgtcggcatcggccactccggtgctgctgctgtcccggccggcattggtcactccggtgctgctgctgtcccggccggcattggtcactccggtgctgctgctgtcccggccggcattggtcactccggtgctgctgctgtcccggccggcattggtcactccggtgctgctgctgtcccggccggcatcggtcactccggtgccgccgccgtcccggcccggccgtgcgacgagaacccgctcgccggcctgccggcctggaactga

SEQ ID NO: 5222 - DNA, 1401 bp, Actinoplanes utahensis
atgcagctgccgcacggatacaccgtcgccctggacgtgcgcacccgtgtcgtcgacggcggccgcgcgctgctcggcggggcgcccggcacccacctgctgcggctcaccccgaaagcgcgacggctgctggccggccgcaccctgcgggtgaccgacccggccagcgcggcgctcgccgagcgcctcctcgatctggcggtcgcccacccggtcgtggccgacctgccggccccggccgacgccggcgtcacctacgtgatcccggtgcgcgaccggccggcgcccctggcccggctgctggccagcatcccggcgggcagtgacgtcatcgtggtcgacgacgcctcacggaacccggcggcgatcgcggcggtcgccgcgcggtaccgggcccgcctgctggccctgccggtgaaccggggcccggcgggcgcccgcaacgccggcctgcgatcggtgcggacaccgttcgtcgccttcgtcgactccgacatcgtcctggaccccggcaccgtcccgacgctgctgcggcacttcgccgacccgcgcacggcggtggcggtcccccggatcaccgggctgcggaccgcacgttcggaaacctggatcgggcggtacgaggaatcccgctcgtcactcgacctgggctcgcgccccgcgtcggtgcgccccgggtcgtacgtctcctgggtttcgaccgcctgcctggtggcccgggtcagcgccaccggcgacggcttcgacgaggacatgcgggtcggcgaggacgtggacttcggctggcgggcggtgcgggccggttggcgggtccggttcgagccgtcagtggcggcggcgcacgagcaccgggtgcggttcggcgactggttcgtccgcaaagccgaatacggaaccggcgcgcacccgctcgccctgcggcaccccgagtcggtcgccccggccgtcctgccaccctggggtgtcgcgctgggcgccgccctgctggcgcagcgccgctggtccctgccggtggcggccgcggtgtacgcggtgaccgccgcccggatcgcccgcaaactcgacgtcgacggggcggccggcctcgggatgcgcctgaccggcggcggcgccgtcaccgtgctgcagcaggcgtccgcgctggtcacccggcactggtggccggcgaccgcggtcggctgcctgttctcggcgcgggtgcggcgggtcgcggcggtggccgcggtgaccgacgtggtgctggagtatgcgacccaggggtcccgcgggcggatccggctggacccggtgcggtacggggtggcccggcgactcgacgacatcgcctacggcgcgggggtgtggtggtcggcggccaagggccggtcggcgaccgcgctgcggccgcgactgcgcgggtga

SEQ ID NO: 5223 - DNA, 843 bp, Actinoplanes utahensis
ttgttgaccgccgtgacgggatctctcctggcggtcagcgacctgcacgtctcctaccagcagaaccgcgaggtcgtcgaacggatccggcccgggaccggggacgactggctgatcgtcgcgggtgacgtgggcgagcgcccagccgacatcggctgggcgctcggcctgctgcgcgaccggttcgcccgggtgatctgggcgcccggcaaccacgagctgtggacccatccccaggatccggtccggctgcgcggcgacgagcggtatcagtcactggtcgagctgtgccgcgacctggacgtggtcaccccggaggacgaatatccgatgtggaccggcgccggcgggccggtggtcgtcgccccgctgttcgtgctctacgactactcgtggctggcgccgggcgcgaccacccgggaggagtcgctgaagctggcgtacgacgcgggtgtcgtctgcaccgacgagatgatgctcttccccgacccgtacccggaccgggcggcatggtgcgcggcccgggtcgcctacaccgagcagcggctgtccgcgatcgacccggccctgccgaccgtgctggtcagccactggccgctgcggcgggaaccgaccgacgtgctctggcatccggagttccgccagtggtgcggcaccgaccggaccgcggactggcacctgcggttccgggccgccgtcgcggtctacggccacctgcacatcccccgcaccacccggtacgacggggtgcgcttcgaggaggtgtcgctcggctacccgcgcgagtggggccggcgcggcgaccagccccagccggtgcggcggatcctcggcaccccttga

SEQ ID NO: 5224 - DNA, 468 bp, Actinoplanes utahensis
atggacgaaataccgcaacgagtggtgctggacgacccggcggctcgaacgactgcagagaatgtcgccgcggacctggcggcacagttgcaacgaggcggcgacaccttggacgccgacgtatacgacgcctggttcgccgccgacatcctgtggggcagcccgtacggagcgaccctgacgggtttcgagggattgaacgcgattcaccaccgcttgatggaccggtcggcgccggtgaccgcgcccccggcgccggcctcgcggttcgaagtcgtgtcggttctggcacccgcgcccggcgtcgtcgtggcgcagatccgtcggcaggcactggccgcgggcggcttctcggagatggcgctctacgtactcgtggaacgcgcgggccggtggtggctggccgccgcgcagaacacgccgatcaggccggcagatggcgcgctgtcggcgtctcccggcaactga

SEQ ID NO: 5225 - DNA, 1197 bp, Actinoplanes utahensis
atgggagtcactctaggaactccggcacaccaccgcaggcgattgccgggtacaccgccgggtggcgcgacgagcagaatgaggatcatggcgaccatctatgacgtcgcgcagcgtgcgcgggtctctccggccaccgtctcccgggtgctcaacgggaacgacagcgtcgatcccgggttggccgaccgggtgcgcgacgcggtccgcgagctgaactaccggcccaacatggtcgcccgcaacctgcgccgcagccgcaccacgctgtgggcggtgatcatctcggacgtcgaaaacccgttcttcaccgcgctcgtgcgcggcgtcgaggatgtcgcccagcgggccggctactcggtggtgctctgcaacagcgacgaggacccggccaaggaggcgcgatacgtgaccgccgccctggaggaccggatggccggcgtgatcatctccagtgcgggcagtaccgcgaacgtgacccggctgatcgaggccggcaccccggtggtcgcgatcgaccggcagatcggcggcacccgggtggacagcgtgctggtcgacaacgagcacggcgccgaggcggccaccgcccacctgatcgggaacggataccgccggatcgcctgcatcaccgggccggccgcggtctcgaccgccgtccagcggctgcgcggctaccggcgcgcgctgcagacccacaagatcaagatcgatgatgcgctggtacgccacgccgacttccgtgaggacggcggctacaccgcgatggcctcgctgctggacgccggcgaacccccggacgcggtgttcaccgccaacaacctgatgaccgtcggcgcggtcgagtgcctggtcgatcggggcgtcgccatcccggccgggctcggcgtgatcggcttcgacgaggcgccgggcgcccggctgctgcgcccggccctgtcgacggtcgcccagcccacctacgagctgggacgcaccgccgccacgctgctcgccgaacggatcgccgaccccgaccggcccccgtccacggtcaccctgctgaccgagctgcggatccgggagagcagccggggtcaggcgaccgtgcaggccgccccgttgcgcgtgacgtcgaccggccgcggatccgcgccggtcgacgtgccgttgaagccgaagctcagcgacgccccgggggccggcacgccgtggtga

SEQ ID NO: 5226 - DNA, 426 bp, Actinoplanes utahensis
atgccgcgtctcccgcgtgtcctggccgctctggtggccggcacgaccgcgttcgcgccggtgccggccccgccaccgctgcatcagggccgcgtcttcaccaaggccgacgacacccgctgcctgaccggcggcgccgtcggcgcgctgctgagcgtccgcgcctgcgacgaccagacgcccggtcaacgctggtatcaggcgagcaccggcgcgctgtacaacgggctgaactgcatccgggccgagggcgcgctggtgcgggtggcggcctgcaacggcggcgacccggcccaggactggtggttcatcgaggagatccgcagcggacggtacgggccctgtctgaccgacgagggcgacggcaccgtccggctgcagccgtgcacgtggacgctgaaccagaaatggatctccagctcctga

SEQ ID NO: 5227 - DNA, 1578 bp, Actinoplanes utahensis
gtgcgccggctgctgatccggtcggcggtgctcctgctcggagcgggtttgatcagtagcgtcgccgcctccccggcgcaggcgctgcccaacaatctggcgctcaccccgccgatgggctggaacgactggaacgcctacggctgcaacgtgtcggaggcgctggtcaaacagaccgccgacaagatcgtctcggcgggcctggcgaccgccggctaccagtacgtcaacatcgacgactgctggatgcagaagagccgcgacgcggccggcaacctgcagcccgacctcggcaagtttcccgacggcatcgccggcaccgcggcgtacgtgcacggcaagggtctgaaactcggcatctacgaggacgccgggacggccacctgcgccggctacccgggcagcctcggacacgaggcgcaggacgcgcgctcgttcgccgcgtggggcgtcgactacctgaaatacgacaactgcaacaacagcggctccaccaccaccgcgcagtacatcgcccggtactcggcgatgcgtgacgcgctggccgccaccggccggccgatcgtctacagcatctgcgagtggggggtgaacgcgccgtggacctgggccggtgacgtcggcaacctgtggcgcaccaccggtgacatccaggcgaactacgccagcatgctgtcgatcttccaccagaacgtgggtctggccgcctacgccgggcccggccggtggaacgacccggacatgctggaggtcggcaacggcatgaccgccaccgaggaccgcgcgcacttcagcctctgggccgagatggccgcgccgctgttggccggcaacaacctggtcaccgccagtgccaccacgctgtccatcctcggcaaccgctcggtgatcgcggtcgaccaggactccgccggtcggcagggtcacctggtcagctccaccggcgggctcgacgtactggccaaacccctcgcgaacggcgacgtgtcggtggtgctgttcaacgagaacgcggcgaccgccacgatcagcaccacggtcgcggcgatcggcaagtccggggcgtccagctacgggctggccgacctgtgggccggaaccagcggcagcaccaccgggacgatcagcgccggcgtccccgggcacggcgtggtcatgtaccgggtgtccggcggcaccaccggcggcggcaccgacaccgtcgtcaccatccgcggcgccggctcgggccgctgcctggacgacccgaacagcagcaccaccaacggcacccaggtggtcatctgggactgcaacgggggcggcaaccagcgctggacccgggtcggcaaccagctccaggtcctcggcaagtgcctggacgcctacaacaaccagaccaccaacggcaccaaggtggagatctgggactgcaacggccagaccaatcagcagtggacggtcaacgccgacggcaccatcaccggcgtgcagtccggcctctgcctggacgtgaccggcgccgccaccgccaacaacacgctcgtcgaactgtggacctgcaacggcggcagcaatcagaagtggacgctgagctga

SEQ ID NO: 5228 - DNA, 402 bp, Actinoplanes utahensis
gtgcggacccccaccgccacaccgccgcagaccccgaccgccacgccgtcgcgcagcccggccacctcgccgacgtccgctccggcgccgtccggggcctgccagagcgggttcgcgtcgcacgccaccggccagatcggcgagggcgccaccgtggtgggcgcgtcgttcaccgcgcgccgtggccggcagaccgcctgcctggccggaccgtccggcaccgacttcgacctgtacctggaccgcaacgtcggcggccggtggaccaccgtggcgaaatcgaccggggagacgtcccgcgaggcgatcaccttcagcgccgcggccgggacctaccggtaccgggtggtgtcgtacgccggctcgggcaaggccgtgctcggctggaacgccccggcctga

SEQ ID NO: 5229 - DNA, 918 bp, Actinoplanes utahensis
atgacgttctgctaccgacaggtaaccccatgcggtagaagatctccgtacggtgaccgaagttttaagggtttcttatttccattgccgccggcctattcgttgcggatgctcgcgtcgaaccgacgagagtgcggcggccgcgagccggccccgccgtccgcgctctcccgcacaccccgggccgaccgggcaacgccgggcacgatccggtgtgccgatggcgcgggacccctcaaggagcaacgcttgaagcacaaagtcgcgctggcgacgaccctgacggccgtcaccgtcgcgggttccatcgcactcaccatgccgcagggcaacgcggccaccaccgcgggtcatcagccgcctgcggccgatgggccggcgccggtggcgttggccacgtcctcggccgcggatctggtcgccaagaagccgaaggcgtttttcaagagtcggttcgacaggcttgatcggcgtcaggtggtcagtcagaacggtttgcagtatgtggtgtacgagcggacctatcggggtttgccggtgcatggtggtgatgcggtggtggtcaccgacagccgcggccgggtgctcaacgagtatgttgcgcaggagcaggcgttgtcggttccggtgaccgcgaaggtttcggcggccgcggcggcgcggaccgcgcagaagcagttggtcaaggtgagcgcggtgtctccggcggcgttgcaggtggtggcgcagggtgccggtgtgctggcgtacgaggtggtcgtggcgggtgccaagcgtgctgccggcggtgtggtgccgagtaatctgcatgtgttcgtggatgccaccacgggcaaggtgctgccggagctgacccgggacgacatcgtcgacgcggccgggcacggcgcctactacggtgatgtgctagctagctag

SEQ ID NO: 5230 - DNA, 555 bp, Actinoplanes utahensis
atgagaaatgctttcgccgcgcgcgtgctgccggccctgctgatcgccggactcgccggctgctcgaccggcaccaccgcggccgggtccccggcgacatccccggtcgcgtcgtcaccggtgtccacgcccgggtccacgcccgcctccccggccggctcgccggccgtgacctccgccgcggtcccggccgcgccgtccacggcggtggcggacgccgccgccttcccggtggtgatcacccgcaccgggggcatcgccggcgtcgacgaccgggtgtcgatcgatgcggacggcgccgcgacggtgacccggcgcgggcagaaggcgcggcacgtcacggtgccgccggccatgatgaccggcctgcgccgcgccctggcggccccgatgccccgtggcgcggccgtcccgccggcgggtgcctgctccgacgggttcgtctaccagatcacccggccggccggcagcgtgaccgtggcggactgcggcaagccggccgatcccggcgtcaccgcgatcctcgacgtcgccaaggcgctgttggcgggctga

SEQ ID NO: 5231 - DNA, 660 bp, Actinoplanes utahensis
atgcgggtcaccgtagaccgccgacggttcggcggtcaccgcagtgtccagggccggggccggctcacggccacgcgcggcgatcagcgccatcgtgccggatttctgcgattatgcggcatgaccgttctccattcggtgcacaccgcggacctgagcccgagtgaccgcagccggatccgggatctgctggacgacgcgttcggcggccggttcgacgatcacgactgggagcacgcactcggcggactgcacattctgatcagcgtggacggcaccctgatcgcgcacggttcggtggtccgccggcagttcctgcaccagggccggtcggtgcggtgcgggtacgtggaagcggtcgcggtgcatccggcgcatcggcggcgcggattcggctcagcggtgatgaccgaggcggagcggctgatcgaccacgggtacgcgctgggcgggctgtccgcgtcggcctccgctgtcgatctctatcgggggcgggggtggcggcgctggccgggcgggaccgcggtgctcgggccggccggcgtcacgccgacgcccggggacgacgacagcacgctgctgcggctcgtcccgggcggcacaccactgagcgtcaccgacccggtggtctgcgactggcgcgacggcgacgtctggtga

SEQ ID NO: 5232 - DNA, 891 bp, Actinoplanes utahensis
atgtccacccccgtcgccccggcccgcgtccgtccctcgatcaccgtgctcaccgctgtcgtggtcaccgtcaccgcctgggcctcggccttcgtcgcgatccgcgccgtacacgcccacttcggcgccggcccgctcgccctcggccgcctcgccaccggcaccgtcgcgctcaccgccgccctgctgatcacccgcggctgggtccgccccaccgcccgcgagtggtccctggtcgccggcgtcggggtgatctggttcggtctctacaacgtcgccctgaacgccgccgagcaacgcctcgacgccggcacctcggcgatgctggtcaacgtcggcccgatcctgatcgccgtcctggccggcgtcttcctcggcgagggcttcccgcgccgcctgctgatcggcgccggggtggcgttctgcggcgtcctgctgatcgggttcgccggccgcggcggcagcgccgccgacccgctcggcgtcgccctgtgcctgctggcggcggccgcctgggcggtcggtgtcaccctgcagaagccggccctgcgccgcctccccgcgttgcaggtgacccagatggcctgcaccgtcggcatgctgaccacgctcccgttcaccggcggtctcctgcacgacctgcgcaccgctccgcccgcctcgatcgccggcgtcgtctacctgggcctgatccccaccgccctggccttcggcacctgggcgtacgccctgacccggatgaccgccggccgcctcggcgtcaccacctacctggttccgccgctgaccatcctgctggcctggcccctgctcgcggaaaccccgcacctgctcgccctggccggcggcgccgtcgccctgaccggcgtagccctctcccgccgccgctga

SEQ ID NO: 5233 - DNA, 546 bp, Actinoplanes utahensis
gtggtcacgatctattcggacgagcgcctggaccgcaacctgggcggctgggagatgccggtgtcctgggtgcagtcgatcaacccggtcttcatcatcatcctgtccggggcgttcgccgcgctctggacccgcctcggcgaccggcaaccctcgaccccgatcaaattcgccgccggtacgacgttgatggggctggcgttcctgctcttcctgccgctggccggcggcggaccgcacagcgcgccgctgctcgccctggccggcatcctgttcgtcttcaccgtggccgaactgctgctctccccggtcggcctgtccctggccaccaagctggcgccgcacgccttccagacgcagatggtggccctgttcttcctgtccgtcgcgctgggcacggcggcgtccgggagcctggcgcagctctacagccccgagcacgaggtcgcctacttcggcatcctcggcgctgtggcgatcatcctgggcgtggcactgggcgcggcggcccgcccgatctcccgcctgatgggcgacgtccgctga

SEQ ID NO: 5234 - DNA, 2031 bp, Actinoplanes utahensis
ttgccggcggcgcatttcggtgagcggtcgaaatttccgaaccagcaacctcacgcgcacggcccctggtggatctatccctcgtacgagccagcactcacaaggggcttgaccaccttggcgggctgcacgtcttcacttatgttgccaaggccgaagccgccggccaggccaccgcggtcggtcaaaccgggacggctggccaaactgccccggccgggcgcttttagatcagccgcagccgcggcgggcgcaccctgccacccgcgtgagaactcacgaccccgggtggcagccgcaaacctgccggcgatgccaggcccacccgatcctgagcggtcccgggaaacagaagtatctctgctggtggtgcgtgttcccggtcaagacccgcccccgccttgcaaagtctgcggcgaaggcaagcactggaccaagggctactgccgcaactgccacccgagcgcgagccagcgtggttgccttgactgtctctcctggggacccgtccgcatcggtggcctacctgcctttcagggcagctggtgctacgcctgctcgcagaaccgtcggcgctatccggtcgggccctgccggttttgccaccgcgaggcagcgctcctgcacggcgtctgtcgcctctgccggcacgaggccggccgtcgggccggctcgggtcaccagatcaggccccttgaccggctcaagcagcatccgagtcaacagctgttcttcgccgagatgctgcggcatctccaactgggcgggctccgccgtgtcgagccgcggccgccgccgccagcgccagcatcctggggaccacccgtcggggtccagggcgtcctgttcgacctgaaccgggacttgtcgctcttcgtccgcaaggaggccgccgtttgcgacgatccccggctgtttcacgctcatgctgtgtcggccagactcgcggataggggcggctggtcccatcacaccgtcctcggggtcaaccgggcgctgaccgcagttctgggctgccggccggacgacggacagcagattcgcatgtcggagctacgccagctcgggcgccggaagatgtccgctgagcgcaccgccgaggtcctgaacgagatgggcctcctgcacgacgacaccccggacgccctcgcggcatgggtcgaccggcaactcgacgggctggcgccacggatcgagcacgaggtccgtcactggatcgacttccttcgaggacggctgccgcggtcgaagtccaggcccgtcgagggcgtctaccgcgagctggcctacctgctgccgccgctgcgggcatggtcagatcgatacgactcgttacgcgaggtcgtccgggacgacatcaaggcggtcgccttcgccaggggacaagacttggactaccgcacgcaccagctcacggccctgcggtcgctgttccggcggctcaagcgggaccagctgatcttccgcaatccgaccacccccctatcccttcctggccgggaccggcttgtcgccgcccggccactgcccgacgaggagcttcggcgagccgtctcctgggcggcaggccgaccggaacgaaccgtgctggtcggcctggcgatcggacaggctctccggccggttcagatgcgtcggctgctcgtcgtcgacgtcaacctcggcgagcggatgctggtggtcgagggccagccctggcctctgcatgacttgacgttcaacgcgctgaccagctatctcgaccacaggcggacccgctggccgaacacccggaacccgcacctgctgatcacccagcagaccgcggccgagatcgggccggtcagcaagtcatggtccaagatagtgatgaagcctttggggatcaccctggtccagctgcgccaggaccggctgctcgatgagctgatcgctcacggcccggatccgctccacttcatgaccgtgttcggatgcagtgacaccaccgcgctgaggtttctccgggtcgccgagcagttgctcgggcacgatccgcgtttccgtcgctga

SEQ ID NO: 5235 - DNA, 636 bp, Actinoplanes utahensis
gtgatcttgactttctcgtccacatcgtccgagcggggctcgggagcaaggccggcgatcccggagcgctccgagtcccgcaccggtggcgaggttgacgaccgtcgacctcgccaaccttcgcctggccgtgacaaggaccccattcggggttcggaccccgcgttcgacgccttcttcatgaataccttcgggcaggtcgtgcggcgactgctctattcgggtgcctcacgcgcggacgcggaagacgcggtccagcaagcaatggctgccgtctacgaacgctggtccgagatcggcgaacctgaccgtttcgttcatgtcgtagcccgacatgcgctgatcaaaatgcagtcacgggcgcatagggaggcccagcggtgggccctgcaaggcggacctttcgtggtctccgaggaatcgggactcgactcggctgccctggaggccgatgccgttaggggcctcttcgcactccttacgcccatgcagcgccaggtcatatccctctactacgacggttaccccaccaacgagatcgccgacagcctgaacatcagccagagcaccgtccgagtgcacctccagagagcccgccagattctgcggaaagcactctcgtcggtcgacgggtag

SEQ ID NO: 5236 - DNA, 1206 bp, Actinoplanes utahensis
gtggacaacgcgtacggcgtgttcctcggcctggacgtcggcaaaactgatcatcacgcggtcgcgttgaacccggagggcaaacggctgcacgacgcagccctgccgaacaccgaggccgggctgcggaaactgttcgacaagctggcccgtcacggccagatcctggcggtggtcgaccagccggcctcgatcggcgccctgcccgtcgcggttgcccgagcctgcgggcaccagatcgcctacctgccaggcctggtcatgcgccgactcgctgacctgcacccaggaacggccaagaccgacgcccgtgacgcctacgtgatcgccgacgccgcccggaccctgccgcacacgctgcgccgcgtcgacgccggcgacgacactctggccgagctggaaatgctggtcggctacgacgacgacctcgccggtgaggtcacccgcatcagcaaccggatccgcggtctgctcacccagatccacccgcccctggaacgagtcctgggcccgaaagtccagcacgcggccgtcctggacctgttatcgcgctgcggcggcccgaccgggctgcgcaaggccggccggtcgaaactcgtcgagatcgccaagccgcgggcacctcgcatgggcgtccggctcgtcgaacaaatcttcaccgctctcgacgcgcaaaccgtggtcgttcccggcaccaccgcggccgagaccatcctgccgaagctggccgaaaatctgcgtgacctgctgaaacaacgagaccaagtcgctgtccaagtcgaggagatgcttgacgctcaccctctttcctcggtcctgatctcgatgcccggcgtcggggtcaggaccgcagcccggatcctgctcgaagtcggcgacgtcgccgcgtttcccacctccggacacctggccgcctacgccggcctggcaccggtcacccgccgctcgggcaccagcatccgcggcgagcatccacccaaaggcggcaacaagcagctcaaacgagcgttcttcctgtccgcattcgctgccctgtccgatccactcagccgggcctactacgaccggaaaagagccgaaggcaagaaacacaacgcggccctcatctgcctggcccgccgccgcgtcgacgtcctgcacgccatgctccgcacctcaacgccctaccagcacaaaccggtagaaaaccttgcgctcgctgcttga

SEQ ID NO: 5237 - DNA, 93 bp, Actinoplanes utahensis
atgttactctccgagcagaaccggttcttcgtcaccggcggatggggcgagccgataagcccactcatcgagaatgagggtttcataggatga

SEQ ID NO: 5238 - DNA, 588 bp, Actinoplanes utahensis
gtgacgaactacctcgccatcgtgagttctatcgtcgccttggtcggagtttggataggcggccgcttgacttttcgtacccaggcgaagggctggaagcaggcggaatcccaacggtggcgcgaccttcgccaggccacatatggagacttcctcgctgcggtgcgccgctaccgaacatacgtggggcgccacgagacacccttcgagctcgcgccctacgcggatggcatccgattgtcgccacgcctggacgagcaggggatggttcacaagcaagcgctcgacgcagcgctggcgcaggtccagttcatcgcgcaacagcaggagactgctagcgctgctcggacccttgtgagcatggcgcgaaggactgcggtggcaaagacgatctatggatcgaagaccgttcccacccgcatcgacgacatgttctggcattcggagctggccttcgtcaacgccatccgcgccgaactcggtctgatccctctcgtccaagacacctacgacgaccccatgaagacccttgatcgagaactctttgacgcataccgctcgcaacaggccgggacaggctcgaactga

SEQ ID NO: 5239 - DNA, 96 bp, Actinoplanes utahensis
gtggcgacaatcggggccggtgtgtcgaggacgtgccggcggatcgcggcggcgtgggcggcgatggacggggccgagggcctgcaccggggttga

SEQ ID NO: 5240 - DNA, 429 bp, Actinoplanes utahensis
atgaacgggcacgtgactcgcagacccgacccgatggcccgccgccagtcgcagccgcgcgccgacttagtgcatcgttcagcaccgttcctgccgtcagacagtgaaatccggcaggtgttcatctaccagactgcggcgaacttcctgatcttcgtcctcatctacctcaccggactcgcgattttctgggccaagtaccgctgcgtagcagtcacccaagacgccatctacgtgttggagagcagcaaggtatcgggcggcggcaaaccgcaacgcctgatcggcacgttgccacgccgcacccagctcggcccgatgtccggccgatggagtcagatgaaactactcggcgaacagtgctgggtccacaagcgatttcacgatcaggtcgctgccgccgaccgggaggctggcttcactgcatag

SEQ ID NO: 5241 - DNA, 870 bp, Actinoplanes utahensis
ttgtgcacgtcatcggctgtgatcgttcgttggtcgagcatggggatggagcgacttccatatcgaactgatctgtcggatgcgcggtgggcgttgatcgagccggttctgacgcagtggcgtgaggcacggcggggtctggggatccggccgccggtccatgatttacgggagatcgtcaatgcgatcttgtatgtggcgcggaccggcatggcgtgggagtacctgccgcacgactttccgccggcgaagaccgtctatgactactacgccaagtgggaggccgacggcaccacggcccgcatccacgatcttctacggtcgtgggtacgtgaggcgctcggccgagacgccgaaccgagcgccgcggtgctggatgctcaaagcgtcaaaacgtcttgcaacgtaagggaatccgagcagggcatcgacgcggcgaagaagatcaaagggcggaaacggcacatcgctaccgacaccctcggactgctgctggcggtcgtggtcacggcggcgtcggtgtccgattccgcagccggcaagggcctgctgagcacgctggccgccgagcatccgacggtgagcaaggtctgggtcgacggcggctaccagaacaccgtgctccgtcacggcgcaggcctcggcatcgacgtcgagcgggtgccacgccgtgcggagaaaggatttcaggtccttgctcgccgatgggtggtcgagcggacgttcgggtggctgatgcagcaccgacgcctagctcgcgactacgaggcgctgccgcagcgatcggccacgatggtctattgggcgatgactaacacaatcatgctcagactgaccggcgaatccacccaaacttggcagcggctatga

SEQ ID NO: 5242 - DNA, 1635 bp, Actinoplanes utahensis
gtgcgagatcgagctgacccgcaaggagttccacctgctcggcgtcctggccgaggcaccgggctcggtgttgcgcaagaaccagctgatggtgcgggtgtggcaggcggccgacccgtcggcggcccgcacgctcgaggtgcacatcagttcactacgcaccaagctgcggcgggcggtcaccatcgagaccgtgcgcggcgttggctaccggctggtcccgcgcggcgacggaaacgccggctagctgtgcgtaaccgcctgatgagctgctattcggtgttgctggccgcggtgctgaccgggttgatcgtgccgctggccatctccacggtcacccgcgacacccaggcgatgttcatcgaccggcttaacgacaccgacaggctcgcctcgctggccgacccggccttgcggaccggccacattacggcgttgagcatggaactgcggcagtaccaccagatctacggcgtggacgtactgctggtggaccgtgacggcgtcacggtcctcgagcagggtgacggtcaggtggctagccgggcgatgctgcgccgctacgtcgatgaggcgctcacgggcgagcggcacgacgtgagcggagcgatttggccttggcgcgatcagccgctggtggtggcgaccccgatcggtcgcggcggcgagattatcggcggcattctgactatttcaccggtacgcggacttcaattggaggtctggcgctacctggcggtgctggcggcatgcggcgtgttagcgatgattgcgggcatcgcggtcggccagccgctggtgcgctggatcctgcgcccggtgtacgatctcgacgcgatggtgacatcgctgccggagcagctccaccgcagccgggcggccgagtccggaccgccggagctgcagcgcctggccgcctcggtcaaccagatggccgaccggatcaccgagctgatcgatcggcagggctccttcgtctcgtatgcgggtcaccagctgcgcaccccgctggcctccctgcgcattgccctcgacaacctcgcgccggcaccgggcaagcgcgaccggtcacacgagattgcggtgcaggaggccgaccgctcggccgcgatcatcgactcgctgctcgcctatgccagcgccaacgcccgggccgccgcggccaccgagatcgacgctgtgcccgcgatcgaggcgtgggtagcggcgcggcagccgatggccgaggcggctagagtgcagctggtctgccgggccgccgggccgcggtgggtgcgggtggcaccgtcagtgctcgaccaagccgtggaggtcctagtggacaacgcggtgaagtacggtgagacgcgtacccgcatttttatagaggtggcggcccccgagcccggctgggtcgaagtctccgtcgaggacgacggggtcggcatcccggacgatgagctgctgcatgcggtcgagccgttctggcggcacccgtcccggcaggtgcacgacgggagcggcctgggcctgagtatcatcggcgcgctggtcaccgcgtccggaggcgagcttcaactggccggcgtccggccacacgggttgcgtgcgacggtccgtctgcctgccgccagaactgagtgcgatgcccgatga

SEQ ID NO: 5243 - DNA, 909 bp, Actinoplanes utahensis
ttgctagcggcgggatgcagtggctcaagcgcggaagcggacgagttggtgatcgcgaccggcagcgtgggcggcgtctacgaccggctgggaaccgctctggcgtcggtcggccagcgcttcgccctgcagatgagcgccgtccgcacggccgcctcgattgagaacatgacgctgctaggcaaccgggctgccgacatcggcttcaccacggtggactgcgccagcttggccctaggcggtgaggcgccgttcccggcgccggtgccgattgccgcgctcgccgccctctacgacgattacctgcagctggtggtgcgggctgacgcgagcatcggcacgctggccgatttggcgggtcgtcgggtgtccaccggcgaggtcggctccggcaccgacatcgccgccgagagggtgctggcggcggccgggctggccggacgtgtacgcatagcacggcagtccctgtcgaccgccgtggccggggtccgggccggcgcgctggacgcgttcttcttcagcgctggtctcccgaccccggccatcaacgacctcgtgcgggccgagccggggatcatccggctgctgccgctgagccagctggtgggcaggctgcagtcggagttcggcgaggtgtacgccgagcgcaccgtcccccgagtgacctatcggatgacagccgatgtcggcacgatcggcatcaccaacgtgctagtggtccggcgcgacatgtccgacaacgtggcccgacggctcaccgcgctgctgttcgaggccggcttccagttgcgcgacgcccacatcgacgccgagcagatcgacccgcgttcggccctgggcacgtatccggtaccgctgcatcccggagcacagcagtactaccgagccgccaagctcttcgtcgactga

SEQ ID NO: 5244 - DNA, 1437 bp, Actinoplanes utahensis
atgatcgacgtgatcgtggtcggctccggccccaacggcctggcaggcgcggtcgcgctggccaggcaaggcctgaccgtgaccgtgctcgaggcggccgaaaccataggcggaggcacccgcagcggcgagctgaccgtccccggcgtgctgcacgaccactgctccgcggtccacccgatggcggtggcctcaccgttcctggcctcgctccccctcgaccagcacgggctgacctggacctgggcgccggtggagctggcgcatccgctcgacggcggccggggcgccgcgctgtaccggtcgatcgagcgcaccgcagccgcgctcggcgacgacggcgcgacctggcgacggctgttcggcccgctggccgcggacttcgacacgctcgcaactgacctgctcggcccggtgctgcgggttccccggcatccggtccggctcggccgcttcggactgcgggcggccgcgccggcgtcggccctggcccggctgtggcgtacggccgaaagccgggcgctgttcgcggggaccgccgcgcacgccatgcggccgttgcacacgcctgggagcaccgccatcggggcgatgttgatcgcggccggtcaccggcacggctggccagtggcccggggtggttcccgggcgatcaccgacgcgctggcccggcatctgtttgaactaggcggcacgatccagaccggcgcgctggtgcggtcgctggccgatctgccgccggccagggtggtgctgctcgacgtcgcgccgtccgcggccgcgcgcatctgtggcgaccgactgccgccccgggtcgcgcgcgcctaccgccggtggcggcacggtcccgcggcattcaaggtggacctcgcagtcgagggcggtgtgccgtggcggctggaggcggcccggcaggcgggcacagtgcatgtcgggggagagctgaacgagattgcgtacgcggaaaggcaggtcaccgacggacgcctacctacgcggccgttcgttctggtcgcccagcagtacctggccgacccggcccggtcacagggtgacatccacccggtctacgcctacgctcacgtgccgagcggatgggacggagacgccaccgacgccgtcctcgaccagatcgaacggttcgcgcccggactgcgcgagcggatcgtcgcccggtcggtgcatacggtgtcccagttctctggcggcaaccccaactacgtgcgcggggacatcctcaccggggccaatacgccggcgcagctggtggcacggccgcgctgggccatcgacccgtacgcgaccggcgtccccggcgtcttcctctgctcggccgccacgccgcctggcgcaggtgtacacggcatgtgcggctaccaagcggcccgatcggcgctccgtcacattcagtcgacgaagagcttggcggctcggtag

SEQ ID NO: 5245 - DNA, 1170 bp, Actinoplanes utahensis
gtgtcgccgcatgatgcccaggtgcgggcgctggacgcgttcttgcgcgctgatccgcagacctggccgcggctggcgccagcgctggtggcccgggcaggtgagcagcggcttcgcgaagtcgttgacgaggcccacggccggctcggcggcatcaccggcgtcatcgataccccagacggcctagcgatcgaaggaccgcaggggcaggtgctggcctgggccgaaacggacgagggcggcgcgctgagcggactgtggatcgccggggcacggcgcggacgtgtccgttccgggcgccgggctgagctgatcgggtacgcggtgccctacgtaccgatgctgtggggggcgatcggctgctggacagccaggtcggtgctgggctgggctgggctcctgctgaccaccgtggcgatgtacacgttcatccgcgggctcggcgctctgcccgtacggccttggtgggcgaaccatcccctcactctgctgttcactctcgccctcgcctcgacggcccgcctgccgcggctgaccgctgagggcggtgccgacagtctgatcgtcggcgtcgttctggtcgtcgcggtagtcgcgctgcttgtgccggcccgccggcaccggtggcccgaaagcaccgagcggccgctggcagtgtttcccgtcgacggtgactggtatgtactgcaaggcggcggccgtctgattaaccatcacgctaccgtccccgagcagcgcggcgccgtcgacctagtccgcatcggcccccagcggggtgatgcgagccggctcgagtcgtacctggcctacggcgagccggtcgtcgcgccctgcgccggccgggtcgtaaccgccgtcgatggcatcgaggaccaggcgcccggcacgattcggtttgcgcccccgtacggcaaccgcgtgaccatcgacaacggcagtgagctggtcacagtcgcccatctgaaaccgggcacggtcaccgtccgcctcggcgacacggtcgaggccggccagctgatcggcgcggtcggcaattccggcaacagcagcatgccccacctgcatctgcaggccgaccgggccggagtgggcctccaactgcgcttcgcctgcatcaacggctcgctgtaccgcggtcgtcgcgtgcgcgccccgaagcggcggccatga

SEQ ID NO: 5246 - DNA, 1002 bp, Actinoplanes utahensis
atgaaccgactcgacaccttcctggcgcggatcagcgtgcgcgagcaccggctcatcggcatcgcgctgatgcgcatcgtcatcgggttcgcgaccatcctgtactgcctggctgactacgaccgtcgtgaattcctttggggaccgacgtcgtactactcggccggcgtcgcccgtaccgccttgccgcaccacgggttctcgctgttcctgctcagtgactcgcgggtgtggtttgagatcgtgttccacctagtcatcgtcgtctcactggcgttcatgatctttggtgggcgatcgttgaccatcgcgcaggcggtgctgctctggtcgctgcactggcgcaaccaggatgtcctcgagggcggcgacaacttggcccagatcgtgatcatcttcatgatcttcacggtgtccaacgcctacttcgcgcccggagcccgcaatcgccgggagcgcatgctcgcccgggaggcgccggtcctgcggaccgcggtgcacaacctggccgcgtacctcatggtgttccagatctgcgtcctctatttcatggctgggtactggaaggtgaccggcgagcagtggcaggacggcgtggccatgtactacatcagtcacgtgaccggcttcgcgctgtcatccacctatgcggcgttaatgagcaatgcgttcatcggcaccgccgtcacttacttcaccgtctttaccgagctcgcgttcccgttcgcggtgctatcggtgcgcggctgggtccgcaagacggtcatcctcgccatcgaggggatgcatctgggcattatggtattcatgggtctagtctgctttgggttgttgatgctgggcgctgacagcgtctgcctgcgcgacgacgactacaagaccatgtaccggtacgcgctgaggctgcgtgacgcgaccctagcccgttatcgccggcgcttcactgcgccggtgccctcagcggtcgtcgccatggaggaggacacgcgtgtcgccgcatga

SEQ ID NO: 5247 - DNA, 663 bp, Actinoplanes utahensis
atgtccccacgcgaagccctacccgtgcgcatccgggtcgccgtgccgctgctactgctggtggtggcgctgttcaccgcggccacgctgatctacaacgcgccggcctcaccggcccgcaaccgtctcgacttcgtgcccaaactcctacagccctacttctggcaggactggcagctgttcggccccaacccgccggtcaccaacaacctcatctacctggaggtgcggctgcgcgacgcaaccgggcaggtaaccgagagcgcgccggccgagattgagcaggccatcgaccggcagccgcgcagcttccggaccaatccgaccaagacccccggcatcatgctggccttcaacgcgtcggccaacaacttcgcccgggccgcgagcgcgatcgccaagatgccggccgatcagcaggccgacgcccgcaagaagctgttcgacgagtacgccaacttctttgtcgagatgcagcggttcttctccgccagcgccgacgggctctacccgggccgggacatcgtcgcggtgcgggctcggttccgtacgcgatcgatcgtgccgttctcgcagcgctaccaagacccaccgccggcacaacccgagaaggaactgctcgacacgagctggctcacctacataccggggatagcacgatga

SEQ ID NO: 5248 - DNA, 1779 bp, Actinoplanes utahensis
gtgcgggcgattgcattgttggccgcggcggcggcaatagtgatgtcggtaggaaatacttttccggccgctgccgaaacagcgggaagcgcggtcgcccgcctctatatcgacgtacgcgatcagaatgatcttgattctctggcacgggcagtcaccgatccgcggtcgccgtcgtaccgccatttcctgtcgcccgccgattaccgacggcgattcgcgctcaccgatgcgcagcaccgcgacctgctgactcggctggccgccgacggcatccgggtgaccggcgagacctcgcactacctgcggatcaccggcccggccgcggcagtcgcccgggtggcgggcgccagcgctgcggcccattcactgtccaccccggtcagcgcggctgccgacgctgccgcgaggctggccgggccacaggcccgggtgcgagagaaggcggatgctgacgagccggccaagtgctcctcctggctcggcgagtcaccggcggccgacatgccacccgcgtacggcagcatttcgtcctacgccacctgcccgtaccgcccggaccagctgcgcaaggcttaccacgtcacgaccaccggccgcggcaggaccgtggccatcgtcggcgcctacggctcgcccaccatgcgcgccgacgccgaccgatttgccaccgctgtcggcgacaagccgttccggcccggccagtaccgcgaggacgtcgacccgaacgcgtggaacctcaccccggactgtgcgccacctgctgattgggccggtgagcaggctttggacgtggagaccgtgcacggctacgcgccggacgccgccgtccgctacgtcggggccaactcgtgcctcgacgaagacctgatggacgccgagagctcgatcatcgacaaccgctcggccgacctgatcaccaactcgtgggccgagatcatccatgccgatcccggccacctcacgcccgacctcgtggcggcctggaaccggctgttcgagcaagcggccgtcgagggcatcggcgtctacttcgcctccggtgactgcggcgacgcctcgccgggtgccgcccacgcaggactgaactgcgacccggccacaaccgcggcccaggccgagtggccggccgcctcgccgtgggtgacggcggtcggcgggacggcgctaggcaccgatgcacacggccggtacgcctgggagacgagcatgggcgacgacctctcaatccgttcggcggacggcacggcctggacgccgctgcccggggtcttcgtcttcggaggcggcggcgggccgggcgacgcccctcagccgtggtaccagcgtggcgtggtgccggctgcgctcgctgcggccgggggtcaggcccgccgcgtcacccccgacgtcgcgctggagggcgacttcgccgtgccagtgctggtcggctataccctcggcgggacgttccagctgatcgggtacgccggcacgtcggcggccagccccgggttcgcggccatccaggccggcgccgagcaggtatcggggcgcacgatcgggttcgccaacccgctgctgtaccggctgtcccgggctggtgtcctgcacgacgtgaccgagccgaccgcaccggtgacggcggtgcgcgatctcggcgccgaccagggcgatctgcgatacgtcctgttcactctgggccaggactacggcctgtcggccaccaccgggtacgacgccgctaccggcttaggctcacccggtcccgcgtacctctcctggttccgaaggcactga

SEQ ID NO: 5249 - DNA, 336 bp, Actinoplanes utahensis
atgtccatcaaaaggtttgtcgccctgggcgtagccgtaccgacatttctgacggcctcgctcgtgggattggaccaggcggccatggcgtcgcccgcacccgaggctgtcaagcccgcctcggtcgccccgatcgtcgctttcaacggttcggccgatccgcagttctggggtgccgtcgcccaggccgccgccaacgcggccgccggggcggtggcggccgcggtggtggcggcggcactggctccgaagtcgtccagctccagctccggcggcccagccaccggcacggccgcggatcgatccggcgacgcgcagttcgacgtggccagctga

SEQ ID NO: 5250 - DNA, 894 bp, Actinoplanes utahensis
gtggccaccttagcggtgacgaggcggcatgacctgaccgaccggcagtgggccgtgctggccccgcttcttcctgccgcgtccacgacaggtcgtccgccgaagtgggacaaacggcagctcatcgacgggatccggtggcgaatccggatgggcaccccgtggcgtgacgtccctgccgtctacccgccctggcagacggtctacggcctgttccgccgctggcagcgcgacggcacctgggaccggatcctcgcggcattgcaggccgccgccgataccaacggcaggatcatctggacggtcagcgtcgactcgatgaccagccgcgcccatcagcacgccgccggcgctcgcaccaacggccacctgcagaaagagccacccggcggcgtccacgacgaacccgccgaccacgcactcggccgttcccacggcggtttgaccaccaagacgcacctggcctgcgaacagggccagaaggtgttgtcgatggtcgtgaccgccgggcatcgcggcgacagcccccagttcatcccggtcctgcgccgcatcagggtcacccgcctcggtgtcggccggccccgcacctgtcccgacctggtcctggccgacaaggcctacacgagccgagccaaccgtgcctacctgcgcaaacgagggatcaaggcctgcatccccagcaagaaggaccaggacgcccaccgcaaggccaaaggatcccgcggcggacgcccgccgaagttcgacaaggccctctaccgcatgcgtcacgccgtcgagaacagcatcgcccgactcaagcgctaccggggcatcgccacccgctacgaaaagctggcagtccgcttccaagccgccctaaccatcgtgatcatcggcgagtggctatga

SEQ ID NO: 5251 - DNA, 222 bp, Actinoplanes utahensis
atgaccgtcaccgtcaccgacatgcacatcccggcccagcgcgatccgggccacgaccagatggtcaccccggaatcggcgcgggtggctgagctgcaggagatgattcggtccggccagtacgccggctacctggacgaactcacggatgcgctggcgaaagcgaaagcggcccgtgacgagatccgacagctcaccgcgaccagcgcgctgggggcgtga

SEQ ID NO: 5252 - DNA, 405 bp, Actinoplanes utahensis
atgagcttccacccgcccgccgacggacgctgggccatgcagccccgcctcttccgcatcggtaacacgaccctgctggacgacgatccgaacccgtggaccgtcaaagccgttaccgccaacttcgctgtgctcacccgactggacgatcccgagtgggaaaacggcgacgatgacccggaagacggtccgaccagcaacgactgcgacgtcctctataccgtcctggactgccgtaacggctaccgcggcccgtgcaacctgtccggctggggctacggcgacggtacctacagcgaggccgactgcgctgcgatgctggccgacttcgaggctggcgacctggagatcagccatcgaaattggacgcgcattaggtttgcagacgaggcggccgtccgatga

SEQ ID NO: 5253 - DNA, 258 bp, Actinoplanes utahensis
gtgaccacgctccgcgatgacctggccgtgctcatccgcgaagccgacaaggacaacgaactgagcccgtaccagcttgcttcctcgatcagcgaattcctcctcgaccgcggcctggtcacgcccgtgcaggcacacgcggtgtcggacttcgctgaggaacagaaccgcggcgccggctaccggcacccgaaaccggtcggcccggaagccctggccgccgtgatcgtcgaccgtttcaaccttgaggagaactga

SEQ ID NO: 5254 - DNA, 228 bp, Actinoplanes utahensis
atgtccttgattggagggcgcatccgcgacttgatctatgtcgaaaaggagcacgtcaacttggatgaggcggctgcgattgctcgggtgctgcggtgcaccggcaagtacggcgccggccggcccgaggtgcgtaccgatgagatggtaaccgacgtactcgccgtgatgcaggtgctggcagggccggacggcgacaacgcccgttacctcagccggagcgcctga

SEQ ID NO: 5255 - DNA, 480 bp, Actinoplanes utahensis
atgaccaccatggaggacctgtatccggacggccacggctaccacgatgcgcacggcccgtacatcgacgccgtggccaaagcactcgacgaggccggcttcaaaaccgacatctcgtggtcggacccaaacgatccgcgagacggctggatcggcttcgacatggaacagcagccccaccgaaacggcgagccggtctggtcctacgacgaagtcggtatcggctggtccgaaaatcgcggctggcacctgctgtgtatcgacgaccgcaacggccgggactcccggtacgtgttcgagctcgctatcgcccggctggcgtcaccggagacggtggcgaacgcggtcgcggagcaggcaggcatcgacgcgcacgttgcgagcgacgactacccggacgtcgacttcccggagcacaccttcgaggacgacgacatcccgttcgaccaggcgctggcccaataccgggagccggcgtga

SEQ ID NO: 5256 - DNA, 159 bp, Actinoplanes utahensis
atgcccgacacggacctgaccgcccgcctgcaccgcctgctccacctgtaccgggccctgcccgacgaccggatagttctcgccgcgatcgtcggcgacgacgcagacaccctcaccctcggcgacctgcgcgagctggcccgactggtaggcgcctga

SEQ ID NO: 5257 - DNA, 159 bp, Actinoplanes utahensis
gtggaaagggctggcttcaccatgaacacgttcttccgggccgtgctgcgctgggtccgcaacgatccgcgccggctcgcccagttcaaagctctgatggtcgaagtggatgccgagacgccacgtggccggccaaaaaagaacgccccgcaggagtag

SEQ ID NO: 5258 - DNA, 510 bp, Actinoplanes utahensis
atgaccttccgaaacacctacgttgcgccgatgaccaccagcgccagctcagtcatcaccgccatcaacacccgacggccgggcctgaagcccgcaaaacagcacatgctgatgttctttatgcagggccaccaccttgcctggcgcgaccgggccctgttcgacgagcccatgcacgccaccgaacgagccgttgagatcgacgccagcgcggacagcgctgagcctcagatcacggacgaagcagccctgaacaccatcgggtacgtcatcgcccggtacagcgcactgtcaccagccgacctacgcaccctcatccaggcatcgcagccgtggcagacagccaccaaaccgggctccgaatcccgcatcgagtgggcgcacctgcgcgactggttccagcgcccggacgagaccgacgacccggacgatgagcgacccaaccgtgccgaggtcgccgcagccgaggcctacctgacgtctcgcgcccggaagctggcagcagtctga

SEQ ID NO: 5259 - DNA, 183 bp, Actinoplanes utahensis
atggctgacctgcccgccgacctgctggtgatcgtgcaccacgacgacagcgtcacccggtacgagcaggtcacatactgcccgtggcctggcggggtcaccgtgtaccggaatggtgagcagatcgccgagcacaacgacgtgatcggccagcatgccgaacgtgcagcggtaccggcctga

SEQ ID NO: 5260 - DNA, 213 bp, Actinoplanes utahensis
atgtgtcaaaacccgctgtgccagtacacgagcgaagccgtccacgagctccgggtcgccggcaccaagatggtccggctggtgtgcgcggaccgtagctgcaccttctgggcgtccggtgagctgtgcaaggacgtgccgaacgcggtgatcgaacgggacgaactgcatccggtcgacgccggcggcgtccacatctacgacgacttctga

SEQ ID NO: 5261 - DNA, 441 bp, Actinoplanes utahensis
ttgcccggtggcggccgggcatggcccggtgaccgcctacgatccgggcaggtccataggcggcgagcgttgcagccgcatcgtgtcgaacgagatgatcgatgcccaccccgactggtccgatcagcagatcgccgaccgactcaaccgccggttcgacaatccggtgatcacggtcgacgaggtggcgcactggcgttccgagcgggcgacggcatgagcgcttacgccaacgacccgcgggtgaacgatgtgaccggccgcggcacgctgttcctcgtcgccgacaagccggacggtgagccggtcgcccgggtacgtccgttcattgacggcgcgacctgggtggcgtggccggtcgacgagaacctcatgactgagctgccggagttcgggaccgccgatgaggccatcaggtctgtgatcggggacccgcagtga

SEQ ID NO: 5262 - DNA, 189 bp, Actinoplanes utahensis
gtgagcatcgactacacgggcgaggtggtcggccgggatccggtcggcaagacgatcgtcgaggcgctggtttcctcgcaccccgactggtcggaccagcaggtcacggaccggattaaccgggaatacgacgagccggtcatcaccgtggctgaggttgcccggtggcggccgggcatggcccggtga

SEQ ID NO: 5263 - DNA, 264 bp, Actinoplanes utahensis
gtgaccgcccgtatccttacgctcaagcccagccagatgcagcggcttcggcagcagcagcacgtctggtgggacgacagcaccggccgcgaggtactcgtccgcaccgaccccggcggcagggttgatacctacccgggcgcgctggtcctgaccctaacccccgccgacctggacctgatcgagacaccggacggcctggtatgcgccgatgagacccgcactaccggctggacggtttgcatggccgaggtgcaggcgtga

SEQ ID NO: 5264 - DNA, 276 bp, Actinoplanes utahensis
atgacggcagcgtttacgccgtgtcggtgtgggcctgaccggccccgaaaggacaccatgatccgcatcagactggttgacggccgcaccgtcgaaaccaacacctacaccctcgaccaggcctacaagctcatggccgatggtcatccgctgcagatcggcggccccgaagactgcgagctgcagccagtcttcgccgacgacccgcagggcgagaacccgcgccaggccatcaacgccgcggcgatcgtcagcatcgaggaggacggcgcgtga

SEQ ID NO: 5265 - DNA, 258 bp, Actinoplanes utahensis
atgcagcacattcacaccaacgcggcggaacttatgtctgcccgcaacggcaccaccacgttcatgaccgtcgcggacggcacctacagcaacaaggtggcgttcgacgtcaagggcggcgaaatggcgccgaccgatggcctgccccgcgtggtcctgacacccgaccagttccagaagatcaccgccaaggacagccgcgactaccaggtcaccgccgatgacggcagcgtttacgccgtgtcggtgtgggcctga
